United States Patent 7,888,497 (BIOINFORMATICALLY DETECTABLE GROUP OF NOVEL REGULATORY OLIGONUCLEOTIDES AND USES THEREOF) - sequence listing, part 16

SEQ ID NO: 637691 - DNA, 21 bp, Homo sapiens
cagcccatgctggctggggcc

SEQ ID NO: 637692 - DNA, 18 bp, Homo sapiens
cagcccccacccatgcca

SEQ ID NO: 637693 - DNA, 20 bp, Homo sapiens
cagcccccacccatgccagc

SEQ ID NO: 637694 - DNA, 16 bp, Homo sapiens
cagcccccacccccgt

SEQ ID NO: 637695 - DNA, 17 bp, Homo sapiens
cagcccccacccccgtc

SEQ ID NO: 637696 - DNA, 12 bp, Homo sapiens
cagcccccacgc

SEQ ID NO: 637697 - DNA, 21 bp, Homo sapiens
cagccccgcgaccacccctgt

SEQ ID NO: 637698 - DNA, 17 bp, Homo sapiens
cagcccctgctggacca

SEQ ID NO: 637699 - DNA, 13 bp, Homo sapiens
cagccctccgcca

SEQ ID NO: 637700 - DNA, 23 bp, Homo sapiens
cagccctccgccagccctgttcc

SEQ ID NO: 637701 - DNA, 17 bp, Homo sapiens
cagccctgcacgcccag

SEQ ID NO: 637702 - DNA, 13 bp, Homo sapiens
cagggagggggct

SEQ ID NO: 637703 - DNA, 17 bp, Homo sapiens
cagggagggggctggga

SEQ ID NO: 637704 - DNA, 19 bp, Homo sapiens
cagggaggtggcagggaag

SEQ ID NO: 637705 - DNA, 19 bp, Homo sapiens
cagggatgctatctcgcta

SEQ ID NO: 637706 - DNA, 11 bp, Homo sapiens
cagggcaagct

SEQ ID NO: 637707 - DNA, 17 bp, Homo sapiens
cagggcaatcaatgttc

SEQ ID NO: 637708 - DNA, 13 bp, Homo sapiens
cagggcagaggaa

SEQ ID NO: 637709 - DNA, 16 bp, Homo sapiens
cagggccagtcatggc

SEQ ID NO: 637710 - DNA, 16 bp, Homo sapiens
cagggcccagggaggt

SEQ ID NO: 637711 - DNA, 15 bp, Homo sapiens
cagggcccccacagg

SEQ ID NO: 637712 - DNA, 17 bp, Homo sapiens
cagggcccccacaggag

SEQ ID NO: 637713 - DNA, 15 bp, Homo sapiens
cagggcccccatgca

SEQ ID NO: 637714 - DNA, 18 bp, Homo sapiens
cagggcccccatgcaggc

SEQ ID NO: 637715 - DNA, 21 bp, Homo sapiens
cagggccctggggtctctgag

SEQ ID NO: 637716 - DNA, 22 bp, Homo sapiens
cagggccctggggtctctgagc

SEQ ID NO: 637717 - DNA, 17 bp, Homo sapiens
cagggccgcagggcgct

SEQ ID NO: 637718 - DNA, 23 bp, Homo sapiens
cagggccgccgaagggcagcccc

SEQ ID NO: 637719 - DNA, 13 bp, Homo sapiens
caggggaggctga

SEQ ID NO: 637720 - DNA, 20 bp, Homo sapiens
caggggcaaagaactgcccc

SEQ ID NO: 637721 - DNA, 17 bp, Homo sapiens
caggggcactgtgttct

SEQ ID NO: 637722 - DNA, 16 bp, Homo sapiens
caggggcaggcagcta

SEQ ID NO: 637723 - DNA, 21 bp, Homo sapiens
caggggcttctccccctcagc

SEQ ID NO: 637724 - DNA, 23 bp, Homo sapiens
caggggggttgggttccagacag

SEQ ID NO: 637725 - DNA, 15 bp, Homo sapiens
cagggtgagaagcta

SEQ ID NO: 637726 - DNA, 16 bp, Homo sapiens
cagggtggggcttaga

SEQ ID NO: 637727 - DNA, 17 bp, Homo sapiens
cagggttctagaagggg

SEQ ID NO: 637728 - DNA, 16 bp, Homo sapiens
caggtctggcgccagg

SEQ ID NO: 637729 - DNA, 17 bp, Homo sapiens
caggtgaccagaatgag

SEQ ID NO: 637730 - DNA, 13 bp, Homo sapiens
caggtgccccacc

SEQ ID NO: 637731 - DNA, 15 bp, Homo sapiens
cagtaaatatacact

SEQ ID NO: 637732 - DNA, 17 bp, Homo sapiens
cagtaaatgtatattga

SEQ ID NO: 637733 - DNA, 14 bp, Homo sapiens
cagtaactgccatt

SEQ ID NO: 637734 - DNA, 21 bp, Homo sapiens
cagtaagataggttctgcttt

SEQ ID NO: 637735 - DNA, 14 bp, Homo sapiens
cagtacaattcttt

SEQ ID NO: 637736 - DNA, 17 bp, Homo sapiens
cagtacaattctttgtt

SEQ ID NO: 637737 - DNA, 21 bp, Homo sapiens
cagtacaattctttgttgctt

SEQ ID NO: 637738 - DNA, 23 bp, Homo sapiens
cagtacaattctttgttgcttaa

SEQ ID NO: 637739 - DNA, 24 bp, Homo sapiens
cagtagagggtccagtcttctagt

SEQ ID NO: 637740 - DNA, 19 bp, Homo sapiens
cagtagcatactgatgaga

SEQ ID NO: 637741 - DNA, 23 bp, Homo sapiens
cagtagcattttaatagtttcta

SEQ ID NO: 637742 - DNA, 15 bp, Homo sapiens
cagtagtgcctgtga

SEQ ID NO: 637743 - DNA, 15 bp, Homo sapiens
cagtatcttaaaatt

SEQ ID NO: 637744 - DNA, 19 bp, Homo sapiens
cagtatgctttccctgagg

SEQ ID NO: 637745 - DNA, 18 bp, Homo sapiens
cagtattctgtagccaac

SEQ ID NO: 637746 - DNA, 19 bp, Homo sapiens
cagtattctgtagccaact

SEQ ID NO: 637747 - DNA, 21 bp, Homo sapiens
cagtattgacgacctacatct

SEQ ID NO: 637748 - DNA, 22 bp, Homo sapiens
cagtattgacgacctacatctg

SEQ ID NO: 637749 - DNA, 23 bp, Homo sapiens
cagtattgacgacctacatctga

SEQ ID NO: 637750 - DNA, 13 bp, Homo sapiens
cagtattgagaca

SEQ ID NO: 637751 - DNA, 20 bp, Homo sapiens
cagtattgagacactgtcaa

SEQ ID NO: 637752 - DNA, 13 bp, Homo sapiens
cagtattgttctt

SEQ ID NO: 637753 - DNA, 22 bp, Homo sapiens
cagtattgttcttgtaaaactg

SEQ ID NO: 637754 - DNA, 16 bp, Homo sapiens
cagtcagcacagagag

SEQ ID NO: 637755 - DNA, 15 bp, Homo sapiens
cagtcagtattgttt

SEQ ID NO: 637756 - DNA, 20 bp, Homo sapiens
cagtccacccccattgtgaa

SEQ ID NO: 637757 - DNA, 20 bp, Homo sapiens
cagtccatttttgagtaaaa

SEQ ID NO: 637758 - DNA, 16 bp, Homo sapiens
cagtccctggagctgt

SEQ ID NO: 637759 - DNA, 19 bp, Homo sapiens
cagtcctcacagcctctcc

SEQ ID NO: 637760 - DNA, 17 bp, Homo sapiens
cagtctaatttttattc

SEQ ID NO: 637761 - DNA, 14 bp, Homo sapiens
cagtctatgctgtg

SEQ ID NO: 637762 - DNA, 21 bp, Homo sapiens
cagtctctatttgatttgcaa

SEQ ID NO: 637763 - DNA, 15 bp, Homo sapiens
cagtctgttcagagg

SEQ ID NO: 637764 - DNA, 20 bp, Homo sapiens
cagtcttgagtgggccccct

SEQ ID NO: 637765 - DNA, 22 bp, Homo sapiens
cagtcttgagtgggccccctct

SEQ ID NO: 637766 - DNA, 23 bp, Homo sapiens
cagtcttgagtgggccccctctc

SEQ ID NO: 637767 - DNA, 13 bp, Homo sapiens
cagtgaacagctt

SEQ ID NO: 637768 - DNA, 13 bp, Homo sapiens
cagtgaataaata

SEQ ID NO: 637769 - DNA, 16 bp, Homo sapiens
cagtgactgtggatac

SEQ ID NO: 637770 - DNA, 18 bp, Homo sapiens
cagtgagtcagaggcaga

SEQ ID NO: 637771 - DNA, 20 bp, Homo sapiens
cagtgcagcaaccagagcac

SEQ ID NO: 637772 - DNA, 23 bp, Homo sapiens
cagtgcagcaaccagagcactgt

SEQ ID NO: 637773 - DNA, 15 bp, Homo sapiens
cagtgcagggacagc

SEQ ID NO: 637774 - DNA, 14 bp, Homo sapiens
cagtgccccagtgg

SEQ ID NO: 637775 - DNA, 16 bp, Homo sapiens
cagtgccgcctgtgcc

SEQ ID NO: 637776 - DNA, 11 bp, Homo sapiens
cagtgcctgct

SEQ ID NO: 637777 - DNA, 14 bp, Homo sapiens
cagtgcctgctgtt

SEQ ID NO: 637778 - DNA, 16 bp, Homo sapiens
cagtgccttatggaac

SEQ ID NO: 637779 - DNA, 19 bp, Homo sapiens
cagtgccttatggaacact

SEQ ID NO: 637780 - DNA, 20 bp, Homo sapiens
cagtgccttatggaacactc

SEQ ID NO: 637781 - DNA, 22 bp, Homo sapiens
cagtgccttatggaacactctg

SEQ ID NO: 637782 - DNA, 13 bp, Homo sapiens
cagtgccttggag

SEQ ID NO: 637783 - DNA, 14 bp, Homo sapiens
cagtggagagggga

SEQ ID NO: 637784 - DNA, 17 bp, Homo sapiens
cagtggagaggggactt

SEQ ID NO: 637785 - DNA, 18 bp, Homo sapiens
cagtggagaggggacttg

SEQ ID NO: 637786 - DNA, 20 bp, Homo sapiens
cagtggctgggggactgctt

SEQ ID NO: 637787 - DNA, 21 bp, Homo sapiens
cagtggctgggggactgcttt

SEQ ID NO: 637788 - DNA, 22 bp, Homo sapiens
cagtggctgggggactgctttc

SEQ ID NO: 637789 - DNA, 18 bp, Homo sapiens
cagtgggcggcttccctg

SEQ ID NO: 637790 - DNA, 15 bp, Homo sapiens
cagtggggcccatgg

SEQ ID NO: 637791 - DNA, 18 bp, Homo sapiens
cacctggtggccctgcgg

SEQ ID NO: 637792 - DNA, 18 bp, Homo sapiens
caccttacaaagccagct

SEQ ID NO: 637793 - DNA, 19 bp, Homo sapiens
caccttacaaagccagctc

SEQ ID NO: 637794 - DNA, 16 bp, Homo sapiens
caccttagcagctctt

SEQ ID NO: 637795 - DNA, 23 bp, Homo sapiens
caccttctgtgcatctggcctgg

SEQ ID NO: 637796 - DNA, 14 bp, Homo sapiens
cacgaagaaataga

SEQ ID NO: 637797 - DNA, 16 bp, Homo sapiens
cacgaatattgctgat

SEQ ID NO: 637798 - DNA, 13 bp, Homo sapiens
cacgaggagcttc

SEQ ID NO: 637799 - DNA, 17 bp, Homo sapiens
cacgaggagcttccagt

SEQ ID NO: 637800 - DNA, 15 bp, Homo sapiens
cacgcaacttgaaat

SEQ ID NO: 637801 - DNA, 14 bp, Homo sapiens
cacgcagagccccg

SEQ ID NO: 637802 - DNA, 22 bp, Homo sapiens
cacgccggggctggccctgccc

SEQ ID NO: 637803 - DNA, 14 bp, Homo sapiens
cacgcggctgctgc

SEQ ID NO: 637804 - DNA, 15 bp, Homo sapiens
cacgcggctgctgct

SEQ ID NO: 637805 - DNA, 21 bp, Homo sapiens
cacggaggctcgtgcatgtaa

SEQ ID NO: 637806 - DNA, 16 bp, Homo sapiens
cacggagtttccattt

SEQ ID NO: 637807 - DNA, 19 bp, Homo sapiens
cacggcagcttgagcctgt

SEQ ID NO: 637808 - DNA, 13 bp, Homo sapiens
cacgggagagcgc

SEQ ID NO: 637809 - DNA, 16 bp, Homo sapiens
cacgggagagcgccac

SEQ ID NO: 637810 - DNA, 12 bp, Homo sapiens
cacgggcccgct

SEQ ID NO: 637811 - DNA, 20 bp, Homo sapiens
cacgggcccgctcaacctct

SEQ ID NO: 637812 - DNA, 19 bp, Homo sapiens
cacggggtcgggggaggag

SEQ ID NO: 637813 - DNA, 21 bp, Homo sapiens
cacggtccaatccagccttct

SEQ ID NO: 637814 - DNA, 19 bp, Homo sapiens
cacgtgactcctcaattcc

SEQ ID NO: 637815 - DNA, 20 bp, Homo sapiens
cacgtgaggcccctgtgcag

SEQ ID NO: 637816 - DNA, 17 bp, Homo sapiens
cacgtgcagcacctgtc

SEQ ID NO: 637817 - DNA, 18 bp, Homo sapiens
cacgtgcagcacctgtca

SEQ ID NO: 637818 - DNA, 15 bp, Homo sapiens
cacgtgtgcagactg

SEQ ID NO: 637819 - DNA, 18 bp, Homo sapiens
cacgtgtttcgggccagg

SEQ ID NO: 637820 - DNA, 20 bp, Homo sapiens
cacgtgtttcgggccagggc

SEQ ID NO: 637821 - DNA, 22 bp, Homo sapiens
cactaatggccaagtgtacatt

SEQ ID NO: 637822 - DNA, 16 bp, Homo sapiens
cactagccctctttct

SEQ ID NO: 637823 - DNA, 22 bp, Homo sapiens
cactagccctctttctctctgt

SEQ ID NO: 637824 - DNA, 23 bp, Homo sapiens
cactagccctctttctctctgtg

SEQ ID NO: 637825 - DNA, 22 bp, Homo sapiens
cactatctttcaggaaattttt

SEQ ID NO: 637826 - DNA, 15 bp, Homo sapiens
cactcagcagccccc

SEQ ID NO: 637827 - DNA, 18 bp, Homo sapiens
cactcaggagcacagcca

SEQ ID NO: 637828 - DNA, 13 bp, Homo sapiens
cactccactcccc

SEQ ID NO: 637829 - DNA, 16 bp, Homo sapiens
cactcccctcatccac

SEQ ID NO: 637830 - DNA, 17 bp, Homo sapiens
cactctcttcttactgt

SEQ ID NO: 637831 - DNA, 13 bp, Homo sapiens
cactgagcagagt

SEQ ID NO: 637832 - DNA, 12 bp, Homo sapiens
cactgagctggg

SEQ ID NO: 637833 - DNA, 13 bp, Homo sapiens
cactgagctgggc

SEQ ID NO: 637834 - DNA, 13 bp, Homo sapiens
cactgagtgaaat

SEQ ID NO: 637835 - DNA, 16 bp, Homo sapiens
cactgagtgaaatatt

SEQ ID NO: 637836 - DNA, 22 bp, Homo sapiens
cactgatatcacgggcccgctc

SEQ ID NO: 637837 - DNA, 20 bp, Homo sapiens
cactgatgggtcctgctgct

SEQ ID NO: 637838 - DNA, 21 bp, Homo sapiens
cactgatgggtcctgctgctc

SEQ ID NO: 637839 - DNA, 17 bp, Homo sapiens
cactgcaccctccacag

SEQ ID NO: 637840 - DNA, 18 bp, Homo sapiens
cactgcagttatttacca

SEQ ID NO: 637841 - DNA, 19 bp, Homo sapiens
cactgcagttatttaccag

SEQ ID NO: 637842 - DNA, 14 bp, Homo sapiens
cactgccctccgcc

SEQ ID NO: 637843 - DNA, 18 bp, Homo sapiens
cactgccctctgccactg

SEQ ID NO: 637844 - DNA, 23 bp, Homo sapiens
cactgccctctgccactgacagg

SEQ ID NO: 637845 - DNA, 21 bp, Homo sapiens
cactgctacaccttagcagct

SEQ ID NO: 637846 - DNA, 19 bp, Homo sapiens
cactgggtgtggcctggct

SEQ ID NO: 637847 - DNA, 22 bp, Homo sapiens
cactgtataccccgtgaagcat

SEQ ID NO: 637848 - DNA, 17 bp, Homo sapiens
cactgtcaagattaagt

SEQ ID NO: 637849 - DNA, 15 bp, Homo sapiens
cactgtcaggaatgg

SEQ ID NO: 637850 - DNA, 19 bp, Homo sapiens
cactgtcccggagctcagg

SEQ ID NO: 637851 - DNA, 16 bp, Homo sapiens
cactgtgacctgctcc

SEQ ID NO: 637852 - DNA, 22 bp, Homo sapiens
cactgtgacctgctcctgccca

SEQ ID NO: 637853 - DNA, 23 bp, Homo sapiens
cactgtgacctgctcctgcccac

SEQ ID NO: 637854 - DNA, 17 bp, Homo sapiens
ataccagcaaaagtgca

SEQ ID NO: 637855 - DNA, 16 bp, Homo sapiens
ataccattttgaaata

SEQ ID NO: 637856 - DNA, 18 bp, Homo sapiens
ataccctaggtctccacc

SEQ ID NO: 637857 - DNA, 13 bp, Homo sapiens
ataccctctgaga

SEQ ID NO: 637858 - DNA, 14 bp, Homo sapiens
atacccttttccaa

SEQ ID NO: 637859 - DNA, 22 bp, Homo sapiens
atacctattcaagaagatagtt

SEQ ID NO: 637860 - DNA, 17 bp, Homo sapiens
atacctgtacacacaca

SEQ ID NO: 637861 - DNA, 14 bp, Homo sapiens
ataccttctgatga

SEQ ID NO: 637862 - DNA, 22 bp, Homo sapiens
ataccttctgatgaagttgtac

SEQ ID NO: 637863 - DNA, 17 bp, Homo sapiens
atacgcaattgtatata

SEQ ID NO: 637864 - DNA, 22 bp, Homo sapiens
atacgcaattgtatatatatgt

SEQ ID NO: 637865 - DNA, 22 bp, Homo sapiens
atacgggggttccctttcccca

SEQ ID NO: 637866 - DNA, 17 bp, Homo sapiens
atacgttgatagtttac

SEQ ID NO: 637867 - DNA, 15 bp, Homo sapiens
atactcatccttgta

SEQ ID NO: 637868 - DNA, 13 bp, Homo sapiens
atactcatttgga

SEQ ID NO: 637869 - DNA, 14 bp, Homo sapiens
atactcatttggat

SEQ ID NO: 637870 - DNA, 22 bp, Homo sapiens
atactcatttggatataaatct

SEQ ID NO: 637871 - DNA, 14 bp, Homo sapiens
atactgatgagaca

SEQ ID NO: 637872 - DNA, 17 bp, Homo sapiens
atactgatgagacaaca

SEQ ID NO: 637873 - DNA, 18 bp, Homo sapiens
atactgatgagacaacac

SEQ ID NO: 637874 - DNA, 18 bp, Homo sapiens
atactgttgcccttttcc

SEQ ID NO: 637875 - DNA, 14 bp, Homo sapiens
atacttattatgta

SEQ ID NO: 637876 - DNA, 12 bp, Homo sapiens
atacttcaaatg

SEQ ID NO: 637877 - DNA, 14 bp, Homo sapiens
atacttcaaatgtc

SEQ ID NO: 637878 - DNA, 23 bp, Homo sapiens
cactgttcccagcaaagttttca

SEQ ID NO: 637879 - DNA, 13 bp, Homo sapiens
cacttaaaatcaa

SEQ ID NO: 637880 - DNA, 13 bp, Homo sapiens
cacttccttaaca

SEQ ID NO: 637881 - DNA, 19 bp, Homo sapiens
cacttccttaacagctgta

SEQ ID NO: 637882 - DNA, 17 bp, Homo sapiens
cacttctccttaacccc

SEQ ID NO: 637883 - DNA, 20 bp, Homo sapiens
cacttcttaaggacagtgtt

SEQ ID NO: 637884 - DNA, 20 bp, Homo sapiens
cacttgggctggcacccact

SEQ ID NO: 637885 - DNA, 17 bp, Homo sapiens
cactttcccacactgtg

SEQ ID NO: 637886 - DNA, 17 bp, Homo sapiens
cagaaaaagagcttccc

SEQ ID NO: 637887 - DNA, 20 bp, Homo sapiens
cagaaaaatgaaatttaagc

SEQ ID NO: 637888 - DNA, 21 bp, Homo sapiens
cagaaaaatgaaatttaagca

SEQ ID NO: 637889 - DNA, 12 bp, Homo sapiens
cagaaaacattg

SEQ ID NO: 637890 - DNA, 18 bp, Homo sapiens
cagaaaacattgttccag

SEQ ID NO: 637891 - DNA, 11 bp, Homo sapiens
cagaaaagcac

SEQ ID NO: 637892 - DNA, 12 bp, Homo sapiens
cagaaaattttt

SEQ ID NO: 637893 - DNA, 16 bp, Homo sapiens
cagaaaatttttgtct

SEQ ID NO: 637894 - DNA, 22 bp, Homo sapiens
cagaaagaggaataaaatgatt

SEQ ID NO: 637895 - DNA, 18 bp, Homo sapiens
cagaaatacatcatatgt

SEQ ID NO: 637896 - DNA, 18 bp, Homo sapiens
cagaaatgagtgataaat

SEQ ID NO: 637897 - DNA, 14 bp, Homo sapiens
cagaacaacaacaa

SEQ ID NO: 637898 - DNA, 15 bp, Homo sapiens
cagaacaacaacaaa

SEQ ID NO: 637899 - DNA, 16 bp, Homo sapiens
cagaaccaacgggtct

SEQ ID NO: 637900 - DNA, 13 bp, Homo sapiens
cagaaccagcact

SEQ ID NO: 637901 - DNA, 14 bp, Homo sapiens
cagaaccagcactc

SEQ ID NO: 637902 - DNA, 19 bp, Homo sapiens
cagaaccagcactcccagg

SEQ ID NO: 637903 - DNA, 15 bp, Homo sapiens
cagaacgggcctccc

SEQ ID NO: 637904 - DNA, 18 bp, Homo sapiens
cagaacgggcctccccgg

SEQ ID NO: 637905 - DNA, 16 bp, Homo sapiens
cagaactcctttctaa

SEQ ID NO: 637906 - DNA, 18 bp, Homo sapiens
cagaagaaaaacactgag

SEQ ID NO: 637907 - DNA, 17 bp, Homo sapiens
cagaagtgaaaaagact

SEQ ID NO: 637908 - DNA, 14 bp, Homo sapiens
cagaagtggaagga

SEQ ID NO: 637909 - DNA, 23 bp, Homo sapiens
cagaagtttaaatctttgttaaa

SEQ ID NO: 637910 - DNA, 16 bp, Homo sapiens
cagaatgagatgattt

SEQ ID NO: 637911 - DNA, 22 bp, Homo sapiens
cagaatgagatgatttaattct

SEQ ID NO: 637912 - DNA, 15 bp, Homo sapiens
cagaatgaggcacat

SEQ ID NO: 637913 - DNA, 19 bp, Homo sapiens
cagaatggtgggctccaga

SEQ ID NO: 637914 - DNA, 23 bp, Homo sapiens
cagaattgggcccttagaatgtg

SEQ ID NO: 637915 - DNA, 14 bp, Homo sapiens
cagacacacacata

SEQ ID NO: 637916 - DNA, 15 bp, Homo sapiens
cagacagacagacag

SEQ ID NO: 637917 - DNA, 16 bp, Homo sapiens
cagacagggcgtcctc

SEQ ID NO: 637918 - DNA, 11 bp, Homo sapiens
cagacattgtc

SEQ ID NO: 637919 - DNA, 15 bp, Homo sapiens
cagacattgttttgc

SEQ ID NO: 637920 - DNA, 20 bp, Homo sapiens
cagaccacactctgcctggc

SEQ ID NO: 637921 - DNA, 18 bp, Homo sapiens
cagaccggggtggagtca

SEQ ID NO: 637922 - DNA, 20 bp, Homo sapiens
cagacggacgggacagcggc

SEQ ID NO: 637923 - DNA, 21 bp, Homo sapiens
cagacggacgggacagcggcc

SEQ ID NO: 637924 - DNA, 23 bp, Homo sapiens
cagactctctcctctctctccct

SEQ ID NO: 637925 - DNA, 20 bp, Homo sapiens
tggccccctcgcgcccctgt

SEQ ID NO: 637926 - DNA, 18 bp, Homo sapiens
tggcccctccttctcccc

SEQ ID NO: 637927 - DNA, 23 bp, Homo sapiens
tggcccctccttctcccctccag

SEQ ID NO: 637928 - DNA, 14 bp, Homo sapiens
tggccctgcctcac

SEQ ID NO: 637929 - DNA, 23 bp, Homo sapiens
tggccctgcggggcggcatccga

SEQ ID NO: 637930 - DNA, 14 bp, Homo sapiens
tggccctggagcca

SEQ ID NO: 637931 - DNA, 15 bp, Homo sapiens
tggccctggagccag

SEQ ID NO: 637932 - DNA, 12 bp, Homo sapiens
tggccctgtggg

SEQ ID NO: 637933 - DNA, 19 bp, Homo sapiens
tggccctgtgggagtccac

SEQ ID NO: 637934 - DNA, 20 bp, Homo sapiens
tggccctgtgggagtccact

SEQ ID NO: 637935 - DNA, 13 bp, Homo sapiens
tggccggctggcc

SEQ ID NO: 637936 - DNA, 18 bp, Homo sapiens
tggccggtaggctgctgg

SEQ ID NO: 637937 - DNA, 19 bp, Homo sapiens
tggccggtaggctgctggc

SEQ ID NO: 637938 - DNA, 16 bp, Homo sapiens
tggcctaatccacctg

SEQ ID NO: 637939 - DNA, 23 bp, Homo sapiens
tggcctattttggacgtgtgagg

SEQ ID NO: 637940 - DNA, 13 bp, Homo sapiens
tggcctgggggct

SEQ ID NO: 637941 - DNA, 20 bp, Homo sapiens
tggccttggttcctccagca

SEQ ID NO: 637942 - DNA, 19 bp, Homo sapiens
tggcgccaggggcaggcag

SEQ ID NO: 637943 - DNA, 20 bp, Homo sapiens
tggcggcaggggttggcagc

SEQ ID NO: 637944 - DNA, 18 bp, Homo sapiens
tggcgggcagcccctgct

SEQ ID NO: 637945 - DNA, 22 bp, Homo sapiens
tggctatgttttggagagagca

SEQ ID NO: 637946 - DNA, 16 bp, Homo sapiens
tggctcccagcagagg

SEQ ID NO: 637947 - DNA, 19 bp, Homo sapiens
tggctcgtgtttcacagtg

SEQ ID NO: 637948 - DNA, 22 bp, Homo sapiens
tggctgaaataaaagcctctgg

SEQ ID NO: 637949 - DNA, 23 bp, Homo sapiens
tggctgaaataaaagcctctggt

SEQ ID NO: 637950 - DNA, 12 bp, Homo sapiens
tggctgaaatta

SEQ ID NO: 637951 - DNA, 21 bp, Homo sapiens
tggctgctcccagcctcttgc

SEQ ID NO: 637952 - DNA, 16 bp, Homo sapiens
tggctgcttcaaggat

SEQ ID NO: 637953 - DNA, 16 bp, Homo sapiens
tggctggagccccatc

SEQ ID NO: 637954 - DNA, 13 bp, Homo sapiens
tggctggggccgg

SEQ ID NO: 637955 - DNA, 17 bp, Homo sapiens
tggctggggccggggct

SEQ ID NO: 637956 - DNA, 17 bp, Homo sapiens
tggctgggggactgctt

SEQ ID NO: 637957 - DNA, 16 bp, Homo sapiens
tggctgggtcgcccct

SEQ ID NO: 637958 - DNA, 20 bp, Homo sapiens
tggctgggtcgcccctcctc

SEQ ID NO: 637959 - DNA, 18 bp, Homo sapiens
tggctgtggcccctcctt

SEQ ID NO: 637960 - DNA, 19 bp, Homo sapiens
tggctgttatctgtcttta

SEQ ID NO: 637961 - DNA, 14 bp, Homo sapiens
tggcttaaacattt

SEQ ID NO: 637962 - DNA, 18 bp, Homo sapiens
tggcttcttctttaggat

SEQ ID NO: 637963 - DNA, 16 bp, Homo sapiens
tggcttggcattgacc

SEQ ID NO: 637964 - DNA, 16 bp, Homo sapiens
tggcttgtagggtgag

SEQ ID NO: 637965 - DNA, 22 bp, Homo sapiens
tggctttccacatccccaccct

SEQ ID NO: 637966 - DNA, 13 bp, Homo sapiens
tggctttggcgcc

SEQ ID NO: 637967 - DNA, 23 bp, Homo sapiens
tgggaaattgctccattcctgag

SEQ ID NO: 637968 - DNA, 18 bp, Homo sapiens
tgggaacatgacccagcc

SEQ ID NO: 637969 - DNA, 22 bp, Homo sapiens
tgggaaggttagaaaggcagcc

SEQ ID NO: 637970 - DNA, 19 bp, Homo sapiens
tgggacaggcaccatgctg

SEQ ID NO: 637971 - DNA, 20 bp, Homo sapiens
tgggacggaagtggcctgag

SEQ ID NO: 637972 - DNA, 12 bp, Homo sapiens
tgggactggccc

SEQ ID NO: 637973 - DNA, 16 bp, Homo sapiens
tgggagactgagcttg

SEQ ID NO: 637974 - DNA, 18 bp, Homo sapiens
tgggagtccactttcctc

SEQ ID NO: 637975 - DNA, 21 bp, Homo sapiens
tgggagtccactttcctctct

SEQ ID NO: 637976 - DNA, 22 bp, Homo sapiens
tgggataggagggtgcccctgg

SEQ ID NO: 637977 - DNA, 16 bp, Homo sapiens
tgggatccagagagaa

SEQ ID NO: 637978 - DNA, 19 bp, Homo sapiens
tgggcaccacaggctgcct

SEQ ID NO: 637979 - DNA, 14 bp, Homo sapiens
tgggcaccctgcag

SEQ ID NO: 637980 - DNA, 15 bp, Homo sapiens
tgggcacgggagagc

SEQ ID NO: 637981 - DNA, 18 bp, Homo sapiens
tgggcagggccgcagggc

SEQ ID NO: 637982 - DNA, 20 bp, Homo sapiens
tgggcagggccgcagggcgc

SEQ ID NO: 637983 - DNA, 14 bp, Homo sapiens
tgggcagtggagag

SEQ ID NO: 637984 - DNA, 23 bp, Homo sapiens
tgggccaagccagggttccagac

SEQ ID NO: 637985 - DNA, 21 bp, Homo sapiens
tgggcccaggcccagcctctt

SEQ ID NO: 637986 - DNA, 18 bp, Homo sapiens
tgggccccctctcttacc

SEQ ID NO: 637987 - DNA, 16 bp, Homo sapiens
tgggcgcaaaggtgcc

SEQ ID NO: 637988 - DNA, 20 bp, Homo sapiens
tgggcgccggttccacgtgg

SEQ ID NO: 637989 - DNA, 13 bp, Homo sapiens
tgggcgtgacttc

SEQ ID NO: 637990 - DNA, 15 bp, Homo sapiens
tgggctcacaccggc

SEQ ID NO: 637991 - DNA, 21 bp, Homo sapiens
tgggctcacaccggcactgtg

SEQ ID NO: 637992 - DNA, 23 bp, Homo sapiens
tgggctcactacatgggccagcc

SEQ ID NO: 637993 - DNA, 12 bp, Homo sapiens
tgggctccagag

SEQ ID NO: 637994 - DNA, 13 bp, Homo sapiens
tgggctccagagt

SEQ ID NO: 637995 - DNA, 14 bp, Homo sapiens
tgggctccagagta

SEQ ID NO: 637996 - DNA, 14 bp, Homo sapiens
tgggctgctggggc

SEQ ID NO: 637997 - DNA, 19 bp, Homo sapiens
tgggctgctggggcagggc

SEQ ID NO: 637998 - DNA, 15 bp, Homo sapiens
tgggctggcacccac

SEQ ID NO: 637999 - DNA, 17 bp, Homo sapiens
tgggctggcacccactg

SEQ ID NO: 638000 - DNA, 19 bp, Homo sapiens
tgggctggcacccactgga

SEQ ID NO: 638001 - DNA, 13 bp, Homo sapiens
tggggacagggct

SEQ ID NO: 638002 - DNA, 15 bp, Homo sapiens
tggggaccaggagct

SEQ ID NO: 638003 - DNA, 17 bp, Homo sapiens
tggggaccaggagctag

SEQ ID NO: 638004 - DNA, 14 bp, Homo sapiens
tggggaggacccct

SEQ ID NO: 638005 - DNA, 15 bp, Homo sapiens
tggggagggtgggcg

SEQ ID NO: 638006 - DNA, 17 bp, Homo sapiens
tggggagggtgggcgtg

SEQ ID NO: 638007 - DNA, 16 bp, Homo sapiens
tggggcagggcccagg

SEQ ID NO: 638008 - DNA, 21 bp, Homo sapiens
tggggcagggcccagggaggt

SEQ ID NO: 638009 - DNA, 22 bp, Homo sapiens
tggggcatccaccttcctgccc

SEQ ID NO: 638010 - DNA, 13 bp, Homo sapiens
tggggccagcgct

SEQ ID NO: 638011 - DNA, 11 bp, Homo sapiens
tggggccagga

SEQ ID NO: 638012 - DNA, 16 bp, Homo sapiens
tggggcccatggcccc

SEQ ID NO: 638013 - DNA, 18 bp, Homo sapiens
tggggcccatggccccag

SEQ ID NO: 638014 - DNA, 19 bp, Homo sapiens
tggggcccatggccccagc

SEQ ID NO: 638015 - DNA, 13 bp, Homo sapiens
tggggcctgggct

SEQ ID NO: 638016 - DNA, 14 bp, Homo sapiens
tggggcctgggctg

SEQ ID NO: 638017 - DNA, 19 bp, Homo sapiens
tgggggacgcccagccccc

SEQ ID NO: 638018 - DNA, 22 bp, Homo sapiens
tgggggactgctttcagtgcct

SEQ ID NO: 638019 - DNA, 21 bp, Homo sapiens
tgggggaggtccctgccagtg

SEQ ID NO: 638020 - DNA, 13 bp, Homo sapiens
tggggtacaggca

SEQ ID NO: 638021 - DNA, 16 bp, Homo sapiens
tggggtcccccctgag

SEQ ID NO: 638022 - DNA, 16 bp, Homo sapiens
tggggtggggcttgga

SEQ ID NO: 638023 - DNA, 17 bp, Homo sapiens
tggggtggggcttggaa

SEQ ID NO: 638024 - DNA, 20 bp, Homo sapiens
tgggtaacctgaagttttat

SEQ ID NO: 638025 - DNA, 20 bp, Homo sapiens
tgggtaagggactccagaag

SEQ ID NO: 638026 - DNA, 23 bp, Homo sapiens
tgggtatctcaaatctgctttca

SEQ ID NO: 638027 - DNA, 12 bp, Homo sapiens
tgggtccaggag

SEQ ID NO: 638028 - DNA, 14 bp, Homo sapiens
tgggtccccctcct

SEQ ID NO: 638029 - DNA, 23 bp, Homo sapiens
tgggtccctaagcacaataaaag

SEQ ID NO: 638030 - DNA, 17 bp, Homo sapiens
tgggtcgcccctcctcg

SEQ ID NO: 638031 - DNA, 14 bp, Homo sapiens
tgggttgttgcaga

SEQ ID NO: 638032 - DNA, 15 bp, Homo sapiens
tgggtttactctgtg

SEQ ID NO: 638033 - DNA, 18 bp, Homo sapiens
tgggttttagaaattcta

SEQ ID NO: 638034 - DNA, 21 bp, Homo sapiens
tgggttttagaaattctataa

SEQ ID NO: 638035 - DNA, 18 bp, Homo sapiens
tggtaaaaagatccaggg

SEQ ID NO: 638036 - DNA, 22 bp, Homo sapiens
tttcagcattcccaattatcaa

SEQ ID NO: 638037 - DNA, 13 bp, Homo sapiens
tttcaggaaattt

SEQ ID NO: 638038 - DNA, 16 bp, Homo sapiens
tttcagtaagatcaag

SEQ ID NO: 638039 - DNA, 14 bp, Homo sapiens
tttcagtgcctgct

SEQ ID NO: 638040 - DNA, 16 bp, Homo sapiens
tttcatactctagatt

SEQ ID NO: 638041 - DNA, 17 bp, Homo sapiens
tttcatactctagattt

SEQ ID NO: 638042 - DNA, 19 bp, Homo sapiens
tttcatactctagattttg

SEQ ID NO: 638043 - DNA, 17 bp, Homo sapiens
tttcatggaatgcaatt

SEQ ID NO: 638044 - DNA, 18 bp, Homo sapiens
tttcatggagtagagtca

SEQ ID NO: 638045 - DNA, 14 bp, Homo sapiens
tttcatgtttaaga

SEQ ID NO: 638046 - DNA, 15 bp, Homo sapiens
tttcatgtttaagaa

SEQ ID NO: 638047 - DNA, 18 bp, Homo sapiens
tttcattttctctcctcg

SEQ ID NO: 638048 - DNA, 13 bp, Homo sapiens
tttccaaaggttg

SEQ ID NO: 638049 - DNA, 14 bp, Homo sapiens
tttccaacacacaa

SEQ ID NO: 638050 - DNA, 18 bp, Homo sapiens
tttccacatccccaccct

SEQ ID NO: 638051 - DNA, 15 bp, Homo sapiens
tttccagtgctgctc

SEQ ID NO: 638052 - DNA, 19 bp, Homo sapiens
tttccataaagaagatgtt

SEQ ID NO: 638053 - DNA, 14 bp, Homo sapiens
tttccatgacagta

SEQ ID NO: 638054 - DNA, 13 bp, Homo sapiens
tttccatttggat

SEQ ID NO: 638055 - DNA, 15 bp, Homo sapiens
tttccctgcatccct

SEQ ID NO: 638056 - DNA, 14 bp, Homo sapiens
tttcctcctgggca

SEQ ID NO: 638057 - DNA, 13 bp, Homo sapiens
tttcctctcctct

SEQ ID NO: 638058 - DNA, 12 bp, Homo sapiens
tttcctctctct

SEQ ID NO: 638059 - DNA, 24 bp, Homo sapiens
tttcctctctctctctctctctgt

SEQ ID NO: 638060 - DNA, 15 bp, Homo sapiens
tttcctgctcctcca

SEQ ID NO: 638061 - DNA, 11 bp, Homo sapiens
tttccttcagt

SEQ ID NO: 638062 - DNA, 21 bp, Homo sapiens
tttccttcagtgccttatgga

SEQ ID NO: 638063 - DNA, 21 bp, Homo sapiens
tttcctttgacctctcacttt

SEQ ID NO: 638064 - DNA, 13 bp, Homo sapiens
tttccttttttat

SEQ ID NO: 638065 - DNA, 22 bp, Homo sapiens
tttccttttttatacacataat

SEQ ID NO: 638066 - DNA, 12 bp, Homo sapiens
tttctaaaacat

SEQ ID NO: 638067 - DNA, 12 bp, Homo sapiens
tttctaaaacta

SEQ ID NO: 638068 - DNA, 15 bp, Homo sapiens
tttctagcaattgct

SEQ ID NO: 638069 - DNA, 17 bp, Homo sapiens
tttctcagcatatatat

SEQ ID NO: 638070 - DNA, 13 bp, Homo sapiens
tttctcatctgta

SEQ ID NO: 638071 - DNA, 19 bp, Homo sapiens
tttctccatttatttaaaa

SEQ ID NO: 638072 - DNA, 14 bp, Homo sapiens
tttctccgttgtgg

SEQ ID NO: 638073 - DNA, 13 bp, Homo sapiens
tttctctctgtgt

SEQ ID NO: 638074 - DNA, 23 bp, Homo sapiens
tttctctctgtgtggcaaacatt

SEQ ID NO: 638075 - DNA, 22 bp, Homo sapiens
tttctgagtagcatatataatt

SEQ ID NO: 638076 - DNA, 18 bp, Homo sapiens
tttctgagtgacatgggt

SEQ ID NO: 638077 - DNA, 18 bp, Homo sapiens
tttctgcactgagcagag

SEQ ID NO: 638078 - DNA, 17 bp, Homo sapiens
tttctgcagtattctgt

SEQ ID NO: 638079 - DNA, 18 bp, Homo sapiens
tttctgcagtattctgta

SEQ ID NO: 638080 - DNA, 19 bp, Homo sapiens
tttctgcagtattctgtag

SEQ ID NO: 638081 - DNA, 20 bp, Homo sapiens
tttctgctgaattttcacat

SEQ ID NO: 638082 - DNA, 21 bp, Homo sapiens
tttctgctgaattttcacatg

SEQ ID NO: 638083 - DNA, 19 bp, Homo sapiens
tttcttaattatggtacct

SEQ ID NO: 638084 - DNA, 15 bp, Homo sapiens
tttcttccaacatgt

SEQ ID NO: 638085 - DNA, 14 bp, Homo sapiens
tttcttccttcctt

SEQ ID NO: 638086 - DNA, 21 bp, Homo sapiens
tttcttctttaatttttctgt

SEQ ID NO: 638087 - DNA, 13 bp, Homo sapiens
tttcttttttaat

SEQ ID NO: 638088 - DNA, 12 bp, Homo sapiens
tttgaggaaact

SEQ ID NO: 638089 - DNA, 18 bp, Homo sapiens
tttgagtgtcaggctctg

SEQ ID NO: 638090 - DNA, 20 bp, Homo sapiens
tttgataaagatctccagtt

SEQ ID NO: 638091 - DNA, 21 bp, Homo sapiens
tttgatatacagacctccaga

SEQ ID NO: 638092 - DNA, 17 bp, Homo sapiens
tttgatatgttgatgaa

SEQ ID NO: 638093 - DNA, 20 bp, Homo sapiens
tttgatttgcaacactgcca

SEQ ID NO: 638094 - DNA, 17 bp, Homo sapiens
tttgcaaccttgtactt

SEQ ID NO: 638095 - DNA, 19 bp, Homo sapiens
tttgcaaccttgtacttta

SEQ ID NO: 638096 - DNA, 21 bp, Homo sapiens
tttgcagctatggacaattta

SEQ ID NO: 638097 - DNA, 18 bp, Homo sapiens
tttgcaggcccagcagac

SEQ ID NO: 638098 - DNA, 17 bp, Homo sapiens
tttgctgcttttgatgg

SEQ ID NO: 638099 - DNA, 21 bp, Homo sapiens
tttgctgtatacaaacaggtg

SEQ ID NO: 638100 - DNA, 16 bp, Homo sapiens
ttgctccattcctgag

SEQ ID NO: 638101 - DNA, 16 bp, Homo sapiens
ttgctctacctggccg

SEQ ID NO: 638102 - DNA, 21 bp, Homo sapiens
ttgctctccctcccttctttc

SEQ ID NO: 638103 - DNA, 19 bp, Homo sapiens
ttgctctctcattcccagg

SEQ ID NO: 638104 - DNA, 21 bp, Homo sapiens
ttgctgaataacaacaattta

SEQ ID NO: 638105 - DNA, 15 bp, Homo sapiens
ttgctgggccaggga

SEQ ID NO: 638106 - DNA, 15 bp, Homo sapiens
ttgctgtctgaaaaa

SEQ ID NO: 638107 - DNA, 14 bp, Homo sapiens
ttgctgtgaaacag

SEQ ID NO: 638108 - DNA, 20 bp, Homo sapiens
ttgctgtttaccgcccaccc

SEQ ID NO: 638109 - DNA, 22 bp, Homo sapiens
ttggaaaatgttctgacagcat

SEQ ID NO: 638110 - DNA, 19 bp, Homo sapiens
ttggaagcagcaaggtggg

SEQ ID NO: 638111 - DNA, 14 bp, Homo sapiens
ttggaagtatagat

SEQ ID NO: 638112 - DNA, 13 bp, Homo sapiens
ttggaattctgct

SEQ ID NO: 638113 - DNA, 14 bp, Homo sapiens
ttggaatttgctta

SEQ ID NO: 638114 - DNA, 18 bp, Homo sapiens
ttggacatttatgtacaa

SEQ ID NO: 638115 - DNA, 15 bp, Homo sapiens
ttggagagcagcagg

SEQ ID NO: 638116 - DNA, 12 bp, Homo sapiens
ttggagaggagg

SEQ ID NO: 638117 - DNA, 15 bp, Homo sapiens
ttggaggctgctgcc

SEQ ID NO: 638118 - DNA, 17 bp, Homo sapiens
ttggaggctgctgcccc

SEQ ID NO: 638119 - DNA, 21 bp, Homo sapiens
ttggatcgtggaagaagggcc

SEQ ID NO: 638120 - DNA, 22 bp, Homo sapiens
ttggatcgtggaagaagggcca

SEQ ID NO: 638121 - DNA, 20 bp, Homo sapiens
ttggattcacagcctttgcg

SEQ ID NO: 638122 - DNA, 18 bp, Homo sapiens
ttggcagcgcctcgcccc

SEQ ID NO: 638123 - DNA, 19 bp, Homo sapiens
ttggcagcgcctcgcccca

SEQ ID NO: 638124 - DNA, 21 bp, Homo sapiens
ttggcatggatttcctttgac

SEQ ID NO: 638125 - DNA, 11 bp, Homo sapiens
ttggcccctct

SEQ ID NO: 638126 - DNA, 10 bp, Homo sapiens
ttggccctgg

SEQ ID NO: 638127 - DNA, 15 bp, Homo sapiens
ttggccctggagcca

SEQ ID NO: 638128 - DNA, 22 bp, Homo sapiens
ttggccctggagccagggcaga

SEQ ID NO: 638129 - DNA, 14 bp, Homo sapiens
ttggccggctggcc

SEQ ID NO: 638130 - DNA, 21 bp, Homo sapiens
ttggcgccccatgggccctca

SEQ ID NO: 638131 - DNA, 15 bp, Homo sapiens
ttggctgaaattatg

SEQ ID NO: 638132 - DNA, 15 bp, Homo sapiens
ttgggaaattcttgc

SEQ ID NO: 638133 - DNA, 16 bp, Homo sapiens
ttgggaaattcttgca

SEQ ID NO: 638134 - DNA, 17 bp, Homo sapiens
ttgggaattgcatgcca

SEQ ID NO: 638135 - DNA, 11 bp, Homo sapiens
ttgggaggctg

SEQ ID NO: 638136 - DNA, 17 bp, Homo sapiens
ttgggcagtggagaggg

SEQ ID NO: 638137 - DNA, 17 bp, Homo sapiens
ttgggcctccatgcccc

SEQ ID NO: 638138 - DNA, 22 bp, Homo sapiens
ttgggcctccatgccccagctc

SEQ ID NO: 638139 - DNA, 23 bp, Homo sapiens
ttgggcctccatgccccagctct

SEQ ID NO: 638140 - DNA, 14 bp, Homo sapiens
ttgggctcagggtt

SEQ ID NO: 638141 - DNA, 21 bp, Homo sapiens
ttgggctcagggttggccatt

SEQ ID NO: 638142 - DNA, 20 bp, Homo sapiens
ttgggggacgcccagccccc

SEQ ID NO: 638143 - DNA, 15 bp, Homo sapiens
tgaggacagaggccg

SEQ ID NO: 638144 - DNA, 18 bp, Homo sapiens
tgaggacggggcagagct

SEQ ID NO: 638145 - DNA, 19 bp, Homo sapiens
tgaggacggggcagagctg

SEQ ID NO: 638146 - DNA, 22 bp, Homo sapiens
tgaggaggaggacacagcacaa

SEQ ID NO: 638147 - DNA, 23 bp, Homo sapiens
tgaggaggaggacacagcacaag

SEQ ID NO: 638148 - DNA, 14 bp, Homo sapiens
tgaggatgtatgtg

SEQ ID NO: 638149 - DNA, 22 bp, Homo sapiens
tgaggcccccggaggcgcccac

SEQ ID NO: 638150 - DNA, 23 bp, Homo sapiens
tgaggcccccggaggcgcccacc

SEQ ID NO: 638151 - DNA, 13 bp, Homo sapiens
tgaggcccctgtg

SEQ ID NO: 638152 - DNA, 14 bp, Homo sapiens
tgaggcccctgtgc

SEQ ID NO: 638153 - DNA, 19 bp, Homo sapiens
tgaggcccctgtgcagtag

SEQ ID NO: 638154 - DNA, 18 bp, Homo sapiens
tgaggcctttccccagtg

SEQ ID NO: 638155 - DNA, 21 bp, Homo sapiens
tgaggcctttccccagtgtgg

SEQ ID NO: 638156 - DNA, 22 bp, Homo sapiens
tgaggcctttccccagtgtggc

SEQ ID NO: 638157 - DNA, 22 bp, Homo sapiens
tgaggctggataggagaggaaa

SEQ ID NO: 638158 - DNA, 15 bp, Homo sapiens
tgagggaagcccacc

SEQ ID NO: 638159 - DNA, 18 bp, Homo sapiens
tgagggaagcccacccgc

SEQ ID NO: 638160 - DNA, 19 bp, Homo sapiens
tgagggacgagcagagcgc

SEQ ID NO: 638161 - DNA, 21 bp, Homo sapiens
tgagggcagggttctagaagg

SEQ ID NO: 638162 - DNA, 19 bp, Homo sapiens
tgagggcgtgaaacacaat

SEQ ID NO: 638163 - DNA, 19 bp, Homo sapiens
tgaggtcttgagtttcatt

SEQ ID NO: 638164 - DNA, 15 bp, Homo sapiens
tgaggtctttgcatt

SEQ ID NO: 638165 - DNA, 23 bp, Homo sapiens
tgagtcagaggcagaacctagtc

SEQ ID NO: 638166 - DNA, 21 bp, Homo sapiens
tgagtcggctgggcagggccg

SEQ ID NO: 638167 - DNA, 13 bp, Homo sapiens
tgagtctgtcctt

SEQ ID NO: 638168 - DNA, 18 bp, Homo sapiens
tgagtctgtcctttccca

SEQ ID NO: 638169 - DNA, 15 bp, Homo sapiens
tgagtgaaatattac

SEQ ID NO: 638170 - DNA, 16 bp, Homo sapiens
tgagtgggccccctct

SEQ ID NO: 638171 - DNA, 24 bp, Homo sapiens
tgagttgtactggttagattcatt

SEQ ID NO: 638172 - DNA, 17 bp, Homo sapiens
tgagttttatccaagac

SEQ ID NO: 638173 - DNA, 17 bp, Homo sapiens
tgataaatttgactgtt

SEQ ID NO: 638174 - DNA, 21 bp, Homo sapiens
tgataaatttggccatgaaag

SEQ ID NO: 638175 - DNA, 18 bp, Homo sapiens
tgataatagctcacagca

SEQ ID NO: 638176 - DNA, 13 bp, Homo sapiens
tgataatcagttt

SEQ ID NO: 638177 - DNA, 18 bp, Homo sapiens
tgataatcagtttccact

SEQ ID NO: 638178 - DNA, 14 bp, Homo sapiens
tgataattgtaaag

SEQ ID NO: 638179 - DNA, 18 bp, Homo sapiens
tgataattgtaaaggtga

SEQ ID NO: 638180 - DNA, 23 bp, Homo sapiens
tgatagaagaaggactgaagaaa

SEQ ID NO: 638181 - DNA, 24 bp, Homo sapiens
tgatagaagaaggactgaagaaaa

SEQ ID NO: 638182 - DNA, 15 bp, Homo sapiens
tgatagtttacaaac

SEQ ID NO: 638183 - DNA, 14 bp, Homo sapiens
tgatatacagacct

SEQ ID NO: 638184 - DNA, 17 bp, Homo sapiens
tgatatcacagtctaat

SEQ ID NO: 638185 - DNA, 22 bp, Homo sapiens
tgatatcaggaaatatctgtga

SEQ ID NO: 638186 - DNA, 21 bp, Homo sapiens
tgatatccaacagaaagcata

SEQ ID NO: 638187 - DNA, 15 bp, Homo sapiens
tgatatctgtttgct

SEQ ID NO: 638188 - DNA, 14 bp, Homo sapiens
tgatatgtctttaa

SEQ ID NO: 638189 - DNA, 23 bp, Homo sapiens
tgatcaaggagggagaaaggcaa

SEQ ID NO: 638190 - DNA, 24 bp, Homo sapiens
tgatcactttctgaaattcacaaa

SEQ ID NO: 638191 - DNA, 18 bp, Homo sapiens
tgatctcagcatcctgga

SEQ ID NO: 638192 - DNA, 18 bp, Homo sapiens
tgatctggtgcgtgtggc

SEQ ID NO: 638193 - DNA, 19 bp, Homo sapiens
tgatgaagttgtacaacac

SEQ ID NO: 638194 - DNA, 17 bp, Homo sapiens
tgatgaataaaatgttt

SEQ ID NO: 638195 - DNA, 19 bp, Homo sapiens
tgatgagacaacacacaca

SEQ ID NO: 638196 - DNA, 14 bp, Homo sapiens
tgatgatgttctga

SEQ ID NO: 638197 - DNA, 14 bp, Homo sapiens
tgatgccgtgcggg

SEQ ID NO: 638198 - DNA, 15 bp, Homo sapiens
tgatggaagggcctt

SEQ ID NO: 638199 - DNA, 14 bp, Homo sapiens
tgatggctatgttt

SEQ ID NO: 638200 - DNA, 13 bp, Homo sapiens
tgatgggtcctgc

SEQ ID NO: 638201 - DNA, 13 bp, Homo sapiens
tgatggtgcaatg

SEQ ID NO: 638202 - DNA, 15 bp, Homo sapiens
tgatggtgcaatgac

SEQ ID NO: 638203 - DNA, 23 bp, Homo sapiens
tgatggtgcaatgacctttcaat

SEQ ID NO: 638204 - DNA, 14 bp, Homo sapiens
tgatgtccaaactt

SEQ ID NO: 638205 - DNA, 16 bp, Homo sapiens
tgatgtccaaacttaa

SEQ ID NO: 638206 - DNA, 19 bp, Homo sapiens
tgatgtgatttatgcattt

SEQ ID NO: 638207 - DNA, 19 bp, Homo sapiens
tgatgtgctcatcagaaac

SEQ ID NO: 638208 - DNA, 16 bp, Homo sapiens
tgatgttctgaaatgg

SEQ ID NO: 638209 - DNA, 19 bp, Homo sapiens
tgattaaactgggaaatga

SEQ ID NO: 638210 - DNA, 17 bp, Homo sapiens
tgattaactcagtcctg

SEQ ID NO: 638211 - DNA, 11 bp, Homo sapiens
tgattaaggac

SEQ ID NO: 638212 - DNA, 13 bp, Homo sapiens
tgattacctgaaa

SEQ ID NO: 638213 - DNA, 14 bp, Homo sapiens
tgattacctgaaag

SEQ ID NO: 638214 - DNA, 18 bp, Homo sapiens
tgattacctgaaagccct

SEQ ID NO: 638215 - DNA, 16 bp, Homo sapiens
tgattagacaatgtgg

SEQ ID NO: 638216 - DNA, 19 bp, Homo sapiens
tgattcaatgtgaatttta

SEQ ID NO: 638217 - DNA, 13 bp, Homo sapiens
tgattctcctctc

SEQ ID NO: 638218 - DNA, 12 bp, Homo sapiens
tgattgacattt

SEQ ID NO: 638219 - DNA, 20 bp, Homo sapiens
tgattgacattttgtagcta

SEQ ID NO: 638220 - DNA, 21 bp, Homo sapiens
tgattgagagcagcctcttga

SEQ ID NO: 638221 - DNA, 21 bp, Homo sapiens
tgattgtcaaatacagcattt

SEQ ID NO: 638222 - DNA, 13 bp, Homo sapiens
tgatttaacatta

SEQ ID NO: 638223 - DNA, 16 bp, Homo sapiens
tgatttactaacagta

SEQ ID NO: 638224 - DNA, 13 bp, Homo sapiens
tgatttatgcatt

SEQ ID NO: 638225 - DNA, 12 bp, Homo sapiens
tgatttattctg

SEQ ID NO: 638226 - DNA, 16 bp, Homo sapiens
tgatttctgaactatc

SEQ ID NO: 638227 - DNA, 16 bp, Homo sapiens
tgatttgatatacaga

SEQ ID NO: 638228 - DNA, 17 bp, Homo sapiens
tgatttgcaacactgcc

SEQ ID NO: 638229 - DNA, 13 bp, Homo sapiens
tgattttaacttt

SEQ ID NO: 638230 - DNA, 14 bp, Homo sapiens
tgatttttgttgat

SEQ ID NO: 638231 - DNA, 19 bp, Homo sapiens
tgatttttgttgattaaaa

SEQ ID NO: 638232 - DNA, 22 bp, Homo sapiens
tccactcctcccaactctggcc

SEQ ID NO: 638233 - DNA, 13 bp, Homo sapiens
tccacttctctgt

SEQ ID NO: 638234 - DNA, 12 bp, Homo sapiens
tccactttcctc

SEQ ID NO: 638235 - DNA, 13 bp, Homo sapiens
tccactttcctct

SEQ ID NO: 638236 - DNA, 14 bp, Homo sapiens
tccagaagcagcag

SEQ ID NO: 638237 - DNA, 20 bp, Homo sapiens
tccagacagagtggatctgg

SEQ ID NO: 638238 - DNA, 18 bp, Homo sapiens
tccagacagggtggggct

SEQ ID NO: 638239 - DNA, 9 bp, Homo sapiens
tccagaccc

SEQ ID NO: 638240 - DNA, 10 bp, Homo sapiens
tccagagaga

SEQ ID NO: 638241 - DNA, 21 bp, Homo sapiens
tccagagagaagcaccccacc

SEQ ID NO: 638242 - DNA, 20 bp, Homo sapiens
tccagagggttgtgattttg

SEQ ID NO: 638243 - DNA, 19 bp, Homo sapiens
tccagattattttctatat

SEQ ID NO: 638244 - DNA, 14 bp, Homo sapiens
tccagcaatgcctg

SEQ ID NO: 638245 - DNA, 15 bp, Homo sapiens
tccagcccatgctgg

SEQ ID NO: 638246 - DNA, 11 bp, Homo sapiens
tccagccctcc

SEQ ID NO: 638247 - DNA, 12 bp, Homo sapiens
tccagccctccg

SEQ ID NO: 638248 - DNA, 18 bp, Homo sapiens
tccagccctccgccagcc

SEQ ID NO: 638249 - DNA, 19 bp, Homo sapiens
tccagccttcttcccccag

SEQ ID NO: 638250 - DNA, 14 bp, Homo sapiens
tccagcgaaatggt

SEQ ID NO: 638251 - DNA, 19 bp, Homo sapiens
tccagcggggcttctgggc

SEQ ID NO: 638252 - DNA, 20 bp, Homo sapiens
tccagcggggcttctgggcg

SEQ ID NO: 638253 - DNA, 22 bp, Homo sapiens
tccagctgattttaactttttt

SEQ ID NO: 638254 - DNA, 20 bp, Homo sapiens
tccagcttcactgtcatgtg

SEQ ID NO: 638255 - DNA, 21 bp, Homo sapiens
tccaggaggactgttctaact

SEQ ID NO: 638256 - DNA, 22 bp, Homo sapiens
tccaggcagtagatcatttttt

SEQ ID NO: 638257 - DNA, 14 bp, Homo sapiens
tccaggtcacaggc

SEQ ID NO: 638258 - DNA, 12 bp, Homo sapiens
tccagtgcatgt

SEQ ID NO: 638259 - DNA, 15 bp, Homo sapiens
tccagtgcatgttgc

SEQ ID NO: 638260 - DNA, 20 bp, Homo sapiens
tccagtggggcaagattttc

SEQ ID NO: 638261 - DNA, 14 bp, Homo sapiens
tccagttctgatga

SEQ ID NO: 638262 - DNA, 17 bp, Homo sapiens
tccagttctgatgaggc

SEQ ID NO: 638263 - DNA, 17 bp, Homo sapiens
tccataaagaagatgtt

SEQ ID NO: 638264 - DNA, 19 bp, Homo sapiens
tccatcaaagccctccctg

SEQ ID NO: 638265 - DNA, 13 bp, Homo sapiens
tccatcaggactt

SEQ ID NO: 638266 - DNA, 19 bp, Homo sapiens
tccatccgtctctgtccgc

SEQ ID NO: 638267 - DNA, 22 bp, Homo sapiens
tccatcgatttgtattaatgta

SEQ ID NO: 638268 - DNA, 18 bp, Homo sapiens
tccatcttgtggggccag

SEQ ID NO: 638269 - DNA, 23 bp, Homo sapiens
tccatgacagtagcatactgatg

SEQ ID NO: 638270 - DNA, 17 bp, Homo sapiens
tccatgccccagctctg

SEQ ID NO: 638271 - DNA, 22 bp, Homo sapiens
tccatgctgtccctgtgggctc

SEQ ID NO: 638272 - DNA, 19 bp, Homo sapiens
tccatggatgcagaaatga

SEQ ID NO: 638273 - DNA, 16 bp, Homo sapiens
tccatggtgaactgaa

SEQ ID NO: 638274 - DNA, 21 bp, Homo sapiens
tccatggtgaactgaagcaga

SEQ ID NO: 638275 - DNA, 22 bp, Homo sapiens
tccatggtgaactgaagcagag

SEQ ID NO: 638276 - DNA, 14 bp, Homo sapiens
tccattcctgagta

SEQ ID NO: 638277 - DNA, 12 bp, Homo sapiens
tccattctatga

SEQ ID NO: 638278 - DNA, 18 bp, Homo sapiens
tccattgacatgtacaga

SEQ ID NO: 638279 - DNA, 13 bp, Homo sapiens
tccattgtatctt

SEQ ID NO: 638280 - DNA, 18 bp, Homo sapiens
tccatttggattttaaac

SEQ ID NO: 638281 - DNA, 16 bp, Homo sapiens
tcccaaataaactcct

SEQ ID NO: 638282 - DNA, 22 bp, Homo sapiens
tcccaacacatcacttaccact

SEQ ID NO: 638283 - DNA, 16 bp, Homo sapiens
tcccaacctcccctgg

SEQ ID NO: 638284 - DNA, 23 bp, Homo sapiens
tcccaagtcctcgccccccgccc

SEQ ID NO: 638285 - DNA, 18 bp, Homo sapiens
tcccaattatcaaaaaac

SEQ ID NO: 638286 - DNA, 14 bp, Homo sapiens
tcccacactgtgaa

SEQ ID NO: 638287 - DNA, 17 bp, Homo sapiens
tcccacctcggacacca

SEQ ID NO: 638288 - DNA, 19 bp, Homo sapiens
tcccacgacataagctggt

SEQ ID NO: 638289 - DNA, 20 bp, Homo sapiens
tcccactaagctttctcctt

SEQ ID NO: 638290 - DNA, 19 bp, Homo sapiens
tcccactgcccctgcacct

SEQ ID NO: 638291 - DNA, 17 bp, Homo sapiens
tcccagagttatttccc

SEQ ID NO: 638292 - DNA, 18 bp, Homo sapiens
tcgggggaggagcacccc

SEQ ID NO: 638293 - DNA, 19 bp, Homo sapiens
tcgggggaggagcaccccc

SEQ ID NO: 638294 - DNA, 21 bp, Homo sapiens
tcgggggaggagcacccccag

SEQ ID NO: 638295 - DNA, 13 bp, Homo sapiens
tcggtcagcaccg

SEQ ID NO: 638296 - DNA, 18 bp, Homo sapiens
tcggtggcatttgctgaa

SEQ ID NO: 638297 - DNA, 23 bp, Homo sapiens
tcggtgggagccgtcagcctgtg

SEQ ID NO: 638298 - DNA, 17 bp, Homo sapiens
tcggtgtttggaggctg

SEQ ID NO: 638299 - DNA, 21 bp, Homo sapiens
tcggtgtttggaggctgctgc

SEQ ID NO: 638300 - DNA, 12 bp, Homo sapiens
tcgtaagttctg

SEQ ID NO: 638301 - DNA, 16 bp, Homo sapiens
tcgtaagttctgtgca

SEQ ID NO: 638302 - DNA, 14 bp, Homo sapiens
tcgtccggcctgca

SEQ ID NO: 638303 - DNA, 13 bp, Homo sapiens
tcgtgcatgtaat

SEQ ID NO: 638304 - DNA, 21 bp, Homo sapiens
tcgtgccgtggagcttggagc

SEQ ID NO: 638305 - DNA, 23 bp, Homo sapiens
tcgtgccgtggagcttggagccc

SEQ ID NO: 638306 - DNA, 12 bp, Homo sapiens
tcgttggagagc

SEQ ID NO: 638307 - DNA, 22 bp, Homo sapiens
tctaaaacccttggtctgtgtt

SEQ ID NO: 638308 - DNA, 14 bp, Homo sapiens
tctaaaccatgaaa

SEQ ID NO: 638309 - DNA, 22 bp, Homo sapiens
tctaaaccatgaaaagttttca

SEQ ID NO: 638310 - DNA, 13 bp, Homo sapiens
tctaaatattatg

SEQ ID NO: 638311 - DNA, 17 bp, Homo sapiens
tctaaatcactttaatt

SEQ ID NO: 638312 - DNA, 16 bp, Homo sapiens
tctaactagtaatctt

SEQ ID NO: 638313 - DNA, 23 bp, Homo sapiens
tctaagaaatggctttccacatc

SEQ ID NO: 638314 - DNA, 18 bp, Homo sapiens
tctaatttttattcataa

SEQ ID NO: 638315 - DNA, 15 bp, Homo sapiens
tctacaaacttttat

SEQ ID NO: 638316 - DNA, 21 bp, Homo sapiens
tctacaaacttttataaatgt

SEQ ID NO: 638317 - DNA, 22 bp, Homo sapiens
tctacaaacttttataaatgtt

SEQ ID NO: 638318 - DNA, 19 bp, Homo sapiens
tctacacatataaacacag

SEQ ID NO: 638319 - DNA, 21 bp, Homo sapiens
tctacacatataaacacagta

SEQ ID NO: 638320 - DNA, 14 bp, Homo sapiens
tctaccattaaaat

SEQ ID NO: 638321 - DNA, 20 bp, Homo sapiens
tctaccattaaaatcttgaa

SEQ ID NO: 638322 - DNA, 22 bp, Homo sapiens
tctacctggccggtaggctgct

SEQ ID NO: 638323 - DNA, 16 bp, Homo sapiens
tctagaaggggcgagg

SEQ ID NO: 638324 - DNA, 15 bp, Homo sapiens
tctagatatgagaaa

SEQ ID NO: 638325 - DNA, 19 bp, Homo sapiens
tctagattttgttttgctt

SEQ ID NO: 638326 - DNA, 21 bp, Homo sapiens
tctataggacttaatttagca

SEQ ID NO: 638327 - DNA, 14 bp, Homo sapiens
tctatatgtaactt

SEQ ID NO: 638328 - DNA, 22 bp, Homo sapiens
tctatattccgggtgccattcc

SEQ ID NO: 638329 - DNA, 13 bp, Homo sapiens
tctatatttactg

SEQ ID NO: 638330 - DNA, 18 bp, Homo sapiens
tctatatttactgtttat

SEQ ID NO: 638331 - DNA, 15 bp, Homo sapiens
tctatgcctcagttt

SEQ ID NO: 638332 - DNA, 14 bp, Homo sapiens
tctatgctgtgtgc

SEQ ID NO: 638333 - DNA, 20 bp, Homo sapiens
tctattatctgggttttaga

SEQ ID NO: 638334 - DNA, 16 bp, Homo sapiens
tctatttgatttgcaa

SEQ ID NO: 638335 - DNA, 18 bp, Homo sapiens
tctatttgatttgcaaca

SEQ ID NO: 638336 - DNA, 17 bp, Homo sapiens
tctcaaacactgcttaa

SEQ ID NO: 638337 - DNA, 17 bp, Homo sapiens
tctcaaatctgctttca

SEQ ID NO: 638338 - DNA, 23 bp, Homo sapiens
tctcaacacacagtatagataaa

SEQ ID NO: 638339 - DNA, 19 bp, Homo sapiens
tctcagaagtgaaaaagac

SEQ ID NO: 638340 - DNA, 19 bp, Homo sapiens
tctcagcatcctggaaatt

SEQ ID NO: 638341 - DNA, 22 bp, Homo sapiens
tctcagcatcctggaaatttgt

SEQ ID NO: 638342 - DNA, 15 bp, Homo sapiens
tctcagctccactct

SEQ ID NO: 638343 - DNA, 16 bp, Homo sapiens
tctcagctccactctg

SEQ ID NO: 638344 - DNA, 17 bp, Homo sapiens
tctcagctccactctga

SEQ ID NO: 638345 - DNA, 15 bp, Homo sapiens
tctcagtatcttaaa

SEQ ID NO: 638346 - DNA, 17 bp, Homo sapiens
tctcagtatcttaaaat

SEQ ID NO: 638347 - DNA, 14 bp, Homo sapiens
tctcagtgaaggaa

SEQ ID NO: 638348 - DNA, 14 bp, Homo sapiens
tctcatagatgacc

SEQ ID NO: 638349 - DNA, 22 bp, Homo sapiens
tctcatctgtaaaaccaggctg

SEQ ID NO: 638350 - DNA, 12 bp, Homo sapiens
tctcatggtatt

SEQ ID NO: 638351 - DNA, 18 bp, Homo sapiens
tctcattagggctttttt

SEQ ID NO: 638352 - DNA, 11 bp, Homo sapiens
tctcattccca

SEQ ID NO: 638353 - DNA, 20 bp, Homo sapiens
tctccacccctcaagccagg

SEQ ID NO: 638354 - DNA, 18 bp, Homo sapiens
tctccaccctgagcctga

SEQ ID NO: 638355 - DNA, 16 bp, Homo sapiens
tctccagccaatttca

SEQ ID NO: 638356 - DNA, 19 bp, Homo sapiens
tctccagcccatgctggct

SEQ ID NO: 638357 - DNA, 22 bp, Homo sapiens
tctccagcccatgctggctggg

SEQ ID NO: 638358 - DNA, 21 bp, Homo sapiens
tctcccaaataaactccttaa

SEQ ID NO: 638359 - DNA, 12 bp, Homo sapiens
tctcccctccag

SEQ ID NO: 638360 - DNA, 14 bp, Homo sapiens
tctcccctccagac

SEQ ID NO: 638361 - DNA, 16 bp, Homo sapiens
tctccctccactcctc

SEQ ID NO: 638362 - DNA, 15 bp, Homo sapiens
tcttctcagctccac

SEQ ID NO: 638363 - DNA, 20 bp, Homo sapiens
tcttctcagctccactctga

SEQ ID NO: 638364 - DNA, 19 bp, Homo sapiens
tcttctcctttgtcaaatg

SEQ ID NO: 638365 - DNA, 23 bp, Homo sapiens
tcttgacaggcgccgcctcgccc

SEQ ID NO: 638366 - DNA, 15 bp, Homo sapiens
tcttgagcagctgaa

SEQ ID NO: 638367 - DNA, 18 bp, Homo sapiens
tcttgagtgggccccctc

SEQ ID NO: 638368 - DNA, 19 bp, Homo sapiens
tcttgagtgggccccctct

SEQ ID NO: 638369 - DNA, 19 bp, Homo sapiens
tcttgagtttcatttttca

SEQ ID NO: 638370 - DNA, 19 bp, Homo sapiens
tcttgcactgtatccaagt

SEQ ID NO: 638371 - DNA, 20 bp, Homo sapiens
tcttgcggcaccgcccaccc

SEQ ID NO: 638372 - DNA, 20 bp, Homo sapiens
tcttgctacctcagtcagta

SEQ ID NO: 638373 - DNA, 14 bp, Homo sapiens
tcttgctctgctca

SEQ ID NO: 638374 - DNA, 12 bp, Homo sapiens
tcttgctgtgaa

SEQ ID NO: 638375 - DNA, 13 bp, Homo sapiens
tcttgctgtgaaa

SEQ ID NO: 638376 - DNA, 19 bp, Homo sapiens
tcttgctgtttaccgccca

SEQ ID NO: 638377 - DNA, 22 bp, Homo sapiens
tcttgctgtttaccgcccaccc

SEQ ID NO: 638378 - DNA, 21 bp, Homo sapiens
tcttggattggtaccagagcc

SEQ ID NO: 638379 - DNA, 14 bp, Homo sapiens
tcttgggattcctc

SEQ ID NO: 638380 - DNA, 15 bp, Homo sapiens
tcttggtatgatcat

SEQ ID NO: 638381 - DNA, 20 bp, Homo sapiens
tcttggtctctttctttcca

SEQ ID NO: 638382 - DNA, 21 bp, Homo sapiens
tcttgtaaaactgtgacattc

SEQ ID NO: 638383 - DNA, 22 bp, Homo sapiens
tcttgtaaataatgcttaacat

SEQ ID NO: 638384 - DNA, 15 bp, Homo sapiens
tcttgtggggccagg

SEQ ID NO: 638385 - DNA, 16 bp, Homo sapiens
tctttaatttttctgt

SEQ ID NO: 638386 - DNA, 15 bp, Homo sapiens
tctttactaacactg

SEQ ID NO: 638387 - DNA, 18 bp, Homo sapiens
tctttactaacactggct

SEQ ID NO: 638388 - DNA, 12 bp, Homo sapiens
tctttagtcatt

SEQ ID NO: 638389 - DNA, 13 bp, Homo sapiens
tctttatgatttc

SEQ ID NO: 638390 - DNA, 16 bp, Homo sapiens
tctttatgatttcatg

SEQ ID NO: 638391 - DNA, 17 bp, Homo sapiens
tctttatgatttcatga

SEQ ID NO: 638392 - DNA, 14 bp, Homo sapiens
tctttccctcatgt

SEQ ID NO: 638393 - DNA, 12 bp, Homo sapiens
tctttcctctta

SEQ ID NO: 638394 - DNA, 13 bp, Homo sapiens
tctttccttcctt

SEQ ID NO: 638395 - DNA, 14 bp, Homo sapiens
tctttctctctgtg

SEQ ID NO: 638396 - DNA, 22 bp, Homo sapiens
tctttctgtgtggtgaaaacat

SEQ ID NO: 638397 - DNA, 14 bp, Homo sapiens
tctttctttccaaa

SEQ ID NO: 638398 - DNA, 15 bp, Homo sapiens
tctttctttccaaag

SEQ ID NO: 638399 - DNA, 11 bp, Homo sapiens
tctttcttttc

SEQ ID NO: 638400 - DNA, 15 bp, Homo sapiens
tctttggaagcagcc

SEQ ID NO: 638401 - DNA, 23 bp, Homo sapiens
tctttggaagcagccccctgtgg

SEQ ID NO: 638402 - DNA, 15 bp, Homo sapiens
tctttggttcctcat

SEQ ID NO: 638403 - DNA, 21 bp, Homo sapiens
tcttttcatggagtagagtca

SEQ ID NO: 638404 - DNA, 21 bp, Homo sapiens
tcttttcccatttacaaatga

SEQ ID NO: 638405 - DNA, 17 bp, Homo sapiens
tcttttgcatgatgatc

SEQ ID NO: 638406 - DNA, 13 bp, Homo sapiens
tcttttgttctct

SEQ ID NO: 638407 - DNA, 21 bp, Homo sapiens
tctttttattaggttaagtct

SEQ ID NO: 638408 - DNA, 16 bp, Homo sapiens
tctttttgctttgctt

SEQ ID NO: 638409 - DNA, 20 bp, Homo sapiens
tcttttttcaatgtactgta

SEQ ID NO: 638410 - DNA, 21 bp, Homo sapiens
tctttttttaagtgttctgtg

SEQ ID NO: 638411 - DNA, 19 bp, Homo sapiens
tgaaaaaaaaaagtaatta

SEQ ID NO: 638412 - DNA, 21 bp, Homo sapiens
tgaaaaagcatgtacagtgtt

SEQ ID NO: 638413 - DNA, 15 bp, Homo sapiens
tgaaaaatctgaatt

SEQ ID NO: 638414 - DNA, 22 bp, Homo sapiens
tgaaaacataagccatggtgaa

SEQ ID NO: 638415 - DNA, 17 bp, Homo sapiens
tgaaaacctctttcgga

SEQ ID NO: 638416 - DNA, 21 bp, Homo sapiens
tgaaaactggaataagaagca

SEQ ID NO: 638417 - DNA, 21 bp, Homo sapiens
tgaaaagaggtgaccataaag

SEQ ID NO: 638418 - DNA, 17 bp, Homo sapiens
tgaaaatgtttttaagt

SEQ ID NO: 638419 - DNA, 20 bp, Homo sapiens
tgaaaatgtttttaagtgct

SEQ ID NO: 638420 - DNA, 22 bp, Homo sapiens
tgaaacaaatatactcatttgg

SEQ ID NO: 638421 - DNA, 14 bp, Homo sapiens
tgaaacacaatatc

SEQ ID NO: 638422 - DNA, 12 bp, Homo sapiens
tgaaactgtatt

SEQ ID NO: 638423 - DNA, 17 bp, Homo sapiens
tgaaactgtatttactt

SEQ ID NO: 638424 - DNA, 13 bp, Homo sapiens
tgaaagagaaaat

SEQ ID NO: 638425 - DNA, 18 bp, Homo sapiens
tgaaagagaaaatgcttt

SEQ ID NO: 638426 - DNA, 16 bp, Homo sapiens
tgaaagggacaagtat

SEQ ID NO: 638427 - DNA, 15 bp, Homo sapiens
tgaaaggtgctttct

SEQ ID NO: 638428 - DNA, 18 bp, Homo sapiens
tgaaaggtgctttctcca

SEQ ID NO: 638429 - DNA, 21 bp, Homo sapiens
tgaaagtcaagtctacctgcc

SEQ ID NO: 638430 - DNA, 20 bp, Homo sapiens
tgaaagtctcctgtatcatt

SEQ ID NO: 638431 - DNA, 15 bp, Homo sapiens
tgaaagttgtgatct

SEQ ID NO: 638432 - DNA, 17 bp, Homo sapiens
tgaaagttgtgatctgt

SEQ ID NO: 638433 - DNA, 15 bp, Homo sapiens
tgaaataaagagttc

SEQ ID NO: 638434 - DNA, 21 bp, Homo sapiens
tgaaataaagagttctccttg

SEQ ID NO: 638435 - DNA, 13 bp, Homo sapiens
tgaaatataaact

SEQ ID NO: 638436 - DNA, 17 bp, Homo sapiens
tgaaatataaactgtga

SEQ ID NO: 638437 - DNA, 19 bp, Homo sapiens
tgaaatataaactgtgaga

SEQ ID NO: 638438 - DNA, 20 bp, Homo sapiens
tgaaatataaactgtgagat

SEQ ID NO: 638439 - DNA, 14 bp, Homo sapiens
tgaaatccaaaata

SEQ ID NO: 638440 - DNA, 22 bp, Homo sapiens
tgaaattaggaaagtactgcat

SEQ ID NO: 638441 - DNA, 16 bp, Homo sapiens
tgaaattagtattttg

SEQ ID NO: 638442 - DNA, 17 bp, Homo sapiens
tgaaattagtattttga

SEQ ID NO: 638443 - DNA, 16 bp, Homo sapiens
tgccccctcccccgca

SEQ ID NO: 638444 - DNA, 18 bp, Homo sapiens
tgccccctcccccgcaga

SEQ ID NO: 638445 - DNA, 13 bp, Homo sapiens
tgccccctggctt

SEQ ID NO: 638446 - DNA, 13 bp, Homo sapiens
tgcccctgcacct

SEQ ID NO: 638447 - DNA, 19 bp, Homo sapiens
tgcccctgcacctgcttct

SEQ ID NO: 638448 - DNA, 21 bp, Homo sapiens
tgcccctgcagtttggccctg

SEQ ID NO: 638449 - DNA, 17 bp, Homo sapiens
tgcccctggccctgcct

SEQ ID NO: 638450 - DNA, 19 bp, Homo sapiens
tgcccctggccctgcctca

SEQ ID NO: 638451 - DNA, 18 bp, Homo sapiens
tgccccttccccatgctc

SEQ ID NO: 638452 - DNA, 20 bp, Homo sapiens
tgccccttgaccccacacgc

SEQ ID NO: 638453 - DNA, 21 bp, Homo sapiens
tgcccgcgcccgccgcctccc

SEQ ID NO: 638454 - DNA, 24 bp, Homo sapiens
tgcccgcgggtggctggagcccca

SEQ ID NO: 638455 - DNA, 19 bp, Homo sapiens
tgccctcaaaatctttaga

SEQ ID NO: 638456 - DNA, 16 bp, Homo sapiens
tgccctccctgctgcc

SEQ ID NO: 638457 - DNA, 20 bp, Homo sapiens
tgccctccctgctgccaggc

SEQ ID NO: 638458 - DNA, 17 bp, Homo sapiens
tgccctccgcccttccc

SEQ ID NO: 638459 - DNA, 15 bp, Homo sapiens
tgccctctcactgac

SEQ ID NO: 638460 - DNA, 22 bp, Homo sapiens
tgccctctcactgacttctccc

SEQ ID NO: 638461 - DNA, 18 bp, Homo sapiens
tgccctcttaagatctga

SEQ ID NO: 638462 - DNA, 16 bp, Homo sapiens
tgctgtccctgtgggc

SEQ ID NO: 638463 - DNA, 18 bp, Homo sapiens
tgctgtctgtgtgaggct

SEQ ID NO: 638464 - DNA, 14 bp, Homo sapiens
tgctgtgaaacagt

SEQ ID NO: 638465 - DNA, 16 bp, Homo sapiens
tgctgtgaaacagtgt

SEQ ID NO: 638466 - DNA, 18 bp, Homo sapiens
tgctgttgattctttcaa

SEQ ID NO: 638467 - DNA, 16 bp, Homo sapiens
tgctgtttaccgccca

SEQ ID NO: 638468 - DNA, 21 bp, Homo sapiens
tgctgtttaccgcccacccag

SEQ ID NO: 638469 - DNA, 16 bp, Homo sapiens
tgcttaatctagagct

SEQ ID NO: 638470 - DNA, 17 bp, Homo sapiens
tgcttaatctagagcta

SEQ ID NO: 638471 - DNA, 23 bp, Homo sapiens
tgcttaatctagagctatgcaca

SEQ ID NO: 638472 - DNA, 14 bp, Homo sapiens
tgcttacagtgact

SEQ ID NO: 638473 - DNA, 15 bp, Homo sapiens
tgcttacagtgactg

SEQ ID NO: 638474 - DNA, 20 bp, Homo sapiens
tgcttagtgtcccttacctg

SEQ ID NO: 638475 - DNA, 21 bp, Homo sapiens
tgcttcaaggatcctgagcca

SEQ ID NO: 638476 - DNA, 22 bp, Homo sapiens
tgcttcacacaaagtgaaatta

SEQ ID NO: 638477 - DNA, 15 bp, Homo sapiens
tgcttcattaaaaca

SEQ ID NO: 638478 - DNA, 16 bp, Homo sapiens
tgcttcattaaaacaa

SEQ ID NO: 638479 - DNA, 16 bp, Homo sapiens
tgcttctactccatgg

SEQ ID NO: 638480 - DNA, 23 bp, Homo sapiens
tgcttctactccatggtgaactg

SEQ ID NO: 638481 - DNA, 22 bp, Homo sapiens
tgcttgagcatgcccaaatata

SEQ ID NO: 638482 - DNA, 18 bp, Homo sapiens
tgcttgaggccaaatgag

SEQ ID NO: 638483 - DNA, 17 bp, Homo sapiens
tgctttcagtgcctgct

SEQ ID NO: 638484 - DNA, 12 bp, Homo sapiens
tgctttcatcca

SEQ ID NO: 638485 - DNA, 14 bp, Homo sapiens
tgctttcatccagc

SEQ ID NO: 638486 - DNA, 16 bp, Homo sapiens
tgctttccctgaggaa

SEQ ID NO: 638487 - DNA, 22 bp, Homo sapiens
tgctttctccatttatttaaaa

SEQ ID NO: 638488 - DNA, 16 bp, Homo sapiens
tgcttttgatggctat

SEQ ID NO: 638489 - DNA, 19 bp, Homo sapiens
tgcttttgatggctatgtt

SEQ ID NO: 638490 - DNA, 13 bp, Homo sapiens
tggaaagggtgtg

SEQ ID NO: 638491 - DNA, 16 bp, Homo sapiens
tggaaagggtgtggct

SEQ ID NO: 638492 - DNA, 22 bp, Homo sapiens
tggaaagggtgtggcttggaac

SEQ ID NO: 638493 - DNA, 23 bp, Homo sapiens
tggaaatttgtgtgcttcacaca

SEQ ID NO: 638494 - DNA, 14 bp, Homo sapiens
tggaacagccctgc

SEQ ID NO: 638495 - DNA, 15 bp, Homo sapiens
tggaacagccctgca

SEQ ID NO: 638496 - DNA, 18 bp, Homo sapiens
tggaagaagggccaccct

SEQ ID NO: 638497 - DNA, 17 bp, Homo sapiens
tggaagacaaatacaca

SEQ ID NO: 638498 - DNA, 22 bp, Homo sapiens
tggaagagctgctgtatttgag

SEQ ID NO: 638499 - DNA, 13 bp, Homo sapiens
tggaagcagcaag

SEQ ID NO: 638500 - DNA, 19 bp, Homo sapiens
tggaagcagcaaggtgggg

SEQ ID NO: 638501 - DNA, 22 bp, Homo sapiens
tggaaggctttattcttccaag

SEQ ID NO: 638502 - DNA, 18 bp, Homo sapiens
tggaagggccttctccac

SEQ ID NO: 638503 - DNA, 16 bp, Homo sapiens
tggaagttttacttga

SEQ ID NO: 638504 - DNA, 13 bp, Homo sapiens
tggaatcacagcc

SEQ ID NO: 638505 - DNA, 19 bp, Homo sapiens
tggaatgcaatttgacttg

SEQ ID NO: 638506 - DNA, 19 bp, Homo sapiens
tggaattacataacaggca

SEQ ID NO: 638507 - DNA, 19 bp, Homo sapiens
tggaattattagcaccagc

SEQ ID NO: 638508 - DNA, 15 bp, Homo sapiens
tggaattttttcctg

SEQ ID NO: 638509 - DNA, 23 bp, Homo sapiens
tggaattttttcctgctagtgta

SEQ ID NO: 638510 - DNA, 22 bp, Homo sapiens
tggacagtgcctaactccttac

SEQ ID NO: 638511 - DNA, 16 bp, Homo sapiens
tggacatttatgtaca

SEQ ID NO: 638512 - DNA, 17 bp, Homo sapiens
tggacatttatgtacaa

SEQ ID NO: 638513 - DNA, 14 bp, Homo sapiens
tggaccagttccct

SEQ ID NO: 638514 - DNA, 16 bp, Homo sapiens
tggacgtgggctccag

SEQ ID NO: 638515 - DNA, 16 bp, Homo sapiens
tggagaccctgcgccc

SEQ ID NO: 638516 - DNA, 15 bp, Homo sapiens
tggagactaacttat

SEQ ID NO: 638517 - DNA, 19 bp, Homo sapiens
tggagactaacttattttg

SEQ ID NO: 638518 - DNA, 15 bp, Homo sapiens
tggagagagaggctg

SEQ ID NO: 638519 - DNA, 14 bp, Homo sapiens
tggagatggatcct

SEQ ID NO: 638520 - DNA, 14 bp, Homo sapiens
tggagatgggaagg

SEQ ID NO: 638521 - DNA, 17 bp, Homo sapiens
tggagcagagacggcag

SEQ ID NO: 638522 - DNA, 19 bp, Homo sapiens
tggagccagggcagaggaa

SEQ ID NO: 638523 - DNA, 22 bp, Homo sapiens
tggagccagggcagaggaatgt

SEQ ID NO: 638524 - DNA, 12 bp, Homo sapiens
tggagccccctg

SEQ ID NO: 638525 - DNA, 17 bp, Homo sapiens
tggagccccctggcggc

SEQ ID NO: 638526 - DNA, 18 bp, Homo sapiens
tggagccccctggcggca

SEQ ID NO: 638527 - DNA, 19 bp, Homo sapiens
tggagccccctggcggcag

SEQ ID NO: 638528 - DNA, 17 bp, Homo sapiens
tggagcctgggcagcac

SEQ ID NO: 638529 - DNA, 21 bp, Homo sapiens
tggagctgaggactctcacga

SEQ ID NO: 638530 - DNA, 20 bp, Homo sapiens
tggagcttggagccccctgg

SEQ ID NO: 638531 - DNA, 21 bp, Homo sapiens
tggagcttggagccccctggc

SEQ ID NO: 638532 - DNA, 15 bp, Homo sapiens
tggaggagaaggagg

SEQ ID NO: 638533 - DNA, 17 bp, Homo sapiens
tggaggagaaggaggaa

SEQ ID NO: 638534 - DNA, 12 bp, Homo sapiens
tggaggctgctg

SEQ ID NO: 638535 - DNA, 22 bp, Homo sapiens
tggaggctgctgccccctggct

SEQ ID NO: 638536 - DNA, 23 bp, Homo sapiens
tggaggctgctgccccctggctt

SEQ ID NO: 638537 - DNA, 14 bp, Homo sapiens
tggagtagagtcag

SEQ ID NO: 638538 - DNA, 19 bp, Homo sapiens
tggagtctgaaggagagga

SEQ ID NO: 638539 - DNA, 20 bp, Homo sapiens
tggagtctgaaggagaggag

SEQ ID NO: 638540 - DNA, 23 bp, Homo sapiens
tggagtctgaaggagaggagtgc

SEQ ID NO: 638541 - DNA, 11 bp, Homo sapiens
tggagtggagg

SEQ ID NO: 638542 - DNA, 23 bp, Homo sapiens
tggatacgggggttccctttccc

SEQ ID NO: 638543 - DNA, 14 bp, Homo sapiens
tggataggagagga

SEQ ID NO: 638544 - DNA, 20 bp, Homo sapiens
tggatatgaaagagaaaatg

SEQ ID NO: 638545 - DNA, 20 bp, Homo sapiens
tggatcaggaacccttacag

SEQ ID NO: 638546 - DNA, 22 bp, Homo sapiens
tggatcaggaacccttacagta

SEQ ID NO: 638547 - DNA, 22 bp, Homo sapiens
tggatcgtggaagaagggccac

SEQ ID NO: 638548 - DNA, 17 bp, Homo sapiens
tggatgtaatatagggt

SEQ ID NO: 638549 - DNA, 14 bp, Homo sapiens
tggatgtcccttcc

SEQ ID NO: 638550 - DNA, 11 bp, Homo sapiens
tggattgtttt

SEQ ID NO: 638551 - DNA, 14 bp, Homo sapiens
tggatttcctttga

SEQ ID NO: 638552 - DNA, 17 bp, Homo sapiens
tggatttgacacactca

SEQ ID NO: 638553 - DNA, 23 bp, Homo sapiens
tggatttgacacactcaccattt

SEQ ID NO: 638554 - DNA, 18 bp, Homo sapiens
tggattttaaacaaaatt

SEQ ID NO: 638555 - DNA, 19 bp, Homo sapiens
tggattttaaacaaaattt

SEQ ID NO: 638556 - DNA, 23 bp, Homo sapiens
tggattttaaacaaaatttatgt

SEQ ID NO: 638557 - DNA, 20 bp, Homo sapiens
tggcaacgttcatgttcatc

SEQ ID NO: 638558 - DNA, 11 bp, Homo sapiens
tggcagcagat

SEQ ID NO: 638559 - DNA, 20 bp, Homo sapiens
tggcagggaagggtgcctgg

SEQ ID NO: 638560 - DNA, 11 bp, Homo sapiens
tggcagtattg

SEQ ID NO: 638561 - DNA, 22 bp, Homo sapiens
tggcagtgcagcaaccagagca

SEQ ID NO: 638562 - DNA, 23 bp, Homo sapiens
tggcagtgtgtcacactgagctg

SEQ ID NO: 638563 - DNA, 20 bp, Homo sapiens
tggcatcctggcttgcctcc

SEQ ID NO: 638564 - DNA, 19 bp, Homo sapiens
tggcatttagcacagtatt

SEQ ID NO: 638565 - DNA, 12 bp, Homo sapiens
tggcatttgcag

SEQ ID NO: 638566 - DNA, 15 bp, Homo sapiens
tggcatttgctgaat

SEQ ID NO: 638567 - DNA, 23 bp, Homo sapiens
tggccacctgccaggcctccctc

SEQ ID NO: 638568 - DNA, 17 bp, Homo sapiens
tatatctgaaaactgga

SEQ ID NO: 638569 - DNA, 18 bp, Homo sapiens
tatatctgaaaactggaa

SEQ ID NO: 638570 - DNA, 14 bp, Homo sapiens
tatatgtaacttca

SEQ ID NO: 638571 - DNA, 16 bp, Homo sapiens
tatatgtaacttcaga

SEQ ID NO: 638572 - DNA, 21 bp, Homo sapiens
tatatgtaacttcagatgttt

SEQ ID NO: 638573 - DNA, 15 bp, Homo sapiens
tatatgtatatctgt

SEQ ID NO: 638574 - DNA, 22 bp, Homo sapiens
tatatgtatatttaccaagatt

SEQ ID NO: 638575 - DNA, 14 bp, Homo sapiens
tatatgtgaacttt

SEQ ID NO: 638576 - DNA, 17 bp, Homo sapiens
tatatgtttatacacac

SEQ ID NO: 638577 - DNA, 19 bp, Homo sapiens
tatatgtttatacacacag

SEQ ID NO: 638578 - DNA, 16 bp, Homo sapiens
tatatgtttggctgaa

SEQ ID NO: 638579 - DNA, 22 bp, Homo sapiens
tatatgtttggctgaaattatg

SEQ ID NO: 638580 - DNA, 15 bp, Homo sapiens
tatatttattatttt

SEQ ID NO: 638581 - DNA, 16 bp, Homo sapiens
tatcaaaaaacagaaa

SEQ ID NO: 638582 - DNA, 20 bp, Homo sapiens
tatcaaaaaacagaaaaaca

SEQ ID NO: 638583 - DNA, 17 bp, Homo sapiens
tatcacaccagttactt

SEQ ID NO: 638584 - DNA, 20 bp, Homo sapiens
tatcacagtctaatttttat

SEQ ID NO: 638585 - DNA, 13 bp, Homo sapiens
tatcagaactcct

SEQ ID NO: 638586 - DNA, 17 bp, Homo sapiens
tatcagctctaaagcag

SEQ ID NO: 638587 - DNA, 16 bp, Homo sapiens
tatcagggcaagctca

SEQ ID NO: 638588 - DNA, 24 bp, Homo sapiens
tatcagggcaagctcatagcacat

SEQ ID NO: 638589 - DNA, 19 bp, Homo sapiens
tatcagtacaattctttgt

SEQ ID NO: 638590 - DNA, 22 bp, Homo sapiens
tatcagttacagtggcagtatt

SEQ ID NO: 638591 - DNA, 20 bp, Homo sapiens
tatcatccccaaatgtgtct

SEQ ID NO: 638592 - DNA, 17 bp, Homo sapiens
tatcatctaaatattat

SEQ ID NO: 638593 - DNA, 17 bp, Homo sapiens
tatcattatagcatgta

SEQ ID NO: 638594 - DNA, 16 bp, Homo sapiens
tatcattgtttgtcct

SEQ ID NO: 638595 - DNA, 12 bp, Homo sapiens
tatccctggcca

SEQ ID NO: 638596 - DNA, 15 bp, Homo sapiens
tatccctggccacct

SEQ ID NO: 638597 - DNA, 15 bp, Homo sapiens
tattttgtgtccttt

SEQ ID NO: 638598 - DNA, 17 bp, Homo sapiens
tatttttgctctccctc

SEQ ID NO: 638599 - DNA, 18 bp, Homo sapiens
tatttttgctctccctcc

SEQ ID NO: 638600 - DNA, 22 bp, Homo sapiens
tcaaaaaacagaaaaacaaaaa

SEQ ID NO: 638601 - DNA, 19 bp, Homo sapiens
tcaaaaaccattacaaaat

SEQ ID NO: 638602 - DNA, 14 bp, Homo sapiens
tcaaacaaatcatt

SEQ ID NO: 638603 - DNA, 13 bp, Homo sapiens
tcaaacactgctt

SEQ ID NO: 638604 - DNA, 15 bp, Homo sapiens
tcaaacagtgtggct

SEQ ID NO: 638605 - DNA, 20 bp, Homo sapiens
tcaaagaacccccctcccca

SEQ ID NO: 638606 - DNA, 19 bp, Homo sapiens
tcaaagaggccagtacttt

SEQ ID NO: 638607 - DNA, 13 bp, Homo sapiens
tcaaatctgcttt

SEQ ID NO: 638608 - DNA, 21 bp, Homo sapiens
tcaaatggtattttttgtgaa

SEQ ID NO: 638609 - DNA, 18 bp, Homo sapiens
tcaaatgttattcaataa

SEQ ID NO: 638610 - DNA, 16 bp, Homo sapiens
tcaaatttttctggga

SEQ ID NO: 638611 - DNA, 18 bp, Homo sapiens
tcaacaaagaaatattat

SEQ ID NO: 638612 - DNA, 11 bp, Homo sapiens
tcaacacacag

SEQ ID NO: 638613 - DNA, 13 bp, Homo sapiens
tcaaccctgccct

SEQ ID NO: 638614 - DNA, 17 bp, Homo sapiens
tcaagaagatagttgta

SEQ ID NO: 638615 - DNA, 18 bp, Homo sapiens
tcaagccaggagaccctg

SEQ ID NO: 638616 - DNA, 19 bp, Homo sapiens
tcaagccaggagaccctgt

SEQ ID NO: 638617 - DNA, 17 bp, Homo sapiens
tcaaggatcctgagcca

SEQ ID NO: 638618 - DNA, 19 bp, Homo sapiens
tcaaggatcctgagccaga

SEQ ID NO: 638619 - DNA, 20 bp, Homo sapiens
tcaaggatcctgagccagat

SEQ ID NO: 638620 - DNA, 12 bp, Homo sapiens
tcaagtctgtga

SEQ ID NO: 638621 - DNA, 15 bp, Homo sapiens
tcaagttgtgtgcta

SEQ ID NO: 638622 - DNA, 23 bp, Homo sapiens
tcaataacaacagtttttatgtt

SEQ ID NO: 638623 - DNA, 17 bp, Homo sapiens
tcaataggaaaaactga

SEQ ID NO: 638624 - DNA, 19 bp, Homo sapiens
tcaataggaaaaactgatt

SEQ ID NO: 638625 - DNA, 21 bp, Homo sapiens
tcaatcattttgggaaattct

SEQ ID NO: 638626 - DNA, 13 bp, Homo sapiens
tcaatccacagta

SEQ ID NO: 638627 - DNA, 18 bp, Homo sapiens
tcaatccacagtattgtt

SEQ ID NO: 638628 - DNA, 12 bp, Homo sapiens
tcaatccccata

SEQ ID NO: 638629 - DNA, 19 bp, Homo sapiens
tcaatgtgctgttgattct

SEQ ID NO: 638630 - DNA, 16 bp, Homo sapiens
tcaatgttaaatctac

SEQ ID NO: 638631 - DNA, 14 bp, Homo sapiens
tcaattatcttgga

SEQ ID NO: 638632 - DNA, 23 bp, Homo sapiens
tcaattatcttggaaaaatgcgt

SEQ ID NO: 638633 - DNA, 19 bp, Homo sapiens
tcaattgggttttgatctc

SEQ ID NO: 638634 - DNA, 17 bp, Homo sapiens
tcaatttaaaggaaagt

SEQ ID NO: 638635 - DNA, 11 bp, Homo sapiens
tcaatttctcc

SEQ ID NO: 638636 - DNA, 18 bp, Homo sapiens
tcacaaagctatttaagt

SEQ ID NO: 638637 - DNA, 12 bp, Homo sapiens
tcacaactttgc

SEQ ID NO: 638638 - DNA, 12 bp, Homo sapiens
tcacacaaagtg

SEQ ID NO: 638639 - DNA, 22 bp, Homo sapiens
tcacacaactgtggataaattt

SEQ ID NO: 638640 - DNA, 23 bp, Homo sapiens
tcacaccaatttagaatgaatat

SEQ ID NO: 638641 - DNA, 17 bp, Homo sapiens
tcacaccactgccattt

SEQ ID NO: 638642 - DNA, 16 bp, Homo sapiens
tcacaccttacaaagc

SEQ ID NO: 638643 - DNA, 23 bp, Homo sapiens
tcacaccttacaaagccagctct

SEQ ID NO: 638644 - DNA, 19 bp, Homo sapiens
tcacactctcttcttactg

SEQ ID NO: 638645 - DNA, 15 bp, Homo sapiens
tcacacttgggctgg

SEQ ID NO: 638646 - DNA, 19 bp, Homo sapiens
tcacacttgggctggcacc

SEQ ID NO: 638647 - DNA, 19 bp, Homo sapiens
tcacagcacatttgttaat

SEQ ID NO: 638648 - DNA, 13 bp, Homo sapiens
tcacagcctctcc

SEQ ID NO: 638649 - DNA, 22 bp, Homo sapiens
tcacagcctttgcgctctgggt

SEQ ID NO: 638650 - DNA, 15 bp, Homo sapiens
tcacagtctaatttt

SEQ ID NO: 638651 - DNA, 16 bp, Homo sapiens
tcacagtctaattttt

SEQ ID NO: 638652 - DNA, 21 bp, Homo sapiens
tcacagtctaatttttattca

SEQ ID NO: 638653 - DNA, 21 bp, Homo sapiens
tcacagtgggcggcttccctg

SEQ ID NO: 638654 - DNA, 12 bp, Homo sapiens
tcacatctgtat

SEQ ID NO: 638655 - DNA, 14 bp, Homo sapiens
tcacattcctgacc

SEQ ID NO: 638656 - DNA, 23 bp, Homo sapiens
tcaccatttaatcatttccagca

SEQ ID NO: 638657 - DNA, 21 bp, Homo sapiens
tcaccctgaattcattgtctc

SEQ ID NO: 638658 - DNA, 16 bp, Homo sapiens
tcacctaattaatttc

SEQ ID NO: 638659 - DNA, 17 bp, Homo sapiens
tcacctaattaatttca

SEQ ID NO: 638660 - DNA, 17 bp, Homo sapiens
tcacctctgaggacaga

SEQ ID NO: 638661 - DNA, 13 bp, Homo sapiens
tcacctgaaatgc

SEQ ID NO: 638662 - DNA, 15 bp, Homo sapiens
tcaccttctgtgcat

SEQ ID NO: 638663 - DNA, 14 bp, Homo sapiens
tcaccttctgtttt

SEQ ID NO: 638664 - DNA, 15 bp, Homo sapiens
tcacgcaacttgaaa

SEQ ID NO: 638665 - DNA, 22 bp, Homo sapiens
tcacgtctgtgagtctgtcctt

SEQ ID NO: 638666 - DNA, 22 bp, Homo sapiens
tcacgtgaggcccctgtgcagt

SEQ ID NO: 638667 - DNA, 20 bp, Homo sapiens
tcacgtggtcaaggcccggc

SEQ ID NO: 638668 - DNA, 15 bp, Homo sapiens
tcactacatgggcca

SEQ ID NO: 638669 - DNA, 14 bp, Homo sapiens
tcactccactcccc

SEQ ID NO: 638670 - DNA, 20 bp, Homo sapiens
tcactccactcccctcatcc

SEQ ID NO: 638671 - DNA, 22 bp, Homo sapiens
tcactgctacaccttagcagct

SEQ ID NO: 638672 - DNA, 14 bp, Homo sapiens
tcactgtgacctgc

SEQ ID NO: 638673 - DNA, 17 bp, Homo sapiens
tcactgtgacctgctcc

SEQ ID NO: 638674 - DNA, 22 bp, Homo sapiens
tcaggaatgggccaagccaggg

SEQ ID NO: 638675 - DNA, 15 bp, Homo sapiens
tcaggaccattttag

SEQ ID NO: 638676 - DNA, 18 bp, Homo sapiens
tcaggaccattttagaag

SEQ ID NO: 638677 - DNA, 14 bp, Homo sapiens
tcaggagcacagcc

SEQ ID NO: 638678 - DNA, 16 bp, Homo sapiens
tcaggagcacagccat

SEQ ID NO: 638679 - DNA, 22 bp, Homo sapiens
tcaggagcacagccatagcaga

SEQ ID NO: 638680 - DNA, 21 bp, Homo sapiens
tcaggaggggtgttaaaacat

SEQ ID NO: 638681 - DNA, 23 bp, Homo sapiens
tcaggattctcctttttacccct

SEQ ID NO: 638682 - DNA, 16 bp, Homo sapiens
tcaggctctgaatctc

SEQ ID NO: 638683 - DNA, 15 bp, Homo sapiens
tcagggaccaaggag

SEQ ID NO: 638684 - DNA, 23 bp, Homo sapiens
tcagggcaagctcatagcacatg

SEQ ID NO: 638685 - DNA, 14 bp, Homo sapiens
tcagggctgtgctt

SEQ ID NO: 638686 - DNA, 16 bp, Homo sapiens
tcaggtgcgtgccaca

SEQ ID NO: 638687 - DNA, 19 bp, Homo sapiens
tcagtagcattttaatagt

SEQ ID NO: 638688 - DNA, 20 bp, Homo sapiens
tcagtagcattttaatagtt

SEQ ID NO: 638689 - DNA, 18 bp, Homo sapiens
tcagtagtgcctgtgatc

SEQ ID NO: 638690 - DNA, 16 bp, Homo sapiens
tcagtatcttaaaatt

SEQ ID NO: 638691 - DNA, 20 bp, Homo sapiens
tcagtatgctttccctgagg

SEQ ID NO: 638692 - DNA, 15 bp, Homo sapiens
tcagtattgagacac

SEQ ID NO: 638693 - DNA, 24 bp, Homo sapiens
tcagtattgttttggtttgctact

SEQ ID NO: 638694 - DNA, 22 bp, Homo sapiens
tcagtccacccccattgtgaat

SEQ ID NO: 638695 - DNA, 15 bp, Homo sapiens
tcagtctatgctgtg

SEQ ID NO: 638696 - DNA, 18 bp, Homo sapiens
tcagtgaagcccaggagg

SEQ ID NO: 638697 - DNA, 10 bp, Homo sapiens
tcagtgcctt

SEQ ID NO: 638698 - DNA, 15 bp, Homo sapiens
tcagtggacatttgt

SEQ ID NO: 638699 - DNA, 13 bp, Homo sapiens
tcagtgttataaa

SEQ ID NO: 638700 - DNA, 14 bp, Homo sapiens
tcagttacagtggc

SEQ ID NO: 638701 - DNA, 15 bp, Homo sapiens
tcagttataatttca

SEQ ID NO: 638702 - DNA, 17 bp, Homo sapiens
tcagttggcctctgccc

SEQ ID NO: 638703 - DNA, 14 bp, Homo sapiens
tcagtttgtgaagt

SEQ ID NO: 638704 - DNA, 21 bp, Homo sapiens
tcataaagagcacgttttcca

SEQ ID NO: 638705 - DNA, 13 bp, Homo sapiens
tcataaattcaaa

SEQ ID NO: 638706 - DNA, 24 bp, Homo sapiens
tcataaattcaaacctaagttgct

SEQ ID NO: 638707 - DNA, 18 bp, Homo sapiens
tcataagccaatttttct

SEQ ID NO: 638708 - DNA, 20 bp, Homo sapiens
tcataagccaatttttctgc

SEQ ID NO: 638709 - DNA, 21 bp, Homo sapiens
tcataagccaatttttctgca

SEQ ID NO: 638710 - DNA, 18 bp, Homo sapiens
tcatacaaattttcccag

SEQ ID NO: 638711 - DNA, 11 bp, Homo sapiens
tcatacacaga

SEQ ID NO: 638712 - DNA, 14 bp, Homo sapiens
tcatacacagaaat

SEQ ID NO: 638713 - DNA, 20 bp, Homo sapiens
tcatacacagaaatcctaac

SEQ ID NO: 638714 - DNA, 22 bp, Homo sapiens
tcatacgttgatagtttacaaa

SEQ ID NO: 638715 - DNA, 13 bp, Homo sapiens
tcatactcaaaga

SEQ ID NO: 638716 - DNA, 14 bp, Homo sapiens
tcatactctagatt

SEQ ID NO: 638717 - DNA, 23 bp, Homo sapiens
tcatactctagattttgttttgc

SEQ ID NO: 638718 - DNA, 14 bp, Homo sapiens
tcatagataccatt

SEQ ID NO: 638719 - DNA, 17 bp, Homo sapiens
tcatagcatagccagca

SEQ ID NO: 638720 - DNA, 18 bp, Homo sapiens
tcatagtcaatcaaacag

SEQ ID NO: 638721 - DNA, 20 bp, Homo sapiens
tcatatcctctcgttcagtt

SEQ ID NO: 638722 - DNA, 22 bp, Homo sapiens
tcatattcataccttctgatga

SEQ ID NO: 638723 - DNA, 24 bp, Homo sapiens
tcatattttcctttatgtgatgta

SEQ ID NO: 638724 - DNA, 15 bp, Homo sapiens
tcatcctgccttcat

SEQ ID NO: 638725 - DNA, 23 bp, Homo sapiens
tcatcctgccttcatggaactca

SEQ ID NO: 638726 - DNA, 19 bp, Homo sapiens
tcatctacacatataaaca

SEQ ID NO: 638727 - DNA, 13 bp, Homo sapiens
tcatctagtttta

SEQ ID NO: 638728 - DNA, 16 bp, Homo sapiens
tcatctcaaacactgc

SEQ ID NO: 638729 - DNA, 18 bp, Homo sapiens
tcatctcaaacactgctt

SEQ ID NO: 638730 - DNA, 20 bp, Homo sapiens
tcatctcaaacactgcttaa

SEQ ID NO: 638731 - DNA, 21 bp, Homo sapiens
tcatctcaggtggcatttgca

SEQ ID NO: 638732 - DNA, 18 bp, Homo sapiens
tcatctgaggagtccaaa

SEQ ID NO: 638733 - DNA, 22 bp, Homo sapiens
tcatctgaggagtccaaaatat

SEQ ID NO: 638734 - DNA, 20 bp, Homo sapiens
tcatctgtaaaaccaggctg

SEQ ID NO: 638735 - DNA, 21 bp, Homo sapiens
tcatcttgtaaataatgctta

SEQ ID NO: 638736 - DNA, 13 bp, Homo sapiens
tcatgaccttaca

SEQ ID NO: 638737 - DNA, 13 bp, Homo sapiens
tcatgatgctagt

SEQ ID NO: 638738 - DNA, 18 bp, Homo sapiens
tcatgatgctagttctta

SEQ ID NO: 638739 - DNA, 14 bp, Homo sapiens
tcatgcatagacaa

SEQ ID NO: 638740 - DNA, 23 bp, Homo sapiens
tcatgcctttatttctgtatctg

SEQ ID NO: 638741 - DNA, 17 bp, Homo sapiens
tcatgcttctactccat

SEQ ID NO: 638742 - DNA, 16 bp, Homo sapiens
tcatggaatgcaattt

SEQ ID NO: 638743 - DNA, 16 bp, Homo sapiens
tcatgtgcgaacacag

SEQ ID NO: 638744 - DNA, 14 bp, Homo sapiens
ttcagatgtttcca

SEQ ID NO: 638745 - DNA, 19 bp, Homo sapiens
ttcagatgtttccaagatg

SEQ ID NO: 638746 - DNA, 13 bp, Homo sapiens
ttcaggaaatttt

SEQ ID NO: 638747 - DNA, 14 bp, Homo sapiens
ttcaggaaattttt

SEQ ID NO: 638748 - DNA, 21 bp, Homo sapiens
ttcagggagggctgttcaagt

SEQ ID NO: 638749 - DNA, 22 bp, Homo sapiens
ttcagtcacttgtttgtgtttg

SEQ ID NO: 638750 - DNA, 13 bp, Homo sapiens
ttcagtgcctgct

SEQ ID NO: 638751 - DNA, 12 bp, Homo sapiens
ttcagtgcctta

SEQ ID NO: 638752 - DNA, 18 bp, Homo sapiens
ttcagtgccttatggaac

SEQ ID NO: 638753 - DNA, 19 bp, Homo sapiens
ttcagtgccttatggaaca

SEQ ID NO: 638754 - DNA, 21 bp, Homo sapiens
ttcagtggacatttgttctgg

SEQ ID NO: 638755 - DNA, 20 bp, Homo sapiens
ttcagttataatttcaattt

SEQ ID NO: 638756 - DNA, 19 bp, Homo sapiens
ttcagttctcatcttgtaa

SEQ ID NO: 638757 - DNA, 14 bp, Homo sapiens
ttcagttgacacat

SEQ ID NO: 638758 - DNA, 22 bp, Homo sapiens
ttcataagccaatttttctgca

SEQ ID NO: 638759 - DNA, 17 bp, Homo sapiens
ttcatactctagatttt

SEQ ID NO: 638760 - DNA, 13 bp, Homo sapiens
ttcatataatttg

SEQ ID NO: 638761 - DNA, 23 bp, Homo sapiens
ttcatataggggcaaaaatttga

SEQ ID NO: 638762 - DNA, 18 bp, Homo sapiens
ttcatccagccactgccc

SEQ ID NO: 638763 - DNA, 12 bp, Homo sapiens
ttcatcctctta

SEQ ID NO: 638764 - DNA, 15 bp, Homo sapiens
ttcatctgaggagtc

SEQ ID NO: 638765 - DNA, 18 bp, Homo sapiens
ttcatctgaggagtccaa

SEQ ID NO: 638766 - DNA, 19 bp, Homo sapiens
ttcatctgaggagtccaaa

SEQ ID NO: 638767 - DNA, 15 bp, Homo sapiens
ttcatgattagacaa

SEQ ID NO: 638768 - DNA, 18 bp, Homo sapiens
ttcatgattagacaatgt

SEQ ID NO: 638769 - DNA, 14 bp, Homo sapiens
ttcatgctttctcc

SEQ ID NO: 638770 - DNA, 15 bp, Homo sapiens
ttcatgcttttctca

SEQ ID NO: 638771 - DNA, 17 bp, Homo sapiens
tttgatatcacagtcta

SEQ ID NO: 638772 - DNA, 19 bp, Homo sapiens
tttgatatgttgatgaaat

SEQ ID NO: 638773 - DNA, 13 bp, Homo sapiens
tttgatctggtgc

SEQ ID NO: 638774 - DNA, 21 bp, Homo sapiens
tttgatctggtgcgtgtggcc

SEQ ID NO: 638775 - DNA, 18 bp, Homo sapiens
tttgatgaataaaatgtt

SEQ ID NO: 638776 - DNA, 17 bp, Homo sapiens
tttgatttatcaatatt

SEQ ID NO: 638777 - DNA, 18 bp, Homo sapiens
tttgatttgatatacaga

SEQ ID NO: 638778 - DNA, 23 bp, Homo sapiens
tttgcaacactgccaaacatcag

SEQ ID NO: 638779 - DNA, 14 bp, Homo sapiens
tttgccaacattgc

SEQ ID NO: 638780 - DNA, 21 bp, Homo sapiens
tttgccaatgaactctttccc

SEQ ID NO: 638781 - DNA, 12 bp, Homo sapiens
tttgctttttct

SEQ ID NO: 638782 - DNA, 13 bp, Homo sapiens
tttggaagaaagg

SEQ ID NO: 638783 - DNA, 14 bp, Homo sapiens
tttggaagcagcaa

SEQ ID NO: 638784 - DNA, 16 bp, Homo sapiens
tttggacgtgtgagga

SEQ ID NO: 638785 - DNA, 16 bp, Homo sapiens
tttggattttaaacaa

SEQ ID NO: 638786 - DNA, 11 bp, Homo sapiens
tttggccctgg

SEQ ID NO: 638787 - DNA, 16 bp, Homo sapiens
tttggccctggagcca

SEQ ID NO: 638788 - DNA, 19 bp, Homo sapiens
tttggcgccccatgggccc

SEQ ID NO: 638789 - DNA, 21 bp, Homo sapiens
tttgggcctccatgccccagc

SEQ ID NO: 638790 - DNA, 18 bp, Homo sapiens
tttgggggacgcccagcc

SEQ ID NO: 638791 - DNA, 16 bp, Homo sapiens
tttggtaactcatttg

SEQ ID NO: 638792 - DNA, 22 bp, Homo sapiens
tttggtatgaaacaaatatact

SEQ ID NO: 638793 - DNA, 13 bp, Homo sapiens
tttggtggctcta

SEQ ID NO: 638794 - DNA, 15 bp, Homo sapiens
tttggttcctcatgg

SEQ ID NO: 638795 - DNA, 19 bp, Homo sapiens
tttgtaatataagacaagt

SEQ ID NO: 638796 - DNA, 20 bp, Homo sapiens
tttgtacgttaattaaacaa

SEQ ID NO: 638797 - DNA, 22 bp, Homo sapiens
tttgtagctagtttaaaattat

SEQ ID NO: 638798 - DNA, 23 bp, Homo sapiens
tttgtagctagtttaaaattatt

SEQ ID NO: 638799 - DNA, 20 bp, Homo sapiens
tttgtgaaagtggcaagctc

SEQ ID NO: 638800 - DNA, 14 bp, Homo sapiens
tttgtgaagtgatt

SEQ ID NO: 638801 - DNA, 18 bp, Homo sapiens
tttgtgaagtgattgaca

SEQ ID NO: 638802 - DNA, 19 bp, Homo sapiens
tttgtgaagtgattgacat

SEQ ID NO: 638803 - DNA, 20 bp, Homo sapiens
tttgtgaagtgattgacatt

SEQ ID NO: 638804 - DNA, 21 bp, Homo sapiens
tgacagtagcatactgatgag

SEQ ID NO: 638805 - DNA, 17 bp, Homo sapiens
tgacagtggttatattt

SEQ ID NO: 638806 - DNA, 20 bp, Homo sapiens
tgacagtggttatatttcaa

SEQ ID NO: 638807 - DNA, 20 bp, Homo sapiens
tgacagttacttacacacct

SEQ ID NO: 638808 - DNA, 13 bp, Homo sapiens
tgacatggtgctg

SEQ ID NO: 638809 - DNA, 15 bp, Homo sapiens
tgacatgtacagaga

SEQ ID NO: 638810 - DNA, 12 bp, Homo sapiens
tgacattccaca

SEQ ID NO: 638811 - DNA, 15 bp, Homo sapiens
tgacattgtcagaat

SEQ ID NO: 638812 - DNA, 21 bp, Homo sapiens
tgacattgtcagaatgttgtg

SEQ ID NO: 638813 - DNA, 20 bp, Homo sapiens
tgacattttgtagctagttt

SEQ ID NO: 638814 - DNA, 13 bp, Homo sapiens
tgaccataaaatt

SEQ ID NO: 638815 - DNA, 13 bp, Homo sapiens
tgaccccacacgc

SEQ ID NO: 638816 - DNA, 14 bp, Homo sapiens
tgaccccacacgcc

SEQ ID NO: 638817 - DNA, 13 bp, Homo sapiens
tgacccgtacaca

SEQ ID NO: 638818 - DNA, 19 bp, Homo sapiens
tgaccctcaattcatattt

SEQ ID NO: 638819 - DNA, 12 bp, Homo sapiens
tgaccctcactt

SEQ ID NO: 638820 - DNA, 21 bp, Homo sapiens
tgaccctcacttttctcatct

SEQ ID NO: 638821 - DNA, 15 bp, Homo sapiens
tgaccctcctgtcca

SEQ ID NO: 638822 - DNA, 16 bp, Homo sapiens
tgaccctcctgtccag

SEQ ID NO: 638823 - DNA, 21 bp, Homo sapiens
tgaccctgaaatattttctac

SEQ ID NO: 638824 - DNA, 15 bp, Homo sapiens
tgacctaccctggac

SEQ ID NO: 638825 - DNA, 16 bp, Homo sapiens
tgaccttcggcagtgg

SEQ ID NO: 638826 - DNA, 18 bp, Homo sapiens
tgaccttcggcagtggct

SEQ ID NO: 638827 - DNA, 20 bp, Homo sapiens
tgaccttcggcagtggctgg

SEQ ID NO: 638828 - DNA, 22 bp, Homo sapiens
tgaccttcggcagtggctgggg

SEQ ID NO: 638829 - DNA, 14 bp, Homo sapiens
tgacctttcaatag

SEQ ID NO: 638830 - DNA, 22 bp, Homo sapiens
tgacctttcaataggaaaaact

SEQ ID NO: 638831 - DNA, 22 bp, Homo sapiens
tgactcagtgcagggacagcct

SEQ ID NO: 638832 - DNA, 18 bp, Homo sapiens
tgactgtgttcagtgcct

SEQ ID NO: 638833 - DNA, 22 bp, Homo sapiens
tgacttcagaaactttttctaa

SEQ ID NO: 638834 - DNA, 18 bp, Homo sapiens
tgacttcccagctggcag

SEQ ID NO: 638835 - DNA, 20 bp, Homo sapiens
tgacttctttactaacactg

SEQ ID NO: 638836 - DNA, 20 bp, Homo sapiens
tgactttggagacgatgctt

SEQ ID NO: 638837 - DNA, 20 bp, Homo sapiens
tgactttggggacaccctcc

SEQ ID NO: 638838 - DNA, 18 bp, Homo sapiens
tgagaaatataaaaataa

SEQ ID NO: 638839 - DNA, 15 bp, Homo sapiens
tgagaaatttacaaa

SEQ ID NO: 638840 - DNA, 15 bp, Homo sapiens
tgagaactaaataga

SEQ ID NO: 638841 - DNA, 15 bp, Homo sapiens
tgagacaacacacac

SEQ ID NO: 638842 - DNA, 23 bp, Homo sapiens
tgagacacagcccagagactgaa

SEQ ID NO: 638843 - DNA, 13 bp, Homo sapiens
tgagacactgtca

SEQ ID NO: 638844 - DNA, 14 bp, Homo sapiens
tgagacactgtcaa

SEQ ID NO: 638845 - DNA, 16 bp, Homo sapiens
tgagacactgtcaaga

SEQ ID NO: 638846 - DNA, 16 bp, Homo sapiens
tgagaccagcctgcca

SEQ ID NO: 638847 - DNA, 19 bp, Homo sapiens
tgagacttcctattaattt

SEQ ID NO: 638848 - DNA, 14 bp, Homo sapiens
tgagagcagcctct

SEQ ID NO: 638849 - DNA, 14 bp, Homo sapiens
tgagaggaaatcac

SEQ ID NO: 638850 - DNA, 23 bp, Homo sapiens
tgagagggtgtgggtgccctgtt

SEQ ID NO: 638851 - DNA, 15 bp, Homo sapiens
tgagatgatttaatt

SEQ ID NO: 638852 - DNA, 20 bp, Homo sapiens
tgagattggaaaaaattaga

SEQ ID NO: 638853 - DNA, 21 bp, Homo sapiens
tgagcaaactgaagcccacag

SEQ ID NO: 638854 - DNA, 13 bp, Homo sapiens
tgagcaaggcaag

SEQ ID NO: 638855 - DNA, 21 bp, Homo sapiens
tgagcaaggcaagaagtggga

SEQ ID NO: 638856 - DNA, 20 bp, Homo sapiens
tgagcagacagggcgtcctc

SEQ ID NO: 638857 - DNA, 20 bp, Homo sapiens
tgagcagatcgtgccgtgga

SEQ ID NO: 638858 - DNA, 22 bp, Homo sapiens
tgagcagatcgtgccgtggagc

SEQ ID NO: 638859 - DNA, 21 bp, Homo sapiens
tgagcagtaaatgtatattga

SEQ ID NO: 638860 - DNA, 12 bp, Homo sapiens
tgagcagtgggg

SEQ ID NO: 638861 - DNA, 21 bp, Homo sapiens
tgagcatgcccaaatataaca

SEQ ID NO: 638862 - DNA, 16 bp, Homo sapiens
tgagccacagtggggc

SEQ ID NO: 638863 - DNA, 19 bp, Homo sapiens
tgagccacagtggggccca

SEQ ID NO: 638864 - DNA, 19 bp, Homo sapiens
tgagccagatttcactctc

SEQ ID NO: 638865 - DNA, 20 bp, Homo sapiens
tgagccagatttcactctcc

SEQ ID NO: 638866 - DNA, 21 bp, Homo sapiens
tgagccagatttcactctcct

SEQ ID NO: 638867 - DNA, 13 bp, Homo sapiens
tgagccagcagac

SEQ ID NO: 638868 - DNA, 23 bp, Homo sapiens
tgagcccagaagctcaaggctgc

SEQ ID NO: 638869 - DNA, 13 bp, Homo sapiens
tgagccctgccct

SEQ ID NO: 638870 - DNA, 23 bp, Homo sapiens
tgagccgtgacctccaggaaggg

SEQ ID NO: 638871 - DNA, 19 bp, Homo sapiens
tgagcctgtcacgtggtca

SEQ ID NO: 638872 - DNA, 13 bp, Homo sapiens
tgagcctgtctct

SEQ ID NO: 638873 - DNA, 14 bp, Homo sapiens
tgagcctgtctctc

SEQ ID NO: 638874 - DNA, 14 bp, Homo sapiens
tgagccttattaaa

SEQ ID NO: 638875 - DNA, 21 bp, Homo sapiens
tgagcgttcagttgacacatt

SEQ ID NO: 638876 - DNA, 16 bp, Homo sapiens
tgagctccaccctccc

SEQ ID NO: 638877 - DNA, 17 bp, Homo sapiens
tgagctccaccctcccc

SEQ ID NO: 638878 - DNA, 17 bp, Homo sapiens
tgaggacggggcagagc

SEQ ID NO: 638879 - DNA, 20 bp, Homo sapiens
tgaggacggggcagagctga

SEQ ID NO: 638880 - DNA, 17 bp, Homo sapiens
tgaggaggaggacacag

SEQ ID NO: 638881 - DNA, 20 bp, Homo sapiens
tgaggagttgcctgactcct

SEQ ID NO: 638882 - DNA, 17 bp, Homo sapiens
tgaggatgtatgtgtat

SEQ ID NO: 638883 - DNA, 18 bp, Homo sapiens
tgaggatgtatgtgtata

SEQ ID NO: 638884 - DNA, 22 bp, Homo sapiens
tgaggatgtatgtgtatatgtt

SEQ ID NO: 638885 - DNA, 12 bp, Homo sapiens
tgaggcacatga

SEQ ID NO: 638886 - DNA, 16 bp, Homo sapiens
tgaggcacatgacagt

SEQ ID NO: 638887 - DNA, 20 bp, Homo sapiens
tgaggccaaatgagttccct

SEQ ID NO: 638888 - DNA, 22 bp, Homo sapiens
tgaggccaaatgagttcccttg

SEQ ID NO: 638889 - DNA, 16 bp, Homo sapiens
tggtcttggagaggag

SEQ ID NO: 638890 - DNA, 18 bp, Homo sapiens
tggtgaactgaagcagag

SEQ ID NO: 638891 - DNA, 20 bp, Homo sapiens
tggtgatggaggtttcatac

SEQ ID NO: 638892 - DNA, 14 bp, Homo sapiens
tggtgcaatgacct

SEQ ID NO: 638893 - DNA, 21 bp, Homo sapiens
tggtgcaatgacctttcaata

SEQ ID NO: 638894 - DNA, 14 bp, Homo sapiens
tggtgcagtgaaga

SEQ ID NO: 638895 - DNA, 22 bp, Homo sapiens
tggtgcccagactcaaggcctc

SEQ ID NO: 638896 - DNA, 17 bp, Homo sapiens
tggtgcgggccaggtct

SEQ ID NO: 638897 - DNA, 14 bp, Homo sapiens
tggtgcgtgtggcc

SEQ ID NO: 638898 - DNA, 19 bp, Homo sapiens
tggtgcgtgtggccctgtg

SEQ ID NO: 638899 - DNA, 14 bp, Homo sapiens
tggtggccctgcgg

SEQ ID NO: 638900 - DNA, 16 bp, Homo sapiens
tggtggccctgcgggg

SEQ ID NO: 638901 - DNA, 15 bp, Homo sapiens
tggtgggctccagag

SEQ ID NO: 638902 - DNA, 16 bp, Homo sapiens
tggtggtttcagaaag

SEQ ID NO: 638903 - DNA, 12 bp, Homo sapiens
tggtgtcctctg

SEQ ID NO: 638904 - DNA, 13 bp, Homo sapiens
tggtgtcctctgt

SEQ ID NO: 638905 - DNA, 19 bp, Homo sapiens
tggtgtcctgcatgtatgc

SEQ ID NO: 638906 - DNA, 21 bp, Homo sapiens
tggtgtctaataaacacagat

SEQ ID NO: 638907 - DNA, 23 bp, Homo sapiens
tggtgtcttgagaccagcctgcc

SEQ ID NO: 638908 - DNA, 13 bp, Homo sapiens
tggtgtgaggccc

SEQ ID NO: 638909 - DNA, 15 bp, Homo sapiens
tggttacaaattttt

SEQ ID NO: 638910 - DNA, 14 bp, Homo sapiens
tggttggaggcctg

SEQ ID NO: 638911 - DNA, 15 bp, Homo sapiens
tggttggaggcctgg

SEQ ID NO: 638912 - DNA, 22 bp, Homo sapiens
tggttggaggcctggtctggag

SEQ ID NO: 638913 - DNA, 14 bp, Homo sapiens
tggtttgctacttc

SEQ ID NO: 638914 - DNA, 13 bp, Homo sapiens
tggtttttctcat

SEQ ID NO: 638915 - DNA, 15 bp, Homo sapiens
tggttttttttctaa

SEQ ID NO: 638916 - DNA, 12 bp, Homo sapiens
tgtaaaactgtg

SEQ ID NO: 638917 - DNA, 14 bp, Homo sapiens
tgtaaaactgtgac

SEQ ID NO: 638918 - DNA, 15 bp, Homo sapiens
tgtaaacatcataaa

SEQ ID NO: 638919 - DNA, 20 bp, Homo sapiens
tgtaaacatcataaatagta

SEQ ID NO: 638920 - DNA, 19 bp, Homo sapiens
tgtaaatattgctgtctga

SEQ ID NO: 638921 - DNA, 20 bp, Homo sapiens
tgtaaatgatatgtctttaa

SEQ ID NO: 638922 - DNA, 22 bp, Homo sapiens
tgtaaatgatatgtctttaaaa

SEQ ID NO: 638923 - DNA, 13 bp, Homo sapiens
tgtaacagacatt

SEQ ID NO: 638924 - DNA, 11 bp, Homo sapiens
tgtaagaaaat

SEQ ID NO: 638925 - DNA, 22 bp, Homo sapiens
tgtaagaagctaaaatgaaaaa

SEQ ID NO: 638926 - DNA, 18 bp, Homo sapiens
tgtaagacacgtgcaaca

SEQ ID NO: 638927 - DNA, 19 bp, Homo sapiens
tgtaagacacgtgcaacag

SEQ ID NO: 638928 - DNA, 21 bp, Homo sapiens
tgtaagtactctaatatacag

SEQ ID NO: 638929 - DNA, 14 bp, Homo sapiens
tgtaatataagaca

SEQ ID NO: 638930 - DNA, 15 bp, Homo sapiens
tgtaatataagacaa

SEQ ID NO: 638931 - DNA, 19 bp, Homo sapiens
tgtaatatcagttacagtg

SEQ ID NO: 638932 - DNA, 20 bp, Homo sapiens
tgtacaaaatgaattgcctt

SEQ ID NO: 638933 - DNA, 21 bp, Homo sapiens
tgtacaaataatattgccttg

SEQ ID NO: 638934 - DNA, 21 bp, Homo sapiens
tgtacacacacagacacacaa

SEQ ID NO: 638935 - DNA, 20 bp, Homo sapiens
tgtacaccactttcccacac

SEQ ID NO: 638936 - DNA, 24 bp, Homo sapiens
tgtacagaaccagcactcccaggg

SEQ ID NO: 638937 - DNA, 16 bp, Homo sapiens
tgtacaggctgagaca

SEQ ID NO: 638938 - DNA, 20 bp, Homo sapiens
tgtacatagtggtcatttgg

SEQ ID NO: 638939 - DNA, 18 bp, Homo sapiens
tgtacatttatgtgtgaa

SEQ ID NO: 638940 - DNA, 24 bp, Homo sapiens
tgtacatttgatttgatatacaga

SEQ ID NO: 638941 - DNA, 17 bp, Homo sapiens
tgtacgaggcttctcta

SEQ ID NO: 638942 - DNA, 17 bp, Homo sapiens
tgtacgttaattaaaca

SEQ ID NO: 638943 - DNA, 16 bp, Homo sapiens
tgtactaccccaggac

SEQ ID NO: 638944 - DNA, 21 bp, Homo sapiens
tgtacttacactgaaatccaa

SEQ ID NO: 638945 - DNA, 16 bp, Homo sapiens
tgtacttcattcaaaa

SEQ ID NO: 638946 - DNA, 22 bp, Homo sapiens
tgtacttgatttttcaaagact

SEQ ID NO: 638947 - DNA, 21 bp, Homo sapiens
tgtagaatgccgcgaactggg

SEQ ID NO: 638948 - DNA, 17 bp, Homo sapiens
tgtagacgcacctgctg

SEQ ID NO: 638949 - DNA, 19 bp, Homo sapiens
tgtagatgaaaaagcatgt

SEQ ID NO: 638950 - DNA, 20 bp, Homo sapiens
tgtagatgaaaaagcatgta

SEQ ID NO: 638951 - DNA, 22 bp, Homo sapiens
tgtagatgaaaaagcatgtaca

SEQ ID NO: 638952 - DNA, 23 bp, Homo sapiens
tgtagatgaaaaagcatgtacag

SEQ ID NO: 638953 - DNA, 15 bp, Homo sapiens
tgtagattgcgtgga

SEQ ID NO: 638954 - DNA, 23 bp, Homo sapiens
tgtagctctgaatgctatttgtg

SEQ ID NO: 638955 - DNA, 22 bp, Homo sapiens
tgtagcttctgaaaggtgcttt

SEQ ID NO: 638956 - DNA, 16 bp, Homo sapiens
tgtagctttaaaacca

SEQ ID NO: 638957 - DNA, 16 bp, Homo sapiens
tgtagggaaaccttgg

SEQ ID NO: 638958 - DNA, 18 bp, Homo sapiens
tgtagggaaaccttggag

SEQ ID NO: 638959 - DNA, 17 bp, Homo sapiens
tgtataaaaaaaatagt

SEQ ID NO: 638960 - DNA, 13 bp, Homo sapiens
tgtatacaaacag

SEQ ID NO: 638961 - DNA, 16 bp, Homo sapiens
tgtatacaaacaggtg

SEQ ID NO: 638962 - DNA, 17 bp, Homo sapiens
tgtatagggaattttca

SEQ ID NO: 638963 - DNA, 13 bp, Homo sapiens
tgtatatatatgt

SEQ ID NO: 638964 - DNA, 15 bp, Homo sapiens
tgtatatatatgtga

SEQ ID NO: 638965 - DNA, 18 bp, Homo sapiens
tgtatatatttattattt

SEQ ID NO: 638966 - DNA, 15 bp, Homo sapiens
tgtatatcagctcta

SEQ ID NO: 638967 - DNA, 16 bp, Homo sapiens
tgtatatcagctctaa

SEQ ID NO: 638968 - DNA, 13 bp, Homo sapiens
tgtatatctgtgt

SEQ ID NO: 638969 - DNA, 19 bp, Homo sapiens
tgtatctgacatatttcat

SEQ ID NO: 638970 - DNA, 19 bp, Homo sapiens
tgtatggaagacaaataca

SEQ ID NO: 638971 - DNA, 12 bp, Homo sapiens
tgtatgtgtata

SEQ ID NO: 638972 - DNA, 12 bp, Homo sapiens
tgtatgttaata

SEQ ID NO: 638973 - DNA, 18 bp, Homo sapiens
tgtattgtgtcttttgca

SEQ ID NO: 638974 - DNA, 21 bp, Homo sapiens
tgtattgtgtcttttgcatga

SEQ ID NO: 638975 - DNA, 14 bp, Homo sapiens
tgtattttattgta

SEQ ID NO: 638976 - DNA, 21 bp, Homo sapiens
tgtatttttcctctttcactt

SEQ ID NO: 638977 - DNA, 19 bp, Homo sapiens
tgtcaaatggatgtaatat

SEQ ID NO: 638978 - DNA, 13 bp, Homo sapiens
tgtcacttttttc

SEQ ID NO: 638979 - DNA, 15 bp, Homo sapiens
tgtcacttttttcct

SEQ ID NO: 638980 - DNA, 19 bp, Homo sapiens
tgtcacttttttcctgtca

SEQ ID NO: 638981 - DNA, 20 bp, Homo sapiens
tgtcacttttttcctgtcaa

SEQ ID NO: 638982 - DNA, 21 bp, Homo sapiens
tgtcacttttttcctgtcaat

SEQ ID NO: 638983 - DNA, 17 bp, Homo sapiens
tgtcagaatgttgtgtt

SEQ ID NO: 638984 - DNA, 17 bp, Homo sapiens
tgtcaggagagccctct

SEQ ID NO: 638985 - DNA, 17 bp, Homo sapiens
tgtcagtagtgcctgtg

SEQ ID NO: 638986 - DNA, 14 bp, Homo sapiens
tgtcagtttgtgaa

SEQ ID NO: 638987 - DNA, 18 bp, Homo sapiens
tgtcagtttgtgaagtga

SEQ ID NO: 638988 - DNA, 22 bp, Homo sapiens
tgtcatattttcctttatgtga

SEQ ID NO: 638989 - DNA, 13 bp, Homo sapiens
tgtcatctgtcag

SEQ ID NO: 638990 - DNA, 19 bp, Homo sapiens
tgtcatgtgcgaacacagt

SEQ ID NO: 638991 - DNA, 22 bp, Homo sapiens
tgtcattggttacaaattttta

SEQ ID NO: 638992 - DNA, 18 bp, Homo sapiens
tgtcattttcagatcctt

SEQ ID NO: 638993 - DNA, 18 bp, Homo sapiens
tgtccaggtcacaggcat

SEQ ID NO: 638994 - DNA, 20 bp, Homo sapiens
tgtccattgacatgtacaga

SEQ ID NO: 638995 - DNA, 14 bp, Homo sapiens
tgtccctgcagggc

SEQ ID NO: 638996 - DNA, 15 bp, Homo sapiens
tgtccctgtgggctc

SEQ ID NO: 638997 - DNA, 18 bp, Homo sapiens
tgtccctgtgggctcaca

SEQ ID NO: 638998 - DNA, 22 bp, Homo sapiens
tgtccctgtgggctcacaccgg

SEQ ID NO: 638999 - DNA, 18 bp, Homo sapiens
tgtcccttcacatagttt

SEQ ID NO: 639000 - DNA, 12 bp, Homo sapiens
tgtccgcgtcct

SEQ ID NO: 639001 - DNA, 23 bp, Homo sapiens
tgtccgtcctgctcgccctgtgc

SEQ ID NO: 639002 - DNA, 20 bp, Homo sapiens
tgtccgtctgtcctgcgcct

SEQ ID NO: 639003 - DNA, 15 bp, Homo sapiens
tgtcctatccccgga

SEQ ID NO: 639004 - DNA, 13 bp, Homo sapiens
tgtcctctgtccg

SEQ ID NO: 639005 - DNA, 13 bp, Homo sapiens
tgtcctgcatgta

SEQ ID NO: 639006 - DNA, 15 bp, Homo sapiens
tgtcctgcgcctgcg

SEQ ID NO: 639007 - DNA, 21 bp, Homo sapiens
tgttataaaatctgtattgct

SEQ ID NO: 639008 - DNA, 22 bp, Homo sapiens
tgttatcagtacaattctttgt

SEQ ID NO: 639009 - DNA, 17 bp, Homo sapiens
tgttatccactacaggt

SEQ ID NO: 639010 - DNA, 12 bp, Homo sapiens
tgttatctgtct

SEQ ID NO: 639011 - DNA, 21 bp, Homo sapiens
tgttattcaataactattgct

SEQ ID NO: 639012 - DNA, 19 bp, Homo sapiens
tgttcaaagaacccccctc

SEQ ID NO: 639013 - DNA, 20 bp, Homo sapiens
tgttcaaagaacccccctcc

SEQ ID NO: 639014 - DNA, 19 bp, Homo sapiens
ttctaaaccatgaaaagtt

SEQ ID NO: 639015 - DNA, 15 bp, Homo sapiens
ttctagtaacagtat

SEQ ID NO: 639016 - DNA, 16 bp, Homo sapiens
ttctagtaacagtatt

SEQ ID NO: 639017 - DNA, 14 bp, Homo sapiens
ttctatataatttt

SEQ ID NO: 639018 - DNA, 16 bp, Homo sapiens
ttctatataatttttc

SEQ ID NO: 639019 - DNA, 14 bp, Homo sapiens
ttctatatgtaact

SEQ ID NO: 639020 - DNA, 16 bp, Homo sapiens
ttctatatttggattc

SEQ ID NO: 639021 - DNA, 15 bp, Homo sapiens
ttctatgattaaact

SEQ ID NO: 639022 - DNA, 22 bp, Homo sapiens
ttctatgattaaactgggaaat

SEQ ID NO: 639023 - DNA, 16 bp, Homo sapiens
ttctcagaagtgaaaa

SEQ ID NO: 639024 - DNA, 16 bp, Homo sapiens
ttctcagcatatatat

SEQ ID NO: 639025 - DNA, 23 bp, Homo sapiens
ttctcatctgtaaaaccaggctg

SEQ ID NO: 639026 - DNA, 18 bp, Homo sapiens
ttctcatggtattatcta

SEQ ID NO: 639027 - DNA, 20 bp, Homo sapiens
ttctccagcccatgctggct

SEQ ID NO: 639028 - DNA, 23 bp, Homo sapiens
ttctccagcccatgctggctggg

SEQ ID NO: 639029 - DNA, 16 bp, Homo sapiens
ttctcccctccaagtg

SEQ ID NO: 639030 - DNA, 14 bp, Homo sapiens
ttctcccctccaga

SEQ ID NO: 639031 - DNA, 15 bp, Homo sapiens
ttctcccctccagac

SEQ ID NO: 639032 - DNA, 22 bp, Homo sapiens
ttctccctggggaggacccctg

SEQ ID NO: 639033 - DNA, 15 bp, Homo sapiens
ttctcctccaaatgc

SEQ ID NO: 639034 - DNA, 22 bp, Homo sapiens
ttgcctgaatccatcaggactt

SEQ ID NO: 639035 - DNA, 23 bp, Homo sapiens
ttgcctgaatccatcaggacttg

SEQ ID NO: 639036 - DNA, 11 bp, Homo sapiens
ttgccttcagc

SEQ ID NO: 639037 - DNA, 16 bp, Homo sapiens
ttgctagttctgctgc

SEQ ID NO: 639038 - DNA, 17 bp, Homo sapiens
ttgctagttctgctgcc

SEQ ID NO: 639039 - DNA, 16 bp, Homo sapiens
ttgctattgtttatag

SEQ ID NO: 639040 - DNA, 15 bp, Homo sapiens
ttgctccattcctga

SEQ ID NO: 639041 - DNA, 11 bp, Homo sapiens
ttgctctctca

SEQ ID NO: 639042 - DNA, 20 bp, Homo sapiens
ttgctgaataacaacaattt

SEQ ID NO: 639043 - DNA, 16 bp, Homo sapiens
ttgctgagatgtttag

SEQ ID NO: 639044 - DNA, 22 bp, Homo sapiens
ttgctgatggtgcaatgacctt

SEQ ID NO: 639045 - DNA, 19 bp, Homo sapiens
ttgctggaatctactagaa

SEQ ID NO: 639046 - DNA, 15 bp, Homo sapiens
ttgctggcatttgct

SEQ ID NO: 639047 - DNA, 13 bp, Homo sapiens
ttgctgggccagg

SEQ ID NO: 639048 - DNA, 14 bp, Homo sapiens
ttgctgggccaggg

SEQ ID NO: 639049 - DNA, 16 bp, Homo sapiens
ttgctgggccagggaa

SEQ ID NO: 639050 - DNA, 15 bp, Homo sapiens
ttgctgtaaataaaa

SEQ ID NO: 639051 - DNA, 20 bp, Homo sapiens
ttgctgtctgaaaaagtgtt

SEQ ID NO: 639052 - DNA, 12 bp, Homo sapiens
ttgctgtgaaat

SEQ ID NO: 639053 - DNA, 17 bp, Homo sapiens
ttgcttaatctagagct

SEQ ID NO: 639054 - DNA, 18 bp, Homo sapiens
ttgcttaatctagagcta

SEQ ID NO: 639055 - DNA, 13 bp, Homo sapiens
ttgctttttctga

SEQ ID NO: 639056 - DNA, 15 bp, Homo sapiens
ttgctttttctgact

SEQ ID NO: 639057 - DNA, 20 bp, Homo sapiens
ttggaaaacgatttaattta

SEQ ID NO: 639058 - DNA, 17 bp, Homo sapiens
ttggaaaccaccttaaa

SEQ ID NO: 639059 - DNA, 22 bp, Homo sapiens
tttaaatctttgttaaaatata

SEQ ID NO: 639060 - DNA, 15 bp, Homo sapiens
tttaaatgtctaatg

SEQ ID NO: 639061 - DNA, 12 bp, Homo sapiens
tttaacactgag

SEQ ID NO: 639062 - DNA, 18 bp, Homo sapiens
tttaacagaaaaatgaaa

SEQ ID NO: 639063 - DNA, 22 bp, Homo sapiens
tttaacagaaaaatgaaattta

SEQ ID NO: 639064 - DNA, 11 bp, Homo sapiens
tttaacatagc

SEQ ID NO: 639065 - DNA, 13 bp, Homo sapiens
tttaaccaaataa

SEQ ID NO: 639066 - DNA, 15 bp, Homo sapiens
tttaacttatctcca

SEQ ID NO: 639067 - DNA, 20 bp, Homo sapiens
tttaaggttatttatttaaa

SEQ ID NO: 639068 - DNA, 21 bp, Homo sapiens
tttaaggttatttatttaaat

SEQ ID NO: 639069 - DNA, 18 bp, Homo sapiens
tttaagtgtactggattt

SEQ ID NO: 639070 - DNA, 20 bp, Homo sapiens
tttaataatatgtacaaata

SEQ ID NO: 639071 - DNA, 16 bp, Homo sapiens
tttaatagtttctaaa

SEQ ID NO: 639072 - DNA, 17 bp, Homo sapiens
tttaatatttatagagt

SEQ ID NO: 639073 - DNA, 10 bp, Homo sapiens
tttaatcatt

SEQ ID NO: 639074 - DNA, 21 bp, Homo sapiens
tttaattcttaccgaaatgaa

SEQ ID NO: 639075 - DNA, 21 bp, Homo sapiens
tttaattgaaagggacaagta

SEQ ID NO: 639076 - DNA, 12 bp, Homo sapiens
tttacaaagaaa

SEQ ID NO: 639077 - DNA, 22 bp, Homo sapiens
tttacaacttccagatttgagc

SEQ ID NO: 639078 - DNA, 14 bp, Homo sapiens
tttacattcttgct

SEQ ID NO: 639079 - DNA, 19 bp, Homo sapiens
tttacattgtcctgtagct

SEQ ID NO: 639080 - DNA, 21 bp, Homo sapiens
tttaccagaagtttaaatctt

SEQ ID NO: 639081 - DNA, 12 bp, Homo sapiens
tttactatgtaa

SEQ ID NO: 639082 - DNA, 20 bp, Homo sapiens
tttactgacatggtgctgtg

SEQ ID NO: 639083 - DNA, 16 bp, Homo sapiens
tttactgcaatgtctg

SEQ ID NO: 639084 - DNA, 13 bp, Homo sapiens
tttactgtttgaa

SEQ ID NO: 639085 - DNA, 18 bp, Homo sapiens
tttacttgattaaggact

SEQ ID NO: 639086 - DNA, 15 bp, Homo sapiens
tttagaaattctata

SEQ ID NO: 639087 - DNA, 19 bp, Homo sapiens
tttagaatcaagtctgtga

SEQ ID NO: 639088 - DNA, 23 bp, Homo sapiens
tcaggattgaggatgaactcagg

SEQ ID NO: 639089 - DNA, 16 bp, Homo sapiens
tcaggctacaggtgcc

SEQ ID NO: 639090 - DNA, 21 bp, Homo sapiens
tcaggctacaggtgccccacc

SEQ ID NO: 639091 - DNA, 21 bp, Homo sapiens
tcaggctctgaatctctcaaa

SEQ ID NO: 639092 - DNA, 12 bp, Homo sapiens
tcaggctttcta

SEQ ID NO: 639093 - DNA, 14 bp, Homo sapiens
tcagggaccaagga

SEQ ID NO: 639094 - DNA, 16 bp, Homo sapiens
tcaggtggcatttgca

SEQ ID NO: 639095 - DNA, 22 bp, Homo sapiens
tcaggtgtatagggaattttca

SEQ ID NO: 639096 - DNA, 14 bp, Homo sapiens
tcagtattgagaca

SEQ ID NO: 639097 - DNA, 19 bp, Homo sapiens
tcagtattgagacactgtc

SEQ ID NO: 639098 - DNA, 20 bp, Homo sapiens
tcagtattgagacactgtca

SEQ ID NO: 639099 - DNA, 15 bp, Homo sapiens
tcagtattgttttgg

SEQ ID NO: 639100 - DNA, 17 bp, Homo sapiens
tcagtattgttttggtt

SEQ ID NO: 639101 - DNA, 19 bp, Homo sapiens
tcagtctatgctgtgtgca

SEQ ID NO: 639102 - DNA, 17 bp, Homo sapiens
tcagtgaagcccaggag

SEQ ID NO: 639103 - DNA, 23 bp, Homo sapiens
tcagtgaagcccaggaggacctg

SEQ ID NO: 639104 - DNA, 15 bp, Homo sapiens
tcagtgagtcagagg

SEQ ID NO: 639105 - DNA, 11 bp, Homo sapiens
tcagtgcctgc

SEQ ID NO: 639106 - DNA, 13 bp, Homo sapiens
tcagtgcctgctg

SEQ ID NO: 639107 - DNA, 14 bp, Homo sapiens
tcagtgcctgctgt

SEQ ID NO: 639108 - DNA, 15 bp, Homo sapiens
tcagtgccttatgga

SEQ ID NO: 639109 - DNA, 19 bp, Homo sapiens
tcagtgccttatggaacac

SEQ ID NO: 639110 - DNA, 22 bp, Homo sapiens
tcagtgccttatggaacactct

SEQ ID NO: 639111 - DNA, 16 bp, Homo sapiens
tcagtggacatttgtt

SEQ ID NO: 639112 - DNA, 13 bp, Homo sapiens
tcagttacagtgg

SEQ ID NO: 639113 - DNA, 15 bp, Homo sapiens
tcagttctcatcttg

SEQ ID NO: 639114 - DNA, 16 bp, Homo sapiens
tcagttctcatcttgt

SEQ ID NO: 639115 - DNA, 19 bp, Homo sapiens
tcagttctcatcttgtaaa

SEQ ID NO: 639116 - DNA, 14 bp, Homo sapiens
tcagttggcctctg

SEQ ID NO: 639117 - DNA, 13 bp, Homo sapiens
tcagtttgtgaag

SEQ ID NO: 639118 - DNA, 16 bp, Homo sapiens
tcataaatagtaaata

SEQ ID NO: 639119 - DNA, 18 bp, Homo sapiens
tcataaattatttctaaa

SEQ ID NO: 639120 - DNA, 22 bp, Homo sapiens
tcataagccaatttttctgcac

SEQ ID NO: 639121 - DNA, 23 bp, Homo sapiens
tcataagccaatttttctgcact

SEQ ID NO: 639122 - DNA, 20 bp, Homo sapiens
tcatacagtctctatttgat

SEQ ID NO: 639123 - DNA, 19 bp, Homo sapiens
tcatacgttgatagtttac

SEQ ID NO: 639124 - DNA, 14 bp, Homo sapiens
tcatactcaaagag

SEQ ID NO: 639125 - DNA, 15 bp, Homo sapiens
tcatagataccattt

SEQ ID NO: 639126 - DNA, 16 bp, Homo sapiens
tcatagcacatgtttt

SEQ ID NO: 639127 - DNA, 15 bp, Homo sapiens
tcatagtcaatcaaa

SEQ ID NO: 639128 - DNA, 23 bp, Homo sapiens
tcatatctgtatgcctcatttta

SEQ ID NO: 639129 - DNA, 16 bp, Homo sapiens
tcatatgagttcctga

SEQ ID NO: 639130 - DNA, 15 bp, Homo sapiens
tcatatgttagatac

SEQ ID NO: 639131 - DNA, 16 bp, Homo sapiens
tcatcaacaaagaaat

SEQ ID NO: 639132 - DNA, 23 bp, Homo sapiens
tcatcaagtagtagtacttaata

SEQ ID NO: 639133 - DNA, 16 bp, Homo sapiens
tcttcatataataaat

SEQ ID NO: 639134 - DNA, 20 bp, Homo sapiens
tcttccaagttcattcatac

SEQ ID NO: 639135 - DNA, 23 bp, Homo sapiens
tcttcccccttcccctgcgccct

SEQ ID NO: 639136 - DNA, 16 bp, Homo sapiens
tcttcgtggattgttt

SEQ ID NO: 639137 - DNA, 23 bp, Homo sapiens
tcttctaggcattactggccttt

SEQ ID NO: 639138 - DNA, 15 bp, Homo sapiens
tcttctcctttgtca

SEQ ID NO: 639139 - DNA, 21 bp, Homo sapiens
tcttctcctttgtcaaatggt

SEQ ID NO: 639140 - DNA, 14 bp, Homo sapiens
tcttctttaatttt

SEQ ID NO: 639141 - DNA, 19 bp, Homo sapiens
tcttgagaccagcctgcca

SEQ ID NO: 639142 - DNA, 22 bp, Homo sapiens
tcttgagcaaggcaagaagtgg

SEQ ID NO: 639143 - DNA, 23 bp, Homo sapiens
tcttgagcagctgaattggctgc

SEQ ID NO: 639144 - DNA, 21 bp, Homo sapiens
tcttgagtgggccccctctct

SEQ ID NO: 639145 - DNA, 11 bp, Homo sapiens
tcttgcctgaa

SEQ ID NO: 639146 - DNA, 18 bp, Homo sapiens
tcttgcctgaatccatca

SEQ ID NO: 639147 - DNA, 17 bp, Homo sapiens
tcttgcggcaccgccca

SEQ ID NO: 639148 - DNA, 19 bp, Homo sapiens
tcttgcggcaccgcccacc

SEQ ID NO: 639149 - DNA, 21 bp, Homo sapiens
tcttgcggcaccgcccaccca

SEQ ID NO: 639150 - DNA, 17 bp, Homo sapiens
tcttgctacctcagtca

SEQ ID NO: 639151 - DNA, 11 bp, Homo sapiens
tcttgctgtga

SEQ ID NO: 639152 - DNA, 13 bp, Homo sapiens
tcttggagaggag

SEQ ID NO: 639153 - DNA, 19 bp, Homo sapiens
tcttggagaggaggtgtgg

SEQ ID NO: 639154 - DNA, 18 bp, Homo sapiens
tcttggccctattcatta

SEQ ID NO: 639155 - DNA, 12 bp, Homo sapiens
tcttggtctctt

SEQ ID NO: 639156 - DNA, 21 bp, Homo sapiens
tcttggtctctttctttccaa

SEQ ID NO: 639157 - DNA, 16 bp, Homo sapiens
tcttggtgtcaaattt

SEQ ID NO: 639158 - DNA, 16 bp, Homo sapiens
tcttgtaaaactgtga

SEQ ID NO: 639159 - DNA, 23 bp, Homo sapiens
tcttgtaaaactgtgacattcca

SEQ ID NO: 639160 - DNA, 16 bp, Homo sapiens
tcttgtattatcataa

SEQ ID NO: 639161 - DNA, 16 bp, Homo sapiens
tcttgtggggccagga

SEQ ID NO: 639162 - DNA, 13 bp, Homo sapiens
tcttgttgttcat

SEQ ID NO: 639163 - DNA, 23 bp, Homo sapiens
tctttaaaatgattcacttttat

SEQ ID NO: 639164 - DNA, 14 bp, Homo sapiens
tctttactaacact

SEQ ID NO: 639165 - DNA, 12 bp, Homo sapiens
tctttatgattt

SEQ ID NO: 639166 - DNA, 14 bp, Homo sapiens
tctttatgatttca

SEQ ID NO: 639167 - DNA, 15 bp, Homo sapiens
tctttcaggaaattt

SEQ ID NO: 639168 - DNA, 13 bp, Homo sapiens
tctttcatggaat

SEQ ID NO: 639169 - DNA, 19 bp, Homo sapiens
tctttccaaaggttgtaca

SEQ ID NO: 639170 - DNA, 22 bp, Homo sapiens
tctttccctcatgtatacttca

SEQ ID NO: 639171 - DNA, 12 bp, Homo sapiens
tctttctttcca

SEQ ID NO: 639172 - DNA, 14 bp, Homo sapiens
tctttgaaaactca

SEQ ID NO: 639173 - DNA, 20 bp, Homo sapiens
tctttgatatgttgatgaaa

SEQ ID NO: 639174 - DNA, 16 bp, Homo sapiens
tctttgcattcgtcct

SEQ ID NO: 639175 - DNA, 18 bp, Homo sapiens
tctttggttcctcatggc

SEQ ID NO: 639176 - DNA, 12 bp, Homo sapiens
tctttgttgctt

SEQ ID NO: 639177 - DNA, 19 bp, Homo sapiens
tcttttaaaaactcctgtt

SEQ ID NO: 639178 - DNA, 15 bp, Homo sapiens
tcttttgaaaactca

SEQ ID NO: 639179 - DNA, 12 bp, Homo sapiens
tcttttgttctc

SEQ ID NO: 639180 - DNA, 18 bp, Homo sapiens
tgaaaaagacttcaaatg

SEQ ID NO: 639181 - DNA, 13 bp, Homo sapiens
tgaaaaagcatgt

SEQ ID NO: 639182 - DNA, 15 bp, Homo sapiens
tgaaaaagcatgtac

SEQ ID NO: 639183 - DNA, 17 bp, Homo sapiens
tgaaaaagcatgtacag

SEQ ID NO: 639184 - DNA, 18 bp, Homo sapiens
tgaaaaagcatgtacagt

SEQ ID NO: 639185 - DNA, 12 bp, Homo sapiens
tgaaaaagtgtt

SEQ ID NO: 639186 - DNA, 13 bp, Homo sapiens
tgaaaactggaat

SEQ ID NO: 639187 - DNA, 14 bp, Homo sapiens
tgaaaagttttcaa

SEQ ID NO: 639188 - DNA, 22 bp, Homo sapiens
tgaaaagttttcaagcattgct

SEQ ID NO: 639189 - DNA, 20 bp, Homo sapiens
tgaaaatggctgaagaaaca

SEQ ID NO: 639190 - DNA, 18 bp, Homo sapiens
tgaaacaaatatactcat

SEQ ID NO: 639191 - DNA, 21 bp, Homo sapiens
tgaaacaaatatactcatttg

SEQ ID NO: 639192 - DNA, 17 bp, Homo sapiens
tgaaacacaatatcatc

SEQ ID NO: 639193 - DNA, 13 bp, Homo sapiens
tgaaactgtattt

SEQ ID NO: 639194 - DNA, 21 bp, Homo sapiens
tgaaactgtatttacttgtta

SEQ ID NO: 639195 - DNA, 17 bp, Homo sapiens
tgaaagagaaaatgctt

SEQ ID NO: 639196 - DNA, 21 bp, Homo sapiens
tgaaagagaaaatgctttctc

SEQ ID NO: 639197 - DNA, 16 bp, Homo sapiens
tgaaaggtgctttctc

SEQ ID NO: 639198 - DNA, 15 bp, Homo sapiens
tgaaagtcaagtcta

SEQ ID NO: 639199 - DNA, 14 bp, Homo sapiens
tgaaagtcagttta

SEQ ID NO: 639200 - DNA, 11 bp, Homo sapiens
tgaaagttgtg

SEQ ID NO: 639201 - DNA, 13 bp, Homo sapiens
tgaaagttgtgat

SEQ ID NO: 639202 - DNA, 18 bp, Homo sapiens
tgaaataaagagttctcc

SEQ ID NO: 639203 - DNA, 12 bp, Homo sapiens
tgaaatacctat

SEQ ID NO: 639204 - DNA, 10 bp, Homo sapiens
tgaaatataa

SEQ ID NO: 639205 - DNA, 16 bp, Homo sapiens
tgaaatataaactgtg

SEQ ID NO: 639206 - DNA, 13 bp, Homo sapiens
tgaaatattactc

SEQ ID NO: 639207 - DNA, 21 bp, Homo sapiens
tgaaatccaaaatagtcatgt

SEQ ID NO: 639208 - DNA, 22 bp, Homo sapiens
tgaaatccaaaatagtcatgtt

SEQ ID NO: 639209 - DNA, 15 bp, Homo sapiens
tgaaatctacaacat

SEQ ID NO: 639210 - DNA, 20 bp, Homo sapiens
tgaaatctacaacataatga

SEQ ID NO: 639211 - DNA, 12 bp, Homo sapiens
tgaaattagtat

SEQ ID NO: 639212 - DNA, 14 bp, Homo sapiens
tgaaattagtattt

SEQ ID NO: 639213 - DNA, 18 bp, Homo sapiens
tgaaattagtattttgag

SEQ ID NO: 639214 - DNA, 19 bp, Homo sapiens
tgaaattagtgttttcatt

SEQ ID NO: 639215 - DNA, 21 bp, Homo sapiens
tgaaattagtgttttcattct

SEQ ID NO: 639216 - DNA, 14 bp, Homo sapiens
tgaaattatatctg

SEQ ID NO: 639217 - DNA, 14 bp, Homo sapiens
tgaaattatgtcaa

SEQ ID NO: 639218 - DNA, 18 bp, Homo sapiens
tgaaattcacaaagttaa

SEQ ID NO: 639219 - DNA, 20 bp, Homo sapiens
tgaaattctggatcaggagg

SEQ ID NO: 639220 - DNA, 16 bp, Homo sapiens
tgaaatttaagcacaa

SEQ ID NO: 639221 - DNA, 20 bp, Homo sapiens
tgaacaagccacgttgcaga

SEQ ID NO: 639222 - DNA, 16 bp, Homo sapiens
tgaacagcttcactta

SEQ ID NO: 639223 - DNA, 16 bp, Homo sapiens
tgaacatagttttcac

SEQ ID NO: 639224 - DNA, 17 bp, Homo sapiens
tgaacatagttttcacc

SEQ ID NO: 639225 - DNA, 19 bp, Homo sapiens
tgaacatagttttcaccca

SEQ ID NO: 639226 - DNA, 16 bp, Homo sapiens
tgaaccgtcaatgtga

SEQ ID NO: 639227 - DNA, 17 bp, Homo sapiens
tgaaccgtcaatgtgaa

SEQ ID NO: 639228 - DNA, 21 bp, Homo sapiens
tgaaccgtcaatgtgaaataa

SEQ ID NO: 639229 - DNA, 20 bp, Homo sapiens
tgaactatcagggcaagctc

SEQ ID NO: 639230 - DNA, 14 bp, Homo sapiens
tgaactgataattt

SEQ ID NO: 639231 - DNA, 15 bp, Homo sapiens
tgaactgataatttt

SEQ ID NO: 639232 - DNA, 18 bp, Homo sapiens
tgaactgataatttttgt

SEQ ID NO: 639233 - DNA, 21 bp, Homo sapiens
tgaactgataatttttgtttt

SEQ ID NO: 639234 - DNA, 17 bp, Homo sapiens
tgaagaaaatccttcag

SEQ ID NO: 639235 - DNA, 14 bp, Homo sapiens
tgaagcaaacacac

SEQ ID NO: 639236 - DNA, 23 bp, Homo sapiens
tgaagcaaacacacagactctgt

SEQ ID NO: 639237 - DNA, 20 bp, Homo sapiens
tgaagcagagtcaagctgat

SEQ ID NO: 639238 - DNA, 21 bp, Homo sapiens
tgaagcagagtcaagctgatg

SEQ ID NO: 639239 - DNA, 15 bp, Homo sapiens
tgaagcccaggagga

SEQ ID NO: 639240 - DNA, 14 bp, Homo sapiens
tgaaggggaaaacc

SEQ ID NO: 639241 - DNA, 18 bp, Homo sapiens
tgaaggggccagaccacg

SEQ ID NO: 639242 - DNA, 15 bp, Homo sapiens
tgaaggtcttgcctg

SEQ ID NO: 639243 - DNA, 15 bp, Homo sapiens
tgaaggtgccagacg

SEQ ID NO: 639244 - DNA, 15 bp, Homo sapiens
tgaagtaagttcatc

SEQ ID NO: 639245 - DNA, 14 bp, Homo sapiens
tgaagtatgtcttc

SEQ ID NO: 639246 - DNA, 19 bp, Homo sapiens
tgaagtcccttcctgtcct

SEQ ID NO: 639247 - DNA, 16 bp, Homo sapiens
tgaagtgattgacatt

SEQ ID NO: 639248 - DNA, 18 bp, Homo sapiens
tgaagtgattgacatttt

SEQ ID NO: 639249 - DNA, 22 bp, Homo sapiens
tgaagttaagcacaaccatgtt

SEQ ID NO: 639250 - DNA, 13 bp, Homo sapiens
tgaataaaatgtt

SEQ ID NO: 639251 - DNA, 12 bp, Homo sapiens
tgaataacaaca

SEQ ID NO: 639252 - DNA, 20 bp, Homo sapiens
tgaatagacagaggtttcat

SEQ ID NO: 639253 - DNA, 23 bp, Homo sapiens
tctcaattctgaaggggaaaacc

SEQ ID NO: 639254 - DNA, 15 bp, Homo sapiens
tctcacccagcctgg

SEQ ID NO: 639255 - DNA, 15 bp, Homo sapiens
tctcacttttttata

SEQ ID NO: 639256 - DNA, 16 bp, Homo sapiens
tctcagatccctcggt

SEQ ID NO: 639257 - DNA, 18 bp, Homo sapiens
tctcagcccctcagagaa

SEQ ID NO: 639258 - DNA, 20 bp, Homo sapiens
tctcatgttttatatgatta

SEQ ID NO: 639259 - DNA, 15 bp, Homo sapiens
tctcatttgaaatgt

SEQ ID NO: 639260 - DNA, 22 bp, Homo sapiens
tctccacagggacacagtctgg

SEQ ID NO: 639261 - DNA, 13 bp, Homo sapiens
tctccacccctca

SEQ ID NO: 639262 - DNA, 17 bp, Homo sapiens
tctccacccctcaagcc

SEQ ID NO: 639263 - DNA, 23 bp, Homo sapiens
tctccacccctcaagccaggaga

SEQ ID NO: 639264 - DNA, 19 bp, Homo sapiens
tctccaccctgagcctgac

SEQ ID NO: 639265 - DNA, 20 bp, Homo sapiens
tctccagccaatttcaaaga

SEQ ID NO: 639266 - DNA, 14 bp, Homo sapiens
tctccagcccatgc

SEQ ID NO: 639267 - DNA, 18 bp, Homo sapiens
tctccagcccatgctggc

SEQ ID NO: 639268 - DNA, 23 bp, Homo sapiens
tctccagcccatgctggctgggg

SEQ ID NO: 639269 - DNA, 15 bp, Homo sapiens
tctccagctgatttt

SEQ ID NO: 639270 - DNA, 23 bp, Homo sapiens
tctcccaaataaactccttaacc

SEQ ID NO: 639271 - DNA, 15 bp, Homo sapiens
tctccccatgctggg

SEQ ID NO: 639272 - DNA, 18 bp, Homo sapiens
tctccccatgctgggctc

SEQ ID NO: 639273 - DNA, 23 bp, Homo sapiens
tctccccctcagctctccctcac

SEQ ID NO: 639274 - DNA, 13 bp, Homo sapiens
tctcccctccaga

SEQ ID NO: 639275 - DNA, 15 bp, Homo sapiens
tctccctaccctctt

SEQ ID NO: 639276 - DNA, 12 bp, Homo sapiens
tctccctgggca

SEQ ID NO: 639277 - DNA, 19 bp, Homo sapiens
tctccctgggcaccctgca

SEQ ID NO: 639278 - DNA, 18 bp, Homo sapiens
tctccctggggaggaccc

SEQ ID NO: 639279 - DNA, 23 bp, Homo sapiens
tctccgcccacgcggctgctgct

SEQ ID NO: 639280 - DNA, 20 bp, Homo sapiens
tctccgccccccggcctggc

SEQ ID NO: 639281 - DNA, 18 bp, Homo sapiens
tctcctcccatggccttc

SEQ ID NO: 639282 - DNA, 15 bp, Homo sapiens
tctcctctctctccc

SEQ ID NO: 639283 - DNA, 16 bp, Homo sapiens
tctcctctctctccct

SEQ ID NO: 639284 - DNA, 22 bp, Homo sapiens
tctcctctgtcagtttgtgaag

SEQ ID NO: 639285 - DNA, 18 bp, Homo sapiens
tctcctgagcctgtctct

SEQ ID NO: 639286 - DNA, 20 bp, Homo sapiens
tctcctgagcctgtctctcc

SEQ ID NO: 639287 - DNA, 21 bp, Homo sapiens
tctccttggtgtcgggcatga

SEQ ID NO: 639288 - DNA, 12 bp, Homo sapiens
tctccttgtact

SEQ ID NO: 639289 - DNA, 19 bp, Homo sapiens
tctccttgtacttgaataa

SEQ ID NO: 639290 - DNA, 17 bp, Homo sapiens
tctcctttgtcaaatgg

SEQ ID NO: 639291 - DNA, 19 bp, Homo sapiens
tctcctttgtcaaatggta

SEQ ID NO: 639292 - DNA, 16 bp, Homo sapiens
tctcgcagcctgaagc

SEQ ID NO: 639293 - DNA, 17 bp, Homo sapiens
tctcgtatggatttcta

SEQ ID NO: 639294 - DNA, 14 bp, Homo sapiens
tctctaaaacagca

SEQ ID NO: 639295 - DNA, 13 bp, Homo sapiens
tctctcaaaatgt

SEQ ID NO: 639296 - DNA, 17 bp, Homo sapiens
tctctcacccagcctgg

SEQ ID NO: 639297 - DNA, 18 bp, Homo sapiens
tctctccctaccctcttc

SEQ ID NO: 639298 - DNA, 11 bp, Homo sapiens
tctctccctcc

SEQ ID NO: 639299 - DNA, 12 bp, Homo sapiens
tctctccctcca

SEQ ID NO: 639300 - DNA, 16 bp, Homo sapiens
tctctcctctctctcc

SEQ ID NO: 639301 - DNA, 11 bp, Homo sapiens
tctctctccct

SEQ ID NO: 639302 - DNA, 10 bp, Homo sapiens
tctctctctc

SEQ ID NO: 639303 - DNA, 15 bp, Homo sapiens
tctctctctctctgt

SEQ ID NO: 639304 - DNA, 16 bp, Homo sapiens
tctctctctctctgtt

SEQ ID NO: 639305 - DNA, 14 bp, Homo sapiens
tctctctctctgtt

SEQ ID NO: 639306 - DNA, 15 bp, Homo sapiens
tctctctctctgttc

SEQ ID NO: 639307 - DNA, 16 bp, Homo sapiens
tctctctgtgtggcaa

SEQ ID NO: 639308 - DNA, 12 bp, Homo sapiens
tctctctgttcc

SEQ ID NO: 639309 - DNA, 16 bp, Homo sapiens
tctctcttggtctctt

SEQ ID NO: 639310 - DNA, 17 bp, Homo sapiens
tctctcttggtctcttt

SEQ ID NO: 639311 - DNA, 22 bp, Homo sapiens
tctctcttggtctctttctttc

SEQ ID NO: 639312 - DNA, 16 bp, Homo sapiens
tctctgagcagtgggg

SEQ ID NO: 639313 - DNA, 24 bp, Homo sapiens
tctctgccggtggggccagcgctg

SEQ ID NO: 639314 - DNA, 15 bp, Homo sapiens
tctctgtaaaaagca

SEQ ID NO: 639315 - DNA, 13 bp, Homo sapiens
tctctgtgtggca

SEQ ID NO: 639316 - DNA, 12 bp, Homo sapiens
tctctgttccaa

SEQ ID NO: 639317 - DNA, 13 bp, Homo sapiens
tctctttctttcc

SEQ ID NO: 639318 - DNA, 15 bp, Homo sapiens
tctctttctttccaa

SEQ ID NO: 639319 - DNA, 18 bp, Homo sapiens
tctctttcttttgtgcat

SEQ ID NO: 639320 - DNA, 19 bp, Homo sapiens
tctctttcttttgtgcata

SEQ ID NO: 639321 - DNA, 12 bp, Homo sapiens
tctgaaaactgg

SEQ ID NO: 639322 - DNA, 14 bp, Homo sapiens
tctgaaacatagat

SEQ ID NO: 639323 - DNA, 13 bp, Homo sapiens
tctgaaggagagg

SEQ ID NO: 639324 - DNA, 14 bp, Homo sapiens
tctgaaggagagga

SEQ ID NO: 639325 - DNA, 15 bp, Homo sapiens
tctgaaggagaggag

SEQ ID NO: 639326 - DNA, 21 bp, Homo sapiens
tctgaaggggaaaacctcagt

SEQ ID NO: 639327 - DNA, 22 bp, Homo sapiens
tctgaaggggaaaacctcagtt

SEQ ID NO: 639328 - DNA, 23 bp, Homo sapiens
tctgaaggggaaaacctcagttg

SEQ ID NO: 639329 - DNA, 22 bp, Homo sapiens
tctgaagtcccttcctgtcctg

SEQ ID NO: 639330 - DNA, 18 bp, Homo sapiens
tctgaatctctcaaaatg

SEQ ID NO: 639331 - DNA, 16 bp, Homo sapiens
tctgagacagagagcc

SEQ ID NO: 639332 - DNA, 22 bp, Homo sapiens
tctgagcagacagggcgtcctc

SEQ ID NO: 639333 - DNA, 23 bp, Homo sapiens
tctgagcagacagggcgtcctct

SEQ ID NO: 639334 - DNA, 16 bp, Homo sapiens
tctgagccctgccctc

SEQ ID NO: 639335 - DNA, 18 bp, Homo sapiens
tctgagccctgccctcac

SEQ ID NO: 639336 - DNA, 20 bp, Homo sapiens
tctgagccctgccctcactc

SEQ ID NO: 639337 - DNA, 14 bp, Homo sapiens
tctgaggagtccaa

SEQ ID NO: 639338 - DNA, 17 bp, Homo sapiens
tctgaggctgccccagg

SEQ ID NO: 639339 - DNA, 21 bp, Homo sapiens
tctgatacttatttataacat

SEQ ID NO: 639340 - DNA, 12 bp, Homo sapiens
tctgatttctga

SEQ ID NO: 639341 - DNA, 15 bp, Homo sapiens
tctgcacacataaca

SEQ ID NO: 639342 - DNA, 14 bp, Homo sapiens
tctgcagcctgagc

SEQ ID NO: 639343 - DNA, 18 bp, Homo sapiens
tctgcagcctgagctcca

SEQ ID NO: 639344 - DNA, 19 bp, Homo sapiens
tctgcagcctgagctccac

SEQ ID NO: 639345 - DNA, 17 bp, Homo sapiens
tctgccacaagggcagt

SEQ ID NO: 639346 - DNA, 9 bp, Homo sapiens
tctgccccc

SEQ ID NO: 639347 - DNA, 13 bp, Homo sapiens
tctgccccctccc

SEQ ID NO: 639348 - DNA, 14 bp, Homo sapiens
tctgccccctcccc

SEQ ID NO: 639349 - DNA, 19 bp, Homo sapiens
tctgccccctcccccgcag

SEQ ID NO: 639350 - DNA, 22 bp, Homo sapiens
tctgccccctcccccgcagaca

SEQ ID NO: 639351 - DNA, 12 bp, Homo sapiens
tctgcccctccg

SEQ ID NO: 639352 - DNA, 17 bp, Homo sapiens
tctgccccttgacccca

SEQ ID NO: 639353 - DNA, 23 bp, Homo sapiens
tctgcccgcgggtggctggagcc

SEQ ID NO: 639354 - DNA, 15 bp, Homo sapiens
tctgccctgcctgag

SEQ ID NO: 639355 - DNA, 18 bp, Homo sapiens
tctgccctgcctgaggag

SEQ ID NO: 639356 - DNA, 22 bp, Homo sapiens
tctgccggtggggccagcgctg

SEQ ID NO: 639357 - DNA, 16 bp, Homo sapiens
tctgcctgtcaagttt

SEQ ID NO: 639358 - DNA, 18 bp, Homo sapiens
tctgcgacgatccccatg

SEQ ID NO: 639359 - DNA, 14 bp, Homo sapiens
tctgcgccccagcg

SEQ ID NO: 639360 - DNA, 18 bp, Homo sapiens
tctgctcatctacacata

SEQ ID NO: 639361 - DNA, 14 bp, Homo sapiens
tctgctgaattttc

SEQ ID NO: 639362 - DNA, 22 bp, Homo sapiens
tctgctttggggcttatcagaa

SEQ ID NO: 639363 - DNA, 23 bp, Homo sapiens
tctgctttggggcttatcagaac

SEQ ID NO: 639364 - DNA, 15 bp, Homo sapiens
tctggaaaagcactt

SEQ ID NO: 639365 - DNA, 12 bp, Homo sapiens
tctggagcccct

SEQ ID NO: 639366 - DNA, 16 bp, Homo sapiens
tctggagcccctatcc

SEQ ID NO: 639367 - DNA, 23 bp, Homo sapiens
tctggagcccctatcctgcaccc

SEQ ID NO: 639368 - DNA, 12 bp, Homo sapiens
tctggagcctgc

SEQ ID NO: 639369 - DNA, 13 bp, Homo sapiens
tctggagtctgaa

SEQ ID NO: 639370 - DNA, 15 bp, Homo sapiens
gccaaagatagcaga

SEQ ID NO: 639371 - DNA, 13 bp, Homo sapiens
gccaacttaaacc

SEQ ID NO: 639372 - DNA, 21 bp, Homo sapiens
gccaagccagggttccagaca

SEQ ID NO: 639373 - DNA, 16 bp, Homo sapiens
gccaataaagctcaca

SEQ ID NO: 639374 - DNA, 17 bp, Homo sapiens
gccaataaagctcacac

SEQ ID NO: 639375 - DNA, 21 bp, Homo sapiens
gccaataaagctcacacttgg

SEQ ID NO: 639376 - DNA, 18 bp, Homo sapiens
gccaatttcaaagaaaac

SEQ ID NO: 639377 - DNA, 20 bp, Homo sapiens
gccaatttcaaagaaaacag

SEQ ID NO: 639378 - DNA, 15 bp, Homo sapiens
gccaatttttctgca

SEQ ID NO: 639379 - DNA, 13 bp, Homo sapiens
gccacagtggggc

SEQ ID NO: 639380 - DNA, 18 bp, Homo sapiens
gccacagtggggcccatg

SEQ ID NO: 639381 - DNA, 20 bp, Homo sapiens
gccacagtggggcccatggc

SEQ ID NO: 639382 - DNA, 12 bp, Homo sapiens
gccacctgccag

SEQ ID NO: 639383 - DNA, 13 bp, Homo sapiens
gccacctgccagg

SEQ ID NO: 639384 - DNA, 22 bp, Homo sapiens
gccacctgccaggcctccctcg

SEQ ID NO: 639385 - DNA, 18 bp, Homo sapiens
gccaccttgtacagaacc

SEQ ID NO: 639386 - DNA, 17 bp, Homo sapiens
gccacgttgcagaaaaa

SEQ ID NO: 639387 - DNA, 18 bp, Homo sapiens
gccacgttgcagaaaaag

SEQ ID NO: 639388 - DNA, 22 bp, Homo sapiens
gccactacctttgtccaggcct

SEQ ID NO: 639389 - DNA, 13 bp, Homo sapiens
gccagatttcact

SEQ ID NO: 639390 - DNA, 13 bp, Homo sapiens
gccagcagacatt

SEQ ID NO: 639391 - DNA, 17 bp, Homo sapiens
gccagcattcagcacac

SEQ ID NO: 639392 - DNA, 19 bp, Homo sapiens
gccagccatgcccacgccc

SEQ ID NO: 639393 - DNA, 12 bp, Homo sapiens
gccagccctgtt

SEQ ID NO: 639394 - DNA, 22 bp, Homo sapiens
gccagccctgttccgcctcact

SEQ ID NO: 639395 - DNA, 23 bp, Homo sapiens
gccagccctgttccgcctcactg

SEQ ID NO: 639396 - DNA, 22 bp, Homo sapiens
gccagcccttgctctacctggc

SEQ ID NO: 639397 - DNA, 16 bp, Homo sapiens
gccagctctgagcaga

SEQ ID NO: 639398 - DNA, 10 bp, Homo sapiens
gccaggagac

SEQ ID NO: 639399 - DNA, 11 bp, Homo sapiens
gccaggagacc

SEQ ID NO: 639400 - DNA, 14 bp, Homo sapiens
gccaggccctccag

SEQ ID NO: 639401 - DNA, 18 bp, Homo sapiens
gccaggcctcagggacca

SEQ ID NO: 639402 - DNA, 15 bp, Homo sapiens
gccaggcctccctcg

SEQ ID NO: 639403 - DNA, 16 bp, Homo sapiens
gccagggcagaggaat

SEQ ID NO: 639404 - DNA, 18 bp, Homo sapiens
gccagggcagaggaatgt

SEQ ID NO: 639405 - DNA, 16 bp, Homo sapiens
gccagggctcagatgg

SEQ ID NO: 639406 - DNA, 21 bp, Homo sapiens
gccagggctcagatggggcct

SEQ ID NO: 639407 - DNA, 22 bp, Homo sapiens
gccagggctcagatggggcctg

SEQ ID NO: 639408 - DNA, 19 bp, Homo sapiens
gccaggggcttctccccct

SEQ ID NO: 639409 - DNA, 20 bp, Homo sapiens
gccaggggcttctccccctc

SEQ ID NO: 639410 - DNA, 18 bp, Homo sapiens
gccagggtgggaagagaa

SEQ ID NO: 639411 - DNA, 19 bp, Homo sapiens
gccagggtgggaagagaag

SEQ ID NO: 639412 - DNA, 20 bp, Homo sapiens
gccagggtgggaagagaaga

SEQ ID NO: 639413 - DNA, 14 bp, Homo sapiens
gccatagccccagg

SEQ ID NO: 639414 - DNA, 15 bp, Homo sapiens
gccatagccccaggc

SEQ ID NO: 639415 - DNA, 17 bp, Homo sapiens
gccatagccccaggccc

SEQ ID NO: 639416 - DNA, 19 bp, Homo sapiens
gccatagccccaggcccgc

SEQ ID NO: 639417 - DNA, 19 bp, Homo sapiens
gccatatattttctgagta

SEQ ID NO: 639418 - DNA, 18 bp, Homo sapiens
gccatccttgctgcagct

SEQ ID NO: 639419 - DNA, 23 bp, Homo sapiens
gccatctccaccctgagcctgac

SEQ ID NO: 639420 - DNA, 21 bp, Homo sapiens
gccatgcccacgcccctcccc

SEQ ID NO: 639421 - DNA, 22 bp, Homo sapiens
gccatgcccacgcccctcccca

SEQ ID NO: 639422 - DNA, 23 bp, Homo sapiens
gccatggtgaactgataattttt

SEQ ID NO: 639423 - DNA, 23 bp, Homo sapiens
gccattgcacttcggataatttt

SEQ ID NO: 639424 - DNA, 22 bp, Homo sapiens
gccatttgctagttctgctgcc

SEQ ID NO: 639425 - DNA, 14 bp, Homo sapiens
gcccaaataacagt

SEQ ID NO: 639426 - DNA, 15 bp, Homo sapiens
gcccaacccccacct

SEQ ID NO: 639427 - DNA, 16 bp, Homo sapiens
gcccaacccccacctc

SEQ ID NO: 639428 - DNA, 17 bp, Homo sapiens
gcccaacccccacctcc

SEQ ID NO: 639429 - DNA, 19 bp, Homo sapiens
gcccaacccccacctcccg

SEQ ID NO: 639430 - DNA, 15 bp, Homo sapiens
gcccacatttgggct

SEQ ID NO: 639431 - DNA, 15 bp, Homo sapiens
gcccacccagcagcg

SEQ ID NO: 639432 - DNA, 16 bp, Homo sapiens
gcccaccccgctgcct

SEQ ID NO: 639433 - DNA, 18 bp, Homo sapiens
gcccaccccgctgcctgg

SEQ ID NO: 639434 - DNA, 22 bp, Homo sapiens
gcccacccctcttcccccttcc

SEQ ID NO: 639435 - DNA, 12 bp, Homo sapiens
gcccacccgccc

SEQ ID NO: 639436 - DNA, 14 bp, Homo sapiens
gcccacccgcccca

SEQ ID NO: 639437 - DNA, 16 bp, Homo sapiens
gcccacccgccccaga

SEQ ID NO: 639438 - DNA, 20 bp, Homo sapiens
gcccacccgtgttctcctcc

SEQ ID NO: 639439 - DNA, 13 bp, Homo sapiens
gcccaccctgggc

SEQ ID NO: 639440 - DNA, 17 bp, Homo sapiens
gcccaccctgggcctcc

SEQ ID NO: 639441 - DNA, 20 bp, Homo sapiens
gcccaccctgggcctcccgt

SEQ ID NO: 639442 - DNA, 12 bp, Homo sapiens
gcccacctgccc

SEQ ID NO: 639443 - DNA, 13 bp, Homo sapiens
gcccacctgccca

SEQ ID NO: 639444 - DNA, 15 bp, Homo sapiens
gcccacgcagagccc

SEQ ID NO: 639445 - DNA, 16 bp, Homo sapiens
gcccacgcagagcccc

SEQ ID NO: 639446 - DNA, 18 bp, Homo sapiens
gcccacgcagagccccgg

SEQ ID NO: 639447 - DNA, 19 bp, Homo sapiens
gcccacgcagagccccgga

SEQ ID NO: 639448 - DNA, 17 bp, Homo sapiens
gcccacgcccctcccca

SEQ ID NO: 639449 - DNA, 22 bp, Homo sapiens
gcccacgtgcagcacctgtcac

SEQ ID NO: 639450 - DNA, 19 bp, Homo sapiens
gcccacttcacacatttat

SEQ ID NO: 639451 - DNA, 20 bp, Homo sapiens
gcccagaacgggcctccccg

SEQ ID NO: 639452 - DNA, 17 bp, Homo sapiens
gcccagcacctcctccg

SEQ ID NO: 639453 - DNA, 11 bp, Homo sapiens
gcccagccccc

SEQ ID NO: 639454 - DNA, 16 bp, Homo sapiens
gcccagcccccacccc

SEQ ID NO: 639455 - DNA, 13 bp, Homo sapiens
gcccagccctggg

SEQ ID NO: 639456 - DNA, 18 bp, Homo sapiens
gcccaggcccagcctctt

SEQ ID NO: 639457 - DNA, 18 bp, Homo sapiens
gcccagggaggtggcagg

SEQ ID NO: 639458 - DNA, 14 bp, Homo sapiens
gcccagtccctgga

SEQ ID NO: 639459 - DNA, 19 bp, Homo sapiens
gcccagtccctggagctgt

SEQ ID NO: 639460 - DNA, 18 bp, Homo sapiens
gtgtatatgtttatacac

SEQ ID NO: 639461 - DNA, 22 bp, Homo sapiens
gtgtatatgtttatacacacag

SEQ ID NO: 639462 - DNA, 23 bp, Homo sapiens
gtgtatttctattttgcagcagt

SEQ ID NO: 639463 - DNA, 13 bp, Homo sapiens
gtgtcaaattttt

SEQ ID NO: 639464 - DNA, 16 bp, Homo sapiens
gtgtcacttttttcct

SEQ ID NO: 639465 - DNA, 19 bp, Homo sapiens
gtgtccattgacatgtaca

SEQ ID NO: 639466 - DNA, 21 bp, Homo sapiens
gtgtccattgacatgtacaga

SEQ ID NO: 639467 - DNA, 12 bp, Homo sapiens
gtgtctggagcc

SEQ ID NO: 639468 - DNA, 18 bp, Homo sapiens
gtgtcttgagaccagcct

SEQ ID NO: 639469 - DNA, 21 bp, Homo sapiens
gtgtcttttaaaaactcctgt

SEQ ID NO: 639470 - DNA, 16 bp, Homo sapiens
gtgtcttttgcatgat

SEQ ID NO: 639471 - DNA, 21 bp, Homo sapiens
gtgtcttttgttctctcttgg

SEQ ID NO: 639472 - DNA, 12 bp, Homo sapiens
gtgtgaggcccc

SEQ ID NO: 639473 - DNA, 18 bp, Homo sapiens
gtgtgcagactgtggctg

SEQ ID NO: 639474 - DNA, 21 bp, Homo sapiens
gtgtgcagagtatacaagtgt

SEQ ID NO: 639475 - DNA, 20 bp, Homo sapiens
gtgtgcccacccgtgttctc

SEQ ID NO: 639476 - DNA, 17 bp, Homo sapiens
gtgtgctattcgtaagt

SEQ ID NO: 639477 - DNA, 18 bp, Homo sapiens
gtgtgcttacctgttgtc

SEQ ID NO: 639478 - DNA, 14 bp, Homo sapiens
gtgtggcaaacatt

SEQ ID NO: 639479 - DNA, 15 bp, Homo sapiens
gtgtggcctggcttc

SEQ ID NO: 639480 - DNA, 17 bp, Homo sapiens
gtgtggcttaaacattt

SEQ ID NO: 639481 - DNA, 17 bp, Homo sapiens
gtgtgggtttactctgt

SEQ ID NO: 639482 - DNA, 13 bp, Homo sapiens
gtgtgtgcaatgt

SEQ ID NO: 639483 - DNA, 12 bp, Homo sapiens
gtgttaaaacat

SEQ ID NO: 639484 - DNA, 13 bp, Homo sapiens
gtgttcaaattct

SEQ ID NO: 639485 - DNA, 16 bp, Homo sapiens
gtgttcaaattctgat

SEQ ID NO: 639486 - DNA, 14 bp, Homo sapiens
gtgttctcaacaca

SEQ ID NO: 639487 - DNA, 16 bp, Homo sapiens
gtgttctcaacacaca

SEQ ID NO: 639488 - DNA, 17 bp, Homo sapiens
gtgttctcaacacacag

SEQ ID NO: 639489 - DNA, 14 bp, Homo sapiens
gtgttctctccgga

SEQ ID NO: 639490 - DNA, 17 bp, Homo sapiens
gtgttgggaattgcatg

SEQ ID NO: 639491 - DNA, 19 bp, Homo sapiens
gtgttgtccgtgtctgttg

SEQ ID NO: 639492 - DNA, 19 bp, Homo sapiens
gtgtttggaggctgctgcc

SEQ ID NO: 639493 - DNA, 15 bp, Homo sapiens
gttaaaacatcaaaa

SEQ ID NO: 639494 - DNA, 22 bp, Homo sapiens
gttaaaatatagtgttgtgtta

SEQ ID NO: 639495 - DNA, 12 bp, Homo sapiens
gttaacagtaaa

SEQ ID NO: 639496 - DNA, 21 bp, Homo sapiens
gttaacccagtgttcagcata

SEQ ID NO: 639497 - DNA, 18 bp, Homo sapiens
gttaaccgggactacaga

SEQ ID NO: 639498 - DNA, 19 bp, Homo sapiens
gttaaggggatctaaaagg

SEQ ID NO: 639499 - DNA, 12 bp, Homo sapiens
gttaatgaaaaa

SEQ ID NO: 639500 - DNA, 20 bp, Homo sapiens
gttaattctcagaagtgaaa

SEQ ID NO: 639501 - DNA, 16 bp, Homo sapiens
gttacaaatttttact

SEQ ID NO: 639502 - DNA, 12 bp, Homo sapiens
gttacttacaca

SEQ ID NO: 639503 - DNA, 15 bp, Homo sapiens
gttagaaaggcagcc

SEQ ID NO: 639504 - DNA, 14 bp, Homo sapiens
gttagagactcgcc

SEQ ID NO: 639505 - DNA, 12 bp, Homo sapiens
gttatatttcaa

SEQ ID NO: 639506 - DNA, 19 bp, Homo sapiens
gttatcattcttataacat

SEQ ID NO: 639507 - DNA, 21 bp, Homo sapiens
gttatggcaagtttttggtaa

SEQ ID NO: 639508 - DNA, 13 bp, Homo sapiens
gttatgttgtaat

SEQ ID NO: 639509 - DNA, 18 bp, Homo sapiens
gttattcgttactctaag

SEQ ID NO: 639510 - DNA, 19 bp, Homo sapiens
gttatttactcctcctgct

SEQ ID NO: 639511 - DNA, 18 bp, Homo sapiens
gttcaaagaacccccctc

SEQ ID NO: 639512 - DNA, 16 bp, Homo sapiens
gttcaatttcagaaac

SEQ ID NO: 639513 - DNA, 18 bp, Homo sapiens
gttcaatttcagaaacta

SEQ ID NO: 639514 - DNA, 14 bp, Homo sapiens
gttcaccttctgtg

SEQ ID NO: 639515 - DNA, 16 bp, Homo sapiens
gttcacgtgactcctc

SEQ ID NO: 639516 - DNA, 20 bp, Homo sapiens
gttcagatctcatagatgac

SEQ ID NO: 639517 - DNA, 21 bp, Homo sapiens
gttcagatctcatagatgacc

SEQ ID NO: 639518 - DNA, 14 bp, Homo sapiens
gttcatctgaggag

SEQ ID NO: 639519 - DNA, 18 bp, Homo sapiens
gttcatctgaggagtcca

SEQ ID NO: 639520 - DNA, 19 bp, Homo sapiens
gttcatgtgtaacttctag

SEQ ID NO: 639521 - DNA, 17 bp, Homo sapiens
gttcattcatactcaaa

SEQ ID NO: 639522 - DNA, 9 bp, Homo sapiens
gttccaagt

SEQ ID NO: 639523 - DNA, 18 bp, Homo sapiens
gttccaagtgtgtgtgca

SEQ ID NO: 639524 - DNA, 19 bp, Homo sapiens
gttccagacagagtggatc

SEQ ID NO: 639525 - DNA, 12 bp, Homo sapiens
gttccagacagg

SEQ ID NO: 639526 - DNA, 20 bp, Homo sapiens
gttccagacagggtggggct

SEQ ID NO: 639527 - DNA, 16 bp, Homo sapiens
gttccatgaagacaaa

SEQ ID NO: 639528 - DNA, 14 bp, Homo sapiens
gttccattctatga

SEQ ID NO: 639529 - DNA, 19 bp, Homo sapiens
gttcccttgattcaaataa

SEQ ID NO: 639530 - DNA, 23 bp, Homo sapiens
gttccctttccccattcagtgac

SEQ ID NO: 639531 - DNA, 11 bp, Homo sapiens
gttcctccagc

SEQ ID NO: 639532 - DNA, 13 bp, Homo sapiens
gttcctccagcaa

SEQ ID NO: 639533 - DNA, 17 bp, Homo sapiens
gttctatataatttttc

SEQ ID NO: 639534 - DNA, 13 bp, Homo sapiens
gttctgaaatgga

SEQ ID NO: 639535 - DNA, 17 bp, Homo sapiens
gttctgaaattaggaaa

SEQ ID NO: 639536 - DNA, 16 bp, Homo sapiens
gttctgcaataacagt

SEQ ID NO: 639537 - DNA, 13 bp, Homo sapiens
gttctgccactta

SEQ ID NO: 639538 - DNA, 15 bp, Homo sapiens
gttctgccctgcctg

SEQ ID NO: 639539 - DNA, 17 bp, Homo sapiens
gttctgccctgcctgag

SEQ ID NO: 639540 - DNA, 19 bp, Homo sapiens
gttctgccctgcctgagga

SEQ ID NO: 639541 - DNA, 19 bp, Homo sapiens
gttctgtgcagtttggtat

SEQ ID NO: 639542 - DNA, 16 bp, Homo sapiens
gttcttcctcttacct

SEQ ID NO: 639543 - DNA, 16 bp, Homo sapiens
gttcttgagcagctga

SEQ ID NO: 639544 - DNA, 18 bp, Homo sapiens
gttcttgcagcagagaga

SEQ ID NO: 639545 - DNA, 19 bp, Homo sapiens
gttcttgtaaaactgtgac

SEQ ID NO: 639546 - DNA, 14 bp, Homo sapiens
gttgaagtgcatgt

SEQ ID NO: 639547 - DNA, 15 bp, Homo sapiens
gttgaagtgcatgtt

SEQ ID NO: 639548 - DNA, 15 bp, Homo sapiens
gttgagccagcagac

SEQ ID NO: 639549 - DNA, 16 bp, Homo sapiens
gttgagccagcagaca

SEQ ID NO: 639550 - DNA, 14 bp, Homo sapiens
gttgagtttgctgt

SEQ ID NO: 639551 - DNA, 18 bp, Homo sapiens
gttgatagtttacaaaca

SEQ ID NO: 639552 - DNA, 14 bp, Homo sapiens
gttgattctttcaa

SEQ ID NO: 639553 - DNA, 19 bp, Homo sapiens
gttgctccaactgaattgc

SEQ ID NO: 639554 - DNA, 21 bp, Homo sapiens
gttggccggctggccggtcca

SEQ ID NO: 639555 - DNA, 13 bp, Homo sapiens
gttgggttccaga

SEQ ID NO: 639556 - DNA, 15 bp, Homo sapiens
gttgggttccagaca

SEQ ID NO: 639557 - DNA, 19 bp, Homo sapiens
gttgggttccagacagagt

SEQ ID NO: 639558 - DNA, 14 bp, Homo sapiens
gttggtatttactg

SEQ ID NO: 639559 - DNA, 12 bp, Homo sapiens
gttgtaaagata

SEQ ID NO: 639560 - DNA, 20 bp, Homo sapiens
gttgtaatatcagttacagt

SEQ ID NO: 639561 - DNA, 12 bp, Homo sapiens
gttgtccctgca

SEQ ID NO: 639562 - DNA, 13 bp, Homo sapiens
gttgtccctgcag

SEQ ID NO: 639563 - DNA, 14 bp, Homo sapiens
gttgtctgaaacat

SEQ ID NO: 639564 - DNA, 12 bp, Homo sapiens
gttgtgttacaa

SEQ ID NO: 639565 - DNA, 15 bp, Homo sapiens
gtttaaaaatcagaa

SEQ ID NO: 639566 - DNA, 13 bp, Homo sapiens
gtttaaaattatt

SEQ ID NO: 639567 - DNA, 23 bp, Homo sapiens
gtttccatttggattttaaacaa

SEQ ID NO: 639568 - DNA, 20 bp, Homo sapiens
gtttcgcattaagcacacac

SEQ ID NO: 639569 - DNA, 18 bp, Homo sapiens
gtttctgcagtattctgt

SEQ ID NO: 639570 - DNA, 21 bp, Homo sapiens
gtttgatgaataaaatgttta

SEQ ID NO: 639571 - DNA, 19 bp, Homo sapiens
gtttggaggctgctgcccc

SEQ ID NO: 639572 - DNA, 15 bp, Homo sapiens
gtttggccctggagc

SEQ ID NO: 639573 - DNA, 17 bp, Homo sapiens
gtttggccctggagcca

SEQ ID NO: 639574 - DNA, 18 bp, Homo sapiens
gtttggccctggagccag

SEQ ID NO: 639575 - DNA, 19 bp, Homo sapiens
gtttggccctggagccagg

SEQ ID NO: 639576 - DNA, 22 bp, Homo sapiens
gtttgggggacgcccagccccc

SEQ ID NO: 639577 - DNA, 19 bp, Homo sapiens
gtttgtcctttatgtattc

SEQ ID NO: 639578 - DNA, 20 bp, Homo sapiens
gttttaaagaagtccatgtg

SEQ ID NO: 639579 - DNA, 22 bp, Homo sapiens
gttttacaaagaaacaaaatat

SEQ ID NO: 639580 - DNA, 18 bp, Homo sapiens
gttttatgagacttccta

SEQ ID NO: 639581 - DNA, 12 bp, Homo sapiens
gttttcacacct

SEQ ID NO: 639582 - DNA, 23 bp, Homo sapiens
gttttcagattgtaaaggtaggt

SEQ ID NO: 639583 - DNA, 15 bp, Homo sapiens
gttttcattctggtc

SEQ ID NO: 639584 - DNA, 22 bp, Homo sapiens
gtttttaaaaaaaatattctgt

SEQ ID NO: 639585 - DNA, 23 bp, Homo sapiens
gtttttatacctgtacacacaca

SEQ ID NO: 639586 - DNA, 13 bp, Homo sapiens
gttttttttctaa

SEQ ID NO: 639587 - DNA, 16 bp, Homo sapiens
taaaaaaaatagttga

SEQ ID NO: 639588 - DNA, 19 bp, Homo sapiens
taaaaaaataaaacatttt

SEQ ID NO: 639589 - DNA, 18 bp, Homo sapiens
taaaaaaataatataaat

SEQ ID NO: 639590 - DNA, 21 bp, Homo sapiens
taaaaaaatcccatttatgca

SEQ ID NO: 639591 - DNA, 19 bp, Homo sapiens
taaaaagccaagtgtcctg

SEQ ID NO: 639592 - DNA, 16 bp, Homo sapiens
taaaaatagctataaa

SEQ ID NO: 639593 - DNA, 22 bp, Homo sapiens
taaaaatcagaaagacattctt

SEQ ID NO: 639594 - DNA, 17 bp, Homo sapiens
taaaaattaaagcagca

SEQ ID NO: 639595 - DNA, 17 bp, Homo sapiens
taaaaattatctttaaa

SEQ ID NO: 639596 - DNA, 18 bp, Homo sapiens
taaaaattatctttaaaa

SEQ ID NO: 639597 - DNA, 20 bp, Homo sapiens
taaaacaagagaccacttcc

SEQ ID NO: 639598 - DNA, 19 bp, Homo sapiens
taaaacacccttgaaaata

SEQ ID NO: 639599 - DNA, 14 bp, Homo sapiens
taaaacatcaaaat

SEQ ID NO: 639600 - DNA, 15 bp, Homo sapiens
taaaacatcaaaatg

SEQ ID NO: 639601 - DNA, 17 bp, Homo sapiens
taaaacattttaaatgg

SEQ ID NO: 639602 - DNA, 22 bp, Homo sapiens
taaaacattttaaatggacaga

SEQ ID NO: 639603 - DNA, 13 bp, Homo sapiens
taaaaccacagct

SEQ ID NO: 639604 - DNA, 18 bp, Homo sapiens
taaaaccacagctgggca

SEQ ID NO: 639605 - DNA, 16 bp, Homo sapiens
taaaaccagaaagagg

SEQ ID NO: 639606 - DNA, 12 bp, Homo sapiens
taaaaccaggct

SEQ ID NO: 639607 - DNA, 15 bp, Homo sapiens
taaaactaaatagca

SEQ ID NO: 639608 - DNA, 20 bp, Homo sapiens
taaaactaaatagcatgtat

SEQ ID NO: 639609 - DNA, 11 bp, Homo sapiens
taaaactgtga

SEQ ID NO: 639610 - DNA, 22 bp, Homo sapiens
taaaactgtgacattccacaga

SEQ ID NO: 639611 - DNA, 18 bp, Homo sapiens
taaaacttactatggtat

SEQ ID NO: 639612 - DNA, 16 bp, Homo sapiens
taaaagcccatgctta

SEQ ID NO: 639613 - DNA, 17 bp, Homo sapiens
taaaataattatatgaa

SEQ ID NO: 639614 - DNA, 20 bp, Homo sapiens
taaaataattatatgaagca

SEQ ID NO: 639615 - DNA, 16 bp, Homo sapiens
taaaatacttattatg

SEQ ID NO: 639616 - DNA, 18 bp, Homo sapiens
taaaatatagtgttgtgt

SEQ ID NO: 639617 - DNA, 19 bp, Homo sapiens
taaaatatagtgttgtgtt

SEQ ID NO: 639618 - DNA, 21 bp, Homo sapiens
taaaatcaaatttttctggga

SEQ ID NO: 639619 - DNA, 17 bp, Homo sapiens
taaaatctgtattgcta

SEQ ID NO: 639620 - DNA, 19 bp, Homo sapiens
taaaatggcatttagcaca

SEQ ID NO: 639621 - DNA, 21 bp, Homo sapiens
taaaatgtgtttttcagttat

SEQ ID NO: 639622 - DNA, 19 bp, Homo sapiens
taaacaaaaactttccatg

SEQ ID NO: 639623 - DNA, 21 bp, Homo sapiens
taaacaaaatttatgtcattt

SEQ ID NO: 639624 - DNA, 17 bp, Homo sapiens
taaacaaattccttccc

SEQ ID NO: 639625 - DNA, 16 bp, Homo sapiens
taaacaattcaagtga

SEQ ID NO: 639626 - DNA, 23 bp, Homo sapiens
taaacatagtggtattttaacat

SEQ ID NO: 639627 - DNA, 13 bp, Homo sapiens
taaacatcataaa

SEQ ID NO: 639628 - DNA, 20 bp, Homo sapiens
taaacattttttgtttcttg

SEQ ID NO: 639629 - DNA, 19 bp, Homo sapiens
taaacctgtgctttcatgt

SEQ ID NO: 639630 - DNA, 13 bp, Homo sapiens
taaactcagtcaa

SEQ ID NO: 639631 - DNA, 14 bp, Homo sapiens
taaactgggaaatg

SEQ ID NO: 639632 - DNA, 14 bp, Homo sapiens
taaactgtgagata

SEQ ID NO: 639633 - DNA, 20 bp, Homo sapiens
taaagaaaggcagagattgg

SEQ ID NO: 639634 - DNA, 14 bp, Homo sapiens
taaagaaagtcata

SEQ ID NO: 639635 - DNA, 18 bp, Homo sapiens
taaagaagtccatgtgat

SEQ ID NO: 639636 - DNA, 23 bp, Homo sapiens
taaagaccatttagtcctcacct

SEQ ID NO: 639637 - DNA, 18 bp, Homo sapiens
taaagagcacgttttcca

SEQ ID NO: 639638 - DNA, 16 bp, Homo sapiens
taaagatattgtatct

SEQ ID NO: 639639 - DNA, 22 bp, Homo sapiens
taaagatattgtatctccttta

SEQ ID NO: 639640 - DNA, 24 bp, Homo sapiens
taaagatattgtatctcctttaat

SEQ ID NO: 639641 - DNA, 20 bp, Homo sapiens
taaagatctttttttaagtg

SEQ ID NO: 639642 - DNA, 16 bp, Homo sapiens
taaagcaactgtctat

SEQ ID NO: 639643 - DNA, 20 bp, Homo sapiens
taaagcaactgtctatttct

SEQ ID NO: 639644 - DNA, 19 bp, Homo sapiens
taaagctcacacttgggct

SEQ ID NO: 639645 - DNA, 14 bp, Homo sapiens
taaaggtgatgaat

SEQ ID NO: 639646 - DNA, 20 bp, Homo sapiens
taaaggtgatgaatttacca

SEQ ID NO: 639647 - DNA, 15 bp, Homo sapiens
taaagtctgagaaat

SEQ ID NO: 639648 - DNA, 17 bp, Homo sapiens
taaataaaaatagctat

SEQ ID NO: 639649 - DNA, 17 bp, Homo sapiens
taaataaaaattatgtc

SEQ ID NO: 639650 - DNA, 17 bp, Homo sapiens
taaataatagatgtgaa

SEQ ID NO: 639651 - DNA, 15 bp, Homo sapiens
taaataatcatacac

SEQ ID NO: 639652 - DNA, 22 bp, Homo sapiens
taaatagatttttagattccta

SEQ ID NO: 639653 - DNA, 13 bp, Homo sapiens
taaatagcatgta

SEQ ID NO: 639654 - DNA, 14 bp, Homo sapiens
taaatagcatgtat

SEQ ID NO: 639655 - DNA, 14 bp, Homo sapiens
taaatagtgaaaat

SEQ ID NO: 639656 - DNA, 18 bp, Homo sapiens
taaatatacactttacat

SEQ ID NO: 639657 - DNA, 13 bp, Homo sapiens
taaatattgctgt

SEQ ID NO: 639658 - DNA, 16 bp, Homo sapiens
taaatcacagatttcc

SEQ ID NO: 639659 - DNA, 17 bp, Homo sapiens
taaatcacagatttcca

SEQ ID NO: 639660 - DNA, 21 bp, Homo sapiens
taaatcactttaatttagaag

SEQ ID NO: 639661 - DNA, 14 bp, Homo sapiens
taaatcataatcat

SEQ ID NO: 639662 - DNA, 16 bp, Homo sapiens
taaatcatcctcatgt

SEQ ID NO: 639663 - DNA, 13 bp, Homo sapiens
taaatctaaatat

SEQ ID NO: 639664 - DNA, 21 bp, Homo sapiens
taaatctaaattaacttctat

SEQ ID NO: 639665 - DNA, 21 bp, Homo sapiens
taaatctacaaacttttataa

SEQ ID NO: 639666 - DNA, 22 bp, Homo sapiens
taaatcttacccttcaatgtta

SEQ ID NO: 639667 - DNA, 13 bp, Homo sapiens
tacgttttctgca

SEQ ID NO: 639668 - DNA, 12 bp, Homo sapiens
tactaacagtaa

SEQ ID NO: 639669 - DNA, 16 bp, Homo sapiens
tactaacagtaactgc

SEQ ID NO: 639670 - DNA, 15 bp, Homo sapiens
tactaaccaccattt

SEQ ID NO: 639671 - DNA, 17 bp, Homo sapiens
tactaaccaccatttcc

SEQ ID NO: 639672 - DNA, 22 bp, Homo sapiens
tactagaaccttctaatccatg

SEQ ID NO: 639673 - DNA, 16 bp, Homo sapiens
tactcaggctttctat

SEQ ID NO: 639674 - DNA, 19 bp, Homo sapiens
tactcatttggatataaat

SEQ ID NO: 639675 - DNA, 22 bp, Homo sapiens
tactcatttggatataaatctt

SEQ ID NO: 639676 - DNA, 16 bp, Homo sapiens
tactcctcctgctcct

SEQ ID NO: 639677 - DNA, 15 bp, Homo sapiens
tactctagattttgt

SEQ ID NO: 639678 - DNA, 17 bp, Homo sapiens
tactctgagtcctcatt

SEQ ID NO: 639679 - DNA, 14 bp, Homo sapiens
tactgaattgttat

SEQ ID NO: 639680 - DNA, 16 bp, Homo sapiens
tactgacatggtgctg

SEQ ID NO: 639681 - DNA, 21 bp, Homo sapiens
tactgcaatgtctgtccctaa

SEQ ID NO: 639682 - DNA, 19 bp, Homo sapiens
tactgcccacatttgggct

SEQ ID NO: 639683 - DNA, 15 bp, Homo sapiens
tactggccttttcac

SEQ ID NO: 639684 - DNA, 14 bp, Homo sapiens
tactgttttgggcc

SEQ ID NO: 639685 - DNA, 14 bp, Homo sapiens
tacttaaacaaaaa

SEQ ID NO: 639686 - DNA, 22 bp, Homo sapiens
tacttaaacaaaaactttccat

SEQ ID NO: 639687 - DNA, 22 bp, Homo sapiens
tacttaccagtcaatgcattgt

SEQ ID NO: 639688 - DNA, 15 bp, Homo sapiens
tacttatattctgca

SEQ ID NO: 639689 - DNA, 17 bp, Homo sapiens
tacttcaagtaagatca

SEQ ID NO: 639690 - DNA, 12 bp, Homo sapiens
tacttgattaag

SEQ ID NO: 639691 - DNA, 14 bp, Homo sapiens
tacttgattaagga

SEQ ID NO: 639692 - DNA, 14 bp, Homo sapiens
tacttgatttttca

SEQ ID NO: 639693 - DNA, 19 bp, Homo sapiens
tacttgttatgttgtaata

SEQ ID NO: 639694 - DNA, 16 bp, Homo sapiens
tactttaaattgtgga

SEQ ID NO: 639695 - DNA, 18 bp, Homo sapiens
tactttacaatcatgcct

SEQ ID NO: 639696 - DNA, 16 bp, Homo sapiens
tagaaaaaactggaaa

SEQ ID NO: 639697 - DNA, 20 bp, Homo sapiens
tagaaaaccccacagaaatc

SEQ ID NO: 639698 - DNA, 15 bp, Homo sapiens
tagaaaatatatttg

SEQ ID NO: 639699 - DNA, 15 bp, Homo sapiens
tagaaattaagattg

SEQ ID NO: 639700 - DNA, 16 bp, Homo sapiens
tagaaattctataaga

SEQ ID NO: 639701 - DNA, 23 bp, Homo sapiens
tagaaattctataagagacaaag

SEQ ID NO: 639702 - DNA, 17 bp, Homo sapiens
tagaaatttactatgta

SEQ ID NO: 639703 - DNA, 21 bp, Homo sapiens
tagaaatttattcttatctta

SEQ ID NO: 639704 - DNA, 13 bp, Homo sapiens
tagaaccttctaa

SEQ ID NO: 639705 - DNA, 19 bp, Homo sapiens
tagaagaaggactgaagaa

SEQ ID NO: 639706 - DNA, 19 bp, Homo sapiens
tagaagataggtgagcaac

SEQ ID NO: 639707 - DNA, 12 bp, Homo sapiens
tagaagatgacc

SEQ ID NO: 639708 - DNA, 15 bp, Homo sapiens
tagaataggcaaact

SEQ ID NO: 639709 - DNA, 14 bp, Homo sapiens
tagaatgtgaaaaa

SEQ ID NO: 639710 - DNA, 12 bp, Homo sapiens
tagacaagtgtt

SEQ ID NO: 639711 - DNA, 20 bp, Homo sapiens
tagacaatgtggaattacat

SEQ ID NO: 639712 - DNA, 19 bp, Homo sapiens
tagacagaaaccaagccat

SEQ ID NO: 639713 - DNA, 21 bp, Homo sapiens
tagacagaaaccaagccatta

SEQ ID NO: 639714 - DNA, 19 bp, Homo sapiens
tagacagaggtttcatttt

SEQ ID NO: 639715 - DNA, 20 bp, Homo sapiens
tagaccgtggtgtcctctgt

SEQ ID NO: 639716 - DNA, 23 bp, Homo sapiens
tagactaggaggttccggtgtct

SEQ ID NO: 639717 - DNA, 10 bp, Homo sapiens
tagagaggac

SEQ ID NO: 639718 - DNA, 17 bp, Homo sapiens
tagagcctcaattttgg

SEQ ID NO: 639719 - DNA, 17 bp, Homo sapiens
tagagggtccagtcttc

SEQ ID NO: 639720 - DNA, 20 bp, Homo sapiens
tagatgacccccaggtattg

SEQ ID NO: 639721 - DNA, 18 bp, Homo sapiens
tagattcctacttaaaca

SEQ ID NO: 639722 - DNA, 17 bp, Homo sapiens
tagatttttagattcct

SEQ ID NO: 639723 - DNA, 23 bp, Homo sapiens
tagcaaaaggatgatttaacatt

SEQ ID NO: 639724 - DNA, 22 bp, Homo sapiens
tagcaataagttgaatgataat

SEQ ID NO: 639725 - DNA, 20 bp, Homo sapiens
tagcacagaggatggcttcc

SEQ ID NO: 639726 - DNA, 22 bp, Homo sapiens
tagcacagaggatggcttcccc

SEQ ID NO: 639727 - DNA, 21 bp, Homo sapiens
tagcacagtatttaacattct

SEQ ID NO: 639728 - DNA, 13 bp, Homo sapiens
tagcaccagcttg

SEQ ID NO: 639729 - DNA, 18 bp, Homo sapiens
tagcagagaagcctgtct

SEQ ID NO: 639730 - DNA, 11 bp, Homo sapiens
tagcagagcct

SEQ ID NO: 639731 - DNA, 20 bp, Homo sapiens
tagcagctcttcccctttcc

SEQ ID NO: 639732 - DNA, 23 bp, Homo sapiens
tagcatactgatgagacaacaca

SEQ ID NO: 639733 - DNA, 15 bp, Homo sapiens
tagcatgagttctgc

SEQ ID NO: 639734 - DNA, 20 bp, Homo sapiens
tagcatgagttctgcacata

SEQ ID NO: 639735 - DNA, 15 bp, Homo sapiens
tagcatgtattgtgt

SEQ ID NO: 639736 - DNA, 23 bp, Homo sapiens
tagcatgtattgtgtcttttgca

SEQ ID NO: 639737 - DNA, 20 bp, Homo sapiens
tagccagcattcagcacaca

SEQ ID NO: 639738 - DNA, 15 bp, Homo sapiens
tagcccggccaagga

SEQ ID NO: 639739 - DNA, 23 bp, Homo sapiens
tagcccggccaaggacactgatg

SEQ ID NO: 639740 - DNA, 16 bp, Homo sapiens
tagccctctttctctc

SEQ ID NO: 639741 - DNA, 24 bp, Homo sapiens
tagccctctttctctctgtgtggc

SEQ ID NO: 639742 - DNA, 17 bp, Homo sapiens
tagcctctccgcccacg

SEQ ID NO: 639743 - DNA, 18 bp, Homo sapiens
tagcgttgttttgtggat

SEQ ID NO: 639744 - DNA, 19 bp, Homo sapiens
tagcgttgttttgtggata

SEQ ID NO: 639745 - DNA, 12 bp, Homo sapiens
tagctcacagca

SEQ ID NO: 639746 - DNA, 14 bp, Homo sapiens
tagctcgtgtgctt

SEQ ID NO: 639747 - DNA, 15 bp, Homo sapiens
tagctcgtgtgctta

SEQ ID NO: 639748 - DNA, 17 bp, Homo sapiens
tagctctgaatgctatt

SEQ ID NO: 639749 - DNA, 13 bp, Homo sapiens
tagctctgtccac

SEQ ID NO: 639750 - DNA, 14 bp, Homo sapiens
tagctgataaagaa

SEQ ID NO: 639751 - DNA, 20 bp, Homo sapiens
tagctgataaagaaaccttt

SEQ ID NO: 639752 - DNA, 19 bp, Homo sapiens
tagctttagagaagccata

SEQ ID NO: 639753 - DNA, 13 bp, Homo sapiens
tagcttttcactt

SEQ ID NO: 639754 - DNA, 14 bp, Homo sapiens
taggaaaaactgat

SEQ ID NO: 639755 - DNA, 14 bp, Homo sapiens
taggaaactctcca

SEQ ID NO: 639756 - DNA, 20 bp, Homo sapiens
taggaaagtactgcatgatc

SEQ ID NO: 639757 - DNA, 15 bp, Homo sapiens
taggaaataaatcta

SEQ ID NO: 639758 - DNA, 16 bp, Homo sapiens
taggaataacactgca

SEQ ID NO: 639759 - DNA, 22 bp, Homo sapiens
taggacatctctgtaaaaagca

SEQ ID NO: 639760 - DNA, 17 bp, Homo sapiens
taggacttaatttagca

SEQ ID NO: 639761 - DNA, 20 bp, Homo sapiens
taggagggtgcccctgggaa

SEQ ID NO: 639762 - DNA, 21 bp, Homo sapiens
taggagggtgcccctgggaac

SEQ ID NO: 639763 - DNA, 21 bp, Homo sapiens
taggaggttccggtgtctgga

SEQ ID NO: 639764 - DNA, 16 bp, Homo sapiens
taggcagggagggggc

SEQ ID NO: 639765 - DNA, 21 bp, Homo sapiens
taggcccccaaattgccttca

SEQ ID NO: 639766 - DNA, 20 bp, Homo sapiens
taggcctgagttagctgttt

SEQ ID NO: 639767 - DNA, 13 bp, Homo sapiens
taggctgctggcg

SEQ ID NO: 639768 - DNA, 18 bp, Homo sapiens
tagggcaaagaatcaaca

SEQ ID NO: 639769 - DNA, 17 bp, Homo sapiens
taggggcaaaaatttga

SEQ ID NO: 639770 - DNA, 19 bp, Homo sapiens
taggggtgggggagaatgg

SEQ ID NO: 639771 - DNA, 14 bp, Homo sapiens
tagggtgaggcgtg

SEQ ID NO: 639772 - DNA, 18 bp, Homo sapiens
tagggtttgtttgctgct

SEQ ID NO: 639773 - DNA, 19 bp, Homo sapiens
taggtctatgatgtccaaa

SEQ ID NO: 639774 - DNA, 14 bp, Homo sapiens
taggtctccacccc

SEQ ID NO: 639775 - DNA, 16 bp, Homo sapiens
taggtctccacccctc

SEQ ID NO: 639776 - DNA, 14 bp, Homo sapiens
taggtctgcacaca

SEQ ID NO: 639777 - DNA, 15 bp, Homo sapiens
taggtctgcacacat

SEQ ID NO: 639778 - DNA, 16 bp, Homo sapiens
taggtctgcacacata

SEQ ID NO: 639779 - DNA, 21 bp, Homo sapiens
taggtctgttgaagtgcatgt

SEQ ID NO: 639780 - DNA, 16 bp, Homo sapiens
taggtgggtcttggat

SEQ ID NO: 639781 - DNA, 21 bp, Homo sapiens
tatctttcaggaaatttttgc

SEQ ID NO: 639782 - DNA, 16 bp, Homo sapiens
tatgaaacaaatatac

SEQ ID NO: 639783 - DNA, 23 bp, Homo sapiens
tatgaaagagaaaatgctttctc

SEQ ID NO: 639784 - DNA, 17 bp, Homo sapiens
tatgaatcgcagacgca

SEQ ID NO: 639785 - DNA, 16 bp, Homo sapiens
tatgagacttcctatt

SEQ ID NO: 639786 - DNA, 22 bp, Homo sapiens
tatgagacttcctattaattta

SEQ ID NO: 639787 - DNA, 12 bp, Homo sapiens
tatgaggaaact

SEQ ID NO: 639788 - DNA, 16 bp, Homo sapiens
tatgaggatgtatgtg

SEQ ID NO: 639789 - DNA, 19 bp, Homo sapiens
tatgatataataaatatat

SEQ ID NO: 639790 - DNA, 14 bp, Homo sapiens
tatgattctcctct

SEQ ID NO: 639791 - DNA, 15 bp, Homo sapiens
tatgattctcctctc

SEQ ID NO: 639792 - DNA, 18 bp, Homo sapiens
tatgatttcatgattaga

SEQ ID NO: 639793 - DNA, 14 bp, Homo sapiens
tatgcaaatatttt

SEQ ID NO: 639794 - DNA, 16 bp, Homo sapiens
tatgcatatatatgta

SEQ ID NO: 639795 - DNA, 17 bp, Homo sapiens
tatgcatatatatgtat

SEQ ID NO: 639796 - DNA, 20 bp, Homo sapiens
tatgcatatatatgtatatt

SEQ ID NO: 639797 - DNA, 19 bp, Homo sapiens
tatgcatatttatagagtt

SEQ ID NO: 639798 - DNA, 12 bp, Homo sapiens
tatgcatttatg

SEQ ID NO: 639799 - DNA, 15 bp, Homo sapiens
tatgcatttatgcat

SEQ ID NO: 639800 - DNA, 16 bp, Homo sapiens
tatgcatttatgcatg

SEQ ID NO: 639801 - DNA, 19 bp, Homo sapiens
tatgcatttatgcatgaga

SEQ ID NO: 639802 - DNA, 22 bp, Homo sapiens
tatgcatttatgcatgagaact

SEQ ID NO: 639803 - DNA, 15 bp, Homo sapiens
tatgccatgtatgtt

SEQ ID NO: 639804 - DNA, 13 bp, Homo sapiens
tatgctgtgtgca

SEQ ID NO: 639805 - DNA, 18 bp, Homo sapiens
tatgctttccctgaggaa

SEQ ID NO: 639806 - DNA, 19 bp, Homo sapiens
tatggaagacaaatacaca

SEQ ID NO: 639807 - DNA, 20 bp, Homo sapiens
tatggaagacaaatacacat

SEQ ID NO: 639808 - DNA, 20 bp, Homo sapiens
tatggatatttttaatttat

SEQ ID NO: 639809 - DNA, 23 bp, Homo sapiens
tatggcaagtttttggtaatgat

SEQ ID NO: 639810 - DNA, 22 bp, Homo sapiens
tatggctttgtgcttgttcttc

SEQ ID NO: 639811 - DNA, 14 bp, Homo sapiens
tatggtatatattt

SEQ ID NO: 639812 - DNA, 21 bp, Homo sapiens
tatgtaacttcagatgtttcc

SEQ ID NO: 639813 - DNA, 12 bp, Homo sapiens
tatgtacaaaat

SEQ ID NO: 639814 - DNA, 23 bp, Homo sapiens
tatgtacaaaatgaattgccttt

SEQ ID NO: 639815 - DNA, 22 bp, Homo sapiens
tatgtacaaataatattgcctt

SEQ ID NO: 639816 - DNA, 23 bp, Homo sapiens
tatgtacaaataatattgccttg

SEQ ID NO: 639817 - DNA, 12 bp, Homo sapiens
aaaaaaatcaaa

SEQ ID NO: 639818 - DNA, 13 bp, Homo sapiens
aaaaaactggaaa

SEQ ID NO: 639819 - DNA, 15 bp, Homo sapiens
aaaaaactggaaaca

SEQ ID NO: 639820 - DNA, 13 bp, Homo sapiens
aaaaaatatgaga

SEQ ID NO: 639821 - DNA, 15 bp, Homo sapiens
aaaaactggaaacat

SEQ ID NO: 639822 - DNA, 14 bp, Homo sapiens
aaaaactgtactgt

SEQ ID NO: 639823 - DNA, 16 bp, Homo sapiens
aaaaactgtactgtgt

SEQ ID NO: 639824 - DNA, 17 bp, Homo sapiens
aaaaactttccatgaca

SEQ ID NO: 639825 - DNA, 24 bp, Homo sapiens
aaaaactttccatgacagtagcat

SEQ ID NO: 639826 - DNA, 14 bp, Homo sapiens
aaaaagacttcaaa

SEQ ID NO: 639827 - DNA, 21 bp, Homo sapiens
aaaaagatggatttgacacac

SEQ ID NO: 639828 - DNA, 22 bp, Homo sapiens
aaaaagcaggaaagatcccaag

SEQ ID NO: 639829 - DNA, 23 bp, Homo sapiens
aaaaagcaggaaagatcccaagt

SEQ ID NO: 639830 - DNA, 20 bp, Homo sapiens
aaaaagcatgtacagtgttc

SEQ ID NO: 639831 - DNA, 17 bp, Homo sapiens
aaaaagtgtttttacat

SEQ ID NO: 639832 - DNA, 18 bp, Homo sapiens
aaaaagtgtttttacata

SEQ ID NO: 639833 - DNA, 20 bp, Homo sapiens
aaaaataatataaatgaatg

SEQ ID NO: 639834 - DNA, 19 bp, Homo sapiens
aaaaatgaaatttaagcac

SEQ ID NO: 639835 - DNA, 13 bp, Homo sapiens
aaaaatgatactt

SEQ ID NO: 639836 - DNA, 20 bp, Homo sapiens
aaaaattatctttaaaactt

SEQ ID NO: 639837 - DNA, 24 bp, Homo sapiens
aaaaatttgacattgtcagaatgt

SEQ ID NO: 639838 - DNA, 23 bp, Homo sapiens
aaaacaagagaccacttccttaa

SEQ ID NO: 639839 - DNA, 18 bp, Homo sapiens
aaaacagaccagcatagt

SEQ ID NO: 639840 - DNA, 12 bp, Homo sapiens
aaaacattgttc

SEQ ID NO: 639841 - DNA, 13 bp, Homo sapiens
aaaaccaaataag

SEQ ID NO: 639842 - DNA, 18 bp, Homo sapiens
aaaaccacagctgggcag

SEQ ID NO: 639843 - DNA, 17 bp, Homo sapiens
aaaaccattctgcttgg

SEQ ID NO: 639844 - DNA, 23 bp, Homo sapiens
aaaacctcagttggcctctgccc

SEQ ID NO: 639845 - DNA, 15 bp, Homo sapiens
aaaacgatttaattt

SEQ ID NO: 639846 - DNA, 17 bp, Homo sapiens
aaaacgtggctgcttca

SEQ ID NO: 639847 - DNA, 22 bp, Homo sapiens
aaaactaaatagcatgtattgt

SEQ ID NO: 639848 - DNA, 20 bp, Homo sapiens
aaaactggaaacatctgatt

SEQ ID NO: 639849 - DNA, 17 bp, Homo sapiens
aaaactggaataagaag

SEQ ID NO: 639850 - DNA, 21 bp, Homo sapiens
aaaactgtgacattccacaga

SEQ ID NO: 639851 - DNA, 12 bp, Homo sapiens
aaaactttccat

SEQ ID NO: 639852 - DNA, 17 bp, Homo sapiens
aaaactttccatgacag

SEQ ID NO: 639853 - DNA, 18 bp, Homo sapiens
aaaactttccatgacagt

SEQ ID NO: 639854 - DNA, 21 bp, Homo sapiens
aaaactttccatgacagtagc

SEQ ID NO: 639855 - DNA, 14 bp, Homo sapiens
aaaagaaagaaaaa

SEQ ID NO: 639856 - DNA, 18 bp, Homo sapiens
aaaagacacttttaccga

SEQ ID NO: 639857 - DNA, 16 bp, Homo sapiens
aaaagaccatgcattc

SEQ ID NO: 639858 - DNA, 20 bp, Homo sapiens
aaaagaccatgcattcagat

SEQ ID NO: 639859 - DNA, 22 bp, Homo sapiens
aaaagatggatttgacacactc

SEQ ID NO: 639860 - DNA, 14 bp, Homo sapiens
aaacagaaaaacaa

SEQ ID NO: 639861 - DNA, 17 bp, Homo sapiens
aaacagagaaccctgtg

SEQ ID NO: 639862 - DNA, 19 bp, Homo sapiens
aaacagtgtggcttaaaca

SEQ ID NO: 639863 - DNA, 23 bp, Homo sapiens
aaacagtgtggcttaaacatttt

SEQ ID NO: 639864 - DNA, 20 bp, Homo sapiens
aaacatagtggtattttaac

SEQ ID NO: 639865 - DNA, 20 bp, Homo sapiens
aaacattttaaatggacaga

SEQ ID NO: 639866 - DNA, 18 bp, Homo sapiens
aaacattttttgtttctt

SEQ ID NO: 639867 - DNA, 18 bp, Homo sapiens
aaaccaagccattaatga

SEQ ID NO: 639868 - DNA, 13 bp, Homo sapiens
aaaccacagctgg

SEQ ID NO: 639869 - DNA, 20 bp, Homo sapiens
aaaccacctgtccccagtta

SEQ ID NO: 639870 - DNA, 16 bp, Homo sapiens
aaacccacataaacac

SEQ ID NO: 639871 - DNA, 20 bp, Homo sapiens
aaacccacataaacacttct

SEQ ID NO: 639872 - DNA, 17 bp, Homo sapiens
aaaccccacagaaatct

SEQ ID NO: 639873 - DNA, 15 bp, Homo sapiens
aaaccccggggctcc

SEQ ID NO: 639874 - DNA, 11 bp, Homo sapiens
aaacctcagtt

SEQ ID NO: 639875 - DNA, 19 bp, Homo sapiens
aaacctcagttggcctctg

SEQ ID NO: 639876 - DNA, 21 bp, Homo sapiens
aaacctcagttggcctctgcc

SEQ ID NO: 639877 - DNA, 13 bp, Homo sapiens
aaacctgtgcttt

SEQ ID NO: 639878 - DNA, 16 bp, Homo sapiens
aaacctgtgctttcat

SEQ ID NO: 639879 - DNA, 20 bp, Homo sapiens
aaacctgtgctttcatgttt

SEQ ID NO: 639880 - DNA, 19 bp, Homo sapiens
aaaccttgctgctatgctg

SEQ ID NO: 639881 - DNA, 16 bp, Homo sapiens
aaacgtggctgcttca

SEQ ID NO: 639882 - DNA, 17 bp, Homo sapiens
aaacgtggctgcttcaa

SEQ ID NO: 639883 - DNA, 20 bp, Homo sapiens
aaacgtggctgcttcaagga

SEQ ID NO: 639884 - DNA, 21 bp, Homo sapiens
aaacgtggctgcttcaaggat

SEQ ID NO: 639885 - DNA, 16 bp, Homo sapiens
aaactaaatagcatgt

SEQ ID NO: 639886 - DNA, 13 bp, Homo sapiens
aaactcatacagt

SEQ ID NO: 639887 - DNA, 21 bp, Homo sapiens
aaactcatacagtctctattt

SEQ ID NO: 639888 - DNA, 20 bp, Homo sapiens
aaactcctgttttcacacct

SEQ ID NO: 639889 - DNA, 13 bp, Homo sapiens
aaactgatgcttt

SEQ ID NO: 639890 - DNA, 19 bp, Homo sapiens
aaactgatttttttttcct

SEQ ID NO: 639891 - DNA, 22 bp, Homo sapiens
aaactgatttttttttccttca

SEQ ID NO: 639892 - DNA, 13 bp, Homo sapiens
aaactggaaacat

SEQ ID NO: 639893 - DNA, 10 bp, Homo sapiens
aaactgtgac

SEQ ID NO: 639894 - DNA, 12 bp, Homo sapiens
aaactgtgacat

SEQ ID NO: 639895 - DNA, 21 bp, Homo sapiens
aaactgtgagataaatatcat

SEQ ID NO: 639896 - DNA, 23 bp, Homo sapiens
aaacttactatggtatatatttt

SEQ ID NO: 639897 - DNA, 15 bp, Homo sapiens
aaacttggacattta

SEQ ID NO: 639898 - DNA, 20 bp, Homo sapiens
aaacttgtacttacactgaa

SEQ ID NO: 639899 - DNA, 23 bp, Homo sapiens
aaacttgtacttacactgaaatc

SEQ ID NO: 639900 - DNA, 16 bp, Homo sapiens
aaactttccatgacag

SEQ ID NO: 639901 - DNA, 14 bp, Homo sapiens
aaacttttataaat

SEQ ID NO: 639902 - DNA, 23 bp, Homo sapiens
aaagaacagcacagtcttttcct

SEQ ID NO: 639903 - DNA, 16 bp, Homo sapiens
aaagaacccccctccc

SEQ ID NO: 639904 - DNA, 18 bp, Homo sapiens
aaagaacccccctcccca

SEQ ID NO: 639905 - DNA, 20 bp, Homo sapiens
aaagaacccccctccccaag

SEQ ID NO: 639906 - DNA, 15 bp, Homo sapiens
aaagaactgccccat

SEQ ID NO: 639907 - DNA, 16 bp, Homo sapiens
aaagaacttggacttc

SEQ ID NO: 639908 - DNA, 13 bp, Homo sapiens
aaagaagatgttt

SEQ ID NO: 639909 - DNA, 17 bp, Homo sapiens
aaagaccatgcattcag

SEQ ID NO: 639910 - DNA, 18 bp, Homo sapiens
aaagaccatgcattcaga

SEQ ID NO: 639911 - DNA, 18 bp, Homo sapiens
aaagacttcaaatgttat

SEQ ID NO: 639912 - DNA, 14 bp, Homo sapiens
aaagacttcattta

SEQ ID NO: 639913 - DNA, 22 bp, Homo sapiens
aaagacttcatttaacactgag

SEQ ID NO: 639914 - DNA, 22 bp, Homo sapiens
aaagagtagaactttaaaagaa

SEQ ID NO: 639915 - DNA, 22 bp, Homo sapiens
aaagagttctccttgtacttga

SEQ ID NO: 639916 - DNA, 13 bp, Homo sapiens
aaagatagcagaa

SEQ ID NO: 639917 - DNA, 19 bp, Homo sapiens
aaagatagcagaagagtag

SEQ ID NO: 639918 - DNA, 20 bp, Homo sapiens
aaagatattgtatctccttt

SEQ ID NO: 639919 - DNA, 18 bp, Homo sapiens
aaagatctttttttaagt

SEQ ID NO: 639920 - DNA, 20 bp, Homo sapiens
aaagatctttttttaagtgt

SEQ ID NO: 639921 - DNA, 22 bp, Homo sapiens
aaagattactagggttttgcca

SEQ ID NO: 639922 - DNA, 18 bp, Homo sapiens
aaagcagagatgtattat

SEQ ID NO: 639923 - DNA, 12 bp, Homo sapiens
aaattctgatta

SEQ ID NO: 639924 - DNA, 14 bp, Homo sapiens
aaattctgattatt

SEQ ID NO: 639925 - DNA, 21 bp, Homo sapiens
aaattcttgcactgtatccaa

SEQ ID NO: 639926 - DNA, 17 bp, Homo sapiens
aaattgaagagagatat

SEQ ID NO: 639927 - DNA, 21 bp, Homo sapiens
aaattgaagagagatatatct

SEQ ID NO: 639928 - DNA, 13 bp, Homo sapiens
aaattgccttcag

SEQ ID NO: 639929 - DNA, 11 bp, Homo sapiens
aaattgctgag

SEQ ID NO: 639930 - DNA, 20 bp, Homo sapiens
aaattggttaatgaaaaatc

SEQ ID NO: 639931 - DNA, 19 bp, Homo sapiens
aaatttaaaaattaaagca

SEQ ID NO: 639932 - DNA, 12 bp, Homo sapiens
aaatttaagcac

SEQ ID NO: 639933 - DNA, 17 bp, Homo sapiens
aaatttatgtcattttc

SEQ ID NO: 639934 - DNA, 16 bp, Homo sapiens
aaatttattaaatgtt

SEQ ID NO: 639935 - DNA, 21 bp, Homo sapiens
aaatttattcttatcttagga

SEQ ID NO: 639936 - DNA, 15 bp, Homo sapiens
aaatttgacattgtc

SEQ ID NO: 639937 - DNA, 18 bp, Homo sapiens
aaatttggccatgaaagc

SEQ ID NO: 639938 - DNA, 12 bp, Homo sapiens
aaatttgtgtgc

SEQ ID NO: 639939 - DNA, 20 bp, Homo sapiens
aaattttatctcttcttcct

SEQ ID NO: 639940 - DNA, 12 bp, Homo sapiens
aaattttattga

SEQ ID NO: 639941 - DNA, 17 bp, Homo sapiens
aaattttggaagaattc

SEQ ID NO: 639942 - DNA, 22 bp, Homo sapiens
aaattttggaagaattcatgat

SEQ ID NO: 639943 - DNA, 13 bp, Homo sapiens
aaatttttactca

SEQ ID NO: 639944 - DNA, 22 bp, Homo sapiens
aaatttttactcaggctttcta

SEQ ID NO: 639945 - DNA, 22 bp, Homo sapiens
aaatttttgcatgtttaataat

SEQ ID NO: 639946 - DNA, 17 bp, Homo sapiens
aaatttttgtaagaaaa

SEQ ID NO: 639947 - DNA, 15 bp, Homo sapiens
aaatttttttccaga

SEQ ID NO: 639948 - DNA, 19 bp, Homo sapiens
aacaaaccagcaacttttc

SEQ ID NO: 639949 - DNA, 16 bp, Homo sapiens
aacaaagcatgctcag

SEQ ID NO: 639950 - DNA, 16 bp, Homo sapiens
aacaaatatactcatt

SEQ ID NO: 639951 - DNA, 17 bp, Homo sapiens
aacaaatatactcattt

SEQ ID NO: 639952 - DNA, 23 bp, Homo sapiens
aacaaatatgattctcctctccc

SEQ ID NO: 639953 - DNA, 12 bp, Homo sapiens
aacaaatcattt

SEQ ID NO: 639954 - DNA, 14 bp, Homo sapiens
aacaaatcattttg

SEQ ID NO: 639955 - DNA, 15 bp, Homo sapiens
aacaaatcattttga

SEQ ID NO: 639956 - DNA, 22 bp, Homo sapiens
aacaacaaagcatgctcagtat

SEQ ID NO: 639957 - DNA, 14 bp, Homo sapiens
aacaacaacaaagc

SEQ ID NO: 639958 - DNA, 16 bp, Homo sapiens
aacaactttctggaaa

SEQ ID NO: 639959 - DNA, 21 bp, Homo sapiens
aacaagagaccacttccttaa

SEQ ID NO: 639960 - DNA, 17 bp, Homo sapiens
aacaagcaaactgaaat

SEQ ID NO: 639961 - DNA, 18 bp, Homo sapiens
aacaatgttttttatact

SEQ ID NO: 639962 - DNA, 22 bp, Homo sapiens
aacaatgttttttatacttcaa

SEQ ID NO: 639963 - DNA, 16 bp, Homo sapiens
aacacagcatgcattt

SEQ ID NO: 639964 - DNA, 20 bp, Homo sapiens
aacacagcatgcatttagca

SEQ ID NO: 639965 - DNA, 20 bp, Homo sapiens
aacacattgaaactgtattt

SEQ ID NO: 639966 - DNA, 21 bp, Homo sapiens
aacactgagtgaaatattact

SEQ ID NO: 639967 - DNA, 12 bp, Homo sapiens
aacactgcagcc

SEQ ID NO: 639968 - DNA, 16 bp, Homo sapiens
aacactgcttaaggaa

SEQ ID NO: 639969 - DNA, 16 bp, Homo sapiens
aacacttctccttaac

SEQ ID NO: 639970 - DNA, 15 bp, Homo sapiens
aacagaaagcataga

SEQ ID NO: 639971 - DNA, 13 bp, Homo sapiens
aacagacattgtt

SEQ ID NO: 639972 - DNA, 15 bp, Homo sapiens
aacagacattgtttt

SEQ ID NO: 639973 - DNA, 18 bp, Homo sapiens
aacagacattgttttgcc

SEQ ID NO: 639974 - DNA, 22 bp, Homo sapiens
aacagacattgttttgccaaca

SEQ ID NO: 639975 - DNA, 14 bp, Homo sapiens
aacagaccagcata

SEQ ID NO: 639976 - DNA, 15 bp, Homo sapiens
aacagactgccttat

SEQ ID NO: 639977 - DNA, 11 bp, Homo sapiens
aacagccctgc

SEQ ID NO: 639978 - DNA, 20 bp, Homo sapiens
aacagggacactacaaacat

SEQ ID NO: 639979 - DNA, 11 bp, Homo sapiens
aacagtaaata

SEQ ID NO: 639980 - DNA, 14 bp, Homo sapiens
aacagtaaatatac

SEQ ID NO: 639981 - DNA, 20 bp, Homo sapiens
catccaccttcctgcccagg

SEQ ID NO: 639982 - DNA, 19 bp, Homo sapiens
catccatggatgcagaaat

SEQ ID NO: 639983 - DNA, 24 bp, Homo sapiens
catccccaccctcccctctcctga

SEQ ID NO: 639984 - DNA, 12 bp, Homo sapiens
catcccctgcct

SEQ ID NO: 639985 - DNA, 14 bp, Homo sapiens
catcccctgcctct

SEQ ID NO: 639986 - DNA, 20 bp, Homo sapiens
catcccttggcccctctctg

SEQ ID NO: 639987 - DNA, 13 bp, Homo sapiens
catccgagcccct

SEQ ID NO: 639988 - DNA, 16 bp, Homo sapiens
catccgagcccctgtt

SEQ ID NO: 639989 - DNA, 18 bp, Homo sapiens
catccgagcccctgtttc

SEQ ID NO: 639990 - DNA, 14 bp, Homo sapiens
catccgtctctgtc

SEQ ID NO: 639991 - DNA, 11 bp, Homo sapiens
catcctcttat

SEQ ID NO: 639992 - DNA, 16 bp, Homo sapiens
catcctggaaatttgt

SEQ ID NO: 639993 - DNA, 21 bp, Homo sapiens
catcctggaaatttgtgtgct

SEQ ID NO: 639994 - DNA, 13 bp, Homo sapiens
catccttcccgca

SEQ ID NO: 639995 - DNA, 16 bp, Homo sapiens
catccttgctgcagct

SEQ ID NO: 639996 - DNA, 18 bp, Homo sapiens
catccttttttaaaaaaa

SEQ ID NO: 639997 - DNA, 14 bp, Homo sapiens
catcgccttctggc

SEQ ID NO: 639998 - DNA, 22 bp, Homo sapiens
catcgccttctggctgctgcag

SEQ ID NO: 639999 - DNA, 15 bp, Homo sapiens
catcgccttctgggg

SEQ ID NO: 640000 - DNA, 16 bp, Homo sapiens
catctaaatattatgc

SEQ ID NO: 640001 - DNA, 16 bp, Homo sapiens
catctcaaacactgct

SEQ ID NO: 640002 - DNA, 18 bp, Homo sapiens
catctccaccctgagcct

SEQ ID NO: 640003 - DNA, 23 bp, Homo sapiens
catctcctcccatggccttccct

SEQ ID NO: 640004 - DNA, 12 bp, Homo sapiens
catctctgtaaa

SEQ ID NO: 640005 - DNA, 13 bp, Homo sapiens
catctgcctggag

SEQ ID NO: 640006 - DNA, 14 bp, Homo sapiens
catctgcctggagc

SEQ ID NO: 640007 - DNA, 13 bp, Homo sapiens
catctggccctga

SEQ ID NO: 640008 - DNA, 11 bp, Homo sapiens
catctggcctg

SEQ ID NO: 640009 - DNA, 18 bp, Homo sapiens
catctgtatatcagctct

SEQ ID NO: 640010 - DNA, 20 bp, Homo sapiens
catctgtcagtgagtcagag

SEQ ID NO: 640011 - DNA, 16 bp, Homo sapiens
catcttcctgcctact

SEQ ID NO: 640012 - DNA, 13 bp, Homo sapiens
catcttgtggggc

SEQ ID NO: 640013 - DNA, 15 bp, Homo sapiens
catcttgtggggcca

SEQ ID NO: 640014 - DNA, 16 bp, Homo sapiens
catcttgtggggccag

SEQ ID NO: 640015 - DNA, 21 bp, Homo sapiens
catgaaaagttttcaagcatt

SEQ ID NO: 640016 - DNA, 21 bp, Homo sapiens
catgaatccatcgatttgtat

SEQ ID NO: 640017 - DNA, 17 bp, Homo sapiens
catgacacgaatattgc

SEQ ID NO: 640018 - DNA, 15 bp, Homo sapiens
catgacagtagcata

SEQ ID NO: 640019 - DNA, 22 bp, Homo sapiens
catgacagtagcatactgatga

SEQ ID NO: 640020 - DNA, 13 bp, Homo sapiens
catgacagtggtt

SEQ ID NO: 640021 - DNA, 16 bp, Homo sapiens
catgacccgtacacac

SEQ ID NO: 640022 - DNA, 18 bp, Homo sapiens
catgaccctcctgtccag

SEQ ID NO: 640023 - DNA, 13 bp, Homo sapiens
catgaccttacat

SEQ ID NO: 640024 - DNA, 22 bp, Homo sapiens
catgacttctttactaacactg

SEQ ID NO: 640025 - DNA, 15 bp, Homo sapiens
catgagaactaaata

SEQ ID NO: 640026 - DNA, 19 bp, Homo sapiens
catgagttctgcacataca

SEQ ID NO: 640027 - DNA, 22 bp, Homo sapiens
catgagttctgcacatacagat

SEQ ID NO: 640028 - DNA, 18 bp, Homo sapiens
catgatcttacacgaaga

SEQ ID NO: 640029 - DNA, 18 bp, Homo sapiens
catgatgctagttcttac

SEQ ID NO: 640030 - DNA, 16 bp, Homo sapiens
catgcaaagtcctttc

SEQ ID NO: 640031 - DNA, 14 bp, Homo sapiens
catgcaccagtgcc

SEQ ID NO: 640032 - DNA, 18 bp, Homo sapiens
catgcaggcagcctgcag

SEQ ID NO: 640033 - DNA, 17 bp, Homo sapiens
catgcagggcccccaca

SEQ ID NO: 640034 - DNA, 15 bp, Homo sapiens
catgcatagacaagt

SEQ ID NO: 640035 - DNA, 15 bp, Homo sapiens
catgcatttagcatg

SEQ ID NO: 640036 - DNA, 17 bp, Homo sapiens
catgcccaaatataaca

SEQ ID NO: 640037 - DNA, 15 bp, Homo sapiens
catgccccagctctg

SEQ ID NO: 640038 - DNA, 22 bp, Homo sapiens
catgcctacattagtgagattt

SEQ ID NO: 640039 - DNA, 17 bp, Homo sapiens
catgcctgggcccaggc

SEQ ID NO: 640040 - DNA, 13 bp, Homo sapiens
catgctggctggg

SEQ ID NO: 640041 - DNA, 12 bp, Homo sapiens
catgctgggccg

SEQ ID NO: 640042 - DNA, 15 bp, Homo sapiens
catgctgggctcact

SEQ ID NO: 640043 - DNA, 15 bp, Homo sapiens
catgctgtccctgtg

SEQ ID NO: 640044 - DNA, 23 bp, Homo sapiens
catgctgtctgtgtgaggctccc

SEQ ID NO: 640045 - DNA, 16 bp, Homo sapiens
catggaacagccctgc

SEQ ID NO: 640046 - DNA, 23 bp, Homo sapiens
catggaacagccctgcacgccca

SEQ ID NO: 640047 - DNA, 21 bp, Homo sapiens
catggagaagggttctgccct

SEQ ID NO: 640048 - DNA, 17 bp, Homo sapiens
catggatgcagaaatga

SEQ ID NO: 640049 - DNA, 16 bp, Homo sapiens
catggatttcctttga

SEQ ID NO: 640050 - DNA, 20 bp, Homo sapiens
catggccccagctggctggg

SEQ ID NO: 640051 - DNA, 13 bp, Homo sapiens
catggccttccct

SEQ ID NO: 640052 - DNA, 15 bp, Homo sapiens
catgggactgtgcct

SEQ ID NO: 640053 - DNA, 17 bp, Homo sapiens
catgggactgtgccttt

SEQ ID NO: 640054 - DNA, 19 bp, Homo sapiens
catgggccagcccttgctc

SEQ ID NO: 640055 - DNA, 14 bp, Homo sapiens
catggtatctcttt

SEQ ID NO: 640056 - DNA, 19 bp, Homo sapiens
catggtgaactgaagcaga

SEQ ID NO: 640057 - DNA, 20 bp, Homo sapiens
catggtgaactgaagcagag

SEQ ID NO: 640058 - DNA, 23 bp, Homo sapiens
catggtgaactgaagcagagtca

SEQ ID NO: 640059 - DNA, 11 bp, Homo sapiens
catgtacagtg

SEQ ID NO: 640060 - DNA, 21 bp, Homo sapiens
catgtacagtgttctgtttaa

SEQ ID NO: 640061 - DNA, 20 bp, Homo sapiens
catgtattgtgtcttttgca

SEQ ID NO: 640062 - DNA, 20 bp, Homo sapiens
catgtctttggcttcagaat

SEQ ID NO: 640063 - DNA, 21 bp, Homo sapiens
catgtctttggcttcagaatt

SEQ ID NO: 640064 - DNA, 12 bp, Homo sapiens
catgtgataatt

SEQ ID NO: 640065 - DNA, 21 bp, Homo sapiens
catgtgataattgtaaaggtg

SEQ ID NO: 640066 - DNA, 15 bp, Homo sapiens
catgtgatgagagga

SEQ ID NO: 640067 - DNA, 17 bp, Homo sapiens
catgtgatgagaggaaa

SEQ ID NO: 640068 - DNA, 14 bp, Homo sapiens
catgtgcgaacaca

SEQ ID NO: 640069 - DNA, 13 bp, Homo sapiens
catgttaaaataa

SEQ ID NO: 640070 - DNA, 14 bp, Homo sapiens
catgttaatacatc

SEQ ID NO: 640071 - DNA, 17 bp, Homo sapiens
catgttctcaataccca

SEQ ID NO: 640072 - DNA, 16 bp, Homo sapiens
catgtttaagaaatga

SEQ ID NO: 640073 - DNA, 13 bp, Homo sapiens
catgtttaataat

SEQ ID NO: 640074 - DNA, 15 bp, Homo sapiens
catgtttaataatat

SEQ ID NO: 640075 - DNA, 23 bp, Homo sapiens
catgtttaataatatgtacaaat

SEQ ID NO: 640076 - DNA, 19 bp, Homo sapiens
catgttttacaaagaaaca

SEQ ID NO: 640077 - DNA, 21 bp, Homo sapiens
catgttttacaaagaaacaaa

SEQ ID NO: 640078 - DNA, 13 bp, Homo sapiens
cattaaaacaaga

SEQ ID NO: 640079 - DNA, 13 bp, Homo sapiens
cattaaactaatt

SEQ ID NO: 640080 - DNA, 13 bp, Homo sapiens
cattaagcacaca

SEQ ID NO: 640081 - DNA, 17 bp, Homo sapiens
cattagacaaatgtctt

SEQ ID NO: 640082 - DNA, 14 bp, Homo sapiens
cattagggcttttt

SEQ ID NO: 640083 - DNA, 22 bp, Homo sapiens
cattatagcatgtaatattaaa

SEQ ID NO: 640084 - DNA, 12 bp, Homo sapiens
cattcagcacac

SEQ ID NO: 640085 - DNA, 13 bp, Homo sapiens
cattcagcacaca

SEQ ID NO: 640086 - DNA, 15 bp, Homo sapiens
cattcatcctcttat

SEQ ID NO: 640087 - DNA, 15 bp, Homo sapiens
cattcccaattatca

SEQ ID NO: 640088 - DNA, 16 bp, Homo sapiens
cattcctgaccctcac

SEQ ID NO: 640089 - DNA, 16 bp, Homo sapiens
cattctggggtggggc

SEQ ID NO: 640090 - DNA, 19 bp, Homo sapiens
cattctggtccttagtaaa

SEQ ID NO: 640091 - DNA, 21 bp, Homo sapiens
cattctggtccttagtaaatt

SEQ ID NO: 640092 - DNA, 22 bp, Homo sapiens
cattctggtccttagtaaattc

SEQ ID NO: 640093 - DNA, 17 bp, Homo sapiens
cattcttgggaggacac

SEQ ID NO: 640094 - DNA, 13 bp, Homo sapiens
cattcttttaaat

SEQ ID NO: 640095 - DNA, 19 bp, Homo sapiens
cattgaaatctttttgctt

SEQ ID NO: 640096 - DNA, 18 bp, Homo sapiens
cattgaacactgcaccct

SEQ ID NO: 640097 - DNA, 21 bp, Homo sapiens
cattgaacactgcaccctcca

SEQ ID NO: 640098 - DNA, 13 bp, Homo sapiens
cattgaccttcat

SEQ ID NO: 640099 - DNA, 21 bp, Homo sapiens
cattgataattcgagcaaaca

SEQ ID NO: 640100 - DNA, 22 bp, Homo sapiens
cattgataattcgagcaaacaa

SEQ ID NO: 640101 - DNA, 20 bp, Homo sapiens
catttcttctctctgtgctg

SEQ ID NO: 640102 - DNA, 17 bp, Homo sapiens
catttcttggtatgatc

SEQ ID NO: 640103 - DNA, 21 bp, Homo sapiens
catttgatttgatatacagac

SEQ ID NO: 640104 - DNA, 20 bp, Homo sapiens
catttgcaggtgaccagaat

SEQ ID NO: 640105 - DNA, 19 bp, Homo sapiens
catttgctagttctgctgc

SEQ ID NO: 640106 - DNA, 22 bp, Homo sapiens
catttgctagttctgctgccct

SEQ ID NO: 640107 - DNA, 20 bp, Homo sapiens
catttgctgaataacaacaa

SEQ ID NO: 640108 - DNA, 16 bp, Homo sapiens
catttggatataaatc

SEQ ID NO: 640109 - DNA, 18 bp, Homo sapiens
catttggatataaatctt

SEQ ID NO: 640110 - DNA, 22 bp, Homo sapiens
catttgggctcagggttggcca

SEQ ID NO: 640111 - DNA, 15 bp, Homo sapiens
catttggtggctcta

SEQ ID NO: 640112 - DNA, 23 bp, Homo sapiens
catttgttctgggttaacagtaa

SEQ ID NO: 640113 - DNA, 15 bp, Homo sapiens
cattttaaatggaca

SEQ ID NO: 640114 - DNA, 17 bp, Homo sapiens
cattttcattatttcaa

SEQ ID NO: 640115 - DNA, 16 bp, Homo sapiens
cattttgtctggctgt

SEQ ID NO: 640116 - DNA, 12 bp, Homo sapiens
catttttgagta

SEQ ID NO: 640117 - DNA, 22 bp, Homo sapiens
ccaaaagctagaggagattgct

SEQ ID NO: 640118 - DNA, 13 bp, Homo sapiens
ccaaaatgtcaat

SEQ ID NO: 640119 - DNA, 16 bp, Homo sapiens
ccaaataaactcctta

SEQ ID NO: 640120 - DNA, 19 bp, Homo sapiens
ccaaataagaataacactc

SEQ ID NO: 640121 - DNA, 17 bp, Homo sapiens
ccaaatagcttttcact

SEQ ID NO: 640122 - DNA, 15 bp, Homo sapiens
ccaaatataacatga

SEQ ID NO: 640123 - DNA, 23 bp, Homo sapiens
ccaaatgctgtcgggcaagatag

SEQ ID NO: 640124 - DNA, 21 bp, Homo sapiens
ccaaatgtgtcttgtattatc

SEQ ID NO: 640125 - DNA, 18 bp, Homo sapiens
ccaaattgctgagatgtt

SEQ ID NO: 640126 - DNA, 22 bp, Homo sapiens
ccaacccaggattcaacatcaa

SEQ ID NO: 640127 - DNA, 24 bp, Homo sapiens
ccaacctcccctggtcctgcactg

SEQ ID NO: 640128 - DNA, 17 bp, Homo sapiens
ccaacgacccatgaccg

SEQ ID NO: 640129 - DNA, 21 bp, Homo sapiens
ccaacgggtctgtgggactgg

SEQ ID NO: 640130 - DNA, 14 bp, Homo sapiens
ccaactaagttgta

SEQ ID NO: 640131 - DNA, 17 bp, Homo sapiens
ccaactaagttgtattt

SEQ ID NO: 640132 - DNA, 18 bp, Homo sapiens
ccaactctggccttggtt

SEQ ID NO: 640133 - DNA, 11 bp, Homo sapiens
ccaactgaatt

SEQ ID NO: 640134 - DNA, 21 bp, Homo sapiens
ccaactggaaggctttattct

SEQ ID NO: 640135 - DNA, 16 bp, Homo sapiens
ccaagagtccaagcca

SEQ ID NO: 640136 - DNA, 19 bp, Homo sapiens
ccaagccagggttccagac

SEQ ID NO: 640137 - DNA, 20 bp, Homo sapiens
ccaagccagggttccagaca

SEQ ID NO: 640138 - DNA, 22 bp, Homo sapiens
ccaagcccagcctatctctctt

SEQ ID NO: 640139 - DNA, 18 bp, Homo sapiens
ccaagctataaaagccca

SEQ ID NO: 640140 - DNA, 20 bp, Homo sapiens
ccaagctgtgaccctcaatt

SEQ ID NO: 640141 - DNA, 18 bp, Homo sapiens
ccaaggaagaacaaatat

SEQ ID NO: 640142 - DNA, 16 bp, Homo sapiens
ccaaggtggtcttgga

SEQ ID NO: 640143 - DNA, 18 bp, Homo sapiens
ccaaggtggtcttggaga

SEQ ID NO: 640144 - DNA, 23 bp, Homo sapiens
ccaaggtggtcttggagaggagg

SEQ ID NO: 640145 - DNA, 24 bp, Homo sapiens
ccaaggtggtcttggagaggaggt

SEQ ID NO: 640146 - DNA, 21 bp, Homo sapiens
ccaagtgtgttgggaattgca

SEQ ID NO: 640147 - DNA, 15 bp, Homo sapiens
ccaataaagctcaca

SEQ ID NO: 640148 - DNA, 17 bp, Homo sapiens
ccaataaagctcacact

SEQ ID NO: 640149 - DNA, 23 bp, Homo sapiens
ccaatagtctgccacaagggcag

SEQ ID NO: 640150 - DNA, 17 bp, Homo sapiens
ccaatgaagcaaacaca

SEQ ID NO: 640151 - DNA, 20 bp, Homo sapiens
ccaatgaagcaaacacacag

SEQ ID NO: 640152 - DNA, 17 bp, Homo sapiens
ccaatgtccaggtcaca

SEQ ID NO: 640153 - DNA, 13 bp, Homo sapiens
ccaattatcaaaa

SEQ ID NO: 640154 - DNA, 14 bp, Homo sapiens
ccaatttttctgca

SEQ ID NO: 640155 - DNA, 13 bp, Homo sapiens
ccacaaattcatg

SEQ ID NO: 640156 - DNA, 20 bp, Homo sapiens
ccacaaggcccagccctggg

SEQ ID NO: 640157 - DNA, 18 bp, Homo sapiens
ccacaagggcagtggaag

SEQ ID NO: 640158 - DNA, 12 bp, Homo sapiens
ccacaataggct

SEQ ID NO: 640159 - DNA, 17 bp, Homo sapiens
ccacacacacccttccc

SEQ ID NO: 640160 - DNA, 14 bp, Homo sapiens
ccacacctccaccc

SEQ ID NO: 640161 - DNA, 21 bp, Homo sapiens
ccacacgccggggctggccct

SEQ ID NO: 640162 - DNA, 13 bp, Homo sapiens
ccacagaaatctc

SEQ ID NO: 640163 - DNA, 18 bp, Homo sapiens
ccacaggagcatgtccta

SEQ ID NO: 640164 - DNA, 16 bp, Homo sapiens
ccacaggagccgcaga

SEQ ID NO: 640165 - DNA, 23 bp, Homo sapiens
ccacaggagcgtgtcctatcccc

SEQ ID NO: 640166 - DNA, 15 bp, Homo sapiens
ccacagtcctcacag

SEQ ID NO: 640167 - DNA, 21 bp, Homo sapiens
ccacagtggggcccatggccc

SEQ ID NO: 640168 - DNA, 12 bp, Homo sapiens
ccacataaacac

SEQ ID NO: 640169 - DNA, 17 bp, Homo sapiens
ccacatttgggctcagg

SEQ ID NO: 640170 - DNA, 18 bp, Homo sapiens
ccacatttgggctcaggg

SEQ ID NO: 640171 - DNA, 16 bp, Homo sapiens
ccaccacacacaccct

SEQ ID NO: 640172 - DNA, 17 bp, Homo sapiens
ccaccacacacaccctt

SEQ ID NO: 640173 - DNA, 19 bp, Homo sapiens
ccaccacacacacccttcc

SEQ ID NO: 640174 - DNA, 21 bp, Homo sapiens
ccacccacaccccgtctgccc

SEQ ID NO: 640175 - DNA, 16 bp, Homo sapiens
ccacccactagccctc

SEQ ID NO: 640176 - DNA, 13 bp, Homo sapiens
ccacccagcagcg

SEQ ID NO: 640177 - DNA, 14 bp, Homo sapiens
ccacccagcagcgc

SEQ ID NO: 640178 - DNA, 17 bp, Homo sapiens
ccacccccattgtgaat

SEQ ID NO: 640179 - DNA, 15 bp, Homo sapiens
ccaccccgctgcctg

SEQ ID NO: 640180 - DNA, 12 bp, Homo sapiens
ccaccccgtccc

SEQ ID NO: 640181 - DNA, 22 bp, Homo sapiens
ccaccccgttgttgtccctgca

SEQ ID NO: 640182 - DNA, 18 bp, Homo sapiens
cagtgccttatggaacac

SEQ ID NO: 640183 - DNA, 23 bp, Homo sapiens
cagtgccttatggaacactctga

SEQ ID NO: 640184 - DNA, 16 bp, Homo sapiens
cagtgccttggagcag

SEQ ID NO: 640185 - DNA, 19 bp, Homo sapiens
cagtggaagagctgctgta

SEQ ID NO: 640186 - DNA, 22 bp, Homo sapiens
cagtggaagagctgctgtattt

SEQ ID NO: 640187 - DNA, 13 bp, Homo sapiens
cagtggagagggg

SEQ ID NO: 640188 - DNA, 21 bp, Homo sapiens
cagtggagaggggacttggat

SEQ ID NO: 640189 - DNA, 14 bp, Homo sapiens
cagtggcagtattg

SEQ ID NO: 640190 - DNA, 13 bp, Homo sapiens
cagtggctggggg

SEQ ID NO: 640191 - DNA, 14 bp, Homo sapiens
cagtggctggggga

SEQ ID NO: 640192 - DNA, 14 bp, Homo sapiens
cagtggggcccatg

SEQ ID NO: 640193 - DNA, 19 bp, Homo sapiens
cagtggggcccatggcccc

SEQ ID NO: 640194 - DNA, 21 bp, Homo sapiens
cagtggggcccatggccccag

SEQ ID NO: 640195 - DNA, 19 bp, Homo sapiens
cagtggtccagggtccagc

SEQ ID NO: 640196 - DNA, 14 bp, Homo sapiens
cagtggtgcgggcc

SEQ ID NO: 640197 - DNA, 15 bp, Homo sapiens
cagtggtgcgggcca

SEQ ID NO: 640198 - DNA, 17 bp, Homo sapiens
cagtggtgcgggccagg

SEQ ID NO: 640199 - DNA, 20 bp, Homo sapiens
cagtggttcgggggaaatag

SEQ ID NO: 640200 - DNA, 17 bp, Homo sapiens
cagtgtattttctgtgt

SEQ ID NO: 640201 - DNA, 14 bp, Homo sapiens
cagtgtggccccag

SEQ ID NO: 640202 - DNA, 20 bp, Homo sapiens
cagtgtggcttaaacatttt

SEQ ID NO: 640203 - DNA, 19 bp, Homo sapiens
cagtgttcaaattctgatt

SEQ ID NO: 640204 - DNA, 22 bp, Homo sapiens
cagtgttctgtttaatactcat

SEQ ID NO: 640205 - DNA, 20 bp, Homo sapiens
cagtgtttagaagagcctga

SEQ ID NO: 640206 - DNA, 15 bp, Homo sapiens
cagttaatgtgccaa

SEQ ID NO: 640207 - DNA, 16 bp, Homo sapiens
cagttaatgtgccaaa

SEQ ID NO: 640208 - DNA, 19 bp, Homo sapiens
cagttacagtggcagtatt

SEQ ID NO: 640209 - DNA, 16 bp, Homo sapiens
cagttacttacacacc

SEQ ID NO: 640210 - DNA, 19 bp, Homo sapiens
cagttacttgtgttcattg

SEQ ID NO: 640211 - DNA, 20 bp, Homo sapiens
cagttacttgtgttcattga

SEQ ID NO: 640212 - DNA, 13 bp, Homo sapiens
cagttagcacaga

SEQ ID NO: 640213 - DNA, 18 bp, Homo sapiens
cagttagcccggccaagg

SEQ ID NO: 640214 - DNA, 20 bp, Homo sapiens
cagttaggtgctgaatgaag

SEQ ID NO: 640215 - DNA, 21 bp, Homo sapiens
cagttccctcagccctcatta

SEQ ID NO: 640216 - DNA, 13 bp, Homo sapiens
cagttctgatgag

SEQ ID NO: 640217 - DNA, 22 bp, Homo sapiens
cagttgcaataaactcagtcaa

SEQ ID NO: 640218 - DNA, 19 bp, Homo sapiens
cagttggcctctgcccctc

SEQ ID NO: 640219 - DNA, 23 bp, Homo sapiens
cagttggcctctgcccctcttcc

SEQ ID NO: 640220 - DNA, 14 bp, Homo sapiens
cagttgtatcctct

SEQ ID NO: 640221 - DNA, 11 bp, Homo sapiens
cagtttaacag

SEQ ID NO: 640222 - DNA, 12 bp, Homo sapiens
cagtttaacaga

SEQ ID NO: 640223 - DNA, 19 bp, Homo sapiens
cagtttaacagaaaaatga

SEQ ID NO: 640224 - DNA, 22 bp, Homo sapiens
cagtttaggacccaaggtggtc

SEQ ID NO: 640225 - DNA, 13 bp, Homo sapiens
cagtttggccctg

SEQ ID NO: 640226 - DNA, 14 bp, Homo sapiens
cagtttggccctgg

SEQ ID NO: 640227 - DNA, 18 bp, Homo sapiens
cagtttgtgaagtgattg

SEQ ID NO: 640228 - DNA, 19 bp, Homo sapiens
cataaaacacccttgaaaa

SEQ ID NO: 640229 - DNA, 22 bp, Homo sapiens
cataaaacacccttgaaaatat

SEQ ID NO: 640230 - DNA, 19 bp, Homo sapiens
cataaagaagatgtttaac

SEQ ID NO: 640231 - DNA, 14 bp, Homo sapiens
cataaagtaataac

SEQ ID NO: 640232 - DNA, 16 bp, Homo sapiens
cataaatcttccaaag

SEQ ID NO: 640233 - DNA, 14 bp, Homo sapiens
cataaattatttct

SEQ ID NO: 640234 - DNA, 14 bp, Homo sapiens
cataacacacatca

SEQ ID NO: 640235 - DNA, 13 bp, Homo sapiens
cataacaggcatt

SEQ ID NO: 640236 - DNA, 16 bp, Homo sapiens
cataacaggcattgca

SEQ ID NO: 640237 - DNA, 21 bp, Homo sapiens
cataacaggcattgcactaaa

SEQ ID NO: 640238 - DNA, 22 bp, Homo sapiens
cataacaggcattgcactaaaa

SEQ ID NO: 640239 - DNA, 17 bp, Homo sapiens
cataaccgcacagacat

SEQ ID NO: 640240 - DNA, 22 bp, Homo sapiens
cataagattatatacaaagctg

SEQ ID NO: 640241 - DNA, 23 bp, Homo sapiens
cataagattatatacaaagctgt

SEQ ID NO: 640242 - DNA, 21 bp, Homo sapiens
cataagctggtatcagtggtt

SEQ ID NO: 640243 - DNA, 14 bp, Homo sapiens
cataagttagatgt

SEQ ID NO: 640244 - DNA, 16 bp, Homo sapiens
cataatatgcatatat

SEQ ID NO: 640245 - DNA, 20 bp, Homo sapiens
cataatatgcatatatatgt

SEQ ID NO: 640246 - DNA, 23 bp, Homo sapiens
cataatatgcatatatatgtata

SEQ ID NO: 640247 - DNA, 21 bp, Homo sapiens
cataatcatccttttttaaaa

SEQ ID NO: 640248 - DNA, 14 bp, Homo sapiens
cataattaaagtgt

SEQ ID NO: 640249 - DNA, 15 bp, Homo sapiens
cataattaaagtgtc

SEQ ID NO: 640250 - DNA, 18 bp, Homo sapiens
cataattgtgagttaatt

SEQ ID NO: 640251 - DNA, 23 bp, Homo sapiens
cataattgtgagttaatttgata

SEQ ID NO: 640252 - DNA, 18 bp, Homo sapiens
catacgcaattgtatata

SEQ ID NO: 640253 - DNA, 19 bp, Homo sapiens
catacgcaattgtatatat

SEQ ID NO: 640254 - DNA, 15 bp, Homo sapiens
catacgcactgggca

SEQ ID NO: 640255 - DNA, 22 bp, Homo sapiens
catacgttgatagtttacaaac

SEQ ID NO: 640256 - DNA, 23 bp, Homo sapiens
catactcaaagaggccagtactt

SEQ ID NO: 640257 - DNA, 22 bp, Homo sapiens
catactctagattttgttttgc

SEQ ID NO: 640258 - DNA, 23 bp, Homo sapiens
catactctagattttgttttgct

SEQ ID NO: 640259 - DNA, 18 bp, Homo sapiens
catactgatgagacaaca

SEQ ID NO: 640260 - DNA, 18 bp, Homo sapiens
catactgtttaatattta

SEQ ID NO: 640261 - DNA, 23 bp, Homo sapiens
catactgtttaatatttatagag

SEQ ID NO: 640262 - DNA, 14 bp, Homo sapiens
catagcacatgttt

SEQ ID NO: 640263 - DNA, 21 bp, Homo sapiens
catagccagcattcagcacac

SEQ ID NO: 640264 - DNA, 22 bp, Homo sapiens
catagccccaggcccgccctgc

SEQ ID NO: 640265 - DNA, 16 bp, Homo sapiens
catagggtttggaaga

SEQ ID NO: 640266 - DNA, 18 bp, Homo sapiens
catagtcaatcaaacagg

SEQ ID NO: 640267 - DNA, 14 bp, Homo sapiens
catagtggtatttt

SEQ ID NO: 640268 - DNA, 17 bp, Homo sapiens
catagtggtattttaac

SEQ ID NO: 640269 - DNA, 18 bp, Homo sapiens
catagtggtattttaaca

SEQ ID NO: 640270 - DNA, 23 bp, Homo sapiens
catagtggtattttaacatagca

SEQ ID NO: 640271 - DNA, 21 bp, Homo sapiens
catagtttgaattcatgcctc

SEQ ID NO: 640272 - DNA, 19 bp, Homo sapiens
catataaacacagtaagat

SEQ ID NO: 640273 - DNA, 23 bp, Homo sapiens
catataataaattaatttttcaa

SEQ ID NO: 640274 - DNA, 24 bp, Homo sapiens
catataggggcaaaaatttgacat

SEQ ID NO: 640275 - DNA, 17 bp, Homo sapiens
catatataatcaaaata

SEQ ID NO: 640276 - DNA, 12 bp, Homo sapiens
catatatacata

SEQ ID NO: 640277 - DNA, 13 bp, Homo sapiens
catatatacatac

SEQ ID NO: 640278 - DNA, 20 bp, Homo sapiens
catatatataaaatacacgt

SEQ ID NO: 640279 - DNA, 13 bp, Homo sapiens
catatatatgtat

SEQ ID NO: 640280 - DNA, 14 bp, Homo sapiens
catatatatgtata

SEQ ID NO: 640281 - DNA, 15 bp, Homo sapiens
catatatatgtatat

SEQ ID NO: 640282 - DNA, 15 bp, Homo sapiens
catatcagctctgca

SEQ ID NO: 640283 - DNA, 15 bp, Homo sapiens
catatcattcagaat

SEQ ID NO: 640284 - DNA, 16 bp, Homo sapiens
catatcattcagaatg

SEQ ID NO: 640285 - DNA, 15 bp, Homo sapiens
catatgtaggaaaat

SEQ ID NO: 640286 - DNA, 19 bp, Homo sapiens
catatgttagatacacaaa

SEQ ID NO: 640287 - DNA, 16 bp, Homo sapiens
catattatatcagact

SEQ ID NO: 640288 - DNA, 23 bp, Homo sapiens
catattatatcagactgctttga

SEQ ID NO: 640289 - DNA, 16 bp, Homo sapiens
catatttacctgtgaa

SEQ ID NO: 640290 - DNA, 16 bp, Homo sapiens
catcaaacaaatcatt

SEQ ID NO: 640291 - DNA, 18 bp, Homo sapiens
catcaaacaaatcatttt

SEQ ID NO: 640292 - DNA, 19 bp, Homo sapiens
catcaaacaaatcattttg

SEQ ID NO: 640293 - DNA, 21 bp, Homo sapiens
catcaaacaaatcattttgat

SEQ ID NO: 640294 - DNA, 14 bp, Homo sapiens
catcagaagtggta

SEQ ID NO: 640295 - DNA, 15 bp, Homo sapiens
catcaggacttggga

SEQ ID NO: 640296 - DNA, 18 bp, Homo sapiens
catcattttttgtttctt

SEQ ID NO: 640297 - DNA, 18 bp, Homo sapiens
catccaactggaaggctt

SEQ ID NO: 640298 - DNA, 15 bp, Homo sapiens
catccaccttcctgc

SEQ ID NO: 640299 - DNA, 19 bp, Homo sapiens
catccaccttcctgcccag

SEQ ID NO: 640300 - DNA, 19 bp, Homo sapiens
cctctgctatgtctgtgat

SEQ ID NO: 640301 - DNA, 21 bp, Homo sapiens
cctctgcttgtcattctgcta

SEQ ID NO: 640302 - DNA, 12 bp, Homo sapiens
cctctgtccaca

SEQ ID NO: 640303 - DNA, 19 bp, Homo sapiens
cctctgtccgtctgtcctg

SEQ ID NO: 640304 - DNA, 22 bp, Homo sapiens
cctcttaagatctgactgccaa

SEQ ID NO: 640305 - DNA, 15 bp, Homo sapiens
cctcttctcagctcc

SEQ ID NO: 640306 - DNA, 16 bp, Homo sapiens
cctcttctcagctcca

SEQ ID NO: 640307 - DNA, 17 bp, Homo sapiens
cctcttctcagctccac

SEQ ID NO: 640308 - DNA, 18 bp, Homo sapiens
cctcttctcagctccact

SEQ ID NO: 640309 - DNA, 21 bp, Homo sapiens
cctcttcttgcggcaccgccc

SEQ ID NO: 640310 - DNA, 21 bp, Homo sapiens
cctgaaagcccttctcaagac

SEQ ID NO: 640311 - DNA, 15 bp, Homo sapiens
cctgaactcccagtc

SEQ ID NO: 640312 - DNA, 16 bp, Homo sapiens
cctgaagcctggattc

SEQ ID NO: 640313 - DNA, 13 bp, Homo sapiens
cctgaagttttat

SEQ ID NO: 640314 - DNA, 21 bp, Homo sapiens
cctgaatccatcaggacttgg

SEQ ID NO: 640315 - DNA, 19 bp, Homo sapiens
cctgacagcaaacacagtc

SEQ ID NO: 640316 - DNA, 13 bp, Homo sapiens
cctgaccctcact

SEQ ID NO: 640317 - DNA, 20 bp, Homo sapiens
cctgactgtgttcagtgcct

SEQ ID NO: 640318 - DNA, 20 bp, Homo sapiens
cctgacttcccagctggcag

SEQ ID NO: 640319 - DNA, 22 bp, Homo sapiens
cctgagcagatcgtgccgtgga

SEQ ID NO: 640320 - DNA, 23 bp, Homo sapiens
cctgagcagatcgtgccgtggag

SEQ ID NO: 640321 - DNA, 17 bp, Homo sapiens
cctgagccacagtgggg

SEQ ID NO: 640322 - DNA, 21 bp, Homo sapiens
cctgagccacagtggggccca

SEQ ID NO: 640323 - DNA, 12 bp, Homo sapiens
cctgagcctgtc

SEQ ID NO: 640324 - DNA, 16 bp, Homo sapiens
cctgagcctgtctctc

SEQ ID NO: 640325 - DNA, 22 bp, Homo sapiens
cctgagctccaccctcccctct

SEQ ID NO: 640326 - DNA, 12 bp, Homo sapiens
cctgaggaatga

SEQ ID NO: 640327 - DNA, 12 bp, Homo sapiens
cctgaggaggag

SEQ ID NO: 640328 - DNA, 23 bp, Homo sapiens
cctgaggaggaggacacagcaca

SEQ ID NO: 640329 - DNA, 13 bp, Homo sapiens
cctgagggaagcc

SEQ ID NO: 640330 - DNA, 22 bp, Homo sapiens
cctgagggacgagcagagcgca

SEQ ID NO: 640331 - DNA, 13 bp, Homo sapiens
cctgagtgggctg

SEQ ID NO: 640332 - DNA, 15 bp, Homo sapiens
cctgataactctgta

SEQ ID NO: 640333 - DNA, 16 bp, Homo sapiens
cctgatatccaacaga

SEQ ID NO: 640334 - DNA, 12 bp, Homo sapiens
cctgcaccctct

SEQ ID NO: 640335 - DNA, 17 bp, Homo sapiens
cctgcacctgcttctca

SEQ ID NO: 640336 - DNA, 20 bp, Homo sapiens
cctgcactgtcccggagctc

SEQ ID NO: 640337 - DNA, 13 bp, Homo sapiens
cctgcagcccaga

SEQ ID NO: 640338 - DNA, 12 bp, Homo sapiens
cctgcaggcagg

SEQ ID NO: 640339 - DNA, 18 bp, Homo sapiens
cctgcagtcacgtgaggc

SEQ ID NO: 640340 - DNA, 17 bp, Homo sapiens
cctgcagtttggccctg

SEQ ID NO: 640341 - DNA, 19 bp, Homo sapiens
cctgcagtttggccctgga

SEQ ID NO: 640342 - DNA, 22 bp, Homo sapiens
cctgcagtttggccctggagcc

SEQ ID NO: 640343 - DNA, 24 bp, Homo sapiens
cctgcagtttggccctggagccag

SEQ ID NO: 640344 - DNA, 19 bp, Homo sapiens
cctgcatcccttggcccct

SEQ ID NO: 640345 - DNA, 21 bp, Homo sapiens
cctgcatcccttggcccctct

SEQ ID NO: 640346 - DNA, 23 bp, Homo sapiens
cctgcatcccttggcccctctct

SEQ ID NO: 640347 - DNA, 15 bp, Homo sapiens
cctgcatggagaagg

SEQ ID NO: 640348 - DNA, 19 bp, Homo sapiens
cctgcatgtcggggcccct

SEQ ID NO: 640349 - DNA, 24 bp, Homo sapiens
cctgcatgtcggggcccctgcgtg

SEQ ID NO: 640350 - DNA, 17 bp, Homo sapiens
cctgccaggccctccag

SEQ ID NO: 640351 - DNA, 23 bp, Homo sapiens
cctgccagtgtttagaagagcct

SEQ ID NO: 640352 - DNA, 19 bp, Homo sapiens
cctgcccagcacctcctcc

SEQ ID NO: 640353 - DNA, 19 bp, Homo sapiens
cctgccccccttcccaccc

SEQ ID NO: 640354 - DNA, 13 bp, Homo sapiens
cctgcccgcccgc

SEQ ID NO: 640355 - DNA, 20 bp, Homo sapiens
cctgccctcactccactccc

SEQ ID NO: 640356 - DNA, 14 bp, Homo sapiens
cctgcctcactgtg

SEQ ID NO: 640357 - DNA, 17 bp, Homo sapiens
cctgcctctatccctgg

SEQ ID NO: 640358 - DNA, 14 bp, Homo sapiens
cctgcctgagacca

SEQ ID NO: 640359 - DNA, 21 bp, Homo sapiens
cctgcctgagaccacggtcca

SEQ ID NO: 640360 - DNA, 12 bp, Homo sapiens
cctgcctgagga

SEQ ID NO: 640361 - DNA, 16 bp, Homo sapiens
cctgcctgaggaggag

SEQ ID NO: 640362 - DNA, 22 bp, Homo sapiens
cctgcctgaggaggaggacaca

SEQ ID NO: 640363 - DNA, 23 bp, Homo sapiens
cctgcctggaggagaaggaggaa

SEQ ID NO: 640364 - DNA, 21 bp, Homo sapiens
cctgcgacggaggcaggacca

SEQ ID NO: 640365 - DNA, 21 bp, Homo sapiens
cctgcgcaccccgttcccagc

SEQ ID NO: 640366 - DNA, 12 bp, Homo sapiens
cctgcgcccctg

SEQ ID NO: 640367 - DNA, 13 bp, Homo sapiens
cctgcgcccctgc

SEQ ID NO: 640368 - DNA, 18 bp, Homo sapiens
cctgcgcccctgcccagc

SEQ ID NO: 640369 - DNA, 19 bp, Homo sapiens
cctgcgcccctgcccagca

SEQ ID NO: 640370 - DNA, 21 bp, Homo sapiens
cctgcgccctccctccctcca

SEQ ID NO: 640371 - DNA, 15 bp, Homo sapiens
cctgcgcctcctcct

SEQ ID NO: 640372 - DNA, 17 bp, Homo sapiens
cctgcgcctcctcctgc

SEQ ID NO: 640373 - DNA, 19 bp, Homo sapiens
cctgcgcctcctcctgcat

SEQ ID NO: 640374 - DNA, 19 bp, Homo sapiens
cctgcgcctgcgcctcctc

SEQ ID NO: 640375 - DNA, 16 bp, Homo sapiens
cctgcgcgcagctggc

SEQ ID NO: 640376 - DNA, 14 bp, Homo sapiens
cctgcgctcctctg

SEQ ID NO: 640377 - DNA, 16 bp, Homo sapiens
cctgcgctcctctgca

SEQ ID NO: 640378 - DNA, 17 bp, Homo sapiens
cctgcggggcggcatcc

SEQ ID NO: 640379 - DNA, 20 bp, Homo sapiens
cctgcggggttccctgcgcg

SEQ ID NO: 640380 - DNA, 21 bp, Homo sapiens
cctgcgtgtgttctctccgga

SEQ ID NO: 640381 - DNA, 14 bp, Homo sapiens
cctgctcagcccat

SEQ ID NO: 640382 - DNA, 16 bp, Homo sapiens
cctgctcagcccatcc

SEQ ID NO: 640383 - DNA, 16 bp, Homo sapiens
cctgctccctgctccc

SEQ ID NO: 640384 - DNA, 13 bp, Homo sapiens
cctgctcctccag

SEQ ID NO: 640385 - DNA, 13 bp, Homo sapiens
cctgctcctgccc

SEQ ID NO: 640386 - DNA, 12 bp, Homo sapiens
cctgctcgccct

SEQ ID NO: 640387 - DNA, 16 bp, Homo sapiens
cctgctcgccctgtgc

SEQ ID NO: 640388 - DNA, 17 bp, Homo sapiens
cctgctcgccctgtgcc

SEQ ID NO: 640389 - DNA, 21 bp, Homo sapiens
cctgctcgccctgtgccctct

SEQ ID NO: 640390 - DNA, 23 bp, Homo sapiens
cctgctgagaatccccgtgctca

SEQ ID NO: 640391 - DNA, 12 bp, Homo sapiens
cctgctgccagg

SEQ ID NO: 640392 - DNA, 19 bp, Homo sapiens
cctgctgctcgggaaggcc

SEQ ID NO: 640393 - DNA, 20 bp, Homo sapiens
cctggaagttgtcctttctg

SEQ ID NO: 640394 - DNA, 16 bp, Homo sapiens
cctggaattttaggaa

SEQ ID NO: 640395 - DNA, 18 bp, Homo sapiens
cctggacagtgcctaact

SEQ ID NO: 640396 - DNA, 16 bp, Homo sapiens
cctggacatattccca

SEQ ID NO: 640397 - DNA, 13 bp, Homo sapiens
cctggagccaggg

SEQ ID NO: 640398 - DNA, 13 bp, Homo sapiens
cctggagctgtcc

SEQ ID NO: 640399 - DNA, 22 bp, Homo sapiens
cctggattccagcagtgaatgc

SEQ ID NO: 640400 - DNA, 23 bp, Homo sapiens
cctggattccagcagtgaatgct

SEQ ID NO: 640401 - DNA, 15 bp, Homo sapiens
cctcacccctgtagg

SEQ ID NO: 640402 - DNA, 14 bp, Homo sapiens
cctcactaccactt

SEQ ID NO: 640403 - DNA, 23 bp, Homo sapiens
cctcactccactcccctcatcca

SEQ ID NO: 640404 - DNA, 16 bp, Homo sapiens
cctcactgggtgtggc

SEQ ID NO: 640405 - DNA, 18 bp, Homo sapiens
cctcactgtgacctgctc

SEQ ID NO: 640406 - DNA, 19 bp, Homo sapiens
cctcacttgtggcagcttc

SEQ ID NO: 640407 - DNA, 16 bp, Homo sapiens
cctcagagaatgatca

SEQ ID NO: 640408 - DNA, 20 bp, Homo sapiens
cctcagccagtggcacagga

SEQ ID NO: 640409 - DNA, 17 bp, Homo sapiens
cctcagctctccctcac

SEQ ID NO: 640410 - DNA, 17 bp, Homo sapiens
cctcagggaccaaggag

SEQ ID NO: 640411 - DNA, 17 bp, Homo sapiens
cctcagttggcctctgc

SEQ ID NO: 640412 - DNA, 20 bp, Homo sapiens
cctcagttggcctctgcccc

SEQ ID NO: 640413 - DNA, 19 bp, Homo sapiens
cctcatagcatagccagca

SEQ ID NO: 640414 - DNA, 15 bp, Homo sapiens
cctcatgaccctcct

SEQ ID NO: 640415 - DNA, 23 bp, Homo sapiens
cctcatgaccctcctgtccagca

SEQ ID NO: 640416 - DNA, 19 bp, Homo sapiens
cctcatggctgttatctgt

SEQ ID NO: 640417 - DNA, 17 bp, Homo sapiens
cctccacacctccaccc

SEQ ID NO: 640418 - DNA, 18 bp, Homo sapiens
cctccacacctccacccg

SEQ ID NO: 640419 - DNA, 13 bp, Homo sapiens
cctccacaggagc

SEQ ID NO: 640420 - DNA, 17 bp, Homo sapiens
cctccacaggagccgca

SEQ ID NO: 640421 - DNA, 22 bp, Homo sapiens
cctccacaggagccgcagaggc

SEQ ID NO: 640422 - DNA, 18 bp, Homo sapiens
cctccacagtagcatttc

SEQ ID NO: 640423 - DNA, 15 bp, Homo sapiens
cctccacccgtcctg

SEQ ID NO: 640424 - DNA, 12 bp, Homo sapiens
cctccactcctc

SEQ ID NO: 640425 - DNA, 15 bp, Homo sapiens
cctccactcctccca

SEQ ID NO: 640426 - DNA, 14 bp, Homo sapiens
cctccagaccccta

SEQ ID NO: 640427 - DNA, 15 bp, Homo sapiens
cctccagacccctac

SEQ ID NO: 640428 - DNA, 17 bp, Homo sapiens
cctccagacccctaccc

SEQ ID NO: 640429 - DNA, 22 bp, Homo sapiens
cctccaggaggactgttctaac

SEQ ID NO: 640430 - DNA, 19 bp, Homo sapiens
cctccagttctgatgaggc

SEQ ID NO: 640431 - DNA, 12 bp, Homo sapiens
cctccatgctgt

SEQ ID NO: 640432 - DNA, 17 bp, Homo sapiens
cctcccaactctggcct

SEQ ID NO: 640433 - DNA, 12 bp, Homo sapiens
cctccccagagc

SEQ ID NO: 640434 - DNA, 14 bp, Homo sapiens
cctccccagagccc

SEQ ID NO: 640435 - DNA, 20 bp, Homo sapiens
cctccccagagccctgcagt

SEQ ID NO: 640436 - DNA, 21 bp, Homo sapiens
cctcccccaggctgcgcctgc

SEQ ID NO: 640437 - DNA, 13 bp, Homo sapiens
cctcccccgcaga

SEQ ID NO: 640438 - DNA, 16 bp, Homo sapiens
cctcccccgcagacag

SEQ ID NO: 640439 - DNA, 12 bp, Homo sapiens
cctccccctaca

SEQ ID NO: 640440 - DNA, 12 bp, Homo sapiens
cctccccctcct

SEQ ID NO: 640441 - DNA, 14 bp, Homo sapiens
cctcccctctcctg

SEQ ID NO: 640442 - DNA, 15 bp, Homo sapiens
cctcccctctcctga

SEQ ID NO: 640443 - DNA, 14 bp, Homo sapiens
cctcccctggaagt

SEQ ID NO: 640444 - DNA, 17 bp, Homo sapiens
cctccctcacccggcaa

SEQ ID NO: 640445 - DNA, 15 bp, Homo sapiens
cctccctccctccac

SEQ ID NO: 640446 - DNA, 16 bp, Homo sapiens
cctccctccctccaca

SEQ ID NO: 640447 - DNA, 18 bp, Homo sapiens
cctccctccctgctccct

SEQ ID NO: 640448 - DNA, 15 bp, Homo sapiens
cctccctgctccctg

SEQ ID NO: 640449 - DNA, 14 bp, Homo sapiens
cctccctgctgcca

SEQ ID NO: 640450 - DNA, 15 bp, Homo sapiens
cctccctgctgccag

SEQ ID NO: 640451 - DNA, 15 bp, Homo sapiens
cctccctggggacca

SEQ ID NO: 640452 - DNA, 18 bp, Homo sapiens
cctccctggggaccagga

SEQ ID NO: 640453 - DNA, 20 bp, Homo sapiens
cctccctgtcccctgaggtt

SEQ ID NO: 640454 - DNA, 13 bp, Homo sapiens
cctccgcccttcc

SEQ ID NO: 640455 - DNA, 17 bp, Homo sapiens
cctccgcggaggcccct

SEQ ID NO: 640456 - DNA, 21 bp, Homo sapiens
cctccgcggaggcccctgagg

SEQ ID NO: 640457 - DNA, 22 bp, Homo sapiens
cctccgggcagagaccaccgcg

SEQ ID NO: 640458 - DNA, 14 bp, Homo sapiens
cctccgtccccagg

SEQ ID NO: 640459 - DNA, 22 bp, Homo sapiens
cctccgtgggcagctcctcggg

SEQ ID NO: 640460 - DNA, 24 bp, Homo sapiens
cctccgtgggcagctcctcgggtg

SEQ ID NO: 640461 - DNA, 14 bp, Homo sapiens
cctcctagcctctc

SEQ ID NO: 640462 - DNA, 22 bp, Homo sapiens
cctcctagcctctccgcccacg

SEQ ID NO: 640463 - DNA, 11 bp, Homo sapiens
cctcctccaga

SEQ ID NO: 640464 - DNA, 14 bp, Homo sapiens
cctcctccatgctg

SEQ ID NO: 640465 - DNA, 13 bp, Homo sapiens
cctcctcctgcat

SEQ ID NO: 640466 - DNA, 14 bp, Homo sapiens
cctcctcgggcgcc

SEQ ID NO: 640467 - DNA, 22 bp, Homo sapiens
cctcctcgggcgcctgcgctcc

SEQ ID NO: 640468 - DNA, 23 bp, Homo sapiens
cctcctcgggcgcctgcgctcct

SEQ ID NO: 640469 - DNA, 15 bp, Homo sapiens
cctcctctcctcgtc

SEQ ID NO: 640470 - DNA, 23 bp, Homo sapiens
cctcctctcctcgtccggcctgc

SEQ ID NO: 640471 - DNA, 11 bp, Homo sapiens
cctcctctgcc

SEQ ID NO: 640472 - DNA, 15 bp, Homo sapiens
cctcctctgccccct

SEQ ID NO: 640473 - DNA, 15 bp, Homo sapiens
cctcctgtctcctct

SEQ ID NO: 640474 - DNA, 21 bp, Homo sapiens
cctcctgtctcctctgtcagt

SEQ ID NO: 640475 - DNA, 21 bp, Homo sapiens
cctccttcactccctgtcata

SEQ ID NO: 640476 - DNA, 12 bp, Homo sapiens
cctccttctccc

SEQ ID NO: 640477 - DNA, 14 bp, Homo sapiens
cctccttctcccct

SEQ ID NO: 640478 - DNA, 15 bp, Homo sapiens
cctccttctcccctc

SEQ ID NO: 640479 - DNA, 21 bp, Homo sapiens
cctccttctcccctccagacc

SEQ ID NO: 640480 - DNA, 20 bp, Homo sapiens
cctcgccccagccaagcctg

SEQ ID NO: 640481 - DNA, 14 bp, Homo sapiens
cctcgccccccgcc

SEQ ID NO: 640482 - DNA, 23 bp, Homo sapiens
cctcgccccccgcccggcctcct

SEQ ID NO: 640483 - DNA, 12 bp, Homo sapiens
cctcgcgcccct

SEQ ID NO: 640484 - DNA, 17 bp, Homo sapiens
cctcgcgcccctgtcca

SEQ ID NO: 640485 - DNA, 20 bp, Homo sapiens
cctcggacaccatcttggga

SEQ ID NO: 640486 - DNA, 13 bp, Homo sapiens
cctcggctgtgtg

SEQ ID NO: 640487 - DNA, 12 bp, Homo sapiens
cctcgggccgcc

SEQ ID NO: 640488 - DNA, 16 bp, Homo sapiens
cctcgggccgcctcct

SEQ ID NO: 640489 - DNA, 18 bp, Homo sapiens
cctcgggccgcctcctcc

SEQ ID NO: 640490 - DNA, 21 bp, Homo sapiens
cctcgggccgcctcctccaga

SEQ ID NO: 640491 - DNA, 19 bp, Homo sapiens
cctcgtccggcctgcagcc

SEQ ID NO: 640492 - DNA, 18 bp, Homo sapiens
cctcgttggagagcagca

SEQ ID NO: 640493 - DNA, 14 bp, Homo sapiens
cctctaccaagctg

SEQ ID NO: 640494 - DNA, 23 bp, Homo sapiens
cctctaggtaaactagcaaaagg

SEQ ID NO: 640495 - DNA, 23 bp, Homo sapiens
cctctatccctggccacctgcca

SEQ ID NO: 640496 - DNA, 20 bp, Homo sapiens
cctctcagcccctcagagaa

SEQ ID NO: 640497 - DNA, 22 bp, Homo sapiens
cctctcccaaataaactcctta

SEQ ID NO: 640498 - DNA, 19 bp, Homo sapiens
cctctcctcgtccggcctg

SEQ ID NO: 640499 - DNA, 20 bp, Homo sapiens
cctctcctcgtccggcctgc

SEQ ID NO: 640500 - DNA, 21 bp, Homo sapiens
cctctcctcgtccggcctgca

SEQ ID NO: 640501 - DNA, 12 bp, Homo sapiens
cctctcctctct

SEQ ID NO: 640502 - DNA, 15 bp, Homo sapiens
cctctcctctctgga

SEQ ID NO: 640503 - DNA, 16 bp, Homo sapiens
cctctcctgagcctgt

SEQ ID NO: 640504 - DNA, 19 bp, Homo sapiens
cctctcgggctctctcacc

SEQ ID NO: 640505 - DNA, 21 bp, Homo sapiens
cctctcgtagaacctgcgcac

SEQ ID NO: 640506 - DNA, 13 bp, Homo sapiens
cctctctctccct

SEQ ID NO: 640507 - DNA, 14 bp, Homo sapiens
cctctctctccctc

SEQ ID NO: 640508 - DNA, 15 bp, Homo sapiens
cctctctctccctcc

SEQ ID NO: 640509 - DNA, 19 bp, Homo sapiens
ccactaagctttctccttt

SEQ ID NO: 640510 - DNA, 13 bp, Homo sapiens
ccactagccctct

SEQ ID NO: 640511 - DNA, 17 bp, Homo sapiens
ccactaggtgcccagtc

SEQ ID NO: 640512 - DNA, 21 bp, Homo sapiens
ccactaggtgcccagtcttga

SEQ ID NO: 640513 - DNA, 17 bp, Homo sapiens
ccactccccccatccta

SEQ ID NO: 640514 - DNA, 17 bp, Homo sapiens
ccactcccctcatccac

SEQ ID NO: 640515 - DNA, 18 bp, Homo sapiens
ccactcccctcatccact

SEQ ID NO: 640516 - DNA, 16 bp, Homo sapiens
ccactcctcccaactc

SEQ ID NO: 640517 - DNA, 21 bp, Homo sapiens
ccactctgaagtcccttcctg

SEQ ID NO: 640518 - DNA, 16 bp, Homo sapiens
ccactgaatctgagaa

SEQ ID NO: 640519 - DNA, 23 bp, Homo sapiens
ccactgactaggcatgttaggaa

SEQ ID NO: 640520 - DNA, 24 bp, Homo sapiens
ccactgatatcacgggcccgctca

SEQ ID NO: 640521 - DNA, 14 bp, Homo sapiens
ccactgcccctgca

SEQ ID NO: 640522 - DNA, 21 bp, Homo sapiens
ccagaaagaggaataaaatga

SEQ ID NO: 640523 - DNA, 16 bp, Homo sapiens
ccagaacgggcctccc

SEQ ID NO: 640524 - DNA, 18 bp, Homo sapiens
ccagaacgggcctccccg

SEQ ID NO: 640525 - DNA, 13 bp, Homo sapiens
ccagaagcagcag

SEQ ID NO: 640526 - DNA, 16 bp, Homo sapiens
ccagaagtttaaatct

SEQ ID NO: 640527 - DNA, 22 bp, Homo sapiens
ccagaatgaggcacatgacagt

SEQ ID NO: 640528 - DNA, 14 bp, Homo sapiens
ccagacagagatca

SEQ ID NO: 640529 - DNA, 15 bp, Homo sapiens
ccagacagagatcag

SEQ ID NO: 640530 - DNA, 15 bp, Homo sapiens
ccagacagagtggat

SEQ ID NO: 640531 - DNA, 18 bp, Homo sapiens
ccagaccacgcccctgcc

SEQ ID NO: 640532 - DNA, 16 bp, Homo sapiens
ccagactcgagagggc

SEQ ID NO: 640533 - DNA, 22 bp, Homo sapiens
ccagactcgagagggctgagcc

SEQ ID NO: 640534 - DNA, 19 bp, Homo sapiens
ccagagactgcccaccctg

SEQ ID NO: 640535 - DNA, 11 bp, Homo sapiens
ccagagcactg

SEQ ID NO: 640536 - DNA, 14 bp, Homo sapiens
ccagagcactgtat

SEQ ID NO: 640537 - DNA, 16 bp, Homo sapiens
ccagagccctgcagtc

SEQ ID NO: 640538 - DNA, 19 bp, Homo sapiens
ccagagcctatggaaaggg

SEQ ID NO: 640539 - DNA, 18 bp, Homo sapiens
ccagagcgatgtgttctt

SEQ ID NO: 640540 - DNA, 21 bp, Homo sapiens
ccagagcgatgtgttctttgt

SEQ ID NO: 640541 - DNA, 21 bp, Homo sapiens
ccagagtaggtgggtcttgga

SEQ ID NO: 640542 - DNA, 18 bp, Homo sapiens
ccagattattttctatat

SEQ ID NO: 640543 - DNA, 12 bp, Homo sapiens
ccagatttcact

SEQ ID NO: 640544 - DNA, 17 bp, Homo sapiens
ccagcaaagttttcaga

SEQ ID NO: 640545 - DNA, 13 bp, Homo sapiens
ccagcacctcctc

SEQ ID NO: 640546 - DNA, 14 bp, Homo sapiens
ccagcacctcctcc

SEQ ID NO: 640547 - DNA, 16 bp, Homo sapiens
ccagcacctcctccgt

SEQ ID NO: 640548 - DNA, 18 bp, Homo sapiens
ccagcacctcctccgtgg

SEQ ID NO: 640549 - DNA, 14 bp, Homo sapiens
ccagcactcccagg

SEQ ID NO: 640550 - DNA, 18 bp, Homo sapiens
ccagcactcccagggccc

SEQ ID NO: 640551 - DNA, 17 bp, Homo sapiens
ccagcagacattgtcag

SEQ ID NO: 640552 - DNA, 16 bp, Homo sapiens
ccagcaggaggacaga

SEQ ID NO: 640553 - DNA, 14 bp, Homo sapiens
ccagcatagttctg

SEQ ID NO: 640554 - DNA, 17 bp, Homo sapiens
ccagcatagttctgcaa

SEQ ID NO: 640555 - DNA, 14 bp, Homo sapiens
ccagcccatgctgg

SEQ ID NO: 640556 - DNA, 19 bp, Homo sapiens
ccagcccatgctggctggg

SEQ ID NO: 640557 - DNA, 20 bp, Homo sapiens
ccagcccatgctggctgggg

SEQ ID NO: 640558 - DNA, 21 bp, Homo sapiens
ccagccctccgccagccctgt

SEQ ID NO: 640559 - DNA, 22 bp, Homo sapiens
ccagccctccgccagccctgtt

SEQ ID NO: 640560 - DNA, 17 bp, Homo sapiens
ccagcccttgctctacc

SEQ ID NO: 640561 - DNA, 20 bp, Homo sapiens
ccagcccttgctctacctgg

SEQ ID NO: 640562 - DNA, 22 bp, Homo sapiens
ccagccctttgcaggcccagca

SEQ ID NO: 640563 - DNA, 23 bp, Homo sapiens
ccagccctttgcaggcccagcag

SEQ ID NO: 640564 - DNA, 20 bp, Homo sapiens
ccagcctatctctcttctgc

SEQ ID NO: 640565 - DNA, 12 bp, Homo sapiens
ccagcctccccc

SEQ ID NO: 640566 - DNA, 17 bp, Homo sapiens
ccagcctcccccaggct

SEQ ID NO: 640567 - DNA, 18 bp, Homo sapiens
ccagcctgaaagatacag

SEQ ID NO: 640568 - DNA, 13 bp, Homo sapiens
ccagcctgagcca

SEQ ID NO: 640569 - DNA, 14 bp, Homo sapiens
ccagcctgagccac

SEQ ID NO: 640570 - DNA, 15 bp, Homo sapiens
ccagcctgagccaca

SEQ ID NO: 640571 - DNA, 18 bp, Homo sapiens
ccagcctgagccacagtg

SEQ ID NO: 640572 - DNA, 15 bp, Homo sapiens
ccagcctgccaggcc

SEQ ID NO: 640573 - DNA, 17 bp, Homo sapiens
ccagcctgccaggccct

SEQ ID NO: 640574 - DNA, 14 bp, Homo sapiens
ccagccttcttccc

SEQ ID NO: 640575 - DNA, 15 bp, Homo sapiens
ccagcgagtggtcaa

SEQ ID NO: 640576 - DNA, 20 bp, Homo sapiens
ccagcgcagcgccagggctc

SEQ ID NO: 640577 - DNA, 17 bp, Homo sapiens
ccagcgcatggcgcccc

SEQ ID NO: 640578 - DNA, 15 bp, Homo sapiens
ccagcgctgaacaga

SEQ ID NO: 640579 - DNA, 19 bp, Homo sapiens
ccagcggggcttctgggcg

SEQ ID NO: 640580 - DNA, 12 bp, Homo sapiens
ccagcgtggggc

SEQ ID NO: 640581 - DNA, 23 bp, Homo sapiens
ccagcgtggggctaacgggcgcc

SEQ ID NO: 640582 - DNA, 20 bp, Homo sapiens
ccagctacaggggaggctga

SEQ ID NO: 640583 - DNA, 13 bp, Homo sapiens
ccagctctgagca

SEQ ID NO: 640584 - DNA, 11 bp, Homo sapiens
ccagctctgga

SEQ ID NO: 640585 - DNA, 18 bp, Homo sapiens
ccagctctggatgaaggc

SEQ ID NO: 640586 - DNA, 14 bp, Homo sapiens
ccagctggcagcgc

SEQ ID NO: 640587 - DNA, 19 bp, Homo sapiens
ccagctggcagcgcctccc

SEQ ID NO: 640588 - DNA, 22 bp, Homo sapiens
ccagctggctgggtcgcccctc

SEQ ID NO: 640589 - DNA, 15 bp, Homo sapiens
ccagcttgcttctct

SEQ ID NO: 640590 - DNA, 16 bp, Homo sapiens
ccagcttgcttctctg

SEQ ID NO: 640591 - DNA, 15 bp, Homo sapiens
ccaggacccccccag

SEQ ID NO: 640592 - DNA, 18 bp, Homo sapiens
ccaggacccccccagtcc

SEQ ID NO: 640593 - DNA, 20 bp, Homo sapiens
ccaggagctagcccagtccc

SEQ ID NO: 640594 - DNA, 14 bp, Homo sapiens
ccaggatgcatgca

SEQ ID NO: 640595 - DNA, 13 bp, Homo sapiens
ccaggcccgccct

SEQ ID NO: 640596 - DNA, 15 bp, Homo sapiens
ccaggcccgccctgc

SEQ ID NO: 640597 - DNA, 16 bp, Homo sapiens
ccaggcccgccctgcc

SEQ ID NO: 640598 - DNA, 15 bp, Homo sapiens
cccccaggctgcgcc

SEQ ID NO: 640599 - DNA, 18 bp, Homo sapiens
cccccaggctgcgcctgc

SEQ ID NO: 640600 - DNA, 15 bp, Homo sapiens
cccccagtccgcccc

SEQ ID NO: 640601 - DNA, 17 bp, Homo sapiens
cccccggaggcgcccac

SEQ ID NO: 640602 - DNA, 18 bp, Homo sapiens
cccccggaggcgcccacc

SEQ ID NO: 640603 - DNA, 21 bp, Homo sapiens
cccccggaggcgcccacctgc

SEQ ID NO: 640604 - DNA, 22 bp, Homo sapiens
cccccggcctggccccctcgcg

SEQ ID NO: 640605 - DNA, 14 bp, Homo sapiens
cccccgggcccttt

SEQ ID NO: 640606 - DNA, 14 bp, Homo sapiens
ccccctcccccgca

SEQ ID NO: 640607 - DNA, 13 bp, Homo sapiens
ccccctcctgcac

SEQ ID NO: 640608 - DNA, 11 bp, Homo sapiens
ccccctgagtg

SEQ ID NO: 640609 - DNA, 15 bp, Homo sapiens
ccctccacaggagcc

SEQ ID NO: 640610 - DNA, 12 bp, Homo sapiens
ccctccactcct

SEQ ID NO: 640611 - DNA, 13 bp, Homo sapiens
ccctccactcctc

SEQ ID NO: 640612 - DNA, 19 bp, Homo sapiens
ccctccactcctcccaact

SEQ ID NO: 640613 - DNA, 22 bp, Homo sapiens
ccctccactcctcccaactctg

SEQ ID NO: 640614 - DNA, 17 bp, Homo sapiens
ccctccagacccctacc

SEQ ID NO: 640615 - DNA, 16 bp, Homo sapiens
ccctccccacagtcct

SEQ ID NO: 640616 - DNA, 17 bp, Homo sapiens
ccctccccacagtcctc

SEQ ID NO: 640617 - DNA, 18 bp, Homo sapiens
ccctccccacagtcctca

SEQ ID NO: 640618 - DNA, 13 bp, Homo sapiens
ccctccccagccc

SEQ ID NO: 640619 - DNA, 15 bp, Homo sapiens
ccctccccagccctt

SEQ ID NO: 640620 - DNA, 17 bp, Homo sapiens
ccctcccctctcctgag

SEQ ID NO: 640621 - DNA, 12 bp, Homo sapiens
ccctccctccac

SEQ ID NO: 640622 - DNA, 14 bp, Homo sapiens
ccctccctccacac

SEQ ID NO: 640623 - DNA, 15 bp, Homo sapiens
ccctccctccctgct

SEQ ID NO: 640624 - DNA, 17 bp, Homo sapiens
ccctccgccagccctgt

SEQ ID NO: 640625 - DNA, 18 bp, Homo sapiens
ccctccgccagccctgtt

SEQ ID NO: 640626 - DNA, 14 bp, Homo sapiens
ccctccgcccttcc

SEQ ID NO: 640627 - DNA, 15 bp, Homo sapiens
ccctccgtccccagg

SEQ ID NO: 640628 - DNA, 16 bp, Homo sapiens
ccctccgtccccaggg

SEQ ID NO: 640629 - DNA, 17 bp, Homo sapiens
ccctccgtccccagggt

SEQ ID NO: 640630 - DNA, 14 bp, Homo sapiens
ccctcctctgcccc

SEQ ID NO: 640631 - DNA, 19 bp, Homo sapiens
ccctccttctcccctccag

SEQ ID NO: 640632 - DNA, 17 bp, Homo sapiens
ccctcgcgcccctgtcc

SEQ ID NO: 640633 - DNA, 21 bp, Homo sapiens
ccctcggtcagcaccgtggtg

SEQ ID NO: 640634 - DNA, 19 bp, Homo sapiens
ccctctcctgagcctgtct

SEQ ID NO: 640635 - DNA, 21 bp, Homo sapiens
ccctctcctgagcctgtctct

SEQ ID NO: 640636 - DNA, 22 bp, Homo sapiens
ccctctcctgagcctgtctctc

SEQ ID NO: 640637 - DNA, 18 bp, Homo sapiens
ccctctctgtttaccctc

SEQ ID NO: 640638 - DNA, 15 bp, Homo sapiens
ccctctgcgccccag

SEQ ID NO: 640639 - DNA, 18 bp, Homo sapiens
ccctctgcgccccagcga

SEQ ID NO: 640640 - DNA, 21 bp, Homo sapiens
ccctctgctatgtctgtgatg

SEQ ID NO: 640641 - DNA, 13 bp, Homo sapiens
ccctctgtccaca

SEQ ID NO: 640642 - DNA, 11 bp, Homo sapiens
ccctcttcaat

SEQ ID NO: 640643 - DNA, 12 bp, Homo sapiens
ccctcttccccc

SEQ ID NO: 640644 - DNA, 14 bp, Homo sapiens
ccctcttccccctt

SEQ ID NO: 640645 - DNA, 20 bp, Homo sapiens
ccctcttcccccttcccctg

SEQ ID NO: 640646 - DNA, 15 bp, Homo sapiens
ccctcttctcagctc

SEQ ID NO: 640647 - DNA, 18 bp, Homo sapiens
ccctcttctcagctccac

SEQ ID NO: 640648 - DNA, 23 bp, Homo sapiens
ccctcttctcagctccactctga

SEQ ID NO: 640649 - DNA, 15 bp, Homo sapiens
ccctctttctctctg

SEQ ID NO: 640650 - DNA, 16 bp, Homo sapiens
ccctctttctctctgt

SEQ ID NO: 640651 - DNA, 19 bp, Homo sapiens
ccctctttctctctgtgtg

SEQ ID NO: 640652 - DNA, 21 bp, Homo sapiens
ccctgaaatattttctacttt

SEQ ID NO: 640653 - DNA, 17 bp, Homo sapiens
ccctgaatcagaggcag

SEQ ID NO: 640654 - DNA, 20 bp, Homo sapiens
ccctgacaacaactatcacc

SEQ ID NO: 640655 - DNA, 21 bp, Homo sapiens
ccctgacaacaactatcacca

SEQ ID NO: 640656 - DNA, 13 bp, Homo sapiens
ccctgacactgtc

SEQ ID NO: 640657 - DNA, 15 bp, Homo sapiens
ccctgacttcccagc

SEQ ID NO: 640658 - DNA, 19 bp, Homo sapiens
ccctgacttcccagctggc

SEQ ID NO: 640659 - DNA, 21 bp, Homo sapiens
ccctgacttcccagctggcag

SEQ ID NO: 640660 - DNA, 22 bp, Homo sapiens
ccctgacttcccagctggcagc

SEQ ID NO: 640661 - DNA, 18 bp, Homo sapiens
ccctgagcctgacctttc

SEQ ID NO: 640662 - DNA, 13 bp, Homo sapiens
ccctgaggaatga

SEQ ID NO: 640663 - DNA, 22 bp, Homo sapiens
ccctgcaggcaggcagaccacg

SEQ ID NO: 640664 - DNA, 23 bp, Homo sapiens
ccctgcagtcacgtgaggcccct

SEQ ID NO: 640665 - DNA, 18 bp, Homo sapiens
ccctgcagtttggccctg

SEQ ID NO: 640666 - DNA, 24 bp, Homo sapiens
ccctgcagtttggccctggagcca

SEQ ID NO: 640667 - DNA, 13 bp, Homo sapiens
ccctgcatccctt

SEQ ID NO: 640668 - DNA, 14 bp, Homo sapiens
ccctgcatcccttg

SEQ ID NO: 640669 - DNA, 13 bp, Homo sapiens
ccctgcccagcac

SEQ ID NO: 640670 - DNA, 14 bp, Homo sapiens
ccctgcccagcacc

SEQ ID NO: 640671 - DNA, 18 bp, Homo sapiens
ccctgcccagcacctcct

SEQ ID NO: 640672 - DNA, 19 bp, Homo sapiens
ccctgcccgaccccatctc

SEQ ID NO: 640673 - DNA, 14 bp, Homo sapiens
ccctgccctcactc

SEQ ID NO: 640674 - DNA, 14 bp, Homo sapiens
ccctgccctcggcc

SEQ ID NO: 640675 - DNA, 13 bp, Homo sapiens
ccctgcctgagga

SEQ ID NO: 640676 - DNA, 18 bp, Homo sapiens
ccctgcgcccctgcccag

SEQ ID NO: 640677 - DNA, 22 bp, Homo sapiens
ccctgcgccctccctccctcca

SEQ ID NO: 640678 - DNA, 23 bp, Homo sapiens
ccctgcgccctccctccctccac

SEQ ID NO: 640679 - DNA, 17 bp, Homo sapiens
ccctgctcccggctctg

SEQ ID NO: 640680 - DNA, 19 bp, Homo sapiens
ccctgctcccggctctgag

SEQ ID NO: 640681 - DNA, 21 bp, Homo sapiens
ccctgctgccaggctcccact

SEQ ID NO: 640682 - DNA, 12 bp, Homo sapiens
ccctgctggacc

SEQ ID NO: 640683 - DNA, 13 bp, Homo sapiens
ccctgctggacca

SEQ ID NO: 640684 - DNA, 23 bp, Homo sapiens
ccctgcttagtgtcccttacctg

SEQ ID NO: 640685 - DNA, 23 bp, Homo sapiens
ccctggaagttgtcctttctgat

SEQ ID NO: 640686 - DNA, 15 bp, Homo sapiens
ccctggagccagggc

SEQ ID NO: 640687 - DNA, 22 bp, Homo sapiens
ccctggagccagggcagaggaa

SEQ ID NO: 640688 - DNA, 12 bp, Homo sapiens
ccctggagctgt

SEQ ID NO: 640689 - DNA, 15 bp, Homo sapiens
ccctggagctgtcct

SEQ ID NO: 640690 - DNA, 18 bp, Homo sapiens
ccctggagctgtccttca

SEQ ID NO: 640691 - DNA, 20 bp, Homo sapiens
ccctggagctgtccttcatt

SEQ ID NO: 640692 - DNA, 17 bp, Homo sapiens
ccctggccacctgccag

SEQ ID NO: 640693 - DNA, 15 bp, Homo sapiens
ccctggccctgcctc

SEQ ID NO: 640694 - DNA, 17 bp, Homo sapiens
ccctggccctgcctcac

SEQ ID NO: 640695 - DNA, 13 bp, Homo sapiens
ccctgggcctccc

SEQ ID NO: 640696 - DNA, 14 bp, Homo sapiens
ccctgggcctcccg

SEQ ID NO: 640697 - DNA, 17 bp, Homo sapiens
ccctgggcctcccgtcc

SEQ ID NO: 640698 - DNA, 18 bp, Homo sapiens
ccctggggaggacccctg

SEQ ID NO: 640699 - DNA, 20 bp, Homo sapiens
ccctggggaggacccctgcc

SEQ ID NO: 640700 - DNA, 16 bp, Homo sapiens
ccctggggcatccacc

SEQ ID NO: 640701 - DNA, 20 bp, Homo sapiens
ccctggggcatccaccttcc

SEQ ID NO: 640702 - DNA, 13 bp, Homo sapiens
ccctggtcctgca

SEQ ID NO: 640703 - DNA, 21 bp, Homo sapiens
ccctgtagggaaaccttggag

SEQ ID NO: 640704 - DNA, 20 bp, Homo sapiens
ccctgtccatccgtctctgt

SEQ ID NO: 640705 - DNA, 14 bp, Homo sapiens
ccctgtcccctgag

SEQ ID NO: 640706 - DNA, 19 bp, Homo sapiens
ccctgtctgtctgtctctc

SEQ ID NO: 640707 - DNA, 21 bp, Homo sapiens
ccctgtctgtctgtctctctt

SEQ ID NO: 640708 - DNA, 16 bp, Homo sapiens
ccctgtgggagtccac

SEQ ID NO: 640709 - DNA, 20 bp, Homo sapiens
ccctgtgggagtccactttc

SEQ ID NO: 640710 - DNA, 13 bp, Homo sapiens
ccctgtgggctca

SEQ ID NO: 640711 - DNA, 14 bp, Homo sapiens
ccctgtgggctcac

SEQ ID NO: 640712 - DNA, 15 bp, Homo sapiens
ccctgtgggctcaca

SEQ ID NO: 640713 - DNA, 14 bp, Homo sapiens
ccctgttccgcctc

SEQ ID NO: 640714 - DNA, 20 bp, Homo sapiens
ccctgttccgcctcactggg

SEQ ID NO: 640715 - DNA, 17 bp, Homo sapiens
ccctgttgacctaccct

SEQ ID NO: 640716 - DNA, 14 bp, Homo sapiens
cccttcatcccagg

SEQ ID NO: 640717 - DNA, 17 bp, Homo sapiens
cccttcccctgcgccct

SEQ ID NO: 640718 - DNA, 21 bp, Homo sapiens
cccttcccctgcgccctccct

SEQ ID NO: 640719 - DNA, 16 bp, Homo sapiens
cccttcctgtcctgct

SEQ ID NO: 640720 - DNA, 17 bp, Homo sapiens
cccttctttccttcctt

SEQ ID NO: 640721 - DNA, 14 bp, Homo sapiens
cccttgaccccaca

SEQ ID NO: 640722 - DNA, 19 bp, Homo sapiens
cccttgcagttatgttatc

SEQ ID NO: 640723 - DNA, 13 bp, Homo sapiens
cccttggcccctc

SEQ ID NO: 640724 - DNA, 17 bp, Homo sapiens
caggagcgtgtcctatc

SEQ ID NO: 640725 - DNA, 21 bp, Homo sapiens
caggagctagcccagtccctg

SEQ ID NO: 640726 - DNA, 23 bp, Homo sapiens
caggagctagcccagtccctgga

SEQ ID NO: 640727 - DNA, 23 bp, Homo sapiens
caggatacgatgactgacactca

SEQ ID NO: 640728 - DNA, 17 bp, Homo sapiens
caggatgaaggggccag

SEQ ID NO: 640729 - DNA, 22 bp, Homo sapiens
caggatgaaggggccagaccac

SEQ ID NO: 640730 - DNA, 17 bp, Homo sapiens
caggatgcatattaaag

SEQ ID NO: 640731 - DNA, 17 bp, Homo sapiens
caggatgcatgcagggc

SEQ ID NO: 640732 - DNA, 14 bp, Homo sapiens
caggcaccatgctg

SEQ ID NO: 640733 - DNA, 16 bp, Homo sapiens
caggcacggaggctcg

SEQ ID NO: 640734 - DNA, 19 bp, Homo sapiens
caggcagcctgtgggtcct

SEQ ID NO: 640735 - DNA, 20 bp, Homo sapiens
caggcagcctgtgggtcctt

SEQ ID NO: 640736 - DNA, 20 bp, Homo sapiens
caggcagctaggcagggagg

SEQ ID NO: 640737 - DNA, 16 bp, Homo sapiens
caggcaggtgggggct

SEQ ID NO: 640738 - DNA, 17 bp, Homo sapiens
caggcagttaggtgctg

SEQ ID NO: 640739 - DNA, 14 bp, Homo sapiens
caggccattcagtc

SEQ ID NO: 640740 - DNA, 16 bp, Homo sapiens
caggcccgtgggcgca

SEQ ID NO: 640741 - DNA, 13 bp, Homo sapiens
caggcctccctcg

SEQ ID NO: 640742 - DNA, 13 bp, Homo sapiens
caggcgccgcctc

SEQ ID NO: 640743 - DNA, 16 bp, Homo sapiens
caggcgccgcctcgcc

SEQ ID NO: 640744 - DNA, 18 bp, Homo sapiens
caggcgccgcctcgcccc

SEQ ID NO: 640745 - DNA, 13 bp, Homo sapiens
caggcgcgcaccg

SEQ ID NO: 640746 - DNA, 16 bp, Homo sapiens
caggcgcgcaccgccc

SEQ ID NO: 640747 - DNA, 23 bp, Homo sapiens
caggcggaggggcttggagcaga

SEQ ID NO: 640748 - DNA, 16 bp, Homo sapiens
caggctagactaggag

SEQ ID NO: 640749 - DNA, 23 bp, Homo sapiens
caggctgagacacagcccagaga

SEQ ID NO: 640750 - DNA, 19 bp, Homo sapiens
caggctgcctcatgaccct

SEQ ID NO: 640751 - DNA, 13 bp, Homo sapiens
caggctgcgcctg

SEQ ID NO: 640752 - DNA, 18 bp, Homo sapiens
cagggaagggtgcctggc

SEQ ID NO: 640753 - DNA, 22 bp, Homo sapiens
cagggaagggtgcctggctggg

SEQ ID NO: 640754 - DNA, 19 bp, Homo sapiens
cagggacagcctgcacagt

SEQ ID NO: 640755 - DNA, 20 bp, Homo sapiens
cagggacagcctgcacagtg

SEQ ID NO: 640756 - DNA, 14 bp, Homo sapiens
cagggaccaaggag

SEQ ID NO: 640757 - DNA, 16 bp, Homo sapiens
cagggaggtggcaggg

SEQ ID NO: 640758 - DNA, 17 bp, Homo sapiens
cagggaggtggcaggga

SEQ ID NO: 640759 - DNA, 18 bp, Homo sapiens
cagggatggagatgggaa

SEQ ID NO: 640760 - DNA, 12 bp, Homo sapiens
cagggcagagga

SEQ ID NO: 640761 - DNA, 17 bp, Homo sapiens
cagggcccaaataacag

SEQ ID NO: 640762 - DNA, 18 bp, Homo sapiens
cagggcccaaataacagt

SEQ ID NO: 640763 - DNA, 15 bp, Homo sapiens
cagggcccagggagg

SEQ ID NO: 640764 - DNA, 19 bp, Homo sapiens
cagggcccagggaggtggc

SEQ ID NO: 640765 - DNA, 22 bp, Homo sapiens
cagggcccagggaggtggcagg

SEQ ID NO: 640766 - DNA, 18 bp, Homo sapiens
cagggcccccacaggagc

SEQ ID NO: 640767 - DNA, 17 bp, Homo sapiens
cagggcccccatgcagg

SEQ ID NO: 640768 - DNA, 12 bp, Homo sapiens
cagggcccgagc

SEQ ID NO: 640769 - DNA, 19 bp, Homo sapiens
cagggcccgagcgcgtgcc

SEQ ID NO: 640770 - DNA, 24 bp, Homo sapiens
cagggccctggggtctctgagcag

SEQ ID NO: 640771 - DNA, 16 bp, Homo sapiens
cagggccgcagggcgc

SEQ ID NO: 640772 - DNA, 20 bp, Homo sapiens
cagggccgcagggcgctccg

SEQ ID NO: 640773 - DNA, 14 bp, Homo sapiens
cagggcgctccggc

SEQ ID NO: 640774 - DNA, 23 bp, Homo sapiens
cagggcgctccggcagaggcagg

SEQ ID NO: 640775 - DNA, 16 bp, Homo sapiens
caggggacgtggcgct

SEQ ID NO: 640776 - DNA, 12 bp, Homo sapiens
caggggaggctg

SEQ ID NO: 640777 - DNA, 14 bp, Homo sapiens
caggggaggctgag

SEQ ID NO: 640778 - DNA, 19 bp, Homo sapiens
caggggaggctgagacgca

SEQ ID NO: 640779 - DNA, 15 bp, Homo sapiens
caggggcaggcagct

SEQ ID NO: 640780 - DNA, 19 bp, Homo sapiens
caggggcaggcagctaggc

SEQ ID NO: 640781 - DNA, 18 bp, Homo sapiens
caggggcttctccccctc

SEQ ID NO: 640782 - DNA, 23 bp, Homo sapiens
caggggcttctccccctcagctc

SEQ ID NO: 640783 - DNA, 13 bp, Homo sapiens
caggggggttggg

SEQ ID NO: 640784 - DNA, 21 bp, Homo sapiens
caggggggttgggttccagac

SEQ ID NO: 640785 - DNA, 22 bp, Homo sapiens
caggggggttgggttccagaca

SEQ ID NO: 640786 - DNA, 16 bp, Homo sapiens
cagggtccagccctcc

SEQ ID NO: 640787 - DNA, 12 bp, Homo sapiens
cagggtcctgag

SEQ ID NO: 640788 - DNA, 19 bp, Homo sapiens
cagggtcctgggggctgct

SEQ ID NO: 640789 - DNA, 21 bp, Homo sapiens
cagggtcctgggggctgctgc

SEQ ID NO: 640790 - DNA, 19 bp, Homo sapiens
cagggtgcaggcgcgcacc

SEQ ID NO: 640791 - DNA, 17 bp, Homo sapiens
cagggtgggaagagaag

SEQ ID NO: 640792 - DNA, 13 bp, Homo sapiens
cagggtggggctt

SEQ ID NO: 640793 - DNA, 22 bp, Homo sapiens
cagggttaaagaaaggcagaga

SEQ ID NO: 640794 - DNA, 15 bp, Homo sapiens
cagggttccagacag

SEQ ID NO: 640795 - DNA, 21 bp, Homo sapiens
cagggttctagaaggggcgag

SEQ ID NO: 640796 - DNA, 23 bp, Homo sapiens
caggtaaactgatgctttcagat

SEQ ID NO: 640797 - DNA, 21 bp, Homo sapiens
caggtatctgatgatgttctg

SEQ ID NO: 640798 - DNA, 13 bp, Homo sapiens
caggtattgtctt

SEQ ID NO: 640799 - DNA, 13 bp, Homo sapiens
caggtcacaggca

SEQ ID NO: 640800 - DNA, 12 bp, Homo sapiens
caggtctggcgc

SEQ ID NO: 640801 - DNA, 14 bp, Homo sapiens
caggtctggcgcca

SEQ ID NO: 640802 - DNA, 21 bp, Homo sapiens
caggtctggcgccaggggcag

SEQ ID NO: 640803 - DNA, 15 bp, Homo sapiens
caggtggcatttgca

SEQ ID NO: 640804 - DNA, 19 bp, Homo sapiens
caggtggcatttgcaggtg

SEQ ID NO: 640805 - DNA, 14 bp, Homo sapiens
caggttttatgaga

SEQ ID NO: 640806 - DNA, 20 bp, Homo sapiens
cagtaaatatacactttaca

SEQ ID NO: 640807 - DNA, 14 bp, Homo sapiens
cagtaaatgtatat

SEQ ID NO: 640808 - DNA, 22 bp, Homo sapiens
cagtacaataaataaaagaaag

SEQ ID NO: 640809 - DNA, 13 bp, Homo sapiens
cagtacaattctt

SEQ ID NO: 640810 - DNA, 15 bp, Homo sapiens
cagtaccatcccact

SEQ ID NO: 640811 - DNA, 15 bp, Homo sapiens
cagtactttctttct

SEQ ID NO: 640812 - DNA, 15 bp, Homo sapiens
cagtagatcattttt

SEQ ID NO: 640813 - DNA, 20 bp, Homo sapiens
cagtagatcattttttgtct

SEQ ID NO: 640814 - DNA, 21 bp, Homo sapiens
cagtagatcattttttgtcta

SEQ ID NO: 640815 - DNA, 17 bp, Homo sapiens
cagtagtgcctgtgatc

SEQ ID NO: 640816 - DNA, 14 bp, Homo sapiens
cagtatagataaat

SEQ ID NO: 640817 - DNA, 24 bp, Homo sapiens
cagtatccgcgagcctgcttgctg

SEQ ID NO: 640818 - DNA, 20 bp, Homo sapiens
cagtatgctttccctgagga

SEQ ID NO: 640819 - DNA, 23 bp, Homo sapiens
cagtatgctttccctgaggaatg

SEQ ID NO: 640820 - DNA, 20 bp, Homo sapiens
cagtattgttttggtttgct

SEQ ID NO: 640821 - DNA, 16 bp, Homo sapiens
cagtcacgtgaggccc

SEQ ID NO: 640822 - DNA, 13 bp, Homo sapiens
cagtcagcacaga

SEQ ID NO: 640823 - DNA, 15 bp, Homo sapiens
cagtcagcacagaga

SEQ ID NO: 640824 - DNA, 20 bp, Homo sapiens
cagtcatggctgtcccctgc

SEQ ID NO: 640825 - DNA, 21 bp, Homo sapiens
cagtccacccccattgtgaat

SEQ ID NO: 640826 - DNA, 12 bp, Homo sapiens
cagtccctggag

SEQ ID NO: 640827 - DNA, 15 bp, Homo sapiens
cagtccctggagctg

SEQ ID NO: 640828 - DNA, 23 bp, Homo sapiens
cagtccgccccgtgctcctctgc

SEQ ID NO: 640829 - DNA, 17 bp, Homo sapiens
cagtcctcacagcctct

SEQ ID NO: 640830 - DNA, 18 bp, Homo sapiens
cagtctaatttttattca

SEQ ID NO: 640831 - DNA, 15 bp, Homo sapiens
cagtctatgctgtgt

SEQ ID NO: 640832 - DNA, 18 bp, Homo sapiens
cagtctatgctgtgtgca

SEQ ID NO: 640833 - DNA, 13 bp, Homo sapiens
cagtctctatttg

SEQ ID NO: 640834 - DNA, 18 bp, Homo sapiens
cagtcttgagtgggcccc

SEQ ID NO: 640835 - DNA, 16 bp, Homo sapiens
cagtgaagcccaggag

SEQ ID NO: 640836 - DNA, 22 bp, Homo sapiens
cagtgaagcccaggaggacctg

SEQ ID NO: 640837 - DNA, 23 bp, Homo sapiens
cagtgaataaatattttaggaaa

SEQ ID NO: 640838 - DNA, 18 bp, Homo sapiens
cagtgaatgctagacaga

SEQ ID NO: 640839 - DNA, 21 bp, Homo sapiens
cagtgcagggacagcctgcac

SEQ ID NO: 640840 - DNA, 13 bp, Homo sapiens
cagtgcctgctgt

SEQ ID NO: 640841 - DNA, 15 bp, Homo sapiens
cagtgcctgctgttc

SEQ ID NO: 640842 - DNA, 19 bp, Homo sapiens
cagcaaccagagcactgta

SEQ ID NO: 640843 - DNA, 15 bp, Homo sapiens
cagcacagtcttttc

SEQ ID NO: 640844 - DNA, 17 bp, Homo sapiens
cagcacatttgttaatg

SEQ ID NO: 640845 - DNA, 14 bp, Homo sapiens
cagcaccagcctga

SEQ ID NO: 640846 - DNA, 17 bp, Homo sapiens
cagcaccagcctgagcc

SEQ ID NO: 640847 - DNA, 21 bp, Homo sapiens
cagcaccgtggtgtgaggccc

SEQ ID NO: 640848 - DNA, 17 bp, Homo sapiens
cagcacctccgggactg

SEQ ID NO: 640849 - DNA, 14 bp, Homo sapiens
cagcactcccaggg

SEQ ID NO: 640850 - DNA, 15 bp, Homo sapiens
cagcactcccagggc

SEQ ID NO: 640851 - DNA, 13 bp, Homo sapiens
cagcagattttag

SEQ ID NO: 640852 - DNA, 19 bp, Homo sapiens
cagcagcagtttgtgatct

SEQ ID NO: 640853 - DNA, 17 bp, Homo sapiens
cagcagccccctgcccg

SEQ ID NO: 640854 - DNA, 17 bp, Homo sapiens
cagcagcgcccgaggcc

SEQ ID NO: 640855 - DNA, 18 bp, Homo sapiens
cagcagctagaaagagaa

SEQ ID NO: 640856 - DNA, 22 bp, Homo sapiens
cagcaggaggacagagtgccct

SEQ ID NO: 640857 - DNA, 19 bp, Homo sapiens
cagcaggggggttgggttc

SEQ ID NO: 640858 - DNA, 22 bp, Homo sapiens
cagcaggtagtgggtgaatgtg

SEQ ID NO: 640859 - DNA, 16 bp, Homo sapiens
cagcagtaccatccca

SEQ ID NO: 640860 - DNA, 20 bp, Homo sapiens
cagcagtaccatcccactga

SEQ ID NO: 640861 - DNA, 20 bp, Homo sapiens
cagcagtttgtgatctgtcc

SEQ ID NO: 640862 - DNA, 21 bp, Homo sapiens
cagcagttttcttttaatttt

SEQ ID NO: 640863 - DNA, 17 bp, Homo sapiens
cagcatagttctgcaat

SEQ ID NO: 640864 - DNA, 19 bp, Homo sapiens
cagcatagttctgcaataa

SEQ ID NO: 640865 - DNA, 11 bp, Homo sapiens
cagcatatata

SEQ ID NO: 640866 - DNA, 13 bp, Homo sapiens
cagcatatatata

SEQ ID NO: 640867 - DNA, 19 bp, Homo sapiens
cagcatcgtgtgggtccct

SEQ ID NO: 640868 - DNA, 12 bp, Homo sapiens
cagcatgcattt

SEQ ID NO: 640869 - DNA, 19 bp, Homo sapiens
cagcatgcatttagcatga

SEQ ID NO: 640870 - DNA, 18 bp, Homo sapiens
cagcatgcgatgtcatat

SEQ ID NO: 640871 - DNA, 22 bp, Homo sapiens
cagcattcccaattatcaaaaa

SEQ ID NO: 640872 - DNA, 20 bp, Homo sapiens
cagccaatttcaaagaaaac

SEQ ID NO: 640873 - DNA, 16 bp, Homo sapiens
cagccagtggcacagg

SEQ ID NO: 640874 - DNA, 20 bp, Homo sapiens
cagccatgcccacgcccctc

SEQ ID NO: 640875 - DNA, 20 bp, Homo sapiens
cagcccagtggaggaggggg

SEQ ID NO: 640876 - DNA, 15 bp, Homo sapiens
cagcccatcccctgc

SEQ ID NO: 640877 - DNA, 15 bp, Homo sapiens
cagcccatgctggct

SEQ ID NO: 640878 - DNA, 17 bp, Homo sapiens
cagcccatgctggctgg

SEQ ID NO: 640879 - DNA, 22 bp, Homo sapiens
cagcccatgctggctggggccg

SEQ ID NO: 640880 - DNA, 15 bp, Homo sapiens
cagcccccacccccg

SEQ ID NO: 640881 - DNA, 13 bp, Homo sapiens
cagcccccacgcc

SEQ ID NO: 640882 - DNA, 14 bp, Homo sapiens
cagccccctgtggc

SEQ ID NO: 640883 - DNA, 17 bp, Homo sapiens
cagccccgcgaccaccc

SEQ ID NO: 640884 - DNA, 20 bp, Homo sapiens
cagccccgcgaccacccctg

SEQ ID NO: 640885 - DNA, 22 bp, Homo sapiens
cagccccgcgaccacccctgtg

SEQ ID NO: 640886 - DNA, 13 bp, Homo sapiens
cagcccctcccca

SEQ ID NO: 640887 - DNA, 15 bp, Homo sapiens
cagccctcacctctg

SEQ ID NO: 640888 - DNA, 16 bp, Homo sapiens
cagccctcacctctga

SEQ ID NO: 640889 - DNA, 18 bp, Homo sapiens
cagccctccgccagccct

SEQ ID NO: 640890 - DNA, 19 bp, Homo sapiens
cagccctccgccagccctg

SEQ ID NO: 640891 - DNA, 20 bp, Homo sapiens
cagccctccgccagccctgt

SEQ ID NO: 640892 - DNA, 12 bp, Homo sapiens
cagccctgcacg

SEQ ID NO: 640893 - DNA, 20 bp, Homo sapiens
cagccctgggcaaggaagct

SEQ ID NO: 640894 - DNA, 22 bp, Homo sapiens
cagccctgttccgcctcactgg

SEQ ID NO: 640895 - DNA, 19 bp, Homo sapiens
cagccgcgctctgcccctc

SEQ ID NO: 640896 - DNA, 22 bp, Homo sapiens
cagccgcgctctgcccctccgt

SEQ ID NO: 640897 - DNA, 17 bp, Homo sapiens
cagcctcccccaggctg

SEQ ID NO: 640898 - DNA, 21 bp, Homo sapiens
cagcctcccccaggctgcgcc

SEQ ID NO: 640899 - DNA, 17 bp, Homo sapiens
cagcctcttgctcagag

SEQ ID NO: 640900 - DNA, 18 bp, Homo sapiens
cagcctgaaagatacagg

SEQ ID NO: 640901 - DNA, 12 bp, Homo sapiens
cagcctgagcca

SEQ ID NO: 640902 - DNA, 14 bp, Homo sapiens
cagcctgagccaca

SEQ ID NO: 640903 - DNA, 21 bp, Homo sapiens
cagcctgagctccaccctccc

SEQ ID NO: 640904 - DNA, 23 bp, Homo sapiens
cagcctgcacagtggtccagggt

SEQ ID NO: 640905 - DNA, 12 bp, Homo sapiens
cagcctgccagg

SEQ ID NO: 640906 - DNA, 19 bp, Homo sapiens
cagcctgccaggccctcca

SEQ ID NO: 640907 - DNA, 14 bp, Homo sapiens
attttttgtgaatg

SEQ ID NO: 640908 - DNA, 13 bp, Homo sapiens
attttttgtttct

SEQ ID NO: 640909 - DNA, 15 bp, Homo sapiens
atttttttactgttt

SEQ ID NO: 640910 - DNA, 17 bp, Homo sapiens
atttttttttccttcag

SEQ ID NO: 640911 - DNA, 18 bp, Homo sapiens
caaaaaccattacaaaat

SEQ ID NO: 640912 - DNA, 10 bp, Homo sapiens
caaaacaaca

SEQ ID NO: 640913 - DNA, 15 bp, Homo sapiens
caaaagatctcctgt

SEQ ID NO: 640914 - DNA, 18 bp, Homo sapiens
caaaagctagaggagatt

SEQ ID NO: 640915 - DNA, 19 bp, Homo sapiens
caaaagtgcagtagtgtca

SEQ ID NO: 640916 - DNA, 20 bp, Homo sapiens
caaaataaaaccagaaagag

SEQ ID NO: 640917 - DNA, 15 bp, Homo sapiens
caaaatagtcatgtt

SEQ ID NO: 640918 - DNA, 13 bp, Homo sapiens
caaaatataaatc

SEQ ID NO: 640919 - DNA, 21 bp, Homo sapiens
caaaatataaatcacagattt

SEQ ID NO: 640920 - DNA, 19 bp, Homo sapiens
caaaatgtgtgcttggaaa

SEQ ID NO: 640921 - DNA, 16 bp, Homo sapiens
caaaattacagttcac

SEQ ID NO: 640922 - DNA, 18 bp, Homo sapiens
caaaattacagttcacac

SEQ ID NO: 640923 - DNA, 21 bp, Homo sapiens
caaaatttatgtcattttcag

SEQ ID NO: 640924 - DNA, 13 bp, Homo sapiens
caaacaaatcatt

SEQ ID NO: 640925 - DNA, 20 bp, Homo sapiens
caaacaagatacgtatattt

SEQ ID NO: 640926 - DNA, 18 bp, Homo sapiens
caaacacacagactctgt

SEQ ID NO: 640927 - DNA, 15 bp, Homo sapiens
caaacaggaaaatga

SEQ ID NO: 640928 - DNA, 13 bp, Homo sapiens
caaacaggtgcta

SEQ ID NO: 640929 - DNA, 16 bp, Homo sapiens
caaacaggtgctaaca

SEQ ID NO: 640930 - DNA, 20 bp, Homo sapiens
atgagattccctctcctccc

SEQ ID NO: 640931 - DNA, 17 bp, Homo sapiens
atgagcatgctccctca

SEQ ID NO: 640932 - DNA, 22 bp, Homo sapiens
atgaggaaacttggacatttat

SEQ ID NO: 640933 - DNA, 15 bp, Homo sapiens
atgaggatgtatgtg

SEQ ID NO: 640934 - DNA, 20 bp, Homo sapiens
atgaggcacgcctgccttct

SEQ ID NO: 640935 - DNA, 14 bp, Homo sapiens
atgaggcctttccc

SEQ ID NO: 640936 - DNA, 19 bp, Homo sapiens
atgaggctggataggagag

SEQ ID NO: 640937 - DNA, 15 bp, Homo sapiens
atgagtcacttactt

SEQ ID NO: 640938 - DNA, 15 bp, Homo sapiens
atgatactgaattgt

SEQ ID NO: 640939 - DNA, 16 bp, Homo sapiens
atgatatgtctttaaa

SEQ ID NO: 640940 - DNA, 15 bp, Homo sapiens
atgatcaaggaggga

SEQ ID NO: 640941 - DNA, 18 bp, Homo sapiens
atgatcaaggagggagaa

SEQ ID NO: 640942 - DNA, 23 bp, Homo sapiens
atgatcaaggagggagaaaggca

SEQ ID NO: 640943 - DNA, 20 bp, Homo sapiens
atgatccctgaacatagttt

SEQ ID NO: 640944 - DNA, 14 bp, Homo sapiens
atgatgatttcaga

SEQ ID NO: 640945 - DNA, 17 bp, Homo sapiens
atgattagacaatgtgg

SEQ ID NO: 640946 - DNA, 13 bp, Homo sapiens
atgattcaatgtg

SEQ ID NO: 640947 - DNA, 16 bp, Homo sapiens
atgattcaatgtgaat

SEQ ID NO: 640948 - DNA, 18 bp, Homo sapiens
atgattcacttttattgt

SEQ ID NO: 640949 - DNA, 16 bp, Homo sapiens
atgattctcctctccc

SEQ ID NO: 640950 - DNA, 17 bp, Homo sapiens
atgattctcctctccca

SEQ ID NO: 640951 - DNA, 14 bp, Homo sapiens
atgattgagagcag

SEQ ID NO: 640952 - DNA, 21 bp, Homo sapiens
atgattgagagcagcctcttg

SEQ ID NO: 640953 - DNA, 15 bp, Homo sapiens
atgatttcagaaaca

SEQ ID NO: 640954 - DNA, 19 bp, Homo sapiens
atgatttcatgattagaca

SEQ ID NO: 640955 - DNA, 16 bp, Homo sapiens
atgcaaatattgctat

SEQ ID NO: 640956 - DNA, 17 bp, Homo sapiens
atgcaatttacttggaa

SEQ ID NO: 640957 - DNA, 19 bp, Homo sapiens
atgcaatttacttggaatt

SEQ ID NO: 640958 - DNA, 21 bp, Homo sapiens
atgcaatttgataatcagttt

SEQ ID NO: 640959 - DNA, 17 bp, Homo sapiens
atgcacaccaaattgct

SEQ ID NO: 640960 - DNA, 19 bp, Homo sapiens
atgcacaccaaattgctga

SEQ ID NO: 640961 - DNA, 18 bp, Homo sapiens
atgcaccagtgccgcctg

SEQ ID NO: 640962 - DNA, 16 bp, Homo sapiens
atgcatatatatgtat

SEQ ID NO: 640963 - DNA, 15 bp, Homo sapiens
atgcatgagaactaa

SEQ ID NO: 640964 - DNA, 18 bp, Homo sapiens
atgcatgagaactaaata

SEQ ID NO: 640965 - DNA, 13 bp, Homo sapiens
atgcattcagatc

SEQ ID NO: 640966 - DNA, 13 bp, Homo sapiens
atgcatttagcat

SEQ ID NO: 640967 - DNA, 15 bp, Homo sapiens
atgcatttatgcatg

SEQ ID NO: 640968 - DNA, 19 bp, Homo sapiens
atgcatttatgcatgagaa

SEQ ID NO: 640969 - DNA, 20 bp, Homo sapiens
atgccagtccagatgtgcct

SEQ ID NO: 640970 - DNA, 22 bp, Homo sapiens
atgccatctccaccctgagcct

SEQ ID NO: 640971 - DNA, 20 bp, Homo sapiens
atgccatgtatgttgcatga

SEQ ID NO: 640972 - DNA, 23 bp, Homo sapiens
atgcccctgcagtttggccctgg

SEQ ID NO: 640973 - DNA, 14 bp, Homo sapiens
atgcccctggccct

SEQ ID NO: 640974 - DNA, 16 bp, Homo sapiens
atgcctcattttattc

SEQ ID NO: 640975 - DNA, 15 bp, Homo sapiens
atgcctgcctgaaca

SEQ ID NO: 640976 - DNA, 23 bp, Homo sapiens
atgcctgtactcgcttgtgcaga

SEQ ID NO: 640977 - DNA, 16 bp, Homo sapiens
atgctacaaaatgtgt

SEQ ID NO: 640978 - DNA, 15 bp, Homo sapiens
atgctagttcttacg

SEQ ID NO: 640979 - DNA, 20 bp, Homo sapiens
atgctcaatgtgctgttgat

SEQ ID NO: 640980 - DNA, 14 bp, Homo sapiens
atgctcagtattga

SEQ ID NO: 640981 - DNA, 18 bp, Homo sapiens
atgctcagtattgagaca

SEQ ID NO: 640982 - DNA, 22 bp, Homo sapiens
atgctgctgagcacatctcttc

SEQ ID NO: 640983 - DNA, 14 bp, Homo sapiens
atgctggctggggc

SEQ ID NO: 640984 - DNA, 11 bp, Homo sapiens
atgctgggctc

SEQ ID NO: 640985 - DNA, 13 bp, Homo sapiens
atgctgggctcac

SEQ ID NO: 640986 - DNA, 23 bp, Homo sapiens
atgctgtccctgtgggctcacac

SEQ ID NO: 640987 - DNA, 21 bp, Homo sapiens
atgctgtctctaattgattca

SEQ ID NO: 640988 - DNA, 14 bp, Homo sapiens
atgctgtgtgcaga

SEQ ID NO: 640989 - DNA, 22 bp, Homo sapiens
atgcttaacataaacttgtact

SEQ ID NO: 640990 - DNA, 15 bp, Homo sapiens
atgcttacagtgact

SEQ ID NO: 640991 - DNA, 16 bp, Homo sapiens
atgctttccctgagga

SEQ ID NO: 640992 - DNA, 17 bp, Homo sapiens
atgctttccctgaggaa

SEQ ID NO: 640993 - DNA, 14 bp, Homo sapiens
atgctttctcatgc

SEQ ID NO: 640994 - DNA, 15 bp, Homo sapiens
atgctttctcctttt

SEQ ID NO: 640995 - DNA, 16 bp, Homo sapiens
atgctttctccttttt

SEQ ID NO: 640996 - DNA, 15 bp, Homo sapiens
atgctttgaaaatgt

SEQ ID NO: 640997 - DNA, 20 bp, Homo sapiens
atggaaagggtgtggcttgg

SEQ ID NO: 640998 - DNA, 15 bp, Homo sapiens
atggaacactctgag

SEQ ID NO: 640999 - DNA, 17 bp, Homo sapiens
atggaacactctgagac

SEQ ID NO: 641000 - DNA, 14 bp, Homo sapiens
atggaacagccctg

SEQ ID NO: 641001 - DNA, 18 bp, Homo sapiens
atggaagacaaatacaca

SEQ ID NO: 641002 - DNA, 22 bp, Homo sapiens
atggaagacaaatacacataca

SEQ ID NO: 641003 - DNA, 19 bp, Homo sapiens
atggaagggccttctccac

SEQ ID NO: 641004 - DNA, 16 bp, Homo sapiens
atggaatcacagccaa

SEQ ID NO: 641005 - DNA, 18 bp, Homo sapiens
atggacaatttaccacag

SEQ ID NO: 641006 - DNA, 24 bp, Homo sapiens
atggaggtttcatactctagattt

SEQ ID NO: 641007 - DNA, 20 bp, Homo sapiens
atggagtagagtcaggagaa

SEQ ID NO: 641008 - DNA, 15 bp, Homo sapiens
atggatatgaaagag

SEQ ID NO: 641009 - DNA, 20 bp, Homo sapiens
atggcaacgttcatgttcat

SEQ ID NO: 641010 - DNA, 17 bp, Homo sapiens
atggcaagtttttggta

SEQ ID NO: 641011 - DNA, 22 bp, Homo sapiens
atggcagcatgcgatgtcatat

SEQ ID NO: 641012 - DNA, 17 bp, Homo sapiens
atggccaagtgtacatt

SEQ ID NO: 641013 - DNA, 13 bp, Homo sapiens
atggccaggcctc

SEQ ID NO: 641014 - DNA, 12 bp, Homo sapiens
atggccccagct

SEQ ID NO: 641015 - DNA, 15 bp, Homo sapiens
atggccccagctggc

SEQ ID NO: 641016 - DNA, 16 bp, Homo sapiens
atggccccagctggct

SEQ ID NO: 641017 - DNA, 23 bp, Homo sapiens
atggctgaagaaacacagcatgc

SEQ ID NO: 641018 - DNA, 19 bp, Homo sapiens
atggctgttatctgtcttt

SEQ ID NO: 641019 - DNA, 21 bp, Homo sapiens
atggcttccccattgccttct

SEQ ID NO: 641020 - DNA, 19 bp, Homo sapiens
atggcttgtagggtgaggc

SEQ ID NO: 641021 - DNA, 21 bp, Homo sapiens
atggggggcgggccagggtgg

SEQ ID NO: 641022 - DNA, 22 bp, Homo sapiens
atggggggcgggccagggtggg

SEQ ID NO: 641023 - DNA, 18 bp, Homo sapiens
atgggtatcatgcttcta

SEQ ID NO: 641024 - DNA, 15 bp, Homo sapiens
atggtagactgtgac

SEQ ID NO: 641025 - DNA, 16 bp, Homo sapiens
atggtagactgtgaca

SEQ ID NO: 641026 - DNA, 20 bp, Homo sapiens
atggtgaactgaagcagagt

SEQ ID NO: 641027 - DNA, 12 bp, Homo sapiens
atggtgcaatga

SEQ ID NO: 641028 - DNA, 13 bp, Homo sapiens
atggtgcaatgac

SEQ ID NO: 641029 - DNA, 11 bp, Homo sapiens
atggtgcagtg

SEQ ID NO: 641030 - DNA, 13 bp, Homo sapiens
atggtgcagtgaa

SEQ ID NO: 641031 - DNA, 19 bp, Homo sapiens
atggtgctgtgtgtgagcg

SEQ ID NO: 641032 - DNA, 19 bp, Homo sapiens
atggtgggctccagagtag

SEQ ID NO: 641033 - DNA, 18 bp, Homo sapiens
atggtgtcctgcatgtat

SEQ ID NO: 641034 - DNA, 16 bp, Homo sapiens
atggttcgttctgttt

SEQ ID NO: 641035 - DNA, 22 bp, Homo sapiens
atggttgcaaagtgttgtctta

SEQ ID NO: 641036 - DNA, 23 bp, Homo sapiens
atggttgcaaagtgttgtcttat

SEQ ID NO: 641037 - DNA, 15 bp, Homo sapiens
atgtaaatattgctg

SEQ ID NO: 641038 - DNA, 22 bp, Homo sapiens
atgtaaatattgctgtctgaaa

SEQ ID NO: 641039 - DNA, 13 bp, Homo sapiens
atgtaaatgcttg

SEQ ID NO: 641040 - DNA, 12 bp, Homo sapiens
atgtaacttcag

SEQ ID NO: 641041 - DNA, 19 bp, Homo sapiens
atgtacaaaatgaattgcc

SEQ ID NO: 641042 - DNA, 21 bp, Homo sapiens
atgtacaaaatgaattgcctt

SEQ ID NO: 641043 - DNA, 19 bp, Homo sapiens
atgtacaaataatattgcc

SEQ ID NO: 641044 - DNA, 21 bp, Homo sapiens
attatcttaaacccacataaa

SEQ ID NO: 641045 - DNA, 22 bp, Homo sapiens
attatcttaaacccacataaac

SEQ ID NO: 641046 - DNA, 20 bp, Homo sapiens
attatcttggaaaaatgcgt

SEQ ID NO: 641047 - DNA, 16 bp, Homo sapiens
attatgccttgagaat

SEQ ID NO: 641048 - DNA, 15 bp, Homo sapiens
attatgtcaaatgga

SEQ ID NO: 641049 - DNA, 21 bp, Homo sapiens
attatgtcaaatggatgtaat

SEQ ID NO: 641050 - DNA, 21 bp, Homo sapiens
attattacaacaagcaaactg

SEQ ID NO: 641051 - DNA, 13 bp, Homo sapiens
attattttctata

SEQ ID NO: 641052 - DNA, 18 bp, Homo sapiens
attattttctatatttgg

SEQ ID NO: 641053 - DNA, 22 bp, Homo sapiens
attcaaataaccctgaatcaga

SEQ ID NO: 641054 - DNA, 23 bp, Homo sapiens
attcaaataaccctgaatcagag

SEQ ID NO: 641055 - DNA, 12 bp, Homo sapiens
atatatctgaaa

SEQ ID NO: 641056 - DNA, 18 bp, Homo sapiens
atatatctgaaaactgga

SEQ ID NO: 641057 - DNA, 15 bp, Homo sapiens
atatatttattattt

SEQ ID NO: 641058 - DNA, 16 bp, Homo sapiens
ataatgattcaatgtg

SEQ ID NO: 641059 - DNA, 19 bp, Homo sapiens
ataatgattcaatgtgaat

SEQ ID NO: 641060 - DNA, 14 bp, Homo sapiens
ataatgcatctaaa

SEQ ID NO: 641061 - DNA, 14 bp, Homo sapiens
ataatggccctgta

SEQ ID NO: 641062 - DNA, 16 bp, Homo sapiens
ataatggcctcttaaa

SEQ ID NO: 641063 - DNA, 19 bp, Homo sapiens
ataatggcctcttaaaaat

SEQ ID NO: 641064 - DNA, 13 bp, Homo sapiens
ataattaaaacaa

SEQ ID NO: 641065 - DNA, 14 bp, Homo sapiens
ataattaaaacaaa

SEQ ID NO: 641066 - DNA, 15 bp, Homo sapiens
ataattaaagtgtcc

SEQ ID NO: 641067 - DNA, 14 bp, Homo sapiens
ataattaaatgaaa

SEQ ID NO: 641068 - DNA, 21 bp, Homo sapiens
ataattatatgaagcagaatg

SEQ ID NO: 641069 - DNA, 16 bp, Homo sapiens
ataattttcattttta

SEQ ID NO: 641070 - DNA, 12 bp, Homo sapiens
atacaaacaggt

SEQ ID NO: 641071 - DNA, 15 bp, Homo sapiens
atacaaacaggtgct

SEQ ID NO: 641072 - DNA, 14 bp, Homo sapiens
atacaaagctgtca

SEQ ID NO: 641073 - DNA, 19 bp, Homo sapiens
atacaagtgtttctagtaa

SEQ ID NO: 641074 - DNA, 13 bp, Homo sapiens
atacacacaggag

SEQ ID NO: 641075 - DNA, 22 bp, Homo sapiens
atacacataattaaagtgtcca

SEQ ID NO: 641076 - DNA, 14 bp, Homo sapiens
atacacatacatat

SEQ ID NO: 641077 - DNA, 14 bp, Homo sapiens
atacacgtgtatat

SEQ ID NO: 641078 - DNA, 20 bp, Homo sapiens
atacagacctccagattatt

SEQ ID NO: 641079 - DNA, 16 bp, Homo sapiens
atacagtctctatttg

SEQ ID NO: 641080 - DNA, 21 bp, Homo sapiens
atacagtctctatttgatttg

SEQ ID NO: 641081 - DNA, 18 bp, Homo sapiens
atacatacgcaattgtat

SEQ ID NO: 641082 - DNA, 19 bp, Homo sapiens
atacatacgcaattgtata

SEQ ID NO: 641083 - DNA, 21 bp, Homo sapiens
atacatacgcaattgtatata

SEQ ID NO: 641084 - DNA, 20 bp, Homo sapiens
atacatatatacattttgca

SEQ ID NO: 641085 - DNA, 23 bp, Homo sapiens
atacattccagtgtattttctgt

SEQ ID NO: 641086 - DNA, 13 bp, Homo sapiens
ataccagcaaaag

SEQ ID NO: 641087 - DNA, 15 bp, Homo sapiens
ataccagcaaaagtg

SEQ ID NO: 641088 - DNA, 15 bp, Homo sapiens
ataccattttgaaat

SEQ ID NO: 641089 - DNA, 14 bp, Homo sapiens
ataccctctgagac

SEQ ID NO: 641090 - DNA, 20 bp, Homo sapiens
ataccctctgagacagagag

SEQ ID NO: 641091 - DNA, 21 bp, Homo sapiens
atacctgtacacacacagaca

SEQ ID NO: 641092 - DNA, 15 bp, Homo sapiens
atacgcaattgtata

SEQ ID NO: 641093 - DNA, 24 bp, Homo sapiens
atacgtgcccatttcacacaactg

SEQ ID NO: 641094 - DNA, 17 bp, Homo sapiens
atactatttattaaaac

SEQ ID NO: 641095 - DNA, 18 bp, Homo sapiens
atactcatccttgtataa

SEQ ID NO: 641096 - DNA, 22 bp, Homo sapiens
atactcgttattcatacaaata

SEQ ID NO: 641097 - DNA, 22 bp, Homo sapiens
atactctagattttgttttgct

SEQ ID NO: 641098 - DNA, 18 bp, Homo sapiens
atactgaattgttatgta

SEQ ID NO: 641099 - DNA, 19 bp, Homo sapiens
atactgttgcccttttcct

SEQ ID NO: 641100 - DNA, 20 bp, Homo sapiens
atacttatttataacattgt

SEQ ID NO: 641101 - DNA, 23 bp, Homo sapiens
atacttcaaatgtcatttcatac

SEQ ID NO: 641102 - DNA, 16 bp, Homo sapiens
atacttccagcgaaat

SEQ ID NO: 641103 - DNA, 21 bp, Homo sapiens
atacttccagcgaaatggtac

SEQ ID NO: 641104 - DNA, 16 bp, Homo sapiens
atactttgtgtctttt

SEQ ID NO: 641105 - DNA, 20 bp, Homo sapiens
atagaagaaggactgaagaa

SEQ ID NO: 641106 - DNA, 24 bp, Homo sapiens
atagacagaggtttcattttcatc

SEQ ID NO: 641107 - DNA, 23 bp, Homo sapiens
atagagctcttgggtatgtagaa

SEQ ID NO: 641108 - DNA, 16 bp, Homo sapiens
atagatgtgaaaatgc

SEQ ID NO: 641109 - DNA, 15 bp, Homo sapiens
atagcatagccagca

SEQ ID NO: 641110 - DNA, 10 bp, Homo sapiens
atagcatgta

SEQ ID NO: 641111 - DNA, 15 bp, Homo sapiens
atagcatgtattgtg

SEQ ID NO: 641112 - DNA, 15 bp, Homo sapiens
atagccaactgtagc

SEQ ID NO: 641113 - DNA, 20 bp, Homo sapiens
atagccagcattcagcacac

SEQ ID NO: 641114 - DNA, 21 bp, Homo sapiens
atagccagcattcagcacaca

SEQ ID NO: 641115 - DNA, 13 bp, Homo sapiens
atagccccaggcc

SEQ ID NO: 641116 - DNA, 14 bp, Homo sapiens
atagccccaggccc

SEQ ID NO: 641117 - DNA, 17 bp, Homo sapiens
atagctgatagaagaag

SEQ ID NO: 641118 - DNA, 14 bp, Homo sapiens
ataggaaaaactga

SEQ ID NO: 641119 - DNA, 20 bp, Homo sapiens
ataggaaataaatctaaata

SEQ ID NO: 641120 - DNA, 19 bp, Homo sapiens
ataggacttaatttagcag

SEQ ID NO: 641121 - DNA, 15 bp, Homo sapiens
ataggagcttccaga

SEQ ID NO: 641122 - DNA, 19 bp, Homo sapiens
ataggagggtgcccctggg

SEQ ID NO: 641123 - DNA, 17 bp, Homo sapiens
ataggcttgtgtaattt

SEQ ID NO: 641124 - DNA, 23 bp, Homo sapiens
ataggcttgtgtaatttcctgct

SEQ ID NO: 641125 - DNA, 23 bp, Homo sapiens
atagtaaataatgattcaatgtg

SEQ ID NO: 641126 - DNA, 18 bp, Homo sapiens
atagtcaatcaaacaggg

SEQ ID NO: 641127 - DNA, 13 bp, Homo sapiens
atagtctgtactt

SEQ ID NO: 641128 - DNA, 12 bp, Homo sapiens
atagtgaaaatt

SEQ ID NO: 641129 - DNA, 19 bp, Homo sapiens
atagtgaaaattttattga

SEQ ID NO: 641130 - DNA, 14 bp, Homo sapiens
atagtggtatttta

SEQ ID NO: 641131 - DNA, 17 bp, Homo sapiens
atagtggtattttaaca

SEQ ID NO: 641132 - DNA, 13 bp, Homo sapiens
atagtgttgtgtt

SEQ ID NO: 641133 - DNA, 19 bp, Homo sapiens
atagttattcaaatccata

SEQ ID NO: 641134 - DNA, 18 bp, Homo sapiens
atagttccattctatgac

SEQ ID NO: 641135 - DNA, 19 bp, Homo sapiens
atagttctgcaataacagt

SEQ ID NO: 641136 - DNA, 22 bp, Homo sapiens
atagttctgcaataacagtttt

SEQ ID NO: 641137 - DNA, 17 bp, Homo sapiens
atagttgagccagcaga

SEQ ID NO: 641138 - DNA, 21 bp, Homo sapiens
atagttgagccagcagacatt

SEQ ID NO: 641139 - DNA, 22 bp, Homo sapiens
atagttgagccagcagacattg

SEQ ID NO: 641140 - DNA, 23 bp, Homo sapiens
atagttgagccagcagacattgt

SEQ ID NO: 641141 - DNA, 21 bp, Homo sapiens
atagttgtaaagatattgtat

SEQ ID NO: 641142 - DNA, 17 bp, Homo sapiens
atagtttattatagtct

SEQ ID NO: 641143 - DNA, 22 bp, Homo sapiens
atagtttattatagtctgtact

SEQ ID NO: 641144 - DNA, 22 bp, Homo sapiens
atagtttctaaaccatgaaaag

SEQ ID NO: 641145 - DNA, 21 bp, Homo sapiens
atagtttttttcttttttaat

SEQ ID NO: 641146 - DNA, 20 bp, Homo sapiens
atataaaaataattaaaaca

SEQ ID NO: 641147 - DNA, 13 bp, Homo sapiens
atataaaatacac

SEQ ID NO: 641148 - DNA, 14 bp, Homo sapiens
atataaaatacacg

SEQ ID NO: 641149 - DNA, 14 bp, Homo sapiens
atataaactgtgag

SEQ ID NO: 641150 - DNA, 10 bp, Homo sapiens
atataaatca

SEQ ID NO: 641151 - DNA, 17 bp, Homo sapiens
atataaatcacagattt

SEQ ID NO: 641152 - DNA, 13 bp, Homo sapiens
atataaatcttac

SEQ ID NO: 641153 - DNA, 15 bp, Homo sapiens
atataaatgaatgaa

SEQ ID NO: 641154 - DNA, 15 bp, Homo sapiens
atataacatgaaagt

SEQ ID NO: 641155 - DNA, 21 bp, Homo sapiens
atataatttgccagacagaga

SEQ ID NO: 641156 - DNA, 22 bp, Homo sapiens
atataatttgccagacagagat

SEQ ID NO: 641157 - DNA, 23 bp, Homo sapiens
atataatttgccagacagagatc

SEQ ID NO: 641158 - DNA, 14 bp, Homo sapiens
atatactcatttgg

SEQ ID NO: 641159 - DNA, 21 bp, Homo sapiens
atatagagacttctaaatcat

SEQ ID NO: 641160 - DNA, 17 bp, Homo sapiens
atataggggcaaaaatt

SEQ ID NO: 641161 - DNA, 14 bp, Homo sapiens
atatagtgttgtgt

SEQ ID NO: 641162 - DNA, 17 bp, Homo sapiens
atatataaaatacacgt

SEQ ID NO: 641163 - DNA, 21 bp, Homo sapiens
atatataaaatacacgtgtat

SEQ ID NO: 641164 - DNA, 12 bp, Homo sapiens
atatatacatac

SEQ ID NO: 641165 - DNA, 14 bp, Homo sapiens
atatatacatacgc

SEQ ID NO: 641166 - DNA, 15 bp, Homo sapiens
atatatatatatgta

SEQ ID NO: 641167 - DNA, 14 bp, Homo sapiens
atatatatatgtat

SEQ ID NO: 641168 - DNA, 12 bp, Homo sapiens
atatatatgtga

SEQ ID NO: 641169 - DNA, 13 bp, Homo sapiens
atatatatgtgaa

SEQ ID NO: 641170 - DNA, 14 bp, Homo sapiens
atatatatgtgaac

SEQ ID NO: 641171 - DNA, 19 bp, Homo sapiens
aggtttcactgttcatgaa

SEQ ID NO: 641172 - DNA, 13 bp, Homo sapiens
aggtttcagcatt

SEQ ID NO: 641173 - DNA, 21 bp, Homo sapiens
aggtttcattttcatctcatt

SEQ ID NO: 641174 - DNA, 15 bp, Homo sapiens
agtaaatatacactt

SEQ ID NO: 641175 - DNA, 18 bp, Homo sapiens
agtaaatatacactttac

SEQ ID NO: 641176 - DNA, 20 bp, Homo sapiens
agtaaattcctaattctatg

SEQ ID NO: 641177 - DNA, 14 bp, Homo sapiens
agtaacagtatttc

SEQ ID NO: 641178 - DNA, 16 bp, Homo sapiens
agtaacagtatttcca

SEQ ID NO: 641179 - DNA, 12 bp, Homo sapiens
agtaatttcatg

SEQ ID NO: 641180 - DNA, 15 bp, Homo sapiens
agtacaattctttgt

SEQ ID NO: 641181 - DNA, 23 bp, Homo sapiens
agtacaattctttgttgcttaat

SEQ ID NO: 641182 - DNA, 16 bp, Homo sapiens
agtgtcacttttttcc

SEQ ID NO: 641183 - DNA, 19 bp, Homo sapiens
agtgtcacttttttcctgt

SEQ ID NO: 641184 - DNA, 23 bp, Homo sapiens
agtgtcacttttttcctgtcaat

SEQ ID NO: 641185 - DNA, 17 bp, Homo sapiens
agtgtcaggctctgaat

SEQ ID NO: 641186 - DNA, 15 bp, Homo sapiens
agtgtggcttaaaca

SEQ ID NO: 641187 - DNA, 12 bp, Homo sapiens
agtgtgtgtgca

SEQ ID NO: 641188 - DNA, 20 bp, Homo sapiens
agtgttacctaacaatgttt

SEQ ID NO: 641189 - DNA, 16 bp, Homo sapiens
agtgttcagcatagag

SEQ ID NO: 641190 - DNA, 15 bp, Homo sapiens
agtgttctgtttaat

SEQ ID NO: 641191 - DNA, 19 bp, Homo sapiens
agtgttggccatcatttca

SEQ ID NO: 641192 - DNA, 23 bp, Homo sapiens
agtgttgtcttattcctaattcc

SEQ ID NO: 641193 - DNA, 22 bp, Homo sapiens
agtgttgtgttacaataagtgt

SEQ ID NO: 641194 - DNA, 16 bp, Homo sapiens
agtgtttagaagagcc

SEQ ID NO: 641195 - DNA, 20 bp, Homo sapiens
agtgtttagaagagcctgac

SEQ ID NO: 641196 - DNA, 15 bp, Homo sapiens
agtgtttttacatat

SEQ ID NO: 641197 - DNA, 10 bp, Homo sapiens
agttaaaatg

SEQ ID NO: 641198 - DNA, 21 bp, Homo sapiens
agttaaaatgtgtttttcagt

SEQ ID NO: 641199 - DNA, 22 bp, Homo sapiens
agttaagcacaaccatgttctt

SEQ ID NO: 641200 - DNA, 23 bp, Homo sapiens
agttaatctttgaaaactcatac

SEQ ID NO: 641201 - DNA, 20 bp, Homo sapiens
agttaatttgataaagatct

SEQ ID NO: 641202 - DNA, 19 bp, Homo sapiens
agttacagtggcagtattg

SEQ ID NO: 641203 - DNA, 16 bp, Homo sapiens
agttacccctgaaatc

SEQ ID NO: 641204 - DNA, 13 bp, Homo sapiens
agttagcccggcc

SEQ ID NO: 641205 - DNA, 16 bp, Homo sapiens
agttagcccggccaag

SEQ ID NO: 641206 - DNA, 23 bp, Homo sapiens
agttagcccggccaaggacactg

SEQ ID NO: 641207 - DNA, 16 bp, Homo sapiens
agttataccagcaaaa

SEQ ID NO: 641208 - DNA, 21 bp, Homo sapiens
agttatccagagggttgtgat

SEQ ID NO: 641209 - DNA, 18 bp, Homo sapiens
agttatttaccagaagtt

SEQ ID NO: 641210 - DNA, 16 bp, Homo sapiens
agttattttgtgtcct

SEQ ID NO: 641211 - DNA, 14 bp, Homo sapiens
agttcatagaaata

SEQ ID NO: 641212 - DNA, 17 bp, Homo sapiens
agttcatagaaatacat

SEQ ID NO: 641213 - DNA, 19 bp, Homo sapiens
agttcatagaaatacatca

SEQ ID NO: 641214 - DNA, 16 bp, Homo sapiens
agttccctcagccctc

SEQ ID NO: 641215 - DNA, 15 bp, Homo sapiens
agttctcatcttgta

SEQ ID NO: 641216 - DNA, 12 bp, Homo sapiens
agttctgatgag

SEQ ID NO: 641217 - DNA, 16 bp, Homo sapiens
agttctgcaataacag

SEQ ID NO: 641218 - DNA, 12 bp, Homo sapiens
agttctgctgcc

SEQ ID NO: 641219 - DNA, 22 bp, Homo sapiens
agttgaagggaaatcaatttaa

SEQ ID NO: 641220 - DNA, 13 bp, Homo sapiens
agttgcagtaaag

SEQ ID NO: 641221 - DNA, 19 bp, Homo sapiens
agttgtcctttctgatcct

SEQ ID NO: 641222 - DNA, 21 bp, Homo sapiens
agtttaaaaatcagaaagaca

SEQ ID NO: 641223 - DNA, 17 bp, Homo sapiens
agtttaaatctttgtta

SEQ ID NO: 641224 - DNA, 14 bp, Homo sapiens
agtttacattgtcc

SEQ ID NO: 641225 - DNA, 17 bp, Homo sapiens
agtttacattgtcctgt

SEQ ID NO: 641226 - DNA, 20 bp, Homo sapiens
agtttacattgtcctgtagc

SEQ ID NO: 641227 - DNA, 20 bp, Homo sapiens
agtttcatttttcattttct

SEQ ID NO: 641228 - DNA, 23 bp, Homo sapiens
agtttccatttggattttaaaca

SEQ ID NO: 641229 - DNA, 20 bp, Homo sapiens
agtttggaagtacataaagt

SEQ ID NO: 641230 - DNA, 13 bp, Homo sapiens
agtttggccctgg

SEQ ID NO: 641231 - DNA, 14 bp, Homo sapiens
agtttggccctgga

SEQ ID NO: 641232 - DNA, 15 bp, Homo sapiens
agtttggccctggag

SEQ ID NO: 641233 - DNA, 16 bp, Homo sapiens
agtttggccctggagc

SEQ ID NO: 641234 - DNA, 19 bp, Homo sapiens
agtttggccctggagccag

SEQ ID NO: 641235 - DNA, 20 bp, Homo sapiens
agtttggccctggagccagg

SEQ ID NO: 641236 - DNA, 15 bp, Homo sapiens
agtttggtatgaaac

SEQ ID NO: 641237 - DNA, 19 bp, Homo sapiens
agtttggtttttgaataga

SEQ ID NO: 641238 - DNA, 15 bp, Homo sapiens
ataaaaaaaatagtt

SEQ ID NO: 641239 - DNA, 16 bp, Homo sapiens
ataaaaataattaaaa

SEQ ID NO: 641240 - DNA, 18 bp, Homo sapiens
ataaaacattttaaatgg

SEQ ID NO: 641241 - DNA, 19 bp, Homo sapiens
ataaaacattttaaatgga

SEQ ID NO: 641242 - DNA, 12 bp, Homo sapiens
ataaaaccagaa

SEQ ID NO: 641243 - DNA, 20 bp, Homo sapiens
ataaaactccttgaaaccag

SEQ ID NO: 641244 - DNA, 15 bp, Homo sapiens
ataaaatacacgtgt

SEQ ID NO: 641245 - DNA, 15 bp, Homo sapiens
ataaaatcaccctga

SEQ ID NO: 641246 - DNA, 12 bp, Homo sapiens
ataaacacttct

SEQ ID NO: 641247 - DNA, 14 bp, Homo sapiens
ataaactcagtcaa

SEQ ID NO: 641248 - DNA, 19 bp, Homo sapiens
ataaactcagtcaaatgta

SEQ ID NO: 641249 - DNA, 11 bp, Homo sapiens
ataaactgtga

SEQ ID NO: 641250 - DNA, 15 bp, Homo sapiens
ataaagaaacctttt

SEQ ID NO: 641251 - DNA, 22 bp, Homo sapiens
ataaagatcacaccaatttaga

SEQ ID NO: 641252 - DNA, 15 bp, Homo sapiens
ataaatagtaaataa

SEQ ID NO: 641253 - DNA, 13 bp, Homo sapiens
ataaatatctatt

SEQ ID NO: 641254 - DNA, 24 bp, Homo sapiens
ataaatatctatttatctgtctga

SEQ ID NO: 641255 - DNA, 19 bp, Homo sapiens
ataaatcacagatttccaa

SEQ ID NO: 641256 - DNA, 24 bp, Homo sapiens
ataaatccaatagtctgccacaag

SEQ ID NO: 641257 - DNA, 16 bp, Homo sapiens
ataaattaatgagttt

SEQ ID NO: 641258 - DNA, 19 bp, Homo sapiens
ataaattataatgcatcta

SEQ ID NO: 641259 - DNA, 16 bp, Homo sapiens
ataaattatttctaaa

SEQ ID NO: 641260 - DNA, 13 bp, Homo sapiens
ataaattttggaa

SEQ ID NO: 641261 - DNA, 18 bp, Homo sapiens
ataaattttggaagaatt

SEQ ID NO: 641262 - DNA, 19 bp, Homo sapiens
ataaattttggaagaattc

SEQ ID NO: 641263 - DNA, 22 bp, Homo sapiens
ataaattttggaagaattcatg

SEQ ID NO: 641264 - DNA, 12 bp, Homo sapiens
ataacaacaatt

SEQ ID NO: 641265 - DNA, 20 bp, Homo sapiens
ataacactcaagactatgtt

SEQ ID NO: 641266 - DNA, 13 bp, Homo sapiens
ataacagaaatac

SEQ ID NO: 641267 - DNA, 17 bp, Homo sapiens
ataacagaaatacatca

SEQ ID NO: 641268 - DNA, 19 bp, Homo sapiens
ataacagagtgatttgtaa

SEQ ID NO: 641269 - DNA, 19 bp, Homo sapiens
ataacaggcattgcactaa

SEQ ID NO: 641270 - DNA, 16 bp, Homo sapiens
ataacagttttaagat

SEQ ID NO: 641271 - DNA, 12 bp, Homo sapiens
ataacattgtaa

SEQ ID NO: 641272 - DNA, 12 bp, Homo sapiens
ataacattgtat

SEQ ID NO: 641273 - DNA, 14 bp, Homo sapiens
ataacattgtatgt

SEQ ID NO: 641274 - DNA, 15 bp, Homo sapiens
ataacattgtatgtt

SEQ ID NO: 641275 - DNA, 16 bp, Homo sapiens
ataacattgtatgtta

SEQ ID NO: 641276 - DNA, 20 bp, Homo sapiens
ataaccctgaatcagaggca

SEQ ID NO: 641277 - DNA, 24 bp, Homo sapiens
ataaccctgaatcagaggcagaga

SEQ ID NO: 641278 - DNA, 18 bp, Homo sapiens
ataagattatatacaaag

SEQ ID NO: 641279 - DNA, 21 bp, Homo sapiens
ataagcatctgtgtaacctcc

SEQ ID NO: 641280 - DNA, 19 bp, Homo sapiens
ataagccatagccccaggc

SEQ ID NO: 641281 - DNA, 21 bp, Homo sapiens
ataagctggtatcagtggttc

SEQ ID NO: 641282 - DNA, 15 bp, Homo sapiens
ataagtagaattctt

SEQ ID NO: 641283 - DNA, 21 bp, Homo sapiens
ataagtgttggccatcatttc

SEQ ID NO: 641284 - DNA, 18 bp, Homo sapiens
ataagttcccatttcctt

SEQ ID NO: 641285 - DNA, 13 bp, Homo sapiens
ataagttgaatga

SEQ ID NO: 641286 - DNA, 21 bp, Homo sapiens
ataatacttcatacaacatat

SEQ ID NO: 641287 - DNA, 14 bp, Homo sapiens
ataatagatgtgaa

SEQ ID NO: 641288 - DNA, 19 bp, Homo sapiens
ataatagctcacagcacat

SEQ ID NO: 641289 - DNA, 20 bp, Homo sapiens
ataatagctcacagcacatt

SEQ ID NO: 641290 - DNA, 17 bp, Homo sapiens
ataatataaatgaatga

SEQ ID NO: 641291 - DNA, 18 bp, Homo sapiens
ataatataaatgaatgaa

SEQ ID NO: 641292 - DNA, 20 bp, Homo sapiens
ctcccaaataaactccttaa

SEQ ID NO: 641293 - DNA, 22 bp, Homo sapiens
ctcccacaaataagttcccatt

SEQ ID NO: 641294 - DNA, 13 bp, Homo sapiens
ctccccacagtcc

SEQ ID NO: 641295 - DNA, 19 bp, Homo sapiens
ctccccacagtcctcacag

SEQ ID NO: 641296 - DNA, 14 bp, Homo sapiens
ctccccagcccttt

SEQ ID NO: 641297 - DNA, 17 bp, Homo sapiens
ctccccatgctgggctc

SEQ ID NO: 641298 - DNA, 15 bp, Homo sapiens
ctccccatggtgcag

SEQ ID NO: 641299 - DNA, 14 bp, Homo sapiens
ctcccccagagcca

SEQ ID NO: 641300 - DNA, 16 bp, Homo sapiens
ctcccccaggctgcgc

SEQ ID NO: 641301 - DNA, 17 bp, Homo sapiens
ctcccccaggctgcgcc

SEQ ID NO: 641302 - DNA, 22 bp, Homo sapiens
ctcccccaggctgcgcctgccc

SEQ ID NO: 641303 - DNA, 15 bp, Homo sapiens
ctccccctacagatc

SEQ ID NO: 641304 - DNA, 23 bp, Homo sapiens
ctccccctcagctctccctcaca

SEQ ID NO: 641305 - DNA, 19 bp, Homo sapiens
ctccccgggggtccccgga

SEQ ID NO: 641306 - DNA, 15 bp, Homo sapiens
ctcccctccagaccc

SEQ ID NO: 641307 - DNA, 19 bp, Homo sapiens
ctcccctcttcttgcggca

SEQ ID NO: 641308 - DNA, 13 bp, Homo sapiens
ctcccctggaagt

SEQ ID NO: 641309 - DNA, 14 bp, Homo sapiens
ctcccctggtcctg

SEQ ID NO: 641310 - DNA, 13 bp, Homo sapiens
ctcccgccgcctc

SEQ ID NO: 641311 - DNA, 19 bp, Homo sapiens
ctcccggtgtatgcagtgg

SEQ ID NO: 641312 - DNA, 23 bp, Homo sapiens
ctcccgtccgtccgcccgcccac

SEQ ID NO: 641313 - DNA, 14 bp, Homo sapiens
ctccctaggcctga

SEQ ID NO: 641314 - DNA, 13 bp, Homo sapiens
ctccctccactcc

SEQ ID NO: 641315 - DNA, 14 bp, Homo sapiens
ctccctccactcct

SEQ ID NO: 641316 - DNA, 16 bp, Homo sapiens
ctccctccactcctcc

SEQ ID NO: 641317 - DNA, 13 bp, Homo sapiens
ctccctccctcca

SEQ ID NO: 641318 - DNA, 14 bp, Homo sapiens
ctccctccctccac

SEQ ID NO: 641319 - DNA, 15 bp, Homo sapiens
ctccctccctccaca

SEQ ID NO: 641320 - DNA, 16 bp, Homo sapiens
ctccctccctccacac

SEQ ID NO: 641321 - DNA, 14 bp, Homo sapiens
ctccctgctccctg

SEQ ID NO: 641322 - DNA, 16 bp, Homo sapiens
ctccctgctccctgct

SEQ ID NO: 641323 - DNA, 15 bp, Homo sapiens
ctccctgctgccagg

SEQ ID NO: 641324 - DNA, 18 bp, Homo sapiens
ctccctgggcaccctgca

SEQ ID NO: 641325 - DNA, 22 bp, Homo sapiens
ctccctgggcaccctgcaggca

SEQ ID NO: 641326 - DNA, 20 bp, Homo sapiens
ctccctggggaccaggagct

SEQ ID NO: 641327 - DNA, 14 bp, Homo sapiens
ctccctgtcccctg

SEQ ID NO: 641328 - DNA, 20 bp, Homo sapiens
ctcccttctttccttccttt

SEQ ID NO: 641329 - DNA, 21 bp, Homo sapiens
ctccgccccccggcctggccc

SEQ ID NO: 641330 - DNA, 14 bp, Homo sapiens
ctccgcggaggccc

SEQ ID NO: 641331 - DNA, 17 bp, Homo sapiens
ctccgcggaggcccctg

SEQ ID NO: 641332 - DNA, 14 bp, Homo sapiens
ctccggcagaggca

SEQ ID NO: 641333 - DNA, 15 bp, Homo sapiens
ctccggcagaggcag

SEQ ID NO: 641334 - DNA, 22 bp, Homo sapiens
ctccgggtgcgtgaccggcccg

SEQ ID NO: 641335 - DNA, 18 bp, Homo sapiens
ctccgtgggcagctcctc

SEQ ID NO: 641336 - DNA, 20 bp, Homo sapiens
ctcctagcctctccgcccac

SEQ ID NO: 641337 - DNA, 23 bp, Homo sapiens
ctcctcaattccagggaaccaga

SEQ ID NO: 641338 - DNA, 13 bp, Homo sapiens
ctcctccaaatgc

SEQ ID NO: 641339 - DNA, 13 bp, Homo sapiens
ctcctccagactc

SEQ ID NO: 641340 - DNA, 14 bp, Homo sapiens
ctcctccagactcg

SEQ ID NO: 641341 - DNA, 22 bp, Homo sapiens
ctcctccagactcgagagggct

SEQ ID NO: 641342 - DNA, 17 bp, Homo sapiens
ctcctccagtacaataa

SEQ ID NO: 641343 - DNA, 20 bp, Homo sapiens
ctcctccagttctgatgagg

SEQ ID NO: 641344 - DNA, 14 bp, Homo sapiens
ctcctccattcatg

SEQ ID NO: 641345 - DNA, 17 bp, Homo sapiens
ctcctcccaactctggc

SEQ ID NO: 641346 - DNA, 19 bp, Homo sapiens
tattatatatgtatatctg

SEQ ID NO: 641347 - DNA, 22 bp, Homo sapiens
tattatatatgtatatctgtgt

SEQ ID NO: 641348 - DNA, 20 bp, Homo sapiens
tattatcttaaacccacata

SEQ ID NO: 641349 - DNA, 16 bp, Homo sapiens
tattatgccttgagaa

SEQ ID NO: 641350 - DNA, 17 bp, Homo sapiens
tattatgccttgagaat

SEQ ID NO: 641351 - DNA, 20 bp, Homo sapiens
tattattttctgtaattctt

SEQ ID NO: 641352 - DNA, 20 bp, Homo sapiens
tattcataagccaatttttc

SEQ ID NO: 641353 - DNA, 13 bp, Homo sapiens
tattcatacaaat

SEQ ID NO: 641354 - DNA, 16 bp, Homo sapiens
tattcatgctttctcc

SEQ ID NO: 641355 - DNA, 18 bp, Homo sapiens
tattcatgctttctcctt

SEQ ID NO: 641356 - DNA, 17 bp, Homo sapiens
tattcctaattcctgta

SEQ ID NO: 641357 - DNA, 18 bp, Homo sapiens
tattcctaattcctgtat

SEQ ID NO: 641358 - DNA, 16 bp, Homo sapiens
tattctgcagaaaatt

SEQ ID NO: 641359 - DNA, 13 bp, Homo sapiens
tattctttcacaa

SEQ ID NO: 641360 - DNA, 24 bp, Homo sapiens
tattgaagtaagttcatcaaacat

SEQ ID NO: 641361 - DNA, 14 bp, Homo sapiens
tattgaatataatg

SEQ ID NO: 641362 - DNA, 17 bp, Homo sapiens
tattgacaataagaaac

SEQ ID NO: 641363 - DNA, 21 bp, Homo sapiens
tattgacgacctacatctgaa

SEQ ID NO: 641364 - DNA, 23 bp, Homo sapiens
tattgacgacctacatctgaaat

SEQ ID NO: 641365 - DNA, 17 bp, Homo sapiens
tattgagacactgtcaa

SEQ ID NO: 641366 - DNA, 14 bp, Homo sapiens
tattgagtgtacat

SEQ ID NO: 641367 - DNA, 21 bp, Homo sapiens
tattgccttgatgtttctata

SEQ ID NO: 641368 - DNA, 18 bp, Homo sapiens
tattgctggaatctacta

SEQ ID NO: 641369 - DNA, 16 bp, Homo sapiens
tattgctgtctgaaaa

SEQ ID NO: 641370 - DNA, 20 bp, Homo sapiens
tattggcatggatttccttt

SEQ ID NO: 641371 - DNA, 13 bp, Homo sapiens
tattggttctatt

SEQ ID NO: 641372 - DNA, 15 bp, Homo sapiens
tattgtaacagacat

SEQ ID NO: 641373 - DNA, 19 bp, Homo sapiens
tattgtaacagacattgtt

SEQ ID NO: 641374 - DNA, 18 bp, Homo sapiens
tattgtatatatggatat

SEQ ID NO: 641375 - DNA, 16 bp, Homo sapiens
tattgtgtcttttgca

SEQ ID NO: 641376 - DNA, 18 bp, Homo sapiens
tattgtgtcttttgcatg

SEQ ID NO: 641377 - DNA, 19 bp, Homo sapiens
tattgtgtcttttgcatga

SEQ ID NO: 641378 - DNA, 16 bp, Homo sapiens
tattgttacagctgaa

SEQ ID NO: 641379 - DNA, 15 bp, Homo sapiens
tattgttcttgtaaa

SEQ ID NO: 641380 - DNA, 22 bp, Homo sapiens
tattgtttaaagcaactgtcta

SEQ ID NO: 641381 - DNA, 16 bp, Homo sapiens
tattgtttataggaaa

SEQ ID NO: 641382 - DNA, 14 bp, Homo sapiens
tatttaacattctt

SEQ ID NO: 641383 - DNA, 15 bp, Homo sapiens
tatttaacattcttg

SEQ ID NO: 641384 - DNA, 19 bp, Homo sapiens
tatttaccagaagtttaaa

SEQ ID NO: 641385 - DNA, 16 bp, Homo sapiens
tatttactgtttataa

SEQ ID NO: 641386 - DNA, 12 bp, Homo sapiens
tatttacttgtt

SEQ ID NO: 641387 - DNA, 15 bp, Homo sapiens
tatttataacattgt

SEQ ID NO: 641388 - DNA, 14 bp, Homo sapiens
tatttcggctatgt

SEQ ID NO: 641389 - DNA, 21 bp, Homo sapiens
tatttctaccattaaaatctt

SEQ ID NO: 641390 - DNA, 22 bp, Homo sapiens
tatttctgctgaattttcacat

SEQ ID NO: 641391 - DNA, 17 bp, Homo sapiens
tatttgaggaaactcat

SEQ ID NO: 641392 - DNA, 14 bp, Homo sapiens
tatttgatctggtg

SEQ ID NO: 641393 - DNA, 15 bp, Homo sapiens
tatttgatctggtgc

SEQ ID NO: 641394 - DNA, 17 bp, Homo sapiens
tatttgctcataagtaa

SEQ ID NO: 641395 - DNA, 23 bp, Homo sapiens
tatttgctcataagtaaatgtct

SEQ ID NO: 641396 - DNA, 23 bp, Homo sapiens
tatttgtatcacaccagttactt

SEQ ID NO: 641397 - DNA, 17 bp, Homo sapiens
tatttgtgtaactgaaa

SEQ ID NO: 641398 - DNA, 12 bp, Homo sapiens
tatttgtttcat

SEQ ID NO: 641399 - DNA, 12 bp, Homo sapiens
tattttaacata

SEQ ID NO: 641400 - DNA, 16 bp, Homo sapiens
tattttaacatagcag

SEQ ID NO: 641401 - DNA, 19 bp, Homo sapiens
tattttattgtaacagaca

SEQ ID NO: 641402 - DNA, 23 bp, Homo sapiens
tattttattgtaacagacattgt

SEQ ID NO: 641403 - DNA, 15 bp, Homo sapiens
tattttcgcccacct

SEQ ID NO: 641404 - DNA, 14 bp, Homo sapiens
tattttgattgttt

SEQ ID NO: 641405 - DNA, 21 bp, Homo sapiens
tatttttaaccaaataagaat

SEQ ID NO: 641406 - DNA, 15 bp, Homo sapiens
tattttttgtgaatg

SEQ ID NO: 641407 - DNA, 20 bp, Homo sapiens
tatttttttactgtttgaaa

SEQ ID NO: 641408 - DNA, 14 bp, Homo sapiens
tcaaaataaaacca

SEQ ID NO: 641409 - DNA, 15 bp, Homo sapiens
tcaaaataaaaccag

SEQ ID NO: 641410 - DNA, 17 bp, Homo sapiens
tcaaaatgtggaccagt

SEQ ID NO: 641411 - DNA, 13 bp, Homo sapiens
tcaaacaaatcat

SEQ ID NO: 641412 - DNA, 14 bp, Homo sapiens
tcaaacagtgtggc

SEQ ID NO: 641413 - DNA, 23 bp, Homo sapiens
tcaaacagtgtggcttaaacatt

SEQ ID NO: 641414 - DNA, 17 bp, Homo sapiens
tcaaagaaaacagacca

SEQ ID NO: 641415 - DNA, 17 bp, Homo sapiens
tcaaagaacccccctcc

SEQ ID NO: 641416 - DNA, 23 bp, Homo sapiens
tcaaagaatcacctaattaattt

SEQ ID NO: 641417 - DNA, 20 bp, Homo sapiens
tcaaagaggccagtactttg

SEQ ID NO: 641418 - DNA, 15 bp, Homo sapiens
tcaaataaccctgaa

SEQ ID NO: 641419 - DNA, 23 bp, Homo sapiens
tcaaatacattctaaatcacttt

SEQ ID NO: 641420 - DNA, 18 bp, Homo sapiens
tcaaatctgctttcatcc

SEQ ID NO: 641421 - DNA, 19 bp, Homo sapiens
tcaaatctgctttcatcca

SEQ ID NO: 641422 - DNA, 22 bp, Homo sapiens
tatgcacaccaaattgctgaga

SEQ ID NO: 641423 - DNA, 21 bp, Homo sapiens
tatgcaggcagattaataaca

SEQ ID NO: 641424 - DNA, 18 bp, Homo sapiens
tatgcatgagaactaaat

SEQ ID NO: 641425 - DNA, 18 bp, Homo sapiens
tatgcatttatgcatgag

SEQ ID NO: 641426 - DNA, 14 bp, Homo sapiens
tatgctgtgtgcag

SEQ ID NO: 641427 - DNA, 15 bp, Homo sapiens
tatgctgtgtgcaga

SEQ ID NO: 641428 - DNA, 15 bp, Homo sapiens
tatgctgttcattga

SEQ ID NO: 641429 - DNA, 21 bp, Homo sapiens
tatgctttccctgaggaatga

SEQ ID NO: 641430 - DNA, 23 bp, Homo sapiens
tatggaaagggtgtggcttggaa

SEQ ID NO: 641431 - DNA, 17 bp, Homo sapiens
tatggaacactctgaga

SEQ ID NO: 641432 - DNA, 23 bp, Homo sapiens
tatggaggagagtgtttaactga

SEQ ID NO: 641433 - DNA, 18 bp, Homo sapiens
tatggcaacgttcatgtt

SEQ ID NO: 641434 - DNA, 17 bp, Homo sapiens
tatggctttgtgcttgt

SEQ ID NO: 641435 - DNA, 16 bp, Homo sapiens
tatggtgatactccaa

SEQ ID NO: 641436 - DNA, 20 bp, Homo sapiens
tatgtaacttcagatgtttc

SEQ ID NO: 641437 - DNA, 14 bp, Homo sapiens
tatgtacaggctga

SEQ ID NO: 641438 - DNA, 15 bp, Homo sapiens
tatgtaggaaaattt

SEQ ID NO: 641439 - DNA, 16 bp, Homo sapiens
tatgtatatctgtgta

SEQ ID NO: 641440 - DNA, 15 bp, Homo sapiens
tatgtcccttcacat

SEQ ID NO: 641441 - DNA, 15 bp, Homo sapiens
tatgtctcatgtttt

SEQ ID NO: 641442 - DNA, 17 bp, Homo sapiens
tatgtctcatgttttat

SEQ ID NO: 641443 - DNA, 22 bp, Homo sapiens
tatgtgaactttctcagcatat

SEQ ID NO: 641444 - DNA, 14 bp, Homo sapiens
tatgtgatgtaact

SEQ ID NO: 641445 - DNA, 19 bp, Homo sapiens
tatgtgccccttccccatg

SEQ ID NO: 641446 - DNA, 10 bp, Homo sapiens
tatgtgtata

SEQ ID NO: 641447 - DNA, 14 bp, Homo sapiens
tatgttgatgaaat

SEQ ID NO: 641448 - DNA, 19 bp, Homo sapiens
tatgttgcatgaatccatc

SEQ ID NO: 641449 - DNA, 14 bp, Homo sapiens
tatgtttatacaca

SEQ ID NO: 641450 - DNA, 16 bp, Homo sapiens
tatgtttatacacaca

SEQ ID NO: 641451 - DNA, 17 bp, Homo sapiens
tatgtttatacacacag

SEQ ID NO: 641452 - DNA, 11 bp, Homo sapiens
tatgttttgga

SEQ ID NO: 641453 - DNA, 19 bp, Homo sapiens
tatgttttggagagagcaa

SEQ ID NO: 641454 - DNA, 19 bp, Homo sapiens
tattaaatttattaaatgt

SEQ ID NO: 641455 - DNA, 20 bp, Homo sapiens
tattaaatttattaaatgtt

SEQ ID NO: 641456 - DNA, 22 bp, Homo sapiens
tattacaacaagcaaactgaaa

SEQ ID NO: 641457 - DNA, 14 bp, Homo sapiens
tattacataaaaca

SEQ ID NO: 641458 - DNA, 14 bp, Homo sapiens
tattatagtctgta

SEQ ID NO: 641459 - DNA, 17 bp, Homo sapiens
tattatagtctgtactt

SEQ ID NO: 641460 - DNA, 18 bp, Homo sapiens
tattatagttattcaaat

SEQ ID NO: 641461 - DNA, 14 bp, Homo sapiens
cttcacatagtttt

SEQ ID NO: 641462 - DNA, 20 bp, Homo sapiens
cttcagaaactttttctaaa

SEQ ID NO: 641463 - DNA, 23 bp, Homo sapiens
cttcagaattgtttttagaaatt

SEQ ID NO: 641464 - DNA, 16 bp, Homo sapiens
cttcagactctctcct

SEQ ID NO: 641465 - DNA, 14 bp, Homo sapiens
cttcagatgtttcc

SEQ ID NO: 641466 - DNA, 14 bp, Homo sapiens
cttcagtgccttat

SEQ ID NO: 641467 - DNA, 14 bp, Homo sapiens
cttcagttctcatc

SEQ ID NO: 641468 - DNA, 16 bp, Homo sapiens
cttcataaattatttc

SEQ ID NO: 641469 - DNA, 23 bp, Homo sapiens
cttcatacaaaggacagtacaca

SEQ ID NO: 641470 - DNA, 17 bp, Homo sapiens
cttcatgaccttacata

SEQ ID NO: 641471 - DNA, 14 bp, Homo sapiens
cttcatgctgtctg

SEQ ID NO: 641472 - DNA, 14 bp, Homo sapiens
cttcatgttgatgt

SEQ ID NO: 641473 - DNA, 13 bp, Homo sapiens
cttcatttaacac

SEQ ID NO: 641474 - DNA, 18 bp, Homo sapiens
cttccaagttcattcata

SEQ ID NO: 641475 - DNA, 15 bp, Homo sapiens
cttccagtgcatgtt

SEQ ID NO: 641476 - DNA, 22 bp, Homo sapiens
cttccagtgcatgttgccatga

SEQ ID NO: 641477 - DNA, 21 bp, Homo sapiens
cttccatcttgtggggccagg

SEQ ID NO: 641478 - DNA, 22 bp, Homo sapiens
cttccatcttgtggggccagga

SEQ ID NO: 641479 - DNA, 13 bp, Homo sapiens
cttccatggtggt

SEQ ID NO: 641480 - DNA, 20 bp, Homo sapiens
cttccatggtggtttcagaa

SEQ ID NO: 641481 - DNA, 19 bp, Homo sapiens
cttcccaacaatactttgt

SEQ ID NO: 641482 - DNA, 22 bp, Homo sapiens
cttcccaacctcccctggtcct

SEQ ID NO: 641483 - DNA, 19 bp, Homo sapiens
cttcccaagtcctcgcccc

SEQ ID NO: 641484 - DNA, 13 bp, Homo sapiens
actaacttatttt

SEQ ID NO: 641485 - DNA, 18 bp, Homo sapiens
actaacttattttgattg

SEQ ID NO: 641486 - DNA, 16 bp, Homo sapiens
actaagctttctcctt

SEQ ID NO: 641487 - DNA, 17 bp, Homo sapiens
actaatgacaagtgact

SEQ ID NO: 641488 - DNA, 24 bp, Homo sapiens
actaatggccaagtgtacatttga

SEQ ID NO: 641489 - DNA, 13 bp, Homo sapiens
actaatgtaaata

SEQ ID NO: 641490 - DNA, 23 bp, Homo sapiens
actaatgtaaatattgctgtctg

SEQ ID NO: 641491 - DNA, 16 bp, Homo sapiens
actacagaagtggaag

SEQ ID NO: 641492 - DNA, 18 bp, Homo sapiens
actacatgggccagccct

SEQ ID NO: 641493 - DNA, 19 bp, Homo sapiens
actacatgggccagccctt

SEQ ID NO: 641494 - DNA, 20 bp, Homo sapiens
actaccccagaacgcatgca

SEQ ID NO: 641495 - DNA, 21 bp, Homo sapiens
actaccccagaacgcatgcag

SEQ ID NO: 641496 - DNA, 21 bp, Homo sapiens
actaccccaggacgcatgcag

SEQ ID NO: 641497 - DNA, 19 bp, Homo sapiens
actacctttgtccaggcct

SEQ ID NO: 641498 - DNA, 20 bp, Homo sapiens
actacctttgtccaggcctg

SEQ ID NO: 641499 - DNA, 14 bp, Homo sapiens
actagaatgagaaa

SEQ ID NO: 641500 - DNA, 15 bp, Homo sapiens
actagccctctttct

SEQ ID NO: 641501 - DNA, 22 bp, Homo sapiens
actagggtcctggccctcttct

SEQ ID NO: 641502 - DNA, 20 bp, Homo sapiens
actaggtgcccagtcttgag

SEQ ID NO: 641503 - DNA, 16 bp, Homo sapiens
actatcagcagcggca

SEQ ID NO: 641504 - DNA, 23 bp, Homo sapiens
actatcagcagcggcagcagcag

SEQ ID NO: 641505 - DNA, 14 bp, Homo sapiens
actatctttcagga

SEQ ID NO: 641506 - DNA, 12 bp, Homo sapiens
actatgtaaatg

SEQ ID NO: 641507 - DNA, 14 bp, Homo sapiens
actattacactgcc

SEQ ID NO: 641508 - DNA, 15 bp, Homo sapiens
actattcttaatagg

SEQ ID NO: 641509 - DNA, 19 bp, Homo sapiens
actcaagactatgttctcc

SEQ ID NO: 641510 - DNA, 13 bp, Homo sapiens
actcacaaaaggc

SEQ ID NO: 641511 - DNA, 22 bp, Homo sapiens
actcagaaacagaagaaaaaca

SEQ ID NO: 641512 - DNA, 13 bp, Homo sapiens
actcaggagcaca

SEQ ID NO: 641513 - DNA, 18 bp, Homo sapiens
actcaggagcacagccat

SEQ ID NO: 641514 - DNA, 19 bp, Homo sapiens
actcaggagcacagccata

SEQ ID NO: 641515 - DNA, 15 bp, Homo sapiens
actcaggcagcctgt

SEQ ID NO: 641516 - DNA, 15 bp, Homo sapiens
actcaggctttctat

SEQ ID NO: 641517 - DNA, 20 bp, Homo sapiens
actcagtaaatcagtgcagt

SEQ ID NO: 641518 - DNA, 18 bp, Homo sapiens
actcagtaacagtgcagt

SEQ ID NO: 641519 - DNA, 21 bp, Homo sapiens
actcatacagtctctatttga

SEQ ID NO: 641520 - DNA, 17 bp, Homo sapiens
actcatacagtggtatt

SEQ ID NO: 641521 - DNA, 21 bp, Homo sapiens
accgaactcgggattacagaa

SEQ ID NO: 641522 - DNA, 22 bp, Homo sapiens
accgaactcgggattacagaaa

SEQ ID NO: 641523 - DNA, 23 bp, Homo sapiens
accgaactcgggattacagaaac

SEQ ID NO: 641524 - DNA, 13 bp, Homo sapiens
accgacgcccctc

SEQ ID NO: 641525 - DNA, 15 bp, Homo sapiens
accgacgcccctccg

SEQ ID NO: 641526 - DNA, 21 bp, Homo sapiens
accgagaggaaaaaggcttct

SEQ ID NO: 641527 - DNA, 16 bp, Homo sapiens
accgcccaacccccac

SEQ ID NO: 641528 - DNA, 19 bp, Homo sapiens
accgcccaacccccacctc

SEQ ID NO: 641529 - DNA, 20 bp, Homo sapiens
accgcccaacccccacctcc

SEQ ID NO: 641530 - DNA, 18 bp, Homo sapiens
accggacgcatgcagggc

SEQ ID NO: 641531 - DNA, 14 bp, Homo sapiens
accggcactgtgca

SEQ ID NO: 641532 - DNA, 18 bp, Homo sapiens
accgggactacagaagtg

SEQ ID NO: 641533 - DNA, 21 bp, Homo sapiens
accggggtggagtcagggctg

SEQ ID NO: 641534 - DNA, 17 bp, Homo sapiens
accgtggtgtcctctgt

SEQ ID NO: 641535 - DNA, 19 bp, Homo sapiens
accgtggtgtcctctgtcc

SEQ ID NO: 641536 - DNA, 17 bp, Homo sapiens
acctaaattaacaaatt

SEQ ID NO: 641537 - DNA, 18 bp, Homo sapiens
acctaaattaacaaattc

SEQ ID NO: 641538 - DNA, 22 bp, Homo sapiens
acctaaatttttgtaagaaaat

SEQ ID NO: 641539 - DNA, 19 bp, Homo sapiens
acctaagagccacaataag

SEQ ID NO: 641540 - DNA, 14 bp, Homo sapiens
acctaattaatttc

SEQ ID NO: 641541 - DNA, 12 bp, Homo sapiens
acctacatctga

SEQ ID NO: 641542 - DNA, 16 bp, Homo sapiens
acctacatctgaaatc

SEQ ID NO: 641543 - DNA, 22 bp, Homo sapiens
acctattgctgtaaataaaaat

SEQ ID NO: 641544 - DNA, 18 bp, Homo sapiens
acctcagtcagtattgtt

SEQ ID NO: 641545 - DNA, 22 bp, Homo sapiens
acctcagtcagtattgttttgg

SEQ ID NO: 641546 - DNA, 17 bp, Homo sapiens
acctcagttggcctctg

SEQ ID NO: 641547 - DNA, 10 bp, Homo sapiens
acctccaccc

SEQ ID NO: 641548 - DNA, 14 bp, Homo sapiens
acctccagattatt

SEQ ID NO: 641549 - DNA, 21 bp, Homo sapiens
acctccccagagccctgcagt

SEQ ID NO: 641550 - DNA, 12 bp, Homo sapiens
acctcgccgtgt

SEQ ID NO: 641551 - DNA, 23 bp, Homo sapiens
acctcgtccatttaaacccggct

SEQ ID NO: 641552 - DNA, 21 bp, Homo sapiens
acctctcagcccctcagagaa

SEQ ID NO: 641553 - DNA, 19 bp, Homo sapiens
acctctctgaactgcaaca

SEQ ID NO: 641554 - DNA, 21 bp, Homo sapiens
acctctgaggacagaggccgg

SEQ ID NO: 641555 - DNA, 18 bp, Homo sapiens
acctgacagcaaacacag

SEQ ID NO: 641556 - DNA, 13 bp, Homo sapiens
acctgccaggcct

SEQ ID NO: 641557 - DNA, 14 bp, Homo sapiens
acctgccaggcctc

SEQ ID NO: 641558 - DNA, 14 bp, Homo sapiens
acctgcccctcccc

SEQ ID NO: 641559 - DNA, 16 bp, Homo sapiens
acctgctcctgcccac

SEQ ID NO: 641560 - DNA, 14 bp, Homo sapiens
acctggtggccctg

SEQ ID NO: 641561 - DNA, 15 bp, Homo sapiens
acctggtggccctgc

SEQ ID NO: 641562 - DNA, 20 bp, Homo sapiens
acctgtaatagcctcacctt

SEQ ID NO: 641563 - DNA, 13 bp, Homo sapiens
tgcaggcagcctg

SEQ ID NO: 641564 - DNA, 14 bp, Homo sapiens
tgcaggcagcctgc

SEQ ID NO: 641565 - DNA, 13 bp, Homo sapiens
tgcaggcaggcag

SEQ ID NO: 641566 - DNA, 17 bp, Homo sapiens
tgcaggcccagcagact

SEQ ID NO: 641567 - DNA, 18 bp, Homo sapiens
tgcaggcgcgcaccgccc

SEQ ID NO: 641568 - DNA, 17 bp, Homo sapiens
tgcagggacagcctgca

SEQ ID NO: 641569 - DNA, 18 bp, Homo sapiens
tgcagggcccccacagga

SEQ ID NO: 641570 - DNA, 14 bp, Homo sapiens
tgcagtagagagcc

SEQ ID NO: 641571 - DNA, 16 bp, Homo sapiens
tgcagtagtgtcactt

SEQ ID NO: 641572 - DNA, 14 bp, Homo sapiens
tgcagtattctgta

SEQ ID NO: 641573 - DNA, 15 bp, Homo sapiens
tgcagtattctgtag

SEQ ID NO: 641574 - DNA, 17 bp, Homo sapiens
tgcagttagcacagagg

SEQ ID NO: 641575 - DNA, 23 bp, Homo sapiens
tgcagtttggccctggagccagg

SEQ ID NO: 641576 - DNA, 18 bp, Homo sapiens
tgcagtttggtatgaaac

SEQ ID NO: 641577 - DNA, 19 bp, Homo sapiens
tgcagtttggtatgaaaca

SEQ ID NO: 641578 - DNA, 13 bp, Homo sapiens
tgcatagacaagt

SEQ ID NO: 641579 - DNA, 13 bp, Homo sapiens
tgcatatatatgt

SEQ ID NO: 641580 - DNA, 16 bp, Homo sapiens
tgcatatatatgtata

SEQ ID NO: 641581 - DNA, 16 bp, Homo sapiens
tgcatatggcaacgtt

SEQ ID NO: 641582 - DNA, 24 bp, Homo sapiens
tgcatatggcaacgttcatgttca

SEQ ID NO: 641583 - DNA, 19 bp, Homo sapiens
tgcatcccttggcccctct

SEQ ID NO: 641584 - DNA, 23 bp, Homo sapiens
tgcatgatcttacacgaagaaat

SEQ ID NO: 641585 - DNA, 23 bp, Homo sapiens
tgcatgcagggcccccacaggag

SEQ ID NO: 641586 - DNA, 12 bp, Homo sapiens
tgcatgcctggg

SEQ ID NO: 641587 - DNA, 16 bp, Homo sapiens
tgcatgtatgccatgt

SEQ ID NO: 641588 - DNA, 18 bp, Homo sapiens
tgcatgtcggggcccctg

SEQ ID NO: 641589 - DNA, 19 bp, Homo sapiens
tgcatgtcggggcccctgc

SEQ ID NO: 641590 - DNA, 14 bp, Homo sapiens
tgcatgttaaaata

SEQ ID NO: 641591 - DNA, 21 bp, Homo sapiens
tgcatgttgccatgaggcctt

SEQ ID NO: 641592 - DNA, 14 bp, Homo sapiens
tgcatgtttaataa

SEQ ID NO: 641593 - DNA, 18 bp, Homo sapiens
tgcatgtttaataatatg

SEQ ID NO: 641594 - DNA, 19 bp, Homo sapiens
tgcatgtttaataatatgt

SEQ ID NO: 641595 - DNA, 23 bp, Homo sapiens
tgcatgtttaataatatgtacaa

SEQ ID NO: 641596 - DNA, 12 bp, Homo sapiens
tgcattcagatc

SEQ ID NO: 641597 - DNA, 18 bp, Homo sapiens
tgcattcattcatcctct

SEQ ID NO: 641598 - DNA, 19 bp, Homo sapiens
tgcatttagcatgagttct

SEQ ID NO: 641599 - DNA, 20 bp, Homo sapiens
tgcatttagcatgagttctg

SEQ ID NO: 641600 - DNA, 16 bp, Homo sapiens
tgcatttatgcatgag

SEQ ID NO: 641601 - DNA, 18 bp, Homo sapiens
tgccaaaatgtcaatttt

SEQ ID NO: 641602 - DNA, 21 bp, Homo sapiens
tgccaaaatgtcaatttttaa

SEQ ID NO: 641603 - DNA, 23 bp, Homo sapiens
tgccaaacatcagtcaattgctt

SEQ ID NO: 641604 - DNA, 13 bp, Homo sapiens
tgccaaagatagc

SEQ ID NO: 641605 - DNA, 17 bp, Homo sapiens
tgccaaagatagcagaa

SEQ ID NO: 641606 - DNA, 21 bp, Homo sapiens
tgccaaagatagcagaagagt

SEQ ID NO: 641607 - DNA, 21 bp, Homo sapiens
tgccaaataaatcatcctcat

SEQ ID NO: 641608 - DNA, 14 bp, Homo sapiens
tgccaattcatctc

SEQ ID NO: 641609 - DNA, 19 bp, Homo sapiens
tgccacattgcttcattaa

SEQ ID NO: 641610 - DNA, 18 bp, Homo sapiens
tgccactcaggcagcctg

SEQ ID NO: 641611 - DNA, 21 bp, Homo sapiens
tgccagcgcagcgccagggct

SEQ ID NO: 641612 - DNA, 15 bp, Homo sapiens
tgccaggcagctgca

SEQ ID NO: 641613 - DNA, 14 bp, Homo sapiens
tgccaggccctcca

SEQ ID NO: 641614 - DNA, 15 bp, Homo sapiens
tgccaggccctccag

SEQ ID NO: 641615 - DNA, 16 bp, Homo sapiens
tgccaggccctccagc

SEQ ID NO: 641616 - DNA, 16 bp, Homo sapiens
tgccaggcctccctcg

SEQ ID NO: 641617 - DNA, 19 bp, Homo sapiens
tgccaggctcccactgccc

SEQ ID NO: 641618 - DNA, 21 bp, Homo sapiens
tgccagtgtttagaagagcct

SEQ ID NO: 641619 - DNA, 13 bp, Homo sapiens
tgccatgaggcct

SEQ ID NO: 641620 - DNA, 22 bp, Homo sapiens
tgccatgaggcctttccccagt

SEQ ID NO: 641621 - DNA, 15 bp, Homo sapiens
tgccattatttctac

SEQ ID NO: 641622 - DNA, 11 bp, Homo sapiens
tgccattccca

SEQ ID NO: 641623 - DNA, 18 bp, Homo sapiens
tgccattttgtctggctg

SEQ ID NO: 641624 - DNA, 19 bp, Homo sapiens
tgccattttgtctggctgt

SEQ ID NO: 641625 - DNA, 20 bp, Homo sapiens
tgccattttgtctggctgtg

SEQ ID NO: 641626 - DNA, 20 bp, Homo sapiens
tgccattttttgtctgtgat

SEQ ID NO: 641627 - DNA, 23 bp, Homo sapiens
tgccattttttgtctgtgataac

SEQ ID NO: 641628 - DNA, 17 bp, Homo sapiens
tgcccacatttgggctc

SEQ ID NO: 641629 - DNA, 21 bp, Homo sapiens
tgcccacatttgggctcaggg

SEQ ID NO: 641630 - DNA, 22 bp, Homo sapiens
tgcccacgcccctccccagccc

SEQ ID NO: 641631 - DNA, 16 bp, Homo sapiens
tgcccagttagcccgg

SEQ ID NO: 641632 - DNA, 14 bp, Homo sapiens
tgcccatggctggg

SEQ ID NO: 641633 - DNA, 17 bp, Homo sapiens
tgcccatggctgggaac

SEQ ID NO: 641634 - DNA, 14 bp, Homo sapiens
tgcccatgtgtatg

SEQ ID NO: 641635 - DNA, 15 bp, Homo sapiens
tgcccatttcacaca

SEQ ID NO: 641636 - DNA, 16 bp, Homo sapiens
tgcccatttcacacaa

SEQ ID NO: 641637 - DNA, 17 bp, Homo sapiens
tgcccatttcacacaac

SEQ ID NO: 641638 - DNA, 19 bp, Homo sapiens
tgccccacaaggcccagcc

SEQ ID NO: 641639 - DNA, 13 bp, Homo sapiens
tgccccagctctg

SEQ ID NO: 641640 - DNA, 15 bp, Homo sapiens
tgccccagctctgga

SEQ ID NO: 641641 - DNA, 22 bp, Homo sapiens
tgccccagtggtgcgggccagg

SEQ ID NO: 641642 - DNA, 22 bp, Homo sapiens
tgccccatctcctcccatggcc

SEQ ID NO: 641643 - DNA, 14 bp, Homo sapiens
tgccccccatgccc

SEQ ID NO: 641644 - DNA, 18 bp, Homo sapiens
tgccccccatgccctccc

SEQ ID NO: 641645 - DNA, 14 bp, Homo sapiens
tgccccccttccca

SEQ ID NO: 641646 - DNA, 20 bp, Homo sapiens
tgccccccttcccaccccta

SEQ ID NO: 641647 - DNA, 11 bp, Homo sapiens
tgccccctccc

SEQ ID NO: 641648 - DNA, 14 bp, Homo sapiens
tgccccctcccccg

SEQ ID NO: 641649 - DNA, 19 bp, Homo sapiens
tgccccctcccccgcagac

SEQ ID NO: 641650 - DNA, 21 bp, Homo sapiens
tgccccctcccccgcagacag

SEQ ID NO: 641651 - DNA, 17 bp, Homo sapiens
tgcccctccccagccct

SEQ ID NO: 641652 - DNA, 18 bp, Homo sapiens
tgcccctccgtccccagg

SEQ ID NO: 641653 - DNA, 18 bp, Homo sapiens
tgcccctgcacctgcttc

SEQ ID NO: 641654 - DNA, 20 bp, Homo sapiens
tgcccctgcacctgcttctc

SEQ ID NO: 641655 - DNA, 20 bp, Homo sapiens
tgcccctgcagtttggccct

SEQ ID NO: 641656 - DNA, 22 bp, Homo sapiens
tgcccctgcagtttggccctgg

SEQ ID NO: 641657 - DNA, 16 bp, Homo sapiens
tgcccctggccctgcc

SEQ ID NO: 641658 - DNA, 21 bp, Homo sapiens
tgcccgcgggtggctggagcc

SEQ ID NO: 641659 - DNA, 15 bp, Homo sapiens
tgccctcactccact

SEQ ID NO: 641660 - DNA, 22 bp, Homo sapiens
tgccctcactccactcccctca

SEQ ID NO: 641661 - DNA, 17 bp, Homo sapiens
tgccctcccccacggcc

SEQ ID NO: 641662 - DNA, 14 bp, Homo sapiens
tgccctccctgctg

SEQ ID NO: 641663 - DNA, 15 bp, Homo sapiens
tgccctccctgctgc

SEQ ID NO: 641664 - DNA, 22 bp, Homo sapiens
tgccctccctgctgccaggctc

SEQ ID NO: 641665 - DNA, 14 bp, Homo sapiens
tgccctctgccact

SEQ ID NO: 641666 - DNA, 20 bp, Homo sapiens
tgccctcttaagatctgact

SEQ ID NO: 641667 - DNA, 12 bp, Homo sapiens
tgccctgcacct

SEQ ID NO: 641668 - DNA, 16 bp, Homo sapiens
tgccctgcaccttggg

SEQ ID NO: 641669 - DNA, 18 bp, Homo sapiens
tgccctgcaccttgggca

SEQ ID NO: 641670 - DNA, 21 bp, Homo sapiens
tgccctggggcatccaccttc

SEQ ID NO: 641671 - DNA, 14 bp, Homo sapiens
tgccctgtttccaa

SEQ ID NO: 641672 - DNA, 17 bp, Homo sapiens
tgccgcatctgcctgga

SEQ ID NO: 641673 - DNA, 19 bp, Homo sapiens
tgccgcatctgcctggagc

SEQ ID NO: 641674 - DNA, 15 bp, Homo sapiens
tgccggtggggccag

SEQ ID NO: 641675 - DNA, 12 bp, Homo sapiens
tgcctcactgtg

SEQ ID NO: 641676 - DNA, 20 bp, Homo sapiens
tgcctcagccagtggcacag

SEQ ID NO: 641677 - DNA, 14 bp, Homo sapiens
tgcctcatgaccct

SEQ ID NO: 641678 - DNA, 20 bp, Homo sapiens
tgcctcatgaccctcctgtc

SEQ ID NO: 641679 - DNA, 15 bp, Homo sapiens
tgcttctccctgggg

SEQ ID NO: 641680 - DNA, 16 bp, Homo sapiens
tgcttctctaaaacag

SEQ ID NO: 641681 - DNA, 16 bp, Homo sapiens
tgcttctctttataga

SEQ ID NO: 641682 - DNA, 20 bp, Homo sapiens
tgcttggtttagctgtgcag

SEQ ID NO: 641683 - DNA, 18 bp, Homo sapiens
tgcttgtcattctgctaa

SEQ ID NO: 641684 - DNA, 14 bp, Homo sapiens
tgcttgttcttcct

SEQ ID NO: 641685 - DNA, 20 bp, Homo sapiens
tgctttacaacttgaatgct

SEQ ID NO: 641686 - DNA, 13 bp, Homo sapiens
tgctttcagtgcc

SEQ ID NO: 641687 - DNA, 20 bp, Homo sapiens
tgctttcagtgcctgctgtt

SEQ ID NO: 641688 - DNA, 21 bp, Homo sapiens
tgctttcagtgcctgctgttc

SEQ ID NO: 641689 - DNA, 16 bp, Homo sapiens
tgctttccaacacaca

SEQ ID NO: 641690 - DNA, 12 bp, Homo sapiens
tgctttctccat

SEQ ID NO: 641691 - DNA, 15 bp, Homo sapiens
tgctttctgatacat

SEQ ID NO: 641692 - DNA, 11 bp, Homo sapiens
tgctttgtcta

SEQ ID NO: 641693 - DNA, 14 bp, Homo sapiens
tgcttttctcatgg

SEQ ID NO: 641694 - DNA, 15 bp, Homo sapiens
tgcttttctcatggt

SEQ ID NO: 641695 - DNA, 13 bp, Homo sapiens
tgctttttctgac

SEQ ID NO: 641696 - DNA, 21 bp, Homo sapiens
tggaaaatgttctgacagcat

SEQ ID NO: 641697 - DNA, 20 bp, Homo sapiens
tggaaacaaggaaggacatt

SEQ ID NO: 641698 - DNA, 15 bp, Homo sapiens
tggaaacatctgatt

SEQ ID NO: 641699 - DNA, 17 bp, Homo sapiens
tggaaacatctgatttc

SEQ ID NO: 641700 - DNA, 20 bp, Homo sapiens
tggaaacatctgatttctga

SEQ ID NO: 641701 - DNA, 16 bp, Homo sapiens
tggaaatttgtgtgct

SEQ ID NO: 641702 - DNA, 19 bp, Homo sapiens
tggaaatttgtgtgcttca

SEQ ID NO: 641703 - DNA, 12 bp, Homo sapiens
tggaacactctg

SEQ ID NO: 641704 - DNA, 12 bp, Homo sapiens
tggaacagccct

SEQ ID NO: 641705 - DNA, 23 bp, Homo sapiens
tggaactcagctgtctgtggctt

SEQ ID NO: 641706 - DNA, 14 bp, Homo sapiens
tggaagaattcatg

SEQ ID NO: 641707 - DNA, 17 bp, Homo sapiens
tggaagaattcatgatg

SEQ ID NO: 641708 - DNA, 15 bp, Homo sapiens
tggaagacaaataca

SEQ ID NO: 641709 - DNA, 18 bp, Homo sapiens
tggaagacaaatacacat

SEQ ID NO: 641710 - DNA, 20 bp, Homo sapiens
tggaagggcgctgagggcag

SEQ ID NO: 641711 - DNA, 20 bp, Homo sapiens
tggaagttgtcctttctgat

SEQ ID NO: 641712 - DNA, 21 bp, Homo sapiens
tggaattattagcaccagctt

SEQ ID NO: 641713 - DNA, 14 bp, Homo sapiens
tggaattctgcttc

SEQ ID NO: 641714 - DNA, 16 bp, Homo sapiens
tggaatttatgaatgg

SEQ ID NO: 641715 - DNA, 16 bp, Homo sapiens
tggacagtgcctaact

SEQ ID NO: 641716 - DNA, 18 bp, Homo sapiens
tggacatttatgtacaaa

SEQ ID NO: 641717 - DNA, 19 bp, Homo sapiens
tggacatttatgtacaaaa

SEQ ID NO: 641718 - DNA, 22 bp, Homo sapiens
tggaccagttccctcagccctc

SEQ ID NO: 641719 - DNA, 24 bp, Homo sapiens
tggaccagttccctcagccctcat

SEQ ID NO: 641720 - DNA, 17 bp, Homo sapiens
tggaccgagtggaccac

SEQ ID NO: 641721 - DNA, 18 bp, Homo sapiens
tggagactaacttatttt

SEQ ID NO: 641722 - DNA, 21 bp, Homo sapiens
tggagactaacttattttgat

SEQ ID NO: 641723 - DNA, 21 bp, Homo sapiens
tggagagagaggctgcctcag

SEQ ID NO: 641724 - DNA, 11 bp, Homo sapiens
tggagaggaga

SEQ ID NO: 641725 - DNA, 23 bp, Homo sapiens
tggagaggaggtgtggagtggag

SEQ ID NO: 641726 - DNA, 17 bp, Homo sapiens
tggagaggggacttgga

SEQ ID NO: 641727 - DNA, 22 bp, Homo sapiens
tggagcagaaagccagggtcct

SEQ ID NO: 641728 - DNA, 13 bp, Homo sapiens
tggagcagagacg

SEQ ID NO: 641729 - DNA, 14 bp, Homo sapiens
tggagccccctggc

SEQ ID NO: 641730 - DNA, 16 bp, Homo sapiens
tggagcctgggcagca

SEQ ID NO: 641731 - DNA, 13 bp, Homo sapiens
tggagcttggagc

SEQ ID NO: 641732 - DNA, 14 bp, Homo sapiens
tggagcttggagcc

SEQ ID NO: 641733 - DNA, 15 bp, Homo sapiens
tggagcttggagccc

SEQ ID NO: 641734 - DNA, 14 bp, Homo sapiens
tggaggagaaggag

SEQ ID NO: 641735 - DNA, 16 bp, Homo sapiens
tggaggaggaggagga

SEQ ID NO: 641736 - DNA, 23 bp, Homo sapiens
tggaggaggaggaggagccttgc

SEQ ID NO: 641737 - DNA, 20 bp, Homo sapiens
tggaggcctggtctggagcc

SEQ ID NO: 641738 - DNA, 21 bp, Homo sapiens
tggaggctgctgccccctggc

SEQ ID NO: 641739 - DNA, 15 bp, Homo sapiens
tggaggtttcatact

SEQ ID NO: 641740 - DNA, 18 bp, Homo sapiens
tggagtagagtcaggaga

SEQ ID NO: 641741 - DNA, 16 bp, Homo sapiens
tggagtctgaaggaga

SEQ ID NO: 641742 - DNA, 12 bp, Homo sapiens
tggataagaaaa

SEQ ID NO: 641743 - DNA, 14 bp, Homo sapiens
tggatataaatctt

SEQ ID NO: 641744 - DNA, 17 bp, Homo sapiens
tggatatgaaagagaaa

SEQ ID NO: 641745 - DNA, 16 bp, Homo sapiens
tggatcgtggaagaag

SEQ ID NO: 641746 - DNA, 12 bp, Homo sapiens
tggatctggagt

SEQ ID NO: 641747 - DNA, 15 bp, Homo sapiens
tggatgcagaaatga

SEQ ID NO: 641748 - DNA, 18 bp, Homo sapiens
tggatgcttacagtgact

SEQ ID NO: 641749 - DNA, 15 bp, Homo sapiens
tggatgtgagtttaa

SEQ ID NO: 641750 - DNA, 14 bp, Homo sapiens
tggattcccctgga

SEQ ID NO: 641751 - DNA, 16 bp, Homo sapiens
tggatttgacacactc

SEQ ID NO: 641752 - DNA, 15 bp, Homo sapiens
tggattttaaacaaa

SEQ ID NO: 641753 - DNA, 16 bp, Homo sapiens
tggattttaaacaaaa

SEQ ID NO: 641754 - DNA, 15 bp, Homo sapiens
tggcaagctcttcat

SEQ ID NO: 641755 - DNA, 21 bp, Homo sapiens
tggcaccactagggtcctggc

SEQ ID NO: 641756 - DNA, 15 bp, Homo sapiens
tggcagcgcctcccg

SEQ ID NO: 641757 - DNA, 17 bp, Homo sapiens
tggcagcgcctcgcccc

SEQ ID NO: 641758 - DNA, 19 bp, Homo sapiens
tggcagggaagggtgcctg

SEQ ID NO: 641759 - DNA, 14 bp, Homo sapiens
tggcaggtgggctg

SEQ ID NO: 641760 - DNA, 14 bp, Homo sapiens
tggcagtgtgtcac

SEQ ID NO: 641761 - DNA, 15 bp, Homo sapiens
tggcatttagcacag

SEQ ID NO: 641762 - DNA, 18 bp, Homo sapiens
tggccacctgccaggcct

SEQ ID NO: 641763 - DNA, 21 bp, Homo sapiens
tggccacctgccaggcctccc

SEQ ID NO: 641764 - DNA, 23 bp, Homo sapiens
tggccaggggcttctccccctca

SEQ ID NO: 641765 - DNA, 18 bp, Homo sapiens
tggccagtgacatttcaa

SEQ ID NO: 641766 - DNA, 19 bp, Homo sapiens
tggccatcatttcattcgt

SEQ ID NO: 641767 - DNA, 14 bp, Homo sapiens
tggcccacccctct

SEQ ID NO: 641768 - DNA, 12 bp, Homo sapiens
tggccccagctg

SEQ ID NO: 641769 - DNA, 18 bp, Homo sapiens
tggccccctcgcgcccct

SEQ ID NO: 641770 - DNA, 21 bp, Homo sapiens
tggccccctcgcgcccctgtc

SEQ ID NO: 641771 - DNA, 17 bp, Homo sapiens
tggcccctccttctccc

SEQ ID NO: 641772 - DNA, 10 bp, Homo sapiens
tggcccctct

SEQ ID NO: 641773 - DNA, 17 bp, Homo sapiens
tggccctgccctccccc

SEQ ID NO: 641774 - DNA, 12 bp, Homo sapiens
tggccctgcctc

SEQ ID NO: 641775 - DNA, 15 bp, Homo sapiens
tggccctgcctcact

SEQ ID NO: 641776 - DNA, 17 bp, Homo sapiens
tggccctggagccaggg

SEQ ID NO: 641777 - DNA, 19 bp, Homo sapiens
tggccctggagccagggca

SEQ ID NO: 641778 - DNA, 16 bp, Homo sapiens
tggccctgtagctctg

SEQ ID NO: 641779 - DNA, 21 bp, Homo sapiens
tggccctgtgggagtccactt

SEQ ID NO: 641780 - DNA, 18 bp, Homo sapiens
tggccgaagccccttgga

SEQ ID NO: 641781 - DNA, 21 bp, Homo sapiens
tggccgctgcagtcagcacag

SEQ ID NO: 641782 - DNA, 16 bp, Homo sapiens
tggccggtaggctgct

SEQ ID NO: 641783 - DNA, 15 bp, Homo sapiens
tggcctaatccacct

SEQ ID NO: 641784 - DNA, 15 bp, Homo sapiens
tggcctctgcccctc

SEQ ID NO: 641785 - DNA, 16 bp, Homo sapiens
tggcctctgcccctct

SEQ ID NO: 641786 - DNA, 15 bp, Homo sapiens
tggcctgagaagagt

SEQ ID NO: 641787 - DNA, 18 bp, Homo sapiens
tggccttggttcctccag

SEQ ID NO: 641788 - DNA, 20 bp, Homo sapiens
tggcgccccgggccgcgagc

SEQ ID NO: 641789 - DNA, 19 bp, Homo sapiens
tggcggcaggggttggcag

SEQ ID NO: 641790 - DNA, 13 bp, Homo sapiens
tggcggccttccg

SEQ ID NO: 641791 - DNA, 12 bp, Homo sapiens
tggcgggcagcc

SEQ ID NO: 641792 - DNA, 14 bp, Homo sapiens
tggcgggcagcccc

SEQ ID NO: 641793 - DNA, 15 bp, Homo sapiens
tggcgggcagcccct

SEQ ID NO: 641794 - DNA, 20 bp, Homo sapiens
tggctgaaataaaagcctct

SEQ ID NO: 641795 - DNA, 21 bp, Homo sapiens
tggctgaaattatgtcaaatg

SEQ ID NO: 641796 - DNA, 14 bp, Homo sapiens
tggttcctcatggc

SEQ ID NO: 641797 - DNA, 15 bp, Homo sapiens
tggttctttatcatt

SEQ ID NO: 641798 - DNA, 20 bp, Homo sapiens
tggttgcaaagtgttgtctt

SEQ ID NO: 641799 - DNA, 23 bp, Homo sapiens
tggttggaggcctggtctggagc

SEQ ID NO: 641800 - DNA, 20 bp, Homo sapiens
tggttgttttttcattgtgt

SEQ ID NO: 641801 - DNA, 22 bp, Homo sapiens
tggtttttctcatttgaaatgt

SEQ ID NO: 641802 - DNA, 16 bp, Homo sapiens
tgtaaaactgtgacat

SEQ ID NO: 641803 - DNA, 21 bp, Homo sapiens
tgtaaagatattgtatctcct

SEQ ID NO: 641804 - DNA, 17 bp, Homo sapiens
tgtaaaggtaggtgcat

SEQ ID NO: 641805 - DNA, 18 bp, Homo sapiens
tgtaaaggtaggtgcatg

SEQ ID NO: 641806 - DNA, 18 bp, Homo sapiens
tgtaaaggtgatgaattt

SEQ ID NO: 641807 - DNA, 19 bp, Homo sapiens
tgtaaaggtgatgaattta

SEQ ID NO: 641808 - DNA, 17 bp, Homo sapiens
tgtaaataaaaatagct

SEQ ID NO: 641809 - DNA, 21 bp, Homo sapiens
tgtaaatgatatgtctttaaa

SEQ ID NO: 641810 - DNA, 18 bp, Homo sapiens
tgtaaatgcttgatggaa

SEQ ID NO: 641811 - DNA, 20 bp, Homo sapiens
tgtaaattttataaggctga

SEQ ID NO: 641812 - DNA, 18 bp, Homo sapiens
tgtaacttcagatgtttc

SEQ ID NO: 641813 - DNA, 22 bp, Homo sapiens
tgtaaggcactgtcaggaatgg

SEQ ID NO: 641814 - DNA, 23 bp, Homo sapiens
tgtaagtactctaatatacagtg

SEQ ID NO: 641815 - DNA, 12 bp, Homo sapiens
tgtaatatcagt

SEQ ID NO: 641816 - DNA, 21 bp, Homo sapiens
tgtaatatcagttacagtggc

SEQ ID NO: 641817 - DNA, 23 bp, Homo sapiens
tgtaatatcagttacagtggcag

SEQ ID NO: 641818 - DNA, 17 bp, Homo sapiens
tgtaatattaaattcct

SEQ ID NO: 641819 - DNA, 17 bp, Homo sapiens
tgtaatcacactctctt

SEQ ID NO: 641820 - DNA, 19 bp, Homo sapiens
tgtaattcttctcctttgt

SEQ ID NO: 641821 - DNA, 22 bp, Homo sapiens
tgtaattcttctcctttgtcaa

SEQ ID NO: 641822 - DNA, 17 bp, Homo sapiens
tgtaatttcctgctcct

SEQ ID NO: 641823 - DNA, 18 bp, Homo sapiens
tgtacaaaatatccaagc

SEQ ID NO: 641824 - DNA, 19 bp, Homo sapiens
tgtacaaaatatccaagcc

SEQ ID NO: 641825 - DNA, 22 bp, Homo sapiens
tgtacaacaccagcaacattat

SEQ ID NO: 641826 - DNA, 19 bp, Homo sapiens
tgtacacacacagacacac

SEQ ID NO: 641827 - DNA, 21 bp, Homo sapiens
tgtacagaaccagcactccca

SEQ ID NO: 641828 - DNA, 13 bp, Homo sapiens
tgtacaggctgag

SEQ ID NO: 641829 - DNA, 18 bp, Homo sapiens
tgtacaggctgagacaca

SEQ ID NO: 641830 - DNA, 13 bp, Homo sapiens
tgtacagtgttct

SEQ ID NO: 641831 - DNA, 16 bp, Homo sapiens
tgtacagtgttctgtt

SEQ ID NO: 641832 - DNA, 17 bp, Homo sapiens
tgtacatagtggtcatt

SEQ ID NO: 641833 - DNA, 20 bp, Homo sapiens
tgtactcgcttgtgcagaaa

SEQ ID NO: 641834 - DNA, 23 bp, Homo sapiens
tgtactcgcttgtgcagaaaaca

SEQ ID NO: 641835 - DNA, 14 bp, Homo sapiens
tgtacttgaataat

SEQ ID NO: 641836 - DNA, 14 bp, Homo sapiens
tgtactttacaatc

SEQ ID NO: 641837 - DNA, 20 bp, Homo sapiens
tgtagatcaactcatgttaa

SEQ ID NO: 641838 - DNA, 21 bp, Homo sapiens
tgtagatgaaaaagcatgtac

SEQ ID NO: 641839 - DNA, 18 bp, Homo sapiens
tgtagctagtttaaaatt

SEQ ID NO: 641840 - DNA, 21 bp, Homo sapiens
tgtagctagtttaaaattatt

SEQ ID NO: 641841 - DNA, 21 bp, Homo sapiens
tgtagcttctgaaaggtgctt

SEQ ID NO: 641842 - DNA, 19 bp, Homo sapiens
tgtagggcctgcatggaga

SEQ ID NO: 641843 - DNA, 15 bp, Homo sapiens
tgtatacaaacaggt

SEQ ID NO: 641844 - DNA, 18 bp, Homo sapiens
tgtatagggaattttcat

SEQ ID NO: 641845 - DNA, 19 bp, Homo sapiens
tgtatagggaattttcatt

SEQ ID NO: 641846 - DNA, 23 bp, Homo sapiens
tgtatagggaattttcattttca

SEQ ID NO: 641847 - DNA, 23 bp, Homo sapiens
tgtatatcagctctaaagcagag

SEQ ID NO: 641848 - DNA, 14 bp, Homo sapiens
tgtatatctgtgta

SEQ ID NO: 641849 - DNA, 15 bp, Homo sapiens
tgtatatctgtgtaa

SEQ ID NO: 641850 - DNA, 21 bp, Homo sapiens
tgtatatctgtgtaagacacg

SEQ ID NO: 641851 - DNA, 21 bp, Homo sapiens
tgtatatgaggatgtatgtgt

SEQ ID NO: 641852 - DNA, 18 bp, Homo sapiens
tgtatatgtttatacaca

SEQ ID NO: 641853 - DNA, 17 bp, Homo sapiens
tgtatctgacatatttc

SEQ ID NO: 641854 - DNA, 17 bp, Homo sapiens
tgtatggaagacaaata

SEQ ID NO: 641855 - DNA, 18 bp, Homo sapiens
tgtatggaagacaaatac

SEQ ID NO: 641856 - DNA, 22 bp, Homo sapiens
tgtatggaagacaaatacacat

SEQ ID NO: 641857 - DNA, 23 bp, Homo sapiens
tgtatggaagacaaatacacata

SEQ ID NO: 641858 - DNA, 12 bp, Homo sapiens
tgtatgtccatt

SEQ ID NO: 641859 - DNA, 13 bp, Homo sapiens
tgtatgtgtatat

SEQ ID NO: 641860 - DNA, 18 bp, Homo sapiens
tgtattggaagtatagat

SEQ ID NO: 641861 - DNA, 19 bp, Homo sapiens
tgtattgtgtcttttgcat

SEQ ID NO: 641862 - DNA, 23 bp, Homo sapiens
tgtatttacttgttatgttgtaa

SEQ ID NO: 641863 - DNA, 14 bp, Homo sapiens
tgtatttgaggaaa

SEQ ID NO: 641864 - DNA, 23 bp, Homo sapiens
tgtatttgaggaaactcatacag

SEQ ID NO: 641865 - DNA, 13 bp, Homo sapiens
tgtattttaataa

SEQ ID NO: 641866 - DNA, 21 bp, Homo sapiens
tgtattttctgtgttgttcat

SEQ ID NO: 641867 - DNA, 23 bp, Homo sapiens
tgtcaaatggtattttttgtgaa

SEQ ID NO: 641868 - DNA, 15 bp, Homo sapiens
tgtcaatatatagag

SEQ ID NO: 641869 - DNA, 11 bp, Homo sapiens
tgtcagaatgt

SEQ ID NO: 641870 - DNA, 12 bp, Homo sapiens
tgtcagaatgtt

SEQ ID NO: 641871 - DNA, 14 bp, Homo sapiens
tgtcagcttcccaa

SEQ ID NO: 641872 - DNA, 15 bp, Homo sapiens
tgtcaggctctgaat

SEQ ID NO: 641873 - DNA, 19 bp, Homo sapiens
tgtcagtttgtgaagtgat

SEQ ID NO: 641874 - DNA, 14 bp, Homo sapiens
tgtcatctgtcagc

SEQ ID NO: 641875 - DNA, 13 bp, Homo sapiens
tgtcattcatatg

SEQ ID NO: 641876 - DNA, 14 bp, Homo sapiens
tgtcattctgctaa

SEQ ID NO: 641877 - DNA, 16 bp, Homo sapiens
tgtcatttcatacaaa

SEQ ID NO: 641878 - DNA, 17 bp, Homo sapiens
tgtcatttcatacaaat

SEQ ID NO: 641879 - DNA, 23 bp, Homo sapiens
tgtccactctgaataccaagtgt

SEQ ID NO: 641880 - DNA, 13 bp, Homo sapiens
tgtccatccgtct

SEQ ID NO: 641881 - DNA, 19 bp, Homo sapiens
tgtccatccgtctctgtcc

SEQ ID NO: 641882 - DNA, 15 bp, Homo sapiens
tgtccattgacatgt

SEQ ID NO: 641883 - DNA, 22 bp, Homo sapiens
tgtccattgacatgtacagaga

SEQ ID NO: 641884 - DNA, 22 bp, Homo sapiens
tgtcccacccccagcagctcac

SEQ ID NO: 641885 - DNA, 20 bp, Homo sapiens
tgtccctgtgggctcacacc

SEQ ID NO: 641886 - DNA, 12 bp, Homo sapiens
tgtcccttcccc

SEQ ID NO: 641887 - DNA, 20 bp, Homo sapiens
tgtccgcgtcctttcctctc

SEQ ID NO: 641888 - DNA, 16 bp, Homo sapiens
tgtcctaaatgcaaag

SEQ ID NO: 641889 - DNA, 16 bp, Homo sapiens
tgtcctatccccggac

SEQ ID NO: 641890 - DNA, 15 bp, Homo sapiens
tgtcctatccctgga

SEQ ID NO: 641891 - DNA, 16 bp, Homo sapiens
tgtcctctgtccgtct

SEQ ID NO: 641892 - DNA, 20 bp, Homo sapiens
tgtcctgcatgtatgccatg

SEQ ID NO: 641893 - DNA, 13 bp, Homo sapiens
tgtcctgcgcctg

SEQ ID NO: 641894 - DNA, 17 bp, Homo sapiens
tgtcctgctcacgtctg

SEQ ID NO: 641895 - DNA, 14 bp, Homo sapiens
tgtcctggctccca

SEQ ID NO: 641896 - DNA, 13 bp, Homo sapiens
tgtcctgtagctt

SEQ ID NO: 641897 - DNA, 17 bp, Homo sapiens
tgtcctttatgtattct

SEQ ID NO: 641898 - DNA, 22 bp, Homo sapiens
tgtcgggcccgcactcaggagc

SEQ ID NO: 641899 - DNA, 17 bp, Homo sapiens
tgtctaatgtattttat

SEQ ID NO: 641900 - DNA, 18 bp, Homo sapiens
tgtctatttctgctgaat

SEQ ID NO: 641901 - DNA, 15 bp, Homo sapiens
tgtctcctctgtcag

SEQ ID NO: 641902 - DNA, 16 bp, Homo sapiens
tgtctcctctgtcagt

SEQ ID NO: 641903 - DNA, 16 bp, Homo sapiens
tgtctctccctaccct

SEQ ID NO: 641904 - DNA, 19 bp, Homo sapiens
tgtctctccctaccctctt

SEQ ID NO: 641905 - DNA, 23 bp, Homo sapiens
tgtctctccctaccctcttctca

SEQ ID NO: 641906 - DNA, 18 bp, Homo sapiens
tgtctctcttttgctctc

SEQ ID NO: 641907 - DNA, 13 bp, Homo sapiens
tgtctgagccctg

SEQ ID NO: 641908 - DNA, 22 bp, Homo sapiens
tgtctgagccctgccctcactc

SEQ ID NO: 641909 - DNA, 18 bp, Homo sapiens
tgtctgctgctgcctccc

SEQ ID NO: 641910 - DNA, 14 bp, Homo sapiens
tgtctggagcctgc

SEQ ID NO: 641911 - DNA, 15 bp, Homo sapiens
tgtctggctgtggcc

SEQ ID NO: 641912 - DNA, 15 bp, Homo sapiens
tgttgtccctgcagg

SEQ ID NO: 641913 - DNA, 22 bp, Homo sapiens
tgttgtcctgtgtcatctgtca

SEQ ID NO: 641914 - DNA, 19 bp, Homo sapiens
tgtttaacttaatcaatta

SEQ ID NO: 641915 - DNA, 20 bp, Homo sapiens
tgtttaacttaatcaattaa

SEQ ID NO: 641916 - DNA, 19 bp, Homo sapiens
tgtttaagaaatgagaaat

SEQ ID NO: 641917 - DNA, 21 bp, Homo sapiens
tgtttaagaaatgagaaattg

SEQ ID NO: 641918 - DNA, 16 bp, Homo sapiens
tgtttaataatatgta

SEQ ID NO: 641919 - DNA, 21 bp, Homo sapiens
tgtttacatcagttttaacga

SEQ ID NO: 641920 - DNA, 15 bp, Homo sapiens
tgtttaccctccctg

SEQ ID NO: 641921 - DNA, 22 bp, Homo sapiens
tgtttaccctccctgtcccctg

SEQ ID NO: 641922 - DNA, 20 bp, Homo sapiens
tgtttagacttcctctcatt

SEQ ID NO: 641923 - DNA, 22 bp, Homo sapiens
tgtttagtagctgataaagaaa

SEQ ID NO: 641924 - DNA, 22 bp, Homo sapiens
tgtttagtcagtgtactctgag

SEQ ID NO: 641925 - DNA, 23 bp, Homo sapiens
tgtttatttttgctctccctccc

SEQ ID NO: 641926 - DNA, 20 bp, Homo sapiens
tgtttctgcagtattctgta

SEQ ID NO: 641927 - DNA, 14 bp, Homo sapiens
tgtttgtcctttat

SEQ ID NO: 641928 - DNA, 23 bp, Homo sapiens
tgtttgtcctttatgtattctct

SEQ ID NO: 641929 - DNA, 20 bp, Homo sapiens
tgttttacaaagaaacaaaa

SEQ ID NO: 641930 - DNA, 12 bp, Homo sapiens
tgttttcattct

SEQ ID NO: 641931 - DNA, 17 bp, Homo sapiens
tgttttgctttttctga

SEQ ID NO: 641932 - DNA, 12 bp, Homo sapiens
tgttttgtggat

SEQ ID NO: 641933 - DNA, 18 bp, Homo sapiens
tgttttgtggataagaaa

SEQ ID NO: 641934 - DNA, 13 bp, Homo sapiens
tgtttttcagtta

SEQ ID NO: 641935 - DNA, 21 bp, Homo sapiens
tgttttttcattgtgttttct

SEQ ID NO: 641936 - DNA, 20 bp, Homo sapiens
ttaaaaaaaatattctgtca

SEQ ID NO: 641937 - DNA, 18 bp, Homo sapiens
ttaaaaaaataaaacatt

SEQ ID NO: 641938 - DNA, 16 bp, Homo sapiens
ttaaaaagacactttt

SEQ ID NO: 641939 - DNA, 15 bp, Homo sapiens
ttaaaaatgtatgtt

SEQ ID NO: 641940 - DNA, 13 bp, Homo sapiens
ttaaaacaaaatc

SEQ ID NO: 641941 - DNA, 15 bp, Homo sapiens
ttaaaataattatat

SEQ ID NO: 641942 - DNA, 19 bp, Homo sapiens
ttaaaataattatatgaag

SEQ ID NO: 641943 - DNA, 17 bp, Homo sapiens
ttaaaatattttcttaa

SEQ ID NO: 641944 - DNA, 23 bp, Homo sapiens
ttaaaatcatatttacctgtgaa

SEQ ID NO: 641945 - DNA, 23 bp, Homo sapiens
ttaaaatgattcacttttattgt

SEQ ID NO: 641946 - DNA, 13 bp, Homo sapiens
ttaaaattattaa

SEQ ID NO: 641947 - DNA, 14 bp, Homo sapiens
ttaaacaaaattta

SEQ ID NO: 641948 - DNA, 23 bp, Homo sapiens
ttaaacaaaatttatgtcatttt

SEQ ID NO: 641949 - DNA, 23 bp, Homo sapiens
ttaaagaagtccatgtgataatt

SEQ ID NO: 641950 - DNA, 12 bp, Homo sapiens
ttaaagcagcaa

SEQ ID NO: 641951 - DNA, 22 bp, Homo sapiens
ttaaagtgtccattgacatgta

SEQ ID NO: 641952 - DNA, 13 bp, Homo sapiens
ttaaatgaaatac

SEQ ID NO: 641953 - DNA, 18 bp, Homo sapiens
ttaaatgtctaatgtatt

SEQ ID NO: 641954 - DNA, 22 bp, Homo sapiens
ttaaatgtctaatgtattttat

SEQ ID NO: 641955 - DNA, 20 bp, Homo sapiens
ttaaattatcattgtttgtc

SEQ ID NO: 641956 - DNA, 13 bp, Homo sapiens
ttaaattgtggat

SEQ ID NO: 641957 - DNA, 19 bp, Homo sapiens
ttaaatttattaaatgttg

SEQ ID NO: 641958 - DNA, 22 bp, Homo sapiens
ttaaatttcttggtgctttgtc

SEQ ID NO: 641959 - DNA, 14 bp, Homo sapiens
ttaacagtaaatat

SEQ ID NO: 641960 - DNA, 17 bp, Homo sapiens
ttaacagtaaatataca

SEQ ID NO: 641961 - DNA, 19 bp, Homo sapiens
ttaacataaacttgtactt

SEQ ID NO: 641962 - DNA, 20 bp, Homo sapiens
ttaacataaacttgtactta

SEQ ID NO: 641963 - DNA, 15 bp, Homo sapiens
ttaacatagcagctg

SEQ ID NO: 641964 - DNA, 14 bp, Homo sapiens
ttaactaatgtaaa

SEQ ID NO: 641965 - DNA, 15 bp, Homo sapiens
ttaacttatctccag

SEQ ID NO: 641966 - DNA, 16 bp, Homo sapiens
ttaagagattttatgt

SEQ ID NO: 641967 - DNA, 21 bp, Homo sapiens
ttaagcacaaaaaatttaaga

SEQ ID NO: 641968 - DNA, 19 bp, Homo sapiens
ttaaggactacagaattgg

SEQ ID NO: 641969 - DNA, 22 bp, Homo sapiens
ttaaggttatttatttaaatgt

SEQ ID NO: 641970 - DNA, 16 bp, Homo sapiens
ttaagtaatttcatgc

SEQ ID NO: 641971 - DNA, 21 bp, Homo sapiens
ttaagtgcttgaggccaaatg

SEQ ID NO: 641972 - DNA, 15 bp, Homo sapiens
ttaagtgttctgtgg

SEQ ID NO: 641973 - DNA, 16 bp, Homo sapiens
ttaagtgttctgtggc

SEQ ID NO: 641974 - DNA, 16 bp, Homo sapiens
ttaataatatgtacaa

SEQ ID NO: 641975 - DNA, 17 bp, Homo sapiens
ttaataggaggacagaa

SEQ ID NO: 641976 - DNA, 16 bp, Homo sapiens
ttaatcatttccagca

SEQ ID NO: 641977 - DNA, 13 bp, Homo sapiens
ttaatctagagct

SEQ ID NO: 641978 - DNA, 13 bp, Homo sapiens
ttaatcttcatgg

SEQ ID NO: 641979 - DNA, 22 bp, Homo sapiens
ttaatgagatgttattactgtt

SEQ ID NO: 641980 - DNA, 11 bp, Homo sapiens
ttaattgaaag

SEQ ID NO: 641981 - DNA, 12 bp, Homo sapiens
ttaattgaaagg

SEQ ID NO: 641982 - DNA, 20 bp, Homo sapiens
ttaattgaaagggacaagta

SEQ ID NO: 641983 - DNA, 23 bp, Homo sapiens
ttaatttagcagtccatttttga

SEQ ID NO: 641984 - DNA, 20 bp, Homo sapiens
ttaatttattaaatttatta

SEQ ID NO: 641985 - DNA, 17 bp, Homo sapiens
ttacaaaatcttaacct

SEQ ID NO: 641986 - DNA, 11 bp, Homo sapiens
ttacaaacaag

SEQ ID NO: 641987 - DNA, 17 bp, Homo sapiens
ttacaaagaaacaaaat

SEQ ID NO: 641988 - DNA, 12 bp, Homo sapiens
ttacaaagccag

SEQ ID NO: 641989 - DNA, 20 bp, Homo sapiens
ttacaacaagcaaactgaaa

SEQ ID NO: 641990 - DNA, 13 bp, Homo sapiens
ttacaacttccag

SEQ ID NO: 641991 - DNA, 17 bp, Homo sapiens
ttacaatcatgcctaca

SEQ ID NO: 641992 - DNA, 19 bp, Homo sapiens
ttacacacctgagaatgtg

SEQ ID NO: 641993 - DNA, 22 bp, Homo sapiens
ttacacacctgagaatgtgcct

SEQ ID NO: 641994 - DNA, 13 bp, Homo sapiens
ttacacccttgtc

SEQ ID NO: 641995 - DNA, 15 bp, Homo sapiens
ttacacgaagaaata

SEQ ID NO: 641996 - DNA, 22 bp, Homo sapiens
ttacagtaggagtgagaaattt

SEQ ID NO: 641997 - DNA, 12 bp, Homo sapiens
ttacagtgactg

SEQ ID NO: 641998 - DNA, 18 bp, Homo sapiens
ttaccacaggatgcatat

SEQ ID NO: 641999 - DNA, 20 bp, Homo sapiens
ttaccacttgcactattctt

SEQ ID NO: 642000 - DNA, 12 bp, Homo sapiens
ttaccctccctg

SEQ ID NO: 642001 - DNA, 12 bp, Homo sapiens
ttaccgcccacc

SEQ ID NO: 642002 - DNA, 17 bp, Homo sapiens
ttacctgttgtctgaaa

SEQ ID NO: 642003 - DNA, 22 bp, Homo sapiens
ttactaacagtaactgccattt

SEQ ID NO: 642004 - DNA, 16 bp, Homo sapiens
ttactatgtaaatgct

SEQ ID NO: 642005 - DNA, 18 bp, Homo sapiens
ttactcaggctttctatt

SEQ ID NO: 642006 - DNA, 19 bp, Homo sapiens
ttactgacatggtgctgtg

SEQ ID NO: 642007 - DNA, 17 bp, Homo sapiens
ttactggccttttcact

SEQ ID NO: 642008 - DNA, 15 bp, Homo sapiens
ttacttgattaagga

SEQ ID NO: 642009 - DNA, 15 bp, Homo sapiens
ttagaaattctataa

SEQ ID NO: 642010 - DNA, 17 bp, Homo sapiens
ttagaagagcctgactg

SEQ ID NO: 642011 - DNA, 18 bp, Homo sapiens
ttagaatcaagtctgtga

SEQ ID NO: 642012 - DNA, 15 bp, Homo sapiens
ttagaatgtgaaaaa

SEQ ID NO: 642013 - DNA, 21 bp, Homo sapiens
ttagacaatgtggaattacat

SEQ ID NO: 642014 - DNA, 19 bp, Homo sapiens
ttagagataccctctgaga

SEQ ID NO: 642015 - DNA, 17 bp, Homo sapiens
ttagattcctacttaaa

SEQ ID NO: 642016 - DNA, 18 bp, Homo sapiens
ttagattcctacttaaac

SEQ ID NO: 642017 - DNA, 13 bp, Homo sapiens
ttagcacagtatt

SEQ ID NO: 642018 - DNA, 14 bp, Homo sapiens
ttagcacagtattt

SEQ ID NO: 642019 - DNA, 17 bp, Homo sapiens
ttagcacagtatttaac

SEQ ID NO: 642020 - DNA, 19 bp, Homo sapiens
ttagcacagtatttaacat

SEQ ID NO: 642021 - DNA, 22 bp, Homo sapiens
ttagcagctcttcccctttcct

SEQ ID NO: 642022 - DNA, 21 bp, Homo sapiens
ttagcatgagttctgcacata

SEQ ID NO: 642023 - DNA, 15 bp, Homo sapiens
ttaggaaatgaatgt

SEQ ID NO: 642024 - DNA, 17 bp, Homo sapiens
ttaggaaatgaatgtgt

SEQ ID NO: 642025 - DNA, 14 bp, Homo sapiens
ttaggaatgctcaa

SEQ ID NO: 642026 - DNA, 15 bp, Homo sapiens
ttaggaatgctcaat

SEQ ID NO: 642027 - DNA, 19 bp, Homo sapiens
ttaggaatgctcaatgtgc

SEQ ID NO: 642028 - DNA, 22 bp, Homo sapiens
aaagacggaatgaccagaaaat

SEQ ID NO: 642029 - DNA, 15 bp, Homo sapiens
aaagacttcatttaa

SEQ ID NO: 642030 - DNA, 21 bp, Homo sapiens
aaagacttcatttaacactga

SEQ ID NO: 642031 - DNA, 15 bp, Homo sapiens
aaagagaaaatgctt

SEQ ID NO: 642032 - DNA, 21 bp, Homo sapiens
aaagagaaaatgctttctcat

SEQ ID NO: 642033 - DNA, 23 bp, Homo sapiens
aaagagtagaactttaaaagaag

SEQ ID NO: 642034 - DNA, 18 bp, Homo sapiens
aaagatattgtatctcct

SEQ ID NO: 642035 - DNA, 17 bp, Homo sapiens
aaagatccagggatgga

SEQ ID NO: 642036 - DNA, 21 bp, Homo sapiens
aaagatctccagttgtatcct

SEQ ID NO: 642037 - DNA, 18 bp, Homo sapiens
aaagatctcctgtgcacc

SEQ ID NO: 642038 - DNA, 16 bp, Homo sapiens
aaagatctttttttaa

SEQ ID NO: 642039 - DNA, 21 bp, Homo sapiens
aaagatggatttgacacactc

SEQ ID NO: 642040 - DNA, 22 bp, Homo sapiens
aaagatggatttgacacactca

SEQ ID NO: 642041 - DNA, 15 bp, Homo sapiens
aaagattccatgggt

SEQ ID NO: 642042 - DNA, 19 bp, Homo sapiens
aaagcaactgtctatttct

SEQ ID NO: 642043 - DNA, 21 bp, Homo sapiens
aaagcaactgtctatttctgc

SEQ ID NO: 642044 - DNA, 20 bp, Homo sapiens
aaagcagagatgtattatgg

SEQ ID NO: 642045 - DNA, 13 bp, Homo sapiens
aaagcagcaaagg

SEQ ID NO: 642046 - DNA, 20 bp, Homo sapiens
aaagcaggaaagatcccaag

SEQ ID NO: 642047 - DNA, 21 bp, Homo sapiens
aaagcaggaaagatcccaagt

SEQ ID NO: 642048 - DNA, 17 bp, Homo sapiens
aaagcatgccaatttct

SEQ ID NO: 642049 - DNA, 13 bp, Homo sapiens
aaagcatgctcag

SEQ ID NO: 642050 - DNA, 18 bp, Homo sapiens
aaagcatgctcagtattg

SEQ ID NO: 642051 - DNA, 19 bp, Homo sapiens
aaagcatgctcagtattga

SEQ ID NO: 642052 - DNA, 11 bp, Homo sapiens
aaagcatgtac

SEQ ID NO: 642053 - DNA, 12 bp, Homo sapiens
aaagcatgtaca

SEQ ID NO: 642054 - DNA, 22 bp, Homo sapiens
aaagcctctggtggaacctgca

SEQ ID NO: 642055 - DNA, 15 bp, Homo sapiens
aaagctatttaagtg

SEQ ID NO: 642056 - DNA, 16 bp, Homo sapiens
aaaggatgatttaaca

SEQ ID NO: 642057 - DNA, 23 bp, Homo sapiens
aaaggcagccctcacctctgagg

SEQ ID NO: 642058 - DNA, 18 bp, Homo sapiens
aaagggaaggctgctgtg

SEQ ID NO: 642059 - DNA, 16 bp, Homo sapiens
aaaggtgatgaattta

SEQ ID NO: 642060 - DNA, 15 bp, Homo sapiens
aaaggtgcctcatag

SEQ ID NO: 642061 - DNA, 19 bp, Homo sapiens
aaaggtttcactgttcatg

SEQ ID NO: 642062 - DNA, 22 bp, Homo sapiens
aaaggtttcactgttcatgaat

SEQ ID NO: 642063 - DNA, 20 bp, Homo sapiens
aaagtcaagtctacctgcct

SEQ ID NO: 642064 - DNA, 17 bp, Homo sapiens
aaagtctcctgtatcat

SEQ ID NO: 642065 - DNA, 12 bp, Homo sapiens
aaagtctgagaa

SEQ ID NO: 642066 - DNA, 15 bp, Homo sapiens
aaagtctgagaaatt

SEQ ID NO: 642067 - DNA, 16 bp, Homo sapiens
aaagtctgagaaattt

SEQ ID NO: 642068 - DNA, 16 bp, Homo sapiens
aaagtgtagcaccctg

SEQ ID NO: 642069 - DNA, 21 bp, Homo sapiens
aaagtgtccattgacatgtac

SEQ ID NO: 642070 - DNA, 17 bp, Homo sapiens
aaagtgttgtcttattc

SEQ ID NO: 642071 - DNA, 18 bp, Homo sapiens
aaagtgtttttacatata

SEQ ID NO: 642072 - DNA, 20 bp, Homo sapiens
aaagttaaacgtgatgtgct

SEQ ID NO: 642073 - DNA, 18 bp, Homo sapiens
aaagttgtgattctttga

SEQ ID NO: 642074 - DNA, 13 bp, Homo sapiens
aaagttttgccta

SEQ ID NO: 642075 - DNA, 13 bp, Homo sapiens
aaataaaacattt

SEQ ID NO: 642076 - DNA, 23 bp, Homo sapiens
aaataaaacattttaaatggaca

SEQ ID NO: 642077 - DNA, 14 bp, Homo sapiens
aaataaaaccagaa

SEQ ID NO: 642078 - DNA, 24 bp, Homo sapiens
aaataaagagttctccttgtactt

SEQ ID NO: 642079 - DNA, 12 bp, Homo sapiens
aaataaatatca

SEQ ID NO: 642080 - DNA, 12 bp, Homo sapiens
aaataaatctaa

SEQ ID NO: 642081 - DNA, 13 bp, Homo sapiens
aaataaccctgaa

SEQ ID NO: 642082 - DNA, 18 bp, Homo sapiens
aaataaccctgaatcaga

SEQ ID NO: 642083 - DNA, 18 bp, Homo sapiens
aaataagccaaaataaga

SEQ ID NO: 642084 - DNA, 21 bp, Homo sapiens
aaataagtagtgtcattcata

SEQ ID NO: 642085 - DNA, 17 bp, Homo sapiens
aaataatgattcaatgt

SEQ ID NO: 642086 - DNA, 22 bp, Homo sapiens
aaataatgcttaacataaactt

SEQ ID NO: 642087 - DNA, 15 bp, Homo sapiens
aaatacacatacata

SEQ ID NO: 642088 - DNA, 18 bp, Homo sapiens
aaatacacgtgtatatga

SEQ ID NO: 642089 - DNA, 20 bp, Homo sapiens
aaatacatgatgatttcaga

SEQ ID NO: 642090 - DNA, 13 bp, Homo sapiens
aaatacattccag

SEQ ID NO: 642091 - DNA, 15 bp, Homo sapiens
aaatacattccagtg

SEQ ID NO: 642092 - DNA, 18 bp, Homo sapiens
aaatagaataggcaaact

SEQ ID NO: 642093 - DNA, 18 bp, Homo sapiens
aaatagcatgtattgtgt

SEQ ID NO: 642094 - DNA, 13 bp, Homo sapiens
aaatagctataaa

SEQ ID NO: 642095 - DNA, 18 bp, Homo sapiens
aaatagctataaatagtg

SEQ ID NO: 642096 - DNA, 18 bp, Homo sapiens
aaatagggcaaagaatca

SEQ ID NO: 642097 - DNA, 19 bp, Homo sapiens
aaatagtcatgtttctgca

SEQ ID NO: 642098 - DNA, 13 bp, Homo sapiens
aaatagtgaaaat

SEQ ID NO: 642099 - DNA, 18 bp, Homo sapiens
aaatagttccattctatg

SEQ ID NO: 642100 - DNA, 20 bp, Homo sapiens
aaatagttgagccagcagac

SEQ ID NO: 642101 - DNA, 23 bp, Homo sapiens
aaatagttgagccagcagacatt

SEQ ID NO: 642102 - DNA, 12 bp, Homo sapiens
aaatataaaaat

SEQ ID NO: 642103 - DNA, 16 bp, Homo sapiens
aaatataaactgtgag

SEQ ID NO: 642104 - DNA, 15 bp, Homo sapiens
aaatataaatcacag

SEQ ID NO: 642105 - DNA, 16 bp, Homo sapiens
aaatatacactttaca

SEQ ID NO: 642106 - DNA, 15 bp, Homo sapiens
aaatatagtgttgtg

SEQ ID NO: 642107 - DNA, 16 bp, Homo sapiens
aaatatagtgttgtgt

SEQ ID NO: 642108 - DNA, 21 bp, Homo sapiens
aaatatagtgttgtgttacaa

SEQ ID NO: 642109 - DNA, 17 bp, Homo sapiens
aaatatatgtttggctg

SEQ ID NO: 642110 - DNA, 14 bp, Homo sapiens
aaatatcattatag

SEQ ID NO: 642111 - DNA, 19 bp, Homo sapiens
aaatatcattatagcatgt

SEQ ID NO: 642112 - DNA, 15 bp, Homo sapiens
aaatatctatttatc

SEQ ID NO: 642113 - DNA, 13 bp, Homo sapiens
aaatattactata

SEQ ID NO: 642114 - DNA, 20 bp, Homo sapiens
aaatattgctgtctgaaaaa

SEQ ID NO: 642115 - DNA, 22 bp, Homo sapiens
aaatattgctgtctgaaaaagt

SEQ ID NO: 642116 - DNA, 17 bp, Homo sapiens
aaatattttctacttta

SEQ ID NO: 642117 - DNA, 22 bp, Homo sapiens
aaatattttctactttaaattg

SEQ ID NO: 642118 - DNA, 17 bp, Homo sapiens
aaatatttttttgtaga

SEQ ID NO: 642119 - DNA, 21 bp, Homo sapiens
aaatatttttttgtagatgaa

SEQ ID NO: 642120 - DNA, 17 bp, Homo sapiens
aaatcaaatttttctgg

SEQ ID NO: 642121 - DNA, 13 bp, Homo sapiens
aaatcaatttaaa

SEQ ID NO: 642122 - DNA, 16 bp, Homo sapiens
aaatcacagatttcca

SEQ ID NO: 642123 - DNA, 22 bp, Homo sapiens
aaatcatatttacctgtgaatc

SEQ ID NO: 642124 - DNA, 13 bp, Homo sapiens
aaatcattttgat

SEQ ID NO: 642125 - DNA, 22 bp, Homo sapiens
aaatctaaattaacttctattt

SEQ ID NO: 642126 - DNA, 15 bp, Homo sapiens
aaatctacaaacttt

SEQ ID NO: 642127 - DNA, 21 bp, Homo sapiens
aaatctcaaaagatctcctgt

SEQ ID NO: 642128 - DNA, 13 bp, Homo sapiens
aaatctgaatttc

SEQ ID NO: 642129 - DNA, 14 bp, Homo sapiens
aaatctgaatttct

SEQ ID NO: 642130 - DNA, 16 bp, Homo sapiens
aaatctgaatttctaa

SEQ ID NO: 642131 - DNA, 13 bp, Homo sapiens
aaatctgctttca

SEQ ID NO: 642132 - DNA, 15 bp, Homo sapiens
aaatctgtattgcta

SEQ ID NO: 642133 - DNA, 16 bp, Homo sapiens
aaatctttgttaaaat

SEQ ID NO: 642134 - DNA, 14 bp, Homo sapiens
aaatgaatgaaata

SEQ ID NO: 642135 - DNA, 15 bp, Homo sapiens
aaatgaattgccttt

SEQ ID NO: 642136 - DNA, 14 bp, Homo sapiens
aaatgaatttatca

SEQ ID NO: 642137 - DNA, 19 bp, Homo sapiens
aaatgaatttatcatttta

SEQ ID NO: 642138 - DNA, 20 bp, Homo sapiens
aaatgagttcccttgattca

SEQ ID NO: 642139 - DNA, 20 bp, Homo sapiens
aaatgatatgtctttaaaat

SEQ ID NO: 642140 - DNA, 13 bp, Homo sapiens
aaatgattcactt

SEQ ID NO: 642141 - DNA, 13 bp, Homo sapiens
aaatgctttctca

SEQ ID NO: 642142 - DNA, 14 bp, Homo sapiens
aaatgctttctcat

SEQ ID NO: 642143 - DNA, 15 bp, Homo sapiens
aaatgctttctcatg

SEQ ID NO: 642144 - DNA, 21 bp, Homo sapiens
aaatgctttctcatgcataga

SEQ ID NO: 642145 - DNA, 17 bp, Homo sapiens
aaatgctttgaaaatgt

SEQ ID NO: 642146 - DNA, 14 bp, Homo sapiens
aaatggatgtaata

SEQ ID NO: 642147 - DNA, 21 bp, Homo sapiens
aagaaaaaagtgcaacttgag

SEQ ID NO: 642148 - DNA, 16 bp, Homo sapiens
aagaaacagtttaaca

SEQ ID NO: 642149 - DNA, 17 bp, Homo sapiens
aagaaaccttttaaaaa

SEQ ID NO: 642150 - DNA, 13 bp, Homo sapiens
aagaaagaaaaaa

SEQ ID NO: 642151 - DNA, 13 bp, Homo sapiens
aagaaatagcaga

SEQ ID NO: 642152 - DNA, 12 bp, Homo sapiens
aagaaatgagaa

SEQ ID NO: 642153 - DNA, 14 bp, Homo sapiens
aagaacccccctcc

SEQ ID NO: 642154 - DNA, 18 bp, Homo sapiens
aagaacccccctccccaa

SEQ ID NO: 642155 - DNA, 13 bp, Homo sapiens
aagaactgcccca

SEQ ID NO: 642156 - DNA, 23 bp, Homo sapiens
aagaactgccccatctcctccca

SEQ ID NO: 642157 - DNA, 21 bp, Homo sapiens
aagaagatagttgtaaagata

SEQ ID NO: 642158 - DNA, 16 bp, Homo sapiens
aagaagcaaataaata

SEQ ID NO: 642159 - DNA, 15 bp, Homo sapiens
aagaaggactgaaga

SEQ ID NO: 642160 - DNA, 21 bp, Homo sapiens
aagaatcacctaattaatttc

SEQ ID NO: 642161 - DNA, 22 bp, Homo sapiens
aagaatcatcctcatgccttta

SEQ ID NO: 642162 - DNA, 16 bp, Homo sapiens
aagaattcatgatgct

SEQ ID NO: 642163 - DNA, 22 bp, Homo sapiens
aagaattcatgatgctagttct

SEQ ID NO: 642164 - DNA, 14 bp, Homo sapiens
aagacaaatacaca

SEQ ID NO: 642165 - DNA, 15 bp, Homo sapiens
aagacaaatacacat

SEQ ID NO: 642166 - DNA, 18 bp, Homo sapiens
aagacaaatacacataca

SEQ ID NO: 642167 - DNA, 16 bp, Homo sapiens
aagacagccatacttc

SEQ ID NO: 642168 - DNA, 17 bp, Homo sapiens
aagacagccatacttcc

SEQ ID NO: 642169 - DNA, 17 bp, Homo sapiens
aagaccatgcattcaga

SEQ ID NO: 642170 - DNA, 14 bp, Homo sapiens
aagactatgttctc

SEQ ID NO: 642171 - DNA, 18 bp, Homo sapiens
aagagaaaatgctttctc

SEQ ID NO: 642172 - DNA, 21 bp, Homo sapiens
aagagaaacactaatggccaa

SEQ ID NO: 642173 - DNA, 16 bp, Homo sapiens
aagagagatatatctg

SEQ ID NO: 642174 - DNA, 17 bp, Homo sapiens
aagagctcaggagaagg

SEQ ID NO: 642175 - DNA, 19 bp, Homo sapiens
aagagctgctgtatttgag

SEQ ID NO: 642176 - DNA, 12 bp, Homo sapiens
aagatagctcct

SEQ ID NO: 642177 - DNA, 16 bp, Homo sapiens
aagatagttgtaaaga

SEQ ID NO: 642178 - DNA, 15 bp, Homo sapiens
aagatagtttattat

SEQ ID NO: 642179 - DNA, 21 bp, Homo sapiens
aagatattgtatctcctttaa

SEQ ID NO: 642180 - DNA, 22 bp, Homo sapiens
aagatattgtatctcctttaat

SEQ ID NO: 642181 - DNA, 20 bp, Homo sapiens
aagatctccagttgtatcct

SEQ ID NO: 642182 - DNA, 16 bp, Homo sapiens
aagatctgactgccaa

SEQ ID NO: 642183 - DNA, 18 bp, Homo sapiens
aagatctgactgccaaat

SEQ ID NO: 642184 - DNA, 14 bp, Homo sapiens
aagatgctgctgag

SEQ ID NO: 642185 - DNA, 19 bp, Homo sapiens
aagatggatttgacacact

SEQ ID NO: 642186 - DNA, 15 bp, Homo sapiens
aagattatatacaaa

SEQ ID NO: 642187 - DNA, 21 bp, Homo sapiens
aagattatatacaaagctgtc

SEQ ID NO: 642188 - DNA, 20 bp, Homo sapiens
aagattgaagctaaaacact

SEQ ID NO: 642189 - DNA, 15 bp, Homo sapiens
aagcaaactgaaatt

SEQ ID NO: 642190 - DNA, 16 bp, Homo sapiens
aagcaaactgaaatta

SEQ ID NO: 642191 - DNA, 20 bp, Homo sapiens
aagcaaactgaaattagtgt

SEQ ID NO: 642192 - DNA, 21 bp, Homo sapiens
aagcaactgtctatttctgct

SEQ ID NO: 642193 - DNA, 22 bp, Homo sapiens
aagcaactgtctatttctgctg

SEQ ID NO: 642194 - DNA, 20 bp, Homo sapiens
aagcacaataaaagacatcc

SEQ ID NO: 642195 - DNA, 15 bp, Homo sapiens
aagcacacacatctg

SEQ ID NO: 642196 - DNA, 13 bp, Homo sapiens
aagcaccctgttc

SEQ ID NO: 642197 - DNA, 18 bp, Homo sapiens
aagcacctcttgaagaac

SEQ ID NO: 642198 - DNA, 19 bp, Homo sapiens
aagcacctcttgaagaact

SEQ ID NO: 642199 - DNA, 21 bp, Homo sapiens
aagcacctcttgaagaactga

SEQ ID NO: 642200 - DNA, 23 bp, Homo sapiens
aagcagaatgagatgatttaatt

SEQ ID NO: 642201 - DNA, 14 bp, Homo sapiens
aagcagacacacac

SEQ ID NO: 642202 - DNA, 16 bp, Homo sapiens
aagcagacacacacat

SEQ ID NO: 642203 - DNA, 20 bp, Homo sapiens
aagcagacacacacatatat

SEQ ID NO: 642204 - DNA, 22 bp, Homo sapiens
aagcagagtcaagctgatgaag

SEQ ID NO: 642205 - DNA, 21 bp, Homo sapiens
aagcagcaaggtgggggtcag

SEQ ID NO: 642206 - DNA, 18 bp, Homo sapiens
aagcagcagctagaaaga

SEQ ID NO: 642207 - DNA, 20 bp, Homo sapiens
aagcagtatgtacaggctga

SEQ ID NO: 642208 - DNA, 12 bp, Homo sapiens
aagcatgctcag

SEQ ID NO: 642209 - DNA, 20 bp, Homo sapiens
aagcatgctcagtattgaga

SEQ ID NO: 642210 - DNA, 16 bp, Homo sapiens
aagcatgtacagtgtt

SEQ ID NO: 642211 - DNA, 16 bp, Homo sapiens
aatttgtgaaagtggc

SEQ ID NO: 642212 - DNA, 12 bp, Homo sapiens
aatttgtgtgct

SEQ ID NO: 642213 - DNA, 21 bp, Homo sapiens
aattttaaaaaagatggattt

SEQ ID NO: 642214 - DNA, 12 bp, Homo sapiens
aattttcatttt

SEQ ID NO: 642215 - DNA, 17 bp, Homo sapiens
aattttggaagaattca

SEQ ID NO: 642216 - DNA, 13 bp, Homo sapiens
aatttttactcag

SEQ ID NO: 642217 - DNA, 15 bp, Homo sapiens
aatttttcaatttct

SEQ ID NO: 642218 - DNA, 13 bp, Homo sapiens
aatttttgcatgt

SEQ ID NO: 642219 - DNA, 22 bp, Homo sapiens
aatttttgcatgtttaataata

SEQ ID NO: 642220 - DNA, 16 bp, Homo sapiens
aatttttgtaagaaaa

SEQ ID NO: 642221 - DNA, 20 bp, Homo sapiens
aatttttgtctttcatggaa

SEQ ID NO: 642222 - DNA, 20 bp, Homo sapiens
aattttttcctgctagtgta

SEQ ID NO: 642223 - DNA, 12 bp, Homo sapiens
acaaaacaacag

SEQ ID NO: 642224 - DNA, 14 bp, Homo sapiens
acaaaacaacagca

SEQ ID NO: 642225 - DNA, 12 bp, Homo sapiens
acaaaaggctgg

SEQ ID NO: 642226 - DNA, 12 bp, Homo sapiens
acaaaatgaatt

SEQ ID NO: 642227 - DNA, 23 bp, Homo sapiens
acaaaatttatgtcattttcaga

SEQ ID NO: 642228 - DNA, 17 bp, Homo sapiens
acaaacctactgcccac

SEQ ID NO: 642229 - DNA, 18 bp, Homo sapiens
acaaagaaacaaaatata

SEQ ID NO: 642230 - DNA, 15 bp, Homo sapiens
acaaagcatgctcag

SEQ ID NO: 642231 - DNA, 18 bp, Homo sapiens
acaaagccagctctgagc

SEQ ID NO: 642232 - DNA, 17 bp, Homo sapiens
acaaagtgaaattagta

SEQ ID NO: 642233 - DNA, 17 bp, Homo sapiens
acaaataatattgcctt

SEQ ID NO: 642234 - DNA, 22 bp, Homo sapiens
acaaataatattgccttgatgt

SEQ ID NO: 642235 - DNA, 15 bp, Homo sapiens
acaaatacacataca

SEQ ID NO: 642236 - DNA, 16 bp, Homo sapiens
acaaatacacatacat

SEQ ID NO: 642237 - DNA, 14 bp, Homo sapiens
acaaatatactcat

SEQ ID NO: 642238 - DNA, 16 bp, Homo sapiens
acaaatcattttgatg

SEQ ID NO: 642239 - DNA, 18 bp, Homo sapiens
acaaatcattttgatgta

SEQ ID NO: 642240 - DNA, 15 bp, Homo sapiens
acaaatttttactca

SEQ ID NO: 642241 - DNA, 18 bp, Homo sapiens
acaacaaagcatgctcag

SEQ ID NO: 642242 - DNA, 14 bp, Homo sapiens
acaacaacaaagca

SEQ ID NO: 642243 - DNA, 17 bp, Homo sapiens
acaacaagcaaactgaa

SEQ ID NO: 642244 - DNA, 23 bp, Homo sapiens
acaacaatttaggaatgctcaat

SEQ ID NO: 642245 - DNA, 16 bp, Homo sapiens
acaacacattgaaact

SEQ ID NO: 642246 - DNA, 21 bp, Homo sapiens
acaaccacatttctggccatt

SEQ ID NO: 642247 - DNA, 18 bp, Homo sapiens
acaacctgcccctcccca

SEQ ID NO: 642248 - DNA, 17 bp, Homo sapiens
acaactgtggataaatt

SEQ ID NO: 642249 - DNA, 12 bp, Homo sapiens
acaacttccaga

SEQ ID NO: 642250 - DNA, 14 bp, Homo sapiens
acaacttccagatt

SEQ ID NO: 642251 - DNA, 21 bp, Homo sapiens
acaagagaccacttccttaac

SEQ ID NO: 642252 - DNA, 22 bp, Homo sapiens
acaagagaccacttccttaaca

SEQ ID NO: 642253 - DNA, 23 bp, Homo sapiens
acaagagaccacttccttaacag

SEQ ID NO: 642254 - DNA, 19 bp, Homo sapiens
acaagccacgttgcagaaa

SEQ ID NO: 642255 - DNA, 14 bp, Homo sapiens
acaagctacatatg

SEQ ID NO: 642256 - DNA, 17 bp, Homo sapiens
acaaggcccagccctgg

SEQ ID NO: 642257 - DNA, 18 bp, Homo sapiens
acaaggcccagccctggg

SEQ ID NO: 642258 - DNA, 19 bp, Homo sapiens
acaagttacccctgaaatc

SEQ ID NO: 642259 - DNA, 22 bp, Homo sapiens
acaatactttgtgtcttttgtt

SEQ ID NO: 642260 - DNA, 14 bp, Homo sapiens
acaatatcatcccc

SEQ ID NO: 642261 - DNA, 15 bp, Homo sapiens
acaatcatctattga

SEQ ID NO: 642262 - DNA, 17 bp, Homo sapiens
acaatcatctattgagt

SEQ ID NO: 642263 - DNA, 22 bp, Homo sapiens
acaatcatgcctacattagtga

SEQ ID NO: 642264 - DNA, 17 bp, Homo sapiens
acaatgcaaaccatcat

SEQ ID NO: 642265 - DNA, 21 bp, Homo sapiens
acaatgtggaattacataaca

SEQ ID NO: 642266 - DNA, 23 bp, Homo sapiens
acaatgtggaattacataacagg

SEQ ID NO: 642267 - DNA, 19 bp, Homo sapiens
acaatgttttttatacttc

SEQ ID NO: 642268 - DNA, 20 bp, Homo sapiens
acaatgttttttatacttca

SEQ ID NO: 642269 - DNA, 22 bp, Homo sapiens
acaattctttgttgcttaatct

SEQ ID NO: 642270 - DNA, 13 bp, Homo sapiens
acaatttctgtgt

SEQ ID NO: 642271 - DNA, 20 bp, Homo sapiens
acacaaaacaacagcaacaa

SEQ ID NO: 642272 - DNA, 19 bp, Homo sapiens
acacaagcagacacacaca

SEQ ID NO: 642273 - DNA, 20 bp, Homo sapiens
acacaagcagacacacacat

SEQ ID NO: 642274 - DNA, 20 bp, Homo sapiens
acacacaaacctactgccca

SEQ ID NO: 642275 - DNA, 15 bp, Homo sapiens
acacacaagcagaca

SEQ ID NO: 642276 - DNA, 14 bp, Homo sapiens
acacacacacacaa

SEQ ID NO: 642277 - DNA, 15 bp, Homo sapiens
acacacacacacaca

SEQ ID NO: 642278 - DNA, 15 bp, Homo sapiens
acacacacatatata

SEQ ID NO: 642279 - DNA, 18 bp, Homo sapiens
acacacatatatacatac

SEQ ID NO: 642280 - DNA, 21 bp, Homo sapiens
acacacatatatacatacgca

SEQ ID NO: 642281 - DNA, 12 bp, Homo sapiens
acacacccttcc

SEQ ID NO: 642282 - DNA, 13 bp, Homo sapiens
acacacctgagaa

SEQ ID NO: 642283 - DNA, 16 bp, Homo sapiens
acacacctgagaatgt

SEQ ID NO: 642284 - DNA, 17 bp, Homo sapiens
acacacctgagaatgtg

SEQ ID NO: 642285 - DNA, 15 bp, Homo sapiens
acacactcagcagcc

SEQ ID NO: 642286 - DNA, 17 bp, Homo sapiens
acacagacacacaagca

SEQ ID NO: 642287 - DNA, 12 bp, Homo sapiens
acacagactctg

SEQ ID NO: 642288 - DNA, 19 bp, Homo sapiens
acacagactctgtgagatt

SEQ ID NO: 642289 - DNA, 16 bp, Homo sapiens
acacagcccagagact

SEQ ID NO: 642290 - DNA, 19 bp, Homo sapiens
acacagcccagagactgaa

SEQ ID NO: 642291 - DNA, 17 bp, Homo sapiens
acacagtatagataaat

SEQ ID NO: 642292 - DNA, 15 bp, Homo sapiens
acacataattaaagt

SEQ ID NO: 642293 - DNA, 17 bp, Homo sapiens
acacataattaaagtgt

SEQ ID NO: 642294 - DNA, 18 bp, Homo sapiens
acacataattaaagtgtc

SEQ ID NO: 642295 - DNA, 20 bp, Homo sapiens
acacataattaaagtgtcca

SEQ ID NO: 642296 - DNA, 14 bp, Homo sapiens
acacatacatatat

SEQ ID NO: 642297 - DNA, 15 bp, Homo sapiens
acacatataaacaca

SEQ ID NO: 642298 - DNA, 16 bp, Homo sapiens
acacatctggccctga

SEQ ID NO: 642299 - DNA, 18 bp, Homo sapiens
acacattgaaactgtatt

SEQ ID NO: 642300 - DNA, 18 bp, Homo sapiens
acaccaaattgctgagat

SEQ ID NO: 642301 - DNA, 23 bp, Homo sapiens
acacccaaagcccacttcacaca

SEQ ID NO: 642302 - DNA, 17 bp, Homo sapiens
acaccccgtctgcccct

SEQ ID NO: 642303 - DNA, 19 bp, Homo sapiens
acacccttccccactcccg

SEQ ID NO: 642304 - DNA, 14 bp, Homo sapiens
acaccggcactgtg

SEQ ID NO: 642305 - DNA, 15 bp, Homo sapiens
acaccggcactgtgc

SEQ ID NO: 642306 - DNA, 18 bp, Homo sapiens
acacctaaattaacaaat

SEQ ID NO: 642307 - DNA, 17 bp, Homo sapiens
acaccttacaaagccag

SEQ ID NO: 642308 - DNA, 14 bp, Homo sapiens
acaccttagcagct

SEQ ID NO: 642309 - DNA, 16 bp, Homo sapiens
acacgaagaaatagaa

SEQ ID NO: 642310 - DNA, 18 bp, Homo sapiens
acacgaagaaatagaata

SEQ ID NO: 642311 - DNA, 14 bp, Homo sapiens
acacgaatattgct

SEQ ID NO: 642312 - DNA, 15 bp, Homo sapiens
acacgaatattgctg

SEQ ID NO: 642313 - DNA, 20 bp, Homo sapiens
acacgccggggctggccctg

SEQ ID NO: 642314 - DNA, 15 bp, Homo sapiens
acacggagtttccat

SEQ ID NO: 642315 - DNA, 15 bp, Homo sapiens
acacgttggagtata

SEQ ID NO: 642316 - DNA, 13 bp, Homo sapiens
acactattttatg

SEQ ID NO: 642317 - DNA, 17 bp, Homo sapiens
acactcaccgagaggaa

SEQ ID NO: 642318 - DNA, 22 bp, Homo sapiens
acactctcttcttactgtattt

SEQ ID NO: 642319 - DNA, 20 bp, Homo sapiens
acactgatgggtcctgctgc

SEQ ID NO: 642320 - DNA, 23 bp, Homo sapiens
acactgcaccctccacaggagcc

SEQ ID NO: 642321 - DNA, 16 bp, Homo sapiens
acagaggtttcatttt

SEQ ID NO: 642322 - DNA, 14 bp, Homo sapiens
acagagtgccctgg

SEQ ID NO: 642323 - DNA, 17 bp, Homo sapiens
acagagtggatctggag

SEQ ID NO: 642324 - DNA, 19 bp, Homo sapiens
acagatattttcgcccacc

SEQ ID NO: 642325 - DNA, 21 bp, Homo sapiens
acagatggtgtcctgcatgta

SEQ ID NO: 642326 - DNA, 13 bp, Homo sapiens
acagatttccaaa

SEQ ID NO: 642327 - DNA, 20 bp, Homo sapiens
acagatttccaaaagtacta

SEQ ID NO: 642328 - DNA, 20 bp, Homo sapiens
acagcaaacacagtcactgt

SEQ ID NO: 642329 - DNA, 13 bp, Homo sapiens
acagcaacaacaa

SEQ ID NO: 642330 - DNA, 19 bp, Homo sapiens
acagcacatttgttaatga

SEQ ID NO: 642331 - DNA, 18 bp, Homo sapiens
acagcatgcatttagcat

SEQ ID NO: 642332 - DNA, 14 bp, Homo sapiens
acagcatttctttg

SEQ ID NO: 642333 - DNA, 14 bp, Homo sapiens
acagccatacttcc

SEQ ID NO: 642334 - DNA, 17 bp, Homo sapiens
acagcccagagactgaa

SEQ ID NO: 642335 - DNA, 13 bp, Homo sapiens
acagccctgcacg

SEQ ID NO: 642336 - DNA, 16 bp, Homo sapiens
acagcctgcacagtgg

SEQ ID NO: 642337 - DNA, 15 bp, Homo sapiens
acagcggccccgcgg

SEQ ID NO: 642338 - DNA, 20 bp, Homo sapiens
acagcggccccgcggagccc

SEQ ID NO: 642339 - DNA, 20 bp, Homo sapiens
acagcggcccggcccacgca

SEQ ID NO: 642340 - DNA, 23 bp, Homo sapiens
acagctaggttaataggaggaca

SEQ ID NO: 642341 - DNA, 18 bp, Homo sapiens
acaggaaagtggatgcca

SEQ ID NO: 642342 - DNA, 20 bp, Homo sapiens
acaggagccgcagaggcccg

SEQ ID NO: 642343 - DNA, 19 bp, Homo sapiens
acaggatgcatattaaaga

SEQ ID NO: 642344 - DNA, 18 bp, Homo sapiens
acaggcatattattttct

SEQ ID NO: 642345 - DNA, 13 bp, Homo sapiens
acaggcgccgcct

SEQ ID NO: 642346 - DNA, 17 bp, Homo sapiens
acagggcgtcctctcgt

SEQ ID NO: 642347 - DNA, 16 bp, Homo sapiens
acaggttttatgagac

SEQ ID NO: 642348 - DNA, 17 bp, Homo sapiens
acagtaaagaccattta

SEQ ID NO: 642349 - DNA, 13 bp, Homo sapiens
acagtaaatatac

SEQ ID NO: 642350 - DNA, 19 bp, Homo sapiens
acagtaaatatacacttta

SEQ ID NO: 642351 - DNA, 18 bp, Homo sapiens
acagtagcatactgatga

SEQ ID NO: 642352 - DNA, 20 bp, Homo sapiens
acagtagcatactgatgaga

SEQ ID NO: 642353 - DNA, 22 bp, Homo sapiens
acagtagcatactgatgagaca

SEQ ID NO: 642354 - DNA, 18 bp, Homo sapiens
acagtagcttcctagacc

SEQ ID NO: 642355 - DNA, 17 bp, Homo sapiens
acagtatagataaatcc

SEQ ID NO: 642356 - DNA, 19 bp, Homo sapiens
acagtattgttcttgtaaa

SEQ ID NO: 642357 - DNA, 14 bp, Homo sapiens
acagtatttaacat

SEQ ID NO: 642358 - DNA, 15 bp, Homo sapiens
acagtatttaacatt

SEQ ID NO: 642359 - DNA, 13 bp, Homo sapiens
acagtcctggtta

SEQ ID NO: 642360 - DNA, 13 bp, Homo sapiens
acagtctaatttt

SEQ ID NO: 642361 - DNA, 12 bp, Homo sapiens
acagtctctatt

SEQ ID NO: 642362 - DNA, 16 bp, Homo sapiens
acagtctctatttgat

SEQ ID NO: 642363 - DNA, 16 bp, Homo sapiens
acagtgaacagcttca

SEQ ID NO: 642364 - DNA, 15 bp, Homo sapiens
acagtggcaagctac

SEQ ID NO: 642365 - DNA, 17 bp, Homo sapiens
acagtggcaagctacca

SEQ ID NO: 642366 - DNA, 16 bp, Homo sapiens
acagtggggcccatgg

SEQ ID NO: 642367 - DNA, 23 bp, Homo sapiens
acagtggggcccatggccccagc

SEQ ID NO: 642368 - DNA, 23 bp, Homo sapiens
acagtggtccagggtccagccct

SEQ ID NO: 642369 - DNA, 18 bp, Homo sapiens
acagtggttatatttcaa

SEQ ID NO: 642370 - DNA, 19 bp, Homo sapiens
acagtgtggcttaaacatt

SEQ ID NO: 642371 - DNA, 18 bp, Homo sapiens
acagtgttcaaattctga

SEQ ID NO: 642372 - DNA, 15 bp, Homo sapiens
acagtgttctgttta

SEQ ID NO: 642373 - DNA, 22 bp, Homo sapiens
acagtgttctgtttaatactca

SEQ ID NO: 642374 - DNA, 17 bp, Homo sapiens
acataaaacacccttga

SEQ ID NO: 642375 - DNA, 21 bp, Homo sapiens
acataaaacacccttgaaaat

SEQ ID NO: 642376 - DNA, 20 bp, Homo sapiens
acataaacacttctccttaa

SEQ ID NO: 642377 - DNA, 16 bp, Homo sapiens
acataaacttgtactt

SEQ ID NO: 642378 - DNA, 18 bp, Homo sapiens
acataaagtaataactgt

SEQ ID NO: 642379 - DNA, 18 bp, Homo sapiens
acataacaggcattgcac

SEQ ID NO: 642380 - DNA, 20 bp, Homo sapiens
acataattaaagtgtccatt

SEQ ID NO: 642381 - DNA, 14 bp, Homo sapiens
acatacatatatac

SEQ ID NO: 642382 - DNA, 19 bp, Homo sapiens
acatacgcaattgtatata

SEQ ID NO: 642383 - DNA, 23 bp, Homo sapiens
acatacgcaattgtatatatatg

SEQ ID NO: 642384 - DNA, 21 bp, Homo sapiens
acatagctttagagaagccat

SEQ ID NO: 642385 - DNA, 18 bp, Homo sapiens
acatagtggtattttaac

SEQ ID NO: 642386 - DNA, 15 bp, Homo sapiens
acatagtggtcattt

SEQ ID NO: 642387 - DNA, 19 bp, Homo sapiens
acatatatacatacgcaat

SEQ ID NO: 642388 - DNA, 13 bp, Homo sapiens
acatatatacatt

SEQ ID NO: 642389 - DNA, 16 bp, Homo sapiens
acatatcattcagaat

SEQ ID NO: 642390 - DNA, 20 bp, Homo sapiens
acatatgtaggaaaattttc

SEQ ID NO: 642391 - DNA, 22 bp, Homo sapiens
acatatgtaggaaaattttctt

SEQ ID NO: 642392 - DNA, 21 bp, Homo sapiens
acatcaattgggttttgatct

SEQ ID NO: 642393 - DNA, 23 bp, Homo sapiens
acatcagtccacccccattgtga

SEQ ID NO: 642394 - DNA, 22 bp, Homo sapiens
acatcatatgttagatacacaa

SEQ ID NO: 642395 - DNA, 23 bp, Homo sapiens
acatccagcagtccaaggtattg

SEQ ID NO: 642396 - DNA, 23 bp, Homo sapiens
acatccccaccctcccctctcct

SEQ ID NO: 642397 - DNA, 12 bp, Homo sapiens
acatctcttcat

SEQ ID NO: 642398 - DNA, 13 bp, Homo sapiens
acatctgatttct

SEQ ID NO: 642399 - DNA, 14 bp, Homo sapiens
acatctgatttctg

SEQ ID NO: 642400 - DNA, 12 bp, Homo sapiens
acatctgtatat

SEQ ID NO: 642401 - DNA, 13 bp, Homo sapiens
acatctgtcagtg

SEQ ID NO: 642402 - DNA, 17 bp, Homo sapiens
acatcttttgataattg

SEQ ID NO: 642403 - DNA, 15 bp, Homo sapiens
acatgacccagcctg

SEQ ID NO: 642404 - DNA, 16 bp, Homo sapiens
acatgacccagcctga

SEQ ID NO: 642405 - DNA, 17 bp, Homo sapiens
acatgacccgtacacac

SEQ ID NO: 642406 - DNA, 21 bp, Homo sapiens
acatgcccctcttagaagaaa

SEQ ID NO: 642407 - DNA, 20 bp, Homo sapiens
acatgctaacctctctgaac

SEQ ID NO: 642408 - DNA, 21 bp, Homo sapiens
acatgctgtcttagatcagga

SEQ ID NO: 642409 - DNA, 21 bp, Homo sapiens
acatggcacttggaagaaaaa

SEQ ID NO: 642410 - DNA, 15 bp, Homo sapiens
acatgggccagccct

SEQ ID NO: 642411 - DNA, 14 bp, Homo sapiens
agcatatatataaa

SEQ ID NO: 642412 - DNA, 14 bp, Homo sapiens
agcatcctggaaat

SEQ ID NO: 642413 - DNA, 15 bp, Homo sapiens
agcatcctggaaatt

SEQ ID NO: 642414 - DNA, 20 bp, Homo sapiens
agcatcctggaaatttgtgt

SEQ ID NO: 642415 - DNA, 23 bp, Homo sapiens
agcatcctggaaatttgtgtgct

SEQ ID NO: 642416 - DNA, 16 bp, Homo sapiens
agcatcgtgtgggtcc

SEQ ID NO: 642417 - DNA, 19 bp, Homo sapiens
agcatgagttctgcacata

SEQ ID NO: 642418 - DNA, 19 bp, Homo sapiens
agcatgcatttagcatgag

SEQ ID NO: 642419 - DNA, 11 bp, Homo sapiens
agcatgctcag

SEQ ID NO: 642420 - DNA, 16 bp, Homo sapiens
agcatgctcagtattg

SEQ ID NO: 642421 - DNA, 15 bp, Homo sapiens
agcatgctccctcat

SEQ ID NO: 642422 - DNA, 22 bp, Homo sapiens
agcatgggactgtgcctttggg

SEQ ID NO: 642423 - DNA, 14 bp, Homo sapiens
agcatgtacagtgt

SEQ ID NO: 642424 - DNA, 16 bp, Homo sapiens
agcatgtattgtgtct

SEQ ID NO: 642425 - DNA, 19 bp, Homo sapiens
agcatgtcctatccctgga

SEQ ID NO: 642426 - DNA, 16 bp, Homo sapiens
agcattcagcacacac

SEQ ID NO: 642427 - DNA, 17 bp, Homo sapiens
agcatttgactttctgt

SEQ ID NO: 642428 - DNA, 21 bp, Homo sapiens
agcatttgactttctgtctgt

SEQ ID NO: 642429 - DNA, 18 bp, Homo sapiens
agccaaaataagactatt

SEQ ID NO: 642430 - DNA, 20 bp, Homo sapiens
agccaagctaatgtggtagt

SEQ ID NO: 642431 - DNA, 19 bp, Homo sapiens
agccaataaagctcacact

SEQ ID NO: 642432 - DNA, 18 bp, Homo sapiens
agccaatgaagcaaacac

SEQ ID NO: 642433 - DNA, 16 bp, Homo sapiens
agccactacctttgtc

SEQ ID NO: 642434 - DNA, 14 bp, Homo sapiens
agccagatttcact

SEQ ID NO: 642435 - DNA, 15 bp, Homo sapiens
agccagcagacattg

SEQ ID NO: 642436 - DNA, 15 bp, Homo sapiens
agccagcattcagca

SEQ ID NO: 642437 - DNA, 17 bp, Homo sapiens
agccagcattcagcaca

SEQ ID NO: 642438 - DNA, 11 bp, Homo sapiens
agccaggagac

SEQ ID NO: 642439 - DNA, 17 bp, Homo sapiens
agccaggagaccctgtc

SEQ ID NO: 642440 - DNA, 14 bp, Homo sapiens
agccagggttccag

SEQ ID NO: 642441 - DNA, 16 bp, Homo sapiens
agccagggttccagac

SEQ ID NO: 642442 - DNA, 15 bp, Homo sapiens
agccagtggcacagg

SEQ ID NO: 642443 - DNA, 23 bp, Homo sapiens
agccagtggggtcccccctgagt

SEQ ID NO: 642444 - DNA, 14 bp, Homo sapiens
agccatagccccag

SEQ ID NO: 642445 - DNA, 20 bp, Homo sapiens
agccatgcccacgcccctcc

SEQ ID NO: 642446 - DNA, 23 bp, Homo sapiens
agccatggtgaactgataatttt

SEQ ID NO: 642447 - DNA, 21 bp, Homo sapiens
agcccagaacgggcctccccg

SEQ ID NO: 642448 - DNA, 12 bp, Homo sapiens
agcccaggagga

SEQ ID NO: 642449 - DNA, 16 bp, Homo sapiens
agcccaggaggacctg

SEQ ID NO: 642450 - DNA, 20 bp, Homo sapiens
agcccagtccctggagctgt

SEQ ID NO: 642451 - DNA, 13 bp, Homo sapiens
agcccatgctggc

SEQ ID NO: 642452 - DNA, 19 bp, Homo sapiens
agcccatgctggctggggc

SEQ ID NO: 642453 - DNA, 20 bp, Homo sapiens
agccccaggcccgccctgcc

SEQ ID NO: 642454 - DNA, 21 bp, Homo sapiens
agccccatccttcccgcagca

SEQ ID NO: 642455 - DNA, 17 bp, Homo sapiens
agcccccacccatgcca

SEQ ID NO: 642456 - DNA, 12 bp, Homo sapiens
agcccccacccc

SEQ ID NO: 642457 - DNA, 11 bp, Homo sapiens
agccccctggc

SEQ ID NO: 642458 - DNA, 12 bp, Homo sapiens
agccccctggcg

SEQ ID NO: 642459 - DNA, 13 bp, Homo sapiens
agccccctggcgg

SEQ ID NO: 642460 - DNA, 16 bp, Homo sapiens
agccccctggcggcag

SEQ ID NO: 642461 - DNA, 14 bp, Homo sapiens
agccccggagcacc

SEQ ID NO: 642462 - DNA, 20 bp, Homo sapiens
agcccctatcctgcaccctc

SEQ ID NO: 642463 - DNA, 15 bp, Homo sapiens
agcccctcagagaat

SEQ ID NO: 642464 - DNA, 13 bp, Homo sapiens
agcccctcctctc

SEQ ID NO: 642465 - DNA, 14 bp, Homo sapiens
agcccggccaagga

SEQ ID NO: 642466 - DNA, 21 bp, Homo sapiens
agcccggccaaggacactgat

SEQ ID NO: 642467 - DNA, 22 bp, Homo sapiens
agcccggccaaggacactgatg

SEQ ID NO: 642468 - DNA, 11 bp, Homo sapiens
agccctcacct

SEQ ID NO: 642469 - DNA, 15 bp, Homo sapiens
agccctcacctctga

SEQ ID NO: 642470 - DNA, 20 bp, Homo sapiens
agccctcacctctgaggaca

SEQ ID NO: 642471 - DNA, 21 bp, Homo sapiens
agccctcacctctgaggacag

SEQ ID NO: 642472 - DNA, 19 bp, Homo sapiens
agccctccgccagccctgt

SEQ ID NO: 642473 - DNA, 20 bp, Homo sapiens
agccctccgccagccctgtt

SEQ ID NO: 642474 - DNA, 16 bp, Homo sapiens
agccctctccaccctc

SEQ ID NO: 642475 - DNA, 15 bp, Homo sapiens
agccctctttctctc

SEQ ID NO: 642476 - DNA, 23 bp, Homo sapiens
agccctctttctctctgtgtggc

SEQ ID NO: 642477 - DNA, 12 bp, Homo sapiens
agccctgacaac

SEQ ID NO: 642478 - DNA, 18 bp, Homo sapiens
agccctgttccgcctcac

SEQ ID NO: 642479 - DNA, 20 bp, Homo sapiens
agccctgttccgcctcactg

SEQ ID NO: 642480 - DNA, 21 bp, Homo sapiens
agccctttgcaggcccagcag

SEQ ID NO: 642481 - DNA, 12 bp, Homo sapiens
agccgcagaggc

SEQ ID NO: 642482 - DNA, 19 bp, Homo sapiens
agccgcagaggcccgaggc

SEQ ID NO: 642483 - DNA, 18 bp, Homo sapiens
agccgcgctctgcccctc

SEQ ID NO: 642484 - DNA, 22 bp, Homo sapiens
agcctcaattttggtttttctc

SEQ ID NO: 642485 - DNA, 11 bp, Homo sapiens
agcctcacctt

SEQ ID NO: 642486 - DNA, 13 bp, Homo sapiens
agcctcactgata

SEQ ID NO: 642487 - DNA, 17 bp, Homo sapiens
agcctcactgatatatt

SEQ ID NO: 642488 - DNA, 16 bp, Homo sapiens
agcctcccccaggctg

SEQ ID NO: 642489 - DNA, 17 bp, Homo sapiens
agcctcccccaggctgc

SEQ ID NO: 642490 - DNA, 18 bp, Homo sapiens
agcctcgttggagagcag

SEQ ID NO: 642491 - DNA, 20 bp, Homo sapiens
agcctcgttggagagcagca

SEQ ID NO: 642492 - DNA, 10 bp, Homo sapiens
agcctctccc

SEQ ID NO: 642493 - DNA, 22 bp, Homo sapiens
agcctcttgaatgcttaaatga

SEQ ID NO: 642494 - DNA, 20 bp, Homo sapiens
agcctgaaagatacagggga

SEQ ID NO: 642495 - DNA, 23 bp, Homo sapiens
agcctgaaagatacaggggatca

SEQ ID NO: 642496 - DNA, 16 bp, Homo sapiens
agcctgagccacagtg

SEQ ID NO: 642497 - DNA, 14 bp, Homo sapiens
agcctgagctccac

SEQ ID NO: 642498 - DNA, 14 bp, Homo sapiens
agcctgccaggccc

SEQ ID NO: 642499 - DNA, 20 bp, Homo sapiens
agcctgccaggccctccagc

SEQ ID NO: 642500 - DNA, 17 bp, Homo sapiens
agcctggattccagcag

SEQ ID NO: 642501 - DNA, 13 bp, Homo sapiens
agcctgggcagca

SEQ ID NO: 642502 - DNA, 14 bp, Homo sapiens
agcctgtcacgtgg

SEQ ID NO: 642503 - DNA, 17 bp, Homo sapiens
agcctgtgaactgccag

SEQ ID NO: 642504 - DNA, 13 bp, Homo sapiens
agccttattaaaa

SEQ ID NO: 642505 - DNA, 13 bp, Homo sapiens
agcctttctccag

SEQ ID NO: 642506 - DNA, 17 bp, Homo sapiens
agcgcatggcgccccgg

SEQ ID NO: 642507 - DNA, 22 bp, Homo sapiens
agcgcatggcgccccgggccgc

SEQ ID NO: 642508 - DNA, 19 bp, Homo sapiens
agcgcccgaggccagggcc

SEQ ID NO: 642509 - DNA, 17 bp, Homo sapiens
agcgcctcccgccgcct

SEQ ID NO: 642510 - DNA, 18 bp, Homo sapiens
agcgcctcgccccagcca

SEQ ID NO: 642511 - DNA, 15 bp, Homo sapiens
accacgacctcgtcc

SEQ ID NO: 642512 - DNA, 23 bp, Homo sapiens
accacgattccaacccaggtctg

SEQ ID NO: 642513 - DNA, 15 bp, Homo sapiens
accacgcgtcaccca

SEQ ID NO: 642514 - DNA, 15 bp, Homo sapiens
accacggtgtggggg

SEQ ID NO: 642515 - DNA, 19 bp, Homo sapiens
accactagttgcttacaaa

SEQ ID NO: 642516 - DNA, 20 bp, Homo sapiens
accactagttgcttacaaaa

SEQ ID NO: 642517 - DNA, 21 bp, Homo sapiens
accagaaagaggaataaaatg

SEQ ID NO: 642518 - DNA, 15 bp, Homo sapiens
accagagcactgtat

SEQ ID NO: 642519 - DNA, 16 bp, Homo sapiens
accagagcactgtata

SEQ ID NO: 642520 - DNA, 17 bp, Homo sapiens
accagagcactgtatac

SEQ ID NO: 642521 - DNA, 20 bp, Homo sapiens
accagagcactgtatacccc

SEQ ID NO: 642522 - DNA, 16 bp, Homo sapiens
accagcaacttttctc

SEQ ID NO: 642523 - DNA, 13 bp, Homo sapiens
accagcactccca

SEQ ID NO: 642524 - DNA, 15 bp, Homo sapiens
accagcactcccagg

SEQ ID NO: 642525 - DNA, 16 bp, Homo sapiens
accagcactcccaggg

SEQ ID NO: 642526 - DNA, 17 bp, Homo sapiens
accagcactcccagggc

SEQ ID NO: 642527 - DNA, 18 bp, Homo sapiens
accagcactcccagggcc

SEQ ID NO: 642528 - DNA, 19 bp, Homo sapiens
accagcactcccagggccc

SEQ ID NO: 642529 - DNA, 12 bp, Homo sapiens
accagcctgcca

SEQ ID NO: 642530 - DNA, 14 bp, Homo sapiens
accagcctgccagg

SEQ ID NO: 642531 - DNA, 18 bp, Homo sapiens
accagcctgccaggccct

SEQ ID NO: 642532 - DNA, 23 bp, Homo sapiens
accagcttgcttctctgccggtg

SEQ ID NO: 642533 - DNA, 16 bp, Homo sapiens
accagtgccgcctgtg

SEQ ID NO: 642534 - DNA, 19 bp, Homo sapiens
accagtgccgcctgtgccc

SEQ ID NO: 642535 - DNA, 21 bp, Homo sapiens
accagttccctcagccctcat

SEQ ID NO: 642536 - DNA, 15 bp, Homo sapiens
accatagcttaagaa

SEQ ID NO: 642537 - DNA, 23 bp, Homo sapiens
accatcaaacaaatcattttgat

SEQ ID NO: 642538 - DNA, 12 bp, Homo sapiens
accatcattgaa

SEQ ID NO: 642539 - DNA, 23 bp, Homo sapiens
accatcattgaaatctttttgct

SEQ ID NO: 642540 - DNA, 13 bp, Homo sapiens
accatcccactga

SEQ ID NO: 642541 - DNA, 14 bp, Homo sapiens
accatcccactgat

SEQ ID NO: 642542 - DNA, 21 bp, Homo sapiens
accatcttgggattcctcccc

SEQ ID NO: 642543 - DNA, 15 bp, Homo sapiens
accatgaaaagtttt

SEQ ID NO: 642544 - DNA, 22 bp, Homo sapiens
accatgcattcagatctgaagt

SEQ ID NO: 642545 - DNA, 19 bp, Homo sapiens
accatgctgggccggggtg

SEQ ID NO: 642546 - DNA, 12 bp, Homo sapiens
accattaaaatc

SEQ ID NO: 642547 - DNA, 18 bp, Homo sapiens
accattaaaatcttgaaa

SEQ ID NO: 642548 - DNA, 18 bp, Homo sapiens
accatttaatcatttcca

SEQ ID NO: 642549 - DNA, 22 bp, Homo sapiens
accatttcccctgtggtttgtt

SEQ ID NO: 642550 - DNA, 21 bp, Homo sapiens
acccaaagcccacttcacaca

SEQ ID NO: 642551 - DNA, 18 bp, Homo sapiens
acccaaggtggtcttgga

SEQ ID NO: 642552 - DNA, 21 bp, Homo sapiens
acccactagccctctttctct

SEQ ID NO: 642553 - DNA, 11 bp, Homo sapiens
acccagcagcg

SEQ ID NO: 642554 - DNA, 11 bp, Homo sapiens
acccagcctga

SEQ ID NO: 642555 - DNA, 15 bp, Homo sapiens
acccaggattcaaca

SEQ ID NO: 642556 - DNA, 16 bp, Homo sapiens
acccatgccagcgcag

SEQ ID NO: 642557 - DNA, 15 bp, Homo sapiens
accccacacgccggg

SEQ ID NO: 642558 - DNA, 22 bp, Homo sapiens
accccacacgccggggctggcc

SEQ ID NO: 642559 - DNA, 20 bp, Homo sapiens
accccaccacacacaccctt

SEQ ID NO: 642560 - DNA, 23 bp, Homo sapiens
accccaccacacacacccttccc

SEQ ID NO: 642561 - DNA, 21 bp, Homo sapiens
accccaggaagtcatcctgca

SEQ ID NO: 642562 - DNA, 14 bp, Homo sapiens
acccccacctcccg

SEQ ID NO: 642563 - DNA, 13 bp, Homo sapiens
acccccagcctcc

SEQ ID NO: 642564 - DNA, 18 bp, Homo sapiens
acccccagcctcccccag

SEQ ID NO: 642565 - DNA, 19 bp, Homo sapiens
acccccatgccaatgtcca

SEQ ID NO: 642566 - DNA, 20 bp, Homo sapiens
accccgtcccggccccgcgc

SEQ ID NO: 642567 - DNA, 13 bp, Homo sapiens
accccgtctgccc

SEQ ID NO: 642568 - DNA, 16 bp, Homo sapiens
accccgtctgcccctt

SEQ ID NO: 642569 - DNA, 15 bp, Homo sapiens
accccgttgttgtcc

SEQ ID NO: 642570 - DNA, 20 bp, Homo sapiens
accccgttgttgtccctgca

SEQ ID NO: 642571 - DNA, 15 bp, Homo sapiens
acccctaccctttcc

SEQ ID NO: 642572 - DNA, 15 bp, Homo sapiens
acccctcaagccagg

SEQ ID NO: 642573 - DNA, 16 bp, Homo sapiens
acccctcaagccagga

SEQ ID NO: 642574 - DNA, 18 bp, Homo sapiens
acccctcttcccccttcc

SEQ ID NO: 642575 - DNA, 15 bp, Homo sapiens
acccctgccctcggc

SEQ ID NO: 642576 - DNA, 17 bp, Homo sapiens
acccctgccctcggcca

SEQ ID NO: 642577 - DNA, 15 bp, Homo sapiens
acccctgtagggaaa

SEQ ID NO: 642578 - DNA, 22 bp, Homo sapiens
acccctgtagggaaaccttgga

SEQ ID NO: 642579 - DNA, 21 bp, Homo sapiens
acccgccccagagactgccca

SEQ ID NO: 642580 - DNA, 18 bp, Homo sapiens
acccggctgactcagtgc

SEQ ID NO: 642581 - DNA, 21 bp, Homo sapiens
acccggctgactcagtgcagg

SEQ ID NO: 642582 - DNA, 14 bp, Homo sapiens
acccgtacacacca

SEQ ID NO: 642583 - DNA, 16 bp, Homo sapiens
acccgtgttctcctcc

SEQ ID NO: 642584 - DNA, 21 bp, Homo sapiens
accctaggtctccacccctca

SEQ ID NO: 642585 - DNA, 15 bp, Homo sapiens
accctatttgtttca

SEQ ID NO: 642586 - DNA, 16 bp, Homo sapiens
accctatttgtttcat

SEQ ID NO: 642587 - DNA, 17 bp, Homo sapiens
accctccacaggagccg

SEQ ID NO: 642588 - DNA, 16 bp, Homo sapiens
accctcccctctcctg

SEQ ID NO: 642589 - DNA, 14 bp, Homo sapiens
accctccctgtccc

SEQ ID NO: 642590 - DNA, 17 bp, Homo sapiens
accctccctgtcccctg

SEQ ID NO: 642591 - DNA, 19 bp, Homo sapiens
accctccctgtcccctgag

SEQ ID NO: 642592 - DNA, 18 bp, Homo sapiens
accctccggccagcgagt

SEQ ID NO: 642593 - DNA, 12 bp, Homo sapiens
accctctgagac

SEQ ID NO: 642594 - DNA, 15 bp, Homo sapiens
accctctgctatgtc

SEQ ID NO: 642595 - DNA, 18 bp, Homo sapiens
agcggccccgcggagccc

SEQ ID NO: 642596 - DNA, 20 bp, Homo sapiens
agcggccccgcggagccccc

SEQ ID NO: 642597 - DNA, 21 bp, Homo sapiens
agcggcccggcccacgcagag

SEQ ID NO: 642598 - DNA, 23 bp, Homo sapiens
agcggcccggcccacgcagagcc

SEQ ID NO: 642599 - DNA, 15 bp, Homo sapiens
agcggctgaggacgg

SEQ ID NO: 642600 - DNA, 23 bp, Homo sapiens
agcggctgaggacggggcagagc

SEQ ID NO: 642601 - DNA, 12 bp, Homo sapiens
agcggggcttct

SEQ ID NO: 642602 - DNA, 15 bp, Homo sapiens
agcggggcttctggg

SEQ ID NO: 642603 - DNA, 23 bp, Homo sapiens
agcgggggctaactggccccagg

SEQ ID NO: 642604 - DNA, 16 bp, Homo sapiens
agcgtctccccatgct

SEQ ID NO: 642605 - DNA, 19 bp, Homo sapiens
agcgtctccccatgctggg

SEQ ID NO: 642606 - DNA, 23 bp, Homo sapiens
agcgtctccccatgctgggctca

SEQ ID NO: 642607 - DNA, 14 bp, Homo sapiens
agcgtgtcctatcc

SEQ ID NO: 642608 - DNA, 15 bp, Homo sapiens
agcgtgtcctatccc

SEQ ID NO: 642609 - DNA, 17 bp, Homo sapiens
agcgttgttttgtggat

SEQ ID NO: 642610 - DNA, 15 bp, Homo sapiens
agctaaaacacttct

SEQ ID NO: 642611 - DNA, 17 bp, Homo sapiens
agctaagcctgatgatg

SEQ ID NO: 642612 - DNA, 22 bp, Homo sapiens
agctaatgtggtagtgaaaatc

SEQ ID NO: 642613 - DNA, 17 bp, Homo sapiens
agctacaggggaggctg

SEQ ID NO: 642614 - DNA, 17 bp, Homo sapiens
agctacatatgtaggaa

SEQ ID NO: 642615 - DNA, 19 bp, Homo sapiens
agctacatatgtaggaaaa

SEQ ID NO: 642616 - DNA, 18 bp, Homo sapiens
agctaccatgttaataca

SEQ ID NO: 642617 - DNA, 21 bp, Homo sapiens
agctagaaagagaaaaagccc

SEQ ID NO: 642618 - DNA, 15 bp, Homo sapiens
agctagatgcccctg

SEQ ID NO: 642619 - DNA, 19 bp, Homo sapiens
agctagtttaaaattatta

SEQ ID NO: 642620 - DNA, 12 bp, Homo sapiens
agctataaatag

SEQ ID NO: 642621 - DNA, 17 bp, Homo sapiens
agctatgcacaccaaat

SEQ ID NO: 642622 - DNA, 22 bp, Homo sapiens
agctatgcacaccaaattgctg

SEQ ID NO: 642623 - DNA, 15 bp, Homo sapiens
agctatggacaattt

SEQ ID NO: 642624 - DNA, 22 bp, Homo sapiens
agctatttaagtggactgtatt

SEQ ID NO: 642625 - DNA, 23 bp, Homo sapiens
agctatttaagtggactgtattt

SEQ ID NO: 642626 - DNA, 14 bp, Homo sapiens
agctcaaggctgca

SEQ ID NO: 642627 - DNA, 17 bp, Homo sapiens
agctcacacttgggctg

SEQ ID NO: 642628 - DNA, 19 bp, Homo sapiens
agctcacacttgggctggc

SEQ ID NO: 642629 - DNA, 14 bp, Homo sapiens
agctcaggagaagg

SEQ ID NO: 642630 - DNA, 13 bp, Homo sapiens
agctccactctga

SEQ ID NO: 642631 - DNA, 21 bp, Homo sapiens
agctcctcgggtggggcctgc

SEQ ID NO: 642632 - DNA, 16 bp, Homo sapiens
agctccttcatgcttt

SEQ ID NO: 642633 - DNA, 19 bp, Homo sapiens
agctcgtagaaacaagaca

SEQ ID NO: 642634 - DNA, 17 bp, Homo sapiens
agctcgtgtgcttagaa

SEQ ID NO: 642635 - DNA, 15 bp, Homo sapiens
agctctaaagcagag

SEQ ID NO: 642636 - DNA, 14 bp, Homo sapiens
agctctgagcagac

SEQ ID NO: 642637 - DNA, 14 bp, Homo sapiens
agctctgcataaga

SEQ ID NO: 642638 - DNA, 17 bp, Homo sapiens
agctctggatgaaggca

SEQ ID NO: 642639 - DNA, 23 bp, Homo sapiens
agctcttcccctttcctggggga

SEQ ID NO: 642640 - DNA, 13 bp, Homo sapiens
agctgagctggcc

SEQ ID NO: 642641 - DNA, 19 bp, Homo sapiens
agctgagtcggctgggcag

SEQ ID NO: 642642 - DNA, 20 bp, Homo sapiens
agctgagtcggctgggcagg

SEQ ID NO: 642643 - DNA, 23 bp, Homo sapiens
agctgagtcggctgggcagggcc

SEQ ID NO: 642644 - DNA, 14 bp, Homo sapiens
agctgattagtgtc

SEQ ID NO: 642645 - DNA, 16 bp, Homo sapiens
agctgcaggaatcaaa

SEQ ID NO: 642646 - DNA, 17 bp, Homo sapiens
agctgcaggaatcaaaa

SEQ ID NO: 642647 - DNA, 22 bp, Homo sapiens
agctgcaggaatcaaaaattga

SEQ ID NO: 642648 - DNA, 23 bp, Homo sapiens
agctgcaggaatcaaaaattgaa

SEQ ID NO: 642649 - DNA, 14 bp, Homo sapiens
agctgctgtatttg

SEQ ID NO: 642650 - DNA, 13 bp, Homo sapiens
agctggcagcgcc

SEQ ID NO: 642651 - DNA, 14 bp, Homo sapiens
agctggcagcgcct

SEQ ID NO: 642652 - DNA, 17 bp, Homo sapiens
agctggcagcgcctccc

SEQ ID NO: 642653 - DNA, 19 bp, Homo sapiens
agctggcagcgcctcccgc

SEQ ID NO: 642654 - DNA, 20 bp, Homo sapiens
agctggcgcgtgtgtggcct

SEQ ID NO: 642655 - DNA, 19 bp, Homo sapiens
agctggctgggtcgcccct

SEQ ID NO: 642656 - DNA, 14 bp, Homo sapiens
agctgggcagggtg

SEQ ID NO: 642657 - DNA, 15 bp, Homo sapiens
agctgggcagggtga

SEQ ID NO: 642658 - DNA, 16 bp, Homo sapiens
agctgtctgtggcttc

SEQ ID NO: 642659 - DNA, 19 bp, Homo sapiens
agcttaagaagtatccctg

SEQ ID NO: 642660 - DNA, 18 bp, Homo sapiens
agcttctgaaaggtgctt

SEQ ID NO: 642661 - DNA, 20 bp, Homo sapiens
agcttctgaaaggtgctttc

SEQ ID NO: 642662 - DNA, 23 bp, Homo sapiens
agcttgagcctgtcacgtggtca

SEQ ID NO: 642663 - DNA, 16 bp, Homo sapiens
agcttgcttctctgcc

SEQ ID NO: 642664 - DNA, 16 bp, Homo sapiens
agcttggagccccctg

SEQ ID NO: 642665 - DNA, 23 bp, Homo sapiens
agcttgtctcaaaaaccattaca

SEQ ID NO: 642666 - DNA, 14 bp, Homo sapiens
agctttctcctttg

SEQ ID NO: 642667 - DNA, 16 bp, Homo sapiens
agctttggaagcagca

SEQ ID NO: 642668 - DNA, 13 bp, Homo sapiens
aggaaaaactgat

SEQ ID NO: 642669 - DNA, 15 bp, Homo sapiens
aggaaaaactgattt

SEQ ID NO: 642670 - DNA, 16 bp, Homo sapiens
aggaaaaggctgcagc

SEQ ID NO: 642671 - DNA, 22 bp, Homo sapiens
aggaaaaggctgcagctaattt

SEQ ID NO: 642672 - DNA, 13 bp, Homo sapiens
aggaaagttctat

SEQ ID NO: 642673 - DNA, 13 bp, Homo sapiens
aggaaatatctgt

SEQ ID NO: 642674 - DNA, 22 bp, Homo sapiens
aggaaatatctgtgaaggactt

SEQ ID NO: 642675 - DNA, 15 bp, Homo sapiens
aggaaatcaccgaaa

SEQ ID NO: 642676 - DNA, 15 bp, Homo sapiens
aggaaatttttgcat

SEQ ID NO: 642677 - DNA, 21 bp, Homo sapiens
aggaagctttggaagcagcaa

SEQ ID NO: 642678 - DNA, 14 bp, Homo sapiens
aggaaggacatttc

SEQ ID NO: 642679 - DNA, 14 bp, Homo sapiens
aggaataacactgc

SEQ ID NO: 642680 - DNA, 15 bp, Homo sapiens
aggaataacactgca

SEQ ID NO: 642681 - DNA, 17 bp, Homo sapiens
aggaataacactgcagc

SEQ ID NO: 642682 - DNA, 18 bp, Homo sapiens
aggaatagagttttcctc

SEQ ID NO: 642683 - DNA, 21 bp, Homo sapiens
aggaatgctcaatgtgctgtt

SEQ ID NO: 642684 - DNA, 21 bp, Homo sapiens
aggaatgggccaagccagggt

SEQ ID NO: 642685 - DNA, 21 bp, Homo sapiens
aggacaacctgcccctcccca

SEQ ID NO: 642686 - DNA, 14 bp, Homo sapiens
aggacacagcacaa

SEQ ID NO: 642687 - DNA, 22 bp, Homo sapiens
aggacacagcacaagggcacat

SEQ ID NO: 642688 - DNA, 22 bp, Homo sapiens
aggacagaggccggggtccagg

SEQ ID NO: 642689 - DNA, 15 bp, Homo sapiens
aggacagagtgccct

SEQ ID NO: 642690 - DNA, 20 bp, Homo sapiens
aggacagagtgccctggggc

SEQ ID NO: 642691 - DNA, 21 bp, Homo sapiens
aggacagtgttcaaattctga

SEQ ID NO: 642692 - DNA, 12 bp, Homo sapiens
aggaccatttta

SEQ ID NO: 642693 - DNA, 13 bp, Homo sapiens
aggacccctgccc

SEQ ID NO: 642694 - DNA, 18 bp, Homo sapiens
aggacgcatgcagggccc

SEQ ID NO: 642695 - DNA, 14 bp, Homo sapiens
aggactacagaatt

SEQ ID NO: 642696 - DNA, 21 bp, Homo sapiens
aggactctcacgatatgcaag

SEQ ID NO: 642697 - DNA, 14 bp, Homo sapiens
aggactgaagaaaa

SEQ ID NO: 642698 - DNA, 14 bp, Homo sapiens
aggactgttctaac

SEQ ID NO: 642699 - DNA, 14 bp, Homo sapiens
aggagaaggaggaa

SEQ ID NO: 642700 - DNA, 16 bp, Homo sapiens
aggagaaggcctgccc

SEQ ID NO: 642701 - DNA, 22 bp, Homo sapiens
aggagaaggcctgccccccttc

SEQ ID NO: 642702 - DNA, 19 bp, Homo sapiens
aggagagccctctgctgct

SEQ ID NO: 642703 - DNA, 19 bp, Homo sapiens
aggagaggtcttgctcaca

SEQ ID NO: 642704 - DNA, 18 bp, Homo sapiens
aggagagtggcaggtggg

SEQ ID NO: 642705 - DNA, 17 bp, Homo sapiens
aggagatggggagggcg

SEQ ID NO: 642706 - DNA, 16 bp, Homo sapiens
aggagattgctctggg

SEQ ID NO: 642707 - DNA, 9 bp, Homo sapiens
aggagcacc

SEQ ID NO: 642708 - DNA, 23 bp, Homo sapiens
aggagcacccccagcctccccca

SEQ ID NO: 642709 - DNA, 14 bp, Homo sapiens
aggagccttgctgg

SEQ ID NO: 642710 - DNA, 17 bp, Homo sapiens
aggagccttgctgggcc

SEQ ID NO: 642711 - DNA, 19 bp, Homo sapiens
aggagctagcccagtccct

SEQ ID NO: 642712 - DNA, 13 bp, Homo sapiens
aggagcttccaga

SEQ ID NO: 642713 - DNA, 13 bp, Homo sapiens
agttggcctctgc

SEQ ID NO: 642714 - DNA, 13 bp, Homo sapiens
agttgtaaagata

SEQ ID NO: 642715 - DNA, 18 bp, Homo sapiens
agttgtattttaataaag

SEQ ID NO: 642716 - DNA, 13 bp, Homo sapiens
agttgtgatctgt

SEQ ID NO: 642717 - DNA, 12 bp, Homo sapiens
agtttaaatctt

SEQ ID NO: 642718 - DNA, 19 bp, Homo sapiens
agtttaaatctttgttaaa

SEQ ID NO: 642719 - DNA, 12 bp, Homo sapiens
agtttaacagaa

SEQ ID NO: 642720 - DNA, 15 bp, Homo sapiens
agtttacaaacaaga

SEQ ID NO: 642721 - DNA, 23 bp, Homo sapiens
agtttattttttttcttccaaca

SEQ ID NO: 642722 - DNA, 19 bp, Homo sapiens
agtttccagctaagcctga

SEQ ID NO: 642723 - DNA, 21 bp, Homo sapiens
agtttctaaaccatgaaaagt

SEQ ID NO: 642724 - DNA, 12 bp, Homo sapiens
agtttggccctg

SEQ ID NO: 642725 - DNA, 17 bp, Homo sapiens
agtttggccctggagcc

SEQ ID NO: 642726 - DNA, 23 bp, Homo sapiens
agtttggccctggagccagggca

SEQ ID NO: 642727 - DNA, 23 bp, Homo sapiens
agtttggtatgaaacaaatatac

SEQ ID NO: 642728 - DNA, 12 bp, Homo sapiens
agtttgtgaagt

SEQ ID NO: 642729 - DNA, 21 bp, Homo sapiens
agtttgtgaagtgattgacat

SEQ ID NO: 642730 - DNA, 16 bp, Homo sapiens
agttttaaaaaaataa

SEQ ID NO: 642731 - DNA, 12 bp, Homo sapiens
agttttcagatt

SEQ ID NO: 642732 - DNA, 10 bp, Homo sapiens
agttttccag

SEQ ID NO: 642733 - DNA, 11 bp, Homo sapiens
agttttcccta

SEQ ID NO: 642734 - DNA, 15 bp, Homo sapiens
agttttcgataaagg

SEQ ID NO: 642735 - DNA, 16 bp, Homo sapiens
agttttcttttaattt

SEQ ID NO: 642736 - DNA, 21 bp, Homo sapiens
agtttttgttcaccttctgtg

SEQ ID NO: 642737 - DNA, 13 bp, Homo sapiens
ataaaaataatta

SEQ ID NO: 642738 - DNA, 13 bp, Homo sapiens
ataaaacatttta

SEQ ID NO: 642739 - DNA, 23 bp, Homo sapiens
ataaaacattttaaatggacaga

SEQ ID NO: 642740 - DNA, 15 bp, Homo sapiens
ataaaaccagaaaga

SEQ ID NO: 642741 - DNA, 18 bp, Homo sapiens
ataaaaccagaaagagga

SEQ ID NO: 642742 - DNA, 11 bp, Homo sapiens
ataaaatacac

SEQ ID NO: 642743 - DNA, 19 bp, Homo sapiens
ataaaatacacgtgtatat

SEQ ID NO: 642744 - DNA, 21 bp, Homo sapiens
ataaaatacacgtgtatatga

SEQ ID NO: 642745 - DNA, 13 bp, Homo sapiens
ataaaatgtttat

SEQ ID NO: 642746 - DNA, 18 bp, Homo sapiens
ataaacacagattatttg

SEQ ID NO: 642747 - DNA, 18 bp, Homo sapiens
ataaacacttctccttaa

SEQ ID NO: 642748 - DNA, 12 bp, Homo sapiens
ataaactgtgag

SEQ ID NO: 642749 - DNA, 13 bp, Homo sapiens
ataaacttgtact

SEQ ID NO: 642750 - DNA, 15 bp, Homo sapiens
ataaacttgtactta

SEQ ID NO: 642751 - DNA, 14 bp, Homo sapiens
ataaagaagatgtt

SEQ ID NO: 642752 - DNA, 19 bp, Homo sapiens
ataaagagcacgttttcca

SEQ ID NO: 642753 - DNA, 18 bp, Homo sapiens
ataaagctaccatgttaa

SEQ ID NO: 642754 - DNA, 22 bp, Homo sapiens
ataaagctaccatgttaataca

SEQ ID NO: 642755 - DNA, 13 bp, Homo sapiens
atcaaatttttct

SEQ ID NO: 642756 - DNA, 15 bp, Homo sapiens
atcaaggagggagaa

SEQ ID NO: 642757 - DNA, 14 bp, Homo sapiens
atcaagtctgtgaa

SEQ ID NO: 642758 - DNA, 14 bp, Homo sapiens
atcaattaattttt

SEQ ID NO: 642759 - DNA, 21 bp, Homo sapiens
atcacatgcccctcttagaag

SEQ ID NO: 642760 - DNA, 14 bp, Homo sapiens
atcaccgaaaacgt

SEQ ID NO: 642761 - DNA, 16 bp, Homo sapiens
atcacgggcccgctca

SEQ ID NO: 642762 - DNA, 17 bp, Homo sapiens
atcagaaagacattctt

SEQ ID NO: 642763 - DNA, 19 bp, Homo sapiens
atcagaaagacattcttag

SEQ ID NO: 642764 - DNA, 19 bp, Homo sapiens
atcagaactcctttctaag

SEQ ID NO: 642765 - DNA, 13 bp, Homo sapiens
atcagaggcagag

SEQ ID NO: 642766 - DNA, 16 bp, Homo sapiens
atcagcaacatcattc

SEQ ID NO: 642767 - DNA, 19 bp, Homo sapiens
atcagcagcggcagcagca

SEQ ID NO: 642768 - DNA, 23 bp, Homo sapiens
atcaggaaatatctgtgaaggac

SEQ ID NO: 642769 - DNA, 15 bp, Homo sapiens
atcaggacttgggaa

SEQ ID NO: 642770 - DNA, 20 bp, Homo sapiens
atcaggaggggtgttaaaac

SEQ ID NO: 642771 - DNA, 23 bp, Homo sapiens
atcagggcaagctcatagcacat

SEQ ID NO: 642772 - DNA, 18 bp, Homo sapiens
atcaggtaaactgatgct

SEQ ID NO: 642773 - DNA, 14 bp, Homo sapiens
atcagtacaattct

SEQ ID NO: 642774 - DNA, 21 bp, Homo sapiens
atcagtatttggactttttaa

SEQ ID NO: 642775 - DNA, 22 bp, Homo sapiens
atcagtccacccccattgtgaa

SEQ ID NO: 642776 - DNA, 21 bp, Homo sapiens
atcagtggttcgggggaaata

SEQ ID NO: 642777 - DNA, 21 bp, Homo sapiens
atcagttacagtggcagtatt

SEQ ID NO: 642778 - DNA, 22 bp, Homo sapiens
atcataaagagcacgttttcca

SEQ ID NO: 642779 - DNA, 17 bp, Homo sapiens
atcataagttagatgtt

SEQ ID NO: 642780 - DNA, 14 bp, Homo sapiens
atactggctggtga

SEQ ID NO: 642781 - DNA, 13 bp, Homo sapiens
atacttcaaatgt

SEQ ID NO: 642782 - DNA, 16 bp, Homo sapiens
atacttcaaatgtcat

SEQ ID NO: 642783 - DNA, 20 bp, Homo sapiens
atacttccatgcactcttca

SEQ ID NO: 642784 - DNA, 18 bp, Homo sapiens
atacttgacaacattttt

SEQ ID NO: 642785 - DNA, 13 bp, Homo sapiens
atacttggtcctt

SEQ ID NO: 642786 - DNA, 17 bp, Homo sapiens
atacttggtccttaaaa

SEQ ID NO: 642787 - DNA, 12 bp, Homo sapiens
atagaaatacat

SEQ ID NO: 642788 - DNA, 19 bp, Homo sapiens
atagaaatttactatgtaa

SEQ ID NO: 642789 - DNA, 15 bp, Homo sapiens
atagaagaaggactg

SEQ ID NO: 642790 - DNA, 14 bp, Homo sapiens
atagagttcataga

SEQ ID NO: 642791 - DNA, 17 bp, Homo sapiens
atagagttcatagaaat

SEQ ID NO: 642792 - DNA, 18 bp, Homo sapiens
atagataccattttgaaa

SEQ ID NO: 642793 - DNA, 20 bp, Homo sapiens
atagataccattttgaaata

SEQ ID NO: 642794 - DNA, 22 bp, Homo sapiens
atagataccattttgaaatatt

SEQ ID NO: 642795 - DNA, 15 bp, Homo sapiens
atagatggtagaaac

SEQ ID NO: 642796 - DNA, 21 bp, Homo sapiens
atagatggtagaaactttgga

SEQ ID NO: 642797 - DNA, 12 bp, Homo sapiens
atagatgtgaaa

SEQ ID NO: 642798 - DNA, 12 bp, Homo sapiens
atagcacatgtt

SEQ ID NO: 642799 - DNA, 20 bp, Homo sapiens
atagcatgtaatattaaatt

SEQ ID NO: 642800 - DNA, 22 bp, Homo sapiens
atagcatgtattgtgtcttttg

SEQ ID NO: 642801 - DNA, 23 bp, Homo sapiens
atagccagcattcagcacacaca

SEQ ID NO: 642802 - DNA, 20 bp, Homo sapiens
atagccattcatttacaact

SEQ ID NO: 642803 - DNA, 18 bp, Homo sapiens
atagccccaggcccgccc

SEQ ID NO: 642804 - DNA, 17 bp, Homo sapiens
atagcctcaccttccct

SEQ ID NO: 642805 - DNA, 17 bp, Homo sapiens
atagctcacagcacatt

SEQ ID NO: 642806 - DNA, 18 bp, Homo sapiens
atagctcacagcacattt

SEQ ID NO: 642807 - DNA, 19 bp, Homo sapiens
atagctccttcatgctttt

SEQ ID NO: 642808 - DNA, 22 bp, Homo sapiens
atagctgatagaagaaggactg

SEQ ID NO: 642809 - DNA, 23 bp, Homo sapiens
atagcttttcacttcttaaggac

SEQ ID NO: 642810 - DNA, 12 bp, Homo sapiens
ataggaaaaact

SEQ ID NO: 642811 - DNA, 15 bp, Homo sapiens
ataggaaataaatct

SEQ ID NO: 642812 - DNA, 14 bp, Homo sapiens
ataggagaggaaaa

SEQ ID NO: 642813 - DNA, 15 bp, Homo sapiens
atagggtttggaaga

SEQ ID NO: 642814 - DNA, 13 bp, Homo sapiens
atgctggctgggg

SEQ ID NO: 642815 - DNA, 15 bp, Homo sapiens
atgctggctggggcc

SEQ ID NO: 642816 - DNA, 20 bp, Homo sapiens
atgctgtccctgtgggctca

SEQ ID NO: 642817 - DNA, 21 bp, Homo sapiens
atgctgtccctgtgggctcac

SEQ ID NO: 642818 - DNA, 12 bp, Homo sapiens
atgctgtgtgca

SEQ ID NO: 642819 - DNA, 18 bp, Homo sapiens
atgcttaaataaaaatta

SEQ ID NO: 642820 - DNA, 14 bp, Homo sapiens
atgcttacagtgac

SEQ ID NO: 642821 - DNA, 13 bp, Homo sapiens
atgctttctcatg

SEQ ID NO: 642822 - DNA, 17 bp, Homo sapiens
atgctttgaaaatgttt

SEQ ID NO: 642823 - DNA, 13 bp, Homo sapiens
atgcttttctcat

SEQ ID NO: 642824 - DNA, 16 bp, Homo sapiens
atgcttttctcatggt

SEQ ID NO: 642825 - DNA, 14 bp, Homo sapiens
attaaaacaagaga

SEQ ID NO: 642826 - DNA, 21 bp, Homo sapiens
attaaaacaagagaccacttc

SEQ ID NO: 642827 - DNA, 11 bp, Homo sapiens
attaaaatatt

SEQ ID NO: 642828 - DNA, 23 bp, Homo sapiens
attaaaatcttgaaagcgaaata

SEQ ID NO: 642829 - DNA, 18 bp, Homo sapiens
attaaactgggaaatgag

SEQ ID NO: 642830 - DNA, 17 bp, Homo sapiens
attaaagtctgagaaat

SEQ ID NO: 642831 - DNA, 15 bp, Homo sapiens
attaaagtgtccatt

SEQ ID NO: 642832 - DNA, 13 bp, Homo sapiens
attttatgtttaa

SEQ ID NO: 642833 - DNA, 14 bp, Homo sapiens
attttatgtttaaa

SEQ ID NO: 642834 - DNA, 22 bp, Homo sapiens
attttatgtttaaaatggcatt

SEQ ID NO: 642835 - DNA, 15 bp, Homo sapiens
attttattgaatata

SEQ ID NO: 642836 - DNA, 14 bp, Homo sapiens
attttattgtaaca

SEQ ID NO: 642837 - DNA, 15 bp, Homo sapiens
attttattgtaacag

SEQ ID NO: 642838 - DNA, 16 bp, Homo sapiens
attttattgtaacaga

SEQ ID NO: 642839 - DNA, 18 bp, Homo sapiens
attttattgtaacagaca

SEQ ID NO: 642840 - DNA, 21 bp, Homo sapiens
attttattgtaacagacattg

SEQ ID NO: 642841 - DNA, 16 bp, Homo sapiens
attttcaagtggaaac

SEQ ID NO: 642842 - DNA, 14 bp, Homo sapiens
attttcagatcctt

SEQ ID NO: 642843 - DNA, 14 bp, Homo sapiens
attttcattttcat

SEQ ID NO: 642844 - DNA, 17 bp, Homo sapiens
attttccagggcaatca

SEQ ID NO: 642845 - DNA, 21 bp, Homo sapiens
attttccttttttatacacat

SEQ ID NO: 642846 - DNA, 19 bp, Homo sapiens
attttctgtaattcttctc

SEQ ID NO: 642847 - DNA, 19 bp, Homo sapiens
attttgaaaggagaaaaaa

SEQ ID NO: 642848 - DNA, 20 bp, Homo sapiens
attttgattgtttgatgaat

SEQ ID NO: 642849 - DNA, 18 bp, Homo sapiens
attttgcagctatggaca

SEQ ID NO: 642850 - DNA, 13 bp, Homo sapiens
attttgtcagttt

SEQ ID NO: 642851 - DNA, 12 bp, Homo sapiens
attttgtctggc

SEQ ID NO: 642852 - DNA, 15 bp, Homo sapiens
attttgtctggctgt

SEQ ID NO: 642853 - DNA, 18 bp, Homo sapiens
attttgttttgctttttc

SEQ ID NO: 642854 - DNA, 21 bp, Homo sapiens
attttgttttgctttttctga

SEQ ID NO: 642855 - DNA, 22 bp, Homo sapiens
attttgttttgctttttctgac

SEQ ID NO: 642856 - DNA, 18 bp, Homo sapiens
atttttaagtaatttcat

SEQ ID NO: 642857 - DNA, 19 bp, Homo sapiens
atttttaagtaatttcatg

SEQ ID NO: 642858 - DNA, 18 bp, Homo sapiens
atttttactcaggctttc

SEQ ID NO: 642859 - DNA, 20 bp, Homo sapiens
atttttactcaggctttcta

SEQ ID NO: 642860 - DNA, 16 bp, Homo sapiens
atttttgagtaaaact

SEQ ID NO: 642861 - DNA, 14 bp, Homo sapiens
atttttgcatgttt

SEQ ID NO: 642862 - DNA, 22 bp, Homo sapiens
atttttttattgtttaaagcaa

SEQ ID NO: 642863 - DNA, 18 bp, Homo sapiens
atttttttccagaattga

SEQ ID NO: 642864 - DNA, 18 bp, Homo sapiens
atttttttttccttcagt

SEQ ID NO: 642865 - DNA, 15 bp, Homo sapiens
caaaaaaaagaaaga

SEQ ID NO: 642866 - DNA, 19 bp, Homo sapiens
caaaaaaaagaaagaaaaa

SEQ ID NO: 642867 - DNA, 14 bp, Homo sapiens
caaaaaacagaaaa

SEQ ID NO: 642868 - DNA, 16 bp, Homo sapiens
caaaaaacagaaaaac

SEQ ID NO: 642869 - DNA, 15 bp, Homo sapiens
caaaaaatttaagag

SEQ ID NO: 642870 - DNA, 16 bp, Homo sapiens
caaaaactgtactgtg

SEQ ID NO: 642871 - DNA, 17 bp, Homo sapiens
caaaaactgtactgtgt

SEQ ID NO: 642872 - DNA, 16 bp, Homo sapiens
caaaaactttccatga

SEQ ID NO: 642873 - DNA, 21 bp, Homo sapiens
caaaaactttccatgacagta

SEQ ID NO: 642874 - DNA, 17 bp, Homo sapiens
caaaacaaattcaagaa

SEQ ID NO: 642875 - DNA, 12 bp, Homo sapiens
caaaacaacagc

SEQ ID NO: 642876 - DNA, 20 bp, Homo sapiens
caaaacaacagcaacaacaa

SEQ ID NO: 642877 - DNA, 14 bp, Homo sapiens
caaaaggatgattt

SEQ ID NO: 642878 - DNA, 16 bp, Homo sapiens
caaaataaaaccagaa

SEQ ID NO: 642879 - DNA, 19 bp, Homo sapiens
caaaatacatgatgatttc

SEQ ID NO: 642880 - DNA, 22 bp, Homo sapiens
caaaatacatgatgatttcaga

SEQ ID NO: 642881 - DNA, 19 bp, Homo sapiens
caaaatatattgaagtaag

SEQ ID NO: 642882 - DNA, 21 bp, Homo sapiens
caaaatcttaaccttcaaata

SEQ ID NO: 642883 - DNA, 15 bp, Homo sapiens
caaaatgaattgcct

SEQ ID NO: 642884 - DNA, 16 bp, Homo sapiens
caaaatgaattgcctt

SEQ ID NO: 642885 - DNA, 11 bp, Homo sapiens
caaaatgtgcc

SEQ ID NO: 642886 - DNA, 17 bp, Homo sapiens
caaaatttatgtcattt

SEQ ID NO: 642887 - DNA, 18 bp, Homo sapiens
caaaatttatgtcatttt

SEQ ID NO: 642888 - DNA, 17 bp, Homo sapiens
caaacaaatcattttga

SEQ ID NO: 642889 - DNA, 18 bp, Homo sapiens
caaacaaatcattttgat

SEQ ID NO: 642890 - DNA, 22 bp, Homo sapiens
caaacaaatcattttgatgtat

SEQ ID NO: 642891 - DNA, 14 bp, Homo sapiens
caaacaacaaagca

SEQ ID NO: 642892 - DNA, 19 bp, Homo sapiens
caaacacacagactctgtg

SEQ ID NO: 642893 - DNA, 19 bp, Homo sapiens
caaacactgcttaaggaaa

SEQ ID NO: 642894 - DNA, 14 bp, Homo sapiens
caaacagtgtggct

SEQ ID NO: 642895 - DNA, 15 bp, Homo sapiens
caaaccaatttgttc

SEQ ID NO: 642896 - DNA, 14 bp, Homo sapiens
caaaccatcattga

SEQ ID NO: 642897 - DNA, 14 bp, Homo sapiens
caaacctactgccc

SEQ ID NO: 642898 - DNA, 19 bp, Homo sapiens
caaacctactgcccacatt

SEQ ID NO: 642899 - DNA, 20 bp, Homo sapiens
caaacctactgcccacattt

SEQ ID NO: 642900 - DNA, 22 bp, Homo sapiens
caaacctactgcccacatttgg

SEQ ID NO: 642901 - DNA, 13 bp, Homo sapiens
caaactgaaatta

SEQ ID NO: 642902 - DNA, 15 bp, Homo sapiens
caaactgaaattagt

SEQ ID NO: 642903 - DNA, 21 bp, Homo sapiens
caaactgaaattagtgttttc

SEQ ID NO: 642904 - DNA, 22 bp, Homo sapiens
caaactgaaattagtgttttca

SEQ ID NO: 642905 - DNA, 23 bp, Homo sapiens
caaactgaaattagtgttttcat

SEQ ID NO: 642906 - DNA, 15 bp, Homo sapiens
caaacttttataaat

SEQ ID NO: 642907 - DNA, 17 bp, Homo sapiens
caaacttttataaatgt

SEQ ID NO: 642908 - DNA, 13 bp, Homo sapiens
caaagaaaacaga

SEQ ID NO: 642909 - DNA, 17 bp, Homo sapiens
caaagaacccccctccc

SEQ ID NO: 642910 - DNA, 13 bp, Homo sapiens
caaagagtagaac

SEQ ID NO: 642911 - DNA, 18 bp, Homo sapiens
caaagagtagaactttaa

SEQ ID NO: 642912 - DNA, 19 bp, Homo sapiens
caaagatccagcggggctt

SEQ ID NO: 642913 - DNA, 17 bp, Homo sapiens
caaagcccacttcacac

SEQ ID NO: 642914 - DNA, 14 bp, Homo sapiens
caaaggtgcctcat

SEQ ID NO: 642915 - DNA, 15 bp, Homo sapiens
caaaggttgtacata

SEQ ID NO: 642916 - DNA, 16 bp, Homo sapiens
caaaggttgtacatag

SEQ ID NO: 642917 - DNA, 21 bp, Homo sapiens
caaagttaaacgtgatgtgct

SEQ ID NO: 642918 - DNA, 23 bp, Homo sapiens
caaagtttacattgtcctgtagc

SEQ ID NO: 642919 - DNA, 22 bp, Homo sapiens
caaataaatcatcctcatgtcc

SEQ ID NO: 642920 - DNA, 18 bp, Homo sapiens
caaataagcatctgtgta

SEQ ID NO: 642921 - DNA, 11 bp, Homo sapiens
caaatacacat

SEQ ID NO: 642922 - DNA, 12 bp, Homo sapiens
caaatacacata

SEQ ID NO: 642923 - DNA, 18 bp, Homo sapiens
caaatacacatacatata

SEQ ID NO: 642924 - DNA, 14 bp, Homo sapiens
caaatacatgcctt

SEQ ID NO: 642925 - DNA, 17 bp, Homo sapiens
caaatagcttttcactt

SEQ ID NO: 642926 - DNA, 17 bp, Homo sapiens
caaatataacatgaaag

SEQ ID NO: 642927 - DNA, 13 bp, Homo sapiens
caaatatactcat

SEQ ID NO: 642928 - DNA, 19 bp, Homo sapiens
caaatatactcatttggat

SEQ ID NO: 642929 - DNA, 23 bp, Homo sapiens
caaatattgctattgtttatagg

SEQ ID NO: 642930 - DNA, 20 bp, Homo sapiens
caaatattttcaagcttttt

SEQ ID NO: 642931 - DNA, 15 bp, Homo sapiens
caaatatttttttgt

SEQ ID NO: 642932 - DNA, 14 bp, Homo sapiens
caaatcattttgat

SEQ ID NO: 642933 - DNA, 23 bp, Homo sapiens
caaatccaacgcttttcccacct

SEQ ID NO: 642934 - DNA, 21 bp, Homo sapiens
caaatgaatttatcattttag

SEQ ID NO: 642935 - DNA, 16 bp, Homo sapiens
caaatgatttcgtgac

SEQ ID NO: 642936 - DNA, 15 bp, Homo sapiens
caaatgctactcagt

SEQ ID NO: 642937 - DNA, 16 bp, Homo sapiens
caaatggatgtaatat

SEQ ID NO: 642938 - DNA, 13 bp, Homo sapiens
caaatggtatttt

SEQ ID NO: 642939 - DNA, 22 bp, Homo sapiens
caaatggtattttttgtgaatg

SEQ ID NO: 642940 - DNA, 17 bp, Homo sapiens
caaatgtacccagccta

SEQ ID NO: 642941 - DNA, 16 bp, Homo sapiens
caaatgtcatttcata

SEQ ID NO: 642942 - DNA, 19 bp, Homo sapiens
caattgtatatatatgtga

SEQ ID NO: 642943 - DNA, 18 bp, Homo sapiens
caatttaggaatgctcaa

SEQ ID NO: 642944 - DNA, 15 bp, Homo sapiens
caatttcagaaacta

SEQ ID NO: 642945 - DNA, 22 bp, Homo sapiens
caattttggtttttctcatttg

SEQ ID NO: 642946 - DNA, 19 bp, Homo sapiens
caatttttaacttatctcc

SEQ ID NO: 642947 - DNA, 16 bp, Homo sapiens
cacaaaaaatttaaga

SEQ ID NO: 642948 - DNA, 16 bp, Homo sapiens
cacaaaacaacagcaa

SEQ ID NO: 642949 - DNA, 18 bp, Homo sapiens
cacaaacctactgcccac

SEQ ID NO: 642950 - DNA, 20 bp, Homo sapiens
cacaaagctatttaagtgga

SEQ ID NO: 642951 - DNA, 22 bp, Homo sapiens
cacaaagctatttaagtggact

SEQ ID NO: 642952 - DNA, 23 bp, Homo sapiens
cacaaagtgaaattagtattttg

SEQ ID NO: 642953 - DNA, 14 bp, Homo sapiens
cacaactgtggata

SEQ ID NO: 642954 - DNA, 13 bp, Homo sapiens
cacaagcagacac

SEQ ID NO: 642955 - DNA, 14 bp, Homo sapiens
attttatctcttct

SEQ ID NO: 642956 - DNA, 16 bp, Homo sapiens
attttatgcaaatatt

SEQ ID NO: 642957 - DNA, 16 bp, Homo sapiens
caccctgttccctctt

SEQ ID NO: 642958 - DNA, 11 bp, Homo sapiens
cacccttcccc

SEQ ID NO: 642959 - DNA, 12 bp, Homo sapiens
cacccttcccca

SEQ ID NO: 642960 - DNA, 15 bp, Homo sapiens
cacccttccccactc

SEQ ID NO: 642961 - DNA, 15 bp, Homo sapiens
caccgaaaacgtggc

SEQ ID NO: 642962 - DNA, 22 bp, Homo sapiens
caccgaaaacgtggctgcttca

SEQ ID NO: 642963 - DNA, 22 bp, Homo sapiens
caccgagaggaaaaaggcttct

SEQ ID NO: 642964 - DNA, 21 bp, Homo sapiens
caccgcccaacccccacctcc

SEQ ID NO: 642965 - DNA, 22 bp, Homo sapiens
caccgcccaacccccacctccc

SEQ ID NO: 642966 - DNA, 16 bp, Homo sapiens
caccgcgcccctctgc

SEQ ID NO: 642967 - DNA, 16 bp, Homo sapiens
caccggacgctggaga

SEQ ID NO: 642968 - DNA, 20 bp, Homo sapiens
caccggacgctggagaccct

SEQ ID NO: 642969 - DNA, 16 bp, Homo sapiens
caccggcactgtgcac

SEQ ID NO: 642970 - DNA, 20 bp, Homo sapiens
cacctaaagggaagccctga

SEQ ID NO: 642971 - DNA, 11 bp, Homo sapiens
cacctccaccc

SEQ ID NO: 642972 - DNA, 12 bp, Homo sapiens
cacctccacccg

SEQ ID NO: 642973 - DNA, 23 bp, Homo sapiens
cacctcccggtgtatgcagtggt

SEQ ID NO: 642974 - DNA, 19 bp, Homo sapiens
cacctccgggactgacctt

SEQ ID NO: 642975 - DNA, 18 bp, Homo sapiens
cacctcctccgtgggcag

SEQ ID NO: 642976 - DNA, 23 bp, Homo sapiens
cacctcctccgtgggcagctcct

SEQ ID NO: 642977 - DNA, 15 bp, Homo sapiens
cacctgaataaggga

SEQ ID NO: 642978 - DNA, 17 bp, Homo sapiens
cacctgccaggcctccc

SEQ ID NO: 642979 - DNA, 14 bp, Homo sapiens
cacctgcccagtta

SEQ ID NO: 642980 - DNA, 15 bp, Homo sapiens
cacctgcttctcagc

SEQ ID NO: 642981 - DNA, 15 bp, Homo sapiens
cacctggtggccctg

SEQ ID NO: 642982 - DNA, 13 bp, Homo sapiens
cacctgtcacctt

SEQ ID NO: 642983 - DNA, 17 bp, Homo sapiens
cacctgtcaccttttct

SEQ ID NO: 642984 - DNA, 21 bp, Homo sapiens
caccttacaaagccagctctg

SEQ ID NO: 642985 - DNA, 21 bp, Homo sapiens
caccttctgtgcatctggcct

SEQ ID NO: 642986 - DNA, 22 bp, Homo sapiens
caccttctgtgcatctggcctg

SEQ ID NO: 642987 - DNA, 22 bp, Homo sapiens
caccttgtacagaaccagcact

SEQ ID NO: 642988 - DNA, 23 bp, Homo sapiens
cacgcagagccccggagcaccac

SEQ ID NO: 642989 - DNA, 19 bp, Homo sapiens
cacgcccctccccagcccc

SEQ ID NO: 642990 - DNA, 20 bp, Homo sapiens
cacgccggggctggccctgc

SEQ ID NO: 642991 - DNA, 19 bp, Homo sapiens
cacggagtttccatttgga

SEQ ID NO: 642992 - DNA, 20 bp, Homo sapiens
cacggagtttccatttggat

SEQ ID NO: 642993 - DNA, 11 bp, Homo sapiens
cacggcagctt

SEQ ID NO: 642994 - DNA, 15 bp, Homo sapiens
cacggcagcttgagc

SEQ ID NO: 642995 - DNA, 23 bp, Homo sapiens
cacggccgtccctgacttcccag

SEQ ID NO: 642996 - DNA, 21 bp, Homo sapiens
cacgggagagcgccacccgcc

SEQ ID NO: 642997 - DNA, 22 bp, Homo sapiens
cacgggagagcgccacccgccc

SEQ ID NO: 642998 - DNA, 22 bp, Homo sapiens
cacggggtcgggggaggagcac

SEQ ID NO: 642999 - DNA, 19 bp, Homo sapiens
cacggtccaatccagcctt

SEQ ID NO: 643000 - DNA, 19 bp, Homo sapiens
cacggtgtggggggtgccc

SEQ ID NO: 643001 - DNA, 19 bp, Homo sapiens
cacgtgaggcccctgtgca

SEQ ID NO: 643002 - DNA, 23 bp, Homo sapiens
cacgtgtatatgaggatgtatgt

SEQ ID NO: 643003 - DNA, 14 bp, Homo sapiens
cacgttgcagaaaa

SEQ ID NO: 643004 - DNA, 17 bp, Homo sapiens
cactaaaagtgatgtga

SEQ ID NO: 643005 - DNA, 19 bp, Homo sapiens
cactaaaagtgatgtgatt

SEQ ID NO: 643006 - DNA, 21 bp, Homo sapiens
cactaaaagtgatgtgattta

SEQ ID NO: 643007 - DNA, 19 bp, Homo sapiens
cactaagctttctcctttg

SEQ ID NO: 643008 - DNA, 18 bp, Homo sapiens
cactaatggccaagtgta

SEQ ID NO: 643009 - DNA, 21 bp, Homo sapiens
cactacatgggccagcccttg

SEQ ID NO: 643010 - DNA, 23 bp, Homo sapiens
cactacatgggccagcccttgct

SEQ ID NO: 643011 - DNA, 20 bp, Homo sapiens
cactacctttgtccaggcct

SEQ ID NO: 643012 - DNA, 15 bp, Homo sapiens
cactagccctctttc

SEQ ID NO: 643013 - DNA, 16 bp, Homo sapiens
cactaggtgcccagtc

SEQ ID NO: 643014 - DNA, 20 bp, Homo sapiens
cactaggtgcccagtcttga

SEQ ID NO: 643015 - DNA, 20 bp, Homo sapiens
cactatctttcaggaaattt

SEQ ID NO: 643016 - DNA, 14 bp, Homo sapiens
cactattttatgca

SEQ ID NO: 643017 - DNA, 20 bp, Homo sapiens
cactcagcagccccctgccc

SEQ ID NO: 643018 - DNA, 12 bp, Homo sapiens
cactcaggagca

SEQ ID NO: 643019 - DNA, 19 bp, Homo sapiens
cactcaggagcacagccat

SEQ ID NO: 643020 - DNA, 14 bp, Homo sapiens
cactccactcccct

SEQ ID NO: 643021 - DNA, 15 bp, Homo sapiens
cactccactcccctc

SEQ ID NO: 643022 - DNA, 16 bp, Homo sapiens
cactccactcccctca

SEQ ID NO: 643023 - DNA, 17 bp, Homo sapiens
cactccactcccctcat

SEQ ID NO: 643024 - DNA, 14 bp, Homo sapiens
cactcccagggccc

SEQ ID NO: 643025 - DNA, 18 bp, Homo sapiens
cactcccagggcccgagc

SEQ ID NO: 643026 - DNA, 17 bp, Homo sapiens
cactctgcctggccttg

SEQ ID NO: 643027 - DNA, 18 bp, Homo sapiens
cactgacttctcccgggt

SEQ ID NO: 643028 - DNA, 15 bp, Homo sapiens
cactgagtgaaatat

SEQ ID NO: 643029 - DNA, 18 bp, Homo sapiens
cactgatatattttccag

SEQ ID NO: 643030 - DNA, 18 bp, Homo sapiens
cactgatatcacgggccc

SEQ ID NO: 643031 - DNA, 17 bp, Homo sapiens
cactgatgggtcctgct

SEQ ID NO: 643032 - DNA, 22 bp, Homo sapiens
cactgatgggtcctgctgctcg

SEQ ID NO: 643033 - DNA, 18 bp, Homo sapiens
cagcccccacccccgtca

SEQ ID NO: 643034 - DNA, 19 bp, Homo sapiens
cagccccgcgaccacccct

SEQ ID NO: 643035 - DNA, 23 bp, Homo sapiens
cagccccgcgaccacccctgtgc

SEQ ID NO: 643036 - DNA, 14 bp, Homo sapiens
cagcccctccccat

SEQ ID NO: 643037 - DNA, 20 bp, Homo sapiens
cagccctcacctctgaggac

SEQ ID NO: 643038 - DNA, 17 bp, Homo sapiens
cagccctttgcaggccc

SEQ ID NO: 643039 - DNA, 22 bp, Homo sapiens
cagccctttgcaggcccagcag

SEQ ID NO: 643040 - DNA, 21 bp, Homo sapiens
cagccgcgctctgcccctccg

SEQ ID NO: 643041 - DNA, 11 bp, Homo sapiens
cagcctccccc

SEQ ID NO: 643042 - DNA, 12 bp, Homo sapiens
cagcctccccca

SEQ ID NO: 643043 - DNA, 22 bp, Homo sapiens
cagcctcccccaggctgcgcct

SEQ ID NO: 643044 - DNA, 21 bp, Homo sapiens
cagcctcgttggagagcagca

SEQ ID NO: 643045 - DNA, 14 bp, Homo sapiens
cagcctgaagcctg

SEQ ID NO: 643046 - DNA, 20 bp, Homo sapiens
cagcctgagccacagtgggg

SEQ ID NO: 643047 - DNA, 16 bp, Homo sapiens
cagcctgagctccacc

SEQ ID NO: 643048 - DNA, 17 bp, Homo sapiens
cagcctgagctccaccc

SEQ ID NO: 643049 - DNA, 20 bp, Homo sapiens
cagcctgagctccaccctcc

SEQ ID NO: 643050 - DNA, 13 bp, Homo sapiens
cagcctgccaggc

SEQ ID NO: 643051 - DNA, 18 bp, Homo sapiens
cagcctgtgggtccttgc

SEQ ID NO: 643052 - DNA, 19 bp, Homo sapiens
cagcctttgcgctctgggt

SEQ ID NO: 643053 - DNA, 23 bp, Homo sapiens
cagcgcaacagctgtgtgtgccc

SEQ ID NO: 643054 - DNA, 19 bp, Homo sapiens
cagcgcccgaggccagggc

SEQ ID NO: 643055 - DNA, 17 bp, Homo sapiens
cagcgcctcccgccgcc

SEQ ID NO: 643056 - DNA, 22 bp, Homo sapiens
cagcgcctcccgccgcctcggg

SEQ ID NO: 643057 - DNA, 12 bp, Homo sapiens
cagcggcccggc

SEQ ID NO: 643058 - DNA, 13 bp, Homo sapiens
cagcggcccggcc

SEQ ID NO: 643059 - DNA, 15 bp, Homo sapiens
cagcggcccggccca

SEQ ID NO: 643060 - DNA, 20 bp, Homo sapiens
cagcggcccggcccacgcag

SEQ ID NO: 643061 - DNA, 13 bp, Homo sapiens
cagcgtctcccca

SEQ ID NO: 643062 - DNA, 16 bp, Homo sapiens
cagcgtctccccatgc

SEQ ID NO: 643063 - DNA, 17 bp, Homo sapiens
cagctaagcctgatgat

SEQ ID NO: 643064 - DNA, 19 bp, Homo sapiens
cagctaagcctgatgatgg

SEQ ID NO: 643065 - DNA, 19 bp, Homo sapiens
cagctaatttgtgaaagtg

SEQ ID NO: 643066 - DNA, 15 bp, Homo sapiens
cagctagaaagagaa

SEQ ID NO: 643067 - DNA, 12 bp, Homo sapiens
cagctaggcagg

SEQ ID NO: 643068 - DNA, 17 bp, Homo sapiens
cagctcagcattgtgta

SEQ ID NO: 643069 - DNA, 13 bp, Homo sapiens
cagctccactctg

SEQ ID NO: 643070 - DNA, 12 bp, Homo sapiens
cagctctaaagc

SEQ ID NO: 643071 - DNA, 20 bp, Homo sapiens
cagctctgagcagacagggc

SEQ ID NO: 643072 - DNA, 18 bp, Homo sapiens
cagctcttcccctttcct

SEQ ID NO: 643073 - DNA, 15 bp, Homo sapiens
cagctgagctggcct

SEQ ID NO: 643074 - DNA, 21 bp, Homo sapiens
cagctgcagttagcacagagg

SEQ ID NO: 643075 - DNA, 16 bp, Homo sapiens
cagctggcagcgcctc

SEQ ID NO: 643076 - DNA, 21 bp, Homo sapiens
cagctggcgcgtgtgtggcct

SEQ ID NO: 643077 - DNA, 23 bp, Homo sapiens
cagctggctgggtcgcccctcct

SEQ ID NO: 643078 - DNA, 13 bp, Homo sapiens
cagctgggcaggg

SEQ ID NO: 643079 - DNA, 17 bp, Homo sapiens
cagcttcccaacaatac

SEQ ID NO: 643080 - DNA, 21 bp, Homo sapiens
cagcttccccatcgccttctg

SEQ ID NO: 643081 - DNA, 15 bp, Homo sapiens
cagcttccctgaaca

SEQ ID NO: 643082 - DNA, 14 bp, Homo sapiens
cagcttgagcctgt

SEQ ID NO: 643083 - DNA, 15 bp, Homo sapiens
cagcttgagcctgtc

SEQ ID NO: 643084 - DNA, 14 bp, Homo sapiens
cagcttgcttctct

SEQ ID NO: 643085 - DNA, 17 bp, Homo sapiens
caggaaaacctctgagt

SEQ ID NO: 643086 - DNA, 14 bp, Homo sapiens
caggaaagatccca

SEQ ID NO: 643087 - DNA, 17 bp, Homo sapiens
caggaaagatcccaagt

SEQ ID NO: 643088 - DNA, 14 bp, Homo sapiens
caggaaatttttgc

SEQ ID NO: 643089 - DNA, 22 bp, Homo sapiens
caggaaatttttgcatgtttaa

SEQ ID NO: 643090 - DNA, 19 bp, Homo sapiens
caggaagtcatcctgcaat

SEQ ID NO: 643091 - DNA, 18 bp, Homo sapiens
caggaatcaaaaattgaa

SEQ ID NO: 643092 - DNA, 19 bp, Homo sapiens
caggaatggggggcgggcc

SEQ ID NO: 643093 - DNA, 14 bp, Homo sapiens
caggacccccccag

SEQ ID NO: 643094 - DNA, 14 bp, Homo sapiens
caggagaaggcctg

SEQ ID NO: 643095 - DNA, 19 bp, Homo sapiens
caggagagccctctgctgc

SEQ ID NO: 643096 - DNA, 22 bp, Homo sapiens
caggagagccctctgctgcttt

SEQ ID NO: 643097 - DNA, 16 bp, Homo sapiens
caggagcatgtcctat

SEQ ID NO: 643098 - DNA, 17 bp, Homo sapiens
caggagcatgtcctatc

SEQ ID NO: 643099 - DNA, 16 bp, Homo sapiens
caggagccgcagaggc

SEQ ID NO: 643100 - DNA, 17 bp, Homo sapiens
caggagccgcagaggcc

SEQ ID NO: 643101 - DNA, 14 bp, Homo sapiens
caggagcgtgtact

SEQ ID NO: 643102 - DNA, 19 bp, Homo sapiens
caggagctagcccagtccc

SEQ ID NO: 643103 - DNA, 17 bp, Homo sapiens
ggttggcagcgcctcgc

SEQ ID NO: 643104 - DNA, 19 bp, Homo sapiens
ggttgtacatagtggtcat

SEQ ID NO: 643105 - DNA, 20 bp, Homo sapiens
ggtttccatcaaagccctcc

SEQ ID NO: 643106 - DNA, 14 bp, Homo sapiens
ggtttgggcagtgg

SEQ ID NO: 643107 - DNA, 20 bp, Homo sapiens
ggtttgggcagtggagaggg

SEQ ID NO: 643108 - DNA, 19 bp, Homo sapiens
ggtttgggggacgcccagc

SEQ ID NO: 643109 - DNA, 17 bp, Homo sapiens
ggttttgttaggggtgg

SEQ ID NO: 643110 - DNA, 15 bp, Homo sapiens
gtaaaactgtgacat

SEQ ID NO: 643111 - DNA, 16 bp, Homo sapiens
gtaaaactgtgacatt

SEQ ID NO: 643112 - DNA, 19 bp, Homo sapiens
gtaaaactgtgacattcca

SEQ ID NO: 643113 - DNA, 18 bp, Homo sapiens
gtaaacatcataaatagt

SEQ ID NO: 643114 - DNA, 22 bp, Homo sapiens
gtaaacatcataaatagtaaat

SEQ ID NO: 643115 - DNA, 23 bp, Homo sapiens
gtaaacatcataaatagtaaata

SEQ ID NO: 643116 - DNA, 16 bp, Homo sapiens
gtaaagatattgtatc

SEQ ID NO: 643117 - DNA, 17 bp, Homo sapiens
gtaaaggtgatgaattt

SEQ ID NO: 643118 - DNA, 19 bp, Homo sapiens
gtaaataatgattcaatgt

SEQ ID NO: 643119 - DNA, 20 bp, Homo sapiens
gtaaataatgattcaatgtg

SEQ ID NO: 643120 - DNA, 19 bp, Homo sapiens
gtaaatatacactttacat

SEQ ID NO: 643121 - DNA, 22 bp, Homo sapiens
gtaaatattgctgtctgaaaaa

SEQ ID NO: 643122 - DNA, 21 bp, Homo sapiens
gtaaattcctaattctatgat

SEQ ID NO: 643123 - DNA, 14 bp, Homo sapiens
gtaacagacattgt

SEQ ID NO: 643124 - DNA, 16 bp, Homo sapiens
gtaacagacattgttt

SEQ ID NO: 643125 - DNA, 17 bp, Homo sapiens
gtaacctgaagttttat

SEQ ID NO: 643126 - DNA, 23 bp, Homo sapiens
gtaactgccattttttgtctgtg

SEQ ID NO: 643127 - DNA, 21 bp, Homo sapiens
gtaacttcagatgtttccaag

SEQ ID NO: 643128 - DNA, 16 bp, Homo sapiens
gtaagaaaatttaaaa

SEQ ID NO: 643129 - DNA, 17 bp, Homo sapiens
gtaagacagtgcagtgc

SEQ ID NO: 643130 - DNA, 12 bp, Homo sapiens
gtaagttctgtg

SEQ ID NO: 643131 - DNA, 17 bp, Homo sapiens
gtaagttgaagggaaat

SEQ ID NO: 643132 - DNA, 22 bp, Homo sapiens
gtaagttgaagggaaatcaatt

SEQ ID NO: 643133 - DNA, 16 bp, Homo sapiens
gtaatagcctcacctt

SEQ ID NO: 643134 - DNA, 13 bp, Homo sapiens
gtaatataagaca

SEQ ID NO: 643135 - DNA, 21 bp, Homo sapiens
gtaatataagacaagtctgag

SEQ ID NO: 643136 - DNA, 12 bp, Homo sapiens
gtaatattaaat

SEQ ID NO: 643137 - DNA, 20 bp, Homo sapiens
gtaatcacactctcttctta

SEQ ID NO: 643138 - DNA, 21 bp, Homo sapiens
gtaatggatatgaaagagaaa

SEQ ID NO: 643139 - DNA, 21 bp, Homo sapiens
gtaattcttctcctttgtcaa

SEQ ID NO: 643140 - DNA, 13 bp, Homo sapiens
gtacaattctttg

SEQ ID NO: 643141 - DNA, 14 bp, Homo sapiens
gtacaattctttgt

SEQ ID NO: 643142 - DNA, 22 bp, Homo sapiens
gtacaattctttgttgcttaat

SEQ ID NO: 643143 - DNA, 20 bp, Homo sapiens
gtacacacacagacacacaa

SEQ ID NO: 643144 - DNA, 17 bp, Homo sapiens
gtacagaaccagcactc

SEQ ID NO: 643145 - DNA, 20 bp, Homo sapiens
gtacagaaccagcactccca

SEQ ID NO: 643146 - DNA, 17 bp, Homo sapiens
gtacagtgttctgttta

SEQ ID NO: 643147 - DNA, 22 bp, Homo sapiens
gtacataaagtaataactgtta

SEQ ID NO: 643148 - DNA, 23 bp, Homo sapiens
gtacatttgatttgatatacaga

SEQ ID NO: 643149 - DNA, 22 bp, Homo sapiens
gtaccagagcctatggaaaggg

SEQ ID NO: 643150 - DNA, 13 bp, Homo sapiens
gtaccatcccact

SEQ ID NO: 643151 - DNA, 18 bp, Homo sapiens
gtactaccccaggacgca

SEQ ID NO: 643152 - DNA, 13 bp, Homo sapiens
gtactagcaataa

SEQ ID NO: 643153 - DNA, 19 bp, Homo sapiens
gtactctgagtcctcattg

SEQ ID NO: 643154 - DNA, 18 bp, Homo sapiens
gtactggttagattcatt

SEQ ID NO: 643155 - DNA, 12 bp, Homo sapiens
gtactgtattgg

SEQ ID NO: 643156 - DNA, 19 bp, Homo sapiens
gtacttacactgaaatcca

SEQ ID NO: 643157 - DNA, 22 bp, Homo sapiens
gtacttaccagtcaatgcattg

SEQ ID NO: 643158 - DNA, 15 bp, Homo sapiens
gtagaaactttggaa

SEQ ID NO: 643159 - DNA, 20 bp, Homo sapiens
gtagaaactttggaagtttt

SEQ ID NO: 643160 - DNA, 20 bp, Homo sapiens
gtagaaattttatctcttct

SEQ ID NO: 643161 - DNA, 22 bp, Homo sapiens
gtagaaattttatctcttcttc

SEQ ID NO: 643162 - DNA, 17 bp, Homo sapiens
gtagaactttaaaagaa

SEQ ID NO: 643163 - DNA, 13 bp, Homo sapiens
gtagaagatgacc

SEQ ID NO: 643164 - DNA, 14 bp, Homo sapiens
gtagagaggacagt

SEQ ID NO: 643165 - DNA, 21 bp, Homo sapiens
gtagatgaaaaagcatgtaca

SEQ ID NO: 643166 - DNA, 23 bp, Homo sapiens
gtagatgaaaaagcatgtacagt

SEQ ID NO: 643167 - DNA, 18 bp, Homo sapiens
gtagctagtttaaaatta

SEQ ID NO: 643168 - DNA, 16 bp, Homo sapiens
gtagctcgtgtgctta

SEQ ID NO: 643169 - DNA, 18 bp, Homo sapiens
gtagctctgtccactctg

SEQ ID NO: 643170 - DNA, 23 bp, Homo sapiens
gtagcttctgaaaggtgctttct

SEQ ID NO: 643171 - DNA, 21 bp, Homo sapiens
gtagctttaaaaccacagctg

SEQ ID NO: 643172 - DNA, 22 bp, Homo sapiens
gtagctttaaaaccacagctgg

SEQ ID NO: 643173 - DNA, 13 bp, Homo sapiens
gtaggctgctggc

SEQ ID NO: 643174 - DNA, 23 bp, Homo sapiens
gtagggaaaccttggagaggaga

SEQ ID NO: 643175 - DNA, 23 bp, Homo sapiens
gtagggaacggcctgagaggagc

SEQ ID NO: 643176 - DNA, 13 bp, Homo sapiens
gtagggcctgcat

SEQ ID NO: 643177 - DNA, 21 bp, Homo sapiens
gtagtttttgttcaccttctg

SEQ ID NO: 643178 - DNA, 15 bp, Homo sapiens
gtataaaaaaaatag

SEQ ID NO: 643179 - DNA, 11 bp, Homo sapiens
gtatacaaaca

SEQ ID NO: 643180 - DNA, 12 bp, Homo sapiens
gtatacaaacag

SEQ ID NO: 643181 - DNA, 15 bp, Homo sapiens
gtatagggaattttc

SEQ ID NO: 643182 - DNA, 22 bp, Homo sapiens
gtatatcagctctaaagcagag

SEQ ID NO: 643183 - DNA, 13 bp, Homo sapiens
gtatatctgtgta

SEQ ID NO: 643184 - DNA, 16 bp, Homo sapiens
gtatatctgtgtaaga

SEQ ID NO: 643185 - DNA, 23 bp, Homo sapiens
gtatatgaggatgtatgtgtata

SEQ ID NO: 643186 - DNA, 18 bp, Homo sapiens
gtcaatgtgaaataaaga

SEQ ID NO: 643187 - DNA, 19 bp, Homo sapiens
gtcaatgtgaaataaagag

SEQ ID NO: 643188 - DNA, 19 bp, Homo sapiens
gtcacaaagctatttaagt

SEQ ID NO: 643189 - DNA, 19 bp, Homo sapiens
gtcacttttttcctgtcaa

SEQ ID NO: 643190 - DNA, 18 bp, Homo sapiens
gtcagcttcccaacaata

SEQ ID NO: 643191 - DNA, 22 bp, Homo sapiens
gtcaggctacaggtgccccacc

SEQ ID NO: 643192 - DNA, 21 bp, Homo sapiens
gtcaggctctgaatctctcaa

SEQ ID NO: 643193 - DNA, 16 bp, Homo sapiens
gtcagtgtactctgag

SEQ ID NO: 643194 - DNA, 13 bp, Homo sapiens
gtcatagtttttt

SEQ ID NO: 643195 - DNA, 20 bp, Homo sapiens
gtcatagtttttttcttttt

SEQ ID NO: 643196 - DNA, 17 bp, Homo sapiens
gtcatattttcctttat

SEQ ID NO: 643197 - DNA, 15 bp, Homo sapiens
gtcatcaagtagtag

SEQ ID NO: 643198 - DNA, 20 bp, Homo sapiens
gtcatcaagtagtagtactt

SEQ ID NO: 643199 - DNA, 12 bp, Homo sapiens
gtcatctagttt

SEQ ID NO: 643200 - DNA, 11 bp, Homo sapiens
gtcatctgtca

SEQ ID NO: 643201 - DNA, 17 bp, Homo sapiens
gtcatgtgcgaacacag

SEQ ID NO: 643202 - DNA, 12 bp, Homo sapiens
gtcatgtggcta

SEQ ID NO: 643203 - DNA, 14 bp, Homo sapiens
gtcattctgctaat

SEQ ID NO: 643204 - DNA, 17 bp, Homo sapiens
gtcatttcatacaaatt

SEQ ID NO: 643205 - DNA, 22 bp, Homo sapiens
gtcatttcttctctctgtgctg

SEQ ID NO: 643206 - DNA, 19 bp, Homo sapiens
gtcatttggtggctctaac

SEQ ID NO: 643207 - DNA, 20 bp, Homo sapiens
gtcattttcagatccttcca

SEQ ID NO: 643208 - DNA, 18 bp, Homo sapiens
gtccacatcaaaaatgca

SEQ ID NO: 643209 - DNA, 21 bp, Homo sapiens
gtccacccccattgtgaatgt

SEQ ID NO: 643210 - DNA, 16 bp, Homo sapiens
gtccactttcctctct

SEQ ID NO: 643211 - DNA, 22 bp, Homo sapiens
gtccagccctccgccagccctg

SEQ ID NO: 643212 - DNA, 19 bp, Homo sapiens
gtccaggcccgtgggcgca

SEQ ID NO: 643213 - DNA, 14 bp, Homo sapiens
gtccaggtcacagg

SEQ ID NO: 643214 - DNA, 16 bp, Homo sapiens
gtccaggtcacaggca

SEQ ID NO: 643215 - DNA, 16 bp, Homo sapiens
gtccatccgtctctgt

SEQ ID NO: 643216 - DNA, 19 bp, Homo sapiens
gtccattgacatgtacaga

SEQ ID NO: 643217 - DNA, 19 bp, Homo sapiens
gtccatttttgagtaaaac

SEQ ID NO: 643218 - DNA, 23 bp, Homo sapiens
gtcccagctacaggggaggctga

SEQ ID NO: 643219 - DNA, 11 bp, Homo sapiens
gtccccagggt

SEQ ID NO: 643220 - DNA, 15 bp, Homo sapiens
gtccccctcctgcac

SEQ ID NO: 643221 - DNA, 10 bp, Homo sapiens
gtccccggac

SEQ ID NO: 643222 - DNA, 17 bp, Homo sapiens
gtccccggacgctggct

SEQ ID NO: 643223 - DNA, 18 bp, Homo sapiens
gtccccggacgctggctc

SEQ ID NO: 643224 - DNA, 15 bp, Homo sapiens
gtcccggagctcagg

SEQ ID NO: 643225 - DNA, 14 bp, Homo sapiens
gtccctgacttccc

SEQ ID NO: 643226 - DNA, 15 bp, Homo sapiens
gtccctgacttccca

SEQ ID NO: 643227 - DNA, 16 bp, Homo sapiens
gtccctgacttcccag

SEQ ID NO: 643228 - DNA, 14 bp, Homo sapiens
gtccctgctcagcc

SEQ ID NO: 643229 - DNA, 19 bp, Homo sapiens
gtccctgctcagcccatcc

SEQ ID NO: 643230 - DNA, 23 bp, Homo sapiens
gtccctgctcagcccatcccctg

SEQ ID NO: 643231 - DNA, 24 bp, Homo sapiens
gtccctgctcagcccatcccctgc

SEQ ID NO: 643232 - DNA, 13 bp, Homo sapiens
gtccctggagctg

SEQ ID NO: 643233 - DNA, 15 bp, Homo sapiens
gtcccttcctgtcct

SEQ ID NO: 643234 - DNA, 21 bp, Homo sapiens
gtcccttcctgtcctgctcac

SEQ ID NO: 643235 - DNA, 16 bp, Homo sapiens
gtccctttccctgcat

SEQ ID NO: 643236 - DNA, 20 bp, Homo sapiens
gtccgccccgtgctcctctg

SEQ ID NO: 643237 - DNA, 21 bp, Homo sapiens
gtccgccccgtgctcctctgc

SEQ ID NO: 643238 - DNA, 22 bp, Homo sapiens
gtccgccccgtgctcctctgcc

SEQ ID NO: 643239 - DNA, 13 bp, Homo sapiens
gtccgcccgccca

SEQ ID NO: 643240 - DNA, 13 bp, Homo sapiens
gtccggcctgcag

SEQ ID NO: 643241 - DNA, 15 bp, Homo sapiens
gtccggcctgcagcc

SEQ ID NO: 643242 - DNA, 15 bp, Homo sapiens
gtccgtccgcccgcc

SEQ ID NO: 643243 - DNA, 21 bp, Homo sapiens
gtccgtccgcccgcccacccc

SEQ ID NO: 643244 - DNA, 23 bp, Homo sapiens
gtccgtccgcccgcccaccccgc

SEQ ID NO: 643245 - DNA, 12 bp, Homo sapiens
gtccgtcctgct

SEQ ID NO: 643246 - DNA, 13 bp, Homo sapiens
gtccgtctgtcct

SEQ ID NO: 643247 - DNA, 22 bp, Homo sapiens
gtcctatccccggaccggacgc

SEQ ID NO: 643248 - DNA, 22 bp, Homo sapiens
gtcctatccctggacgcatgca

SEQ ID NO: 643249 - DNA, 13 bp, Homo sapiens
gtcctcacagcct

SEQ ID NO: 643250 - DNA, 16 bp, Homo sapiens
gtcctcacagcctctc

SEQ ID NO: 643251 - DNA, 23 bp, Homo sapiens
gtcctcattgttcagaaaagcac

SEQ ID NO: 643252 - DNA, 14 bp, Homo sapiens
gtcctcgccccccg

SEQ ID NO: 643253 - DNA, 24 bp, Homo sapiens
gtcctgcgcctgcgcctcctcctg

SEQ ID NO: 643254 - DNA, 21 bp, Homo sapiens
gtcctgctcacgtctgtgagt

SEQ ID NO: 643255 - DNA, 16 bp, Homo sapiens
gtcctgctcgccctgt

SEQ ID NO: 643256 - DNA, 17 bp, Homo sapiens
gtcctgctcgccctgtg

SEQ ID NO: 643257 - DNA, 18 bp, Homo sapiens
gtcctgggggctgctgca

SEQ ID NO: 643258 - DNA, 13 bp, Homo sapiens
gtcctggggtggt

SEQ ID NO: 643259 - DNA, 23 bp, Homo sapiens
gtcctggggtggttggaggcctg

SEQ ID NO: 643260 - DNA, 18 bp, Homo sapiens
gtccttagaatactgtat

SEQ ID NO: 643261 - DNA, 21 bp, Homo sapiens
gtccttcattccgttaggaat

SEQ ID NO: 643262 - DNA, 18 bp, Homo sapiens
gtccttccaacctgttca

SEQ ID NO: 643263 - DNA, 20 bp, Homo sapiens
gtcctttctgatcctctctt

SEQ ID NO: 643264 - DNA, 16 bp, Homo sapiens
gtcgcccctcctcggg

SEQ ID NO: 643265 - DNA, 15 bp, Homo sapiens
gtcgctgtccgtcct

SEQ ID NO: 643266 - DNA, 12 bp, Homo sapiens
gtcggctgggca

SEQ ID NO: 643267 - DNA, 13 bp, Homo sapiens
gtcggctgggcag

SEQ ID NO: 643268 - DNA, 15 bp, Homo sapiens
gtcggctgggcaggg

SEQ ID NO: 643269 - DNA, 16 bp, Homo sapiens
gtcggctgggcagggc

SEQ ID NO: 643270 - DNA, 18 bp, Homo sapiens
gtcggctgggcagggccg

SEQ ID NO: 643271 - DNA, 14 bp, Homo sapiens
gtcgggggaggagc

SEQ ID NO: 643272 - DNA, 17 bp, Homo sapiens
gtcgggggaggagcacc

SEQ ID NO: 643273 - DNA, 21 bp, Homo sapiens
gtcgggggaggagcaccccca

SEQ ID NO: 643274 - DNA, 19 bp, Homo sapiens
gtcggtgtttggaggctgc

SEQ ID NO: 643275 - DNA, 12 bp, Homo sapiens
gtctaataaaca

SEQ ID NO: 643276 - DNA, 15 bp, Homo sapiens
tacacatacatatat

SEQ ID NO: 643277 - DNA, 18 bp, Homo sapiens
tacacatacatatataca

SEQ ID NO: 643278 - DNA, 13 bp, Homo sapiens
tacacatataaac

SEQ ID NO: 643279 - DNA, 14 bp, Homo sapiens
tacacatataaaca

SEQ ID NO: 643280 - DNA, 17 bp, Homo sapiens
tacacatataaacacag

SEQ ID NO: 643281 - DNA, 15 bp, Homo sapiens
tacaccttagcagct

SEQ ID NO: 643282 - DNA, 15 bp, Homo sapiens
tacacgtgtatatga

SEQ ID NO: 643283 - DNA, 20 bp, Homo sapiens
tacacttctcaaatgctact

SEQ ID NO: 643284 - DNA, 18 bp, Homo sapiens
tacagaaccagcactccc

SEQ ID NO: 643285 - DNA, 20 bp, Homo sapiens
tacagaaccagcactcccag

SEQ ID NO: 643286 - DNA, 16 bp, Homo sapiens
tacagaagtggaagga

SEQ ID NO: 643287 - DNA, 21 bp, Homo sapiens
tacagatggtgtcctgcatgt

SEQ ID NO: 643288 - DNA, 19 bp, Homo sapiens
tacagcatttctttggaaa

SEQ ID NO: 643289 - DNA, 20 bp, Homo sapiens
tacagctgaaagacagtaaa

SEQ ID NO: 643290 - DNA, 15 bp, Homo sapiens
tacaggctgagacac

SEQ ID NO: 643291 - DNA, 13 bp, Homo sapiens
tacaggtgcccca

SEQ ID NO: 643292 - DNA, 17 bp, Homo sapiens
tacaggtgccccacctc

SEQ ID NO: 643293 - DNA, 12 bp, Homo sapiens
tacaggttttat

SEQ ID NO: 643294 - DNA, 15 bp, Homo sapiens
tacagtcctagagaa

SEQ ID NO: 643295 - DNA, 20 bp, Homo sapiens
tacagtctctatttgatttg

SEQ ID NO: 643296 - DNA, 16 bp, Homo sapiens
tacagtggcagtattg

SEQ ID NO: 643297 - DNA, 21 bp, Homo sapiens
tacataaaacacccttgaaaa

SEQ ID NO: 643298 - DNA, 23 bp, Homo sapiens
tacataaaacacccttgaaaata

SEQ ID NO: 643299 - DNA, 18 bp, Homo sapiens
tacatacgcaattgtata

SEQ ID NO: 643300 - DNA, 15 bp, Homo sapiens
tacatagtggtcatt

SEQ ID NO: 643301 - DNA, 20 bp, Homo sapiens
tacatatatacattttgcag

SEQ ID NO: 643302 - DNA, 15 bp, Homo sapiens
tacatatgataaatt

SEQ ID NO: 643303 - DNA, 16 bp, Homo sapiens
tacatctgaaatctac

SEQ ID NO: 643304 - DNA, 17 bp, Homo sapiens
tacattcttgctctgct

SEQ ID NO: 643305 - DNA, 20 bp, Homo sapiens
tacatttatgtgtgaagcaa

SEQ ID NO: 643306 - DNA, 22 bp, Homo sapiens
tacatttgatttgatatacaga

SEQ ID NO: 643307 - DNA, 13 bp, Homo sapiens
taccaagtgtgtt

SEQ ID NO: 643308 - DNA, 14 bp, Homo sapiens
taccacaggatgca

SEQ ID NO: 643309 - DNA, 16 bp, Homo sapiens
taccagtcaatgcatt

SEQ ID NO: 643310 - DNA, 15 bp, Homo sapiens
taccatcaaacaaat

SEQ ID NO: 643311 - DNA, 14 bp, Homo sapiens
taccatcccactga

SEQ ID NO: 643312 - DNA, 15 bp, Homo sapiens
taccccgtccctttc

SEQ ID NO: 643313 - DNA, 22 bp, Homo sapiens
taccctaggtctccacccctca

SEQ ID NO: 643314 - DNA, 23 bp, Homo sapiens
taccctaggtctccacccctcaa

SEQ ID NO: 643315 - DNA, 11 bp, Homo sapiens
taccctccctg

SEQ ID NO: 643316 - DNA, 19 bp, Homo sapiens
taccctccctgtcccctga

SEQ ID NO: 643317 - DNA, 12 bp, Homo sapiens
taccctttccca

SEQ ID NO: 643318 - DNA, 17 bp, Homo sapiens
taccgcccacccagcag

SEQ ID NO: 643319 - DNA, 16 bp, Homo sapiens
tacctaacaatgtttt

SEQ ID NO: 643320 - DNA, 22 bp, Homo sapiens
tacctattcaagaagatagttg

SEQ ID NO: 643321 - DNA, 22 bp, Homo sapiens
tacctggcttagcgttctgttt

SEQ ID NO: 643322 - DNA, 14 bp, Homo sapiens
tacctgtaggtcta

SEQ ID NO: 643323 - DNA, 18 bp, Homo sapiens
taccttctgatgaagttg

SEQ ID NO: 643324 - DNA, 18 bp, Homo sapiens
tacctttttttctctcct

SEQ ID NO: 643325 - DNA, 15 bp, Homo sapiens
tacgcaattgtatat

SEQ ID NO: 643326 - DNA, 14 bp, Homo sapiens
tactaacactggct

SEQ ID NO: 643327 - DNA, 16 bp, Homo sapiens
tactaaccaccatttc

SEQ ID NO: 643328 - DNA, 21 bp, Homo sapiens
tactagcaataagttgaatga

SEQ ID NO: 643329 - DNA, 17 bp, Homo sapiens
tactatgtaaatgcttg

SEQ ID NO: 643330 - DNA, 15 bp, Homo sapiens
tactcaaagaggcca

SEQ ID NO: 643331 - DNA, 14 bp, Homo sapiens
tactcctccccctc

SEQ ID NO: 643332 - DNA, 22 bp, Homo sapiens
tactcctgcctccccattcctt

SEQ ID NO: 643333 - DNA, 18 bp, Homo sapiens
tactccttaaaaatgtat

SEQ ID NO: 643334 - DNA, 14 bp, Homo sapiens
tactcgttattcat

SEQ ID NO: 643335 - DNA, 17 bp, Homo sapiens
tactctaaggtaaaacc

SEQ ID NO: 643336 - DNA, 19 bp, Homo sapiens
tactctgcctgtcaagttt

SEQ ID NO: 643337 - DNA, 15 bp, Homo sapiens
tactctgtgctaagt

SEQ ID NO: 643338 - DNA, 22 bp, Homo sapiens
tactgaattgttatgtaaacat

SEQ ID NO: 643339 - DNA, 20 bp, Homo sapiens
tactgatgagacaacacaca

SEQ ID NO: 643340 - DNA, 15 bp, Homo sapiens
tactgcatgatctta

SEQ ID NO: 643341 - DNA, 17 bp, Homo sapiens
tactgttctgaaattag

SEQ ID NO: 643342 - DNA, 19 bp, Homo sapiens
tactgtttaatatttatag

SEQ ID NO: 643343 - DNA, 13 bp, Homo sapiens
tactgtttgaaaa

SEQ ID NO: 643344 - DNA, 20 bp, Homo sapiens
tactgtttgaaaagaaataa

SEQ ID NO: 643345 - DNA, 14 bp, Homo sapiens
tactgttttgtgcg

SEQ ID NO: 643346 - DNA, 23 bp, Homo sapiens
tactgttttgtgcggtgtgtctc

SEQ ID NO: 643347 - DNA, 19 bp, Homo sapiens
tacttaaacaaaaactttc

SEQ ID NO: 643348 - DNA, 14 bp, Homo sapiens
tacttaatagtacc

SEQ ID NO: 643349 - DNA, 18 bp, Homo sapiens
tacttacactgaaatcca

SEQ ID NO: 643350 - DNA, 14 bp, Homo sapiens
tacttatattctgc

SEQ ID NO: 643351 - DNA, 12 bp, Homo sapiens
tacttcaaatgt

SEQ ID NO: 643352 - DNA, 19 bp, Homo sapiens
tacttcagttctcatcttg

SEQ ID NO: 643353 - DNA, 16 bp, Homo sapiens
tacttgtgttcattga

SEQ ID NO: 643354 - DNA, 15 bp, Homo sapiens
tactttaaattgtgg

SEQ ID NO: 643355 - DNA, 15 bp, Homo sapiens
tactttgtgtctttt

SEQ ID NO: 643356 - DNA, 18 bp, Homo sapiens
tagaaaaccccacagaaa

SEQ ID NO: 643357 - DNA, 21 bp, Homo sapiens
tagaaaaccccacagaaatct

SEQ ID NO: 643358 - DNA, 17 bp, Homo sapiens
tagaaacaagacaaggt

SEQ ID NO: 643359 - DNA, 13 bp, Homo sapiens
tagaaaggcagcc

SEQ ID NO: 643360 - DNA, 15 bp, Homo sapiens
tagaaatttactatg

SEQ ID NO: 643361 - DNA, 23 bp, Homo sapiens
tagaaattttatctcttcttcct

SEQ ID NO: 643362 - DNA, 22 bp, Homo sapiens
tagaagaaggactgaagaaaat

SEQ ID NO: 643363 - DNA, 13 bp, Homo sapiens
tagaagagcctga

SEQ ID NO: 643364 - DNA, 18 bp, Homo sapiens
tagaagagcctgactgtg

SEQ ID NO: 643365 - DNA, 20 bp, Homo sapiens
tagaatactgtattgttaca

SEQ ID NO: 643366 - DNA, 16 bp, Homo sapiens
tagaatgagaaatcat

SEQ ID NO: 643367 - DNA, 18 bp, Homo sapiens
tagaattaggtaatggat

SEQ ID NO: 643368 - DNA, 18 bp, Homo sapiens
tagacagaaaccaagcca

SEQ ID NO: 643369 - DNA, 17 bp, Homo sapiens
tagacagaggtttcatt

SEQ ID NO: 643370 - DNA, 18 bp, Homo sapiens
tagacagaggtttcattt

SEQ ID NO: 643371 - DNA, 23 bp, Homo sapiens
tagacatggaatttatgaatggt

SEQ ID NO: 643372 - DNA, 18 bp, Homo sapiens
tagactctaaaactatca

SEQ ID NO: 643373 - DNA, 13 bp, Homo sapiens
tagagaagccata

SEQ ID NO: 643374 - DNA, 13 bp, Homo sapiens
tagatttttagat

SEQ ID NO: 643375 - DNA, 12 bp, Homo sapiens
tagcacagtatt

SEQ ID NO: 643376 - DNA, 14 bp, Homo sapiens
tagcacagtattta

SEQ ID NO: 643377 - DNA, 17 bp, Homo sapiens
tagcacagtatttaaca

SEQ ID NO: 643378 - DNA, 18 bp, Homo sapiens
tagcacagtatttaacat

SEQ ID NO: 643379 - DNA, 14 bp, Homo sapiens
tagcacatgtttta

SEQ ID NO: 643380 - DNA, 21 bp, Homo sapiens
tagcaccagcttgcttctctg

SEQ ID NO: 643381 - DNA, 12 bp, Homo sapiens
tagcagagccta

SEQ ID NO: 643382 - DNA, 22 bp, Homo sapiens
tagcagctcttcccctttcctg

SEQ ID NO: 643383 - DNA, 22 bp, Homo sapiens
tagcatactgatgagacaacac

SEQ ID NO: 643384 - DNA, 14 bp, Homo sapiens
tagcatagccagca

SEQ ID NO: 643385 - DNA, 18 bp, Homo sapiens
tagcatgagttctgcaca

SEQ ID NO: 643386 - DNA, 22 bp, Homo sapiens
tagcatgtaatattaaattcct

SEQ ID NO: 643387 - DNA, 13 bp, Homo sapiens
tagcatgtattgt

SEQ ID NO: 643388 - DNA, 19 bp, Homo sapiens
tagcatgtattgtgtcttt

SEQ ID NO: 643389 - DNA, 19 bp, Homo sapiens
tagcattttaatagtttct

SEQ ID NO: 643390 - DNA, 18 bp, Homo sapiens
tagccaacttaaacctgt

SEQ ID NO: 643391 - DNA, 22 bp, Homo sapiens
tagccaacttaaacctgtgctt

SEQ ID NO: 643392 - DNA, 13 bp, Homo sapiens
tagccattcattt

SEQ ID NO: 643393 - DNA, 20 bp, Homo sapiens
tagcccagtccctggagctg

SEQ ID NO: 643394 - DNA, 22 bp, Homo sapiens
tagccccaggcccgccctgccc

SEQ ID NO: 643395 - DNA, 15 bp, Homo sapiens
tagccctctttctct

SEQ ID NO: 643396 - DNA, 21 bp, Homo sapiens
tagccctctttctctctgtgt

SEQ ID NO: 643397 - DNA, 17 bp, Homo sapiens
tagcgctcccttttcac

SEQ ID NO: 643398 - DNA, 17 bp, Homo sapiens
tagctagtttaaaatta

SEQ ID NO: 643399 - DNA, 19 bp, Homo sapiens
tagctagtttaaaattatt

SEQ ID NO: 643400 - DNA, 18 bp, Homo sapiens
tagctcagaggagaggag

SEQ ID NO: 643401 - DNA, 11 bp, Homo sapiens
tagctccttca

SEQ ID NO: 643402 - DNA, 18 bp, Homo sapiens
tagctctgaatgctattt

SEQ ID NO: 643403 - DNA, 17 bp, Homo sapiens
tagctctgtccactctg

SEQ ID NO: 643404 - DNA, 15 bp, Homo sapiens
tagctgatagaagaa

SEQ ID NO: 643405 - DNA, 22 bp, Homo sapiens
tagctgtttactgacatggtgc

SEQ ID NO: 643406 - DNA, 17 bp, Homo sapiens
taggaaaaactgatttt

SEQ ID NO: 643407 - DNA, 12 bp, Homo sapiens
taggaaaatttt

SEQ ID NO: 643408 - DNA, 17 bp, Homo sapiens
taggaaataaatctaaa

SEQ ID NO: 643409 - DNA, 14 bp, Homo sapiens
taggaaatgaatgt

SEQ ID NO: 643410 - DNA, 16 bp, Homo sapiens
taggaaatgaatgtgt

SEQ ID NO: 643411 - DNA, 19 bp, Homo sapiens
taggaaatgaatgtgtgtg

SEQ ID NO: 643412 - DNA, 17 bp, Homo sapiens
taggacatctctgtaaa

SEQ ID NO: 643413 - DNA, 23 bp, Homo sapiens
taggacatctctgtaaaaagcag

SEQ ID NO: 643414 - DNA, 17 bp, Homo sapiens
taggagcttccagatgg

SEQ ID NO: 643415 - DNA, 19 bp, Homo sapiens
taggagggtgcccctggga

SEQ ID NO: 643416 - DNA, 9 bp, Homo sapiens
taggcaaac

SEQ ID NO: 643417 - DNA, 18 bp, Homo sapiens
taggcagggagggggctg

SEQ ID NO: 643418 - DNA, 21 bp, Homo sapiens
taggcagggagggggctggga

SEQ ID NO: 643419 - DNA, 21 bp, Homo sapiens
taggcctgagttagctgttta

SEQ ID NO: 643420 - DNA, 15 bp, Homo sapiens
taggctgctggcgcc

SEQ ID NO: 643421 - DNA, 16 bp, Homo sapiens
taggctgctggcgcct

SEQ ID NO: 643422 - DNA, 19 bp, Homo sapiens
tagggaaaccttggagagg

SEQ ID NO: 643423 - DNA, 16 bp, Homo sapiens
tagggctctaatttcc

SEQ ID NO: 643424 - DNA, 11 bp, Homo sapiens
taggggtgggg

SEQ ID NO: 643425 - DNA, 17 bp, Homo sapiens
tagggtcctggccctct

SEQ ID NO: 643426 - DNA, 20 bp, Homo sapiens
tagggttctatatttactgt

SEQ ID NO: 643427 - DNA, 18 bp, Homo sapiens
tagggtttggaagaaagg

SEQ ID NO: 643428 - DNA, 19 bp, Homo sapiens
tagggtttgtttgctgctt

SEQ ID NO: 643429 - DNA, 13 bp, Homo sapiens
taggtctccaccc

SEQ ID NO: 643430 - DNA, 20 bp, Homo sapiens
taggtctccacccctcaagc

SEQ ID NO: 643431 - DNA, 23 bp, Homo sapiens
taggtctccacccctcaagccag

SEQ ID NO: 643432 - DNA, 19 bp, Homo sapiens
taggtctgcacacataaca

SEQ ID NO: 643433 - DNA, 23 bp, Homo sapiens
taggtgcccagtcttgagtgggc

SEQ ID NO: 643434 - DNA, 16 bp, Homo sapiens
taggttaataggagga

SEQ ID NO: 643435 - DNA, 21 bp, Homo sapiens
taggtttgggggacgcccagc

SEQ ID NO: 643436 - DNA, 20 bp, Homo sapiens
tagtaaataatgattcaatg

SEQ ID NO: 643437 - DNA, 14 bp, Homo sapiens
tagtagctgataaa

SEQ ID NO: 643438 - DNA, 18 bp, Homo sapiens
tagtagtacttaatagta

SEQ ID NO: 643439 - DNA, 17 bp, Homo sapiens
tagtcatgtttctgcag

SEQ ID NO: 643440 - DNA, 13 bp, Homo sapiens
tagtcctcacctt

SEQ ID NO: 643441 - DNA, 16 bp, Homo sapiens
tagtgaaaatcgagga

SEQ ID NO: 643442 - DNA, 17 bp, Homo sapiens
tagtgaaaatcgaggaa

SEQ ID NO: 643443 - DNA, 18 bp, Homo sapiens
tagtgaaaattttattga

SEQ ID NO: 643444 - DNA, 21 bp, Homo sapiens
tagtggtcatttggtggctct

SEQ ID NO: 643445 - DNA, 22 bp, Homo sapiens
tagtgtcacttttttcctgtca

SEQ ID NO: 643446 - DNA, 13 bp, Homo sapiens
tagtgtctaagga

SEQ ID NO: 643447 - DNA, 17 bp, Homo sapiens
tagtgttttcattctgg

SEQ ID NO: 643448 - DNA, 22 bp, Homo sapiens
tagtgttttcattctggtcctt

SEQ ID NO: 643449 - DNA, 16 bp, Homo sapiens
tagttccattctatga

SEQ ID NO: 643450 - DNA, 18 bp, Homo sapiens
tagttccattctatgact

SEQ ID NO: 643451 - DNA, 11 bp, Homo sapiens
tagttctgcaa

SEQ ID NO: 643452 - DNA, 23 bp, Homo sapiens
tagttctgcaataacagttttaa

SEQ ID NO: 643453 - DNA, 16 bp, Homo sapiens
tagttctgctgccctc

SEQ ID NO: 643454 - DNA, 19 bp, Homo sapiens
tagttctgctgccctctta

SEQ ID NO: 643455 - DNA, 16 bp, Homo sapiens
tagttgagccagcaga

SEQ ID NO: 643456 - DNA, 17 bp, Homo sapiens
tagttgagccagcagac

SEQ ID NO: 643457 - DNA, 20 bp, Homo sapiens
tagttgagccagcagacatt

SEQ ID NO: 643458 - DNA, 22 bp, Homo sapiens
tagttgagccagcagacattgt

SEQ ID NO: 643459 - DNA, 15 bp, Homo sapiens
tcagtgttataaaat

SEQ ID NO: 643460 - DNA, 18 bp, Homo sapiens
tcagtgttataaaatctg

SEQ ID NO: 643461 - DNA, 20 bp, Homo sapiens
tcagttacagtggcagtatt

SEQ ID NO: 643462 - DNA, 21 bp, Homo sapiens
tcagttacagtggcagtattg

SEQ ID NO: 643463 - DNA, 22 bp, Homo sapiens
tcagttaggattaggtttagaa

SEQ ID NO: 643464 - DNA, 22 bp, Homo sapiens
tcagttataatttcaattttta

SEQ ID NO: 643465 - DNA, 14 bp, Homo sapiens
tcagttctcatctt

SEQ ID NO: 643466 - DNA, 12 bp, Homo sapiens
tcagtttgtgaa

SEQ ID NO: 643467 - DNA, 18 bp, Homo sapiens
tcagtttgtgaagtgatt

SEQ ID NO: 643468 - DNA, 17 bp, Homo sapiens
tcataaattatttctaa

SEQ ID NO: 643469 - DNA, 15 bp, Homo sapiens
tcataagccaatttt

SEQ ID NO: 643470 - DNA, 23 bp, Homo sapiens
tcataccttctgatgaagttgta

SEQ ID NO: 643471 - DNA, 12 bp, Homo sapiens
tcatagaaatac

SEQ ID NO: 643472 - DNA, 20 bp, Homo sapiens
tcatagataccattttgaaa

SEQ ID NO: 643473 - DNA, 12 bp, Homo sapiens
tcatagcacatg

SEQ ID NO: 643474 - DNA, 15 bp, Homo sapiens
tcatagcacatgttt

SEQ ID NO: 643475 - DNA, 20 bp, Homo sapiens
tcatattttcctttatgtga

SEQ ID NO: 643476 - DNA, 21 bp, Homo sapiens
tcatattttcctttatgtgat

SEQ ID NO: 643477 - DNA, 22 bp, Homo sapiens
tcatattttcctttatgtgatg

SEQ ID NO: 643478 - DNA, 22 bp, Homo sapiens
tcatcagaagtggtaggaaagc

SEQ ID NO: 643479 - DNA, 13 bp, Homo sapiens
tcatctacacata

SEQ ID NO: 643480 - DNA, 17 bp, Homo sapiens
tcatctcaaacactgct

SEQ ID NO: 643481 - DNA, 22 bp, Homo sapiens
tcatctcaggtggcatttgcag

SEQ ID NO: 643482 - DNA, 18 bp, Homo sapiens
tcatctgtaaaaccaggc

SEQ ID NO: 643483 - DNA, 19 bp, Homo sapiens
tcatctgtaaaaccaggct

SEQ ID NO: 643484 - DNA, 15 bp, Homo sapiens
tcatggctgttatct

SEQ ID NO: 643485 - DNA, 19 bp, Homo sapiens
tcatggctgttatctgtct

SEQ ID NO: 643486 - DNA, 17 bp, Homo sapiens
tcatgttgatgtgtccg

SEQ ID NO: 643487 - DNA, 15 bp, Homo sapiens
tcatgtttaagaaat

SEQ ID NO: 643488 - DNA, 22 bp, Homo sapiens
tcatgtttaagaaatgagaaat

SEQ ID NO: 643489 - DNA, 13 bp, Homo sapiens
tcattaaaacaag

SEQ ID NO: 643490 - DNA, 15 bp, Homo sapiens
tcattaaaacaagag

SEQ ID NO: 643491 - DNA, 19 bp, Homo sapiens
tcattaaaacaagagacca

SEQ ID NO: 643492 - DNA, 22 bp, Homo sapiens
tcattaaccttatcataaattc

SEQ ID NO: 643493 - DNA, 17 bp, Homo sapiens
tcattagctgtgatttt

SEQ ID NO: 643494 - DNA, 15 bp, Homo sapiens
tcattcatactcaaa

SEQ ID NO: 643495 - DNA, 18 bp, Homo sapiens
tcattcatatgagttcct

SEQ ID NO: 643496 - DNA, 19 bp, Homo sapiens
tcattctgctaatttatga

SEQ ID NO: 643497 - DNA, 20 bp, Homo sapiens
tcattctgctaatttatgaa

SEQ ID NO: 643498 - DNA, 22 bp, Homo sapiens
tcattgggccatgtttaagtgt

SEQ ID NO: 643499 - DNA, 20 bp, Homo sapiens
tcattggttacaaattttta

SEQ ID NO: 643500 - DNA, 16 bp, Homo sapiens
tcattgtctcagtgaa

SEQ ID NO: 643501 - DNA, 14 bp, Homo sapiens
tcattgtgttttct

SEQ ID NO: 643502 - DNA, 20 bp, Homo sapiens
tcattgtttgtcctttatgt

SEQ ID NO: 643503 - DNA, 17 bp, Homo sapiens
tcatttacaacttccag

SEQ ID NO: 643504 - DNA, 16 bp, Homo sapiens
tcatttcatacaaatt

SEQ ID NO: 643505 - DNA, 14 bp, Homo sapiens
tcatttgaaatgtt

SEQ ID NO: 643506 - DNA, 17 bp, Homo sapiens
tcatttggatataaatc

SEQ ID NO: 643507 - DNA, 20 bp, Homo sapiens
tcatttggatataaatctta

SEQ ID NO: 643508 - DNA, 13 bp, Homo sapiens
tcattttcagatc

SEQ ID NO: 643509 - DNA, 12 bp, Homo sapiens
tcattttcatct

SEQ ID NO: 643510 - DNA, 18 bp, Homo sapiens
tcatttttcattttctct

SEQ ID NO: 643511 - DNA, 16 bp, Homo sapiens
tcattttttgtttctt

SEQ ID NO: 643512 - DNA, 16 bp, Homo sapiens
tccaaaagtactagca

SEQ ID NO: 643513 - DNA, 22 bp, Homo sapiens
tccaaaagtactagcaataagt

SEQ ID NO: 643514 - DNA, 23 bp, Homo sapiens
tccaaatgctgtcgggcaagata

SEQ ID NO: 643515 - DNA, 15 bp, Homo sapiens
tccaacatgtgatgt

SEQ ID NO: 643516 - DNA, 18 bp, Homo sapiens
tccaagaccttacaacca

SEQ ID NO: 643517 - DNA, 17 bp, Homo sapiens
tccaagtgtgtgtgcaa

SEQ ID NO: 643518 - DNA, 22 bp, Homo sapiens
tccaagttatttgatctggtgc

SEQ ID NO: 643519 - DNA, 16 bp, Homo sapiens
tccaatccagccttct

SEQ ID NO: 643520 - DNA, 18 bp, Homo sapiens
tccacaatcatctattga

SEQ ID NO: 643521 - DNA, 19 bp, Homo sapiens
tccacacctccacccgtcc

SEQ ID NO: 643522 - DNA, 21 bp, Homo sapiens
tccacacctccacccgtcctg

SEQ ID NO: 643523 - DNA, 23 bp, Homo sapiens
tccacccccattgtgaatgttgt

SEQ ID NO: 643524 - DNA, 21 bp, Homo sapiens
tccattgacatgtacagagaa

SEQ ID NO: 643525 - DNA, 14 bp, Homo sapiens
tcccaacctcccct

SEQ ID NO: 643526 - DNA, 20 bp, Homo sapiens
tcccaacctcccctggtcct

SEQ ID NO: 643527 - DNA, 20 bp, Homo sapiens
tcccaactctggccttggtt

SEQ ID NO: 643528 - DNA, 21 bp, Homo sapiens
tcccaagtcaaacagtgtggc

SEQ ID NO: 643529 - DNA, 22 bp, Homo sapiens
tcccaagtcaaacagtgtggct

SEQ ID NO: 643530 - DNA, 20 bp, Homo sapiens
tcccacccactagccctctt

SEQ ID NO: 643531 - DNA, 15 bp, Homo sapiens
tcccacctctttgga

SEQ ID NO: 643532 - DNA, 22 bp, Homo sapiens
tcccactaagctttctcctttg

SEQ ID NO: 643533 - DNA, 19 bp, Homo sapiens
tcccactgatatcacgggc

SEQ ID NO: 643534 - DNA, 15 bp, Homo sapiens
tcccactgcccctgc

SEQ ID NO: 643535 - DNA, 20 bp, Homo sapiens
tcccagcaaagttttcagat

SEQ ID NO: 643536 - DNA, 22 bp, Homo sapiens
tcccagcctcttgctcagagct

SEQ ID NO: 643537 - DNA, 22 bp, Homo sapiens
tcccagcgcatggcgccccggg

SEQ ID NO: 643538 - DNA, 13 bp, Homo sapiens
tcccagctggcag

SEQ ID NO: 643539 - DNA, 16 bp, Homo sapiens
tcccaggcactctctt

SEQ ID NO: 643540 - DNA, 23 bp, Homo sapiens
tcccagggcccgagcgcgtgcct

SEQ ID NO: 643541 - DNA, 12 bp, Homo sapiens
tcccagggtcct

SEQ ID NO: 643542 - DNA, 18 bp, Homo sapiens
tcccagtgaataaatatt

SEQ ID NO: 643543 - DNA, 23 bp, Homo sapiens
tccccacagtcctcacagcctct

SEQ ID NO: 643544 - DNA, 15 bp, Homo sapiens
tccccaccctcccct

SEQ ID NO: 643545 - DNA, 21 bp, Homo sapiens
tccccaccctcccctctcctg

SEQ ID NO: 643546 - DNA, 19 bp, Homo sapiens
tccccagagccctgcagtc

SEQ ID NO: 643547 - DNA, 11 bp, Homo sapiens
tccccagcccc

SEQ ID NO: 643548 - DNA, 17 bp, Homo sapiens
tccccagcccccaccca

SEQ ID NO: 643549 - DNA, 14 bp, Homo sapiens
tccccagtgtggcc

SEQ ID NO: 643550 - DNA, 23 bp, Homo sapiens
tccccagtgtggccccagcccga

SEQ ID NO: 643551 - DNA, 22 bp, Homo sapiens
tccccataatacccttttccaa

SEQ ID NO: 643552 - DNA, 18 bp, Homo sapiens
tccccattgccttctggg

SEQ ID NO: 643553 - DNA, 17 bp, Homo sapiens
tcccccacggccgtccc

SEQ ID NO: 643554 - DNA, 15 bp, Homo sapiens
tcccccagagccact

SEQ ID NO: 643555 - DNA, 13 bp, Homo sapiens
tcccccaggctgc

SEQ ID NO: 643556 - DNA, 18 bp, Homo sapiens
tcccccaggctgcgcctg

SEQ ID NO: 643557 - DNA, 19 bp, Homo sapiens
tcccccaggctgcgcctgc

SEQ ID NO: 643558 - DNA, 17 bp, Homo sapiens
tcccccagggtcccctg

SEQ ID NO: 643559 - DNA, 19 bp, Homo sapiens
tcccccagggtcccctgca

SEQ ID NO: 643560 - DNA, 21 bp, Homo sapiens
tcccccagggtcccctgcatg

SEQ ID NO: 643561 - DNA, 19 bp, Homo sapiens
tcccccgcagacagacaga

SEQ ID NO: 643562 - DNA, 10 bp, Homo sapiens
tccccctcct

SEQ ID NO: 643563 - DNA, 15 bp, Homo sapiens
tccccctcctccatg

SEQ ID NO: 643564 - DNA, 17 bp, Homo sapiens
tccccctcctccatgct

SEQ ID NO: 643565 - DNA, 12 bp, Homo sapiens
tccccctcctgc

SEQ ID NO: 643566 - DNA, 10 bp, Homo sapiens
tcccccttcc

SEQ ID NO: 643567 - DNA, 18 bp, Homo sapiens
tccccgcccgccctcctc

SEQ ID NO: 643568 - DNA, 17 bp, Homo sapiens
tccccggacgctggctc

SEQ ID NO: 643569 - DNA, 20 bp, Homo sapiens
tccccgtgcggcccgtgcgc

SEQ ID NO: 643570 - DNA, 13 bp, Homo sapiens
tcccctccctttt

SEQ ID NO: 643571 - DNA, 12 bp, Homo sapiens
tcccctctcctg

SEQ ID NO: 643572 - DNA, 13 bp, Homo sapiens
tcccctctcctga

SEQ ID NO: 643573 - DNA, 15 bp, Homo sapiens
tcccctctcctgagc

SEQ ID NO: 643574 - DNA, 17 bp, Homo sapiens
tcccctctcctgagcct

SEQ ID NO: 643575 - DNA, 20 bp, Homo sapiens
tcccctgaggttaaggggat

SEQ ID NO: 643576 - DNA, 16 bp, Homo sapiens
tcccctgcaagtggac

SEQ ID NO: 643577 - DNA, 14 bp, Homo sapiens
tcccctggtcctgc

SEQ ID NO: 643578 - DNA, 15 bp, Homo sapiens
tcccctggtcctgca

SEQ ID NO: 643579 - DNA, 16 bp, Homo sapiens
tcccctggtcctgcac

SEQ ID NO: 643580 - DNA, 17 bp, Homo sapiens
tcccctggtcctgcact

SEQ ID NO: 643581 - DNA, 20 bp, Homo sapiens
tcccctggtcctgcactgtc

SEQ ID NO: 643582 - DNA, 17 bp, Homo sapiens
tcccctgtggtttgtta

SEQ ID NO: 643583 - DNA, 19 bp, Homo sapiens
tccccttcgcgtatttcag

SEQ ID NO: 643584 - DNA, 14 bp, Homo sapiens
tcccgcagcaccag

SEQ ID NO: 643585 - DNA, 12 bp, Homo sapiens
tcctgctgctcg

SEQ ID NO: 643586 - DNA, 19 bp, Homo sapiens
tcctggaaatttgtgtgct

SEQ ID NO: 643587 - DNA, 12 bp, Homo sapiens
tcctggccctct

SEQ ID NO: 643588 - DNA, 17 bp, Homo sapiens
tcctgggggatgtgcac

SEQ ID NO: 643589 - DNA, 19 bp, Homo sapiens
tcctgggggatgtgcacgg

SEQ ID NO: 643590 - DNA, 17 bp, Homo sapiens
tcctgggggctgctgca

SEQ ID NO: 643591 - DNA, 20 bp, Homo sapiens
tcctgggggctgctgcactg

SEQ ID NO: 643592 - DNA, 19 bp, Homo sapiens
tcctggggtggttggaggc

SEQ ID NO: 643593 - DNA, 22 bp, Homo sapiens
tcctggggtggttggaggcctg

SEQ ID NO: 643594 - DNA, 21 bp, Homo sapiens
tcctgtagctttaaaaccaca

SEQ ID NO: 643595 - DNA, 13 bp, Homo sapiens
tcctgtcctggct

SEQ ID NO: 643596 - DNA, 17 bp, Homo sapiens
tcctgtcctggctccca

SEQ ID NO: 643597 - DNA, 16 bp, Homo sapiens
tcctgtctcctctgtc

SEQ ID NO: 643598 - DNA, 18 bp, Homo sapiens
tcctgtctcctctgtcag

SEQ ID NO: 643599 - DNA, 20 bp, Homo sapiens
tcctgttttcacaccttaca

SEQ ID NO: 643600 - DNA, 17 bp, Homo sapiens
tccttaaaaatgtatgt

SEQ ID NO: 643601 - DNA, 20 bp, Homo sapiens
tccttacagaagggagtgaa

SEQ ID NO: 643602 - DNA, 13 bp, Homo sapiens
tccttcagtgcct

SEQ ID NO: 643603 - DNA, 17 bp, Homo sapiens
tccttcagtgccttatg

SEQ ID NO: 643604 - DNA, 22 bp, Homo sapiens
tccttcagtgccttatggaaca

SEQ ID NO: 643605 - DNA, 14 bp, Homo sapiens
tccttccatcttgt

SEQ ID NO: 643606 - DNA, 17 bp, Homo sapiens
tccttccatcttgtggg

SEQ ID NO: 643607 - DNA, 18 bp, Homo sapiens
tccttcccgcagcaccag

SEQ ID NO: 643608 - DNA, 13 bp, Homo sapiens
tccttctcccctc

SEQ ID NO: 643609 - DNA, 21 bp, Homo sapiens
tccttctcccctccagacccc

SEQ ID NO: 643610 - DNA, 22 bp, Homo sapiens
tccttgcctgtcaggaccattt

SEQ ID NO: 643611 - DNA, 18 bp, Homo sapiens
tccttggtgtcgggcatg

SEQ ID NO: 643612 - DNA, 20 bp, Homo sapiens
tccttgtagacgcacctgct

SEQ ID NO: 643613 - DNA, 19 bp, Homo sapiens
tcctttagtttgcttctgt

SEQ ID NO: 643614 - DNA, 21 bp, Homo sapiens
tcctttcctctcctctctgga

SEQ ID NO: 643615 - DNA, 16 bp, Homo sapiens
tcctttcttccttcct

SEQ ID NO: 643616 - DNA, 15 bp, Homo sapiens
tccttttgtatcctc

SEQ ID NO: 643617 - DNA, 15 bp, Homo sapiens
tcgagagggctgagc

SEQ ID NO: 643618 - DNA, 16 bp, Homo sapiens
tcgagagggctgagcc

SEQ ID NO: 643619 - DNA, 17 bp, Homo sapiens
tcgagagggctgagccc

SEQ ID NO: 643620 - DNA, 22 bp, Homo sapiens
tcgcactacatctgatatcagg

SEQ ID NO: 643621 - DNA, 11 bp, Homo sapiens
tcgcagcctga

SEQ ID NO: 643622 - DNA, 17 bp, Homo sapiens
tcgcagcctgaagcctg

SEQ ID NO: 643623 - DNA, 14 bp, Homo sapiens
tcgcattaagcaca

SEQ ID NO: 643624 - DNA, 21 bp, Homo sapiens
tcgccccccgcccggcctcct

SEQ ID NO: 643625 - DNA, 23 bp, Homo sapiens
tcgccccccgcccggcctcctag

SEQ ID NO: 643626 - DNA, 13 bp, Homo sapiens
tcgcccctcctcg

SEQ ID NO: 643627 - DNA, 14 bp, Homo sapiens
tcgcccctcctcgg

SEQ ID NO: 643628 - DNA, 14 bp, Homo sapiens
tcgccctgtgccct

SEQ ID NO: 643629 - DNA, 15 bp, Homo sapiens
tcgccctgtgccctc

SEQ ID NO: 643630 - DNA, 14 bp, Homo sapiens
tcgccttctggctg

SEQ ID NO: 643631 - DNA, 12 bp, Homo sapiens
tcgccttctggg

SEQ ID NO: 643632 - DNA, 16 bp, Homo sapiens
tcgctgtccgtcctgc

SEQ ID NO: 643633 - DNA, 23 bp, Homo sapiens
tcgcttgtgcagaaaacattgtt

SEQ ID NO: 643634 - DNA, 19 bp, Homo sapiens
tcggacaccatcttgggat

SEQ ID NO: 643635 - DNA, 14 bp, Homo sapiens
tcggatcgctccgc

SEQ ID NO: 643636 - DNA, 15 bp, Homo sapiens
tcggcagtggctggg

SEQ ID NO: 643637 - DNA, 17 bp, Homo sapiens
tcggctgggcagggccg

SEQ ID NO: 643638 - DNA, 16 bp, Homo sapiens
tcgggaaggcctgagg

SEQ ID NO: 643639 - DNA, 20 bp, Homo sapiens
tcgggaaggcctgagggaag

SEQ ID NO: 643640 - DNA, 12 bp, Homo sapiens
tcgggcccgcac

SEQ ID NO: 643641 - DNA, 21 bp, Homo sapiens
tcgggcccgcactcaggagca

SEQ ID NO: 643642 - DNA, 16 bp, Homo sapiens
tcgggccgcctcctcc

SEQ ID NO: 643643 - DNA, 19 bp, Homo sapiens
tcgggccgcctcctccaga

SEQ ID NO: 643644 - DNA, 22 bp, Homo sapiens
tcgggctctctcacccagcctg

SEQ ID NO: 643645 - DNA, 14 bp, Homo sapiens
tcgggggaggagca

SEQ ID NO: 643646 - DNA, 16 bp, Homo sapiens
tcgggggaggagcacc

SEQ ID NO: 643647 - DNA, 22 bp, Homo sapiens
tcggtgtttggaggctgctgcc

SEQ ID NO: 643648 - DNA, 23 bp, Homo sapiens
tcggtgtttggaggctgctgccc

SEQ ID NO: 643649 - DNA, 13 bp, Homo sapiens
tcgtaagttctgt

SEQ ID NO: 643650 - DNA, 15 bp, Homo sapiens
tcgtatggatttcta

SEQ ID NO: 643651 - DNA, 17 bp, Homo sapiens
tcgtccggcctgcagcc

SEQ ID NO: 643652 - DNA, 18 bp, Homo sapiens
tcgtccggcctgcagccc

SEQ ID NO: 643653 - DNA, 20 bp, Homo sapiens
tcgtccggcctgcagcccag

SEQ ID NO: 643654 - DNA, 18 bp, Homo sapiens
tcgtgactcagaaacaga

SEQ ID NO: 643655 - DNA, 17 bp, Homo sapiens
tctttaggattgtgatg

SEQ ID NO: 643656 - DNA, 23 bp, Homo sapiens
tctttaggattgtgatggttcgt

SEQ ID NO: 643657 - DNA, 17 bp, Homo sapiens
tctttcaatccacagta

SEQ ID NO: 643658 - DNA, 20 bp, Homo sapiens
tctttcaatccacagtattg

SEQ ID NO: 643659 - DNA, 21 bp, Homo sapiens
tctttcaatccacagtattgt

SEQ ID NO: 643660 - DNA, 11 bp, Homo sapiens
tctttcaggaa

SEQ ID NO: 643661 - DNA, 14 bp, Homo sapiens
tctttcaggaaatt

SEQ ID NO: 643662 - DNA, 20 bp, Homo sapiens
tctttcaggaaatttttgca

SEQ ID NO: 643663 - DNA, 12 bp, Homo sapiens
tctttcatggaa

SEQ ID NO: 643664 - DNA, 20 bp, Homo sapiens
tctttccaaaggttgtacat

SEQ ID NO: 643665 - DNA, 12 bp, Homo sapiens
tctttctctctg

SEQ ID NO: 643666 - DNA, 15 bp, Homo sapiens
tctttctctctgtgt

SEQ ID NO: 643667 - DNA, 17 bp, Homo sapiens
tctttctctctgtgtgg

SEQ ID NO: 643668 - DNA, 20 bp, Homo sapiens
tctttctgtgtggtgaaaac

SEQ ID NO: 643669 - DNA, 13 bp, Homo sapiens
tctttctttccaa

SEQ ID NO: 643670 - DNA, 17 bp, Homo sapiens
tctttcttttgtgcata

SEQ ID NO: 643671 - DNA, 18 bp, Homo sapiens
tctttcttttgtgcatat

SEQ ID NO: 643672 - DNA, 19 bp, Homo sapiens
tctttgctgtttatatata

SEQ ID NO: 643673 - DNA, 14 bp, Homo sapiens
tctttggttcctca

SEQ ID NO: 643674 - DNA, 13 bp, Homo sapiens
tctttgttaaaat

SEQ ID NO: 643675 - DNA, 14 bp, Homo sapiens
tctttgttaaaata

SEQ ID NO: 643676 - DNA, 14 bp, Homo sapiens
tcttttgttctctc

SEQ ID NO: 643677 - DNA, 13 bp, Homo sapiens
tcttttttcaatg

SEQ ID NO: 643678 - DNA, 14 bp, Homo sapiens
tcttttttcaatgt

SEQ ID NO: 643679 - DNA, 23 bp, Homo sapiens
tctttttttaagtgttctgtggc

SEQ ID NO: 643680 - DNA, 15 bp, Homo sapiens
tcttttttttcttca

SEQ ID NO: 643681 - DNA, 14 bp, Homo sapiens
tgaaaaagcatgta

SEQ ID NO: 643682 - DNA, 20 bp, Homo sapiens
tgaaaaagcatgtacagtgt

SEQ ID NO: 643683 - DNA, 23 bp, Homo sapiens
tgaaaaagcatgtacagtgttct

SEQ ID NO: 643684 - DNA, 20 bp, Homo sapiens
tgaaaaatagtgtgtccatg

SEQ ID NO: 643685 - DNA, 16 bp, Homo sapiens
tgaaaactcatcggga

SEQ ID NO: 643686 - DNA, 12 bp, Homo sapiens
tgaaaactggaa

SEQ ID NO: 643687 - DNA, 14 bp, Homo sapiens
tgaaaactggaata

SEQ ID NO: 643688 - DNA, 12 bp, Homo sapiens
tgaaaagttttc

SEQ ID NO: 643689 - DNA, 18 bp, Homo sapiens
tgaaaagttttcaagcat

SEQ ID NO: 643690 - DNA, 22 bp, Homo sapiens
tgaaaatatatgactttgaata

SEQ ID NO: 643691 - DNA, 16 bp, Homo sapiens
tgacaataagaaacag

SEQ ID NO: 643692 - DNA, 18 bp, Homo sapiens
tgacacactcaccattta

SEQ ID NO: 643693 - DNA, 15 bp, Homo sapiens
tgacaccctttaatg

SEQ ID NO: 643694 - DNA, 16 bp, Homo sapiens
tgacactgtctgctgc

SEQ ID NO: 643695 - DNA, 15 bp, Homo sapiens
tgacagcaaacacag

SEQ ID NO: 643696 - DNA, 19 bp, Homo sapiens
tgacagcaaacacagtcac

SEQ ID NO: 643697 - DNA, 16 bp, Homo sapiens
tgacagtagcatactg

SEQ ID NO: 643698 - DNA, 19 bp, Homo sapiens
tgacagtggttatatttca

SEQ ID NO: 643699 - DNA, 18 bp, Homo sapiens
tgacagttacttacacac

SEQ ID NO: 643700 - DNA, 22 bp, Homo sapiens
tgacatccagcagtccaaggta

SEQ ID NO: 643701 - DNA, 14 bp, Homo sapiens
tgacatggtgctgt

SEQ ID NO: 643702 - DNA, 17 bp, Homo sapiens
tgacatggtgctgtgtg

SEQ ID NO: 643703 - DNA, 18 bp, Homo sapiens
tgacattgtcagaatgtt

SEQ ID NO: 643704 - DNA, 16 bp, Homo sapiens
tgacatttcaatcact

SEQ ID NO: 643705 - DNA, 17 bp, Homo sapiens
tgacattttgtagctag

SEQ ID NO: 643706 - DNA, 18 bp, Homo sapiens
tgacattttgtagctagt

SEQ ID NO: 643707 - DNA, 13 bp, Homo sapiens
tgaccagaaaatt

SEQ ID NO: 643708 - DNA, 13 bp, Homo sapiens
tgacccagcctga

SEQ ID NO: 643709 - DNA, 14 bp, Homo sapiens
tgacccagcctgaa

SEQ ID NO: 643710 - DNA, 15 bp, Homo sapiens
tgacccagcctgaaa

SEQ ID NO: 643711 - DNA, 22 bp, Homo sapiens
tgaccccacacgccggggctgg

SEQ ID NO: 643712 - DNA, 20 bp, Homo sapiens
tgaccctgaaatattttcta

SEQ ID NO: 643713 - DNA, 21 bp, Homo sapiens
tgaccggcccgccaccttgta

SEQ ID NO: 643714 - DNA, 19 bp, Homo sapiens
tgacctctcacttttttat

SEQ ID NO: 643715 - DNA, 13 bp, Homo sapiens
tgacctgctcctg

SEQ ID NO: 643716 - DNA, 21 bp, Homo sapiens
tgaccttcggcagtggctggg

SEQ ID NO: 643717 - DNA, 17 bp, Homo sapiens
tgaccttctgcggctcc

SEQ ID NO: 643718 - DNA, 21 bp, Homo sapiens
tgacgacctacatctgaaatc

SEQ ID NO: 643719 - DNA, 23 bp, Homo sapiens
tgacgacctacatctgaaatcta

SEQ ID NO: 643720 - DNA, 20 bp, Homo sapiens
tgactatggctctggcacca

SEQ ID NO: 643721 - DNA, 22 bp, Homo sapiens
tgactcagaaacagaagaaaaa

SEQ ID NO: 643722 - DNA, 23 bp, Homo sapiens
tgactccagtggggcaagatttt

SEQ ID NO: 643723 - DNA, 14 bp, Homo sapiens
tgactcctgggtgg

SEQ ID NO: 643724 - DNA, 23 bp, Homo sapiens
tgactcttactaaccaccatttc

SEQ ID NO: 643725 - DNA, 13 bp, Homo sapiens
tgactggaaacaa

SEQ ID NO: 643726 - DNA, 20 bp, Homo sapiens
tgactgtacttgatttttca

SEQ ID NO: 643727 - DNA, 16 bp, Homo sapiens
tgactgtagtttttgt

SEQ ID NO: 643728 - DNA, 17 bp, Homo sapiens
tgactgtgttcagtgcc

SEQ ID NO: 643729 - DNA, 13 bp, Homo sapiens
tgacttatttgct

SEQ ID NO: 643730 - DNA, 21 bp, Homo sapiens
tgacttcagaaactttttcta

SEQ ID NO: 643731 - DNA, 19 bp, Homo sapiens
tgacttcagactctctcct

SEQ ID NO: 643732 - DNA, 22 bp, Homo sapiens
tgacttcagactctctcctctc

SEQ ID NO: 643733 - DNA, 14 bp, Homo sapiens
tgacttcccagctg

SEQ ID NO: 643734 - DNA, 21 bp, Homo sapiens
tgactttggggacaccctcct

SEQ ID NO: 643735 - DNA, 20 bp, Homo sapiens
tgagaaaaagcattaaaaat

SEQ ID NO: 643736 - DNA, 15 bp, Homo sapiens
tgagaaatataaaaa

SEQ ID NO: 643737 - DNA, 20 bp, Homo sapiens
tgagaaatcatgttgttcga

SEQ ID NO: 643738 - DNA, 18 bp, Homo sapiens
tgagaaattgtgccaaag

SEQ ID NO: 643739 - DNA, 22 bp, Homo sapiens
tgagaaattgtgccaaagatag

SEQ ID NO: 643740 - DNA, 13 bp, Homo sapiens
tgagaactaaata

SEQ ID NO: 643741 - DNA, 18 bp, Homo sapiens
tgagaactacagctttta

SEQ ID NO: 643742 - DNA, 14 bp, Homo sapiens
tgagaccagcctgc

SEQ ID NO: 643743 - DNA, 15 bp, Homo sapiens
tgagaccagcctgcc

SEQ ID NO: 643744 - DNA, 23 bp, Homo sapiens
tgagactcgcgacaatgcaaacc

SEQ ID NO: 643745 - DNA, 10 bp, Homo sapiens
tgagaggaaa

SEQ ID NO: 643746 - DNA, 20 bp, Homo sapiens
tgagagggggatgcccctgg

SEQ ID NO: 643747 - DNA, 21 bp, Homo sapiens
tgagagggggatgcccctggc

SEQ ID NO: 643748 - DNA, 22 bp, Homo sapiens
tgagagggggatgcccctggcc

SEQ ID NO: 643749 - DNA, 13 bp, Homo sapiens
tgagagtcatctc

SEQ ID NO: 643750 - DNA, 15 bp, Homo sapiens
tgagagtcatctcaa

SEQ ID NO: 643751 - DNA, 22 bp, Homo sapiens
tgagatcccagagttatttccc

SEQ ID NO: 643752 - DNA, 18 bp, Homo sapiens
tgagatgatttaattctt

SEQ ID NO: 643753 - DNA, 20 bp, Homo sapiens
tgagatgttattactgtttt

SEQ ID NO: 643754 - DNA, 17 bp, Homo sapiens
tgagatgtttagtagct

SEQ ID NO: 643755 - DNA, 13 bp, Homo sapiens
tgagattccctct

SEQ ID NO: 643756 - DNA, 19 bp, Homo sapiens
tgagattctaaatgttcat

SEQ ID NO: 643757 - DNA, 17 bp, Homo sapiens
tgagcacatctcttcat

SEQ ID NO: 643758 - DNA, 19 bp, Homo sapiens
tgagcactatctttcagga

SEQ ID NO: 643759 - DNA, 12 bp, Homo sapiens
tgagcagagtct

SEQ ID NO: 643760 - DNA, 21 bp, Homo sapiens
tgagcagagtcttgctacctc

SEQ ID NO: 643761 - DNA, 17 bp, Homo sapiens
tgagcagatcgtgccgt

SEQ ID NO: 643762 - DNA, 19 bp, Homo sapiens
tgagcagatcgtgccgtgg

SEQ ID NO: 643763 - DNA, 13 bp, Homo sapiens
tgagcagtgggga

SEQ ID NO: 643764 - DNA, 17 bp, Homo sapiens
tgagcagtggggagcgg

SEQ ID NO: 643765 - DNA, 19 bp, Homo sapiens
tgagcatatataatcaaaa

SEQ ID NO: 643766 - DNA, 22 bp, Homo sapiens
tgagcatgcccaaatataacat

SEQ ID NO: 643767 - DNA, 14 bp, Homo sapiens
tgagcatgctccct

SEQ ID NO: 643768 - DNA, 15 bp, Homo sapiens
tgagcatgctccctc

SEQ ID NO: 643769 - DNA, 20 bp, Homo sapiens
tgagccaataaagctcacac

SEQ ID NO: 643770 - DNA, 13 bp, Homo sapiens
tgagccagatttc

SEQ ID NO: 643771 - DNA, 16 bp, Homo sapiens
tgagccagatttcact

SEQ ID NO: 643772 - DNA, 17 bp, Homo sapiens
tgagccagatttcactc

SEQ ID NO: 643773 - DNA, 22 bp, Homo sapiens
tgagccagatttcactctcctt

SEQ ID NO: 643774 - DNA, 23 bp, Homo sapiens
tgagccagcagacattgtcagca

SEQ ID NO: 643775 - DNA, 14 bp, Homo sapiens
tgagcccctcctct

SEQ ID NO: 643776 - DNA, 15 bp, Homo sapiens
tgagcccctcctctc

SEQ ID NO: 643777 - DNA, 22 bp, Homo sapiens
tgagccctgccctcactccact

SEQ ID NO: 643778 - DNA, 14 bp, Homo sapiens
tgagccgtgacctc

SEQ ID NO: 643779 - DNA, 16 bp, Homo sapiens
tgagccttattaaaat

SEQ ID NO: 643780 - DNA, 18 bp, Homo sapiens
tgagccttattaaaatat

SEQ ID NO: 643781 - DNA, 15 bp, Homo sapiens
tgagcgagtgacaga

SEQ ID NO: 643782 - DNA, 20 bp, Homo sapiens
tgagcgagtgacagaaggcc

SEQ ID NO: 643783 - DNA, 13 bp, Homo sapiens
tgagctccaccct

SEQ ID NO: 643784 - DNA, 20 bp, Homo sapiens
tgagctccaccctcccctct

SEQ ID NO: 643785 - DNA, 21 bp, Homo sapiens
tgagctgggcaccacaggctg

SEQ ID NO: 643786 - DNA, 21 bp, Homo sapiens
tgagcttgattctaaagggga

SEQ ID NO: 643787 - DNA, 22 bp, Homo sapiens
tgagctttcgttgactgcttct

SEQ ID NO: 643788 - DNA, 16 bp, Homo sapiens
tgaggaaactcataca

SEQ ID NO: 643789 - DNA, 17 bp, Homo sapiens
tgaggacataaatcttc

SEQ ID NO: 643790 - DNA, 16 bp, Homo sapiens
tgaggaggaggacaca

SEQ ID NO: 643791 - DNA, 18 bp, Homo sapiens
tgaggaggaggacacagc

SEQ ID NO: 643792 - DNA, 12 bp, Homo sapiens
tgaggagtccaa

SEQ ID NO: 643793 - DNA, 15 bp, Homo sapiens
tgaggagtccaaaat

SEQ ID NO: 643794 - DNA, 16 bp, Homo sapiens
tgaggatgtatgtgta

SEQ ID NO: 643795 - DNA, 15 bp, Homo sapiens
tgaggccaaatgagt

SEQ ID NO: 643796 - DNA, 14 bp, Homo sapiens
tgaggcccccggag

SEQ ID NO: 643797 - DNA, 16 bp, Homo sapiens
tgaggcccccggaggc

SEQ ID NO: 643798 - DNA, 16 bp, Homo sapiens
tgaggcccctgtgcag

SEQ ID NO: 643799 - DNA, 19 bp, Homo sapiens
tgaggcctttccccagtgt

SEQ ID NO: 643800 - DNA, 22 bp, Homo sapiens
tgagggaagcccacccgcccca

SEQ ID NO: 643801 - DNA, 16 bp, Homo sapiens
tgagggcagggttcta

SEQ ID NO: 643802 - DNA, 18 bp, Homo sapiens
tgaggttaaggggatcta

SEQ ID NO: 643803 - DNA, 15 bp, Homo sapiens
tgagtagcatatata

SEQ ID NO: 643804 - DNA, 14 bp, Homo sapiens
tgagtagttatgaa

SEQ ID NO: 643805 - DNA, 18 bp, Homo sapiens
tgagtatttgcgtccgca

SEQ ID NO: 643806 - DNA, 19 bp, Homo sapiens
tgagtcggctgggcagggc

SEQ ID NO: 643807 - DNA, 20 bp, Homo sapiens
tgagtcggctgggcagggcc

SEQ ID NO: 643808 - DNA, 15 bp, Homo sapiens
tgagtgggccccctc

SEQ ID NO: 643809 - DNA, 23 bp, Homo sapiens
tctgactccagtggggcaagatt

SEQ ID NO: 643810 - DNA, 12 bp, Homo sapiens
tctgactgccaa

SEQ ID NO: 643811 - DNA, 23 bp, Homo sapiens
tctgagactcgcgacaatgcaaa

SEQ ID NO: 643812 - DNA, 15 bp, Homo sapiens
tctgagcagtgggga

SEQ ID NO: 643813 - DNA, 12 bp, Homo sapiens
tctgaggacaga

SEQ ID NO: 643814 - DNA, 13 bp, Homo sapiens
tctgaggagtcca

SEQ ID NO: 643815 - DNA, 19 bp, Homo sapiens
tctgaggagtccaaaatat

SEQ ID NO: 643816 - DNA, 17 bp, Homo sapiens
tctgaggccccaggccc

SEQ ID NO: 643817 - DNA, 14 bp, Homo sapiens
tctgagtgttgaag

SEQ ID NO: 643818 - DNA, 19 bp, Homo sapiens
tctgatacatctgtcagtg

SEQ ID NO: 643819 - DNA, 22 bp, Homo sapiens
tctgatatcaggaaatatctgt

SEQ ID NO: 643820 - DNA, 14 bp, Homo sapiens
tctgattattacaa

SEQ ID NO: 643821 - DNA, 19 bp, Homo sapiens
tctgcacacataacacaca

SEQ ID NO: 643822 - DNA, 22 bp, Homo sapiens
tctgcactgagcagagtcttgc

SEQ ID NO: 643823 - DNA, 15 bp, Homo sapiens
tctgcagcctgagct

SEQ ID NO: 643824 - DNA, 16 bp, Homo sapiens
tctgcagtattctgta

SEQ ID NO: 643825 - DNA, 17 bp, Homo sapiens
tctgcagtattctgtag

SEQ ID NO: 643826 - DNA, 15 bp, Homo sapiens
tctgccccctccccc

SEQ ID NO: 643827 - DNA, 20 bp, Homo sapiens
tctgccccctcccccgcaga

SEQ ID NO: 643828 - DNA, 24 bp, Homo sapiens
tctgccccctcccccgcagacaga

SEQ ID NO: 643829 - DNA, 19 bp, Homo sapiens
tctgccccttgaccccaca

SEQ ID NO: 643830 - DNA, 17 bp, Homo sapiens
tctgcccgcgggtggct

SEQ ID NO: 643831 - DNA, 22 bp, Homo sapiens
tctgcccgcgggtggctggagc

SEQ ID NO: 643832 - DNA, 13 bp, Homo sapiens
tctgcgccccagc

SEQ ID NO: 643833 - DNA, 16 bp, Homo sapiens
tctgctaatttatgaa

SEQ ID NO: 643834 - DNA, 16 bp, Homo sapiens
tctgctgaattttcac

SEQ ID NO: 643835 - DNA, 16 bp, Homo sapiens
tctgctgctttccaac

SEQ ID NO: 643836 - DNA, 16 bp, Homo sapiens
tctgcttgtcattctg

SEQ ID NO: 643837 - DNA, 19 bp, Homo sapiens
tctgcttgtcattctgcta

SEQ ID NO: 643838 - DNA, 20 bp, Homo sapiens
tctggagcccctatcctgca

SEQ ID NO: 643839 - DNA, 11 bp, Homo sapiens
tctggccctga

SEQ ID NO: 643840 - DNA, 21 bp, Homo sapiens
tctggccttggttcctccagc

SEQ ID NO: 643841 - DNA, 22 bp, Homo sapiens
tctggcgccaggggcaggcagc

SEQ ID NO: 643842 - DNA, 14 bp, Homo sapiens
tctggctgtggccc

SEQ ID NO: 643843 - DNA, 14 bp, Homo sapiens
tctgggttaacagt

SEQ ID NO: 643844 - DNA, 22 bp, Homo sapiens
tctgggttttagaaattctata

SEQ ID NO: 643845 - DNA, 22 bp, Homo sapiens
tctggtccttagtaaattccta

SEQ ID NO: 643846 - DNA, 15 bp, Homo sapiens
tctggtgcgtgtggc

SEQ ID NO: 643847 - DNA, 18 bp, Homo sapiens
tctgtaaaaagcaggtga

SEQ ID NO: 643848 - DNA, 14 bp, Homo sapiens
tctgtaaaaccagg

SEQ ID NO: 643849 - DNA, 17 bp, Homo sapiens
tgctaattaaaaagtta

SEQ ID NO: 643850 - DNA, 20 bp, Homo sapiens
tgctaatttatgaagatagt

SEQ ID NO: 643851 - DNA, 15 bp, Homo sapiens
tgctacaaaatgtgt

SEQ ID NO: 643852 - DNA, 16 bp, Homo sapiens
tgctacaaaatgtgtg

SEQ ID NO: 643853 - DNA, 21 bp, Homo sapiens
tgctacaccttagcagctctt

SEQ ID NO: 643854 - DNA, 13 bp, Homo sapiens
tgctacctcagtc

SEQ ID NO: 643855 - DNA, 22 bp, Homo sapiens
tgctagacagaaaccaagccat

SEQ ID NO: 643856 - DNA, 17 bp, Homo sapiens
tgctagttctgctgccc

SEQ ID NO: 643857 - DNA, 18 bp, Homo sapiens
tgctagttctgctgccct

SEQ ID NO: 643858 - DNA, 12 bp, Homo sapiens
tgctagttctta

SEQ ID NO: 643859 - DNA, 18 bp, Homo sapiens
tgctatgctgttcattga

SEQ ID NO: 643860 - DNA, 14 bp, Homo sapiens
tgctattgtttata

SEQ ID NO: 643861 - DNA, 14 bp, Homo sapiens
tgctatttgtgtaa

SEQ ID NO: 643862 - DNA, 15 bp, Homo sapiens
tgctatttgtgtaac

SEQ ID NO: 643863 - DNA, 21 bp, Homo sapiens
tggagaagggttctgccctgc

SEQ ID NO: 643864 - DNA, 22 bp, Homo sapiens
tggagaccctgcgcccctgccc

SEQ ID NO: 643865 - DNA, 23 bp, Homo sapiens
tggagaccctgcgcccctgccca

SEQ ID NO: 643866 - DNA, 13 bp, Homo sapiens
tggagagcagcag

SEQ ID NO: 643867 - DNA, 14 bp, Homo sapiens
tggagagcagcagg

SEQ ID NO: 643868 - DNA, 19 bp, Homo sapiens
tggagagcagcaggtgctg

SEQ ID NO: 643869 - DNA, 12 bp, Homo sapiens
tggagaggagag

SEQ ID NO: 643870 - DNA, 21 bp, Homo sapiens
tggagaggagagtggcaggtg

SEQ ID NO: 643871 - DNA, 20 bp, Homo sapiens
tggagaggaggtgtggagtg

SEQ ID NO: 643872 - DNA, 21 bp, Homo sapiens
tggagaggaggtgtggagtgg

SEQ ID NO: 643873 - DNA, 22 bp, Homo sapiens
tggagcagagacggcagcccca

SEQ ID NO: 643874 - DNA, 14 bp, Homo sapiens
tggagccagggcag

SEQ ID NO: 643875 - DNA, 16 bp, Homo sapiens
tggagccagggcagag

SEQ ID NO: 643876 - DNA, 18 bp, Homo sapiens
tggagccagggcagagga

SEQ ID NO: 643877 - DNA, 19 bp, Homo sapiens
tggagccccatcgcctggg

SEQ ID NO: 643878 - DNA, 22 bp, Homo sapiens
tggagccccctggcggcagggg

SEQ ID NO: 643879 - DNA, 15 bp, Homo sapiens
tggagcccctatcct

SEQ ID NO: 643880 - DNA, 12 bp, Homo sapiens
tggagcctgggc

SEQ ID NO: 643881 - DNA, 20 bp, Homo sapiens
tggaggagaaggaggaaccc

SEQ ID NO: 643882 - DNA, 20 bp, Homo sapiens
tggaggaggaggaggagcct

SEQ ID NO: 643883 - DNA, 21 bp, Homo sapiens
tggaggaggaggaggagcctt

SEQ ID NO: 643884 - DNA, 22 bp, Homo sapiens
tggaggagggggtacagtcctg

SEQ ID NO: 643885 - DNA, 22 bp, Homo sapiens
tggaggcatgtgatgagaggaa

SEQ ID NO: 643886 - DNA, 18 bp, Homo sapiens
tggaggcctggtctggag

SEQ ID NO: 643887 - DNA, 19 bp, Homo sapiens
tggaggcctggtctggagc

SEQ ID NO: 643888 - DNA, 21 bp, Homo sapiens
tggaggcctggtctggagccc

SEQ ID NO: 643889 - DNA, 13 bp, Homo sapiens
tggaggctgctgc

SEQ ID NO: 643890 - DNA, 14 bp, Homo sapiens
tggaggctgctgcc

SEQ ID NO: 643891 - DNA, 13 bp, Homo sapiens
tggagtagagtca

SEQ ID NO: 643892 - DNA, 14 bp, Homo sapiens
tggagtcagggctg

SEQ ID NO: 643893 - DNA, 19 bp, Homo sapiens
tggagtcagggctgtgctt

SEQ ID NO: 643894 - DNA, 17 bp, Homo sapiens
tggagtctgaaggagag

SEQ ID NO: 643895 - DNA, 18 bp, Homo sapiens
tggagtctgaaggagagg

SEQ ID NO: 643896 - DNA, 13 bp, Homo sapiens
tggagtgcagtgg

SEQ ID NO: 643897 - DNA, 22 bp, Homo sapiens
tggatacgggggttccctttcc

SEQ ID NO: 643898 - DNA, 18 bp, Homo sapiens
tggataggagcttccaga

SEQ ID NO: 643899 - DNA, 16 bp, Homo sapiens
tggatatgaaagagaa

SEQ ID NO: 643900 - DNA, 12 bp, Homo sapiens
tggatcaggaaa

SEQ ID NO: 643901 - DNA, 14 bp, Homo sapiens
tggatccttccatc

SEQ ID NO: 643902 - DNA, 18 bp, Homo sapiens
tggatctggagtctgaag

SEQ ID NO: 643903 - DNA, 13 bp, Homo sapiens
tggatgaaggcaa

SEQ ID NO: 643904 - DNA, 17 bp, Homo sapiens
tggatggaggtgatgaa

SEQ ID NO: 643905 - DNA, 15 bp, Homo sapiens
tggatgtgctttcat

SEQ ID NO: 643906 - DNA, 15 bp, Homo sapiens
tggatttgacacact

SEQ ID NO: 643907 - DNA, 12 bp, Homo sapiens
tggcaaacattt

SEQ ID NO: 643908 - DNA, 13 bp, Homo sapiens
tggcaaacattta

SEQ ID NO: 643909 - DNA, 19 bp, Homo sapiens
tggcaacgttcatgttcat

SEQ ID NO: 643910 - DNA, 14 bp, Homo sapiens
tggcaactgtggaa

SEQ ID NO: 643911 - DNA, 21 bp, Homo sapiens
tggcaagctcttcattgcact

SEQ ID NO: 643912 - DNA, 13 bp, Homo sapiens
tggcaagtttttg

SEQ ID NO: 643913 - DNA, 13 bp, Homo sapiens
tggcacccactgg

SEQ ID NO: 643914 - DNA, 19 bp, Homo sapiens
tggcagaagcagttgcaat

SEQ ID NO: 643915 - DNA, 17 bp, Homo sapiens
tggcagcgcctcccgcc

SEQ ID NO: 643916 - DNA, 15 bp, Homo sapiens
tggcagcttccctga

SEQ ID NO: 643917 - DNA, 11 bp, Homo sapiens
tggcagggaag

SEQ ID NO: 643918 - DNA, 21 bp, Homo sapiens
tggcagggaagggtgcctggc

SEQ ID NO: 643919 - DNA, 22 bp, Homo sapiens
tggcagggaagggtgcctggct

SEQ ID NO: 643920 - DNA, 23 bp, Homo sapiens
tggcagggaagggtgcctggctg

SEQ ID NO: 643921 - DNA, 15 bp, Homo sapiens
tggcaggtgggctgc

SEQ ID NO: 643922 - DNA, 14 bp, Homo sapiens
tggcagtattgaca

SEQ ID NO: 643923 - DNA, 11 bp, Homo sapiens
tggcagtgtgt

SEQ ID NO: 643924 - DNA, 22 bp, Homo sapiens
tggcagtgtgtcacactgagct

SEQ ID NO: 643925 - DNA, 18 bp, Homo sapiens
tggcatagccattcattt

SEQ ID NO: 643926 - DNA, 15 bp, Homo sapiens
tggcatgctgtctct

SEQ ID NO: 643927 - DNA, 14 bp, Homo sapiens
tggcatttgctgaa

SEQ ID NO: 643928 - DNA, 18 bp, Homo sapiens
tggccaagtgtacatttg

SEQ ID NO: 643929 - DNA, 12 bp, Homo sapiens
tggccacctgcc

SEQ ID NO: 643930 - DNA, 13 bp, Homo sapiens
tggccacctgcca

SEQ ID NO: 643931 - DNA, 14 bp, Homo sapiens
tggccacctgccag

SEQ ID NO: 643932 - DNA, 22 bp, Homo sapiens
tggccacctgccaggcctccct

SEQ ID NO: 643933 - DNA, 16 bp, Homo sapiens
tggccaggcctcaggg

SEQ ID NO: 643934 - DNA, 20 bp, Homo sapiens
tggccatttgctagttctgc

SEQ ID NO: 643935 - DNA, 20 bp, Homo sapiens
tggcccaacatacgcactgg

SEQ ID NO: 643936 - DNA, 13 bp, Homo sapiens
tggcccacccctc

SEQ ID NO: 643937 - DNA, 21 bp, Homo sapiens
tggcccacccctcttccccct

SEQ ID NO: 643938 - DNA, 22 bp, Homo sapiens
tggcccacccctcttccccctt

SEQ ID NO: 643939 - DNA, 12 bp, Homo sapiens
tggccccaggcg

SEQ ID NO: 643940 - DNA, 11 bp, Homo sapiens
tggccccctcg

SEQ ID NO: 643941 - DNA, 21 bp, Homo sapiens
tggcccctccttctcccctcc

SEQ ID NO: 643942 - DNA, 14 bp, Homo sapiens
tggcccctctctgt

SEQ ID NO: 643943 - DNA, 13 bp, Homo sapiens
tggccctcttctt

SEQ ID NO: 643944 - DNA, 16 bp, Homo sapiens
tggccctggagccagg

SEQ ID NO: 643945 - DNA, 19 bp, Homo sapiens
tggccctgtgactatggct

SEQ ID NO: 643946 - DNA, 16 bp, Homo sapiens
tggccctgtgggagtc

SEQ ID NO: 643947 - DNA, 12 bp, Homo sapiens
tggccggctggc

SEQ ID NO: 643948 - DNA, 17 bp, Homo sapiens
tggccggtaggctgctg

SEQ ID NO: 643949 - DNA, 22 bp, Homo sapiens
tggccggtaggctgctggcgcc

SEQ ID NO: 643950 - DNA, 15 bp, Homo sapiens
tggccggtccacccc

SEQ ID NO: 643951 - DNA, 16 bp, Homo sapiens
tggccggtccaccccg

SEQ ID NO: 643952 - DNA, 12 bp, Homo sapiens
tggcctctgccc

SEQ ID NO: 643953 - DNA, 13 bp, Homo sapiens
tggcctctgcccc

SEQ ID NO: 643954 - DNA, 14 bp, Homo sapiens
tggcctctgcccct

SEQ ID NO: 643955 - DNA, 14 bp, Homo sapiens
tggcctgagaagag

SEQ ID NO: 643956 - DNA, 16 bp, Homo sapiens
tggcctggcttctggg

SEQ ID NO: 643957 - DNA, 18 bp, Homo sapiens
tggccttccctccccaca

SEQ ID NO: 643958 - DNA, 13 bp, Homo sapiens
tggcgccaggggc

SEQ ID NO: 643959 - DNA, 18 bp, Homo sapiens
tggcgccaggggcaggca

SEQ ID NO: 643960 - DNA, 20 bp, Homo sapiens
tggcgccaggggcaggcagc

SEQ ID NO: 643961 - DNA, 21 bp, Homo sapiens
tggcgccccatgggccctcag

SEQ ID NO: 643962 - DNA, 21 bp, Homo sapiens
tggcggcaggggttggcagcg

SEQ ID NO: 643963 - DNA, 20 bp, Homo sapiens
tggcgggcagcccctgctgg

SEQ ID NO: 643964 - DNA, 20 bp, Homo sapiens
tggctaaatgcctaataaac

SEQ ID NO: 643965 - DNA, 14 bp, Homo sapiens
tggctcccagcaga

SEQ ID NO: 643966 - DNA, 18 bp, Homo sapiens
tggctcccagggtcctgg

SEQ ID NO: 643967 - DNA, 16 bp, Homo sapiens
tggctcgtgtttcaca

SEQ ID NO: 643968 - DNA, 17 bp, Homo sapiens
tggctctaactccttga

SEQ ID NO: 643969 - DNA, 19 bp, Homo sapiens
tggctgaaattatgtcaaa

SEQ ID NO: 643970 - DNA, 18 bp, Homo sapiens
tggctgaagaaacacagc

SEQ ID NO: 643971 - DNA, 18 bp, Homo sapiens
tggctgagagggtgtggg

SEQ ID NO: 643972 - DNA, 21 bp, Homo sapiens
tggctgatttactaacagtaa

SEQ ID NO: 643973 - DNA, 16 bp, Homo sapiens
tggctgcagagacctt

SEQ ID NO: 643974 - DNA, 21 bp, Homo sapiens
tggctgcagatgactggaaac

SEQ ID NO: 643975 - DNA, 13 bp, Homo sapiens
tggctgctgcagt

SEQ ID NO: 643976 - DNA, 11 bp, Homo sapiens
tggctgcttca

SEQ ID NO: 643977 - DNA, 21 bp, Homo sapiens
tggctgcttcaaggatcctga

SEQ ID NO: 643978 - DNA, 22 bp, Homo sapiens
tggctgggaacatgacccagcc

SEQ ID NO: 643979 - DNA, 20 bp, Homo sapiens
tggctggggccggggctgcc

SEQ ID NO: 643980 - DNA, 19 bp, Homo sapiens
tggctgggtcgcccctcct

SEQ ID NO: 643981 - DNA, 19 bp, Homo sapiens
tggctgggtttgggcagtg

SEQ ID NO: 643982 - DNA, 18 bp, Homo sapiens
tggtgtcgggcatgacac

SEQ ID NO: 643983 - DNA, 13 bp, Homo sapiens
tgtctcaaaataa

SEQ ID NO: 643984 - DNA, 12 bp, Homo sapiens
tgtctcatgttt

SEQ ID NO: 643985 - DNA, 14 bp, Homo sapiens
tgtctcctctgtca

SEQ ID NO: 643986 - DNA, 14 bp, Homo sapiens
tgtctctaattgat

SEQ ID NO: 643987 - DNA, 21 bp, Homo sapiens
tgtctctacaaaaaaaatcaa

SEQ ID NO: 643988 - DNA, 20 bp, Homo sapiens
tgtctgaaaaagtgttttta

SEQ ID NO: 643989 - DNA, 19 bp, Homo sapiens
tgtctgagccctgccctca

SEQ ID NO: 643990 - DNA, 15 bp, Homo sapiens
tgtctgctgctgcct

SEQ ID NO: 643991 - DNA, 19 bp, Homo sapiens
tgtctggagcctgcaggca

SEQ ID NO: 643992 - DNA, 20 bp, Homo sapiens
tgtctgtccctaaacatagt

SEQ ID NO: 643993 - DNA, 21 bp, Homo sapiens
tgtctgtccctaaacatagtg

SEQ ID NO: 643994 - DNA, 15 bp, Homo sapiens
tgtcttcaaaatata

SEQ ID NO: 643995 - DNA, 19 bp, Homo sapiens
tgtcttcaaccctgccctg

SEQ ID NO: 643996 - DNA, 20 bp, Homo sapiens
tgtcttcaaccctgccctgc

SEQ ID NO: 643997 - DNA, 22 bp, Homo sapiens
tgtcttcaaccctgccctgcac

SEQ ID NO: 643998 - DNA, 17 bp, Homo sapiens
tgtcttcatgttgatgt

SEQ ID NO: 643999 - DNA, 14 bp, Homo sapiens
tgtctttatgattt

SEQ ID NO: 644000 - DNA, 17 bp, Homo sapiens
tgtctttctccaaagtt

SEQ ID NO: 644001 - DNA, 12 bp, Homo sapiens
tgtctttgctgt

SEQ ID NO: 644002 - DNA, 13 bp, Homo sapiens
tgtctttgctgtt

SEQ ID NO: 644003 - DNA, 14 bp, Homo sapiens
tgtcttttgcatga

SEQ ID NO: 644004 - DNA, 13 bp, Homo sapiens
tgtgaaaatgctt

SEQ ID NO: 644005 - DNA, 13 bp, Homo sapiens
tgtgaaataaaga

SEQ ID NO: 644006 - DNA, 14 bp, Homo sapiens
tgtgaactatgttt

SEQ ID NO: 644007 - DNA, 14 bp, Homo sapiens
tgtgaactgccagg

SEQ ID NO: 644008 - DNA, 17 bp, Homo sapiens
tgtgaagtgattgacat

SEQ ID NO: 644009 - DNA, 19 bp, Homo sapiens
tgtgaagtgattgacattt

SEQ ID NO: 644010 - DNA, 17 bp, Homo sapiens
tgtgaccctcaattcat

SEQ ID NO: 644011 - DNA, 22 bp, Homo sapiens
tgtgagataaatatcattatag

SEQ ID NO: 644012 - DNA, 19 bp, Homo sapiens
tgtgaggatgtggatggag

SEQ ID NO: 644013 - DNA, 23 bp, Homo sapiens
tgtgaggctccctccctccctgc

SEQ ID NO: 644014 - DNA, 21 bp, Homo sapiens
tgtgagtctgtcctttcccac

SEQ ID NO: 644015 - DNA, 18 bp, Homo sapiens
tgtgataattgtaaaggt

SEQ ID NO: 644016 - DNA, 19 bp, Homo sapiens
tgtgatgagaggaaatcac

SEQ ID NO: 644017 - DNA, 22 bp, Homo sapiens
tgtgatggttcgttctgtttac

SEQ ID NO: 644018 - DNA, 13 bp, Homo sapiens
tgtgatttatgca

SEQ ID NO: 644019 - DNA, 15 bp, Homo sapiens
tgtgatttatgcatt

SEQ ID NO: 644020 - DNA, 18 bp, Homo sapiens
tgtgcacctgactttgga

SEQ ID NO: 644021 - DNA, 16 bp, Homo sapiens
tgtgcacggcagcttg

SEQ ID NO: 644022 - DNA, 16 bp, Homo sapiens
tgtgcactctactctg

SEQ ID NO: 644023 - DNA, 17 bp, Homo sapiens
tgtgcagaaaacattgt

SEQ ID NO: 644024 - DNA, 19 bp, Homo sapiens
tgtgcagaaaacattgttc

SEQ ID NO: 644025 - DNA, 16 bp, Homo sapiens
tgtgcagactgtggct

SEQ ID NO: 644026 - DNA, 20 bp, Homo sapiens
tgtgcagtagagagcctttc

SEQ ID NO: 644027 - DNA, 20 bp, Homo sapiens
tgtgcatctggcctgggggc

SEQ ID NO: 644028 - DNA, 17 bp, Homo sapiens
tgtgccaaaatgtcaat

SEQ ID NO: 644029 - DNA, 20 bp, Homo sapiens
tgtgcccacccgtgttctcc

SEQ ID NO: 644030 - DNA, 20 bp, Homo sapiens
tgtgcccacgtgtgcagact

SEQ ID NO: 644031 - DNA, 13 bp, Homo sapiens
tgtgccccttccc

SEQ ID NO: 644032 - DNA, 15 bp, Homo sapiens
tgtgccccttcccca

SEQ ID NO: 644033 - DNA, 20 bp, Homo sapiens
tgtgccgtctttggttcctc

SEQ ID NO: 644034 - DNA, 17 bp, Homo sapiens
tgtgcctttgggaggca

SEQ ID NO: 644035 - DNA, 23 bp, Homo sapiens
tgtgctctacatctcgtatggat

SEQ ID NO: 644036 - DNA, 18 bp, Homo sapiens
tgtgctgctgtggcatca

SEQ ID NO: 644037 - DNA, 17 bp, Homo sapiens
tgtgctgttgattcttt

SEQ ID NO: 644038 - DNA, 19 bp, Homo sapiens
tgtgctgttgattctttca

SEQ ID NO: 644039 - DNA, 16 bp, Homo sapiens
tgtgcttatgtcattt

SEQ ID NO: 644040 - DNA, 16 bp, Homo sapiens
tgtgcttgttcttcct

SEQ ID NO: 644041 - DNA, 12 bp, Homo sapiens
tgtgctttcatc

SEQ ID NO: 644042 - DNA, 14 bp, Homo sapiens
tgtgctttcatgtt

SEQ ID NO: 644043 - DNA, 22 bp, Homo sapiens
tgtggaaggcacactgagcaag

SEQ ID NO: 644044 - DNA, 23 bp, Homo sapiens
tgtggaattacataacaggcatt

SEQ ID NO: 644045 - DNA, 18 bp, Homo sapiens
tgtggacttttccccatt

SEQ ID NO: 644046 - DNA, 12 bp, Homo sapiens
tgtggagtggag

SEQ ID NO: 644047 - DNA, 23 bp, Homo sapiens
tgtggatggaggtgatgaaaacc

SEQ ID NO: 644048 - DNA, 13 bp, Homo sapiens
tgtggcaaacatt

SEQ ID NO: 644049 - DNA, 15 bp, Homo sapiens
tgtggcaaacattta

SEQ ID NO: 644050 - DNA, 12 bp, Homo sapiens
tgtggcccctcc

SEQ ID NO: 644051 - DNA, 19 bp, Homo sapiens
tgtggcccctccttctccc

SEQ ID NO: 644052 - DNA, 21 bp, Homo sapiens
tgtggctaaatgcctaataaa

SEQ ID NO: 644053 - DNA, 14 bp, Homo sapiens
tgtggctgcagaga

SEQ ID NO: 644054 - DNA, 12 bp, Homo sapiens
tgtggcttggaa

SEQ ID NO: 644055 - DNA, 18 bp, Homo sapiens
tgtgggactggcccaccc

SEQ ID NO: 644056 - DNA, 20 bp, Homo sapiens
tgtgggactggcccacccct

SEQ ID NO: 644057 - DNA, 13 bp, Homo sapiens
tgtggggagggtg

SEQ ID NO: 644058 - DNA, 13 bp, Homo sapiens
tgtggggccagga

SEQ ID NO: 644059 - DNA, 16 bp, Homo sapiens
tgtggggccaggacca

SEQ ID NO: 644060 - DNA, 22 bp, Homo sapiens
tgtggggccaggaccatggccg

SEQ ID NO: 644061 - DNA, 15 bp, Homo sapiens
tgtgtaactgaaagg

SEQ ID NO: 644062 - DNA, 20 bp, Homo sapiens
tgtgtatggaagacaaatac

SEQ ID NO: 644063 - DNA, 21 bp, Homo sapiens
tgtgtatggaagacaaataca

SEQ ID NO: 644064 - DNA, 23 bp, Homo sapiens
tgtgtatggaagacaaatacaca

SEQ ID NO: 644065 - DNA, 15 bp, Homo sapiens
tgtgtcacactgagc

SEQ ID NO: 644066 - DNA, 17 bp, Homo sapiens
tgtgtcacactgagctg

SEQ ID NO: 644067 - DNA, 10 bp, Homo sapiens
tgtgtccttt

SEQ ID NO: 644068 - DNA, 16 bp, Homo sapiens
tgtgtcctttaaaaaa

SEQ ID NO: 644069 - DNA, 16 bp, Homo sapiens
tgtgtcttttgcatga

SEQ ID NO: 644070 - DNA, 20 bp, Homo sapiens
tgtgtgcttcacacaaagtg

SEQ ID NO: 644071 - DNA, 14 bp, Homo sapiens
tgtgtggcaaacat

SEQ ID NO: 644072 - DNA, 16 bp, Homo sapiens
tgtgtggcaaacattt

SEQ ID NO: 644073 - DNA, 21 bp, Homo sapiens
tgtgtgggtttactctgtgct

SEQ ID NO: 644074 - DNA, 13 bp, Homo sapiens
tgtgtgtggtttt

SEQ ID NO: 644075 - DNA, 20 bp, Homo sapiens
tgtgtgtggttttttttcta

SEQ ID NO: 644076 - DNA, 22 bp, Homo sapiens
tgtgttcagtgccttggagcag

SEQ ID NO: 644077 - DNA, 15 bp, Homo sapiens
tgtgttctcaacaca

SEQ ID NO: 644078 - DNA, 17 bp, Homo sapiens
tgtgttctcaacacaca

SEQ ID NO: 644079 - DNA, 19 bp, Homo sapiens
tgtgttctcaacacacagt

SEQ ID NO: 644080 - DNA, 16 bp, Homo sapiens
tgtgttttcttcgtgg

SEQ ID NO: 644081 - DNA, 19 bp, Homo sapiens
tgtgttttcttcgtggatt

SEQ ID NO: 644082 - DNA, 23 bp, Homo sapiens
tgtgttttcttcgtggattgttt

SEQ ID NO: 644083 - DNA, 13 bp, Homo sapiens
tgttaaaatatag

SEQ ID NO: 644084 - DNA, 14 bp, Homo sapiens
tgttacaataagtg

SEQ ID NO: 644085 - DNA, 14 bp, Homo sapiens
tgttagaaaaaact

SEQ ID NO: 644086 - DNA, 20 bp, Homo sapiens
tgttagaaaaaactggaaac

SEQ ID NO: 644087 - DNA, 11 bp, Homo sapiens
tgttagaatta

SEQ ID NO: 644088 - DNA, 15 bp, Homo sapiens
tgttagctcagagga

SEQ ID NO: 644089 - DNA, 17 bp, Homo sapiens
tgttataaaatctgtat

SEQ ID NO: 644090 - DNA, 19 bp, Homo sapiens
tgttattcaataactattg

SEQ ID NO: 644091 - DNA, 15 bp, Homo sapiens
tgttcaaattctgat

SEQ ID NO: 644092 - DNA, 19 bp, Homo sapiens
tgttcaaattctgattatt

SEQ ID NO: 644093 - DNA, 15 bp, Homo sapiens
tgttcaccttctgtg

SEQ ID NO: 644094 - DNA, 22 bp, Homo sapiens
tgttcagatctcatagatgacc

SEQ ID NO: 644095 - DNA, 14 bp, Homo sapiens
tgttcagtcacttg

SEQ ID NO: 644096 - DNA, 16 bp, Homo sapiens
tgttccaagtgtgtgt

SEQ ID NO: 644097 - DNA, 14 bp, Homo sapiens
tgttccgcctcact

SEQ ID NO: 644098 - DNA, 24 bp, Homo sapiens
tgttccgttcatctgaggagtcca

SEQ ID NO: 644099 - DNA, 12 bp, Homo sapiens
tgttctcaacac

SEQ ID NO: 644100 - DNA, 19 bp, Homo sapiens
tgttctcaacacacagtat

SEQ ID NO: 644101 - DNA, 20 bp, Homo sapiens
tgttctcaacacacagtata

SEQ ID NO: 644102 - DNA, 11 bp, Homo sapiens
tgttctcctcc

SEQ ID NO: 644103 - DNA, 16 bp, Homo sapiens
ttctgatcctctcttc

SEQ ID NO: 644104 - DNA, 16 bp, Homo sapiens
ttctgattattacaac

SEQ ID NO: 644105 - DNA, 22 bp, Homo sapiens
ttctgattattacaacaagcaa

SEQ ID NO: 644106 - DNA, 15 bp, Homo sapiens
ttctgcaataacagt

SEQ ID NO: 644107 - DNA, 22 bp, Homo sapiens
ttctgcaataacagttttaaga

SEQ ID NO: 644108 - DNA, 14 bp, Homo sapiens
ttctgcacatacag

SEQ ID NO: 644109 - DNA, 15 bp, Homo sapiens
ttctgcacatacaga

SEQ ID NO: 644110 - DNA, 20 bp, Homo sapiens
ttctgcactgagcagagtct

SEQ ID NO: 644111 - DNA, 18 bp, Homo sapiens
ttctgcagtattctgtag

SEQ ID NO: 644112 - DNA, 17 bp, Homo sapiens
ttctgccctgcctgagg

SEQ ID NO: 644113 - DNA, 17 bp, Homo sapiens
ttctggagatggatcct

SEQ ID NO: 644114 - DNA, 13 bp, Homo sapiens
ttctgggaagaaa

SEQ ID NO: 644115 - DNA, 22 bp, Homo sapiens
ttctgggacaggcaccatgctg

SEQ ID NO: 644116 - DNA, 19 bp, Homo sapiens
ttctggggagggacacaga

SEQ ID NO: 644117 - DNA, 21 bp, Homo sapiens
ttctggggagggacacagagg

SEQ ID NO: 644118 - DNA, 16 bp, Homo sapiens
ttctggggtggggctt

SEQ ID NO: 644119 - DNA, 20 bp, Homo sapiens
ttctggtggcaaatgaattt

SEQ ID NO: 644120 - DNA, 12 bp, Homo sapiens
ttctgtaattct

SEQ ID NO: 644121 - DNA, 14 bp, Homo sapiens
ttctgtgcatctgg

SEQ ID NO: 644122 - DNA, 16 bp, Homo sapiens
ttctgttggtcttaac

SEQ ID NO: 644123 - DNA, 22 bp, Homo sapiens
ttctgttggtcttaactaatgt

SEQ ID NO: 644124 - DNA, 15 bp, Homo sapiens
ttctgttttagagtt

SEQ ID NO: 644125 - DNA, 23 bp, Homo sapiens
ttcttaaggacagtgttcaaatt

SEQ ID NO: 644126 - DNA, 19 bp, Homo sapiens
ttcttaccgaaatgaaaat

SEQ ID NO: 644127 - DNA, 22 bp, Homo sapiens
ttcttattcatgctttctcctt

SEQ ID NO: 644128 - DNA, 20 bp, Homo sapiens
ttcttatttgtttggtcact

SEQ ID NO: 644129 - DNA, 14 bp, Homo sapiens
ttcttccaacatgt

SEQ ID NO: 644130 - DNA, 21 bp, Homo sapiens
ttcttcccccagggtcccctg

SEQ ID NO: 644131 - DNA, 16 bp, Homo sapiens
ttcttctttaattttt

SEQ ID NO: 644132 - DNA, 19 bp, Homo sapiens
ttcttgcagtcatcagaag

SEQ ID NO: 644133 - DNA, 19 bp, Homo sapiens
ttcttgcggcaccgcccac

SEQ ID NO: 644134 - DNA, 18 bp, Homo sapiens
ttcttgctctgctcatct

SEQ ID NO: 644135 - DNA, 14 bp, Homo sapiens
ttcttggtatgatc

SEQ ID NO: 644136 - DNA, 23 bp, Homo sapiens
ttcttgtaaaactgtgacattcc

SEQ ID NO: 644137 - DNA, 15 bp, Homo sapiens
ttctttaacatatca

SEQ ID NO: 644138 - DNA, 12 bp, Homo sapiens
ttctttaatttt

SEQ ID NO: 644139 - DNA, 17 bp, Homo sapiens
ttctttaatttttctgt

SEQ ID NO: 644140 - DNA, 14 bp, Homo sapiens
ttctttccaaaggt

SEQ ID NO: 644141 - DNA, 12 bp, Homo sapiens
ttctttccttcc

SEQ ID NO: 644142 - DNA, 14 bp, Homo sapiens
ttctttccttcctt

SEQ ID NO: 644143 - DNA, 15 bp, Homo sapiens
ttctttgttgcttaa

SEQ ID NO: 644144 - DNA, 14 bp, Homo sapiens
ttcttttcccattt

SEQ ID NO: 644145 - DNA, 21 bp, Homo sapiens
ttgaaactgtatttacttgtt

SEQ ID NO: 644146 - DNA, 20 bp, Homo sapiens
ttgaagagagatatatctga

SEQ ID NO: 644147 - DNA, 21 bp, Homo sapiens
ttgaagagagatatatctgaa

SEQ ID NO: 644148 - DNA, 16 bp, Homo sapiens
ttgaagctaaaacact

SEQ ID NO: 644149 - DNA, 14 bp, Homo sapiens
ttgaagggaaatca

SEQ ID NO: 644150 - DNA, 12 bp, Homo sapiens
ttgaatgataat

SEQ ID NO: 644151 - DNA, 17 bp, Homo sapiens
ttgaatgataatagctc

SEQ ID NO: 644152 - DNA, 18 bp, Homo sapiens
ttgaatgcttaaatgatc

SEQ ID NO: 644153 - DNA, 20 bp, Homo sapiens
ttgacaataagaaacagttt

SEQ ID NO: 644154 - DNA, 19 bp, Homo sapiens
ttgacaccaaatattttca

SEQ ID NO: 644155 - DNA, 12 bp, Homo sapiens
ttgacatccagc

SEQ ID NO: 644156 - DNA, 13 bp, Homo sapiens
ttgacatgtacag

SEQ ID NO: 644157 - DNA, 15 bp, Homo sapiens
ttgacattgtcagaa

SEQ ID NO: 644158 - DNA, 17 bp, Homo sapiens
ttgactattacactgcc

SEQ ID NO: 644159 - DNA, 16 bp, Homo sapiens
ttgactgcttctctgc

SEQ ID NO: 644160 - DNA, 23 bp, Homo sapiens
ttgagaatgagggcgtgaaacac

SEQ ID NO: 644161 - DNA, 13 bp, Homo sapiens
ttgagacactgtc

SEQ ID NO: 644162 - DNA, 23 bp, Homo sapiens
ttgagacactgtcaagattaagt

SEQ ID NO: 644163 - DNA, 15 bp, Homo sapiens
ttgagaccagcctgc

SEQ ID NO: 644164 - DNA, 18 bp, Homo sapiens
ttgagcaaggcaagaagt

SEQ ID NO: 644165 - DNA, 23 bp, Homo sapiens
ttgagcaaggcaagaagtgggat

SEQ ID NO: 644166 - DNA, 12 bp, Homo sapiens
ttgagcagctga

SEQ ID NO: 644167 - DNA, 20 bp, Homo sapiens
ttgagcatgcccaaatataa

SEQ ID NO: 644168 - DNA, 13 bp, Homo sapiens
ttgagccagcaga

SEQ ID NO: 644169 - DNA, 17 bp, Homo sapiens
ttgagccagcagacatt

SEQ ID NO: 644170 - DNA, 19 bp, Homo sapiens
ttgagccagcagacattgt

SEQ ID NO: 644171 - DNA, 20 bp, Homo sapiens
ttgagccagcagacattgtc

SEQ ID NO: 644172 - DNA, 13 bp, Homo sapiens
ttgagcctgtcac

SEQ ID NO: 644173 - DNA, 15 bp, Homo sapiens
ttgagtttgctgtat

SEQ ID NO: 644174 - DNA, 23 bp, Homo sapiens
ttgagtttgctgtatacaaacag

SEQ ID NO: 644175 - DNA, 15 bp, Homo sapiens
ttgatagtttacaaa

SEQ ID NO: 644176 - DNA, 21 bp, Homo sapiens
ttgatctcagcatcctggaaa

SEQ ID NO: 644177 - DNA, 19 bp, Homo sapiens
ttgatggctatgttttgga

SEQ ID NO: 644178 - DNA, 19 bp, Homo sapiens
ttgatgtttctatatgtaa

SEQ ID NO: 644179 - DNA, 22 bp, Homo sapiens
ttgatgtttctatatgtaactt

SEQ ID NO: 644180 - DNA, 17 bp, Homo sapiens
ttgattgtttgatgaat

SEQ ID NO: 644181 - DNA, 21 bp, Homo sapiens
ttgcaaccttgtactttacaa

SEQ ID NO: 644182 - DNA, 20 bp, Homo sapiens
ttgcacacacagtctgttca

SEQ ID NO: 644183 - DNA, 20 bp, Homo sapiens
ttgcactaaaagtgatgtga

SEQ ID NO: 644184 - DNA, 22 bp, Homo sapiens
ttgcactaaaagtgatgtgatt

SEQ ID NO: 644185 - DNA, 23 bp, Homo sapiens
ttgcacttcggataattttcatt

SEQ ID NO: 644186 - DNA, 14 bp, Homo sapiens
ttgcagcagtacca

SEQ ID NO: 644187 - DNA, 17 bp, Homo sapiens
ttgcagtcatcagaagt

SEQ ID NO: 644188 - DNA, 17 bp, Homo sapiens
ttgcataatatgcatat

SEQ ID NO: 644189 - DNA, 13 bp, Homo sapiens
ttgccaacattgc

SEQ ID NO: 644190 - DNA, 17 bp, Homo sapiens
ttgccagacagagatca

SEQ ID NO: 644191 - DNA, 14 bp, Homo sapiens
ttgccatccttgca

SEQ ID NO: 644192 - DNA, 23 bp, Homo sapiens
ttgccatccttgcacttctgtta

SEQ ID NO: 644193 - DNA, 19 bp, Homo sapiens
ttgccatgaggcctttccc

SEQ ID NO: 644194 - DNA, 14 bp, Homo sapiens
ttgccttctgggga

SEQ ID NO: 644195 - DNA, 17 bp, Homo sapiens
ttgcgaccatgtgtaga

SEQ ID NO: 644196 - DNA, 15 bp, Homo sapiens
ttgcgctctgggttt

SEQ ID NO: 644197 - DNA, 21 bp, Homo sapiens
ttgcggcaccgcccacccaca

SEQ ID NO: 644198 - DNA, 13 bp, Homo sapiens
ttgctaaagtcag

SEQ ID NO: 644199 - DNA, 19 bp, Homo sapiens
ttgctaagataattaaatg

SEQ ID NO: 644200 - DNA, 16 bp, Homo sapiens
ttgctaattaaaaagt

SEQ ID NO: 644201 - DNA, 14 bp, Homo sapiens
ttgctcagagctag

SEQ ID NO: 644202 - DNA, 18 bp, Homo sapiens
ttgctctctcattcccag

SEQ ID NO: 644203 - DNA, 14 bp, Homo sapiens
ttgctgaataacaa

SEQ ID NO: 644204 - DNA, 20 bp, Homo sapiens
ttgctgatggtgcaatgacc

SEQ ID NO: 644205 - DNA, 12 bp, Homo sapiens
ttgctgggccag

SEQ ID NO: 644206 - DNA, 23 bp, Homo sapiens
ttgctgtaaataaaaatagctat

SEQ ID NO: 644207 - DNA, 19 bp, Homo sapiens
tttaaaaaaataaaacatt

SEQ ID NO: 644208 - DNA, 20 bp, Homo sapiens
tttaaaaaaataaaacattt

SEQ ID NO: 644209 - DNA, 21 bp, Homo sapiens
tttaaaaaaataaaacatttt

SEQ ID NO: 644210 - DNA, 14 bp, Homo sapiens
tttaaaaaaataat

SEQ ID NO: 644211 - DNA, 19 bp, Homo sapiens
tttaaaaaaataatataaa

SEQ ID NO: 644212 - DNA, 23 bp, Homo sapiens
tttaaaaaaataatataaatgaa

SEQ ID NO: 644213 - DNA, 18 bp, Homo sapiens
tttaaaaaagatggattt

SEQ ID NO: 644214 - DNA, 17 bp, Homo sapiens
tttaaaaccacagctgg

SEQ ID NO: 644215 - DNA, 18 bp, Homo sapiens
tttaaacaaaatttatgt

SEQ ID NO: 644216 - DNA, 21 bp, Homo sapiens
tttaaagaagtccatgtgata

SEQ ID NO: 644217 - DNA, 20 bp, Homo sapiens
tttaaagcaactgtctattt

SEQ ID NO: 644218 - DNA, 23 bp, Homo sapiens
tttaaagcaactgtctatttctg

SEQ ID NO: 644219 - DNA, 23 bp, Homo sapiens
tttaaatctttgttaaaatatag

SEQ ID NO: 644220 - DNA, 18 bp, Homo sapiens
tttaaatgtctaatgtat

SEQ ID NO: 644221 - DNA, 17 bp, Homo sapiens
tttaacactgagtgaaa

SEQ ID NO: 644222 - DNA, 23 bp, Homo sapiens
tttaacattcttggtcacaaagc

SEQ ID NO: 644223 - DNA, 16 bp, Homo sapiens
tttaactagcacttta

SEQ ID NO: 644224 - DNA, 18 bp, Homo sapiens
tttaactagcactttata

SEQ ID NO: 644225 - DNA, 21 bp, Homo sapiens
tttaacttaatcaattaattt

SEQ ID NO: 644226 - DNA, 16 bp, Homo sapiens
tttaagaaatgagaaa

SEQ ID NO: 644227 - DNA, 17 bp, Homo sapiens
tttaagaaatgagaaat

SEQ ID NO: 644228 - DNA, 14 bp, Homo sapiens
tttaagagatttta

SEQ ID NO: 644229 - DNA, 16 bp, Homo sapiens
tttaagattgtacttt

SEQ ID NO: 644230 - DNA, 15 bp, Homo sapiens
tttaagtaatttcat

SEQ ID NO: 644231 - DNA, 19 bp, Homo sapiens
tttaagtgctatgcatatt

SEQ ID NO: 644232 - DNA, 17 bp, Homo sapiens
tttaagtggactgtatt

SEQ ID NO: 644233 - DNA, 19 bp, Homo sapiens
tttaagtgttctgtggctg

SEQ ID NO: 644234 - DNA, 18 bp, Homo sapiens
tttaataatatgtacaaa

SEQ ID NO: 644235 - DNA, 23 bp, Homo sapiens
tttaataatatgtacaaataata

SEQ ID NO: 644236 - DNA, 16 bp, Homo sapiens
tttaatatactcctta

SEQ ID NO: 644237 - DNA, 23 bp, Homo sapiens
tttacaaatgatttcgtgactgt

SEQ ID NO: 644238 - DNA, 18 bp, Homo sapiens
tttacatatagctttgca

SEQ ID NO: 644239 - DNA, 15 bp, Homo sapiens
tttaccatcaaacaa

SEQ ID NO: 644240 - DNA, 18 bp, Homo sapiens
tttactaacagtaactgc

SEQ ID NO: 644241 - DNA, 13 bp, Homo sapiens
tttactatgtaaa

SEQ ID NO: 644242 - DNA, 14 bp, Homo sapiens
tttactcaggcttt

SEQ ID NO: 644243 - DNA, 19 bp, Homo sapiens
tttactcaggctttctatt

SEQ ID NO: 644244 - DNA, 17 bp, Homo sapiens
tttagcacagtatttaa

SEQ ID NO: 644245 - DNA, 19 bp, Homo sapiens
tttagcacagtatttaaca

SEQ ID NO: 644246 - DNA, 17 bp, Homo sapiens
tttagcatgagttctgc

SEQ ID NO: 644247 - DNA, 15 bp, Homo sapiens
tttaggaatgctcaa

SEQ ID NO: 644248 - DNA, 16 bp, Homo sapiens
tttaggaatgctcaat

SEQ ID NO: 644249 - DNA, 16 bp, Homo sapiens
tttagtagctgataaa

SEQ ID NO: 644250 - DNA, 15 bp, Homo sapiens
tttataacattgtaa

SEQ ID NO: 644251 - DNA, 16 bp, Homo sapiens
tttatacacacaggag

SEQ ID NO: 644252 - DNA, 15 bp, Homo sapiens
tttatacttcaaatg

SEQ ID NO: 644253 - DNA, 15 bp, Homo sapiens
tttatatgattaaat

SEQ ID NO: 644254 - DNA, 19 bp, Homo sapiens
tttatatgattaaattatc

SEQ ID NO: 644255 - DNA, 23 bp, Homo sapiens
tttatctgtctgagccctgccct

SEQ ID NO: 644256 - DNA, 14 bp, Homo sapiens
tttatgaagatagt

SEQ ID NO: 644257 - DNA, 12 bp, Homo sapiens
tttatgatttca

SEQ ID NO: 644258 - DNA, 21 bp, Homo sapiens
tttatgcatgagaactaaata

SEQ ID NO: 644259 - DNA, 12 bp, Homo sapiens
tttatgtattct

SEQ ID NO: 644260 - DNA, 17 bp, Homo sapiens
tttatgtcattttcaga

SEQ ID NO: 644261 - DNA, 16 bp, Homo sapiens
tttatgtgatgtaact

SEQ ID NO: 644262 - DNA, 15 bp, Homo sapiens
tttatgtttaaaatg

SEQ ID NO: 644263 - DNA, 17 bp, Homo sapiens
tttattaaaaccattct

SEQ ID NO: 644264 - DNA, 12 bp, Homo sapiens
tttattaaatgt

SEQ ID NO: 644265 - DNA, 21 bp, Homo sapiens
tttattaaatttattaaatgt

SEQ ID NO: 644266 - DNA, 18 bp, Homo sapiens
tttattcattagctgtga

SEQ ID NO: 644267 - DNA, 23 bp, Homo sapiens
tttattgtttaaagcaactgtct

SEQ ID NO: 644268 - DNA, 15 bp, Homo sapiens
tttatttaaatgtct

SEQ ID NO: 644269 - DNA, 21 bp, Homo sapiens
tttatttaaatgtctaatgta

SEQ ID NO: 644270 - DNA, 14 bp, Homo sapiens
tttcaaccacacct

SEQ ID NO: 644271 - DNA, 22 bp, Homo sapiens
tttcaataggaaaaactgattt

SEQ ID NO: 644272 - DNA, 15 bp, Homo sapiens
tttcaatccacagta

SEQ ID NO: 644273 - DNA, 18 bp, Homo sapiens
tttcaatccacagtattg

SEQ ID NO: 644274 - DNA, 23 bp, Homo sapiens
tttcacagtgggcggcttccctg

SEQ ID NO: 644275 - DNA, 14 bp, Homo sapiens
tttcacatgaacat

SEQ ID NO: 644276 - DNA, 14 bp, Homo sapiens
tttcacattcctga

SEQ ID NO: 644277 - DNA, 18 bp, Homo sapiens
tttcacattcctgaccct

SEQ ID NO: 644278 - DNA, 14 bp, Homo sapiens
tttcactctccttg

SEQ ID NO: 644279 - DNA, 13 bp, Homo sapiens
tttcacttcttaa

SEQ ID NO: 644280 - DNA, 17 bp, Homo sapiens
tttcacttcttaaggac

SEQ ID NO: 644281 - DNA, 20 bp, Homo sapiens
tttcagaaagggcagcccct

SEQ ID NO: 644282 - DNA, 22 bp, Homo sapiens
tttcagaaagggcagcccctcc

SEQ ID NO: 644283 - DNA, 23 bp, Homo sapiens
tttcagaaagggcagcccctccc

SEQ ID NO: 644284 - DNA, 23 bp, Homo sapiens
tttcaggaaatttttgcatgttt

SEQ ID NO: 644285 - DNA, 17 bp, Homo sapiens
tttcagtgcctgctgtt

SEQ ID NO: 644286 - DNA, 22 bp, Homo sapiens
tttcagtggcacgtcatctagt

SEQ ID NO: 644287 - DNA, 19 bp, Homo sapiens
tttcagttataatttcaat

SEQ ID NO: 644288 - DNA, 22 bp, Homo sapiens
tttcatactctagattttgttt

SEQ ID NO: 644289 - DNA, 14 bp, Homo sapiens
tttcatgattagac

SEQ ID NO: 644290 - DNA, 15 bp, Homo sapiens
tttcatgattagaca

SEQ ID NO: 644291 - DNA, 21 bp, Homo sapiens
tttcatgattagacaatgtgg

SEQ ID NO: 644292 - DNA, 14 bp, Homo sapiens
tttcatggaatgca

SEQ ID NO: 644293 - DNA, 16 bp, Homo sapiens
tttcattatttcaagg

SEQ ID NO: 644294 - DNA, 24 bp, Homo sapiens
tttcattcgtgggcctgctgctct

SEQ ID NO: 644295 - DNA, 15 bp, Homo sapiens
tttcattctggtcct

SEQ ID NO: 644296 - DNA, 16 bp, Homo sapiens
tttcattctggtcctt

SEQ ID NO: 644297 - DNA, 12 bp, Homo sapiens
tttcattgtgtt

SEQ ID NO: 644298 - DNA, 15 bp, Homo sapiens
tttcattttcattat

SEQ ID NO: 644299 - DNA, 18 bp, Homo sapiens
tttccaaaggttgtacat

SEQ ID NO: 644300 - DNA, 22 bp, Homo sapiens
tttccatacgtgcccatttcac

SEQ ID NO: 644301 - DNA, 13 bp, Homo sapiens
tttcccacactgt

SEQ ID NO: 644302 - DNA, 20 bp, Homo sapiens
tttcccacactgtgaactaa

SEQ ID NO: 644303 - DNA, 13 bp, Homo sapiens
tttccctgaggaa

SEQ ID NO: 644304 - DNA, 16 bp, Homo sapiens
tttccctgaggaatga

SEQ ID NO: 644305 - DNA, 12 bp, Homo sapiens
tttccctgctga

SEQ ID NO: 644306 - DNA, 20 bp, Homo sapiens
tttccgtgagagtcatctca

SEQ ID NO: 644307 - DNA, 17 bp, Homo sapiens
tttcctctcctctctgg

SEQ ID NO: 644308 - DNA, 13 bp, Homo sapiens
tttcctctctctc

SEQ ID NO: 644309 - DNA, 14 bp, Homo sapiens
tttcctctctctct

SEQ ID NO: 644310 - DNA, 23 bp, Homo sapiens
tttcctctctctctctctctctg

SEQ ID NO: 644311 - DNA, 24 bp, Homo sapiens
tttcctcttaatgtctcaaaataa

SEQ ID NO: 644312 - DNA, 15 bp, Homo sapiens
tttccttcagtgcct

SEQ ID NO: 644313 - DNA, 18 bp, Homo sapiens
tttccttcagtgccttat

SEQ ID NO: 644314 - DNA, 22 bp, Homo sapiens
tttccttcagtgccttatggaa

SEQ ID NO: 644315 - DNA, 18 bp, Homo sapiens
tttccttttttatacaca

SEQ ID NO: 644316 - DNA, 18 bp, Homo sapiens
tttctaaaacattaattg

SEQ ID NO: 644317 - DNA, 22 bp, Homo sapiens
tttctagaaataaaatcaccct

SEQ ID NO: 644318 - DNA, 16 bp, Homo sapiens
tttctagcaattgctt

SEQ ID NO: 644319 - DNA, 19 bp, Homo sapiens
tttctcatttgaaatgttt

SEQ ID NO: 644320 - DNA, 19 bp, Homo sapiens
tttctccagcccatgctgg

SEQ ID NO: 644321 - DNA, 11 bp, Homo sapiens
tttctctctgt

SEQ ID NO: 644322 - DNA, 12 bp, Homo sapiens
tttctctctgtg

SEQ ID NO: 644323 - DNA, 20 bp, Homo sapiens
tttctgatacatctgtcagt

SEQ ID NO: 644324 - DNA, 17 bp, Homo sapiens
tttctgcactgagcaga

SEQ ID NO: 644325 - DNA, 20 bp, Homo sapiens
aaaatgaaatttaagcacaa

SEQ ID NO: 644326 - DNA, 12 bp, Homo sapiens
aaaatgcaaata

SEQ ID NO: 644327 - DNA, 15 bp, Homo sapiens
aaaatgcttgaccct

SEQ ID NO: 644328 - DNA, 22 bp, Homo sapiens
aaaatgctttctcatgcataga

SEQ ID NO: 644329 - DNA, 12 bp, Homo sapiens
aaaatggcattt

SEQ ID NO: 644330 - DNA, 15 bp, Homo sapiens
aaaatggcatttagc

SEQ ID NO: 644331 - DNA, 14 bp, Homo sapiens
aaaatggctgaaga

SEQ ID NO: 644332 - DNA, 21 bp, Homo sapiens
aaaatggctgaagaaacacag

SEQ ID NO: 644333 - DNA, 12 bp, Homo sapiens
aaaatgtatgtt

SEQ ID NO: 644334 - DNA, 18 bp, Homo sapiens
aaaatgtttatttttgct

SEQ ID NO: 644335 - DNA, 14 bp, Homo sapiens
aaaattattaaaaa

SEQ ID NO: 644336 - DNA, 18 bp, Homo sapiens
aaaattattaaaaattat

SEQ ID NO: 644337 - DNA, 16 bp, Homo sapiens
aaaattggttaatgaa

SEQ ID NO: 644338 - DNA, 12 bp, Homo sapiens
aaaatttaaaaa

SEQ ID NO: 644339 - DNA, 15 bp, Homo sapiens
aaaatttatgtcatt

SEQ ID NO: 644340 - DNA, 13 bp, Homo sapiens
aaaatttgacatt

SEQ ID NO: 644341 - DNA, 24 bp, Homo sapiens
aaaatttgacattgtcagaatgtt

SEQ ID NO: 644342 - DNA, 15 bp, Homo sapiens
aaaattttcttcttt

SEQ ID NO: 644343 - DNA, 12 bp, Homo sapiens
aaaatttttgtc

SEQ ID NO: 644344 - DNA, 14 bp, Homo sapiens
aaacaaaaactttc

SEQ ID NO: 644345 - DNA, 17 bp, Homo sapiens
aaacaaatcattttgat

SEQ ID NO: 644346 - DNA, 12 bp, Homo sapiens
aaacaacagcaa

SEQ ID NO: 644347 - DNA, 14 bp, Homo sapiens
aaacaacagcaaca

SEQ ID NO: 644348 - DNA, 17 bp, Homo sapiens
aaacaagagaccacttc

SEQ ID NO: 644349 - DNA, 23 bp, Homo sapiens
aaacacggagtttccatttggat

SEQ ID NO: 644350 - DNA, 18 bp, Homo sapiens
aaacactgagaaaaagca

SEQ ID NO: 644351 - DNA, 17 bp, Homo sapiens
aaacacttctccttaac

SEQ ID NO: 644352 - DNA, 15 bp, Homo sapiens
aaacagaaaaacaaa

SEQ ID NO: 644353 - DNA, 18 bp, Homo sapiens
aaacaggtgctaacactg

SEQ ID NO: 644354 - DNA, 22 bp, Homo sapiens
aaacagtgtggcttaaacattt

SEQ ID NO: 644355 - DNA, 14 bp, Homo sapiens
aaacagtttaacag

SEQ ID NO: 644356 - DNA, 16 bp, Homo sapiens
aaacatagtggtattt

SEQ ID NO: 644357 - DNA, 18 bp, Homo sapiens
aaacatagtggtatttta

SEQ ID NO: 644358 - DNA, 19 bp, Homo sapiens
aaacatagtggtattttaa

SEQ ID NO: 644359 - DNA, 21 bp, Homo sapiens
aaacatcagtcaattgcttga

SEQ ID NO: 644360 - DNA, 13 bp, Homo sapiens
aaacatctgattt

SEQ ID NO: 644361 - DNA, 14 bp, Homo sapiens
aaacatctgatttc

SEQ ID NO: 644362 - DNA, 18 bp, Homo sapiens
aaacatctgatttctgaa

SEQ ID NO: 644363 - DNA, 20 bp, Homo sapiens
aaacattatagattttcatg

SEQ ID NO: 644364 - DNA, 17 bp, Homo sapiens
aaacatttccctgctga

SEQ ID NO: 644365 - DNA, 15 bp, Homo sapiens
aaacattttaaatgg

SEQ ID NO: 644366 - DNA, 20 bp, Homo sapiens
aaaccaaataagcatctgtg

SEQ ID NO: 644367 - DNA, 17 bp, Homo sapiens
aaaccaatttgttctgt

SEQ ID NO: 644368 - DNA, 12 bp, Homo sapiens
aaaccacagctg

SEQ ID NO: 644369 - DNA, 14 bp, Homo sapiens
aaacccacataaac

SEQ ID NO: 644370 - DNA, 14 bp, Homo sapiens
aaacctactgccca

SEQ ID NO: 644371 - DNA, 18 bp, Homo sapiens
aaacctcagttggcctct

SEQ ID NO: 644372 - DNA, 20 bp, Homo sapiens
aaacctcagttggcctctgc

SEQ ID NO: 644373 - DNA, 23 bp, Homo sapiens
aaacctcagttggcctctgcccc

SEQ ID NO: 644374 - DNA, 14 bp, Homo sapiens
aaaccttttaaaaa

SEQ ID NO: 644375 - DNA, 23 bp, Homo sapiens
aaactaaatagcatgtattgtgt

SEQ ID NO: 644376 - DNA, 16 bp, Homo sapiens
aaactctccatgatta

SEQ ID NO: 644377 - DNA, 12 bp, Homo sapiens
aaactgaaatta

SEQ ID NO: 644378 - DNA, 17 bp, Homo sapiens
aaactgatgctttcaga

SEQ ID NO: 644379 - DNA, 20 bp, Homo sapiens
aaactgatttttttttcctt

SEQ ID NO: 644380 - DNA, 18 bp, Homo sapiens
aaactgcgtaggagagaa

SEQ ID NO: 644381 - DNA, 15 bp, Homo sapiens
aaactggaaacatct

SEQ ID NO: 644382 - DNA, 13 bp, Homo sapiens
aaactgtactgtg

SEQ ID NO: 644383 - DNA, 14 bp, Homo sapiens
aaactgtactgtgt

SEQ ID NO: 644384 - DNA, 12 bp, Homo sapiens
aaactgtattta

SEQ ID NO: 644385 - DNA, 14 bp, Homo sapiens
aaactgtgacattc

SEQ ID NO: 644386 - DNA, 19 bp, Homo sapiens
aaactgtgagataaatatc

SEQ ID NO: 644387 - DNA, 21 bp, Homo sapiens
aaacttggacatttatgtaca

SEQ ID NO: 644388 - DNA, 14 bp, Homo sapiens
aaactttccatgac

SEQ ID NO: 644389 - DNA, 14 bp, Homo sapiens
aaactttggaagtt

SEQ ID NO: 644390 - DNA, 20 bp, Homo sapiens
aaactttggaagttttactt

SEQ ID NO: 644391 - DNA, 17 bp, Homo sapiens
aaacttttataaatgtt

SEQ ID NO: 644392 - DNA, 22 bp, Homo sapiens
aaagaaattagggctctaattt

SEQ ID NO: 644393 - DNA, 15 bp, Homo sapiens
aaagaagtccatgtg

SEQ ID NO: 644394 - DNA, 22 bp, Homo sapiens
aaagaatcacctaattaatttc

SEQ ID NO: 644395 - DNA, 16 bp, Homo sapiens
aaagaccatgcattca

SEQ ID NO: 644396 - DNA, 23 bp, Homo sapiens
aaagaccatgcattcagatctga

SEQ ID NO: 644397 - DNA, 22 bp, Homo sapiens
aaagacccactgaatctgagaa

SEQ ID NO: 644398 - DNA, 20 bp, Homo sapiens
aaagatccagggatggagat

SEQ ID NO: 644399 - DNA, 14 bp, Homo sapiens
aaagatctcctgtg

SEQ ID NO: 644400 - DNA, 20 bp, Homo sapiens
aaagatggatttgacacact

SEQ ID NO: 644401 - DNA, 15 bp, Homo sapiens
aaagcacctcttgaa

SEQ ID NO: 644402 - DNA, 10 bp, Homo sapiens
aaagcagcaa

SEQ ID NO: 644403 - DNA, 13 bp, Homo sapiens
aaagcagtatgta

SEQ ID NO: 644404 - DNA, 13 bp, Homo sapiens
aaagcatgtacag

SEQ ID NO: 644405 - DNA, 16 bp, Homo sapiens
aaagcatgtacagtgt

SEQ ID NO: 644406 - DNA, 15 bp, Homo sapiens
aaagccctccctgtc

SEQ ID NO: 644407 - DNA, 18 bp, Homo sapiens
aaagccctccctgtctgt

SEQ ID NO: 644408 - DNA, 18 bp, Homo sapiens
aaagctagaggagattgc

SEQ ID NO: 644409 - DNA, 16 bp, Homo sapiens
aaaggcagagattggg

SEQ ID NO: 644410 - DNA, 22 bp, Homo sapiens
aaaggcagccctcacctctgag

SEQ ID NO: 644411 - DNA, 21 bp, Homo sapiens
aaaggctgcagctaatttgtg

SEQ ID NO: 644412 - DNA, 16 bp, Homo sapiens
aaaggcttcttggctt

SEQ ID NO: 644413 - DNA, 15 bp, Homo sapiens
aaagggattgaggag

SEQ ID NO: 644414 - DNA, 19 bp, Homo sapiens
aaagggcagcccctcccca

SEQ ID NO: 644415 - DNA, 21 bp, Homo sapiens
aaagggtggtagttttcccta

SEQ ID NO: 644416 - DNA, 22 bp, Homo sapiens
aaaggtgcctcatagcatagcc

SEQ ID NO: 644417 - DNA, 13 bp, Homo sapiens
aaaggtgctttct

SEQ ID NO: 644418 - DNA, 14 bp, Homo sapiens
aaagtactagcaat

SEQ ID NO: 644419 - DNA, 17 bp, Homo sapiens
aaagtcaggccattcag

SEQ ID NO: 644420 - DNA, 14 bp, Homo sapiens
aaagtctgagaaat

SEQ ID NO: 644421 - DNA, 18 bp, Homo sapiens
aaagtcttgaatgttgaa

SEQ ID NO: 644422 - DNA, 22 bp, Homo sapiens
aaagtgaaattagtattttgag

SEQ ID NO: 644423 - DNA, 10 bp, Homo sapiens
aaagtgtttt

SEQ ID NO: 644424 - DNA, 15 bp, Homo sapiens
aaagtgtttttacat

SEQ ID NO: 644425 - DNA, 20 bp, Homo sapiens
aaagttctattatctgggtt

SEQ ID NO: 644426 - DNA, 21 bp, Homo sapiens
aaagttctattatctgggttt

SEQ ID NO: 644427 - DNA, 15 bp, Homo sapiens
aaataaaacatttta

SEQ ID NO: 644428 - DNA, 22 bp, Homo sapiens
aaataaaaccagaaagaggaat

SEQ ID NO: 644429 - DNA, 14 bp, Homo sapiens
aaataaaagaaaga

SEQ ID NO: 644430 - DNA, 17 bp, Homo sapiens
aaataaatcatcctcat

SEQ ID NO: 644431 - DNA, 18 bp, Homo sapiens
aaataatataaatgaatg

SEQ ID NO: 644432 - DNA, 15 bp, Homo sapiens
aaataattaaaacaa

SEQ ID NO: 644433 - DNA, 13 bp, Homo sapiens
aaatacacataca

SEQ ID NO: 644434 - DNA, 16 bp, Homo sapiens
aaatacacatacatat

SEQ ID NO: 644435 - DNA, 18 bp, Homo sapiens
aaatacacatacatatat

SEQ ID NO: 644436 - DNA, 20 bp, Homo sapiens
aaatacacatacatatatac

SEQ ID NO: 644437 - DNA, 15 bp, Homo sapiens
aaatacacgtgtata

SEQ ID NO: 644438 - DNA, 17 bp, Homo sapiens
aaatacacgtgtatatg

SEQ ID NO: 644439 - DNA, 16 bp, Homo sapiens
aaatacctattcaaga

SEQ ID NO: 644440 - DNA, 13 bp, Homo sapiens
aaatacttgaaaa

SEQ ID NO: 644441 - DNA, 19 bp, Homo sapiens
aaatagaataggcaaactt

SEQ ID NO: 644442 - DNA, 16 bp, Homo sapiens
aaatagatttttagat

SEQ ID NO: 644443 - DNA, 21 bp, Homo sapiens
aagaaacacagcatgcattta

SEQ ID NO: 644444 - DNA, 13 bp, Homo sapiens
aagaaaggcagag

SEQ ID NO: 644445 - DNA, 23 bp, Homo sapiens
aagaaatagaataggcaaacttt

SEQ ID NO: 644446 - DNA, 17 bp, Homo sapiens
aagaaatagcagagcct

SEQ ID NO: 644447 - DNA, 13 bp, Homo sapiens
aagaaatgagaaa

SEQ ID NO: 644448 - DNA, 14 bp, Homo sapiens
aagaaatgagaaat

SEQ ID NO: 644449 - DNA, 15 bp, Homo sapiens
aagaaatgagaaatt

SEQ ID NO: 644450 - DNA, 21 bp, Homo sapiens
aagaaatgagaaattgtgcca

SEQ ID NO: 644451 - DNA, 22 bp, Homo sapiens
aagaaatgagaaattgtgccaa

SEQ ID NO: 644452 - DNA, 18 bp, Homo sapiens
aagaactgccccatctcc

SEQ ID NO: 644453 - DNA, 14 bp, Homo sapiens
aagaagatgtttaa

SEQ ID NO: 644454 - DNA, 16 bp, Homo sapiens
aagaagggccaccctg

SEQ ID NO: 644455 - DNA, 22 bp, Homo sapiens
aagaagggccaccctgagcaga

SEQ ID NO: 644456 - DNA, 17 bp, Homo sapiens
aagaagtccatgtgata

SEQ ID NO: 644457 - DNA, 11 bp, Homo sapiens
aagaattcagt

SEQ ID NO: 644458 - DNA, 14 bp, Homo sapiens
aagaattttaaaaa

SEQ ID NO: 644459 - DNA, 18 bp, Homo sapiens
aagacagccatacttcca

SEQ ID NO: 644460 - DNA, 16 bp, Homo sapiens
aagaccatgcattcag

SEQ ID NO: 644461 - DNA, 22 bp, Homo sapiens
aagaccatttagtcctcacctt

SEQ ID NO: 644462 - DNA, 19 bp, Homo sapiens
aagaccctatctcccacaa

SEQ ID NO: 644463 - DNA, 13 bp, Homo sapiens
aagacttcaaatg

SEQ ID NO: 644464 - DNA, 20 bp, Homo sapiens
aagacttcatttaacactga

SEQ ID NO: 644465 - DNA, 15 bp, Homo sapiens
aagagaaaaagccct

SEQ ID NO: 644466 - DNA, 17 bp, Homo sapiens
aagagaaaaagccctct

SEQ ID NO: 644467 - DNA, 18 bp, Homo sapiens
aagagaaaaagccctctt

SEQ ID NO: 644468 - DNA, 18 bp, Homo sapiens
aagagaaacactaatggc

SEQ ID NO: 644469 - DNA, 17 bp, Homo sapiens
aagagaccacttcctta

SEQ ID NO: 644470 - DNA, 19 bp, Homo sapiens
aagagaccacttccttaac

SEQ ID NO: 644471 - DNA, 19 bp, Homo sapiens
aagagattttatgtttaaa

SEQ ID NO: 644472 - DNA, 23 bp, Homo sapiens
aagagattttatgtttaaaatgg

SEQ ID NO: 644473 - DNA, 18 bp, Homo sapiens
aagagcctgactgtgttc

SEQ ID NO: 644474 - DNA, 15 bp, Homo sapiens
aagagctgctgtatt

SEQ ID NO: 644475 - DNA, 18 bp, Homo sapiens
aagagctgctgtatttga

SEQ ID NO: 644476 - DNA, 12 bp, Homo sapiens
aagagtggagga

SEQ ID NO: 644477 - DNA, 16 bp, Homo sapiens
aagagtggaggaggag

SEQ ID NO: 644478 - DNA, 15 bp, Homo sapiens
aagatagcagaagag

SEQ ID NO: 644479 - DNA, 21 bp, Homo sapiens
aagatagctccttcatgcttt

SEQ ID NO: 644480 - DNA, 13 bp, Homo sapiens
aagatagttgtaa

SEQ ID NO: 644481 - DNA, 12 bp, Homo sapiens
aagatctgactg

SEQ ID NO: 644482 - DNA, 18 bp, Homo sapiens
aagatgctgctgagcaca

SEQ ID NO: 644483 - DNA, 20 bp, Homo sapiens
aagatgctgctgagcacatc

SEQ ID NO: 644484 - DNA, 20 bp, Homo sapiens
aagattactagggttttgcc

SEQ ID NO: 644485 - DNA, 12 bp, Homo sapiens
aagattttcctt

SEQ ID NO: 644486 - DNA, 18 bp, Homo sapiens
aagattttccttttttat

SEQ ID NO: 644487 - DNA, 22 bp, Homo sapiens
aagcaaactgaaattagtgttt

SEQ ID NO: 644488 - DNA, 13 bp, Homo sapiens
aagcaaataaata

SEQ ID NO: 644489 - DNA, 16 bp, Homo sapiens
aagcaaataaatatca

SEQ ID NO: 644490 - DNA, 16 bp, Homo sapiens
aagcaactgtctattt

SEQ ID NO: 644491 - DNA, 17 bp, Homo sapiens
aagcaactgtctatttc

SEQ ID NO: 644492 - DNA, 20 bp, Homo sapiens
aagcacaaaaaatttaagag

SEQ ID NO: 644493 - DNA, 22 bp, Homo sapiens
aagcacacacatctggccctga

SEQ ID NO: 644494 - DNA, 12 bp, Homo sapiens
aagcagaatgag

SEQ ID NO: 644495 - DNA, 18 bp, Homo sapiens
aagcagacacacacatat

SEQ ID NO: 644496 - DNA, 19 bp, Homo sapiens
aagcagcagctagaaagag

SEQ ID NO: 644497 - DNA, 20 bp, Homo sapiens
aagcagccccctgtggcggc

SEQ ID NO: 644498 - DNA, 23 bp, Homo sapiens
aagcagtatatattctttcacaa

SEQ ID NO: 644499 - DNA, 16 bp, Homo sapiens
aagcatgccaatttct

SEQ ID NO: 644500 - DNA, 17 bp, Homo sapiens
aagcatgctcagtattg

SEQ ID NO: 644501 - DNA, 17 bp, Homo sapiens
aagcatgtacagtgttc

SEQ ID NO: 644502 - DNA, 18 bp, Homo sapiens
aagcatgtacagtgttct

SEQ ID NO: 644503 - DNA, 21 bp, Homo sapiens
aagcatgtacagtgttctgtt

SEQ ID NO: 644504 - DNA, 16 bp, Homo sapiens
aagcattaaaaataag

SEQ ID NO: 644505 - DNA, 11 bp, Homo sapiens
aagccaatttt

SEQ ID NO: 644506 - DNA, 18 bp, Homo sapiens
aagccaatttttctgcac

SEQ ID NO: 644507 - DNA, 17 bp, Homo sapiens
aagccagctctgagcag

SEQ ID NO: 644508 - DNA, 11 bp, Homo sapiens
aagccaggaga

SEQ ID NO: 644509 - DNA, 12 bp, Homo sapiens
aagccaggagac

SEQ ID NO: 644510 - DNA, 21 bp, Homo sapiens
aagccagggtcctgagtggct

SEQ ID NO: 644511 - DNA, 17 bp, Homo sapiens
aagccagggttccagac

SEQ ID NO: 644512 - DNA, 18 bp, Homo sapiens
aagccagggttccagaca

SEQ ID NO: 644513 - DNA, 19 bp, Homo sapiens
aagccatagccccaggccc

SEQ ID NO: 644514 - DNA, 13 bp, Homo sapiens
aagcccacccgcc

SEQ ID NO: 644515 - DNA, 22 bp, Homo sapiens
aagcccacccgccccagagact

SEQ ID NO: 644516 - DNA, 20 bp, Homo sapiens
aagcccagcctatctctctt

SEQ ID NO: 644517 - DNA, 12 bp, Homo sapiens
aagcccaggagg

SEQ ID NO: 644518 - DNA, 15 bp, Homo sapiens
aagcccaggaggacc

SEQ ID NO: 644519 - DNA, 13 bp, Homo sapiens
aagccccttggag

SEQ ID NO: 644520 - DNA, 14 bp, Homo sapiens
aagcctctggtgga

SEQ ID NO: 644521 - DNA, 23 bp, Homo sapiens
aagcctgactttggggacaccct

SEQ ID NO: 644522 - DNA, 14 bp, Homo sapiens
aagctaaaacactt

SEQ ID NO: 644523 - DNA, 19 bp, Homo sapiens
aagctaatgtggtagtgaa

SEQ ID NO: 644524 - DNA, 13 bp, Homo sapiens
aagctatttaagt

SEQ ID NO: 644525 - DNA, 15 bp, Homo sapiens
aagctcaaggctgca

SEQ ID NO: 644526 - DNA, 18 bp, Homo sapiens
aagctcatagcacatgtt

SEQ ID NO: 644527 - DNA, 18 bp, Homo sapiens
aagctgatgaagttaagc

SEQ ID NO: 644528 - DNA, 23 bp, Homo sapiens
aagctgatgaagttaagcacaac

SEQ ID NO: 644529 - DNA, 12 bp, Homo sapiens
aagctttctcct

SEQ ID NO: 644530 - DNA, 14 bp, Homo sapiens
aagctttggaagca

SEQ ID NO: 644531 - DNA, 17 bp, Homo sapiens
aagctttggaagcagca

SEQ ID NO: 644532 - DNA, 17 bp, Homo sapiens
aaggaaacaaagcaata

SEQ ID NO: 644533 - DNA, 17 bp, Homo sapiens
aaggacaacctgcccct

SEQ ID NO: 644534 - DNA, 13 bp, Homo sapiens
aaggacactgatg

SEQ ID NO: 644535 - DNA, 12 bp, Homo sapiens
aaggacagtgtt

SEQ ID NO: 644536 - DNA, 17 bp, Homo sapiens
aaggacagtgttcaaat

SEQ ID NO: 644537 - DNA, 23 bp, Homo sapiens
aaggactgaagaaaatccttcag

SEQ ID NO: 644538 - DNA, 14 bp, Homo sapiens
aaggacttggtgat

SEQ ID NO: 644539 - DNA, 21 bp, Homo sapiens
aaggagcactagaatgagaaa

SEQ ID NO: 644540 - DNA, 21 bp, Homo sapiens
aaggagctactgacattccta

SEQ ID NO: 644541 - DNA, 12 bp, Homo sapiens
aaggatcctgag

SEQ ID NO: 644542 - DNA, 20 bp, Homo sapiens
aaggatcctgagccagattt

SEQ ID NO: 644543 - DNA, 17 bp, Homo sapiens
aaggattcttttttcaa

SEQ ID NO: 644544 - DNA, 21 bp, Homo sapiens
aaggattcttttttcaatgta

SEQ ID NO: 644545 - DNA, 22 bp, Homo sapiens
aaggattcttttttcaatgtac

SEQ ID NO: 644546 - DNA, 19 bp, Homo sapiens
aaggcaaaaactgtactgt

SEQ ID NO: 644547 - DNA, 19 bp, Homo sapiens
aaggcactgtcaggaatgg

SEQ ID NO: 644548 - DNA, 17 bp, Homo sapiens
aaggcatcacagttcac

SEQ ID NO: 644549 - DNA, 16 bp, Homo sapiens
aaggcccagccctggg

SEQ ID NO: 644550 - DNA, 14 bp, Homo sapiens
aaggccgttaggga

SEQ ID NO: 644551 - DNA, 20 bp, Homo sapiens
aaggcctgccccccttccca

SEQ ID NO: 644552 - DNA, 21 bp, Homo sapiens
aaggcggagggtctccctggg

SEQ ID NO: 644553 - DNA, 22 bp, Homo sapiens
aaggcggagggtctccctgggc

SEQ ID NO: 644554 - DNA, 17 bp, Homo sapiens
aagggaaatcaatttaa

SEQ ID NO: 644555 - DNA, 16 bp, Homo sapiens
aagggagtgaaaacct

SEQ ID NO: 644556 - DNA, 23 bp, Homo sapiens
aagggattgaggagttgcctgac

SEQ ID NO: 644557 - DNA, 16 bp, Homo sapiens
aagggcacattgccca

SEQ ID NO: 644558 - DNA, 12 bp, Homo sapiens
aagggcagcccc

SEQ ID NO: 644559 - DNA, 14 bp, Homo sapiens
aagggcagcccctc

SEQ ID NO: 644560 - DNA, 14 bp, Homo sapiens
aattcttgcactgt

SEQ ID NO: 644561 - DNA, 19 bp, Homo sapiens
aattgaaccgtcaatgtga

SEQ ID NO: 644562 - DNA, 17 bp, Homo sapiens
aattgaggcttacagta

SEQ ID NO: 644563 - DNA, 21 bp, Homo sapiens
aattgatttttaaacagcagg

SEQ ID NO: 644564 - DNA, 22 bp, Homo sapiens
aattgcatgccatctccaccct

SEQ ID NO: 644565 - DNA, 14 bp, Homo sapiens
aattgctgagatgt

SEQ ID NO: 644566 - DNA, 14 bp, Homo sapiens
aattgcttctctaa

SEQ ID NO: 644567 - DNA, 15 bp, Homo sapiens
aattgcttctctaaa

SEQ ID NO: 644568 - DNA, 20 bp, Homo sapiens
aattgcttctctaaaacagc

SEQ ID NO: 644569 - DNA, 21 bp, Homo sapiens
aattgcttgagcatgcccaaa

SEQ ID NO: 644570 - DNA, 11 bp, Homo sapiens
aattggcagca

SEQ ID NO: 644571 - DNA, 22 bp, Homo sapiens
aattggcagcagattttaggaa

SEQ ID NO: 644572 - DNA, 23 bp, Homo sapiens
aattggcttgtttaaggttcttg

SEQ ID NO: 644573 - DNA, 14 bp, Homo sapiens
aattggttaatgaa

SEQ ID NO: 644574 - DNA, 17 bp, Homo sapiens
aattggttaatgaaaaa

SEQ ID NO: 644575 - DNA, 22 bp, Homo sapiens
aattggttaatgaaaaatctga

SEQ ID NO: 644576 - DNA, 14 bp, Homo sapiens
aattgtatatatat

SEQ ID NO: 644577 - DNA, 15 bp, Homo sapiens
aattgtatatatatg

SEQ ID NO: 644578 - DNA, 17 bp, Homo sapiens
aattgtatatatatgtg

SEQ ID NO: 644579 - DNA, 12 bp, Homo sapiens
aattgtgccaaa

SEQ ID NO: 644580 - DNA, 15 bp, Homo sapiens
aattgtgccaaagat

SEQ ID NO: 644581 - DNA, 17 bp, Homo sapiens
aattgtgccaaagatag

SEQ ID NO: 644582 - DNA, 22 bp, Homo sapiens
aattgttatgtaaacatcataa

SEQ ID NO: 644583 - DNA, 14 bp, Homo sapiens
aatttaagcacaaa

SEQ ID NO: 644584 - DNA, 18 bp, Homo sapiens
aatttaccacaggatgca

SEQ ID NO: 644585 - DNA, 16 bp, Homo sapiens
aatttactatgtaaat

SEQ ID NO: 644586 - DNA, 17 bp, Homo sapiens
aatttaggaatgctcaa

SEQ ID NO: 644587 - DNA, 22 bp, Homo sapiens
aatttatcattttagtatagtt

SEQ ID NO: 644588 - DNA, 19 bp, Homo sapiens
aatttatgtcattttcaga

SEQ ID NO: 644589 - DNA, 13 bp, Homo sapiens
aatttattcttat

SEQ ID NO: 644590 - DNA, 13 bp, Homo sapiens
aatttcaattttt

SEQ ID NO: 644591 - DNA, 20 bp, Homo sapiens
aatttcaatttttaaatttc

SEQ ID NO: 644592 - DNA, 21 bp, Homo sapiens
aatttcaatttttaaatttct

SEQ ID NO: 644593 - DNA, 16 bp, Homo sapiens
aatttcagtaagatca

SEQ ID NO: 644594 - DNA, 12 bp, Homo sapiens
aatttcctgctc

SEQ ID NO: 644595 - DNA, 23 bp, Homo sapiens
aatttctcttaagtactgaaata

SEQ ID NO: 644596 - DNA, 15 bp, Homo sapiens
aatttgacattgtca

SEQ ID NO: 644597 - DNA, 17 bp, Homo sapiens
aatttgacattgtcaga

SEQ ID NO: 644598 - DNA, 19 bp, Homo sapiens
aatttgacattgtcagaat

SEQ ID NO: 644599 - DNA, 21 bp, Homo sapiens
aatttgacattgtcagaatgt

SEQ ID NO: 644600 - DNA, 19 bp, Homo sapiens
aatttgacttggcataatt

SEQ ID NO: 644601 - DNA, 20 bp, Homo sapiens
aatttgataatcagtttcca

SEQ ID NO: 644602 - DNA, 23 bp, Homo sapiens
aatttgataatcagtttccacta

SEQ ID NO: 644603 - DNA, 14 bp, Homo sapiens
aatttgtgaaagtg

SEQ ID NO: 644604 - DNA, 12 bp, Homo sapiens
aatttgttctgt

SEQ ID NO: 644605 - DNA, 17 bp, Homo sapiens
aattttaggaaagttgt

SEQ ID NO: 644606 - DNA, 14 bp, Homo sapiens
aattttcacatgaa

SEQ ID NO: 644607 - DNA, 16 bp, Homo sapiens
aattttcacatgaaca

SEQ ID NO: 644608 - DNA, 21 bp, Homo sapiens
aattttcacatgaacatactg

SEQ ID NO: 644609 - DNA, 14 bp, Homo sapiens
aattttcattttca

SEQ ID NO: 644610 - DNA, 14 bp, Homo sapiens
aattttcattttta

SEQ ID NO: 644611 - DNA, 12 bp, Homo sapiens
aattttcttctt

SEQ ID NO: 644612 - DNA, 14 bp, Homo sapiens
aattttcttcttta

SEQ ID NO: 644613 - DNA, 14 bp, Homo sapiens
aattttggaagaat

SEQ ID NO: 644614 - DNA, 18 bp, Homo sapiens
aattttggaagaattcat

SEQ ID NO: 644615 - DNA, 17 bp, Homo sapiens
aatttttactcaggctt

SEQ ID NO: 644616 - DNA, 22 bp, Homo sapiens
aatttttactcaggctttctat

SEQ ID NO: 644617 - DNA, 13 bp, Homo sapiens
aatttttattcat

SEQ ID NO: 644618 - DNA, 16 bp, Homo sapiens
aatttttattcataag

SEQ ID NO: 644619 - DNA, 12 bp, Homo sapiens
aatttttctgca

SEQ ID NO: 644620 - DNA, 22 bp, Homo sapiens
aatttttctgttggtcttaact

SEQ ID NO: 644621 - DNA, 14 bp, Homo sapiens
aatttttgcatgtt

SEQ ID NO: 644622 - DNA, 16 bp, Homo sapiens
aatttttgcatgttta

SEQ ID NO: 644623 - DNA, 17 bp, Homo sapiens
aatttttgtaagaaaat

SEQ ID NO: 644624 - DNA, 17 bp, Homo sapiens
acaaaaactttccatga

SEQ ID NO: 644625 - DNA, 17 bp, Homo sapiens
acaaaacaacagcaaca

SEQ ID NO: 644626 - DNA, 18 bp, Homo sapiens
acaaaacaacagcaacaa

SEQ ID NO: 644627 - DNA, 21 bp, Homo sapiens
acaaaacaacagcaacaacaa

SEQ ID NO: 644628 - DNA, 21 bp, Homo sapiens
acaaaaggctggatgtgcttt

SEQ ID NO: 644629 - DNA, 23 bp, Homo sapiens
acaaaagggctctataatgatta

SEQ ID NO: 644630 - DNA, 23 bp, Homo sapiens
acaaaatgtgtgcttggaaaatg

SEQ ID NO: 644631 - DNA, 12 bp, Homo sapiens
acaaaatttatg

SEQ ID NO: 644632 - DNA, 22 bp, Homo sapiens
acaaaatttatgtcattttcag

SEQ ID NO: 644633 - DNA, 19 bp, Homo sapiens
acaaaccagcaacttttct

SEQ ID NO: 644634 - DNA, 23 bp, Homo sapiens
acaaacctactgcccacatttgg

SEQ ID NO: 644635 - DNA, 14 bp, Homo sapiens
acaaagcatgctca

SEQ ID NO: 644636 - DNA, 20 bp, Homo sapiens
acaaagcatgctcagtattg

SEQ ID NO: 644637 - DNA, 21 bp, Homo sapiens
acaaagcatgctcagtattga

SEQ ID NO: 644638 - DNA, 15 bp, Homo sapiens
acaaagctatttaag

SEQ ID NO: 644639 - DNA, 14 bp, Homo sapiens
acaaagctgtcact

SEQ ID NO: 644640 - DNA, 14 bp, Homo sapiens
acaaagtgaaatta

SEQ ID NO: 644641 - DNA, 19 bp, Homo sapiens
acaaagtttacattgtcct

SEQ ID NO: 644642 - DNA, 18 bp, Homo sapiens
acaaagtttggaagtaca

SEQ ID NO: 644643 - DNA, 23 bp, Homo sapiens
acaaataagttcccatttccttg

SEQ ID NO: 644644 - DNA, 15 bp, Homo sapiens
acaaataatattgcc

SEQ ID NO: 644645 - DNA, 18 bp, Homo sapiens
acaaataatattgccttg

SEQ ID NO: 644646 - DNA, 12 bp, Homo sapiens
acaaatacacat

SEQ ID NO: 644647 - DNA, 20 bp, Homo sapiens
acaaatacacatacatatat

SEQ ID NO: 644648 - DNA, 20 bp, Homo sapiens
acaaatatgattctcctctc

SEQ ID NO: 644649 - DNA, 21 bp, Homo sapiens
acaaatatgattctcctctcc

SEQ ID NO: 644650 - DNA, 14 bp, Homo sapiens
acaaatcattttga

SEQ ID NO: 644651 - DNA, 15 bp, Homo sapiens
acaaatcattttgat

SEQ ID NO: 644652 - DNA, 22 bp, Homo sapiens
acaaatggcttgttcagtcact

SEQ ID NO: 644653 - DNA, 21 bp, Homo sapiens
acaaattcagtggacatttgt

SEQ ID NO: 644654 - DNA, 14 bp, Homo sapiens
acaaattccttccc

SEQ ID NO: 644655 - DNA, 17 bp, Homo sapiens
acaaatttttactcagg

SEQ ID NO: 644656 - DNA, 15 bp, Homo sapiens
acaacaaagcatgct

SEQ ID NO: 644657 - DNA, 19 bp, Homo sapiens
acaacaaagcatgctcagt

SEQ ID NO: 644658 - DNA, 23 bp, Homo sapiens
acaacaaagcatgctcagtattg

SEQ ID NO: 644659 - DNA, 21 bp, Homo sapiens
acaacaagcaaactgaaatta

SEQ ID NO: 644660 - DNA, 22 bp, Homo sapiens
acaacaatttaggaatgctcaa

SEQ ID NO: 644661 - DNA, 14 bp, Homo sapiens
acaacacacacaca

SEQ ID NO: 644662 - DNA, 23 bp, Homo sapiens
acaacacacacacacacaaaaca

SEQ ID NO: 644663 - DNA, 14 bp, Homo sapiens
acaacagcaacaac

SEQ ID NO: 644664 - DNA, 15 bp, Homo sapiens
acaaccacatttctg

SEQ ID NO: 644665 - DNA, 16 bp, Homo sapiens
acaaccatgttcttga

SEQ ID NO: 644666 - DNA, 15 bp, Homo sapiens
acaacctgcccctcc

SEQ ID NO: 644667 - DNA, 22 bp, Homo sapiens
acaactgtggataaattttgga

SEQ ID NO: 644668 - DNA, 17 bp, Homo sapiens
acaagagaccacttcct

SEQ ID NO: 644669 - DNA, 17 bp, Homo sapiens
acaagcaaactgaaatt

SEQ ID NO: 644670 - DNA, 18 bp, Homo sapiens
acaagcaaactgaaatta

SEQ ID NO: 644671 - DNA, 14 bp, Homo sapiens
acaagcagacacac

SEQ ID NO: 644672 - DNA, 20 bp, Homo sapiens
acaagcagacacacacatat

SEQ ID NO: 644673 - DNA, 23 bp, Homo sapiens
acaaggcatccatactgtttaat

SEQ ID NO: 644674 - DNA, 11 bp, Homo sapiens
acaaggcccag

SEQ ID NO: 644675 - DNA, 12 bp, Homo sapiens
acaaggcccagc

SEQ ID NO: 644676 - DNA, 14 bp, Homo sapiens
acgatttaatttat

SEQ ID NO: 644677 - DNA, 22 bp, Homo sapiens
acgcaattgtatatatatgtga

SEQ ID NO: 644678 - DNA, 23 bp, Homo sapiens
acgcaattgtatatatatgtgaa

SEQ ID NO: 644679 - DNA, 16 bp, Homo sapiens
acgcagagccccggag

SEQ ID NO: 644680 - DNA, 17 bp, Homo sapiens
acgcagagccccggagc

SEQ ID NO: 644681 - DNA, 20 bp, Homo sapiens
acgcagagccccggagcacc

SEQ ID NO: 644682 - DNA, 21 bp, Homo sapiens
acgcagagccccggagcacca

SEQ ID NO: 644683 - DNA, 15 bp, Homo sapiens
acgcatgcagggccc

SEQ ID NO: 644684 - DNA, 12 bp, Homo sapiens
acgcccagcccc

SEQ ID NO: 644685 - DNA, 18 bp, Homo sapiens
acgccccccggcctgatg

SEQ ID NO: 644686 - DNA, 14 bp, Homo sapiens
acgcccctccccag

SEQ ID NO: 644687 - DNA, 18 bp, Homo sapiens
acgcccctccccagcccc

SEQ ID NO: 644688 - DNA, 13 bp, Homo sapiens
acgcccctgcctg

SEQ ID NO: 644689 - DNA, 18 bp, Homo sapiens
acgccgatataagccata

SEQ ID NO: 644690 - DNA, 23 bp, Homo sapiens
acgccgatataagccatagcccc

SEQ ID NO: 644691 - DNA, 15 bp, Homo sapiens
acgccggggctggcc

SEQ ID NO: 644692 - DNA, 19 bp, Homo sapiens
acgccggggctggccctgc

SEQ ID NO: 644693 - DNA, 19 bp, Homo sapiens
acgctggagaccctgcgcc

SEQ ID NO: 644694 - DNA, 11 bp, Homo sapiens
acgctggctcg

SEQ ID NO: 644695 - DNA, 16 bp, Homo sapiens
acgcttgacagttact

SEQ ID NO: 644696 - DNA, 18 bp, Homo sapiens
acggaggcaggaccaggc

SEQ ID NO: 644697 - DNA, 18 bp, Homo sapiens
acggagtttccatttgga

SEQ ID NO: 644698 - DNA, 17 bp, Homo sapiens
acggcagcttgagcctg

SEQ ID NO: 644699 - DNA, 23 bp, Homo sapiens
acggcctgagaggagcgtgtcct

SEQ ID NO: 644700 - DNA, 14 bp, Homo sapiens
acgggacagcggcc

SEQ ID NO: 644701 - DNA, 21 bp, Homo sapiens
acgggagagcgccacccgccc

SEQ ID NO: 644702 - DNA, 12 bp, Homo sapiens
acgggcctcccc

SEQ ID NO: 644703 - DNA, 14 bp, Homo sapiens
acggggcagagctg

SEQ ID NO: 644704 - DNA, 12 bp, Homo sapiens
acgggtctgtgg

SEQ ID NO: 644705 - DNA, 17 bp, Homo sapiens
acggtccaatccagcct

SEQ ID NO: 644706 - DNA, 18 bp, Homo sapiens
acggtccaatccagcctt

SEQ ID NO: 644707 - DNA, 14 bp, Homo sapiens
acgtatatttttaa

SEQ ID NO: 644708 - DNA, 18 bp, Homo sapiens
acgtctgtgagtctgtcc

SEQ ID NO: 644709 - DNA, 17 bp, Homo sapiens
acgtgaagataccataa

SEQ ID NO: 644710 - DNA, 19 bp, Homo sapiens
acgtgaggcccctgtgcag

SEQ ID NO: 644711 - DNA, 16 bp, Homo sapiens
acgtgcagcacctgtc

SEQ ID NO: 644712 - DNA, 15 bp, Homo sapiens
acgtgcccatttcac

SEQ ID NO: 644713 - DNA, 17 bp, Homo sapiens
acgtgcccatttcacac

SEQ ID NO: 644714 - DNA, 13 bp, Homo sapiens
acgtggctgcttc

SEQ ID NO: 644715 - DNA, 15 bp, Homo sapiens
acgtggctgcttcaa

SEQ ID NO: 644716 - DNA, 21 bp, Homo sapiens
acgtggctgcttcaaggatcc

SEQ ID NO: 644717 - DNA, 23 bp, Homo sapiens
acgtgtatatgaggatgtatgtg

SEQ ID NO: 644718 - DNA, 12 bp, Homo sapiens
acgttcatgttc

SEQ ID NO: 644719 - DNA, 14 bp, Homo sapiens
acgttcatgttcat

SEQ ID NO: 644720 - DNA, 20 bp, Homo sapiens
acgttgatagtttacaaaca

SEQ ID NO: 644721 - DNA, 17 bp, Homo sapiens
actaaatagatttttag

SEQ ID NO: 644722 - DNA, 18 bp, Homo sapiens
actaaatagcatgtattg

SEQ ID NO: 644723 - DNA, 12 bp, Homo sapiens
actaacactatt

SEQ ID NO: 644724 - DNA, 15 bp, Homo sapiens
actaacagtaactgc

SEQ ID NO: 644725 - DNA, 18 bp, Homo sapiens
actaagctttctcctttg

SEQ ID NO: 644726 - DNA, 15 bp, Homo sapiens
actaattaaactgat

SEQ ID NO: 644727 - DNA, 21 bp, Homo sapiens
actacagaagtggaaggataa

SEQ ID NO: 644728 - DNA, 15 bp, Homo sapiens
actacaggttttatg

SEQ ID NO: 644729 - DNA, 16 bp, Homo sapiens
actacaggttttatga

SEQ ID NO: 644730 - DNA, 14 bp, Homo sapiens
actacatctgatat

SEQ ID NO: 644731 - DNA, 17 bp, Homo sapiens
actacatgggccagccc

SEQ ID NO: 644732 - DNA, 16 bp, Homo sapiens
actactcctagactga

SEQ ID NO: 644733 - DNA, 15 bp, Homo sapiens
actagaatgagaaat

SEQ ID NO: 644734 - DNA, 17 bp, Homo sapiens
actagaatgagaaatca

SEQ ID NO: 644735 - DNA, 13 bp, Homo sapiens
actagcaataagt

SEQ ID NO: 644736 - DNA, 14 bp, Homo sapiens
actagcaataagtt

SEQ ID NO: 644737 - DNA, 15 bp, Homo sapiens
actagcaataagttg

SEQ ID NO: 644738 - DNA, 19 bp, Homo sapiens
actagcaataagttgaatg

SEQ ID NO: 644739 - DNA, 20 bp, Homo sapiens
actagcaataagttgaatga

SEQ ID NO: 644740 - DNA, 12 bp, Homo sapiens
actagccctctt

SEQ ID NO: 644741 - DNA, 17 bp, Homo sapiens
actagccctctttctct

SEQ ID NO: 644742 - DNA, 21 bp, Homo sapiens
actagccctctttctctctgt

SEQ ID NO: 644743 - DNA, 13 bp, Homo sapiens
actagtaatcttg

SEQ ID NO: 644744 - DNA, 14 bp, Homo sapiens
actataattgagaa

SEQ ID NO: 644745 - DNA, 18 bp, Homo sapiens
actatattgcgagaaaca

SEQ ID NO: 644746 - DNA, 18 bp, Homo sapiens
actatctttcaggaaatt

SEQ ID NO: 644747 - DNA, 22 bp, Homo sapiens
actatggtatatattttgaaag

SEQ ID NO: 644748 - DNA, 19 bp, Homo sapiens
actcaaagaggccagtact

SEQ ID NO: 644749 - DNA, 17 bp, Homo sapiens
actcaccatttaatcat

SEQ ID NO: 644750 - DNA, 19 bp, Homo sapiens
actcagaaacagaagaaaa

SEQ ID NO: 644751 - DNA, 18 bp, Homo sapiens
actcagctgtctgtggct

SEQ ID NO: 644752 - DNA, 15 bp, Homo sapiens
actcaggagcacagc

SEQ ID NO: 644753 - DNA, 16 bp, Homo sapiens
actcaggagcacagcc

SEQ ID NO: 644754 - DNA, 16 bp, Homo sapiens
actcaggcagtgcagt

SEQ ID NO: 644755 - DNA, 20 bp, Homo sapiens
actcagtaacacagtgcagt

SEQ ID NO: 644756 - DNA, 14 bp, Homo sapiens
actcagtcaaatgt

SEQ ID NO: 644757 - DNA, 20 bp, Homo sapiens
actcagttaggcagtgcagt

SEQ ID NO: 644758 - DNA, 20 bp, Homo sapiens
actcatcccccatcagatga

SEQ ID NO: 644759 - DNA, 20 bp, Homo sapiens
actcatttgggtattttgtc

SEQ ID NO: 644760 - DNA, 18 bp, Homo sapiens
actccaaggagctactga

SEQ ID NO: 644761 - DNA, 13 bp, Homo sapiens
actccactcccct

SEQ ID NO: 644762 - DNA, 13 bp, Homo sapiens
actccagaagcag

SEQ ID NO: 644763 - DNA, 20 bp, Homo sapiens
actccagggttaaagaaagg

SEQ ID NO: 644764 - DNA, 22 bp, Homo sapiens
actccagtggggcaagattttc

SEQ ID NO: 644765 - DNA, 17 bp, Homo sapiens
actccatggtgaactga

SEQ ID NO: 644766 - DNA, 19 bp, Homo sapiens
actccatggtgaactgaag

SEQ ID NO: 644767 - DNA, 12 bp, Homo sapiens
actcccagggcc

SEQ ID NO: 644768 - DNA, 19 bp, Homo sapiens
actcctcccaactctggcc

SEQ ID NO: 644769 - DNA, 20 bp, Homo sapiens
actcctcctgctcctcaccc

SEQ ID NO: 644770 - DNA, 14 bp, Homo sapiens
actccttaaaaatg

SEQ ID NO: 644771 - DNA, 17 bp, Homo sapiens
actccttaaaaatgtat

SEQ ID NO: 644772 - DNA, 19 bp, Homo sapiens
actccttaaccacctagtc

SEQ ID NO: 644773 - DNA, 19 bp, Homo sapiens
actcgagagggctgagccc

SEQ ID NO: 644774 - DNA, 17 bp, Homo sapiens
actcgattttaccatat

SEQ ID NO: 644775 - DNA, 22 bp, Homo sapiens
actcgcctgggaaattgctcca

SEQ ID NO: 644776 - DNA, 17 bp, Homo sapiens
actcgcgacaatgcaaa

SEQ ID NO: 644777 - DNA, 17 bp, Homo sapiens
actcgcttgtgcagaaa

SEQ ID NO: 644778 - DNA, 23 bp, Homo sapiens
actctaagaaatggctttccaca

SEQ ID NO: 644779 - DNA, 14 bp, Homo sapiens
actctagattttgt

SEQ ID NO: 644780 - DNA, 20 bp, Homo sapiens
actctagattttgttttgct

SEQ ID NO: 644781 - DNA, 16 bp, Homo sapiens
actctccttggtgtcg

SEQ ID NO: 644782 - DNA, 20 bp, Homo sapiens
actctctactacacaggcct

SEQ ID NO: 644783 - DNA, 19 bp, Homo sapiens
actctctcctctctctccc

SEQ ID NO: 644784 - DNA, 20 bp, Homo sapiens
actctctcctctctctccct

SEQ ID NO: 644785 - DNA, 23 bp, Homo sapiens
actctctcctctctctccctcca

SEQ ID NO: 644786 - DNA, 18 bp, Homo sapiens
actctgaagtcccttcct

SEQ ID NO: 644787 - DNA, 23 bp, Homo sapiens
actctgaagtcccttcctgtcct

SEQ ID NO: 644788 - DNA, 17 bp, Homo sapiens
actctgagtcctcattg

SEQ ID NO: 644789 - DNA, 23 bp, Homo sapiens
actctgcctgtcaagtttttata

SEQ ID NO: 644790 - DNA, 21 bp, Homo sapiens
actctggccttggttcctcca

SEQ ID NO: 644791 - DNA, 22 bp, Homo sapiens
actctggccttggttcctccag

SEQ ID NO: 644792 - DNA, 18 bp, Homo sapiens
agactctgtgagattcta

SEQ ID NO: 644793 - DNA, 22 bp, Homo sapiens
agactgcccaccctgggcctcc

SEQ ID NO: 644794 - DNA, 23 bp, Homo sapiens
agacttcctattaatttattaaa

SEQ ID NO: 644795 - DNA, 16 bp, Homo sapiens
agagaaaaagccctct

SEQ ID NO: 644796 - DNA, 17 bp, Homo sapiens
agagaaaaagccctctt

SEQ ID NO: 644797 - DNA, 16 bp, Homo sapiens
agagaaaatgctttct

SEQ ID NO: 644798 - DNA, 14 bp, Homo sapiens
agagaaaggagggc

SEQ ID NO: 644799 - DNA, 16 bp, Homo sapiens
agagaactaacactat

SEQ ID NO: 644800 - DNA, 14 bp, Homo sapiens
agagaagcacccca

SEQ ID NO: 644801 - DNA, 14 bp, Homo sapiens
agagacggcagccc

SEQ ID NO: 644802 - DNA, 19 bp, Homo sapiens
agagacggcagccccatcc

SEQ ID NO: 644803 - DNA, 15 bp, Homo sapiens
agagactcgcctggg

SEQ ID NO: 644804 - DNA, 13 bp, Homo sapiens
agagactgcccac

SEQ ID NO: 644805 - DNA, 19 bp, Homo sapiens
agagactgcccaccctggg

SEQ ID NO: 644806 - DNA, 18 bp, Homo sapiens
agagactggttttttcca

SEQ ID NO: 644807 - DNA, 18 bp, Homo sapiens
agagagaggctgcctcag

SEQ ID NO: 644808 - DNA, 22 bp, Homo sapiens
agagagatatatctgaaaactg

SEQ ID NO: 644809 - DNA, 21 bp, Homo sapiens
agagagcaatcttgctgtgaa

SEQ ID NO: 644810 - DNA, 17 bp, Homo sapiens
agagagcggcttcccca

SEQ ID NO: 644811 - DNA, 18 bp, Homo sapiens
agagaggacagtttagga

SEQ ID NO: 644812 - DNA, 22 bp, Homo sapiens
agagagtatggtgctgggtcct

SEQ ID NO: 644813 - DNA, 15 bp, Homo sapiens
agagatatatctgaa

SEQ ID NO: 644814 - DNA, 16 bp, Homo sapiens
agagatatatctgaaa

SEQ ID NO: 644815 - DNA, 19 bp, Homo sapiens
agagatatatctgaaaact

SEQ ID NO: 644816 - DNA, 16 bp, Homo sapiens
agagcaatcttgctgt

SEQ ID NO: 644817 - DNA, 19 bp, Homo sapiens
agagcaatcttgctgtgaa

SEQ ID NO: 644818 - DNA, 17 bp, Homo sapiens
agagcactgtatacccc

SEQ ID NO: 644819 - DNA, 13 bp, Homo sapiens
agagcagcaggtg

SEQ ID NO: 644820 - DNA, 16 bp, Homo sapiens
agagcagcaggtgctg

SEQ ID NO: 644821 - DNA, 16 bp, Homo sapiens
agagcagcctcttgaa

SEQ ID NO: 644822 - DNA, 16 bp, Homo sapiens
agagcattctggggtg

SEQ ID NO: 644823 - DNA, 22 bp, Homo sapiens
agagccaagctaatgtggtagt

SEQ ID NO: 644824 - DNA, 14 bp, Homo sapiens
agagccacaataag

SEQ ID NO: 644825 - DNA, 23 bp, Homo sapiens
agagccctctgctgctttccaac

SEQ ID NO: 644826 - DNA, 14 bp, Homo sapiens
agagccctgcagtc

SEQ ID NO: 644827 - DNA, 21 bp, Homo sapiens
agagcctatggaaagggtgtg

SEQ ID NO: 644828 - DNA, 14 bp, Homo sapiens
agagctatgcacac

SEQ ID NO: 644829 - DNA, 20 bp, Homo sapiens
agagctatgcacaccaaatt

SEQ ID NO: 644830 - DNA, 18 bp, Homo sapiens
agagctcaggagaaggcc

SEQ ID NO: 644831 - DNA, 20 bp, Homo sapiens
agagctcaggagaaggcctg

SEQ ID NO: 644832 - DNA, 20 bp, Homo sapiens
agagctgagtcggctgggca

SEQ ID NO: 644833 - DNA, 21 bp, Homo sapiens
agagctgagtcggctgggcag

SEQ ID NO: 644834 - DNA, 11 bp, Homo sapiens
agaggaaatca

SEQ ID NO: 644835 - DNA, 18 bp, Homo sapiens
agaggagcaaacaggaaa

SEQ ID NO: 644836 - DNA, 15 bp, Homo sapiens
agaggagcgtgtcct

SEQ ID NO: 644837 - DNA, 18 bp, Homo sapiens
agaggaggtgtggagtgg

SEQ ID NO: 644838 - DNA, 15 bp, Homo sapiens
agaggatttctgctt

SEQ ID NO: 644839 - DNA, 14 bp, Homo sapiens
agaggcagggccct

SEQ ID NO: 644840 - DNA, 21 bp, Homo sapiens
agaggccggggtccaggcccg

SEQ ID NO: 644841 - DNA, 12 bp, Homo sapiens
agaggctgcctc

SEQ ID NO: 644842 - DNA, 14 bp, Homo sapiens
agaggctgcctcag

SEQ ID NO: 644843 - DNA, 17 bp, Homo sapiens
agagggctgagcccctc

SEQ ID NO: 644844 - DNA, 18 bp, Homo sapiens
agagggctgagcccctcc

SEQ ID NO: 644845 - DNA, 20 bp, Homo sapiens
agagtagaactttaaaagaa

SEQ ID NO: 644846 - DNA, 17 bp, Homo sapiens
agagtatacaagtgttt

SEQ ID NO: 644847 - DNA, 15 bp, Homo sapiens
agagtcaagctgatg

SEQ ID NO: 644848 - DNA, 21 bp, Homo sapiens
agagtcgagtgatatggcttg

SEQ ID NO: 644849 - DNA, 23 bp, Homo sapiens
agagtggaggaggaggaggagcc

SEQ ID NO: 644850 - DNA, 23 bp, Homo sapiens
agagtggcaggtgggctgcctgc

SEQ ID NO: 644851 - DNA, 18 bp, Homo sapiens
agataagtgctcagtatt

SEQ ID NO: 644852 - DNA, 15 bp, Homo sapiens
agataattaaatgaa

SEQ ID NO: 644853 - DNA, 18 bp, Homo sapiens
agataattaaatgaaata

SEQ ID NO: 644854 - DNA, 20 bp, Homo sapiens
agataattaaatgaaatact

SEQ ID NO: 644855 - DNA, 13 bp, Homo sapiens
agatacacaaaat

SEQ ID NO: 644856 - DNA, 22 bp, Homo sapiens
agataccctctgagacagagag

SEQ ID NO: 644857 - DNA, 13 bp, Homo sapiens
agatagttgtaaa

SEQ ID NO: 644858 - DNA, 22 bp, Homo sapiens
agatcaagaatcttttgtgaaa

SEQ ID NO: 644859 - DNA, 19 bp, Homo sapiens
agatcacaccaatttagaa

SEQ ID NO: 644860 - DNA, 16 bp, Homo sapiens
agatcattttttgtct

SEQ ID NO: 644861 - DNA, 17 bp, Homo sapiens
agatcccagagttattt

SEQ ID NO: 644862 - DNA, 19 bp, Homo sapiens
agatccctcggtcagcacc

SEQ ID NO: 644863 - DNA, 13 bp, Homo sapiens
agatctgactgcc

SEQ ID NO: 644864 - DNA, 14 bp, Homo sapiens
agatctgactgcca

SEQ ID NO: 644865 - DNA, 17 bp, Homo sapiens
agatcttgagcaaggca

SEQ ID NO: 644866 - DNA, 19 bp, Homo sapiens
agatgaaaaagcatgtaca

SEQ ID NO: 644867 - DNA, 18 bp, Homo sapiens
agatgacccccaggtatt

SEQ ID NO: 644868 - DNA, 15 bp, Homo sapiens
agatgacctcgttcc

SEQ ID NO: 644869 - DNA, 13 bp, Homo sapiens
agatgactggaaa

SEQ ID NO: 644870 - DNA, 17 bp, Homo sapiens
agatgatttaattctta

SEQ ID NO: 644871 - DNA, 18 bp, Homo sapiens
agatgatttaattcttac

SEQ ID NO: 644872 - DNA, 18 bp, Homo sapiens
agatggggcctgggctgt

SEQ ID NO: 644873 - DNA, 18 bp, Homo sapiens
agatggtgtcctgcatgt

SEQ ID NO: 644874 - DNA, 20 bp, Homo sapiens
agattaagttataccagcaa

SEQ ID NO: 644875 - DNA, 23 bp, Homo sapiens
agattaagttataccagcaaaag

SEQ ID NO: 644876 - DNA, 20 bp, Homo sapiens
agattaataacagaaataca

SEQ ID NO: 644877 - DNA, 17 bp, Homo sapiens
agattatatacaaagct

SEQ ID NO: 644878 - DNA, 16 bp, Homo sapiens
agattattttctatat

SEQ ID NO: 644879 - DNA, 17 bp, Homo sapiens
agattgacttcagaaac

SEQ ID NO: 644880 - DNA, 15 bp, Homo sapiens
agattgtaaaggtag

SEQ ID NO: 644881 - DNA, 13 bp, Homo sapiens
agatttcactctc

SEQ ID NO: 644882 - DNA, 14 bp, Homo sapiens
agatttcactctcc

SEQ ID NO: 644883 - DNA, 18 bp, Homo sapiens
agatttggagactttgtt

SEQ ID NO: 644884 - DNA, 23 bp, Homo sapiens
agatttggagactttgttcctta

SEQ ID NO: 644885 - DNA, 14 bp, Homo sapiens
agattttatgttta

SEQ ID NO: 644886 - DNA, 11 bp, Homo sapiens
agattttcctt

SEQ ID NO: 644887 - DNA, 20 bp, Homo sapiens
agattttccttttttataca

SEQ ID NO: 644888 - DNA, 16 bp, Homo sapiens
agattttgttttgctt

SEQ ID NO: 644889 - DNA, 17 bp, Homo sapiens
agattttgttttgcttt

SEQ ID NO: 644890 - DNA, 21 bp, Homo sapiens
agattttgttttgctttttct

SEQ ID NO: 644891 - DNA, 24 bp, Homo sapiens
agattttgttttgctttttctgac

SEQ ID NO: 644892 - DNA, 21 bp, Homo sapiens
agcaaactgaaattagtgttt

SEQ ID NO: 644893 - DNA, 16 bp, Homo sapiens
agcaaattaattggca

SEQ ID NO: 644894 - DNA, 19 bp, Homo sapiens
agcaaattaattggcagca

SEQ ID NO: 644895 - DNA, 21 bp, Homo sapiens
agcaaatttctagatatgaga

SEQ ID NO: 644896 - DNA, 22 bp, Homo sapiens
agcaacccaggtgttgtccgtg

SEQ ID NO: 644897 - DNA, 21 bp, Homo sapiens
agcaacgggaacacctgctga

SEQ ID NO: 644898 - DNA, 13 bp, Homo sapiens
agcaactgtctat

SEQ ID NO: 644899 - DNA, 14 bp, Homo sapiens
agcaatcttgctgt

SEQ ID NO: 644900 - DNA, 15 bp, Homo sapiens
agcaatcttgctgtg

SEQ ID NO: 644901 - DNA, 19 bp, Homo sapiens
agcaatcttgctgtgaaac

SEQ ID NO: 644902 - DNA, 14 bp, Homo sapiens
agcaatgcctgcct

SEQ ID NO: 644903 - DNA, 19 bp, Homo sapiens
agcacaaccatgttcttga

SEQ ID NO: 644904 - DNA, 20 bp, Homo sapiens
agcacaagggcacattgccc

SEQ ID NO: 644905 - DNA, 19 bp, Homo sapiens
agcacacacaaacctactg

SEQ ID NO: 644906 - DNA, 23 bp, Homo sapiens
agcacacacaaacctactgccca

SEQ ID NO: 644907 - DNA, 20 bp, Homo sapiens
agcacacacatctggccctg

SEQ ID NO: 644908 - DNA, 20 bp, Homo sapiens
aggccgactgggctgctggg

SEQ ID NO: 644909 - DNA, 16 bp, Homo sapiens
aggccggggtccaggc

SEQ ID NO: 644910 - DNA, 17 bp, Homo sapiens
aggcctgagggaagccc

SEQ ID NO: 644911 - DNA, 19 bp, Homo sapiens
aggcctgagggaagcccac

SEQ ID NO: 644912 - DNA, 20 bp, Homo sapiens
aggcctgagggaagcccacc

SEQ ID NO: 644913 - DNA, 22 bp, Homo sapiens
aggcctgagggaagcccacccg

SEQ ID NO: 644914 - DNA, 17 bp, Homo sapiens
aggcctgagttagctgt

SEQ ID NO: 644915 - DNA, 18 bp, Homo sapiens
aggcctgagttagctgtt

SEQ ID NO: 644916 - DNA, 20 bp, Homo sapiens
aggcctgagttagctgttta

SEQ ID NO: 644917 - DNA, 19 bp, Homo sapiens
aggcctgccccccttccca

SEQ ID NO: 644918 - DNA, 12 bp, Homo sapiens
aggcctggtctg

SEQ ID NO: 644919 - DNA, 17 bp, Homo sapiens
aggcgcccacctgccca

SEQ ID NO: 644920 - DNA, 19 bp, Homo sapiens
aggcgcccacctgcccagt

SEQ ID NO: 644921 - DNA, 16 bp, Homo sapiens
aggcgccgcctcgccc

SEQ ID NO: 644922 - DNA, 19 bp, Homo sapiens
aggcgcgcaccgcccaacc

SEQ ID NO: 644923 - DNA, 19 bp, Homo sapiens
aggcggagggtctccctgg

SEQ ID NO: 644924 - DNA, 24 bp, Homo sapiens
aggcggcacattggcagtgtgtca

SEQ ID NO: 644925 - DNA, 18 bp, Homo sapiens
aggcgtgggatccagaga

SEQ ID NO: 644926 - DNA, 22 bp, Homo sapiens
aggcgtgggatccagagagaag

SEQ ID NO: 644927 - DNA, 14 bp, Homo sapiens
aggctactgccact

SEQ ID NO: 644928 - DNA, 18 bp, Homo sapiens
aggctcccactgcccctg

SEQ ID NO: 644929 - DNA, 17 bp, Homo sapiens
aggctgcagtgagccaa

SEQ ID NO: 644930 - DNA, 12 bp, Homo sapiens
aggctgcctcag

SEQ ID NO: 644931 - DNA, 15 bp, Homo sapiens
aggctgcctcagcca

SEQ ID NO: 644932 - DNA, 14 bp, Homo sapiens
aggctgcgcctgcc

SEQ ID NO: 644933 - DNA, 13 bp, Homo sapiens
aggctgctgcccc

SEQ ID NO: 644934 - DNA, 19 bp, Homo sapiens
aggctgctgtgtagctctg

SEQ ID NO: 644935 - DNA, 16 bp, Homo sapiens
aggctggatgtgcttt

SEQ ID NO: 644936 - DNA, 18 bp, Homo sapiens
aggctggatgtgctttca

SEQ ID NO: 644937 - DNA, 21 bp, Homo sapiens
aggcttgtgtaatttcctgct

SEQ ID NO: 644938 - DNA, 23 bp, Homo sapiens
aggctttctattggcatggattt

SEQ ID NO: 644939 - DNA, 15 bp, Homo sapiens
agggaaaccttggag

SEQ ID NO: 644940 - DNA, 19 bp, Homo sapiens
agggaaaccttggagagga

SEQ ID NO: 644941 - DNA, 14 bp, Homo sapiens
agggaaatcaattt

SEQ ID NO: 644942 - DNA, 15 bp, Homo sapiens
agggaaatcaattta

SEQ ID NO: 644943 - DNA, 22 bp, Homo sapiens
agggaaatcaatttaaaggaaa

SEQ ID NO: 644944 - DNA, 16 bp, Homo sapiens
agggaaatccaactcc

SEQ ID NO: 644945 - DNA, 15 bp, Homo sapiens
agggaaccagagcga

SEQ ID NO: 644946 - DNA, 15 bp, Homo sapiens
agggaagcccacccg

SEQ ID NO: 644947 - DNA, 18 bp, Homo sapiens
agggaagcccacccgccc

SEQ ID NO: 644948 - DNA, 22 bp, Homo sapiens
agggaagcccacccgccccaga

SEQ ID NO: 644949 - DNA, 14 bp, Homo sapiens
agggaaggctgctg

SEQ ID NO: 644950 - DNA, 15 bp, Homo sapiens
agggaagggtgcctg

SEQ ID NO: 644951 - DNA, 20 bp, Homo sapiens
agggaatccatatcagctct

SEQ ID NO: 644952 - DNA, 18 bp, Homo sapiens
agggacacagaggacagc

SEQ ID NO: 644953 - DNA, 17 bp, Homo sapiens
agggacactacaaacat

SEQ ID NO: 644954 - DNA, 19 bp, Homo sapiens
agggacgactttctttaac

SEQ ID NO: 644955 - DNA, 21 bp, Homo sapiens
agggactccagaagcagcagc

SEQ ID NO: 644956 - DNA, 14 bp, Homo sapiens
agggagaaaggcaa

SEQ ID NO: 644957 - DNA, 12 bp, Homo sapiens
agggagaaggat

SEQ ID NO: 644958 - DNA, 15 bp, Homo sapiens
agggagggggctggg

SEQ ID NO: 644959 - DNA, 18 bp, Homo sapiens
agggaggtggcagggaag

SEQ ID NO: 644960 - DNA, 19 bp, Homo sapiens
agggatggagatgggaagg

SEQ ID NO: 644961 - DNA, 22 bp, Homo sapiens
agggattgaggagttgcctgac

SEQ ID NO: 644962 - DNA, 21 bp, Homo sapiens
agggcacattgcccatggctg

SEQ ID NO: 644963 - DNA, 23 bp, Homo sapiens
agggcagaggaatgtagggcctg

SEQ ID NO: 644964 - DNA, 13 bp, Homo sapiens
agggcagcccctc

SEQ ID NO: 644965 - DNA, 19 bp, Homo sapiens
agggcagggttctagaagg

SEQ ID NO: 644966 - DNA, 19 bp, Homo sapiens
agggccagtcatggctgtc

SEQ ID NO: 644967 - DNA, 24 bp, Homo sapiens
agggccagtcatggctgtcccctg

SEQ ID NO: 644968 - DNA, 19 bp, Homo sapiens
agggcccagggaggtggca

SEQ ID NO: 644969 - DNA, 19 bp, Homo sapiens
agggcccgagcgcgtgcct

SEQ ID NO: 644970 - DNA, 22 bp, Homo sapiens
agggccgccgaagggcagcccc

SEQ ID NO: 644971 - DNA, 23 bp, Homo sapiens
agggcctgcatggagaagggttc

SEQ ID NO: 644972 - DNA, 20 bp, Homo sapiens
agggcgctccggcagaggca

SEQ ID NO: 644973 - DNA, 17 bp, Homo sapiens
agggcggcggggcctgg

SEQ ID NO: 644974 - DNA, 13 bp, Homo sapiens
agggcgtcctctc

SEQ ID NO: 644975 - DNA, 12 bp, Homo sapiens
agggctgagccc

SEQ ID NO: 644976 - DNA, 18 bp, Homo sapiens
agggctgagcccctcctc

SEQ ID NO: 644977 - DNA, 21 bp, Homo sapiens
agggctggtgtggctgctccc

SEQ ID NO: 644978 - DNA, 12 bp, Homo sapiens
aggggaggctga

SEQ ID NO: 644979 - DNA, 19 bp, Homo sapiens
aggggcaaaaatttgacat

SEQ ID NO: 644980 - DNA, 19 bp, Homo sapiens
aggggcaaagaactgcccc

SEQ ID NO: 644981 - DNA, 14 bp, Homo sapiens
aggggcaggcagct

SEQ ID NO: 644982 - DNA, 22 bp, Homo sapiens
aggggcgcgcgcccccaggacc

SEQ ID NO: 644983 - DNA, 14 bp, Homo sapiens
aggggcttctcccc

SEQ ID NO: 644984 - DNA, 16 bp, Homo sapiens
aggggcttggagcaga

SEQ ID NO: 644985 - DNA, 19 bp, Homo sapiens
aggggcttggagcagagac

SEQ ID NO: 644986 - DNA, 20 bp, Homo sapiens
agggggatgcccctggccct

SEQ ID NO: 644987 - DNA, 20 bp, Homo sapiens
agggggctgggaaagaactt

SEQ ID NO: 644988 - DNA, 19 bp, Homo sapiens
aggggggttgggttccaga

SEQ ID NO: 644989 - DNA, 17 bp, Homo sapiens
aggggtgggggagaatg

SEQ ID NO: 644990 - DNA, 16 bp, Homo sapiens
aggggtgttaaaacat

SEQ ID NO: 644991 - DNA, 13 bp, Homo sapiens
agggtccagccct

SEQ ID NO: 644992 - DNA, 13 bp, Homo sapiens
agggtcccctgca

SEQ ID NO: 644993 - DNA, 18 bp, Homo sapiens
agggtcctgggggctgct

SEQ ID NO: 644994 - DNA, 13 bp, Homo sapiens
agggtctccctgg

SEQ ID NO: 644995 - DNA, 16 bp, Homo sapiens
agggtctccctgggca

SEQ ID NO: 644996 - DNA, 13 bp, Homo sapiens
agggtgcccctgg

SEQ ID NO: 644997 - DNA, 12 bp, Homo sapiens
agggtgcctggc

SEQ ID NO: 644998 - DNA, 13 bp, Homo sapiens
agggtgcctggct

SEQ ID NO: 644999 - DNA, 17 bp, Homo sapiens
agggtgcctggctgggc

SEQ ID NO: 645000 - DNA, 18 bp, Homo sapiens
agggtgcctggctgggct

SEQ ID NO: 645001 - DNA, 14 bp, Homo sapiens
agggtgggaagaga

SEQ ID NO: 645002 - DNA, 12 bp, Homo sapiens
agggtgggcgtg

SEQ ID NO: 645003 - DNA, 19 bp, Homo sapiens
agggtgtgggtgccctgtt

SEQ ID NO: 645004 - DNA, 15 bp, Homo sapiens
agggttaaagaaagg

SEQ ID NO: 645005 - DNA, 16 bp, Homo sapiens
agggttaaagaaaggc

SEQ ID NO: 645006 - DNA, 15 bp, Homo sapiens
agggttctagaaggg

SEQ ID NO: 645007 - DNA, 19 bp, Homo sapiens
agggttctatatttactgt

SEQ ID NO: 645008 - DNA, 18 bp, Homo sapiens
agggttctgccctgcctg

SEQ ID NO: 645009 - DNA, 19 bp, Homo sapiens
agggttgtgattttgtctg

SEQ ID NO: 645010 - DNA, 15 bp, Homo sapiens
agggttttttagaaa

SEQ ID NO: 645011 - DNA, 16 bp, Homo sapiens
aggtaaactgatgctt

SEQ ID NO: 645012 - DNA, 16 bp, Homo sapiens
aggtaaataatcatac

SEQ ID NO: 645013 - DNA, 17 bp, Homo sapiens
aggtagtgggtgaatgt

SEQ ID NO: 645014 - DNA, 20 bp, Homo sapiens
aggtccaccccgttgttgtc

SEQ ID NO: 645015 - DNA, 23 bp, Homo sapiens
aggtctggcgccaggggcaggca

SEQ ID NO: 645016 - DNA, 13 bp, Homo sapiens
aggtgcccagtct

SEQ ID NO: 645017 - DNA, 18 bp, Homo sapiens
aggtgcccagtcttgagt

SEQ ID NO: 645018 - DNA, 22 bp, Homo sapiens
aggtgcccagtcttgagtgggc

SEQ ID NO: 645019 - DNA, 16 bp, Homo sapiens
aggtgccctttctctt

SEQ ID NO: 645020 - DNA, 18 bp, Homo sapiens
aggtgcggaccggagcgg

SEQ ID NO: 645021 - DNA, 22 bp, Homo sapiens
aggtgcggaccggagcggctga

SEQ ID NO: 645022 - DNA, 13 bp, Homo sapiens
aggtgctttctcc

SEQ ID NO: 645023 - DNA, 16 bp, Homo sapiens
aggtggcatttgcagg

SEQ ID NO: 645024 - DNA, 23 bp, Homo sapiens
ataacaggcattgcactaaaagt

SEQ ID NO: 645025 - DNA, 12 bp, Homo sapiens
ataacatgaaag

SEQ ID NO: 645026 - DNA, 13 bp, Homo sapiens
ataacattgtaaa

SEQ ID NO: 645027 - DNA, 17 bp, Homo sapiens
ataacattgtaaatgat

SEQ ID NO: 645028 - DNA, 13 bp, Homo sapiens
ataacattgtatg

SEQ ID NO: 645029 - DNA, 23 bp, Homo sapiens
ataactctgtacgaggcttctct

SEQ ID NO: 645030 - DNA, 14 bp, Homo sapiens
ataagaaacagttt

SEQ ID NO: 645031 - DNA, 14 bp, Homo sapiens
ataagaagcaaata

SEQ ID NO: 645032 - DNA, 18 bp, Homo sapiens
ataagacaagtctgagta

SEQ ID NO: 645033 - DNA, 15 bp, Homo sapiens
ataagagacaaagtt

SEQ ID NO: 645034 - DNA, 16 bp, Homo sapiens
ataagattatatacaa

SEQ ID NO: 645035 - DNA, 22 bp, Homo sapiens
ataagccaatttttctgcactg

SEQ ID NO: 645036 - DNA, 15 bp, Homo sapiens
ataagccatggtgaa

SEQ ID NO: 645037 - DNA, 14 bp, Homo sapiens
ataagtagaattct

SEQ ID NO: 645038 - DNA, 22 bp, Homo sapiens
ataagtagtgtcattcatatga

SEQ ID NO: 645039 - DNA, 13 bp, Homo sapiens
ataagtgctcagt

SEQ ID NO: 645040 - DNA, 15 bp, Homo sapiens
ataagtgctcagtat

SEQ ID NO: 645041 - DNA, 23 bp, Homo sapiens
ataataaattaatttttcaattt

SEQ ID NO: 645042 - DNA, 15 bp, Homo sapiens
ataatacttcataca

SEQ ID NO: 645043 - DNA, 17 bp, Homo sapiens
ataatagatgtgaaaat

SEQ ID NO: 645044 - DNA, 21 bp, Homo sapiens
ataatattgccttgatgtttc

SEQ ID NO: 645045 - DNA, 22 bp, Homo sapiens
ataatattgccttgatgtttct

SEQ ID NO: 645046 - DNA, 15 bp, Homo sapiens
ataatcaaaataata

SEQ ID NO: 645047 - DNA, 15 bp, Homo sapiens
ataatgatactgaat

SEQ ID NO: 645048 - DNA, 20 bp, Homo sapiens
ataatgattaggagagctgt

SEQ ID NO: 645049 - DNA, 18 bp, Homo sapiens
ataatgattcaatgtgaa

SEQ ID NO: 645050 - DNA, 17 bp, Homo sapiens
ataatgcttaacataaa

SEQ ID NO: 645051 - DNA, 12 bp, Homo sapiens
ataattaaaaca

SEQ ID NO: 645052 - DNA, 21 bp, Homo sapiens
ataattaaaacaaaatccttg

SEQ ID NO: 645053 - DNA, 13 bp, Homo sapiens
ataattaaagtgt

SEQ ID NO: 645054 - DNA, 19 bp, Homo sapiens
ataattcgagcaaacaact

SEQ ID NO: 645055 - DNA, 16 bp, Homo sapiens
ataattgtaaaggtga

SEQ ID NO: 645056 - DNA, 20 bp, Homo sapiens
ataattgtaaaggtgatgaa

SEQ ID NO: 645057 - DNA, 16 bp, Homo sapiens
ataatttcaattttta

SEQ ID NO: 645058 - DNA, 11 bp, Homo sapiens
ataattttcat

SEQ ID NO: 645059 - DNA, 13 bp, Homo sapiens
atacaaagctgtc

SEQ ID NO: 645060 - DNA, 15 bp, Homo sapiens
atacaagtgtttcta

SEQ ID NO: 645061 - DNA, 12 bp, Homo sapiens
atacacacagga

SEQ ID NO: 645062 - DNA, 10 bp, Homo sapiens
atacacataa

SEQ ID NO: 645063 - DNA, 12 bp, Homo sapiens
atacacataatt

SEQ ID NO: 645064 - DNA, 13 bp, Homo sapiens
atacacatacata

SEQ ID NO: 645065 - DNA, 19 bp, Homo sapiens
atacacatacatatataca

SEQ ID NO: 645066 - DNA, 20 bp, Homo sapiens
atacagcatttctttggaaa

SEQ ID NO: 645067 - DNA, 17 bp, Homo sapiens
atacagtcctagagaat

SEQ ID NO: 645068 - DNA, 20 bp, Homo sapiens
atacagtctctatttgattt

SEQ ID NO: 645069 - DNA, 20 bp, Homo sapiens
atacatacgcaattgtatat

SEQ ID NO: 645070 - DNA, 20 bp, Homo sapiens
atacatcattttttgtttct

SEQ ID NO: 645071 - DNA, 16 bp, Homo sapiens
atacatgatgatttca

SEQ ID NO: 645072 - DNA, 19 bp, Homo sapiens
atacatgatgatttcagaa

SEQ ID NO: 645073 - DNA, 13 bp, Homo sapiens
atacattttgcag

SEQ ID NO: 645074 - DNA, 23 bp, Homo sapiens
ataccaagcccctagtcttagag

SEQ ID NO: 645075 - DNA, 11 bp, Homo sapiens
ataccaagtgt

SEQ ID NO: 645076 - DNA, 14 bp, Homo sapiens
ataccattttgaaa

SEQ ID NO: 645077 - DNA, 17 bp, Homo sapiens
ataccattttgaaatat

SEQ ID NO: 645078 - DNA, 16 bp, Homo sapiens
ataccctaggtctcca

SEQ ID NO: 645079 - DNA, 19 bp, Homo sapiens
ataccctaggtctccaccc

SEQ ID NO: 645080 - DNA, 21 bp, Homo sapiens
ataccctaggtctccacccct

SEQ ID NO: 645081 - DNA, 23 bp, Homo sapiens
ataccctaggtctccacccctca

SEQ ID NO: 645082 - DNA, 16 bp, Homo sapiens
atacctgtacacacac

SEQ ID NO: 645083 - DNA, 19 bp, Homo sapiens
atacctgtacacacacaga

SEQ ID NO: 645084 - DNA, 20 bp, Homo sapiens
atacctgtacacacacagac

SEQ ID NO: 645085 - DNA, 23 bp, Homo sapiens
atacctgtacacacacagacaca

SEQ ID NO: 645086 - DNA, 19 bp, Homo sapiens
atacgcaattgtatatata

SEQ ID NO: 645087 - DNA, 21 bp, Homo sapiens
atacgcaattgtatatatatg

SEQ ID NO: 645088 - DNA, 20 bp, Homo sapiens
atacgggggttccctttccc

SEQ ID NO: 645089 - DNA, 21 bp, Homo sapiens
atacgggggttccctttcccc

SEQ ID NO: 645090 - DNA, 19 bp, Homo sapiens
atacgtatatttttaactg

SEQ ID NO: 645091 - DNA, 20 bp, Homo sapiens
atacgtgcccatttcacaca

SEQ ID NO: 645092 - DNA, 14 bp, Homo sapiens
atacgttttctgca

SEQ ID NO: 645093 - DNA, 23 bp, Homo sapiens
atactaacgaccgacgcccctcc

SEQ ID NO: 645094 - DNA, 22 bp, Homo sapiens
atactcaaagaggccagtactt

SEQ ID NO: 645095 - DNA, 23 bp, Homo sapiens
atactcatttggatataaatctt

SEQ ID NO: 645096 - DNA, 16 bp, Homo sapiens
atactccttaaaaatg

SEQ ID NO: 645097 - DNA, 17 bp, Homo sapiens
atactccttaaaaatgt

SEQ ID NO: 645098 - DNA, 22 bp, Homo sapiens
atactccttaaaaatgtatgtt

SEQ ID NO: 645099 - DNA, 15 bp, Homo sapiens
atactctagattttg

SEQ ID NO: 645100 - DNA, 21 bp, Homo sapiens
atactctagattttgttttgc

SEQ ID NO: 645101 - DNA, 13 bp, Homo sapiens
atactgatgagac

SEQ ID NO: 645102 - DNA, 20 bp, Homo sapiens
atactgatgagacaacacac

SEQ ID NO: 645103 - DNA, 21 bp, Homo sapiens
atactgatgagacaacacaca

SEQ ID NO: 645104 - DNA, 22 bp, Homo sapiens
atactgatgagacaacacacac

SEQ ID NO: 645105 - DNA, 13 bp, Homo sapiens
atacttcaagtaa

SEQ ID NO: 645106 - DNA, 14 bp, Homo sapiens
atacttggtcctta

SEQ ID NO: 645107 - DNA, 14 bp, Homo sapiens
atactttgtgtctt

SEQ ID NO: 645108 - DNA, 23 bp, Homo sapiens
atactttgtgtcttttgttctct

SEQ ID NO: 645109 - DNA, 22 bp, Homo sapiens
atagacagaggtttcattttca

SEQ ID NO: 645110 - DNA, 23 bp, Homo sapiens
atagacagaggtttcattttcat

SEQ ID NO: 645111 - DNA, 19 bp, Homo sapiens
atagacgcaaccttaactt

SEQ ID NO: 645112 - DNA, 17 bp, Homo sapiens
atagagacttctaaatc

SEQ ID NO: 645113 - DNA, 17 bp, Homo sapiens
atagataccattttgaa

SEQ ID NO: 645114 - DNA, 20 bp, Homo sapiens
atagatcccacgttgatgtc

SEQ ID NO: 645115 - DNA, 21 bp, Homo sapiens
atagatcccacgttgatgtct

SEQ ID NO: 645116 - DNA, 18 bp, Homo sapiens
atagatgacccccaggta

SEQ ID NO: 645117 - DNA, 14 bp, Homo sapiens
atagatttttagat

SEQ ID NO: 645118 - DNA, 15 bp, Homo sapiens
atagcaacatctttt

SEQ ID NO: 645119 - DNA, 12 bp, Homo sapiens
atagcagaagag

SEQ ID NO: 645120 - DNA, 14 bp, Homo sapiens
atagcatgtattgt

SEQ ID NO: 645121 - DNA, 16 bp, Homo sapiens
atagcatgtattgtgt

SEQ ID NO: 645122 - DNA, 23 bp, Homo sapiens
atagcatgtattgtgtcttttgc

SEQ ID NO: 645123 - DNA, 15 bp, Homo sapiens
atagccccaggcccg

SEQ ID NO: 645124 - DNA, 14 bp, Homo sapiens
atagctataaatag

SEQ ID NO: 645125 - DNA, 17 bp, Homo sapiens
atagctataaatagtga

SEQ ID NO: 645126 - DNA, 23 bp, Homo sapiens
atagctccttcatgcttttctca

SEQ ID NO: 645127 - DNA, 17 bp, Homo sapiens
atagcttttcacttctt

SEQ ID NO: 645128 - DNA, 19 bp, Homo sapiens
atagcttttcacttcttaa

SEQ ID NO: 645129 - DNA, 20 bp, Homo sapiens
atagcttttcacttcttaag

SEQ ID NO: 645130 - DNA, 17 bp, Homo sapiens
ataggaaaaactgattt

SEQ ID NO: 645131 - DNA, 16 bp, Homo sapiens
ataggaaataaatcta

SEQ ID NO: 645132 - DNA, 16 bp, Homo sapiens
ataggagcttccagat

SEQ ID NO: 645133 - DNA, 18 bp, Homo sapiens
ataggagcttccagatgg

SEQ ID NO: 645134 - DNA, 20 bp, Homo sapiens
ataggagcttccagatgggt

SEQ ID NO: 645135 - DNA, 13 bp, Homo sapiens
ataggaggacaga

SEQ ID NO: 645136 - DNA, 13 bp, Homo sapiens
ataggagggtgcc

SEQ ID NO: 645137 - DNA, 18 bp, Homo sapiens
ataggagggtgcccctgg

SEQ ID NO: 645138 - DNA, 14 bp, Homo sapiens
atagggaattttca

SEQ ID NO: 645139 - DNA, 15 bp, Homo sapiens
atagggaattttcat

SEQ ID NO: 645140 - DNA, 18 bp, Homo sapiens
atgggactgtgcctttgg

SEQ ID NO: 645141 - DNA, 15 bp, Homo sapiens
atgggccagcccttg

SEQ ID NO: 645142 - DNA, 14 bp, Homo sapiens
atgggccctcagcg

SEQ ID NO: 645143 - DNA, 20 bp, Homo sapiens
atggggggcgggccagggtg

SEQ ID NO: 645144 - DNA, 22 bp, Homo sapiens
atggtacctctgtctataggac

SEQ ID NO: 645145 - DNA, 13 bp, Homo sapiens
atggtatctcttt

SEQ ID NO: 645146 - DNA, 22 bp, Homo sapiens
atggtattttttgtgaatggtt

SEQ ID NO: 645147 - DNA, 16 bp, Homo sapiens
atggtgaactgtcatt

SEQ ID NO: 645148 - DNA, 15 bp, Homo sapiens
atggtgatactccaa

SEQ ID NO: 645149 - DNA, 15 bp, Homo sapiens
atggtgcaatgacct

SEQ ID NO: 645150 - DNA, 16 bp, Homo sapiens
atggtgcaatgacctt

SEQ ID NO: 645151 - DNA, 16 bp, Homo sapiens
atggtgggctccagag

SEQ ID NO: 645152 - DNA, 14 bp, Homo sapiens
atggtggtttcaga

SEQ ID NO: 645153 - DNA, 16 bp, Homo sapiens
atggtgtcctgcatgt

SEQ ID NO: 645154 - DNA, 21 bp, Homo sapiens
atggttacctctgcataaata

SEQ ID NO: 645155 - DNA, 18 bp, Homo sapiens
atggttcgttctgtttac

SEQ ID NO: 645156 - DNA, 23 bp, Homo sapiens
atggttctttatcatttctcttc

SEQ ID NO: 645157 - DNA, 20 bp, Homo sapiens
atgtaacttcagatgtttcc

SEQ ID NO: 645158 - DNA, 12 bp, Homo sapiens
atgtaaggcact

SEQ ID NO: 645159 - DNA, 14 bp, Homo sapiens
atgtaaggcactgt

SEQ ID NO: 645160 - DNA, 17 bp, Homo sapiens
atgtacaaaatgaattg

SEQ ID NO: 645161 - DNA, 22 bp, Homo sapiens
atgtacaaaatgaattgccttt

SEQ ID NO: 645162 - DNA, 18 bp, Homo sapiens
atgtacaaataatattgc

SEQ ID NO: 645163 - DNA, 21 bp, Homo sapiens
atgtacagagaactaacacta

SEQ ID NO: 645164 - DNA, 20 bp, Homo sapiens
atgtacaggctgagacacag

SEQ ID NO: 645165 - DNA, 17 bp, Homo sapiens
atgtacagtgttctgtt

SEQ ID NO: 645166 - DNA, 15 bp, Homo sapiens
atgtaggaaaatttt

SEQ ID NO: 645167 - DNA, 18 bp, Homo sapiens
atgtaggaaaattttctt

SEQ ID NO: 645168 - DNA, 19 bp, Homo sapiens
atgtagggcagaatagctg

SEQ ID NO: 645169 - DNA, 22 bp, Homo sapiens
atgtagggcagaatagctgata

SEQ ID NO: 645170 - DNA, 14 bp, Homo sapiens
atgtatatatttat

SEQ ID NO: 645171 - DNA, 18 bp, Homo sapiens
atgtatatctgtgtaaga

SEQ ID NO: 645172 - DNA, 17 bp, Homo sapiens
atgtatgtccattcact

SEQ ID NO: 645173 - DNA, 15 bp, Homo sapiens
atgtattttattgta

SEQ ID NO: 645174 - DNA, 16 bp, Homo sapiens
atgtcagtagtgcctg

SEQ ID NO: 645175 - DNA, 21 bp, Homo sapiens
atgtcagtagtgcctgtgatc

SEQ ID NO: 645176 - DNA, 16 bp, Homo sapiens
atgtcatttcatacaa

SEQ ID NO: 645177 - DNA, 17 bp, Homo sapiens
atgtcatttcatacaaa

SEQ ID NO: 645178 - DNA, 19 bp, Homo sapiens
atgtcattttcagatcctt

SEQ ID NO: 645179 - DNA, 21 bp, Homo sapiens
atgtccaaacttaacagatca

SEQ ID NO: 645180 - DNA, 18 bp, Homo sapiens
atgtccaggtcacaggca

SEQ ID NO: 645181 - DNA, 18 bp, Homo sapiens
atgtctaatgtattttat

SEQ ID NO: 645182 - DNA, 19 bp, Homo sapiens
atgtctaatgtattttatt

SEQ ID NO: 645183 - DNA, 21 bp, Homo sapiens
atgtctaatgtattttattgt

SEQ ID NO: 645184 - DNA, 13 bp, Homo sapiens
atgtctcatgttt

SEQ ID NO: 645185 - DNA, 15 bp, Homo sapiens
atgtctcatgtttta

SEQ ID NO: 645186 - DNA, 20 bp, Homo sapiens
atgtctgtccctaaacatag

SEQ ID NO: 645187 - DNA, 21 bp, Homo sapiens
atgtctgtccctaaacatagt

SEQ ID NO: 645188 - DNA, 11 bp, Homo sapiens
atgtctgtgat

SEQ ID NO: 645189 - DNA, 16 bp, Homo sapiens
atgtcttggtttccat

SEQ ID NO: 645190 - DNA, 18 bp, Homo sapiens
atgtctttctccaaagtt

SEQ ID NO: 645191 - DNA, 19 bp, Homo sapiens
atgtgaaaaaaaaaagtaa

SEQ ID NO: 645192 - DNA, 22 bp, Homo sapiens
atgtgaaaaaaaaaagtaatta

SEQ ID NO: 645193 - DNA, 14 bp, Homo sapiens
atgtgaaataaaga

SEQ ID NO: 645194 - DNA, 19 bp, Homo sapiens
atgtgaaataaagagttct

SEQ ID NO: 645195 - DNA, 19 bp, Homo sapiens
atgtgagcactatctttca

SEQ ID NO: 645196 - DNA, 18 bp, Homo sapiens
atgtgagtttaatctttt

SEQ ID NO: 645197 - DNA, 19 bp, Homo sapiens
atgtgataattgtaaaggt

SEQ ID NO: 645198 - DNA, 16 bp, Homo sapiens
atgtgatgagaggaaa

SEQ ID NO: 645199 - DNA, 19 bp, Homo sapiens
atgtgatgagaggaaatca

SEQ ID NO: 645200 - DNA, 16 bp, Homo sapiens
atgtgcaaagcagtat

SEQ ID NO: 645201 - DNA, 14 bp, Homo sapiens
atgtgccgtctttg

SEQ ID NO: 645202 - DNA, 14 bp, Homo sapiens
atgtgcgaacacag

SEQ ID NO: 645203 - DNA, 16 bp, Homo sapiens
atgtgctcatcagaaa

SEQ ID NO: 645204 - DNA, 20 bp, Homo sapiens
atgtgctgttgattctttca

SEQ ID NO: 645205 - DNA, 15 bp, Homo sapiens
atgtgctttcatcca

SEQ ID NO: 645206 - DNA, 14 bp, Homo sapiens
atgtggaattacat

SEQ ID NO: 645207 - DNA, 16 bp, Homo sapiens
atgtgtaacttctaga

SEQ ID NO: 645208 - DNA, 17 bp, Homo sapiens
atgtgtagattgcgtgg

SEQ ID NO: 645209 - DNA, 21 bp, Homo sapiens
atgtgtatatgtttatacaca

SEQ ID NO: 645210 - DNA, 20 bp, Homo sapiens
atgtgtgaaggtcttgcctg

SEQ ID NO: 645211 - DNA, 14 bp, Homo sapiens
atgtgttctttgta

SEQ ID NO: 645212 - DNA, 19 bp, Homo sapiens
atgtgtttggagttaaaat

SEQ ID NO: 645213 - DNA, 15 bp, Homo sapiens
atgtgtttttcagtt

SEQ ID NO: 645214 - DNA, 16 bp, Homo sapiens
atgttaaaaatagcag

SEQ ID NO: 645215 - DNA, 17 bp, Homo sapiens
atgttaaaaatagcagt

SEQ ID NO: 645216 - DNA, 14 bp, Homo sapiens
atgttaatacatca

SEQ ID NO: 645217 - DNA, 19 bp, Homo sapiens
atgttaatagaaaatatat

SEQ ID NO: 645218 - DNA, 15 bp, Homo sapiens
atgttattactgttt

SEQ ID NO: 645219 - DNA, 22 bp, Homo sapiens
atgttattactgttttgggcct

SEQ ID NO: 645220 - DNA, 17 bp, Homo sapiens
atgttccgttcatctga

SEQ ID NO: 645221 - DNA, 20 bp, Homo sapiens
atgttccgttcatctgagga

SEQ ID NO: 645222 - DNA, 18 bp, Homo sapiens
atgttctatataattttt

SEQ ID NO: 645223 - DNA, 12 bp, Homo sapiens
atgttgatgaaa

SEQ ID NO: 645224 - DNA, 14 bp, Homo sapiens
atgttgcatgaatc

SEQ ID NO: 645225 - DNA, 17 bp, Homo sapiens
atgttgcatgaatccat

SEQ ID NO: 645226 - DNA, 17 bp, Homo sapiens
atgttgtcctgtgtcat

SEQ ID NO: 645227 - DNA, 18 bp, Homo sapiens
atgttgtcctgtgtcatc

SEQ ID NO: 645228 - DNA, 22 bp, Homo sapiens
atgttgttcgatcgtttcacat

SEQ ID NO: 645229 - DNA, 13 bp, Homo sapiens
atgtttaaaatgg

SEQ ID NO: 645230 - DNA, 20 bp, Homo sapiens
atgtttaagaaatgagaaat

SEQ ID NO: 645231 - DNA, 17 bp, Homo sapiens
atgtttaataatatgta

SEQ ID NO: 645232 - DNA, 21 bp, Homo sapiens
atgtttaataatatgtacaaa

SEQ ID NO: 645233 - DNA, 14 bp, Homo sapiens
atgtttagtagctg

SEQ ID NO: 645234 - DNA, 16 bp, Homo sapiens
atgtttagtagctgat

SEQ ID NO: 645235 - DNA, 15 bp, Homo sapiens
atgtttatacacaca

SEQ ID NO: 645236 - DNA, 17 bp, Homo sapiens
atgtttatacacacagg

SEQ ID NO: 645237 - DNA, 21 bp, Homo sapiens
atgtttctgcagtattctgta

SEQ ID NO: 645238 - DNA, 22 bp, Homo sapiens
atgtttctgcagtattctgtag

SEQ ID NO: 645239 - DNA, 19 bp, Homo sapiens
atgttttaaagaagtccat

SEQ ID NO: 645240 - DNA, 21 bp, Homo sapiens
atgttttccccaattatcctc

SEQ ID NO: 645241 - DNA, 15 bp, Homo sapiens
attaaaaagacactt

SEQ ID NO: 645242 - DNA, 16 bp, Homo sapiens
attaaaacaaaatcct

SEQ ID NO: 645243 - DNA, 23 bp, Homo sapiens
attaaaacaagagaccacttcct

SEQ ID NO: 645244 - DNA, 18 bp, Homo sapiens
attaaaatattttcttaa

SEQ ID NO: 645245 - DNA, 19 bp, Homo sapiens
attaaaatattttcttaat

SEQ ID NO: 645246 - DNA, 15 bp, Homo sapiens
attaaactgatgggt

SEQ ID NO: 645247 - DNA, 13 bp, Homo sapiens
attaaactgggaa

SEQ ID NO: 645248 - DNA, 15 bp, Homo sapiens
attaaactgggaaat

SEQ ID NO: 645249 - DNA, 15 bp, Homo sapiens
attaaagaaagtcat

SEQ ID NO: 645250 - DNA, 14 bp, Homo sapiens
attaaagcagcaaa

SEQ ID NO: 645251 - DNA, 16 bp, Homo sapiens
attaaagtctgagaaa

SEQ ID NO: 645252 - DNA, 18 bp, Homo sapiens
attaaatttattaaatgt

SEQ ID NO: 645253 - DNA, 19 bp, Homo sapiens
attaaatttattaaatgtt

SEQ ID NO: 645254 - DNA, 16 bp, Homo sapiens
attaacaaattcagtg

SEQ ID NO: 645255 - DNA, 18 bp, Homo sapiens
attaactccgtttccaaa

SEQ ID NO: 645256 - DNA, 18 bp, Homo sapiens
caaattcagtggacattt

SEQ ID NO: 645257 - DNA, 21 bp, Homo sapiens
caaattcagtggacatttgtt

SEQ ID NO: 645258 - DNA, 21 bp, Homo sapiens
caaattctgattattacaaca

SEQ ID NO: 645259 - DNA, 13 bp, Homo sapiens
caaattgccttca

SEQ ID NO: 645260 - DNA, 16 bp, Homo sapiens
caaattgccttcagcc

SEQ ID NO: 645261 - DNA, 16 bp, Homo sapiens
caaattgctgagatgt

SEQ ID NO: 645262 - DNA, 23 bp, Homo sapiens
caaattttcccagtgaataaata

SEQ ID NO: 645263 - DNA, 13 bp, Homo sapiens
caacaaagaaata

SEQ ID NO: 645264 - DNA, 15 bp, Homo sapiens
caacaaagcatgctc

SEQ ID NO: 645265 - DNA, 16 bp, Homo sapiens
caacaatactttgtgt

SEQ ID NO: 645266 - DNA, 20 bp, Homo sapiens
caacaatactttgtgtcttt

SEQ ID NO: 645267 - DNA, 13 bp, Homo sapiens
caacacacacaca

SEQ ID NO: 645268 - DNA, 18 bp, Homo sapiens
caacacacacacacacaa

SEQ ID NO: 645269 - DNA, 17 bp, Homo sapiens
caacacattgaaactgt

SEQ ID NO: 645270 - DNA, 19 bp, Homo sapiens
caacagaacaacaacaaag

SEQ ID NO: 645271 - DNA, 21 bp, Homo sapiens
caacagaacaacaacaaagca

SEQ ID NO: 645272 - DNA, 15 bp, Homo sapiens
caacagactgcctta

SEQ ID NO: 645273 - DNA, 20 bp, Homo sapiens
caacatcttttgataattgt

SEQ ID NO: 645274 - DNA, 13 bp, Homo sapiens
caacatgtgatgt

SEQ ID NO: 645275 - DNA, 15 bp, Homo sapiens
caacattgcctattt

SEQ ID NO: 645276 - DNA, 18 bp, Homo sapiens
caaccagagcactgtata

SEQ ID NO: 645277 - DNA, 20 bp, Homo sapiens
caaccagagcactgtatacc

SEQ ID NO: 645278 - DNA, 17 bp, Homo sapiens
caacccaggattcaaca

SEQ ID NO: 645279 - DNA, 17 bp, Homo sapiens
caacccaggtgttgtcc

SEQ ID NO: 645280 - DNA, 22 bp, Homo sapiens
caacccaggtgttgtccgtgtc

SEQ ID NO: 645281 - DNA, 16 bp, Homo sapiens
caaccctgccctgcac

SEQ ID NO: 645282 - DNA, 17 bp, Homo sapiens
caaccctgccctgcacc

SEQ ID NO: 645283 - DNA, 17 bp, Homo sapiens
caacctcccctggtcct

SEQ ID NO: 645284 - DNA, 16 bp, Homo sapiens
caacctctcagatccc

SEQ ID NO: 645285 - DNA, 16 bp, Homo sapiens
caactaagttgtattt

SEQ ID NO: 645286 - DNA, 20 bp, Homo sapiens
caactatattgcgagaaaca

SEQ ID NO: 645287 - DNA, 22 bp, Homo sapiens
caactatattgcgagaaacaga

SEQ ID NO: 645288 - DNA, 11 bp, Homo sapiens
caactctggcc

SEQ ID NO: 645289 - DNA, 22 bp, Homo sapiens
caactctggccttggttcctcc

SEQ ID NO: 645290 - DNA, 21 bp, Homo sapiens
caactgaattgctatcatttg

SEQ ID NO: 645291 - DNA, 23 bp, Homo sapiens
caactgtggtcccagctacaggg

SEQ ID NO: 645292 - DNA, 23 bp, Homo sapiens
caacttaaacctgtgctttcatg

SEQ ID NO: 645293 - DNA, 16 bp, Homo sapiens
caacttccagatttga

SEQ ID NO: 645294 - DNA, 15 bp, Homo sapiens
caagagaccacttcc

SEQ ID NO: 645295 - DNA, 14 bp, Homo sapiens
caagagctcaggag

SEQ ID NO: 645296 - DNA, 22 bp, Homo sapiens
caagatagctccttcatgcttt

SEQ ID NO: 645297 - DNA, 23 bp, Homo sapiens
caagattaagttataccagcaaa

SEQ ID NO: 645298 - DNA, 15 bp, Homo sapiens
caagattttcctttt

SEQ ID NO: 645299 - DNA, 23 bp, Homo sapiens
caagattttgtttcttacgcttg

SEQ ID NO: 645300 - DNA, 19 bp, Homo sapiens
caagcaccctgttccctct

SEQ ID NO: 645301 - DNA, 17 bp, Homo sapiens
caagcagacacacacat

SEQ ID NO: 645302 - DNA, 14 bp, Homo sapiens
caagccaggagacc

SEQ ID NO: 645303 - DNA, 19 bp, Homo sapiens
caagccaggagaccctgtc

SEQ ID NO: 645304 - DNA, 23 bp, Homo sapiens
caagctgatgaagttaagcacaa

SEQ ID NO: 645305 - DNA, 19 bp, Homo sapiens
caaggaagctttggaagca

SEQ ID NO: 645306 - DNA, 22 bp, Homo sapiens
caaggaatgaattttttcctac

SEQ ID NO: 645307 - DNA, 18 bp, Homo sapiens
caaggacaacctgcccct

SEQ ID NO: 645308 - DNA, 20 bp, Homo sapiens
caaggacaacctgcccctcc

SEQ ID NO: 645309 - DNA, 15 bp, Homo sapiens
caaggatcctgagcc

SEQ ID NO: 645310 - DNA, 20 bp, Homo sapiens
caaggatcctgagccagatt

SEQ ID NO: 645311 - DNA, 22 bp, Homo sapiens
caaggatcctgagccagatttc

SEQ ID NO: 645312 - DNA, 14 bp, Homo sapiens
caaggcattatttg

SEQ ID NO: 645313 - DNA, 16 bp, Homo sapiens
caaggcccagccctgg

SEQ ID NO: 645314 - DNA, 22 bp, Homo sapiens
caaggcccagccctgggcaagg

SEQ ID NO: 645315 - DNA, 22 bp, Homo sapiens
caaggcccttacacccttgtcc

SEQ ID NO: 645316 - DNA, 21 bp, Homo sapiens
caaggtattgagacatattac

SEQ ID NO: 645317 - DNA, 21 bp, Homo sapiens
caaggtgggggtcaggctaca

SEQ ID NO: 645318 - DNA, 17 bp, Homo sapiens
caaggtggtcttggaga

SEQ ID NO: 645319 - DNA, 19 bp, Homo sapiens
caaggtggtcttggagagg

SEQ ID NO: 645320 - DNA, 20 bp, Homo sapiens
caaggtggtcttggagagga

SEQ ID NO: 645321 - DNA, 22 bp, Homo sapiens
caaggtggtcttggagaggagg

SEQ ID NO: 645322 - DNA, 20 bp, Homo sapiens
caagtatcatctaaatatta

SEQ ID NO: 645323 - DNA, 14 bp, Homo sapiens
caagtcctcgcccc

SEQ ID NO: 645324 - DNA, 17 bp, Homo sapiens
caagtcctcgccccccg

SEQ ID NO: 645325 - DNA, 23 bp, Homo sapiens
caagtctacctgccttgcctgtt

SEQ ID NO: 645326 - DNA, 11 bp, Homo sapiens
caagtctgtga

SEQ ID NO: 645327 - DNA, 12 bp, Homo sapiens
caagtctgtgaa

SEQ ID NO: 645328 - DNA, 12 bp, Homo sapiens
caagtgtacatt

SEQ ID NO: 645329 - DNA, 23 bp, Homo sapiens
caagtgtacatttgatttgatat

SEQ ID NO: 645330 - DNA, 12 bp, Homo sapiens
caagtgtcctgc

SEQ ID NO: 645331 - DNA, 23 bp, Homo sapiens
caagtgtgttgggaattgcatgc

SEQ ID NO: 645332 - DNA, 21 bp, Homo sapiens
caagtgtttctagtaacagta

SEQ ID NO: 645333 - DNA, 20 bp, Homo sapiens
caataaactcagtcaaatgt

SEQ ID NO: 645334 - DNA, 14 bp, Homo sapiens
caataacagtttta

SEQ ID NO: 645335 - DNA, 17 bp, Homo sapiens
caataacagttttaaga

SEQ ID NO: 645336 - DNA, 21 bp, Homo sapiens
caataagaaacagtttaacag

SEQ ID NO: 645337 - DNA, 17 bp, Homo sapiens
caatactttgtgtcttt

SEQ ID NO: 645338 - DNA, 21 bp, Homo sapiens
caatagcgctcccttttcacc

SEQ ID NO: 645339 - DNA, 12 bp, Homo sapiens
caataggaaaaa

SEQ ID NO: 645340 - DNA, 16 bp, Homo sapiens
caataggaaaaactga

SEQ ID NO: 645341 - DNA, 18 bp, Homo sapiens
caataggaaaaactgatt

SEQ ID NO: 645342 - DNA, 20 bp, Homo sapiens
caataggaaaaactgatttt

SEQ ID NO: 645343 - DNA, 14 bp, Homo sapiens
caataggcttagtg

SEQ ID NO: 645344 - DNA, 22 bp, Homo sapiens
caataggtttgggggacgccca

SEQ ID NO: 645345 - DNA, 13 bp, Homo sapiens
caatcaaacaggg

SEQ ID NO: 645346 - DNA, 22 bp, Homo sapiens
caatcattttgggaaattcttg

SEQ ID NO: 645347 - DNA, 14 bp, Homo sapiens
caatccacagtatt

SEQ ID NO: 645348 - DNA, 20 bp, Homo sapiens
caatcgactgggtttatgtc

SEQ ID NO: 645349 - DNA, 17 bp, Homo sapiens
caatcttgctgtgaaac

SEQ ID NO: 645350 - DNA, 14 bp, Homo sapiens
caatgaactctttc

SEQ ID NO: 645351 - DNA, 15 bp, Homo sapiens
caatgaactctttcc

SEQ ID NO: 645352 - DNA, 13 bp, Homo sapiens
caatgacctttca

SEQ ID NO: 645353 - DNA, 14 bp, Homo sapiens
caatgacctttcaa

SEQ ID NO: 645354 - DNA, 21 bp, Homo sapiens
caatgacctttcaataggaaa

SEQ ID NO: 645355 - DNA, 21 bp, Homo sapiens
caatgcaaaccatcattgaaa

SEQ ID NO: 645356 - DNA, 23 bp, Homo sapiens
caatgcaaaccatcattgaaatc

SEQ ID NO: 645357 - DNA, 15 bp, Homo sapiens
caatgcctgcctgaa

SEQ ID NO: 645358 - DNA, 21 bp, Homo sapiens
caatggctgggtttgggcagt

SEQ ID NO: 645359 - DNA, 12 bp, Homo sapiens
caatgtccaggt

SEQ ID NO: 645360 - DNA, 22 bp, Homo sapiens
caatgtgctgttgattctttca

SEQ ID NO: 645361 - DNA, 20 bp, Homo sapiens
caatgtggaattacataaca

SEQ ID NO: 645362 - DNA, 14 bp, Homo sapiens
caatgttaaatcta

SEQ ID NO: 645363 - DNA, 21 bp, Homo sapiens
caatgttaaatctacaaactt

SEQ ID NO: 645364 - DNA, 18 bp, Homo sapiens
caatgttccgttcatctg

SEQ ID NO: 645365 - DNA, 13 bp, Homo sapiens
caattaatttttt

SEQ ID NO: 645366 - DNA, 20 bp, Homo sapiens
caattaatttttttattgtt

SEQ ID NO: 645367 - DNA, 22 bp, Homo sapiens
caattaatttttttattgttta

SEQ ID NO: 645368 - DNA, 14 bp, Homo sapiens
caattatcaaaaaa

SEQ ID NO: 645369 - DNA, 17 bp, Homo sapiens
caattatcaaaaaacag

SEQ ID NO: 645370 - DNA, 22 bp, Homo sapiens
caattatcaaaaaacagaaaaa

SEQ ID NO: 645371 - DNA, 19 bp, Homo sapiens
cactgatgggtcctgctgc

SEQ ID NO: 645372 - DNA, 13 bp, Homo sapiens
cactgcaccctcc

SEQ ID NO: 645373 - DNA, 16 bp, Homo sapiens
cactgcccaaagccat

SEQ ID NO: 645374 - DNA, 22 bp, Homo sapiens
cactgtcatgtgcgaacacagt

SEQ ID NO: 645375 - DNA, 14 bp, Homo sapiens
cactgtgacctgct

SEQ ID NO: 645376 - DNA, 18 bp, Homo sapiens
cactgtgacctgctcctg

SEQ ID NO: 645377 - DNA, 16 bp, Homo sapiens
cactgtgcactctact

SEQ ID NO: 645378 - DNA, 22 bp, Homo sapiens
cacttaaaatcaaatttttctg

SEQ ID NO: 645379 - DNA, 14 bp, Homo sapiens
cacttatttccatg

SEQ ID NO: 645380 - DNA, 14 bp, Homo sapiens
cacttccttaacag

SEQ ID NO: 645381 - DNA, 20 bp, Homo sapiens
cacttccttaacagctgtat

SEQ ID NO: 645382 - DNA, 21 bp, Homo sapiens
cacttctccttaacccccatt

SEQ ID NO: 645383 - DNA, 14 bp, Homo sapiens
cacttcttaaggac

SEQ ID NO: 645384 - DNA, 16 bp, Homo sapiens
cacttgggctggcacc

SEQ ID NO: 645385 - DNA, 19 bp, Homo sapiens
cacttgggctggcacccac

SEQ ID NO: 645386 - DNA, 19 bp, Homo sapiens
cacttgtggcagcttccct

SEQ ID NO: 645387 - DNA, 14 bp, Homo sapiens
cactttacattctt

SEQ ID NO: 645388 - DNA, 16 bp, Homo sapiens
cactttacattcttgc

SEQ ID NO: 645389 - DNA, 18 bp, Homo sapiens
cactttcccacactgtga

SEQ ID NO: 645390 - DNA, 15 bp, Homo sapiens
cactttcctctctct

SEQ ID NO: 645391 - DNA, 15 bp, Homo sapiens
cacttttctcatctg

SEQ ID NO: 645392 - DNA, 22 bp, Homo sapiens
cacttttttcctgtcaatatat

SEQ ID NO: 645393 - DNA, 12 bp, Homo sapiens
cagaaaaacaaa

SEQ ID NO: 645394 - DNA, 13 bp, Homo sapiens
cagaaaaacaaaa

SEQ ID NO: 645395 - DNA, 14 bp, Homo sapiens
cagaaaaacaaaaa

SEQ ID NO: 645396 - DNA, 14 bp, Homo sapiens
cagaaaacattgtt

SEQ ID NO: 645397 - DNA, 16 bp, Homo sapiens
cagaaaacattgttcc

SEQ ID NO: 645398 - DNA, 13 bp, Homo sapiens
cagaaaatttttg

SEQ ID NO: 645399 - DNA, 19 bp, Homo sapiens
cagaaacacggagtttcca

SEQ ID NO: 645400 - DNA, 16 bp, Homo sapiens
cagaaactttttctaa

SEQ ID NO: 645401 - DNA, 13 bp, Homo sapiens
cagaaagaggaat

SEQ ID NO: 645402 - DNA, 18 bp, Homo sapiens
cagaaagggcagcccctc

SEQ ID NO: 645403 - DNA, 20 bp, Homo sapiens
cagaaagggcagcccctccc

SEQ ID NO: 645404 - DNA, 22 bp, Homo sapiens
cagaaagggcagcccctcccca

SEQ ID NO: 645405 - DNA, 23 bp, Homo sapiens
cagaaatctctcacccagttcag

SEQ ID NO: 645406 - DNA, 20 bp, Homo sapiens
cagaaccaacgggtctgtgg

SEQ ID NO: 645407 - DNA, 21 bp, Homo sapiens
cagaaccagcactcccagggc

SEQ ID NO: 645408 - DNA, 15 bp, Homo sapiens
cagaacgcatgcagg

SEQ ID NO: 645409 - DNA, 19 bp, Homo sapiens
cagaacgcatgcagggccc

SEQ ID NO: 645410 - DNA, 16 bp, Homo sapiens
cagaacgggcctcccc

SEQ ID NO: 645411 - DNA, 14 bp, Homo sapiens
cagaagcagcagct

SEQ ID NO: 645412 - DNA, 19 bp, Homo sapiens
cagaagctcaaggctgcag

SEQ ID NO: 645413 - DNA, 20 bp, Homo sapiens
cagaatgagatgatttaatt

SEQ ID NO: 645414 - DNA, 23 bp, Homo sapiens
cagaatgagatgatttaattctt

SEQ ID NO: 645415 - DNA, 21 bp, Homo sapiens
cagaattgaaccgtcaatgtg

SEQ ID NO: 645416 - DNA, 13 bp, Homo sapiens
cagacacacacat

SEQ ID NO: 645417 - DNA, 20 bp, Homo sapiens
cagacacacacatatataca

SEQ ID NO: 645418 - DNA, 14 bp, Homo sapiens
cagacagacagacg

SEQ ID NO: 645419 - DNA, 12 bp, Homo sapiens
cagacagagatc

SEQ ID NO: 645420 - DNA, 12 bp, Homo sapiens
cagacagagtgg

SEQ ID NO: 645421 - DNA, 14 bp, Homo sapiens
cagacagagtggat

SEQ ID NO: 645422 - DNA, 15 bp, Homo sapiens
cagacagggtggggc

SEQ ID NO: 645423 - DNA, 17 bp, Homo sapiens
cagacagggtggggctt

SEQ ID NO: 645424 - DNA, 20 bp, Homo sapiens
cagacattgacaagcacgca

SEQ ID NO: 645425 - DNA, 17 bp, Homo sapiens
cagacattgtcagcaaa

SEQ ID NO: 645426 - DNA, 21 bp, Homo sapiens
cagacattgtcagcaaattaa

SEQ ID NO: 645427 - DNA, 11 bp, Homo sapiens
cagacattgtt

SEQ ID NO: 645428 - DNA, 15 bp, Homo sapiens
cagacccctaccctt

SEQ ID NO: 645429 - DNA, 23 bp, Homo sapiens
cagaccggggtggagtcagggct

SEQ ID NO: 645430 - DNA, 22 bp, Homo sapiens
cagacgcaagaggtttcagcat

SEQ ID NO: 645431 - DNA, 17 bp, Homo sapiens
cagacggacgggacagc

SEQ ID NO: 645432 - DNA, 19 bp, Homo sapiens
cagactcgagagggctgag

SEQ ID NO: 645433 - DNA, 20 bp, Homo sapiens
cagactcgagagggctgagc

SEQ ID NO: 645434 - DNA, 21 bp, Homo sapiens
cagactcgagagggctgagcc

SEQ ID NO: 645435 - DNA, 17 bp, Homo sapiens
cagactctctcctctct

SEQ ID NO: 645436 - DNA, 12 bp, Homo sapiens
cagactctgtga

SEQ ID NO: 645437 - DNA, 12 bp, Homo sapiens
cagactgcctta

SEQ ID NO: 645438 - DNA, 22 bp, Homo sapiens
cagactgtggctgcagagacct

SEQ ID NO: 645439 - DNA, 18 bp, Homo sapiens
cagagaactaacactatt

SEQ ID NO: 645440 - DNA, 16 bp, Homo sapiens
cagagaccaccgcgcc

SEQ ID NO: 645441 - DNA, 17 bp, Homo sapiens
cagagaccaccgcgccc

SEQ ID NO: 645442 - DNA, 19 bp, Homo sapiens
cagagaccaccgcgcccct

SEQ ID NO: 645443 - DNA, 22 bp, Homo sapiens
cagagaccaccgcgcccctctg

SEQ ID NO: 645444 - DNA, 23 bp, Homo sapiens
cagagaccaccgcgcccctctgc

SEQ ID NO: 645445 - DNA, 16 bp, Homo sapiens
cagagacctcctgatg

SEQ ID NO: 645446 - DNA, 12 bp, Homo sapiens
cagagactgccc

SEQ ID NO: 645447 - DNA, 19 bp, Homo sapiens
cagagactgcccaccctgg

SEQ ID NO: 645448 - DNA, 16 bp, Homo sapiens
cagagagaagcacccc

SEQ ID NO: 645449 - DNA, 16 bp, Homo sapiens
cagagcactgtatacc

SEQ ID NO: 645450 - DNA, 17 bp, Homo sapiens
cagagccccggagcacc

SEQ ID NO: 645451 - DNA, 19 bp, Homo sapiens
cagagccccggagcaccac

SEQ ID NO: 645452 - DNA, 16 bp, Homo sapiens
cagagcgatgtgttct

SEQ ID NO: 645453 - DNA, 21 bp, Homo sapiens
cagaggaatgtagggcctgca

SEQ ID NO: 645454 - DNA, 14 bp, Homo sapiens
cagaggatggcttc

SEQ ID NO: 645455 - DNA, 17 bp, Homo sapiens
cagaggcagggccctgg

SEQ ID NO: 645456 - DNA, 18 bp, Homo sapiens
cagaggcagggccctggg

SEQ ID NO: 645457 - DNA, 19 bp, Homo sapiens
cagaggcattggaggatgg

SEQ ID NO: 645458 - DNA, 17 bp, Homo sapiens
cagaggcccgaggcacc

SEQ ID NO: 645459 - DNA, 15 bp, Homo sapiens
cagaggtttcatttt

SEQ ID NO: 645460 - DNA, 18 bp, Homo sapiens
cagagtatacaagtgttt

SEQ ID NO: 645461 - DNA, 16 bp, Homo sapiens
cagagtgatttgtaaa

SEQ ID NO: 645462 - DNA, 20 bp, Homo sapiens
cagagtgatttgtaaaacag

SEQ ID NO: 645463 - DNA, 17 bp, Homo sapiens
cagagtgccctggggca

SEQ ID NO: 645464 - DNA, 15 bp, Homo sapiens
cagagtggatctgga

SEQ ID NO: 645465 - DNA, 20 bp, Homo sapiens
cagagtggatctggagtctg

SEQ ID NO: 645466 - DNA, 13 bp, Homo sapiens
cagatccatcggt

SEQ ID NO: 645467 - DNA, 14 bp, Homo sapiens
cagatccctcggtc

SEQ ID NO: 645468 - DNA, 19 bp, Homo sapiens
cagatcctccgcggaggcc

SEQ ID NO: 645469 - DNA, 22 bp, Homo sapiens
cagatcctccgcggaggcccct

SEQ ID NO: 645470 - DNA, 12 bp, Homo sapiens
cagatccttcca

SEQ ID NO: 645471 - DNA, 22 bp, Homo sapiens
cagatcgtgccgtggagcttgg

SEQ ID NO: 645472 - DNA, 22 bp, Homo sapiens
cagatctgaagtagtgtgagtg

SEQ ID NO: 645473 - DNA, 20 bp, Homo sapiens
cagatgagattccctctcct

SEQ ID NO: 645474 - DNA, 18 bp, Homo sapiens
cagatggggcctgggctg

SEQ ID NO: 645475 - DNA, 23 bp, Homo sapiens
cagatgggttttgttaggggtgg

SEQ ID NO: 645476 - DNA, 21 bp, Homo sapiens
cagatggtgtcctgcatgtat

SEQ ID NO: 645477 - DNA, 17 bp, Homo sapiens
cagatgtttccaagatg

SEQ ID NO: 645478 - DNA, 12 bp, Homo sapiens
cagattaataac

SEQ ID NO: 645479 - DNA, 20 bp, Homo sapiens
cagattaataacagaaatac

SEQ ID NO: 645480 - DNA, 19 bp, Homo sapiens
cagattattttctatattt

SEQ ID NO: 645481 - DNA, 18 bp, Homo sapiens
cagatttcactctccttg

SEQ ID NO: 645482 - DNA, 13 bp, Homo sapiens
cagcaaaatatat

SEQ ID NO: 645483 - DNA, 17 bp, Homo sapiens
cagcaaaatatatgttt

SEQ ID NO: 645484 - DNA, 15 bp, Homo sapiens
cagcaaacacagtca

SEQ ID NO: 645485 - DNA, 15 bp, Homo sapiens
cagcaaagttttcag

SEQ ID NO: 645486 - DNA, 23 bp, Homo sapiens
cagcaaattaattggcagcagat

SEQ ID NO: 645487 - DNA, 16 bp, Homo sapiens
cagtgaacagcttcac

SEQ ID NO: 645488 - DNA, 18 bp, Homo sapiens
cagtgcagggacagcctg

SEQ ID NO: 645489 - DNA, 19 bp, Homo sapiens
cagtgcagggacagcctgc

SEQ ID NO: 645490 - DNA, 16 bp, Homo sapiens
cagtgcccatgtgtat

SEQ ID NO: 645491 - DNA, 17 bp, Homo sapiens
cagtgcccatgtgtatg

SEQ ID NO: 645492 - DNA, 15 bp, Homo sapiens
cagtgccccagtggt

SEQ ID NO: 645493 - DNA, 12 bp, Homo sapiens
cagtgcctgctg

SEQ ID NO: 645494 - DNA, 11 bp, Homo sapiens
cagtgccttat

SEQ ID NO: 645495 - DNA, 12 bp, Homo sapiens
cagtgccttgga

SEQ ID NO: 645496 - DNA, 23 bp, Homo sapiens
cagtgccttggagcagaaagcca

SEQ ID NO: 645497 - DNA, 21 bp, Homo sapiens
cagtggaagagctgctgtatt

SEQ ID NO: 645498 - DNA, 19 bp, Homo sapiens
cagtggagaggggacttgg

SEQ ID NO: 645499 - DNA, 13 bp, Homo sapiens
cagtggggcccat

SEQ ID NO: 645500 - DNA, 20 bp, Homo sapiens
cagtggggcccatggcccca

SEQ ID NO: 645501 - DNA, 23 bp, Homo sapiens
cagtggggcccatggccccagct

SEQ ID NO: 645502 - DNA, 22 bp, Homo sapiens
cagtggggtcccccctgagtgg

SEQ ID NO: 645503 - DNA, 23 bp, Homo sapiens
cagtggtccagggtccagccctc

SEQ ID NO: 645504 - DNA, 23 bp, Homo sapiens
cagtggtgcgggccaggtctggc

SEQ ID NO: 645505 - DNA, 23 bp, Homo sapiens
cagtggttgttttttcattgtgt

SEQ ID NO: 645506 - DNA, 23 bp, Homo sapiens
cagtgtactctgagtcctcattg

SEQ ID NO: 645507 - DNA, 13 bp, Homo sapiens
cagtgtggcccca

SEQ ID NO: 645508 - DNA, 18 bp, Homo sapiens
cagtgtggcttaaacatt

SEQ ID NO: 645509 - DNA, 18 bp, Homo sapiens
cagtgttcaaattctgat

SEQ ID NO: 645510 - DNA, 21 bp, Homo sapiens
cagtgttcagcatagagctat

SEQ ID NO: 645511 - DNA, 13 bp, Homo sapiens
cagttacagtggc

SEQ ID NO: 645512 - DNA, 15 bp, Homo sapiens
cagttacttgtgttc

SEQ ID NO: 645513 - DNA, 19 bp, Homo sapiens
cagttagcacagaggatgg

SEQ ID NO: 645514 - DNA, 17 bp, Homo sapiens
cagttagcccggccaag

SEQ ID NO: 645515 - DNA, 13 bp, Homo sapiens
cagttataatttc

SEQ ID NO: 645516 - DNA, 20 bp, Homo sapiens
cagttataatttcaattttt

SEQ ID NO: 645517 - DNA, 13 bp, Homo sapiens
cagttctcatctt

SEQ ID NO: 645518 - DNA, 21 bp, Homo sapiens
cagttctcatcttgtaaataa

SEQ ID NO: 645519 - DNA, 22 bp, Homo sapiens
cagttgacacattgcacacaca

SEQ ID NO: 645520 - DNA, 17 bp, Homo sapiens
cagttggcctctgcccc

SEQ ID NO: 645521 - DNA, 18 bp, Homo sapiens
cagtttggccctggagcc

SEQ ID NO: 645522 - DNA, 19 bp, Homo sapiens
cagtttggccctggagcca

SEQ ID NO: 645523 - DNA, 21 bp, Homo sapiens
cagtttggccctggagccagg

SEQ ID NO: 645524 - DNA, 12 bp, Homo sapiens
cagtttgtgaag

SEQ ID NO: 645525 - DNA, 22 bp, Homo sapiens
cagtttgtgaagtgattgacat

SEQ ID NO: 645526 - DNA, 15 bp, Homo sapiens
cataaacaaagagta

SEQ ID NO: 645527 - DNA, 18 bp, Homo sapiens
cataaacacttctcctta

SEQ ID NO: 645528 - DNA, 21 bp, Homo sapiens
cataaacacttctccttaacc

SEQ ID NO: 645529 - DNA, 15 bp, Homo sapiens
cataaatagtaaata

SEQ ID NO: 645530 - DNA, 12 bp, Homo sapiens
cataacacacat

SEQ ID NO: 645531 - DNA, 17 bp, Homo sapiens
cataacaggcattgcac

SEQ ID NO: 645532 - DNA, 20 bp, Homo sapiens
cataacgttagactgcaata

SEQ ID NO: 645533 - DNA, 15 bp, Homo sapiens
cataagccaattttt

SEQ ID NO: 645534 - DNA, 17 bp, Homo sapiens
cataagccaatttttct

SEQ ID NO: 645535 - DNA, 20 bp, Homo sapiens
cataagccaatttttctgca

SEQ ID NO: 645536 - DNA, 16 bp, Homo sapiens
cataagctttttctct

SEQ ID NO: 645537 - DNA, 21 bp, Homo sapiens
cataagggacatgtctttggc

SEQ ID NO: 645538 - DNA, 13 bp, Homo sapiens
cataagtaaatgt

SEQ ID NO: 645539 - DNA, 16 bp, Homo sapiens
cataagtaaatgtctt

SEQ ID NO: 645540 - DNA, 17 bp, Homo sapiens
cataatatgcatatata

SEQ ID NO: 645541 - DNA, 17 bp, Homo sapiens
cataatcatcctttttt

SEQ ID NO: 645542 - DNA, 13 bp, Homo sapiens
cataatgcttctt

SEQ ID NO: 645543 - DNA, 17 bp, Homo sapiens
cataattaaagtgtcca

SEQ ID NO: 645544 - DNA, 18 bp, Homo sapiens
cataattaaagtgtccat

SEQ ID NO: 645545 - DNA, 11 bp, Homo sapiens
catacaaataa

SEQ ID NO: 645546 - DNA, 13 bp, Homo sapiens
catacaacatata

SEQ ID NO: 645547 - DNA, 21 bp, Homo sapiens
catacacagaaatcctaacat

SEQ ID NO: 645548 - DNA, 14 bp, Homo sapiens
catacagatggtgt

SEQ ID NO: 645549 - DNA, 17 bp, Homo sapiens
catacagtctctatttg

SEQ ID NO: 645550 - DNA, 23 bp, Homo sapiens
catacgcaattgtatatatatgt

SEQ ID NO: 645551 - DNA, 21 bp, Homo sapiens
catacgtgcccatttcacaca

SEQ ID NO: 645552 - DNA, 21 bp, Homo sapiens
catacgttgatagtttacaaa

SEQ ID NO: 645553 - DNA, 17 bp, Homo sapiens
catactctagattttgt

SEQ ID NO: 645554 - DNA, 16 bp, Homo sapiens
catactgatgagacaa

SEQ ID NO: 645555 - DNA, 20 bp, Homo sapiens
catactgatgagacaacaca

SEQ ID NO: 645556 - DNA, 21 bp, Homo sapiens
catactgatgagacaacacac

SEQ ID NO: 645557 - DNA, 17 bp, Homo sapiens
catacttccagcgaaat

SEQ ID NO: 645558 - DNA, 22 bp, Homo sapiens
catagataccattttgaaatat

SEQ ID NO: 645559 - DNA, 13 bp, Homo sapiens
catagcacatgtt

SEQ ID NO: 645560 - DNA, 19 bp, Homo sapiens
catagcatagccagcattc

SEQ ID NO: 645561 - DNA, 13 bp, Homo sapiens
catagccagcatt

SEQ ID NO: 645562 - DNA, 22 bp, Homo sapiens
catagccagcattcagcacaca

SEQ ID NO: 645563 - DNA, 16 bp, Homo sapiens
catagccccaggcccg

SEQ ID NO: 645564 - DNA, 17 bp, Homo sapiens
catagcttaagaagtat

SEQ ID NO: 645565 - DNA, 19 bp, Homo sapiens
catagctttagagaagcca

SEQ ID NO: 645566 - DNA, 20 bp, Homo sapiens
catagggtttggaagaaagg

SEQ ID NO: 645567 - DNA, 15 bp, Homo sapiens
catagtggtatttta

SEQ ID NO: 645568 - DNA, 16 bp, Homo sapiens
catataaacacagtaa

SEQ ID NO: 645569 - DNA, 20 bp, Homo sapiens
catataaacacagtaagata

SEQ ID NO: 645570 - DNA, 23 bp, Homo sapiens
catataatttgccagacagagat

SEQ ID NO: 645571 - DNA, 15 bp, Homo sapiens
catatagctttgcaa

SEQ ID NO: 645572 - DNA, 18 bp, Homo sapiens
catataggggcaaaaatt

SEQ ID NO: 645573 - DNA, 19 bp, Homo sapiens
catataggggcaaaaattt

SEQ ID NO: 645574 - DNA, 21 bp, Homo sapiens
catatatataaaatacacgtg

SEQ ID NO: 645575 - DNA, 13 bp, Homo sapiens
catatcagctctg

SEQ ID NO: 645576 - DNA, 17 bp, Homo sapiens
catatcagctctgcata

SEQ ID NO: 645577 - DNA, 18 bp, Homo sapiens
catatcagctctgcataa

SEQ ID NO: 645578 - DNA, 17 bp, Homo sapiens
catatgtaggaaaattt

SEQ ID NO: 645579 - DNA, 18 bp, Homo sapiens
catatgtaggaaaatttt

SEQ ID NO: 645580 - DNA, 21 bp, Homo sapiens
catatgtaggaaaattttctt

SEQ ID NO: 645581 - DNA, 18 bp, Homo sapiens
catattaaagaaagtcat

SEQ ID NO: 645582 - DNA, 22 bp, Homo sapiens
catatttaataggataaattaa

SEQ ID NO: 645583 - DNA, 15 bp, Homo sapiens
catcaagtctccacg

SEQ ID NO: 645584 - DNA, 18 bp, Homo sapiens
catcaagtctccacgtgt

SEQ ID NO: 645585 - DNA, 22 bp, Homo sapiens
catcagtccacccccattgtga

SEQ ID NO: 645586 - DNA, 21 bp, Homo sapiens
catcataaacaaagagtagaa

SEQ ID NO: 645587 - DNA, 21 bp, Homo sapiens
catcatatgttagatacacaa

SEQ ID NO: 645588 - DNA, 13 bp, Homo sapiens
catcattgaaatc

SEQ ID NO: 645589 - DNA, 20 bp, Homo sapiens
catcattgaaatctttttgc

SEQ ID NO: 645590 - DNA, 17 bp, Homo sapiens
catcattttttgtttct

SEQ ID NO: 645591 - DNA, 23 bp, Homo sapiens
catccaactggaaggctttattc

SEQ ID NO: 645592 - DNA, 14 bp, Homo sapiens
catccaccttcctg

SEQ ID NO: 645593 - DNA, 21 bp, Homo sapiens
catccaccttcctgcccaggg

SEQ ID NO: 645594 - DNA, 20 bp, Homo sapiens
catccactaggtgcccagtc

SEQ ID NO: 645595 - DNA, 13 bp, Homo sapiens
catcccctgcctc

SEQ ID NO: 645596 - DNA, 23 bp, Homo sapiens
catcccctgcctctatccctggc

SEQ ID NO: 645597 - DNA, 13 bp, Homo sapiens
catcccttggccc

SEQ ID NO: 645598 - DNA, 17 bp, Homo sapiens
catcccttggcccctct

SEQ ID NO: 645599 - DNA, 21 bp, Homo sapiens
catcctcttatatgtgcccct

SEQ ID NO: 645600 - DNA, 19 bp, Homo sapiens
catccttcccgcagcacca

SEQ ID NO: 645601 - DNA, 19 bp, Homo sapiens
catccttgcacttctgtta

SEQ ID NO: 645602 - DNA, 21 bp, Homo sapiens
catcgcctgggacgccccttt

SEQ ID NO: 645603 - DNA, 16 bp, Homo sapiens
ccaccttcctgcccag

SEQ ID NO: 645604 - DNA, 16 bp, Homo sapiens
ccacgcccctgcctga

SEQ ID NO: 645605 - DNA, 20 bp, Homo sapiens
ccacgccgatataagccata

SEQ ID NO: 645606 - DNA, 22 bp, Homo sapiens
ccacgcggctgctgcttctccc

SEQ ID NO: 645607 - DNA, 16 bp, Homo sapiens
ccacggccgtccctga

SEQ ID NO: 645608 - DNA, 16 bp, Homo sapiens
ccacgtgcagcacctg

SEQ ID NO: 645609 - DNA, 15 bp, Homo sapiens
ccacgtggggtggaa

SEQ ID NO: 645610 - DNA, 17 bp, Homo sapiens
ccacgtgtgcagactgt

SEQ ID NO: 645611 - DNA, 17 bp, Homo sapiens
ccactaagctttctcct

SEQ ID NO: 645612 - DNA, 21 bp, Homo sapiens
ccactaagctttctcctttga

SEQ ID NO: 645613 - DNA, 22 bp, Homo sapiens
ccactacctttgtccaggcctg

SEQ ID NO: 645614 - DNA, 22 bp, Homo sapiens
ccactagccctctttctctctg

SEQ ID NO: 645615 - DNA, 20 bp, Homo sapiens
ccactagggtcctggccctc

SEQ ID NO: 645616 - DNA, 22 bp, Homo sapiens
ccactagggtcctggccctctt

SEQ ID NO: 645617 - DNA, 16 bp, Homo sapiens
ccactcaggcagcctg

SEQ ID NO: 645618 - DNA, 12 bp, Homo sapiens
ccactcccctca

SEQ ID NO: 645619 - DNA, 13 bp, Homo sapiens
ccactcctcccaa

SEQ ID NO: 645620 - DNA, 22 bp, Homo sapiens
ccactgatatcacgggcccgct

SEQ ID NO: 645621 - DNA, 23 bp, Homo sapiens
ccactgatatcacgggcccgctc

SEQ ID NO: 645622 - DNA, 18 bp, Homo sapiens
ccacttagggagtgtgcc

SEQ ID NO: 645623 - DNA, 14 bp, Homo sapiens
ccacttccttaaca

SEQ ID NO: 645624 - DNA, 17 bp, Homo sapiens
ccacttccttaacagct

SEQ ID NO: 645625 - DNA, 18 bp, Homo sapiens
ccacttccttaacagctg

SEQ ID NO: 645626 - DNA, 20 bp, Homo sapiens
ccacttccttaacagctgta

SEQ ID NO: 645627 - DNA, 14 bp, Homo sapiens
ccactttcccacac

SEQ ID NO: 645628 - DNA, 12 bp, Homo sapiens
ccactttcctct

SEQ ID NO: 645629 - DNA, 14 bp, Homo sapiens
ccactttcctctct

SEQ ID NO: 645630 - DNA, 16 bp, Homo sapiens
ccactttcctctctct

SEQ ID NO: 645631 - DNA, 18 bp, Homo sapiens
ccagaaaatttttgtctt

SEQ ID NO: 645632 - DNA, 13 bp, Homo sapiens
ccagaacgggcct

SEQ ID NO: 645633 - DNA, 15 bp, Homo sapiens
ccagaacgggcctcc

SEQ ID NO: 645634 - DNA, 15 bp, Homo sapiens
ccagaagcagcagct

SEQ ID NO: 645635 - DNA, 18 bp, Homo sapiens
ccagaagctcaaggctgc

SEQ ID NO: 645636 - DNA, 14 bp, Homo sapiens
ccagacagggtggg

SEQ ID NO: 645637 - DNA, 9 bp, Homo sapiens
ccagacccc

SEQ ID NO: 645638 - DNA, 23 bp, Homo sapiens
ccagactcgagagggctgagccc

SEQ ID NO: 645639 - DNA, 23 bp, Homo sapiens
ccagagaaatgaaagtcagttta

SEQ ID NO: 645640 - DNA, 13 bp, Homo sapiens
ccagagactgccc

SEQ ID NO: 645641 - DNA, 18 bp, Homo sapiens
ccagagactgcccaccct

SEQ ID NO: 645642 - DNA, 19 bp, Homo sapiens
ccagagagaagcaccccac

SEQ ID NO: 645643 - DNA, 20 bp, Homo sapiens
ccagagagaagcaccccacc

SEQ ID NO: 645644 - DNA, 12 bp, Homo sapiens
ccagagcactgt

SEQ ID NO: 645645 - DNA, 13 bp, Homo sapiens
ccagagcactgta

SEQ ID NO: 645646 - DNA, 13 bp, Homo sapiens
ccagagccactac

SEQ ID NO: 645647 - DNA, 12 bp, Homo sapiens
ccagagccctgc

SEQ ID NO: 645648 - DNA, 17 bp, Homo sapiens
ccagattattttctata

SEQ ID NO: 645649 - DNA, 23 bp, Homo sapiens
ccagattattttctatatttgga

SEQ ID NO: 645650 - DNA, 13 bp, Homo sapiens
ccagcactcccag

SEQ ID NO: 645651 - DNA, 21 bp, Homo sapiens
ccagcactcccagggcccgag

SEQ ID NO: 645652 - DNA, 22 bp, Homo sapiens
ccagcactcccagggcccgagc

SEQ ID NO: 645653 - DNA, 12 bp, Homo sapiens
ccagcagacatt

SEQ ID NO: 645654 - DNA, 16 bp, Homo sapiens
ccagcagacttgagtc

SEQ ID NO: 645655 - DNA, 18 bp, Homo sapiens
ccagcagcgcccgaggcc

SEQ ID NO: 645656 - DNA, 19 bp, Homo sapiens
ccagcagcgcccgaggcca

SEQ ID NO: 645657 - DNA, 14 bp, Homo sapiens
ccagcagtgaatgc

SEQ ID NO: 645658 - DNA, 18 bp, Homo sapiens
ccagcatagttctgcaat

SEQ ID NO: 645659 - DNA, 15 bp, Homo sapiens
ccagcattcagcaca

SEQ ID NO: 645660 - DNA, 13 bp, Homo sapiens
ccagccactgccc

SEQ ID NO: 645661 - DNA, 12 bp, Homo sapiens
ccagcccatgct

SEQ ID NO: 645662 - DNA, 13 bp, Homo sapiens
ccagcccatgctg

SEQ ID NO: 645663 - DNA, 18 bp, Homo sapiens
ccagcccatgctggctgg

SEQ ID NO: 645664 - DNA, 17 bp, Homo sapiens
ccagcccccacccatgc

SEQ ID NO: 645665 - DNA, 24 bp, Homo sapiens
ccagcccccacccatgccagcgca

SEQ ID NO: 645666 - DNA, 24 bp, Homo sapiens
ccagccctgttccgcctcactggg

SEQ ID NO: 645667 - DNA, 18 bp, Homo sapiens
ccagccctttgcaggccc

SEQ ID NO: 645668 - DNA, 14 bp, Homo sapiens
ccagcctcccccag

SEQ ID NO: 645669 - DNA, 15 bp, Homo sapiens
ccagcctcccccagg

SEQ ID NO: 645670 - DNA, 17 bp, Homo sapiens
ccagcctgagccacagt

SEQ ID NO: 645671 - DNA, 12 bp, Homo sapiens
ccagcctgccag

SEQ ID NO: 645672 - DNA, 13 bp, Homo sapiens
ccagcctgccagg

SEQ ID NO: 645673 - DNA, 17 bp, Homo sapiens
ccagccttggtttggaa

SEQ ID NO: 645674 - DNA, 21 bp, Homo sapiens
ccagcgcatggcgccccgggc

SEQ ID NO: 645675 - DNA, 14 bp, Homo sapiens
ccagcgctgaacag

SEQ ID NO: 645676 - DNA, 16 bp, Homo sapiens
ccagcgctgaacagac

SEQ ID NO: 645677 - DNA, 18 bp, Homo sapiens
ccagcgctgaacagaccg

SEQ ID NO: 645678 - DNA, 23 bp, Homo sapiens
ccagcgctgaacagaccggggtg

SEQ ID NO: 645679 - DNA, 17 bp, Homo sapiens
ccagcggggcttctggg

SEQ ID NO: 645680 - DNA, 21 bp, Homo sapiens
ccagctcaggctactgccact

SEQ ID NO: 645681 - DNA, 21 bp, Homo sapiens
ccagctctgagcagacagggc

SEQ ID NO: 645682 - DNA, 14 bp, Homo sapiens
ccagctctggatga

SEQ ID NO: 645683 - DNA, 20 bp, Homo sapiens
ccagctctggatgaaggcaa

SEQ ID NO: 645684 - DNA, 20 bp, Homo sapiens
ccagctgcaggaatcaaaaa

SEQ ID NO: 645685 - DNA, 12 bp, Homo sapiens
ccagctggcagc

SEQ ID NO: 645686 - DNA, 16 bp, Homo sapiens
ccagctggcagcgcct

SEQ ID NO: 645687 - DNA, 17 bp, Homo sapiens
ccagctggcagcgcctc

SEQ ID NO: 645688 - DNA, 20 bp, Homo sapiens
ccagctggcagcgcctcccg

SEQ ID NO: 645689 - DNA, 18 bp, Homo sapiens
ccaggaagtcatcctgca

SEQ ID NO: 645690 - DNA, 16 bp, Homo sapiens
ccaggacgcatgcagg

SEQ ID NO: 645691 - DNA, 16 bp, Homo sapiens
ccaggagaccctgtct

SEQ ID NO: 645692 - DNA, 19 bp, Homo sapiens
ccaggagatgaggctggat

SEQ ID NO: 645693 - DNA, 12 bp, Homo sapiens
ccaggagctagc

SEQ ID NO: 645694 - DNA, 21 bp, Homo sapiens
ccaggagctagcccagtccct

SEQ ID NO: 645695 - DNA, 18 bp, Homo sapiens
ccaggatgaaggggccag

SEQ ID NO: 645696 - DNA, 16 bp, Homo sapiens
ccaggatgcatgcagg

SEQ ID NO: 645697 - DNA, 17 bp, Homo sapiens
ccaggatgcatgcaggg

SEQ ID NO: 645698 - DNA, 14 bp, Homo sapiens
ccaggcccagcctc

SEQ ID NO: 645699 - DNA, 16 bp, Homo sapiens
ccaggcccagcctctt

SEQ ID NO: 645700 - DNA, 13 bp, Homo sapiens
ccaggcctccctc

SEQ ID NO: 645701 - DNA, 14 bp, Homo sapiens
ccaggcctccctcg

SEQ ID NO: 645702 - DNA, 16 bp, Homo sapiens
ccaggcctccctcggg

SEQ ID NO: 645703 - DNA, 22 bp, Homo sapiens
ccaggcggaggggcttggagca

SEQ ID NO: 645704 - DNA, 23 bp, Homo sapiens
ccaggcggaggggcttggagcag

SEQ ID NO: 645705 - DNA, 16 bp, Homo sapiens
ccagggaaccagagcg

SEQ ID NO: 645706 - DNA, 20 bp, Homo sapiens
ccagggaggtggcagggaag

SEQ ID NO: 645707 - DNA, 16 bp, Homo sapiens
ccagggcagaggaatg

SEQ ID NO: 645708 - DNA, 20 bp, Homo sapiens
ccagggcccgagcgcgtgcc

SEQ ID NO: 645709 - DNA, 23 bp, Homo sapiens
ccagggcccgagcgcgtgccttc

SEQ ID NO: 645710 - DNA, 21 bp, Homo sapiens
ccagggctcagatggggcctg

SEQ ID NO: 645711 - DNA, 22 bp, Homo sapiens
ccaggggcttctccccctcagc

SEQ ID NO: 645712 - DNA, 14 bp, Homo sapiens
ccagggtccagccc

SEQ ID NO: 645713 - DNA, 21 bp, Homo sapiens
ccagggtccagccctccgcca

SEQ ID NO: 645714 - DNA, 22 bp, Homo sapiens
ccagggttaaagaaaggcagag

SEQ ID NO: 645715 - DNA, 22 bp, Homo sapiens
ccaggtatctgatgatgttctg

SEQ ID NO: 645716 - DNA, 14 bp, Homo sapiens
ccaggtcacaggca

SEQ ID NO: 645717 - DNA, 15 bp, Homo sapiens
ccaggtcacaggcat

SEQ ID NO: 645718 - DNA, 19 bp, Homo sapiens
ccaggtctggcgccagggg

SEQ ID NO: 645719 - DNA, 22 bp, Homo sapiens
ccagtcatggctgtcccctgca

SEQ ID NO: 645720 - DNA, 21 bp, Homo sapiens
cccgcactcaggagcacagcc

SEQ ID NO: 645721 - DNA, 15 bp, Homo sapiens
cccgcagcaccagcc

SEQ ID NO: 645722 - DNA, 17 bp, Homo sapiens
cccgcagcaccagcctg

SEQ ID NO: 645723 - DNA, 16 bp, Homo sapiens
cccgcccaccccgctg

SEQ ID NO: 645724 - DNA, 17 bp, Homo sapiens
cccgcccaccccgctgc

SEQ ID NO: 645725 - DNA, 21 bp, Homo sapiens
cccgccccagagactgcccac

SEQ ID NO: 645726 - DNA, 18 bp, Homo sapiens
cccgcccccgccctcgct

SEQ ID NO: 645727 - DNA, 21 bp, Homo sapiens
cccgccccgctgctcccggtg

SEQ ID NO: 645728 - DNA, 21 bp, Homo sapiens
cccgccctcctctgccccctc

SEQ ID NO: 645729 - DNA, 21 bp, Homo sapiens
cccgccggttggccggctggc

SEQ ID NO: 645730 - DNA, 19 bp, Homo sapiens
cccgcgaccacccctgtgc

SEQ ID NO: 645731 - DNA, 17 bp, Homo sapiens
cccgcggagcccccgcc

SEQ ID NO: 645732 - DNA, 22 bp, Homo sapiens
cccgcggagcccccgcccctcc

SEQ ID NO: 645733 - DNA, 22 bp, Homo sapiens
cccgcgggtggctggagcccca

SEQ ID NO: 645734 - DNA, 18 bp, Homo sapiens
cccgctcaacctctcaga

SEQ ID NO: 645735 - DNA, 23 bp, Homo sapiens
cccgctcttcccaagtcctcgcc

SEQ ID NO: 645736 - DNA, 14 bp, Homo sapiens
cccgctgcctggcg

SEQ ID NO: 645737 - DNA, 15 bp, Homo sapiens
cccgctgcctggcgg

SEQ ID NO: 645738 - DNA, 15 bp, Homo sapiens
cccgctgctcccggt

SEQ ID NO: 645739 - DNA, 17 bp, Homo sapiens
cccgctgctcccggtgt

SEQ ID NO: 645740 - DNA, 19 bp, Homo sapiens
cccggagcaccacggggtc

SEQ ID NO: 645741 - DNA, 17 bp, Homo sapiens
cccggagctcaggccct

SEQ ID NO: 645742 - DNA, 19 bp, Homo sapiens
cccggaggcgcccacctgc

SEQ ID NO: 645743 - DNA, 20 bp, Homo sapiens
cccggaggcgcccacctgcc

SEQ ID NO: 645744 - DNA, 19 bp, Homo sapiens
cccggccccatcagaggct

SEQ ID NO: 645745 - DNA, 13 bp, Homo sapiens
cccggcctcctag

SEQ ID NO: 645746 - DNA, 14 bp, Homo sapiens
cccggcctggcccc

SEQ ID NO: 645747 - DNA, 12 bp, Homo sapiens
cccggctgactc

SEQ ID NO: 645748 - DNA, 14 bp, Homo sapiens
cccgtccgtccgcc

SEQ ID NO: 645749 - DNA, 17 bp, Homo sapiens
cccgtccgtccgcccgc

SEQ ID NO: 645750 - DNA, 16 bp, Homo sapiens
cccgtgcgcagccgcg

SEQ ID NO: 645751 - DNA, 22 bp, Homo sapiens
cccgtgcgcagccgcgctctgc

SEQ ID NO: 645752 - DNA, 12 bp, Homo sapiens
cccgtgctcaca

SEQ ID NO: 645753 - DNA, 14 bp, Homo sapiens
cccgttcccagcgc

SEQ ID NO: 645754 - DNA, 17 bp, Homo sapiens
cccgttcccagcgcatg

SEQ ID NO: 645755 - DNA, 16 bp, Homo sapiens
cccgttgttgtccctg

SEQ ID NO: 645756 - DNA, 18 bp, Homo sapiens
ccctaagcacaataaaag

SEQ ID NO: 645757 - DNA, 17 bp, Homo sapiens
ccctaccctcttctcag

SEQ ID NO: 645758 - DNA, 23 bp, Homo sapiens
ccctaggcctgagttagctgttt

SEQ ID NO: 645759 - DNA, 21 bp, Homo sapiens
ccctataccctaggtctccac

SEQ ID NO: 645760 - DNA, 11 bp, Homo sapiens
ccctatctccc

SEQ ID NO: 645761 - DNA, 22 bp, Homo sapiens
ccctcaagccaggagaccctgt

SEQ ID NO: 645762 - DNA, 10 bp, Homo sapiens
ccctcacctc

SEQ ID NO: 645763 - DNA, 15 bp, Homo sapiens
ccctcactccactcc

SEQ ID NO: 645764 - DNA, 16 bp, Homo sapiens
ccctcactccactccc

SEQ ID NO: 645765 - DNA, 22 bp, Homo sapiens
ccctcactccactcccctcatc

SEQ ID NO: 645766 - DNA, 17 bp, Homo sapiens
ccctcagccctcattaa

SEQ ID NO: 645767 - DNA, 17 bp, Homo sapiens
ccctccacacctccacc

SEQ ID NO: 645768 - DNA, 18 bp, Homo sapiens
ccctccacacctccaccc

SEQ ID NO: 645769 - DNA, 19 bp, Homo sapiens
ccctccacacctccacccg

SEQ ID NO: 645770 - DNA, 17 bp, Homo sapiens
ccctccacaggagccgc

SEQ ID NO: 645771 - DNA, 11 bp, Homo sapiens
ccctccagacc

SEQ ID NO: 645772 - DNA, 13 bp, Homo sapiens
ccctccagacccc

SEQ ID NO: 645773 - DNA, 22 bp, Homo sapiens
ccctccagacccctaccctttc

SEQ ID NO: 645774 - DNA, 17 bp, Homo sapiens
ccctccccagcccccac

SEQ ID NO: 645775 - DNA, 23 bp, Homo sapiens
ccctccccatggtgcagtgaaga

SEQ ID NO: 645776 - DNA, 15 bp, Homo sapiens
ccctcccccacggcc

SEQ ID NO: 645777 - DNA, 15 bp, Homo sapiens
ccctcccccgcagac

SEQ ID NO: 645778 - DNA, 18 bp, Homo sapiens
ccctcccccgcagacaga

SEQ ID NO: 645779 - DNA, 15 bp, Homo sapiens
ccctccctgctccct

SEQ ID NO: 645780 - DNA, 12 bp, Homo sapiens
ccctccctgtcc

SEQ ID NO: 645781 - DNA, 13 bp, Homo sapiens
ccctccctgtccc

SEQ ID NO: 645782 - DNA, 16 bp, Homo sapiens
ccctccctgtcccctg

SEQ ID NO: 645783 - DNA, 16 bp, Homo sapiens
ccctccgccagccctg

SEQ ID NO: 645784 - DNA, 13 bp, Homo sapiens
ccctccgggcaga

SEQ ID NO: 645785 - DNA, 22 bp, Homo sapiens
ccctccgggcagagaccaccgc

SEQ ID NO: 645786 - DNA, 14 bp, Homo sapiens
ccctcctccatgct

SEQ ID NO: 645787 - DNA, 13 bp, Homo sapiens
ccctcctctgccc

SEQ ID NO: 645788 - DNA, 18 bp, Homo sapiens
ccctcctctgccccctcc

SEQ ID NO: 645789 - DNA, 22 bp, Homo sapiens
ccctccttctcccctccagacc

SEQ ID NO: 645790 - DNA, 14 bp, Homo sapiens
ccctcgcgcccctg

SEQ ID NO: 645791 - DNA, 13 bp, Homo sapiens
ccctcgctccggg

SEQ ID NO: 645792 - DNA, 13 bp, Homo sapiens
ccctcggccattg

SEQ ID NO: 645793 - DNA, 15 bp, Homo sapiens
ccctcggtcagcacc

SEQ ID NO: 645794 - DNA, 20 bp, Homo sapiens
ccctctcctcccccaccttc

SEQ ID NO: 645795 - DNA, 20 bp, Homo sapiens
ccctctcctgagcctgtctc

SEQ ID NO: 645796 - DNA, 19 bp, Homo sapiens
ccctctcgggctctctcac

SEQ ID NO: 645797 - DNA, 13 bp, Homo sapiens
ccctctgccactg

SEQ ID NO: 645798 - DNA, 12 bp, Homo sapiens
ccctctgcgccc

SEQ ID NO: 645799 - DNA, 19 bp, Homo sapiens
ccctctgctatgtctgtga

SEQ ID NO: 645800 - DNA, 14 bp, Homo sapiens
ccctctgctgcttt

SEQ ID NO: 645801 - DNA, 22 bp, Homo sapiens
ccctcttaagatctgactgcca

SEQ ID NO: 645802 - DNA, 22 bp, Homo sapiens
ccctcttagaagaaatatgagc

SEQ ID NO: 645803 - DNA, 17 bp, Homo sapiens
ccctcttcccccttccc

SEQ ID NO: 645804 - DNA, 22 bp, Homo sapiens
ccctcttcttgcggcaccgccc

SEQ ID NO: 645805 - DNA, 17 bp, Homo sapiens
ccctctttctctctgtg

SEQ ID NO: 645806 - DNA, 18 bp, Homo sapiens
ccctctttctctctgtgt

SEQ ID NO: 645807 - DNA, 20 bp, Homo sapiens
ccctctttctctctgtgtgg

SEQ ID NO: 645808 - DNA, 16 bp, Homo sapiens
ccctgacttcccagct

SEQ ID NO: 645809 - DNA, 16 bp, Homo sapiens
ccctgacttctggaga

SEQ ID NO: 645810 - DNA, 15 bp, Homo sapiens
ccctgagcctgacct

SEQ ID NO: 645811 - DNA, 19 bp, Homo sapiens
ccctgagcctgacctttct

SEQ ID NO: 645812 - DNA, 14 bp, Homo sapiens
ccctgagggccctt

SEQ ID NO: 645813 - DNA, 20 bp, Homo sapiens
ccctgagggcccttcccaac

SEQ ID NO: 645814 - DNA, 16 bp, Homo sapiens
ccctgatttattctgg

SEQ ID NO: 645815 - DNA, 12 bp, Homo sapiens
ccctgcagggca

SEQ ID NO: 645816 - DNA, 22 bp, Homo sapiens
ccctgcatcccttggcccctct

SEQ ID NO: 645817 - DNA, 20 bp, Homo sapiens
ccctgcatggctgagagggt

SEQ ID NO: 645818 - DNA, 23 bp, Homo sapiens
ccctgcccagcacctcctccgtg

SEQ ID NO: 645819 - DNA, 17 bp, Homo sapiens
ccctgccctcactccac

SEQ ID NO: 645820 - DNA, 21 bp, Homo sapiens
ccctgccctcactccactccc

SEQ ID NO: 645821 - DNA, 12 bp, Homo sapiens
ccctgccctccc

SEQ ID NO: 645822 - DNA, 15 bp, Homo sapiens
ccctgccctccccca

SEQ ID NO: 645823 - DNA, 11 bp, Homo sapiens
ccctgccctcg

SEQ ID NO: 645824 - DNA, 18 bp, Homo sapiens
ccctgccctcggccattg

SEQ ID NO: 645825 - DNA, 13 bp, Homo sapiens
ccctgccctgcac

SEQ ID NO: 645826 - DNA, 13 bp, Homo sapiens
ccctgcgcccctg

SEQ ID NO: 645827 - DNA, 15 bp, Homo sapiens
ccctgcgcccctgcc

SEQ ID NO: 645828 - DNA, 23 bp, Homo sapiens
ccctgcgcccctgcccagcacct

SEQ ID NO: 645829 - DNA, 13 bp, Homo sapiens
ccctgcgccctcc

SEQ ID NO: 645830 - DNA, 17 bp, Homo sapiens
ccctgcgccctccctcc

SEQ ID NO: 645831 - DNA, 14 bp, Homo sapiens
ccctgcggggcggc

SEQ ID NO: 645832 - DNA, 14 bp, Homo sapiens
ccctgctcagccca

SEQ ID NO: 645833 - DNA, 15 bp, Homo sapiens
ccctgctcagcccat

SEQ ID NO: 645834 - DNA, 17 bp, Homo sapiens
ccctgctccctgctccc

SEQ ID NO: 645835 - DNA, 20 bp, Homo sapiens
ccctggaccgagtggaccac

SEQ ID NO: 645836 - DNA, 12 bp, Homo sapiens
ccctggagccag

SEQ ID NO: 645837 - DNA, 17 bp, Homo sapiens
cctcgggctggtgtctt

SEQ ID NO: 645838 - DNA, 17 bp, Homo sapiens
cctcgtccggcctgcag

SEQ ID NO: 645839 - DNA, 21 bp, Homo sapiens
cctctatccctggccacctgc

SEQ ID NO: 645840 - DNA, 17 bp, Homo sapiens
cctctccaccctccggc

SEQ ID NO: 645841 - DNA, 14 bp, Homo sapiens
cctctcccaaataa

SEQ ID NO: 645842 - DNA, 23 bp, Homo sapiens
cctctcccaaataaactccttaa

SEQ ID NO: 645843 - DNA, 16 bp, Homo sapiens
cctctcctcgtccggc

SEQ ID NO: 645844 - DNA, 16 bp, Homo sapiens
cctctctctccctcca

SEQ ID NO: 645845 - DNA, 21 bp, Homo sapiens
cctctctgaactgcaacactg

SEQ ID NO: 645846 - DNA, 13 bp, Homo sapiens
cctctctgtttac

SEQ ID NO: 645847 - DNA, 20 bp, Homo sapiens
cctctctgtttaccctccct

SEQ ID NO: 645848 - DNA, 16 bp, Homo sapiens
cctctcttaccccgtc

SEQ ID NO: 645849 - DNA, 18 bp, Homo sapiens
cctctcttaccccgtccc

SEQ ID NO: 645850 - DNA, 22 bp, Homo sapiens
cctctcttaccccgtccctttc

SEQ ID NO: 645851 - DNA, 11 bp, Homo sapiens
cctctgaggac

SEQ ID NO: 645852 - DNA, 16 bp, Homo sapiens
cctctgcagcctgagc

SEQ ID NO: 645853 - DNA, 17 bp, Homo sapiens
cctctgcagcctgagct

SEQ ID NO: 645854 - DNA, 18 bp, Homo sapiens
cctctgcagcctgagctc

SEQ ID NO: 645855 - DNA, 17 bp, Homo sapiens
cctctgccactgacagg

SEQ ID NO: 645856 - DNA, 19 bp, Homo sapiens
cctctgccactgacaggaa

SEQ ID NO: 645857 - DNA, 15 bp, Homo sapiens
cctctgccccctccc

SEQ ID NO: 645858 - DNA, 16 bp, Homo sapiens
cctctgccccctcccc

SEQ ID NO: 645859 - DNA, 14 bp, Homo sapiens
cctctgcccctctt

SEQ ID NO: 645860 - DNA, 17 bp, Homo sapiens
cctctgcgccccagcga

SEQ ID NO: 645861 - DNA, 18 bp, Homo sapiens
cctctgcgccccagcgac

SEQ ID NO: 645862 - DNA, 22 bp, Homo sapiens
cctctgtcagtttgtgaagtga

SEQ ID NO: 645863 - DNA, 14 bp, Homo sapiens
cctcttcaatcccc

SEQ ID NO: 645864 - DNA, 14 bp, Homo sapiens
cctcttcccccttc

SEQ ID NO: 645865 - DNA, 20 bp, Homo sapiens
cctcttcccccttcccctgc

SEQ ID NO: 645866 - DNA, 21 bp, Homo sapiens
cctcttcccccttcccctgcg

SEQ ID NO: 645867 - DNA, 13 bp, Homo sapiens
cctcttctcagct

SEQ ID NO: 645868 - DNA, 22 bp, Homo sapiens
cctcttgctcagagctaggccc

SEQ ID NO: 645869 - DNA, 21 bp, Homo sapiens
cctcttgttcttagggcttgg

SEQ ID NO: 645870 - DNA, 21 bp, Homo sapiens
cctctttctctctgtgtggca

SEQ ID NO: 645871 - DNA, 22 bp, Homo sapiens
cctctttctctctgtgtggcaa

SEQ ID NO: 645872 - DNA, 23 bp, Homo sapiens
cctctttctctctgtgtggcaaa

SEQ ID NO: 645873 - DNA, 20 bp, Homo sapiens
cctgaaatattttctacttt

SEQ ID NO: 645874 - DNA, 13 bp, Homo sapiens
cctgaacactcat

SEQ ID NO: 645875 - DNA, 17 bp, Homo sapiens
cctgaattcattgtctc

SEQ ID NO: 645876 - DNA, 23 bp, Homo sapiens
cctgaattcattgtctcagtgaa

SEQ ID NO: 645877 - DNA, 14 bp, Homo sapiens
cctgaccctcactt

SEQ ID NO: 645878 - DNA, 12 bp, Homo sapiens
cctgactgtggg

SEQ ID NO: 645879 - DNA, 18 bp, Homo sapiens
cctgacttcccagctggc

SEQ ID NO: 645880 - DNA, 19 bp, Homo sapiens
cctgacttcccagctggca

SEQ ID NO: 645881 - DNA, 13 bp, Homo sapiens
cctgacttctgga

SEQ ID NO: 645882 - DNA, 15 bp, Homo sapiens
cctgacttctggaga

SEQ ID NO: 645883 - DNA, 16 bp, Homo sapiens
cctgacttctggagat

SEQ ID NO: 645884 - DNA, 15 bp, Homo sapiens
cctgactttggggac

SEQ ID NO: 645885 - DNA, 21 bp, Homo sapiens
cctgactttggggacaccctc

SEQ ID NO: 645886 - DNA, 20 bp, Homo sapiens
cctgagaggagcgtgtccta

SEQ ID NO: 645887 - DNA, 21 bp, Homo sapiens
cctgagcagatcgtgccgtgg

SEQ ID NO: 645888 - DNA, 16 bp, Homo sapiens
cctgagccagatttca

SEQ ID NO: 645889 - DNA, 14 bp, Homo sapiens
cctgagcctgtctc

SEQ ID NO: 645890 - DNA, 15 bp, Homo sapiens
cctgagcctgtctct

SEQ ID NO: 645891 - DNA, 14 bp, Homo sapiens
cctgagctccaccc

SEQ ID NO: 645892 - DNA, 17 bp, Homo sapiens
cctgaggaggaggacac

SEQ ID NO: 645893 - DNA, 19 bp, Homo sapiens
cctgaggaggaggacacag

SEQ ID NO: 645894 - DNA, 22 bp, Homo sapiens
cctgaggaggaggacacagcac

SEQ ID NO: 645895 - DNA, 12 bp, Homo sapiens
cctgagggaagc

SEQ ID NO: 645896 - DNA, 16 bp, Homo sapiens
cctgagggaagcccac

SEQ ID NO: 645897 - DNA, 17 bp, Homo sapiens
cctgagggaagcccacc

SEQ ID NO: 645898 - DNA, 18 bp, Homo sapiens
cctgagggaagcccaccc

SEQ ID NO: 645899 - DNA, 20 bp, Homo sapiens
cctgagggaagcccacccgc

SEQ ID NO: 645900 - DNA, 14 bp, Homo sapiens
cctgagtgggctgg

SEQ ID NO: 645901 - DNA, 15 bp, Homo sapiens
cctgatggccaggcc

SEQ ID NO: 645902 - DNA, 19 bp, Homo sapiens
cctgatgtcttggtttcca

SEQ ID NO: 645903 - DNA, 15 bp, Homo sapiens
cctgatttattctgg

SEQ ID NO: 645904 - DNA, 17 bp, Homo sapiens
cctgcaagtggacgtgg

SEQ ID NO: 645905 - DNA, 20 bp, Homo sapiens
cctgcacagtggtccagggt

SEQ ID NO: 645906 - DNA, 21 bp, Homo sapiens
cctgcacagtggtccagggtc

SEQ ID NO: 645907 - DNA, 13 bp, Homo sapiens
cctgcaccctctg

SEQ ID NO: 645908 - DNA, 19 bp, Homo sapiens
cctgcacgcggactccggg

SEQ ID NO: 645909 - DNA, 22 bp, Homo sapiens
cctgcagaccacactctgcctg

SEQ ID NO: 645910 - DNA, 16 bp, Homo sapiens
cctgcaggcaggcaga

SEQ ID NO: 645911 - DNA, 19 bp, Homo sapiens
cctgcaggcaggcagacca

SEQ ID NO: 645912 - DNA, 21 bp, Homo sapiens
cctgcagtcacgtgaggcccc

SEQ ID NO: 645913 - DNA, 15 bp, Homo sapiens
cctgcagtttggccc

SEQ ID NO: 645914 - DNA, 18 bp, Homo sapiens
cctgcagtttggccctgg

SEQ ID NO: 645915 - DNA, 21 bp, Homo sapiens
cctgcagtttggccctggagc

SEQ ID NO: 645916 - DNA, 16 bp, Homo sapiens
cctgcatcccttggcc

SEQ ID NO: 645917 - DNA, 15 bp, Homo sapiens
cctgccaggccctcc

SEQ ID NO: 645918 - DNA, 16 bp, Homo sapiens
cctgcccagcacctcc

SEQ ID NO: 645919 - DNA, 17 bp, Homo sapiens
cctgcccagcacctcct

SEQ ID NO: 645920 - DNA, 18 bp, Homo sapiens
cctgcccagcacctcctc

SEQ ID NO: 645921 - DNA, 21 bp, Homo sapiens
cctgcccagcacctcctccgt

SEQ ID NO: 645922 - DNA, 18 bp, Homo sapiens
cctgcccagttagcccgg

SEQ ID NO: 645923 - DNA, 13 bp, Homo sapiens
cctgccccccttc

SEQ ID NO: 645924 - DNA, 14 bp, Homo sapiens
cctgccccccttcc

SEQ ID NO: 645925 - DNA, 15 bp, Homo sapiens
cctgccccccttccc

SEQ ID NO: 645926 - DNA, 22 bp, Homo sapiens
cctgccccccttcccaccccta

SEQ ID NO: 645927 - DNA, 15 bp, Homo sapiens
cctgccctcactcca

SEQ ID NO: 645928 - DNA, 13 bp, Homo sapiens
cctgccctccccc

SEQ ID NO: 645929 - DNA, 14 bp, Homo sapiens
cctgccctccccca

SEQ ID NO: 645930 - DNA, 19 bp, Homo sapiens
cctgccctcccccacggcc

SEQ ID NO: 645931 - DNA, 17 bp, Homo sapiens
cctgcctacgtgctgcc

SEQ ID NO: 645932 - DNA, 13 bp, Homo sapiens
cctgcctgaggag

SEQ ID NO: 645933 - DNA, 15 bp, Homo sapiens
cctgcctgaggagga

SEQ ID NO: 645934 - DNA, 14 bp, Homo sapiens
cctgccttcatgga

SEQ ID NO: 645935 - DNA, 13 bp, Homo sapiens
cctgcgcaccccg

SEQ ID NO: 645936 - DNA, 22 bp, Homo sapiens
cctgcgcaccccgttcccagcg

SEQ ID NO: 645937 - DNA, 20 bp, Homo sapiens
cctgcgcccctgcccagcac

SEQ ID NO: 645938 - DNA, 15 bp, Homo sapiens
cctgcgccctccctc

SEQ ID NO: 645939 - DNA, 23 bp, Homo sapiens
cctgcgccctccctccctccaca

SEQ ID NO: 645940 - DNA, 21 bp, Homo sapiens
cctgcgccctgacatgctaac

SEQ ID NO: 645941 - DNA, 14 bp, Homo sapiens
cctgcgcctgcgcc

SEQ ID NO: 645942 - DNA, 13 bp, Homo sapiens
cctgcgctcctct

SEQ ID NO: 645943 - DNA, 18 bp, Homo sapiens
cctgcgctcctctgcagc

SEQ ID NO: 645944 - DNA, 21 bp, Homo sapiens
cctgcgctcctctgcagcctg

SEQ ID NO: 645945 - DNA, 23 bp, Homo sapiens
cctgcggggcggcatccgagccc

SEQ ID NO: 645946 - DNA, 17 bp, Homo sapiens
cctgcggggttccctgc

SEQ ID NO: 645947 - DNA, 18 bp, Homo sapiens
cctgcggggttccctgcg

SEQ ID NO: 645948 - DNA, 17 bp, Homo sapiens
cctgcgtgtgttctctc

SEQ ID NO: 645949 - DNA, 21 bp, Homo sapiens
cctgctcagcccatcccctgc

SEQ ID NO: 645950 - DNA, 18 bp, Homo sapiens
cctgctcccggctctgag

SEQ ID NO: 645951 - DNA, 11 bp, Homo sapiens
cctgctccctg

SEQ ID NO: 645952 - DNA, 15 bp, Homo sapiens
cctgctcctgcccac

SEQ ID NO: 645953 - DNA, 21 bp, Homo sapiens
cgccccagcgacgcggcccgc

SEQ ID NO: 645954 - DNA, 18 bp, Homo sapiens
cgccccatgggccctcag

SEQ ID NO: 645955 - DNA, 14 bp, Homo sapiens
cgcccccaggaccc

SEQ ID NO: 645956 - DNA, 12 bp, Homo sapiens
cgccccccgccc

SEQ ID NO: 645957 - DNA, 15 bp, Homo sapiens
cgccccccggcctgg

SEQ ID NO: 645958 - DNA, 16 bp, Homo sapiens
cgccccccggcctggc

SEQ ID NO: 645959 - DNA, 18 bp, Homo sapiens
cgcccccgccctcgctcc

SEQ ID NO: 645960 - DNA, 15 bp, Homo sapiens
cgccccgctgctccc

SEQ ID NO: 645961 - DNA, 16 bp, Homo sapiens
cgccccgggccgcgag

SEQ ID NO: 645962 - DNA, 14 bp, Homo sapiens
cgcccctcctcggg

SEQ ID NO: 645963 - DNA, 14 bp, Homo sapiens
cgcccctctgcgcc

SEQ ID NO: 645964 - DNA, 19 bp, Homo sapiens
cgcccctctgcgccccagc

SEQ ID NO: 645965 - DNA, 15 bp, Homo sapiens
cgcccctgcctgaga

SEQ ID NO: 645966 - DNA, 15 bp, Homo sapiens
cgcccgcccaccccg

SEQ ID NO: 645967 - DNA, 23 bp, Homo sapiens
cgcccgcccaccccgctgcctgg

SEQ ID NO: 645968 - DNA, 23 bp, Homo sapiens
cgcccgcccccgccctcgctccg

SEQ ID NO: 645969 - DNA, 16 bp, Homo sapiens
cgcccgccctcctctg

SEQ ID NO: 645970 - DNA, 19 bp, Homo sapiens
cgcccgccctcctctgccc

SEQ ID NO: 645971 - DNA, 14 bp, Homo sapiens
cgcccggcctccta

SEQ ID NO: 645972 - DNA, 11 bp, Homo sapiens
cgccctccctc

SEQ ID NO: 645973 - DNA, 13 bp, Homo sapiens
cgccctccctccc

SEQ ID NO: 645974 - DNA, 11 bp, Homo sapiens
cgccctcctct

SEQ ID NO: 645975 - DNA, 12 bp, Homo sapiens
cgccctcctctg

SEQ ID NO: 645976 - DNA, 23 bp, Homo sapiens
cgccctcctctgccccctccccc

SEQ ID NO: 645977 - DNA, 22 bp, Homo sapiens
cgccctgtgccctctcactgac

SEQ ID NO: 645978 - DNA, 23 bp, Homo sapiens
cgcccttccctgacactgtctgc

SEQ ID NO: 645979 - DNA, 17 bp, Homo sapiens
cgccgaagggcagcccc

SEQ ID NO: 645980 - DNA, 17 bp, Homo sapiens
cgccgatataagccata

SEQ ID NO: 645981 - DNA, 18 bp, Homo sapiens
cgccggggctggccctgc

SEQ ID NO: 645982 - DNA, 16 bp, Homo sapiens
cgccggttggccggct

SEQ ID NO: 645983 - DNA, 21 bp, Homo sapiens
cgccggttggccggctggccg

SEQ ID NO: 645984 - DNA, 14 bp, Homo sapiens
cgcctcactgggtg

SEQ ID NO: 645985 - DNA, 14 bp, Homo sapiens
cgcctcgcccccgg

SEQ ID NO: 645986 - DNA, 21 bp, Homo sapiens
cgcctcgggccgcctcctcca

SEQ ID NO: 645987 - DNA, 17 bp, Homo sapiens
cgcctgcgcctcctcct

SEQ ID NO: 645988 - DNA, 18 bp, Homo sapiens
cgcctgcgcctcctcctg

SEQ ID NO: 645989 - DNA, 19 bp, Homo sapiens
cgcctgcgcctcctcctgc

SEQ ID NO: 645990 - DNA, 20 bp, Homo sapiens
cgcctgcgcctcctcctgca

SEQ ID NO: 645991 - DNA, 16 bp, Homo sapiens
cgcctgcgctcctctg

SEQ ID NO: 645992 - DNA, 17 bp, Homo sapiens
cgcctgcgctcctctgc

SEQ ID NO: 645993 - DNA, 23 bp, Homo sapiens
cgcctgcgctcctctgcagcctg

SEQ ID NO: 645994 - DNA, 20 bp, Homo sapiens
cgcctgggaaattgctccat

SEQ ID NO: 645995 - DNA, 24 bp, Homo sapiens
cgcctgggaaattgctccattcct

SEQ ID NO: 645996 - DNA, 15 bp, Homo sapiens
cgcctgtgcccacgt

SEQ ID NO: 645997 - DNA, 14 bp, Homo sapiens
cgcgacaatgcaaa

SEQ ID NO: 645998 - DNA, 16 bp, Homo sapiens
cgcgaccacccctgtg

SEQ ID NO: 645999 - DNA, 21 bp, Homo sapiens
cgcgcaccgcccaacccccac

SEQ ID NO: 646000 - DNA, 17 bp, Homo sapiens
cgcgcccccaggacccc

SEQ ID NO: 646001 - DNA, 14 bp, Homo sapiens
cgcgcccctctgcg

SEQ ID NO: 646002 - DNA, 19 bp, Homo sapiens
cgcgcccctgtccatccgt

SEQ ID NO: 646003 - DNA, 16 bp, Homo sapiens
cgcgcgtgcccccagc

SEQ ID NO: 646004 - DNA, 14 bp, Homo sapiens
cgcggagcccccgc

SEQ ID NO: 646005 - DNA, 16 bp, Homo sapiens
cgcggaggcccctgag

SEQ ID NO: 646006 - DNA, 16 bp, Homo sapiens
cgcggccgctctccgc

SEQ ID NO: 646007 - DNA, 19 bp, Homo sapiens
cgcggccgctctccgcccc

SEQ ID NO: 646008 - DNA, 20 bp, Homo sapiens
cgcgggtggctggagcccca

SEQ ID NO: 646009 - DNA, 15 bp, Homo sapiens
cgcgtgcccccagcg

SEQ ID NO: 646010 - DNA, 13 bp, Homo sapiens
cgcgtgtgtggcc

SEQ ID NO: 646011 - DNA, 15 bp, Homo sapiens
cgctcaacctctcag

SEQ ID NO: 646012 - DNA, 14 bp, Homo sapiens
cgctccggcagagg

SEQ ID NO: 646013 - DNA, 15 bp, Homo sapiens
cgctccggcagaggc

SEQ ID NO: 646014 - DNA, 22 bp, Homo sapiens
cgctccggcagaggcagggccc

SEQ ID NO: 646015 - DNA, 24 bp, Homo sapiens
cgctccggcagaggcagggccctg

SEQ ID NO: 646016 - DNA, 12 bp, Homo sapiens
cgctcctctgca

SEQ ID NO: 646017 - DNA, 23 bp, Homo sapiens
cgctcctctgcagcctgagctcc

SEQ ID NO: 646018 - DNA, 17 bp, Homo sapiens
cgctctccgccccccgg

SEQ ID NO: 646019 - DNA, 18 bp, Homo sapiens
cgctctccgccccccggc

SEQ ID NO: 646020 - DNA, 22 bp, Homo sapiens
cgctctgcccctccgtccccag

SEQ ID NO: 646021 - DNA, 23 bp, Homo sapiens
cgctctgcccctccgtccccagg

SEQ ID NO: 646022 - DNA, 14 bp, Homo sapiens
cgctgagggcaggg

SEQ ID NO: 646023 - DNA, 23 bp, Homo sapiens
cgctgagggcagggttctagaag

SEQ ID NO: 646024 - DNA, 12 bp, Homo sapiens
cgctgcctggcg

SEQ ID NO: 646025 - DNA, 17 bp, Homo sapiens
cgctgcctggcgggcag

SEQ ID NO: 646026 - DNA, 21 bp, Homo sapiens
cgctgcctggcgggcagcccc

SEQ ID NO: 646027 - DNA, 16 bp, Homo sapiens
cgctggagaccctgcg

SEQ ID NO: 646028 - DNA, 21 bp, Homo sapiens
cgctggagaccctgcgcccct

SEQ ID NO: 646029 - DNA, 15 bp, Homo sapiens
cgctgtccgtcctgc

SEQ ID NO: 646030 - DNA, 17 bp, Homo sapiens
cgctgtccgtcctgctc

SEQ ID NO: 646031 - DNA, 24 bp, Homo sapiens
cgctgtcggtgtttggaggctgct

SEQ ID NO: 646032 - DNA, 23 bp, Homo sapiens
cgcttaaacatttccctgctgag

SEQ ID NO: 646033 - DNA, 20 bp, Homo sapiens
cggaagtggcctgagaagag

SEQ ID NO: 646034 - DNA, 21 bp, Homo sapiens
cggaagtggcctgagaagagt

SEQ ID NO: 646035 - DNA, 18 bp, Homo sapiens
cggacgctggagaccctg

SEQ ID NO: 646036 - DNA, 21 bp, Homo sapiens
cggacgctggagaccctgcgc

SEQ ID NO: 646037 - DNA, 15 bp, Homo sapiens
cggagcccccgcccc

SEQ ID NO: 646038 - DNA, 16 bp, Homo sapiens
cggagcccccgcccct

SEQ ID NO: 646039 - DNA, 18 bp, Homo sapiens
cggagcccccgcccctcc

SEQ ID NO: 646040 - DNA, 15 bp, Homo sapiens
cggagcggctgagga

SEQ ID NO: 646041 - DNA, 15 bp, Homo sapiens
cggaggcaggaccag

SEQ ID NO: 646042 - DNA, 12 bp, Homo sapiens
cggaggcgccca

SEQ ID NO: 646043 - DNA, 14 bp, Homo sapiens
cggaggcgcccacc

SEQ ID NO: 646044 - DNA, 13 bp, Homo sapiens
cggataattttca

SEQ ID NO: 646045 - DNA, 14 bp, Homo sapiens
cggataattttcat

SEQ ID NO: 646046 - DNA, 18 bp, Homo sapiens
cggatggaatcacagcca

SEQ ID NO: 646047 - DNA, 17 bp, Homo sapiens
cggcaaggggcgcgcgc

SEQ ID NO: 646048 - DNA, 20 bp, Homo sapiens
cggcaaggggcgcgcgcccc

SEQ ID NO: 646049 - DNA, 12 bp, Homo sapiens
cggcaccgccca

SEQ ID NO: 646050 - DNA, 16 bp, Homo sapiens
cggcaccgcccaccca

SEQ ID NO: 646051 - DNA, 14 bp, Homo sapiens
cggcagaggcaggg

SEQ ID NO: 646052 - DNA, 15 bp, Homo sapiens
cggcagaggcagggc

SEQ ID NO: 646053 - DNA, 16 bp, Homo sapiens
cggcagaggcagggcc

SEQ ID NO: 646054 - DNA, 17 bp, Homo sapiens
cggcagcttgagcctgt

SEQ ID NO: 646055 - DNA, 15 bp, Homo sapiens
cggcatccgagcccc

SEQ ID NO: 646056 - DNA, 19 bp, Homo sapiens
cggcatccgagcccctgtt

SEQ ID NO: 646057 - DNA, 15 bp, Homo sapiens
cggccaaggacactg

SEQ ID NO: 646058 - DNA, 19 bp, Homo sapiens
cggccaaggacactgatgg

SEQ ID NO: 646059 - DNA, 15 bp, Homo sapiens
cggcccacgcagagc

SEQ ID NO: 646060 - DNA, 18 bp, Homo sapiens
cggcccacgcagagcccc

SEQ ID NO: 646061 - DNA, 19 bp, Homo sapiens
cggcccacgcagagccccg

SEQ ID NO: 646062 - DNA, 20 bp, Homo sapiens
cggccccatcagaggctggg

SEQ ID NO: 646063 - DNA, 18 bp, Homo sapiens
cggccccgcggagccccc

SEQ ID NO: 646064 - DNA, 20 bp, Homo sapiens
cggcccggcccacgcagagc

SEQ ID NO: 646065 - DNA, 15 bp, Homo sapiens
cggccgtccctgact

SEQ ID NO: 646066 - DNA, 13 bp, Homo sapiens
cggcctcctagcc

SEQ ID NO: 646067 - DNA, 17 bp, Homo sapiens
cggcctcctagcctctc

SEQ ID NO: 646068 - DNA, 23 bp, Homo sapiens
cggcctgagaggagcgtgtccta

SEQ ID NO: 646069 - DNA, 15 bp, Homo sapiens
cggcctgcagcccag

SEQ ID NO: 646070 - DNA, 21 bp, Homo sapiens
ctaaaggggacagatcttgag

SEQ ID NO: 646071 - DNA, 20 bp, Homo sapiens
ctaaatagatttttagattc

SEQ ID NO: 646072 - DNA, 22 bp, Homo sapiens
ctaaatagatttttagattcct

SEQ ID NO: 646073 - DNA, 15 bp, Homo sapiens
ctaaatagcatgtat

SEQ ID NO: 646074 - DNA, 22 bp, Homo sapiens
ctaaatagcatgtattgtgtct

SEQ ID NO: 646075 - DNA, 15 bp, Homo sapiens
ctaaatcataatcat

SEQ ID NO: 646076 - DNA, 14 bp, Homo sapiens
ctaaatgcaaagca

SEQ ID NO: 646077 - DNA, 19 bp, Homo sapiens
ctaaatgcctaataaacaa

SEQ ID NO: 646078 - DNA, 13 bp, Homo sapiens
ctaaattaacaaa

SEQ ID NO: 646079 - DNA, 13 bp, Homo sapiens
ctaaattaacttc

SEQ ID NO: 646080 - DNA, 18 bp, Homo sapiens
ctaaattaacttctattt

SEQ ID NO: 646081 - DNA, 16 bp, Homo sapiens
ctaacactattttatg

SEQ ID NO: 646082 - DNA, 20 bp, Homo sapiens
ctaacatagtgtctgctgct

SEQ ID NO: 646083 - DNA, 18 bp, Homo sapiens
ctaacccctagtgtcttt

SEQ ID NO: 646084 - DNA, 20 bp, Homo sapiens
ctaacctgggttgttgcaga

SEQ ID NO: 646085 - DNA, 19 bp, Homo sapiens
ctaacgaccgacgcccctc

SEQ ID NO: 646086 - DNA, 21 bp, Homo sapiens
ctaacgaccgacgcccctccg

SEQ ID NO: 646087 - DNA, 16 bp, Homo sapiens
ctaactagtaatcttg

SEQ ID NO: 646088 - DNA, 15 bp, Homo sapiens
ctaactggccccagg

SEQ ID NO: 646089 - DNA, 16 bp, Homo sapiens
ctaactggccccaggc

SEQ ID NO: 646090 - DNA, 17 bp, Homo sapiens
ctaactggccccaggcg

SEQ ID NO: 646091 - DNA, 15 bp, Homo sapiens
ctaacttattttgat

SEQ ID NO: 646092 - DNA, 18 bp, Homo sapiens
ctaagagtggaggaggag

SEQ ID NO: 646093 - DNA, 15 bp, Homo sapiens
ctaagctttctcctt

SEQ ID NO: 646094 - DNA, 17 bp, Homo sapiens
ctaagctttctcctttg

SEQ ID NO: 646095 - DNA, 13 bp, Homo sapiens
ctaatccacctgg

SEQ ID NO: 646096 - DNA, 16 bp, Homo sapiens
ctaatgacaagtgact

SEQ ID NO: 646097 - DNA, 17 bp, Homo sapiens
ctaatgtattttattgt

SEQ ID NO: 646098 - DNA, 18 bp, Homo sapiens
ctaatgtattttattgta

SEQ ID NO: 646099 - DNA, 13 bp, Homo sapiens
ctaatgtggtagt

SEQ ID NO: 646100 - DNA, 13 bp, Homo sapiens
ctaattaaactga

SEQ ID NO: 646101 - DNA, 17 bp, Homo sapiens
ctaattcctgtatgtta

SEQ ID NO: 646102 - DNA, 18 bp, Homo sapiens
ctaattcctgtatgttat

SEQ ID NO: 646103 - DNA, 18 bp, Homo sapiens
ctaatttatgaagatagt

SEQ ID NO: 646104 - DNA, 11 bp, Homo sapiens
ctaatttgtga

SEQ ID NO: 646105 - DNA, 23 bp, Homo sapiens
ctaatttgtgaaagtggcaagct

SEQ ID NO: 646106 - DNA, 20 bp, Homo sapiens
ctacaaaacgtatttatctg

SEQ ID NO: 646107 - DNA, 22 bp, Homo sapiens
ctacacatataaacacagtaag

SEQ ID NO: 646108 - DNA, 15 bp, Homo sapiens
ctacagaagtggaag

SEQ ID NO: 646109 - DNA, 17 bp, Homo sapiens
ctacagaagtggaagga

SEQ ID NO: 646110 - DNA, 19 bp, Homo sapiens
ctacaggtgccccacctcc

SEQ ID NO: 646111 - DNA, 11 bp, Homo sapiens
ctacatatgta

SEQ ID NO: 646112 - DNA, 15 bp, Homo sapiens
ctacatctgaaatct

SEQ ID NO: 646113 - DNA, 17 bp, Homo sapiens
ctacatctgatatcagg

SEQ ID NO: 646114 - DNA, 17 bp, Homo sapiens
ctacatgggccagccct

SEQ ID NO: 646115 - DNA, 17 bp, Homo sapiens
ctacattagtgagattt

SEQ ID NO: 646116 - DNA, 19 bp, Homo sapiens
ctaccctcttctcagctcc

SEQ ID NO: 646117 - DNA, 19 bp, Homo sapiens
ctaccctttcccaaaccct

SEQ ID NO: 646118 - DNA, 21 bp, Homo sapiens
ctacctaactccctaggcctg

SEQ ID NO: 646119 - DNA, 22 bp, Homo sapiens
ctacctggccggtaggctgctg

SEQ ID NO: 646120 - DNA, 23 bp, Homo sapiens
ctacctggccggtaggctgctgg

SEQ ID NO: 646121 - DNA, 19 bp, Homo sapiens
ctacctttttttctctcct

SEQ ID NO: 646122 - DNA, 20 bp, Homo sapiens
ctacctttttttctctccta

SEQ ID NO: 646123 - DNA, 15 bp, Homo sapiens
ctactcctccccctc

SEQ ID NO: 646124 - DNA, 23 bp, Homo sapiens
ctactcctccccctcctccatgc

SEQ ID NO: 646125 - DNA, 22 bp, Homo sapiens
ctactctgcgacgatccccatg

SEQ ID NO: 646126 - DNA, 23 bp, Homo sapiens
ctactgccactcaggcagcctgt

SEQ ID NO: 646127 - DNA, 12 bp, Homo sapiens
ctactgcccaca

SEQ ID NO: 646128 - DNA, 15 bp, Homo sapiens
ctactgcccacattt

SEQ ID NO: 646129 - DNA, 19 bp, Homo sapiens
ctactggatgcttacagtg

SEQ ID NO: 646130 - DNA, 15 bp, Homo sapiens
ctacttaaacaaaaa

SEQ ID NO: 646131 - DNA, 16 bp, Homo sapiens
ctacttccctcaccca

SEQ ID NO: 646132 - DNA, 12 bp, Homo sapiens
ctactttaaatt

SEQ ID NO: 646133 - DNA, 14 bp, Homo sapiens
ctactttaaattgt

SEQ ID NO: 646134 - DNA, 19 bp, Homo sapiens
ctactttaaattgtggatg

SEQ ID NO: 646135 - DNA, 20 bp, Homo sapiens
ctactttaaattgtggatga

SEQ ID NO: 646136 - DNA, 14 bp, Homo sapiens
ctagaatgagaaat

SEQ ID NO: 646137 - DNA, 16 bp, Homo sapiens
ctagaatgagaaatca

SEQ ID NO: 646138 - DNA, 17 bp, Homo sapiens
ctagaatgagaaatcat

SEQ ID NO: 646139 - DNA, 21 bp, Homo sapiens
ctagacagaaaccaagccatt

SEQ ID NO: 646140 - DNA, 23 bp, Homo sapiens
ctagatttggagactttgttcct

SEQ ID NO: 646141 - DNA, 19 bp, Homo sapiens
ctagcaataagttgaatga

SEQ ID NO: 646142 - DNA, 20 bp, Homo sapiens
ctagcaataagttgaatgat

SEQ ID NO: 646143 - DNA, 13 bp, Homo sapiens
ctagcccagtccc

SEQ ID NO: 646144 - DNA, 18 bp, Homo sapiens
ctagcccagtccctggag

SEQ ID NO: 646145 - DNA, 23 bp, Homo sapiens
ctagccctctttctctctgtgtg

SEQ ID NO: 646146 - DNA, 13 bp, Homo sapiens
ctaggcagggagg

SEQ ID NO: 646147 - DNA, 17 bp, Homo sapiens
ctaggcagggagggggc

SEQ ID NO: 646148 - DNA, 13 bp, Homo sapiens
ctaggtctccacc

SEQ ID NO: 646149 - DNA, 14 bp, Homo sapiens
ctaggtctccaccc

SEQ ID NO: 646150 - DNA, 19 bp, Homo sapiens
ctagtgccattatttctac

SEQ ID NO: 646151 - DNA, 21 bp, Homo sapiens
ctagtgtagcttctgaaaggt

SEQ ID NO: 646152 - DNA, 21 bp, Homo sapiens
ctagttagagactcgcctggg

SEQ ID NO: 646153 - DNA, 21 bp, Homo sapiens
ctagttctgctgccctcttaa

SEQ ID NO: 646154 - DNA, 17 bp, Homo sapiens
ctataaatagtgaaaat

SEQ ID NO: 646155 - DNA, 19 bp, Homo sapiens
ctataaatagtgaaaattt

SEQ ID NO: 646156 - DNA, 16 bp, Homo sapiens
ctatataatttttcct

SEQ ID NO: 646157 - DNA, 20 bp, Homo sapiens
ctatattccgggtgccattc

SEQ ID NO: 646158 - DNA, 13 bp, Homo sapiens
ctatatttactgt

SEQ ID NO: 646159 - DNA, 22 bp, Homo sapiens
ctatatttggattcacagcctt

SEQ ID NO: 646160 - DNA, 23 bp, Homo sapiens
ctatatttggattcacagccttt

SEQ ID NO: 646161 - DNA, 22 bp, Homo sapiens
ctatccctggacgcatgcaggg

SEQ ID NO: 646162 - DNA, 17 bp, Homo sapiens
ctatcctgcaccctctg

SEQ ID NO: 646163 - DNA, 20 bp, Homo sapiens
ctatctcccacaaataagtt

SEQ ID NO: 646164 - DNA, 12 bp, Homo sapiens
ctatctggaaaa

SEQ ID NO: 646165 - DNA, 16 bp, Homo sapiens
ctatctttcaggaaat

SEQ ID NO: 646166 - DNA, 15 bp, Homo sapiens
ctatgcacaccaaat

SEQ ID NO: 646167 - DNA, 22 bp, Homo sapiens
ctatgcacaccaaattgctgag

SEQ ID NO: 646168 - DNA, 21 bp, Homo sapiens
ctatggaaagggtgtggcttg

SEQ ID NO: 646169 - DNA, 15 bp, Homo sapiens
ctatgtctcatgttt

SEQ ID NO: 646170 - DNA, 13 bp, Homo sapiens
ctatgtctgtgat

SEQ ID NO: 646171 - DNA, 21 bp, Homo sapiens
ctattagcttactgattaact

SEQ ID NO: 646172 - DNA, 18 bp, Homo sapiens
ctattcattacatcctct

SEQ ID NO: 646173 - DNA, 22 bp, Homo sapiens
ctattcattacatcctctgctt

SEQ ID NO: 646174 - DNA, 15 bp, Homo sapiens
ctattcgtaagttct

SEQ ID NO: 646175 - DNA, 21 bp, Homo sapiens
ctattggcatggatttccttt

SEQ ID NO: 646176 - DNA, 19 bp, Homo sapiens
ctatttaagtggactgtat

SEQ ID NO: 646177 - DNA, 21 bp, Homo sapiens
ctatttaagtggactgtattt

SEQ ID NO: 646178 - DNA, 14 bp, Homo sapiens
ctatttattaaaac

SEQ ID NO: 646179 - DNA, 18 bp, Homo sapiens
ctatttcaacttcaggaa

SEQ ID NO: 646180 - DNA, 12 bp, Homo sapiens
ctatttctgctg

SEQ ID NO: 646181 - DNA, 20 bp, Homo sapiens
ctatttctgctgaattttca

SEQ ID NO: 646182 - DNA, 20 bp, Homo sapiens
ctatttgtgtaactgaaagg

SEQ ID NO: 646183 - DNA, 13 bp, Homo sapiens
ctatttgtttcat

SEQ ID NO: 646184 - DNA, 13 bp, Homo sapiens
ctcaaaatgtgcc

SEQ ID NO: 646185 - DNA, 21 bp, Homo sapiens
ctcaaaatgtggaccagttcc

SEQ ID NO: 646186 - DNA, 18 bp, Homo sapiens
ctctctgaactgcaacac

SEQ ID NO: 646187 - DNA, 22 bp, Homo sapiens
ctctctggaaggttttgcttct

SEQ ID NO: 646188 - DNA, 21 bp, Homo sapiens
ctctctgtgtggcaaacattt

SEQ ID NO: 646189 - DNA, 22 bp, Homo sapiens
ctctctgtgtggcaaacattta

SEQ ID NO: 646190 - DNA, 13 bp, Homo sapiens
ctctctgttccaa

SEQ ID NO: 646191 - DNA, 19 bp, Homo sapiens
ctctctgttccaagtgtgt

SEQ ID NO: 646192 - DNA, 24 bp, Homo sapiens
ctctctgttccaagtgtgtgtgca

SEQ ID NO: 646193 - DNA, 12 bp, Homo sapiens
ctctctgtttac

SEQ ID NO: 646194 - DNA, 15 bp, Homo sapiens
ctctctgtttaccct

SEQ ID NO: 646195 - DNA, 21 bp, Homo sapiens
ctctctgtttaccctccctgt

SEQ ID NO: 646196 - DNA, 20 bp, Homo sapiens
ctctcttaccccgtcccttt

SEQ ID NO: 646197 - DNA, 13 bp, Homo sapiens
ctctgaagtccct

SEQ ID NO: 646198 - DNA, 17 bp, Homo sapiens
ctctgaagtcccttcct

SEQ ID NO: 646199 - DNA, 23 bp, Homo sapiens
ctctgaagtcccttcctgtcctg

SEQ ID NO: 646200 - DNA, 18 bp, Homo sapiens
ctctgaataccaagtgtg

SEQ ID NO: 646201 - DNA, 22 bp, Homo sapiens
ctctgaataccaagtgtgttgg

SEQ ID NO: 646202 - DNA, 15 bp, Homo sapiens
ctctgagcagtgggg

SEQ ID NO: 646203 - DNA, 18 bp, Homo sapiens
ctctgagcagtggggagc

SEQ ID NO: 646204 - DNA, 20 bp, Homo sapiens
ctctgaggacagaggccggg

SEQ ID NO: 646205 - DNA, 15 bp, Homo sapiens
ctctgagtgttgaag

SEQ ID NO: 646206 - DNA, 14 bp, Homo sapiens
ctctgcagcctgag

SEQ ID NO: 646207 - DNA, 15 bp, Homo sapiens
ctctgcagcctgagc

SEQ ID NO: 646208 - DNA, 17 bp, Homo sapiens
ctctgcagcctgagctc

SEQ ID NO: 646209 - DNA, 18 bp, Homo sapiens
ctctgcagcctgagctcc

SEQ ID NO: 646210 - DNA, 23 bp, Homo sapiens
ctctgcagcctgagctccaccct

SEQ ID NO: 646211 - DNA, 19 bp, Homo sapiens
ctctgcataagattatata

SEQ ID NO: 646212 - DNA, 20 bp, Homo sapiens
ctctgccccctcccccgcag

SEQ ID NO: 646213 - DNA, 10 bp, Homo sapiens
ctctgcccct

SEQ ID NO: 646214 - DNA, 19 bp, Homo sapiens
ctctgcccctcttccctgg

SEQ ID NO: 646215 - DNA, 20 bp, Homo sapiens
ctctggccttggttcctcca

SEQ ID NO: 646216 - DNA, 15 bp, Homo sapiens
ctctggggcttgcta

SEQ ID NO: 646217 - DNA, 19 bp, Homo sapiens
ctctgtacgaggcttctct

SEQ ID NO: 646218 - DNA, 20 bp, Homo sapiens
ctctgtgctaagttgtctta

SEQ ID NO: 646219 - DNA, 12 bp, Homo sapiens
ctctgtgtggca

SEQ ID NO: 646220 - DNA, 15 bp, Homo sapiens
ctctgtgtggcaaac

SEQ ID NO: 646221 - DNA, 11 bp, Homo sapiens
ctctgttccaa

SEQ ID NO: 646222 - DNA, 12 bp, Homo sapiens
ctctgttccaag

SEQ ID NO: 646223 - DNA, 21 bp, Homo sapiens
ctctgttccaagtgtgtgtgc

SEQ ID NO: 646224 - DNA, 17 bp, Homo sapiens
ctctgtttaccctccct

SEQ ID NO: 646225 - DNA, 21 bp, Homo sapiens
ctctgtttaccctccctgtcc

SEQ ID NO: 646226 - DNA, 14 bp, Homo sapiens
ctcttaccccgtcc

SEQ ID NO: 646227 - DNA, 23 bp, Homo sapiens
ctcttaccccgtccctttccctg

SEQ ID NO: 646228 - DNA, 13 bp, Homo sapiens
ctcttcccccttc

SEQ ID NO: 646229 - DNA, 21 bp, Homo sapiens
ctcttctacaatacaacacat

SEQ ID NO: 646230 - DNA, 20 bp, Homo sapiens
ctcttcttccttttgtatcc

SEQ ID NO: 646231 - DNA, 22 bp, Homo sapiens
ctcttcttgcggcaccgcccac

SEQ ID NO: 646232 - DNA, 23 bp, Homo sapiens
ctcttcttgcggcaccgcccacc

SEQ ID NO: 646233 - DNA, 16 bp, Homo sapiens
ctcttcttttcccatt

SEQ ID NO: 646234 - DNA, 15 bp, Homo sapiens
ctcttgctcagagct

SEQ ID NO: 646235 - DNA, 21 bp, Homo sapiens
ctcttgctgtttaccgcccac

SEQ ID NO: 646236 - DNA, 18 bp, Homo sapiens
ctcttggtctctttcttt

SEQ ID NO: 646237 - DNA, 22 bp, Homo sapiens
ctcttggtctctttctttccaa

SEQ ID NO: 646238 - DNA, 18 bp, Homo sapiens
ctctttctctctgtgtgg

SEQ ID NO: 646239 - DNA, 22 bp, Homo sapiens
ctctttcttttgtgcatatggc

SEQ ID NO: 646240 - DNA, 17 bp, Homo sapiens
ctcttttgctctctcat

SEQ ID NO: 646241 - DNA, 16 bp, Homo sapiens
ctgaaaaagtgttttt

SEQ ID NO: 646242 - DNA, 21 bp, Homo sapiens
ctgaaaaagtgtttttacata

SEQ ID NO: 646243 - DNA, 23 bp, Homo sapiens
ctgaaaaagtgtttttacatata

SEQ ID NO: 646244 - DNA, 23 bp, Homo sapiens
ctgaaataaaagcctctggtgga

SEQ ID NO: 646245 - DNA, 16 bp, Homo sapiens
ctgaaatattttctac

SEQ ID NO: 646246 - DNA, 13 bp, Homo sapiens
ctgaaatctacaa

SEQ ID NO: 646247 - DNA, 17 bp, Homo sapiens
ctgaaattagtgttttc

SEQ ID NO: 646248 - DNA, 19 bp, Homo sapiens
ctgaaattagtgttttcat

SEQ ID NO: 646249 - DNA, 18 bp, Homo sapiens
ctgaaattatgtcaaatg

SEQ ID NO: 646250 - DNA, 23 bp, Homo sapiens
ctgaaattatgtcaaatggatgt

SEQ ID NO: 646251 - DNA, 12 bp, Homo sapiens
ctgaacactcat

SEQ ID NO: 646252 - DNA, 16 bp, Homo sapiens
ctgaacatagttttca

SEQ ID NO: 646253 - DNA, 16 bp, Homo sapiens
ctgaactgcaacactg

SEQ ID NO: 646254 - DNA, 12 bp, Homo sapiens
ctgaagaaacac

SEQ ID NO: 646255 - DNA, 16 bp, Homo sapiens
ctgaagaaacacagca

SEQ ID NO: 646256 - DNA, 18 bp, Homo sapiens
ctgaagaaacacagcatg

SEQ ID NO: 646257 - DNA, 19 bp, Homo sapiens
ctgaagaaacacagcatgc

SEQ ID NO: 646258 - DNA, 14 bp, Homo sapiens
ctgaagcagagtca

SEQ ID NO: 646259 - DNA, 20 bp, Homo sapiens
ctgaagcagagtcaagctga

SEQ ID NO: 646260 - DNA, 22 bp, Homo sapiens
ctgaagcctggattccagcagt

SEQ ID NO: 646261 - DNA, 14 bp, Homo sapiens
ctgaaggagaggag

SEQ ID NO: 646262 - DNA, 15 bp, Homo sapiens
ctgaaggagaggagt

SEQ ID NO: 646263 - DNA, 20 bp, Homo sapiens
ctgaagtcccttcctgtcct

SEQ ID NO: 646264 - DNA, 17 bp, Homo sapiens
ctgaataccaagtgtgt

SEQ ID NO: 646265 - DNA, 16 bp, Homo sapiens
ctgaatcagaggcaga

SEQ ID NO: 646266 - DNA, 20 bp, Homo sapiens
ctgaatctctcaaaatgtgc

SEQ ID NO: 646267 - DNA, 19 bp, Homo sapiens
ctgaattgctatcatttgg

SEQ ID NO: 646268 - DNA, 17 bp, Homo sapiens
ctgaattgttatgtaaa

SEQ ID NO: 646269 - DNA, 20 bp, Homo sapiens
ctgaatttggggctacttat

SEQ ID NO: 646270 - DNA, 20 bp, Homo sapiens
ctgaattttcacatgaacat

SEQ ID NO: 646271 - DNA, 20 bp, Homo sapiens
ctgacaccctttaatgttct

SEQ ID NO: 646272 - DNA, 15 bp, Homo sapiens
ctgacaccttttcag

SEQ ID NO: 646273 - DNA, 16 bp, Homo sapiens
ctgacactcagatgcc

SEQ ID NO: 646274 - DNA, 15 bp, Homo sapiens
ctgacagcaaacaca

SEQ ID NO: 646275 - DNA, 21 bp, Homo sapiens
ctgacatgctaacctctctga

SEQ ID NO: 646276 - DNA, 13 bp, Homo sapiens
ctgaccttctgcg

SEQ ID NO: 646277 - DNA, 16 bp, Homo sapiens
ctgactcagtgcaggg

SEQ ID NO: 646278 - DNA, 21 bp, Homo sapiens
ctgactcagtgcagggacagc

SEQ ID NO: 646279 - DNA, 23 bp, Homo sapiens
ctgactcagtgcagggacagcct

SEQ ID NO: 646280 - DNA, 13 bp, Homo sapiens
ctgactccagtgg

SEQ ID NO: 646281 - DNA, 18 bp, Homo sapiens
ctgactgtgttcagtgcc

SEQ ID NO: 646282 - DNA, 21 bp, Homo sapiens
ctgactgtttacacctttccg

SEQ ID NO: 646283 - DNA, 19 bp, Homo sapiens
ctgacttcccagctggcag

SEQ ID NO: 646284 - DNA, 21 bp, Homo sapiens
ctgagaatccccgtgctcaca

SEQ ID NO: 646285 - DNA, 22 bp, Homo sapiens
ctgagaatccccgtgctcacag

SEQ ID NO: 646286 - DNA, 12 bp, Homo sapiens
ctgagaatgtgc

SEQ ID NO: 646287 - DNA, 19 bp, Homo sapiens
ctgagacagagagccaagc

SEQ ID NO: 646288 - DNA, 20 bp, Homo sapiens
ctgagactcgcgacaatgca

SEQ ID NO: 646289 - DNA, 22 bp, Homo sapiens
ctgagcagacagggcgtcctct

SEQ ID NO: 646290 - DNA, 18 bp, Homo sapiens
ctgagcagatcgtgccgt

SEQ ID NO: 646291 - DNA, 20 bp, Homo sapiens
ctgagcagatcgtgccgtgg

SEQ ID NO: 646292 - DNA, 14 bp, Homo sapiens
ctgagcagtgggga

SEQ ID NO: 646293 - DNA, 21 bp, Homo sapiens
ctgagccacagtggggcccat

SEQ ID NO: 646294 - DNA, 14 bp, Homo sapiens
ctgagccagatttc

SEQ ID NO: 646295 - DNA, 15 bp, Homo sapiens
ctgagccagatttca

SEQ ID NO: 646296 - DNA, 20 bp, Homo sapiens
ctgagccagatttcactctc

SEQ ID NO: 646297 - DNA, 16 bp, Homo sapiens
ctgagcccctcctctc

SEQ ID NO: 646298 - DNA, 12 bp, Homo sapiens
ctgagccctgcc

SEQ ID NO: 646299 - DNA, 16 bp, Homo sapiens
ctgagcctgacctttc

SEQ ID NO: 646300 - DNA, 17 bp, Homo sapiens
ctgagctccaccctccc

SEQ ID NO: 646301 - DNA, 19 bp, Homo sapiens
ctgagctccaccctcccct

SEQ ID NO: 646302 - DNA, 12 bp, Homo sapiens
ctgggccaggga

SEQ ID NO: 646303 - DNA, 17 bp, Homo sapiens
ctgggcccaggcccagc

SEQ ID NO: 646304 - DNA, 18 bp, Homo sapiens
ctgggcccaggcccagcc

SEQ ID NO: 646305 - DNA, 19 bp, Homo sapiens
ctgggcccaggcccagcct

SEQ ID NO: 646306 - DNA, 18 bp, Homo sapiens
ctgggccctctgtccaca

SEQ ID NO: 646307 - DNA, 23 bp, Homo sapiens
ctgggccggggtgtggaatcacc

SEQ ID NO: 646308 - DNA, 18 bp, Homo sapiens
ctgggcgccggttccacg

SEQ ID NO: 646309 - DNA, 22 bp, Homo sapiens
ctgggcgccggttccacgtggg

SEQ ID NO: 646310 - DNA, 19 bp, Homo sapiens
ctgggctgctggggcaggg

SEQ ID NO: 646311 - DNA, 22 bp, Homo sapiens
ctgggctgttgtgtctggagcc

SEQ ID NO: 646312 - DNA, 15 bp, Homo sapiens
ctggggaccaggagc

SEQ ID NO: 646313 - DNA, 18 bp, Homo sapiens
ctggggaccaggagctag

SEQ ID NO: 646314 - DNA, 15 bp, Homo sapiens
ctggggaggacccct

SEQ ID NO: 646315 - DNA, 17 bp, Homo sapiens
ctggggaggacccctgc

SEQ ID NO: 646316 - DNA, 21 bp, Homo sapiens
ctggggagggacacagaggac

SEQ ID NO: 646317 - DNA, 14 bp, Homo sapiens
ctggggcagggccc

SEQ ID NO: 646318 - DNA, 16 bp, Homo sapiens
ctggggcagggcccag

SEQ ID NO: 646319 - DNA, 17 bp, Homo sapiens
ctggggcagggcccagg

SEQ ID NO: 646320 - DNA, 24 bp, Homo sapiens
ctgggggactgctttcagtgcctg

SEQ ID NO: 646321 - DNA, 20 bp, Homo sapiens
ctggggtctctgagcagtgg

SEQ ID NO: 646322 - DNA, 23 bp, Homo sapiens
ctggggtctctgagcagtgggga

SEQ ID NO: 646323 - DNA, 22 bp, Homo sapiens
ctggggtggttggaggcctggt

SEQ ID NO: 646324 - DNA, 13 bp, Homo sapiens
ctgggtccccctc

SEQ ID NO: 646325 - DNA, 16 bp, Homo sapiens
ctgggtccccctcctg

SEQ ID NO: 646326 - DNA, 17 bp, Homo sapiens
ctgggtccccctcctgc

SEQ ID NO: 646327 - DNA, 19 bp, Homo sapiens
ctgggtccccctcctgcac

SEQ ID NO: 646328 - DNA, 15 bp, Homo sapiens
ctgggtcgcccctcc

SEQ ID NO: 646329 - DNA, 22 bp, Homo sapiens
ctgggtgtggcctggcttctgg

SEQ ID NO: 646330 - DNA, 15 bp, Homo sapiens
ctgggttctttggaa

SEQ ID NO: 646331 - DNA, 17 bp, Homo sapiens
ctgggttctttggaagc

SEQ ID NO: 646332 - DNA, 14 bp, Homo sapiens
ctgggtttgggcag

SEQ ID NO: 646333 - DNA, 19 bp, Homo sapiens
ctgggtttgggcagtggag

SEQ ID NO: 646334 - DNA, 20 bp, Homo sapiens
ctgggtttgggcagtggaga

SEQ ID NO: 646335 - DNA, 17 bp, Homo sapiens
ctgggttttagaaattc

SEQ ID NO: 646336 - DNA, 18 bp, Homo sapiens
ctggtaaaaagatccagg

SEQ ID NO: 646337 - DNA, 15 bp, Homo sapiens
ctggtcctgcactgt

SEQ ID NO: 646338 - DNA, 12 bp, Homo sapiens
ctggtctggagc

SEQ ID NO: 646339 - DNA, 21 bp, Homo sapiens
ctggtctggagcccctatcct

SEQ ID NO: 646340 - DNA, 20 bp, Homo sapiens
ctggtgcgtgtggccctgtg

SEQ ID NO: 646341 - DNA, 21 bp, Homo sapiens
ctggtgcgtgtggccctgtgg

SEQ ID NO: 646342 - DNA, 12 bp, Homo sapiens
ctggtggccctg

SEQ ID NO: 646343 - DNA, 14 bp, Homo sapiens
ctggtggccctgcg

SEQ ID NO: 646344 - DNA, 15 bp, Homo sapiens
ctggtggccctgcgg

SEQ ID NO: 646345 - DNA, 17 bp, Homo sapiens
ctggtgggataggaggg

SEQ ID NO: 646346 - DNA, 23 bp, Homo sapiens
ctgtaaaatacatggtatctctt

SEQ ID NO: 646347 - DNA, 17 bp, Homo sapiens
ctgtaaataaaaatagc

SEQ ID NO: 646348 - DNA, 17 bp, Homo sapiens
ctgtaatagcctcacct

SEQ ID NO: 646349 - DNA, 18 bp, Homo sapiens
ctgtaatagcctcacctt

SEQ ID NO: 646350 - DNA, 22 bp, Homo sapiens
ctgtaattcttctcctttgtca

SEQ ID NO: 646351 - DNA, 15 bp, Homo sapiens
ctgtacacacacaga

SEQ ID NO: 646352 - DNA, 17 bp, Homo sapiens
ctgtacacacacagaca

SEQ ID NO: 646353 - DNA, 12 bp, Homo sapiens
ctgtagctttaa

SEQ ID NO: 646354 - DNA, 19 bp, Homo sapiens
ctgtatacaaacaggtgct

SEQ ID NO: 646355 - DNA, 19 bp, Homo sapiens
ctgtattatcttaaaccca

SEQ ID NO: 646356 - DNA, 19 bp, Homo sapiens
ctgtattgttacagctgaa

SEQ ID NO: 646357 - DNA, 20 bp, Homo sapiens
ctgtcagcttcccaacaata

SEQ ID NO: 646358 - DNA, 21 bp, Homo sapiens
ctgtcagtttgtgaagtgatt

SEQ ID NO: 646359 - DNA, 20 bp, Homo sapiens
ctgtcatgtgcgaacacagt

SEQ ID NO: 646360 - DNA, 22 bp, Homo sapiens
ctgtcattggttacaaattttt

SEQ ID NO: 646361 - DNA, 17 bp, Homo sapiens
ctgtcccctgcaagtgg

SEQ ID NO: 646362 - DNA, 21 bp, Homo sapiens
ctgtcccggagctcaggccct

SEQ ID NO: 646363 - DNA, 18 bp, Homo sapiens
ctgtccctgtgggctcac

SEQ ID NO: 646364 - DNA, 23 bp, Homo sapiens
ctgtccctgtgggctcacaccgg

SEQ ID NO: 646365 - DNA, 16 bp, Homo sapiens
ctgtccgtctgtcctg

SEQ ID NO: 646366 - DNA, 17 bp, Homo sapiens
ctgtccgtctgtcctgc

SEQ ID NO: 646367 - DNA, 19 bp, Homo sapiens
ctgtccgtctgtcctgcgc

SEQ ID NO: 646368 - DNA, 17 bp, Homo sapiens
ctgtcctgcgcctgcgc

SEQ ID NO: 646369 - DNA, 22 bp, Homo sapiens
ctgtcctgctcacgtctgtgag

SEQ ID NO: 646370 - DNA, 14 bp, Homo sapiens
ctgtcctggctccc

SEQ ID NO: 646371 - DNA, 16 bp, Homo sapiens
ctgtcctggctcccag

SEQ ID NO: 646372 - DNA, 15 bp, Homo sapiens
ctgtctatttctgct

SEQ ID NO: 646373 - DNA, 18 bp, Homo sapiens
ctgtctatttctgctgaa

SEQ ID NO: 646374 - DNA, 16 bp, Homo sapiens
ctgtctcctctgtcag

SEQ ID NO: 646375 - DNA, 11 bp, Homo sapiens
ctgtctctctt

SEQ ID NO: 646376 - DNA, 18 bp, Homo sapiens
ctgtctgagccctgccct

SEQ ID NO: 646377 - DNA, 20 bp, Homo sapiens
ctgtctgagccctgccctca

SEQ ID NO: 646378 - DNA, 19 bp, Homo sapiens
ctgtctgtcccagttaact

SEQ ID NO: 646379 - DNA, 19 bp, Homo sapiens
ctgtctgtgtgaggctccc

SEQ ID NO: 646380 - DNA, 15 bp, Homo sapiens
ctgtcttcaaccctg

SEQ ID NO: 646381 - DNA, 16 bp, Homo sapiens
ctgtcttcaaccctgc

SEQ ID NO: 646382 - DNA, 18 bp, Homo sapiens
ctgtcttcaaccctgccc

SEQ ID NO: 646383 - DNA, 19 bp, Homo sapiens
ctgtcttcaaccctgccct

SEQ ID NO: 646384 - DNA, 20 bp, Homo sapiens
ctgtcttcaaccctgccctg

SEQ ID NO: 646385 - DNA, 23 bp, Homo sapiens
ctgtcttcaaccctgccctgcac

SEQ ID NO: 646386 - DNA, 17 bp, Homo sapiens
ctgtctttatgatttca

SEQ ID NO: 646387 - DNA, 18 bp, Homo sapiens
ctgtgaaagtctcctgta

SEQ ID NO: 646388 - DNA, 16 bp, Homo sapiens
ctgtgaactaatgaca

SEQ ID NO: 646389 - DNA, 21 bp, Homo sapiens
ctgtgaccctcaattcatatt

SEQ ID NO: 646390 - DNA, 14 bp, Homo sapiens
ctgtgacctgctcc

SEQ ID NO: 646391 - DNA, 19 bp, Homo sapiens
ctgtgacctgctcctgccc

SEQ ID NO: 646392 - DNA, 21 bp, Homo sapiens
ctgtgacctgctcctgcccac

SEQ ID NO: 646393 - DNA, 15 bp, Homo sapiens
ctgtgagtctgtcct

SEQ ID NO: 646394 - DNA, 19 bp, Homo sapiens
ctgtgatcgtgtgttgcca

SEQ ID NO: 646395 - DNA, 16 bp, Homo sapiens
ctgtgcagtttggtat

SEQ ID NO: 646396 - DNA, 22 bp, Homo sapiens
ctgtgcagtttggtatgaaaca

SEQ ID NO: 646397 - DNA, 15 bp, Homo sapiens
ctgtgcatctggcct

SEQ ID NO: 646398 - DNA, 23 bp, Homo sapiens
ctgtgcatctggcctgggggctg

SEQ ID NO: 646399 - DNA, 17 bp, Homo sapiens
ctgtgcccacgtgtgca

SEQ ID NO: 646400 - DNA, 13 bp, Homo sapiens
ctgtgccctctca

SEQ ID NO: 646401 - DNA, 18 bp, Homo sapiens
ctgtgccctctcactgac

SEQ ID NO: 646402 - DNA, 18 bp, Homo sapiens
ctgtgcctttgggaggca

SEQ ID NO: 646403 - DNA, 15 bp, Homo sapiens
ctgtgcgccttgtag

SEQ ID NO: 646404 - DNA, 15 bp, Homo sapiens
ctgtgctaagttgtc

SEQ ID NO: 646405 - DNA, 18 bp, Homo sapiens
ctgtgctaagttgtctta

SEQ ID NO: 646406 - DNA, 12 bp, Homo sapiens
ctgtgctttccg

SEQ ID NO: 646407 - DNA, 11 bp, Homo sapiens
ctgtggataaa

SEQ ID NO: 646408 - DNA, 21 bp, Homo sapiens
ctgtggataaattttggaaga

SEQ ID NO: 646409 - DNA, 21 bp, Homo sapiens
ctgtggcccctccttctcccc

SEQ ID NO: 646410 - DNA, 20 bp, Homo sapiens
ctgtggctgatttactaaca

SEQ ID NO: 646411 - DNA, 21 bp, Homo sapiens
ctgtgggactggcccacccct

SEQ ID NO: 646412 - DNA, 14 bp, Homo sapiens
ctgtgggagtccac

SEQ ID NO: 646413 - DNA, 19 bp, Homo sapiens
ctgtgggagtccactttcc

SEQ ID NO: 646414 - DNA, 20 bp, Homo sapiens
ctgtgggagtccactttcct

SEQ ID NO: 646415 - DNA, 21 bp, Homo sapiens
ctgtgggagtccactttcctc

SEQ ID NO: 646416 - DNA, 23 bp, Homo sapiens
ctgtgggagtccactttcctctc

SEQ ID NO: 646417 - DNA, 19 bp, Homo sapiens
ctttatcatgtgtttctgt

SEQ ID NO: 646418 - DNA, 16 bp, Homo sapiens
ctttatgatttcatga

SEQ ID NO: 646419 - DNA, 14 bp, Homo sapiens
ctttcaataggaaa

SEQ ID NO: 646420 - DNA, 15 bp, Homo sapiens
ctttcaataggaaaa

SEQ ID NO: 646421 - DNA, 21 bp, Homo sapiens
ctttcaataggaaaaactgat

SEQ ID NO: 646422 - DNA, 15 bp, Homo sapiens
ctttcaatccacagt

SEQ ID NO: 646423 - DNA, 16 bp, Homo sapiens
ctttcaatccacagta

SEQ ID NO: 646424 - DNA, 19 bp, Homo sapiens
ctttcaatccacagtattg

SEQ ID NO: 646425 - DNA, 15 bp, Homo sapiens
ctttcagtgcctgct

SEQ ID NO: 646426 - DNA, 14 bp, Homo sapiens
ctttccaacacaca

SEQ ID NO: 646427 - DNA, 11 bp, Homo sapiens
ctttcccacac

SEQ ID NO: 646428 - DNA, 13 bp, Homo sapiens
ctttccccagtgt

SEQ ID NO: 646429 - DNA, 18 bp, Homo sapiens
ctttccccattcagtgac

SEQ ID NO: 646430 - DNA, 19 bp, Homo sapiens
ctttccccattcagtgaca

SEQ ID NO: 646431 - DNA, 23 bp, Homo sapiens
ctttcccgatgcgtggctcccag

SEQ ID NO: 646432 - DNA, 14 bp, Homo sapiens
ctttccctgcatcc

SEQ ID NO: 646433 - DNA, 14 bp, Homo sapiens
ctttcctctctctc

SEQ ID NO: 646434 - DNA, 14 bp, Homo sapiens
ctttcggaaatgat

SEQ ID NO: 646435 - DNA, 10 bp, Homo sapiens
ctttctcatg

SEQ ID NO: 646436 - DNA, 14 bp, Homo sapiens
ctttctccaaagtt

SEQ ID NO: 646437 - DNA, 20 bp, Homo sapiens
ctttctccaaagttatccag

SEQ ID NO: 646438 - DNA, 14 bp, Homo sapiens
ctttctctctgtgt

SEQ ID NO: 646439 - DNA, 15 bp, Homo sapiens
ctttctcttgctgtt

SEQ ID NO: 646440 - DNA, 17 bp, Homo sapiens
ctttctgagtgacatgg

SEQ ID NO: 646441 - DNA, 22 bp, Homo sapiens
ctttctgatacatctgtcagtg

SEQ ID NO: 646442 - DNA, 20 bp, Homo sapiens
ctttctggaaaaacaggata

SEQ ID NO: 646443 - DNA, 17 bp, Homo sapiens
ctttctgttatctagaa

SEQ ID NO: 646444 - DNA, 13 bp, Homo sapiens
ctttcttccttcc

SEQ ID NO: 646445 - DNA, 19 bp, Homo sapiens
ctttctttccaaaggttgt

SEQ ID NO: 646446 - DNA, 18 bp, Homo sapiens
ctttcttttgtgttggat

SEQ ID NO: 646447 - DNA, 17 bp, Homo sapiens
ctttgagtgtcaggctc

SEQ ID NO: 646448 - DNA, 20 bp, Homo sapiens
ctttgatatgttgatgaaat

SEQ ID NO: 646449 - DNA, 23 bp, Homo sapiens
ctttgcaaccttgtactttacaa

SEQ ID NO: 646450 - DNA, 17 bp, Homo sapiens
ctttgcgctctgggttt

SEQ ID NO: 646451 - DNA, 13 bp, Homo sapiens
ctttgctgtttat

SEQ ID NO: 646452 - DNA, 20 bp, Homo sapiens
ctttggaaaccaccttaaaa

SEQ ID NO: 646453 - DNA, 14 bp, Homo sapiens
ctttggaagcagca

SEQ ID NO: 646454 - DNA, 21 bp, Homo sapiens
ctttggaagcagcaaggtggg

SEQ ID NO: 646455 - DNA, 20 bp, Homo sapiens
ctttggaattctgcttctct

SEQ ID NO: 646456 - DNA, 16 bp, Homo sapiens
ctttggcttaattcca

SEQ ID NO: 646457 - DNA, 21 bp, Homo sapiens
ctttggcttaattccaatcat

SEQ ID NO: 646458 - DNA, 15 bp, Homo sapiens
ctttggggacaccct

SEQ ID NO: 646459 - DNA, 19 bp, Homo sapiens
ctttggggacaccctcctg

SEQ ID NO: 646460 - DNA, 17 bp, Homo sapiens
ctttggggcttatcaga

SEQ ID NO: 646461 - DNA, 13 bp, Homo sapiens
ctttgtcaaatgg

SEQ ID NO: 646462 - DNA, 14 bp, Homo sapiens
ctttgtgcttgttc

SEQ ID NO: 646463 - DNA, 21 bp, Homo sapiens
ctttgttgcttaatctagagc

SEQ ID NO: 646464 - DNA, 12 bp, Homo sapiens
cttttaaaaaaa

SEQ ID NO: 646465 - DNA, 18 bp, Homo sapiens
cttttaaaaaaataatat

SEQ ID NO: 646466 - DNA, 17 bp, Homo sapiens
cttttaagattgtactt

SEQ ID NO: 646467 - DNA, 13 bp, Homo sapiens
cttttataaatgt

SEQ ID NO: 646468 - DNA, 14 bp, Homo sapiens
cttttataaatgtt

SEQ ID NO: 646469 - DNA, 21 bp, Homo sapiens
cttttataaatgttttaaaga

SEQ ID NO: 646470 - DNA, 20 bp, Homo sapiens
cttttcctacggtacaagct

SEQ ID NO: 646471 - DNA, 13 bp, Homo sapiens
cttttctcatggt

SEQ ID NO: 646472 - DNA, 14 bp, Homo sapiens
cttttctcatggta

SEQ ID NO: 646473 - DNA, 17 bp, Homo sapiens
cttttgatggctatgtt

SEQ ID NO: 646474 - DNA, 15 bp, Homo sapiens
cttttgggaaatgct

SEQ ID NO: 646475 - DNA, 22 bp, Homo sapiens
cttttgtacgttaattaaacaa

SEQ ID NO: 646476 - DNA, 14 bp, Homo sapiens
cttttgtatcctcc

SEQ ID NO: 646477 - DNA, 16 bp, Homo sapiens
cttttgttctctcttg

SEQ ID NO: 646478 - DNA, 20 bp, Homo sapiens
ctttttattaggttaagtct

SEQ ID NO: 646479 - DNA, 11 bp, Homo sapiens
ctttttctgac

SEQ ID NO: 646480 - DNA, 15 bp, Homo sapiens
ctttttgtgagaaag

SEQ ID NO: 646481 - DNA, 14 bp, Homo sapiens
cttttttaaaaaaa

SEQ ID NO: 646482 - DNA, 20 bp, Homo sapiens
cttttttataaattataatg

SEQ ID NO: 646483 - DNA, 14 bp, Homo sapiens
cttttttatacaca

SEQ ID NO: 646484 - DNA, 12 bp, Homo sapiens
cttttttcctgt

SEQ ID NO: 646485 - DNA, 17 bp, Homo sapiens
cttttttcctgtcaata

SEQ ID NO: 646486 - DNA, 22 bp, Homo sapiens
cttttttcctgtcaatatatag

SEQ ID NO: 646487 - DNA, 14 bp, Homo sapiens
ctttttttaagtgt

SEQ ID NO: 646488 - DNA, 22 bp, Homo sapiens
ctttttttaagtgttctgtggc

SEQ ID NO: 646489 - DNA, 14 bp, Homo sapiens
ctttttttctctcc

SEQ ID NO: 646490 - DNA, 17 bp, Homo sapiens
gaaaaaaaaaagtaatt

SEQ ID NO: 646491 - DNA, 14 bp, Homo sapiens
gaaaaaactggaaa

SEQ ID NO: 646492 - DNA, 16 bp, Homo sapiens
gaaaaaactggaaaca

SEQ ID NO: 646493 - DNA, 18 bp, Homo sapiens
gaaaaaagtgcaacttga

SEQ ID NO: 646494 - DNA, 13 bp, Homo sapiens
gaaaaagtgtttt

SEQ ID NO: 646495 - DNA, 16 bp, Homo sapiens
gaaaaagtgtttttac

SEQ ID NO: 646496 - DNA, 13 bp, Homo sapiens
gaaaaatctgaat

SEQ ID NO: 646497 - DNA, 12 bp, Homo sapiens
gaaaacattgtt

SEQ ID NO: 646498 - DNA, 12 bp, Homo sapiens
gaaaacctcagt

SEQ ID NO: 646499 - DNA, 15 bp, Homo sapiens
gaaaacgtggctgct

SEQ ID NO: 646500 - DNA, 16 bp, Homo sapiens
gaaaacgtggctgctt

SEQ ID NO: 646501 - DNA, 15 bp, Homo sapiens
gaaaagagaaacact

SEQ ID NO: 646502 - DNA, 20 bp, Homo sapiens
gaaaaggctgcagctaattt

SEQ ID NO: 646503 - DNA, 23 bp, Homo sapiens
gaaaatatatattaaaattgatt

SEQ ID NO: 646504 - DNA, 13 bp, Homo sapiens
gaaaatatatttg

SEQ ID NO: 646505 - DNA, 13 bp, Homo sapiens
gaaaatgctttct

SEQ ID NO: 646506 - DNA, 17 bp, Homo sapiens
gaaaattttcttcttta

SEQ ID NO: 646507 - DNA, 12 bp, Homo sapiens
gaaacaaggaag

SEQ ID NO: 646508 - DNA, 13 bp, Homo sapiens
gaaacaaggaagg

SEQ ID NO: 646509 - DNA, 20 bp, Homo sapiens
gaaacacggagtttccattt

SEQ ID NO: 646510 - DNA, 15 bp, Homo sapiens
gaaacagagaaccct

SEQ ID NO: 646511 - DNA, 14 bp, Homo sapiens
gaaacagtttaaca

SEQ ID NO: 646512 - DNA, 12 bp, Homo sapiens
gaaaccttggag

SEQ ID NO: 646513 - DNA, 17 bp, Homo sapiens
gaaaccttttaaaaaaa

SEQ ID NO: 646514 - DNA, 20 bp, Homo sapiens
gaaaccttttaaaaaaataa

SEQ ID NO: 646515 - DNA, 12 bp, Homo sapiens
gaaactctccat

SEQ ID NO: 646516 - DNA, 16 bp, Homo sapiens
gaaactgacttgctgt

SEQ ID NO: 646517 - DNA, 18 bp, Homo sapiens
gaaactttggaagtttta

SEQ ID NO: 646518 - DNA, 11 bp, Homo sapiens
gaaagaggaat

SEQ ID NO: 646519 - DNA, 19 bp, Homo sapiens
gaaagaggaataaaatgat

SEQ ID NO: 646520 - DNA, 14 bp, Homo sapiens
gaaagatcccaagt

SEQ ID NO: 646521 - DNA, 18 bp, Homo sapiens
gaaagcctcactgatata

SEQ ID NO: 646522 - DNA, 18 bp, Homo sapiens
gaaaggcagccctcacct

SEQ ID NO: 646523 - DNA, 18 bp, Homo sapiens
gaaagggcagcccctccc

SEQ ID NO: 646524 - DNA, 20 bp, Homo sapiens
gaaagtactgcatgatctta

SEQ ID NO: 646525 - DNA, 15 bp, Homo sapiens
gaaataaaagcctct

SEQ ID NO: 646526 - DNA, 15 bp, Homo sapiens
gaaataaatctaaat

SEQ ID NO: 646527 - DNA, 19 bp, Homo sapiens
gaaatagaataggcaaact

SEQ ID NO: 646528 - DNA, 20 bp, Homo sapiens
gaaatagttccattctatga

SEQ ID NO: 646529 - DNA, 14 bp, Homo sapiens
gaaatataaactgt

SEQ ID NO: 646530 - DNA, 15 bp, Homo sapiens
gaaatataaactgtg

SEQ ID NO: 646531 - DNA, 22 bp, Homo sapiens
gaaatataaactgtgagataaa

SEQ ID NO: 646532 - DNA, 14 bp, Homo sapiens
gaaatccaaaatag

SEQ ID NO: 646533 - DNA, 17 bp, Homo sapiens
gaaatgaaaatggctga

SEQ ID NO: 646534 - DNA, 21 bp, Homo sapiens
gaaatgaaaatggctgaagaa

SEQ ID NO: 646535 - DNA, 15 bp, Homo sapiens
gacttctggagatgg

SEQ ID NO: 646536 - DNA, 21 bp, Homo sapiens
gacttggtgattacctgaaag

SEQ ID NO: 646537 - DNA, 18 bp, Homo sapiens
gactttggggacaccctc

SEQ ID NO: 646538 - DNA, 21 bp, Homo sapiens
gactttggggacaccctcctg

SEQ ID NO: 646539 - DNA, 22 bp, Homo sapiens
gactttggggacaccctcctgc

SEQ ID NO: 646540 - DNA, 12 bp, Homo sapiens
gacttttcccca

SEQ ID NO: 646541 - DNA, 15 bp, Homo sapiens
gagaaacagagatca

SEQ ID NO: 646542 - DNA, 21 bp, Homo sapiens
gagaaactcgggcactcccta

SEQ ID NO: 646543 - DNA, 16 bp, Homo sapiens
gagaaagtactttctg

SEQ ID NO: 646544 - DNA, 16 bp, Homo sapiens
gagaaattgtgccaaa

SEQ ID NO: 646545 - DNA, 23 bp, Homo sapiens
gagaaatttttttccagaattga

SEQ ID NO: 646546 - DNA, 19 bp, Homo sapiens
gagaagctagatgcccctg

SEQ ID NO: 646547 - DNA, 12 bp, Homo sapiens
gagaaggaggaa

SEQ ID NO: 646548 - DNA, 12 bp, Homo sapiens
gagaaggcctgc

SEQ ID NO: 646549 - DNA, 19 bp, Homo sapiens
gagaagggttctgccctgc

SEQ ID NO: 646550 - DNA, 13 bp, Homo sapiens
gagaatggctctg

SEQ ID NO: 646551 - DNA, 14 bp, Homo sapiens
gagaatggctctgg

SEQ ID NO: 646552 - DNA, 14 bp, Homo sapiens
gagacaacacacac

SEQ ID NO: 646553 - DNA, 22 bp, Homo sapiens
gagacaacacacacacacacaa

SEQ ID NO: 646554 - DNA, 22 bp, Homo sapiens
gagaccaccgcgcccctctgcg

SEQ ID NO: 646555 - DNA, 23 bp, Homo sapiens
gagaccaccgcgcccctctgcgc

SEQ ID NO: 646556 - DNA, 18 bp, Homo sapiens
gagaccacttccttaaca

SEQ ID NO: 646557 - DNA, 22 bp, Homo sapiens
gagaccctgcgcccctgcccag

SEQ ID NO: 646558 - DNA, 14 bp, Homo sapiens
gagacggcagcccc

SEQ ID NO: 646559 - DNA, 14 bp, Homo sapiens
gagactcgcctggg

SEQ ID NO: 646560 - DNA, 20 bp, Homo sapiens
gagactcgcgacaatgcaaa

SEQ ID NO: 646561 - DNA, 11 bp, Homo sapiens
gagactgccca

SEQ ID NO: 646562 - DNA, 13 bp, Homo sapiens
gagactgcccacc

SEQ ID NO: 646563 - DNA, 14 bp, Homo sapiens
gagactgcccaccc

SEQ ID NO: 646564 - DNA, 16 bp, Homo sapiens
gagactgcccaccctg

SEQ ID NO: 646565 - DNA, 21 bp, Homo sapiens
gagactgcccaccctgggcct

SEQ ID NO: 646566 - DNA, 22 bp, Homo sapiens
gagactgcccaccctgggcctc

SEQ ID NO: 646567 - DNA, 20 bp, Homo sapiens
gagagactggttttttccag

SEQ ID NO: 646568 - DNA, 19 bp, Homo sapiens
gagagagcaatcttgctgt

SEQ ID NO: 646569 - DNA, 17 bp, Homo sapiens
gagagaggctgcctcag

SEQ ID NO: 646570 - DNA, 19 bp, Homo sapiens
gagagaggctgcctcagcc

SEQ ID NO: 646571 - DNA, 14 bp, Homo sapiens
gagagatatatctg

SEQ ID NO: 646572 - DNA, 17 bp, Homo sapiens
gagagatatatctgaaa

SEQ ID NO: 646573 - DNA, 23 bp, Homo sapiens
gagagccaagctaatgtggtagt

SEQ ID NO: 646574 - DNA, 14 bp, Homo sapiens
gagagcgccacccg

SEQ ID NO: 646575 - DNA, 22 bp, Homo sapiens
gagagcgccacccgcccgcccc

SEQ ID NO: 646576 - DNA, 16 bp, Homo sapiens
gagagcggcttcccca

SEQ ID NO: 646577 - DNA, 21 bp, Homo sapiens
gagagcggcttccccattgcc

SEQ ID NO: 646578 - DNA, 19 bp, Homo sapiens
gagaggaggtgtggagtgg

SEQ ID NO: 646579 - DNA, 15 bp, Homo sapiens
gagaggctgcctcag

SEQ ID NO: 646580 - DNA, 13 bp, Homo sapiens
gagagggctgagc

SEQ ID NO: 646581 - DNA, 16 bp, Homo sapiens
gagagggggatgcccc

SEQ ID NO: 646582 - DNA, 18 bp, Homo sapiens
gagagggggatgcccctg

SEQ ID NO: 646583 - DNA, 21 bp, Homo sapiens
gagagggggatgcccctggcc

SEQ ID NO: 646584 - DNA, 22 bp, Homo sapiens
gagagtggcaggtgggctgcct

SEQ ID NO: 646585 - DNA, 19 bp, Homo sapiens
gagataccctctgagacag

SEQ ID NO: 646586 - DNA, 13 bp, Homo sapiens
gagatcagaattg

SEQ ID NO: 646587 - DNA, 15 bp, Homo sapiens
gagatgaggctggat

SEQ ID NO: 646588 - DNA, 17 bp, Homo sapiens
gagattgggggggcttg

SEQ ID NO: 646589 - DNA, 19 bp, Homo sapiens
gagattgggggggcttggg

SEQ ID NO: 646590 - DNA, 22 bp, Homo sapiens
gagatttagggttctatattta

SEQ ID NO: 646591 - DNA, 14 bp, Homo sapiens
gagcacagccatag

SEQ ID NO: 646592 - DNA, 20 bp, Homo sapiens
gagcacagctttcctgggtc

SEQ ID NO: 646593 - DNA, 23 bp, Homo sapiens
gagcacaggcatattattttctg

SEQ ID NO: 646594 - DNA, 11 bp, Homo sapiens
gagcaccccca

SEQ ID NO: 646595 - DNA, 12 bp, Homo sapiens
gagcacccccag

SEQ ID NO: 646596 - DNA, 13 bp, Homo sapiens
gagcacccccagc

SEQ ID NO: 646597 - DNA, 15 bp, Homo sapiens
gagcacccccagcct

SEQ ID NO: 646598 - DNA, 15 bp, Homo sapiens
gagcactgtataccc

SEQ ID NO: 646599 - DNA, 19 bp, Homo sapiens
gagcagaaagccagggtcc

SEQ ID NO: 646600 - DNA, 13 bp, Homo sapiens
gagcagacagggc

SEQ ID NO: 646601 - DNA, 21 bp, Homo sapiens
gagcagagacggcagccccat

SEQ ID NO: 646602 - DNA, 18 bp, Homo sapiens
gagcagagcgcagccccc

SEQ ID NO: 646603 - DNA, 11 bp, Homo sapiens
gagcagtgggg

SEQ ID NO: 646604 - DNA, 12 bp, Homo sapiens
gagcagtgggga

SEQ ID NO: 646605 - DNA, 16 bp, Homo sapiens
gagcagtggggagcgg

SEQ ID NO: 646606 - DNA, 15 bp, Homo sapiens
gagcatgaagataaa

SEQ ID NO: 646607 - DNA, 21 bp, Homo sapiens
gagcatgcccaaatataacat

SEQ ID NO: 646608 - DNA, 18 bp, Homo sapiens
gagccaataaagctcaca

SEQ ID NO: 646609 - DNA, 19 bp, Homo sapiens
gagccaataaagctcacac

SEQ ID NO: 646610 - DNA, 19 bp, Homo sapiens
gagccacagtggggcccat

SEQ ID NO: 646611 - DNA, 20 bp, Homo sapiens
gagccacagtggggcccatg

SEQ ID NO: 646612 - DNA, 15 bp, Homo sapiens
gagccactacctttg

SEQ ID NO: 646613 - DNA, 13 bp, Homo sapiens
gagccagatttca

SEQ ID NO: 646614 - DNA, 23 bp, Homo sapiens
gagccagcagacattgtcagcaa

SEQ ID NO: 646615 - DNA, 13 bp, Homo sapiens
gagccagggcaga

SEQ ID NO: 646616 - DNA, 21 bp, Homo sapiens
gagcccagaagctcaaggctg

SEQ ID NO: 646617 - DNA, 16 bp, Homo sapiens
gagcccccgcccctcc

SEQ ID NO: 646618 - DNA, 14 bp, Homo sapiens
gagccccctggcgg

SEQ ID NO: 646619 - DNA, 16 bp, Homo sapiens
gagccccctggcggca

SEQ ID NO: 646620 - DNA, 12 bp, Homo sapiens
gagccccggagc

SEQ ID NO: 646621 - DNA, 12 bp, Homo sapiens
gagcccctcctc

SEQ ID NO: 646622 - DNA, 14 bp, Homo sapiens
gagcccctcctctc

SEQ ID NO: 646623 - DNA, 20 bp, Homo sapiens
gagcccctgtttctcctcca

SEQ ID NO: 646624 - DNA, 12 bp, Homo sapiens
gagccctgcagt

SEQ ID NO: 646625 - DNA, 13 bp, Homo sapiens
gagccctgccctc

SEQ ID NO: 646626 - DNA, 16 bp, Homo sapiens
gagccgcagaggcccg

SEQ ID NO: 646627 - DNA, 17 bp, Homo sapiens
gagccttattaaaatat

SEQ ID NO: 646628 - DNA, 12 bp, Homo sapiens
gagcgccacccg

SEQ ID NO: 646629 - DNA, 23 bp, Homo sapiens
gagcgccacccgcccgcccccgc

SEQ ID NO: 646630 - DNA, 14 bp, Homo sapiens
gagcggctgaggac

SEQ ID NO: 646631 - DNA, 21 bp, Homo sapiens
gagcggcttccccatcgcctt

SEQ ID NO: 646632 - DNA, 19 bp, Homo sapiens
gagcgggggctaactggcc

SEQ ID NO: 646633 - DNA, 20 bp, Homo sapiens
gagcgggggctaactggccc

SEQ ID NO: 646634 - DNA, 15 bp, Homo sapiens
gagctatgcacacca

SEQ ID NO: 646635 - DNA, 23 bp, Homo sapiens
gagctatgcacaccaaattgctg

SEQ ID NO: 646636 - DNA, 13 bp, Homo sapiens
gagctccaccctc

SEQ ID NO: 646637 - DNA, 18 bp, Homo sapiens
gagctccaccctcccctc

SEQ ID NO: 646638 - DNA, 21 bp, Homo sapiens
gagctgagtcggctgggcagg

SEQ ID NO: 646639 - DNA, 18 bp, Homo sapiens
gagcttgattctaaaggg

SEQ ID NO: 646640 - DNA, 19 bp, Homo sapiens
gagcttgattctaaagggg

SEQ ID NO: 646641 - DNA, 13 bp, Homo sapiens
gagcttggagccc

SEQ ID NO: 646642 - DNA, 22 bp, Homo sapiens
gaggacacagcacaagggcaca

SEQ ID NO: 646643 - DNA, 17 bp, Homo sapiens
gaggacagagtgccctg

SEQ ID NO: 646644 - DNA, 19 bp, Homo sapiens
gaggacagagtgccctggg

SEQ ID NO: 646645 - DNA, 21 bp, Homo sapiens
gaggacagagtgccctggggc

SEQ ID NO: 646646 - DNA, 15 bp, Homo sapiens
gaggacccctgccct

SEQ ID NO: 646647 - DNA, 14 bp, Homo sapiens
gaggacctgggggg

SEQ ID NO: 646648 - DNA, 14 bp, Homo sapiens
gaggacggcttccc

SEQ ID NO: 646649 - DNA, 16 bp, Homo sapiens
gaggacggggcagagc

SEQ ID NO: 646650 - DNA, 18 bp, Homo sapiens
gaggacggggcagagctg

SEQ ID NO: 646651 - DNA, 13 bp, Homo sapiens
gaggactgttcta

SEQ ID NO: 646652 - DNA, 22 bp, Homo sapiens
gcagtggctgggggactgcttt

SEQ ID NO: 646653 - DNA, 12 bp, Homo sapiens
gcagtggggagc

SEQ ID NO: 646654 - DNA, 18 bp, Homo sapiens
gcagtgtgcttacctgtt

SEQ ID NO: 646655 - DNA, 20 bp, Homo sapiens
gcagtgtgtcacactgagct

SEQ ID NO: 646656 - DNA, 18 bp, Homo sapiens
gcagttagcacagaggat

SEQ ID NO: 646657 - DNA, 16 bp, Homo sapiens
gcagttatttaccaga

SEQ ID NO: 646658 - DNA, 16 bp, Homo sapiens
gcagttgcaataaact

SEQ ID NO: 646659 - DNA, 20 bp, Homo sapiens
gcagtttggccctggagcca

SEQ ID NO: 646660 - DNA, 16 bp, Homo sapiens
gcataagattatatac

SEQ ID NO: 646661 - DNA, 20 bp, Homo sapiens
gcatagggtttggaagaaag

SEQ ID NO: 646662 - DNA, 13 bp, Homo sapiens
gcatatatataaa

SEQ ID NO: 646663 - DNA, 22 bp, Homo sapiens
gcatatatataaaatacacgtg

SEQ ID NO: 646664 - DNA, 22 bp, Homo sapiens
gcatatggcaacgttcatgttc

SEQ ID NO: 646665 - DNA, 14 bp, Homo sapiens
gcatatttatagag

SEQ ID NO: 646666 - DNA, 21 bp, Homo sapiens
gcatccaccttcctgcccagg

SEQ ID NO: 646667 - DNA, 23 bp, Homo sapiens
gcatccatactgtttaatattta

SEQ ID NO: 646668 - DNA, 20 bp, Homo sapiens
gcatcccttggcccctctct

SEQ ID NO: 646669 - DNA, 18 bp, Homo sapiens
gcatcctggcttgcctcc

SEQ ID NO: 646670 - DNA, 12 bp, Homo sapiens
gcatctgcctgg

SEQ ID NO: 646671 - DNA, 13 bp, Homo sapiens
gcatctgcctgga

SEQ ID NO: 646672 - DNA, 18 bp, Homo sapiens
gcatctgcctggagcctg

SEQ ID NO: 646673 - DNA, 23 bp, Homo sapiens
gcatgaatccatcgatttgtatt

SEQ ID NO: 646674 - DNA, 13 bp, Homo sapiens
gcatgagttctgc

SEQ ID NO: 646675 - DNA, 23 bp, Homo sapiens
gcatgatcttacacgaagaaata

SEQ ID NO: 646676 - DNA, 20 bp, Homo sapiens
gcatgcaccagtgccgcctg

SEQ ID NO: 646677 - DNA, 21 bp, Homo sapiens
gcatgcagggcccccacagga

SEQ ID NO: 646678 - DNA, 23 bp, Homo sapiens
gcatgcagggcccccacaggagc

SEQ ID NO: 646679 - DNA, 19 bp, Homo sapiens
gcatgctccctcatgcaga

SEQ ID NO: 646680 - DNA, 20 bp, Homo sapiens
gcatgctccctcatgcagat

SEQ ID NO: 646681 - DNA, 20 bp, Homo sapiens
gcatgtacagtgttctgttt

SEQ ID NO: 646682 - DNA, 13 bp, Homo sapiens
gcatgttaaaata

SEQ ID NO: 646683 - DNA, 23 bp, Homo sapiens
gcatgttgccatgaggcctttcc

SEQ ID NO: 646684 - DNA, 13 bp, Homo sapiens
gcatgtttaataa

SEQ ID NO: 646685 - DNA, 17 bp, Homo sapiens
gcattaagcacacacat

SEQ ID NO: 646686 - DNA, 20 bp, Homo sapiens
gcattatttggatgtgagtt

SEQ ID NO: 646687 - DNA, 12 bp, Homo sapiens
gcattcccaatt

SEQ ID NO: 646688 - DNA, 14 bp, Homo sapiens
gcattgcactaaaa

SEQ ID NO: 646689 - DNA, 21 bp, Homo sapiens
gcattgcactaaaagtgatgt

SEQ ID NO: 646690 - DNA, 20 bp, Homo sapiens
gcatttgctgaataacaaca

SEQ ID NO: 646691 - DNA, 20 bp, Homo sapiens
gcattttaatagtttctaaa

SEQ ID NO: 646692 - DNA, 20 bp, Homo sapiens
gccaaatgagttcccttgat

SEQ ID NO: 646693 - DNA, 12 bp, Homo sapiens
gccaagccaggg

SEQ ID NO: 646694 - DNA, 14 bp, Homo sapiens
gccaatgtccaggt

SEQ ID NO: 646695 - DNA, 22 bp, Homo sapiens
gccaatttcaaagaaaacagac

SEQ ID NO: 646696 - DNA, 20 bp, Homo sapiens
gccaatttctcttaagtact

SEQ ID NO: 646697 - DNA, 22 bp, Homo sapiens
gccaatttttctgcactgagca

SEQ ID NO: 646698 - DNA, 16 bp, Homo sapiens
gccacagtggggccca

SEQ ID NO: 646699 - DNA, 12 bp, Homo sapiens
gccacccgcccg

SEQ ID NO: 646700 - DNA, 21 bp, Homo sapiens
gccacctgccaggcctccctc

SEQ ID NO: 646701 - DNA, 19 bp, Homo sapiens
gccaccttgtacagaacca

SEQ ID NO: 646702 - DNA, 14 bp, Homo sapiens
gccactaaggtcag

SEQ ID NO: 646703 - DNA, 15 bp, Homo sapiens
gccactacctttgtc

SEQ ID NO: 646704 - DNA, 17 bp, Homo sapiens
gccactcaggcagcctg

SEQ ID NO: 646705 - DNA, 18 bp, Homo sapiens
gccactgcccaaagccat

SEQ ID NO: 646706 - DNA, 17 bp, Homo sapiens
gccagacagagatcaga

SEQ ID NO: 646707 - DNA, 16 bp, Homo sapiens
gccagaccacgcccct

SEQ ID NO: 646708 - DNA, 19 bp, Homo sapiens
gccagaccacgcccctgcc

SEQ ID NO: 646709 - DNA, 16 bp, Homo sapiens
gccagatttcactctc

SEQ ID NO: 646710 - DNA, 18 bp, Homo sapiens
gccagatttcactctcct

SEQ ID NO: 646711 - DNA, 17 bp, Homo sapiens
gccagcagacattgtca

SEQ ID NO: 646712 - DNA, 13 bp, Homo sapiens
gccagcattcagc

SEQ ID NO: 646713 - DNA, 18 bp, Homo sapiens
gccagcattcagcacaca

SEQ ID NO: 646714 - DNA, 20 bp, Homo sapiens
gccagccctgttccgcctca

SEQ ID NO: 646715 - DNA, 19 bp, Homo sapiens
gccagcccttgctctacct

SEQ ID NO: 646716 - DNA, 23 bp, Homo sapiens
gccagcccttgctctacctggcc

SEQ ID NO: 646717 - DNA, 18 bp, Homo sapiens
gccagctctgagcagaca

SEQ ID NO: 646718 - DNA, 17 bp, Homo sapiens
gccaggagaccctgtct

SEQ ID NO: 646719 - DNA, 20 bp, Homo sapiens
gccaggcctccctcgggctg

SEQ ID NO: 646720 - DNA, 18 bp, Homo sapiens
gccagggacattttcaag

SEQ ID NO: 646721 - DNA, 13 bp, Homo sapiens
gccagggcagagg

SEQ ID NO: 646722 - DNA, 20 bp, Homo sapiens
gccagggctcagatggggcc

SEQ ID NO: 646723 - DNA, 23 bp, Homo sapiens
gccagggctcagatggggcctgg

SEQ ID NO: 646724 - DNA, 17 bp, Homo sapiens
gccagggtcctgagtgg

SEQ ID NO: 646725 - DNA, 17 bp, Homo sapiens
gccagggtgggaagaga

SEQ ID NO: 646726 - DNA, 17 bp, Homo sapiens
gccagggttccagacag

SEQ ID NO: 646727 - DNA, 14 bp, Homo sapiens
gccaggtctggcgc

SEQ ID NO: 646728 - DNA, 20 bp, Homo sapiens
gccaggtctggcgccagggg

SEQ ID NO: 646729 - DNA, 18 bp, Homo sapiens
gccagtgtttagaagagc

SEQ ID NO: 646730 - DNA, 20 bp, Homo sapiens
gccagtgtttagaagagcct

SEQ ID NO: 646731 - DNA, 13 bp, Homo sapiens
gccatagccccag

SEQ ID NO: 646732 - DNA, 18 bp, Homo sapiens
gccatagccccaggcccg

SEQ ID NO: 646733 - DNA, 15 bp, Homo sapiens
gccatctccaccctg

SEQ ID NO: 646734 - DNA, 12 bp, Homo sapiens
gccatgaggcct

SEQ ID NO: 646735 - DNA, 19 bp, Homo sapiens
gccatgcccacgcccctcc

SEQ ID NO: 646736 - DNA, 22 bp, Homo sapiens
gccattcatttacaacttccag

SEQ ID NO: 646737 - DNA, 20 bp, Homo sapiens
gccattgaacactgcaccct

SEQ ID NO: 646738 - DNA, 15 bp, Homo sapiens
gccatttcacattcc

SEQ ID NO: 646739 - DNA, 18 bp, Homo sapiens
gccattttgtctggctgt

SEQ ID NO: 646740 - DNA, 13 bp, Homo sapiens
gcccaacccccac

SEQ ID NO: 646741 - DNA, 18 bp, Homo sapiens
gcccaacccccacctccc

SEQ ID NO: 646742 - DNA, 20 bp, Homo sapiens
gcccacatttgggctcaggg

SEQ ID NO: 646743 - DNA, 21 bp, Homo sapiens
gcccacatttgggctcagggt

SEQ ID NO: 646744 - DNA, 23 bp, Homo sapiens
gcccacatttgggctcagggttg

SEQ ID NO: 646745 - DNA, 13 bp, Homo sapiens
gcccacccacacc

SEQ ID NO: 646746 - DNA, 17 bp, Homo sapiens
gcccacccacaccccgt

SEQ ID NO: 646747 - DNA, 21 bp, Homo sapiens
gcccacccacaccccgtctgc

SEQ ID NO: 646748 - DNA, 14 bp, Homo sapiens
gcccacccagcagc

SEQ ID NO: 646749 - DNA, 19 bp, Homo sapiens
gcccacccagcagcgcccg

SEQ ID NO: 646750 - DNA, 15 bp, Homo sapiens
gcccaccccgctgcc

SEQ ID NO: 646751 - DNA, 19 bp, Homo sapiens
gcccaccccgctgcctggc

SEQ ID NO: 646752 - DNA, 21 bp, Homo sapiens
gcccaccccgctgcctggcgg

SEQ ID NO: 646753 - DNA, 19 bp, Homo sapiens
gcccacccctcttccccct

SEQ ID NO: 646754 - DNA, 23 bp, Homo sapiens
gcccacccctcttcccccttccc

SEQ ID NO: 646755 - DNA, 13 bp, Homo sapiens
gcccacccgcccc

SEQ ID NO: 646756 - DNA, 18 bp, Homo sapiens
gcccacccgccccagaga

SEQ ID NO: 646757 - DNA, 19 bp, Homo sapiens
gcccacccgccccagagac

SEQ ID NO: 646758 - DNA, 21 bp, Homo sapiens
gcccacccgccccagagactg

SEQ ID NO: 646759 - DNA, 15 bp, Homo sapiens
gcccaccctgggcct

SEQ ID NO: 646760 - DNA, 18 bp, Homo sapiens
gcccaccctgggcctccc

SEQ ID NO: 646761 - DNA, 19 bp, Homo sapiens
gcccaccctgggcctcccg

SEQ ID NO: 646762 - DNA, 21 bp, Homo sapiens
gcccaccctgggcctcccgtc

SEQ ID NO: 646763 - DNA, 13 bp, Homo sapiens
gcccacgcagagc

SEQ ID NO: 646764 - DNA, 17 bp, Homo sapiens
gcccacgcagagccccg

SEQ ID NO: 646765 - DNA, 22 bp, Homo sapiens
gcccacgcagagccccggagca

SEQ ID NO: 646766 - DNA, 23 bp, Homo sapiens
gcccacgcagagccccggagcac

SEQ ID NO: 646767 - DNA, 23 bp, Homo sapiens
gcctgcgcctcctcctgcatgtc

SEQ ID NO: 646768 - DNA, 19 bp, Homo sapiens
gcctgcgctcctctgcagc

SEQ ID NO: 646769 - DNA, 20 bp, Homo sapiens
gcctgcggggttccctgcgc

SEQ ID NO: 646770 - DNA, 20 bp, Homo sapiens
gcctgctgctctctaagaat

SEQ ID NO: 646771 - DNA, 15 bp, Homo sapiens
gcctggagcctgggc

SEQ ID NO: 646772 - DNA, 20 bp, Homo sapiens
gcctggagcctgggcagcac

SEQ ID NO: 646773 - DNA, 22 bp, Homo sapiens
gcctggaggagaaggaggaacc

SEQ ID NO: 646774 - DNA, 14 bp, Homo sapiens
gcctggattccagc

SEQ ID NO: 646775 - DNA, 13 bp, Homo sapiens
gcctggccccctc

SEQ ID NO: 646776 - DNA, 13 bp, Homo sapiens
gcctggcgggcag

SEQ ID NO: 646777 - DNA, 16 bp, Homo sapiens
gcctggcgggcagccc

SEQ ID NO: 646778 - DNA, 22 bp, Homo sapiens
gcctgggaaattgctccattcc

SEQ ID NO: 646779 - DNA, 21 bp, Homo sapiens
gcctgggtccccctcctgcac

SEQ ID NO: 646780 - DNA, 22 bp, Homo sapiens
gcctgggtccccctcctgcacg

SEQ ID NO: 646781 - DNA, 19 bp, Homo sapiens
gcctggtctggagccccta

SEQ ID NO: 646782 - DNA, 17 bp, Homo sapiens
gcctgtcgggcccgcac

SEQ ID NO: 646783 - DNA, 15 bp, Homo sapiens
gcctgttaggtctgt

SEQ ID NO: 646784 - DNA, 20 bp, Homo sapiens
gccttatggaacactctgag

SEQ ID NO: 646785 - DNA, 15 bp, Homo sapiens
gccttccccgtgcgg

SEQ ID NO: 646786 - DNA, 16 bp, Homo sapiens
gccttccctccccaca

SEQ ID NO: 646787 - DNA, 23 bp, Homo sapiens
gccttctggggagggacacagag

SEQ ID NO: 646788 - DNA, 13 bp, Homo sapiens
gccttgatgtttc

SEQ ID NO: 646789 - DNA, 15 bp, Homo sapiens
gccttgctgggccag

SEQ ID NO: 646790 - DNA, 12 bp, Homo sapiens
gccttggagcag

SEQ ID NO: 646791 - DNA, 15 bp, Homo sapiens
gccttggttcctcca

SEQ ID NO: 646792 - DNA, 18 bp, Homo sapiens
gccttggttcctccagca

SEQ ID NO: 646793 - DNA, 23 bp, Homo sapiens
gccttgtctgtgtatttctattt

SEQ ID NO: 646794 - DNA, 21 bp, Homo sapiens
gcctttctccagcccatgctg

SEQ ID NO: 646795 - DNA, 11 bp, Homo sapiens
gcgaacacagt

SEQ ID NO: 646796 - DNA, 12 bp, Homo sapiens
gcgaacacagtg

SEQ ID NO: 646797 - DNA, 22 bp, Homo sapiens
gcgaactgggttctttggaagc

SEQ ID NO: 646798 - DNA, 21 bp, Homo sapiens
gcgacaatgcaaaccatcatt

SEQ ID NO: 646799 - DNA, 11 bp, Homo sapiens
gcgaccacccc

SEQ ID NO: 646800 - DNA, 15 bp, Homo sapiens
gcgaccacccctgtg

SEQ ID NO: 646801 - DNA, 15 bp, Homo sapiens
gcgagcctgcttgct

SEQ ID NO: 646802 - DNA, 21 bp, Homo sapiens
gcgcagccgcgctctgcccct

SEQ ID NO: 646803 - DNA, 15 bp, Homo sapiens
gcgcatggcgccccg

SEQ ID NO: 646804 - DNA, 16 bp, Homo sapiens
gcgcatggcgccccgg

SEQ ID NO: 646805 - DNA, 15 bp, Homo sapiens
gcgccacccgcccgc

SEQ ID NO: 646806 - DNA, 16 bp, Homo sapiens
gcgccaggggcaggca

SEQ ID NO: 646807 - DNA, 19 bp, Homo sapiens
gcgccccatgggccctcag

SEQ ID NO: 646808 - DNA, 15 bp, Homo sapiens
gcgcccccaggaccc

SEQ ID NO: 646809 - DNA, 21 bp, Homo sapiens
gcgcccctctgcgccccagcg

SEQ ID NO: 646810 - DNA, 14 bp, Homo sapiens
gcgcccctgcccag

SEQ ID NO: 646811 - DNA, 17 bp, Homo sapiens
gcgcccctgcccagcac

SEQ ID NO: 646812 - DNA, 11 bp, Homo sapiens
gcgcccctgtc

SEQ ID NO: 646813 - DNA, 17 bp, Homo sapiens
gcgcccgaggccagggc

SEQ ID NO: 646814 - DNA, 16 bp, Homo sapiens
gcgccgcctcgccccc

SEQ ID NO: 646815 - DNA, 23 bp, Homo sapiens
gcgccgcctcgcccccgggccct

SEQ ID NO: 646816 - DNA, 20 bp, Homo sapiens
gcgcctaggttgtgttgaga

SEQ ID NO: 646817 - DNA, 14 bp, Homo sapiens
gcgcctcccgccgc

SEQ ID NO: 646818 - DNA, 13 bp, Homo sapiens
gcgcctcctcctg

SEQ ID NO: 646819 - DNA, 15 bp, Homo sapiens
gcgcctcctcctgca

SEQ ID NO: 646820 - DNA, 16 bp, Homo sapiens
gcgcctcctcctgcat

SEQ ID NO: 646821 - DNA, 21 bp, Homo sapiens
gcgcctgcgcctcctcctgca

SEQ ID NO: 646822 - DNA, 18 bp, Homo sapiens
gcgcctgcgctcctctgc

SEQ ID NO: 646823 - DNA, 21 bp, Homo sapiens
gcgcctgcgctcctctgcagc

SEQ ID NO: 646824 - DNA, 17 bp, Homo sapiens
gcgcctgtcgggcccgc

SEQ ID NO: 646825 - DNA, 13 bp, Homo sapiens
gcgcgcaccgccc

SEQ ID NO: 646826 - DNA, 14 bp, Homo sapiens
gcgcgcccccagga

SEQ ID NO: 646827 - DNA, 16 bp, Homo sapiens
gcgcgcccccaggacc

SEQ ID NO: 646828 - DNA, 18 bp, Homo sapiens
gcgcgcgcccccaggacc

SEQ ID NO: 646829 - DNA, 23 bp, Homo sapiens
gcgcgcgggacagcggccccgcg

SEQ ID NO: 646830 - DNA, 15 bp, Homo sapiens
gcgcgtgcccccagc

SEQ ID NO: 646831 - DNA, 23 bp, Homo sapiens
gcgctccggcagaggcagggccc

SEQ ID NO: 646832 - DNA, 12 bp, Homo sapiens
gcgctcctctgc

SEQ ID NO: 646833 - DNA, 14 bp, Homo sapiens
gcgctcctctgcag

SEQ ID NO: 646834 - DNA, 18 bp, Homo sapiens
gcgctcctctgcagcctg

SEQ ID NO: 646835 - DNA, 14 bp, Homo sapiens
gcgctgagggcagg

SEQ ID NO: 646836 - DNA, 20 bp, Homo sapiens
gcggaccggagcggctgagg

SEQ ID NO: 646837 - DNA, 20 bp, Homo sapiens
gcggagcccccgcccctccc

SEQ ID NO: 646838 - DNA, 21 bp, Homo sapiens
gcggagcccccgcccctcccc

SEQ ID NO: 646839 - DNA, 19 bp, Homo sapiens
gcggcacattggcagtgtg

SEQ ID NO: 646840 - DNA, 12 bp, Homo sapiens
gcggcaccgccc

SEQ ID NO: 646841 - DNA, 16 bp, Homo sapiens
gcggcaggggttggca

SEQ ID NO: 646842 - DNA, 14 bp, Homo sapiens
gcggcccggcccac

SEQ ID NO: 646843 - DNA, 20 bp, Homo sapiens
gcggcccgtgcgcagccgcg

SEQ ID NO: 646844 - DNA, 20 bp, Homo sapiens
gcggctgaggacggggcaga

SEQ ID NO: 646845 - DNA, 23 bp, Homo sapiens
gcggctgaggacggggcagagct

SEQ ID NO: 646846 - DNA, 15 bp, Homo sapiens
gcgggacagcggccc

SEQ ID NO: 646847 - DNA, 17 bp, Homo sapiens
gcgggacagcggccccg

SEQ ID NO: 646848 - DNA, 11 bp, Homo sapiens
gcgggccaggg

SEQ ID NO: 646849 - DNA, 16 bp, Homo sapiens
gcgggccaggtctggc

SEQ ID NO: 646850 - DNA, 22 bp, Homo sapiens
gcgggccatttcacattcctga

SEQ ID NO: 646851 - DNA, 23 bp, Homo sapiens
gcgggtcatattcataccttctg

SEQ ID NO: 646852 - DNA, 12 bp, Homo sapiens
gcgtaggagaga

SEQ ID NO: 646853 - DNA, 20 bp, Homo sapiens
gcgtccctgagggcccttcc

SEQ ID NO: 646854 - DNA, 20 bp, Homo sapiens
gcgtccctgctcagcccatc

SEQ ID NO: 646855 - DNA, 14 bp, Homo sapiens
gcgtgaaacacaat

SEQ ID NO: 646856 - DNA, 24 bp, Homo sapiens
gcgtgacttcagactctctcctct

SEQ ID NO: 646857 - DNA, 15 bp, Homo sapiens
gcgtgtggccctgtg

SEQ ID NO: 646858 - DNA, 18 bp, Homo sapiens
gcgtgtggccctgtggga

SEQ ID NO: 646859 - DNA, 21 bp, Homo sapiens
gcgtgtggccctgtgggagtc

SEQ ID NO: 646860 - DNA, 14 bp, Homo sapiens
gcgtgtgtggccta

SEQ ID NO: 646861 - DNA, 21 bp, Homo sapiens
gcgttgttttgtggataagaa

SEQ ID NO: 646862 - DNA, 18 bp, Homo sapiens
gctaaatgcctaataaac

SEQ ID NO: 646863 - DNA, 13 bp, Homo sapiens
gctaacgggcgcc

SEQ ID NO: 646864 - DNA, 13 bp, Homo sapiens
gctaactggcccc

SEQ ID NO: 646865 - DNA, 14 bp, Homo sapiens
gctaactggcccca

SEQ ID NO: 646866 - DNA, 17 bp, Homo sapiens
gctaactggccccaggc

SEQ ID NO: 646867 - DNA, 14 bp, Homo sapiens
gctaattaaaaagt

SEQ ID NO: 646868 - DNA, 17 bp, Homo sapiens
gctacaggggaggctga

SEQ ID NO: 646869 - DNA, 13 bp, Homo sapiens
gctacaggtgccc

SEQ ID NO: 646870 - DNA, 17 bp, Homo sapiens
gctacttatattctgca

SEQ ID NO: 646871 - DNA, 15 bp, Homo sapiens
gctagaaagagaaaa

SEQ ID NO: 646872 - DNA, 21 bp, Homo sapiens
gctagaaagagaaaaagccct

SEQ ID NO: 646873 - DNA, 19 bp, Homo sapiens
gctagagcattctggggtg

SEQ ID NO: 646874 - DNA, 20 bp, Homo sapiens
gctagagcattctggggtgg

SEQ ID NO: 646875 - DNA, 11 bp, Homo sapiens
gctaggcaggg

SEQ ID NO: 646876 - DNA, 18 bp, Homo sapiens
gctagttctgctgccctc

SEQ ID NO: 646877 - DNA, 18 bp, Homo sapiens
gctataaatagtgaaaat

SEQ ID NO: 646878 - DNA, 13 bp, Homo sapiens
gctatgcacacca

SEQ ID NO: 646879 - DNA, 17 bp, Homo sapiens
gctatgctgttcattga

SEQ ID NO: 646880 - DNA, 13 bp, Homo sapiens
gctatttgtgtaa

SEQ ID NO: 646881 - DNA, 13 bp, Homo sapiens
gctcaacctctca

SEQ ID NO: 646882 - DNA, 14 bp, Homo sapiens
gctcaatgtgctgt

SEQ ID NO: 646883 - DNA, 14 bp, Homo sapiens
gctcacacttgggc

SEQ ID NO: 646884 - DNA, 16 bp, Homo sapiens
gctcacacttgggctg

SEQ ID NO: 646885 - DNA, 11 bp, Homo sapiens
gctcacagcac

SEQ ID NO: 646886 - DNA, 15 bp, Homo sapiens
gctcagagctaggcc

SEQ ID NO: 646887 - DNA, 13 bp, Homo sapiens
gctcagaggagag

SEQ ID NO: 646888 - DNA, 16 bp, Homo sapiens
gctcagaggagaggag

SEQ ID NO: 646889 - DNA, 17 bp, Homo sapiens
gctcagatggggcctgg

SEQ ID NO: 646890 - DNA, 19 bp, Homo sapiens
gctcagcccatcccctgcc

SEQ ID NO: 646891 - DNA, 21 bp, Homo sapiens
gctcagcccatcccctgcctc

SEQ ID NO: 646892 - DNA, 16 bp, Homo sapiens
gctcagggttggccat

SEQ ID NO: 646893 - DNA, 11 bp, Homo sapiens
gctcagtattg

SEQ ID NO: 646894 - DNA, 23 bp, Homo sapiens
gctcagtattgagacactgtcaa

SEQ ID NO: 646895 - DNA, 19 bp, Homo sapiens
gctcataagtaaatgtctt

SEQ ID NO: 646896 - DNA, 16 bp, Homo sapiens
gctcatagcacatgtt

SEQ ID NO: 646897 - DNA, 19 bp, Homo sapiens
gctcatctacacatataaa

SEQ ID NO: 646898 - DNA, 13 bp, Homo sapiens
gctccaccctccc

SEQ ID NO: 646899 - DNA, 14 bp, Homo sapiens
gctccaccctcccc

SEQ ID NO: 646900 - DNA, 17 bp, Homo sapiens
gctccaccctcccctct

SEQ ID NO: 646901 - DNA, 15 bp, Homo sapiens
gctccactctgaagt

SEQ ID NO: 646902 - DNA, 14 bp, Homo sapiens
gctccatcttattt

SEQ ID NO: 646903 - DNA, 12 bp, Homo sapiens
gctccattcctg

SEQ ID NO: 646904 - DNA, 15 bp, Homo sapiens
gctcccactgcccct

SEQ ID NO: 646905 - DNA, 19 bp, Homo sapiens
gctcccactgcccctgcac

SEQ ID NO: 646906 - DNA, 23 bp, Homo sapiens
gctcccagggtcctgggggctgc

SEQ ID NO: 646907 - DNA, 10 bp, Homo sapiens
gctccctgct

SEQ ID NO: 646908 - DNA, 16 bp, Homo sapiens
gctccggcagaggcag

SEQ ID NO: 646909 - DNA, 19 bp, Homo sapiens
gctccggcagaggcagggc

SEQ ID NO: 646910 - DNA, 19 bp, Homo sapiens
gctcctcacccctgtaggg

SEQ ID NO: 646911 - DNA, 16 bp, Homo sapiens
gctcctctgcagcctg

SEQ ID NO: 646912 - DNA, 17 bp, Homo sapiens
gctcctctgcagcctga

SEQ ID NO: 646913 - DNA, 21 bp, Homo sapiens
gctcctgcccacgtgcagcac

SEQ ID NO: 646914 - DNA, 14 bp, Homo sapiens
gctccttcatgctt

SEQ ID NO: 646915 - DNA, 19 bp, Homo sapiens
gctcgccctgtgccctctc

SEQ ID NO: 646916 - DNA, 21 bp, Homo sapiens
gctcggccaggcacggaggct

SEQ ID NO: 646917 - DNA, 13 bp, Homo sapiens
gctcgggaaggcc

SEQ ID NO: 646918 - DNA, 23 bp, Homo sapiens
gctcgggaaggcctgagggaagc

SEQ ID NO: 646919 - DNA, 20 bp, Homo sapiens
gctctctcattcccaggcac

SEQ ID NO: 646920 - DNA, 15 bp, Homo sapiens
gctctgaatctctca

SEQ ID NO: 646921 - DNA, 16 bp, Homo sapiens
gctctgaatctctcaa

SEQ ID NO: 646922 - DNA, 23 bp, Homo sapiens
gctctgaatctctcaaaatgtgc

SEQ ID NO: 646923 - DNA, 15 bp, Homo sapiens
gctctgagcagacag

SEQ ID NO: 646924 - DNA, 11 bp, Homo sapiens
gctctgcccct

SEQ ID NO: 646925 - DNA, 12 bp, Homo sapiens
gctctgcccctc

SEQ ID NO: 646926 - DNA, 17 bp, Homo sapiens
gctctggatgaaggcaa

SEQ ID NO: 646927 - DNA, 16 bp, Homo sapiens
gctgaaagacagtaaa

SEQ ID NO: 646928 - DNA, 12 bp, Homo sapiens
gctgaaattatg

SEQ ID NO: 646929 - DNA, 16 bp, Homo sapiens
gctgaaattatgtcaa

SEQ ID NO: 646930 - DNA, 20 bp, Homo sapiens
gctgaagaaacacagcatgc

SEQ ID NO: 646931 - DNA, 22 bp, Homo sapiens
gctgagacacagcccagagact

SEQ ID NO: 646932 - DNA, 18 bp, Homo sapiens
gctgagatgtttagtagc

SEQ ID NO: 646933 - DNA, 20 bp, Homo sapiens
gctgagatgtttagtagctg

SEQ ID NO: 646934 - DNA, 15 bp, Homo sapiens
gctgagcccctcctc

SEQ ID NO: 646935 - DNA, 14 bp, Homo sapiens
gctgagctggccta

SEQ ID NO: 646936 - DNA, 16 bp, Homo sapiens
gctgaggacggggcag

SEQ ID NO: 646937 - DNA, 22 bp, Homo sapiens
gctgaggacggggcagagctga

SEQ ID NO: 646938 - DNA, 16 bp, Homo sapiens
gctgagtcggctgggc

SEQ ID NO: 646939 - DNA, 17 bp, Homo sapiens
gctgagtcggctgggca

SEQ ID NO: 646940 - DNA, 23 bp, Homo sapiens
gctgagtcggctgggcagggccg

SEQ ID NO: 646941 - DNA, 16 bp, Homo sapiens
gctgatggtgcaatga

SEQ ID NO: 646942 - DNA, 18 bp, Homo sapiens
gctgatggtgcaatgacc

SEQ ID NO: 646943 - DNA, 14 bp, Homo sapiens
gctgcactgccctc

SEQ ID NO: 646944 - DNA, 17 bp, Homo sapiens
gctgcagctaatttgtg

SEQ ID NO: 646945 - DNA, 21 bp, Homo sapiens
gctgcaggaatcaaaaattga

SEQ ID NO: 646946 - DNA, 19 bp, Homo sapiens
gctgcagtcagcacagaga

SEQ ID NO: 646947 - DNA, 14 bp, Homo sapiens
gctgcatttcaagt

SEQ ID NO: 646948 - DNA, 17 bp, Homo sapiens
gctgccgcatctgcctg

SEQ ID NO: 646949 - DNA, 20 bp, Homo sapiens
gctgccgcatctgcctggag

SEQ ID NO: 646950 - DNA, 22 bp, Homo sapiens
gctgccgcatctgcctggagcc

SEQ ID NO: 646951 - DNA, 10 bp, Homo sapiens
gctgcctcag

SEQ ID NO: 646952 - DNA, 19 bp, Homo sapiens
gctgcctcagccagtggca

SEQ ID NO: 646953 - DNA, 24 bp, Homo sapiens
gctgcctcatgaccctcctgtcca

SEQ ID NO: 646954 - DNA, 13 bp, Homo sapiens
gctgcctggaggg

SEQ ID NO: 646955 - DNA, 12 bp, Homo sapiens
gctgcctggcgg

SEQ ID NO: 646956 - DNA, 12 bp, Homo sapiens
gctgcgcctgcc

SEQ ID NO: 646957 - DNA, 13 bp, Homo sapiens
gctgcgcctgccc

SEQ ID NO: 646958 - DNA, 15 bp, Homo sapiens
gctgcgcctgcccgc

SEQ ID NO: 646959 - DNA, 16 bp, Homo sapiens
gctgcgcctgcccgcc

SEQ ID NO: 646960 - DNA, 17 bp, Homo sapiens
gctgcgctcccacctcg

SEQ ID NO: 646961 - DNA, 13 bp, Homo sapiens
gctgcgtccctgc

SEQ ID NO: 646962 - DNA, 20 bp, Homo sapiens
gctgcgtccctgctcagccc

SEQ ID NO: 646963 - DNA, 14 bp, Homo sapiens
gctgctcccggtgt

SEQ ID NO: 646964 - DNA, 16 bp, Homo sapiens
gctgctgcactgccct

SEQ ID NO: 646965 - DNA, 17 bp, Homo sapiens
gctgctgcactgccctc

SEQ ID NO: 646966 - DNA, 14 bp, Homo sapiens
gctgctgccccctg

SEQ ID NO: 646967 - DNA, 16 bp, Homo sapiens
gctgctgccccctggc

SEQ ID NO: 646968 - DNA, 15 bp, Homo sapiens
gctgctgcctccctg

SEQ ID NO: 646969 - DNA, 17 bp, Homo sapiens
gctgctgcctccctggg

SEQ ID NO: 646970 - DNA, 19 bp, Homo sapiens
gctgctgcttctccctggg

SEQ ID NO: 646971 - DNA, 13 bp, Homo sapiens
gctgctggggcag

SEQ ID NO: 646972 - DNA, 16 bp, Homo sapiens
gctgctggggcagggc

SEQ ID NO: 646973 - DNA, 21 bp, Homo sapiens
gctgctggggcagggcccagg

SEQ ID NO: 646974 - DNA, 13 bp, Homo sapiens
gctgcttcaagga

SEQ ID NO: 646975 - DNA, 14 bp, Homo sapiens
gctgcttctccctg

SEQ ID NO: 646976 - DNA, 19 bp, Homo sapiens
gctgctttccaacacacaa

SEQ ID NO: 646977 - DNA, 16 bp, Homo sapiens
gctgctttccatggca

SEQ ID NO: 646978 - DNA, 15 bp, Homo sapiens
gctggaccaaggtgc

SEQ ID NO: 646979 - DNA, 20 bp, Homo sapiens
gctggagaccctgcgcccct

SEQ ID NO: 646980 - DNA, 23 bp, Homo sapiens
gctggagaccctgcgcccctgcc

SEQ ID NO: 646981 - DNA, 15 bp, Homo sapiens
gctggatgtgctttc

SEQ ID NO: 646982 - DNA, 14 bp, Homo sapiens
gctggcagcgcctc

SEQ ID NO: 646983 - DNA, 13 bp, Homo sapiens
gctggccctgccc

SEQ ID NO: 646984 - DNA, 14 bp, Homo sapiens
gctggccctgccct

SEQ ID NO: 646985 - DNA, 16 bp, Homo sapiens
gctggccctgccctcc

SEQ ID NO: 646986 - DNA, 17 bp, Homo sapiens
gctggccctgccctccc

SEQ ID NO: 646987 - DNA, 18 bp, Homo sapiens
gctggccctgccctcccc

SEQ ID NO: 646988 - DNA, 20 bp, Homo sapiens
gctggccggtccaccccgtc

SEQ ID NO: 646989 - DNA, 21 bp, Homo sapiens
gctggctgggtcgcccctcct

SEQ ID NO: 646990 - DNA, 14 bp, Homo sapiens
gctgggcagggccg

SEQ ID NO: 646991 - DNA, 16 bp, Homo sapiens
gctgggcagggccgca

SEQ ID NO: 646992 - DNA, 23 bp, Homo sapiens
gctgggcagggccgcagggcgct

SEQ ID NO: 646993 - DNA, 19 bp, Homo sapiens
gctgggcagggtgagaagc

SEQ ID NO: 646994 - DNA, 14 bp, Homo sapiens
gctggggccggggc

SEQ ID NO: 646995 - DNA, 18 bp, Homo sapiens
gctggggccggggctgcc

SEQ ID NO: 646996 - DNA, 15 bp, Homo sapiens
gctgggggactgctt

SEQ ID NO: 646997 - DNA, 23 bp, Homo sapiens
gctgggggaggcggcacattggc

SEQ ID NO: 646998 - DNA, 15 bp, Homo sapiens
gctgggtcgcccctc

SEQ ID NO: 646999 - DNA, 18 bp, Homo sapiens
gctgggtcgcccctcctc

SEQ ID NO: 647000 - DNA, 13 bp, Homo sapiens
gctggtgggatag

SEQ ID NO: 647001 - DNA, 21 bp, Homo sapiens
gctggtgggataggagggtgc

SEQ ID NO: 647002 - DNA, 15 bp, Homo sapiens
ggcaccgcccaccca

SEQ ID NO: 647003 - DNA, 17 bp, Homo sapiens
ggcaccgcccacccaca

SEQ ID NO: 647004 - DNA, 17 bp, Homo sapiens
ggcaccggacgctggag

SEQ ID NO: 647005 - DNA, 13 bp, Homo sapiens
ggcacggaggctc

SEQ ID NO: 647006 - DNA, 13 bp, Homo sapiens
ggcacgggagagc

SEQ ID NO: 647007 - DNA, 22 bp, Homo sapiens
ggcacgggagagcgccacccgc

SEQ ID NO: 647008 - DNA, 23 bp, Homo sapiens
ggcacgggagagcgccacccgcc

SEQ ID NO: 647009 - DNA, 23 bp, Homo sapiens
ggcagagattgggggggcttggg

SEQ ID NO: 647010 - DNA, 13 bp, Homo sapiens
ggcagaggcaggg

SEQ ID NO: 647011 - DNA, 15 bp, Homo sapiens
ggcagaggcagggcc

SEQ ID NO: 647012 - DNA, 13 bp, Homo sapiens
ggcagattaataa

SEQ ID NO: 647013 - DNA, 21 bp, Homo sapiens
ggcagattaataacagaaata

SEQ ID NO: 647014 - DNA, 15 bp, Homo sapiens
ggcagcacctccggg

SEQ ID NO: 647015 - DNA, 10 bp, Homo sapiens
ggcagcagat

SEQ ID NO: 647016 - DNA, 13 bp, Homo sapiens
ggcagccccatcc

SEQ ID NO: 647017 - DNA, 21 bp, Homo sapiens
ggcagccccatccttcccgca

SEQ ID NO: 647018 - DNA, 17 bp, Homo sapiens
ggcagccctcacctctg

SEQ ID NO: 647019 - DNA, 21 bp, Homo sapiens
ggcagccctcacctctgagga

SEQ ID NO: 647020 - DNA, 17 bp, Homo sapiens
ggcagcgcctcccgccg

SEQ ID NO: 647021 - DNA, 20 bp, Homo sapiens
ggcagcgcctcgccccagcc

SEQ ID NO: 647022 - DNA, 23 bp, Homo sapiens
ggcagctcctcgggtggggcctg

SEQ ID NO: 647023 - DNA, 21 bp, Homo sapiens
ggcagcttccctgaacactca

SEQ ID NO: 647024 - DNA, 20 bp, Homo sapiens
ggcagcttgagcctgtcacg

SEQ ID NO: 647025 - DNA, 22 bp, Homo sapiens
ggcaggcagctaggcagggagg

SEQ ID NO: 647026 - DNA, 18 bp, Homo sapiens
ggcagggaagggtgcctg

SEQ ID NO: 647027 - DNA, 13 bp, Homo sapiens
ggcagggcccagg

SEQ ID NO: 647028 - DNA, 16 bp, Homo sapiens
ggcagggccgcagggc

SEQ ID NO: 647029 - DNA, 21 bp, Homo sapiens
ggcaggggccgtgcagggcca

SEQ ID NO: 647030 - DNA, 18 bp, Homo sapiens
ggcagggttctagaaggg

SEQ ID NO: 647031 - DNA, 23 bp, Homo sapiens
ggcagtgaacacactcagcagcc

SEQ ID NO: 647032 - DNA, 21 bp, Homo sapiens
ggcagtgcagcaaccagagca

SEQ ID NO: 647033 - DNA, 11 bp, Homo sapiens
ggcagtggaga

SEQ ID NO: 647034 - DNA, 14 bp, Homo sapiens
ggcagtggctgggg

SEQ ID NO: 647035 - DNA, 12 bp, Homo sapiens
ggcataaaacaa

SEQ ID NO: 647036 - DNA, 18 bp, Homo sapiens
ggcatccaccttcctgcc

SEQ ID NO: 647037 - DNA, 22 bp, Homo sapiens
ggcatgacacgaatattgctga

SEQ ID NO: 647038 - DNA, 22 bp, Homo sapiens
ggcatgcaccagtgccgcctgt

SEQ ID NO: 647039 - DNA, 16 bp, Homo sapiens
ggcattgcactaaaag

SEQ ID NO: 647040 - DNA, 22 bp, Homo sapiens
ggccaagccagggttccagaca

SEQ ID NO: 647041 - DNA, 14 bp, Homo sapiens
ggccaccctgagca

SEQ ID NO: 647042 - DNA, 16 bp, Homo sapiens
ggccacctgccaggcc

SEQ ID NO: 647043 - DNA, 19 bp, Homo sapiens
ggccagaccacgcccctgc

SEQ ID NO: 647044 - DNA, 11 bp, Homo sapiens
ggccagggtgg

SEQ ID NO: 647045 - DNA, 19 bp, Homo sapiens
ggccagggtgggaagagaa

SEQ ID NO: 647046 - DNA, 17 bp, Homo sapiens
ggccattgaacactgca

SEQ ID NO: 647047 - DNA, 14 bp, Homo sapiens
ggcccaaataacag

SEQ ID NO: 647048 - DNA, 20 bp, Homo sapiens
ggcccaaataacagtggcaa

SEQ ID NO: 647049 - DNA, 17 bp, Homo sapiens
ggcccacgcagagcccc

SEQ ID NO: 647050 - DNA, 22 bp, Homo sapiens
ggcccacgcagagccccggagc

SEQ ID NO: 647051 - DNA, 15 bp, Homo sapiens
ggcccagccctgggc

SEQ ID NO: 647052 - DNA, 13 bp, Homo sapiens
ggcccagcctctt

SEQ ID NO: 647053 - DNA, 13 bp, Homo sapiens
ggcccaggcccag

SEQ ID NO: 647054 - DNA, 19 bp, Homo sapiens
ggcccaggcccagcctctt

SEQ ID NO: 647055 - DNA, 13 bp, Homo sapiens
ggcccagggaggt

SEQ ID NO: 647056 - DNA, 19 bp, Homo sapiens
ggcccagggaggtggcagg

SEQ ID NO: 647057 - DNA, 13 bp, Homo sapiens
ggcccatggcccc

SEQ ID NO: 647058 - DNA, 14 bp, Homo sapiens
ggcccatggcccca

SEQ ID NO: 647059 - DNA, 12 bp, Homo sapiens
ggccccagctgg

SEQ ID NO: 647060 - DNA, 18 bp, Homo sapiens
ggcccccggaggcgccca

SEQ ID NO: 647061 - DNA, 22 bp, Homo sapiens
ggccccctcgcgcccctgtcca

SEQ ID NO: 647062 - DNA, 20 bp, Homo sapiens
ggccccgcgcgtgcccccag

SEQ ID NO: 647063 - DNA, 18 bp, Homo sapiens
ggccccgcggagcccccg

SEQ ID NO: 647064 - DNA, 22 bp, Homo sapiens
ggcccgagcgcgtgccttcccc

SEQ ID NO: 647065 - DNA, 14 bp, Homo sapiens
ggcccgaggcaccg

SEQ ID NO: 647066 - DNA, 16 bp, Homo sapiens
ggcccgcactcaggag

SEQ ID NO: 647067 - DNA, 17 bp, Homo sapiens
ggcccgcactcaggagc

SEQ ID NO: 647068 - DNA, 22 bp, Homo sapiens
ggcccgcactcaggagcacagc

SEQ ID NO: 647069 - DNA, 14 bp, Homo sapiens
ggcccggcccacgc

SEQ ID NO: 647070 - DNA, 16 bp, Homo sapiens
ggcccggcccacgcag

SEQ ID NO: 647071 - DNA, 17 bp, Homo sapiens
ggcccggcccacgcaga

SEQ ID NO: 647072 - DNA, 20 bp, Homo sapiens
ggcccggcccacgcagagcc

SEQ ID NO: 647073 - DNA, 21 bp, Homo sapiens
ggcccggcccacgcagagccc

SEQ ID NO: 647074 - DNA, 22 bp, Homo sapiens
ggccctaggattcctcccccag

SEQ ID NO: 647075 - DNA, 17 bp, Homo sapiens
ggccctcagcgtctccc

SEQ ID NO: 647076 - DNA, 19 bp, Homo sapiens
ggccctcagcgtctcccca

SEQ ID NO: 647077 - DNA, 15 bp, Homo sapiens
ggccctctgtccaca

SEQ ID NO: 647078 - DNA, 16 bp, Homo sapiens
ggccctctgtccacat

SEQ ID NO: 647079 - DNA, 19 bp, Homo sapiens
ggccctcttcttattcatg

SEQ ID NO: 647080 - DNA, 14 bp, Homo sapiens
ggccctgacttctg

SEQ ID NO: 647081 - DNA, 14 bp, Homo sapiens
ggccctgccctccc

SEQ ID NO: 647082 - DNA, 23 bp, Homo sapiens
ggccctgccctcccccacggccg

SEQ ID NO: 647083 - DNA, 23 bp, Homo sapiens
ggccctgcctcactgtgacctgc

SEQ ID NO: 647084 - DNA, 13 bp, Homo sapiens
ggccctggagcca

SEQ ID NO: 647085 - DNA, 16 bp, Homo sapiens
ggccctggagccaggg

SEQ ID NO: 647086 - DNA, 19 bp, Homo sapiens
ggccctggggtctctgagc

SEQ ID NO: 647087 - DNA, 12 bp, Homo sapiens
ggccctgtggga

SEQ ID NO: 647088 - DNA, 20 bp, Homo sapiens
ggcccttcccaacctcccct

SEQ ID NO: 647089 - DNA, 15 bp, Homo sapiens
ggccctttcgtccac

SEQ ID NO: 647090 - DNA, 17 bp, Homo sapiens
ggccgaagccccttgga

SEQ ID NO: 647091 - DNA, 20 bp, Homo sapiens
ggccgaagccccttggagag

SEQ ID NO: 647092 - DNA, 17 bp, Homo sapiens
ggccgactgggctgctg

SEQ ID NO: 647093 - DNA, 19 bp, Homo sapiens
ggccgactgggctgctggg

SEQ ID NO: 647094 - DNA, 13 bp, Homo sapiens
ggccgaggcctgc

SEQ ID NO: 647095 - DNA, 20 bp, Homo sapiens
ggccgcagggcgctccggca

SEQ ID NO: 647096 - DNA, 22 bp, Homo sapiens
ggccgcagggcgctccggcaga

SEQ ID NO: 647097 - DNA, 14 bp, Homo sapiens
ggccgctctccgcc

SEQ ID NO: 647098 - DNA, 21 bp, Homo sapiens
ggccgctgcagtcagcacaga

SEQ ID NO: 647099 - DNA, 23 bp, Homo sapiens
ggccgctgcagtcagcacagaga

SEQ ID NO: 647100 - DNA, 14 bp, Homo sapiens
ggccggggctgccg

SEQ ID NO: 647101 - DNA, 23 bp, Homo sapiens
ggccggtccaccccgtcccggcc

SEQ ID NO: 647102 - DNA, 23 bp, Homo sapiens
ggccgtccctgacttcccagctg

SEQ ID NO: 647103 - DNA, 16 bp, Homo sapiens
ggcctaatccacctgg

SEQ ID NO: 647104 - DNA, 21 bp, Homo sapiens
ggcctccatgccccagctctg

SEQ ID NO: 647105 - DNA, 23 bp, Homo sapiens
ggcctccccgggggtccccggac

SEQ ID NO: 647106 - DNA, 12 bp, Homo sapiens
ggcctcctagcc

SEQ ID NO: 647107 - DNA, 16 bp, Homo sapiens
ggcctgagggaagccc

SEQ ID NO: 647108 - DNA, 17 bp, Homo sapiens
ggcctgagggaagccca

SEQ ID NO: 647109 - DNA, 20 bp, Homo sapiens
ggcctgagggaagcccaccc

SEQ ID NO: 647110 - DNA, 18 bp, Homo sapiens
ggcctgagttagctgttt

SEQ ID NO: 647111 - DNA, 17 bp, Homo sapiens
ggcctgatggccaggcc

SEQ ID NO: 647112 - DNA, 17 bp, Homo sapiens
ggcctgcatggagaagg

SEQ ID NO: 647113 - DNA, 21 bp, Homo sapiens
ggcctgccccccttcccaccc

SEQ ID NO: 647114 - DNA, 22 bp, Homo sapiens
ggcctgggtccccctcctgcac

SEQ ID NO: 647115 - DNA, 14 bp, Homo sapiens
ggcctggtctggag

SEQ ID NO: 647116 - DNA, 14 bp, Homo sapiens
ggcgcccacctgcc

SEQ ID NO: 647117 - DNA, 14 bp, Homo sapiens
ggcgccgcctcgcc

SEQ ID NO: 647118 - DNA, 22 bp, Homo sapiens
ggggctgttagctcagaggaga

SEQ ID NO: 647119 - DNA, 18 bp, Homo sapiens
ggggcttccatggtggtt

SEQ ID NO: 647120 - DNA, 17 bp, Homo sapiens
ggggcttggaagggcgc

SEQ ID NO: 647121 - DNA, 24 bp, Homo sapiens
ggggcttggagcagagacggcagc

SEQ ID NO: 647122 - DNA, 21 bp, Homo sapiens
ggggcttggggtagagaggac

SEQ ID NO: 647123 - DNA, 22 bp, Homo sapiens
gggggactgctttcagtgcctg

SEQ ID NO: 647124 - DNA, 15 bp, Homo sapiens
ggggtagagaggaca

SEQ ID NO: 647125 - DNA, 14 bp, Homo sapiens
ggggtccaggcccg

SEQ ID NO: 647126 - DNA, 18 bp, Homo sapiens
ggggtgccccacaaggcc

SEQ ID NO: 647127 - DNA, 21 bp, Homo sapiens
ggggtggaattattagcacca

SEQ ID NO: 647128 - DNA, 15 bp, Homo sapiens
gggtagagaggacag

SEQ ID NO: 647129 - DNA, 21 bp, Homo sapiens
gggtcatattcataccttctg

SEQ ID NO: 647130 - DNA, 14 bp, Homo sapiens
gggtcctgctgctc

SEQ ID NO: 647131 - DNA, 21 bp, Homo sapiens
gggtcgggggaggagcacccc

SEQ ID NO: 647132 - DNA, 14 bp, Homo sapiens
gggtctccctgggc

SEQ ID NO: 647133 - DNA, 20 bp, Homo sapiens
gggtctccctgggcaccctg

SEQ ID NO: 647134 - DNA, 10 bp, Homo sapiens
gggtctgtga

SEQ ID NO: 647135 - DNA, 19 bp, Homo sapiens
gggtctgtgggactggccc

SEQ ID NO: 647136 - DNA, 15 bp, Homo sapiens
gggtgaggcgtggga

SEQ ID NO: 647137 - DNA, 22 bp, Homo sapiens
gggtgccccacaaggcccagcc

SEQ ID NO: 647138 - DNA, 16 bp, Homo sapiens
gggtgccccccatgcc

SEQ ID NO: 647139 - DNA, 15 bp, Homo sapiens
gggtgcctggctggg

SEQ ID NO: 647140 - DNA, 20 bp, Homo sapiens
gggtgcgtgaccggcccgcc

SEQ ID NO: 647141 - DNA, 12 bp, Homo sapiens
gggtgggaagag

SEQ ID NO: 647142 - DNA, 17 bp, Homo sapiens
gggtggggcttggaagg

SEQ ID NO: 647143 - DNA, 13 bp, Homo sapiens
gggtgtgccaggc

SEQ ID NO: 647144 - DNA, 20 bp, Homo sapiens
gggttaaagaaaggcagaga

SEQ ID NO: 647145 - DNA, 23 bp, Homo sapiens
gggttccagacagagtggatctg

SEQ ID NO: 647146 - DNA, 22 bp, Homo sapiens
gggttctatatttactgtttat

SEQ ID NO: 647147 - DNA, 19 bp, Homo sapiens
gggttctgccctgcctgag

SEQ ID NO: 647148 - DNA, 21 bp, Homo sapiens
gggttctgccctgcctgagga

SEQ ID NO: 647149 - DNA, 15 bp, Homo sapiens
gggttctttggaagc

SEQ ID NO: 647150 - DNA, 13 bp, Homo sapiens
gggttgttgcaga

SEQ ID NO: 647151 - DNA, 14 bp, Homo sapiens
gggtttgggcagtg

SEQ ID NO: 647152 - DNA, 17 bp, Homo sapiens
ggtaacttgctgtgaaa

SEQ ID NO: 647153 - DNA, 16 bp, Homo sapiens
ggtaagggactccaga

SEQ ID NO: 647154 - DNA, 18 bp, Homo sapiens
ggtacaagctacatatgt

SEQ ID NO: 647155 - DNA, 16 bp, Homo sapiens
ggtagaaactttggaa

SEQ ID NO: 647156 - DNA, 12 bp, Homo sapiens
ggtagagaggac

SEQ ID NO: 647157 - DNA, 17 bp, Homo sapiens
ggtaggctgctggcgcc

SEQ ID NO: 647158 - DNA, 12 bp, Homo sapiens
ggtatgatcatt

SEQ ID NO: 647159 - DNA, 17 bp, Homo sapiens
ggtattatctagtaggt

SEQ ID NO: 647160 - DNA, 23 bp, Homo sapiens
ggtattgtcttttgacatccagc

SEQ ID NO: 647161 - DNA, 11 bp, Homo sapiens
ggtatttactg

SEQ ID NO: 647162 - DNA, 12 bp, Homo sapiens
ggtatttactgc

SEQ ID NO: 647163 - DNA, 23 bp, Homo sapiens
ggtcagcaccgtggtgtgaggcc

SEQ ID NO: 647164 - DNA, 20 bp, Homo sapiens
ggtcagtgaagcccaggagg

SEQ ID NO: 647165 - DNA, 19 bp, Homo sapiens
ggtcagtgttataaaatct

SEQ ID NO: 647166 - DNA, 23 bp, Homo sapiens
ggtcatattcataccttctgatg

SEQ ID NO: 647167 - DNA, 17 bp, Homo sapiens
ggtccaatccagccttc

SEQ ID NO: 647168 - DNA, 18 bp, Homo sapiens
ggtccaatccagccttct

SEQ ID NO: 647169 - DNA, 14 bp, Homo sapiens
ggtccaccccgtcc

SEQ ID NO: 647170 - DNA, 15 bp, Homo sapiens
ggtccaccccgtccc

SEQ ID NO: 647171 - DNA, 18 bp, Homo sapiens
ggtccaccccgtcccggc

SEQ ID NO: 647172 - DNA, 23 bp, Homo sapiens
ggtccaccccgtcccggccccgc

SEQ ID NO: 647173 - DNA, 19 bp, Homo sapiens
ggtccagccctccgccagc

SEQ ID NO: 647174 - DNA, 12 bp, Homo sapiens
ggtccaggcccg

SEQ ID NO: 647175 - DNA, 13 bp, Homo sapiens
ggtccaggcccgt

SEQ ID NO: 647176 - DNA, 15 bp, Homo sapiens
ggtccctgccagtgt

SEQ ID NO: 647177 - DNA, 16 bp, Homo sapiens
ggtcctgagtggctga

SEQ ID NO: 647178 - DNA, 18 bp, Homo sapiens
ggtcctgggggctgctgc

SEQ ID NO: 647179 - DNA, 17 bp, Homo sapiens
ggtcctttgagtgtcag

SEQ ID NO: 647180 - DNA, 13 bp, Homo sapiens
ggtcgcccctcct

SEQ ID NO: 647181 - DNA, 23 bp, Homo sapiens
ggtcgggggaggagcacccccag

SEQ ID NO: 647182 - DNA, 11 bp, Homo sapiens
ggtctccaccc

SEQ ID NO: 647183 - DNA, 12 bp, Homo sapiens
ggtctccacccc

SEQ ID NO: 647184 - DNA, 14 bp, Homo sapiens
ggtctccacccctc

SEQ ID NO: 647185 - DNA, 17 bp, Homo sapiens
ggtctccacccctcaag

SEQ ID NO: 647186 - DNA, 15 bp, Homo sapiens
ggtctcgcagcctga

SEQ ID NO: 647187 - DNA, 16 bp, Homo sapiens
ggtctcgcagcctgaa

SEQ ID NO: 647188 - DNA, 20 bp, Homo sapiens
ggtctcgcagcctgaagcct

SEQ ID NO: 647189 - DNA, 15 bp, Homo sapiens
ggtctctttctttcc

SEQ ID NO: 647190 - DNA, 17 bp, Homo sapiens
ggtctctttctttccaa

SEQ ID NO: 647191 - DNA, 21 bp, Homo sapiens
ggtctgcacacataacacaca

SEQ ID NO: 647192 - DNA, 16 bp, Homo sapiens
ggtctggcgccagggg

SEQ ID NO: 647193 - DNA, 17 bp, Homo sapiens
ggtctggcgccaggggc

SEQ ID NO: 647194 - DNA, 16 bp, Homo sapiens
ggtctgtgggactggc

SEQ ID NO: 647195 - DNA, 14 bp, Homo sapiens
ggtcttggagagga

SEQ ID NO: 647196 - DNA, 16 bp, Homo sapiens
ggtcttggagaggagg

SEQ ID NO: 647197 - DNA, 22 bp, Homo sapiens
ggtcttggattggtaccagagc

SEQ ID NO: 647198 - DNA, 15 bp, Homo sapiens
ggtgaactgaagcag

SEQ ID NO: 647199 - DNA, 19 bp, Homo sapiens
ggtgaatgtgtgaaggtct

SEQ ID NO: 647200 - DNA, 18 bp, Homo sapiens
ggtgaggcgtgggatcca

SEQ ID NO: 647201 - DNA, 21 bp, Homo sapiens
ggtgatactccaaggtggcat

SEQ ID NO: 647202 - DNA, 13 bp, Homo sapiens
ggtgcagtgaaga

SEQ ID NO: 647203 - DNA, 19 bp, Homo sapiens
ggtgccccccatgccctcc

SEQ ID NO: 647204 - DNA, 23 bp, Homo sapiens
ggtgccctgttgacctaccctgg

SEQ ID NO: 647205 - DNA, 14 bp, Homo sapiens
ggtgcctggctggg

SEQ ID NO: 647206 - DNA, 15 bp, Homo sapiens
ggtgcctggctgggc

SEQ ID NO: 647207 - DNA, 14 bp, Homo sapiens
ggtgcggaccggag

SEQ ID NO: 647208 - DNA, 20 bp, Homo sapiens
ggtgcggaccggagcggctg

SEQ ID NO: 647209 - DNA, 24 bp, Homo sapiens
ggtgcggaccggagcggctgagga

SEQ ID NO: 647210 - DNA, 16 bp, Homo sapiens
ggtgctgaatgaagct

SEQ ID NO: 647211 - DNA, 18 bp, Homo sapiens
ggtgctgggtccttaaaa

SEQ ID NO: 647212 - DNA, 23 bp, Homo sapiens
ggtggaattattagcaccagctt

SEQ ID NO: 647213 - DNA, 21 bp, Homo sapiens
ggtggagtcagggctgtgctt

SEQ ID NO: 647214 - DNA, 19 bp, Homo sapiens
ggtggcagggaagggtgcc

SEQ ID NO: 647215 - DNA, 22 bp, Homo sapiens
ggtggcagggaagggtgcctgg

SEQ ID NO: 647216 - DNA, 23 bp, Homo sapiens
ggtggcagggaagggtgcctggc

SEQ ID NO: 647217 - DNA, 12 bp, Homo sapiens
ggtggccctgcg

SEQ ID NO: 647218 - DNA, 15 bp, Homo sapiens
ggtggggccagcgct

SEQ ID NO: 647219 - DNA, 15 bp, Homo sapiens
ggtggggcttggaag

SEQ ID NO: 647220 - DNA, 17 bp, Homo sapiens
ggtggttggaggcctgg

SEQ ID NO: 647221 - DNA, 20 bp, Homo sapiens
ggtgtagggaacggcctgag

SEQ ID NO: 647222 - DNA, 20 bp, Homo sapiens
ggtgtctggaaaagcacttt

SEQ ID NO: 647223 - DNA, 11 bp, Homo sapiens
ggtgtggcttg

SEQ ID NO: 647224 - DNA, 19 bp, Homo sapiens
ggtgtttggaggctgctgc

SEQ ID NO: 647225 - DNA, 19 bp, Homo sapiens
ggttaaagaaaggcagaga

SEQ ID NO: 647226 - DNA, 20 bp, Homo sapiens
ggttaacagtaaatatacac

SEQ ID NO: 647227 - DNA, 14 bp, Homo sapiens
ggttatttatttaa

SEQ ID NO: 647228 - DNA, 18 bp, Homo sapiens
ggttatttatttaaatgt

SEQ ID NO: 647229 - DNA, 13 bp, Homo sapiens
ggttccacgtggg

SEQ ID NO: 647230 - DNA, 18 bp, Homo sapiens
ggttccagacagagtgga

SEQ ID NO: 647231 - DNA, 13 bp, Homo sapiens
ggttccagacagg

SEQ ID NO: 647232 - DNA, 13 bp, Homo sapiens
ggttctgccctgc

SEQ ID NO: 647233 - DNA, 17 bp, Homo sapiens
ggttctgccctgcctga

SEQ ID NO: 647234 - DNA, 18 bp, Homo sapiens
ggttctgccctgcctgag

SEQ ID NO: 647235 - DNA, 19 bp, Homo sapiens
gtcttttaaaaactcctgt

SEQ ID NO: 647236 - DNA, 13 bp, Homo sapiens
gtcttttgttctc

SEQ ID NO: 647237 - DNA, 18 bp, Homo sapiens
gtcttttgttctctcttg

SEQ ID NO: 647238 - DNA, 20 bp, Homo sapiens
gtcttttgttctctcttggt

SEQ ID NO: 647239 - DNA, 17 bp, Homo sapiens
gtgaaacagtgtggatg

SEQ ID NO: 647240 - DNA, 19 bp, Homo sapiens
gtgaaattagtattttgag

SEQ ID NO: 647241 - DNA, 18 bp, Homo sapiens
gtgaactgataatttttg

SEQ ID NO: 647242 - DNA, 19 bp, Homo sapiens
gtgaactttctcagcatat

SEQ ID NO: 647243 - DNA, 16 bp, Homo sapiens
gtgaagcatccaggca

SEQ ID NO: 647244 - DNA, 15 bp, Homo sapiens
gtgaagcccaggagg

SEQ ID NO: 647245 - DNA, 17 bp, Homo sapiens
gtgaatgttgtcctgtg

SEQ ID NO: 647246 - DNA, 15 bp, Homo sapiens
gtgacagaaggcccg

SEQ ID NO: 647247 - DNA, 22 bp, Homo sapiens
gtgacagaaggcccgaggaggc

SEQ ID NO: 647248 - DNA, 14 bp, Homo sapiens
gtgaccggcccgcc

SEQ ID NO: 647249 - DNA, 15 bp, Homo sapiens
gtgaccggcccgcca

SEQ ID NO: 647250 - DNA, 20 bp, Homo sapiens
gtgaccggcccgccaccttg

SEQ ID NO: 647251 - DNA, 21 bp, Homo sapiens
gtgaccggcccgccaccttgt

SEQ ID NO: 647252 - DNA, 19 bp, Homo sapiens
gtgacctgctcctgcccac

SEQ ID NO: 647253 - DNA, 23 bp, Homo sapiens
gtgacttcagactctctcctctc

SEQ ID NO: 647254 - DNA, 17 bp, Homo sapiens
gtgagcactatctttca

SEQ ID NO: 647255 - DNA, 20 bp, Homo sapiens
gtgagcatatataatcaaaa

SEQ ID NO: 647256 - DNA, 15 bp, Homo sapiens
gtgaggcccccggag

SEQ ID NO: 647257 - DNA, 19 bp, Homo sapiens
gtgaggtcctgtcctggct

SEQ ID NO: 647258 - DNA, 14 bp, Homo sapiens
gtgatgagaggaaa

SEQ ID NO: 647259 - DNA, 14 bp, Homo sapiens
gtgatgtgatttat

SEQ ID NO: 647260 - DNA, 17 bp, Homo sapiens
gtgatgtgatttatgca

SEQ ID NO: 647261 - DNA, 17 bp, Homo sapiens
gtgatttatgcatttat

SEQ ID NO: 647262 - DNA, 18 bp, Homo sapiens
gtgcaatgacctttcaat

SEQ ID NO: 647263 - DNA, 22 bp, Homo sapiens
gtgcaatgacctttcaatagga

SEQ ID NO: 647264 - DNA, 17 bp, Homo sapiens
gtgcagaaaacattgtt

SEQ ID NO: 647265 - DNA, 19 bp, Homo sapiens
gtgcaggcgcgcaccgccc

SEQ ID NO: 647266 - DNA, 19 bp, Homo sapiens
gtgcagtagagagcctttc

SEQ ID NO: 647267 - DNA, 22 bp, Homo sapiens
gtgcagtttggtatgaaacaaa

SEQ ID NO: 647268 - DNA, 12 bp, Homo sapiens
gtgcatgttaaa

SEQ ID NO: 647269 - DNA, 15 bp, Homo sapiens
gtgcatgttaaaata

SEQ ID NO: 647270 - DNA, 21 bp, Homo sapiens
gtgcatgttgccatgaggcct

SEQ ID NO: 647271 - DNA, 22 bp, Homo sapiens
gtgcatgttgccatgaggcctt

SEQ ID NO: 647272 - DNA, 19 bp, Homo sapiens
gtgcccacccgtgttctcc

SEQ ID NO: 647273 - DNA, 14 bp, Homo sapiens
gtgcccagtcttga

SEQ ID NO: 647274 - DNA, 15 bp, Homo sapiens
gtgcccagtcttgag

SEQ ID NO: 647275 - DNA, 20 bp, Homo sapiens
gtgcccagtcttgagtgggc

SEQ ID NO: 647276 - DNA, 20 bp, Homo sapiens
gtgccccacaaggcccagcc

SEQ ID NO: 647277 - DNA, 12 bp, Homo sapiens
gtgcccccagcg

SEQ ID NO: 647278 - DNA, 18 bp, Homo sapiens
gtgcccccagcgtggggc

SEQ ID NO: 647279 - DNA, 22 bp, Homo sapiens
gtgccctctcactgacttctcc

SEQ ID NO: 647280 - DNA, 13 bp, Homo sapiens
gtgccctggggca

SEQ ID NO: 647281 - DNA, 14 bp, Homo sapiens
gtgccgtggagctt

SEQ ID NO: 647282 - DNA, 22 bp, Homo sapiens
gtgccgtggagcttggagcccc

SEQ ID NO: 647283 - DNA, 20 bp, Homo sapiens
gtgcctaactccttacagaa

SEQ ID NO: 647284 - DNA, 15 bp, Homo sapiens
gtgcctggctgggct

SEQ ID NO: 647285 - DNA, 21 bp, Homo sapiens
gtgccttatggaacactctga

SEQ ID NO: 647286 - DNA, 14 bp, Homo sapiens
gtgccttccccgtg

SEQ ID NO: 647287 - DNA, 20 bp, Homo sapiens
gtgccttccccgtgcggccc

SEQ ID NO: 647288 - DNA, 15 bp, Homo sapiens
gtgcgcagccgcgct

SEQ ID NO: 647289 - DNA, 23 bp, Homo sapiens
gtgcgcagccgcgctctgcccct

SEQ ID NO: 647290 - DNA, 19 bp, Homo sapiens
gtgcggcccgtgcgcagcc

SEQ ID NO: 647291 - DNA, 21 bp, Homo sapiens
gtgcggcccgtgcgcagccgc

SEQ ID NO: 647292 - DNA, 22 bp, Homo sapiens
gtgcgtgaccggcccgccacct

SEQ ID NO: 647293 - DNA, 18 bp, Homo sapiens
gtgcgtgtggccctgtgg

SEQ ID NO: 647294 - DNA, 15 bp, Homo sapiens
gtgctcatcagaaac

SEQ ID NO: 647295 - DNA, 20 bp, Homo sapiens
gtggaagaagggccaccctg

SEQ ID NO: 647296 - DNA, 21 bp, Homo sapiens
gtggaattattagcaccagct

SEQ ID NO: 647297 - DNA, 17 bp, Homo sapiens
gtggacgtgggctccag

SEQ ID NO: 647298 - DNA, 20 bp, Homo sapiens
gtggacgtgggctccaggga

SEQ ID NO: 647299 - DNA, 14 bp, Homo sapiens
gtggactgtatttc

SEQ ID NO: 647300 - DNA, 20 bp, Homo sapiens
gtggaggaggaggaggagcc

SEQ ID NO: 647301 - DNA, 17 bp, Homo sapiens
gtggataaattttggaa

SEQ ID NO: 647302 - DNA, 17 bp, Homo sapiens
gtggcacacaactgtgg

SEQ ID NO: 647303 - DNA, 19 bp, Homo sapiens
gtggcacgtcatctagttt

SEQ ID NO: 647304 - DNA, 22 bp, Homo sapiens
gtggcagggaagggtgcctggc

SEQ ID NO: 647305 - DNA, 23 bp, Homo sapiens
gtggcagggaagggtgcctggct

SEQ ID NO: 647306 - DNA, 19 bp, Homo sapiens
gtggcaggtgggctgcctg

SEQ ID NO: 647307 - DNA, 18 bp, Homo sapiens
gtggcccctccttctccc

SEQ ID NO: 647308 - DNA, 23 bp, Homo sapiens
gtggcgctgtcggtgtttggagg

SEQ ID NO: 647309 - DNA, 17 bp, Homo sapiens
gtggctctaactccttg

SEQ ID NO: 647310 - DNA, 12 bp, Homo sapiens
gtggctgcttca

SEQ ID NO: 647311 - DNA, 14 bp, Homo sapiens
gtggctgcttcaag

SEQ ID NO: 647312 - DNA, 22 bp, Homo sapiens
gtggctgcttcaaggatcctga

SEQ ID NO: 647313 - DNA, 15 bp, Homo sapiens
gtggctggagcccca

SEQ ID NO: 647314 - DNA, 18 bp, Homo sapiens
gtggcttggaacatttgg

SEQ ID NO: 647315 - DNA, 14 bp, Homo sapiens
gtggctttgtgctt

SEQ ID NO: 647316 - DNA, 18 bp, Homo sapiens
gtgggactggcccacccc

SEQ ID NO: 647317 - DNA, 12 bp, Homo sapiens
gtgggagtccac

SEQ ID NO: 647318 - DNA, 18 bp, Homo sapiens
gtgggagtccactttcct

SEQ ID NO: 647319 - DNA, 21 bp, Homo sapiens
gtgggagtccactttcctctc

SEQ ID NO: 647320 - DNA, 22 bp, Homo sapiens
gtgggagtccactttcctctct

SEQ ID NO: 647321 - DNA, 17 bp, Homo sapiens
gtgggatccagagagaa

SEQ ID NO: 647322 - DNA, 16 bp, Homo sapiens
gtgggcgcaaaggtgc

SEQ ID NO: 647323 - DNA, 14 bp, Homo sapiens
gtgggctccagagt

SEQ ID NO: 647324 - DNA, 13 bp, Homo sapiens
gtgggctgcctgc

SEQ ID NO: 647325 - DNA, 15 bp, Homo sapiens
gtgggctgggccctc

SEQ ID NO: 647326 - DNA, 14 bp, Homo sapiens
gtggggagggtggg

SEQ ID NO: 647327 - DNA, 15 bp, Homo sapiens
gtggggagggtgggc

SEQ ID NO: 647328 - DNA, 16 bp, Homo sapiens
gtggggcccatggccc

SEQ ID NO: 647329 - DNA, 19 bp, Homo sapiens
gtggggcccatggccccag

SEQ ID NO: 647330 - DNA, 23 bp, Homo sapiens
gtggggcccatggccccagctgg

SEQ ID NO: 647331 - DNA, 20 bp, Homo sapiens
gtggggcttagaatggggct

SEQ ID NO: 647332 - DNA, 23 bp, Homo sapiens
gtggggtcccccctgagtgggct

SEQ ID NO: 647333 - DNA, 23 bp, Homo sapiens
gtggtattttaacatagcagctg

SEQ ID NO: 647334 - DNA, 19 bp, Homo sapiens
gtggtcttcaaattgtctt

SEQ ID NO: 647335 - DNA, 21 bp, Homo sapiens
gtggtgcgggccaggtctggc

SEQ ID NO: 647336 - DNA, 15 bp, Homo sapiens
gtggtgtgaggcccc

SEQ ID NO: 647337 - DNA, 18 bp, Homo sapiens
gtggtgtgaggcccccgg

SEQ ID NO: 647338 - DNA, 18 bp, Homo sapiens
gtggttcgggggaaatag

SEQ ID NO: 647339 - DNA, 23 bp, Homo sapiens
gtggtttgttatcagtacaattc

SEQ ID NO: 647340 - DNA, 17 bp, Homo sapiens
gtgtagctctgtccact

SEQ ID NO: 647341 - DNA, 18 bp, Homo sapiens
gtgtatagggaattttca

SEQ ID NO: 647342 - DNA, 20 bp, Homo sapiens
gtgtatagggaattttcatt

SEQ ID NO: 647343 - DNA, 18 bp, Homo sapiens
gtgtatggaagacaaata

SEQ ID NO: 647344 - DNA, 23 bp, Homo sapiens
gtgtatggaagacaaatacacat

SEQ ID NO: 647345 - DNA, 18 bp, Homo sapiens
gtgtcacactgagctggg

SEQ ID NO: 647346 - DNA, 19 bp, Homo sapiens
gtgtcaggattgaggatga

SEQ ID NO: 647347 - DNA, 16 bp, Homo sapiens
gtgtcatctgtcagct

SEQ ID NO: 647348 - DNA, 14 bp, Homo sapiens
gtgtcccgttgtgt

SEQ ID NO: 647349 - DNA, 11 bp, Homo sapiens
gtgtcctctgt

SEQ ID NO: 647350 - DNA, 15 bp, Homo sapiens
taaatcccacgacat

SEQ ID NO: 647351 - DNA, 18 bp, Homo sapiens
taaatctttgttaaaata

SEQ ID NO: 647352 - DNA, 19 bp, Homo sapiens
taaatctttgttaaaatat

SEQ ID NO: 647353 - DNA, 12 bp, Homo sapiens
taaatgaaatac

SEQ ID NO: 647354 - DNA, 15 bp, Homo sapiens
taaatgaaatacttg

SEQ ID NO: 647355 - DNA, 17 bp, Homo sapiens
taaatgaatgaaatata

SEQ ID NO: 647356 - DNA, 14 bp, Homo sapiens
taaatgtatattga

SEQ ID NO: 647357 - DNA, 16 bp, Homo sapiens
taaattaacaaattca

SEQ ID NO: 647358 - DNA, 18 bp, Homo sapiens
taaattaacaaattcagt

SEQ ID NO: 647359 - DNA, 21 bp, Homo sapiens
taaattaatgagttttatcca

SEQ ID NO: 647360 - DNA, 13 bp, Homo sapiens
taaattaattttt

SEQ ID NO: 647361 - DNA, 19 bp, Homo sapiens
taaattaatttttcaattt

SEQ ID NO: 647362 - DNA, 15 bp, Homo sapiens
taaattatttctaaa

SEQ ID NO: 647363 - DNA, 15 bp, Homo sapiens
taaattcaaacctaa

SEQ ID NO: 647364 - DNA, 17 bp, Homo sapiens
taaatttattaaatgtt

SEQ ID NO: 647365 - DNA, 23 bp, Homo sapiens
taaattttataaggctgactctt

SEQ ID NO: 647366 - DNA, 19 bp, Homo sapiens
taaatttttgtaagaaaat

SEQ ID NO: 647367 - DNA, 22 bp, Homo sapiens
taacaacaatttaggaatgctc

SEQ ID NO: 647368 - DNA, 23 bp, Homo sapiens
taacaacaatttaggaatgctca

SEQ ID NO: 647369 - DNA, 23 bp, Homo sapiens
taacaatgttttttatacttcaa

SEQ ID NO: 647370 - DNA, 14 bp, Homo sapiens
taacactattttat

SEQ ID NO: 647371 - DNA, 22 bp, Homo sapiens
taacactcaagactatgttctc

SEQ ID NO: 647372 - DNA, 15 bp, Homo sapiens
taacactgagtgaaa

SEQ ID NO: 647373 - DNA, 18 bp, Homo sapiens
taacactgagtgaaatat

SEQ ID NO: 647374 - DNA, 21 bp, Homo sapiens
taacactgagtgaaatattac

SEQ ID NO: 647375 - DNA, 14 bp, Homo sapiens
taacagtaactgcc

SEQ ID NO: 647376 - DNA, 16 bp, Homo sapiens
taacagtaactgccat

SEQ ID NO: 647377 - DNA, 22 bp, Homo sapiens
taacagtaactgccattttttg

SEQ ID NO: 647378 - DNA, 20 bp, Homo sapiens
taacatatcattcagaatgt

SEQ ID NO: 647379 - DNA, 23 bp, Homo sapiens
taacattatattcccaaatctca

SEQ ID NO: 647380 - DNA, 20 bp, Homo sapiens
taacattcttggtcacaaag

SEQ ID NO: 647381 - DNA, 13 bp, Homo sapiens
taacccagtgttc

SEQ ID NO: 647382 - DNA, 20 bp, Homo sapiens
taaccctgaatcagaggcag

SEQ ID NO: 647383 - DNA, 22 bp, Homo sapiens
taacctgggttgttgcagagta

SEQ ID NO: 647384 - DNA, 17 bp, Homo sapiens
taaccttatcataaatt

SEQ ID NO: 647385 - DNA, 14 bp, Homo sapiens
taactaatgtaaat

SEQ ID NO: 647386 - DNA, 22 bp, Homo sapiens
taactaatgtaaatattgctgt

SEQ ID NO: 647387 - DNA, 21 bp, Homo sapiens
taactacctttggcttaattc

SEQ ID NO: 647388 - DNA, 18 bp, Homo sapiens
taactactttctgttatc

SEQ ID NO: 647389 - DNA, 16 bp, Homo sapiens
taactccgtttccaaa

SEQ ID NO: 647390 - DNA, 18 bp, Homo sapiens
taactgccattttttgtc

SEQ ID NO: 647391 - DNA, 22 bp, Homo sapiens
taactgccattttttgtctgtg

SEQ ID NO: 647392 - DNA, 12 bp, Homo sapiens
taactgcttcaa

SEQ ID NO: 647393 - DNA, 16 bp, Homo sapiens
taactgcttcaagtgt

SEQ ID NO: 647394 - DNA, 17 bp, Homo sapiens
taacttattttgattgt

SEQ ID NO: 647395 - DNA, 13 bp, Homo sapiens
taacttcagatgt

SEQ ID NO: 647396 - DNA, 16 bp, Homo sapiens
taacttcagatgtttc

SEQ ID NO: 647397 - DNA, 17 bp, Homo sapiens
taacttcagatgtttcc

SEQ ID NO: 647398 - DNA, 18 bp, Homo sapiens
taacttcagatgtttcca

SEQ ID NO: 647399 - DNA, 13 bp, Homo sapiens
taacttgctgtga

SEQ ID NO: 647400 - DNA, 14 bp, Homo sapiens
taacttgctgtgaa

SEQ ID NO: 647401 - DNA, 19 bp, Homo sapiens
taacttgctgtgaaatgac

SEQ ID NO: 647402 - DNA, 20 bp, Homo sapiens
taacttgctgtgaaatgact

SEQ ID NO: 647403 - DNA, 16 bp, Homo sapiens
taagaaatgagaaatt

SEQ ID NO: 647404 - DNA, 17 bp, Homo sapiens
taagaaatgagaaattg

SEQ ID NO: 647405 - DNA, 19 bp, Homo sapiens
taagaattcagtagcattt

SEQ ID NO: 647406 - DNA, 14 bp, Homo sapiens
taagacaagtctga

SEQ ID NO: 647407 - DNA, 19 bp, Homo sapiens
taagacacgtgcaacagac

SEQ ID NO: 647408 - DNA, 14 bp, Homo sapiens
taagagattttatg

SEQ ID NO: 647409 - DNA, 16 bp, Homo sapiens
taagagattttatgtt

SEQ ID NO: 647410 - DNA, 16 bp, Homo sapiens
taagagtggaggagga

SEQ ID NO: 647411 - DNA, 17 bp, Homo sapiens
taagagtggaggaggag

SEQ ID NO: 647412 - DNA, 18 bp, Homo sapiens
taagataattaaatgaaa

SEQ ID NO: 647413 - DNA, 21 bp, Homo sapiens
taagataattaaatgaaatac

SEQ ID NO: 647414 - DNA, 16 bp, Homo sapiens
taagatctgactgcca

SEQ ID NO: 647415 - DNA, 23 bp, Homo sapiens
taagatgggcatagggtttggaa

SEQ ID NO: 647416 - DNA, 17 bp, Homo sapiens
taagattgaagctaaaa

SEQ ID NO: 647417 - DNA, 19 bp, Homo sapiens
taagattgaagctaaaaca

SEQ ID NO: 647418 - DNA, 15 bp, Homo sapiens
taagccatagcccca

SEQ ID NO: 647419 - DNA, 15 bp, Homo sapiens
taaggaaaagagaaa

SEQ ID NO: 647420 - DNA, 16 bp, Homo sapiens
taaggactacagaatt

SEQ ID NO: 647421 - DNA, 22 bp, Homo sapiens
taagggactccagaagcagcag

SEQ ID NO: 647422 - DNA, 22 bp, Homo sapiens
taaggtcagtgttataaaatct

SEQ ID NO: 647423 - DNA, 15 bp, Homo sapiens
taagtaaatgtcttc

SEQ ID NO: 647424 - DNA, 16 bp, Homo sapiens
taagtagtgtcattca

SEQ ID NO: 647425 - DNA, 24 bp, Homo sapiens
taagtagtgtcattcatatgagtt

SEQ ID NO: 647426 - DNA, 14 bp, Homo sapiens
taagtggactgtat

SEQ ID NO: 647427 - DNA, 13 bp, Homo sapiens
taagtgttctgtg

SEQ ID NO: 647428 - DNA, 14 bp, Homo sapiens
taagtgttggccat

SEQ ID NO: 647429 - DNA, 15 bp, Homo sapiens
taagttgaagggaaa

SEQ ID NO: 647430 - DNA, 17 bp, Homo sapiens
taagttgaagggaaatc

SEQ ID NO: 647431 - DNA, 19 bp, Homo sapiens
taagttgaagggaaatcaa

SEQ ID NO: 647432 - DNA, 12 bp, Homo sapiens
taagttgaatga

SEQ ID NO: 647433 - DNA, 15 bp, Homo sapiens
taagttgtcttacac

SEQ ID NO: 647434 - DNA, 22 bp, Homo sapiens
taataaatattgtcctgtttct

SEQ ID NO: 647435 - DNA, 20 bp, Homo sapiens
taataaattaatttttcaat

SEQ ID NO: 647436 - DNA, 14 bp, Homo sapiens
taataacagaaata

SEQ ID NO: 647437 - DNA, 17 bp, Homo sapiens
taataacagaaatacat

SEQ ID NO: 647438 - DNA, 13 bp, Homo sapiens
taataactgttag

SEQ ID NO: 647439 - DNA, 17 bp, Homo sapiens
taataatatgtacaaat

SEQ ID NO: 647440 - DNA, 18 bp, Homo sapiens
taataatatgtacaaata

SEQ ID NO: 647441 - DNA, 16 bp, Homo sapiens
taatagctcacagcac

SEQ ID NO: 647442 - DNA, 18 bp, Homo sapiens
taatagctcacagcacat

SEQ ID NO: 647443 - DNA, 23 bp, Homo sapiens
taatagtacccaacctggtaatt

SEQ ID NO: 647444 - DNA, 14 bp, Homo sapiens
taatataaatgaat

SEQ ID NO: 647445 - DNA, 14 bp, Homo sapiens
taatatacagtgtg

SEQ ID NO: 647446 - DNA, 13 bp, Homo sapiens
taatatgcatata

SEQ ID NO: 647447 - DNA, 20 bp, Homo sapiens
taatatgcatatatatgtat

SEQ ID NO: 647448 - DNA, 16 bp, Homo sapiens
taatattgccttgatg

SEQ ID NO: 647449 - DNA, 20 bp, Homo sapiens
taatattgccttgatgtttc

SEQ ID NO: 647450 - DNA, 14 bp, Homo sapiens
taatatttatagag

SEQ ID NO: 647451 - DNA, 24 bp, Homo sapiens
taatatttatagagttcatagaaa

SEQ ID NO: 647452 - DNA, 22 bp, Homo sapiens
taatcaattaatttttttattg

SEQ ID NO: 647453 - DNA, 20 bp, Homo sapiens
taatccacctggtggccctg

SEQ ID NO: 647454 - DNA, 19 bp, Homo sapiens
taatctagagctatgcaca

SEQ ID NO: 647455 - DNA, 14 bp, Homo sapiens
taatgaaaaatctg

SEQ ID NO: 647456 - DNA, 15 bp, Homo sapiens
taatgaaaaatctga

SEQ ID NO: 647457 - DNA, 19 bp, Homo sapiens
taatgaaaaatctgaattt

SEQ ID NO: 647458 - DNA, 23 bp, Homo sapiens
taatgagccaataaagctcacac

SEQ ID NO: 647459 - DNA, 23 bp, Homo sapiens
taatgcttaacataaacttgtac

SEQ ID NO: 647460 - DNA, 17 bp, Homo sapiens
taatgtctcaaaataaa

SEQ ID NO: 647461 - DNA, 16 bp, Homo sapiens
taatgtttagtcagtg

SEQ ID NO: 647462 - DNA, 18 bp, Homo sapiens
taattaaaaagttaatct

SEQ ID NO: 647463 - DNA, 12 bp, Homo sapiens
taattaaagtgt

SEQ ID NO: 647464 - DNA, 23 bp, Homo sapiens
taattagagattgacttcagaaa

SEQ ID NO: 647465 - DNA, 20 bp, Homo sapiens
taattatcctcaagttgtgt

SEQ ID NO: 647466 - DNA, 16 bp, Homo sapiens
tatacacatcataaac

SEQ ID NO: 647467 - DNA, 15 bp, Homo sapiens
tatacactttacatt

SEQ ID NO: 647468 - DNA, 19 bp, Homo sapiens
tatacatacgcaattgtat

SEQ ID NO: 647469 - DNA, 21 bp, Homo sapiens
tatacatacgcaattgtatat

SEQ ID NO: 647470 - DNA, 22 bp, Homo sapiens
tataccccgtgaagcatccagg

SEQ ID NO: 647471 - DNA, 12 bp, Homo sapiens
tatactccttaa

SEQ ID NO: 647472 - DNA, 18 bp, Homo sapiens
tatactccttaaaaatgt

SEQ ID NO: 647473 - DNA, 15 bp, Homo sapiens
tatacttcaaatgtc

SEQ ID NO: 647474 - DNA, 17 bp, Homo sapiens
tatagagacttctaaat

SEQ ID NO: 647475 - DNA, 17 bp, Homo sapiens
tatagagttattatagt

SEQ ID NO: 647476 - DNA, 19 bp, Homo sapiens
tatagagttcatagaaata

SEQ ID NO: 647477 - DNA, 21 bp, Homo sapiens
tatagatggtagaaactttgg

SEQ ID NO: 647478 - DNA, 15 bp, Homo sapiens
tatagggaattttca

SEQ ID NO: 647479 - DNA, 17 bp, Homo sapiens
tatagggaattttcatt

SEQ ID NO: 647480 - DNA, 19 bp, Homo sapiens
tatagggaattttcatttt

SEQ ID NO: 647481 - DNA, 17 bp, Homo sapiens
tatagtgttgtgttaca

SEQ ID NO: 647482 - DNA, 14 bp, Homo sapiens
tatataaaatacac

SEQ ID NO: 647483 - DNA, 17 bp, Homo sapiens
tatataaaatacacgtg

SEQ ID NO: 647484 - DNA, 13 bp, Homo sapiens
tatatataaaata

SEQ ID NO: 647485 - DNA, 16 bp, Homo sapiens
tatatataaaatacac

SEQ ID NO: 647486 - DNA, 16 bp, Homo sapiens
tatatatatatgtata

SEQ ID NO: 647487 - DNA, 14 bp, Homo sapiens
tatatatatgtgaa

SEQ ID NO: 647488 - DNA, 20 bp, Homo sapiens
tatatatgtatatctgtgta

SEQ ID NO: 647489 - DNA, 15 bp, Homo sapiens
tatatattaaaattg

SEQ ID NO: 647490 - DNA, 19 bp, Homo sapiens
tatatatttattattttca

SEQ ID NO: 647491 - DNA, 22 bp, Homo sapiens
tatatatttattattttcatat

SEQ ID NO: 647492 - DNA, 14 bp, Homo sapiens
tatatattttgaaa

SEQ ID NO: 647493 - DNA, 15 bp, Homo sapiens
tatatcagactgctt

SEQ ID NO: 647494 - DNA, 21 bp, Homo sapiens
tatatcagactgctttgagaa

SEQ ID NO: 647495 - DNA, 16 bp, Homo sapiens
tatatctgaaaactgg

SEQ ID NO: 647496 - DNA, 14 bp, Homo sapiens
tatatctgtggtct

SEQ ID NO: 647497 - DNA, 14 bp, Homo sapiens
tatatgaaaactaa

SEQ ID NO: 647498 - DNA, 16 bp, Homo sapiens
tatatgaagcagaatg

SEQ ID NO: 647499 - DNA, 19 bp, Homo sapiens
tatatgaagcagaatgaga

SEQ ID NO: 647500 - DNA, 15 bp, Homo sapiens
tatatgaggatgtat

SEQ ID NO: 647501 - DNA, 22 bp, Homo sapiens
tatatgaggatgtatgtgtata

SEQ ID NO: 647502 - DNA, 22 bp, Homo sapiens
tatatgtaacttcagatgtttc

SEQ ID NO: 647503 - DNA, 16 bp, Homo sapiens
tatatgtgaactttct

SEQ ID NO: 647504 - DNA, 15 bp, Homo sapiens
tatattactgaattg

SEQ ID NO: 647505 - DNA, 12 bp, Homo sapiens
tatattatatat

SEQ ID NO: 647506 - DNA, 13 bp, Homo sapiens
tatattgaagtaa

SEQ ID NO: 647507 - DNA, 19 bp, Homo sapiens
tatattgaagtaagttcat

SEQ ID NO: 647508 - DNA, 15 bp, Homo sapiens
tatattttgaaagga

SEQ ID NO: 647509 - DNA, 20 bp, Homo sapiens
tatatttttaactgcttcaa

SEQ ID NO: 647510 - DNA, 17 bp, Homo sapiens
tatcaaaaaacagaaaa

SEQ ID NO: 647511 - DNA, 22 bp, Homo sapiens
tatcaaaaaacagaaaaacaaa

SEQ ID NO: 647512 - DNA, 15 bp, Homo sapiens
tatcacgggcccgct

SEQ ID NO: 647513 - DNA, 19 bp, Homo sapiens
tatcagaactcctttctaa

SEQ ID NO: 647514 - DNA, 21 bp, Homo sapiens
tatcagctctaaagcagagat

SEQ ID NO: 647515 - DNA, 16 bp, Homo sapiens
tatcagctctgcataa

SEQ ID NO: 647516 - DNA, 22 bp, Homo sapiens
tatcagctctgcataagattat

SEQ ID NO: 647517 - DNA, 19 bp, Homo sapiens
tatcagggcccaaataaca

SEQ ID NO: 647518 - DNA, 16 bp, Homo sapiens
tatcagtacaattctt

SEQ ID NO: 647519 - DNA, 22 bp, Homo sapiens
tatcagtggttcgggggaaata

SEQ ID NO: 647520 - DNA, 15 bp, Homo sapiens
tatcatacgttgata

SEQ ID NO: 647521 - DNA, 12 bp, Homo sapiens
tatcatctaaat

SEQ ID NO: 647522 - DNA, 13 bp, Homo sapiens
tatcatgcttcta

SEQ ID NO: 647523 - DNA, 19 bp, Homo sapiens
tatcatgcttctactccat

SEQ ID NO: 647524 - DNA, 21 bp, Homo sapiens
tatcattatagcatgtaatat

SEQ ID NO: 647525 - DNA, 13 bp, Homo sapiens
tatcatttctctt

SEQ ID NO: 647526 - DNA, 21 bp, Homo sapiens
tatccccggacgcatgcaggg

SEQ ID NO: 647527 - DNA, 24 bp, Homo sapiens
tatccctgatttattctggtgtct

SEQ ID NO: 647528 - DNA, 13 bp, Homo sapiens
tatccctggccac

SEQ ID NO: 647529 - DNA, 16 bp, Homo sapiens
tatcctcaattatctt

SEQ ID NO: 647530 - DNA, 14 bp, Homo sapiens
tatcctgcaccctc

SEQ ID NO: 647531 - DNA, 15 bp, Homo sapiens
tatctatttatctgt

SEQ ID NO: 647532 - DNA, 21 bp, Homo sapiens
tatctatttatctgtctgagc

SEQ ID NO: 647533 - DNA, 19 bp, Homo sapiens
tatctcaaatctgctttca

SEQ ID NO: 647534 - DNA, 24 bp, Homo sapiens
tatctcaaatctgctttcatccag

SEQ ID NO: 647535 - DNA, 14 bp, Homo sapiens
tatctcatcaacaa

SEQ ID NO: 647536 - DNA, 22 bp, Homo sapiens
tatctccagccaatttcaaaga

SEQ ID NO: 647537 - DNA, 12 bp, Homo sapiens
tatctgaaaact

SEQ ID NO: 647538 - DNA, 15 bp, Homo sapiens
tatctgaaaactgga

SEQ ID NO: 647539 - DNA, 18 bp, Homo sapiens
tatctgatgatgttctga

SEQ ID NO: 647540 - DNA, 22 bp, Homo sapiens
tatctggaaaaaaaaaaatatg

SEQ ID NO: 647541 - DNA, 22 bp, Homo sapiens
tatctgtctgagccctgccctc

SEQ ID NO: 647542 - DNA, 13 bp, Homo sapiens
tatctgtgtaaga

SEQ ID NO: 647543 - DNA, 21 bp, Homo sapiens
tatctgtgtaagacacgtgca

SEQ ID NO: 647544 - DNA, 17 bp, Homo sapiens
tatctgtttgcttctaa

SEQ ID NO: 647545 - DNA, 20 bp, Homo sapiens
tatcttaaaagggtggtagt

SEQ ID NO: 647546 - DNA, 21 bp, Homo sapiens
tatcttaaaattggttaatga

SEQ ID NO: 647547 - DNA, 16 bp, Homo sapiens
tatcttaaacccacat

SEQ ID NO: 647548 - DNA, 15 bp, Homo sapiens
tatctttcaggaaat

SEQ ID NO: 647549 - DNA, 14 bp, Homo sapiens
tatgaaacaaatat

SEQ ID NO: 647550 - DNA, 20 bp, Homo sapiens
tatgaaacaaatatactcat

SEQ ID NO: 647551 - DNA, 22 bp, Homo sapiens
tatgaaacaaatatactcattt

SEQ ID NO: 647552 - DNA, 14 bp, Homo sapiens
tatgaaagagaaaa

SEQ ID NO: 647553 - DNA, 15 bp, Homo sapiens
tatgaaagagaaaat

SEQ ID NO: 647554 - DNA, 22 bp, Homo sapiens
tatgaaagagaaaatgctttct

SEQ ID NO: 647555 - DNA, 19 bp, Homo sapiens
tatgaagcagaatgagatg

SEQ ID NO: 647556 - DNA, 21 bp, Homo sapiens
tatgaatctctacgcaaaaaa

SEQ ID NO: 647557 - DNA, 18 bp, Homo sapiens
tatgactttgaataaaat

SEQ ID NO: 647558 - DNA, 18 bp, Homo sapiens
tatgagaaatataaaaat

SEQ ID NO: 647559 - DNA, 20 bp, Homo sapiens
tatgagcatgctccctcatg

SEQ ID NO: 647560 - DNA, 20 bp, Homo sapiens
tatgaggatgtatgtgtata

SEQ ID NO: 647561 - DNA, 18 bp, Homo sapiens
tatgatgtccaaacttaa

SEQ ID NO: 647562 - DNA, 20 bp, Homo sapiens
tatgcacaccaaattgctga

SEQ ID NO: 647563 - DNA, 21 bp, Homo sapiens
tatgcacaccaaattgctgag

SEQ ID NO: 647564 - DNA, 13 bp, Homo sapiens
tatgcatatatat

SEQ ID NO: 647565 - DNA, 22 bp, Homo sapiens
tatgcatatttatagagttatt

SEQ ID NO: 647566 - DNA, 15 bp, Homo sapiens
tatgcatgagaacta

SEQ ID NO: 647567 - DNA, 16 bp, Homo sapiens
tatgcatgagaactaa

SEQ ID NO: 647568 - DNA, 19 bp, Homo sapiens
tatgcatgagaactaaata

SEQ ID NO: 647569 - DNA, 21 bp, Homo sapiens
tatgcatgagaactaaataga

SEQ ID NO: 647570 - DNA, 13 bp, Homo sapiens
tatgcatttatgc

SEQ ID NO: 647571 - DNA, 22 bp, Homo sapiens
tatgcctgtactcgcttgtgca

SEQ ID NO: 647572 - DNA, 17 bp, Homo sapiens
tatgctttccctgagga

SEQ ID NO: 647573 - DNA, 16 bp, Homo sapiens
tatggaaagggtgtgg

SEQ ID NO: 647574 - DNA, 16 bp, Homo sapiens
tatggaacactctgag

SEQ ID NO: 647575 - DNA, 15 bp, Homo sapiens
tatggaagacaaata

SEQ ID NO: 647576 - DNA, 21 bp, Homo sapiens
tatggaagacaaatacacata

SEQ ID NO: 647577 - DNA, 22 bp, Homo sapiens
tatggaagacaaatacacatac

SEQ ID NO: 647578 - DNA, 13 bp, Homo sapiens
tatggatttctag

SEQ ID NO: 647579 - DNA, 21 bp, Homo sapiens
tatggcaacgttcatgttcat

SEQ ID NO: 647580 - DNA, 19 bp, Homo sapiens
tatggcttgtagggtgagg

SEQ ID NO: 647581 - DNA, 15 bp, Homo sapiens
tatggctttgtgctt

SEQ ID NO: 647582 - DNA, 23 bp, Homo sapiens
tccaggtcacaggcatccgctgc

SEQ ID NO: 647583 - DNA, 22 bp, Homo sapiens
tccagtgtggtcttgtttaata

SEQ ID NO: 647584 - DNA, 12 bp, Homo sapiens
tccatactgttt

SEQ ID NO: 647585 - DNA, 15 bp, Homo sapiens
tccatatcagctctg

SEQ ID NO: 647586 - DNA, 19 bp, Homo sapiens
tccatatcagctctgcata

SEQ ID NO: 647587 - DNA, 22 bp, Homo sapiens
tccatatgtgagcactatcttt

SEQ ID NO: 647588 - DNA, 14 bp, Homo sapiens
tccatcaaagccct

SEQ ID NO: 647589 - DNA, 16 bp, Homo sapiens
tccatcaaagccctcc

SEQ ID NO: 647590 - DNA, 17 bp, Homo sapiens
tccatcccaacacatca

SEQ ID NO: 647591 - DNA, 13 bp, Homo sapiens
tccatccgtctct

SEQ ID NO: 647592 - DNA, 21 bp, Homo sapiens
tccatcttgtggggccaggac

SEQ ID NO: 647593 - DNA, 15 bp, Homo sapiens
tccatgccccagctc

SEQ ID NO: 647594 - DNA, 12 bp, Homo sapiens
tccatgctgtcc

SEQ ID NO: 647595 - DNA, 14 bp, Homo sapiens
tccatgctgtccct

SEQ ID NO: 647596 - DNA, 18 bp, Homo sapiens
tccatgctgtccctgtgg

SEQ ID NO: 647597 - DNA, 13 bp, Homo sapiens
tccatggtggttt

SEQ ID NO: 647598 - DNA, 23 bp, Homo sapiens
tccatggtggtttcagaaagggc

SEQ ID NO: 647599 - DNA, 17 bp, Homo sapiens
tccatgtgctgctgtgg

SEQ ID NO: 647600 - DNA, 15 bp, Homo sapiens
tccattcactttcag

SEQ ID NO: 647601 - DNA, 16 bp, Homo sapiens
tccattgacatgtaca

SEQ ID NO: 647602 - DNA, 17 bp, Homo sapiens
tccatttaaacccggct

SEQ ID NO: 647603 - DNA, 17 bp, Homo sapiens
tccatttttgagtaaaa

SEQ ID NO: 647604 - DNA, 14 bp, Homo sapiens
tcccaaacccttcg

SEQ ID NO: 647605 - DNA, 14 bp, Homo sapiens
tcccaaatctcaaa

SEQ ID NO: 647606 - DNA, 15 bp, Homo sapiens
tcccaaatctcaaaa

SEQ ID NO: 647607 - DNA, 21 bp, Homo sapiens
tcccaacccaggattcaacat

SEQ ID NO: 647608 - DNA, 15 bp, Homo sapiens
tcccaacctcccctg

SEQ ID NO: 647609 - DNA, 23 bp, Homo sapiens
tcccaacctcccctggtcctgca

SEQ ID NO: 647610 - DNA, 15 bp, Homo sapiens
tcccaactctggcct

SEQ ID NO: 647611 - DNA, 18 bp, Homo sapiens
tcccaagtcaaacagtgt

SEQ ID NO: 647612 - DNA, 20 bp, Homo sapiens
tcccaagtcaaacagtgtgg

SEQ ID NO: 647613 - DNA, 13 bp, Homo sapiens
tcccacccccagc

SEQ ID NO: 647614 - DNA, 19 bp, Homo sapiens
tcccacccccagcagctca

SEQ ID NO: 647615 - DNA, 12 bp, Homo sapiens
tcccacccctat

SEQ ID NO: 647616 - DNA, 22 bp, Homo sapiens
tcccacccctataccctaggtc

SEQ ID NO: 647617 - DNA, 18 bp, Homo sapiens
tcccactaagctttctcc

SEQ ID NO: 647618 - DNA, 21 bp, Homo sapiens
tcccactgatatcacgggccc

SEQ ID NO: 647619 - DNA, 16 bp, Homo sapiens
tcccagctggcagcgc

SEQ ID NO: 647620 - DNA, 20 bp, Homo sapiens
tcccagctggcagcgcctcc

SEQ ID NO: 647621 - DNA, 22 bp, Homo sapiens
tcccagctttgggcacatgtat

SEQ ID NO: 647622 - DNA, 13 bp, Homo sapiens
tcccatggccttc

SEQ ID NO: 647623 - DNA, 14 bp, Homo sapiens
tcccatggccttcc

SEQ ID NO: 647624 - DNA, 17 bp, Homo sapiens
tcccatggtagactgtg

SEQ ID NO: 647625 - DNA, 23 bp, Homo sapiens
tcccatggtagactgtgacacag

SEQ ID NO: 647626 - DNA, 18 bp, Homo sapiens
tccccacagtcctcacag

SEQ ID NO: 647627 - DNA, 21 bp, Homo sapiens
tccccacagtcctcacagcct

SEQ ID NO: 647628 - DNA, 13 bp, Homo sapiens
tccccactcccgt

SEQ ID NO: 647629 - DNA, 17 bp, Homo sapiens
tccccagagccctgcag

SEQ ID NO: 647630 - DNA, 18 bp, Homo sapiens
tccccagagccctgcagt

SEQ ID NO: 647631 - DNA, 20 bp, Homo sapiens
tccccagcccccacccatgc

SEQ ID NO: 647632 - DNA, 12 bp, Homo sapiens
tccccagctgat

SEQ ID NO: 647633 - DNA, 18 bp, Homo sapiens
tccccagttaatgtgcca

SEQ ID NO: 647634 - DNA, 17 bp, Homo sapiens
tccccataatgcttctt

SEQ ID NO: 647635 - DNA, 15 bp, Homo sapiens
tccccatgctgggct

SEQ ID NO: 647636 - DNA, 21 bp, Homo sapiens
tccccatggaacagccctgca

SEQ ID NO: 647637 - DNA, 13 bp, Homo sapiens
tccccattcagtg

SEQ ID NO: 647638 - DNA, 16 bp, Homo sapiens
tccccattgccttctg

SEQ ID NO: 647639 - DNA, 19 bp, Homo sapiens
tccccattgccttctgggg

SEQ ID NO: 647640 - DNA, 20 bp, Homo sapiens
tcccccacggccgtccctga

SEQ ID NO: 647641 - DNA, 16 bp, Homo sapiens
tcccccaggctgcgcc

SEQ ID NO: 647642 - DNA, 20 bp, Homo sapiens
tcccccaggctgcgcctgcc

SEQ ID NO: 647643 - DNA, 13 bp, Homo sapiens
tcccccctgagtg

SEQ ID NO: 647644 - DNA, 20 bp, Homo sapiens
tccccctacagatcctccgc

SEQ ID NO: 647645 - DNA, 17 bp, Homo sapiens
tccccctcagctctccc

SEQ ID NO: 647646 - DNA, 22 bp, Homo sapiens
tccccctcagctctccctcaca

SEQ ID NO: 647647 - DNA, 14 bp, Homo sapiens
tccccctcctccat

SEQ ID NO: 647648 - DNA, 16 bp, Homo sapiens
tccccctcctgcacgc

SEQ ID NO: 647649 - DNA, 15 bp, Homo sapiens
tcccccttcccctgc

SEQ ID NO: 647650 - DNA, 21 bp, Homo sapiens
tccccgcccgccctcctctgc

SEQ ID NO: 647651 - DNA, 17 bp, Homo sapiens
tccccggacgcatgcag

SEQ ID NO: 647652 - DNA, 16 bp, Homo sapiens
tccccggacgctggct

SEQ ID NO: 647653 - DNA, 17 bp, Homo sapiens
tcccctaacctgggttg

SEQ ID NO: 647654 - DNA, 21 bp, Homo sapiens
tcccctccagacccctaccct

SEQ ID NO: 647655 - DNA, 14 bp, Homo sapiens
tcccctctcctgag

SEQ ID NO: 647656 - DNA, 17 bp, Homo sapiens
tcccctgcatggctgag

SEQ ID NO: 647657 - DNA, 12 bp, Homo sapiens
tcccctgcctct

SEQ ID NO: 647658 - DNA, 22 bp, Homo sapiens
tcccgatgcgtggctcccagca

SEQ ID NO: 647659 - DNA, 15 bp, Homo sapiens
tcccgcagcaccagc

SEQ ID NO: 647660 - DNA, 21 bp, Homo sapiens
tcccgcagcaccagcctgagc

SEQ ID NO: 647661 - DNA, 22 bp, Homo sapiens
tcccgcagcaccagcctgagcc

SEQ ID NO: 647662 - DNA, 23 bp, Homo sapiens
tcccgcagcaccagcctgagcca

SEQ ID NO: 647663 - DNA, 23 bp, Homo sapiens
tcccggccccgcgcgtgccccca

SEQ ID NO: 647664 - DNA, 15 bp, Homo sapiens
tcccgtccgtccgcc

SEQ ID NO: 647665 - DNA, 17 bp, Homo sapiens
tcccgtgccctgtttcc

SEQ ID NO: 647666 - DNA, 13 bp, Homo sapiens
tccctaaacatag

SEQ ID NO: 647667 - DNA, 16 bp, Homo sapiens
tccctaccctcttctc

SEQ ID NO: 647668 - DNA, 23 bp, Homo sapiens
tccctaggcctgagttagctgtt

SEQ ID NO: 647669 - DNA, 17 bp, Homo sapiens
tccctcatgtatacttc

SEQ ID NO: 647670 - DNA, 19 bp, Homo sapiens
tccctcatgtatacttcaa

SEQ ID NO: 647671 - DNA, 13 bp, Homo sapiens
tccctccactcct

SEQ ID NO: 647672 - DNA, 14 bp, Homo sapiens
tccctccactcctc

SEQ ID NO: 647673 - DNA, 22 bp, Homo sapiens
tccctccactcctcccaactct

SEQ ID NO: 647674 - DNA, 15 bp, Homo sapiens
tccctccctccacac

SEQ ID NO: 647675 - DNA, 22 bp, Homo sapiens
tccctcccttctttccttcctt

SEQ ID NO: 647676 - DNA, 17 bp, Homo sapiens
tccctcggtcagcaccg

SEQ ID NO: 647677 - DNA, 13 bp, Homo sapiens
tccctctcctccc

SEQ ID NO: 647678 - DNA, 15 bp, Homo sapiens
tccctgacttcccag

SEQ ID NO: 647679 - DNA, 18 bp, Homo sapiens
tccctgacttcccagctg

SEQ ID NO: 647680 - DNA, 19 bp, Homo sapiens
tccctgacttcccagctgg

SEQ ID NO: 647681 - DNA, 16 bp, Homo sapiens
tccctgagggcccttc

SEQ ID NO: 647682 - DNA, 15 bp, Homo sapiens
tccctgctcagccca

SEQ ID NO: 647683 - DNA, 15 bp, Homo sapiens
tccctgctgccaggc

SEQ ID NO: 647684 - DNA, 17 bp, Homo sapiens
tccctgctgccaggctc

SEQ ID NO: 647685 - DNA, 20 bp, Homo sapiens
tccctggacgcatgcagggc

SEQ ID NO: 647686 - DNA, 14 bp, Homo sapiens
tccctggccacctg

SEQ ID NO: 647687 - DNA, 18 bp, Homo sapiens
tccctggccacctgccag

SEQ ID NO: 647688 - DNA, 22 bp, Homo sapiens
tccctggccacctgccaggcct

SEQ ID NO: 647689 - DNA, 20 bp, Homo sapiens
tccctgggcaccctgcaggc

SEQ ID NO: 647690 - DNA, 22 bp, Homo sapiens
tccctgggcaccctgcaggcag

SEQ ID NO: 647691 - DNA, 20 bp, Homo sapiens
tccctggggaccaggagcta

SEQ ID NO: 647692 - DNA, 16 bp, Homo sapiens
tccctggggaggaccc

SEQ ID NO: 647693 - DNA, 16 bp, Homo sapiens
tccctgtccagcacta

SEQ ID NO: 647694 - DNA, 14 bp, Homo sapiens
tccctgtcccctga

SEQ ID NO: 647695 - DNA, 14 bp, Homo sapiens
tccctgtgggctca

SEQ ID NO: 647696 - DNA, 18 bp, Homo sapiens
tccctgtgggctcacacc

SEQ ID NO: 647697 - DNA, 21 bp, Homo sapiens
tccctgtgggctcacaccggc

SEQ ID NO: 647698 - DNA, 12 bp, Homo sapiens
tctgttccaagt

SEQ ID NO: 647699 - DNA, 11 bp, Homo sapiens
tctgttgtaat

SEQ ID NO: 647700 - DNA, 20 bp, Homo sapiens
tctgtttaccctccctgtcc

SEQ ID NO: 647701 - DNA, 23 bp, Homo sapiens
tctgtttaccctccctgtcccct

SEQ ID NO: 647702 - DNA, 21 bp, Homo sapiens
tctgtttatgttcttgcagca

SEQ ID NO: 647703 - DNA, 18 bp, Homo sapiens
tcttaaaaattatcttta

SEQ ID NO: 647704 - DNA, 18 bp, Homo sapiens
tcttaactaatgtaaata

SEQ ID NO: 647705 - DNA, 20 bp, Homo sapiens
tcttaactaatgtaaatatt

SEQ ID NO: 647706 - DNA, 16 bp, Homo sapiens
tcttaaggacagtgtt

SEQ ID NO: 647707 - DNA, 18 bp, Homo sapiens
tcttaatgtctcaaaata

SEQ ID NO: 647708 - DNA, 16 bp, Homo sapiens
tcttacccttcaatgt

SEQ ID NO: 647709 - DNA, 20 bp, Homo sapiens
tcttacccttcaatgttaaa

SEQ ID NO: 647710 - DNA, 14 bp, Homo sapiens
tcttaccgaaatga

SEQ ID NO: 647711 - DNA, 15 bp, Homo sapiens
tcttaccgaaatgaa

SEQ ID NO: 647712 - DNA, 18 bp, Homo sapiens
tcttataacattgtatgt

SEQ ID NO: 647713 - DNA, 21 bp, Homo sapiens
tcttataacattgtatgttaa

SEQ ID NO: 647714 - DNA, 21 bp, Homo sapiens
tcttattcatgctttctcctt

SEQ ID NO: 647715 - DNA, 23 bp, Homo sapiens
tcttatttgtttggtcactgcta

SEQ ID NO: 647716 - DNA, 14 bp, Homo sapiens
tcttcaaccctgcc

SEQ ID NO: 647717 - DNA, 16 bp, Homo sapiens
tcttcaaccctgccct

SEQ ID NO: 647718 - DNA, 17 bp, Homo sapiens
tcttcaaccctgccctg

SEQ ID NO: 647719 - DNA, 19 bp, Homo sapiens
tcttcaaccctgccctgca

SEQ ID NO: 647720 - DNA, 24 bp, Homo sapiens
tcttccaacatgtgatgtgttgct

SEQ ID NO: 647721 - DNA, 17 bp, Homo sapiens
tcttccaagttcattca

SEQ ID NO: 647722 - DNA, 20 bp, Homo sapiens
tcttcccaagtcctcgcccc

SEQ ID NO: 647723 - DNA, 14 bp, Homo sapiens
tcttcccccttccc

SEQ ID NO: 647724 - DNA, 24 bp, Homo sapiens
tcttcccccttcccctgcgccctc

SEQ ID NO: 647725 - DNA, 13 bp, Homo sapiens
tcttcccctttcc

SEQ ID NO: 647726 - DNA, 15 bp, Homo sapiens
tcttcccctttcctg

SEQ ID NO: 647727 - DNA, 13 bp, Homo sapiens
tcttccttccttt

SEQ ID NO: 647728 - DNA, 22 bp, Homo sapiens
tcttccttcctttctctctttc

SEQ ID NO: 647729 - DNA, 15 bp, Homo sapiens
tcttctacttcttgt

SEQ ID NO: 647730 - DNA, 15 bp, Homo sapiens
tcttctctctgtgct

SEQ ID NO: 647731 - DNA, 20 bp, Homo sapiens
tcttcttgcggcaccgccca

SEQ ID NO: 647732 - DNA, 23 bp, Homo sapiens
tcttcttgcggcaccgcccaccc

SEQ ID NO: 647733 - DNA, 17 bp, Homo sapiens
tcttctttaatttttct

SEQ ID NO: 647734 - DNA, 21 bp, Homo sapiens
tcttctttaatttttctgttg

SEQ ID NO: 647735 - DNA, 15 bp, Homo sapiens
tcttcttttcccatt

SEQ ID NO: 647736 - DNA, 19 bp, Homo sapiens
tcttgacaggcgccgcctc

SEQ ID NO: 647737 - DNA, 21 bp, Homo sapiens
tcttgagaccagcctgccagg

SEQ ID NO: 647738 - DNA, 17 bp, Homo sapiens
tcttgagtgggccccct

SEQ ID NO: 647739 - DNA, 12 bp, Homo sapiens
tcttgcactgta

SEQ ID NO: 647740 - DNA, 14 bp, Homo sapiens
tcttgctcagagct

SEQ ID NO: 647741 - DNA, 20 bp, Homo sapiens
tcttgctgtttaccgcccac

SEQ ID NO: 647742 - DNA, 14 bp, Homo sapiens
tcttggagaggagg

SEQ ID NO: 647743 - DNA, 23 bp, Homo sapiens
tcttgggattcctcccctggaag

SEQ ID NO: 647744 - DNA, 16 bp, Homo sapiens
tcttggtgctttgtct

SEQ ID NO: 647745 - DNA, 20 bp, Homo sapiens
tcttggtgtcaaatttttaa

SEQ ID NO: 647746 - DNA, 15 bp, Homo sapiens
tcttgtaaaactgtg

SEQ ID NO: 647747 - DNA, 19 bp, Homo sapiens
tcttgtaaaactgtgacat

SEQ ID NO: 647748 - DNA, 21 bp, Homo sapiens
tcttgtgtcatcaagtagtag

SEQ ID NO: 647749 - DNA, 19 bp, Homo sapiens
tctttcaggaaatttttgc

SEQ ID NO: 647750 - DNA, 11 bp, Homo sapiens
tctttccttcc

SEQ ID NO: 647751 - DNA, 12 bp, Homo sapiens
tctttccttcct

SEQ ID NO: 647752 - DNA, 17 bp, Homo sapiens
tctttctccaaagttat

SEQ ID NO: 647753 - DNA, 21 bp, Homo sapiens
tctttctccaaagttatccag

SEQ ID NO: 647754 - DNA, 13 bp, Homo sapiens
tctttctctctgt

SEQ ID NO: 647755 - DNA, 19 bp, Homo sapiens
tctttctctctgtgtggca

SEQ ID NO: 647756 - DNA, 17 bp, Homo sapiens
tctttcttttcttttta

SEQ ID NO: 647757 - DNA, 15 bp, Homo sapiens
tctttcttttgtgca

SEQ ID NO: 647758 - DNA, 22 bp, Homo sapiens
tctttgatatgttgatgaaatt

SEQ ID NO: 647759 - DNA, 13 bp, Homo sapiens
tctttggcttcag

SEQ ID NO: 647760 - DNA, 14 bp, Homo sapiens
tctttgttgcttaa

SEQ ID NO: 647761 - DNA, 15 bp, Homo sapiens
tctttgttgcttaat

SEQ ID NO: 647762 - DNA, 15 bp, Homo sapiens
tcttttgtgcatatg

SEQ ID NO: 647763 - DNA, 16 bp, Homo sapiens
tcttttgttctctctt

SEQ ID NO: 647764 - DNA, 22 bp, Homo sapiens
tctttttttaagtgttctgtgg

SEQ ID NO: 647765 - DNA, 16 bp, Homo sapiens
tgaaaaagcatgtaca

SEQ ID NO: 647766 - DNA, 15 bp, Homo sapiens
tgaaaaagtgttttt

SEQ ID NO: 647767 - DNA, 19 bp, Homo sapiens
tgaaaaagtgtttttacat

SEQ ID NO: 647768 - DNA, 20 bp, Homo sapiens
tgaaaaagtgtttttacata

SEQ ID NO: 647769 - DNA, 14 bp, Homo sapiens
tgaaaaatctgaat

SEQ ID NO: 647770 - DNA, 16 bp, Homo sapiens
tgaaaaatctgaattt

SEQ ID NO: 647771 - DNA, 19 bp, Homo sapiens
tgaaaaatctgaatttcta

SEQ ID NO: 647772 - DNA, 16 bp, Homo sapiens
tgaaaactaagttctc

SEQ ID NO: 647773 - DNA, 15 bp, Homo sapiens
tgaaaactcatacag

SEQ ID NO: 647774 - DNA, 23 bp, Homo sapiens
tgaaaactggaataagaagcaaa

SEQ ID NO: 647775 - DNA, 17 bp, Homo sapiens
tgaaaatcgaggaagca

SEQ ID NO: 647776 - DNA, 20 bp, Homo sapiens
tgaaaatgctttgaaaatgt

SEQ ID NO: 647777 - DNA, 17 bp, Homo sapiens
tgaaaatggctgaagaa

SEQ ID NO: 647778 - DNA, 18 bp, Homo sapiens
tgaaaatggctgaagaaa

SEQ ID NO: 647779 - DNA, 18 bp, Homo sapiens
tgaaaattttattgaata

SEQ ID NO: 647780 - DNA, 12 bp, Homo sapiens
tgaaacacaata

SEQ ID NO: 647781 - DNA, 17 bp, Homo sapiens
tgaaactgacttgctgt

SEQ ID NO: 647782 - DNA, 11 bp, Homo sapiens
tgaaagagaaa

SEQ ID NO: 647783 - DNA, 14 bp, Homo sapiens
tgaaagagaaaatg

SEQ ID NO: 647784 - DNA, 16 bp, Homo sapiens
tgaaagtggcaagctc

SEQ ID NO: 647785 - DNA, 17 bp, Homo sapiens
tgaaagtggcaagctct

SEQ ID NO: 647786 - DNA, 22 bp, Homo sapiens
tgaaagttgtgatctgttgtaa

SEQ ID NO: 647787 - DNA, 22 bp, Homo sapiens
tgaaatacatatgataaatttg

SEQ ID NO: 647788 - DNA, 18 bp, Homo sapiens
tgaaatataaactgtgag

SEQ ID NO: 647789 - DNA, 17 bp, Homo sapiens
tgaaatattttctactt

SEQ ID NO: 647790 - DNA, 21 bp, Homo sapiens
tgaaatattttctactttaaa

SEQ ID NO: 647791 - DNA, 12 bp, Homo sapiens
tgaaatctacaa

SEQ ID NO: 647792 - DNA, 13 bp, Homo sapiens
tgaaatctacaac

SEQ ID NO: 647793 - DNA, 21 bp, Homo sapiens
tgaaatggatagattgtttta

SEQ ID NO: 647794 - DNA, 15 bp, Homo sapiens
tgaaattaggaaagt

SEQ ID NO: 647795 - DNA, 23 bp, Homo sapiens
tgaaattagtgttttcattctgg

SEQ ID NO: 647796 - DNA, 19 bp, Homo sapiens
tgaaattatgtcaaatgga

SEQ ID NO: 647797 - DNA, 14 bp, Homo sapiens
tgaaattcacaaag

SEQ ID NO: 647798 - DNA, 14 bp, Homo sapiens
tgaaatttaagcac

SEQ ID NO: 647799 - DNA, 17 bp, Homo sapiens
tgaaatttaagcacaaa

SEQ ID NO: 647800 - DNA, 15 bp, Homo sapiens
tgaacactgcaccct

SEQ ID NO: 647801 - DNA, 16 bp, Homo sapiens
tgaacactgcaccctc

SEQ ID NO: 647802 - DNA, 23 bp, Homo sapiens
tgaacactgcaccctccacagga

SEQ ID NO: 647803 - DNA, 19 bp, Homo sapiens
tgaacatactggctggtga

SEQ ID NO: 647804 - DNA, 18 bp, Homo sapiens
tgaaccgtcaatgtgaaa

SEQ ID NO: 647805 - DNA, 19 bp, Homo sapiens
tgaaccgtcaatgtgaaat

SEQ ID NO: 647806 - DNA, 15 bp, Homo sapiens
tgaactgaagcagag

SEQ ID NO: 647807 - DNA, 14 bp, Homo sapiens
tgaactgcaacact

SEQ ID NO: 647808 - DNA, 15 bp, Homo sapiens
tgaactgcaacactg

SEQ ID NO: 647809 - DNA, 17 bp, Homo sapiens
tgaactgcaacactgga

SEQ ID NO: 647810 - DNA, 13 bp, Homo sapiens
tgaactttctcag

SEQ ID NO: 647811 - DNA, 15 bp, Homo sapiens
tgaagaaacacagca

SEQ ID NO: 647812 - DNA, 17 bp, Homo sapiens
tgaagaaacacagcatg

SEQ ID NO: 647813 - DNA, 21 bp, Homo sapiens
tgaagaaacacagcatgcatt

SEQ ID NO: 647814 - DNA, 22 bp, Homo sapiens
tgaagagagatatatctgaaaa

SEQ ID NO: 647815 - DNA, 16 bp, Homo sapiens
ttcatgcttttctcat

SEQ ID NO: 647816 - DNA, 18 bp, Homo sapiens
ttcatgtttaagaaatga

SEQ ID NO: 647817 - DNA, 13 bp, Homo sapiens
ttcattaaaacaa

SEQ ID NO: 647818 - DNA, 22 bp, Homo sapiens
ttcattccgttaggaataacac

SEQ ID NO: 647819 - DNA, 22 bp, Homo sapiens
ttcattctggtccttagtaaat

SEQ ID NO: 647820 - DNA, 12 bp, Homo sapiens
ttcatttaacac

SEQ ID NO: 647821 - DNA, 19 bp, Homo sapiens
ttcatttaacactgagtga

SEQ ID NO: 647822 - DNA, 21 bp, Homo sapiens
ttcatttaacactgagtgaaa

SEQ ID NO: 647823 - DNA, 23 bp, Homo sapiens
ttcatttaacactgagtgaaata

SEQ ID NO: 647824 - DNA, 21 bp, Homo sapiens
ttccaaaagtactagcaataa

SEQ ID NO: 647825 - DNA, 17 bp, Homo sapiens
ttccaacctgttcacgt

SEQ ID NO: 647826 - DNA, 19 bp, Homo sapiens
ttccaacctgttcacgtga

SEQ ID NO: 647827 - DNA, 22 bp, Homo sapiens
ttccaagtgtatatttgtatca

SEQ ID NO: 647828 - DNA, 12 bp, Homo sapiens
ttccaagtgtgt

SEQ ID NO: 647829 - DNA, 18 bp, Homo sapiens
ttccaatgccaattcatc

SEQ ID NO: 647830 - DNA, 10 bp, Homo sapiens
ttccagacag

SEQ ID NO: 647831 - DNA, 17 bp, Homo sapiens
ttccagacagagtggat

SEQ ID NO: 647832 - DNA, 14 bp, Homo sapiens
ttccagggcaatca

SEQ ID NO: 647833 - DNA, 13 bp, Homo sapiens
ttccagtgctgct

SEQ ID NO: 647834 - DNA, 14 bp, Homo sapiens
ttccagtgctgctc

SEQ ID NO: 647835 - DNA, 19 bp, Homo sapiens
ttccagtgtattttctgtg

SEQ ID NO: 647836 - DNA, 13 bp, Homo sapiens
ttccatgacagta

SEQ ID NO: 647837 - DNA, 18 bp, Homo sapiens
ttccattatgaggaaact

SEQ ID NO: 647838 - DNA, 15 bp, Homo sapiens
ttccattctatgact

SEQ ID NO: 647839 - DNA, 21 bp, Homo sapiens
ttccatttggattttaaacaa

SEQ ID NO: 647840 - DNA, 23 bp, Homo sapiens
ttcccaagtcctcgccccccgcc

SEQ ID NO: 647841 - DNA, 21 bp, Homo sapiens
ttccccagctgattagtgtct

SEQ ID NO: 647842 - DNA, 18 bp, Homo sapiens
ttccccatcgccttctgg

SEQ ID NO: 647843 - DNA, 13 bp, Homo sapiens
ttcccgcagcacc

SEQ ID NO: 647844 - DNA, 19 bp, Homo sapiens
ttcccgcagcaccagcctg

SEQ ID NO: 647845 - DNA, 19 bp, Homo sapiens
ttcccgtggctttgtgctt

SEQ ID NO: 647846 - DNA, 14 bp, Homo sapiens
ttccctagttcttt

SEQ ID NO: 647847 - DNA, 20 bp, Homo sapiens
ttccctccccacagtcctca

SEQ ID NO: 647848 - DNA, 15 bp, Homo sapiens
ttccctgacactgtc

SEQ ID NO: 647849 - DNA, 15 bp, Homo sapiens
ttccctgaggaatga

SEQ ID NO: 647850 - DNA, 23 bp, Homo sapiens
ttccctgcatcccttggcccctc

SEQ ID NO: 647851 - DNA, 15 bp, Homo sapiens
ttccctgctgagtgg

SEQ ID NO: 647852 - DNA, 18 bp, Homo sapiens
ttcccttgattcaaataa

SEQ ID NO: 647853 - DNA, 12 bp, Homo sapiens
ttccgcctcact

SEQ ID NO: 647854 - DNA, 18 bp, Homo sapiens
ttccgcgtggttctgcca

SEQ ID NO: 647855 - DNA, 22 bp, Homo sapiens
ttccggagctgggtatctcaaa

SEQ ID NO: 647856 - DNA, 23 bp, Homo sapiens
ttccgggtctcgcagcctgaagc

SEQ ID NO: 647857 - DNA, 21 bp, Homo sapiens
ttccgtgagagtcatctcaaa

SEQ ID NO: 647858 - DNA, 13 bp, Homo sapiens
ttccgttcatctg

SEQ ID NO: 647859 - DNA, 19 bp, Homo sapiens
ttccgttcatctgaggagt

SEQ ID NO: 647860 - DNA, 19 bp, Homo sapiens
ttcctaagagtggaggagg

SEQ ID NO: 647861 - DNA, 21 bp, Homo sapiens
ttcctaagagtggaggaggag

SEQ ID NO: 647862 - DNA, 15 bp, Homo sapiens
ttcctaattcctgta

SEQ ID NO: 647863 - DNA, 14 bp, Homo sapiens
ttcctaattctatg

SEQ ID NO: 647864 - DNA, 23 bp, Homo sapiens
ttcctaccattatggctttgtgc

SEQ ID NO: 647865 - DNA, 12 bp, Homo sapiens
ttcctcccctgg

SEQ ID NO: 647866 - DNA, 14 bp, Homo sapiens
ttcctcctgtctcc

SEQ ID NO: 647867 - DNA, 14 bp, Homo sapiens
ttcctctcctctct

SEQ ID NO: 647868 - DNA, 12 bp, Homo sapiens
ttcctctctctc

SEQ ID NO: 647869 - DNA, 14 bp, Homo sapiens
ttcctctctctctc

SEQ ID NO: 647870 - DNA, 22 bp, Homo sapiens
ttcctctctctctctctctctg

SEQ ID NO: 647871 - DNA, 20 bp, Homo sapiens
ttcctcttggtgtcaaattt

SEQ ID NO: 647872 - DNA, 16 bp, Homo sapiens
ttcctgtcctgctcac

SEQ ID NO: 647873 - DNA, 18 bp, Homo sapiens
ttccttaacagctgtatt

SEQ ID NO: 647874 - DNA, 19 bp, Homo sapiens
ttccttcagtgccttatgg

SEQ ID NO: 647875 - DNA, 17 bp, Homo sapiens
ttccttcctttctctct

SEQ ID NO: 647876 - DNA, 13 bp, Homo sapiens
ttcctttcttcct

SEQ ID NO: 647877 - DNA, 22 bp, Homo sapiens
ttcctttgacctctcacttttt

SEQ ID NO: 647878 - DNA, 14 bp, Homo sapiens
ttcgagcaaacaac

SEQ ID NO: 647879 - DNA, 19 bp, Homo sapiens
ttcggaggtcaagaaagca

SEQ ID NO: 647880 - DNA, 16 bp, Homo sapiens
ttcggataattttcat

SEQ ID NO: 647881 - DNA, 14 bp, Homo sapiens
ttctaaaccatgaa

SEQ ID NO: 647882 - DNA, 22 bp, Homo sapiens
ttctaaaccatgaaaagttttc

SEQ ID NO: 647883 - DNA, 16 bp, Homo sapiens
ttctaattagattaac

SEQ ID NO: 647884 - DNA, 21 bp, Homo sapiens
ttctacctttttttctctcct

SEQ ID NO: 647885 - DNA, 16 bp, Homo sapiens
ttctactgttcaattt

SEQ ID NO: 647886 - DNA, 17 bp, Homo sapiens
ttctactttaaattgtg

SEQ ID NO: 647887 - DNA, 21 bp, Homo sapiens
ttctagaaggggcgaggcttt

SEQ ID NO: 647888 - DNA, 20 bp, Homo sapiens
ttctagtaacagtatttcca

SEQ ID NO: 647889 - DNA, 15 bp, Homo sapiens
ttctatataattttt

SEQ ID NO: 647890 - DNA, 22 bp, Homo sapiens
ttctatatgtaacttcagatgt

SEQ ID NO: 647891 - DNA, 13 bp, Homo sapiens
ttctatatttact

SEQ ID NO: 647892 - DNA, 17 bp, Homo sapiens
ttctatatttactgttt

SEQ ID NO: 647893 - DNA, 17 bp, Homo sapiens
ttctattatctgggttt

SEQ ID NO: 647894 - DNA, 16 bp, Homo sapiens
ttctcaaatgctactc

SEQ ID NO: 647895 - DNA, 16 bp, Homo sapiens
ttctcagctccactct

SEQ ID NO: 647896 - DNA, 21 bp, Homo sapiens
ttctcagctccactctgaagt

SEQ ID NO: 647897 - DNA, 16 bp, Homo sapiens
ttctcatcttgtaaat

SEQ ID NO: 647898 - DNA, 15 bp, Homo sapiens
ttctcatttgaaatg

SEQ ID NO: 647899 - DNA, 18 bp, Homo sapiens
ttctcatttgaaatgttt

SEQ ID NO: 647900 - DNA, 22 bp, Homo sapiens
ttctccagcccatgctggctgg

SEQ ID NO: 647901 - DNA, 19 bp, Homo sapiens
ttctcccctccagacccct

SEQ ID NO: 647902 - DNA, 17 bp, Homo sapiens
ttctcctccaaatgctg

SEQ ID NO: 647903 - DNA, 13 bp, Homo sapiens
ttctcctctccca

SEQ ID NO: 647904 - DNA, 14 bp, Homo sapiens
ttctccttaacccc

SEQ ID NO: 647905 - DNA, 18 bp, Homo sapiens
ttctccttgtacttgaat

SEQ ID NO: 647906 - DNA, 15 bp, Homo sapiens
ttctcctttgtcaaa

SEQ ID NO: 647907 - DNA, 16 bp, Homo sapiens
ttctcctttttacccc

SEQ ID NO: 647908 - DNA, 12 bp, Homo sapiens
ttctctaaaaca

SEQ ID NO: 647909 - DNA, 17 bp, Homo sapiens
ttctctaacccctagtg

SEQ ID NO: 647910 - DNA, 22 bp, Homo sapiens
ttctctcaggtgcgtgccacat

SEQ ID NO: 647911 - DNA, 23 bp, Homo sapiens
ttctctccggatggaatcacagc

SEQ ID NO: 647912 - DNA, 14 bp, Homo sapiens
ttctctctgtgctg

SEQ ID NO: 647913 - DNA, 14 bp, Homo sapiens
ttctctctgtgtgg

SEQ ID NO: 647914 - DNA, 21 bp, Homo sapiens
ttctcttaccactagttgctt

SEQ ID NO: 647915 - DNA, 18 bp, Homo sapiens
ttctgaaaggtgctttct

SEQ ID NO: 647916 - DNA, 16 bp, Homo sapiens
ttctgaaattaggaaa

SEQ ID NO: 647917 - DNA, 17 bp, Homo sapiens
ttctgaaattaggaaag

SEQ ID NO: 647918 - DNA, 17 bp, Homo sapiens
ttctgatacatctgtca

SEQ ID NO: 647919 - DNA, 16 bp, Homo sapiens
ttctgcaataacagtt

SEQ ID NO: 647920 - DNA, 18 bp, Homo sapiens
ttctgcaataacagtttt

SEQ ID NO: 647921 - DNA, 19 bp, Homo sapiens
ttctgcaataacagtttta

SEQ ID NO: 647922 - DNA, 15 bp, Homo sapiens
ttctgcactgagcag

SEQ ID NO: 647923 - DNA, 11 bp, Homo sapiens
ttctgccctgc

SEQ ID NO: 647924 - DNA, 16 bp, Homo sapiens
ttctgccctgcctgag

SEQ ID NO: 647925 - DNA, 18 bp, Homo sapiens
ttctgccctgcctgagga

SEQ ID NO: 647926 - DNA, 19 bp, Homo sapiens
ttctgccctgcctgaggag

SEQ ID NO: 647927 - DNA, 22 bp, Homo sapiens
ttctgccctgcctgaggaggag

SEQ ID NO: 647928 - DNA, 14 bp, Homo sapiens
ttctgctaatttat

SEQ ID NO: 647929 - DNA, 20 bp, Homo sapiens
ttctgctgaattttcacatg

SEQ ID NO: 647930 - DNA, 14 bp, Homo sapiens
ttctgctgccctct

SEQ ID NO: 647931 - DNA, 17 bp, Homo sapiens
ttctggaaaaacaggat

SEQ ID NO: 647932 - DNA, 20 bp, Homo sapiens
tttcaataggaaaaactgat

SEQ ID NO: 647933 - DNA, 17 bp, Homo sapiens
tttcaatcactgaaaat

SEQ ID NO: 647934 - DNA, 14 bp, Homo sapiens
tttcacacaactgt

SEQ ID NO: 647935 - DNA, 16 bp, Homo sapiens
tttcacctatctggaa

SEQ ID NO: 647936 - DNA, 15 bp, Homo sapiens
tttcactctccttgg

SEQ ID NO: 647937 - DNA, 19 bp, Homo sapiens
tttcagaaagggcagcccc

SEQ ID NO: 647938 - DNA, 13 bp, Homo sapiens
tttcagtgcctgc

SEQ ID NO: 647939 - DNA, 18 bp, Homo sapiens
tttcagttataatttcaa

SEQ ID NO: 647940 - DNA, 13 bp, Homo sapiens
tttcatacaaatt

SEQ ID NO: 647941 - DNA, 18 bp, Homo sapiens
tttcatactctagatttt

SEQ ID NO: 647942 - DNA, 16 bp, Homo sapiens
tttcatgattagacaa

SEQ ID NO: 647943 - DNA, 18 bp, Homo sapiens
tttcatgattagacaatg

SEQ ID NO: 647944 - DNA, 19 bp, Homo sapiens
tttcatgattagacaatgt

SEQ ID NO: 647945 - DNA, 14 bp, Homo sapiens
tttcattatttcaa

SEQ ID NO: 647946 - DNA, 11 bp, Homo sapiens
tttcattgtgt

SEQ ID NO: 647947 - DNA, 11 bp, Homo sapiens
tttcattttca

SEQ ID NO: 647948 - DNA, 18 bp, Homo sapiens
tttcattttcatctcatt

SEQ ID NO: 647949 - DNA, 13 bp, Homo sapiens
tttcattttctct

SEQ ID NO: 647950 - DNA, 15 bp, Homo sapiens
tttcattttctctcc

SEQ ID NO: 647951 - DNA, 16 bp, Homo sapiens
tttcatttttcatttt

SEQ ID NO: 647952 - DNA, 22 bp, Homo sapiens
tttccaagatgtcccattgata

SEQ ID NO: 647953 - DNA, 12 bp, Homo sapiens
tttccagaattg

SEQ ID NO: 647954 - DNA, 21 bp, Homo sapiens
tttccagaattgagagatgtt

SEQ ID NO: 647955 - DNA, 17 bp, Homo sapiens
tttccagcaaaatatat

SEQ ID NO: 647956 - DNA, 14 bp, Homo sapiens
tttccagtgctgct

SEQ ID NO: 647957 - DNA, 23 bp, Homo sapiens
tttccatgacagtagcatactga

SEQ ID NO: 647958 - DNA, 16 bp, Homo sapiens
tttcccacactgtgaa

SEQ ID NO: 647959 - DNA, 22 bp, Homo sapiens
tttcccacccactagccctctt

SEQ ID NO: 647960 - DNA, 18 bp, Homo sapiens
tttccccaattatcctcc

SEQ ID NO: 647961 - DNA, 19 bp, Homo sapiens
tttccccagtgtggcccca

SEQ ID NO: 647962 - DNA, 17 bp, Homo sapiens
tttccccattcagtgac

SEQ ID NO: 647963 - DNA, 18 bp, Homo sapiens
tttcccctgtggtttgtt

SEQ ID NO: 647964 - DNA, 21 bp, Homo sapiens
tttcctgctagtgtagcttct

SEQ ID NO: 647965 - DNA, 12 bp, Homo sapiens
tttcctgtcaat

SEQ ID NO: 647966 - DNA, 15 bp, Homo sapiens
tttcctgtcaatata

SEQ ID NO: 647967 - DNA, 16 bp, Homo sapiens
tttcctgtcaatatat

SEQ ID NO: 647968 - DNA, 12 bp, Homo sapiens
tttccttcagtg

SEQ ID NO: 647969 - DNA, 19 bp, Homo sapiens
tttctaaaactaaatagca

SEQ ID NO: 647970 - DNA, 21 bp, Homo sapiens
tttctactttaaattgtggat

SEQ ID NO: 647971 - DNA, 15 bp, Homo sapiens
tttctagtaacagta

SEQ ID NO: 647972 - DNA, 21 bp, Homo sapiens
tttctagtaacagtatttcca

SEQ ID NO: 647973 - DNA, 14 bp, Homo sapiens
tttctatatttgga

SEQ ID NO: 647974 - DNA, 13 bp, Homo sapiens
tttctcatttgaa

SEQ ID NO: 647975 - DNA, 16 bp, Homo sapiens
tttctcatttgaaatg

SEQ ID NO: 647976 - DNA, 23 bp, Homo sapiens
tttctccagcccatgctggctgg

SEQ ID NO: 647977 - DNA, 14 bp, Homo sapiens
tttctccatttatt

SEQ ID NO: 647978 - DNA, 21 bp, Homo sapiens
tttctgagtagcatatataat

SEQ ID NO: 647979 - DNA, 13 bp, Homo sapiens
tttctgcactgag

SEQ ID NO: 647980 - DNA, 21 bp, Homo sapiens
tttctggtggcaaatgaattt

SEQ ID NO: 647981 - DNA, 14 bp, Homo sapiens
tttctgttggtctt

SEQ ID NO: 647982 - DNA, 23 bp, Homo sapiens
tttctgttggtcttaactaatgt

SEQ ID NO: 647983 - DNA, 15 bp, Homo sapiens
tttcttttgtgcata

SEQ ID NO: 647984 - DNA, 17 bp, Homo sapiens
tttcttttttaattgaa

SEQ ID NO: 647985 - DNA, 18 bp, Homo sapiens
tttcttttttaattgaaa

SEQ ID NO: 647986 - DNA, 15 bp, Homo sapiens
tttgaaaatgttttt

SEQ ID NO: 647987 - DNA, 12 bp, Homo sapiens
tttgacattgtc

SEQ ID NO: 647988 - DNA, 13 bp, Homo sapiens
tttgacattgtca

SEQ ID NO: 647989 - DNA, 21 bp, Homo sapiens
tttgacctctcacttttttat

SEQ ID NO: 647990 - DNA, 14 bp, Homo sapiens
tttgaggaaactca

SEQ ID NO: 647991 - DNA, 15 bp, Homo sapiens
tttgagtgtcaggct

SEQ ID NO: 647992 - DNA, 20 bp, Homo sapiens
tttgatatcacagtctaatt

SEQ ID NO: 647993 - DNA, 17 bp, Homo sapiens
tttgatgaataaaatgt

SEQ ID NO: 647994 - DNA, 22 bp, Homo sapiens
tttgatgtattattatatatgt

SEQ ID NO: 647995 - DNA, 21 bp, Homo sapiens
tttgcaacactgccaaacatc

SEQ ID NO: 647996 - DNA, 20 bp, Homo sapiens
tttgcagctatggacaattt

SEQ ID NO: 647997 - DNA, 13 bp, Homo sapiens
tttgcatgtttaa

SEQ ID NO: 647998 - DNA, 23 bp, Homo sapiens
tttgcatgtttaataatatgtac

SEQ ID NO: 647999 - DNA, 14 bp, Homo sapiens
tttgctaattaaaa

SEQ ID NO: 648000 - DNA, 19 bp, Homo sapiens
tttgctcataagtaaatgt

SEQ ID NO: 648001 - DNA, 21 bp, Homo sapiens
tttgctcataagtaaatgtct

SEQ ID NO: 648002 - DNA, 22 bp, Homo sapiens
tttgctcataagtaaatgtctt

SEQ ID NO: 648003 - DNA, 20 bp, Homo sapiens
tttgctctccctcccttctt

SEQ ID NO: 648004 - DNA, 22 bp, Homo sapiens
tttgctctccctcccttctttc

SEQ ID NO: 648005 - DNA, 20 bp, Homo sapiens
tttgctgaataacaacaatt

SEQ ID NO: 648006 - DNA, 23 bp, Homo sapiens
tttgctgtatacaaacaggtgct

SEQ ID NO: 648007 - DNA, 13 bp, Homo sapiens
tttggaagaattc

SEQ ID NO: 648008 - DNA, 17 bp, Homo sapiens
tttggaagaattcatga

SEQ ID NO: 648009 - DNA, 22 bp, Homo sapiens
tttggaagcagccccctgtggc

SEQ ID NO: 648010 - DNA, 15 bp, Homo sapiens
tttggagttaaaatg

SEQ ID NO: 648011 - DNA, 14 bp, Homo sapiens
tttggctgaaatta

SEQ ID NO: 648012 - DNA, 17 bp, Homo sapiens
tttggcttcagaattgt

SEQ ID NO: 648013 - DNA, 22 bp, Homo sapiens
tttgggcctccatgccccagct

SEQ ID NO: 648014 - DNA, 20 bp, Homo sapiens
tttggtatgaaacaaatata

SEQ ID NO: 648015 - DNA, 19 bp, Homo sapiens
tttggttcctcatggctgt

SEQ ID NO: 648016 - DNA, 17 bp, Homo sapiens
tttgtaatataagacaa

SEQ ID NO: 648017 - DNA, 18 bp, Homo sapiens
tttgtaatataagacaag

SEQ ID NO: 648018 - DNA, 12 bp, Homo sapiens
tttgtatcctcc

SEQ ID NO: 648019 - DNA, 16 bp, Homo sapiens
tttgtcaaatggtatt

SEQ ID NO: 648020 - DNA, 23 bp, Homo sapiens
tttgtcagtgtagatcaactcat

SEQ ID NO: 648021 - DNA, 17 bp, Homo sapiens
tttgttaataaagtgca

SEQ ID NO: 648022 - DNA, 13 bp, Homo sapiens
tttgttaatgatt

SEQ ID NO: 648023 - DNA, 17 bp, Homo sapiens
tttgttcaccttctgtg

SEQ ID NO: 648024 - DNA, 23 bp, Homo sapiens
tttgttctgggttaacagtaaat

SEQ ID NO: 648025 - DNA, 19 bp, Homo sapiens
ttttaaaaaaaatattctg

SEQ ID NO: 648026 - DNA, 20 bp, Homo sapiens
ttttaaaaaaaatattctgt

SEQ ID NO: 648027 - DNA, 18 bp, Homo sapiens
ttttaaaaaaataaaaca

SEQ ID NO: 648028 - DNA, 19 bp, Homo sapiens
ttttaaaaaaataaaacat

SEQ ID NO: 648029 - DNA, 20 bp, Homo sapiens
ttttaaaaaaataaaacatt

SEQ ID NO: 648030 - DNA, 22 bp, Homo sapiens
ttttaaaaaaataaaacatttt

SEQ ID NO: 648031 - DNA, 22 bp, Homo sapiens
ttttaaagctcgtagaaacaag

SEQ ID NO: 648032 - DNA, 13 bp, Homo sapiens
ttttaacatagca

SEQ ID NO: 648033 - DNA, 16 bp, Homo sapiens
ttttaagtaatttcat

SEQ ID NO: 648034 - DNA, 21 bp, Homo sapiens
ttttacaaagaaacaaaatat

SEQ ID NO: 648035 - DNA, 20 bp, Homo sapiens
ttttactcaggctttctatt

SEQ ID NO: 648036 - DNA, 21 bp, Homo sapiens
ttttagaaaaccccacagaaa

SEQ ID NO: 648037 - DNA, 17 bp, Homo sapiens
ttttagaaattctataa

SEQ ID NO: 648038 - DNA, 15 bp, Homo sapiens
ttttatacacataat

SEQ ID NO: 648039 - DNA, 12 bp, Homo sapiens
ttttatacttca

SEQ ID NO: 648040 - DNA, 14 bp, Homo sapiens
ttttatatgattaa

SEQ ID NO: 648041 - DNA, 17 bp, Homo sapiens
ttttatctcttcttcct

SEQ ID NO: 648042 - DNA, 20 bp, Homo sapiens
ttttatgagacttcctatta

SEQ ID NO: 648043 - DNA, 23 bp, Homo sapiens
ttttatgcaaatatttttttgta

SEQ ID NO: 648044 - DNA, 19 bp, Homo sapiens
ttttattgtaacagacatt

SEQ ID NO: 648045 - DNA, 17 bp, Homo sapiens
ttttcaatgtactgtat

SEQ ID NO: 648046 - DNA, 13 bp, Homo sapiens
ttttcacatgaac

SEQ ID NO: 648047 - DNA, 15 bp, Homo sapiens
ttttcacctgaaatg

SEQ ID NO: 648048 - DNA, 22 bp, Homo sapiens
aaaaagctaatccctaaaatag

SEQ ID NO: 648049 - DNA, 14 bp, Homo sapiens
aaaaagctcactgc

SEQ ID NO: 648050 - DNA, 14 bp, Homo sapiens
aaaaagctttttcc

SEQ ID NO: 648051 - DNA, 22 bp, Homo sapiens
aaaaatataaaattatgagatt

SEQ ID NO: 648052 - DNA, 14 bp, Homo sapiens
aaaaatatgtaatt

SEQ ID NO: 648053 - DNA, 12 bp, Homo sapiens
aaaaatggatat

SEQ ID NO: 648054 - DNA, 20 bp, Homo sapiens
aaaaatgtatccagtctgaa

SEQ ID NO: 648055 - DNA, 17 bp, Homo sapiens
aaaacaaatatacattt

SEQ ID NO: 648056 - DNA, 14 bp, Homo sapiens
aaaacaattttctg

SEQ ID NO: 648057 - DNA, 21 bp, Homo sapiens
aaaacactgaaaaatattcca

SEQ ID NO: 648058 - DNA, 15 bp, Homo sapiens
aaaacactgccctct

SEQ ID NO: 648059 - DNA, 13 bp, Homo sapiens
aaaacatttgctg

SEQ ID NO: 648060 - DNA, 14 bp, Homo sapiens
aaaactaaatttca

SEQ ID NO: 648061 - DNA, 17 bp, Homo sapiens
aaaactctagcagttgt

SEQ ID NO: 648062 - DNA, 13 bp, Homo sapiens
aaaagaaactttt

SEQ ID NO: 648063 - DNA, 11 bp, Homo sapiens
aaaagaaatat

SEQ ID NO: 648064 - DNA, 16 bp, Homo sapiens
aaaagaaatatatttt

SEQ ID NO: 648065 - DNA, 16 bp, Homo sapiens
aaaagaataaaaactt

SEQ ID NO: 648066 - DNA, 23 bp, Homo sapiens
aaaagatattgttgttttccatg

SEQ ID NO: 648067 - DNA, 14 bp, Homo sapiens
aaaagcatgaattg

SEQ ID NO: 648068 - DNA, 16 bp, Homo sapiens
aaaagcattttgtaat

SEQ ID NO: 648069 - DNA, 17 bp, Homo sapiens
aaaagccatgtataacc

SEQ ID NO: 648070 - DNA, 20 bp, Homo sapiens
aaaagcgacccattcagaga

SEQ ID NO: 648071 - DNA, 16 bp, Homo sapiens
aaaagctcactgctga

SEQ ID NO: 648072 - DNA, 17 bp, Homo sapiens
aaaagctcactgctgat

SEQ ID NO: 648073 - DNA, 23 bp, Homo sapiens
aaaagctctgttccatgcaactg

SEQ ID NO: 648074 - DNA, 14 bp, Homo sapiens
aaaaggcccatgta

SEQ ID NO: 648075 - DNA, 19 bp, Homo sapiens
aaaaggtagagtcttacaa

SEQ ID NO: 648076 - DNA, 19 bp, Homo sapiens
aaaagtgtgtatatatttt

SEQ ID NO: 648077 - DNA, 12 bp, Homo sapiens
aaaataaaatgt

SEQ ID NO: 648078 - DNA, 22 bp, Homo sapiens
aaaataaacagacaaaaacaag

SEQ ID NO: 648079 - DNA, 12 bp, Homo sapiens
aaaataaataat

SEQ ID NO: 648080 - DNA, 16 bp, Homo sapiens
aaaataaataatttta

SEQ ID NO: 648081 - DNA, 13 bp, Homo sapiens
aaaataacagtat

SEQ ID NO: 648082 - DNA, 16 bp, Homo sapiens
aaaataatagttttag

SEQ ID NO: 648083 - DNA, 14 bp, Homo sapiens
aaaataattttgta

SEQ ID NO: 648084 - DNA, 17 bp, Homo sapiens
aaaatactatttaagat

SEQ ID NO: 648085 - DNA, 17 bp, Homo sapiens
aaaatatatgaagacaa

SEQ ID NO: 648086 - DNA, 15 bp, Homo sapiens
aaaatatgtaatttc

SEQ ID NO: 648087 - DNA, 16 bp, Homo sapiens
aaaatatgtaatttca

SEQ ID NO: 648088 - DNA, 17 bp, Homo sapiens
aaaatatttaatatcaa

SEQ ID NO: 648089 - DNA, 21 bp, Homo sapiens
aaaatcactttgtctaactca

SEQ ID NO: 648090 - DNA, 18 bp, Homo sapiens
aaaatcagaacaaaactt

SEQ ID NO: 648091 - DNA, 22 bp, Homo sapiens
aaaatcatgatccttgtgttca

SEQ ID NO: 648092 - DNA, 22 bp, Homo sapiens
aaaatcattgattgtcagctac

SEQ ID NO: 648093 - DNA, 17 bp, Homo sapiens
aaaatccccttcgctga

SEQ ID NO: 648094 - DNA, 22 bp, Homo sapiens
aaaatctaagcagcttattgtt

SEQ ID NO: 648095 - DNA, 15 bp, Homo sapiens
aaaatctcaattgaa

SEQ ID NO: 648096 - DNA, 15 bp, Homo sapiens
aaaatcttctgatga

SEQ ID NO: 648097 - DNA, 13 bp, Homo sapiens
aaaatgaagggat

SEQ ID NO: 648098 - DNA, 22 bp, Homo sapiens
aaaatgaattgaaaaacaattt

SEQ ID NO: 648099 - DNA, 17 bp, Homo sapiens
aaaatgacaattgtgaa

SEQ ID NO: 648100 - DNA, 19 bp, Homo sapiens
aaaatggacacaaattttc

SEQ ID NO: 648101 - DNA, 20 bp, Homo sapiens
aaaattacctttaattttaa

SEQ ID NO: 648102 - DNA, 17 bp, Homo sapiens
aaaattactaattttac

SEQ ID NO: 648103 - DNA, 16 bp, Homo sapiens
aaaattcagagtcctt

SEQ ID NO: 648104 - DNA, 18 bp, Homo sapiens
aaaattcatagtaagatt

SEQ ID NO: 648105 - DNA, 19 bp, Homo sapiens
aaaattcatagtaagattg

SEQ ID NO: 648106 - DNA, 18 bp, Homo sapiens
aaaattcttgagaagtaa

SEQ ID NO: 648107 - DNA, 15 bp, Homo sapiens
aaaattgatattata

SEQ ID NO: 648108 - DNA, 13 bp, Homo sapiens
aaaattgatattt

SEQ ID NO: 648109 - DNA, 20 bp, Homo sapiens
aaaattgctatgttactatt

SEQ ID NO: 648110 - DNA, 22 bp, Homo sapiens
aaaattgctatgttactatttt

SEQ ID NO: 648111 - DNA, 17 bp, Homo sapiens
aaaattttaaaaatcta

SEQ ID NO: 648112 - DNA, 18 bp, Homo sapiens
aaaattttgtatgttaaa

SEQ ID NO: 648113 - DNA, 21 bp, Homo sapiens
aaaattttgtatgttaaagag

SEQ ID NO: 648114 - DNA, 16 bp, Homo sapiens
aaacaaagtactcttt

SEQ ID NO: 648115 - DNA, 16 bp, Homo sapiens
aaacaagtaaatatat

SEQ ID NO: 648116 - DNA, 18 bp, Homo sapiens
aaacacaggctgtcctta

SEQ ID NO: 648117 - DNA, 15 bp, Homo sapiens
aaacacgtggtcatg

SEQ ID NO: 648118 - DNA, 17 bp, Homo sapiens
aaacactacacatttga

SEQ ID NO: 648119 - DNA, 16 bp, Homo sapiens
aaacactgaaatgaaa

SEQ ID NO: 648120 - DNA, 22 bp, Homo sapiens
aaacactgcaaattttaactgt

SEQ ID NO: 648121 - DNA, 16 bp, Homo sapiens
aaacagacaaaaacaa

SEQ ID NO: 648122 - DNA, 16 bp, Homo sapiens
aaacagacaatatgtg

SEQ ID NO: 648123 - DNA, 18 bp, Homo sapiens
aaacagctgcattagaaa

SEQ ID NO: 648124 - DNA, 23 bp, Homo sapiens
aaacagtccaaactgttctgaga

SEQ ID NO: 648125 - DNA, 13 bp, Homo sapiens
aaacataaaaact

SEQ ID NO: 648126 - DNA, 12 bp, Homo sapiens
aaacatgtatgt

SEQ ID NO: 648127 - DNA, 23 bp, Homo sapiens
aaacattttatcattaaaaatta

SEQ ID NO: 648128 - DNA, 17 bp, Homo sapiens
aaacattttttcttctg

SEQ ID NO: 648129 - DNA, 18 bp, Homo sapiens
aaacattttttcttctga

SEQ ID NO: 648130 - DNA, 23 bp, Homo sapiens
aaaccgccagcgaacttgacaat

SEQ ID NO: 648131 - DNA, 11 bp, Homo sapiens
aaacctaggtc

SEQ ID NO: 648132 - DNA, 22 bp, Homo sapiens
aaacctgactcaattatttgca

SEQ ID NO: 648133 - DNA, 17 bp, Homo sapiens
aaacctgggctcagcct

SEQ ID NO: 648134 - DNA, 22 bp, Homo sapiens
aaacctgtattactgaataata

SEQ ID NO: 648135 - DNA, 17 bp, Homo sapiens
aaaccttgctctcctca

SEQ ID NO: 648136 - DNA, 22 bp, Homo sapiens
aaaccttgctctcctcatctcc

SEQ ID NO: 648137 - DNA, 15 bp, Homo sapiens
aaacgaaggcataat

SEQ ID NO: 648138 - DNA, 23 bp, Homo sapiens
aaacgagttaatgatggcagagg

SEQ ID NO: 648139 - DNA, 16 bp, Homo sapiens
aaacgcgtctgcctgg

SEQ ID NO: 648140 - DNA, 13 bp, Homo sapiens
aaacgctacctct

SEQ ID NO: 648141 - DNA, 21 bp, Homo sapiens
aaacgtggcacacactgacca

SEQ ID NO: 648142 - DNA, 22 bp, Homo sapiens
aaacgtggcacacactgaccac

SEQ ID NO: 648143 - DNA, 16 bp, Homo sapiens
aaacgtggttacatta

SEQ ID NO: 648144 - DNA, 17 bp, Homo sapiens
aaactaaccttgaataa

SEQ ID NO: 648145 - DNA, 20 bp, Homo sapiens
aaactaaccttgaataaggc

SEQ ID NO: 648146 - DNA, 22 bp, Homo sapiens
aaactaccactttttttaacca

SEQ ID NO: 648147 - DNA, 14 bp, Homo sapiens
aaactatcttgtgt

SEQ ID NO: 648148 - DNA, 15 bp, Homo sapiens
aaactatgttcctaa

SEQ ID NO: 648149 - DNA, 19 bp, Homo sapiens
aaactatttatatcacaca

SEQ ID NO: 648150 - DNA, 15 bp, Homo sapiens
aaactccagatgcca

SEQ ID NO: 648151 - DNA, 22 bp, Homo sapiens
aaactccagatgccacaatgga

SEQ ID NO: 648152 - DNA, 14 bp, Homo sapiens
aaactcctttctta

SEQ ID NO: 648153 - DNA, 18 bp, Homo sapiens
aaactctgttacactttt

SEQ ID NO: 648154 - DNA, 14 bp, Homo sapiens
aaactcttcagtgc

SEQ ID NO: 648155 - DNA, 17 bp, Homo sapiens
aaactgagagtaattca

SEQ ID NO: 648156 - DNA, 22 bp, Homo sapiens
aaactgcttcccttactttgct

SEQ ID NO: 648157 - DNA, 14 bp, Homo sapiens
aaactggcttcccc

SEQ ID NO: 648158 - DNA, 19 bp, Homo sapiens
aaactgggattaagaaacc

SEQ ID NO: 648159 - DNA, 16 bp, Homo sapiens
aaactgtacatttaaa

SEQ ID NO: 648160 - DNA, 13 bp, Homo sapiens
aaacttaaaaaca

SEQ ID NO: 648161 - DNA, 15 bp, Homo sapiens
aaacttaagaattga

SEQ ID NO: 648162 - DNA, 14 bp, Homo sapiens
aaacttctgctcgt

SEQ ID NO: 648163 - DNA, 19 bp, Homo sapiens
aaacttgactccatttcat

SEQ ID NO: 648164 - DNA, 12 bp, Homo sapiens
aaagaaaattga

SEQ ID NO: 648165 - DNA, 16 bp, Homo sapiens
aaagaaacttttctga

SEQ ID NO: 648166 - DNA, 18 bp, Homo sapiens
aaagaaatatattttttg

SEQ ID NO: 648167 - DNA, 15 bp, Homo sapiens
aaagaacgctgattt

SEQ ID NO: 648168 - DNA, 16 bp, Homo sapiens
aaagaatttagtatta

SEQ ID NO: 648169 - DNA, 15 bp, Homo sapiens
aaagacccaggggga

SEQ ID NO: 648170 - DNA, 22 bp, Homo sapiens
aaagaccctcctattctataaa

SEQ ID NO: 648171 - DNA, 23 bp, Homo sapiens
aaatacatgccacatcaaacctt

SEQ ID NO: 648172 - DNA, 18 bp, Homo sapiens
aaatacctcaatttttgt

SEQ ID NO: 648173 - DNA, 21 bp, Homo sapiens
aaatacttttgctttcaggga

SEQ ID NO: 648174 - DNA, 13 bp, Homo sapiens
aaatagaataatt

SEQ ID NO: 648175 - DNA, 14 bp, Homo sapiens
aaatagaataattc

SEQ ID NO: 648176 - DNA, 16 bp, Homo sapiens
aaatagaataattctt

SEQ ID NO: 648177 - DNA, 17 bp, Homo sapiens
aaatagacagcatgaga

SEQ ID NO: 648178 - DNA, 22 bp, Homo sapiens
aaataggctttttaggaactca

SEQ ID NO: 648179 - DNA, 22 bp, Homo sapiens
aaatagtatacattgtcttgat

SEQ ID NO: 648180 - DNA, 13 bp, Homo sapiens
aaatataaaatta

SEQ ID NO: 648181 - DNA, 18 bp, Homo sapiens
aaatataaaattatgaga

SEQ ID NO: 648182 - DNA, 14 bp, Homo sapiens
aaatataacacatt

SEQ ID NO: 648183 - DNA, 19 bp, Homo sapiens
aaatataagacatttgttt

SEQ ID NO: 648184 - DNA, 20 bp, Homo sapiens
aaatatacattttctaaata

SEQ ID NO: 648185 - DNA, 18 bp, Homo sapiens
aaatatatattatatatt

SEQ ID NO: 648186 - DNA, 13 bp, Homo sapiens
aaatatcataaag

SEQ ID NO: 648187 - DNA, 18 bp, Homo sapiens
aaatatccaccactttaa

SEQ ID NO: 648188 - DNA, 14 bp, Homo sapiens
aaatatccacccag

SEQ ID NO: 648189 - DNA, 17 bp, Homo sapiens
aaatatgccactgaccg

SEQ ID NO: 648190 - DNA, 17 bp, Homo sapiens
aaatatgtaatttcaaa

SEQ ID NO: 648191 - DNA, 14 bp, Homo sapiens
aaatattaagcatg

SEQ ID NO: 648192 - DNA, 17 bp, Homo sapiens
aaatattcactggcccc

SEQ ID NO: 648193 - DNA, 16 bp, Homo sapiens
aaatatttaatatcaa

SEQ ID NO: 648194 - DNA, 22 bp, Homo sapiens
aaatatttagatgtaattttgt

SEQ ID NO: 648195 - DNA, 17 bp, Homo sapiens
aaatctaccactgtatg

SEQ ID NO: 648196 - DNA, 14 bp, Homo sapiens
aaatctcaattgaa

SEQ ID NO: 648197 - DNA, 19 bp, Homo sapiens
aaatcttcagtattttctc

SEQ ID NO: 648198 - DNA, 14 bp, Homo sapiens
aaatgaagaaagtc

SEQ ID NO: 648199 - DNA, 15 bp, Homo sapiens
aaatgagctctgaaa

SEQ ID NO: 648200 - DNA, 18 bp, Homo sapiens
aaatgaggattattgata

SEQ ID NO: 648201 - DNA, 23 bp, Homo sapiens
aaatgattgtttcttcttcatgc

SEQ ID NO: 648202 - DNA, 19 bp, Homo sapiens
aaatgcaggtgtcctgagc

SEQ ID NO: 648203 - DNA, 16 bp, Homo sapiens
aaatgcatattaaata

SEQ ID NO: 648204 - DNA, 15 bp, Homo sapiens
aaatgcattgaacat

SEQ ID NO: 648205 - DNA, 18 bp, Homo sapiens
aaatgccagtctcattgt

SEQ ID NO: 648206 - DNA, 22 bp, Homo sapiens
aaatgctgggggtaggtggcta

SEQ ID NO: 648207 - DNA, 13 bp, Homo sapiens
aaatgcttaaaaa

SEQ ID NO: 648208 - DNA, 20 bp, Homo sapiens
aaatggacacaaattttcaa

SEQ ID NO: 648209 - DNA, 21 bp, Homo sapiens
aaatggacacaaattttcaag

SEQ ID NO: 648210 - DNA, 21 bp, Homo sapiens
aaatgggaaaaaacttaaaaa

SEQ ID NO: 648211 - DNA, 20 bp, Homo sapiens
aaatgggtgtatataatttt

SEQ ID NO: 648212 - DNA, 18 bp, Homo sapiens
aaatggtcatggggatga

SEQ ID NO: 648213 - DNA, 19 bp, Homo sapiens
aaatgtaattatgttctaa

SEQ ID NO: 648214 - DNA, 14 bp, Homo sapiens
aaatgtaatttaaa

SEQ ID NO: 648215 - DNA, 19 bp, Homo sapiens
aaatgtaatttaaatgaaa

SEQ ID NO: 648216 - DNA, 19 bp, Homo sapiens
aaatgtagaaacttaaaca

SEQ ID NO: 648217 - DNA, 19 bp, Homo sapiens
aaatgtaggatcaaaaggc

SEQ ID NO: 648218 - DNA, 16 bp, Homo sapiens
aaatgtataaatatac

SEQ ID NO: 648219 - DNA, 19 bp, Homo sapiens
aaatgtataaatatacagt

SEQ ID NO: 648220 - DNA, 21 bp, Homo sapiens
aaatgtataaatatacagtat

SEQ ID NO: 648221 - DNA, 21 bp, Homo sapiens
aaatgtatccaaggaaacatt

SEQ ID NO: 648222 - DNA, 23 bp, Homo sapiens
aaatgtcagtagtgctaatgcat

SEQ ID NO: 648223 - DNA, 18 bp, Homo sapiens
aaatgtcattgtctactc

SEQ ID NO: 648224 - DNA, 21 bp, Homo sapiens
aaatgtcttggtcttctactg

SEQ ID NO: 648225 - DNA, 18 bp, Homo sapiens
aaatgtgaatttttattg

SEQ ID NO: 648226 - DNA, 20 bp, Homo sapiens
aaatgtgaatttttattgtt

SEQ ID NO: 648227 - DNA, 20 bp, Homo sapiens
aaatgtgtcctatctatctt

SEQ ID NO: 648228 - DNA, 14 bp, Homo sapiens
aaatgttaaaagtt

SEQ ID NO: 648229 - DNA, 16 bp, Homo sapiens
aaatgttaaaagtttt

SEQ ID NO: 648230 - DNA, 19 bp, Homo sapiens
aaatgttaaaagttttata

SEQ ID NO: 648231 - DNA, 18 bp, Homo sapiens
aaatgtttatactgtatt

SEQ ID NO: 648232 - DNA, 14 bp, Homo sapiens
aaattaaaacaaat

SEQ ID NO: 648233 - DNA, 16 bp, Homo sapiens
aaattaagcaaatgtt

SEQ ID NO: 648234 - DNA, 20 bp, Homo sapiens
aaattaatatggcttcacca

SEQ ID NO: 648235 - DNA, 22 bp, Homo sapiens
aaattaatatggcttcaccaag

SEQ ID NO: 648236 - DNA, 14 bp, Homo sapiens
aaattaattttact

SEQ ID NO: 648237 - DNA, 13 bp, Homo sapiens
aaattacctttaa

SEQ ID NO: 648238 - DNA, 16 bp, Homo sapiens
aaattacctttaattt

SEQ ID NO: 648239 - DNA, 14 bp, Homo sapiens
aaattactttaaca

SEQ ID NO: 648240 - DNA, 22 bp, Homo sapiens
aaattactttaacattttggaa

SEQ ID NO: 648241 - DNA, 16 bp, Homo sapiens
aaattatggcatttct

SEQ ID NO: 648242 - DNA, 21 bp, Homo sapiens
aaattcaagagctagaaaaat

SEQ ID NO: 648243 - DNA, 14 bp, Homo sapiens
aaattcttcacatg

SEQ ID NO: 648244 - DNA, 14 bp, Homo sapiens
aaattcttgagaag

SEQ ID NO: 648245 - DNA, 15 bp, Homo sapiens
aaattgaaataaata

SEQ ID NO: 648246 - DNA, 20 bp, Homo sapiens
aaattgaatgtggctgaagt

SEQ ID NO: 648247 - DNA, 12 bp, Homo sapiens
aaattgcatact

SEQ ID NO: 648248 - DNA, 14 bp, Homo sapiens
aaattgcatacttt

SEQ ID NO: 648249 - DNA, 17 bp, Homo sapiens
aaattgcatactttgta

SEQ ID NO: 648250 - DNA, 18 bp, Homo sapiens
aaattgccctatgctgtg

SEQ ID NO: 648251 - DNA, 22 bp, Homo sapiens
aaattgctatgttactattttc

SEQ ID NO: 648252 - DNA, 14 bp, Homo sapiens
aaattgctgtgctt

SEQ ID NO: 648253 - DNA, 11 bp, Homo sapiens
aaattgtgtta

SEQ ID NO: 648254 - DNA, 23 bp, Homo sapiens
aaattgtttagtgatattacatt

SEQ ID NO: 648255 - DNA, 13 bp, Homo sapiens
aaatttaaaaaat

SEQ ID NO: 648256 - DNA, 16 bp, Homo sapiens
aaatttaaaatgtgtg

SEQ ID NO: 648257 - DNA, 21 bp, Homo sapiens
aaatttaataccagatacctt

SEQ ID NO: 648258 - DNA, 18 bp, Homo sapiens
aaatttgatggactaatt

SEQ ID NO: 648259 - DNA, 20 bp, Homo sapiens
aaatttgatggactaattat

SEQ ID NO: 648260 - DNA, 15 bp, Homo sapiens
aaattttaaaaatct

SEQ ID NO: 648261 - DNA, 12 bp, Homo sapiens
aaattttaactg

SEQ ID NO: 648262 - DNA, 16 bp, Homo sapiens
aaattttattttgtgc

SEQ ID NO: 648263 - DNA, 14 bp, Homo sapiens
aaattttcaagttt

SEQ ID NO: 648264 - DNA, 22 bp, Homo sapiens
aacaaaggcctaattctatgcc

SEQ ID NO: 648265 - DNA, 20 bp, Homo sapiens
aacaagtgctcctgaaagaa

SEQ ID NO: 648266 - DNA, 19 bp, Homo sapiens
aacaatgacactagaaaac

SEQ ID NO: 648267 - DNA, 20 bp, Homo sapiens
aacaattttctgtaatcttt

SEQ ID NO: 648268 - DNA, 19 bp, Homo sapiens
aacacaaaaaaaattttag

SEQ ID NO: 648269 - DNA, 14 bp, Homo sapiens
aacacagttctggg

SEQ ID NO: 648270 - DNA, 14 bp, Homo sapiens
aacacatctggctg

SEQ ID NO: 648271 - DNA, 15 bp, Homo sapiens
aacacatctggctgc

SEQ ID NO: 648272 - DNA, 18 bp, Homo sapiens
aagaatatcctttaaaat

SEQ ID NO: 648273 - DNA, 18 bp, Homo sapiens
aagaatatttttagacta

SEQ ID NO: 648274 - DNA, 22 bp, Homo sapiens
aagaatgaaaaatataatgttg

SEQ ID NO: 648275 - DNA, 16 bp, Homo sapiens
aagaatgtacgtccag

SEQ ID NO: 648276 - DNA, 18 bp, Homo sapiens
aagaattaagatacaaat

SEQ ID NO: 648277 - DNA, 20 bp, Homo sapiens
aagaattctgattgatttga

SEQ ID NO: 648278 - DNA, 18 bp, Homo sapiens
aagaattgaaaagttttt

SEQ ID NO: 648279 - DNA, 15 bp, Homo sapiens
aagaattggaagtta

SEQ ID NO: 648280 - DNA, 22 bp, Homo sapiens
aagaattgttagcaaatgacag

SEQ ID NO: 648281 - DNA, 16 bp, Homo sapiens
aagacaaaataaatgt

SEQ ID NO: 648282 - DNA, 23 bp, Homo sapiens
aagacagggctcatttttgcact

SEQ ID NO: 648283 - DNA, 16 bp, Homo sapiens
aagacattttgttaca

SEQ ID NO: 648284 - DNA, 14 bp, Homo sapiens
aagacgggagggga

SEQ ID NO: 648285 - DNA, 15 bp, Homo sapiens
aagacgggaggggag

SEQ ID NO: 648286 - DNA, 17 bp, Homo sapiens
aagactgtagatatgta

SEQ ID NO: 648287 - DNA, 13 bp, Homo sapiens
aagacttgagaca

SEQ ID NO: 648288 - DNA, 22 bp, Homo sapiens
aagacttgagacaatgttttct

SEQ ID NO: 648289 - DNA, 11 bp, Homo sapiens
aagagaatgag

SEQ ID NO: 648290 - DNA, 13 bp, Homo sapiens
aagagacaaagat

SEQ ID NO: 648291 - DNA, 17 bp, Homo sapiens
aagagatctacacatgt

SEQ ID NO: 648292 - DNA, 19 bp, Homo sapiens
aagagatctacacatgttg

SEQ ID NO: 648293 - DNA, 13 bp, Homo sapiens
aagagattgctga

SEQ ID NO: 648294 - DNA, 21 bp, Homo sapiens
aagagcacactgcacagggaa

SEQ ID NO: 648295 - DNA, 17 bp, Homo sapiens
aagagccattttggtaa

SEQ ID NO: 648296 - DNA, 20 bp, Homo sapiens
aagagctagaaaaataaaat

SEQ ID NO: 648297 - DNA, 22 bp, Homo sapiens
aagagctagaaaaataaaatgt

SEQ ID NO: 648298 - DNA, 23 bp, Homo sapiens
aagaggctgcccctctcaccaaa

SEQ ID NO: 648299 - DNA, 15 bp, Homo sapiens
aagaggtgggagggc

SEQ ID NO: 648300 - DNA, 17 bp, Homo sapiens
aagaggtgggagggccc

SEQ ID NO: 648301 - DNA, 22 bp, Homo sapiens
aagagtattttaagaagacata

SEQ ID NO: 648302 - DNA, 16 bp, Homo sapiens
aagagtgacttatttt

SEQ ID NO: 648303 - DNA, 16 bp, Homo sapiens
aagagttcccttgaaa

SEQ ID NO: 648304 - DNA, 18 bp, Homo sapiens
aagagtttcagtttgttg

SEQ ID NO: 648305 - DNA, 18 bp, Homo sapiens
aagatacaaattaatttt

SEQ ID NO: 648306 - DNA, 20 bp, Homo sapiens
aagatacaaattaattttac

SEQ ID NO: 648307 - DNA, 15 bp, Homo sapiens
aagatgaaaaagaat

SEQ ID NO: 648308 - DNA, 12 bp, Homo sapiens
aagatggtggcc

SEQ ID NO: 648309 - DNA, 21 bp, Homo sapiens
aagatggtggccacagactga

SEQ ID NO: 648310 - DNA, 13 bp, Homo sapiens
aagatgtgaaaat

SEQ ID NO: 648311 - DNA, 14 bp, Homo sapiens
aagatgtgaaaatt

SEQ ID NO: 648312 - DNA, 20 bp, Homo sapiens
aagatgttctggataccatt

SEQ ID NO: 648313 - DNA, 22 bp, Homo sapiens
aagattccagagctctttgatc

SEQ ID NO: 648314 - DNA, 18 bp, Homo sapiens
aagatttatacagttgaa

SEQ ID NO: 648315 - DNA, 16 bp, Homo sapiens
aagatttgatgtatgt

SEQ ID NO: 648316 - DNA, 23 bp, Homo sapiens
aagatttgatgtatgtaatacat

SEQ ID NO: 648317 - DNA, 23 bp, Homo sapiens
aagcaaacttacaggtcctgctg

SEQ ID NO: 648318 - DNA, 18 bp, Homo sapiens
aagcaaagttcaacttat

SEQ ID NO: 648319 - DNA, 14 bp, Homo sapiens
aagcaacatggctt

SEQ ID NO: 648320 - DNA, 15 bp, Homo sapiens
aagcaagagagatgt

SEQ ID NO: 648321 - DNA, 17 bp, Homo sapiens
aagcaagagagatgttt

SEQ ID NO: 648322 - DNA, 15 bp, Homo sapiens
aagcaagggggtgat

SEQ ID NO: 648323 - DNA, 19 bp, Homo sapiens
aagcactatgcccttttat

SEQ ID NO: 648324 - DNA, 23 bp, Homo sapiens
aagcactcctgcttaatcttcaa

SEQ ID NO: 648325 - DNA, 14 bp, Homo sapiens
aagcagagcctcct

SEQ ID NO: 648326 - DNA, 15 bp, Homo sapiens
aagcagagcctcctg

SEQ ID NO: 648327 - DNA, 13 bp, Homo sapiens
aagcagaggacca

SEQ ID NO: 648328 - DNA, 17 bp, Homo sapiens
aagcaggtttgttttca

SEQ ID NO: 648329 - DNA, 13 bp, Homo sapiens
aagcatgaaaaag

SEQ ID NO: 648330 - DNA, 14 bp, Homo sapiens
aagcatgaaatgtg

SEQ ID NO: 648331 - DNA, 13 bp, Homo sapiens
aagcatgaattgg

SEQ ID NO: 648332 - DNA, 15 bp, Homo sapiens
aagcatgaattggaa

SEQ ID NO: 648333 - DNA, 16 bp, Homo sapiens
aagcatgtcaattcat

SEQ ID NO: 648334 - DNA, 23 bp, Homo sapiens
aagcatgtggtcttatagtgttt

SEQ ID NO: 648335 - DNA, 15 bp, Homo sapiens
aagcattggagtttc

SEQ ID NO: 648336 - DNA, 16 bp, Homo sapiens
aagcattttgaaacaa

SEQ ID NO: 648337 - DNA, 19 bp, Homo sapiens
aagccaactgacaaagatg

SEQ ID NO: 648338 - DNA, 15 bp, Homo sapiens
aagccaatgtgaatt

SEQ ID NO: 648339 - DNA, 19 bp, Homo sapiens
aagccacattatttctagt

SEQ ID NO: 648340 - DNA, 12 bp, Homo sapiens
aagccagggtct

SEQ ID NO: 648341 - DNA, 21 bp, Homo sapiens
aagccagggtctctccctcag

SEQ ID NO: 648342 - DNA, 19 bp, Homo sapiens
aagcccaaactcctttctt

SEQ ID NO: 648343 - DNA, 22 bp, Homo sapiens
aagcccaaactcctttcttatc

SEQ ID NO: 648344 - DNA, 13 bp, Homo sapiens
aagccccacatgt

SEQ ID NO: 648345 - DNA, 14 bp, Homo sapiens
aagcctaaaattga

SEQ ID NO: 648346 - DNA, 15 bp, Homo sapiens
aagcctcaaaacaaa

SEQ ID NO: 648347 - DNA, 16 bp, Homo sapiens
aagcctcaaaacaaag

SEQ ID NO: 648348 - DNA, 16 bp, Homo sapiens
aagcctcatgccaacc

SEQ ID NO: 648349 - DNA, 20 bp, Homo sapiens
aagcggccctaagggagtgt

SEQ ID NO: 648350 - DNA, 15 bp, Homo sapiens
aagcgttaagggcag

SEQ ID NO: 648351 - DNA, 15 bp, Homo sapiens
aagctagtgtttcta

SEQ ID NO: 648352 - DNA, 11 bp, Homo sapiens
aagctgagcct

SEQ ID NO: 648353 - DNA, 14 bp, Homo sapiens
aagctgattttatt

SEQ ID NO: 648354 - DNA, 17 bp, Homo sapiens
aagctgcagagatttct

SEQ ID NO: 648355 - DNA, 13 bp, Homo sapiens
aagctggcctgag

SEQ ID NO: 648356 - DNA, 15 bp, Homo sapiens
aagcttaaattttat

SEQ ID NO: 648357 - DNA, 20 bp, Homo sapiens
aagcttaaattttatatcat

SEQ ID NO: 648358 - DNA, 21 bp, Homo sapiens
aaggtttattgttaatacaag

SEQ ID NO: 648359 - DNA, 23 bp, Homo sapiens
aaggttttggatcttgaatgtgg

SEQ ID NO: 648360 - DNA, 15 bp, Homo sapiens
aagtaacttatttga

SEQ ID NO: 648361 - DNA, 17 bp, Homo sapiens
aagtaacttatttgact

SEQ ID NO: 648362 - DNA, 15 bp, Homo sapiens
aagtaagaagacatg

SEQ ID NO: 648363 - DNA, 20 bp, Homo sapiens
aagtaagaagacatgaacca

SEQ ID NO: 648364 - DNA, 17 bp, Homo sapiens
aagtacaaatgaagaaa

SEQ ID NO: 648365 - DNA, 20 bp, Homo sapiens
aagtatctgggattattctt

SEQ ID NO: 648366 - DNA, 15 bp, Homo sapiens
aagtatggtgtgttc

SEQ ID NO: 648367 - DNA, 20 bp, Homo sapiens
aagtcagatttttatttatg

SEQ ID NO: 648368 - DNA, 15 bp, Homo sapiens
aagtcagctccagct

SEQ ID NO: 648369 - DNA, 17 bp, Homo sapiens
aagtcatttttgtattt

SEQ ID NO: 648370 - DNA, 22 bp, Homo sapiens
aagtcatttttgtatttttcat

SEQ ID NO: 648371 - DNA, 17 bp, Homo sapiens
aagtccatctgacaaaa

SEQ ID NO: 648372 - DNA, 14 bp, Homo sapiens
aagtctgctgctgt

SEQ ID NO: 648373 - DNA, 15 bp, Homo sapiens
aagtctgctgctgtg

SEQ ID NO: 648374 - DNA, 20 bp, Homo sapiens
aagtctgttgattaaagatg

SEQ ID NO: 648375 - DNA, 15 bp, Homo sapiens
aagtctttcatggct

SEQ ID NO: 648376 - DNA, 14 bp, Homo sapiens
aagtgaaaatatag

SEQ ID NO: 648377 - DNA, 11 bp, Homo sapiens
aagtgaaatta

SEQ ID NO: 648378 - DNA, 13 bp, Homo sapiens
aagtgaaattaag

SEQ ID NO: 648379 - DNA, 18 bp, Homo sapiens
aagtgaaattaagcattt

SEQ ID NO: 648380 - DNA, 20 bp, Homo sapiens
aagtgagcagtcgcctgcct

SEQ ID NO: 648381 - DNA, 15 bp, Homo sapiens
aagtgcactttctaa

SEQ ID NO: 648382 - DNA, 16 bp, Homo sapiens
aagtgcgtgccgtgtg

SEQ ID NO: 648383 - DNA, 13 bp, Homo sapiens
aagtggctgcctt

SEQ ID NO: 648384 - DNA, 16 bp, Homo sapiens
aagtgtaaaaaatgtc

SEQ ID NO: 648385 - DNA, 14 bp, Homo sapiens
aagtgtataatata

SEQ ID NO: 648386 - DNA, 21 bp, Homo sapiens
aagtgtataatataaaaaatt

SEQ ID NO: 648387 - DNA, 23 bp, Homo sapiens
aagtgtgctctttttttaaaagg

SEQ ID NO: 648388 - DNA, 17 bp, Homo sapiens
aagtgtgtatatatttt

SEQ ID NO: 648389 - DNA, 19 bp, Homo sapiens
aagtgtgtatatattttgt

SEQ ID NO: 648390 - DNA, 21 bp, Homo sapiens
aagtgtgtatatattttgtgt

SEQ ID NO: 648391 - DNA, 21 bp, Homo sapiens
aagtgttaagtttttaatctg

SEQ ID NO: 648392 - DNA, 22 bp, Homo sapiens
aagttacagtttgatacaggaa

SEQ ID NO: 648393 - DNA, 18 bp, Homo sapiens
aagttagttccactgaga

SEQ ID NO: 648394 - DNA, 21 bp, Homo sapiens
aagttgattaagaaaggaagt

SEQ ID NO: 648395 - DNA, 18 bp, Homo sapiens
aagttgtttgaggcaaat

SEQ ID NO: 648396 - DNA, 16 bp, Homo sapiens
aagtttaattgtctca

SEQ ID NO: 648397 - DNA, 20 bp, Homo sapiens
aagtttcaaacttactattt

SEQ ID NO: 648398 - DNA, 14 bp, Homo sapiens
aagttttaacttta

SEQ ID NO: 648399 - DNA, 13 bp, Homo sapiens
aagttttatatgc

SEQ ID NO: 648400 - DNA, 12 bp, Homo sapiens
aagttttgttgt

SEQ ID NO: 648401 - DNA, 22 bp, Homo sapiens
aagttttgttgtacttaaatgg

SEQ ID NO: 648402 - DNA, 12 bp, Homo sapiens
aagtttttttgc

SEQ ID NO: 648403 - DNA, 17 bp, Homo sapiens
aataaaaatatgtaatt

SEQ ID NO: 648404 - DNA, 18 bp, Homo sapiens
aataaaatgtttcattat

SEQ ID NO: 648405 - DNA, 19 bp, Homo sapiens
aataaacagacaaaaacaa

SEQ ID NO: 648406 - DNA, 18 bp, Homo sapiens
aataaacctgggctcagc

SEQ ID NO: 648407 - DNA, 12 bp, Homo sapiens
aataaagcttta

SEQ ID NO: 648408 - DNA, 16 bp, Homo sapiens
aataaaggcagctgcc

SEQ ID NO: 648409 - DNA, 18 bp, Homo sapiens
aataaaggcagctgcctc

SEQ ID NO: 648410 - DNA, 19 bp, Homo sapiens
aataaaggcagctgcctct

SEQ ID NO: 648411 - DNA, 20 bp, Homo sapiens
aataaaggcagctgcctctg

SEQ ID NO: 648412 - DNA, 23 bp, Homo sapiens
aataaaggcagctgcctctgctc

SEQ ID NO: 648413 - DNA, 11 bp, Homo sapiens
aataaaggctg

SEQ ID NO: 648414 - DNA, 14 bp, Homo sapiens
aataaatactcagt

SEQ ID NO: 648415 - DNA, 11 bp, Homo sapiens
aataaatataa

SEQ ID NO: 648416 - DNA, 19 bp, Homo sapiens
aataaatctcttctttgct

SEQ ID NO: 648417 - DNA, 15 bp, Homo sapiens
aataaatgccctctt

SEQ ID NO: 648418 - DNA, 16 bp, Homo sapiens
aataaatgccctcttc

SEQ ID NO: 648419 - DNA, 16 bp, Homo sapiens
aataacactgtatttt

SEQ ID NO: 648420 - DNA, 22 bp, Homo sapiens
aataacactgtattttaatgta

SEQ ID NO: 648421 - DNA, 15 bp, Homo sapiens
aataagacaaaaata

SEQ ID NO: 648422 - DNA, 21 bp, Homo sapiens
aataaggcaggcattgaggaa

SEQ ID NO: 648423 - DNA, 15 bp, Homo sapiens
aataataaagtatga

SEQ ID NO: 648424 - DNA, 14 bp, Homo sapiens
aataatatcaaata

SEQ ID NO: 648425 - DNA, 21 bp, Homo sapiens
aataatgctacaattttaaga

SEQ ID NO: 648426 - DNA, 14 bp, Homo sapiens
aataattttgtaat

SEQ ID NO: 648427 - DNA, 19 bp, Homo sapiens
aatacaacaacaacaaaaa

SEQ ID NO: 648428 - DNA, 16 bp, Homo sapiens
aatacagtattataga

SEQ ID NO: 648429 - DNA, 16 bp, Homo sapiens
aatacagttatttcat

SEQ ID NO: 648430 - DNA, 14 bp, Homo sapiens
aatacatagtgaaa

SEQ ID NO: 648431 - DNA, 16 bp, Homo sapiens
aatacatgtgtatatt

SEQ ID NO: 648432 - DNA, 20 bp, Homo sapiens
aatacatgtgtatattcctt

SEQ ID NO: 648433 - DNA, 14 bp, Homo sapiens
aatacatttaaaac

SEQ ID NO: 648434 - DNA, 22 bp, Homo sapiens
aatacatttaaaacattaaaat

SEQ ID NO: 648435 - DNA, 17 bp, Homo sapiens
aatacatttgtaagtgt

SEQ ID NO: 648436 - DNA, 17 bp, Homo sapiens
aatacctcaatttttgt

SEQ ID NO: 648437 - DNA, 17 bp, Homo sapiens
aatactctacttacagt

SEQ ID NO: 648438 - DNA, 16 bp, Homo sapiens
aatactgttctttcca

SEQ ID NO: 648439 - DNA, 18 bp, Homo sapiens
aatacttaaaaatagtct

SEQ ID NO: 648440 - DNA, 23 bp, Homo sapiens
aatactttctatgtgacatttct

SEQ ID NO: 648441 - DNA, 17 bp, Homo sapiens
aatagaataattctttt

SEQ ID NO: 648442 - DNA, 16 bp, Homo sapiens
aatagacagcatgaga

SEQ ID NO: 648443 - DNA, 15 bp, Homo sapiens
aatagctttaatgat

SEQ ID NO: 648444 - DNA, 19 bp, Homo sapiens
aataggaatcattcagaaa

SEQ ID NO: 648445 - DNA, 23 bp, Homo sapiens
aataggaatcattcagaaatgtt

SEQ ID NO: 648446 - DNA, 16 bp, Homo sapiens
aataggagtatttttg

SEQ ID NO: 648447 - DNA, 11 bp, Homo sapiens
aataggagtct

SEQ ID NO: 648448 - DNA, 14 bp, Homo sapiens
aataggcctattta

SEQ ID NO: 648449 - DNA, 23 bp, Homo sapiens
aattaagcattttgaaacaaagt

SEQ ID NO: 648450 - DNA, 22 bp, Homo sapiens
aattaatagtttgtctatttta

SEQ ID NO: 648451 - DNA, 23 bp, Homo sapiens
aattaatatggcttcaccaagaa

SEQ ID NO: 648452 - DNA, 20 bp, Homo sapiens
aattaatgacttactttaat

SEQ ID NO: 648453 - DNA, 13 bp, Homo sapiens
aattaattttact

SEQ ID NO: 648454 - DNA, 16 bp, Homo sapiens
aattacctttaatttt

SEQ ID NO: 648455 - DNA, 15 bp, Homo sapiens
aattactaattttac

SEQ ID NO: 648456 - DNA, 13 bp, Homo sapiens
aattactttaaca

SEQ ID NO: 648457 - DNA, 20 bp, Homo sapiens
aattagaaaaaaattactaa

SEQ ID NO: 648458 - DNA, 19 bp, Homo sapiens
aattagtggtcataaaata

SEQ ID NO: 648459 - DNA, 20 bp, Homo sapiens
aattagtgtgacagtttcca

SEQ ID NO: 648460 - DNA, 23 bp, Homo sapiens
aattagtgtgacagtttccaaat

SEQ ID NO: 648461 - DNA, 21 bp, Homo sapiens
aattatcctgaactcttctgc

SEQ ID NO: 648462 - DNA, 17 bp, Homo sapiens
aattatgagattggttt

SEQ ID NO: 648463 - DNA, 15 bp, Homo sapiens
aattatggcatttct

SEQ ID NO: 648464 - DNA, 19 bp, Homo sapiens
aattattaggagtaattct

SEQ ID NO: 648465 - DNA, 18 bp, Homo sapiens
aattattattttaaaata

SEQ ID NO: 648466 - DNA, 17 bp, Homo sapiens
aattattggcaaagttt

SEQ ID NO: 648467 - DNA, 12 bp, Homo sapiens
aattatttgcta

SEQ ID NO: 648468 - DNA, 14 bp, Homo sapiens
aattcagagtcctt

SEQ ID NO: 648469 - DNA, 15 bp, Homo sapiens
aattcatctgtgaat

SEQ ID NO: 648470 - DNA, 22 bp, Homo sapiens
aattcctacctcttcacctgac

SEQ ID NO: 648471 - DNA, 13 bp, Homo sapiens
aattctagcatgc

SEQ ID NO: 648472 - DNA, 15 bp, Homo sapiens
aattctatgcctgtc

SEQ ID NO: 648473 - DNA, 15 bp, Homo sapiens
aattctcccctccct

SEQ ID NO: 648474 - DNA, 16 bp, Homo sapiens
aattctcccctccctc

SEQ ID NO: 648475 - DNA, 20 bp, Homo sapiens
aattctcctgcctcagcctc

SEQ ID NO: 648476 - DNA, 15 bp, Homo sapiens
aattctgattgattt

SEQ ID NO: 648477 - DNA, 23 bp, Homo sapiens
aattcttaaaaggcccatagcag

SEQ ID NO: 648478 - DNA, 18 bp, Homo sapiens
aattcttttctgtttctg

SEQ ID NO: 648479 - DNA, 13 bp, Homo sapiens
aattgaaaaaaat

SEQ ID NO: 648480 - DNA, 15 bp, Homo sapiens
aattgaaacacagag

SEQ ID NO: 648481 - DNA, 21 bp, Homo sapiens
aattgaagtgtataatataaa

SEQ ID NO: 648482 - DNA, 20 bp, Homo sapiens
aattgactgaaattacttta

SEQ ID NO: 648483 - DNA, 21 bp, Homo sapiens
aattgactgaaattactttaa

SEQ ID NO: 648484 - DNA, 22 bp, Homo sapiens
aattgactgaaattactttaac

SEQ ID NO: 648485 - DNA, 16 bp, Homo sapiens
aattgcatactttgta

SEQ ID NO: 648486 - DNA, 13 bp, Homo sapiens
aattgccccatcc

SEQ ID NO: 648487 - DNA, 13 bp, Homo sapiens
aattgctatgtta

SEQ ID NO: 648488 - DNA, 13 bp, Homo sapiens
aattggaaagact

SEQ ID NO: 648489 - DNA, 16 bp, Homo sapiens
aattggaaggagaggg

SEQ ID NO: 648490 - DNA, 12 bp, Homo sapiens
aattggaatcaa

SEQ ID NO: 648491 - DNA, 17 bp, Homo sapiens
aattggagaagatttat

SEQ ID NO: 648492 - DNA, 12 bp, Homo sapiens
aattggtaatat

SEQ ID NO: 648493 - DNA, 19 bp, Homo sapiens
aattggtacttttaaaaac

SEQ ID NO: 648494 - DNA, 23 bp, Homo sapiens
aattggtacttttaaaaacataa

SEQ ID NO: 648495 - DNA, 15 bp, Homo sapiens
aattgtaagtgaaat

SEQ ID NO: 648496 - DNA, 18 bp, Homo sapiens
aattgtaagtgaaattaa

SEQ ID NO: 648497 - DNA, 12 bp, Homo sapiens
aattgtacaaaa

SEQ ID NO: 648498 - DNA, 20 bp, Homo sapiens
aattgtacaaaattaagcaa

SEQ ID NO: 648499 - DNA, 17 bp, Homo sapiens
aattgtatcaatttgtt

SEQ ID NO: 648500 - DNA, 20 bp, Homo sapiens
aattgtatcttattataaaa

SEQ ID NO: 648501 - DNA, 19 bp, Homo sapiens
aattgtctaaaatgtcagt

SEQ ID NO: 648502 - DNA, 13 bp, Homo sapiens
aattgtctattta

SEQ ID NO: 648503 - DNA, 17 bp, Homo sapiens
aattgtctatttatctt

SEQ ID NO: 648504 - DNA, 18 bp, Homo sapiens
aattgtctatttatcttt

SEQ ID NO: 648505 - DNA, 21 bp, Homo sapiens
aattgtctatttatcttttat

SEQ ID NO: 648506 - DNA, 21 bp, Homo sapiens
aattgtgcagtactttgtgca

SEQ ID NO: 648507 - DNA, 22 bp, Homo sapiens
aattgtgtatttaaaaaaaaga

SEQ ID NO: 648508 - DNA, 22 bp, Homo sapiens
aattgttgtatatcactaaaag

SEQ ID NO: 648509 - DNA, 14 bp, Homo sapiens
aatttaaaatgtgt

SEQ ID NO: 648510 - DNA, 16 bp, Homo sapiens
aatttaaatgaaagaa

SEQ ID NO: 648511 - DNA, 19 bp, Homo sapiens
aatttaaatgaaagaaaat

SEQ ID NO: 648512 - DNA, 18 bp, Homo sapiens
aatttaatccttctttgt

SEQ ID NO: 648513 - DNA, 21 bp, Homo sapiens
aatttaatccttctttgtaat

SEQ ID NO: 648514 - DNA, 23 bp, Homo sapiens
aatttacaagatattattaattt

SEQ ID NO: 648515 - DNA, 16 bp, Homo sapiens
aatttaccatcatctc

SEQ ID NO: 648516 - DNA, 13 bp, Homo sapiens
aatttacttgttt

SEQ ID NO: 648517 - DNA, 12 bp, Homo sapiens
aatttactttaa

SEQ ID NO: 648518 - DNA, 15 bp, Homo sapiens
aatttagaaactgaa

SEQ ID NO: 648519 - DNA, 15 bp, Homo sapiens
aatttataaagtacc

SEQ ID NO: 648520 - DNA, 17 bp, Homo sapiens
aatttatcagtacctaa

SEQ ID NO: 648521 - DNA, 11 bp, Homo sapiens
aatttcaaaat

SEQ ID NO: 648522 - DNA, 22 bp, Homo sapiens
aatttcaaaatacatttgtaag

SEQ ID NO: 648523 - DNA, 21 bp, Homo sapiens
aatttcagtgggaaatatgcc

SEQ ID NO: 648524 - DNA, 18 bp, Homo sapiens
aatttcatttaaatatct

SEQ ID NO: 648525 - DNA, 21 bp, Homo sapiens
aatttgaaaaatgcataataa

SEQ ID NO: 648526 - DNA, 21 bp, Homo sapiens
aatttgaacaggtcaaagatg

SEQ ID NO: 648527 - DNA, 14 bp, Homo sapiens
aatttgaagtaact

SEQ ID NO: 648528 - DNA, 23 bp, Homo sapiens
aatttgaagtaacttatttgact

SEQ ID NO: 648529 - DNA, 21 bp, Homo sapiens
aatttgatgatgttaaatgta

SEQ ID NO: 648530 - DNA, 20 bp, Homo sapiens
aatttgatgcccaatatatt

SEQ ID NO: 648531 - DNA, 16 bp, Homo sapiens
aatttgctttaattaa

SEQ ID NO: 648532 - DNA, 19 bp, Homo sapiens
aatttgtaaaacttctgct

SEQ ID NO: 648533 - DNA, 13 bp, Homo sapiens
aattttaactgta

SEQ ID NO: 648534 - DNA, 23 bp, Homo sapiens
aattttactccataaacagactg

SEQ ID NO: 648535 - DNA, 20 bp, Homo sapiens
aattttattttgtgctcatt

SEQ ID NO: 648536 - DNA, 16 bp, Homo sapiens
aattttgtatgttaaa

SEQ ID NO: 648537 - DNA, 18 bp, Homo sapiens
aattttgtgtaagaaata

SEQ ID NO: 648538 - DNA, 22 bp, Homo sapiens
aattttgtgtaagaaatacaga

SEQ ID NO: 648539 - DNA, 14 bp, Homo sapiens
aatttttaagagaa

SEQ ID NO: 648540 - DNA, 13 bp, Homo sapiens
aatttttattgtt

SEQ ID NO: 648541 - DNA, 17 bp, Homo sapiens
aatttttgtctcagaag

SEQ ID NO: 648542 - DNA, 21 bp, Homo sapiens
aattttttaagtgaaaatata

SEQ ID NO: 648543 - DNA, 13 bp, Homo sapiens
aattttttgaata

SEQ ID NO: 648544 - DNA, 17 bp, Homo sapiens
aattttttgaatatgcc

SEQ ID NO: 648545 - DNA, 20 bp, Homo sapiens
aatttttttttcatagagat

SEQ ID NO: 648546 - DNA, 22 bp, Homo sapiens
acaaaaaaaattttagctcttc

SEQ ID NO: 648547 - DNA, 16 bp, Homo sapiens
acaaaagaataagaca

SEQ ID NO: 648548 - DNA, 21 bp, Homo sapiens
acaaaagaataagacaagaga

SEQ ID NO: 648549 - DNA, 12 bp, Homo sapiens
acaaaagattta

SEQ ID NO: 648550 - DNA, 22 bp, Homo sapiens
acaaaattttattttgtgctca

SEQ ID NO: 648551 - DNA, 16 bp, Homo sapiens
acaaagtactctttaa

SEQ ID NO: 648552 - DNA, 19 bp, Homo sapiens
acaaagttgattaagaaag

SEQ ID NO: 648553 - DNA, 19 bp, Homo sapiens
acaaatattcactggcccc

SEQ ID NO: 648554 - DNA, 22 bp, Homo sapiens
acaaattcaagagctagaaaaa

SEQ ID NO: 648555 - DNA, 19 bp, Homo sapiens
acaaattttcaagtttaca

SEQ ID NO: 648556 - DNA, 17 bp, Homo sapiens
acaaattttcagaaggt

SEQ ID NO: 648557 - DNA, 14 bp, Homo sapiens
acaacaaaaaatac

SEQ ID NO: 648558 - DNA, 17 bp, Homo sapiens
acaacagccctgcctga

SEQ ID NO: 648559 - DNA, 16 bp, Homo sapiens
acaaccccctccaccc

SEQ ID NO: 648560 - DNA, 18 bp, Homo sapiens
acaaccccctccaccccc

SEQ ID NO: 648561 - DNA, 17 bp, Homo sapiens
acaacccttctctgttg

SEQ ID NO: 648562 - DNA, 23 bp, Homo sapiens
acaacttttgagagtatagcatg

SEQ ID NO: 648563 - DNA, 20 bp, Homo sapiens
acaagacagaggggagcagt

SEQ ID NO: 648564 - DNA, 16 bp, Homo sapiens
acaagagatctacaca

SEQ ID NO: 648565 - DNA, 14 bp, Homo sapiens
acaagataccaggc

SEQ ID NO: 648566 - DNA, 15 bp, Homo sapiens
acaagatgtgggcct

SEQ ID NO: 648567 - DNA, 14 bp, Homo sapiens
acaaggaataaatg

SEQ ID NO: 648568 - DNA, 23 bp, Homo sapiens
acaaggaataaatgagagggaat

SEQ ID NO: 648569 - DNA, 21 bp, Homo sapiens
acaaggtggggattgcccctg

SEQ ID NO: 648570 - DNA, 14 bp, Homo sapiens
acaagtaatgtaaa

SEQ ID NO: 648571 - DNA, 18 bp, Homo sapiens
acaagtcatttttgtatt

SEQ ID NO: 648572 - DNA, 21 bp, Homo sapiens
acaataagcgttaagggcaga

SEQ ID NO: 648573 - DNA, 12 bp, Homo sapiens
acaataatgcaa

SEQ ID NO: 648574 - DNA, 18 bp, Homo sapiens
acaataatgcaattagaa

SEQ ID NO: 648575 - DNA, 12 bp, Homo sapiens
acaatacagtat

SEQ ID NO: 648576 - DNA, 14 bp, Homo sapiens
acaatatagttttt

SEQ ID NO: 648577 - DNA, 16 bp, Homo sapiens
acaatatagttttttc

SEQ ID NO: 648578 - DNA, 18 bp, Homo sapiens
acaatattgattgggaaa

SEQ ID NO: 648579 - DNA, 21 bp, Homo sapiens
acaatcaaatctcctgctgat

SEQ ID NO: 648580 - DNA, 15 bp, Homo sapiens
acaatccgagcagtg

SEQ ID NO: 648581 - DNA, 17 bp, Homo sapiens
acaatgaagaagtttct

SEQ ID NO: 648582 - DNA, 17 bp, Homo sapiens
acaattattggcaaagt

SEQ ID NO: 648583 - DNA, 12 bp, Homo sapiens
acaattttaaga

SEQ ID NO: 648584 - DNA, 21 bp, Homo sapiens
acacaaattttcaagtttaca

SEQ ID NO: 648585 - DNA, 23 bp, Homo sapiens
acacaaattttcaagtttacact

SEQ ID NO: 648586 - DNA, 13 bp, Homo sapiens
acacaccctgagg

SEQ ID NO: 648587 - DNA, 12 bp, Homo sapiens
acacactgtgcc

SEQ ID NO: 648588 - DNA, 15 bp, Homo sapiens
acacacttacagagc

SEQ ID NO: 648589 - DNA, 16 bp, Homo sapiens
acacatacatgtcaca

SEQ ID NO: 648590 - DNA, 22 bp, Homo sapiens
acacatctggctgcacaggctg

SEQ ID NO: 648591 - DNA, 23 bp, Homo sapiens
acacattagattttattttacta

SEQ ID NO: 648592 - DNA, 14 bp, Homo sapiens
acacatttaattca

SEQ ID NO: 648593 - DNA, 19 bp, Homo sapiens
acacatttgctactgttgt

SEQ ID NO: 648594 - DNA, 20 bp, Homo sapiens
acacatttgctactgttgta

SEQ ID NO: 648595 - DNA, 13 bp, Homo sapiens
acacatttttttg

SEQ ID NO: 648596 - DNA, 18 bp, Homo sapiens
acaccgtacatctgcaat

SEQ ID NO: 648597 - DNA, 22 bp, Homo sapiens
acacctttattcagaactttag

SEQ ID NO: 648598 - DNA, 15 bp, Homo sapiens
acaccttttaactca

SEQ ID NO: 648599 - DNA, 22 bp, Homo sapiens
acaccttttccaggagttctga

SEQ ID NO: 648600 - DNA, 16 bp, Homo sapiens
acacgtgagaatccct

SEQ ID NO: 648601 - DNA, 21 bp, Homo sapiens
acacgtgagaatccctggcaa

SEQ ID NO: 648602 - DNA, 20 bp, Homo sapiens
acactccattattcctctca

SEQ ID NO: 648603 - DNA, 14 bp, Homo sapiens
acactgtattttaa

SEQ ID NO: 648604 - DNA, 21 bp, Homo sapiens
acactgtcatgcttcatcatt

SEQ ID NO: 648605 - DNA, 12 bp, Homo sapiens
acactgtggcca

SEQ ID NO: 648606 - DNA, 20 bp, Homo sapiens
acacttcttacgcaatgctt

SEQ ID NO: 648607 - DNA, 23 bp, Homo sapiens
acagaacaggaggtgtgaatgca

SEQ ID NO: 648608 - DNA, 15 bp, Homo sapiens
acagaactggaggca

SEQ ID NO: 648609 - DNA, 16 bp, Homo sapiens
acagaatgactgacaa

SEQ ID NO: 648610 - DNA, 14 bp, Homo sapiens
acagactatttgct

SEQ ID NO: 648611 - DNA, 16 bp, Homo sapiens
acagactatttgctaa

SEQ ID NO: 648612 - DNA, 14 bp, Homo sapiens
acagactccatctc

SEQ ID NO: 648613 - DNA, 18 bp, Homo sapiens
acagactccatctcttct

SEQ ID NO: 648614 - DNA, 18 bp, Homo sapiens
acagaggggagcagtggc

SEQ ID NO: 648615 - DNA, 22 bp, Homo sapiens
acagaggtattaaaactaaatt

SEQ ID NO: 648616 - DNA, 13 bp, Homo sapiens
acagataagcaag

SEQ ID NO: 648617 - DNA, 15 bp, Homo sapiens
acagataagcaagag

SEQ ID NO: 648618 - DNA, 19 bp, Homo sapiens
acagataagcaagagagat

SEQ ID NO: 648619 - DNA, 19 bp, Homo sapiens
acagatgaccataattttt

SEQ ID NO: 648620 - DNA, 19 bp, Homo sapiens
acagatggaaaaactgagg

SEQ ID NO: 648621 - DNA, 15 bp, Homo sapiens
acagattctttcagt

SEQ ID NO: 648622 - DNA, 16 bp, Homo sapiens
acagatttcatacctc

SEQ ID NO: 648623 - DNA, 14 bp, Homo sapiens
acagccagggggat

SEQ ID NO: 648624 - DNA, 16 bp, Homo sapiens
acagcccaaaatttga

SEQ ID NO: 648625 - DNA, 15 bp, Homo sapiens
acagccctgcctgag

SEQ ID NO: 648626 - DNA, 16 bp, Homo sapiens
acagccctgcctgaga

SEQ ID NO: 648627 - DNA, 19 bp, Homo sapiens
acagcgaagtagcttgctc

SEQ ID NO: 648628 - DNA, 18 bp, Homo sapiens
acagctcttccagggcag

SEQ ID NO: 648629 - DNA, 19 bp, Homo sapiens
acagctcttccagggcagc

SEQ ID NO: 648630 - DNA, 19 bp, Homo sapiens
acagctgaagtcaaaatat

SEQ ID NO: 648631 - DNA, 22 bp, Homo sapiens
acagctgactgaatgcagaacg

SEQ ID NO: 648632 - DNA, 12 bp, Homo sapiens
acagctgtttga

SEQ ID NO: 648633 - DNA, 14 bp, Homo sapiens
acagctgtttgaaa

SEQ ID NO: 648634 - DNA, 15 bp, Homo sapiens
acagctgtttgaaat

SEQ ID NO: 648635 - DNA, 23 bp, Homo sapiens
acaggaaatgggaaaaaacttaa

SEQ ID NO: 648636 - DNA, 13 bp, Homo sapiens
acaggaggcaggc

SEQ ID NO: 648637 - DNA, 21 bp, Homo sapiens
acaggaggcaggcatggccct

SEQ ID NO: 648638 - DNA, 21 bp, Homo sapiens
acaggcaccgagaatgttgta

SEQ ID NO: 648639 - DNA, 20 bp, Homo sapiens
acaggctcgtcagccacctg

SEQ ID NO: 648640 - DNA, 21 bp, Homo sapiens
acaggctgaaatatccaccca

SEQ ID NO: 648641 - DNA, 23 bp, Homo sapiens
acaggctgtccttaacccacctc

SEQ ID NO: 648642 - DNA, 19 bp, Homo sapiens
acagggccagtggggcctg

SEQ ID NO: 648643 - DNA, 23 bp, Homo sapiens
acagggccagtggggcctgtgga

SEQ ID NO: 648644 - DNA, 18 bp, Homo sapiens
acagggtaactgtgctga

SEQ ID NO: 648645 - DNA, 18 bp, Homo sapiens
acaggtcaaagatgtgtt

SEQ ID NO: 648646 - DNA, 19 bp, Homo sapiens
acaggtcaaagatgtgttc

SEQ ID NO: 648647 - DNA, 15 bp, Homo sapiens
acaggtgtgtatgta

SEQ ID NO: 648648 - DNA, 15 bp, Homo sapiens
acagtaagatatctc

SEQ ID NO: 648649 - DNA, 17 bp, Homo sapiens
acagtacagcatgtgcc

SEQ ID NO: 648650 - DNA, 19 bp, Homo sapiens
acagtacagcatgtgcctt

SEQ ID NO: 648651 - DNA, 15 bp, Homo sapiens
acagtattatagaca

SEQ ID NO: 648652 - DNA, 23 bp, Homo sapiens
acagtatttctggtgtatatttt

SEQ ID NO: 648653 - DNA, 18 bp, Homo sapiens
acagtccaaactgttctg

SEQ ID NO: 648654 - DNA, 13 bp, Homo sapiens
acagtcttattta

SEQ ID NO: 648655 - DNA, 17 bp, Homo sapiens
acagtgactccctggga

SEQ ID NO: 648656 - DNA, 16 bp, Homo sapiens
acagtgagccaagagt

SEQ ID NO: 648657 - DNA, 18 bp, Homo sapiens
acagtgccaactcctcac

SEQ ID NO: 648658 - DNA, 18 bp, Homo sapiens
acagtggctcacacctgt

SEQ ID NO: 648659 - DNA, 17 bp, Homo sapiens
acagtggggctgcaggc

SEQ ID NO: 648660 - DNA, 19 bp, Homo sapiens
acagtgtgcctggttaata

SEQ ID NO: 648661 - DNA, 19 bp, Homo sapiens
acagttatttcatctttta

SEQ ID NO: 648662 - DNA, 17 bp, Homo sapiens
acagttgaaaacttgta

SEQ ID NO: 648663 - DNA, 13 bp, Homo sapiens
acagttgctgtga

SEQ ID NO: 648664 - DNA, 13 bp, Homo sapiens
acagtttccaaat

SEQ ID NO: 648665 - DNA, 13 bp, Homo sapiens
acagtttgataca

SEQ ID NO: 648666 - DNA, 16 bp, Homo sapiens
acataacggaaagttt

SEQ ID NO: 648667 - DNA, 19 bp, Homo sapiens
acataacggaaagttttta

SEQ ID NO: 648668 - DNA, 13 bp, Homo sapiens
acatacaagaaaa

SEQ ID NO: 648669 - DNA, 16 bp, Homo sapiens
acatacaagaaaatgt

SEQ ID NO: 648670 - DNA, 15 bp, Homo sapiens
acatacatgtcacat

SEQ ID NO: 648671 - DNA, 15 bp, Homo sapiens
acatacgatttaagg

SEQ ID NO: 648672 - DNA, 13 bp, Homo sapiens
acatactgcttga

SEQ ID NO: 648673 - DNA, 22 bp, Homo sapiens
acataggtcataaagcattgga

SEQ ID NO: 648674 - DNA, 15 bp, Homo sapiens
acatatacatatgag

SEQ ID NO: 648675 - DNA, 23 bp, Homo sapiens
acatatgctgatcttttaaaatc

SEQ ID NO: 648676 - DNA, 24 bp, Homo sapiens
acatatgctgatcttttaaaatca

SEQ ID NO: 648677 - DNA, 22 bp, Homo sapiens
acatcaagtccatctgacaaaa

SEQ ID NO: 648678 - DNA, 18 bp, Homo sapiens
acatcaggaaagagagca

SEQ ID NO: 648679 - DNA, 14 bp, Homo sapiens
aatatatttcttct

SEQ ID NO: 648680 - DNA, 20 bp, Homo sapiens
aatatatttcttcttctaag

SEQ ID NO: 648681 - DNA, 16 bp, Homo sapiens
aatatcaaaagaaaat

SEQ ID NO: 648682 - DNA, 17 bp, Homo sapiens
aatatcaaataaaatat

SEQ ID NO: 648683 - DNA, 17 bp, Homo sapiens
aatatcagctttgataa

SEQ ID NO: 648684 - DNA, 23 bp, Homo sapiens
aatatcagctttgataattgtgt

SEQ ID NO: 648685 - DNA, 15 bp, Homo sapiens
aatatcataaagcat

SEQ ID NO: 648686 - DNA, 16 bp, Homo sapiens
aatatcataaagcatt

SEQ ID NO: 648687 - DNA, 16 bp, Homo sapiens
aatatccattctgtag

SEQ ID NO: 648688 - DNA, 15 bp, Homo sapiens
aatatctgttattca

SEQ ID NO: 648689 - DNA, 22 bp, Homo sapiens
aatatgaattcaagaaaggaaa

SEQ ID NO: 648690 - DNA, 19 bp, Homo sapiens
aatatgccttaatttagaa

SEQ ID NO: 648691 - DNA, 21 bp, Homo sapiens
aatatgccttaatttagaaac

SEQ ID NO: 648692 - DNA, 14 bp, Homo sapiens
aatatggtgtattt

SEQ ID NO: 648693 - DNA, 19 bp, Homo sapiens
aatattcatgcttgccatc

SEQ ID NO: 648694 - DNA, 17 bp, Homo sapiens
aatattccaagcttcat

SEQ ID NO: 648695 - DNA, 22 bp, Homo sapiens
aatattccagatctttcagaaa

SEQ ID NO: 648696 - DNA, 16 bp, Homo sapiens
aatattcttttgtttc

SEQ ID NO: 648697 - DNA, 21 bp, Homo sapiens
aatattcttttgtttccatgg

SEQ ID NO: 648698 - DNA, 21 bp, Homo sapiens
aatattgattgggaaaacatt

SEQ ID NO: 648699 - DNA, 16 bp, Homo sapiens
aatattgtttggtaaa

SEQ ID NO: 648700 - DNA, 18 bp, Homo sapiens
aatatttttagactattt

SEQ ID NO: 648701 - DNA, 17 bp, Homo sapiens
aatatttttgtatttct

SEQ ID NO: 648702 - DNA, 18 bp, Homo sapiens
aatcaaatctcctgctga

SEQ ID NO: 648703 - DNA, 17 bp, Homo sapiens
aatcacacgactgtcat

SEQ ID NO: 648704 - DNA, 23 bp, Homo sapiens
aatcactttgtctaactcagaat

SEQ ID NO: 648705 - DNA, 17 bp, Homo sapiens
aatcagaacaaaacttc

SEQ ID NO: 648706 - DNA, 23 bp, Homo sapiens
aatcagagataaagcttaggtca

SEQ ID NO: 648707 - DNA, 15 bp, Homo sapiens
aatcagttagttttt

SEQ ID NO: 648708 - DNA, 13 bp, Homo sapiens
aatcattcagaaa

SEQ ID NO: 648709 - DNA, 16 bp, Homo sapiens
aatcattcagaaatgt

SEQ ID NO: 648710 - DNA, 19 bp, Homo sapiens
aatcattcagaaatgttga

SEQ ID NO: 648711 - DNA, 23 bp, Homo sapiens
aatcattcagaaatgttgagtct

SEQ ID NO: 648712 - DNA, 15 bp, Homo sapiens
aatcccaccttccca

SEQ ID NO: 648713 - DNA, 12 bp, Homo sapiens
aatccctttctg

SEQ ID NO: 648714 - DNA, 9 bp, Homo sapiens
aatcctcct

SEQ ID NO: 648715 - DNA, 13 bp, Homo sapiens
aatccttctttgt

SEQ ID NO: 648716 - DNA, 20 bp, Homo sapiens
aatctacaatctctttttgt

SEQ ID NO: 648717 - DNA, 18 bp, Homo sapiens
aatctacaccaatgaaaa

SEQ ID NO: 648718 - DNA, 20 bp, Homo sapiens
aatctattgacttttcaata

SEQ ID NO: 648719 - DNA, 22 bp, Homo sapiens
aatctcaattgaaagcttttaa

SEQ ID NO: 648720 - DNA, 15 bp, Homo sapiens
aatctccatgtgtac

SEQ ID NO: 648721 - DNA, 14 bp, Homo sapiens
aatctcctgctgat

SEQ ID NO: 648722 - DNA, 17 bp, Homo sapiens
aatctcttcaaattctt

SEQ ID NO: 648723 - DNA, 19 bp, Homo sapiens
aatctcttcatgcttgaca

SEQ ID NO: 648724 - DNA, 24 bp, Homo sapiens
aatctcttcatgcttgacatacct

SEQ ID NO: 648725 - DNA, 18 bp, Homo sapiens
aatctgcctgtatctctc

SEQ ID NO: 648726 - DNA, 16 bp, Homo sapiens
aatctgggagcagggc

SEQ ID NO: 648727 - DNA, 19 bp, Homo sapiens
aatctggtcttgttagaaa

SEQ ID NO: 648728 - DNA, 23 bp, Homo sapiens
aatgaaaaatctcaattgaaagc

SEQ ID NO: 648729 - DNA, 15 bp, Homo sapiens
aatgaaaacatgtac

SEQ ID NO: 648730 - DNA, 17 bp, Homo sapiens
aatgaaaacatgtacta

SEQ ID NO: 648731 - DNA, 23 bp, Homo sapiens
aatgaaaacatgtactacagcta

SEQ ID NO: 648732 - DNA, 15 bp, Homo sapiens
aatgaaacttaagaa

SEQ ID NO: 648733 - DNA, 13 bp, Homo sapiens
aatgaaagaaaat

SEQ ID NO: 648734 - DNA, 17 bp, Homo sapiens
aatgaaccataaattca

SEQ ID NO: 648735 - DNA, 12 bp, Homo sapiens
aatgaagaaagt

SEQ ID NO: 648736 - DNA, 14 bp, Homo sapiens
aatgaagaaagtca

SEQ ID NO: 648737 - DNA, 15 bp, Homo sapiens
aatgaagaacactgt

SEQ ID NO: 648738 - DNA, 12 bp, Homo sapiens
aatgaattgaaa

SEQ ID NO: 648739 - DNA, 13 bp, Homo sapiens
aatgaattgaaaa

SEQ ID NO: 648740 - DNA, 17 bp, Homo sapiens
aatgaattgaaaaacaa

SEQ ID NO: 648741 - DNA, 12 bp, Homo sapiens
aatgacaatatt

SEQ ID NO: 648742 - DNA, 17 bp, Homo sapiens
aatgacaattgtgaaca

SEQ ID NO: 648743 - DNA, 16 bp, Homo sapiens
aatgacagatttctgt

SEQ ID NO: 648744 - DNA, 23 bp, Homo sapiens
aatgacttgtacaaacagtattt

SEQ ID NO: 648745 - DNA, 14 bp, Homo sapiens
aatgagcccagaga

SEQ ID NO: 648746 - DNA, 19 bp, Homo sapiens
aatgaggaaaattcttaaa

SEQ ID NO: 648747 - DNA, 13 bp, Homo sapiens
aatgagtgtgcat

SEQ ID NO: 648748 - DNA, 23 bp, Homo sapiens
aatgataaaataaataattttaa

SEQ ID NO: 648749 - DNA, 14 bp, Homo sapiens
aatgatggcagagg

SEQ ID NO: 648750 - DNA, 15 bp, Homo sapiens
aatgatggcagagga

SEQ ID NO: 648751 - DNA, 13 bp, Homo sapiens
aatgcaaccattt

SEQ ID NO: 648752 - DNA, 13 bp, Homo sapiens
aatgcaataattt

SEQ ID NO: 648753 - DNA, 14 bp, Homo sapiens
aatgcaataatttt

SEQ ID NO: 648754 - DNA, 17 bp, Homo sapiens
aatgcaataattttact

SEQ ID NO: 648755 - DNA, 16 bp, Homo sapiens
aatgcaatttgattga

SEQ ID NO: 648756 - DNA, 14 bp, Homo sapiens
aatgcataaatgca

SEQ ID NO: 648757 - DNA, 20 bp, Homo sapiens
aatgcataaatgcataattt

SEQ ID NO: 648758 - DNA, 17 bp, Homo sapiens
aatgccatctatctagt

SEQ ID NO: 648759 - DNA, 17 bp, Homo sapiens
aatgcctcctgtgggga

SEQ ID NO: 648760 - DNA, 20 bp, Homo sapiens
aatgctgtttctaagaaaat

SEQ ID NO: 648761 - DNA, 22 bp, Homo sapiens
aatgctgtttctaagaaaatgt

SEQ ID NO: 648762 - DNA, 18 bp, Homo sapiens
aatgcttaaaaaataata

SEQ ID NO: 648763 - DNA, 11 bp, Homo sapiens
aatgcttcaga

SEQ ID NO: 648764 - DNA, 13 bp, Homo sapiens
aatgcttcattat

SEQ ID NO: 648765 - DNA, 21 bp, Homo sapiens
aatggacacaaattttcaagt

SEQ ID NO: 648766 - DNA, 14 bp, Homo sapiens
aatggatattatta

SEQ ID NO: 648767 - DNA, 20 bp, Homo sapiens
aatggctatttttgaagcaa

SEQ ID NO: 648768 - DNA, 18 bp, Homo sapiens
aatgggtgtatataattt

SEQ ID NO: 648769 - DNA, 20 bp, Homo sapiens
aatgggtgtatataatttta

SEQ ID NO: 648770 - DNA, 14 bp, Homo sapiens
aatggtaataagca

SEQ ID NO: 648771 - DNA, 19 bp, Homo sapiens
aatggtacatgtcttccat

SEQ ID NO: 648772 - DNA, 22 bp, Homo sapiens
aatgtaaagttatgtatttaaa

SEQ ID NO: 648773 - DNA, 13 bp, Homo sapiens
aatgtaaataaac

SEQ ID NO: 648774 - DNA, 18 bp, Homo sapiens
aatgtatcaaatacattt

SEQ ID NO: 648775 - DNA, 13 bp, Homo sapiens
aatgtattttaca

SEQ ID NO: 648776 - DNA, 14 bp, Homo sapiens
aatgtcattgtcta

SEQ ID NO: 648777 - DNA, 18 bp, Homo sapiens
aatgtcattgtctactcc

SEQ ID NO: 648778 - DNA, 15 bp, Homo sapiens
aatgtctgaaatgga

SEQ ID NO: 648779 - DNA, 23 bp, Homo sapiens
aatgtctgtagctcctcaactca

SEQ ID NO: 648780 - DNA, 14 bp, Homo sapiens
aatgtcttggtctt

SEQ ID NO: 648781 - DNA, 20 bp, Homo sapiens
aatgtgaataatggcactga

SEQ ID NO: 648782 - DNA, 22 bp, Homo sapiens
aatgtgcagaaaatatttaata

SEQ ID NO: 648783 - DNA, 20 bp, Homo sapiens
aggagtaaataattggaaaa

SEQ ID NO: 648784 - DNA, 17 bp, Homo sapiens
aggagtggtgatttgaa

SEQ ID NO: 648785 - DNA, 18 bp, Homo sapiens
aggagtggtgcagacaga

SEQ ID NO: 648786 - DNA, 20 bp, Homo sapiens
aggagttctgaagctgacag

SEQ ID NO: 648787 - DNA, 22 bp, Homo sapiens
aggagttctgaagctgacagca

SEQ ID NO: 648788 - DNA, 13 bp, Homo sapiens
aggataagaaagc

SEQ ID NO: 648789 - DNA, 20 bp, Homo sapiens
aggatagtagttaaataact

SEQ ID NO: 648790 - DNA, 15 bp, Homo sapiens
aggatatactgcagc

SEQ ID NO: 648791 - DNA, 22 bp, Homo sapiens
aggatatccttatcagagctaa

SEQ ID NO: 648792 - DNA, 16 bp, Homo sapiens
aggatcccctccaagc

SEQ ID NO: 648793 - DNA, 21 bp, Homo sapiens
aggatggtgctgagtaaacat

SEQ ID NO: 648794 - DNA, 22 bp, Homo sapiens
aggatgtccctgggccagggtc

SEQ ID NO: 648795 - DNA, 19 bp, Homo sapiens
aggatttttttcctcccca

SEQ ID NO: 648796 - DNA, 23 bp, Homo sapiens
aggcaaattaactgtatgtgtgt

SEQ ID NO: 648797 - DNA, 19 bp, Homo sapiens
aggcaattcagtcctgggc

SEQ ID NO: 648798 - DNA, 15 bp, Homo sapiens
aggcaccgagaatgt

SEQ ID NO: 648799 - DNA, 13 bp, Homo sapiens
aggcacctcttcc

SEQ ID NO: 648800 - DNA, 14 bp, Homo sapiens
aggcacctcttcct

SEQ ID NO: 648801 - DNA, 15 bp, Homo sapiens
aggcagacagcaggc

SEQ ID NO: 648802 - DNA, 19 bp, Homo sapiens
aggcagacagcaggcagcg

SEQ ID NO: 648803 - DNA, 23 bp, Homo sapiens
aggcagacagcaggcagcgccaa

SEQ ID NO: 648804 - DNA, 18 bp, Homo sapiens
aggcagagaacagaactg

SEQ ID NO: 648805 - DNA, 15 bp, Homo sapiens
aggcagattgaaaag

SEQ ID NO: 648806 - DNA, 11 bp, Homo sapiens
aggcagcatgg

SEQ ID NO: 648807 - DNA, 15 bp, Homo sapiens
aggcagcgcagggct

SEQ ID NO: 648808 - DNA, 16 bp, Homo sapiens
aggcagcgcagggctg

SEQ ID NO: 648809 - DNA, 19 bp, Homo sapiens
aggcagcgccaagtgcgtg

SEQ ID NO: 648810 - DNA, 18 bp, Homo sapiens
aggcagctgcctctgctc

SEQ ID NO: 648811 - DNA, 22 bp, Homo sapiens
aggcagctgcctctgctccctc

SEQ ID NO: 648812 - DNA, 14 bp, Homo sapiens
aggcaggcattgag

SEQ ID NO: 648813 - DNA, 23 bp, Homo sapiens
aggcaggcattgaggaagagtct

SEQ ID NO: 648814 - DNA, 14 bp, Homo sapiens
aggcaggcggctcc

SEQ ID NO: 648815 - DNA, 14 bp, Homo sapiens
aggcaggctttctg

SEQ ID NO: 648816 - DNA, 16 bp, Homo sapiens
aggcaggtgggcagac

SEQ ID NO: 648817 - DNA, 13 bp, Homo sapiens
aggcatggccctg

SEQ ID NO: 648818 - DNA, 16 bp, Homo sapiens
aggcattaatgtttct

SEQ ID NO: 648819 - DNA, 20 bp, Homo sapiens
aggcattaatgtttctatct

SEQ ID NO: 648820 - DNA, 22 bp, Homo sapiens
aggccacagtggggctgcaggc

SEQ ID NO: 648821 - DNA, 23 bp, Homo sapiens
aggccctcctctcccatccttga

SEQ ID NO: 648822 - DNA, 21 bp, Homo sapiens
aggccctcctgtgctggggga

SEQ ID NO: 648823 - DNA, 19 bp, Homo sapiens
aggccgcgcgtccagctgc

SEQ ID NO: 648824 - DNA, 20 bp, Homo sapiens
aggccgcgcgtccagctgcc

SEQ ID NO: 648825 - DNA, 21 bp, Homo sapiens
aggcctgacttctgctggcat

SEQ ID NO: 648826 - DNA, 17 bp, Homo sapiens
aggcctgccccctgggc

SEQ ID NO: 648827 - DNA, 20 bp, Homo sapiens
aggcctgcgaccctgggggc

SEQ ID NO: 648828 - DNA, 13 bp, Homo sapiens
aggcctgtcccaa

SEQ ID NO: 648829 - DNA, 18 bp, Homo sapiens
aggcctgtcccaattctg

SEQ ID NO: 648830 - DNA, 17 bp, Homo sapiens
aggcctgtcccttgcct

SEQ ID NO: 648831 - DNA, 13 bp, Homo sapiens
aggctagacagaa

SEQ ID NO: 648832 - DNA, 16 bp, Homo sapiens
aggctatgtataaaat

SEQ ID NO: 648833 - DNA, 18 bp, Homo sapiens
aggctatgtataaaatac

SEQ ID NO: 648834 - DNA, 21 bp, Homo sapiens
aggctatgtataaaatacata

SEQ ID NO: 648835 - DNA, 15 bp, Homo sapiens
aggctcttcacatcc

SEQ ID NO: 648836 - DNA, 13 bp, Homo sapiens
aggctgaaagagg

SEQ ID NO: 648837 - DNA, 16 bp, Homo sapiens
aggctgaaagaggcca

SEQ ID NO: 648838 - DNA, 21 bp, Homo sapiens
aggctgaaatatccacccagc

SEQ ID NO: 648839 - DNA, 17 bp, Homo sapiens
aggctgcccctctcacc

SEQ ID NO: 648840 - DNA, 14 bp, Homo sapiens
aggctgcctcctgc

SEQ ID NO: 648841 - DNA, 17 bp, Homo sapiens
aggctgcctcctgccct

SEQ ID NO: 648842 - DNA, 18 bp, Homo sapiens
aggctgcctcctgccctt

SEQ ID NO: 648843 - DNA, 10 bp, Homo sapiens
aggctgggcc

SEQ ID NO: 648844 - DNA, 22 bp, Homo sapiens
aggctgggccatgtccaaagag

SEQ ID NO: 648845 - DNA, 17 bp, Homo sapiens
aggctggtaagagaagt

SEQ ID NO: 648846 - DNA, 18 bp, Homo sapiens
aggctggtaagagaagtg

SEQ ID NO: 648847 - DNA, 22 bp, Homo sapiens
aggctgtagaaaggggagaatg

SEQ ID NO: 648848 - DNA, 22 bp, Homo sapiens
aggctgtccttaacccacctct

SEQ ID NO: 648849 - DNA, 22 bp, Homo sapiens
aggctgttctttaaatgtctga

SEQ ID NO: 648850 - DNA, 19 bp, Homo sapiens
aggctttctgggtgtgact

SEQ ID NO: 648851 - DNA, 17 bp, Homo sapiens
aggctttttaggaactc

SEQ ID NO: 648852 - DNA, 16 bp, Homo sapiens
agggaaaattgcccca

SEQ ID NO: 648853 - DNA, 15 bp, Homo sapiens
agggaaagttttttt

SEQ ID NO: 648854 - DNA, 23 bp, Homo sapiens
agggaagctggcctgagagggga

SEQ ID NO: 648855 - DNA, 12 bp, Homo sapiens
agggaaggcctg

SEQ ID NO: 648856 - DNA, 13 bp, Homo sapiens
agggaaggcctga

SEQ ID NO: 648857 - DNA, 18 bp, Homo sapiens
agggaatcctcctccagg

SEQ ID NO: 648858 - DNA, 17 bp, Homo sapiens
agggacatagaatctgt

SEQ ID NO: 648859 - DNA, 21 bp, Homo sapiens
agggaccatcaagaacctaca

SEQ ID NO: 648860 - DNA, 19 bp, Homo sapiens
agggactacccatagacat

SEQ ID NO: 648861 - DNA, 22 bp, Homo sapiens
agggactatctttgctgcagag

SEQ ID NO: 648862 - DNA, 20 bp, Homo sapiens
agggagacggtttccaggga

SEQ ID NO: 648863 - DNA, 14 bp, Homo sapiens
agggagctgggccc

SEQ ID NO: 648864 - DNA, 17 bp, Homo sapiens
agggaggggccggccct

SEQ ID NO: 648865 - DNA, 23 bp, Homo sapiens
agggaggggccggccctgtgtgc

SEQ ID NO: 648866 - DNA, 20 bp, Homo sapiens
agggagtgctggctcacagt

SEQ ID NO: 648867 - DNA, 20 bp, Homo sapiens
agggatatggcaggactcct

SEQ ID NO: 648868 - DNA, 22 bp, Homo sapiens
agggatatggcaggactcctgg

SEQ ID NO: 648869 - DNA, 14 bp, Homo sapiens
agggcagcggctcc

SEQ ID NO: 648870 - DNA, 15 bp, Homo sapiens
agggccagtggggcc

SEQ ID NO: 648871 - DNA, 20 bp, Homo sapiens
agggccagtggggcctgtgg

SEQ ID NO: 648872 - DNA, 23 bp, Homo sapiens
agggccagtggggcctgtggaat

SEQ ID NO: 648873 - DNA, 18 bp, Homo sapiens
agggccagttggtgttcc

SEQ ID NO: 648874 - DNA, 20 bp, Homo sapiens
agggcctggggcctgagaga

SEQ ID NO: 648875 - DNA, 15 bp, Homo sapiens
agggccttttctggc

SEQ ID NO: 648876 - DNA, 20 bp, Homo sapiens
agggccttttctggcaccgc

SEQ ID NO: 648877 - DNA, 16 bp, Homo sapiens
agggctggagcctggg

SEQ ID NO: 648878 - DNA, 20 bp, Homo sapiens
agggctggcacgtgacaggc

SEQ ID NO: 648879 - DNA, 15 bp, Homo sapiens
agggcttactatttc

SEQ ID NO: 648880 - DNA, 14 bp, Homo sapiens
aggggaaagtccag

SEQ ID NO: 648881 - DNA, 13 bp, Homo sapiens
aggggaacctgcc

SEQ ID NO: 648882 - DNA, 13 bp, Homo sapiens
aggggaagaatga

SEQ ID NO: 648883 - DNA, 20 bp, Homo sapiens
aggggctgactctccaggga

SEQ ID NO: 648884 - DNA, 22 bp, Homo sapiens
aggggctgactctccagggagc

SEQ ID NO: 648885 - DNA, 13 bp, Homo sapiens
agggggcctcatt

SEQ ID NO: 648886 - DNA, 23 bp, Homo sapiens
aggggtccctagcagcccaccct

SEQ ID NO: 648887 - DNA, 16 bp, Homo sapiens
aggggtctccctggct

SEQ ID NO: 648888 - DNA, 18 bp, Homo sapiens
aggggtctccctggctcc

SEQ ID NO: 648889 - DNA, 19 bp, Homo sapiens
aggggtctccctggctccc

SEQ ID NO: 648890 - DNA, 18 bp, Homo sapiens
aggggttggggtgacagt

SEQ ID NO: 648891 - DNA, 21 bp, Homo sapiens
agggtccaggagagcctgggg

SEQ ID NO: 648892 - DNA, 22 bp, Homo sapiens
agggtcccggtgtatcctggcc

SEQ ID NO: 648893 - DNA, 19 bp, Homo sapiens
agggtctcccctcctgcac

SEQ ID NO: 648894 - DNA, 15 bp, Homo sapiens
agggtctccttcctt

SEQ ID NO: 648895 - DNA, 14 bp, Homo sapiens
agtcctaatttgaa

SEQ ID NO: 648896 - DNA, 14 bp, Homo sapiens
agtcggtcctcttt

SEQ ID NO: 648897 - DNA, 18 bp, Homo sapiens
agtctacccgacataagt

SEQ ID NO: 648898 - DNA, 15 bp, Homo sapiens
agtctagcattctgc

SEQ ID NO: 648899 - DNA, 21 bp, Homo sapiens
agtctcatgccttgagatctg

SEQ ID NO: 648900 - DNA, 17 bp, Homo sapiens
agtctcattgtcacctc

SEQ ID NO: 648901 - DNA, 19 bp, Homo sapiens
agtctcattgtcacctctg

SEQ ID NO: 648902 - DNA, 11 bp, Homo sapiens
agtctcctcaa

SEQ ID NO: 648903 - DNA, 15 bp, Homo sapiens
agtctgataaactga

SEQ ID NO: 648904 - DNA, 19 bp, Homo sapiens
agtctgggtccatcctggt

SEQ ID NO: 648905 - DNA, 17 bp, Homo sapiens
agtcttggtttctctct

SEQ ID NO: 648906 - DNA, 13 bp, Homo sapiens
agtctttaataaa

SEQ ID NO: 648907 - DNA, 14 bp, Homo sapiens
agtctttaataaat

SEQ ID NO: 648908 - DNA, 13 bp, Homo sapiens
agtctttcttgaa

SEQ ID NO: 648909 - DNA, 19 bp, Homo sapiens
agtctttgccctgaatggt

SEQ ID NO: 648910 - DNA, 15 bp, Homo sapiens
agtgaccgagagaac

SEQ ID NO: 648911 - DNA, 14 bp, Homo sapiens
agtgactccctggg

SEQ ID NO: 648912 - DNA, 19 bp, Homo sapiens
agtgacttattttgtctta

SEQ ID NO: 648913 - DNA, 18 bp, Homo sapiens
agtgagcagtcgcctgcc

SEQ ID NO: 648914 - DNA, 23 bp, Homo sapiens
agtgagtgggagagtacctgtgt

SEQ ID NO: 648915 - DNA, 19 bp, Homo sapiens
agtgcaaattgtatcttat

SEQ ID NO: 648916 - DNA, 18 bp, Homo sapiens
agtgcacacctttattca

SEQ ID NO: 648917 - DNA, 22 bp, Homo sapiens
agtgcacacctttattcagaac

SEQ ID NO: 648918 - DNA, 17 bp, Homo sapiens
agtgcagctcatgtttt

SEQ ID NO: 648919 - DNA, 16 bp, Homo sapiens
agtgcatatttatcca

SEQ ID NO: 648920 - DNA, 16 bp, Homo sapiens
agtgcatggtggccag

SEQ ID NO: 648921 - DNA, 20 bp, Homo sapiens
agtgccagaattttaggaac

SEQ ID NO: 648922 - DNA, 15 bp, Homo sapiens
agtgcctcaccttcc

SEQ ID NO: 648923 - DNA, 14 bp, Homo sapiens
agtgcctccacatg

SEQ ID NO: 648924 - DNA, 22 bp, Homo sapiens
agtgcctccacatgctgcctgg

SEQ ID NO: 648925 - DNA, 15 bp, Homo sapiens
agtgccttttggaac

SEQ ID NO: 648926 - DNA, 14 bp, Homo sapiens
agtgcgtgaatgta

SEQ ID NO: 648927 - DNA, 16 bp, Homo sapiens
agtgcgtgccgtgtga

SEQ ID NO: 648928 - DNA, 13 bp, Homo sapiens
agtgctggctcac

SEQ ID NO: 648929 - DNA, 17 bp, Homo sapiens
agtgctggctcacagta

SEQ ID NO: 648930 - DNA, 20 bp, Homo sapiens
agtgctggctcacagtacag

SEQ ID NO: 648931 - DNA, 16 bp, Homo sapiens
agtgcttaaaaatcat

SEQ ID NO: 648932 - DNA, 17 bp, Homo sapiens
agtgcttaaaaatcatt

SEQ ID NO: 648933 - DNA, 18 bp, Homo sapiens
agtggaccttgagaccac

SEQ ID NO: 648934 - DNA, 22 bp, Homo sapiens
agtggcatttctatgcaggcag

SEQ ID NO: 648935 - DNA, 18 bp, Homo sapiens
agtggcgtggcctcccca

SEQ ID NO: 648936 - DNA, 14 bp, Homo sapiens
agtgggaagatttt

SEQ ID NO: 648937 - DNA, 12 bp, Homo sapiens
agtgggccaggg

SEQ ID NO: 648938 - DNA, 15 bp, Homo sapiens
agtgggccagggctg

SEQ ID NO: 648939 - DNA, 22 bp, Homo sapiens
agtgggccagggctgccctgag

SEQ ID NO: 648940 - DNA, 18 bp, Homo sapiens
agtggggctgcaggcagg

SEQ ID NO: 648941 - DNA, 20 bp, Homo sapiens
agtggtgtaaacttgtacat

SEQ ID NO: 648942 - DNA, 20 bp, Homo sapiens
agtggtgtgatctcggctca

SEQ ID NO: 648943 - DNA, 20 bp, Homo sapiens
agtgtacatttctataaata

SEQ ID NO: 648944 - DNA, 17 bp, Homo sapiens
agtgtacctcctctcag

SEQ ID NO: 648945 - DNA, 12 bp, Homo sapiens
agtgtatttatt

SEQ ID NO: 648946 - DNA, 14 bp, Homo sapiens
agtgtcagggtcca

SEQ ID NO: 648947 - DNA, 20 bp, Homo sapiens
agtgtcatataaactcattt

SEQ ID NO: 648948 - DNA, 13 bp, Homo sapiens
agtgtcctttcca

SEQ ID NO: 648949 - DNA, 17 bp, Homo sapiens
agtgtctgtctgaggtg

SEQ ID NO: 648950 - DNA, 16 bp, Homo sapiens
agtgtgacagggccag

SEQ ID NO: 648951 - DNA, 17 bp, Homo sapiens
agtgtgagctcttccct

SEQ ID NO: 648952 - DNA, 19 bp, Homo sapiens
agtgtgagctcttccctta

SEQ ID NO: 648953 - DNA, 18 bp, Homo sapiens
agtgtgccaaatcagttt

SEQ ID NO: 648954 - DNA, 17 bp, Homo sapiens
agtgtgccagtttaaaa

SEQ ID NO: 648955 - DNA, 20 bp, Homo sapiens
agtgtgccagtttaaaaaga

SEQ ID NO: 648956 - DNA, 22 bp, Homo sapiens
agtgtgccagtttaaaaagatg

SEQ ID NO: 648957 - DNA, 22 bp, Homo sapiens
agtgtgctctttttttaaaagg

SEQ ID NO: 648958 - DNA, 19 bp, Homo sapiens
agtgtggcctgtgccagca

SEQ ID NO: 648959 - DNA, 20 bp, Homo sapiens
agtgttaagtttttaatctg

SEQ ID NO: 648960 - DNA, 14 bp, Homo sapiens
agtgtttctagcta

SEQ ID NO: 648961 - DNA, 16 bp, Homo sapiens
agtgtttggacagctg

SEQ ID NO: 648962 - DNA, 15 bp, Homo sapiens
agtgttttggactcc

SEQ ID NO: 648963 - DNA, 21 bp, Homo sapiens
agtgttttggactccatctct

SEQ ID NO: 648964 - DNA, 15 bp, Homo sapiens
agtgtttttgtgaat

SEQ ID NO: 648965 - DNA, 19 bp, Homo sapiens
agttaaactaccacttttt

SEQ ID NO: 648966 - DNA, 12 bp, Homo sapiens
agttaaactgag

SEQ ID NO: 648967 - DNA, 21 bp, Homo sapiens
agttaacgggtgaataataaa

SEQ ID NO: 648968 - DNA, 20 bp, Homo sapiens
agttaataggagtatttttg

SEQ ID NO: 648969 - DNA, 21 bp, Homo sapiens
agttaattggatgttcactgc

SEQ ID NO: 648970 - DNA, 15 bp, Homo sapiens
agttacagtttgata

SEQ ID NO: 648971 - DNA, 18 bp, Homo sapiens
agttacatgctgtatatg

SEQ ID NO: 648972 - DNA, 15 bp, Homo sapiens
agttagatctttgta

SEQ ID NO: 648973 - DNA, 17 bp, Homo sapiens
agttagttccactgaga

SEQ ID NO: 648974 - DNA, 17 bp, Homo sapiens
agttatggtgatgactt

SEQ ID NO: 648975 - DNA, 18 bp, Homo sapiens
agttatgtatttaaagtt

SEQ ID NO: 648976 - DNA, 15 bp, Homo sapiens
agttatgtttgaatg

SEQ ID NO: 648977 - DNA, 24 bp, Homo sapiens
agttattggcatggttgttgcata

SEQ ID NO: 648978 - DNA, 12 bp, Homo sapiens
agttcaaaaaca

SEQ ID NO: 648979 - DNA, 16 bp, Homo sapiens
agttccagccttctct

SEQ ID NO: 648980 - DNA, 17 bp, Homo sapiens
agttcccttgaaacttt

SEQ ID NO: 648981 - DNA, 22 bp, Homo sapiens
agttcccttgaaactttgggaa

SEQ ID NO: 648982 - DNA, 12 bp, Homo sapiens
agttctagcagt

SEQ ID NO: 648983 - DNA, 22 bp, Homo sapiens
agttctttggattctaaataca

SEQ ID NO: 648984 - DNA, 23 bp, Homo sapiens
agttctttttgccagttttccct

SEQ ID NO: 648985 - DNA, 19 bp, Homo sapiens
agttgaaaattcatagtaa

SEQ ID NO: 648986 - DNA, 16 bp, Homo sapiens
agttgactttcctccc

SEQ ID NO: 648987 - DNA, 18 bp, Homo sapiens
agttgtagcagattgttt

SEQ ID NO: 648988 - DNA, 21 bp, Homo sapiens
agttgtcttatgtgaaaaatt

SEQ ID NO: 648989 - DNA, 13 bp, Homo sapiens
agtttaattgtct

SEQ ID NO: 648990 - DNA, 16 bp, Homo sapiens
agtttaccatctgaaa

SEQ ID NO: 648991 - DNA, 21 bp, Homo sapiens
agtttatcttaagcatgtcaa

SEQ ID NO: 648992 - DNA, 17 bp, Homo sapiens
agtttatggcagaaggg

SEQ ID NO: 648993 - DNA, 21 bp, Homo sapiens
agtttcaaacttactattttg

SEQ ID NO: 648994 - DNA, 22 bp, Homo sapiens
agtttctgtcgttaaaaacaga

SEQ ID NO: 648995 - DNA, 15 bp, Homo sapiens
agtttgtctatttta

SEQ ID NO: 648996 - DNA, 16 bp, Homo sapiens
agtttgtctattttaa

SEQ ID NO: 648997 - DNA, 13 bp, Homo sapiens
agttttgttgtac

SEQ ID NO: 648998 - DNA, 22 bp, Homo sapiens
agtttttaaaaacctgtatctg

SEQ ID NO: 648999 - DNA, 17 bp, Homo sapiens
agtttttatatgttgta

SEQ ID NO: 649000 - DNA, 18 bp, Homo sapiens
agtttttatttagcatgg

SEQ ID NO: 649001 - DNA, 12 bp, Homo sapiens
agtttttgtttg

SEQ ID NO: 649002 - DNA, 17 bp, Homo sapiens
agttttttattatgcat

SEQ ID NO: 649003 - DNA, 14 bp, Homo sapiens
ataaaaactgattt

SEQ ID NO: 649004 - DNA, 16 bp, Homo sapiens
ataaaaactgatttgc

SEQ ID NO: 649005 - DNA, 14 bp, Homo sapiens
ataaaaacttttga

SEQ ID NO: 649006 - DNA, 18 bp, Homo sapiens
ataaaacttaaaaacaag

SEQ ID NO: 649007 - DNA, 20 bp, Homo sapiens
ataaaataaataattttaat

SEQ ID NO: 649008 - DNA, 22 bp, Homo sapiens
ataaaatagatataaattttta

SEQ ID NO: 649009 - DNA, 20 bp, Homo sapiens
ataaaatatcataaagcatt

SEQ ID NO: 649010 - DNA, 14 bp, Homo sapiens
ataaaatgtttcat

SEQ ID NO: 649011 - DNA, 18 bp, Homo sapiens
ataaaatgtttcattatg

SEQ ID NO: 649012 - DNA, 16 bp, Homo sapiens
ataaaattcatttcta

SEQ ID NO: 649013 - DNA, 13 bp, Homo sapiens
ataaacagaaatg

SEQ ID NO: 649014 - DNA, 21 bp, Homo sapiens
ataaacagacaaaaacaagta

SEQ ID NO: 649015 - DNA, 20 bp, Homo sapiens
ataaacagactgttaattat

SEQ ID NO: 649016 - DNA, 16 bp, Homo sapiens
ataaactttttttaga

SEQ ID NO: 649017 - DNA, 18 bp, Homo sapiens
ataaagaattaatgactt

SEQ ID NO: 649018 - DNA, 20 bp, Homo sapiens
ataaagccttttaaatcatc

SEQ ID NO: 649019 - DNA, 12 bp, Homo sapiens
ataaagctttat

SEQ ID NO: 649020 - DNA, 13 bp, Homo sapiens
ataaagctttata

SEQ ID NO: 649021 - DNA, 15 bp, Homo sapiens
ataaagctttataaa

SEQ ID NO: 649022 - DNA, 18 bp, Homo sapiens
ataaaggcagctgcctct

SEQ ID NO: 649023 - DNA, 19 bp, Homo sapiens
ataaaggcagctgcctctg

SEQ ID NO: 649024 - DNA, 20 bp, Homo sapiens
ataaaggcagctgcctctgc

SEQ ID NO: 649025 - DNA, 22 bp, Homo sapiens
ataaaggcagctgcctctgctc

SEQ ID NO: 649026 - DNA, 17 bp, Homo sapiens
ataaagtacaaatgaag

SEQ ID NO: 649027 - DNA, 20 bp, Homo sapiens
ataaagtacaaatgaagaaa

SEQ ID NO: 649028 - DNA, 21 bp, Homo sapiens
ataaagtcattattaggaagt

SEQ ID NO: 649029 - DNA, 13 bp, Homo sapiens
ataaagttacagt

SEQ ID NO: 649030 - DNA, 15 bp, Homo sapiens
ataaataaataaata

SEQ ID NO: 649031 - DNA, 15 bp, Homo sapiens
ataaataattttaat

SEQ ID NO: 649032 - DNA, 22 bp, Homo sapiens
ataaatataatttataagcatt

SEQ ID NO: 649033 - DNA, 20 bp, Homo sapiens
ataaatatttatgtagatgt

SEQ ID NO: 649034 - DNA, 13 bp, Homo sapiens
ataaatgggtgta

SEQ ID NO: 649035 - DNA, 22 bp, Homo sapiens
ataaattgtagggctttagctt

SEQ ID NO: 649036 - DNA, 13 bp, Homo sapiens
ataacactgtatt

SEQ ID NO: 649037 - DNA, 16 bp, Homo sapiens
ataacataaatttttt

SEQ ID NO: 649038 - DNA, 19 bp, Homo sapiens
ataaccaagtgtgctcttt

SEQ ID NO: 649039 - DNA, 19 bp, Homo sapiens
ataactcatttgttgtttg

SEQ ID NO: 649040 - DNA, 18 bp, Homo sapiens
ataactcctgtccctttt

SEQ ID NO: 649041 - DNA, 19 bp, Homo sapiens
ataactcctgtcccttttc

SEQ ID NO: 649042 - DNA, 21 bp, Homo sapiens
ataactcctgtcccttttccc

SEQ ID NO: 649043 - DNA, 14 bp, Homo sapiens
ataactgtagctca

SEQ ID NO: 649044 - DNA, 20 bp, Homo sapiens
ataagaaagcctaaaattga

SEQ ID NO: 649045 - DNA, 14 bp, Homo sapiens
ataagacaaaaata

SEQ ID NO: 649046 - DNA, 13 bp, Homo sapiens
ataagcactgtaa

SEQ ID NO: 649047 - DNA, 15 bp, Homo sapiens
ataagcattgccatt

SEQ ID NO: 649048 - DNA, 20 bp, Homo sapiens
ataagcgttaagggcagagt

SEQ ID NO: 649049 - DNA, 16 bp, Homo sapiens
ataagctaaagaggct

SEQ ID NO: 649050 - DNA, 22 bp, Homo sapiens
ataagtagtaaatcagaaagta

SEQ ID NO: 649051 - DNA, 13 bp, Homo sapiens
ataatataaaaaa

SEQ ID NO: 649052 - DNA, 19 bp, Homo sapiens
ataatatcaaataaaatat

SEQ ID NO: 649053 - DNA, 15 bp, Homo sapiens
ataatatttttgtat

SEQ ID NO: 649054 - DNA, 19 bp, Homo sapiens
ataatatttttgtatttct

SEQ ID NO: 649055 - DNA, 21 bp, Homo sapiens
ataatatttttgtatttctct

SEQ ID NO: 649056 - DNA, 22 bp, Homo sapiens
ataatatttttgtatttctcta

SEQ ID NO: 649057 - DNA, 22 bp, Homo sapiens
ataatgataaaataaataattt

SEQ ID NO: 649058 - DNA, 14 bp, Homo sapiens
ataatgctacaatt

SEQ ID NO: 649059 - DNA, 15 bp, Homo sapiens
ataatgctacaattt

SEQ ID NO: 649060 - DNA, 13 bp, Homo sapiens
ataattaaagact

SEQ ID NO: 649061 - DNA, 13 bp, Homo sapiens
ataattcttttct

SEQ ID NO: 649062 - DNA, 15 bp, Homo sapiens
ataattcttttctga

SEQ ID NO: 649063 - DNA, 22 bp, Homo sapiens
ataattgcctacatttatcatg

SEQ ID NO: 649064 - DNA, 16 bp, Homo sapiens
ataatttacaagatat

SEQ ID NO: 649065 - DNA, 20 bp, Homo sapiens
ataatttacaagatattatt

SEQ ID NO: 649066 - DNA, 14 bp, Homo sapiens
ataatttatttcaa

SEQ ID NO: 649067 - DNA, 22 bp, Homo sapiens
ataattttcagctgcaaggatt

SEQ ID NO: 649068 - DNA, 19 bp, Homo sapiens
atacaaattttcagaaggt

SEQ ID NO: 649069 - DNA, 15 bp, Homo sapiens
atacaagaaaatgta

SEQ ID NO: 649070 - DNA, 16 bp, Homo sapiens
atacaagaaaatgtat

SEQ ID NO: 649071 - DNA, 17 bp, Homo sapiens
atacaagattgaaaatc

SEQ ID NO: 649072 - DNA, 14 bp, Homo sapiens
atacacatttgcta

SEQ ID NO: 649073 - DNA, 13 bp, Homo sapiens
atacataatacaa

SEQ ID NO: 649074 - DNA, 15 bp, Homo sapiens
atacatagtgaaaat

SEQ ID NO: 649075 - DNA, 18 bp, Homo sapiens
atacatatagcagctctt

SEQ ID NO: 649076 - DNA, 21 bp, Homo sapiens
atacatatgagaatatacctt

SEQ ID NO: 649077 - DNA, 21 bp, Homo sapiens
atacatgccacatcaaacctt

SEQ ID NO: 649078 - DNA, 18 bp, Homo sapiens
atacatgtgatacatttt

SEQ ID NO: 649079 - DNA, 20 bp, Homo sapiens
atacattccctctaatttga

SEQ ID NO: 649080 - DNA, 14 bp, Homo sapiens
atacattttctaaa

SEQ ID NO: 649081 - DNA, 22 bp, Homo sapiens
atacattttctaaataaaaata

SEQ ID NO: 649082 - DNA, 22 bp, Homo sapiens
ataccaaggtacaactgtattt

SEQ ID NO: 649083 - DNA, 19 bp, Homo sapiens
ataccaagttgatacttga

SEQ ID NO: 649084 - DNA, 21 bp, Homo sapiens
ataccactttgacacgcttca

SEQ ID NO: 649085 - DNA, 11 bp, Homo sapiens
ataccagtgtt

SEQ ID NO: 649086 - DNA, 23 bp, Homo sapiens
ataccattatatgttccccctgt

SEQ ID NO: 649087 - DNA, 22 bp, Homo sapiens
ataccatttagtaagaatacca

SEQ ID NO: 649088 - DNA, 17 bp, Homo sapiens
ataccatttcctcagct

SEQ ID NO: 649089 - DNA, 14 bp, Homo sapiens
atacctcaattttt

SEQ ID NO: 649090 - DNA, 17 bp, Homo sapiens
atactaataaatataat

SEQ ID NO: 649091 - DNA, 13 bp, Homo sapiens
atactatttaaga

SEQ ID NO: 649092 - DNA, 12 bp, Homo sapiens
atactccttccc

SEQ ID NO: 649093 - DNA, 17 bp, Homo sapiens
atactgggtctgcgatg

SEQ ID NO: 649094 - DNA, 14 bp, Homo sapiens
atactgggtttcaa

SEQ ID NO: 649095 - DNA, 16 bp, Homo sapiens
atactgggtttcaaga

SEQ ID NO: 649096 - DNA, 17 bp, Homo sapiens
atactgggtttcaagaa

SEQ ID NO: 649097 - DNA, 15 bp, Homo sapiens
atactgtatttctaa

SEQ ID NO: 649098 - DNA, 16 bp, Homo sapiens
atactgtatttctaag

SEQ ID NO: 649099 - DNA, 19 bp, Homo sapiens
atacttgcaagataatttt

SEQ ID NO: 649100 - DNA, 20 bp, Homo sapiens
atacttgcaagataattttc

SEQ ID NO: 649101 - DNA, 12 bp, Homo sapiens
atacttgtgaaa

SEQ ID NO: 649102 - DNA, 15 bp, Homo sapiens
atactttatttctga

SEQ ID NO: 649103 - DNA, 22 bp, Homo sapiens
atactttgcagcacagctgaga

SEQ ID NO: 649104 - DNA, 13 bp, Homo sapiens
atactttgtattt

SEQ ID NO: 649105 - DNA, 16 bp, Homo sapiens
atagaaaattcttgag

SEQ ID NO: 649106 - DNA, 15 bp, Homo sapiens
atagaactctgggct

SEQ ID NO: 649107 - DNA, 19 bp, Homo sapiens
atagaataattcttttctg

SEQ ID NO: 649108 - DNA, 20 bp, Homo sapiens
atagaataattcttttctga

SEQ ID NO: 649109 - DNA, 20 bp, Homo sapiens
atagacaaaagaataagaca

SEQ ID NO: 649110 - DNA, 14 bp, Homo sapiens
atagacacatacat

SEQ ID NO: 649111 - DNA, 15 bp, Homo sapiens
atagacagcatgaga

SEQ ID NO: 649112 - DNA, 12 bp, Homo sapiens
atagacatgaaa

SEQ ID NO: 649113 - DNA, 15 bp, Homo sapiens
atagataatattgtt

SEQ ID NO: 649114 - DNA, 18 bp, Homo sapiens
atagatataaatttttaa

SEQ ID NO: 649115 - DNA, 23 bp, Homo sapiens
atagcaactaatgtttgaacaaa

SEQ ID NO: 649116 - DNA, 17 bp, Homo sapiens
atagcagccagttcaaa

SEQ ID NO: 649117 - DNA, 17 bp, Homo sapiens
atagcattgataatctt

SEQ ID NO: 649118 - DNA, 18 bp, Homo sapiens
atagcattgataatcttc

SEQ ID NO: 649119 - DNA, 16 bp, Homo sapiens
atatttttgtatttct

SEQ ID NO: 649120 - DNA, 16 bp, Homo sapiens
atatttttttaattta

SEQ ID NO: 649121 - DNA, 13 bp, Homo sapiens
atcaaaagaaaat

SEQ ID NO: 649122 - DNA, 19 bp, Homo sapiens
atcaaaagaaaattgatat

SEQ ID NO: 649123 - DNA, 17 bp, Homo sapiens
atcttggagaccctgca

SEQ ID NO: 649124 - DNA, 22 bp, Homo sapiens
atcttggctgtttcaaaaaaat

SEQ ID NO: 649125 - DNA, 22 bp, Homo sapiens
atcttggtttgtcagtttatct

SEQ ID NO: 649126 - DNA, 16 bp, Homo sapiens
atctttaagaatgctt

SEQ ID NO: 649127 - DNA, 21 bp, Homo sapiens
atctttaagaatgcttaaaaa

SEQ ID NO: 649128 - DNA, 20 bp, Homo sapiens
atctttatactgggtttcaa

SEQ ID NO: 649129 - DNA, 14 bp, Homo sapiens
atctttcagaaata

SEQ ID NO: 649130 - DNA, 17 bp, Homo sapiens
atctttcagaaatataa

SEQ ID NO: 649131 - DNA, 16 bp, Homo sapiens
atctttgttttaacca

SEQ ID NO: 649132 - DNA, 18 bp, Homo sapiens
atctttttaaaaactctt

SEQ ID NO: 649133 - DNA, 13 bp, Homo sapiens
atgaaaacatgta

SEQ ID NO: 649134 - DNA, 21 bp, Homo sapiens
atgaaaaggttgcctgaaaaa

SEQ ID NO: 649135 - DNA, 14 bp, Homo sapiens
atgaaaataccatt

SEQ ID NO: 649136 - DNA, 15 bp, Homo sapiens
atgaaacttaagaat

SEQ ID NO: 649137 - DNA, 20 bp, Homo sapiens
atgaaagagccagactctgt

SEQ ID NO: 649138 - DNA, 18 bp, Homo sapiens
atgaaagtcaaatttact

SEQ ID NO: 649139 - DNA, 19 bp, Homo sapiens
atgaaagtcaaatttactt

SEQ ID NO: 649140 - DNA, 20 bp, Homo sapiens
atgaaagtcaaatttacttt

SEQ ID NO: 649141 - DNA, 15 bp, Homo sapiens
atgaaatcttcccag

SEQ ID NO: 649142 - DNA, 18 bp, Homo sapiens
atgaaatgtgaattttta

SEQ ID NO: 649143 - DNA, 15 bp, Homo sapiens
atgaaccataaattc

SEQ ID NO: 649144 - DNA, 18 bp, Homo sapiens
atgaaccctccttttctc

SEQ ID NO: 649145 - DNA, 17 bp, Homo sapiens
atgaactatatgactgg

SEQ ID NO: 649146 - DNA, 21 bp, Homo sapiens
atgaagaaagtcaaaaaatta

SEQ ID NO: 649147 - DNA, 15 bp, Homo sapiens
atgaagaagtttcta

SEQ ID NO: 649148 - DNA, 18 bp, Homo sapiens
atgaagtgcgtgaatgta

SEQ ID NO: 649149 - DNA, 15 bp, Homo sapiens
atgaatacagcattt

SEQ ID NO: 649150 - DNA, 18 bp, Homo sapiens
atgaatatcatacaaatc

SEQ ID NO: 649151 - DNA, 12 bp, Homo sapiens
atgaatgcagat

SEQ ID NO: 649152 - DNA, 17 bp, Homo sapiens
atgaattcaagaaagga

SEQ ID NO: 649153 - DNA, 14 bp, Homo sapiens
atgaattggaactg

SEQ ID NO: 649154 - DNA, 23 bp, Homo sapiens
atgaattggaactgcaatgaaag

SEQ ID NO: 649155 - DNA, 19 bp, Homo sapiens
atgacaattgtgaacatga

SEQ ID NO: 649156 - DNA, 20 bp, Homo sapiens
atgacaattgtgaacatgat

SEQ ID NO: 649157 - DNA, 16 bp, Homo sapiens
atgacactagaaaact

SEQ ID NO: 649158 - DNA, 21 bp, Homo sapiens
atgacactagaaaacttgact

SEQ ID NO: 649159 - DNA, 23 bp, Homo sapiens
atgaccacccctctcgcctcatt

SEQ ID NO: 649160 - DNA, 20 bp, Homo sapiens
atgacctctgtcctccctct

SEQ ID NO: 649161 - DNA, 16 bp, Homo sapiens
atgacggaagaacata

SEQ ID NO: 649162 - DNA, 20 bp, Homo sapiens
atgacgtgctccgtagctct

SEQ ID NO: 649163 - DNA, 12 bp, Homo sapiens
atgactaaagag

SEQ ID NO: 649164 - DNA, 16 bp, Homo sapiens
atgactaaagagagaa

SEQ ID NO: 649165 - DNA, 17 bp, Homo sapiens
atgactaaagagagaat

SEQ ID NO: 649166 - DNA, 20 bp, Homo sapiens
atgacttagcgtcaagacat

SEQ ID NO: 649167 - DNA, 16 bp, Homo sapiens
atgagactcagtgcag

SEQ ID NO: 649168 - DNA, 14 bp, Homo sapiens
atgagccagacaaa

SEQ ID NO: 649169 - DNA, 11 bp, Homo sapiens
atgagcccaga

SEQ ID NO: 649170 - DNA, 14 bp, Homo sapiens
atgagcccagagaa

SEQ ID NO: 649171 - DNA, 18 bp, Homo sapiens
atgagcccagagaacagc

SEQ ID NO: 649172 - DNA, 19 bp, Homo sapiens
atgaggaaaattcttaaaa

SEQ ID NO: 649173 - DNA, 21 bp, Homo sapiens
atgagtggaaattaagacttt

SEQ ID NO: 649174 - DNA, 12 bp, Homo sapiens
atgagtgtgcat

SEQ ID NO: 649175 - DNA, 12 bp, Homo sapiens
atgataaaataa

SEQ ID NO: 649176 - DNA, 21 bp, Homo sapiens
atgatactatcatactactga

SEQ ID NO: 649177 - DNA, 19 bp, Homo sapiens
atgatagttaaactaccac

SEQ ID NO: 649178 - DNA, 20 bp, Homo sapiens
atgatcagtgttgttgctct

SEQ ID NO: 649179 - DNA, 17 bp, Homo sapiens
atgatctcttctggtgt

SEQ ID NO: 649180 - DNA, 22 bp, Homo sapiens
atgatttagcaagcaactaatt

SEQ ID NO: 649181 - DNA, 20 bp, Homo sapiens
atgatttataaacagacaat

SEQ ID NO: 649182 - DNA, 19 bp, Homo sapiens
atgatttccttcaatgtgc

SEQ ID NO: 649183 - DNA, 20 bp, Homo sapiens
atgatttccttcaatgtgca

SEQ ID NO: 649184 - DNA, 14 bp, Homo sapiens
atgattttcctttt

SEQ ID NO: 649185 - DNA, 22 bp, Homo sapiens
atgcaaaatttagaagaaaagt

SEQ ID NO: 649186 - DNA, 19 bp, Homo sapiens
atgcaaatgagctctgaaa

SEQ ID NO: 649187 - DNA, 23 bp, Homo sapiens
atgcaaatgagctctgaaatctt

SEQ ID NO: 649188 - DNA, 20 bp, Homo sapiens
atgcaactctaactctgaga

SEQ ID NO: 649189 - DNA, 22 bp, Homo sapiens
atgcaagcagaggaccagggcc

SEQ ID NO: 649190 - DNA, 23 bp, Homo sapiens
atgcaagcagaggaccagggcct

SEQ ID NO: 649191 - DNA, 15 bp, Homo sapiens
atgcaataactctgg

SEQ ID NO: 649192 - DNA, 18 bp, Homo sapiens
atgcaatgcttcattatt

SEQ ID NO: 649193 - DNA, 16 bp, Homo sapiens
atgcacttttagaaat

SEQ ID NO: 649194 - DNA, 18 bp, Homo sapiens
atgcacttttagaaatgc

SEQ ID NO: 649195 - DNA, 17 bp, Homo sapiens
atgcagattacactgat

SEQ ID NO: 649196 - DNA, 16 bp, Homo sapiens
atgcagcaaatatatg

SEQ ID NO: 649197 - DNA, 17 bp, Homo sapiens
atgcagcaaatatatga

SEQ ID NO: 649198 - DNA, 22 bp, Homo sapiens
atgcagttagctgaagaattga

SEQ ID NO: 649199 - DNA, 19 bp, Homo sapiens
atgcataaatgcataattt

SEQ ID NO: 649200 - DNA, 17 bp, Homo sapiens
atgcatatcctgagcca

SEQ ID NO: 649201 - DNA, 16 bp, Homo sapiens
atgcatattaaataat

SEQ ID NO: 649202 - DNA, 16 bp, Homo sapiens
atgcatgcaaatgagc

SEQ ID NO: 649203 - DNA, 18 bp, Homo sapiens
atgcattatatcaaatct

SEQ ID NO: 649204 - DNA, 14 bp, Homo sapiens
atgccactcctccc

SEQ ID NO: 649205 - DNA, 12 bp, Homo sapiens
atgccagtctca

SEQ ID NO: 649206 - DNA, 13 bp, Homo sapiens
atgccagtctcat

SEQ ID NO: 649207 - DNA, 21 bp, Homo sapiens
atgccagtctcattgtcacct

SEQ ID NO: 649208 - DNA, 16 bp, Homo sapiens
atgcccaatatattct

SEQ ID NO: 649209 - DNA, 14 bp, Homo sapiens
atgcctcctgtggg

SEQ ID NO: 649210 - DNA, 15 bp, Homo sapiens
atgcctcctgtgggg

SEQ ID NO: 649211 - DNA, 20 bp, Homo sapiens
atgcctgactaatttttgta

SEQ ID NO: 649212 - DNA, 14 bp, Homo sapiens
atgccttaatttag

SEQ ID NO: 649213 - DNA, 20 bp, Homo sapiens
atgccttaatttagaaactg

SEQ ID NO: 649214 - DNA, 22 bp, Homo sapiens
atgcgtgagatgggtgtacaaa

SEQ ID NO: 649215 - DNA, 18 bp, Homo sapiens
atgctactgaactgaaag

SEQ ID NO: 649216 - DNA, 19 bp, Homo sapiens
atgctagaaaaatgttctt

SEQ ID NO: 649217 - DNA, 12 bp, Homo sapiens
atgctatttctg

SEQ ID NO: 649218 - DNA, 13 bp, Homo sapiens
atgctcactttat

SEQ ID NO: 649219 - DNA, 14 bp, Homo sapiens
atgctccccacagc

SEQ ID NO: 649220 - DNA, 23 bp, Homo sapiens
atgctccccacagcgtccctggc

SEQ ID NO: 649221 - DNA, 20 bp, Homo sapiens
atgctgagggtgtttcttcc

SEQ ID NO: 649222 - DNA, 14 bp, Homo sapiens
atgctgatcatcgc

SEQ ID NO: 649223 - DNA, 17 bp, Homo sapiens
atgctgatcttttaaaa

SEQ ID NO: 649224 - DNA, 18 bp, Homo sapiens
atgctgatcttttaaaat

SEQ ID NO: 649225 - DNA, 13 bp, Homo sapiens
atgctgcctggca

SEQ ID NO: 649226 - DNA, 21 bp, Homo sapiens
atgctggtactattgtgacca

SEQ ID NO: 649227 - DNA, 18 bp, Homo sapiens
atgctgtgctccatattt

SEQ ID NO: 649228 - DNA, 18 bp, Homo sapiens
atgcttaaaaaataatac

SEQ ID NO: 649229 - DNA, 19 bp, Homo sapiens
atgcttcatatgaggagga

SEQ ID NO: 649230 - DNA, 14 bp, Homo sapiens
atgcttcattgaaa

SEQ ID NO: 649231 - DNA, 15 bp, Homo sapiens
atgcttcctgacaat

SEQ ID NO: 649232 - DNA, 19 bp, Homo sapiens
atgctttattaatgttttc

SEQ ID NO: 649233 - DNA, 14 bp, Homo sapiens
atggaaaaggaaga

SEQ ID NO: 649234 - DNA, 18 bp, Homo sapiens
atggaaaagtgtccttct

SEQ ID NO: 649235 - DNA, 20 bp, Homo sapiens
atggaagaggaaaaggctgg

SEQ ID NO: 649236 - DNA, 15 bp, Homo sapiens
atggaataaattatg

SEQ ID NO: 649237 - DNA, 17 bp, Homo sapiens
atggaattttttgaata

SEQ ID NO: 649238 - DNA, 15 bp, Homo sapiens
atggacacaaatttt

SEQ ID NO: 649239 - DNA, 20 bp, Homo sapiens
atggacacaaattttcaagt

SEQ ID NO: 649240 - DNA, 20 bp, Homo sapiens
atggatatatttgaaatagt

SEQ ID NO: 649241 - DNA, 19 bp, Homo sapiens
atgttgtaatatttcttca

SEQ ID NO: 649242 - DNA, 16 bp, Homo sapiens
atgtttaaaagaaata

SEQ ID NO: 649243 - DNA, 18 bp, Homo sapiens
atgtttaataaagcttta

SEQ ID NO: 649244 - DNA, 14 bp, Homo sapiens
atgtttatgagcca

SEQ ID NO: 649245 - DNA, 13 bp, Homo sapiens
atgtttctatctg

SEQ ID NO: 649246 - DNA, 12 bp, Homo sapiens
atgtttgctgat

SEQ ID NO: 649247 - DNA, 22 bp, Homo sapiens
atgttttcaaaaggtattatac

SEQ ID NO: 649248 - DNA, 18 bp, Homo sapiens
atgttttgggaaacactg

SEQ ID NO: 649249 - DNA, 11 bp, Homo sapiens
atgtttttaaa

SEQ ID NO: 649250 - DNA, 23 bp, Homo sapiens
atgtttttaaaaagagtaatttc

SEQ ID NO: 649251 - DNA, 15 bp, Homo sapiens
atgttttttatgttc

SEQ ID NO: 649252 - DNA, 16 bp, Homo sapiens
atgttttttctgtaat

SEQ ID NO: 649253 - DNA, 21 bp, Homo sapiens
atgttttttctgtaatgtaaa

SEQ ID NO: 649254 - DNA, 16 bp, Homo sapiens
attaaaaagaatagaa

SEQ ID NO: 649255 - DNA, 14 bp, Homo sapiens
attaaaacaaatat

SEQ ID NO: 649256 - DNA, 17 bp, Homo sapiens
attaaaactaaatttca

SEQ ID NO: 649257 - DNA, 18 bp, Homo sapiens
attaaaatataatctcta

SEQ ID NO: 649258 - DNA, 14 bp, Homo sapiens
attaaaatttctta

SEQ ID NO: 649259 - DNA, 12 bp, Homo sapiens
attaaacttttt

SEQ ID NO: 649260 - DNA, 14 bp, Homo sapiens
attaaataaataaa

SEQ ID NO: 649261 - DNA, 15 bp, Homo sapiens
attaaatccaataaa

SEQ ID NO: 649262 - DNA, 15 bp, Homo sapiens
attaacttatttaga

SEQ ID NO: 649263 - DNA, 11 bp, Homo sapiens
attaagaaata

SEQ ID NO: 649264 - DNA, 12 bp, Homo sapiens
attaagaaatag

SEQ ID NO: 649265 - DNA, 15 bp, Homo sapiens
attaagatacaaatt

SEQ ID NO: 649266 - DNA, 11 bp, Homo sapiens
attaagatttc

SEQ ID NO: 649267 - DNA, 21 bp, Homo sapiens
attaagcattttgaaacaaag

SEQ ID NO: 649268 - DNA, 20 bp, Homo sapiens
attaagcttttgtctgtagg

SEQ ID NO: 649269 - DNA, 19 bp, Homo sapiens
attaaggggaagaatgaaa

SEQ ID NO: 649270 - DNA, 18 bp, Homo sapiens
attaatatggcttcacca

SEQ ID NO: 649271 - DNA, 19 bp, Homo sapiens
attaatattcccattttat

SEQ ID NO: 649272 - DNA, 20 bp, Homo sapiens
attaatattcccattttatt

SEQ ID NO: 649273 - DNA, 12 bp, Homo sapiens
attaatgactta

SEQ ID NO: 649274 - DNA, 12 bp, Homo sapiens
attaatgtttct

SEQ ID NO: 649275 - DNA, 16 bp, Homo sapiens
attaatgtttctatct

SEQ ID NO: 649276 - DNA, 18 bp, Homo sapiens
attaatgtttctatctga

SEQ ID NO: 649277 - DNA, 17 bp, Homo sapiens
attaatgttttcaaaag

SEQ ID NO: 649278 - DNA, 14 bp, Homo sapiens
attaattaagtatc

SEQ ID NO: 649279 - DNA, 14 bp, Homo sapiens
attacaacatttat

SEQ ID NO: 649280 - DNA, 21 bp, Homo sapiens
attacagaggtattaaaacta

SEQ ID NO: 649281 - DNA, 18 bp, Homo sapiens
attacatttatttatcca

SEQ ID NO: 649282 - DNA, 23 bp, Homo sapiens
attaccagggactatctttgctg

SEQ ID NO: 649283 - DNA, 20 bp, Homo sapiens
attacctggtgagtaactta

SEQ ID NO: 649284 - DNA, 23 bp, Homo sapiens
attacctggtgagtaacttagaa

SEQ ID NO: 649285 - DNA, 19 bp, Homo sapiens
attacctttaattttaatg

SEQ ID NO: 649286 - DNA, 16 bp, Homo sapiens
attactgaataatatc

SEQ ID NO: 649287 - DNA, 15 bp, Homo sapiens
attactgacatttct

SEQ ID NO: 649288 - DNA, 13 bp, Homo sapiens
attactgggcctt

SEQ ID NO: 649289 - DNA, 21 bp, Homo sapiens
attagaattagtgccagaatt

SEQ ID NO: 649290 - DNA, 22 bp, Homo sapiens
attagattttattttactattg

SEQ ID NO: 649291 - DNA, 17 bp, Homo sapiens
attaggagtaattcttt

SEQ ID NO: 649292 - DNA, 13 bp, Homo sapiens
attagtctgaaac

SEQ ID NO: 649293 - DNA, 15 bp, Homo sapiens
attagtctgaaactg

SEQ ID NO: 649294 - DNA, 19 bp, Homo sapiens
attagtgccagaattttag

SEQ ID NO: 649295 - DNA, 21 bp, Homo sapiens
attagtgccagaattttagga

SEQ ID NO: 649296 - DNA, 22 bp, Homo sapiens
attagtgccagaattttaggaa

SEQ ID NO: 649297 - DNA, 20 bp, Homo sapiens
attagtggtcataaaataga

SEQ ID NO: 649298 - DNA, 20 bp, Homo sapiens
attagtgtgacagtttccaa

SEQ ID NO: 649299 - DNA, 21 bp, Homo sapiens
attagtgtgacagtttccaaa

SEQ ID NO: 649300 - DNA, 22 bp, Homo sapiens
attagtgtgacagtttccaaat

SEQ ID NO: 649301 - DNA, 16 bp, Homo sapiens
attataaagttttcta

SEQ ID NO: 649302 - DNA, 15 bp, Homo sapiens
attataacaactatt

SEQ ID NO: 649303 - DNA, 19 bp, Homo sapiens
attataacaactatttact

SEQ ID NO: 649304 - DNA, 15 bp, Homo sapiens
attatacatgtgata

SEQ ID NO: 649305 - DNA, 21 bp, Homo sapiens
attatacatgtgatacatttt

SEQ ID NO: 649306 - DNA, 22 bp, Homo sapiens
attatacatgtgatacattttt

SEQ ID NO: 649307 - DNA, 19 bp, Homo sapiens
attataggagccttaattt

SEQ ID NO: 649308 - DNA, 14 bp, Homo sapiens
attatatatttaca

SEQ ID NO: 649309 - DNA, 19 bp, Homo sapiens
attatccatcctctgagat

SEQ ID NO: 649310 - DNA, 12 bp, Homo sapiens
attatgcaaaat

SEQ ID NO: 649311 - DNA, 21 bp, Homo sapiens
attatgcacttttagaaatgc

SEQ ID NO: 649312 - DNA, 16 bp, Homo sapiens
attatgcattatatca

SEQ ID NO: 649313 - DNA, 13 bp, Homo sapiens
attatggcatttc

SEQ ID NO: 649314 - DNA, 17 bp, Homo sapiens
attatgtatggatatat

SEQ ID NO: 649315 - DNA, 17 bp, Homo sapiens
attattagataatattt

SEQ ID NO: 649316 - DNA, 18 bp, Homo sapiens
attattaggagtaattct

SEQ ID NO: 649317 - DNA, 13 bp, Homo sapiens
attattatgcaaa

SEQ ID NO: 649318 - DNA, 21 bp, Homo sapiens
attattcaagaatgaaaaata

SEQ ID NO: 649319 - DNA, 15 bp, Homo sapiens
attattgatagtact

SEQ ID NO: 649320 - DNA, 17 bp, Homo sapiens
attattgatagtactct

SEQ ID NO: 649321 - DNA, 14 bp, Homo sapiens
attatttatgacct

SEQ ID NO: 649322 - DNA, 15 bp, Homo sapiens
attatttatgacctg

SEQ ID NO: 649323 - DNA, 19 bp, Homo sapiens
attatttctaatccttttc

SEQ ID NO: 649324 - DNA, 12 bp, Homo sapiens
attcaaaatctt

SEQ ID NO: 649325 - DNA, 18 bp, Homo sapiens
attcaagaatgaaaaata

SEQ ID NO: 649326 - DNA, 21 bp, Homo sapiens
attcaagaatgaaaaatataa

SEQ ID NO: 649327 - DNA, 21 bp, Homo sapiens
attcaattagtggtcataaaa

SEQ ID NO: 649328 - DNA, 24 bp, Homo sapiens
attcaattagtggtcataaaatag

SEQ ID NO: 649329 - DNA, 13 bp, Homo sapiens
attcactggcccc

SEQ ID NO: 649330 - DNA, 14 bp, Homo sapiens
attcagaactttag

SEQ ID NO: 649331 - DNA, 20 bp, Homo sapiens
attcagaactttagtattaa

SEQ ID NO: 649332 - DNA, 13 bp, Homo sapiens
attcagagtcctt

SEQ ID NO: 649333 - DNA, 15 bp, Homo sapiens
attcagtgagggtct

SEQ ID NO: 649334 - DNA, 16 bp, Homo sapiens
attcagtgagggtctt

SEQ ID NO: 649335 - DNA, 15 bp, Homo sapiens
attcatctgtgaatc

SEQ ID NO: 649336 - DNA, 21 bp, Homo sapiens
attcatctgtgaatctgcttt

SEQ ID NO: 649337 - DNA, 18 bp, Homo sapiens
attcatgcttgccatctg

SEQ ID NO: 649338 - DNA, 15 bp, Homo sapiens
attccaactttcagg

SEQ ID NO: 649339 - DNA, 16 bp, Homo sapiens
attccagatctttcag

SEQ ID NO: 649340 - DNA, 13 bp, Homo sapiens
attccctccattt

SEQ ID NO: 649341 - DNA, 18 bp, Homo sapiens
attccgttgtctgtggat

SEQ ID NO: 649342 - DNA, 20 bp, Homo sapiens
attcctaacacagcatgtgt

SEQ ID NO: 649343 - DNA, 15 bp, Homo sapiens
attcctaagccactt

SEQ ID NO: 649344 - DNA, 20 bp, Homo sapiens
attcctactgacaacattat

SEQ ID NO: 649345 - DNA, 18 bp, Homo sapiens
attcctctcaccccactc

SEQ ID NO: 649346 - DNA, 22 bp, Homo sapiens
attcctgagatttcctcctggc

SEQ ID NO: 649347 - DNA, 22 bp, Homo sapiens
attcctggtttaattcagcaga

SEQ ID NO: 649348 - DNA, 16 bp, Homo sapiens
attccttttaaagaag

SEQ ID NO: 649349 - DNA, 21 bp, Homo sapiens
attccttttaaagaagcttta

SEQ ID NO: 649350 - DNA, 14 bp, Homo sapiens
attctaaatacatg

SEQ ID NO: 649351 - DNA, 19 bp, Homo sapiens
attctaacattaaatcaca

SEQ ID NO: 649352 - DNA, 18 bp, Homo sapiens
attctcagggctggagcc

SEQ ID NO: 649353 - DNA, 22 bp, Homo sapiens
attctcagggctggagcctggg

SEQ ID NO: 649354 - DNA, 12 bp, Homo sapiens
attctcccctcc

SEQ ID NO: 649355 - DNA, 13 bp, Homo sapiens
attctcctgcctc

SEQ ID NO: 649356 - DNA, 20 bp, Homo sapiens
attctgaccgttaaaaaatt

SEQ ID NO: 649357 - DNA, 23 bp, Homo sapiens
attctgaccgttaaaaaattctt

SEQ ID NO: 649358 - DNA, 20 bp, Homo sapiens
cctctgggtccttggctccc

SEQ ID NO: 649359 - DNA, 14 bp, Homo sapiens
cctctgggtttcta

SEQ ID NO: 649360 - DNA, 15 bp, Homo sapiens
cctctgtccctctcc

SEQ ID NO: 649361 - DNA, 18 bp, Homo sapiens
cctctgtccctctccttg

SEQ ID NO: 649362 - DNA, 19 bp, Homo sapiens
cctcttctcgtgcctcccc

SEQ ID NO: 649363 - DNA, 17 bp, Homo sapiens
cctcttctttgtgcctt

SEQ ID NO: 649364 - DNA, 18 bp, Homo sapiens
cctcttctttgtgccttt

SEQ ID NO: 649365 - DNA, 23 bp, Homo sapiens
cctcttctttgtgcctttggcct

SEQ ID NO: 649366 - DNA, 13 bp, Homo sapiens
cctcttgcccatc

SEQ ID NO: 649367 - DNA, 14 bp, Homo sapiens
cctcttgtctgatt

SEQ ID NO: 649368 - DNA, 18 bp, Homo sapiens
cctgaagaattaagatac

SEQ ID NO: 649369 - DNA, 21 bp, Homo sapiens
cctgaatgtagcgtgtaagct

SEQ ID NO: 649370 - DNA, 23 bp, Homo sapiens
cctgacctaaattagataaattg

SEQ ID NO: 649371 - DNA, 14 bp, Homo sapiens
cctgacttgcttta

SEQ ID NO: 649372 - DNA, 19 bp, Homo sapiens
cctgagaagctgctccagg

SEQ ID NO: 649373 - DNA, 23 bp, Homo sapiens
cctgagaagctgctccaggcctg

SEQ ID NO: 649374 - DNA, 18 bp, Homo sapiens
cctgagagaattggctca

SEQ ID NO: 649375 - DNA, 15 bp, Homo sapiens
cctgagaggggaagc

SEQ ID NO: 649376 - DNA, 20 bp, Homo sapiens
cctgagggaagagtagctgt

SEQ ID NO: 649377 - DNA, 16 bp, Homo sapiens
cctgatggggaaggga

SEQ ID NO: 649378 - DNA, 19 bp, Homo sapiens
cctgcaaacagaacagggt

SEQ ID NO: 649379 - DNA, 15 bp, Homo sapiens
cctgcaaagctggtt

SEQ ID NO: 649380 - DNA, 12 bp, Homo sapiens
cctgcacacagg

SEQ ID NO: 649381 - DNA, 20 bp, Homo sapiens
cctgcacacagggcagtcct

SEQ ID NO: 649382 - DNA, 17 bp, Homo sapiens
cctgcagcccccactca

SEQ ID NO: 649383 - DNA, 13 bp, Homo sapiens
cctgcaggaccct

SEQ ID NO: 649384 - DNA, 22 bp, Homo sapiens
cctgcaggaccctgtcctgcag

SEQ ID NO: 649385 - DNA, 23 bp, Homo sapiens
cctgcagtcccacactgtgcaga

SEQ ID NO: 649386 - DNA, 14 bp, Homo sapiens
cctgccatttaaaa

SEQ ID NO: 649387 - DNA, 16 bp, Homo sapiens
cctgcccctcagagac

SEQ ID NO: 649388 - DNA, 13 bp, Homo sapiens
cctgcctgcagca

SEQ ID NO: 649389 - DNA, 16 bp, Homo sapiens
cctgcctgcagcaggc

SEQ ID NO: 649390 - DNA, 12 bp, Homo sapiens
cctgcctggccc

SEQ ID NO: 649391 - DNA, 13 bp, Homo sapiens
cctgcctggcccc

SEQ ID NO: 649392 - DNA, 12 bp, Homo sapiens
cctgccttggag

SEQ ID NO: 649393 - DNA, 15 bp, Homo sapiens
cctgcgaccctgggg

SEQ ID NO: 649394 - DNA, 12 bp, Homo sapiens
cctgctcccagg

SEQ ID NO: 649395 - DNA, 14 bp, Homo sapiens
cctgctgcgctgct

SEQ ID NO: 649396 - DNA, 15 bp, Homo sapiens
cctgctgcgctgctt

SEQ ID NO: 649397 - DNA, 18 bp, Homo sapiens
cctgctgcgctgcttggt

SEQ ID NO: 649398 - DNA, 23 bp, Homo sapiens
cctgctggagatcagcatgcctg

SEQ ID NO: 649399 - DNA, 22 bp, Homo sapiens
cctgcttaatcttcaaagcctt

SEQ ID NO: 649400 - DNA, 23 bp, Homo sapiens
cctgcttaatcttcaaagccttc

SEQ ID NO: 649401 - DNA, 18 bp, Homo sapiens
cctgctttgcatctttgt

SEQ ID NO: 649402 - DNA, 15 bp, Homo sapiens
cctggaactcctggc

SEQ ID NO: 649403 - DNA, 22 bp, Homo sapiens
cctggaagagccgagcacctgt

SEQ ID NO: 649404 - DNA, 17 bp, Homo sapiens
cctggagaaggaagctg

SEQ ID NO: 649405 - DNA, 22 bp, Homo sapiens
cctggagaaggaagctgcctgg

SEQ ID NO: 649406 - DNA, 18 bp, Homo sapiens
cctggattggttggcaaa

SEQ ID NO: 649407 - DNA, 19 bp, Homo sapiens
cctggcaaagggagcagaa

SEQ ID NO: 649408 - DNA, 20 bp, Homo sapiens
cctggcagggccacctgcag

SEQ ID NO: 649409 - DNA, 21 bp, Homo sapiens
cctggcagggccacctgcagg

SEQ ID NO: 649410 - DNA, 21 bp, Homo sapiens
cctggcccccaccctctgcca

SEQ ID NO: 649411 - DNA, 15 bp, Homo sapiens
cctggcccctgcctg

SEQ ID NO: 649412 - DNA, 19 bp, Homo sapiens
cctggccttgtcctcagcc

SEQ ID NO: 649413 - DNA, 14 bp, Homo sapiens
cctggctccactct

SEQ ID NO: 649414 - DNA, 14 bp, Homo sapiens
cctggctccctcct

SEQ ID NO: 649415 - DNA, 12 bp, Homo sapiens
cctggctttgcc

SEQ ID NO: 649416 - DNA, 13 bp, Homo sapiens
cctggctttgcct

SEQ ID NO: 649417 - DNA, 19 bp, Homo sapiens
cctgggaacacatctggct

SEQ ID NO: 649418 - DNA, 19 bp, Homo sapiens
cctgggcaacatggtgaaa

SEQ ID NO: 649419 - DNA, 14 bp, Homo sapiens
cctgggccagggtc

SEQ ID NO: 649420 - DNA, 19 bp, Homo sapiens
cctgggctattgctgctgc

SEQ ID NO: 649421 - DNA, 16 bp, Homo sapiens
cctgggctcagcctga

SEQ ID NO: 649422 - DNA, 12 bp, Homo sapiens
cctgggctgggg

SEQ ID NO: 649423 - DNA, 21 bp, Homo sapiens
cctggggagtggttaggcagc

SEQ ID NO: 649424 - DNA, 16 bp, Homo sapiens
cctggggcctgagaga

SEQ ID NO: 649425 - DNA, 17 bp, Homo sapiens
cctggggcctgagagaa

SEQ ID NO: 649426 - DNA, 17 bp, Homo sapiens
cctggggtgcatctcct

SEQ ID NO: 649427 - DNA, 14 bp, Homo sapiens
cctgggtgtccccg

SEQ ID NO: 649428 - DNA, 21 bp, Homo sapiens
cctgggtgtccccgctgctgt

SEQ ID NO: 649429 - DNA, 19 bp, Homo sapiens
cctggtccccactgctgag

SEQ ID NO: 649430 - DNA, 20 bp, Homo sapiens
cctggtccccactgctgagc

SEQ ID NO: 649431 - DNA, 21 bp, Homo sapiens
cctggtgagtaacttagaaaa

SEQ ID NO: 649432 - DNA, 15 bp, Homo sapiens
cctggttcagacaca

SEQ ID NO: 649433 - DNA, 20 bp, Homo sapiens
cctggtttaattcagcagag

SEQ ID NO: 649434 - DNA, 21 bp, Homo sapiens
cctggtttcataacttcctgt

SEQ ID NO: 649435 - DNA, 19 bp, Homo sapiens
cctgtcccttgcctctgcc

SEQ ID NO: 649436 - DNA, 23 bp, Homo sapiens
cctgtcccttgcctctgccctgg

SEQ ID NO: 649437 - DNA, 13 bp, Homo sapiens
cctgtcccttttc

SEQ ID NO: 649438 - DNA, 18 bp, Homo sapiens
cctgtcccttttccctta

SEQ ID NO: 649439 - DNA, 14 bp, Homo sapiens
cctgtcctgcagtc

SEQ ID NO: 649440 - DNA, 22 bp, Homo sapiens
cctgtgaagtttaattgtctca

SEQ ID NO: 649441 - DNA, 20 bp, Homo sapiens
cctgtgcccatggcttctgg

SEQ ID NO: 649442 - DNA, 16 bp, Homo sapiens
cctgtgctagaagctc

SEQ ID NO: 649443 - DNA, 18 bp, Homo sapiens
cctgtgtgtgtgtgtgta

SEQ ID NO: 649444 - DNA, 20 bp, Homo sapiens
cctgtgtgtgtgtgtgtaca

SEQ ID NO: 649445 - DNA, 16 bp, Homo sapiens
cctgttagctttccaa

SEQ ID NO: 649446 - DNA, 15 bp, Homo sapiens
ccttaaacacaggct

SEQ ID NO: 649447 - DNA, 13 bp, Homo sapiens
ccttaaatttaat

SEQ ID NO: 649448 - DNA, 17 bp, Homo sapiens
ccttaacccacctctcc

SEQ ID NO: 649449 - DNA, 20 bp, Homo sapiens
ccttaacccacctctcctgc

SEQ ID NO: 649450 - DNA, 16 bp, Homo sapiens
ccttaagatattgaag

SEQ ID NO: 649451 - DNA, 14 bp, Homo sapiens
ccttaatttagaaa

SEQ ID NO: 649452 - DNA, 17 bp, Homo sapiens
ccttaatttagaaactg

SEQ ID NO: 649453 - DNA, 19 bp, Homo sapiens
ccttaatttagaaactgaa

SEQ ID NO: 649454 - DNA, 22 bp, Homo sapiens
ccttaatttagaaactgaaaaa

SEQ ID NO: 649455 - DNA, 19 bp, Homo sapiens
ccttaatttttttttcata

SEQ ID NO: 649456 - DNA, 16 bp, Homo sapiens
ccttacaatgtgaata

SEQ ID NO: 649457 - DNA, 15 bp, Homo sapiens
ccttagaaaatgtgt

SEQ ID NO: 649458 - DNA, 16 bp, Homo sapiens
ccttagaaaatgtgtc

SEQ ID NO: 649459 - DNA, 19 bp, Homo sapiens
ccttagtgggccagggctg

SEQ ID NO: 649460 - DNA, 17 bp, Homo sapiens
ccttatagtctaagact

SEQ ID NO: 649461 - DNA, 14 bp, Homo sapiens
ccttatccctctct

SEQ ID NO: 649462 - DNA, 19 bp, Homo sapiens
ccttatcctacagtacaat

SEQ ID NO: 649463 - DNA, 15 bp, Homo sapiens
attgaaaaacaattt

SEQ ID NO: 649464 - DNA, 15 bp, Homo sapiens
attgaaacacagagt

SEQ ID NO: 649465 - DNA, 20 bp, Homo sapiens
attgaaagcttcaaagttta

SEQ ID NO: 649466 - DNA, 18 bp, Homo sapiens
attgaagaggtgaaatgg

SEQ ID NO: 649467 - DNA, 17 bp, Homo sapiens
attgaaggcttaattga

SEQ ID NO: 649468 - DNA, 22 bp, Homo sapiens
attgaagtgtataatataaaaa

SEQ ID NO: 649469 - DNA, 17 bp, Homo sapiens
attgaattggaaagact

SEQ ID NO: 649470 - DNA, 19 bp, Homo sapiens
attgacaaccgagaaggtt

SEQ ID NO: 649471 - DNA, 20 bp, Homo sapiens
attgactgatgattttcctt

SEQ ID NO: 649472 - DNA, 15 bp, Homo sapiens
attgacttttataaa

SEQ ID NO: 649473 - DNA, 16 bp, Homo sapiens
attgagaaccaaagca

SEQ ID NO: 649474 - DNA, 14 bp, Homo sapiens
attgagtattgttt

SEQ ID NO: 649475 - DNA, 16 bp, Homo sapiens
attgagtattgtttaa

SEQ ID NO: 649476 - DNA, 14 bp, Homo sapiens
attgataatcttca

SEQ ID NO: 649477 - DNA, 16 bp, Homo sapiens
attgataatcttcagg

SEQ ID NO: 649478 - DNA, 19 bp, Homo sapiens
attgattgggaaaacattt

SEQ ID NO: 649479 - DNA, 23 bp, Homo sapiens
attgattgggaaaacatttgctg

SEQ ID NO: 649480 - DNA, 13 bp, Homo sapiens
attgatttttaag

SEQ ID NO: 649481 - DNA, 16 bp, Homo sapiens
attgatttttaagaaa

SEQ ID NO: 649482 - DNA, 19 bp, Homo sapiens
attgcatcactgtatcatt

SEQ ID NO: 649483 - DNA, 19 bp, Homo sapiens
attgcatctcaaaattatt

SEQ ID NO: 649484 - DNA, 12 bp, Homo sapiens
attgccccctct

SEQ ID NO: 649485 - DNA, 16 bp, Homo sapiens
attgcccctggctttg

SEQ ID NO: 649486 - DNA, 17 bp, Homo sapiens
attgcccctggctttgc

SEQ ID NO: 649487 - DNA, 18 bp, Homo sapiens
attgctgtgctttatgga

SEQ ID NO: 649488 - DNA, 14 bp, Homo sapiens
attggaaagacttc

SEQ ID NO: 649489 - DNA, 14 bp, Homo sapiens
attggaatctgata

SEQ ID NO: 649490 - DNA, 18 bp, Homo sapiens
attggaatctgatatact

SEQ ID NO: 649491 - DNA, 19 bp, Homo sapiens
attggtgtaaggtactttc

SEQ ID NO: 649492 - DNA, 15 bp, Homo sapiens
attggttttcctgtg

SEQ ID NO: 649493 - DNA, 19 bp, Homo sapiens
attgtaaaagcattttgta

SEQ ID NO: 649494 - DNA, 23 bp, Homo sapiens
attgtaagtgaaattaagcattt

SEQ ID NO: 649495 - DNA, 16 bp, Homo sapiens
attgtatcaatttgtt

SEQ ID NO: 649496 - DNA, 17 bp, Homo sapiens
attgtatcaatttgttt

SEQ ID NO: 649497 - DNA, 17 bp, Homo sapiens
attgtctaaaatgtcag

SEQ ID NO: 649498 - DNA, 12 bp, Homo sapiens
attgtctattta

SEQ ID NO: 649499 - DNA, 21 bp, Homo sapiens
attgtctcaacgcctccccct

SEQ ID NO: 649500 - DNA, 12 bp, Homo sapiens
attgtgaacatg

SEQ ID NO: 649501 - DNA, 20 bp, Homo sapiens
attgtgtaccttaagatatt

SEQ ID NO: 649502 - DNA, 23 bp, Homo sapiens
attgttaatacaaggtataataa

SEQ ID NO: 649503 - DNA, 18 bp, Homo sapiens
attgttgtatatcactaa

SEQ ID NO: 649504 - DNA, 20 bp, Homo sapiens
attgttgtatatcactaaaa

SEQ ID NO: 649505 - DNA, 13 bp, Homo sapiens
attgttgttgcca

SEQ ID NO: 649506 - DNA, 15 bp, Homo sapiens
attgttgttttccat

SEQ ID NO: 649507 - DNA, 17 bp, Homo sapiens
attgtttaaaatgtaat

SEQ ID NO: 649508 - DNA, 16 bp, Homo sapiens
attgtttctctgaaag

SEQ ID NO: 649509 - DNA, 23 bp, Homo sapiens
attgttttactcctttttattca

SEQ ID NO: 649510 - DNA, 18 bp, Homo sapiens
atttaaaaaaaagaaact

SEQ ID NO: 649511 - DNA, 20 bp, Homo sapiens
atttaaaaaaaagaaacttt

SEQ ID NO: 649512 - DNA, 22 bp, Homo sapiens
atttaaaaaaaagaaacttttc

SEQ ID NO: 649513 - DNA, 22 bp, Homo sapiens
atttaaaaaataaataaaaact

SEQ ID NO: 649514 - DNA, 22 bp, Homo sapiens
atttaaaaagctcactgctgat

SEQ ID NO: 649515 - DNA, 19 bp, Homo sapiens
atttaaaacattaaaatat

SEQ ID NO: 649516 - DNA, 21 bp, Homo sapiens
atttaaaattgctatgttact

SEQ ID NO: 649517 - DNA, 16 bp, Homo sapiens
atttaaactatcttgt

SEQ ID NO: 649518 - DNA, 19 bp, Homo sapiens
atttaaagaccaataaact

SEQ ID NO: 649519 - DNA, 17 bp, Homo sapiens
atttaaatgaaagaaaa

SEQ ID NO: 649520 - DNA, 20 bp, Homo sapiens
atttaagtttcaaacttact

SEQ ID NO: 649521 - DNA, 20 bp, Homo sapiens
atttaatccagttataagaa

SEQ ID NO: 649522 - DNA, 23 bp, Homo sapiens
atttaatggaagtgtatttattt

SEQ ID NO: 649523 - DNA, 20 bp, Homo sapiens
atttaatttgtaaaacttct

SEQ ID NO: 649524 - DNA, 20 bp, Homo sapiens
atttacaagatattattaat

SEQ ID NO: 649525 - DNA, 18 bp, Homo sapiens
atttacaagatggactta

SEQ ID NO: 649526 - DNA, 23 bp, Homo sapiens
atttacattaggtattacaagta

SEQ ID NO: 649527 - DNA, 16 bp, Homo sapiens
atttaccatcatctct

SEQ ID NO: 649528 - DNA, 18 bp, Homo sapiens
atttaccatcatctctga

SEQ ID NO: 649529 - DNA, 12 bp, Homo sapiens
atttacttgttt

SEQ ID NO: 649530 - DNA, 23 bp, Homo sapiens
atttacttgttttggatggcttg

SEQ ID NO: 649531 - DNA, 22 bp, Homo sapiens
atttactttaaaaagaaattaa

SEQ ID NO: 649532 - DNA, 13 bp, Homo sapiens
atttagaaactga

SEQ ID NO: 649533 - DNA, 18 bp, Homo sapiens
atttagaaactgaaaaat

SEQ ID NO: 649534 - DNA, 22 bp, Homo sapiens
atttagaaactgaaaaatatct

SEQ ID NO: 649535 - DNA, 15 bp, Homo sapiens
atttagaagaaaagt

SEQ ID NO: 649536 - DNA, 21 bp, Homo sapiens
atttagcatggggattgcaga

SEQ ID NO: 649537 - DNA, 16 bp, Homo sapiens
atttagccgggcgcgg

SEQ ID NO: 649538 - DNA, 15 bp, Homo sapiens
atttagtaagaatac

SEQ ID NO: 649539 - DNA, 23 bp, Homo sapiens
atttataaacagacaatatgtga

SEQ ID NO: 649540 - DNA, 17 bp, Homo sapiens
atttataagcattgcca

SEQ ID NO: 649541 - DNA, 20 bp, Homo sapiens
atttataagcattgccattg

SEQ ID NO: 649542 - DNA, 15 bp, Homo sapiens
atttatacaagattg

SEQ ID NO: 649543 - DNA, 15 bp, Homo sapiens
atttatacagttgaa

SEQ ID NO: 649544 - DNA, 20 bp, Homo sapiens
atttatataaaacttaaaaa

SEQ ID NO: 649545 - DNA, 21 bp, Homo sapiens
atttatatcacacaatatagt

SEQ ID NO: 649546 - DNA, 18 bp, Homo sapiens
atttatcatggtcctgaa

SEQ ID NO: 649547 - DNA, 21 bp, Homo sapiens
atttatcatggtcctgaatgt

SEQ ID NO: 649548 - DNA, 22 bp, Homo sapiens
atttatccagaaaactgtgatt

SEQ ID NO: 649549 - DNA, 13 bp, Homo sapiens
atttatgggcccc

SEQ ID NO: 649550 - DNA, 19 bp, Homo sapiens
atttatgggcccctggcac

SEQ ID NO: 649551 - DNA, 18 bp, Homo sapiens
atttatgtagatgtgcat

SEQ ID NO: 649552 - DNA, 22 bp, Homo sapiens
atttatgttccttttaaagaaa

SEQ ID NO: 649553 - DNA, 15 bp, Homo sapiens
atttatttcatttac

SEQ ID NO: 649554 - DNA, 14 bp, Homo sapiens
atttcaaaatacat

SEQ ID NO: 649555 - DNA, 19 bp, Homo sapiens
atttcaaagttttgttgta

SEQ ID NO: 649556 - DNA, 18 bp, Homo sapiens
atttcagtgggaaatatg

SEQ ID NO: 649557 - DNA, 23 bp, Homo sapiens
atttcagtgggaaatatgccact

SEQ ID NO: 649558 - DNA, 23 bp, Homo sapiens
atttcataattgcctacatttat

SEQ ID NO: 649559 - DNA, 14 bp, Homo sapiens
atttcatcattgtt

SEQ ID NO: 649560 - DNA, 15 bp, Homo sapiens
atttcatgaaaatga

SEQ ID NO: 649561 - DNA, 18 bp, Homo sapiens
atttcatgaacgttatta

SEQ ID NO: 649562 - DNA, 22 bp, Homo sapiens
atttcattttttatgtattgtt

SEQ ID NO: 649563 - DNA, 21 bp, Homo sapiens
cccttactggcttacctcctc

SEQ ID NO: 649564 - DNA, 18 bp, Homo sapiens
cccttattcctaatggct

SEQ ID NO: 649565 - DNA, 19 bp, Homo sapiens
cccttcccatttcttccca

SEQ ID NO: 649566 - DNA, 13 bp, Homo sapiens
cccttctctgttg

SEQ ID NO: 649567 - DNA, 18 bp, Homo sapiens
cccttgaaactttgggaa

SEQ ID NO: 649568 - DNA, 20 bp, Homo sapiens
cccttgcaccgtcctcagca

SEQ ID NO: 649569 - DNA, 13 bp, Homo sapiens
cccttgccttcct

SEQ ID NO: 649570 - DNA, 21 bp, Homo sapiens
cccttgctgtatgctgatcat

SEQ ID NO: 649571 - DNA, 19 bp, Homo sapiens
cccttgcttgcctgcaggg

SEQ ID NO: 649572 - DNA, 23 bp, Homo sapiens
cccttgcttgcctgcagggccat

SEQ ID NO: 649573 - DNA, 16 bp, Homo sapiens
cccttttcccccttcc

SEQ ID NO: 649574 - DNA, 17 bp, Homo sapiens
ccgaagagcaaacaaaa

SEQ ID NO: 649575 - DNA, 23 bp, Homo sapiens
ccgaagatggtggccacagactg

SEQ ID NO: 649576 - DNA, 23 bp, Homo sapiens
ccgacacacggggctcgggcctt

SEQ ID NO: 649577 - DNA, 13 bp, Homo sapiens
ccgacatggctcc

SEQ ID NO: 649578 - DNA, 21 bp, Homo sapiens
ccgagaagcacttgagcatga

SEQ ID NO: 649579 - DNA, 21 bp, Homo sapiens
ccgagagcctcgctttttcat

SEQ ID NO: 649580 - DNA, 14 bp, Homo sapiens
ccgagctggaaaac

SEQ ID NO: 649581 - DNA, 14 bp, Homo sapiens
ccgaggggcctttg

SEQ ID NO: 649582 - DNA, 15 bp, Homo sapiens
ccgcaaggcctccag

SEQ ID NO: 649583 - DNA, 14 bp, Homo sapiens
ccgcagaagccctg

SEQ ID NO: 649584 - DNA, 18 bp, Homo sapiens
ccgcagtgtggccaggct

SEQ ID NO: 649585 - DNA, 13 bp, Homo sapiens
ccgcccagcctca

SEQ ID NO: 649586 - DNA, 20 bp, Homo sapiens
ccgcccttccatgtgccttt

SEQ ID NO: 649587 - DNA, 16 bp, Homo sapiens
ccgcctgaaagccaca

SEQ ID NO: 649588 - DNA, 17 bp, Homo sapiens
ccgcgcgtccagctgcc

SEQ ID NO: 649589 - DNA, 18 bp, Homo sapiens
ccgctacagtttttattt

SEQ ID NO: 649590 - DNA, 20 bp, Homo sapiens
ccgctgtataaagcatgtgg

SEQ ID NO: 649591 - DNA, 13 bp, Homo sapiens
ccggccctgtgtg

SEQ ID NO: 649592 - DNA, 17 bp, Homo sapiens
ccggccctgtgtgcagg

SEQ ID NO: 649593 - DNA, 21 bp, Homo sapiens
ccgggcgcggtggcgggcacc

SEQ ID NO: 649594 - DNA, 19 bp, Homo sapiens
ccggtgtatcctggccctg

SEQ ID NO: 649595 - DNA, 17 bp, Homo sapiens
ccgtctggacctgggga

SEQ ID NO: 649596 - DNA, 18 bp, Homo sapiens
ccgtctggacctggggag

SEQ ID NO: 649597 - DNA, 21 bp, Homo sapiens
ccgtgaactctggtgctcctg

SEQ ID NO: 649598 - DNA, 17 bp, Homo sapiens
ccgtgcatgctctgcag

SEQ ID NO: 649599 - DNA, 13 bp, Homo sapiens
ccgtggcacagct

SEQ ID NO: 649600 - DNA, 15 bp, Homo sapiens
ccgtggggcagggag

SEQ ID NO: 649601 - DNA, 20 bp, Homo sapiens
ccgtgtgagtgtgacagggc

SEQ ID NO: 649602 - DNA, 14 bp, Homo sapiens
ccgtttctcctttt

SEQ ID NO: 649603 - DNA, 12 bp, Homo sapiens
cctaaaactggg

SEQ ID NO: 649604 - DNA, 21 bp, Homo sapiens
cctaacaacattgtagcctca

SEQ ID NO: 649605 - DNA, 22 bp, Homo sapiens
cctaacaacattgtagcctcaa

SEQ ID NO: 649606 - DNA, 15 bp, Homo sapiens
cctaaccactaacat

SEQ ID NO: 649607 - DNA, 19 bp, Homo sapiens
cctaatggctatttttgaa

SEQ ID NO: 649608 - DNA, 19 bp, Homo sapiens
cctaatgtttatgagccag

SEQ ID NO: 649609 - DNA, 13 bp, Homo sapiens
cctacagtacaat

SEQ ID NO: 649610 - DNA, 20 bp, Homo sapiens
cctacagtgactccctggga

SEQ ID NO: 649611 - DNA, 22 bp, Homo sapiens
cctacagtgactccctgggagc

SEQ ID NO: 649612 - DNA, 22 bp, Homo sapiens
cctagaagaaccaaatacctca

SEQ ID NO: 649613 - DNA, 17 bp, Homo sapiens
cctagcagcccaccctg

SEQ ID NO: 649614 - DNA, 20 bp, Homo sapiens
cctagcagcccaccctgctg

SEQ ID NO: 649615 - DNA, 17 bp, Homo sapiens
cctagcgatctctcctg

SEQ ID NO: 649616 - DNA, 21 bp, Homo sapiens
cctagcgatctctcctggcct

SEQ ID NO: 649617 - DNA, 22 bp, Homo sapiens
cctagcgatctctcctggccta

SEQ ID NO: 649618 - DNA, 20 bp, Homo sapiens
cctagtagctgggatgacag

SEQ ID NO: 649619 - DNA, 17 bp, Homo sapiens
cctatagtcccactact

SEQ ID NO: 649620 - DNA, 15 bp, Homo sapiens
cctatccgctgccag

SEQ ID NO: 649621 - DNA, 22 bp, Homo sapiens
cctatgtaagaattcagaagac

SEQ ID NO: 649622 - DNA, 22 bp, Homo sapiens
cctatttattaatattttacag

SEQ ID NO: 649623 - DNA, 15 bp, Homo sapiens
cctcaaagaggcctt

SEQ ID NO: 649624 - DNA, 13 bp, Homo sapiens
cctcaattctcca

SEQ ID NO: 649625 - DNA, 21 bp, Homo sapiens
cctcaatttttgtctcagaag

SEQ ID NO: 649626 - DNA, 13 bp, Homo sapiens
cctcacccacctc

SEQ ID NO: 649627 - DNA, 16 bp, Homo sapiens
cctcacccacctctgg

SEQ ID NO: 649628 - DNA, 12 bp, Homo sapiens
cctcaccttcca

SEQ ID NO: 649629 - DNA, 19 bp, Homo sapiens
cctcactgtagcaggttct

SEQ ID NO: 649630 - DNA, 14 bp, Homo sapiens
cctcacttcctttg

SEQ ID NO: 649631 - DNA, 15 bp, Homo sapiens
cctcacttcctttgc

SEQ ID NO: 649632 - DNA, 14 bp, Homo sapiens
cctcagccttggga

SEQ ID NO: 649633 - DNA, 14 bp, Homo sapiens
cctcagctgaatgc

SEQ ID NO: 649634 - DNA, 19 bp, Homo sapiens
cctcagggagcagggaagg

SEQ ID NO: 649635 - DNA, 15 bp, Homo sapiens
cctcagggctcccag

SEQ ID NO: 649636 - DNA, 16 bp, Homo sapiens
cctcagggctcccagg

SEQ ID NO: 649637 - DNA, 16 bp, Homo sapiens
cctcagtccctcttct

SEQ ID NO: 649638 - DNA, 16 bp, Homo sapiens
cctcatctatgaggaa

SEQ ID NO: 649639 - DNA, 23 bp, Homo sapiens
cctcatctccaaggcagggacca

SEQ ID NO: 649640 - DNA, 19 bp, Homo sapiens
cctcatgccaaccctgggc

SEQ ID NO: 649641 - DNA, 20 bp, Homo sapiens
cctcatgccaaccctgggct

SEQ ID NO: 649642 - DNA, 16 bp, Homo sapiens
cctcattactgggcct

SEQ ID NO: 649643 - DNA, 16 bp, Homo sapiens
cctcattactgtgagg

SEQ ID NO: 649644 - DNA, 11 bp, Homo sapiens
cctccaagcct

SEQ ID NO: 649645 - DNA, 18 bp, Homo sapiens
cctccacatgctgcctgg

SEQ ID NO: 649646 - DNA, 19 bp, Homo sapiens
cctccacatgctgcctggc

SEQ ID NO: 649647 - DNA, 20 bp, Homo sapiens
cctccacatgctgcctggca

SEQ ID NO: 649648 - DNA, 21 bp, Homo sapiens
cctccacatgctgcctggcac

SEQ ID NO: 649649 - DNA, 13 bp, Homo sapiens
cctccaggcctgc

SEQ ID NO: 649650 - DNA, 16 bp, Homo sapiens
cctccaggcctgcctc

SEQ ID NO: 649651 - DNA, 17 bp, Homo sapiens
cctccagtaccttgctt

SEQ ID NO: 649652 - DNA, 19 bp, Homo sapiens
cctccagtgtcagggtcca

SEQ ID NO: 649653 - DNA, 18 bp, Homo sapiens
cctcccacacccaaagct

SEQ ID NO: 649654 - DNA, 17 bp, Homo sapiens
cctccccgtctcattcc

SEQ ID NO: 649655 - DNA, 23 bp, Homo sapiens
cctccctctgtccctctccttgc

SEQ ID NO: 649656 - DNA, 13 bp, Homo sapiens
cctccctggcaga

SEQ ID NO: 649657 - DNA, 22 bp, Homo sapiens
cctccgaccacttccaggggaa

SEQ ID NO: 649658 - DNA, 19 bp, Homo sapiens
cctcctattctataaaact

SEQ ID NO: 649659 - DNA, 14 bp, Homo sapiens
cctcctcacccacc

SEQ ID NO: 649660 - DNA, 19 bp, Homo sapiens
cctcctcacccacctctgg

SEQ ID NO: 649661 - DNA, 14 bp, Homo sapiens
cctcctgcacacag

SEQ ID NO: 649662 - DNA, 13 bp, Homo sapiens
cctcctgccctcc

SEQ ID NO: 649663 - DNA, 12 bp, Homo sapiens
cctcctgccctt

SEQ ID NO: 649664 - DNA, 11 bp, Homo sapiens
cctcctgggaa

SEQ ID NO: 649665 - DNA, 13 bp, Homo sapiens
cctccttctcctt

SEQ ID NO: 649666 - DNA, 21 bp, Homo sapiens
cctcgctttttcatccttctt

SEQ ID NO: 649667 - DNA, 14 bp, Homo sapiens
cctcggcacacact

SEQ ID NO: 649668 - DNA, 20 bp, Homo sapiens
cctcgttggaagaggaacag

SEQ ID NO: 649669 - DNA, 20 bp, Homo sapiens
cctctcacctgccgtgcgta

SEQ ID NO: 649670 - DNA, 12 bp, Homo sapiens
cctctcgcctca

SEQ ID NO: 649671 - DNA, 15 bp, Homo sapiens
cctctctggccttgc

SEQ ID NO: 649672 - DNA, 12 bp, Homo sapiens
cctctctgtccc

SEQ ID NO: 649673 - DNA, 13 bp, Homo sapiens
cctctctgtccct

SEQ ID NO: 649674 - DNA, 15 bp, Homo sapiens
cctctcttccccttc

SEQ ID NO: 649675 - DNA, 17 bp, Homo sapiens
cctctcttccccttccc

SEQ ID NO: 649676 - DNA, 20 bp, Homo sapiens
cctctcttccccttccctta

SEQ ID NO: 649677 - DNA, 13 bp, Homo sapiens
cgtctgcctgggc

SEQ ID NO: 649678 - DNA, 21 bp, Homo sapiens
cgtgacaggctcgtcagccac

SEQ ID NO: 649679 - DNA, 13 bp, Homo sapiens
cgtgaggcctggg

SEQ ID NO: 649680 - DNA, 20 bp, Homo sapiens
cgtgatggcaggtgcctgta

SEQ ID NO: 649681 - DNA, 20 bp, Homo sapiens
cgtgcattaaaatttcttat

SEQ ID NO: 649682 - DNA, 22 bp, Homo sapiens
cgtgccgtgtgagtgtgacagg

SEQ ID NO: 649683 - DNA, 22 bp, Homo sapiens
cgtggcctccccatgggcacag

SEQ ID NO: 649684 - DNA, 14 bp, Homo sapiens
cgtggcttttccta

SEQ ID NO: 649685 - DNA, 15 bp, Homo sapiens
cgtggggcagggagc

SEQ ID NO: 649686 - DNA, 13 bp, Homo sapiens
cgtgggtggtctt

SEQ ID NO: 649687 - DNA, 14 bp, Homo sapiens
cgtggttcttaaat

SEQ ID NO: 649688 - DNA, 17 bp, Homo sapiens
cgtgttccagtgtctgt

SEQ ID NO: 649689 - DNA, 14 bp, Homo sapiens
cgttaagggcagag

SEQ ID NO: 649690 - DNA, 18 bp, Homo sapiens
cgttaggaggacaaaagg

SEQ ID NO: 649691 - DNA, 21 bp, Homo sapiens
cgttaggaggacaaaaggaat

SEQ ID NO: 649692 - DNA, 16 bp, Homo sapiens
cgttccatctgggctt

SEQ ID NO: 649693 - DNA, 18 bp, Homo sapiens
cgttgttgtggaagcatg

SEQ ID NO: 649694 - DNA, 19 bp, Homo sapiens
cgtttcaaagctttcctgt

SEQ ID NO: 649695 - DNA, 19 bp, Homo sapiens
ctaaaagcatgaattggaa

SEQ ID NO: 649696 - DNA, 20 bp, Homo sapiens
ctaaaagcatgaattggaac

SEQ ID NO: 649697 - DNA, 17 bp, Homo sapiens
ctaaaataattttgtaa

SEQ ID NO: 649698 - DNA, 15 bp, Homo sapiens
ctaaagtcctggccc

SEQ ID NO: 649699 - DNA, 14 bp, Homo sapiens
ctaaataaaaatat

SEQ ID NO: 649700 - DNA, 21 bp, Homo sapiens
ctaaatgcatatcctgagcca

SEQ ID NO: 649701 - DNA, 15 bp, Homo sapiens
ctaaatttatattca

SEQ ID NO: 649702 - DNA, 18 bp, Homo sapiens
ctaaatttatattcataa

SEQ ID NO: 649703 - DNA, 13 bp, Homo sapiens
ctaacaaaatgag

SEQ ID NO: 649704 - DNA, 14 bp, Homo sapiens
ctaacacagcatgt

SEQ ID NO: 649705 - DNA, 16 bp, Homo sapiens
ctaacacagcatgtgt

SEQ ID NO: 649706 - DNA, 17 bp, Homo sapiens
ctaacacagcatgtgta

SEQ ID NO: 649707 - DNA, 17 bp, Homo sapiens
ctaacagataagcaaga

SEQ ID NO: 649708 - DNA, 18 bp, Homo sapiens
ctaacagataagcaagag

SEQ ID NO: 649709 - DNA, 15 bp, Homo sapiens
ctaactaaataccat

SEQ ID NO: 649710 - DNA, 16 bp, Homo sapiens
ctaactaaataccatt

SEQ ID NO: 649711 - DNA, 20 bp, Homo sapiens
ctaactcaaatacacatttg

SEQ ID NO: 649712 - DNA, 15 bp, Homo sapiens
ctaagaaaatgtagt

SEQ ID NO: 649713 - DNA, 16 bp, Homo sapiens
ctaagaagacattttg

SEQ ID NO: 649714 - DNA, 17 bp, Homo sapiens
ctaagaagacattttgt

SEQ ID NO: 649715 - DNA, 18 bp, Homo sapiens
ctaagaagacattttgtt

SEQ ID NO: 649716 - DNA, 14 bp, Homo sapiens
ctaaggaaccttcc

SEQ ID NO: 649717 - DNA, 14 bp, Homo sapiens
ctaagggtgggtgc

SEQ ID NO: 649718 - DNA, 18 bp, Homo sapiens
ctaagggtgggtgctcag

SEQ ID NO: 649719 - DNA, 20 bp, Homo sapiens
ctaagtccctataataaagg

SEQ ID NO: 649720 - DNA, 19 bp, Homo sapiens
ctaagtggctgccttcttt

SEQ ID NO: 649721 - DNA, 15 bp, Homo sapiens
ctaataaatataatt

SEQ ID NO: 649722 - DNA, 13 bp, Homo sapiens
ctaatcaaagcca

SEQ ID NO: 649723 - DNA, 20 bp, Homo sapiens
ctaatcaaagccagggtctc

SEQ ID NO: 649724 - DNA, 13 bp, Homo sapiens
ctaatccttttcc

SEQ ID NO: 649725 - DNA, 15 bp, Homo sapiens
ctaatccttttcctt

SEQ ID NO: 649726 - DNA, 17 bp, Homo sapiens
ctaatgcttgtttatga

SEQ ID NO: 649727 - DNA, 17 bp, Homo sapiens
ctaatgtttatgagcca

SEQ ID NO: 649728 - DNA, 22 bp, Homo sapiens
ctaattgctgtgtgtcccaggc

SEQ ID NO: 649729 - DNA, 18 bp, Homo sapiens
ctaattggaaggagaggg

SEQ ID NO: 649730 - DNA, 21 bp, Homo sapiens
ctaattggtacttttaaaaac

SEQ ID NO: 649731 - DNA, 18 bp, Homo sapiens
ctaattgtaagtgaaatt

SEQ ID NO: 649732 - DNA, 16 bp, Homo sapiens
ctaatttatattatcc

SEQ ID NO: 649733 - DNA, 19 bp, Homo sapiens
ctaatttatattatccata

SEQ ID NO: 649734 - DNA, 13 bp, Homo sapiens
ctaatttttgtat

SEQ ID NO: 649735 - DNA, 13 bp, Homo sapiens
ctacacatgttgc

SEQ ID NO: 649736 - DNA, 19 bp, Homo sapiens
ctacagactccatctcttc

SEQ ID NO: 649737 - DNA, 23 bp, Homo sapiens
ctacagactccatctcttctgca

SEQ ID NO: 649738 - DNA, 12 bp, Homo sapiens
ctacagtacaat

SEQ ID NO: 649739 - DNA, 17 bp, Homo sapiens
ctacagtgactccctgg

SEQ ID NO: 649740 - DNA, 18 bp, Homo sapiens
ctacagtgccaactcctc

SEQ ID NO: 649741 - DNA, 19 bp, Homo sapiens
ctacagtgccaactcctca

SEQ ID NO: 649742 - DNA, 20 bp, Homo sapiens
ctacagtttttatttagcat

SEQ ID NO: 649743 - DNA, 18 bp, Homo sapiens
ctaccaaaaaaaggaagg

SEQ ID NO: 649744 - DNA, 21 bp, Homo sapiens
ctaccactttttttaaccatt

SEQ ID NO: 649745 - DNA, 20 bp, Homo sapiens
ctacccgacataagtcgagg

SEQ ID NO: 649746 - DNA, 12 bp, Homo sapiens
ctacccttttcc

SEQ ID NO: 649747 - DNA, 15 bp, Homo sapiens
ctacccttttccttt

SEQ ID NO: 649748 - DNA, 16 bp, Homo sapiens
ctacccttttcctttt

SEQ ID NO: 649749 - DNA, 13 bp, Homo sapiens
ctacctctctgtc

SEQ ID NO: 649750 - DNA, 20 bp, Homo sapiens
ctacctctctgtcccttgct

SEQ ID NO: 649751 - DNA, 12 bp, Homo sapiens
ctacctgccctc

SEQ ID NO: 649752 - DNA, 14 bp, Homo sapiens
ctacctgccctcaa

SEQ ID NO: 649753 - DNA, 16 bp, Homo sapiens
ctacctgccttggaga

SEQ ID NO: 649754 - DNA, 15 bp, Homo sapiens
ctactagattgacta

SEQ ID NO: 649755 - DNA, 14 bp, Homo sapiens
ctactattggccct

SEQ ID NO: 649756 - DNA, 22 bp, Homo sapiens
ctactgaaacagatttcatacc

SEQ ID NO: 649757 - DNA, 18 bp, Homo sapiens
ctactgacaacattataa

SEQ ID NO: 649758 - DNA, 18 bp, Homo sapiens
ctactgcactccagcctg

SEQ ID NO: 649759 - DNA, 16 bp, Homo sapiens
ctactgccttgaaaaa

SEQ ID NO: 649760 - DNA, 22 bp, Homo sapiens
ctactgttgtaagaattctgat

SEQ ID NO: 649761 - DNA, 17 bp, Homo sapiens
ctactttgtggcaatct

SEQ ID NO: 649762 - DNA, 18 bp, Homo sapiens
ctagaaaaataaaatgtt

SEQ ID NO: 649763 - DNA, 22 bp, Homo sapiens
ctagaaaacttgactccatttc

SEQ ID NO: 649764 - DNA, 12 bp, Homo sapiens
ctagaagaacaa

SEQ ID NO: 649765 - DNA, 15 bp, Homo sapiens
ctagaagattagaaa

SEQ ID NO: 649766 - DNA, 18 bp, Homo sapiens
ctagaagtctgtccaaat

SEQ ID NO: 649767 - DNA, 12 bp, Homo sapiens
ctagagaacact

SEQ ID NO: 649768 - DNA, 21 bp, Homo sapiens
ctagagccctctcctccctct

SEQ ID NO: 649769 - DNA, 23 bp, Homo sapiens
ctagagccctctcctccctctgt

SEQ ID NO: 649770 - DNA, 18 bp, Homo sapiens
ctagagttttatagcctg

SEQ ID NO: 649771 - DNA, 16 bp, Homo sapiens
ctagataggaggatgg

SEQ ID NO: 649772 - DNA, 12 bp, Homo sapiens
ctagattgacta

SEQ ID NO: 649773 - DNA, 23 bp, Homo sapiens
ctagcagcccaccctgctgctgg

SEQ ID NO: 649774 - DNA, 22 bp, Homo sapiens
ctagcagtccccagctgagtga

SEQ ID NO: 649775 - DNA, 19 bp, Homo sapiens
ctagcgatctctcctggcc

SEQ ID NO: 649776 - DNA, 13 bp, Homo sapiens
ctagctacactga

SEQ ID NO: 649777 - DNA, 15 bp, Homo sapiens
ctagctcctcccctt

SEQ ID NO: 649778 - DNA, 14 bp, Homo sapiens
ctagcttttaggaa

SEQ ID NO: 649779 - DNA, 20 bp, Homo sapiens
ctaggacagttgattcaaca

SEQ ID NO: 649780 - DNA, 13 bp, Homo sapiens
ctagtaagaagac

SEQ ID NO: 649781 - DNA, 22 bp, Homo sapiens
ctagtaagaagacaaactgctt

SEQ ID NO: 649782 - DNA, 15 bp, Homo sapiens
ctagtaggaatgtac

SEQ ID NO: 649783 - DNA, 16 bp, Homo sapiens
ctagtttcctggttcc

SEQ ID NO: 649784 - DNA, 19 bp, Homo sapiens
ctagtttcttacacactgt

SEQ ID NO: 649785 - DNA, 11 bp, Homo sapiens
ctataaaatag

SEQ ID NO: 649786 - DNA, 21 bp, Homo sapiens
ctataaaatagatataaattt

SEQ ID NO: 649787 - DNA, 15 bp, Homo sapiens
ctataataaaggctg

SEQ ID NO: 649788 - DNA, 17 bp, Homo sapiens
ctataattctgttatat

SEQ ID NO: 649789 - DNA, 14 bp, Homo sapiens
ctatatatataaat

SEQ ID NO: 649790 - DNA, 17 bp, Homo sapiens
ctatatatataaatgta

SEQ ID NO: 649791 - DNA, 12 bp, Homo sapiens
ctatatatggta

SEQ ID NO: 649792 - DNA, 20 bp, Homo sapiens
ctatatgtgaaacatttttt

SEQ ID NO: 649793 - DNA, 22 bp, Homo sapiens
ctatatgtgaaacattttttct

SEQ ID NO: 649794 - DNA, 22 bp, Homo sapiens
ctatcatactactgaaacagat

SEQ ID NO: 649795 - DNA, 13 bp, Homo sapiens
ctatcatggcata

SEQ ID NO: 649796 - DNA, 18 bp, Homo sapiens
ctatccccatctccctgc

SEQ ID NO: 649797 - DNA, 19 bp, Homo sapiens
ctatccccatctccctgcc

SEQ ID NO: 649798 - DNA, 14 bp, Homo sapiens
ctatgacaaattca

SEQ ID NO: 649799 - DNA, 15 bp, Homo sapiens
ctatgacaaattcaa

SEQ ID NO: 649800 - DNA, 19 bp, Homo sapiens
ctatggaacataaagttgt

SEQ ID NO: 649801 - DNA, 21 bp, Homo sapiens
ctatggcttatttctatgaca

SEQ ID NO: 649802 - DNA, 15 bp, Homo sapiens
ctatgtaagggtctt

SEQ ID NO: 649803 - DNA, 13 bp, Homo sapiens
ctatgtataaaat

SEQ ID NO: 649804 - DNA, 17 bp, Homo sapiens
ctatgtataaaatacat

SEQ ID NO: 649805 - DNA, 22 bp, Homo sapiens
ctatgtgacatttctcttcccc

SEQ ID NO: 649806 - DNA, 15 bp, Homo sapiens
ctatgttactatttt

SEQ ID NO: 649807 - DNA, 16 bp, Homo sapiens
ctatgttactattttc

SEQ ID NO: 649808 - DNA, 19 bp, Homo sapiens
ctattatttttataattgt

SEQ ID NO: 649809 - DNA, 22 bp, Homo sapiens
ctattctataaaactctgcatg

SEQ ID NO: 649810 - DNA, 18 bp, Homo sapiens
ctattgcttggacttaac

SEQ ID NO: 649811 - DNA, 16 bp, Homo sapiens
ctattgtgccaactgc

SEQ ID NO: 649812 - DNA, 11 bp, Homo sapiens
ctatttaagat

SEQ ID NO: 649813 - DNA, 12 bp, Homo sapiens
ctatttatatca

SEQ ID NO: 649814 - DNA, 23 bp, Homo sapiens
ctatttatatcacacaatatagt

SEQ ID NO: 649815 - DNA, 15 bp, Homo sapiens
ctatttatttgaggt

SEQ ID NO: 649816 - DNA, 13 bp, Homo sapiens
ctattttaaaata

SEQ ID NO: 649817 - DNA, 22 bp, Homo sapiens
ctattttaaaataaattagttg

SEQ ID NO: 649818 - DNA, 13 bp, Homo sapiens
ctattttcataat

SEQ ID NO: 649819 - DNA, 14 bp, Homo sapiens
ctattttctacaat

SEQ ID NO: 649820 - DNA, 19 bp, Homo sapiens
ctattttgacagttatttt

SEQ ID NO: 649821 - DNA, 21 bp, Homo sapiens
ctcaaactcctgacctcaggt

SEQ ID NO: 649822 - DNA, 20 bp, Homo sapiens
ctcaaagagaattgtatgta

SEQ ID NO: 649823 - DNA, 19 bp, Homo sapiens
ctcaaagtatgcaatgctt

SEQ ID NO: 649824 - DNA, 15 bp, Homo sapiens
ctcaaatacacattt

SEQ ID NO: 649825 - DNA, 18 bp, Homo sapiens
ctcaaatacacatttgct

SEQ ID NO: 649826 - DNA, 11 bp, Homo sapiens
ctcaaatgctg

SEQ ID NO: 649827 - DNA, 18 bp, Homo sapiens
ctcaactgtcccaaggag

SEQ ID NO: 649828 - DNA, 19 bp, Homo sapiens
ctcaagctagtgtttctag

SEQ ID NO: 649829 - DNA, 20 bp, Homo sapiens
ctcaagctagtgtttctagc

SEQ ID NO: 649830 - DNA, 13 bp, Homo sapiens
ctcaagtttaaaa

SEQ ID NO: 649831 - DNA, 13 bp, Homo sapiens
ctcaataaagatt

SEQ ID NO: 649832 - DNA, 16 bp, Homo sapiens
ctcaatagatctccag

SEQ ID NO: 649833 - DNA, 19 bp, Homo sapiens
ctcaatgaaccataaattc

SEQ ID NO: 649834 - DNA, 21 bp, Homo sapiens
ctcaattgaaagcttttaaaa

SEQ ID NO: 649835 - DNA, 12 bp, Homo sapiens
ctcaatttcatt

SEQ ID NO: 649836 - DNA, 17 bp, Homo sapiens
ctcaatttttgtctcag

SEQ ID NO: 649837 - DNA, 15 bp, Homo sapiens
ctcacacaccctgag

SEQ ID NO: 649838 - DNA, 16 bp, Homo sapiens
ctcacacaccctgagg

SEQ ID NO: 649839 - DNA, 17 bp, Homo sapiens
ctcacacaccctgaggt

SEQ ID NO: 649840 - DNA, 18 bp, Homo sapiens
ctcacactcccctagggg

SEQ ID NO: 649841 - DNA, 20 bp, Homo sapiens
ctcacagatgtgactgtata

SEQ ID NO: 649842 - DNA, 22 bp, Homo sapiens
ctcacccatgcaagcagaggac

SEQ ID NO: 649843 - DNA, 18 bp, Homo sapiens
ctcaccccactcctgtca

SEQ ID NO: 649844 - DNA, 19 bp, Homo sapiens
ctcacctcccgaagccacc

SEQ ID NO: 649845 - DNA, 21 bp, Homo sapiens
ctcacgcctgtaatcccagca

SEQ ID NO: 649846 - DNA, 16 bp, Homo sapiens
ctcactatatatattt

SEQ ID NO: 649847 - DNA, 14 bp, Homo sapiens
ctcactgaaaccag

SEQ ID NO: 649848 - DNA, 12 bp, Homo sapiens
ctcactgctgat

SEQ ID NO: 649849 - DNA, 14 bp, Homo sapiens
ctcagaattatttt

SEQ ID NO: 649850 - DNA, 18 bp, Homo sapiens
ctcagaccccctcagcct

SEQ ID NO: 649851 - DNA, 19 bp, Homo sapiens
ctcagaccccctcagcctt

SEQ ID NO: 649852 - DNA, 23 bp, Homo sapiens
ctcagagaaaaatgctccccaca

SEQ ID NO: 649853 - DNA, 20 bp, Homo sapiens
ctcagagaaggaaaagactg

SEQ ID NO: 649854 - DNA, 23 bp, Homo sapiens
ctcagattcttcattgaggattg

SEQ ID NO: 649855 - DNA, 21 bp, Homo sapiens
ctcagcacattcgggaccaat

SEQ ID NO: 649856 - DNA, 22 bp, Homo sapiens
ctcagcacattcgggaccaata

SEQ ID NO: 649857 - DNA, 15 bp, Homo sapiens
ctcagccccaactct

SEQ ID NO: 649858 - DNA, 21 bp, Homo sapiens
ctcagccctggcctggctggg

SEQ ID NO: 649859 - DNA, 11 bp, Homo sapiens
ctcagccctgt

SEQ ID NO: 649860 - DNA, 22 bp, Homo sapiens
ctcagcctcccaaagtgctggg

SEQ ID NO: 649861 - DNA, 12 bp, Homo sapiens
ctcagctgcctc

SEQ ID NO: 649862 - DNA, 19 bp, Homo sapiens
ctcagctgcctcctgcgcc

SEQ ID NO: 649863 - DNA, 18 bp, Homo sapiens
ctcagctgtcaaggctca

SEQ ID NO: 649864 - DNA, 20 bp, Homo sapiens
ctcaggatatccttatcaga

SEQ ID NO: 649865 - DNA, 22 bp, Homo sapiens
ctcaggatatccttatcagagc

SEQ ID NO: 649866 - DNA, 19 bp, Homo sapiens
ctcaggccacagtggggct

SEQ ID NO: 649867 - DNA, 13 bp, Homo sapiens
ctcagggctccca

SEQ ID NO: 649868 - DNA, 12 bp, Homo sapiens
ctcagggctgga

SEQ ID NO: 649869 - DNA, 14 bp, Homo sapiens
ctcagggctggagc

SEQ ID NO: 649870 - DNA, 15 bp, Homo sapiens
ctcagggctggagcc

SEQ ID NO: 649871 - DNA, 20 bp, Homo sapiens
ctcagggctggagcctgggg

SEQ ID NO: 649872 - DNA, 15 bp, Homo sapiens
ctcagggtggtctct

SEQ ID NO: 649873 - DNA, 22 bp, Homo sapiens
ctcaggtgttttttatgaagtg

SEQ ID NO: 649874 - DNA, 18 bp, Homo sapiens
ctcagtccctcttctggt

SEQ ID NO: 649875 - DNA, 16 bp, Homo sapiens
ctcagtcctaatttga

SEQ ID NO: 649876 - DNA, 22 bp, Homo sapiens
ctcagtgttttggactccatct

SEQ ID NO: 649877 - DNA, 16 bp, Homo sapiens
ctcagttcaatgagca

SEQ ID NO: 649878 - DNA, 22 bp, Homo sapiens
ctcataggctatgccatgtgcg

SEQ ID NO: 649879 - DNA, 19 bp, Homo sapiens
ctcatctatgaggaaaggt

SEQ ID NO: 649880 - DNA, 15 bp, Homo sapiens
ctcatgagtgtgccc

SEQ ID NO: 649881 - DNA, 18 bp, Homo sapiens
ctcatgagtgtgccccat

SEQ ID NO: 649882 - DNA, 16 bp, Homo sapiens
ctcattactgggcctt

SEQ ID NO: 649883 - DNA, 14 bp, Homo sapiens
ctcattgactttta

SEQ ID NO: 649884 - DNA, 14 bp, Homo sapiens
ctcattgtcacctc

SEQ ID NO: 649885 - DNA, 14 bp, Homo sapiens
ctcatttttgcact

SEQ ID NO: 649886 - DNA, 20 bp, Homo sapiens
ctccacatatttcagtgagg

SEQ ID NO: 649887 - DNA, 23 bp, Homo sapiens
ctccaccccccactcagtgcctc

SEQ ID NO: 649888 - DNA, 13 bp, Homo sapiens
ctccacttgtata

SEQ ID NO: 649889 - DNA, 15 bp, Homo sapiens
ctccacttgtatata

SEQ ID NO: 649890 - DNA, 17 bp, Homo sapiens
ctccaggaagcccaggg

SEQ ID NO: 649891 - DNA, 18 bp, Homo sapiens
ctccaggaagcccagggc

SEQ ID NO: 649892 - DNA, 22 bp, Homo sapiens
ctccaggcctgcagcaggagtg

SEQ ID NO: 649893 - DNA, 17 bp, Homo sapiens
ctccagggatggcccct

SEQ ID NO: 649894 - DNA, 16 bp, Homo sapiens
ctccagggtacatgct

SEQ ID NO: 649895 - DNA, 15 bp, Homo sapiens
ctccagggtgatttt

SEQ ID NO: 649896 - DNA, 14 bp, Homo sapiens
ctccagtgtcaggg

SEQ ID NO: 649897 - DNA, 20 bp, Homo sapiens
ctccatactgtttctttctt

SEQ ID NO: 649898 - DNA, 23 bp, Homo sapiens
ctccataggagggaaggagcagt

SEQ ID NO: 649899 - DNA, 21 bp, Homo sapiens
ctccatctctcatcctccagt

SEQ ID NO: 649900 - DNA, 16 bp, Homo sapiens
ctccatctcttctgca

SEQ ID NO: 649901 - DNA, 23 bp, Homo sapiens
ctccatggacgtgtctgcacagg

SEQ ID NO: 649902 - DNA, 16 bp, Homo sapiens
ctccatgtgtacttat

SEQ ID NO: 649903 - DNA, 20 bp, Homo sapiens
ctccatttttctcccaagaa

SEQ ID NO: 649904 - DNA, 14 bp, Homo sapiens
ctcccaacttcttc

SEQ ID NO: 649905 - DNA, 17 bp, Homo sapiens
ctcccaacttcttcctg

SEQ ID NO: 649906 - DNA, 18 bp, Homo sapiens
ctcccacacccaaagctg

SEQ ID NO: 649907 - DNA, 21 bp, Homo sapiens
ctcccacacccaaagctgagc

SEQ ID NO: 649908 - DNA, 13 bp, Homo sapiens
ctcccaggggtct

SEQ ID NO: 649909 - DNA, 19 bp, Homo sapiens
ctcccaggggtctccctgg

SEQ ID NO: 649910 - DNA, 22 bp, Homo sapiens
ctcccaggggtctccctggctc

SEQ ID NO: 649911 - DNA, 17 bp, Homo sapiens
ctccccaattctcccct

SEQ ID NO: 649912 - DNA, 15 bp, Homo sapiens
ctccccacagcgtcc

SEQ ID NO: 649913 - DNA, 15 bp, Homo sapiens
ctccccacctccagg

SEQ ID NO: 649914 - DNA, 16 bp, Homo sapiens
ctccccacctccaggc

SEQ ID NO: 649915 - DNA, 16 bp, Homo sapiens
ctccccagcccacctg

SEQ ID NO: 649916 - DNA, 17 bp, Homo sapiens
ctcccccaccactcagg

SEQ ID NO: 649917 - DNA, 17 bp, Homo sapiens
ctcccccgtttctcctt

SEQ ID NO: 649918 - DNA, 22 bp, Homo sapiens
ctcccccgtttctccttttcct

SEQ ID NO: 649919 - DNA, 16 bp, Homo sapiens
ctcccctaaagcctca

SEQ ID NO: 649920 - DNA, 23 bp, Homo sapiens
ctcccctagagccctctcctccc

SEQ ID NO: 649921 - DNA, 17 bp, Homo sapiens
ctcccctcctgcacaca

SEQ ID NO: 649922 - DNA, 20 bp, Homo sapiens
ctcccgccaggagcttcttc

SEQ ID NO: 649923 - DNA, 20 bp, Homo sapiens
ctcccgtgcatgctctgcag

SEQ ID NO: 649924 - DNA, 16 bp, Homo sapiens
ctccctccccgtctca

SEQ ID NO: 649925 - DNA, 15 bp, Homo sapiens
ctccctcctccaggc

SEQ ID NO: 649926 - DNA, 17 bp, Homo sapiens
ctccctctgtccctctc

SEQ ID NO: 649927 - DNA, 13 bp, Homo sapiens
ctccctgcctggc

SEQ ID NO: 649928 - DNA, 16 bp, Homo sapiens
ctccctgcctggcccc

SEQ ID NO: 649929 - DNA, 16 bp, Homo sapiens
ctccctggatcacata

SEQ ID NO: 649930 - DNA, 16 bp, Homo sapiens
ctccctggcagacaca

SEQ ID NO: 649931 - DNA, 16 bp, Homo sapiens
ctccctggctccctcc

SEQ ID NO: 649932 - DNA, 15 bp, Homo sapiens
ctccctgggtctggg

SEQ ID NO: 649933 - DNA, 18 bp, Homo sapiens
ctccggcttgacctgttt

SEQ ID NO: 649934 - DNA, 18 bp, Homo sapiens
ctccgtagctctgctgct

SEQ ID NO: 649935 - DNA, 14 bp, Homo sapiens
ctccgttccatctg

SEQ ID NO: 649936 - DNA, 17 bp, Homo sapiens
ctcctaaaactgggatt

SEQ ID NO: 649937 - DNA, 20 bp, Homo sapiens
ctcctaactgccagccccct

SEQ ID NO: 649938 - DNA, 17 bp, Homo sapiens
ctcctacttttcatcct

SEQ ID NO: 649939 - DNA, 12 bp, Homo sapiens
ctcctagaagaa

SEQ ID NO: 649940 - DNA, 19 bp, Homo sapiens
ctcctagaagaaccaaata

SEQ ID NO: 649941 - DNA, 14 bp, Homo sapiens
ctcctcaactcacc

SEQ ID NO: 649942 - DNA, 17 bp, Homo sapiens
ctcctcacacaccctga

SEQ ID NO: 649943 - DNA, 19 bp, Homo sapiens
ctcctcacccacctctggg

SEQ ID NO: 649944 - DNA, 21 bp, Homo sapiens
ctcctccagggtgattttatg

SEQ ID NO: 649945 - DNA, 15 bp, Homo sapiens
ctcctccccttcctc

SEQ ID NO: 649946 - DNA, 15 bp, Homo sapiens
ctcctcccgcccttc

SEQ ID NO: 649947 - DNA, 20 bp, Homo sapiens
ctcctcccgcccttccatgt

SEQ ID NO: 649948 - DNA, 18 bp, Homo sapiens
ctttctcaaagaaatatt

SEQ ID NO: 649949 - DNA, 20 bp, Homo sapiens
ctttctcaaagaaatattaa

SEQ ID NO: 649950 - DNA, 21 bp, Homo sapiens
ctttctgccatctagccagcc

SEQ ID NO: 649951 - DNA, 18 bp, Homo sapiens
ctttcttatcttgaccat

SEQ ID NO: 649952 - DNA, 16 bp, Homo sapiens
ctttctttgcctctgc

SEQ ID NO: 649953 - DNA, 17 bp, Homo sapiens
ctttctttgcctctgca

SEQ ID NO: 649954 - DNA, 22 bp, Homo sapiens
ctttgaagtgcagctcatgttt

SEQ ID NO: 649955 - DNA, 13 bp, Homo sapiens
ctttgcctcttct

SEQ ID NO: 649956 - DNA, 15 bp, Homo sapiens
ctttgcctcttcttt

SEQ ID NO: 649957 - DNA, 16 bp, Homo sapiens
ctttgcctcttctttg

SEQ ID NO: 649958 - DNA, 21 bp, Homo sapiens
ctttgcctcttctttgtgcct

SEQ ID NO: 649959 - DNA, 23 bp, Homo sapiens
ctttgcctcttctttgtgccttt

SEQ ID NO: 649960 - DNA, 14 bp, Homo sapiens
ctttgctatgtaag

SEQ ID NO: 649961 - DNA, 19 bp, Homo sapiens
ctttgctgcagagatcaag

SEQ ID NO: 649962 - DNA, 21 bp, Homo sapiens
ctttgctttgagacctttcct

SEQ ID NO: 649963 - DNA, 19 bp, Homo sapiens
ctttggagaccattatcag

SEQ ID NO: 649964 - DNA, 21 bp, Homo sapiens
ctttggcctggggtgcatctc

SEQ ID NO: 649965 - DNA, 18 bp, Homo sapiens
ctttgggatatggtcttg

SEQ ID NO: 649966 - DNA, 17 bp, Homo sapiens
ctttgtattttgattat

SEQ ID NO: 649967 - DNA, 17 bp, Homo sapiens
ctttgtcgtggttctta

SEQ ID NO: 649968 - DNA, 18 bp, Homo sapiens
ctttgtcgtggttcttaa

SEQ ID NO: 649969 - DNA, 20 bp, Homo sapiens
ctttgtctaactcagaatta

SEQ ID NO: 649970 - DNA, 15 bp, Homo sapiens
ctttgtgactgtcac

SEQ ID NO: 649971 - DNA, 13 bp, Homo sapiens
ctttgtgcattct

SEQ ID NO: 649972 - DNA, 13 bp, Homo sapiens
ctttgtgcctttg

SEQ ID NO: 649973 - DNA, 20 bp, Homo sapiens
ctttgtggattctgaggccc

SEQ ID NO: 649974 - DNA, 13 bp, Homo sapiens
cttttaaagaagc

SEQ ID NO: 649975 - DNA, 19 bp, Homo sapiens
cttttaaagaagctttatc

SEQ ID NO: 649976 - DNA, 15 bp, Homo sapiens
cttttagaaatgcat

SEQ ID NO: 649977 - DNA, 16 bp, Homo sapiens
cttttattgtaaagtc

SEQ ID NO: 649978 - DNA, 17 bp, Homo sapiens
cttttatttggtgtgtt

SEQ ID NO: 649979 - DNA, 18 bp, Homo sapiens
cttttatttggtgtgttc

SEQ ID NO: 649980 - DNA, 22 bp, Homo sapiens
cttttccaggagttctgaagct

SEQ ID NO: 649981 - DNA, 16 bp, Homo sapiens
cttttcccccttccca

SEQ ID NO: 649982 - DNA, 23 bp, Homo sapiens
cttttccttatttgccttctact

SEQ ID NO: 649983 - DNA, 17 bp, Homo sapiens
cttttctcagtgttggt

SEQ ID NO: 649984 - DNA, 13 bp, Homo sapiens
cttttctcttttc

SEQ ID NO: 649985 - DNA, 17 bp, Homo sapiens
cttttgaaaaaaaagtt

SEQ ID NO: 649986 - DNA, 23 bp, Homo sapiens
cttttgaaaaaaaagtttttaat

SEQ ID NO: 649987 - DNA, 12 bp, Homo sapiens
cttttgctgtgc

SEQ ID NO: 649988 - DNA, 11 bp, Homo sapiens
cttttgggaag

SEQ ID NO: 649989 - DNA, 21 bp, Homo sapiens
cttttgtggaggggagggatg

SEQ ID NO: 649990 - DNA, 20 bp, Homo sapiens
cttttgttaaacccttctgt

SEQ ID NO: 649991 - DNA, 12 bp, Homo sapiens
cttttgtttcca

SEQ ID NO: 649992 - DNA, 18 bp, Homo sapiens
ctttttaaaaactcttca

SEQ ID NO: 649993 - DNA, 19 bp, Homo sapiens
ctttttaaaaactcttcag

SEQ ID NO: 649994 - DNA, 20 bp, Homo sapiens
ctttttaaaaactcttcagt

SEQ ID NO: 649995 - DNA, 15 bp, Homo sapiens
ctttttatgctattt

SEQ ID NO: 649996 - DNA, 17 bp, Homo sapiens
ctttttcaggagaatta

SEQ ID NO: 649997 - DNA, 20 bp, Homo sapiens
ctttttcatccttctttcct

SEQ ID NO: 649998 - DNA, 13 bp, Homo sapiens
ctttttctgcgct

SEQ ID NO: 649999 - DNA, 19 bp, Homo sapiens
cttttttctcagtcctaat

SEQ ID NO: 650000 - DNA, 16 bp, Homo sapiens
cttttttttttcttgg

SEQ ID NO: 650001 - DNA, 16 bp, Homo sapiens
gaaaaaaaagttttta

SEQ ID NO: 650002 - DNA, 19 bp, Homo sapiens
gaaaaaaaagtttttaatt

SEQ ID NO: 650003 - DNA, 18 bp, Homo sapiens
gaaaaagaataaaaactt

SEQ ID NO: 650004 - DNA, 15 bp, Homo sapiens
gaaaaataaaatgtt

SEQ ID NO: 650005 - DNA, 12 bp, Homo sapiens
gaaaaatataaa

SEQ ID NO: 650006 - DNA, 16 bp, Homo sapiens
gaaaaatataaaatta

SEQ ID NO: 650007 - DNA, 21 bp, Homo sapiens
gaaaaatataatgttgataat

SEQ ID NO: 650008 - DNA, 22 bp, Homo sapiens
gaaaaatatctggttatatcat

SEQ ID NO: 650009 - DNA, 20 bp, Homo sapiens
gaaaaatctcaattgaaagc

SEQ ID NO: 650010 - DNA, 16 bp, Homo sapiens
gaaaaatgacaattgt

SEQ ID NO: 650011 - DNA, 16 bp, Homo sapiens
gaaaaatgctccccac

SEQ ID NO: 650012 - DNA, 17 bp, Homo sapiens
gaaaaatgctccccaca

SEQ ID NO: 650013 - DNA, 11 bp, Homo sapiens
gaaaaattaac

SEQ ID NO: 650014 - DNA, 14 bp, Homo sapiens
gaaaaattaacttt

SEQ ID NO: 650015 - DNA, 15 bp, Homo sapiens
gaaaaattaactttt

SEQ ID NO: 650016 - DNA, 16 bp, Homo sapiens
gaaaaattaacttttt

SEQ ID NO: 650017 - DNA, 16 bp, Homo sapiens
gaaaaattggggagga

SEQ ID NO: 650018 - DNA, 21 bp, Homo sapiens
gaaaactgggtatgcgtttca

SEQ ID NO: 650019 - DNA, 14 bp, Homo sapiens
gaaaagctgaatcc

SEQ ID NO: 650020 - DNA, 20 bp, Homo sapiens
gaaaaggaagactagaggct

SEQ ID NO: 650021 - DNA, 13 bp, Homo sapiens
gaaaatgcaactc

SEQ ID NO: 650022 - DNA, 19 bp, Homo sapiens
gaaaatgcttaaaaaataa

SEQ ID NO: 650023 - DNA, 19 bp, Homo sapiens
gaaaatgtgtcctatctat

SEQ ID NO: 650024 - DNA, 13 bp, Homo sapiens
gaaaattcttgag

SEQ ID NO: 650025 - DNA, 23 bp, Homo sapiens
gaaacactgaaatgaaatcttcc

SEQ ID NO: 650026 - DNA, 13 bp, Homo sapiens
gaaacatgtcttg

SEQ ID NO: 650027 - DNA, 21 bp, Homo sapiens
gaaaccacagtcttcccagca

SEQ ID NO: 650028 - DNA, 17 bp, Homo sapiens
gaaacctagtactgccc

SEQ ID NO: 650029 - DNA, 18 bp, Homo sapiens
gaaacctagtactgcccc

SEQ ID NO: 650030 - DNA, 19 bp, Homo sapiens
gaaacctcacccttgcacc

SEQ ID NO: 650031 - DNA, 19 bp, Homo sapiens
gaaaccttgctctcctcat

SEQ ID NO: 650032 - DNA, 21 bp, Homo sapiens
gaaacgctacctctctgtccc

SEQ ID NO: 650033 - DNA, 13 bp, Homo sapiens
gaaacggacagct

SEQ ID NO: 650034 - DNA, 12 bp, Homo sapiens
gaaactgaaaaa

SEQ ID NO: 650035 - DNA, 21 bp, Homo sapiens
gaaactttgggaaaacatgtt

SEQ ID NO: 650036 - DNA, 13 bp, Homo sapiens
gaaagaacaagtt

SEQ ID NO: 650037 - DNA, 14 bp, Homo sapiens
gaaagaagagaagt

SEQ ID NO: 650038 - DNA, 18 bp, Homo sapiens
gaaagagccagactctgt

SEQ ID NO: 650039 - DNA, 18 bp, Homo sapiens
gaaagcagagcctcctgg

SEQ ID NO: 650040 - DNA, 22 bp, Homo sapiens
gaaagcagagttttcattaaat

SEQ ID NO: 650041 - DNA, 14 bp, Homo sapiens
gaaagcagctgaac

SEQ ID NO: 650042 - DNA, 14 bp, Homo sapiens
gaaaggaaaagagg

SEQ ID NO: 650043 - DNA, 13 bp, Homo sapiens
gaaaggaagcaac

SEQ ID NO: 650044 - DNA, 17 bp, Homo sapiens
gaaaggaagcaacagat

SEQ ID NO: 650045 - DNA, 15 bp, Homo sapiens
gaaaggagaatttga

SEQ ID NO: 650046 - DNA, 13 bp, Homo sapiens
gaaagtaatttaa

SEQ ID NO: 650047 - DNA, 21 bp, Homo sapiens
gaaagtaatttaatttgtaaa

SEQ ID NO: 650048 - DNA, 17 bp, Homo sapiens
gaaagtcaaaaaattat

SEQ ID NO: 650049 - DNA, 21 bp, Homo sapiens
gaaagtcaaatttactttaaa

SEQ ID NO: 650050 - DNA, 18 bp, Homo sapiens
gaaagtcagctcttgtca

SEQ ID NO: 650051 - DNA, 22 bp, Homo sapiens
gaaagtgggcttaatggagttc

SEQ ID NO: 650052 - DNA, 18 bp, Homo sapiens
gaaagtgtgagctcttcc

SEQ ID NO: 650053 - DNA, 11 bp, Homo sapiens
gaaagtttttt

SEQ ID NO: 650054 - DNA, 18 bp, Homo sapiens
gaaagtttttttttatta

SEQ ID NO: 650055 - DNA, 16 bp, Homo sapiens
gaaataatatatttct

SEQ ID NO: 650056 - DNA, 19 bp, Homo sapiens
gaaataatatatttcttct

SEQ ID NO: 650057 - DNA, 14 bp, Homo sapiens
gaaataatgctaca

SEQ ID NO: 650058 - DNA, 23 bp, Homo sapiens
gaaataatgctacaattttaaga

SEQ ID NO: 650059 - DNA, 18 bp, Homo sapiens
gaaatacagttatttcat

SEQ ID NO: 650060 - DNA, 17 bp, Homo sapiens
gaaatagtatacattgt

SEQ ID NO: 650061 - DNA, 17 bp, Homo sapiens
gaaatataacacatttt

SEQ ID NO: 650062 - DNA, 14 bp, Homo sapiens
gaaatccctttctg

SEQ ID NO: 650063 - DNA, 19 bp, Homo sapiens
gaaatccctttctgctagt

SEQ ID NO: 650064 - DNA, 17 bp, Homo sapiens
gattactgaattgtatc

SEQ ID NO: 650065 - DNA, 14 bp, Homo sapiens
gattctaaatacat

SEQ ID NO: 650066 - DNA, 18 bp, Homo sapiens
gattctcagggctggagc

SEQ ID NO: 650067 - DNA, 23 bp, Homo sapiens
gattctcagggctggagcctggg

SEQ ID NO: 650068 - DNA, 21 bp, Homo sapiens
gattctgaccttaaatgcaac

SEQ ID NO: 650069 - DNA, 20 bp, Homo sapiens
gattctggctttaagccttc

SEQ ID NO: 650070 - DNA, 19 bp, Homo sapiens
gattctggtccctggaaat

SEQ ID NO: 650071 - DNA, 21 bp, Homo sapiens
gattgcccctggctttgcctc

SEQ ID NO: 650072 - DNA, 14 bp, Homo sapiens
gattgcctctgaaa

SEQ ID NO: 650073 - DNA, 13 bp, Homo sapiens
gatttaaggtatt

SEQ ID NO: 650074 - DNA, 21 bp, Homo sapiens
gatttcagtcatagcaagctt

SEQ ID NO: 650075 - DNA, 16 bp, Homo sapiens
gatttcatacctcaga

SEQ ID NO: 650076 - DNA, 10 bp, Homo sapiens
gatttctaat

SEQ ID NO: 650077 - DNA, 22 bp, Homo sapiens
gatttctcattgacttttataa

SEQ ID NO: 650078 - DNA, 13 bp, Homo sapiens
gatttcttaaata

SEQ ID NO: 650079 - DNA, 15 bp, Homo sapiens
gatttgaaaaatata

SEQ ID NO: 650080 - DNA, 16 bp, Homo sapiens
gatttgaaaaatataa

SEQ ID NO: 650081 - DNA, 21 bp, Homo sapiens
gatttgaaaaatataaaatta

SEQ ID NO: 650082 - DNA, 19 bp, Homo sapiens
gatttggcactagccaaag

SEQ ID NO: 650083 - DNA, 20 bp, Homo sapiens
gattttattcaatatggtta

SEQ ID NO: 650084 - DNA, 21 bp, Homo sapiens
gattttattcaatatggttac

SEQ ID NO: 650085 - DNA, 16 bp, Homo sapiens
gattttcatttcatga

SEQ ID NO: 650086 - DNA, 12 bp, Homo sapiens
gattttgaggtt

SEQ ID NO: 650087 - DNA, 12 bp, Homo sapiens
gattttgcacaa

SEQ ID NO: 650088 - DNA, 18 bp, Homo sapiens
gatttttaagaaagtaat

SEQ ID NO: 650089 - DNA, 18 bp, Homo sapiens
gattttttattattattc

SEQ ID NO: 650090 - DNA, 13 bp, Homo sapiens
gcaaacagaacag

SEQ ID NO: 650091 - DNA, 14 bp, Homo sapiens
gcaaacagaacagg

SEQ ID NO: 650092 - DNA, 19 bp, Homo sapiens
gcaaacgagactttctcct

SEQ ID NO: 650093 - DNA, 22 bp, Homo sapiens
gcaaacttacaggtcctgctga

SEQ ID NO: 650094 - DNA, 18 bp, Homo sapiens
gcaaagaaaggagataca

SEQ ID NO: 650095 - DNA, 18 bp, Homo sapiens
gcaaagataatttatttc

SEQ ID NO: 650096 - DNA, 21 bp, Homo sapiens
gcaaagataatttatttcaat

SEQ ID NO: 650097 - DNA, 17 bp, Homo sapiens
gcaaaggctggctgtgt

SEQ ID NO: 650098 - DNA, 15 bp, Homo sapiens
gcaaataaagccttt

SEQ ID NO: 650099 - DNA, 20 bp, Homo sapiens
gcaaataagtcatctgatga

SEQ ID NO: 650100 - DNA, 13 bp, Homo sapiens
gcaaatatatgat

SEQ ID NO: 650101 - DNA, 16 bp, Homo sapiens
gcaaatgacagatttc

SEQ ID NO: 650102 - DNA, 21 bp, Homo sapiens
gcaaatgacagatttctgtaa

SEQ ID NO: 650103 - DNA, 16 bp, Homo sapiens
gcaaatgagctctgaa

SEQ ID NO: 650104 - DNA, 14 bp, Homo sapiens
gcaaattgtatctt

SEQ ID NO: 650105 - DNA, 14 bp, Homo sapiens
gcaaccatttgaaa

SEQ ID NO: 650106 - DNA, 21 bp, Homo sapiens
gcaagcagaggaccagggcct

SEQ ID NO: 650107 - DNA, 21 bp, Homo sapiens
gcaagttcatgtgtggaaatg

SEQ ID NO: 650108 - DNA, 19 bp, Homo sapiens
gcaataaaatttaaaaaat

SEQ ID NO: 650109 - DNA, 23 bp, Homo sapiens
gcaatcacacgactgtcatctaa

SEQ ID NO: 650110 - DNA, 14 bp, Homo sapiens
gcaatgaaagtcaa

SEQ ID NO: 650111 - DNA, 21 bp, Homo sapiens
gcaatgaaagtcaaatttact

SEQ ID NO: 650112 - DNA, 22 bp, Homo sapiens
gcaatggtgtcagtatccaggc

SEQ ID NO: 650113 - DNA, 21 bp, Homo sapiens
gcaattagtctgaaactggct

SEQ ID NO: 650114 - DNA, 23 bp, Homo sapiens
gcaattctcctgcctcagcctcc

SEQ ID NO: 650115 - DNA, 20 bp, Homo sapiens
gcaatttgagccatttaaag

SEQ ID NO: 650116 - DNA, 19 bp, Homo sapiens
gcacaacagccctgcctga

SEQ ID NO: 650117 - DNA, 21 bp, Homo sapiens
gcacaacagccctgcctgaga

SEQ ID NO: 650118 - DNA, 13 bp, Homo sapiens
gcacacactgacc

SEQ ID NO: 650119 - DNA, 14 bp, Homo sapiens
gcacacactgtgcc

SEQ ID NO: 650120 - DNA, 11 bp, Homo sapiens
gcacacagggc

SEQ ID NO: 650121 - DNA, 17 bp, Homo sapiens
gcacaccattttgtaaa

SEQ ID NO: 650122 - DNA, 21 bp, Homo sapiens
gcacacctttattcagaactt

SEQ ID NO: 650123 - DNA, 18 bp, Homo sapiens
gcacagaacaggaggtgt

SEQ ID NO: 650124 - DNA, 23 bp, Homo sapiens
gcacagaacaggaggtgtgaatg

SEQ ID NO: 650125 - DNA, 13 bp, Homo sapiens
gcacagctgtttg

SEQ ID NO: 650126 - DNA, 15 bp, Homo sapiens
gcacaggaggcaggc

SEQ ID NO: 650127 - DNA, 18 bp, Homo sapiens
gcacaggccccgaggagc

SEQ ID NO: 650128 - DNA, 23 bp, Homo sapiens
gcacatacgggctttaatagtca

SEQ ID NO: 650129 - DNA, 23 bp, Homo sapiens
gcacatccgcgtgtgcctgtgtg

SEQ ID NO: 650130 - DNA, 17 bp, Homo sapiens
gcacatgccacctggca

SEQ ID NO: 650131 - DNA, 18 bp, Homo sapiens
gcacattcgggaccaata

SEQ ID NO: 650132 - DNA, 21 bp, Homo sapiens
gcacattcgggaccaatatat

SEQ ID NO: 650133 - DNA, 18 bp, Homo sapiens
gcaccagttatgtttgaa

SEQ ID NO: 650134 - DNA, 16 bp, Homo sapiens
gcaccatccagctccc

SEQ ID NO: 650135 - DNA, 17 bp, Homo sapiens
gcaccatccagctcccc

SEQ ID NO: 650136 - DNA, 15 bp, Homo sapiens
gccaccatccccacc

SEQ ID NO: 650137 - DNA, 23 bp, Homo sapiens
gccacctgggaacacagttctgg

SEQ ID NO: 650138 - DNA, 15 bp, Homo sapiens
gccacttgaaatgtt

SEQ ID NO: 650139 - DNA, 22 bp, Homo sapiens
gccagacccacgggctcatgca

SEQ ID NO: 650140 - DNA, 15 bp, Homo sapiens
gccagaggtgcttca

SEQ ID NO: 650141 - DNA, 14 bp, Homo sapiens
gccagatcttaggt

SEQ ID NO: 650142 - DNA, 19 bp, Homo sapiens
gccagcaacattggcacat

SEQ ID NO: 650143 - DNA, 14 bp, Homo sapiens
gccagcaccacagc

SEQ ID NO: 650144 - DNA, 23 bp, Homo sapiens
gccagcagggcatcttggaaaag

SEQ ID NO: 650145 - DNA, 18 bp, Homo sapiens
gccagcccatggccccca

SEQ ID NO: 650146 - DNA, 18 bp, Homo sapiens
gccagccttgagccctgg

SEQ ID NO: 650147 - DNA, 22 bp, Homo sapiens
gccaggacatgcaataaaattt

SEQ ID NO: 650148 - DNA, 17 bp, Homo sapiens
gccagggcaagagagcg

SEQ ID NO: 650149 - DNA, 20 bp, Homo sapiens
gccagggtctctccctcagg

SEQ ID NO: 650150 - DNA, 21 bp, Homo sapiens
gccagggtctgtgtgaatgtg

SEQ ID NO: 650151 - DNA, 15 bp, Homo sapiens
gccagtaatctttat

SEQ ID NO: 650152 - DNA, 17 bp, Homo sapiens
gccagtctcattgtcac

SEQ ID NO: 650153 - DNA, 16 bp, Homo sapiens
gccagttggtgttcct

SEQ ID NO: 650154 - DNA, 20 bp, Homo sapiens
gccatattctggttcttgaa

SEQ ID NO: 650155 - DNA, 17 bp, Homo sapiens
gccatcaaacctgggta

SEQ ID NO: 650156 - DNA, 12 bp, Homo sapiens
gccatcatcctc

SEQ ID NO: 650157 - DNA, 23 bp, Homo sapiens
gccatcatcctcccgccaggagc

SEQ ID NO: 650158 - DNA, 14 bp, Homo sapiens
gccatctgttcatt

SEQ ID NO: 650159 - DNA, 17 bp, Homo sapiens
gccatggctcagggtgg

SEQ ID NO: 650160 - DNA, 22 bp, Homo sapiens
gccatgtctgggaacagggacg

SEQ ID NO: 650161 - DNA, 15 bp, Homo sapiens
gccatgtgaagaggg

SEQ ID NO: 650162 - DNA, 11 bp, Homo sapiens
gccatttaaaa

SEQ ID NO: 650163 - DNA, 18 bp, Homo sapiens
gccatttaaaaagttgta

SEQ ID NO: 650164 - DNA, 20 bp, Homo sapiens
gcccaccctgctgctggtgc

SEQ ID NO: 650165 - DNA, 22 bp, Homo sapiens
gcccaccctgctgctggtgcac

SEQ ID NO: 650166 - DNA, 20 bp, Homo sapiens
gcccaggggagcgtgttcct

SEQ ID NO: 650167 - DNA, 19 bp, Homo sapiens
gcccaggttggagtgcagt

SEQ ID NO: 650168 - DNA, 20 bp, Homo sapiens
gcccaggttggagtgcagtg

SEQ ID NO: 650169 - DNA, 12 bp, Homo sapiens
gcccagtgcatg

SEQ ID NO: 650170 - DNA, 15 bp, Homo sapiens
gcccatggcccccaa

SEQ ID NO: 650171 - DNA, 16 bp, Homo sapiens
gcccatggcccccaat

SEQ ID NO: 650172 - DNA, 17 bp, Homo sapiens
gcccatggcccccaata

SEQ ID NO: 650173 - DNA, 19 bp, Homo sapiens
gcccatggcccccaataaa

SEQ ID NO: 650174 - DNA, 15 bp, Homo sapiens
gccccacatgtccag

SEQ ID NO: 650175 - DNA, 21 bp, Homo sapiens
gccccacctcggcacacactg

SEQ ID NO: 650176 - DNA, 23 bp, Homo sapiens
gccccatgtgtcctggtgagaaa

SEQ ID NO: 650177 - DNA, 16 bp, Homo sapiens
gcccccaacctcaggg

SEQ ID NO: 650178 - DNA, 12 bp, Homo sapiens
gcccccaataaa

SEQ ID NO: 650179 - DNA, 18 bp, Homo sapiens
gcccccaataaaggcagc

SEQ ID NO: 650180 - DNA, 23 bp, Homo sapiens
gcccccaataaaggcagctgcct

SEQ ID NO: 650181 - DNA, 24 bp, Homo sapiens
gcccccaataaaggcagctgcctc

SEQ ID NO: 650182 - DNA, 13 bp, Homo sapiens
gcccccagtgcct

SEQ ID NO: 650183 - DNA, 21 bp, Homo sapiens
gccccctgggctggggcctca

SEQ ID NO: 650184 - DNA, 18 bp, Homo sapiens
gccccgacacacggggct

SEQ ID NO: 650185 - DNA, 17 bp, Homo sapiens
gcccctaggctgctgct

SEQ ID NO: 650186 - DNA, 22 bp, Homo sapiens
gcccctcccacacccaaagctg

SEQ ID NO: 650187 - DNA, 13 bp, Homo sapiens
gcccctggctttg

SEQ ID NO: 650188 - DNA, 16 bp, Homo sapiens
gcccctggctttgcct

SEQ ID NO: 650189 - DNA, 19 bp, Homo sapiens
gcccctggctttgcctctt

SEQ ID NO: 650190 - DNA, 20 bp, Homo sapiens
gcccctggctttgcctcttc

SEQ ID NO: 650191 - DNA, 24 bp, Homo sapiens
gcccgacatggctccggcctctgc

SEQ ID NO: 650192 - DNA, 13 bp, Homo sapiens
gcctgcctgcagc

SEQ ID NO: 650193 - DNA, 17 bp, Homo sapiens
gcctgcctgcagcaggc

SEQ ID NO: 650194 - DNA, 18 bp, Homo sapiens
gcctgcctgcagcaggca

SEQ ID NO: 650195 - DNA, 20 bp, Homo sapiens
gcctgcctgcagcaggcagc

SEQ ID NO: 650196 - DNA, 15 bp, Homo sapiens
gcctgcgaccctggg

SEQ ID NO: 650197 - DNA, 23 bp, Homo sapiens
gcctgcgaccctgggggcacagg

SEQ ID NO: 650198 - DNA, 13 bp, Homo sapiens
gcctggactgcta

SEQ ID NO: 650199 - DNA, 13 bp, Homo sapiens
gcctggcccccaa

SEQ ID NO: 650200 - DNA, 20 bp, Homo sapiens
gcctggcccccaacctcagg

SEQ ID NO: 650201 - DNA, 21 bp, Homo sapiens
gcctggctgggtggtattctg

SEQ ID NO: 650202 - DNA, 13 bp, Homo sapiens
gcctggggcctga

SEQ ID NO: 650203 - DNA, 14 bp, Homo sapiens
gcctggggcctgag

SEQ ID NO: 650204 - DNA, 16 bp, Homo sapiens
gcctggggcctgagag

SEQ ID NO: 650205 - DNA, 17 bp, Homo sapiens
gcctggggcctgagaga

SEQ ID NO: 650206 - DNA, 18 bp, Homo sapiens
gcctggggcctgagagaa

SEQ ID NO: 650207 - DNA, 15 bp, Homo sapiens
gcctgggggtggggg

SEQ ID NO: 650208 - DNA, 16 bp, Homo sapiens
gcctggggtgcatctc

SEQ ID NO: 650209 - DNA, 17 bp, Homo sapiens
gcctggggtgcatctcc

SEQ ID NO: 650210 - DNA, 20 bp, Homo sapiens
gcctggggtgtcctacagtg

SEQ ID NO: 650211 - DNA, 23 bp, Homo sapiens
gcctggggtgtcctacagtgact

SEQ ID NO: 650212 - DNA, 22 bp, Homo sapiens
gcctggggtgttagtggcaccg

SEQ ID NO: 650213 - DNA, 19 bp, Homo sapiens
gcctggttaatattaatat

SEQ ID NO: 650214 - DNA, 22 bp, Homo sapiens
gcctggttcagacacagctctt

SEQ ID NO: 650215 - DNA, 11 bp, Homo sapiens
gcctgtcccaa

SEQ ID NO: 650216 - DNA, 18 bp, Homo sapiens
gcctgtcccttgcctctg

SEQ ID NO: 650217 - DNA, 16 bp, Homo sapiens
gcctgtgatgttttat

SEQ ID NO: 650218 - DNA, 18 bp, Homo sapiens
gcctgtggaatgagtgtg

SEQ ID NO: 650219 - DNA, 14 bp, Homo sapiens
gccttaatttagaa

SEQ ID NO: 650220 - DNA, 16 bp, Homo sapiens
gccttaatttagaaac

SEQ ID NO: 650221 - DNA, 12 bp, Homo sapiens
gccttagtgggc

SEQ ID NO: 650222 - DNA, 16 bp, Homo sapiens
gccttagtgggccagg

SEQ ID NO: 650223 - DNA, 19 bp, Homo sapiens
gccttcaaaactatagctt

SEQ ID NO: 650224 - DNA, 14 bp, Homo sapiens
gccttcacaaatgt

SEQ ID NO: 650225 - DNA, 13 bp, Homo sapiens
gccttcctcagct

SEQ ID NO: 650226 - DNA, 15 bp, Homo sapiens
gccttcctcagctgc

SEQ ID NO: 650227 - DNA, 10 bp, Homo sapiens
gccttctgct

SEQ ID NO: 650228 - DNA, 21 bp, Homo sapiens
gccttgatccccttgatagat

SEQ ID NO: 650229 - DNA, 19 bp, Homo sapiens
gccttgctacctcaagggg

SEQ ID NO: 650230 - DNA, 17 bp, Homo sapiens
gccttgctgtttgtcct

SEQ ID NO: 650231 - DNA, 13 bp, Homo sapiens
gccttggaaattc

SEQ ID NO: 650232 - DNA, 14 bp, Homo sapiens
gccttggaaattcc

SEQ ID NO: 650233 - DNA, 24 bp, Homo sapiens
gcctttaaaacgcgtctgcctggg

SEQ ID NO: 650234 - DNA, 19 bp, Homo sapiens
gcctttctcaactgtccca

SEQ ID NO: 650235 - DNA, 17 bp, Homo sapiens
gcctttctttgcctctg

SEQ ID NO: 650236 - DNA, 22 bp, Homo sapiens
gcctttggcctggggtgcatct

SEQ ID NO: 650237 - DNA, 14 bp, Homo sapiens
gccttttgctctct

SEQ ID NO: 650238 - DNA, 15 bp, Homo sapiens
gccttttgctctctg

SEQ ID NO: 650239 - DNA, 22 bp, Homo sapiens
gcctttttctgagatgctcact

SEQ ID NO: 650240 - DNA, 23 bp, Homo sapiens
gcgaccctgggggcacaggaggc

SEQ ID NO: 650241 - DNA, 16 bp, Homo sapiens
gcgagaccctgtctca

SEQ ID NO: 650242 - DNA, 18 bp, Homo sapiens
gcgatctctcctggccta

SEQ ID NO: 650243 - DNA, 17 bp, Homo sapiens
gcgcaggcagcgcaggg

SEQ ID NO: 650244 - DNA, 20 bp, Homo sapiens
gcgcaggcagcgcagggctg

SEQ ID NO: 650245 - DNA, 12 bp, Homo sapiens
gcgcagggctgg

SEQ ID NO: 650246 - DNA, 16 bp, Homo sapiens
gcgcagggctggcacg

SEQ ID NO: 650247 - DNA, 20 bp, Homo sapiens
gcgcggtggcgggcacctgt

SEQ ID NO: 650248 - DNA, 16 bp, Homo sapiens
gcggggtttcaccatg

SEQ ID NO: 650249 - DNA, 13 bp, Homo sapiens
gcgtcaagacatt

SEQ ID NO: 650250 - DNA, 14 bp, Homo sapiens
gcgtcagctgctcc

SEQ ID NO: 650251 - DNA, 17 bp, Homo sapiens
gcgtccagctcagccct

SEQ ID NO: 650252 - DNA, 18 bp, Homo sapiens
gcgtccagctcagccctg

SEQ ID NO: 650253 - DNA, 19 bp, Homo sapiens
gcgtccagctcagccctgg

SEQ ID NO: 650254 - DNA, 13 bp, Homo sapiens
gcgtctgcctggg

SEQ ID NO: 650255 - DNA, 21 bp, Homo sapiens
gcgtgcgcatcttgcctccag

SEQ ID NO: 650256 - DNA, 14 bp, Homo sapiens
gcgtggagggaggc

SEQ ID NO: 650257 - DNA, 21 bp, Homo sapiens
gcgtggagggaggccccaggg

SEQ ID NO: 650258 - DNA, 12 bp, Homo sapiens
gcgtggcctccc

SEQ ID NO: 650259 - DNA, 23 bp, Homo sapiens
gctttaattaattaagtatctgg

SEQ ID NO: 650260 - DNA, 18 bp, Homo sapiens
gctttattaaagaaataa

SEQ ID NO: 650261 - DNA, 18 bp, Homo sapiens
gctttattttgagatgta

SEQ ID NO: 650262 - DNA, 15 bp, Homo sapiens
gctttcccacttccc

SEQ ID NO: 650263 - DNA, 22 bp, Homo sapiens
gctttcccacttcccaccctgc

SEQ ID NO: 650264 - DNA, 18 bp, Homo sapiens
gctttcccgcccagcctc

SEQ ID NO: 650265 - DNA, 23 bp, Homo sapiens
gctttcccgcccagcctcacttc

SEQ ID NO: 650266 - DNA, 15 bp, Homo sapiens
gctttctgccatcta

SEQ ID NO: 650267 - DNA, 23 bp, Homo sapiens
gctttctggggcctagcgatctc

SEQ ID NO: 650268 - DNA, 12 bp, Homo sapiens
gctttggaaaca

SEQ ID NO: 650269 - DNA, 19 bp, Homo sapiens
gctttgtcgtatttggcac

SEQ ID NO: 650270 - DNA, 18 bp, Homo sapiens
gctttgtctacttcaaaa

SEQ ID NO: 650271 - DNA, 15 bp, Homo sapiens
gcttttaaaatgtag

SEQ ID NO: 650272 - DNA, 17 bp, Homo sapiens
gcttttaataaactgca

SEQ ID NO: 650273 - DNA, 19 bp, Homo sapiens
gcttttatttggtgtgttc

SEQ ID NO: 650274 - DNA, 14 bp, Homo sapiens
gcttttgttgttta

SEQ ID NO: 650275 - DNA, 16 bp, Homo sapiens
gctttttcctcctgga

SEQ ID NO: 650276 - DNA, 16 bp, Homo sapiens
ggaaaaggctggtaca

SEQ ID NO: 650277 - DNA, 20 bp, Homo sapiens
ggaaaatgcttaaaaaataa

SEQ ID NO: 650278 - DNA, 23 bp, Homo sapiens
ggaaacactgaaatgaaatcttc

SEQ ID NO: 650279 - DNA, 21 bp, Homo sapiens
ggaaagcagagcctcctggga

SEQ ID NO: 650280 - DNA, 21 bp, Homo sapiens
ggaaaggggttggggtgacag

SEQ ID NO: 650281 - DNA, 20 bp, Homo sapiens
ggaaagtgtgagctcttccc

SEQ ID NO: 650282 - DNA, 21 bp, Homo sapiens
ggaaagtgtgagctcttccct

SEQ ID NO: 650283 - DNA, 12 bp, Homo sapiens
ggaacaaggaag

SEQ ID NO: 650284 - DNA, 11 bp, Homo sapiens
ggaacctgcca

SEQ ID NO: 650285 - DNA, 19 bp, Homo sapiens
ggaaccttccttcctgctt

SEQ ID NO: 650286 - DNA, 19 bp, Homo sapiens
ggaactcactctttagata

SEQ ID NO: 650287 - DNA, 13 bp, Homo sapiens
ggaagaacataga

SEQ ID NO: 650288 - DNA, 16 bp, Homo sapiens
ggaagaacatagaact

SEQ ID NO: 650289 - DNA, 11 bp, Homo sapiens
ggaagaatgaa

SEQ ID NO: 650290 - DNA, 13 bp, Homo sapiens
ggaagaatgaaag

SEQ ID NO: 650291 - DNA, 21 bp, Homo sapiens
ggaagacttttggtagagaag

SEQ ID NO: 650292 - DNA, 17 bp, Homo sapiens
ggaagagccgagcacct

SEQ ID NO: 650293 - DNA, 23 bp, Homo sapiens
ggaagagtgtgggggaggcgcac

SEQ ID NO: 650294 - DNA, 17 bp, Homo sapiens
ggaagcatgtagactgt

SEQ ID NO: 650295 - DNA, 15 bp, Homo sapiens
ggaagctgcctggtg

SEQ ID NO: 650296 - DNA, 14 bp, Homo sapiens
ggaaggcagacagc

SEQ ID NO: 650297 - DNA, 17 bp, Homo sapiens
ggaagggaaagtttttt

SEQ ID NO: 650298 - DNA, 22 bp, Homo sapiens
ggaataaattatggcatttcta

SEQ ID NO: 650299 - DNA, 13 bp, Homo sapiens
ggaattcatgcaa

SEQ ID NO: 650300 - DNA, 13 bp, Homo sapiens
ggacacaaatttt

SEQ ID NO: 650301 - DNA, 19 bp, Homo sapiens
ggacaggcccgcttgctgg

SEQ ID NO: 650302 - DNA, 12 bp, Homo sapiens
ggacataatttc

SEQ ID NO: 650303 - DNA, 11 bp, Homo sapiens
ggacccagtgc

SEQ ID NO: 650304 - DNA, 16 bp, Homo sapiens
ggacccagtgcagaat

SEQ ID NO: 650305 - DNA, 11 bp, Homo sapiens
ggactacacaa

SEQ ID NO: 650306 - DNA, 18 bp, Homo sapiens
ggactagaagattagaaa

SEQ ID NO: 650307 - DNA, 24 bp, Homo sapiens
ggactcatttcattcctaacacag

SEQ ID NO: 650308 - DNA, 23 bp, Homo sapiens
ggactgctacctttcaaagcttg

SEQ ID NO: 650309 - DNA, 20 bp, Homo sapiens
ggactgctattctagagctt

SEQ ID NO: 650310 - DNA, 20 bp, Homo sapiens
ggactgtctttcagatacat

SEQ ID NO: 650311 - DNA, 23 bp, Homo sapiens
ggactgtgaggccatacttgtga

SEQ ID NO: 650312 - DNA, 12 bp, Homo sapiens
ggagaatatgat

SEQ ID NO: 650313 - DNA, 19 bp, Homo sapiens
ggagacggtttccagggag

SEQ ID NO: 650314 - DNA, 22 bp, Homo sapiens
ggagacgtttataaacagaaat

SEQ ID NO: 650315 - DNA, 17 bp, Homo sapiens
ggagaggcaaagaaagg

SEQ ID NO: 650316 - DNA, 18 bp, Homo sapiens
ggagagggcccaggtccc

SEQ ID NO: 650317 - DNA, 22 bp, Homo sapiens
ggagaggtgattctcagggctg

SEQ ID NO: 650318 - DNA, 23 bp, Homo sapiens
ggagatgagttttaggaccagca

SEQ ID NO: 650319 - DNA, 12 bp, Homo sapiens
ggagcagaactg

SEQ ID NO: 650320 - DNA, 17 bp, Homo sapiens
ggagcagggaaggcctg

SEQ ID NO: 650321 - DNA, 17 bp, Homo sapiens
ggagcctggggtgtcct

SEQ ID NO: 650322 - DNA, 15 bp, Homo sapiens
ggagcgcaggcagcg

SEQ ID NO: 650323 - DNA, 19 bp, Homo sapiens
ggagctgtcaccaaggaaa

SEQ ID NO: 650324 - DNA, 17 bp, Homo sapiens
ggaggaggcctgtccca

SEQ ID NO: 650325 - DNA, 20 bp, Homo sapiens
ggaggatgtccctgggccag

SEQ ID NO: 650326 - DNA, 23 bp, Homo sapiens
ggaggcagcatggagagaggcct

SEQ ID NO: 650327 - DNA, 14 bp, Homo sapiens
ggaggcaggcatgg

SEQ ID NO: 650328 - DNA, 22 bp, Homo sapiens
ggaggccgaggtgggcagatca

SEQ ID NO: 650329 - DNA, 19 bp, Homo sapiens
ggaggcctgcgaccctggg

SEQ ID NO: 650330 - DNA, 21 bp, Homo sapiens
ggaggcctgcgaccctggggg

SEQ ID NO: 650331 - DNA, 13 bp, Homo sapiens
ggagggaggcccc

SEQ ID NO: 650332 - DNA, 18 bp, Homo sapiens
ggagggtttgggcagagc

SEQ ID NO: 650333 - DNA, 21 bp, Homo sapiens
ggaggtccctggtcggagagg

SEQ ID NO: 650334 - DNA, 19 bp, Homo sapiens
ggaggtcctttggacagct

SEQ ID NO: 650335 - DNA, 17 bp, Homo sapiens
ggaggtgattccagtga

SEQ ID NO: 650336 - DNA, 14 bp, Homo sapiens
ggaggttgcagtga

SEQ ID NO: 650337 - DNA, 15 bp, Homo sapiens
ggagtcagccaggag

SEQ ID NO: 650338 - DNA, 19 bp, Homo sapiens
ggagtcagccaggagctgt

SEQ ID NO: 650339 - DNA, 17 bp, Homo sapiens
ggagtccctgcaggtga

SEQ ID NO: 650340 - DNA, 16 bp, Homo sapiens
ggagtgctggctcaca

SEQ ID NO: 650341 - DNA, 13 bp, Homo sapiens
ggagtggtgcaga

SEQ ID NO: 650342 - DNA, 22 bp, Homo sapiens
ggagttccttatccctctcttc

SEQ ID NO: 650343 - DNA, 24 bp, Homo sapiens
ggagttccttatccctctcttccc

SEQ ID NO: 650344 - DNA, 20 bp, Homo sapiens
ggatatggcaggactcctgg

SEQ ID NO: 650345 - DNA, 21 bp, Homo sapiens
ggatattttttggtgtgccct

SEQ ID NO: 650346 - DNA, 22 bp, Homo sapiens
ggatctctgagaccacagaggc

SEQ ID NO: 650347 - DNA, 19 bp, Homo sapiens
ggatgacaggcgcctgcca

SEQ ID NO: 650348 - DNA, 19 bp, Homo sapiens
ggatgccactcctccctcc

SEQ ID NO: 650349 - DNA, 14 bp, Homo sapiens
ggatggcttgtcta

SEQ ID NO: 650350 - DNA, 22 bp, Homo sapiens
ggatgtccctgggccagggtct

SEQ ID NO: 650351 - DNA, 18 bp, Homo sapiens
ggattttttactgccctt

SEQ ID NO: 650352 - DNA, 15 bp, Homo sapiens
ggcaaagaggatccg

SEQ ID NO: 650353 - DNA, 18 bp, Homo sapiens
ggcaaagtttaaatgtat

SEQ ID NO: 650354 - DNA, 24 bp, Homo sapiens
ggcaaagtttaaatgtattttaca

SEQ ID NO: 650355 - DNA, 18 bp, Homo sapiens
ggcaattagtgtgacagt

SEQ ID NO: 650356 - DNA, 15 bp, Homo sapiens
ggcacagaccaggcc

SEQ ID NO: 650357 - DNA, 16 bp, Homo sapiens
ggcacagaccaggcct

SEQ ID NO: 650358 - DNA, 17 bp, Homo sapiens
ggcacagaccaggcctt

SEQ ID NO: 650359 - DNA, 15 bp, Homo sapiens
ggcacagctgggagc

SEQ ID NO: 650360 - DNA, 20 bp, Homo sapiens
ggcacaggaggcaggcatgg

SEQ ID NO: 650361 - DNA, 18 bp, Homo sapiens
ggcacatgccacctggca

SEQ ID NO: 650362 - DNA, 19 bp, Homo sapiens
ggcagaagagaaaggactc

SEQ ID NO: 650363 - DNA, 12 bp, Homo sapiens
ggcagacacaac

SEQ ID NO: 650364 - DNA, 17 bp, Homo sapiens
ggcagacagcaggcagc

SEQ ID NO: 650365 - DNA, 23 bp, Homo sapiens
ggcagacagcaggcagcgccaag

SEQ ID NO: 650366 - DNA, 19 bp, Homo sapiens
gtggccagaggtgtcaccc

SEQ ID NO: 650367 - DNA, 20 bp, Homo sapiens
gtggccatcatcctcccgcc

SEQ ID NO: 650368 - DNA, 23 bp, Homo sapiens
gtggcctcagctgaatgcctcct

SEQ ID NO: 650369 - DNA, 12 bp, Homo sapiens
gtggctaggcag

SEQ ID NO: 650370 - DNA, 14 bp, Homo sapiens
gtgggaggaggcct

SEQ ID NO: 650371 - DNA, 13 bp, Homo sapiens
gtgggccagggct

SEQ ID NO: 650372 - DNA, 19 bp, Homo sapiens
gtgggccagggctgccctg

SEQ ID NO: 650373 - DNA, 12 bp, Homo sapiens
gtgggcccaccc

SEQ ID NO: 650374 - DNA, 19 bp, Homo sapiens
gtgggctacatgctggggt

SEQ ID NO: 650375 - DNA, 17 bp, Homo sapiens
gtgggctggacttctac

SEQ ID NO: 650376 - DNA, 13 bp, Homo sapiens
gtggggacttctg

SEQ ID NO: 650377 - DNA, 15 bp, Homo sapiens
gtggggcagggagct

SEQ ID NO: 650378 - DNA, 13 bp, Homo sapiens
gtggggcctgtgg

SEQ ID NO: 650379 - DNA, 17 bp, Homo sapiens
gtggggctgcaggcagg

SEQ ID NO: 650380 - DNA, 13 bp, Homo sapiens
gtggggggtcctt

SEQ ID NO: 650381 - DNA, 14 bp, Homo sapiens
gtgggtgtagccag

SEQ ID NO: 650382 - DNA, 15 bp, Homo sapiens
gtggtaatctacacc

SEQ ID NO: 650383 - DNA, 14 bp, Homo sapiens
gtggtacttgatca

SEQ ID NO: 650384 - DNA, 22 bp, Homo sapiens
gtggtcataaaatagaataatt

SEQ ID NO: 650385 - DNA, 11 bp, Homo sapiens
gtggtctcagg

SEQ ID NO: 650386 - DNA, 12 bp, Homo sapiens
gtggtctcagga

SEQ ID NO: 650387 - DNA, 21 bp, Homo sapiens
gtggtctcttcttggggccca

SEQ ID NO: 650388 - DNA, 23 bp, Homo sapiens
gtggtctcttcttggggcccagt

SEQ ID NO: 650389 - DNA, 16 bp, Homo sapiens
gtggtcttgtggttgt

SEQ ID NO: 650390 - DNA, 14 bp, Homo sapiens
gtggtgcagacaga

SEQ ID NO: 650391 - DNA, 16 bp, Homo sapiens
gtggttcctctgctca

SEQ ID NO: 650392 - DNA, 12 bp, Homo sapiens
gtggttcttaaa

SEQ ID NO: 650393 - DNA, 19 bp, Homo sapiens
gtggttcttaaatgtttat

SEQ ID NO: 650394 - DNA, 14 bp, Homo sapiens
gtgtaaaaaatgtc

SEQ ID NO: 650395 - DNA, 16 bp, Homo sapiens
gtgtaaacttgtacat

SEQ ID NO: 650396 - DNA, 17 bp, Homo sapiens
gtgtaaagatttataca

SEQ ID NO: 650397 - DNA, 18 bp, Homo sapiens
gtgtacaaatacatgtgt

SEQ ID NO: 650398 - DNA, 21 bp, Homo sapiens
gtgtacctcctctcagtgttt

SEQ ID NO: 650399 - DNA, 22 bp, Homo sapiens
gtgtaggttatctttttaaaaa

SEQ ID NO: 650400 - DNA, 14 bp, Homo sapiens
gtgtataatataaa

SEQ ID NO: 650401 - DNA, 14 bp, Homo sapiens
gtgtatataatttt

SEQ ID NO: 650402 - DNA, 15 bp, Homo sapiens
gtgtatataatttta

SEQ ID NO: 650403 - DNA, 21 bp, Homo sapiens
gtgtatattccttttaaagaa

SEQ ID NO: 650404 - DNA, 21 bp, Homo sapiens
gtgtatttaaaaaaaagaaac

SEQ ID NO: 650405 - DNA, 19 bp, Homo sapiens
gtgtatttattttacagct

SEQ ID NO: 650406 - DNA, 15 bp, Homo sapiens
gtgtccacctgtggg

SEQ ID NO: 650407 - DNA, 14 bp, Homo sapiens
gtgtcccaggcagg

SEQ ID NO: 650408 - DNA, 21 bp, Homo sapiens
gtgtccccgctgctgtgcaac

SEQ ID NO: 650409 - DNA, 18 bp, Homo sapiens
gtgtctcactaaagcatg

SEQ ID NO: 650410 - DNA, 18 bp, Homo sapiens
gtgtctgacttttgttaa

SEQ ID NO: 650411 - DNA, 19 bp, Homo sapiens
gtgtctgggctcaagcttt

SEQ ID NO: 650412 - DNA, 23 bp, Homo sapiens
gtgtctgggctcaagctttcccg

SEQ ID NO: 650413 - DNA, 23 bp, Homo sapiens
gtgtgaacctacctgccttggag

SEQ ID NO: 650414 - DNA, 17 bp, Homo sapiens
gtgtgacagtttccaaa

SEQ ID NO: 650415 - DNA, 19 bp, Homo sapiens
gtgtgctctttttttaaaa

SEQ ID NO: 650416 - DNA, 13 bp, Homo sapiens
gtgtggccaggct

SEQ ID NO: 650417 - DNA, 19 bp, Homo sapiens
gtgtggcctgtgccagcac

SEQ ID NO: 650418 - DNA, 15 bp, Homo sapiens
gtgtggtggcctcag

SEQ ID NO: 650419 - DNA, 21 bp, Homo sapiens
gtgtgtatgactaaagagaga

SEQ ID NO: 650420 - DNA, 13 bp, Homo sapiens
gtgtgtgtgtgtg

SEQ ID NO: 650421 - DNA, 15 bp, Homo sapiens
gtgtgtgtgtgtgca

SEQ ID NO: 650422 - DNA, 21 bp, Homo sapiens
gtgtgttcgttgcacagctgt

SEQ ID NO: 650423 - DNA, 14 bp, Homo sapiens
gtgttaggtcaata

SEQ ID NO: 650424 - DNA, 14 bp, Homo sapiens
gtgttcaatatcag

SEQ ID NO: 650425 - DNA, 18 bp, Homo sapiens
gtgttcagctctttccaa

SEQ ID NO: 650426 - DNA, 20 bp, Homo sapiens
gtgttcagctctttccaaat

SEQ ID NO: 650427 - DNA, 21 bp, Homo sapiens
gtgttcagctctttccaaatt

SEQ ID NO: 650428 - DNA, 17 bp, Homo sapiens
gtgttcctcagtagctt

SEQ ID NO: 650429 - DNA, 17 bp, Homo sapiens
gtgtttgcttgaatgct

SEQ ID NO: 650430 - DNA, 17 bp, Homo sapiens
gttaaacccttctgtct

SEQ ID NO: 650431 - DNA, 13 bp, Homo sapiens
gttaaactgagag

SEQ ID NO: 650432 - DNA, 18 bp, Homo sapiens
gttaaaggtgaacattgg

SEQ ID NO: 650433 - DNA, 19 bp, Homo sapiens
gttaaattcagtaatgcag

SEQ ID NO: 650434 - DNA, 16 bp, Homo sapiens
gttaatacaaggtata

SEQ ID NO: 650435 - DNA, 23 bp, Homo sapiens
gttaatgttatatcatatgtata

SEQ ID NO: 650436 - DNA, 21 bp, Homo sapiens
gttaatttttcttagtgttgt

SEQ ID NO: 650437 - DNA, 22 bp, Homo sapiens
gttacagagacctatgtaagaa

SEQ ID NO: 650438 - DNA, 20 bp, Homo sapiens
gttacatattatatgttcta

SEQ ID NO: 650439 - DNA, 21 bp, Homo sapiens
gttaccactcttttgctgtgc

SEQ ID NO: 650440 - DNA, 15 bp, Homo sapiens
gttacccaggctgga

SEQ ID NO: 650441 - DNA, 12 bp, Homo sapiens
gttactattttc

SEQ ID NO: 650442 - DNA, 16 bp, Homo sapiens
gttagattaagaaata

SEQ ID NO: 650443 - DNA, 17 bp, Homo sapiens
gttagctgaagaattga

SEQ ID NO: 650444 - DNA, 20 bp, Homo sapiens
gttaggaggacaaaaggaat

SEQ ID NO: 650445 - DNA, 13 bp, Homo sapiens
gttagtggcaccg

SEQ ID NO: 650446 - DNA, 17 bp, Homo sapiens
gttatatataataaata

SEQ ID NO: 650447 - DNA, 16 bp, Homo sapiens
gttatatcatatgtat

SEQ ID NO: 650448 - DNA, 20 bp, Homo sapiens
gttatgatttccttcaatgt

SEQ ID NO: 650449 - DNA, 16 bp, Homo sapiens
gttatggtgatgactt

SEQ ID NO: 650450 - DNA, 17 bp, Homo sapiens
gttatggtgatgactta

SEQ ID NO: 650451 - DNA, 16 bp, Homo sapiens
gttatgtttgaatgaa

SEQ ID NO: 650452 - DNA, 15 bp, Homo sapiens
gttattcaaatttga

SEQ ID NO: 650453 - DNA, 16 bp, Homo sapiens
gttattcaaatttgat

SEQ ID NO: 650454 - DNA, 16 bp, Homo sapiens
gttatttgcacactgc

SEQ ID NO: 650455 - DNA, 18 bp, Homo sapiens
gttattttgatgtaaaga

SEQ ID NO: 650456 - DNA, 20 bp, Homo sapiens
gttattttgatgtaaagatg

SEQ ID NO: 650457 - DNA, 14 bp, Homo sapiens
gttcaaaaagatat

SEQ ID NO: 650458 - DNA, 23 bp, Homo sapiens
gttcaaagccacattatttctag

SEQ ID NO: 650459 - DNA, 12 bp, Homo sapiens
gttcaatatcag

SEQ ID NO: 650460 - DNA, 21 bp, Homo sapiens
gttcaatatcagctttgataa

SEQ ID NO: 650461 - DNA, 16 bp, Homo sapiens
gttcacattagaatta

SEQ ID NO: 650462 - DNA, 17 bp, Homo sapiens
gttcagacacagctctt

SEQ ID NO: 650463 - DNA, 18 bp, Homo sapiens
gttcagctctttccaaat

SEQ ID NO: 650464 - DNA, 14 bp, Homo sapiens
gttcattttaaatg

SEQ ID NO: 650465 - DNA, 13 bp, Homo sapiens
gttccactgagac

SEQ ID NO: 650466 - DNA, 20 bp, Homo sapiens
gttccactgcaaataaagcc

SEQ ID NO: 650467 - DNA, 21 bp, Homo sapiens
gttccactgcaaataaagcct

SEQ ID NO: 650468 - DNA, 19 bp, Homo sapiens
gttccttttttgtatatta

SEQ ID NO: 650469 - DNA, 17 bp, Homo sapiens
gttcgatacctggagca

SEQ ID NO: 650470 - DNA, 22 bp, Homo sapiens
gttctaacagtgaagttttact

SEQ ID NO: 650471 - DNA, 17 bp, Homo sapiens
gttctagcagtccccag

SEQ ID NO: 650472 - DNA, 21 bp, Homo sapiens
gttctagcagtccccagctga

SEQ ID NO: 650473 - DNA, 15 bp, Homo sapiens
gttctcaatttcatt

SEQ ID NO: 650474 - DNA, 20 bp, Homo sapiens
tacacactgtcatgcttcat

SEQ ID NO: 650475 - DNA, 17 bp, Homo sapiens
tacacatgttgccttgc

SEQ ID NO: 650476 - DNA, 14 bp, Homo sapiens
tacacattagattt

SEQ ID NO: 650477 - DNA, 23 bp, Homo sapiens
tacacattagattttattttact

SEQ ID NO: 650478 - DNA, 17 bp, Homo sapiens
tacaccaatgaaaacat

SEQ ID NO: 650479 - DNA, 14 bp, Homo sapiens
tacaccttgccttg

SEQ ID NO: 650480 - DNA, 16 bp, Homo sapiens
tacactgagcagggag

SEQ ID NO: 650481 - DNA, 16 bp, Homo sapiens
tacagaaatatccatg

SEQ ID NO: 650482 - DNA, 19 bp, Homo sapiens
tacagactccatctcttct

SEQ ID NO: 650483 - DNA, 15 bp, Homo sapiens
tacagctatatttga

SEQ ID NO: 650484 - DNA, 17 bp, Homo sapiens
tacagctatatttgatt

SEQ ID NO: 650485 - DNA, 13 bp, Homo sapiens
tacagctcagtaa

SEQ ID NO: 650486 - DNA, 14 bp, Homo sapiens
tacaggcaccgaga

SEQ ID NO: 650487 - DNA, 19 bp, Homo sapiens
tacaggcaccgagaatgtt

SEQ ID NO: 650488 - DNA, 17 bp, Homo sapiens
tacagggatttctgttt

SEQ ID NO: 650489 - DNA, 19 bp, Homo sapiens
tacagggtaactgtgctga

SEQ ID NO: 650490 - DNA, 20 bp, Homo sapiens
tacagggtaactgtgctgaa

SEQ ID NO: 650491 - DNA, 18 bp, Homo sapiens
tacagtacacagatacct

SEQ ID NO: 650492 - DNA, 15 bp, Homo sapiens
tacagtatagatttt

SEQ ID NO: 650493 - DNA, 18 bp, Homo sapiens
tacagtgactccctggga

SEQ ID NO: 650494 - DNA, 16 bp, Homo sapiens
tacataactcctgtcc

SEQ ID NO: 650495 - DNA, 17 bp, Homo sapiens
tacatacgatttaaggt

SEQ ID NO: 650496 - DNA, 18 bp, Homo sapiens
tacatatgctgatctttt

SEQ ID NO: 650497 - DNA, 19 bp, Homo sapiens
tacatattaggaaaatatg

SEQ ID NO: 650498 - DNA, 23 bp, Homo sapiens
tacatattaggaaaatatgggtt

SEQ ID NO: 650499 - DNA, 16 bp, Homo sapiens
tacatattttttgtat

SEQ ID NO: 650500 - DNA, 17 bp, Homo sapiens
tacatcaagtccatctg

SEQ ID NO: 650501 - DNA, 21 bp, Homo sapiens
tacatcaagtccatctgacaa

SEQ ID NO: 650502 - DNA, 23 bp, Homo sapiens
tacatccagcttctcatgttaaa

SEQ ID NO: 650503 - DNA, 13 bp, Homo sapiens
tacatctggctgg

SEQ ID NO: 650504 - DNA, 15 bp, Homo sapiens
tacatctggctggaa

SEQ ID NO: 650505 - DNA, 14 bp, Homo sapiens
tacatgctggggtc

SEQ ID NO: 650506 - DNA, 15 bp, Homo sapiens
tacatgtgatacatt

SEQ ID NO: 650507 - DNA, 19 bp, Homo sapiens
tacatgtgatacatttttt

SEQ ID NO: 650508 - DNA, 15 bp, Homo sapiens
tacatttaaaacatt

SEQ ID NO: 650509 - DNA, 19 bp, Homo sapiens
tacatttaaaacattaaaa

SEQ ID NO: 650510 - DNA, 17 bp, Homo sapiens
tacatttaaaattgcta

SEQ ID NO: 650511 - DNA, 23 bp, Homo sapiens
tacatttatttatccagaaaact

SEQ ID NO: 650512 - DNA, 23 bp, Homo sapiens
tacatttgtaagtgtaaaaaatg

SEQ ID NO: 650513 - DNA, 15 bp, Homo sapiens
taccaaaaaaaggaa

SEQ ID NO: 650514 - DNA, 17 bp, Homo sapiens
taccaaaaaaaggaagg

SEQ ID NO: 650515 - DNA, 21 bp, Homo sapiens
taccagattctgcctatgtaa

SEQ ID NO: 650516 - DNA, 20 bp, Homo sapiens
taccagggactatctttgct

SEQ ID NO: 650517 - DNA, 20 bp, Homo sapiens
taccattcagatcactgaat

SEQ ID NO: 650518 - DNA, 19 bp, Homo sapiens
taccatttagtaagaatac

SEQ ID NO: 650519 - DNA, 23 bp, Homo sapiens
taccatttcctcagcttatctct

SEQ ID NO: 650520 - DNA, 16 bp, Homo sapiens
tacccatagacatgaa

SEQ ID NO: 650521 - DNA, 22 bp, Homo sapiens
tacccgatttgtttatttgcaa

SEQ ID NO: 650522 - DNA, 12 bp, Homo sapiens
taccctgggtgt

SEQ ID NO: 650523 - DNA, 19 bp, Homo sapiens
tacccttttcccccttccc

SEQ ID NO: 650524 - DNA, 17 bp, Homo sapiens
tacctactattggccct

SEQ ID NO: 650525 - DNA, 14 bp, Homo sapiens
tacctcctctcagt

SEQ ID NO: 650526 - DNA, 23 bp, Homo sapiens
tacctctcaagctagtgtttcta

SEQ ID NO: 650527 - DNA, 20 bp, Homo sapiens
tacctctctgtcccttgctg

SEQ ID NO: 650528 - DNA, 21 bp, Homo sapiens
tacctctctgtcccttgctgt

SEQ ID NO: 650529 - DNA, 13 bp, Homo sapiens
tacctgacctaaa

SEQ ID NO: 650530 - DNA, 19 bp, Homo sapiens
tacctgccctaagggactt

SEQ ID NO: 650531 - DNA, 18 bp, Homo sapiens
tacctgctggaagaattc

SEQ ID NO: 650532 - DNA, 23 bp, Homo sapiens
tacctggtccccactgctgagct

SEQ ID NO: 650533 - DNA, 21 bp, Homo sapiens
tacctggtgagtaacttagaa

SEQ ID NO: 650534 - DNA, 22 bp, Homo sapiens
tacctggtgagtaacttagaaa

SEQ ID NO: 650535 - DNA, 15 bp, Homo sapiens
taccttcaatactta

SEQ ID NO: 650536 - DNA, 14 bp, Homo sapiens
tacctttcaaagct

SEQ ID NO: 650537 - DNA, 21 bp, Homo sapiens
taccttttctcttttctttct

SEQ ID NO: 650538 - DNA, 16 bp, Homo sapiens
taccttttttttttct

SEQ ID NO: 650539 - DNA, 22 bp, Homo sapiens
tacgaaatacgttaggaggaca

SEQ ID NO: 650540 - DNA, 15 bp, Homo sapiens
tacgtagctctctta

SEQ ID NO: 650541 - DNA, 17 bp, Homo sapiens
tactaataaatataatt

SEQ ID NO: 650542 - DNA, 14 bp, Homo sapiens
tactaatgatgttt

SEQ ID NO: 650543 - DNA, 16 bp, Homo sapiens
tactaatgatgttttc

SEQ ID NO: 650544 - DNA, 15 bp, Homo sapiens
tactaattttacaca

SEQ ID NO: 650545 - DNA, 18 bp, Homo sapiens
tactaattttacacatta

SEQ ID NO: 650546 - DNA, 18 bp, Homo sapiens
tactacagctatatttga

SEQ ID NO: 650547 - DNA, 19 bp, Homo sapiens
tactacagctatatttgat

SEQ ID NO: 650548 - DNA, 14 bp, Homo sapiens
tactacctgtaatg

SEQ ID NO: 650549 - DNA, 16 bp, Homo sapiens
tactatcctgtaaata

SEQ ID NO: 650550 - DNA, 19 bp, Homo sapiens
tactattcaggtaacacta

SEQ ID NO: 650551 - DNA, 19 bp, Homo sapiens
tactatttaagatgtgaaa

SEQ ID NO: 650552 - DNA, 18 bp, Homo sapiens
tactattttctacaatta

SEQ ID NO: 650553 - DNA, 13 bp, Homo sapiens
tactcatgcgtga

SEQ ID NO: 650554 - DNA, 15 bp, Homo sapiens
tactccataaacaga

SEQ ID NO: 650555 - DNA, 13 bp, Homo sapiens
tactcccccacca

SEQ ID NO: 650556 - DNA, 19 bp, Homo sapiens
tactcccccaccactcagg

SEQ ID NO: 650557 - DNA, 15 bp, Homo sapiens
tactcctagaagaac

SEQ ID NO: 650558 - DNA, 16 bp, Homo sapiens
tactctacttacagtt

SEQ ID NO: 650559 - DNA, 21 bp, Homo sapiens
tactctggggtgctgcctgaa

SEQ ID NO: 650560 - DNA, 12 bp, Homo sapiens
tactctttgaaa

SEQ ID NO: 650561 - DNA, 18 bp, Homo sapiens
tactgaataatatcaaat

SEQ ID NO: 650562 - DNA, 16 bp, Homo sapiens
tactgacatttcttct

SEQ ID NO: 650563 - DNA, 22 bp, Homo sapiens
tactgattattttcttcatcca

SEQ ID NO: 650564 - DNA, 16 bp, Homo sapiens
tactgcactccagcct

SEQ ID NO: 650565 - DNA, 17 bp, Homo sapiens
tactgcactccagcctg

SEQ ID NO: 650566 - DNA, 15 bp, Homo sapiens
tactgcctgaataaa

SEQ ID NO: 650567 - DNA, 20 bp, Homo sapiens
tactgcctgaataaagagcc

SEQ ID NO: 650568 - DNA, 16 bp, Homo sapiens
tactgccttgaaaaat

SEQ ID NO: 650569 - DNA, 19 bp, Homo sapiens
tactgccttgaaaaatgac

SEQ ID NO: 650570 - DNA, 17 bp, Homo sapiens
tactggaattcttctgc

SEQ ID NO: 650571 - DNA, 23 bp, Homo sapiens
tactgggccctgagtctgggcag

SEQ ID NO: 650572 - DNA, 16 bp, Homo sapiens
tactgggtttcaagaa

SEQ ID NO: 650573 - DNA, 13 bp, Homo sapiens
tactgtactatcc

SEQ ID NO: 650574 - DNA, 18 bp, Homo sapiens
tactgtctgttatgattt

SEQ ID NO: 650575 - DNA, 19 bp, Homo sapiens
tactgtgtctcatggattt

SEQ ID NO: 650576 - DNA, 18 bp, Homo sapiens
tactgttactgggccctg

SEQ ID NO: 650577 - DNA, 14 bp, Homo sapiens
tacttaaatggtaa

SEQ ID NO: 650578 - DNA, 15 bp, Homo sapiens
tacttattacagtct

SEQ ID NO: 650579 - DNA, 12 bp, Homo sapiens
tacttccttatg

SEQ ID NO: 650580 - DNA, 12 bp, Homo sapiens
tacttctaagag

SEQ ID NO: 650581 - DNA, 23 bp, Homo sapiens
tacttgaagtctaaaagcagaaa

SEQ ID NO: 650582 - DNA, 18 bp, Homo sapiens
tacttgaataaccatctg

SEQ ID NO: 650583 - DNA, 11 bp, Homo sapiens
tacttgtgaaa

SEQ ID NO: 650584 - DNA, 22 bp, Homo sapiens
tactttaaaaagaaattaatat

SEQ ID NO: 650585 - DNA, 12 bp, Homo sapiens
tactttaacatt

SEQ ID NO: 650586 - DNA, 20 bp, Homo sapiens
tactttaacattttggaaat

SEQ ID NO: 650587 - DNA, 22 bp, Homo sapiens
tactttaattactggaattctt

SEQ ID NO: 650588 - DNA, 15 bp, Homo sapiens
tactttactgcctga

SEQ ID NO: 650589 - DNA, 14 bp, Homo sapiens
tactttatttctga

SEQ ID NO: 650590 - DNA, 15 bp, Homo sapiens
tactttctatgtgac

SEQ ID NO: 650591 - DNA, 17 bp, Homo sapiens
tactttctatgtgacat

SEQ ID NO: 650592 - DNA, 16 bp, Homo sapiens
tactttgtattttgat

SEQ ID NO: 650593 - DNA, 15 bp, Homo sapiens
tactttgtgcattct

SEQ ID NO: 650594 - DNA, 20 bp, Homo sapiens
tataggtgatgtttgctctt

SEQ ID NO: 650595 - DNA, 18 bp, Homo sapiens
tatagtctaagactatat

SEQ ID NO: 650596 - DNA, 16 bp, Homo sapiens
tatagttaaactgaga

SEQ ID NO: 650597 - DNA, 13 bp, Homo sapiens
tatagttttttct

SEQ ID NO: 650598 - DNA, 21 bp, Homo sapiens
tatataaaacttaaaaacaag

SEQ ID NO: 650599 - DNA, 14 bp, Homo sapiens
tatataattttatg

SEQ ID NO: 650600 - DNA, 13 bp, Homo sapiens
tatatacttgcaa

SEQ ID NO: 650601 - DNA, 16 bp, Homo sapiens
tatatactttgccact

SEQ ID NO: 650602 - DNA, 16 bp, Homo sapiens
tatatataacatatat

SEQ ID NO: 650603 - DNA, 15 bp, Homo sapiens
tatatataataaata

SEQ ID NO: 650604 - DNA, 19 bp, Homo sapiens
tatatatggatcagaggag

SEQ ID NO: 650605 - DNA, 13 bp, Homo sapiens
tatatcattctgg

SEQ ID NO: 650606 - DNA, 13 bp, Homo sapiens
tatatcattttaa

SEQ ID NO: 650607 - DNA, 14 bp, Homo sapiens
tatatcattttaaa

SEQ ID NO: 650608 - DNA, 20 bp, Homo sapiens
tatatcattttaaaatgtct

SEQ ID NO: 650609 - DNA, 21 bp, Homo sapiens
tatatcattttaaaatgtctt

SEQ ID NO: 650610 - DNA, 14 bp, Homo sapiens
tatatggatcagag

SEQ ID NO: 650611 - DNA, 22 bp, Homo sapiens
tatatgtgacactgcagcagaa

SEQ ID NO: 650612 - DNA, 12 bp, Homo sapiens
tatattaaaaca

SEQ ID NO: 650613 - DNA, 20 bp, Homo sapiens
tatattaaaacaataatgca

SEQ ID NO: 650614 - DNA, 22 bp, Homo sapiens
tatattaaacatacataataca

SEQ ID NO: 650615 - DNA, 19 bp, Homo sapiens
tatattcaaattatgtata

SEQ ID NO: 650616 - DNA, 15 bp, Homo sapiens
tatattcataaagtt

SEQ ID NO: 650617 - DNA, 20 bp, Homo sapiens
tatattccttttaaagaagc

SEQ ID NO: 650618 - DNA, 14 bp, Homo sapiens
tatatttgaaatag

SEQ ID NO: 650619 - DNA, 21 bp, Homo sapiens
tatatttgaaatagtatacat

SEQ ID NO: 650620 - DNA, 15 bp, Homo sapiens
tatatttgttttatg

SEQ ID NO: 650621 - DNA, 15 bp, Homo sapiens
tatattttatattac

SEQ ID NO: 650622 - DNA, 15 bp, Homo sapiens
tatcaaatctaccac

SEQ ID NO: 650623 - DNA, 16 bp, Homo sapiens
tatcaagcaacattct

SEQ ID NO: 650624 - DNA, 14 bp, Homo sapiens
tatcacacaatata

SEQ ID NO: 650625 - DNA, 15 bp, Homo sapiens
tatcacacaatatag

SEQ ID NO: 650626 - DNA, 14 bp, Homo sapiens
tatcactaaaagca

SEQ ID NO: 650627 - DNA, 21 bp, Homo sapiens
tatcactaaaagcatgaattg

SEQ ID NO: 650628 - DNA, 12 bp, Homo sapiens
tatcagtacctc

SEQ ID NO: 650629 - DNA, 17 bp, Homo sapiens
tatcagtgtaagccctg

SEQ ID NO: 650630 - DNA, 22 bp, Homo sapiens
tatcataaacattttacatgca

SEQ ID NO: 650631 - DNA, 13 bp, Homo sapiens
tatcataaagcat

SEQ ID NO: 650632 - DNA, 16 bp, Homo sapiens
tatcattttaaaatgt

SEQ ID NO: 650633 - DNA, 18 bp, Homo sapiens
tatcattttaaaatgtct

SEQ ID NO: 650634 - DNA, 19 bp, Homo sapiens
tatcattttaaaatgtctt

SEQ ID NO: 650635 - DNA, 12 bp, Homo sapiens
tatccaaggaaa

SEQ ID NO: 650636 - DNA, 22 bp, Homo sapiens
tatccacaattattggcaaagt

SEQ ID NO: 650637 - DNA, 23 bp, Homo sapiens
tatccataggtttctctccctcc

SEQ ID NO: 650638 - DNA, 13 bp, Homo sapiens
tatccccatctcc

SEQ ID NO: 650639 - DNA, 22 bp, Homo sapiens
tatccccatctccctgcctggc

SEQ ID NO: 650640 - DNA, 16 bp, Homo sapiens
tatcctacagtacaat

SEQ ID NO: 650641 - DNA, 13 bp, Homo sapiens
tatcctgagccat

SEQ ID NO: 650642 - DNA, 17 bp, Homo sapiens
tatcctggccctggggg

SEQ ID NO: 650643 - DNA, 20 bp, Homo sapiens
tatcctgggagcactgcgtt

SEQ ID NO: 650644 - DNA, 16 bp, Homo sapiens
tatccttacaatgtga

SEQ ID NO: 650645 - DNA, 18 bp, Homo sapiens
tatccttacaatgtgaat

SEQ ID NO: 650646 - DNA, 19 bp, Homo sapiens
tatcggattactgaattgt

SEQ ID NO: 650647 - DNA, 14 bp, Homo sapiens
tatctatcttccaa

SEQ ID NO: 650648 - DNA, 22 bp, Homo sapiens
tatctcaatgaaccataaattc

SEQ ID NO: 650649 - DNA, 16 bp, Homo sapiens
tatctccgttccatct

SEQ ID NO: 650650 - DNA, 16 bp, Homo sapiens
tatctgattttgtgca

SEQ ID NO: 650651 - DNA, 22 bp, Homo sapiens
tatctgattttgtgcaaaagct

SEQ ID NO: 650652 - DNA, 17 bp, Homo sapiens
tatctgggattattctt

SEQ ID NO: 650653 - DNA, 18 bp, Homo sapiens
tatctgggattattcttt

SEQ ID NO: 650654 - DNA, 22 bp, Homo sapiens
tatctgggattattctttgaaa

SEQ ID NO: 650655 - DNA, 16 bp, Homo sapiens
tatctgggttaagtgt

SEQ ID NO: 650656 - DNA, 17 bp, Homo sapiens
tatctgggttaagtgtt

SEQ ID NO: 650657 - DNA, 16 bp, Homo sapiens
tatctggttatatcat

SEQ ID NO: 650658 - DNA, 18 bp, Homo sapiens
tatctttttaaaaactct

SEQ ID NO: 650659 - DNA, 22 bp, Homo sapiens
tatctttttaaaaactcttcag

SEQ ID NO: 650660 - DNA, 23 bp, Homo sapiens
tatctttttaaaaactcttcagt

SEQ ID NO: 650661 - DNA, 15 bp, Homo sapiens
tatgaaagaggcagc

SEQ ID NO: 650662 - DNA, 21 bp, Homo sapiens
tatgaagaatacccaggaaga

SEQ ID NO: 650663 - DNA, 17 bp, Homo sapiens
tatgaagccaactgaca

SEQ ID NO: 650664 - DNA, 18 bp, Homo sapiens
tatgaagccaactgacaa

SEQ ID NO: 650665 - DNA, 19 bp, Homo sapiens
tatgaagtgcgtgaatgta

SEQ ID NO: 650666 - DNA, 13 bp, Homo sapiens
tatgaatactttg

SEQ ID NO: 650667 - DNA, 15 bp, Homo sapiens
tatgaatactttgca

SEQ ID NO: 650668 - DNA, 16 bp, Homo sapiens
tatgacggaagaacat

SEQ ID NO: 650669 - DNA, 20 bp, Homo sapiens
tatgacggaagaacatagaa

SEQ ID NO: 650670 - DNA, 20 bp, Homo sapiens
tatgactaaagagagaatgt

SEQ ID NO: 650671 - DNA, 21 bp, Homo sapiens
tatgactaaagagagaatgta

SEQ ID NO: 650672 - DNA, 19 bp, Homo sapiens
tatgagaatataccttatt

SEQ ID NO: 650673 - DNA, 21 bp, Homo sapiens
tatgagaatataccttattta

SEQ ID NO: 650674 - DNA, 16 bp, Homo sapiens
tatgagccagacaaat

SEQ ID NO: 650675 - DNA, 15 bp, Homo sapiens
tatgataaaacactg

SEQ ID NO: 650676 - DNA, 19 bp, Homo sapiens
tatgatatttcttgctttc

SEQ ID NO: 650677 - DNA, 13 bp, Homo sapiens
tatgatcagtgtt

SEQ ID NO: 650678 - DNA, 18 bp, Homo sapiens
tatgatctcttctggtgt

SEQ ID NO: 650679 - DNA, 14 bp, Homo sapiens
tatgatttccttca

SEQ ID NO: 650680 - DNA, 11 bp, Homo sapiens
tatgcaaaagg

SEQ ID NO: 650681 - DNA, 15 bp, Homo sapiens
tatgcaaaatttaga

SEQ ID NO: 650682 - DNA, 16 bp, Homo sapiens
tatgcaaaatttagaa

SEQ ID NO: 650683 - DNA, 12 bp, Homo sapiens
tatgcactttta

SEQ ID NO: 650684 - DNA, 20 bp, Homo sapiens
tatgcacttttagaaatgca

SEQ ID NO: 650685 - DNA, 15 bp, Homo sapiens
tatgcagtattcttg

SEQ ID NO: 650686 - DNA, 16 bp, Homo sapiens
tatgcatattcaatgt

SEQ ID NO: 650687 - DNA, 16 bp, Homo sapiens
tatgcattatatcaaa

SEQ ID NO: 650688 - DNA, 13 bp, Homo sapiens
tatgccttaattt

SEQ ID NO: 650689 - DNA, 16 bp, Homo sapiens
tatgccttaatttaga

SEQ ID NO: 650690 - DNA, 21 bp, Homo sapiens
tatgccttaatttagaaactg

SEQ ID NO: 650691 - DNA, 23 bp, Homo sapiens
tatgccttaatttagaaactgaa

SEQ ID NO: 650692 - DNA, 13 bp, Homo sapiens
tatgctatttctg

SEQ ID NO: 650693 - DNA, 15 bp, Homo sapiens
tatgctgatcatcgc

SEQ ID NO: 650694 - DNA, 20 bp, Homo sapiens
tatgctgatcatcgccagag

SEQ ID NO: 650695 - DNA, 22 bp, Homo sapiens
tatgctgatcatcgccagaggt

SEQ ID NO: 650696 - DNA, 13 bp, Homo sapiens
tatgctttattaa

SEQ ID NO: 650697 - DNA, 17 bp, Homo sapiens
tatggataaagatgaga

SEQ ID NO: 650698 - DNA, 21 bp, Homo sapiens
tatggatttaagagtatttta

SEQ ID NO: 650699 - DNA, 17 bp, Homo sapiens
tatggcaggactcctgg

SEQ ID NO: 650700 - DNA, 18 bp, Homo sapiens
tatggcaggactcctggc

SEQ ID NO: 650701 - DNA, 21 bp, Homo sapiens
tatggcaggactcctggcagg

SEQ ID NO: 650702 - DNA, 22 bp, Homo sapiens
tatggcaggactcctggcaggg

SEQ ID NO: 650703 - DNA, 14 bp, Homo sapiens
tatggcatttctat

SEQ ID NO: 650704 - DNA, 22 bp, Homo sapiens
tatggcttatttctatgacaaa

SEQ ID NO: 650705 - DNA, 15 bp, Homo sapiens
tatgggcccctggca

SEQ ID NO: 650706 - DNA, 23 bp, Homo sapiens
tatgggcttttggggagccagaa

SEQ ID NO: 650707 - DNA, 20 bp, Homo sapiens
tatgggtgggattttgcaaa

SEQ ID NO: 650708 - DNA, 15 bp, Homo sapiens
tatggtgatgactta

SEQ ID NO: 650709 - DNA, 18 bp, Homo sapiens
tatggtgctgctctgtgt

SEQ ID NO: 650710 - DNA, 22 bp, Homo sapiens
tatggttacgttggttaaataa

SEQ ID NO: 650711 - DNA, 15 bp, Homo sapiens
tatgtaatttcaaaa

SEQ ID NO: 650712 - DNA, 16 bp, Homo sapiens
tatgtagatgtgcatt

SEQ ID NO: 650713 - DNA, 12 bp, Homo sapiens
tatgtataaaat

SEQ ID NO: 650714 - DNA, 20 bp, Homo sapiens
tatgtatcagtgtcctttcc

SEQ ID NO: 650715 - DNA, 19 bp, Homo sapiens
tatgtatggatatatttga

SEQ ID NO: 650716 - DNA, 15 bp, Homo sapiens
tatgtcagtactatt

SEQ ID NO: 650717 - DNA, 22 bp, Homo sapiens
tatgtctgctgagttggcctgg

SEQ ID NO: 650718 - DNA, 18 bp, Homo sapiens
tatgtgggatattgaatg

SEQ ID NO: 650719 - DNA, 13 bp, Homo sapiens
tatgtgtgtaggt

SEQ ID NO: 650720 - DNA, 14 bp, Homo sapiens
tatgttaaagagaa

SEQ ID NO: 650721 - DNA, 22 bp, Homo sapiens
tatgttgtaatatttcttcaaa

SEQ ID NO: 650722 - DNA, 19 bp, Homo sapiens
tatgtttaaaagaaatata

SEQ ID NO: 650723 - DNA, 14 bp, Homo sapiens
tatgtttgaatgaa

SEQ ID NO: 650724 - DNA, 19 bp, Homo sapiens
tattaaaactaaatttcac

SEQ ID NO: 650725 - DNA, 14 bp, Homo sapiens
tattaaacatacat

SEQ ID NO: 650726 - DNA, 20 bp, Homo sapiens
tattaaataataaagtatga

SEQ ID NO: 650727 - DNA, 18 bp, Homo sapiens
tattaatgttttcaaaag

SEQ ID NO: 650728 - DNA, 12 bp, Homo sapiens
tattacagtctt

SEQ ID NO: 650729 - DNA, 21 bp, Homo sapiens
tattactgaataatatcaaat

SEQ ID NO: 650730 - DNA, 17 bp, Homo sapiens
tattagataatattttt

SEQ ID NO: 650731 - DNA, 14 bp, Homo sapiens
tattataaagctta

SEQ ID NO: 650732 - DNA, 20 bp, Homo sapiens
tattataaattgtgtattta

SEQ ID NO: 650733 - DNA, 15 bp, Homo sapiens
tattatagacaaaag

SEQ ID NO: 650734 - DNA, 18 bp, Homo sapiens
tattatgcaaaatttaga

SEQ ID NO: 650735 - DNA, 22 bp, Homo sapiens
tattatgcaaaatttagaagaa

SEQ ID NO: 650736 - DNA, 18 bp, Homo sapiens
tattatgtaggtaagact

SEQ ID NO: 650737 - DNA, 15 bp, Homo sapiens
tattcaaatttgatg

SEQ ID NO: 650738 - DNA, 16 bp, Homo sapiens
tattcaaggaagtttt

SEQ ID NO: 650739 - DNA, 14 bp, Homo sapiens
tattcactggcccc

SEQ ID NO: 650740 - DNA, 13 bp, Homo sapiens
tattcagaacttt

SEQ ID NO: 650741 - DNA, 20 bp, Homo sapiens
tattcagaactttagtatta

SEQ ID NO: 650742 - DNA, 15 bp, Homo sapiens
tattcagggtaaata

SEQ ID NO: 650743 - DNA, 19 bp, Homo sapiens
tattcatatacaaacatgt

SEQ ID NO: 650744 - DNA, 23 bp, Homo sapiens
tattcatatacaaacatgtatgt

SEQ ID NO: 650745 - DNA, 18 bp, Homo sapiens
tattcattgtggtcatag

SEQ ID NO: 650746 - DNA, 19 bp, Homo sapiens
tattcccgacgacacatat

SEQ ID NO: 650747 - DNA, 16 bp, Homo sapiens
tattccttttaaagaa

SEQ ID NO: 650748 - DNA, 14 bp, Homo sapiens
tattctagagcttt

SEQ ID NO: 650749 - DNA, 16 bp, Homo sapiens
tattctagagctttta

SEQ ID NO: 650750 - DNA, 19 bp, Homo sapiens
tattctataaaactctgca

SEQ ID NO: 650751 - DNA, 14 bp, Homo sapiens
tattcttgcactga

SEQ ID NO: 650752 - DNA, 21 bp, Homo sapiens
tattgacaaccgagaaggttt

SEQ ID NO: 650753 - DNA, 15 bp, Homo sapiens
tattgacttttcaat

SEQ ID NO: 650754 - DNA, 15 bp, Homo sapiens
tattgatagtactct

SEQ ID NO: 650755 - DNA, 14 bp, Homo sapiens
tattgattgggaaa

SEQ ID NO: 650756 - DNA, 15 bp, Homo sapiens
tattgattgggaaaa

SEQ ID NO: 650757 - DNA, 18 bp, Homo sapiens
tattgattgggaaaacat

SEQ ID NO: 650758 - DNA, 20 bp, Homo sapiens
tattggcaaagtttaaatgt

SEQ ID NO: 650759 - DNA, 15 bp, Homo sapiens
tattgtgaagtacat

SEQ ID NO: 650760 - DNA, 12 bp, Homo sapiens
tatttaaactat

SEQ ID NO: 650761 - DNA, 14 bp, Homo sapiens
tatttaagatgtga

SEQ ID NO: 650762 - DNA, 16 bp, Homo sapiens
tatttaagatgtgaaa

SEQ ID NO: 650763 - DNA, 21 bp, Homo sapiens
tatttaaggtagcttcagcta

SEQ ID NO: 650764 - DNA, 13 bp, Homo sapiens
tatttaatatcaa

SEQ ID NO: 650765 - DNA, 14 bp, Homo sapiens
tatttaatatttaa

SEQ ID NO: 650766 - DNA, 20 bp, Homo sapiens
tatttaatggaagtgtattt

SEQ ID NO: 650767 - DNA, 17 bp, Homo sapiens
tatttactaactaaata

SEQ ID NO: 650768 - DNA, 19 bp, Homo sapiens
tatttactaactaaatacc

SEQ ID NO: 650769 - DNA, 22 bp, Homo sapiens
tatttagcatggggattgcaga

SEQ ID NO: 650770 - DNA, 20 bp, Homo sapiens
tatttatatcacacaatata

SEQ ID NO: 650771 - DNA, 21 bp, Homo sapiens
tatttatccagaaaactgtga

SEQ ID NO: 650772 - DNA, 22 bp, Homo sapiens
tatttatgggcccctggcactc

SEQ ID NO: 650773 - DNA, 19 bp, Homo sapiens
tatttatttttgtgtaggt

SEQ ID NO: 650774 - DNA, 17 bp, Homo sapiens
tatttcaataaatcttt

SEQ ID NO: 650775 - DNA, 18 bp, Homo sapiens
tatttcataattgcctac

SEQ ID NO: 650776 - DNA, 20 bp, Homo sapiens
tatttctatgacaaattcaa

SEQ ID NO: 650777 - DNA, 15 bp, Homo sapiens
tatttctcatctgca

SEQ ID NO: 650778 - DNA, 18 bp, Homo sapiens
tatttctggtgtatattt

SEQ ID NO: 650779 - DNA, 15 bp, Homo sapiens
tatttctgtatataa

SEQ ID NO: 650780 - DNA, 14 bp, Homo sapiens
tatttcttccctgc

SEQ ID NO: 650781 - DNA, 15 bp, Homo sapiens
tatttgaaatagtat

SEQ ID NO: 650782 - DNA, 15 bp, Homo sapiens
tatttgattatgtat

SEQ ID NO: 650783 - DNA, 20 bp, Homo sapiens
tatttgattatgtatggata

SEQ ID NO: 650784 - DNA, 15 bp, Homo sapiens
tatttgatttctaat

SEQ ID NO: 650785 - DNA, 19 bp, Homo sapiens
tatttgccttctactcccc

SEQ ID NO: 650786 - DNA, 21 bp, Homo sapiens
tatttgctaatcaaagccagg

SEQ ID NO: 650787 - DNA, 13 bp, Homo sapiens
tatttggtgtgtt

SEQ ID NO: 650788 - DNA, 15 bp, Homo sapiens
tatttggtgtgttcg

SEQ ID NO: 650789 - DNA, 24 bp, Homo sapiens
tatttgttatatataataaatact

SEQ ID NO: 650790 - DNA, 17 bp, Homo sapiens
tatttgttttatgctac

SEQ ID NO: 650791 - DNA, 14 bp, Homo sapiens
tattttaaaatata

SEQ ID NO: 650792 - DNA, 13 bp, Homo sapiens
tattttaatgtac

SEQ ID NO: 650793 - DNA, 20 bp, Homo sapiens
tattttcatgaaaataccat

SEQ ID NO: 650794 - DNA, 16 bp, Homo sapiens
tattttctccacttca

SEQ ID NO: 650795 - DNA, 14 bp, Homo sapiens
tattttctttttat

SEQ ID NO: 650796 - DNA, 17 bp, Homo sapiens
tattttgacactggtat

SEQ ID NO: 650797 - DNA, 21 bp, Homo sapiens
tattttgcactctgtaattgc

SEQ ID NO: 650798 - DNA, 19 bp, Homo sapiens
tattttgtcttattcttaa

SEQ ID NO: 650799 - DNA, 20 bp, Homo sapiens
tattttgtcttattcttaag

SEQ ID NO: 650800 - DNA, 17 bp, Homo sapiens
tattttgtgtgaaattg

SEQ ID NO: 650801 - DNA, 17 bp, Homo sapiens
tattttgttgctttctt

SEQ ID NO: 650802 - DNA, 20 bp, Homo sapiens
tatttttatacaagtaattt

SEQ ID NO: 650803 - DNA, 14 bp, Homo sapiens
tatttttatttttg

SEQ ID NO: 650804 - DNA, 20 bp, Homo sapiens
tattttttgctctaatctct

SEQ ID NO: 650805 - DNA, 18 bp, Homo sapiens
tatttttttaatttaaca

SEQ ID NO: 650806 - DNA, 14 bp, Homo sapiens
tcaaaaaaacaaaa

SEQ ID NO: 650807 - DNA, 19 bp, Homo sapiens
tcaaaaaattatttgctat

SEQ ID NO: 650808 - DNA, 16 bp, Homo sapiens
tcaaaacaaaggccta

SEQ ID NO: 650809 - DNA, 13 bp, Homo sapiens
tcaaaagtttgtt

SEQ ID NO: 650810 - DNA, 18 bp, Homo sapiens
tcaaaatacatttgtaag

SEQ ID NO: 650811 - DNA, 20 bp, Homo sapiens
tcaaactcctgacctcaggt

SEQ ID NO: 650812 - DNA, 14 bp, Homo sapiens
tcaaagagaattgt

SEQ ID NO: 650813 - DNA, 16 bp, Homo sapiens
tcaaagagaattgtat

SEQ ID NO: 650814 - DNA, 15 bp, Homo sapiens
tcaaagccacattat

SEQ ID NO: 650815 - DNA, 21 bp, Homo sapiens
tcaaagccacattatttctag

SEQ ID NO: 650816 - DNA, 18 bp, Homo sapiens
tcaaagctttcctgtttc

SEQ ID NO: 650817 - DNA, 23 bp, Homo sapiens
tcaaagtaaggctggtaagagaa

SEQ ID NO: 650818 - DNA, 17 bp, Homo sapiens
tcaaagttcatagagtt

SEQ ID NO: 650819 - DNA, 15 bp, Homo sapiens
tcaaagttgaaaatt

SEQ ID NO: 650820 - DNA, 15 bp, Homo sapiens
tcaaagtttatatgc

SEQ ID NO: 650821 - DNA, 13 bp, Homo sapiens
tcaaagttttgtt

SEQ ID NO: 650822 - DNA, 15 bp, Homo sapiens
tcaaataaaatatca

SEQ ID NO: 650823 - DNA, 19 bp, Homo sapiens
tcaaataaaatatcataaa

SEQ ID NO: 650824 - DNA, 12 bp, Homo sapiens
tcaaataagaaa

SEQ ID NO: 650825 - DNA, 13 bp, Homo sapiens
tcaaatcaacttt

SEQ ID NO: 650826 - DNA, 16 bp, Homo sapiens
tcaaatcagtgataat

SEQ ID NO: 650827 - DNA, 15 bp, Homo sapiens
tcaaatttactttaa

SEQ ID NO: 650828 - DNA, 19 bp, Homo sapiens
tcaaatttactttaaaaag

SEQ ID NO: 650829 - DNA, 16 bp, Homo sapiens
tcaacaacatccactg

SEQ ID NO: 650830 - DNA, 17 bp, Homo sapiens
tcaacaacatccactgt

SEQ ID NO: 650831 - DNA, 17 bp, Homo sapiens
tgcagaggtaccctggg

SEQ ID NO: 650832 - DNA, 19 bp, Homo sapiens
tgcagaggtaccctgggtg

SEQ ID NO: 650833 - DNA, 15 bp, Homo sapiens
tgcagagttgaagtt

SEQ ID NO: 650834 - DNA, 16 bp, Homo sapiens
tgcagagttgaagttt

SEQ ID NO: 650835 - DNA, 22 bp, Homo sapiens
tgcagatactttgaagtgcagc

SEQ ID NO: 650836 - DNA, 17 bp, Homo sapiens
tgcagatgcaattgttt

SEQ ID NO: 650837 - DNA, 15 bp, Homo sapiens
tgcagattacactga

SEQ ID NO: 650838 - DNA, 23 bp, Homo sapiens
tgcagcacagctgagaggctgtc

SEQ ID NO: 650839 - DNA, 23 bp, Homo sapiens
tgcagcagaaaggctctgaaggt

SEQ ID NO: 650840 - DNA, 23 bp, Homo sapiens
tgcagcaggagtggtgcagacag

SEQ ID NO: 650841 - DNA, 14 bp, Homo sapiens
tgcagctcatgttt

SEQ ID NO: 650842 - DNA, 17 bp, Homo sapiens
tgcaggcaggcggctcc

SEQ ID NO: 650843 - DNA, 13 bp, Homo sapiens
tgcaggggtgacg

SEQ ID NO: 650844 - DNA, 14 bp, Homo sapiens
tgcaggggtgacgg

SEQ ID NO: 650845 - DNA, 15 bp, Homo sapiens
tgcagtattcttgca

SEQ ID NO: 650846 - DNA, 14 bp, Homo sapiens
tgcagtctcatttc

SEQ ID NO: 650847 - DNA, 16 bp, Homo sapiens
tgcataaatgcataat

SEQ ID NO: 650848 - DNA, 17 bp, Homo sapiens
tgcataaatgcataatt

SEQ ID NO: 650849 - DNA, 15 bp, Homo sapiens
tgcataatttatggt

SEQ ID NO: 650850 - DNA, 20 bp, Homo sapiens
tgcatatagttaaactgaga

SEQ ID NO: 650851 - DNA, 13 bp, Homo sapiens
tgcatatcctgag

SEQ ID NO: 650852 - DNA, 18 bp, Homo sapiens
tgcatatcctgagccatc

SEQ ID NO: 650853 - DNA, 14 bp, Homo sapiens
tgcatattcaatgt

SEQ ID NO: 650854 - DNA, 15 bp, Homo sapiens
tgcatattttgagaa

SEQ ID NO: 650855 - DNA, 18 bp, Homo sapiens
tgcatattttgagaaact

SEQ ID NO: 650856 - DNA, 21 bp, Homo sapiens
tgcatcactgtatcattttct

SEQ ID NO: 650857 - DNA, 13 bp, Homo sapiens
tgcatccctgaga

SEQ ID NO: 650858 - DNA, 16 bp, Homo sapiens
tgcatctttgttactt

SEQ ID NO: 650859 - DNA, 20 bp, Homo sapiens
tgcatctttgttacttcctt

SEQ ID NO: 650860 - DNA, 22 bp, Homo sapiens
tgcatgcaaatgagctctgaaa

SEQ ID NO: 650861 - DNA, 18 bp, Homo sapiens
tgcatggaggccctcctg

SEQ ID NO: 650862 - DNA, 13 bp, Homo sapiens
tgcatggtggcca

SEQ ID NO: 650863 - DNA, 18 bp, Homo sapiens
tgcattaaaatttcttat

SEQ ID NO: 650864 - DNA, 15 bp, Homo sapiens
tgcatttgtggtaat

SEQ ID NO: 650865 - DNA, 23 bp, Homo sapiens
tgcatttgtggtaatctacacca

SEQ ID NO: 650866 - DNA, 17 bp, Homo sapiens
tgcattttgcactagaa

SEQ ID NO: 650867 - DNA, 18 bp, Homo sapiens
tgcattttgcactagaac

SEQ ID NO: 650868 - DNA, 14 bp, Homo sapiens
tgcatttttgtgaa

SEQ ID NO: 650869 - DNA, 17 bp, Homo sapiens
tgcatttttgtgaaatg

SEQ ID NO: 650870 - DNA, 13 bp, Homo sapiens
tgccaactcctca

SEQ ID NO: 650871 - DNA, 19 bp, Homo sapiens
tgccactaaactacattgt

SEQ ID NO: 650872 - DNA, 17 bp, Homo sapiens
tgccactcctccctccg

SEQ ID NO: 650873 - DNA, 23 bp, Homo sapiens
tgccagccccctaaaagcactcc

SEQ ID NO: 650874 - DNA, 14 bp, Homo sapiens
tgccaggaacctgt

SEQ ID NO: 650875 - DNA, 23 bp, Homo sapiens
tgccaggacatgcaataaaattt

SEQ ID NO: 650876 - DNA, 17 bp, Homo sapiens
tgccaggctgcctcctg

SEQ ID NO: 650877 - DNA, 16 bp, Homo sapiens
tgccatctagccagcc

SEQ ID NO: 650878 - DNA, 19 bp, Homo sapiens
tgccattgaaggcttaatt

SEQ ID NO: 650879 - DNA, 21 bp, Homo sapiens
tgccattgaaggcttaattga

SEQ ID NO: 650880 - DNA, 15 bp, Homo sapiens
tgcccagctaatttt

SEQ ID NO: 650881 - DNA, 20 bp, Homo sapiens
tgcccatgctgggagcccac

SEQ ID NO: 650882 - DNA, 16 bp, Homo sapiens
tgcccatggcttctgg

SEQ ID NO: 650883 - DNA, 18 bp, Homo sapiens
tgcccattcaccaaaatt

SEQ ID NO: 650884 - DNA, 20 bp, Homo sapiens
tgccccacaaaacttcagtg

SEQ ID NO: 650885 - DNA, 15 bp, Homo sapiens
tgccccaggccctgc

SEQ ID NO: 650886 - DNA, 20 bp, Homo sapiens
tgccccatccagacctggct

SEQ ID NO: 650887 - DNA, 18 bp, Homo sapiens
tgccccatgtgtcctggt

SEQ ID NO: 650888 - DNA, 20 bp, Homo sapiens
tgccccatgtgtcctggtga

SEQ ID NO: 650889 - DNA, 23 bp, Homo sapiens
tgccccccatgaggaaggaacag

SEQ ID NO: 650890 - DNA, 12 bp, Homo sapiens
tgccccctgggc

SEQ ID NO: 650891 - DNA, 12 bp, Homo sapiens
tgcccctggctt

SEQ ID NO: 650892 - DNA, 19 bp, Homo sapiens
tgcccctggctttgcctct

SEQ ID NO: 650893 - DNA, 21 bp, Homo sapiens
tgccccttaaacacaggctgt

SEQ ID NO: 650894 - DNA, 18 bp, Homo sapiens
tgcccgactgactggagg

SEQ ID NO: 650895 - DNA, 14 bp, Homo sapiens
tgccctcctctccc

SEQ ID NO: 650896 - DNA, 15 bp, Homo sapiens
tgccctcctctcccc

SEQ ID NO: 650897 - DNA, 15 bp, Homo sapiens
tgccctcgcctcctc

SEQ ID NO: 650898 - DNA, 11 bp, Homo sapiens
tgccctgagaa

SEQ ID NO: 650899 - DNA, 15 bp, Homo sapiens
tgccctgagaagctg

SEQ ID NO: 650900 - DNA, 22 bp, Homo sapiens
tgccctttcaaagcacttaagt

SEQ ID NO: 650901 - DNA, 19 bp, Homo sapiens
tgccgtgtgagtgtgacag

SEQ ID NO: 650902 - DNA, 16 bp, Homo sapiens
tgcctatagtcccact

SEQ ID NO: 650903 - DNA, 12 bp, Homo sapiens
tgcctcaccttc

SEQ ID NO: 650904 - DNA, 14 bp, Homo sapiens
tgcctcaccttcca

SEQ ID NO: 650905 - DNA, 21 bp, Homo sapiens
tgcctccacatgctgcctggc

SEQ ID NO: 650906 - DNA, 14 bp, Homo sapiens
tgcctccaggtgca

SEQ ID NO: 650907 - DNA, 16 bp, Homo sapiens
tgcctcccacttcact

SEQ ID NO: 650908 - DNA, 14 bp, Homo sapiens
tgcctcctgccctt

SEQ ID NO: 650909 - DNA, 18 bp, Homo sapiens
tgcctcctgtggggaaag

SEQ ID NO: 650910 - DNA, 14 bp, Homo sapiens
tgcctctgcagtct

SEQ ID NO: 650911 - DNA, 15 bp, Homo sapiens
tgcctctgcagtctc

SEQ ID NO: 650912 - DNA, 13 bp, Homo sapiens
tgcctctgccctg

SEQ ID NO: 650913 - DNA, 13 bp, Homo sapiens
tgcctcttctttg

SEQ ID NO: 650914 - DNA, 21 bp, Homo sapiens
tgcctcttctttgtgcctttg

SEQ ID NO: 650915 - DNA, 12 bp, Homo sapiens
tgcctctttccc

SEQ ID NO: 650916 - DNA, 20 bp, Homo sapiens
tgcctgactaatttttgtat

SEQ ID NO: 650917 - DNA, 22 bp, Homo sapiens
tgcctgactaatttttgtattt

SEQ ID NO: 650918 - DNA, 14 bp, Homo sapiens
tgcctgcagcaggc

SEQ ID NO: 650919 - DNA, 14 bp, Homo sapiens
tgcctgcagggcca

SEQ ID NO: 650920 - DNA, 22 bp, Homo sapiens
tgcctgcagggccatggctcag

SEQ ID NO: 650921 - DNA, 23 bp, Homo sapiens
tgcctgcagggccatggctcagg

SEQ ID NO: 650922 - DNA, 17 bp, Homo sapiens
tgcctggcacagaccag

SEQ ID NO: 650923 - DNA, 21 bp, Homo sapiens
tgcctggcacagaccaggcct

SEQ ID NO: 650924 - DNA, 22 bp, Homo sapiens
tgcctgtccccaaacaggacag

SEQ ID NO: 650925 - DNA, 16 bp, Homo sapiens
tgcctgtcctttcagt

SEQ ID NO: 650926 - DNA, 12 bp, Homo sapiens
tgcctgtgtgcg

SEQ ID NO: 650927 - DNA, 14 bp, Homo sapiens
tgccttaatttaga

SEQ ID NO: 650928 - DNA, 19 bp, Homo sapiens
tgccttaatttagaaactg

SEQ ID NO: 650929 - DNA, 16 bp, Homo sapiens
tgccttctactcccct

SEQ ID NO: 650930 - DNA, 16 bp, Homo sapiens
tgccttctgctgaaag

SEQ ID NO: 650931 - DNA, 14 bp, Homo sapiens
tgccttctttccat

SEQ ID NO: 650932 - DNA, 14 bp, Homo sapiens
tgccttcttttgta

SEQ ID NO: 650933 - DNA, 22 bp, Homo sapiens
tgccttgaaaaatgacaattgt

SEQ ID NO: 650934 - DNA, 11 bp, Homo sapiens
tgcctttctca

SEQ ID NO: 650935 - DNA, 13 bp, Homo sapiens
tgcctttctttgc

SEQ ID NO: 650936 - DNA, 14 bp, Homo sapiens
tgcctttctttgcc

SEQ ID NO: 650937 - DNA, 22 bp, Homo sapiens
tgcctttctttgcctctgcagt

SEQ ID NO: 650938 - DNA, 13 bp, Homo sapiens
tgcctttggcctg

SEQ ID NO: 650939 - DNA, 19 bp, Homo sapiens
tgccttttgcagaagaggg

SEQ ID NO: 650940 - DNA, 13 bp, Homo sapiens
tgcgaccctgggg

SEQ ID NO: 650941 - DNA, 15 bp, Homo sapiens
tgcgattctggataa

SEQ ID NO: 650942 - DNA, 15 bp, Homo sapiens
tgcgcatcttgcctc

SEQ ID NO: 650943 - DNA, 22 bp, Homo sapiens
tgcgcatcttgcctccaggtgc

SEQ ID NO: 650944 - DNA, 16 bp, Homo sapiens
tgcgcgctatcccctc

SEQ ID NO: 650945 - DNA, 13 bp, Homo sapiens
tgcgtctgaggcc

SEQ ID NO: 650946 - DNA, 12 bp, Homo sapiens
tgcgtgaatgta

SEQ ID NO: 650947 - DNA, 20 bp, Homo sapiens
tgcgtgaatgtatgtaatgt

SEQ ID NO: 650948 - DNA, 23 bp, Homo sapiens
tgctacttggggacataatttca

SEQ ID NO: 650949 - DNA, 17 bp, Homo sapiens
tgctagtggtgagcatg

SEQ ID NO: 650950 - DNA, 19 bp, Homo sapiens
tgctagtggtgagcatgta

SEQ ID NO: 650951 - DNA, 18 bp, Homo sapiens
tgctatgttactattttc

SEQ ID NO: 650952 - DNA, 16 bp, Homo sapiens
tgctattctagagctt

SEQ ID NO: 650953 - DNA, 19 bp, Homo sapiens
tgctattctagagctttta

SEQ ID NO: 650954 - DNA, 19 bp, Homo sapiens
tgctcaacagacaattaga

SEQ ID NO: 650955 - DNA, 23 bp, Homo sapiens
tgctcaacagcatatgggtggga

SEQ ID NO: 650956 - DNA, 14 bp, Homo sapiens
tgctcactttatta

SEQ ID NO: 650957 - DNA, 14 bp, Homo sapiens
tgctcagagaagga

SEQ ID NO: 650958 - DNA, 12 bp, Homo sapiens
tgctcatttaag

SEQ ID NO: 650959 - DNA, 18 bp, Homo sapiens
tgctcatttaagtttcaa

SEQ ID NO: 650960 - DNA, 14 bp, Homo sapiens
tgctccaaatataa

SEQ ID NO: 650961 - DNA, 14 bp, Homo sapiens
tgctccaggcctgc

SEQ ID NO: 650962 - DNA, 19 bp, Homo sapiens
tgctccataccttttctct

SEQ ID NO: 650963 - DNA, 11 bp, Homo sapiens
tgctcccaggc

SEQ ID NO: 650964 - DNA, 20 bp, Homo sapiens
tgctcccaggccccaggcct

SEQ ID NO: 650965 - DNA, 21 bp, Homo sapiens
tgctccccacagcgtccctgg

SEQ ID NO: 650966 - DNA, 21 bp, Homo sapiens
tgctccgtagctctgctgctg

SEQ ID NO: 650967 - DNA, 17 bp, Homo sapiens
tgctccttgagaggaga

SEQ ID NO: 650968 - DNA, 23 bp, Homo sapiens
tgctcgcccctgttttttgtaga

SEQ ID NO: 650969 - DNA, 19 bp, Homo sapiens
tgctctaggaagacatttt

SEQ ID NO: 650970 - DNA, 11 bp, Homo sapiens
tgctctcctca

SEQ ID NO: 650971 - DNA, 19 bp, Homo sapiens
tgctctgcagcattgaagt

SEQ ID NO: 650972 - DNA, 18 bp, Homo sapiens
tgctcttgtttttattaa

SEQ ID NO: 650973 - DNA, 14 bp, Homo sapiens
tgctctttcacctg

SEQ ID NO: 650974 - DNA, 18 bp, Homo sapiens
tgctctttcacctgggtg

SEQ ID NO: 650975 - DNA, 12 bp, Homo sapiens
tgctgagggtgt

SEQ ID NO: 650976 - DNA, 16 bp, Homo sapiens
tgctgagttggcctgg

SEQ ID NO: 650977 - DNA, 20 bp, Homo sapiens
tgctgatactgggtctgcga

SEQ ID NO: 650978 - DNA, 23 bp, Homo sapiens
tgctgatcatcgccagaggtgct

SEQ ID NO: 650979 - DNA, 13 bp, Homo sapiens
tgctgattattta

SEQ ID NO: 650980 - DNA, 16 bp, Homo sapiens
tgctgattatttatga

SEQ ID NO: 650981 - DNA, 23 bp, Homo sapiens
tgctgcagcaccgaggggccttt

SEQ ID NO: 650982 - DNA, 19 bp, Homo sapiens
tgctgcctctttccctagg

SEQ ID NO: 650983 - DNA, 13 bp, Homo sapiens
tgctgcgctgctt

SEQ ID NO: 650984 - DNA, 13 bp, Homo sapiens
tgctgctgcccct

SEQ ID NO: 650985 - DNA, 18 bp, Homo sapiens
tgctgctggtgcacagcc

SEQ ID NO: 650986 - DNA, 22 bp, Homo sapiens
tgctgctttttctgcgcttcag

SEQ ID NO: 650987 - DNA, 21 bp, Homo sapiens
tgctggaagaattctagcatg

SEQ ID NO: 650988 - DNA, 22 bp, Homo sapiens
tgctgggtacctggtccccact

SEQ ID NO: 650989 - DNA, 23 bp, Homo sapiens
tgctgtacacatatttgaagggt

SEQ ID NO: 650990 - DNA, 19 bp, Homo sapiens
tgctgtgtatatggtatat

SEQ ID NO: 650991 - DNA, 22 bp, Homo sapiens
tgctgttagtaaatttctgtga

SEQ ID NO: 650992 - DNA, 12 bp, Homo sapiens
tgctgtttctaa

SEQ ID NO: 650993 - DNA, 16 bp, Homo sapiens
tgctgtttctaagaaa

SEQ ID NO: 650994 - DNA, 15 bp, Homo sapiens
tgcttaaaaaataat

SEQ ID NO: 650995 - DNA, 20 bp, Homo sapiens
tgcttaatcttcaaagcctt

SEQ ID NO: 650996 - DNA, 12 bp, Homo sapiens
tgcttcattatt

SEQ ID NO: 650997 - DNA, 14 bp, Homo sapiens
tgcttcattgaaag

SEQ ID NO: 650998 - DNA, 15 bp, Homo sapiens
tgcttcccttacttt

SEQ ID NO: 650999 - DNA, 20 bp, Homo sapiens
tgcttgacatacctaccagt

SEQ ID NO: 651000 - DNA, 18 bp, Homo sapiens
tgcttgcctgcagggcca

SEQ ID NO: 651001 - DNA, 15 bp, Homo sapiens
tgcttgtaactaaaa

SEQ ID NO: 651002 - DNA, 15 bp, Homo sapiens
tgcttgtcttctggt

SEQ ID NO: 651003 - DNA, 20 bp, Homo sapiens
tgcttgtttatgatatttct

SEQ ID NO: 651004 - DNA, 12 bp, Homo sapiens
tgcttgttttat

SEQ ID NO: 651005 - DNA, 23 bp, Homo sapiens
tgctttattaatgttttcaaaag

SEQ ID NO: 651006 - DNA, 17 bp, Homo sapiens
tgctttgagacctttcc

SEQ ID NO: 651007 - DNA, 16 bp, Homo sapiens
tgctttgcatctttgt

SEQ ID NO: 651008 - DNA, 12 bp, Homo sapiens
tgctttggaaac

SEQ ID NO: 651009 - DNA, 16 bp, Homo sapiens
tgcttttaattaaata

SEQ ID NO: 651010 - DNA, 20 bp, Homo sapiens
tggaaaaggaagactagagg

SEQ ID NO: 651011 - DNA, 22 bp, Homo sapiens
tggaaagacttctcaaagagaa

SEQ ID NO: 651012 - DNA, 23 bp, Homo sapiens
tggaaagacttctcaaagagaat

SEQ ID NO: 651013 - DNA, 19 bp, Homo sapiens
tggaaagcagagcctcctg

SEQ ID NO: 651014 - DNA, 15 bp, Homo sapiens
tggaaagtaactgtg

SEQ ID NO: 651015 - DNA, 14 bp, Homo sapiens
tggaaattcctgta

SEQ ID NO: 651016 - DNA, 21 bp, Homo sapiens
tggaagaattctagcatgcta

SEQ ID NO: 651017 - DNA, 13 bp, Homo sapiens
tggaaggagaggg

SEQ ID NO: 651018 - DNA, 14 bp, Homo sapiens
tggaaggagagggg

SEQ ID NO: 651019 - DNA, 22 bp, Homo sapiens
tggaaggagaggggaggtcact

SEQ ID NO: 651020 - DNA, 14 bp, Homo sapiens
tggaaggcagacag

SEQ ID NO: 651021 - DNA, 16 bp, Homo sapiens
tggaaggcctccctct

SEQ ID NO: 651022 - DNA, 16 bp, Homo sapiens
tggaaggctgaggcag

SEQ ID NO: 651023 - DNA, 19 bp, Homo sapiens
tggaagttttcctacactt

SEQ ID NO: 651024 - DNA, 23 bp, Homo sapiens
tggaataaattatggcatttcta

SEQ ID NO: 651025 - DNA, 17 bp, Homo sapiens
tggaatgagtgtgcatg

SEQ ID NO: 651026 - DNA, 19 bp, Homo sapiens
tggaatgagtgtgcatgga

SEQ ID NO: 651027 - DNA, 21 bp, Homo sapiens
tggaatgagtgtgcatggagg

SEQ ID NO: 651028 - DNA, 18 bp, Homo sapiens
tggacagctgataaattt

SEQ ID NO: 651029 - DNA, 16 bp, Homo sapiens
tggacctggggagtgg

SEQ ID NO: 651030 - DNA, 12 bp, Homo sapiens
tggactacacaa

SEQ ID NO: 651031 - DNA, 14 bp, Homo sapiens
tggactacacaata

SEQ ID NO: 651032 - DNA, 22 bp, Homo sapiens
tggactacacaatacagtatta

SEQ ID NO: 651033 - DNA, 17 bp, Homo sapiens
tggactgctattctaga

SEQ ID NO: 651034 - DNA, 16 bp, Homo sapiens
tggacttacctggcag

SEQ ID NO: 651035 - DNA, 19 bp, Homo sapiens
tggacttcaaagcaagctg

SEQ ID NO: 651036 - DNA, 17 bp, Homo sapiens
tggagaagttgtgaaag

SEQ ID NO: 651037 - DNA, 13 bp, Homo sapiens
tggagccccaggg

SEQ ID NO: 651038 - DNA, 22 bp, Homo sapiens
tggaggagggtttgggcagagc

SEQ ID NO: 651039 - DNA, 21 bp, Homo sapiens
tggaggccctcctgtgctggg

SEQ ID NO: 651040 - DNA, 14 bp, Homo sapiens
tggagggaggcccc

SEQ ID NO: 651041 - DNA, 19 bp, Homo sapiens
tggagggaggccccagggg

SEQ ID NO: 651042 - DNA, 12 bp, Homo sapiens
tggagtcattca

SEQ ID NO: 651043 - DNA, 19 bp, Homo sapiens
tggagtttctctagaagct

SEQ ID NO: 651044 - DNA, 15 bp, Homo sapiens
tggataaagccactg

SEQ ID NO: 651045 - DNA, 23 bp, Homo sapiens
tggataataaacctgggctcagc

SEQ ID NO: 651046 - DNA, 19 bp, Homo sapiens
tggatatatttgaaatagt

SEQ ID NO: 651047 - DNA, 16 bp, Homo sapiens
tggatattattagaaa

SEQ ID NO: 651048 - DNA, 15 bp, Homo sapiens
tggattctaaataca

SEQ ID NO: 651049 - DNA, 16 bp, Homo sapiens
tggattgcctctgaaa

SEQ ID NO: 651050 - DNA, 16 bp, Homo sapiens
tggcaaacgagacttt

SEQ ID NO: 651051 - DNA, 21 bp, Homo sapiens
tggcaaacgagactttctcct

SEQ ID NO: 651052 - DNA, 22 bp, Homo sapiens
tggcaaaggacccttgagtaag

SEQ ID NO: 651053 - DNA, 14 bp, Homo sapiens
tggcaacagaagtg

SEQ ID NO: 651054 - DNA, 13 bp, Homo sapiens
tggcaattgtcta

SEQ ID NO: 651055 - DNA, 15 bp, Homo sapiens
tggtaaatgtttctt

SEQ ID NO: 651056 - DNA, 20 bp, Homo sapiens
tggtaagcaacatggctttg

SEQ ID NO: 651057 - DNA, 16 bp, Homo sapiens
tggtaataagcactgt

SEQ ID NO: 651058 - DNA, 21 bp, Homo sapiens
tggtaatcccctaaaataaca

SEQ ID NO: 651059 - DNA, 23 bp, Homo sapiens
tggtaatcccctaaaataacagt

SEQ ID NO: 651060 - DNA, 16 bp, Homo sapiens
tggtacaacggaggcc

SEQ ID NO: 651061 - DNA, 15 bp, Homo sapiens
tggtacatggtgttt

SEQ ID NO: 651062 - DNA, 18 bp, Homo sapiens
tggtacatggtgtttgtg

SEQ ID NO: 651063 - DNA, 17 bp, Homo sapiens
tggtacatgtcttccat

SEQ ID NO: 651064 - DNA, 19 bp, Homo sapiens
tggtagaagtttggctgct

SEQ ID NO: 651065 - DNA, 23 bp, Homo sapiens
tggtagggatatggcaggactcc

SEQ ID NO: 651066 - DNA, 14 bp, Homo sapiens
tggtatatatacat

SEQ ID NO: 651067 - DNA, 14 bp, Homo sapiens
tggtcaacatagtg

SEQ ID NO: 651068 - DNA, 23 bp, Homo sapiens
tggtcaagggctgtcattgcaca

SEQ ID NO: 651069 - DNA, 22 bp, Homo sapiens
tggtcacaacttgatggctgcg

SEQ ID NO: 651070 - DNA, 22 bp, Homo sapiens
tggtcagctgccccaatgtgac

SEQ ID NO: 651071 - DNA, 15 bp, Homo sapiens
tggtcatatacatat

SEQ ID NO: 651072 - DNA, 23 bp, Homo sapiens
tggtcatgaatagaaaaaaaaca

SEQ ID NO: 651073 - DNA, 21 bp, Homo sapiens
tggtccagaccagccctgcag

SEQ ID NO: 651074 - DNA, 17 bp, Homo sapiens
tggtcctagtaagaaga

SEQ ID NO: 651075 - DNA, 13 bp, Homo sapiens
tggtcggagaggg

SEQ ID NO: 651076 - DNA, 14 bp, Homo sapiens
tggtcggagaggga

SEQ ID NO: 651077 - DNA, 16 bp, Homo sapiens
tggtctcaaactcctg

SEQ ID NO: 651078 - DNA, 23 bp, Homo sapiens
tggtctccccaattctcccctcc

SEQ ID NO: 651079 - DNA, 14 bp, Homo sapiens
tggtctgattttga

SEQ ID NO: 651080 - DNA, 22 bp, Homo sapiens
tggtcttatagtgtttggacag

SEQ ID NO: 651081 - DNA, 18 bp, Homo sapiens
tggtcttctactgccttg

SEQ ID NO: 651082 - DNA, 14 bp, Homo sapiens
tggtctttaatgaa

SEQ ID NO: 651083 - DNA, 11 bp, Homo sapiens
tggtgagaaaa

SEQ ID NO: 651084 - DNA, 21 bp, Homo sapiens
tggtgagaaaatatatgcctg

SEQ ID NO: 651085 - DNA, 21 bp, Homo sapiens
tggtgagcatgtaagtgttaa

SEQ ID NO: 651086 - DNA, 15 bp, Homo sapiens
tggtgcagacagaag

SEQ ID NO: 651087 - DNA, 22 bp, Homo sapiens
tggtgcagacagaagtctcctc

SEQ ID NO: 651088 - DNA, 14 bp, Homo sapiens
tggtgccctcgcct

SEQ ID NO: 651089 - DNA, 15 bp, Homo sapiens
tggtggtgaaattga

SEQ ID NO: 651090 - DNA, 18 bp, Homo sapiens
tggtgtcagtatccaggc

SEQ ID NO: 651091 - DNA, 17 bp, Homo sapiens
tggtgtgccctgtgtgt

SEQ ID NO: 651092 - DNA, 23 bp, Homo sapiens
tggtgtgttcaagaccagcctgg

SEQ ID NO: 651093 - DNA, 16 bp, Homo sapiens
tggtgttgacatacat

SEQ ID NO: 651094 - DNA, 22 bp, Homo sapiens
tggttaaaactgtacatttaaa

SEQ ID NO: 651095 - DNA, 16 bp, Homo sapiens
tggttaccactctttt

SEQ ID NO: 651096 - DNA, 16 bp, Homo sapiens
tggttcagacacagct

SEQ ID NO: 651097 - DNA, 18 bp, Homo sapiens
tggttcagacacagctct

SEQ ID NO: 651098 - DNA, 14 bp, Homo sapiens
tggttcttgaaaat

SEQ ID NO: 651099 - DNA, 23 bp, Homo sapiens
tggttgggaatgaggaaaattct

SEQ ID NO: 651100 - DNA, 21 bp, Homo sapiens
tggttggtcacagaatgactg

SEQ ID NO: 651101 - DNA, 17 bp, Homo sapiens
tggttgtgtgtgttctg

SEQ ID NO: 651102 - DNA, 18 bp, Homo sapiens
tggttgtgtgtgttctgt

SEQ ID NO: 651103 - DNA, 22 bp, Homo sapiens
tggtttaaccattggaatggac

SEQ ID NO: 651104 - DNA, 21 bp, Homo sapiens
tggtttacgcctataatccca

SEQ ID NO: 651105 - DNA, 12 bp, Homo sapiens
tgtaaaacttct

SEQ ID NO: 651106 - DNA, 16 bp, Homo sapiens
tgtaaaacttctgctc

SEQ ID NO: 651107 - DNA, 17 bp, Homo sapiens
tgtaaaacttctgctcg

SEQ ID NO: 651108 - DNA, 19 bp, Homo sapiens
tgtaaaagcattttgtaat

SEQ ID NO: 651109 - DNA, 22 bp, Homo sapiens
tgtaaaatgaattgaaaaacaa

SEQ ID NO: 651110 - DNA, 23 bp, Homo sapiens
tgtaaaatgaattgaaaaacaat

SEQ ID NO: 651111 - DNA, 20 bp, Homo sapiens
tgtaaacagaagcctgtttc

SEQ ID NO: 651112 - DNA, 18 bp, Homo sapiens
tgtaaagttatgtattta

SEQ ID NO: 651113 - DNA, 21 bp, Homo sapiens
tgtaaagttatgtatttaaag

SEQ ID NO: 651114 - DNA, 15 bp, Homo sapiens
tgtaactaaaataat

SEQ ID NO: 651115 - DNA, 23 bp, Homo sapiens
tgtaactaaaataattttgtaat

SEQ ID NO: 651116 - DNA, 17 bp, Homo sapiens
tgtaagaattctgattg

SEQ ID NO: 651117 - DNA, 15 bp, Homo sapiens
tgtaagtgaaattaa

SEQ ID NO: 651118 - DNA, 16 bp, Homo sapiens
tgtaagtgaaattaag

SEQ ID NO: 651119 - DNA, 15 bp, Homo sapiens
tgtaatataatgtat

SEQ ID NO: 651120 - DNA, 18 bp, Homo sapiens
tgtaatataatgtatttt

SEQ ID NO: 651121 - DNA, 17 bp, Homo sapiens
tgtaatatttcttcaaa

SEQ ID NO: 651122 - DNA, 14 bp, Homo sapiens
tgtaatcttcccca

SEQ ID NO: 651123 - DNA, 17 bp, Homo sapiens
tgtaatcttttatttaa

SEQ ID NO: 651124 - DNA, 12 bp, Homo sapiens
tgtaatgacagg

SEQ ID NO: 651125 - DNA, 23 bp, Homo sapiens
tgtaattgcactttttaagtttg

SEQ ID NO: 651126 - DNA, 16 bp, Homo sapiens
tgtaatttaaatgaaa

SEQ ID NO: 651127 - DNA, 17 bp, Homo sapiens
tgtaatttcaaaataca

SEQ ID NO: 651128 - DNA, 13 bp, Homo sapiens
tgtacaaaattaa

SEQ ID NO: 651129 - DNA, 24 bp, Homo sapiens
tgtacaaaattaagcaaatgttaa

SEQ ID NO: 651130 - DNA, 15 bp, Homo sapiens
tgtacaaacagtatt

SEQ ID NO: 651131 - DNA, 17 bp, Homo sapiens
tgtacaaatacatgtgt

SEQ ID NO: 651132 - DNA, 20 bp, Homo sapiens
tgtacaaatacatgtgtata

SEQ ID NO: 651133 - DNA, 20 bp, Homo sapiens
tgtacataactcctgtccct

SEQ ID NO: 651134 - DNA, 13 bp, Homo sapiens
tgtacatctttca

SEQ ID NO: 651135 - DNA, 20 bp, Homo sapiens
tgtacatggaattttttgaa

SEQ ID NO: 651136 - DNA, 21 bp, Homo sapiens
tgtacatggaattttttgaat

SEQ ID NO: 651137 - DNA, 14 bp, Homo sapiens
tgtacattatgaag

SEQ ID NO: 651138 - DNA, 17 bp, Homo sapiens
tgtacatttctataaat

SEQ ID NO: 651139 - DNA, 14 bp, Homo sapiens
tgtactaaacagta

SEQ ID NO: 651140 - DNA, 12 bp, Homo sapiens
tgtactacagct

SEQ ID NO: 651141 - DNA, 14 bp, Homo sapiens
tgtactacagctat

SEQ ID NO: 651142 - DNA, 19 bp, Homo sapiens
tgtactacagctatatttg

SEQ ID NO: 651143 - DNA, 20 bp, Homo sapiens
tgtactacagctatatttga

SEQ ID NO: 651144 - DNA, 22 bp, Homo sapiens
tgtactacagctatatttgatt

SEQ ID NO: 651145 - DNA, 18 bp, Homo sapiens
tgtactatcctgtaaata

SEQ ID NO: 651146 - DNA, 18 bp, Homo sapiens
tgtactgttactgggccc

SEQ ID NO: 651147 - DNA, 22 bp, Homo sapiens
tgtacttaaatggtaataagca

SEQ ID NO: 651148 - DNA, 23 bp, Homo sapiens
tgtacttgaagtctaaaagcaga

SEQ ID NO: 651149 - DNA, 20 bp, Homo sapiens
tgtagaatctcttcatgctt

SEQ ID NO: 651150 - DNA, 21 bp, Homo sapiens
tgtagaatctcttcatgcttg

SEQ ID NO: 651151 - DNA, 14 bp, Homo sapiens
tgtagcataactgt

SEQ ID NO: 651152 - DNA, 15 bp, Homo sapiens
tgtagcatataggtg

SEQ ID NO: 651153 - DNA, 22 bp, Homo sapiens
tgtagccaggtatggctctgca

SEQ ID NO: 651154 - DNA, 23 bp, Homo sapiens
tgtagcccatccttccctttgga

SEQ ID NO: 651155 - DNA, 15 bp, Homo sapiens
tgtagccctcccact

SEQ ID NO: 651156 - DNA, 21 bp, Homo sapiens
tgtagccctcccactttgctg

SEQ ID NO: 651157 - DNA, 18 bp, Homo sapiens
tgtaggatttttttcctc

SEQ ID NO: 651158 - DNA, 15 bp, Homo sapiens
tgtaggtaagactgt

SEQ ID NO: 651159 - DNA, 16 bp, Homo sapiens
tgtaggtgtctgcctt

SEQ ID NO: 651160 - DNA, 13 bp, Homo sapiens
tgtataaaataca

SEQ ID NO: 651161 - DNA, 19 bp, Homo sapiens
tgtataaaatacatagtga

SEQ ID NO: 651162 - DNA, 22 bp, Homo sapiens
tgtataaaatacatagtgaaaa

SEQ ID NO: 651163 - DNA, 13 bp, Homo sapiens
tgtataaagcatg

SEQ ID NO: 651164 - DNA, 15 bp, Homo sapiens
tgtataaccaagtgt

SEQ ID NO: 651165 - DNA, 20 bp, Homo sapiens
tgtatagaaaattcttgaga

SEQ ID NO: 651166 - DNA, 23 bp, Homo sapiens
tgtatagaaaattcttgagaagt

SEQ ID NO: 651167 - DNA, 17 bp, Homo sapiens
tgtgtacacctctggat

SEQ ID NO: 651168 - DNA, 18 bp, Homo sapiens
tgtgtaggtgtctgcctt

SEQ ID NO: 651169 - DNA, 22 bp, Homo sapiens
tgtgtatatattttgtgtgaaa

SEQ ID NO: 651170 - DNA, 16 bp, Homo sapiens
tgtgtatgtaaagtta

SEQ ID NO: 651171 - DNA, 16 bp, Homo sapiens
tgtgtatttcttatac

SEQ ID NO: 651172 - DNA, 13 bp, Homo sapiens
tgtgtcatttctt

SEQ ID NO: 651173 - DNA, 13 bp, Homo sapiens
tgtgtcccaggca

SEQ ID NO: 651174 - DNA, 14 bp, Homo sapiens
tgtgtcccaggcag

SEQ ID NO: 651175 - DNA, 19 bp, Homo sapiens
tgtgtcccaggcagggaga

SEQ ID NO: 651176 - DNA, 14 bp, Homo sapiens
tgtgtgaaattgca

SEQ ID NO: 651177 - DNA, 13 bp, Homo sapiens
tgtgtgaatgtgg

SEQ ID NO: 651178 - DNA, 16 bp, Homo sapiens
tgtgtgccatattctg

SEQ ID NO: 651179 - DNA, 18 bp, Homo sapiens
tgtgtgccatattctggt

SEQ ID NO: 651180 - DNA, 23 bp, Homo sapiens
tgtgtggattgcctctgaaaagt

SEQ ID NO: 651181 - DNA, 16 bp, Homo sapiens
tgtgtggtggcctcag

SEQ ID NO: 651182 - DNA, 15 bp, Homo sapiens
tgtgtgtcccaggca

SEQ ID NO: 651183 - DNA, 13 bp, Homo sapiens
tgtgtgtgcgtgt

SEQ ID NO: 651184 - DNA, 12 bp, Homo sapiens
tgtgtgtgtgca

SEQ ID NO: 651185 - DNA, 15 bp, Homo sapiens
tgtgtgtgtgcacat

SEQ ID NO: 651186 - DNA, 12 bp, Homo sapiens
tgtgtgtgttct

SEQ ID NO: 651187 - DNA, 14 bp, Homo sapiens
tgtgttctgctcca

SEQ ID NO: 651188 - DNA, 16 bp, Homo sapiens
tgtgtttgaaatcatc

SEQ ID NO: 651189 - DNA, 18 bp, Homo sapiens
tgtgtttttctttttcca

SEQ ID NO: 651190 - DNA, 16 bp, Homo sapiens
tgtgtttttgggaaga

SEQ ID NO: 651191 - DNA, 12 bp, Homo sapiens
tgttaaacacta

SEQ ID NO: 651192 - DNA, 20 bp, Homo sapiens
tgttaaatatttgtccttaa

SEQ ID NO: 651193 - DNA, 22 bp, Homo sapiens
tgttaatacaaggtataataaa

SEQ ID NO: 651194 - DNA, 18 bp, Homo sapiens
tgttaattataggagcct

SEQ ID NO: 651195 - DNA, 21 bp, Homo sapiens
tgttacaggcaccgagaatgt

SEQ ID NO: 651196 - DNA, 23 bp, Homo sapiens
tgttacaggcaccgagaatgttg

SEQ ID NO: 651197 - DNA, 14 bp, Homo sapiens
tgttactattttct

SEQ ID NO: 651198 - DNA, 20 bp, Homo sapiens
tgttactattttctacaatt

SEQ ID NO: 651199 - DNA, 15 bp, Homo sapiens
tgttactgggccctg

SEQ ID NO: 651200 - DNA, 14 bp, Homo sapiens
tgttacttccttat

SEQ ID NO: 651201 - DNA, 15 bp, Homo sapiens
tgttacttccttatg

SEQ ID NO: 651202 - DNA, 17 bp, Homo sapiens
tgttagaaaacaaaatt

SEQ ID NO: 651203 - DNA, 17 bp, Homo sapiens
tgttagcacattgataa

SEQ ID NO: 651204 - DNA, 14 bp, Homo sapiens
tgttagctttccaa

SEQ ID NO: 651205 - DNA, 18 bp, Homo sapiens
tgttagtaatggcagagc

SEQ ID NO: 651206 - DNA, 15 bp, Homo sapiens
tgttatatataataa

SEQ ID NO: 651207 - DNA, 18 bp, Homo sapiens
tgttatgatttccttcaa

SEQ ID NO: 651208 - DNA, 15 bp, Homo sapiens
tgttattcaaatttg

SEQ ID NO: 651209 - DNA, 15 bp, Homo sapiens
tgttatttcttccct

SEQ ID NO: 651210 - DNA, 17 bp, Homo sapiens
tgttcagctctttccaa

SEQ ID NO: 651211 - DNA, 19 bp, Homo sapiens
tgttcagctctttccaaat

SEQ ID NO: 651212 - DNA, 13 bp, Homo sapiens
tgttcaggcattc

SEQ ID NO: 651213 - DNA, 18 bp, Homo sapiens
tgttcaggcattccaggt

SEQ ID NO: 651214 - DNA, 19 bp, Homo sapiens
tgttcatttctaaatttat

SEQ ID NO: 651215 - DNA, 23 bp, Homo sapiens
tgttccactgcaaataaagcctt

SEQ ID NO: 651216 - DNA, 16 bp, Homo sapiens
tgttcccacaccccaa

SEQ ID NO: 651217 - DNA, 14 bp, Homo sapiens
tgttcccccagggg

SEQ ID NO: 651218 - DNA, 16 bp, Homo sapiens
tgttcctaacaaaatg

SEQ ID NO: 651219 - DNA, 20 bp, Homo sapiens
tgttcctaacaaaatgagat

SEQ ID NO: 651220 - DNA, 14 bp, Homo sapiens
tgttcctcaaatca

SEQ ID NO: 651221 - DNA, 23 bp, Homo sapiens
tgttcctcaaatcagtgataatt

SEQ ID NO: 651222 - DNA, 22 bp, Homo sapiens
tgttcgttgcacagctgtttga

SEQ ID NO: 651223 - DNA, 22 bp, Homo sapiens
tgttctaaaatgtcaaggcagt

SEQ ID NO: 651224 - DNA, 17 bp, Homo sapiens
tgttctcctgaatattt

SEQ ID NO: 651225 - DNA, 15 bp, Homo sapiens
tgttctgcctctccc

SEQ ID NO: 651226 - DNA, 20 bp, Homo sapiens
tgttctgcctctccctgggt

SEQ ID NO: 651227 - DNA, 21 bp, Homo sapiens
tgttctggggggacccagtgc

SEQ ID NO: 651228 - DNA, 23 bp, Homo sapiens
tgttctggggggacccagtgcag

SEQ ID NO: 651229 - DNA, 19 bp, Homo sapiens
tgttctgtggttcctctgc

SEQ ID NO: 651230 - DNA, 15 bp, Homo sapiens
tgttgattaaagatg

SEQ ID NO: 651231 - DNA, 15 bp, Homo sapiens
tgttgcatatagtta

SEQ ID NO: 651232 - DNA, 17 bp, Homo sapiens
tgttgcatatagttaaa

SEQ ID NO: 651233 - DNA, 16 bp, Homo sapiens
tgttgccttcatcttc

SEQ ID NO: 651234 - DNA, 23 bp, Homo sapiens
tgttggcaaacgagactttctcc

SEQ ID NO: 651235 - DNA, 12 bp, Homo sapiens
tgttggtctgcc

SEQ ID NO: 651236 - DNA, 15 bp, Homo sapiens
tgttgtacttaaatg

SEQ ID NO: 651237 - DNA, 16 bp, Homo sapiens
tgttgtacttaaatgg

SEQ ID NO: 651238 - DNA, 18 bp, Homo sapiens
tgttgtatatcactaaaa

SEQ ID NO: 651239 - DNA, 22 bp, Homo sapiens
tgttgtatatcactaaaagcat

SEQ ID NO: 651240 - DNA, 18 bp, Homo sapiens
tgtttaaaagaaatatat

SEQ ID NO: 651241 - DNA, 22 bp, Homo sapiens
tgtttaaaatgtaatttaaatg

SEQ ID NO: 651242 - DNA, 14 bp, Homo sapiens
tgtttaataaagct

SEQ ID NO: 651243 - DNA, 13 bp, Homo sapiens
ttaaacagaggat

SEQ ID NO: 651244 - DNA, 14 bp, Homo sapiens
ttaaactatcttgt

SEQ ID NO: 651245 - DNA, 18 bp, Homo sapiens
ttaaactgagagtaattc

SEQ ID NO: 651246 - DNA, 15 bp, Homo sapiens
ttaaagaagctttat

SEQ ID NO: 651247 - DNA, 20 bp, Homo sapiens
ttaaagaccctcctattcta

SEQ ID NO: 651248 - DNA, 18 bp, Homo sapiens
ttaaagggtttgagatgt

SEQ ID NO: 651249 - DNA, 13 bp, Homo sapiens
ttaaataaaagct

SEQ ID NO: 651250 - DNA, 14 bp, Homo sapiens
ttaaataactgtgt

SEQ ID NO: 651251 - DNA, 20 bp, Homo sapiens
ttaaataatgcttcagatat

SEQ ID NO: 651252 - DNA, 22 bp, Homo sapiens
ttaaatcacagcccaaaatttg

SEQ ID NO: 651253 - DNA, 15 bp, Homo sapiens
ttaaatccaataaaa

SEQ ID NO: 651254 - DNA, 13 bp, Homo sapiens
ttaaatcctttta

SEQ ID NO: 651255 - DNA, 16 bp, Homo sapiens
ttaaatgcaataattt

SEQ ID NO: 651256 - DNA, 17 bp, Homo sapiens
ttaaatgcaataatttt

SEQ ID NO: 651257 - DNA, 19 bp, Homo sapiens
ttaaatgcaataattttac

SEQ ID NO: 651258 - DNA, 18 bp, Homo sapiens
ttaaatgtttatactgta

SEQ ID NO: 651259 - DNA, 19 bp, Homo sapiens
ttaaatgtttatactgtat

SEQ ID NO: 651260 - DNA, 14 bp, Homo sapiens
ttaaattcagtaat

SEQ ID NO: 651261 - DNA, 16 bp, Homo sapiens
ttaacatacaagaaaa

SEQ ID NO: 651262 - DNA, 18 bp, Homo sapiens
ttaacattttggaaattg

SEQ ID NO: 651263 - DNA, 19 bp, Homo sapiens
ttaaccattattatgcaaa

SEQ ID NO: 651264 - DNA, 15 bp, Homo sapiens
ttaaccttaaaattg

SEQ ID NO: 651265 - DNA, 21 bp, Homo sapiens
ttaaccttaaaattgatatta

SEQ ID NO: 651266 - DNA, 14 bp, Homo sapiens
ttaacctttgctat

SEQ ID NO: 651267 - DNA, 21 bp, Homo sapiens
ttaacctttgctatgtaaggg

SEQ ID NO: 651268 - DNA, 13 bp, Homo sapiens
ttaagaaaccttg

SEQ ID NO: 651269 - DNA, 22 bp, Homo sapiens
ttaagaaatagacagcatgaga

SEQ ID NO: 651270 - DNA, 20 bp, Homo sapiens
ttaagaatagaaaactgggt

SEQ ID NO: 651271 - DNA, 23 bp, Homo sapiens
ttaagagcagaacagatctttta

SEQ ID NO: 651272 - DNA, 12 bp, Homo sapiens
ttaagatgtgaa

SEQ ID NO: 651273 - DNA, 14 bp, Homo sapiens
ttaagatgtgaaaa

SEQ ID NO: 651274 - DNA, 17 bp, Homo sapiens
ttaagatgtgaaaatta

SEQ ID NO: 651275 - DNA, 23 bp, Homo sapiens
ttaagctgcagagatttctcatt

SEQ ID NO: 651276 - DNA, 18 bp, Homo sapiens
ttaaggggaagaatgaaa

SEQ ID NO: 651277 - DNA, 18 bp, Homo sapiens
ttaaggggtatcatgtat

SEQ ID NO: 651278 - DNA, 14 bp, Homo sapiens
ttaagtcagatttt

SEQ ID NO: 651279 - DNA, 21 bp, Homo sapiens
ttaagtcagatttttatttat

SEQ ID NO: 651280 - DNA, 21 bp, Homo sapiens
ttaataaaaagctttttcctc

SEQ ID NO: 651281 - DNA, 13 bp, Homo sapiens
ttaatacaaggta

SEQ ID NO: 651282 - DNA, 17 bp, Homo sapiens
ttaatacagctcagtaa

SEQ ID NO: 651283 - DNA, 23 bp, Homo sapiens
ttaatagtcaccttcatgattat

SEQ ID NO: 651284 - DNA, 15 bp, Homo sapiens
ttaatagtttgtcta

SEQ ID NO: 651285 - DNA, 21 bp, Homo sapiens
ttaatcaagatttttttcctg

SEQ ID NO: 651286 - DNA, 17 bp, Homo sapiens
ttaatccttctttgtaa

SEQ ID NO: 651287 - DNA, 17 bp, Homo sapiens
ttaatctctaacagtgg

SEQ ID NO: 651288 - DNA, 18 bp, Homo sapiens
ttaatctctaacagtgga

SEQ ID NO: 651289 - DNA, 16 bp, Homo sapiens
ttaatctgggagcagg

SEQ ID NO: 651290 - DNA, 20 bp, Homo sapiens
ttaatcttcaaagccttctc

SEQ ID NO: 651291 - DNA, 21 bp, Homo sapiens
ttaatgatatgcttgtaacta

SEQ ID NO: 651292 - DNA, 22 bp, Homo sapiens
ttaatgctgtttctaagaaaat

SEQ ID NO: 651293 - DNA, 24 bp, Homo sapiens
ttaatgctgtttctaagaaaatgt

SEQ ID NO: 651294 - DNA, 21 bp, Homo sapiens
ttaatggcatttctctttaaa

SEQ ID NO: 651295 - DNA, 14 bp, Homo sapiens
ttaattactggaat

SEQ ID NO: 651296 - DNA, 12 bp, Homo sapiens
ttaatttagaaa

SEQ ID NO: 651297 - DNA, 15 bp, Homo sapiens
ttaatttagaaactg

SEQ ID NO: 651298 - DNA, 18 bp, Homo sapiens
ttaatttagaaactgaaa

SEQ ID NO: 651299 - DNA, 20 bp, Homo sapiens
ttaatttgtaaaacttctgc

SEQ ID NO: 651300 - DNA, 18 bp, Homo sapiens
ttaattttaaagtgcaaa

SEQ ID NO: 651301 - DNA, 18 bp, Homo sapiens
ttacaacatttatgtgag

SEQ ID NO: 651302 - DNA, 17 bp, Homo sapiens
ttacaagtaatgtaaag

SEQ ID NO: 651303 - DNA, 15 bp, Homo sapiens
ttacaatgtgaataa

SEQ ID NO: 651304 - DNA, 16 bp, Homo sapiens
ttacactttttggaag

SEQ ID NO: 651305 - DNA, 17 bp, Homo sapiens
ttacaggcaccgagaat

SEQ ID NO: 651306 - DNA, 22 bp, Homo sapiens
ttacagggtaactgtgctgaat

SEQ ID NO: 651307 - DNA, 16 bp, Homo sapiens
ttacatgctgtatatg

SEQ ID NO: 651308 - DNA, 19 bp, Homo sapiens
ttaccagggactatctttg

SEQ ID NO: 651309 - DNA, 16 bp, Homo sapiens
ttatggatgatttaag

SEQ ID NO: 651310 - DNA, 16 bp, Homo sapiens
ttatggcagaagggaa

SEQ ID NO: 651311 - DNA, 15 bp, Homo sapiens
ttatgggcccctggc

SEQ ID NO: 651312 - DNA, 15 bp, Homo sapiens
ttatgtagatgtgca

SEQ ID NO: 651313 - DNA, 11 bp, Homo sapiens
ttatgtagttt

SEQ ID NO: 651314 - DNA, 21 bp, Homo sapiens
ttatgtagtttttatatgttg

SEQ ID NO: 651315 - DNA, 15 bp, Homo sapiens
ttatgtattgtttta

SEQ ID NO: 651316 - DNA, 21 bp, Homo sapiens
ttatgtcagcacacacttaca

SEQ ID NO: 651317 - DNA, 12 bp, Homo sapiens
ttatgtgaaaaa

SEQ ID NO: 651318 - DNA, 18 bp, Homo sapiens
ttatgtgaaatgctttct

SEQ ID NO: 651319 - DNA, 23 bp, Homo sapiens
ttatgttgttgttgtttttggat

SEQ ID NO: 651320 - DNA, 16 bp, Homo sapiens
ttattaatgttttcaa

SEQ ID NO: 651321 - DNA, 17 bp, Homo sapiens
ttattaatgttttcaaa

SEQ ID NO: 651322 - DNA, 12 bp, Homo sapiens
ttattataaagc

SEQ ID NO: 651323 - DNA, 23 bp, Homo sapiens
ttattcaaatttgatgatgttaa

SEQ ID NO: 651324 - DNA, 16 bp, Homo sapiens
ttattcaatatggtta

SEQ ID NO: 651325 - DNA, 18 bp, Homo sapiens
ttattcccgacgacacat

SEQ ID NO: 651326 - DNA, 22 bp, Homo sapiens
ttattctttgaaaacagatgac

SEQ ID NO: 651327 - DNA, 11 bp, Homo sapiens
ttatttagcat

SEQ ID NO: 651328 - DNA, 17 bp, Homo sapiens
ttatttcctttgtcctt

SEQ ID NO: 651329 - DNA, 22 bp, Homo sapiens
ttatttctaatccttttcctta

SEQ ID NO: 651330 - DNA, 18 bp, Homo sapiens
ttatttctagtccaaaat

SEQ ID NO: 651331 - DNA, 12 bp, Homo sapiens
ttatttctatga

SEQ ID NO: 651332 - DNA, 13 bp, Homo sapiens
ttatttcttccct

SEQ ID NO: 651333 - DNA, 12 bp, Homo sapiens
ttatttgcaatt

SEQ ID NO: 651334 - DNA, 22 bp, Homo sapiens
ttatttgcaatttgagccattt

SEQ ID NO: 651335 - DNA, 18 bp, Homo sapiens
ttattttaaaatatatga

SEQ ID NO: 651336 - DNA, 20 bp, Homo sapiens
ttattttacagctcattaaa

SEQ ID NO: 651337 - DNA, 19 bp, Homo sapiens
ttattttgtgctcatttaa

SEQ ID NO: 651338 - DNA, 18 bp, Homo sapiens
ttatttttataattgtac

SEQ ID NO: 651339 - DNA, 21 bp, Homo sapiens
ttattttttggacttcaaagc

SEQ ID NO: 651340 - DNA, 15 bp, Homo sapiens
ttcaaaaaaatctat

SEQ ID NO: 651341 - DNA, 14 bp, Homo sapiens
ttcaaaaagatatt

SEQ ID NO: 651342 - DNA, 20 bp, Homo sapiens
ttcaaaagtttgtttgctta

SEQ ID NO: 651343 - DNA, 12 bp, Homo sapiens
ttcaaatttgat

SEQ ID NO: 651344 - DNA, 14 bp, Homo sapiens
ttcaaatttgatga

SEQ ID NO: 651345 - DNA, 15 bp, Homo sapiens
ttcaacaaagtattt

SEQ ID NO: 651346 - DNA, 16 bp, Homo sapiens
ttcaacttatttcata

SEQ ID NO: 651347 - DNA, 14 bp, Homo sapiens
ttcaagaaaatctt

SEQ ID NO: 651348 - DNA, 13 bp, Homo sapiens
ttcaagaaaggaa

SEQ ID NO: 651349 - DNA, 16 bp, Homo sapiens
ttcaagaatgaaaaat

SEQ ID NO: 651350 - DNA, 16 bp, Homo sapiens
ttcaaggagaatatga

SEQ ID NO: 651351 - DNA, 21 bp, Homo sapiens
ttcaaggatatactgcagctt

SEQ ID NO: 651352 - DNA, 13 bp, Homo sapiens
ttcaagtttacac

SEQ ID NO: 651353 - DNA, 16 bp, Homo sapiens
ttcaatatgaatctat

SEQ ID NO: 651354 - DNA, 22 bp, Homo sapiens
ttcaatatgaatctataagtag

SEQ ID NO: 651355 - DNA, 20 bp, Homo sapiens
ttcaatgacttctaatttat

SEQ ID NO: 651356 - DNA, 16 bp, Homo sapiens
ttcaatgtgcataatg

SEQ ID NO: 651357 - DNA, 19 bp, Homo sapiens
ttcacaaatgtcattgtct

SEQ ID NO: 651358 - DNA, 16 bp, Homo sapiens
ttcacatgtttaactt

SEQ ID NO: 651359 - DNA, 15 bp, Homo sapiens
ttcaccaaaattatc

SEQ ID NO: 651360 - DNA, 14 bp, Homo sapiens
ttcacccaccatgc

SEQ ID NO: 651361 - DNA, 20 bp, Homo sapiens
ttcagaaatataacacattt

SEQ ID NO: 651362 - DNA, 11 bp, Homo sapiens
ttcagaagacc

SEQ ID NO: 651363 - DNA, 19 bp, Homo sapiens
ttcagaaggttattttctt

SEQ ID NO: 651364 - DNA, 23 bp, Homo sapiens
ttcagaaggttattttctttatc

SEQ ID NO: 651365 - DNA, 15 bp, Homo sapiens
ttcagacaagacaga

SEQ ID NO: 651366 - DNA, 16 bp, Homo sapiens
ttcagacaagacagag

SEQ ID NO: 651367 - DNA, 24 bp, Homo sapiens
ttcagacacagctcttccagggca

SEQ ID NO: 651368 - DNA, 12 bp, Homo sapiens
ttcagatacatg

SEQ ID NO: 651369 - DNA, 21 bp, Homo sapiens
ttcagatcactgaatttataa

SEQ ID NO: 651370 - DNA, 21 bp, Homo sapiens
ttcagcaccagttatgtttga

SEQ ID NO: 651371 - DNA, 13 bp, Homo sapiens
tttaatttgtaaa

SEQ ID NO: 651372 - DNA, 15 bp, Homo sapiens
tttaattttaatgct

SEQ ID NO: 651373 - DNA, 21 bp, Homo sapiens
tttacaaaagatttattgtaa

SEQ ID NO: 651374 - DNA, 21 bp, Homo sapiens
tttaccctcttgaatataatc

SEQ ID NO: 651375 - DNA, 22 bp, Homo sapiens
tttacccttttcccccttccca

SEQ ID NO: 651376 - DNA, 13 bp, Homo sapiens
tttactctttgaa

SEQ ID NO: 651377 - DNA, 22 bp, Homo sapiens
tttactgcctgaataaagagcc

SEQ ID NO: 651378 - DNA, 23 bp, Homo sapiens
tttactgtctattaatattcagg

SEQ ID NO: 651379 - DNA, 12 bp, Homo sapiens
tttactttggcc

SEQ ID NO: 651380 - DNA, 19 bp, Homo sapiens
tttacttttttttttttct

SEQ ID NO: 651381 - DNA, 15 bp, Homo sapiens
tttagaaactgaaaa

SEQ ID NO: 651382 - DNA, 16 bp, Homo sapiens
tttagaaactgaaaaa

SEQ ID NO: 651383 - DNA, 18 bp, Homo sapiens
tttagaaactgaaaaata

SEQ ID NO: 651384 - DNA, 20 bp, Homo sapiens
tttagaaactgaaaaatatc

SEQ ID NO: 651385 - DNA, 17 bp, Homo sapiens
tttagatgaggaaatga

SEQ ID NO: 651386 - DNA, 17 bp, Homo sapiens
tttagatgtaattttgt

SEQ ID NO: 651387 - DNA, 22 bp, Homo sapiens
tttagcaatagctagctatata

SEQ ID NO: 651388 - DNA, 15 bp, Homo sapiens
tttagtattatcaaa

SEQ ID NO: 651389 - DNA, 18 bp, Homo sapiens
tttagtgtttatgtttaa

SEQ ID NO: 651390 - DNA, 16 bp, Homo sapiens
tttagttgccaacagt

SEQ ID NO: 651391 - DNA, 23 bp, Homo sapiens
tttataaacagacaatatgtgag

SEQ ID NO: 651392 - DNA, 20 bp, Homo sapiens
tttataaataaactgttgct

SEQ ID NO: 651393 - DNA, 15 bp, Homo sapiens
tttataattgtacaa

SEQ ID NO: 651394 - DNA, 21 bp, Homo sapiens
tttatacaatggaataaatta

SEQ ID NO: 651395 - DNA, 19 bp, Homo sapiens
tttatactgtatttctaag

SEQ ID NO: 651396 - DNA, 14 bp, Homo sapiens
tttatattatccat

SEQ ID NO: 651397 - DNA, 22 bp, Homo sapiens
tttatcataaacattttacatg

SEQ ID NO: 651398 - DNA, 16 bp, Homo sapiens
tttatccaaaatgtgt

SEQ ID NO: 651399 - DNA, 18 bp, Homo sapiens
tttatccaaaatgtgtat

SEQ ID NO: 651400 - DNA, 22 bp, Homo sapiens
tttatccaaaatgtgtatttct

SEQ ID NO: 651401 - DNA, 12 bp, Homo sapiens
tttatgagccag

SEQ ID NO: 651402 - DNA, 17 bp, Homo sapiens
tttatgagccagacaaa

SEQ ID NO: 651403 - DNA, 19 bp, Homo sapiens
tttatgagccagacaaatg

SEQ ID NO: 651404 - DNA, 14 bp, Homo sapiens
tttatgatcagtgt

SEQ ID NO: 651405 - DNA, 16 bp, Homo sapiens
tttatgcaaaaggttt

SEQ ID NO: 651406 - DNA, 14 bp, Homo sapiens
tttatgcagcaaat

SEQ ID NO: 651407 - DNA, 21 bp, Homo sapiens
tttatgctactgaactgaaag

SEQ ID NO: 651408 - DNA, 22 bp, Homo sapiens
tttatggccacatttaatatct

SEQ ID NO: 651409 - DNA, 20 bp, Homo sapiens
tttatgtgaaatgctttctg

SEQ ID NO: 651410 - DNA, 12 bp, Homo sapiens
tttatgttcctt

SEQ ID NO: 651411 - DNA, 13 bp, Homo sapiens
tttattaaagatg

SEQ ID NO: 651412 - DNA, 20 bp, Homo sapiens
tttattaataatatttatgt

SEQ ID NO: 651413 - DNA, 18 bp, Homo sapiens
tttattaatgttttcaaa

SEQ ID NO: 651414 - DNA, 14 bp, Homo sapiens
tttattcagaactt

SEQ ID NO: 651415 - DNA, 15 bp, Homo sapiens
tttattcagaacttt

SEQ ID NO: 651416 - DNA, 21 bp, Homo sapiens
tttattcatacgtaaaatttt

SEQ ID NO: 651417 - DNA, 19 bp, Homo sapiens
tttattgttaatacaaggt

SEQ ID NO: 651418 - DNA, 19 bp, Homo sapiens
tttatttcaataaatcttt

SEQ ID NO: 651419 - DNA, 12 bp, Homo sapiens
tttatttctctt

SEQ ID NO: 651420 - DNA, 20 bp, Homo sapiens
tttatttgcaatttgagcca

SEQ ID NO: 651421 - DNA, 23 bp, Homo sapiens
tttatttgcaatttgagccattt

SEQ ID NO: 651422 - DNA, 17 bp, Homo sapiens
tttatttttgcacaact

SEQ ID NO: 651423 - DNA, 15 bp, Homo sapiens
tttatttttttaagt

SEQ ID NO: 651424 - DNA, 21 bp, Homo sapiens
tttcaaaagccttaccttgaa

SEQ ID NO: 651425 - DNA, 19 bp, Homo sapiens
tttcaaacaatcaagttga

SEQ ID NO: 651426 - DNA, 16 bp, Homo sapiens
tttcaaacttactatt

SEQ ID NO: 651427 - DNA, 19 bp, Homo sapiens
tttcaaagcacttaagtgt

SEQ ID NO: 651428 - DNA, 12 bp, Homo sapiens
tttcaaagtttt

SEQ ID NO: 651429 - DNA, 16 bp, Homo sapiens
tttcaagaaaatcttt

SEQ ID NO: 651430 - DNA, 15 bp, Homo sapiens
tttcaataaatcttt

SEQ ID NO: 651431 - DNA, 14 bp, Homo sapiens
tttcagaaatataa

SEQ ID NO: 651432 - DNA, 21 bp, Homo sapiens
tttcagaaatataacacattt

SEQ ID NO: 651433 - DNA, 14 bp, Homo sapiens
tttcataattgcct

SEQ ID NO: 651434 - DNA, 15 bp, Homo sapiens
tttcataattgccta

SEQ ID NO: 651435 - DNA, 22 bp, Homo sapiens
tttcatgtagccagcagaactg

SEQ ID NO: 651436 - DNA, 20 bp, Homo sapiens
tttcatttaaatatctgtta

SEQ ID NO: 651437 - DNA, 16 bp, Homo sapiens
tttccaaatgaaaaat

SEQ ID NO: 651438 - DNA, 14 bp, Homo sapiens
tttccaaattaaaa

SEQ ID NO: 651439 - DNA, 20 bp, Homo sapiens
tttccaaattaaaacaaata

SEQ ID NO: 651440 - DNA, 11 bp, Homo sapiens
tttccagggag

SEQ ID NO: 651441 - DNA, 13 bp, Homo sapiens
tttccagggaggg

SEQ ID NO: 651442 - DNA, 23 bp, Homo sapiens
tttcccacttcccaccctgcccc

SEQ ID NO: 651443 - DNA, 21 bp, Homo sapiens
tttccctggaactcctggcct

SEQ ID NO: 651444 - DNA, 19 bp, Homo sapiens
tttcccttacaaggtgggg

SEQ ID NO: 651445 - DNA, 21 bp, Homo sapiens
tttccctttatttctcttcta

SEQ ID NO: 651446 - DNA, 16 bp, Homo sapiens
tttccgtttgcttttg

SEQ ID NO: 651447 - DNA, 13 bp, Homo sapiens
tttcctaatttat

SEQ ID NO: 651448 - DNA, 14 bp, Homo sapiens
tttcctatccttat

SEQ ID NO: 651449 - DNA, 15 bp, Homo sapiens
tttcctcttccaaag

SEQ ID NO: 651450 - DNA, 17 bp, Homo sapiens
tttccttatttgccttc

SEQ ID NO: 651451 - DNA, 15 bp, Homo sapiens
tttcctttttcttcg

SEQ ID NO: 651452 - DNA, 17 bp, Homo sapiens
tttctaaataaaaatat

SEQ ID NO: 651453 - DNA, 20 bp, Homo sapiens
tttctaaataaaaatatgta

SEQ ID NO: 651454 - DNA, 15 bp, Homo sapiens
tttctaagaaaatgt

SEQ ID NO: 651455 - DNA, 18 bp, Homo sapiens
tttctaatccttttcctt

SEQ ID NO: 651456 - DNA, 19 bp, Homo sapiens
tttctaatccttttcctta

SEQ ID NO: 651457 - DNA, 21 bp, Homo sapiens
tttctacaattaatagtttgt

SEQ ID NO: 651458 - DNA, 15 bp, Homo sapiens
tttctatgacaaatt

SEQ ID NO: 651459 - DNA, 20 bp, Homo sapiens
tttcttgggcagtctttctt

SEQ ID NO: 651460 - DNA, 18 bp, Homo sapiens
tttctttaggagatttat

SEQ ID NO: 651461 - DNA, 18 bp, Homo sapiens
tttctttatcattgctaa

SEQ ID NO: 651462 - DNA, 22 bp, Homo sapiens
tttctttcccatgtatttgtta

SEQ ID NO: 651463 - DNA, 11 bp, Homo sapiens
tttctttgcct

SEQ ID NO: 651464 - DNA, 12 bp, Homo sapiens
tttctttgcctc

SEQ ID NO: 651465 - DNA, 22 bp, Homo sapiens
tttgaaacccctgtaggcctca

SEQ ID NO: 651466 - DNA, 14 bp, Homo sapiens
tttgaaatgtttaa

SEQ ID NO: 651467 - DNA, 17 bp, Homo sapiens
tttgaactggcaattgt

SEQ ID NO: 651468 - DNA, 19 bp, Homo sapiens
tttgaactggtattgttta

SEQ ID NO: 651469 - DNA, 22 bp, Homo sapiens
tttgaagagattgctgacgccc

SEQ ID NO: 651470 - DNA, 20 bp, Homo sapiens
tttgaagtaacttatttgac

SEQ ID NO: 651471 - DNA, 16 bp, Homo sapiens
tttgaatgcttcctga

SEQ ID NO: 651472 - DNA, 13 bp, Homo sapiens
tttgacagccttc

SEQ ID NO: 651473 - DNA, 15 bp, Homo sapiens
tttgactatgaatgt

SEQ ID NO: 651474 - DNA, 20 bp, Homo sapiens
tttgaggcaaattaactgta

SEQ ID NO: 651475 - DNA, 20 bp, Homo sapiens
tttgaggtcaagtaagaaga

SEQ ID NO: 651476 - DNA, 16 bp, Homo sapiens
tttgatacaggaatta

SEQ ID NO: 651477 - DNA, 19 bp, Homo sapiens
tttgatagggaactgggga

SEQ ID NO: 651478 - DNA, 18 bp, Homo sapiens
tttgatcgcttttaataa

SEQ ID NO: 651479 - DNA, 22 bp, Homo sapiens
tttgatcgcttttaataaactg

SEQ ID NO: 651480 - DNA, 12 bp, Homo sapiens
tttgatgataaa

SEQ ID NO: 651481 - DNA, 20 bp, Homo sapiens
tttgatgcccaatatattct

SEQ ID NO: 651482 - DNA, 17 bp, Homo sapiens
tttgattgggatgaatg

SEQ ID NO: 651483 - DNA, 16 bp, Homo sapiens
tttgcaatttgagcca

SEQ ID NO: 651484 - DNA, 17 bp, Homo sapiens
tttgcaatttgagccat

SEQ ID NO: 651485 - DNA, 17 bp, Homo sapiens
tttgcagaagagggtgt

SEQ ID NO: 651486 - DNA, 20 bp, Homo sapiens
tttgcatattttgagaaact

SEQ ID NO: 651487 - DNA, 22 bp, Homo sapiens
tttgcatattttgagaaactgc

SEQ ID NO: 651488 - DNA, 24 bp, Homo sapiens
tttgcatattttgagaaactgctg

SEQ ID NO: 651489 - DNA, 18 bp, Homo sapiens
tttgccagttttccctgg

SEQ ID NO: 651490 - DNA, 16 bp, Homo sapiens
tttgcctcttctttgt

SEQ ID NO: 651491 - DNA, 20 bp, Homo sapiens
tttgcctcttctttgtgcct

SEQ ID NO: 651492 - DNA, 22 bp, Homo sapiens
tttgcctcttctttgtgccttt

SEQ ID NO: 651493 - DNA, 14 bp, Homo sapiens
tttgctactaagtt

SEQ ID NO: 651494 - DNA, 23 bp, Homo sapiens
tttggacagctgataaatttaat

SEQ ID NO: 651495 - DNA, 17 bp, Homo sapiens
tttggatcttgaatgtg

SEQ ID NO: 651496 - DNA, 15 bp, Homo sapiens
tttggattctaaata

SEQ ID NO: 651497 - DNA, 18 bp, Homo sapiens
tttggattgactctgcat

SEQ ID NO: 651498 - DNA, 12 bp, Homo sapiens
tttggcctgtga

SEQ ID NO: 651499 - DNA, 21 bp, Homo sapiens
tttgggaagaatccagtatta

SEQ ID NO: 651500 - DNA, 12 bp, Homo sapiens
tttgggcagagc

SEQ ID NO: 651501 - DNA, 23 bp, Homo sapiens
tttgggtggggggcattgagtat

SEQ ID NO: 651502 - DNA, 16 bp, Homo sapiens
tttggtgaacagtttt

SEQ ID NO: 651503 - DNA, 12 bp, Homo sapiens
tttggtgtgccc

SEQ ID NO: 651504 - DNA, 18 bp, Homo sapiens
tttggtgtgccctgtgtg

SEQ ID NO: 651505 - DNA, 19 bp, Homo sapiens
tttggtgtgccctgtgtgt

SEQ ID NO: 651506 - DNA, 15 bp, Homo sapiens
tttgtaaaacttctg

SEQ ID NO: 651507 - DNA, 17 bp, Homo sapiens
tttgtaaatgaaactta

SEQ ID NO: 651508 - DNA, 21 bp, Homo sapiens
tttgtaataataaagaatagc

SEQ ID NO: 651509 - DNA, 18 bp, Homo sapiens
tttgtagcataactgtag

SEQ ID NO: 651510 - DNA, 14 bp, Homo sapiens
tttgtatcttttat

SEQ ID NO: 651511 - DNA, 21 bp, Homo sapiens
tttgtatcttttatcctggga

SEQ ID NO: 651512 - DNA, 22 bp, Homo sapiens
tttgtatcttttatcctgggag

SEQ ID NO: 651513 - DNA, 17 bp, Homo sapiens
tttgtatttctctattt

SEQ ID NO: 651514 - DNA, 21 bp, Homo sapiens
tttgtattttcatgaaaatac

SEQ ID NO: 651515 - DNA, 18 bp, Homo sapiens
tttgtcagtttatcttaa

SEQ ID NO: 651516 - DNA, 18 bp, Homo sapiens
tttgtctattttaaaata

SEQ ID NO: 651517 - DNA, 15 bp, Homo sapiens
tttgtcttattctta

SEQ ID NO: 651518 - DNA, 15 bp, Homo sapiens
tttgtgactgtcact

SEQ ID NO: 651519 - DNA, 12 bp, Homo sapiens
tttgtgcctttg

SEQ ID NO: 651520 - DNA, 16 bp, Homo sapiens
tttgtgcctttggcct

SEQ ID NO: 651521 - DNA, 21 bp, Homo sapiens
tttgtgctcatttaagtttca

SEQ ID NO: 651522 - DNA, 19 bp, Homo sapiens
tttgttaaattcagtaatg

SEQ ID NO: 651523 - DNA, 15 bp, Homo sapiens
tttgttacttcctta

SEQ ID NO: 651524 - DNA, 18 bp, Homo sapiens
tttgttgctttcttacct

SEQ ID NO: 651525 - DNA, 18 bp, Homo sapiens
ttttaaaaacctgtatct

SEQ ID NO: 651526 - DNA, 14 bp, Homo sapiens
ttttaaaaactctt

SEQ ID NO: 651527 - DNA, 21 bp, Homo sapiens
ttttaaaaatctaagcagctt

SEQ ID NO: 651528 - DNA, 15 bp, Homo sapiens
ttttaaaactggacc

SEQ ID NO: 651529 - DNA, 17 bp, Homo sapiens
ttttaaaactggacctg

SEQ ID NO: 651530 - DNA, 15 bp, Homo sapiens
ttttaatacattgat

SEQ ID NO: 651531 - DNA, 21 bp, Homo sapiens
ttttaatattcttttgtttcc

SEQ ID NO: 651532 - DNA, 21 bp, Homo sapiens
ttttaatctctaacagtggac

SEQ ID NO: 651533 - DNA, 18 bp, Homo sapiens
ttttaatgctgtttctaa

SEQ ID NO: 651534 - DNA, 13 bp, Homo sapiens
ttttaatggcatt

SEQ ID NO: 651535 - DNA, 20 bp, Homo sapiens
ttttaatgtacttgaaaaat

SEQ ID NO: 651536 - DNA, 15 bp, Homo sapiens
ttttacaagatgtat

SEQ ID NO: 651537 - DNA, 15 bp, Homo sapiens
ttttactccttttta

SEQ ID NO: 651538 - DNA, 13 bp, Homo sapiens
ttttactgtctat

SEQ ID NO: 651539 - DNA, 16 bp, Homo sapiens
ttttagaaatgcatat

SEQ ID NO: 651540 - DNA, 16 bp, Homo sapiens
ttttataattgtacaa

SEQ ID NO: 651541 - DNA, 17 bp, Homo sapiens
ttttatagcctggactg

SEQ ID NO: 651542 - DNA, 13 bp, Homo sapiens
ttttatgatcagt

SEQ ID NO: 651543 - DNA, 13 bp, Homo sapiens
ttttattaattta

SEQ ID NO: 651544 - DNA, 13 bp, Homo sapiens
ttttattctccag

SEQ ID NO: 651545 - DNA, 21 bp, Homo sapiens
ttttcaagtttacacttcata

SEQ ID NO: 651546 - DNA, 16 bp, Homo sapiens
ttttcaataaatcagc

SEQ ID NO: 651547 - DNA, 20 bp, Homo sapiens
ttttcaataccaattacatg

SEQ ID NO: 651548 - DNA, 14 bp, Homo sapiens
ttttcataaacaag

SEQ ID NO: 651549 - DNA, 22 bp, Homo sapiens
ttttcatctttaagaatgctta

SEQ ID NO: 651550 - DNA, 14 bp, Homo sapiens
ttttcatttcatga

SEQ ID NO: 651551 - DNA, 21 bp, Homo sapiens
ttttccatgatttagcaagca

SEQ ID NO: 651552 - DNA, 17 bp, Homo sapiens
ttttctaaataaaaata

SEQ ID NO: 651553 - DNA, 15 bp, Homo sapiens
ttttctaaatttatc

SEQ ID NO: 651554 - DNA, 19 bp, Homo sapiens
ttttctattatttttataa

SEQ ID NO: 651555 - DNA, 15 bp, Homo sapiens
ttttctcagtcctaa

SEQ ID NO: 651556 - DNA, 12 bp, Homo sapiens
ttttctcccaag

SEQ ID NO: 651557 - DNA, 19 bp, Homo sapiens
ttttctcccaagaaacctg

SEQ ID NO: 651558 - DNA, 22 bp, Homo sapiens
ttttctcccaagctgattttat

SEQ ID NO: 651559 - DNA, 14 bp, Homo sapiens
ttttctcggtgggg

SEQ ID NO: 651560 - DNA, 17 bp, Homo sapiens
tgacccccatctgagct

SEQ ID NO: 651561 - DNA, 21 bp, Homo sapiens
tgacccccatctgagctgggg

SEQ ID NO: 651562 - DNA, 21 bp, Homo sapiens
tgacccccttgattcccaccg

SEQ ID NO: 651563 - DNA, 12 bp, Homo sapiens
tgaccgagagaa

SEQ ID NO: 651564 - DNA, 22 bp, Homo sapiens
tgacctggcatctaattctgat

SEQ ID NO: 651565 - DNA, 15 bp, Homo sapiens
tgacctgtttctctg

SEQ ID NO: 651566 - DNA, 14 bp, Homo sapiens
tgacgatgatgtac

SEQ ID NO: 651567 - DNA, 21 bp, Homo sapiens
tgacgtgctccgtagctctgc

SEQ ID NO: 651568 - DNA, 15 bp, Homo sapiens
tgactaactcaaata

SEQ ID NO: 651569 - DNA, 24 bp, Homo sapiens
tgactacgtcttaagtcagatttt

SEQ ID NO: 651570 - DNA, 15 bp, Homo sapiens
tgactactttgcctt

SEQ ID NO: 651571 - DNA, 16 bp, Homo sapiens
tgactcaattatttgc

SEQ ID NO: 651572 - DNA, 14 bp, Homo sapiens
tgactccctgggag

SEQ ID NO: 651573 - DNA, 15 bp, Homo sapiens
tgactccctgggagc

SEQ ID NO: 651574 - DNA, 15 bp, Homo sapiens
tgactcttactcctt

SEQ ID NO: 651575 - DNA, 12 bp, Homo sapiens
tgactgaaatta

SEQ ID NO: 651576 - DNA, 13 bp, Homo sapiens
tgactgaaattac

SEQ ID NO: 651577 - DNA, 14 bp, Homo sapiens
tgactgaaattact

SEQ ID NO: 651578 - DNA, 15 bp, Homo sapiens
tgactgaaattactt

SEQ ID NO: 651579 - DNA, 23 bp, Homo sapiens
tgactgaaattactttaacattt

SEQ ID NO: 651580 - DNA, 12 bp, Homo sapiens
tgactgaatgca

SEQ ID NO: 651581 - DNA, 16 bp, Homo sapiens
tgactgacaaagacat

SEQ ID NO: 651582 - DNA, 19 bp, Homo sapiens
tgactgcattgccgctgta

SEQ ID NO: 651583 - DNA, 22 bp, Homo sapiens
tgactgtcacttgctgcttttt

SEQ ID NO: 651584 - DNA, 17 bp, Homo sapiens
tgactgttagttgtcca

SEQ ID NO: 651585 - DNA, 21 bp, Homo sapiens
tgacttagcgtcaagacattt

SEQ ID NO: 651586 - DNA, 17 bp, Homo sapiens
tgacttattttgtctta

SEQ ID NO: 651587 - DNA, 21 bp, Homo sapiens
tgacttattttgtcttattct

SEQ ID NO: 651588 - DNA, 17 bp, Homo sapiens
tgacttcctctggtgtt

SEQ ID NO: 651589 - DNA, 12 bp, Homo sapiens
tgacttgcttta

SEQ ID NO: 651590 - DNA, 13 bp, Homo sapiens
tgactttcctccc

SEQ ID NO: 651591 - DNA, 14 bp, Homo sapiens
tgactttgctttga

SEQ ID NO: 651592 - DNA, 16 bp, Homo sapiens
tgacttttataaagca

SEQ ID NO: 651593 - DNA, 15 bp, Homo sapiens
tgagaaactgctgca

SEQ ID NO: 651594 - DNA, 16 bp, Homo sapiens
tgagaaggtttattgt

SEQ ID NO: 651595 - DNA, 19 bp, Homo sapiens
tgagaaggtttattgttaa

SEQ ID NO: 651596 - DNA, 20 bp, Homo sapiens
tgagacaatgttttcttcaa

SEQ ID NO: 651597 - DNA, 19 bp, Homo sapiens
tgagactaaattcaatcac

SEQ ID NO: 651598 - DNA, 15 bp, Homo sapiens
tgagactcagtgcag

SEQ ID NO: 651599 - DNA, 16 bp, Homo sapiens
tgagactcagtgcaga

SEQ ID NO: 651600 - DNA, 18 bp, Homo sapiens
tgagactcagtgcagatg

SEQ ID NO: 651601 - DNA, 21 bp, Homo sapiens
tgagactctagggtccagtgg

SEQ ID NO: 651602 - DNA, 20 bp, Homo sapiens
tgagagctgtttttgacagc

SEQ ID NO: 651603 - DNA, 18 bp, Homo sapiens
tgagaggagaaatgcaat

SEQ ID NO: 651604 - DNA, 23 bp, Homo sapiens
tgagaggagaaatgcaataactc

SEQ ID NO: 651605 - DNA, 19 bp, Homo sapiens
tgagaggctgtctgttgta

SEQ ID NO: 651606 - DNA, 20 bp, Homo sapiens
tgagagtatagcatgaatgt

SEQ ID NO: 651607 - DNA, 23 bp, Homo sapiens
tgagagtatttaggcagattgaa

SEQ ID NO: 651608 - DNA, 20 bp, Homo sapiens
tgagatcgtgctactgcact

SEQ ID NO: 651609 - DNA, 21 bp, Homo sapiens
tgagatggaaaagtgtccttc

SEQ ID NO: 651610 - DNA, 13 bp, Homo sapiens
tgagatgtaaaaa

SEQ ID NO: 651611 - DNA, 15 bp, Homo sapiens
tgagattggttttcc

SEQ ID NO: 651612 - DNA, 19 bp, Homo sapiens
tgagattggttttcctgtg

SEQ ID NO: 651613 - DNA, 17 bp, Homo sapiens
tgagattttgcttgagc

SEQ ID NO: 651614 - DNA, 16 bp, Homo sapiens
tgagcagtcgcctgcc

SEQ ID NO: 651615 - DNA, 14 bp, Homo sapiens
tgagccagacaaat

SEQ ID NO: 651616 - DNA, 20 bp, Homo sapiens
tgagccagacaaatggagga

SEQ ID NO: 651617 - DNA, 12 bp, Homo sapiens
tgagccagcagg

SEQ ID NO: 651618 - DNA, 15 bp, Homo sapiens
tgagcccagagaaca

SEQ ID NO: 651619 - DNA, 17 bp, Homo sapiens
tgagcccagagaacagc

SEQ ID NO: 651620 - DNA, 14 bp, Homo sapiens
tgagctcaggaggt

SEQ ID NO: 651621 - DNA, 15 bp, Homo sapiens
tgagctctgaaatct

SEQ ID NO: 651622 - DNA, 20 bp, Homo sapiens
tgagctcttcccttattcct

SEQ ID NO: 651623 - DNA, 23 bp, Homo sapiens
tgagctcttcccttattcctaat

SEQ ID NO: 651624 - DNA, 14 bp, Homo sapiens
tgaggaagagtctt

SEQ ID NO: 651625 - DNA, 22 bp, Homo sapiens
tgaggaggatgtccctgggcca

SEQ ID NO: 651626 - DNA, 17 bp, Homo sapiens
tgaggcaaattaactgt

SEQ ID NO: 651627 - DNA, 14 bp, Homo sapiens
tgaggccctgccca

SEQ ID NO: 651628 - DNA, 16 bp, Homo sapiens
tgaggcctgccccctg

SEQ ID NO: 651629 - DNA, 20 bp, Homo sapiens
tgaggcctgccccctgggct

SEQ ID NO: 651630 - DNA, 14 bp, Homo sapiens
tgagggtaagtatt

SEQ ID NO: 651631 - DNA, 16 bp, Homo sapiens
tgaggtcagggagtgc

SEQ ID NO: 651632 - DNA, 12 bp, Homo sapiens
tgaggtcagtgt

SEQ ID NO: 651633 - DNA, 15 bp, Homo sapiens
tgaggtcagtgtttg

SEQ ID NO: 651634 - DNA, 13 bp, Homo sapiens
tgaggtgctatga

SEQ ID NO: 651635 - DNA, 15 bp, Homo sapiens
tgagtaacttagaaa

SEQ ID NO: 651636 - DNA, 19 bp, Homo sapiens
tgagtagatccatttccat

SEQ ID NO: 651637 - DNA, 14 bp, Homo sapiens
tgagtctgggcagc

SEQ ID NO: 651638 - DNA, 21 bp, Homo sapiens
tgagtctgggcagctgtccct

SEQ ID NO: 651639 - DNA, 21 bp, Homo sapiens
tgagtctgtactaaacagtaa

SEQ ID NO: 651640 - DNA, 15 bp, Homo sapiens
tgagtgccttttgca

SEQ ID NO: 651641 - DNA, 21 bp, Homo sapiens
tgagtgggagagtacctgtgt

SEQ ID NO: 651642 - DNA, 15 bp, Homo sapiens
tgagtgtgacagggc

SEQ ID NO: 651643 - DNA, 19 bp, Homo sapiens
tgagtttgtagaactttat

SEQ ID NO: 651644 - DNA, 16 bp, Homo sapiens
tgataaaataaataat

SEQ ID NO: 651645 - DNA, 19 bp, Homo sapiens
tgataaaataaataatttt

SEQ ID NO: 651646 - DNA, 15 bp, Homo sapiens
tgataaatttaatcc

SEQ ID NO: 651647 - DNA, 15 bp, Homo sapiens
tgatagggaactggg

SEQ ID NO: 651648 - DNA, 22 bp, Homo sapiens
tgataggttattttgatgtaaa

SEQ ID NO: 651649 - DNA, 18 bp, Homo sapiens
tgatatctataaaataga

SEQ ID NO: 651650 - DNA, 15 bp, Homo sapiens
tgatattatattaaa

SEQ ID NO: 651651 - DNA, 16 bp, Homo sapiens
tgatattatattaaac

SEQ ID NO: 651652 - DNA, 19 bp, Homo sapiens
tgatattatattaaacata

SEQ ID NO: 651653 - DNA, 17 bp, Homo sapiens
tgatatttcttgctttc

SEQ ID NO: 651654 - DNA, 21 bp, Homo sapiens
tgatatttttatacaagtaat

SEQ ID NO: 651655 - DNA, 17 bp, Homo sapiens
tgatcaagggaatgtaa

SEQ ID NO: 651656 - DNA, 20 bp, Homo sapiens
tgatcaagggaatgtaactg

SEQ ID NO: 651657 - DNA, 23 bp, Homo sapiens
tgatcgcttttaataaactgcaa

SEQ ID NO: 651658 - DNA, 20 bp, Homo sapiens
tgatcgtagaaaatttgctt

SEQ ID NO: 651659 - DNA, 17 bp, Homo sapiens
tgatctctcttgtcctc

SEQ ID NO: 651660 - DNA, 16 bp, Homo sapiens
tgatgattttcatttc

SEQ ID NO: 651661 - DNA, 13 bp, Homo sapiens
tgatgattttcct

SEQ ID NO: 651662 - DNA, 18 bp, Homo sapiens
tgatgattttcctttttc

SEQ ID NO: 651663 - DNA, 15 bp, Homo sapiens
tgatgcccaatatat

SEQ ID NO: 651664 - DNA, 12 bp, Homo sapiens
tgatggcagagg

SEQ ID NO: 651665 - DNA, 17 bp, Homo sapiens
tgatggcttatgatagc

SEQ ID NO: 651666 - DNA, 12 bp, Homo sapiens
tgatggtggccc

SEQ ID NO: 651667 - DNA, 22 bp, Homo sapiens
tgatgtacataactcctgtccc

SEQ ID NO: 651668 - DNA, 13 bp, Homo sapiens
tgatgtttgctct

SEQ ID NO: 651669 - DNA, 22 bp, Homo sapiens
tgatgttttatccttacaatgt

SEQ ID NO: 651670 - DNA, 16 bp, Homo sapiens
tgattaagaaaggaag

SEQ ID NO: 651671 - DNA, 19 bp, Homo sapiens
tgattattttcttcatcca

SEQ ID NO: 651672 - DNA, 16 bp, Homo sapiens
tgattctcagggctgg

SEQ ID NO: 651673 - DNA, 17 bp, Homo sapiens
tgattctggctttaagc

SEQ ID NO: 651674 - DNA, 21 bp, Homo sapiens
tgattctggctttaagccttc

SEQ ID NO: 651675 - DNA, 18 bp, Homo sapiens
tgattgggaaaacatttg

SEQ ID NO: 651676 - DNA, 20 bp, Homo sapiens
tgatttaagtgtctcactaa

SEQ ID NO: 651677 - DNA, 16 bp, Homo sapiens
tgatttagcaagcaac

SEQ ID NO: 651678 - DNA, 17 bp, Homo sapiens
tgatttcactttgggat

SEQ ID NO: 651679 - DNA, 12 bp, Homo sapiens
tgatttctaatt

SEQ ID NO: 651680 - DNA, 14 bp, Homo sapiens
tgatttctaattgt

SEQ ID NO: 651681 - DNA, 14 bp, Homo sapiens
tgattttaatacat

SEQ ID NO: 651682 - DNA, 23 bp, Homo sapiens
tgatttttaagaaagtaatttaa

SEQ ID NO: 651683 - DNA, 20 bp, Homo sapiens
tgcaaaaattcagagtcctt

SEQ ID NO: 651684 - DNA, 22 bp, Homo sapiens
tgcaaaattgtctaaaatgtca

SEQ ID NO: 651685 - DNA, 23 bp, Homo sapiens
tgcaaaatttagaagaaaagtta

SEQ ID NO: 651686 - DNA, 18 bp, Homo sapiens
tgcaaacagaacagggtc

SEQ ID NO: 651687 - DNA, 13 bp, Homo sapiens
tgcaaataaagcc

SEQ ID NO: 651688 - DNA, 15 bp, Homo sapiens
tgcaaataaagcctt

SEQ ID NO: 651689 - DNA, 19 bp, Homo sapiens
tgcaaataaagccttttaa

SEQ ID NO: 651690 - DNA, 18 bp, Homo sapiens
tgcaaatgagctctgaaa

SEQ ID NO: 651691 - DNA, 16 bp, Homo sapiens
tgcaacatttgacaaa

SEQ ID NO: 651692 - DNA, 16 bp, Homo sapiens
tgcaacctctgcctcc

SEQ ID NO: 651693 - DNA, 21 bp, Homo sapiens
tgcaacggtctcctgactggt

SEQ ID NO: 651694 - DNA, 22 bp, Homo sapiens
tgcaacggtctcctgactggtg

SEQ ID NO: 651695 - DNA, 18 bp, Homo sapiens
tgcaactaggtatttcta

SEQ ID NO: 651696 - DNA, 20 bp, Homo sapiens
tgcaactctaactctgagag

SEQ ID NO: 651697 - DNA, 21 bp, Homo sapiens
tgcaagcagaggaccagggcc

SEQ ID NO: 651698 - DNA, 21 bp, Homo sapiens
tgcaagtggtagcaagaagtg

SEQ ID NO: 651699 - DNA, 14 bp, Homo sapiens
tgcaataactctgg

SEQ ID NO: 651700 - DNA, 16 bp, Homo sapiens
tgcaataactctggga

SEQ ID NO: 651701 - DNA, 12 bp, Homo sapiens
tgcaataatttt

SEQ ID NO: 651702 - DNA, 15 bp, Homo sapiens
tgcaatatgcctagt

SEQ ID NO: 651703 - DNA, 16 bp, Homo sapiens
tgcaatccatttattt

SEQ ID NO: 651704 - DNA, 20 bp, Homo sapiens
tgcaatgtccagcagtctga

SEQ ID NO: 651705 - DNA, 22 bp, Homo sapiens
tgcaattgtaggggtgtgtgtg

SEQ ID NO: 651706 - DNA, 21 bp, Homo sapiens
tggggcctagcgatctctcct

SEQ ID NO: 651707 - DNA, 13 bp, Homo sapiens
tggggcctgagag

SEQ ID NO: 651708 - DNA, 12 bp, Homo sapiens
tggggcctgtgg

SEQ ID NO: 651709 - DNA, 21 bp, Homo sapiens
tggggctgcaggcaggcggct

SEQ ID NO: 651710 - DNA, 12 bp, Homo sapiens
tgggggtggggg

SEQ ID NO: 651711 - DNA, 11 bp, Homo sapiens
tggggtgacag

SEQ ID NO: 651712 - DNA, 12 bp, Homo sapiens
tggggtgacagt

SEQ ID NO: 651713 - DNA, 23 bp, Homo sapiens
tggggttgcgtctgaggcctgcc

SEQ ID NO: 651714 - DNA, 22 bp, Homo sapiens
tgggtacatcaagtccatctga

SEQ ID NO: 651715 - DNA, 15 bp, Homo sapiens
tgggtccatcctggt

SEQ ID NO: 651716 - DNA, 20 bp, Homo sapiens
tgggtgattcctaagccact

SEQ ID NO: 651717 - DNA, 14 bp, Homo sapiens
tgggtgctcagaat

SEQ ID NO: 651718 - DNA, 20 bp, Homo sapiens
tgggtggggggcattgagta

SEQ ID NO: 651719 - DNA, 14 bp, Homo sapiens
tggtaagagaagtg

SEQ ID NO: 651720 - DNA, 16 bp, Homo sapiens
tggtacaaggtggaga

SEQ ID NO: 651721 - DNA, 14 bp, Homo sapiens
tggtagagaaggag

SEQ ID NO: 651722 - DNA, 20 bp, Homo sapiens
tggtatatactttgccactg

SEQ ID NO: 651723 - DNA, 16 bp, Homo sapiens
tggtatcatatattaa

SEQ ID NO: 651724 - DNA, 17 bp, Homo sapiens
tggtattctggtaggga

SEQ ID NO: 651725 - DNA, 21 bp, Homo sapiens
tggtcataaaatagaataatt

SEQ ID NO: 651726 - DNA, 15 bp, Homo sapiens
tggtcatgaatagaa

SEQ ID NO: 651727 - DNA, 14 bp, Homo sapiens
tggtcctgaatgta

SEQ ID NO: 651728 - DNA, 12 bp, Homo sapiens
tggtccttattt

SEQ ID NO: 651729 - DNA, 16 bp, Homo sapiens
tggtccttatttattt

SEQ ID NO: 651730 - DNA, 13 bp, Homo sapiens
tggtctcaggata

SEQ ID NO: 651731 - DNA, 23 bp, Homo sapiens
tggtctcaggatatccttatcag

SEQ ID NO: 651732 - DNA, 22 bp, Homo sapiens
tggtctccccaattctcccctc

SEQ ID NO: 651733 - DNA, 18 bp, Homo sapiens
tggtctgccttctgctga

SEQ ID NO: 651734 - DNA, 23 bp, Homo sapiens
tggtctgtgtgtgtgtgtgtgcg

SEQ ID NO: 651735 - DNA, 13 bp, Homo sapiens
tggtgatgactta

SEQ ID NO: 651736 - DNA, 19 bp, Homo sapiens
tggtgatttgaaaaatata

SEQ ID NO: 651737 - DNA, 21 bp, Homo sapiens
tggtgatttgaaaaatataaa

SEQ ID NO: 651738 - DNA, 17 bp, Homo sapiens
tggtgcatagcagatgg

SEQ ID NO: 651739 - DNA, 10 bp, Homo sapiens
tggtggcctc

SEQ ID NO: 651740 - DNA, 13 bp, Homo sapiens
tggtggcctcagc

SEQ ID NO: 651741 - DNA, 16 bp, Homo sapiens
tggtggtttttgctct

SEQ ID NO: 651742 - DNA, 13 bp, Homo sapiens
tggtgtaaacttg

SEQ ID NO: 651743 - DNA, 14 bp, Homo sapiens
tggtgtaaacttgt

SEQ ID NO: 651744 - DNA, 11 bp, Homo sapiens
tggtgtatttt

SEQ ID NO: 651745 - DNA, 16 bp, Homo sapiens
tggtgtgaacccggga

SEQ ID NO: 651746 - DNA, 12 bp, Homo sapiens
tggttaaataaa

SEQ ID NO: 651747 - DNA, 18 bp, Homo sapiens
tggttcagacaagacaga

SEQ ID NO: 651748 - DNA, 22 bp, Homo sapiens
tggttcagacacagctcttcca

SEQ ID NO: 651749 - DNA, 15 bp, Homo sapiens
tggttccctgctgcg

SEQ ID NO: 651750 - DNA, 13 bp, Homo sapiens
tggttggagaagg

SEQ ID NO: 651751 - DNA, 16 bp, Homo sapiens
tggttgggaatgagga

SEQ ID NO: 651752 - DNA, 14 bp, Homo sapiens
tggttgttgcatat

SEQ ID NO: 651753 - DNA, 17 bp, Homo sapiens
tggtttaattcagcaga

SEQ ID NO: 651754 - DNA, 16 bp, Homo sapiens
tgtaaaaatcttttga

SEQ ID NO: 651755 - DNA, 23 bp, Homo sapiens
tgtaaaaatcttttgaagcatag

SEQ ID NO: 651756 - DNA, 13 bp, Homo sapiens
tgtaaaacttctg

SEQ ID NO: 651757 - DNA, 14 bp, Homo sapiens
tgtaaaacttctgc

SEQ ID NO: 651758 - DNA, 14 bp, Homo sapiens
tgtaaacttgtaca

SEQ ID NO: 651759 - DNA, 15 bp, Homo sapiens
tgtaaataaactatt

SEQ ID NO: 651760 - DNA, 15 bp, Homo sapiens
tgtaacactggccag

SEQ ID NO: 651761 - DNA, 17 bp, Homo sapiens
tgtaagaaatacagact

SEQ ID NO: 651762 - DNA, 16 bp, Homo sapiens
tgtaagaacacatttt

SEQ ID NO: 651763 - DNA, 20 bp, Homo sapiens
tgtaagaacacattttaaat

SEQ ID NO: 651764 - DNA, 18 bp, Homo sapiens
tgtaagaattcagaagac

SEQ ID NO: 651765 - DNA, 15 bp, Homo sapiens
tgtaagcttgtgttt

SEQ ID NO: 651766 - DNA, 19 bp, Homo sapiens
tgtaataataaagaatagc

SEQ ID NO: 651767 - DNA, 18 bp, Homo sapiens
tgtaatgtgtggtggcct

SEQ ID NO: 651768 - DNA, 22 bp, Homo sapiens
tgtaatgtgtggtggcctcagc

SEQ ID NO: 651769 - DNA, 15 bp, Homo sapiens
tgtaattaaattctg

SEQ ID NO: 651770 - DNA, 21 bp, Homo sapiens
tgtaattatgttctaagtgcc

SEQ ID NO: 651771 - DNA, 17 bp, Homo sapiens
tgtaatttaaatgaaag

SEQ ID NO: 651772 - DNA, 13 bp, Homo sapiens
tgtaatttcaaaa

SEQ ID NO: 651773 - DNA, 19 bp, Homo sapiens
tgtacaaaattaagcaaat

SEQ ID NO: 651774 - DNA, 14 bp, Homo sapiens
tgtacaaactcatc

SEQ ID NO: 651775 - DNA, 21 bp, Homo sapiens
tgtacaaatacatgtgtatat

SEQ ID NO: 651776 - DNA, 21 bp, Homo sapiens
tgtacacagtgggaagatttt

SEQ ID NO: 651777 - DNA, 17 bp, Homo sapiens
tgtacacatatttgaag

SEQ ID NO: 651778 - DNA, 19 bp, Homo sapiens
tgtacagagtgcttttctg

SEQ ID NO: 651779 - DNA, 18 bp, Homo sapiens
tgtacagattctttcagt

SEQ ID NO: 651780 - DNA, 15 bp, Homo sapiens
tgtacattatgaaga

SEQ ID NO: 651781 - DNA, 14 bp, Homo sapiens
tgtacatttaaaat

SEQ ID NO: 651782 - DNA, 18 bp, Homo sapiens
tgtacatttctataaata

SEQ ID NO: 651783 - DNA, 14 bp, Homo sapiens
tgtaccaagtgaaa

SEQ ID NO: 651784 - DNA, 16 bp, Homo sapiens
tgtaccaagtgaaatt

SEQ ID NO: 651785 - DNA, 19 bp, Homo sapiens
tgtacctcctctcagtgtt

SEQ ID NO: 651786 - DNA, 20 bp, Homo sapiens
tgtacctcctctcagtgttt

SEQ ID NO: 651787 - DNA, 16 bp, Homo sapiens
tgtacctgctggaaga

SEQ ID NO: 651788 - DNA, 18 bp, Homo sapiens
tgtactacagctatattt

SEQ ID NO: 651789 - DNA, 21 bp, Homo sapiens
tgtactacagctatatttgat

SEQ ID NO: 651790 - DNA, 15 bp, Homo sapiens
tgtacttaaatggta

SEQ ID NO: 651791 - DNA, 19 bp, Homo sapiens
tgtacttattacagtctta

SEQ ID NO: 651792 - DNA, 13 bp, Homo sapiens
tgtacttgaaaaa

SEQ ID NO: 651793 - DNA, 18 bp, Homo sapiens
tgtagaaacttaaacaca

SEQ ID NO: 651794 - DNA, 15 bp, Homo sapiens
tgtagaactttatta

SEQ ID NO: 651795 - DNA, 12 bp, Homo sapiens
tgtagaaggagt

SEQ ID NO: 651796 - DNA, 22 bp, Homo sapiens
tgtagaatctcttcatgcttga

SEQ ID NO: 651797 - DNA, 14 bp, Homo sapiens
tgtagactgtggct

SEQ ID NO: 651798 - DNA, 17 bp, Homo sapiens
tgtagagtgtagactgt

SEQ ID NO: 651799 - DNA, 19 bp, Homo sapiens
tgtagatattgtgaagtac

SEQ ID NO: 651800 - DNA, 22 bp, Homo sapiens
tgtagatattgtgaagtacata

SEQ ID NO: 651801 - DNA, 21 bp, Homo sapiens
tgtagcaagtactttggctta

SEQ ID NO: 651802 - DNA, 20 bp, Homo sapiens
tgtagccaggtatggctctg

SEQ ID NO: 651803 - DNA, 21 bp, Homo sapiens
tgtagccaggtatggctctgc

SEQ ID NO: 651804 - DNA, 23 bp, Homo sapiens
tgtagcctcaatcgagtgagaca

SEQ ID NO: 651805 - DNA, 18 bp, Homo sapiens
tgtagctacaagggaagc

SEQ ID NO: 651806 - DNA, 14 bp, Homo sapiens
tgtagctcaagttt

SEQ ID NO: 651807 - DNA, 17 bp, Homo sapiens
tgtagggagaagcttta

SEQ ID NO: 651808 - DNA, 14 bp, Homo sapiens
tgtaggtaagactg

SEQ ID NO: 651809 - DNA, 18 bp, Homo sapiens
tgtaggtgtctgccttca

SEQ ID NO: 651810 - DNA, 23 bp, Homo sapiens
tgtagtcccagctacttgggagg

SEQ ID NO: 651811 - DNA, 19 bp, Homo sapiens
tgtagtttttatatgttgt

SEQ ID NO: 651812 - DNA, 20 bp, Homo sapiens
tgtagtttttatatgttgta

SEQ ID NO: 651813 - DNA, 16 bp, Homo sapiens
tgtataaaatacatag

SEQ ID NO: 651814 - DNA, 12 bp, Homo sapiens
tgtataaatata

SEQ ID NO: 651815 - DNA, 16 bp, Homo sapiens
tgtataaccaagtgtg

SEQ ID NO: 651816 - DNA, 20 bp, Homo sapiens
tgtataaccaagtgtgctct

SEQ ID NO: 651817 - DNA, 13 bp, Homo sapiens
tgtataatataaa

SEQ ID NO: 651818 - DNA, 16 bp, Homo sapiens
tgtatagaaaattctt

SEQ ID NO: 651819 - DNA, 19 bp, Homo sapiens
tgtatagaaaattcttgag

SEQ ID NO: 651820 - DNA, 20 bp, Homo sapiens
tgtatatatggatcagagga

SEQ ID NO: 651821 - DNA, 13 bp, Homo sapiens
tgtatatcactaa

SEQ ID NO: 651822 - DNA, 15 bp, Homo sapiens
tgtatatcactaaaa

SEQ ID NO: 651823 - DNA, 16 bp, Homo sapiens
tgtatatcactaaaag

SEQ ID NO: 651824 - DNA, 19 bp, Homo sapiens
tgtatatggtatatataca

SEQ ID NO: 651825 - DNA, 14 bp, Homo sapiens
tgtatattcctttt

SEQ ID NO: 651826 - DNA, 22 bp, Homo sapiens
tgtatatttgtaaagctattta

SEQ ID NO: 651827 - DNA, 18 bp, Homo sapiens
tgtatattttaatgtttt

SEQ ID NO: 651828 - DNA, 14 bp, Homo sapiens
tgtatcaaatacat

SEQ ID NO: 651829 - DNA, 14 bp, Homo sapiens
tgtatcagtgtcct

SEQ ID NO: 651830 - DNA, 16 bp, Homo sapiens
tgtatcagtgtccttt

SEQ ID NO: 651831 - DNA, 12 bp, Homo sapiens
tgtatcctggcc

SEQ ID NO: 651832 - DNA, 18 bp, Homo sapiens
tgtatgaaaaattgggga

SEQ ID NO: 651833 - DNA, 20 bp, Homo sapiens
tgtatgaaaaattggggagg

SEQ ID NO: 651834 - DNA, 21 bp, Homo sapiens
tgtatgaaaaattggggagga

SEQ ID NO: 651835 - DNA, 16 bp, Homo sapiens
tgtatgagtagccagg

SEQ ID NO: 651836 - DNA, 15 bp, Homo sapiens
tgtatgctgatcatc

SEQ ID NO: 651837 - DNA, 19 bp, Homo sapiens
tgtatggaatcccactgta

SEQ ID NO: 651838 - DNA, 13 bp, Homo sapiens
tgtatggatttaa

SEQ ID NO: 651839 - DNA, 19 bp, Homo sapiens
tgtatgtaacgatgttgta

SEQ ID NO: 651840 - DNA, 12 bp, Homo sapiens
tgtatgtataca

SEQ ID NO: 651841 - DNA, 14 bp, Homo sapiens
tgtatgtattatta

SEQ ID NO: 651842 - DNA, 16 bp, Homo sapiens
tgtatgtcagaagtgc

SEQ ID NO: 651843 - DNA, 22 bp, Homo sapiens
tgtatgttaaagagaatgagtc

SEQ ID NO: 651844 - DNA, 17 bp, Homo sapiens
tgtattcgtgcattttt

SEQ ID NO: 651845 - DNA, 19 bp, Homo sapiens
tgtattcttttctcagtgt

SEQ ID NO: 651846 - DNA, 15 bp, Homo sapiens
tgtattgagatttct

SEQ ID NO: 651847 - DNA, 20 bp, Homo sapiens
tgtattgagatttcttaaat

SEQ ID NO: 651848 - DNA, 15 bp, Homo sapiens
tgtattgcatgcaat

SEQ ID NO: 651849 - DNA, 16 bp, Homo sapiens
tgtattggttaaaact

SEQ ID NO: 651850 - DNA, 18 bp, Homo sapiens
tgtattggttaaaactgt

SEQ ID NO: 651851 - DNA, 15 bp, Homo sapiens
tgtatttctaagaag

SEQ ID NO: 651852 - DNA, 19 bp, Homo sapiens
tgtatttgttatatataat

SEQ ID NO: 651853 - DNA, 21 bp, Homo sapiens
tgtatttgttatatataataa

SEQ ID NO: 651854 - DNA, 13 bp, Homo sapiens
tgtattttacata

SEQ ID NO: 651855 - DNA, 12 bp, Homo sapiens
tgtattttcatg

SEQ ID NO: 651856 - DNA, 18 bp, Homo sapiens
tgtatttttcatctttaa

SEQ ID NO: 651857 - DNA, 23 bp, Homo sapiens
tgtcaaaatatttctcatctgca

SEQ ID NO: 651858 - DNA, 19 bp, Homo sapiens
tgtcaaatatttagatgta

SEQ ID NO: 651859 - DNA, 16 bp, Homo sapiens
tgtcaaggaagacttt

SEQ ID NO: 651860 - DNA, 23 bp, Homo sapiens
tgtcaaggaagacttttggtaga

SEQ ID NO: 651861 - DNA, 18 bp, Homo sapiens
tgtcaattcataaaaaca

SEQ ID NO: 651862 - DNA, 19 bp, Homo sapiens
tgtcaattcataaaaacaa

SEQ ID NO: 651863 - DNA, 23 bp, Homo sapiens
tgtcaccaaggaaacgctacctc

SEQ ID NO: 651864 - DNA, 18 bp, Homo sapiens
tgtcaccggtcagtgcct

SEQ ID NO: 651865 - DNA, 12 bp, Homo sapiens
tgtcagaagtgc

SEQ ID NO: 651866 - DNA, 23 bp, Homo sapiens
tgtcagcacacacttacagagca

SEQ ID NO: 651867 - DNA, 21 bp, Homo sapiens
tgtcagctactaatgatgttt

SEQ ID NO: 651868 - DNA, 21 bp, Homo sapiens
tgtcagggtccaggagagcct

SEQ ID NO: 651869 - DNA, 17 bp, Homo sapiens
tgtcagtactattcagg

SEQ ID NO: 651870 - DNA, 12 bp, Homo sapiens
tgtcatctaaag

SEQ ID NO: 651871 - DNA, 17 bp, Homo sapiens
tgtcatgcttcatcatt

SEQ ID NO: 651872 - DNA, 21 bp, Homo sapiens
tgtcattgtctactcctagaa

SEQ ID NO: 651873 - DNA, 13 bp, Homo sapiens
tgtcatttcttca

SEQ ID NO: 651874 - DNA, 17 bp, Homo sapiens
tgtccaaagaggctgcc

SEQ ID NO: 651875 - DNA, 14 bp, Homo sapiens
tgtccaaatttaaa

SEQ ID NO: 651876 - DNA, 13 bp, Homo sapiens
tgtccaagacagg

SEQ ID NO: 651877 - DNA, 22 bp, Homo sapiens
tgtccaagacagggctcatttt

SEQ ID NO: 651878 - DNA, 12 bp, Homo sapiens
tgtccagcacct

SEQ ID NO: 651879 - DNA, 22 bp, Homo sapiens
tgtccagcaccttgtgcctggg

SEQ ID NO: 651880 - DNA, 20 bp, Homo sapiens
tgtccctctccttgccccca

SEQ ID NO: 651881 - DNA, 15 bp, Homo sapiens
tgtccctgggccagg

SEQ ID NO: 651882 - DNA, 14 bp, Homo sapiens
tgtcccttccagga

SEQ ID NO: 651883 - DNA, 15 bp, Homo sapiens
tgtcccttgcctctg

SEQ ID NO: 651884 - DNA, 16 bp, Homo sapiens
tgtcccttgcctctgc

SEQ ID NO: 651885 - DNA, 12 bp, Homo sapiens
tgtcccttgctg

SEQ ID NO: 651886 - DNA, 14 bp, Homo sapiens
tgtcccttgctgta

SEQ ID NO: 651887 - DNA, 13 bp, Homo sapiens
tgtcccttttccc

SEQ ID NO: 651888 - DNA, 16 bp, Homo sapiens
tgtcctaattcttctg

SEQ ID NO: 651889 - DNA, 22 bp, Homo sapiens
tgtcctcttctgctcttttcct

SEQ ID NO: 651890 - DNA, 14 bp, Homo sapiens
tgtcctgagcacca

SEQ ID NO: 651891 - DNA, 21 bp, Homo sapiens
tgtccttaacccacctctcct

SEQ ID NO: 651892 - DNA, 19 bp, Homo sapiens
tgtcgaattcctactgaca

SEQ ID NO: 651893 - DNA, 17 bp, Homo sapiens
tgtcgttaaaaacagat

SEQ ID NO: 651894 - DNA, 18 bp, Homo sapiens
tgtctaactcagaattat

SEQ ID NO: 651895 - DNA, 19 bp, Homo sapiens
tgtctaattgcatctcaaa

SEQ ID NO: 651896 - DNA, 19 bp, Homo sapiens
tgtctactcctagaagaac

SEQ ID NO: 651897 - DNA, 16 bp, Homo sapiens
tgtctattttaaaata

SEQ ID NO: 651898 - DNA, 22 bp, Homo sapiens
tgtctattttaaaataaattag

SEQ ID NO: 651899 - DNA, 19 bp, Homo sapiens
tgtctcaacgcctccccct

SEQ ID NO: 651900 - DNA, 17 bp, Homo sapiens
tgtctcactaaagcatg

SEQ ID NO: 651901 - DNA, 19 bp, Homo sapiens
tgtctccacttgtatatat

SEQ ID NO: 651902 - DNA, 22 bp, Homo sapiens
tgtctctaccaaaaaaaggaag

SEQ ID NO: 651903 - DNA, 14 bp, Homo sapiens
tgtctcttccatgc

SEQ ID NO: 651904 - DNA, 20 bp, Homo sapiens
tgtctgaggtgacttaaaaa

SEQ ID NO: 651905 - DNA, 13 bp, Homo sapiens
tgtctgccttcac

SEQ ID NO: 651906 - DNA, 17 bp, Homo sapiens
tgtctgtagctcctcaa

SEQ ID NO: 651907 - DNA, 21 bp, Homo sapiens
tgtctgtggatggtcattgca

SEQ ID NO: 651908 - DNA, 22 bp, Homo sapiens
tgtcttaagatggaaatacagt

SEQ ID NO: 651909 - DNA, 22 bp, Homo sapiens
tgtcttatgtgaaaaattaact

SEQ ID NO: 651910 - DNA, 14 bp, Homo sapiens
tgtcttattcttaa

SEQ ID NO: 651911 - DNA, 16 bp, Homo sapiens
tgtcttccatgtatct

SEQ ID NO: 651912 - DNA, 18 bp, Homo sapiens
tgtcttgatgactgctga

SEQ ID NO: 651913 - DNA, 20 bp, Homo sapiens
tgtctttcagatacatggtt

SEQ ID NO: 651914 - DNA, 12 bp, Homo sapiens
tgtgaaaaatta

SEQ ID NO: 651915 - DNA, 17 bp, Homo sapiens
tgtgaaaaattaacttt

SEQ ID NO: 651916 - DNA, 21 bp, Homo sapiens
tgtgaaacagttgctgtgaac

SEQ ID NO: 651917 - DNA, 15 bp, Homo sapiens
tgtgaacatgatagt

SEQ ID NO: 651918 - DNA, 13 bp, Homo sapiens
tgtgaactttcat

SEQ ID NO: 651919 - DNA, 18 bp, Homo sapiens
tgtgaatgtgggcactgg

SEQ ID NO: 651920 - DNA, 20 bp, Homo sapiens
tgtgaatttttattgttgta

SEQ ID NO: 651921 - DNA, 13 bp, Homo sapiens
tgtgacaagccaa

SEQ ID NO: 651922 - DNA, 15 bp, Homo sapiens
tgtgacagggccagt

SEQ ID NO: 651923 - DNA, 23 bp, Homo sapiens
tgtgacagggccagtggggcctg

SEQ ID NO: 651924 - DNA, 14 bp, Homo sapiens
tgtgacccctcctt

SEQ ID NO: 651925 - DNA, 16 bp, Homo sapiens
tgtgacccctccttgt

SEQ ID NO: 651926 - DNA, 15 bp, Homo sapiens
tgtgacctggggcag

SEQ ID NO: 651927 - DNA, 21 bp, Homo sapiens
tgtgagaaggtttattgttaa

SEQ ID NO: 651928 - DNA, 16 bp, Homo sapiens
tgtgagctcttccctt

SEQ ID NO: 651929 - DNA, 19 bp, Homo sapiens
tgtgaggccatacttgtga

SEQ ID NO: 651930 - DNA, 17 bp, Homo sapiens
tgtgagtgccttttgca

SEQ ID NO: 651931 - DNA, 21 bp, Homo sapiens
tgtgagtgccttttgcagaag

SEQ ID NO: 651932 - DNA, 14 bp, Homo sapiens
tgtgagtgtgacag

SEQ ID NO: 651933 - DNA, 16 bp, Homo sapiens
tgtgagtgtgacaggg

SEQ ID NO: 651934 - DNA, 22 bp, Homo sapiens
tgtgatccggtttctttttgct

SEQ ID NO: 651935 - DNA, 10 bp, Homo sapiens
tgtgcacatc

SEQ ID NO: 651936 - DNA, 19 bp, Homo sapiens
tgtgcagaaaatatttaat

SEQ ID NO: 651937 - DNA, 19 bp, Homo sapiens
tgtgcagtactttgtgcat

SEQ ID NO: 651938 - DNA, 19 bp, Homo sapiens
tgtgcatggaggccctcct

SEQ ID NO: 651939 - DNA, 22 bp, Homo sapiens
tgtgccaactgccaggctgcct

SEQ ID NO: 651940 - DNA, 18 bp, Homo sapiens
tgtgcctatagtcccact

SEQ ID NO: 651941 - DNA, 17 bp, Homo sapiens
tgtgcctttctttgcct

SEQ ID NO: 651942 - DNA, 18 bp, Homo sapiens
tgtgcctttctttgcctc

SEQ ID NO: 651943 - DNA, 22 bp, Homo sapiens
tgtgcctttctttgcctctgca

SEQ ID NO: 651944 - DNA, 10 bp, Homo sapiens
tgtgcctttg

SEQ ID NO: 651945 - DNA, 16 bp, Homo sapiens
tgtgcctttggcctgg

SEQ ID NO: 651946 - DNA, 15 bp, Homo sapiens
tgtgctctattacca

SEQ ID NO: 651947 - DNA, 15 bp, Homo sapiens
tgtgctttttaagaa

SEQ ID NO: 651948 - DNA, 21 bp, Homo sapiens
tgtgctttttaagaatatttt

SEQ ID NO: 651949 - DNA, 13 bp, Homo sapiens
tgtggaaatggga

SEQ ID NO: 651950 - DNA, 16 bp, Homo sapiens
tgtggaaggcctccct

SEQ ID NO: 651951 - DNA, 16 bp, Homo sapiens
tgtggaatgagtgtgc

SEQ ID NO: 651952 - DNA, 19 bp, Homo sapiens
tgtggcaattagtgtgaca

SEQ ID NO: 651953 - DNA, 13 bp, Homo sapiens
tgtggcagggcgt

SEQ ID NO: 651954 - DNA, 15 bp, Homo sapiens
tgtggcgtctccctc

SEQ ID NO: 651955 - DNA, 16 bp, Homo sapiens
tgtggcgtctccctcg

SEQ ID NO: 651956 - DNA, 17 bp, Homo sapiens
tgtggctccaagctcag

SEQ ID NO: 651957 - DNA, 23 bp, Homo sapiens
tgtggctccaagctcaggtgcct

SEQ ID NO: 651958 - DNA, 20 bp, Homo sapiens
tgtggtaagcaacatggctt

SEQ ID NO: 651959 - DNA, 18 bp, Homo sapiens
tgtggtacaaggtggaga

SEQ ID NO: 651960 - DNA, 14 bp, Homo sapiens
tgtggtctcaggat

SEQ ID NO: 651961 - DNA, 15 bp, Homo sapiens
tgtggtctcaggata

SEQ ID NO: 651962 - DNA, 19 bp, Homo sapiens
tgtggtctggtgttccagc

SEQ ID NO: 651963 - DNA, 15 bp, Homo sapiens
tgtggtggcctcagc

SEQ ID NO: 651964 - DNA, 17 bp, Homo sapiens
tgtgtacaaatacatgt

SEQ ID NO: 651965 - DNA, 19 bp, Homo sapiens
tgtgtacaaatacatgtgt

SEQ ID NO: 651966 - DNA, 14 bp, Homo sapiens
tgtgtagttccagc

SEQ ID NO: 651967 - DNA, 13 bp, Homo sapiens
tgtgtatatggta

SEQ ID NO: 651968 - DNA, 21 bp, Homo sapiens
tgtgtatttaaaaaaaagaaa

SEQ ID NO: 651969 - DNA, 19 bp, Homo sapiens
tgtgtgatccggtttcttt

SEQ ID NO: 651970 - DNA, 16 bp, Homo sapiens
tgtgtgtcccaggcag

SEQ ID NO: 651971 - DNA, 11 bp, Homo sapiens
tgtgtgtgtgt

SEQ ID NO: 651972 - DNA, 16 bp, Homo sapiens
tgtgtgtgtgtgtgcg

SEQ ID NO: 651973 - DNA, 14 bp, Homo sapiens
tgtgtgtgttctgt

SEQ ID NO: 651974 - DNA, 19 bp, Homo sapiens
tgtgttcagctctttccaa

SEQ ID NO: 651975 - DNA, 20 bp, Homo sapiens
tgtgttcagctctttccaaa

SEQ ID NO: 651976 - DNA, 20 bp, Homo sapiens
tgtgttcgttgcacagctgt

SEQ ID NO: 651977 - DNA, 21 bp, Homo sapiens
tgtgtttctcctgagctagga

SEQ ID NO: 651978 - DNA, 21 bp, Homo sapiens
tgtgtttcttgggcagtcttt

SEQ ID NO: 651979 - DNA, 14 bp, Homo sapiens
tgtgtttttctttt

SEQ ID NO: 651980 - DNA, 12 bp, Homo sapiens
tgttaaagagaa

SEQ ID NO: 651981 - DNA, 12 bp, Homo sapiens
tgttaaattcag

SEQ ID NO: 651982 - DNA, 18 bp, Homo sapiens
tgttactattttctacaa

SEQ ID NO: 651983 - DNA, 17 bp, Homo sapiens
tgttactgactcctcag

SEQ ID NO: 651984 - DNA, 19 bp, Homo sapiens
tgttagatatttttcataa

SEQ ID NO: 651985 - DNA, 23 bp, Homo sapiens
tgttagcaaatgacagatttctg

SEQ ID NO: 651986 - DNA, 18 bp, Homo sapiens
tgttatatataataaata

SEQ ID NO: 651987 - DNA, 22 bp, Homo sapiens
tgttatatatttactcagtctt

SEQ ID NO: 651988 - DNA, 17 bp, Homo sapiens
tgttatcaaactgctgt

SEQ ID NO: 651989 - DNA, 21 bp, Homo sapiens
tgttatgatttccttcaatgt

SEQ ID NO: 651990 - DNA, 22 bp, Homo sapiens
tgttattcaaatttgatgatgt

SEQ ID NO: 651991 - DNA, 14 bp, Homo sapiens
tgttatttcttccc

SEQ ID NO: 651992 - DNA, 16 bp, Homo sapiens
tgttatttcttccctg

SEQ ID NO: 651993 - DNA, 18 bp, Homo sapiens
tgttcaaagccacattat

SEQ ID NO: 651994 - DNA, 20 bp, Homo sapiens
tgttcaaagccacattattt

SEQ ID NO: 651995 - DNA, 22 bp, Homo sapiens
tgttcaaagccacattatttct

SEQ ID NO: 651996 - DNA, 22 bp, Homo sapiens
tgttcaatatcagctttgataa

SEQ ID NO: 651997 - DNA, 20 bp, Homo sapiens
tgttcagctctttccaaatt

SEQ ID NO: 651998 - DNA, 13 bp, Homo sapiens
tgttcatttctaa

SEQ ID NO: 651999 - DNA, 16 bp, Homo sapiens
tgttcatttctaaatt

SEQ ID NO: 652000 - DNA, 18 bp, Homo sapiens
tgttccaatgtcaatgtg

SEQ ID NO: 652001 - DNA, 18 bp, Homo sapiens
tgttcgttgcacagctgt

SEQ ID NO: 652002 - DNA, 11 bp, Homo sapiens
tgttctgcctc

SEQ ID NO: 652003 - DNA, 18 bp, Homo sapiens
tgttgactggactgcttg

SEQ ID NO: 652004 - DNA, 22 bp, Homo sapiens
tgttgcatatagttaaactgag

SEQ ID NO: 652005 - DNA, 20 bp, Homo sapiens
tgttgctctaggaagacatt

SEQ ID NO: 652006 - DNA, 15 bp, Homo sapiens
tgttgctctttcacc

SEQ ID NO: 652007 - DNA, 21 bp, Homo sapiens
tgttggcaaacgagactttct

SEQ ID NO: 652008 - DNA, 21 bp, Homo sapiens
tgttggcacagaacaggaggt

SEQ ID NO: 652009 - DNA, 19 bp, Homo sapiens
tgttggtctgccttctgct

SEQ ID NO: 652010 - DNA, 15 bp, Homo sapiens
tgttgtaagaattct

SEQ ID NO: 652011 - DNA, 21 bp, Homo sapiens
tgttgtacatacgatttaagg

SEQ ID NO: 652012 - DNA, 21 bp, Homo sapiens
tgttgtatatcactaaaagca

SEQ ID NO: 652013 - DNA, 23 bp, Homo sapiens
tgttgtatatcactaaaagcatg

SEQ ID NO: 652014 - DNA, 24 bp, Homo sapiens
tgttgtatatcactaaaagcatga

SEQ ID NO: 652015 - DNA, 14 bp, Homo sapiens
tgttgttgccaaag

SEQ ID NO: 652016 - DNA, 15 bp, Homo sapiens
tgttgtttttggatg

SEQ ID NO: 652017 - DNA, 13 bp, Homo sapiens
tgtttaaaatgta

SEQ ID NO: 652018 - DNA, 14 bp, Homo sapiens
tgtttaaaatgtaa

SEQ ID NO: 652019 - DNA, 20 bp, Homo sapiens
tgtttaaaatgtaatttaaa

SEQ ID NO: 652020 - DNA, 15 bp, Homo sapiens
tgtttaataaagctt

SEQ ID NO: 652021 - DNA, 18 bp, Homo sapiens
tgtttaataaagctttat

SEQ ID NO: 652022 - DNA, 16 bp, Homo sapiens
tgtttacctttctctc

SEQ ID NO: 652023 - DNA, 23 bp, Homo sapiens
tgtttacctttctctctctaagg

SEQ ID NO: 652024 - DNA, 17 bp, Homo sapiens
tgtttagtgatattaca

SEQ ID NO: 652025 - DNA, 14 bp, Homo sapiens
tgtttatgagccag

SEQ ID NO: 652026 - DNA, 19 bp, Homo sapiens
tgtttatgatatttcttgc

SEQ ID NO: 652027 - DNA, 23 bp, Homo sapiens
tgtttatgatatttcttgctttc

SEQ ID NO: 652028 - DNA, 15 bp, Homo sapiens
tgtttatgtttaaaa

SEQ ID NO: 652029 - DNA, 14 bp, Homo sapiens
tgtttatttgcaat

SEQ ID NO: 652030 - DNA, 18 bp, Homo sapiens
tgtttatttgcaatttga

SEQ ID NO: 652031 - DNA, 14 bp, Homo sapiens
tgtttcaaaaaaat

SEQ ID NO: 652032 - DNA, 21 bp, Homo sapiens
tgtttctaataaagaaagcag

SEQ ID NO: 652033 - DNA, 18 bp, Homo sapiens
tgtttctagctaaataaa

SEQ ID NO: 652034 - DNA, 16 bp, Homo sapiens
tgtttctatctgattt

SEQ ID NO: 652035 - DNA, 15 bp, Homo sapiens
tgtttctgtttataa

SEQ ID NO: 652036 - DNA, 13 bp, Homo sapiens
tgtttcttcctgc

SEQ ID NO: 652037 - DNA, 18 bp, Homo sapiens
tgtttcttttgtttggta

SEQ ID NO: 652038 - DNA, 23 bp, Homo sapiens
tgtttcttttttttttttttaca

SEQ ID NO: 652039 - DNA, 20 bp, Homo sapiens
tgtttgaggcaaattaactg

SEQ ID NO: 652040 - DNA, 21 bp, Homo sapiens
tgtttgaggcaaattaactgt

SEQ ID NO: 652041 - DNA, 13 bp, Homo sapiens
tgtttgccaggac

SEQ ID NO: 652042 - DNA, 19 bp, Homo sapiens
tgtttgctgattatttatg

SEQ ID NO: 652043 - DNA, 16 bp, Homo sapiens
tgtttgcttgaatgct

SEQ ID NO: 652044 - DNA, 13 bp, Homo sapiens
tgtttggacagct

SEQ ID NO: 652045 - DNA, 15 bp, Homo sapiens
tgtttggacagctga

SEQ ID NO: 652046 - DNA, 19 bp, Homo sapiens
tgtttggagacgtttataa

SEQ ID NO: 652047 - DNA, 16 bp, Homo sapiens
tgtttggcaaggaaag

SEQ ID NO: 652048 - DNA, 14 bp, Homo sapiens
tgtttggtaaatgt

SEQ ID NO: 652049 - DNA, 23 bp, Homo sapiens
tgttttatccttacaatgtgaat

SEQ ID NO: 652050 - DNA, 17 bp, Homo sapiens
tgttttggatggcttgt

SEQ ID NO: 652051 - DNA, 22 bp, Homo sapiens
tgtttttcagcgttaatgtaaa

SEQ ID NO: 652052 - DNA, 18 bp, Homo sapiens
tgtttttgaggctttctg

SEQ ID NO: 652053 - DNA, 14 bp, Homo sapiens
tgtttttgggaaga

SEQ ID NO: 652054 - DNA, 23 bp, Homo sapiens
tgtttttgggaagaagaagacct

SEQ ID NO: 652055 - DNA, 13 bp, Homo sapiens
tgttttttctgta

SEQ ID NO: 652056 - DNA, 16 bp, Homo sapiens
ttaaaaaaaagaaact

SEQ ID NO: 652057 - DNA, 18 bp, Homo sapiens
ttaaaaaaaagaaacttt

SEQ ID NO: 652058 - DNA, 14 bp, Homo sapiens
ttaaaaaataaata

SEQ ID NO: 652059 - DNA, 16 bp, Homo sapiens
ttaaaaacctgtatct

SEQ ID NO: 652060 - DNA, 19 bp, Homo sapiens
ttaaaaagatgaaaaagaa

SEQ ID NO: 652061 - DNA, 20 bp, Homo sapiens
ttaaaaagatgaaaaagaat

SEQ ID NO: 652062 - DNA, 17 bp, Homo sapiens
ttaaaacaaatatacat

SEQ ID NO: 652063 - DNA, 19 bp, Homo sapiens
ttaaaacaaatatacattt

SEQ ID NO: 652064 - DNA, 21 bp, Homo sapiens
ttaaaacagctgcattagaaa

SEQ ID NO: 652065 - DNA, 15 bp, Homo sapiens
ttaaaacattaaaat

SEQ ID NO: 652066 - DNA, 14 bp, Homo sapiens
ttaaaactggacct

SEQ ID NO: 652067 - DNA, 13 bp, Homo sapiens
ttaaaagaaatat

SEQ ID NO: 652068 - DNA, 21 bp, Homo sapiens
ttaaaagaggagaaaatttat

SEQ ID NO: 652069 - DNA, 12 bp, Homo sapiens
ttaaaagccatg

SEQ ID NO: 652070 - DNA, 22 bp, Homo sapiens
ttaaaataggggatatttaagg

SEQ ID NO: 652071 - DNA, 12 bp, Homo sapiens
ttaaaatataat

SEQ ID NO: 652072 - DNA, 16 bp, Homo sapiens
ttaaaatatatgaaga

SEQ ID NO: 652073 - DNA, 17 bp, Homo sapiens
ttaaaatgtaatttaaa

SEQ ID NO: 652074 - DNA, 17 bp, Homo sapiens
ttaaaatgtcttggtct

SEQ ID NO: 652075 - DNA, 15 bp, Homo sapiens
ttaaaattgctatgt

SEQ ID NO: 652076 - DNA, 20 bp, Homo sapiens
ttaaaattttgtatgttaaa

SEQ ID NO: 652077 - DNA, 21 bp, Homo sapiens
ttaaacactacacatttgaaa

SEQ ID NO: 652078 - DNA, 19 bp, Homo sapiens
ttaaacatacataatacaa

SEQ ID NO: 652079 - DNA, 14 bp, Homo sapiens
ttaaaccacttaaa

SEQ ID NO: 652080 - DNA, 19 bp, Homo sapiens
ttaaacgaagagttccctt

SEQ ID NO: 652081 - DNA, 16 bp, Homo sapiens
ttaaactatcttgtgt

SEQ ID NO: 652082 - DNA, 21 bp, Homo sapiens
ttaaactatgttcctaacaaa

SEQ ID NO: 652083 - DNA, 13 bp, Homo sapiens
ttaaagaagcttt

SEQ ID NO: 652084 - DNA, 18 bp, Homo sapiens
ttaaagaccaataaactt

SEQ ID NO: 652085 - DNA, 17 bp, Homo sapiens
ttaaagatgctatggaa

SEQ ID NO: 652086 - DNA, 18 bp, Homo sapiens
ttaaataatgcttcagat

SEQ ID NO: 652087 - DNA, 14 bp, Homo sapiens
ttaaatccaataaa

SEQ ID NO: 652088 - DNA, 16 bp, Homo sapiens
ttaaatgaggattatt

SEQ ID NO: 652089 - DNA, 23 bp, Homo sapiens
ttaaatgtaatataatgtatttt

SEQ ID NO: 652090 - DNA, 16 bp, Homo sapiens
ttaaatgtattttaca

SEQ ID NO: 652091 - DNA, 21 bp, Homo sapiens
ttaacatacaagaaaatgtat

SEQ ID NO: 652092 - DNA, 14 bp, Homo sapiens
ttaacatcaagcca

SEQ ID NO: 652093 - DNA, 17 bp, Homo sapiens
ttaaccagtacttctaa

SEQ ID NO: 652094 - DNA, 21 bp, Homo sapiens
ttaaccggtaagagtttcagt

SEQ ID NO: 652095 - DNA, 15 bp, Homo sapiens
ttaaccttaaaatta

SEQ ID NO: 652096 - DNA, 23 bp, Homo sapiens
ttaaccttaaaattaagatttcc

SEQ ID NO: 652097 - DNA, 19 bp, Homo sapiens
ttaactactatattgattg

SEQ ID NO: 652098 - DNA, 17 bp, Homo sapiens
ttaacttttaatttaaa

SEQ ID NO: 652099 - DNA, 12 bp, Homo sapiens
ttaagaaacctt

SEQ ID NO: 652100 - DNA, 21 bp, Homo sapiens
ttaagaaaccttgctctcctc

SEQ ID NO: 652101 - DNA, 13 bp, Homo sapiens
ttaagaaaggaag

SEQ ID NO: 652102 - DNA, 16 bp, Homo sapiens
ttaagaaaggaagcaa

SEQ ID NO: 652103 - DNA, 14 bp, Homo sapiens
ttaagaaaggaagt

SEQ ID NO: 652104 - DNA, 15 bp, Homo sapiens
ttaagaaagtaattt

SEQ ID NO: 652105 - DNA, 16 bp, Homo sapiens
ttaagaaagtaattta

SEQ ID NO: 652106 - DNA, 18 bp, Homo sapiens
ttaagaaagtaatttaat

SEQ ID NO: 652107 - DNA, 20 bp, Homo sapiens
ttaagatacaaattaatttt

SEQ ID NO: 652108 - DNA, 13 bp, Homo sapiens
ttaagggcagagt

SEQ ID NO: 652109 - DNA, 20 bp, Homo sapiens
ttaaggggaagaatgaaagc

SEQ ID NO: 652110 - DNA, 17 bp, Homo sapiens
ttaagtcagatttttat

SEQ ID NO: 652111 - DNA, 20 bp, Homo sapiens
ttaagttagttccactgaga

SEQ ID NO: 652112 - DNA, 15 bp, Homo sapiens
ttaataaagctttat

SEQ ID NO: 652113 - DNA, 16 bp, Homo sapiens
ttaataaagctttata

SEQ ID NO: 652114 - DNA, 13 bp, Homo sapiens
ttaataatattta

SEQ ID NO: 652115 - DNA, 19 bp, Homo sapiens
ttaatacaaggtataataa

SEQ ID NO: 652116 - DNA, 22 bp, Homo sapiens
ttaatacaaggtataataaaat

SEQ ID NO: 652117 - DNA, 16 bp, Homo sapiens
ttaatagtttgtctat

SEQ ID NO: 652118 - DNA, 22 bp, Homo sapiens
ttaatatcaaaagaaaattgat

SEQ ID NO: 652119 - DNA, 18 bp, Homo sapiens
ttaatattcccattttat

SEQ ID NO: 652120 - DNA, 21 bp, Homo sapiens
ttaatattcttttgtttccat

SEQ ID NO: 652121 - DNA, 23 bp, Homo sapiens
ttaatattcttttgtttccatgg

SEQ ID NO: 652122 - DNA, 20 bp, Homo sapiens
ttaatcaagatttttttcct

SEQ ID NO: 652123 - DNA, 19 bp, Homo sapiens
ttaatccagttataagaag

SEQ ID NO: 652124 - DNA, 18 bp, Homo sapiens
ttaatcttcaaagccttc

SEQ ID NO: 652125 - DNA, 16 bp, Homo sapiens
ttaatgatggcagagg

SEQ ID NO: 652126 - DNA, 14 bp, Homo sapiens
ttaatgctacatgt

SEQ ID NO: 652127 - DNA, 19 bp, Homo sapiens
ttaatgctgtttctaagaa

SEQ ID NO: 652128 - DNA, 14 bp, Homo sapiens
ttaatgttttcaaa

SEQ ID NO: 652129 - DNA, 14 bp, Homo sapiens
ttaattgactgaaa

SEQ ID NO: 652130 - DNA, 23 bp, Homo sapiens
ttaattgactgaaattactttaa

SEQ ID NO: 652131 - DNA, 17 bp, Homo sapiens
ttaatttagaaactgaa

SEQ ID NO: 652132 - DNA, 21 bp, Homo sapiens
ttaatttagaaactgaaaaat

SEQ ID NO: 652133 - DNA, 12 bp, Homo sapiens
ttaatttgtaaa

SEQ ID NO: 652134 - DNA, 16 bp, Homo sapiens
ttaatttgtaaaactt

SEQ ID NO: 652135 - DNA, 18 bp, Homo sapiens
ttaatttgtaaaacttct

SEQ ID NO: 652136 - DNA, 13 bp, Homo sapiens
ttaattttaaagt

SEQ ID NO: 652137 - DNA, 19 bp, Homo sapiens
ttaattttaaagtgcaaaa

SEQ ID NO: 652138 - DNA, 20 bp, Homo sapiens
ttaattttaatgctgtttct

SEQ ID NO: 652139 - DNA, 17 bp, Homo sapiens
ttacaagtttatatata

SEQ ID NO: 652140 - DNA, 16 bp, Homo sapiens
ttacaatgtgaataat

SEQ ID NO: 652141 - DNA, 16 bp, Homo sapiens
ttacacattagatttt

SEQ ID NO: 652142 - DNA, 21 bp, Homo sapiens
ttacagaggtattaaaactaa

SEQ ID NO: 652143 - DNA, 11 bp, Homo sapiens
ttacagatttc

SEQ ID NO: 652144 - DNA, 15 bp, Homo sapiens
ttacaggcaccgaga

SEQ ID NO: 652145 - DNA, 24 bp, Homo sapiens
ttacaggcaccgagaatgttgtat

SEQ ID NO: 652146 - DNA, 16 bp, Homo sapiens
ttacaggcactaaagt

SEQ ID NO: 652147 - DNA, 20 bp, Homo sapiens
ttacagtttgatacaggaat

SEQ ID NO: 652148 - DNA, 17 bp, Homo sapiens
ttacataacggaaagtt

SEQ ID NO: 652149 - DNA, 20 bp, Homo sapiens
ttaccagggactatctttgc

SEQ ID NO: 652150 - DNA, 20 bp, Homo sapiens
ttacccccagctttgaggaa

SEQ ID NO: 652151 - DNA, 22 bp, Homo sapiens
ttacccttttcccccttcccat

SEQ ID NO: 652152 - DNA, 17 bp, Homo sapiens
ttacctactattggccc

SEQ ID NO: 652153 - DNA, 22 bp, Homo sapiens
ttacctggtgagtaacttagaa

SEQ ID NO: 652154 - DNA, 22 bp, Homo sapiens
ttacgcctataatcccagcatt

SEQ ID NO: 652155 - DNA, 15 bp, Homo sapiens
ttacggaggaacaga

SEQ ID NO: 652156 - DNA, 14 bp, Homo sapiens
ttacgggtacctga

SEQ ID NO: 652157 - DNA, 21 bp, Homo sapiens
ttacgttggttaaataaactt

SEQ ID NO: 652158 - DNA, 21 bp, Homo sapiens
ttactaaggcaggtgggcaga

SEQ ID NO: 652159 - DNA, 17 bp, Homo sapiens
ttactattttctacaat

SEQ ID NO: 652160 - DNA, 21 bp, Homo sapiens
ttactattttgacagttattt

SEQ ID NO: 652161 - DNA, 21 bp, Homo sapiens
ttactccttaggtgcccagaa

SEQ ID NO: 652162 - DNA, 13 bp, Homo sapiens
ttactctttgaaa

SEQ ID NO: 652163 - DNA, 14 bp, Homo sapiens
ttactgaattgtat

SEQ ID NO: 652164 - DNA, 14 bp, Homo sapiens
ttactgataatttt

SEQ ID NO: 652165 - DNA, 13 bp, Homo sapiens
ttactgattattt

SEQ ID NO: 652166 - DNA, 21 bp, Homo sapiens
ttactgccctttcaaagcact

SEQ ID NO: 652167 - DNA, 18 bp, Homo sapiens
ttactggaattcttctgc

SEQ ID NO: 652168 - DNA, 14 bp, Homo sapiens
ttactgggccctga

SEQ ID NO: 652169 - DNA, 23 bp, Homo sapiens
ttactgggccttagtgggccagg

SEQ ID NO: 652170 - DNA, 14 bp, Homo sapiens
ttactgtcaaaata

SEQ ID NO: 652171 - DNA, 18 bp, Homo sapiens
ttactgtgaggagtctgg

SEQ ID NO: 652172 - DNA, 13 bp, Homo sapiens
ttactttaacatt

SEQ ID NO: 652173 - DNA, 15 bp, Homo sapiens
ttagaaaaaaattac

SEQ ID NO: 652174 - DNA, 13 bp, Homo sapiens
ttagaaaatgtgt

SEQ ID NO: 652175 - DNA, 13 bp, Homo sapiens
ttagaaacactgc

SEQ ID NO: 652176 - DNA, 10 bp, Homo sapiens
ttagaaacta

SEQ ID NO: 652177 - DNA, 21 bp, Homo sapiens
ttagaaagggaaggaaatccc

SEQ ID NO: 652178 - DNA, 13 bp, Homo sapiens
ttagaagaaaagt

SEQ ID NO: 652179 - DNA, 12 bp, Homo sapiens
ttttataaagca

SEQ ID NO: 652180 - DNA, 15 bp, Homo sapiens
ttttataaagcatgt

SEQ ID NO: 652181 - DNA, 20 bp, Homo sapiens
ttttatacaagtaatttcct

SEQ ID NO: 652182 - DNA, 12 bp, Homo sapiens
ttttatatttgt

SEQ ID NO: 652183 - DNA, 13 bp, Homo sapiens
ttttatgccccat

SEQ ID NO: 652184 - DNA, 14 bp, Homo sapiens
ttttattatgcatt

SEQ ID NO: 652185 - DNA, 10 bp, Homo sapiens
ttttattgtt

SEQ ID NO: 652186 - DNA, 13 bp, Homo sapiens
ttttcaagttgta

SEQ ID NO: 652187 - DNA, 19 bp, Homo sapiens
ttttccctggaactcctgg

SEQ ID NO: 652188 - DNA, 16 bp, Homo sapiens
ttttccttatttgcct

SEQ ID NO: 652189 - DNA, 20 bp, Homo sapiens
ttttccttatttgccttcta

SEQ ID NO: 652190 - DNA, 20 bp, Homo sapiens
ttttcctttttcttcgctgg

SEQ ID NO: 652191 - DNA, 16 bp, Homo sapiens
ttttctaaataaaaat

SEQ ID NO: 652192 - DNA, 12 bp, Homo sapiens
ttttctctcttt

SEQ ID NO: 652193 - DNA, 14 bp, Homo sapiens
ttttctctgagatt

SEQ ID NO: 652194 - DNA, 19 bp, Homo sapiens
ttttctgtaatgtaaataa

SEQ ID NO: 652195 - DNA, 22 bp, Homo sapiens
ttttgaatatgccttaatttag

SEQ ID NO: 652196 - DNA, 20 bp, Homo sapiens
ttttgacagactatttgcta

SEQ ID NO: 652197 - DNA, 22 bp, Homo sapiens
ttttgattattttttttttctt

SEQ ID NO: 652198 - DNA, 19 bp, Homo sapiens
ttttgcaaattatattttg

SEQ ID NO: 652199 - DNA, 14 bp, Homo sapiens
ttttgcactagaac

SEQ ID NO: 652200 - DNA, 14 bp, Homo sapiens
ttttgcacttatct

SEQ ID NO: 652201 - DNA, 18 bp, Homo sapiens
ttttggaaattgttgtat

SEQ ID NO: 652202 - DNA, 18 bp, Homo sapiens
ttttggagattataataa

SEQ ID NO: 652203 - DNA, 17 bp, Homo sapiens
ttttggatcttgaatgt

SEQ ID NO: 652204 - DNA, 15 bp, Homo sapiens
ttttggggagccaga

SEQ ID NO: 652205 - DNA, 16 bp, Homo sapiens
ttttggtggtgaaatt

SEQ ID NO: 652206 - DNA, 17 bp, Homo sapiens
ttttgtaataataaaga

SEQ ID NO: 652207 - DNA, 13 bp, Homo sapiens
ttttgtatagaaa

SEQ ID NO: 652208 - DNA, 21 bp, Homo sapiens
ttttgtatagaaaattcttga

SEQ ID NO: 652209 - DNA, 18 bp, Homo sapiens
ttttgtattttcatgaaa

SEQ ID NO: 652210 - DNA, 22 bp, Homo sapiens
ttttgtgaaatgaaaacatgta

SEQ ID NO: 652211 - DNA, 24 bp, Homo sapiens
ttttgtgaaatgaaaacatgtaat

SEQ ID NO: 652212 - DNA, 14 bp, Homo sapiens
cttattataaaatg

SEQ ID NO: 652213 - DNA, 24 bp, Homo sapiens
cttattataaaatggacacaaatt

SEQ ID NO: 652214 - DNA, 20 bp, Homo sapiens
cttattatgtaggtaagact

SEQ ID NO: 652215 - DNA, 22 bp, Homo sapiens
cttattgacaaccgagaaggtt

SEQ ID NO: 652216 - DNA, 23 bp, Homo sapiens
cttatttaaccaggggtcctaac

SEQ ID NO: 652217 - DNA, 18 bp, Homo sapiens
cttatttctatgacaaat

SEQ ID NO: 652218 - DNA, 22 bp, Homo sapiens
cttatttgccttctactcccct

SEQ ID NO: 652219 - DNA, 20 bp, Homo sapiens
cttattttgtcttattctta

SEQ ID NO: 652220 - DNA, 18 bp, Homo sapiens
cttcaaattaaaacagct

SEQ ID NO: 652221 - DNA, 22 bp, Homo sapiens
cttcaaattcttcacatgttta

SEQ ID NO: 652222 - DNA, 15 bp, Homo sapiens
cttcaacatgctcca

SEQ ID NO: 652223 - DNA, 19 bp, Homo sapiens
cttcaacatgctccaaata

SEQ ID NO: 652224 - DNA, 23 bp, Homo sapiens
cttcaagctgttatttcttccct

SEQ ID NO: 652225 - DNA, 17 bp, Homo sapiens
cttcaatacttaaaaat

SEQ ID NO: 652226 - DNA, 14 bp, Homo sapiens
cttcacaaatgtca

SEQ ID NO: 652227 - DNA, 20 bp, Homo sapiens
cttcacaaatgtcattgtct

SEQ ID NO: 652228 - DNA, 22 bp, Homo sapiens
cttcacaaatgtcattgtctac

SEQ ID NO: 652229 - DNA, 22 bp, Homo sapiens
cttcagatccttttattctcca

SEQ ID NO: 652230 - DNA, 16 bp, Homo sapiens
cttcaggtgaacactt

SEQ ID NO: 652231 - DNA, 22 bp, Homo sapiens
cttcagtgcaaattgtatctta

SEQ ID NO: 652232 - DNA, 19 bp, Homo sapiens
cttcatcattccctctcat

SEQ ID NO: 652233 - DNA, 12 bp, Homo sapiens
cttcatgctttt

SEQ ID NO: 652234 - DNA, 20 bp, Homo sapiens
cttcatgcttttgcttgcaa

SEQ ID NO: 652235 - DNA, 23 bp, Homo sapiens
cttcatggcatcttcaatatgaa

SEQ ID NO: 652236 - DNA, 18 bp, Homo sapiens
cttcatttttaagaaagg

SEQ ID NO: 652237 - DNA, 17 bp, Homo sapiens
cttccaatgcttctgtt

SEQ ID NO: 652238 - DNA, 15 bp, Homo sapiens
cttccaggggaacct

SEQ ID NO: 652239 - DNA, 20 bp, Homo sapiens
cttccatgccgtcctgcagt

SEQ ID NO: 652240 - DNA, 13 bp, Homo sapiens
cttccatgtgcct

SEQ ID NO: 652241 - DNA, 14 bp, Homo sapiens
cttccatgtgcctt

SEQ ID NO: 652242 - DNA, 18 bp, Homo sapiens
cttcccatgcattctggt

SEQ ID NO: 652243 - DNA, 13 bp, Homo sapiens
cttcccatttctt

SEQ ID NO: 652244 - DNA, 19 bp, Homo sapiens
cttccccgagtgactctgg

SEQ ID NO: 652245 - DNA, 15 bp, Homo sapiens
cttccccttagaaac

SEQ ID NO: 652246 - DNA, 13 bp, Homo sapiens
cttccccttccct

SEQ ID NO: 652247 - DNA, 17 bp, Homo sapiens
cttccctgacttgcttt

SEQ ID NO: 652248 - DNA, 18 bp, Homo sapiens
cttccctgacttgcttta

SEQ ID NO: 652249 - DNA, 16 bp, Homo sapiens
cttccctgctttgcat

SEQ ID NO: 652250 - DNA, 14 bp, Homo sapiens
cttccgcagtgtgg

SEQ ID NO: 652251 - DNA, 17 bp, Homo sapiens
cttccgcagtgtggcca

SEQ ID NO: 652252 - DNA, 18 bp, Homo sapiens
cttcctagaaagttctgt

SEQ ID NO: 652253 - DNA, 18 bp, Homo sapiens
cttcctcagctgcctcct

SEQ ID NO: 652254 - DNA, 20 bp, Homo sapiens
cttcctcagctgcctcctgc

SEQ ID NO: 652255 - DNA, 22 bp, Homo sapiens
cttcctctggtgtttattataa

SEQ ID NO: 652256 - DNA, 13 bp, Homo sapiens
cttcgctggacta

SEQ ID NO: 652257 - DNA, 21 bp, Homo sapiens
cttcgctggactattgtgcca

SEQ ID NO: 652258 - DNA, 13 bp, Homo sapiens
cttctaagaagac

SEQ ID NO: 652259 - DNA, 16 bp, Homo sapiens
cttctaagaagacatt

SEQ ID NO: 652260 - DNA, 20 bp, Homo sapiens
cttctacccttttccttttt

SEQ ID NO: 652261 - DNA, 16 bp, Homo sapiens
cttctacctgccctca

SEQ ID NO: 652262 - DNA, 18 bp, Homo sapiens
cttctacctgccctcaag

SEQ ID NO: 652263 - DNA, 19 bp, Homo sapiens
cttctacctgccctcaagg

SEQ ID NO: 652264 - DNA, 14 bp, Homo sapiens
cttctactcctgcc

SEQ ID NO: 652265 - DNA, 17 bp, Homo sapiens
cttctactgccttgaaa

SEQ ID NO: 652266 - DNA, 15 bp, Homo sapiens
cttctcaaagagaat

SEQ ID NO: 652267 - DNA, 22 bp, Homo sapiens
cttctcacacacaactgtccat

SEQ ID NO: 652268 - DNA, 16 bp, Homo sapiens
cttctccctagctcct

SEQ ID NO: 652269 - DNA, 18 bp, Homo sapiens
cttctctgtgagaaggtt

SEQ ID NO: 652270 - DNA, 13 bp, Homo sapiens
cttctctgttggt

SEQ ID NO: 652271 - DNA, 12 bp, Homo sapiens
cttctgaagatt

SEQ ID NO: 652272 - DNA, 18 bp, Homo sapiens
cttctgcaacaagcatgc

SEQ ID NO: 652273 - DNA, 16 bp, Homo sapiens
cttctgcaagcctcat

SEQ ID NO: 652274 - DNA, 23 bp, Homo sapiens
cttctgcaagcctcatgccaacc

SEQ ID NO: 652275 - DNA, 17 bp, Homo sapiens
cttctgcagttctcatg

SEQ ID NO: 652276 - DNA, 15 bp, Homo sapiens
cttctggggcaggct

SEQ ID NO: 652277 - DNA, 20 bp, Homo sapiens
cttctggggcaggctgggcc

SEQ ID NO: 652278 - DNA, 22 bp, Homo sapiens
cttctggggcaggctgggccat

SEQ ID NO: 652279 - DNA, 15 bp, Homo sapiens
cttctggtgttgact

SEQ ID NO: 652280 - DNA, 21 bp, Homo sapiens
cttctggtgttgactggactg

SEQ ID NO: 652281 - DNA, 18 bp, Homo sapiens
cttctgtactaaagtatt

SEQ ID NO: 652282 - DNA, 14 bp, Homo sapiens
cttcttacatgcat

SEQ ID NO: 652283 - DNA, 15 bp, Homo sapiens
cttcttacatgcatt

SEQ ID NO: 652284 - DNA, 14 bp, Homo sapiens
cttcttcgttcctg

SEQ ID NO: 652285 - DNA, 17 bp, Homo sapiens
cttcttctaagaagaca

SEQ ID NO: 652286 - DNA, 19 bp, Homo sapiens
gtccctgggccagggtctg

SEQ ID NO: 652287 - DNA, 11 bp, Homo sapiens
gtcccttgctg

SEQ ID NO: 652288 - DNA, 21 bp, Homo sapiens
gtccgctgccccatgtgtcct

SEQ ID NO: 652289 - DNA, 14 bp, Homo sapiens
gtcctaaccactaa

SEQ ID NO: 652290 - DNA, 21 bp, Homo sapiens
gtcctacagtgactccctggg

SEQ ID NO: 652291 - DNA, 22 bp, Homo sapiens
gtcctacagtgactccctggga

SEQ ID NO: 652292 - DNA, 17 bp, Homo sapiens
gtcctatagtcgtgggt

SEQ ID NO: 652293 - DNA, 18 bp, Homo sapiens
gtcctatctatcttccaa

SEQ ID NO: 652294 - DNA, 19 bp, Homo sapiens
gtcctcagcagtccacaaa

SEQ ID NO: 652295 - DNA, 20 bp, Homo sapiens
gtcctgagcaccacacccag

SEQ ID NO: 652296 - DNA, 15 bp, Homo sapiens
gtcctggtgagaaaa

SEQ ID NO: 652297 - DNA, 22 bp, Homo sapiens
gtccttccctcaaagaggcctt

SEQ ID NO: 652298 - DNA, 16 bp, Homo sapiens
gtccttgatttcaaag

SEQ ID NO: 652299 - DNA, 21 bp, Homo sapiens
gtccttttgggaagaatccag

SEQ ID NO: 652300 - DNA, 20 bp, Homo sapiens
gtcgcctgcctgcagcaggc

SEQ ID NO: 652301 - DNA, 15 bp, Homo sapiens
gtcgtggttcttaaa

SEQ ID NO: 652302 - DNA, 23 bp, Homo sapiens
gtcgttaaaaacagatttggaaa

SEQ ID NO: 652303 - DNA, 14 bp, Homo sapiens
gtctagaagaacaa

SEQ ID NO: 652304 - DNA, 15 bp, Homo sapiens
gtctagagaacactg

SEQ ID NO: 652305 - DNA, 17 bp, Homo sapiens
gtctcattgtcacctct

SEQ ID NO: 652306 - DNA, 14 bp, Homo sapiens
gtctccacttgtat

SEQ ID NO: 652307 - DNA, 21 bp, Homo sapiens
taatcttcaggtgaacactta

SEQ ID NO: 652308 - DNA, 21 bp, Homo sapiens
taatgataaaataaataattt

SEQ ID NO: 652309 - DNA, 16 bp, Homo sapiens
taatgatatgcttgta

SEQ ID NO: 652310 - DNA, 16 bp, Homo sapiens
taatgcattttgcact

SEQ ID NO: 652311 - DNA, 15 bp, Homo sapiens
taatgctgtttctaa

SEQ ID NO: 652312 - DNA, 20 bp, Homo sapiens
taatggaagtgtatttattt

SEQ ID NO: 652313 - DNA, 15 bp, Homo sapiens
taatgtaaataaact

SEQ ID NO: 652314 - DNA, 20 bp, Homo sapiens
taatgtaaataaactattta

SEQ ID NO: 652315 - DNA, 15 bp, Homo sapiens
taatgtacttgaaaa

SEQ ID NO: 652316 - DNA, 15 bp, Homo sapiens
taatgtattttcttt

SEQ ID NO: 652317 - DNA, 22 bp, Homo sapiens
taatgtgcagaaaatatttaat

SEQ ID NO: 652318 - DNA, 13 bp, Homo sapiens
taatgttgataat

SEQ ID NO: 652319 - DNA, 19 bp, Homo sapiens
taatgttgataatatatat

SEQ ID NO: 652320 - DNA, 17 bp, Homo sapiens
taatgtttctatctgat

SEQ ID NO: 652321 - DNA, 13 bp, Homo sapiens
taatgttttcaaa

SEQ ID NO: 652322 - DNA, 14 bp, Homo sapiens
taattaagtatctg

SEQ ID NO: 652323 - DNA, 13 bp, Homo sapiens
taattactggaat

SEQ ID NO: 652324 - DNA, 20 bp, Homo sapiens
taattcaaggagaatatgat

SEQ ID NO: 652325 - DNA, 15 bp, Homo sapiens
taattcttttctgag

SEQ ID NO: 652326 - DNA, 13 bp, Homo sapiens
taattgactgaaa

SEQ ID NO: 652327 - DNA, 15 bp, Homo sapiens
taattgactgaaatt

SEQ ID NO: 652328 - DNA, 18 bp, Homo sapiens
taattgactgaaattact

SEQ ID NO: 652329 - DNA, 18 bp, Homo sapiens
taattgcctacatttatc

SEQ ID NO: 652330 - DNA, 14 bp, Homo sapiens
taattgctgtgtgt

SEQ ID NO: 652331 - DNA, 14 bp, Homo sapiens
taattggatgttca

SEQ ID NO: 652332 - DNA, 16 bp, Homo sapiens
taattgtaagtgaaat

SEQ ID NO: 652333 - DNA, 22 bp, Homo sapiens
taattgtacaaaattaagcaaa

SEQ ID NO: 652334 - DNA, 16 bp, Homo sapiens
taatttaaatgaaaga

SEQ ID NO: 652335 - DNA, 22 bp, Homo sapiens
taatttaatttgtaaaacttct

SEQ ID NO: 652336 - DNA, 23 bp, Homo sapiens
taatttaatttgtaaaacttctg

SEQ ID NO: 652337 - DNA, 16 bp, Homo sapiens
taatttacttgttttg

SEQ ID NO: 652338 - DNA, 20 bp, Homo sapiens
taatttacttgttttggatg

SEQ ID NO: 652339 - DNA, 12 bp, Homo sapiens
taatttagaaac

SEQ ID NO: 652340 - DNA, 18 bp, Homo sapiens
taatttagaaactgaaaa

SEQ ID NO: 652341 - DNA, 20 bp, Homo sapiens
taatttagaaactgaaaaat

SEQ ID NO: 652342 - DNA, 21 bp, Homo sapiens
taatttagagataggaaactg

SEQ ID NO: 652343 - DNA, 12 bp, Homo sapiens
taatttcaaaat

SEQ ID NO: 652344 - DNA, 21 bp, Homo sapiens
taatttcaaaatacatttgta

SEQ ID NO: 652345 - DNA, 12 bp, Homo sapiens
taatttgaactg

SEQ ID NO: 652346 - DNA, 16 bp, Homo sapiens
taatttgtaaaacttc

SEQ ID NO: 652347 - DNA, 17 bp, Homo sapiens
taatttgtaaaacttct

SEQ ID NO: 652348 - DNA, 18 bp, Homo sapiens
taatttgtgaaaatgtaa

SEQ ID NO: 652349 - DNA, 17 bp, Homo sapiens
tactgtctattaatatt

SEQ ID NO: 652350 - DNA, 19 bp, Homo sapiens
tactgtctattaatattca

SEQ ID NO: 652351 - DNA, 17 bp, Homo sapiens
tactgttactgggccct

SEQ ID NO: 652352 - DNA, 17 bp, Homo sapiens
tactgttgtaagaattc

SEQ ID NO: 652353 - DNA, 21 bp, Homo sapiens
tacttaaatggtaataagcac

SEQ ID NO: 652354 - DNA, 22 bp, Homo sapiens
tacttgaagtctaaaagcagaa

SEQ ID NO: 652355 - DNA, 14 bp, Homo sapiens
tacttgcaagataa

SEQ ID NO: 652356 - DNA, 18 bp, Homo sapiens
tacttgctggctctcaga

SEQ ID NO: 652357 - DNA, 16 bp, Homo sapiens
tactttctatgtgaca

SEQ ID NO: 652358 - DNA, 18 bp, Homo sapiens
tactttgaagtgcagctc

SEQ ID NO: 652359 - DNA, 13 bp, Homo sapiens
tactttgccactg

SEQ ID NO: 652360 - DNA, 17 bp, Homo sapiens
tactttgccactgctgt

SEQ ID NO: 652361 - DNA, 15 bp, Homo sapiens
tagaaaaaaattact

SEQ ID NO: 652362 - DNA, 20 bp, Homo sapiens
tagaaaagtggtgtaaactt

SEQ ID NO: 652363 - DNA, 12 bp, Homo sapiens
tagaaaatgtgt

SEQ ID NO: 652364 - DNA, 16 bp, Homo sapiens
tagaaaatttgcttta

SEQ ID NO: 652365 - DNA, 12 bp, Homo sapiens
tagaaactgaaa

SEQ ID NO: 652366 - DNA, 15 bp, Homo sapiens
tagaaactgaaaaat

SEQ ID NO: 652367 - DNA, 16 bp, Homo sapiens
tagaaacttaaacaca

SEQ ID NO: 652368 - DNA, 16 bp, Homo sapiens
tagaaaggggagaatg

SEQ ID NO: 652369 - DNA, 22 bp, Homo sapiens
tagaaattagaaaaaaattact

SEQ ID NO: 652370 - DNA, 18 bp, Homo sapiens
tagaagaaccaaatacct

SEQ ID NO: 652371 - DNA, 20 bp, Homo sapiens
tagaagaaccaaatacctca

SEQ ID NO: 652372 - DNA, 23 bp, Homo sapiens
tagaagaaccaaatacctcaatt

SEQ ID NO: 652373 - DNA, 21 bp, Homo sapiens
tagaagcactacaccttgcct

SEQ ID NO: 652374 - DNA, 22 bp, Homo sapiens
tagaagcactacaccttgcctt

SEQ ID NO: 652375 - DNA, 17 bp, Homo sapiens
tagaagccgtgggaaga

SEQ ID NO: 652376 - DNA, 11 bp, Homo sapiens
tagaataattc

SEQ ID NO: 652377 - DNA, 15 bp, Homo sapiens
tagaatgtaaagtta

SEQ ID NO: 652378 - DNA, 16 bp, Homo sapiens
tagaattgcagtcatt

SEQ ID NO: 652379 - DNA, 13 bp, Homo sapiens
tagactatttctt

SEQ ID NO: 652380 - DNA, 18 bp, Homo sapiens
tagactgtgccagaggcc

SEQ ID NO: 652381 - DNA, 22 bp, Homo sapiens
tagagaggacaatactggggtt

SEQ ID NO: 652382 - DNA, 15 bp, Homo sapiens
tagagcttggacagt

SEQ ID NO: 652383 - DNA, 13 bp, Homo sapiens
tagataatattgt

SEQ ID NO: 652384 - DNA, 15 bp, Homo sapiens
tagataatattgttt

SEQ ID NO: 652385 - DNA, 23 bp, Homo sapiens
tagatataaatttttaagagaaa

SEQ ID NO: 652386 - DNA, 15 bp, Homo sapiens
tagatatttttcata

SEQ ID NO: 652387 - DNA, 21 bp, Homo sapiens
tagatatttttcataaacaag

SEQ ID NO: 652388 - DNA, 15 bp, Homo sapiens
tagatccatttccat

SEQ ID NO: 652389 - DNA, 21 bp, Homo sapiens
tagatccatttccattgctta

SEQ ID NO: 652390 - DNA, 13 bp, Homo sapiens
tagatctccagcg

SEQ ID NO: 652391 - DNA, 19 bp, Homo sapiens
tagatctttgtaaatgcat

SEQ ID NO: 652392 - DNA, 16 bp, Homo sapiens
tagatgtaattttgtg

SEQ ID NO: 652393 - DNA, 15 bp, Homo sapiens
tagcaaataagtcat

SEQ ID NO: 652394 - DNA, 23 bp, Homo sapiens
tagcaaatgacagatttctgtaa

SEQ ID NO: 652395 - DNA, 15 bp, Homo sapiens
tagcaactaatgttt

SEQ ID NO: 652396 - DNA, 15 bp, Homo sapiens
tagcaagcttttgct

SEQ ID NO: 652397 - DNA, 15 bp, Homo sapiens
tagcagaaagaagag

SEQ ID NO: 652398 - DNA, 14 bp, Homo sapiens
tagcagatggtttc

SEQ ID NO: 652399 - DNA, 14 bp, Homo sapiens
tagcagcccaccct

SEQ ID NO: 652400 - DNA, 18 bp, Homo sapiens
tagccagcccctcttccc

SEQ ID NO: 652401 - DNA, 16 bp, Homo sapiens
tagccctcccactttg

SEQ ID NO: 652402 - DNA, 16 bp, Homo sapiens
tagcctcaattctcca

SEQ ID NO: 652403 - DNA, 14 bp, Homo sapiens
tagcctggactgct

SEQ ID NO: 652404 - DNA, 16 bp, Homo sapiens
tagcgatctctcctgg

SEQ ID NO: 652405 - DNA, 14 bp, Homo sapiens
tagcgtcaagacat

SEQ ID NO: 652406 - DNA, 16 bp, Homo sapiens
tagctacattttcaga

SEQ ID NO: 652407 - DNA, 12 bp, Homo sapiens
tagctctgctgc

SEQ ID NO: 652408 - DNA, 17 bp, Homo sapiens
tagctgaagaattgaaa

SEQ ID NO: 652409 - DNA, 20 bp, Homo sapiens
tagctttccaaggaagcaga

SEQ ID NO: 652410 - DNA, 11 bp, Homo sapiens
taggaagaaaa

SEQ ID NO: 652411 - DNA, 16 bp, Homo sapiens
taggaagaaaatgtca

SEQ ID NO: 652412 - DNA, 19 bp, Homo sapiens
taggacagttgattcaaca

SEQ ID NO: 652413 - DNA, 15 bp, Homo sapiens
taggagtatttttgg

SEQ ID NO: 652414 - DNA, 13 bp, Homo sapiens
taggcattctgga

SEQ ID NO: 652415 - DNA, 21 bp, Homo sapiens
taggcctgtcccttgcctctg

SEQ ID NO: 652416 - DNA, 16 bp, Homo sapiens
taggctatgccatgtg

SEQ ID NO: 652417 - DNA, 15 bp, Homo sapiens
tagggaactggggaa

SEQ ID NO: 652418 - DNA, 18 bp, Homo sapiens
tagggagaatatttacta

SEQ ID NO: 652419 - DNA, 18 bp, Homo sapiens
tagggctttagctttctt

SEQ ID NO: 652420 - DNA, 21 bp, Homo sapiens
tatccccatctccctgcctgg

SEQ ID NO: 652421 - DNA, 23 bp, Homo sapiens
tatccctctcttccccttccctt

SEQ ID NO: 652422 - DNA, 14 bp, Homo sapiens
tatccgctgccagc

SEQ ID NO: 652423 - DNA, 20 bp, Homo sapiens
tatcctccctggcagacaca

SEQ ID NO: 652424 - DNA, 21 bp, Homo sapiens
tatccttacaatgtgaataat

SEQ ID NO: 652425 - DNA, 21 bp, Homo sapiens
tatccttataggcctgtccct

SEQ ID NO: 652426 - DNA, 12 bp, Homo sapiens
tatcgtttttgt

SEQ ID NO: 652427 - DNA, 20 bp, Homo sapiens
tatcgtttttgtattttcat

SEQ ID NO: 652428 - DNA, 12 bp, Homo sapiens
tatctataaaat

SEQ ID NO: 652429 - DNA, 21 bp, Homo sapiens
tatctcttttatatttgtagg

SEQ ID NO: 652430 - DNA, 21 bp, Homo sapiens
tatctgggattattctttgaa

SEQ ID NO: 652431 - DNA, 20 bp, Homo sapiens
tatctgggttaagtgtttat

SEQ ID NO: 652432 - DNA, 17 bp, Homo sapiens
tatcttaagcatgtcaa

SEQ ID NO: 652433 - DNA, 14 bp, Homo sapiens
tatcttacaatatt

SEQ ID NO: 652434 - DNA, 17 bp, Homo sapiens
tatcttattaaagtatt

SEQ ID NO: 652435 - DNA, 21 bp, Homo sapiens
tatcttgaccatactaataaa

SEQ ID NO: 652436 - DNA, 19 bp, Homo sapiens
tatgaaaaattggggagga

SEQ ID NO: 652437 - DNA, 19 bp, Homo sapiens
tatgaagccaactgacaaa

SEQ ID NO: 652438 - DNA, 13 bp, Homo sapiens
tatgaattcaaga

SEQ ID NO: 652439 - DNA, 22 bp, Homo sapiens
tatgacccacattactttttat

SEQ ID NO: 652440 - DNA, 14 bp, Homo sapiens
tatgactaaagaga

SEQ ID NO: 652441 - DNA, 21 bp, Homo sapiens
tatgactaatttggggaaaat

SEQ ID NO: 652442 - DNA, 20 bp, Homo sapiens
tatgagattggttttcctgt

SEQ ID NO: 652443 - DNA, 21 bp, Homo sapiens
tatgagattggttttcctgtg

SEQ ID NO: 652444 - DNA, 20 bp, Homo sapiens
tatgaggggcagtggacagt

SEQ ID NO: 652445 - DNA, 24 bp, Homo sapiens
tatgataggttattttgatgtaaa

SEQ ID NO: 652446 - DNA, 16 bp, Homo sapiens
tatgatggttttaaac

SEQ ID NO: 652447 - DNA, 18 bp, Homo sapiens
tatgatttaatttgaaat

SEQ ID NO: 652448 - DNA, 17 bp, Homo sapiens
tatgatttataaacaga

SEQ ID NO: 652449 - DNA, 19 bp, Homo sapiens
tatgatttataaacagaca

SEQ ID NO: 652450 - DNA, 18 bp, Homo sapiens
tatgatttccttcaatgt

SEQ ID NO: 652451 - DNA, 19 bp, Homo sapiens
tatgcaaaatttagaagaa

SEQ ID NO: 652452 - DNA, 15 bp, Homo sapiens
tatgcaatgcttcat

SEQ ID NO: 652453 - DNA, 17 bp, Homo sapiens
tatgcaggcagcacagc

SEQ ID NO: 652454 - DNA, 13 bp, Homo sapiens
tatgccactgacc

SEQ ID NO: 652455 - DNA, 18 bp, Homo sapiens
tatgccttaatttagaaa

SEQ ID NO: 652456 - DNA, 19 bp, Homo sapiens
tatgccttaatttagaaac

SEQ ID NO: 652457 - DNA, 14 bp, Homo sapiens
tatgctatttctgt

SEQ ID NO: 652458 - DNA, 21 bp, Homo sapiens
tatgctgatcttttaaaatca

SEQ ID NO: 652459 - DNA, 18 bp, Homo sapiens
tatgcttgtaactaaaat

SEQ ID NO: 652460 - DNA, 16 bp, Homo sapiens
tatggatatatttgaa

SEQ ID NO: 652461 - DNA, 16 bp, Homo sapiens
tatggatgatttaagt

SEQ ID NO: 652462 - DNA, 14 bp, Homo sapiens
tatggatttaagag

SEQ ID NO: 652463 - DNA, 23 bp, Homo sapiens
tatggcagaagggaattgctcag

SEQ ID NO: 652464 - DNA, 15 bp, Homo sapiens
tatggcaggactcct

SEQ ID NO: 652465 - DNA, 17 bp, Homo sapiens
tatggcaggataagaaa

SEQ ID NO: 652466 - DNA, 19 bp, Homo sapiens
tatggccacatttaatatc

SEQ ID NO: 652467 - DNA, 22 bp, Homo sapiens
tatggctctgcacccctctgcc

SEQ ID NO: 652468 - DNA, 17 bp, Homo sapiens
tatggcttcaccaagaa

SEQ ID NO: 652469 - DNA, 19 bp, Homo sapiens
tatgggagcttaactttat

SEQ ID NO: 652470 - DNA, 14 bp, Homo sapiens
tatgggtgaaaata

SEQ ID NO: 652471 - DNA, 16 bp, Homo sapiens
tatggtggaaaagaac

SEQ ID NO: 652472 - DNA, 13 bp, Homo sapiens
tatggtgtatttt

SEQ ID NO: 652473 - DNA, 21 bp, Homo sapiens
tatgtaaatggtatgtcattc

SEQ ID NO: 652474 - DNA, 14 bp, Homo sapiens
tatgtaatttcaaa

SEQ ID NO: 652475 - DNA, 17 bp, Homo sapiens
tatgtaatttcaaaata

SEQ ID NO: 652476 - DNA, 13 bp, Homo sapiens
tcaactttgtaaa

SEQ ID NO: 652477 - DNA, 19 bp, Homo sapiens
tcaactttgtaaaaatctt

SEQ ID NO: 652478 - DNA, 21 bp, Homo sapiens
tcaagaaaatctttgttgaag

SEQ ID NO: 652479 - DNA, 23 bp, Homo sapiens
tcaagaaaatctttgttgaagtt

SEQ ID NO: 652480 - DNA, 13 bp, Homo sapiens
tcaagaaaggaaa

SEQ ID NO: 652481 - DNA, 15 bp, Homo sapiens
tcaagaatgaaaaat

SEQ ID NO: 652482 - DNA, 18 bp, Homo sapiens
tcaagaccagcctggtca

SEQ ID NO: 652483 - DNA, 18 bp, Homo sapiens
tcaagattttgaatgctt

SEQ ID NO: 652484 - DNA, 17 bp, Homo sapiens
tcaagctagtgtttcta

SEQ ID NO: 652485 - DNA, 20 bp, Homo sapiens
tcaagctgttatttcttccc

SEQ ID NO: 652486 - DNA, 22 bp, Homo sapiens
tcaagctgttatttcttccctg

SEQ ID NO: 652487 - DNA, 18 bp, Homo sapiens
tcaaggagaggcaaagaa

SEQ ID NO: 652488 - DNA, 20 bp, Homo sapiens
tcaaggagaggcaaagaaag

SEQ ID NO: 652489 - DNA, 19 bp, Homo sapiens
tcaaggatatactgcagct

SEQ ID NO: 652490 - DNA, 17 bp, Homo sapiens
tcaagggcttactattt

SEQ ID NO: 652491 - DNA, 19 bp, Homo sapiens
tcaagtccatctgacaaaa

SEQ ID NO: 652492 - DNA, 16 bp, Homo sapiens
tcaagttaccaatgta

SEQ ID NO: 652493 - DNA, 18 bp, Homo sapiens
tcaataacactgtatttt

SEQ ID NO: 652494 - DNA, 15 bp, Homo sapiens
tcaatatcagctttg

SEQ ID NO: 652495 - DNA, 15 bp, Homo sapiens
tcaatatgaatctat

SEQ ID NO: 652496 - DNA, 17 bp, Homo sapiens
tcaatatgaatctataa

SEQ ID NO: 652497 - DNA, 14 bp, Homo sapiens
tcaatcatgaatga

SEQ ID NO: 652498 - DNA, 17 bp, Homo sapiens
tcaatgaaccataaatt

SEQ ID NO: 652499 - DNA, 20 bp, Homo sapiens
tcaatgaccattcaattagt

SEQ ID NO: 652500 - DNA, 18 bp, Homo sapiens
tcaattagtggtcataaa

SEQ ID NO: 652501 - DNA, 15 bp, Homo sapiens
tcaattatctttatc

SEQ ID NO: 652502 - DNA, 15 bp, Homo sapiens
tcaattatttgcata

SEQ ID NO: 652503 - DNA, 14 bp, Homo sapiens
tcaattgtcacttt

SEQ ID NO: 652504 - DNA, 20 bp, Homo sapiens
tcacaaatgtcattgtctac

SEQ ID NO: 652505 - DNA, 19 bp, Homo sapiens
tcacaacttgatggctgcg

SEQ ID NO: 652506 - DNA, 16 bp, Homo sapiens
tcacacaatatagttt

SEQ ID NO: 652507 - DNA, 16 bp, Homo sapiens
tcacacaccctgaggt

SEQ ID NO: 652508 - DNA, 17 bp, Homo sapiens
tcacagggtgggcctcg

SEQ ID NO: 652509 - DNA, 19 bp, Homo sapiens
tcacagggtgggcctcggc

SEQ ID NO: 652510 - DNA, 22 bp, Homo sapiens
tcacatgtttaactttaaggat

SEQ ID NO: 652511 - DNA, 15 bp, Homo sapiens
tcacattagaattag

SEQ ID NO: 652512 - DNA, 13 bp, Homo sapiens
tcaccaagaagca

SEQ ID NO: 652513 - DNA, 12 bp, Homo sapiens
tcaccaaggaaa

SEQ ID NO: 652514 - DNA, 18 bp, Homo sapiens
tcaccatgtgagctcttc

SEQ ID NO: 652515 - DNA, 18 bp, Homo sapiens
tcaccattgtgtggtgta

SEQ ID NO: 652516 - DNA, 14 bp, Homo sapiens
tcaccccactcctg

SEQ ID NO: 652517 - DNA, 17 bp, Homo sapiens
tcaccccactcctgtca

SEQ ID NO: 652518 - DNA, 19 bp, Homo sapiens
tcacccgagttcctctggg

SEQ ID NO: 652519 - DNA, 22 bp, Homo sapiens
tcacccttatagtctaagacta

SEQ ID NO: 652520 - DNA, 22 bp, Homo sapiens
tcacccttgcaccgtcctcagc

SEQ ID NO: 652521 - DNA, 15 bp, Homo sapiens
tcaccgcccatcagg

SEQ ID NO: 652522 - DNA, 20 bp, Homo sapiens
tcaccgcccatcagggttct

SEQ ID NO: 652523 - DNA, 22 bp, Homo sapiens
tcacctaatgtttatgagccag

SEQ ID NO: 652524 - DNA, 21 bp, Homo sapiens
tcacctctgtgacccctcctt

SEQ ID NO: 652525 - DNA, 15 bp, Homo sapiens
tcaccttccaacact

SEQ ID NO: 652526 - DNA, 13 bp, Homo sapiens
tcactaaaagcat

SEQ ID NO: 652527 - DNA, 16 bp, Homo sapiens
tcactaaaagcatgaa

SEQ ID NO: 652528 - DNA, 17 bp, Homo sapiens
tcactaaaagcatgaat

SEQ ID NO: 652529 - DNA, 22 bp, Homo sapiens
tcactaaaagcatgaattggaa

SEQ ID NO: 652530 - DNA, 16 bp, Homo sapiens
tcactaaagcatgaaa

SEQ ID NO: 652531 - DNA, 18 bp, Homo sapiens
tcactacaagtcagctcc

SEQ ID NO: 652532 - DNA, 17 bp, Homo sapiens
tcattgctaaactgatg

SEQ ID NO: 652533 - DNA, 12 bp, Homo sapiens
tcattgtcacct

SEQ ID NO: 652534 - DNA, 19 bp, Homo sapiens
tcattgtctactcctagaa

SEQ ID NO: 652535 - DNA, 22 bp, Homo sapiens
tcattgtctctcacagatgtga

SEQ ID NO: 652536 - DNA, 14 bp, Homo sapiens
tcatttaaaaagct

SEQ ID NO: 652537 - DNA, 16 bp, Homo sapiens
tcatttcattcctaac

SEQ ID NO: 652538 - DNA, 14 bp, Homo sapiens
tcatttgctttgga

SEQ ID NO: 652539 - DNA, 15 bp, Homo sapiens
tcatttgctttggaa

SEQ ID NO: 652540 - DNA, 21 bp, Homo sapiens
tcatttgtggcagtcccttat

SEQ ID NO: 652541 - DNA, 17 bp, Homo sapiens
tcattttcctgacattt

SEQ ID NO: 652542 - DNA, 16 bp, Homo sapiens
tcattttttatgtatt

SEQ ID NO: 652543 - DNA, 19 bp, Homo sapiens
tccaaaatgtgtatttctt

SEQ ID NO: 652544 - DNA, 15 bp, Homo sapiens
tccaaagaggctgcc

SEQ ID NO: 652545 - DNA, 22 bp, Homo sapiens
tccaaatataagacatttgttt

SEQ ID NO: 652546 - DNA, 18 bp, Homo sapiens
tccaaattaaaacaaata

SEQ ID NO: 652547 - DNA, 14 bp, Homo sapiens
tccaaatttaaaat

SEQ ID NO: 652548 - DNA, 16 bp, Homo sapiens
tccaactgcaggaaaa

SEQ ID NO: 652549 - DNA, 18 bp, Homo sapiens
tccaacttatgtttttaa

SEQ ID NO: 652550 - DNA, 20 bp, Homo sapiens
tccaacttatgtttttaaat

SEQ ID NO: 652551 - DNA, 13 bp, Homo sapiens
tccaagttcaaaa

SEQ ID NO: 652552 - DNA, 14 bp, Homo sapiens
tccacatcagatgc

SEQ ID NO: 652553 - DNA, 16 bp, Homo sapiens
tccacatgctgcctgg

SEQ ID NO: 652554 - DNA, 14 bp, Homo sapiens
tccacccagcaggc

SEQ ID NO: 652555 - DNA, 17 bp, Homo sapiens
tccacccagcaggcaga

SEQ ID NO: 652556 - DNA, 15 bp, Homo sapiens
tccaccccccactca

SEQ ID NO: 652557 - DNA, 20 bp, Homo sapiens
tccacgtcctccaagctcac

SEQ ID NO: 652558 - DNA, 16 bp, Homo sapiens
tccactcttgatctct

SEQ ID NO: 652559 - DNA, 19 bp, Homo sapiens
tccactcttgatctctctt

SEQ ID NO: 652560 - DNA, 14 bp, Homo sapiens
tccactgttagcac

SEQ ID NO: 652561 - DNA, 11 bp, Homo sapiens
tccacttgtat

SEQ ID NO: 652562 - DNA, 15 bp, Homo sapiens
tccagaaaactgtga

SEQ ID NO: 652563 - DNA, 17 bp, Homo sapiens
tccagatctttcagaaa

SEQ ID NO: 652564 - DNA, 15 bp, Homo sapiens
tccagatgccacaat

SEQ ID NO: 652565 - DNA, 18 bp, Homo sapiens
tccagcaattctcctgcc

SEQ ID NO: 652566 - DNA, 14 bp, Homo sapiens
tccagcaccttgtg

SEQ ID NO: 652567 - DNA, 19 bp, Homo sapiens
tccagcaccttgtgcctgg

SEQ ID NO: 652568 - DNA, 13 bp, Homo sapiens
tccagctcagccc

SEQ ID NO: 652569 - DNA, 14 bp, Homo sapiens
tccagctcagccct

SEQ ID NO: 652570 - DNA, 22 bp, Homo sapiens
tccagcttctcatgttaaatat

SEQ ID NO: 652571 - DNA, 18 bp, Homo sapiens
tccaggagagcctggggg

SEQ ID NO: 652572 - DNA, 14 bp, Homo sapiens
tccaggcctgcctc

SEQ ID NO: 652573 - DNA, 13 bp, Homo sapiens
tccagggatggcc

SEQ ID NO: 652574 - DNA, 15 bp, Homo sapiens
tccagggcagcggct

SEQ ID NO: 652575 - DNA, 18 bp, Homo sapiens
tccagggtacatgcttta

SEQ ID NO: 652576 - DNA, 15 bp, Homo sapiens
tccagtaccttgctt

SEQ ID NO: 652577 - DNA, 14 bp, Homo sapiens
tccagtgcaattgt

SEQ ID NO: 652578 - DNA, 13 bp, Homo sapiens
tccagtgctccca

SEQ ID NO: 652579 - DNA, 17 bp, Homo sapiens
tccagtgtcagggtcca

SEQ ID NO: 652580 - DNA, 15 bp, Homo sapiens
tccagtgtctgtctg

SEQ ID NO: 652581 - DNA, 13 bp, Homo sapiens
tccagttataaga

SEQ ID NO: 652582 - DNA, 16 bp, Homo sapiens
tccagttataagaaga

SEQ ID NO: 652583 - DNA, 13 bp, Homo sapiens
tccataaagtaca

SEQ ID NO: 652584 - DNA, 18 bp, Homo sapiens
tccataaagtacaaatga

SEQ ID NO: 652585 - DNA, 13 bp, Homo sapiens
tccataccttttc

SEQ ID NO: 652586 - DNA, 20 bp, Homo sapiens
tccataccttttctcttttc

SEQ ID NO: 652587 - DNA, 22 bp, Homo sapiens
tccataggagggaaggagcagt

SEQ ID NO: 652588 - DNA, 16 bp, Homo sapiens
tccatatttgatttct

SEQ ID NO: 652589 - DNA, 23 bp, Homo sapiens
tccatcaactcccaacttcttcc

SEQ ID NO: 652590 - DNA, 17 bp, Homo sapiens
tccatctctctcttgcc

SEQ ID NO: 652591 - DNA, 14 bp, Homo sapiens
tccatctcttctgc

SEQ ID NO: 652592 - DNA, 13 bp, Homo sapiens
tccatctgacaaa

SEQ ID NO: 652593 - DNA, 17 bp, Homo sapiens
tccatgatttagcaagc

SEQ ID NO: 652594 - DNA, 22 bp, Homo sapiens
tccatgatttagcaagcaacta

SEQ ID NO: 652595 - DNA, 20 bp, Homo sapiens
tccatgtgcctttctttgcc

SEQ ID NO: 652596 - DNA, 22 bp, Homo sapiens
tccatgtgcctttctttgcctc

SEQ ID NO: 652597 - DNA, 14 bp, Homo sapiens
tccatgtgtatcca

SEQ ID NO: 652598 - DNA, 15 bp, Homo sapiens
tccattatgattctt

SEQ ID NO: 652599 - DNA, 22 bp, Homo sapiens
tccattattcctctcaccccac

SEQ ID NO: 652600 - DNA, 15 bp, Homo sapiens
tccatttccattgct

SEQ ID NO: 652601 - DNA, 19 bp, Homo sapiens
tccatttccattgcttatt

SEQ ID NO: 652602 - DNA, 21 bp, Homo sapiens
tcccaaggagggggcctcatt

SEQ ID NO: 652603 - DNA, 22 bp, Homo sapiens
tcccaaggagggggcctcattg

SEQ ID NO: 652604 - DNA, 20 bp, Homo sapiens
tccttaagctgcagagattt

SEQ ID NO: 652605 - DNA, 19 bp, Homo sapiens
tccttacaatgtgaataat

SEQ ID NO: 652606 - DNA, 20 bp, Homo sapiens
tccttactcccccaccactc

SEQ ID NO: 652607 - DNA, 14 bp, Homo sapiens
tccttatccctctc

SEQ ID NO: 652608 - DNA, 19 bp, Homo sapiens
tccttatcctacagtacaa

SEQ ID NO: 652609 - DNA, 18 bp, Homo sapiens
tccttatgtcctgtcata

SEQ ID NO: 652610 - DNA, 21 bp, Homo sapiens
tccttatttgccttctactcc

SEQ ID NO: 652611 - DNA, 21 bp, Homo sapiens
tccttcccagaatgttactga

SEQ ID NO: 652612 - DNA, 17 bp, Homo sapiens
tccttctttccttgttc

SEQ ID NO: 652613 - DNA, 14 bp, Homo sapiens
tccttgaggacaga

SEQ ID NO: 652614 - DNA, 18 bp, Homo sapiens
tccttgcccccagtgcct

SEQ ID NO: 652615 - DNA, 23 bp, Homo sapiens
tccttgtcagggtctccttcctt

SEQ ID NO: 652616 - DNA, 15 bp, Homo sapiens
tcctttaaaaaagaa

SEQ ID NO: 652617 - DNA, 20 bp, Homo sapiens
tcctttcttatcttgaccat

SEQ ID NO: 652618 - DNA, 21 bp, Homo sapiens
tcctttgcccttcctcctgcc

SEQ ID NO: 652619 - DNA, 22 bp, Homo sapiens
tcctttgcccttcctcctgcct

SEQ ID NO: 652620 - DNA, 14 bp, Homo sapiens
tccttttaaagaaa

SEQ ID NO: 652621 - DNA, 21 bp, Homo sapiens
tccttttaaagaagctttatc

SEQ ID NO: 652622 - DNA, 11 bp, Homo sapiens
tccttttccta

SEQ ID NO: 652623 - DNA, 16 bp, Homo sapiens
tccttttcctatcctt

SEQ ID NO: 652624 - DNA, 19 bp, Homo sapiens
tccttttccttatttgcct

SEQ ID NO: 652625 - DNA, 15 bp, Homo sapiens
tcgagaccatcctgg

SEQ ID NO: 652626 - DNA, 16 bp, Homo sapiens
tcgagaccatcctggc

SEQ ID NO: 652627 - DNA, 16 bp, Homo sapiens
tcgcctcctcctcctg

SEQ ID NO: 652628 - DNA, 19 bp, Homo sapiens
tcgcctcctcctcctgccc

SEQ ID NO: 652629 - DNA, 19 bp, Homo sapiens
tcgcctgcctgcagcaggc

SEQ ID NO: 652630 - DNA, 17 bp, Homo sapiens
tcgctgaaattgcttat

SEQ ID NO: 652631 - DNA, 22 bp, Homo sapiens
tcgctgagggcagactggggca

SEQ ID NO: 652632 - DNA, 15 bp, Homo sapiens
tcgcttttaataaac

SEQ ID NO: 652633 - DNA, 18 bp, Homo sapiens
tcggagagggacatagaa

SEQ ID NO: 652634 - DNA, 16 bp, Homo sapiens
tcgggaccaatatata

SEQ ID NO: 652635 - DNA, 14 bp, Homo sapiens
tcgtgtctctggtc

SEQ ID NO: 652636 - DNA, 21 bp, Homo sapiens
tcgttctgtactgttactggg

SEQ ID NO: 652637 - DNA, 15 bp, Homo sapiens
tcgttgcacagctgt

SEQ ID NO: 652638 - DNA, 17 bp, Homo sapiens
tcgtttacactgcacat

SEQ ID NO: 652639 - DNA, 14 bp, Homo sapiens
tctaaataaaaata

SEQ ID NO: 652640 - DNA, 21 bp, Homo sapiens
tctaaataaaaatatgtaatt

SEQ ID NO: 652641 - DNA, 17 bp, Homo sapiens
tctaaatttatattcat

SEQ ID NO: 652642 - DNA, 19 bp, Homo sapiens
tctaacactggcatgttca

SEQ ID NO: 652643 - DNA, 16 bp, Homo sapiens
tctaactcagaattat

SEQ ID NO: 652644 - DNA, 23 bp, Homo sapiens
tctaactcccccattttacagat

SEQ ID NO: 652645 - DNA, 17 bp, Homo sapiens
tctggggcaggctgggc

SEQ ID NO: 652646 - DNA, 19 bp, Homo sapiens
tctggggggacccagtgca

SEQ ID NO: 652647 - DNA, 21 bp, Homo sapiens
tctggggggacccagtgcaga

SEQ ID NO: 652648 - DNA, 19 bp, Homo sapiens
tctggggtgctgcctgaat

SEQ ID NO: 652649 - DNA, 15 bp, Homo sapiens
tctgggtccatcctg

SEQ ID NO: 652650 - DNA, 18 bp, Homo sapiens
tctgggtccatcctggtc

SEQ ID NO: 652651 - DNA, 16 bp, Homo sapiens
tctgggtccttggctc

SEQ ID NO: 652652 - DNA, 13 bp, Homo sapiens
tctgggtcttttg

SEQ ID NO: 652653 - DNA, 19 bp, Homo sapiens
tctgggtgtgactgattcc

SEQ ID NO: 652654 - DNA, 14 bp, Homo sapiens
tctgggtttctaag

SEQ ID NO: 652655 - DNA, 18 bp, Homo sapiens
tctgggtttctaagcagt

SEQ ID NO: 652656 - DNA, 23 bp, Homo sapiens
tctggtagggatatggcaggact

SEQ ID NO: 652657 - DNA, 14 bp, Homo sapiens
tctggttatatcat

SEQ ID NO: 652658 - DNA, 15 bp, Homo sapiens
tctggttcttgaaaa

SEQ ID NO: 652659 - DNA, 23 bp, Homo sapiens
tctggttcttgaaaataagattc

SEQ ID NO: 652660 - DNA, 14 bp, Homo sapiens
tctgtaatgtaaat

SEQ ID NO: 652661 - DNA, 22 bp, Homo sapiens
tctgtaatgtaaataaactatt

SEQ ID NO: 652662 - DNA, 23 bp, Homo sapiens
tctgtcccactacatctgggact

SEQ ID NO: 652663 - DNA, 13 bp, Homo sapiens
tctgtccctctcc

SEQ ID NO: 652664 - DNA, 16 bp, Homo sapiens
tctgtcccttgctgta

SEQ ID NO: 652665 - DNA, 16 bp, Homo sapiens
tctgtgacccctcctt

SEQ ID NO: 652666 - DNA, 20 bp, Homo sapiens
tctgtgagaaggtttattgt

SEQ ID NO: 652667 - DNA, 18 bp, Homo sapiens
tctgtggatggtcattgc

SEQ ID NO: 652668 - DNA, 13 bp, Homo sapiens
tctgtgggatata

SEQ ID NO: 652669 - DNA, 18 bp, Homo sapiens
tctgtggttcctctgctc

SEQ ID NO: 652670 - DNA, 20 bp, Homo sapiens
tctgtggttcctctgctcac

SEQ ID NO: 652671 - DNA, 14 bp, Homo sapiens
tctgtgtaaacaga

SEQ ID NO: 652672 - DNA, 15 bp, Homo sapiens
tctgtgtcatttctt

SEQ ID NO: 652673 - DNA, 19 bp, Homo sapiens
tctgttacactttttggaa

SEQ ID NO: 652674 - DNA, 15 bp, Homo sapiens
tctgttacccaggct

SEQ ID NO: 652675 - DNA, 12 bp, Homo sapiens
tctgttatatga

SEQ ID NO: 652676 - DNA, 14 bp, Homo sapiens
tctgttcatttcta

SEQ ID NO: 652677 - DNA, 18 bp, Homo sapiens
tctgttggtctgccttct

SEQ ID NO: 652678 - DNA, 21 bp, Homo sapiens
tctgtttataatgaagaacac

SEQ ID NO: 652679 - DNA, 18 bp, Homo sapiens
tctgtttcctatttaata

SEQ ID NO: 652680 - DNA, 19 bp, Homo sapiens
tctgtttggactgcagaag

SEQ ID NO: 652681 - DNA, 19 bp, Homo sapiens
tcttaaataatgcttcaga

SEQ ID NO: 652682 - DNA, 21 bp, Homo sapiens
tcttaaatgtttatactgtat

SEQ ID NO: 652683 - DNA, 19 bp, Homo sapiens
tcttaacagtggttcaaat

SEQ ID NO: 652684 - DNA, 20 bp, Homo sapiens
tcttaacctttgctatgtaa

SEQ ID NO: 652685 - DNA, 21 bp, Homo sapiens
tcttaagcaggtttgttttca

SEQ ID NO: 652686 - DNA, 17 bp, Homo sapiens
tcttacaatcaaatctc

SEQ ID NO: 652687 - DNA, 18 bp, Homo sapiens
tcttacacactgtctgta

SEQ ID NO: 652688 - DNA, 19 bp, Homo sapiens
tcttacagtgtttggacag

SEQ ID NO: 652689 - DNA, 16 bp, Homo sapiens
tcttataactcaacat

SEQ ID NO: 652690 - DNA, 15 bp, Homo sapiens
tcttatcttgaccat

SEQ ID NO: 652691 - DNA, 14 bp, Homo sapiens
tcttatttaccctt

SEQ ID NO: 652692 - DNA, 17 bp, Homo sapiens
tcttcaaagccttctcc

SEQ ID NO: 652693 - DNA, 22 bp, Homo sapiens
tcttcaacatgctccaaatata

SEQ ID NO: 652694 - DNA, 20 bp, Homo sapiens
tcttcaggtgaacacttagt

SEQ ID NO: 652695 - DNA, 21 bp, Homo sapiens
tcttcatggcatcttcaatat

SEQ ID NO: 652696 - DNA, 14 bp, Homo sapiens
tcttccagggcagc

SEQ ID NO: 652697 - DNA, 21 bp, Homo sapiens
tcttcccactttcatctacct

SEQ ID NO: 652698 - DNA, 13 bp, Homo sapiens
tcttcccatgcat

SEQ ID NO: 652699 - DNA, 14 bp, Homo sapiens
tcttccccttccct

SEQ ID NO: 652700 - DNA, 23 bp, Homo sapiens
tcttcctgtgaagtttaattgtc

SEQ ID NO: 652701 - DNA, 18 bp, Homo sapiens
tcttccttgatgtttggg

SEQ ID NO: 652702 - DNA, 19 bp, Homo sapiens
tcttcgatgtgcccagggg

SEQ ID NO: 652703 - DNA, 15 bp, Homo sapiens
tcttctaagaagaca

SEQ ID NO: 652704 - DNA, 17 bp, Homo sapiens
tcttctaagaagacatt

SEQ ID NO: 652705 - DNA, 19 bp, Homo sapiens
tcttctagtgatgatggtt

SEQ ID NO: 652706 - DNA, 16 bp, Homo sapiens
tcttctgaagattctt

SEQ ID NO: 652707 - DNA, 17 bp, Homo sapiens
tcttctgcaacatttga

SEQ ID NO: 652708 - DNA, 21 bp, Homo sapiens
tcttctgcaacatttgacaaa

SEQ ID NO: 652709 - DNA, 17 bp, Homo sapiens
tcttctgcaagcctcat

SEQ ID NO: 652710 - DNA, 20 bp, Homo sapiens
tcttctgcaagcctcatgcc

SEQ ID NO: 652711 - DNA, 20 bp, Homo sapiens
tcttctggggcaggctgggc

SEQ ID NO: 652712 - DNA, 21 bp, Homo sapiens
tcttctggggcaggctgggcc

SEQ ID NO: 652713 - DNA, 12 bp, Homo sapiens
tcttcttctaag

SEQ ID NO: 652714 - DNA, 19 bp, Homo sapiens
tcttcttggggcccagtgc

SEQ ID NO: 652715 - DNA, 15 bp, Homo sapiens
tcttctttgtgcctt

SEQ ID NO: 652716 - DNA, 16 bp, Homo sapiens
tcttctttgtgccttt

SEQ ID NO: 652717 - DNA, 17 bp, Homo sapiens
tcttctttgtgcctttg

SEQ ID NO: 652718 - DNA, 20 bp, Homo sapiens
tcttctttgtgcctttggcc

SEQ ID NO: 652719 - DNA, 20 bp, Homo sapiens
tcttgatgccaccttcagat

SEQ ID NO: 652720 - DNA, 13 bp, Homo sapiens
tcttgcccatcct

SEQ ID NO: 652721 - DNA, 18 bp, Homo sapiens
tcttgcccatcctgactg

SEQ ID NO: 652722 - DNA, 18 bp, Homo sapiens
tcttgcctccaggtgcag

SEQ ID NO: 652723 - DNA, 22 bp, Homo sapiens
tcttggtttctctctacagtgc

SEQ ID NO: 652724 - DNA, 20 bp, Homo sapiens
tcttgtggttgtgtgtgttc

SEQ ID NO: 652725 - DNA, 15 bp, Homo sapiens
tcttgttagaaaaca

SEQ ID NO: 652726 - DNA, 14 bp, Homo sapiens
tctttaaactatgt

SEQ ID NO: 652727 - DNA, 18 bp, Homo sapiens
tctttaaccaggaatatt

SEQ ID NO: 652728 - DNA, 21 bp, Homo sapiens
tctttaagaatgcttaaaaaa

SEQ ID NO: 652729 - DNA, 15 bp, Homo sapiens
tctttcacctgggtg

SEQ ID NO: 652730 - DNA, 19 bp, Homo sapiens
tctttcatttcgtatttct

SEQ ID NO: 652731 - DNA, 12 bp, Homo sapiens
gcctttctttgc

SEQ ID NO: 652732 - DNA, 16 bp, Homo sapiens
gcctttctttgcctct

SEQ ID NO: 652733 - DNA, 22 bp, Homo sapiens
gccttttctggcaccgcagttt

SEQ ID NO: 652734 - DNA, 16 bp, Homo sapiens
gccttttgctctctgt

SEQ ID NO: 652735 - DNA, 18 bp, Homo sapiens
gccttttgctctctgtga

SEQ ID NO: 652736 - DNA, 16 bp, Homo sapiens
gctgcccctctcacca

SEQ ID NO: 652737 - DNA, 18 bp, Homo sapiens
gctgcccctctcaccaaa

SEQ ID NO: 652738 - DNA, 16 bp, Homo sapiens
gctgccctgagaagct

SEQ ID NO: 652739 - DNA, 21 bp, Homo sapiens
gctgccctgagaagctgctcc

SEQ ID NO: 652740 - DNA, 14 bp, Homo sapiens
gctgcctctgctcc

SEQ ID NO: 652741 - DNA, 15 bp, Homo sapiens
gctgcctctgctccc

SEQ ID NO: 652742 - DNA, 13 bp, Homo sapiens
gctgcctgaatcc

SEQ ID NO: 652743 - DNA, 12 bp, Homo sapiens
gctgcctggcac

SEQ ID NO: 652744 - DNA, 17 bp, Homo sapiens
gctgcctggcacagacc

SEQ ID NO: 652745 - DNA, 20 bp, Homo sapiens
gctgcctggcacagaccagg

SEQ ID NO: 652746 - DNA, 16 bp, Homo sapiens
gctgccttctttccat

SEQ ID NO: 652747 - DNA, 21 bp, Homo sapiens
gctgctatccccatctccctg

SEQ ID NO: 652748 - DNA, 23 bp, Homo sapiens
gctgctccaggcctgcagcagga

SEQ ID NO: 652749 - DNA, 21 bp, Homo sapiens
gctggaaagcagagcctcctg

SEQ ID NO: 652750 - DNA, 23 bp, Homo sapiens
gctggacttctacctgccctcaa

SEQ ID NO: 652751 - DNA, 18 bp, Homo sapiens
gctggcacgtgacaggct

SEQ ID NO: 652752 - DNA, 17 bp, Homo sapiens
gctggctcacagtacag

SEQ ID NO: 652753 - DNA, 23 bp, Homo sapiens
gctgggagcctggttcagacaca

SEQ ID NO: 652754 - DNA, 19 bp, Homo sapiens
gctgggccatgtccaaaga

SEQ ID NO: 652755 - DNA, 20 bp, Homo sapiens
gctgggcccgacatggctcc

SEQ ID NO: 652756 - DNA, 22 bp, Homo sapiens
gctgggggaatgagcccagaga

SEQ ID NO: 652757 - DNA, 12 bp, Homo sapiens
gctggtgcacag

SEQ ID NO: 652758 - DNA, 16 bp, Homo sapiens
gctgtaacttaaaata

SEQ ID NO: 652759 - DNA, 16 bp, Homo sapiens
gctgtataaagcatgt

SEQ ID NO: 652760 - DNA, 15 bp, Homo sapiens
gctgtatgctgatca

SEQ ID NO: 652761 - DNA, 17 bp, Homo sapiens
gctgtatttttattttt

SEQ ID NO: 652762 - DNA, 14 bp, Homo sapiens
gctgtgtgtcccag

SEQ ID NO: 652763 - DNA, 16 bp, Homo sapiens
gctgtgtgtcccaggc

SEQ ID NO: 652764 - DNA, 20 bp, Homo sapiens
gctgttatttcttccctgct

SEQ ID NO: 652765 - DNA, 19 bp, Homo sapiens
gctgttgcttaaaccactt

SEQ ID NO: 652766 - DNA, 12 bp, Homo sapiens
gctgtttctaag

SEQ ID NO: 652767 - DNA, 15 bp, Homo sapiens
gctgtttgaaatgtt

SEQ ID NO: 652768 - DNA, 13 bp, Homo sapiens
gctgttttgtgga

SEQ ID NO: 652769 - DNA, 19 bp, Homo sapiens
gctgttttgtggatttttg

SEQ ID NO: 652770 - DNA, 13 bp, Homo sapiens
gcttaaaaaataa

SEQ ID NO: 652771 - DNA, 16 bp, Homo sapiens
gcttagagaggacaat

SEQ ID NO: 652772 - DNA, 16 bp, Homo sapiens
gcttattgtttctctg

SEQ ID NO: 652773 - DNA, 19 bp, Homo sapiens
gcttatttctatgacaaat

SEQ ID NO: 652774 - DNA, 23 bp, Homo sapiens
gcttatttctatgacaaattcaa

SEQ ID NO: 652775 - DNA, 16 bp, Homo sapiens
gcttcaccaagaagca

SEQ ID NO: 652776 - DNA, 18 bp, Homo sapiens
gcttcactctctccgtct

SEQ ID NO: 652777 - DNA, 19 bp, Homo sapiens
gcttccattttaattttaa

SEQ ID NO: 652778 - DNA, 18 bp, Homo sapiens
gcttccctgacttgcttt

SEQ ID NO: 652779 - DNA, 12 bp, Homo sapiens
gcttcgggaaaa

SEQ ID NO: 652780 - DNA, 12 bp, Homo sapiens
gcttctccagga

SEQ ID NO: 652781 - DNA, 23 bp, Homo sapiens
gcttctgtcttatttgaaggcca

SEQ ID NO: 652782 - DNA, 18 bp, Homo sapiens
gcttcttactgataattt

SEQ ID NO: 652783 - DNA, 14 bp, Homo sapiens
gcttcttcgttcct

SEQ ID NO: 652784 - DNA, 19 bp, Homo sapiens
gcttgaaaagctagtgtac

SEQ ID NO: 652785 - DNA, 11 bp, Homo sapiens
gcttgaatgct

SEQ ID NO: 652786 - DNA, 14 bp, Homo sapiens
gcttgactgcattg

SEQ ID NO: 652787 - DNA, 15 bp, Homo sapiens
gcttgcataataagc

SEQ ID NO: 652788 - DNA, 14 bp, Homo sapiens
gcttgcctgcaggg

SEQ ID NO: 652789 - DNA, 15 bp, Homo sapiens
gcttggactacacaa

SEQ ID NO: 652790 - DNA, 15 bp, Homo sapiens
gcttggccctttcct

SEQ ID NO: 652791 - DNA, 15 bp, Homo sapiens
gcttgggaattttat

SEQ ID NO: 652792 - DNA, 12 bp, Homo sapiens
gcttggtgtgac

SEQ ID NO: 652793 - DNA, 17 bp, Homo sapiens
gcttgtaactaaaataa

SEQ ID NO: 652794 - DNA, 22 bp, Homo sapiens
gcttgtaactaaaataattttg

SEQ ID NO: 652795 - DNA, 18 bp, Homo sapiens
gcttgtttacctttctct

SEQ ID NO: 652796 - DNA, 20 bp, Homo sapiens
gcttgttttataaaattttg

SEQ ID NO: 652797 - DNA, 22 bp, Homo sapiens
gctttaattaattaagtatctg

SEQ ID NO: 652798 - DNA, 16 bp, Homo sapiens
gctttattaatgtttt

SEQ ID NO: 652799 - DNA, 20 bp, Homo sapiens
gctttattttgagatgtaaa

SEQ ID NO: 652800 - DNA, 19 bp, Homo sapiens
gctttcatgttgcaaagaa

SEQ ID NO: 652801 - DNA, 17 bp, Homo sapiens
gctttccaaggaagcag

SEQ ID NO: 652802 - DNA, 21 bp, Homo sapiens
gctttcccacttcccaccctg

SEQ ID NO: 652803 - DNA, 21 bp, Homo sapiens
gctttcccgcccagcctcact

SEQ ID NO: 652804 - DNA, 15 bp, Homo sapiens
gctttcctgtttcca

SEQ ID NO: 652805 - DNA, 17 bp, Homo sapiens
gctttctggggcctagc

SEQ ID NO: 652806 - DNA, 20 bp, Homo sapiens
gctttgagacctttcctctc

SEQ ID NO: 652807 - DNA, 11 bp, Homo sapiens
gctttgcctct

SEQ ID NO: 652808 - DNA, 16 bp, Homo sapiens
gcttttgtatagaaaa

SEQ ID NO: 652809 - DNA, 18 bp, Homo sapiens
gctttttaagaatatttt

SEQ ID NO: 652810 - DNA, 21 bp, Homo sapiens
gctttttcatccttctttcct

SEQ ID NO: 652811 - DNA, 22 bp, Homo sapiens
ggaaaatattcatgcttgccat

SEQ ID NO: 652812 - DNA, 18 bp, Homo sapiens
ggaaactcacactcccct

SEQ ID NO: 652813 - DNA, 15 bp, Homo sapiens
ggaaagcagagcctc

SEQ ID NO: 652814 - DNA, 19 bp, Homo sapiens
ggaaagcagagcctcctgg

SEQ ID NO: 652815 - DNA, 12 bp, Homo sapiens
ggaaagttttta

SEQ ID NO: 652816 - DNA, 11 bp, Homo sapiens
ggaaatacagt

SEQ ID NO: 652817 - DNA, 18 bp, Homo sapiens
ggaaatccctttctgcta

SEQ ID NO: 652818 - DNA, 16 bp, Homo sapiens
ggaaatgggaaaaaac

SEQ ID NO: 652819 - DNA, 16 bp, Homo sapiens
ggaaattcctgtactg

SEQ ID NO: 652820 - DNA, 13 bp, Homo sapiens
ggaacaaggaagg

SEQ ID NO: 652821 - DNA, 16 bp, Homo sapiens
ggaacacatctggctg

SEQ ID NO: 652822 - DNA, 13 bp, Homo sapiens
ggaacctgccatg

SEQ ID NO: 652823 - DNA, 15 bp, Homo sapiens
ggaagacatttttcc

SEQ ID NO: 652824 - DNA, 17 bp, Homo sapiens
ggaagactttgtgactg

SEQ ID NO: 652825 - DNA, 13 bp, Homo sapiens
ggaagagacaaag

SEQ ID NO: 652826 - DNA, 22 bp, Homo sapiens
ggaagcagaagacgggagggga

SEQ ID NO: 652827 - DNA, 13 bp, Homo sapiens
ggaagccccacat

SEQ ID NO: 652828 - DNA, 16 bp, Homo sapiens
ggaaggagaagtaaga

SEQ ID NO: 652829 - DNA, 12 bp, Homo sapiens
ggaaggagaggg

SEQ ID NO: 652830 - DNA, 18 bp, Homo sapiens
ggaaggcagacagcaggc

SEQ ID NO: 652831 - DNA, 13 bp, Homo sapiens
ggaaggctgaggc

SEQ ID NO: 652832 - DNA, 18 bp, Homo sapiens
ggaaggctgaggcaggag

SEQ ID NO: 652833 - DNA, 23 bp, Homo sapiens
ggaagttttaactttaatacagc

SEQ ID NO: 652834 - DNA, 16 bp, Homo sapiens
ggaatcctcctccagg

SEQ ID NO: 652835 - DNA, 19 bp, Homo sapiens
ggaatcctcctccagggtg

SEQ ID NO: 652836 - DNA, 13 bp, Homo sapiens
ggaatgagcccag

SEQ ID NO: 652837 - DNA, 20 bp, Homo sapiens
ggaatgagcccagagaacag

SEQ ID NO: 652838 - DNA, 21 bp, Homo sapiens
ggaatgagcccagagaacagc

SEQ ID NO: 652839 - DNA, 14 bp, Homo sapiens
ggaattgaaaaaaa

SEQ ID NO: 652840 - DNA, 14 bp, Homo sapiens
ggacagaaagagac

SEQ ID NO: 652841 - DNA, 19 bp, Homo sapiens
ggacagctgactgaatgca

SEQ ID NO: 652842 - DNA, 17 bp, Homo sapiens
ggacagctgataaattt

SEQ ID NO: 652843 - DNA, 11 bp, Homo sapiens
ggacaggcccg

SEQ ID NO: 652844 - DNA, 15 bp, Homo sapiens
ggacagttgattcaa

SEQ ID NO: 652845 - DNA, 14 bp, Homo sapiens
ggacataatttcag

SEQ ID NO: 652846 - DNA, 22 bp, Homo sapiens
ggacatgcaataaaatttaaaa

SEQ ID NO: 652847 - DNA, 16 bp, Homo sapiens
ggacccccgtggggca

SEQ ID NO: 652848 - DNA, 16 bp, Homo sapiens
ggaccctgtcctgcag

SEQ ID NO: 652849 - DNA, 21 bp, Homo sapiens
ggaccctgtcctgcagtccca

SEQ ID NO: 652850 - DNA, 21 bp, Homo sapiens
ggacctttaacttttttttct

SEQ ID NO: 652851 - DNA, 12 bp, Homo sapiens
ggacggccaaga

SEQ ID NO: 652852 - DNA, 22 bp, Homo sapiens
ggactgactttccgagcctcca

SEQ ID NO: 652853 - DNA, 22 bp, Homo sapiens
ggactgctacctttcaaagctt

SEQ ID NO: 652854 - DNA, 23 bp, Homo sapiens
ggacttctacctgccctcaaggg

SEQ ID NO: 652855 - DNA, 17 bp, Homo sapiens
ggagaaatgcaataact

SEQ ID NO: 652856 - DNA, 13 bp, Homo sapiens
ggagaagcatgaa

SEQ ID NO: 652857 - DNA, 16 bp, Homo sapiens
ggagaccctgcaaaca

SEQ ID NO: 652858 - DNA, 22 bp, Homo sapiens
ggagaccctgcaaacagaacag

SEQ ID NO: 652859 - DNA, 21 bp, Homo sapiens
ggagacggtttccagggaggg

SEQ ID NO: 652860 - DNA, 14 bp, Homo sapiens
ggagagcctggggg

SEQ ID NO: 652861 - DNA, 23 bp, Homo sapiens
ggagaggtgattctcagggctgg

SEQ ID NO: 652862 - DNA, 14 bp, Homo sapiens
ggagatacagtgga

SEQ ID NO: 652863 - DNA, 18 bp, Homo sapiens
ggagatcagcatgcctgt

SEQ ID NO: 652864 - DNA, 12 bp, Homo sapiens
ggagattataat

SEQ ID NO: 652865 - DNA, 14 bp, Homo sapiens
ggagattataataa

SEQ ID NO: 652866 - DNA, 14 bp, Homo sapiens
ggagcagaggaggg

SEQ ID NO: 652867 - DNA, 19 bp, Homo sapiens
ggagcagggaaggcctgac

SEQ ID NO: 652868 - DNA, 21 bp, Homo sapiens
ggagcccgaagtctgctgctg

SEQ ID NO: 652869 - DNA, 22 bp, Homo sapiens
ggagcccgaagtctgctgctgt

SEQ ID NO: 652870 - DNA, 18 bp, Homo sapiens
ggagctgtcaccaaggaa

SEQ ID NO: 652871 - DNA, 23 bp, Homo sapiens
ggaggccctcctgtgctggggga

SEQ ID NO: 652872 - DNA, 20 bp, Homo sapiens
ggaggcctgcgaccctgggg

SEQ ID NO: 652873 - DNA, 11 bp, Homo sapiens
ggagggaggcc

SEQ ID NO: 652874 - DNA, 13 bp, Homo sapiens
ggaggggaggcat

SEQ ID NO: 652875 - DNA, 15 bp, Homo sapiens
ggagggggcctcatt

SEQ ID NO: 652876 - DNA, 17 bp, Homo sapiens
ggagggggcctcattgt

SEQ ID NO: 652877 - DNA, 20 bp, Homo sapiens
ggaggtcaagatcagcctgg

SEQ ID NO: 652878 - DNA, 22 bp, Homo sapiens
ggaggtccctggtcggagaggg

SEQ ID NO: 652879 - DNA, 16 bp, Homo sapiens
ggaggtgtgaatgcac

SEQ ID NO: 652880 - DNA, 18 bp, Homo sapiens
ggagtgctggctcacagt

SEQ ID NO: 652881 - DNA, 12 bp, Homo sapiens
ggagttccttat

SEQ ID NO: 652882 - DNA, 12 bp, Homo sapiens
ggataaagatga

SEQ ID NO: 652883 - DNA, 14 bp, Homo sapiens
ggataaagatgaga

SEQ ID NO: 652884 - DNA, 15 bp, Homo sapiens
ggataaagccactga

SEQ ID NO: 652885 - DNA, 14 bp, Homo sapiens
ggatatactgcagc

SEQ ID NO: 652886 - DNA, 11 bp, Homo sapiens
ggatatatttg

SEQ ID NO: 652887 - DNA, 22 bp, Homo sapiens
ggatatccttatcagagctaag

SEQ ID NO: 652888 - DNA, 19 bp, Homo sapiens
ggatatggcaggactcctg

SEQ ID NO: 652889 - DNA, 22 bp, Homo sapiens
ggatatggcaggactcctggca

SEQ ID NO: 652890 - DNA, 12 bp, Homo sapiens
ggatatggtctt

SEQ ID NO: 652891 - DNA, 12 bp, Homo sapiens
ggatatttaagg

SEQ ID NO: 652892 - DNA, 23 bp, Homo sapiens
ggatattttttggtgtgccctgt

SEQ ID NO: 652893 - DNA, 21 bp, Homo sapiens
ggatcttgaatgtggtctcag

SEQ ID NO: 652894 - DNA, 18 bp, Homo sapiens
ggatgacttttttataca

SEQ ID NO: 652895 - DNA, 18 bp, Homo sapiens
ggatgccactcctccctc

SEQ ID NO: 652896 - DNA, 20 bp, Homo sapiens
ggatgccactcctccctccg

SEQ ID NO: 652897 - DNA, 18 bp, Homo sapiens
ggatgtccctgggccagg

SEQ ID NO: 652898 - DNA, 19 bp, Homo sapiens
ggatgtccctgggccaggg

SEQ ID NO: 652899 - DNA, 23 bp, Homo sapiens
ggatgtccctgggccagggtctg

SEQ ID NO: 652900 - DNA, 18 bp, Homo sapiens
ggattaagaaaccttgct

SEQ ID NO: 652901 - DNA, 20 bp, Homo sapiens
ggattaagaaaccttgctct

SEQ ID NO: 652902 - DNA, 19 bp, Homo sapiens
ggattattctttgaaaaca

SEQ ID NO: 652903 - DNA, 22 bp, Homo sapiens
ggattcattgtctctcacagat

SEQ ID NO: 652904 - DNA, 14 bp, Homo sapiens
ggattctaaataca

SEQ ID NO: 652905 - DNA, 20 bp, Homo sapiens
ggattctgaggccctgccca

SEQ ID NO: 652906 - DNA, 18 bp, Homo sapiens
ggattctttccattatga

SEQ ID NO: 652907 - DNA, 20 bp, Homo sapiens
ggcaaagggagcagaactga

SEQ ID NO: 652908 - DNA, 22 bp, Homo sapiens
ggcaaagtttaaatgtatttta

SEQ ID NO: 652909 - DNA, 23 bp, Homo sapiens
ggcaaagtttaaatgtattttac

SEQ ID NO: 652910 - DNA, 15 bp, Homo sapiens
ggcaaattaactgta

SEQ ID NO: 652911 - DNA, 16 bp, Homo sapiens
ggcaaattaactgtat

SEQ ID NO: 652912 - DNA, 12 bp, Homo sapiens
ggcacacactgt

SEQ ID NO: 652913 - DNA, 13 bp, Homo sapiens
ggcacagaccagg

SEQ ID NO: 652914 - DNA, 12 bp, Homo sapiens
ggcacagctggg

SEQ ID NO: 652915 - DNA, 20 bp, Homo sapiens
ggcacagctgggagcctggt

SEQ ID NO: 652916 - DNA, 14 bp, Homo sapiens
ggcaccgagaatgt

SEQ ID NO: 652917 - DNA, 16 bp, Homo sapiens
ggcactagccaaagcg

SEQ ID NO: 652918 - DNA, 14 bp, Homo sapiens
ggcagacacaaccc

SEQ ID NO: 652919 - DNA, 19 bp, Homo sapiens
ggcagagtggcgtggcctc

SEQ ID NO: 652920 - DNA, 17 bp, Homo sapiens
ggcagcatggagagagg

SEQ ID NO: 652921 - DNA, 21 bp, Homo sapiens
ggcagctgcctctgctccctc

SEQ ID NO: 652922 - DNA, 15 bp, Homo sapiens
ggcaggactcctggc

SEQ ID NO: 652923 - DNA, 16 bp, Homo sapiens
ggcaggactcctggca

SEQ ID NO: 652924 - DNA, 18 bp, Homo sapiens
ggcaggactcctggcagg

SEQ ID NO: 652925 - DNA, 15 bp, Homo sapiens
ggcaggcatggccct

SEQ ID NO: 652926 - DNA, 12 bp, Homo sapiens
ggcaggctgggc

SEQ ID NO: 652927 - DNA, 15 bp, Homo sapiens
ggcaggctgggccat

SEQ ID NO: 652928 - DNA, 22 bp, Homo sapiens
ggcaggctgggccatgtccaaa

SEQ ID NO: 652929 - DNA, 22 bp, Homo sapiens
ggcaggtgccatgtctgggaac

SEQ ID NO: 652930 - DNA, 17 bp, Homo sapiens
ggcagtccttactcccc

SEQ ID NO: 652931 - DNA, 14 bp, Homo sapiens
ggcagtggcagaga

SEQ ID NO: 652932 - DNA, 21 bp, Homo sapiens
ggcatcaagaggtgggagggc

SEQ ID NO: 652933 - DNA, 15 bp, Homo sapiens
ggcatcttggaaaag

SEQ ID NO: 652934 - DNA, 16 bp, Homo sapiens
ggcatcttggaaaagg

SEQ ID NO: 652935 - DNA, 21 bp, Homo sapiens
ggcatgagactcagtgcagat

SEQ ID NO: 652936 - DNA, 19 bp, Homo sapiens
ggcattgaggaagagtctt

SEQ ID NO: 652937 - DNA, 17 bp, Homo sapiens
ggcatttgtttctttct

SEQ ID NO: 652938 - DNA, 23 bp, Homo sapiens
ggcatttgtttctttctctgagg

SEQ ID NO: 652939 - DNA, 21 bp, Homo sapiens
ggccaagaatgtacgtccagc

SEQ ID NO: 652940 - DNA, 11 bp, Homo sapiens
ggccacagact

SEQ ID NO: 652941 - DNA, 20 bp, Homo sapiens
ggccacagtggggctgcagg

SEQ ID NO: 652942 - DNA, 21 bp, Homo sapiens
ggccacagtggggctgcaggc

SEQ ID NO: 652943 - DNA, 22 bp, Homo sapiens
ggccacagtggggctgcaggca

SEQ ID NO: 652944 - DNA, 16 bp, Homo sapiens
ggccacatggcggaga

SEQ ID NO: 652945 - DNA, 23 bp, Homo sapiens
ggccagacccacgggctcatgca

SEQ ID NO: 652946 - DNA, 23 bp, Homo sapiens
ggccaggccttacatctggctgg

SEQ ID NO: 652947 - DNA, 18 bp, Homo sapiens
ggccagggctgccctgag

SEQ ID NO: 652948 - DNA, 20 bp, Homo sapiens
ggccagggctgccctgagaa

SEQ ID NO: 652949 - DNA, 19 bp, Homo sapiens
ggccagggtctgtgtgaat

SEQ ID NO: 652950 - DNA, 16 bp, Homo sapiens
ggccagtggggcctgt

SEQ ID NO: 652951 - DNA, 17 bp, Homo sapiens
ggccagtggggcctgtg

SEQ ID NO: 652952 - DNA, 19 bp, Homo sapiens
ggccagtggggcctgtgga

SEQ ID NO: 652953 - DNA, 13 bp, Homo sapiens
ggccatgtccaaa

SEQ ID NO: 652954 - DNA, 20 bp, Homo sapiens
ggcccacccggtgggacccc

SEQ ID NO: 652955 - DNA, 15 bp, Homo sapiens
ggcccagtgcatggt

SEQ ID NO: 652956 - DNA, 21 bp, Homo sapiens
ggcccccaacctcagggctcc

SEQ ID NO: 652957 - DNA, 18 bp, Homo sapiens
ggcccccaataaaggcag

SEQ ID NO: 652958 - DNA, 14 bp, Homo sapiens
ggcccctcccacac

SEQ ID NO: 652959 - DNA, 22 bp, Homo sapiens
ggcccctcccacacccaaagct

SEQ ID NO: 652960 - DNA, 23 bp, Homo sapiens
ggcccctcccacacccaaagctg

SEQ ID NO: 652961 - DNA, 20 bp, Homo sapiens
ggcccctgcctgctggagat

SEQ ID NO: 652962 - DNA, 13 bp, Homo sapiens
ggcccgacatggc

SEQ ID NO: 652963 - DNA, 22 bp, Homo sapiens
ggccctcatctatgaggaaagg

SEQ ID NO: 652964 - DNA, 19 bp, Homo sapiens
ggccgcgcgtccagctgcc

SEQ ID NO: 652965 - DNA, 18 bp, Homo sapiens
ggccgtggcacagctggg

SEQ ID NO: 652966 - DNA, 21 bp, Homo sapiens
ggcctcagaccccctcagcct

SEQ ID NO: 652967 - DNA, 21 bp, Homo sapiens
ggcctgagagaattggctcaa

SEQ ID NO: 652968 - DNA, 20 bp, Homo sapiens
ggcctgcagcaggagtggtg

SEQ ID NO: 652969 - DNA, 14 bp, Homo sapiens
ggcctgccccctgg

SEQ ID NO: 652970 - DNA, 22 bp, Homo sapiens
ggcctgccctgttagctttcca

SEQ ID NO: 652971 - DNA, 22 bp, Homo sapiens
ggcctgtcccaattctgcccgc

SEQ ID NO: 652972 - DNA, 19 bp, Homo sapiens
ggcctgtgccagcaccaca

SEQ ID NO: 652973 - DNA, 22 bp, Homo sapiens
ggcctgtggaatgagtgtgcat

SEQ ID NO: 652974 - DNA, 19 bp, Homo sapiens
ggccttgccccaggccctg

SEQ ID NO: 652975 - DNA, 17 bp, Homo sapiens
ggcctttgttctggggg

SEQ ID NO: 652976 - DNA, 15 bp, Homo sapiens
ggcgagaggtgagct

SEQ ID NO: 652977 - DNA, 14 bp, Homo sapiens
ggcgcaggtgggct

SEQ ID NO: 652978 - DNA, 14 bp, Homo sapiens
ggtacaacggaggc

SEQ ID NO: 652979 - DNA, 14 bp, Homo sapiens
ggtacaactgtatt

SEQ ID NO: 652980 - DNA, 18 bp, Homo sapiens
ggtacaactgtatttatt

SEQ ID NO: 652981 - DNA, 16 bp, Homo sapiens
ggtacttttaaaaaca

SEQ ID NO: 652982 - DNA, 20 bp, Homo sapiens
ggtatatactttgccactgc

SEQ ID NO: 652983 - DNA, 14 bp, Homo sapiens
ggtatttaaagtat

SEQ ID NO: 652984 - DNA, 13 bp, Homo sapiens
ggtcaagatcagc

SEQ ID NO: 652985 - DNA, 23 bp, Homo sapiens
ggtcaaggcagtagaactccagg

SEQ ID NO: 652986 - DNA, 17 bp, Homo sapiens
ggtcactcttttgatgg

SEQ ID NO: 652987 - DNA, 17 bp, Homo sapiens
ggtcaggagatcgagac

SEQ ID NO: 652988 - DNA, 12 bp, Homo sapiens
ggtcagtgcctt

SEQ ID NO: 652989 - DNA, 13 bp, Homo sapiens
ggtcagtgccttt

SEQ ID NO: 652990 - DNA, 12 bp, Homo sapiens
ggtcataaagca

SEQ ID NO: 652991 - DNA, 23 bp, Homo sapiens
ggtcatatacatattgtatatat

SEQ ID NO: 652992 - DNA, 14 bp, Homo sapiens
ggtcatgtttgcag

SEQ ID NO: 652993 - DNA, 16 bp, Homo sapiens
ggtccaggagagcctg

SEQ ID NO: 652994 - DNA, 20 bp, Homo sapiens
ggtcccggtgtatcctggcc

SEQ ID NO: 652995 - DNA, 22 bp, Homo sapiens
ggtcctgctgaaactgcccact

SEQ ID NO: 652996 - DNA, 12 bp, Homo sapiens
ggtcctggaaca

SEQ ID NO: 652997 - DNA, 14 bp, Homo sapiens
ggtctagaagaaca

SEQ ID NO: 652998 - DNA, 23 bp, Homo sapiens
ggtctcacccatgcaagcagagg

SEQ ID NO: 652999 - DNA, 16 bp, Homo sapiens
ggtctcccctcctgca

SEQ ID NO: 653000 - DNA, 14 bp, Homo sapiens
ggtctccttccttc

SEQ ID NO: 653001 - DNA, 20 bp, Homo sapiens
ggtctcttcttggggcccag

SEQ ID NO: 653002 - DNA, 21 bp, Homo sapiens
ggtctcttcttggggcccagt

SEQ ID NO: 653003 - DNA, 18 bp, Homo sapiens
ggtctgccttctgctgaa

SEQ ID NO: 653004 - DNA, 16 bp, Homo sapiens
ggtctggggacaggcc

SEQ ID NO: 653005 - DNA, 21 bp, Homo sapiens
ggtcttctactgccttgaaaa

SEQ ID NO: 653006 - DNA, 23 bp, Homo sapiens
ggtcttgagccagtaatctttat

SEQ ID NO: 653007 - DNA, 23 bp, Homo sapiens
ggtcttgtggttgtgtgtgttct

SEQ ID NO: 653008 - DNA, 20 bp, Homo sapiens
ggtgacagtcatcatcaggg

SEQ ID NO: 653009 - DNA, 14 bp, Homo sapiens
ggtgctatgaagcc

SEQ ID NO: 653010 - DNA, 22 bp, Homo sapiens
ggtggatcacgaggtcaggaga

SEQ ID NO: 653011 - DNA, 15 bp, Homo sapiens
ggtgggattttgcaa

SEQ ID NO: 653012 - DNA, 14 bp, Homo sapiens
ggtgggctggactt

SEQ ID NO: 653013 - DNA, 19 bp, Homo sapiens
ggtggtttacgcctataat

SEQ ID NO: 653014 - DNA, 20 bp, Homo sapiens
ggtgtccccgctgctgtgca

SEQ ID NO: 653015 - DNA, 16 bp, Homo sapiens
ggtgtgaacccgggag

SEQ ID NO: 653016 - DNA, 18 bp, Homo sapiens
ggtgtgaacctacctgcc

SEQ ID NO: 653017 - DNA, 22 bp, Homo sapiens
ggtgtgttcaagaccagcctgg

SEQ ID NO: 653018 - DNA, 21 bp, Homo sapiens
ggtgtgttcgttgcacagctg

SEQ ID NO: 653019 - DNA, 21 bp, Homo sapiens
ggtgtttattataaagcttaa

SEQ ID NO: 653020 - DNA, 21 bp, Homo sapiens
ggttaaaactgtacatttaaa

SEQ ID NO: 653021 - DNA, 22 bp, Homo sapiens
ggttaccactcttttgctgtgc

SEQ ID NO: 653022 - DNA, 15 bp, Homo sapiens
ggttcagacacagct

SEQ ID NO: 653023 - DNA, 16 bp, Homo sapiens
ggttcagacacagctc

SEQ ID NO: 653024 - DNA, 17 bp, Homo sapiens
ggttcagacacagctct

SEQ ID NO: 653025 - DNA, 14 bp, Homo sapiens
ggttccctgctgcg

SEQ ID NO: 653026 - DNA, 17 bp, Homo sapiens
ggttcgatacctggagc

SEQ ID NO: 653027 - DNA, 19 bp, Homo sapiens
ggttctaggctaccagaag

SEQ ID NO: 653028 - DNA, 14 bp, Homo sapiens
ggttcttaaatgtt

SEQ ID NO: 653029 - DNA, 12 bp, Homo sapiens
ggttcttgaaaa

SEQ ID NO: 653030 - DNA, 18 bp, Homo sapiens
ggttgcgtctgaggcctg

SEQ ID NO: 653031 - DNA, 15 bp, Homo sapiens
ggttggggtgacagt

SEQ ID NO: 653032 - DNA, 19 bp, Homo sapiens
ggttgtaattaaattctga

SEQ ID NO: 653033 - DNA, 13 bp, Homo sapiens
ggttgtgtgtgtt

SEQ ID NO: 653034 - DNA, 15 bp, Homo sapiens
ggttgttgcatatag

SEQ ID NO: 653035 - DNA, 16 bp, Homo sapiens
ggtttaattcagcaga

SEQ ID NO: 653036 - DNA, 18 bp, Homo sapiens
ggtttcaagaaaatcttt

SEQ ID NO: 653037 - DNA, 18 bp, Homo sapiens
ggtttctctctacagtgc

SEQ ID NO: 653038 - DNA, 20 bp, Homo sapiens
ggtttctctctacagtgcca

SEQ ID NO: 653039 - DNA, 13 bp, Homo sapiens
ggttttaaacttt

SEQ ID NO: 653040 - DNA, 22 bp, Homo sapiens
gtaaaaaatgtctcatgtcaat

SEQ ID NO: 653041 - DNA, 14 bp, Homo sapiens
gtaaaacttctgct

SEQ ID NO: 653042 - DNA, 19 bp, Homo sapiens
gtaaaagcagggcagcagg

SEQ ID NO: 653043 - DNA, 23 bp, Homo sapiens
gtaaaatccccttcgctgaaatt

SEQ ID NO: 653044 - DNA, 16 bp, Homo sapiens
gtaaaatgaattgaaa

SEQ ID NO: 653045 - DNA, 19 bp, Homo sapiens
gtaaaattgctgtgcttta

SEQ ID NO: 653046 - DNA, 20 bp, Homo sapiens
gtaaacataaaaactgattt

SEQ ID NO: 653047 - DNA, 20 bp, Homo sapiens
gtaaagctatttatgggccc

SEQ ID NO: 653048 - DNA, 17 bp, Homo sapiens
gtaaagttatgtattta

SEQ ID NO: 653049 - DNA, 19 bp, Homo sapiens
gtaaagttatgtatttaaa

SEQ ID NO: 653050 - DNA, 15 bp, Homo sapiens
gtaaataatttattt

SEQ ID NO: 653051 - DNA, 23 bp, Homo sapiens
gtaaatagtgtcatataaactca

SEQ ID NO: 653052 - DNA, 11 bp, Homo sapiens
gtaaatatatc

SEQ ID NO: 653053 - DNA, 12 bp, Homo sapiens
gtaaatgcatat

SEQ ID NO: 653054 - DNA, 11 bp, Homo sapiens
gtaaatgtttc

SEQ ID NO: 653055 - DNA, 20 bp, Homo sapiens
gtaacactagggccttggaa

SEQ ID NO: 653056 - DNA, 16 bp, Homo sapiens
gtaacactggccagcg

SEQ ID NO: 653057 - DNA, 15 bp, Homo sapiens
gtaacatcagggacc

SEQ ID NO: 653058 - DNA, 22 bp, Homo sapiens
gtaactaaaataattttgtaat

SEQ ID NO: 653059 - DNA, 15 bp, Homo sapiens
gtaactgctgaaaac

SEQ ID NO: 653060 - DNA, 16 bp, Homo sapiens
gtaagaaatacagact

SEQ ID NO: 653061 - DNA, 16 bp, Homo sapiens
gtaagtatgtttttta

SEQ ID NO: 653062 - DNA, 14 bp, Homo sapiens
gtaagtgtaaaaaa

SEQ ID NO: 653063 - DNA, 14 bp, Homo sapiens
gtaataggaaaatg

SEQ ID NO: 653064 - DNA, 17 bp, Homo sapiens
gtaatcccctaaaataa

SEQ ID NO: 653065 - DNA, 22 bp, Homo sapiens
gtaatctacaccaatgaaaaca

SEQ ID NO: 653066 - DNA, 14 bp, Homo sapiens
gtaatctttatact

SEQ ID NO: 653067 - DNA, 16 bp, Homo sapiens
gtaatctttatactgg

SEQ ID NO: 653068 - DNA, 23 bp, Homo sapiens
gtaatgtaaataaactatttata

SEQ ID NO: 653069 - DNA, 23 bp, Homo sapiens
gtaatttaatttgtaaaacttct

SEQ ID NO: 653070 - DNA, 17 bp, Homo sapiens
gtacaaatgaagaaagt

SEQ ID NO: 653071 - DNA, 14 bp, Homo sapiens
gtacaacggaggcc

SEQ ID NO: 653072 - DNA, 23 bp, Homo sapiens
gtacaacggaggcctgcgaccct

SEQ ID NO: 653073 - DNA, 17 bp, Homo sapiens
gtacaactgtatttatt

SEQ ID NO: 653074 - DNA, 18 bp, Homo sapiens
gtacaatcttagtgaatg

SEQ ID NO: 653075 - DNA, 18 bp, Homo sapiens
gtacataactcctgtccc

SEQ ID NO: 653076 - DNA, 18 bp, Homo sapiens
gtacatctgcaatatgaa

SEQ ID NO: 653077 - DNA, 23 bp, Homo sapiens
gtacatggaattttttgaatatg

SEQ ID NO: 653078 - DNA, 15 bp, Homo sapiens
gtacattatgaagaa

SEQ ID NO: 653079 - DNA, 14 bp, Homo sapiens
gtacatttaaaatt

SEQ ID NO: 653080 - DNA, 20 bp, Homo sapiens
gtaccatggtttgatatgta

SEQ ID NO: 653081 - DNA, 23 bp, Homo sapiens
gtaccatttaatggggaggacaa

SEQ ID NO: 653082 - DNA, 17 bp, Homo sapiens
gtacccatctagtactt

SEQ ID NO: 653083 - DNA, 13 bp, Homo sapiens
gtacctcctctca

SEQ ID NO: 653084 - DNA, 12 bp, Homo sapiens
gtacctctcaag

SEQ ID NO: 653085 - DNA, 17 bp, Homo sapiens
gtacctggtccccactg

SEQ ID NO: 653086 - DNA, 13 bp, Homo sapiens
gtaccttgcttct

SEQ ID NO: 653087 - DNA, 11 bp, Homo sapiens
gtactctttaa

SEQ ID NO: 653088 - DNA, 14 bp, Homo sapiens
gtactgaaagcctt

SEQ ID NO: 653089 - DNA, 18 bp, Homo sapiens
gtactgaggtgctatgaa

SEQ ID NO: 653090 - DNA, 23 bp, Homo sapiens
gtacttgaagtctaaaagcagaa

SEQ ID NO: 653091 - DNA, 21 bp, Homo sapiens
gtactttctgttatgggcttt

SEQ ID NO: 653092 - DNA, 15 bp, Homo sapiens
gtagaaacttaaaca

SEQ ID NO: 653093 - DNA, 17 bp, Homo sapiens
gtagactgtgccagagg

SEQ ID NO: 653094 - DNA, 15 bp, Homo sapiens
gtagaggcttgttta

SEQ ID NO: 653095 - DNA, 17 bp, Homo sapiens
gtagcaggttctaggct

SEQ ID NO: 653096 - DNA, 18 bp, Homo sapiens
gtagccaggtatggctct

SEQ ID NO: 653097 - DNA, 15 bp, Homo sapiens
gtagccctcccactt

SEQ ID NO: 653098 - DNA, 17 bp, Homo sapiens
gtagccctcccactttg

SEQ ID NO: 653099 - DNA, 12 bp, Homo sapiens
gtagctacattt

SEQ ID NO: 653100 - DNA, 13 bp, Homo sapiens
gtagctcaagttt

SEQ ID NO: 653101 - DNA, 20 bp, Homo sapiens
gaaaaatgggagacagcctc

SEQ ID NO: 653102 - DNA, 16 bp, Homo sapiens
gaaaacagatgaccat

SEQ ID NO: 653103 - DNA, 22 bp, Homo sapiens
gaaaacagatgaccataatttt

SEQ ID NO: 653104 - DNA, 16 bp, Homo sapiens
gaaaacatgtactaca

SEQ ID NO: 653105 - DNA, 20 bp, Homo sapiens
gaaaacgtggcacacactga

SEQ ID NO: 653106 - DNA, 15 bp, Homo sapiens
gaaaactgtgatttc

SEQ ID NO: 653107 - DNA, 23 bp, Homo sapiens
gaaaagtggcgtgggagccagcc

SEQ ID NO: 653108 - DNA, 18 bp, Homo sapiens
gaaaataaacagacaaaa

SEQ ID NO: 653109 - DNA, 14 bp, Homo sapiens
gaaaatatatgcct

SEQ ID NO: 653110 - DNA, 17 bp, Homo sapiens
gaaaatcactttgtcta

SEQ ID NO: 653111 - DNA, 22 bp, Homo sapiens
gaaaattacagtccaaaatact

SEQ ID NO: 653112 - DNA, 15 bp, Homo sapiens
gaaaattgatatttt

SEQ ID NO: 653113 - DNA, 21 bp, Homo sapiens
gaaaattggcagtggcagaga

SEQ ID NO: 653114 - DNA, 17 bp, Homo sapiens
gaaacagttgctgtgaa

SEQ ID NO: 653115 - DNA, 20 bp, Homo sapiens
gaaacattttatcattaaaa

SEQ ID NO: 653116 - DNA, 18 bp, Homo sapiens
gaaaccaattaagcagct

SEQ ID NO: 653117 - DNA, 19 bp, Homo sapiens
gaaaccacagtcttcccag

SEQ ID NO: 653118 - DNA, 15 bp, Homo sapiens
gaaaccttgctctcc

SEQ ID NO: 653119 - DNA, 13 bp, Homo sapiens
gaaacgctacctc

SEQ ID NO: 653120 - DNA, 12 bp, Homo sapiens
gaaactaacaga

SEQ ID NO: 653121 - DNA, 15 bp, Homo sapiens
gaaactaacagataa

SEQ ID NO: 653122 - DNA, 21 bp, Homo sapiens
gaaactcacactcccctaggg

SEQ ID NO: 653123 - DNA, 14 bp, Homo sapiens
gaaactgctgcaga

SEQ ID NO: 653124 - DNA, 20 bp, Homo sapiens
gaaagaacgctgatttaaag

SEQ ID NO: 653125 - DNA, 15 bp, Homo sapiens
gaaagacttctcaaa

SEQ ID NO: 653126 - DNA, 15 bp, Homo sapiens
gaaagatgtgttttt

SEQ ID NO: 653127 - DNA, 22 bp, Homo sapiens
gaaagcagagcctcctgggaac

SEQ ID NO: 653128 - DNA, 17 bp, Homo sapiens
gaaagcatatcccacca

SEQ ID NO: 653129 - DNA, 15 bp, Homo sapiens
gaaagcctaaaattg

SEQ ID NO: 653130 - DNA, 16 bp, Homo sapiens
gaaagccttagggaag

SEQ ID NO: 653131 - DNA, 20 bp, Homo sapiens
gaaagcttcaaagtttatat

SEQ ID NO: 653132 - DNA, 22 bp, Homo sapiens
gaaagctttattttgagatgta

SEQ ID NO: 653133 - DNA, 15 bp, Homo sapiens
gaaagcttttaaaat

SEQ ID NO: 653134 - DNA, 14 bp, Homo sapiens
gaaaggggttgggg

SEQ ID NO: 653135 - DNA, 13 bp, Homo sapiens
gaaaggttttgga

SEQ ID NO: 653136 - DNA, 18 bp, Homo sapiens
gaaagtcaaaaaattatt

SEQ ID NO: 653137 - DNA, 16 bp, Homo sapiens
gacaagacagagggga

SEQ ID NO: 653138 - DNA, 18 bp, Homo sapiens
gacaagagatctacacat

SEQ ID NO: 653139 - DNA, 15 bp, Homo sapiens
gacaatactggggtt

SEQ ID NO: 653140 - DNA, 19 bp, Homo sapiens
gacaatatgtgagtgcctt

SEQ ID NO: 653141 - DNA, 17 bp, Homo sapiens
gacaatcaactctaata

SEQ ID NO: 653142 - DNA, 17 bp, Homo sapiens
gacacaacccaatagga

SEQ ID NO: 653143 - DNA, 17 bp, Homo sapiens
gacacacggggctcggg

SEQ ID NO: 653144 - DNA, 12 bp, Homo sapiens
gacacagctctt

SEQ ID NO: 653145 - DNA, 16 bp, Homo sapiens
gacactgcagcagaaa

SEQ ID NO: 653146 - DNA, 14 bp, Homo sapiens
gacagactatttgc

SEQ ID NO: 653147 - DNA, 18 bp, Homo sapiens
gacagctacacagagctt

SEQ ID NO: 653148 - DNA, 19 bp, Homo sapiens
gacagggccagtggggcct

SEQ ID NO: 653149 - DNA, 21 bp, Homo sapiens
gacagggccagtggggcctgt

SEQ ID NO: 653150 - DNA, 17 bp, Homo sapiens
gacagggctcatttttg

SEQ ID NO: 653151 - DNA, 19 bp, Homo sapiens
gacagtcatcatcagggcc

SEQ ID NO: 653152 - DNA, 21 bp, Homo sapiens
gacagtcatcatcagggcctg

SEQ ID NO: 653153 - DNA, 23 bp, Homo sapiens
gacagtcatcatcagggcctggg

SEQ ID NO: 653154 - DNA, 14 bp, Homo sapiens
gacagtttccaaat

SEQ ID NO: 653155 - DNA, 14 bp, Homo sapiens
gacagtttttctgt

SEQ ID NO: 653156 - DNA, 11 bp, Homo sapiens
gacataatttc

SEQ ID NO: 653157 - DNA, 18 bp, Homo sapiens
gacataggtcataaagca

SEQ ID NO: 653158 - DNA, 20 bp, Homo sapiens
gacataggtcataaagcatt

SEQ ID NO: 653159 - DNA, 16 bp, Homo sapiens
gacatcacagggtggg

SEQ ID NO: 653160 - DNA, 19 bp, Homo sapiens
gacatgcaataaaatttaa

SEQ ID NO: 653161 - DNA, 21 bp, Homo sapiens
gacattaaatgcaataatttt

SEQ ID NO: 653162 - DNA, 12 bp, Homo sapiens
gaccaatatata

SEQ ID NO: 653163 - DNA, 21 bp, Homo sapiens
gaccacccctctcgcctcatt

SEQ ID NO: 653164 - DNA, 22 bp, Homo sapiens
gaccacccctctcgcctcatta

SEQ ID NO: 653165 - DNA, 19 bp, Homo sapiens
gaccattttttaatttact

SEQ ID NO: 653166 - DNA, 20 bp, Homo sapiens
gaccattttttaatttactt

SEQ ID NO: 653167 - DNA, 13 bp, Homo sapiens
gacccagggggag

SEQ ID NO: 653168 - DNA, 17 bp, Homo sapiens
gacccagtcccacactg

SEQ ID NO: 653169 - DNA, 15 bp, Homo sapiens
gacccccgtggggca

SEQ ID NO: 653170 - DNA, 13 bp, Homo sapiens
gaccctcttgccc

SEQ ID NO: 653171 - DNA, 19 bp, Homo sapiens
gaccctcttgcccatcctg

SEQ ID NO: 653172 - DNA, 18 bp, Homo sapiens
gaccctgcaaacagaaca

SEQ ID NO: 653173 - DNA, 17 bp, Homo sapiens
gaccctgggcagggact

SEQ ID NO: 653174 - DNA, 18 bp, Homo sapiens
gaccctgggggcacagga

SEQ ID NO: 653175 - DNA, 15 bp, Homo sapiens
gaccctgtcctgcag

SEQ ID NO: 653176 - DNA, 16 bp, Homo sapiens
gaccctgtcctgcagt

SEQ ID NO: 653177 - DNA, 15 bp, Homo sapiens
gaccggtgcttttat

SEQ ID NO: 653178 - DNA, 15 bp, Homo sapiens
gacctctgacaactg

SEQ ID NO: 653179 - DNA, 16 bp, Homo sapiens
gacctggctccactct

SEQ ID NO: 653180 - DNA, 14 bp, Homo sapiens
gacgacctttacct

SEQ ID NO: 653181 - DNA, 15 bp, Homo sapiens
gacgccgtcccacca

SEQ ID NO: 653182 - DNA, 13 bp, Homo sapiens
gacgggaggggag

SEQ ID NO: 653183 - DNA, 10 bp, Homo sapiens
gactaaagag

SEQ ID NO: 653184 - DNA, 16 bp, Homo sapiens
gactacacaatacagt

SEQ ID NO: 653185 - DNA, 17 bp, Homo sapiens
gactacacaatacagta

SEQ ID NO: 653186 - DNA, 18 bp, Homo sapiens
gactatatatataaatgt

SEQ ID NO: 653187 - DNA, 19 bp, Homo sapiens
gactatatatataaatgta

SEQ ID NO: 653188 - DNA, 20 bp, Homo sapiens
gactatatatataaatgtat

SEQ ID NO: 653189 - DNA, 13 bp, Homo sapiens
gactattacatat

SEQ ID NO: 653190 - DNA, 13 bp, Homo sapiens
gactatttctttt

SEQ ID NO: 653191 - DNA, 19 bp, Homo sapiens
gactatttgctaatgtata

SEQ ID NO: 653192 - DNA, 17 bp, Homo sapiens
gactccatctctcatcc

SEQ ID NO: 653193 - DNA, 15 bp, Homo sapiens
gactccatctcttct

SEQ ID NO: 653194 - DNA, 16 bp, Homo sapiens
gactccatctcttctg

SEQ ID NO: 653195 - DNA, 14 bp, Homo sapiens
gactccctgggagc

SEQ ID NO: 653196 - DNA, 17 bp, Homo sapiens
gactccgaggtggttca

SEQ ID NO: 653197 - DNA, 20 bp, Homo sapiens
gactccgaggtggttcagac

SEQ ID NO: 653198 - DNA, 21 bp, Homo sapiens
gactcctggcagggccacctg

SEQ ID NO: 653199 - DNA, 15 bp, Homo sapiens
gactctaaagtctgt

SEQ ID NO: 653200 - DNA, 18 bp, Homo sapiens
gactcttcgatgtgccca

SEQ ID NO: 653201 - DNA, 19 bp, Homo sapiens
gactcttgggccgtcccca

SEQ ID NO: 653202 - DNA, 17 bp, Homo sapiens
gactgaaattactttaa

SEQ ID NO: 653203 - DNA, 21 bp, Homo sapiens
gactgacccccatctgagctg

SEQ ID NO: 653204 - DNA, 23 bp, Homo sapiens
gactgacccccatctgagctggg

SEQ ID NO: 653205 - DNA, 14 bp, Homo sapiens
gactgcattgccgc

SEQ ID NO: 653206 - DNA, 15 bp, Homo sapiens
gactgcattgccgct

SEQ ID NO: 653207 - DNA, 15 bp, Homo sapiens
gactgcttggggtgg

SEQ ID NO: 653208 - DNA, 15 bp, Homo sapiens
gactggactgcttgg

SEQ ID NO: 653209 - DNA, 16 bp, Homo sapiens
gactggaggaggcctg

SEQ ID NO: 653210 - DNA, 20 bp, Homo sapiens
gactgtagatatgtattctt

SEQ ID NO: 653211 - DNA, 17 bp, Homo sapiens
gactgtcacttgctgct

SEQ ID NO: 653212 - DNA, 14 bp, Homo sapiens
gactgtgccagagg

SEQ ID NO: 653213 - DNA, 18 bp, Homo sapiens
gactgttgaaaggagaat

SEQ ID NO: 653214 - DNA, 21 bp, Homo sapiens
gacttactttaattactggaa

SEQ ID NO: 653215 - DNA, 20 bp, Homo sapiens
gacttagcgtcaagacattt

SEQ ID NO: 653216 - DNA, 21 bp, Homo sapiens
gacttagcgtcaagacatttg

SEQ ID NO: 653217 - DNA, 15 bp, Homo sapiens
gacttctacctgccc

SEQ ID NO: 653218 - DNA, 16 bp, Homo sapiens
gacttctcaaagagaa

SEQ ID NO: 653219 - DNA, 17 bp, Homo sapiens
gacttctcaaagagaat

SEQ ID NO: 653220 - DNA, 13 bp, Homo sapiens
gactttcctccca

SEQ ID NO: 653221 - DNA, 13 bp, Homo sapiens
gacttttgaaaaa

SEQ ID NO: 653222 - DNA, 17 bp, Homo sapiens
gacttttggtagagaag

SEQ ID NO: 653223 - DNA, 15 bp, Homo sapiens
gagaaactgctgcag

SEQ ID NO: 653224 - DNA, 18 bp, Homo sapiens
gagaaactgctgcagatt

SEQ ID NO: 653225 - DNA, 19 bp, Homo sapiens
gagaaccaaccagggaagc

SEQ ID NO: 653226 - DNA, 17 bp, Homo sapiens
gagaacctcagattctt

SEQ ID NO: 653227 - DNA, 14 bp, Homo sapiens
gagaagcacttgag

SEQ ID NO: 653228 - DNA, 15 bp, Homo sapiens
gagaagttgtgaaag

SEQ ID NO: 653229 - DNA, 16 bp, Homo sapiens
gatatcttcagaaaac

SEQ ID NO: 653230 - DNA, 12 bp, Homo sapiens
gatatggcagga

SEQ ID NO: 653231 - DNA, 20 bp, Homo sapiens
gatatggcaggactcctggc

SEQ ID NO: 653232 - DNA, 15 bp, Homo sapiens
gatatgtctgctgag

SEQ ID NO: 653233 - DNA, 16 bp, Homo sapiens
gatattatattaaaca

SEQ ID NO: 653234 - DNA, 17 bp, Homo sapiens
gatattgtgaagtacat

SEQ ID NO: 653235 - DNA, 16 bp, Homo sapiens
gatcagaggagtaaat

SEQ ID NO: 653236 - DNA, 11 bp, Homo sapiens
gatcagtgttg

SEQ ID NO: 653237 - DNA, 15 bp, Homo sapiens
gatcatccctttggt

SEQ ID NO: 653238 - DNA, 14 bp, Homo sapiens
gatcatcgccagag

SEQ ID NO: 653239 - DNA, 23 bp, Homo sapiens
gatcatcgccagaggtgcttcac

SEQ ID NO: 653240 - DNA, 16 bp, Homo sapiens
gatcatgctgcagtgg

SEQ ID NO: 653241 - DNA, 15 bp, Homo sapiens
gatcatttaaaaagc

SEQ ID NO: 653242 - DNA, 14 bp, Homo sapiens
gatccactcccagg

SEQ ID NO: 653243 - DNA, 16 bp, Homo sapiens
gatccccttgatagat

SEQ ID NO: 653244 - DNA, 21 bp, Homo sapiens
gatccttgtgttcagctcttt

SEQ ID NO: 653245 - DNA, 17 bp, Homo sapiens
gatcgagaccatcctgg

SEQ ID NO: 653246 - DNA, 19 bp, Homo sapiens
gatcgagaccatcctggct

SEQ ID NO: 653247 - DNA, 22 bp, Homo sapiens
gatcgtgctactgcactccagc

SEQ ID NO: 653248 - DNA, 13 bp, Homo sapiens
gatctaaacagtt

SEQ ID NO: 653249 - DNA, 15 bp, Homo sapiens
gatctacacatgttg

SEQ ID NO: 653250 - DNA, 21 bp, Homo sapiens
gatctacacatgttgccttgc

SEQ ID NO: 653251 - DNA, 16 bp, Homo sapiens
gcagcggcgtgaggcc

SEQ ID NO: 653252 - DNA, 17 bp, Homo sapiens
gcagctgcctctgctcc

SEQ ID NO: 653253 - DNA, 23 bp, Homo sapiens
gcagctgctatccccatctccct

SEQ ID NO: 653254 - DNA, 22 bp, Homo sapiens
gcagctgtcccttgcttgcctg

SEQ ID NO: 653255 - DNA, 15 bp, Homo sapiens
gcaggactcctggca

SEQ ID NO: 653256 - DNA, 17 bp, Homo sapiens
gcaggactcctggcagg

SEQ ID NO: 653257 - DNA, 15 bp, Homo sapiens
gcaggagtggtgcag

SEQ ID NO: 653258 - DNA, 23 bp, Homo sapiens
gcaggcagcgcagggctggcacg

SEQ ID NO: 653259 - DNA, 16 bp, Homo sapiens
gcaggcaggcggctcc

SEQ ID NO: 653260 - DNA, 12 bp, Homo sapiens
gcaggctgggcc

SEQ ID NO: 653261 - DNA, 15 bp, Homo sapiens
gcaggctgggccatg

SEQ ID NO: 653262 - DNA, 18 bp, Homo sapiens
gcagggaagccccacatg

SEQ ID NO: 653263 - DNA, 23 bp, Homo sapiens
gcagggaagccccacatgtccag

SEQ ID NO: 653264 - DNA, 20 bp, Homo sapiens
gcagggccacctgcaggacc

SEQ ID NO: 653265 - DNA, 13 bp, Homo sapiens
gcagggccatggc

SEQ ID NO: 653266 - DNA, 12 bp, Homo sapiens
gcaggtgggcag

SEQ ID NO: 653267 - DNA, 21 bp, Homo sapiens
gcaggtgggcagacagtgacc

SEQ ID NO: 653268 - DNA, 16 bp, Homo sapiens
gcaggtgtcctgagca

SEQ ID NO: 653269 - DNA, 13 bp, Homo sapiens
gcagtcccacact

SEQ ID NO: 653270 - DNA, 15 bp, Homo sapiens
gcagtcccacactgt

SEQ ID NO: 653271 - DNA, 15 bp, Homo sapiens
gcagtcgcctgcctg

SEQ ID NO: 653272 - DNA, 19 bp, Homo sapiens
gcagtcgcctgcctgcagc

SEQ ID NO: 653273 - DNA, 22 bp, Homo sapiens
gcagtctaaacagagtccggga

SEQ ID NO: 653274 - DNA, 12 bp, Homo sapiens
gcagtcttgctc

SEQ ID NO: 653275 - DNA, 12 bp, Homo sapiens
gcagtctttctt

SEQ ID NO: 653276 - DNA, 19 bp, Homo sapiens
gcagtctttcttgaaattg

SEQ ID NO: 653277 - DNA, 17 bp, Homo sapiens
gcagttagctgaagaat

SEQ ID NO: 653278 - DNA, 19 bp, Homo sapiens
gcataataagccatggctg

SEQ ID NO: 653279 - DNA, 14 bp, Homo sapiens
gcataataagctaa

SEQ ID NO: 653280 - DNA, 18 bp, Homo sapiens
gcataataagctaaagag

SEQ ID NO: 653281 - DNA, 17 bp, Homo sapiens
gcataatgataaaataa

SEQ ID NO: 653282 - DNA, 19 bp, Homo sapiens
gcatataggtgatgtttgc

SEQ ID NO: 653283 - DNA, 15 bp, Homo sapiens
gcatatcctgagcca

SEQ ID NO: 653284 - DNA, 19 bp, Homo sapiens
gcatattgttggcacagaa

SEQ ID NO: 653285 - DNA, 20 bp, Homo sapiens
gcatattttgagaaactgct

SEQ ID NO: 653286 - DNA, 21 bp, Homo sapiens
gcatattttgagaaactgctg

SEQ ID NO: 653287 - DNA, 19 bp, Homo sapiens
gcatctcctcccgcccttc

SEQ ID NO: 653288 - DNA, 15 bp, Homo sapiens
gcatgaatgttttta

SEQ ID NO: 653289 - DNA, 18 bp, Homo sapiens
gcatgaattggaactgca

SEQ ID NO: 653290 - DNA, 16 bp, Homo sapiens
gcatggggattgcaga

SEQ ID NO: 653291 - DNA, 17 bp, Homo sapiens
gcatggggattgcagag

SEQ ID NO: 653292 - DNA, 13 bp, Homo sapiens
gcatggtggccag

SEQ ID NO: 653293 - DNA, 19 bp, Homo sapiens
gcatggtggtgtgtgccta

SEQ ID NO: 653294 - DNA, 15 bp, Homo sapiens
gcatgtaagtgttaa

SEQ ID NO: 653295 - DNA, 18 bp, Homo sapiens
gcatgtagaggcttgttt

SEQ ID NO: 653296 - DNA, 16 bp, Homo sapiens
gcatgtctgttcttct

SEQ ID NO: 653297 - DNA, 20 bp, Homo sapiens
gcatgttcacccttatagtc

SEQ ID NO: 653298 - DNA, 14 bp, Homo sapiens
gcattaatgtttct

SEQ ID NO: 653299 - DNA, 18 bp, Homo sapiens
gcattatataccctggtg

SEQ ID NO: 653300 - DNA, 18 bp, Homo sapiens
gcattccaggtaacaggt

SEQ ID NO: 653301 - DNA, 14 bp, Homo sapiens
gcattgacataggt

SEQ ID NO: 653302 - DNA, 18 bp, Homo sapiens
gcattgaggaagagtctt

SEQ ID NO: 653303 - DNA, 15 bp, Homo sapiens
gcattgataatcttc

SEQ ID NO: 653304 - DNA, 14 bp, Homo sapiens
gcatttctctttaa

SEQ ID NO: 653305 - DNA, 22 bp, Homo sapiens
gcatttgtttctttctctgagg

SEQ ID NO: 653306 - DNA, 13 bp, Homo sapiens
gcattttgaaaca

SEQ ID NO: 653307 - DNA, 15 bp, Homo sapiens
gcattttgaaacaaa

SEQ ID NO: 653308 - DNA, 18 bp, Homo sapiens
gcatttttgtgaaatgaa

SEQ ID NO: 653309 - DNA, 14 bp, Homo sapiens
gccaactcctcaca

SEQ ID NO: 653310 - DNA, 20 bp, Homo sapiens
gccaactgacaaagatgcat

SEQ ID NO: 653311 - DNA, 13 bp, Homo sapiens
gccaagaatgtac

SEQ ID NO: 653312 - DNA, 20 bp, Homo sapiens
gccaagggacgttgacctgg

SEQ ID NO: 653313 - DNA, 23 bp, Homo sapiens
gccaagtgcgtgccgtgtgagtg

SEQ ID NO: 653314 - DNA, 17 bp, Homo sapiens
gccacagtggggctgca

SEQ ID NO: 653315 - DNA, 16 bp, Homo sapiens
gccaccatccccaccc

SEQ ID NO: 653316 - DNA, 16 bp, Homo sapiens
gccactcaccgaagcc

SEQ ID NO: 653317 - DNA, 22 bp, Homo sapiens
gccactccccggcatgagactc

SEQ ID NO: 653318 - DNA, 12 bp, Homo sapiens
gccactcctccc

SEQ ID NO: 653319 - DNA, 16 bp, Homo sapiens
gccactcctccctccg

SEQ ID NO: 653320 - DNA, 16 bp, Homo sapiens
gccagcaccacagccg

SEQ ID NO: 653321 - DNA, 21 bp, Homo sapiens
gccagcccatggcccccaata

SEQ ID NO: 653322 - DNA, 15 bp, Homo sapiens
gccagcccctcttcc

SEQ ID NO: 653323 - DNA, 20 bp, Homo sapiens
gccagcccctcttccccaat

SEQ ID NO: 653324 - DNA, 17 bp, Homo sapiens
gccagccttgagccctg

SEQ ID NO: 653325 - DNA, 19 bp, Homo sapiens
gccagccttgagccctggc

SEQ ID NO: 653326 - DNA, 20 bp, Homo sapiens
gccagccttgagccctggct

SEQ ID NO: 653327 - DNA, 12 bp, Homo sapiens
gccagcgaactt

SEQ ID NO: 653328 - DNA, 16 bp, Homo sapiens
gccagcgaacttgaca

SEQ ID NO: 653329 - DNA, 15 bp, Homo sapiens
gccaggaacctgtcc

SEQ ID NO: 653330 - DNA, 22 bp, Homo sapiens
gccaggagcttcttcgttcctg

SEQ ID NO: 653331 - DNA, 17 bp, Homo sapiens
gccaggcagagaacaga

SEQ ID NO: 653332 - DNA, 15 bp, Homo sapiens
gccaggctgcctcct

SEQ ID NO: 653333 - DNA, 19 bp, Homo sapiens
gccaggctgcctcctgccc

SEQ ID NO: 653334 - DNA, 20 bp, Homo sapiens
gccaggctgcctcctgccct

SEQ ID NO: 653335 - DNA, 14 bp, Homo sapiens
gccaggctgcctgg

SEQ ID NO: 653336 - DNA, 20 bp, Homo sapiens
gccagggcaagagagcgaga

SEQ ID NO: 653337 - DNA, 17 bp, Homo sapiens
gccagggctgccctgag

SEQ ID NO: 653338 - DNA, 19 bp, Homo sapiens
gccagggctgccctgagaa

SEQ ID NO: 653339 - DNA, 22 bp, Homo sapiens
gccagggtctctccctcaggtg

SEQ ID NO: 653340 - DNA, 19 bp, Homo sapiens
gccagggtctgtgtgaatg

SEQ ID NO: 653341 - DNA, 18 bp, Homo sapiens
gccagtggggcctgtgga

SEQ ID NO: 653342 - DNA, 17 bp, Homo sapiens
gccataatgttgcttct

SEQ ID NO: 653343 - DNA, 15 bp, Homo sapiens
gccatacttgtgaaa

SEQ ID NO: 653344 - DNA, 15 bp, Homo sapiens
gccatcatcctcccg

SEQ ID NO: 653345 - DNA, 18 bp, Homo sapiens
gccatctaatgcttgttt

SEQ ID NO: 653346 - DNA, 19 bp, Homo sapiens
gccatctaatgcttgttta

SEQ ID NO: 653347 - DNA, 15 bp, Homo sapiens
gccatctagccagcc

SEQ ID NO: 653348 - DNA, 21 bp, Homo sapiens
gccatctgttcatttctaaat

SEQ ID NO: 653349 - DNA, 15 bp, Homo sapiens
gccatgccaggaacc

SEQ ID NO: 653350 - DNA, 18 bp, Homo sapiens
gccatgtccaaagaggct

SEQ ID NO: 653351 - DNA, 22 bp, Homo sapiens
gccatgtccaaagaggctgccc

SEQ ID NO: 653352 - DNA, 17 bp, Homo sapiens
gccatgtgaagagggag

SEQ ID NO: 653353 - DNA, 19 bp, Homo sapiens
gccattcatgtatgtcaga

SEQ ID NO: 653354 - DNA, 14 bp, Homo sapiens
gcccaactggggtt

SEQ ID NO: 653355 - DNA, 18 bp, Homo sapiens
gcccacccggtgggaccc

SEQ ID NO: 653356 - DNA, 17 bp, Homo sapiens
gcccaccctgctgctgg

SEQ ID NO: 653357 - DNA, 21 bp, Homo sapiens
gcccaccctgctgctggtgca

SEQ ID NO: 653358 - DNA, 20 bp, Homo sapiens
taatttgtgaaaatgtaatt

SEQ ID NO: 653359 - DNA, 14 bp, Homo sapiens
taattttaaagtgc

SEQ ID NO: 653360 - DNA, 23 bp, Homo sapiens
taattttatggtggaaaagaact

SEQ ID NO: 653361 - DNA, 17 bp, Homo sapiens
taattttcagctgcaag

SEQ ID NO: 653362 - DNA, 12 bp, Homo sapiens
taattttgcaaa

SEQ ID NO: 653363 - DNA, 13 bp, Homo sapiens
taattttgcaaat

SEQ ID NO: 653364 - DNA, 17 bp, Homo sapiens
taatttttatactgaca

SEQ ID NO: 653365 - DNA, 22 bp, Homo sapiens
taatttttgctccaatatccat

SEQ ID NO: 653366 - DNA, 16 bp, Homo sapiens
taatttttgctctaga

SEQ ID NO: 653367 - DNA, 14 bp, Homo sapiens
tacaaaattaagca

SEQ ID NO: 653368 - DNA, 15 bp, Homo sapiens
tacaaaattaagcaa

SEQ ID NO: 653369 - DNA, 16 bp, Homo sapiens
tacaaatgaagaaagt

SEQ ID NO: 653370 - DNA, 21 bp, Homo sapiens
tacaaatgaagaaagtcaaaa

SEQ ID NO: 653371 - DNA, 17 bp, Homo sapiens
tacaaccccctccaccc

SEQ ID NO: 653372 - DNA, 14 bp, Homo sapiens
tacaactgtattta

SEQ ID NO: 653373 - DNA, 20 bp, Homo sapiens
tacaagattgaaaatcttgt

SEQ ID NO: 653374 - DNA, 20 bp, Homo sapiens
tacaaggtataataaaatta

SEQ ID NO: 653375 - DNA, 16 bp, Homo sapiens
tacaagtttatatata

SEQ ID NO: 653376 - DNA, 23 bp, Homo sapiens
tacaataagcgttaagggcagag

SEQ ID NO: 653377 - DNA, 17 bp, Homo sapiens
tacaatctctttttgtt

SEQ ID NO: 653378 - DNA, 18 bp, Homo sapiens
tacaatcttagtgaatgg

SEQ ID NO: 653379 - DNA, 18 bp, Homo sapiens
tacaatggaataaattat

SEQ ID NO: 653380 - DNA, 11 bp, Homo sapiens
tacaatgtgaa

SEQ ID NO: 653381 - DNA, 15 bp, Homo sapiens
tacacaattgtttta

SEQ ID NO: 653382 - DNA, 19 bp, Homo sapiens
tacacagtgggaagatttt

SEQ ID NO: 653383 - DNA, 20 bp, Homo sapiens
tacacatatttgaagggtct

SEQ ID NO: 653384 - DNA, 15 bp, Homo sapiens
tacacatgttgcctt

SEQ ID NO: 653385 - DNA, 20 bp, Homo sapiens
tacacatgttgccttgcatt

SEQ ID NO: 653386 - DNA, 13 bp, Homo sapiens
tacacattagatt

SEQ ID NO: 653387 - DNA, 17 bp, Homo sapiens
tacacatttgctactgt

SEQ ID NO: 653388 - DNA, 21 bp, Homo sapiens
tacacatttgctactgttgta

SEQ ID NO: 653389 - DNA, 15 bp, Homo sapiens
tacaccctttccagg

SEQ ID NO: 653390 - DNA, 23 bp, Homo sapiens
tacacctaaaggtgtatttaaac

SEQ ID NO: 653391 - DNA, 14 bp, Homo sapiens
tacagactccatct

SEQ ID NO: 653392 - DNA, 17 bp, Homo sapiens
tacagactccatctctt

SEQ ID NO: 653393 - DNA, 20 bp, Homo sapiens
tacagactccatctcttctg

SEQ ID NO: 653394 - DNA, 20 bp, Homo sapiens
tacagccctaagtggctgcc

SEQ ID NO: 653395 - DNA, 22 bp, Homo sapiens
tacagccctaagtggctgcctt

SEQ ID NO: 653396 - DNA, 18 bp, Homo sapiens
tacagctatatttgatta

SEQ ID NO: 653397 - DNA, 23 bp, Homo sapiens
tacagctatatttgattatgtat

SEQ ID NO: 653398 - DNA, 21 bp, Homo sapiens
tacagctcattaaactttttt

SEQ ID NO: 653399 - DNA, 14 bp, Homo sapiens
tacagctcctttga

SEQ ID NO: 653400 - DNA, 18 bp, Homo sapiens
tacagtattatagacaaa

SEQ ID NO: 653401 - DNA, 22 bp, Homo sapiens
tacagtattatagacaaaagaa

SEQ ID NO: 653402 - DNA, 19 bp, Homo sapiens
tacagtccaaaatactgtt

SEQ ID NO: 653403 - DNA, 16 bp, Homo sapiens
tacagtgactccctgg

SEQ ID NO: 653404 - DNA, 16 bp, Homo sapiens
tacagtgtttggacag

SEQ ID NO: 653405 - DNA, 20 bp, Homo sapiens
tacataacggaaagttttta

SEQ ID NO: 653406 - DNA, 20 bp, Homo sapiens
tacataaggatgactttttt

SEQ ID NO: 653407 - DNA, 16 bp, Homo sapiens
tacatacgatttaagg

SEQ ID NO: 653408 - DNA, 13 bp, Homo sapiens
tacatagtgaaaa

SEQ ID NO: 653409 - DNA, 18 bp, Homo sapiens
tacatatatatatataac

SEQ ID NO: 653410 - DNA, 18 bp, Homo sapiens
tacatattaggaaaatat

SEQ ID NO: 653411 - DNA, 15 bp, Homo sapiens
tacatattgtatata

SEQ ID NO: 653412 - DNA, 18 bp, Homo sapiens
tacatccagcttctcatg

SEQ ID NO: 653413 - DNA, 13 bp, Homo sapiens
tacatctttcatt

SEQ ID NO: 653414 - DNA, 14 bp, Homo sapiens
tacatgcatttgag

SEQ ID NO: 653415 - DNA, 17 bp, Homo sapiens
tacatgccacatcaaac

SEQ ID NO: 653416 - DNA, 22 bp, Homo sapiens
tacatggaattttttgaatatg

SEQ ID NO: 653417 - DNA, 15 bp, Homo sapiens
tacatgtctagagaa

SEQ ID NO: 653418 - DNA, 16 bp, Homo sapiens
tacatgtgatacattt

SEQ ID NO: 653419 - DNA, 17 bp, Homo sapiens
tacatgtgatacatttt

SEQ ID NO: 653420 - DNA, 18 bp, Homo sapiens
tacatgtgatacattttt

SEQ ID NO: 653421 - DNA, 23 bp, Homo sapiens
tacattgtcttgatgttttttct

SEQ ID NO: 653422 - DNA, 20 bp, Homo sapiens
tacatttaaaacattaaaat

SEQ ID NO: 653423 - DNA, 17 bp, Homo sapiens
tacatttatttatccag

SEQ ID NO: 653424 - DNA, 15 bp, Homo sapiens
tacattttcagaagt

SEQ ID NO: 653425 - DNA, 15 bp, Homo sapiens
tacattttctaaata

SEQ ID NO: 653426 - DNA, 20 bp, Homo sapiens
tacattttctaaataaaaat

SEQ ID NO: 653427 - DNA, 21 bp, Homo sapiens
tacattttctaaataaaaata

SEQ ID NO: 653428 - DNA, 23 bp, Homo sapiens
tacattttctaaataaaaatatg

SEQ ID NO: 653429 - DNA, 15 bp, Homo sapiens
tacattttttaagct

SEQ ID NO: 653430 - DNA, 21 bp, Homo sapiens
taccaaggtacaactgtattt

SEQ ID NO: 653431 - DNA, 14 bp, Homo sapiens
taccaagtgaaatt

SEQ ID NO: 653432 - DNA, 20 bp, Homo sapiens
taccactttttttaaccatt

SEQ ID NO: 653433 - DNA, 19 bp, Homo sapiens
ttgtaagtgtaaaaaatgt

SEQ ID NO: 653434 - DNA, 20 bp, Homo sapiens
ttgtaagtgtaaaaaatgtc

SEQ ID NO: 653435 - DNA, 14 bp, Homo sapiens
ttgtaatatgtaaa

SEQ ID NO: 653436 - DNA, 23 bp, Homo sapiens
ttgtacttaaatggtaataagca

SEQ ID NO: 653437 - DNA, 15 bp, Homo sapiens
ttgtagcataactgt

SEQ ID NO: 653438 - DNA, 23 bp, Homo sapiens
ttgtagcatataggtgatgtttg

SEQ ID NO: 653439 - DNA, 22 bp, Homo sapiens
ttgtatagaaaattcttgagaa

SEQ ID NO: 653440 - DNA, 22 bp, Homo sapiens
ttgtatattacaacatttatgt

SEQ ID NO: 653441 - DNA, 13 bp, Homo sapiens
ttgtattgttttc

SEQ ID NO: 653442 - DNA, 15 bp, Homo sapiens
ttgtatttaaggatt

SEQ ID NO: 653443 - DNA, 18 bp, Homo sapiens
ttgtattttgattatttt

SEQ ID NO: 653444 - DNA, 14 bp, Homo sapiens
ttgtcactttttat

SEQ ID NO: 653445 - DNA, 21 bp, Homo sapiens
ttgtcactttttatgctattt

SEQ ID NO: 653446 - DNA, 20 bp, Homo sapiens
ttgtccaaaggaaagcttaa

SEQ ID NO: 653447 - DNA, 19 bp, Homo sapiens
ttgtccacaaatcttcagt

SEQ ID NO: 653448 - DNA, 12 bp, Homo sapiens
ttgtctatttat

SEQ ID NO: 653449 - DNA, 11 bp, Homo sapiens
ttgtctcagaa

SEQ ID NO: 653450 - DNA, 21 bp, Homo sapiens
ttgtcttatgtgaaaaattaa

SEQ ID NO: 653451 - DNA, 14 bp, Homo sapiens
ttgtcttattctta

SEQ ID NO: 653452 - DNA, 12 bp, Homo sapiens
ttgtgaacatga

SEQ ID NO: 653453 - DNA, 13 bp, Homo sapiens
ttgtgactgtcac

SEQ ID NO: 653454 - DNA, 21 bp, Homo sapiens
ttgtgcaaaagcttcaaatta

SEQ ID NO: 653455 - DNA, 15 bp, Homo sapiens
ttgtggcgtctccct

SEQ ID NO: 653456 - DNA, 14 bp, Homo sapiens
ttgtgtaagaaata

SEQ ID NO: 653457 - DNA, 21 bp, Homo sapiens
ttgtgttcagctctttccaaa

SEQ ID NO: 653458 - DNA, 21 bp, Homo sapiens
ttgttacataaggatgacttt

SEQ ID NO: 653459 - DNA, 19 bp, Homo sapiens
ttgttgtctccacttgtat

SEQ ID NO: 653460 - DNA, 15 bp, Homo sapiens
ttgttgttgccaaag

SEQ ID NO: 653461 - DNA, 14 bp, Homo sapiens
ttgttgttttccat

SEQ ID NO: 653462 - DNA, 15 bp, Homo sapiens
ttgtttaaaatgtaa

SEQ ID NO: 653463 - DNA, 9 bp, Homo sapiens
ttgtttata

SEQ ID NO: 653464 - DNA, 23 bp, Homo sapiens
ttgtttatttgcaatttgagcca

SEQ ID NO: 653465 - DNA, 13 bp, Homo sapiens
ttgtttgccagga

SEQ ID NO: 653466 - DNA, 13 bp, Homo sapiens
ttgttttaaaact

SEQ ID NO: 653467 - DNA, 17 bp, Homo sapiens
ttgttttggatggcttg

SEQ ID NO: 653468 - DNA, 12 bp, Homo sapiens
tttaaaaaataa

SEQ ID NO: 653469 - DNA, 13 bp, Homo sapiens
tttaaaaagaaat

SEQ ID NO: 653470 - DNA, 17 bp, Homo sapiens
tttaaaaagaaatctgg

SEQ ID NO: 653471 - DNA, 13 bp, Homo sapiens
tttaaaaagctca

SEQ ID NO: 653472 - DNA, 18 bp, Homo sapiens
tttaaaaagctcactgct

SEQ ID NO: 653473 - DNA, 21 bp, Homo sapiens
tttaaaaagctcactgctgat

SEQ ID NO: 653474 - DNA, 18 bp, Homo sapiens
tttaaaaggtagagtctt

SEQ ID NO: 653475 - DNA, 13 bp, Homo sapiens
tttaaaatatatg

SEQ ID NO: 653476 - DNA, 12 bp, Homo sapiens
tttaaaatgtaa

SEQ ID NO: 653477 - DNA, 18 bp, Homo sapiens
tttaaaatgtaatttaaa

SEQ ID NO: 653478 - DNA, 21 bp, Homo sapiens
tttaaaatgtaatttaaatga

SEQ ID NO: 653479 - DNA, 21 bp, Homo sapiens
tttaaaatgtagaaacttaaa

SEQ ID NO: 653480 - DNA, 23 bp, Homo sapiens
tttaaaattgctatgttactatt

SEQ ID NO: 653481 - DNA, 14 bp, Homo sapiens
tttaaagaagcttt

SEQ ID NO: 653482 - DNA, 17 bp, Homo sapiens
tttaaagaccctcctat

SEQ ID NO: 653483 - DNA, 22 bp, Homo sapiens
tttaaccaggggtcctaaccac

SEQ ID NO: 653484 - DNA, 18 bp, Homo sapiens
tttaaccattattatgca

SEQ ID NO: 653485 - DNA, 15 bp, Homo sapiens
tttaacggactgctt

SEQ ID NO: 653486 - DNA, 17 bp, Homo sapiens
tttaacttttttttctc

SEQ ID NO: 653487 - DNA, 22 bp, Homo sapiens
tttaagaaagtaatttaatttg

SEQ ID NO: 653488 - DNA, 12 bp, Homo sapiens
tttaagatgtga

SEQ ID NO: 653489 - DNA, 23 bp, Homo sapiens
tttaagtatacaggaggatgtga

SEQ ID NO: 653490 - DNA, 22 bp, Homo sapiens
tttaagtttcaaacttactatt

SEQ ID NO: 653491 - DNA, 14 bp, Homo sapiens
tttaagtttgaaga

SEQ ID NO: 653492 - DNA, 16 bp, Homo sapiens
tttaataaactgcaag

SEQ ID NO: 653493 - DNA, 13 bp, Homo sapiens
tttaataaagctt

SEQ ID NO: 653494 - DNA, 13 bp, Homo sapiens
tttaatatcttca

SEQ ID NO: 653495 - DNA, 15 bp, Homo sapiens
tttaatatcttcagc

SEQ ID NO: 653496 - DNA, 22 bp, Homo sapiens
tttaatattcttttgtttccat

SEQ ID NO: 653497 - DNA, 19 bp, Homo sapiens
tttaattaattaagtatct

SEQ ID NO: 653498 - DNA, 20 bp, Homo sapiens
tttaattacctggtgagtaa

SEQ ID NO: 653499 - DNA, 22 bp, Homo sapiens
tttaattactggaattcttctg

SEQ ID NO: 653500 - DNA, 19 bp, Homo sapiens
tttacagggatttctgttt

SEQ ID NO: 653501 - DNA, 20 bp, Homo sapiens
tttacataacggaaagtttt

SEQ ID NO: 653502 - DNA, 13 bp, Homo sapiens
tttaccatctgaa

SEQ ID NO: 653503 - DNA, 14 bp, Homo sapiens
tttaccatctgaaa

SEQ ID NO: 653504 - DNA, 23 bp, Homo sapiens
tttacctgttctgaaatgttctt

SEQ ID NO: 653505 - DNA, 19 bp, Homo sapiens
tttactaactaaataccat

SEQ ID NO: 653506 - DNA, 20 bp, Homo sapiens
tttactcctttttattcata

SEQ ID NO: 653507 - DNA, 14 bp, Homo sapiens
tttactctttgaaa

SEQ ID NO: 653508 - DNA, 12 bp, Homo sapiens
tttagaaactga

SEQ ID NO: 653509 - DNA, 14 bp, Homo sapiens
tttagaaactgaaa

SEQ ID NO: 653510 - DNA, 15 bp, Homo sapiens
tttagaaatgcatat

SEQ ID NO: 653511 - DNA, 12 bp, Homo sapiens
tttagaagaaaa

SEQ ID NO: 653512 - DNA, 13 bp, Homo sapiens
tttagcttcattt

SEQ ID NO: 653513 - DNA, 16 bp, Homo sapiens
tttaggaacttcagag

SEQ ID NO: 653514 - DNA, 23 bp, Homo sapiens
tttagtaagtatgttttttatgt

SEQ ID NO: 653515 - DNA, 15 bp, Homo sapiens
ttcaagaaaatcttt

SEQ ID NO: 653516 - DNA, 17 bp, Homo sapiens
ttcaagaatgaaaaata

SEQ ID NO: 653517 - DNA, 18 bp, Homo sapiens
ttcaagaatgaaaaatat

SEQ ID NO: 653518 - DNA, 15 bp, Homo sapiens
ttcaagaccagcctg

SEQ ID NO: 653519 - DNA, 18 bp, Homo sapiens
ttcaagagctagaaaaat

SEQ ID NO: 653520 - DNA, 23 bp, Homo sapiens
ttcaagagctagaaaaataaaat

SEQ ID NO: 653521 - DNA, 23 bp, Homo sapiens
ttcaagttaccaatgtaacactg

SEQ ID NO: 653522 - DNA, 17 bp, Homo sapiens
ttcaatgacttctaatt

SEQ ID NO: 653523 - DNA, 21 bp, Homo sapiens
ttcaattacaaagcagttact

SEQ ID NO: 653524 - DNA, 14 bp, Homo sapiens
ttcaattgtcactt

SEQ ID NO: 653525 - DNA, 16 bp, Homo sapiens
ttcaccaaaattatcc

SEQ ID NO: 653526 - DNA, 18 bp, Homo sapiens
ttcacccgagttcctctg

SEQ ID NO: 653527 - DNA, 22 bp, Homo sapiens
ttcactagaagccgtgggaaga

SEQ ID NO: 653528 - DNA, 17 bp, Homo sapiens
ttcactgccagttgtct

SEQ ID NO: 653529 - DNA, 22 bp, Homo sapiens
ttcacttaagttagttccactg

SEQ ID NO: 653530 - DNA, 15 bp, Homo sapiens
ttcagaaatataaca

SEQ ID NO: 653531 - DNA, 19 bp, Homo sapiens
ttcagaaatctggagctgg

SEQ ID NO: 653532 - DNA, 12 bp, Homo sapiens
ttcagaaatgtt

SEQ ID NO: 653533 - DNA, 15 bp, Homo sapiens
ttcagaagttaacat

SEQ ID NO: 653534 - DNA, 13 bp, Homo sapiens
ttcagaggctcag

SEQ ID NO: 653535 - DNA, 22 bp, Homo sapiens
ttcagaggctcagattgtaata

SEQ ID NO: 653536 - DNA, 18 bp, Homo sapiens
ttcagcaggctagacaga

SEQ ID NO: 653537 - DNA, 22 bp, Homo sapiens
ttcagcatctaaagcagcaggt

SEQ ID NO: 653538 - DNA, 18 bp, Homo sapiens
ttcagctctttccaaatt

SEQ ID NO: 653539 - DNA, 20 bp, Homo sapiens
ttcagctctttccaaattaa

SEQ ID NO: 653540 - DNA, 21 bp, Homo sapiens
ttcaggagaacctaacatgct

SEQ ID NO: 653541 - DNA, 23 bp, Homo sapiens
ttcagggtaaataggaatcattc

SEQ ID NO: 653542 - DNA, 22 bp, Homo sapiens
ttcagtcatagcaagcttttgc

SEQ ID NO: 653543 - DNA, 20 bp, Homo sapiens
ttcagtgagggtcttcttac

SEQ ID NO: 653544 - DNA, 20 bp, Homo sapiens
ttcagttctttggattctaa

SEQ ID NO: 653545 - DNA, 15 bp, Homo sapiens
ttcataaacaagttc

SEQ ID NO: 653546 - DNA, 21 bp, Homo sapiens
ttcataatcagtaaatagtgt

SEQ ID NO: 653547 - DNA, 16 bp, Homo sapiens
ttcatacgtaaaattt

SEQ ID NO: 653548 - DNA, 17 bp, Homo sapiens
ttcatagtaagattgat

SEQ ID NO: 653549 - DNA, 17 bp, Homo sapiens
ttcatattttaaacaga

SEQ ID NO: 653550 - DNA, 14 bp, Homo sapiens
ttcatctacctttt

SEQ ID NO: 653551 - DNA, 22 bp, Homo sapiens
ttcatgattatagcaactaatg

SEQ ID NO: 653552 - DNA, 14 bp, Homo sapiens
ttcatgcttgccat

SEQ ID NO: 653553 - DNA, 14 bp, Homo sapiens
ttcattattcaaga

SEQ ID NO: 653554 - DNA, 19 bp, Homo sapiens
ttcattattcaagaatgaa

SEQ ID NO: 653555 - DNA, 23 bp, Homo sapiens
ttcattattcaagaatgaaaaat

SEQ ID NO: 653556 - DNA, 14 bp, Homo sapiens
ttcatttttaagaa

SEQ ID NO: 653557 - DNA, 18 bp, Homo sapiens
ttcattttttatgtattg

SEQ ID NO: 653558 - DNA, 20 bp, Homo sapiens
ttcattttttatgtattgtt

SEQ ID NO: 653559 - DNA, 23 bp, Homo sapiens
ttccaaattgccctatgctgtgc

SEQ ID NO: 653560 - DNA, 19 bp, Homo sapiens
ttccaaggaagcagaagac

SEQ ID NO: 653561 - DNA, 23 bp, Homo sapiens
ttccagagctctttgatcgcttt

SEQ ID NO: 653562 - DNA, 21 bp, Homo sapiens
ttccagcatttagctggccac

SEQ ID NO: 653563 - DNA, 12 bp, Homo sapiens
ttccagggcagc

SEQ ID NO: 653564 - DNA, 14 bp, Homo sapiens
ttccaggggaacct

SEQ ID NO: 653565 - DNA, 18 bp, Homo sapiens
ttccaggggaacctgcca

SEQ ID NO: 653566 - DNA, 13 bp, Homo sapiens
ttccagtgtctgt

SEQ ID NO: 653567 - DNA, 23 bp, Homo sapiens
ttgaaatgtttaataaagcttta

SEQ ID NO: 653568 - DNA, 14 bp, Homo sapiens
ttgaaattgaagag

SEQ ID NO: 653569 - DNA, 23 bp, Homo sapiens
ttgaactggcaattgtctattta

SEQ ID NO: 653570 - DNA, 19 bp, Homo sapiens
ttgaagcctaaatttgtgc

SEQ ID NO: 653571 - DNA, 22 bp, Homo sapiens
ttgaatatgccttaatttagaa

SEQ ID NO: 653572 - DNA, 12 bp, Homo sapiens
ttgacagccttc

SEQ ID NO: 653573 - DNA, 17 bp, Homo sapiens
ttgacctggactgaagt

SEQ ID NO: 653574 - DNA, 18 bp, Homo sapiens
ttgacctggactgaagtt

SEQ ID NO: 653575 - DNA, 17 bp, Homo sapiens
ttgagacctttcctctc

SEQ ID NO: 653576 - DNA, 13 bp, Homo sapiens
ttgagatgtacat

SEQ ID NO: 653577 - DNA, 11 bp, Homo sapiens
ttgagatttct

SEQ ID NO: 653578 - DNA, 17 bp, Homo sapiens
ttgagccagtaatcttt

SEQ ID NO: 653579 - DNA, 14 bp, Homo sapiens
ttgagccctggctg

SEQ ID NO: 653580 - DNA, 21 bp, Homo sapiens
ttgagctcagccccaactctt

SEQ ID NO: 653581 - DNA, 16 bp, Homo sapiens
ttgaggtcaagtaaga

SEQ ID NO: 653582 - DNA, 13 bp, Homo sapiens
ttgagtattgttt

SEQ ID NO: 653583 - DNA, 12 bp, Homo sapiens
ttgatagatgtt

SEQ ID NO: 653584 - DNA, 17 bp, Homo sapiens
ttgatatctataaaata

SEQ ID NO: 653585 - DNA, 12 bp, Homo sapiens
ttgatctctctt

SEQ ID NO: 653586 - DNA, 15 bp, Homo sapiens
ttgatgcccaatata

SEQ ID NO: 653587 - DNA, 23 bp, Homo sapiens
ttgatgtaaagatgttctggata

SEQ ID NO: 653588 - DNA, 18 bp, Homo sapiens
ttgatgttttttctgtaa

SEQ ID NO: 653589 - DNA, 14 bp, Homo sapiens
ttgattaaagatga

SEQ ID NO: 653590 - DNA, 16 bp, Homo sapiens
ttgattaagaaaggaa

SEQ ID NO: 653591 - DNA, 17 bp, Homo sapiens
ttgattaagaaaggaag

SEQ ID NO: 653592 - DNA, 23 bp, Homo sapiens
ttgattattttttttttcttctt

SEQ ID NO: 653593 - DNA, 19 bp, Homo sapiens
ttgattgggaaaacatttg

SEQ ID NO: 653594 - DNA, 17 bp, Homo sapiens
ttgattgtcagctacta

SEQ ID NO: 653595 - DNA, 14 bp, Homo sapiens
ttgatttcaaagtt

SEQ ID NO: 653596 - DNA, 15 bp, Homo sapiens
ttgatttttaagaaa

SEQ ID NO: 653597 - DNA, 12 bp, Homo sapiens
ttgcaaagaact

SEQ ID NO: 653598 - DNA, 20 bp, Homo sapiens
ttgcaactaggtatttctaa

SEQ ID NO: 653599 - DNA, 22 bp, Homo sapiens
ttgcacaccattttgtaaatga

SEQ ID NO: 653600 - DNA, 18 bp, Homo sapiens
ttgcacagctgtttgaaa

SEQ ID NO: 653601 - DNA, 15 bp, Homo sapiens
ttgcagaagagggtg

SEQ ID NO: 653602 - DNA, 16 bp, Homo sapiens
ttgcagaagagggtgt

SEQ ID NO: 653603 - DNA, 20 bp, Homo sapiens
ttgcagaagagggtgtgttt

SEQ ID NO: 653604 - DNA, 16 bp, Homo sapiens
ttgcagtgagctgaga

SEQ ID NO: 653605 - DNA, 21 bp, Homo sapiens
ttgcatactttgtattttgat

SEQ ID NO: 653606 - DNA, 15 bp, Homo sapiens
ttgcatatagttaaa

SEQ ID NO: 653607 - DNA, 20 bp, Homo sapiens
ttgcatattttgagaaactg

SEQ ID NO: 653608 - DNA, 21 bp, Homo sapiens
ttgcatattttgagaaactgc

SEQ ID NO: 653609 - DNA, 17 bp, Homo sapiens
ttgcatctcaaaattat

SEQ ID NO: 653610 - DNA, 15 bp, Homo sapiens
ttgcatttggtcaag

SEQ ID NO: 653611 - DNA, 22 bp, Homo sapiens
ttgcatttgtggtaatctacac

SEQ ID NO: 653612 - DNA, 15 bp, Homo sapiens
ttgccaacagttgta

SEQ ID NO: 653613 - DNA, 15 bp, Homo sapiens
ttgccaagaaaatga

SEQ ID NO: 653614 - DNA, 22 bp, Homo sapiens
ttgccaagaaaatgaagggatt

SEQ ID NO: 653615 - DNA, 14 bp, Homo sapiens
ttgccactgctgta

SEQ ID NO: 653616 - DNA, 15 bp, Homo sapiens
ttgccaggacatgca

SEQ ID NO: 653617 - DNA, 16 bp, Homo sapiens
ttgccagttttccctg

SEQ ID NO: 653618 - DNA, 14 bp, Homo sapiens
ttgccatctgtgat

SEQ ID NO: 653619 - DNA, 14 bp, Homo sapiens
ttgcccatcctgac

SEQ ID NO: 653620 - DNA, 16 bp, Homo sapiens
ttgcccatcctgactg

SEQ ID NO: 653621 - DNA, 15 bp, Homo sapiens
ttgccccaggccctg

SEQ ID NO: 653622 - DNA, 20 bp, Homo sapiens
ttgcccccagtgcctcacct

SEQ ID NO: 653623 - DNA, 12 bp, Homo sapiens
ttgcccctggct

SEQ ID NO: 653624 - DNA, 13 bp, Homo sapiens
ttgcccctggctt

SEQ ID NO: 653625 - DNA, 18 bp, Homo sapiens
ttgcccctggctttgcct

SEQ ID NO: 653626 - DNA, 16 bp, Homo sapiens
ttgccctatgctgtgc

SEQ ID NO: 653627 - DNA, 12 bp, Homo sapiens
ttgcccttcctc

SEQ ID NO: 653628 - DNA, 19 bp, Homo sapiens
ttgcctctgcagtctcatt

SEQ ID NO: 653629 - DNA, 15 bp, Homo sapiens
ttgcctctgccctgg

SEQ ID NO: 653630 - DNA, 16 bp, Homo sapiens
ttgctaatcaaagcca

SEQ ID NO: 653631 - DNA, 23 bp, Homo sapiens
ttgctatgttactattttctaca

SEQ ID NO: 653632 - DNA, 18 bp, Homo sapiens
ttgctcaacagacaatta

SEQ ID NO: 653633 - DNA, 15 bp, Homo sapiens
ttgctctttcacctg

SEQ ID NO: 653634 - DNA, 14 bp, Homo sapiens
ttgctgaactcagc

SEQ ID NO: 653635 - DNA, 17 bp, Homo sapiens
ttgctgattatttatga

SEQ ID NO: 653636 - DNA, 15 bp, Homo sapiens
ttgctgctgcctctt

SEQ ID NO: 653637 - DNA, 19 bp, Homo sapiens
ttgctgtgtgtcccaggca

SEQ ID NO: 653638 - DNA, 15 bp, Homo sapiens
ttgcttcttactgat

SEQ ID NO: 653639 - DNA, 18 bp, Homo sapiens
ttgcttcttactgataat

SEQ ID NO: 653640 - DNA, 16 bp, Homo sapiens
ttgctttaattaatta

SEQ ID NO: 653641 - DNA, 12 bp, Homo sapiens
ttgcttttaatt

SEQ ID NO: 653642 - DNA, 19 bp, Homo sapiens
ttgcttttttgtattggtt

SEQ ID NO: 653643 - DNA, 19 bp, Homo sapiens
ttggaaattgttgtatatc

SEQ ID NO: 653644 - DNA, 15 bp, Homo sapiens
aaaatgacaattgtg

SEQ ID NO: 653645 - DNA, 22 bp, Homo sapiens
aaaatgcttaaaaaataataca

SEQ ID NO: 653646 - DNA, 23 bp, Homo sapiens
aaaatgcttaaaaaataatacaa

SEQ ID NO: 653647 - DNA, 20 bp, Homo sapiens
aaaatggatattattagaaa

SEQ ID NO: 653648 - DNA, 19 bp, Homo sapiens
aaaatgtaatttaaatgaa

SEQ ID NO: 653649 - DNA, 21 bp, Homo sapiens
aaaatgtatccaaggaaacat

SEQ ID NO: 653650 - DNA, 12 bp, Homo sapiens
aaaatgtctgta

SEQ ID NO: 653651 - DNA, 21 bp, Homo sapiens
aaaatgtttcattatgcactt

SEQ ID NO: 653652 - DNA, 13 bp, Homo sapiens
aaaattaactttt

SEQ ID NO: 653653 - DNA, 21 bp, Homo sapiens
aaaattcttgagaagtaactg

SEQ ID NO: 653654 - DNA, 20 bp, Homo sapiens
aaaattgaatgtggctgaag

SEQ ID NO: 653655 - DNA, 13 bp, Homo sapiens
aaaattgatatta

SEQ ID NO: 653656 - DNA, 17 bp, Homo sapiens
aaaattgatattatatt

SEQ ID NO: 653657 - DNA, 20 bp, Homo sapiens
aaaattgtctaaaatgtcag

SEQ ID NO: 653658 - DNA, 16 bp, Homo sapiens
aaaattgtttagtgat

SEQ ID NO: 653659 - DNA, 19 bp, Homo sapiens
aaaatttgatggactaatt

SEQ ID NO: 653660 - DNA, 15 bp, Homo sapiens
aaaatttgctttaat

SEQ ID NO: 653661 - DNA, 19 bp, Homo sapiens
aaaattttagctcttccca

SEQ ID NO: 653662 - DNA, 20 bp, Homo sapiens
aaacaaaggcctaattctat

SEQ ID NO: 653663 - DNA, 13 bp, Homo sapiens
aaacaataatgca

SEQ ID NO: 653664 - DNA, 17 bp, Homo sapiens
aaacaattttctgtaat

SEQ ID NO: 653665 - DNA, 20 bp, Homo sapiens
aaacacccgacgtcatgtat

SEQ ID NO: 653666 - DNA, 22 bp, Homo sapiens
aaacacgtggtcatgaatagaa

SEQ ID NO: 653667 - DNA, 15 bp, Homo sapiens
aaacactacacattt

SEQ ID NO: 653668 - DNA, 14 bp, Homo sapiens
aaacagaaatggaa

SEQ ID NO: 653669 - DNA, 15 bp, Homo sapiens
aaacagaacagggtc

SEQ ID NO: 653670 - DNA, 18 bp, Homo sapiens
aaacagaagcctgtttca

SEQ ID NO: 653671 - DNA, 14 bp, Homo sapiens
aaacagacaatatg

SEQ ID NO: 653672 - DNA, 22 bp, Homo sapiens
aaacagacaatatgtgagtgcc

SEQ ID NO: 653673 - DNA, 17 bp, Homo sapiens
aaacagatgaccataat

SEQ ID NO: 653674 - DNA, 18 bp, Homo sapiens
aaacagatgaccataatt

SEQ ID NO: 653675 - DNA, 17 bp, Homo sapiens
aaacagatttggaaaga

SEQ ID NO: 653676 - DNA, 20 bp, Homo sapiens
aaacagctgcattagaaaaa

SEQ ID NO: 653677 - DNA, 23 bp, Homo sapiens
aaacagttgctgtgaactttcat

SEQ ID NO: 653678 - DNA, 15 bp, Homo sapiens
aaacatgtactacag

SEQ ID NO: 653679 - DNA, 21 bp, Homo sapiens
aaacatgttaatgacaatatt

SEQ ID NO: 653680 - DNA, 14 bp, Homo sapiens
aaacattaaaatat

SEQ ID NO: 653681 - DNA, 22 bp, Homo sapiens
aaacattttatcattaaaaatt

SEQ ID NO: 653682 - DNA, 15 bp, Homo sapiens
aaacattttttcttc

SEQ ID NO: 653683 - DNA, 15 bp, Homo sapiens
aaaccactagaaagt

SEQ ID NO: 653684 - DNA, 12 bp, Homo sapiens
aaacctcaccct

SEQ ID NO: 653685 - DNA, 13 bp, Homo sapiens
aaacgagactttc

SEQ ID NO: 653686 - DNA, 14 bp, Homo sapiens
aaacgagactttct

SEQ ID NO: 653687 - DNA, 17 bp, Homo sapiens
aaacgcgtctgcctggg

SEQ ID NO: 653688 - DNA, 16 bp, Homo sapiens
aaacgctacctctctg

SEQ ID NO: 653689 - DNA, 13 bp, Homo sapiens
aaacgtgaacaaa

SEQ ID NO: 653690 - DNA, 13 bp, Homo sapiens
aaactaaatttca

SEQ ID NO: 653691 - DNA, 20 bp, Homo sapiens
aaactaacagataagcaaga

SEQ ID NO: 653692 - DNA, 15 bp, Homo sapiens
aaactaaccttgaat

SEQ ID NO: 653693 - DNA, 18 bp, Homo sapiens
aaactaatcaccatattg

SEQ ID NO: 653694 - DNA, 20 bp, Homo sapiens
aaactcctttcttatcttga

SEQ ID NO: 653695 - DNA, 12 bp, Homo sapiens
aaactcttcagt

SEQ ID NO: 653696 - DNA, 14 bp, Homo sapiens
aaactgaaaaatat

SEQ ID NO: 653697 - DNA, 21 bp, Homo sapiens
aaactgagagtaattcatctg

SEQ ID NO: 653698 - DNA, 16 bp, Homo sapiens
aaactgcaagttcatt

SEQ ID NO: 653699 - DNA, 19 bp, Homo sapiens
aaactggcttccccactcc

SEQ ID NO: 653700 - DNA, 21 bp, Homo sapiens
aaactggttttaagtgctttc

SEQ ID NO: 653701 - DNA, 15 bp, Homo sapiens
aaactgtacatttaa

SEQ ID NO: 653702 - DNA, 17 bp, Homo sapiens
aaactgtacatttaaaa

SEQ ID NO: 653703 - DNA, 14 bp, Homo sapiens
aaacttaaaaacaa

SEQ ID NO: 653704 - DNA, 15 bp, Homo sapiens
aaacttaaaaacaag

SEQ ID NO: 653705 - DNA, 15 bp, Homo sapiens
aaacttactattttg

SEQ ID NO: 653706 - DNA, 11 bp, Homo sapiens
aaacttctgct

SEQ ID NO: 653707 - DNA, 12 bp, Homo sapiens
aaacttctgctc

SEQ ID NO: 653708 - DNA, 13 bp, Homo sapiens
aaacttgtacatg

SEQ ID NO: 653709 - DNA, 18 bp, Homo sapiens
aaacttgtacatggaatt

SEQ ID NO: 653710 - DNA, 19 bp, Homo sapiens
aaagaactcattcatagga

SEQ ID NO: 653711 - DNA, 14 bp, Homo sapiens
aaagaactgtactg

SEQ ID NO: 653712 - DNA, 17 bp, Homo sapiens
aaagaacttactgatta

SEQ ID NO: 653713 - DNA, 13 bp, Homo sapiens
aaagaagagaagt

SEQ ID NO: 653714 - DNA, 13 bp, Homo sapiens
aaagaagctttat

SEQ ID NO: 653715 - DNA, 14 bp, Homo sapiens
aaagaatttagtat

SEQ ID NO: 653716 - DNA, 17 bp, Homo sapiens
aaagactcgagaaccaa

SEQ ID NO: 653717 - DNA, 20 bp, Homo sapiens
aaagacttctcaaagagaat

SEQ ID NO: 653718 - DNA, 23 bp, Homo sapiens
aaagacttctcaaagagaattgt

SEQ ID NO: 653719 - DNA, 17 bp, Homo sapiens
aaagacttgagacaatg

SEQ ID NO: 653720 - DNA, 23 bp, Homo sapiens
aaagacttgagacaatgttttct

SEQ ID NO: 653721 - DNA, 18 bp, Homo sapiens
aaagagagaatgtagata

SEQ ID NO: 653722 - DNA, 20 bp, Homo sapiens
aaagaggctgaaagaggcca

SEQ ID NO: 653723 - DNA, 22 bp, Homo sapiens
aagtttcaaacttactattttg

SEQ ID NO: 653724 - DNA, 17 bp, Homo sapiens
aagttttaactttaata

SEQ ID NO: 653725 - DNA, 20 bp, Homo sapiens
aagttttcctacacttgaga

SEQ ID NO: 653726 - DNA, 13 bp, Homo sapiens
aagtttttttgct

SEQ ID NO: 653727 - DNA, 23 bp, Homo sapiens
aagtttttttgctgctgcctctt

SEQ ID NO: 653728 - DNA, 18 bp, Homo sapiens
aataaaaacttttgagga

SEQ ID NO: 653729 - DNA, 22 bp, Homo sapiens
aataaaatatcataaagcattt

SEQ ID NO: 653730 - DNA, 19 bp, Homo sapiens
aataaaatgtttcattatg

SEQ ID NO: 653731 - DNA, 16 bp, Homo sapiens
aataaaattcatttct

SEQ ID NO: 653732 - DNA, 13 bp, Homo sapiens
aataaaatttaaa

SEQ ID NO: 653733 - DNA, 21 bp, Homo sapiens
aataaagccttttaaatcatc

SEQ ID NO: 653734 - DNA, 10 bp, Homo sapiens
aataaaggca

SEQ ID NO: 653735 - DNA, 11 bp, Homo sapiens
aataaaggcag

SEQ ID NO: 653736 - DNA, 22 bp, Homo sapiens
aataaaggcagctgcctctgct

SEQ ID NO: 653737 - DNA, 18 bp, Homo sapiens
aataaataaaaactaatt

SEQ ID NO: 653738 - DNA, 12 bp, Homo sapiens
aataaataattt

SEQ ID NO: 653739 - DNA, 14 bp, Homo sapiens
aataaatataattt

SEQ ID NO: 653740 - DNA, 16 bp, Homo sapiens
aataaatataatttat

SEQ ID NO: 653741 - DNA, 15 bp, Homo sapiens
aataaatatatacat

SEQ ID NO: 653742 - DNA, 14 bp, Homo sapiens
aataaatatttatg

SEQ ID NO: 653743 - DNA, 14 bp, Homo sapiens
aataaattagttgt

SEQ ID NO: 653744 - DNA, 15 bp, Homo sapiens
aataacactgtattt

SEQ ID NO: 653745 - DNA, 23 bp, Homo sapiens
aataacactgtattttaatgtac

SEQ ID NO: 653746 - DNA, 13 bp, Homo sapiens
aataagacaaaaa

SEQ ID NO: 653747 - DNA, 14 bp, Homo sapiens
aataagacaagaga

SEQ ID NO: 653748 - DNA, 19 bp, Homo sapiens
aataagcactgtaaacttc

SEQ ID NO: 653749 - DNA, 13 bp, Homo sapiens
aataagctaaaga

SEQ ID NO: 653750 - DNA, 15 bp, Homo sapiens
aataataaaaagcaa

SEQ ID NO: 653751 - DNA, 12 bp, Homo sapiens
aataataaagaa

SEQ ID NO: 653752 - DNA, 20 bp, Homo sapiens
aataataaagaatagcttta

SEQ ID NO: 653753 - DNA, 16 bp, Homo sapiens
aataataaatgccctc

SEQ ID NO: 653754 - DNA, 14 bp, Homo sapiens
aataatatttatgt

SEQ ID NO: 653755 - DNA, 14 bp, Homo sapiens
aataatgcttcaga

SEQ ID NO: 653756 - DNA, 19 bp, Homo sapiens
aataatggcactgaccggt

SEQ ID NO: 653757 - DNA, 19 bp, Homo sapiens
aataattggagaagattta

SEQ ID NO: 653758 - DNA, 17 bp, Homo sapiens
aataattttaatattct

SEQ ID NO: 653759 - DNA, 13 bp, Homo sapiens
aataattttgtaa

SEQ ID NO: 653760 - DNA, 17 bp, Homo sapiens
aatacaacaacaacaaa

SEQ ID NO: 653761 - DNA, 17 bp, Homo sapiens
aatacaaggtataataa

SEQ ID NO: 653762 - DNA, 20 bp, Homo sapiens
aatacaaggtataataaaat

SEQ ID NO: 653763 - DNA, 15 bp, Homo sapiens
aatacacatttgcta

SEQ ID NO: 653764 - DNA, 15 bp, Homo sapiens
aatacagactggatg

SEQ ID NO: 653765 - DNA, 23 bp, Homo sapiens
aatacagtattatagacaaaaga

SEQ ID NO: 653766 - DNA, 16 bp, Homo sapiens
aatacatagtgaaaat

SEQ ID NO: 653767 - DNA, 17 bp, Homo sapiens
aatacatttaaaacatt

SEQ ID NO: 653768 - DNA, 21 bp, Homo sapiens
aatacatttaaaacattaaaa

SEQ ID NO: 653769 - DNA, 23 bp, Homo sapiens
aatacatttaaaacattaaaata

SEQ ID NO: 653770 - DNA, 14 bp, Homo sapiens
aatactatttaaga

SEQ ID NO: 653771 - DNA, 20 bp, Homo sapiens
aatactatttaagatgtgaa

SEQ ID NO: 653772 - DNA, 19 bp, Homo sapiens
aatactttctatgtgacat

SEQ ID NO: 653773 - DNA, 22 bp, Homo sapiens
aatagaagctaaggtttagata

SEQ ID NO: 653774 - DNA, 13 bp, Homo sapiens
aatagaataattc

SEQ ID NO: 653775 - DNA, 22 bp, Homo sapiens
aataggaatcattcagaaatgt

SEQ ID NO: 653776 - DNA, 14 bp, Homo sapiens
aataggagtatttt

SEQ ID NO: 653777 - DNA, 17 bp, Homo sapiens
aataggagtatttttgg

SEQ ID NO: 653778 - DNA, 21 bp, Homo sapiens
aataggagtggtgatttgaaa

SEQ ID NO: 653779 - DNA, 16 bp, Homo sapiens
aataggggatatttaa

SEQ ID NO: 653780 - DNA, 18 bp, Homo sapiens
aatagtatacattgtctt

SEQ ID NO: 653781 - DNA, 20 bp, Homo sapiens
aatagtatacattgtcttga

SEQ ID NO: 653782 - DNA, 20 bp, Homo sapiens
aatagtgtcatataaactca

SEQ ID NO: 653783 - DNA, 16 bp, Homo sapiens
aatagtttgtctattt

SEQ ID NO: 653784 - DNA, 14 bp, Homo sapiens
aatataacacattt

SEQ ID NO: 653785 - DNA, 15 bp, Homo sapiens
aatataacacatttt

SEQ ID NO: 653786 - DNA, 14 bp, Homo sapiens
aatataagacattt

SEQ ID NO: 653787 - DNA, 23 bp, Homo sapiens
aatataatgtattttctttttat

SEQ ID NO: 653788 - DNA, 12 bp, Homo sapiens
aatataatttat

SEQ ID NO: 653789 - DNA, 19 bp, Homo sapiens
aatataatttataagcatt

SEQ ID NO: 653790 - DNA, 21 bp, Homo sapiens
aatataatttataagcattgc

SEQ ID NO: 653791 - DNA, 15 bp, Homo sapiens
aatatacattttcta

SEQ ID NO: 653792 - DNA, 15 bp, Homo sapiens
aatataccttattta

SEQ ID NO: 653793 - DNA, 16 bp, Homo sapiens
aatataccttatttat

SEQ ID NO: 653794 - DNA, 22 bp, Homo sapiens
aatataccttatttatttttgt

SEQ ID NO: 653795 - DNA, 15 bp, Homo sapiens
aatatatatggtcat

SEQ ID NO: 653796 - DNA, 21 bp, Homo sapiens
aatatatgcctggcacagctt

SEQ ID NO: 653797 - DNA, 17 bp, Homo sapiens
atgatatgcttgtaact

SEQ ID NO: 653798 - DNA, 12 bp, Homo sapiens
atgatctcttct

SEQ ID NO: 653799 - DNA, 14 bp, Homo sapiens
atgatctcttctgg

SEQ ID NO: 653800 - DNA, 17 bp, Homo sapiens
atgatggttttaaactt

SEQ ID NO: 653801 - DNA, 14 bp, Homo sapiens
atgatgtacagatt

SEQ ID NO: 653802 - DNA, 18 bp, Homo sapiens
atgatgtacagattcttt

SEQ ID NO: 653803 - DNA, 20 bp, Homo sapiens
atgatgttaaatgtaatata

SEQ ID NO: 653804 - DNA, 17 bp, Homo sapiens
atgatttaatttgaaat

SEQ ID NO: 653805 - DNA, 15 bp, Homo sapiens
atgatttagcaagca

SEQ ID NO: 653806 - DNA, 15 bp, Homo sapiens
atgatttccttcaat

SEQ ID NO: 653807 - DNA, 14 bp, Homo sapiens
atgcaaaaggttta

SEQ ID NO: 653808 - DNA, 15 bp, Homo sapiens
atgcaaccatttgaa

SEQ ID NO: 653809 - DNA, 17 bp, Homo sapiens
atgcaactctaactctg

SEQ ID NO: 653810 - DNA, 23 bp, Homo sapiens
atgcaactggagttccttatccc

SEQ ID NO: 653811 - DNA, 14 bp, Homo sapiens
atgcaataaaattt

SEQ ID NO: 653812 - DNA, 18 bp, Homo sapiens
atgcaataaaatttaaaa

SEQ ID NO: 653813 - DNA, 23 bp, Homo sapiens
atgcaataaaatttaaaaaataa

SEQ ID NO: 653814 - DNA, 13 bp, Homo sapiens
atgcaataactct

SEQ ID NO: 653815 - DNA, 14 bp, Homo sapiens
atgcaatttgaagt

SEQ ID NO: 653816 - DNA, 23 bp, Homo sapiens
atgcaatttgaagtaacttattt

SEQ ID NO: 653817 - DNA, 12 bp, Homo sapiens
atgcaatttgat

SEQ ID NO: 653818 - DNA, 14 bp, Homo sapiens
atgcacccctgagc

SEQ ID NO: 653819 - DNA, 14 bp, Homo sapiens
atgcactatgtata

SEQ ID NO: 653820 - DNA, 16 bp, Homo sapiens
atgcactgatgttgtg

SEQ ID NO: 653821 - DNA, 15 bp, Homo sapiens
atgcacttttagaaa

SEQ ID NO: 653822 - DNA, 16 bp, Homo sapiens
atgcagattacactga

SEQ ID NO: 653823 - DNA, 21 bp, Homo sapiens
atgcagccgtgatcaagggaa

SEQ ID NO: 653824 - DNA, 14 bp, Homo sapiens
atgcagctttgcaa

SEQ ID NO: 653825 - DNA, 17 bp, Homo sapiens
atgcaggtgtcctgagc

SEQ ID NO: 653826 - DNA, 19 bp, Homo sapiens
atgcagttagctgaagaat

SEQ ID NO: 653827 - DNA, 20 bp, Homo sapiens
atgcagttagctgaagaatt

SEQ ID NO: 653828 - DNA, 13 bp, Homo sapiens
atgcataaatgca

SEQ ID NO: 653829 - DNA, 13 bp, Homo sapiens
atgcataatttat

SEQ ID NO: 653830 - DNA, 16 bp, Homo sapiens
atgccactcctccctc

SEQ ID NO: 653831 - DNA, 17 bp, Homo sapiens
atgccactcctccctcc

SEQ ID NO: 653832 - DNA, 18 bp, Homo sapiens
atgccactcctccctccg

SEQ ID NO: 653833 - DNA, 16 bp, Homo sapiens
atgccagtctcattgt

SEQ ID NO: 653834 - DNA, 23 bp, Homo sapiens
atgccatgtgcggaattcaagtt

SEQ ID NO: 653835 - DNA, 14 bp, Homo sapiens
atgcccaatatatt

SEQ ID NO: 653836 - DNA, 23 bp, Homo sapiens
atgcctagtttcttacacactgt

SEQ ID NO: 653837 - DNA, 13 bp, Homo sapiens
atgccttaattta

SEQ ID NO: 653838 - DNA, 17 bp, Homo sapiens
atgccttaatttagaaa

SEQ ID NO: 653839 - DNA, 17 bp, Homo sapiens
atgctacaattttaaga

SEQ ID NO: 653840 - DNA, 17 bp, Homo sapiens
aatgttgaaaagtaatt

SEQ ID NO: 653841 - DNA, 17 bp, Homo sapiens
aatgttgtattcagtga

SEQ ID NO: 653842 - DNA, 15 bp, Homo sapiens
aatgtttaataaagc

SEQ ID NO: 653843 - DNA, 16 bp, Homo sapiens
aatgtttaataaagct

SEQ ID NO: 653844 - DNA, 18 bp, Homo sapiens
aatgtttaataaagcttt

SEQ ID NO: 653845 - DNA, 23 bp, Homo sapiens
aatgtttatactgtatttctaag

SEQ ID NO: 653846 - DNA, 16 bp, Homo sapiens
aatgttttcaaaaggt

SEQ ID NO: 653847 - DNA, 18 bp, Homo sapiens
aatgttttgggaaacact

SEQ ID NO: 653848 - DNA, 14 bp, Homo sapiens
aattaaaacaaata

SEQ ID NO: 653849 - DNA, 16 bp, Homo sapiens
aattaaaacaaatata

SEQ ID NO: 653850 - DNA, 16 bp, Homo sapiens
aattaaaagtcttttt

SEQ ID NO: 653851 - DNA, 13 bp, Homo sapiens
aattaagcaaatg

SEQ ID NO: 653852 - DNA, 16 bp, Homo sapiens
aattaagcattttgaa

SEQ ID NO: 653853 - DNA, 14 bp, Homo sapiens
aattaatagtttgt

SEQ ID NO: 653854 - DNA, 20 bp, Homo sapiens
aattaatagtttgtctattt

SEQ ID NO: 653855 - DNA, 13 bp, Homo sapiens
aattaattaagta

SEQ ID NO: 653856 - DNA, 12 bp, Homo sapiens
aattaattttac

SEQ ID NO: 653857 - DNA, 19 bp, Homo sapiens
aattacagtccaaaatact

SEQ ID NO: 653858 - DNA, 17 bp, Homo sapiens
aattacctttaatttta

SEQ ID NO: 653859 - DNA, 20 bp, Homo sapiens
aattacctttaattttaatg

SEQ ID NO: 653860 - DNA, 16 bp, Homo sapiens
aattactttaacattt

SEQ ID NO: 653861 - DNA, 22 bp, Homo sapiens
aattactttaacattttggaaa

SEQ ID NO: 653862 - DNA, 23 bp, Homo sapiens
aattactttaacattttggaaat

SEQ ID NO: 653863 - DNA, 21 bp, Homo sapiens
aattagtacagaaatatccat

SEQ ID NO: 653864 - DNA, 18 bp, Homo sapiens
aattagtggtcataaaat

SEQ ID NO: 653865 - DNA, 21 bp, Homo sapiens
aattataggagccttaatttt

SEQ ID NO: 653866 - DNA, 23 bp, Homo sapiens
aattatattttgttgctttctta

SEQ ID NO: 653867 - DNA, 16 bp, Homo sapiens
aattatggcatttcta

SEQ ID NO: 653868 - DNA, 21 bp, Homo sapiens
aattattattttaaaatatat

SEQ ID NO: 653869 - DNA, 22 bp, Homo sapiens
aattattattttaaaatatatg

SEQ ID NO: 653870 - DNA, 14 bp, Homo sapiens
aattattggcaaag

SEQ ID NO: 653871 - DNA, 14 bp, Homo sapiens
aattcaactttgta

SEQ ID NO: 653872 - DNA, 15 bp, Homo sapiens
aattcaactttgtaa

SEQ ID NO: 653873 - DNA, 16 bp, Homo sapiens
aattcaactttgtaaa

SEQ ID NO: 653874 - DNA, 20 bp, Homo sapiens
aattcaagagctagaaaaat

SEQ ID NO: 653875 - DNA, 21 bp, Homo sapiens
aattcagtcctgggcaaaggt

SEQ ID NO: 653876 - DNA, 14 bp, Homo sapiens
aattcataaaaaca

SEQ ID NO: 653877 - DNA, 18 bp, Homo sapiens
aattcatagtaagattga

SEQ ID NO: 653878 - DNA, 16 bp, Homo sapiens
aattctaacattaaat

SEQ ID NO: 653879 - DNA, 16 bp, Homo sapiens
acacaatacagtatta

SEQ ID NO: 653880 - DNA, 21 bp, Homo sapiens
acacaatttaattcctctttt

SEQ ID NO: 653881 - DNA, 22 bp, Homo sapiens
acacactgtcatgcttcatcat

SEQ ID NO: 653882 - DNA, 22 bp, Homo sapiens
acacagcagaggcccagatatt

SEQ ID NO: 653883 - DNA, 22 bp, Homo sapiens
acacagctcttccagggcagcg

SEQ ID NO: 653884 - DNA, 19 bp, Homo sapiens
acacagttctgggcaaaga

SEQ ID NO: 653885 - DNA, 16 bp, Homo sapiens
acacatttgctactgt

SEQ ID NO: 653886 - DNA, 11 bp, Homo sapiens
acacattttaa

SEQ ID NO: 653887 - DNA, 16 bp, Homo sapiens
acaccaatgaaaacat

SEQ ID NO: 653888 - DNA, 19 bp, Homo sapiens
acaccactttctgctttcc

SEQ ID NO: 653889 - DNA, 16 bp, Homo sapiens
acaccattttgtaaat

SEQ ID NO: 653890 - DNA, 20 bp, Homo sapiens
acaccattttgtaaatgaaa

SEQ ID NO: 653891 - DNA, 13 bp, Homo sapiens
acacccaaagctg

SEQ ID NO: 653892 - DNA, 19 bp, Homo sapiens
acacccaaagctgagcctg

SEQ ID NO: 653893 - DNA, 13 bp, Homo sapiens
acacgtgagaatc

SEQ ID NO: 653894 - DNA, 14 bp, Homo sapiens
acactgcagacttg

SEQ ID NO: 653895 - DNA, 15 bp, Homo sapiens
acactgtattttaat

SEQ ID NO: 653896 - DNA, 18 bp, Homo sapiens
acactgtattttaatgta

SEQ ID NO: 653897 - DNA, 17 bp, Homo sapiens
acactgtcatgcttcat

SEQ ID NO: 653898 - DNA, 15 bp, Homo sapiens
acactgtgccccaca

SEQ ID NO: 653899 - DNA, 16 bp, Homo sapiens
acactgtggccaggcc

SEQ ID NO: 653900 - DNA, 14 bp, Homo sapiens
acacttacagagca

SEQ ID NO: 653901 - DNA, 17 bp, Homo sapiens
acagaaatggaaagcag

SEQ ID NO: 653902 - DNA, 12 bp, Homo sapiens
acagaactaaaa

SEQ ID NO: 653903 - DNA, 13 bp, Homo sapiens
acagacaaaaaca

SEQ ID NO: 653904 - DNA, 22 bp, Homo sapiens
acagactatttgctaatgtata

SEQ ID NO: 653905 - DNA, 16 bp, Homo sapiens
acagaggttgcagtga

SEQ ID NO: 653906 - DNA, 18 bp, Homo sapiens
acagataagcaagagaga

SEQ ID NO: 653907 - DNA, 20 bp, Homo sapiens
acagataagcaagagagatg

SEQ ID NO: 653908 - DNA, 21 bp, Homo sapiens
acagataagcaagagagatgt

SEQ ID NO: 653909 - DNA, 19 bp, Homo sapiens
acagatagatgttgctctt

SEQ ID NO: 653910 - DNA, 18 bp, Homo sapiens
acagatgaccataatttt

SEQ ID NO: 653911 - DNA, 20 bp, Homo sapiens
acagattctttcagttcttt

SEQ ID NO: 653912 - DNA, 15 bp, Homo sapiens
acagatttggaaaga

SEQ ID NO: 653913 - DNA, 21 bp, Homo sapiens
acagatttggaaagactggac

SEQ ID NO: 653914 - DNA, 16 bp, Homo sapiens
acagcaggcagcgcca

SEQ ID NO: 653915 - DNA, 16 bp, Homo sapiens
acagccactccccggc

SEQ ID NO: 653916 - DNA, 21 bp, Homo sapiens
acagccctgcctgagaagccc

SEQ ID NO: 653917 - DNA, 19 bp, Homo sapiens
acagccggtcagaggagcg

SEQ ID NO: 653918 - DNA, 20 bp, Homo sapiens
acagccggtcagaggagcgc

SEQ ID NO: 653919 - DNA, 17 bp, Homo sapiens
acagccttcttgatgta

SEQ ID NO: 653920 - DNA, 14 bp, Homo sapiens
acagcgtccctggc

SEQ ID NO: 653921 - DNA, 17 bp, Homo sapiens
acagcgtccctggcgca

SEQ ID NO: 653922 - DNA, 15 bp, Homo sapiens
acagctatatttgat

SEQ ID NO: 653923 - DNA, 17 bp, Homo sapiens
acagctcttccagggca

SEQ ID NO: 653924 - DNA, 22 bp, Homo sapiens
acagctcttccagggcagcggc

SEQ ID NO: 653925 - DNA, 16 bp, Homo sapiens
acagctgtttgaaatg

SEQ ID NO: 653926 - DNA, 20 bp, Homo sapiens
acagcttttgtatagaaaat

SEQ ID NO: 653927 - DNA, 23 bp, Homo sapiens
acaggagggtatggtgctgctct

SEQ ID NO: 653928 - DNA, 19 bp, Homo sapiens
acaggaggtgtgaatgcac

SEQ ID NO: 653929 - DNA, 20 bp, Homo sapiens
acaggcaccgagaatgttgt

SEQ ID NO: 653930 - DNA, 23 bp, Homo sapiens
acaggctcgtcagccacctggga

SEQ ID NO: 653931 - DNA, 21 bp, Homo sapiens
acagggcagtccttactcccc

SEQ ID NO: 653932 - DNA, 22 bp, Homo sapiens
acagggcagtccttactccccc

SEQ ID NO: 653933 - DNA, 18 bp, Homo sapiens
acagggccagtggggcct

SEQ ID NO: 653934 - DNA, 16 bp, Homo sapiens
acagggctcatttttg

SEQ ID NO: 653935 - DNA, 13 bp, Homo sapiens
acagggcttgtcc

SEQ ID NO: 653936 - DNA, 23 bp, Homo sapiens
acagggtaactgtgctgaatgct

SEQ ID NO: 653937 - DNA, 14 bp, Homo sapiens
acagggtgggcctc

SEQ ID NO: 653938 - DNA, 15 bp, Homo sapiens
acagggtgggcctcg

SEQ ID NO: 653939 - DNA, 16 bp, Homo sapiens
acagggttcaaaatgt

SEQ ID NO: 653940 - DNA, 17 bp, Homo sapiens
acaggtaactaattgga

SEQ ID NO: 653941 - DNA, 22 bp, Homo sapiens
acagtatatcccaagtgcactt

SEQ ID NO: 653942 - DNA, 23 bp, Homo sapiens
acagtatgtgggatattgaatgt

SEQ ID NO: 653943 - DNA, 20 bp, Homo sapiens
acagtattatagacaaaaga

SEQ ID NO: 653944 - DNA, 21 bp, Homo sapiens
acagtattatagacaaaagaa

SEQ ID NO: 653945 - DNA, 18 bp, Homo sapiens
acagtcatcatcagggcc

SEQ ID NO: 653946 - DNA, 14 bp, Homo sapiens
acagtctagtttcc

SEQ ID NO: 653947 - DNA, 19 bp, Homo sapiens
acagtgactccctgggagc

SEQ ID NO: 653948 - DNA, 15 bp, Homo sapiens
acagtgtttggacag

SEQ ID NO: 653949 - DNA, 20 bp, Homo sapiens
acagtgtttggacaggaggg

SEQ ID NO: 653950 - DNA, 21 bp, Homo sapiens
acagttatttcatcttttatt

SEQ ID NO: 653951 - DNA, 22 bp, Homo sapiens
acagttatttcatcttttattc

SEQ ID NO: 653952 - DNA, 15 bp, Homo sapiens
acagttattttgata

SEQ ID NO: 653953 - DNA, 16 bp, Homo sapiens
acagttgtatgtttgc

SEQ ID NO: 653954 - DNA, 11 bp, Homo sapiens
acataaaaact

SEQ ID NO: 653955 - DNA, 15 bp, Homo sapiens
acataaagttgtatt

SEQ ID NO: 653956 - DNA, 15 bp, Homo sapiens
acataagcttccatt

SEQ ID NO: 653957 - DNA, 15 bp, Homo sapiens
acataaggatgactt

SEQ ID NO: 653958 - DNA, 14 bp, Homo sapiens
acataatacaatgt

SEQ ID NO: 653959 - DNA, 12 bp, Homo sapiens
acataatttcag

SEQ ID NO: 653960 - DNA, 13 bp, Homo sapiens
acataatttcagt

SEQ ID NO: 653961 - DNA, 23 bp, Homo sapiens
acataatttcagtgggaaatatg

SEQ ID NO: 653962 - DNA, 14 bp, Homo sapiens
acatacaagaaaat

SEQ ID NO: 653963 - DNA, 15 bp, Homo sapiens
acatacctaccagta

SEQ ID NO: 653964 - DNA, 14 bp, Homo sapiens
acatagaatctgtg

SEQ ID NO: 653965 - DNA, 15 bp, Homo sapiens
acatatatatatata

SEQ ID NO: 653966 - DNA, 18 bp, Homo sapiens
acatattaggaaaatatg

SEQ ID NO: 653967 - DNA, 14 bp, Homo sapiens
acatcaaataagaa

SEQ ID NO: 653968 - DNA, 15 bp, Homo sapiens
attagaaattagaaa

SEQ ID NO: 653969 - DNA, 22 bp, Homo sapiens
attagatgttacaagtttatat

SEQ ID NO: 653970 - DNA, 16 bp, Homo sapiens
attaggagtaattctt

SEQ ID NO: 653971 - DNA, 22 bp, Homo sapiens
attagggttgcctcactgtagc

SEQ ID NO: 653972 - DNA, 23 bp, Homo sapiens
attagtgtgacagtttccaaatt

SEQ ID NO: 653973 - DNA, 17 bp, Homo sapiens
attagttctttttgcca

SEQ ID NO: 653974 - DNA, 13 bp, Homo sapiens
attataaagctta

SEQ ID NO: 653975 - DNA, 13 bp, Homo sapiens
attataaagtttt

SEQ ID NO: 653976 - DNA, 16 bp, Homo sapiens
attataactcatttgt

SEQ ID NO: 653977 - DNA, 19 bp, Homo sapiens
attataataaatatataca

SEQ ID NO: 653978 - DNA, 20 bp, Homo sapiens
attatacatgtgatacattt

SEQ ID NO: 653979 - DNA, 16 bp, Homo sapiens
attatagcaactaatg

SEQ ID NO: 653980 - DNA, 16 bp, Homo sapiens
attatattaaacatac

SEQ ID NO: 653981 - DNA, 23 bp, Homo sapiens
attatgcacttttagaaatgcat

SEQ ID NO: 653982 - DNA, 17 bp, Homo sapiens
attatggcatttctatt

SEQ ID NO: 653983 - DNA, 21 bp, Homo sapiens
attatgtatggatatatttga

SEQ ID NO: 653984 - DNA, 20 bp, Homo sapiens
attattatgcaaaatttaga

SEQ ID NO: 653985 - DNA, 20 bp, Homo sapiens
attattattttaaaatatat

SEQ ID NO: 653986 - DNA, 14 bp, Homo sapiens
attattcaaaaaca

SEQ ID NO: 653987 - DNA, 12 bp, Homo sapiens
attattcaagaa

SEQ ID NO: 653988 - DNA, 16 bp, Homo sapiens
attattcaagaatgaa

SEQ ID NO: 653989 - DNA, 22 bp, Homo sapiens
attattcctctcaccccactcc

SEQ ID NO: 653990 - DNA, 15 bp, Homo sapiens
attattctttgaaaa

SEQ ID NO: 653991 - DNA, 23 bp, Homo sapiens
attattctttgaaaacagatgac

SEQ ID NO: 653992 - DNA, 14 bp, Homo sapiens
attattggcaaagt

SEQ ID NO: 653993 - DNA, 15 bp, Homo sapiens
attattttaaaatat

SEQ ID NO: 653994 - DNA, 17 bp, Homo sapiens
attattttaaaatatat

SEQ ID NO: 653995 - DNA, 19 bp, Homo sapiens
attattttaaaatatatga

SEQ ID NO: 653996 - DNA, 14 bp, Homo sapiens
attattttcttcat

SEQ ID NO: 653997 - DNA, 21 bp, Homo sapiens
attattttcttcatccaactt

SEQ ID NO: 653998 - DNA, 19 bp, Homo sapiens
attatttttataattgtac

SEQ ID NO: 653999 - DNA, 18 bp, Homo sapiens
attatttttttaaaattt

SEQ ID NO: 654000 - DNA, 20 bp, Homo sapiens
attatttttttaaaattttg

SEQ ID NO: 654001 - DNA, 16 bp, Homo sapiens
attcaaatttgatgat

SEQ ID NO: 654002 - DNA, 19 bp, Homo sapiens
attcaagagctagaaaaat

SEQ ID NO: 654003 - DNA, 18 bp, Homo sapiens
attcaaggagaatatgat

SEQ ID NO: 654004 - DNA, 14 bp, Homo sapiens
attcaagttaccaa

SEQ ID NO: 654005 - DNA, 22 bp, Homo sapiens
attcaattagtggtcataaaat

SEQ ID NO: 654006 - DNA, 13 bp, Homo sapiens
attcagaaatgtt

SEQ ID NO: 654007 - DNA, 16 bp, Homo sapiens
attcagatcactgaat

SEQ ID NO: 654008 - DNA, 13 bp, Homo sapiens
attcagtaatgca

SEQ ID NO: 654009 - DNA, 15 bp, Homo sapiens
attcataaagttaca

SEQ ID NO: 654010 - DNA, 19 bp, Homo sapiens
attcataaagttacagttt

SEQ ID NO: 654011 - DNA, 19 bp, Homo sapiens
attcatctgtgaatctgct

SEQ ID NO: 654012 - DNA, 19 bp, Homo sapiens
attccagatctttcagaaa

SEQ ID NO: 654013 - DNA, 14 bp, Homo sapiens
attcccccatcctt

SEQ ID NO: 654014 - DNA, 16 bp, Homo sapiens
attccctctcatctca

SEQ ID NO: 654015 - DNA, 22 bp, Homo sapiens
attccggaaactagtgtacatt

SEQ ID NO: 654016 - DNA, 23 bp, Homo sapiens
attccggaaactagtgtacattt

SEQ ID NO: 654017 - DNA, 22 bp, Homo sapiens
attcctctcaccccactcctgt

SEQ ID NO: 654018 - DNA, 23 bp, Homo sapiens
attcctctcaccccactcctgtc

SEQ ID NO: 654019 - DNA, 17 bp, Homo sapiens
attccttgaggacagac

SEQ ID NO: 654020 - DNA, 18 bp, Homo sapiens
attccttttaaagaagct

SEQ ID NO: 654021 - DNA, 19 bp, Homo sapiens
cacagataccttgaaagga

SEQ ID NO: 654022 - DNA, 13 bp, Homo sapiens
cacagcatgtgta

SEQ ID NO: 654023 - DNA, 17 bp, Homo sapiens
cacagcccaaaatttga

SEQ ID NO: 654024 - DNA, 18 bp, Homo sapiens
cacagcgtccctggcgca

SEQ ID NO: 654025 - DNA, 17 bp, Homo sapiens
cacagctcttccagggc

SEQ ID NO: 654026 - DNA, 13 bp, Homo sapiens
cacagctgggagc

SEQ ID NO: 654027 - DNA, 15 bp, Homo sapiens
cacagctgtttgaaa

SEQ ID NO: 654028 - DNA, 19 bp, Homo sapiens
cacagcttttgtatagaaa

SEQ ID NO: 654029 - DNA, 22 bp, Homo sapiens
cacaggaaatgggaaaaaactt

SEQ ID NO: 654030 - DNA, 14 bp, Homo sapiens
cacaggaggcaggc

SEQ ID NO: 654031 - DNA, 16 bp, Homo sapiens
cacagggtgggcctcg

SEQ ID NO: 654032 - DNA, 18 bp, Homo sapiens
cacagtacagcatgtgcc

SEQ ID NO: 654033 - DNA, 20 bp, Homo sapiens
cacagtacagcatgtgcctt

SEQ ID NO: 654034 - DNA, 16 bp, Homo sapiens
cacagtcttcccagca

SEQ ID NO: 654035 - DNA, 20 bp, Homo sapiens
cacagtggggctgcaggcag

SEQ ID NO: 654036 - DNA, 22 bp, Homo sapiens
cacagtggggctgcaggcaggc

SEQ ID NO: 654037 - DNA, 13 bp, Homo sapiens
cacataccaggtc

SEQ ID NO: 654038 - DNA, 18 bp, Homo sapiens
cacatcaaataagaaata

SEQ ID NO: 654039 - DNA, 14 bp, Homo sapiens
cacatcaggaaaga

SEQ ID NO: 654040 - DNA, 16 bp, Homo sapiens
cacatcaggaaagaga

SEQ ID NO: 654041 - DNA, 23 bp, Homo sapiens
cacatccgcgtgtgcctgtgtgc

SEQ ID NO: 654042 - DNA, 13 bp, Homo sapiens
cacatctggctgc

SEQ ID NO: 654043 - DNA, 21 bp, Homo sapiens
cacatgaaacctacacactgt

SEQ ID NO: 654044 - DNA, 14 bp, Homo sapiens
cacatgccacctgg

SEQ ID NO: 654045 - DNA, 16 bp, Homo sapiens
cacatgccacctggca

SEQ ID NO: 654046 - DNA, 15 bp, Homo sapiens
cacatgctgcctggc

SEQ ID NO: 654047 - DNA, 18 bp, Homo sapiens
cacatgctgcctggcaca

SEQ ID NO: 654048 - DNA, 18 bp, Homo sapiens
cacatggaagcccaactg

SEQ ID NO: 654049 - DNA, 12 bp, Homo sapiens
cacatgtgtggt

SEQ ID NO: 654050 - DNA, 20 bp, Homo sapiens
cacattagattttattttac

SEQ ID NO: 654051 - DNA, 13 bp, Homo sapiens
cacattatttcta

SEQ ID NO: 654052 - DNA, 23 bp, Homo sapiens
cacattcagggctattttttccc

SEQ ID NO: 654053 - DNA, 21 bp, Homo sapiens
cacatttgctactgttgtaag

SEQ ID NO: 654054 - DNA, 18 bp, Homo sapiens
caccaactactacctgta

SEQ ID NO: 654055 - DNA, 17 bp, Homo sapiens
caccacccctgggcagc

SEQ ID NO: 654056 - DNA, 11 bp, Homo sapiens
caccactcagg

SEQ ID NO: 654057 - DNA, 15 bp, Homo sapiens
caccactcaggccac

SEQ ID NO: 654058 - DNA, 20 bp, Homo sapiens
caccacttttggattttatg

SEQ ID NO: 654059 - DNA, 13 bp, Homo sapiens
caccagcttcact

SEQ ID NO: 654060 - DNA, 14 bp, Homo sapiens
caccattttgtaaa

SEQ ID NO: 654061 - DNA, 12 bp, Homo sapiens
cacccaaagctg

SEQ ID NO: 654062 - DNA, 18 bp, Homo sapiens
cacccaaagctgagcctg

SEQ ID NO: 654063 - DNA, 12 bp, Homo sapiens
cacccagcaggc

SEQ ID NO: 654064 - DNA, 13 bp, Homo sapiens
cacccagcaggca

SEQ ID NO: 654065 - DNA, 19 bp, Homo sapiens
cacccatgcaagcagagga

SEQ ID NO: 654066 - DNA, 17 bp, Homo sapiens
caccccaacacttccag

SEQ ID NO: 654067 - DNA, 12 bp, Homo sapiens
caccccactcct

SEQ ID NO: 654068 - DNA, 17 bp, Homo sapiens
caccccactcctgtcag

SEQ ID NO: 654069 - DNA, 12 bp, Homo sapiens
caccccccactc

SEQ ID NO: 654070 - DNA, 18 bp, Homo sapiens
caccccctcacccctcca

SEQ ID NO: 654071 - DNA, 19 bp, Homo sapiens
cacccctctcgcctcatta

SEQ ID NO: 654072 - DNA, 15 bp, Homo sapiens
cacccctgagccagc

SEQ ID NO: 654073 - DNA, 15 bp, Homo sapiens
cacccttagaaaatg

SEQ ID NO: 654074 - DNA, 14 bp, Homo sapiens
cacccttgcaccgt

SEQ ID NO: 654075 - DNA, 14 bp, Homo sapiens
caccggtcagtgcc

SEQ ID NO: 654076 - DNA, 15 bp, Homo sapiens
caccggtcagtgcct

SEQ ID NO: 654077 - DNA, 12 bp, Homo sapiens
cacctccaggct

SEQ ID NO: 654078 - DNA, 23 bp, Homo sapiens
cacctccccccacaagtgccctc

SEQ ID NO: 654079 - DNA, 13 bp, Homo sapiens
cacctcggcacac

SEQ ID NO: 654080 - DNA, 12 bp, Homo sapiens
cacctctcctgc

SEQ ID NO: 654081 - DNA, 16 bp, Homo sapiens
cacctctcctgccctg

SEQ ID NO: 654082 - DNA, 15 bp, Homo sapiens
cacctgcaggaccct

SEQ ID NO: 654083 - DNA, 22 bp, Homo sapiens
cacctgctcccaggccccaggc

SEQ ID NO: 654084 - DNA, 20 bp, Homo sapiens
cacctgggaacacagttctg

SEQ ID NO: 654085 - DNA, 16 bp, Homo sapiens
cacctgtagtcccagc

SEQ ID NO: 654086 - DNA, 17 bp, Homo sapiens
cacctgtagtcccagct

SEQ ID NO: 654087 - DNA, 16 bp, Homo sapiens
caccttcatgattata

SEQ ID NO: 654088 - DNA, 18 bp, Homo sapiens
caccttccaacactccat

SEQ ID NO: 654089 - DNA, 13 bp, Homo sapiens
caccttgccttgc

SEQ ID NO: 654090 - DNA, 15 bp, Homo sapiens
caccttgtgcctggg

SEQ ID NO: 654091 - DNA, 14 bp, Homo sapiens
cacgagggtctccc

SEQ ID NO: 654092 - DNA, 22 bp, Homo sapiens
cacgagggtctcccctcctgca

SEQ ID NO: 654093 - DNA, 23 bp, Homo sapiens
cacgagggtctcccctcctgcac

SEQ ID NO: 654094 - DNA, 18 bp, Homo sapiens
cacggaggcctcgagcag

SEQ ID NO: 654095 - DNA, 22 bp, Homo sapiens
cacggaggcctcgagcagagag

SEQ ID NO: 654096 - DNA, 23 bp, Homo sapiens
cacggaggcctcgagcagagaga

SEQ ID NO: 654097 - DNA, 12 bp, Homo sapiens
catccctttggt

SEQ ID NO: 654098 - DNA, 17 bp, Homo sapiens
catccgcgtgtgcctgt

SEQ ID NO: 654099 - DNA, 16 bp, Homo sapiens
catcctcccgccagga

SEQ ID NO: 654100 - DNA, 22 bp, Homo sapiens
catcctcccgccaggagcttct

SEQ ID NO: 654101 - DNA, 23 bp, Homo sapiens
catcctgcagatactttgaagtg

SEQ ID NO: 654102 - DNA, 23 bp, Homo sapiens
catcctggatgaaagagccagac

SEQ ID NO: 654103 - DNA, 16 bp, Homo sapiens
catccttcagtgaact

SEQ ID NO: 654104 - DNA, 13 bp, Homo sapiens
catccttcccttt

SEQ ID NO: 654105 - DNA, 15 bp, Homo sapiens
catccttctttcctt

SEQ ID NO: 654106 - DNA, 22 bp, Homo sapiens
catcggtgaaactaacagataa

SEQ ID NO: 654107 - DNA, 17 bp, Homo sapiens
catctaatgcttgttta

SEQ ID NO: 654108 - DNA, 19 bp, Homo sapiens
catctaatgcttgtttatg

SEQ ID NO: 654109 - DNA, 13 bp, Homo sapiens
catctaattctga

SEQ ID NO: 654110 - DNA, 16 bp, Homo sapiens
catctaattctgattc

SEQ ID NO: 654111 - DNA, 17 bp, Homo sapiens
catctagccagcccctc

SEQ ID NO: 654112 - DNA, 15 bp, Homo sapiens
catctaggtcctggc

SEQ ID NO: 654113 - DNA, 18 bp, Homo sapiens
catctaggtcctggctgg

SEQ ID NO: 654114 - DNA, 14 bp, Homo sapiens
catctcaaaattat

SEQ ID NO: 654115 - DNA, 14 bp, Homo sapiens
catctccctgcctg

SEQ ID NO: 654116 - DNA, 17 bp, Homo sapiens
catctccctgcctggcc

SEQ ID NO: 654117 - DNA, 18 bp, Homo sapiens
catctccctgcctggccc

SEQ ID NO: 654118 - DNA, 17 bp, Homo sapiens
catctcccttttccatg

SEQ ID NO: 654119 - DNA, 16 bp, Homo sapiens
catctctctcttgcct

SEQ ID NO: 654120 - DNA, 12 bp, Homo sapiens
catctctgaagg

SEQ ID NO: 654121 - DNA, 19 bp, Homo sapiens
catctggaaagttttctcc

SEQ ID NO: 654122 - DNA, 18 bp, Homo sapiens
catctggctgcacaggct

SEQ ID NO: 654123 - DNA, 23 bp, Homo sapiens
catctggctggaaagcagagcct

SEQ ID NO: 654124 - DNA, 17 bp, Homo sapiens
catcttagacctccaca

SEQ ID NO: 654125 - DNA, 23 bp, Homo sapiens
catcttagagcaaagagccagca

SEQ ID NO: 654126 - DNA, 14 bp, Homo sapiens
catcttagtgcctg

SEQ ID NO: 654127 - DNA, 16 bp, Homo sapiens
catcttcaatatgaat

SEQ ID NO: 654128 - DNA, 19 bp, Homo sapiens
catcttcaatatgaatcta

SEQ ID NO: 654129 - DNA, 21 bp, Homo sapiens
catcttcacttctaaatgcat

SEQ ID NO: 654130 - DNA, 18 bp, Homo sapiens
catcttgcctccaggtgc

SEQ ID NO: 654131 - DNA, 12 bp, Homo sapiens
catgaaaaagca

SEQ ID NO: 654132 - DNA, 13 bp, Homo sapiens
catgaaatgtgaa

SEQ ID NO: 654133 - DNA, 19 bp, Homo sapiens
catgaaatgtgaattttta

SEQ ID NO: 654134 - DNA, 13 bp, Homo sapiens
catgaatgttttt

SEQ ID NO: 654135 - DNA, 20 bp, Homo sapiens
catgaattggaactgcaatg

SEQ ID NO: 654136 - DNA, 21 bp, Homo sapiens
catgaattggaactgcaatga

SEQ ID NO: 654137 - DNA, 22 bp, Homo sapiens
catgaattggaactgcaatgaa

SEQ ID NO: 654138 - DNA, 19 bp, Homo sapiens
catgagactcagtgcagat

SEQ ID NO: 654139 - DNA, 14 bp, Homo sapiens
catgagtgtgcccc

SEQ ID NO: 654140 - DNA, 15 bp, Homo sapiens
catgatagttaaact

SEQ ID NO: 654141 - DNA, 17 bp, Homo sapiens
catgatagttaaactac

SEQ ID NO: 654142 - DNA, 22 bp, Homo sapiens
catgattatagcaactaatgtt

SEQ ID NO: 654143 - DNA, 14 bp, Homo sapiens
catgatttagcaag

SEQ ID NO: 654144 - DNA, 18 bp, Homo sapiens
catgatttagcaagcaac

SEQ ID NO: 654145 - DNA, 19 bp, Homo sapiens
catgatttagcaagcaact

SEQ ID NO: 654146 - DNA, 22 bp, Homo sapiens
catgcaaatgagctctgaaatc

SEQ ID NO: 654147 - DNA, 14 bp, Homo sapiens
catgcaagcagagg

SEQ ID NO: 654148 - DNA, 23 bp, Homo sapiens
catgcaagcagaggaccagggcc

SEQ ID NO: 654149 - DNA, 14 bp, Homo sapiens
catgcaataaaatt

SEQ ID NO: 654150 - DNA, 16 bp, Homo sapiens
catgcaatttgaagta

SEQ ID NO: 654151 - DNA, 18 bp, Homo sapiens
catgcacccctgagccag

SEQ ID NO: 654152 - DNA, 22 bp, Homo sapiens
catgcacccctgagccagcagg

SEQ ID NO: 654153 - DNA, 20 bp, Homo sapiens
catgcactgatgttgtgttt

SEQ ID NO: 654154 - DNA, 15 bp, Homo sapiens
catgcagccgtgatc

SEQ ID NO: 654155 - DNA, 20 bp, Homo sapiens
catgccaaccctgggctatt

SEQ ID NO: 654156 - DNA, 14 bp, Homo sapiens
catgccacctggca

SEQ ID NO: 654157 - DNA, 13 bp, Homo sapiens
catgccaggaacc

SEQ ID NO: 654158 - DNA, 15 bp, Homo sapiens
catgcctgtcctttc

SEQ ID NO: 654159 - DNA, 21 bp, Homo sapiens
catgctacttggggacataat

SEQ ID NO: 654160 - DNA, 15 bp, Homo sapiens
catgctccaaatata

SEQ ID NO: 654161 - DNA, 15 bp, Homo sapiens
catgctgcagtgggt

SEQ ID NO: 654162 - DNA, 16 bp, Homo sapiens
catgctgcctggcaca

SEQ ID NO: 654163 - DNA, 23 bp, Homo sapiens
catgcttcatcattccctctcat

SEQ ID NO: 654164 - DNA, 13 bp, Homo sapiens
catgcttgacata

SEQ ID NO: 654165 - DNA, 18 bp, Homo sapiens
catgcttgacatacctac

SEQ ID NO: 654166 - DNA, 20 bp, Homo sapiens
catggacgtgtctgcacagg

SEQ ID NO: 654167 - DNA, 20 bp, Homo sapiens
catggaggccctcctgtgct

SEQ ID NO: 654168 - DNA, 19 bp, Homo sapiens
catggcccccaataaaggc

SEQ ID NO: 654169 - DNA, 20 bp, Homo sapiens
catggcccccaataaaggca

SEQ ID NO: 654170 - DNA, 21 bp, Homo sapiens
catggcccccaataaaggcag

SEQ ID NO: 654171 - DNA, 22 bp, Homo sapiens
catggcccccaataaaggcagc

SEQ ID NO: 654172 - DNA, 24 bp, Homo sapiens
catggcccccaataaaggcagctg

SEQ ID NO: 654173 - DNA, 16 bp, Homo sapiens
catggctccggcctct

SEQ ID NO: 654174 - DNA, 15 bp, Homo sapiens
catgggcacagtggt

SEQ ID NO: 654175 - DNA, 17 bp, Homo sapiens
catggggattgcagagt

SEQ ID NO: 654176 - DNA, 13 bp, Homo sapiens
catggtggccaga

SEQ ID NO: 654177 - DNA, 22 bp, Homo sapiens
catggttgttgcatatagttaa

SEQ ID NO: 654178 - DNA, 16 bp, Homo sapiens
catggtttgatatgta

SEQ ID NO: 654179 - DNA, 13 bp, Homo sapiens
catgtactacagc

SEQ ID NO: 654180 - DNA, 17 bp, Homo sapiens
catgtagactgtgccag

SEQ ID NO: 654181 - DNA, 19 bp, Homo sapiens
catgtagccagcagaactg

SEQ ID NO: 654182 - DNA, 17 bp, Homo sapiens
catgtatttgttatata

SEQ ID NO: 654183 - DNA, 22 bp, Homo sapiens
catgtatttgttatatataata

SEQ ID NO: 654184 - DNA, 21 bp, Homo sapiens
catgtcaattcataaaaacaa

SEQ ID NO: 654185 - DNA, 19 bp, Homo sapiens
catgtcaccggtcagtgcc

SEQ ID NO: 654186 - DNA, 20 bp, Homo sapiens
catgtcaccggtcagtgcct

SEQ ID NO: 654187 - DNA, 23 bp, Homo sapiens
catgtcaccggtcagtgcctttt

SEQ ID NO: 654188 - DNA, 12 bp, Homo sapiens
catgtccaaaga

SEQ ID NO: 654189 - DNA, 19 bp, Homo sapiens
catgtccagcaccttgtgc

SEQ ID NO: 654190 - DNA, 14 bp, Homo sapiens
catgtctgttcttc

SEQ ID NO: 654191 - DNA, 22 bp, Homo sapiens
catgtgatacattttttaagct

SEQ ID NO: 654192 - DNA, 11 bp, Homo sapiens
catgtgccttt

SEQ ID NO: 654193 - DNA, 21 bp, Homo sapiens
catgtgcctttctttgcctct

SEQ ID NO: 654194 - DNA, 23 bp, Homo sapiens
catgtgcctttctttgcctctgc

SEQ ID NO: 654195 - DNA, 13 bp, Homo sapiens
cacgtgacaggct

SEQ ID NO: 654196 - DNA, 15 bp, Homo sapiens
cacgtgacaggctcg

SEQ ID NO: 654197 - DNA, 15 bp, Homo sapiens
cactaaaagcatgaa

SEQ ID NO: 654198 - DNA, 16 bp, Homo sapiens
cactaaagcatgaaat

SEQ ID NO: 654199 - DNA, 22 bp, Homo sapiens
cactaaagcatgaaatgtgaat

SEQ ID NO: 654200 - DNA, 12 bp, Homo sapiens
cactaacattgt

SEQ ID NO: 654201 - DNA, 22 bp, Homo sapiens
cactaacattgtgactttgctt

SEQ ID NO: 654202 - DNA, 18 bp, Homo sapiens
cactaacgtgtgtgtctt

SEQ ID NO: 654203 - DNA, 23 bp, Homo sapiens
cactaattggtacttttaaaaac

SEQ ID NO: 654204 - DNA, 20 bp, Homo sapiens
cactacccgatttgtttatt

SEQ ID NO: 654205 - DNA, 18 bp, Homo sapiens
cactagggccttggaaat

SEQ ID NO: 654206 - DNA, 17 bp, Homo sapiens
cactatatatatttcta

SEQ ID NO: 654207 - DNA, 14 bp, Homo sapiens
cactcaccgaagcc

SEQ ID NO: 654208 - DNA, 17 bp, Homo sapiens
cactcaccgaagccact

SEQ ID NO: 654209 - DNA, 23 bp, Homo sapiens
cactcagccggcagccagatggc

SEQ ID NO: 654210 - DNA, 17 bp, Homo sapiens
cactcaggccacagtgg

SEQ ID NO: 654211 - DNA, 20 bp, Homo sapiens
cactcaggccacagtggggc

SEQ ID NO: 654212 - DNA, 15 bp, Homo sapiens
cactcagtgcctcca

SEQ ID NO: 654213 - DNA, 19 bp, Homo sapiens
cactcagtgcctccacatg

SEQ ID NO: 654214 - DNA, 22 bp, Homo sapiens
cactccattattcctctcaccc

SEQ ID NO: 654215 - DNA, 17 bp, Homo sapiens
cactcgtgcatccctga

SEQ ID NO: 654216 - DNA, 15 bp, Homo sapiens
cactcttgatctctc

SEQ ID NO: 654217 - DNA, 18 bp, Homo sapiens
cactcttgatctctcttg

SEQ ID NO: 654218 - DNA, 12 bp, Homo sapiens
cactcttttgat

SEQ ID NO: 654219 - DNA, 15 bp, Homo sapiens
cactgaatttataaa

SEQ ID NO: 654220 - DNA, 19 bp, Homo sapiens
cactgaatttataaagtac

SEQ ID NO: 654221 - DNA, 17 bp, Homo sapiens
cactgcaaataaagcct

SEQ ID NO: 654222 - DNA, 18 bp, Homo sapiens
cactgcaaataaagcctt

SEQ ID NO: 654223 - DNA, 20 bp, Homo sapiens
cactgcaacctcacctcccg

SEQ ID NO: 654224 - DNA, 13 bp, Homo sapiens
cactgctgagctg

SEQ ID NO: 654225 - DNA, 14 bp, Homo sapiens
cactgctgagctgg

SEQ ID NO: 654226 - DNA, 18 bp, Homo sapiens
cactgctgatcgtagaaa

SEQ ID NO: 654227 - DNA, 22 bp, Homo sapiens
cactgctgatcgtagaaaattt

SEQ ID NO: 654228 - DNA, 23 bp, Homo sapiens
cactgggaacctagctacactga

SEQ ID NO: 654229 - DNA, 22 bp, Homo sapiens
cactggtccccaacaatgtgag

SEQ ID NO: 654230 - DNA, 22 bp, Homo sapiens
cactgtaatacgtagctctctt

SEQ ID NO: 654231 - DNA, 15 bp, Homo sapiens
cactgtatgatttat

SEQ ID NO: 654232 - DNA, 16 bp, Homo sapiens
cactgtcatgcttcat

SEQ ID NO: 654233 - DNA, 12 bp, Homo sapiens
cactgtgcccca

SEQ ID NO: 654234 - DNA, 21 bp, Homo sapiens
cactgtggaaggcctccctct

SEQ ID NO: 654235 - DNA, 15 bp, Homo sapiens
cactgtggccaggcc

SEQ ID NO: 654236 - DNA, 20 bp, Homo sapiens
cacttaagttagttccactg

SEQ ID NO: 654237 - DNA, 17 bp, Homo sapiens
cagctactaatgatgtt

SEQ ID NO: 654238 - DNA, 18 bp, Homo sapiens
cagctacttgggaggctg

SEQ ID NO: 654239 - DNA, 17 bp, Homo sapiens
cagctactttaacacca

SEQ ID NO: 654240 - DNA, 21 bp, Homo sapiens
cagctatatttgattatgtat

SEQ ID NO: 654241 - DNA, 11 bp, Homo sapiens
cagctcagccc

SEQ ID NO: 654242 - DNA, 13 bp, Homo sapiens
cagctcagccctg

SEQ ID NO: 654243 - DNA, 14 bp, Homo sapiens
cagctcagccctgg

SEQ ID NO: 654244 - DNA, 21 bp, Homo sapiens
cagctcagccctggcctggct

SEQ ID NO: 654245 - DNA, 14 bp, Homo sapiens
cagctcattaaact

SEQ ID NO: 654246 - DNA, 16 bp, Homo sapiens
cagctcattaaacttt

SEQ ID NO: 654247 - DNA, 16 bp, Homo sapiens
cagctctgctatgagt

SEQ ID NO: 654248 - DNA, 13 bp, Homo sapiens
cagctcttccagg

SEQ ID NO: 654249 - DNA, 15 bp, Homo sapiens
cagctcttgaagtat

SEQ ID NO: 654250 - DNA, 15 bp, Homo sapiens
cagctctttccaaat

SEQ ID NO: 654251 - DNA, 23 bp, Homo sapiens
cagctctttccaaattaaaacaa

SEQ ID NO: 654252 - DNA, 20 bp, Homo sapiens
cagctgaagtcaaaatatgt

SEQ ID NO: 654253 - DNA, 17 bp, Homo sapiens
cagctgaggcaggggga

SEQ ID NO: 654254 - DNA, 12 bp, Homo sapiens
cagctgcctctg

SEQ ID NO: 654255 - DNA, 13 bp, Homo sapiens
cagctgcctctgc

SEQ ID NO: 654256 - DNA, 15 bp, Homo sapiens
cagctgcctctgctc

SEQ ID NO: 654257 - DNA, 17 bp, Homo sapiens
cagctgcctctgctccc

SEQ ID NO: 654258 - DNA, 18 bp, Homo sapiens
cagctgcctctgctccct

SEQ ID NO: 654259 - DNA, 16 bp, Homo sapiens
cagctgctatccccat

SEQ ID NO: 654260 - DNA, 14 bp, Homo sapiens
cagctggtccagac

SEQ ID NO: 654261 - DNA, 15 bp, Homo sapiens
cagcttatctctttt

SEQ ID NO: 654262 - DNA, 16 bp, Homo sapiens
cagcttatctctttta

SEQ ID NO: 654263 - DNA, 21 bp, Homo sapiens
cagcttctactcctgcctcat

SEQ ID NO: 654264 - DNA, 22 bp, Homo sapiens
cagcttttgtatagaaaattct

SEQ ID NO: 654265 - DNA, 15 bp, Homo sapiens
caggacatgcaataa

SEQ ID NO: 654266 - DNA, 22 bp, Homo sapiens
caggaccctgtcctgcagtccc

SEQ ID NO: 654267 - DNA, 24 bp, Homo sapiens
caggaccctgtcctgcagtcccac

SEQ ID NO: 654268 - DNA, 18 bp, Homo sapiens
caggactcctggcagggc

SEQ ID NO: 654269 - DNA, 14 bp, Homo sapiens
caggagagcctggg

SEQ ID NO: 654270 - DNA, 22 bp, Homo sapiens
caggagatcgagaccatcctgg

SEQ ID NO: 654271 - DNA, 21 bp, Homo sapiens
caggagctgtcaccaaggaaa

SEQ ID NO: 654272 - DNA, 22 bp, Homo sapiens
caggagctgtcaccaaggaaac

SEQ ID NO: 654273 - DNA, 18 bp, Homo sapiens
caggaggcaggcatggcc

SEQ ID NO: 654274 - DNA, 21 bp, Homo sapiens
caggaggcaggcatggccctg

SEQ ID NO: 654275 - DNA, 22 bp, Homo sapiens
caggaggtcaagatcagcctgg

SEQ ID NO: 654276 - DNA, 17 bp, Homo sapiens
caggaggtgtgaatgca

SEQ ID NO: 654277 - DNA, 18 bp, Homo sapiens
caggagttcaagaccagc

SEQ ID NO: 654278 - DNA, 12 bp, Homo sapiens
caggagttctga

SEQ ID NO: 654279 - DNA, 20 bp, Homo sapiens
caggatatccttatcagagc

SEQ ID NO: 654280 - DNA, 14 bp, Homo sapiens
caggcacctcttcc

SEQ ID NO: 654281 - DNA, 15 bp, Homo sapiens
caggcacctcttcct

SEQ ID NO: 654282 - DNA, 12 bp, Homo sapiens
caggcagagtgg

SEQ ID NO: 654283 - DNA, 20 bp, Homo sapiens
caggcagagtggcgtggcct

SEQ ID NO: 654284 - DNA, 18 bp, Homo sapiens
caggcagcgcagggctgg

SEQ ID NO: 654285 - DNA, 15 bp, Homo sapiens
caggcaggcggctcc

SEQ ID NO: 654286 - DNA, 21 bp, Homo sapiens
caggcaggcggctcctcctca

SEQ ID NO: 654287 - DNA, 22 bp, Homo sapiens
caggcaggcggctcctcctcac

SEQ ID NO: 654288 - DNA, 12 bp, Homo sapiens
caggcagggaga

SEQ ID NO: 654289 - DNA, 14 bp, Homo sapiens
caggcatggccctg

SEQ ID NO: 654290 - DNA, 14 bp, Homo sapiens
caggcattgaggaa

SEQ ID NO: 654291 - DNA, 13 bp, Homo sapiens
caggccccagcaa

SEQ ID NO: 654292 - DNA, 16 bp, Homo sapiens
caggcccgcttgctgg

SEQ ID NO: 654293 - DNA, 14 bp, Homo sapiens
caggccctcctctc

SEQ ID NO: 654294 - DNA, 12 bp, Homo sapiens
caggcctgcctc

SEQ ID NO: 654295 - DNA, 14 bp, Homo sapiens
caggcctgcctccc

SEQ ID NO: 654296 - DNA, 15 bp, Homo sapiens
caggcctgcctccca

SEQ ID NO: 654297 - DNA, 15 bp, Homo sapiens
caggcctgtggctcc

SEQ ID NO: 654298 - DNA, 18 bp, Homo sapiens
caggccttacatctggct

SEQ ID NO: 654299 - DNA, 18 bp, Homo sapiens
caggcggctcctcctcac

SEQ ID NO: 654300 - DNA, 21 bp, Homo sapiens
caggcggctcctcctcaccca

SEQ ID NO: 654301 - DNA, 23 bp, Homo sapiens
caggctgaaatatccacccagca

SEQ ID NO: 654302 - DNA, 11 bp, Homo sapiens
caggctgggcc

SEQ ID NO: 654303 - DNA, 20 bp, Homo sapiens
caggctgggccatgtccaaa

SEQ ID NO: 654304 - DNA, 22 bp, Homo sapiens
caggctgggccatgtccaaaga

SEQ ID NO: 654305 - DNA, 23 bp, Homo sapiens
cagggaagccccacatgtccagc

SEQ ID NO: 654306 - DNA, 17 bp, Homo sapiens
cagggaaggtgaaacag

SEQ ID NO: 654307 - DNA, 18 bp, Homo sapiens
cagggaccatcaagaacc

SEQ ID NO: 654308 - DNA, 21 bp, Homo sapiens
cagggacctttggagaccatt

SEQ ID NO: 654309 - DNA, 14 bp, Homo sapiens
cagggagcagggaa

SEQ ID NO: 654310 - DNA, 16 bp, Homo sapiens
cagggagctgggcccg

SEQ ID NO: 654311 - DNA, 12 bp, Homo sapiens
cagggaggggcc

SEQ ID NO: 654312 - DNA, 14 bp, Homo sapiens
cagggagtgctggc

SEQ ID NO: 654313 - DNA, 22 bp, Homo sapiens
cagggcaccatccagctcccca

SEQ ID NO: 654314 - DNA, 19 bp, Homo sapiens
cagggcagcagggaacaaa

SEQ ID NO: 654315 - DNA, 15 bp, Homo sapiens
cagggcagcggctcc

SEQ ID NO: 654316 - DNA, 22 bp, Homo sapiens
cagggcagtccttactccccca

SEQ ID NO: 654317 - DNA, 18 bp, Homo sapiens
cagggccacctgcaggac

SEQ ID NO: 654318 - DNA, 21 bp, Homo sapiens
cagggccacctgcaggaccct

SEQ ID NO: 654319 - DNA, 15 bp, Homo sapiens
cagggccagtggggc

SEQ ID NO: 654320 - DNA, 18 bp, Homo sapiens
cagggccagtggggcctg

SEQ ID NO: 654321 - DNA, 15 bp, Homo sapiens
cagggcctggggcct

SEQ ID NO: 654322 - DNA, 12 bp, Homo sapiens
cagggctcccag

SEQ ID NO: 654323 - DNA, 21 bp, Homo sapiens
ccacagcgtccctggcgcagg

SEQ ID NO: 654324 - DNA, 17 bp, Homo sapiens
ccacaggtgggaggagt

SEQ ID NO: 654325 - DNA, 14 bp, Homo sapiens
ccacatgaaaccta

SEQ ID NO: 654326 - DNA, 16 bp, Homo sapiens
ccacatgctgcctggc

SEQ ID NO: 654327 - DNA, 16 bp, Homo sapiens
ccaccactcaggccac

SEQ ID NO: 654328 - DNA, 19 bp, Homo sapiens
ccaccactcaggccacagt

SEQ ID NO: 654329 - DNA, 13 bp, Homo sapiens
ccacccagcaggc

SEQ ID NO: 654330 - DNA, 14 bp, Homo sapiens
ccaccctgctgctg

SEQ ID NO: 654331 - DNA, 15 bp, Homo sapiens
ccaccctgctgctgg

SEQ ID NO: 654332 - DNA, 21 bp, Homo sapiens
ccaccctgctgctggtgcaca

SEQ ID NO: 654333 - DNA, 18 bp, Homo sapiens
ccaccgtacaaccccctc

SEQ ID NO: 654334 - DNA, 16 bp, Homo sapiens
ccacctccccccacaa

SEQ ID NO: 654335 - DNA, 17 bp, Homo sapiens
ccacctcggcacacact

SEQ ID NO: 654336 - DNA, 16 bp, Homo sapiens
ccacctgctcccaggc

SEQ ID NO: 654337 - DNA, 13 bp, Homo sapiens
ccattcaattagt

SEQ ID NO: 654338 - DNA, 18 bp, Homo sapiens
ccattccctccatttttc

SEQ ID NO: 654339 - DNA, 20 bp, Homo sapiens
ccatttaatggggaggacaa

SEQ ID NO: 654340 - DNA, 22 bp, Homo sapiens
ccatttgtggtcctgaaggaaa

SEQ ID NO: 654341 - DNA, 21 bp, Homo sapiens
ccattttaattttaaagtgca

SEQ ID NO: 654342 - DNA, 17 bp, Homo sapiens
ccattttacagatttct

SEQ ID NO: 654343 - DNA, 14 bp, Homo sapiens
cccaaagctgagcc

SEQ ID NO: 654344 - DNA, 16 bp, Homo sapiens
cccaaagctgagcctg

SEQ ID NO: 654345 - DNA, 20 bp, Homo sapiens
cccaaccaggcacctcttcc

SEQ ID NO: 654346 - DNA, 13 bp, Homo sapiens
cccaacctcaggg

SEQ ID NO: 654347 - DNA, 16 bp, Homo sapiens
cccaagctgattttat

SEQ ID NO: 654348 - DNA, 21 bp, Homo sapiens
cccaaggagggggcctcattg

SEQ ID NO: 654349 - DNA, 19 bp, Homo sapiens
cccaagtcccagagcacct

SEQ ID NO: 654350 - DNA, 21 bp, Homo sapiens
cccaagtcccagagcacctca

SEQ ID NO: 654351 - DNA, 13 bp, Homo sapiens
cccaataaaggca

SEQ ID NO: 654352 - DNA, 15 bp, Homo sapiens
cccaataaaggcagc

SEQ ID NO: 654353 - DNA, 17 bp, Homo sapiens
cccaataaaggcagctg

SEQ ID NO: 654354 - DNA, 18 bp, Homo sapiens
cccaataaaggcagctgc

SEQ ID NO: 654355 - DNA, 19 bp, Homo sapiens
cccaataaaggcagctgcc

SEQ ID NO: 654356 - DNA, 21 bp, Homo sapiens
cccaataaaggcagctgcctc

SEQ ID NO: 654357 - DNA, 14 bp, Homo sapiens
cccaccactcaggc

SEQ ID NO: 654358 - DNA, 14 bp, Homo sapiens
cccacctcggcaca

SEQ ID NO: 654359 - DNA, 17 bp, Homo sapiens
cccacctcggcacacac

SEQ ID NO: 654360 - DNA, 21 bp, Homo sapiens
cccacctctcctgccctgtga

SEQ ID NO: 654361 - DNA, 12 bp, Homo sapiens
cccacctgctcc

SEQ ID NO: 654362 - DNA, 14 bp, Homo sapiens
cccacctgctccca

SEQ ID NO: 654363 - DNA, 23 bp, Homo sapiens
cccacgagggtctcccctcctgc

SEQ ID NO: 654364 - DNA, 15 bp, Homo sapiens
cccacgctcaccccc

SEQ ID NO: 654365 - DNA, 24 bp, Homo sapiens
cccactcccccgtttctccttttc

SEQ ID NO: 654366 - DNA, 12 bp, Homo sapiens
cccactcctgtc

SEQ ID NO: 654367 - DNA, 13 bp, Homo sapiens
cccactgctgagc

SEQ ID NO: 654368 - DNA, 17 bp, Homo sapiens
cccactgtatgatttat

SEQ ID NO: 654369 - DNA, 21 bp, Homo sapiens
cccactttcatctaccttttc

SEQ ID NO: 654370 - DNA, 12 bp, Homo sapiens
cccactttgtaa

SEQ ID NO: 654371 - DNA, 22 bp, Homo sapiens
cccagaatttaccatcatctct

SEQ ID NO: 654372 - DNA, 17 bp, Homo sapiens
cccagagcacctcacct

SEQ ID NO: 654373 - DNA, 23 bp, Homo sapiens
cccagatggctggaaggggtcca

SEQ ID NO: 654374 - DNA, 17 bp, Homo sapiens
cccagcactttgggagg

SEQ ID NO: 654375 - DNA, 16 bp, Homo sapiens
cccagcctcacttcct

SEQ ID NO: 654376 - DNA, 19 bp, Homo sapiens
cccagcctcacttcctttg

SEQ ID NO: 654377 - DNA, 14 bp, Homo sapiens
cccagctaattttt

SEQ ID NO: 654378 - DNA, 21 bp, Homo sapiens
cccagctaatttttgtatttt

SEQ ID NO: 654379 - DNA, 22 bp, Homo sapiens
cccagctaatttttgtattttt

SEQ ID NO: 654380 - DNA, 15 bp, Homo sapiens
cccagctacttggga

SEQ ID NO: 654381 - DNA, 18 bp, Homo sapiens
cccagctacttgggaggc

SEQ ID NO: 654382 - DNA, 20 bp, Homo sapiens
cccagctttgaggaaaatgg

SEQ ID NO: 654383 - DNA, 11 bp, Homo sapiens
cccaggcaggg

SEQ ID NO: 654384 - DNA, 12 bp, Homo sapiens
cccaggcaggga

SEQ ID NO: 654385 - DNA, 19 bp, Homo sapiens
cccaggcctgtggctccct

SEQ ID NO: 654386 - DNA, 19 bp, Homo sapiens
cccaggggtctccctggct

SEQ ID NO: 654387 - DNA, 23 bp, Homo sapiens
cccaggggtctccctggctccct

SEQ ID NO: 654388 - DNA, 14 bp, Homo sapiens
cccaggtcatggaa

SEQ ID NO: 654389 - DNA, 12 bp, Homo sapiens
cccagtgcagaa

SEQ ID NO: 654390 - DNA, 19 bp, Homo sapiens
cccagtgcatggtggccag

SEQ ID NO: 654391 - DNA, 15 bp, Homo sapiens
cccagtgcctcacct

SEQ ID NO: 654392 - DNA, 16 bp, Homo sapiens
cccagtgcctcacctt

SEQ ID NO: 654393 - DNA, 21 bp, Homo sapiens
cccagtgggaagagtgtgggg

SEQ ID NO: 654394 - DNA, 23 bp, Homo sapiens
cccataacaattcccccatcctt

SEQ ID NO: 654395 - DNA, 20 bp, Homo sapiens
cccatagcagccagttcaaa

SEQ ID NO: 654396 - DNA, 15 bp, Homo sapiens
cccatctccctgcct

SEQ ID NO: 654397 - DNA, 20 bp, Homo sapiens
cccatctccctgcctggccc

SEQ ID NO: 654398 - DNA, 15 bp, Homo sapiens
cccatctgagctggg

SEQ ID NO: 654399 - DNA, 18 bp, Homo sapiens
cccatgcaagcagaggac

SEQ ID NO: 654400 - DNA, 22 bp, Homo sapiens
cccatggcccccaataaaggca

SEQ ID NO: 654401 - DNA, 15 bp, Homo sapiens
cccatgggcacagtg

SEQ ID NO: 654402 - DNA, 16 bp, Homo sapiens
cccatgtcaccggtca

SEQ ID NO: 654403 - DNA, 22 bp, Homo sapiens
cccattttattaataatattta

SEQ ID NO: 654404 - DNA, 15 bp, Homo sapiens
ccccaaacaggacag

SEQ ID NO: 654405 - DNA, 17 bp, Homo sapiens
ccccaaacaggacagca

SEQ ID NO: 654406 - DNA, 13 bp, Homo sapiens
ccccaacctcagg

SEQ ID NO: 654407 - DNA, 20 bp, Homo sapiens
ccccaacctcagggctccca

SEQ ID NO: 654408 - DNA, 14 bp, Homo sapiens
ccccaataaaggca

SEQ ID NO: 654409 - DNA, 16 bp, Homo sapiens
ccccaataaaggcagc

SEQ ID NO: 654410 - DNA, 16 bp, Homo sapiens
ccccaatgtgacctgg

SEQ ID NO: 654411 - DNA, 18 bp, Homo sapiens
ccccaatgtgacctgggg

SEQ ID NO: 654412 - DNA, 18 bp, Homo sapiens
ccccacaagtgccctcca

SEQ ID NO: 654413 - DNA, 17 bp, Homo sapiens
ccccaccactcaggcca

SEQ ID NO: 654414 - DNA, 22 bp, Homo sapiens
ccccactcccccgtttctcctt

SEQ ID NO: 654415 - DNA, 12 bp, Homo sapiens
ccccactcctgt

SEQ ID NO: 654416 - DNA, 13 bp, Homo sapiens
ccccactcctgtc

SEQ ID NO: 654417 - DNA, 21 bp, Homo sapiens
ccccactgctgagctggccct

SEQ ID NO: 654418 - DNA, 18 bp, Homo sapiens
ccccagcccacctgctcc

SEQ ID NO: 654419 - DNA, 19 bp, Homo sapiens
ccccagcccacctgctccc

SEQ ID NO: 654420 - DNA, 22 bp, Homo sapiens
ccccagggggtctcacccatgc

SEQ ID NO: 654421 - DNA, 17 bp, Homo sapiens
ccccaggtggaaggcag

SEQ ID NO: 654422 - DNA, 19 bp, Homo sapiens
ccccatccagacctggctc

SEQ ID NO: 654423 - DNA, 14 bp, Homo sapiens
ccccatctccctgc

SEQ ID NO: 654424 - DNA, 14 bp, Homo sapiens
ccccatctgagctg

SEQ ID NO: 654425 - DNA, 18 bp, Homo sapiens
ccccatgaggaaggaaca

SEQ ID NO: 654426 - DNA, 12 bp, Homo sapiens
ccccattccctc

SEQ ID NO: 654427 - DNA, 14 bp, Homo sapiens
cccccaacctcagg

SEQ ID NO: 654428 - DNA, 18 bp, Homo sapiens
cccccaataaaggcagct

SEQ ID NO: 654429 - DNA, 15 bp, Homo sapiens
cccccaccactcagg

SEQ ID NO: 654430 - DNA, 17 bp, Homo sapiens
cccccactcagtgcctc

SEQ ID NO: 654431 - DNA, 17 bp, Homo sapiens
cccccgtggggcaggga

SEQ ID NO: 654432 - DNA, 13 bp, Homo sapiens
ccccgctgctgtg

SEQ ID NO: 654433 - DNA, 23 bp, Homo sapiens
ccccggcatgagactcagtgcag

SEQ ID NO: 654434 - DNA, 13 bp, Homo sapiens
ccccgtggggcag

SEQ ID NO: 654435 - DNA, 15 bp, Homo sapiens
cccctagagccctct

SEQ ID NO: 654436 - DNA, 21 bp, Homo sapiens
cccctccaccccccactcagt

SEQ ID NO: 654437 - DNA, 12 bp, Homo sapiens
cccctcctgcac

SEQ ID NO: 654438 - DNA, 12 bp, Homo sapiens
cccctctcacca

SEQ ID NO: 654439 - DNA, 11 bp, Homo sapiens
cccctggcttt

SEQ ID NO: 654440 - DNA, 20 bp, Homo sapiens
cccctggctttgcctcttct

SEQ ID NO: 654441 - DNA, 21 bp, Homo sapiens
cccctggctttgcctcttctt

SEQ ID NO: 654442 - DNA, 15 bp, Homo sapiens
cccctgggctggggc

SEQ ID NO: 654443 - DNA, 20 bp, Homo sapiens
cccgacacacggggctcggg

SEQ ID NO: 654444 - DNA, 12 bp, Homo sapiens
cccgcagcctcg

SEQ ID NO: 654445 - DNA, 18 bp, Homo sapiens
cccgccaggagcttcttc

SEQ ID NO: 654446 - DNA, 20 bp, Homo sapiens
cccgcccccacgtcgtgggg

SEQ ID NO: 654447 - DNA, 17 bp, Homo sapiens
cccgctcctggttggtc

SEQ ID NO: 654448 - DNA, 12 bp, Homo sapiens
cccgctgctgtg

SEQ ID NO: 654449 - DNA, 17 bp, Homo sapiens
cccgtctggacctgggg

SEQ ID NO: 654450 - DNA, 14 bp, Homo sapiens
cccgtggggcaggg

SEQ ID NO: 654451 - DNA, 21 bp, Homo sapiens
attttcataatcagtaaatag

SEQ ID NO: 654452 - DNA, 17 bp, Homo sapiens
attttcatgaaaatacc

SEQ ID NO: 654453 - DNA, 14 bp, Homo sapiens
attttcatttcatg

SEQ ID NO: 654454 - DNA, 18 bp, Homo sapiens
attttcctgacatttgtt

SEQ ID NO: 654455 - DNA, 19 bp, Homo sapiens
attttcctgacatttgttt

SEQ ID NO: 654456 - DNA, 16 bp, Homo sapiens
attttctccacttcat

SEQ ID NO: 654457 - DNA, 22 bp, Homo sapiens
attttgaaacaaagtactcttt

SEQ ID NO: 654458 - DNA, 21 bp, Homo sapiens
attttgagaaactgctgcaga

SEQ ID NO: 654459 - DNA, 13 bp, Homo sapiens
attttgagatgta

SEQ ID NO: 654460 - DNA, 19 bp, Homo sapiens
attttgagatgtaaaaaga

SEQ ID NO: 654461 - DNA, 11 bp, Homo sapiens
attttgcacaa

SEQ ID NO: 654462 - DNA, 19 bp, Homo sapiens
attttgctggaattcctaa

SEQ ID NO: 654463 - DNA, 13 bp, Homo sapiens
attttggaaattg

SEQ ID NO: 654464 - DNA, 20 bp, Homo sapiens
attttggagattataataaa

SEQ ID NO: 654465 - DNA, 23 bp, Homo sapiens
attttgtaatgtatcaaatacat

SEQ ID NO: 654466 - DNA, 15 bp, Homo sapiens
attttgtatgttaaa

SEQ ID NO: 654467 - DNA, 15 bp, Homo sapiens
attttgtcttattct

SEQ ID NO: 654468 - DNA, 16 bp, Homo sapiens
attttgtgtaagaaat

SEQ ID NO: 654469 - DNA, 13 bp, Homo sapiens
atttttaaaaaga

SEQ ID NO: 654470 - DNA, 18 bp, Homo sapiens
atttttagactatttctt

SEQ ID NO: 654471 - DNA, 12 bp, Homo sapiens
atttttataatt

SEQ ID NO: 654472 - DNA, 23 bp, Homo sapiens
atttttatacaagtaatttcctg

SEQ ID NO: 654473 - DNA, 13 bp, Homo sapiens
atttttatttatg

SEQ ID NO: 654474 - DNA, 15 bp, Homo sapiens
atttttatttttgca

SEQ ID NO: 654475 - DNA, 15 bp, Homo sapiens
atttttcataaacaa

SEQ ID NO: 654476 - DNA, 17 bp, Homo sapiens
atttttccgtttgcttt

SEQ ID NO: 654477 - DNA, 15 bp, Homo sapiens
atttttctcccaaga

SEQ ID NO: 654478 - DNA, 20 bp, Homo sapiens
atttttctcccaagaaacct

SEQ ID NO: 654479 - DNA, 21 bp, Homo sapiens
atttttctcccaagaaacctg

SEQ ID NO: 654480 - DNA, 19 bp, Homo sapiens
atttttgaagcaaagaagg

SEQ ID NO: 654481 - DNA, 20 bp, Homo sapiens
atttttgctccaatatccat

SEQ ID NO: 654482 - DNA, 16 bp, Homo sapiens
atttttgtctcagaag

SEQ ID NO: 654483 - DNA, 21 bp, Homo sapiens
attttttaagcttcagttgct

SEQ ID NO: 654484 - DNA, 15 bp, Homo sapiens
atttttttaaaattt

SEQ ID NO: 654485 - DNA, 23 bp, Homo sapiens
atttttttttcatagagatttgt

SEQ ID NO: 654486 - DNA, 19 bp, Homo sapiens
caaaaaaaatttagccggg

SEQ ID NO: 654487 - DNA, 11 bp, Homo sapiens
caaaaaattat

SEQ ID NO: 654488 - DNA, 24 bp, Homo sapiens
caaaaaggagccttttgctctctg

SEQ ID NO: 654489 - DNA, 12 bp, Homo sapiens
caaaaataatag

SEQ ID NO: 654490 - DNA, 20 bp, Homo sapiens
caaaaatcccaccttcccac

SEQ ID NO: 654491 - DNA, 23 bp, Homo sapiens
caaaaattcagagtccttgcaaa

SEQ ID NO: 654492 - DNA, 12 bp, Homo sapiens
caaaacaaaggc

SEQ ID NO: 654493 - DNA, 16 bp, Homo sapiens
caaaacaaaggcctaa

SEQ ID NO: 654494 - DNA, 22 bp, Homo sapiens
caaaacaaaggcctaattctat

SEQ ID NO: 654495 - DNA, 16 bp, Homo sapiens
caaaagaaaattgata

SEQ ID NO: 654496 - DNA, 20 bp, Homo sapiens
caaaagaaaattgatatttt

SEQ ID NO: 654497 - DNA, 14 bp, Homo sapiens
caaaagaataagac

SEQ ID NO: 654498 - DNA, 14 bp, Homo sapiens
caaaagatttattg

SEQ ID NO: 654499 - DNA, 18 bp, Homo sapiens
caaaagtttgtttgctta

SEQ ID NO: 654500 - DNA, 14 bp, Homo sapiens
caaaatgtgtattt

SEQ ID NO: 654501 - DNA, 16 bp, Homo sapiens
caaaatgtgtatttct

SEQ ID NO: 654502 - DNA, 12 bp, Homo sapiens
caaaatttagaa

SEQ ID NO: 654503 - DNA, 14 bp, Homo sapiens
caaaattttatttt

SEQ ID NO: 654504 - DNA, 12 bp, Homo sapiens
caaacagtattt

SEQ ID NO: 654505 - DNA, 15 bp, Homo sapiens
caaacagtatttctg

SEQ ID NO: 654506 - DNA, 16 bp, Homo sapiens
caaacatgtatgtata

SEQ ID NO: 654507 - DNA, 14 bp, Homo sapiens
caaacctttgagta

SEQ ID NO: 654508 - DNA, 16 bp, Homo sapiens
caaactcctttcttat

SEQ ID NO: 654509 - DNA, 21 bp, Homo sapiens
caaactgcttcccttactttg

SEQ ID NO: 654510 - DNA, 20 bp, Homo sapiens
caaactgttctgagaaggtg

SEQ ID NO: 654511 - DNA, 16 bp, Homo sapiens
caaacttactattttg

SEQ ID NO: 654512 - DNA, 12 bp, Homo sapiens
caaagaaatatt

SEQ ID NO: 654513 - DNA, 19 bp, Homo sapiens
caaagaactccagagtcag

SEQ ID NO: 654514 - DNA, 14 bp, Homo sapiens
caaagagaattgta

SEQ ID NO: 654515 - DNA, 19 bp, Homo sapiens
caaagataatttatttcaa

SEQ ID NO: 654516 - DNA, 19 bp, Homo sapiens
ctggggcctcagaccccct

SEQ ID NO: 654517 - DNA, 13 bp, Homo sapiens
ctggggcctgaga

SEQ ID NO: 654518 - DNA, 13 bp, Homo sapiens
ctgggggcacagg

SEQ ID NO: 654519 - DNA, 14 bp, Homo sapiens
ctgggggcacagga

SEQ ID NO: 654520 - DNA, 16 bp, Homo sapiens
ctggggggacccagtg

SEQ ID NO: 654521 - DNA, 19 bp, Homo sapiens
ctggggggacccagtgcag

SEQ ID NO: 654522 - DNA, 18 bp, Homo sapiens
ctggggtgcatctcctcc

SEQ ID NO: 654523 - DNA, 22 bp, Homo sapiens
ctggggttgcgtctgaggcctg

SEQ ID NO: 654524 - DNA, 18 bp, Homo sapiens
ctgggtactgaaagcctt

SEQ ID NO: 654525 - DNA, 23 bp, Homo sapiens
ctgggtactgaggtgctatgaag

SEQ ID NO: 654526 - DNA, 16 bp, Homo sapiens
ctgggtccatcctggt

SEQ ID NO: 654527 - DNA, 17 bp, Homo sapiens
ctgggtccatcctggtc

SEQ ID NO: 654528 - DNA, 17 bp, Homo sapiens
ctgggtcttttgctact

SEQ ID NO: 654529 - DNA, 20 bp, Homo sapiens
ctgggtggtattctggtagg

SEQ ID NO: 654530 - DNA, 13 bp, Homo sapiens
ctgggtttcaaga

SEQ ID NO: 654531 - DNA, 18 bp, Homo sapiens
ctggtacaacggaggcct

SEQ ID NO: 654532 - DNA, 15 bp, Homo sapiens
ctggtccccactgct

SEQ ID NO: 654533 - DNA, 17 bp, Homo sapiens
ctggtccccactgctga

SEQ ID NO: 654534 - DNA, 19 bp, Homo sapiens
ctggtccccactgctgagc

SEQ ID NO: 654535 - DNA, 20 bp, Homo sapiens
ctggtccccactgctgagct

SEQ ID NO: 654536 - DNA, 13 bp, Homo sapiens
ctggtccttattt

SEQ ID NO: 654537 - DNA, 14 bp, Homo sapiens
ctggtcggagaggg

SEQ ID NO: 654538 - DNA, 15 bp, Homo sapiens
ctggtcttgttagaa

SEQ ID NO: 654539 - DNA, 20 bp, Homo sapiens
ctggtcttgttagaaaacaa

SEQ ID NO: 654540 - DNA, 15 bp, Homo sapiens
ctggtgagaaaatat

SEQ ID NO: 654541 - DNA, 22 bp, Homo sapiens
ctggtgagtaacttagaaaagt

SEQ ID NO: 654542 - DNA, 17 bp, Homo sapiens
ctggtgctgcagcaccg

SEQ ID NO: 654543 - DNA, 23 bp, Homo sapiens
ctggtgtgttcaagaccagcctg

SEQ ID NO: 654544 - DNA, 20 bp, Homo sapiens
ctggttatatcattctgggt

SEQ ID NO: 654545 - DNA, 17 bp, Homo sapiens
ctggttcagacacagct

SEQ ID NO: 654546 - DNA, 16 bp, Homo sapiens
ctggttccctgctgcg

SEQ ID NO: 654547 - DNA, 19 bp, Homo sapiens
ctggtttaattcagcagag

SEQ ID NO: 654548 - DNA, 13 bp, Homo sapiens
ctgtaaatatatc

SEQ ID NO: 654549 - DNA, 15 bp, Homo sapiens
ctgtaacttaaaata

SEQ ID NO: 654550 - DNA, 17 bp, Homo sapiens
ctgtaagcctatatata

SEQ ID NO: 654551 - DNA, 20 bp, Homo sapiens
ctgtaatacgtagctctctt

SEQ ID NO: 654552 - DNA, 21 bp, Homo sapiens
ctgtaatacgtagctctctta

SEQ ID NO: 654553 - DNA, 17 bp, Homo sapiens
ccctaggaactcagtcc

SEQ ID NO: 654554 - DNA, 15 bp, Homo sapiens
ccctcagccttggga

SEQ ID NO: 654555 - DNA, 19 bp, Homo sapiens
ccctcccacacccaaagct

SEQ ID NO: 654556 - DNA, 18 bp, Homo sapiens
ccctcccccattccctcc

SEQ ID NO: 654557 - DNA, 21 bp, Homo sapiens
ccctccgaccacttccagggg

SEQ ID NO: 654558 - DNA, 15 bp, Homo sapiens
ccctcctccaggcct

SEQ ID NO: 654559 - DNA, 23 bp, Homo sapiens
ccctcctccaggcctgcctccca

SEQ ID NO: 654560 - DNA, 14 bp, Homo sapiens
ccctccttctcctt

SEQ ID NO: 654561 - DNA, 20 bp, Homo sapiens
ccctctcatctcaggtagaa

SEQ ID NO: 654562 - DNA, 17 bp, Homo sapiens
ccctctccttgccccca

SEQ ID NO: 654563 - DNA, 17 bp, Homo sapiens
ccctctcgcctcattac

SEQ ID NO: 654564 - DNA, 17 bp, Homo sapiens
ccctcttgcccatcctg

SEQ ID NO: 654565 - DNA, 22 bp, Homo sapiens
ccctcttgcccatcctgactga

SEQ ID NO: 654566 - DNA, 21 bp, Homo sapiens
ccctgaaacctagtactgccc

SEQ ID NO: 654567 - DNA, 16 bp, Homo sapiens
ccctgagaagctgctc

SEQ ID NO: 654568 - DNA, 15 bp, Homo sapiens
ccctgagccagcagg

SEQ ID NO: 654569 - DNA, 16 bp, Homo sapiens
ccctgagccagcaggg

SEQ ID NO: 654570 - DNA, 13 bp, Homo sapiens
ccctgcaaacaga

SEQ ID NO: 654571 - DNA, 18 bp, Homo sapiens
ccctgcaaacagaacagg

SEQ ID NO: 654572 - DNA, 22 bp, Homo sapiens
ccctgcaaacagaacagggtca

SEQ ID NO: 654573 - DNA, 18 bp, Homo sapiens
ccctgcagcccccactca

SEQ ID NO: 654574 - DNA, 21 bp, Homo sapiens
ccctgcagcggtggttgtcac

SEQ ID NO: 654575 - DNA, 13 bp, Homo sapiens
ccctgcctggccc

SEQ ID NO: 654576 - DNA, 12 bp, Homo sapiens
ccctgctgcgct

SEQ ID NO: 654577 - DNA, 15 bp, Homo sapiens
ccctgctgcgctgct

SEQ ID NO: 654578 - DNA, 17 bp, Homo sapiens
ccctgctgcgctgcttg

SEQ ID NO: 654579 - DNA, 13 bp, Homo sapiens
ccctgctgctggt

SEQ ID NO: 654580 - DNA, 16 bp, Homo sapiens
ccctgctgctggtgca

SEQ ID NO: 654581 - DNA, 19 bp, Homo sapiens
ccctggaaatccctttctg

SEQ ID NO: 654582 - DNA, 12 bp, Homo sapiens
ccctggcctggc

SEQ ID NO: 654583 - DNA, 18 bp, Homo sapiens
ccctggctccctcctcca

SEQ ID NO: 654584 - DNA, 23 bp, Homo sapiens
ccctggctccctcctccaggcct

SEQ ID NO: 654585 - DNA, 15 bp, Homo sapiens
ccctggctttgcctc

SEQ ID NO: 654586 - DNA, 16 bp, Homo sapiens
ccctggctttgcctct

SEQ ID NO: 654587 - DNA, 20 bp, Homo sapiens
ccctggctttgcctcttctt

SEQ ID NO: 654588 - DNA, 18 bp, Homo sapiens
ccctgggagccgcctgct

SEQ ID NO: 654589 - DNA, 13 bp, Homo sapiens
ccctgggccaggg

SEQ ID NO: 654590 - DNA, 13 bp, Homo sapiens
ccctgggggtctg

SEQ ID NO: 654591 - DNA, 19 bp, Homo sapiens
ccctgggggtctgggcgtc

SEQ ID NO: 654592 - DNA, 15 bp, Homo sapiens
ccctgggtctgggga

SEQ ID NO: 654593 - DNA, 17 bp, Homo sapiens
ccctggtcggagaggga

SEQ ID NO: 654594 - DNA, 15 bp, Homo sapiens
ccctgtaggcctcag

SEQ ID NO: 654595 - DNA, 21 bp, Homo sapiens
ccctgtgtccacctgtgggtg

SEQ ID NO: 654596 - DNA, 13 bp, Homo sapiens
ccctgtgtgcagg

SEQ ID NO: 654597 - DNA, 10 bp, Homo sapiens
ccctgtgtgt

SEQ ID NO: 654598 - DNA, 11 bp, Homo sapiens
ccctgtgtgtg

SEQ ID NO: 654599 - DNA, 16 bp, Homo sapiens
ccctgttttttgtaga

SEQ ID NO: 654600 - DNA, 21 bp, Homo sapiens
cccttaaacacaggctgtcct

SEQ ID NO: 654601 - DNA, 13 bp, Homo sapiens
cccttataaaatc

SEQ ID NO: 654602 - DNA, 11 bp, Homo sapiens
cccttccagga

SEQ ID NO: 654603 - DNA, 20 bp, Homo sapiens
cccttccatgtgcctttctt

SEQ ID NO: 654604 - DNA, 20 bp, Homo sapiens
cccttcctcttgtctgattt

SEQ ID NO: 654605 - DNA, 12 bp, Homo sapiens
cccttctctgtt

SEQ ID NO: 654606 - DNA, 16 bp, Homo sapiens
cccttgcctctgccct

SEQ ID NO: 654607 - DNA, 22 bp, Homo sapiens
cccttgcttgcctgcagggcca

SEQ ID NO: 654608 - DNA, 14 bp, Homo sapiens
ccctttctgtccca

SEQ ID NO: 654609 - DNA, 15 bp, Homo sapiens
ccctttctgtcccac

SEQ ID NO: 654610 - DNA, 23 bp, Homo sapiens
ccctttggagatgctgagggtgt

SEQ ID NO: 654611 - DNA, 17 bp, Homo sapiens
ccgaccacttccagggg

SEQ ID NO: 654612 - DNA, 22 bp, Homo sapiens
ccgacgacacatatacatatga

SEQ ID NO: 654613 - DNA, 23 bp, Homo sapiens
ccgacgccgtcccaccagcttca

SEQ ID NO: 654614 - DNA, 24 bp, Homo sapiens
ccgacgccgtcccaccagcttcac

SEQ ID NO: 654615 - DNA, 14 bp, Homo sapiens
ccgacgtcatgtat

SEQ ID NO: 654616 - DNA, 18 bp, Homo sapiens
ccgactgactggaggagg

SEQ ID NO: 654617 - DNA, 14 bp, Homo sapiens
ccgagtgactctgg

SEQ ID NO: 654618 - DNA, 18 bp, Homo sapiens
ccgatagagggacggcca

SEQ ID NO: 654619 - DNA, 14 bp, Homo sapiens
ccgatttgtttatt

SEQ ID NO: 654620 - DNA, 17 bp, Homo sapiens
ccgcgtgtgcctgtgtg

SEQ ID NO: 654621 - DNA, 15 bp, Homo sapiens
ccgctgccagccttg

SEQ ID NO: 654622 - DNA, 16 bp, Homo sapiens
ccgctgccccatgtgt

SEQ ID NO: 654623 - DNA, 23 bp, Homo sapiens
ccgcttgaaaagctagtgtacct

SEQ ID NO: 654624 - DNA, 16 bp, Homo sapiens
ccggcagccagatggc

SEQ ID NO: 654625 - DNA, 20 bp, Homo sapiens
ccggcagccagatggccccg

SEQ ID NO: 654626 - DNA, 15 bp, Homo sapiens
ccggtcagtgccttt

SEQ ID NO: 654627 - DNA, 18 bp, Homo sapiens
ccggtgtatcctggccct

SEQ ID NO: 654628 - DNA, 14 bp, Homo sapiens
ccgtagctctgctg

SEQ ID NO: 654629 - DNA, 16 bp, Homo sapiens
ccgtagctctgctgct

SEQ ID NO: 654630 - DNA, 21 bp, Homo sapiens
ccgtgcccacgagggtctccc

SEQ ID NO: 654631 - DNA, 21 bp, Homo sapiens
ccgtgtgagtgtgacagggcc

SEQ ID NO: 654632 - DNA, 21 bp, Homo sapiens
ccgtgtggtaagcaacatggc

SEQ ID NO: 654633 - DNA, 22 bp, Homo sapiens
ccgtgtggtaagcaacatggct

SEQ ID NO: 654634 - DNA, 14 bp, Homo sapiens
ccgttcacatgtgt

SEQ ID NO: 654635 - DNA, 13 bp, Homo sapiens
ccgtttctccttt

SEQ ID NO: 654636 - DNA, 17 bp, Homo sapiens
ccgtttctccttttcct

SEQ ID NO: 654637 - DNA, 13 bp, Homo sapiens
ccgtttgcttttg

SEQ ID NO: 654638 - DNA, 19 bp, Homo sapiens
cctaaaataacagtatgtg

SEQ ID NO: 654639 - DNA, 23 bp, Homo sapiens
cctaaaataacagtatgtgggat

SEQ ID NO: 654640 - DNA, 18 bp, Homo sapiens
cctaacacagcatgtgta

SEQ ID NO: 654641 - DNA, 14 bp, Homo sapiens
cctaacttttcaat

SEQ ID NO: 654642 - DNA, 18 bp, Homo sapiens
cctaagtggctgccttct

SEQ ID NO: 654643 - DNA, 19 bp, Homo sapiens
cctaagtggctgccttctt

SEQ ID NO: 654644 - DNA, 20 bp, Homo sapiens
cctaatggctatttttgaag

SEQ ID NO: 654645 - DNA, 18 bp, Homo sapiens
cctaatgtttatgagcca

SEQ ID NO: 654646 - DNA, 17 bp, Homo sapiens
cctaattctatgcctgt

SEQ ID NO: 654647 - DNA, 17 bp, Homo sapiens
cctacagactccatctc

SEQ ID NO: 654648 - DNA, 21 bp, Homo sapiens
cctacagtgactccctgggag

SEQ ID NO: 654649 - DNA, 17 bp, Homo sapiens
cctagagccctctcctc

SEQ ID NO: 654650 - DNA, 15 bp, Homo sapiens
cctagctacactgag

SEQ ID NO: 654651 - DNA, 18 bp, Homo sapiens
cctagctacactgagcag

SEQ ID NO: 654652 - DNA, 20 bp, Homo sapiens
cctagctcctccccttcctc

SEQ ID NO: 654653 - DNA, 13 bp, Homo sapiens
cctagtactgccc

SEQ ID NO: 654654 - DNA, 19 bp, Homo sapiens
cctagtttcttacacactg

SEQ ID NO: 654655 - DNA, 14 bp, Homo sapiens
cctatccctctcct

SEQ ID NO: 654656 - DNA, 15 bp, Homo sapiens
cctatccctctccta

SEQ ID NO: 654657 - DNA, 17 bp, Homo sapiens
cctatccgctgccagcc

SEQ ID NO: 654658 - DNA, 18 bp, Homo sapiens
cctatccgctgccagcct

SEQ ID NO: 654659 - DNA, 16 bp, Homo sapiens
cctatctatcttccaa

SEQ ID NO: 654660 - DNA, 16 bp, Homo sapiens
cctattctataaaact

SEQ ID NO: 654661 - DNA, 12 bp, Homo sapiens
cctatttaatac

SEQ ID NO: 654662 - DNA, 15 bp, Homo sapiens
cctatttaatacagc

SEQ ID NO: 654663 - DNA, 19 bp, Homo sapiens
cctcaagggggactgtctt

SEQ ID NO: 654664 - DNA, 23 bp, Homo sapiens
cctcacacaccctgaggtcaggg

SEQ ID NO: 654665 - DNA, 11 bp, Homo sapiens
cctcacttcct

SEQ ID NO: 654666 - DNA, 13 bp, Homo sapiens
cctcacttccttt

SEQ ID NO: 654667 - DNA, 16 bp, Homo sapiens
cctcagattcttcatt

SEQ ID NO: 654668 - DNA, 20 bp, Homo sapiens
cctcagggagcagggaaggc

SEQ ID NO: 654669 - DNA, 23 bp, Homo sapiens
cctcagggagcagggaaggcctg

SEQ ID NO: 654670 - DNA, 24 bp, Homo sapiens
cctcaggtgttttttatgaagtgc

SEQ ID NO: 654671 - DNA, 15 bp, Homo sapiens
cctcagtccctcttc

SEQ ID NO: 654672 - DNA, 15 bp, Homo sapiens
cctccaccccccact

SEQ ID NO: 654673 - DNA, 15 bp, Homo sapiens
ctccatcctgcagat

SEQ ID NO: 654674 - DNA, 13 bp, Homo sapiens
ctccatggaaaag

SEQ ID NO: 654675 - DNA, 14 bp, Homo sapiens
ctccatggaaaagc

SEQ ID NO: 654676 - DNA, 16 bp, Homo sapiens
ctccatttttctccca

SEQ ID NO: 654677 - DNA, 22 bp, Homo sapiens
ctcccacacccaaagctgagcc

SEQ ID NO: 654678 - DNA, 16 bp, Homo sapiens
ctcccaggccccaggc

SEQ ID NO: 654679 - DNA, 18 bp, Homo sapiens
ctcccaggccccaggcct

SEQ ID NO: 654680 - DNA, 16 bp, Homo sapiens
ctcccaggggtctccc

SEQ ID NO: 654681 - DNA, 21 bp, Homo sapiens
ctcccaggggtctccctggct

SEQ ID NO: 654682 - DNA, 15 bp, Homo sapiens
ctccccaacccccaa

SEQ ID NO: 654683 - DNA, 11 bp, Homo sapiens
ctccccacagc

SEQ ID NO: 654684 - DNA, 19 bp, Homo sapiens
ctccccacagcgtccctgg

SEQ ID NO: 654685 - DNA, 19 bp, Homo sapiens
ctcccccaccactcaggcc

SEQ ID NO: 654686 - DNA, 17 bp, Homo sapiens
ctccccccgcctgccac

SEQ ID NO: 654687 - DNA, 13 bp, Homo sapiens
ctcccctcctgca

SEQ ID NO: 654688 - DNA, 14 bp, Homo sapiens
ctcccctctcagca

SEQ ID NO: 654689 - DNA, 17 bp, Homo sapiens
ctcccgattcccaactg

SEQ ID NO: 654690 - DNA, 19 bp, Homo sapiens
ctcccgcccttccatgtgc

SEQ ID NO: 654691 - DNA, 21 bp, Homo sapiens
ctcccgcccttccatgtgcct

SEQ ID NO: 654692 - DNA, 14 bp, Homo sapiens
ctccctagctcctc

SEQ ID NO: 654693 - DNA, 16 bp, Homo sapiens
ctccctccttctcctt

SEQ ID NO: 654694 - DNA, 18 bp, Homo sapiens
ctccctctgatttttcat

SEQ ID NO: 654695 - DNA, 14 bp, Homo sapiens
ctccctctgtccct

SEQ ID NO: 654696 - DNA, 15 bp, Homo sapiens
ctccctgcctggccc

SEQ ID NO: 654697 - DNA, 13 bp, Homo sapiens
ctccctgggagcc

SEQ ID NO: 654698 - DNA, 13 bp, Homo sapiens
ctccctgtgtcca

SEQ ID NO: 654699 - DNA, 14 bp, Homo sapiens
ctcccttggtgccc

SEQ ID NO: 654700 - DNA, 17 bp, Homo sapiens
ctcccttggtgccctcg

SEQ ID NO: 654701 - DNA, 18 bp, Homo sapiens
ctcccttggtgccctcgc

SEQ ID NO: 654702 - DNA, 20 bp, Homo sapiens
ctcccttggtgccctcgcct

SEQ ID NO: 654703 - DNA, 16 bp, Homo sapiens
ctccgaggtggttcag

SEQ ID NO: 654704 - DNA, 16 bp, Homo sapiens
ctccgtagctctgctg

SEQ ID NO: 654705 - DNA, 19 bp, Homo sapiens
ctccgtagctctgctgctg

SEQ ID NO: 654706 - DNA, 15 bp, Homo sapiens
ctccgttccatctgg

SEQ ID NO: 654707 - DNA, 19 bp, Homo sapiens
ctccgttccatctgggctt

SEQ ID NO: 654708 - DNA, 22 bp, Homo sapiens
ctcctagaagaaccaaatacct

SEQ ID NO: 654709 - DNA, 16 bp, Homo sapiens
ctcctattctataaaa

SEQ ID NO: 654710 - DNA, 20 bp, Homo sapiens
ctcctcatggcagcctactc

SEQ ID NO: 654711 - DNA, 15 bp, Homo sapiens
ctcctccaggcctgc

SEQ ID NO: 654712 - DNA, 23 bp, Homo sapiens
ctcctccaggcctgcctcccact

SEQ ID NO: 654713 - DNA, 17 bp, Homo sapiens
ctcctccccttcctctt

SEQ ID NO: 654714 - DNA, 14 bp, Homo sapiens
ctcctccctctgtc

SEQ ID NO: 654715 - DNA, 10 bp, Homo sapiens
ctcctctccc

SEQ ID NO: 654716 - DNA, 17 bp, Homo sapiens
ctcctgcacacagggca

SEQ ID NO: 654717 - DNA, 20 bp, Homo sapiens
ctcctgccctcctctcccct

SEQ ID NO: 654718 - DNA, 19 bp, Homo sapiens
ctcctgcctttctcaactg

SEQ ID NO: 654719 - DNA, 22 bp, Homo sapiens
ctcctggaacagaagacagctg

SEQ ID NO: 654720 - DNA, 10 bp, Homo sapiens
ctcctggcag

SEQ ID NO: 654721 - DNA, 23 bp, Homo sapiens
ctcctggcagggccacctgcagg

SEQ ID NO: 654722 - DNA, 24 bp, Homo sapiens
ctcctggcagggccacctgcagga

SEQ ID NO: 654723 - DNA, 17 bp, Homo sapiens
ctcctgggaacacatct

SEQ ID NO: 654724 - DNA, 18 bp, Homo sapiens
ctcctgtcccttttccct

SEQ ID NO: 654725 - DNA, 19 bp, Homo sapiens
ctcctgtcccttttccctt

SEQ ID NO: 654726 - DNA, 17 bp, Homo sapiens
ctcctgtctaactgctg

SEQ ID NO: 654727 - DNA, 13 bp, Homo sapiens
ctcctgtgctggg

SEQ ID NO: 654728 - DNA, 16 bp, Homo sapiens
ctcctgtggggaaagg

SEQ ID NO: 654729 - DNA, 18 bp, Homo sapiens
ctccttaggtgcccagaa

SEQ ID NO: 654730 - DNA, 20 bp, Homo sapiens
ctccttccccgagtgactct

SEQ ID NO: 654731 - DNA, 19 bp, Homo sapiens
ctccttgagtgtatgagta

SEQ ID NO: 654732 - DNA, 14 bp, Homo sapiens
ctccttgcccccag

SEQ ID NO: 654733 - DNA, 22 bp, Homo sapiens
ctcgagaaccaaccagggaagc

SEQ ID NO: 654734 - DNA, 19 bp, Homo sapiens
ctcgcccctgttttttgta

SEQ ID NO: 654735 - DNA, 19 bp, Homo sapiens
ctcgcctcctcctcctgcc

SEQ ID NO: 654736 - DNA, 15 bp, Homo sapiens
ctcggcccctcccac

SEQ ID NO: 654737 - DNA, 18 bp, Homo sapiens
ctcgtcagccacctggga

SEQ ID NO: 654738 - DNA, 19 bp, Homo sapiens
ctcgtcagccacctgggaa

SEQ ID NO: 654739 - DNA, 19 bp, Homo sapiens
ctctaccaaaaaaaggaag

SEQ ID NO: 654740 - DNA, 18 bp, Homo sapiens
ctctagtagtgtggcctg

SEQ ID NO: 654741 - DNA, 21 bp, Homo sapiens
ctctagtagtgtggcctgtgc

SEQ ID NO: 654742 - DNA, 18 bp, Homo sapiens
ctctcaagctagtgtttc

SEQ ID NO: 654743 - DNA, 21 bp, Homo sapiens
ctctcaagctagtgtttctag

SEQ ID NO: 654744 - DNA, 12 bp, Homo sapiens
ctctcaccccac

SEQ ID NO: 654745 - DNA, 23 bp, Homo sapiens
ctctcagcatttccttgtcccgt

SEQ ID NO: 654746 - DNA, 13 bp, Homo sapiens
ctctcagtgtttt

SEQ ID NO: 654747 - DNA, 13 bp, Homo sapiens
ctctcctgccctg

SEQ ID NO: 654748 - DNA, 14 bp, Homo sapiens
ctctcctgccctgt

SEQ ID NO: 654749 - DNA, 15 bp, Homo sapiens
ctctcctgccctgtg

SEQ ID NO: 654750 - DNA, 16 bp, Homo sapiens
ctctcctgccctgtga

SEQ ID NO: 654751 - DNA, 14 bp, Homo sapiens
ctctccttgagtgt

SEQ ID NO: 654752 - DNA, 19 bp, Homo sapiens
ctctccttgcccccagtgc

SEQ ID NO: 654753 - DNA, 21 bp, Homo sapiens
ctctccttgcccccagtgcct

SEQ ID NO: 654754 - DNA, 13 bp, Homo sapiens
ctctctacagtgc

SEQ ID NO: 654755 - DNA, 18 bp, Homo sapiens
ctctctgtcccttgctgt

SEQ ID NO: 654756 - DNA, 23 bp, Homo sapiens
ctctctgtcccttgctgtatgct

SEQ ID NO: 654757 - DNA, 21 bp, Homo sapiens
ctctgacaactgtgaagccac

SEQ ID NO: 654758 - DNA, 17 bp, Homo sapiens
ctctgcaagaagaaatc

SEQ ID NO: 654759 - DNA, 17 bp, Homo sapiens
ctctgcagtctcatttc

SEQ ID NO: 654760 - DNA, 19 bp, Homo sapiens
ctctgcagtctcatttctc

SEQ ID NO: 654761 - DNA, 22 bp, Homo sapiens
ctctgccctcattactgggcct

SEQ ID NO: 654762 - DNA, 11 bp, Homo sapiens
ctctgccctgg

SEQ ID NO: 654763 - DNA, 13 bp, Homo sapiens
ctctgccctggat

SEQ ID NO: 654764 - DNA, 22 bp, Homo sapiens
ctctgctcaccgcccatcaggg

SEQ ID NO: 654765 - DNA, 13 bp, Homo sapiens
ctctgctccctct

SEQ ID NO: 654766 - DNA, 17 bp, Homo sapiens
ctctgggctgccatgtg

SEQ ID NO: 654767 - DNA, 13 bp, Homo sapiens
ctctggtgtttat

SEQ ID NO: 654768 - DNA, 18 bp, Homo sapiens
ctctgtagtttatggcag

SEQ ID NO: 654769 - DNA, 14 bp, Homo sapiens
ctctgtccctctcc

SEQ ID NO: 654770 - DNA, 17 bp, Homo sapiens
ctctgtccctctccttg

SEQ ID NO: 654771 - DNA, 19 bp, Homo sapiens
ctctgtgacccctccttgt

SEQ ID NO: 654772 - DNA, 15 bp, Homo sapiens
ctctgttacccaggc

SEQ ID NO: 654773 - DNA, 19 bp, Homo sapiens
ctcttacagtgtttggaca

SEQ ID NO: 654774 - DNA, 21 bp, Homo sapiens
ctcttcatgcttgacatacct

SEQ ID NO: 654775 - DNA, 22 bp, Homo sapiens
ctcttcatgcttgacataccta

SEQ ID NO: 654776 - DNA, 19 bp, Homo sapiens
ctcttcatggcatcttcaa

SEQ ID NO: 654777 - DNA, 23 bp, Homo sapiens
ctcttcatggcatcttcaatatg

SEQ ID NO: 654778 - DNA, 22 bp, Homo sapiens
ctcttccagggcagcggctcca

SEQ ID NO: 654779 - DNA, 14 bp, Homo sapiens
ctcttccccttccc

SEQ ID NO: 654780 - DNA, 20 bp, Homo sapiens
ctcttcctatccctctccta

SEQ ID NO: 654781 - DNA, 19 bp, Homo sapiens
ctcttcgatgtgcccaggg

SEQ ID NO: 654782 - DNA, 15 bp, Homo sapiens
ctcttctaccctttt

SEQ ID NO: 654783 - DNA, 22 bp, Homo sapiens
ctcttctacccttttccttttt

SEQ ID NO: 654784 - DNA, 19 bp, Homo sapiens
ctcttctgcaagcctcatg

SEQ ID NO: 654785 - DNA, 15 bp, Homo sapiens
ctcttctgctctttt

SEQ ID NO: 654786 - DNA, 19 bp, Homo sapiens
ctcttctgctcttttcctg

SEQ ID NO: 654787 - DNA, 23 bp, Homo sapiens
ctcttctggggcaggctgggcca

SEQ ID NO: 654788 - DNA, 16 bp, Homo sapiens
ctcttctttgtgcctt

SEQ ID NO: 654789 - DNA, 23 bp, Homo sapiens
ctcttctttgtgcctttggcctg

SEQ ID NO: 654790 - DNA, 15 bp, Homo sapiens
ctcttgatctctctt

SEQ ID NO: 654791 - DNA, 20 bp, Homo sapiens
ctcttgatctctcttgtcct

SEQ ID NO: 654792 - DNA, 14 bp, Homo sapiens
ctcttgcccatcct

SEQ ID NO: 654793 - DNA, 21 bp, Homo sapiens
ctcttggttcgatacctggag

SEQ ID NO: 654794 - DNA, 24 bp, Homo sapiens
ctcttgtcctcttctgctcttttc

SEQ ID NO: 654795 - DNA, 20 bp, Homo sapiens
ctctttaaactatgttccta

SEQ ID NO: 654796 - DNA, 22 bp, Homo sapiens
ctctttatcaagcaacattctt

SEQ ID NO: 654797 - DNA, 19 bp, Homo sapiens
ctcttttaatggcatttct

SEQ ID NO: 654798 - DNA, 15 bp, Homo sapiens
ctcttttatatttgt

SEQ ID NO: 654799 - DNA, 16 bp, Homo sapiens
ctcttttatatttgta

SEQ ID NO: 654800 - DNA, 19 bp, Homo sapiens
ctcttttcctggtgctctt

SEQ ID NO: 654801 - DNA, 20 bp, Homo sapiens
ctcttttcctggtgctcttt

SEQ ID NO: 654802 - DNA, 19 bp, Homo sapiens
ctgaaaaatatctggttat

SEQ ID NO: 654803 - DNA, 13 bp, Homo sapiens
ctgaaaaatggga

SEQ ID NO: 654804 - DNA, 14 bp, Homo sapiens
ctgaaactggcttc

SEQ ID NO: 654805 - DNA, 22 bp, Homo sapiens
ctgaaactggcttccccactcc

SEQ ID NO: 654806 - DNA, 22 bp, Homo sapiens
ctgaaactggttttaagtgctt

SEQ ID NO: 654807 - DNA, 21 bp, Homo sapiens
ctgaaagtgtgtgtagtttta

SEQ ID NO: 654808 - DNA, 15 bp, Homo sapiens
ctgaaatgttcttaa

SEQ ID NO: 654809 - DNA, 21 bp, Homo sapiens
ctgaaattactttaacatttt

SEQ ID NO: 654810 - DNA, 17 bp, Homo sapiens
ctgaaccggctttacca

SEQ ID NO: 654811 - DNA, 17 bp, Homo sapiens
ctgaagctgacagcact

SEQ ID NO: 654812 - DNA, 11 bp, Homo sapiens
ctgaagttcag

SEQ ID NO: 654813 - DNA, 15 bp, Homo sapiens
ctgaagttgaacatg

SEQ ID NO: 654814 - DNA, 17 bp, Homo sapiens
ctgaagttgcagatgtt

SEQ ID NO: 654815 - DNA, 15 bp, Homo sapiens
ctgaatgcctcctgt

SEQ ID NO: 654816 - DNA, 20 bp, Homo sapiens
ctgaatgcctcctgtgggga

SEQ ID NO: 654817 - DNA, 21 bp, Homo sapiens
ctgaattgtatcaatttgttt

SEQ ID NO: 654818 - DNA, 18 bp, Homo sapiens
ctgacactaaccagagtc

SEQ ID NO: 654819 - DNA, 14 bp, Homo sapiens
ctgacagtttttct

SEQ ID NO: 654820 - DNA, 14 bp, Homo sapiens
ctgacatttcttct

SEQ ID NO: 654821 - DNA, 19 bp, Homo sapiens
ctgacccccatctgagctg

SEQ ID NO: 654822 - DNA, 17 bp, Homo sapiens
ctgaccctgcccccact

SEQ ID NO: 654823 - DNA, 22 bp, Homo sapiens
ctgactcctcagtccctcttct

SEQ ID NO: 654824 - DNA, 15 bp, Homo sapiens
ctgactctccaggga

SEQ ID NO: 654825 - DNA, 13 bp, Homo sapiens
ctgactgaatgca

SEQ ID NO: 654826 - DNA, 16 bp, Homo sapiens
ctgactggaggaggcc

SEQ ID NO: 654827 - DNA, 18 bp, Homo sapiens
ctgactggaggaggcctg

SEQ ID NO: 654828 - DNA, 23 bp, Homo sapiens
ctgacttcagggaaggtgaaaca

SEQ ID NO: 654829 - DNA, 12 bp, Homo sapiens
ctgacttgcttt

SEQ ID NO: 654830 - DNA, 13 bp, Homo sapiens
ctgacttgcttta

SEQ ID NO: 654831 - DNA, 20 bp, Homo sapiens
ctgagaagccccgacacacg

SEQ ID NO: 654832 - DNA, 16 bp, Homo sapiens
ctgagaccacagaggc

SEQ ID NO: 654833 - DNA, 21 bp, Homo sapiens
ctgagataagtaggctggttt

SEQ ID NO: 654834 - DNA, 19 bp, Homo sapiens
ctgagatgctcactttatt

SEQ ID NO: 654835 - DNA, 22 bp, Homo sapiens
ctgagatgctcactttattatc

SEQ ID NO: 654836 - DNA, 15 bp, Homo sapiens
ctgagccagcagggc

SEQ ID NO: 654837 - DNA, 18 bp, Homo sapiens
ctgagcctgcagggaagc

SEQ ID NO: 654838 - DNA, 19 bp, Homo sapiens
ctgagcctgcagggaagcc

SEQ ID NO: 654839 - DNA, 16 bp, Homo sapiens
ctgagctggggggatg

SEQ ID NO: 654840 - DNA, 14 bp, Homo sapiens
ctgaggcaggagga

SEQ ID NO: 654841 - DNA, 18 bp, Homo sapiens
ctgaggcctgccccctgg

SEQ ID NO: 654842 - DNA, 21 bp, Homo sapiens
ctgaggcctgccccctgggct

SEQ ID NO: 654843 - DNA, 14 bp, Homo sapiens
ctgaggctgcatct

SEQ ID NO: 654844 - DNA, 20 bp, Homo sapiens
ctgagggcagactggggcat

SEQ ID NO: 654845 - DNA, 19 bp, Homo sapiens
ctgagggtgtttcttcctg

SEQ ID NO: 654846 - DNA, 19 bp, Homo sapiens
ctgaggtcagggagtgctg

SEQ ID NO: 654847 - DNA, 19 bp, Homo sapiens
ctgaggtgctatgaagcca

SEQ ID NO: 654848 - DNA, 17 bp, Homo sapiens
ctgagtgcaagttcatg

SEQ ID NO: 654849 - DNA, 13 bp, Homo sapiens
ctgagttggcctg

SEQ ID NO: 654850 - DNA, 19 bp, Homo sapiens
ctgatactgggtctgcgat

SEQ ID NO: 654851 - DNA, 14 bp, Homo sapiens
ctgatatactgtgt

SEQ ID NO: 654852 - DNA, 18 bp, Homo sapiens
ctgatcatcgccagaggt

SEQ ID NO: 654853 - DNA, 19 bp, Homo sapiens
ctgatcatcgccagaggtg

SEQ ID NO: 654854 - DNA, 22 bp, Homo sapiens
ctgatccatccatctctctctt

SEQ ID NO: 654855 - DNA, 16 bp, Homo sapiens
ctgatcttatgtgtta

SEQ ID NO: 654856 - DNA, 17 bp, Homo sapiens
ctgatcttttaaaatca

SEQ ID NO: 654857 - DNA, 17 bp, Homo sapiens
ctgatgagaacaagcta

SEQ ID NO: 654858 - DNA, 14 bp, Homo sapiens
ctgatgattttcct

SEQ ID NO: 654859 - DNA, 17 bp, Homo sapiens
ctgatgattttcctttt

SEQ ID NO: 654860 - DNA, 22 bp, Homo sapiens
ctgatgattttcctttttcttc

SEQ ID NO: 654861 - DNA, 15 bp, Homo sapiens
ctgattctggcttta

SEQ ID NO: 654862 - DNA, 19 bp, Homo sapiens
ctgattctggctttaagcc

SEQ ID NO: 654863 - DNA, 22 bp, Homo sapiens
ctgattctggctttaagccttc

SEQ ID NO: 654864 - DNA, 13 bp, Homo sapiens
ctgcaaaaatgga

SEQ ID NO: 654865 - DNA, 15 bp, Homo sapiens
ctgcaaacagaacag

SEQ ID NO: 654866 - DNA, 19 bp, Homo sapiens
ctgcaaacagaacagggtc

SEQ ID NO: 654867 - DNA, 14 bp, Homo sapiens
ctgcaaataaagcc

SEQ ID NO: 654868 - DNA, 15 bp, Homo sapiens
ctgcaaataaagcct

SEQ ID NO: 654869 - DNA, 23 bp, Homo sapiens
ctgcaacctcacctcccgggttc

SEQ ID NO: 654870 - DNA, 16 bp, Homo sapiens
ctgcaacctctgcctc

SEQ ID NO: 654871 - DNA, 14 bp, Homo sapiens
ctgcacaacagccc

SEQ ID NO: 654872 - DNA, 16 bp, Homo sapiens
ctgcacaacagccctg

SEQ ID NO: 654873 - DNA, 23 bp, Homo sapiens
ctgcacaacagccctgcctgaga

SEQ ID NO: 654874 - DNA, 11 bp, Homo sapiens
ctgcacacagg

SEQ ID NO: 654875 - DNA, 16 bp, Homo sapiens
ctgcactccagcctgg

SEQ ID NO: 654876 - DNA, 20 bp, Homo sapiens
ctgcactccagcctggggga

SEQ ID NO: 654877 - DNA, 14 bp, Homo sapiens
ctgcagagatttct

SEQ ID NO: 654878 - DNA, 20 bp, Homo sapiens
ctgcagcaggagtggtgcag

SEQ ID NO: 654879 - DNA, 21 bp, Homo sapiens
ctgcagcaggagtggtgcaga

SEQ ID NO: 654880 - DNA, 14 bp, Homo sapiens
ctgcagcaggcagc

SEQ ID NO: 654881 - DNA, 15 bp, Homo sapiens
ctgcagcattgaagt

SEQ ID NO: 654882 - DNA, 20 bp, Homo sapiens
ctgcaggaccctgtcctgca

SEQ ID NO: 654883 - DNA, 21 bp, Homo sapiens
ctgcaggaccctgtcctgcag

SEQ ID NO: 654884 - DNA, 12 bp, Homo sapiens
ctgcaggcaggc

SEQ ID NO: 654885 - DNA, 13 bp, Homo sapiens
ctgcaggcaggcg

SEQ ID NO: 654886 - DNA, 19 bp, Homo sapiens
ctgcaggcaggcggctcct

SEQ ID NO: 654887 - DNA, 21 bp, Homo sapiens
ctgcagggccatggctcaggg

SEQ ID NO: 654888 - DNA, 16 bp, Homo sapiens
ctgcagtcccacactg

SEQ ID NO: 654889 - DNA, 17 bp, Homo sapiens
ctgcagtcccacactgt

SEQ ID NO: 654890 - DNA, 12 bp, Homo sapiens
ctgcagtctcat

SEQ ID NO: 654891 - DNA, 18 bp, Homo sapiens
ctgcagtctcatttctca

SEQ ID NO: 654892 - DNA, 16 bp, Homo sapiens
ctgcatgaatatcata

SEQ ID NO: 654893 - DNA, 12 bp, Homo sapiens
ctgcattagaaa

SEQ ID NO: 654894 - DNA, 17 bp, Homo sapiens
ctgccagccttgagccc

SEQ ID NO: 654895 - DNA, 20 bp, Homo sapiens
ctgccatctagccagcccct

SEQ ID NO: 654896 - DNA, 14 bp, Homo sapiens
ctgccatgccagga

SEQ ID NO: 654897 - DNA, 17 bp, Homo sapiens
ctgccatgccaggaacc

SEQ ID NO: 654898 - DNA, 18 bp, Homo sapiens
ctgccatgccaggaacct

SEQ ID NO: 654899 - DNA, 22 bp, Homo sapiens
ctgccattacagaggtattaaa

SEQ ID NO: 654900 - DNA, 23 bp, Homo sapiens
ctgccattacagaggtattaaaa

SEQ ID NO: 654901 - DNA, 21 bp, Homo sapiens
ctgccccatgtgtcctggtga

SEQ ID NO: 654902 - DNA, 19 bp, Homo sapiens
ctgccccggagctggagga

SEQ ID NO: 654903 - DNA, 20 bp, Homo sapiens
ctgccctcattactgggcct

SEQ ID NO: 654904 - DNA, 23 bp, Homo sapiens
ctgccctcattactgggccttag

SEQ ID NO: 654905 - DNA, 11 bp, Homo sapiens
ctgccctcctc

SEQ ID NO: 654906 - DNA, 12 bp, Homo sapiens
ctgccctgagaa

SEQ ID NO: 654907 - DNA, 12 bp, Homo sapiens
ctgccctgtgat

SEQ ID NO: 654908 - DNA, 21 bp, Homo sapiens
ctgccctgtgatatgtctgct

SEQ ID NO: 654909 - DNA, 22 bp, Homo sapiens
ctgccctgtgatatgtctgctg

SEQ ID NO: 654910 - DNA, 19 bp, Homo sapiens
ctgccctgttagctttcca

SEQ ID NO: 654911 - DNA, 12 bp, Homo sapiens
ctgcctcccact

SEQ ID NO: 654912 - DNA, 14 bp, Homo sapiens
ctgcctcccaggtt

SEQ ID NO: 654913 - DNA, 12 bp, Homo sapiens
ctgcctcctgcc

SEQ ID NO: 654914 - DNA, 14 bp, Homo sapiens
ctgcctcctgccct

SEQ ID NO: 654915 - DNA, 10 bp, Homo sapiens
ctgcctctgc

SEQ ID NO: 654916 - DNA, 13 bp, Homo sapiens
ctgcctgaataaa

SEQ ID NO: 654917 - DNA, 16 bp, Homo sapiens
ctgcctgcagcaggca

SEQ ID NO: 654918 - DNA, 22 bp, Homo sapiens
ctgcctggcacagaccaggcct

SEQ ID NO: 654919 - DNA, 11 bp, Homo sapiens
ctgcctggccc

SEQ ID NO: 654920 - DNA, 16 bp, Homo sapiens
ctgccttcacaaatgt

SEQ ID NO: 654921 - DNA, 18 bp, Homo sapiens
ctgccttcacaaatgtca

SEQ ID NO: 654922 - DNA, 14 bp, Homo sapiens
ctgccttcctcctt

SEQ ID NO: 654923 - DNA, 15 bp, Homo sapiens
ctgccttcctcctta

SEQ ID NO: 654924 - DNA, 15 bp, Homo sapiens
ctgccttctgctgaa

SEQ ID NO: 654925 - DNA, 16 bp, Homo sapiens
ctgccttgaaaaatga

SEQ ID NO: 654926 - DNA, 12 bp, Homo sapiens
ctgcctttctca

SEQ ID NO: 654927 - DNA, 20 bp, Homo sapiens
ctgcgaagaccctcttgccc

SEQ ID NO: 654928 - DNA, 16 bp, Homo sapiens
ctgcgctgcttggtgt

SEQ ID NO: 654929 - DNA, 23 bp, Homo sapiens
ctgcggaatcttcttactaagct

SEQ ID NO: 654930 - DNA, 21 bp, Homo sapiens
ctgcgttttcctagctgtgtt

SEQ ID NO: 654931 - DNA, 19 bp, Homo sapiens
ctgctacctttcaaagctt

SEQ ID NO: 654932 - DNA, 16 bp, Homo sapiens
ctgctagagccagcaa

SEQ ID NO: 654933 - DNA, 16 bp, Homo sapiens
ctgctatccccatctc

SEQ ID NO: 654934 - DNA, 21 bp, Homo sapiens
ctgctatccccatctccctgc

SEQ ID NO: 654935 - DNA, 18 bp, Homo sapiens
ctgctattctagagcttt

SEQ ID NO: 654936 - DNA, 22 bp, Homo sapiens
ctgctattctagagcttttatt

SEQ ID NO: 654937 - DNA, 23 bp, Homo sapiens
ctgctattctagagcttttattt

SEQ ID NO: 654938 - DNA, 17 bp, Homo sapiens
aaaattatttgctatgg

SEQ ID NO: 654939 - DNA, 20 bp, Homo sapiens
aaaattcatagtaagattga

SEQ ID NO: 654940 - DNA, 17 bp, Homo sapiens
aaaattcttgagaagta

SEQ ID NO: 654941 - DNA, 16 bp, Homo sapiens
aaaattttgcttttaa

SEQ ID NO: 654942 - DNA, 17 bp, Homo sapiens
aaaattttgcttttaat

SEQ ID NO: 654943 - DNA, 15 bp, Homo sapiens
aaacacaaaaaaaat

SEQ ID NO: 654944 - DNA, 21 bp, Homo sapiens
aaacactacacatttgaaaca

SEQ ID NO: 654945 - DNA, 13 bp, Homo sapiens
aaacactgcaaat

SEQ ID NO: 654946 - DNA, 20 bp, Homo sapiens
aaacagatctcctggcaaag

SEQ ID NO: 654947 - DNA, 14 bp, Homo sapiens
aaacagttatttct

SEQ ID NO: 654948 - DNA, 15 bp, Homo sapiens
aaacagttgctgtga

SEQ ID NO: 654949 - DNA, 14 bp, Homo sapiens
aaacataaaaactg

SEQ ID NO: 654950 - DNA, 17 bp, Homo sapiens
aaacataacataaattt

SEQ ID NO: 654951 - DNA, 13 bp, Homo sapiens
aaacatacataat

SEQ ID NO: 654952 - DNA, 20 bp, Homo sapiens
aaacatgtactacagctata

SEQ ID NO: 654953 - DNA, 16 bp, Homo sapiens
aaacatgttaatgaca

SEQ ID NO: 654954 - DNA, 21 bp, Homo sapiens
aaacattcaattccagagaac

SEQ ID NO: 654955 - DNA, 15 bp, Homo sapiens
aaacattttgaagtg

SEQ ID NO: 654956 - DNA, 16 bp, Homo sapiens
aaacctagtactgccc

SEQ ID NO: 654957 - DNA, 22 bp, Homo sapiens
aaacctgggtatagtgcagaaa

SEQ ID NO: 654958 - DNA, 16 bp, Homo sapiens
aaaccttgctctcctc

SEQ ID NO: 654959 - DNA, 20 bp, Homo sapiens
aaaccttgctctcctcatct

SEQ ID NO: 654960 - DNA, 23 bp, Homo sapiens
aaacgtcctctttagtttttggt

SEQ ID NO: 654961 - DNA, 23 bp, Homo sapiens
aaactagctcgtgattggcatat

SEQ ID NO: 654962 - DNA, 14 bp, Homo sapiens
aaactcatttatct

SEQ ID NO: 654963 - DNA, 16 bp, Homo sapiens
aaactctagcagttgt

SEQ ID NO: 654964 - DNA, 20 bp, Homo sapiens
aaactctccttttccttacc

SEQ ID NO: 654965 - DNA, 22 bp, Homo sapiens
aaactctgttacactttttgga

SEQ ID NO: 654966 - DNA, 13 bp, Homo sapiens
aaactcttcagtg

SEQ ID NO: 654967 - DNA, 16 bp, Homo sapiens
aaactgaaaaatatct

SEQ ID NO: 654968 - DNA, 15 bp, Homo sapiens
aaactgagagtaatt

SEQ ID NO: 654969 - DNA, 16 bp, Homo sapiens
aaactgctgcagatta

SEQ ID NO: 654970 - DNA, 22 bp, Homo sapiens
aaactgtacatttaaaattgct

SEQ ID NO: 654971 - DNA, 13 bp, Homo sapiens
aaacttaagaatt

SEQ ID NO: 654972 - DNA, 14 bp, Homo sapiens
aaacttactatttt

SEQ ID NO: 654973 - DNA, 19 bp, Homo sapiens
aaacttattggaatgttga

SEQ ID NO: 654974 - DNA, 13 bp, Homo sapiens
aaactttgggaaa

SEQ ID NO: 654975 - DNA, 17 bp, Homo sapiens
aaactttgggaaaacat

SEQ ID NO: 654976 - DNA, 20 bp, Homo sapiens
aaactttgggaaaacatgtt

SEQ ID NO: 654977 - DNA, 12 bp, Homo sapiens
aaactttgtagt

SEQ ID NO: 654978 - DNA, 12 bp, Homo sapiens
aaagaacttact

SEQ ID NO: 654979 - DNA, 22 bp, Homo sapiens
aaagaagagtgacttattttgt

SEQ ID NO: 654980 - DNA, 12 bp, Homo sapiens
aaagaagcttta

SEQ ID NO: 654981 - DNA, 14 bp, Homo sapiens
aaagaataaaaact

SEQ ID NO: 654982 - DNA, 15 bp, Homo sapiens
aaagaataaaaactt

SEQ ID NO: 654983 - DNA, 16 bp, Homo sapiens
aaagaatagaagctaa

SEQ ID NO: 654984 - DNA, 20 bp, Homo sapiens
aaagaccaataaacttcctt

SEQ ID NO: 654985 - DNA, 16 bp, Homo sapiens
aaagacccagggggag

SEQ ID NO: 654986 - DNA, 23 bp, Homo sapiens
aaagacgaccagcatttaaccaa

SEQ ID NO: 654987 - DNA, 12 bp, Homo sapiens
aaagagaatgag

SEQ ID NO: 654988 - DNA, 20 bp, Homo sapiens
aaagagagatgggccaggca

SEQ ID NO: 654989 - DNA, 21 bp, Homo sapiens
aaagagccagactctgtctca

SEQ ID NO: 654990 - DNA, 18 bp, Homo sapiens
aattttaatgctgtttct

SEQ ID NO: 654991 - DNA, 21 bp, Homo sapiens
aattttaggaacttcagagat

SEQ ID NO: 654992 - DNA, 13 bp, Homo sapiens
aattttattttgt

SEQ ID NO: 654993 - DNA, 15 bp, Homo sapiens
aattttcaagtttac

SEQ ID NO: 654994 - DNA, 12 bp, Homo sapiens
aattttctttca

SEQ ID NO: 654995 - DNA, 16 bp, Homo sapiens
aattttgcttttaatt

SEQ ID NO: 654996 - DNA, 17 bp, Homo sapiens
aattttgcttttaatta

SEQ ID NO: 654997 - DNA, 18 bp, Homo sapiens
aattttgcttttaattaa

SEQ ID NO: 654998 - DNA, 15 bp, Homo sapiens
aatttttatttattt

SEQ ID NO: 654999 - DNA, 14 bp, Homo sapiens
aatttttgtatttt

SEQ ID NO: 655000 - DNA, 15 bp, Homo sapiens
aatttttgtctcaga

SEQ ID NO: 655001 - DNA, 16 bp, Homo sapiens
aattttttttaaagaa

SEQ ID NO: 655002 - DNA, 13 bp, Homo sapiens
acaaaaaatacat

SEQ ID NO: 655003 - DNA, 12 bp, Homo sapiens
acaaaaaatact

SEQ ID NO: 655004 - DNA, 11 bp, Homo sapiens
acaaaacttct

SEQ ID NO: 655005 - DNA, 11 bp, Homo sapiens
aagtttttaat

SEQ ID NO: 655006 - DNA, 23 bp, Homo sapiens
aataaaaaagaacttttgtatct

SEQ ID NO: 655007 - DNA, 19 bp, Homo sapiens
aataaaatatcataaagca

SEQ ID NO: 655008 - DNA, 12 bp, Homo sapiens
aataaaatttaa

SEQ ID NO: 655009 - DNA, 16 bp, Homo sapiens
aataaacagacaaaaa

SEQ ID NO: 655010 - DNA, 13 bp, Homo sapiens
aataaactattta

SEQ ID NO: 655011 - DNA, 19 bp, Homo sapiens
aataaactatttatatcac

SEQ ID NO: 655012 - DNA, 11 bp, Homo sapiens
aataaactgca

SEQ ID NO: 655013 - DNA, 12 bp, Homo sapiens
aataaactgcaa

SEQ ID NO: 655014 - DNA, 14 bp, Homo sapiens
aataaactgcaagt

SEQ ID NO: 655015 - DNA, 18 bp, Homo sapiens
aataaactgcaagttcat

SEQ ID NO: 655016 - DNA, 13 bp, Homo sapiens
aataaagctttat

SEQ ID NO: 655017 - DNA, 13 bp, Homo sapiens
aataaaggcagct

SEQ ID NO: 655018 - DNA, 21 bp, Homo sapiens
aataaaggcagctgcctctgc

SEQ ID NO: 655019 - DNA, 11 bp, Homo sapiens
aataaatatat

SEQ ID NO: 655020 - DNA, 22 bp, Homo sapiens
aataaatgggtgtatataattt

SEQ ID NO: 655021 - DNA, 16 bp, Homo sapiens
aataaattagttgtta

SEQ ID NO: 655022 - DNA, 17 bp, Homo sapiens
aataacactgtatttta

SEQ ID NO: 655023 - DNA, 13 bp, Homo sapiens
aataactgtgtgg

SEQ ID NO: 655024 - DNA, 20 bp, Homo sapiens
aataagacaagagatctaca

SEQ ID NO: 655025 - DNA, 15 bp, Homo sapiens
aataattctacatgt

SEQ ID NO: 655026 - DNA, 16 bp, Homo sapiens
aataattcttttctga

SEQ ID NO: 655027 - DNA, 15 bp, Homo sapiens
aataattttgtaatg

SEQ ID NO: 655028 - DNA, 17 bp, Homo sapiens
aagcattttgtaataat

SEQ ID NO: 655029 - DNA, 18 bp, Homo sapiens
aagccaccatccccaccc

SEQ ID NO: 655030 - DNA, 21 bp, Homo sapiens
aagccaggttccacagaggac

SEQ ID NO: 655031 - DNA, 21 bp, Homo sapiens
aagccatggctgacctctgga

SEQ ID NO: 655032 - DNA, 16 bp, Homo sapiens
aagccccacatgtcca

SEQ ID NO: 655033 - DNA, 13 bp, Homo sapiens
aagcctaaaattg

SEQ ID NO: 655034 - DNA, 15 bp, Homo sapiens
aagcctaaatttgtg

SEQ ID NO: 655035 - DNA, 17 bp, Homo sapiens
aagccttttaaatcatc

SEQ ID NO: 655036 - DNA, 21 bp, Homo sapiens
aagcggccctaagggagtgtc

SEQ ID NO: 655037 - DNA, 18 bp, Homo sapiens
aagcgttaagggcagagt

SEQ ID NO: 655038 - DNA, 23 bp, Homo sapiens
aagctctgttccatgcaactgga

SEQ ID NO: 655039 - DNA, 13 bp, Homo sapiens
aagctgattttat

SEQ ID NO: 655040 - DNA, 12 bp, Homo sapiens
aagcttaaattt

SEQ ID NO: 655041 - DNA, 14 bp, Homo sapiens
aagcttcaaattaa

SEQ ID NO: 655042 - DNA, 16 bp, Homo sapiens
aagctttcctgtttcc

SEQ ID NO: 655043 - DNA, 20 bp, Homo sapiens
aagctttggtttatggtttt

SEQ ID NO: 655044 - DNA, 13 bp, Homo sapiens
aagcttttgctca

SEQ ID NO: 655045 - DNA, 17 bp, Homo sapiens
aagcttttgtctgtagg

SEQ ID NO: 655046 - DNA, 16 bp, Homo sapiens
aaggaaacattttatc

SEQ ID NO: 655047 - DNA, 13 bp, Homo sapiens
aaggaagactaga

SEQ ID NO: 655048 - DNA, 12 bp, Homo sapiens
aaggaagcagaa

SEQ ID NO: 655049 - DNA, 21 bp, Homo sapiens
aaggaattaccaagaatatcc

SEQ ID NO: 655050 - DNA, 23 bp, Homo sapiens
aaggagaggcaaagaaaggagat

SEQ ID NO: 655051 - DNA, 20 bp, Homo sapiens
aaggagccttttgctctctg

SEQ ID NO: 655052 - DNA, 16 bp, Homo sapiens
aaggatatactgcagc

SEQ ID NO: 655053 - DNA, 11 bp, Homo sapiens
aaggatgactt

SEQ ID NO: 655054 - DNA, 12 bp, Homo sapiens
aaggatgacttt

SEQ ID NO: 655055 - DNA, 13 bp, Homo sapiens
aaggatgactttt

SEQ ID NO: 655056 - DNA, 22 bp, Homo sapiens
aaggattcagcaccagttatgt

SEQ ID NO: 655057 - DNA, 14 bp, Homo sapiens
aaggcagacagcag

SEQ ID NO: 655058 - DNA, 13 bp, Homo sapiens
aaggcagctgcct

SEQ ID NO: 655059 - DNA, 17 bp, Homo sapiens
aaggcaggaggatcact

SEQ ID NO: 655060 - DNA, 23 bp, Homo sapiens
aaggcagtagaactccaggccct

SEQ ID NO: 655061 - DNA, 22 bp, Homo sapiens
aaggctggtacaacggaggcct

SEQ ID NO: 655062 - DNA, 12 bp, Homo sapiens
aaggcttaattg

SEQ ID NO: 655063 - DNA, 18 bp, Homo sapiens
aaggcttaattgactgaa

SEQ ID NO: 655064 - DNA, 11 bp, Homo sapiens
aagggcagagt

SEQ ID NO: 655065 - DNA, 15 bp, Homo sapiens
aagggcttactattt

SEQ ID NO: 655066 - DNA, 16 bp, Homo sapiens
aaggggagaagggaat

SEQ ID NO: 655067 - DNA, 18 bp, Homo sapiens
aaggggtcccatcagtga

SEQ ID NO: 655068 - DNA, 17 bp, Homo sapiens
aagggtgggtgctcaga

SEQ ID NO: 655069 - DNA, 18 bp, Homo sapiens
aaggtataataaaattat

SEQ ID NO: 655070 - DNA, 16 bp, Homo sapiens
aaggtattatacatgt

SEQ ID NO: 655071 - DNA, 23 bp, Homo sapiens
aaggtcacaacccttctctgttg

SEQ ID NO: 655072 - DNA, 17 bp, Homo sapiens
aaggtgggccttgctac

SEQ ID NO: 655073 - DNA, 13 bp, Homo sapiens
aaggtttattgtt

SEQ ID NO: 655074 - DNA, 14 bp, Homo sapiens
aaggtttattgtta

SEQ ID NO: 655075 - DNA, 20 bp, Homo sapiens
aaggtttattgttaatacaa

SEQ ID NO: 655076 - DNA, 13 bp, Homo sapiens
aagtaaagacagc

SEQ ID NO: 655077 - DNA, 14 bp, Homo sapiens
aagtaactgtgaga

SEQ ID NO: 655078 - DNA, 13 bp, Homo sapiens
aagtaagaagaca

SEQ ID NO: 655079 - DNA, 13 bp, Homo sapiens
aagtaatttcctg

SEQ ID NO: 655080 - DNA, 20 bp, Homo sapiens
aagtacatattaggaaaata

SEQ ID NO: 655081 - DNA, 23 bp, Homo sapiens
aagtatacaggaggatgtgaata

SEQ ID NO: 655082 - DNA, 20 bp, Homo sapiens
aagtatgacccacattactt

SEQ ID NO: 655083 - DNA, 13 bp, Homo sapiens
aagtatggtgtgt

SEQ ID NO: 655084 - DNA, 16 bp, Homo sapiens
aagtatggtgtgttca

SEQ ID NO: 655085 - DNA, 15 bp, Homo sapiens
aagtattttcctgtt

SEQ ID NO: 655086 - DNA, 14 bp, Homo sapiens
aagtattttttcaa

SEQ ID NO: 655087 - DNA, 13 bp, Homo sapiens
aagtcaaaaaatt

SEQ ID NO: 655088 - DNA, 15 bp, Homo sapiens
aagtcaaaatatgta

SEQ ID NO: 655089 - DNA, 17 bp, Homo sapiens
aagtcaaatttacttta

SEQ ID NO: 655090 - DNA, 16 bp, Homo sapiens
aagtcacccctttctg

SEQ ID NO: 655091 - DNA, 23 bp, Homo sapiens
aagtcacccctttctgtcccact

SEQ ID NO: 655092 - DNA, 22 bp, Homo sapiens
aagtcagctccagctttctgcc

SEQ ID NO: 655093 - DNA, 16 bp, Homo sapiens
aagtcagtatggtcta

SEQ ID NO: 655094 - DNA, 16 bp, Homo sapiens
aagtcatttttgtatt

SEQ ID NO: 655095 - DNA, 18 bp, Homo sapiens
aagtcatttttgtatttt

SEQ ID NO: 655096 - DNA, 20 bp, Homo sapiens
aagtcatttttgtatttttc

SEQ ID NO: 655097 - DNA, 20 bp, Homo sapiens
aagtccctataataaaggct

SEQ ID NO: 655098 - DNA, 22 bp, Homo sapiens
aagtccctataataaaggctga

SEQ ID NO: 655099 - DNA, 18 bp, Homo sapiens
aagtctgtccaaatttaa

SEQ ID NO: 655100 - DNA, 18 bp, Homo sapiens
aagtctttaataaataac

SEQ ID NO: 655101 - DNA, 12 bp, Homo sapiens
aagtgaaaactt

SEQ ID NO: 655102 - DNA, 12 bp, Homo sapiens
aagtgaaaatat

SEQ ID NO: 655103 - DNA, 16 bp, Homo sapiens
aagtgcactttctaat

SEQ ID NO: 655104 - DNA, 20 bp, Homo sapiens
aagtggaccttgagaccaca

SEQ ID NO: 655105 - DNA, 12 bp, Homo sapiens
aagtggctgcct

SEQ ID NO: 655106 - DNA, 11 bp, Homo sapiens
aagtgggccca

SEQ ID NO: 655107 - DNA, 16 bp, Homo sapiens
aagtgtatgcagtatt

SEQ ID NO: 655108 - DNA, 14 bp, Homo sapiens
aagtgtccttcttg

SEQ ID NO: 655109 - DNA, 18 bp, Homo sapiens
aagtgtgctgtgacaagc

SEQ ID NO: 655110 - DNA, 15 bp, Homo sapiens
aagtgtgttggatta

SEQ ID NO: 655111 - DNA, 22 bp, Homo sapiens
aagtgttggcaaacgagacttt

SEQ ID NO: 655112 - DNA, 23 bp, Homo sapiens
aagttacagtttgatacaggaat

SEQ ID NO: 655113 - DNA, 19 bp, Homo sapiens
aagttagttccactgagac

SEQ ID NO: 655114 - DNA, 15 bp, Homo sapiens
aagttatgtatttaa

SEQ ID NO: 655115 - DNA, 13 bp, Homo sapiens
aagttattggcat

SEQ ID NO: 655116 - DNA, 18 bp, Homo sapiens
aagttcaacttatttcat

SEQ ID NO: 655117 - DNA, 14 bp, Homo sapiens
aagttctataacta

SEQ ID NO: 655118 - DNA, 20 bp, Homo sapiens
aagttgattaagaaaggaag

SEQ ID NO: 655119 - DNA, 22 bp, Homo sapiens
aagttgcagatgttagatattt

SEQ ID NO: 655120 - DNA, 15 bp, Homo sapiens
aagtttaaatgtatt

SEQ ID NO: 655121 - DNA, 15 bp, Homo sapiens
aagtttacagagatg

SEQ ID NO: 655122 - DNA, 13 bp, Homo sapiens
aagtttatatata

SEQ ID NO: 655123 - DNA, 20 bp, Homo sapiens
aagttttaactttaatacag

SEQ ID NO: 655124 - DNA, 11 bp, Homo sapiens
aactctggtgc

SEQ ID NO: 655125 - DNA, 13 bp, Homo sapiens
aactcttcagtgc

SEQ ID NO: 655126 - DNA, 22 bp, Homo sapiens
aactcttggttcgatacctgga

SEQ ID NO: 655127 - DNA, 17 bp, Homo sapiens
aactgagagtaattcat

SEQ ID NO: 655128 - DNA, 14 bp, Homo sapiens
aactgcaagttcat

SEQ ID NO: 655129 - DNA, 17 bp, Homo sapiens
aactggacctgtatatt

SEQ ID NO: 655130 - DNA, 14 bp, Homo sapiens
aactgtacatttaa

SEQ ID NO: 655131 - DNA, 18 bp, Homo sapiens
aactgtacatttaaaatt

SEQ ID NO: 655132 - DNA, 15 bp, Homo sapiens
aactgtactgtctgt

SEQ ID NO: 655133 - DNA, 15 bp, Homo sapiens
aacttactgattatt

SEQ ID NO: 655134 - DNA, 21 bp, Homo sapiens
aacttacttgcataccaagtt

SEQ ID NO: 655135 - DNA, 12 bp, Homo sapiens
aacttagaaaag

SEQ ID NO: 655136 - DNA, 20 bp, Homo sapiens
aacttatttcataattgcct

SEQ ID NO: 655137 - DNA, 19 bp, Homo sapiens
aacttctgcaacaagcatg

SEQ ID NO: 655138 - DNA, 20 bp, Homo sapiens
aacttctgcaacaagcatgc

SEQ ID NO: 655139 - DNA, 11 bp, Homo sapiens
aacttctgctc

SEQ ID NO: 655140 - DNA, 12 bp, Homo sapiens
aactttgggaaa

SEQ ID NO: 655141 - DNA, 16 bp, Homo sapiens
aactttgggaaaacat

SEQ ID NO: 655142 - DNA, 22 bp, Homo sapiens
aactttgggaaaacatgttaat

SEQ ID NO: 655143 - DNA, 14 bp, Homo sapiens
aactttgtaaaaat

SEQ ID NO: 655144 - DNA, 17 bp, Homo sapiens
aacttttcaatgacatt

SEQ ID NO: 655145 - DNA, 18 bp, Homo sapiens
aacttttttttctctctt

SEQ ID NO: 655146 - DNA, 16 bp, Homo sapiens
aagaaaagtttaccat

SEQ ID NO: 655147 - DNA, 12 bp, Homo sapiens
aagaaaatgaag

SEQ ID NO: 655148 - DNA, 17 bp, Homo sapiens
aagaaaccttgctctcc

SEQ ID NO: 655149 - DNA, 10 bp, Homo sapiens
aagaaacttt

SEQ ID NO: 655150 - DNA, 13 bp, Homo sapiens
aagaaaggaagca

SEQ ID NO: 655151 - DNA, 19 bp, Homo sapiens
aagaaataatgctacaatt

SEQ ID NO: 655152 - DNA, 15 bp, Homo sapiens
aagaaatatattttt

SEQ ID NO: 655153 - DNA, 12 bp, Homo sapiens
aagaaccaaata

SEQ ID NO: 655154 - DNA, 17 bp, Homo sapiens
aagaaccaaatacctca

SEQ ID NO: 655155 - DNA, 15 bp, Homo sapiens
aagaactccagagtc

SEQ ID NO: 655156 - DNA, 20 bp, Homo sapiens
aagaacttactgattatttt

SEQ ID NO: 655157 - DNA, 16 bp, Homo sapiens
aagaagacattttgtt

SEQ ID NO: 655158 - DNA, 23 bp, Homo sapiens
aagaagcaaagttcaacttattt

SEQ ID NO: 655159 - DNA, 13 bp, Homo sapiens
aagaagctttatc

SEQ ID NO: 655160 - DNA, 17 bp, Homo sapiens
aagaaggaaagaaccga

SEQ ID NO: 655161 - DNA, 22 bp, Homo sapiens
aagaaggaaagaaccgaagagc

SEQ ID NO: 655162 - DNA, 17 bp, Homo sapiens
aagaagttcatgtccaa

SEQ ID NO: 655163 - DNA, 23 bp, Homo sapiens
aagaatagcattgtaaaagcatt

SEQ ID NO: 655164 - DNA, 14 bp, Homo sapiens
aagaatgaaaaata

SEQ ID NO: 655165 - DNA, 15 bp, Homo sapiens
aagaatgaaaaatat

SEQ ID NO: 655166 - DNA, 19 bp, Homo sapiens
aagaatgaaaaatataatg

SEQ ID NO: 655167 - DNA, 19 bp, Homo sapiens
aagaatgaaagctgttcct

SEQ ID NO: 655168 - DNA, 12 bp, Homo sapiens
aagaattaatga

SEQ ID NO: 655169 - DNA, 19 bp, Homo sapiens
aagaattctgattgatttg

SEQ ID NO: 655170 - DNA, 20 bp, Homo sapiens
aagaattgaaaagtttttgt

SEQ ID NO: 655171 - DNA, 21 bp, Homo sapiens
aagacaagagatctacacatg

SEQ ID NO: 655172 - DNA, 22 bp, Homo sapiens
aagacaagagatctacacatgt

SEQ ID NO: 655173 - DNA, 14 bp, Homo sapiens
aagacagaggggag

SEQ ID NO: 655174 - DNA, 17 bp, Homo sapiens
aagacagaggggagcag

SEQ ID NO: 655175 - DNA, 20 bp, Homo sapiens
aagacagggctcatttttgc

SEQ ID NO: 655176 - DNA, 21 bp, Homo sapiens
aagacagggctcatttttgca

SEQ ID NO: 655177 - DNA, 13 bp, Homo sapiens
aagacatgaacca

SEQ ID NO: 655178 - DNA, 18 bp, Homo sapiens
aagacatttgctgaactc

SEQ ID NO: 655179 - DNA, 14 bp, Homo sapiens
aagaccaataaact

SEQ ID NO: 655180 - DNA, 15 bp, Homo sapiens
aagacccctgactca

SEQ ID NO: 655181 - DNA, 14 bp, Homo sapiens
aagacccggccagg

SEQ ID NO: 655182 - DNA, 22 bp, Homo sapiens
aagaccctcttgcccatcctga

SEQ ID NO: 655183 - DNA, 19 bp, Homo sapiens
aagacgggaggggaggcat

SEQ ID NO: 655184 - DNA, 20 bp, Homo sapiens
aagactagaggcttgcataa

SEQ ID NO: 655185 - DNA, 22 bp, Homo sapiens
aagactatatatataaatgtat

SEQ ID NO: 655186 - DNA, 16 bp, Homo sapiens
aagactgtagatatgt

SEQ ID NO: 655187 - DNA, 22 bp, Homo sapiens
aagacttctcaaagagaattgt

SEQ ID NO: 655188 - DNA, 17 bp, Homo sapiens
aagacttgagacaatgt

SEQ ID NO: 655189 - DNA, 14 bp, Homo sapiens
aagactttgtgact

SEQ ID NO: 655190 - DNA, 20 bp, Homo sapiens
aagacttttggtagagaagg

SEQ ID NO: 655191 - DNA, 21 bp, Homo sapiens
aagacttttggtagagaagga

SEQ ID NO: 655192 - DNA, 19 bp, Homo sapiens
aagagaaaggactcagtgt

SEQ ID NO: 655193 - DNA, 16 bp, Homo sapiens
aagagaatgagtcctt

SEQ ID NO: 655194 - DNA, 17 bp, Homo sapiens
aagagaattgtatgtaa

SEQ ID NO: 655195 - DNA, 15 bp, Homo sapiens
aagagataagtcttt

SEQ ID NO: 655196 - DNA, 18 bp, Homo sapiens
aagagatctacacatgtt

SEQ ID NO: 655197 - DNA, 16 bp, Homo sapiens
aagagcaaacaaaagt

SEQ ID NO: 655198 - DNA, 13 bp, Homo sapiens
aagagcacactgc

SEQ ID NO: 655199 - DNA, 18 bp, Homo sapiens
aagagccctaagtttgta

SEQ ID NO: 655200 - DNA, 16 bp, Homo sapiens
aagagctagaaaaata

SEQ ID NO: 655201 - DNA, 22 bp, Homo sapiens
aagaggaacagcactggggagt

SEQ ID NO: 655202 - DNA, 23 bp, Homo sapiens
aagaggccacttagggaaagatg

SEQ ID NO: 655203 - DNA, 18 bp, Homo sapiens
aagaggctgaaagaggcc

SEQ ID NO: 655204 - DNA, 17 bp, Homo sapiens
aagagggagaagcatga

SEQ ID NO: 655205 - DNA, 14 bp, Homo sapiens
aagagtaatttcat

SEQ ID NO: 655206 - DNA, 21 bp, Homo sapiens
aagagtctacccgacataagt

SEQ ID NO: 655207 - DNA, 21 bp, Homo sapiens
aagagtgacttattttgtctt

SEQ ID NO: 655208 - DNA, 22 bp, Homo sapiens
aagagtgacttattttgtctta

SEQ ID NO: 655209 - DNA, 19 bp, Homo sapiens
aagagtttcagtttgttgg

SEQ ID NO: 655210 - DNA, 19 bp, Homo sapiens
aagataatttatttcaata

SEQ ID NO: 655211 - DNA, 14 bp, Homo sapiens
aagatgaaaaagaa

SEQ ID NO: 655212 - DNA, 15 bp, Homo sapiens
aagatggaaatacag

SEQ ID NO: 655213 - DNA, 11 bp, Homo sapiens
aagatgtgaaa

SEQ ID NO: 655214 - DNA, 11 bp, Homo sapiens
cctttggcctg

SEQ ID NO: 655215 - DNA, 18 bp, Homo sapiens
ccttttaaagaagcttta

SEQ ID NO: 655216 - DNA, 20 bp, Homo sapiens
ccttttccaggagttctgaa

SEQ ID NO: 655217 - DNA, 13 bp, Homo sapiens
ccttttcctatcc

SEQ ID NO: 655218 - DNA, 12 bp, Homo sapiens
ccttttgggaag

SEQ ID NO: 655219 - DNA, 14 bp, Homo sapiens
cctttttctgagat

SEQ ID NO: 655220 - DNA, 18 bp, Homo sapiens
cctttttctgagatgctc

SEQ ID NO: 655221 - DNA, 19 bp, Homo sapiens
cctttttcttcgctggact

SEQ ID NO: 655222 - DNA, 17 bp, Homo sapiens
cctgcgaccctgggggc

SEQ ID NO: 655223 - DNA, 21 bp, Homo sapiens
cctgcgaccctgggggcacag

SEQ ID NO: 655224 - DNA, 13 bp, Homo sapiens
cctgctcccaggc

SEQ ID NO: 655225 - DNA, 17 bp, Homo sapiens
cctgctcccaggcccca

SEQ ID NO: 655226 - DNA, 20 bp, Homo sapiens
cctgctcccaggccccaggc

SEQ ID NO: 655227 - DNA, 22 bp, Homo sapiens
cctgctcccaggccccaggcct

SEQ ID NO: 655228 - DNA, 19 bp, Homo sapiens
cctgctgaaactgcccact

SEQ ID NO: 655229 - DNA, 13 bp, Homo sapiens
cctgctgcgctgc

SEQ ID NO: 655230 - DNA, 19 bp, Homo sapiens
cctgctgctggtgcacagc

SEQ ID NO: 655231 - DNA, 19 bp, Homo sapiens
cctgcttcttctctccaca

SEQ ID NO: 655232 - DNA, 12 bp, Homo sapiens
cctgctttgcat

SEQ ID NO: 655233 - DNA, 14 bp, Homo sapiens
cccatggcccccaa

SEQ ID NO: 655234 - DNA, 18 bp, Homo sapiens
cccatggcccccaataaa

SEQ ID NO: 655235 - DNA, 21 bp, Homo sapiens
cccatgtcaccggtcagtgcc

SEQ ID NO: 655236 - DNA, 15 bp, Homo sapiens
cccattccctccatt

SEQ ID NO: 655237 - DNA, 14 bp, Homo sapiens
ccccaacctcaggg

SEQ ID NO: 655238 - DNA, 22 bp, Homo sapiens
ccccaacctcagggctcccagg

SEQ ID NO: 655239 - DNA, 15 bp, Homo sapiens
ccccaataaaggcag

SEQ ID NO: 655240 - DNA, 17 bp, Homo sapiens
ccccaataaaggcagct

SEQ ID NO: 655241 - DNA, 20 bp, Homo sapiens
ccccaataaaggcagctgcc

SEQ ID NO: 655242 - DNA, 22 bp, Homo sapiens
ccccaataaaggcagctgcctc

SEQ ID NO: 655243 - DNA, 23 bp, Homo sapiens
ccccaataaaggcagctgcctct

SEQ ID NO: 655244 - DNA, 24 bp, Homo sapiens
ccccaataaaggcagctgcctctg

SEQ ID NO: 655245 - DNA, 13 bp, Homo sapiens
ccccaattctccc

SEQ ID NO: 655246 - DNA, 17 bp, Homo sapiens
ccccacagcgtccctgg

SEQ ID NO: 655247 - DNA, 14 bp, Homo sapiens
ccccactcctgtca

SEQ ID NO: 655248 - DNA, 14 bp, Homo sapiens
ccccactgctgagc

SEQ ID NO: 655249 - DNA, 16 bp, Homo sapiens
ccccactgctgagctg

SEQ ID NO: 655250 - DNA, 17 bp, Homo sapiens
ccccagcccacctgctc

SEQ ID NO: 655251 - DNA, 13 bp, Homo sapiens
ccccatccttcag

SEQ ID NO: 655252 - DNA, 21 bp, Homo sapiens
ccccatctaggtcctggctgg

SEQ ID NO: 655253 - DNA, 13 bp, Homo sapiens
ccccatctccctg

SEQ ID NO: 655254 - DNA, 17 bp, Homo sapiens
ccccatctccctgcctg

SEQ ID NO: 655255 - DNA, 19 bp, Homo sapiens
ccccatctccctgcctggc

SEQ ID NO: 655256 - DNA, 19 bp, Homo sapiens
cccccaataaaggcagctg

SEQ ID NO: 655257 - DNA, 20 bp, Homo sapiens
cccccaataaaggcagctgc

SEQ ID NO: 655258 - DNA, 21 bp, Homo sapiens
cccccaataaaggcagctgcc

SEQ ID NO: 655259 - DNA, 23 bp, Homo sapiens
cccccaataaaggcagctgcctc

SEQ ID NO: 655260 - DNA, 14 bp, Homo sapiens
cccccatccttcag

SEQ ID NO: 655261 - DNA, 12 bp, Homo sapiens
cccccattttac

SEQ ID NO: 655262 - DNA, 19 bp, Homo sapiens
ccccctcagccttgggacc

SEQ ID NO: 655263 - DNA, 16 bp, Homo sapiens
cccccttaaatttaat

SEQ ID NO: 655264 - DNA, 13 bp, Homo sapiens
cccctcacccctc

SEQ ID NO: 655265 - DNA, 16 bp, Homo sapiens
cccctcagccttggga

SEQ ID NO: 655266 - DNA, 21 bp, Homo sapiens
cccctcccacacccaaagctg

SEQ ID NO: 655267 - DNA, 17 bp, Homo sapiens
cccctgagccagcaggg

SEQ ID NO: 655268 - DNA, 16 bp, Homo sapiens
cccctggctttgcctc

SEQ ID NO: 655269 - DNA, 19 bp, Homo sapiens
cccctgtggataccaaggt

SEQ ID NO: 655270 - DNA, 19 bp, Homo sapiens
cccctttactcgtgcatta

SEQ ID NO: 655271 - DNA, 15 bp, Homo sapiens
cccgagttcctctgg

SEQ ID NO: 655272 - DNA, 12 bp, Homo sapiens
cccgccaggagc

SEQ ID NO: 655273 - DNA, 18 bp, Homo sapiens
cccgctccatggaaaagc

SEQ ID NO: 655274 - DNA, 23 bp, Homo sapiens
cccggcatgagactcagtgcaga

SEQ ID NO: 655275 - DNA, 20 bp, Homo sapiens
cccggtgggacccccgtggg

SEQ ID NO: 655276 - DNA, 23 bp, Homo sapiens
cccggtgtatcctggccctgggg

SEQ ID NO: 655277 - DNA, 22 bp, Homo sapiens
cccgtggggcagggagctgggc

SEQ ID NO: 655278 - DNA, 17 bp, Homo sapiens
ccctaagtggctgcctt

SEQ ID NO: 655279 - DNA, 20 bp, Homo sapiens
ccctaagtggctgccttctt

SEQ ID NO: 655280 - DNA, 21 bp, Homo sapiens
ccctagagccctctcctccct

SEQ ID NO: 655281 - DNA, 23 bp, Homo sapiens
ccctagcagcccaccctgctgct

SEQ ID NO: 655282 - DNA, 21 bp, Homo sapiens
ccctagctataccagcagaaa

SEQ ID NO: 655283 - DNA, 13 bp, Homo sapiens
ccctatgctgtgc

SEQ ID NO: 655284 - DNA, 16 bp, Homo sapiens
ccctcaaagaggcctt

SEQ ID NO: 655285 - DNA, 17 bp, Homo sapiens
ccctcatctatgaggaa

SEQ ID NO: 655286 - DNA, 19 bp, Homo sapiens
ccctccaccccccactcag

SEQ ID NO: 655287 - DNA, 19 bp, Homo sapiens
ccctcctgtgctgggggaa

SEQ ID NO: 655288 - DNA, 23 bp, Homo sapiens
ccctcctgtgctgggggaatgag

SEQ ID NO: 655289 - DNA, 15 bp, Homo sapiens
ccctcgcctcctcct

SEQ ID NO: 655290 - DNA, 16 bp, Homo sapiens
ccctcgcctcctcctc

SEQ ID NO: 655291 - DNA, 13 bp, Homo sapiens
ccctctcaccaaa

SEQ ID NO: 655292 - DNA, 15 bp, Homo sapiens
ccctctcatctcagg

SEQ ID NO: 655293 - DNA, 21 bp, Homo sapiens
ccctctccttgcccccagtgc

SEQ ID NO: 655294 - DNA, 15 bp, Homo sapiens
ccctctcgcctcatt

SEQ ID NO: 655295 - DNA, 13 bp, Homo sapiens
ccctcttgcccat

SEQ ID NO: 655296 - DNA, 16 bp, Homo sapiens
ccctcttgcccatcct

SEQ ID NO: 655297 - DNA, 20 bp, Homo sapiens
ccctgagaagctgctccagg

SEQ ID NO: 655298 - DNA, 18 bp, Homo sapiens
ccctgaggtcagggagtg

SEQ ID NO: 655299 - DNA, 21 bp, Homo sapiens
ccctgaggtcagggagtgctg

SEQ ID NO: 655300 - DNA, 18 bp, Homo sapiens
ccctgcagcggtggttgt

SEQ ID NO: 655301 - DNA, 16 bp, Homo sapiens
ccctgctgcgctgctt

SEQ ID NO: 655302 - DNA, 19 bp, Homo sapiens
ccctggaactcctggcctt

SEQ ID NO: 655303 - DNA, 13 bp, Homo sapiens
ccctggctccctc

SEQ ID NO: 655304 - DNA, 15 bp, Homo sapiens
ccctggctccctcct

SEQ ID NO: 655305 - DNA, 22 bp, Homo sapiens
ccctggctgttctgtggttcct

SEQ ID NO: 655306 - DNA, 12 bp, Homo sapiens
ccctgggccagg

SEQ ID NO: 655307 - DNA, 17 bp, Homo sapiens
ccctgggctggggcctc

SEQ ID NO: 655308 - DNA, 16 bp, Homo sapiens
ccctgggtctggggac

SEQ ID NO: 655309 - DNA, 23 bp, Homo sapiens
ccctgggtctggggacaggcccg

SEQ ID NO: 655310 - DNA, 14 bp, Homo sapiens
ccctgtaggcctca

SEQ ID NO: 655311 - DNA, 20 bp, Homo sapiens
ccctgtcctgcagtcccaca

SEQ ID NO: 655312 - DNA, 23 bp, Homo sapiens
ccctgtgagattttgcttttcca

SEQ ID NO: 655313 - DNA, 22 bp, Homo sapiens
cccttaaacacaggctgtcctt

SEQ ID NO: 655314 - DNA, 16 bp, Homo sapiens
cccttagaaaatgtgt

SEQ ID NO: 655315 - DNA, 15 bp, Homo sapiens
cccttccatgtgcct

SEQ ID NO: 655316 - DNA, 17 bp, Homo sapiens
cccttccatgtgccttt

SEQ ID NO: 655317 - DNA, 23 bp, Homo sapiens
cccttccgcagtgtggccaggct

SEQ ID NO: 655318 - DNA, 18 bp, Homo sapiens
cccttcctcctgcctttc

SEQ ID NO: 655319 - DNA, 13 bp, Homo sapiens
cccttgcctctgc

SEQ ID NO: 655320 - DNA, 22 bp, Homo sapiens
cccttgcctctgccctggattg

SEQ ID NO: 655321 - DNA, 22 bp, Homo sapiens
cccttgccttcctcagctgcct

SEQ ID NO: 655322 - DNA, 18 bp, Homo sapiens
cccttgcttgcctgcagg

SEQ ID NO: 655323 - DNA, 23 bp, Homo sapiens
cccttggtgccctcgcctcctcc

SEQ ID NO: 655324 - DNA, 15 bp, Homo sapiens
ccctttatttctctt

SEQ ID NO: 655325 - DNA, 15 bp, Homo sapiens
cccttttcccccttc

SEQ ID NO: 655326 - DNA, 11 bp, Homo sapiens
cccttttcctt

SEQ ID NO: 655327 - DNA, 22 bp, Homo sapiens
ccgactgactggaggaggcctg

SEQ ID NO: 655328 - DNA, 14 bp, Homo sapiens
ccgactgggctcaa

SEQ ID NO: 655329 - DNA, 18 bp, Homo sapiens
ccgagagcctcgcttttt

SEQ ID NO: 655330 - DNA, 21 bp, Homo sapiens
ccgagagcttggactacacaa

SEQ ID NO: 655331 - DNA, 20 bp, Homo sapiens
ccgaggcgggtggatcacga

SEQ ID NO: 655332 - DNA, 20 bp, Homo sapiens
ccgaggtgggcagatcactt

SEQ ID NO: 655333 - DNA, 15 bp, Homo sapiens
ccgaggtggttcaga

SEQ ID NO: 655334 - DNA, 17 bp, Homo sapiens
ccgatagagggacggcc

SEQ ID NO: 655335 - DNA, 19 bp, Homo sapiens
ccgatgttattagatgtta

SEQ ID NO: 655336 - DNA, 22 bp, Homo sapiens
ccgattttttttttttcctctt

SEQ ID NO: 655337 - DNA, 22 bp, Homo sapiens
ccgcctgcttcttctctccaca

SEQ ID NO: 655338 - DNA, 14 bp, Homo sapiens
ccgcgtgtgcctgt

SEQ ID NO: 655339 - DNA, 13 bp, Homo sapiens
ccgctgccagcct

SEQ ID NO: 655340 - DNA, 14 bp, Homo sapiens
ccgctgctgtgcaa

SEQ ID NO: 655341 - DNA, 22 bp, Homo sapiens
ccggcatgagactcagtgcaga

SEQ ID NO: 655342 - DNA, 23 bp, Homo sapiens
ccggcatgagactcagtgcagat

SEQ ID NO: 655343 - DNA, 14 bp, Homo sapiens
ccggccctgtgtgc

SEQ ID NO: 655344 - DNA, 15 bp, Homo sapiens
ccggccctgtgtgca

SEQ ID NO: 655345 - DNA, 13 bp, Homo sapiens
ccgggggccccac

SEQ ID NO: 655346 - DNA, 16 bp, Homo sapiens
ccgggggccccacctc

SEQ ID NO: 655347 - DNA, 20 bp, Homo sapiens
ccggtcagaggagcgcaggc

SEQ ID NO: 655348 - DNA, 13 bp, Homo sapiens
ccggtcagtgcct

SEQ ID NO: 655349 - DNA, 20 bp, Homo sapiens
ccggtcagtgccttttggaa

SEQ ID NO: 655350 - DNA, 22 bp, Homo sapiens
ccggtgggacccccgtggggca

SEQ ID NO: 655351 - DNA, 20 bp, Homo sapiens
ccggtgtatcctggccctgg

SEQ ID NO: 655352 - DNA, 15 bp, Homo sapiens
ccgtagctctgctgc

SEQ ID NO: 655353 - DNA, 17 bp, Homo sapiens
ccgtagctctgctgctg

SEQ ID NO: 655354 - DNA, 17 bp, Homo sapiens
ccgtcccaccagcttca

SEQ ID NO: 655355 - DNA, 16 bp, Homo sapiens
ccgtgaactctggtgc

SEQ ID NO: 655356 - DNA, 13 bp, Homo sapiens
ccgtggggcaggg

SEQ ID NO: 655357 - DNA, 14 bp, Homo sapiens
ccgtggggcaggga

SEQ ID NO: 655358 - DNA, 22 bp, Homo sapiens
ccgtggggcagggagctgggcc

SEQ ID NO: 655359 - DNA, 23 bp, Homo sapiens
ccgtggggcagggagctgggccc

SEQ ID NO: 655360 - DNA, 17 bp, Homo sapiens
ccgtgtctgtctggcac

SEQ ID NO: 655361 - DNA, 19 bp, Homo sapiens
cctaaatagcagaaagaag

SEQ ID NO: 655362 - DNA, 13 bp, Homo sapiens
cctaaggaacctt

SEQ ID NO: 655363 - DNA, 16 bp, Homo sapiens
cctaaggaaccttcct

SEQ ID NO: 655364 - DNA, 15 bp, Homo sapiens
cctaattcttctgtc

SEQ ID NO: 655365 - DNA, 13 bp, Homo sapiens
cctaatttgaaca

SEQ ID NO: 655366 - DNA, 18 bp, Homo sapiens
cctacagactccatctct

SEQ ID NO: 655367 - DNA, 20 bp, Homo sapiens
cctacagactccatctcttc

SEQ ID NO: 655368 - DNA, 21 bp, Homo sapiens
cctacagactccatctcttct

SEQ ID NO: 655369 - DNA, 12 bp, Homo sapiens
cctacctgcctt

SEQ ID NO: 655370 - DNA, 15 bp, Homo sapiens
ccagctaatttttgt

SEQ ID NO: 655371 - DNA, 16 bp, Homo sapiens
ccagctacttgggagg

SEQ ID NO: 655372 - DNA, 17 bp, Homo sapiens
ccagctacttgggaggc

SEQ ID NO: 655373 - DNA, 21 bp, Homo sapiens
ccagctgagtgagtgggagag

SEQ ID NO: 655374 - DNA, 20 bp, Homo sapiens
ccagctgcccttccgcagtg

SEQ ID NO: 655375 - DNA, 21 bp, Homo sapiens
ccagcttctcatgttaaatat

SEQ ID NO: 655376 - DNA, 22 bp, Homo sapiens
ccagcttctcatgttaaatatt

SEQ ID NO: 655377 - DNA, 13 bp, Homo sapiens
ccaggaatattaa

SEQ ID NO: 655378 - DNA, 14 bp, Homo sapiens
ccaggaatattaag

SEQ ID NO: 655379 - DNA, 17 bp, Homo sapiens
ccaggagagcctggggg

SEQ ID NO: 655380 - DNA, 15 bp, Homo sapiens
ccaggagctgtcacc

SEQ ID NO: 655381 - DNA, 14 bp, Homo sapiens
ccaggcctgcagca

SEQ ID NO: 655382 - DNA, 13 bp, Homo sapiens
ccaggcctgcctc

SEQ ID NO: 655383 - DNA, 16 bp, Homo sapiens
ccaggcctgcctccca

SEQ ID NO: 655384 - DNA, 18 bp, Homo sapiens
ccaggcctgtggctccct

SEQ ID NO: 655385 - DNA, 19 bp, Homo sapiens
ccaggccttacatctggct

SEQ ID NO: 655386 - DNA, 15 bp, Homo sapiens
ccaggctggtctcaa

SEQ ID NO: 655387 - DNA, 14 bp, Homo sapiens
ccagggcaagagag

SEQ ID NO: 655388 - DNA, 19 bp, Homo sapiens
ccagggcaccatccagctc

SEQ ID NO: 655389 - DNA, 17 bp, Homo sapiens
ccagggctgccctgaga

SEQ ID NO: 655390 - DNA, 19 bp, Homo sapiens
ccagggctgccctgagaag

SEQ ID NO: 655391 - DNA, 13 bp, Homo sapiens
ccaggggaacctg

SEQ ID NO: 655392 - DNA, 15 bp, Homo sapiens
ccaggggaacctgcc

SEQ ID NO: 655393 - DNA, 16 bp, Homo sapiens
ccaggggaacctgcca

SEQ ID NO: 655394 - DNA, 21 bp, Homo sapiens
ccaggggaggcctgaggcttc

SEQ ID NO: 655395 - DNA, 18 bp, Homo sapiens
ccagggggtctcacccat

SEQ ID NO: 655396 - DNA, 15 bp, Homo sapiens
ccaggggtctccctg

SEQ ID NO: 655397 - DNA, 18 bp, Homo sapiens
ccaggggtctccctggct

SEQ ID NO: 655398 - DNA, 18 bp, Homo sapiens
ccagggtctctccctcag

SEQ ID NO: 655399 - DNA, 16 bp, Homo sapiens
ccaggtatcaaatcaa

SEQ ID NO: 655400 - DNA, 13 bp, Homo sapiens
ccaggtgcagagg

SEQ ID NO: 655401 - DNA, 20 bp, Homo sapiens
ccaggtgcagaggtaccctg

SEQ ID NO: 655402 - DNA, 19 bp, Homo sapiens
ccaggtggaaggcagacag

SEQ ID NO: 655403 - DNA, 20 bp, Homo sapiens
ccaggtggaaggcagacagc

SEQ ID NO: 655404 - DNA, 14 bp, Homo sapiens
ccagtaccttgctt

SEQ ID NO: 655405 - DNA, 13 bp, Homo sapiens
ccagtacttctaa

SEQ ID NO: 655406 - DNA, 14 bp, Homo sapiens
ccagtacttctaag

SEQ ID NO: 655407 - DNA, 14 bp, Homo sapiens
ccagtcccacactg

SEQ ID NO: 655408 - DNA, 15 bp, Homo sapiens
ccagtctgaagatgt

SEQ ID NO: 655409 - DNA, 15 bp, Homo sapiens
ccagtgaagatattt

SEQ ID NO: 655410 - DNA, 15 bp, Homo sapiens
ccagtgcagaatgta

SEQ ID NO: 655411 - DNA, 18 bp, Homo sapiens
ccagtgcatggtggccag

SEQ ID NO: 655412 - DNA, 19 bp, Homo sapiens
ccagtgcctcaccttccaa

SEQ ID NO: 655413 - DNA, 16 bp, Homo sapiens
ccagtgcgattctgga

SEQ ID NO: 655414 - DNA, 19 bp, Homo sapiens
ccagtggatgccacagccc

SEQ ID NO: 655415 - DNA, 17 bp, Homo sapiens
ccagtggctgttctgga

SEQ ID NO: 655416 - DNA, 14 bp, Homo sapiens
ccagtggggcctgt

SEQ ID NO: 655417 - DNA, 17 bp, Homo sapiens
ccagtggggcctgtgga

SEQ ID NO: 655418 - DNA, 19 bp, Homo sapiens
ccagttaaaatgtgtttct

SEQ ID NO: 655419 - DNA, 18 bp, Homo sapiens
ccagttatgtttgaatga

SEQ ID NO: 655420 - DNA, 14 bp, Homo sapiens
ccagttttccctgg

SEQ ID NO: 655421 - DNA, 16 bp, Homo sapiens
ccatagacatgaaagg

SEQ ID NO: 655422 - DNA, 19 bp, Homo sapiens
ccatattctggttcttgaa

SEQ ID NO: 655423 - DNA, 20 bp, Homo sapiens
ccatattctggttcttgaaa

SEQ ID NO: 655424 - DNA, 20 bp, Homo sapiens
ccatcaagaacctacagact

SEQ ID NO: 655425 - DNA, 15 bp, Homo sapiens
ccatcagtgaaagaa

SEQ ID NO: 655426 - DNA, 13 bp, Homo sapiens
ccatcatctctga

SEQ ID NO: 655427 - DNA, 18 bp, Homo sapiens
ccatccagacctggctcc

SEQ ID NO: 655428 - DNA, 14 bp, Homo sapiens
ccatccagctcccc

SEQ ID NO: 655429 - DNA, 18 bp, Homo sapiens
ccatctaggtcctggctg

SEQ ID NO: 655430 - DNA, 22 bp, Homo sapiens
ccatctgacaaaatggggcaga

SEQ ID NO: 655431 - DNA, 19 bp, Homo sapiens
ccatctgtgatatgccata

SEQ ID NO: 655432 - DNA, 16 bp, Homo sapiens
ccatgatttagcaagc

SEQ ID NO: 655433 - DNA, 18 bp, Homo sapiens
ccatgatttagcaagcaa

SEQ ID NO: 655434 - DNA, 12 bp, Homo sapiens
ccatgcaactgg

SEQ ID NO: 655435 - DNA, 12 bp, Homo sapiens
ccatggccccca

SEQ ID NO: 655436 - DNA, 23 bp, Homo sapiens
ccatggcccccaataaaggcagc

SEQ ID NO: 655437 - DNA, 13 bp, Homo sapiens
ccatggcttctgg

SEQ ID NO: 655438 - DNA, 18 bp, Homo sapiens
ccatgtatttgttatata

SEQ ID NO: 655439 - DNA, 20 bp, Homo sapiens
ccatgtcaccggtcagtgcc

SEQ ID NO: 655440 - DNA, 13 bp, Homo sapiens
ccatgtgcctttc

SEQ ID NO: 655441 - DNA, 15 bp, Homo sapiens
ccatgtgcctttctt

SEQ ID NO: 655442 - DNA, 19 bp, Homo sapiens
ccatgtgcctttctttgcc

SEQ ID NO: 655443 - DNA, 20 bp, Homo sapiens
ccatgtgcctttctttgcct

SEQ ID NO: 655444 - DNA, 17 bp, Homo sapiens
ccatgtgtcctggtgag

SEQ ID NO: 655445 - DNA, 20 bp, Homo sapiens
ccatgttggccaggatggtc

SEQ ID NO: 655446 - DNA, 18 bp, Homo sapiens
ccattatttttaggatgt

SEQ ID NO: 655447 - DNA, 20 bp, Homo sapiens
ccattgaaggcttaattgac

SEQ ID NO: 655448 - DNA, 15 bp, Homo sapiens
ccatttccattgctt

SEQ ID NO: 655449 - DNA, 14 bp, Homo sapiens
ccattttaatttta

SEQ ID NO: 655450 - DNA, 22 bp, Homo sapiens
ccattttattaataatatttat

SEQ ID NO: 655451 - DNA, 16 bp, Homo sapiens
cccaaactcctttctt

SEQ ID NO: 655452 - DNA, 16 bp, Homo sapiens
cccaagaaacctgact

SEQ ID NO: 655453 - DNA, 19 bp, Homo sapiens
cccaaggagggggcctcat

SEQ ID NO: 655454 - DNA, 22 bp, Homo sapiens
cccaaggagggggcctcattgt

SEQ ID NO: 655455 - DNA, 18 bp, Homo sapiens
cccaaggcattgattgca

SEQ ID NO: 655456 - DNA, 20 bp, Homo sapiens
cccaataaaggcagctgcct

SEQ ID NO: 655457 - DNA, 12 bp, Homo sapiens
cccaatatattc

SEQ ID NO: 655458 - DNA, 16 bp, Homo sapiens
cccaattctgcccgct

SEQ ID NO: 655459 - DNA, 16 bp, Homo sapiens
cccacacccaaagctg

SEQ ID NO: 655460 - DNA, 19 bp, Homo sapiens
cccacactgtggccaggcc

SEQ ID NO: 655461 - DNA, 21 bp, Homo sapiens
cccacactgtggccaggcctt

SEQ ID NO: 655462 - DNA, 17 bp, Homo sapiens
cccacagcgtccctggc

SEQ ID NO: 655463 - DNA, 18 bp, Homo sapiens
cccacagcgtccctggcg

SEQ ID NO: 655464 - DNA, 14 bp, Homo sapiens
cccaccagcttcac

SEQ ID NO: 655465 - DNA, 17 bp, Homo sapiens
cccaccctgctgctggt

SEQ ID NO: 655466 - DNA, 14 bp, Homo sapiens
cccacctccaggct

SEQ ID NO: 655467 - DNA, 18 bp, Homo sapiens
cccacctctcctgccctg

SEQ ID NO: 655468 - DNA, 14 bp, Homo sapiens
cccacgagggtctc

SEQ ID NO: 655469 - DNA, 13 bp, Homo sapiens
cccactcctgtca

SEQ ID NO: 655470 - DNA, 14 bp, Homo sapiens
cccactgctgagct

SEQ ID NO: 655471 - DNA, 12 bp, Homo sapiens
cccactgtatga

SEQ ID NO: 655472 - DNA, 17 bp, Homo sapiens
cccacttcccaccctgc

SEQ ID NO: 655473 - DNA, 13 bp, Homo sapiens
cccagagaacagc

SEQ ID NO: 655474 - DNA, 23 bp, Homo sapiens
cccagcactttgggaggccgagg

SEQ ID NO: 655475 - DNA, 13 bp, Homo sapiens
cccagcaggcaga

SEQ ID NO: 655476 - DNA, 12 bp, Homo sapiens
cccagcctcact

SEQ ID NO: 655477 - DNA, 18 bp, Homo sapiens
cccagcctcacttccttt

SEQ ID NO: 655478 - DNA, 17 bp, Homo sapiens
cccaggcagggagacgg

SEQ ID NO: 655479 - DNA, 19 bp, Homo sapiens
cccaggctggagtgcagtg

SEQ ID NO: 655480 - DNA, 18 bp, Homo sapiens
cccaggggtctccctggc

SEQ ID NO: 655481 - DNA, 16 bp, Homo sapiens
cccaggtgatattttt

SEQ ID NO: 655482 - DNA, 16 bp, Homo sapiens
cccagtcccacactgt

SEQ ID NO: 655483 - DNA, 10 bp, Homo sapiens
cccagtgcag

SEQ ID NO: 655484 - DNA, 14 bp, Homo sapiens
cccagtgcatggtg

SEQ ID NO: 655485 - DNA, 18 bp, Homo sapiens
cccagtgcatggtggcca

SEQ ID NO: 655486 - DNA, 22 bp, Homo sapiens
cccataacaattcccccatcct

SEQ ID NO: 655487 - DNA, 17 bp, Homo sapiens
cccatcagttccagcct

SEQ ID NO: 655488 - DNA, 17 bp, Homo sapiens
cccatccagacctggct

SEQ ID NO: 655489 - DNA, 22 bp, Homo sapiens
cccatccagacctggctccact

SEQ ID NO: 655490 - DNA, 14 bp, Homo sapiens
cccatctccctgcc

SEQ ID NO: 655491 - DNA, 17 bp, Homo sapiens
cccatgcaagcagagga

SEQ ID NO: 655492 - DNA, 21 bp, Homo sapiens
cccatgcaagcagaggaccag

SEQ ID NO: 655493 - DNA, 13 bp, Homo sapiens
cccatggccccca

SEQ ID NO: 655494 - DNA, 20 bp, Homo sapiens
cagggtctgtgtgaatgtgg

SEQ ID NO: 655495 - DNA, 23 bp, Homo sapiens
cagggtctgtgtgaatgtgggca

SEQ ID NO: 655496 - DNA, 18 bp, Homo sapiens
cagggttcaaaatgtctg

SEQ ID NO: 655497 - DNA, 17 bp, Homo sapiens
caggtaagtctggtttt

SEQ ID NO: 655498 - DNA, 16 bp, Homo sapiens
caggtatggctctgca

SEQ ID NO: 655499 - DNA, 14 bp, Homo sapiens
caggtcaccaagca

SEQ ID NO: 655500 - DNA, 21 bp, Homo sapiens
caggtcagggaggatctgttc

SEQ ID NO: 655501 - DNA, 13 bp, Homo sapiens
caggtgcagaggt

SEQ ID NO: 655502 - DNA, 15 bp, Homo sapiens
caggtgggcagacag

SEQ ID NO: 655503 - DNA, 20 bp, Homo sapiens
cagtaaatagtgtcatataa

SEQ ID NO: 655504 - DNA, 20 bp, Homo sapiens
cagtaacccccttaaattta

SEQ ID NO: 655505 - DNA, 20 bp, Homo sapiens
cagtaagatatctcaatgaa

SEQ ID NO: 655506 - DNA, 16 bp, Homo sapiens
cagtacctctcaagct

SEQ ID NO: 655507 - DNA, 22 bp, Homo sapiens
cagtactattcaggtaacacta

SEQ ID NO: 655508 - DNA, 12 bp, Homo sapiens
cagtacttctaa

SEQ ID NO: 655509 - DNA, 13 bp, Homo sapiens
cagtacttctaag

SEQ ID NO: 655510 - DNA, 19 bp, Homo sapiens
cagtagtgctaatgcattt

SEQ ID NO: 655511 - DNA, 21 bp, Homo sapiens
cagtatggtctaacactggca

SEQ ID NO: 655512 - DNA, 20 bp, Homo sapiens
cagtattgccccctctcact

SEQ ID NO: 655513 - DNA, 18 bp, Homo sapiens
cagtcactgggagaggtt

SEQ ID NO: 655514 - DNA, 13 bp, Homo sapiens
cagtcatcatcag

SEQ ID NO: 655515 - DNA, 15 bp, Homo sapiens
cagtcatcatcaggg

SEQ ID NO: 655516 - DNA, 22 bp, Homo sapiens
cagtcatcatcagggcctgggg

SEQ ID NO: 655517 - DNA, 12 bp, Homo sapiens
cagtcccacact

SEQ ID NO: 655518 - DNA, 19 bp, Homo sapiens
cagtcccacactgtgcaga

SEQ ID NO: 655519 - DNA, 18 bp, Homo sapiens
cagtcccacactgtggcc

SEQ ID NO: 655520 - DNA, 19 bp, Homo sapiens
cagtcccacactgtggcca

SEQ ID NO: 655521 - DNA, 16 bp, Homo sapiens
cagtcctaatttgaac

SEQ ID NO: 655522 - DNA, 17 bp, Homo sapiens
cagtcctaatttgaaca

SEQ ID NO: 655523 - DNA, 17 bp, Homo sapiens
cagtccttactccccca

SEQ ID NO: 655524 - DNA, 20 bp, Homo sapiens
cagtccttactcccccacca

SEQ ID NO: 655525 - DNA, 17 bp, Homo sapiens
cagtcgcctgcctgcag

SEQ ID NO: 655526 - DNA, 21 bp, Homo sapiens
cagtctaaacagagtccggga

SEQ ID NO: 655527 - DNA, 12 bp, Homo sapiens
cagtctcattgt

SEQ ID NO: 655528 - DNA, 13 bp, Homo sapiens
cagtctcattgtc

SEQ ID NO: 655529 - DNA, 13 bp, Homo sapiens
cagtctcatttct

SEQ ID NO: 655530 - DNA, 15 bp, Homo sapiens
cattttatcattaaa

SEQ ID NO: 655531 - DNA, 23 bp, Homo sapiens
cattttctaaataaaaatatgta

SEQ ID NO: 655532 - DNA, 14 bp, Homo sapiens
cattttgaaacaaa

SEQ ID NO: 655533 - DNA, 16 bp, Homo sapiens
catttttaagaaagga

SEQ ID NO: 655534 - DNA, 14 bp, Homo sapiens
catttttaccatta

SEQ ID NO: 655535 - DNA, 23 bp, Homo sapiens
catttttgtatttttcatcttta

SEQ ID NO: 655536 - DNA, 16 bp, Homo sapiens
cattttttaatttact

SEQ ID NO: 655537 - DNA, 14 bp, Homo sapiens
ccaaacaggacagc

SEQ ID NO: 655538 - DNA, 17 bp, Homo sapiens
ccaaaccgccagcgaac

SEQ ID NO: 655539 - DNA, 21 bp, Homo sapiens
ccaaactgttctgagaaggtg

SEQ ID NO: 655540 - DNA, 12 bp, Homo sapiens
ccaaagaggctg

SEQ ID NO: 655541 - DNA, 20 bp, Homo sapiens
ccaaagaggctgcccctctc

SEQ ID NO: 655542 - DNA, 15 bp, Homo sapiens
ccaaagctgagcctg

SEQ ID NO: 655543 - DNA, 21 bp, Homo sapiens
ccaaagctgagcctgcaggga

SEQ ID NO: 655544 - DNA, 16 bp, Homo sapiens
ccaaatacctcaattt

SEQ ID NO: 655545 - DNA, 20 bp, Homo sapiens
ccaaatataagacatttgtt

SEQ ID NO: 655546 - DNA, 18 bp, Homo sapiens
ccaaatgaaaaatctcaa

SEQ ID NO: 655547 - DNA, 13 bp, Homo sapiens
ccaacatgcactg

SEQ ID NO: 655548 - DNA, 16 bp, Homo sapiens
ccaactgccaggctgc

SEQ ID NO: 655549 - DNA, 16 bp, Homo sapiens
ccaagacagggctcat

SEQ ID NO: 655550 - DNA, 17 bp, Homo sapiens
ccaaggaaacgctacct

SEQ ID NO: 655551 - DNA, 12 bp, Homo sapiens
ccaaggaagcag

SEQ ID NO: 655552 - DNA, 21 bp, Homo sapiens
ccaaggagggggcctcattgt

SEQ ID NO: 655553 - DNA, 21 bp, Homo sapiens
ccaagtgtgctctttttttaa

SEQ ID NO: 655554 - DNA, 13 bp, Homo sapiens
ccaataaaggcag

SEQ ID NO: 655555 - DNA, 16 bp, Homo sapiens
ccaataaaggcagctg

SEQ ID NO: 655556 - DNA, 22 bp, Homo sapiens
ccaataaaggcagctgcctctg

SEQ ID NO: 655557 - DNA, 24 bp, Homo sapiens
ccaataaaggcagctgcctctgct

SEQ ID NO: 655558 - DNA, 23 bp, Homo sapiens
ccaataataaatgccctcttctc

SEQ ID NO: 655559 - DNA, 20 bp, Homo sapiens
ccaatgaaaacatgtactac

SEQ ID NO: 655560 - DNA, 21 bp, Homo sapiens
ccaatgagactctagggtcca

SEQ ID NO: 655561 - DNA, 19 bp, Homo sapiens
ccaatgtgacctggggcag

SEQ ID NO: 655562 - DNA, 15 bp, Homo sapiens
ccaattaagcagctt

SEQ ID NO: 655563 - DNA, 21 bp, Homo sapiens
ccaattacatggaacttttct

SEQ ID NO: 655564 - DNA, 16 bp, Homo sapiens
ccacaagtgccctcca

SEQ ID NO: 655565 - DNA, 14 bp, Homo sapiens
ccacactgtggcca

SEQ ID NO: 655566 - DNA, 19 bp, Homo sapiens
ccacactgtggccaggcct

SEQ ID NO: 655567 - DNA, 16 bp, Homo sapiens
ccacacttgaaacctt

SEQ ID NO: 655568 - DNA, 17 bp, Homo sapiens
ccacacttgaaaccttt

SEQ ID NO: 655569 - DNA, 17 bp, Homo sapiens
ccacagcgtccctggcg

SEQ ID NO: 655570 - DNA, 17 bp, Homo sapiens
ccacagtggggctgcag

SEQ ID NO: 655571 - DNA, 19 bp, Homo sapiens
ccacagtggggctgcaggc

SEQ ID NO: 655572 - DNA, 14 bp, Homo sapiens
ccacatcaaacctt

SEQ ID NO: 655573 - DNA, 19 bp, Homo sapiens
ccacatgctgcctggcaca

SEQ ID NO: 655574 - DNA, 23 bp, Homo sapiens
ccacatgctgcctggcacagacc

SEQ ID NO: 655575 - DNA, 18 bp, Homo sapiens
ccacatggcggagagttt

SEQ ID NO: 655576 - DNA, 16 bp, Homo sapiens
ccacattactttttat

SEQ ID NO: 655577 - DNA, 14 bp, Homo sapiens
ccaccacccccttt

SEQ ID NO: 655578 - DNA, 12 bp, Homo sapiens
ccaccactcagg

SEQ ID NO: 655579 - DNA, 15 bp, Homo sapiens
ccaccactcaggcca

SEQ ID NO: 655580 - DNA, 12 bp, Homo sapiens
ccacccagcagg

SEQ ID NO: 655581 - DNA, 14 bp, Homo sapiens
ccacccatgtcacc

SEQ ID NO: 655582 - DNA, 22 bp, Homo sapiens
ccaccccccactcagtgcctcc

SEQ ID NO: 655583 - DNA, 13 bp, Homo sapiens
ccaccctgcccct

SEQ ID NO: 655584 - DNA, 18 bp, Homo sapiens
ccaccctgctgctggtgc

SEQ ID NO: 655585 - DNA, 12 bp, Homo sapiens
ccacctctcctg

SEQ ID NO: 655586 - DNA, 11 bp, Homo sapiens
ccacctggcaa

SEQ ID NO: 655587 - DNA, 22 bp, Homo sapiens
ccacctggcaaaggacccttga

SEQ ID NO: 655588 - DNA, 23 bp, Homo sapiens
ccacctggcaaaggacccttgag

SEQ ID NO: 655589 - DNA, 11 bp, Homo sapiens
ccaccttccca

SEQ ID NO: 655590 - DNA, 13 bp, Homo sapiens
ccacgattctccc

SEQ ID NO: 655591 - DNA, 15 bp, Homo sapiens
ccacgctcaccccct

SEQ ID NO: 655592 - DNA, 21 bp, Homo sapiens
ccactacttgtggggctaagg

SEQ ID NO: 655593 - DNA, 14 bp, Homo sapiens
ccactcagtgcctc

SEQ ID NO: 655594 - DNA, 16 bp, Homo sapiens
ccactcagtgcctcca

SEQ ID NO: 655595 - DNA, 12 bp, Homo sapiens
ccactcccagga

SEQ ID NO: 655596 - DNA, 20 bp, Homo sapiens
ccactcccccgtttctcctt

SEQ ID NO: 655597 - DNA, 21 bp, Homo sapiens
ccactcccccgtttctccttt

SEQ ID NO: 655598 - DNA, 13 bp, Homo sapiens
ccactcctccctc

SEQ ID NO: 655599 - DNA, 15 bp, Homo sapiens
ccactcttgatctct

SEQ ID NO: 655600 - DNA, 18 bp, Homo sapiens
ccactcttgatctctctt

SEQ ID NO: 655601 - DNA, 14 bp, Homo sapiens
ccactgctgagctg

SEQ ID NO: 655602 - DNA, 17 bp, Homo sapiens
ccacttgaaatgttagt

SEQ ID NO: 655603 - DNA, 10 bp, Homo sapiens
ccacttgtat

SEQ ID NO: 655604 - DNA, 21 bp, Homo sapiens
ccacttgtatatatggatcag

SEQ ID NO: 655605 - DNA, 19 bp, Homo sapiens
ccactttcatctacctttt

SEQ ID NO: 655606 - DNA, 22 bp, Homo sapiens
ccagaaccacacttgaaacctt

SEQ ID NO: 655607 - DNA, 20 bp, Homo sapiens
ccagaatctagagcaaagcc

SEQ ID NO: 655608 - DNA, 19 bp, Homo sapiens
ccagaatttaccatcatct

SEQ ID NO: 655609 - DNA, 17 bp, Homo sapiens
ccagaccagccctgcag

SEQ ID NO: 655610 - DNA, 20 bp, Homo sapiens
ccagacctggctccactctt

SEQ ID NO: 655611 - DNA, 11 bp, Homo sapiens
ccagactctgt

SEQ ID NO: 655612 - DNA, 12 bp, Homo sapiens
ccagagaacagc

SEQ ID NO: 655613 - DNA, 22 bp, Homo sapiens
ccagatggctggaaggggtcca

SEQ ID NO: 655614 - DNA, 10 bp, Homo sapiens
ccagcaacat

SEQ ID NO: 655615 - DNA, 15 bp, Homo sapiens
ccagcactttgggag

SEQ ID NO: 655616 - DNA, 12 bp, Homo sapiens
ccagcaggcaga

SEQ ID NO: 655617 - DNA, 19 bp, Homo sapiens
ccagccagggcaagagagc

SEQ ID NO: 655618 - DNA, 14 bp, Homo sapiens
ccagcccacctgct

SEQ ID NO: 655619 - DNA, 20 bp, Homo sapiens
ccagcccatggcccccaata

SEQ ID NO: 655620 - DNA, 21 bp, Homo sapiens
ccagcccatggcccccaataa

SEQ ID NO: 655621 - DNA, 23 bp, Homo sapiens
ccagcccatggcccccaataaag

SEQ ID NO: 655622 - DNA, 17 bp, Homo sapiens
ccagcccctcttcccca

SEQ ID NO: 655623 - DNA, 22 bp, Homo sapiens
ccagcctcgttggaagaggaac

SEQ ID NO: 655624 - DNA, 15 bp, Homo sapiens
ccagccttctctcaa

SEQ ID NO: 655625 - DNA, 20 bp, Homo sapiens
ccagccttgagccctggctg

SEQ ID NO: 655626 - DNA, 16 bp, Homo sapiens
ctgaatgcagaacggt

SEQ ID NO: 655627 - DNA, 18 bp, Homo sapiens
ctgaatgcctcctgtggg

SEQ ID NO: 655628 - DNA, 14 bp, Homo sapiens
ctgaattaaataaa

SEQ ID NO: 655629 - DNA, 16 bp, Homo sapiens
ctgaattaaataaata

SEQ ID NO: 655630 - DNA, 21 bp, Homo sapiens
ctgaattgtcagatgtggagt

SEQ ID NO: 655631 - DNA, 21 bp, Homo sapiens
ctgacaaaatggggcagaaga

SEQ ID NO: 655632 - DNA, 17 bp, Homo sapiens
ctgacaactgtgaagcc

SEQ ID NO: 655633 - DNA, 18 bp, Homo sapiens
ctgacatttcttctagtg

SEQ ID NO: 655634 - DNA, 23 bp, Homo sapiens
ctgacccactttgtaatttttgc

SEQ ID NO: 655635 - DNA, 17 bp, Homo sapiens
ctgaccggtgcttttat

SEQ ID NO: 655636 - DNA, 23 bp, Homo sapiens
ctgacctggcatctaattctgat

SEQ ID NO: 655637 - DNA, 24 bp, Homo sapiens
ctgacgcccgagagcctcgctttt

SEQ ID NO: 655638 - DNA, 22 bp, Homo sapiens
ctgacggcgcctttttggcctg

SEQ ID NO: 655639 - DNA, 15 bp, Homo sapiens
ctgactactttgcct

SEQ ID NO: 655640 - DNA, 18 bp, Homo sapiens
ctgactcaattatttgca

SEQ ID NO: 655641 - DNA, 20 bp, Homo sapiens
ctgactcaattatttgcata

SEQ ID NO: 655642 - DNA, 16 bp, Homo sapiens
ctgactcatcatttgt

SEQ ID NO: 655643 - DNA, 14 bp, Homo sapiens
ctgactgaatgcag

SEQ ID NO: 655644 - DNA, 23 bp, Homo sapiens
ctgactggaggaggcctgtccca

SEQ ID NO: 655645 - DNA, 14 bp, Homo sapiens
ctgagaagctgctc

SEQ ID NO: 655646 - DNA, 17 bp, Homo sapiens
ctgagaagctgctccag

SEQ ID NO: 655647 - DNA, 18 bp, Homo sapiens
ctgagaagctgctccagg

SEQ ID NO: 655648 - DNA, 18 bp, Homo sapiens
ctgagagaattggctcaa

SEQ ID NO: 655649 - DNA, 23 bp, Homo sapiens
ctgagagctgtttttgacagcct

SEQ ID NO: 655650 - DNA, 14 bp, Homo sapiens
ctgagaggctgtct

SEQ ID NO: 655651 - DNA, 19 bp, Homo sapiens
ctgagagtatttaggcaga

SEQ ID NO: 655652 - DNA, 15 bp, Homo sapiens
ctgagatggaaaagt

SEQ ID NO: 655653 - DNA, 23 bp, Homo sapiens
ctgaggacaagagaaaaaagcca

SEQ ID NO: 655654 - DNA, 22 bp, Homo sapiens
ctgaggatttaagggatggaaa

SEQ ID NO: 655655 - DNA, 20 bp, Homo sapiens
ctgaggcaggaggatcactt

SEQ ID NO: 655656 - DNA, 17 bp, Homo sapiens
ctgaggcctgccccctg

SEQ ID NO: 655657 - DNA, 22 bp, Homo sapiens
ctgaggcctgccccctgggctg

SEQ ID NO: 655658 - DNA, 20 bp, Homo sapiens
ctgagggtgtttcttcctgc

SEQ ID NO: 655659 - DNA, 15 bp, Homo sapiens
ctgaggtcagggagt

SEQ ID NO: 655660 - DNA, 20 bp, Homo sapiens
ctgaggtccttatgtcctgt

SEQ ID NO: 655661 - DNA, 14 bp, Homo sapiens
ctgagtctgggcag

SEQ ID NO: 655662 - DNA, 14 bp, Homo sapiens
ctgagtgagtggga

SEQ ID NO: 655663 - DNA, 14 bp, Homo sapiens
ctgagttggcctgg

SEQ ID NO: 655664 - DNA, 23 bp, Homo sapiens
ctgagttggcctggccatttcca

SEQ ID NO: 655665 - DNA, 14 bp, Homo sapiens
ctgataaactgacg

SEQ ID NO: 655666 - DNA, 21 bp, Homo sapiens
ctgataagcttcctagaaagt

SEQ ID NO: 655667 - DNA, 16 bp, Homo sapiens
ctgatactgggtctgc

SEQ ID NO: 655668 - DNA, 22 bp, Homo sapiens
ctgatcgtagaaaatttgcttt

SEQ ID NO: 655669 - DNA, 13 bp, Homo sapiens
ctgatcttttaaa

SEQ ID NO: 655670 - DNA, 19 bp, Homo sapiens
ctgatgattttcctttttc

SEQ ID NO: 655671 - DNA, 16 bp, Homo sapiens
ctgatggaaaatacca

SEQ ID NO: 655672 - DNA, 21 bp, Homo sapiens
ctgatggaaaataccagtgtt

SEQ ID NO: 655673 - DNA, 14 bp, Homo sapiens
ctgcaaacagaaca

SEQ ID NO: 655674 - DNA, 20 bp, Homo sapiens
ctgcaaacagaacagggtca

SEQ ID NO: 655675 - DNA, 21 bp, Homo sapiens
ctgcaaacagaacagggtcat

SEQ ID NO: 655676 - DNA, 16 bp, Homo sapiens
ctgcaaataaagcctt

SEQ ID NO: 655677 - DNA, 17 bp, Homo sapiens
ctgcaaattttaactgt

SEQ ID NO: 655678 - DNA, 22 bp, Homo sapiens
ctgcaatgaaagtcaaatttac

SEQ ID NO: 655679 - DNA, 23 bp, Homo sapiens
ctgcaatgaaagtcaaatttact

SEQ ID NO: 655680 - DNA, 17 bp, Homo sapiens
ctgcacaacagccctgc

SEQ ID NO: 655681 - DNA, 21 bp, Homo sapiens
ctgcacaacagccctgcctga

SEQ ID NO: 655682 - DNA, 14 bp, Homo sapiens
ctgcacacagggca

SEQ ID NO: 655683 - DNA, 22 bp, Homo sapiens
ctgcaccttcactctccagggt

SEQ ID NO: 655684 - DNA, 15 bp, Homo sapiens
ctgcagaagcaaggg

SEQ ID NO: 655685 - DNA, 17 bp, Homo sapiens
ctgcagagtttccaaaa

SEQ ID NO: 655686 - DNA, 16 bp, Homo sapiens
ctgcagcaccgagggg

SEQ ID NO: 655687 - DNA, 19 bp, Homo sapiens
ctgcagcaccgaggggcct

SEQ ID NO: 655688 - DNA, 15 bp, Homo sapiens
ctgcagcaggcagct

SEQ ID NO: 655689 - DNA, 18 bp, Homo sapiens
ctgcagggccatggctca

SEQ ID NO: 655690 - DNA, 20 bp, Homo sapiens
ctgcagggccatggctcagg

SEQ ID NO: 655691 - DNA, 22 bp, Homo sapiens
ctgcagggccctcccttttccc

SEQ ID NO: 655692 - DNA, 15 bp, Homo sapiens
ctgcagtcccacact

SEQ ID NO: 655693 - DNA, 21 bp, Homo sapiens
ctgcagtcccacactgtgcag

SEQ ID NO: 655694 - DNA, 19 bp, Homo sapiens
ctgcagtctcatttctcat

SEQ ID NO: 655695 - DNA, 20 bp, Homo sapiens
ctgcatgtagaggcttgttt

SEQ ID NO: 655696 - DNA, 14 bp, Homo sapiens
ctgcattagaaaaa

SEQ ID NO: 655697 - DNA, 17 bp, Homo sapiens
ctgccacctccccccac

SEQ ID NO: 655698 - DNA, 21 bp, Homo sapiens
ctgccacctccccccacaagt

SEQ ID NO: 655699 - DNA, 16 bp, Homo sapiens
ctgccagaatctagag

SEQ ID NO: 655700 - DNA, 21 bp, Homo sapiens
ctgccagccttgagccctggc

SEQ ID NO: 655701 - DNA, 22 bp, Homo sapiens
ctgccagccttgagccctggct

SEQ ID NO: 655702 - DNA, 23 bp, Homo sapiens
ctgccatgccaggaacctgtcct

SEQ ID NO: 655703 - DNA, 21 bp, Homo sapiens
ctgcccactctgcaagaagaa

SEQ ID NO: 655704 - DNA, 15 bp, Homo sapiens
ctgccccatgtgtcc

SEQ ID NO: 655705 - DNA, 12 bp, Homo sapiens
ctgccccctggg

SEQ ID NO: 655706 - DNA, 13 bp, Homo sapiens
ctgccccctgggc

SEQ ID NO: 655707 - DNA, 20 bp, Homo sapiens
ctgccccctgggctggggcc

SEQ ID NO: 655708 - DNA, 21 bp, Homo sapiens
ctgccccctgggctggggcct

SEQ ID NO: 655709 - DNA, 22 bp, Homo sapiens
ctgccccctgggctggggcctc

SEQ ID NO: 655710 - DNA, 15 bp, Homo sapiens
ctgcccctcagagac

SEQ ID NO: 655711 - DNA, 13 bp, Homo sapiens
ctgcccctctcac

SEQ ID NO: 655712 - DNA, 17 bp, Homo sapiens
ctgcccctctcaccaaa

SEQ ID NO: 655713 - DNA, 16 bp, Homo sapiens
ctgccctcctctcccc

SEQ ID NO: 655714 - DNA, 17 bp, Homo sapiens
ctgccctgttagctttc

SEQ ID NO: 655715 - DNA, 18 bp, Homo sapiens
ctgcccttccgcagtgtg

SEQ ID NO: 655716 - DNA, 18 bp, Homo sapiens
ctgccctttcaaagcact

SEQ ID NO: 655717 - DNA, 13 bp, Homo sapiens
ctgccctttctca

SEQ ID NO: 655718 - DNA, 18 bp, Homo sapiens
ctgcctcccacttcactg

SEQ ID NO: 655719 - DNA, 15 bp, Homo sapiens
ctgcctcctgccctt

SEQ ID NO: 655720 - DNA, 18 bp, Homo sapiens
ctgcctctccctgggtct

SEQ ID NO: 655721 - DNA, 21 bp, Homo sapiens
ctgcctctccctgggtctggg

SEQ ID NO: 655722 - DNA, 14 bp, Homo sapiens
ctgcctctttccct

SEQ ID NO: 655723 - DNA, 17 bp, Homo sapiens
ctgcctgcagcaggcag

SEQ ID NO: 655724 - DNA, 15 bp, Homo sapiens
ctgcctggcccccaa

SEQ ID NO: 655725 - DNA, 22 bp, Homo sapiens
ctgcctggcccccaacctcagg

SEQ ID NO: 655726 - DNA, 12 bp, Homo sapiens
ctgccttctgct

SEQ ID NO: 655727 - DNA, 14 bp, Homo sapiens
ctgccttctttcca

SEQ ID NO: 655728 - DNA, 23 bp, Homo sapiens
ctgccttctttccatcaactccc

SEQ ID NO: 655729 - DNA, 21 bp, Homo sapiens
ctgcgaagaccctcttgccca

SEQ ID NO: 655730 - DNA, 13 bp, Homo sapiens
ctgcgaccctggg

SEQ ID NO: 655731 - DNA, 21 bp, Homo sapiens
ctgcgaccctgggggcacagg

SEQ ID NO: 655732 - DNA, 16 bp, Homo sapiens
ctgcgccctgtgcccg

SEQ ID NO: 655733 - DNA, 14 bp, Homo sapiens
ctgcgctgcttggt

SEQ ID NO: 655734 - DNA, 17 bp, Homo sapiens
ctgctaaccatttatat

SEQ ID NO: 655735 - DNA, 18 bp, Homo sapiens
ctgctacctttcaaagct

SEQ ID NO: 655736 - DNA, 23 bp, Homo sapiens
ctgctatccccatctccctgcct

SEQ ID NO: 655737 - DNA, 19 bp, Homo sapiens
ctgctattctagagctttt

SEQ ID NO: 655738 - DNA, 20 bp, Homo sapiens
ctgctattctagagctttta

SEQ ID NO: 655739 - DNA, 20 bp, Homo sapiens
ctgctccataccttttctct

SEQ ID NO: 655740 - DNA, 21 bp, Homo sapiens
ctgctccataccttttctctt

SEQ ID NO: 655741 - DNA, 12 bp, Homo sapiens
ctgctcccaggc

SEQ ID NO: 655742 - DNA, 21 bp, Homo sapiens
ctgctcgtttacactgcacat

SEQ ID NO: 655743 - DNA, 22 bp, Homo sapiens
ctgctgagctggcccttgggga

SEQ ID NO: 655744 - DNA, 19 bp, Homo sapiens
ctgctgatactgggtctgc

SEQ ID NO: 655745 - DNA, 12 bp, Homo sapiens
ctgctgcctctt

SEQ ID NO: 655746 - DNA, 17 bp, Homo sapiens
ctgctgcctctttccct

SEQ ID NO: 655747 - DNA, 22 bp, Homo sapiens
ctcctggcctatccgctgccag

SEQ ID NO: 655748 - DNA, 14 bp, Homo sapiens
ctcctgtccctttt

SEQ ID NO: 655749 - DNA, 17 bp, Homo sapiens
ctccttgagaggagaaa

SEQ ID NO: 655750 - DNA, 17 bp, Homo sapiens
ctccttgcccccagtgc

SEQ ID NO: 655751 - DNA, 19 bp, Homo sapiens
ctccttgtcagggtctcct

SEQ ID NO: 655752 - DNA, 20 bp, Homo sapiens
ctccttgtcagggtctcctt

SEQ ID NO: 655753 - DNA, 21 bp, Homo sapiens
ctccttgtcagggtctccttc

SEQ ID NO: 655754 - DNA, 23 bp, Homo sapiens
ctccttgtcagggtctccttcct

SEQ ID NO: 655755 - DNA, 16 bp, Homo sapiens
ctcgaatttgaagaga

SEQ ID NO: 655756 - DNA, 23 bp, Homo sapiens
ctcgagagggctggtccttattt

SEQ ID NO: 655757 - DNA, 15 bp, Homo sapiens
ctcgagcaactgctg

SEQ ID NO: 655758 - DNA, 12 bp, Homo sapiens
ctcgcctcctcc

SEQ ID NO: 655759 - DNA, 13 bp, Homo sapiens
ctcgcctcctcct

SEQ ID NO: 655760 - DNA, 15 bp, Homo sapiens
ctcgcctcctcctcc

SEQ ID NO: 655761 - DNA, 13 bp, Homo sapiens
ctcgcctgaggga

SEQ ID NO: 655762 - DNA, 21 bp, Homo sapiens
ctcgcgggtgtcacattcctg

SEQ ID NO: 655763 - DNA, 18 bp, Homo sapiens
ctcgctttttcatccttc

SEQ ID NO: 655764 - DNA, 21 bp, Homo sapiens
ctcgctttttcatccttcttt

SEQ ID NO: 655765 - DNA, 22 bp, Homo sapiens
ctcgctttttcatccttctttc

SEQ ID NO: 655766 - DNA, 14 bp, Homo sapiens
ctcggcacacactg

SEQ ID NO: 655767 - DNA, 18 bp, Homo sapiens
ctcgtgattggcatataa

SEQ ID NO: 655768 - DNA, 17 bp, Homo sapiens
ctcgtgcatccctgaga

SEQ ID NO: 655769 - DNA, 19 bp, Homo sapiens
ctcgtgcatccctgagaca

SEQ ID NO: 655770 - DNA, 18 bp, Homo sapiens
ctcgttggaagaggaaca

SEQ ID NO: 655771 - DNA, 18 bp, Homo sapiens
ctcgtttacactgcacat

SEQ ID NO: 655772 - DNA, 22 bp, Homo sapiens
ctctaaagtctgttgattaaag

SEQ ID NO: 655773 - DNA, 15 bp, Homo sapiens
ctctaacagtggaca

SEQ ID NO: 655774 - DNA, 19 bp, Homo sapiens
ctctaacagtggacaaagt

SEQ ID NO: 655775 - DNA, 19 bp, Homo sapiens
ctctaactctgagagctgt

SEQ ID NO: 655776 - DNA, 13 bp, Homo sapiens
ctctacagtgcca

SEQ ID NO: 655777 - DNA, 16 bp, Homo sapiens
ctctaccaaaaaaagg

SEQ ID NO: 655778 - DNA, 13 bp, Homo sapiens
ctctagaagctcc

SEQ ID NO: 655779 - DNA, 19 bp, Homo sapiens
ctctagtagtgtggcctgt

SEQ ID NO: 655780 - DNA, 12 bp, Homo sapiens
ctctatgtacta

SEQ ID NO: 655781 - DNA, 20 bp, Homo sapiens
ctctattttcataatcagta

SEQ ID NO: 655782 - DNA, 16 bp, Homo sapiens
ctctcaccccactcct

SEQ ID NO: 655783 - DNA, 20 bp, Homo sapiens
ctctcaccccactcctgtca

SEQ ID NO: 655784 - DNA, 12 bp, Homo sapiens
ctctcagtgttt

SEQ ID NO: 655785 - DNA, 22 bp, Homo sapiens
ctctcagtgttttggactccat

SEQ ID NO: 655786 - DNA, 19 bp, Homo sapiens
ctctccagggagctgatgt

SEQ ID NO: 655787 - DNA, 18 bp, Homo sapiens
ctctcccctagagccctc

SEQ ID NO: 655788 - DNA, 20 bp, Homo sapiens
ctctcccctagagccctctc

SEQ ID NO: 655789 - DNA, 12 bp, Homo sapiens
ctctccctgggt

SEQ ID NO: 655790 - DNA, 19 bp, Homo sapiens
ctctcctcatctccaaggc

SEQ ID NO: 655791 - DNA, 12 bp, Homo sapiens
ctctcctggcct

SEQ ID NO: 655792 - DNA, 13 bp, Homo sapiens
ctctcctggccta

SEQ ID NO: 655793 - DNA, 21 bp, Homo sapiens
ctctcctggcctatccgctgc

SEQ ID NO: 655794 - DNA, 14 bp, Homo sapiens
ctctccttgccccc

SEQ ID NO: 655795 - DNA, 18 bp, Homo sapiens
ctctccttttccttacca

SEQ ID NO: 655796 - DNA, 13 bp, Homo sapiens
ctctcttcccctt

SEQ ID NO: 655797 - DNA, 14 bp, Homo sapiens
ctctcttccccttc

SEQ ID NO: 655798 - DNA, 19 bp, Homo sapiens
ctctcttccccttccctta

SEQ ID NO: 655799 - DNA, 18 bp, Homo sapiens
ctctcttgtcctcttctg

SEQ ID NO: 655800 - DNA, 23 bp, Homo sapiens
ctctcttgtcctcttctgctctt

SEQ ID NO: 655801 - DNA, 19 bp, Homo sapiens
ctctgaaggagttacaggg

SEQ ID NO: 655802 - DNA, 22 bp, Homo sapiens
ctctgaaggagttacagggaag

SEQ ID NO: 655803 - DNA, 15 bp, Homo sapiens
ctctgagaccacaga

SEQ ID NO: 655804 - DNA, 13 bp, Homo sapiens
ctctgcacccctc

SEQ ID NO: 655805 - DNA, 17 bp, Homo sapiens
ctctgcagcattgaagt

SEQ ID NO: 655806 - DNA, 15 bp, Homo sapiens
ctctgccgctacctc

SEQ ID NO: 655807 - DNA, 15 bp, Homo sapiens
ctctgcctcccaggt

SEQ ID NO: 655808 - DNA, 16 bp, Homo sapiens
ctctgcctcccaggtt

SEQ ID NO: 655809 - DNA, 20 bp, Homo sapiens
ctctggccttgccccaggcc

SEQ ID NO: 655810 - DNA, 19 bp, Homo sapiens
ctctgggtccttggctccc

SEQ ID NO: 655811 - DNA, 14 bp, Homo sapiens
ctctggtgtttatt

SEQ ID NO: 655812 - DNA, 14 bp, Homo sapiens
ctctgtagtttatg

SEQ ID NO: 655813 - DNA, 17 bp, Homo sapiens
ctctgtagtttatggca

SEQ ID NO: 655814 - DNA, 13 bp, Homo sapiens
ctctgtccctctc

SEQ ID NO: 655815 - DNA, 15 bp, Homo sapiens
ctctgtccctctcct

SEQ ID NO: 655816 - DNA, 19 bp, Homo sapiens
ctctgtcggctttttgcca

SEQ ID NO: 655817 - DNA, 11 bp, Homo sapiens
ctctgtgagaa

SEQ ID NO: 655818 - DNA, 22 bp, Homo sapiens
ctctgtgagaaggtttattgtt

SEQ ID NO: 655819 - DNA, 22 bp, Homo sapiens
ctctgttacactttttggaagt

SEQ ID NO: 655820 - DNA, 23 bp, Homo sapiens
ctctgttccatgcaactggagtt

SEQ ID NO: 655821 - DNA, 14 bp, Homo sapiens
ctctgttggtctgc

SEQ ID NO: 655822 - DNA, 21 bp, Homo sapiens
ctctgttggtctgccttctgc

SEQ ID NO: 655823 - DNA, 22 bp, Homo sapiens
ctctgttggtctgccttctgct

SEQ ID NO: 655824 - DNA, 14 bp, Homo sapiens
ctcttacttgccaa

SEQ ID NO: 655825 - DNA, 13 bp, Homo sapiens
ctcttcacctgac

SEQ ID NO: 655826 - DNA, 14 bp, Homo sapiens
ctcttccagggcag

SEQ ID NO: 655827 - DNA, 20 bp, Homo sapiens
ctcttccagggcagcggctc

SEQ ID NO: 655828 - DNA, 22 bp, Homo sapiens
ctcttccccttagaaacactgc

SEQ ID NO: 655829 - DNA, 23 bp, Homo sapiens
ctcttcgatgtgcccaggggagc

SEQ ID NO: 655830 - DNA, 14 bp, Homo sapiens
ctcttctgcaagcc

SEQ ID NO: 655831 - DNA, 12 bp, Homo sapiens
ctcttctggtgt

SEQ ID NO: 655832 - DNA, 19 bp, Homo sapiens
ctcttctggtgttgactgg

SEQ ID NO: 655833 - DNA, 20 bp, Homo sapiens
ctcttctggtttccctttat

SEQ ID NO: 655834 - DNA, 21 bp, Homo sapiens
ctcttctggtttccctttatt

SEQ ID NO: 655835 - DNA, 21 bp, Homo sapiens
ctcttcttggggcccagtgca

SEQ ID NO: 655836 - DNA, 14 bp, Homo sapiens
ctcttctttgtgcc

SEQ ID NO: 655837 - DNA, 23 bp, Homo sapiens
ctcttgatctctcttgtcctctt

SEQ ID NO: 655838 - DNA, 15 bp, Homo sapiens
ctcttgcccatcctg

SEQ ID NO: 655839 - DNA, 20 bp, Homo sapiens
ctcttgcccatcctgactga

SEQ ID NO: 655840 - DNA, 20 bp, Homo sapiens
ctcttggttcgatacctgga

SEQ ID NO: 655841 - DNA, 14 bp, Homo sapiens
ctcttgtcctcttc

SEQ ID NO: 655842 - DNA, 21 bp, Homo sapiens
ctcttgtttttattaatttat

SEQ ID NO: 655843 - DNA, 17 bp, Homo sapiens
ctctttaacatacaaga

SEQ ID NO: 655844 - DNA, 18 bp, Homo sapiens
ctctttatcaagcaacat

SEQ ID NO: 655845 - DNA, 13 bp, Homo sapiens
ctctttccaaatt

SEQ ID NO: 655846 - DNA, 16 bp, Homo sapiens
ctctttccctaggaaa

SEQ ID NO: 655847 - DNA, 22 bp, Homo sapiens
ctcttttatatttgtaggagaa

SEQ ID NO: 655848 - DNA, 14 bp, Homo sapiens
ctcttttctttctg

SEQ ID NO: 655849 - DNA, 13 bp, Homo sapiens
ctctttttgtttg

SEQ ID NO: 655850 - DNA, 16 bp, Homo sapiens
ctctttttttaaaagg

SEQ ID NO: 655851 - DNA, 22 bp, Homo sapiens
ctgaaaagtgtgtatatatttt

SEQ ID NO: 655852 - DNA, 18 bp, Homo sapiens
ctgaaaattcgaaccagg

SEQ ID NO: 655853 - DNA, 13 bp, Homo sapiens
ctgaaacagattt

SEQ ID NO: 655854 - DNA, 15 bp, Homo sapiens
ctgaaactgcccact

SEQ ID NO: 655855 - DNA, 20 bp, Homo sapiens
ctgaaactggcttccccact

SEQ ID NO: 655856 - DNA, 20 bp, Homo sapiens
ctgaaagccttagggaagct

SEQ ID NO: 655857 - DNA, 12 bp, Homo sapiens
ctgaaagtgtgt

SEQ ID NO: 655858 - DNA, 18 bp, Homo sapiens
ctgaaataatatatttct

SEQ ID NO: 655859 - DNA, 22 bp, Homo sapiens
ctgaaatatccacccagcaggc

SEQ ID NO: 655860 - DNA, 17 bp, Homo sapiens
ctgaaatgaaatcttcc

SEQ ID NO: 655861 - DNA, 20 bp, Homo sapiens
ctgaaatgttcttaaatttt

SEQ ID NO: 655862 - DNA, 16 bp, Homo sapiens
ctgaaattactttaac

SEQ ID NO: 655863 - DNA, 11 bp, Homo sapiens
ctgaactcagc

SEQ ID NO: 655864 - DNA, 23 bp, Homo sapiens
ctaagtccctataataaaggctg

SEQ ID NO: 655865 - DNA, 17 bp, Homo sapiens
ctaagtggctgccttct

SEQ ID NO: 655866 - DNA, 18 bp, Homo sapiens
ctaagttcacattagaat

SEQ ID NO: 655867 - DNA, 14 bp, Homo sapiens
ctaataaatataat

SEQ ID NO: 655868 - DNA, 16 bp, Homo sapiens
ctcactttattatccc

SEQ ID NO: 655869 - DNA, 22 bp, Homo sapiens
ctcagaagtgaaaatcttggag

SEQ ID NO: 655870 - DNA, 17 bp, Homo sapiens
ctcagaataaggcaggc

SEQ ID NO: 655871 - DNA, 19 bp, Homo sapiens
ctcagaataaggcaggcat

SEQ ID NO: 655872 - DNA, 17 bp, Homo sapiens
ctcagaattatttttaa

SEQ ID NO: 655873 - DNA, 12 bp, Homo sapiens
ctcagattcttc

SEQ ID NO: 655874 - DNA, 15 bp, Homo sapiens
ctcagattgtaatat

SEQ ID NO: 655875 - DNA, 14 bp, Homo sapiens
ctcagcagtccaca

SEQ ID NO: 655876 - DNA, 19 bp, Homo sapiens
ctcagcatttccttgtccc

SEQ ID NO: 655877 - DNA, 20 bp, Homo sapiens
ctcagccccaactctttatc

SEQ ID NO: 655878 - DNA, 14 bp, Homo sapiens
ctcagccctggcct

SEQ ID NO: 655879 - DNA, 20 bp, Homo sapiens
ctcagccctggcctggctgg

SEQ ID NO: 655880 - DNA, 18 bp, Homo sapiens
ctcagctataattctgtt

SEQ ID NO: 655881 - DNA, 14 bp, Homo sapiens
ctcagctcaatgca

SEQ ID NO: 655882 - DNA, 23 bp, Homo sapiens
ctcagctgaatgcctcctgtggg

SEQ ID NO: 655883 - DNA, 14 bp, Homo sapiens
ctcagctgcctcct

SEQ ID NO: 655884 - DNA, 20 bp, Homo sapiens
ctcagctgcctcctgcgccc

SEQ ID NO: 655885 - DNA, 22 bp, Homo sapiens
ctcagggagcagggaaggcctg

SEQ ID NO: 655886 - DNA, 15 bp, Homo sapiens
ctcagggctcccagg

SEQ ID NO: 655887 - DNA, 11 bp, Homo sapiens
ctcagggctgg

SEQ ID NO: 655888 - DNA, 19 bp, Homo sapiens
ctcagggctggagcctggg

SEQ ID NO: 655889 - DNA, 17 bp, Homo sapiens
ctcaggtagaaggttga

SEQ ID NO: 655890 - DNA, 15 bp, Homo sapiens
ctcagtccctcttct

SEQ ID NO: 655891 - DNA, 12 bp, Homo sapiens
ctcagtcctaat

SEQ ID NO: 655892 - DNA, 12 bp, Homo sapiens
ctcagtgcagat

SEQ ID NO: 655893 - DNA, 12 bp, Homo sapiens
ctcagtgttttg

SEQ ID NO: 655894 - DNA, 17 bp, Homo sapiens
ctcagtgttttggactc

SEQ ID NO: 655895 - DNA, 21 bp, Homo sapiens
ctcagttgaaaatgcaactct

SEQ ID NO: 655896 - DNA, 18 bp, Homo sapiens
ctcagttttatgccccat

SEQ ID NO: 655897 - DNA, 14 bp, Homo sapiens
ctcataattttgca

SEQ ID NO: 655898 - DNA, 15 bp, Homo sapiens
ctcataattttgcaa

SEQ ID NO: 655899 - DNA, 13 bp, Homo sapiens
ctcatcctccagt

SEQ ID NO: 655900 - DNA, 15 bp, Homo sapiens
ctcatctatgaggaa

SEQ ID NO: 655901 - DNA, 18 bp, Homo sapiens
ctcatcttagtgcctgag

SEQ ID NO: 655902 - DNA, 14 bp, Homo sapiens
ctcatgcagccgtg

SEQ ID NO: 655903 - DNA, 18 bp, Homo sapiens
ctcatgcgtacgtcccac

SEQ ID NO: 655904 - DNA, 20 bp, Homo sapiens
ctcatgtttttaacttttaa

SEQ ID NO: 655905 - DNA, 15 bp, Homo sapiens
ctcattactgggcct

SEQ ID NO: 655906 - DNA, 12 bp, Homo sapiens
ctcattgacttt

SEQ ID NO: 655907 - DNA, 15 bp, Homo sapiens
ctcattgtgtctccc

SEQ ID NO: 655908 - DNA, 17 bp, Homo sapiens
ctcattgtgtctcccgt

SEQ ID NO: 655909 - DNA, 20 bp, Homo sapiens
ctcatttctcataattttgc

SEQ ID NO: 655910 - DNA, 23 bp, Homo sapiens
ctccaattttttaagtgaaaata

SEQ ID NO: 655911 - DNA, 16 bp, Homo sapiens
ctccacaacccaagca

SEQ ID NO: 655912 - DNA, 19 bp, Homo sapiens
ctccacatgctgcctggca

SEQ ID NO: 655913 - DNA, 21 bp, Homo sapiens
ctccacatgctgcctggcaca

SEQ ID NO: 655914 - DNA, 18 bp, Homo sapiens
ctccaccccccactcagt

SEQ ID NO: 655915 - DNA, 24 bp, Homo sapiens
ctccactcttgatctctcttgtcc

SEQ ID NO: 655916 - DNA, 16 bp, Homo sapiens
ctccagcctgggggac

SEQ ID NO: 655917 - DNA, 18 bp, Homo sapiens
ctccagcgtcagctgctc

SEQ ID NO: 655918 - DNA, 19 bp, Homo sapiens
ctccaggaagcccagggca

SEQ ID NO: 655919 - DNA, 15 bp, Homo sapiens
ctccaggcctgcctc

SEQ ID NO: 655920 - DNA, 15 bp, Homo sapiens
ctccaggctttccca

SEQ ID NO: 655921 - DNA, 16 bp, Homo sapiens
ctccaggtgcagaggt

SEQ ID NO: 655922 - DNA, 23 bp, Homo sapiens
ctccataccttttctcttttctt

SEQ ID NO: 655923 - DNA, 20 bp, Homo sapiens
ctccatatttgatttctaat

SEQ ID NO: 655924 - DNA, 19 bp, Homo sapiens
ctccatctctcatcctcca

SEQ ID NO: 655925 - DNA, 20 bp, Homo sapiens
ctccatctctcatcctccag

SEQ ID NO: 655926 - DNA, 12 bp, Homo sapiens
ctccatctcttc

SEQ ID NO: 655927 - DNA, 16 bp, Homo sapiens
ctccatgctccttgag

SEQ ID NO: 655928 - DNA, 18 bp, Homo sapiens
ctccattattcctctcac

SEQ ID NO: 655929 - DNA, 20 bp, Homo sapiens
ctccattattcctctcaccc

SEQ ID NO: 655930 - DNA, 12 bp, Homo sapiens
ctccatttttct

SEQ ID NO: 655931 - DNA, 16 bp, Homo sapiens
ctcccaacttcttcct

SEQ ID NO: 655932 - DNA, 14 bp, Homo sapiens
ctcccaagaaacct

SEQ ID NO: 655933 - DNA, 19 bp, Homo sapiens
ctcccaagctgattttatt

SEQ ID NO: 655934 - DNA, 20 bp, Homo sapiens
ctcccactttgctgttcctt

SEQ ID NO: 655935 - DNA, 22 bp, Homo sapiens
ctcccagagcttgttgtctcca

SEQ ID NO: 655936 - DNA, 22 bp, Homo sapiens
ctcccaggatgacgtgctccgt

SEQ ID NO: 655937 - DNA, 18 bp, Homo sapiens
ctcccaggggtctccctg

SEQ ID NO: 655938 - DNA, 23 bp, Homo sapiens
ctcccaggggtctccctggctcc

SEQ ID NO: 655939 - DNA, 14 bp, Homo sapiens
ctcccatgtatgga

SEQ ID NO: 655940 - DNA, 16 bp, Homo sapiens
ctccccaattctcccc

SEQ ID NO: 655941 - DNA, 20 bp, Homo sapiens
ctccccacagcgtccctggc

SEQ ID NO: 655942 - DNA, 17 bp, Homo sapiens
ctccccagcccacctgc

SEQ ID NO: 655943 - DNA, 18 bp, Homo sapiens
ctccccagcccacctgct

SEQ ID NO: 655944 - DNA, 20 bp, Homo sapiens
ctccccagcccacctgctcc

SEQ ID NO: 655945 - DNA, 23 bp, Homo sapiens
ctccccggcatgagactcagtgc

SEQ ID NO: 655946 - DNA, 12 bp, Homo sapiens
ctcccctcctgc

SEQ ID NO: 655947 - DNA, 14 bp, Homo sapiens
ctcccctcctgcac

SEQ ID NO: 655948 - DNA, 19 bp, Homo sapiens
ctcccctcctgcacacagg

SEQ ID NO: 655949 - DNA, 14 bp, Homo sapiens
ctcccgccaggagc

SEQ ID NO: 655950 - DNA, 15 bp, Homo sapiens
ctcccgcccttccat

SEQ ID NO: 655951 - DNA, 22 bp, Homo sapiens
ctcccgcccttccatgtgcctt

SEQ ID NO: 655952 - DNA, 15 bp, Homo sapiens
ctcccgggggcccca

SEQ ID NO: 655953 - DNA, 21 bp, Homo sapiens
ctcccgggggccccacctcgg

SEQ ID NO: 655954 - DNA, 17 bp, Homo sapiens
ctccctccggcttgacc

SEQ ID NO: 655955 - DNA, 16 bp, Homo sapiens
ctccctcctccaggcc

SEQ ID NO: 655956 - DNA, 18 bp, Homo sapiens
ctccctgcctggccccca

SEQ ID NO: 655957 - DNA, 17 bp, Homo sapiens
ctccctggcagacacaa

SEQ ID NO: 655958 - DNA, 12 bp, Homo sapiens
ctccctggctcc

SEQ ID NO: 655959 - DNA, 15 bp, Homo sapiens
ctccctggctccctc

SEQ ID NO: 655960 - DNA, 21 bp, Homo sapiens
ctccctgtgtccacctgtggg

SEQ ID NO: 655961 - DNA, 16 bp, Homo sapiens
ctccggatcgaggcct

SEQ ID NO: 655962 - DNA, 19 bp, Homo sapiens
ctccggcctctgcctttgc

SEQ ID NO: 655963 - DNA, 17 bp, Homo sapiens
ctccgtagctctgctgc

SEQ ID NO: 655964 - DNA, 20 bp, Homo sapiens
ctccgtagctctgctgctga

SEQ ID NO: 655965 - DNA, 13 bp, Homo sapiens
ctcctagaagaac

SEQ ID NO: 655966 - DNA, 15 bp, Homo sapiens
ctcctagaagaacca

SEQ ID NO: 655967 - DNA, 20 bp, Homo sapiens
ctcctattctataaaactct

SEQ ID NO: 655968 - DNA, 20 bp, Homo sapiens
ctcctcaatttttgtctcag

SEQ ID NO: 655969 - DNA, 21 bp, Homo sapiens
ctcctcaatttttgtctcaga

SEQ ID NO: 655970 - DNA, 15 bp, Homo sapiens
ctcctcacacaccct

SEQ ID NO: 655971 - DNA, 19 bp, Homo sapiens
ctcctcacacaccctgagg

SEQ ID NO: 655972 - DNA, 21 bp, Homo sapiens
ctcctcacccacctctgggtc

SEQ ID NO: 655973 - DNA, 17 bp, Homo sapiens
ctcctcagtccctcttc

SEQ ID NO: 655974 - DNA, 21 bp, Homo sapiens
ctcctcagtccctcttctggt

SEQ ID NO: 655975 - DNA, 13 bp, Homo sapiens
ctcctcatctcca

SEQ ID NO: 655976 - DNA, 17 bp, Homo sapiens
ctcctccaggcctgcct

SEQ ID NO: 655977 - DNA, 18 bp, Homo sapiens
ctcctccaggcctgcctc

SEQ ID NO: 655978 - DNA, 19 bp, Homo sapiens
ctcctccaggcctgcctcc

SEQ ID NO: 655979 - DNA, 16 bp, Homo sapiens
ctcctcccgcccttcc

SEQ ID NO: 655980 - DNA, 14 bp, Homo sapiens
ctcctcctcaccca

SEQ ID NO: 655981 - DNA, 14 bp, Homo sapiens
ctcctcctcctgcc

SEQ ID NO: 655982 - DNA, 11 bp, Homo sapiens
ctcctcctgcc

SEQ ID NO: 655983 - DNA, 18 bp, Homo sapiens
ctcctctcccatccttga

SEQ ID NO: 655984 - DNA, 15 bp, Homo sapiens
ctcctgactggtgct

SEQ ID NO: 655985 - DNA, 16 bp, Homo sapiens
ctcctgactggtgctg

SEQ ID NO: 655986 - DNA, 13 bp, Homo sapiens
ctcctgagctagg

SEQ ID NO: 655987 - DNA, 14 bp, Homo sapiens
ctcctgccctcctc

SEQ ID NO: 655988 - DNA, 16 bp, Homo sapiens
cttgtcctcagccagt

SEQ ID NO: 655989 - DNA, 18 bp, Homo sapiens
cttgtcttctggtacttt

SEQ ID NO: 655990 - DNA, 21 bp, Homo sapiens
cttgtcttctggtactttctg

SEQ ID NO: 655991 - DNA, 19 bp, Homo sapiens
cttgtgaaacgtctggact

SEQ ID NO: 655992 - DNA, 22 bp, Homo sapiens
cttgtggttgtgtgtgttctgt

SEQ ID NO: 655993 - DNA, 14 bp, Homo sapiens
cttgtgttctgctc

SEQ ID NO: 655994 - DNA, 20 bp, Homo sapiens
cttgtgtttaactgtgaaca

SEQ ID NO: 655995 - DNA, 16 bp, Homo sapiens
cttgttagaaaacaaa

SEQ ID NO: 655996 - DNA, 15 bp, Homo sapiens
cttgttcagcaggct

SEQ ID NO: 655997 - DNA, 23 bp, Homo sapiens
cttgttcagcaggctagacagaa

SEQ ID NO: 655998 - DNA, 13 bp, Homo sapiens
cttgttcatatgg

SEQ ID NO: 655999 - DNA, 22 bp, Homo sapiens
cttgttgtctccacttgtatat

SEQ ID NO: 656000 - DNA, 23 bp, Homo sapiens
cttgtttatgatatttcttgctt

SEQ ID NO: 656001 - DNA, 13 bp, Homo sapiens
cttgttttataaa

SEQ ID NO: 656002 - DNA, 21 bp, Homo sapiens
cttgttttggatggcttgtct

SEQ ID NO: 656003 - DNA, 20 bp, Homo sapiens
cttgtttttattaatttata

SEQ ID NO: 656004 - DNA, 16 bp, Homo sapiens
ctttaaaaagaaatta

SEQ ID NO: 656005 - DNA, 17 bp, Homo sapiens
ctttaaaacgcgtctgc

SEQ ID NO: 656006 - DNA, 22 bp, Homo sapiens
ctttaaaacgcgtctgcctggg

SEQ ID NO: 656007 - DNA, 23 bp, Homo sapiens
ctttaaaacgcgtctgcctgggc

SEQ ID NO: 656008 - DNA, 16 bp, Homo sapiens
ctttaacattttggaa

SEQ ID NO: 656009 - DNA, 19 bp, Homo sapiens
ctttaacattttggaaatt

SEQ ID NO: 656010 - DNA, 19 bp, Homo sapiens
ctttaacttttttttctct

SEQ ID NO: 656011 - DNA, 18 bp, Homo sapiens
ctttaagccttcaaaact

SEQ ID NO: 656012 - DNA, 23 bp, Homo sapiens
ctttaatagtcaccttcatgatt

SEQ ID NO: 656013 - DNA, 17 bp, Homo sapiens
ctttaatcactgcattt

SEQ ID NO: 656014 - DNA, 21 bp, Homo sapiens
ctttaattaattaagtatctg

SEQ ID NO: 656015 - DNA, 19 bp, Homo sapiens
ctttactgcctgaataaag

SEQ ID NO: 656016 - DNA, 12 bp, Homo sapiens
ctttagattaaa

SEQ ID NO: 656017 - DNA, 13 bp, Homo sapiens
ctttagtttttgg

SEQ ID NO: 656018 - DNA, 15 bp, Homo sapiens
ctttatcattgctaa

SEQ ID NO: 656019 - DNA, 20 bp, Homo sapiens
ctttatgtagtttttatatg

SEQ ID NO: 656020 - DNA, 20 bp, Homo sapiens
ctttatgtttttgaggcttt

SEQ ID NO: 656021 - DNA, 16 bp, Homo sapiens
ctttattaagtaaaat

SEQ ID NO: 656022 - DNA, 15 bp, Homo sapiens
ctttattaatgtttt

SEQ ID NO: 656023 - DNA, 16 bp, Homo sapiens
ctttattcagaacttt

SEQ ID NO: 656024 - DNA, 18 bp, Homo sapiens
ctttattgcttttttgta

SEQ ID NO: 656025 - DNA, 15 bp, Homo sapiens
ctttatttctcttct

SEQ ID NO: 656026 - DNA, 19 bp, Homo sapiens
ctttattttgagatgtaaa

SEQ ID NO: 656027 - DNA, 13 bp, Homo sapiens
ctttcacctgggt

SEQ ID NO: 656028 - DNA, 19 bp, Homo sapiens
ctttcagatacatggttgt

SEQ ID NO: 656029 - DNA, 23 bp, Homo sapiens
ctttcagtggaaaccctgagagt

SEQ ID NO: 656030 - DNA, 22 bp, Homo sapiens
ctttcatggctgctgttgctta

SEQ ID NO: 656031 - DNA, 10 bp, Homo sapiens
ctttccaaat

SEQ ID NO: 656032 - DNA, 15 bp, Homo sapiens
ctttccaaggaagca

SEQ ID NO: 656033 - DNA, 16 bp, Homo sapiens
ctttccaaggaagcag

SEQ ID NO: 656034 - DNA, 18 bp, Homo sapiens
ctttccaaggaagcagaa

SEQ ID NO: 656035 - DNA, 23 bp, Homo sapiens
ctttccagagcaaccagaaggag

SEQ ID NO: 656036 - DNA, 18 bp, Homo sapiens
ctttcccatgtatttgtt

SEQ ID NO: 656037 - DNA, 18 bp, Homo sapiens
ctttcccgcccagcctca

SEQ ID NO: 656038 - DNA, 18 bp, Homo sapiens
ctttcctgtttccagggt

SEQ ID NO: 656039 - DNA, 20 bp, Homo sapiens
ctttcctgtttccagggtct

SEQ ID NO: 656040 - DNA, 15 bp, Homo sapiens
ctttccttgttcagc

SEQ ID NO: 656041 - DNA, 14 bp, Homo sapiens
ctttctacaggcca

SEQ ID NO: 656042 - DNA, 23 bp, Homo sapiens
ctttctcctggcccctgcctgct

SEQ ID NO: 656043 - DNA, 21 bp, Homo sapiens
ctttctgctagtggtgagcat

SEQ ID NO: 656044 - DNA, 13 bp, Homo sapiens
ctttctgttgcca

SEQ ID NO: 656045 - DNA, 22 bp, Homo sapiens
ctttcttacctactattggccc

SEQ ID NO: 656046 - DNA, 23 bp, Homo sapiens
ctttcttacctactattggccct

SEQ ID NO: 656047 - DNA, 11 bp, Homo sapiens
ctttcttgaaa

SEQ ID NO: 656048 - DNA, 13 bp, Homo sapiens
ctttcttgaaatt

SEQ ID NO: 656049 - DNA, 14 bp, Homo sapiens
ctttcttgaaattg

SEQ ID NO: 656050 - DNA, 12 bp, Homo sapiens
ctttctttgcct

SEQ ID NO: 656051 - DNA, 14 bp, Homo sapiens
ctttctttgcctct

SEQ ID NO: 656052 - DNA, 21 bp, Homo sapiens
ctttctttgcctctgcagtct

SEQ ID NO: 656053 - DNA, 18 bp, Homo sapiens
ctttgaacctgtgcaata

SEQ ID NO: 656054 - DNA, 18 bp, Homo sapiens
ctttgagacctttcctct

SEQ ID NO: 656055 - DNA, 14 bp, Homo sapiens
ctttgccactgctg

SEQ ID NO: 656056 - DNA, 14 bp, Homo sapiens
ctttgcccttcctc

SEQ ID NO: 656057 - DNA, 18 bp, Homo sapiens
ctttgcctctgcagtctc

SEQ ID NO: 656058 - DNA, 23 bp, Homo sapiens
ctttgcctctgcagtctcatttc

SEQ ID NO: 656059 - DNA, 13 bp, Homo sapiens
ctttgctatgtaa

SEQ ID NO: 656060 - DNA, 13 bp, Homo sapiens
ctttggacagctg

SEQ ID NO: 656061 - DNA, 14 bp, Homo sapiens
ctttggattctaaa

SEQ ID NO: 656062 - DNA, 18 bp, Homo sapiens
ctttggattctaaataca

SEQ ID NO: 656063 - DNA, 24 bp, Homo sapiens
ctttggcctggggtgcatctcctc

SEQ ID NO: 656064 - DNA, 23 bp, Homo sapiens
ctttggtttatggttttcattca

SEQ ID NO: 656065 - DNA, 13 bp, Homo sapiens
ctttgtaaaaatc

SEQ ID NO: 656066 - DNA, 16 bp, Homo sapiens
ctttgtaaaaatcttt

SEQ ID NO: 656067 - DNA, 21 bp, Homo sapiens
ctttgtaaatgcatattaaat

SEQ ID NO: 656068 - DNA, 23 bp, Homo sapiens
ctttgtaaatgcatattaaataa

SEQ ID NO: 656069 - DNA, 16 bp, Homo sapiens
ctttgtaatactttct

SEQ ID NO: 656070 - DNA, 19 bp, Homo sapiens
ctttgtacagagtgctttt

SEQ ID NO: 656071 - DNA, 17 bp, Homo sapiens
ctttgtccaaaggaaag

SEQ ID NO: 656072 - DNA, 23 bp, Homo sapiens
ctttgtgactgtcacttgctgct

SEQ ID NO: 656073 - DNA, 14 bp, Homo sapiens
ctttgtgcctttgg

SEQ ID NO: 656074 - DNA, 18 bp, Homo sapiens
ctttgtgcctttggcctg

SEQ ID NO: 656075 - DNA, 15 bp, Homo sapiens
ctttgttacaggcac

SEQ ID NO: 656076 - DNA, 14 bp, Homo sapiens
ctttgttataccat

SEQ ID NO: 656077 - DNA, 15 bp, Homo sapiens
ctttgttgaagtttg

SEQ ID NO: 656078 - DNA, 20 bp, Homo sapiens
ctttgttgaagtttgaacca

SEQ ID NO: 656079 - DNA, 18 bp, Homo sapiens
cttttaaaaacataacat

SEQ ID NO: 656080 - DNA, 20 bp, Homo sapiens
cttttaaaatgtagaaactt

SEQ ID NO: 656081 - DNA, 18 bp, Homo sapiens
cttatttacccttttccc

SEQ ID NO: 656082 - DNA, 13 bp, Homo sapiens
cttatttagagat

SEQ ID NO: 656083 - DNA, 16 bp, Homo sapiens
cttatttcataattgc

SEQ ID NO: 656084 - DNA, 17 bp, Homo sapiens
cttatttctatgacaaa

SEQ ID NO: 656085 - DNA, 19 bp, Homo sapiens
cttatttgccttctactcc

SEQ ID NO: 656086 - DNA, 13 bp, Homo sapiens
cttcaaagccttc

SEQ ID NO: 656087 - DNA, 15 bp, Homo sapiens
cttcaaagtttatat

SEQ ID NO: 656088 - DNA, 22 bp, Homo sapiens
cttcaagctgttatttcttccc

SEQ ID NO: 656089 - DNA, 20 bp, Homo sapiens
cttcaaggatatactgcagc

SEQ ID NO: 656090 - DNA, 22 bp, Homo sapiens
cttcaaggatatactgcagctt

SEQ ID NO: 656091 - DNA, 18 bp, Homo sapiens
cttcaatatgaatctata

SEQ ID NO: 656092 - DNA, 23 bp, Homo sapiens
cttcacaaatgtcattgtctact

SEQ ID NO: 656093 - DNA, 17 bp, Homo sapiens
cttcacatcccattggg

SEQ ID NO: 656094 - DNA, 17 bp, Homo sapiens
cttcacccgagttcctc

SEQ ID NO: 656095 - DNA, 15 bp, Homo sapiens
cttcaccctgagttt

SEQ ID NO: 656096 - DNA, 14 bp, Homo sapiens
cttcactctccagg

SEQ ID NO: 656097 - DNA, 19 bp, Homo sapiens
cttcactgcaattttgtgt

SEQ ID NO: 656098 - DNA, 21 bp, Homo sapiens
cttcagctagcttttaggaaa

SEQ ID NO: 656099 - DNA, 15 bp, Homo sapiens
cttcagctctttttg

SEQ ID NO: 656100 - DNA, 15 bp, Homo sapiens
cttcaggtgaacact

SEQ ID NO: 656101 - DNA, 22 bp, Homo sapiens
cttcagtattttctccacttca

SEQ ID NO: 656102 - DNA, 14 bp, Homo sapiens
cttcagttgcttgt

SEQ ID NO: 656103 - DNA, 17 bp, Homo sapiens
cttcatcattccctctc

SEQ ID NO: 656104 - DNA, 18 bp, Homo sapiens
cttcatcattccctctca

SEQ ID NO: 656105 - DNA, 17 bp, Homo sapiens
cttcattattcaagaat

SEQ ID NO: 656106 - DNA, 13 bp, Homo sapiens
cttcattgaaagc

SEQ ID NO: 656107 - DNA, 13 bp, Homo sapiens
cttccagcattta

SEQ ID NO: 656108 - DNA, 20 bp, Homo sapiens
cttccagggcagcggctcca

SEQ ID NO: 656109 - DNA, 21 bp, Homo sapiens
cttccagggcagcggctccac

SEQ ID NO: 656110 - DNA, 22 bp, Homo sapiens
cttccagggcagcggctccact

SEQ ID NO: 656111 - DNA, 16 bp, Homo sapiens
cttccaggggaacctg

SEQ ID NO: 656112 - DNA, 16 bp, Homo sapiens
cttccattttaatttt

SEQ ID NO: 656113 - DNA, 13 bp, Homo sapiens
cttcccaccctgc

SEQ ID NO: 656114 - DNA, 15 bp, Homo sapiens
cttcccatttcttcc

SEQ ID NO: 656115 - DNA, 17 bp, Homo sapiens
cttcccatttcttccca

SEQ ID NO: 656116 - DNA, 19 bp, Homo sapiens
cttcccatttcttcccact

SEQ ID NO: 656117 - DNA, 17 bp, Homo sapiens
cttccccgagtgactct

SEQ ID NO: 656118 - DNA, 17 bp, Homo sapiens
cttccccttagaaacac

SEQ ID NO: 656119 - DNA, 18 bp, Homo sapiens
cttccctgctttgcatct

SEQ ID NO: 656120 - DNA, 22 bp, Homo sapiens
cttcctctacgtttatcctggc

SEQ ID NO: 656121 - DNA, 19 bp, Homo sapiens
cttcctctggtgtttatta

SEQ ID NO: 656122 - DNA, 14 bp, Homo sapiens
cttcctcttgtctg

SEQ ID NO: 656123 - DNA, 21 bp, Homo sapiens
cttcctgtgaagtttaattgt

SEQ ID NO: 656124 - DNA, 13 bp, Homo sapiens
cttcctttgccct

SEQ ID NO: 656125 - DNA, 18 bp, Homo sapiens
cttcctttgcccttcctc

SEQ ID NO: 656126 - DNA, 20 bp, Homo sapiens
cttcctttgcccttcctcct

SEQ ID NO: 656127 - DNA, 13 bp, Homo sapiens
cttcgctgaaatt

SEQ ID NO: 656128 - DNA, 12 bp, Homo sapiens
cttcgctggact

SEQ ID NO: 656129 - DNA, 17 bp, Homo sapiens
cttcgctggactattgt

SEQ ID NO: 656130 - DNA, 15 bp, Homo sapiens
cttctaaatgcatat

SEQ ID NO: 656131 - DNA, 14 bp, Homo sapiens
cttctaagaagaca

SEQ ID NO: 656132 - DNA, 14 bp, Homo sapiens
cttctaatttatat

SEQ ID NO: 656133 - DNA, 18 bp, Homo sapiens
cttctaatttatattatc

SEQ ID NO: 656134 - DNA, 19 bp, Homo sapiens
cttctacccttttcctttt

SEQ ID NO: 656135 - DNA, 22 bp, Homo sapiens
cttctactgccttgaaaaatga

SEQ ID NO: 656136 - DNA, 21 bp, Homo sapiens
cttctattatccagagtcatg

SEQ ID NO: 656137 - DNA, 23 bp, Homo sapiens
cttctcaaagagaattgtatgta

SEQ ID NO: 656138 - DNA, 19 bp, Homo sapiens
cttctccaggaagcccagg

SEQ ID NO: 656139 - DNA, 22 bp, Homo sapiens
cttctctccacatggaagccca

SEQ ID NO: 656140 - DNA, 17 bp, Homo sapiens
cttctctgttggtctgc

SEQ ID NO: 656141 - DNA, 14 bp, Homo sapiens
cttctgctcttttc

SEQ ID NO: 656142 - DNA, 13 bp, Homo sapiens
cttctgctgaaag

SEQ ID NO: 656143 - DNA, 14 bp, Homo sapiens
cttctggggcaggc

SEQ ID NO: 656144 - DNA, 16 bp, Homo sapiens
cttctggggcaggctg

SEQ ID NO: 656145 - DNA, 14 bp, Homo sapiens
cttctggtttccct

SEQ ID NO: 656146 - DNA, 13 bp, Homo sapiens
cttcttcctgtga

SEQ ID NO: 656147 - DNA, 15 bp, Homo sapiens
cttcttctaagaaga

SEQ ID NO: 656148 - DNA, 16 bp, Homo sapiens
cttcttctaagaagac

SEQ ID NO: 656149 - DNA, 14 bp, Homo sapiens
cttcttctctccac

SEQ ID NO: 656150 - DNA, 21 bp, Homo sapiens
cttcttgatgtatttctccat

SEQ ID NO: 656151 - DNA, 18 bp, Homo sapiens
cttcttggggcccagtgc

SEQ ID NO: 656152 - DNA, 24 bp, Homo sapiens
cttcttggggcccagtgcatggtg

SEQ ID NO: 656153 - DNA, 14 bp, Homo sapiens
cttctttgtgcctt

SEQ ID NO: 656154 - DNA, 13 bp, Homo sapiens
cttgaaaaatgac

SEQ ID NO: 656155 - DNA, 20 bp, Homo sapiens
cttgaagtctaaaagcagaa

SEQ ID NO: 656156 - DNA, 18 bp, Homo sapiens
cttgaatgtggtctcagg

SEQ ID NO: 656157 - DNA, 19 bp, Homo sapiens
cttgaatgtggtctcagga

SEQ ID NO: 656158 - DNA, 17 bp, Homo sapiens
cttgaattccttgggga

SEQ ID NO: 656159 - DNA, 21 bp, Homo sapiens
cttgacacaggaaatgggaaa

SEQ ID NO: 656160 - DNA, 14 bp, Homo sapiens
cttgacatacctac

SEQ ID NO: 656161 - DNA, 19 bp, Homo sapiens
cttgactgcattgccgctg

SEQ ID NO: 656162 - DNA, 16 bp, Homo sapiens
cttgagacaatgtttt

SEQ ID NO: 656163 - DNA, 21 bp, Homo sapiens
cttgagacaatgttttcttca

SEQ ID NO: 656164 - DNA, 14 bp, Homo sapiens
cttgatctctcttg

SEQ ID NO: 656165 - DNA, 18 bp, Homo sapiens
cttgatgactgctgattt

SEQ ID NO: 656166 - DNA, 13 bp, Homo sapiens
cttgatgtacata

SEQ ID NO: 656167 - DNA, 19 bp, Homo sapiens
cttgatttcaaagttttgt

SEQ ID NO: 656168 - DNA, 14 bp, Homo sapiens
cttgcagaactgta

SEQ ID NO: 656169 - DNA, 20 bp, Homo sapiens
cttgcataataagctaaaga

SEQ ID NO: 656170 - DNA, 16 bp, Homo sapiens
cttgccatctgttcat

SEQ ID NO: 656171 - DNA, 20 bp, Homo sapiens
cttgcccaggtcaccaagca

SEQ ID NO: 656172 - DNA, 23 bp, Homo sapiens
cttgcccaggtcaccaagcagtg

SEQ ID NO: 656173 - DNA, 16 bp, Homo sapiens
cttgcccatcctgact

SEQ ID NO: 656174 - DNA, 15 bp, Homo sapiens
cttgcccccagtgcc

SEQ ID NO: 656175 - DNA, 16 bp, Homo sapiens
cttgcccccagtgcct

SEQ ID NO: 656176 - DNA, 14 bp, Homo sapiens
cttgcctccaggtg

SEQ ID NO: 656177 - DNA, 15 bp, Homo sapiens
cttgcctccaggtgc

SEQ ID NO: 656178 - DNA, 17 bp, Homo sapiens
cttgcctctgccctgga

SEQ ID NO: 656179 - DNA, 14 bp, Homo sapiens
cttgcctgcagggc

SEQ ID NO: 656180 - DNA, 17 bp, Homo sapiens
cttgcctgcagggccat

SEQ ID NO: 656181 - DNA, 22 bp, Homo sapiens
ctggttccctgctgcgctgctt

SEQ ID NO: 656182 - DNA, 13 bp, Homo sapiens
ctggtttcccttt

SEQ ID NO: 656183 - DNA, 16 bp, Homo sapiens
ctgtaacttaaaatag

SEQ ID NO: 656184 - DNA, 14 bp, Homo sapiens
ctgtaatgtaaata

SEQ ID NO: 656185 - DNA, 16 bp, Homo sapiens
ctgtaatgtaaataaa

SEQ ID NO: 656186 - DNA, 20 bp, Homo sapiens
ctgtactgttactgggccct

SEQ ID NO: 656187 - DNA, 20 bp, Homo sapiens
ctgtagatatgtattctttt

SEQ ID NO: 656188 - DNA, 18 bp, Homo sapiens
ctgtagcaggttctaggc

SEQ ID NO: 656189 - DNA, 18 bp, Homo sapiens
ctgtagctacattttcag

SEQ ID NO: 656190 - DNA, 20 bp, Homo sapiens
ctgtagctcaagtttaaaag

SEQ ID NO: 656191 - DNA, 14 bp, Homo sapiens
ctgtagctgccatg

SEQ ID NO: 656192 - DNA, 20 bp, Homo sapiens
ctgtaggtgaaagaacaagt

SEQ ID NO: 656193 - DNA, 23 bp, Homo sapiens
ctgtagtttatggcagaagggaa

SEQ ID NO: 656194 - DNA, 15 bp, Homo sapiens
ctgtatataaaggtg

SEQ ID NO: 656195 - DNA, 16 bp, Homo sapiens
ctgtatgctgatcatc

SEQ ID NO: 656196 - DNA, 23 bp, Homo sapiens
ctgtatgtgtgtaggttatcttt

SEQ ID NO: 656197 - DNA, 20 bp, Homo sapiens
ctgtattactgaataatatc

SEQ ID NO: 656198 - DNA, 21 bp, Homo sapiens
ctgtatttttatttttgcaca

SEQ ID NO: 656199 - DNA, 14 bp, Homo sapiens
ctgtcatctaaagt

SEQ ID NO: 656200 - DNA, 23 bp, Homo sapiens
ctgtcatctaaagtcctggccct

SEQ ID NO: 656201 - DNA, 19 bp, Homo sapiens
ctgtccaaatttaaaatgt

SEQ ID NO: 656202 - DNA, 14 bp, Homo sapiens
ctgtccaagacagg

SEQ ID NO: 656203 - DNA, 20 bp, Homo sapiens
ctgtcccaattctgcccgct

SEQ ID NO: 656204 - DNA, 18 bp, Homo sapiens
ctgtcccactacatctgg

SEQ ID NO: 656205 - DNA, 20 bp, Homo sapiens
ctgtcccactacatctggga

SEQ ID NO: 656206 - DNA, 21 bp, Homo sapiens
ctgtccccatctaggtcctgg

SEQ ID NO: 656207 - DNA, 13 bp, Homo sapiens
ctgtccctctcct

SEQ ID NO: 656208 - DNA, 17 bp, Homo sapiens
ctgtcccttgcctctgc

SEQ ID NO: 656209 - DNA, 18 bp, Homo sapiens
ctgtcccttgcttgcctg

SEQ ID NO: 656210 - DNA, 23 bp, Homo sapiens
ctgtcccttgcttgcctgcaggg

SEQ ID NO: 656211 - DNA, 21 bp, Homo sapiens
ctgtccgttcacatgtgtggt

SEQ ID NO: 656212 - DNA, 20 bp, Homo sapiens
ctgtcctaaggaaccttcct

SEQ ID NO: 656213 - DNA, 12 bp, Homo sapiens
ctgtcctgcagt

SEQ ID NO: 656214 - DNA, 20 bp, Homo sapiens
ctgtcctgcagtcccacact

SEQ ID NO: 656215 - DNA, 22 bp, Homo sapiens
ctgtcctgcagtcccacactgt

SEQ ID NO: 656216 - DNA, 19 bp, Homo sapiens
ctgtccttcttagaatgtt

SEQ ID NO: 656217 - DNA, 23 bp, Homo sapiens
ctgtctgtatagtgtctgtattt

SEQ ID NO: 656218 - DNA, 14 bp, Homo sapiens
ctgtcttaattttc

SEQ ID NO: 656219 - DNA, 19 bp, Homo sapiens
ctgtcttgatgactgctga

SEQ ID NO: 656220 - DNA, 15 bp, Homo sapiens
ctgtctttcagatac

SEQ ID NO: 656221 - DNA, 22 bp, Homo sapiens
ctgtgacaagccaatgtgaatt

SEQ ID NO: 656222 - DNA, 17 bp, Homo sapiens
ctgtgagaaggtttatt

SEQ ID NO: 656223 - DNA, 22 bp, Homo sapiens
ctgtgagaaggtttattgttaa

SEQ ID NO: 656224 - DNA, 23 bp, Homo sapiens
ctgtgaggccatacttgtgaaac

SEQ ID NO: 656225 - DNA, 16 bp, Homo sapiens
ctgtgatatgccatag

SEQ ID NO: 656226 - DNA, 16 bp, Homo sapiens
ctgtgatatgtctgct

SEQ ID NO: 656227 - DNA, 21 bp, Homo sapiens
ctgtgcaatagacacatacat

SEQ ID NO: 656228 - DNA, 18 bp, Homo sapiens
ctgtgcagacccagtccc

SEQ ID NO: 656229 - DNA, 21 bp, Homo sapiens
ctgtgccactcaccgaagcca

SEQ ID NO: 656230 - DNA, 16 bp, Homo sapiens
ctgtgccagcaccaca

SEQ ID NO: 656231 - DNA, 14 bp, Homo sapiens
ctgtgctagaagct

SEQ ID NO: 656232 - DNA, 13 bp, Homo sapiens
ctgtgctcagaag

SEQ ID NO: 656233 - DNA, 17 bp, Homo sapiens
ctgtgctcagaagggct

SEQ ID NO: 656234 - DNA, 13 bp, Homo sapiens
ctgtgctggggga

SEQ ID NO: 656235 - DNA, 17 bp, Homo sapiens
ctgtggcataaattgca

SEQ ID NO: 656236 - DNA, 18 bp, Homo sapiens
ctgtggcataaattgcat

SEQ ID NO: 656237 - DNA, 13 bp, Homo sapiens
ctgtggccaggcc

SEQ ID NO: 656238 - DNA, 20 bp, Homo sapiens
ctgtggtctggtgttccagc

SEQ ID NO: 656239 - DNA, 19 bp, Homo sapiens
ctgtgtctgcctgtcccca

SEQ ID NO: 656240 - DNA, 13 bp, Homo sapiens
ctgtgtgcaggtt

SEQ ID NO: 656241 - DNA, 16 bp, Homo sapiens
ctgtgtgtcccaggca

SEQ ID NO: 656242 - DNA, 18 bp, Homo sapiens
ctgtgtgtcccaggcagg

SEQ ID NO: 656243 - DNA, 23 bp, Homo sapiens
ctgtgtgtcccaggcagggagac

SEQ ID NO: 656244 - DNA, 21 bp, Homo sapiens
ctgtgtgtgtgtgtgtgcgtg

SEQ ID NO: 656245 - DNA, 16 bp, Homo sapiens
ctgttaatttttctta

SEQ ID NO: 656246 - DNA, 16 bp, Homo sapiens
ctgttactgggccctg

SEQ ID NO: 656247 - DNA, 19 bp, Homo sapiens
ctgttagctttccaaggaa

SEQ ID NO: 656248 - DNA, 18 bp, Homo sapiens
ctgttatcaaactgctgt

SEQ ID NO: 656249 - DNA, 19 bp, Homo sapiens
ctgttatgatttccttcaa

SEQ ID NO: 656250 - DNA, 20 bp, Homo sapiens
ctgttatgatttccttcaat

SEQ ID NO: 656251 - DNA, 13 bp, Homo sapiens
ctgttatgggctt

SEQ ID NO: 656252 - DNA, 16 bp, Homo sapiens
ctgttatttcttccct

SEQ ID NO: 656253 - DNA, 18 bp, Homo sapiens
ctgttatttcttccctgc

SEQ ID NO: 656254 - DNA, 21 bp, Homo sapiens
ctgttatttcttccctgcttt

SEQ ID NO: 656255 - DNA, 23 bp, Homo sapiens
ctgttatttcttccctgctttgc

SEQ ID NO: 656256 - DNA, 20 bp, Homo sapiens
ctgttcatttctaaatttat

SEQ ID NO: 656257 - DNA, 21 bp, Homo sapiens
ctgttctgtggttcctctgct

SEQ ID NO: 656258 - DNA, 16 bp, Homo sapiens
ctgttggtctgccttc

SEQ ID NO: 656259 - DNA, 21 bp, Homo sapiens
ctgttggtctgccttctgctg

SEQ ID NO: 656260 - DNA, 19 bp, Homo sapiens
ctgtttacatccagagttc

SEQ ID NO: 656261 - DNA, 16 bp, Homo sapiens
ctgtttataatgaaga

SEQ ID NO: 656262 - DNA, 19 bp, Homo sapiens
ctgtttcaaaaaaatctat

SEQ ID NO: 656263 - DNA, 13 bp, Homo sapiens
ctgtttccagggt

SEQ ID NO: 656264 - DNA, 15 bp, Homo sapiens
ctgtttccagggtct

SEQ ID NO: 656265 - DNA, 19 bp, Homo sapiens
ctgtttcctatttaataca

SEQ ID NO: 656266 - DNA, 15 bp, Homo sapiens
ctgtttctaagaaaa

SEQ ID NO: 656267 - DNA, 16 bp, Homo sapiens
ctgtttgtcctgagat

SEQ ID NO: 656268 - DNA, 22 bp, Homo sapiens
ctgtttgtcctgagatggaaaa

SEQ ID NO: 656269 - DNA, 21 bp, Homo sapiens
ctgttttagtgtttatgttta

SEQ ID NO: 656270 - DNA, 20 bp, Homo sapiens
cttaaaaatcattgattgtc

SEQ ID NO: 656271 - DNA, 22 bp, Homo sapiens
cttaaaataggggatatttaag

SEQ ID NO: 656272 - DNA, 17 bp, Homo sapiens
cttaaaattaagatttc

SEQ ID NO: 656273 - DNA, 16 bp, Homo sapiens
cttaaacacaggctgt

SEQ ID NO: 656274 - DNA, 21 bp, Homo sapiens
cttaaacacaggctgtcctta

SEQ ID NO: 656275 - DNA, 12 bp, Homo sapiens
cttaaatgttta

SEQ ID NO: 656276 - DNA, 14 bp, Homo sapiens
cttaaatgtttata

SEQ ID NO: 656277 - DNA, 16 bp, Homo sapiens
cttaaatgtttatact

SEQ ID NO: 656278 - DNA, 20 bp, Homo sapiens
cttaaatgtttatactgtat

SEQ ID NO: 656279 - DNA, 18 bp, Homo sapiens
cttaaccttaaccttaaa

SEQ ID NO: 656280 - DNA, 14 bp, Homo sapiens
cttaagatattgaa

SEQ ID NO: 656281 - DNA, 17 bp, Homo sapiens
cttaagatattgaagga

SEQ ID NO: 656282 - DNA, 19 bp, Homo sapiens
cttaagatggaaatacagt

SEQ ID NO: 656283 - DNA, 21 bp, Homo sapiens
cttaagttagttccactgaga

SEQ ID NO: 656284 - DNA, 22 bp, Homo sapiens
cttaattgactgaaattacttt

SEQ ID NO: 656285 - DNA, 12 bp, Homo sapiens
cttaatttagaa

SEQ ID NO: 656286 - DNA, 14 bp, Homo sapiens
cttaatttagaaac

SEQ ID NO: 656287 - DNA, 16 bp, Homo sapiens
cttaatttagaaactg

SEQ ID NO: 656288 - DNA, 17 bp, Homo sapiens
cttaatttagaaactga

SEQ ID NO: 656289 - DNA, 22 bp, Homo sapiens
cttaatttagaaactgaaaaat

SEQ ID NO: 656290 - DNA, 20 bp, Homo sapiens
cttaatttttttttcataga

SEQ ID NO: 656291 - DNA, 15 bp, Homo sapiens
cttacaatgtgaata

SEQ ID NO: 656292 - DNA, 22 bp, Homo sapiens
cttacagccctaagtggctgcc

SEQ ID NO: 656293 - DNA, 14 bp, Homo sapiens
cttaccataccact

SEQ ID NO: 656294 - DNA, 12 bp, Homo sapiens
cttactattttg

SEQ ID NO: 656295 - DNA, 23 bp, Homo sapiens
cttactcccccaccactcaggcc

SEQ ID NO: 656296 - DNA, 14 bp, Homo sapiens
cttagaaacactgc

SEQ ID NO: 656297 - DNA, 22 bp, Homo sapiens
cttagacctcctaaatgcccca

SEQ ID NO: 656298 - DNA, 18 bp, Homo sapiens
cttagcctggatttcctt

SEQ ID NO: 656299 - DNA, 20 bp, Homo sapiens
cttagcgtcaagacatttgc

SEQ ID NO: 656300 - DNA, 21 bp, Homo sapiens
attttttaagtgaaaatatag

SEQ ID NO: 656301 - DNA, 16 bp, Homo sapiens
attttttactgccctt

SEQ ID NO: 656302 - DNA, 13 bp, Homo sapiens
caaaaaaaggaag

SEQ ID NO: 656303 - DNA, 14 bp, Homo sapiens
caaaaaaaggaagg

SEQ ID NO: 656304 - DNA, 21 bp, Homo sapiens
caaaaaagacttgagacaatg

SEQ ID NO: 656305 - DNA, 11 bp, Homo sapiens
caaaaaataca

SEQ ID NO: 656306 - DNA, 20 bp, Homo sapiens
caaaaacaagtaaatatata

SEQ ID NO: 656307 - DNA, 15 bp, Homo sapiens
caaaacaaaggccta

SEQ ID NO: 656308 - DNA, 20 bp, Homo sapiens
caaaacctgtattactgaat

SEQ ID NO: 656309 - DNA, 23 bp, Homo sapiens
caaaagaaaattgatatttttat

SEQ ID NO: 656310 - DNA, 16 bp, Homo sapiens
caaaagaataagacaa

SEQ ID NO: 656311 - DNA, 17 bp, Homo sapiens
caaaagcttcaaattaa

SEQ ID NO: 656312 - DNA, 20 bp, Homo sapiens
caaaatcactttaagatctt

SEQ ID NO: 656313 - DNA, 16 bp, Homo sapiens
caaaattaagcaaatg

SEQ ID NO: 656314 - DNA, 22 bp, Homo sapiens
caaaattaagcaaatgttaaaa

SEQ ID NO: 656315 - DNA, 16 bp, Homo sapiens
caaaattttattttgt

SEQ ID NO: 656316 - DNA, 16 bp, Homo sapiens
caaacagaacagggtc

SEQ ID NO: 656317 - DNA, 17 bp, Homo sapiens
caaacagaacagggtca

SEQ ID NO: 656318 - DNA, 13 bp, Homo sapiens
caaacaggacagc

SEQ ID NO: 656319 - DNA, 17 bp, Homo sapiens
caaaccgccagcgaact

SEQ ID NO: 656320 - DNA, 15 bp, Homo sapiens
caaacctttgagtag

SEQ ID NO: 656321 - DNA, 19 bp, Homo sapiens
caaacgagactttctcctg

SEQ ID NO: 656322 - DNA, 21 bp, Homo sapiens
caaacttacaggtcctgctga

SEQ ID NO: 656323 - DNA, 13 bp, Homo sapiens
caaacttactatt

SEQ ID NO: 656324 - DNA, 15 bp, Homo sapiens
caaacttagaaaggg

SEQ ID NO: 656325 - DNA, 14 bp, Homo sapiens
caaagaaatattaa

SEQ ID NO: 656326 - DNA, 17 bp, Homo sapiens
caaagacgacctttacc

SEQ ID NO: 656327 - DNA, 16 bp, Homo sapiens
caaagaggctgcccct

SEQ ID NO: 656328 - DNA, 12 bp, Homo sapiens
caaagataattt

SEQ ID NO: 656329 - DNA, 22 bp, Homo sapiens
caaagatctgaattaaataaat

SEQ ID NO: 656330 - DNA, 19 bp, Homo sapiens
caaagcaaccacaaatgca

SEQ ID NO: 656331 - DNA, 22 bp, Homo sapiens
caaagcccaaactcctttctta

SEQ ID NO: 656332 - DNA, 14 bp, Homo sapiens
caaagctcaaagta

SEQ ID NO: 656333 - DNA, 13 bp, Homo sapiens
caaagctgagcct

SEQ ID NO: 656334 - DNA, 17 bp, Homo sapiens
caaagctgagcctgcag

SEQ ID NO: 656335 - DNA, 23 bp, Homo sapiens
caaagctgagcctgcagggaagc

SEQ ID NO: 656336 - DNA, 24 bp, Homo sapiens
caaagctgagcctgcagggaagcc

SEQ ID NO: 656337 - DNA, 15 bp, Homo sapiens
caaagggagcagaac

SEQ ID NO: 656338 - DNA, 22 bp, Homo sapiens
caaagtgtatgcagtattcttg

SEQ ID NO: 656339 - DNA, 22 bp, Homo sapiens
caaagttttgttgtacttaaat

SEQ ID NO: 656340 - DNA, 15 bp, Homo sapiens
caaataaagcctttt

SEQ ID NO: 656341 - DNA, 23 bp, Homo sapiens
caaataaagccttttaaatcatc

SEQ ID NO: 656342 - DNA, 12 bp, Homo sapiens
caaatacctcaa

SEQ ID NO: 656343 - DNA, 15 bp, Homo sapiens
caaatataagacatt

SEQ ID NO: 656344 - DNA, 16 bp, Homo sapiens
caaatcagttagtttt

SEQ ID NO: 656345 - DNA, 17 bp, Homo sapiens
caaatgaaaaatctcaa

SEQ ID NO: 656346 - DNA, 15 bp, Homo sapiens
caaatgaagaaagtc

SEQ ID NO: 656347 - DNA, 16 bp, Homo sapiens
caaatgaagaaagtca

SEQ ID NO: 656348 - DNA, 16 bp, Homo sapiens
caaatgacagatttct

SEQ ID NO: 656349 - DNA, 16 bp, Homo sapiens
caaatgagctctgaaa

SEQ ID NO: 656350 - DNA, 21 bp, Homo sapiens
caaatgagctctgaaatcttc

SEQ ID NO: 656351 - DNA, 15 bp, Homo sapiens
caaatgcaatttgat

SEQ ID NO: 656352 - DNA, 13 bp, Homo sapiens
caaatgtcattgt

SEQ ID NO: 656353 - DNA, 19 bp, Homo sapiens
caaattaaaacaaatatac

SEQ ID NO: 656354 - DNA, 15 bp, Homo sapiens
caaattgtatcttat

SEQ ID NO: 656355 - DNA, 22 bp, Homo sapiens
caaattgtatcttattataaaa

SEQ ID NO: 656356 - DNA, 15 bp, Homo sapiens
caaattttcaagttt

SEQ ID NO: 656357 - DNA, 15 bp, Homo sapiens
caacaacatccactg

SEQ ID NO: 656358 - DNA, 16 bp, Homo sapiens
caacaagtgctcctga

SEQ ID NO: 656359 - DNA, 22 bp, Homo sapiens
caacaagtgctcctgaaagaaa

SEQ ID NO: 656360 - DNA, 20 bp, Homo sapiens
caacacatcaggaaagagag

SEQ ID NO: 656361 - DNA, 21 bp, Homo sapiens
caacactccattattcctctc

SEQ ID NO: 656362 - DNA, 18 bp, Homo sapiens
caacagccctgcctgaga

SEQ ID NO: 656363 - DNA, 19 bp, Homo sapiens
caacatagtgagacactgt

SEQ ID NO: 656364 - DNA, 19 bp, Homo sapiens
caacatgctccaaatataa

SEQ ID NO: 656365 - DNA, 14 bp, Homo sapiens
caacccttctctgt

SEQ ID NO: 656366 - DNA, 18 bp, Homo sapiens
caacctcagggctcccag

SEQ ID NO: 656367 - DNA, 20 bp, Homo sapiens
caacctcagggctcccaggg

SEQ ID NO: 656368 - DNA, 20 bp, Homo sapiens
caacctccagtgtcagggtc

SEQ ID NO: 656369 - DNA, 15 bp, Homo sapiens
caacctctgcctccc

SEQ ID NO: 656370 - DNA, 22 bp, Homo sapiens
caactacggttgggagaatgag

SEQ ID NO: 656371 - DNA, 23 bp, Homo sapiens
caactcagagaaaaatgctcccc

SEQ ID NO: 656372 - DNA, 15 bp, Homo sapiens
caactcccaacttct

SEQ ID NO: 656373 - DNA, 14 bp, Homo sapiens
caactcctgtctaa

SEQ ID NO: 656374 - DNA, 20 bp, Homo sapiens
caactgccaggctgcctcct

SEQ ID NO: 656375 - DNA, 22 bp, Homo sapiens
caactggggttgcgtctgaggc

SEQ ID NO: 656376 - DNA, 13 bp, Homo sapiens
caactgtatttat

SEQ ID NO: 656377 - DNA, 16 bp, Homo sapiens
caactgtcccaaggag

SEQ ID NO: 656378 - DNA, 14 bp, Homo sapiens
caacttatttcata

SEQ ID NO: 656379 - DNA, 19 bp, Homo sapiens
caactttgtaaaaatcttt

SEQ ID NO: 656380 - DNA, 16 bp, Homo sapiens
caagaaacctgactca

SEQ ID NO: 656381 - DNA, 17 bp, Homo sapiens
caagaagcaaagttcaa

SEQ ID NO: 656382 - DNA, 11 bp, Homo sapiens
caagaatgtac

SEQ ID NO: 656383 - DNA, 20 bp, Homo sapiens
caagacatttgctgaactca

SEQ ID NO: 656384 - DNA, 15 bp, Homo sapiens
caagagatctacaca

SEQ ID NO: 656385 - DNA, 19 bp, Homo sapiens
caagagctagaaaaataaa

SEQ ID NO: 656386 - DNA, 19 bp, Homo sapiens
caagaggctgtagaaaggg

SEQ ID NO: 656387 - DNA, 15 bp, Homo sapiens
caagaggtgggaggg

SEQ ID NO: 656388 - DNA, 16 bp, Homo sapiens
caagaggtgggagggc

SEQ ID NO: 656389 - DNA, 23 bp, Homo sapiens
caagatgaatgcagattacactg

SEQ ID NO: 656390 - DNA, 22 bp, Homo sapiens
caagattttgaatgcttcctga

SEQ ID NO: 656391 - DNA, 14 bp, Homo sapiens
caagcaactaattt

SEQ ID NO: 656392 - DNA, 16 bp, Homo sapiens
caagcaactaattttc

SEQ ID NO: 656393 - DNA, 20 bp, Homo sapiens
caagcactatgcccttttat

SEQ ID NO: 656394 - DNA, 19 bp, Homo sapiens
caagcagaggaccagggcc

SEQ ID NO: 656395 - DNA, 22 bp, Homo sapiens
caagcctcatgccaaccctggg

SEQ ID NO: 656396 - DNA, 16 bp, Homo sapiens
caagctagtgtttcta

SEQ ID NO: 656397 - DNA, 21 bp, Homo sapiens
caagctcactccccaaccccc

SEQ ID NO: 656398 - DNA, 17 bp, Homo sapiens
caagctgattttattca

SEQ ID NO: 656399 - DNA, 23 bp, Homo sapiens
caagctgttatttcttccctgct

SEQ ID NO: 656400 - DNA, 17 bp, Homo sapiens
caaggaaggaaagatgt

SEQ ID NO: 656401 - DNA, 22 bp, Homo sapiens
caaggaagttttaactttaata

SEQ ID NO: 656402 - DNA, 18 bp, Homo sapiens
caaggagaggcaaagaaa

SEQ ID NO: 656403 - DNA, 16 bp, Homo sapiens
caaggatatactgcag

SEQ ID NO: 656404 - DNA, 18 bp, Homo sapiens
caagggaagcctgcctgg

SEQ ID NO: 656405 - DNA, 17 bp, Homo sapiens
caagggctgtcattgca

SEQ ID NO: 656406 - DNA, 14 bp, Homo sapiens
caaggtataataaa

SEQ ID NO: 656407 - DNA, 23 bp, Homo sapiens
caaggtggggattgcccctggct

SEQ ID NO: 656408 - DNA, 16 bp, Homo sapiens
caagtaagaagacatg

SEQ ID NO: 656409 - DNA, 22 bp, Homo sapiens
caagtaagaagacatgaaccaa

SEQ ID NO: 656410 - DNA, 15 bp, Homo sapiens
caagtcagctccagc

SEQ ID NO: 656411 - DNA, 18 bp, Homo sapiens
caagtcatagccataaat

SEQ ID NO: 656412 - DNA, 20 bp, Homo sapiens
caagtcatttttgtattttt

SEQ ID NO: 656413 - DNA, 16 bp, Homo sapiens
caagtccgcagaagcc

SEQ ID NO: 656414 - DNA, 20 bp, Homo sapiens
caagtggtagcaagaagtga

SEQ ID NO: 656415 - DNA, 22 bp, Homo sapiens
caagttaccaatgtaacactgg

SEQ ID NO: 656416 - DNA, 15 bp, Homo sapiens
caagttgtaaataat

SEQ ID NO: 656417 - DNA, 16 bp, Homo sapiens
caagtttaaaagccat

SEQ ID NO: 656418 - DNA, 15 bp, Homo sapiens
caagtttacacttca

SEQ ID NO: 656419 - DNA, 19 bp, Homo sapiens
caagtttacacttcatata

SEQ ID NO: 656420 - DNA, 14 bp, Homo sapiens
caagtttatatata

SEQ ID NO: 656421 - DNA, 17 bp, Homo sapiens
caagttttcttccatga

SEQ ID NO: 656422 - DNA, 13 bp, Homo sapiens
atttagcaagcaa

SEQ ID NO: 656423 - DNA, 15 bp, Homo sapiens
atttagcaagcaact

SEQ ID NO: 656424 - DNA, 20 bp, Homo sapiens
atttagcaagcaactaattt

SEQ ID NO: 656425 - DNA, 21 bp, Homo sapiens
atttagcaagcaactaatttt

SEQ ID NO: 656426 - DNA, 22 bp, Homo sapiens
atttaggcagattgaaaaggac

SEQ ID NO: 656427 - DNA, 15 bp, Homo sapiens
atttagtaagtatgt

SEQ ID NO: 656428 - DNA, 16 bp, Homo sapiens
atttagtattatcaaa

SEQ ID NO: 656429 - DNA, 15 bp, Homo sapiens
atttataaacagaca

SEQ ID NO: 656430 - DNA, 21 bp, Homo sapiens
atttataaacagacaatatgt

SEQ ID NO: 656431 - DNA, 19 bp, Homo sapiens
atttataagcattgccatt

SEQ ID NO: 656432 - DNA, 19 bp, Homo sapiens
atttatattcataaagtta

SEQ ID NO: 656433 - DNA, 17 bp, Homo sapiens
atttatccaaaatgtgt

SEQ ID NO: 656434 - DNA, 19 bp, Homo sapiens
atttatccaaaatgtgtat

SEQ ID NO: 656435 - DNA, 20 bp, Homo sapiens
atttatccagaaaactgtga

SEQ ID NO: 656436 - DNA, 18 bp, Homo sapiens
atttatgacctgaaataa

SEQ ID NO: 656437 - DNA, 15 bp, Homo sapiens
atttatgggcccctg

SEQ ID NO: 656438 - DNA, 14 bp, Homo sapiens
atttatgtagatgt

SEQ ID NO: 656439 - DNA, 20 bp, Homo sapiens
atttatgtagatgtgcattt

SEQ ID NO: 656440 - DNA, 18 bp, Homo sapiens
atttatgtgaaatgcttt

SEQ ID NO: 656441 - DNA, 12 bp, Homo sapiens
atttatttaata

SEQ ID NO: 656442 - DNA, 15 bp, Homo sapiens
atttatttaatattt

SEQ ID NO: 656443 - DNA, 18 bp, Homo sapiens
atttatttaatatttaat

SEQ ID NO: 656444 - DNA, 18 bp, Homo sapiens
atttatttcaataaatct

SEQ ID NO: 656445 - DNA, 19 bp, Homo sapiens
atttatttgaggtcagtgt

SEQ ID NO: 656446 - DNA, 12 bp, Homo sapiens
atttatttttgt

SEQ ID NO: 656447 - DNA, 19 bp, Homo sapiens
atttcaaaatacatttgta

SEQ ID NO: 656448 - DNA, 18 bp, Homo sapiens
atttcaaagttttgttgt

SEQ ID NO: 656449 - DNA, 15 bp, Homo sapiens
atttcataattgcct

SEQ ID NO: 656450 - DNA, 13 bp, Homo sapiens
atttcatttaaat

SEQ ID NO: 656451 - DNA, 16 bp, Homo sapiens
atttcatttaaatatc

SEQ ID NO: 656452 - DNA, 22 bp, Homo sapiens
atttccagaaccacacttgaaa

SEQ ID NO: 656453 - DNA, 19 bp, Homo sapiens
atttcctcagcttatctct

SEQ ID NO: 656454 - DNA, 13 bp, Homo sapiens
atttcctcctggc

SEQ ID NO: 656455 - DNA, 19 bp, Homo sapiens
atttcctgtgtgtgttgcc

SEQ ID NO: 656456 - DNA, 19 bp, Homo sapiens
atttccttcaatgtgcata

SEQ ID NO: 656457 - DNA, 17 bp, Homo sapiens
atttcgtgtactgcaaa

SEQ ID NO: 656458 - DNA, 19 bp, Homo sapiens
atttctaatccttttcctt

SEQ ID NO: 656459 - DNA, 21 bp, Homo sapiens
atttctaatccttttccttat

SEQ ID NO: 656460 - DNA, 12 bp, Homo sapiens
atttctaattgt

SEQ ID NO: 656461 - DNA, 21 bp, Homo sapiens
atttctagtccaaaattacaa

SEQ ID NO: 656462 - DNA, 14 bp, Homo sapiens
atttctataaatag

SEQ ID NO: 656463 - DNA, 13 bp, Homo sapiens
atttctatgacaa

SEQ ID NO: 656464 - DNA, 15 bp, Homo sapiens
atttctatgacaaat

SEQ ID NO: 656465 - DNA, 19 bp, Homo sapiens
atttctatgacaaattcaa

SEQ ID NO: 656466 - DNA, 22 bp, Homo sapiens
atttctcactatatatatttct

SEQ ID NO: 656467 - DNA, 18 bp, Homo sapiens
atttctcataattttgca

SEQ ID NO: 656468 - DNA, 19 bp, Homo sapiens
atttctcataattttgcaa

SEQ ID NO: 656469 - DNA, 17 bp, Homo sapiens
atttctcattgactttt

SEQ ID NO: 656470 - DNA, 18 bp, Homo sapiens
atttctccatcctgcaga

SEQ ID NO: 656471 - DNA, 13 bp, Homo sapiens
atttctgtatata

SEQ ID NO: 656472 - DNA, 22 bp, Homo sapiens
atttctgtttcctatttaatac

SEQ ID NO: 656473 - DNA, 22 bp, Homo sapiens
atttcttcttctaagaagacat

SEQ ID NO: 656474 - DNA, 23 bp, Homo sapiens
atttcttcttctaagaagacatt

SEQ ID NO: 656475 - DNA, 11 bp, Homo sapiens
atttcttgctt

SEQ ID NO: 656476 - DNA, 20 bp, Homo sapiens
atttgaaaaatataaaatta

SEQ ID NO: 656477 - DNA, 15 bp, Homo sapiens
cagcagcttctccag

SEQ ID NO: 656478 - DNA, 13 bp, Homo sapiens
cagcaggcagagt

SEQ ID NO: 656479 - DNA, 19 bp, Homo sapiens
cagcatgcctgtcctttca

SEQ ID NO: 656480 - DNA, 22 bp, Homo sapiens
cagccacctgggaacacagttc

SEQ ID NO: 656481 - DNA, 16 bp, Homo sapiens
cagccactccccggca

SEQ ID NO: 656482 - DNA, 20 bp, Homo sapiens
cagccagcccatggccccca

SEQ ID NO: 656483 - DNA, 12 bp, Homo sapiens
cagcccaccctg

SEQ ID NO: 656484 - DNA, 13 bp, Homo sapiens
cagcccaccctgc

SEQ ID NO: 656485 - DNA, 15 bp, Homo sapiens
cagcccatggccccc

SEQ ID NO: 656486 - DNA, 16 bp, Homo sapiens
cagcccatggccccca

SEQ ID NO: 656487 - DNA, 19 bp, Homo sapiens
cagccccctaaaagcactc

SEQ ID NO: 656488 - DNA, 17 bp, Homo sapiens
cagccctgcctgagaag

SEQ ID NO: 656489 - DNA, 16 bp, Homo sapiens
cagccctggcctggct

SEQ ID NO: 656490 - DNA, 17 bp, Homo sapiens
cagccctggcctggctg

SEQ ID NO: 656491 - DNA, 18 bp, Homo sapiens
cagccctggcctggctgg

SEQ ID NO: 656492 - DNA, 15 bp, Homo sapiens
cagcctactctcctt

SEQ ID NO: 656493 - DNA, 16 bp, Homo sapiens
cagcctactctccttg

SEQ ID NO: 656494 - DNA, 14 bp, Homo sapiens
cagcctagcacagg

SEQ ID NO: 656495 - DNA, 22 bp, Homo sapiens
cagcctcacttcctttgccctt

SEQ ID NO: 656496 - DNA, 18 bp, Homo sapiens
cagcctcgttggaagagg

SEQ ID NO: 656497 - DNA, 22 bp, Homo sapiens
cagcctcgttggaagaggaaca

SEQ ID NO: 656498 - DNA, 23 bp, Homo sapiens
cagcctcgttggaagaggaacag

SEQ ID NO: 656499 - DNA, 13 bp, Homo sapiens
cagcctcttactt

SEQ ID NO: 656500 - DNA, 18 bp, Homo sapiens
cagccttgagccctggct

SEQ ID NO: 656501 - DNA, 22 bp, Homo sapiens
cagcgaagtagcttgctccctg

SEQ ID NO: 656502 - DNA, 12 bp, Homo sapiens
cagcgcagggct

SEQ ID NO: 656503 - DNA, 23 bp, Homo sapiens
cagcgccaagtgcgtgccgtgtg

SEQ ID NO: 656504 - DNA, 14 bp, Homo sapiens
cagcgtccctggcg

SEQ ID NO: 656505 - DNA, 17 bp, Homo sapiens
cagcgtggcttttccta

SEQ ID NO: 656506 - DNA, 14 bp, Homo sapiens
cagctataattctg

SEQ ID NO: 656507 - DNA, 16 bp, Homo sapiens
cagctataattctgtt

SEQ ID NO: 656508 - DNA, 13 bp, Homo sapiens
cagctatatttga

SEQ ID NO: 656509 - DNA, 22 bp, Homo sapiens
cagctcttccagggcagcggct

SEQ ID NO: 656510 - DNA, 23 bp, Homo sapiens
cagctcttccagggcagcggctc

SEQ ID NO: 656511 - DNA, 18 bp, Homo sapiens
cagctctttccaaattaa

SEQ ID NO: 656512 - DNA, 22 bp, Homo sapiens
cagctgaagtcaaaatatgtaa

SEQ ID NO: 656513 - DNA, 23 bp, Homo sapiens
cagctgaatgcctcctgtgggga

SEQ ID NO: 656514 - DNA, 24 bp, Homo sapiens
cagctgactgaatgcagaacggtt

SEQ ID NO: 656515 - DNA, 17 bp, Homo sapiens
cagctgagtgagtggga

SEQ ID NO: 656516 - DNA, 15 bp, Homo sapiens
cagctgcccttccgc

SEQ ID NO: 656517 - DNA, 22 bp, Homo sapiens
cacacccaaagctgagcctgca

SEQ ID NO: 656518 - DNA, 19 bp, Homo sapiens
cacacccagtgggaagagt

SEQ ID NO: 656519 - DNA, 22 bp, Homo sapiens
cacaccctgaggtcagggagtg

SEQ ID NO: 656520 - DNA, 18 bp, Homo sapiens
cacactgcactgttttca

SEQ ID NO: 656521 - DNA, 21 bp, Homo sapiens
cacactgtcatgcttcatcat

SEQ ID NO: 656522 - DNA, 21 bp, Homo sapiens
cacagaacaggaggtgtgaat

SEQ ID NO: 656523 - DNA, 19 bp, Homo sapiens
cacagaggacacagagaag

SEQ ID NO: 656524 - DNA, 17 bp, Homo sapiens
cacagatctgcatctga

SEQ ID NO: 656525 - DNA, 22 bp, Homo sapiens
cacagccagggggatgccactc

SEQ ID NO: 656526 - DNA, 21 bp, Homo sapiens
cacagctcttccagggcagcg

SEQ ID NO: 656527 - DNA, 17 bp, Homo sapiens
cacagctgggagcctgg

SEQ ID NO: 656528 - DNA, 21 bp, Homo sapiens
cacagcttttgtatagaaaat

SEQ ID NO: 656529 - DNA, 14 bp, Homo sapiens
cacaggctggcagt

SEQ ID NO: 656530 - DNA, 20 bp, Homo sapiens
cacagtggctcacacctgta

SEQ ID NO: 656531 - DNA, 13 bp, Homo sapiens
cacatatacatat

SEQ ID NO: 656532 - DNA, 17 bp, Homo sapiens
cacatatttcagtgagg

SEQ ID NO: 656533 - DNA, 23 bp, Homo sapiens
cacatatttgaagggtctttctc

SEQ ID NO: 656534 - DNA, 23 bp, Homo sapiens
cacatcccattgggactccatgc

SEQ ID NO: 656535 - DNA, 18 bp, Homo sapiens
cacatccgcgtgtgcctg

SEQ ID NO: 656536 - DNA, 12 bp, Homo sapiens
cacatctggctg

SEQ ID NO: 656537 - DNA, 20 bp, Homo sapiens
cacatgccccccagattgct

SEQ ID NO: 656538 - DNA, 17 bp, Homo sapiens
cacatgctgcctggcac

SEQ ID NO: 656539 - DNA, 14 bp, Homo sapiens
cacatgtttaactt

SEQ ID NO: 656540 - DNA, 23 bp, Homo sapiens
cacattagattttattttactat

SEQ ID NO: 656541 - DNA, 13 bp, Homo sapiens
caccaagaagcaa

SEQ ID NO: 656542 - DNA, 20 bp, Homo sapiens
caccaaggaaacgctacctc

SEQ ID NO: 656543 - DNA, 12 bp, Homo sapiens
caccaatgaaaa

SEQ ID NO: 656544 - DNA, 13 bp, Homo sapiens
caccaatgaaaac

SEQ ID NO: 656545 - DNA, 15 bp, Homo sapiens
caccaatgaaaacat

SEQ ID NO: 656546 - DNA, 16 bp, Homo sapiens
caccacgattctccca

SEQ ID NO: 656547 - DNA, 13 bp, Homo sapiens
caccactcaggcc

SEQ ID NO: 656548 - DNA, 20 bp, Homo sapiens
caccagcttcactctctccg

SEQ ID NO: 656549 - DNA, 19 bp, Homo sapiens
caccagttatgtttgaatg

SEQ ID NO: 656550 - DNA, 13 bp, Homo sapiens
caccatccagctc

SEQ ID NO: 656551 - DNA, 16 bp, Homo sapiens
caccatccagctcccc

SEQ ID NO: 656552 - DNA, 17 bp, Homo sapiens
caccatccagctcccca

SEQ ID NO: 656553 - DNA, 17 bp, Homo sapiens
caccatgtgagctcttc

SEQ ID NO: 656554 - DNA, 21 bp, Homo sapiens
cacccaaaccggcaggtgcga

SEQ ID NO: 656555 - DNA, 15 bp, Homo sapiens
cacccaaagctgagc

SEQ ID NO: 656556 - DNA, 19 bp, Homo sapiens
cacccaaagctgagcctgc

SEQ ID NO: 656557 - DNA, 15 bp, Homo sapiens
cacccagcaggcaga

SEQ ID NO: 656558 - DNA, 19 bp, Homo sapiens
cacccagcaggcagagtgg

SEQ ID NO: 656559 - DNA, 14 bp, Homo sapiens
cacccagtgggaag

SEQ ID NO: 656560 - DNA, 14 bp, Homo sapiens
caccccactcctgt

SEQ ID NO: 656561 - DNA, 16 bp, Homo sapiens
caccccactcctgtca

SEQ ID NO: 656562 - DNA, 13 bp, Homo sapiens
caccccccactca

SEQ ID NO: 656563 - DNA, 17 bp, Homo sapiens
cacccctctcgcctcat

SEQ ID NO: 656564 - DNA, 16 bp, Homo sapiens
cacccctctgccctca

SEQ ID NO: 656565 - DNA, 16 bp, Homo sapiens
cacccctttctgtccc

SEQ ID NO: 656566 - DNA, 18 bp, Homo sapiens
cacccctttctgtcccac

SEQ ID NO: 656567 - DNA, 17 bp, Homo sapiens
cacccgagttcctctgg

SEQ ID NO: 656568 - DNA, 18 bp, Homo sapiens
cacccgagttcctctggg

SEQ ID NO: 656569 - DNA, 17 bp, Homo sapiens
caccctgctgctggtgc

SEQ ID NO: 656570 - DNA, 20 bp, Homo sapiens
caccctgctgctggtgcaca

SEQ ID NO: 656571 - DNA, 14 bp, Homo sapiens
caccctttccagga

SEQ ID NO: 656572 - DNA, 16 bp, Homo sapiens
caccgaggggcctttg

SEQ ID NO: 656573 - DNA, 22 bp, Homo sapiens
caccgcctccccacctccaggc

SEQ ID NO: 656574 - DNA, 16 bp, Homo sapiens
caccggtcagtgcctt

SEQ ID NO: 656575 - DNA, 22 bp, Homo sapiens
caccgtacatctgcaatatgaa

SEQ ID NO: 656576 - DNA, 21 bp, Homo sapiens
cacctaaaggtgtatttaaac

SEQ ID NO: 656577 - DNA, 14 bp, Homo sapiens
cacctaatgtttat

SEQ ID NO: 656578 - DNA, 20 bp, Homo sapiens
cacctaatgtttatgagcca

SEQ ID NO: 656579 - DNA, 19 bp, Homo sapiens
cacctcggcacacactgtg

SEQ ID NO: 656580 - DNA, 22 bp, Homo sapiens
cacctctgtgacccctccttgt

SEQ ID NO: 656581 - DNA, 23 bp, Homo sapiens
cacctctgtgacccctccttgtc

SEQ ID NO: 656582 - DNA, 23 bp, Homo sapiens
cacctgacactaaccagagtcag

SEQ ID NO: 656583 - DNA, 23 bp, Homo sapiens
cacctgcaggaccctgtcctgca

SEQ ID NO: 656584 - DNA, 13 bp, Homo sapiens
cacctgctcccag

SEQ ID NO: 656585 - DNA, 15 bp, Homo sapiens
cacctgctcccaggc

SEQ ID NO: 656586 - DNA, 17 bp, Homo sapiens
cacctgctcccaggccc

SEQ ID NO: 656587 - DNA, 14 bp, Homo sapiens
cacctgggaacaca

SEQ ID NO: 656588 - DNA, 15 bp, Homo sapiens
cacctgggaacacag

SEQ ID NO: 656589 - DNA, 16 bp, Homo sapiens
cacctgggaacacagt

SEQ ID NO: 656590 - DNA, 20 bp, Homo sapiens
cacctgtgggtgtagccagg

SEQ ID NO: 656591 - DNA, 13 bp, Homo sapiens
caccttgtgcctg

SEQ ID NO: 656592 - DNA, 16 bp, Homo sapiens
caccttgtgcctgggg

SEQ ID NO: 656593 - DNA, 14 bp, Homo sapiens
aggtgaacattggt

SEQ ID NO: 656594 - DNA, 21 bp, Homo sapiens
aggtgacttcctctggtgttt

SEQ ID NO: 656595 - DNA, 13 bp, Homo sapiens
aggtgagctactt

SEQ ID NO: 656596 - DNA, 19 bp, Homo sapiens
aggtgataggtaaattttt

SEQ ID NO: 656597 - DNA, 11 bp, Homo sapiens
aggtgcagagg

SEQ ID NO: 656598 - DNA, 16 bp, Homo sapiens
aggtgccgctacagtt

SEQ ID NO: 656599 - DNA, 16 bp, Homo sapiens
aggtggaaggcagaca

SEQ ID NO: 656600 - DNA, 18 bp, Homo sapiens
aggtggaaggcagacagc

SEQ ID NO: 656601 - DNA, 19 bp, Homo sapiens
aggtgggccttgctacctc

SEQ ID NO: 656602 - DNA, 14 bp, Homo sapiens
aggtggttcagaca

SEQ ID NO: 656603 - DNA, 19 bp, Homo sapiens
aggtgtcctgagcaccaca

SEQ ID NO: 656604 - DNA, 20 bp, Homo sapiens
aggtgtctgccttcacaaat

SEQ ID NO: 656605 - DNA, 22 bp, Homo sapiens
aggtgtctgccttcacaaatgt

SEQ ID NO: 656606 - DNA, 21 bp, Homo sapiens
aggtgtgaacctacctgcctt

SEQ ID NO: 656607 - DNA, 22 bp, Homo sapiens
aggtgtgaacctacctgccttg

SEQ ID NO: 656608 - DNA, 12 bp, Homo sapiens
aggtgtgaatgc

SEQ ID NO: 656609 - DNA, 17 bp, Homo sapiens
aggtgttctacactcat

SEQ ID NO: 656610 - DNA, 23 bp, Homo sapiens
aggtgttttttatgaagtgcgtg

SEQ ID NO: 656611 - DNA, 22 bp, Homo sapiens
aggttatctttttaaaaactct

SEQ ID NO: 656612 - DNA, 23 bp, Homo sapiens
aggttatctttttaaaaactctt

SEQ ID NO: 656613 - DNA, 23 bp, Homo sapiens
aggttattttctttatcattgct

SEQ ID NO: 656614 - DNA, 16 bp, Homo sapiens
aggttccgatgttatt

SEQ ID NO: 656615 - DNA, 11 bp, Homo sapiens
aggcagctgcc

SEQ ID NO: 656616 - DNA, 12 bp, Homo sapiens
aggcagctgcct

SEQ ID NO: 656617 - DNA, 13 bp, Homo sapiens
aggcagctgcctc

SEQ ID NO: 656618 - DNA, 19 bp, Homo sapiens
aggcagctgcctctgctcc

SEQ ID NO: 656619 - DNA, 21 bp, Homo sapiens
aggcagctgcctctgctccct

SEQ ID NO: 656620 - DNA, 15 bp, Homo sapiens
aggcaggcatggccc

SEQ ID NO: 656621 - DNA, 20 bp, Homo sapiens
aggcaggcatggccctgggc

SEQ ID NO: 656622 - DNA, 15 bp, Homo sapiens
aggcaggcggctcct

SEQ ID NO: 656623 - DNA, 15 bp, Homo sapiens
aggcaggtgggcaga

SEQ ID NO: 656624 - DNA, 13 bp, Homo sapiens
aggcattaatgtt

SEQ ID NO: 656625 - DNA, 20 bp, Homo sapiens
aggcattgacataggtcata

SEQ ID NO: 656626 - DNA, 19 bp, Homo sapiens
aggcattgaggaagagtct

SEQ ID NO: 656627 - DNA, 17 bp, Homo sapiens
aggccacagtggggctg

SEQ ID NO: 656628 - DNA, 14 bp, Homo sapiens
aggccagcaacatt

SEQ ID NO: 656629 - DNA, 18 bp, Homo sapiens
aggccatctcagcttgct

SEQ ID NO: 656630 - DNA, 22 bp, Homo sapiens
aggcccgcttgctgggtacctg

SEQ ID NO: 656631 - DNA, 17 bp, Homo sapiens
aggccctcctgtgctgg

SEQ ID NO: 656632 - DNA, 12 bp, Homo sapiens
aggccctgccca

SEQ ID NO: 656633 - DNA, 18 bp, Homo sapiens
aggccgcgcgtccagctg

SEQ ID NO: 656634 - DNA, 15 bp, Homo sapiens
acagtacagcatgtg

SEQ ID NO: 656635 - DNA, 16 bp, Homo sapiens
acagtatagatttttg

SEQ ID NO: 656636 - DNA, 21 bp, Homo sapiens
acagtcatcatcagggcctgg

SEQ ID NO: 656637 - DNA, 23 bp, Homo sapiens
acagtgaagttttactgtctatt

SEQ ID NO: 656638 - DNA, 21 bp, Homo sapiens
acagtggggctgcaggcaggc

SEQ ID NO: 656639 - DNA, 18 bp, Homo sapiens
acagttgaaaacttgtaa

SEQ ID NO: 656640 - DNA, 14 bp, Homo sapiens
acagtttccaaatt

SEQ ID NO: 656641 - DNA, 20 bp, Homo sapiens
acagtttgatacaggaatta

SEQ ID NO: 656642 - DNA, 21 bp, Homo sapiens
acagtttttatttagcatggg

SEQ ID NO: 656643 - DNA, 15 bp, Homo sapiens
acataacggaaagtt

SEQ ID NO: 656644 - DNA, 17 bp, Homo sapiens
acataagcttccatttt

SEQ ID NO: 656645 - DNA, 16 bp, Homo sapiens
agcgcagggctggcac

SEQ ID NO: 656646 - DNA, 21 bp, Homo sapiens
agcggaggttgcagtgagctg

SEQ ID NO: 656647 - DNA, 14 bp, Homo sapiens
agcgtcaagacatt

SEQ ID NO: 656648 - DNA, 15 bp, Homo sapiens
agcgtcaagacattt

SEQ ID NO: 656649 - DNA, 15 bp, Homo sapiens
agcgtcagctgctcc

SEQ ID NO: 656650 - DNA, 21 bp, Homo sapiens
agcgtcagctgctccctggca

SEQ ID NO: 656651 - DNA, 15 bp, Homo sapiens
agcgttaatgtaaag

SEQ ID NO: 656652 - DNA, 13 bp, Homo sapiens
agctaaagaggct

SEQ ID NO: 656653 - DNA, 16 bp, Homo sapiens
agctaagggtgggtgc

SEQ ID NO: 656654 - DNA, 20 bp, Homo sapiens
agctaagggtgggtgctcag

SEQ ID NO: 656655 - DNA, 22 bp, Homo sapiens
agctaagggtgggtgctcagaa

SEQ ID NO: 656656 - DNA, 12 bp, Homo sapiens
agctaataaatc

SEQ ID NO: 656657 - DNA, 15 bp, Homo sapiens
agctacaagggaagc

SEQ ID NO: 656658 - DNA, 15 bp, Homo sapiens
agctacactgagcag

SEQ ID NO: 656659 - DNA, 16 bp, Homo sapiens
agctactaatgatgtt

SEQ ID NO: 656660 - DNA, 13 bp, Homo sapiens
ataatatatttct

SEQ ID NO: 656661 - DNA, 13 bp, Homo sapiens
ataatatcaaata

SEQ ID NO: 656662 - DNA, 17 bp, Homo sapiens
ataatatcaaataaaat

SEQ ID NO: 656663 - DNA, 14 bp, Homo sapiens
ataatattgtttgg

SEQ ID NO: 656664 - DNA, 16 bp, Homo sapiens
ataatattgtttggta

SEQ ID NO: 656665 - DNA, 17 bp, Homo sapiens
ataatcaaatacatttt

SEQ ID NO: 656666 - DNA, 13 bp, Homo sapiens
ataatcagtaaat

SEQ ID NO: 656667 - DNA, 20 bp, Homo sapiens
ataatccctggatgatattt

SEQ ID NO: 656668 - DNA, 21 bp, Homo sapiens
ataatccctggatgatatttt

SEQ ID NO: 656669 - DNA, 12 bp, Homo sapiens
ataatcttcagg

SEQ ID NO: 656670 - DNA, 12 bp, Homo sapiens
ataatgaagaac

SEQ ID NO: 656671 - DNA, 18 bp, Homo sapiens
ataatgaagaacactgta

SEQ ID NO: 656672 - DNA, 15 bp, Homo sapiens
ataatgataaaataa

SEQ ID NO: 656673 - DNA, 20 bp, Homo sapiens
ataatgctacaattttaaga

SEQ ID NO: 656674 - DNA, 15 bp, Homo sapiens
ataatgcttcagata

SEQ ID NO: 656675 - DNA, 18 bp, Homo sapiens
ataatgtgcagaaaatat

SEQ ID NO: 656676 - DNA, 14 bp, Homo sapiens
ataatgttttggga

SEQ ID NO: 656677 - DNA, 21 bp, Homo sapiens
ataatgttttgggaaacactg

SEQ ID NO: 656678 - DNA, 17 bp, Homo sapiens
ataattctgttatatga

SEQ ID NO: 656679 - DNA, 20 bp, Homo sapiens
ataattgcctacatttatca

SEQ ID NO: 656680 - DNA, 24 bp, Homo sapiens
ataattgtacaaaattaagcaaat

SEQ ID NO: 656681 - DNA, 23 bp, Homo sapiens
ataattgtgtaccttaagatatt

SEQ ID NO: 656682 - DNA, 14 bp, Homo sapiens
ataatttataagca

SEQ ID NO: 656683 - DNA, 17 bp, Homo sapiens
ataatttataagcattg

SEQ ID NO: 656684 - DNA, 21 bp, Homo sapiens
ataatttataagcattgccat

SEQ ID NO: 656685 - DNA, 20 bp, Homo sapiens
ataatttcagtgggaaatat

SEQ ID NO: 656686 - DNA, 13 bp, Homo sapiens
ataattttgtaat

SEQ ID NO: 656687 - DNA, 23 bp, Homo sapiens
ataattttgtaatgtatcaaata

SEQ ID NO: 656688 - DNA, 19 bp, Homo sapiens
ataattttttttaaagaag

SEQ ID NO: 656689 - DNA, 14 bp, Homo sapiens
atacaagaaaatgt

SEQ ID NO: 656690 - DNA, 17 bp, Homo sapiens
atacaggaggatgtgaa

SEQ ID NO: 656691 - DNA, 20 bp, Homo sapiens
atacagttgaaaacttgtaa

SEQ ID NO: 656692 - DNA, 13 bp, Homo sapiens
atacatatatata

SEQ ID NO: 656693 - DNA, 14 bp, Homo sapiens
agtgtggccaggct

SEQ ID NO: 656694 - DNA, 18 bp, Homo sapiens
agtgtgtatatattttgt

SEQ ID NO: 656695 - DNA, 21 bp, Homo sapiens
agtgtttctagctaaataaat

SEQ ID NO: 656696 - DNA, 18 bp, Homo sapiens
agtgttttggactccatc

SEQ ID NO: 656697 - DNA, 20 bp, Homo sapiens
agtgttttggactccatctc

SEQ ID NO: 656698 - DNA, 16 bp, Homo sapiens
agtgtttttgtgaatt

SEQ ID NO: 656699 - DNA, 14 bp, Homo sapiens
agttaaactgagag

SEQ ID NO: 656700 - DNA, 22 bp, Homo sapiens
agttaaactgagagtaattcat

SEQ ID NO: 656701 - DNA, 20 bp, Homo sapiens
agttaattacatcctcatgc

SEQ ID NO: 656702 - DNA, 15 bp, Homo sapiens
agttagaacatttgc

SEQ ID NO: 656703 - DNA, 16 bp, Homo sapiens
agttagatctttgtaa

SEQ ID NO: 656704 - DNA, 22 bp, Homo sapiens
agttagatctttgtaaatgcat

SEQ ID NO: 656705 - DNA, 17 bp, Homo sapiens
agttagctccataaagt

SEQ ID NO: 656706 - DNA, 23 bp, Homo sapiens
agttagctccataaagtacaaat

SEQ ID NO: 656707 - DNA, 15 bp, Homo sapiens
agttagttccactga

SEQ ID NO: 656708 - DNA, 17 bp, Homo sapiens
agttagtttttaggtca

SEQ ID NO: 656709 - DNA, 14 bp, Homo sapiens
agttatttctgttt

SEQ ID NO: 656710 - DNA, 19 bp, Homo sapiens
agttcaacttatttcataa

SEQ ID NO: 656711 - DNA, 14 bp, Homo sapiens
agttcattttaaat

SEQ ID NO: 656712 - DNA, 17 bp, Homo sapiens
agttccacatctgtgga

SEQ ID NO: 656713 - DNA, 19 bp, Homo sapiens
agttccttatccctctctt

SEQ ID NO: 656714 - DNA, 21 bp, Homo sapiens
agttccttatccctctcttcc

SEQ ID NO: 656715 - DNA, 23 bp, Homo sapiens
agttctaacagtgaagttttact

SEQ ID NO: 656716 - DNA, 20 bp, Homo sapiens
agttctgtgtaaacagaagc

SEQ ID NO: 656717 - DNA, 14 bp, Homo sapiens
agttctttttgcca

SEQ ID NO: 656718 - DNA, 16 bp, Homo sapiens
agttgggtgtctcctt

SEQ ID NO: 656719 - DNA, 16 bp, Homo sapiens
agttggtgttgacata

SEQ ID NO: 656720 - DNA, 14 bp, Homo sapiens
atctataaaataga

SEQ ID NO: 656721 - DNA, 23 bp, Homo sapiens
atctataagtagtaaatcagaaa

SEQ ID NO: 656722 - DNA, 13 bp, Homo sapiens
atctatggcttat

SEQ ID NO: 656723 - DNA, 17 bp, Homo sapiens
atctatgggaagatact

SEQ ID NO: 656724 - DNA, 23 bp, Homo sapiens
atctcaatgaaccataaattcaa

SEQ ID NO: 656725 - DNA, 14 bp, Homo sapiens
atctcagcttgctg

SEQ ID NO: 656726 - DNA, 16 bp, Homo sapiens
atctcaggcttctgca

SEQ ID NO: 656727 - DNA, 18 bp, Homo sapiens
atctccaaggcagggacc

SEQ ID NO: 656728 - DNA, 22 bp, Homo sapiens
atctccatactgtttctttctt

SEQ ID NO: 656729 - DNA, 15 bp, Homo sapiens
atctccctgcctggc

SEQ ID NO: 656730 - DNA, 15 bp, Homo sapiens
atctcgaatttgaag

SEQ ID NO: 656731 - DNA, 19 bp, Homo sapiens
atctcgaatttgaagagat

SEQ ID NO: 656732 - DNA, 23 bp, Homo sapiens
atctcgaatttgaagagattgct

SEQ ID NO: 656733 - DNA, 22 bp, Homo sapiens
atctctcctggcctatccgctg

SEQ ID NO: 656734 - DNA, 15 bp, Homo sapiens
atctctctcttgcct

SEQ ID NO: 656735 - DNA, 17 bp, Homo sapiens
atctctcttgtcctctt

SEQ ID NO: 656736 - DNA, 20 bp, Homo sapiens
atctctcttgtcctcttctg

SEQ ID NO: 656737 - DNA, 14 bp, Homo sapiens
atctcttctgcaag

SEQ ID NO: 656738 - DNA, 19 bp, Homo sapiens
atctcttttatatttgtag

SEQ ID NO: 656739 - DNA, 17 bp, Homo sapiens
atctgacccactttgta

SEQ ID NO: 656740 - DNA, 21 bp, Homo sapiens
atctgacccactttgtaattt

SEQ ID NO: 656741 - DNA, 12 bp, Homo sapiens
atctgagctggg

SEQ ID NO: 656742 - DNA, 14 bp, Homo sapiens
atctgcaatatgaa

SEQ ID NO: 656743 - DNA, 16 bp, Homo sapiens
atctggctgcacaggc

SEQ ID NO: 656744 - DNA, 18 bp, Homo sapiens
atctggctgcacaggctg

SEQ ID NO: 656745 - DNA, 21 bp, Homo sapiens
atctggctggaaagcagagcc

SEQ ID NO: 656746 - DNA, 16 bp, Homo sapiens
atctgggattattctt

SEQ ID NO: 656747 - DNA, 21 bp, Homo sapiens
atctgggcttatatgtacttt

SEQ ID NO: 656748 - DNA, 18 bp, Homo sapiens
atctggtcttgttagaaa

SEQ ID NO: 656749 - DNA, 18 bp, Homo sapiens
atctgtgccatagaacaa

SEQ ID NO: 656750 - DNA, 23 bp, Homo sapiens
atctgttattcaaatttgatgat

SEQ ID NO: 656751 - DNA, 13 bp, Homo sapiens
atctgttcatttc

SEQ ID NO: 656752 - DNA, 14 bp, Homo sapiens
atcttcactagaag

SEQ ID NO: 656753 - DNA, 17 bp, Homo sapiens
atcttcactagaagccg

SEQ ID NO: 656754 - DNA, 22 bp, Homo sapiens
atcttcactgcaattttgtgta

SEQ ID NO: 656755 - DNA, 13 bp, Homo sapiens
atcttcacttcta

SEQ ID NO: 656756 - DNA, 18 bp, Homo sapiens
atcttcaggtgaacactt

SEQ ID NO: 656757 - DNA, 19 bp, Homo sapiens
atcttgaatgtggtctcag

SEQ ID NO: 656758 - DNA, 16 bp, Homo sapiens
atcttgaccatactaa

SEQ ID NO: 656759 - DNA, 21 bp, Homo sapiens
atcttggtttgtcagtttatc

SEQ ID NO: 656760 - DNA, 22 bp, Homo sapiens
atcttgtgtgattaacttattt

SEQ ID NO: 656761 - DNA, 17 bp, Homo sapiens
atctttaagaatgctta

SEQ ID NO: 656762 - DNA, 16 bp, Homo sapiens
atctttgtaaatgcat

SEQ ID NO: 656763 - DNA, 17 bp, Homo sapiens
atctttgttacttcctt

SEQ ID NO: 656764 - DNA, 18 bp, Homo sapiens
atctttgttttaaccagt

SEQ ID NO: 656765 - DNA, 17 bp, Homo sapiens
atcttttaaaatcatga

SEQ ID NO: 656766 - DNA, 16 bp, Homo sapiens
atcttttgaagcatag

SEQ ID NO: 656767 - DNA, 17 bp, Homo sapiens
atcttttgaagcataga

SEQ ID NO: 656768 - DNA, 19 bp, Homo sapiens
atctttttaaaaactcttc

SEQ ID NO: 656769 - DNA, 21 bp, Homo sapiens
atctttttaaaaactcttcag

SEQ ID NO: 656770 - DNA, 22 bp, Homo sapiens
atctttttaaaaactcttcagt

SEQ ID NO: 656771 - DNA, 18 bp, Homo sapiens
atgaaaaattggggagga

SEQ ID NO: 656772 - DNA, 19 bp, Homo sapiens
atgaaaacatgtactacag

SEQ ID NO: 656773 - DNA, 24 bp, Homo sapiens
atgaaaataccatttagtaagaat

SEQ ID NO: 656774 - DNA, 18 bp, Homo sapiens
atgaaagctgttccttgg

SEQ ID NO: 656775 - DNA, 21 bp, Homo sapiens
atgaaagtcaaatttacttta

SEQ ID NO: 656776 - DNA, 22 bp, Homo sapiens
atgaaataaagacccaggggga

SEQ ID NO: 656777 - DNA, 12 bp, Homo sapiens
atgaaatgtgaa

SEQ ID NO: 656778 - DNA, 23 bp, Homo sapiens
atgaaatgtgaatttttattgtt

SEQ ID NO: 656779 - DNA, 14 bp, Homo sapiens
atgaacactcccca

SEQ ID NO: 656780 - DNA, 21 bp, Homo sapiens
atgaaccctccttttctctga

SEQ ID NO: 656781 - DNA, 20 bp, Homo sapiens
atgaagtgcgtgaatgtatg

SEQ ID NO: 656782 - DNA, 12 bp, Homo sapiens
atgaatactttg

SEQ ID NO: 656783 - DNA, 20 bp, Homo sapiens
atgaattcaagaaaggaaat

SEQ ID NO: 656784 - DNA, 16 bp, Homo sapiens
atgaattgaaaaacaa

SEQ ID NO: 656785 - DNA, 22 bp, Homo sapiens
atgaattgaaaaacaattttct

SEQ ID NO: 656786 - DNA, 12 bp, Homo sapiens
atgaattggaac

SEQ ID NO: 656787 - DNA, 16 bp, Homo sapiens
atgaattggaactgca

SEQ ID NO: 656788 - DNA, 21 bp, Homo sapiens
atgaattggaactgcaatgaa

SEQ ID NO: 656789 - DNA, 15 bp, Homo sapiens
atgacaattgtgaac

SEQ ID NO: 656790 - DNA, 13 bp, Homo sapiens
atgacagatttct

SEQ ID NO: 656791 - DNA, 14 bp, Homo sapiens
atgacagatttctg

SEQ ID NO: 656792 - DNA, 15 bp, Homo sapiens
atgacaggcctgtcc

SEQ ID NO: 656793 - DNA, 21 bp, Homo sapiens
atgacattaaatgcaataatt

SEQ ID NO: 656794 - DNA, 17 bp, Homo sapiens
atggtatatatacatat

SEQ ID NO: 656795 - DNA, 19 bp, Homo sapiens
atggtatatatacatatat

SEQ ID NO: 656796 - DNA, 16 bp, Homo sapiens
atggtcttgagccagt

SEQ ID NO: 656797 - DNA, 21 bp, Homo sapiens
atggtgaaacctggtctctac

SEQ ID NO: 656798 - DNA, 16 bp, Homo sapiens
atggtggccacagact

SEQ ID NO: 656799 - DNA, 14 bp, Homo sapiens
atggtggccctgaa

SEQ ID NO: 656800 - DNA, 15 bp, Homo sapiens
atggtgtgttctgca

SEQ ID NO: 656801 - DNA, 14 bp, Homo sapiens
atggtgttacatat

SEQ ID NO: 656802 - DNA, 17 bp, Homo sapiens
atggttgttgcatatag

SEQ ID NO: 656803 - DNA, 15 bp, Homo sapiens
atggtttgatatgta

SEQ ID NO: 656804 - DNA, 13 bp, Homo sapiens
atggttttaagaa

SEQ ID NO: 656805 - DNA, 21 bp, Homo sapiens
atggttttcattcattggtga

SEQ ID NO: 656806 - DNA, 22 bp, Homo sapiens
atgtaaaagaacttactgatta

SEQ ID NO: 656807 - DNA, 15 bp, Homo sapiens
atgtaaaatgaattg

SEQ ID NO: 656808 - DNA, 16 bp, Homo sapiens
atgtaaaatgaattga

SEQ ID NO: 656809 - DNA, 19 bp, Homo sapiens
atgtaaaggggcagcagtg

SEQ ID NO: 656810 - DNA, 14 bp, Homo sapiens
atgtaaataaacta

SEQ ID NO: 656811 - DNA, 22 bp, Homo sapiens
atgtaagaacacattttaaata

SEQ ID NO: 656812 - DNA, 19 bp, Homo sapiens
atgtaagaattcagaagac

SEQ ID NO: 656813 - DNA, 11 bp, Homo sapiens
atgtaagggtc

SEQ ID NO: 656814 - DNA, 15 bp, Homo sapiens
atgtaagtgggccca

SEQ ID NO: 656815 - DNA, 15 bp, Homo sapiens
atgtaatataatgta

SEQ ID NO: 656816 - DNA, 19 bp, Homo sapiens
atgtaatataatgtatttt

SEQ ID NO: 656817 - DNA, 21 bp, Homo sapiens
atgtaatgtgtggtggcctca

SEQ ID NO: 656818 - DNA, 17 bp, Homo sapiens
atgtaattatgttctaa

SEQ ID NO: 656819 - DNA, 20 bp, Homo sapiens
atgtaatttaaatgaaagaa

SEQ ID NO: 656820 - DNA, 16 bp, Homo sapiens
atgtacagattctttc

SEQ ID NO: 656821 - DNA, 20 bp, Homo sapiens
atgtacgtccagcctgcccc

SEQ ID NO: 656822 - DNA, 18 bp, Homo sapiens
atgtactacagctatatt

SEQ ID NO: 656823 - DNA, 21 bp, Homo sapiens
atgtactacagctatatttga

SEQ ID NO: 656824 - DNA, 19 bp, Homo sapiens
atgtagccagcagaactga

SEQ ID NO: 656825 - DNA, 21 bp, Homo sapiens
atgtagcgctttgaatatgaa

SEQ ID NO: 656826 - DNA, 19 bp, Homo sapiens
atgtagcgtgtaagcttgt

SEQ ID NO: 656827 - DNA, 17 bp, Homo sapiens
atgtaggcattctggag

SEQ ID NO: 656828 - DNA, 18 bp, Homo sapiens
atgtaggtaagactgtag

SEQ ID NO: 656829 - DNA, 14 bp, Homo sapiens
atgtataaccaagt

SEQ ID NO: 656830 - DNA, 20 bp, Homo sapiens
atgtatatttttttaattta

SEQ ID NO: 656831 - DNA, 17 bp, Homo sapiens
atgtatcagtgtccttt

SEQ ID NO: 656832 - DNA, 20 bp, Homo sapiens
atgtatcagtgtcctttcca

SEQ ID NO: 656833 - DNA, 21 bp, Homo sapiens
atgtatcagtgtcctttccag

SEQ ID NO: 656834 - DNA, 22 bp, Homo sapiens
atgtatccaaggaaacatttta

SEQ ID NO: 656835 - DNA, 22 bp, Homo sapiens
atgtatggatatatttgaaata

SEQ ID NO: 656836 - DNA, 14 bp, Homo sapiens
atgtatttaaagtt

SEQ ID NO: 656837 - DNA, 20 bp, Homo sapiens
atgtatttgttatatataat

SEQ ID NO: 656838 - DNA, 12 bp, Homo sapiens
atgtattttaca

SEQ ID NO: 656839 - DNA, 22 bp, Homo sapiens
atgtcaaggaagacttttggta

SEQ ID NO: 656840 - DNA, 22 bp, Homo sapiens
atgtcaaggcagttgcttgtgt

SEQ ID NO: 656841 - DNA, 23 bp, Homo sapiens
atgtcaatgaccattcaattagt

SEQ ID NO: 656842 - DNA, 19 bp, Homo sapiens
atgtcaccggtcagtgcct

SEQ ID NO: 656843 - DNA, 13 bp, Homo sapiens
atgtcattgtcta

SEQ ID NO: 656844 - DNA, 16 bp, Homo sapiens
tctactgccttgaaaa

SEQ ID NO: 656845 - DNA, 14 bp, Homo sapiens
tctacttacagttg

SEQ ID NO: 656846 - DNA, 12 bp, Homo sapiens
tctagagctttt

SEQ ID NO: 656847 - DNA, 15 bp, Homo sapiens
tctagcatgctactt

SEQ ID NO: 656848 - DNA, 22 bp, Homo sapiens
tctaggatgggaacaaggaagg

SEQ ID NO: 656849 - DNA, 14 bp, Homo sapiens
tctaggtcctggct

SEQ ID NO: 656850 - DNA, 16 bp, Homo sapiens
tctataagtagtaaat

SEQ ID NO: 656851 - DNA, 14 bp, Homo sapiens
tctatatatataat

SEQ ID NO: 656852 - DNA, 16 bp, Homo sapiens
tctatcagattaagtt

SEQ ID NO: 656853 - DNA, 17 bp, Homo sapiens
tctatcttccaaatgca

SEQ ID NO: 656854 - DNA, 23 bp, Homo sapiens
tctatctttcattaaaaagaata

SEQ ID NO: 656855 - DNA, 13 bp, Homo sapiens
tctatgcaggcag

SEQ ID NO: 656856 - DNA, 17 bp, Homo sapiens
tctatggcttatttcta

SEQ ID NO: 656857 - DNA, 20 bp, Homo sapiens
tctatggcttatttctatga

SEQ ID NO: 656858 - DNA, 16 bp, Homo sapiens
tctattatttttataa

SEQ ID NO: 656859 - DNA, 17 bp, Homo sapiens
tctcaaagaaatattaa

SEQ ID NO: 656860 - DNA, 16 bp, Homo sapiens
tctcaaagtaaggctg

SEQ ID NO: 656861 - DNA, 15 bp, Homo sapiens
tctcaagctagtgtt

SEQ ID NO: 656862 - DNA, 21 bp, Homo sapiens
tctcaaggagaggcaaagaaa

SEQ ID NO: 656863 - DNA, 20 bp, Homo sapiens
tctcaaggtgggccttgcta

SEQ ID NO: 656864 - DNA, 21 bp, Homo sapiens
tctcaatgaaccataaattca

SEQ ID NO: 656865 - DNA, 23 bp, Homo sapiens
tctcactaaagcatgaaatgtga

SEQ ID NO: 656866 - DNA, 20 bp, Homo sapiens
tctcagggctggagcctggg

SEQ ID NO: 656867 - DNA, 14 bp, Homo sapiens
tctcagtgttggta

SEQ ID NO: 656868 - DNA, 15 bp, Homo sapiens
tctcagtgttttgga

SEQ ID NO: 656869 - DNA, 19 bp, Homo sapiens
tctcagtgttttggactcc

SEQ ID NO: 656870 - DNA, 14 bp, Homo sapiens
tctcatgtcaatga

SEQ ID NO: 656871 - DNA, 14 bp, Homo sapiens
tctcattccgttgt

SEQ ID NO: 656872 - DNA, 13 bp, Homo sapiens
tctccacttgtat

SEQ ID NO: 656873 - DNA, 21 bp, Homo sapiens
tctccagcgtcagctgctccc

SEQ ID NO: 656874 - DNA, 17 bp, Homo sapiens
tctccaggaagcccagg

SEQ ID NO: 656875 - DNA, 19 bp, Homo sapiens
tctccaggaagcccagggc

SEQ ID NO: 656876 - DNA, 24 bp, Homo sapiens
tctccataggagggaaggagcagt

SEQ ID NO: 656877 - DNA, 13 bp, Homo sapiens
tctccatgtgtac

SEQ ID NO: 656878 - DNA, 14 bp, Homo sapiens
tctcccaagaaacc

SEQ ID NO: 656879 - DNA, 19 bp, Homo sapiens
tctcccaagaaacctgact

SEQ ID NO: 656880 - DNA, 21 bp, Homo sapiens
tctcccaagctgattttattc

SEQ ID NO: 656881 - DNA, 16 bp, Homo sapiens
tctccctagctcctcc

SEQ ID NO: 656882 - DNA, 12 bp, Homo sapiens
tctccctgcctg

SEQ ID NO: 656883 - DNA, 14 bp, Homo sapiens
tctccctgcctggc

SEQ ID NO: 656884 - DNA, 15 bp, Homo sapiens
tctccctggctccct

SEQ ID NO: 656885 - DNA, 14 bp, Homo sapiens
tctccgttccatct

SEQ ID NO: 656886 - DNA, 15 bp, Homo sapiens
tctccgttccatctg

SEQ ID NO: 656887 - DNA, 23 bp, Homo sapiens
tctcctccctctgtccctctcct

SEQ ID NO: 656888 - DNA, 14 bp, Homo sapiens
tctcctgccctgtg

SEQ ID NO: 656889 - DNA, 17 bp, Homo sapiens
tctcctgctgatttcac

SEQ ID NO: 656890 - DNA, 12 bp, Homo sapiens
tctcctggcccc

SEQ ID NO: 656891 - DNA, 13 bp, Homo sapiens
tctcctggcccct

SEQ ID NO: 656892 - DNA, 16 bp, Homo sapiens
tctcctggcccctgcc

SEQ ID NO: 656893 - DNA, 17 bp, Homo sapiens
tctcctggcccctgcct

SEQ ID NO: 656894 - DNA, 21 bp, Homo sapiens
tctcctggcccctgcctgctg

SEQ ID NO: 656895 - DNA, 19 bp, Homo sapiens
tctcctggcctatccgctg

SEQ ID NO: 656896 - DNA, 21 bp, Homo sapiens
tctcctggcctatccgctgcc

SEQ ID NO: 656897 - DNA, 23 bp, Homo sapiens
tctcctggcctatccgctgccag

SEQ ID NO: 656898 - DNA, 12 bp, Homo sapiens
tctccttaagct

SEQ ID NO: 656899 - DNA, 21 bp, Homo sapiens
tctcgcctcattactgtgagg

SEQ ID NO: 656900 - DNA, 18 bp, Homo sapiens
tctctcttgtcctcttct

SEQ ID NO: 656901 - DNA, 19 bp, Homo sapiens
tctctgagaccacagaggc

SEQ ID NO: 656902 - DNA, 17 bp, Homo sapiens
tctctggcagctggcct

SEQ ID NO: 656903 - DNA, 14 bp, Homo sapiens
tctctgtcccttgc

SEQ ID NO: 656904 - DNA, 16 bp, Homo sapiens
tctctgtcccttgctg

SEQ ID NO: 656905 - DNA, 17 bp, Homo sapiens
tctctgtcccttgctgt

SEQ ID NO: 656906 - DNA, 18 bp, Homo sapiens
tctctgtcccttgctgta

SEQ ID NO: 656907 - DNA, 15 bp, Homo sapiens
tctctgtgagaaggt

SEQ ID NO: 656908 - DNA, 16 bp, Homo sapiens
tctcttcatgcttgac

SEQ ID NO: 656909 - DNA, 19 bp, Homo sapiens
tctcttcatgcttgacata

SEQ ID NO: 656910 - DNA, 18 bp, Homo sapiens
tctcttccccttagaaac

SEQ ID NO: 656911 - DNA, 18 bp, Homo sapiens
tctcttccccttccctta

SEQ ID NO: 656912 - DNA, 20 bp, Homo sapiens
tctcttgtcctcttctgctc

SEQ ID NO: 656913 - DNA, 14 bp, Homo sapiens
tctctttaaactat

SEQ ID NO: 656914 - DNA, 13 bp, Homo sapiens
tctcttttctttc

SEQ ID NO: 656915 - DNA, 15 bp, Homo sapiens
tctgaaaagtgtgta

SEQ ID NO: 656916 - DNA, 23 bp, Homo sapiens
tctgaaaagtgtgtatatatttt

SEQ ID NO: 656917 - DNA, 15 bp, Homo sapiens
tctgaaactggcttc

SEQ ID NO: 656918 - DNA, 22 bp, Homo sapiens
tctgaaatcttcccatgcattc

SEQ ID NO: 656919 - DNA, 18 bp, Homo sapiens
tctgaaggtccaaagagt

SEQ ID NO: 656920 - DNA, 22 bp, Homo sapiens
tctgacaaaatggggcagaaga

SEQ ID NO: 656921 - DNA, 19 bp, Homo sapiens
tctgacaactgtgaagcca

SEQ ID NO: 656922 - DNA, 21 bp, Homo sapiens
tctgacaactgtgaagccacc

SEQ ID NO: 656923 - DNA, 17 bp, Homo sapiens
tctgacagtttttctgt

SEQ ID NO: 656924 - DNA, 14 bp, Homo sapiens
tctgactactttgc

SEQ ID NO: 656925 - DNA, 15 bp, Homo sapiens
tctgagagctgtttt

SEQ ID NO: 656926 - DNA, 15 bp, Homo sapiens
tctgagcctgatatt

SEQ ID NO: 656927 - DNA, 23 bp, Homo sapiens
tctgaggatagtagttaaataac

SEQ ID NO: 656928 - DNA, 13 bp, Homo sapiens
tctgaggcctgcc

SEQ ID NO: 656929 - DNA, 18 bp, Homo sapiens
tctgaggtgacttaaaaa

SEQ ID NO: 656930 - DNA, 22 bp, Homo sapiens
tctgataagcttcctagaaagt

SEQ ID NO: 656931 - DNA, 21 bp, Homo sapiens
tctgattttgtgcaaaagctt

SEQ ID NO: 656932 - DNA, 14 bp, Homo sapiens
tctgcaacaagcat

SEQ ID NO: 656933 - DNA, 17 bp, Homo sapiens
tctgcaacaagcatgca

SEQ ID NO: 656934 - DNA, 18 bp, Homo sapiens
tctgccctcattactggg

SEQ ID NO: 656935 - DNA, 12 bp, Homo sapiens
tctgccctggat

SEQ ID NO: 656936 - DNA, 23 bp, Homo sapiens
tctgccctggattggttggcaaa

SEQ ID NO: 656937 - DNA, 22 bp, Homo sapiens
tctgcctctccctgggtctggg

SEQ ID NO: 656938 - DNA, 15 bp, Homo sapiens
tctgccttcacaaat

SEQ ID NO: 656939 - DNA, 19 bp, Homo sapiens
tctgccttcacaaatgtca

SEQ ID NO: 656940 - DNA, 14 bp, Homo sapiens
tctgcgatgcagcg

SEQ ID NO: 656941 - DNA, 20 bp, Homo sapiens
tctgctaaccatttatataa

SEQ ID NO: 656942 - DNA, 16 bp, Homo sapiens
tctgctccataccttt

SEQ ID NO: 656943 - DNA, 20 bp, Homo sapiens
tctgctccataccttttctc

SEQ ID NO: 656944 - DNA, 17 bp, Homo sapiens
tctgctgagttggcctg

SEQ ID NO: 656945 - DNA, 18 bp, Homo sapiens
tctgctgagttggcctgg

SEQ ID NO: 656946 - DNA, 14 bp, Homo sapiens
tctgctttaattac

SEQ ID NO: 656947 - DNA, 20 bp, Homo sapiens
tctggaaagttttctccact

SEQ ID NO: 656948 - DNA, 22 bp, Homo sapiens
tctggactgctattctagagct

SEQ ID NO: 656949 - DNA, 18 bp, Homo sapiens
tctggatttggtgctgga

SEQ ID NO: 656950 - DNA, 14 bp, Homo sapiens
tgaaaagtgtgtat

SEQ ID NO: 656951 - DNA, 14 bp, Homo sapiens
tgaaaatcttggag

SEQ ID NO: 656952 - DNA, 21 bp, Homo sapiens
tgaaaattacagtccaaaata

SEQ ID NO: 656953 - DNA, 14 bp, Homo sapiens
tgaaacagatttca

SEQ ID NO: 656954 - DNA, 22 bp, Homo sapiens
tgaaacagttgctgtgaacttt

SEQ ID NO: 656955 - DNA, 15 bp, Homo sapiens
tgaaacattttttct

SEQ ID NO: 656956 - DNA, 16 bp, Homo sapiens
tgaaacgtctggactg

SEQ ID NO: 656957 - DNA, 14 bp, Homo sapiens
tgaaacttaagaat

SEQ ID NO: 656958 - DNA, 19 bp, Homo sapiens
tgaaactttgggaaaacat

SEQ ID NO: 656959 - DNA, 22 bp, Homo sapiens
tgaaagagccagactctgtctc

SEQ ID NO: 656960 - DNA, 18 bp, Homo sapiens
tgaaagcttcaaagttta

SEQ ID NO: 656961 - DNA, 22 bp, Homo sapiens
tgaaaggaagagctaataaatc

SEQ ID NO: 656962 - DNA, 14 bp, Homo sapiens
tgaaataatatatt

SEQ ID NO: 656963 - DNA, 14 bp, Homo sapiens
tgaaatcttcccag

SEQ ID NO: 656964 - DNA, 18 bp, Homo sapiens
tgaaatcttcccatgcat

SEQ ID NO: 656965 - DNA, 19 bp, Homo sapiens
tgaaatcttcccatgcatt

SEQ ID NO: 656966 - DNA, 13 bp, Homo sapiens
tgaaatgaaaaca

SEQ ID NO: 656967 - DNA, 19 bp, Homo sapiens
tgaaatgaaaacatgtaat

SEQ ID NO: 656968 - DNA, 17 bp, Homo sapiens
tgaaatgctgttagtaa

SEQ ID NO: 656969 - DNA, 21 bp, Homo sapiens
tgaaatgtgaatttttattgt

SEQ ID NO: 656970 - DNA, 20 bp, Homo sapiens
tgaaatgtttaataaagctt

SEQ ID NO: 656971 - DNA, 17 bp, Homo sapiens
tattaatgttttcaaaa

SEQ ID NO: 656972 - DNA, 13 bp, Homo sapiens
tattacagtctta

SEQ ID NO: 656973 - DNA, 16 bp, Homo sapiens
tattactgaataatat

SEQ ID NO: 656974 - DNA, 23 bp, Homo sapiens
tattactgaataatatcaaataa

SEQ ID NO: 656975 - DNA, 22 bp, Homo sapiens
tcattgttatttatacaagatt

SEQ ID NO: 656976 - DNA, 16 bp, Homo sapiens
tcatttaaaaagctca

SEQ ID NO: 656977 - DNA, 13 bp, Homo sapiens
tcatttaaatatc

SEQ ID NO: 656978 - DNA, 17 bp, Homo sapiens
tcatttctaaatttata

SEQ ID NO: 656979 - DNA, 18 bp, Homo sapiens
gtcagcttttgttgttta

SEQ ID NO: 656980 - DNA, 19 bp, Homo sapiens
gtcagcttttgttgtttat

SEQ ID NO: 656981 - DNA, 21 bp, Homo sapiens
gtcaggagatcgagaccatcc

SEQ ID NO: 656982 - DNA, 13 bp, Homo sapiens
gtcagggagtgct

SEQ ID NO: 656983 - DNA, 14 bp, Homo sapiens
gtcagggagtgctg

SEQ ID NO: 656984 - DNA, 14 bp, Homo sapiens
gtcagtatccaggc

SEQ ID NO: 656985 - DNA, 16 bp, Homo sapiens
gtcagtatccaggctt

SEQ ID NO: 656986 - DNA, 14 bp, Homo sapiens
gtcatcatcagggc

SEQ ID NO: 656987 - DNA, 16 bp, Homo sapiens
gtcatcatcagggcct

SEQ ID NO: 656988 - DNA, 17 bp, Homo sapiens
gtcatcatcagggcctg

SEQ ID NO: 656989 - DNA, 23 bp, Homo sapiens
gtcatcatcagggcctggggcct

SEQ ID NO: 656990 - DNA, 16 bp, Homo sapiens
gtcatgttgaaggtgc

SEQ ID NO: 656991 - DNA, 16 bp, Homo sapiens
gtccaaagaggctgcc

SEQ ID NO: 656992 - DNA, 19 bp, Homo sapiens
gtccaaagaggctgcccct

SEQ ID NO: 656993 - DNA, 22 bp, Homo sapiens
gtccagcctgccccggagctgg

SEQ ID NO: 656994 - DNA, 12 bp, Homo sapiens
gtccagctcagc

SEQ ID NO: 656995 - DNA, 16 bp, Homo sapiens
gtccagctcagccctg

SEQ ID NO: 656996 - DNA, 21 bp, Homo sapiens
gtccagctgcccttccgcagt

SEQ ID NO: 656997 - DNA, 22 bp, Homo sapiens
gtccagctgcccttccgcagtg

SEQ ID NO: 656998 - DNA, 16 bp, Homo sapiens
gtccaggagagcctgg

SEQ ID NO: 656999 - DNA, 22 bp, Homo sapiens
gtcccaaggagggggcctcatt

SEQ ID NO: 657000 - DNA, 13 bp, Homo sapiens
gtccccatctagg

SEQ ID NO: 657001 - DNA, 22 bp, Homo sapiens
gtccccatctaggtcctggctg

SEQ ID NO: 657002 - DNA, 14 bp, Homo sapiens
gtccccgctgctgt

SEQ ID NO: 657003 - DNA, 16 bp, Homo sapiens
gtccccgctgctgtgc

SEQ ID NO: 657004 - DNA, 20 bp, Homo sapiens
gtcccgtctggacctgggga

SEQ ID NO: 657005 - DNA, 15 bp, Homo sapiens
gtccctagcagccca

SEQ ID NO: 657006 - DNA, 20 bp, Homo sapiens
gtccctagcagcccaccctg

SEQ ID NO: 657007 - DNA, 18 bp, Homo sapiens
gtccctgggccagggtct

SEQ ID NO: 657008 - DNA, 16 bp, Homo sapiens
gtcccttccaggagga

SEQ ID NO: 657009 - DNA, 13 bp, Homo sapiens
gtcccttgcctct

SEQ ID NO: 657010 - DNA, 14 bp, Homo sapiens
gtcccttgcctctg

SEQ ID NO: 657011 - DNA, 18 bp, Homo sapiens
gtcccttgcctctgccct

SEQ ID NO: 657012 - DNA, 21 bp, Homo sapiens
gtcccttgcctctgccctgga

SEQ ID NO: 657013 - DNA, 20 bp, Homo sapiens
gtcccttgcttgcctgcagg

SEQ ID NO: 657014 - DNA, 22 bp, Homo sapiens
gtcccttgcttgcctgcagggc

SEQ ID NO: 657015 - DNA, 15 bp, Homo sapiens
gtcctaaggaacctt

SEQ ID NO: 657016 - DNA, 18 bp, Homo sapiens
gtcctaaggaaccttcct

SEQ ID NO: 657017 - DNA, 19 bp, Homo sapiens
gtcctaattcttctgtcct

SEQ ID NO: 657018 - DNA, 21 bp, Homo sapiens
tagaagtttggctgctgtcat

SEQ ID NO: 657019 - DNA, 12 bp, Homo sapiens
tagaataattct

SEQ ID NO: 657020 - DNA, 20 bp, Homo sapiens
tagaataattcttttctgag

SEQ ID NO: 657021 - DNA, 20 bp, Homo sapiens
tagaatctcttcatgcttga

SEQ ID NO: 657022 - DNA, 18 bp, Homo sapiens
tagacagaaacatgtctt

SEQ ID NO: 657023 - DNA, 13 bp, Homo sapiens
tagactgtgccag

SEQ ID NO: 657024 - DNA, 17 bp, Homo sapiens
tagactgtgccagaggc

SEQ ID NO: 657025 - DNA, 21 bp, Homo sapiens
tagagaggacaatactggggt

SEQ ID NO: 657026 - DNA, 17 bp, Homo sapiens
tagagataggaaactga

SEQ ID NO: 657027 - DNA, 23 bp, Homo sapiens
tagagatgctgtaacttaaaata

SEQ ID NO: 657028 - DNA, 22 bp, Homo sapiens
tagagggacggccaagaatgta

SEQ ID NO: 657029 - DNA, 22 bp, Homo sapiens
tagagtcttacaatcaaatctc

SEQ ID NO: 657030 - DNA, 17 bp, Homo sapiens
tagagtgtagactgtgg

SEQ ID NO: 657031 - DNA, 23 bp, Homo sapiens
taaaattgctatgttactatttt

SEQ ID NO: 657032 - DNA, 15 bp, Homo sapiens
taaaattttggatta

SEQ ID NO: 657033 - DNA, 16 bp, Homo sapiens
taaacagacaaaaaca

SEQ ID NO: 657034 - DNA, 13 bp, Homo sapiens
taaacagacaata

SEQ ID NO: 657035 - DNA, 19 bp, Homo sapiens
taaacagagtccgggagaa

SEQ ID NO: 657036 - DNA, 14 bp, Homo sapiens
taaacagttatttc

SEQ ID NO: 657037 - DNA, 17 bp, Homo sapiens
taaacagttatttctgt

SEQ ID NO: 657038 - DNA, 22 bp, Homo sapiens
taaaccacttaaacgaagagtt

SEQ ID NO: 657039 - DNA, 22 bp, Homo sapiens
taaacggtttttattaaagatg

SEQ ID NO: 657040 - DNA, 21 bp, Homo sapiens
taaactgagagtaattcatct

SEQ ID NO: 657041 - DNA, 12 bp, Homo sapiens
taaactgcaagt

SEQ ID NO: 657042 - DNA, 21 bp, Homo sapiens
taaactgcaagttcattttaa

SEQ ID NO: 657043 - DNA, 22 bp, Homo sapiens
taaactgcaagttcattttaaa

SEQ ID NO: 657044 - DNA, 13 bp, Homo sapiens
taaactgttgctc

SEQ ID NO: 657045 - DNA, 17 bp, Homo sapiens
taaacttgtacatggaa

SEQ ID NO: 657046 - DNA, 20 bp, Homo sapiens
taaagaagagtgacttattt

SEQ ID NO: 657047 - DNA, 20 bp, Homo sapiens
taaagaccaataaacttcct

SEQ ID NO: 657048 - DNA, 17 bp, Homo sapiens
taaagaggctgaaagag

SEQ ID NO: 657049 - DNA, 19 bp, Homo sapiens
taaagcatgaaatgtgaat

SEQ ID NO: 657050 - DNA, 20 bp, Homo sapiens
taaagcatgaaatgtgaatt

SEQ ID NO: 657051 - DNA, 16 bp, Homo sapiens
taaagcttaggtcaaa

SEQ ID NO: 657052 - DNA, 10 bp, Homo sapiens
taaaggcagc

SEQ ID NO: 657053 - DNA, 12 bp, Homo sapiens
taaaggcagctg

SEQ ID NO: 657054 - DNA, 18 bp, Homo sapiens
taaaggcagctgcctctg

SEQ ID NO: 657055 - DNA, 22 bp, Homo sapiens
taaaggcagctgcctctgctcc

SEQ ID NO: 657056 - DNA, 16 bp, Homo sapiens
taagtgtaaaaaatgt

SEQ ID NO: 657057 - DNA, 17 bp, Homo sapiens
taagttagttccactga

SEQ ID NO: 657058 - DNA, 13 bp, Homo sapiens
taagtttgaagag

SEQ ID NO: 657059 - DNA, 19 bp, Homo sapiens
taataaaaagctttttcct

SEQ ID NO: 657060 - DNA, 23 bp, Homo sapiens
taataaaaagctttttcctcctg

SEQ ID NO: 657061 - DNA, 13 bp, Homo sapiens
taataaactgcaa

SEQ ID NO: 657062 - DNA, 16 bp, Homo sapiens
taataaagctttataa

SEQ ID NO: 657063 - DNA, 20 bp, Homo sapiens
taataaagctttataaactt

SEQ ID NO: 657064 - DNA, 13 bp, Homo sapiens
taataaaggctga

SEQ ID NO: 657065 - DNA, 14 bp, Homo sapiens
taataaatgccctc

SEQ ID NO: 657066 - DNA, 18 bp, Homo sapiens
taataaatgccctcttct

SEQ ID NO: 657067 - DNA, 16 bp, Homo sapiens
taataagcactgtaaa

SEQ ID NO: 657068 - DNA, 19 bp, Homo sapiens
taatacaaggtataataaa

SEQ ID NO: 657069 - DNA, 20 bp, Homo sapiens
taatacaaggtataataaaa

SEQ ID NO: 657070 - DNA, 21 bp, Homo sapiens
taatagtgcttaaaaatcatt

SEQ ID NO: 657071 - DNA, 20 bp, Homo sapiens
taatagtttgtctattttaa

SEQ ID NO: 657072 - DNA, 12 bp, Homo sapiens
taatataaaaaa

SEQ ID NO: 657073 - DNA, 15 bp, Homo sapiens
taatataaaaaattt

SEQ ID NO: 657074 - DNA, 16 bp, Homo sapiens
taatataatgtatttt

SEQ ID NO: 657075 - DNA, 17 bp, Homo sapiens
taatatcaaaagaaaat

SEQ ID NO: 657076 - DNA, 14 bp, Homo sapiens
taatatcaaataaa

SEQ ID NO: 657077 - DNA, 20 bp, Homo sapiens
taatatggcttcaccaagaa

SEQ ID NO: 657078 - DNA, 19 bp, Homo sapiens
taatcaagatttttttcct

SEQ ID NO: 657079 - DNA, 13 bp, Homo sapiens
taatcacttttca

SEQ ID NO: 657080 - DNA, 23 bp, Homo sapiens
taatccagttataagaagaagtt

SEQ ID NO: 657081 - DNA, 22 bp, Homo sapiens
taatccattccttgaggacaga

SEQ ID NO: 657082 - DNA, 21 bp, Homo sapiens
taatcccagcactttgggagg

SEQ ID NO: 657083 - DNA, 20 bp, Homo sapiens
taatccttttccttatttgc

SEQ ID NO: 657084 - DNA, 10 bp, Homo sapiens
taatctacac

SEQ ID NO: 657085 - DNA, 19 bp, Homo sapiens
taatctacaccaatgaaaa

SEQ ID NO: 657086 - DNA, 20 bp, Homo sapiens
taatctacaccaatgaaaac

SEQ ID NO: 657087 - DNA, 23 bp, Homo sapiens
taatctctctgccgaaagtcaaa

SEQ ID NO: 657088 - DNA, 16 bp, Homo sapiens
taatcttcaaagcctt

SEQ ID NO: 657089 - DNA, 15 bp, Homo sapiens
taatcttcaggtgaa

SEQ ID NO: 657090 - DNA, 19 bp, Homo sapiens
taatcttcaggtgaacact

SEQ ID NO: 657091 - DNA, 14 bp, Homo sapiens
taatcttttattta

SEQ ID NO: 657092 - DNA, 17 bp, Homo sapiens
taatgaagaacactgta

SEQ ID NO: 657093 - DNA, 15 bp, Homo sapiens
taatgacaggcctgt

SEQ ID NO: 657094 - DNA, 20 bp, Homo sapiens
taatgacaggcctgtccaac

SEQ ID NO: 657095 - DNA, 17 bp, Homo sapiens
taatgataaaataaata

SEQ ID NO: 657096 - DNA, 21 bp, Homo sapiens
taatgcattttgcactagaac

SEQ ID NO: 657097 - DNA, 14 bp, Homo sapiens
taatgctacaattt

SEQ ID NO: 657098 - DNA, 14 bp, Homo sapiens
taatgctgtttcta

SEQ ID NO: 657099 - DNA, 19 bp, Homo sapiens
taatgctgtttctaagaaa

SEQ ID NO: 657100 - DNA, 20 bp, Homo sapiens
taatgctgtttctaagaaaa

SEQ ID NO: 657101 - DNA, 19 bp, Homo sapiens
taatggaagtgtatttatt

SEQ ID NO: 657102 - DNA, 15 bp, Homo sapiens
taatggcagagcagt

SEQ ID NO: 657103 - DNA, 18 bp, Homo sapiens
taatgttatatcatatgt

SEQ ID NO: 657104 - DNA, 16 bp, Homo sapiens
taatgtttatgagcca

SEQ ID NO: 657105 - DNA, 17 bp, Homo sapiens
taatgtttatgagccag

SEQ ID NO: 657106 - DNA, 18 bp, Homo sapiens
taatgtttatgagccaga

SEQ ID NO: 657107 - DNA, 22 bp, Homo sapiens
taatgtttatgagccagacaaa

SEQ ID NO: 657108 - DNA, 14 bp, Homo sapiens
taatgtttgaacaa

SEQ ID NO: 657109 - DNA, 14 bp, Homo sapiens
taatgttttcaaaa

SEQ ID NO: 657110 - DNA, 17 bp, Homo sapiens
taattaaagactcaaga

SEQ ID NO: 657111 - DNA, 14 bp, Homo sapiens
taattaattaagta

SEQ ID NO: 657112 - DNA, 21 bp, Homo sapiens
taattactggaattcttctgc

SEQ ID NO: 657113 - DNA, 12 bp, Homo sapiens
taattataagct

SEQ ID NO: 657114 - DNA, 22 bp, Homo sapiens
taattgaagtgtataatataaa

SEQ ID NO: 657115 - DNA, 17 bp, Homo sapiens
taattgactgaaattac

SEQ ID NO: 657116 - DNA, 19 bp, Homo sapiens
taattgcactttttaagtt

SEQ ID NO: 657117 - DNA, 18 bp, Homo sapiens
taattgcatctcaaaatt

SEQ ID NO: 657118 - DNA, 20 bp, Homo sapiens
taattgcctacatttatcat

SEQ ID NO: 657119 - DNA, 15 bp, Homo sapiens
taattgtacaaaatt

SEQ ID NO: 657120 - DNA, 23 bp, Homo sapiens
taattgtacaaaattaagcaaat

SEQ ID NO: 657121 - DNA, 16 bp, Homo sapiens
taatttagaaactgaa

SEQ ID NO: 657122 - DNA, 13 bp, Homo sapiens
taatttatttcaa

SEQ ID NO: 657123 - DNA, 14 bp, Homo sapiens
taatttcaaaatac

SEQ ID NO: 657124 - DNA, 19 bp, Homo sapiens
taatttcaaaatacatttg

SEQ ID NO: 657125 - DNA, 20 bp, Homo sapiens
taatttgatgcccaatatat

SEQ ID NO: 657126 - DNA, 21 bp, Homo sapiens
taatttgggaaaataaataca

SEQ ID NO: 657127 - DNA, 12 bp, Homo sapiens
taattttaaagt

SEQ ID NO: 657128 - DNA, 16 bp, Homo sapiens
taattttcaccgagca

SEQ ID NO: 657129 - DNA, 18 bp, Homo sapiens
taattttcagctgcaagg

SEQ ID NO: 657130 - DNA, 12 bp, Homo sapiens
taattttgtaat

SEQ ID NO: 657131 - DNA, 19 bp, Homo sapiens
taattttgtaatgtatcaa

SEQ ID NO: 657132 - DNA, 23 bp, Homo sapiens
tacaaactcatcctcttttaatg

SEQ ID NO: 657133 - DNA, 15 bp, Homo sapiens
tacaaatgaagaaag

SEQ ID NO: 657134 - DNA, 21 bp, Homo sapiens
tacaacaacaacaaaaaatac

SEQ ID NO: 657135 - DNA, 14 bp, Homo sapiens
tacaacatttatgt

SEQ ID NO: 657136 - DNA, 15 bp, Homo sapiens
tacaacatttatgtg

SEQ ID NO: 657137 - DNA, 17 bp, Homo sapiens
tacaactgtatttatta

SEQ ID NO: 657138 - DNA, 14 bp, Homo sapiens
tacaagaaaatgta

SEQ ID NO: 657139 - DNA, 15 bp, Homo sapiens
tacaagaaaatgtat

SEQ ID NO: 657140 - DNA, 17 bp, Homo sapiens
tacaaggtataataaaa

SEQ ID NO: 657141 - DNA, 18 bp, Homo sapiens
tacaaggtataataaaat

SEQ ID NO: 657142 - DNA, 14 bp, Homo sapiens
tacaagtaatgtaa

SEQ ID NO: 657143 - DNA, 14 bp, Homo sapiens
tacaatattgattg

SEQ ID NO: 657144 - DNA, 15 bp, Homo sapiens
tacaatattgattgg

SEQ ID NO: 657145 - DNA, 14 bp, Homo sapiens
tacaatggaataaa

SEQ ID NO: 657146 - DNA, 12 bp, Homo sapiens
tacaatgtgaat

SEQ ID NO: 657147 - DNA, 18 bp, Homo sapiens
tacacatatttgaagggt

SEQ ID NO: 657148 - DNA, 16 bp, Homo sapiens
tacacatgttgccttg

SEQ ID NO: 657149 - DNA, 15 bp, Homo sapiens
tacacattagatttt

SEQ ID NO: 657150 - DNA, 13 bp, Homo sapiens
tacacatttgcta

SEQ ID NO: 657151 - DNA, 14 bp, Homo sapiens
tacaccaatgaaaa

SEQ ID NO: 657152 - DNA, 21 bp, Homo sapiens
tacaccaatgaaaacatgtac

SEQ ID NO: 657153 - DNA, 12 bp, Homo sapiens
tacaccctttcc

SEQ ID NO: 657154 - DNA, 20 bp, Homo sapiens
tacaccttgccttgctgttt

SEQ ID NO: 657155 - DNA, 21 bp, Homo sapiens
tacacgaccatttgataggga

SEQ ID NO: 657156 - DNA, 23 bp, Homo sapiens
tacagactccatctcttctgcaa

SEQ ID NO: 657157 - DNA, 19 bp, Homo sapiens
tacagactggatgtaccac

SEQ ID NO: 657158 - DNA, 18 bp, Homo sapiens
ggggattgcagagtgacc

SEQ ID NO: 657159 - DNA, 18 bp, Homo sapiens
ggggattgcccctggctt

SEQ ID NO: 657160 - DNA, 16 bp, Homo sapiens
ggggcaggctgggcca

SEQ ID NO: 657161 - DNA, 13 bp, Homo sapiens
ggggcagggagct

SEQ ID NO: 657162 - DNA, 17 bp, Homo sapiens
ggggcagggagctgggc

SEQ ID NO: 657163 - DNA, 19 bp, Homo sapiens
ggggcattgagtattgttt

SEQ ID NO: 657164 - DNA, 19 bp, Homo sapiens
ggggcgtggagggaggccc

SEQ ID NO: 657165 - DNA, 11 bp, Homo sapiens
ggggctaaggc

SEQ ID NO: 657166 - DNA, 21 bp, Homo sapiens
gggggaatgagcccagagaac

SEQ ID NO: 657167 - DNA, 21 bp, Homo sapiens
gggggatgccactcctccctc

SEQ ID NO: 657168 - DNA, 22 bp, Homo sapiens
gggggatgccactcctccctcc

SEQ ID NO: 657169 - DNA, 19 bp, Homo sapiens
gggggccccacctcggcac

SEQ ID NO: 657170 - DNA, 12 bp, Homo sapiens
gggggctttctg

SEQ ID NO: 657171 - DNA, 18 bp, Homo sapiens
gggggtctcacccatgca

SEQ ID NO: 657172 - DNA, 13 bp, Homo sapiens
ggggtctccctgg

SEQ ID NO: 657173 - DNA, 12 bp, Homo sapiens
ggggtctttgtg

SEQ ID NO: 657174 - DNA, 17 bp, Homo sapiens
ggggtgcatctcctccc

SEQ ID NO: 657175 - DNA, 17 bp, Homo sapiens
ggggttggggtgacagt

SEQ ID NO: 657176 - DNA, 20 bp, Homo sapiens
gggtcatgtttgcaggggtg

SEQ ID NO: 657177 - DNA, 21 bp, Homo sapiens
gggtcatgtttgcaggggtga

SEQ ID NO: 657178 - DNA, 17 bp, Homo sapiens
gggtccctagcagccca

SEQ ID NO: 657179 - DNA, 21 bp, Homo sapiens
gggtcctgaggcctgcagcac

SEQ ID NO: 657180 - DNA, 17 bp, Homo sapiens
gggtctcccctcctgca

SEQ ID NO: 657181 - DNA, 13 bp, Homo sapiens
gggtctccctggc

SEQ ID NO: 657182 - DNA, 21 bp, Homo sapiens
gggtctccctggctccctcct

SEQ ID NO: 657183 - DNA, 22 bp, Homo sapiens
gggtctccctggctccctcctc

SEQ ID NO: 657184 - DNA, 18 bp, Homo sapiens
gggtctctccctcaggtg

SEQ ID NO: 657185 - DNA, 17 bp, Homo sapiens
gggtctgtgtgaatgtg

SEQ ID NO: 657186 - DNA, 24 bp, Homo sapiens
gggtctgtgtgaatgtgggcactg

SEQ ID NO: 657187 - DNA, 23 bp, Homo sapiens
gggtgaataataaaagtatatat

SEQ ID NO: 657188 - DNA, 13 bp, Homo sapiens
gggtgattcctaa

SEQ ID NO: 657189 - DNA, 12 bp, Homo sapiens
gggtgctcagaa

SEQ ID NO: 657190 - DNA, 17 bp, Homo sapiens
gggtggatcacgaggtc

SEQ ID NO: 657191 - DNA, 11 bp, Homo sapiens
gggtgggcctc

SEQ ID NO: 657192 - DNA, 21 bp, Homo sapiens
gggtgggggacgatcaggagg

SEQ ID NO: 657193 - DNA, 14 bp, Homo sapiens
gggtgggtgctcag

SEQ ID NO: 657194 - DNA, 22 bp, Homo sapiens
gggtggtcttgtggttgtgtgt

SEQ ID NO: 657195 - DNA, 16 bp, Homo sapiens
gggttgcgtctgaggc

SEQ ID NO: 657196 - DNA, 17 bp, Homo sapiens
ggtaagcaacatggctt

SEQ ID NO: 657197 - DNA, 12 bp, Homo sapiens
ggtaatctacac

SEQ ID NO: 657198 - DNA, 16 bp, Homo sapiens
ggtacaactgtattta

SEQ ID NO: 657199 - DNA, 12 bp, Homo sapiens
ggtacagtttgg

SEQ ID NO: 657200 - DNA, 18 bp, Homo sapiens
ggtacatggtgtttgtgg

SEQ ID NO: 657201 - DNA, 19 bp, Homo sapiens
ggtacctggtccccactgc

SEQ ID NO: 657202 - DNA, 21 bp, Homo sapiens
ggtagggatatggcaggactc

SEQ ID NO: 657203 - DNA, 19 bp, Homo sapiens
ggtatatactttgccactg

SEQ ID NO: 657204 - DNA, 18 bp, Homo sapiens
ggtcaataacactgtatt

SEQ ID NO: 657205 - DNA, 20 bp, Homo sapiens
ggtcaataacactgtatttt

SEQ ID NO: 657206 - DNA, 22 bp, Homo sapiens
gcttctccaggaagcccagggc

SEQ ID NO: 657207 - DNA, 17 bp, Homo sapiens
gcttctgttgatctcag

SEQ ID NO: 657208 - DNA, 19 bp, Homo sapiens
gcttcttcgttcctgcgca

SEQ ID NO: 657209 - DNA, 17 bp, Homo sapiens
gcttgacatacctacca

SEQ ID NO: 657210 - DNA, 18 bp, Homo sapiens
gcttgattttaatacatt

SEQ ID NO: 657211 - DNA, 16 bp, Homo sapiens
gcttgcaatgtagtca

SEQ ID NO: 657212 - DNA, 21 bp, Homo sapiens
gcttgccatctgttcatttct

SEQ ID NO: 657213 - DNA, 23 bp, Homo sapiens
gcttggactacacaatacagtat

SEQ ID NO: 657214 - DNA, 14 bp, Homo sapiens
gctttaagccttca

SEQ ID NO: 657215 - DNA, 18 bp, Homo sapiens
gctttaattacctggtga

SEQ ID NO: 657216 - DNA, 20 bp, Homo sapiens
gctttaattacctggtgagt

SEQ ID NO: 657217 - DNA, 13 bp, Homo sapiens
gctttactgcctt

SEQ ID NO: 657218 - DNA, 14 bp, Homo sapiens
gctttcctgtttct

SEQ ID NO: 657219 - DNA, 14 bp, Homo sapiens
gctttctggggcct

SEQ ID NO: 657220 - DNA, 15 bp, Homo sapiens
gctttcttacctact

SEQ ID NO: 657221 - DNA, 13 bp, Homo sapiens
gctttgcctcttc

SEQ ID NO: 657222 - DNA, 22 bp, Homo sapiens
gctttgcctcttctttgtgcct

SEQ ID NO: 657223 - DNA, 22 bp, Homo sapiens
gcttttaaaaacaaatgagttt

SEQ ID NO: 657224 - DNA, 20 bp, Homo sapiens
gcttttaataaactgcaagt

SEQ ID NO: 657225 - DNA, 15 bp, Homo sapiens
gcttttaattaaata

SEQ ID NO: 657226 - DNA, 16 bp, Homo sapiens
gcttttatttggtgtg

SEQ ID NO: 657227 - DNA, 17 bp, Homo sapiens
gcttttgtatagaaaat

SEQ ID NO: 657228 - DNA, 14 bp, Homo sapiens
gctttttcatcctt

SEQ ID NO: 657229 - DNA, 15 bp, Homo sapiens
ggaaaaatgtatcca

SEQ ID NO: 657230 - DNA, 13 bp, Homo sapiens
ggaaaacatttgc

SEQ ID NO: 657231 - DNA, 23 bp, Homo sapiens
ggaaacgctacctctctgtccct

SEQ ID NO: 657232 - DNA, 14 bp, Homo sapiens
ggaaactgaagcat

SEQ ID NO: 657233 - DNA, 22 bp, Homo sapiens
ggaaaggggttggggtgacagt

SEQ ID NO: 657234 - DNA, 15 bp, Homo sapiens
ggaaagttttctcca

SEQ ID NO: 657235 - DNA, 20 bp, Homo sapiens
ggaaagttttctccactgga

SEQ ID NO: 657236 - DNA, 22 bp, Homo sapiens
ggaaagttttctccactggaaa

SEQ ID NO: 657237 - DNA, 15 bp, Homo sapiens
ggaaatccctttctg

SEQ ID NO: 657238 - DNA, 23 bp, Homo sapiens
ggaaatgggaaaaaacttaaaaa

SEQ ID NO: 657239 - DNA, 20 bp, Homo sapiens
ggaaatgtattttgacactg

SEQ ID NO: 657240 - DNA, 17 bp, Homo sapiens
ggaacacatctggctgc

SEQ ID NO: 657241 - DNA, 21 bp, Homo sapiens
ggaacagcactggggagtctt

SEQ ID NO: 657242 - DNA, 23 bp, Homo sapiens
ggaacaggctcagatctcatggg

SEQ ID NO: 657243 - DNA, 19 bp, Homo sapiens
ggaacctagctacactgag

SEQ ID NO: 657244 - DNA, 16 bp, Homo sapiens
ggaaccttccttcctg

SEQ ID NO: 657245 - DNA, 20 bp, Homo sapiens
ggaaccttccttcctgcttg

SEQ ID NO: 657246 - DNA, 21 bp, Homo sapiens
ggaaccttccttcctgcttga

SEQ ID NO: 657247 - DNA, 14 bp, Homo sapiens
ggaagaacatagaa

SEQ ID NO: 657248 - DNA, 17 bp, Homo sapiens
ggaagaatccagtatta

SEQ ID NO: 657249 - DNA, 15 bp, Homo sapiens
ggaagacgcagagca

SEQ ID NO: 657250 - DNA, 18 bp, Homo sapiens
ggaagaggaaaaggctgg

SEQ ID NO: 657251 - DNA, 22 bp, Homo sapiens
ggaagagtgtgggggaggcgca

SEQ ID NO: 657252 - DNA, 16 bp, Homo sapiens
ggaagctgtcctggag

SEQ ID NO: 657253 - DNA, 21 bp, Homo sapiens
ggaaggaaatcccatcagtga

SEQ ID NO: 657254 - DNA, 12 bp, Homo sapiens
ggaaggagcagt

SEQ ID NO: 657255 - DNA, 13 bp, Homo sapiens
ggaaggcctccct

SEQ ID NO: 657256 - DNA, 15 bp, Homo sapiens
ggaaggcctccctct

SEQ ID NO: 657257 - DNA, 12 bp, Homo sapiens
ggaaggcctgac

SEQ ID NO: 657258 - DNA, 20 bp, Homo sapiens
ggaaggcctgacttctgctg

SEQ ID NO: 657259 - DNA, 14 bp, Homo sapiens
ggaaggtgaaacag

SEQ ID NO: 657260 - DNA, 17 bp, Homo sapiens
ggaagttacatgctgta

SEQ ID NO: 657261 - DNA, 21 bp, Homo sapiens
ggaataacttttacacgacca

SEQ ID NO: 657262 - DNA, 22 bp, Homo sapiens
ggaatatatcagtacctctcaa

SEQ ID NO: 657263 - DNA, 14 bp, Homo sapiens
ggaatcctcctcca

SEQ ID NO: 657264 - DNA, 13 bp, Homo sapiens
ggaatcttcacta

SEQ ID NO: 657265 - DNA, 14 bp, Homo sapiens
cttttgttgtttat

SEQ ID NO: 657266 - DNA, 16 bp, Homo sapiens
cttttgtttggtaaat

SEQ ID NO: 657267 - DNA, 22 bp, Homo sapiens
ctttttaaaaactcttcagtgc

SEQ ID NO: 657268 - DNA, 14 bp, Homo sapiens
ctttttaagggatt

SEQ ID NO: 657269 - DNA, 13 bp, Homo sapiens
ctttttcatcctt

SEQ ID NO: 657270 - DNA, 12 bp, Homo sapiens
ctttttccacaa

SEQ ID NO: 657271 - DNA, 21 bp, Homo sapiens
ctttttgccagttttccctgg

SEQ ID NO: 657272 - DNA, 22 bp, Homo sapiens
ctttttgccagttttccctgga

SEQ ID NO: 657273 - DNA, 12 bp, Homo sapiens
ctttttggcctg

SEQ ID NO: 657274 - DNA, 19 bp, Homo sapiens
cttttttgtggcaattagt

SEQ ID NO: 657275 - DNA, 15 bp, Homo sapiens
ctttttttaaccatt

SEQ ID NO: 657276 - DNA, 17 bp, Homo sapiens
cttttttttctctcttt

SEQ ID NO: 657277 - DNA, 15 bp, Homo sapiens
gaaaaaaaagttttt

SEQ ID NO: 657278 - DNA, 14 bp, Homo sapiens
gaaaaaaatactat

SEQ ID NO: 657279 - DNA, 14 bp, Homo sapiens
gaaaaaaattgaaa

SEQ ID NO: 657280 - DNA, 17 bp, Homo sapiens
gaaaaacaattttctgt

SEQ ID NO: 657281 - DNA, 16 bp, Homo sapiens
gaaaaataaaatgttt

SEQ ID NO: 657282 - DNA, 17 bp, Homo sapiens
gaaaaatataaaattat

SEQ ID NO: 657283 - DNA, 22 bp, Homo sapiens
gaaaaatgacaattgtgaacat

SEQ ID NO: 657284 - DNA, 19 bp, Homo sapiens
gaaaaattggggaggaggg

SEQ ID NO: 657285 - DNA, 12 bp, Homo sapiens
gaaaacatgtac

SEQ ID NO: 657286 - DNA, 19 bp, Homo sapiens
gaaaacatgtactacagct

SEQ ID NO: 657287 - DNA, 20 bp, Homo sapiens
gaaaacatgttaatgacaat

SEQ ID NO: 657288 - DNA, 13 bp, Homo sapiens
gaaaacctgttca

SEQ ID NO: 657289 - DNA, 14 bp, Homo sapiens
gaaaactgggtatg

SEQ ID NO: 657290 - DNA, 14 bp, Homo sapiens
gaaaagaatagaag

SEQ ID NO: 657291 - DNA, 13 bp, Homo sapiens
gaaaaggaagact

SEQ ID NO: 657292 - DNA, 15 bp, Homo sapiens
gaaaataccagtgtt

SEQ ID NO: 657293 - DNA, 16 bp, Homo sapiens
gaaaatctttgttgaa

SEQ ID NO: 657294 - DNA, 17 bp, Homo sapiens
gaaaattcttgagaagt

SEQ ID NO: 657295 - DNA, 12 bp, Homo sapiens
gaaaattgagtt

SEQ ID NO: 657296 - DNA, 12 bp, Homo sapiens
gaaaattgcccc

SEQ ID NO: 657297 - DNA, 21 bp, Homo sapiens
gaaaattgtttagtgatatta

SEQ ID NO: 657298 - DNA, 16 bp, Homo sapiens
gaaacagatttcatac

SEQ ID NO: 657299 - DNA, 21 bp, Homo sapiens
gaaacagttgctgtgaacttt

SEQ ID NO: 657300 - DNA, 19 bp, Homo sapiens
gaaaccaattaagcagctt

SEQ ID NO: 657301 - DNA, 19 bp, Homo sapiens
gaaacccctgtaggcctca

SEQ ID NO: 657302 - DNA, 21 bp, Homo sapiens
gaaacctacacactgtcatgc

SEQ ID NO: 657303 - DNA, 17 bp, Homo sapiens
gaaaccttgctctcctc

SEQ ID NO: 657304 - DNA, 16 bp, Homo sapiens
gaaactgaaaaatatc

SEQ ID NO: 657305 - DNA, 15 bp, Homo sapiens
gaaactgctgcagat

SEQ ID NO: 657306 - DNA, 19 bp, Homo sapiens
gaaagacttctcaaagaga

SEQ ID NO: 657307 - DNA, 21 bp, Homo sapiens
gaaagacttctcaaagagaat

SEQ ID NO: 657308 - DNA, 20 bp, Homo sapiens
gaaagagagcaccacgtgat

SEQ ID NO: 657309 - DNA, 22 bp, Homo sapiens
gaaagatgtgtttttgggaaga

SEQ ID NO: 657310 - DNA, 20 bp, Homo sapiens
gaaagcagagcctcctggga

SEQ ID NO: 657311 - DNA, 11 bp, Homo sapiens
gaaaggaagca

SEQ ID NO: 657312 - DNA, 12 bp, Homo sapiens
gaaaggaagcaa

SEQ ID NO: 657313 - DNA, 21 bp, Homo sapiens
gaaaggggttggggtgacagt

SEQ ID NO: 657314 - DNA, 22 bp, Homo sapiens
gaaagtaatttaatttgtaaaa

SEQ ID NO: 657315 - DNA, 21 bp, Homo sapiens
gaaagtagggggctttctggg

SEQ ID NO: 657316 - DNA, 21 bp, Homo sapiens
gaaagtcaaaaaattatttgc

SEQ ID NO: 657317 - DNA, 16 bp, Homo sapiens
gaaagtcaaatttact

SEQ ID NO: 657318 - DNA, 19 bp, Homo sapiens
gaaagtgtgagctcttccc

SEQ ID NO: 657319 - DNA, 22 bp, Homo sapiens
gaaatacgttaggaggacaaaa

SEQ ID NO: 657320 - DNA, 16 bp, Homo sapiens
gaaatagtatacattg

SEQ ID NO: 657321 - DNA, 22 bp, Homo sapiens
gaaatattaagcatgttttgtt

SEQ ID NO: 657322 - DNA, 17 bp, Homo sapiens
gaaatccctttctgcta

SEQ ID NO: 657323 - DNA, 13 bp, Homo sapiens
gaaatcttcccag

SEQ ID NO: 657324 - DNA, 15 bp, Homo sapiens
gaaatcttcccagta

SEQ ID NO: 657325 - DNA, 15 bp, Homo sapiens
gaaatgcatatttgc

SEQ ID NO: 657326 - DNA, 20 bp, Homo sapiens
gaaatggaacagatttcaaa

SEQ ID NO: 657327 - DNA, 18 bp, Homo sapiens
gaaatgtttaataaagct

SEQ ID NO: 657328 - DNA, 20 bp, Homo sapiens
gaaatgtttaataaagcttt

SEQ ID NO: 657329 - DNA, 20 bp, Homo sapiens
gaaattactttaacattttg

SEQ ID NO: 657330 - DNA, 20 bp, Homo sapiens
gaacaaggaaggaaagatgt

SEQ ID NO: 657331 - DNA, 23 bp, Homo sapiens
gaacacccttagaaaatgtgtcc

SEQ ID NO: 657332 - DNA, 18 bp, Homo sapiens
gaacagaactggaggcag

SEQ ID NO: 657333 - DNA, 19 bp, Homo sapiens
gaacatgatagttaaacta

SEQ ID NO: 657334 - DNA, 24 bp, Homo sapiens
gaacatgtcctaattcttctgtcc

SEQ ID NO: 657335 - DNA, 23 bp, Homo sapiens
gaaccaaaaatcccaccttccca

SEQ ID NO: 657336 - DNA, 16 bp, Homo sapiens
gaaccaaatacctcaa

SEQ ID NO: 657337 - DNA, 19 bp, Homo sapiens
gaaccaaatacctcaattt

SEQ ID NO: 657338 - DNA, 23 bp, Homo sapiens
gaaccaagtggaccttgagacca

SEQ ID NO: 657339 - DNA, 24 bp, Homo sapiens
gaaccaagtggaccttgagaccac

SEQ ID NO: 657340 - DNA, 14 bp, Homo sapiens
gaaccacaactttg

SEQ ID NO: 657341 - DNA, 18 bp, Homo sapiens
gaacctacctgccttgga

SEQ ID NO: 657342 - DNA, 14 bp, Homo sapiens
gaactccaggccct

SEQ ID NO: 657343 - DNA, 17 bp, Homo sapiens
gaactccaggccctcct

SEQ ID NO: 657344 - DNA, 13 bp, Homo sapiens
gaactgcaatgaa

SEQ ID NO: 657345 - DNA, 18 bp, Homo sapiens
gaactggcaattgtctat

SEQ ID NO: 657346 - DNA, 21 bp, Homo sapiens
gaacttggctttcctgtttct

SEQ ID NO: 657347 - DNA, 15 bp, Homo sapiens
gaagaaacagatctc

SEQ ID NO: 657348 - DNA, 17 bp, Homo sapiens
gaagaaagtcaaaaaat

SEQ ID NO: 657349 - DNA, 20 bp, Homo sapiens
gaagaagacctctaggagga

SEQ ID NO: 657350 - DNA, 17 bp, Homo sapiens
gaagaatacccaggaag

SEQ ID NO: 657351 - DNA, 18 bp, Homo sapiens
gaagaatacccaggaaga

SEQ ID NO: 657352 - DNA, 20 bp, Homo sapiens
gaagaatacccaggaagact

SEQ ID NO: 657353 - DNA, 16 bp, Homo sapiens
gaagaatccagtatta

SEQ ID NO: 657354 - DNA, 16 bp, Homo sapiens
gaagaattaagataca

SEQ ID NO: 657355 - DNA, 18 bp, Homo sapiens
gccaagtgcgtgccgtgt

SEQ ID NO: 657356 - DNA, 18 bp, Homo sapiens
gccaatgccccactggca

SEQ ID NO: 657357 - DNA, 11 bp, Homo sapiens
gccacagtggg

SEQ ID NO: 657358 - DNA, 20 bp, Homo sapiens
gccacagtggggctgcaggc

SEQ ID NO: 657359 - DNA, 12 bp, Homo sapiens
gccacatttaat

SEQ ID NO: 657360 - DNA, 13 bp, Homo sapiens
gccacctgcagga

SEQ ID NO: 657361 - DNA, 17 bp, Homo sapiens
gccacgcattttgcact

SEQ ID NO: 657362 - DNA, 12 bp, Homo sapiens
gccagactctgt

SEQ ID NO: 657363 - DNA, 15 bp, Homo sapiens
gccagactctgtctc

SEQ ID NO: 657364 - DNA, 13 bp, Homo sapiens
gccagaggtgctt

SEQ ID NO: 657365 - DNA, 16 bp, Homo sapiens
gccagaggtgcttcac

SEQ ID NO: 657366 - DNA, 19 bp, Homo sapiens
gccagaggtgcttcaccct

SEQ ID NO: 657367 - DNA, 15 bp, Homo sapiens
gccagcaacattggc

SEQ ID NO: 657368 - DNA, 13 bp, Homo sapiens
gccagcaccacag

SEQ ID NO: 657369 - DNA, 17 bp, Homo sapiens
gccagcaccacagccgg

SEQ ID NO: 657370 - DNA, 20 bp, Homo sapiens
gccagcccatggcccccaat

SEQ ID NO: 657371 - DNA, 22 bp, Homo sapiens
gccagccttgagccctggctgt

SEQ ID NO: 657372 - DNA, 22 bp, Homo sapiens
gccaggaacctgtcctaaggaa

SEQ ID NO: 657373 - DNA, 15 bp, Homo sapiens
gccaggagcttcttc

SEQ ID NO: 657374 - DNA, 16 bp, Homo sapiens
gccaggaggccaggct

SEQ ID NO: 657375 - DNA, 14 bp, Homo sapiens
gccaggcagagaac

SEQ ID NO: 657376 - DNA, 16 bp, Homo sapiens
gccaggctgcctcctg

SEQ ID NO: 657377 - DNA, 18 bp, Homo sapiens
gccagggctgccctgaga

SEQ ID NO: 657378 - DNA, 15 bp, Homo sapiens
gccagggggatgcca

SEQ ID NO: 657379 - DNA, 17 bp, Homo sapiens
gccagggtctctccctc

SEQ ID NO: 657380 - DNA, 16 bp, Homo sapiens
gccaggtatggctctg

SEQ ID NO: 657381 - DNA, 19 bp, Homo sapiens
gccagtgaacttggctttc

SEQ ID NO: 657382 - DNA, 15 bp, Homo sapiens
gccagtggggcctgt

SEQ ID NO: 657383 - DNA, 21 bp, Homo sapiens
gccagtggggcctgtggaatg

SEQ ID NO: 657384 - DNA, 18 bp, Homo sapiens
gccatccccgctcctggt

SEQ ID NO: 657385 - DNA, 17 bp, Homo sapiens
gccatctcagcttgctg

SEQ ID NO: 657386 - DNA, 13 bp, Homo sapiens
gccatctgttcat

SEQ ID NO: 657387 - DNA, 18 bp, Homo sapiens
gccatgccaggaacctgt

SEQ ID NO: 657388 - DNA, 23 bp, Homo sapiens
gccatggctcagggtggtctctt

SEQ ID NO: 657389 - DNA, 14 bp, Homo sapiens
gccatgtccaaaga

SEQ ID NO: 657390 - DNA, 15 bp, Homo sapiens
gccatgtccaaagag

SEQ ID NO: 657391 - DNA, 20 bp, Homo sapiens
gcccaatgagactctagggt

SEQ ID NO: 657392 - DNA, 23 bp, Homo sapiens
gcccacacccagctactttaaca

SEQ ID NO: 657393 - DNA, 18 bp, Homo sapiens
gcccaccctgctgctggt

SEQ ID NO: 657394 - DNA, 19 bp, Homo sapiens
gcccaccctgctgctggtg

SEQ ID NO: 657395 - DNA, 17 bp, Homo sapiens
gcccacctgctcccagg

SEQ ID NO: 657396 - DNA, 18 bp, Homo sapiens
gcccacctgctcccaggc

SEQ ID NO: 657397 - DNA, 17 bp, Homo sapiens
gcccacgctcaccccct

SEQ ID NO: 657398 - DNA, 23 bp, Homo sapiens
gcccacggaggcctcgagcagag

SEQ ID NO: 657399 - DNA, 14 bp, Homo sapiens
gcccagagaacagc

SEQ ID NO: 657400 - DNA, 22 bp, Homo sapiens
gcccagctaatttttgtatttt

SEQ ID NO: 657401 - DNA, 20 bp, Homo sapiens
gcccagtgcatggtggccag

SEQ ID NO: 657402 - DNA, 21 bp, Homo sapiens
gcccagtgcatggtggccaga

SEQ ID NO: 657403 - DNA, 13 bp, Homo sapiens
gcccatccttccc

SEQ ID NO: 657404 - DNA, 22 bp, Homo sapiens
gccccacaaaacttcagtgtgg

SEQ ID NO: 657405 - DNA, 23 bp, Homo sapiens
gccccacatgtccagcaccttgt

SEQ ID NO: 657406 - DNA, 14 bp, Homo sapiens
gccccacctcggca

SEQ ID NO: 657407 - DNA, 19 bp, Homo sapiens
gccccacctcggcacacac

SEQ ID NO: 657408 - DNA, 19 bp, Homo sapiens
gccccagtggctgttctgg

SEQ ID NO: 657409 - DNA, 19 bp, Homo sapiens
gccccatccagacctggct

SEQ ID NO: 657410 - DNA, 19 bp, Homo sapiens
gcccccaacctcagggctc

SEQ ID NO: 657411 - DNA, 16 bp, Homo sapiens
gcccccaataaaggca

SEQ ID NO: 657412 - DNA, 20 bp, Homo sapiens
gcccccaataaaggcagctg

SEQ ID NO: 657413 - DNA, 12 bp, Homo sapiens
gccccctgggct

SEQ ID NO: 657414 - DNA, 17 bp, Homo sapiens
gccccctgggctggggc

SEQ ID NO: 657415 - DNA, 13 bp, Homo sapiens
gccccgacacacg

SEQ ID NO: 657416 - DNA, 22 bp, Homo sapiens
gccccgacacacggggctcggg

SEQ ID NO: 657417 - DNA, 15 bp, Homo sapiens
gcccctaggctgctg

SEQ ID NO: 657418 - DNA, 21 bp, Homo sapiens
gcccctcccacacccaaagct

SEQ ID NO: 657419 - DNA, 15 bp, Homo sapiens
gcccctctcaccaaa

SEQ ID NO: 657420 - DNA, 13 bp, Homo sapiens
gcccctgcctgct

SEQ ID NO: 657421 - DNA, 12 bp, Homo sapiens
gcccctggcact

SEQ ID NO: 657422 - DNA, 17 bp, Homo sapiens
gcccctggcactcttgt

SEQ ID NO: 657423 - DNA, 15 bp, Homo sapiens
gcccctggctttgcc

SEQ ID NO: 657424 - DNA, 19 bp, Homo sapiens
gccccttaaacacaggctg

SEQ ID NO: 657425 - DNA, 16 bp, Homo sapiens
gcccgacatggctccg

SEQ ID NO: 657426 - DNA, 18 bp, Homo sapiens
gctaaggcaggaggatca

SEQ ID NO: 657427 - DNA, 22 bp, Homo sapiens
gctaagggtgggtgctcagaat

SEQ ID NO: 657428 - DNA, 22 bp, Homo sapiens
gctaatttagagataggaaact

SEQ ID NO: 657429 - DNA, 13 bp, Homo sapiens
gctacattttcag

SEQ ID NO: 657430 - DNA, 13 bp, Homo sapiens
gctacctcaaggg

SEQ ID NO: 657431 - DNA, 14 bp, Homo sapiens
gctacctccctccc

SEQ ID NO: 657432 - DNA, 15 bp, Homo sapiens
gctacctctctgtcc

SEQ ID NO: 657433 - DNA, 16 bp, Homo sapiens
gctacctctctgtccc

SEQ ID NO: 657434 - DNA, 22 bp, Homo sapiens
gctactaagttcacattagaat

SEQ ID NO: 657435 - DNA, 21 bp, Homo sapiens
gctatccccatctccctgcct

SEQ ID NO: 657436 - DNA, 23 bp, Homo sapiens
gctatccccatctccctgcctgg

SEQ ID NO: 657437 - DNA, 18 bp, Homo sapiens
gctatgaagccaactgac

SEQ ID NO: 657438 - DNA, 15 bp, Homo sapiens
gctatgtataaaata

SEQ ID NO: 657439 - DNA, 12 bp, Homo sapiens
gctattgctgct

SEQ ID NO: 657440 - DNA, 17 bp, Homo sapiens
gctatttatgggcccct

SEQ ID NO: 657441 - DNA, 18 bp, Homo sapiens
gctatttatgggcccctg

SEQ ID NO: 657442 - DNA, 19 bp, Homo sapiens
gctatttatgggcccctgg

SEQ ID NO: 657443 - DNA, 12 bp, Homo sapiens
gctcaagctttc

SEQ ID NO: 657444 - DNA, 20 bp, Homo sapiens
gctcacagtacagcatgtgc

SEQ ID NO: 657445 - DNA, 20 bp, Homo sapiens
gctcagaataaggcaggcat

SEQ ID NO: 657446 - DNA, 16 bp, Homo sapiens
gctcagccccaactct

SEQ ID NO: 657447 - DNA, 17 bp, Homo sapiens
gctcagccctggcctgg

SEQ ID NO: 657448 - DNA, 12 bp, Homo sapiens
gctcagggtggt

SEQ ID NO: 657449 - DNA, 19 bp, Homo sapiens
gctcatgcacccctgagcc

SEQ ID NO: 657450 - DNA, 13 bp, Homo sapiens
gctcatgttttta

SEQ ID NO: 657451 - DNA, 14 bp, Homo sapiens
gctcattaaacttt

SEQ ID NO: 657452 - DNA, 12 bp, Homo sapiens
gctcatttaagt

SEQ ID NO: 657453 - DNA, 16 bp, Homo sapiens
gctccaggcctgcagc

SEQ ID NO: 657454 - DNA, 22 bp, Homo sapiens
gctccatcccaaccaggcacct

SEQ ID NO: 657455 - DNA, 21 bp, Homo sapiens
gctccccacagcgtccctggc

SEQ ID NO: 657456 - DNA, 15 bp, Homo sapiens
gctcccttggtgccc

SEQ ID NO: 657457 - DNA, 14 bp, Homo sapiens
gctccgtagctctg

SEQ ID NO: 657458 - DNA, 19 bp, Homo sapiens
gctccgtagctctgctgct

SEQ ID NO: 657459 - DNA, 20 bp, Homo sapiens
gctccgtagctctgctgctg

SEQ ID NO: 657460 - DNA, 14 bp, Homo sapiens
gctcctcctcaccc

SEQ ID NO: 657461 - DNA, 17 bp, Homo sapiens
gctccttgagaggagaa

SEQ ID NO: 657462 - DNA, 16 bp, Homo sapiens
gctcgtcagccacctg

SEQ ID NO: 657463 - DNA, 17 bp, Homo sapiens
gctcgtcagccacctgg

SEQ ID NO: 657464 - DNA, 20 bp, Homo sapiens
gctcgtcagccacctgggaa

SEQ ID NO: 657465 - DNA, 19 bp, Homo sapiens
gctcgtttacactgcacat

SEQ ID NO: 657466 - DNA, 20 bp, Homo sapiens
gctctaaaaggtaatgtgtg

SEQ ID NO: 657467 - DNA, 15 bp, Homo sapiens
gctctctgtgaccct

SEQ ID NO: 657468 - DNA, 21 bp, Homo sapiens
gctctgaaggtccaaagagtt

SEQ ID NO: 657469 - DNA, 15 bp, Homo sapiens
gctctgcacccctct

SEQ ID NO: 657470 - DNA, 17 bp, Homo sapiens
gctctgcacccctctgc

SEQ ID NO: 657471 - DNA, 18 bp, Homo sapiens
gctctgcagcattgaagt

SEQ ID NO: 657472 - DNA, 19 bp, Homo sapiens
gctctgcagcattgaagta

SEQ ID NO: 657473 - DNA, 21 bp, Homo sapiens
gctctgcagcattgaagtatg

SEQ ID NO: 657474 - DNA, 15 bp, Homo sapiens
gctcttcccactttt

SEQ ID NO: 657475 - DNA, 23 bp, Homo sapiens
gctcttgtttttattaatttata

SEQ ID NO: 657476 - DNA, 16 bp, Homo sapiens
gctctttcacctgggt

SEQ ID NO: 657477 - DNA, 16 bp, Homo sapiens
gctctttccaaattaa

SEQ ID NO: 657478 - DNA, 20 bp, Homo sapiens
gctctttccaaattaaaaca

SEQ ID NO: 657479 - DNA, 23 bp, Homo sapiens
gctctttccaaattaaaacaaat

SEQ ID NO: 657480 - DNA, 13 bp, Homo sapiens
gctcttttcctgg

SEQ ID NO: 657481 - DNA, 15 bp, Homo sapiens
gctgaactcagcaca

SEQ ID NO: 657482 - DNA, 18 bp, Homo sapiens
gatattgttgttttccat

SEQ ID NO: 657483 - DNA, 18 bp, Homo sapiens
gatatttcgtgtactgca

SEQ ID NO: 657484 - DNA, 17 bp, Homo sapiens
gatatttcttgctttca

SEQ ID NO: 657485 - DNA, 18 bp, Homo sapiens
gatatttttcataaacaa

SEQ ID NO: 657486 - DNA, 22 bp, Homo sapiens
gatatttttcataaacaagttc

SEQ ID NO: 657487 - DNA, 22 bp, Homo sapiens
gatattttttggtgtgccctgt

SEQ ID NO: 657488 - DNA, 17 bp, Homo sapiens
gatcactgaatttataa

SEQ ID NO: 657489 - DNA, 16 bp, Homo sapiens
gatcatcgccagaggt

SEQ ID NO: 657490 - DNA, 19 bp, Homo sapiens
gatcatcgccagaggtgct

SEQ ID NO: 657491 - DNA, 17 bp, Homo sapiens
gatcatttaaaaagctc

SEQ ID NO: 657492 - DNA, 21 bp, Homo sapiens
gatcatttttaactgattctt

SEQ ID NO: 657493 - DNA, 20 bp, Homo sapiens
gatccatccatctctctctt

SEQ ID NO: 657494 - DNA, 23 bp, Homo sapiens
gatccatttccattgcttattat

SEQ ID NO: 657495 - DNA, 20 bp, Homo sapiens
gatcctggttaccactcttt

SEQ ID NO: 657496 - DNA, 14 bp, Homo sapiens
gatccttttattct

SEQ ID NO: 657497 - DNA, 11 bp, Homo sapiens
gatctacacat

SEQ ID NO: 657498 - DNA, 12 bp, Homo sapiens
gatctacacatg

SEQ ID NO: 657499 - DNA, 14 bp, Homo sapiens
gatctctcctggcc

SEQ ID NO: 657500 - DNA, 16 bp, Homo sapiens
gatctctcctggccta

SEQ ID NO: 657501 - DNA, 18 bp, Homo sapiens
gatctctcttgtcctctt

SEQ ID NO: 657502 - DNA, 20 bp, Homo sapiens
gatctctcttgtcctcttct

SEQ ID NO: 657503 - DNA, 18 bp, Homo sapiens
gatctctgagaccacaga

SEQ ID NO: 657504 - DNA, 17 bp, Homo sapiens
gatctgcatctgataga

SEQ ID NO: 657505 - DNA, 12 bp, Homo sapiens
gatctttcagaa

SEQ ID NO: 657506 - DNA, 15 bp, Homo sapiens
gatctttcagaaata

SEQ ID NO: 657507 - DNA, 21 bp, Homo sapiens
gatgaaaaagaataaaaactt

SEQ ID NO: 657508 - DNA, 15 bp, Homo sapiens
gatgaatgcagatta

SEQ ID NO: 657509 - DNA, 13 bp, Homo sapiens
gatgaggcaaccc

SEQ ID NO: 657510 - DNA, 14 bp, Homo sapiens
gatgatttaagtgt

SEQ ID NO: 657511 - DNA, 21 bp, Homo sapiens
gatgattttcatttcatgaaa

SEQ ID NO: 657512 - DNA, 19 bp, Homo sapiens
gatgccactcctccctccg

SEQ ID NO: 657513 - DNA, 19 bp, Homo sapiens
gatgctgtaacttaaaata

SEQ ID NO: 657514 - DNA, 14 bp, Homo sapiens
gatggaaatacagt

SEQ ID NO: 657515 - DNA, 21 bp, Homo sapiens
gatggaacaggctcagatctc

SEQ ID NO: 657516 - DNA, 13 bp, Homo sapiens
gatggagagaata

SEQ ID NO: 657517 - DNA, 15 bp, Homo sapiens
gatggcagaggagct

SEQ ID NO: 657518 - DNA, 15 bp, Homo sapiens
gatggcttgtctata

SEQ ID NO: 657519 - DNA, 20 bp, Homo sapiens
gatgggaacaaggaaggaaa

SEQ ID NO: 657520 - DNA, 12 bp, Homo sapiens
gatgtaaagatg

SEQ ID NO: 657521 - DNA, 22 bp, Homo sapiens
gatgtacataactcctgtccct

SEQ ID NO: 657522 - DNA, 17 bp, Homo sapiens
gatgtgcccaggggagc

SEQ ID NO: 657523 - DNA, 21 bp, Homo sapiens
gatgttctgcctctccctggg

SEQ ID NO: 657524 - DNA, 18 bp, Homo sapiens
gatgttctggataccatt

SEQ ID NO: 657525 - DNA, 22 bp, Homo sapiens
gatgtttgctcttgtttttatt

SEQ ID NO: 657526 - DNA, 17 bp, Homo sapiens
gatgttttatccttaca

SEQ ID NO: 657527 - DNA, 16 bp, Homo sapiens
gattaagaaaggaagt

SEQ ID NO: 657528 - DNA, 16 bp, Homo sapiens
gattatttatgacctg

SEQ ID NO: 657529 - DNA, 17 bp, Homo sapiens
gattattttttttttct

SEQ ID NO: 657530 - DNA, 19 bp, Homo sapiens
gattcaaccaaccaaggac

SEQ ID NO: 657531 - DNA, 22 bp, Homo sapiens
gattcctaagccacttgaaatg

SEQ ID NO: 657532 - DNA, 23 bp, Homo sapiens
gattctcttgatgccaccttcag

SEQ ID NO: 657533 - DNA, 20 bp, Homo sapiens
gattctgaccttaaatgcaa

SEQ ID NO: 657534 - DNA, 17 bp, Homo sapiens
gattctggataaagcca

SEQ ID NO: 657535 - DNA, 19 bp, Homo sapiens
gattctggataaagccact

SEQ ID NO: 657536 - DNA, 22 bp, Homo sapiens
gattctggataaagccactgaa

SEQ ID NO: 657537 - DNA, 16 bp, Homo sapiens
gattctggctttaagc

SEQ ID NO: 657538 - DNA, 19 bp, Homo sapiens
gattctttccattatgatt

SEQ ID NO: 657539 - DNA, 20 bp, Homo sapiens
gattgcccctggctttgcct

SEQ ID NO: 657540 - DNA, 22 bp, Homo sapiens
gattgcccctggctttgcctct

SEQ ID NO: 657541 - DNA, 23 bp, Homo sapiens
gattgcccctggctttgcctctt

SEQ ID NO: 657542 - DNA, 23 bp, Homo sapiens
gattgtaatatgtaaatggtatg

SEQ ID NO: 657543 - DNA, 20 bp, Homo sapiens
gattgtcctttaaaaaagaa

SEQ ID NO: 657544 - DNA, 18 bp, Homo sapiens
gattgtttcctcttccaa

SEQ ID NO: 657545 - DNA, 12 bp, Homo sapiens
gatttattgtaa

SEQ ID NO: 657546 - DNA, 15 bp, Homo sapiens
gatttattgtaagca

SEQ ID NO: 657547 - DNA, 22 bp, Homo sapiens
gatttccagaaccacacttgaa

SEQ ID NO: 657548 - DNA, 15 bp, Homo sapiens
gatttccttcaatgt

SEQ ID NO: 657549 - DNA, 15 bp, Homo sapiens
gatttctaattgtaa

SEQ ID NO: 657550 - DNA, 16 bp, Homo sapiens
gatttctcattgactt

SEQ ID NO: 657551 - DNA, 18 bp, Homo sapiens
gatttgaaccatgaagtc

SEQ ID NO: 657552 - DNA, 23 bp, Homo sapiens
gatttgtgaaacagttgctgtga

SEQ ID NO: 657553 - DNA, 16 bp, Homo sapiens
gattttaatacattga

SEQ ID NO: 657554 - DNA, 19 bp, Homo sapiens
gattttatgatcagtgttg

SEQ ID NO: 657555 - DNA, 15 bp, Homo sapiens
gattttattttacta

SEQ ID NO: 657556 - DNA, 11 bp, Homo sapiens
gattttgcaca

SEQ ID NO: 657557 - DNA, 11 bp, Homo sapiens
gatttttaaga

SEQ ID NO: 657558 - DNA, 13 bp, Homo sapiens
gatttttttcctc

SEQ ID NO: 657559 - DNA, 18 bp, Homo sapiens
gatttttttttttaattt

SEQ ID NO: 657560 - DNA, 16 bp, Homo sapiens
gcaaacagaacagggt

SEQ ID NO: 657561 - DNA, 16 bp, Homo sapiens
gcaaagaaaggagata

SEQ ID NO: 657562 - DNA, 22 bp, Homo sapiens
gcaaagataatttatttcaata

SEQ ID NO: 657563 - DNA, 19 bp, Homo sapiens
gcaaaggacccttgagtaa

SEQ ID NO: 657564 - DNA, 17 bp, Homo sapiens
gcaaagttcaacttatt

SEQ ID NO: 657565 - DNA, 20 bp, Homo sapiens
gcaaagtttaaatgtatttt

SEQ ID NO: 657566 - DNA, 14 bp, Homo sapiens
gcaaataaagcctt

SEQ ID NO: 657567 - DNA, 14 bp, Homo sapiens
gcaaatggcctcat

SEQ ID NO: 657568 - DNA, 12 bp, Homo sapiens
gcaaatgttaaa

SEQ ID NO: 657569 - DNA, 15 bp, Homo sapiens
gcaaattaactgtat

SEQ ID NO: 657570 - DNA, 22 bp, Homo sapiens
gcaacagatagatgttgctctt

SEQ ID NO: 657571 - DNA, 14 bp, Homo sapiens
gcaacattggcaca

SEQ ID NO: 657572 - DNA, 15 bp, Homo sapiens
gcaacatttgacaaa

SEQ ID NO: 657573 - DNA, 13 bp, Homo sapiens
gcaacctctgcct

SEQ ID NO: 657574 - DNA, 23 bp, Homo sapiens
gcaacctctgcctcccaggttcc

SEQ ID NO: 657575 - DNA, 22 bp, Homo sapiens
gcaacggtctcctgactggtgc

SEQ ID NO: 657576 - DNA, 19 bp, Homo sapiens
gcaactaatgtttgaacaa

SEQ ID NO: 657577 - DNA, 20 bp, Homo sapiens
gcaactaatgtttgaacaaa

SEQ ID NO: 657578 - DNA, 13 bp, Homo sapiens
gcaagcagaggac

SEQ ID NO: 657579 - DNA, 14 bp, Homo sapiens
gcaagcagaggacc

SEQ ID NO: 657580 - DNA, 19 bp, Homo sapiens
gcaagctcttttatatgct

SEQ ID NO: 657581 - DNA, 15 bp, Homo sapiens
gcaataaaatttaaa

SEQ ID NO: 657582 - DNA, 21 bp, Homo sapiens
gcaataaaatttaaaaaataa

SEQ ID NO: 657583 - DNA, 13 bp, Homo sapiens
gcaatccatttat

SEQ ID NO: 657584 - DNA, 14 bp, Homo sapiens
gcaatcttctactt

SEQ ID NO: 657585 - DNA, 21 bp, Homo sapiens
gcaattcagtcctgggcaaag

SEQ ID NO: 657586 - DNA, 22 bp, Homo sapiens
gcaattgtctatttatctttta

SEQ ID NO: 657587 - DNA, 14 bp, Homo sapiens
gcacaacagccctg

SEQ ID NO: 657588 - DNA, 24 bp, Homo sapiens
gcacaacagccctgcctgagaagc

SEQ ID NO: 657589 - DNA, 13 bp, Homo sapiens
gcacacagggcag

SEQ ID NO: 657590 - DNA, 16 bp, Homo sapiens
gcacacctttattcag

SEQ ID NO: 657591 - DNA, 19 bp, Homo sapiens
gcacagaacaggaggtgtg

SEQ ID NO: 657592 - DNA, 15 bp, Homo sapiens
gcacagaccaggcct

SEQ ID NO: 657593 - DNA, 18 bp, Homo sapiens
gcacagctgggagcctgg

SEQ ID NO: 657594 - DNA, 19 bp, Homo sapiens
gcacagctgggagcctggt

SEQ ID NO: 657595 - DNA, 16 bp, Homo sapiens
gcacagctgtttgaaa

SEQ ID NO: 657596 - DNA, 22 bp, Homo sapiens
gcacagcttttgtatagaaaat

SEQ ID NO: 657597 - DNA, 22 bp, Homo sapiens
gcacaggaggcaggcatggccc

SEQ ID NO: 657598 - DNA, 20 bp, Homo sapiens
gcacagtggctcacacctgt

SEQ ID NO: 657599 - DNA, 14 bp, Homo sapiens
gcacagtgtgagcc

SEQ ID NO: 657600 - DNA, 21 bp, Homo sapiens
gcaccacagccggtcagagga

SEQ ID NO: 657601 - DNA, 16 bp, Homo sapiens
gcaccacccctgggca

SEQ ID NO: 657602 - DNA, 22 bp, Homo sapiens
gcaccagttatgtttgaatgaa

SEQ ID NO: 657603 - DNA, 22 bp, Homo sapiens
gcaccatggtatcatatattaa

SEQ ID NO: 657604 - DNA, 21 bp, Homo sapiens
tgttctccataggagggaagg

SEQ ID NO: 657605 - DNA, 20 bp, Homo sapiens
tgttctgcaatatgcctagt

SEQ ID NO: 657606 - DNA, 19 bp, Homo sapiens
tgttctgcctctccctggg

SEQ ID NO: 657607 - DNA, 22 bp, Homo sapiens
tgttctgctccataccttttct

SEQ ID NO: 657608 - DNA, 23 bp, Homo sapiens
tgttctgtggttcctctgctcac

SEQ ID NO: 657609 - DNA, 14 bp, Homo sapiens
tgttgaagtttgaa

SEQ ID NO: 657610 - DNA, 16 bp, Homo sapiens
tgttgattaaagatga

SEQ ID NO: 657611 - DNA, 23 bp, Homo sapiens
tgttgcatatagttaaactgaga

SEQ ID NO: 657612 - DNA, 12 bp, Homo sapiens
tgttgctctttc

SEQ ID NO: 657613 - DNA, 14 bp, Homo sapiens
tgttgcttctcagg

SEQ ID NO: 657614 - DNA, 18 bp, Homo sapiens
tgttgctttcttacctac

SEQ ID NO: 657615 - DNA, 13 bp, Homo sapiens
tgttggaaagtaa

SEQ ID NO: 657616 - DNA, 14 bp, Homo sapiens
tgttggccaggctg

SEQ ID NO: 657617 - DNA, 18 bp, Homo sapiens
tgttgtaagaattctgat

SEQ ID NO: 657618 - DNA, 17 bp, Homo sapiens
tgttgtatatcactaaa

SEQ ID NO: 657619 - DNA, 11 bp, Homo sapiens
tgttgtcaaga

SEQ ID NO: 657620 - DNA, 14 bp, Homo sapiens
tgttgtctccactt

SEQ ID NO: 657621 - DNA, 14 bp, Homo sapiens
tgttgtggaagcat

SEQ ID NO: 657622 - DNA, 22 bp, Homo sapiens
tgttgttttccatgatttagca

SEQ ID NO: 657623 - DNA, 17 bp, Homo sapiens
tgtttaataaagcttta

SEQ ID NO: 657624 - DNA, 15 bp, Homo sapiens
tgtttacctttctct

SEQ ID NO: 657625 - DNA, 14 bp, Homo sapiens
tgtttatactgtat

SEQ ID NO: 657626 - DNA, 22 bp, Homo sapiens
tgtttatgatatttcttgcttt

SEQ ID NO: 657627 - DNA, 17 bp, Homo sapiens
tgtttatggccacattt

SEQ ID NO: 657628 - DNA, 21 bp, Homo sapiens
tgtttcagaggctcagattgt

SEQ ID NO: 657629 - DNA, 13 bp, Homo sapiens
tgtttccagggtc

SEQ ID NO: 657630 - DNA, 15 bp, Homo sapiens
tgtttcctcttccaa

SEQ ID NO: 657631 - DNA, 19 bp, Homo sapiens
tgtttctagctaaataaat

SEQ ID NO: 657632 - DNA, 21 bp, Homo sapiens
tgtttctagctaaataaatgg

SEQ ID NO: 657633 - DNA, 22 bp, Homo sapiens
tgtttctggacccttataaaat

SEQ ID NO: 657634 - DNA, 23 bp, Homo sapiens
tgtttctggacccttataaaatc

SEQ ID NO: 657635 - DNA, 20 bp, Homo sapiens
tgtttctgggtcctgaagaa

SEQ ID NO: 657636 - DNA, 21 bp, Homo sapiens
tgtttctgtttataatgaaga

SEQ ID NO: 657637 - DNA, 21 bp, Homo sapiens
tgtttctttctctgaggacaa

SEQ ID NO: 657638 - DNA, 21 bp, Homo sapiens
tgtttcttttgtttggtaaat

SEQ ID NO: 657639 - DNA, 16 bp, Homo sapiens
tgtttgaaatgtttaa

SEQ ID NO: 657640 - DNA, 22 bp, Homo sapiens
tgtttgaaatgtttaataaagc

SEQ ID NO: 657641 - DNA, 18 bp, Homo sapiens
tgtttgccaggacatgca

SEQ ID NO: 657642 - DNA, 21 bp, Homo sapiens
tgttttagtgtttatgtttaa

SEQ ID NO: 657643 - DNA, 12 bp, Homo sapiens
tgttttatcctt

SEQ ID NO: 657644 - DNA, 16 bp, Homo sapiens
tgttttatccttacaa

SEQ ID NO: 657645 - DNA, 11 bp, Homo sapiens
tgttttatgct

SEQ ID NO: 657646 - DNA, 14 bp, Homo sapiens
tgttttatgctact

SEQ ID NO: 657647 - DNA, 22 bp, Homo sapiens
tgttttccatgatttagcaagc

SEQ ID NO: 657648 - DNA, 12 bp, Homo sapiens
tgttttcttcaa

SEQ ID NO: 657649 - DNA, 18 bp, Homo sapiens
tgtttttattaatttata

SEQ ID NO: 657650 - DNA, 19 bp, Homo sapiens
tgtttttctttttccacaa

SEQ ID NO: 657651 - DNA, 15 bp, Homo sapiens
tgttttttatgaagt

SEQ ID NO: 657652 - DNA, 14 bp, Homo sapiens
tgttttttctgtaa

SEQ ID NO: 657653 - DNA, 15 bp, Homo sapiens
ttaaaaaataataca

SEQ ID NO: 657654 - DNA, 18 bp, Homo sapiens
ttaaaaactcttcagtgc

SEQ ID NO: 657655 - DNA, 14 bp, Homo sapiens
ttaaaaagaaatct

SEQ ID NO: 657656 - DNA, 15 bp, Homo sapiens
ttaaaaagaaattaa

SEQ ID NO: 657657 - DNA, 20 bp, Homo sapiens
ttaaaaagctcactgctgat

SEQ ID NO: 657658 - DNA, 17 bp, Homo sapiens
ttaaaaattacctttaa

SEQ ID NO: 657659 - DNA, 13 bp, Homo sapiens
ttaaaactaaatt

SEQ ID NO: 657660 - DNA, 16 bp, Homo sapiens
ttaaaactaaatttca

SEQ ID NO: 657661 - DNA, 16 bp, Homo sapiens
ttaaaactggacctgt

SEQ ID NO: 657662 - DNA, 14 bp, Homo sapiens
ttaaaatatatgaa

SEQ ID NO: 657663 - DNA, 16 bp, Homo sapiens
ttaaaatcatgatcct

SEQ ID NO: 657664 - DNA, 11 bp, Homo sapiens
ttaaaatgtaa

SEQ ID NO: 657665 - DNA, 16 bp, Homo sapiens
ttaaacacaggctgtc

SEQ ID NO: 657666 - DNA, 14 bp, Homo sapiens
tttcaagaaaatct

SEQ ID NO: 657667 - DNA, 17 bp, Homo sapiens
tttcaagaaaatctttg

SEQ ID NO: 657668 - DNA, 12 bp, Homo sapiens
tttcaagtttac

SEQ ID NO: 657669 - DNA, 16 bp, Homo sapiens
tttcaagtttacactt

SEQ ID NO: 657670 - DNA, 19 bp, Homo sapiens
tttcaataaatctttcaaa

SEQ ID NO: 657671 - DNA, 22 bp, Homo sapiens
tttcagaaatataacacatttt

SEQ ID NO: 657672 - DNA, 22 bp, Homo sapiens
tttcaggggctgactctccagg

SEQ ID NO: 657673 - DNA, 11 bp, Homo sapiens
tttcagtgagg

SEQ ID NO: 657674 - DNA, 16 bp, Homo sapiens
tttcagtggaaaccct

SEQ ID NO: 657675 - DNA, 22 bp, Homo sapiens
tttcagttctttggattctaaa

SEQ ID NO: 657676 - DNA, 17 bp, Homo sapiens
tttcatattttaaacag

SEQ ID NO: 657677 - DNA, 16 bp, Homo sapiens
tttcatcattgtttct

SEQ ID NO: 657678 - DNA, 16 bp, Homo sapiens
tttcatccttctttcc

SEQ ID NO: 657679 - DNA, 18 bp, Homo sapiens
tttcatccttctttcctt

SEQ ID NO: 657680 - DNA, 19 bp, Homo sapiens
tttcatccttctttccttg

SEQ ID NO: 657681 - DNA, 17 bp, Homo sapiens
tttcatctaccttttct

SEQ ID NO: 657682 - DNA, 19 bp, Homo sapiens
tttcatctaccttttctgg

SEQ ID NO: 657683 - DNA, 14 bp, Homo sapiens
tttcatgaaaatac

SEQ ID NO: 657684 - DNA, 17 bp, Homo sapiens
tttcatgaaaataccat

SEQ ID NO: 657685 - DNA, 19 bp, Homo sapiens
tttcatgaaaataccattt

SEQ ID NO: 657686 - DNA, 20 bp, Homo sapiens
tttcatgaacgttattatat

SEQ ID NO: 657687 - DNA, 12 bp, Homo sapiens
tttcattatgca

SEQ ID NO: 657688 - DNA, 17 bp, Homo sapiens
tttccaaattaaaacaa

SEQ ID NO: 657689 - DNA, 16 bp, Homo sapiens
tttccaagaggctgta

SEQ ID NO: 657690 - DNA, 12 bp, Homo sapiens
tttccaaggaag

SEQ ID NO: 657691 - DNA, 21 bp, Homo sapiens
tttccagaaccacacttgaaa

SEQ ID NO: 657692 - DNA, 12 bp, Homo sapiens
tttccagtgcaa

SEQ ID NO: 657693 - DNA, 21 bp, Homo sapiens
tttccatgatttagcaagcaa

SEQ ID NO: 657694 - DNA, 19 bp, Homo sapiens
tttcccacttcccaccctg

SEQ ID NO: 657695 - DNA, 22 bp, Homo sapiens
tttcccccttcccatttcttcc

SEQ ID NO: 657696 - DNA, 22 bp, Homo sapiens
tttccctggaactcctggcctt

SEQ ID NO: 657697 - DNA, 13 bp, Homo sapiens
tttcctatttaat

SEQ ID NO: 657698 - DNA, 17 bp, Homo sapiens
tttcctgtttccagggt

SEQ ID NO: 657699 - DNA, 14 bp, Homo sapiens
tttccttaccatac

SEQ ID NO: 657700 - DNA, 13 bp, Homo sapiens
tttccttgtcccg

SEQ ID NO: 657701 - DNA, 14 bp, Homo sapiens
tttcctttgtcctt

SEQ ID NO: 657702 - DNA, 16 bp, Homo sapiens
tttcctttttcttcgc

SEQ ID NO: 657703 - DNA, 13 bp, Homo sapiens
tttctaaatttat

SEQ ID NO: 657704 - DNA, 15 bp, Homo sapiens
tttctaaatttatat

SEQ ID NO: 657705 - DNA, 19 bp, Homo sapiens
tttctaagaagttgtttga

SEQ ID NO: 657706 - DNA, 13 bp, Homo sapiens
tttctaattgtaa

SEQ ID NO: 657707 - DNA, 22 bp, Homo sapiens
tttctaattgtaagtgaaatta

SEQ ID NO: 657708 - DNA, 14 bp, Homo sapiens
tttctatgacaaat

SEQ ID NO: 657709 - DNA, 20 bp, Homo sapiens
tttctcataggctatgccat

SEQ ID NO: 657710 - DNA, 12 bp, Homo sapiens
tttctctctcta

SEQ ID NO: 657711 - DNA, 14 bp, Homo sapiens
tttctctcttttgt

SEQ ID NO: 657712 - DNA, 20 bp, Homo sapiens
tttctcttccccttagaaac

SEQ ID NO: 657713 - DNA, 13 bp, Homo sapiens
tttctcttctacc

SEQ ID NO: 657714 - DNA, 12 bp, Homo sapiens
tttctggcaccg

SEQ ID NO: 657715 - DNA, 14 bp, Homo sapiens
tttctggggcctag

SEQ ID NO: 657716 - DNA, 15 bp, Homo sapiens
tttctggtgtatatt

SEQ ID NO: 657717 - DNA, 12 bp, Homo sapiens
tttctgtcccac

SEQ ID NO: 657718 - DNA, 20 bp, Homo sapiens
tttctgtttactgtcaaaat

SEQ ID NO: 657719 - DNA, 12 bp, Homo sapiens
tttcttaaggtt

SEQ ID NO: 657720 - DNA, 21 bp, Homo sapiens
tttcttaattttcaccgagca

SEQ ID NO: 657721 - DNA, 18 bp, Homo sapiens
tttcttacacactgtctg

SEQ ID NO: 657722 - DNA, 20 bp, Homo sapiens
tttcttagatggagaagttg

SEQ ID NO: 657723 - DNA, 16 bp, Homo sapiens
tttcttcacttcaagc

SEQ ID NO: 657724 - DNA, 23 bp, Homo sapiens
tttcttcacttcaagctgttatt

SEQ ID NO: 657725 - DNA, 13 bp, Homo sapiens
tttcttcatccaa

SEQ ID NO: 657726 - DNA, 12 bp, Homo sapiens
tttcttccctgc

SEQ ID NO: 657727 - DNA, 20 bp, Homo sapiens
tttcttccctgctttgcatc

SEQ ID NO: 657728 - DNA, 21 bp, Homo sapiens
tttcttccctgctttgcatct

SEQ ID NO: 657729 - DNA, 17 bp, Homo sapiens
tttcttctgaagattct

SEQ ID NO: 657730 - DNA, 17 bp, Homo sapiens
tttcttcttctaagaag

SEQ ID NO: 657731 - DNA, 19 bp, Homo sapiens
tttcttcttctaagaagac

SEQ ID NO: 657732 - DNA, 19 bp, Homo sapiens
tttctttcccatgtatttg

SEQ ID NO: 657733 - DNA, 14 bp, Homo sapiens
tttctttctgtctt

SEQ ID NO: 657734 - DNA, 13 bp, Homo sapiens
tttgaaaaatata

SEQ ID NO: 657735 - DNA, 21 bp, Homo sapiens
tttgaaaaatataaaattatg

SEQ ID NO: 657736 - DNA, 10 bp, Homo sapiens
tttgaagtgt

SEQ ID NO: 657737 - DNA, 13 bp, Homo sapiens
tttgaatatgaaa

SEQ ID NO: 657738 - DNA, 21 bp, Homo sapiens
tttgacacttatagattgaaa

SEQ ID NO: 657739 - DNA, 15 bp, Homo sapiens
tttgacagactattt

SEQ ID NO: 657740 - DNA, 13 bp, Homo sapiens
tttgagaaactgc

SEQ ID NO: 657741 - DNA, 22 bp, Homo sapiens
tttgagctcagccccaactctt

SEQ ID NO: 657742 - DNA, 17 bp, Homo sapiens
tttgaggcaaattaact

SEQ ID NO: 657743 - DNA, 14 bp, Homo sapiens
tttgaggtcagtgt

SEQ ID NO: 657744 - DNA, 22 bp, Homo sapiens
tttgatgattttcatttcatga

SEQ ID NO: 657745 - DNA, 20 bp, Homo sapiens
tttgatgtaaagatgttctg

SEQ ID NO: 657746 - DNA, 19 bp, Homo sapiens
tttgcacaccattttgtaa

SEQ ID NO: 657747 - DNA, 13 bp, Homo sapiens
tttgcatgcatgc

SEQ ID NO: 657748 - DNA, 20 bp, Homo sapiens
tttgcatgcatgcaaatgag

SEQ ID NO: 657749 - DNA, 14 bp, Homo sapiens
tttgcatttctttc

SEQ ID NO: 657750 - DNA, 17 bp, Homo sapiens
tttgccaggacatgcaa

SEQ ID NO: 657751 - DNA, 12 bp, Homo sapiens
tttgcccttcct

SEQ ID NO: 657752 - DNA, 22 bp, Homo sapiens
tttgccttctactccccttaat

SEQ ID NO: 657753 - DNA, 16 bp, Homo sapiens
tggttgttgcatatag

SEQ ID NO: 657754 - DNA, 22 bp, Homo sapiens
tggtttcataacttcctgtact

SEQ ID NO: 657755 - DNA, 21 bp, Homo sapiens
tggtttctctctacagtgcca

SEQ ID NO: 657756 - DNA, 21 bp, Homo sapiens
tggtttgtggcgtctccctcg

SEQ ID NO: 657757 - DNA, 13 bp, Homo sapiens
tggttttcctgtg

SEQ ID NO: 657758 - DNA, 14 bp, Homo sapiens
tggtttttgctctc

SEQ ID NO: 657759 - DNA, 22 bp, Homo sapiens
tgtaaaaaatgtctcatgtcaa

SEQ ID NO: 657760 - DNA, 17 bp, Homo sapiens
tgtaaaatgaattgaaa

SEQ ID NO: 657761 - DNA, 21 bp, Homo sapiens
tgtaaaatgaattgaaaaaca

SEQ ID NO: 657762 - DNA, 16 bp, Homo sapiens
tgtaaacttgtacatg

SEQ ID NO: 657763 - DNA, 14 bp, Homo sapiens
tgtaaagatttata

SEQ ID NO: 657764 - DNA, 17 bp, Homo sapiens
tgtaaagttaaaaatag

SEQ ID NO: 657765 - DNA, 12 bp, Homo sapiens
tgtaaataaact

SEQ ID NO: 657766 - DNA, 14 bp, Homo sapiens
tgtaaataaactat

SEQ ID NO: 657767 - DNA, 15 bp, Homo sapiens
tgtaaataatttatt

SEQ ID NO: 657768 - DNA, 18 bp, Homo sapiens
tgtaaatgaaacttaaga

SEQ ID NO: 657769 - DNA, 19 bp, Homo sapiens
tgtaaatgaaacttaagaa

SEQ ID NO: 657770 - DNA, 20 bp, Homo sapiens
tgtaaatgaaacttaagaat

SEQ ID NO: 657771 - DNA, 17 bp, Homo sapiens
tgtaaatgcatattaaa

SEQ ID NO: 657772 - DNA, 12 bp, Homo sapiens
tgtaactgctga

SEQ ID NO: 657773 - DNA, 21 bp, Homo sapiens
tgtaactgtcttctagcagtg

SEQ ID NO: 657774 - DNA, 15 bp, Homo sapiens
tgtaagaaatacaga

SEQ ID NO: 657775 - DNA, 19 bp, Homo sapiens
tgtaagaacacattttaaa

SEQ ID NO: 657776 - DNA, 14 bp, Homo sapiens
tgtaagtgggccca

SEQ ID NO: 657777 - DNA, 23 bp, Homo sapiens
tgtaatgtatcaaatacatttaa

SEQ ID NO: 657778 - DNA, 20 bp, Homo sapiens
tgtaatgtgtggtggcctca

SEQ ID NO: 657779 - DNA, 21 bp, Homo sapiens
tgtaatgtgtggtggcctcag

SEQ ID NO: 657780 - DNA, 16 bp, Homo sapiens
tgtaattataagctga

SEQ ID NO: 657781 - DNA, 12 bp, Homo sapiens
tgtaatttcaaa

SEQ ID NO: 657782 - DNA, 14 bp, Homo sapiens
tgtaatttcaaaat

SEQ ID NO: 657783 - DNA, 15 bp, Homo sapiens
tgtaattttgtgtaa

SEQ ID NO: 657784 - DNA, 19 bp, Homo sapiens
tgtacaaacagtatttctg

SEQ ID NO: 657785 - DNA, 14 bp, Homo sapiens
tgtacagattcttt

SEQ ID NO: 657786 - DNA, 19 bp, Homo sapiens
tgtacagattctttcagtt

SEQ ID NO: 657787 - DNA, 17 bp, Homo sapiens
tgtacataactcctgtc

SEQ ID NO: 657788 - DNA, 19 bp, Homo sapiens
tgtacataactcctgtccc

SEQ ID NO: 657789 - DNA, 18 bp, Homo sapiens
tgtacatacgatttaagg

SEQ ID NO: 657790 - DNA, 21 bp, Homo sapiens
tgtacatacgatttaaggtat

SEQ ID NO: 657791 - DNA, 23 bp, Homo sapiens
tgtacatacgatttaaggtattt

SEQ ID NO: 657792 - DNA, 17 bp, Homo sapiens
tgtacattatgaagaat

SEQ ID NO: 657793 - DNA, 20 bp, Homo sapiens
tgtacatttaaaattgctat

SEQ ID NO: 657794 - DNA, 15 bp, Homo sapiens
tgtacctcctctcag

SEQ ID NO: 657795 - DNA, 13 bp, Homo sapiens
tgtacctgctgga

SEQ ID NO: 657796 - DNA, 14 bp, Homo sapiens
tgtacgtccagcct

SEQ ID NO: 657797 - DNA, 17 bp, Homo sapiens
tgtacgtccagcctgcc

SEQ ID NO: 657798 - DNA, 20 bp, Homo sapiens
tgtactaaacagtaagatat

SEQ ID NO: 657799 - DNA, 16 bp, Homo sapiens
tgtactacagctatat

SEQ ID NO: 657800 - DNA, 20 bp, Homo sapiens
tgtactgcaaagtgtatgca

SEQ ID NO: 657801 - DNA, 15 bp, Homo sapiens
tgtactgttactggg

SEQ ID NO: 657802 - DNA, 18 bp, Homo sapiens
tgtacttattacagtctt

SEQ ID NO: 657803 - DNA, 21 bp, Homo sapiens
tgtacttattacagtcttatt

SEQ ID NO: 657804 - DNA, 21 bp, Homo sapiens
tgtagaaaggggagaatgtca

SEQ ID NO: 657805 - DNA, 19 bp, Homo sapiens
tgtagaaggagtagctgcc

SEQ ID NO: 657806 - DNA, 15 bp, Homo sapiens
tgtagactgtgccag

SEQ ID NO: 657807 - DNA, 18 bp, Homo sapiens
tgtagatatgtattcttt

SEQ ID NO: 657808 - DNA, 21 bp, Homo sapiens
tgtagatattgtgaagtacat

SEQ ID NO: 657809 - DNA, 15 bp, Homo sapiens
tgtagcataactgta

SEQ ID NO: 657810 - DNA, 17 bp, Homo sapiens
tgtagccaggtatggct

SEQ ID NO: 657811 - DNA, 15 bp, Homo sapiens
tgtagctcaagttta

SEQ ID NO: 657812 - DNA, 18 bp, Homo sapiens
tgtaggagaaactcccat

SEQ ID NO: 657813 - DNA, 16 bp, Homo sapiens
tgtagggttacagaga

SEQ ID NO: 657814 - DNA, 14 bp, Homo sapiens
tgtagtatctcata

SEQ ID NO: 657815 - DNA, 15 bp, Homo sapiens
tgtagtcaataaaac

SEQ ID NO: 657816 - DNA, 13 bp, Homo sapiens
tgtataaatatac

SEQ ID NO: 657817 - DNA, 16 bp, Homo sapiens
tgtataatataaaaaa

SEQ ID NO: 657818 - DNA, 21 bp, Homo sapiens
tgtatagaaaattcttgagaa

SEQ ID NO: 657819 - DNA, 22 bp, Homo sapiens
tgtatatattttgtgtgaaatt

SEQ ID NO: 657820 - DNA, 17 bp, Homo sapiens
tgtatatcactaaaagc

SEQ ID NO: 657821 - DNA, 18 bp, Homo sapiens
tgtatatcactaaaagca

SEQ ID NO: 657822 - DNA, 20 bp, Homo sapiens
tgtatatggtatatatacat

SEQ ID NO: 657823 - DNA, 13 bp, Homo sapiens
tgtatattccttt

SEQ ID NO: 657824 - DNA, 16 bp, Homo sapiens
tgtatatttgtaaagc

SEQ ID NO: 657825 - DNA, 14 bp, Homo sapiens
tgtgcttgttttat

SEQ ID NO: 657826 - DNA, 18 bp, Homo sapiens
tgtggaaggcctccctct

SEQ ID NO: 657827 - DNA, 18 bp, Homo sapiens
tgtggaatgagtgtgcat

SEQ ID NO: 657828 - DNA, 22 bp, Homo sapiens
tgtggattctgaggccctgccc

SEQ ID NO: 657829 - DNA, 17 bp, Homo sapiens
tgtggcaatctgtgggc

SEQ ID NO: 657830 - DNA, 23 bp, Homo sapiens
tgtggcataaattgcatcactgt

SEQ ID NO: 657831 - DNA, 14 bp, Homo sapiens
tgtggccaggcctt

SEQ ID NO: 657832 - DNA, 22 bp, Homo sapiens
tgtggcctgtgccagcaccaca

SEQ ID NO: 657833 - DNA, 24 bp, Homo sapiens
tgtggcctgtgccagcaccacagc

SEQ ID NO: 657834 - DNA, 16 bp, Homo sapiens
tgtggctagtgacaaa

SEQ ID NO: 657835 - DNA, 14 bp, Homo sapiens
tgtggctccaagct

SEQ ID NO: 657836 - DNA, 14 bp, Homo sapiens
tgtgggcactggcc

SEQ ID NO: 657837 - DNA, 16 bp, Homo sapiens
tgtgggcactggccca

SEQ ID NO: 657838 - DNA, 17 bp, Homo sapiens
tgtgggcactggcccag

SEQ ID NO: 657839 - DNA, 14 bp, Homo sapiens
tgtggtaatctaca

SEQ ID NO: 657840 - DNA, 11 bp, Homo sapiens
tgtggtctcag

SEQ ID NO: 657841 - DNA, 13 bp, Homo sapiens
tgtggtctcagga

SEQ ID NO: 657842 - DNA, 17 bp, Homo sapiens
tgtggttcctctgctca

SEQ ID NO: 657843 - DNA, 18 bp, Homo sapiens
tgtggttgtgtgtgttct

SEQ ID NO: 657844 - DNA, 14 bp, Homo sapiens
tgtgtaaagattta

SEQ ID NO: 657845 - DNA, 19 bp, Homo sapiens
tgtgtaaagatttatacag

SEQ ID NO: 657846 - DNA, 21 bp, Homo sapiens
tgtgtacaaatacatgtgtat

SEQ ID NO: 657847 - DNA, 18 bp, Homo sapiens
tgtgtaccttaagatatt

SEQ ID NO: 657848 - DNA, 18 bp, Homo sapiens
tgtgtacttattacagtc

SEQ ID NO: 657849 - DNA, 19 bp, Homo sapiens
tgtgtatatattttgtgtg

SEQ ID NO: 657850 - DNA, 19 bp, Homo sapiens
tgtgtatttccagtgcaat

SEQ ID NO: 657851 - DNA, 16 bp, Homo sapiens
tgtgtccacctgtggg

SEQ ID NO: 657852 - DNA, 14 bp, Homo sapiens
tgtgtcctcaggga

SEQ ID NO: 657853 - DNA, 16 bp, Homo sapiens
tgtgtggaaatgggac

SEQ ID NO: 657854 - DNA, 19 bp, Homo sapiens
tgtgtgtcccaggcaggga

SEQ ID NO: 657855 - DNA, 15 bp, Homo sapiens
tgtgtgtgtgtatga

SEQ ID NO: 657856 - DNA, 14 bp, Homo sapiens
tgtgtgtgtgtgca

SEQ ID NO: 657857 - DNA, 16 bp, Homo sapiens
tgtgtgtgtgtgtgca

SEQ ID NO: 657858 - DNA, 13 bp, Homo sapiens
tgtgttcaatatc

SEQ ID NO: 657859 - DNA, 23 bp, Homo sapiens
tgtgttctaatccaagggccagt

SEQ ID NO: 657860 - DNA, 16 bp, Homo sapiens
tgtgtttttctttttc

SEQ ID NO: 657861 - DNA, 16 bp, Homo sapiens
tgttaaagagaatgag

SEQ ID NO: 657862 - DNA, 17 bp, Homo sapiens
tgttaagtttttaatct

SEQ ID NO: 657863 - DNA, 16 bp, Homo sapiens
tgttaatacaaggtat

SEQ ID NO: 657864 - DNA, 18 bp, Homo sapiens
tgttacactttttggaag

SEQ ID NO: 657865 - DNA, 20 bp, Homo sapiens
tgttagatatttttcataaa

SEQ ID NO: 657866 - DNA, 23 bp, Homo sapiens
tgttagatatttttcataaacaa

SEQ ID NO: 657867 - DNA, 17 bp, Homo sapiens
tgttagattaagaaata

SEQ ID NO: 657868 - DNA, 20 bp, Homo sapiens
tgttagattaagaaatagac

SEQ ID NO: 657869 - DNA, 13 bp, Homo sapiens
tgttatatataat

SEQ ID NO: 657870 - DNA, 17 bp, Homo sapiens
tgttatatcatatgtat

SEQ ID NO: 657871 - DNA, 19 bp, Homo sapiens
tgttcaagaccagcctggt

SEQ ID NO: 657872 - DNA, 18 bp, Homo sapiens
tgttcagctctttccaaa

SEQ ID NO: 657873 - DNA, 12 bp, Homo sapiens
tgttcaggcagg

SEQ ID NO: 657874 - DNA, 16 bp, Homo sapiens
tgttcaggcattccag

SEQ ID NO: 657875 - DNA, 21 bp, Homo sapiens
tgttccactgcaaataaagcc

SEQ ID NO: 657876 - DNA, 18 bp, Homo sapiens
tgttccagctgaggcagg

SEQ ID NO: 657877 - DNA, 23 bp, Homo sapiens
tgttccagctgaggcagggggat

SEQ ID NO: 657878 - DNA, 17 bp, Homo sapiens
tgttcctaacaaaatga

SEQ ID NO: 657879 - DNA, 20 bp, Homo sapiens
tgttcgttgcacagctgttt

SEQ ID NO: 657880 - DNA, 13 bp, Homo sapiens
tgttctaagtgcc

SEQ ID NO: 657881 - DNA, 20 bp, Homo sapiens
tccctgtgtccacctgtggg

SEQ ID NO: 657882 - DNA, 22 bp, Homo sapiens
tccctgtgtccacctgtgggtg

SEQ ID NO: 657883 - DNA, 20 bp, Homo sapiens
tcccttaaggggtatcatgt

SEQ ID NO: 657884 - DNA, 15 bp, Homo sapiens
tcccttactttgctg

SEQ ID NO: 657885 - DNA, 14 bp, Homo sapiens
tcccttgcctctgc

SEQ ID NO: 657886 - DNA, 23 bp, Homo sapiens
tcccttggtgccctcgcctcctc

SEQ ID NO: 657887 - DNA, 18 bp, Homo sapiens
tccgaccacttccagggg

SEQ ID NO: 657888 - DNA, 15 bp, Homo sapiens
tccgcagaagccctg

SEQ ID NO: 657889 - DNA, 19 bp, Homo sapiens
aaatacatgccacatcaaa

SEQ ID NO: 657890 - DNA, 17 bp, Homo sapiens
aaatacatttaaaacat

SEQ ID NO: 657891 - DNA, 12 bp, Homo sapiens
aaataccattta

SEQ ID NO: 657892 - DNA, 11 bp, Homo sapiens
aaatacctcaa

SEQ ID NO: 657893 - DNA, 16 bp, Homo sapiens
aaatacctcaattttt

SEQ ID NO: 657894 - DNA, 15 bp, Homo sapiens
aaatactatttaaga

SEQ ID NO: 657895 - DNA, 16 bp, Homo sapiens
aaatactatttaagat

SEQ ID NO: 657896 - DNA, 18 bp, Homo sapiens
aaatagaataattctttt

SEQ ID NO: 657897 - DNA, 15 bp, Homo sapiens
aaatagatgctgtgt

SEQ ID NO: 657898 - DNA, 20 bp, Homo sapiens
aaataggaatcattcagaaa

SEQ ID NO: 657899 - DNA, 17 bp, Homo sapiens
aaataggggatatttaa

SEQ ID NO: 657900 - DNA, 13 bp, Homo sapiens
aaatagtatacat

SEQ ID NO: 657901 - DNA, 16 bp, Homo sapiens
aaatataacacatttt

SEQ ID NO: 657902 - DNA, 17 bp, Homo sapiens
aaatataacacattttt

SEQ ID NO: 657903 - DNA, 16 bp, Homo sapiens
aaatatacattttcta

SEQ ID NO: 657904 - DNA, 18 bp, Homo sapiens
aaatatatgcctggcaca

SEQ ID NO: 657905 - DNA, 23 bp, Homo sapiens
aaatatattacggaggaacagat

SEQ ID NO: 657906 - DNA, 15 bp, Homo sapiens
aaatatccacccagc

SEQ ID NO: 657907 - DNA, 13 bp, Homo sapiens
aaatatttaatat

SEQ ID NO: 657908 - DNA, 20 bp, Homo sapiens
aaatatttaatatcaaaaga

SEQ ID NO: 657909 - DNA, 14 bp, Homo sapiens
aaatcagttctcaa

SEQ ID NO: 657910 - DNA, 12 bp, Homo sapiens
aaatctattgac

SEQ ID NO: 657911 - DNA, 19 bp, Homo sapiens
aaatctgggtatctttcca

SEQ ID NO: 657912 - DNA, 15 bp, Homo sapiens
aaatctggtcttgtt

SEQ ID NO: 657913 - DNA, 22 bp, Homo sapiens
aaatctggtcttgttagaaaac

SEQ ID NO: 657914 - DNA, 13 bp, Homo sapiens
aaatctttcaaaa

SEQ ID NO: 657915 - DNA, 18 bp, Homo sapiens
aaatgaaaacatgtaata

SEQ ID NO: 657916 - DNA, 20 bp, Homo sapiens
aaatgaaagaaaattgagtt

SEQ ID NO: 657917 - DNA, 14 bp, Homo sapiens
aaatgaaatcttcc

SEQ ID NO: 657918 - DNA, 21 bp, Homo sapiens
aaatgaagggccagcatatat

SEQ ID NO: 657919 - DNA, 18 bp, Homo sapiens
aaatgaattgaaaaacaa

SEQ ID NO: 657920 - DNA, 13 bp, Homo sapiens
aaatgacagattt

SEQ ID NO: 657921 - DNA, 16 bp, Homo sapiens
aaatgacagatttctg

SEQ ID NO: 657922 - DNA, 12 bp, Homo sapiens
aaatgcaataac

SEQ ID NO: 657923 - DNA, 15 bp, Homo sapiens
aaatgcaataatttt

SEQ ID NO: 657924 - DNA, 16 bp, Homo sapiens
aaatgcaataatttta

SEQ ID NO: 657925 - DNA, 20 bp, Homo sapiens
aaatgcatatcctgagccat

SEQ ID NO: 657926 - DNA, 12 bp, Homo sapiens
aaatgcattgaa

SEQ ID NO: 657927 - DNA, 13 bp, Homo sapiens
aaatgccctcttc

SEQ ID NO: 657928 - DNA, 19 bp, Homo sapiens
aaatgctgctgtcagacga

SEQ ID NO: 657929 - DNA, 22 bp, Homo sapiens
aaatgctggtatttgatttcct

SEQ ID NO: 657930 - DNA, 19 bp, Homo sapiens
aaatgcttaaaaaataata

SEQ ID NO: 657931 - DNA, 21 bp, Homo sapiens
aaatggaaagcagagttttca

SEQ ID NO: 657932 - DNA, 15 bp, Homo sapiens
aaatgggaaaaaact

SEQ ID NO: 657933 - DNA, 16 bp, Homo sapiens
aaatgggaaaaaactt

SEQ ID NO: 657934 - DNA, 21 bp, Homo sapiens
aaatgggtgtatataatttta

SEQ ID NO: 657935 - DNA, 18 bp, Homo sapiens
aaatgtaatataatgtat

SEQ ID NO: 657936 - DNA, 15 bp, Homo sapiens
aaatgtataaatata

SEQ ID NO: 657937 - DNA, 17 bp, Homo sapiens
aaatgtataaatataca

SEQ ID NO: 657938 - DNA, 12 bp, Homo sapiens
aaatgtcttggt

SEQ ID NO: 657939 - DNA, 12 bp, Homo sapiens
aaatgtgtgcca

SEQ ID NO: 657940 - DNA, 23 bp, Homo sapiens
aaatgtttcattatgcactttta

SEQ ID NO: 657941 - DNA, 11 bp, Homo sapiens
aaatgtttctt

SEQ ID NO: 657942 - DNA, 15 bp, Homo sapiens
aaatgtttcttttaa

SEQ ID NO: 657943 - DNA, 15 bp, Homo sapiens
aaatgtttttatttt

SEQ ID NO: 657944 - DNA, 17 bp, Homo sapiens
aaatgtttttatttttg

SEQ ID NO: 657945 - DNA, 15 bp, Homo sapiens
aaattaaaacaaata

SEQ ID NO: 657946 - DNA, 13 bp, Homo sapiens
aaattaactgtat

SEQ ID NO: 657947 - DNA, 14 bp, Homo sapiens
aaattaactgtatg

SEQ ID NO: 657948 - DNA, 13 bp, Homo sapiens
aaattaagacttt

SEQ ID NO: 657949 - DNA, 17 bp, Homo sapiens
aaattaatatggcttca

SEQ ID NO: 657950 - DNA, 21 bp, Homo sapiens
aaattaatatggtgtattttt

SEQ ID NO: 657951 - DNA, 20 bp, Homo sapiens
aaattacctttaattttaat

SEQ ID NO: 657952 - DNA, 22 bp, Homo sapiens
aaattactaattttacacatta

SEQ ID NO: 657953 - DNA, 21 bp, Homo sapiens
aaattactttaacattttgga

SEQ ID NO: 657954 - DNA, 12 bp, Homo sapiens
aaattagaaaaa

SEQ ID NO: 657955 - DNA, 18 bp, Homo sapiens
aaattagataaattgtag

SEQ ID NO: 657956 - DNA, 18 bp, Homo sapiens
aaattatggcatttctat

SEQ ID NO: 657957 - DNA, 13 bp, Homo sapiens
aaattatttgcta

SEQ ID NO: 657958 - DNA, 15 bp, Homo sapiens
aaattcagagtcctt

SEQ ID NO: 657959 - DNA, 11 bp, Homo sapiens
aaattcctgta

SEQ ID NO: 657960 - DNA, 21 bp, Homo sapiens
aaattcttctaattgctgtgt

SEQ ID NO: 657961 - DNA, 14 bp, Homo sapiens
aaattgatattata

SEQ ID NO: 657962 - DNA, 21 bp, Homo sapiens
aaattgatattatattaaaca

SEQ ID NO: 657963 - DNA, 15 bp, Homo sapiens
aaattgcatactttg

SEQ ID NO: 657964 - DNA, 13 bp, Homo sapiens
aaattgctatgtt

SEQ ID NO: 657965 - DNA, 21 bp, Homo sapiens
aaattgctatgttactatttt

SEQ ID NO: 657966 - DNA, 23 bp, Homo sapiens
aaattgctgtgctttatggatag

SEQ ID NO: 657967 - DNA, 21 bp, Homo sapiens
aaattgttgtatatcactaaa

SEQ ID NO: 657968 - DNA, 15 bp, Homo sapiens
aaattgtttagtgat

SEQ ID NO: 657969 - DNA, 21 bp, Homo sapiens
aaatttaaaatgtgtgccata

SEQ ID NO: 657970 - DNA, 19 bp, Homo sapiens
aaatttaatccttctttgt

SEQ ID NO: 657971 - DNA, 16 bp, Homo sapiens
aaatttagccgggcgc

SEQ ID NO: 657972 - DNA, 14 bp, Homo sapiens
aaatttatattcat

SEQ ID NO: 657973 - DNA, 14 bp, Homo sapiens
aaattttatatcat

SEQ ID NO: 657974 - DNA, 17 bp, Homo sapiens
aaatttttaggcaaaga

SEQ ID NO: 657975 - DNA, 21 bp, Homo sapiens
aacaaaagcgacccattcaga

SEQ ID NO: 657976 - DNA, 14 bp, Homo sapiens
aacaactatttact

SEQ ID NO: 657977 - DNA, 13 bp, Homo sapiens
aacaagcatgcag

SEQ ID NO: 657978 - DNA, 14 bp, Homo sapiens
aacaagtcattttt

SEQ ID NO: 657979 - DNA, 18 bp, Homo sapiens
aacaagtcatttttgtat

SEQ ID NO: 657980 - DNA, 21 bp, Homo sapiens
aacaagtcatttttgtatttt

SEQ ID NO: 657981 - DNA, 18 bp, Homo sapiens
aacacagcatgtgtattt

SEQ ID NO: 657982 - DNA, 17 bp, Homo sapiens
aacacagttctgggcaa

SEQ ID NO: 657983 - DNA, 22 bp, Homo sapiens
aacacatctggctgcacaggct

SEQ ID NO: 657984 - DNA, 13 bp, Homo sapiens
aacactaaacatt

SEQ ID NO: 657985 - DNA, 21 bp, Homo sapiens
aacactgggggcaccttaaga

SEQ ID NO: 657986 - DNA, 14 bp, Homo sapiens
aacagaaatggaaa

SEQ ID NO: 657987 - DNA, 13 bp, Homo sapiens
aacagaagtggtt

SEQ ID NO: 657988 - DNA, 12 bp, Homo sapiens
aacagaggatat

SEQ ID NO: 657989 - DNA, 18 bp, Homo sapiens
aacagataagcaagagag

SEQ ID NO: 657990 - DNA, 19 bp, Homo sapiens
aacagataagcaagagaga

SEQ ID NO: 657991 - DNA, 14 bp, Homo sapiens
aacagatttggaaa

SEQ ID NO: 657992 - DNA, 17 bp, Homo sapiens
aacagctgcattagaaa

SEQ ID NO: 657993 - DNA, 19 bp, Homo sapiens
aacaggaggtgtgaatgca

SEQ ID NO: 657994 - DNA, 21 bp, Homo sapiens
aacagtatgtgggatattgaa

SEQ ID NO: 657995 - DNA, 16 bp, Homo sapiens
aacagttatttctgtt

SEQ ID NO: 657996 - DNA, 14 bp, Homo sapiens
aacagttgtatgtt

SEQ ID NO: 657997 - DNA, 16 bp, Homo sapiens
aacataaaaactgatt

SEQ ID NO: 657998 - DNA, 17 bp, Homo sapiens
aacataaaaactgattt

SEQ ID NO: 657999 - DNA, 21 bp, Homo sapiens
aacataaagttgtattgcatg

SEQ ID NO: 658000 - DNA, 15 bp, Homo sapiens
aacatacaagaaaat

SEQ ID NO: 658001 - DNA, 17 bp, Homo sapiens
aacatagtgagacactg

SEQ ID NO: 658002 - DNA, 18 bp, Homo sapiens
aacatagtgagacactgt

SEQ ID NO: 658003 - DNA, 12 bp, Homo sapiens
aacatatatgga

SEQ ID NO: 658004 - DNA, 19 bp, Homo sapiens
aacatgcactgatgttgtg

SEQ ID NO: 658005 - DNA, 18 bp, Homo sapiens
aacatgctggtgaatatt

SEQ ID NO: 658006 - DNA, 19 bp, Homo sapiens
aacatgtactacagctata

SEQ ID NO: 658007 - DNA, 15 bp, Homo sapiens
aacattaaatcacag

SEQ ID NO: 658008 - DNA, 14 bp, Homo sapiens
aacattaaggaatt

SEQ ID NO: 658009 - DNA, 17 bp, Homo sapiens
aacattaaggaatttga

SEQ ID NO: 658010 - DNA, 14 bp, Homo sapiens
aagtgcagctcatg

SEQ ID NO: 658011 - DNA, 12 bp, Homo sapiens
aagtgccctcca

SEQ ID NO: 658012 - DNA, 18 bp, Homo sapiens
aagtgccctccaggcttt

SEQ ID NO: 658013 - DNA, 15 bp, Homo sapiens
aagtgcgtgaatgta

SEQ ID NO: 658014 - DNA, 20 bp, Homo sapiens
aagtggcgtgggagccagcc

SEQ ID NO: 658015 - DNA, 13 bp, Homo sapiens
aagtgggcccacc

SEQ ID NO: 658016 - DNA, 15 bp, Homo sapiens
aagtgggcccacccg

SEQ ID NO: 658017 - DNA, 19 bp, Homo sapiens
aagtgggcccacccggtgg

SEQ ID NO: 658018 - DNA, 15 bp, Homo sapiens
aagtgtaaaaaatgt

SEQ ID NO: 658019 - DNA, 19 bp, Homo sapiens
aagtgtataatataaaaaa

SEQ ID NO: 658020 - DNA, 17 bp, Homo sapiens
aagtgtatgcagtattc

SEQ ID NO: 658021 - DNA, 19 bp, Homo sapiens
aagtgtctcactaaagcat

SEQ ID NO: 658022 - DNA, 17 bp, Homo sapiens
aagtgtgggctgggcgt

SEQ ID NO: 658023 - DNA, 16 bp, Homo sapiens
aagtgtgtatatattt

SEQ ID NO: 658024 - DNA, 16 bp, Homo sapiens
aagtgtgtgtagtttt

SEQ ID NO: 658025 - DNA, 19 bp, Homo sapiens
aagtgttaagtttttaatc

SEQ ID NO: 658026 - DNA, 20 bp, Homo sapiens
aagttattggcatggttgtt

SEQ ID NO: 658027 - DNA, 21 bp, Homo sapiens
aagttcatgtccaaacgtcct

SEQ ID NO: 658028 - DNA, 18 bp, Homo sapiens
aagttcattttaaatgaa

SEQ ID NO: 658029 - DNA, 16 bp, Homo sapiens
aagttgtagcagattg

SEQ ID NO: 658030 - DNA, 15 bp, Homo sapiens
aagtttacacttcat

SEQ ID NO: 658031 - DNA, 15 bp, Homo sapiens
aagtttaggtcgagg

SEQ ID NO: 658032 - DNA, 21 bp, Homo sapiens
aagttttaactttaatacagc

SEQ ID NO: 658033 - DNA, 13 bp, Homo sapiens
aagttttgttgta

SEQ ID NO: 658034 - DNA, 15 bp, Homo sapiens
aagtttttagaatgt

SEQ ID NO: 658035 - DNA, 15 bp, Homo sapiens
aagtttttgtttgga

SEQ ID NO: 658036 - DNA, 14 bp, Homo sapiens
aataaaaacaaagt

SEQ ID NO: 658037 - DNA, 20 bp, Homo sapiens
aataaaaacattttgaagtg

SEQ ID NO: 658038 - DNA, 16 bp, Homo sapiens
aataaaaacttttgag

SEQ ID NO: 658039 - DNA, 17 bp, Homo sapiens
aataaacacacagatct

SEQ ID NO: 658040 - DNA, 23 bp, Homo sapiens
aataaactgcaagttcattttaa

SEQ ID NO: 658041 - DNA, 12 bp, Homo sapiens
aataaagccttt

SEQ ID NO: 658042 - DNA, 16 bp, Homo sapiens
aataaagccttttaaa

SEQ ID NO: 658043 - DNA, 12 bp, Homo sapiens
aataaaggcagc

SEQ ID NO: 658044 - DNA, 14 bp, Homo sapiens
aataaaggcagctg

SEQ ID NO: 658045 - DNA, 15 bp, Homo sapiens
aataaaggcagctgc

SEQ ID NO: 658046 - DNA, 17 bp, Homo sapiens
aataaaggcagctgcct

SEQ ID NO: 658047 - DNA, 20 bp, Homo sapiens
aataaagtcattattaggaa

SEQ ID NO: 658048 - DNA, 14 bp, Homo sapiens
aataaataaaaatg

SEQ ID NO: 658049 - DNA, 23 bp, Homo sapiens
aataaataaaattcatttctaca

SEQ ID NO: 658050 - DNA, 14 bp, Homo sapiens
aataaataatttta

SEQ ID NO: 658051 - DNA, 22 bp, Homo sapiens
aataaatctcttctttgctgca

SEQ ID NO: 658052 - DNA, 14 bp, Homo sapiens
aataaatctttcaa

SEQ ID NO: 658053 - DNA, 15 bp, Homo sapiens
aataaatctttcaaa

SEQ ID NO: 658054 - DNA, 16 bp, Homo sapiens
aataaattatggcatt

SEQ ID NO: 658055 - DNA, 14 bp, Homo sapiens
aataacactgtatt

SEQ ID NO: 658056 - DNA, 18 bp, Homo sapiens
aataacccataattgaag

SEQ ID NO: 658057 - DNA, 13 bp, Homo sapiens
aataactctggga

SEQ ID NO: 658058 - DNA, 13 bp, Homo sapiens
aataagacaagag

SEQ ID NO: 658059 - DNA, 21 bp, Homo sapiens
aataagacaagagatctacac

SEQ ID NO: 658060 - DNA, 14 bp, Homo sapiens
aataagctaaagag

SEQ ID NO: 658061 - DNA, 19 bp, Homo sapiens
aataatgctacaattttaa

SEQ ID NO: 658062 - DNA, 12 bp, Homo sapiens
aataatggcact

SEQ ID NO: 658063 - DNA, 17 bp, Homo sapiens
aataattcttttctgag

SEQ ID NO: 658064 - DNA, 23 bp, Homo sapiens
aataattttaatattcttttgtt

SEQ ID NO: 658065 - DNA, 13 bp, Homo sapiens
aatacaaggtata

SEQ ID NO: 658066 - DNA, 19 bp, Homo sapiens
aatacaaggtataataaaa

SEQ ID NO: 658067 - DNA, 22 bp, Homo sapiens
aatacaaggtataataaaatta

SEQ ID NO: 658068 - DNA, 14 bp, Homo sapiens
aatacacatttgct

SEQ ID NO: 658069 - DNA, 20 bp, Homo sapiens
aatacagctgaagtcaaaat

SEQ ID NO: 658070 - DNA, 18 bp, Homo sapiens
aatacagtctagtttcct

SEQ ID NO: 658071 - DNA, 14 bp, Homo sapiens
aatacagttatttc

SEQ ID NO: 658072 - DNA, 18 bp, Homo sapiens
aatacatgccacatcaaa

SEQ ID NO: 658073 - DNA, 20 bp, Homo sapiens
aatacatttaaaacattaaa

SEQ ID NO: 658074 - DNA, 12 bp, Homo sapiens
aatacatttgta

SEQ ID NO: 658075 - DNA, 19 bp, Homo sapiens
aataccacatcaaataaga

SEQ ID NO: 658076 - DNA, 21 bp, Homo sapiens
aataccacatcaaataagaaa

SEQ ID NO: 658077 - DNA, 14 bp, Homo sapiens
aatactttatttct

SEQ ID NO: 658078 - DNA, 23 bp, Homo sapiens
aatactttgcagcacagctgaga

SEQ ID NO: 658079 - DNA, 15 bp, Homo sapiens
aatagacacatacat

SEQ ID NO: 658080 - DNA, 22 bp, Homo sapiens
aatagatataaatttttaagag

SEQ ID NO: 658081 - DNA, 20 bp, Homo sapiens
aataggaatcattcagaaat

SEQ ID NO: 658082 - DNA, 21 bp, Homo sapiens
aataggaatcttcactagaag

SEQ ID NO: 658083 - DNA, 22 bp, Homo sapiens
aataggctgatgggcaaaaaac

SEQ ID NO: 658084 - DNA, 18 bp, Homo sapiens
aataggctttttaggaac

SEQ ID NO: 658085 - DNA, 19 bp, Homo sapiens
aatagtcaccttcatgatt

SEQ ID NO: 658086 - DNA, 20 bp, Homo sapiens
aatagtgcttaaaaatcatt

SEQ ID NO: 658087 - DNA, 14 bp, Homo sapiens
aatagtttgtctat

SEQ ID NO: 658088 - DNA, 17 bp, Homo sapiens
aatagtttgtctatttt

SEQ ID NO: 658089 - DNA, 23 bp, Homo sapiens
aatagtttgtctattttaaaata

SEQ ID NO: 658090 - DNA, 11 bp, Homo sapiens
aatataaaaaa

SEQ ID NO: 658091 - DNA, 15 bp, Homo sapiens
aatataaaattatga

SEQ ID NO: 658092 - DNA, 23 bp, Homo sapiens
aatataagacatttgtttgctgt

SEQ ID NO: 658093 - DNA, 18 bp, Homo sapiens
aatataatttataagcat

SEQ ID NO: 658094 - DNA, 19 bp, Homo sapiens
aatatacattttctaaata

SEQ ID NO: 658095 - DNA, 20 bp, Homo sapiens
aatatacattttctaaataa

SEQ ID NO: 658096 - DNA, 21 bp, Homo sapiens
aatatacattttctaaataaa

SEQ ID NO: 658097 - DNA, 21 bp, Homo sapiens
aatataccttttgcatttctt

SEQ ID NO: 658098 - DNA, 22 bp, Homo sapiens
aatataggtcctgtgttaaaca

SEQ ID NO: 658099 - DNA, 21 bp, Homo sapiens
aatatatagtgggtacatcaa

SEQ ID NO: 658100 - DNA, 22 bp, Homo sapiens
aatatatagtgggtacatcaag

SEQ ID NO: 658101 - DNA, 21 bp, Homo sapiens
aatatatgaagacaataattc

SEQ ID NO: 658102 - DNA, 17 bp, Homo sapiens
aatatatgcctggcaca

SEQ ID NO: 658103 - DNA, 23 bp, Homo sapiens
aatatattcctgagatttcctcc

SEQ ID NO: 658104 - DNA, 12 bp, Homo sapiens
aatatatttctt

SEQ ID NO: 658105 - DNA, 13 bp, Homo sapiens
aatatatttcttc

SEQ ID NO: 658106 - DNA, 17 bp, Homo sapiens
aatatcaaaagaaaatt

SEQ ID NO: 658107 - DNA, 12 bp, Homo sapiens
aatatcaaataa

SEQ ID NO: 658108 - DNA, 15 bp, Homo sapiens
aatatcaaataaaat

SEQ ID NO: 658109 - DNA, 16 bp, Homo sapiens
aatatcagctttgata

SEQ ID NO: 658110 - DNA, 13 bp, Homo sapiens
aatatcataaagc

SEQ ID NO: 658111 - DNA, 18 bp, Homo sapiens
aatatcataaagcatttt

SEQ ID NO: 658112 - DNA, 22 bp, Homo sapiens
aatatctgttattcaaatttga

SEQ ID NO: 658113 - DNA, 18 bp, Homo sapiens
aatatcttcagctctttt

SEQ ID NO: 658114 - DNA, 13 bp, Homo sapiens
aatatgaatctat

SEQ ID NO: 658115 - DNA, 17 bp, Homo sapiens
aatatgacggaagaaca

SEQ ID NO: 658116 - DNA, 19 bp, Homo sapiens
aatatgacggaagaacata

SEQ ID NO: 658117 - DNA, 15 bp, Homo sapiens
aatatgccactgacc

SEQ ID NO: 658118 - DNA, 17 bp, Homo sapiens
aatatgccttaatttag

SEQ ID NO: 658119 - DNA, 22 bp, Homo sapiens
aatatggcttcaccaagaagca

SEQ ID NO: 658120 - DNA, 18 bp, Homo sapiens
aatatggtcttttggtta

SEQ ID NO: 658121 - DNA, 19 bp, Homo sapiens
aatatgtaagaacacattt

SEQ ID NO: 658122 - DNA, 23 bp, Homo sapiens
aatatgtaatttcaaaatacatt

SEQ ID NO: 658123 - DNA, 22 bp, Homo sapiens
aatattataactcatttgttgt

SEQ ID NO: 658124 - DNA, 20 bp, Homo sapiens
aatattcagggtaaatagga

SEQ ID NO: 658125 - DNA, 18 bp, Homo sapiens
aatattcatgcttgccat

SEQ ID NO: 658126 - DNA, 12 bp, Homo sapiens
aatattccaagc

SEQ ID NO: 658127 - DNA, 13 bp, Homo sapiens
aatattcttttgt

SEQ ID NO: 658128 - DNA, 17 bp, Homo sapiens
aatattcttttgtttcc

SEQ ID NO: 658129 - DNA, 23 bp, Homo sapiens
aatattgattgggaaaacatttg

SEQ ID NO: 658130 - DNA, 14 bp, Homo sapiens
acacaattgtttta

SEQ ID NO: 658131 - DNA, 11 bp, Homo sapiens
acacactgacc

SEQ ID NO: 658132 - DNA, 19 bp, Homo sapiens
acacactgtcatgcttcat

SEQ ID NO: 658133 - DNA, 16 bp, Homo sapiens
acacaggctgtcctta

SEQ ID NO: 658134 - DNA, 19 bp, Homo sapiens
acacatatacatatgagaa

SEQ ID NO: 658135 - DNA, 14 bp, Homo sapiens
acacatttgaaaca

SEQ ID NO: 658136 - DNA, 17 bp, Homo sapiens
acacatttgctactgtt

SEQ ID NO: 658137 - DNA, 15 bp, Homo sapiens
acaccattttgtaaa

SEQ ID NO: 658138 - DNA, 15 bp, Homo sapiens
acacccttagaaaat

SEQ ID NO: 658139 - DNA, 21 bp, Homo sapiens
acacctaaaggtgtatttaaa

SEQ ID NO: 658140 - DNA, 22 bp, Homo sapiens
acacctaaaggtgtatttaaac

SEQ ID NO: 658141 - DNA, 17 bp, Homo sapiens
acacggggctcgggcct

SEQ ID NO: 658142 - DNA, 13 bp, Homo sapiens
acactaaacattc

SEQ ID NO: 658143 - DNA, 17 bp, Homo sapiens
acactgtagctacattt

SEQ ID NO: 658144 - DNA, 18 bp, Homo sapiens
acactgtagctacatttt

SEQ ID NO: 658145 - DNA, 21 bp, Homo sapiens
acactgtagctacattttcag

SEQ ID NO: 658146 - DNA, 17 bp, Homo sapiens
acactgtgcagacccag

SEQ ID NO: 658147 - DNA, 17 bp, Homo sapiens
acactgtggccaggcct

SEQ ID NO: 658148 - DNA, 18 bp, Homo sapiens
acactgtggccaggcctt

SEQ ID NO: 658149 - DNA, 19 bp, Homo sapiens
acacttagtgatcatttaa

SEQ ID NO: 658150 - DNA, 20 bp, Homo sapiens
acacttagtgatcatttaaa

SEQ ID NO: 658151 - DNA, 24 bp, Homo sapiens
acacttgaagcctaaatttgtgct

SEQ ID NO: 658152 - DNA, 22 bp, Homo sapiens
acagaaacatgtcttgactgtt

SEQ ID NO: 658153 - DNA, 20 bp, Homo sapiens
acagaaagagactccgtctc

SEQ ID NO: 658154 - DNA, 14 bp, Homo sapiens
acagaacaggaggt

SEQ ID NO: 658155 - DNA, 16 bp, Homo sapiens
acagaagcctgtttca

SEQ ID NO: 658156 - DNA, 15 bp, Homo sapiens
acagacaaaaacaag

SEQ ID NO: 658157 - DNA, 20 bp, Homo sapiens
acagaccatattacctggat

SEQ ID NO: 658158 - DNA, 16 bp, Homo sapiens
acagacctcagtttta

SEQ ID NO: 658159 - DNA, 20 bp, Homo sapiens
acagactggatgtaccacca

SEQ ID NO: 658160 - DNA, 11 bp, Homo sapiens
acagagaccta

SEQ ID NO: 658161 - DNA, 22 bp, Homo sapiens
acagagatggtgtgttctgcaa

SEQ ID NO: 658162 - DNA, 13 bp, Homo sapiens
acagaggggagca

SEQ ID NO: 658163 - DNA, 19 bp, Homo sapiens
acagaggtattaaaactaa

SEQ ID NO: 658164 - DNA, 17 bp, Homo sapiens
acagatctcctggcaaa

SEQ ID NO: 658165 - DNA, 17 bp, Homo sapiens
acagatgaccataattt

SEQ ID NO: 658166 - DNA, 15 bp, Homo sapiens
acagatttcatacct

SEQ ID NO: 658167 - DNA, 17 bp, Homo sapiens
acagatttcatacctca

SEQ ID NO: 658168 - DNA, 14 bp, Homo sapiens
acagccctgcctga

SEQ ID NO: 658169 - DNA, 14 bp, Homo sapiens
acagcctcttactt

SEQ ID NO: 658170 - DNA, 22 bp, Homo sapiens
acagcggtcagatagcatcaga

SEQ ID NO: 658171 - DNA, 15 bp, Homo sapiens
acagcgtccctggcg

SEQ ID NO: 658172 - DNA, 14 bp, Homo sapiens
acagctcattaaac

SEQ ID NO: 658173 - DNA, 16 bp, Homo sapiens
acagctcattaaactt

SEQ ID NO: 658174 - DNA, 17 bp, Homo sapiens
acagctcattaaacttt

SEQ ID NO: 658175 - DNA, 17 bp, Homo sapiens
acagctgataaatttaa

SEQ ID NO: 658176 - DNA, 16 bp, Homo sapiens
acagctgcattagaaa

SEQ ID NO: 658177 - DNA, 20 bp, Homo sapiens
acagctgcattagaaaaaga

SEQ ID NO: 658178 - DNA, 16 bp, Homo sapiens
acagctgggagcctgg

SEQ ID NO: 658179 - DNA, 16 bp, Homo sapiens
acaggaggtgtgaatg

SEQ ID NO: 658180 - DNA, 23 bp, Homo sapiens
acaggctgaaatatccacccagc

SEQ ID NO: 658181 - DNA, 14 bp, Homo sapiens
acaggctgtcctta

SEQ ID NO: 658182 - DNA, 20 bp, Homo sapiens
acagggccagtggggcctgt

SEQ ID NO: 658183 - DNA, 15 bp, Homo sapiens
acaggtaactaattg

SEQ ID NO: 658184 - DNA, 11 bp, Homo sapiens
acagtacaatc

SEQ ID NO: 658185 - DNA, 14 bp, Homo sapiens
acagtcatcatcag

SEQ ID NO: 658186 - DNA, 17 bp, Homo sapiens
acagtcatcatcagggc

SEQ ID NO: 658187 - DNA, 19 bp, Homo sapiens
acagtcatcatcagggcct

SEQ ID NO: 658188 - DNA, 20 bp, Homo sapiens
acagtcatcatcagggcctg

SEQ ID NO: 658189 - DNA, 14 bp, Homo sapiens
acagtcttatttaa

SEQ ID NO: 658190 - DNA, 17 bp, Homo sapiens
acagtcttatttaacca

SEQ ID NO: 658191 - DNA, 16 bp, Homo sapiens
acagtgaagttttact

SEQ ID NO: 658192 - DNA, 15 bp, Homo sapiens
acagtgactccctgg

SEQ ID NO: 658193 - DNA, 18 bp, Homo sapiens
acagtggggctgcaggca

SEQ ID NO: 658194 - DNA, 20 bp, Homo sapiens
acagtggggctgcaggcagg

SEQ ID NO: 658195 - DNA, 15 bp, Homo sapiens
acagttgattcaaca

SEQ ID NO: 658196 - DNA, 22 bp, Homo sapiens
acagttgattcaacaaagtatt

SEQ ID NO: 658197 - DNA, 23 bp, Homo sapiens
acagttgctgtgaactttcatgt

SEQ ID NO: 658198 - DNA, 18 bp, Homo sapiens
acagttgctgttgtgtga

SEQ ID NO: 658199 - DNA, 19 bp, Homo sapiens
acataaaaactgatttgct

SEQ ID NO: 658200 - DNA, 16 bp, Homo sapiens
acataacataaatttt

SEQ ID NO: 658201 - DNA, 18 bp, Homo sapiens
acataagcttccatttta

SEQ ID NO: 658202 - DNA, 16 bp, Homo sapiens
acataaggatgacttt

SEQ ID NO: 658203 - DNA, 20 bp, Homo sapiens
acataatttcagtgggaaat

SEQ ID NO: 658204 - DNA, 18 bp, Homo sapiens
acatacgatttaaggtat

SEQ ID NO: 658205 - DNA, 19 bp, Homo sapiens
acatacgatttaaggtatt

SEQ ID NO: 658206 - DNA, 19 bp, Homo sapiens
acataggtcataaagcatt

SEQ ID NO: 658207 - DNA, 13 bp, Homo sapiens
acatagtgaaaat

SEQ ID NO: 658208 - DNA, 14 bp, Homo sapiens
acatagtgaaaatt

SEQ ID NO: 658209 - DNA, 19 bp, Homo sapiens
acatatgagaatatacctt

SEQ ID NO: 658210 - DNA, 19 bp, Homo sapiens
acatatgctgatcttttaa

SEQ ID NO: 658211 - DNA, 18 bp, Homo sapiens
acatattgtatatatatt

SEQ ID NO: 658212 - DNA, 17 bp, Homo sapiens
acatcaaacctttgagt

SEQ ID NO: 658213 - DNA, 13 bp, Homo sapiens
acatcaaataaga

SEQ ID NO: 658214 - DNA, 18 bp, Homo sapiens
acatcaaataagaaataa

SEQ ID NO: 658215 - DNA, 20 bp, Homo sapiens
acatcaagtccatctgacaa

SEQ ID NO: 658216 - DNA, 21 bp, Homo sapiens
acatcaagtccatctgacaaa

SEQ ID NO: 658217 - DNA, 16 bp, Homo sapiens
acatcaggaaagagag

SEQ ID NO: 658218 - DNA, 21 bp, Homo sapiens
acatccagagctttgtcgtat

SEQ ID NO: 658219 - DNA, 22 bp, Homo sapiens
acatctgttatcaaactgctgt

SEQ ID NO: 658220 - DNA, 20 bp, Homo sapiens
acatgaaacctacacactgt

SEQ ID NO: 658221 - DNA, 11 bp, Homo sapiens
acatgaaagcg

SEQ ID NO: 658222 - DNA, 22 bp, Homo sapiens
acatgaagcaattagtctgaaa

SEQ ID NO: 658223 - DNA, 13 bp, Homo sapiens
acatgcaataaaa

SEQ ID NO: 658224 - DNA, 13 bp, Homo sapiens
acatgctgcctgg

SEQ ID NO: 658225 - DNA, 22 bp, Homo sapiens
acatgctgcctggcacagacca

SEQ ID NO: 658226 - DNA, 21 bp, Homo sapiens
acatgctggtgaatattttca

SEQ ID NO: 658227 - DNA, 22 bp, Homo sapiens
acatggctccggcctctgcctt

SEQ ID NO: 658228 - DNA, 21 bp, Homo sapiens
acatgggagcttattgctaat

SEQ ID NO: 658229 - DNA, 20 bp, Homo sapiens
acatggttgtgacctgagga

SEQ ID NO: 658230 - DNA, 20 bp, Homo sapiens
acatgtaataaaaagtatat

SEQ ID NO: 658231 - DNA, 23 bp, Homo sapiens
acatgtactacagctatatttga

SEQ ID NO: 658232 - DNA, 12 bp, Homo sapiens
acatgtcaatct

SEQ ID NO: 658233 - DNA, 22 bp, Homo sapiens
acatgtcctaattcttctgtcc

SEQ ID NO: 658234 - DNA, 13 bp, Homo sapiens
acatgtcttccat

SEQ ID NO: 658235 - DNA, 18 bp, Homo sapiens
acatgtgaaaagaataga

SEQ ID NO: 658236 - DNA, 23 bp, Homo sapiens
acatgtgatacattttttaagct

SEQ ID NO: 658237 - DNA, 20 bp, Homo sapiens
acatgttaatgacaatattc

SEQ ID NO: 658238 - DNA, 20 bp, Homo sapiens
acattaaatgcaataatttt

SEQ ID NO: 658239 - DNA, 14 bp, Homo sapiens
acattactttttat

SEQ ID NO: 658240 - DNA, 19 bp, Homo sapiens
acattagattttattttac

SEQ ID NO: 658241 - DNA, 21 bp, Homo sapiens
acattataacaactatttact

SEQ ID NO: 658242 - DNA, 19 bp, Homo sapiens
acattccctctaatttgaa

SEQ ID NO: 658243 - DNA, 20 bp, Homo sapiens
acattcgggaccaatatata

SEQ ID NO: 658244 - DNA, 17 bp, Homo sapiens
acattgccaagtcagat

SEQ ID NO: 658245 - DNA, 10 bp, Homo sapiens
acatttaaaa

SEQ ID NO: 658246 - DNA, 14 bp, Homo sapiens
acatttaaaacatt

SEQ ID NO: 658247 - DNA, 22 bp, Homo sapiens
acatttaaaacattaaaatata

SEQ ID NO: 658248 - DNA, 17 bp, Homo sapiens
acatttaaaattgctat

SEQ ID NO: 658249 - DNA, 16 bp, Homo sapiens
acatttaatatcttca

SEQ ID NO: 658250 - DNA, 20 bp, Homo sapiens
actgctgatcgtagaaaatt

SEQ ID NO: 658251 - DNA, 17 bp, Homo sapiens
actgctgctagagccag

SEQ ID NO: 658252 - DNA, 23 bp, Homo sapiens
actgctgtcgttgttgtggaagc

SEQ ID NO: 658253 - DNA, 21 bp, Homo sapiens
actgcttcccttactttgctg

SEQ ID NO: 658254 - DNA, 23 bp, Homo sapiens
actggaaaactgctactatctgt

SEQ ID NO: 658255 - DNA, 20 bp, Homo sapiens
actggaggaggcctgtccca

SEQ ID NO: 658256 - DNA, 21 bp, Homo sapiens
actggaggaggcctgtcccaa

SEQ ID NO: 658257 - DNA, 11 bp, Homo sapiens
actggaggcag

SEQ ID NO: 658258 - DNA, 21 bp, Homo sapiens
actggagttccttatccctct

SEQ ID NO: 658259 - DNA, 23 bp, Homo sapiens
actggcactggtggtttttgctc

SEQ ID NO: 658260 - DNA, 20 bp, Homo sapiens
actggcccctaggctgctgc

SEQ ID NO: 658261 - DNA, 12 bp, Homo sapiens
actgggccctga

SEQ ID NO: 658262 - DNA, 16 bp, Homo sapiens
actgggtttcaagaaa

SEQ ID NO: 658263 - DNA, 20 bp, Homo sapiens
actgggtttcaagaaaatct

SEQ ID NO: 658264 - DNA, 22 bp, Homo sapiens
actgggtttcaagaaaatcttt

SEQ ID NO: 658265 - DNA, 13 bp, Homo sapiens
actgtaagggatt

SEQ ID NO: 658266 - DNA, 22 bp, Homo sapiens
actgtaatacgtagctctctta

SEQ ID NO: 658267 - DNA, 16 bp, Homo sapiens
actgtacatttaaaat

SEQ ID NO: 658268 - DNA, 17 bp, Homo sapiens
actgtagctacattttc

SEQ ID NO: 658269 - DNA, 21 bp, Homo sapiens
actgtagctacattttcagaa

SEQ ID NO: 658270 - DNA, 22 bp, Homo sapiens
actgtagctcaagtttaaaagc

SEQ ID NO: 658271 - DNA, 14 bp, Homo sapiens
actgtatcattttc

SEQ ID NO: 658272 - DNA, 17 bp, Homo sapiens
actgtatgtgtgtaggt

SEQ ID NO: 658273 - DNA, 22 bp, Homo sapiens
actgtatgtgtgtaggttatct

SEQ ID NO: 658274 - DNA, 20 bp, Homo sapiens
actgtattcgtgcatttttg

SEQ ID NO: 658275 - DNA, 18 bp, Homo sapiens
actgtcccaaggaggggg

SEQ ID NO: 658276 - DNA, 23 bp, Homo sapiens
actgtgaggccatacttgtgaaa

SEQ ID NO: 658277 - DNA, 18 bp, Homo sapiens
actgtggaaggcctccct

SEQ ID NO: 658278 - DNA, 18 bp, Homo sapiens
actgtggtctggtgttcc

SEQ ID NO: 658279 - DNA, 15 bp, Homo sapiens
actgttactgggccc

SEQ ID NO: 658280 - DNA, 19 bp, Homo sapiens
actgttctcctgaatattt

SEQ ID NO: 658281 - DNA, 13 bp, Homo sapiens
actgttctgagaa

SEQ ID NO: 658282 - DNA, 16 bp, Homo sapiens
acttaaaaaatcagaa

SEQ ID NO: 658283 - DNA, 22 bp, Homo sapiens
acttaaaataggggatatttaa

SEQ ID NO: 658284 - DNA, 21 bp, Homo sapiens
acttactttaattactggaat

SEQ ID NO: 658285 - DNA, 12 bp, Homo sapiens
acttagaaaagt

SEQ ID NO: 658286 - DNA, 18 bp, Homo sapiens
acttagcgtcaagacatt

SEQ ID NO: 658287 - DNA, 23 bp, Homo sapiens
acttagcgtcaagacatttgctg

SEQ ID NO: 658288 - DNA, 18 bp, Homo sapiens
acttaggactagaagatt

SEQ ID NO: 658289 - DNA, 18 bp, Homo sapiens
acttagtgatcatttaaa

SEQ ID NO: 658290 - DNA, 15 bp, Homo sapiens
acttatagattgaaa

SEQ ID NO: 658291 - DNA, 20 bp, Homo sapiens
acttatctcgaatttgaaga

SEQ ID NO: 658292 - DNA, 15 bp, Homo sapiens
acttatgtttttaaa

SEQ ID NO: 658293 - DNA, 15 bp, Homo sapiens
acttattgaccattt

SEQ ID NO: 658294 - DNA, 21 bp, Homo sapiens
acttattttgtcttattctta

SEQ ID NO: 658295 - DNA, 15 bp, Homo sapiens
acttcacccgagttc

SEQ ID NO: 658296 - DNA, 22 bp, Homo sapiens
acttcagtgtggtacaaggtgg

SEQ ID NO: 658297 - DNA, 23 bp, Homo sapiens
acttcatttttaagaaaggaagc

SEQ ID NO: 658298 - DNA, 20 bp, Homo sapiens
acttccaggggaacctgcca

SEQ ID NO: 658299 - DNA, 20 bp, Homo sapiens
acttccatccctgcttattt

SEQ ID NO: 658300 - DNA, 13 bp, Homo sapiens
acttcccaccctg

SEQ ID NO: 658301 - DNA, 14 bp, Homo sapiens
acttcccaccctgc

SEQ ID NO: 658302 - DNA, 19 bp, Homo sapiens
acttcctttgcccttcctc

SEQ ID NO: 658303 - DNA, 23 bp, Homo sapiens
acttcctttgcccttcctcctgc

SEQ ID NO: 658304 - DNA, 17 bp, Homo sapiens
acttctacctgccctca

SEQ ID NO: 658305 - DNA, 20 bp, Homo sapiens
acttctcaaagagaattgta

SEQ ID NO: 658306 - DNA, 18 bp, Homo sapiens
acttctgcaacaagcatg

SEQ ID NO: 658307 - DNA, 14 bp, Homo sapiens
acttctgctggcat

SEQ ID NO: 658308 - DNA, 17 bp, Homo sapiens
acttcttacgcaatgct

SEQ ID NO: 658309 - DNA, 11 bp, Homo sapiens
acttcttcctg

SEQ ID NO: 658310 - DNA, 17 bp, Homo sapiens
acttgagacaatgtttt

SEQ ID NO: 658311 - DNA, 20 bp, Homo sapiens
acttgatagcaaacactggg

SEQ ID NO: 658312 - DNA, 16 bp, Homo sapiens
acttgatggctgcgaa

SEQ ID NO: 658313 - DNA, 22 bp, Homo sapiens
acttgatgtacataactcctgt

SEQ ID NO: 658314 - DNA, 15 bp, Homo sapiens
acttgcccaggtcac

SEQ ID NO: 658315 - DNA, 19 bp, Homo sapiens
acttggggacataatttca

SEQ ID NO: 658316 - DNA, 19 bp, Homo sapiens
acttgtacaaacagtattt

SEQ ID NO: 658317 - DNA, 23 bp, Homo sapiens
acttgtatatatggatcagagga

SEQ ID NO: 658318 - DNA, 21 bp, Homo sapiens
acttgtgaaacgtctggactg

SEQ ID NO: 658319 - DNA, 18 bp, Homo sapiens
acttgttttggatggctt

SEQ ID NO: 658320 - DNA, 13 bp, Homo sapiens
actttaatacagc

SEQ ID NO: 658321 - DNA, 19 bp, Homo sapiens
actttactgcctgaataaa

SEQ ID NO: 658322 - DNA, 17 bp, Homo sapiens
actttagtattaaatca

SEQ ID NO: 658323 - DNA, 13 bp, Homo sapiens
actttatgtagtt

SEQ ID NO: 658324 - DNA, 18 bp, Homo sapiens
actttattaagtaaaatc

SEQ ID NO: 658325 - DNA, 12 bp, Homo sapiens
actttatttctg

SEQ ID NO: 658326 - DNA, 20 bp, Homo sapiens
actttcaattgtcacttttt

SEQ ID NO: 658327 - DNA, 13 bp, Homo sapiens
actttcaggggct

SEQ ID NO: 658328 - DNA, 22 bp, Homo sapiens
actttcatattttaaacagagg

SEQ ID NO: 658329 - DNA, 21 bp, Homo sapiens
actttcccaggttctgtttat

SEQ ID NO: 658330 - DNA, 15 bp, Homo sapiens
actttctatgtgaca

SEQ ID NO: 658331 - DNA, 16 bp, Homo sapiens
actttctatgtgacat

SEQ ID NO: 658332 - DNA, 20 bp, Homo sapiens
actttgccactgctgtattt

SEQ ID NO: 658333 - DNA, 19 bp, Homo sapiens
actttgctgttccttactt

SEQ ID NO: 658334 - DNA, 19 bp, Homo sapiens
actttgggaaaacatgtta

SEQ ID NO: 658335 - DNA, 21 bp, Homo sapiens
actttgtaaaaatcttttgaa

SEQ ID NO: 658336 - DNA, 17 bp, Homo sapiens
actttgtaatttttgct

SEQ ID NO: 658337 - DNA, 19 bp, Homo sapiens
actttgtcgtggttcttaa

SEQ ID NO: 658338 - DNA, 23 bp, Homo sapiens
actttgtcgtggttcttaaatgt

SEQ ID NO: 658339 - DNA, 13 bp, Homo sapiens
acttttaatttaa

SEQ ID NO: 658340 - DNA, 21 bp, Homo sapiens
acttttatgcagcaaatatat

SEQ ID NO: 658341 - DNA, 17 bp, Homo sapiens
acttttcaataaatcag

SEQ ID NO: 658342 - DNA, 17 bp, Homo sapiens
acttttggattttatgg

SEQ ID NO: 658343 - DNA, 21 bp, Homo sapiens
actttttttaaccattattat

SEQ ID NO: 658344 - DNA, 17 bp, Homo sapiens
acttttttttctctctt

SEQ ID NO: 658345 - DNA, 19 bp, Homo sapiens
acttttttttctctctttt

SEQ ID NO: 658346 - DNA, 16 bp, Homo sapiens
agaaaaaaatactatt

SEQ ID NO: 658347 - DNA, 13 bp, Homo sapiens
agaaaacaaaatt

SEQ ID NO: 658348 - DNA, 19 bp, Homo sapiens
agaaaacctaagcaaactt

SEQ ID NO: 658349 - DNA, 16 bp, Homo sapiens
agaaaatagataattt

SEQ ID NO: 658350 - DNA, 11 bp, Homo sapiens
agaaaatgtag

SEQ ID NO: 658351 - DNA, 18 bp, Homo sapiens
agaaaatttgctttaatt

SEQ ID NO: 658352 - DNA, 16 bp, Homo sapiens
agaaacactgcaaatt

SEQ ID NO: 658353 - DNA, 22 bp, Homo sapiens
agaaacactgcaaattttaact

SEQ ID NO: 658354 - DNA, 19 bp, Homo sapiens
agaaaccacagtcttccca

SEQ ID NO: 658355 - DNA, 23 bp, Homo sapiens
agaaaccttccaatgcttctgtt

SEQ ID NO: 658356 - DNA, 14 bp, Homo sapiens
agaaaccttgctct

SEQ ID NO: 658357 - DNA, 21 bp, Homo sapiens
agaaactgaaaaatatctggt

SEQ ID NO: 658358 - DNA, 16 bp, Homo sapiens
agaaactgagaccaaa

SEQ ID NO: 658359 - DNA, 16 bp, Homo sapiens
agaaagatttgatgta

SEQ ID NO: 658360 - DNA, 11 bp, Homo sapiens
agaaaggaagt

SEQ ID NO: 658361 - DNA, 17 bp, Homo sapiens
agaaaggctctattcca

SEQ ID NO: 658362 - DNA, 18 bp, Homo sapiens
agaaagtcaaaaaattat

SEQ ID NO: 658363 - DNA, 20 bp, Homo sapiens
agaaataatgctacaatttt

SEQ ID NO: 658364 - DNA, 17 bp, Homo sapiens
agaaatacagtactgtt

SEQ ID NO: 658365 - DNA, 16 bp, Homo sapiens
agaaatataacacatt

SEQ ID NO: 658366 - DNA, 18 bp, Homo sapiens
agaaatataacacatttt

SEQ ID NO: 658367 - DNA, 17 bp, Homo sapiens
agaaatattaagcatgt

SEQ ID NO: 658368 - DNA, 22 bp, Homo sapiens
agaaatgcatatttgccacaaa

SEQ ID NO: 658369 - DNA, 22 bp, Homo sapiens
agccatgtataaccaagtgtgc

SEQ ID NO: 658370 - DNA, 13 bp, Homo sapiens
agcccaccctgct

SEQ ID NO: 658371 - DNA, 19 bp, Homo sapiens
agcccaccctgctgctggt

SEQ ID NO: 658372 - DNA, 22 bp, Homo sapiens
agcccaccctgctgctggtgca

SEQ ID NO: 658373 - DNA, 14 bp, Homo sapiens
agcccacctgctcc

SEQ ID NO: 658374 - DNA, 19 bp, Homo sapiens
agcccacctgctcccaggc

SEQ ID NO: 658375 - DNA, 18 bp, Homo sapiens
agcccacgctcaccccct

SEQ ID NO: 658376 - DNA, 23 bp, Homo sapiens
agcccagcttggccctttccttc

SEQ ID NO: 658377 - DNA, 16 bp, Homo sapiens
agcccatggcccccaa

SEQ ID NO: 658378 - DNA, 21 bp, Homo sapiens
agcccatggcccccaataaag

SEQ ID NO: 658379 - DNA, 23 bp, Homo sapiens
agcccatggcccccaataaaggc

SEQ ID NO: 658380 - DNA, 17 bp, Homo sapiens
agccccacatgtccagc

SEQ ID NO: 658381 - DNA, 19 bp, Homo sapiens
agccctaagtggctgcctt

SEQ ID NO: 658382 - DNA, 20 bp, Homo sapiens
agccctaagtggctgccttc

SEQ ID NO: 658383 - DNA, 22 bp, Homo sapiens
agccctcccactttgctgttcc

SEQ ID NO: 658384 - DNA, 14 bp, Homo sapiens
agccctctcctccc

SEQ ID NO: 658385 - DNA, 21 bp, Homo sapiens
agccctctcctccctctgtcc

SEQ ID NO: 658386 - DNA, 18 bp, Homo sapiens
agccctggcctggctggg

SEQ ID NO: 658387 - DNA, 13 bp, Homo sapiens
agcctaaatttgt

SEQ ID NO: 658388 - DNA, 20 bp, Homo sapiens
agcctcaaaacaaaggccta

SEQ ID NO: 658389 - DNA, 17 bp, Homo sapiens
agcctcaattctccatt

SEQ ID NO: 658390 - DNA, 22 bp, Homo sapiens
agcctcatgccaaccctgggct

SEQ ID NO: 658391 - DNA, 14 bp, Homo sapiens
agcctccaattttt

SEQ ID NO: 658392 - DNA, 23 bp, Homo sapiens
agcctccagtccaaagccggctt

SEQ ID NO: 658393 - DNA, 11 bp, Homo sapiens
agcctcctggg

SEQ ID NO: 658394 - DNA, 12 bp, Homo sapiens
agcctcctggga

SEQ ID NO: 658395 - DNA, 16 bp, Homo sapiens
agcctgatattgatat

SEQ ID NO: 658396 - DNA, 19 bp, Homo sapiens
agcctgcagggaagcccca

SEQ ID NO: 658397 - DNA, 19 bp, Homo sapiens
agcctgtgggtttggtcct

SEQ ID NO: 658398 - DNA, 11 bp, Homo sapiens
agcctgtttca

SEQ ID NO: 658399 - DNA, 12 bp, Homo sapiens
agccttaatttt

SEQ ID NO: 658400 - DNA, 19 bp, Homo sapiens
agccttcttgatgtatttc

SEQ ID NO: 658401 - DNA, 17 bp, Homo sapiens
agccttgagccctggct

SEQ ID NO: 658402 - DNA, 19 bp, Homo sapiens
agccttgagccctggctgt

SEQ ID NO: 658403 - DNA, 19 bp, Homo sapiens
agcctttaccttttatgca

SEQ ID NO: 658404 - DNA, 16 bp, Homo sapiens
agcgaacttgacaatt

SEQ ID NO: 658405 - DNA, 13 bp, Homo sapiens
agcgaagtagctt

SEQ ID NO: 658406 - DNA, 17 bp, Homo sapiens
agcgacccattcagaga

SEQ ID NO: 658407 - DNA, 23 bp, Homo sapiens
agcgaggcacccttactggctta

SEQ ID NO: 658408 - DNA, 19 bp, Homo sapiens
agcgatctctcctggccta

SEQ ID NO: 658409 - DNA, 15 bp, Homo sapiens
agcgccaagtgcgtg

SEQ ID NO: 658410 - DNA, 13 bp, Homo sapiens
agcgggcccagca

SEQ ID NO: 658411 - DNA, 14 bp, Homo sapiens
agcgtccctggcgc

SEQ ID NO: 658412 - DNA, 15 bp, Homo sapiens
agcgttaagggcaga

SEQ ID NO: 658413 - DNA, 16 bp, Homo sapiens
agcgttaagggcagag

SEQ ID NO: 658414 - DNA, 23 bp, Homo sapiens
agctaagggtgggtgctcagaat

SEQ ID NO: 658415 - DNA, 19 bp, Homo sapiens
agctaaggtttagataaat

SEQ ID NO: 658416 - DNA, 19 bp, Homo sapiens
agctaataaatctcttctt

SEQ ID NO: 658417 - DNA, 20 bp, Homo sapiens
agctaataaatctcttcttt

SEQ ID NO: 658418 - DNA, 13 bp, Homo sapiens
agctaatttttgt

SEQ ID NO: 658419 - DNA, 14 bp, Homo sapiens
agctaatttttgta

SEQ ID NO: 658420 - DNA, 17 bp, Homo sapiens
agctaatttttgtattt

SEQ ID NO: 658421 - DNA, 14 bp, Homo sapiens
agctacactgagca

SEQ ID NO: 658422 - DNA, 18 bp, Homo sapiens
agctacattttcagaagt

SEQ ID NO: 658423 - DNA, 13 bp, Homo sapiens
agctactaatgat

SEQ ID NO: 658424 - DNA, 18 bp, Homo sapiens
agctactaatgatgtttt

SEQ ID NO: 658425 - DNA, 12 bp, Homo sapiens
agctacttggca

SEQ ID NO: 658426 - DNA, 16 bp, Homo sapiens
agctagcttttaggaa

SEQ ID NO: 658427 - DNA, 20 bp, Homo sapiens
agctagcttttaggaaaatc

SEQ ID NO: 658428 - DNA, 19 bp, Homo sapiens
agctagtgtacctcctctc

SEQ ID NO: 658429 - DNA, 21 bp, Homo sapiens
agctagtgtacctcctctcag

SEQ ID NO: 658430 - DNA, 13 bp, Homo sapiens
agctatatttgat

SEQ ID NO: 658431 - DNA, 14 bp, Homo sapiens
agctcagccctggc

SEQ ID NO: 658432 - DNA, 19 bp, Homo sapiens
agctcagccctggcctggc

SEQ ID NO: 658433 - DNA, 16 bp, Homo sapiens
agctcaggaggtcaag

SEQ ID NO: 658434 - DNA, 16 bp, Homo sapiens
agctcattaaactttt

SEQ ID NO: 658435 - DNA, 18 bp, Homo sapiens
agctcattaaactttttt

SEQ ID NO: 658436 - DNA, 19 bp, Homo sapiens
agctcattaaactttttta

SEQ ID NO: 658437 - DNA, 21 bp, Homo sapiens
agctcattaaacttttttaac

SEQ ID NO: 658438 - DNA, 14 bp, Homo sapiens
agctccagctttct

SEQ ID NO: 658439 - DNA, 13 bp, Homo sapiens
agctcctcccctt

SEQ ID NO: 658440 - DNA, 12 bp, Homo sapiens
agctctgctgct

SEQ ID NO: 658441 - DNA, 11 bp, Homo sapiens
agctcttccct

SEQ ID NO: 658442 - DNA, 15 bp, Homo sapiens
agctctttccaaatt

SEQ ID NO: 658443 - DNA, 21 bp, Homo sapiens
agctctttccaaattaaaaca

SEQ ID NO: 658444 - DNA, 14 bp, Homo sapiens
agctgagcctgcag

SEQ ID NO: 658445 - DNA, 23 bp, Homo sapiens
agctgagcctgcagggaagcccc

SEQ ID NO: 658446 - DNA, 15 bp, Homo sapiens
agctgattttattca

SEQ ID NO: 658447 - DNA, 15 bp, Homo sapiens
agctgccatggctag

SEQ ID NO: 658448 - DNA, 15 bp, Homo sapiens
agctgcccttccgca

SEQ ID NO: 658449 - DNA, 16 bp, Homo sapiens
agctgccctttctcag

SEQ ID NO: 658450 - DNA, 14 bp, Homo sapiens
agctgcctctgctc

SEQ ID NO: 658451 - DNA, 15 bp, Homo sapiens
agctgcctctgctcc

SEQ ID NO: 658452 - DNA, 16 bp, Homo sapiens
agctgcctctgctccc

SEQ ID NO: 658453 - DNA, 11 bp, Homo sapiens
agctgggcccg

SEQ ID NO: 658454 - DNA, 21 bp, Homo sapiens
agctgggcccgacatggctcc

SEQ ID NO: 658455 - DNA, 22 bp, Homo sapiens
agctggggggatgttctgcctc

SEQ ID NO: 658456 - DNA, 14 bp, Homo sapiens
agctgtcctggagg

SEQ ID NO: 658457 - DNA, 15 bp, Homo sapiens
agctgtgctcagaag

SEQ ID NO: 658458 - DNA, 15 bp, Homo sapiens
agctgttatttcttc

SEQ ID NO: 658459 - DNA, 17 bp, Homo sapiens
agctgttatttcttccc

SEQ ID NO: 658460 - DNA, 18 bp, Homo sapiens
agctgttatttcttccct

SEQ ID NO: 658461 - DNA, 20 bp, Homo sapiens
agctgttccttggtcctagt

SEQ ID NO: 658462 - DNA, 14 bp, Homo sapiens
agctgtttgaaatg

SEQ ID NO: 658463 - DNA, 17 bp, Homo sapiens
agctgtttttgacagcc

SEQ ID NO: 658464 - DNA, 14 bp, Homo sapiens
agcttaactttata

SEQ ID NO: 658465 - DNA, 14 bp, Homo sapiens
agcttaatgctaca

SEQ ID NO: 658466 - DNA, 23 bp, Homo sapiens
agcttataaaaataaagggaaga

SEQ ID NO: 658467 - DNA, 14 bp, Homo sapiens
agcttatctctttt

SEQ ID NO: 658468 - DNA, 19 bp, Homo sapiens
agcttatctcttttatatt

SEQ ID NO: 658469 - DNA, 19 bp, Homo sapiens
agcttcagttgcttgtctt

SEQ ID NO: 658470 - DNA, 15 bp, Homo sapiens
agcttccattttaat

SEQ ID NO: 658471 - DNA, 15 bp, Homo sapiens
agcttgctccctgtg

SEQ ID NO: 658472 - DNA, 17 bp, Homo sapiens
agcttggactacacaat

SEQ ID NO: 658473 - DNA, 23 bp, Homo sapiens
agcttggactacacaatacagta

SEQ ID NO: 658474 - DNA, 15 bp, Homo sapiens
agcttgttgtctcca

SEQ ID NO: 658475 - DNA, 15 bp, Homo sapiens
agctttataaacttt

SEQ ID NO: 658476 - DNA, 18 bp, Homo sapiens
agctttatcgaacgtggt

SEQ ID NO: 658477 - DNA, 22 bp, Homo sapiens
agctttatcgaacgtggtctga

SEQ ID NO: 658478 - DNA, 21 bp, Homo sapiens
agctttattttgagatgtaaa

SEQ ID NO: 658479 - DNA, 20 bp, Homo sapiens
agctttccaaggaagcagaa

SEQ ID NO: 658480 - DNA, 16 bp, Homo sapiens
agctttcctgtttcca

SEQ ID NO: 658481 - DNA, 21 bp, Homo sapiens
agctttgcaaacccattaagg

SEQ ID NO: 658482 - DNA, 16 bp, Homo sapiens
agcttttaaaatgtag

SEQ ID NO: 658483 - DNA, 17 bp, Homo sapiens
agctttttcctcctgga

SEQ ID NO: 658484 - DNA, 14 bp, Homo sapiens
aggaaagaaccgaa

SEQ ID NO: 658485 - DNA, 18 bp, Homo sapiens
aggaaaggggagaaggga

SEQ ID NO: 658486 - DNA, 13 bp, Homo sapiens
aggaaaggtgact

SEQ ID NO: 658487 - DNA, 21 bp, Homo sapiens
aggaaatagtaccttcaatac

SEQ ID NO: 658488 - DNA, 22 bp, Homo sapiens
aggaaccttccttcctgcttga

SEQ ID NO: 658489 - DNA, 13 bp, Homo sapiens
aggaagactttgt

SEQ ID NO: 658490 - DNA, 13 bp, Homo sapiens
agtcatttttgta

SEQ ID NO: 658491 - DNA, 13 bp, Homo sapiens
agtccaaaatact

SEQ ID NO: 658492 - DNA, 17 bp, Homo sapiens
agtcccacactgtgcag

SEQ ID NO: 658493 - DNA, 18 bp, Homo sapiens
agtcccacactgtggcca

SEQ ID NO: 658494 - DNA, 20 bp, Homo sapiens
agtcccagagcacctcacct

SEQ ID NO: 658495 - DNA, 20 bp, Homo sapiens
agtcccagctacttgggagg

SEQ ID NO: 658496 - DNA, 18 bp, Homo sapiens
agtccctataataaaggc

SEQ ID NO: 658497 - DNA, 21 bp, Homo sapiens
agtccctataataaaggctga

SEQ ID NO: 658498 - DNA, 12 bp, Homo sapiens
agtccctcttct

SEQ ID NO: 658499 - DNA, 18 bp, Homo sapiens
agtccctgcaggtgaata

SEQ ID NO: 658500 - DNA, 15 bp, Homo sapiens
agtccgcagaagccc

SEQ ID NO: 658501 - DNA, 16 bp, Homo sapiens
agtccgggagaatgct

SEQ ID NO: 658502 - DNA, 16 bp, Homo sapiens
agtcctaatttgaaca

SEQ ID NO: 658503 - DNA, 14 bp, Homo sapiens
agtcgcctgcctgc

SEQ ID NO: 658504 - DNA, 17 bp, Homo sapiens
agtcgcctgcctgcagc

SEQ ID NO: 658505 - DNA, 21 bp, Homo sapiens
agtcgcctgcctgcagcaggc

SEQ ID NO: 658506 - DNA, 19 bp, Homo sapiens
agtctcatgccttgagatc

SEQ ID NO: 658507 - DNA, 15 bp, Homo sapiens
agtctcatttctcat

SEQ ID NO: 658508 - DNA, 23 bp, Homo sapiens
agtctcctcaatttttgtctcag

SEQ ID NO: 658509 - DNA, 14 bp, Homo sapiens
agtctgaaactggc

SEQ ID NO: 658510 - DNA, 11 bp, Homo sapiens
agtctgaagat

SEQ ID NO: 658511 - DNA, 17 bp, Homo sapiens
agtctgtactaaacagt

SEQ ID NO: 658512 - DNA, 18 bp, Homo sapiens
agtcttaatttatttctt

SEQ ID NO: 658513 - DNA, 18 bp, Homo sapiens
agtcttacaatcaaatct

SEQ ID NO: 658514 - DNA, 20 bp, Homo sapiens
agtcttacaatcaaatctcc

SEQ ID NO: 658515 - DNA, 23 bp, Homo sapiens
agtcttggtttctctctacagtg

SEQ ID NO: 658516 - DNA, 17 bp, Homo sapiens
agtctttcatggctgct

SEQ ID NO: 658517 - DNA, 17 bp, Homo sapiens
agtctttcttgaaattg

SEQ ID NO: 658518 - DNA, 18 bp, Homo sapiens
agtctttcttgaaattga

SEQ ID NO: 658519 - DNA, 16 bp, Homo sapiens
agtcttttttttcctg

SEQ ID NO: 658520 - DNA, 16 bp, Homo sapiens
agtgaaaactttgtag

SEQ ID NO: 658521 - DNA, 14 bp, Homo sapiens
agtgaaaatatagc

SEQ ID NO: 658522 - DNA, 22 bp, Homo sapiens
agtgaaaatcttggagaccctg

SEQ ID NO: 658523 - DNA, 15 bp, Homo sapiens
agtgactccctggga

SEQ ID NO: 658524 - DNA, 21 bp, Homo sapiens
agtgagcagtcgcctgcctgc

SEQ ID NO: 658525 - DNA, 20 bp, Homo sapiens
agtgatcatttaaaaagctc

SEQ ID NO: 658526 - DNA, 19 bp, Homo sapiens
agtgatcttggctgtttca

SEQ ID NO: 658527 - DNA, 20 bp, Homo sapiens
agtgatgggagaattggtat

SEQ ID NO: 658528 - DNA, 17 bp, Homo sapiens
agtgcaagttcatgtgt

SEQ ID NO: 658529 - DNA, 19 bp, Homo sapiens
agtgcacacctttattcag

SEQ ID NO: 658530 - DNA, 20 bp, Homo sapiens
agtgcacacctttattcaga

SEQ ID NO: 658531 - DNA, 21 bp, Homo sapiens
agtgcactttctaatgtttct

SEQ ID NO: 658532 - DNA, 14 bp, Homo sapiens
agtgcagaatgtaa

SEQ ID NO: 658533 - DNA, 23 bp, Homo sapiens
agtgcagaatgtaagtgggccca

SEQ ID NO: 658534 - DNA, 22 bp, Homo sapiens
agtgccttttgcagaagagggt

SEQ ID NO: 658535 - DNA, 13 bp, Homo sapiens
agtgcgtgaatgt

SEQ ID NO: 658536 - DNA, 17 bp, Homo sapiens
agtgcgtgaatgtatgt

SEQ ID NO: 658537 - DNA, 14 bp, Homo sapiens
agtgctggctcaca

SEQ ID NO: 658538 - DNA, 23 bp, Homo sapiens
agtgctgtcttgatgactgctga

SEQ ID NO: 658539 - DNA, 19 bp, Homo sapiens
agtgcttaaaaatcattga

SEQ ID NO: 658540 - DNA, 16 bp, Homo sapiens
agtgcttttctgttta

SEQ ID NO: 658541 - DNA, 12 bp, Homo sapiens
agtggcagagaa

SEQ ID NO: 658542 - DNA, 19 bp, Homo sapiens
agtggcgtggcctccccat

SEQ ID NO: 658543 - DNA, 19 bp, Homo sapiens
agtggcgtgggagccagcc

SEQ ID NO: 658544 - DNA, 21 bp, Homo sapiens
agtgggagagtacctgtgtgt

SEQ ID NO: 658545 - DNA, 18 bp, Homo sapiens
agtgggcccacccggtgg

SEQ ID NO: 658546 - DNA, 19 bp, Homo sapiens
agtggggctgcaggcaggc

SEQ ID NO: 658547 - DNA, 13 bp, Homo sapiens
agtggtctcccca

SEQ ID NO: 658548 - DNA, 15 bp, Homo sapiens
agtggtgatttgaaa

SEQ ID NO: 658549 - DNA, 19 bp, Homo sapiens
agtggtgtgactcttactc

SEQ ID NO: 658550 - DNA, 13 bp, Homo sapiens
agtggtttagaaa

SEQ ID NO: 658551 - DNA, 14 bp, Homo sapiens
agtgtacctcctct

SEQ ID NO: 658552 - DNA, 15 bp, Homo sapiens
agtgtacctcctctc

SEQ ID NO: 658553 - DNA, 21 bp, Homo sapiens
agtgtacctcctctcagtgtt

SEQ ID NO: 658554 - DNA, 17 bp, Homo sapiens
agtgtgacagggccagt

SEQ ID NO: 658555 - DNA, 17 bp, Homo sapiens
agtgtgacagtttccaa

SEQ ID NO: 658556 - DNA, 13 bp, Homo sapiens
agtgtgagctctt

SEQ ID NO: 658557 - DNA, 16 bp, Homo sapiens
agtgtgagctcttccc

SEQ ID NO: 658558 - DNA, 20 bp, Homo sapiens
agtgtggcctgtgccagcac

SEQ ID NO: 658559 - DNA, 22 bp, Homo sapiens
agtgtggcctgtgccagcacca

SEQ ID NO: 658560 - DNA, 21 bp, Homo sapiens
agtgttggcaaacgagacttt

SEQ ID NO: 658561 - DNA, 23 bp, Homo sapiens
agtgttggcaaacgagactttct

SEQ ID NO: 658562 - DNA, 21 bp, Homo sapiens
agtgttggtatattttatatt

SEQ ID NO: 658563 - DNA, 20 bp, Homo sapiens
agtgtttatgtttaaaagaa

SEQ ID NO: 658564 - DNA, 19 bp, Homo sapiens
agtgttttggactccatct

SEQ ID NO: 658565 - DNA, 22 bp, Homo sapiens
agtgttttggactccatctctc

SEQ ID NO: 658566 - DNA, 16 bp, Homo sapiens
agttaaataactgtgt

SEQ ID NO: 658567 - DNA, 17 bp, Homo sapiens
agttaacgggtgaataa

SEQ ID NO: 658568 - DNA, 18 bp, Homo sapiens
agttaatgatggcagagg

SEQ ID NO: 658569 - DNA, 15 bp, Homo sapiens
agttaccagtgcctt

SEQ ID NO: 658570 - DNA, 15 bp, Homo sapiens
agttagctccataaa

SEQ ID NO: 658571 - DNA, 12 bp, Homo sapiens
agttataagaag

SEQ ID NO: 658572 - DNA, 14 bp, Homo sapiens
agttataagaagaa

SEQ ID NO: 658573 - DNA, 13 bp, Homo sapiens
agttatgtattta

SEQ ID NO: 658574 - DNA, 17 bp, Homo sapiens
agttatgtttgaatgaa

SEQ ID NO: 658575 - DNA, 16 bp, Homo sapiens
agttatttcatctttt

SEQ ID NO: 658576 - DNA, 21 bp, Homo sapiens
agttatttcatcttttattca

SEQ ID NO: 658577 - DNA, 18 bp, Homo sapiens
agttcacattagaattag

SEQ ID NO: 658578 - DNA, 22 bp, Homo sapiens
agttcatgtgtggaaatgggac

SEQ ID NO: 658579 - DNA, 19 bp, Homo sapiens
agttccagccttctctcaa

SEQ ID NO: 658580 - DNA, 13 bp, Homo sapiens
agttcctctgggt

SEQ ID NO: 658581 - DNA, 18 bp, Homo sapiens
agttccttatccctctct

SEQ ID NO: 658582 - DNA, 23 bp, Homo sapiens
agttccttatccctctcttcccc

SEQ ID NO: 658583 - DNA, 17 bp, Homo sapiens
agttctcaatttcattt

SEQ ID NO: 658584 - DNA, 18 bp, Homo sapiens
agttgaaaatgcaactct

SEQ ID NO: 658585 - DNA, 23 bp, Homo sapiens
agttgatacttgaataaccatct

SEQ ID NO: 658586 - DNA, 19 bp, Homo sapiens
agttgctgtgaactttcat

SEQ ID NO: 658587 - DNA, 19 bp, Homo sapiens
agttgcttgtcttctggta

SEQ ID NO: 658588 - DNA, 15 bp, Homo sapiens
agttgggtgtctcct

SEQ ID NO: 658589 - DNA, 16 bp, Homo sapiens
agttgtagcagattgt

SEQ ID NO: 658590 - DNA, 23 bp, Homo sapiens
agttgtttgaggcaaattaactg

SEQ ID NO: 658591 - DNA, 22 bp, Homo sapiens
agtttaaaaagatgaaaaagaa

SEQ ID NO: 658592 - DNA, 21 bp, Homo sapiens
agtttacacttcatatagcat

SEQ ID NO: 658593 - DNA, 22 bp, Homo sapiens
agtttatcttaagcatgtcaat

SEQ ID NO: 658594 - DNA, 23 bp, Homo sapiens
agtttctgtcgttaaaaacagat

SEQ ID NO: 658595 - DNA, 21 bp, Homo sapiens
agtttgctgtccttcttagaa

SEQ ID NO: 658596 - DNA, 23 bp, Homo sapiens
agtttggctgctgtcataacatc

SEQ ID NO: 658597 - DNA, 18 bp, Homo sapiens
agtttgtagaactttatt

SEQ ID NO: 658598 - DNA, 13 bp, Homo sapiens
agtttgtctattt

SEQ ID NO: 658599 - DNA, 19 bp, Homo sapiens
agtttgtctattttaaaat

SEQ ID NO: 658600 - DNA, 21 bp, Homo sapiens
agtttgtctattttaaaataa

SEQ ID NO: 658601 - DNA, 19 bp, Homo sapiens
agttttatagcctggactg

SEQ ID NO: 658602 - DNA, 10 bp, Homo sapiens
agttttccta

SEQ ID NO: 658603 - DNA, 21 bp, Homo sapiens
agttttgtgaaggtgatttat

SEQ ID NO: 658604 - DNA, 18 bp, Homo sapiens
agttttgttgtacttaaa

SEQ ID NO: 658605 - DNA, 23 bp, Homo sapiens
agttttgttgtacttaaatggta

SEQ ID NO: 658606 - DNA, 16 bp, Homo sapiens
agtttttaatttgatg

SEQ ID NO: 658607 - DNA, 17 bp, Homo sapiens
agtttttacaagatgta

SEQ ID NO: 658608 - DNA, 18 bp, Homo sapiens
agtttttagaatgttgaa

SEQ ID NO: 658609 - DNA, 21 bp, Homo sapiens
atcacagggtgggcctcggcc

SEQ ID NO: 658610 - DNA, 20 bp, Homo sapiens
atcacttgagctcaggaggt

SEQ ID NO: 658611 - DNA, 15 bp, Homo sapiens
atcagaacaaaactt

SEQ ID NO: 658612 - DNA, 17 bp, Homo sapiens
atcagaacaaaacttct

SEQ ID NO: 658613 - DNA, 16 bp, Homo sapiens
atcagaggagtaaata

SEQ ID NO: 658614 - DNA, 21 bp, Homo sapiens
atcagcatgcctgtcctttca

SEQ ID NO: 658615 - DNA, 19 bp, Homo sapiens
atcagctgcaatccattta

SEQ ID NO: 658616 - DNA, 11 bp, Homo sapiens
atcagggcctg

SEQ ID NO: 658617 - DNA, 15 bp, Homo sapiens
atcagggcctggggc

SEQ ID NO: 658618 - DNA, 21 bp, Homo sapiens
atcagggcctggggcctgaga

SEQ ID NO: 658619 - DNA, 18 bp, Homo sapiens
atcagtaaatagtgtcat

SEQ ID NO: 658620 - DNA, 23 bp, Homo sapiens
atcagtaacccccttaaatttaa

SEQ ID NO: 658621 - DNA, 15 bp, Homo sapiens
atcagtgataattgg

SEQ ID NO: 658622 - DNA, 10 bp, Homo sapiens
atcagtgttg

SEQ ID NO: 658623 - DNA, 14 bp, Homo sapiens
atcataaacatttt

SEQ ID NO: 658624 - DNA, 18 bp, Homo sapiens
atcatagaaaattgaaac

SEQ ID NO: 658625 - DNA, 23 bp, Homo sapiens
atcatcctcccgccaggagcttc

SEQ ID NO: 658626 - DNA, 13 bp, Homo sapiens
atcatcgccagag

SEQ ID NO: 658627 - DNA, 16 bp, Homo sapiens
atcatcgccagaggtg

SEQ ID NO: 658628 - DNA, 20 bp, Homo sapiens
atcatcgccagaggtgcttc

SEQ ID NO: 658629 - DNA, 12 bp, Homo sapiens
atcattaaaaat

SEQ ID NO: 658630 - DNA, 13 bp, Homo sapiens
atcattcagaaat

SEQ ID NO: 658631 - DNA, 22 bp, Homo sapiens
atcattccctctcatctcaggt

SEQ ID NO: 658632 - DNA, 14 bp, Homo sapiens
atccaaaatgtgta

SEQ ID NO: 658633 - DNA, 17 bp, Homo sapiens
atccaaaatgtgtattt

SEQ ID NO: 658634 - DNA, 19 bp, Homo sapiens
atccaccactttaacctta

SEQ ID NO: 658635 - DNA, 15 bp, Homo sapiens
atccacccagcaggc

SEQ ID NO: 658636 - DNA, 20 bp, Homo sapiens
atccagacctggctccactc

SEQ ID NO: 658637 - DNA, 22 bp, Homo sapiens
atccataggtttctctccctcc

SEQ ID NO: 658638 - DNA, 13 bp, Homo sapiens
atccatccatctc

SEQ ID NO: 658639 - DNA, 23 bp, Homo sapiens
atccatccatctctctcttgcct

SEQ ID NO: 658640 - DNA, 14 bp, Homo sapiens
atccatctctctct

SEQ ID NO: 658641 - DNA, 20 bp, Homo sapiens
atccccaacatgcactgatg

SEQ ID NO: 658642 - DNA, 16 bp, Homo sapiens
atccccatctccctgc

SEQ ID NO: 658643 - DNA, 20 bp, Homo sapiens
atccccatctccctgcctgg

SEQ ID NO: 658644 - DNA, 14 bp, Homo sapiens
atcccgcagcctcg

SEQ ID NO: 658645 - DNA, 13 bp, Homo sapiens
atccctctcttcc

SEQ ID NO: 658646 - DNA, 16 bp, Homo sapiens
atccctctcttcccct

SEQ ID NO: 658647 - DNA, 18 bp, Homo sapiens
atccctctcttccccttc

SEQ ID NO: 658648 - DNA, 20 bp, Homo sapiens
atccctctcttccccttccc

SEQ ID NO: 658649 - DNA, 21 bp, Homo sapiens
atccctctcttccccttccct

SEQ ID NO: 658650 - DNA, 22 bp, Homo sapiens
atccctctcttccccttccctt

SEQ ID NO: 658651 - DNA, 14 bp, Homo sapiens
atccctgcttattt

SEQ ID NO: 658652 - DNA, 18 bp, Homo sapiens
atccgcctacctcagcct

SEQ ID NO: 658653 - DNA, 15 bp, Homo sapiens
atccgcgtgtgcctg

SEQ ID NO: 658654 - DNA, 12 bp, Homo sapiens
atccggtttctt

SEQ ID NO: 658655 - DNA, 11 bp, Homo sapiens
atcctacagta

SEQ ID NO: 658656 - DNA, 21 bp, Homo sapiens
atcctcccgccaggagcttct

SEQ ID NO: 658657 - DNA, 23 bp, Homo sapiens
atcctcccgccaggagcttcttc

SEQ ID NO: 658658 - DNA, 19 bp, Homo sapiens
atcctccctggcagacaca

SEQ ID NO: 658659 - DNA, 15 bp, Homo sapiens
atcctcctccagggt

SEQ ID NO: 658660 - DNA, 19 bp, Homo sapiens
atcctgaactgcttctcca

SEQ ID NO: 658661 - DNA, 21 bp, Homo sapiens
atcctgcagatactttgaagt

SEQ ID NO: 658662 - DNA, 22 bp, Homo sapiens
atcctggccctgggggtctggg

SEQ ID NO: 658663 - DNA, 15 bp, Homo sapiens
atcctgtgcaataga

SEQ ID NO: 658664 - DNA, 16 bp, Homo sapiens
atccttatcagagcta

SEQ ID NO: 658665 - DNA, 21 bp, Homo sapiens
atccttccctttggagatgct

SEQ ID NO: 658666 - DNA, 14 bp, Homo sapiens
atccttctttcctt

SEQ ID NO: 658667 - DNA, 22 bp, Homo sapiens
atccttgatgcaagtgcaacct

SEQ ID NO: 658668 - DNA, 20 bp, Homo sapiens
atccttgtgttcagctcttt

SEQ ID NO: 658669 - DNA, 17 bp, Homo sapiens
atcctttaaaatttaaa

SEQ ID NO: 658670 - DNA, 14 bp, Homo sapiens
atccttttccttat

SEQ ID NO: 658671 - DNA, 16 bp, Homo sapiens
atcgcttttaataaac

SEQ ID NO: 658672 - DNA, 16 bp, Homo sapiens
atcggattactgaatt

SEQ ID NO: 658673 - DNA, 19 bp, Homo sapiens
atcggtgaaactaacagat

SEQ ID NO: 658674 - DNA, 13 bp, Homo sapiens
atcgtagaaaatt

SEQ ID NO: 658675 - DNA, 18 bp, Homo sapiens
atctaaacagttatttct

SEQ ID NO: 658676 - DNA, 15 bp, Homo sapiens
atctaaagcagcagg

SEQ ID NO: 658677 - DNA, 21 bp, Homo sapiens
atctaaagcagcaggtctaga

SEQ ID NO: 658678 - DNA, 21 bp, Homo sapiens
atctaacgtgttccagtgtct

SEQ ID NO: 658679 - DNA, 17 bp, Homo sapiens
atctaatgcttgtttat

SEQ ID NO: 658680 - DNA, 23 bp, Homo sapiens
atctacaatctctttttgtttgc

SEQ ID NO: 658681 - DNA, 14 bp, Homo sapiens
atctacacatgttg

SEQ ID NO: 658682 - DNA, 19 bp, Homo sapiens
atctacaccaatgaaaaca

SEQ ID NO: 658683 - DNA, 16 bp, Homo sapiens
atctatctagttctaa

SEQ ID NO: 658684 - DNA, 13 bp, Homo sapiens
atctatcttccaa

SEQ ID NO: 658685 - DNA, 14 bp, Homo sapiens
atctcaatcttggt

SEQ ID NO: 658686 - DNA, 22 bp, Homo sapiens
atctcaatcttggtttgtcagt

SEQ ID NO: 658687 - DNA, 18 bp, Homo sapiens
atctcaattgaaagcttt

SEQ ID NO: 658688 - DNA, 18 bp, Homo sapiens
atctccctgcctggcccc

SEQ ID NO: 658689 - DNA, 20 bp, Homo sapiens
atctccctgcctggccccca

SEQ ID NO: 658690 - DNA, 21 bp, Homo sapiens
atctcccttttccatgactgt

SEQ ID NO: 658691 - DNA, 21 bp, Homo sapiens
atctccgttccatctgggctt

SEQ ID NO: 658692 - DNA, 12 bp, Homo sapiens
atctcctgctga

SEQ ID NO: 658693 - DNA, 16 bp, Homo sapiens
atctcgaatttgaaga

SEQ ID NO: 658694 - DNA, 17 bp, Homo sapiens
atctcgaatttgaagag

SEQ ID NO: 658695 - DNA, 17 bp, Homo sapiens
atctctcatcctccagt

SEQ ID NO: 658696 - DNA, 17 bp, Homo sapiens
atctctctcttgcctga

SEQ ID NO: 658697 - DNA, 18 bp, Homo sapiens
atctcttctggtgttgac

SEQ ID NO: 658698 - DNA, 13 bp, Homo sapiens
atctgacaaaatg

SEQ ID NO: 658699 - DNA, 19 bp, Homo sapiens
atctgacccactttgtaat

SEQ ID NO: 658700 - DNA, 15 bp, Homo sapiens
atctgcaatatgaat

SEQ ID NO: 658701 - DNA, 23 bp, Homo sapiens
atctgctcgcctgagggaagagt

SEQ ID NO: 658702 - DNA, 20 bp, Homo sapiens
atctggagctggcactgtgg

SEQ ID NO: 658703 - DNA, 17 bp, Homo sapiens
atctgggattattcttt

SEQ ID NO: 658704 - DNA, 16 bp, Homo sapiens
atctgggttaagtgtt

SEQ ID NO: 658705 - DNA, 19 bp, Homo sapiens
atctggtcttgttagaaaa

SEQ ID NO: 658706 - DNA, 14 bp, Homo sapiens
atctggttatatca

SEQ ID NO: 658707 - DNA, 13 bp, Homo sapiens
atctgtgaatctg

SEQ ID NO: 658708 - DNA, 21 bp, Homo sapiens
atctgtgccatagaacaagat

SEQ ID NO: 658709 - DNA, 16 bp, Homo sapiens
atctgttcatttctaa

SEQ ID NO: 658710 - DNA, 18 bp, Homo sapiens
atcttaagcaggtttgtt

SEQ ID NO: 658711 - DNA, 21 bp, Homo sapiens
atcttaagcatgtcaattcat

SEQ ID NO: 658712 - DNA, 17 bp, Homo sapiens
atcttacaatattgatt

SEQ ID NO: 658713 - DNA, 18 bp, Homo sapiens
atcttcaaagccttctcc

SEQ ID NO: 658714 - DNA, 23 bp, Homo sapiens
atcttcacttctaaatgcatatc

SEQ ID NO: 658715 - DNA, 14 bp, Homo sapiens
atcttcccatgcat

SEQ ID NO: 658716 - DNA, 13 bp, Homo sapiens
atcttgaatgtgg

SEQ ID NO: 658717 - DNA, 14 bp, Homo sapiens
atcttgaatgtggt

SEQ ID NO: 658718 - DNA, 21 bp, Homo sapiens
atcttgcctccaggtgcagag

SEQ ID NO: 658719 - DNA, 18 bp, Homo sapiens
atcttgtgtgattaactt

SEQ ID NO: 658720 - DNA, 12 bp, Homo sapiens
atctttcagaaa

SEQ ID NO: 658721 - DNA, 16 bp, Homo sapiens
atctttcagaaatata

SEQ ID NO: 658722 - DNA, 14 bp, Homo sapiens
atcttttaaaatca

SEQ ID NO: 658723 - DNA, 13 bp, Homo sapiens
atctttttaaaaa

SEQ ID NO: 658724 - DNA, 23 bp, Homo sapiens
atctttttaaaaactcttcagtg

SEQ ID NO: 658725 - DNA, 12 bp, Homo sapiens
atgaaaaagaat

SEQ ID NO: 658726 - DNA, 23 bp, Homo sapiens
atgaaaaagaataaaaacttttg

SEQ ID NO: 658727 - DNA, 20 bp, Homo sapiens
atgaaaaatctcaattgaaa

SEQ ID NO: 658728 - DNA, 18 bp, Homo sapiens
atgaaacttaagaattga

SEQ ID NO: 658729 - DNA, 12 bp, Homo sapiens
attacaacattt

SEQ ID NO: 658730 - DNA, 15 bp, Homo sapiens
attacaacatttatg

SEQ ID NO: 658731 - DNA, 22 bp, Homo sapiens
attaccagggactatctttgct

SEQ ID NO: 658732 - DNA, 22 bp, Homo sapiens
attactaaggcaggtgggcaga

SEQ ID NO: 658733 - DNA, 19 bp, Homo sapiens
attactaattttacacatt

SEQ ID NO: 658734 - DNA, 16 bp, Homo sapiens
attactgacatttctt

SEQ ID NO: 658735 - DNA, 19 bp, Homo sapiens
attactggaattcttctgc

SEQ ID NO: 658736 - DNA, 14 bp, Homo sapiens
attactgggcctta

SEQ ID NO: 658737 - DNA, 15 bp, Homo sapiens
attactgggccttag

SEQ ID NO: 658738 - DNA, 13 bp, Homo sapiens
attactttaacat

SEQ ID NO: 658739 - DNA, 15 bp, Homo sapiens
attactttaacattt

SEQ ID NO: 658740 - DNA, 16 bp, Homo sapiens
attactttaacatttt

SEQ ID NO: 658741 - DNA, 14 bp, Homo sapiens
attagagaacatcc

SEQ ID NO: 658742 - DNA, 15 bp, Homo sapiens
attagagaacatcct

SEQ ID NO: 658743 - DNA, 13 bp, Homo sapiens
attagataatatt

SEQ ID NO: 658744 - DNA, 15 bp, Homo sapiens
attagataatatttt

SEQ ID NO: 658745 - DNA, 18 bp, Homo sapiens
attagatctaaacagtta

SEQ ID NO: 658746 - DNA, 18 bp, Homo sapiens
attagattttattttact

SEQ ID NO: 658747 - DNA, 21 bp, Homo sapiens
attaggctgtgtcaccattgt

SEQ ID NO: 658748 - DNA, 18 bp, Homo sapiens
attagtgccagaatttta

SEQ ID NO: 658749 - DNA, 14 bp, Homo sapiens
attataaattgtgt

SEQ ID NO: 658750 - DNA, 16 bp, Homo sapiens
attataacaactattt

SEQ ID NO: 658751 - DNA, 16 bp, Homo sapiens
attatagacaaaagaa

SEQ ID NO: 658752 - DNA, 19 bp, Homo sapiens
attatagacaaaagaataa

SEQ ID NO: 658753 - DNA, 21 bp, Homo sapiens
attatagacaaaagaataaga

SEQ ID NO: 658754 - DNA, 15 bp, Homo sapiens
attatattaaacata

SEQ ID NO: 658755 - DNA, 21 bp, Homo sapiens
attatcctgaactcttctgca

SEQ ID NO: 658756 - DNA, 23 bp, Homo sapiens
attatgagattggttttcctgtg

SEQ ID NO: 658757 - DNA, 17 bp, Homo sapiens
attatgcaaaatttaga

SEQ ID NO: 658758 - DNA, 20 bp, Homo sapiens
attatgcaaaatttagaaga

SEQ ID NO: 658759 - DNA, 15 bp, Homo sapiens
attatggcatttcta

SEQ ID NO: 658760 - DNA, 20 bp, Homo sapiens
attatgtatggatatatttg

SEQ ID NO: 658761 - DNA, 12 bp, Homo sapiens
attattagaaat

SEQ ID NO: 658762 - DNA, 19 bp, Homo sapiens
attattcaagaatgaaaaa

SEQ ID NO: 658763 - DNA, 14 bp, Homo sapiens
attattctttgaaa

SEQ ID NO: 658764 - DNA, 17 bp, Homo sapiens
attattctttgaaaaca

SEQ ID NO: 658765 - DNA, 19 bp, Homo sapiens
attattctttgaaaacaga

SEQ ID NO: 658766 - DNA, 12 bp, Homo sapiens
attatttgctat

SEQ ID NO: 658767 - DNA, 18 bp, Homo sapiens
attatttttataattgta

SEQ ID NO: 658768 - DNA, 19 bp, Homo sapiens
attatttttttaaaatttt

SEQ ID NO: 658769 - DNA, 21 bp, Homo sapiens
attatttttttaaaattttgt

SEQ ID NO: 658770 - DNA, 22 bp, Homo sapiens
attatttttttaaaattttgta

SEQ ID NO: 658771 - DNA, 15 bp, Homo sapiens
attcaacaaagtatt

SEQ ID NO: 658772 - DNA, 16 bp, Homo sapiens
attcaacaaagtattt

SEQ ID NO: 658773 - DNA, 14 bp, Homo sapiens
attcaactttgtaa

SEQ ID NO: 658774 - DNA, 18 bp, Homo sapiens
attcaactttgtaaaaat

SEQ ID NO: 658775 - DNA, 19 bp, Homo sapiens
attcaaggagaatatgata

SEQ ID NO: 658776 - DNA, 19 bp, Homo sapiens
attcagatcactgaattta

SEQ ID NO: 658777 - DNA, 14 bp, Homo sapiens
attcaggtaacact

SEQ ID NO: 658778 - DNA, 22 bp, Homo sapiens
attcagtaatgcagtttttaaa

SEQ ID NO: 658779 - DNA, 17 bp, Homo sapiens
attcagtcctgggcaaa

SEQ ID NO: 658780 - DNA, 21 bp, Homo sapiens
attcagtgagggtcttcttac

SEQ ID NO: 658781 - DNA, 17 bp, Homo sapiens
attcatagtaagattga

SEQ ID NO: 658782 - DNA, 13 bp, Homo sapiens
attcattgtctct

SEQ ID NO: 658783 - DNA, 20 bp, Homo sapiens
attccagatctttcagaaat

SEQ ID NO: 658784 - DNA, 21 bp, Homo sapiens
attccagatctttcagaaata

SEQ ID NO: 658785 - DNA, 17 bp, Homo sapiens
attcctctcaccccact

SEQ ID NO: 658786 - DNA, 19 bp, Homo sapiens
attcctctcaccccactcc

SEQ ID NO: 658787 - DNA, 21 bp, Homo sapiens
attcctctcaccccactcctg

SEQ ID NO: 658788 - DNA, 13 bp, Homo sapiens
attcctcttttta

SEQ ID NO: 658789 - DNA, 15 bp, Homo sapiens
attcgaaccaggaaa

SEQ ID NO: 658790 - DNA, 19 bp, Homo sapiens
attcgaaggaacctgtgtt

SEQ ID NO: 658791 - DNA, 20 bp, Homo sapiens
attcgtgcatttttggatca

SEQ ID NO: 658792 - DNA, 14 bp, Homo sapiens
attctataaaactc

SEQ ID NO: 658793 - DNA, 11 bp, Homo sapiens
attctcagggc

SEQ ID NO: 658794 - DNA, 12 bp, Homo sapiens
attctcagggct

SEQ ID NO: 658795 - DNA, 18 bp, Homo sapiens
attctgaccgttaaaaaa

SEQ ID NO: 658796 - DNA, 14 bp, Homo sapiens
attctgaccttaaa

SEQ ID NO: 658797 - DNA, 15 bp, Homo sapiens
attctgaggccctgc

SEQ ID NO: 658798 - DNA, 17 bp, Homo sapiens
attctgccctccttaat

SEQ ID NO: 658799 - DNA, 18 bp, Homo sapiens
attctgcctatgtaaaat

SEQ ID NO: 658800 - DNA, 14 bp, Homo sapiens
attctggctttaag

SEQ ID NO: 658801 - DNA, 23 bp, Homo sapiens
attctggtagggatatggcagga

SEQ ID NO: 658802 - DNA, 18 bp, Homo sapiens
attctggttccctgctgc

SEQ ID NO: 658803 - DNA, 18 bp, Homo sapiens
attctggttcttgaaaat

SEQ ID NO: 658804 - DNA, 16 bp, Homo sapiens
attcttgagaagtaac

SEQ ID NO: 658805 - DNA, 18 bp, Homo sapiens
attcttgagaagtaactg

SEQ ID NO: 658806 - DNA, 17 bp, Homo sapiens
attctttcagttctttg

SEQ ID NO: 658807 - DNA, 15 bp, Homo sapiens
attcttttgtttcca

SEQ ID NO: 658808 - DNA, 19 bp, Homo sapiens
attgaaaaacaattttctg

SEQ ID NO: 658809 - DNA, 16 bp, Homo sapiens
attgaaaagtttttgt

SEQ ID NO: 658810 - DNA, 20 bp, Homo sapiens
attgaaaagtttttgtttgg

SEQ ID NO: 658811 - DNA, 15 bp, Homo sapiens
attgaaaatcttgtg

SEQ ID NO: 658812 - DNA, 20 bp, Homo sapiens
attgaaagcttttaaaatgt

SEQ ID NO: 658813 - DNA, 22 bp, Homo sapiens
attgaaataaataaaaatgcat

SEQ ID NO: 658814 - DNA, 22 bp, Homo sapiens
attgaaggcttaattgactgaa

SEQ ID NO: 658815 - DNA, 19 bp, Homo sapiens
attgaagtatggtgtgttc

SEQ ID NO: 658816 - DNA, 21 bp, Homo sapiens
attgacataggtcataaagca

SEQ ID NO: 658817 - DNA, 13 bp, Homo sapiens
attgaccattttt

SEQ ID NO: 658818 - DNA, 22 bp, Homo sapiens
attgaccattttttaatttact

SEQ ID NO: 658819 - DNA, 19 bp, Homo sapiens
attgactaactcaaataca

SEQ ID NO: 658820 - DNA, 12 bp, Homo sapiens
attgactgaaat

SEQ ID NO: 658821 - DNA, 14 bp, Homo sapiens
attgactgaaatta

SEQ ID NO: 658822 - DNA, 16 bp, Homo sapiens
attgactgaaattact

SEQ ID NO: 658823 - DNA, 15 bp, Homo sapiens
attgactgatgattt

SEQ ID NO: 658824 - DNA, 12 bp, Homo sapiens
attgagatttct

SEQ ID NO: 658825 - DNA, 12 bp, Homo sapiens
attgaggaagag

SEQ ID NO: 658826 - DNA, 15 bp, Homo sapiens
attgaggaagagtct

SEQ ID NO: 658827 - DNA, 15 bp, Homo sapiens
attgagtattgttta

SEQ ID NO: 658828 - DNA, 20 bp, Homo sapiens
attgagtattgtttaaaatg

SEQ ID NO: 658829 - DNA, 17 bp, Homo sapiens
attgataatcttcaggt

SEQ ID NO: 658830 - DNA, 14 bp, Homo sapiens
attgattgggaaaa

SEQ ID NO: 658831 - DNA, 20 bp, Homo sapiens
attgattgggaaaacatttg

SEQ ID NO: 658832 - DNA, 22 bp, Homo sapiens
attgattgggaaaacatttgct

SEQ ID NO: 658833 - DNA, 18 bp, Homo sapiens
attgatttttaagaaagt

SEQ ID NO: 658834 - DNA, 22 bp, Homo sapiens
attgcacttgattaagcttttg

SEQ ID NO: 658835 - DNA, 14 bp, Homo sapiens
attgcatcactgta

SEQ ID NO: 658836 - DNA, 15 bp, Homo sapiens
attgccaagtcagat

SEQ ID NO: 658837 - DNA, 22 bp, Homo sapiens
attgccccatccagacctggct

SEQ ID NO: 658838 - DNA, 20 bp, Homo sapiens
attgcccctggctttgcctc

SEQ ID NO: 658839 - DNA, 14 bp, Homo sapiens
attgcctacattta

SEQ ID NO: 658840 - DNA, 18 bp, Homo sapiens
attgcctctgaaaagtgt

SEQ ID NO: 658841 - DNA, 16 bp, Homo sapiens
attgctaatttagaga

SEQ ID NO: 658842 - DNA, 15 bp, Homo sapiens
attgctatgttacta

SEQ ID NO: 658843 - DNA, 18 bp, Homo sapiens
attgctatgttactattt

SEQ ID NO: 658844 - DNA, 20 bp, Homo sapiens
attgctatgttactattttc

SEQ ID NO: 658845 - DNA, 19 bp, Homo sapiens
attggaaagacttctcaaa

SEQ ID NO: 658846 - DNA, 21 bp, Homo sapiens
attggcacatgccacctggca

SEQ ID NO: 658847 - DNA, 17 bp, Homo sapiens
attggcagtggcagaga

SEQ ID NO: 658848 - DNA, 15 bp, Homo sapiens
attgggaaaacattt

SEQ ID NO: 658849 - DNA, 23 bp, Homo sapiens
caacggtctcctgactggtgctg

SEQ ID NO: 658850 - DNA, 23 bp, Homo sapiens
caacgtggctttttttttttccc

SEQ ID NO: 658851 - DNA, 19 bp, Homo sapiens
caactactacctgtaatga

SEQ ID NO: 658852 - DNA, 18 bp, Homo sapiens
caactctaactctgagag

SEQ ID NO: 658853 - DNA, 20 bp, Homo sapiens
caactgtcccaaggaggggg

SEQ ID NO: 658854 - DNA, 18 bp, Homo sapiens
caacttatttcataattg

SEQ ID NO: 658855 - DNA, 16 bp, Homo sapiens
caagaaaatctttgtt

SEQ ID NO: 658856 - DNA, 20 bp, Homo sapiens
caagaaaatctttgttgaag

SEQ ID NO: 658857 - DNA, 20 bp, Homo sapiens
caagaaagctcactgtagct

SEQ ID NO: 658858 - DNA, 19 bp, Homo sapiens
caagaatagcattgtaaaa

SEQ ID NO: 658859 - DNA, 20 bp, Homo sapiens
caagaatgtacgtccagcct

SEQ ID NO: 658860 - DNA, 16 bp, Homo sapiens
caagacagaggggagc

SEQ ID NO: 658861 - DNA, 14 bp, Homo sapiens
caagagatctacac

SEQ ID NO: 658862 - DNA, 17 bp, Homo sapiens
caagagatctacacatg

SEQ ID NO: 658863 - DNA, 18 bp, Homo sapiens
caagagatctacacatgt

SEQ ID NO: 658864 - DNA, 12 bp, Homo sapiens
caagataatttt

SEQ ID NO: 658865 - DNA, 18 bp, Homo sapiens
caagataattttcagctg

SEQ ID NO: 658866 - DNA, 12 bp, Homo sapiens
caagattgaaaa

SEQ ID NO: 658867 - DNA, 16 bp, Homo sapiens
caagatttttttcctg

SEQ ID NO: 658868 - DNA, 18 bp, Homo sapiens
caagcaacattcttgtta

SEQ ID NO: 658869 - DNA, 15 bp, Homo sapiens
caagcaacatttgta

SEQ ID NO: 658870 - DNA, 18 bp, Homo sapiens
caagcaactaattttctc

SEQ ID NO: 658871 - DNA, 14 bp, Homo sapiens
caagcagaggacca

SEQ ID NO: 658872 - DNA, 18 bp, Homo sapiens
caagcagaggaccagggc

SEQ ID NO: 658873 - DNA, 20 bp, Homo sapiens
caagcagaggaccagggcct

SEQ ID NO: 658874 - DNA, 17 bp, Homo sapiens
caagctagtgtttctag

SEQ ID NO: 658875 - DNA, 14 bp, Homo sapiens
caagctgattttat

SEQ ID NO: 658876 - DNA, 12 bp, Homo sapiens
caagctttggtt

SEQ ID NO: 658877 - DNA, 15 bp, Homo sapiens
caaggaaacatttta

SEQ ID NO: 658878 - DNA, 20 bp, Homo sapiens
caaggaaacgctacctctct

SEQ ID NO: 658879 - DNA, 19 bp, Homo sapiens
caaggaaaggggagaaggg

SEQ ID NO: 658880 - DNA, 11 bp, Homo sapiens
caaggaagcag

SEQ ID NO: 658881 - DNA, 20 bp, Homo sapiens
caaggaagcagaagacggga

SEQ ID NO: 658882 - DNA, 21 bp, Homo sapiens
caaggaagcagaagacgggag

SEQ ID NO: 658883 - DNA, 21 bp, Homo sapiens
caaggagaatatgataaaaca

SEQ ID NO: 658884 - DNA, 20 bp, Homo sapiens
caaggagggggcctcattgt

SEQ ID NO: 658885 - DNA, 13 bp, Homo sapiens
caaggcagggacc

SEQ ID NO: 658886 - DNA, 23 bp, Homo sapiens
caagggtcattatgggttaggca

SEQ ID NO: 658887 - DNA, 18 bp, Homo sapiens
caaggtacaactgtattt

SEQ ID NO: 658888 - DNA, 9 bp, Homo sapiens
caaggtata

SEQ ID NO: 658889 - DNA, 17 bp, Homo sapiens
caaggtataataaaatt

SEQ ID NO: 658890 - DNA, 20 bp, Homo sapiens
caaggtggggattgcccctg

SEQ ID NO: 658891 - DNA, 13 bp, Homo sapiens
caagtaaatatat

SEQ ID NO: 658892 - DNA, 13 bp, Homo sapiens
caagtaagaagac

SEQ ID NO: 658893 - DNA, 16 bp, Homo sapiens
caagtcagctccagct

SEQ ID NO: 658894 - DNA, 17 bp, Homo sapiens
caagtcatttttgtatt

SEQ ID NO: 658895 - DNA, 20 bp, Homo sapiens
caagtgcactttctaatgtt

SEQ ID NO: 658896 - DNA, 18 bp, Homo sapiens
caagtgtggggggtcctt

SEQ ID NO: 658897 - DNA, 21 bp, Homo sapiens
caagttcattttaaatgaagg

SEQ ID NO: 658898 - DNA, 16 bp, Homo sapiens
caagtttacacttcat

SEQ ID NO: 658899 - DNA, 19 bp, Homo sapiens
caataaaaacattttgaag

SEQ ID NO: 658900 - DNA, 22 bp, Homo sapiens
caataaaaacattttgaagtgt

SEQ ID NO: 658901 - DNA, 11 bp, Homo sapiens
caataaaattt

SEQ ID NO: 658902 - DNA, 12 bp, Homo sapiens
caataaaggcag

SEQ ID NO: 658903 - DNA, 13 bp, Homo sapiens
caataaaggcagc

SEQ ID NO: 658904 - DNA, 16 bp, Homo sapiens
caataaaggcagctgc

SEQ ID NO: 658905 - DNA, 17 bp, Homo sapiens
caataaaggcagctgcc

SEQ ID NO: 658906 - DNA, 19 bp, Homo sapiens
caataaaggcagctgcctc

SEQ ID NO: 658907 - DNA, 22 bp, Homo sapiens
caataacactgtattttaatgt

SEQ ID NO: 658908 - DNA, 17 bp, Homo sapiens
caataactctgggaggg

SEQ ID NO: 658909 - DNA, 22 bp, Homo sapiens
caataagcgttaagggcagagt

SEQ ID NO: 658910 - DNA, 16 bp, Homo sapiens
caatagacacatacat

SEQ ID NO: 658911 - DNA, 21 bp, Homo sapiens
caatagctagctatatatggt

SEQ ID NO: 658912 - DNA, 18 bp, Homo sapiens
caatatcagctttgataa

SEQ ID NO: 658913 - DNA, 17 bp, Homo sapiens
caatatccattctgtag

SEQ ID NO: 658914 - DNA, 19 bp, Homo sapiens
caatatgaatctataagta

SEQ ID NO: 658915 - DNA, 21 bp, Homo sapiens
caatatgaattcaagaaagga

SEQ ID NO: 658916 - DNA, 19 bp, Homo sapiens
caatattccagatctttca

SEQ ID NO: 658917 - DNA, 23 bp, Homo sapiens
caatattgattgggaaaacattt

SEQ ID NO: 658918 - DNA, 14 bp, Homo sapiens
caatctctttttgt

SEQ ID NO: 658919 - DNA, 22 bp, Homo sapiens
caatcttggtttgtcagtttat

SEQ ID NO: 658920 - DNA, 14 bp, Homo sapiens
caatgaaaacatgt

SEQ ID NO: 658921 - DNA, 15 bp, Homo sapiens
caatgaaaacatgta

SEQ ID NO: 658922 - DNA, 16 bp, Homo sapiens
caatgaaaacatgtac

SEQ ID NO: 658923 - DNA, 12 bp, Homo sapiens
caatgaaagtca

SEQ ID NO: 658924 - DNA, 17 bp, Homo sapiens
caatgaaagtcaaattt

SEQ ID NO: 658925 - DNA, 17 bp, Homo sapiens
caatgaaccataaattc

SEQ ID NO: 658926 - DNA, 13 bp, Homo sapiens
caatgacttctaa

SEQ ID NO: 658927 - DNA, 19 bp, Homo sapiens
caatgacttctaatttata

SEQ ID NO: 658928 - DNA, 21 bp, Homo sapiens
caatgagactctagggtccag

SEQ ID NO: 658929 - DNA, 15 bp, Homo sapiens
caatgcttcattatt

SEQ ID NO: 658930 - DNA, 21 bp, Homo sapiens
caatggtgtcagtatccaggc

SEQ ID NO: 658931 - DNA, 11 bp, Homo sapiens
caatgtgaata

SEQ ID NO: 658932 - DNA, 18 bp, Homo sapiens
caatgtgaggggtcccta

SEQ ID NO: 658933 - DNA, 18 bp, Homo sapiens
caattaatagtttgtcta

SEQ ID NO: 658934 - DNA, 19 bp, Homo sapiens
caattaatagtttgtctat

SEQ ID NO: 658935 - DNA, 16 bp, Homo sapiens
caattatttgcatatt

SEQ ID NO: 658936 - DNA, 23 bp, Homo sapiens
caattcctacctcttcacctgac

SEQ ID NO: 658937 - DNA, 22 bp, Homo sapiens
caattctgcccgctccatggaa

SEQ ID NO: 658938 - DNA, 13 bp, Homo sapiens
caattgaaagctt

SEQ ID NO: 658939 - DNA, 15 bp, Homo sapiens
caattgtcacttttt

SEQ ID NO: 658940 - DNA, 23 bp, Homo sapiens
caattgttttacctgttctgaaa

SEQ ID NO: 658941 - DNA, 13 bp, Homo sapiens
caattttctgtaa

SEQ ID NO: 658942 - DNA, 18 bp, Homo sapiens
caatttttgtctcagaag

SEQ ID NO: 658943 - DNA, 19 bp, Homo sapiens
caatttttgtctcagaagt

SEQ ID NO: 658944 - DNA, 13 bp, Homo sapiens
cacaaatgtcatt

SEQ ID NO: 658945 - DNA, 15 bp, Homo sapiens
cacaaatgtcattgt

SEQ ID NO: 658946 - DNA, 18 bp, Homo sapiens
cacaaatgtcattgtcta

SEQ ID NO: 658947 - DNA, 13 bp, Homo sapiens
cacaaattttcaa

SEQ ID NO: 658948 - DNA, 18 bp, Homo sapiens
cacaatatagttttttct

SEQ ID NO: 658949 - DNA, 22 bp, Homo sapiens
cacaatgagaatgatgcacact

SEQ ID NO: 658950 - DNA, 21 bp, Homo sapiens
cacaatgttccttttttgtat

SEQ ID NO: 658951 - DNA, 22 bp, Homo sapiens
cacaatgttccttttttgtata

SEQ ID NO: 658952 - DNA, 13 bp, Homo sapiens
cacacactgtgcc

SEQ ID NO: 658953 - DNA, 16 bp, Homo sapiens
cacacatttaattcag

SEQ ID NO: 658954 - DNA, 14 bp, Homo sapiens
cacacccagctact

SEQ ID NO: 658955 - DNA, 14 bp, Homo sapiens
cacacctttattca

SEQ ID NO: 658956 - DNA, 20 bp, Homo sapiens
cacactgtcatgcttcatca

SEQ ID NO: 658957 - DNA, 22 bp, Homo sapiens
cacactgtcatgcttcatcatt

SEQ ID NO: 658958 - DNA, 17 bp, Homo sapiens
cacactgtggccaggcc

SEQ ID NO: 658959 - DNA, 18 bp, Homo sapiens
cacactgtggccaggcct

SEQ ID NO: 658960 - DNA, 14 bp, Homo sapiens
cacagaccaggcct

SEQ ID NO: 658961 - DNA, 15 bp, Homo sapiens
cacagaccaggcctt

SEQ ID NO: 658962 - DNA, 21 bp, Homo sapiens
cacagagtttttcaggagaga

SEQ ID NO: 658963 - DNA, 18 bp, Homo sapiens
cacagcccaaaatttgat

SEQ ID NO: 658964 - DNA, 15 bp, Homo sapiens
cacagcccagcttgg

SEQ ID NO: 658965 - DNA, 14 bp, Homo sapiens
cacagcgtccctgg

SEQ ID NO: 658966 - DNA, 15 bp, Homo sapiens
cacagcgtccctggc

SEQ ID NO: 658967 - DNA, 16 bp, Homo sapiens
cacagcgtccctggcg

SEQ ID NO: 658968 - DNA, 19 bp, Homo sapiens
cacagcgtccctggcgcag

SEQ ID NO: 658969 - DNA, 23 bp, Homo sapiens
caggatatcacattggagtcact

SEQ ID NO: 658970 - DNA, 21 bp, Homo sapiens
caggatatccttatcagagct

SEQ ID NO: 658971 - DNA, 21 bp, Homo sapiens
caggcagagtggcgtggcctc

SEQ ID NO: 658972 - DNA, 16 bp, Homo sapiens
caggcagcgcagggct

SEQ ID NO: 658973 - DNA, 17 bp, Homo sapiens
caggcagcgcagggctg

SEQ ID NO: 658974 - DNA, 22 bp, Homo sapiens
caggcagcgcagggctggcacg

SEQ ID NO: 658975 - DNA, 13 bp, Homo sapiens
caggcagcgccaa

SEQ ID NO: 658976 - DNA, 24 bp, Homo sapiens
caggcaggcggctcctcctcaccc

SEQ ID NO: 658977 - DNA, 15 bp, Homo sapiens
caggcatggccctgg

SEQ ID NO: 658978 - DNA, 16 bp, Homo sapiens
caggcatggccctggg

SEQ ID NO: 658979 - DNA, 15 bp, Homo sapiens
caggcattgaggaag

SEQ ID NO: 658980 - DNA, 22 bp, Homo sapiens
caggccacagtggggctgcagg

SEQ ID NO: 658981 - DNA, 24 bp, Homo sapiens
caggccacagtggggctgcaggca

SEQ ID NO: 658982 - DNA, 14 bp, Homo sapiens
caggccccaggcct

SEQ ID NO: 658983 - DNA, 16 bp, Homo sapiens
caggccctcctctccc

SEQ ID NO: 658984 - DNA, 22 bp, Homo sapiens
caggcctgcagcaggagtggtg

SEQ ID NO: 658985 - DNA, 17 bp, Homo sapiens
caggcctgcctcccact

SEQ ID NO: 658986 - DNA, 15 bp, Homo sapiens
caggcgcctgccatc

SEQ ID NO: 658987 - DNA, 12 bp, Homo sapiens
caggcggctcct

SEQ ID NO: 658988 - DNA, 13 bp, Homo sapiens
caggcggctcctc

SEQ ID NO: 658989 - DNA, 17 bp, Homo sapiens
caggctcgtcagccacc

SEQ ID NO: 658990 - DNA, 20 bp, Homo sapiens
caggctcgtcagccacctgg

SEQ ID NO: 658991 - DNA, 21 bp, Homo sapiens
caggctcgtcagccacctggg

SEQ ID NO: 658992 - DNA, 19 bp, Homo sapiens
caggctgaaatatccaccc

SEQ ID NO: 658993 - DNA, 22 bp, Homo sapiens
caggctgaaatatccacccagc

SEQ ID NO: 658994 - DNA, 20 bp, Homo sapiens
caggctgcctcctgccctta

SEQ ID NO: 658995 - DNA, 15 bp, Homo sapiens
caggctggcagttgg

SEQ ID NO: 658996 - DNA, 17 bp, Homo sapiens
caggctgggccatgtcc

SEQ ID NO: 658997 - DNA, 20 bp, Homo sapiens
caggcttccctgacttgctt

SEQ ID NO: 658998 - DNA, 19 bp, Homo sapiens
caggctttgtacagagtgc

SEQ ID NO: 658999 - DNA, 17 bp, Homo sapiens
cagggaaaattgcccca

SEQ ID NO: 659000 - DNA, 15 bp, Homo sapiens
cagggaaggcctgac

SEQ ID NO: 659001 - DNA, 16 bp, Homo sapiens
cagggaaggcctgact

SEQ ID NO: 659002 - DNA, 23 bp, Homo sapiens
cagggaaggcctgacttctgctg

SEQ ID NO: 659003 - DNA, 16 bp, Homo sapiens
cagggaaggtgaaaca

SEQ ID NO: 659004 - DNA, 22 bp, Homo sapiens
cagggagacggtttccagggag

SEQ ID NO: 659005 - DNA, 23 bp, Homo sapiens
cagggagacggtttccagggagg

SEQ ID NO: 659006 - DNA, 16 bp, Homo sapiens
cagggagcagggaagg

SEQ ID NO: 659007 - DNA, 21 bp, Homo sapiens
cagggagcagggaaggcctga

SEQ ID NO: 659008 - DNA, 15 bp, Homo sapiens
cagggagctgggccc

SEQ ID NO: 659009 - DNA, 19 bp, Homo sapiens
cagggagctgggcccgaca

SEQ ID NO: 659010 - DNA, 22 bp, Homo sapiens
cagggagctgggcccgacatgg

SEQ ID NO: 659011 - DNA, 16 bp, Homo sapiens
cagggagtgctggctc

SEQ ID NO: 659012 - DNA, 12 bp, Homo sapiens
cagggcagcggc

SEQ ID NO: 659013 - DNA, 23 bp, Homo sapiens
cagggcataggaagaaaatgtca

SEQ ID NO: 659014 - DNA, 12 bp, Homo sapiens
cagggccacctg

SEQ ID NO: 659015 - DNA, 17 bp, Homo sapiens
cagggccacctgcagga

SEQ ID NO: 659016 - DNA, 17 bp, Homo sapiens
cagggccagtggggcct

SEQ ID NO: 659017 - DNA, 18 bp, Homo sapiens
cagggccatggctcaggg

SEQ ID NO: 659018 - DNA, 22 bp, Homo sapiens
cagggccatggctcagggtggt

SEQ ID NO: 659019 - DNA, 22 bp, Homo sapiens
cagggcctggggcctgagagaa

SEQ ID NO: 659020 - DNA, 22 bp, Homo sapiens
cagggctcatttttgcacttat

SEQ ID NO: 659021 - DNA, 21 bp, Homo sapiens
cagggctcccaggggtctccc

SEQ ID NO: 659022 - DNA, 19 bp, Homo sapiens
cagggctggagcctggggt

SEQ ID NO: 659023 - DNA, 22 bp, Homo sapiens
cagggggatgccactcctccct

SEQ ID NO: 659024 - DNA, 18 bp, Homo sapiens
cagggtcatgtttgcagg

SEQ ID NO: 659025 - DNA, 20 bp, Homo sapiens
cagggtctctccctcaggtg

SEQ ID NO: 659026 - DNA, 21 bp, Homo sapiens
cagggtctctccctcaggtgt

SEQ ID NO: 659027 - DNA, 19 bp, Homo sapiens
caggtaactaattggaagg

SEQ ID NO: 659028 - DNA, 22 bp, Homo sapiens
caggtagaaggttgacacagtt

SEQ ID NO: 659029 - DNA, 13 bp, Homo sapiens
caggtgaacactt

SEQ ID NO: 659030 - DNA, 18 bp, Homo sapiens
caggtgaacacttagtga

SEQ ID NO: 659031 - DNA, 12 bp, Homo sapiens
caggtgcagagg

SEQ ID NO: 659032 - DNA, 16 bp, Homo sapiens
caggtggaaggcagac

SEQ ID NO: 659033 - DNA, 18 bp, Homo sapiens
caggtggaaggcagacag

SEQ ID NO: 659034 - DNA, 12 bp, Homo sapiens
caggtgggctgg

SEQ ID NO: 659035 - DNA, 22 bp, Homo sapiens
caggtgggctggacttctacct

SEQ ID NO: 659036 - DNA, 18 bp, Homo sapiens
caggttgggctagagaaa

SEQ ID NO: 659037 - DNA, 14 bp, Homo sapiens
cagtaatctttata

SEQ ID NO: 659038 - DNA, 18 bp, Homo sapiens
cagtaatctttatactgg

SEQ ID NO: 659039 - DNA, 23 bp, Homo sapiens
cagtaatgcagtttttaaaaacc

SEQ ID NO: 659040 - DNA, 15 bp, Homo sapiens
cagtacaatcagcag

SEQ ID NO: 659041 - DNA, 23 bp, Homo sapiens
cagtaccatttaatggggaggac

SEQ ID NO: 659042 - DNA, 18 bp, Homo sapiens
cagtactttgtgcattct

SEQ ID NO: 659043 - DNA, 16 bp, Homo sapiens
cagtcatcatcagggc

SEQ ID NO: 659044 - DNA, 18 bp, Homo sapiens
cagtcatcatcagggcct

SEQ ID NO: 659045 - DNA, 18 bp, Homo sapiens
cagtcccacactgtgcag

SEQ ID NO: 659046 - DNA, 23 bp, Homo sapiens
cagtcccacactgtgcagaccca

SEQ ID NO: 659047 - DNA, 22 bp, Homo sapiens
cagtccctcttctggtttccct

SEQ ID NO: 659048 - DNA, 14 bp, Homo sapiens
cagtcctaatttga

SEQ ID NO: 659049 - DNA, 16 bp, Homo sapiens
cagtcctgggcaaagg

SEQ ID NO: 659050 - DNA, 14 bp, Homo sapiens
cagtcgcctgcctg

SEQ ID NO: 659051 - DNA, 22 bp, Homo sapiens
cagtcgcctgcctgcagcaggc

SEQ ID NO: 659052 - DNA, 15 bp, Homo sapiens
cagtctcattgtcac

SEQ ID NO: 659053 - DNA, 11 bp, Homo sapiens
cagtcttgctc

SEQ ID NO: 659054 - DNA, 20 bp, Homo sapiens
cagtgaagatattttatttc

SEQ ID NO: 659055 - DNA, 16 bp, Homo sapiens
cagtgactccctggga

SEQ ID NO: 659056 - DNA, 18 bp, Homo sapiens
cagtgactccctgggagc

SEQ ID NO: 659057 - DNA, 16 bp, Homo sapiens
cagtgagggtcttctt

SEQ ID NO: 659058 - DNA, 14 bp, Homo sapiens
cagtgcatggtggc

SEQ ID NO: 659059 - DNA, 14 bp, Homo sapiens
cagtgcctcacctt

SEQ ID NO: 659060 - DNA, 13 bp, Homo sapiens
cagtgcctccaca

SEQ ID NO: 659061 - DNA, 17 bp, Homo sapiens
cagtgccttttggaact

SEQ ID NO: 659062 - DNA, 14 bp, Homo sapiens
cagtggcagagaat

SEQ ID NO: 659063 - DNA, 18 bp, Homo sapiens
cagtggcagagaatccaa

SEQ ID NO: 659064 - DNA, 15 bp, Homo sapiens
cagtgggaaatatgc

SEQ ID NO: 659065 - DNA, 19 bp, Homo sapiens
cagtggggctgcaggcagg

SEQ ID NO: 659066 - DNA, 16 bp, Homo sapiens
cagtggtgaccccctt

SEQ ID NO: 659067 - DNA, 13 bp, Homo sapiens
cagtgtcctttcc

SEQ ID NO: 659068 - DNA, 14 bp, Homo sapiens
cagtgtcctttcca

SEQ ID NO: 659069 - DNA, 14 bp, Homo sapiens
cagtgtctgtctga

SEQ ID NO: 659070 - DNA, 17 bp, Homo sapiens
cagtgtctgtctgaggt

SEQ ID NO: 659071 - DNA, 22 bp, Homo sapiens
cagtgtgcctggttaatattaa

SEQ ID NO: 659072 - DNA, 16 bp, Homo sapiens
cagtgttggtatattt

SEQ ID NO: 659073 - DNA, 18 bp, Homo sapiens
cagttaacttactcttta

SEQ ID NO: 659074 - DNA, 13 bp, Homo sapiens
cagttaattacat

SEQ ID NO: 659075 - DNA, 15 bp, Homo sapiens
cagttataagaagaa

SEQ ID NO: 659076 - DNA, 18 bp, Homo sapiens
cagttatgtttgaatgaa

SEQ ID NO: 659077 - DNA, 17 bp, Homo sapiens
cagttccagccttctct

SEQ ID NO: 659078 - DNA, 23 bp, Homo sapiens
cagttccagccttctctcaagga

SEQ ID NO: 659079 - DNA, 23 bp, Homo sapiens
cagttgtcttatgtgaaaaatta

SEQ ID NO: 659080 - DNA, 23 bp, Homo sapiens
cagtttaaaggggtcccatcagt

SEQ ID NO: 659081 - DNA, 12 bp, Homo sapiens
cagtttccaaat

SEQ ID NO: 659082 - DNA, 18 bp, Homo sapiens
cagtttgaaaatattttg

SEQ ID NO: 659083 - DNA, 15 bp, Homo sapiens
cagttttactctgct

SEQ ID NO: 659084 - DNA, 16 bp, Homo sapiens
cagttttatgccccat

SEQ ID NO: 659085 - DNA, 15 bp, Homo sapiens
cagtttttaaaaacc

SEQ ID NO: 659086 - DNA, 20 bp, Homo sapiens
cataaagaattaatgactta

SEQ ID NO: 659087 - DNA, 16 bp, Homo sapiens
cataaagtacaaatga

SEQ ID NO: 659088 - DNA, 14 bp, Homo sapiens
cattaaaatataat

SEQ ID NO: 659089 - DNA, 21 bp, Homo sapiens
cattaaaatttcttatttacc

SEQ ID NO: 659090 - DNA, 18 bp, Homo sapiens
cattaaggggaagaatga

SEQ ID NO: 659091 - DNA, 23 bp, Homo sapiens
cattaaggggaagaatgaaagct

SEQ ID NO: 659092 - DNA, 19 bp, Homo sapiens
cattagagaacatcctggc

SEQ ID NO: 659093 - DNA, 20 bp, Homo sapiens
cattataacaactatttact

SEQ ID NO: 659094 - DNA, 13 bp, Homo sapiens
cattatgattctt

SEQ ID NO: 659095 - DNA, 18 bp, Homo sapiens
cattattcaagaatgaaa

SEQ ID NO: 659096 - DNA, 13 bp, Homo sapiens
cattatttctagt

SEQ ID NO: 659097 - DNA, 21 bp, Homo sapiens
cattcaattagtggtcataaa

SEQ ID NO: 659098 - DNA, 16 bp, Homo sapiens
cattccttgaggacag

SEQ ID NO: 659099 - DNA, 17 bp, Homo sapiens
cattccttgaggacaga

SEQ ID NO: 659100 - DNA, 21 bp, Homo sapiens
cattctgggtgtgttcttact

SEQ ID NO: 659101 - DNA, 23 bp, Homo sapiens
cattctggtcaagggctgtcatt

SEQ ID NO: 659102 - DNA, 17 bp, Homo sapiens
cattgaaagaagagatg

SEQ ID NO: 659103 - DNA, 22 bp, Homo sapiens
cattgaaggcttaattgactga

SEQ ID NO: 659104 - DNA, 21 bp, Homo sapiens
cattgaagtatggtgtgttca

SEQ ID NO: 659105 - DNA, 16 bp, Homo sapiens
cattgaggaagagtct

SEQ ID NO: 659106 - DNA, 16 bp, Homo sapiens
cattgagtattgttta

SEQ ID NO: 659107 - DNA, 15 bp, Homo sapiens
cattgataatcttca

SEQ ID NO: 659108 - DNA, 17 bp, Homo sapiens
cattgataatcttcagg

SEQ ID NO: 659109 - DNA, 22 bp, Homo sapiens
cattgccgctgtataaagcatg

SEQ ID NO: 659110 - DNA, 17 bp, Homo sapiens
cattggagtttcaaatc

SEQ ID NO: 659111 - DNA, 22 bp, Homo sapiens
cattggtgaagtaaattaggca

SEQ ID NO: 659112 - DNA, 15 bp, Homo sapiens
cattgtaaaagcatt

SEQ ID NO: 659113 - DNA, 13 bp, Homo sapiens
cattgtcttgatg

SEQ ID NO: 659114 - DNA, 15 bp, Homo sapiens
cattgttatttatac

SEQ ID NO: 659115 - DNA, 19 bp, Homo sapiens
catttaaaacattaaaata

SEQ ID NO: 659116 - DNA, 15 bp, Homo sapiens
catttaaaattgcta

SEQ ID NO: 659117 - DNA, 22 bp, Homo sapiens
catttaaaattgctatgttact

SEQ ID NO: 659118 - DNA, 21 bp, Homo sapiens
catttaaagaccaataaactt

SEQ ID NO: 659119 - DNA, 16 bp, Homo sapiens
catttaaatatctgtt

SEQ ID NO: 659120 - DNA, 21 bp, Homo sapiens
catttagctggccacatggcg

SEQ ID NO: 659121 - DNA, 17 bp, Homo sapiens
catttatttatccagaa

SEQ ID NO: 659122 - DNA, 19 bp, Homo sapiens
catttcatcattgtttctg

SEQ ID NO: 659123 - DNA, 21 bp, Homo sapiens
catttcattcctaacacagca

SEQ ID NO: 659124 - DNA, 18 bp, Homo sapiens
catttccaagaggctgta

SEQ ID NO: 659125 - DNA, 16 bp, Homo sapiens
catttccattgcttat

SEQ ID NO: 659126 - DNA, 18 bp, Homo sapiens
catttcccaacacaaaga

SEQ ID NO: 659127 - DNA, 14 bp, Homo sapiens
catttctataaata

SEQ ID NO: 659128 - DNA, 15 bp, Homo sapiens
catttcttcacttca

SEQ ID NO: 659129 - DNA, 16 bp, Homo sapiens
catttgacaaaactaa

SEQ ID NO: 659130 - DNA, 22 bp, Homo sapiens
catttgctactgttgtaagaat

SEQ ID NO: 659131 - DNA, 14 bp, Homo sapiens
catttgctttggaa

SEQ ID NO: 659132 - DNA, 19 bp, Homo sapiens
catttgtaagtgtaaaaaa

SEQ ID NO: 659133 - DNA, 22 bp, Homo sapiens
catttgtaagtgtaaaaaatgt

SEQ ID NO: 659134 - DNA, 23 bp, Homo sapiens
catttgtggtaatctacaccaat

SEQ ID NO: 659135 - DNA, 20 bp, Homo sapiens
catttgtggtcctgaaggaa

SEQ ID NO: 659136 - DNA, 23 bp, Homo sapiens
catttgtttctttctctgaggac

SEQ ID NO: 659137 - DNA, 18 bp, Homo sapiens
cattttaaaatgtcttgg

SEQ ID NO: 659138 - DNA, 19 bp, Homo sapiens
cattttaaaatgtcttggt

SEQ ID NO: 659139 - DNA, 15 bp, Homo sapiens
cattttaattttaaa

SEQ ID NO: 659140 - DNA, 20 bp, Homo sapiens
cattttatcattaaaaatta

SEQ ID NO: 659141 - DNA, 13 bp, Homo sapiens
cattttattaata

SEQ ID NO: 659142 - DNA, 17 bp, Homo sapiens
cattttattaataatat

SEQ ID NO: 659143 - DNA, 20 bp, Homo sapiens
cattttcctgacatttgttt

SEQ ID NO: 659144 - DNA, 12 bp, Homo sapiens
cattttctaaat

SEQ ID NO: 659145 - DNA, 18 bp, Homo sapiens
cattttctaaataaaaat

SEQ ID NO: 659146 - DNA, 12 bp, Homo sapiens
cattttgaagtg

SEQ ID NO: 659147 - DNA, 12 bp, Homo sapiens
cattttgtaata

SEQ ID NO: 659148 - DNA, 16 bp, Homo sapiens
cattttgtaataataa

SEQ ID NO: 659149 - DNA, 12 bp, Homo sapiens
cattttgttaca

SEQ ID NO: 659150 - DNA, 21 bp, Homo sapiens
catttttaagaaaggaagcaa

SEQ ID NO: 659151 - DNA, 14 bp, Homo sapiens
catttttgtatttt

SEQ ID NO: 659152 - DNA, 14 bp, Homo sapiens
cattttttcttctg

SEQ ID NO: 659153 - DNA, 14 bp, Homo sapiens
catttttttgcatg

SEQ ID NO: 659154 - DNA, 13 bp, Homo sapiens
ccaaagaggctgc

SEQ ID NO: 659155 - DNA, 16 bp, Homo sapiens
ccaaagaggctgcccc

SEQ ID NO: 659156 - DNA, 22 bp, Homo sapiens
ccaaagaggctgcccctctcac

SEQ ID NO: 659157 - DNA, 15 bp, Homo sapiens
ccaaatataagacat

SEQ ID NO: 659158 - DNA, 15 bp, Homo sapiens
ccaaatgcaatttga

SEQ ID NO: 659159 - DNA, 18 bp, Homo sapiens
ccaaatttaaaatgtgtg

SEQ ID NO: 659160 - DNA, 12 bp, Homo sapiens
ccaacagttgta

SEQ ID NO: 659161 - DNA, 13 bp, Homo sapiens
ccaaccctgggct

SEQ ID NO: 659162 - DNA, 22 bp, Homo sapiens
ccaacctcagggctcccagggg

SEQ ID NO: 659163 - DNA, 23 bp, Homo sapiens
ccaacctccagtgtcagggtcca

SEQ ID NO: 659164 - DNA, 22 bp, Homo sapiens
ccaactccgtgtggtaagcaac

SEQ ID NO: 659165 - DNA, 19 bp, Homo sapiens
ccaactgccaggctgcctc

SEQ ID NO: 659166 - DNA, 18 bp, Homo sapiens
ccaagaaaatgaagggat

SEQ ID NO: 659167 - DNA, 21 bp, Homo sapiens
ccaagaaagctcactgtagct

SEQ ID NO: 659168 - DNA, 20 bp, Homo sapiens
ccaagaagcaaagttcaact

SEQ ID NO: 659169 - DNA, 11 bp, Homo sapiens
ccaagaatgta

SEQ ID NO: 659170 - DNA, 17 bp, Homo sapiens
ccaagaatgtacgtcca

SEQ ID NO: 659171 - DNA, 18 bp, Homo sapiens
ccaagaatgtacgtccag

SEQ ID NO: 659172 - DNA, 21 bp, Homo sapiens
ccaagaatgtacgtccagcct

SEQ ID NO: 659173 - DNA, 16 bp, Homo sapiens
ccaagcaacatttgta

SEQ ID NO: 659174 - DNA, 15 bp, Homo sapiens
ccaagcagtggcctt

SEQ ID NO: 659175 - DNA, 16 bp, Homo sapiens
ccaagctgattttatt

SEQ ID NO: 659176 - DNA, 22 bp, Homo sapiens
ccaagcttggtttgtggcgtct

SEQ ID NO: 659177 - DNA, 23 bp, Homo sapiens
ccaaggaagcagaagacgggagg

SEQ ID NO: 659178 - DNA, 13 bp, Homo sapiens
ccaaggagggggc

SEQ ID NO: 659179 - DNA, 16 bp, Homo sapiens
ccaagtgcaaaagaaa

SEQ ID NO: 659180 - DNA, 16 bp, Homo sapiens
ccaagtgcactttcta

SEQ ID NO: 659181 - DNA, 13 bp, Homo sapiens
ccaagtgcgtgcc

SEQ ID NO: 659182 - DNA, 20 bp, Homo sapiens
ccaagtggaccttgagacca

SEQ ID NO: 659183 - DNA, 13 bp, Homo sapiens
ccaataaaaacat

SEQ ID NO: 659184 - DNA, 15 bp, Homo sapiens
ccaataaaggcagct

SEQ ID NO: 659185 - DNA, 21 bp, Homo sapiens
ccaataaaggcagctgcctct

SEQ ID NO: 659186 - DNA, 23 bp, Homo sapiens
ccaataaaggcagctgcctctgc

SEQ ID NO: 659187 - DNA, 13 bp, Homo sapiens
ccaatatattctg

SEQ ID NO: 659188 - DNA, 16 bp, Homo sapiens
ccaatgtgacctgggg

SEQ ID NO: 659189 - DNA, 20 bp, Homo sapiens
ccaatgtgacctggggcaga

SEQ ID NO: 659190 - DNA, 14 bp, Homo sapiens
ccaattctcccctc

SEQ ID NO: 659191 - DNA, 18 bp, Homo sapiens
ccacaattattggcaaag

SEQ ID NO: 659192 - DNA, 19 bp, Homo sapiens
ccacaattattggcaaagt

SEQ ID NO: 659193 - DNA, 18 bp, Homo sapiens
ccacactgtggccaggcc

SEQ ID NO: 659194 - DNA, 23 bp, Homo sapiens
ccacacttgaagcctaaatttgt

SEQ ID NO: 659195 - DNA, 13 bp, Homo sapiens
ccacagaggacac

SEQ ID NO: 659196 - DNA, 18 bp, Homo sapiens
ccacagagtttttcagga

SEQ ID NO: 659197 - DNA, 18 bp, Homo sapiens
ccacagccggtcagagga

SEQ ID NO: 659198 - DNA, 16 bp, Homo sapiens
ccacagcgtccctggc

SEQ ID NO: 659199 - DNA, 15 bp, Homo sapiens
ccacaggccctggct

SEQ ID NO: 659200 - DNA, 22 bp, Homo sapiens
ccacagggttcaaaatgtctgt

SEQ ID NO: 659201 - DNA, 14 bp, Homo sapiens
ccacatgctgcctg

SEQ ID NO: 659202 - DNA, 15 bp, Homo sapiens
ccacatgctgcctgg

SEQ ID NO: 659203 - DNA, 17 bp, Homo sapiens
ccacatgctgcctggca

SEQ ID NO: 659204 - DNA, 18 bp, Homo sapiens
ccacatgctgcctggcac

SEQ ID NO: 659205 - DNA, 11 bp, Homo sapiens
ccaccactcag

SEQ ID NO: 659206 - DNA, 14 bp, Homo sapiens
ccaccactcaggcc

SEQ ID NO: 659207 - DNA, 16 bp, Homo sapiens
ccaccccccactcagt

SEQ ID NO: 659208 - DNA, 20 bp, Homo sapiens
ccctcgcctcctcctcctgc

SEQ ID NO: 659209 - DNA, 12 bp, Homo sapiens
ccctctcctccc

SEQ ID NO: 659210 - DNA, 15 bp, Homo sapiens
ccctgacttgcttta

SEQ ID NO: 659211 - DNA, 16 bp, Homo sapiens
ccctgagtctgggcag

SEQ ID NO: 659212 - DNA, 24 bp, Homo sapiens
ccctgcaaacagaacagggtcatg

SEQ ID NO: 659213 - DNA, 13 bp, Homo sapiens
ccctgcccatgct

SEQ ID NO: 659214 - DNA, 23 bp, Homo sapiens
ccctgcctgagaagccccgacac

SEQ ID NO: 659215 - DNA, 17 bp, Homo sapiens
ccctgcctggcccccaa

SEQ ID NO: 659216 - DNA, 16 bp, Homo sapiens
ccctgctttgcatctt

SEQ ID NO: 659217 - DNA, 20 bp, Homo sapiens
ccctggatcacataccaggt

SEQ ID NO: 659218 - DNA, 16 bp, Homo sapiens
ccctggctccctcctc

SEQ ID NO: 659219 - DNA, 20 bp, Homo sapiens
ccctggctccctcctccagg

SEQ ID NO: 659220 - DNA, 17 bp, Homo sapiens
ccctggctttgcctctt

SEQ ID NO: 659221 - DNA, 19 bp, Homo sapiens
ccctggctttgcctcttct

SEQ ID NO: 659222 - DNA, 17 bp, Homo sapiens
ccctgggccagggtctg

SEQ ID NO: 659223 - DNA, 22 bp, Homo sapiens
ccctgggccagggtctgtgtga

SEQ ID NO: 659224 - DNA, 21 bp, Homo sapiens
ccctgggctattgctgctgcc

SEQ ID NO: 659225 - DNA, 22 bp, Homo sapiens
ccctgggtctggggacaggccc

SEQ ID NO: 659226 - DNA, 23 bp, Homo sapiens
ccctgggtgtccccgctgctgtg

SEQ ID NO: 659227 - DNA, 15 bp, Homo sapiens
ccctggtcggagagg

SEQ ID NO: 659228 - DNA, 16 bp, Homo sapiens
ccctgtttcagaggct

SEQ ID NO: 659229 - DNA, 19 bp, Homo sapiens
ccctgtttcagaggctcag

SEQ ID NO: 659230 - DNA, 21 bp, Homo sapiens
cccttacagccctaagtggct

SEQ ID NO: 659231 - DNA, 16 bp, Homo sapiens
cccttccatgtgcctt

SEQ ID NO: 659232 - DNA, 21 bp, Homo sapiens
cccttccatgtgcctttcttt

SEQ ID NO: 659233 - DNA, 17 bp, Homo sapiens
cccttcccatttcttcc

SEQ ID NO: 659234 - DNA, 19 bp, Homo sapiens
cccttgattcccaccgtac

SEQ ID NO: 659235 - DNA, 11 bp, Homo sapiens
cccttgcctct

SEQ ID NO: 659236 - DNA, 12 bp, Homo sapiens
cccttgcctctg

SEQ ID NO: 659237 - DNA, 20 bp, Homo sapiens
cccttgcctctgccctggat

SEQ ID NO: 659238 - DNA, 14 bp, Homo sapiens
cccttgctgtatgc

SEQ ID NO: 659239 - DNA, 12 bp, Homo sapiens
ccctttactcgt

SEQ ID NO: 659240 - DNA, 13 bp, Homo sapiens
cccttttcctttt

SEQ ID NO: 659241 - DNA, 22 bp, Homo sapiens
ccgaagatggtggccacagact

SEQ ID NO: 659242 - DNA, 18 bp, Homo sapiens
ccgacacacggggctcgg

SEQ ID NO: 659243 - DNA, 13 bp, Homo sapiens
ccgagaaggttta

SEQ ID NO: 659244 - DNA, 14 bp, Homo sapiens
ccgcagaagcagac

SEQ ID NO: 659245 - DNA, 14 bp, Homo sapiens
ccgcccagcctcac

SEQ ID NO: 659246 - DNA, 15 bp, Homo sapiens
ccgcccagcctcact

SEQ ID NO: 659247 - DNA, 14 bp, Homo sapiens
ccgcgcgtccagct

SEQ ID NO: 659248 - DNA, 23 bp, Homo sapiens
ccgcgcgtccagctgcccttccg

SEQ ID NO: 659249 - DNA, 16 bp, Homo sapiens
ccgctacagtttttat

SEQ ID NO: 659250 - DNA, 16 bp, Homo sapiens
ccgctacctccctccc

SEQ ID NO: 659251 - DNA, 19 bp, Homo sapiens
ccgcttgaaaagctagtgt

SEQ ID NO: 659252 - DNA, 20 bp, Homo sapiens
ccggagcagcagcttctcca

SEQ ID NO: 659253 - DNA, 23 bp, Homo sapiens
ccggagctggaggatcccctcca

SEQ ID NO: 659254 - DNA, 17 bp, Homo sapiens
ccggagtccctgcaggt

SEQ ID NO: 659255 - DNA, 20 bp, Homo sapiens
ccggcatgagactcagtgca

SEQ ID NO: 659256 - DNA, 21 bp, Homo sapiens
ccggcatgagactcagtgcag

SEQ ID NO: 659257 - DNA, 14 bp, Homo sapiens
ccgggcgcggtggc

SEQ ID NO: 659258 - DNA, 23 bp, Homo sapiens
ccggtcagaggagcgcaggcagc

SEQ ID NO: 659259 - DNA, 12 bp, Homo sapiens
ccggtcagtgcc

SEQ ID NO: 659260 - DNA, 16 bp, Homo sapiens
ccggtgtatcctggcc

SEQ ID NO: 659261 - DNA, 22 bp, Homo sapiens
ccggtgtatcctggccctgggg

SEQ ID NO: 659262 - DNA, 17 bp, Homo sapiens
ccgtcacccctgtttct

SEQ ID NO: 659263 - DNA, 15 bp, Homo sapiens
ccgtggcacagctgg

SEQ ID NO: 659264 - DNA, 18 bp, Homo sapiens
ccgtggcacagctgggag

SEQ ID NO: 659265 - DNA, 20 bp, Homo sapiens
ccgtggcacagctgggagcc

SEQ ID NO: 659266 - DNA, 16 bp, Homo sapiens
ccgtgtctgtctggca

SEQ ID NO: 659267 - DNA, 18 bp, Homo sapiens
ccgtgtgagtgtgacagg

SEQ ID NO: 659268 - DNA, 22 bp, Homo sapiens
ccgtgtgagtgtgacagggcca

SEQ ID NO: 659269 - DNA, 23 bp, Homo sapiens
ccgtgtggtaagcaacatggctt

SEQ ID NO: 659270 - DNA, 13 bp, Homo sapiens
cctaaaagcactc

SEQ ID NO: 659271 - DNA, 13 bp, Homo sapiens
cctaaagcctcaa

SEQ ID NO: 659272 - DNA, 19 bp, Homo sapiens
cctaaagcctcaaaacaaa

SEQ ID NO: 659273 - DNA, 21 bp, Homo sapiens
cctaacatctgacctggcatc

SEQ ID NO: 659274 - DNA, 16 bp, Homo sapiens
cctaagccacttgaaa

SEQ ID NO: 659275 - DNA, 16 bp, Homo sapiens
cctaagtggctgcctt

SEQ ID NO: 659276 - DNA, 18 bp, Homo sapiens
cctaatggctatttttga

SEQ ID NO: 659277 - DNA, 14 bp, Homo sapiens
cctacacactgtca

SEQ ID NO: 659278 - DNA, 15 bp, Homo sapiens
cctacacactgtcat

SEQ ID NO: 659279 - DNA, 22 bp, Homo sapiens
cctacacactgtcatgcttcat

SEQ ID NO: 659280 - DNA, 16 bp, Homo sapiens
cctacagactccatct

SEQ ID NO: 659281 - DNA, 21 bp, Homo sapiens
cctacatatgctgatctttta

SEQ ID NO: 659282 - DNA, 12 bp, Homo sapiens
cctactattggc

SEQ ID NO: 659283 - DNA, 21 bp, Homo sapiens
cctactctccttgagtgtatg

SEQ ID NO: 659284 - DNA, 15 bp, Homo sapiens
cctagaaagttctgt

SEQ ID NO: 659285 - DNA, 15 bp, Homo sapiens
cctagcagcccaccc

SEQ ID NO: 659286 - DNA, 22 bp, Homo sapiens
cctagcagcccaccctgctgct

SEQ ID NO: 659287 - DNA, 19 bp, Homo sapiens
cctagcgatctctcctggc

SEQ ID NO: 659288 - DNA, 17 bp, Homo sapiens
cctagctgtgttattcc

SEQ ID NO: 659289 - DNA, 16 bp, Homo sapiens
cctaggctgctgctgt

SEQ ID NO: 659290 - DNA, 14 bp, Homo sapiens
cctagtaagaagac

SEQ ID NO: 659291 - DNA, 12 bp, Homo sapiens
cctatgctgtgc

SEQ ID NO: 659292 - DNA, 13 bp, Homo sapiens
cctatttatttga

SEQ ID NO: 659293 - DNA, 14 bp, Homo sapiens
cctcaaaacaaagg

SEQ ID NO: 659294 - DNA, 21 bp, Homo sapiens
cctcaactcacctaatgttta

SEQ ID NO: 659295 - DNA, 18 bp, Homo sapiens
cctcaatagatctccagc

SEQ ID NO: 659296 - DNA, 14 bp, Homo sapiens
cctcaatttttgtt

SEQ ID NO: 659297 - DNA, 15 bp, Homo sapiens
cctcacccacctctg

SEQ ID NO: 659298 - DNA, 21 bp, Homo sapiens
cctcacttcctttgcccttcc

SEQ ID NO: 659299 - DNA, 17 bp, Homo sapiens
cctcagggagcagggaa

SEQ ID NO: 659300 - DNA, 21 bp, Homo sapiens
cctcagggagcagggaaggcc

SEQ ID NO: 659301 - DNA, 14 bp, Homo sapiens
cctcagggctccca

SEQ ID NO: 659302 - DNA, 14 bp, Homo sapiens
cctcagtccctctt

SEQ ID NO: 659303 - DNA, 20 bp, Homo sapiens
cctcagttgaaaatgcaact

SEQ ID NO: 659304 - DNA, 22 bp, Homo sapiens
cctcagttgaaaatgcaactct

SEQ ID NO: 659305 - DNA, 21 bp, Homo sapiens
cctcatctatgaggaaaggtt

SEQ ID NO: 659306 - DNA, 15 bp, Homo sapiens
cctcatgccaaccct

SEQ ID NO: 659307 - DNA, 21 bp, Homo sapiens
cctcattctggttccctgctg

SEQ ID NO: 659308 - DNA, 17 bp, Homo sapiens
cctcattgtgtctcccg

SEQ ID NO: 659309 - DNA, 18 bp, Homo sapiens
cctccaccccccactcag

SEQ ID NO: 659310 - DNA, 20 bp, Homo sapiens
cctccaggcctgcctcccac

SEQ ID NO: 659311 - DNA, 14 bp, Homo sapiens
cctccaggtgcaga

SEQ ID NO: 659312 - DNA, 17 bp, Homo sapiens
cctccaggtgcagaggt

SEQ ID NO: 659313 - DNA, 16 bp, Homo sapiens
cctccagtaccttgct

SEQ ID NO: 659314 - DNA, 22 bp, Homo sapiens
cctccagtattgccccctctca

SEQ ID NO: 659315 - DNA, 19 bp, Homo sapiens
cctcccacacccaaagctg

SEQ ID NO: 659316 - DNA, 12 bp, Homo sapiens
cctcccactttg

SEQ ID NO: 659317 - DNA, 19 bp, Homo sapiens
cctccccatgggcacagtg

SEQ ID NO: 659318 - DNA, 15 bp, Homo sapiens
cctcccgaagccacc

SEQ ID NO: 659319 - DNA, 15 bp, Homo sapiens
cctccgtcccctgcc

SEQ ID NO: 659320 - DNA, 12 bp, Homo sapiens
cctcctccaggg

SEQ ID NO: 659321 - DNA, 16 bp, Homo sapiens
cctcctcctcctgccc

SEQ ID NO: 659322 - DNA, 12 bp, Homo sapiens
cctcctcctgcc

SEQ ID NO: 659323 - DNA, 13 bp, Homo sapiens
cctcctctcagtg

SEQ ID NO: 659324 - DNA, 19 bp, Homo sapiens
cctcctctcccatccttga

SEQ ID NO: 659325 - DNA, 16 bp, Homo sapiens
cctcctgcacacaggg

SEQ ID NO: 659326 - DNA, 14 bp, Homo sapiens
cctcctgccctcct

SEQ ID NO: 659327 - DNA, 20 bp, Homo sapiens
cctcctgccctcctctcccc

SEQ ID NO: 659328 - DNA, 14 bp, Homo sapiens
cgctacctccctcc

SEQ ID NO: 659329 - DNA, 15 bp, Homo sapiens
cgctacctctctgtc

SEQ ID NO: 659330 - DNA, 14 bp, Homo sapiens
cgctgccagccttg

SEQ ID NO: 659331 - DNA, 23 bp, Homo sapiens
cgctgccagccttgagccctggc

SEQ ID NO: 659332 - DNA, 16 bp, Homo sapiens
cgctgtataaagcatg

SEQ ID NO: 659333 - DNA, 19 bp, Homo sapiens
cggaacggaggcttcagaa

SEQ ID NO: 659334 - DNA, 13 bp, Homo sapiens
cggaggaacagat

SEQ ID NO: 659335 - DNA, 19 bp, Homo sapiens
cggagtcagccaggagctg

SEQ ID NO: 659336 - DNA, 19 bp, Homo sapiens
cggattactgaattgtatc

SEQ ID NO: 659337 - DNA, 20 bp, Homo sapiens
cggcatgagactcagtgcag

SEQ ID NO: 659338 - DNA, 21 bp, Homo sapiens
cggcatgagactcagtgcaga

SEQ ID NO: 659339 - DNA, 13 bp, Homo sapiens
cggcatttgtttc

SEQ ID NO: 659340 - DNA, 12 bp, Homo sapiens
cggccaagaatg

SEQ ID NO: 659341 - DNA, 14 bp, Homo sapiens
cggccaagaatgta

SEQ ID NO: 659342 - DNA, 13 bp, Homo sapiens
cggcctctgcctt

SEQ ID NO: 659343 - DNA, 14 bp, Homo sapiens
cggctcctcctcac

SEQ ID NO: 659344 - DNA, 24 bp, Homo sapiens
cggctcctcctcacccacctctgg

SEQ ID NO: 659345 - DNA, 22 bp, Homo sapiens
cgggacatcacagggtgggcct

SEQ ID NO: 659346 - DNA, 11 bp, Homo sapiens
cgggaggggag

SEQ ID NO: 659347 - DNA, 15 bp, Homo sapiens
cggtggcgggcacct

SEQ ID NO: 659348 - DNA, 18 bp, Homo sapiens
cggtgggacccccgtggg

SEQ ID NO: 659349 - DNA, 15 bp, Homo sapiens
cggtgtatcctggcc

SEQ ID NO: 659350 - DNA, 21 bp, Homo sapiens
cggtgtatcctggccctgggg

SEQ ID NO: 659351 - DNA, 20 bp, Homo sapiens
cgtaaatcatattttagctg

SEQ ID NO: 659352 - DNA, 20 bp, Homo sapiens
cgtacatctgcaatatgaat

SEQ ID NO: 659353 - DNA, 17 bp, Homo sapiens
cgtagctctgctgctga

SEQ ID NO: 659354 - DNA, 18 bp, Homo sapiens
cgtagctctgctgctgat

SEQ ID NO: 659355 - DNA, 16 bp, Homo sapiens
cgtcagccacctggga

SEQ ID NO: 659356 - DNA, 13 bp, Homo sapiens
cgtccagcctgcc

SEQ ID NO: 659357 - DNA, 22 bp, Homo sapiens
cgtccagctcagccctggcctg

SEQ ID NO: 659358 - DNA, 13 bp, Homo sapiens
cgtcccaccagct

SEQ ID NO: 659359 - DNA, 11 bp, Homo sapiens
cgtccctggcg

SEQ ID NO: 659360 - DNA, 22 bp, Homo sapiens
cgtctgaggcctgccccctggg

SEQ ID NO: 659361 - DNA, 14 bp, Homo sapiens
cgtctgcctgggcc

SEQ ID NO: 659362 - DNA, 22 bp, Homo sapiens
cgtgacaggctcgtcagccacc

SEQ ID NO: 659363 - DNA, 15 bp, Homo sapiens
cgtgctactgcactc

SEQ ID NO: 659364 - DNA, 21 bp, Homo sapiens
cgtgctccgtagctctgctgc

SEQ ID NO: 659365 - DNA, 15 bp, Homo sapiens
cgtggagggaggccc

SEQ ID NO: 659366 - DNA, 19 bp, Homo sapiens
cgtggagggaggccccagg

SEQ ID NO: 659367 - DNA, 18 bp, Homo sapiens
cgtggcacacactgacca

SEQ ID NO: 659368 - DNA, 18 bp, Homo sapiens
cgtggcacagctgggagc

SEQ ID NO: 659369 - DNA, 14 bp, Homo sapiens
cgtggggacttctg

SEQ ID NO: 659370 - DNA, 22 bp, Homo sapiens
cgtggggcagggagctgggccc

SEQ ID NO: 659371 - DNA, 19 bp, Homo sapiens
cgtgggtcctgaggcctgc

SEQ ID NO: 659372 - DNA, 13 bp, Homo sapiens
cgtggttcttaaa

SEQ ID NO: 659373 - DNA, 22 bp, Homo sapiens
cgtgtattgagatttcttaaat

SEQ ID NO: 659374 - DNA, 21 bp, Homo sapiens
cgtgtgagtgtgacagggcca

SEQ ID NO: 659375 - DNA, 14 bp, Homo sapiens
cgttaaaaacagat

SEQ ID NO: 659376 - DNA, 13 bp, Homo sapiens
cgttaagggcaga

SEQ ID NO: 659377 - DNA, 15 bp, Homo sapiens
cgttaagggcagagt

SEQ ID NO: 659378 - DNA, 23 bp, Homo sapiens
cgttctgtactgttactgggccc

SEQ ID NO: 659379 - DNA, 13 bp, Homo sapiens
cgttggtgcgtga

SEQ ID NO: 659380 - DNA, 19 bp, Homo sapiens
cgtttcatgtagccagcag

SEQ ID NO: 659381 - DNA, 13 bp, Homo sapiens
cgtttctcctttt

SEQ ID NO: 659382 - DNA, 15 bp, Homo sapiens
cgtttttgtattttc

SEQ ID NO: 659383 - DNA, 21 bp, Homo sapiens
cgtttttgtattttcatgaaa

SEQ ID NO: 659384 - DNA, 23 bp, Homo sapiens
ctaaaactgggattaagaaacct

SEQ ID NO: 659385 - DNA, 18 bp, Homo sapiens
ctaaaataattttgtaat

SEQ ID NO: 659386 - DNA, 18 bp, Homo sapiens
ctaaacagttatttctgt

SEQ ID NO: 659387 - DNA, 14 bp, Homo sapiens
ctaaagcatgaaat

SEQ ID NO: 659388 - DNA, 20 bp, Homo sapiens
ctaaagcatgaaatgtgaat

SEQ ID NO: 659389 - DNA, 22 bp, Homo sapiens
ctaaagcatgaaatgtgaattt

SEQ ID NO: 659390 - DNA, 22 bp, Homo sapiens
ctaaaggggactagacagttag

SEQ ID NO: 659391 - DNA, 15 bp, Homo sapiens
ctaaataaaaatatg

SEQ ID NO: 659392 - DNA, 16 bp, Homo sapiens
ctaaataaaaatatgt

SEQ ID NO: 659393 - DNA, 18 bp, Homo sapiens
ctaaataaaaatatgtaa

SEQ ID NO: 659394 - DNA, 22 bp, Homo sapiens
ctaaatttgtgctttttaagaa

SEQ ID NO: 659395 - DNA, 14 bp, Homo sapiens
ctaaattttaagtg

SEQ ID NO: 659396 - DNA, 15 bp, Homo sapiens
ctaacaaaatgagat

SEQ ID NO: 659397 - DNA, 20 bp, Homo sapiens
ctaacaacattgtagcctca

SEQ ID NO: 659398 - DNA, 22 bp, Homo sapiens
ctaacatggtgaaaccccgtct

SEQ ID NO: 659399 - DNA, 20 bp, Homo sapiens
ctaacatgttatcaaatctg

SEQ ID NO: 659400 - DNA, 17 bp, Homo sapiens
ctaaccactaacattgt

SEQ ID NO: 659401 - DNA, 14 bp, Homo sapiens
ctaaccatttatat

SEQ ID NO: 659402 - DNA, 16 bp, Homo sapiens
ctaactcaaatacaca

SEQ ID NO: 659403 - DNA, 17 bp, Homo sapiens
ctaactcagaattattt

SEQ ID NO: 659404 - DNA, 14 bp, Homo sapiens
ctaagaagacattt

SEQ ID NO: 659405 - DNA, 13 bp, Homo sapiens
ctaagactatata

SEQ ID NO: 659406 - DNA, 23 bp, Homo sapiens
ctaagcagttatggtgatgactt

SEQ ID NO: 659407 - DNA, 22 bp, Homo sapiens
ctaaggatggaaaggtgacagt

SEQ ID NO: 659408 - DNA, 14 bp, Homo sapiens
ctaaggcaggagga

SEQ ID NO: 659409 - DNA, 23 bp, Homo sapiens
ctaaggggcttgtgttctgctcc

SEQ ID NO: 659410 - DNA, 20 bp, Homo sapiens
ctaagggtgggtgctcagaa

SEQ ID NO: 659411 - DNA, 21 bp, Homo sapiens
ctaagggtgggtgctcagaat

SEQ ID NO: 659412 - DNA, 22 bp, Homo sapiens
ctaagggtgggtgctcagaata

SEQ ID NO: 659413 - DNA, 15 bp, Homo sapiens
ctaagtggctgcctt

SEQ ID NO: 659414 - DNA, 20 bp, Homo sapiens
ctaagtggctgccttctttc

SEQ ID NO: 659415 - DNA, 18 bp, Homo sapiens
ctaataaatataatttat

SEQ ID NO: 659416 - DNA, 16 bp, Homo sapiens
ctaatcaaagccaggg

SEQ ID NO: 659417 - DNA, 14 bp, Homo sapiens
ctaatccttttcct

SEQ ID NO: 659418 - DNA, 16 bp, Homo sapiens
ctaatccttttcctta

SEQ ID NO: 659419 - DNA, 17 bp, Homo sapiens
ctaatccttttccttat

SEQ ID NO: 659420 - DNA, 16 bp, Homo sapiens
ctaatgcttgtttatg

SEQ ID NO: 659421 - DNA, 15 bp, Homo sapiens
ctaatgtttgaacaa

SEQ ID NO: 659422 - DNA, 23 bp, Homo sapiens
ctaattattattttaaaatatat

SEQ ID NO: 659423 - DNA, 18 bp, Homo sapiens
ctaattcttctgtcctga

SEQ ID NO: 659424 - DNA, 16 bp, Homo sapiens
ctaattgcatctcaaa

SEQ ID NO: 659425 - DNA, 19 bp, Homo sapiens
ctaattgcatctcaaaatt

SEQ ID NO: 659426 - DNA, 20 bp, Homo sapiens
ctaattgcatctcaaaatta

SEQ ID NO: 659427 - DNA, 15 bp, Homo sapiens
ctaatttatattatc

SEQ ID NO: 659428 - DNA, 17 bp, Homo sapiens
ctaatttattctaaatt

SEQ ID NO: 659429 - DNA, 20 bp, Homo sapiens
ctaattttctcccaagctga

SEQ ID NO: 659430 - DNA, 16 bp, Homo sapiens
ctaatttttgtatttt

SEQ ID NO: 659431 - DNA, 13 bp, Homo sapiens
ctacaatctcttt

SEQ ID NO: 659432 - DNA, 15 bp, Homo sapiens
ctacaccttgccttg

SEQ ID NO: 659433 - DNA, 15 bp, Homo sapiens
ctacagactccatct

SEQ ID NO: 659434 - DNA, 16 bp, Homo sapiens
ctacagactccatctc

SEQ ID NO: 659435 - DNA, 17 bp, Homo sapiens
ctacagactccatctct

SEQ ID NO: 659436 - DNA, 18 bp, Homo sapiens
ctacagctatatttgatt

SEQ ID NO: 659437 - DNA, 19 bp, Homo sapiens
ctacagtgactccctggga

SEQ ID NO: 659438 - DNA, 12 bp, Homo sapiens
ctacagtgccaa

SEQ ID NO: 659439 - DNA, 22 bp, Homo sapiens
ctacagtttttatttagcatgg

SEQ ID NO: 659440 - DNA, 16 bp, Homo sapiens
ctacatctttttttct

SEQ ID NO: 659441 - DNA, 14 bp, Homo sapiens
ctacatgctggggt

SEQ ID NO: 659442 - DNA, 15 bp, Homo sapiens
ctacatgctggggtc

SEQ ID NO: 659443 - DNA, 20 bp, Homo sapiens
ctacatgtctagagaacact

SEQ ID NO: 659444 - DNA, 14 bp, Homo sapiens
ctacattttcagaa

SEQ ID NO: 659445 - DNA, 17 bp, Homo sapiens
ctaccaaaaaaaggaag

SEQ ID NO: 659446 - DNA, 15 bp, Homo sapiens
ctaccaggtgttcta

SEQ ID NO: 659447 - DNA, 12 bp, Homo sapiens
ctacctccctcc

SEQ ID NO: 659448 - DNA, 22 bp, Homo sapiens
ctctcctaactgccagccccct

SEQ ID NO: 659449 - DNA, 17 bp, Homo sapiens
ctctcctgccctgtgat

SEQ ID NO: 659450 - DNA, 23 bp, Homo sapiens
ctctcctggcctatccgctgcca

SEQ ID NO: 659451 - DNA, 20 bp, Homo sapiens
ctctccttttccttaccata

SEQ ID NO: 659452 - DNA, 13 bp, Homo sapiens
ctctcgcctcatt

SEQ ID NO: 659453 - DNA, 17 bp, Homo sapiens
ctctcgcctcattactg

SEQ ID NO: 659454 - DNA, 15 bp, Homo sapiens
ctctctacagtgcca

SEQ ID NO: 659455 - DNA, 13 bp, Homo sapiens
ctctctcttgcct

SEQ ID NO: 659456 - DNA, 19 bp, Homo sapiens
ctctcttgcctgaggggaa

SEQ ID NO: 659457 - DNA, 15 bp, Homo sapiens
ctctgaaatcttccc

SEQ ID NO: 659458 - DNA, 23 bp, Homo sapiens
ctctgaaatcttcccatgcattc

SEQ ID NO: 659459 - DNA, 12 bp, Homo sapiens
ctctgaggacaa

SEQ ID NO: 659460 - DNA, 14 bp, Homo sapiens
ctctgcaagaagaa

SEQ ID NO: 659461 - DNA, 15 bp, Homo sapiens
ctctgcacccctctg

SEQ ID NO: 659462 - DNA, 14 bp, Homo sapiens
ctctgccctggatt

SEQ ID NO: 659463 - DNA, 15 bp, Homo sapiens
ctctgccctggattg

SEQ ID NO: 659464 - DNA, 14 bp, Homo sapiens
ctctgccgctacct

SEQ ID NO: 659465 - DNA, 19 bp, Homo sapiens
ctctgccgctacctccctc

SEQ ID NO: 659466 - DNA, 21 bp, Homo sapiens
ctctgccgctacctccctccc

SEQ ID NO: 659467 - DNA, 23 bp, Homo sapiens
ctctgcctttgcaccacgggaca

SEQ ID NO: 659468 - DNA, 15 bp, Homo sapiens
ctctgctatgagtgt

SEQ ID NO: 659469 - DNA, 21 bp, Homo sapiens
ctctgctcaccgcccatcagg

SEQ ID NO: 659470 - DNA, 12 bp, Homo sapiens
ctctgctccctc

SEQ ID NO: 659471 - DNA, 12 bp, Homo sapiens
ctctgctgctga

SEQ ID NO: 659472 - DNA, 13 bp, Homo sapiens
ctctgctgctgat

SEQ ID NO: 659473 - DNA, 19 bp, Homo sapiens
ctctggtgtttattataaa

SEQ ID NO: 659474 - DNA, 22 bp, Homo sapiens
ctctgtagaaggagtagctgcc

SEQ ID NO: 659475 - DNA, 15 bp, Homo sapiens
ctctgtcccttgctg

SEQ ID NO: 659476 - DNA, 20 bp, Homo sapiens
ctctgtgacccctccttgtc

SEQ ID NO: 659477 - DNA, 13 bp, Homo sapiens
ctctgtgacccta

SEQ ID NO: 659478 - DNA, 21 bp, Homo sapiens
ctctgtgagaaggtttattgt

SEQ ID NO: 659479 - DNA, 18 bp, Homo sapiens
ctctgttggtctgccttc

SEQ ID NO: 659480 - DNA, 21 bp, Homo sapiens
ctcttacagtgtttggacagg

SEQ ID NO: 659481 - DNA, 18 bp, Homo sapiens
ctcttccagggcagcggc

SEQ ID NO: 659482 - DNA, 14 bp, Homo sapiens
ctcttcccactttt

SEQ ID NO: 659483 - DNA, 16 bp, Homo sapiens
ctcttctacccttttc

SEQ ID NO: 659484 - DNA, 19 bp, Homo sapiens
ctcttctggggcaggctgg

SEQ ID NO: 659485 - DNA, 13 bp, Homo sapiens
ctcttctggtgtt

SEQ ID NO: 659486 - DNA, 19 bp, Homo sapiens
ctcttctggtttcccttta

SEQ ID NO: 659487 - DNA, 16 bp, Homo sapiens
ctcttcttggggccca

SEQ ID NO: 659488 - DNA, 20 bp, Homo sapiens
ctcttcttggggcccagtgc

SEQ ID NO: 659489 - DNA, 22 bp, Homo sapiens
ctcttcttggggcccagtgcat

SEQ ID NO: 659490 - DNA, 17 bp, Homo sapiens
ctcttctttgtgccttt

SEQ ID NO: 659491 - DNA, 20 bp, Homo sapiens
ctcttctttgtgcctttggc

SEQ ID NO: 659492 - DNA, 17 bp, Homo sapiens
ctcttggtcagcttttg

SEQ ID NO: 659493 - DNA, 15 bp, Homo sapiens
ctcttgtcctcttct

SEQ ID NO: 659494 - DNA, 20 bp, Homo sapiens
ctcttgtcctcttctgctct

SEQ ID NO: 659495 - DNA, 23 bp, Homo sapiens
ctcttgtggtgcattgaaagaag

SEQ ID NO: 659496 - DNA, 23 bp, Homo sapiens
ctcttgtttttattaatttatat

SEQ ID NO: 659497 - DNA, 12 bp, Homo sapiens
ctctttagccag

SEQ ID NO: 659498 - DNA, 16 bp, Homo sapiens
ctctttccaaattaaa

SEQ ID NO: 659499 - DNA, 22 bp, Homo sapiens
ctctttccagtggatcataaga

SEQ ID NO: 659500 - DNA, 22 bp, Homo sapiens
ctctttgatcgcttttaataaa

SEQ ID NO: 659501 - DNA, 23 bp, Homo sapiens
ctcttttatatttgtaggagaaa

SEQ ID NO: 659502 - DNA, 15 bp, Homo sapiens
ctcttttctttctgt

SEQ ID NO: 659503 - DNA, 14 bp, Homo sapiens
ctcttttgctgtgc

SEQ ID NO: 659504 - DNA, 13 bp, Homo sapiens
ctgaaaaatatct

SEQ ID NO: 659505 - DNA, 17 bp, Homo sapiens
ctgaaacagatttcata

SEQ ID NO: 659506 - DNA, 20 bp, Homo sapiens
ctgaaacctagtactgcccc

SEQ ID NO: 659507 - DNA, 22 bp, Homo sapiens
ctgaaactgcccactctgcaag

SEQ ID NO: 659508 - DNA, 14 bp, Homo sapiens
ctgaaagaggccaa

SEQ ID NO: 659509 - DNA, 16 bp, Homo sapiens
ctgaaagtagggggct

SEQ ID NO: 659510 - DNA, 15 bp, Homo sapiens
ctgaaataatatatt

SEQ ID NO: 659511 - DNA, 18 bp, Homo sapiens
ctgaaatatccacccagc

SEQ ID NO: 659512 - DNA, 21 bp, Homo sapiens
ctgaaatcttcccatgcattc

SEQ ID NO: 659513 - DNA, 23 bp, Homo sapiens
ctgaaatcttcccatgcattctg

SEQ ID NO: 659514 - DNA, 15 bp, Homo sapiens
ctgaaattactttaa

SEQ ID NO: 659515 - DNA, 20 bp, Homo sapiens
ctgaaattactttaacattt

SEQ ID NO: 659516 - DNA, 20 bp, Homo sapiens
ctgaaccggctttaccaaac

SEQ ID NO: 659517 - DNA, 20 bp, Homo sapiens
ctgaagaattaagatacaaa

SEQ ID NO: 659518 - DNA, 22 bp, Homo sapiens
ctgaagattcttaaaaattgaa

SEQ ID NO: 659519 - DNA, 17 bp, Homo sapiens
ctgaagtttttttgctg

SEQ ID NO: 659520 - DNA, 14 bp, Homo sapiens
ctgaataatatcaa

SEQ ID NO: 659521 - DNA, 11 bp, Homo sapiens
ctgaatatttt

SEQ ID NO: 659522 - DNA, 14 bp, Homo sapiens
ctgaatattttttg

SEQ ID NO: 659523 - DNA, 17 bp, Homo sapiens
ctgaatgcctcctgtgg

SEQ ID NO: 659524 - DNA, 19 bp, Homo sapiens
ctgaatgcctcctgtgggg

SEQ ID NO: 659525 - DNA, 22 bp, Homo sapiens
ctgaatgtagcgtgtaagcttg

SEQ ID NO: 659526 - DNA, 15 bp, Homo sapiens
ctgaattaaataaat

SEQ ID NO: 659527 - DNA, 17 bp, Homo sapiens
ctgaattgtcagatgtg

SEQ ID NO: 659528 - DNA, 19 bp, Homo sapiens
ctgacactaaccagagtca

SEQ ID NO: 659529 - DNA, 21 bp, Homo sapiens
ctgacatttgtttattttttg

SEQ ID NO: 659530 - DNA, 16 bp, Homo sapiens
ctgacccccatctgag

SEQ ID NO: 659531 - DNA, 20 bp, Homo sapiens
ctgacccccatctgagctgg

SEQ ID NO: 659532 - DNA, 21 bp, Homo sapiens
ctgacccccatctgagctggg

SEQ ID NO: 659533 - DNA, 15 bp, Homo sapiens
ctgaccggtgctttt

SEQ ID NO: 659534 - DNA, 16 bp, Homo sapiens
ctgaccggtgctttta

SEQ ID NO: 659535 - DNA, 15 bp, Homo sapiens
ctgaccttaaatgca

SEQ ID NO: 659536 - DNA, 12 bp, Homo sapiens
ctgacgattctt

SEQ ID NO: 659537 - DNA, 21 bp, Homo sapiens
ctgactcaattatttgcatat

SEQ ID NO: 659538 - DNA, 19 bp, Homo sapiens
ctgactcctcagtccctct

SEQ ID NO: 659539 - DNA, 15 bp, Homo sapiens
ctgagaagctgctcc

SEQ ID NO: 659540 - DNA, 13 bp, Homo sapiens
ctgagagctgttt

SEQ ID NO: 659541 - DNA, 15 bp, Homo sapiens
ctgagagtaattcat

SEQ ID NO: 659542 - DNA, 14 bp, Homo sapiens
ctgagatgctcact

SEQ ID NO: 659543 - DNA, 14 bp, Homo sapiens
ctgagccagcaggg

SEQ ID NO: 659544 - DNA, 15 bp, Homo sapiens
ctgagcctgcaggga

SEQ ID NO: 659545 - DNA, 13 bp, Homo sapiens
ctgagctggccct

SEQ ID NO: 659546 - DNA, 23 bp, Homo sapiens
ctgaggcctgccccctgggctgg

SEQ ID NO: 659547 - DNA, 16 bp, Homo sapiens
ctgaggctgcatctgc

SEQ ID NO: 659548 - DNA, 19 bp, Homo sapiens
ctgagggaagagtagctgt

SEQ ID NO: 659549 - DNA, 19 bp, Homo sapiens
ctgagggcagactggggca

SEQ ID NO: 659550 - DNA, 14 bp, Homo sapiens
ctgaggtcagggag

SEQ ID NO: 659551 - DNA, 18 bp, Homo sapiens
ctgagttggcctggccat

SEQ ID NO: 659552 - DNA, 15 bp, Homo sapiens
ctgagttttgttttg

SEQ ID NO: 659553 - DNA, 16 bp, Homo sapiens
ctgatccatccatctc

SEQ ID NO: 659554 - DNA, 18 bp, Homo sapiens
ctgatcttttaaaatcat

SEQ ID NO: 659555 - DNA, 14 bp, Homo sapiens
ctgatgaatctcaa

SEQ ID NO: 659556 - DNA, 15 bp, Homo sapiens
ctgatgattttcctt

SEQ ID NO: 659557 - DNA, 16 bp, Homo sapiens
ctgatgattttccttt

SEQ ID NO: 659558 - DNA, 22 bp, Homo sapiens
ctgatggggaagggacttttat

SEQ ID NO: 659559 - DNA, 12 bp, Homo sapiens
ctgattatttat

SEQ ID NO: 659560 - DNA, 23 bp, Homo sapiens
ctgattttattcaatatggttac

SEQ ID NO: 659561 - DNA, 16 bp, Homo sapiens
ctgattttgaggttta

SEQ ID NO: 659562 - DNA, 17 bp, Homo sapiens
ctgcaaataaagccttt

SEQ ID NO: 659563 - DNA, 14 bp, Homo sapiens
ctgcaacatttata

SEQ ID NO: 659564 - DNA, 15 bp, Homo sapiens
ctgcaacctctgcct

SEQ ID NO: 659565 - DNA, 17 bp, Homo sapiens
ctgcaagttcattttaa

SEQ ID NO: 659566 - DNA, 14 bp, Homo sapiens
ctgcaatgaaagtc

SEQ ID NO: 659567 - DNA, 12 bp, Homo sapiens
ctgcacagggtc

SEQ ID NO: 659568 - DNA, 15 bp, Homo sapiens
ctttcttgaaattga

SEQ ID NO: 659569 - DNA, 15 bp, Homo sapiens
ctttctttgcctctg

SEQ ID NO: 659570 - DNA, 18 bp, Homo sapiens
ctttctttgcctctgcag

SEQ ID NO: 659571 - DNA, 21 bp, Homo sapiens
ctttgagtagatccatttcca

SEQ ID NO: 659572 - DNA, 15 bp, Homo sapiens
ctttgccactgctgt

SEQ ID NO: 659573 - DNA, 16 bp, Homo sapiens
ctttgccactgctgta

SEQ ID NO: 659574 - DNA, 15 bp, Homo sapiens
ctttgcccttcctcc

SEQ ID NO: 659575 - DNA, 18 bp, Homo sapiens
ctttgcccttcctcctgc

SEQ ID NO: 659576 - DNA, 11 bp, Homo sapiens
ctttgcctctt

SEQ ID NO: 659577 - DNA, 17 bp, Homo sapiens
ctttgcctcttctttgt

SEQ ID NO: 659578 - DNA, 15 bp, Homo sapiens
ctttgccttcttttg

SEQ ID NO: 659579 - DNA, 22 bp, Homo sapiens
ctttgctgcagagatcaagggt

SEQ ID NO: 659580 - DNA, 23 bp, Homo sapiens
ctttggacagctgactgaatgca

SEQ ID NO: 659581 - DNA, 18 bp, Homo sapiens
ctttggagatgctgaggg

SEQ ID NO: 659582 - DNA, 21 bp, Homo sapiens
ctttggattctaaatacatgc

SEQ ID NO: 659583 - DNA, 16 bp, Homo sapiens
ctttggcgttggagac

SEQ ID NO: 659584 - DNA, 14 bp, Homo sapiens
ctttgggaaaacat

SEQ ID NO: 659585 - DNA, 21 bp, Homo sapiens
ctttgggaaaacatgttaatg

SEQ ID NO: 659586 - DNA, 16 bp, Homo sapiens
ctttgggaaagctctt

SEQ ID NO: 659587 - DNA, 20 bp, Homo sapiens
ctttggttaataaataaatg

SEQ ID NO: 659588 - DNA, 17 bp, Homo sapiens
ctttgtgcctttggcct

SEQ ID NO: 659589 - DNA, 15 bp, Homo sapiens
cttttaaagaagctt

SEQ ID NO: 659590 - DNA, 16 bp, Homo sapiens
cttttaaagaagcttt

SEQ ID NO: 659591 - DNA, 15 bp, Homo sapiens
cttttaataaactgc

SEQ ID NO: 659592 - DNA, 22 bp, Homo sapiens
cttttaattaaataaaagctgg

SEQ ID NO: 659593 - DNA, 20 bp, Homo sapiens
cttttaccttttttttttct

SEQ ID NO: 659594 - DNA, 14 bp, Homo sapiens
cttttagaaatgca

SEQ ID NO: 659595 - DNA, 17 bp, Homo sapiens
cttttagaaatgcatat

SEQ ID NO: 659596 - DNA, 15 bp, Homo sapiens
cttttagagagggga

SEQ ID NO: 659597 - DNA, 21 bp, Homo sapiens
cttttatataagtgacttgaa

SEQ ID NO: 659598 - DNA, 14 bp, Homo sapiens
cttttatatttgta

SEQ ID NO: 659599 - DNA, 15 bp, Homo sapiens
cttttattctccaga

SEQ ID NO: 659600 - DNA, 18 bp, Homo sapiens
cttttattctccagaata

SEQ ID NO: 659601 - DNA, 23 bp, Homo sapiens
cttttcccccttcccatttcttc

SEQ ID NO: 659602 - DNA, 22 bp, Homo sapiens
cttttcccttacaaggtgggga

SEQ ID NO: 659603 - DNA, 20 bp, Homo sapiens
cttttccttatttgccttct

SEQ ID NO: 659604 - DNA, 22 bp, Homo sapiens
cttttctctgagattctggtcc

SEQ ID NO: 659605 - DNA, 20 bp, Homo sapiens
cttttctcttttctttctgt

SEQ ID NO: 659606 - DNA, 23 bp, Homo sapiens
cttttgatggtggccctgaacct

SEQ ID NO: 659607 - DNA, 19 bp, Homo sapiens
cttttggcagttctgataa

SEQ ID NO: 659608 - DNA, 21 bp, Homo sapiens
cttttggttatgaatactttg

SEQ ID NO: 659609 - DNA, 13 bp, Homo sapiens
cttttgtttccat

SEQ ID NO: 659610 - DNA, 15 bp, Homo sapiens
cttttgtttggtaaa

SEQ ID NO: 659611 - DNA, 23 bp, Homo sapiens
ctttttatgctatttctgtatat

SEQ ID NO: 659612 - DNA, 12 bp, Homo sapiens
ctttttattcat

SEQ ID NO: 659613 - DNA, 12 bp, Homo sapiens
ctttttcctcct

SEQ ID NO: 659614 - DNA, 16 bp, Homo sapiens
ctttttctgcgcttca

SEQ ID NO: 659615 - DNA, 23 bp, Homo sapiens
ctttttgccagttttccctggaa

SEQ ID NO: 659616 - DNA, 13 bp, Homo sapiens
ctttttggcctgt

SEQ ID NO: 659617 - DNA, 20 bp, Homo sapiens
cttttttggggagtacctgt

SEQ ID NO: 659618 - DNA, 15 bp, Homo sapiens
cttttttttttcatt

SEQ ID NO: 659619 - DNA, 20 bp, Homo sapiens
cttttttttttttttacagt

SEQ ID NO: 659620 - DNA, 13 bp, Homo sapiens
gaaaaaaattgaa

SEQ ID NO: 659621 - DNA, 17 bp, Homo sapiens
gaaaaatctcaattgaa

SEQ ID NO: 659622 - DNA, 19 bp, Homo sapiens
gaaaaatgacaattgtgaa

SEQ ID NO: 659623 - DNA, 15 bp, Homo sapiens
gaaaaatgttcttta

SEQ ID NO: 659624 - DNA, 19 bp, Homo sapiens
gaaaacaaaattttatttt

SEQ ID NO: 659625 - DNA, 15 bp, Homo sapiens
gaaaacatgtaataa

SEQ ID NO: 659626 - DNA, 14 bp, Homo sapiens
gaaaacatgttaat

SEQ ID NO: 659627 - DNA, 16 bp, Homo sapiens
gaaaacatgttaatga

SEQ ID NO: 659628 - DNA, 22 bp, Homo sapiens
gaaaactgcctgacctttggga

SEQ ID NO: 659629 - DNA, 22 bp, Homo sapiens
gaaaagctagtgtacctcctct

SEQ ID NO: 659630 - DNA, 24 bp, Homo sapiens
gaaaagctagtgtacctcctctca

SEQ ID NO: 659631 - DNA, 15 bp, Homo sapiens
gaaaaggaagactag

SEQ ID NO: 659632 - DNA, 19 bp, Homo sapiens
gaaaagtgcatatttatcc

SEQ ID NO: 659633 - DNA, 20 bp, Homo sapiens
gaaaagtgcatatttatcca

SEQ ID NO: 659634 - DNA, 18 bp, Homo sapiens
gaaaagttattggcatgg

SEQ ID NO: 659635 - DNA, 17 bp, Homo sapiens
gaaaataaacagacaaa

SEQ ID NO: 659636 - DNA, 22 bp, Homo sapiens
gaaaataaacagacaaaaacaa

SEQ ID NO: 659637 - DNA, 17 bp, Homo sapiens
gaaaataagattccaga

SEQ ID NO: 659638 - DNA, 14 bp, Homo sapiens
gaaaatagtgttcc

SEQ ID NO: 659639 - DNA, 15 bp, Homo sapiens
gaaaatatttaatat

SEQ ID NO: 659640 - DNA, 18 bp, Homo sapiens
gaaaatcactttgtctaa

SEQ ID NO: 659641 - DNA, 21 bp, Homo sapiens
gaaaatctttgttgaagtttg

SEQ ID NO: 659642 - DNA, 14 bp, Homo sapiens
gaaaatgaagggat

SEQ ID NO: 659643 - DNA, 15 bp, Homo sapiens
gaaaatgtatccaag

SEQ ID NO: 659644 - DNA, 21 bp, Homo sapiens
gaaaattcatagtaagattga

SEQ ID NO: 659645 - DNA, 16 bp, Homo sapiens
gaaaattcttaaaagg

SEQ ID NO: 659646 - DNA, 23 bp, Homo sapiens
gaaaattcttgagaagtaactgt

SEQ ID NO: 659647 - DNA, 18 bp, Homo sapiens
gaaaattgaaacacagag

SEQ ID NO: 659648 - DNA, 14 bp, Homo sapiens
gaaaattgtttagt

SEQ ID NO: 659649 - DNA, 15 bp, Homo sapiens
gaaaatttgctttaa

SEQ ID NO: 659650 - DNA, 17 bp, Homo sapiens
gaaacaaagtactcttt

SEQ ID NO: 659651 - DNA, 19 bp, Homo sapiens
gaaacactgcaaattttaa

SEQ ID NO: 659652 - DNA, 23 bp, Homo sapiens
gaaacactgcaaattttaactgt

SEQ ID NO: 659653 - DNA, 20 bp, Homo sapiens
gaaacagatctcctggcaaa

SEQ ID NO: 659654 - DNA, 20 bp, Homo sapiens
gaaacattttttcttctgaa

SEQ ID NO: 659655 - DNA, 20 bp, Homo sapiens
gaaaccacagtcttcccagc

SEQ ID NO: 659656 - DNA, 20 bp, Homo sapiens
gaaaccttccaatgcttctg

SEQ ID NO: 659657 - DNA, 18 bp, Homo sapiens
gaaacgctacctctctgt

SEQ ID NO: 659658 - DNA, 20 bp, Homo sapiens
gaaacgctacctctctgtcc

SEQ ID NO: 659659 - DNA, 23 bp, Homo sapiens
gaaacgctacctctctgtccctt

SEQ ID NO: 659660 - DNA, 15 bp, Homo sapiens
gaaactagtgtacat

SEQ ID NO: 659661 - DNA, 15 bp, Homo sapiens
gaaactccagatgcc

SEQ ID NO: 659662 - DNA, 18 bp, Homo sapiens
gaaactcccatgtatgga

SEQ ID NO: 659663 - DNA, 21 bp, Homo sapiens
gaaactgcccactctgcaaga

SEQ ID NO: 659664 - DNA, 17 bp, Homo sapiens
gaaactgctgcagatta

SEQ ID NO: 659665 - DNA, 17 bp, Homo sapiens
gaaactttgggaaaaca

SEQ ID NO: 659666 - DNA, 18 bp, Homo sapiens
gaaagactcgagaaccaa

SEQ ID NO: 659667 - DNA, 23 bp, Homo sapiens
gaaagagagatgggccaggcaga

SEQ ID NO: 659668 - DNA, 16 bp, Homo sapiens
gaaagcagagcctcct

SEQ ID NO: 659669 - DNA, 19 bp, Homo sapiens
gaaagcagagcctcctggg

SEQ ID NO: 659670 - DNA, 21 bp, Homo sapiens
gaaagcagagcctcctgggaa

SEQ ID NO: 659671 - DNA, 17 bp, Homo sapiens
gaaagctcactgtagct

SEQ ID NO: 659672 - DNA, 17 bp, Homo sapiens
gaaaggaaaagaggccc

SEQ ID NO: 659673 - DNA, 15 bp, Homo sapiens
gaaaggactcagtgt

SEQ ID NO: 659674 - DNA, 16 bp, Homo sapiens
gaaaggggttggggtg

SEQ ID NO: 659675 - DNA, 21 bp, Homo sapiens
gaaagtgtgagctcttccctt

SEQ ID NO: 659676 - DNA, 17 bp, Homo sapiens
gaaagtttttagaatgt

SEQ ID NO: 659677 - DNA, 19 bp, Homo sapiens
gaaataaataaaaatgcat

SEQ ID NO: 659678 - DNA, 19 bp, Homo sapiens
gaaataatgctacaatttt

SEQ ID NO: 659679 - DNA, 17 bp, Homo sapiens
gaaatacagactggatg

SEQ ID NO: 659680 - DNA, 14 bp, Homo sapiens
gaaatacagttatt

SEQ ID NO: 659681 - DNA, 19 bp, Homo sapiens
gaaatacgttaggaggaca

SEQ ID NO: 659682 - DNA, 18 bp, Homo sapiens
gaaatataacacattttt

SEQ ID NO: 659683 - DNA, 23 bp, Homo sapiens
gaaatatccacccagcaggcaga

SEQ ID NO: 659684 - DNA, 19 bp, Homo sapiens
gaaatatgccactgaccga

SEQ ID NO: 659685 - DNA, 16 bp, Homo sapiens
gaaatgaaaacatgta

SEQ ID NO: 659686 - DNA, 15 bp, Homo sapiens
gaaatggaaagcaga

SEQ ID NO: 659687 - DNA, 20 bp, Homo sapiens
gagctaagggtgggtgctca

SEQ ID NO: 659688 - DNA, 22 bp, Homo sapiens
gagctcttcccttattcctaat

SEQ ID NO: 659689 - DNA, 13 bp, Homo sapiens
gagctgggcccga

SEQ ID NO: 659690 - DNA, 16 bp, Homo sapiens
gagctgggcccgacat

SEQ ID NO: 659691 - DNA, 20 bp, Homo sapiens
gagctgggcccgacatggct

SEQ ID NO: 659692 - DNA, 23 bp, Homo sapiens
gagcttgttgtctccacttgtat

SEQ ID NO: 659693 - DNA, 22 bp, Homo sapiens
gagcttttatttggtgtgttcg

SEQ ID NO: 659694 - DNA, 12 bp, Homo sapiens
gaggaaaattct

SEQ ID NO: 659695 - DNA, 13 bp, Homo sapiens
gaggaagagtctt

SEQ ID NO: 659696 - DNA, 15 bp, Homo sapiens
gaggacaaaaggaat

SEQ ID NO: 659697 - DNA, 13 bp, Homo sapiens
gaggaccagggcc

SEQ ID NO: 659698 - DNA, 19 bp, Homo sapiens
gaggagaaatgcaataact

SEQ ID NO: 659699 - DNA, 20 bp, Homo sapiens
gaggatagtagttaaataac

SEQ ID NO: 659700 - DNA, 17 bp, Homo sapiens
gaggatccactcccagg

SEQ ID NO: 659701 - DNA, 13 bp, Homo sapiens
gaggatctggaga

SEQ ID NO: 659702 - DNA, 13 bp, Homo sapiens
gaggatgtccctg

SEQ ID NO: 659703 - DNA, 18 bp, Homo sapiens
gaggatgtccctgggcca

SEQ ID NO: 659704 - DNA, 19 bp, Homo sapiens
gaggatgtccctgggccag

SEQ ID NO: 659705 - DNA, 20 bp, Homo sapiens
gaggatgtccctgggccagg

SEQ ID NO: 659706 - DNA, 14 bp, Homo sapiens
gaggattattgata

SEQ ID NO: 659707 - DNA, 20 bp, Homo sapiens
gaggatttaagggatggaaa

SEQ ID NO: 659708 - DNA, 19 bp, Homo sapiens
gaggcaggcatggccctgg

SEQ ID NO: 659709 - DNA, 16 bp, Homo sapiens
gaggccctcctgtgct

SEQ ID NO: 659710 - DNA, 17 bp, Homo sapiens
gaggccctcctgtgctg

SEQ ID NO: 659711 - DNA, 16 bp, Homo sapiens
gaggcctgccccctgg

SEQ ID NO: 659712 - DNA, 18 bp, Homo sapiens
gaggcctgccccctgggc

SEQ ID NO: 659713 - DNA, 16 bp, Homo sapiens
gaggcctgcgaccctg

SEQ ID NO: 659714 - DNA, 20 bp, Homo sapiens
gaggctgaaagaggccaatg

SEQ ID NO: 659715 - DNA, 14 bp, Homo sapiens
gaggctgcccctct

SEQ ID NO: 659716 - DNA, 23 bp, Homo sapiens
gaggcttgtttacctttctctct

SEQ ID NO: 659717 - DNA, 20 bp, Homo sapiens
gagggacggccaagaatgta

SEQ ID NO: 659718 - DNA, 13 bp, Homo sapiens
gaggggcagcttt

SEQ ID NO: 659719 - DNA, 16 bp, Homo sapiens
gagggggcctcattgt

SEQ ID NO: 659720 - DNA, 20 bp, Homo sapiens
gaggggtccctagcagccca

SEQ ID NO: 659721 - DNA, 19 bp, Homo sapiens
gagggtatggtgctgctct

SEQ ID NO: 659722 - DNA, 22 bp, Homo sapiens
gagggtcccggtgtatcctggc

SEQ ID NO: 659723 - DNA, 15 bp, Homo sapiens
gagggtctcccctcc

SEQ ID NO: 659724 - DNA, 20 bp, Homo sapiens
gagggtctcccctcctgcac

SEQ ID NO: 659725 - DNA, 17 bp, Homo sapiens
gagggtttgggcagagc

SEQ ID NO: 659726 - DNA, 13 bp, Homo sapiens
gaggtaccctggg

SEQ ID NO: 659727 - DNA, 14 bp, Homo sapiens
gaggtattaaaact

SEQ ID NO: 659728 - DNA, 16 bp, Homo sapiens
gaggtcaagtaagaag

SEQ ID NO: 659729 - DNA, 15 bp, Homo sapiens
gaggtcactcttttg

SEQ ID NO: 659730 - DNA, 14 bp, Homo sapiens
gaggtcagggagtg

SEQ ID NO: 659731 - DNA, 19 bp, Homo sapiens
gaggtgagctactttgtga

SEQ ID NO: 659732 - DNA, 18 bp, Homo sapiens
gaggtgattctcagggct

SEQ ID NO: 659733 - DNA, 18 bp, Homo sapiens
gaggtgccggatgcagga

SEQ ID NO: 659734 - DNA, 17 bp, Homo sapiens
gaggtgctatgaagcca

SEQ ID NO: 659735 - DNA, 13 bp, Homo sapiens
gaggtgggagggc

SEQ ID NO: 659736 - DNA, 14 bp, Homo sapiens
gaggtgggagggcc

SEQ ID NO: 659737 - DNA, 16 bp, Homo sapiens
gaggtggttcagacaa

SEQ ID NO: 659738 - DNA, 23 bp, Homo sapiens
gaggtggttcagacaagacagag

SEQ ID NO: 659739 - DNA, 14 bp, Homo sapiens
gaggtttagcaata

SEQ ID NO: 659740 - DNA, 13 bp, Homo sapiens
gagtaacttagaa

SEQ ID NO: 659741 - DNA, 14 bp, Homo sapiens
gagtaacttagaaa

SEQ ID NO: 659742 - DNA, 22 bp, Homo sapiens
gagtaattcatctgtgaatctg

SEQ ID NO: 659743 - DNA, 13 bp, Homo sapiens
gagtaatttcatt

SEQ ID NO: 659744 - DNA, 18 bp, Homo sapiens
gagtacaccctttccagg

SEQ ID NO: 659745 - DNA, 20 bp, Homo sapiens
gagtatttaggcagattgaa

SEQ ID NO: 659746 - DNA, 20 bp, Homo sapiens
gagtattttaagaagacata

SEQ ID NO: 659747 - DNA, 14 bp, Homo sapiens
gagtcaacaggtca

SEQ ID NO: 659748 - DNA, 14 bp, Homo sapiens
gagtcagccaggag

SEQ ID NO: 659749 - DNA, 14 bp, Homo sapiens
gagtgccttttgca

SEQ ID NO: 659750 - DNA, 21 bp, Homo sapiens
gagtgctggctcacagtacag

SEQ ID NO: 659751 - DNA, 21 bp, Homo sapiens
gagtgggagagtacctgtgtg

SEQ ID NO: 659752 - DNA, 16 bp, Homo sapiens
gagtggtgcagacaga

SEQ ID NO: 659753 - DNA, 19 bp, Homo sapiens
gagtggttaggcagcaagc

SEQ ID NO: 659754 - DNA, 14 bp, Homo sapiens
gagtgtgacagggc

SEQ ID NO: 659755 - DNA, 13 bp, Homo sapiens
gagtgtgcatgga

SEQ ID NO: 659756 - DNA, 18 bp, Homo sapiens
gagttaacgggtgaataa

SEQ ID NO: 659757 - DNA, 19 bp, Homo sapiens
gagttaatgatggcagagg

SEQ ID NO: 659758 - DNA, 17 bp, Homo sapiens
gagttccttatccctct

SEQ ID NO: 659759 - DNA, 19 bp, Homo sapiens
gagttccttatccctctct

SEQ ID NO: 659760 - DNA, 18 bp, Homo sapiens
gataaaataaataatttt

SEQ ID NO: 659761 - DNA, 11 bp, Homo sapiens
gataaactgac

SEQ ID NO: 659762 - DNA, 17 bp, Homo sapiens
gataaagaaaaaaatac

SEQ ID NO: 659763 - DNA, 17 bp, Homo sapiens
gataaagccactgaaaa

SEQ ID NO: 659764 - DNA, 20 bp, Homo sapiens
gataaggctgttctttaaat

SEQ ID NO: 659765 - DNA, 22 bp, Homo sapiens
gataatcttcaggtgaacactt

SEQ ID NO: 659766 - DNA, 22 bp, Homo sapiens
gataatttatttcaataaatct

SEQ ID NO: 659767 - DNA, 20 bp, Homo sapiens
gataattttcagctgcaagg

SEQ ID NO: 659768 - DNA, 12 bp, Homo sapiens
gatacctggagc

SEQ ID NO: 659769 - DNA, 16 bp, Homo sapiens
gatacttatttttctg

SEQ ID NO: 659770 - DNA, 13 bp, Homo sapiens
gatactttgaagt

SEQ ID NO: 659771 - DNA, 20 bp, Homo sapiens
gatactttgaagtgcagctc

SEQ ID NO: 659772 - DNA, 14 bp, Homo sapiens
gatagactgctaca

SEQ ID NO: 659773 - DNA, 16 bp, Homo sapiens
gatagatgttgctctt

SEQ ID NO: 659774 - DNA, 13 bp, Homo sapiens
gatagatgtttgg

SEQ ID NO: 659775 - DNA, 13 bp, Homo sapiens
gataggaaactga

SEQ ID NO: 659776 - DNA, 15 bp, Homo sapiens
gataggaaactgaag

SEQ ID NO: 659777 - DNA, 18 bp, Homo sapiens
gatatatttgaaatagta

SEQ ID NO: 659778 - DNA, 22 bp, Homo sapiens
gatatggcaggactcctggcag

SEQ ID NO: 659779 - DNA, 18 bp, Homo sapiens
gatattattaatttttat

SEQ ID NO: 659780 - DNA, 20 bp, Homo sapiens
gatattgaaggagaaaatag

SEQ ID NO: 659781 - DNA, 14 bp, Homo sapiens
gatcaaaaggccca

SEQ ID NO: 659782 - DNA, 18 bp, Homo sapiens
gatcaacaacatccactg

SEQ ID NO: 659783 - DNA, 13 bp, Homo sapiens
gatcactgaattt

SEQ ID NO: 659784 - DNA, 16 bp, Homo sapiens
gatcactgaatttata

SEQ ID NO: 659785 - DNA, 15 bp, Homo sapiens
gatcagaggagtaaa

SEQ ID NO: 659786 - DNA, 15 bp, Homo sapiens
gatcagcatgcctgt

SEQ ID NO: 659787 - DNA, 18 bp, Homo sapiens
gatcagcatgcctgtcct

SEQ ID NO: 659788 - DNA, 15 bp, Homo sapiens
gatccatccatctct

SEQ ID NO: 659789 - DNA, 17 bp, Homo sapiens
gatccatttccattgct

SEQ ID NO: 659790 - DNA, 20 bp, Homo sapiens
gatccgcctacctcagcctc

SEQ ID NO: 659791 - DNA, 21 bp, Homo sapiens
gatccgcctacctcagcctcc

SEQ ID NO: 659792 - DNA, 22 bp, Homo sapiens
gatcctgggtactgaaagcctt

SEQ ID NO: 659793 - DNA, 16 bp, Homo sapiens
gatcgagaccatcctg

SEQ ID NO: 659794 - DNA, 20 bp, Homo sapiens
gatcgcttttaataaactgc

SEQ ID NO: 659795 - DNA, 14 bp, Homo sapiens
gatcgtagaaaatt

SEQ ID NO: 659796 - DNA, 18 bp, Homo sapiens
gatctaaacagttatttc

SEQ ID NO: 659797 - DNA, 17 bp, Homo sapiens
gatctcaggcttctgca

SEQ ID NO: 659798 - DNA, 22 bp, Homo sapiens
gatctctcttgtcctcttctgc

SEQ ID NO: 659799 - DNA, 19 bp, Homo sapiens
gatctctgagaccacagag

SEQ ID NO: 659800 - DNA, 24 bp, Homo sapiens
gatctctgagaccacagaggctca

SEQ ID NO: 659801 - DNA, 13 bp, Homo sapiens
gatcttgaatgtg

SEQ ID NO: 659802 - DNA, 23 bp, Homo sapiens
gatcttgaatgtggtctcaggat

SEQ ID NO: 659803 - DNA, 16 bp, Homo sapiens
gatctttcagaaatat

SEQ ID NO: 659804 - DNA, 18 bp, Homo sapiens
gatcttttcgaagctgtt

SEQ ID NO: 659805 - DNA, 20 bp, Homo sapiens
gatgacaggcgcctgccatc

SEQ ID NO: 659806 - DNA, 14 bp, Homo sapiens
gatgagaacaagct

SEQ ID NO: 659807 - DNA, 20 bp, Homo sapiens
gcccatggcccccaataaag

SEQ ID NO: 659808 - DNA, 23 bp, Homo sapiens
gcccatggcccccaataaaggca

SEQ ID NO: 659809 - DNA, 19 bp, Homo sapiens
gcccatgggagccaggccc

SEQ ID NO: 659810 - DNA, 21 bp, Homo sapiens
gccccacaaaacttcagtgtg

SEQ ID NO: 659811 - DNA, 15 bp, Homo sapiens
gccccacctcggcac

SEQ ID NO: 659812 - DNA, 19 bp, Homo sapiens
gccccaggcctgtggctcc

SEQ ID NO: 659813 - DNA, 17 bp, Homo sapiens
gcccccaacctcagggc

SEQ ID NO: 659814 - DNA, 15 bp, Homo sapiens
gcccccaataaaggc

SEQ ID NO: 659815 - DNA, 19 bp, Homo sapiens
gcccccaataaaggcagct

SEQ ID NO: 659816 - DNA, 22 bp, Homo sapiens
gcccccaataaaggcagctgcc

SEQ ID NO: 659817 - DNA, 20 bp, Homo sapiens
gcccccagtgcctcaccttc

SEQ ID NO: 659818 - DNA, 13 bp, Homo sapiens
gccccctgggctg

SEQ ID NO: 659819 - DNA, 16 bp, Homo sapiens
gcccctgcctgctgga

SEQ ID NO: 659820 - DNA, 13 bp, Homo sapiens
gcccctggcactc

SEQ ID NO: 659821 - DNA, 17 bp, Homo sapiens
gcccctggctttgcctc

SEQ ID NO: 659822 - DNA, 18 bp, Homo sapiens
gcccctggctttgcctct

SEQ ID NO: 659823 - DNA, 21 bp, Homo sapiens
gccccttaaacacaggctgtc

SEQ ID NO: 659824 - DNA, 22 bp, Homo sapiens
gcccgacatggctccggcctct

SEQ ID NO: 659825 - DNA, 15 bp, Homo sapiens
gcccgctctgcagac

SEQ ID NO: 659826 - DNA, 14 bp, Homo sapiens
gccctaagggactt

SEQ ID NO: 659827 - DNA, 16 bp, Homo sapiens
gccctaagtttgtact

SEQ ID NO: 659828 - DNA, 21 bp, Homo sapiens
gccctcatctatgaggaaagg

SEQ ID NO: 659829 - DNA, 18 bp, Homo sapiens
gccctcattactgggcct

SEQ ID NO: 659830 - DNA, 19 bp, Homo sapiens
gccctcattactgggcctt

SEQ ID NO: 659831 - DNA, 21 bp, Homo sapiens
gccctcattactgggccttag

SEQ ID NO: 659832 - DNA, 23 bp, Homo sapiens
gccctcccactttgctgttcctt

SEQ ID NO: 659833 - DNA, 12 bp, Homo sapiens
gccctcctgtgc

SEQ ID NO: 659834 - DNA, 18 bp, Homo sapiens
gccctcctgtgctggggg

SEQ ID NO: 659835 - DNA, 14 bp, Homo sapiens
gccctctcctccct

SEQ ID NO: 659836 - DNA, 22 bp, Homo sapiens
gccctgatgtgtcctcagggag

SEQ ID NO: 659837 - DNA, 14 bp, Homo sapiens
gccctggcctggct

SEQ ID NO: 659838 - DNA, 23 bp, Homo sapiens
gccctggctgttctgtggttcct

SEQ ID NO: 659839 - DNA, 13 bp, Homo sapiens
gccctgtgtgcag

SEQ ID NO: 659840 - DNA, 11 bp, Homo sapiens
gccctgtgtgt

SEQ ID NO: 659841 - DNA, 17 bp, Homo sapiens
gccctgttagctttcca

SEQ ID NO: 659842 - DNA, 16 bp, Homo sapiens
gcccttccatgtgcct

SEQ ID NO: 659843 - DNA, 19 bp, Homo sapiens
gcccttccatgtgcctttc

SEQ ID NO: 659844 - DNA, 20 bp, Homo sapiens
gcccttccatgtgcctttct

SEQ ID NO: 659845 - DNA, 13 bp, Homo sapiens
gcccttcctcctg

SEQ ID NO: 659846 - DNA, 14 bp, Homo sapiens
gcccttcctcctgc

SEQ ID NO: 659847 - DNA, 16 bp, Homo sapiens
gcccttcctcctgcct

SEQ ID NO: 659848 - DNA, 21 bp, Homo sapiens
gccgatagagggacggccaag

SEQ ID NO: 659849 - DNA, 22 bp, Homo sapiens
gccgatagagggacggccaaga

SEQ ID NO: 659850 - DNA, 15 bp, Homo sapiens
gccgctacctccctc

SEQ ID NO: 659851 - DNA, 14 bp, Homo sapiens
gccggccctgtgtg

SEQ ID NO: 659852 - DNA, 17 bp, Homo sapiens
gccggccctgtgtgcag

SEQ ID NO: 659853 - DNA, 15 bp, Homo sapiens
gccgtggcacagctg

SEQ ID NO: 659854 - DNA, 14 bp, Homo sapiens
gccgtgtgagtgtg

SEQ ID NO: 659855 - DNA, 19 bp, Homo sapiens
gccgtgtgagtgtgacagg

SEQ ID NO: 659856 - DNA, 23 bp, Homo sapiens
gccgtgtgagtgtgacagggcca

SEQ ID NO: 659857 - DNA, 21 bp, Homo sapiens
gcctagcgatctctcctggcc

SEQ ID NO: 659858 - DNA, 18 bp, Homo sapiens
gcctataatcccagcatt

SEQ ID NO: 659859 - DNA, 17 bp, Homo sapiens
gcctcaattctccatta

SEQ ID NO: 659860 - DNA, 15 bp, Homo sapiens
gcctcacttcctttg

SEQ ID NO: 659861 - DNA, 20 bp, Homo sapiens
gcctcagaccccctcagcct

SEQ ID NO: 659862 - DNA, 22 bp, Homo sapiens
gcctccacatgctgcctggcac

SEQ ID NO: 659863 - DNA, 18 bp, Homo sapiens
gcctccaggtgcagaggt

SEQ ID NO: 659864 - DNA, 16 bp, Homo sapiens
gcctccccacctccag

SEQ ID NO: 659865 - DNA, 18 bp, Homo sapiens
gcctccccacctccaggc

SEQ ID NO: 659866 - DNA, 22 bp, Homo sapiens
gcctccccctcccccattccct

SEQ ID NO: 659867 - DNA, 22 bp, Homo sapiens
gcctcctcctcctgccctcctc

SEQ ID NO: 659868 - DNA, 12 bp, Homo sapiens
gcctcctgcgcc

SEQ ID NO: 659869 - DNA, 12 bp, Homo sapiens
gcctcctgtggg

SEQ ID NO: 659870 - DNA, 18 bp, Homo sapiens
gcctcctgtggggaaagg

SEQ ID NO: 659871 - DNA, 14 bp, Homo sapiens
gcctcgctttttca

SEQ ID NO: 659872 - DNA, 16 bp, Homo sapiens
gcctctccctgggtct

SEQ ID NO: 659873 - DNA, 19 bp, Homo sapiens
gcctctccctgggtctggg

SEQ ID NO: 659874 - DNA, 21 bp, Homo sapiens
gcctctgcagtctcatttctc

SEQ ID NO: 659875 - DNA, 12 bp, Homo sapiens
gcctctgctccc

SEQ ID NO: 659876 - DNA, 14 bp, Homo sapiens
gcctctgctccctc

SEQ ID NO: 659877 - DNA, 12 bp, Homo sapiens
gcctctttccct

SEQ ID NO: 659878 - DNA, 16 bp, Homo sapiens
gcctgacttctgctgg

SEQ ID NO: 659879 - DNA, 19 bp, Homo sapiens
gcctgagagaattggctca

SEQ ID NO: 659880 - DNA, 19 bp, Homo sapiens
gcctgaggggaaagagaga

SEQ ID NO: 659881 - DNA, 17 bp, Homo sapiens
gcctgcagcaggcagct

SEQ ID NO: 659882 - DNA, 15 bp, Homo sapiens
gcctgcagggaagcc

SEQ ID NO: 659883 - DNA, 22 bp, Homo sapiens
gcctgcagggaagccccacatg

SEQ ID NO: 659884 - DNA, 21 bp, Homo sapiens
gcctgccacctccccccacaa

SEQ ID NO: 659885 - DNA, 15 bp, Homo sapiens
gcctgccccctgggc

SEQ ID NO: 659886 - DNA, 21 bp, Homo sapiens
gcctgccccctgggctggggc

SEQ ID NO: 659887 - DNA, 14 bp, Homo sapiens
gcctgcctggaaga

SEQ ID NO: 659888 - DNA, 14 bp, Homo sapiens
gcctgcgaccctgg

SEQ ID NO: 659889 - DNA, 16 bp, Homo sapiens
gcctgcgaccctgggg

SEQ ID NO: 659890 - DNA, 16 bp, Homo sapiens
gcctggccatttccaa

SEQ ID NO: 659891 - DNA, 15 bp, Homo sapiens
gcctgggccgtggca

SEQ ID NO: 659892 - DNA, 19 bp, Homo sapiens
gcctgggccgtggcacagc

SEQ ID NO: 659893 - DNA, 20 bp, Homo sapiens
gcctgggggacagaaagaga

SEQ ID NO: 659894 - DNA, 23 bp, Homo sapiens
gcctgggggtggggggactgcct

SEQ ID NO: 659895 - DNA, 18 bp, Homo sapiens
gcctggggtgcatctcct

SEQ ID NO: 659896 - DNA, 19 bp, Homo sapiens
gcctggggtgcatctcctc

SEQ ID NO: 659897 - DNA, 18 bp, Homo sapiens
gcctggggtgtcctacag

SEQ ID NO: 659898 - DNA, 23 bp, Homo sapiens
gcctggttcagacacagctcttc

SEQ ID NO: 659899 - DNA, 20 bp, Homo sapiens
gcctgtaatcccagcacttt

SEQ ID NO: 659900 - DNA, 17 bp, Homo sapiens
gcctgtcccaattctgc

SEQ ID NO: 659901 - DNA, 20 bp, Homo sapiens
gcctgtcccaattctgcccg

SEQ ID NO: 659902 - DNA, 22 bp, Homo sapiens
gcctgtcccaattctgcccgct

SEQ ID NO: 659903 - DNA, 14 bp, Homo sapiens
gcctgtcccttgcc

SEQ ID NO: 659904 - DNA, 17 bp, Homo sapiens
gcctgtcttaattttct

SEQ ID NO: 659905 - DNA, 18 bp, Homo sapiens
gcctgtgccagcaccaca

SEQ ID NO: 659906 - DNA, 22 bp, Homo sapiens
gcctgtgccagcaccacagccg

SEQ ID NO: 659907 - DNA, 16 bp, Homo sapiens
gcctgtggaatgagtg

SEQ ID NO: 659908 - DNA, 15 bp, Homo sapiens
gccttaatttagaaa

SEQ ID NO: 659909 - DNA, 13 bp, Homo sapiens
gccttacatctgg

SEQ ID NO: 659910 - DNA, 17 bp, Homo sapiens
gccttacatctggctgg

SEQ ID NO: 659911 - DNA, 20 bp, Homo sapiens
gccttagtgggccagggctg

SEQ ID NO: 659912 - DNA, 23 bp, Homo sapiens
gccttgaaaaatgacaattgtga

SEQ ID NO: 659913 - DNA, 14 bp, Homo sapiens
gccttgcaagatgg

SEQ ID NO: 659914 - DNA, 19 bp, Homo sapiens
gccttgccccaggccctgc

SEQ ID NO: 659915 - DNA, 19 bp, Homo sapiens
gccttgctgtttgtcctga

SEQ ID NO: 659916 - DNA, 22 bp, Homo sapiens
gccttgctgtttgtcctgagat

SEQ ID NO: 659917 - DNA, 13 bp, Homo sapiens
gccttggagaggg

SEQ ID NO: 659918 - DNA, 13 bp, Homo sapiens
gcctttctttgcc

SEQ ID NO: 659919 - DNA, 14 bp, Homo sapiens
gcctttctttgcct

SEQ ID NO: 659920 - DNA, 18 bp, Homo sapiens
gcctttctttgcctctgc

SEQ ID NO: 659921 - DNA, 12 bp, Homo sapiens
gcctttggcctg

SEQ ID NO: 659922 - DNA, 15 bp, Homo sapiens
gccttttctggcacc

SEQ ID NO: 659923 - DNA, 16 bp, Homo sapiens
gccttttgcagaagag

SEQ ID NO: 659924 - DNA, 16 bp, Homo sapiens
gcgaagtagcttgctc

SEQ ID NO: 659925 - DNA, 20 bp, Homo sapiens
gcgaagtagcttgctccctg

SEQ ID NO: 659926 - DNA, 13 bp, Homo sapiens
gcgaccctggggg

SEQ ID NO: 659927 - DNA, 19 bp, Homo sapiens
ggagcggaggttgcagtga

SEQ ID NO: 659928 - DNA, 12 bp, Homo sapiens
ggagctgggccc

SEQ ID NO: 659929 - DNA, 23 bp, Homo sapiens
ggagcttcttcgttcctgcgcat

SEQ ID NO: 659930 - DNA, 17 bp, Homo sapiens
ggaggacaaaaggaatg

SEQ ID NO: 659931 - DNA, 19 bp, Homo sapiens
ggaggaggcctgtcccaat

SEQ ID NO: 659932 - DNA, 21 bp, Homo sapiens
ggaggagggtttgggcagagc

SEQ ID NO: 659933 - DNA, 14 bp, Homo sapiens
ggaggccccagggg

SEQ ID NO: 659934 - DNA, 16 bp, Homo sapiens
ggaggcctcgagcaga

SEQ ID NO: 659935 - DNA, 18 bp, Homo sapiens
ggagggaaggagcagtca

SEQ ID NO: 659936 - DNA, 19 bp, Homo sapiens
ggaggtgccggatgcagga

SEQ ID NO: 659937 - DNA, 19 bp, Homo sapiens
ggaggtgtgaatgcacgtt

SEQ ID NO: 659938 - DNA, 18 bp, Homo sapiens
ggagtcagccaggagctg

SEQ ID NO: 659939 - DNA, 18 bp, Homo sapiens
ggagtggtgatttgaaaa

SEQ ID NO: 659940 - DNA, 15 bp, Homo sapiens
ggagtggtgcagaca

SEQ ID NO: 659941 - DNA, 16 bp, Homo sapiens
ggagtggtgcagacag

SEQ ID NO: 659942 - DNA, 17 bp, Homo sapiens
ggagtggttaggcagca

SEQ ID NO: 659943 - DNA, 20 bp, Homo sapiens
ggagtggttaggcagcaagc

SEQ ID NO: 659944 - DNA, 20 bp, Homo sapiens
ggagttccttatccctctct

SEQ ID NO: 659945 - DNA, 12 bp, Homo sapiens
ggataagaaagc

SEQ ID NO: 659946 - DNA, 12 bp, Homo sapiens
ggatatatttga

SEQ ID NO: 659947 - DNA, 20 bp, Homo sapiens
ggatatccttatcagagcta

SEQ ID NO: 659948 - DNA, 16 bp, Homo sapiens
ggatatggcaggactc

SEQ ID NO: 659949 - DNA, 18 bp, Homo sapiens
ggatattgaatgttaaag

SEQ ID NO: 659950 - DNA, 19 bp, Homo sapiens
ggatcaacaacatccactg

SEQ ID NO: 659951 - DNA, 17 bp, Homo sapiens
ggatctggagaacctca

SEQ ID NO: 659952 - DNA, 15 bp, Homo sapiens
ggatcttgaatgtgg

SEQ ID NO: 659953 - DNA, 20 bp, Homo sapiens
ggatcttgaatgtggtctca

SEQ ID NO: 659954 - DNA, 22 bp, Homo sapiens
ggatgaaagagccagactctgt

SEQ ID NO: 659955 - DNA, 14 bp, Homo sapiens
ggatgactttttta

SEQ ID NO: 659956 - DNA, 14 bp, Homo sapiens
ggatgtccctgggc

SEQ ID NO: 659957 - DNA, 14 bp, Homo sapiens
ggatgttctgcctc

SEQ ID NO: 659958 - DNA, 23 bp, Homo sapiens
ggatgttctgcctctccctgggt

SEQ ID NO: 659959 - DNA, 21 bp, Homo sapiens
ggattcagtcataaagaggta

SEQ ID NO: 659960 - DNA, 13 bp, Homo sapiens
ggattgcagagtg

SEQ ID NO: 659961 - DNA, 15 bp, Homo sapiens
ggattgcctctgaaa

SEQ ID NO: 659962 - DNA, 21 bp, Homo sapiens
ggatttgtagcataactgtag

SEQ ID NO: 659963 - DNA, 16 bp, Homo sapiens
ggattttcatcagggg

SEQ ID NO: 659964 - DNA, 15 bp, Homo sapiens
ggcaaagaaaggaga

SEQ ID NO: 659965 - DNA, 18 bp, Homo sapiens
ggcaaagataatttattt

SEQ ID NO: 659966 - DNA, 14 bp, Homo sapiens
ggcaaagtttaaat

SEQ ID NO: 659967 - DNA, 19 bp, Homo sapiens
ggcaaagtttaaatgtatt

SEQ ID NO: 659968 - DNA, 11 bp, Homo sapiens
ggcaattagtg

SEQ ID NO: 659969 - DNA, 22 bp, Homo sapiens
ggcaattcagtcctgggcaaag

SEQ ID NO: 659970 - DNA, 13 bp, Homo sapiens
ggcaattgtctat

SEQ ID NO: 659971 - DNA, 20 bp, Homo sapiens
ggcacaacacatcaggaaag

SEQ ID NO: 659972 - DNA, 14 bp, Homo sapiens
ggcacagaccaggc

SEQ ID NO: 659973 - DNA, 16 bp, Homo sapiens
ggcacaggaggcaggc

SEQ ID NO: 659974 - DNA, 15 bp, Homo sapiens
ggcaccgagaatgtt

SEQ ID NO: 659975 - DNA, 15 bp, Homo sapiens
ggcacgtgacaggct

SEQ ID NO: 659976 - DNA, 13 bp, Homo sapiens
ggcactggcccag

SEQ ID NO: 659977 - DNA, 21 bp, Homo sapiens
ggcagagtggcgtggcctccc

SEQ ID NO: 659978 - DNA, 15 bp, Homo sapiens
ggcagcatggagaga

SEQ ID NO: 659979 - DNA, 16 bp, Homo sapiens
ggcagctgcctctgct

SEQ ID NO: 659980 - DNA, 18 bp, Homo sapiens
ggcagctgcctctgctcc

SEQ ID NO: 659981 - DNA, 22 bp, Homo sapiens
ggcagctgcctctgctccctct

SEQ ID NO: 659982 - DNA, 14 bp, Homo sapiens
ggcaggactcctgg

SEQ ID NO: 659983 - DNA, 20 bp, Homo sapiens
ggcaggactcctggcagggc

SEQ ID NO: 659984 - DNA, 16 bp, Homo sapiens
ggcaggcggctcctcc

SEQ ID NO: 659985 - DNA, 14 bp, Homo sapiens
ggcaggtgggcaga

SEQ ID NO: 659986 - DNA, 15 bp, Homo sapiens
ggcaggtgggcagac

SEQ ID NO: 659987 - DNA, 14 bp, Homo sapiens
ggcagttgcttgtg

SEQ ID NO: 659988 - DNA, 15 bp, Homo sapiens
ggcagttgcttgtgt

SEQ ID NO: 659989 - DNA, 18 bp, Homo sapiens
ggcatggttgttgcatat

SEQ ID NO: 659990 - DNA, 19 bp, Homo sapiens
ggcattgagtattgtttaa

SEQ ID NO: 659991 - DNA, 16 bp, Homo sapiens
ggccaagtccgcagaa

SEQ ID NO: 659992 - DNA, 23 bp, Homo sapiens
ggccaagtccgcagaagccctga

SEQ ID NO: 659993 - DNA, 15 bp, Homo sapiens
ggccacagtggggct

SEQ ID NO: 659994 - DNA, 14 bp, Homo sapiens
ggccacatttaata

SEQ ID NO: 659995 - DNA, 22 bp, Homo sapiens
ggccaggccttacatctggctg

SEQ ID NO: 659996 - DNA, 14 bp, Homo sapiens
ggccagggctgccc

SEQ ID NO: 659997 - DNA, 22 bp, Homo sapiens
ggccagggtctgtgtgaatgtg

SEQ ID NO: 659998 - DNA, 15 bp, Homo sapiens
ggccagtggggcctg

SEQ ID NO: 659999 - DNA, 15 bp, Homo sapiens
ggccatgtccaaaga

SEQ ID NO: 660000 - DNA, 18 bp, Homo sapiens
ggcccacccggtgggacc

SEQ ID NO: 660001 - DNA, 18 bp, Homo sapiens
ggcccagtgcatggtggc

SEQ ID NO: 660002 - DNA, 22 bp, Homo sapiens
ggccccacctcggcacacactg

SEQ ID NO: 660003 - DNA, 20 bp, Homo sapiens
ggcccccaacctcagggctc

SEQ ID NO: 660004 - DNA, 15 bp, Homo sapiens
ggcccccaataaagg

SEQ ID NO: 660005 - DNA, 16 bp, Homo sapiens
ggcccccaataaaggc

SEQ ID NO: 660006 - DNA, 20 bp, Homo sapiens
ggcccccaataaaggcagct

SEQ ID NO: 660007 - DNA, 21 bp, Homo sapiens
ggcccccaataaaggcagctg

SEQ ID NO: 660008 - DNA, 13 bp, Homo sapiens
ggcccctggcact

SEQ ID NO: 660009 - DNA, 18 bp, Homo sapiens
ggccctgagtctgggcag

SEQ ID NO: 660010 - DNA, 15 bp, Homo sapiens
ggccctgggggtctg

SEQ ID NO: 660011 - DNA, 19 bp, Homo sapiens
ggccctgggggtctgggcg

SEQ ID NO: 660012 - DNA, 19 bp, Homo sapiens
ggccctttccttccagatc

SEQ ID NO: 660013 - DNA, 18 bp, Homo sapiens
ggccgcgcgtccagctgc

SEQ ID NO: 660014 - DNA, 14 bp, Homo sapiens
ggccggccctgtgt

SEQ ID NO: 660015 - DNA, 19 bp, Homo sapiens
ggcctagcgatctctcctg

SEQ ID NO: 660016 - DNA, 23 bp, Homo sapiens
ggcctagcgatctctcctggcct

SEQ ID NO: 660017 - DNA, 19 bp, Homo sapiens
ggcctcagaccccctcagc

SEQ ID NO: 660018 - DNA, 17 bp, Homo sapiens
ggcctcagctgaatgcc

SEQ ID NO: 660019 - DNA, 11 bp, Homo sapiens
ggcctcattgt

SEQ ID NO: 660020 - DNA, 20 bp, Homo sapiens
ggcctccctttgtgtgcata

SEQ ID NO: 660021 - DNA, 14 bp, Homo sapiens
ggcctcggcccctc

SEQ ID NO: 660022 - DNA, 19 bp, Homo sapiens
ggcctgccccctgggctgg

SEQ ID NO: 660023 - DNA, 22 bp, Homo sapiens
ggcctgccccctgggctggggc

SEQ ID NO: 660024 - DNA, 15 bp, Homo sapiens
ggcctgcctcccact

SEQ ID NO: 660025 - DNA, 16 bp, Homo sapiens
ggcctgcgaccctggg

SEQ ID NO: 660026 - DNA, 15 bp, Homo sapiens
ggcctggccatttcc

SEQ ID NO: 660027 - DNA, 16 bp, Homo sapiens
ggcctggggcctgaga

SEQ ID NO: 660028 - DNA, 17 bp, Homo sapiens
ggcctggggcctgagag

SEQ ID NO: 660029 - DNA, 20 bp, Homo sapiens
ggcctggggtgcatctcctc

SEQ ID NO: 660030 - DNA, 23 bp, Homo sapiens
ggcctgtatcctccctggcagac

SEQ ID NO: 660031 - DNA, 20 bp, Homo sapiens
ggcctgtcccttgcctctgc

SEQ ID NO: 660032 - DNA, 16 bp, Homo sapiens
ggcctgtggaatgagt

SEQ ID NO: 660033 - DNA, 16 bp, Homo sapiens
ggcctgtggctccctt

SEQ ID NO: 660034 - DNA, 18 bp, Homo sapiens
ggccttacatctggctgg

SEQ ID NO: 660035 - DNA, 20 bp, Homo sapiens
ggccttgccccaggccctgc

SEQ ID NO: 660036 - DNA, 23 bp, Homo sapiens
ggcctttaaaacgcgtctgcctg

SEQ ID NO: 660037 - DNA, 23 bp, Homo sapiens
ggccttttgttaaacccttctgt

SEQ ID NO: 660038 - DNA, 20 bp, Homo sapiens
ggcgcaggtgggctggactt

SEQ ID NO: 660039 - DNA, 15 bp, Homo sapiens
ggcggctcctcctca

SEQ ID NO: 660040 - DNA, 20 bp, Homo sapiens
ggcgggtggatcacgaggtc

SEQ ID NO: 660041 - DNA, 15 bp, Homo sapiens
ggcgtggagggaggc

SEQ ID NO: 660042 - DNA, 18 bp, Homo sapiens
ggcgtgggagccagcctc

SEQ ID NO: 660043 - DNA, 13 bp, Homo sapiens
ggctagagaaatc

SEQ ID NO: 660044 - DNA, 20 bp, Homo sapiens
ggctaggacagttgattcaa

SEQ ID NO: 660045 - DNA, 16 bp, Homo sapiens
ggctatgccatgtgcg

SEQ ID NO: 660046 - DNA, 17 bp, Homo sapiens
ggctatgtataaaatac

SEQ ID NO: 660047 - DNA, 19 bp, Homo sapiens
gtctgaggcctgccccctg

SEQ ID NO: 660048 - DNA, 22 bp, Homo sapiens
gtctgaggcctgccccctgggc

SEQ ID NO: 660049 - DNA, 11 bp, Homo sapiens
gtctgcctggg

SEQ ID NO: 660050 - DNA, 15 bp, Homo sapiens
gtctgcctgtcccca

SEQ ID NO: 660051 - DNA, 14 bp, Homo sapiens
gtctgccttctgct

SEQ ID NO: 660052 - DNA, 15 bp, Homo sapiens
gtctgccttctgctg

SEQ ID NO: 660053 - DNA, 15 bp, Homo sapiens
gtctggacctgggga

SEQ ID NO: 660054 - DNA, 21 bp, Homo sapiens
gtctgggcgtccagctcagcc

SEQ ID NO: 660055 - DNA, 13 bp, Homo sapiens
gtctgtgtgaatg

SEQ ID NO: 660056 - DNA, 14 bp, Homo sapiens
gtctgtgtgaatgt

SEQ ID NO: 660057 - DNA, 13 bp, Homo sapiens
gtctgttgattaa

SEQ ID NO: 660058 - DNA, 21 bp, Homo sapiens
gtctgtttggactgcagaagc

SEQ ID NO: 660059 - DNA, 19 bp, Homo sapiens
gtcttaatttatttcttaa

SEQ ID NO: 660060 - DNA, 18 bp, Homo sapiens
gtcttacaatcaaatctc

SEQ ID NO: 660061 - DNA, 20 bp, Homo sapiens
gtcttacaatcaaatctcct

SEQ ID NO: 660062 - DNA, 17 bp, Homo sapiens
gtcttctactgccttga

SEQ ID NO: 660063 - DNA, 16 bp, Homo sapiens
gtcttcttacatgcat

SEQ ID NO: 660064 - DNA, 13 bp, Homo sapiens
gtcttgagccagt

SEQ ID NO: 660065 - DNA, 19 bp, Homo sapiens
gtcttgagccagtaatctt

SEQ ID NO: 660066 - DNA, 21 bp, Homo sapiens
gtcttgagccagtaatcttta

SEQ ID NO: 660067 - DNA, 16 bp, Homo sapiens
gtcttgtggttgtgtg

SEQ ID NO: 660068 - DNA, 18 bp, Homo sapiens
gtcttgtggttgtgtgtg

SEQ ID NO: 660069 - DNA, 17 bp, Homo sapiens
gtcttgttagaaaacaa

SEQ ID NO: 660070 - DNA, 19 bp, Homo sapiens
gtctttcatggctgctgtt

SEQ ID NO: 660071 - DNA, 17 bp, Homo sapiens
gtctttcttgaaattga

SEQ ID NO: 660072 - DNA, 18 bp, Homo sapiens
gtgaaaatgtaattataa

SEQ ID NO: 660073 - DNA, 18 bp, Homo sapiens
gtgaaacctggtctctac

SEQ ID NO: 660074 - DNA, 17 bp, Homo sapiens
gtgaaacgtctggactg

SEQ ID NO: 660075 - DNA, 22 bp, Homo sapiens
gtgaacctacctgccttggaga

SEQ ID NO: 660076 - DNA, 21 bp, Homo sapiens
gtgaacgtccacatgaaacct

SEQ ID NO: 660077 - DNA, 14 bp, Homo sapiens
gtgaactctggtgc

SEQ ID NO: 660078 - DNA, 19 bp, Homo sapiens
gtgaagtttaattgtctca

SEQ ID NO: 660079 - DNA, 23 bp, Homo sapiens
gtgaatgtgggcactggcccagg

SEQ ID NO: 660080 - DNA, 18 bp, Homo sapiens
gtgacaggctcgtcagcc

SEQ ID NO: 660081 - DNA, 20 bp, Homo sapiens
gtgacaggctcgtcagccac

SEQ ID NO: 660082 - DNA, 13 bp, Homo sapiens
gtgacagtcatca

SEQ ID NO: 660083 - DNA, 16 bp, Homo sapiens
gtgacagtcatcatca

SEQ ID NO: 660084 - DNA, 13 bp, Homo sapiens
gtgacagtttcca

SEQ ID NO: 660085 - DNA, 14 bp, Homo sapiens
gtgacggccctcat

SEQ ID NO: 660086 - DNA, 15 bp, Homo sapiens
gtgactccctgggag

SEQ ID NO: 660087 - DNA, 18 bp, Homo sapiens
gtgagacactgtctctac

SEQ ID NO: 660088 - DNA, 21 bp, Homo sapiens
gtgagcagtcgcctgcctgca

SEQ ID NO: 660089 - DNA, 18 bp, Homo sapiens
gtgagccaaagcttatgt

SEQ ID NO: 660090 - DNA, 23 bp, Homo sapiens
gtgagctcttcctatccctctcc

SEQ ID NO: 660091 - DNA, 20 bp, Homo sapiens
gtgaggccatacttgtgaaa

SEQ ID NO: 660092 - DNA, 18 bp, Homo sapiens
gtgagggtaagtattttc

SEQ ID NO: 660093 - DNA, 13 bp, Homo sapiens
gtgagtaacttag

SEQ ID NO: 660094 - DNA, 17 bp, Homo sapiens
gtgagtgccttttgcag

SEQ ID NO: 660095 - DNA, 14 bp, Homo sapiens
gtgagtgggagagt

SEQ ID NO: 660096 - DNA, 17 bp, Homo sapiens
gtgagtgtgacagggcc

SEQ ID NO: 660097 - DNA, 14 bp, Homo sapiens
gtgatatttttctt

SEQ ID NO: 660098 - DNA, 15 bp, Homo sapiens
gtgatcatttaaaaa

SEQ ID NO: 660099 - DNA, 22 bp, Homo sapiens
gtgatccgcctacctcagcctc

SEQ ID NO: 660100 - DNA, 20 bp, Homo sapiens
gtgatgggagaattggtata

SEQ ID NO: 660101 - DNA, 16 bp, Homo sapiens
gtgatggtgtagccct

SEQ ID NO: 660102 - DNA, 16 bp, Homo sapiens
gtgattctcagggctg

SEQ ID NO: 660103 - DNA, 14 bp, Homo sapiens
gtgatttgaaaaat

SEQ ID NO: 660104 - DNA, 22 bp, Homo sapiens
gtgatttgaaaaatataaaatt

SEQ ID NO: 660105 - DNA, 19 bp, Homo sapiens
gtgcaaaagcttcaaatta

SEQ ID NO: 660106 - DNA, 18 bp, Homo sapiens
gtgcaaattgtatcttat

SEQ ID NO: 660107 - DNA, 23 bp, Homo sapiens
gtgcaagttcatgtgtggaaatg

SEQ ID NO: 660108 - DNA, 13 bp, Homo sapiens
gtgcacagccact

SEQ ID NO: 660109 - DNA, 21 bp, Homo sapiens
gtgcacatccgcgtgtgcctg

SEQ ID NO: 660110 - DNA, 17 bp, Homo sapiens
gtgcactttctaatgtt

SEQ ID NO: 660111 - DNA, 18 bp, Homo sapiens
gtgcagaaaatatttaat

SEQ ID NO: 660112 - DNA, 12 bp, Homo sapiens
gtgcagaatgta

SEQ ID NO: 660113 - DNA, 16 bp, Homo sapiens
gtgcagacccagtccc

SEQ ID NO: 660114 - DNA, 19 bp, Homo sapiens
gtgcagacccagtcccaca

SEQ ID NO: 660115 - DNA, 19 bp, Homo sapiens
gtgcagatgcaattgtttg

SEQ ID NO: 660116 - DNA, 15 bp, Homo sapiens
gtgcagctcatgttt

SEQ ID NO: 660117 - DNA, 15 bp, Homo sapiens
gtgcagtactttgtg

SEQ ID NO: 660118 - DNA, 12 bp, Homo sapiens
gtgcatctcctc

SEQ ID NO: 660119 - DNA, 14 bp, Homo sapiens
gtgcatctcctccc

SEQ ID NO: 660120 - DNA, 12 bp, Homo sapiens
gtgcatgctctg

SEQ ID NO: 660121 - DNA, 21 bp, Homo sapiens
gtgcatggaggccctcctgtg

SEQ ID NO: 660122 - DNA, 16 bp, Homo sapiens
gtgcatttttgtgaaa

SEQ ID NO: 660123 - DNA, 13 bp, Homo sapiens
gtgccctgtgtgt

SEQ ID NO: 660124 - DNA, 13 bp, Homo sapiens
gtgccgtgtgagt

SEQ ID NO: 660125 - DNA, 20 bp, Homo sapiens
gtgccgtgtgagtgtgacag

SEQ ID NO: 660126 - DNA, 22 bp, Homo sapiens
gtgcctccacatgctgcctggc

SEQ ID NO: 660127 - DNA, 11 bp, Homo sapiens
gtgcctggggt

SEQ ID NO: 660128 - DNA, 12 bp, Homo sapiens
gtgccttccaac

SEQ ID NO: 660129 - DNA, 14 bp, Homo sapiens
gtgcctttctttgc

SEQ ID NO: 660130 - DNA, 19 bp, Homo sapiens
gtgcctttctttgcctctg

SEQ ID NO: 660131 - DNA, 14 bp, Homo sapiens
gtgcctttggcctg

SEQ ID NO: 660132 - DNA, 18 bp, Homo sapiens
gtgccttttgcagaagag

SEQ ID NO: 660133 - DNA, 14 bp, Homo sapiens
gtgccttttggaac

SEQ ID NO: 660134 - DNA, 21 bp, Homo sapiens
gtgctggctcacagtacagca

SEQ ID NO: 660135 - DNA, 22 bp, Homo sapiens
gtgctggctcacagtacagcat

SEQ ID NO: 660136 - DNA, 19 bp, Homo sapiens
gtgctttttaagaatattt

SEQ ID NO: 660137 - DNA, 20 bp, Homo sapiens
gtggaaggcagacagcaggc

SEQ ID NO: 660138 - DNA, 17 bp, Homo sapiens
gtggaaggcctccctct

SEQ ID NO: 660139 - DNA, 18 bp, Homo sapiens
gtggaatgagtgtgcatg

SEQ ID NO: 660140 - DNA, 16 bp, Homo sapiens
gtggatataaaatgtg

SEQ ID NO: 660141 - DNA, 17 bp, Homo sapiens
gtggatataaaatgtgc

SEQ ID NO: 660142 - DNA, 18 bp, Homo sapiens
gtggattctgaggccctg

SEQ ID NO: 660143 - DNA, 14 bp, Homo sapiens
gtggcacacactga

SEQ ID NO: 660144 - DNA, 18 bp, Homo sapiens
gtggcacacactgaccac

SEQ ID NO: 660145 - DNA, 13 bp, Homo sapiens
gtggccagaggtg

SEQ ID NO: 660146 - DNA, 15 bp, Homo sapiens
gtggccatcatcctc

SEQ ID NO: 660147 - DNA, 22 bp, Homo sapiens
gtggccctgaacctcattctgg

SEQ ID NO: 660148 - DNA, 13 bp, Homo sapiens
gtggcctccccat

SEQ ID NO: 660149 - DNA, 23 bp, Homo sapiens
gtggcctttttctgagatgctca

SEQ ID NO: 660150 - DNA, 15 bp, Homo sapiens
gtggcgtctccctcg

SEQ ID NO: 660151 - DNA, 16 bp, Homo sapiens
gtggcgtctccctcgc

SEQ ID NO: 660152 - DNA, 13 bp, Homo sapiens
gtggcgtggcctc

SEQ ID NO: 660153 - DNA, 16 bp, Homo sapiens
gtgggcactggcccag

SEQ ID NO: 660154 - DNA, 14 bp, Homo sapiens
gtgggccagggctg

SEQ ID NO: 660155 - DNA, 21 bp, Homo sapiens
gtgggccagggctgccctgag

SEQ ID NO: 660156 - DNA, 22 bp, Homo sapiens
gtgggcccacccggtgggaccc

SEQ ID NO: 660157 - DNA, 13 bp, Homo sapiens
gtggggcagggag

SEQ ID NO: 660158 - DNA, 19 bp, Homo sapiens
gtggggcctgtggaatgag

SEQ ID NO: 660159 - DNA, 15 bp, Homo sapiens
gtgggtacatcaagt

SEQ ID NO: 660160 - DNA, 13 bp, Homo sapiens
gtgggtgctcaga

SEQ ID NO: 660161 - DNA, 12 bp, Homo sapiens
gtggtaatctac

SEQ ID NO: 660162 - DNA, 17 bp, Homo sapiens
gtggtaatctacaccaa

SEQ ID NO: 660163 - DNA, 22 bp, Homo sapiens
gtggtcacaacttgatggctgc

SEQ ID NO: 660164 - DNA, 18 bp, Homo sapiens
gtggtgatttgaaaaata

SEQ ID NO: 660165 - DNA, 13 bp, Homo sapiens
gtggttcctctgc

SEQ ID NO: 660166 - DNA, 24 bp, Homo sapiens
gtggttcttaaatgtttatactgt

SEQ ID NO: 660167 - DNA, 16 bp, Homo sapiens
gtgtaactcccagtga

SEQ ID NO: 660168 - DNA, 22 bp, Homo sapiens
taaataaactatttatatcaca

SEQ ID NO: 660169 - DNA, 20 bp, Homo sapiens
taaataaatgggtgtatata

SEQ ID NO: 660170 - DNA, 14 bp, Homo sapiens
taaataactgtgtg

SEQ ID NO: 660171 - DNA, 15 bp, Homo sapiens
taaataattggaaaa

SEQ ID NO: 660172 - DNA, 17 bp, Homo sapiens
taaataatttatttaat

SEQ ID NO: 660173 - DNA, 13 bp, Homo sapiens
taaataattttaa

SEQ ID NO: 660174 - DNA, 20 bp, Homo sapiens
taaatacatgccacatcaaa

SEQ ID NO: 660175 - DNA, 19 bp, Homo sapiens
taaatactctacttacagt

SEQ ID NO: 660176 - DNA, 21 bp, Homo sapiens
taaataggaatcattcagaaa

SEQ ID NO: 660177 - DNA, 18 bp, Homo sapiens
taaatagtgtcatataaa

SEQ ID NO: 660178 - DNA, 13 bp, Homo sapiens
taaatataattta

SEQ ID NO: 660179 - DNA, 15 bp, Homo sapiens
taaatataatttata

SEQ ID NO: 660180 - DNA, 23 bp, Homo sapiens
taaatatatatggtcatatacat

SEQ ID NO: 660181 - DNA, 14 bp, Homo sapiens
taaatatttgtcct

SEQ ID NO: 660182 - DNA, 19 bp, Homo sapiens
taaatatttgtccttaaag

SEQ ID NO: 660183 - DNA, 19 bp, Homo sapiens
taaatgcaaccatttgaaa

SEQ ID NO: 660184 - DNA, 15 bp, Homo sapiens
taaatgcataattta

SEQ ID NO: 660185 - DNA, 16 bp, Homo sapiens
taaatgcatattaaat

SEQ ID NO: 660186 - DNA, 22 bp, Homo sapiens
taaatgccctcttctcgtgcct

SEQ ID NO: 660187 - DNA, 19 bp, Homo sapiens
taaatgcttcattgaaagc

SEQ ID NO: 660188 - DNA, 19 bp, Homo sapiens
taaatgggtgtatataatt

SEQ ID NO: 660189 - DNA, 19 bp, Homo sapiens
taaatggtaataagcactg

SEQ ID NO: 660190 - DNA, 22 bp, Homo sapiens
taaatgtataaatatacagtat

SEQ ID NO: 660191 - DNA, 15 bp, Homo sapiens
taaatgtattttaca

SEQ ID NO: 660192 - DNA, 19 bp, Homo sapiens
taaattcaactttgtaaaa

SEQ ID NO: 660193 - DNA, 15 bp, Homo sapiens
taaattgaagaaagt

SEQ ID NO: 660194 - DNA, 14 bp, Homo sapiens
taaatttaatacca

SEQ ID NO: 660195 - DNA, 18 bp, Homo sapiens
taaatttttaggcaaaga

SEQ ID NO: 660196 - DNA, 14 bp, Homo sapiens
taacaaaatgagat

SEQ ID NO: 660197 - DNA, 19 bp, Homo sapiens
taacacatttttttgcatg

SEQ ID NO: 660198 - DNA, 12 bp, Homo sapiens
taacataaattt

SEQ ID NO: 660199 - DNA, 18 bp, Homo sapiens
taacatacaagaaaatgt

SEQ ID NO: 660200 - DNA, 21 bp, Homo sapiens
taacatgaacacccttagaaa

SEQ ID NO: 660201 - DNA, 22 bp, Homo sapiens
taacatgctggtgaatattttc

SEQ ID NO: 660202 - DNA, 19 bp, Homo sapiens
taacatgtgaaaagaatag

SEQ ID NO: 660203 - DNA, 15 bp, Homo sapiens
taacattttggaaat

SEQ ID NO: 660204 - DNA, 17 bp, Homo sapiens
taacattttggaaattg

SEQ ID NO: 660205 - DNA, 17 bp, Homo sapiens
taaccactaacattgtg

SEQ ID NO: 660206 - DNA, 17 bp, Homo sapiens
taaccagtacttctaag

SEQ ID NO: 660207 - DNA, 18 bp, Homo sapiens
taaccagtacttctaaga

SEQ ID NO: 660208 - DNA, 15 bp, Homo sapiens
taacccacctctcct

SEQ ID NO: 660209 - DNA, 13 bp, Homo sapiens
taacctttgctat

SEQ ID NO: 660210 - DNA, 13 bp, Homo sapiens
taacgatgttgta

SEQ ID NO: 660211 - DNA, 14 bp, Homo sapiens
taacgatgttgtat

SEQ ID NO: 660212 - DNA, 14 bp, Homo sapiens
taacgcaggagaat

SEQ ID NO: 660213 - DNA, 22 bp, Homo sapiens
taacggaaagtttttagaatgt

SEQ ID NO: 660214 - DNA, 18 bp, Homo sapiens
taacgtgttccagtgtct

SEQ ID NO: 660215 - DNA, 19 bp, Homo sapiens
taactaaaataattttgta

SEQ ID NO: 660216 - DNA, 20 bp, Homo sapiens
taactaaaataattttgtaa

SEQ ID NO: 660217 - DNA, 21 bp, Homo sapiens
taactaaaataattttgtaat

SEQ ID NO: 660218 - DNA, 18 bp, Homo sapiens
taactcaaatacacattt

SEQ ID NO: 660219 - DNA, 21 bp, Homo sapiens
taactcaaatacacatttgct

SEQ ID NO: 660220 - DNA, 19 bp, Homo sapiens
taactcaatcatgaatgaa

SEQ ID NO: 660221 - DNA, 17 bp, Homo sapiens
taactcctgtccctttt

SEQ ID NO: 660222 - DNA, 13 bp, Homo sapiens
taactctgagagc

SEQ ID NO: 660223 - DNA, 15 bp, Homo sapiens
taactgtgctgaatg

SEQ ID NO: 660224 - DNA, 16 bp, Homo sapiens
taactgtgctgaatgc

SEQ ID NO: 660225 - DNA, 20 bp, Homo sapiens
taacttttcaatgacatttt

SEQ ID NO: 660226 - DNA, 20 bp, Homo sapiens
taagaaaccttgctctcctc

SEQ ID NO: 660227 - DNA, 19 bp, Homo sapiens
taagaaagcctaaaattga

SEQ ID NO: 660228 - DNA, 15 bp, Homo sapiens
taagaaaggaagcaa

SEQ ID NO: 660229 - DNA, 18 bp, Homo sapiens
taagaacaaaagcgaccc

SEQ ID NO: 660230 - DNA, 17 bp, Homo sapiens
taagaagaagttcatgt

SEQ ID NO: 660231 - DNA, 22 bp, Homo sapiens
taagaagaagttcatgtccaaa

SEQ ID NO: 660232 - DNA, 16 bp, Homo sapiens
taagaatatttttaga

SEQ ID NO: 660233 - DNA, 16 bp, Homo sapiens
taagacaagagatcta

SEQ ID NO: 660234 - DNA, 18 bp, Homo sapiens
taagactatatatataaa

SEQ ID NO: 660235 - DNA, 14 bp, Homo sapiens
taagagaagtgagt

SEQ ID NO: 660236 - DNA, 16 bp, Homo sapiens
taagaggttgattata

SEQ ID NO: 660237 - DNA, 23 bp, Homo sapiens
taagagtattttaagaagacata

SEQ ID NO: 660238 - DNA, 23 bp, Homo sapiens
taagattgatatctataaaatag

SEQ ID NO: 660239 - DNA, 19 bp, Homo sapiens
taagcaaatgttaaaagtt

SEQ ID NO: 660240 - DNA, 14 bp, Homo sapiens
taagcaacatggct

SEQ ID NO: 660241 - DNA, 18 bp, Homo sapiens
taagcaagagagatgttt

SEQ ID NO: 660242 - DNA, 21 bp, Homo sapiens
taagcaagttaagtgtcctcc

SEQ ID NO: 660243 - DNA, 17 bp, Homo sapiens
taagcaggtttgttttc

SEQ ID NO: 660244 - DNA, 22 bp, Homo sapiens
taagcagttatggtgatgactt

SEQ ID NO: 660245 - DNA, 14 bp, Homo sapiens
taagcattgccatt

SEQ ID NO: 660246 - DNA, 17 bp, Homo sapiens
taagcattttgaaacaa

SEQ ID NO: 660247 - DNA, 19 bp, Homo sapiens
taagcattttgaaacaaag

SEQ ID NO: 660248 - DNA, 16 bp, Homo sapiens
taagcttccattttaa

SEQ ID NO: 660249 - DNA, 21 bp, Homo sapiens
taaggaatttgatgattttca

SEQ ID NO: 660250 - DNA, 17 bp, Homo sapiens
taaggcaggtgggcaga

SEQ ID NO: 660251 - DNA, 19 bp, Homo sapiens
taagggacttaacttgttt

SEQ ID NO: 660252 - DNA, 12 bp, Homo sapiens
taagggcagagt

SEQ ID NO: 660253 - DNA, 16 bp, Homo sapiens
taaggggaagaatgaa

SEQ ID NO: 660254 - DNA, 13 bp, Homo sapiens
taagggtgggtgc

SEQ ID NO: 660255 - DNA, 18 bp, Homo sapiens
taagggtgggtgctcaga

SEQ ID NO: 660256 - DNA, 20 bp, Homo sapiens
taagggtgggtgctcagaat

SEQ ID NO: 660257 - DNA, 21 bp, Homo sapiens
taagtatctgggattattctt

SEQ ID NO: 660258 - DNA, 16 bp, Homo sapiens
taagtgcctccaagtt

SEQ ID NO: 660259 - DNA, 20 bp, Homo sapiens
taagtgcctccaagttcaaa

SEQ ID NO: 660260 - DNA, 16 bp, Homo sapiens
taagtggctgccttct

SEQ ID NO: 660261 - DNA, 15 bp, Homo sapiens
taagtgggcccaccc

SEQ ID NO: 660262 - DNA, 18 bp, Homo sapiens
taagtgggcccacccggt

SEQ ID NO: 660263 - DNA, 14 bp, Homo sapiens
taagtgtgccaaat

SEQ ID NO: 660264 - DNA, 19 bp, Homo sapiens
taagttagttccactgaga

SEQ ID NO: 660265 - DNA, 20 bp, Homo sapiens
taagttagttccactgagac

SEQ ID NO: 660266 - DNA, 17 bp, Homo sapiens
taagttcacattagaat

SEQ ID NO: 660267 - DNA, 23 bp, Homo sapiens
taagtttcaaacttactattttg

SEQ ID NO: 660268 - DNA, 14 bp, Homo sapiens
taagtttttaatct

SEQ ID NO: 660269 - DNA, 14 bp, Homo sapiens
taataaagctttat

SEQ ID NO: 660270 - DNA, 15 bp, Homo sapiens
taataaagctttata

SEQ ID NO: 660271 - DNA, 15 bp, Homo sapiens
taataaatatttatg

SEQ ID NO: 660272 - DNA, 13 bp, Homo sapiens
taatacaaggtat

SEQ ID NO: 660273 - DNA, 21 bp, Homo sapiens
taatactggtatttttactta

SEQ ID NO: 660274 - DNA, 13 bp, Homo sapiens
taatagtttgtct

SEQ ID NO: 660275 - DNA, 19 bp, Homo sapiens
taatagtttgtctatttta

SEQ ID NO: 660276 - DNA, 14 bp, Homo sapiens
taatatatttcttc

SEQ ID NO: 660277 - DNA, 22 bp, Homo sapiens
taatatcaaaagaaaattgata

SEQ ID NO: 660278 - DNA, 20 bp, Homo sapiens
taatattcagggtaaatagg

SEQ ID NO: 660279 - DNA, 19 bp, Homo sapiens
taatattcccattttatta

SEQ ID NO: 660280 - DNA, 19 bp, Homo sapiens
taatattcttttgtttcca

SEQ ID NO: 660281 - DNA, 14 bp, Homo sapiens
taatatttaatgga

SEQ ID NO: 660282 - DNA, 12 bp, Homo sapiens
taatatttatgt

SEQ ID NO: 660283 - DNA, 14 bp, Homo sapiens
taatcaagcctctg

SEQ ID NO: 660284 - DNA, 13 bp, Homo sapiens
taatcagtaaata

SEQ ID NO: 660285 - DNA, 14 bp, Homo sapiens
taatccttttcctt

SEQ ID NO: 660286 - DNA, 23 bp, Homo sapiens
taatccttttccttatttgcctt

SEQ ID NO: 660287 - DNA, 16 bp, Homo sapiens
taatgaagaacactgt

SEQ ID NO: 660288 - DNA, 14 bp, Homo sapiens
tatcaaataaaata

SEQ ID NO: 660289 - DNA, 18 bp, Homo sapiens
tatcaaataaaatatcat

SEQ ID NO: 660290 - DNA, 12 bp, Homo sapiens
tatcacacaata

SEQ ID NO: 660291 - DNA, 20 bp, Homo sapiens
tatcacattggagtcactgc

SEQ ID NO: 660292 - DNA, 16 bp, Homo sapiens
tatcagtgtcctttcc

SEQ ID NO: 660293 - DNA, 22 bp, Homo sapiens
tatcatacaaatcagttagttt

SEQ ID NO: 660294 - DNA, 21 bp, Homo sapiens
tatcattctgggtgtgttctt

SEQ ID NO: 660295 - DNA, 20 bp, Homo sapiens
tatcattttcttttttaacc

SEQ ID NO: 660296 - DNA, 19 bp, Homo sapiens
tatccaaaaatagccctgc

SEQ ID NO: 660297 - DNA, 18 bp, Homo sapiens
tatccaaaatgtgtattt

SEQ ID NO: 660298 - DNA, 23 bp, Homo sapiens
tatccaaaatgtgtatttcttat

SEQ ID NO: 660299 - DNA, 23 bp, Homo sapiens
tatccaaggaaacattttatcat

SEQ ID NO: 660300 - DNA, 15 bp, Homo sapiens
tatccaccactttaa

SEQ ID NO: 660301 - DNA, 12 bp, Homo sapiens
tatccacccagc

SEQ ID NO: 660302 - DNA, 13 bp, Homo sapiens
tatccacccagca

SEQ ID NO: 660303 - DNA, 15 bp, Homo sapiens
tatccacccagcagg

SEQ ID NO: 660304 - DNA, 14 bp, Homo sapiens
tatccagaaaactg

SEQ ID NO: 660305 - DNA, 17 bp, Homo sapiens
tatccagaaaactgtga

SEQ ID NO: 660306 - DNA, 17 bp, Homo sapiens
tatccccatctccctgc

SEQ ID NO: 660307 - DNA, 22 bp, Homo sapiens
tatccctctcttccccttccct

SEQ ID NO: 660308 - DNA, 15 bp, Homo sapiens
tatcctggccctggg

SEQ ID NO: 660309 - DNA, 16 bp, Homo sapiens
tatcctggccctgggg

SEQ ID NO: 660310 - DNA, 20 bp, Homo sapiens
tatccttataggcctgtccc

SEQ ID NO: 660311 - DNA, 22 bp, Homo sapiens
tatccttataggcctgtccctt

SEQ ID NO: 660312 - DNA, 13 bp, Homo sapiens
tatctataaaata

SEQ ID NO: 660313 - DNA, 16 bp, Homo sapiens
tatctcgaatttgaag

SEQ ID NO: 660314 - DNA, 17 bp, Homo sapiens
tatctcgaatttgaaga

SEQ ID NO: 660315 - DNA, 19 bp, Homo sapiens
tatctcgaatttgaagaga

SEQ ID NO: 660316 - DNA, 16 bp, Homo sapiens
tatctcttttatattt

SEQ ID NO: 660317 - DNA, 16 bp, Homo sapiens
tatctgggattattct

SEQ ID NO: 660318 - DNA, 13 bp, Homo sapiens
tatcttaagcagg

SEQ ID NO: 660319 - DNA, 18 bp, Homo sapiens
tatcttcagctctttttg

SEQ ID NO: 660320 - DNA, 17 bp, Homo sapiens
tatctttttaaaaactc

SEQ ID NO: 660321 - DNA, 19 bp, Homo sapiens
tatctttttaaaaactctt

SEQ ID NO: 660322 - DNA, 20 bp, Homo sapiens
tatgaagccaactgacaaag

SEQ ID NO: 660323 - DNA, 18 bp, Homo sapiens
tatgaattcaagaaagga

SEQ ID NO: 660324 - DNA, 14 bp, Homo sapiens
tatgacaaattcaa

SEQ ID NO: 660325 - DNA, 16 bp, Homo sapiens
tatgacaaattcaaga

SEQ ID NO: 660326 - DNA, 12 bp, Homo sapiens
tatgactaaaga

SEQ ID NO: 660327 - DNA, 17 bp, Homo sapiens
tatgactaaagagagaa

SEQ ID NO: 660328 - DNA, 18 bp, Homo sapiens
tatgactaaagagagaat

SEQ ID NO: 660329 - DNA, 19 bp, Homo sapiens
tatgactaaagagagaatg

SEQ ID NO: 660330 - DNA, 16 bp, Homo sapiens
tatgagaatatacctt

SEQ ID NO: 660331 - DNA, 14 bp, Homo sapiens
tatgagattggttt

SEQ ID NO: 660332 - DNA, 19 bp, Homo sapiens
tatgagccagacaaatgga

SEQ ID NO: 660333 - DNA, 13 bp, Homo sapiens
tatgaggaaaggt

SEQ ID NO: 660334 - DNA, 14 bp, Homo sapiens
tatgagtagccagg

SEQ ID NO: 660335 - DNA, 13 bp, Homo sapiens
tatgatatttctt

SEQ ID NO: 660336 - DNA, 14 bp, Homo sapiens
tatgatcagtgttg

SEQ ID NO: 660337 - DNA, 17 bp, Homo sapiens
tatgatcagtgttgttg

SEQ ID NO: 660338 - DNA, 17 bp, Homo sapiens
tatgatttaatttgaaa

SEQ ID NO: 660339 - DNA, 20 bp, Homo sapiens
tatgatttataaacagacaa

SEQ ID NO: 660340 - DNA, 18 bp, Homo sapiens
tatgcaaaatttagaaga

SEQ ID NO: 660341 - DNA, 23 bp, Homo sapiens
tatgcacttttagaaatgcatat

SEQ ID NO: 660342 - DNA, 16 bp, Homo sapiens
tatgcagcaaatatat

SEQ ID NO: 660343 - DNA, 14 bp, Homo sapiens
tatgccactgaccg

SEQ ID NO: 660344 - DNA, 22 bp, Homo sapiens
tatgccttaatttagaaactga

SEQ ID NO: 660345 - DNA, 16 bp, Homo sapiens
tatggataaagatgag

SEQ ID NO: 660346 - DNA, 15 bp, Homo sapiens
tatggatatatttga

SEQ ID NO: 660347 - DNA, 21 bp, Homo sapiens
tatggatatatttgaaatagt

SEQ ID NO: 660348 - DNA, 21 bp, Homo sapiens
tatggatcagaggagtaaata

SEQ ID NO: 660349 - DNA, 23 bp, Homo sapiens
tatggcttatttctatgacaaat

SEQ ID NO: 660350 - DNA, 22 bp, Homo sapiens
tatgggagaagggggagtaatg

SEQ ID NO: 660351 - DNA, 14 bp, Homo sapiens
tatggtgatgactt

SEQ ID NO: 660352 - DNA, 20 bp, Homo sapiens
tatgtaaaatgaattgaaaa

SEQ ID NO: 660353 - DNA, 20 bp, Homo sapiens
tatgtaaatggtatgtcatt

SEQ ID NO: 660354 - DNA, 21 bp, Homo sapiens
tatgtaagaattcagaagacc

SEQ ID NO: 660355 - DNA, 23 bp, Homo sapiens
tatgtaatgtgtggtggcctcag

SEQ ID NO: 660356 - DNA, 16 bp, Homo sapiens
tatgtaatttcaaaat

SEQ ID NO: 660357 - DNA, 19 bp, Homo sapiens
tatgtacttttattttttg

SEQ ID NO: 660358 - DNA, 14 bp, Homo sapiens
tatgtattcttttc

SEQ ID NO: 660359 - DNA, 13 bp, Homo sapiens
tatgtcctgtcat

SEQ ID NO: 660360 - DNA, 14 bp, Homo sapiens
tatgtgaaaaatta

SEQ ID NO: 660361 - DNA, 20 bp, Homo sapiens
tatgtgacatttctcttccc

SEQ ID NO: 660362 - DNA, 19 bp, Homo sapiens
tatgtgggatattgaatgt

SEQ ID NO: 660363 - DNA, 13 bp, Homo sapiens
tatgttaaagaga

SEQ ID NO: 660364 - DNA, 12 bp, Homo sapiens
tatgttactatt

SEQ ID NO: 660365 - DNA, 15 bp, Homo sapiens
tatgttactattttc

SEQ ID NO: 660366 - DNA, 21 bp, Homo sapiens
tatgttcctaacaaaatgaga

SEQ ID NO: 660367 - DNA, 13 bp, Homo sapiens
tatgtttgctgat

SEQ ID NO: 660368 - DNA, 19 bp, Homo sapiens
tatgtttgctgattattta

SEQ ID NO: 660369 - DNA, 12 bp, Homo sapiens
tattaaaactaa

SEQ ID NO: 660370 - DNA, 19 bp, Homo sapiens
tattaaatcagttctcaat

SEQ ID NO: 660371 - DNA, 14 bp, Homo sapiens
tattaataatattt

SEQ ID NO: 660372 - DNA, 15 bp, Homo sapiens
tattacaacatttat

SEQ ID NO: 660373 - DNA, 16 bp, Homo sapiens
tattacaagtaatgta

SEQ ID NO: 660374 - DNA, 22 bp, Homo sapiens
tattactgaataatatcaaata

SEQ ID NO: 660375 - DNA, 17 bp, Homo sapiens
tattactgacatttctt

SEQ ID NO: 660376 - DNA, 15 bp, Homo sapiens
tattagaaaggctct

SEQ ID NO: 660377 - DNA, 23 bp, Homo sapiens
tattagaaattagaaaaaaatta

SEQ ID NO: 660378 - DNA, 17 bp, Homo sapiens
tattaggaaaataaaca

SEQ ID NO: 660379 - DNA, 13 bp, Homo sapiens
tattaggagtaat

SEQ ID NO: 660380 - DNA, 15 bp, Homo sapiens
tattaggagtaattc

SEQ ID NO: 660381 - DNA, 19 bp, Homo sapiens
tattatacatgtgatacat

SEQ ID NO: 660382 - DNA, 20 bp, Homo sapiens
tattatagacaaaagaataa

SEQ ID NO: 660383 - DNA, 20 bp, Homo sapiens
tattatcaaagggataaaga

SEQ ID NO: 660384 - DNA, 22 bp, Homo sapiens
tattatcaaagggataaagaaa

SEQ ID NO: 660385 - DNA, 12 bp, Homo sapiens
tattatccagag

SEQ ID NO: 660386 - DNA, 12 bp, Homo sapiens
tattatgcaaaa

SEQ ID NO: 660387 - DNA, 17 bp, Homo sapiens
tattatgcaaaatttag

SEQ ID NO: 660388 - DNA, 19 bp, Homo sapiens
tattatgcattatatcaaa

SEQ ID NO: 660389 - DNA, 18 bp, Homo sapiens
tattattagaaattagaa

SEQ ID NO: 660390 - DNA, 19 bp, Homo sapiens
tattattagaaattagaaa

SEQ ID NO: 660391 - DNA, 13 bp, Homo sapiens
tattcaaatttga

SEQ ID NO: 660392 - DNA, 14 bp, Homo sapiens
tattcaaatttgat

SEQ ID NO: 660393 - DNA, 17 bp, Homo sapiens
tattcaagaatgaaaaa

SEQ ID NO: 660394 - DNA, 15 bp, Homo sapiens
tattcagaactttag

SEQ ID NO: 660395 - DNA, 22 bp, Homo sapiens
tattccagacttgggaggatgt

SEQ ID NO: 660396 - DNA, 22 bp, Homo sapiens
tattccagatctttcagaaata

SEQ ID NO: 660397 - DNA, 20 bp, Homo sapiens
tattcctctcaccccactcc

SEQ ID NO: 660398 - DNA, 17 bp, Homo sapiens
tattccttttaaagaag

SEQ ID NO: 660399 - DNA, 20 bp, Homo sapiens
tattccttttaaagaagctt

SEQ ID NO: 660400 - DNA, 23 bp, Homo sapiens
tattccttttaaagaagctttat

SEQ ID NO: 660401 - DNA, 13 bp, Homo sapiens
tattctagagctt

SEQ ID NO: 660402 - DNA, 21 bp, Homo sapiens
tattctgaccgttaaaaaatt

SEQ ID NO: 660403 - DNA, 16 bp, Homo sapiens
tattcttttgtttcca

SEQ ID NO: 660404 - DNA, 14 bp, Homo sapiens
tattgaatgttaaa

SEQ ID NO: 660405 - DNA, 15 bp, Homo sapiens
tattgagatttctta

SEQ ID NO: 660406 - DNA, 19 bp, Homo sapiens
tattgagatttcttaaata

SEQ ID NO: 660407 - DNA, 14 bp, Homo sapiens
tattgatagtactc

SEQ ID NO: 660408 - DNA, 20 bp, Homo sapiens
tccagcatttagctggccac

SEQ ID NO: 660409 - DNA, 20 bp, Homo sapiens
tccagccagggcaagagagc

SEQ ID NO: 660410 - DNA, 15 bp, Homo sapiens
tccagctcagccctg

SEQ ID NO: 660411 - DNA, 21 bp, Homo sapiens
tccagctcagccctggcctgg

SEQ ID NO: 660412 - DNA, 13 bp, Homo sapiens
tccagctccccag

SEQ ID NO: 660413 - DNA, 14 bp, Homo sapiens
tccagctgaggcag

SEQ ID NO: 660414 - DNA, 18 bp, Homo sapiens
tccaggaagcccagggca

SEQ ID NO: 660415 - DNA, 17 bp, Homo sapiens
tccaggagagcctgggg

SEQ ID NO: 660416 - DNA, 13 bp, Homo sapiens
tccaggcctgcct

SEQ ID NO: 660417 - DNA, 15 bp, Homo sapiens
tccaggcctgcctcc

SEQ ID NO: 660418 - DNA, 18 bp, Homo sapiens
tccaggcctgcctcccac

SEQ ID NO: 660419 - DNA, 19 bp, Homo sapiens
tccaggcctgcctcccact

SEQ ID NO: 660420 - DNA, 18 bp, Homo sapiens
tccaggctttcccacttc

SEQ ID NO: 660421 - DNA, 14 bp, Homo sapiens
tccagggtctgagt

SEQ ID NO: 660422 - DNA, 17 bp, Homo sapiens
tccagtggatcataaga

SEQ ID NO: 660423 - DNA, 16 bp, Homo sapiens
tccataaagtacaaat

SEQ ID NO: 660424 - DNA, 20 bp, Homo sapiens
tccataaagtacaaatgaag

SEQ ID NO: 660425 - DNA, 24 bp, Homo sapiens
tccataaagtacaaatgaagaaag

SEQ ID NO: 660426 - DNA, 14 bp, Homo sapiens
tccataccttttct

SEQ ID NO: 660427 - DNA, 22 bp, Homo sapiens
tccatcaactcccaacttcttc

SEQ ID NO: 660428 - DNA, 14 bp, Homo sapiens
tccatcctgcagat

SEQ ID NO: 660429 - DNA, 14 bp, Homo sapiens
tccatctctcatcc

SEQ ID NO: 660430 - DNA, 18 bp, Homo sapiens
tccatgatttagcaagca

SEQ ID NO: 660431 - DNA, 19 bp, Homo sapiens
tccatgatttagcaagcaa

SEQ ID NO: 660432 - DNA, 20 bp, Homo sapiens
tccatgatttagcaagcaac

SEQ ID NO: 660433 - DNA, 14 bp, Homo sapiens
tccatgcaactgga

SEQ ID NO: 660434 - DNA, 21 bp, Homo sapiens
tccatgcaactggagttcctt

SEQ ID NO: 660435 - DNA, 16 bp, Homo sapiens
tccatgctccttgaga

SEQ ID NO: 660436 - DNA, 17 bp, Homo sapiens
tccatgctccttgagag

SEQ ID NO: 660437 - DNA, 16 bp, Homo sapiens
tccatgtgcctttctt

SEQ ID NO: 660438 - DNA, 23 bp, Homo sapiens
tccatgttagtaatggcagagca

SEQ ID NO: 660439 - DNA, 15 bp, Homo sapiens
tcccaaccaggcacc

SEQ ID NO: 660440 - DNA, 20 bp, Homo sapiens
tcccaaggagggggcctcat

SEQ ID NO: 660441 - DNA, 14 bp, Homo sapiens
tcccacactgtggc

SEQ ID NO: 660442 - DNA, 19 bp, Homo sapiens
tcccacactgtggccaggc

SEQ ID NO: 660443 - DNA, 15 bp, Homo sapiens
tcccaccagcttcac

SEQ ID NO: 660444 - DNA, 15 bp, Homo sapiens
tcccaccttcccacc

SEQ ID NO: 660445 - DNA, 15 bp, Homo sapiens
tcccagagcacctca

SEQ ID NO: 660446 - DNA, 16 bp, Homo sapiens
tcccagctacttggga

SEQ ID NO: 660447 - DNA, 18 bp, Homo sapiens
tcccagctacttgggagg

SEQ ID NO: 660448 - DNA, 19 bp, Homo sapiens
tcccagctacttgggaggc

SEQ ID NO: 660449 - DNA, 15 bp, Homo sapiens
tcccaggcagggaga

SEQ ID NO: 660450 - DNA, 21 bp, Homo sapiens
tcccaggggtctccctggctc

SEQ ID NO: 660451 - DNA, 13 bp, Homo sapiens
tcccatgtatgga

SEQ ID NO: 660452 - DNA, 14 bp, Homo sapiens
tcccatgtatttgt

SEQ ID NO: 660453 - DNA, 16 bp, Homo sapiens
tcccatgtatttgtta

SEQ ID NO: 660454 - DNA, 18 bp, Homo sapiens
tccccacagcgtccctgg

SEQ ID NO: 660455 - DNA, 14 bp, Homo sapiens
tccccacctccagg

SEQ ID NO: 660456 - DNA, 15 bp, Homo sapiens
tccccactgctgagc

SEQ ID NO: 660457 - DNA, 16 bp, Homo sapiens
tccccagcccacctgc

SEQ ID NO: 660458 - DNA, 21 bp, Homo sapiens
tccccagcccacctgctccca

SEQ ID NO: 660459 - DNA, 16 bp, Homo sapiens
tccccatctccctgcc

SEQ ID NO: 660460 - DNA, 19 bp, Homo sapiens
tccccatctccctgcctgg

SEQ ID NO: 660461 - DNA, 17 bp, Homo sapiens
tccccatgggcacagtg

SEQ ID NO: 660462 - DNA, 13 bp, Homo sapiens
tcccccaccactc

SEQ ID NO: 660463 - DNA, 16 bp, Homo sapiens
tcccccaccactcagg

SEQ ID NO: 660464 - DNA, 19 bp, Homo sapiens
tcccccaccactcaggcca

SEQ ID NO: 660465 - DNA, 12 bp, Homo sapiens
tcccccatcctt

SEQ ID NO: 660466 - DNA, 13 bp, Homo sapiens
tcccccatccttc

SEQ ID NO: 660467 - DNA, 22 bp, Homo sapiens
tccccccacaagtgccctccag

SEQ ID NO: 660468 - DNA, 19 bp, Homo sapiens
tcccccgtttctccttttc

SEQ ID NO: 660469 - DNA, 21 bp, Homo sapiens
tccccctgtttcagaggctca

SEQ ID NO: 660470 - DNA, 21 bp, Homo sapiens
tcccccttcccatttcttccc

SEQ ID NO: 660471 - DNA, 15 bp, Homo sapiens
tccccgagtgactct

SEQ ID NO: 660472 - DNA, 17 bp, Homo sapiens
tccccgagtgactctgg

SEQ ID NO: 660473 - DNA, 15 bp, Homo sapiens
tccccgctgctgtgc

SEQ ID NO: 660474 - DNA, 16 bp, Homo sapiens
tccccgctgctgtgca

SEQ ID NO: 660475 - DNA, 17 bp, Homo sapiens
tccccgctgctgtgcaa

SEQ ID NO: 660476 - DNA, 22 bp, Homo sapiens
tccccggcatgagactcagtgc

SEQ ID NO: 660477 - DNA, 17 bp, Homo sapiens
tcccctagagccctctc

SEQ ID NO: 660478 - DNA, 18 bp, Homo sapiens
tcccctagagccctctcc

SEQ ID NO: 660479 - DNA, 23 bp, Homo sapiens
tcccctagagccctctcctccct

SEQ ID NO: 660480 - DNA, 16 bp, Homo sapiens
tcccctcctgcacaca

SEQ ID NO: 660481 - DNA, 14 bp, Homo sapiens
tcccctgcccatgc

SEQ ID NO: 660482 - DNA, 16 bp, Homo sapiens
tccccttctgaatcag

SEQ ID NO: 660483 - DNA, 20 bp, Homo sapiens
tcccggtgtatcctggccct

SEQ ID NO: 660484 - DNA, 20 bp, Homo sapiens
tccctataataaaggctgag

SEQ ID NO: 660485 - DNA, 11 bp, Homo sapiens
tccctccaact

SEQ ID NO: 660486 - DNA, 19 bp, Homo sapiens
tccctccggcttgacctgt

SEQ ID NO: 660487 - DNA, 17 bp, Homo sapiens
tccctctcatctcaggt

SEQ ID NO: 660488 - DNA, 14 bp, Homo sapiens
tccctctcctaact

SEQ ID NO: 660489 - DNA, 19 bp, Homo sapiens
tccctctccttgcccccag

SEQ ID NO: 660490 - DNA, 24 bp, Homo sapiens
tccctctccttgcccccagtgcct

SEQ ID NO: 660491 - DNA, 16 bp, Homo sapiens
tccctctcttcccctt

SEQ ID NO: 660492 - DNA, 15 bp, Homo sapiens
tccctggcagacaca

SEQ ID NO: 660493 - DNA, 17 bp, Homo sapiens
tccctggctccctcctc

SEQ ID NO: 660494 - DNA, 18 bp, Homo sapiens
tccctgggccagggtctg

SEQ ID NO: 660495 - DNA, 14 bp, Homo sapiens
tccctgggtctggg

SEQ ID NO: 660496 - DNA, 16 bp, Homo sapiens
tccctggtcggagagg

SEQ ID NO: 660497 - DNA, 17 bp, Homo sapiens
tccctggtcggagaggg

SEQ ID NO: 660498 - DNA, 14 bp, Homo sapiens
tcccttacaaggtg

SEQ ID NO: 660499 - DNA, 19 bp, Homo sapiens
tcccttgcctctgccctgg

SEQ ID NO: 660500 - DNA, 22 bp, Homo sapiens
tcccttgcctctgccctggatt

SEQ ID NO: 660501 - DNA, 20 bp, Homo sapiens
tcccttgcttgcctgcaggg

SEQ ID NO: 660502 - DNA, 14 bp, Homo sapiens
tcccttttccatga

SEQ ID NO: 660503 - DNA, 19 bp, Homo sapiens
tccgcagtgtggccaggct

SEQ ID NO: 660504 - DNA, 14 bp, Homo sapiens
tccgctgccagcct

SEQ ID NO: 660505 - DNA, 16 bp, Homo sapiens
tccgctgccagccttg

SEQ ID NO: 660506 - DNA, 19 bp, Homo sapiens
tccggaaactagtgtacat

SEQ ID NO: 660507 - DNA, 18 bp, Homo sapiens
tccggcctctgcctttgc

SEQ ID NO: 660508 - DNA, 19 bp, Homo sapiens
tccggcctctgcctttgca

SEQ ID NO: 660509 - DNA, 21 bp, Homo sapiens
tccggcttgacctgtttctct

SEQ ID NO: 660510 - DNA, 18 bp, Homo sapiens
tccggtcgtgtctctggt

SEQ ID NO: 660511 - DNA, 18 bp, Homo sapiens
tccggtttctttttgctc

SEQ ID NO: 660512 - DNA, 17 bp, Homo sapiens
tccgtagctctgctgct

SEQ ID NO: 660513 - DNA, 18 bp, Homo sapiens
tccgtagctctgctgctg

SEQ ID NO: 660514 - DNA, 20 bp, Homo sapiens
tccgtagctctgctgctgat

SEQ ID NO: 660515 - DNA, 16 bp, Homo sapiens
tcctaaccactaacat

SEQ ID NO: 660516 - DNA, 14 bp, Homo sapiens
tcctaacttttcaa

SEQ ID NO: 660517 - DNA, 19 bp, Homo sapiens
tcctacacttgagagaaaa

SEQ ID NO: 660518 - DNA, 13 bp, Homo sapiens
tcctacagtacaa

SEQ ID NO: 660519 - DNA, 21 bp, Homo sapiens
tcctaggtcatgcctcctccc

SEQ ID NO: 660520 - DNA, 16 bp, Homo sapiens
tcctatagtcgtgggt

SEQ ID NO: 660521 - DNA, 19 bp, Homo sapiens
tcctcacacaccctgaggt

SEQ ID NO: 660522 - DNA, 12 bp, Homo sapiens
tcctcacccacc

SEQ ID NO: 660523 - DNA, 19 bp, Homo sapiens
tcctcagctgcctcctgcg

SEQ ID NO: 660524 - DNA, 21 bp, Homo sapiens
tcctcagctgcctcctgcgcc

SEQ ID NO: 660525 - DNA, 19 bp, Homo sapiens
tcctcatggcagcctactc

SEQ ID NO: 660526 - DNA, 17 bp, Homo sapiens
tcctccaggcctgcctc

SEQ ID NO: 660527 - DNA, 17 bp, Homo sapiens
tcctccagggtgatttt

SEQ ID NO: 660528 - DNA, 22 bp, Homo sapiens
tgaagcatagataatattgttt

SEQ ID NO: 660529 - DNA, 22 bp, Homo sapiens
tgaagccaactgacaaagatgc

SEQ ID NO: 660530 - DNA, 18 bp, Homo sapiens
tgaagccaccctgggcta

SEQ ID NO: 660531 - DNA, 15 bp, Homo sapiens
tgaagccttagccag

SEQ ID NO: 660532 - DNA, 13 bp, Homo sapiens
tgaagctgacagc

SEQ ID NO: 660533 - DNA, 15 bp, Homo sapiens
tgaagctgttgtgtg

SEQ ID NO: 660534 - DNA, 21 bp, Homo sapiens
tgaaggcttaattgactgaaa

SEQ ID NO: 660535 - DNA, 22 bp, Homo sapiens
tgaaggcttaattgactgaaat

SEQ ID NO: 660536 - DNA, 17 bp, Homo sapiens
tgaagggccagcatata

SEQ ID NO: 660537 - DNA, 21 bp, Homo sapiens
tgaagggggtaccttaagaga

SEQ ID NO: 660538 - DNA, 13 bp, Homo sapiens
tgaagtatggtgt

SEQ ID NO: 660539 - DNA, 16 bp, Homo sapiens
tgaagtatggtgtgtt

SEQ ID NO: 660540 - DNA, 18 bp, Homo sapiens
tgaagtatggtgtgttca

SEQ ID NO: 660541 - DNA, 16 bp, Homo sapiens
tgaagtgcgtgaatgt

SEQ ID NO: 660542 - DNA, 17 bp, Homo sapiens
tgaagtgcgtgaatgta

SEQ ID NO: 660543 - DNA, 18 bp, Homo sapiens
tgaagtgtataatataaa

SEQ ID NO: 660544 - DNA, 18 bp, Homo sapiens
tgaagtttaattgtctca

SEQ ID NO: 660545 - DNA, 14 bp, Homo sapiens
tgaagtttacagag

SEQ ID NO: 660546 - DNA, 16 bp, Homo sapiens
tgaagttttactgtct

SEQ ID NO: 660547 - DNA, 17 bp, Homo sapiens
tgaataggttatatgca

SEQ ID NO: 660548 - DNA, 16 bp, Homo sapiens
tgaatatgccttaatt

SEQ ID NO: 660549 - DNA, 20 bp, Homo sapiens
tgaatatgccttaatttaga

SEQ ID NO: 660550 - DNA, 16 bp, Homo sapiens
tgaatattgccattat

SEQ ID NO: 660551 - DNA, 13 bp, Homo sapiens
tgaatattttcaa

SEQ ID NO: 660552 - DNA, 13 bp, Homo sapiens
tgaatgcctcctg

SEQ ID NO: 660553 - DNA, 17 bp, Homo sapiens
tgaatgcctcctgtggg

SEQ ID NO: 660554 - DNA, 15 bp, Homo sapiens
tgaatgtagcgtgta

SEQ ID NO: 660555 - DNA, 20 bp, Homo sapiens
tgaatgtatgtaatgtgtgg

SEQ ID NO: 660556 - DNA, 20 bp, Homo sapiens
tgaatgtggctgaagttgaa

SEQ ID NO: 660557 - DNA, 21 bp, Homo sapiens
tgaatgtgggcactggcccag

SEQ ID NO: 660558 - DNA, 20 bp, Homo sapiens
tgaattggaaagacttctca

SEQ ID NO: 660559 - DNA, 15 bp, Homo sapiens
tgaattggaactgca

SEQ ID NO: 660560 - DNA, 14 bp, Homo sapiens
tgaatttttattgt

SEQ ID NO: 660561 - DNA, 21 bp, Homo sapiens
tgacaaaatggggcagaagag

SEQ ID NO: 660562 - DNA, 16 bp, Homo sapiens
tgacaatattccagat

SEQ ID NO: 660563 - DNA, 19 bp, Homo sapiens
tgacaattgtgaacatgat

SEQ ID NO: 660564 - DNA, 18 bp, Homo sapiens
tgacactaaccagagtca

SEQ ID NO: 660565 - DNA, 15 bp, Homo sapiens
tgacactagaaaact

SEQ ID NO: 660566 - DNA, 16 bp, Homo sapiens
tgacactgcagcagaa

SEQ ID NO: 660567 - DNA, 16 bp, Homo sapiens
tgacagactatttgct

SEQ ID NO: 660568 - DNA, 11 bp, Homo sapiens
tgacagggcca

SEQ ID NO: 660569 - DNA, 12 bp, Homo sapiens
tgacagggccag

SEQ ID NO: 660570 - DNA, 13 bp, Homo sapiens
tgacagtcatcat

SEQ ID NO: 660571 - DNA, 13 bp, Homo sapiens
tgacagttatttt

SEQ ID NO: 660572 - DNA, 14 bp, Homo sapiens
tgacagtttccaaa

SEQ ID NO: 660573 - DNA, 16 bp, Homo sapiens
tgacagtttccaaatt

SEQ ID NO: 660574 - DNA, 20 bp, Homo sapiens
tgacatacctaccagtatta

SEQ ID NO: 660575 - DNA, 18 bp, Homo sapiens
tgacataggtcataaagc

SEQ ID NO: 660576 - DNA, 14 bp, Homo sapiens
tgaccagcacactg

SEQ ID NO: 660577 - DNA, 18 bp, Homo sapiens
tgaccatcatttcccagg

SEQ ID NO: 660578 - DNA, 18 bp, Homo sapiens
tgacccccatctgagctg

SEQ ID NO: 660579 - DNA, 20 bp, Homo sapiens
tgacccccatctgagctggg

SEQ ID NO: 660580 - DNA, 16 bp, Homo sapiens
tgaccgggagacagag

SEQ ID NO: 660581 - DNA, 15 bp, Homo sapiens
tgaccggtgctttta

SEQ ID NO: 660582 - DNA, 14 bp, Homo sapiens
tgaccgttaaaaaa

SEQ ID NO: 660583 - DNA, 16 bp, Homo sapiens
tgacctaaattagata

SEQ ID NO: 660584 - DNA, 20 bp, Homo sapiens
tgacctcaggtgatccgcct

SEQ ID NO: 660585 - DNA, 21 bp, Homo sapiens
tgacctctctaggtgtgtcca

SEQ ID NO: 660586 - DNA, 21 bp, Homo sapiens
tgacctctgacaactgtgaag

SEQ ID NO: 660587 - DNA, 21 bp, Homo sapiens
tgacgcccgagagcctcgctt

SEQ ID NO: 660588 - DNA, 22 bp, Homo sapiens
tgacgcccgagagcctcgcttt

SEQ ID NO: 660589 - DNA, 14 bp, Homo sapiens
tgacggccctcatc

SEQ ID NO: 660590 - DNA, 20 bp, Homo sapiens
tgacggccctcatctatgag

SEQ ID NO: 660591 - DNA, 21 bp, Homo sapiens
tgacggctgggtgtttcagtt

SEQ ID NO: 660592 - DNA, 17 bp, Homo sapiens
tgactaaagagagaatg

SEQ ID NO: 660593 - DNA, 20 bp, Homo sapiens
tgactaactcaaatacacat

SEQ ID NO: 660594 - DNA, 18 bp, Homo sapiens
tgactcaattatttgcat

SEQ ID NO: 660595 - DNA, 20 bp, Homo sapiens
tgactcaattatttgcatat

SEQ ID NO: 660596 - DNA, 13 bp, Homo sapiens
tgactccctggga

SEQ ID NO: 660597 - DNA, 20 bp, Homo sapiens
tgactgaaattactttaaca

SEQ ID NO: 660598 - DNA, 22 bp, Homo sapiens
tgactgaaattactttaacatt

SEQ ID NO: 660599 - DNA, 15 bp, Homo sapiens
tgactggtgctgcag

SEQ ID NO: 660600 - DNA, 18 bp, Homo sapiens
tgacttattttgtcttat

SEQ ID NO: 660601 - DNA, 23 bp, Homo sapiens
tgacttattttgtcttattctta

SEQ ID NO: 660602 - DNA, 12 bp, Homo sapiens
tgacttcctctg

SEQ ID NO: 660603 - DNA, 20 bp, Homo sapiens
tgacttgtacaaacagtatt

SEQ ID NO: 660604 - DNA, 18 bp, Homo sapiens
tgacttttataaagcatg

SEQ ID NO: 660605 - DNA, 13 bp, Homo sapiens
tgagaaaatatat

SEQ ID NO: 660606 - DNA, 20 bp, Homo sapiens
tgagaagctgctccaggcct

SEQ ID NO: 660607 - DNA, 20 bp, Homo sapiens
tgagaaggtttattgttaat

SEQ ID NO: 660608 - DNA, 13 bp, Homo sapiens
tgagaatatacct

SEQ ID NO: 660609 - DNA, 16 bp, Homo sapiens
tgagaatataccttat

SEQ ID NO: 660610 - DNA, 18 bp, Homo sapiens
tgagaatataccttattt

SEQ ID NO: 660611 - DNA, 19 bp, Homo sapiens
tgagaatataccttattta

SEQ ID NO: 660612 - DNA, 22 bp, Homo sapiens
tgagaatataccttatttattt

SEQ ID NO: 660613 - DNA, 12 bp, Homo sapiens
tgagacaatgtt

SEQ ID NO: 660614 - DNA, 16 bp, Homo sapiens
tgagacaatgttttct

SEQ ID NO: 660615 - DNA, 19 bp, Homo sapiens
tgagacaatgttttcttca

SEQ ID NO: 660616 - DNA, 15 bp, Homo sapiens
tgagacactgtctct

SEQ ID NO: 660617 - DNA, 22 bp, Homo sapiens
tgagactctagggtccagtgga

SEQ ID NO: 660618 - DNA, 21 bp, Homo sapiens
tgagactttccgactgctttt

SEQ ID NO: 660619 - DNA, 14 bp, Homo sapiens
tgagagaattggct

SEQ ID NO: 660620 - DNA, 12 bp, Homo sapiens
tgagaggggaag

SEQ ID NO: 660621 - DNA, 22 bp, Homo sapiens
tgagattctggtccctggaaat

SEQ ID NO: 660622 - DNA, 17 bp, Homo sapiens
tgagatttcctcctggc

SEQ ID NO: 660623 - DNA, 17 bp, Homo sapiens
tgagatttcttaaataa

SEQ ID NO: 660624 - DNA, 14 bp, Homo sapiens
tgagcacttttcaa

SEQ ID NO: 660625 - DNA, 17 bp, Homo sapiens
tgagcagtcgcctgcct

SEQ ID NO: 660626 - DNA, 20 bp, Homo sapiens
tgagcagtcgcctgcctgca

SEQ ID NO: 660627 - DNA, 22 bp, Homo sapiens
tgagcatacctgtctcagctgt

SEQ ID NO: 660628 - DNA, 16 bp, Homo sapiens
tgagcccagagaacag

SEQ ID NO: 660629 - DNA, 12 bp, Homo sapiens
tgagccctggct

SEQ ID NO: 660630 - DNA, 12 bp, Homo sapiens
tgagctcttccc

SEQ ID NO: 660631 - DNA, 13 bp, Homo sapiens
tgagctcttccct

SEQ ID NO: 660632 - DNA, 15 bp, Homo sapiens
tgagctcttccctta

SEQ ID NO: 660633 - DNA, 16 bp, Homo sapiens
tgagctgcctctgaga

SEQ ID NO: 660634 - DNA, 13 bp, Homo sapiens
tgagctggccctt

SEQ ID NO: 660635 - DNA, 15 bp, Homo sapiens
tgaggaaaattctta

SEQ ID NO: 660636 - DNA, 22 bp, Homo sapiens
tgaggacaagagaaaaaagcca

SEQ ID NO: 660637 - DNA, 23 bp, Homo sapiens
tgaggagagtctgaatattttca

SEQ ID NO: 660638 - DNA, 20 bp, Homo sapiens
tgaggcaaattaactgtatg

SEQ ID NO: 660639 - DNA, 14 bp, Homo sapiens
tgaggcctgggctg

SEQ ID NO: 660640 - DNA, 17 bp, Homo sapiens
tgagggaagagtagctg

SEQ ID NO: 660641 - DNA, 12 bp, Homo sapiens
tgagggtcttct

SEQ ID NO: 660642 - DNA, 14 bp, Homo sapiens
tgaggtcagggagt

SEQ ID NO: 660643 - DNA, 13 bp, Homo sapiens
tgaggtccttatg

SEQ ID NO: 660644 - DNA, 21 bp, Homo sapiens
tgaggtccttatgtcctgtca

SEQ ID NO: 660645 - DNA, 13 bp, Homo sapiens
tgagtaaacataa

SEQ ID NO: 660646 - DNA, 16 bp, Homo sapiens
tgagtaacttagaaaa

SEQ ID NO: 660647 - DNA, 23 bp, Homo sapiens
tgagtaagtgaaggtctcctaaa

SEQ ID NO: 660648 - DNA, 20 bp, Homo sapiens
tgctcagctgtcaaggctca

SEQ ID NO: 660649 - DNA, 20 bp, Homo sapiens
tgctcagtgtttttgtgaat

SEQ ID NO: 660650 - DNA, 13 bp, Homo sapiens
tgctccaggcctg

SEQ ID NO: 660651 - DNA, 18 bp, Homo sapiens
tgctccaggcctgcagca

SEQ ID NO: 660652 - DNA, 17 bp, Homo sapiens
tgctccataccttttct

SEQ ID NO: 660653 - DNA, 20 bp, Homo sapiens
tgctccataccttttctctt

SEQ ID NO: 660654 - DNA, 15 bp, Homo sapiens
tgctccatatttgat

SEQ ID NO: 660655 - DNA, 23 bp, Homo sapiens
tgctcccaggccccaggcctgtg

SEQ ID NO: 660656 - DNA, 13 bp, Homo sapiens
tgctccccacagc

SEQ ID NO: 660657 - DNA, 20 bp, Homo sapiens
tgctccccacagcgtccctg

SEQ ID NO: 660658 - DNA, 16 bp, Homo sapiens
tgctccgtagctctgc

SEQ ID NO: 660659 - DNA, 17 bp, Homo sapiens
tgctccgtagctctgct

SEQ ID NO: 660660 - DNA, 19 bp, Homo sapiens
tgctccgtagctctgctgc

SEQ ID NO: 660661 - DNA, 23 bp, Homo sapiens
tgctccttgagaggagaaatgca

SEQ ID NO: 660662 - DNA, 15 bp, Homo sapiens
tgctctaggaagaca

SEQ ID NO: 660663 - DNA, 16 bp, Homo sapiens
tgctctcctcatctcc

SEQ ID NO: 660664 - DNA, 20 bp, Homo sapiens
tgctctgcagcattgaagta

SEQ ID NO: 660665 - DNA, 17 bp, Homo sapiens
tgctctgttacccaggc

SEQ ID NO: 660666 - DNA, 15 bp, Homo sapiens
tgctcttgtttttat

SEQ ID NO: 660667 - DNA, 19 bp, Homo sapiens
tgctctttcacctgggtgt

SEQ ID NO: 660668 - DNA, 15 bp, Homo sapiens
tgctcttttcctggt

SEQ ID NO: 660669 - DNA, 20 bp, Homo sapiens
tgctcttttcctggtgctct

SEQ ID NO: 660670 - DNA, 14 bp, Homo sapiens
tgctcttttttctc

SEQ ID NO: 660671 - DNA, 17 bp, Homo sapiens
tgctgaactcagcacat

SEQ ID NO: 660672 - DNA, 20 bp, Homo sapiens
tgctgaactcagcacattcg

SEQ ID NO: 660673 - DNA, 12 bp, Homo sapiens
tgctgagctggc

SEQ ID NO: 660674 - DNA, 22 bp, Homo sapiens
tgctgagggtgtttcttcctgc

SEQ ID NO: 660675 - DNA, 16 bp, Homo sapiens
tgctgagtaaacataa

SEQ ID NO: 660676 - DNA, 19 bp, Homo sapiens
tgctgatcatcgccagagg

SEQ ID NO: 660677 - DNA, 15 bp, Homo sapiens
tgctgatcgtagaaa

SEQ ID NO: 660678 - DNA, 15 bp, Homo sapiens
tgctgatcttttaaa

SEQ ID NO: 660679 - DNA, 19 bp, Homo sapiens
tgctgatcttttaaaatca

SEQ ID NO: 660680 - DNA, 12 bp, Homo sapiens
tgctgcagagat

SEQ ID NO: 660681 - DNA, 18 bp, Homo sapiens
tgctgcagtcatctactt

SEQ ID NO: 660682 - DNA, 17 bp, Homo sapiens
tgctgctgcctctttcc

SEQ ID NO: 660683 - DNA, 12 bp, Homo sapiens
tgctgctggtgc

SEQ ID NO: 660684 - DNA, 22 bp, Homo sapiens
tgctggagatcagcatgcctgt

SEQ ID NO: 660685 - DNA, 15 bp, Homo sapiens
tgctgggggaatgag

SEQ ID NO: 660686 - DNA, 21 bp, Homo sapiens
tgctgggggaatgagcccaga

SEQ ID NO: 660687 - DNA, 17 bp, Homo sapiens
tgctgtaacttaaaata

SEQ ID NO: 660688 - DNA, 20 bp, Homo sapiens
tgctgtacacatatttgaag

SEQ ID NO: 660689 - DNA, 16 bp, Homo sapiens
tgctgtgaactttcat

SEQ ID NO: 660690 - DNA, 23 bp, Homo sapiens
tgctgtgtatatggtatatatac

SEQ ID NO: 660691 - DNA, 18 bp, Homo sapiens
tgctgtgtgtcccaggca

SEQ ID NO: 660692 - DNA, 21 bp, Homo sapiens
tgctgtgtgtcccaggcaggg

SEQ ID NO: 660693 - DNA, 15 bp, Homo sapiens
tgctgttccttactt

SEQ ID NO: 660694 - DNA, 12 bp, Homo sapiens
tgctgttgctta

SEQ ID NO: 660695 - DNA, 13 bp, Homo sapiens
tgctgtttctaag

SEQ ID NO: 660696 - DNA, 20 bp, Homo sapiens
tgcttaaaaaataatacaac

SEQ ID NO: 660697 - DNA, 21 bp, Homo sapiens
tgcttaaaccacttaaacgaa

SEQ ID NO: 660698 - DNA, 17 bp, Homo sapiens
tgcttcatcattccctc

SEQ ID NO: 660699 - DNA, 19 bp, Homo sapiens
tgcttcattattcaagaat

SEQ ID NO: 660700 - DNA, 23 bp, Homo sapiens
tgcttcattattcaagaatgaaa

SEQ ID NO: 660701 - DNA, 16 bp, Homo sapiens
tgcttcattgaaagct

SEQ ID NO: 660702 - DNA, 15 bp, Homo sapiens
tgcttctcaggctat

SEQ ID NO: 660703 - DNA, 12 bp, Homo sapiens
tgcttgaatgct

SEQ ID NO: 660704 - DNA, 14 bp, Homo sapiens
tgcttgacatacct

SEQ ID NO: 660705 - DNA, 15 bp, Homo sapiens
tgcttggtgtgaccc

SEQ ID NO: 660706 - DNA, 14 bp, Homo sapiens
tgcttgtttatgat

SEQ ID NO: 660707 - DNA, 15 bp, Homo sapiens
tgctttattaatgtt

SEQ ID NO: 660708 - DNA, 12 bp, Homo sapiens
tgctttccaagc

SEQ ID NO: 660709 - DNA, 16 bp, Homo sapiens
tgctttcttacctact

SEQ ID NO: 660710 - DNA, 15 bp, Homo sapiens
tgctttgagaccttt

SEQ ID NO: 660711 - DNA, 20 bp, Homo sapiens
tgctttgcatctttgttact

SEQ ID NO: 660712 - DNA, 16 bp, Homo sapiens
tgcttttgcttgcaat

SEQ ID NO: 660713 - DNA, 17 bp, Homo sapiens
tgctttttctgcgcttc

SEQ ID NO: 660714 - DNA, 13 bp, Homo sapiens
tgcttttttgtat

SEQ ID NO: 660715 - DNA, 14 bp, Homo sapiens
tggaaaacctcctt

SEQ ID NO: 660716 - DNA, 16 bp, Homo sapiens
tggaaaaggaagacta

SEQ ID NO: 660717 - DNA, 12 bp, Homo sapiens
tggaaagacttc

SEQ ID NO: 660718 - DNA, 19 bp, Homo sapiens
tggaaagcagagttttcat

SEQ ID NO: 660719 - DNA, 21 bp, Homo sapiens
tggaaatacagttatttcatc

SEQ ID NO: 660720 - DNA, 13 bp, Homo sapiens
tggaaattcctgt

SEQ ID NO: 660721 - DNA, 15 bp, Homo sapiens
tggaacataaagttg

SEQ ID NO: 660722 - DNA, 17 bp, Homo sapiens
tggaactcctggccttt

SEQ ID NO: 660723 - DNA, 19 bp, Homo sapiens
tggaactgcaatgaaagtc

SEQ ID NO: 660724 - DNA, 14 bp, Homo sapiens
tggaagaattctag

SEQ ID NO: 660725 - DNA, 23 bp, Homo sapiens
tggaagcatgtagactgtgccag

SEQ ID NO: 660726 - DNA, 23 bp, Homo sapiens
tggaaggcagacagcaggcagcg

SEQ ID NO: 660727 - DNA, 18 bp, Homo sapiens
tggaatgagtgtgcatgg

SEQ ID NO: 660728 - DNA, 15 bp, Homo sapiens
tggaattttttgaat

SEQ ID NO: 660729 - DNA, 19 bp, Homo sapiens
tggacacaaattttcaagt

SEQ ID NO: 660730 - DNA, 21 bp, Homo sapiens
tggacacaaattttcaagttt

SEQ ID NO: 660731 - DNA, 12 bp, Homo sapiens
tggacagctgat

SEQ ID NO: 660732 - DNA, 15 bp, Homo sapiens
tggacagctgataaa

SEQ ID NO: 660733 - DNA, 15 bp, Homo sapiens
tggactacacaatac

SEQ ID NO: 660734 - DNA, 19 bp, Homo sapiens
tggactacacaatacagta

SEQ ID NO: 660735 - DNA, 14 bp, Homo sapiens
tggactctaaagtc

SEQ ID NO: 660736 - DNA, 23 bp, Homo sapiens
tggactgctacctttcaaagctt

SEQ ID NO: 660737 - DNA, 22 bp, Homo sapiens
tggactgctattctagagcttt

SEQ ID NO: 660738 - DNA, 18 bp, Homo sapiens
tggacttctacctgccct

SEQ ID NO: 660739 - DNA, 13 bp, Homo sapiens
tggagaagattta

SEQ ID NO: 660740 - DNA, 14 bp, Homo sapiens
tggagaagatttat

SEQ ID NO: 660741 - DNA, 19 bp, Homo sapiens
tggagagaagcaagccagc

SEQ ID NO: 660742 - DNA, 18 bp, Homo sapiens
tggagatgctgagggtgt

SEQ ID NO: 660743 - DNA, 19 bp, Homo sapiens
tggagatgggtgattctct

SEQ ID NO: 660744 - DNA, 18 bp, Homo sapiens
tggaggaggcctgtccca

SEQ ID NO: 660745 - DNA, 21 bp, Homo sapiens
tggaggatcccctccaagcct

SEQ ID NO: 660746 - DNA, 13 bp, Homo sapiens
tggagggaggccc

SEQ ID NO: 660747 - DNA, 16 bp, Homo sapiens
tggagggaggccccag

SEQ ID NO: 660748 - DNA, 18 bp, Homo sapiens
tggagggaggccccaggg

SEQ ID NO: 660749 - DNA, 13 bp, Homo sapiens
tggagttccttat

SEQ ID NO: 660750 - DNA, 18 bp, Homo sapiens
tggagtttctctagaagc

SEQ ID NO: 660751 - DNA, 15 bp, Homo sapiens
tggataccattatat

SEQ ID NO: 660752 - DNA, 13 bp, Homo sapiens
tggatatatttga

SEQ ID NO: 660753 - DNA, 22 bp, Homo sapiens
tggatatatttgaaatagtata

SEQ ID NO: 660754 - DNA, 14 bp, Homo sapiens
tggatcttgaatgt

SEQ ID NO: 660755 - DNA, 15 bp, Homo sapiens
tggatcttgaatgtg

SEQ ID NO: 660756 - DNA, 19 bp, Homo sapiens
tggatcttgaatgtggtct

SEQ ID NO: 660757 - DNA, 23 bp, Homo sapiens
tggatgaaagagccagactctgt

SEQ ID NO: 660758 - DNA, 23 bp, Homo sapiens
tggatggcttgtctatactcctt

SEQ ID NO: 660759 - DNA, 16 bp, Homo sapiens
tggattcattgtctct

SEQ ID NO: 660760 - DNA, 22 bp, Homo sapiens
tggattttttattattattcaa

SEQ ID NO: 660761 - DNA, 22 bp, Homo sapiens
tggcaaaaaggagccttttgct

SEQ ID NO: 660762 - DNA, 22 bp, Homo sapiens
tggcaaacgagactttctcctg

SEQ ID NO: 660763 - DNA, 17 bp, Homo sapiens
tggcaaagtttaaatgt

SEQ ID NO: 660764 - DNA, 14 bp, Homo sapiens
tggcaattgtctat

SEQ ID NO: 660765 - DNA, 18 bp, Homo sapiens
tggcaattgtctatttat

SEQ ID NO: 660766 - DNA, 14 bp, Homo sapiens
tggcacacactgac

SEQ ID NO: 660767 - DNA, 17 bp, Homo sapiens
tggcacacactgaccac

SEQ ID NO: 660768 - DNA, 16 bp, Homo sapiens
tgtcacttgctgcttt

SEQ ID NO: 660769 - DNA, 17 bp, Homo sapiens
tgtcacttgctgctttt

SEQ ID NO: 660770 - DNA, 18 bp, Homo sapiens
tgtcacttgctgcttttt

SEQ ID NO: 660771 - DNA, 19 bp, Homo sapiens
tgtcagctactaatgatgt

SEQ ID NO: 660772 - DNA, 14 bp, Homo sapiens
tgtcagggtctcct

SEQ ID NO: 660773 - DNA, 15 bp, Homo sapiens
tgtcagggtctcctt

SEQ ID NO: 660774 - DNA, 16 bp, Homo sapiens
tgtcagtagtgctaat

SEQ ID NO: 660775 - DNA, 22 bp, Homo sapiens
tgtcatgcttcatcattccctc

SEQ ID NO: 660776 - DNA, 21 bp, Homo sapiens
tgtcattgcacataagcttcc

SEQ ID NO: 660777 - DNA, 21 bp, Homo sapiens
tgtccaaagaggctgcccctc

SEQ ID NO: 660778 - DNA, 15 bp, Homo sapiens
tgtccacctgtgggt

SEQ ID NO: 660779 - DNA, 20 bp, Homo sapiens
tgtccagcaccttgtgcctg

SEQ ID NO: 660780 - DNA, 18 bp, Homo sapiens
tgtcccactacatctggg

SEQ ID NO: 660781 - DNA, 17 bp, Homo sapiens
tgtcccaggcagggaga

SEQ ID NO: 660782 - DNA, 18 bp, Homo sapiens
tgtccccaaacaggacag

SEQ ID NO: 660783 - DNA, 22 bp, Homo sapiens
tgtccccatctaggtcctggct

SEQ ID NO: 660784 - DNA, 18 bp, Homo sapiens
tgtccccgctgctgtgca

SEQ ID NO: 660785 - DNA, 12 bp, Homo sapiens
tgtccctctcct

SEQ ID NO: 660786 - DNA, 15 bp, Homo sapiens
tgtccctctccttgc

SEQ ID NO: 660787 - DNA, 14 bp, Homo sapiens
tgtccctgggccag

SEQ ID NO: 660788 - DNA, 14 bp, Homo sapiens
tgtcccttgcctct

SEQ ID NO: 660789 - DNA, 18 bp, Homo sapiens
tgtcctaattcttctgtc

SEQ ID NO: 660790 - DNA, 14 bp, Homo sapiens
tgtcctacagtgac

SEQ ID NO: 660791 - DNA, 20 bp, Homo sapiens
tgtcctatctatcttccaaa

SEQ ID NO: 660792 - DNA, 14 bp, Homo sapiens
tgtcctcagccagt

SEQ ID NO: 660793 - DNA, 13 bp, Homo sapiens
tgtcctcttctgc

SEQ ID NO: 660794 - DNA, 14 bp, Homo sapiens
tgtcctcttctgct

SEQ ID NO: 660795 - DNA, 21 bp, Homo sapiens
tgtcctcttctgctcttttcc

SEQ ID NO: 660796 - DNA, 16 bp, Homo sapiens
tgtcctggtgagaaaa

SEQ ID NO: 660797 - DNA, 18 bp, Homo sapiens
tgtccttaacccacctct

SEQ ID NO: 660798 - DNA, 19 bp, Homo sapiens
tgtcctttaaaaaagaaaa

SEQ ID NO: 660799 - DNA, 21 bp, Homo sapiens
tgtcgttaaaaagttgtttgt

SEQ ID NO: 660800 - DNA, 23 bp, Homo sapiens
tgtcgttaaaaagttgtttgttt

SEQ ID NO: 660801 - DNA, 17 bp, Homo sapiens
tgtctactcctagaaga

SEQ ID NO: 660802 - DNA, 18 bp, Homo sapiens
tgtctactcctagaagaa

SEQ ID NO: 660803 - DNA, 16 bp, Homo sapiens
tgtctcaacgcctccc

SEQ ID NO: 660804 - DNA, 23 bp, Homo sapiens
tgtctcactaaagcatgaaatgt

SEQ ID NO: 660805 - DNA, 20 bp, Homo sapiens
tgtctcccgtgcatgctctg

SEQ ID NO: 660806 - DNA, 21 bp, Homo sapiens
tgtctcccgtgcatgctctgc

SEQ ID NO: 660807 - DNA, 23 bp, Homo sapiens
tgtctcccgtgcatgctctgcag

SEQ ID NO: 660808 - DNA, 21 bp, Homo sapiens
tgtctgacttttgttaaattc

SEQ ID NO: 660809 - DNA, 17 bp, Homo sapiens
tgtctgccttcacaaat

SEQ ID NO: 660810 - DNA, 18 bp, Homo sapiens
tgtctgctgagttggcct

SEQ ID NO: 660811 - DNA, 19 bp, Homo sapiens
tgtctgctgagttggcctg

SEQ ID NO: 660812 - DNA, 23 bp, Homo sapiens
tgtctgctgagttggcctggcca

SEQ ID NO: 660813 - DNA, 20 bp, Homo sapiens
tgtctgtggatggtcattgc

SEQ ID NO: 660814 - DNA, 16 bp, Homo sapiens
tgtctgttgtattcat

SEQ ID NO: 660815 - DNA, 18 bp, Homo sapiens
tgtcttaattttctttca

SEQ ID NO: 660816 - DNA, 18 bp, Homo sapiens
tgtcttaggctgatgcca

SEQ ID NO: 660817 - DNA, 14 bp, Homo sapiens
tgtcttatgtgaaa

SEQ ID NO: 660818 - DNA, 16 bp, Homo sapiens
tgtcttatgtgaaaaa

SEQ ID NO: 660819 - DNA, 12 bp, Homo sapiens
tgtcttattctt

SEQ ID NO: 660820 - DNA, 16 bp, Homo sapiens
tgtgaacctacctgcc

SEQ ID NO: 660821 - DNA, 18 bp, Homo sapiens
tgtgaacctacctgcctt

SEQ ID NO: 660822 - DNA, 16 bp, Homo sapiens
tgtgaatttttattgt

SEQ ID NO: 660823 - DNA, 13 bp, Homo sapiens
tgtgacagggcca

SEQ ID NO: 660824 - DNA, 14 bp, Homo sapiens
tgtgacagggccag

SEQ ID NO: 660825 - DNA, 22 bp, Homo sapiens
tgtgacagggccagtggggcct

SEQ ID NO: 660826 - DNA, 19 bp, Homo sapiens
tgtgaccacaggctggtgt

SEQ ID NO: 660827 - DNA, 21 bp, Homo sapiens
tgtgaccatcatttcccaggc

SEQ ID NO: 660828 - DNA, 13 bp, Homo sapiens
tgtgacctggggc

SEQ ID NO: 660829 - DNA, 13 bp, Homo sapiens
tgtgactcttact

SEQ ID NO: 660830 - DNA, 19 bp, Homo sapiens
tgtgagaaggtttattgtt

SEQ ID NO: 660831 - DNA, 14 bp, Homo sapiens
tgtgagctcttccc

SEQ ID NO: 660832 - DNA, 15 bp, Homo sapiens
tgtgagctcttccct

SEQ ID NO: 660833 - DNA, 17 bp, Homo sapiens
tgtgagctcttccctta

SEQ ID NO: 660834 - DNA, 22 bp, Homo sapiens
tgtgaggagagtctgaatattt

SEQ ID NO: 660835 - DNA, 16 bp, Homo sapiens
tgtgagtgccttttgc

SEQ ID NO: 660836 - DNA, 15 bp, Homo sapiens
tgtgagtgtgacagg

SEQ ID NO: 660837 - DNA, 18 bp, Homo sapiens
tgtgagtgtgacagggcc

SEQ ID NO: 660838 - DNA, 21 bp, Homo sapiens
tgtgatacattttttaagctt

SEQ ID NO: 660839 - DNA, 17 bp, Homo sapiens
tgtgatatgtctgctga

SEQ ID NO: 660840 - DNA, 21 bp, Homo sapiens
tgtgcacatacgggctttaat

SEQ ID NO: 660841 - DNA, 18 bp, Homo sapiens
tgtgcagaaaatatttaa

SEQ ID NO: 660842 - DNA, 21 bp, Homo sapiens
tgtgcataatgataaaataaa

SEQ ID NO: 660843 - DNA, 16 bp, Homo sapiens
tgtgcatggaggccct

SEQ ID NO: 660844 - DNA, 21 bp, Homo sapiens
tgtgccactaaactacattgt

SEQ ID NO: 660845 - DNA, 16 bp, Homo sapiens
tgtgccagaggccaga

SEQ ID NO: 660846 - DNA, 14 bp, Homo sapiens
tgtgccctgtgtgt

SEQ ID NO: 660847 - DNA, 12 bp, Homo sapiens
tgtgcctggggt

SEQ ID NO: 660848 - DNA, 15 bp, Homo sapiens
tgtgcctttctttgc

SEQ ID NO: 660849 - DNA, 16 bp, Homo sapiens
tgtgcctttctttgcc

SEQ ID NO: 660850 - DNA, 21 bp, Homo sapiens
tgtgcctttctttgcctctgc

SEQ ID NO: 660851 - DNA, 15 bp, Homo sapiens
tgtgcctttggcctg

SEQ ID NO: 660852 - DNA, 16 bp, Homo sapiens
tgtgcggaattcaagt

SEQ ID NO: 660853 - DNA, 15 bp, Homo sapiens
tgtgctcagaagggc

SEQ ID NO: 660854 - DNA, 24 bp, Homo sapiens
tgtgctgggggaatgagcccagag

SEQ ID NO: 660855 - DNA, 19 bp, Homo sapiens
tgtgcttgttttataaaat

SEQ ID NO: 660856 - DNA, 17 bp, Homo sapiens
tgtggattctgaggccc

SEQ ID NO: 660857 - DNA, 18 bp, Homo sapiens
tgtggcaatctgtgggct

SEQ ID NO: 660858 - DNA, 12 bp, Homo sapiens
tgtggccaggct

SEQ ID NO: 660859 - DNA, 13 bp, Homo sapiens
tgtggctcccttg

SEQ ID NO: 660860 - DNA, 17 bp, Homo sapiens
tgtgggatattgaatgt

SEQ ID NO: 660861 - DNA, 18 bp, Homo sapiens
tgtgggcactggcccagg

SEQ ID NO: 660862 - DNA, 23 bp, Homo sapiens
tgtgggcactggcccaggttcat

SEQ ID NO: 660863 - DNA, 13 bp, Homo sapiens
tgtggggaaaggg

SEQ ID NO: 660864 - DNA, 15 bp, Homo sapiens
tgtgggtgtagccag

SEQ ID NO: 660865 - DNA, 21 bp, Homo sapiens
tgtggtaagcaacatggcttt

SEQ ID NO: 660866 - DNA, 17 bp, Homo sapiens
tgtggtaatctacacca

SEQ ID NO: 660867 - DNA, 19 bp, Homo sapiens
tgtggtacatggtgtttgt

SEQ ID NO: 660868 - DNA, 13 bp, Homo sapiens
tgtggttcctctg

SEQ ID NO: 660869 - DNA, 15 bp, Homo sapiens
tgtggttgtgtgtgt

SEQ ID NO: 660870 - DNA, 17 bp, Homo sapiens
tgtgtaccttaagatat

SEQ ID NO: 660871 - DNA, 15 bp, Homo sapiens
tgtgtaggttatctt

SEQ ID NO: 660872 - DNA, 21 bp, Homo sapiens
tgtgtatattccttttaaaga

SEQ ID NO: 660873 - DNA, 17 bp, Homo sapiens
tgtgtcatttcttcact

SEQ ID NO: 660874 - DNA, 19 bp, Homo sapiens
tgtgtccacctgtgggtgt

SEQ ID NO: 660875 - DNA, 17 bp, Homo sapiens
tgtgtcccttggtcctg

SEQ ID NO: 660876 - DNA, 18 bp, Homo sapiens
tgtgtcctggtgagaaaa

SEQ ID NO: 660877 - DNA, 21 bp, Homo sapiens
tgtgtcctggtgagaaaatat

SEQ ID NO: 660878 - DNA, 12 bp, Homo sapiens
tgtgtgaatgtg

SEQ ID NO: 660879 - DNA, 14 bp, Homo sapiens
tgtgtggtggcctc

SEQ ID NO: 660880 - DNA, 20 bp, Homo sapiens
tgtgtgtacaaatacatgtg

SEQ ID NO: 660881 - DNA, 12 bp, Homo sapiens
tgtgtgtgtgtg

SEQ ID NO: 660882 - DNA, 14 bp, Homo sapiens
tgtgtgtgtgtgcg

SEQ ID NO: 660883 - DNA, 10 bp, Homo sapiens
tgtgtgttct

SEQ ID NO: 660884 - DNA, 21 bp, Homo sapiens
tgtgttcagctctttccaaat

SEQ ID NO: 660885 - DNA, 15 bp, Homo sapiens
tgtgttcaggcattc

SEQ ID NO: 660886 - DNA, 22 bp, Homo sapiens
tgtgttcgttgcacagctgttt

SEQ ID NO: 660887 - DNA, 12 bp, Homo sapiens
tgtgttctgcaa

SEQ ID NO: 660888 - DNA, 12 bp, Homo sapiens
tgtgttcttact

SEQ ID NO: 660889 - DNA, 16 bp, Homo sapiens
tgtgttgccctggcat

SEQ ID NO: 660890 - DNA, 17 bp, Homo sapiens
tgtgttttctctggaat

SEQ ID NO: 660891 - DNA, 15 bp, Homo sapiens
tgtgtttttaacatg

SEQ ID NO: 660892 - DNA, 20 bp, Homo sapiens
tgtgtttttgggaagaagaa

SEQ ID NO: 660893 - DNA, 15 bp, Homo sapiens
tgttaaaagttttat

SEQ ID NO: 660894 - DNA, 20 bp, Homo sapiens
tgttaaaagttttatatgct

SEQ ID NO: 660895 - DNA, 14 bp, Homo sapiens
tgttaagaatagaa

SEQ ID NO: 660896 - DNA, 14 bp, Homo sapiens
tgttaatacaaggt

SEQ ID NO: 660897 - DNA, 17 bp, Homo sapiens
tgttaatacaaggtata

SEQ ID NO: 660898 - DNA, 13 bp, Homo sapiens
tgttaatgctttt

SEQ ID NO: 660899 - DNA, 19 bp, Homo sapiens
tgttacaagtttatatata

SEQ ID NO: 660900 - DNA, 19 bp, Homo sapiens
tgttacataaggatgactt

SEQ ID NO: 660901 - DNA, 20 bp, Homo sapiens
tgttacataaggatgacttt

SEQ ID NO: 660902 - DNA, 15 bp, Homo sapiens
tgttactattttcta

SEQ ID NO: 660903 - DNA, 22 bp, Homo sapiens
tgttactattttctacaattaa

SEQ ID NO: 660904 - DNA, 20 bp, Homo sapiens
tgttagctttccaaggaagc

SEQ ID NO: 660905 - DNA, 22 bp, Homo sapiens
tgttagctttccaaggaagcag

SEQ ID NO: 660906 - DNA, 14 bp, Homo sapiens
tgttagtggcaccg

SEQ ID NO: 660907 - DNA, 15 bp, Homo sapiens
tgttagttgtccaca

SEQ ID NO: 660908 - DNA, 19 bp, Homo sapiens
tgttatatataataaatac

SEQ ID NO: 660909 - DNA, 15 bp, Homo sapiens
tgttatatcatatgt

SEQ ID NO: 660910 - DNA, 18 bp, Homo sapiens
tgttatcaaactgctgtc

SEQ ID NO: 660911 - DNA, 18 bp, Homo sapiens
tgttatcggattactgaa

SEQ ID NO: 660912 - DNA, 14 bp, Homo sapiens
tgttattagatgtt

SEQ ID NO: 660913 - DNA, 16 bp, Homo sapiens
tgttattattagataa

SEQ ID NO: 660914 - DNA, 13 bp, Homo sapiens
tgttatttcttcc

SEQ ID NO: 660915 - DNA, 16 bp, Homo sapiens
tgttcaaaaagatatt

SEQ ID NO: 660916 - DNA, 21 bp, Homo sapiens
tgttcagctctttccaaatta

SEQ ID NO: 660917 - DNA, 20 bp, Homo sapiens
tgttcatttctaaatttata

SEQ ID NO: 660918 - DNA, 17 bp, Homo sapiens
tgttcgttgcacagctg

SEQ ID NO: 660919 - DNA, 21 bp, Homo sapiens
tgttctaatccaagggccagt

SEQ ID NO: 660920 - DNA, 21 bp, Homo sapiens
tgttctattaatcacctctct

SEQ ID NO: 660921 - DNA, 22 bp, Homo sapiens
tgttctattaatcacctctctg

SEQ ID NO: 660922 - DNA, 17 bp, Homo sapiens
tgttctgaaatgttctt

SEQ ID NO: 660923 - DNA, 18 bp, Homo sapiens
tgttctgaaatgttctta

SEQ ID NO: 660924 - DNA, 17 bp, Homo sapiens
tgttctgctccatacct

SEQ ID NO: 660925 - DNA, 22 bp, Homo sapiens
tgttctggggggacccagtgca

SEQ ID NO: 660926 - DNA, 12 bp, Homo sapiens
tgttgacataca

SEQ ID NO: 660927 - DNA, 17 bp, Homo sapiens
tgttgactggactgctt

SEQ ID NO: 660928 - DNA, 14 bp, Homo sapiens
tgttgataatatat

SEQ ID NO: 660929 - DNA, 20 bp, Homo sapiens
tgttgcatatagttaaactg

SEQ ID NO: 660930 - DNA, 21 bp, Homo sapiens
tgttgcatatagttaaactga

SEQ ID NO: 660931 - DNA, 23 bp, Homo sapiens
tgttgctcagtgtttttgtgaat

SEQ ID NO: 660932 - DNA, 15 bp, Homo sapiens
tgttgctctaggaag

SEQ ID NO: 660933 - DNA, 17 bp, Homo sapiens
tgttgctctaggaagac

SEQ ID NO: 660934 - DNA, 16 bp, Homo sapiens
tgttgcttctcaggct

SEQ ID NO: 660935 - DNA, 16 bp, Homo sapiens
tgttgctttcttacct

SEQ ID NO: 660936 - DNA, 13 bp, Homo sapiens
tgttggcacagaa

SEQ ID NO: 660937 - DNA, 21 bp, Homo sapiens
tgttgggaaagataaaactct

SEQ ID NO: 660938 - DNA, 16 bp, Homo sapiens
tgttgtaagaattctg

SEQ ID NO: 660939 - DNA, 14 bp, Homo sapiens
tgttgtattcattg

SEQ ID NO: 660940 - DNA, 16 bp, Homo sapiens
tgttgtcaagaatagc

SEQ ID NO: 660941 - DNA, 20 bp, Homo sapiens
tgttgtcaagaatagcattg

SEQ ID NO: 660942 - DNA, 16 bp, Homo sapiens
tgttgtggaagcatgt

SEQ ID NO: 660943 - DNA, 16 bp, Homo sapiens
tgtttaataaagcttt

SEQ ID NO: 660944 - DNA, 14 bp, Homo sapiens
tgtttacgtttgat

SEQ ID NO: 660945 - DNA, 21 bp, Homo sapiens
tgtttatatacagtacacaga

SEQ ID NO: 660946 - DNA, 21 bp, Homo sapiens
tgtttatgagccagacaaatg

SEQ ID NO: 660947 - DNA, 17 bp, Homo sapiens
tgtttattataaagctt

SEQ ID NO: 660948 - DNA, 18 bp, Homo sapiens
tgtttattataaagctta

SEQ ID NO: 660949 - DNA, 19 bp, Homo sapiens
tgtttatttgcaatttgag

SEQ ID NO: 660950 - DNA, 18 bp, Homo sapiens
tgtttcctatttaataca

SEQ ID NO: 660951 - DNA, 14 bp, Homo sapiens
tgtttctaagaaaa

SEQ ID NO: 660952 - DNA, 13 bp, Homo sapiens
tgtttctctgaaa

SEQ ID NO: 660953 - DNA, 22 bp, Homo sapiens
tgtttctgtttataatgaagaa

SEQ ID NO: 660954 - DNA, 15 bp, Homo sapiens
tgtttcttttgtttg

SEQ ID NO: 660955 - DNA, 15 bp, Homo sapiens
tgtttgaaatgttta

SEQ ID NO: 660956 - DNA, 19 bp, Homo sapiens
tgtttgaaatgtttaataa

SEQ ID NO: 660957 - DNA, 19 bp, Homo sapiens
tgtttgccaggacatgcaa

SEQ ID NO: 660958 - DNA, 17 bp, Homo sapiens
tgtttggcaaggaaagg

SEQ ID NO: 660959 - DNA, 12 bp, Homo sapiens
tgtttggtaaat

SEQ ID NO: 660960 - DNA, 15 bp, Homo sapiens
tgtttggtaaatgtt

SEQ ID NO: 660961 - DNA, 19 bp, Homo sapiens
tgtttgtgttcaatatcag

SEQ ID NO: 660962 - DNA, 18 bp, Homo sapiens
tgttttaaaactggacct

SEQ ID NO: 660963 - DNA, 21 bp, Homo sapiens
tgttttaaccagtacttctaa

SEQ ID NO: 660964 - DNA, 13 bp, Homo sapiens
tgttttcttcaac

SEQ ID NO: 660965 - DNA, 13 bp, Homo sapiens
tgttttttatgtt

SEQ ID NO: 660966 - DNA, 11 bp, Homo sapiens
tgttttttgta

SEQ ID NO: 660967 - DNA, 22 bp, Homo sapiens
tgtttttttctttttttataaa

SEQ ID NO: 660968 - DNA, 22 bp, Homo sapiens
ttaaaaaatcagaacaaaactt

SEQ ID NO: 660969 - DNA, 13 bp, Homo sapiens
ttaaaaaattctt

SEQ ID NO: 660970 - DNA, 18 bp, Homo sapiens
ttaaaaacaaatgagttt

SEQ ID NO: 660971 - DNA, 12 bp, Homo sapiens
ttaaaaactctt

SEQ ID NO: 660972 - DNA, 16 bp, Homo sapiens
ttaaaaactcttcagt

SEQ ID NO: 660973 - DNA, 14 bp, Homo sapiens
ttaaaaagaaatta

SEQ ID NO: 660974 - DNA, 13 bp, Homo sapiens
ttaaaaagatgaa

SEQ ID NO: 660975 - DNA, 20 bp, Homo sapiens
ttaaaaattacctttaattt

SEQ ID NO: 660976 - DNA, 16 bp, Homo sapiens
ttaaaacaaatataca

SEQ ID NO: 660977 - DNA, 22 bp, Homo sapiens
ttaaaacaataatgcaattaga

SEQ ID NO: 660978 - DNA, 17 bp, Homo sapiens
ttaaaagccatgtataa

SEQ ID NO: 660979 - DNA, 23 bp, Homo sapiens
ttaaaataggggatatttaaggt

SEQ ID NO: 660980 - DNA, 13 bp, Homo sapiens
ttaaaatgtaatt

SEQ ID NO: 660981 - DNA, 21 bp, Homo sapiens
ttaaaatgtaatttaaatgaa

SEQ ID NO: 660982 - DNA, 14 bp, Homo sapiens
ttaaacactacaca

SEQ ID NO: 660983 - DNA, 21 bp, Homo sapiens
ttaaactaccactttttttaa

SEQ ID NO: 660984 - DNA, 20 bp, Homo sapiens
ttaaactgagagtaattcat

SEQ ID NO: 660985 - DNA, 16 bp, Homo sapiens
ttaaagaagagtgact

SEQ ID NO: 660986 - DNA, 14 bp, Homo sapiens
ttaaagaagcttta

SEQ ID NO: 660987 - DNA, 19 bp, Homo sapiens
ttaaagaccaataaacttc

SEQ ID NO: 660988 - DNA, 15 bp, Homo sapiens
ttaaagagaatgagt

SEQ ID NO: 660989 - DNA, 23 bp, Homo sapiens
ttaaagatgctatggaacataaa

SEQ ID NO: 660990 - DNA, 15 bp, Homo sapiens
ttaaagggtttgaga

SEQ ID NO: 660991 - DNA, 22 bp, Homo sapiens
ttaaataaactttttttagatt

SEQ ID NO: 660992 - DNA, 13 bp, Homo sapiens
ttaaatatttagt

SEQ ID NO: 660993 - DNA, 22 bp, Homo sapiens
ttaaatcagttctcaatttcat

SEQ ID NO: 660994 - DNA, 19 bp, Homo sapiens
ttaaatccttttacctttt

SEQ ID NO: 660995 - DNA, 11 bp, Homo sapiens
ttaaatgattg

SEQ ID NO: 660996 - DNA, 20 bp, Homo sapiens
ttaaatgcaaccatttgaaa

SEQ ID NO: 660997 - DNA, 22 bp, Homo sapiens
ttaaatggtaataagcactgta

SEQ ID NO: 660998 - DNA, 15 bp, Homo sapiens
ttaaatgtaatataa

SEQ ID NO: 660999 - DNA, 15 bp, Homo sapiens
ttaacattttggaaa

SEQ ID NO: 661000 - DNA, 18 bp, Homo sapiens
ttaaccaggggtcctaac

SEQ ID NO: 661001 - DNA, 21 bp, Homo sapiens
ttaaccttagagcttggacag

SEQ ID NO: 661002 - DNA, 20 bp, Homo sapiens
ttaactactatattgattgt

SEQ ID NO: 661003 - DNA, 17 bp, Homo sapiens
ttaacttatttagagat

SEQ ID NO: 661004 - DNA, 19 bp, Homo sapiens
ttaacttgtttggtagtta

SEQ ID NO: 661005 - DNA, 20 bp, Homo sapiens
ttaacttttttttctctctt

SEQ ID NO: 661006 - DNA, 15 bp, Homo sapiens
ttaagaaaggaagca

SEQ ID NO: 661007 - DNA, 21 bp, Homo sapiens
ttaagaaagtaatttaatttg

SEQ ID NO: 661008 - DNA, 14 bp, Homo sapiens
ttccatgcaactgg

SEQ ID NO: 661009 - DNA, 13 bp, Homo sapiens
ttccatgtgcctt

SEQ ID NO: 661010 - DNA, 15 bp, Homo sapiens
ttccatgtgcctttc

SEQ ID NO: 661011 - DNA, 20 bp, Homo sapiens
ttccatgtgcctttctttgc

SEQ ID NO: 661012 - DNA, 18 bp, Homo sapiens
ttccattttaattttaaa

SEQ ID NO: 661013 - DNA, 13 bp, Homo sapiens
ttcccaacacaaa

SEQ ID NO: 661014 - DNA, 15 bp, Homo sapiens
ttcccaacacaaaga

SEQ ID NO: 661015 - DNA, 23 bp, Homo sapiens
ttcccagaatgttactgactcct

SEQ ID NO: 661016 - DNA, 18 bp, Homo sapiens
ttcccaggttctgtttat

SEQ ID NO: 661017 - DNA, 16 bp, Homo sapiens
ttcccatgtatttgtt

SEQ ID NO: 661018 - DNA, 14 bp, Homo sapiens
ttcccatttcttcc

SEQ ID NO: 661019 - DNA, 15 bp, Homo sapiens
ttcccatttcttccc

SEQ ID NO: 661020 - DNA, 16 bp, Homo sapiens
ttcccccttcccattt

SEQ ID NO: 661021 - DNA, 23 bp, Homo sapiens
ttccctccatttttctcccaaga

SEQ ID NO: 661022 - DNA, 12 bp, Homo sapiens
ttccctgctgcg

SEQ ID NO: 661023 - DNA, 17 bp, Homo sapiens
ttccctgctttgcatct

SEQ ID NO: 661024 - DNA, 22 bp, Homo sapiens
ttcccttgaaactttgggaaaa

SEQ ID NO: 661025 - DNA, 16 bp, Homo sapiens
ttcctaacaaaatgag

SEQ ID NO: 661026 - DNA, 18 bp, Homo sapiens
ttcctaacacagcatgtg

SEQ ID NO: 661027 - DNA, 22 bp, Homo sapiens
ttcctaagccacttgaaatgtt

SEQ ID NO: 661028 - DNA, 20 bp, Homo sapiens
ttcctataatataataaata

SEQ ID NO: 661029 - DNA, 15 bp, Homo sapiens
ttcctatttatttga

SEQ ID NO: 661030 - DNA, 20 bp, Homo sapiens
ttcctcaaatcagtgataat

SEQ ID NO: 661031 - DNA, 16 bp, Homo sapiens
ttcctcctgcctttct

SEQ ID NO: 661032 - DNA, 17 bp, Homo sapiens
ttcctcctgcctttctc

SEQ ID NO: 661033 - DNA, 23 bp, Homo sapiens
ttcctctcaccccactcctgtca

SEQ ID NO: 661034 - DNA, 15 bp, Homo sapiens
ttcctcttgtctgat

SEQ ID NO: 661035 - DNA, 14 bp, Homo sapiens
ttcctgaattggaa

SEQ ID NO: 661036 - DNA, 16 bp, Homo sapiens
ttcctgagatttcctc

SEQ ID NO: 661037 - DNA, 22 bp, Homo sapiens
ttcctggtttaattcagcagag

SEQ ID NO: 661038 - DNA, 12 bp, Homo sapiens
ttcctgtactgt

SEQ ID NO: 661039 - DNA, 16 bp, Homo sapiens
ttcctgtactgtgtct

SEQ ID NO: 661040 - DNA, 14 bp, Homo sapiens
ttccttatccctct

SEQ ID NO: 661041 - DNA, 15 bp, Homo sapiens
ttccttatttgcctt

SEQ ID NO: 661042 - DNA, 22 bp, Homo sapiens
ttccttcccagaatgttactga

SEQ ID NO: 661043 - DNA, 13 bp, Homo sapiens
ttccttgaggaca

SEQ ID NO: 661044 - DNA, 17 bp, Homo sapiens
ttcctttgcccttcctc

SEQ ID NO: 661045 - DNA, 17 bp, Homo sapiens
ttcctttttcttcgctg

SEQ ID NO: 661046 - DNA, 14 bp, Homo sapiens
ttcctttttttgat

SEQ ID NO: 661047 - DNA, 20 bp, Homo sapiens
ttcgatgtgcccaggggagc

SEQ ID NO: 661048 - DNA, 20 bp, Homo sapiens
ttcgctggactattgtgcca

SEQ ID NO: 661049 - DNA, 23 bp, Homo sapiens
ttcgctggactattgtgccaact

SEQ ID NO: 661050 - DNA, 17 bp, Homo sapiens
ttcgttctgtactgtta

SEQ ID NO: 661051 - DNA, 20 bp, Homo sapiens
ttcgttgcacagctgtttga

SEQ ID NO: 661052 - DNA, 20 bp, Homo sapiens
ttctaaatttatattcataa

SEQ ID NO: 661053 - DNA, 22 bp, Homo sapiens
ttctaagaaaatgtagttagct

SEQ ID NO: 661054 - DNA, 12 bp, Homo sapiens
ttctaagaagac

SEQ ID NO: 661055 - DNA, 13 bp, Homo sapiens
ttctaagaagaca

SEQ ID NO: 661056 - DNA, 14 bp, Homo sapiens
ttctaagaagacat

SEQ ID NO: 661057 - DNA, 18 bp, Homo sapiens
ttctaagaagttgtttga

SEQ ID NO: 661058 - DNA, 14 bp, Homo sapiens
ttctaattgtaagt

SEQ ID NO: 661059 - DNA, 14 bp, Homo sapiens
ttctaatttatatt

SEQ ID NO: 661060 - DNA, 20 bp, Homo sapiens
ttctaatttatattatccat

SEQ ID NO: 661061 - DNA, 13 bp, Homo sapiens
ttctactcctgcc

SEQ ID NO: 661062 - DNA, 23 bp, Homo sapiens
ttctactgccttgaaaaatgaca

SEQ ID NO: 661063 - DNA, 24 bp, Homo sapiens
ttctactgccttgaaaaatgacaa

SEQ ID NO: 661064 - DNA, 17 bp, Homo sapiens
ttctagcagtgagccaa

SEQ ID NO: 661065 - DNA, 23 bp, Homo sapiens
ttctagtgatgatggttcacgtt

SEQ ID NO: 661066 - DNA, 14 bp, Homo sapiens
ttctatgacaaatt

SEQ ID NO: 661067 - DNA, 18 bp, Homo sapiens
ttctatgacaaattcaag

SEQ ID NO: 661068 - DNA, 15 bp, Homo sapiens
ttctatgtgacattt

SEQ ID NO: 661069 - DNA, 19 bp, Homo sapiens
ttctcaaagatctgaatta

SEQ ID NO: 661070 - DNA, 16 bp, Homo sapiens
ttctcataattttgca

SEQ ID NO: 661071 - DNA, 23 bp, Homo sapiens
ttctcatgttaaatatttgtcct

SEQ ID NO: 661072 - DNA, 20 bp, Homo sapiens
ttctccacttcatttttaag

SEQ ID NO: 661073 - DNA, 16 bp, Homo sapiens
ttctcccctccctcca

SEQ ID NO: 661074 - DNA, 19 bp, Homo sapiens
ttctctcaaggagaggcaa

SEQ ID NO: 661075 - DNA, 12 bp, Homo sapiens
ttctctccctcc

SEQ ID NO: 661076 - DNA, 10 bp, Homo sapiens
ttctctcttt

SEQ ID NO: 661077 - DNA, 23 bp, Homo sapiens
ttctctgccgctacctccctccc

SEQ ID NO: 661078 - DNA, 21 bp, Homo sapiens
ttctcttctacccttttcctt

SEQ ID NO: 661079 - DNA, 15 bp, Homo sapiens
ttctgaaatgttctt

SEQ ID NO: 661080 - DNA, 16 bp, Homo sapiens
ttctgaaatgttctta

SEQ ID NO: 661081 - DNA, 15 bp, Homo sapiens
ttctgaggtccttat

SEQ ID NO: 661082 - DNA, 18 bp, Homo sapiens
ttctgatgaatctcaaag

SEQ ID NO: 661083 - DNA, 13 bp, Homo sapiens
ttctgcaaagtgt

SEQ ID NO: 661084 - DNA, 22 bp, Homo sapiens
ttctgcaaagtgtatgtgacca

SEQ ID NO: 661085 - DNA, 18 bp, Homo sapiens
ttctgcaagcctcatgcc

SEQ ID NO: 661086 - DNA, 19 bp, Homo sapiens
ttctgccatctagccagcc

SEQ ID NO: 661087 - DNA, 20 bp, Homo sapiens
ttctgctccataccttttct

SEQ ID NO: 661088 - DNA, 16 bp, Homo sapiens
ttctgctcttttcctg

SEQ ID NO: 661089 - DNA, 17 bp, Homo sapiens
ttctgctggcatcaaga

SEQ ID NO: 661090 - DNA, 11 bp, Homo sapiens
ttctggcaccg

SEQ ID NO: 661091 - DNA, 19 bp, Homo sapiens
ttctggggcaggctgggcc

SEQ ID NO: 661092 - DNA, 19 bp, Homo sapiens
ttctggggggacccagtgc

SEQ ID NO: 661093 - DNA, 15 bp, Homo sapiens
ttctgggtgtgttct

SEQ ID NO: 661094 - DNA, 15 bp, Homo sapiens
ttctggtactttctg

SEQ ID NO: 661095 - DNA, 17 bp, Homo sapiens
ttctggtactttctgtt

SEQ ID NO: 661096 - DNA, 17 bp, Homo sapiens
ttctggttccctgctgc

SEQ ID NO: 661097 - DNA, 15 bp, Homo sapiens
ttctggttcttgaaa

SEQ ID NO: 661098 - DNA, 15 bp, Homo sapiens
ttctggtttcccttt

SEQ ID NO: 661099 - DNA, 14 bp, Homo sapiens
ttctgtaatgtaaa

SEQ ID NO: 661100 - DNA, 21 bp, Homo sapiens
ttctgtactgttactgggccc

SEQ ID NO: 661101 - DNA, 23 bp, Homo sapiens
ttctgtttcctatttaatacagc

SEQ ID NO: 661102 - DNA, 13 bp, Homo sapiens
ttcttaaatgttt

SEQ ID NO: 661103 - DNA, 21 bp, Homo sapiens
ttcttaaattttgtaggattt

SEQ ID NO: 661104 - DNA, 13 bp, Homo sapiens
ttcttaacctttg

SEQ ID NO: 661105 - DNA, 18 bp, Homo sapiens
ttcttacacactgtctgt

SEQ ID NO: 661106 - DNA, 14 bp, Homo sapiens
ttcttacatgcatt

SEQ ID NO: 661107 - DNA, 16 bp, Homo sapiens
ttcttacgcaatgctt

SEQ ID NO: 661108 - DNA, 14 bp, Homo sapiens
ttcttactgacacc

SEQ ID NO: 661109 - DNA, 16 bp, Homo sapiens
ttcttactgataattt

SEQ ID NO: 661110 - DNA, 20 bp, Homo sapiens
ttcttactgataattttgct

SEQ ID NO: 661111 - DNA, 17 bp, Homo sapiens
ttcttatttaccctttt

SEQ ID NO: 661112 - DNA, 14 bp, Homo sapiens
ttcttatttttgtc

SEQ ID NO: 661113 - DNA, 17 bp, Homo sapiens
ttcttcccactttcatc

SEQ ID NO: 661114 - DNA, 21 bp, Homo sapiens
ttcttccctgctttgcatctt

SEQ ID NO: 661115 - DNA, 21 bp, Homo sapiens
ttcttcgctggactattgtgc

SEQ ID NO: 661116 - DNA, 16 bp, Homo sapiens
ttcttctaagaagaca

SEQ ID NO: 661117 - DNA, 20 bp, Homo sapiens
ttcttctgtcctgagaagca

SEQ ID NO: 661118 - DNA, 12 bp, Homo sapiens
ttcttgcactga

SEQ ID NO: 661119 - DNA, 17 bp, Homo sapiens
ttcttgggaattgaaaa

SEQ ID NO: 661120 - DNA, 19 bp, Homo sapiens
ttcttggggcccagtgcat

SEQ ID NO: 661121 - DNA, 14 bp, Homo sapiens
ttctttccattatg

SEQ ID NO: 661122 - DNA, 20 bp, Homo sapiens
ttctttccattatgattctt

SEQ ID NO: 661123 - DNA, 23 bp, Homo sapiens
ttctttgctgcagtcatctactt

SEQ ID NO: 661124 - DNA, 13 bp, Homo sapiens
ttctttgtgcctt

SEQ ID NO: 661125 - DNA, 14 bp, Homo sapiens
ttcttttaaagacc

SEQ ID NO: 661126 - DNA, 13 bp, Homo sapiens
ttcttttagagag

SEQ ID NO: 661127 - DNA, 14 bp, Homo sapiens
ttcttttctcagtg

SEQ ID NO: 661128 - DNA, 13 bp, Homo sapiens
ttcttttgtttgg

SEQ ID NO: 661129 - DNA, 16 bp, Homo sapiens
tttattaatttatatg

SEQ ID NO: 661130 - DNA, 16 bp, Homo sapiens
tttattatgcattata

SEQ ID NO: 661131 - DNA, 16 bp, Homo sapiens
tttattcagaacttta

SEQ ID NO: 661132 - DNA, 22 bp, Homo sapiens
tttatttatccagaaaactgtg

SEQ ID NO: 661133 - DNA, 23 bp, Homo sapiens
tttatttcatttacaaaagattt

SEQ ID NO: 661134 - DNA, 21 bp, Homo sapiens
tttatttgcaatttgagccat

SEQ ID NO: 661135 - DNA, 22 bp, Homo sapiens
tttattttgtgctcatttaagt

SEQ ID NO: 661136 - DNA, 14 bp, Homo sapiens
tttatttttgacag

SEQ ID NO: 661137 - DNA, 13 bp, Homo sapiens
tttatttttgcac

SEQ ID NO: 661138 - DNA, 19 bp, Homo sapiens
tttatttttgcacaacttt

SEQ ID NO: 661139 - DNA, 19 bp, Homo sapiens
tttatttttgtgtaggtgt

SEQ ID NO: 661140 - DNA, 23 bp, Homo sapiens
tttcaaaagaaatttaagttcta

SEQ ID NO: 661141 - DNA, 20 bp, Homo sapiens
tttcaaaaggtattatacat

SEQ ID NO: 661142 - DNA, 21 bp, Homo sapiens
tttcaaaaggtattatacatg

SEQ ID NO: 661143 - DNA, 13 bp, Homo sapiens
tttcaaaatacat

SEQ ID NO: 661144 - DNA, 15 bp, Homo sapiens
tttcaaaatacattt

SEQ ID NO: 661145 - DNA, 19 bp, Homo sapiens
tttcaaaatacatttgtaa

SEQ ID NO: 661146 - DNA, 20 bp, Homo sapiens
tttcaaagttttgttgtact

SEQ ID NO: 661147 - DNA, 15 bp, Homo sapiens
tttcaagaaaatctt

SEQ ID NO: 661148 - DNA, 16 bp, Homo sapiens
tttcaagttgtaaata

SEQ ID NO: 661149 - DNA, 14 bp, Homo sapiens
tttcaatgacattt

SEQ ID NO: 661150 - DNA, 13 bp, Homo sapiens
tttcagaaatata

SEQ ID NO: 661151 - DNA, 12 bp, Homo sapiens
tttcagaaatct

SEQ ID NO: 661152 - DNA, 20 bp, Homo sapiens
tttcagtgggaaatatgcca

SEQ ID NO: 661153 - DNA, 14 bp, Homo sapiens
tttcataaacaagt

SEQ ID NO: 661154 - DNA, 15 bp, Homo sapiens
tttcataatcagtaa

SEQ ID NO: 661155 - DNA, 22 bp, Homo sapiens
tttcataattgcctacatttat

SEQ ID NO: 661156 - DNA, 13 bp, Homo sapiens
tttcatccttctt

SEQ ID NO: 661157 - DNA, 17 bp, Homo sapiens
tttcatccttctttcct

SEQ ID NO: 661158 - DNA, 18 bp, Homo sapiens
tttcatctaccttttctg

SEQ ID NO: 661159 - DNA, 19 bp, Homo sapiens
tttcatttacaaaagattt

SEQ ID NO: 661160 - DNA, 13 bp, Homo sapiens
tttccaaattgcc

SEQ ID NO: 661161 - DNA, 23 bp, Homo sapiens
tttccaggctatgtataaaatac

SEQ ID NO: 661162 - DNA, 14 bp, Homo sapiens
tttccatcaactcc

SEQ ID NO: 661163 - DNA, 16 bp, Homo sapiens
tttcccaggttctgtt

SEQ ID NO: 661164 - DNA, 16 bp, Homo sapiens
tttcccatgtatttgt

SEQ ID NO: 661165 - DNA, 14 bp, Homo sapiens
tttcccccttccca

SEQ ID NO: 661166 - DNA, 23 bp, Homo sapiens
tttcccgcccagcctcacttcct

SEQ ID NO: 661167 - DNA, 14 bp, Homo sapiens
tttccctggaactc

SEQ ID NO: 661168 - DNA, 18 bp, Homo sapiens
tttcctatttaatacagc

SEQ ID NO: 661169 - DNA, 19 bp, Homo sapiens
tttcctcagcttatctctt

SEQ ID NO: 661170 - DNA, 17 bp, Homo sapiens
tttcctctcctgggtac

SEQ ID NO: 661171 - DNA, 22 bp, Homo sapiens
tttcctgtggcataaattgcat

SEQ ID NO: 661172 - DNA, 14 bp, Homo sapiens
tttcctgtttccag

SEQ ID NO: 661173 - DNA, 22 bp, Homo sapiens
tttccttaccataccactttga

SEQ ID NO: 661174 - DNA, 18 bp, Homo sapiens
tttccttatttgccttct

SEQ ID NO: 661175 - DNA, 16 bp, Homo sapiens
tttccttctaacatgt

SEQ ID NO: 661176 - DNA, 14 bp, Homo sapiens
tttctaaataaaaa

SEQ ID NO: 661177 - DNA, 19 bp, Homo sapiens
tttctaaatttatattcat

SEQ ID NO: 661178 - DNA, 14 bp, Homo sapiens
tttctaagaaaatg

SEQ ID NO: 661179 - DNA, 22 bp, Homo sapiens
tttctatgcttgtaactgtctt

SEQ ID NO: 661180 - DNA, 16 bp, Homo sapiens
tttctcaactgtccca

SEQ ID NO: 661181 - DNA, 14 bp, Homo sapiens
tttctcactatata

SEQ ID NO: 661182 - DNA, 20 bp, Homo sapiens
tttctcagtgttggtatatt

SEQ ID NO: 661183 - DNA, 19 bp, Homo sapiens
tttctcccaagaaacctga

SEQ ID NO: 661184 - DNA, 14 bp, Homo sapiens
tttctccttttcct

SEQ ID NO: 661185 - DNA, 15 bp, Homo sapiens
tttctccttttccta

SEQ ID NO: 661186 - DNA, 15 bp, Homo sapiens
tttctctgaaagtgt

SEQ ID NO: 661187 - DNA, 21 bp, Homo sapiens
tttctcttctacccttttcct

SEQ ID NO: 661188 - DNA, 13 bp, Homo sapiens
tttctcttttctt

SEQ ID NO: 661189 - DNA, 20 bp, Homo sapiens
tttctgagatgctcacttta

SEQ ID NO: 661190 - DNA, 22 bp, Homo sapiens
tttctgcatgaatatcatacaa

SEQ ID NO: 661191 - DNA, 16 bp, Homo sapiens
tttctgtaatgtaaat

SEQ ID NO: 661192 - DNA, 19 bp, Homo sapiens
tttctgtaatgtaaataaa

SEQ ID NO: 661193 - DNA, 21 bp, Homo sapiens
tttcttaaataatgcttcaga

SEQ ID NO: 661194 - DNA, 15 bp, Homo sapiens
tttcttatttttgtc

SEQ ID NO: 661195 - DNA, 15 bp, Homo sapiens
tttcttccctgcttt

SEQ ID NO: 661196 - DNA, 20 bp, Homo sapiens
tttcttctctgtgagaaggt

SEQ ID NO: 661197 - DNA, 20 bp, Homo sapiens
tttcttcttctaagaagaca

SEQ ID NO: 661198 - DNA, 22 bp, Homo sapiens
tttcttgggcagtctttcttga

SEQ ID NO: 661199 - DNA, 14 bp, Homo sapiens
tttctttcccatgt

SEQ ID NO: 661200 - DNA, 13 bp, Homo sapiens
tttctttgcctct

SEQ ID NO: 661201 - DNA, 21 bp, Homo sapiens
tttgaaaaaaaagtttttaat

SEQ ID NO: 661202 - DNA, 20 bp, Homo sapiens
tttgaaacaaagtactcttt

SEQ ID NO: 661203 - DNA, 12 bp, Homo sapiens
tttgaacaggtc

SEQ ID NO: 661204 - DNA, 16 bp, Homo sapiens
tttgaagtgcagctca

SEQ ID NO: 661205 - DNA, 18 bp, Homo sapiens
tttgacagactatttgct

SEQ ID NO: 661206 - DNA, 15 bp, Homo sapiens
tttgagatgtaaaaa

SEQ ID NO: 661207 - DNA, 18 bp, Homo sapiens
tttgagatgtacatcttt

SEQ ID NO: 661208 - DNA, 23 bp, Homo sapiens
tttgaggtcaagtaagaagacat

SEQ ID NO: 661209 - DNA, 12 bp, Homo sapiens
tttgatttctaa

SEQ ID NO: 661210 - DNA, 14 bp, Homo sapiens
tttgatttctaatt

SEQ ID NO: 661211 - DNA, 18 bp, Homo sapiens
tttgatttctaattgtaa

SEQ ID NO: 661212 - DNA, 20 bp, Homo sapiens
tttgcaactaggtatttcta

SEQ ID NO: 661213 - DNA, 15 bp, Homo sapiens
tttgcaatttgagcc

SEQ ID NO: 661214 - DNA, 21 bp, Homo sapiens
tttgcactaggaagaatcagt

SEQ ID NO: 661215 - DNA, 20 bp, Homo sapiens
tttgcactctgtaattgcac

SEQ ID NO: 661216 - DNA, 21 bp, Homo sapiens
tttgcatattttgagaaactg

SEQ ID NO: 661217 - DNA, 20 bp, Homo sapiens
tttgccagttttccctggaa

SEQ ID NO: 661218 - DNA, 15 bp, Homo sapiens
tttgcctcttctttg

SEQ ID NO: 661219 - DNA, 21 bp, Homo sapiens
tttgcctcttctttgtgcctt

SEQ ID NO: 661220 - DNA, 15 bp, Homo sapiens
tttgccttctactcc

SEQ ID NO: 661221 - DNA, 18 bp, Homo sapiens
tttgctaatgtataatgt

SEQ ID NO: 661222 - DNA, 21 bp, Homo sapiens
tttgctactgttgtaagaatt

SEQ ID NO: 661223 - DNA, 23 bp, Homo sapiens
tttgctcttgtttttattaattt

SEQ ID NO: 661224 - DNA, 20 bp, Homo sapiens
tttggaaaagtggcgtggga

SEQ ID NO: 661225 - DNA, 16 bp, Homo sapiens
tttggaaagactggac

SEQ ID NO: 661226 - DNA, 14 bp, Homo sapiens
tttggattttatgg

SEQ ID NO: 661227 - DNA, 13 bp, Homo sapiens
tttggcctgtgat

SEQ ID NO: 661228 - DNA, 19 bp, Homo sapiens
tttggtaaacggtttttat

SEQ ID NO: 661229 - DNA, 13 bp, Homo sapiens
tttggtaaatgtt

SEQ ID NO: 661230 - DNA, 16 bp, Homo sapiens
tttggtaaatgtttct

SEQ ID NO: 661231 - DNA, 20 bp, Homo sapiens
tttggtctttaatgaaaagc

SEQ ID NO: 661232 - DNA, 13 bp, Homo sapiens
tttggtgtgttcg

SEQ ID NO: 661233 - DNA, 20 bp, Homo sapiens
tttggttatgaatactttgc

SEQ ID NO: 661234 - DNA, 22 bp, Homo sapiens
tttgtaaaaatcttttgaagca

SEQ ID NO: 661235 - DNA, 14 bp, Homo sapiens
tttgtaaagctatt

SEQ ID NO: 661236 - DNA, 22 bp, Homo sapiens
tttgtaaatgaaacttaagaat

SEQ ID NO: 661237 - DNA, 13 bp, Homo sapiens
tttgtaaatgcat

SEQ ID NO: 661238 - DNA, 15 bp, Homo sapiens
tttgtaatttttgct

SEQ ID NO: 661239 - DNA, 14 bp, Homo sapiens
tttgtacagagtgc

SEQ ID NO: 661240 - DNA, 23 bp, Homo sapiens
tttgtagcataactgtagctcaa

SEQ ID NO: 661241 - DNA, 21 bp, Homo sapiens
tttgtaggagaaactcccatg

SEQ ID NO: 661242 - DNA, 19 bp, Homo sapiens
tttgtatttaaggattctg

SEQ ID NO: 661243 - DNA, 23 bp, Homo sapiens
tttgtatttttcatctttaagaa

SEQ ID NO: 661244 - DNA, 23 bp, Homo sapiens
tttgtcaaaagttggtgttgaca

SEQ ID NO: 661245 - DNA, 17 bp, Homo sapiens
tttgtcgtggttcttaa

SEQ ID NO: 661246 - DNA, 18 bp, Homo sapiens
tttgtcgtggttcttaaa

SEQ ID NO: 661247 - DNA, 22 bp, Homo sapiens
tttgtctcagaagtgaaaatct

SEQ ID NO: 661248 - DNA, 13 bp, Homo sapiens
tttgtgcattctg

SEQ ID NO: 661249 - DNA, 14 bp, Homo sapiens
tgggcgtccagctc

SEQ ID NO: 661250 - DNA, 18 bp, Homo sapiens
tgggctattgctgctgcc

SEQ ID NO: 661251 - DNA, 16 bp, Homo sapiens
tgggctgccatgtgaa

SEQ ID NO: 661252 - DNA, 23 bp, Homo sapiens
tgggctggttggagaaggtcaca

SEQ ID NO: 661253 - DNA, 20 bp, Homo sapiens
tgggcttttggggagccaga

SEQ ID NO: 661254 - DNA, 11 bp, Homo sapiens
tggggaaaggg

SEQ ID NO: 661255 - DNA, 15 bp, Homo sapiens
tggggacataatttc

SEQ ID NO: 661256 - DNA, 15 bp, Homo sapiens
tggggattgcccctg

SEQ ID NO: 661257 - DNA, 13 bp, Homo sapiens
tggggcagaagag

SEQ ID NO: 661258 - DNA, 17 bp, Homo sapiens
tggggcaggctgggcca

SEQ ID NO: 661259 - DNA, 19 bp, Homo sapiens
tggggcccagtgcatggtg

SEQ ID NO: 661260 - DNA, 22 bp, Homo sapiens
tggggcccagtgcatggtggcc

SEQ ID NO: 661261 - DNA, 12 bp, Homo sapiens
aaagagaattgt

SEQ ID NO: 661262 - DNA, 13 bp, Homo sapiens
aaagagagaatgt

SEQ ID NO: 661263 - DNA, 13 bp, Homo sapiens
aaagatgatttaa

SEQ ID NO: 661264 - DNA, 22 bp, Homo sapiens
aaagattctgaccttaaatgca

SEQ ID NO: 661265 - DNA, 16 bp, Homo sapiens
aaagcagagcctcctg

SEQ ID NO: 661266 - DNA, 17 bp, Homo sapiens
aaagcagagcctcctgg

SEQ ID NO: 661267 - DNA, 17 bp, Homo sapiens
aaagcatgaaatgtgaa

SEQ ID NO: 661268 - DNA, 18 bp, Homo sapiens
aaagcatgaaatgtgaat

SEQ ID NO: 661269 - DNA, 12 bp, Homo sapiens
aaagcatgaatt

SEQ ID NO: 661270 - DNA, 21 bp, Homo sapiens
aaagcattttgtaataataaa

SEQ ID NO: 661271 - DNA, 13 bp, Homo sapiens
aaagccagggtct

SEQ ID NO: 661272 - DNA, 19 bp, Homo sapiens
aaagccagggtctctccct

SEQ ID NO: 661273 - DNA, 22 bp, Homo sapiens
aaagccagggtctctccctcag

SEQ ID NO: 661274 - DNA, 14 bp, Homo sapiens
aaagcctaaaattg

SEQ ID NO: 661275 - DNA, 19 bp, Homo sapiens
aaagccttagggaagctgg

SEQ ID NO: 661276 - DNA, 18 bp, Homo sapiens
aaagccttttaaatcatc

SEQ ID NO: 661277 - DNA, 20 bp, Homo sapiens
aaagctagtgtacctcctct

SEQ ID NO: 661278 - DNA, 23 bp, Homo sapiens
aaagctagtgtacctcctctcag

SEQ ID NO: 661279 - DNA, 18 bp, Homo sapiens
aaagctatttatgggccc

SEQ ID NO: 661280 - DNA, 16 bp, Homo sapiens
aaagctcactgctgat

SEQ ID NO: 661281 - DNA, 21 bp, Homo sapiens
aaagctctgttccatgcaact

SEQ ID NO: 661282 - DNA, 19 bp, Homo sapiens
aaagcttttaaaatgtaga

SEQ ID NO: 661283 - DNA, 12 bp, Homo sapiens
aaaggaagacta

SEQ ID NO: 661284 - DNA, 14 bp, Homo sapiens
aaaggaatgtgtaa

SEQ ID NO: 661285 - DNA, 22 bp, Homo sapiens
aaaggacccttgagtaagtgaa

SEQ ID NO: 661286 - DNA, 21 bp, Homo sapiens
aaaggagccttttgctctctg

SEQ ID NO: 661287 - DNA, 21 bp, Homo sapiens
aaaggatagtaagcatagaaa

SEQ ID NO: 661288 - DNA, 15 bp, Homo sapiens
aaaggatctctgaga

SEQ ID NO: 661289 - DNA, 19 bp, Homo sapiens
aaaggcagctgcctctgct

SEQ ID NO: 661290 - DNA, 21 bp, Homo sapiens
aaaggcctaattctatgcctg

SEQ ID NO: 661291 - DNA, 16 bp, Homo sapiens
aaagggctctttagcc

SEQ ID NO: 661292 - DNA, 20 bp, Homo sapiens
aaaggtattatacatgtgat

SEQ ID NO: 661293 - DNA, 14 bp, Homo sapiens
aaaggtgtatttaa

SEQ ID NO: 661294 - DNA, 15 bp, Homo sapiens
aaaggtgtatttaaa

SEQ ID NO: 661295 - DNA, 23 bp, Homo sapiens
aaaggttttggatcttgaatgtg

SEQ ID NO: 661296 - DNA, 15 bp, Homo sapiens
aaagtaacaatctat

SEQ ID NO: 661297 - DNA, 20 bp, Homo sapiens
aaagtaatcagcatatgtgt

SEQ ID NO: 661298 - DNA, 19 bp, Homo sapiens
aaagtaatttaatttgtaa

SEQ ID NO: 661299 - DNA, 15 bp, Homo sapiens
aaagtacaaatgaag

SEQ ID NO: 661300 - DNA, 17 bp, Homo sapiens
aaagtacaaatgaagaa

SEQ ID NO: 661301 - DNA, 14 bp, Homo sapiens
aaagtactctttaa

SEQ ID NO: 661302 - DNA, 22 bp, Homo sapiens
aaagtatatatatatattatat

SEQ ID NO: 661303 - DNA, 13 bp, Homo sapiens
aaagtattctgat

SEQ ID NO: 661304 - DNA, 21 bp, Homo sapiens
aaagtatttttttcttttttc

SEQ ID NO: 661305 - DNA, 17 bp, Homo sapiens
aaagtgggcttaatgga

SEQ ID NO: 661306 - DNA, 20 bp, Homo sapiens
aaagtggtacttgatcattt

SEQ ID NO: 661307 - DNA, 19 bp, Homo sapiens
aaagtgtgagctcttccct

SEQ ID NO: 661308 - DNA, 20 bp, Homo sapiens
aaagtgtgagctcttccctt

SEQ ID NO: 661309 - DNA, 20 bp, Homo sapiens
aaagtgtgtatatattttgt

SEQ ID NO: 661310 - DNA, 20 bp, Homo sapiens
aaagttcaacttatttcata

SEQ ID NO: 661311 - DNA, 14 bp, Homo sapiens
aaagttttgttgta

SEQ ID NO: 661312 - DNA, 14 bp, Homo sapiens
aaagtttttgtttg

SEQ ID NO: 661313 - DNA, 15 bp, Homo sapiens
aaataaaaactaatt

SEQ ID NO: 661314 - DNA, 14 bp, Homo sapiens
aaataaaatgtttc

SEQ ID NO: 661315 - DNA, 20 bp, Homo sapiens
aaataaaatgtttcattatg

SEQ ID NO: 661316 - DNA, 19 bp, Homo sapiens
aaataaagggaagaaagga

SEQ ID NO: 661317 - DNA, 12 bp, Homo sapiens
aaataaattagt

SEQ ID NO: 661318 - DNA, 12 bp, Homo sapiens
aaataagattcc

SEQ ID NO: 661319 - DNA, 16 bp, Homo sapiens
aaataatatatttctt

SEQ ID NO: 661320 - DNA, 13 bp, Homo sapiens
aaataatgctaca

SEQ ID NO: 661321 - DNA, 20 bp, Homo sapiens
aaataatgctacaattttaa

SEQ ID NO: 661322 - DNA, 13 bp, Homo sapiens
aaataattttgta

SEQ ID NO: 661323 - DNA, 12 bp, Homo sapiens
aaatacaaaaac

SEQ ID NO: 661324 - DNA, 14 bp, Homo sapiens
aaatacacatttgc

SEQ ID NO: 661325 - DNA, 14 bp, Homo sapiens
aaatacagttattt

SEQ ID NO: 661326 - DNA, 18 bp, Homo sapiens
agctgaagtcaaaatatg

SEQ ID NO: 661327 - DNA, 16 bp, Homo sapiens
agctgactgaatgcag

SEQ ID NO: 661328 - DNA, 16 bp, Homo sapiens
agctgagcctgcaggg

SEQ ID NO: 661329 - DNA, 13 bp, Homo sapiens
agctgattttatt

SEQ ID NO: 661330 - DNA, 12 bp, Homo sapiens
agctgcacggca

SEQ ID NO: 661331 - DNA, 16 bp, Homo sapiens
agctgcagagatttct

SEQ ID NO: 661332 - DNA, 14 bp, Homo sapiens
agctgccatggcta

SEQ ID NO: 661333 - DNA, 19 bp, Homo sapiens
agctgcctcctgcgccctg

SEQ ID NO: 661334 - DNA, 19 bp, Homo sapiens
agctgctatccccatctcc

SEQ ID NO: 661335 - DNA, 17 bp, Homo sapiens
agctgctccaggcctgc

SEQ ID NO: 661336 - DNA, 18 bp, Homo sapiens
agctgctccaggcctgca

SEQ ID NO: 661337 - DNA, 22 bp, Homo sapiens
agctgggcccgacatggctccg

SEQ ID NO: 661338 - DNA, 21 bp, Homo sapiens
agctgtagctacaagggaagc

SEQ ID NO: 661339 - DNA, 16 bp, Homo sapiens
agctgtcaaggctcag

SEQ ID NO: 661340 - DNA, 19 bp, Homo sapiens
agctgtgttattcctggtt

SEQ ID NO: 661341 - DNA, 17 bp, Homo sapiens
agcttatctcttttata

SEQ ID NO: 661342 - DNA, 22 bp, Homo sapiens
agcttatctcttttatatttgt

SEQ ID NO: 661343 - DNA, 23 bp, Homo sapiens
agcttcagttgcttgtcttctgg

SEQ ID NO: 661344 - DNA, 21 bp, Homo sapiens
agcttctccaggaagcccagg

SEQ ID NO: 661345 - DNA, 16 bp, Homo sapiens
agcttgctccctgtgt

SEQ ID NO: 661346 - DNA, 16 bp, Homo sapiens
agcttggacagtctga

SEQ ID NO: 661347 - DNA, 22 bp, Homo sapiens
agcttgttgtctccacttgtat

SEQ ID NO: 661348 - DNA, 20 bp, Homo sapiens
agctttcccgcccagcctca

SEQ ID NO: 661349 - DNA, 15 bp, Homo sapiens
agctttcctgtttcc

SEQ ID NO: 661350 - DNA, 15 bp, Homo sapiens
agctttgataattgt

SEQ ID NO: 661351 - DNA, 15 bp, Homo sapiens
agctttgtcgtattt

SEQ ID NO: 661352 - DNA, 19 bp, Homo sapiens
agctttgtcgtatttggca

SEQ ID NO: 661353 - DNA, 17 bp, Homo sapiens
aggaaaacgtgaacaaa

SEQ ID NO: 661354 - DNA, 16 bp, Homo sapiens
aggaaaattcttaaaa

SEQ ID NO: 661355 - DNA, 21 bp, Homo sapiens
aggaaaggtgacttcctctgg

SEQ ID NO: 661356 - DNA, 14 bp, Homo sapiens
aggaaccttccttc

SEQ ID NO: 661357 - DNA, 19 bp, Homo sapiens
aggaaccttccttcctgct

SEQ ID NO: 661358 - DNA, 12 bp, Homo sapiens
aggaagcagaag

SEQ ID NO: 661359 - DNA, 22 bp, Homo sapiens
aggaagtgagcagtcgcctgcc

SEQ ID NO: 661360 - DNA, 14 bp, Homo sapiens
aggaataaatgaga

SEQ ID NO: 661361 - DNA, 22 bp, Homo sapiens
aggacatgcaataaaatttaaa

SEQ ID NO: 661362 - DNA, 18 bp, Homo sapiens
aggaccctaacacagtat

SEQ ID NO: 661363 - DNA, 21 bp, Homo sapiens
aggacggaaaatgcttaaaaa

SEQ ID NO: 661364 - DNA, 21 bp, Homo sapiens
aggactagaagattagaaact

SEQ ID NO: 661365 - DNA, 22 bp, Homo sapiens
aggactattacatattttttgt

SEQ ID NO: 661366 - DNA, 13 bp, Homo sapiens
aggactcctggca

SEQ ID NO: 661367 - DNA, 13 bp, Homo sapiens
aggagagcctggg

SEQ ID NO: 661368 - DNA, 23 bp, Homo sapiens
aggagatcgagaccatcctggct

SEQ ID NO: 661369 - DNA, 14 bp, Homo sapiens
aggagcagaaagat

SEQ ID NO: 661370 - DNA, 24 bp, Homo sapiens
aggagccagtgaacttggctttcc

SEQ ID NO: 661371 - DNA, 16 bp, Homo sapiens
aggagccttttgctct

SEQ ID NO: 661372 - DNA, 13 bp, Homo sapiens
aggagcgcaggca

SEQ ID NO: 661373 - DNA, 15 bp, Homo sapiens
aggaggatgtccctg

SEQ ID NO: 661374 - DNA, 21 bp, Homo sapiens
aggaggatgtccctgggccag

SEQ ID NO: 661375 - DNA, 15 bp, Homo sapiens
aggaggcctgtccca

SEQ ID NO: 661376 - DNA, 19 bp, Homo sapiens
aggagggggccgggcgcgg

SEQ ID NO: 661377 - DNA, 18 bp, Homo sapiens
aggagggtttgggcagag

SEQ ID NO: 661378 - DNA, 14 bp, Homo sapiens
aggaggtgtgaatg

SEQ ID NO: 661379 - DNA, 19 bp, Homo sapiens
agcccatggcccccaataa

SEQ ID NO: 661380 - DNA, 18 bp, Homo sapiens
agcccgaagtctgctgct

SEQ ID NO: 661381 - DNA, 16 bp, Homo sapiens
agccctaagtggctgc

SEQ ID NO: 661382 - DNA, 22 bp, Homo sapiens
agccctaagtggctgccttctt

SEQ ID NO: 661383 - DNA, 23 bp, Homo sapiens
agccctgatgtgtcctcagggag

SEQ ID NO: 661384 - DNA, 14 bp, Homo sapiens
agccctgcctgaga

SEQ ID NO: 661385 - DNA, 15 bp, Homo sapiens
agccctggcctggct

SEQ ID NO: 661386 - DNA, 12 bp, Homo sapiens
agccctggctgt

SEQ ID NO: 661387 - DNA, 22 bp, Homo sapiens
agccgcctgcttcttctctcca

SEQ ID NO: 661388 - DNA, 19 bp, Homo sapiens
agcctaaatttgtgctttt

SEQ ID NO: 661389 - DNA, 13 bp, Homo sapiens
agcctactctcct

SEQ ID NO: 661390 - DNA, 14 bp, Homo sapiens
agcctactctcctt

SEQ ID NO: 661391 - DNA, 13 bp, Homo sapiens
agcctcacttcct

SEQ ID NO: 661392 - DNA, 20 bp, Homo sapiens
agcctcacttcctttgccct

SEQ ID NO: 661393 - DNA, 22 bp, Homo sapiens
agcctcatacctacatcagaca

SEQ ID NO: 661394 - DNA, 22 bp, Homo sapiens
agcctcgctttttcatccttct

SEQ ID NO: 661395 - DNA, 23 bp, Homo sapiens
agcctggttcagacacagctctt

SEQ ID NO: 661396 - DNA, 15 bp, Homo sapiens
agccttaccttgaaa

SEQ ID NO: 661397 - DNA, 20 bp, Homo sapiens
agccttaccttgaaatgctg

SEQ ID NO: 661398 - DNA, 15 bp, Homo sapiens
agccttagggaagct

SEQ ID NO: 661399 - DNA, 22 bp, Homo sapiens
agccttagggaagctggcctga

SEQ ID NO: 661400 - DNA, 20 bp, Homo sapiens
agccttctccctagctcctc

SEQ ID NO: 661401 - DNA, 13 bp, Homo sapiens
agccttttgctct

SEQ ID NO: 661402 - DNA, 15 bp, Homo sapiens
agccttttgctctct

SEQ ID NO: 661403 - DNA, 16 bp, Homo sapiens
agccttttgctctctg

SEQ ID NO: 661404 - DNA, 18 bp, Homo sapiens
agcgaagacccggccagg

SEQ ID NO: 661405 - DNA, 18 bp, Homo sapiens
agcgatctctcctggcct

SEQ ID NO: 661406 - DNA, 16 bp, Homo sapiens
agcgcaggcagcgcag

SEQ ID NO: 661407 - DNA, 12 bp, Homo sapiens
agcgcagggctg

SEQ ID NO: 661408 - DNA, 13 bp, Homo sapiens
agcgcagggctgg

SEQ ID NO: 661409 - DNA, 17 bp, Homo sapiens
agcgcagggctggcacg

SEQ ID NO: 661410 - DNA, 17 bp, Homo sapiens
agcggccctaagggagt

SEQ ID NO: 661411 - DNA, 16 bp, Homo sapiens
agcgtcaagacatttg

SEQ ID NO: 661412 - DNA, 15 bp, Homo sapiens
agcgtccctggcgca

SEQ ID NO: 661413 - DNA, 17 bp, Homo sapiens
agcgtgtaagcttgtgt

SEQ ID NO: 661414 - DNA, 12 bp, Homo sapiens
agctaaatgctt

SEQ ID NO: 661415 - DNA, 21 bp, Homo sapiens
agctaagggtgggtgctcaga

SEQ ID NO: 661416 - DNA, 12 bp, Homo sapiens
agctaatttttg

SEQ ID NO: 661417 - DNA, 21 bp, Homo sapiens
agctacattttcagaagttaa

SEQ ID NO: 661418 - DNA, 17 bp, Homo sapiens
agctacttgggaggctg

SEQ ID NO: 661419 - DNA, 19 bp, Homo sapiens
agctagaaaaataaaatgt

SEQ ID NO: 661420 - DNA, 15 bp, Homo sapiens
agctagcttttagga

SEQ ID NO: 661421 - DNA, 16 bp, Homo sapiens
agctagtgtacctcct

SEQ ID NO: 661422 - DNA, 18 bp, Homo sapiens
agctagtgtacctcctct

SEQ ID NO: 661423 - DNA, 22 bp, Homo sapiens
agctagtgtacctcctctcagt

SEQ ID NO: 661424 - DNA, 23 bp, Homo sapiens
agctagtgtacctcctctcagtg

SEQ ID NO: 661425 - DNA, 14 bp, Homo sapiens
agctagtgtttcta

SEQ ID NO: 661426 - DNA, 23 bp, Homo sapiens
agctcaagaattgttagcaaatg

SEQ ID NO: 661427 - DNA, 11 bp, Homo sapiens
agctcaagttt

SEQ ID NO: 661428 - DNA, 17 bp, Homo sapiens
agctcaagtttaaaagc

SEQ ID NO: 661429 - DNA, 18 bp, Homo sapiens
agctcaagtttaaaagcc

SEQ ID NO: 661430 - DNA, 13 bp, Homo sapiens
agctcaatgcagt

SEQ ID NO: 661431 - DNA, 20 bp, Homo sapiens
agctcagccctggcctggct

SEQ ID NO: 661432 - DNA, 16 bp, Homo sapiens
agctccccagcccacc

SEQ ID NO: 661433 - DNA, 20 bp, Homo sapiens
agctccccagcccacctgct

SEQ ID NO: 661434 - DNA, 22 bp, Homo sapiens
agctccccagcccacctgctcc

SEQ ID NO: 661435 - DNA, 16 bp, Homo sapiens
agctcctcaactcacc

SEQ ID NO: 661436 - DNA, 13 bp, Homo sapiens
agctctgaaatct

SEQ ID NO: 661437 - DNA, 22 bp, Homo sapiens
agctcttcctatccctctccta

SEQ ID NO: 661438 - DNA, 13 bp, Homo sapiens
agctctttccaaa

SEQ ID NO: 661439 - DNA, 22 bp, Homo sapiens
agctctttccaaattaaaacaa

SEQ ID NO: 661440 - DNA, 12 bp, Homo sapiens
agggtctctccc

SEQ ID NO: 661441 - DNA, 16 bp, Homo sapiens
agggtctctccctcag

SEQ ID NO: 661442 - DNA, 10 bp, Homo sapiens
agggtctgag

SEQ ID NO: 661443 - DNA, 17 bp, Homo sapiens
agggtctgtttggactg

SEQ ID NO: 661444 - DNA, 18 bp, Homo sapiens
agggtctttggtgttttt

SEQ ID NO: 661445 - DNA, 23 bp, Homo sapiens
agggtgattttatgatcagtgtt

SEQ ID NO: 661446 - DNA, 23 bp, Homo sapiens
agggtggggggatttgtagcata

SEQ ID NO: 661447 - DNA, 15 bp, Homo sapiens
agggtgggtgctcag

SEQ ID NO: 661448 - DNA, 18 bp, Homo sapiens
agggtgggtgctcagaat

SEQ ID NO: 661449 - DNA, 20 bp, Homo sapiens
agggtgtgtttgaaatcatc

SEQ ID NO: 661450 - DNA, 14 bp, Homo sapiens
agggttcaaaatgt

SEQ ID NO: 661451 - DNA, 18 bp, Homo sapiens
agggttcaaaatgtctgt

SEQ ID NO: 661452 - DNA, 16 bp, Homo sapiens
agggtttgggcagagc

SEQ ID NO: 661453 - DNA, 22 bp, Homo sapiens
aggtaaatttttaggcaaagat

SEQ ID NO: 661454 - DNA, 23 bp, Homo sapiens
aggtaacactagggccttggaaa

SEQ ID NO: 661455 - DNA, 16 bp, Homo sapiens
aggtaacaggtgtgta

SEQ ID NO: 661456 - DNA, 20 bp, Homo sapiens
aggtaccctgggtgtccccg

SEQ ID NO: 661457 - DNA, 23 bp, Homo sapiens
aggtatggctctgcacccctctg

SEQ ID NO: 661458 - DNA, 20 bp, Homo sapiens
aggtattaaaactaaatttc

SEQ ID NO: 661459 - DNA, 18 bp, Homo sapiens
aggtcaagtaagaagaca

SEQ ID NO: 661460 - DNA, 20 bp, Homo sapiens
aggtcaataacactgtattt

SEQ ID NO: 661461 - DNA, 16 bp, Homo sapiens
aggtcagggagtgctg

SEQ ID NO: 661462 - DNA, 20 bp, Homo sapiens
aggtcagggagtgctggctc

SEQ ID NO: 661463 - DNA, 13 bp, Homo sapiens
aggtcgaggactg

SEQ ID NO: 661464 - DNA, 17 bp, Homo sapiens
aggtcgaggctacagtg

SEQ ID NO: 661465 - DNA, 19 bp, Homo sapiens
aggtgaaactccagatgcc

SEQ ID NO: 661466 - DNA, 22 bp, Homo sapiens
aggtgaaactccagatgccaca

SEQ ID NO: 661467 - DNA, 21 bp, Homo sapiens
aggtgaacattggttctttca

SEQ ID NO: 661468 - DNA, 15 bp, Homo sapiens
aggtgacttcctctg

SEQ ID NO: 661469 - DNA, 17 bp, Homo sapiens
aggtgacttcctctggt

SEQ ID NO: 661470 - DNA, 17 bp, Homo sapiens
aggtgattccagtgaag

SEQ ID NO: 661471 - DNA, 22 bp, Homo sapiens
aggtgattctcagggctggagc

SEQ ID NO: 661472 - DNA, 21 bp, Homo sapiens
aggtgcagaggtaccctgggt

SEQ ID NO: 661473 - DNA, 16 bp, Homo sapiens
aggtgctatgaagcca

SEQ ID NO: 661474 - DNA, 17 bp, Homo sapiens
aggtggaaggcagacag

SEQ ID NO: 661475 - DNA, 20 bp, Homo sapiens
aggtgggcagatcacttgag

SEQ ID NO: 661476 - DNA, 15 bp, Homo sapiens
aggtgggccttgcta

SEQ ID NO: 661477 - DNA, 22 bp, Homo sapiens
aggtgggccttgctacctcaag

SEQ ID NO: 661478 - DNA, 21 bp, Homo sapiens
aggtggttcagacaagacaga

SEQ ID NO: 661479 - DNA, 15 bp, Homo sapiens
aggtgtctgccttca

SEQ ID NO: 661480 - DNA, 14 bp, Homo sapiens
aggtgtgaatgcac

SEQ ID NO: 661481 - DNA, 20 bp, Homo sapiens
aggtgtgaatgcacgtttca

SEQ ID NO: 661482 - DNA, 20 bp, Homo sapiens
aggtgttctacactcatctt

SEQ ID NO: 661483 - DNA, 19 bp, Homo sapiens
aggtgttttttatgaagtg

SEQ ID NO: 661484 - DNA, 20 bp, Homo sapiens
aggttacccgagaagcactt

SEQ ID NO: 661485 - DNA, 17 bp, Homo sapiens
aggttgcctgaaaaatg

SEQ ID NO: 661486 - DNA, 18 bp, Homo sapiens
aggttgggctagagaaat

SEQ ID NO: 661487 - DNA, 14 bp, Homo sapiens
aggtttctctccct

SEQ ID NO: 661488 - DNA, 13 bp, Homo sapiens
agtaacaatctat

SEQ ID NO: 661489 - DNA, 19 bp, Homo sapiens
agtaacccccttaaattta

SEQ ID NO: 661490 - DNA, 12 bp, Homo sapiens
agtaacttagaa

SEQ ID NO: 661491 - DNA, 14 bp, Homo sapiens
agtaacttagaaaa

SEQ ID NO: 661492 - DNA, 16 bp, Homo sapiens
agtaacttatttgact

SEQ ID NO: 661493 - DNA, 16 bp, Homo sapiens
agtaatgcagttttta

SEQ ID NO: 661494 - DNA, 14 bp, Homo sapiens
agtaatggcagagc

SEQ ID NO: 661495 - DNA, 17 bp, Homo sapiens
agtaattcatctgtgaa

SEQ ID NO: 661496 - DNA, 18 bp, Homo sapiens
agtaattcatctgtgaat

SEQ ID NO: 661497 - DNA, 18 bp, Homo sapiens
agtaatttaatttgtaaa

SEQ ID NO: 661498 - DNA, 22 bp, Homo sapiens
agtaatttcatttaaatatctg

SEQ ID NO: 661499 - DNA, 19 bp, Homo sapiens
agtacacaattgttttacc

SEQ ID NO: 661500 - DNA, 15 bp, Homo sapiens
agtaccactcttggt

SEQ ID NO: 661501 - DNA, 21 bp, Homo sapiens
agtacctctcaagctagtgtt

SEQ ID NO: 661502 - DNA, 14 bp, Homo sapiens
agtacctgtgtgtt

SEQ ID NO: 661503 - DNA, 15 bp, Homo sapiens
agtacctgtgtgttt

SEQ ID NO: 661504 - DNA, 12 bp, Homo sapiens
agtaccttgctt

SEQ ID NO: 661505 - DNA, 14 bp, Homo sapiens
agtaccttgcttct

SEQ ID NO: 661506 - DNA, 15 bp, Homo sapiens
agtactctttaacat

SEQ ID NO: 661507 - DNA, 14 bp, Homo sapiens
agtacttctaagag

SEQ ID NO: 661508 - DNA, 13 bp, Homo sapiens
agtagcttgctcc

SEQ ID NO: 661509 - DNA, 17 bp, Homo sapiens
agtagcttgctccctgt

SEQ ID NO: 661510 - DNA, 18 bp, Homo sapiens
agtagcttgctccctgtg

SEQ ID NO: 661511 - DNA, 12 bp, Homo sapiens
agtagtgtggcc

SEQ ID NO: 661512 - DNA, 17 bp, Homo sapiens
agtataaccatatgata

SEQ ID NO: 661513 - DNA, 21 bp, Homo sapiens
agtataaccatatgatactat

SEQ ID NO: 661514 - DNA, 20 bp, Homo sapiens
agtatatcccaagtgcactt

SEQ ID NO: 661515 - DNA, 11 bp, Homo sapiens
agtatccaggc

SEQ ID NO: 661516 - DNA, 15 bp, Homo sapiens
agtatggtgtgttca

SEQ ID NO: 661517 - DNA, 14 bp, Homo sapiens
agtattataaattg

SEQ ID NO: 661518 - DNA, 21 bp, Homo sapiens
agtattataaattgtgtattt

SEQ ID NO: 661519 - DNA, 13 bp, Homo sapiens
acatcccattggg

SEQ ID NO: 661520 - DNA, 23 bp, Homo sapiens
acatccgcgtgtgcctgtgtgcg

SEQ ID NO: 661521 - DNA, 23 bp, Homo sapiens
acatctcccttttccatgactgt

SEQ ID NO: 661522 - DNA, 23 bp, Homo sapiens
acatctggaaagttttctccact

SEQ ID NO: 661523 - DNA, 18 bp, Homo sapiens
acatctggctgcacaggc

SEQ ID NO: 661524 - DNA, 22 bp, Homo sapiens
acatctggctggaaagcagagc

SEQ ID NO: 661525 - DNA, 16 bp, Homo sapiens
acatctgttatcaaac

SEQ ID NO: 661526 - DNA, 23 bp, Homo sapiens
acatcttgcattcaaaatcttca

SEQ ID NO: 661527 - DNA, 18 bp, Homo sapiens
acatgaaacctacacact

SEQ ID NO: 661528 - DNA, 19 bp, Homo sapiens
acatgaacacccttagaaa

SEQ ID NO: 661529 - DNA, 23 bp, Homo sapiens
acatgaagcaattagtctgaaac

SEQ ID NO: 661530 - DNA, 14 bp, Homo sapiens
acatgcaataaaat

SEQ ID NO: 661531 - DNA, 16 bp, Homo sapiens
acatgcaataaaattt

SEQ ID NO: 661532 - DNA, 21 bp, Homo sapiens
acatgcagctatttcaaagtg

SEQ ID NO: 661533 - DNA, 14 bp, Homo sapiens
acatgctgcctggc

SEQ ID NO: 661534 - DNA, 21 bp, Homo sapiens
acatgctgtatatgcaatgtc

SEQ ID NO: 661535 - DNA, 19 bp, Homo sapiens
acatggaattttttgaata

SEQ ID NO: 661536 - DNA, 18 bp, Homo sapiens
acatggttgtgacctgag

SEQ ID NO: 661537 - DNA, 17 bp, Homo sapiens
acatgtaataaaaagta

SEQ ID NO: 661538 - DNA, 19 bp, Homo sapiens
acatgtaataaaaagtata

SEQ ID NO: 661539 - DNA, 14 bp, Homo sapiens
acatgtactacagc

SEQ ID NO: 661540 - DNA, 17 bp, Homo sapiens
acatgtactacagctat

SEQ ID NO: 661541 - DNA, 19 bp, Homo sapiens
acatgtactacagctatat

SEQ ID NO: 661542 - DNA, 22 bp, Homo sapiens
acatgtactacagctatatttg

SEQ ID NO: 661543 - DNA, 15 bp, Homo sapiens
acatgtcaatctgtc

SEQ ID NO: 661544 - DNA, 20 bp, Homo sapiens
acatgtccagcaccttgtgc

SEQ ID NO: 661545 - DNA, 23 bp, Homo sapiens
acatgtccagcaccttgtgcctg

SEQ ID NO: 661546 - DNA, 14 bp, Homo sapiens
acatgtgaaaagaa

SEQ ID NO: 661547 - DNA, 17 bp, Homo sapiens
acatgtgaaaagaatag

SEQ ID NO: 661548 - DNA, 21 bp, Homo sapiens
acatgttatcaaatctgggta

SEQ ID NO: 661549 - DNA, 23 bp, Homo sapiens
acattaaatgcaataattttact

SEQ ID NO: 661550 - DNA, 14 bp, Homo sapiens
acattagagaacat

SEQ ID NO: 661551 - DNA, 19 bp, Homo sapiens
acattataacaactattta

SEQ ID NO: 661552 - DNA, 13 bp, Homo sapiens
acattatgaagaa

SEQ ID NO: 661553 - DNA, 14 bp, Homo sapiens
acattatgaagaat

SEQ ID NO: 661554 - DNA, 16 bp, Homo sapiens
acattatttctagtcc

SEQ ID NO: 661555 - DNA, 17 bp, Homo sapiens
acattgttcttattctg

SEQ ID NO: 661556 - DNA, 13 bp, Homo sapiens
acatttagatcct

SEQ ID NO: 661557 - DNA, 14 bp, Homo sapiens
acatttatatagac

SEQ ID NO: 661558 - DNA, 12 bp, Homo sapiens
acatttctataa

SEQ ID NO: 661559 - DNA, 15 bp, Homo sapiens
acatttgctgccatt

SEQ ID NO: 661560 - DNA, 16 bp, Homo sapiens
acatttgtaagtgtaa

SEQ ID NO: 661561 - DNA, 16 bp, Homo sapiens
acattttaaatactct

SEQ ID NO: 661562 - DNA, 14 bp, Homo sapiens
acattttacatgca

SEQ ID NO: 661563 - DNA, 16 bp, Homo sapiens
acattttctaaataaa

SEQ ID NO: 661564 - DNA, 13 bp, Homo sapiens
acattttggaaat

SEQ ID NO: 661565 - DNA, 16 bp, Homo sapiens
acattttggaaattgt

SEQ ID NO: 661566 - DNA, 14 bp, Homo sapiens
acattttttcttct

SEQ ID NO: 661567 - DNA, 23 bp, Homo sapiens
acatttttttgcatgcatgcaaa

SEQ ID NO: 661568 - DNA, 15 bp, Homo sapiens
accaaaaaaaggaag

SEQ ID NO: 661569 - DNA, 23 bp, Homo sapiens
accaaatacctcaatttttgttt

SEQ ID NO: 661570 - DNA, 13 bp, Homo sapiens
accaagaagcaaa

SEQ ID NO: 661571 - DNA, 21 bp, Homo sapiens
accaaggaaacgctacctctc

SEQ ID NO: 661572 - DNA, 12 bp, Homo sapiens
accaagtgaaat

SEQ ID NO: 661573 - DNA, 13 bp, Homo sapiens
accaagtgtgctc

SEQ ID NO: 661574 - DNA, 14 bp, Homo sapiens
accaagtgtgctct

SEQ ID NO: 661575 - DNA, 23 bp, Homo sapiens
accaagtgtgctctttttttaaa

SEQ ID NO: 661576 - DNA, 16 bp, Homo sapiens
accaatgaaaacatgt

SEQ ID NO: 661577 - DNA, 14 bp, Homo sapiens
accacaaatgcata

SEQ ID NO: 661578 - DNA, 13 bp, Homo sapiens
accacacttgaaa

SEQ ID NO: 661579 - DNA, 21 bp, Homo sapiens
accactatctccgttccatct

SEQ ID NO: 661580 - DNA, 14 bp, Homo sapiens
accactcaggccac

SEQ ID NO: 661581 - DNA, 17 bp, Homo sapiens
accactcgtgcatccct

SEQ ID NO: 661582 - DNA, 16 bp, Homo sapiens
accagagtcagcacag

SEQ ID NO: 661583 - DNA, 17 bp, Homo sapiens
accagagtcagcacagg

SEQ ID NO: 661584 - DNA, 16 bp, Homo sapiens
accaggcacctcttcc

SEQ ID NO: 661585 - DNA, 17 bp, Homo sapiens
accaggcacctcttcct

SEQ ID NO: 661586 - DNA, 16 bp, Homo sapiens
accagggccttttctg

SEQ ID NO: 661587 - DNA, 21 bp, Homo sapiens
accagggccttttctggcacc

SEQ ID NO: 661588 - DNA, 17 bp, Homo sapiens
accagtacttctaagag

SEQ ID NO: 661589 - DNA, 18 bp, Homo sapiens
accagtgcgattctggat

SEQ ID NO: 661590 - DNA, 18 bp, Homo sapiens
accataattttttttaaa

SEQ ID NO: 661591 - DNA, 17 bp, Homo sapiens
accatactaataaatat

SEQ ID NO: 661592 - DNA, 21 bp, Homo sapiens
accatactaataaatataatt

SEQ ID NO: 661593 - DNA, 13 bp, Homo sapiens
accatatgatact

SEQ ID NO: 661594 - DNA, 15 bp, Homo sapiens
accatcaagaaccta

SEQ ID NO: 661595 - DNA, 15 bp, Homo sapiens
accatccagctcccc

SEQ ID NO: 661596 - DNA, 17 bp, Homo sapiens
accatccagctccccag

SEQ ID NO: 661597 - DNA, 22 bp, Homo sapiens
accatccagctccccagcccac

SEQ ID NO: 661598 - DNA, 17 bp, Homo sapiens
accatgcctcccagagc

SEQ ID NO: 661599 - DNA, 12 bp, Homo sapiens
accattattttt

SEQ ID NO: 661600 - DNA, 14 bp, Homo sapiens
accattcaattagt

SEQ ID NO: 661601 - DNA, 23 bp, Homo sapiens
accattcagatcactgaatttat

SEQ ID NO: 661602 - DNA, 21 bp, Homo sapiens
accattttgtaaatgaaactt

SEQ ID NO: 661603 - DNA, 18 bp, Homo sapiens
acccaaagctgagcctgc

SEQ ID NO: 661604 - DNA, 15 bp, Homo sapiens
acccacattactttt

SEQ ID NO: 661605 - DNA, 17 bp, Homo sapiens
acccaccacccccttta

SEQ ID NO: 661606 - DNA, 18 bp, Homo sapiens
acccacctctcctgccct

SEQ ID NO: 661607 - DNA, 14 bp, Homo sapiens
acccagcaggcaga

SEQ ID NO: 661608 - DNA, 19 bp, Homo sapiens
acccatcagttccagcctt

SEQ ID NO: 661609 - DNA, 12 bp, Homo sapiens
acccatgtcacc

SEQ ID NO: 661610 - DNA, 21 bp, Homo sapiens
acccattaaggggaagaatga

SEQ ID NO: 661611 - DNA, 20 bp, Homo sapiens
accccccactcagtgcctcc

SEQ ID NO: 661612 - DNA, 17 bp, Homo sapiens
accccctcacccctcca

SEQ ID NO: 661613 - DNA, 23 bp, Homo sapiens
accccctccaccccccactcagt

SEQ ID NO: 661614 - DNA, 14 bp, Homo sapiens
acccctctcgcctc

SEQ ID NO: 661615 - DNA, 17 bp, Homo sapiens
acccctctcgcctcatt

SEQ ID NO: 661616 - DNA, 16 bp, Homo sapiens
acccctgactcatcat

SEQ ID NO: 661617 - DNA, 15 bp, Homo sapiens
acccctgtaggcctc

SEQ ID NO: 661618 - DNA, 17 bp, Homo sapiens
acccctgtaggcctcag

SEQ ID NO: 661619 - DNA, 21 bp, Homo sapiens
acccgatttgtttatttgcaa

SEQ ID NO: 661620 - DNA, 14 bp, Homo sapiens
accctccttttctc

SEQ ID NO: 661621 - DNA, 14 bp, Homo sapiens
accctgaggtcagg

SEQ ID NO: 661622 - DNA, 16 bp, Homo sapiens
accctgctgctggtgc

SEQ ID NO: 661623 - DNA, 19 bp, Homo sapiens
accctgctgctggtgcaca

SEQ ID NO: 661624 - DNA, 19 bp, Homo sapiens
accctgggctacagaaacc

SEQ ID NO: 661625 - DNA, 18 bp, Homo sapiens
accctgggggcacaggag

SEQ ID NO: 661626 - DNA, 22 bp, Homo sapiens
accctgggggcacaggaggcag

SEQ ID NO: 661627 - DNA, 14 bp, Homo sapiens
accctgtcctgcag

SEQ ID NO: 661628 - DNA, 23 bp, Homo sapiens
accctgtcctgcagtcccacact

SEQ ID NO: 661629 - DNA, 21 bp, Homo sapiens
acccttgcaccgtcctcagca

SEQ ID NO: 661630 - DNA, 17 bp, Homo sapiens
acccttttcccccttcc

SEQ ID NO: 661631 - DNA, 18 bp, Homo sapiens
accgagaaggtttatccc

SEQ ID NO: 661632 - DNA, 22 bp, Homo sapiens
accgagagcttggactacacaa

SEQ ID NO: 661633 - DNA, 14 bp, Homo sapiens
accgaggggccttt

SEQ ID NO: 661634 - DNA, 15 bp, Homo sapiens
accgaggggcctttg

SEQ ID NO: 661635 - DNA, 21 bp, Homo sapiens
accgaggggcctttgttctgg

SEQ ID NO: 661636 - DNA, 12 bp, Homo sapiens
accggcaggtgc

SEQ ID NO: 661637 - DNA, 15 bp, Homo sapiens
accggtcagtgcctt

SEQ ID NO: 661638 - DNA, 17 bp, Homo sapiens
accgtgtctgtctggca

SEQ ID NO: 661639 - DNA, 20 bp, Homo sapiens
acctaacaacattgtagcct

SEQ ID NO: 661640 - DNA, 19 bp, Homo sapiens
acctaatgtttatgagcca

SEQ ID NO: 661641 - DNA, 16 bp, Homo sapiens
acctacagactccatc

SEQ ID NO: 661642 - DNA, 19 bp, Homo sapiens
actatgatttaatttgaaa

SEQ ID NO: 661643 - DNA, 23 bp, Homo sapiens
actatgtatgtatgtattattat

SEQ ID NO: 661644 - DNA, 13 bp, Homo sapiens
actatgttcctaa

SEQ ID NO: 661645 - DNA, 17 bp, Homo sapiens
actattatctaaaagaa

SEQ ID NO: 661646 - DNA, 16 bp, Homo sapiens
actattgtgccaactg

SEQ ID NO: 661647 - DNA, 16 bp, Homo sapiens
actatttaagatgtga

SEQ ID NO: 661648 - DNA, 19 bp, Homo sapiens
actatttatatcacacaat

SEQ ID NO: 661649 - DNA, 15 bp, Homo sapiens
actcaaaaaaacaaa

SEQ ID NO: 661650 - DNA, 17 bp, Homo sapiens
actcaattatttgcata

SEQ ID NO: 661651 - DNA, 12 bp, Homo sapiens
actttattatcc

SEQ ID NO: 661652 - DNA, 15 bp, Homo sapiens
actttcatctacctt

SEQ ID NO: 661653 - DNA, 21 bp, Homo sapiens
actttccgaaaaataaagaca

SEQ ID NO: 661654 - DNA, 14 bp, Homo sapiens
actttcctcccatt

SEQ ID NO: 661655 - DNA, 17 bp, Homo sapiens
actttctaatgtttctg

SEQ ID NO: 661656 - DNA, 22 bp, Homo sapiens
actttctcctggcccctgcctg

SEQ ID NO: 661657 - DNA, 18 bp, Homo sapiens
actttctgttatgggctt

SEQ ID NO: 661658 - DNA, 20 bp, Homo sapiens
actttgaagtgcagctcatg

SEQ ID NO: 661659 - DNA, 22 bp, Homo sapiens
actttgaagtgcagctcatgtt

SEQ ID NO: 661660 - DNA, 19 bp, Homo sapiens
actttgccactgctgtatt

SEQ ID NO: 661661 - DNA, 22 bp, Homo sapiens
actttggacaggagttaattaa

SEQ ID NO: 661662 - DNA, 22 bp, Homo sapiens
actttggccattacccccagct

SEQ ID NO: 661663 - DNA, 15 bp, Homo sapiens
actttggcttatgaa

SEQ ID NO: 661664 - DNA, 18 bp, Homo sapiens
actttgggatatggtctt

SEQ ID NO: 661665 - DNA, 19 bp, Homo sapiens
actttgggattctttccat

SEQ ID NO: 661666 - DNA, 20 bp, Homo sapiens
actttgtcgtggttcttaaa

SEQ ID NO: 661667 - DNA, 22 bp, Homo sapiens
actttgtcgtggttcttaaatg

SEQ ID NO: 661668 - DNA, 13 bp, Homo sapiens
actttgtgactgt

SEQ ID NO: 661669 - DNA, 12 bp, Homo sapiens
actttgtgagcc

SEQ ID NO: 661670 - DNA, 14 bp, Homo sapiens
acttttataaagca

SEQ ID NO: 661671 - DNA, 17 bp, Homo sapiens
acttttataaagcatgt

SEQ ID NO: 661672 - DNA, 16 bp, Homo sapiens
acttttgttaaattca

SEQ ID NO: 661673 - DNA, 16 bp, Homo sapiens
actttttaagtttgaa

SEQ ID NO: 661674 - DNA, 22 bp, Homo sapiens
actttttatgggtgaaaataag

SEQ ID NO: 661675 - DNA, 20 bp, Homo sapiens
acttttttgtggcaattagt

SEQ ID NO: 661676 - DNA, 15 bp, Homo sapiens
actttttttaaccat

SEQ ID NO: 661677 - DNA, 16 bp, Homo sapiens
actttttttaaccatt

SEQ ID NO: 661678 - DNA, 15 bp, Homo sapiens
agaaaaataaaatgt

SEQ ID NO: 661679 - DNA, 14 bp, Homo sapiens
agaaaactgtgatt

SEQ ID NO: 661680 - DNA, 13 bp, Homo sapiens
agaaaagaaaaat

SEQ ID NO: 661681 - DNA, 21 bp, Homo sapiens
agaaaagtgcatatttatcca

SEQ ID NO: 661682 - DNA, 11 bp, Homo sapiens
agaaaatatat

SEQ ID NO: 661683 - DNA, 16 bp, Homo sapiens
agaaaatatatgcctg

SEQ ID NO: 661684 - DNA, 23 bp, Homo sapiens
agaaaatatttaatatcaaaaga

SEQ ID NO: 661685 - DNA, 11 bp, Homo sapiens
agaaaatcttt

SEQ ID NO: 661686 - DNA, 13 bp, Homo sapiens
agaaaatgtcagt

SEQ ID NO: 661687 - DNA, 23 bp, Homo sapiens
agaaaattcttgagaagtaactg

SEQ ID NO: 661688 - DNA, 15 bp, Homo sapiens
agaaaattgatattt

SEQ ID NO: 661689 - DNA, 23 bp, Homo sapiens
agaaaattgatatttttatacaa

SEQ ID NO: 661690 - DNA, 15 bp, Homo sapiens
agaaaatttgcttta

SEQ ID NO: 661691 - DNA, 19 bp, Homo sapiens
agaaacaaaaatcaaactt

SEQ ID NO: 661692 - DNA, 22 bp, Homo sapiens
agaaaccacagtcttcccagca

SEQ ID NO: 661693 - DNA, 22 bp, Homo sapiens
agaaagaatttagtattatcaa

SEQ ID NO: 661694 - DNA, 17 bp, Homo sapiens
agaaagcatatcccacc

SEQ ID NO: 661695 - DNA, 16 bp, Homo sapiens
agaaaggggagaatgt

SEQ ID NO: 661696 - DNA, 19 bp, Homo sapiens
agaaagtcaaaaaattatt

SEQ ID NO: 661697 - DNA, 22 bp, Homo sapiens
agaaagtgggcttaatggagtt

SEQ ID NO: 661698 - DNA, 17 bp, Homo sapiens
agaaataatgctacaat

SEQ ID NO: 661699 - DNA, 17 bp, Homo sapiens
agaaatataacacattt

SEQ ID NO: 661700 - DNA, 22 bp, Homo sapiens
agaaatctggtcttgttagaaa

SEQ ID NO: 661701 - DNA, 19 bp, Homo sapiens
agaaatgcaataactctgg

SEQ ID NO: 661702 - DNA, 21 bp, Homo sapiens
agaaatgcaataactctggga

SEQ ID NO: 661703 - DNA, 20 bp, Homo sapiens
agaaatgtaattatgttcta

SEQ ID NO: 661704 - DNA, 20 bp, Homo sapiens
agaaattactaattttactt

SEQ ID NO: 661705 - DNA, 12 bp, Homo sapiens
agaacaaaactt

SEQ ID NO: 661706 - DNA, 13 bp, Homo sapiens
agaacaaaacttc

SEQ ID NO: 661707 - DNA, 16 bp, Homo sapiens
agaacagatcttttac

SEQ ID NO: 661708 - DNA, 19 bp, Homo sapiens
agaaccaaaaatcccacct

SEQ ID NO: 661709 - DNA, 22 bp, Homo sapiens
agaaccaaagcaaccacaaatg

SEQ ID NO: 661710 - DNA, 13 bp, Homo sapiens
agaacctaacatg

SEQ ID NO: 661711 - DNA, 20 bp, Homo sapiens
agaacctacagactccatct

SEQ ID NO: 661712 - DNA, 16 bp, Homo sapiens
agaacgctgatttaaa

SEQ ID NO: 661713 - DNA, 21 bp, Homo sapiens
agaacgcttcgggaaaatatt

SEQ ID NO: 661714 - DNA, 24 bp, Homo sapiens
agaacgcttcgggaaaatattcat

SEQ ID NO: 661715 - DNA, 16 bp, Homo sapiens
agaactgaagtgtgct

SEQ ID NO: 661716 - DNA, 13 bp, Homo sapiens
agaactggaggca

SEQ ID NO: 661717 - DNA, 17 bp, Homo sapiens
agaagaaccaaatacct

SEQ ID NO: 661718 - DNA, 19 bp, Homo sapiens
agaagaaccaaatacctca

SEQ ID NO: 661719 - DNA, 18 bp, Homo sapiens
agaagacatactgcttga

SEQ ID NO: 661720 - DNA, 16 bp, Homo sapiens
agaagacatgaaccaa

SEQ ID NO: 661721 - DNA, 10 bp, Homo sapiens
agaagacatt

SEQ ID NO: 661722 - DNA, 11 bp, Homo sapiens
agaagacattt

SEQ ID NO: 661723 - DNA, 19 bp, Homo sapiens
agaagagatgagaaatgat

SEQ ID NO: 661724 - DNA, 17 bp, Homo sapiens
agaagagggtgtgtttg

SEQ ID NO: 661725 - DNA, 20 bp, Homo sapiens
agaagcaaagttcaacttat

SEQ ID NO: 661726 - DNA, 13 bp, Homo sapiens
agaagcatgaaaa

SEQ ID NO: 661727 - DNA, 15 bp, Homo sapiens
agaagcatgaaaaag

SEQ ID NO: 661728 - DNA, 16 bp, Homo sapiens
agaagcatgaaaaagc

SEQ ID NO: 661729 - DNA, 22 bp, Homo sapiens
agaagccaatctacaatctctt

SEQ ID NO: 661730 - DNA, 13 bp, Homo sapiens
agaagccctgatg

SEQ ID NO: 661731 - DNA, 14 bp, Homo sapiens
agaagcctgtttca

SEQ ID NO: 661732 - DNA, 19 bp, Homo sapiens
agaagctgctccaggcctg

SEQ ID NO: 661733 - DNA, 23 bp, Homo sapiens
agaagctttagcttcattttact

SEQ ID NO: 661734 - DNA, 12 bp, Homo sapiens
agaagctttatc

SEQ ID NO: 661735 - DNA, 16 bp, Homo sapiens
agaaggtttattgtta

SEQ ID NO: 661736 - DNA, 18 bp, Homo sapiens
agaaggtttattgttaat

SEQ ID NO: 661737 - DNA, 20 bp, Homo sapiens
agaagtaagaggctacctct

SEQ ID NO: 661738 - DNA, 14 bp, Homo sapiens
agaagtgagcaaaa

SEQ ID NO: 661739 - DNA, 13 bp, Homo sapiens
agaagttgtttga

SEQ ID NO: 661740 - DNA, 15 bp, Homo sapiens
agaataaaaactttt

SEQ ID NO: 661741 - DNA, 17 bp, Homo sapiens
agaataaaaacttttga

SEQ ID NO: 661742 - DNA, 23 bp, Homo sapiens
agaataagacaagagatctacac

SEQ ID NO: 661743 - DNA, 15 bp, Homo sapiens
agaatacccaggaag

SEQ ID NO: 661744 - DNA, 16 bp, Homo sapiens
agaatacccaggaaga

SEQ ID NO: 661745 - DNA, 21 bp, Homo sapiens
agaatacccaggaagactttg

SEQ ID NO: 661746 - DNA, 11 bp, Homo sapiens
agaatatacct

SEQ ID NO: 661747 - DNA, 13 bp, Homo sapiens
agaatatacctta

SEQ ID NO: 661748 - DNA, 21 bp, Homo sapiens
agaatatcctttaaaatttaa

SEQ ID NO: 661749 - DNA, 16 bp, Homo sapiens
agaatctcttcatgct

SEQ ID NO: 661750 - DNA, 22 bp, Homo sapiens
agaatgagtccttgatttcaaa

SEQ ID NO: 661751 - DNA, 17 bp, Homo sapiens
agaatgctggcaaaggc

SEQ ID NO: 661752 - DNA, 19 bp, Homo sapiens
agaatgtaaagttatgtat

SEQ ID NO: 661753 - DNA, 21 bp, Homo sapiens
agaatgtaaagttatgtattt

SEQ ID NO: 661754 - DNA, 21 bp, Homo sapiens
agaatgtacgtccagcctgcc

SEQ ID NO: 661755 - DNA, 20 bp, Homo sapiens
agaatgttactgactcctca

SEQ ID NO: 661756 - DNA, 17 bp, Homo sapiens
agaattagtgccagaat

SEQ ID NO: 661757 - DNA, 19 bp, Homo sapiens
agaattagtgccagaattt

SEQ ID NO: 661758 - DNA, 18 bp, Homo sapiens
agaattatttttaaaaag

SEQ ID NO: 661759 - DNA, 15 bp, Homo sapiens
agaattctgattgat

SEQ ID NO: 661760 - DNA, 13 bp, Homo sapiens
agaattggctcaa

SEQ ID NO: 661761 - DNA, 16 bp, Homo sapiens
agaattggctcaataa

SEQ ID NO: 661762 - DNA, 19 bp, Homo sapiens
agaatttaccatcatctct

SEQ ID NO: 661763 - DNA, 19 bp, Homo sapiens
agaatttagtattatcaaa

SEQ ID NO: 661764 - DNA, 21 bp, Homo sapiens
agacaaaaacaagtaaatata

SEQ ID NO: 661765 - DNA, 14 bp, Homo sapiens
agacaaagatttct

SEQ ID NO: 661766 - DNA, 14 bp, Homo sapiens
agacaaatggagga

SEQ ID NO: 661767 - DNA, 18 bp, Homo sapiens
agacaagacagaggggag

SEQ ID NO: 661768 - DNA, 20 bp, Homo sapiens
agacaagagatctacacatg

SEQ ID NO: 661769 - DNA, 21 bp, Homo sapiens
agacaagagatctacacatgt

SEQ ID NO: 661770 - DNA, 24 bp, Homo sapiens
agacaagagatctacacatgttgc

SEQ ID NO: 661771 - DNA, 18 bp, Homo sapiens
agacaatatgtgagtgcc

SEQ ID NO: 661772 - DNA, 14 bp, Homo sapiens
agacaatgttttct

SEQ ID NO: 661773 - DNA, 19 bp, Homo sapiens
agtattatagacaaaagaa

SEQ ID NO: 661774 - DNA, 17 bp, Homo sapiens
agtattatcaaagggat

SEQ ID NO: 661775 - DNA, 12 bp, Homo sapiens
agtattgtttaa

SEQ ID NO: 661776 - DNA, 21 bp, Homo sapiens
agtattttcctgttgtcaaga

SEQ ID NO: 661777 - DNA, 22 bp, Homo sapiens
agtattttctccacttcatttt

SEQ ID NO: 661778 - DNA, 23 bp, Homo sapiens
agtattttcttctctgtgagaag

SEQ ID NO: 661779 - DNA, 11 bp, Homo sapiens
agtatttttgg

SEQ ID NO: 661780 - DNA, 20 bp, Homo sapiens
agtatttttgggctattgca

SEQ ID NO: 661781 - DNA, 20 bp, Homo sapiens
agtcaaaaaattatttgcta

SEQ ID NO: 661782 - DNA, 21 bp, Homo sapiens
agtcacccctttctgtcccac

SEQ ID NO: 661783 - DNA, 18 bp, Homo sapiens
agtcagccaggagctgtc

SEQ ID NO: 661784 - DNA, 16 bp, Homo sapiens
agtcatctactttttt

SEQ ID NO: 661785 - DNA, 12 bp, Homo sapiens
agtcatttttgt

SEQ ID NO: 661786 - DNA, 18 bp, Homo sapiens
agtcccacactgtgcaga

SEQ ID NO: 661787 - DNA, 21 bp, Homo sapiens
agtcccacactgtggccaggc

SEQ ID NO: 661788 - DNA, 19 bp, Homo sapiens
agtcccagagcacctcacc

SEQ ID NO: 661789 - DNA, 19 bp, Homo sapiens
agtccctataataaaggct

SEQ ID NO: 661790 - DNA, 20 bp, Homo sapiens
agtccctataataaaggctg

SEQ ID NO: 661791 - DNA, 22 bp, Homo sapiens
agtccctcttctggtttccctt

SEQ ID NO: 661792 - DNA, 17 bp, Homo sapiens
agtccgcagaagccctg

SEQ ID NO: 661793 - DNA, 18 bp, Homo sapiens
agtccgcagaagccctga

SEQ ID NO: 661794 - DNA, 21 bp, Homo sapiens
cagaggtgcttcaccctgagt

SEQ ID NO: 661795 - DNA, 15 bp, Homo sapiens
cagagtcagcacagg

SEQ ID NO: 661796 - DNA, 14 bp, Homo sapiens
cagagttttcatta

SEQ ID NO: 661797 - DNA, 22 bp, Homo sapiens
cagagttttcattaaatccttt

SEQ ID NO: 661798 - DNA, 22 bp, Homo sapiens
cagataccttatcttacaatat

SEQ ID NO: 661799 - DNA, 18 bp, Homo sapiens
cagataccttgaaaggaa

SEQ ID NO: 661800 - DNA, 21 bp, Homo sapiens
cagatactttgaagtgcagct

SEQ ID NO: 661801 - DNA, 23 bp, Homo sapiens
cagatactttgaagtgcagctca

SEQ ID NO: 661802 - DNA, 17 bp, Homo sapiens
cagatcctttgaaaaga

SEQ ID NO: 661803 - DNA, 13 bp, Homo sapiens
cagatctgcatct

SEQ ID NO: 661804 - DNA, 20 bp, Homo sapiens
cagatctttcagaaatataa

SEQ ID NO: 661805 - DNA, 18 bp, Homo sapiens
cagatggaaaaactgagg

SEQ ID NO: 661806 - DNA, 22 bp, Homo sapiens
cagatggtttccacatttagat

SEQ ID NO: 661807 - DNA, 17 bp, Homo sapiens
cagatgttagatatttt

SEQ ID NO: 661808 - DNA, 13 bp, Homo sapiens
cagattacactga

SEQ ID NO: 661809 - DNA, 14 bp, Homo sapiens
cagattgaaaagga

SEQ ID NO: 661810 - DNA, 20 bp, Homo sapiens
cagcacacacttacagagca

SEQ ID NO: 661811 - DNA, 15 bp, Homo sapiens
cagcacactggactc

SEQ ID NO: 661812 - DNA, 23 bp, Homo sapiens
cagcacattcgggaccaatatat

SEQ ID NO: 661813 - DNA, 18 bp, Homo sapiens
cagcaccgaggggccttt

SEQ ID NO: 661814 - DNA, 18 bp, Homo sapiens
cagcaccttgtgcctggg

SEQ ID NO: 661815 - DNA, 13 bp, Homo sapiens
cagcagcttctcc

SEQ ID NO: 661816 - DNA, 21 bp, Homo sapiens
cagcaggagtggtgcagacag

SEQ ID NO: 661817 - DNA, 11 bp, Homo sapiens
cagcaggcaga

SEQ ID NO: 661818 - DNA, 15 bp, Homo sapiens
cagcaggcagagtgg

SEQ ID NO: 661819 - DNA, 16 bp, Homo sapiens
cagcaggctagacaga

SEQ ID NO: 661820 - DNA, 19 bp, Homo sapiens
cagcagggaacaaaactcc

SEQ ID NO: 661821 - DNA, 20 bp, Homo sapiens
cagcaggtctagaagaacaa

SEQ ID NO: 661822 - DNA, 21 bp, Homo sapiens
cagcatctaaagcagcaggtc

SEQ ID NO: 661823 - DNA, 22 bp, Homo sapiens
cagcatgtgtatttccagtgca

SEQ ID NO: 661824 - DNA, 22 bp, Homo sapiens
cagcatttagctggccacatgg

SEQ ID NO: 661825 - DNA, 18 bp, Homo sapiens
cagcatttccttgtcccg

SEQ ID NO: 661826 - DNA, 21 bp, Homo sapiens
cagccagcccatggcccccaa

SEQ ID NO: 661827 - DNA, 15 bp, Homo sapiens
cagcccacctgctcc

SEQ ID NO: 661828 - DNA, 18 bp, Homo sapiens
cagcccacctgctcccag

SEQ ID NO: 661829 - DNA, 21 bp, Homo sapiens
cagcccatggcccccaataaa

SEQ ID NO: 661830 - DNA, 22 bp, Homo sapiens
cagcccatggcccccaataaag

SEQ ID NO: 661831 - DNA, 23 bp, Homo sapiens
cagccctaagtggctgccttctt

SEQ ID NO: 661832 - DNA, 15 bp, Homo sapiens
cagccctgcctgaga

SEQ ID NO: 661833 - DNA, 15 bp, Homo sapiens
cagccggtcagagga

SEQ ID NO: 661834 - DNA, 16 bp, Homo sapiens
cagcctcacttccttt

SEQ ID NO: 661835 - DNA, 19 bp, Homo sapiens
cagcctcgcgggtgtcaca

SEQ ID NO: 661836 - DNA, 15 bp, Homo sapiens
cagccttctctcaag

SEQ ID NO: 661837 - DNA, 19 bp, Homo sapiens
cagccttgagccctggctg

SEQ ID NO: 661838 - DNA, 14 bp, Homo sapiens
cagccttgggaccg

SEQ ID NO: 661839 - DNA, 13 bp, Homo sapiens
cagcgcagggctg

SEQ ID NO: 661840 - DNA, 19 bp, Homo sapiens
cagcgcagggctggcacgt

SEQ ID NO: 661841 - DNA, 13 bp, Homo sapiens
cagcgtccctggc

SEQ ID NO: 661842 - DNA, 18 bp, Homo sapiens
cagctaatttttgtattt

SEQ ID NO: 661843 - DNA, 19 bp, Homo sapiens
cagctactaatgatgtttt

SEQ ID NO: 661844 - DNA, 15 bp, Homo sapiens
cagctacttgggagg

SEQ ID NO: 661845 - DNA, 16 bp, Homo sapiens
cagctacttgggaggc

SEQ ID NO: 661846 - DNA, 18 bp, Homo sapiens
cagctataattctgttat

SEQ ID NO: 661847 - DNA, 15 bp, Homo sapiens
cagctatatttgatt

SEQ ID NO: 661848 - DNA, 20 bp, Homo sapiens
cagctcagccctggcctggc

SEQ ID NO: 661849 - DNA, 20 bp, Homo sapiens
cagctccccagcccacctgc

SEQ ID NO: 661850 - DNA, 14 bp, Homo sapiens
cagctctttccaaa

SEQ ID NO: 661851 - DNA, 16 bp, Homo sapiens
cagctctttccaaatt

SEQ ID NO: 661852 - DNA, 19 bp, Homo sapiens
cagctctttccaaattaaa

SEQ ID NO: 661853 - DNA, 17 bp, Homo sapiens
cagctgaatgcctcctg

SEQ ID NO: 661854 - DNA, 20 bp, Homo sapiens
cagctgaatgcctcctgtgg

SEQ ID NO: 661855 - DNA, 21 bp, Homo sapiens
cagctgaatgcctcctgtggg

SEQ ID NO: 661856 - DNA, 14 bp, Homo sapiens
cagctgagaggctg

SEQ ID NO: 661857 - DNA, 21 bp, Homo sapiens
cagctgcccttccgcagtgtg

SEQ ID NO: 661858 - DNA, 14 bp, Homo sapiens
cagctgcctcctgc

SEQ ID NO: 661859 - DNA, 14 bp, Homo sapiens
cagctgcctctgct

SEQ ID NO: 661860 - DNA, 19 bp, Homo sapiens
cagctgcctctgctccctc

SEQ ID NO: 661861 - DNA, 18 bp, Homo sapiens
cagctgctatccccatct

SEQ ID NO: 661862 - DNA, 23 bp, Homo sapiens
cagctgctatccccatctccctg

SEQ ID NO: 661863 - DNA, 15 bp, Homo sapiens
cagctgggagcctgg

SEQ ID NO: 661864 - DNA, 16 bp, Homo sapiens
cagctgggagcctggt

SEQ ID NO: 661865 - DNA, 16 bp, Homo sapiens
cagctgtcaaggctca

SEQ ID NO: 661866 - DNA, 13 bp, Homo sapiens
cagctgtttgaaa

SEQ ID NO: 661867 - DNA, 17 bp, Homo sapiens
cagctgtttgaaatgtt

SEQ ID NO: 661868 - DNA, 21 bp, Homo sapiens
cagctgtttgaaatgtttaat

SEQ ID NO: 661869 - DNA, 23 bp, Homo sapiens
cagctgtttgaaatgtttaataa

SEQ ID NO: 661870 - DNA, 18 bp, Homo sapiens
cagcttatctcttttata

SEQ ID NO: 661871 - DNA, 21 bp, Homo sapiens
cagcttatctcttttatattt

SEQ ID NO: 661872 - DNA, 16 bp, Homo sapiens
cagcttctactcctgc

SEQ ID NO: 661873 - DNA, 17 bp, Homo sapiens
cagcttctactcctgcc

SEQ ID NO: 661874 - DNA, 18 bp, Homo sapiens
cagcttctactcctgcct

SEQ ID NO: 661875 - DNA, 17 bp, Homo sapiens
cagcttggccctttcct

SEQ ID NO: 661876 - DNA, 21 bp, Homo sapiens
caggaacctgtcctaaggaac

SEQ ID NO: 661877 - DNA, 19 bp, Homo sapiens
caggaagactttgtgactg

SEQ ID NO: 661878 - DNA, 18 bp, Homo sapiens
caggaccctgtcctgcag

SEQ ID NO: 661879 - DNA, 14 bp, Homo sapiens
caggactcctggca

SEQ ID NO: 661880 - DNA, 15 bp, Homo sapiens
caggactcctggcag

SEQ ID NO: 661881 - DNA, 16 bp, Homo sapiens
caggactcctggcagg

SEQ ID NO: 661882 - DNA, 20 bp, Homo sapiens
caggactcctggcagggcca

SEQ ID NO: 661883 - DNA, 20 bp, Homo sapiens
caggagagaaaactgcctga

SEQ ID NO: 661884 - DNA, 15 bp, Homo sapiens
caggagcttcttcgt

SEQ ID NO: 661885 - DNA, 12 bp, Homo sapiens
caggaggcaggc

SEQ ID NO: 661886 - DNA, 23 bp, Homo sapiens
caggaggcaggcatggccctggg

SEQ ID NO: 661887 - DNA, 22 bp, Homo sapiens
caggagggtatggtgctgctct

SEQ ID NO: 661888 - DNA, 14 bp, Homo sapiens
caggaggtgtgaat

SEQ ID NO: 661889 - DNA, 13 bp, Homo sapiens
caggagttctgaa

SEQ ID NO: 661890 - DNA, 23 bp, Homo sapiens
caggataagaaagcctaaaattg

SEQ ID NO: 661891 - DNA, 13 bp, Homo sapiens
caggcaccgagaa

SEQ ID NO: 661892 - DNA, 17 bp, Homo sapiens
caggcaccgagaatgtt

SEQ ID NO: 661893 - DNA, 19 bp, Homo sapiens
caggcagcgcagggctggc

SEQ ID NO: 661894 - DNA, 21 bp, Homo sapiens
caggcagcttctactcctgcc

SEQ ID NO: 661895 - DNA, 16 bp, Homo sapiens
caggcaggcggctcct

SEQ ID NO: 661896 - DNA, 19 bp, Homo sapiens
caggcaggcggctcctcct

SEQ ID NO: 661897 - DNA, 22 bp, Homo sapiens
caggcaggctttctgggtgtga

SEQ ID NO: 661898 - DNA, 17 bp, Homo sapiens
caggcatggccctgggc

SEQ ID NO: 661899 - DNA, 18 bp, Homo sapiens
caggcatggccctgggcg

SEQ ID NO: 661900 - DNA, 20 bp, Homo sapiens
caggcattgaggaagagtct

SEQ ID NO: 661901 - DNA, 14 bp, Homo sapiens
caggccacagtggg

SEQ ID NO: 661902 - DNA, 23 bp, Homo sapiens
caggccacagtggggctgcaggc

SEQ ID NO: 661903 - DNA, 20 bp, Homo sapiens
caggccccaggcctgtggct

SEQ ID NO: 661904 - DNA, 13 bp, Homo sapiens
caggcccgcttgc

SEQ ID NO: 661905 - DNA, 14 bp, Homo sapiens
caggcccgcttgct

SEQ ID NO: 661906 - DNA, 12 bp, Homo sapiens
caggcctgcagc

SEQ ID NO: 661907 - DNA, 16 bp, Homo sapiens
caggcctgcctcccac

SEQ ID NO: 661908 - DNA, 15 bp, Homo sapiens
caggcctgtccaaca

SEQ ID NO: 661909 - DNA, 20 bp, Homo sapiens
caggccttacatctggctgg

SEQ ID NO: 661910 - DNA, 23 bp, Homo sapiens
caggctagacagaaacatgtctt

SEQ ID NO: 661911 - DNA, 19 bp, Homo sapiens
caggctatatgcagtcctt

SEQ ID NO: 661912 - DNA, 12 bp, Homo sapiens
caggctgggcca

SEQ ID NO: 661913 - DNA, 23 bp, Homo sapiens
caggctgggccatgtccaaagag

SEQ ID NO: 661914 - DNA, 13 bp, Homo sapiens
caggctttcccac

SEQ ID NO: 661915 - DNA, 15 bp, Homo sapiens
cagggaagccccaca

SEQ ID NO: 661916 - DNA, 23 bp, Homo sapiens
catagataatattgtttggtaaa

SEQ ID NO: 661917 - DNA, 14 bp, Homo sapiens
cataggtttctctc

SEQ ID NO: 661918 - DNA, 16 bp, Homo sapiens
cataggtttctctccc

SEQ ID NO: 661919 - DNA, 20 bp, Homo sapiens
catagtgagacactgtctct

SEQ ID NO: 661920 - DNA, 17 bp, Homo sapiens
catatacatattgtata

SEQ ID NO: 661921 - DNA, 22 bp, Homo sapiens
catatatacttgcaagataatt

SEQ ID NO: 661922 - DNA, 23 bp, Homo sapiens
catatcctgagccatcggtgaaa

SEQ ID NO: 661923 - DNA, 17 bp, Homo sapiens
catatgagaatatacct

SEQ ID NO: 661924 - DNA, 23 bp, Homo sapiens
catatgagaatataccttattta

SEQ ID NO: 661925 - DNA, 14 bp, Homo sapiens
catattaggaaaat

SEQ ID NO: 661926 - DNA, 20 bp, Homo sapiens
catattaggaaaatatgggt

SEQ ID NO: 661927 - DNA, 18 bp, Homo sapiens
catattctggttcttgaa

SEQ ID NO: 661928 - DNA, 19 bp, Homo sapiens
catattctggttcttgaaa

SEQ ID NO: 661929 - DNA, 18 bp, Homo sapiens
catattgttggcacagaa

SEQ ID NO: 661930 - DNA, 22 bp, Homo sapiens
catatttatccaaaatgtgtat

SEQ ID NO: 661931 - DNA, 14 bp, Homo sapiens
catatttgatttct

SEQ ID NO: 661932 - DNA, 17 bp, Homo sapiens
catatttgatttctaat

SEQ ID NO: 661933 - DNA, 22 bp, Homo sapiens
catatttgatttctaattgtaa

SEQ ID NO: 661934 - DNA, 21 bp, Homo sapiens
catcaagtccatctgacaaaa

SEQ ID NO: 661935 - DNA, 14 bp, Homo sapiens
catcacagggtggg

SEQ ID NO: 661936 - DNA, 15 bp, Homo sapiens
catcagaaagcttta

SEQ ID NO: 661937 - DNA, 19 bp, Homo sapiens
catcaggaaggaaatgaca

SEQ ID NO: 661938 - DNA, 19 bp, Homo sapiens
catcatcctcccgccagga

SEQ ID NO: 661939 - DNA, 14 bp, Homo sapiens
catcatctctgaag

SEQ ID NO: 661940 - DNA, 15 bp, Homo sapiens
catcatctctgaagg

SEQ ID NO: 661941 - DNA, 23 bp, Homo sapiens
catcattccctctcatctcaggt

SEQ ID NO: 661942 - DNA, 17 bp, Homo sapiens
catcattgtttctgcat

SEQ ID NO: 661943 - DNA, 14 bp, Homo sapiens
catcatttcccagg

SEQ ID NO: 661944 - DNA, 14 bp, Homo sapiens
catccaacttatgt

SEQ ID NO: 661945 - DNA, 16 bp, Homo sapiens
catccagcttctcatg

SEQ ID NO: 661946 - DNA, 16 bp, Homo sapiens
catccatctctctctt

SEQ ID NO: 661947 - DNA, 19 bp, Homo sapiens
catccatctctctcttgcc

SEQ ID NO: 661948 - DNA, 20 bp, Homo sapiens
catccatctctctcttgcct

SEQ ID NO: 661949 - DNA, 18 bp, Homo sapiens
catcccaaccaggcacct

SEQ ID NO: 661950 - DNA, 19 bp, Homo sapiens
catccctgcttatttttaa

SEQ ID NO: 661951 - DNA, 23 bp, Homo sapiens
catccctgcttatttttaatttg

SEQ ID NO: 661952 - DNA, 20 bp, Homo sapiens
catccgaagatggtggccac

SEQ ID NO: 661953 - DNA, 19 bp, Homo sapiens
catcctccagtaccttgct

SEQ ID NO: 661954 - DNA, 23 bp, Homo sapiens
catcctgtgccactaaactacat

SEQ ID NO: 661955 - DNA, 14 bp, Homo sapiens
catctaattctgat

SEQ ID NO: 661956 - DNA, 12 bp, Homo sapiens
catctagccagc

SEQ ID NO: 661957 - DNA, 13 bp, Homo sapiens
catctagccagcc

SEQ ID NO: 661958 - DNA, 21 bp, Homo sapiens
catctagccagcccctcttcc

SEQ ID NO: 661959 - DNA, 19 bp, Homo sapiens
catctagggaatgggactg

SEQ ID NO: 661960 - DNA, 18 bp, Homo sapiens
catctagtacttgaaaaa

SEQ ID NO: 661961 - DNA, 17 bp, Homo sapiens
catctatctagttctaa

SEQ ID NO: 661962 - DNA, 19 bp, Homo sapiens
catctcatgagtgtgcccc

SEQ ID NO: 661963 - DNA, 13 bp, Homo sapiens
catctccctgcct

SEQ ID NO: 661964 - DNA, 16 bp, Homo sapiens
catctccctgcctggc

SEQ ID NO: 661965 - DNA, 21 bp, Homo sapiens
catctccctgcctggccccca

SEQ ID NO: 661966 - DNA, 17 bp, Homo sapiens
catctctcatcctccag

SEQ ID NO: 661967 - DNA, 23 bp, Homo sapiens
catctctctcttgcctgagggga

SEQ ID NO: 661968 - DNA, 15 bp, Homo sapiens
catctcttctgcaag

SEQ ID NO: 661969 - DNA, 15 bp, Homo sapiens
catctgagctggggg

SEQ ID NO: 661970 - DNA, 19 bp, Homo sapiens
catctgtgaatctgcttta

SEQ ID NO: 661971 - DNA, 15 bp, Homo sapiens
catcttcactgcaat

SEQ ID NO: 661972 - DNA, 16 bp, Homo sapiens
catcttcactgcaatt

SEQ ID NO: 661973 - DNA, 14 bp, Homo sapiens
catcttcacttcta

SEQ ID NO: 661974 - DNA, 15 bp, Homo sapiens
catcttgcctccagg

SEQ ID NO: 661975 - DNA, 19 bp, Homo sapiens
catcttgcctccaggtgca

SEQ ID NO: 661976 - DNA, 23 bp, Homo sapiens
catcttgcctccaggtgcagagg

SEQ ID NO: 661977 - DNA, 19 bp, Homo sapiens
catgaaaaagcagctacca

SEQ ID NO: 661978 - DNA, 24 bp, Homo sapiens
catgaaaataccatttagtaagaa

SEQ ID NO: 661979 - DNA, 14 bp, Homo sapiens
catgaaaatgacat

SEQ ID NO: 661980 - DNA, 18 bp, Homo sapiens
catgaacacccttagaaa

SEQ ID NO: 661981 - DNA, 12 bp, Homo sapiens
catgaattggaa

SEQ ID NO: 661982 - DNA, 14 bp, Homo sapiens
catgaattggaact

SEQ ID NO: 661983 - DNA, 18 bp, Homo sapiens
catgaattggaactgcaa

SEQ ID NO: 661984 - DNA, 15 bp, Homo sapiens
catgagactcagtgc

SEQ ID NO: 661985 - DNA, 18 bp, Homo sapiens
catgagactcagtgcaga

SEQ ID NO: 661986 - DNA, 15 bp, Homo sapiens
catgaggaaggaaca

SEQ ID NO: 661987 - DNA, 12 bp, Homo sapiens
catgatagttaa

SEQ ID NO: 661988 - DNA, 14 bp, Homo sapiens
catgattatagcaa

SEQ ID NO: 661989 - DNA, 15 bp, Homo sapiens
catgatttagcaagc

SEQ ID NO: 661990 - DNA, 15 bp, Homo sapiens
catgcaactggagtt

SEQ ID NO: 661991 - DNA, 23 bp, Homo sapiens
catgcacccctgagccagcaggg

SEQ ID NO: 661992 - DNA, 17 bp, Homo sapiens
catgcagccgtgatcaa

SEQ ID NO: 661993 - DNA, 15 bp, Homo sapiens
catgcattatatacc

SEQ ID NO: 661994 - DNA, 15 bp, Homo sapiens
catgccacctggcaa

SEQ ID NO: 661995 - DNA, 16 bp, Homo sapiens
catgccacctggcaaa

SEQ ID NO: 661996 - DNA, 19 bp, Homo sapiens
catgccaggaacctgtcct

SEQ ID NO: 661997 - DNA, 20 bp, Homo sapiens
catgcccagctaatttttgt

SEQ ID NO: 661998 - DNA, 22 bp, Homo sapiens
catgctacttggggacataatt

SEQ ID NO: 661999 - DNA, 14 bp, Homo sapiens
catgctccaaatat

SEQ ID NO: 662000 - DNA, 17 bp, Homo sapiens
catgctccttgagagga

SEQ ID NO: 662001 - DNA, 22 bp, Homo sapiens
catgctctgcagcattgaagta

SEQ ID NO: 662002 - DNA, 13 bp, Homo sapiens
catgctgcagtgg

SEQ ID NO: 662003 - DNA, 22 bp, Homo sapiens
catgctgcctggcacagaccag

SEQ ID NO: 662004 - DNA, 17 bp, Homo sapiens
catggaggccctcctgt

SEQ ID NO: 662005 - DNA, 17 bp, Homo sapiens
catggcccccaataaag

SEQ ID NO: 662006 - DNA, 13 bp, Homo sapiens
catggccctgggc

SEQ ID NO: 662007 - DNA, 16 bp, Homo sapiens
catggctcagggtggt

SEQ ID NO: 662008 - DNA, 17 bp, Homo sapiens
catggctccggcctctg

SEQ ID NO: 662009 - DNA, 15 bp, Homo sapiens
catggctgctgttgc

SEQ ID NO: 662010 - DNA, 14 bp, Homo sapiens
catggtatcatata

SEQ ID NO: 662011 - DNA, 19 bp, Homo sapiens
catggtgaaaccccgtctc

SEQ ID NO: 662012 - DNA, 21 bp, Homo sapiens
catggttgttgcatatagtta

SEQ ID NO: 662013 - DNA, 13 bp, Homo sapiens
catggtttgatat

SEQ ID NO: 662014 - DNA, 21 bp, Homo sapiens
catgtaataaaaagtatatgt

SEQ ID NO: 662015 - DNA, 14 bp, Homo sapiens
catgtactacagct

SEQ ID NO: 662016 - DNA, 17 bp, Homo sapiens
catgtactacagctata

SEQ ID NO: 662017 - DNA, 21 bp, Homo sapiens
catgtactacagctatatttg

SEQ ID NO: 662018 - DNA, 20 bp, Homo sapiens
catgtagccagcagaactga

SEQ ID NO: 662019 - DNA, 20 bp, Homo sapiens
catgtataaccaagtgtgct

SEQ ID NO: 662020 - DNA, 14 bp, Homo sapiens
catgtatttgagca

SEQ ID NO: 662021 - DNA, 16 bp, Homo sapiens
catgtatttgttatat

SEQ ID NO: 662022 - DNA, 13 bp, Homo sapiens
catgtccaaagag

SEQ ID NO: 662023 - DNA, 15 bp, Homo sapiens
catgtccaaagaggc

SEQ ID NO: 662024 - DNA, 16 bp, Homo sapiens
catgtccaaagaggct

SEQ ID NO: 662025 - DNA, 21 bp, Homo sapiens
catgtccaaagaggctgcccc

SEQ ID NO: 662026 - DNA, 18 bp, Homo sapiens
catgtcctaattcttctg

SEQ ID NO: 662027 - DNA, 19 bp, Homo sapiens
catgtcctaattcttctgt

SEQ ID NO: 662028 - DNA, 14 bp, Homo sapiens
catgtgagctcttc

SEQ ID NO: 662029 - DNA, 21 bp, Homo sapiens
catgtgagtgacgatgatgta

SEQ ID NO: 662030 - DNA, 17 bp, Homo sapiens
catgtgcctttctttgc

SEQ ID NO: 662031 - DNA, 13 bp, Homo sapiens
catgtgtcctggt

SEQ ID NO: 662032 - DNA, 20 bp, Homo sapiens
catgtgtcctggtgagaaaa

SEQ ID NO: 662033 - DNA, 23 bp, Homo sapiens
catgttgcaaagaactccagagt

SEQ ID NO: 662034 - DNA, 18 bp, Homo sapiens
catgtttttaacttttaa

SEQ ID NO: 662035 - DNA, 11 bp, Homo sapiens
cattaaacttt

SEQ ID NO: 662036 - DNA, 19 bp, Homo sapiens
cattaaacttttttaacca

SEQ ID NO: 662037 - DNA, 20 bp, Homo sapiens
cattaaatgcaataatttta

SEQ ID NO: 662038 - DNA, 17 bp, Homo sapiens
cagggaagccccacatg

SEQ ID NO: 662039 - DNA, 21 bp, Homo sapiens
cagggagacggtttccaggga

SEQ ID NO: 662040 - DNA, 18 bp, Homo sapiens
cagggagcagggaaggcc

SEQ ID NO: 662041 - DNA, 16 bp, Homo sapiens
cagggaggggccggcc

SEQ ID NO: 662042 - DNA, 21 bp, Homo sapiens
cagggaggggccggccctgtg

SEQ ID NO: 662043 - DNA, 22 bp, Homo sapiens
cagggaggggccggccctgtgt

SEQ ID NO: 662044 - DNA, 17 bp, Homo sapiens
cagggagtgctggctca

SEQ ID NO: 662045 - DNA, 22 bp, Homo sapiens
cagggagtgctggctcacagta

SEQ ID NO: 662046 - DNA, 23 bp, Homo sapiens
cagggcaccatccagctccccag

SEQ ID NO: 662047 - DNA, 17 bp, Homo sapiens
cagggcagcggctccac

SEQ ID NO: 662048 - DNA, 18 bp, Homo sapiens
cagggcataggaagaaaa

SEQ ID NO: 662049 - DNA, 16 bp, Homo sapiens
cagggccacctgcagg

SEQ ID NO: 662050 - DNA, 20 bp, Homo sapiens
cagggccacctgcaggaccc

SEQ ID NO: 662051 - DNA, 20 bp, Homo sapiens
cagggccagtggggcctgtg

SEQ ID NO: 662052 - DNA, 21 bp, Homo sapiens
cagggccagtggggcctgtgg

SEQ ID NO: 662053 - DNA, 16 bp, Homo sapiens
cagggccatggctcag

SEQ ID NO: 662054 - DNA, 17 bp, Homo sapiens
cagggcctggggcctga

SEQ ID NO: 662055 - DNA, 19 bp, Homo sapiens
cagggcctggggcctgaga

SEQ ID NO: 662056 - DNA, 20 bp, Homo sapiens
cagggcctggggcctgagag

SEQ ID NO: 662057 - DNA, 21 bp, Homo sapiens
cagggcctggggcctgagaga

SEQ ID NO: 662058 - DNA, 23 bp, Homo sapiens
cagggcctggggcctgagagaat

SEQ ID NO: 662059 - DNA, 11 bp, Homo sapiens
cagggcctttt

SEQ ID NO: 662060 - DNA, 15 bp, Homo sapiens
cagggctgccctgag

SEQ ID NO: 662061 - DNA, 17 bp, Homo sapiens
cagggctgccctgagaa

SEQ ID NO: 662062 - DNA, 13 bp, Homo sapiens
cagggctggagcc

SEQ ID NO: 662063 - DNA, 16 bp, Homo sapiens
cagggctggagcctgg

SEQ ID NO: 662064 - DNA, 22 bp, Homo sapiens
cagggctggcacgtgacaggct

SEQ ID NO: 662065 - DNA, 15 bp, Homo sapiens
caggggaacctgcca

SEQ ID NO: 662066 - DNA, 16 bp, Homo sapiens
caggggaacctgccat

SEQ ID NO: 662067 - DNA, 21 bp, Homo sapiens
caggggctgactctccaggga

SEQ ID NO: 662068 - DNA, 16 bp, Homo sapiens
cagggggatttggtag

SEQ ID NO: 662069 - DNA, 16 bp, Homo sapiens
caggggtctccctggc

SEQ ID NO: 662070 - DNA, 22 bp, Homo sapiens
caggggtctccctggctccctc

SEQ ID NO: 662071 - DNA, 21 bp, Homo sapiens
cagggtaactgtgctgaatgc

SEQ ID NO: 662072 - DNA, 16 bp, Homo sapiens
cagggtcctcagctca

SEQ ID NO: 662073 - DNA, 16 bp, Homo sapiens
cagggtctctccctca

SEQ ID NO: 662074 - DNA, 16 bp, Homo sapiens
cagggtctgagtgcaa

SEQ ID NO: 662075 - DNA, 19 bp, Homo sapiens
cagggtctgtgtgaatgtg

SEQ ID NO: 662076 - DNA, 13 bp, Homo sapiens
cagggtgggcctc

SEQ ID NO: 662077 - DNA, 20 bp, Homo sapiens
cagggtgggcctcggcccct

SEQ ID NO: 662078 - DNA, 23 bp, Homo sapiens
cagggtgggcctcggcccctccc

SEQ ID NO: 662079 - DNA, 22 bp, Homo sapiens
cagggtggtctcttcttggggc

SEQ ID NO: 662080 - DNA, 23 bp, Homo sapiens
cagggttctcttagcaactcaga

SEQ ID NO: 662081 - DNA, 21 bp, Homo sapiens
caggtaacaggtgtgtatgta

SEQ ID NO: 662082 - DNA, 20 bp, Homo sapiens
caggtcaaagatgtgttcag

SEQ ID NO: 662083 - DNA, 23 bp, Homo sapiens
caggtgggctggacttctacctg

SEQ ID NO: 662084 - DNA, 15 bp, Homo sapiens
caggtgtcctgagca

SEQ ID NO: 662085 - DNA, 20 bp, Homo sapiens
caggtgttctacactcatct

SEQ ID NO: 662086 - DNA, 23 bp, Homo sapiens
cagtaaatagtgtcatataaact

SEQ ID NO: 662087 - DNA, 13 bp, Homo sapiens
cagtaccttgctt

SEQ ID NO: 662088 - DNA, 13 bp, Homo sapiens
cagtagtgctaat

SEQ ID NO: 662089 - DNA, 15 bp, Homo sapiens
cagtatgtgggatat

SEQ ID NO: 662090 - DNA, 19 bp, Homo sapiens
cagtatgtgggatattgaa

SEQ ID NO: 662091 - DNA, 19 bp, Homo sapiens
cagtattatagacaaaaga

SEQ ID NO: 662092 - DNA, 21 bp, Homo sapiens
cagtattatagacaaaagaat

SEQ ID NO: 662093 - DNA, 17 bp, Homo sapiens
cagtattgccccctctc

SEQ ID NO: 662094 - DNA, 14 bp, Homo sapiens
cagtcatcatcagg

SEQ ID NO: 662095 - DNA, 17 bp, Homo sapiens
cagtcatcatcagggcc

SEQ ID NO: 662096 - DNA, 19 bp, Homo sapiens
cagtcatcatcagggcctg

SEQ ID NO: 662097 - DNA, 20 bp, Homo sapiens
cagtcatcatcagggcctgg

SEQ ID NO: 662098 - DNA, 14 bp, Homo sapiens
cagtccaaaatact

SEQ ID NO: 662099 - DNA, 17 bp, Homo sapiens
cagtcccacactgtgca

SEQ ID NO: 662100 - DNA, 24 bp, Homo sapiens
cagtcccacactgtgcagacccag

SEQ ID NO: 662101 - DNA, 13 bp, Homo sapiens
cagtcgcctgcct

SEQ ID NO: 662102 - DNA, 19 bp, Homo sapiens
cagtcgcctgcctgcagca

SEQ ID NO: 662103 - DNA, 21 bp, Homo sapiens
cagtcgcctgcctgcagcagg

SEQ ID NO: 662104 - DNA, 16 bp, Homo sapiens
cagtctaaacagagtc

SEQ ID NO: 662105 - DNA, 17 bp, Homo sapiens
cagtctcattgtcacct

SEQ ID NO: 662106 - DNA, 11 bp, Homo sapiens
cagtctgagct

SEQ ID NO: 662107 - DNA, 22 bp, Homo sapiens
cagtctgatccatccatctctc

SEQ ID NO: 662108 - DNA, 16 bp, Homo sapiens
cagtcttatttaacca

SEQ ID NO: 662109 - DNA, 15 bp, Homo sapiens
cagtctttcttgaaa

SEQ ID NO: 662110 - DNA, 18 bp, Homo sapiens
cagtctttcttgaaattg

SEQ ID NO: 662111 - DNA, 15 bp, Homo sapiens
cagtgaaagaaactg

SEQ ID NO: 662112 - DNA, 14 bp, Homo sapiens
cagtgcagaatgta

SEQ ID NO: 662113 - DNA, 18 bp, Homo sapiens
cagtgcatggtggccaga

SEQ ID NO: 662114 - DNA, 20 bp, Homo sapiens
cagtgcatggtggccagagg

SEQ ID NO: 662115 - DNA, 21 bp, Homo sapiens
cagtgcatggtggccagaggt

SEQ ID NO: 662116 - DNA, 17 bp, Homo sapiens
cagtgccaactcctcac

SEQ ID NO: 662117 - DNA, 23 bp, Homo sapiens
cagtgcctccacatgctgcctgg

SEQ ID NO: 662118 - DNA, 18 bp, Homo sapiens
cagtgcgattctggataa

SEQ ID NO: 662119 - DNA, 20 bp, Homo sapiens
cagtggcctttttctgagat

SEQ ID NO: 662120 - DNA, 16 bp, Homo sapiens
cagtggggcctgtgga

SEQ ID NO: 662121 - DNA, 17 bp, Homo sapiens
cagtggggcctgtggaa

SEQ ID NO: 662122 - DNA, 19 bp, Homo sapiens
cagtggttcaaatttcctt

SEQ ID NO: 662123 - DNA, 16 bp, Homo sapiens
cagtgtggccaggctg

SEQ ID NO: 662124 - DNA, 23 bp, Homo sapiens
cagtgttgttgctctaggaagac

SEQ ID NO: 662125 - DNA, 17 bp, Homo sapiens
cagtgtttgggaaatta

SEQ ID NO: 662126 - DNA, 20 bp, Homo sapiens
cagtgttttggactccatct

SEQ ID NO: 662127 - DNA, 13 bp, Homo sapiens
cagttagactagt

SEQ ID NO: 662128 - DNA, 14 bp, Homo sapiens
cagttatttctgtt

SEQ ID NO: 662129 - DNA, 16 bp, Homo sapiens
cagttctcatgactcc

SEQ ID NO: 662130 - DNA, 18 bp, Homo sapiens
cagttctgggcaaagagg

SEQ ID NO: 662131 - DNA, 18 bp, Homo sapiens
cagttgaaaacttgtaat

SEQ ID NO: 662132 - DNA, 18 bp, Homo sapiens
cagttgaaaatgcaactc

SEQ ID NO: 662133 - DNA, 20 bp, Homo sapiens
cagttgctgtgaactttcat

SEQ ID NO: 662134 - DNA, 13 bp, Homo sapiens
cagttgcttgtct

SEQ ID NO: 662135 - DNA, 21 bp, Homo sapiens
cagttgtcttatgtgaaaaat

SEQ ID NO: 662136 - DNA, 17 bp, Homo sapiens
cagtttaaaaagatgaa

SEQ ID NO: 662137 - DNA, 20 bp, Homo sapiens
cagtttaagagcagaacaga

SEQ ID NO: 662138 - DNA, 16 bp, Homo sapiens
cataaattcaactttg

SEQ ID NO: 662139 - DNA, 22 bp, Homo sapiens
cataaattttttgaagtcttta

SEQ ID NO: 662140 - DNA, 15 bp, Homo sapiens
cataacatccagagc

SEQ ID NO: 662141 - DNA, 13 bp, Homo sapiens
cataacggaaagt

SEQ ID NO: 662142 - DNA, 22 bp, Homo sapiens
cataactcctgtcccttttccc

SEQ ID NO: 662143 - DNA, 19 bp, Homo sapiens
cataactgtagctcaagtt

SEQ ID NO: 662144 - DNA, 23 bp, Homo sapiens
cataacttcctgtacttgaagtc

SEQ ID NO: 662145 - DNA, 15 bp, Homo sapiens
cataaggatgacttt

SEQ ID NO: 662146 - DNA, 18 bp, Homo sapiens
cataaggatgactttttt

SEQ ID NO: 662147 - DNA, 14 bp, Homo sapiens
cataattgaagtgt

SEQ ID NO: 662148 - DNA, 21 bp, Homo sapiens
cataattttttttaaagaaga

SEQ ID NO: 662149 - DNA, 22 bp, Homo sapiens
catacaagaaaatgtatccaag

SEQ ID NO: 662150 - DNA, 22 bp, Homo sapiens
cataccaattccaactttcagg

SEQ ID NO: 662151 - DNA, 13 bp, Homo sapiens
catacctgtctca

SEQ ID NO: 662152 - DNA, 14 bp, Homo sapiens
cataccttttctct

SEQ ID NO: 662153 - DNA, 13 bp, Homo sapiens
catactaataaat

SEQ ID NO: 662154 - DNA, 19 bp, Homo sapiens
catactaataaatataatt

SEQ ID NO: 662155 - DNA, 20 bp, Homo sapiens
catactaataaatataattt

SEQ ID NO: 662156 - DNA, 14 bp, Homo sapiens
catacttgtgaaac

SEQ ID NO: 662157 - DNA, 16 bp, Homo sapiens
catactttgtattttg

SEQ ID NO: 662158 - DNA, 13 bp, Homo sapiens
catagacatgaaa

SEQ ID NO: 662159 - DNA, 19 bp, Homo sapiens
ccactacccgatttgttta

SEQ ID NO: 662160 - DNA, 20 bp, Homo sapiens
ccactatctccgttccatct

SEQ ID NO: 662161 - DNA, 22 bp, Homo sapiens
ccactatctccgttccatctgg

SEQ ID NO: 662162 - DNA, 18 bp, Homo sapiens
ccactatgacagaggatt

SEQ ID NO: 662163 - DNA, 11 bp, Homo sapiens
ccactcaggcc

SEQ ID NO: 662164 - DNA, 12 bp, Homo sapiens
ccactcaggcca

SEQ ID NO: 662165 - DNA, 19 bp, Homo sapiens
ccactcccccgtttctcct

SEQ ID NO: 662166 - DNA, 15 bp, Homo sapiens
ccactcctccctccg

SEQ ID NO: 662167 - DNA, 18 bp, Homo sapiens
ccactcgtgcatccctga

SEQ ID NO: 662168 - DNA, 20 bp, Homo sapiens
ccactgcaaataaagccttt

SEQ ID NO: 662169 - DNA, 22 bp, Homo sapiens
ccactgtaatacgtagctctct

SEQ ID NO: 662170 - DNA, 18 bp, Homo sapiens
ccacttccaggggaacct

SEQ ID NO: 662171 - DNA, 18 bp, Homo sapiens
ccactttgtaatttttgc

SEQ ID NO: 662172 - DNA, 23 bp, Homo sapiens
ccagaatgttactgactcctcag

SEQ ID NO: 662173 - DNA, 19 bp, Homo sapiens
ccagacctggctccactct

SEQ ID NO: 662174 - DNA, 18 bp, Homo sapiens
ccagacttgggaggatgt

SEQ ID NO: 662175 - DNA, 19 bp, Homo sapiens
ccagagcttgttgtctcca

SEQ ID NO: 662176 - DNA, 15 bp, Homo sapiens
ccagatcaaggatgt

SEQ ID NO: 662177 - DNA, 13 bp, Homo sapiens
ccagatcctgggt

SEQ ID NO: 662178 - DNA, 21 bp, Homo sapiens
ccagatctttcagaaatataa

SEQ ID NO: 662179 - DNA, 18 bp, Homo sapiens
ccagcaatctccatgtgt

SEQ ID NO: 662180 - DNA, 20 bp, Homo sapiens
ccagcaatctccatgtgtac

SEQ ID NO: 662181 - DNA, 14 bp, Homo sapiens
ccagcaccacagcc

SEQ ID NO: 662182 - DNA, 15 bp, Homo sapiens
ccagcaccttgtgcc

SEQ ID NO: 662183 - DNA, 20 bp, Homo sapiens
ccagcaccttgtgcctgggg

SEQ ID NO: 662184 - DNA, 16 bp, Homo sapiens
ccagcactttgggagg

SEQ ID NO: 662185 - DNA, 20 bp, Homo sapiens
ccagcactttgggaggccga

SEQ ID NO: 662186 - DNA, 23 bp, Homo sapiens
ccagcaggcagagtggcgtggcc

SEQ ID NO: 662187 - DNA, 18 bp, Homo sapiens
ccagcatttagctggcca

SEQ ID NO: 662188 - DNA, 17 bp, Homo sapiens
ccagcccacctgctccc

SEQ ID NO: 662189 - DNA, 19 bp, Homo sapiens
ccagcccacctgctcccag

SEQ ID NO: 662190 - DNA, 14 bp, Homo sapiens
ccagcctggtcaac

SEQ ID NO: 662191 - DNA, 17 bp, Homo sapiens
ccagccttgagccctgg

SEQ ID NO: 662192 - DNA, 21 bp, Homo sapiens
ccagccttgagccctggctgt

SEQ ID NO: 662193 - DNA, 17 bp, Homo sapiens
ccagctaatttttgtat

SEQ ID NO: 662194 - DNA, 20 bp, Homo sapiens
ccagctacttgggaggctga

SEQ ID NO: 662195 - DNA, 12 bp, Homo sapiens
ccagctcagccc

SEQ ID NO: 662196 - DNA, 15 bp, Homo sapiens
ccagctcagccctgg

SEQ ID NO: 662197 - DNA, 23 bp, Homo sapiens
ccagctcagccctggcctggctg

SEQ ID NO: 662198 - DNA, 19 bp, Homo sapiens
ccagctccccagcccacct

SEQ ID NO: 662199 - DNA, 23 bp, Homo sapiens
ccagctccccagcccacctgctc

SEQ ID NO: 662200 - DNA, 16 bp, Homo sapiens
ccagctgcccttccgc

SEQ ID NO: 662201 - DNA, 21 bp, Homo sapiens
ccagctgcccttccgcagtgt

SEQ ID NO: 662202 - DNA, 16 bp, Homo sapiens
ccaggagagcctgggg

SEQ ID NO: 662203 - DNA, 14 bp, Homo sapiens
ccaggagcttcttc

SEQ ID NO: 662204 - DNA, 18 bp, Homo sapiens
ccaggatcgttttttccc

SEQ ID NO: 662205 - DNA, 22 bp, Homo sapiens
ccaggcacttaaagccttttcc

SEQ ID NO: 662206 - DNA, 10 bp, Homo sapiens
ccaggcaggg

SEQ ID NO: 662207 - DNA, 18 bp, Homo sapiens
ccaggccctcctctccca

SEQ ID NO: 662208 - DNA, 19 bp, Homo sapiens
ccaggccctgcagcggtgg

SEQ ID NO: 662209 - DNA, 16 bp, Homo sapiens
ccaggcctgcagcagg

SEQ ID NO: 662210 - DNA, 18 bp, Homo sapiens
ccaggcctgcagcaggag

SEQ ID NO: 662211 - DNA, 20 bp, Homo sapiens
ccaggccttacatctggctg

SEQ ID NO: 662212 - DNA, 20 bp, Homo sapiens
ccaggctgcctcctgccctt

SEQ ID NO: 662213 - DNA, 14 bp, Homo sapiens
ccagggaggggccg

SEQ ID NO: 662214 - DNA, 16 bp, Homo sapiens
ccagggcaccatccag

SEQ ID NO: 662215 - DNA, 20 bp, Homo sapiens
ccagggccttttctggcacc

SEQ ID NO: 662216 - DNA, 21 bp, Homo sapiens
ccagggctgccctgagaagct

SEQ ID NO: 662217 - DNA, 23 bp, Homo sapiens
ccagggctgccctgagaagctgc

SEQ ID NO: 662218 - DNA, 14 bp, Homo sapiens
ccaggggtctccct

SEQ ID NO: 662219 - DNA, 16 bp, Homo sapiens
ccagggtctctccctc

SEQ ID NO: 662220 - DNA, 15 bp, Homo sapiens
ccagtacttctaaga

SEQ ID NO: 662221 - DNA, 16 bp, Homo sapiens
ccagtacttctaagag

SEQ ID NO: 662222 - DNA, 20 bp, Homo sapiens
ccagtaggactcaaggtgga

SEQ ID NO: 662223 - DNA, 15 bp, Homo sapiens
ccagtcccacactgt

SEQ ID NO: 662224 - DNA, 13 bp, Homo sapiens
ccagtctcattgt

SEQ ID NO: 662225 - DNA, 16 bp, Homo sapiens
ccagtgcagaatgtaa

SEQ ID NO: 662226 - DNA, 15 bp, Homo sapiens
ccagtgcatggtggc

SEQ ID NO: 662227 - DNA, 17 bp, Homo sapiens
ccagtgctttatgttgt

SEQ ID NO: 662228 - DNA, 18 bp, Homo sapiens
ccagtggggcctgtggaa

SEQ ID NO: 662229 - DNA, 17 bp, Homo sapiens
ccagtgttgggtttttt

SEQ ID NO: 662230 - DNA, 21 bp, Homo sapiens
ccagttagactagtccccggt

SEQ ID NO: 662231 - DNA, 14 bp, Homo sapiens
ccagttatgtttga

SEQ ID NO: 662232 - DNA, 21 bp, Homo sapiens
ccagttgttagattaagaaat

SEQ ID NO: 662233 - DNA, 15 bp, Homo sapiens
ccataccttttctct

SEQ ID NO: 662234 - DNA, 21 bp, Homo sapiens
ccataccttttctcttttctt

SEQ ID NO: 662235 - DNA, 16 bp, Homo sapiens
ccatactaataaatat

SEQ ID NO: 662236 - DNA, 19 bp, Homo sapiens
ccataggtttctctccctc

SEQ ID NO: 662237 - DNA, 15 bp, Homo sapiens
ccatattacctggat

SEQ ID NO: 662238 - DNA, 18 bp, Homo sapiens
ccatattctggttcttga

SEQ ID NO: 662239 - DNA, 16 bp, Homo sapiens
ccatatttgatttcta

SEQ ID NO: 662240 - DNA, 18 bp, Homo sapiens
ccatatttgatttctaat

SEQ ID NO: 662241 - DNA, 21 bp, Homo sapiens
ccatcaactcccaacttcttc

SEQ ID NO: 662242 - DNA, 23 bp, Homo sapiens
ccatcaactcccaacttcttcct

SEQ ID NO: 662243 - DNA, 16 bp, Homo sapiens
ccatcagtgaaagaaa

SEQ ID NO: 662244 - DNA, 11 bp, Homo sapiens
ccatcatcctc

SEQ ID NO: 662245 - DNA, 12 bp, Homo sapiens
ccatcatctctg

SEQ ID NO: 662246 - DNA, 16 bp, Homo sapiens
ccatccagacctggct

SEQ ID NO: 662247 - DNA, 14 bp, Homo sapiens
ccatccatctctct

SEQ ID NO: 662248 - DNA, 16 bp, Homo sapiens
ccatccatctctctct

SEQ ID NO: 662249 - DNA, 20 bp, Homo sapiens
ccatcctgcagatactttga

SEQ ID NO: 662250 - DNA, 19 bp, Homo sapiens
ccatctaatgcttgtttat

SEQ ID NO: 662251 - DNA, 14 bp, Homo sapiens
ccatctagccagcc

SEQ ID NO: 662252 - DNA, 23 bp, Homo sapiens
ccatctagccagcccctcttccc

SEQ ID NO: 662253 - DNA, 17 bp, Homo sapiens
ccatctaggtcctggct

SEQ ID NO: 662254 - DNA, 14 bp, Homo sapiens
ccatctccctgcct

SEQ ID NO: 662255 - DNA, 18 bp, Homo sapiens
ccatctccctgcctggcc

SEQ ID NO: 662256 - DNA, 15 bp, Homo sapiens
ccatctctctcttgc

SEQ ID NO: 662257 - DNA, 14 bp, Homo sapiens
ccatctcttctgca

SEQ ID NO: 662258 - DNA, 19 bp, Homo sapiens
ccatgatttagcaagcaac

SEQ ID NO: 662259 - DNA, 16 bp, Homo sapiens
ccatggcccccaataa

SEQ ID NO: 662260 - DNA, 24 bp, Homo sapiens
ccatggcccccaataaaggcagct

SEQ ID NO: 662261 - DNA, 16 bp, Homo sapiens
ccatggtgatggtgta

SEQ ID NO: 662262 - DNA, 20 bp, Homo sapiens
ccatggtgatggtgtagccc

SEQ ID NO: 662263 - DNA, 19 bp, Homo sapiens
ccatgtccaaagaggctgc

SEQ ID NO: 662264 - DNA, 23 bp, Homo sapiens
ccatgtgcggaattcaagttacc

SEQ ID NO: 662265 - DNA, 15 bp, Homo sapiens
ccattaaggggaaga

SEQ ID NO: 662266 - DNA, 20 bp, Homo sapiens
ccattaaggggaagaatgaa

SEQ ID NO: 662267 - DNA, 22 bp, Homo sapiens
ccattacagaggtattaaaact

SEQ ID NO: 662268 - DNA, 23 bp, Homo sapiens
ccattacagaggtattaaaacta

SEQ ID NO: 662269 - DNA, 21 bp, Homo sapiens
ccattcactactcatgcgtga

SEQ ID NO: 662270 - DNA, 15 bp, Homo sapiens
ccattccctccattt

SEQ ID NO: 662271 - DNA, 19 bp, Homo sapiens
ccattccctccatttttct

SEQ ID NO: 662272 - DNA, 21 bp, Homo sapiens
ccattgaaggcttaattgact

SEQ ID NO: 662273 - DNA, 17 bp, Homo sapiens
ccattgcttattatgta

SEQ ID NO: 662274 - DNA, 19 bp, Homo sapiens
cccaaactcctttcttatc

SEQ ID NO: 662275 - DNA, 13 bp, Homo sapiens
cccaaagctgagc

SEQ ID NO: 662276 - DNA, 15 bp, Homo sapiens
cccaacctcagggct

SEQ ID NO: 662277 - DNA, 22 bp, Homo sapiens
cccaacctcagggctcccaggg

SEQ ID NO: 662278 - DNA, 14 bp, Homo sapiens
cccaactctttatc

SEQ ID NO: 662279 - DNA, 13 bp, Homo sapiens
cccaactggggtt

SEQ ID NO: 662280 - DNA, 17 bp, Homo sapiens
cccaagctgattttatt

SEQ ID NO: 662281 - DNA, 22 bp, Homo sapiens
cccaataaaggcagctgcctct

SEQ ID NO: 662282 - DNA, 23 bp, Homo sapiens
cccaataaaggcagctgcctctg

SEQ ID NO: 662283 - DNA, 14 bp, Homo sapiens
cccaattctgcccg

SEQ ID NO: 662284 - DNA, 17 bp, Homo sapiens
cccacaactcctgtcta

SEQ ID NO: 662285 - DNA, 21 bp, Homo sapiens
cccacaagtgccctccaggct

SEQ ID NO: 662286 - DNA, 17 bp, Homo sapiens
cccacactgtggccagg

SEQ ID NO: 662287 - DNA, 15 bp, Homo sapiens
cccacatgtccagca

SEQ ID NO: 662288 - DNA, 13 bp, Homo sapiens
cccaccactcagg

SEQ ID NO: 662289 - DNA, 20 bp, Homo sapiens
cccacctcggcacacactgt

SEQ ID NO: 662290 - DNA, 15 bp, Homo sapiens
cccacctgctcccag

SEQ ID NO: 662291 - DNA, 12 bp, Homo sapiens
cccaccttccca

SEQ ID NO: 662292 - DNA, 13 bp, Homo sapiens
cccaccttcccac

SEQ ID NO: 662293 - DNA, 22 bp, Homo sapiens
cccacgagggtctcccctcctg

SEQ ID NO: 662294 - DNA, 16 bp, Homo sapiens
cccacgctcaccccct

SEQ ID NO: 662295 - DNA, 15 bp, Homo sapiens
cccactcagtgcctc

SEQ ID NO: 662296 - DNA, 15 bp, Homo sapiens
cccactggcagcatc

SEQ ID NO: 662297 - DNA, 17 bp, Homo sapiens
cccactttcatctacct

SEQ ID NO: 662298 - DNA, 22 bp, Homo sapiens
cccactttgctgttccttactt

SEQ ID NO: 662299 - DNA, 20 bp, Homo sapiens
cccagaatttaccatcatct

SEQ ID NO: 662300 - DNA, 18 bp, Homo sapiens
cccagcactttgggaggc

SEQ ID NO: 662301 - DNA, 12 bp, Homo sapiens
cccagcccacct

SEQ ID NO: 662302 - DNA, 13 bp, Homo sapiens
cccagcccacctg

SEQ ID NO: 662303 - DNA, 17 bp, Homo sapiens
cccagcccacctgctcc

SEQ ID NO: 662304 - DNA, 19 bp, Homo sapiens
cccagcccacctgctccca

SEQ ID NO: 662305 - DNA, 17 bp, Homo sapiens
cccagctacttgggagg

SEQ ID NO: 662306 - DNA, 16 bp, Homo sapiens
cccaggccccaggcct

SEQ ID NO: 662307 - DNA, 20 bp, Homo sapiens
cccagggcaccatccagctc

SEQ ID NO: 662308 - DNA, 16 bp, Homo sapiens
cccaggggacaaggga

SEQ ID NO: 662309 - DNA, 18 bp, Homo sapiens
cccaggggacaagggatt

SEQ ID NO: 662310 - DNA, 14 bp, Homo sapiens
cccaggggtctccc

SEQ ID NO: 662311 - DNA, 16 bp, Homo sapiens
cccaggggtctccctg

SEQ ID NO: 662312 - DNA, 17 bp, Homo sapiens
cccaggggtctccctgg

SEQ ID NO: 662313 - DNA, 21 bp, Homo sapiens
cccaggggtctccctggctcc

SEQ ID NO: 662314 - DNA, 22 bp, Homo sapiens
cccaggggtctccctggctccc

SEQ ID NO: 662315 - DNA, 21 bp, Homo sapiens
cccaggtggaaggcagacagc

SEQ ID NO: 662316 - DNA, 23 bp, Homo sapiens
cccaggtggaaggcagacagcag

SEQ ID NO: 662317 - DNA, 17 bp, Homo sapiens
cccagtcccacactgtg

SEQ ID NO: 662318 - DNA, 21 bp, Homo sapiens
cccagtcccacactgtggcca

SEQ ID NO: 662319 - DNA, 20 bp, Homo sapiens
cccagtgcatggtggccaga

SEQ ID NO: 662320 - DNA, 21 bp, Homo sapiens
cccagtgcatggtggccagag

SEQ ID NO: 662321 - DNA, 22 bp, Homo sapiens
cccagtgcatggtggccagagg

SEQ ID NO: 662322 - DNA, 18 bp, Homo sapiens
cccatccagacctggctc

SEQ ID NO: 662323 - DNA, 17 bp, Homo sapiens
cccatctccctgcctgg

SEQ ID NO: 662324 - DNA, 18 bp, Homo sapiens
cccatctccctgcctggc

SEQ ID NO: 662325 - DNA, 16 bp, Homo sapiens
cccatggcccccaata

SEQ ID NO: 662326 - DNA, 19 bp, Homo sapiens
cccatggcccccaataaag

SEQ ID NO: 662327 - DNA, 20 bp, Homo sapiens
cccatggcccccaataaagg

SEQ ID NO: 662328 - DNA, 23 bp, Homo sapiens
cccatggcccccaataaaggcag

SEQ ID NO: 662329 - DNA, 22 bp, Homo sapiens
cccatgtcaccggtcagtgcct

SEQ ID NO: 662330 - DNA, 18 bp, Homo sapiens
ccccaataaaggcagctg

SEQ ID NO: 662331 - DNA, 19 bp, Homo sapiens
ccccaataaaggcagctgc

SEQ ID NO: 662332 - DNA, 11 bp, Homo sapiens
ccccactcagt

SEQ ID NO: 662333 - DNA, 22 bp, Homo sapiens
ccccactcagtgcctccacatg

SEQ ID NO: 662334 - DNA, 13 bp, Homo sapiens
ccccaggccctgc

SEQ ID NO: 662335 - DNA, 23 bp, Homo sapiens
ccccaggccctgcagcggtggtt

SEQ ID NO: 662336 - DNA, 15 bp, Homo sapiens
ccccatgaggaagga

SEQ ID NO: 662337 - DNA, 14 bp, Homo sapiens
ccccatgggcacag

SEQ ID NO: 662338 - DNA, 14 bp, Homo sapiens
cccccaataaaggc

SEQ ID NO: 662339 - DNA, 15 bp, Homo sapiens
cccccaataaaggca

SEQ ID NO: 662340 - DNA, 16 bp, Homo sapiens
cccccaataaaggcag

SEQ ID NO: 662341 - DNA, 17 bp, Homo sapiens
cccccaataaaggcagc

SEQ ID NO: 662342 - DNA, 21 bp, Homo sapiens
cccccaccactcaggccacag

SEQ ID NO: 662343 - DNA, 11 bp, Homo sapiens
cccccatcctt

SEQ ID NO: 662344 - DNA, 14 bp, Homo sapiens
cccccatctgagct

SEQ ID NO: 662345 - DNA, 19 bp, Homo sapiens
cccccgtttctccttttcc

SEQ ID NO: 662346 - DNA, 12 bp, Homo sapiens
ccccctcagcct

SEQ ID NO: 662347 - DNA, 19 bp, Homo sapiens
ccccctgggctggggcctc

SEQ ID NO: 662348 - DNA, 12 bp, Homo sapiens
cccccttcccat

SEQ ID NO: 662349 - DNA, 12 bp, Homo sapiens
cccctccttgtc

SEQ ID NO: 662350 - DNA, 14 bp, Homo sapiens
cccctgactcatca

SEQ ID NO: 662351 - DNA, 17 bp, Homo sapiens
cccctggctttgcctct

SEQ ID NO: 662352 - DNA, 18 bp, Homo sapiens
cccctggctttgcctctt

SEQ ID NO: 662353 - DNA, 22 bp, Homo sapiens
cccctggctttgcctcttcttt

SEQ ID NO: 662354 - DNA, 15 bp, Homo sapiens
cccctgtaggcctca

SEQ ID NO: 662355 - DNA, 23 bp, Homo sapiens
ccccttaaacacaggctgtcctt

SEQ ID NO: 662356 - DNA, 13 bp, Homo sapiens
ccccttcccattt

SEQ ID NO: 662357 - DNA, 19 bp, Homo sapiens
ccccttcctcttgtctgat

SEQ ID NO: 662358 - DNA, 18 bp, Homo sapiens
ccccttgattcccaccgt

SEQ ID NO: 662359 - DNA, 15 bp, Homo sapiens
cccgagagcctcgct

SEQ ID NO: 662360 - DNA, 17 bp, Homo sapiens
cccgagttcctctgggt

SEQ ID NO: 662361 - DNA, 21 bp, Homo sapiens
cccgcccttccatgtgccttt

SEQ ID NO: 662362 - DNA, 14 bp, Homo sapiens
cccggagctggagg

SEQ ID NO: 662363 - DNA, 20 bp, Homo sapiens
cccggcatgagactcagtgc

SEQ ID NO: 662364 - DNA, 14 bp, Homo sapiens
cccgggagcggagg

SEQ ID NO: 662365 - DNA, 13 bp, Homo sapiens
ccctaaagcctca

SEQ ID NO: 662366 - DNA, 19 bp, Homo sapiens
ccctagagccctctcctcc

SEQ ID NO: 662367 - DNA, 21 bp, Homo sapiens
ccctcccccattccctccatt

SEQ ID NO: 662368 - DNA, 15 bp, Homo sapiens
ccctcctgcacacag

SEQ ID NO: 662369 - DNA, 16 bp, Homo sapiens
ccctcctgcacacagg

SEQ ID NO: 662370 - DNA, 13 bp, Homo sapiens
ccctcgcctcctc

SEQ ID NO: 662371 - DNA, 16 bp, Homo sapiens
ccctctcatctcaggt

SEQ ID NO: 662372 - DNA, 15 bp, Homo sapiens
ccctctcctccctct

SEQ ID NO: 662373 - DNA, 13 bp, Homo sapiens
ccctctcgcctca

SEQ ID NO: 662374 - DNA, 16 bp, Homo sapiens
ccctctcgcctcatta

SEQ ID NO: 662375 - DNA, 18 bp, Homo sapiens
ccctcttctggtttccct

SEQ ID NO: 662376 - DNA, 15 bp, Homo sapiens
ccctcttgcccatcc

SEQ ID NO: 662377 - DNA, 15 bp, Homo sapiens
ccctgagtctgggca

SEQ ID NO: 662378 - DNA, 20 bp, Homo sapiens
ccctgatgtgtcctcaggga

SEQ ID NO: 662379 - DNA, 12 bp, Homo sapiens
ccctgcctgaga

SEQ ID NO: 662380 - DNA, 21 bp, Homo sapiens
ccctgcctggcccccaacctc

SEQ ID NO: 662381 - DNA, 10 bp, Homo sapiens
ccctgctgcg

SEQ ID NO: 662382 - DNA, 15 bp, Homo sapiens
ccctgctgctggtgc

SEQ ID NO: 662383 - DNA, 19 bp, Homo sapiens
ccctgctgctggtgcacag

SEQ ID NO: 662384 - DNA, 18 bp, Homo sapiens
ccctggaactcctggcct

SEQ ID NO: 662385 - DNA, 18 bp, Homo sapiens
ccctggcagacacaaccc

SEQ ID NO: 662386 - DNA, 15 bp, Homo sapiens
ccctggcctggctgg

SEQ ID NO: 662387 - DNA, 12 bp, Homo sapiens
ccctggctccct

SEQ ID NO: 662388 - DNA, 13 bp, Homo sapiens
ccctggctttgcc

SEQ ID NO: 662389 - DNA, 14 bp, Homo sapiens
ccctggctttgcct

SEQ ID NO: 662390 - DNA, 18 bp, Homo sapiens
ccctggctttgcctcttc

SEQ ID NO: 662391 - DNA, 22 bp, Homo sapiens
ccctggctttgcctcttctttg

SEQ ID NO: 662392 - DNA, 16 bp, Homo sapiens
ccctgggccagggtct

SEQ ID NO: 662393 - DNA, 17 bp, Homo sapiens
ccctgggctattgctgc

SEQ ID NO: 662394 - DNA, 20 bp, Homo sapiens
ccctgggctggggcctcaga

SEQ ID NO: 662395 - DNA, 21 bp, Homo sapiens
ccctgggggcacaggaggcag

SEQ ID NO: 662396 - DNA, 20 bp, Homo sapiens
ccctgggtgtccccgctgct

SEQ ID NO: 662397 - DNA, 22 bp, Homo sapiens
ccctgggtgtccccgctgctgt

SEQ ID NO: 662398 - DNA, 13 bp, Homo sapiens
ccctgtcctgcag

SEQ ID NO: 662399 - DNA, 14 bp, Homo sapiens
ccctgtcctgcagt

SEQ ID NO: 662400 - DNA, 19 bp, Homo sapiens
ccctgtgtccacctgtggg

SEQ ID NO: 662401 - DNA, 11 bp, Homo sapiens
ccctgtgtgca

SEQ ID NO: 662402 - DNA, 12 bp, Homo sapiens
ccctgtgtgtgt

SEQ ID NO: 662403 - DNA, 15 bp, Homo sapiens
ccctgttttttgtag

SEQ ID NO: 662404 - DNA, 21 bp, Homo sapiens
cctctcttccccttcccttat

SEQ ID NO: 662405 - DNA, 13 bp, Homo sapiens
cctctgcagtctc

SEQ ID NO: 662406 - DNA, 17 bp, Homo sapiens
cctctgcagtctcattt

SEQ ID NO: 662407 - DNA, 18 bp, Homo sapiens
cctctgcagtctcatttc

SEQ ID NO: 662408 - DNA, 13 bp, Homo sapiens
cctctgctcaccg

SEQ ID NO: 662409 - DNA, 21 bp, Homo sapiens
cctctgctcaccgcccatcag

SEQ ID NO: 662410 - DNA, 23 bp, Homo sapiens
cctctgctcaccgcccatcaggg

SEQ ID NO: 662411 - DNA, 22 bp, Homo sapiens
cctctggcttgggcagggtctg

SEQ ID NO: 662412 - DNA, 19 bp, Homo sapiens
cctctgggtccttggctcc

SEQ ID NO: 662413 - DNA, 19 bp, Homo sapiens
ccttatggatgatttaagt

SEQ ID NO: 662414 - DNA, 10 bp, Homo sapiens
ccttatttat

SEQ ID NO: 662415 - DNA, 20 bp, Homo sapiens
ccttcaaaactatagcttgc

SEQ ID NO: 662416 - DNA, 13 bp, Homo sapiens
ccttcacaaatgt

SEQ ID NO: 662417 - DNA, 17 bp, Homo sapiens
ccttcactctccagggt

SEQ ID NO: 662418 - DNA, 21 bp, Homo sapiens
ccttcagtgaactaagtccct

SEQ ID NO: 662419 - DNA, 22 bp, Homo sapiens
ccttccatgtgcctttctttgc

SEQ ID NO: 662420 - DNA, 18 bp, Homo sapiens
ccttcctcagctgcctcc

SEQ ID NO: 662421 - DNA, 15 bp, Homo sapiens
ccttcctcctgcctt

SEQ ID NO: 662422 - DNA, 21 bp, Homo sapiens
ccttcctcttgtctgatttct

SEQ ID NO: 662423 - DNA, 15 bp, Homo sapiens
ccttctactcccctt

SEQ ID NO: 662424 - DNA, 22 bp, Homo sapiens
ccttctcacacacaactgtcca

SEQ ID NO: 662425 - DNA, 21 bp, Homo sapiens
ccttgaaaaatgacaattgtg

SEQ ID NO: 662426 - DNA, 18 bp, Homo sapiens
ccttgaaactttgggaaa

SEQ ID NO: 662427 - DNA, 11 bp, Homo sapiens
ccttgagacca

SEQ ID NO: 662428 - DNA, 16 bp, Homo sapiens
ccttgagaccacaggg

SEQ ID NO: 662429 - DNA, 13 bp, Homo sapiens
ccttgagccctgg

SEQ ID NO: 662430 - DNA, 15 bp, Homo sapiens
ccttgagccctggct

SEQ ID NO: 662431 - DNA, 14 bp, Homo sapiens
ccttgcccccagtg

SEQ ID NO: 662432 - DNA, 17 bp, Homo sapiens
ccttgcccccagtgcct

SEQ ID NO: 662433 - DNA, 14 bp, Homo sapiens
ccttgctacctcaa

SEQ ID NO: 662434 - DNA, 17 bp, Homo sapiens
ccttgctctcctcatct

SEQ ID NO: 662435 - DNA, 18 bp, Homo sapiens
ccttgctctcctcatctc

SEQ ID NO: 662436 - DNA, 20 bp, Homo sapiens
ccttgctgtatgctgatcat

SEQ ID NO: 662437 - DNA, 21 bp, Homo sapiens
ccttgctgtatgctgatcatc

SEQ ID NO: 662438 - DNA, 16 bp, Homo sapiens
ccttggctcccggggg

SEQ ID NO: 662439 - DNA, 22 bp, Homo sapiens
ccttggtgccctcgcctcctcc

SEQ ID NO: 662440 - DNA, 11 bp, Homo sapiens
ccttgtgcctg

SEQ ID NO: 662441 - DNA, 23 bp, Homo sapiens
ccttgtgttcagctctttccaaa

SEQ ID NO: 662442 - DNA, 23 bp, Homo sapiens
cctttaaaacgcgtctgcctggg

SEQ ID NO: 662443 - DNA, 18 bp, Homo sapiens
cctttaacttttttttct

SEQ ID NO: 662444 - DNA, 19 bp, Homo sapiens
cctttaacttttttttctc

SEQ ID NO: 662445 - DNA, 20 bp, Homo sapiens
cctttaacttttttttctct

SEQ ID NO: 662446 - DNA, 21 bp, Homo sapiens
cctttaacttttttttctctc

SEQ ID NO: 662447 - DNA, 23 bp, Homo sapiens
cctttaacttttttttctctctt

SEQ ID NO: 662448 - DNA, 22 bp, Homo sapiens
cctttaggatctcaggcttctg

SEQ ID NO: 662449 - DNA, 15 bp, Homo sapiens
cctttatttctcttc

SEQ ID NO: 662450 - DNA, 16 bp, Homo sapiens
cctttatttctcttct

SEQ ID NO: 662451 - DNA, 15 bp, Homo sapiens
cctttctcaactgtc

SEQ ID NO: 662452 - DNA, 14 bp, Homo sapiens
cctttctgtcccac

SEQ ID NO: 662453 - DNA, 11 bp, Homo sapiens
cctttgccgcg

SEQ ID NO: 662454 - DNA, 17 bp, Homo sapiens
cctttgctatgtaaggg

SEQ ID NO: 662455 - DNA, 20 bp, Homo sapiens
cctttggagatgctgagggt

SEQ ID NO: 662456 - DNA, 23 bp, Homo sapiens
cctttggcctggggtgcatctcc

SEQ ID NO: 662457 - DNA, 18 bp, Homo sapiens
cctttgtcctttttcagg

SEQ ID NO: 662458 - DNA, 19 bp, Homo sapiens
ccttttaaagaagctttat

SEQ ID NO: 662459 - DNA, 10 bp, Homo sapiens
ccttttccta

SEQ ID NO: 662460 - DNA, 17 bp, Homo sapiens
ccttttcctatccttat

SEQ ID NO: 662461 - DNA, 10 bp, Homo sapiens
ccttttcctt

SEQ ID NO: 662462 - DNA, 15 bp, Homo sapiens
ccttttgcagaagag

SEQ ID NO: 662463 - DNA, 19 bp, Homo sapiens
ccttttgcagaagagggtg

SEQ ID NO: 662464 - DNA, 14 bp, Homo sapiens
cctttttggcctgt

SEQ ID NO: 662465 - DNA, 16 bp, Homo sapiens
cgaagatggtggccac

SEQ ID NO: 662466 - DNA, 19 bp, Homo sapiens
cgacacacggggctcgggc

SEQ ID NO: 662467 - DNA, 12 bp, Homo sapiens
cgaccctggggg

SEQ ID NO: 662468 - DNA, 19 bp, Homo sapiens
cgaccctgggggcacagga

SEQ ID NO: 662469 - DNA, 16 bp, Homo sapiens
cgagaccatcctggct

SEQ ID NO: 662470 - DNA, 17 bp, Homo sapiens
cgagaccatcctggcta

SEQ ID NO: 662471 - DNA, 14 bp, Homo sapiens
cgagactttctcct

SEQ ID NO: 662472 - DNA, 14 bp, Homo sapiens
cgagagcctcgctt

SEQ ID NO: 662473 - DNA, 20 bp, Homo sapiens
cgagagcctcgctttttcat

SEQ ID NO: 662474 - DNA, 22 bp, Homo sapiens
cgagggtctcccctcctgcaca

SEQ ID NO: 662475 - DNA, 13 bp, Homo sapiens
cgaggtcaggaga

SEQ ID NO: 662476 - DNA, 14 bp, Homo sapiens
cgagtcaaagttga

SEQ ID NO: 662477 - DNA, 20 bp, Homo sapiens
cgagttaatgatggcagagg

SEQ ID NO: 662478 - DNA, 13 bp, Homo sapiens
cgagttcctctgg

SEQ ID NO: 662479 - DNA, 20 bp, Homo sapiens
cgagttcctctgggtttcta

SEQ ID NO: 662480 - DNA, 13 bp, Homo sapiens
cgatacctggagc

SEQ ID NO: 662481 - DNA, 13 bp, Homo sapiens
cgatctctcctgg

SEQ ID NO: 662482 - DNA, 17 bp, Homo sapiens
cgatctctcctggccta

SEQ ID NO: 662483 - DNA, 13 bp, Homo sapiens
cgatgttgtattg

SEQ ID NO: 662484 - DNA, 21 bp, Homo sapiens
cgattctcccaaagtaccttg

SEQ ID NO: 662485 - DNA, 11 bp, Homo sapiens
cgattctggat

SEQ ID NO: 662486 - DNA, 17 bp, Homo sapiens
cgcatcttgcctccagg

SEQ ID NO: 662487 - DNA, 18 bp, Homo sapiens
cgcccttccatgtgcctt

SEQ ID NO: 662488 - DNA, 18 bp, Homo sapiens
cgcctaaggtcacagcta

SEQ ID NO: 662489 - DNA, 14 bp, Homo sapiens
cgcctgagggaaga

SEQ ID NO: 662490 - DNA, 16 bp, Homo sapiens
cgcctttttggcctgt

SEQ ID NO: 662491 - DNA, 18 bp, Homo sapiens
cgcctttttggcctgtga

SEQ ID NO: 662492 - DNA, 13 bp, Homo sapiens
cgctacctccctc

SEQ ID NO: 662493 - DNA, 15 bp, Homo sapiens
cgctacctccctccc

SEQ ID NO: 662494 - DNA, 23 bp, Homo sapiens
cgctggactattgtgccaactgc

SEQ ID NO: 662495 - DNA, 20 bp, Homo sapiens
cgcttatcaactaatgattt

SEQ ID NO: 662496 - DNA, 15 bp, Homo sapiens
cgctttttcatcctt

SEQ ID NO: 662497 - DNA, 18 bp, Homo sapiens
cgctttttcatccttctt

SEQ ID NO: 662498 - DNA, 18 bp, Homo sapiens
cggaggcctcgagcagag

SEQ ID NO: 662499 - DNA, 18 bp, Homo sapiens
cggaggcctgcgaccctg

SEQ ID NO: 662500 - DNA, 22 bp, Homo sapiens
cggaggcctgcgaccctggggg

SEQ ID NO: 662501 - DNA, 19 bp, Homo sapiens
cggcatattattccatatc

SEQ ID NO: 662502 - DNA, 16 bp, Homo sapiens
cggccttgatcccctt

SEQ ID NO: 662503 - DNA, 15 bp, Homo sapiens
cggctgcacaacagc

SEQ ID NO: 662504 - DNA, 21 bp, Homo sapiens
cgggacatcacagggtgggcc

SEQ ID NO: 662505 - DNA, 14 bp, Homo sapiens
cgggcgcggtggct

SEQ ID NO: 662506 - DNA, 20 bp, Homo sapiens
cgggctttaatagtcacctt

SEQ ID NO: 662507 - DNA, 18 bp, Homo sapiens
cggtcagaggagcgcagg

SEQ ID NO: 662508 - DNA, 19 bp, Homo sapiens
cggtcagtgccttttggaa

SEQ ID NO: 662509 - DNA, 20 bp, Homo sapiens
cggtggctcacgcctgtaat

SEQ ID NO: 662510 - DNA, 20 bp, Homo sapiens
cggtttccagggaggggccg

SEQ ID NO: 662511 - DNA, 14 bp, Homo sapiens
cgtaacggccttga

SEQ ID NO: 662512 - DNA, 16 bp, Homo sapiens
cgtacaaccccctcca

SEQ ID NO: 662513 - DNA, 19 bp, Homo sapiens
cgtacaaccccctccaccc

SEQ ID NO: 662514 - DNA, 14 bp, Homo sapiens
cgtacatctgcaat

SEQ ID NO: 662515 - DNA, 13 bp, Homo sapiens
cgtagaaaatttg

SEQ ID NO: 662516 - DNA, 14 bp, Homo sapiens
cgtagctctgctgc

SEQ ID NO: 662517 - DNA, 16 bp, Homo sapiens
cgtagctctgctgctg

SEQ ID NO: 662518 - DNA, 15 bp, Homo sapiens
cgtcaagacatttgc

SEQ ID NO: 662519 - DNA, 21 bp, Homo sapiens
cgtcacccctgtttctggcac

SEQ ID NO: 662520 - DNA, 21 bp, Homo sapiens
cgtcagccacctgggaacaca

SEQ ID NO: 662521 - DNA, 13 bp, Homo sapiens
cgtccagctcagc

SEQ ID NO: 662522 - DNA, 13 bp, Homo sapiens
cgtccatctccct

SEQ ID NO: 662523 - DNA, 14 bp, Homo sapiens
cgtccctggcgcag

SEQ ID NO: 662524 - DNA, 15 bp, Homo sapiens
cgtcctccaagctca

SEQ ID NO: 662525 - DNA, 16 bp, Homo sapiens
cgtcctcgagcaactg

SEQ ID NO: 662526 - DNA, 15 bp, Homo sapiens
cgtctgaggcctgcc

SEQ ID NO: 662527 - DNA, 23 bp, Homo sapiens
cgtctgaggcctgccccctgggc

SEQ ID NO: 662528 - DNA, 14 bp, Homo sapiens
ctggtccctggaaa

SEQ ID NO: 662529 - DNA, 18 bp, Homo sapiens
ctggtctctacataaaat

SEQ ID NO: 662530 - DNA, 16 bp, Homo sapiens
ctggtgaatattttca

SEQ ID NO: 662531 - DNA, 17 bp, Homo sapiens
ctggtgctcctgcatct

SEQ ID NO: 662532 - DNA, 19 bp, Homo sapiens
ctggttccctgctgcgctg

SEQ ID NO: 662533 - DNA, 21 bp, Homo sapiens
ctggttccctgctgcgctgct

SEQ ID NO: 662534 - DNA, 13 bp, Homo sapiens
ctggttcttgaaa

SEQ ID NO: 662535 - DNA, 18 bp, Homo sapiens
ctggtttaattcagcaga

SEQ ID NO: 662536 - DNA, 15 bp, Homo sapiens
ctgtaaagtgcctta

SEQ ID NO: 662537 - DNA, 14 bp, Homo sapiens
ctgtaatcccagca

SEQ ID NO: 662538 - DNA, 20 bp, Homo sapiens
ctgtaatcttttatttaagt

SEQ ID NO: 662539 - DNA, 21 bp, Homo sapiens
ctgtaattgcactttttaagt

SEQ ID NO: 662540 - DNA, 21 bp, Homo sapiens
ctgtacagaaagtatcacaaa

SEQ ID NO: 662541 - DNA, 13 bp, Homo sapiens
ctgtacatttaaa

SEQ ID NO: 662542 - DNA, 16 bp, Homo sapiens
ctgtacatttaaaatt

SEQ ID NO: 662543 - DNA, 23 bp, Homo sapiens
ctgtactatcctgtaaatatatc

SEQ ID NO: 662544 - DNA, 23 bp, Homo sapiens
ctgtactctggggtgctgcctga

SEQ ID NO: 662545 - DNA, 19 bp, Homo sapiens
ctgtactgttactgggccc

SEQ ID NO: 662546 - DNA, 22 bp, Homo sapiens
ctgtactgttactgggccctga

SEQ ID NO: 662547 - DNA, 20 bp, Homo sapiens
ctgtagctacattttcagaa

SEQ ID NO: 662548 - DNA, 13 bp, Homo sapiens
ctgtaggcctcag

SEQ ID NO: 662549 - DNA, 21 bp, Homo sapiens
ctgtagtttatggcagaaggg

SEQ ID NO: 662550 - DNA, 16 bp, Homo sapiens
ctgtatatttgtaaag

SEQ ID NO: 662551 - DNA, 16 bp, Homo sapiens
ctgtatcattttcttt

SEQ ID NO: 662552 - DNA, 12 bp, Homo sapiens
ctgtatgattta

SEQ ID NO: 662553 - DNA, 15 bp, Homo sapiens
ctgtatgctgatcat

SEQ ID NO: 662554 - DNA, 18 bp, Homo sapiens
ctgtatgggagcttaact

SEQ ID NO: 662555 - DNA, 21 bp, Homo sapiens
ctgtattactgaataatatca

SEQ ID NO: 662556 - DNA, 23 bp, Homo sapiens
ctgtattactgaataatatcaaa

SEQ ID NO: 662557 - DNA, 22 bp, Homo sapiens
ctgtatttctaagaagttgttt

SEQ ID NO: 662558 - DNA, 22 bp, Homo sapiens
ctgtatttggtatatactttgc

SEQ ID NO: 662559 - DNA, 14 bp, Homo sapiens
ctgtattttaatgt

SEQ ID NO: 662560 - DNA, 15 bp, Homo sapiens
ctgtcaccaaggaaa

SEQ ID NO: 662561 - DNA, 16 bp, Homo sapiens
ctgtcaccaaggaaac

SEQ ID NO: 662562 - DNA, 20 bp, Homo sapiens
ctgtcacttgctgctttttc

SEQ ID NO: 662563 - DNA, 14 bp, Homo sapiens
ctgtcatgcttcat

SEQ ID NO: 662564 - DNA, 17 bp, Homo sapiens
ctgtcccaaggaggggg

SEQ ID NO: 662565 - DNA, 19 bp, Homo sapiens
ctgtccccaaacaggacag

SEQ ID NO: 662566 - DNA, 17 bp, Homo sapiens
ctgtccctctccttgcc

SEQ ID NO: 662567 - DNA, 15 bp, Homo sapiens
ctgtcccttgcctct

SEQ ID NO: 662568 - DNA, 22 bp, Homo sapiens
ctgtcccttgcctctgccctgg

SEQ ID NO: 662569 - DNA, 14 bp, Homo sapiens
ctgtcccttgctgt

SEQ ID NO: 662570 - DNA, 16 bp, Homo sapiens
ctgtcccttttccctt

SEQ ID NO: 662571 - DNA, 14 bp, Homo sapiens
ctgtcctccctctg

SEQ ID NO: 662572 - DNA, 17 bp, Homo sapiens
ctgtcctgcagtcccac

SEQ ID NO: 662573 - DNA, 19 bp, Homo sapiens
ctgtccttaacccacctct

SEQ ID NO: 662574 - DNA, 23 bp, Homo sapiens
ctgtcgttgttgtggaagcatgt

SEQ ID NO: 662575 - DNA, 23 bp, Homo sapiens
ctgtctctaccaaaaaaaggaag

SEQ ID NO: 662576 - DNA, 15 bp, Homo sapiens
ctgtctcttccatgc

SEQ ID NO: 662577 - DNA, 19 bp, Homo sapiens
ctgtctgttgtattcattg

SEQ ID NO: 662578 - DNA, 18 bp, Homo sapiens
ctgtcttccacagccgcc

SEQ ID NO: 662579 - DNA, 18 bp, Homo sapiens
ctgtcttgatgactgctg

SEQ ID NO: 662580 - DNA, 13 bp, Homo sapiens
ctgtgaagccacc

SEQ ID NO: 662581 - DNA, 20 bp, Homo sapiens
ctgtgagaaggtttattgtt

SEQ ID NO: 662582 - DNA, 13 bp, Homo sapiens
ctgtgagattttg

SEQ ID NO: 662583 - DNA, 22 bp, Homo sapiens
ctgtgaggccatacttgtgaaa

SEQ ID NO: 662584 - DNA, 20 bp, Homo sapiens
ctgtgatatgtctgctgagt

SEQ ID NO: 662585 - DNA, 15 bp, Homo sapiens
ctgtgcagacccagt

SEQ ID NO: 662586 - DNA, 23 bp, Homo sapiens
ctgttggtctgccttctgctgaa

SEQ ID NO: 662587 - DNA, 17 bp, Homo sapiens
ctgttgtaagaattctg

SEQ ID NO: 662588 - DNA, 21 bp, Homo sapiens
ctgttgtaagaattctgattg

SEQ ID NO: 662589 - DNA, 22 bp, Homo sapiens
ctgtttacatccagagttctgt

SEQ ID NO: 662590 - DNA, 13 bp, Homo sapiens
ctgtttataatga

SEQ ID NO: 662591 - DNA, 17 bp, Homo sapiens
ctgtttataatgaagaa

SEQ ID NO: 662592 - DNA, 21 bp, Homo sapiens
ctgtttatggccacatttaat

SEQ ID NO: 662593 - DNA, 14 bp, Homo sapiens
ctgtttccagggtc

SEQ ID NO: 662594 - DNA, 18 bp, Homo sapiens
ctgtttctaagaaaatgt

SEQ ID NO: 662595 - DNA, 21 bp, Homo sapiens
ctgtttctctgccgctacctc

SEQ ID NO: 662596 - DNA, 21 bp, Homo sapiens
ctgttttgtttggcaaggaaa

SEQ ID NO: 662597 - DNA, 22 bp, Homo sapiens
ctgttttgtttggcaaggaaag

SEQ ID NO: 662598 - DNA, 17 bp, Homo sapiens
cttaaaaaataatacaa

SEQ ID NO: 662599 - DNA, 19 bp, Homo sapiens
cttaaataatgcttcagat

SEQ ID NO: 662600 - DNA, 12 bp, Homo sapiens
cttaaatttaat

SEQ ID NO: 662601 - DNA, 16 bp, Homo sapiens
cttaaatttaatacca

SEQ ID NO: 662602 - DNA, 11 bp, Homo sapiens
cttaacctttg

SEQ ID NO: 662603 - DNA, 13 bp, Homo sapiens
cttaacctttgct

SEQ ID NO: 662604 - DNA, 15 bp, Homo sapiens
cttaacctttgctat

SEQ ID NO: 662605 - DNA, 13 bp, Homo sapiens
cttaagaattgaa

SEQ ID NO: 662606 - DNA, 16 bp, Homo sapiens
cttaagcaggtttgtt

SEQ ID NO: 662607 - DNA, 19 bp, Homo sapiens
cttaagttagttccactga

SEQ ID NO: 662608 - DNA, 22 bp, Homo sapiens
cttaatcaagatttttttcctg

SEQ ID NO: 662609 - DNA, 22 bp, Homo sapiens
cttaatctaatctaaaagctct

SEQ ID NO: 662610 - DNA, 17 bp, Homo sapiens
cttaatggagttcttgt

SEQ ID NO: 662611 - DNA, 17 bp, Homo sapiens
cttaattgactgaaatt

SEQ ID NO: 662612 - DNA, 13 bp, Homo sapiens
cttaatttagaaa

SEQ ID NO: 662613 - DNA, 23 bp, Homo sapiens
cttaatttatttcttaacctttg

SEQ ID NO: 662614 - DNA, 15 bp, Homo sapiens
cttacaatattgatt

SEQ ID NO: 662615 - DNA, 20 bp, Homo sapiens
cttacaatattgattgggaa

SEQ ID NO: 662616 - DNA, 15 bp, Homo sapiens
cttacctaacatctg

SEQ ID NO: 662617 - DNA, 11 bp, Homo sapiens
cttactatttc

SEQ ID NO: 662618 - DNA, 13 bp, Homo sapiens
cttactatttctg

SEQ ID NO: 662619 - DNA, 22 bp, Homo sapiens
cttactatttctgggtcttttg

SEQ ID NO: 662620 - DNA, 21 bp, Homo sapiens
cttactttaattactggaatt

SEQ ID NO: 662621 - DNA, 13 bp, Homo sapiens
cttactttgctga

SEQ ID NO: 662622 - DNA, 18 bp, Homo sapiens
cttagcgtcaagacattt

SEQ ID NO: 662623 - DNA, 19 bp, Homo sapiens
cttagcgtcaagacatttg

SEQ ID NO: 662624 - DNA, 14 bp, Homo sapiens
cttagggaaagatg

SEQ ID NO: 662625 - DNA, 13 bp, Homo sapiens
cttagggaagctg

SEQ ID NO: 662626 - DNA, 20 bp, Homo sapiens
cttagggaagctggcctgag

SEQ ID NO: 662627 - DNA, 15 bp, Homo sapiens
cttaggggaaggaga

SEQ ID NO: 662628 - DNA, 15 bp, Homo sapiens
cttagtcatggtgtt

SEQ ID NO: 662629 - DNA, 14 bp, Homo sapiens
cttagtgggccagg

SEQ ID NO: 662630 - DNA, 21 bp, Homo sapiens
cttataaaaataaagggaaga

SEQ ID NO: 662631 - DNA, 19 bp, Homo sapiens
cttataaaatcctgtgcaa

SEQ ID NO: 662632 - DNA, 21 bp, Homo sapiens
cttatagtctaagactatata

SEQ ID NO: 662633 - DNA, 14 bp, Homo sapiens
cttatatgtacttt

SEQ ID NO: 662634 - DNA, 19 bp, Homo sapiens
cttatctcgaatttgaaga

SEQ ID NO: 662635 - DNA, 20 bp, Homo sapiens
cttatctcgaatttgaagag

SEQ ID NO: 662636 - DNA, 20 bp, Homo sapiens
cttatcttgaccatactaat

SEQ ID NO: 662637 - DNA, 13 bp, Homo sapiens
cttattgccaaaa

SEQ ID NO: 662638 - DNA, 15 bp, Homo sapiens
cttatttaccctttt

SEQ ID NO: 662639 - DNA, 19 bp, Homo sapiens
cttatttacccttttcccc

SEQ ID NO: 662640 - DNA, 12 bp, Homo sapiens
cttatttattta

SEQ ID NO: 662641 - DNA, 13 bp, Homo sapiens
cttatttcataat

SEQ ID NO: 662642 - DNA, 15 bp, Homo sapiens
cttatttcataattg

SEQ ID NO: 662643 - DNA, 16 bp, Homo sapiens
cttatttctatgacaa

SEQ ID NO: 662644 - DNA, 21 bp, Homo sapiens
cttatttgccttctactcccc

SEQ ID NO: 662645 - DNA, 16 bp, Homo sapiens
cttattttgtcttatt

SEQ ID NO: 662646 - DNA, 18 bp, Homo sapiens
cttattttgtcttattct

SEQ ID NO: 662647 - DNA, 14 bp, Homo sapiens
cttatttttctgag

SEQ ID NO: 662648 - DNA, 22 bp, Homo sapiens
cttatttttctgaggtccttat

SEQ ID NO: 662649 - DNA, 21 bp, Homo sapiens
cttcaaaagtttgtttgctta

SEQ ID NO: 662650 - DNA, 18 bp, Homo sapiens
cttcaatgtgcataatga

SEQ ID NO: 662651 - DNA, 12 bp, Homo sapiens
cttcacaaatgt

SEQ ID NO: 662652 - DNA, 16 bp, Homo sapiens
cttcacaaatgtcatt

SEQ ID NO: 662653 - DNA, 16 bp, Homo sapiens
cttcaccaagaagcaa

SEQ ID NO: 662654 - DNA, 21 bp, Homo sapiens
cttcacccgagttcctctggg

SEQ ID NO: 662655 - DNA, 18 bp, Homo sapiens
cttcactctccagggtac

SEQ ID NO: 662656 - DNA, 13 bp, Homo sapiens
cttcactctctcc

SEQ ID NO: 662657 - DNA, 22 bp, Homo sapiens
cttcactctctccgtctgtttt

SEQ ID NO: 662658 - DNA, 16 bp, Homo sapiens
cttcacttcaagctgt

SEQ ID NO: 662659 - DNA, 19 bp, Homo sapiens
cttcagatattattgcttt

SEQ ID NO: 662660 - DNA, 20 bp, Homo sapiens
cttcagctagcttttaggaa

SEQ ID NO: 662661 - DNA, 19 bp, Homo sapiens
cttcagggaaggtgaaaca

SEQ ID NO: 662662 - DNA, 20 bp, Homo sapiens
cttcagggaaggtgaaacag

SEQ ID NO: 662663 - DNA, 16 bp, Homo sapiens
cttcagtattttctcc

SEQ ID NO: 662664 - DNA, 21 bp, Homo sapiens
cttccaaagtaaaattgctgt

SEQ ID NO: 662665 - DNA, 15 bp, Homo sapiens
cttccaacactccat

SEQ ID NO: 662666 - DNA, 19 bp, Homo sapiens
cttccaacccattagccat

SEQ ID NO: 662667 - DNA, 21 bp, Homo sapiens
cttccagcatttagctggcca

SEQ ID NO: 662668 - DNA, 16 bp, Homo sapiens
cttccaggaggacata

SEQ ID NO: 662669 - DNA, 19 bp, Homo sapiens
cttccatgtatcttttgaa

SEQ ID NO: 662670 - DNA, 18 bp, Homo sapiens
cttccatgtgcctttctt

SEQ ID NO: 662671 - DNA, 22 bp, Homo sapiens
cttccatgtgcctttctttgcc

SEQ ID NO: 662672 - DNA, 19 bp, Homo sapiens
cttcccaccctgcccctca

SEQ ID NO: 662673 - DNA, 19 bp, Homo sapiens
cttcccagaatgttactga

SEQ ID NO: 662674 - DNA, 13 bp, Homo sapiens
cttcccagcaatt

SEQ ID NO: 662675 - DNA, 13 bp, Homo sapiens
cttcccatgcatt

SEQ ID NO: 662676 - DNA, 14 bp, Homo sapiens
cttcccatttcttc

SEQ ID NO: 662677 - DNA, 20 bp, Homo sapiens
cttcccatttcttcccactt

SEQ ID NO: 662678 - DNA, 14 bp, Homo sapiens
cttccccttccctt

SEQ ID NO: 662679 - DNA, 15 bp, Homo sapiens
cttccctgctttgca

SEQ ID NO: 662680 - DNA, 15 bp, Homo sapiens
cttccgcagtgtggc

SEQ ID NO: 662681 - DNA, 21 bp, Homo sapiens
cttccgcagtgtggccaggct

SEQ ID NO: 662682 - DNA, 19 bp, Homo sapiens
cttcctcagctgcctcctg

SEQ ID NO: 662683 - DNA, 21 bp, Homo sapiens
cttcctttgcccttcctcctg

SEQ ID NO: 662684 - DNA, 13 bp, Homo sapiens
cttcgttcctgcg

SEQ ID NO: 662685 - DNA, 18 bp, Homo sapiens
cttctaagaagacatttt

SEQ ID NO: 662686 - DNA, 17 bp, Homo sapiens
cttctaagtcattcata

SEQ ID NO: 662687 - DNA, 20 bp, Homo sapiens
cttctaatttatattatcca

SEQ ID NO: 662688 - DNA, 17 bp, Homo sapiens
cttctacccttttcctt

SEQ ID NO: 662689 - DNA, 12 bp, Homo sapiens
cttctacctgcc

SEQ ID NO: 662690 - DNA, 15 bp, Homo sapiens
cttctacctgccctc

SEQ ID NO: 662691 - DNA, 15 bp, Homo sapiens
cttctactcccctta

SEQ ID NO: 662692 - DNA, 15 bp, Homo sapiens
cttctactcctgcct

SEQ ID NO: 662693 - DNA, 14 bp, Homo sapiens
cttctactgccttg

SEQ ID NO: 662694 - DNA, 19 bp, Homo sapiens
gaaatgaaaacatgtaata

SEQ ID NO: 662695 - DNA, 22 bp, Homo sapiens
gaaatgctgttagtaaatttct

SEQ ID NO: 662696 - DNA, 19 bp, Homo sapiens
gaaatgggaaaaaacttaa

SEQ ID NO: 662697 - DNA, 16 bp, Homo sapiens
gaaatgggacggaggt

SEQ ID NO: 662698 - DNA, 12 bp, Homo sapiens
gaaatgttctta

SEQ ID NO: 662699 - DNA, 22 bp, Homo sapiens
gaaattaatatggcttcaccaa

SEQ ID NO: 662700 - DNA, 19 bp, Homo sapiens
gaaattactaattttactt

SEQ ID NO: 662701 - DNA, 15 bp, Homo sapiens
gagatctctgtagaa

SEQ ID NO: 662702 - DNA, 17 bp, Homo sapiens
gagatgctgtaacttaa

SEQ ID NO: 662703 - DNA, 16 bp, Homo sapiens
gagatttcctcctggc

SEQ ID NO: 662704 - DNA, 12 bp, Homo sapiens
gagcacctcacc

SEQ ID NO: 662705 - DNA, 13 bp, Homo sapiens
gagcagaggaggg

SEQ ID NO: 662706 - DNA, 13 bp, Homo sapiens
gagcagggaaggc

SEQ ID NO: 662707 - DNA, 17 bp, Homo sapiens
gagcagggaaggcctga

SEQ ID NO: 662708 - DNA, 19 bp, Homo sapiens
gagcagtcgcctgcctgca

SEQ ID NO: 662709 - DNA, 21 bp, Homo sapiens
gagcagtcgcctgcctgcagc

SEQ ID NO: 662710 - DNA, 17 bp, Homo sapiens
gagcagtggccatcatc

SEQ ID NO: 662711 - DNA, 17 bp, Homo sapiens
gagccagtaatctttat

SEQ ID NO: 662712 - DNA, 22 bp, Homo sapiens
gagccatcggtgaaactaacag

SEQ ID NO: 662713 - DNA, 17 bp, Homo sapiens
gagccatttaaagacca

SEQ ID NO: 662714 - DNA, 15 bp, Homo sapiens
gagccattttggtaa

SEQ ID NO: 662715 - DNA, 13 bp, Homo sapiens
gagccctctcctc

SEQ ID NO: 662716 - DNA, 15 bp, Homo sapiens
gagccctctcctccc

SEQ ID NO: 662717 - DNA, 13 bp, Homo sapiens
gagcctcctggga

SEQ ID NO: 662718 - DNA, 20 bp, Homo sapiens
gagcctcgctttttcatcct

SEQ ID NO: 662719 - DNA, 21 bp, Homo sapiens
gagcctcgctttttcatcctt

SEQ ID NO: 662720 - DNA, 19 bp, Homo sapiens
gagcctggttcagacacag

SEQ ID NO: 662721 - DNA, 18 bp, Homo sapiens
gagccttttgctctctgt

SEQ ID NO: 662722 - DNA, 21 bp, Homo sapiens
gagcgcaggcagcgcagggct

SEQ ID NO: 662723 - DNA, 19 bp, Homo sapiens
gagctagaaaaataaaatg

SEQ ID NO: 662724 - DNA, 17 bp, Homo sapiens
gagctaggaagagtcta

SEQ ID NO: 662725 - DNA, 19 bp, Homo sapiens
gagctctgaaatcttccca

SEQ ID NO: 662726 - DNA, 17 bp, Homo sapiens
gcccgactgactggagg

SEQ ID NO: 662727 - DNA, 14 bp, Homo sapiens
gccctaagggagtg

SEQ ID NO: 662728 - DNA, 14 bp, Homo sapiens
gccctatgctgtgc

SEQ ID NO: 662729 - DNA, 14 bp, Homo sapiens
gccctccaggcttt

SEQ ID NO: 662730 - DNA, 22 bp, Homo sapiens
gccctccgaccacttccagggg

SEQ ID NO: 662731 - DNA, 22 bp, Homo sapiens
gccctcgcctcctcctcctgcc

SEQ ID NO: 662732 - DNA, 12 bp, Homo sapiens
gccctcttctcg

SEQ ID NO: 662733 - DNA, 13 bp, Homo sapiens
gccctggcctggc

SEQ ID NO: 662734 - DNA, 15 bp, Homo sapiens
gccctggctgttctg

SEQ ID NO: 662735 - DNA, 16 bp, Homo sapiens
gccctgggggtctggg

SEQ ID NO: 662736 - DNA, 20 bp, Homo sapiens
gccctgtgcccgactgactg

SEQ ID NO: 662737 - DNA, 23 bp, Homo sapiens
gcccttacagccctaagtggctg

SEQ ID NO: 662738 - DNA, 17 bp, Homo sapiens
gcccttccatgtgcctt

SEQ ID NO: 662739 - DNA, 17 bp, Homo sapiens
gccctttcaaagcactt

SEQ ID NO: 662740 - DNA, 17 bp, Homo sapiens
gccgctacctccctccc

SEQ ID NO: 662741 - DNA, 13 bp, Homo sapiens
gccggccctgtgt

SEQ ID NO: 662742 - DNA, 16 bp, Homo sapiens
gccggccctgtgtgca

SEQ ID NO: 662743 - DNA, 18 bp, Homo sapiens
gccggccctgtgtgcagg

SEQ ID NO: 662744 - DNA, 18 bp, Homo sapiens
gccgggcgcggtggctca

SEQ ID NO: 662745 - DNA, 20 bp, Homo sapiens
gccgtcccaccagcttcact

SEQ ID NO: 662746 - DNA, 14 bp, Homo sapiens
gccgtggcacagct

SEQ ID NO: 662747 - DNA, 16 bp, Homo sapiens
gccgtggcacagctgg

SEQ ID NO: 662748 - DNA, 16 bp, Homo sapiens
gcctacctcagcctcc

SEQ ID NO: 662749 - DNA, 21 bp, Homo sapiens
gcctcaccatgtgagctcttc

SEQ ID NO: 662750 - DNA, 22 bp, Homo sapiens
gcctcagaccccctcagccttg

SEQ ID NO: 662751 - DNA, 17 bp, Homo sapiens
gcctcattgtgtctccc

SEQ ID NO: 662752 - DNA, 22 bp, Homo sapiens
gcctccaattttttaagtgaaa

SEQ ID NO: 662753 - DNA, 16 bp, Homo sapiens
gcctccaggtgcagag

SEQ ID NO: 662754 - DNA, 14 bp, Homo sapiens
gcctcctcctcctg

SEQ ID NO: 662755 - DNA, 15 bp, Homo sapiens
gcctcctcctcctgc

SEQ ID NO: 662756 - DNA, 20 bp, Homo sapiens
gcctcctcctcctgccctcc

SEQ ID NO: 662757 - DNA, 12 bp, Homo sapiens
gcctcctgggaa

SEQ ID NO: 662758 - DNA, 14 bp, Homo sapiens
gcctcctgtgggga

SEQ ID NO: 662759 - DNA, 23 bp, Homo sapiens
gcctcgcgggtgtcacattcctg

SEQ ID NO: 662760 - DNA, 16 bp, Homo sapiens
gcctcgctttttcatc

SEQ ID NO: 662761 - DNA, 18 bp, Homo sapiens
gcctcggcccctcccaca

SEQ ID NO: 662762 - DNA, 20 bp, Homo sapiens
gcctcgttggaagaggaaca

SEQ ID NO: 662763 - DNA, 13 bp, Homo sapiens
gcctctccctggg

SEQ ID NO: 662764 - DNA, 14 bp, Homo sapiens
gcctctccctgggt

SEQ ID NO: 662765 - DNA, 15 bp, Homo sapiens
gcctctgagatttgg

SEQ ID NO: 662766 - DNA, 12 bp, Homo sapiens
gcctctgcagtc

SEQ ID NO: 662767 - DNA, 18 bp, Homo sapiens
gcctctgcagtctcattt

SEQ ID NO: 662768 - DNA, 14 bp, Homo sapiens
gcctctgccctgga

SEQ ID NO: 662769 - DNA, 15 bp, Homo sapiens
gcctctgccctggat

SEQ ID NO: 662770 - DNA, 17 bp, Homo sapiens
gcctctgccctggattg

SEQ ID NO: 662771 - DNA, 15 bp, Homo sapiens
gcctcttacttgcca

SEQ ID NO: 662772 - DNA, 18 bp, Homo sapiens
gcctcttctttgtgcctt

SEQ ID NO: 662773 - DNA, 19 bp, Homo sapiens
gcctcttctttgtgccttt

SEQ ID NO: 662774 - DNA, 23 bp, Homo sapiens
gcctgaataaagagccctaagtt

SEQ ID NO: 662775 - DNA, 21 bp, Homo sapiens
gcctgactaatttttgtattt

SEQ ID NO: 662776 - DNA, 20 bp, Homo sapiens
gcctgagagaattggctcaa

SEQ ID NO: 662777 - DNA, 21 bp, Homo sapiens
gcctgagagtatttaggcaga

SEQ ID NO: 662778 - DNA, 14 bp, Homo sapiens
gcctgcagcaggca

SEQ ID NO: 662779 - DNA, 16 bp, Homo sapiens
gcctgcagcaggcagc

SEQ ID NO: 662780 - DNA, 14 bp, Homo sapiens
gcctgcagggccat

SEQ ID NO: 662781 - DNA, 18 bp, Homo sapiens
gcctgcagggccatggct

SEQ ID NO: 662782 - DNA, 15 bp, Homo sapiens
gcgttaagggcagag

SEQ ID NO: 662783 - DNA, 16 bp, Homo sapiens
gcgttaagggcagagt

SEQ ID NO: 662784 - DNA, 20 bp, Homo sapiens
gcgtttcaccatgttggcca

SEQ ID NO: 662785 - DNA, 12 bp, Homo sapiens
gctaaagcctgt

SEQ ID NO: 662786 - DNA, 17 bp, Homo sapiens
gctaaagcctgtgggtt

SEQ ID NO: 662787 - DNA, 20 bp, Homo sapiens
gctaacatggtgaaaccccg

SEQ ID NO: 662788 - DNA, 15 bp, Homo sapiens
gctaaggcaggagga

SEQ ID NO: 662789 - DNA, 19 bp, Homo sapiens
gctaagggtgggtgctcag

SEQ ID NO: 662790 - DNA, 20 bp, Homo sapiens
gctaagggtgggtgctcaga

SEQ ID NO: 662791 - DNA, 11 bp, Homo sapiens
gctaataaatc

SEQ ID NO: 662792 - DNA, 17 bp, Homo sapiens
gctaataaatctcttct

SEQ ID NO: 662793 - DNA, 18 bp, Homo sapiens
gctaatcaaagccagggt

SEQ ID NO: 662794 - DNA, 19 bp, Homo sapiens
gctaatcaaagccagggtc

SEQ ID NO: 662795 - DNA, 20 bp, Homo sapiens
gctaatcaaagccagggtct

SEQ ID NO: 662796 - DNA, 13 bp, Homo sapiens
gctaatttttgta

SEQ ID NO: 662797 - DNA, 14 bp, Homo sapiens
gctacagaaaccac

SEQ ID NO: 662798 - DNA, 16 bp, Homo sapiens
gctacatgctggggtc

SEQ ID NO: 662799 - DNA, 20 bp, Homo sapiens
gctacattttcagaagttaa

SEQ ID NO: 662800 - DNA, 21 bp, Homo sapiens
gctacattttcagaagttaac

SEQ ID NO: 662801 - DNA, 17 bp, Homo sapiens
gctacctcaagggggac

SEQ ID NO: 662802 - DNA, 16 bp, Homo sapiens
gctacctttcaaagct

SEQ ID NO: 662803 - DNA, 16 bp, Homo sapiens
gctactaatgatgttt

SEQ ID NO: 662804 - DNA, 20 bp, Homo sapiens
gctactatgatttaatttga

SEQ ID NO: 662805 - DNA, 21 bp, Homo sapiens
gctactgcactccagcctggg

SEQ ID NO: 662806 - DNA, 18 bp, Homo sapiens
gctactgttgtaagaatt

SEQ ID NO: 662807 - DNA, 16 bp, Homo sapiens
gctacttgggaggctg

SEQ ID NO: 662808 - DNA, 22 bp, Homo sapiens
gctacttggggacataatttca

SEQ ID NO: 662809 - DNA, 17 bp, Homo sapiens
gctagaagtctgtccaa

SEQ ID NO: 662810 - DNA, 19 bp, Homo sapiens
gctagacagaaacatgtct

SEQ ID NO: 662811 - DNA, 12 bp, Homo sapiens
gctagagaaatc

SEQ ID NO: 662812 - DNA, 20 bp, Homo sapiens
gctagagaaatcagctgcta

SEQ ID NO: 662813 - DNA, 21 bp, Homo sapiens
gctagagaaatcagctgctat

SEQ ID NO: 662814 - DNA, 16 bp, Homo sapiens
gctagcttttaggaaa

SEQ ID NO: 662815 - DNA, 22 bp, Homo sapiens
gctagtgtacctcctctcagtg

SEQ ID NO: 662816 - DNA, 22 bp, Homo sapiens
gctagtgtttctagctaaataa

SEQ ID NO: 662817 - DNA, 19 bp, Homo sapiens
gctatccccatctccctgc

SEQ ID NO: 662818 - DNA, 22 bp, Homo sapiens
gctatccccatctccctgcctg

SEQ ID NO: 662819 - DNA, 14 bp, Homo sapiens
gctatggaacataa

SEQ ID NO: 662820 - DNA, 19 bp, Homo sapiens
gctatggcaggataagaaa

SEQ ID NO: 662821 - DNA, 14 bp, Homo sapiens
gctatgtaagggtc

SEQ ID NO: 662822 - DNA, 16 bp, Homo sapiens
gctatgtataaaatac

SEQ ID NO: 662823 - DNA, 17 bp, Homo sapiens
gctatgttactattttc

SEQ ID NO: 662824 - DNA, 16 bp, Homo sapiens
gctatttatgggcccc

SEQ ID NO: 662825 - DNA, 22 bp, Homo sapiens
gctatttatgggcccctggcac

SEQ ID NO: 662826 - DNA, 19 bp, Homo sapiens
gctcaacagacaattagaa

SEQ ID NO: 662827 - DNA, 19 bp, Homo sapiens
gctcactgcaacctctgcc

SEQ ID NO: 662828 - DNA, 16 bp, Homo sapiens
gctcagccctggcctg

SEQ ID NO: 662829 - DNA, 20 bp, Homo sapiens
gctcagccctggcctggctg

SEQ ID NO: 662830 - DNA, 21 bp, Homo sapiens
gctcagccctggcctggctgg

SEQ ID NO: 662831 - DNA, 19 bp, Homo sapiens
gctcagtgtttttgtgaat

SEQ ID NO: 662832 - DNA, 21 bp, Homo sapiens
gctcattttcctgacatttgt

SEQ ID NO: 662833 - DNA, 19 bp, Homo sapiens
gctccactcttgatctctc

SEQ ID NO: 662834 - DNA, 17 bp, Homo sapiens
gctccagctttctgcca

SEQ ID NO: 662835 - DNA, 14 bp, Homo sapiens
gctccataaagtac

SEQ ID NO: 662836 - DNA, 15 bp, Homo sapiens
gctcccaggccccag

SEQ ID NO: 662837 - DNA, 16 bp, Homo sapiens
gctcccaggggtctcc

SEQ ID NO: 662838 - DNA, 18 bp, Homo sapiens
gctcccaggggtctccct

SEQ ID NO: 662839 - DNA, 19 bp, Homo sapiens
gctcccaggggtctccctg

SEQ ID NO: 662840 - DNA, 19 bp, Homo sapiens
gctccccagcccacctgct

SEQ ID NO: 662841 - DNA, 21 bp, Homo sapiens
gctccccagcccacctgctcc

SEQ ID NO: 662842 - DNA, 16 bp, Homo sapiens
gctcccgggggcccca

SEQ ID NO: 662843 - DNA, 18 bp, Homo sapiens
gctccctcctccaggcct

SEQ ID NO: 662844 - DNA, 22 bp, Homo sapiens
gctccctcctccaggcctgcct

SEQ ID NO: 662845 - DNA, 21 bp, Homo sapiens
gctccctgtgtccacctgtgg

SEQ ID NO: 662846 - DNA, 22 bp, Homo sapiens
gctccctgtgtccacctgtggg

SEQ ID NO: 662847 - DNA, 18 bp, Homo sapiens
gctccgtagctctgctgc

SEQ ID NO: 662848 - DNA, 21 bp, Homo sapiens
gctccgtagctctgctgctga

SEQ ID NO: 662849 - DNA, 18 bp, Homo sapiens
gctcctcaactcacctaa

SEQ ID NO: 662850 - DNA, 15 bp, Homo sapiens
gctcctccccttcct

SEQ ID NO: 662851 - DNA, 16 bp, Homo sapiens
gctcctcctcacccac

SEQ ID NO: 662852 - DNA, 22 bp, Homo sapiens
gctcctgaaagaaacgctagaa

SEQ ID NO: 662853 - DNA, 20 bp, Homo sapiens
gctcctgcatctcatgagtg

SEQ ID NO: 662854 - DNA, 13 bp, Homo sapiens
gctctgctgctga

SEQ ID NO: 662855 - DNA, 14 bp, Homo sapiens
gctctgctgctgat

SEQ ID NO: 662856 - DNA, 20 bp, Homo sapiens
gctcttcctatccctctcct

SEQ ID NO: 662857 - DNA, 22 bp, Homo sapiens
gctcttgtttttattaatttat

SEQ ID NO: 662858 - DNA, 14 bp, Homo sapiens
gctctttagccagt

SEQ ID NO: 662859 - DNA, 13 bp, Homo sapiens
gctctttccaaat

SEQ ID NO: 662860 - DNA, 19 bp, Homo sapiens
gctcttttcctggtgctct

SEQ ID NO: 662861 - DNA, 12 bp, Homo sapiens
gctgaaagactc

SEQ ID NO: 662862 - DNA, 14 bp, Homo sapiens
gctgaatgcctcct

SEQ ID NO: 662863 - DNA, 19 bp, Homo sapiens
gctgaatgcctcctgtggg

SEQ ID NO: 662864 - DNA, 21 bp, Homo sapiens
gctgacatgaagctgttgtgt

SEQ ID NO: 662865 - DNA, 15 bp, Homo sapiens
gctgactgaatgcag

SEQ ID NO: 662866 - DNA, 16 bp, Homo sapiens
gctgagggcagactgg

SEQ ID NO: 662867 - DNA, 19 bp, Homo sapiens
gctgagggtgtttcttcct

SEQ ID NO: 662868 - DNA, 15 bp, Homo sapiens
gctgagtgagtggga

SEQ ID NO: 662869 - DNA, 23 bp, Homo sapiens
gctgagttggcctggccatttcc

SEQ ID NO: 662870 - DNA, 22 bp, Homo sapiens
gctgatcatcgccagaggtgct

SEQ ID NO: 662871 - DNA, 12 bp, Homo sapiens
gctgcacaggct

SEQ ID NO: 662872 - DNA, 13 bp, Homo sapiens
gctgcacaggctg

SEQ ID NO: 662873 - DNA, 16 bp, Homo sapiens
gctgcagcaccgaggg

SEQ ID NO: 662874 - DNA, 20 bp, Homo sapiens
gctgcagcaccgaggggcct

SEQ ID NO: 662875 - DNA, 12 bp, Homo sapiens
gctgcaggcagg

SEQ ID NO: 662876 - DNA, 21 bp, Homo sapiens
gctgcaggcaggcggctcctc

SEQ ID NO: 662877 - DNA, 22 bp, Homo sapiens
gctgccagccttgagccctggc

SEQ ID NO: 662878 - DNA, 13 bp, Homo sapiens
gctgcccctctca

SEQ ID NO: 662879 - DNA, 23 bp, Homo sapiens
gctgccccttaaacacaggctgt

SEQ ID NO: 662880 - DNA, 13 bp, Homo sapiens
gctgccctgagaa

SEQ ID NO: 662881 - DNA, 15 bp, Homo sapiens
gctgcctcctgcgcc

SEQ ID NO: 662882 - DNA, 16 bp, Homo sapiens
gctgcctctgctccct

SEQ ID NO: 662883 - DNA, 13 bp, Homo sapiens
gctgcctctttcc

SEQ ID NO: 662884 - DNA, 16 bp, Homo sapiens
gctgctagagccagca

SEQ ID NO: 662885 - DNA, 17 bp, Homo sapiens
gctgctatccccatctc

SEQ ID NO: 662886 - DNA, 19 bp, Homo sapiens
gctgctcatctgatttttg

SEQ ID NO: 662887 - DNA, 14 bp, Homo sapiens
gctgctccaggcct

SEQ ID NO: 662888 - DNA, 16 bp, Homo sapiens
gctgctccaggcctgc

SEQ ID NO: 662889 - DNA, 22 bp, Homo sapiens
gctgctccaggcctgcagcagg

SEQ ID NO: 662890 - DNA, 13 bp, Homo sapiens
gctgctccctggc

SEQ ID NO: 662891 - DNA, 15 bp, Homo sapiens
gctgctggtgcacag

SEQ ID NO: 662892 - DNA, 22 bp, Homo sapiens
gctgctgtgcaacggtctcctg

SEQ ID NO: 662893 - DNA, 19 bp, Homo sapiens
gctgctgtgcagcatggaa

SEQ ID NO: 662894 - DNA, 16 bp, Homo sapiens
gctggagcctggggtg

SEQ ID NO: 662895 - DNA, 19 bp, Homo sapiens
gctggcacgtgacaggctc

SEQ ID NO: 662896 - DNA, 14 bp, Homo sapiens
gctgggagcctggt

SEQ ID NO: 662897 - DNA, 21 bp, Homo sapiens
gctgggcccgacatggctccg

SEQ ID NO: 662898 - DNA, 14 bp, Homo sapiens
gctggggcctcaga

SEQ ID NO: 662899 - DNA, 16 bp, Homo sapiens
gctggggcctcagacc

SEQ ID NO: 662900 - DNA, 15 bp, Homo sapiens
gctggtaagagaagt

SEQ ID NO: 662901 - DNA, 17 bp, Homo sapiens
gctggtacaacggaggc

SEQ ID NO: 662902 - DNA, 14 bp, Homo sapiens
gctggtccttattt

SEQ ID NO: 662903 - DNA, 16 bp, Homo sapiens
gctggtccttatttat

SEQ ID NO: 662904 - DNA, 18 bp, Homo sapiens
gctggtccttatttattt

SEQ ID NO: 662905 - DNA, 14 bp, Homo sapiens
gctggttgtcttta

SEQ ID NO: 662906 - DNA, 20 bp, Homo sapiens
gctgtagctacaagggaagc

SEQ ID NO: 662907 - DNA, 14 bp, Homo sapiens
gctgtatttttatt

SEQ ID NO: 662908 - DNA, 14 bp, Homo sapiens
gctgtcaaggctca

SEQ ID NO: 662909 - DNA, 17 bp, Homo sapiens
gctgtcaccaaggaaac

SEQ ID NO: 662910 - DNA, 21 bp, Homo sapiens
gctgtcattgcacataagctt

SEQ ID NO: 662911 - DNA, 22 bp, Homo sapiens
gctgtcccttgcttgcctgcag

SEQ ID NO: 662912 - DNA, 20 bp, Homo sapiens
gctgtccttaacccacctct

SEQ ID NO: 662913 - DNA, 22 bp, Homo sapiens
gctgtcgatgtaggcattctgg

SEQ ID NO: 662914 - DNA, 16 bp, Homo sapiens
gctgtgcggatctctg

SEQ ID NO: 662915 - DNA, 21 bp, Homo sapiens
gctgtgtatatggtatatata

SEQ ID NO: 662916 - DNA, 18 bp, Homo sapiens
gctgtgtgtcccaggcag

SEQ ID NO: 662917 - DNA, 20 bp, Homo sapiens
gctgtgtgtcccaggcaggg

SEQ ID NO: 662918 - DNA, 18 bp, Homo sapiens
gctgttatttcttccctg

SEQ ID NO: 662919 - DNA, 21 bp, Homo sapiens
gctgttctgtggttcctctgc

SEQ ID NO: 662920 - DNA, 23 bp, Homo sapiens
gctgtttcaaaaaaatctattga

SEQ ID NO: 662921 - DNA, 13 bp, Homo sapiens
gctgtttgaaatg

SEQ ID NO: 662922 - DNA, 14 bp, Homo sapiens
gctgtttgaaatgt

SEQ ID NO: 662923 - DNA, 16 bp, Homo sapiens
gcttaattgactgaaa

SEQ ID NO: 662924 - DNA, 15 bp, Homo sapiens
gcttatctcttttat

SEQ ID NO: 662925 - DNA, 19 bp, Homo sapiens
gcttcaaggatatactgca

SEQ ID NO: 662926 - DNA, 17 bp, Homo sapiens
gcttcaccaagaagcaa

SEQ ID NO: 662927 - DNA, 19 bp, Homo sapiens
gcttcgggaaaatattcat

SEQ ID NO: 662928 - DNA, 18 bp, Homo sapiens
gcttctactcctgcctca

SEQ ID NO: 662929 - DNA, 23 bp, Homo sapiens
gcttctccaggaagcccagggca

SEQ ID NO: 662930 - DNA, 14 bp, Homo sapiens
gcttgacataccta

SEQ ID NO: 662931 - DNA, 21 bp, Homo sapiens
gcttgacatacctaccagtat

SEQ ID NO: 662932 - DNA, 11 bp, Homo sapiens
gcttgcagaac

SEQ ID NO: 662933 - DNA, 15 bp, Homo sapiens
gcttgcctgcagggc

SEQ ID NO: 662934 - DNA, 22 bp, Homo sapiens
gcttgcctgcagggccatggct

SEQ ID NO: 662935 - DNA, 13 bp, Homo sapiens
gcttgctccctgt

SEQ ID NO: 662936 - DNA, 18 bp, Homo sapiens
gcttgctgggtacctggt

SEQ ID NO: 662937 - DNA, 14 bp, Homo sapiens
gcttggactacaca

SEQ ID NO: 662938 - DNA, 14 bp, Homo sapiens
gcttggtgtgaccc

SEQ ID NO: 662939 - DNA, 23 bp, Homo sapiens
gcttgtaactaaaataattttgt

SEQ ID NO: 662940 - DNA, 12 bp, Homo sapiens
gcttgtgttctg

SEQ ID NO: 662941 - DNA, 16 bp, Homo sapiens
gcttgtgttctgctcc

SEQ ID NO: 662942 - DNA, 23 bp, Homo sapiens
gcttgttttataaaattttgctt

SEQ ID NO: 662943 - DNA, 13 bp, Homo sapiens
gctttaagccttc

SEQ ID NO: 662944 - DNA, 16 bp, Homo sapiens
tggcaattgtctattt

SEQ ID NO: 662945 - DNA, 16 bp, Homo sapiens
tggcacagaccaggcc

SEQ ID NO: 662946 - DNA, 20 bp, Homo sapiens
tggcacagctgggagcctgg

SEQ ID NO: 662947 - DNA, 22 bp, Homo sapiens
tggcacagcttttgtatagaaa

SEQ ID NO: 662948 - DNA, 15 bp, Homo sapiens
tggcacatgccacct

SEQ ID NO: 662949 - DNA, 15 bp, Homo sapiens
tggcagaagggaatt

SEQ ID NO: 662950 - DNA, 21 bp, Homo sapiens
tggcagaagggaattgctcag

SEQ ID NO: 662951 - DNA, 23 bp, Homo sapiens
tggcaggactcctggcagggcca

SEQ ID NO: 662952 - DNA, 14 bp, Homo sapiens
tggcagggccacct

SEQ ID NO: 662953 - DNA, 19 bp, Homo sapiens
tggcagggccacctgcagg

SEQ ID NO: 662954 - DNA, 22 bp, Homo sapiens
tggcatcaagaggtgggagggc

SEQ ID NO: 662955 - DNA, 23 bp, Homo sapiens
tggcatcaagaggtgggagggcc

SEQ ID NO: 662956 - DNA, 21 bp, Homo sapiens
tggcatggttgttgcatatag

SEQ ID NO: 662957 - DNA, 18 bp, Homo sapiens
tggcatttctctttaaac

SEQ ID NO: 662958 - DNA, 14 bp, Homo sapiens
tggccaatgtgcat

SEQ ID NO: 662959 - DNA, 13 bp, Homo sapiens
tggccacagactg

SEQ ID NO: 662960 - DNA, 16 bp, Homo sapiens
tggccacatggcggag

SEQ ID NO: 662961 - DNA, 22 bp, Homo sapiens
tggccacatttaatatcttcag

SEQ ID NO: 662962 - DNA, 19 bp, Homo sapiens
tggcccatgggagccaggc

SEQ ID NO: 662963 - DNA, 19 bp, Homo sapiens
tggcccccaataaaggcag

SEQ ID NO: 662964 - DNA, 23 bp, Homo sapiens
tggcccccaataaaggcagctgc

SEQ ID NO: 662965 - DNA, 23 bp, Homo sapiens
tggcccctactttgtggcaatct

SEQ ID NO: 662966 - DNA, 19 bp, Homo sapiens
tggccctaaatagcagaaa

SEQ ID NO: 662967 - DNA, 12 bp, Homo sapiens
tggccctgggcg

SEQ ID NO: 662968 - DNA, 12 bp, Homo sapiens
tggccctggggg

SEQ ID NO: 662969 - DNA, 20 bp, Homo sapiens
tggccctgggggtctgggcg

SEQ ID NO: 662970 - DNA, 22 bp, Homo sapiens
tggcctcagctgaatgcctcct

SEQ ID NO: 662971 - DNA, 23 bp, Homo sapiens
tggcctccccatgggcacagtgg

SEQ ID NO: 662972 - DNA, 15 bp, Homo sapiens
tggcctgagagggga

SEQ ID NO: 662973 - DNA, 23 bp, Homo sapiens
tggcctggggtgcatctcctccc

SEQ ID NO: 662974 - DNA, 15 bp, Homo sapiens
tggcctgtgatgttt

SEQ ID NO: 662975 - DNA, 21 bp, Homo sapiens
tggcctgtgatgttttatcct

SEQ ID NO: 662976 - DNA, 21 bp, Homo sapiens
tggccttgccccaggccctgc

SEQ ID NO: 662977 - DNA, 13 bp, Homo sapiens
tggcgtggcctcc

SEQ ID NO: 662978 - DNA, 14 bp, Homo sapiens
tggctcacacctgt

SEQ ID NO: 662979 - DNA, 13 bp, Homo sapiens
tggctccactctt

SEQ ID NO: 662980 - DNA, 19 bp, Homo sapiens
tggctccctcctccaggcc

SEQ ID NO: 662981 - DNA, 18 bp, Homo sapiens
tggctgacatgaagctgt

SEQ ID NO: 662982 - DNA, 23 bp, Homo sapiens
tggctggaaagcagagcctcctg

SEQ ID NO: 662983 - DNA, 19 bp, Homo sapiens
tggcttcaccaagaagcaa

SEQ ID NO: 662984 - DNA, 14 bp, Homo sapiens
tggcttccccactc

SEQ ID NO: 662985 - DNA, 13 bp, Homo sapiens
tggcttgtctata

SEQ ID NO: 662986 - DNA, 15 bp, Homo sapiens
tggctttaagccttc

SEQ ID NO: 662987 - DNA, 14 bp, Homo sapiens
tggctttgcctctt

SEQ ID NO: 662988 - DNA, 21 bp, Homo sapiens
tgggaaaacatgttaatgaca

SEQ ID NO: 662989 - DNA, 20 bp, Homo sapiens
tgggaaacactgaaatgaaa

SEQ ID NO: 662990 - DNA, 20 bp, Homo sapiens
tgggaaatatgccactgacc

SEQ ID NO: 662991 - DNA, 18 bp, Homo sapiens
tgggaacaaggaaggaaa

SEQ ID NO: 662992 - DNA, 14 bp, Homo sapiens
tgggaacacagttc

SEQ ID NO: 662993 - DNA, 13 bp, Homo sapiens
tgggacggaggtc

SEQ ID NO: 662994 - DNA, 20 bp, Homo sapiens
tgggactccatgctccttga

SEQ ID NO: 662995 - DNA, 18 bp, Homo sapiens
tgggagagtacctgtgtg

SEQ ID NO: 662996 - DNA, 22 bp, Homo sapiens
tgggagcctggttcagacacag

SEQ ID NO: 662997 - DNA, 13 bp, Homo sapiens
tgggaggaggcct

SEQ ID NO: 662998 - DNA, 11 bp, Homo sapiens
tgggaggctga

SEQ ID NO: 662999 - DNA, 14 bp, Homo sapiens
tgggaggctgaggc

SEQ ID NO: 663000 - DNA, 15 bp, Homo sapiens
tgggaggctgaggca

SEQ ID NO: 663001 - DNA, 18 bp, Homo sapiens
tgggatattgaatgttaa

SEQ ID NO: 663002 - DNA, 14 bp, Homo sapiens
tgggatgaatgcca

SEQ ID NO: 663003 - DNA, 22 bp, Homo sapiens
tgggattaagaaaccttgctct

SEQ ID NO: 663004 - DNA, 12 bp, Homo sapiens
tgggattattct

SEQ ID NO: 663005 - DNA, 18 bp, Homo sapiens
tgggattattctttgaaa

SEQ ID NO: 663006 - DNA, 13 bp, Homo sapiens
tgggattttgcaa

SEQ ID NO: 663007 - DNA, 20 bp, Homo sapiens
tgggcagtctttcttgaaat

SEQ ID NO: 663008 - DNA, 23 bp, Homo sapiens
tgggcagtctttcttgaaattga

SEQ ID NO: 663009 - DNA, 21 bp, Homo sapiens
tgggccaggcagagaacagaa

SEQ ID NO: 663010 - DNA, 20 bp, Homo sapiens
tgggccagggctgccctgag

SEQ ID NO: 663011 - DNA, 14 bp, Homo sapiens
tgggccatgtccaa

SEQ ID NO: 663012 - DNA, 15 bp, Homo sapiens
tgggcccctggcact

SEQ ID NO: 663013 - DNA, 21 bp, Homo sapiens
tgggccctgagtctgggcagc

SEQ ID NO: 663014 - DNA, 22 bp, Homo sapiens
tgggccctgagtctgggcagct

SEQ ID NO: 663015 - DNA, 16 bp, Homo sapiens
tgggccttagtgggcc

SEQ ID NO: 663016 - DNA, 18 bp, Homo sapiens
tgggcgtccagctcagcc

SEQ ID NO: 663017 - DNA, 19 bp, Homo sapiens
tgggcgtccagctcagccc

SEQ ID NO: 663018 - DNA, 21 bp, Homo sapiens
tgggcgtccagctcagccctg

SEQ ID NO: 663019 - DNA, 22 bp, Homo sapiens
tgggcgtccagctcagccctgg

SEQ ID NO: 663020 - DNA, 19 bp, Homo sapiens
tgggctacatgctggggtc

SEQ ID NO: 663021 - DNA, 17 bp, Homo sapiens
tgggctattgctgctgc

SEQ ID NO: 663022 - DNA, 14 bp, Homo sapiens
tgggctcaagcttt

SEQ ID NO: 663023 - DNA, 23 bp, Homo sapiens
tgggctcagcctgagcctctgct

SEQ ID NO: 663024 - DNA, 22 bp, Homo sapiens
tgggcttttggggagccagaag

SEQ ID NO: 663025 - DNA, 13 bp, Homo sapiens
tggggacaggccc

SEQ ID NO: 663026 - DNA, 21 bp, Homo sapiens
tggggacttctggggacagac

SEQ ID NO: 663027 - DNA, 19 bp, Homo sapiens
tggggagtggttaggcagc

SEQ ID NO: 663028 - DNA, 14 bp, Homo sapiens
tggggcaggctggg

SEQ ID NO: 663029 - DNA, 15 bp, Homo sapiens
tggggcaggctgggc

SEQ ID NO: 663030 - DNA, 16 bp, Homo sapiens
tggggcaggctgggcc

SEQ ID NO: 663031 - DNA, 18 bp, Homo sapiens
tggggcaggctgggccat

SEQ ID NO: 663032 - DNA, 13 bp, Homo sapiens
tggggcagggagc

SEQ ID NO: 663033 - DNA, 14 bp, Homo sapiens
tggggcagggagct

SEQ ID NO: 663034 - DNA, 21 bp, Homo sapiens
tggggcagggagctgggcccg

SEQ ID NO: 663035 - DNA, 17 bp, Homo sapiens
tggggcatcctgtgcca

SEQ ID NO: 663036 - DNA, 14 bp, Homo sapiens
tggggcccagtgca

SEQ ID NO: 663037 - DNA, 14 bp, Homo sapiens
tggggcctcagacc

SEQ ID NO: 663038 - DNA, 12 bp, Homo sapiens
tggggcctgaga

SEQ ID NO: 663039 - DNA, 14 bp, Homo sapiens
tggggcctgagaga

SEQ ID NO: 663040 - DNA, 16 bp, Homo sapiens
tgggggcacaggaggc

SEQ ID NO: 663041 - DNA, 17 bp, Homo sapiens
tggggggacccagtgca

SEQ ID NO: 663042 - DNA, 15 bp, Homo sapiens
tggggggcattgagt

SEQ ID NO: 663043 - DNA, 19 bp, Homo sapiens
tgggggtggggggactgcc

SEQ ID NO: 663044 - DNA, 16 bp, Homo sapiens
tggggtgacagtcatc

SEQ ID NO: 663045 - DNA, 17 bp, Homo sapiens
tggggtgacagtcatca

SEQ ID NO: 663046 - DNA, 12 bp, Homo sapiens
tggggtgcatct

SEQ ID NO: 663047 - DNA, 13 bp, Homo sapiens
tgggtacatcaag

SEQ ID NO: 663048 - DNA, 19 bp, Homo sapiens
tgggtacctggtccccact

SEQ ID NO: 663049 - DNA, 14 bp, Homo sapiens
tgggtcaggccacc

SEQ ID NO: 663050 - DNA, 22 bp, Homo sapiens
tgggtccttggctcccgggggc

SEQ ID NO: 663051 - DNA, 19 bp, Homo sapiens
tgggtctggggacaggccc

SEQ ID NO: 663052 - DNA, 13 bp, Homo sapiens
tgggtgctcagaa

SEQ ID NO: 663053 - DNA, 15 bp, Homo sapiens
tgggtgctcagaata

SEQ ID NO: 663054 - DNA, 22 bp, Homo sapiens
tgggtgctcagaataaggcagg

SEQ ID NO: 663055 - DNA, 16 bp, Homo sapiens
tgggtgggattttgca

SEQ ID NO: 663056 - DNA, 14 bp, Homo sapiens
tgggtgtagccagg

SEQ ID NO: 663057 - DNA, 17 bp, Homo sapiens
tgggtgtatataatttt

SEQ ID NO: 663058 - DNA, 17 bp, Homo sapiens
tgggtgtctccttaagc

SEQ ID NO: 663059 - DNA, 22 bp, Homo sapiens
tggtaaacggtttttattaaag

SEQ ID NO: 663060 - DNA, 14 bp, Homo sapiens
tgtatataatttta

SEQ ID NO: 663061 - DNA, 20 bp, Homo sapiens
tgtatatatattcatataca

SEQ ID NO: 663062 - DNA, 19 bp, Homo sapiens
tgtatatcactaaaagcat

SEQ ID NO: 663063 - DNA, 21 bp, Homo sapiens
tgtatattccttttaaagaag

SEQ ID NO: 663064 - DNA, 16 bp, Homo sapiens
tgtatattttaatgtt

SEQ ID NO: 663065 - DNA, 21 bp, Homo sapiens
tgtatcaaatacatttaaaac

SEQ ID NO: 663066 - DNA, 23 bp, Homo sapiens
tgtatcaaatacatttaaaacat

SEQ ID NO: 663067 - DNA, 22 bp, Homo sapiens
tgtatccaaggaaacattttat

SEQ ID NO: 663068 - DNA, 17 bp, Homo sapiens
tgtatcctggccctggg

SEQ ID NO: 663069 - DNA, 21 bp, Homo sapiens
tgtatctgacccactttgtaa

SEQ ID NO: 663070 - DNA, 12 bp, Homo sapiens
tgtatctgttta

SEQ ID NO: 663071 - DNA, 14 bp, Homo sapiens
tgtatgactaaaga

SEQ ID NO: 663072 - DNA, 21 bp, Homo sapiens
tgtatgactaaagagagaatg

SEQ ID NO: 663073 - DNA, 14 bp, Homo sapiens
tgtatggatatatt

SEQ ID NO: 663074 - DNA, 16 bp, Homo sapiens
tgtatggatatatttg

SEQ ID NO: 663075 - DNA, 17 bp, Homo sapiens
tgtatggatatatttga

SEQ ID NO: 663076 - DNA, 18 bp, Homo sapiens
tgtatggatatatttgaa

SEQ ID NO: 663077 - DNA, 19 bp, Homo sapiens
tgtatggatatatttgaaa

SEQ ID NO: 663078 - DNA, 15 bp, Homo sapiens
tgtatgtaaagttaa

SEQ ID NO: 663079 - DNA, 22 bp, Homo sapiens
tgtatgtgtgtaggttatcttt

SEQ ID NO: 663080 - DNA, 18 bp, Homo sapiens
tgtattactgaataatat

SEQ ID NO: 663081 - DNA, 18 bp, Homo sapiens
tgtattcttttctcagtg

SEQ ID NO: 663082 - DNA, 23 bp, Homo sapiens
tgtattgttttactcctttttat

SEQ ID NO: 663083 - DNA, 22 bp, Homo sapiens
tgtatttctctattttcataat

SEQ ID NO: 663084 - DNA, 14 bp, Homo sapiens
tgtattttgattat

SEQ ID NO: 663085 - DNA, 21 bp, Homo sapiens
tgtatttttatttttgcacaa

SEQ ID NO: 663086 - DNA, 20 bp, Homo sapiens
tgtcacatttagctgtgctc

SEQ ID NO: 663087 - DNA, 17 bp, Homo sapiens
tgtcaccggtcagtgcc

SEQ ID NO: 663088 - DNA, 12 bp, Homo sapiens
tgtcacttttta

SEQ ID NO: 663089 - DNA, 16 bp, Homo sapiens
tgtcactttttatgct

SEQ ID NO: 663090 - DNA, 13 bp, Homo sapiens
tgtgagtgtgaca

SEQ ID NO: 663091 - DNA, 17 bp, Homo sapiens
tgtgagtgtgacagggc

SEQ ID NO: 663092 - DNA, 22 bp, Homo sapiens
tgtgatacattttttaagcttc

SEQ ID NO: 663093 - DNA, 18 bp, Homo sapiens
tgtgatgttttatcctta

SEQ ID NO: 663094 - DNA, 14 bp, Homo sapiens
tgtgattaacttat

SEQ ID NO: 663095 - DNA, 18 bp, Homo sapiens
tgtgcataatgataaaat

SEQ ID NO: 663096 - DNA, 22 bp, Homo sapiens
tgtgcatggaggccctcctgtg

SEQ ID NO: 663097 - DNA, 21 bp, Homo sapiens
tgtgcatttttgtgaaatgaa

SEQ ID NO: 663098 - DNA, 22 bp, Homo sapiens
tgtgcatttttgtgaaatgaaa

SEQ ID NO: 663099 - DNA, 21 bp, Homo sapiens
tgtgccaactgccaggctgcc

SEQ ID NO: 663100 - DNA, 15 bp, Homo sapiens
tgtgccagcaccaca

SEQ ID NO: 663101 - DNA, 18 bp, Homo sapiens
tgtgccagcaccacagcc

SEQ ID NO: 663102 - DNA, 17 bp, Homo sapiens
tgtgcccatggcttctg

SEQ ID NO: 663103 - DNA, 13 bp, Homo sapiens
tgtgcctgtgtgc

SEQ ID NO: 663104 - DNA, 12 bp, Homo sapiens
tgtgcctttctt

SEQ ID NO: 663105 - DNA, 13 bp, Homo sapiens
tgtgcctttcttt

SEQ ID NO: 663106 - DNA, 19 bp, Homo sapiens
tgtgcctttctttgcctct

SEQ ID NO: 663107 - DNA, 13 bp, Homo sapiens
tgtgcctttggcc

SEQ ID NO: 663108 - DNA, 13 bp, Homo sapiens
tgtgcggaattca

SEQ ID NO: 663109 - DNA, 14 bp, Homo sapiens
tgtgctagaagctc

SEQ ID NO: 663110 - DNA, 11 bp, Homo sapiens
tgtgctggggg

SEQ ID NO: 663111 - DNA, 16 bp, Homo sapiens
tgtgctgggggaatga

SEQ ID NO: 663112 - DNA, 17 bp, Homo sapiens
tgtgctttttaagaata

SEQ ID NO: 663113 - DNA, 22 bp, Homo sapiens
tgtgctttttaagaatattttt

SEQ ID NO: 663114 - DNA, 23 bp, Homo sapiens
tgtggaaatgggacggaggtcct

SEQ ID NO: 663115 - DNA, 13 bp, Homo sapiens
tgtggaatgagtg

SEQ ID NO: 663116 - DNA, 15 bp, Homo sapiens
tgtggatataaaatg

SEQ ID NO: 663117 - DNA, 21 bp, Homo sapiens
tgtggatttttgtggtagtga

SEQ ID NO: 663118 - DNA, 19 bp, Homo sapiens
tgtggcagtcccttataat

SEQ ID NO: 663119 - DNA, 21 bp, Homo sapiens
tgtgggggaggcgcacagtgt

SEQ ID NO: 663120 - DNA, 14 bp, Homo sapiens
tgtggggggtcctt

SEQ ID NO: 663121 - DNA, 12 bp, Homo sapiens
tgtgggtgtagc

SEQ ID NO: 663122 - DNA, 16 bp, Homo sapiens
tgtggtacatggtgtt

SEQ ID NO: 663123 - DNA, 20 bp, Homo sapiens
tgtggtagcttatcttagaa

SEQ ID NO: 663124 - DNA, 14 bp, Homo sapiens
tgtggtggcctcag

SEQ ID NO: 663125 - DNA, 15 bp, Homo sapiens
tgtgtaaagatttat

SEQ ID NO: 663126 - DNA, 14 bp, Homo sapiens
tgtgtaaatttctc

SEQ ID NO: 663127 - DNA, 17 bp, Homo sapiens
tgtgtaagaaatacaga

SEQ ID NO: 663128 - DNA, 20 bp, Homo sapiens
tgtgtacaaatacatgtgta

SEQ ID NO: 663129 - DNA, 21 bp, Homo sapiens
ttaccagggactatctttgct

SEQ ID NO: 663130 - DNA, 14 bp, Homo sapiens
ttaccatcatctct

SEQ ID NO: 663131 - DNA, 15 bp, Homo sapiens
ttaccttgaaatgct

SEQ ID NO: 663132 - DNA, 16 bp, Homo sapiens
ttactcccccaccact

SEQ ID NO: 663133 - DNA, 23 bp, Homo sapiens
ttactcccccaccactcaggcca

SEQ ID NO: 663134 - DNA, 18 bp, Homo sapiens
ttactcctttttattcat

SEQ ID NO: 663135 - DNA, 18 bp, Homo sapiens
ttactgccttcctcctta

SEQ ID NO: 663136 - DNA, 21 bp, Homo sapiens
ttactttaacattttggaaat

SEQ ID NO: 663137 - DNA, 20 bp, Homo sapiens
ttactttactgcctgaataa

SEQ ID NO: 663138 - DNA, 15 bp, Homo sapiens
ttagaaaacaaaatt

SEQ ID NO: 663139 - DNA, 14 bp, Homo sapiens
ttagaaattagaaa

SEQ ID NO: 663140 - DNA, 23 bp, Homo sapiens
ttagaagcactacaccttgcctt

SEQ ID NO: 663141 - DNA, 13 bp, Homo sapiens
ttagaatgttgaa

SEQ ID NO: 663142 - DNA, 19 bp, Homo sapiens
ttagactatttctttttat

SEQ ID NO: 663143 - DNA, 15 bp, Homo sapiens
ttagagcttggacag

SEQ ID NO: 663144 - DNA, 13 bp, Homo sapiens
ttagatatttaca

SEQ ID NO: 663145 - DNA, 19 bp, Homo sapiens
ttagattaagaaatagaca

SEQ ID NO: 663146 - DNA, 11 bp, Homo sapiens
ttagcaagcaa

SEQ ID NO: 663147 - DNA, 18 bp, Homo sapiens
ttagcgtcaagacatttg

SEQ ID NO: 663148 - DNA, 19 bp, Homo sapiens
ttagcgtcaagacatttgc

SEQ ID NO: 663149 - DNA, 21 bp, Homo sapiens
ttagctttccaaggaagcaga

SEQ ID NO: 663150 - DNA, 13 bp, Homo sapiens
ttaggactagaag

SEQ ID NO: 663151 - DNA, 19 bp, Homo sapiens
ttaggcaaagataatttat

SEQ ID NO: 663152 - DNA, 19 bp, Homo sapiens
ttaggtcaaagttcataga

SEQ ID NO: 663153 - DNA, 22 bp, Homo sapiens
ttaggtcaataacactgtattt

SEQ ID NO: 663154 - DNA, 13 bp, Homo sapiens
ttagtgaatggga

SEQ ID NO: 663155 - DNA, 20 bp, Homo sapiens
ttagttaaattgaagaaagt

SEQ ID NO: 663156 - DNA, 16 bp, Homo sapiens
ttagttctttttgcca

SEQ ID NO: 663157 - DNA, 18 bp, Homo sapiens
ttagttttgtgaaggtga

SEQ ID NO: 663158 - DNA, 20 bp, Homo sapiens
ttataaaatcctgtgcaata

SEQ ID NO: 663159 - DNA, 13 bp, Homo sapiens
ttataaacagaaa

SEQ ID NO: 663160 - DNA, 18 bp, Homo sapiens
ttataagaagaagttcat

SEQ ID NO: 663161 - DNA, 21 bp, Homo sapiens
ttataagaagaagttcatgtc

SEQ ID NO: 663162 - DNA, 13 bp, Homo sapiens
ttataatgaagaa

SEQ ID NO: 663163 - DNA, 20 bp, Homo sapiens
ttatacagttgaaaacttgt

SEQ ID NO: 663164 - DNA, 21 bp, Homo sapiens
ttatagacaaaagaataagac

SEQ ID NO: 663165 - DNA, 17 bp, Homo sapiens
ttatagcaactaatgtt

SEQ ID NO: 663166 - DNA, 19 bp, Homo sapiens
ttatagcaactaatgtttg

SEQ ID NO: 663167 - DNA, 16 bp, Homo sapiens
ttatatagactgttga

SEQ ID NO: 663168 - DNA, 18 bp, Homo sapiens
ttatatgttgtaatattt

SEQ ID NO: 663169 - DNA, 17 bp, Homo sapiens
ttatcattaaaaattac

SEQ ID NO: 663170 - DNA, 16 bp, Homo sapiens
ttatccaaaatgtgta

SEQ ID NO: 663171 - DNA, 17 bp, Homo sapiens
ttatccaaaatgtgtat

SEQ ID NO: 663172 - DNA, 21 bp, Homo sapiens
ttatccaaaatgtgtatttct

SEQ ID NO: 663173 - DNA, 22 bp, Homo sapiens
ttatccaaaatgtgtatttctt

SEQ ID NO: 663174 - DNA, 18 bp, Homo sapiens
ttatccagaaaactgtga

SEQ ID NO: 663175 - DNA, 12 bp, Homo sapiens
ttatccctctct

SEQ ID NO: 663176 - DNA, 15 bp, Homo sapiens
ttatccctctcttcc

SEQ ID NO: 663177 - DNA, 23 bp, Homo sapiens
ttatccctctcttccccttccct

SEQ ID NO: 663178 - DNA, 18 bp, Homo sapiens
ttatcgaacgtggtctga

SEQ ID NO: 663179 - DNA, 23 bp, Homo sapiens
ttatcgaacgtggtctgattttg

SEQ ID NO: 663180 - DNA, 15 bp, Homo sapiens
ttatcgtttttgtat

SEQ ID NO: 663181 - DNA, 19 bp, Homo sapiens
ttatctcttttatatttgt

SEQ ID NO: 663182 - DNA, 19 bp, Homo sapiens
ttatgcacttttagaaatg

SEQ ID NO: 663183 - DNA, 22 bp, Homo sapiens
ttatgcacttttagaaatgcat

SEQ ID NO: 663184 - DNA, 18 bp, Homo sapiens
ttatgcagcaaatatatg

SEQ ID NO: 663185 - DNA, 19 bp, Homo sapiens
ttcagctctttccaaatta

SEQ ID NO: 663186 - DNA, 13 bp, Homo sapiens
ttcagctgcaagg

SEQ ID NO: 663187 - DNA, 14 bp, Homo sapiens
ttcagggtaaatag

SEQ ID NO: 663188 - DNA, 15 bp, Homo sapiens
ttcagtaacaagtgt

SEQ ID NO: 663189 - DNA, 21 bp, Homo sapiens
ttcagtattttctccacttca

SEQ ID NO: 663190 - DNA, 19 bp, Homo sapiens
ttcatagagatttgtctaa

SEQ ID NO: 663191 - DNA, 20 bp, Homo sapiens
ttcatcattccctctcatct

SEQ ID NO: 663192 - DNA, 15 bp, Homo sapiens
ttcatcattgtttct

SEQ ID NO: 663193 - DNA, 22 bp, Homo sapiens
ttcatccttctttccttgttca

SEQ ID NO: 663194 - DNA, 15 bp, Homo sapiens
ttcatgaaaatacca

SEQ ID NO: 663195 - DNA, 23 bp, Homo sapiens
ttcatgattatagcaactaatgt

SEQ ID NO: 663196 - DNA, 13 bp, Homo sapiens
ttcatgcttgaca

SEQ ID NO: 663197 - DNA, 22 bp, Homo sapiens
ttcatgcttgccatctgttcat

SEQ ID NO: 663198 - DNA, 18 bp, Homo sapiens
ttcatggctgctgttgct

SEQ ID NO: 663199 - DNA, 19 bp, Homo sapiens
ttcatggctgctgttgctt

SEQ ID NO: 663200 - DNA, 22 bp, Homo sapiens
ttcatggctgctgttgcttaaa

SEQ ID NO: 663201 - DNA, 18 bp, Homo sapiens
ttcattggtgaagtaaat

SEQ ID NO: 663202 - DNA, 16 bp, Homo sapiens
ttcatttgctttggaa

SEQ ID NO: 663203 - DNA, 19 bp, Homo sapiens
ttccaaattaaaacaaata

SEQ ID NO: 663204 - DNA, 15 bp, Homo sapiens
ttccaatgcttctgt

SEQ ID NO: 663205 - DNA, 19 bp, Homo sapiens
ttccactgcaaataaagcc

SEQ ID NO: 663206 - DNA, 21 bp, Homo sapiens
ttccactgcaaataaagcctt

SEQ ID NO: 663207 - DNA, 14 bp, Homo sapiens
ttccagcaattctc

SEQ ID NO: 663208 - DNA, 20 bp, Homo sapiens
ttccagcatttagctggcca

SEQ ID NO: 663209 - DNA, 20 bp, Homo sapiens
ttccaggtaacaggtgtgta

SEQ ID NO: 663210 - DNA, 18 bp, Homo sapiens
ttccagtggatcataaga

SEQ ID NO: 663211 - DNA, 15 bp, Homo sapiens
ttccagtgtctgtct

SEQ ID NO: 663212 - DNA, 23 bp, Homo sapiens
ttccatgcaactggagttcctta

SEQ ID NO: 663213 - DNA, 17 bp, Homo sapiens
ttccatgtgcctttctt

SEQ ID NO: 663214 - DNA, 22 bp, Homo sapiens
ttccatgtgcctttctttgcct

SEQ ID NO: 663215 - DNA, 16 bp, Homo sapiens
ttccattatgattctt

SEQ ID NO: 663216 - DNA, 11 bp, Homo sapiens
ttccatttgtg

SEQ ID NO: 663217 - DNA, 13 bp, Homo sapiens
ttccattttaatt

SEQ ID NO: 663218 - DNA, 13 bp, Homo sapiens
ttcccatttcttc

SEQ ID NO: 663219 - DNA, 22 bp, Homo sapiens
ttccccctgtttcagaggctca

SEQ ID NO: 663220 - DNA, 13 bp, Homo sapiens
ttcccccttccca

SEQ ID NO: 663221 - DNA, 18 bp, Homo sapiens
ttccccgagtgactctgg

SEQ ID NO: 663222 - DNA, 13 bp, Homo sapiens
ttccccttccctt

SEQ ID NO: 663223 - DNA, 14 bp, Homo sapiens
ttccccttccctta

SEQ ID NO: 663224 - DNA, 21 bp, Homo sapiens
ttccctgctttgcatctttgt

SEQ ID NO: 663225 - DNA, 17 bp, Homo sapiens
ttccgtttgcttttgtt

SEQ ID NO: 663226 - DNA, 14 bp, Homo sapiens
ttcctaacaaaatg

SEQ ID NO: 663227 - DNA, 14 bp, Homo sapiens
ttcctaacttttca

SEQ ID NO: 663228 - DNA, 22 bp, Homo sapiens
ttcctaacttttcaatgacatt

SEQ ID NO: 663229 - DNA, 21 bp, Homo sapiens
ttcctaagccacttgaaatgt

SEQ ID NO: 663230 - DNA, 15 bp, Homo sapiens
ttcctcagctgcctc

SEQ ID NO: 663231 - DNA, 16 bp, Homo sapiens
ttcctcagcttatctc

SEQ ID NO: 663232 - DNA, 16 bp, Homo sapiens
ttcctctcaccccact

SEQ ID NO: 663233 - DNA, 16 bp, Homo sapiens
ttcctctggtgtttat

SEQ ID NO: 663234 - DNA, 18 bp, Homo sapiens
ttcctgagatttcctcct

SEQ ID NO: 663235 - DNA, 17 bp, Homo sapiens
ttcctgttgtcaagaat

SEQ ID NO: 663236 - DNA, 12 bp, Homo sapiens
ttccttagtcat

SEQ ID NO: 663237 - DNA, 15 bp, Homo sapiens
ttccttatccctctc

SEQ ID NO: 663238 - DNA, 18 bp, Homo sapiens
ttccttatccctctcttc

SEQ ID NO: 663239 - DNA, 21 bp, Homo sapiens
ttccttatccctctcttcccc

SEQ ID NO: 663240 - DNA, 22 bp, Homo sapiens
ttccttatgtatcagtgtcctt

SEQ ID NO: 663241 - DNA, 19 bp, Homo sapiens
ttccttcaatgtgcataat

SEQ ID NO: 663242 - DNA, 15 bp, Homo sapiens
ttccttgaggacaga

SEQ ID NO: 663243 - DNA, 23 bp, Homo sapiens
ttccttggtcctagtaagaagac

SEQ ID NO: 663244 - DNA, 13 bp, Homo sapiens
ttccttgttcagc

SEQ ID NO: 663245 - DNA, 20 bp, Homo sapiens
ttcctttgcccttcctcctg

SEQ ID NO: 663246 - DNA, 19 bp, Homo sapiens
ttccttttaaagaagcttt

SEQ ID NO: 663247 - DNA, 14 bp, Homo sapiens
ttcctttttcttcg

SEQ ID NO: 663248 - DNA, 16 bp, Homo sapiens
ttcctttttcttcgct

SEQ ID NO: 663249 - DNA, 24 bp, Homo sapiens
ttccttttttggggagtacctgtc

SEQ ID NO: 663250 - DNA, 18 bp, Homo sapiens
ttcgaaggaacctgtgtt

SEQ ID NO: 663251 - DNA, 16 bp, Homo sapiens
ttcgctggactattgt

SEQ ID NO: 663252 - DNA, 16 bp, Homo sapiens
ttcgtgtactgcaaag

SEQ ID NO: 663253 - DNA, 12 bp, Homo sapiens
ttcgttcctgcg

SEQ ID NO: 663254 - DNA, 23 bp, Homo sapiens
ttcgttgcacagctgtttgaaat

SEQ ID NO: 663255 - DNA, 18 bp, Homo sapiens
ttctaaataaaaatatgt

SEQ ID NO: 663256 - DNA, 16 bp, Homo sapiens
ttctaacattaaatca

SEQ ID NO: 663257 - DNA, 16 bp, Homo sapiens
ttctaagaaaatgtag

SEQ ID NO: 663258 - DNA, 18 bp, Homo sapiens
ttctaagtcattcataaa

SEQ ID NO: 663259 - DNA, 19 bp, Homo sapiens
ttctaatccttttccttat

SEQ ID NO: 663260 - DNA, 13 bp, Homo sapiens
ttctaatgtttct

SEQ ID NO: 663261 - DNA, 13 bp, Homo sapiens
ttctacctgccct

SEQ ID NO: 663262 - DNA, 13 bp, Homo sapiens
ttctactcccctt

SEQ ID NO: 663263 - DNA, 16 bp, Homo sapiens
ttctactgccttgaaa

SEQ ID NO: 663264 - DNA, 21 bp, Homo sapiens
ttctactgccttgaaaaatga

SEQ ID NO: 663265 - DNA, 16 bp, Homo sapiens
ttctagcagtccccag

SEQ ID NO: 663266 - DNA, 21 bp, Homo sapiens
ttctataaaactctgcatgta

SEQ ID NO: 663267 - DNA, 16 bp, Homo sapiens
ttctatgacaaattca

SEQ ID NO: 663268 - DNA, 17 bp, Homo sapiens
ttctatgacaaattcaa

SEQ ID NO: 663269 - DNA, 19 bp, Homo sapiens
ttctattatttttataatt

SEQ ID NO: 663270 - DNA, 22 bp, Homo sapiens
ttctcaaagagaattgtatgta

SEQ ID NO: 663271 - DNA, 18 bp, Homo sapiens
ttctcaaagatctgaatt

SEQ ID NO: 663272 - DNA, 21 bp, Homo sapiens
ttctcagtcctaatttgaaca

SEQ ID NO: 663273 - DNA, 21 bp, Homo sapiens
ttctcatgttaaatatttgtc

SEQ ID NO: 663274 - DNA, 15 bp, Homo sapiens
ttctcccaagaaacc

SEQ ID NO: 663275 - DNA, 12 bp, Homo sapiens
ttctccttttcc

SEQ ID NO: 663276 - DNA, 14 bp, Homo sapiens
ttctccttttccta

SEQ ID NO: 663277 - DNA, 18 bp, Homo sapiens
ttctccttttcctatcct

SEQ ID NO: 663278 - DNA, 18 bp, Homo sapiens
ttctctattttcataatc

SEQ ID NO: 663279 - DNA, 17 bp, Homo sapiens
ttctctctacagtgcca

SEQ ID NO: 663280 - DNA, 13 bp, Homo sapiens
ttctctctctaag

SEQ ID NO: 663281 - DNA, 11 bp, Homo sapiens
ttctctctttt

SEQ ID NO: 663282 - DNA, 21 bp, Homo sapiens
ttctctgccgctacctccctc

SEQ ID NO: 663283 - DNA, 22 bp, Homo sapiens
ttctctgccgctacctccctcc

SEQ ID NO: 663284 - DNA, 18 bp, Homo sapiens
ttctcttctacccttttc

SEQ ID NO: 663285 - DNA, 16 bp, Homo sapiens
ttctgaagctgacagc

SEQ ID NO: 663286 - DNA, 21 bp, Homo sapiens
ttctgacagtttttctgtttt

SEQ ID NO: 663287 - DNA, 23 bp, Homo sapiens
ttctgattctggctttaagcctt

SEQ ID NO: 663288 - DNA, 23 bp, Homo sapiens
ttctgcagagtttccaaaaccag

SEQ ID NO: 663289 - DNA, 14 bp, Homo sapiens
ttctgcagttctca

SEQ ID NO: 663290 - DNA, 21 bp, Homo sapiens
ttctgccatctagccagcccc

SEQ ID NO: 663291 - DNA, 14 bp, Homo sapiens
ttctgcgcttcagt

SEQ ID NO: 663292 - DNA, 16 bp, Homo sapiens
ttctgctgaaagactc

SEQ ID NO: 663293 - DNA, 21 bp, Homo sapiens
ttctgctgaaagactcgagaa

SEQ ID NO: 663294 - DNA, 13 bp, Homo sapiens
ttctggataaagc

SEQ ID NO: 663295 - DNA, 17 bp, Homo sapiens
ttctggggcaggctggg

SEQ ID NO: 663296 - DNA, 20 bp, Homo sapiens
ttctggggcaggctgggcca

SEQ ID NO: 663297 - DNA, 18 bp, Homo sapiens
tttctcagtcctaatttg

SEQ ID NO: 663298 - DNA, 17 bp, Homo sapiens
tttctcataattttgca

SEQ ID NO: 663299 - DNA, 19 bp, Homo sapiens
tttctccacttcattttta

SEQ ID NO: 663300 - DNA, 13 bp, Homo sapiens
tttctcccaagaa

SEQ ID NO: 663301 - DNA, 19 bp, Homo sapiens
tttctcctggcccctgcct

SEQ ID NO: 663302 - DNA, 16 bp, Homo sapiens
tttctctctacagtgc

SEQ ID NO: 663303 - DNA, 18 bp, Homo sapiens
tttctcttccccttagaa

SEQ ID NO: 663304 - DNA, 14 bp, Homo sapiens
tttctctttaaact

SEQ ID NO: 663305 - DNA, 13 bp, Homo sapiens
tttctgacagttt

SEQ ID NO: 663306 - DNA, 16 bp, Homo sapiens
tttctgaggtccttat

SEQ ID NO: 663307 - DNA, 15 bp, Homo sapiens
tttctgggtcctgaa

SEQ ID NO: 663308 - DNA, 15 bp, Homo sapiens
tttctgggtcttttg

SEQ ID NO: 663309 - DNA, 17 bp, Homo sapiens
tttctgtttctgtttat

SEQ ID NO: 663310 - DNA, 12 bp, Homo sapiens
tttcttaaataa

SEQ ID NO: 663311 - DNA, 22 bp, Homo sapiens
tttcttaaataatgcttcagat

SEQ ID NO: 663312 - DNA, 23 bp, Homo sapiens
tttcttaaataatgcttcagata

SEQ ID NO: 663313 - DNA, 21 bp, Homo sapiens
tttcttagtgttgtggacact

SEQ ID NO: 663314 - DNA, 18 bp, Homo sapiens
tttcttcaacatgctcca

SEQ ID NO: 663315 - DNA, 13 bp, Homo sapiens
tttcttccctgct

SEQ ID NO: 663316 - DNA, 14 bp, Homo sapiens
tttcttcgctggac

SEQ ID NO: 663317 - DNA, 15 bp, Homo sapiens
tttcttctctgtgag

SEQ ID NO: 663318 - DNA, 23 bp, Homo sapiens
tttcttgggaattgaaaaaaatt

SEQ ID NO: 663319 - DNA, 15 bp, Homo sapiens
ttttgctgagagcat

SEQ ID NO: 663320 - DNA, 22 bp, Homo sapiens
ttttggaagagacaaagatttc

SEQ ID NO: 663321 - DNA, 23 bp, Homo sapiens
ttttggaagagacaaagatttct

SEQ ID NO: 663322 - DNA, 11 bp, Homo sapiens
ttttggcctgt

SEQ ID NO: 663323 - DNA, 19 bp, Homo sapiens
ttttggcctgtgatgtttt

SEQ ID NO: 663324 - DNA, 21 bp, Homo sapiens
ttttggggagtacctgtccaa

SEQ ID NO: 663325 - DNA, 19 bp, Homo sapiens
ttttgtaataataaagaat

SEQ ID NO: 663326 - DNA, 24 bp, Homo sapiens
ttttgtatagaaaattcttgagaa

SEQ ID NO: 663327 - DNA, 17 bp, Homo sapiens
ttttgtatgttaaagag

SEQ ID NO: 663328 - DNA, 19 bp, Homo sapiens
ttttgttgtacttaaatgg

SEQ ID NO: 663329 - DNA, 15 bp, Homo sapiens
ttttgtttggtaaat

SEQ ID NO: 663330 - DNA, 16 bp, Homo sapiens
ttttgtttggtaaatg

SEQ ID NO: 663331 - DNA, 21 bp, Homo sapiens
ttttgtttggttatatcgaaa

SEQ ID NO: 663332 - DNA, 22 bp, Homo sapiens
ttttgttttaaaactggacctg

SEQ ID NO: 663333 - DNA, 11 bp, Homo sapiens
tttttaaagaa

SEQ ID NO: 663334 - DNA, 18 bp, Homo sapiens
tttttaaagaagagtgac

SEQ ID NO: 663335 - DNA, 12 bp, Homo sapiens
tttttaactttt

SEQ ID NO: 663336 - DNA, 11 bp, Homo sapiens
tttttaagaaa

SEQ ID NO: 663337 - DNA, 13 bp, Homo sapiens
tttttaagtgaaa

SEQ ID NO: 663338 - DNA, 16 bp, Homo sapiens
tttttaatttacttgt

SEQ ID NO: 663339 - DNA, 18 bp, Homo sapiens
tttttataattgtacaaa

SEQ ID NO: 663340 - DNA, 23 bp, Homo sapiens
tttttataattgtacaaaattaa

SEQ ID NO: 663341 - DNA, 21 bp, Homo sapiens
tttttcaagttgtaaataatt

SEQ ID NO: 663342 - DNA, 18 bp, Homo sapiens
tttttcataaacaagttc

SEQ ID NO: 663343 - DNA, 18 bp, Homo sapiens
tttttctgtaatgtaaat

SEQ ID NO: 663344 - DNA, 11 bp, Homo sapiens
tttttcttctg

SEQ ID NO: 663345 - DNA, 14 bp, Homo sapiens
tttttgagtactgt

SEQ ID NO: 663346 - DNA, 12 bp, Homo sapiens
tttttgatatat

SEQ ID NO: 663347 - DNA, 18 bp, Homo sapiens
tttttggacttcaaagca

SEQ ID NO: 663348 - DNA, 17 bp, Homo sapiens
tttttggtgtgccctgt

SEQ ID NO: 663349 - DNA, 14 bp, Homo sapiens
tttttggttgggaa

SEQ ID NO: 663350 - DNA, 22 bp, Homo sapiens
tttttgtatttctctattttca

SEQ ID NO: 663351 - DNA, 12 bp, Homo sapiens
tttttgtttgcc

SEQ ID NO: 663352 - DNA, 12 bp, Homo sapiens
ttttttaaagaa

SEQ ID NO: 663353 - DNA, 13 bp, Homo sapiens
ttttttactcttt

SEQ ID NO: 663354 - DNA, 13 bp, Homo sapiens
ttttttatgtatt

SEQ ID NO: 663355 - DNA, 20 bp, Homo sapiens
ttttttggtggtgaaattga

SEQ ID NO: 663356 - DNA, 12 bp, Homo sapiens
tttttttcctga

SEQ ID NO: 663357 - DNA, 18 bp, Homo sapiens
ttatactgggtttcaaga

SEQ ID NO: 663358 - DNA, 18 bp, Homo sapiens
ttatactgtatttctaag

SEQ ID NO: 663359 - DNA, 19 bp, Homo sapiens
ttatagacaaaagaataag

SEQ ID NO: 663360 - DNA, 21 bp, Homo sapiens
ttatagtgtttggacagctga

SEQ ID NO: 663361 - DNA, 21 bp, Homo sapiens
ttatataaaacttaaaaacaa

SEQ ID NO: 663362 - DNA, 23 bp, Homo sapiens
ttatatacagtacacagatacct

SEQ ID NO: 663363 - DNA, 15 bp, Homo sapiens
ttatatcattttaaa

SEQ ID NO: 663364 - DNA, 18 bp, Homo sapiens
ttatatcattttaaaatg

SEQ ID NO: 663365 - DNA, 21 bp, Homo sapiens
ttatattatccataggtttct

SEQ ID NO: 663366 - DNA, 16 bp, Homo sapiens
ttatcatggtcctgaa

SEQ ID NO: 663367 - DNA, 15 bp, Homo sapiens
ttatcattaaaaatt

SEQ ID NO: 663368 - DNA, 15 bp, Homo sapiens
ttatccaaaatgtgt

SEQ ID NO: 663369 - DNA, 19 bp, Homo sapiens
ttatccctctcttcccctt

SEQ ID NO: 663370 - DNA, 18 bp, Homo sapiens
ttatcctacagtacaatc

SEQ ID NO: 663371 - DNA, 22 bp, Homo sapiens
ttatcggattactgaattgtat

SEQ ID NO: 663372 - DNA, 18 bp, Homo sapiens
ttatctcgaatttgaaga

SEQ ID NO: 663373 - DNA, 19 bp, Homo sapiens
ttatctcgaatttgaagag

SEQ ID NO: 663374 - DNA, 15 bp, Homo sapiens
ttatcttacaatatt

SEQ ID NO: 663375 - DNA, 20 bp, Homo sapiens
ttatcttacaatattgattg

SEQ ID NO: 663376 - DNA, 20 bp, Homo sapiens
ttatgaagaatacccaggaa

SEQ ID NO: 663377 - DNA, 14 bp, Homo sapiens
ttatgatatttctt

SEQ ID NO: 663378 - DNA, 15 bp, Homo sapiens
ttatgatcagtgttg

SEQ ID NO: 663379 - DNA, 20 bp, Homo sapiens
ttatgcaaaatttagaagaa

SEQ ID NO: 663380 - DNA, 21 bp, Homo sapiens
ttatgcacttttagaaatgca

SEQ ID NO: 663381 - DNA, 17 bp, Homo sapiens
ttatgctactgaactga

SEQ ID NO: 663382 - DNA, 14 bp, Homo sapiens
ttatggcatttcta

SEQ ID NO: 663383 - DNA, 15 bp, Homo sapiens
ttatggcatttctat

SEQ ID NO: 663384 - DNA, 16 bp, Homo sapiens
ttatggtgatgactta

SEQ ID NO: 663385 - DNA, 20 bp, Homo sapiens
ttatgtatttaaagttgtat

SEQ ID NO: 663386 - DNA, 21 bp, Homo sapiens
ttatgtgaaatgctttctgta

SEQ ID NO: 663387 - DNA, 19 bp, Homo sapiens
ttatgttgggtcaagtgtt

SEQ ID NO: 663388 - DNA, 17 bp, Homo sapiens
ttatgtttaaaagaaat

SEQ ID NO: 663389 - DNA, 19 bp, Homo sapiens
ttatgtttaaaagaaatat

SEQ ID NO: 663390 - DNA, 12 bp, Homo sapiens
ttatgtttgaat

SEQ ID NO: 663391 - DNA, 13 bp, Homo sapiens
ttattaatgtttt

SEQ ID NO: 663392 - DNA, 13 bp, Homo sapiens
ttattaattttta

SEQ ID NO: 663393 - DNA, 19 bp, Homo sapiens
ttattacagtcttatttaa

SEQ ID NO: 663394 - DNA, 19 bp, Homo sapiens
ttattagaaaaatattata

SEQ ID NO: 663395 - DNA, 18 bp, Homo sapiens
ttattaggagtaattctt

SEQ ID NO: 663396 - DNA, 22 bp, Homo sapiens
ttattatgcaaaatttagaaga

SEQ ID NO: 663397 - DNA, 15 bp, Homo sapiens
ttattcaaatttgat

SEQ ID NO: 663398 - DNA, 22 bp, Homo sapiens
ttattcctctcaccccactcct

SEQ ID NO: 663399 - DNA, 14 bp, Homo sapiens
ttattgttaataca

SEQ ID NO: 663400 - DNA, 20 bp, Homo sapiens
ttatttcaataaatctttca

SEQ ID NO: 663401 - DNA, 22 bp, Homo sapiens
ttatttctagtccaaaattaca

SEQ ID NO: 663402 - DNA, 14 bp, Homo sapiens
ttatttcttaacct

SEQ ID NO: 663403 - DNA, 12 bp, Homo sapiens
ttatttcttccc

SEQ ID NO: 663404 - DNA, 14 bp, Homo sapiens
ttatttcttccctg

SEQ ID NO: 663405 - DNA, 21 bp, Homo sapiens
ttattttgagatgtaaaaaga

SEQ ID NO: 663406 - DNA, 13 bp, Homo sapiens
ttattttgatgta

SEQ ID NO: 663407 - DNA, 13 bp, Homo sapiens
ttattttgtctta

SEQ ID NO: 663408 - DNA, 16 bp, Homo sapiens
ttatttttaaaaagaa

SEQ ID NO: 663409 - DNA, 12 bp, Homo sapiens
ttatttttctga

SEQ ID NO: 663410 - DNA, 20 bp, Homo sapiens
ttatttttgcacaacttttg

SEQ ID NO: 663411 - DNA, 22 bp, Homo sapiens
ttatttttgcacaacttttgag

SEQ ID NO: 663412 - DNA, 16 bp, Homo sapiens
ttatttttttaaaatt

SEQ ID NO: 663413 - DNA, 21 bp, Homo sapiens
ttcaaaaggtattatacatgt

SEQ ID NO: 663414 - DNA, 17 bp, Homo sapiens
ttcaaacttactatttt

SEQ ID NO: 663415 - DNA, 11 bp, Homo sapiens
ttcaaagcact

SEQ ID NO: 663416 - DNA, 12 bp, Homo sapiens
ttcaaagccttc

SEQ ID NO: 663417 - DNA, 22 bp, Homo sapiens
ttcaacaaatattcactggccc

SEQ ID NO: 663418 - DNA, 18 bp, Homo sapiens
ttcaacttatttcataat

SEQ ID NO: 663419 - DNA, 21 bp, Homo sapiens
ttcaacttatttcataattgc

SEQ ID NO: 663420 - DNA, 22 bp, Homo sapiens
agtactctttaacatacaagaa

SEQ ID NO: 663421 - DNA, 12 bp, Homo sapiens
agtactgtacta

SEQ ID NO: 663422 - DNA, 12 bp, Homo sapiens
agtacttctaag

SEQ ID NO: 663423 - DNA, 15 bp, Homo sapiens
agtactttgtgcatt

SEQ ID NO: 663424 - DNA, 23 bp, Homo sapiens
agtagatccatttccattgctta

SEQ ID NO: 663425 - DNA, 14 bp, Homo sapiens
agtagcttgctccc

SEQ ID NO: 663426 - DNA, 18 bp, Homo sapiens
agtaggaatgtacatgaa

SEQ ID NO: 663427 - DNA, 21 bp, Homo sapiens
agtaggaatgtacatgaagca

SEQ ID NO: 663428 - DNA, 18 bp, Homo sapiens
agtagtaaatcagaaagt

SEQ ID NO: 663429 - DNA, 20 bp, Homo sapiens
agtagtgtggcctgtgccag

SEQ ID NO: 663430 - DNA, 12 bp, Homo sapiens
agtatacattgt

SEQ ID NO: 663431 - DNA, 23 bp, Homo sapiens
agtatccaggctttgtacagagt

SEQ ID NO: 663432 - DNA, 14 bp, Homo sapiens
agtatggtgtgttc

SEQ ID NO: 663433 - DNA, 23 bp, Homo sapiens
agtattatccacaattattggca

SEQ ID NO: 663434 - DNA, 14 bp, Homo sapiens
agtattgtttaaaa

SEQ ID NO: 663435 - DNA, 22 bp, Homo sapiens
agtattgtttaaaatgtaattt

SEQ ID NO: 663436 - DNA, 13 bp, Homo sapiens
agtcaaaaaatta

SEQ ID NO: 663437 - DNA, 14 bp, Homo sapiens
agtcaaaaaattat

SEQ ID NO: 663438 - DNA, 21 bp, Homo sapiens
agtcaaaaaattatttgctat

SEQ ID NO: 663439 - DNA, 17 bp, Homo sapiens
agtcaaagttgaaaatt

SEQ ID NO: 663440 - DNA, 13 bp, Homo sapiens
agtcaaatttact

SEQ ID NO: 663441 - DNA, 16 bp, Homo sapiens
agtcaaatttacttta

SEQ ID NO: 663442 - DNA, 24 bp, Homo sapiens
agtcagaaaattggcagtggcaga

SEQ ID NO: 663443 - DNA, 19 bp, Homo sapiens
agtcagatttttatttatg

SEQ ID NO: 663444 - DNA, 13 bp, Homo sapiens
agtcatcatcagg

SEQ ID NO: 663445 - DNA, 14 bp, Homo sapiens
agtcatcatcaggg

SEQ ID NO: 663446 - DNA, 15 bp, Homo sapiens
agtcatggtgttgcg

SEQ ID NO: 663447 - DNA, 17 bp, Homo sapiens
agtcatggtgttgcgta

SEQ ID NO: 663448 - DNA, 13 bp, Homo sapiens
agtcccacactgt

SEQ ID NO: 663449 - DNA, 22 bp, Homo sapiens
agtcccacactgtggccaggcc

SEQ ID NO: 663450 - DNA, 16 bp, Homo sapiens
agtcctatagtcgtgg

SEQ ID NO: 663451 - DNA, 23 bp, Homo sapiens
agtccttgatttcaaagttttgt

SEQ ID NO: 663452 - DNA, 15 bp, Homo sapiens
agtcgcctgcctgca

SEQ ID NO: 663453 - DNA, 17 bp, Homo sapiens
agtctacccgacataag

SEQ ID NO: 663454 - DNA, 16 bp, Homo sapiens
agtctcattgtcacct

SEQ ID NO: 663455 - DNA, 20 bp, Homo sapiens
agtctgataaactgacgatt

SEQ ID NO: 663456 - DNA, 22 bp, Homo sapiens
agtctgtactaaacagtaagat

SEQ ID NO: 663457 - DNA, 16 bp, Homo sapiens
agtctgtccaaattta

SEQ ID NO: 663458 - DNA, 16 bp, Homo sapiens
agtctgttgattaaag

SEQ ID NO: 663459 - DNA, 19 bp, Homo sapiens
agtcttacaatcaaatctc

SEQ ID NO: 663460 - DNA, 21 bp, Homo sapiens
agtcttacaatcaaatctcct

SEQ ID NO: 663461 - DNA, 15 bp, Homo sapiens
agtctttcttgaaat

SEQ ID NO: 663462 - DNA, 19 bp, Homo sapiens
agtctttgagactaaattc

SEQ ID NO: 663463 - DNA, 16 bp, Homo sapiens
agtgactccctgggag

SEQ ID NO: 663464 - DNA, 18 bp, Homo sapiens
agtgacttattttgtctt

SEQ ID NO: 663465 - DNA, 19 bp, Homo sapiens
agtgagcagtcgcctgcct

SEQ ID NO: 663466 - DNA, 18 bp, Homo sapiens
agtgagccaaatgtaaaa

SEQ ID NO: 663467 - DNA, 15 bp, Homo sapiens
agtgatattacattt

SEQ ID NO: 663468 - DNA, 14 bp, Homo sapiens
agtgatcatttaaa

SEQ ID NO: 663469 - DNA, 21 bp, Homo sapiens
agtgatcatttaaaaagctca

SEQ ID NO: 663470 - DNA, 12 bp, Homo sapiens
agtgatcttggc

SEQ ID NO: 663471 - DNA, 21 bp, Homo sapiens
agtgcaagttcatgtgtggaa

SEQ ID NO: 663472 - DNA, 21 bp, Homo sapiens
agtgcacacctttattcagaa

SEQ ID NO: 663473 - DNA, 13 bp, Homo sapiens
agtgcagaatgta

SEQ ID NO: 663474 - DNA, 20 bp, Homo sapiens
agtgcagaatgtaagtgggc

SEQ ID NO: 663475 - DNA, 22 bp, Homo sapiens
agtgcagaatgtaagtgggccc

SEQ ID NO: 663476 - DNA, 15 bp, Homo sapiens
agtgcagctcatgtt

SEQ ID NO: 663477 - DNA, 21 bp, Homo sapiens
agtgcagctcatgtttttaac

SEQ ID NO: 663478 - DNA, 17 bp, Homo sapiens
agtgcatggtggccaga

SEQ ID NO: 663479 - DNA, 12 bp, Homo sapiens
agtgcctccaca

SEQ ID NO: 663480 - DNA, 16 bp, Homo sapiens
agtgcctccacatgct

SEQ ID NO: 663481 - DNA, 23 bp, Homo sapiens
agtgcctccacatgctgcctggc

SEQ ID NO: 663482 - DNA, 14 bp, Homo sapiens
agtgccttttggaa

SEQ ID NO: 663483 - DNA, 17 bp, Homo sapiens
agtgcgattctggataa

SEQ ID NO: 663484 - DNA, 18 bp, Homo sapiens
agtgctggctcacagtac

SEQ ID NO: 663485 - DNA, 21 bp, Homo sapiens
agtgctggctcacagtacagc

SEQ ID NO: 663486 - DNA, 20 bp, Homo sapiens
agtgctgggattacaggcgt

SEQ ID NO: 663487 - DNA, 18 bp, Homo sapiens
agtgctgtcttgatgact

SEQ ID NO: 663488 - DNA, 16 bp, Homo sapiens
agtggccatcatcctc

SEQ ID NO: 663489 - DNA, 15 bp, Homo sapiens
agtggcgtggcctcc

SEQ ID NO: 663490 - DNA, 16 bp, Homo sapiens
agtggcgtggcctccc

SEQ ID NO: 663491 - DNA, 19 bp, Homo sapiens
agtggctgccttctttcca

SEQ ID NO: 663492 - DNA, 20 bp, Homo sapiens
agtgggaaatatgccactga

SEQ ID NO: 663493 - DNA, 14 bp, Homo sapiens
agtgggccagggct

SEQ ID NO: 663494 - DNA, 14 bp, Homo sapiens
agtggggcctgtgg

SEQ ID NO: 663495 - DNA, 21 bp, Homo sapiens
agtggtcataaaatagaataa

SEQ ID NO: 663496 - DNA, 18 bp, Homo sapiens
agtggtgagcatgtaagt

SEQ ID NO: 663497 - DNA, 22 bp, Homo sapiens
agtggtgatttgaaaaatataa

SEQ ID NO: 663498 - DNA, 14 bp, Homo sapiens
agtggtgcagacag

SEQ ID NO: 663499 - DNA, 14 bp, Homo sapiens
agtggtgtgactct

SEQ ID NO: 663500 - DNA, 14 bp, Homo sapiens
agtggttaggcagc

SEQ ID NO: 663501 - DNA, 16 bp, Homo sapiens
agtggttaggcagcaa

SEQ ID NO: 663502 - DNA, 17 bp, Homo sapiens
agtggttaggcagcaag

SEQ ID NO: 663503 - DNA, 22 bp, Homo sapiens
agtgtacctcctctcagtgttt

SEQ ID NO: 663504 - DNA, 16 bp, Homo sapiens
agtgtataatataaaa

SEQ ID NO: 663505 - DNA, 17 bp, Homo sapiens
agtgtataatataaaaa

SEQ ID NO: 663506 - DNA, 21 bp, Homo sapiens
agtgtctgacttttgttaaat

SEQ ID NO: 663507 - DNA, 14 bp, Homo sapiens
agtgtgacagggcc

SEQ ID NO: 663508 - DNA, 15 bp, Homo sapiens
agtgtgacagggcca

SEQ ID NO: 663509 - DNA, 22 bp, Homo sapiens
agtgtgacagggccagtggggc

SEQ ID NO: 663510 - DNA, 18 bp, Homo sapiens
agtgtgagctcttccctt

SEQ ID NO: 663511 - DNA, 18 bp, Homo sapiens
agtgtgcatggaggccct

SEQ ID NO: 663512 - DNA, 19 bp, Homo sapiens
agtgtgcatggaggccctc

SEQ ID NO: 663513 - DNA, 19 bp, Homo sapiens
agtgtgctctttttttaaa

SEQ ID NO: 663514 - DNA, 13 bp, Homo sapiens
agtgtggccaggc

SEQ ID NO: 663515 - DNA, 11 bp, Homo sapiens
agtgtggcctg

SEQ ID NO: 663516 - DNA, 15 bp, Homo sapiens
agtgtggggggtcct

SEQ ID NO: 663517 - DNA, 23 bp, Homo sapiens
agtgtgtatatattttgtgtgaa

SEQ ID NO: 663518 - DNA, 18 bp, Homo sapiens
agtgttctgccagatctt

SEQ ID NO: 663519 - DNA, 14 bp, Homo sapiens
agtgttttggactc

SEQ ID NO: 663520 - DNA, 19 bp, Homo sapiens
atatcagctttgataattg

SEQ ID NO: 663521 - DNA, 20 bp, Homo sapiens
atatcagctttgataattgt

SEQ ID NO: 663522 - DNA, 23 bp, Homo sapiens
atatcagtaacccccttaaattt

SEQ ID NO: 663523 - DNA, 16 bp, Homo sapiens
atatcataaagcattt

SEQ ID NO: 663524 - DNA, 13 bp, Homo sapiens
atatcatacaaat

SEQ ID NO: 663525 - DNA, 20 bp, Homo sapiens
atatcattctgggtgtgttc

SEQ ID NO: 663526 - DNA, 18 bp, Homo sapiens
atatcattttaaaatgtc

SEQ ID NO: 663527 - DNA, 23 bp, Homo sapiens
atatccattctgtagacttttga

SEQ ID NO: 663528 - DNA, 13 bp, Homo sapiens
atatcctgagcca

SEQ ID NO: 663529 - DNA, 17 bp, Homo sapiens
atatccttatcagagct

SEQ ID NO: 663530 - DNA, 15 bp, Homo sapiens
atatctataaaatag

SEQ ID NO: 663531 - DNA, 17 bp, Homo sapiens
atatctataaaatagat

SEQ ID NO: 663532 - DNA, 15 bp, Homo sapiens
atatctatatatata

SEQ ID NO: 663533 - DNA, 19 bp, Homo sapiens
atatctatatatataattt

SEQ ID NO: 663534 - DNA, 18 bp, Homo sapiens
atatctggttatatcatt

SEQ ID NO: 663535 - DNA, 21 bp, Homo sapiens
atatctggttatatcattctg

SEQ ID NO: 663536 - DNA, 12 bp, Homo sapiens
atatgaatctat

SEQ ID NO: 663537 - DNA, 23 bp, Homo sapiens
atatgacggaagaacatagaact

SEQ ID NO: 663538 - DNA, 16 bp, Homo sapiens
atatgcactatgtata

SEQ ID NO: 663539 - DNA, 17 bp, Homo sapiens
atatgccactgaccgat

SEQ ID NO: 663540 - DNA, 18 bp, Homo sapiens
atatgccttaatttagaa

SEQ ID NO: 663541 - DNA, 23 bp, Homo sapiens
atatgccttaatttagaaactga

SEQ ID NO: 663542 - DNA, 20 bp, Homo sapiens
atatggcaggactcctggca

SEQ ID NO: 663543 - DNA, 21 bp, Homo sapiens
atatggcttcaccaagaagca

SEQ ID NO: 663544 - DNA, 14 bp, Homo sapiens
atatggtgtatttt

SEQ ID NO: 663545 - DNA, 17 bp, Homo sapiens
atatgtaagaacacatt

SEQ ID NO: 663546 - DNA, 15 bp, Homo sapiens
atatgtgaaacattt

SEQ ID NO: 663547 - DNA, 16 bp, Homo sapiens
atatgttgtaatattt

SEQ ID NO: 663548 - DNA, 13 bp, Homo sapiens
atattaaataata

SEQ ID NO: 663549 - DNA, 18 bp, Homo sapiens
atattacaacatttatgt

SEQ ID NO: 663550 - DNA, 22 bp, Homo sapiens
atattacatttatttatccaga

SEQ ID NO: 663551 - DNA, 14 bp, Homo sapiens
atattactgacatt

SEQ ID NO: 663552 - DNA, 16 bp, Homo sapiens
atattactgacatttc

SEQ ID NO: 663553 - DNA, 15 bp, Homo sapiens
atattatattaaaca

SEQ ID NO: 663554 - DNA, 12 bp, Homo sapiens
atattcataaag

SEQ ID NO: 663555 - DNA, 23 bp, Homo sapiens
atattcatgcttgccatctgttc

SEQ ID NO: 663556 - DNA, 21 bp, Homo sapiens
atattccttttaaagaagctt

SEQ ID NO: 663557 - DNA, 17 bp, Homo sapiens
atattctggttcttgaa

SEQ ID NO: 663558 - DNA, 17 bp, Homo sapiens
atattgttggcacagaa

SEQ ID NO: 663559 - DNA, 21 bp, Homo sapiens
atattgttggcacagaacagg

SEQ ID NO: 663560 - DNA, 16 bp, Homo sapiens
atattgtttggtaaat

SEQ ID NO: 663561 - DNA, 13 bp, Homo sapiens
atatttaatatca

SEQ ID NO: 663562 - DNA, 15 bp, Homo sapiens
atatttaatatcaaa

SEQ ID NO: 663563 - DNA, 17 bp, Homo sapiens
atatttacatccagctt

SEQ ID NO: 663564 - DNA, 23 bp, Homo sapiens
atatttacatccagcttctcatg

SEQ ID NO: 663565 - DNA, 12 bp, Homo sapiens
atatttatccaa

SEQ ID NO: 663566 - DNA, 15 bp, Homo sapiens
atatttatccaaaat

SEQ ID NO: 663567 - DNA, 15 bp, Homo sapiens
atatttcttgctttc

SEQ ID NO: 663568 - DNA, 13 bp, Homo sapiens
atatttgatttct

SEQ ID NO: 663569 - DNA, 14 bp, Homo sapiens
atatttgatttcta

SEQ ID NO: 663570 - DNA, 16 bp, Homo sapiens
atatttgtaaagctat

SEQ ID NO: 663571 - DNA, 13 bp, Homo sapiens
atatttgtaggag

SEQ ID NO: 663572 - DNA, 16 bp, Homo sapiens
atattttgagaaactg

SEQ ID NO: 663573 - DNA, 18 bp, Homo sapiens
atattttgagaaactgct

SEQ ID NO: 663574 - DNA, 13 bp, Homo sapiens
atattttgtgtga

SEQ ID NO: 663575 - DNA, 21 bp, Homo sapiens
atattttgttgccttcatctt

SEQ ID NO: 663576 - DNA, 19 bp, Homo sapiens
atatttttagactatttct

SEQ ID NO: 663577 - DNA, 16 bp, Homo sapiens
atattttttatcataa

SEQ ID NO: 663578 - DNA, 20 bp, Homo sapiens
atattttttggtgtgccctg

SEQ ID NO: 663579 - DNA, 16 bp, Homo sapiens
atcaaagccagggtct

SEQ ID NO: 663580 - DNA, 14 bp, Homo sapiens
atcaaataagaaat

SEQ ID NO: 663581 - DNA, 13 bp, Homo sapiens
atcaaatacattt

SEQ ID NO: 663582 - DNA, 14 bp, Homo sapiens
atcaaatacattta

SEQ ID NO: 663583 - DNA, 12 bp, Homo sapiens
atcaaatcaact

SEQ ID NO: 663584 - DNA, 18 bp, Homo sapiens
atcaaatctcctgctgat

SEQ ID NO: 663585 - DNA, 17 bp, Homo sapiens
atcaacaacatccactg

SEQ ID NO: 663586 - DNA, 13 bp, Homo sapiens
atcaactctaata

SEQ ID NO: 663587 - DNA, 14 bp, Homo sapiens
atcaacttttatgc

SEQ ID NO: 663588 - DNA, 17 bp, Homo sapiens
atcaagatttttttcct

SEQ ID NO: 663589 - DNA, 23 bp, Homo sapiens
atcaagggaatgtaactgctgaa

SEQ ID NO: 663590 - DNA, 18 bp, Homo sapiens
atcaatttgtttgtgttc

SEQ ID NO: 663591 - DNA, 14 bp, Homo sapiens
atcacaaatggaat

SEQ ID NO: 663592 - DNA, 14 bp, Homo sapiens
atcacacaatatag

SEQ ID NO: 663593 - DNA, 13 bp, Homo sapiens
atcacctctctgt

SEQ ID NO: 663594 - DNA, 22 bp, Homo sapiens
atcacctctctgtagtttatgg

SEQ ID NO: 663595 - DNA, 14 bp, Homo sapiens
atcactaaaagcat

SEQ ID NO: 663596 - DNA, 20 bp, Homo sapiens
atcactgaatttataaagta

SEQ ID NO: 663597 - DNA, 19 bp, Homo sapiens
atcactgtatcattttctt

SEQ ID NO: 663598 - DNA, 21 bp, Homo sapiens
atcactttgtctaactcagaa

SEQ ID NO: 663599 - DNA, 18 bp, Homo sapiens
atcagaaagtaacaatct

SEQ ID NO: 663600 - DNA, 20 bp, Homo sapiens
atcagcctgggcaacatggt

SEQ ID NO: 663601 - DNA, 21 bp, Homo sapiens
atcagctttgataattgtgta

SEQ ID NO: 663602 - DNA, 13 bp, Homo sapiens
atcaggaggaagt

SEQ ID NO: 663603 - DNA, 20 bp, Homo sapiens
atcagggcctggggcctgag

SEQ ID NO: 663604 - DNA, 23 bp, Homo sapiens
atcagggcctggggcctgagaga

SEQ ID NO: 663605 - DNA, 24 bp, Homo sapiens
atcagggcctggggcctgagagaa

SEQ ID NO: 663606 - DNA, 15 bp, Homo sapiens
atcagtaaccccctt

SEQ ID NO: 663607 - DNA, 17 bp, Homo sapiens
atcagttccagccttct

SEQ ID NO: 663608 - DNA, 12 bp, Homo sapiens
atcataaagcat

SEQ ID NO: 663609 - DNA, 14 bp, Homo sapiens
atcataaagcattt

SEQ ID NO: 663610 - DNA, 20 bp, Homo sapiens
atcattaaaaattaccttta

SEQ ID NO: 663611 - DNA, 16 bp, Homo sapiens
atcattcagaaatgtt

SEQ ID NO: 663612 - DNA, 15 bp, Homo sapiens
atcattccctctcat

SEQ ID NO: 663613 - DNA, 21 bp, Homo sapiens
atcattctgggtgtgttctta

SEQ ID NO: 663614 - DNA, 14 bp, Homo sapiens
atcattttaaaatg

SEQ ID NO: 663615 - DNA, 15 bp, Homo sapiens
atcattttaaaatgt

SEQ ID NO: 663616 - DNA, 18 bp, Homo sapiens
atcattttaaaatgtctt

SEQ ID NO: 663617 - DNA, 13 bp, Homo sapiens
atccacaattatt

SEQ ID NO: 663618 - DNA, 21 bp, Homo sapiens
atccacaattattggcaaagt

SEQ ID NO: 663619 - DNA, 18 bp, Homo sapiens
atccacccagcaggcaga

SEQ ID NO: 663620 - DNA, 17 bp, Homo sapiens
atccagaaaactgtgat

SEQ ID NO: 663621 - DNA, 18 bp, Homo sapiens
atccagaaaactgtgatt

SEQ ID NO: 663622 - DNA, 15 bp, Homo sapiens
atccagacctggctc

SEQ ID NO: 663623 - DNA, 17 bp, Homo sapiens
atccatttccattgctt

SEQ ID NO: 663624 - DNA, 15 bp, Homo sapiens
atccctctcctaact

SEQ ID NO: 663625 - DNA, 14 bp, Homo sapiens
atccctctcttccc

SEQ ID NO: 663626 - DNA, 15 bp, Homo sapiens
atccctctcttcccc

SEQ ID NO: 663627 - DNA, 23 bp, Homo sapiens
atccctctcttccccttccctta

SEQ ID NO: 663628 - DNA, 17 bp, Homo sapiens
atccctttctgctagtg

SEQ ID NO: 663629 - DNA, 14 bp, Homo sapiens
atcctacagtacaa

SEQ ID NO: 663630 - DNA, 22 bp, Homo sapiens
atcctagtctagcattctgcaa

SEQ ID NO: 663631 - DNA, 20 bp, Homo sapiens
atcctccagtaccttgcttc

SEQ ID NO: 663632 - DNA, 22 bp, Homo sapiens
atcctcccgccaggagcttctt

SEQ ID NO: 663633 - DNA, 13 bp, Homo sapiens
atcctcctccagg

SEQ ID NO: 663634 - DNA, 22 bp, Homo sapiens
atcctcttttaatggcatttct

SEQ ID NO: 663635 - DNA, 12 bp, Homo sapiens
atcctgagccat

SEQ ID NO: 663636 - DNA, 24 bp, Homo sapiens
atcctgagccatcggtgaaactaa

SEQ ID NO: 663637 - DNA, 15 bp, Homo sapiens
atcctggccctgggg

SEQ ID NO: 663638 - DNA, 16 bp, Homo sapiens
atcctggccctggggg

SEQ ID NO: 663639 - DNA, 19 bp, Homo sapiens
atcctggttaccactcttt

SEQ ID NO: 663640 - DNA, 18 bp, Homo sapiens
catttaaagaccaataaa

SEQ ID NO: 663641 - DNA, 14 bp, Homo sapiens
catttagctggcca

SEQ ID NO: 663642 - DNA, 15 bp, Homo sapiens
catttagtaagaata

SEQ ID NO: 663643 - DNA, 16 bp, Homo sapiens
catttatataaaactt

SEQ ID NO: 663644 - DNA, 17 bp, Homo sapiens
catttatataaaactta

SEQ ID NO: 663645 - DNA, 23 bp, Homo sapiens
catttatataaaacttaaaaaca

SEQ ID NO: 663646 - DNA, 17 bp, Homo sapiens
catttcatcattgtttc

SEQ ID NO: 663647 - DNA, 18 bp, Homo sapiens
catttcatcattgtttct

SEQ ID NO: 663648 - DNA, 21 bp, Homo sapiens
catttcatcattgtttctgca

SEQ ID NO: 663649 - DNA, 14 bp, Homo sapiens
catttccattgctt

SEQ ID NO: 663650 - DNA, 20 bp, Homo sapiens
catttcctcagcttatctct

SEQ ID NO: 663651 - DNA, 18 bp, Homo sapiens
catttcgtatttctcata

SEQ ID NO: 663652 - DNA, 16 bp, Homo sapiens
catttctaaatttata

SEQ ID NO: 663653 - DNA, 19 bp, Homo sapiens
catttctcataattttgca

SEQ ID NO: 663654 - DNA, 13 bp, Homo sapiens
catttctctttaa

SEQ ID NO: 663655 - DNA, 21 bp, Homo sapiens
catttgaaacccctgtaggcc

SEQ ID NO: 663656 - DNA, 15 bp, Homo sapiens
catttgctactgttg

SEQ ID NO: 663657 - DNA, 17 bp, Homo sapiens
catttgctgaactcagc

SEQ ID NO: 663658 - DNA, 20 bp, Homo sapiens
catttggtcaagattttgaa

SEQ ID NO: 663659 - DNA, 18 bp, Homo sapiens
catttgtggcagtccctt

SEQ ID NO: 663660 - DNA, 19 bp, Homo sapiens
catttgtggtaatctacac

SEQ ID NO: 663661 - DNA, 21 bp, Homo sapiens
catttgtggtaatctacacca

SEQ ID NO: 663662 - DNA, 14 bp, Homo sapiens
catttgttgtttga

SEQ ID NO: 663663 - DNA, 22 bp, Homo sapiens
catttgtttattttttggaaga

SEQ ID NO: 663664 - DNA, 22 bp, Homo sapiens
catttgtttctttctctgagga

SEQ ID NO: 663665 - DNA, 12 bp, Homo sapiens
catttgtttgct

SEQ ID NO: 663666 - DNA, 22 bp, Homo sapiens
cattttattaataatatttatg

SEQ ID NO: 663667 - DNA, 17 bp, Homo sapiens
cattttcagaagttaac

SEQ ID NO: 663668 - DNA, 19 bp, Homo sapiens
cattttcagaagttaacat

SEQ ID NO: 663669 - DNA, 19 bp, Homo sapiens
cattttcctgacatttgtt

SEQ ID NO: 663670 - DNA, 11 bp, Homo sapiens
cattttctaaa

SEQ ID NO: 663671 - DNA, 13 bp, Homo sapiens
cattttctaaata

SEQ ID NO: 663672 - DNA, 17 bp, Homo sapiens
cattttcttttttaacc

SEQ ID NO: 663673 - DNA, 14 bp, Homo sapiens
cattttggaaattg

SEQ ID NO: 663674 - DNA, 15 bp, Homo sapiens
cattttggaaattgt

SEQ ID NO: 663675 - DNA, 19 bp, Homo sapiens
cattttggaaggctgaggc

SEQ ID NO: 663676 - DNA, 13 bp, Homo sapiens
cattttgtaataa

SEQ ID NO: 663677 - DNA, 14 bp, Homo sapiens
cattttgttacata

SEQ ID NO: 663678 - DNA, 20 bp, Homo sapiens
catttttctcccaagaaacc

SEQ ID NO: 663679 - DNA, 21 bp, Homo sapiens
catttttctcccaagaaacct

SEQ ID NO: 663680 - DNA, 22 bp, Homo sapiens
catttttctcccaagaaacctg

SEQ ID NO: 663681 - DNA, 13 bp, Homo sapiens
cattttttaagct

SEQ ID NO: 663682 - DNA, 23 bp, Homo sapiens
cattttttaatttacttgttttg

SEQ ID NO: 663683 - DNA, 13 bp, Homo sapiens
ccaaaatttgatg

SEQ ID NO: 663684 - DNA, 13 bp, Homo sapiens
ccaaaccggcagg

SEQ ID NO: 663685 - DNA, 16 bp, Homo sapiens
ccaaaccggcaggtgc

SEQ ID NO: 663686 - DNA, 18 bp, Homo sapiens
ccaaaccggcaggtgcga

SEQ ID NO: 663687 - DNA, 14 bp, Homo sapiens
ccaaagaggctgcc

SEQ ID NO: 663688 - DNA, 21 bp, Homo sapiens
ccaaagaggctgcccctctca

SEQ ID NO: 663689 - DNA, 21 bp, Homo sapiens
ccaaagcaaccacaaatgcat

SEQ ID NO: 663690 - DNA, 20 bp, Homo sapiens
ccaaagctgagcctgcaggg

SEQ ID NO: 663691 - DNA, 16 bp, Homo sapiens
ccaaatataagacatt

SEQ ID NO: 663692 - DNA, 16 bp, Homo sapiens
ccaaatgcaatttgat

SEQ ID NO: 663693 - DNA, 12 bp, Homo sapiens
ccaacacttcca

SEQ ID NO: 663694 - DNA, 17 bp, Homo sapiens
ccaacagttgtatgttt

SEQ ID NO: 663695 - DNA, 20 bp, Homo sapiens
ccaacagttgtatgtttgct

SEQ ID NO: 663696 - DNA, 23 bp, Homo sapiens
ccaacatgcactgatgttgtgtt

SEQ ID NO: 663697 - DNA, 18 bp, Homo sapiens
ccaacctcagggctccca

SEQ ID NO: 663698 - DNA, 15 bp, Homo sapiens
ccaagaaacctgact

SEQ ID NO: 663699 - DNA, 12 bp, Homo sapiens
ccaagaatgtac

SEQ ID NO: 663700 - DNA, 17 bp, Homo sapiens
ccaagcaacatttgtat

SEQ ID NO: 663701 - DNA, 20 bp, Homo sapiens
ccaagcagtggcctttttct

SEQ ID NO: 663702 - DNA, 22 bp, Homo sapiens
ccaaggaaacgctacctctctg

SEQ ID NO: 663703 - DNA, 12 bp, Homo sapiens
ccaaggaggggg

SEQ ID NO: 663704 - DNA, 18 bp, Homo sapiens
ccaaggagggggcctcat

SEQ ID NO: 663705 - DNA, 21 bp, Homo sapiens
ccaataaaaacattttgaagt

SEQ ID NO: 663706 - DNA, 23 bp, Homo sapiens
ccaataaaaacattttgaagtgt

SEQ ID NO: 663707 - DNA, 14 bp, Homo sapiens
ccaataaaggcagc

SEQ ID NO: 663708 - DNA, 18 bp, Homo sapiens
ccaataaaggcagctgcc

SEQ ID NO: 663709 - DNA, 19 bp, Homo sapiens
ccaataaaggcagctgcct

SEQ ID NO: 663710 - DNA, 20 bp, Homo sapiens
ccaataaaggcagctgcctc

SEQ ID NO: 663711 - DNA, 13 bp, Homo sapiens
ccaataggagtct

SEQ ID NO: 663712 - DNA, 16 bp, Homo sapiens
ccaatgaaaacatgta

SEQ ID NO: 663713 - DNA, 23 bp, Homo sapiens
ccaatgagactctagggtccagt

SEQ ID NO: 663714 - DNA, 23 bp, Homo sapiens
ccaattttttaagtgaaaatata

SEQ ID NO: 663715 - DNA, 16 bp, Homo sapiens
ccacaaatgcaggtgt

SEQ ID NO: 663716 - DNA, 20 bp, Homo sapiens
ccacaagtgccctccaggct

SEQ ID NO: 663717 - DNA, 14 bp, Homo sapiens
ccacacagggtggc

SEQ ID NO: 663718 - DNA, 15 bp, Homo sapiens
ccacacccaaagctg

SEQ ID NO: 663719 - DNA, 19 bp, Homo sapiens
ccacaccccaacacttcca

SEQ ID NO: 663720 - DNA, 18 bp, Homo sapiens
ccacactgtgcagaccca

SEQ ID NO: 663721 - DNA, 12 bp, Homo sapiens
ccacagcgtccc

SEQ ID NO: 663722 - DNA, 18 bp, Homo sapiens
ccacagggttcaaaatgt

SEQ ID NO: 663723 - DNA, 18 bp, Homo sapiens
ccacagtggggctgcagg

SEQ ID NO: 663724 - DNA, 20 bp, Homo sapiens
ccacagtggggctgcaggca

SEQ ID NO: 663725 - DNA, 22 bp, Homo sapiens
ccacagtggggctgcaggcagg

SEQ ID NO: 663726 - DNA, 16 bp, Homo sapiens
ccacatcaaataagaa

SEQ ID NO: 663727 - DNA, 22 bp, Homo sapiens
ccacatgctgcctggcacagac

SEQ ID NO: 663728 - DNA, 13 bp, Homo sapiens
ccacatgtccagc

SEQ ID NO: 663729 - DNA, 18 bp, Homo sapiens
ccaccctgggctacagaa

SEQ ID NO: 663730 - DNA, 22 bp, Homo sapiens
ccacctctgggtccttggctcc

SEQ ID NO: 663731 - DNA, 12 bp, Homo sapiens
ccacctgcagga

SEQ ID NO: 663732 - DNA, 18 bp, Homo sapiens
ccacctgcaggaccctgt

SEQ ID NO: 663733 - DNA, 14 bp, Homo sapiens
ccacctgctcccag

SEQ ID NO: 663734 - DNA, 24 bp, Homo sapiens
ccacctggagaaggaagctgcctg

SEQ ID NO: 663735 - DNA, 22 bp, Homo sapiens
ccaccttcaatgacttctaatt

SEQ ID NO: 663736 - DNA, 22 bp, Homo sapiens
ccacgagggtctcccctcctgc

SEQ ID NO: 663737 - DNA, 17 bp, Homo sapiens
ccacggactccagtctg

SEQ ID NO: 663738 - DNA, 18 bp, Homo sapiens
ccacgtcgtggggtaaca

SEQ ID NO: 663739 - DNA, 20 bp, Homo sapiens
acaagagatctacacatgtt

SEQ ID NO: 663740 - DNA, 13 bp, Homo sapiens
acaaggaataaat

SEQ ID NO: 663741 - DNA, 18 bp, Homo sapiens
acaaggtataataaaatt

SEQ ID NO: 663742 - DNA, 22 bp, Homo sapiens
acaagtcagctccagctttctg

SEQ ID NO: 663743 - DNA, 14 bp, Homo sapiens
acaagtcatttttg

SEQ ID NO: 663744 - DNA, 14 bp, Homo sapiens
acaagtgccctcca

SEQ ID NO: 663745 - DNA, 19 bp, Homo sapiens
acaagtgccctccaggctt

SEQ ID NO: 663746 - DNA, 18 bp, Homo sapiens
acaataattctacatgtt

SEQ ID NO: 663747 - DNA, 15 bp, Homo sapiens
acaatacagtattat

SEQ ID NO: 663748 - DNA, 16 bp, Homo sapiens
acaatacagtattata

SEQ ID NO: 663749 - DNA, 18 bp, Homo sapiens
acaatacagtattataga

SEQ ID NO: 663750 - DNA, 22 bp, Homo sapiens
acaataggagtggtgatttgaa

SEQ ID NO: 663751 - DNA, 15 bp, Homo sapiens
acaatatagtttttt

SEQ ID NO: 663752 - DNA, 17 bp, Homo sapiens
acaatattccagatctt

SEQ ID NO: 663753 - DNA, 23 bp, Homo sapiens
acaatcaactctaatagtgctta

SEQ ID NO: 663754 - DNA, 17 bp, Homo sapiens
acaatctatggcttatt

SEQ ID NO: 663755 - DNA, 16 bp, Homo sapiens
acaatcttagtgaatg

SEQ ID NO: 663756 - DNA, 18 bp, Homo sapiens
acaatggaccctttttgt

SEQ ID NO: 663757 - DNA, 20 bp, Homo sapiens
acaatgtgaataatggcact

SEQ ID NO: 663758 - DNA, 19 bp, Homo sapiens
acaatgttccttttttgta

SEQ ID NO: 663759 - DNA, 23 bp, Homo sapiens
acaatgttccttttttgtatatt

SEQ ID NO: 663760 - DNA, 12 bp, Homo sapiens
acaatgttttct

SEQ ID NO: 663761 - DNA, 17 bp, Homo sapiens
acaattaatagtttgtc

SEQ ID NO: 663762 - DNA, 13 bp, Homo sapiens
acaattattggca

SEQ ID NO: 663763 - DNA, 19 bp, Homo sapiens
acaattattggcaaagttt

SEQ ID NO: 663764 - DNA, 16 bp, Homo sapiens
acaattgtgaacatga

SEQ ID NO: 663765 - DNA, 17 bp, Homo sapiens
acaattgtgaacatgat

SEQ ID NO: 663766 - DNA, 20 bp, Homo sapiens
acaattgtgaacatgatagt

SEQ ID NO: 663767 - DNA, 21 bp, Homo sapiens
acaattttctgtaatctttta

SEQ ID NO: 663768 - DNA, 23 bp, Homo sapiens
acaattttctgtaatcttttatt

SEQ ID NO: 663769 - DNA, 19 bp, Homo sapiens
acacaaaaaaaattttagc

SEQ ID NO: 663770 - DNA, 15 bp, Homo sapiens
acacaaagcacattg

SEQ ID NO: 663771 - DNA, 18 bp, Homo sapiens
acacaacccaataggagt

SEQ ID NO: 663772 - DNA, 12 bp, Homo sapiens
aaatgcatattt

SEQ ID NO: 663773 - DNA, 21 bp, Homo sapiens
aaatgcattgaacatcttgca

SEQ ID NO: 663774 - DNA, 22 bp, Homo sapiens
aaatgccctcttctcgtgcctc

SEQ ID NO: 663775 - DNA, 22 bp, Homo sapiens
aaatgggtgtatataattttat

SEQ ID NO: 663776 - DNA, 21 bp, Homo sapiens
aaatgtaatataatgtatttt

SEQ ID NO: 663777 - DNA, 20 bp, Homo sapiens
aaatgtaattataagctgag

SEQ ID NO: 663778 - DNA, 17 bp, Homo sapiens
aaatgtaatttaaatga

SEQ ID NO: 663779 - DNA, 13 bp, Homo sapiens
aaatgtataaata

SEQ ID NO: 663780 - DNA, 14 bp, Homo sapiens
aaatgtattttaca

SEQ ID NO: 663781 - DNA, 16 bp, Homo sapiens
aaatgtattttacata

SEQ ID NO: 663782 - DNA, 19 bp, Homo sapiens
aaatgtcagtgtttgggaa

SEQ ID NO: 663783 - DNA, 21 bp, Homo sapiens
aaatgtcagtgtttgggaaat

SEQ ID NO: 663784 - DNA, 21 bp, Homo sapiens
aaatgtgaatttttattgttg

SEQ ID NO: 663785 - DNA, 18 bp, Homo sapiens
aaatgttaaaagttttat

SEQ ID NO: 663786 - DNA, 23 bp, Homo sapiens
aaatgttaaaagttttatatgct

SEQ ID NO: 663787 - DNA, 18 bp, Homo sapiens
aaatgttagtcattgtta

SEQ ID NO: 663788 - DNA, 22 bp, Homo sapiens
aaatgtttaataaagctttata

SEQ ID NO: 663789 - DNA, 12 bp, Homo sapiens
aaatgtttcatt

SEQ ID NO: 663790 - DNA, 18 bp, Homo sapiens
aaatgtttcttttaaaga

SEQ ID NO: 663791 - DNA, 14 bp, Homo sapiens
aaatgtttcttttg

SEQ ID NO: 663792 - DNA, 19 bp, Homo sapiens
aaatgtttcttttgtttgg

SEQ ID NO: 663793 - DNA, 18 bp, Homo sapiens
aaatgtttttatttttgt

SEQ ID NO: 663794 - DNA, 12 bp, Homo sapiens
aaattaaaacaa

SEQ ID NO: 663795 - DNA, 15 bp, Homo sapiens
aaattaactgtatgt

SEQ ID NO: 663796 - DNA, 19 bp, Homo sapiens
aaattaactgtatgtgtgt

SEQ ID NO: 663797 - DNA, 23 bp, Homo sapiens
aaattaacttttttgtggcaatt

SEQ ID NO: 663798 - DNA, 12 bp, Homo sapiens
aaattaagattt

SEQ ID NO: 663799 - DNA, 16 bp, Homo sapiens
aaattaagatttcctt

SEQ ID NO: 663800 - DNA, 21 bp, Homo sapiens
aaattacctttaattttaatg

SEQ ID NO: 663801 - DNA, 12 bp, Homo sapiens
aaattactttaa

SEQ ID NO: 663802 - DNA, 16 bp, Homo sapiens
aaattactttaacatt

SEQ ID NO: 663803 - DNA, 19 bp, Homo sapiens
aaattagaaaaaaattact

SEQ ID NO: 663804 - DNA, 20 bp, Homo sapiens
aaattcaactttgtaaaaat

SEQ ID NO: 663805 - DNA, 18 bp, Homo sapiens
aaattcaagagctagaaa

SEQ ID NO: 663806 - DNA, 22 bp, Homo sapiens
aaattcaagagctagaaaaata

SEQ ID NO: 663807 - DNA, 19 bp, Homo sapiens
aaattgagttgcacttatt

SEQ ID NO: 663808 - DNA, 17 bp, Homo sapiens
aaattgctatgttacta

SEQ ID NO: 663809 - DNA, 19 bp, Homo sapiens
aaattggggaggagggggc

SEQ ID NO: 663810 - DNA, 22 bp, Homo sapiens
aaattgtatcttattataaaat

SEQ ID NO: 663811 - DNA, 18 bp, Homo sapiens
aaattgtctaaaatgtca

SEQ ID NO: 663812 - DNA, 23 bp, Homo sapiens
aaattgtgcagtactttgtgcat

SEQ ID NO: 663813 - DNA, 20 bp, Homo sapiens
aaattgttgtatatcactaa

SEQ ID NO: 663814 - DNA, 13 bp, Homo sapiens
aaattgtttagtg

SEQ ID NO: 663815 - DNA, 16 bp, Homo sapiens
aaatttaaaaaataaa

SEQ ID NO: 663816 - DNA, 19 bp, Homo sapiens
aaatttaaaaaataaataa

SEQ ID NO: 663817 - DNA, 14 bp, Homo sapiens
aaatttactttaaa

SEQ ID NO: 663818 - DNA, 17 bp, Homo sapiens
aaatttactttaaaaag

SEQ ID NO: 663819 - DNA, 22 bp, Homo sapiens
aaatttactttaaaaagaaatt

SEQ ID NO: 663820 - DNA, 16 bp, Homo sapiens
aaatttatattcataa

SEQ ID NO: 663821 - DNA, 12 bp, Homo sapiens
aaggtgtattta

SEQ ID NO: 663822 - DNA, 21 bp, Homo sapiens
aaggtgtatttaaactatctt

SEQ ID NO: 663823 - DNA, 20 bp, Homo sapiens
aaggtttaaccttaaaatta

SEQ ID NO: 663824 - DNA, 16 bp, Homo sapiens
aaggtttctggagcag

SEQ ID NO: 663825 - DNA, 15 bp, Homo sapiens
aagtaaatatatatg

SEQ ID NO: 663826 - DNA, 19 bp, Homo sapiens
aagtaacaatctatggctt

SEQ ID NO: 663827 - DNA, 12 bp, Homo sapiens
aagtaatttaat

SEQ ID NO: 663828 - DNA, 13 bp, Homo sapiens
aagtacaaatgaa

SEQ ID NO: 663829 - DNA, 24 bp, Homo sapiens
aagtactctttaacatacaagaaa

SEQ ID NO: 663830 - DNA, 13 bp, Homo sapiens
aagtagtaaatca

SEQ ID NO: 663831 - DNA, 18 bp, Homo sapiens
aagtatatatatatatta

SEQ ID NO: 663832 - DNA, 19 bp, Homo sapiens
aagtatctgggattattct

SEQ ID NO: 663833 - DNA, 21 bp, Homo sapiens
aagtatctgggattattcttt

SEQ ID NO: 663834 - DNA, 22 bp, Homo sapiens
aagtatgcaatgcttcattatt

SEQ ID NO: 663835 - DNA, 11 bp, Homo sapiens
aagtattttct

SEQ ID NO: 663836 - DNA, 14 bp, Homo sapiens
aagtcaaaatatgt

SEQ ID NO: 663837 - DNA, 18 bp, Homo sapiens
aagtcaaatttactttaa

SEQ ID NO: 663838 - DNA, 17 bp, Homo sapiens
aagtcacccctttctgt

SEQ ID NO: 663839 - DNA, 17 bp, Homo sapiens
aagtcatagccataaat

SEQ ID NO: 663840 - DNA, 20 bp, Homo sapiens
aagtcccagagcacctcacc

SEQ ID NO: 663841 - DNA, 15 bp, Homo sapiens
aagtcccatcataga

SEQ ID NO: 663842 - DNA, 18 bp, Homo sapiens
aagtccgcagaagccctg

SEQ ID NO: 663843 - DNA, 19 bp, Homo sapiens
aagtctgtccaaatttaaa

SEQ ID NO: 663844 - DNA, 15 bp, Homo sapiens
aagtcttttttttcc

SEQ ID NO: 663845 - DNA, 20 bp, Homo sapiens
aagtgagtggtgtgactctt

SEQ ID NO: 663846 - DNA, 17 bp, Homo sapiens
aagtgcagctcatgttt

SEQ ID NO: 663847 - DNA, 20 bp, Homo sapiens
aagtgcgtgccgtgtgagtg

SEQ ID NO: 663848 - DNA, 13 bp, Homo sapiens
aagtgctgggatt

SEQ ID NO: 663849 - DNA, 23 bp, Homo sapiens
aagtgctgtcttgatgactgctg

SEQ ID NO: 663850 - DNA, 22 bp, Homo sapiens
aagtggtgtaaacttgtacatg

SEQ ID NO: 663851 - DNA, 12 bp, Homo sapiens
aagtgtaaaaaa

SEQ ID NO: 663852 - DNA, 14 bp, Homo sapiens
aagtgtaaaaaatg

SEQ ID NO: 663853 - DNA, 21 bp, Homo sapiens
aagtgtctcactaaagcatga

SEQ ID NO: 663854 - DNA, 18 bp, Homo sapiens
aagtgtgagctcttccct

SEQ ID NO: 663855 - DNA, 19 bp, Homo sapiens
aagtgtgagctcttccctt

SEQ ID NO: 663856 - DNA, 18 bp, Homo sapiens
aagtgtgccaaatcagtt

SEQ ID NO: 663857 - DNA, 15 bp, Homo sapiens
aagtgtgtatatatt

SEQ ID NO: 663858 - DNA, 19 bp, Homo sapiens
aagttagaacatttgctgt

SEQ ID NO: 663859 - DNA, 14 bp, Homo sapiens
aagttatgtattta

SEQ ID NO: 663860 - DNA, 17 bp, Homo sapiens
aagttcaacttatttca

SEQ ID NO: 663861 - DNA, 20 bp, Homo sapiens
aagttcaacttatttcataa

SEQ ID NO: 663862 - DNA, 23 bp, Homo sapiens
aagttcatgtgtggaaatgggac

SEQ ID NO: 663863 - DNA, 18 bp, Homo sapiens
aagttgattaagaaagga

SEQ ID NO: 663864 - DNA, 19 bp, Homo sapiens
aagtttaaaagccatgtat

SEQ ID NO: 663865 - DNA, 12 bp, Homo sapiens
aagtttaaatgt

SEQ ID NO: 663866 - DNA, 17 bp, Homo sapiens
aagtttaaatgtatttt

SEQ ID NO: 663867 - DNA, 20 bp, Homo sapiens
aagtttaaatgtattttaca

SEQ ID NO: 663868 - DNA, 14 bp, Homo sapiens
aagtttaccatctg

SEQ ID NO: 663869 - DNA, 13 bp, Homo sapiens
aagtttatatgcc

SEQ ID NO: 663870 - DNA, 16 bp, Homo sapiens
aatcctgccatttaaa

SEQ ID NO: 663871 - DNA, 20 bp, Homo sapiens
aatctaaaagctctgttcca

SEQ ID NO: 663872 - DNA, 21 bp, Homo sapiens
aatctaagcagcttattgttt

SEQ ID NO: 663873 - DNA, 23 bp, Homo sapiens
aatctacaccaatgaaaacatgt

SEQ ID NO: 663874 - DNA, 21 bp, Homo sapiens
aatctaggatgggaacaagga

SEQ ID NO: 663875 - DNA, 18 bp, Homo sapiens
aatctatggcttatttct

SEQ ID NO: 663876 - DNA, 15 bp, Homo sapiens
aatctcctaaccttg

SEQ ID NO: 663877 - DNA, 16 bp, Homo sapiens
aatctgctttaattac

SEQ ID NO: 663878 - DNA, 17 bp, Homo sapiens
aatcttcaaagccttct

SEQ ID NO: 663879 - DNA, 20 bp, Homo sapiens
aatcttcagtattttctcca

SEQ ID NO: 663880 - DNA, 19 bp, Homo sapiens
aatgaaaacatgtactaca

SEQ ID NO: 663881 - DNA, 16 bp, Homo sapiens
aatgaaacttaagaat

SEQ ID NO: 663882 - DNA, 16 bp, Homo sapiens
aatgaaagctgttcct

SEQ ID NO: 663883 - DNA, 19 bp, Homo sapiens
aatgaaagtcaaatttact

SEQ ID NO: 663884 - DNA, 12 bp, Homo sapiens
aatgaaatcttc

SEQ ID NO: 663885 - DNA, 18 bp, Homo sapiens
aatgaaccataaattcaa

SEQ ID NO: 663886 - DNA, 23 bp, Homo sapiens
aatgaagaaagtcaaaaaattat

SEQ ID NO: 663887 - DNA, 15 bp, Homo sapiens
aatgaagccttagcc

SEQ ID NO: 663888 - DNA, 16 bp, Homo sapiens
aatgacaattgtgaac

SEQ ID NO: 663889 - DNA, 15 bp, Homo sapiens
aatgaccattcaatt

SEQ ID NO: 663890 - DNA, 19 bp, Homo sapiens
aatgaccattcaattagtg

SEQ ID NO: 663891 - DNA, 16 bp, Homo sapiens
aatgactgacaaagac

SEQ ID NO: 663892 - DNA, 19 bp, Homo sapiens
aatgagactctagggtcca

SEQ ID NO: 663893 - DNA, 17 bp, Homo sapiens
aatgaggaaaattctta

SEQ ID NO: 663894 - DNA, 14 bp, Homo sapiens
aatgataaaataaa

SEQ ID NO: 663895 - DNA, 18 bp, Homo sapiens
aatgatatgcttgtaact

SEQ ID NO: 663896 - DNA, 19 bp, Homo sapiens
aatgatatgcttgtaacta

SEQ ID NO: 663897 - DNA, 20 bp, Homo sapiens
aatgcaactctaactctgag

SEQ ID NO: 663898 - DNA, 14 bp, Homo sapiens
aatgcagtatatag

SEQ ID NO: 663899 - DNA, 19 bp, Homo sapiens
aatgcatatcctgagccat

SEQ ID NO: 663900 - DNA, 17 bp, Homo sapiens
aatgccagtctcattgt

SEQ ID NO: 663901 - DNA, 13 bp, Homo sapiens
aatgcctcctgtg

SEQ ID NO: 663902 - DNA, 15 bp, Homo sapiens
aatgctacatgtgag

SEQ ID NO: 663903 - DNA, 16 bp, Homo sapiens
aatgctccccacagcg

SEQ ID NO: 663904 - DNA, 18 bp, Homo sapiens
aatgctgctgtcagacga

SEQ ID NO: 663905 - DNA, 13 bp, Homo sapiens
aatgctgtttcta

SEQ ID NO: 663906 - DNA, 15 bp, Homo sapiens
aatgctgtttctaag

SEQ ID NO: 663907 - DNA, 18 bp, Homo sapiens
aatgctgtttctaagaaa

SEQ ID NO: 663908 - DNA, 19 bp, Homo sapiens
aatgctgtttctaagaaaa

SEQ ID NO: 663909 - DNA, 16 bp, Homo sapiens
aatgcttcagatatta

SEQ ID NO: 663910 - DNA, 14 bp, Homo sapiens
aatgcttcattatt

SEQ ID NO: 663911 - DNA, 18 bp, Homo sapiens
aatggaaccccaccactg

SEQ ID NO: 663912 - DNA, 14 bp, Homo sapiens
aatggacacaaatt

SEQ ID NO: 663913 - DNA, 22 bp, Homo sapiens
aatggaccctttttgttatgat

SEQ ID NO: 663914 - DNA, 19 bp, Homo sapiens
aatggatattattagaaat

SEQ ID NO: 663915 - DNA, 11 bp, Homo sapiens
aatggcagagc

SEQ ID NO: 663916 - DNA, 13 bp, Homo sapiens
aatggcatttctc

SEQ ID NO: 663917 - DNA, 16 bp, Homo sapiens
aatggctatttttgaa

SEQ ID NO: 663918 - DNA, 15 bp, Homo sapiens
aatgggaaaaaactt

SEQ ID NO: 663919 - DNA, 20 bp, Homo sapiens
aatggtgtcagtatccaggc

SEQ ID NO: 663920 - DNA, 20 bp, Homo sapiens
aatgtaaagttatgtattta

SEQ ID NO: 663921 - DNA, 16 bp, Homo sapiens
aatgtaaataaactat

SEQ ID NO: 663922 - DNA, 19 bp, Homo sapiens
aatgtaaataaactattta

SEQ ID NO: 663923 - DNA, 21 bp, Homo sapiens
aatgtaaataaactatttata

SEQ ID NO: 663924 - DNA, 22 bp, Homo sapiens
aatgtaaataaactatttatat

SEQ ID NO: 663925 - DNA, 20 bp, Homo sapiens
aatgtaatataatgtatttt

SEQ ID NO: 663926 - DNA, 22 bp, Homo sapiens
aatgtaatataatgtattttct

SEQ ID NO: 663927 - DNA, 13 bp, Homo sapiens
aatgtaatttaaa

SEQ ID NO: 663928 - DNA, 16 bp, Homo sapiens
aatgtaatttaaatga

SEQ ID NO: 663929 - DNA, 17 bp, Homo sapiens
aatgtaatttaaatgaa

SEQ ID NO: 663930 - DNA, 16 bp, Homo sapiens
aatgtacatgaagcaa

SEQ ID NO: 663931 - DNA, 19 bp, Homo sapiens
aatgtatgtaatgtgtggt

SEQ ID NO: 663932 - DNA, 12 bp, Homo sapiens
aatgtcaaggca

SEQ ID NO: 663933 - DNA, 14 bp, Homo sapiens
aatgtcagtagtgc

SEQ ID NO: 663934 - DNA, 13 bp, Homo sapiens
aatgtcattgtct

SEQ ID NO: 663935 - DNA, 15 bp, Homo sapiens
aatgtcattgtctac

SEQ ID NO: 663936 - DNA, 16 bp, Homo sapiens
aatgtcattgtctact

SEQ ID NO: 663937 - DNA, 22 bp, Homo sapiens
aatgtcttggtcttctactgcc

SEQ ID NO: 663938 - DNA, 15 bp, Homo sapiens
aatgtgaataatggc

SEQ ID NO: 663939 - DNA, 20 bp, Homo sapiens
aatgtgaatttttattgttg

SEQ ID NO: 663940 - DNA, 16 bp, Homo sapiens
aatgtgcagaaaatat

SEQ ID NO: 663941 - DNA, 19 bp, Homo sapiens
aatgtgcagaaaatattta

SEQ ID NO: 663942 - DNA, 17 bp, Homo sapiens
aatgtgcataatgataa

SEQ ID NO: 663943 - DNA, 16 bp, Homo sapiens
aatgtggctgaagttg

SEQ ID NO: 663944 - DNA, 23 bp, Homo sapiens
aatgtgtggattgcctctgaaaa

SEQ ID NO: 663945 - DNA, 16 bp, Homo sapiens
aatgttagtcattgtt

SEQ ID NO: 663946 - DNA, 18 bp, Homo sapiens
aatgttccttttttgtat

SEQ ID NO: 663947 - DNA, 20 bp, Homo sapiens
aatgttccttttttgtatat

SEQ ID NO: 663948 - DNA, 21 bp, Homo sapiens
aatgttccttttttgtatatt

SEQ ID NO: 663949 - DNA, 14 bp, Homo sapiens
aaaaatttttgttt

SEQ ID NO: 663950 - DNA, 20 bp, Homo sapiens
aaaacaattttctgtaatct

SEQ ID NO: 663951 - DNA, 21 bp, Homo sapiens
aaaacgtggcacacactgacc

SEQ ID NO: 663952 - DNA, 13 bp, Homo sapiens
aaaactcttcagt

SEQ ID NO: 663953 - DNA, 20 bp, Homo sapiens
aaaactgtacatttaaaatt

SEQ ID NO: 663954 - DNA, 18 bp, Homo sapiens
aaaacttaaaaattaata

SEQ ID NO: 663955 - DNA, 10 bp, Homo sapiens
aaaacttctg

SEQ ID NO: 663956 - DNA, 14 bp, Homo sapiens
aaaacttttgagga

SEQ ID NO: 663957 - DNA, 22 bp, Homo sapiens
aaaagaaaccttccaatgcttc

SEQ ID NO: 663958 - DNA, 16 bp, Homo sapiens
aaaagaaattaatatg

SEQ ID NO: 663959 - DNA, 12 bp, Homo sapiens
aaaagagtaatt

SEQ ID NO: 663960 - DNA, 15 bp, Homo sapiens
aaaagcagggcagca

SEQ ID NO: 663961 - DNA, 15 bp, Homo sapiens
aaaagcattttgtaa

SEQ ID NO: 663962 - DNA, 14 bp, Homo sapiens
aaaagccatgtata

SEQ ID NO: 663963 - DNA, 21 bp, Homo sapiens
aaaagctagtgtacctcctct

SEQ ID NO: 663964 - DNA, 13 bp, Homo sapiens
aaaagctcactgc

SEQ ID NO: 663965 - DNA, 17 bp, Homo sapiens
aaaagctggattttctt

SEQ ID NO: 663966 - DNA, 14 bp, Homo sapiens
aaaaggaagactag

SEQ ID NO: 663967 - DNA, 16 bp, Homo sapiens
aaaaggacacctttta

SEQ ID NO: 663968 - DNA, 21 bp, Homo sapiens
aaaaggtgataggtaaatttt

SEQ ID NO: 663969 - DNA, 15 bp, Homo sapiens
aaaagtatatgttag

SEQ ID NO: 663970 - DNA, 19 bp, Homo sapiens
aaaagtggtgtaaacttgt

SEQ ID NO: 663971 - DNA, 20 bp, Homo sapiens
aaaagttttttattatgcat

SEQ ID NO: 663972 - DNA, 20 bp, Homo sapiens
aaaataaataaaaactaatt

SEQ ID NO: 663973 - DNA, 12 bp, Homo sapiens
aaaataagacaa

SEQ ID NO: 663974 - DNA, 12 bp, Homo sapiens
aaaataatacaa

SEQ ID NO: 663975 - DNA, 13 bp, Homo sapiens
aaaataattttgt

SEQ ID NO: 663976 - DNA, 16 bp, Homo sapiens
aaaatacatagtgaaa

SEQ ID NO: 663977 - DNA, 15 bp, Homo sapiens
aaaataccagtgttg

SEQ ID NO: 663978 - DNA, 21 bp, Homo sapiens
aaaatactatttaagatgtga

SEQ ID NO: 663979 - DNA, 23 bp, Homo sapiens
aaaatactatttaagatgtgaaa

SEQ ID NO: 663980 - DNA, 23 bp, Homo sapiens
aaaatagatataaatttttaaga

SEQ ID NO: 663981 - DNA, 15 bp, Homo sapiens
aaaataggcttttta

SEQ ID NO: 663982 - DNA, 22 bp, Homo sapiens
aaaataggctttttaggaactc

SEQ ID NO: 663983 - DNA, 21 bp, Homo sapiens
aaaatatgtaagaacacattt

SEQ ID NO: 663984 - DNA, 14 bp, Homo sapiens
aaaatatgtaattt

SEQ ID NO: 663985 - DNA, 14 bp, Homo sapiens
aaaatatttaatat

SEQ ID NO: 663986 - DNA, 12 bp, Homo sapiens
aaaatcattgat

SEQ ID NO: 663987 - DNA, 23 bp, Homo sapiens
aaaatctaagcagcttattgttt

SEQ ID NO: 663988 - DNA, 18 bp, Homo sapiens
cagtaacccccttaaatt

SEQ ID NO: 663989 - DNA, 21 bp, Homo sapiens
cagtaacccccttaaatttaa

SEQ ID NO: 663990 - DNA, 13 bp, Homo sapiens
cagtacctctcaa

SEQ ID NO: 663991 - DNA, 14 bp, Homo sapiens
cagtacttctaaga

SEQ ID NO: 663992 - DNA, 16 bp, Homo sapiens
cagtactttgtgcatt

SEQ ID NO: 663993 - DNA, 14 bp, Homo sapiens
cagtagaactccag

SEQ ID NO: 663994 - DNA, 22 bp, Homo sapiens
cagtagaactccaggccctcct

SEQ ID NO: 663995 - DNA, 20 bp, Homo sapiens
cagtataaccagctgaagtt

SEQ ID NO: 663996 - DNA, 17 bp, Homo sapiens
cagtattttctccactt

SEQ ID NO: 663997 - DNA, 15 bp, Homo sapiens
cagtcataaagaggt

SEQ ID NO: 663998 - DNA, 23 bp, Homo sapiens
cagtcatcatcagggcctggggc

SEQ ID NO: 663999 - DNA, 13 bp, Homo sapiens
cagtcccacactg

SEQ ID NO: 664000 - DNA, 15 bp, Homo sapiens
cagtcccacactgtg

SEQ ID NO: 664001 - DNA, 22 bp, Homo sapiens
cagtcccacactgtggccaggc

SEQ ID NO: 664002 - DNA, 15 bp, Homo sapiens
cagtcgcctgcctgc

SEQ ID NO: 664003 - DNA, 16 bp, Homo sapiens
cagtcgcctgcctgca

SEQ ID NO: 664004 - DNA, 13 bp, Homo sapiens
cagtcttcccagc

SEQ ID NO: 664005 - DNA, 14 bp, Homo sapiens
cagtctttcttgaa

SEQ ID NO: 664006 - DNA, 20 bp, Homo sapiens
cagtctttgccctgaatggt

SEQ ID NO: 664007 - DNA, 22 bp, Homo sapiens
cagtgaactaagtccctataat

SEQ ID NO: 664008 - DNA, 17 bp, Homo sapiens
cagtgaacttggctttc

SEQ ID NO: 664009 - DNA, 14 bp, Homo sapiens
cagtgactccctgg

SEQ ID NO: 664010 - DNA, 23 bp, Homo sapiens
cagtgagggtaagtattttcctg

SEQ ID NO: 664011 - DNA, 17 bp, Homo sapiens
cagtgcaaattgtatct

SEQ ID NO: 664012 - DNA, 14 bp, Homo sapiens
cagtgcagatggag

SEQ ID NO: 664013 - DNA, 15 bp, Homo sapiens
cagtgcatggtggcc

SEQ ID NO: 664014 - DNA, 17 bp, Homo sapiens
cagtgcatggtggccag

SEQ ID NO: 664015 - DNA, 10 bp, Homo sapiens
cagtgccaac

SEQ ID NO: 664016 - DNA, 17 bp, Homo sapiens
cagtgcctcaccttcca

SEQ ID NO: 664017 - DNA, 19 bp, Homo sapiens
cagtggaaaccctgagagt

SEQ ID NO: 664018 - DNA, 12 bp, Homo sapiens
cagtggcagaga

SEQ ID NO: 664019 - DNA, 13 bp, Homo sapiens
cagtggcagagaa

SEQ ID NO: 664020 - DNA, 14 bp, Homo sapiens
cagtggccatcatc

SEQ ID NO: 664021 - DNA, 18 bp, Homo sapiens
cagtggctcacacctgta

SEQ ID NO: 664022 - DNA, 15 bp, Homo sapiens
cagtggggctgcagg

SEQ ID NO: 664023 - DNA, 19 bp, Homo sapiens
cagtgtcagggtccaggag

SEQ ID NO: 664024 - DNA, 20 bp, Homo sapiens
cagtgtgccagtttaaaaag

SEQ ID NO: 664025 - DNA, 15 bp, Homo sapiens
cagtgtggccaggct

SEQ ID NO: 664026 - DNA, 15 bp, Homo sapiens
cagtgtttggacagg

SEQ ID NO: 664027 - DNA, 22 bp, Homo sapiens
cagtgttttggactccatctct

SEQ ID NO: 664028 - DNA, 17 bp, Homo sapiens
cagttatggtgatgact

SEQ ID NO: 664029 - DNA, 12 bp, Homo sapiens
cagttatttctg

SEQ ID NO: 664030 - DNA, 16 bp, Homo sapiens
cagttgaaaacttgta

SEQ ID NO: 664031 - DNA, 17 bp, Homo sapiens
cagttgaaaacttgtaa

SEQ ID NO: 664032 - DNA, 21 bp, Homo sapiens
cagttgaaaatgcaactctaa

SEQ ID NO: 664033 - DNA, 12 bp, Homo sapiens
cagttgctgtga

SEQ ID NO: 664034 - DNA, 14 bp, Homo sapiens
cagttgctgtgaac

SEQ ID NO: 664035 - DNA, 23 bp, Homo sapiens
cagttgtagggttacagagacct

SEQ ID NO: 664036 - DNA, 16 bp, Homo sapiens
cagttgtatgtttgct

SEQ ID NO: 664037 - DNA, 13 bp, Homo sapiens
cagtttccaaatt

SEQ ID NO: 664038 - DNA, 15 bp, Homo sapiens
cagtttgttggaaag

SEQ ID NO: 664039 - DNA, 13 bp, Homo sapiens
cagttttccctgg

SEQ ID NO: 664040 - DNA, 18 bp, Homo sapiens
cataaaaactgatttgct

SEQ ID NO: 664041 - DNA, 21 bp, Homo sapiens
cataaaatagaataattcttt

SEQ ID NO: 664042 - DNA, 18 bp, Homo sapiens
cataaagtacaaatgaag

SEQ ID NO: 664043 - DNA, 19 bp, Homo sapiens
cataaatgcataatttatg

SEQ ID NO: 664044 - DNA, 18 bp, Homo sapiens
cataaattcaactttgta

SEQ ID NO: 664045 - DNA, 20 bp, Homo sapiens
cataaattcaactttgtaaa

SEQ ID NO: 664046 - DNA, 12 bp, Homo sapiens
cataaatttttt

SEQ ID NO: 664047 - DNA, 13 bp, Homo sapiens
cataacttcctgt

SEQ ID NO: 664048 - DNA, 13 bp, Homo sapiens
cataagcttccat

SEQ ID NO: 664049 - DNA, 17 bp, Homo sapiens
cataagcttccatttta

SEQ ID NO: 664050 - DNA, 17 bp, Homo sapiens
cataataagctaaagag

SEQ ID NO: 664051 - DNA, 14 bp, Homo sapiens
cataatcagtaaat

SEQ ID NO: 664052 - DNA, 19 bp, Homo sapiens
cataatcagtaaatagtgt

SEQ ID NO: 664053 - DNA, 23 bp, Homo sapiens
cataatcagtaaatagtgtcata

SEQ ID NO: 664054 - DNA, 15 bp, Homo sapiens
cataatgataaaata

SEQ ID NO: 664055 - DNA, 17 bp, Homo sapiens
cataatgataaaataaa

SEQ ID NO: 664056 - DNA, 15 bp, Homo sapiens
cataatgttgcttct

SEQ ID NO: 664057 - DNA, 12 bp, Homo sapiens
cataatttatgg

SEQ ID NO: 664058 - DNA, 12 bp, Homo sapiens
cataattttgca

SEQ ID NO: 664059 - DNA, 22 bp, Homo sapiens
cataccactttgacacgcttca

SEQ ID NO: 664060 - DNA, 14 bp, Homo sapiens
catacctaccagta

SEQ ID NO: 664061 - DNA, 18 bp, Homo sapiens
cataccttttctcttttc

SEQ ID NO: 664062 - DNA, 14 bp, Homo sapiens
catactaataaata

SEQ ID NO: 664063 - DNA, 20 bp, Homo sapiens
catactactgaaacagattt

SEQ ID NO: 664064 - DNA, 17 bp, Homo sapiens
catacttgtgaaacgtc

SEQ ID NO: 664065 - DNA, 18 bp, Homo sapiens
catactttgtattttgat

SEQ ID NO: 664066 - DNA, 19 bp, Homo sapiens
catagaaaacactacagtg

SEQ ID NO: 664067 - DNA, 22 bp, Homo sapiens
catagaaaattgaaacacagag

SEQ ID NO: 664068 - DNA, 17 bp, Homo sapiens
catagagatttgtctaa

SEQ ID NO: 664069 - DNA, 19 bp, Homo sapiens
catagataatattgtttgg

SEQ ID NO: 664070 - DNA, 19 bp, Homo sapiens
catagcaagcttttgctca

SEQ ID NO: 664071 - DNA, 18 bp, Homo sapiens
catagctcaagaattgtt

SEQ ID NO: 664072 - DNA, 14 bp, Homo sapiens
cataggagggaagg

SEQ ID NO: 664073 - DNA, 16 bp, Homo sapiens
cataggtcataaagca

SEQ ID NO: 664074 - DNA, 17 bp, Homo sapiens
catagtgagacactgtc

SEQ ID NO: 664075 - DNA, 16 bp, Homo sapiens
catatacatattgtat

SEQ ID NO: 664076 - DNA, 21 bp, Homo sapiens
catatacatattgtatatata

SEQ ID NO: 664077 - DNA, 22 bp, Homo sapiens
catatagcattgataatcttca

SEQ ID NO: 664078 - DNA, 17 bp, Homo sapiens
catatagttaaactgag

SEQ ID NO: 664079 - DNA, 22 bp, Homo sapiens
catatagttaaactgagagtaa

SEQ ID NO: 664080 - DNA, 11 bp, Homo sapiens
catatatatat

SEQ ID NO: 664081 - DNA, 16 bp, Homo sapiens
catatatatatataac

SEQ ID NO: 664082 - DNA, 18 bp, Homo sapiens
atgtgaatttttattgtt

SEQ ID NO: 664083 - DNA, 20 bp, Homo sapiens
atgtgacctggggcagataa

SEQ ID NO: 664084 - DNA, 18 bp, Homo sapiens
atgtgagtgccttttgca

SEQ ID NO: 664085 - DNA, 21 bp, Homo sapiens
atgtgatacattttttaagct

SEQ ID NO: 664086 - DNA, 22 bp, Homo sapiens
atgtgatacattttttaagctt

SEQ ID NO: 664087 - DNA, 22 bp, Homo sapiens
atgtgcagaaaatatttaatat

SEQ ID NO: 664088 - DNA, 15 bp, Homo sapiens
atgtggcagatctac

SEQ ID NO: 664089 - DNA, 22 bp, Homo sapiens
atgtggcagatctacatgtcta

SEQ ID NO: 664090 - DNA, 19 bp, Homo sapiens
atgtgggatattgaatgtt

SEQ ID NO: 664091 - DNA, 17 bp, Homo sapiens
atgtgtcctcagggagc

SEQ ID NO: 664092 - DNA, 17 bp, Homo sapiens
atgtgtggtggcctcag

SEQ ID NO: 664093 - DNA, 18 bp, Homo sapiens
atgtgtgtaggttatctt

SEQ ID NO: 664094 - DNA, 16 bp, Homo sapiens
atgttaaagagaatga

SEQ ID NO: 664095 - DNA, 21 bp, Homo sapiens
atgttactattttctacaatt

SEQ ID NO: 664096 - DNA, 17 bp, Homo sapiens
atgttagtaatggcaga

SEQ ID NO: 664097 - DNA, 19 bp, Homo sapiens
atgttagtaatggcagagc

SEQ ID NO: 664098 - DNA, 22 bp, Homo sapiens
atgttagtaatggcagagcagt

SEQ ID NO: 664099 - DNA, 23 bp, Homo sapiens
atgttctaaaatgtcaaggcagt

SEQ ID NO: 664100 - DNA, 11 bp, Homo sapiens
atgttctatta

SEQ ID NO: 664101 - DNA, 12 bp, Homo sapiens
atgttctgcctc

SEQ ID NO: 664102 - DNA, 16 bp, Homo sapiens
atgttgaaaagtaatt

SEQ ID NO: 664103 - DNA, 14 bp, Homo sapiens
atgttgctctttca

SEQ ID NO: 664104 - DNA, 17 bp, Homo sapiens
atgttgctctttcacct

SEQ ID NO: 664105 - DNA, 18 bp, Homo sapiens
atgttgctctttcacctg

SEQ ID NO: 664106 - DNA, 14 bp, Homo sapiens
atgttgtaatattt

SEQ ID NO: 664107 - DNA, 17 bp, Homo sapiens
atgttgtaatatttctt

SEQ ID NO: 664108 - DNA, 15 bp, Homo sapiens
atgttgtgtttttaa

SEQ ID NO: 664109 - DNA, 17 bp, Homo sapiens
atgtttaataaagcttt

SEQ ID NO: 664110 - DNA, 13 bp, Homo sapiens
atgtttatactgt

SEQ ID NO: 664111 - DNA, 15 bp, Homo sapiens
atgtttatgagccag

SEQ ID NO: 664112 - DNA, 16 bp, Homo sapiens
atgtttatgagccaga

SEQ ID NO: 664113 - DNA, 20 bp, Homo sapiens
atgtttatgagccagacaaa

SEQ ID NO: 664114 - DNA, 21 bp, Homo sapiens
atgtttatgagccagacaaat

SEQ ID NO: 664115 - DNA, 21 bp, Homo sapiens
atgtttcattatgcactttta

SEQ ID NO: 664116 - DNA, 16 bp, Homo sapiens
atgtttcttttgtttg

SEQ ID NO: 664117 - DNA, 13 bp, Homo sapiens
atgtttgaacaaa

SEQ ID NO: 664118 - DNA, 12 bp, Homo sapiens
atgtttgaatga

SEQ ID NO: 664119 - DNA, 13 bp, Homo sapiens
atgtttgcagggg

SEQ ID NO: 664120 - DNA, 23 bp, Homo sapiens
atgtttgctcttgtttttattaa

SEQ ID NO: 664121 - DNA, 22 bp, Homo sapiens
atgtttgctgattatttatgac

SEQ ID NO: 664122 - DNA, 16 bp, Homo sapiens
atgttttcaaaaggta

SEQ ID NO: 664123 - DNA, 14 bp, Homo sapiens
atgttttcttcaac

SEQ ID NO: 664124 - DNA, 22 bp, Homo sapiens
attaaaaattacctttaatttt

SEQ ID NO: 664125 - DNA, 12 bp, Homo sapiens
attaaaacaata

SEQ ID NO: 664126 - DNA, 17 bp, Homo sapiens
attaaatcagttctcaa

SEQ ID NO: 664127 - DNA, 18 bp, Homo sapiens
attaaatcagttctcaat

SEQ ID NO: 664128 - DNA, 22 bp, Homo sapiens
attaaatcagttctcaatttca

SEQ ID NO: 664129 - DNA, 13 bp, Homo sapiens
attaactgtatgt

SEQ ID NO: 664130 - DNA, 12 bp, Homo sapiens
attaacttattt

SEQ ID NO: 664131 - DNA, 17 bp, Homo sapiens
attaacttatttagaga

SEQ ID NO: 664132 - DNA, 12 bp, Homo sapiens
attaagaaacct

SEQ ID NO: 664133 - DNA, 14 bp, Homo sapiens
attaagaaaggaag

SEQ ID NO: 664134 - DNA, 14 bp, Homo sapiens
attaagatacaaat

SEQ ID NO: 664135 - DNA, 16 bp, Homo sapiens
attaagatacaaatta

SEQ ID NO: 664136 - DNA, 17 bp, Homo sapiens
attaagatacaaattaa

SEQ ID NO: 664137 - DNA, 17 bp, Homo sapiens
attaagcaaatgttaaa

SEQ ID NO: 664138 - DNA, 20 bp, Homo sapiens
attaagcattttgaaacaaa

SEQ ID NO: 664139 - DNA, 17 bp, Homo sapiens
attaagggcattttacc

SEQ ID NO: 664140 - DNA, 20 bp, Homo sapiens
attaagtatctgggattatt

SEQ ID NO: 664141 - DNA, 17 bp, Homo sapiens
attaataatatttatgt

SEQ ID NO: 664142 - DNA, 19 bp, Homo sapiens
attacagtcttatttaacc

SEQ ID NO: 664143 - DNA, 22 bp, Homo sapiens
attacctggtgagtaacttaga

SEQ ID NO: 664144 - DNA, 24 bp, Homo sapiens
attacctggtgagtaacttagaaa

SEQ ID NO: 664145 - DNA, 12 bp, Homo sapiens
attactaatttt

SEQ ID NO: 664146 - DNA, 20 bp, Homo sapiens
attactaattttacacatta

SEQ ID NO: 664147 - DNA, 17 bp, Homo sapiens
attactggaattcttct

SEQ ID NO: 664148 - DNA, 23 bp, Homo sapiens
attactgggccttagtgggccag

SEQ ID NO: 664149 - DNA, 14 bp, Homo sapiens
attactttaacatt

SEQ ID NO: 664150 - DNA, 14 bp, Homo sapiens
attactttttatgg

SEQ ID NO: 664151 - DNA, 18 bp, Homo sapiens
atttcatcattgtttctg

SEQ ID NO: 664152 - DNA, 14 bp, Homo sapiens
atttcattcctaac

SEQ ID NO: 664153 - DNA, 13 bp, Homo sapiens
atttccattgctt

SEQ ID NO: 664154 - DNA, 19 bp, Homo sapiens
atttcccaacacaaagatt

SEQ ID NO: 664155 - DNA, 14 bp, Homo sapiens
atttctaaatttat

SEQ ID NO: 664156 - DNA, 23 bp, Homo sapiens
atttctaagaagttgtttgaggc

SEQ ID NO: 664157 - DNA, 21 bp, Homo sapiens
atttctataaatagatgctgt

SEQ ID NO: 664158 - DNA, 18 bp, Homo sapiens
atttctcttctacccttt

SEQ ID NO: 664159 - DNA, 20 bp, Homo sapiens
atttctgttaaaatatatga

SEQ ID NO: 664160 - DNA, 11 bp, Homo sapiens
atttcttccca

SEQ ID NO: 664161 - DNA, 20 bp, Homo sapiens
atttcttccctgctttgcat

SEQ ID NO: 664162 - DNA, 16 bp, Homo sapiens
atttcttcttctaaga

SEQ ID NO: 664163 - DNA, 19 bp, Homo sapiens
atttcttcttctaagaaga

SEQ ID NO: 664164 - DNA, 21 bp, Homo sapiens
atttcttcttctaagaagaca

SEQ ID NO: 664165 - DNA, 12 bp, Homo sapiens
atttcttgcttt

SEQ ID NO: 664166 - DNA, 16 bp, Homo sapiens
atttgaaatagtatac

SEQ ID NO: 664167 - DNA, 17 bp, Homo sapiens
atttgaaatagtataca

SEQ ID NO: 664168 - DNA, 19 bp, Homo sapiens
atttgaacaggtcaaagat

SEQ ID NO: 664169 - DNA, 13 bp, Homo sapiens
atttgaggtcaag

SEQ ID NO: 664170 - DNA, 22 bp, Homo sapiens
atttgaggtcaagtaagaagac

SEQ ID NO: 664171 - DNA, 17 bp, Homo sapiens
atttgatggactaatta

SEQ ID NO: 664172 - DNA, 21 bp, Homo sapiens
atttgattatgtatggatata

SEQ ID NO: 664173 - DNA, 18 bp, Homo sapiens
atttgattgggatgaatg

SEQ ID NO: 664174 - DNA, 20 bp, Homo sapiens
atttgcaatttgagccattt

SEQ ID NO: 664175 - DNA, 20 bp, Homo sapiens
atttgcatattttgagaaac

SEQ ID NO: 664176 - DNA, 18 bp, Homo sapiens
atttgctaatcaaagcca

SEQ ID NO: 664177 - DNA, 23 bp, Homo sapiens
atttgggaaggtttgtgttttct

SEQ ID NO: 664178 - DNA, 22 bp, Homo sapiens
atttggtatatactttgccact

SEQ ID NO: 664179 - DNA, 23 bp, Homo sapiens
atttggtcaagattttgaatgct

SEQ ID NO: 664180 - DNA, 16 bp, Homo sapiens
atttgtaaaacttctg

SEQ ID NO: 664181 - DNA, 19 bp, Homo sapiens
atttgtaaaacttctgctc

SEQ ID NO: 664182 - DNA, 19 bp, Homo sapiens
atttgtagcataactgtag

SEQ ID NO: 664183 - DNA, 14 bp, Homo sapiens
atttgtaggagaaa

SEQ ID NO: 664184 - DNA, 21 bp, Homo sapiens
atttgtgctttttaagaatat

SEQ ID NO: 664185 - DNA, 13 bp, Homo sapiens
atttgtgtttttc

SEQ ID NO: 664186 - DNA, 14 bp, Homo sapiens
atttgttatatata

SEQ ID NO: 664187 - DNA, 16 bp, Homo sapiens
atttgttatatataat

SEQ ID NO: 664188 - DNA, 23 bp, Homo sapiens
atttgttatatataataaatact

SEQ ID NO: 664189 - DNA, 20 bp, Homo sapiens
atttgtttctttctctgagg

SEQ ID NO: 664190 - DNA, 15 bp, Homo sapiens
attttaaaatatatg

SEQ ID NO: 664191 - DNA, 13 bp, Homo sapiens
attttaaaatgtc

SEQ ID NO: 664192 - DNA, 14 bp, Homo sapiens
attttaaatgaagg

SEQ ID NO: 664193 - DNA, 19 bp, Homo sapiens
attttaatgctgtttctaa

SEQ ID NO: 664194 - DNA, 17 bp, Homo sapiens
attttaatgtacttgaa

SEQ ID NO: 664195 - DNA, 22 bp, Homo sapiens
attttactccataaacagactg

SEQ ID NO: 664196 - DNA, 13 bp, Homo sapiens
attttagctcttc

SEQ ID NO: 664197 - DNA, 18 bp, Homo sapiens
attttaggaacttcagag

SEQ ID NO: 664198 - DNA, 16 bp, Homo sapiens
attttagtatgtgcag

SEQ ID NO: 664199 - DNA, 19 bp, Homo sapiens
attttagttcacacttagt

SEQ ID NO: 664200 - DNA, 16 bp, Homo sapiens
attttatatcatttta

SEQ ID NO: 664201 - DNA, 22 bp, Homo sapiens
attttatattactgacatttct

SEQ ID NO: 664202 - DNA, 12 bp, Homo sapiens
attttatcatta

SEQ ID NO: 664203 - DNA, 17 bp, Homo sapiens
attttatcattaaaaat

SEQ ID NO: 664204 - DNA, 18 bp, Homo sapiens
attttatgatcagtgttg

SEQ ID NO: 664205 - DNA, 15 bp, Homo sapiens
attttatggtggaaa

SEQ ID NO: 664206 - DNA, 21 bp, Homo sapiens
attttattttgtgctcattta

SEQ ID NO: 664207 - DNA, 23 bp, Homo sapiens
attttattttgtgctcatttaag

SEQ ID NO: 664208 - DNA, 15 bp, Homo sapiens
attttcagtgatctt

SEQ ID NO: 664209 - DNA, 19 bp, Homo sapiens
cacttgaagcctaaatttg

SEQ ID NO: 664210 - DNA, 20 bp, Homo sapiens
cacttgaagcctaaatttgt

SEQ ID NO: 664211 - DNA, 19 bp, Homo sapiens
cacttgtatatatggatca

SEQ ID NO: 664212 - DNA, 16 bp, Homo sapiens
cactttctaatgtttc

SEQ ID NO: 664213 - DNA, 17 bp, Homo sapiens
cactttctaatgtttct

SEQ ID NO: 664214 - DNA, 17 bp, Homo sapiens
cactttgtaatttttgc

SEQ ID NO: 664215 - DNA, 17 bp, Homo sapiens
cactttttttaaccatt

SEQ ID NO: 664216 - DNA, 17 bp, Homo sapiens
cagaaaacctaagcaaa

SEQ ID NO: 664217 - DNA, 15 bp, Homo sapiens
cagaaaacctgttca

SEQ ID NO: 664218 - DNA, 17 bp, Homo sapiens
cagaaaatatttaatat

SEQ ID NO: 664219 - DNA, 21 bp, Homo sapiens
cagaaaccacagtcttcccag

SEQ ID NO: 664220 - DNA, 22 bp, Homo sapiens
cagaaatgttgagtctgtacta

SEQ ID NO: 664221 - DNA, 16 bp, Homo sapiens
cagaacaaaacttcta

SEQ ID NO: 664222 - DNA, 23 bp, Homo sapiens
cagaacaggaggtgtgaatgcac

SEQ ID NO: 664223 - DNA, 12 bp, Homo sapiens
cagaacagggtc

SEQ ID NO: 664224 - DNA, 17 bp, Homo sapiens
cagaagacgggagggga

SEQ ID NO: 664225 - DNA, 19 bp, Homo sapiens
cagaagacgggaggggagg

SEQ ID NO: 664226 - DNA, 21 bp, Homo sapiens
cagaagacgggaggggaggca

SEQ ID NO: 664227 - DNA, 22 bp, Homo sapiens
cagaagaggggcagctttttca

SEQ ID NO: 664228 - DNA, 22 bp, Homo sapiens
cagaagcaagggggtgatgtag

SEQ ID NO: 664229 - DNA, 11 bp, Homo sapiens
cagaagggaat

SEQ ID NO: 664230 - DNA, 18 bp, Homo sapiens
cagaataaggcaggcatt

SEQ ID NO: 664231 - DNA, 19 bp, Homo sapiens
cagaatgtaagtgggccca

SEQ ID NO: 664232 - DNA, 13 bp, Homo sapiens
cagaattattttt

SEQ ID NO: 664233 - DNA, 21 bp, Homo sapiens
cagaattatttttaaaaagaa

SEQ ID NO: 664234 - DNA, 22 bp, Homo sapiens
cagaatttaccatcatctctga

SEQ ID NO: 664235 - DNA, 21 bp, Homo sapiens
cagaattttaggaacttcaga

SEQ ID NO: 664236 - DNA, 23 bp, Homo sapiens
cagaattttaggaacttcagaga

SEQ ID NO: 664237 - DNA, 13 bp, Homo sapiens
cagacaaaaacaa

SEQ ID NO: 664238 - DNA, 20 bp, Homo sapiens
cagacaagacagaggggagc

SEQ ID NO: 664239 - DNA, 14 bp, Homo sapiens
cagacaattagaaa

SEQ ID NO: 664240 - DNA, 21 bp, Homo sapiens
cagacacagctcttccagggc

SEQ ID NO: 664241 - DNA, 23 bp, Homo sapiens
cagacacagctcttccagggcag

SEQ ID NO: 664242 - DNA, 16 bp, Homo sapiens
cagacagcaggcagcg

SEQ ID NO: 664243 - DNA, 16 bp, Homo sapiens
cagaccagccctgcag

SEQ ID NO: 664244 - DNA, 19 bp, Homo sapiens
cagacccacgggctcatgc

SEQ ID NO: 664245 - DNA, 16 bp, Homo sapiens
cagaccccctcagcct

SEQ ID NO: 664246 - DNA, 11 bp, Homo sapiens
cagacctggct

SEQ ID NO: 664247 - DNA, 14 bp, Homo sapiens
cagactatttgcta

SEQ ID NO: 664248 - DNA, 22 bp, Homo sapiens
cagactgacccccatctgagct

SEQ ID NO: 664249 - DNA, 23 bp, Homo sapiens
cagactgacccccatctgagctg

SEQ ID NO: 664250 - DNA, 14 bp, Homo sapiens
cagactggggcatc

SEQ ID NO: 664251 - DNA, 16 bp, Homo sapiens
cagactggggcatcct

SEQ ID NO: 664252 - DNA, 16 bp, Homo sapiens
cagactgttaattata

SEQ ID NO: 664253 - DNA, 17 bp, Homo sapiens
cagacttgcccaggtca

SEQ ID NO: 664254 - DNA, 24 bp, Homo sapiens
cagagaacagcgaagtagcttgct

SEQ ID NO: 664255 - DNA, 21 bp, Homo sapiens
cagagatggtgtgttctgcaa

SEQ ID NO: 664256 - DNA, 21 bp, Homo sapiens
cagagatttctcattgacttt

SEQ ID NO: 664257 - DNA, 18 bp, Homo sapiens
cagagcagtctaaacaga

SEQ ID NO: 664258 - DNA, 21 bp, Homo sapiens
cagagcagtctaaacagagtc

SEQ ID NO: 664259 - DNA, 15 bp, Homo sapiens
cagagcctcctggga

SEQ ID NO: 664260 - DNA, 14 bp, Homo sapiens
cagaggccagaccc

SEQ ID NO: 664261 - DNA, 21 bp, Homo sapiens
cagaggccgcgcgtccagctg

SEQ ID NO: 664262 - DNA, 17 bp, Homo sapiens
cagaggctaattctgca

SEQ ID NO: 664263 - DNA, 16 bp, Homo sapiens
cagaggggagcagtgg

SEQ ID NO: 664264 - DNA, 12 bp, Homo sapiens
cagagtccggga

SEQ ID NO: 664265 - DNA, 20 bp, Homo sapiens
cagagtccgggagaatgctg

SEQ ID NO: 664266 - DNA, 15 bp, Homo sapiens
cagagtgaccagcac

SEQ ID NO: 664267 - DNA, 15 bp, Homo sapiens
cagagtgcttttctg

SEQ ID NO: 664268 - DNA, 18 bp, Homo sapiens
cagagtggcgtggcctcc

SEQ ID NO: 664269 - DNA, 19 bp, Homo sapiens
cagagtggcgtggcctccc

SEQ ID NO: 664270 - DNA, 17 bp, Homo sapiens
cagagttttcattaaat

SEQ ID NO: 664271 - DNA, 22 bp, Homo sapiens
cagataagcaagagagatgttt

SEQ ID NO: 664272 - DNA, 17 bp, Homo sapiens
cagatacatggttgtga

SEQ ID NO: 664273 - DNA, 19 bp, Homo sapiens
cagatcactgaatttataa

SEQ ID NO: 664274 - DNA, 23 bp, Homo sapiens
cagatcctgggtactgaaagcct

SEQ ID NO: 664275 - DNA, 14 bp, Homo sapiens
cagatctcctggca

SEQ ID NO: 664276 - DNA, 15 bp, Homo sapiens
cagatctttcagaaa

SEQ ID NO: 664277 - DNA, 17 bp, Homo sapiens
cagatctttcagaaata

SEQ ID NO: 664278 - DNA, 20 bp, Homo sapiens
cagatggtacggacttcctt

SEQ ID NO: 664279 - DNA, 12 bp, Homo sapiens
cagattgaaaag

SEQ ID NO: 664280 - DNA, 16 bp, Homo sapiens
cagatttcatacctca

SEQ ID NO: 664281 - DNA, 16 bp, Homo sapiens
cagatttttatttatg

SEQ ID NO: 664282 - DNA, 12 bp, Homo sapiens
cagcaaatatat

SEQ ID NO: 664283 - DNA, 20 bp, Homo sapiens
cagcaatctccatgtgtact

SEQ ID NO: 664284 - DNA, 15 bp, Homo sapiens
cagcacattcgggac

SEQ ID NO: 664285 - DNA, 15 bp, Homo sapiens
cagcaccgaggggcc

SEQ ID NO: 664286 - DNA, 17 bp, Homo sapiens
cagcaccgaggggcctt

SEQ ID NO: 664287 - DNA, 13 bp, Homo sapiens
cagcaccttgtgc

SEQ ID NO: 664288 - DNA, 16 bp, Homo sapiens
cagcaccttgtgcctg

SEQ ID NO: 664289 - DNA, 21 bp, Homo sapiens
atgctatggaacataaagttg

SEQ ID NO: 664290 - DNA, 14 bp, Homo sapiens
atgctcactttatt

SEQ ID NO: 664291 - DNA, 12 bp, Homo sapiens
atgctccccaca

SEQ ID NO: 664292 - DNA, 18 bp, Homo sapiens
atgctccttgagaggaga

SEQ ID NO: 664293 - DNA, 23 bp, Homo sapiens
atgctccttgagaggagaaatgc

SEQ ID NO: 664294 - DNA, 12 bp, Homo sapiens
atgctctgcagc

SEQ ID NO: 664295 - DNA, 17 bp, Homo sapiens
atgctctgcagcattga

SEQ ID NO: 664296 - DNA, 17 bp, Homo sapiens
atgctgagggtgtttct

SEQ ID NO: 664297 - DNA, 23 bp, Homo sapiens
atgctgagggtgtttcttcctgc

SEQ ID NO: 664298 - DNA, 12 bp, Homo sapiens
atgctgatcatc

SEQ ID NO: 664299 - DNA, 21 bp, Homo sapiens
atgctgatcttttaaaatcat

SEQ ID NO: 664300 - DNA, 11 bp, Homo sapiens
atgctgcctgg

SEQ ID NO: 664301 - DNA, 23 bp, Homo sapiens
atgctgcctggcacagaccaggc

SEQ ID NO: 664302 - DNA, 24 bp, Homo sapiens
atgctgtttctaagaaaatgtagt

SEQ ID NO: 664303 - DNA, 19 bp, Homo sapiens
atgcttcatcattccctct

SEQ ID NO: 664304 - DNA, 13 bp, Homo sapiens
atgcttcattatt

SEQ ID NO: 664305 - DNA, 22 bp, Homo sapiens
atgcttcctgacaatcaactct

SEQ ID NO: 664306 - DNA, 16 bp, Homo sapiens
atgcttctagagtttt

SEQ ID NO: 664307 - DNA, 15 bp, Homo sapiens
atgcttgacatacct

SEQ ID NO: 664308 - DNA, 17 bp, Homo sapiens
atgcttgacatacctac

SEQ ID NO: 664309 - DNA, 15 bp, Homo sapiens
atgcttgccatctgt

SEQ ID NO: 664310 - DNA, 12 bp, Homo sapiens
atgcttgtttat

SEQ ID NO: 664311 - DNA, 17 bp, Homo sapiens
atgcttgtttatgatat

SEQ ID NO: 664312 - DNA, 18 bp, Homo sapiens
atgcttttgcttgcaatg

SEQ ID NO: 664313 - DNA, 12 bp, Homo sapiens
atggaaaaggaa

SEQ ID NO: 664314 - DNA, 20 bp, Homo sapiens
atggaaaaggaagactagag

SEQ ID NO: 664315 - DNA, 13 bp, Homo sapiens
atggaaaatacca

SEQ ID NO: 664316 - DNA, 15 bp, Homo sapiens
atggaacaggctcag

SEQ ID NO: 664317 - DNA, 15 bp, Homo sapiens
atggaagttttccta

SEQ ID NO: 664318 - DNA, 14 bp, Homo sapiens
atggaatatatcag

SEQ ID NO: 664319 - DNA, 19 bp, Homo sapiens
atggaattttttgaatatg

SEQ ID NO: 664320 - DNA, 22 bp, Homo sapiens
atggacgtgtctgcacagggtc

SEQ ID NO: 664321 - DNA, 11 bp, Homo sapiens
atggagagaat

SEQ ID NO: 664322 - DNA, 21 bp, Homo sapiens
atggagttaacgggtgaataa

SEQ ID NO: 664323 - DNA, 14 bp, Homo sapiens
atggatatatttga

SEQ ID NO: 664324 - DNA, 15 bp, Homo sapiens
atggatatatttgaa

SEQ ID NO: 664325 - DNA, 18 bp, Homo sapiens
atggatatatttgaaata

SEQ ID NO: 664326 - DNA, 19 bp, Homo sapiens
atggatatatttgaaatag

SEQ ID NO: 664327 - DNA, 13 bp, Homo sapiens
atggatcagagga

SEQ ID NO: 664328 - DNA, 19 bp, Homo sapiens
atggatcagaggagtaaat

SEQ ID NO: 664329 - DNA, 20 bp, Homo sapiens
atggcaagttgcatcagaaa

SEQ ID NO: 664330 - DNA, 21 bp, Homo sapiens
atggcactgaccggtgctttt

SEQ ID NO: 664331 - DNA, 12 bp, Homo sapiens
atggcagaaggg

SEQ ID NO: 664332 - DNA, 13 bp, Homo sapiens
atggcagaaggga

SEQ ID NO: 664333 - DNA, 12 bp, Homo sapiens
atggcaggactc

SEQ ID NO: 664334 - DNA, 18 bp, Homo sapiens
atggcaggactcctggca

SEQ ID NO: 664335 - DNA, 20 bp, Homo sapiens
atggcaggactcctggcagg

SEQ ID NO: 664336 - DNA, 16 bp, Homo sapiens
atggcaggtgcctgta

SEQ ID NO: 664337 - DNA, 15 bp, Homo sapiens
atggcatcttcaata

SEQ ID NO: 664338 - DNA, 21 bp, Homo sapiens
atggccccgcaaggcctccag

SEQ ID NO: 664339 - DNA, 15 bp, Homo sapiens
atggcttatttctat

SEQ ID NO: 664340 - DNA, 18 bp, Homo sapiens
atgggagccaggcccaga

SEQ ID NO: 664341 - DNA, 16 bp, Homo sapiens
atgggcccctggcact

SEQ ID NO: 664342 - DNA, 21 bp, Homo sapiens
atggggaggcaagtgtggggg

SEQ ID NO: 664343 - DNA, 20 bp, Homo sapiens
atgggtgtatataattttat

SEQ ID NO: 664344 - DNA, 18 bp, Homo sapiens
atggtacatgtcttccat

SEQ ID NO: 664345 - DNA, 23 bp, Homo sapiens
atggtatcatatattaaaacaat

SEQ ID NO: 664346 - DNA, 19 bp, Homo sapiens
atggtcatatacatattgt

SEQ ID NO: 664347 - DNA, 15 bp, Homo sapiens
atggtcctgaatgta

SEQ ID NO: 664348 - DNA, 14 bp, Homo sapiens
atggtctcaatctc

SEQ ID NO: 664349 - DNA, 19 bp, Homo sapiens
atggtgaaaccccgtctct

SEQ ID NO: 664350 - DNA, 17 bp, Homo sapiens
atggtggccacagactg

SEQ ID NO: 664351 - DNA, 18 bp, Homo sapiens
atggtgtgaacccgggag

SEQ ID NO: 664352 - DNA, 21 bp, Homo sapiens
atggttacgttggttaaataa

SEQ ID NO: 664353 - DNA, 16 bp, Homo sapiens
atggtttgatatgtag

SEQ ID NO: 664354 - DNA, 14 bp, Homo sapiens
atggttttaaactt

SEQ ID NO: 664355 - DNA, 15 bp, Homo sapiens
atggttttaaacttt

SEQ ID NO: 664356 - DNA, 23 bp, Homo sapiens
atgtaaaagaacttactgattat

SEQ ID NO: 664357 - DNA, 22 bp, Homo sapiens
atgtaaagttatgtatttaaag

SEQ ID NO: 664358 - DNA, 23 bp, Homo sapiens
atgtaaagttatgtatttaaagt

SEQ ID NO: 664359 - DNA, 13 bp, Homo sapiens
atgtaaataaact

SEQ ID NO: 664360 - DNA, 12 bp, Homo sapiens
atgtaacactgg

SEQ ID NO: 664361 - DNA, 14 bp, Homo sapiens
atgtaactgctgaa

SEQ ID NO: 664362 - DNA, 17 bp, Homo sapiens
atgtaagaacacatttt

SEQ ID NO: 664363 - DNA, 19 bp, Homo sapiens
agctcaagtttaaaagcca

SEQ ID NO: 664364 - DNA, 22 bp, Homo sapiens
agctcaagtttaaaagccatgt

SEQ ID NO: 664365 - DNA, 19 bp, Homo sapiens
agctcactccccaaccccc

SEQ ID NO: 664366 - DNA, 19 bp, Homo sapiens
agctcagccccaactcttt

SEQ ID NO: 664367 - DNA, 12 bp, Homo sapiens
agctcagccctg

SEQ ID NO: 664368 - DNA, 13 bp, Homo sapiens
agctcagccctgg

SEQ ID NO: 664369 - DNA, 22 bp, Homo sapiens
agctcagccctggcctggctgg

SEQ ID NO: 664370 - DNA, 14 bp, Homo sapiens
agctcaggtgcctt

SEQ ID NO: 664371 - DNA, 16 bp, Homo sapiens
agctcaggtgcctttg

SEQ ID NO: 664372 - DNA, 16 bp, Homo sapiens
agctctgaaatcttcc

SEQ ID NO: 664373 - DNA, 11 bp, Homo sapiens
agctctgctgc

SEQ ID NO: 664374 - DNA, 14 bp, Homo sapiens
agctctgctgctga

SEQ ID NO: 664375 - DNA, 22 bp, Homo sapiens
agctctgttccatgcaactgga

SEQ ID NO: 664376 - DNA, 16 bp, Homo sapiens
agctcttccagggcag

SEQ ID NO: 664377 - DNA, 12 bp, Homo sapiens
agctcttccctt

SEQ ID NO: 664378 - DNA, 19 bp, Homo sapiens
agctcttcctatccctctc

SEQ ID NO: 664379 - DNA, 14 bp, Homo sapiens
agctctttccaaat

SEQ ID NO: 664380 - DNA, 20 bp, Homo sapiens
agctgaatgcctcctgtggg

SEQ ID NO: 664381 - DNA, 22 bp, Homo sapiens
agctgaatgcctcctgtgggga

SEQ ID NO: 664382 - DNA, 15 bp, Homo sapiens
agctgactgaatgca

SEQ ID NO: 664383 - DNA, 15 bp, Homo sapiens
agctgagaccggtgg

SEQ ID NO: 664384 - DNA, 17 bp, Homo sapiens
agctgagcctgcaggga

SEQ ID NO: 664385 - DNA, 19 bp, Homo sapiens
agctgagtgagtgggagag

SEQ ID NO: 664386 - DNA, 19 bp, Homo sapiens
agctgcagagatttctcat

SEQ ID NO: 664387 - DNA, 15 bp, Homo sapiens
agctgccctttctca

SEQ ID NO: 664388 - DNA, 18 bp, Homo sapiens
agctgcctcctgcgccct

SEQ ID NO: 664389 - DNA, 13 bp, Homo sapiens
agctgcctctgct

SEQ ID NO: 664390 - DNA, 17 bp, Homo sapiens
agctgcctctgctccct

SEQ ID NO: 664391 - DNA, 18 bp, Homo sapiens
agctgcctctgctccctc

SEQ ID NO: 664392 - DNA, 20 bp, Homo sapiens
agctgcctctgctccctctg

SEQ ID NO: 664393 - DNA, 18 bp, Homo sapiens
agctgctatccccatctc

SEQ ID NO: 664394 - DNA, 16 bp, Homo sapiens
agctgctccaggcctg

SEQ ID NO: 664395 - DNA, 19 bp, Homo sapiens
agctgctccaggcctgcag

SEQ ID NO: 664396 - DNA, 13 bp, Homo sapiens
agctggcccttgg

SEQ ID NO: 664397 - DNA, 21 bp, Homo sapiens
agctggcctgagaggggaagc

SEQ ID NO: 664398 - DNA, 19 bp, Homo sapiens
agctgggagcctggttcag

SEQ ID NO: 664399 - DNA, 17 bp, Homo sapiens
agctgtcaccaaggaaa

SEQ ID NO: 664400 - DNA, 15 bp, Homo sapiens
agctgtcctggaggt

SEQ ID NO: 664401 - DNA, 19 bp, Homo sapiens
agctgttatttcttccctg

SEQ ID NO: 664402 - DNA, 20 bp, Homo sapiens
agctgttatttcttccctgc

SEQ ID NO: 664403 - DNA, 16 bp, Homo sapiens
agctgtttgaaatgtt

SEQ ID NO: 664404 - DNA, 18 bp, Homo sapiens
agctgtttgaaatgttta

SEQ ID NO: 664405 - DNA, 20 bp, Homo sapiens
agctgtttttgacagccttc

SEQ ID NO: 664406 - DNA, 12 bp, Homo sapiens
agcttaaatttt

SEQ ID NO: 664407 - DNA, 16 bp, Homo sapiens
agcttcagttgcttgt

SEQ ID NO: 664408 - DNA, 20 bp, Homo sapiens
agcttccattttaattttaa

SEQ ID NO: 664409 - DNA, 19 bp, Homo sapiens
agcttctactcctgcctca

SEQ ID NO: 664410 - DNA, 22 bp, Homo sapiens
agcttctactcctgcctcatgc

SEQ ID NO: 664411 - DNA, 17 bp, Homo sapiens
agcttctcatgttaaat

SEQ ID NO: 664412 - DNA, 17 bp, Homo sapiens
agcttgctccctgtgtc

SEQ ID NO: 664413 - DNA, 17 bp, Homo sapiens
agcttggccctttcctt

SEQ ID NO: 664414 - DNA, 17 bp, Homo sapiens
agctttccaaggaagca

SEQ ID NO: 664415 - DNA, 20 bp, Homo sapiens
agctttcctgtttccagggt

SEQ ID NO: 664416 - DNA, 17 bp, Homo sapiens
agctttggtctgtgtgt

SEQ ID NO: 664417 - DNA, 20 bp, Homo sapiens
agcttttatttggtgtgttc

SEQ ID NO: 664418 - DNA, 22 bp, Homo sapiens
agcttttgtatagaaaattctt

SEQ ID NO: 664419 - DNA, 15 bp, Homo sapiens
aggaaaagaggccca

SEQ ID NO: 664420 - DNA, 13 bp, Homo sapiens
aggaaacatttta

SEQ ID NO: 664421 - DNA, 18 bp, Homo sapiens
aggaaacattttatcatt

SEQ ID NO: 664422 - DNA, 13 bp, Homo sapiens
aggaacctgtcct

SEQ ID NO: 664423 - DNA, 20 bp, Homo sapiens
aggaaccttccttcctgctt

SEQ ID NO: 664424 - DNA, 15 bp, Homo sapiens
aggaagagtcttggt

SEQ ID NO: 664425 - DNA, 23 bp, Homo sapiens
aggaagcactgaaaatagtgttc

SEQ ID NO: 664426 - DNA, 13 bp, Homo sapiens
aggaagcagaaga

SEQ ID NO: 664427 - DNA, 15 bp, Homo sapiens
aggaagcagaagacg

SEQ ID NO: 664428 - DNA, 18 bp, Homo sapiens
aggaagcagaagacggga

SEQ ID NO: 664429 - DNA, 22 bp, Homo sapiens
aggaagcagaagacgggagggg

SEQ ID NO: 664430 - DNA, 21 bp, Homo sapiens
aggaataaatgagagggaatc

SEQ ID NO: 664431 - DNA, 14 bp, Homo sapiens
aggacaaaaggaat

SEQ ID NO: 664432 - DNA, 16 bp, Homo sapiens
aggacaatactggggt

SEQ ID NO: 664433 - DNA, 21 bp, Homo sapiens
aggacatagcctgcaaagctg

SEQ ID NO: 664434 - DNA, 20 bp, Homo sapiens
aggaccagggccttttctgg

SEQ ID NO: 664435 - DNA, 18 bp, Homo sapiens
aggaccctgtcctgcagt

SEQ ID NO: 664436 - DNA, 22 bp, Homo sapiens
aggaccctgtcctgcagtccca

SEQ ID NO: 664437 - DNA, 13 bp, Homo sapiens
aggactagaagat

SEQ ID NO: 664438 - DNA, 14 bp, Homo sapiens
aggactcctggcag

SEQ ID NO: 664439 - DNA, 15 bp, Homo sapiens
aggagaaatgcaata

SEQ ID NO: 664440 - DNA, 20 bp, Homo sapiens
aggagaatggtgtgaacccg

SEQ ID NO: 664441 - DNA, 19 bp, Homo sapiens
aggagaggcaaagaaagga

SEQ ID NO: 664442 - DNA, 18 bp, Homo sapiens
aggagctagtaggaatgt

SEQ ID NO: 664443 - DNA, 20 bp, Homo sapiens
aggagctgtcaccaaggaaa

SEQ ID NO: 664444 - DNA, 21 bp, Homo sapiens
aggagctgtcaccaaggaaac

SEQ ID NO: 664445 - DNA, 16 bp, Homo sapiens
aggaggatcacttgag

SEQ ID NO: 664446 - DNA, 17 bp, Homo sapiens
aggaggatgtccctggg

SEQ ID NO: 664447 - DNA, 22 bp, Homo sapiens
aggaggcaggcatggccctggg

SEQ ID NO: 664448 - DNA, 16 bp, Homo sapiens
aggaggcctgtcccaa

SEQ ID NO: 664449 - DNA, 12 bp, Homo sapiens
aggagtattttt

SEQ ID NO: 664450 - DNA, 14 bp, Homo sapiens
aggagtggtgcaga

SEQ ID NO: 664451 - DNA, 18 bp, Homo sapiens
aggagttacagggaagtg

SEQ ID NO: 664452 - DNA, 13 bp, Homo sapiens
aggagttctgaag

SEQ ID NO: 664453 - DNA, 18 bp, Homo sapiens
aggatatactgcagcttt

SEQ ID NO: 664454 - DNA, 17 bp, Homo sapiens
aggatatccttatcaga

SEQ ID NO: 664455 - DNA, 19 bp, Homo sapiens
aggatcactttaggcctgg

SEQ ID NO: 664456 - DNA, 18 bp, Homo sapiens
aggatcatccctttggtt

SEQ ID NO: 664457 - DNA, 18 bp, Homo sapiens
aggatcccctccaagcct

SEQ ID NO: 664458 - DNA, 23 bp, Homo sapiens
aggatctctgagaccacagaggc

SEQ ID NO: 664459 - DNA, 14 bp, Homo sapiens
aggatctggagaac

SEQ ID NO: 664460 - DNA, 11 bp, Homo sapiens
aggatgacttt

SEQ ID NO: 664461 - DNA, 13 bp, Homo sapiens
aggatgacttttt

SEQ ID NO: 664462 - DNA, 20 bp, Homo sapiens
aggatgtccctgggccaggg

SEQ ID NO: 664463 - DNA, 13 bp, Homo sapiens
aggattattgata

SEQ ID NO: 664464 - DNA, 16 bp, Homo sapiens
aggcaaagaaaggaga

SEQ ID NO: 664465 - DNA, 21 bp, Homo sapiens
aggcaaagataatttatttca

SEQ ID NO: 664466 - DNA, 20 bp, Homo sapiens
aggcaaggaaagaaatacag

SEQ ID NO: 664467 - DNA, 16 bp, Homo sapiens
aggcaccgagaatgtt

SEQ ID NO: 664468 - DNA, 13 bp, Homo sapiens
aggcagacagcag

SEQ ID NO: 664469 - DNA, 22 bp, Homo sapiens
aggcagacagcaggcagcgcca

SEQ ID NO: 664470 - DNA, 21 bp, Homo sapiens
aggcagagtggcgtggcctcc

SEQ ID NO: 664471 - DNA, 22 bp, Homo sapiens
aggcagagtggcgtggcctccc

SEQ ID NO: 664472 - DNA, 16 bp, Homo sapiens
aggcagattgaaaagg

SEQ ID NO: 664473 - DNA, 17 bp, Homo sapiens
aggcagcgcagggctgg

SEQ ID NO: 664474 - DNA, 15 bp, Homo sapiens
aggcagctgcctctg

SEQ ID NO: 664475 - DNA, 17 bp, Homo sapiens
aggcagctgcctctgct

SEQ ID NO: 664476 - DNA, 20 bp, Homo sapiens
aggcagctgcctctgctccc

SEQ ID NO: 664477 - DNA, 23 bp, Homo sapiens
aggcagctgcctctgctccctct

SEQ ID NO: 664478 - DNA, 20 bp, Homo sapiens
aggcagcttctactcctgcc

SEQ ID NO: 664479 - DNA, 18 bp, Homo sapiens
aggcaggagaatggtgtg

SEQ ID NO: 664480 - DNA, 19 bp, Homo sapiens
aggcaggcatggccctggg

SEQ ID NO: 664481 - DNA, 13 bp, Homo sapiens
aggcaggcattga

SEQ ID NO: 664482 - DNA, 17 bp, Homo sapiens
aggcaggcggctcctcc

SEQ ID NO: 664483 - DNA, 18 bp, Homo sapiens
aggcaggcggctcctcct

SEQ ID NO: 664484 - DNA, 12 bp, Homo sapiens
aggcatggccct

SEQ ID NO: 664485 - DNA, 18 bp, Homo sapiens
acatcaagtccatctgac

SEQ ID NO: 664486 - DNA, 14 bp, Homo sapiens
acatcacagggtgg

SEQ ID NO: 664487 - DNA, 18 bp, Homo sapiens
acatcacagggtgggcct

SEQ ID NO: 664488 - DNA, 19 bp, Homo sapiens
acatcacagggtgggcctc

SEQ ID NO: 664489 - DNA, 15 bp, Homo sapiens
acatcaggaaagaga

SEQ ID NO: 664490 - DNA, 21 bp, Homo sapiens
acatccgcgtgtgcctgtgtg

SEQ ID NO: 664491 - DNA, 18 bp, Homo sapiens
acatctgacctggcatct

SEQ ID NO: 664492 - DNA, 20 bp, Homo sapiens
acatctggctgcacaggctg

SEQ ID NO: 664493 - DNA, 16 bp, Homo sapiens
acatcttgcattcaaa

SEQ ID NO: 664494 - DNA, 23 bp, Homo sapiens
acatgaaacctacacactgtcat

SEQ ID NO: 664495 - DNA, 21 bp, Homo sapiens
acatgaagcaattagtctgaa

SEQ ID NO: 664496 - DNA, 16 bp, Homo sapiens
acatgaccttaatgga

SEQ ID NO: 664497 - DNA, 15 bp, Homo sapiens
acatgcaataaaatt

SEQ ID NO: 664498 - DNA, 18 bp, Homo sapiens
acatgcaataaaatttaa

SEQ ID NO: 664499 - DNA, 15 bp, Homo sapiens
acatgccacctggca

SEQ ID NO: 664500 - DNA, 16 bp, Homo sapiens
acatgctgcctggcac

SEQ ID NO: 664501 - DNA, 23 bp, Homo sapiens
acatgctgcctggcacagaccag

SEQ ID NO: 664502 - DNA, 13 bp, Homo sapiens
acatgtactacag

SEQ ID NO: 664503 - DNA, 19 bp, Homo sapiens
acatgtcctaattcttctg

SEQ ID NO: 664504 - DNA, 20 bp, Homo sapiens
acatgtcctaattcttctgt

SEQ ID NO: 664505 - DNA, 14 bp, Homo sapiens
acatgtgatacatt

SEQ ID NO: 664506 - DNA, 18 bp, Homo sapiens
acatgtgtatattccttt

SEQ ID NO: 664507 - DNA, 20 bp, Homo sapiens
acatgtgtatattcctttta

SEQ ID NO: 664508 - DNA, 16 bp, Homo sapiens
acatgtttaactttaa

SEQ ID NO: 664509 - DNA, 14 bp, Homo sapiens
acattaaatcacag

SEQ ID NO: 664510 - DNA, 15 bp, Homo sapiens
acattaaatgcaata

SEQ ID NO: 664511 - DNA, 17 bp, Homo sapiens
acattaaatgcaataat

SEQ ID NO: 664512 - DNA, 19 bp, Homo sapiens
acattaaatgcaataattt

SEQ ID NO: 664513 - DNA, 16 bp, Homo sapiens
agcaatctccatgtgt

SEQ ID NO: 664514 - DNA, 23 bp, Homo sapiens
agcaatggtgtcagtatccaggc

SEQ ID NO: 664515 - DNA, 22 bp, Homo sapiens
agcaattctcctgcctcagcct

SEQ ID NO: 664516 - DNA, 19 bp, Homo sapiens
agcacattcgggaccaata

SEQ ID NO: 664517 - DNA, 21 bp, Homo sapiens
agcacattcgggaccaatata

SEQ ID NO: 664518 - DNA, 23 bp, Homo sapiens
agcaccagttatgtttgaatgaa

SEQ ID NO: 664519 - DNA, 23 bp, Homo sapiens
agcacctgtgcccatggcttctg

SEQ ID NO: 664520 - DNA, 15 bp, Homo sapiens
agcaccttgtgcctg

SEQ ID NO: 664521 - DNA, 18 bp, Homo sapiens
agcacgattttgcacaaa

SEQ ID NO: 664522 - DNA, 18 bp, Homo sapiens
agcactacaccttgcctt

SEQ ID NO: 664523 - DNA, 16 bp, Homo sapiens
agcactcctgcttaat

SEQ ID NO: 664524 - DNA, 18 bp, Homo sapiens
agcagaaaataaaggaag

SEQ ID NO: 664525 - DNA, 22 bp, Homo sapiens
agcagagcctcctgggaacaca

SEQ ID NO: 664526 - DNA, 12 bp, Homo sapiens
agcagaggaggg

SEQ ID NO: 664527 - DNA, 19 bp, Homo sapiens
agcagagttttcattaaat

SEQ ID NO: 664528 - DNA, 14 bp, Homo sapiens
agcagcccaccctg

SEQ ID NO: 664529 - DNA, 23 bp, Homo sapiens
agcagctctgctatgagtgtgtg

SEQ ID NO: 664530 - DNA, 13 bp, Homo sapiens
agcagcttctcca

SEQ ID NO: 664531 - DNA, 21 bp, Homo sapiens
agcaggagtggtgcagacaga

SEQ ID NO: 664532 - DNA, 12 bp, Homo sapiens
agcagggaaggc

SEQ ID NO: 664533 - DNA, 15 bp, Homo sapiens
agcagggaaggcctg

SEQ ID NO: 664534 - DNA, 17 bp, Homo sapiens
agcagggaaggcctgac

SEQ ID NO: 664535 - DNA, 14 bp, Homo sapiens
agcaggttctaggc

SEQ ID NO: 664536 - DNA, 15 bp, Homo sapiens
agcaggttctaggct

SEQ ID NO: 664537 - DNA, 14 bp, Homo sapiens
agcagtcgcctgcc

SEQ ID NO: 664538 - DNA, 13 bp, Homo sapiens
agcagtcttgctc

SEQ ID NO: 664539 - DNA, 21 bp, Homo sapiens
agcagtgagccaaatgtaaaa

SEQ ID NO: 664540 - DNA, 20 bp, Homo sapiens
agcagttatggtgatgactt

SEQ ID NO: 664541 - DNA, 16 bp, Homo sapiens
agcatatatacttgca

SEQ ID NO: 664542 - DNA, 23 bp, Homo sapiens
agcatatcccaccaacctccagt

SEQ ID NO: 664543 - DNA, 20 bp, Homo sapiens
agcatatgtgtaaagattta

SEQ ID NO: 664544 - DNA, 20 bp, Homo sapiens
agcatcttcacttctaaatg

SEQ ID NO: 664545 - DNA, 14 bp, Homo sapiens
agcatgaaaaagca

SEQ ID NO: 664546 - DNA, 16 bp, Homo sapiens
agcatgaaatgtgaat

SEQ ID NO: 664547 - DNA, 15 bp, Homo sapiens
agcatgaattggaac

SEQ ID NO: 664548 - DNA, 20 bp, Homo sapiens
agcatgcctgtcctttcagt

SEQ ID NO: 664549 - DNA, 19 bp, Homo sapiens
agcatgtaagtgttaagtt

SEQ ID NO: 664550 - DNA, 19 bp, Homo sapiens
agcatgtagactgtgccag

SEQ ID NO: 664551 - DNA, 22 bp, Homo sapiens
agcatgtcaattcataaaaaca

SEQ ID NO: 664552 - DNA, 13 bp, Homo sapiens
agcatgtggtctt

SEQ ID NO: 664553 - DNA, 15 bp, Homo sapiens
agcattctgcaacat

SEQ ID NO: 664554 - DNA, 16 bp, Homo sapiens
agcattctgcaacatt

SEQ ID NO: 664555 - DNA, 18 bp, Homo sapiens
agcattgataatcttcag

SEQ ID NO: 664556 - DNA, 16 bp, Homo sapiens
agcatttagctggcca

SEQ ID NO: 664557 - DNA, 23 bp, Homo sapiens
agcatttagcttgttccactgca

SEQ ID NO: 664558 - DNA, 13 bp, Homo sapiens
agcattttgtaat

SEQ ID NO: 664559 - DNA, 19 bp, Homo sapiens
agccaatctacaatctctt

SEQ ID NO: 664560 - DNA, 17 bp, Homo sapiens
agccacaggccctggct

SEQ ID NO: 664561 - DNA, 17 bp, Homo sapiens
agccacatattgagatg

SEQ ID NO: 664562 - DNA, 14 bp, Homo sapiens
agccaccctgggct

SEQ ID NO: 664563 - DNA, 22 bp, Homo sapiens
agccacctgggaacacagttct

SEQ ID NO: 664564 - DNA, 23 bp, Homo sapiens
agccagcccatggcccccaataa

SEQ ID NO: 664565 - DNA, 14 bp, Homo sapiens
agccaggagctgtc

SEQ ID NO: 664566 - DNA, 12 bp, Homo sapiens
agccagggcaag

SEQ ID NO: 664567 - DNA, 16 bp, Homo sapiens
agccagggcaagagag

SEQ ID NO: 664568 - DNA, 20 bp, Homo sapiens
agccagggggatgccactcc

SEQ ID NO: 664569 - DNA, 18 bp, Homo sapiens
agccagggtctctccctc

SEQ ID NO: 664570 - DNA, 22 bp, Homo sapiens
agccagggtctctccctcaggt

SEQ ID NO: 664571 - DNA, 22 bp, Homo sapiens
agccatcggtgaaactaacaga

SEQ ID NO: 664572 - DNA, 19 bp, Homo sapiens
agccatttaaagaccaata

SEQ ID NO: 664573 - DNA, 14 bp, Homo sapiens
agcccaaaatttga

SEQ ID NO: 664574 - DNA, 15 bp, Homo sapiens
agcccaaaatttgat

SEQ ID NO: 664575 - DNA, 17 bp, Homo sapiens
agcccaaactcctttct

SEQ ID NO: 664576 - DNA, 18 bp, Homo sapiens
agcccaaactcctttctt

SEQ ID NO: 664577 - DNA, 15 bp, Homo sapiens
agcccacctgctccc

SEQ ID NO: 664578 - DNA, 21 bp, Homo sapiens
agcccacctgctcccaggccc

SEQ ID NO: 664579 - DNA, 14 bp, Homo sapiens
agcccagagaacag

SEQ ID NO: 664580 - DNA, 19 bp, Homo sapiens
agcccagggcaccatccag

SEQ ID NO: 664581 - DNA, 20 bp, Homo sapiens
agcccagggcaccatccagc

SEQ ID NO: 664582 - DNA, 18 bp, Homo sapiens
agcccatccttccctttg

SEQ ID NO: 664583 - DNA, 13 bp, Homo sapiens
agcccatggcccc

SEQ ID NO: 664584 - DNA, 17 bp, Homo sapiens
agcccatggcccccaat

SEQ ID NO: 664585 - DNA, 20 bp, Homo sapiens
agcccatggcccccaataaa

SEQ ID NO: 664586 - DNA, 22 bp, Homo sapiens
agcccatggcccccaataaagg

SEQ ID NO: 664587 - DNA, 12 bp, Homo sapiens
agcccctcttcc

SEQ ID NO: 664588 - DNA, 17 bp, Homo sapiens
agcccctcttccccaat

SEQ ID NO: 664589 - DNA, 12 bp, Homo sapiens
agccctcccact

SEQ ID NO: 664590 - DNA, 17 bp, Homo sapiens
agccctggcctggctgg

SEQ ID NO: 664591 - DNA, 19 bp, Homo sapiens
agccgcctgaaagccacaa

SEQ ID NO: 664592 - DNA, 21 bp, Homo sapiens
agccgcctgaaagccacaatg

SEQ ID NO: 664593 - DNA, 12 bp, Homo sapiens
agccgcctgctt

SEQ ID NO: 664594 - DNA, 16 bp, Homo sapiens
agccggcttgatttcc

SEQ ID NO: 664595 - DNA, 22 bp, Homo sapiens
agccggtcagaggagcgcaggc

SEQ ID NO: 664596 - DNA, 21 bp, Homo sapiens
agcctaaatttgtgcttttta

SEQ ID NO: 664597 - DNA, 18 bp, Homo sapiens
agcctcaaaacaaaggcc

SEQ ID NO: 664598 - DNA, 16 bp, Homo sapiens
agcctcacttcctttg

SEQ ID NO: 664599 - DNA, 15 bp, Homo sapiens
agcctcgctttttca

SEQ ID NO: 664600 - DNA, 16 bp, Homo sapiens
agcctcgctttttcat

SEQ ID NO: 664601 - DNA, 17 bp, Homo sapiens
agcctcgctttttcatc

SEQ ID NO: 664602 - DNA, 17 bp, Homo sapiens
agcctgcaaagctggtt

SEQ ID NO: 664603 - DNA, 23 bp, Homo sapiens
agcctgcagggaagccccacatg

SEQ ID NO: 664604 - DNA, 20 bp, Homo sapiens
agcctggttcagacacagct

SEQ ID NO: 664605 - DNA, 14 bp, Homo sapiens
agccttagggaagc

SEQ ID NO: 664606 - DNA, 20 bp, Homo sapiens
agccttagggaagctggcct

SEQ ID NO: 664607 - DNA, 20 bp, Homo sapiens
agccttcaaaactatagctt

SEQ ID NO: 664608 - DNA, 13 bp, Homo sapiens
agccttttaaatc

SEQ ID NO: 664609 - DNA, 14 bp, Homo sapiens
agccttttgctctc

SEQ ID NO: 664610 - DNA, 17 bp, Homo sapiens
agcgaagtagcttgctc

SEQ ID NO: 664611 - DNA, 17 bp, Homo sapiens
agcgatctctcctggcc

SEQ ID NO: 664612 - DNA, 18 bp, Homo sapiens
agcgcagggctggcacgt

SEQ ID NO: 664613 - DNA, 20 bp, Homo sapiens
agcgccaagtgcgtgccgtg

SEQ ID NO: 664614 - DNA, 22 bp, Homo sapiens
agcggaggttgcagtgagctga

SEQ ID NO: 664615 - DNA, 13 bp, Homo sapiens
agcgtccctggcg

SEQ ID NO: 664616 - DNA, 17 bp, Homo sapiens
agcgtggggacttctgg

SEQ ID NO: 664617 - DNA, 13 bp, Homo sapiens
agcgtgtaagctt

SEQ ID NO: 664618 - DNA, 17 bp, Homo sapiens
agcgttaagggcagagt

SEQ ID NO: 664619 - DNA, 14 bp, Homo sapiens
agcgttaatgtaaa

SEQ ID NO: 664620 - DNA, 15 bp, Homo sapiens
agctaaagaggctga

SEQ ID NO: 664621 - DNA, 21 bp, Homo sapiens
agctaaagaggctgaaagagg

SEQ ID NO: 664622 - DNA, 11 bp, Homo sapiens
agctaaataaa

SEQ ID NO: 664623 - DNA, 13 bp, Homo sapiens
agctaaatgcttc

SEQ ID NO: 664624 - DNA, 18 bp, Homo sapiens
agctaataacatgtgaaa

SEQ ID NO: 664625 - DNA, 14 bp, Homo sapiens
agctacattttcag

SEQ ID NO: 664626 - DNA, 21 bp, Homo sapiens
agctacttgggaggctgaggc

SEQ ID NO: 664627 - DNA, 18 bp, Homo sapiens
agctagaaaaataaaatg

SEQ ID NO: 664628 - DNA, 15 bp, Homo sapiens
agctataattctgtt

SEQ ID NO: 664629 - DNA, 20 bp, Homo sapiens
agctatatttgattatgtat

SEQ ID NO: 664630 - DNA, 15 bp, Homo sapiens
agctatttatgggcc

SEQ ID NO: 664631 - DNA, 16 bp, Homo sapiens
agctatttatgggccc

SEQ ID NO: 664632 - DNA, 22 bp, Homo sapiens
agctatttatgggcccctggca

SEQ ID NO: 664633 - DNA, 13 bp, Homo sapiens
agctcaagtttaa

SEQ ID NO: 664634 - DNA, 12 bp, Homo sapiens
tttgctatgtaa

SEQ ID NO: 664635 - DNA, 22 bp, Homo sapiens
tttgctctctgtgaccctaaga

SEQ ID NO: 664636 - DNA, 21 bp, Homo sapiens
tttggatcatttttaactgat

SEQ ID NO: 664637 - DNA, 18 bp, Homo sapiens
tttggattctaaatacat

SEQ ID NO: 664638 - DNA, 19 bp, Homo sapiens
tttggattctaaatacatg

SEQ ID NO: 664639 - DNA, 23 bp, Homo sapiens
tttggcaaggaaaggggagaagg

SEQ ID NO: 664640 - DNA, 11 bp, Homo sapiens
tttgggcagag

SEQ ID NO: 664641 - DNA, 16 bp, Homo sapiens
tttggggtctttgtgg

SEQ ID NO: 664642 - DNA, 21 bp, Homo sapiens
tttgtaaatgaaacttaagaa

SEQ ID NO: 664643 - DNA, 24 bp, Homo sapiens
tttgtaaatgaaacttaagaattg

SEQ ID NO: 664644 - DNA, 23 bp, Homo sapiens
tttgtaaatgcatattaaataat

SEQ ID NO: 664645 - DNA, 20 bp, Homo sapiens
tttgtaagtgtaaaaaatgt

SEQ ID NO: 664646 - DNA, 16 bp, Homo sapiens
tttgtagaatctcttc

SEQ ID NO: 664647 - DNA, 10 bp, Homo sapiens
tttgtagcat

SEQ ID NO: 664648 - DNA, 17 bp, Homo sapiens
tttgtagcataactgta

SEQ ID NO: 664649 - DNA, 13 bp, Homo sapiens
tttgtattttcat

SEQ ID NO: 664650 - DNA, 14 bp, Homo sapiens
tttgtattttcatg

SEQ ID NO: 664651 - DNA, 15 bp, Homo sapiens
tttgtattttcatga

SEQ ID NO: 664652 - DNA, 14 bp, Homo sapiens
tttgtatttttagt

SEQ ID NO: 664653 - DNA, 16 bp, Homo sapiens
tttgtatttttagtag

SEQ ID NO: 664654 - DNA, 20 bp, Homo sapiens
tttgtatttttcatctttaa

SEQ ID NO: 664655 - DNA, 21 bp, Homo sapiens
tttgtcgtggttcttaaatgt

SEQ ID NO: 664656 - DNA, 16 bp, Homo sapiens
tttgtcttattcttaa

SEQ ID NO: 664657 - DNA, 17 bp, Homo sapiens
tttgtcttattcttaag

SEQ ID NO: 664658 - DNA, 21 bp, Homo sapiens
tttgtgcaaaagcttcaaatt

SEQ ID NO: 664659 - DNA, 17 bp, Homo sapiens
tttgtgcctttggcctg

SEQ ID NO: 664660 - DNA, 14 bp, Homo sapiens
tttgtgctcattta

SEQ ID NO: 664661 - DNA, 17 bp, Homo sapiens
tttgtggtaatctacac

SEQ ID NO: 664662 - DNA, 19 bp, Homo sapiens
tttgtggtaatctacacca

SEQ ID NO: 664663 - DNA, 22 bp, Homo sapiens
tttgttacataaggatgacttt

SEQ ID NO: 664664 - DNA, 16 bp, Homo sapiens
tttgttacttccttat

SEQ ID NO: 664665 - DNA, 17 bp, Homo sapiens
tttgttataccatttcc

SEQ ID NO: 664666 - DNA, 14 bp, Homo sapiens
tgcagcaggagtgg

SEQ ID NO: 664667 - DNA, 22 bp, Homo sapiens
tgcagcaggagtggtgcagaca

SEQ ID NO: 664668 - DNA, 10 bp, Homo sapiens
tgcagcaggc

SEQ ID NO: 664669 - DNA, 14 bp, Homo sapiens
tgcagcattgaagt

SEQ ID NO: 664670 - DNA, 17 bp, Homo sapiens
tgcagcggcgtgaggcc

SEQ ID NO: 664671 - DNA, 19 bp, Homo sapiens
tgcaggcaggcggctcctc

SEQ ID NO: 664672 - DNA, 23 bp, Homo sapiens
tgcaggcaggcggctcctcctca

SEQ ID NO: 664673 - DNA, 21 bp, Homo sapiens
tgcagggccagacctgcctgc

SEQ ID NO: 664674 - DNA, 18 bp, Homo sapiens
tgcagtactttgtgcatt

SEQ ID NO: 664675 - DNA, 23 bp, Homo sapiens
tgcagtcatttggtgctctgcta

SEQ ID NO: 664676 - DNA, 21 bp, Homo sapiens
tgcagtcccacactgtgcaga

SEQ ID NO: 664677 - DNA, 16 bp, Homo sapiens
tgcagtctcatttctc

SEQ ID NO: 664678 - DNA, 13 bp, Homo sapiens
tgcagtgagctga

SEQ ID NO: 664679 - DNA, 19 bp, Homo sapiens
tgcagtttaagagcagaac

SEQ ID NO: 664680 - DNA, 17 bp, Homo sapiens
tgcagtttttaaaaacc

SEQ ID NO: 664681 - DNA, 19 bp, Homo sapiens
tgcataataagctaaagag

SEQ ID NO: 664682 - DNA, 24 bp, Homo sapiens
tgcataataagctaaagaggctga

SEQ ID NO: 664683 - DNA, 14 bp, Homo sapiens
tgcataatttatgg

SEQ ID NO: 664684 - DNA, 20 bp, Homo sapiens
tgcatactttgtattttgat

SEQ ID NO: 664685 - DNA, 15 bp, Homo sapiens
tgcatatagttaaac

SEQ ID NO: 664686 - DNA, 16 bp, Homo sapiens
tgcatatcctgagcca

SEQ ID NO: 664687 - DNA, 17 bp, Homo sapiens
tgcatatcctgagccat

SEQ ID NO: 664688 - DNA, 17 bp, Homo sapiens
tgcatattaaataataa

SEQ ID NO: 664689 - DNA, 13 bp, Homo sapiens
tgcatcagaaagc

SEQ ID NO: 664690 - DNA, 12 bp, Homo sapiens
tgcatctcctcc

SEQ ID NO: 664691 - DNA, 13 bp, Homo sapiens
tgcatctcctccc

SEQ ID NO: 664692 - DNA, 19 bp, Homo sapiens
tgcatctcctcccgccctt

SEQ ID NO: 664693 - DNA, 15 bp, Homo sapiens
tgcatgcaaatgagc

SEQ ID NO: 664694 - DNA, 14 bp, Homo sapiens
tgcatggtggccag

SEQ ID NO: 664695 - DNA, 21 bp, Homo sapiens
tgcatgtagaggcttgtttac

SEQ ID NO: 664696 - DNA, 22 bp, Homo sapiens
tgcattgccgctgtataaagca

SEQ ID NO: 664697 - DNA, 19 bp, Homo sapiens
tgcatttttgtgaaatgaa

SEQ ID NO: 664698 - DNA, 22 bp, Homo sapiens
tgccaacagttgtatgtttgct

SEQ ID NO: 664699 - DNA, 16 bp, Homo sapiens
tgccaagaaaatgaag

SEQ ID NO: 664700 - DNA, 23 bp, Homo sapiens
tgccaagtcatagccataaatga

SEQ ID NO: 664701 - DNA, 14 bp, Homo sapiens
tgccaccatacctc

SEQ ID NO: 664702 - DNA, 12 bp, Homo sapiens
tgccacctggca

SEQ ID NO: 664703 - DNA, 15 bp, Homo sapiens
tgccactcctccctc

SEQ ID NO: 664704 - DNA, 16 bp, Homo sapiens
tgccactcctccctcc

SEQ ID NO: 664705 - DNA, 11 bp, Homo sapiens
tgccactgacc

SEQ ID NO: 664706 - DNA, 12 bp, Homo sapiens
tgccactgaccg

SEQ ID NO: 664707 - DNA, 14 bp, Homo sapiens
tgccagcaccacag

SEQ ID NO: 664708 - DNA, 19 bp, Homo sapiens
tgccagcaccacagccggt

SEQ ID NO: 664709 - DNA, 19 bp, Homo sapiens
tgccagccccctaaaagca

SEQ ID NO: 664710 - DNA, 22 bp, Homo sapiens
tgccagccccctaaaagcactc

SEQ ID NO: 664711 - DNA, 19 bp, Homo sapiens
tgccagccttgagccctgg

SEQ ID NO: 664712 - DNA, 21 bp, Homo sapiens
tgccaggaacctgtcctaagg

SEQ ID NO: 664713 - DNA, 16 bp, Homo sapiens
tgccaggctgcctcct

SEQ ID NO: 664714 - DNA, 20 bp, Homo sapiens
tgccaggctgcctcctgccc

SEQ ID NO: 664715 - DNA, 21 bp, Homo sapiens
tgccaggctgcctcctgccct

SEQ ID NO: 664716 - DNA, 16 bp, Homo sapiens
tgccagttttccctgg

SEQ ID NO: 664717 - DNA, 17 bp, Homo sapiens
tgccatattctggttct

SEQ ID NO: 664718 - DNA, 23 bp, Homo sapiens
tgccatattctggttcttgaaaa

SEQ ID NO: 664719 - DNA, 16 bp, Homo sapiens
tgccatgtgaagaggg

SEQ ID NO: 664720 - DNA, 22 bp, Homo sapiens
tgccattacagaggtattaaaa

SEQ ID NO: 664721 - DNA, 21 bp, Homo sapiens
tgcccaatgagactctagggt

SEQ ID NO: 664722 - DNA, 20 bp, Homo sapiens
tgcccacgagggtctcccct

SEQ ID NO: 664723 - DNA, 16 bp, Homo sapiens
tgcccactctgcaaga

SEQ ID NO: 664724 - DNA, 12 bp, Homo sapiens
tgccccatgtgt

SEQ ID NO: 664725 - DNA, 16 bp, Homo sapiens
tgccccctgggctggg

SEQ ID NO: 664726 - DNA, 13 bp, Homo sapiens
tgccccggagctg

SEQ ID NO: 664727 - DNA, 14 bp, Homo sapiens
tgcccctggctttg

SEQ ID NO: 664728 - DNA, 16 bp, Homo sapiens
tgcccctggctttgcc

SEQ ID NO: 664729 - DNA, 17 bp, Homo sapiens
tgcccctggctttgcct

SEQ ID NO: 664730 - DNA, 21 bp, Homo sapiens
tgcccctggctttgcctcttc

SEQ ID NO: 664731 - DNA, 16 bp, Homo sapiens
tgcccgactgactgga

SEQ ID NO: 664732 - DNA, 19 bp, Homo sapiens
tgcccgctccatggaaaag

SEQ ID NO: 664733 - DNA, 23 bp, Homo sapiens
tgcccggagcagcagcttctcca

SEQ ID NO: 664734 - DNA, 13 bp, Homo sapiens
tgccctaagggac

SEQ ID NO: 664735 - DNA, 15 bp, Homo sapiens
tgccctatgctgtgc

SEQ ID NO: 664736 - DNA, 19 bp, Homo sapiens
tgccctcattactgggcct

SEQ ID NO: 664737 - DNA, 23 bp, Homo sapiens
tgccctcattactgggccttagt

SEQ ID NO: 664738 - DNA, 12 bp, Homo sapiens
tgccctgtgtgt

SEQ ID NO: 664739 - DNA, 20 bp, Homo sapiens
tgccgtgtgagtgtgacagg

SEQ ID NO: 664740 - DNA, 23 bp, Homo sapiens
tgccgtgtgagtgtgacagggcc

SEQ ID NO: 664741 - DNA, 15 bp, Homo sapiens
tgcctcaccttccaa

SEQ ID NO: 664742 - DNA, 16 bp, Homo sapiens
tgcctccaggtgcaga

SEQ ID NO: 664743 - DNA, 17 bp, Homo sapiens
tgcctcccacttcactg

SEQ ID NO: 664744 - DNA, 23 bp, Homo sapiens
tgcctccgtcccctgcccatgct

SEQ ID NO: 664745 - DNA, 13 bp, Homo sapiens
tgcctctgcagtc

SEQ ID NO: 664746 - DNA, 21 bp, Homo sapiens
tgcctctgcagtctcatttct

SEQ ID NO: 664747 - DNA, 11 bp, Homo sapiens
tgcctctgctc

SEQ ID NO: 664748 - DNA, 15 bp, Homo sapiens
tgcctctgctccctc

SEQ ID NO: 664749 - DNA, 11 bp, Homo sapiens
tgcctcttctt

SEQ ID NO: 664750 - DNA, 11 bp, Homo sapiens
tgcctctttcc

SEQ ID NO: 664751 - DNA, 16 bp, Homo sapiens
tgcctgactaattttt

SEQ ID NO: 664752 - DNA, 18 bp, Homo sapiens
tgcctgaggggaaagaga

SEQ ID NO: 664753 - DNA, 23 bp, Homo sapiens
tgcctggaagagccgagcacctg

SEQ ID NO: 664754 - DNA, 11 bp, Homo sapiens
tgcctggcccc

SEQ ID NO: 664755 - DNA, 21 bp, Homo sapiens
tgcctgggccgtggcacagct

SEQ ID NO: 664756 - DNA, 23 bp, Homo sapiens
tgcctgggccgtggcacagctgg

SEQ ID NO: 664757 - DNA, 19 bp, Homo sapiens
tgcctggggtgttagtggc

SEQ ID NO: 664758 - DNA, 13 bp, Homo sapiens
tgcctgtaatcct

SEQ ID NO: 664759 - DNA, 23 bp, Homo sapiens
tgccttaatttagaaactgaaaa

SEQ ID NO: 664760 - DNA, 14 bp, Homo sapiens
tgccttcctcctta

SEQ ID NO: 664761 - DNA, 16 bp, Homo sapiens
tgccttgaaaaatgac

SEQ ID NO: 664762 - DNA, 13 bp, Homo sapiens
tgccttggagagg

SEQ ID NO: 664763 - DNA, 19 bp, Homo sapiens
tgccttggagagggcccag

SEQ ID NO: 664764 - DNA, 19 bp, Homo sapiens
tgcctttctttgcctctgc

SEQ ID NO: 664765 - DNA, 19 bp, Homo sapiens
tgcctttgcaccacgggac

SEQ ID NO: 664766 - DNA, 15 bp, Homo sapiens
tgccttttgcagaag

SEQ ID NO: 664767 - DNA, 17 bp, Homo sapiens
tgccttttgcagaagag

SEQ ID NO: 664768 - DNA, 20 bp, Homo sapiens
tgcgaagaccctcttgccca

SEQ ID NO: 664769 - DNA, 15 bp, Homo sapiens
tgcgaccctgggggc

SEQ ID NO: 664770 - DNA, 21 bp, Homo sapiens
tgcgaccctgggggcacagga

SEQ ID NO: 664771 - DNA, 21 bp, Homo sapiens
tgcgattctggataaagccac

SEQ ID NO: 664772 - DNA, 15 bp, Homo sapiens
tgcggatctctggag

SEQ ID NO: 664773 - DNA, 18 bp, Homo sapiens
tgcgtgccgtgtgagtgt

SEQ ID NO: 664774 - DNA, 17 bp, Homo sapiens
tgctaatcaaagccagg

SEQ ID NO: 664775 - DNA, 13 bp, Homo sapiens
tgctaatgtataa

SEQ ID NO: 664776 - DNA, 16 bp, Homo sapiens
tgctaatgtataatgt

SEQ ID NO: 664777 - DNA, 14 bp, Homo sapiens
tgctacaattttaa

SEQ ID NO: 664778 - DNA, 17 bp, Homo sapiens
tgctacctttcaaagct

SEQ ID NO: 664779 - DNA, 20 bp, Homo sapiens
tgctactgcactccagcctg

SEQ ID NO: 664780 - DNA, 21 bp, Homo sapiens
tgctactgcactccagcctgg

SEQ ID NO: 664781 - DNA, 13 bp, Homo sapiens
tgctactgttgta

SEQ ID NO: 664782 - DNA, 20 bp, Homo sapiens
tgctagcccttcaagtgcac

SEQ ID NO: 664783 - DNA, 22 bp, Homo sapiens
tgctatccccatctccctgcct

SEQ ID NO: 664784 - DNA, 20 bp, Homo sapiens
tgctatgaagccaactgaca

SEQ ID NO: 664785 - DNA, 20 bp, Homo sapiens
tgctatgcgggttgattatt

SEQ ID NO: 664786 - DNA, 19 bp, Homo sapiens
tgctcaccgcccatcaggg

SEQ ID NO: 664787 - DNA, 23 bp, Homo sapiens
tgctcaccgcccatcagggttct

SEQ ID NO: 664788 - DNA, 13 bp, Homo sapiens
tgagcctgcaggg

SEQ ID NO: 664789 - DNA, 15 bp, Homo sapiens
tgagcctgcagggaa

SEQ ID NO: 664790 - DNA, 21 bp, Homo sapiens
tgagctcttcctatccctctc

SEQ ID NO: 664791 - DNA, 20 bp, Homo sapiens
tgaggaggatgtccctgggc

SEQ ID NO: 664792 - DNA, 23 bp, Homo sapiens
tgaggaggatgtccctgggccag

SEQ ID NO: 664793 - DNA, 20 bp, Homo sapiens
tgaggatagtagttaaataa

SEQ ID NO: 664794 - DNA, 18 bp, Homo sapiens
tgaggcaaattaactgta

SEQ ID NO: 664795 - DNA, 14 bp, Homo sapiens
tgaggcaggagaat

SEQ ID NO: 664796 - DNA, 19 bp, Homo sapiens
tgaggcctgccccctgggc

SEQ ID NO: 664797 - DNA, 21 bp, Homo sapiens
tgaggcctgccccctgggctg

SEQ ID NO: 664798 - DNA, 13 bp, Homo sapiens
tgaggcttagaga

SEQ ID NO: 664799 - DNA, 22 bp, Homo sapiens
tgaggggtccctagcagcccac

SEQ ID NO: 664800 - DNA, 19 bp, Homo sapiens
tgagggtcttcttacatgc

SEQ ID NO: 664801 - DNA, 14 bp, Homo sapiens
tgagggtgtttctt

SEQ ID NO: 664802 - DNA, 18 bp, Homo sapiens
tgaggtcagggagtgctg

SEQ ID NO: 664803 - DNA, 14 bp, Homo sapiens
tgagtaaacataaa

SEQ ID NO: 664804 - DNA, 14 bp, Homo sapiens
tgagtaacttagaa

SEQ ID NO: 664805 - DNA, 21 bp, Homo sapiens
tgagtagatccatttccattg

SEQ ID NO: 664806 - DNA, 15 bp, Homo sapiens
tgagtattgtttaaa

SEQ ID NO: 664807 - DNA, 23 bp, Homo sapiens
tgagtattgtttaaaatgtaatt

SEQ ID NO: 664808 - DNA, 18 bp, Homo sapiens
tgagtccttgatttcaaa

SEQ ID NO: 664809 - DNA, 16 bp, Homo sapiens
tgagtgagtgggagag

SEQ ID NO: 664810 - DNA, 17 bp, Homo sapiens
tgagtgccttttgcaga

SEQ ID NO: 664811 - DNA, 15 bp, Homo sapiens
tgagtggtgtgactc

SEQ ID NO: 664812 - DNA, 14 bp, Homo sapiens
tgagtgtatgagta

SEQ ID NO: 664813 - DNA, 17 bp, Homo sapiens
tgagtgtgacagggcca

SEQ ID NO: 664814 - DNA, 16 bp, Homo sapiens
tgagtgtgcatggagg

SEQ ID NO: 664815 - DNA, 21 bp, Homo sapiens
tgataaaagcattgtttgtga

SEQ ID NO: 664816 - DNA, 11 bp, Homo sapiens
tgataaaataa

SEQ ID NO: 664817 - DNA, 14 bp, Homo sapiens
tgataaactgacga

SEQ ID NO: 664818 - DNA, 11 bp, Homo sapiens
tgataatcttc

SEQ ID NO: 664819 - DNA, 13 bp, Homo sapiens
tgataatcttcag

SEQ ID NO: 664820 - DNA, 23 bp, Homo sapiens
tgataatcttcaggtgaacactt

SEQ ID NO: 664821 - DNA, 14 bp, Homo sapiens
tgatacaacattaa

SEQ ID NO: 664822 - DNA, 18 bp, Homo sapiens
tgatacattttttaagct

SEQ ID NO: 664823 - DNA, 17 bp, Homo sapiens
tgatactgggtctgcga

SEQ ID NO: 664824 - DNA, 22 bp, Homo sapiens
tgatagaactttgatggatttt

SEQ ID NO: 664825 - DNA, 17 bp, Homo sapiens
tgatatctataaaatag

SEQ ID NO: 664826 - DNA, 17 bp, Homo sapiens
tgatatttttatacaag

SEQ ID NO: 664827 - DNA, 17 bp, Homo sapiens
tgatattttttatcata

SEQ ID NO: 664828 - DNA, 19 bp, Homo sapiens
tgatattttttatcataaa

SEQ ID NO: 664829 - DNA, 11 bp, Homo sapiens
tgatcagtgtt

SEQ ID NO: 664830 - DNA, 16 bp, Homo sapiens
tgatcatcgccagagg

SEQ ID NO: 664831 - DNA, 18 bp, Homo sapiens
tgatcatcgccagaggtg

SEQ ID NO: 664832 - DNA, 22 bp, Homo sapiens
tgatcatttaaaaagctcactg

SEQ ID NO: 664833 - DNA, 19 bp, Homo sapiens
tgatccgcctacctcagcc

SEQ ID NO: 664834 - DNA, 15 bp, Homo sapiens
tgatccggtttcttt

SEQ ID NO: 664835 - DNA, 15 bp, Homo sapiens
tgatctctcttgtcc

SEQ ID NO: 664836 - DNA, 16 bp, Homo sapiens
tgatctctcttgtcct

SEQ ID NO: 664837 - DNA, 18 bp, Homo sapiens
tgatctctcttgtcctct

SEQ ID NO: 664838 - DNA, 20 bp, Homo sapiens
tgatctcttctggtgttgac

SEQ ID NO: 664839 - DNA, 21 bp, Homo sapiens
tgatctcttctggtgttgact

SEQ ID NO: 664840 - DNA, 22 bp, Homo sapiens
tgatctcttctggtgttgactg

SEQ ID NO: 664841 - DNA, 23 bp, Homo sapiens
tgatgacttagcgtcaagacatt

SEQ ID NO: 664842 - DNA, 13 bp, Homo sapiens
tgatgatgttaaa

SEQ ID NO: 664843 - DNA, 14 bp, Homo sapiens
tgatgattttcctt

SEQ ID NO: 664844 - DNA, 16 bp, Homo sapiens
tgatgctttgagaaca

SEQ ID NO: 664845 - DNA, 21 bp, Homo sapiens
tgatgctttgagaacatactt

SEQ ID NO: 664846 - DNA, 24 bp, Homo sapiens
tgatggaaaataccagtgttgggt

SEQ ID NO: 664847 - DNA, 13 bp, Homo sapiens
tgatggcagagga

SEQ ID NO: 664848 - DNA, 18 bp, Homo sapiens
tgatgttttcctataata

SEQ ID NO: 664849 - DNA, 13 bp, Homo sapiens
tgatgttttttct

SEQ ID NO: 664850 - DNA, 17 bp, Homo sapiens
tgatgttttttctgtaa

SEQ ID NO: 664851 - DNA, 15 bp, Homo sapiens
tgattaaagatgagc

SEQ ID NO: 664852 - DNA, 22 bp, Homo sapiens
tgattaaagatgagctttgtct

SEQ ID NO: 664853 - DNA, 15 bp, Homo sapiens
tgattaagaaaggaa

SEQ ID NO: 664854 - DNA, 18 bp, Homo sapiens
tgattatagcaactaatg

SEQ ID NO: 664855 - DNA, 20 bp, Homo sapiens
tgattatagcaactaatgtt

SEQ ID NO: 664856 - DNA, 16 bp, Homo sapiens
tgattatttatgacct

SEQ ID NO: 664857 - DNA, 12 bp, Homo sapiens
tgattctcaggg

SEQ ID NO: 664858 - DNA, 16 bp, Homo sapiens
tgattggcatataatg

SEQ ID NO: 664859 - DNA, 21 bp, Homo sapiens
tgattgtcctttaaaaaagaa

SEQ ID NO: 664860 - DNA, 22 bp, Homo sapiens
tgattgtttcttcttcatgctt

SEQ ID NO: 664861 - DNA, 15 bp, Homo sapiens
tgatttagcaagcaa

SEQ ID NO: 664862 - DNA, 22 bp, Homo sapiens
tgatttagcaagcaactaattt

SEQ ID NO: 664863 - DNA, 23 bp, Homo sapiens
tgatttataaacagacaatatgt

SEQ ID NO: 664864 - DNA, 15 bp, Homo sapiens
tgatttccttcaatg

SEQ ID NO: 664865 - DNA, 20 bp, Homo sapiens
tgatttgtgaaacagttgct

SEQ ID NO: 664866 - DNA, 18 bp, Homo sapiens
tgattttatgatcagtgt

SEQ ID NO: 664867 - DNA, 17 bp, Homo sapiens
tgattttcatttcatga

SEQ ID NO: 664868 - DNA, 14 bp, Homo sapiens
tgatttttaagaaa

SEQ ID NO: 664869 - DNA, 22 bp, Homo sapiens
tgatttttaagaaagtaattta

SEQ ID NO: 664870 - DNA, 12 bp, Homo sapiens
tgcaaaatttag

SEQ ID NO: 664871 - DNA, 15 bp, Homo sapiens
tgcaaaatttagaag

SEQ ID NO: 664872 - DNA, 14 bp, Homo sapiens
tgcaaacagaacag

SEQ ID NO: 664873 - DNA, 21 bp, Homo sapiens
tgcaaatgagctctgaaatct

SEQ ID NO: 664874 - DNA, 12 bp, Homo sapiens
tgcaaattgtat

SEQ ID NO: 664875 - DNA, 16 bp, Homo sapiens
tgcaaccatttgaaac

SEQ ID NO: 664876 - DNA, 19 bp, Homo sapiens
tgcaacctcacctcccggg

SEQ ID NO: 664877 - DNA, 14 bp, Homo sapiens
tgcaacctctgcct

SEQ ID NO: 664878 - DNA, 19 bp, Homo sapiens
tgcaactggagttccttat

SEQ ID NO: 664879 - DNA, 20 bp, Homo sapiens
tgcaagaagaaatcatgata

SEQ ID NO: 664880 - DNA, 17 bp, Homo sapiens
tgcaagataattttcag

SEQ ID NO: 664881 - DNA, 13 bp, Homo sapiens
tgcaagcagagga

SEQ ID NO: 664882 - DNA, 16 bp, Homo sapiens
tgcaagcagaggacca

SEQ ID NO: 664883 - DNA, 17 bp, Homo sapiens
tgcaagcagaggaccag

SEQ ID NO: 664884 - DNA, 15 bp, Homo sapiens
tgcaataaaatttaa

SEQ ID NO: 664885 - DNA, 14 bp, Homo sapiens
tgcaataattttac

SEQ ID NO: 664886 - DNA, 14 bp, Homo sapiens
tgcaatccatttat

SEQ ID NO: 664887 - DNA, 15 bp, Homo sapiens
tgcaatccatttatt

SEQ ID NO: 664888 - DNA, 15 bp, Homo sapiens
tgcaatgaaagtcaa

SEQ ID NO: 664889 - DNA, 20 bp, Homo sapiens
tgcaatttgagccatttaaa

SEQ ID NO: 664890 - DNA, 19 bp, Homo sapiens
tgcacaacagccctgcctg

SEQ ID NO: 664891 - DNA, 20 bp, Homo sapiens
tgcacaacttttgagagtat

SEQ ID NO: 664892 - DNA, 16 bp, Homo sapiens
tgcacaccattttgta

SEQ ID NO: 664893 - DNA, 23 bp, Homo sapiens
tgcacaccattttgtaaatgaaa

SEQ ID NO: 664894 - DNA, 12 bp, Homo sapiens
tgcacagcgtgg

SEQ ID NO: 664895 - DNA, 20 bp, Homo sapiens
tgcacatacgggctttaata

SEQ ID NO: 664896 - DNA, 21 bp, Homo sapiens
tgcacccctgagccagcaggg

SEQ ID NO: 664897 - DNA, 22 bp, Homo sapiens
tgcaccttcactctccagggta

SEQ ID NO: 664898 - DNA, 15 bp, Homo sapiens
tgcactccagcctgg

SEQ ID NO: 664899 - DNA, 16 bp, Homo sapiens
tgcactccagcctggg

SEQ ID NO: 664900 - DNA, 20 bp, Homo sapiens
tgcactctgtaattgcactt

SEQ ID NO: 664901 - DNA, 16 bp, Homo sapiens
tgcactgaggtttttt

SEQ ID NO: 664902 - DNA, 23 bp, Homo sapiens
tgcacttatctcgaatttgaaga

SEQ ID NO: 664903 - DNA, 15 bp, Homo sapiens
tgcagaaaatattta

SEQ ID NO: 664904 - DNA, 12 bp, Homo sapiens
tgcagaatgtaa

SEQ ID NO: 664905 - DNA, 19 bp, Homo sapiens
tgcagacagaagtctcctc

SEQ ID NO: 664906 - DNA, 15 bp, Homo sapiens
tgcagaggtaccctg

SEQ ID NO: 664907 - DNA, 18 bp, Homo sapiens
tgcagagtgaccagcaca

SEQ ID NO: 664908 - DNA, 19 bp, Homo sapiens
tgcagatactttgaagtgc

SEQ ID NO: 664909 - DNA, 16 bp, Homo sapiens
tgcagattacactgat

SEQ ID NO: 664910 - DNA, 20 bp, Homo sapiens
tgcagcagaaaggctctgaa

SEQ ID NO: 664911 - DNA, 24 bp, Homo sapiens
tgaaattaagcattttgaaacaaa

SEQ ID NO: 664912 - DNA, 22 bp, Homo sapiens
tgaaattacgggtacctgaaga

SEQ ID NO: 664913 - DNA, 19 bp, Homo sapiens
tgaaattactttaacattt

SEQ ID NO: 664914 - DNA, 19 bp, Homo sapiens
tgaaattgactgatgattt

SEQ ID NO: 664915 - DNA, 17 bp, Homo sapiens
tgaaattgcatactttg

SEQ ID NO: 664916 - DNA, 18 bp, Homo sapiens
tgaacaaagctcaaagta

SEQ ID NO: 664917 - DNA, 23 bp, Homo sapiens
tgaacaagatgtgggccttgcaa

SEQ ID NO: 664918 - DNA, 14 bp, Homo sapiens
tgaacacttagtga

SEQ ID NO: 664919 - DNA, 22 bp, Homo sapiens
tgaaccataaattcaactttgt

SEQ ID NO: 664920 - DNA, 16 bp, Homo sapiens
tgaacgttattatatt

SEQ ID NO: 664921 - DNA, 13 bp, Homo sapiens
tgaactctggtgc

SEQ ID NO: 664922 - DNA, 19 bp, Homo sapiens
tgaactctggtgctcctgc

SEQ ID NO: 664923 - DNA, 20 bp, Homo sapiens
tgaactctggtgctcctgca

SEQ ID NO: 664924 - DNA, 21 bp, Homo sapiens
tgaactggcaattgtctattt

SEQ ID NO: 664925 - DNA, 22 bp, Homo sapiens
tgaacttggctttcctgtttct

SEQ ID NO: 664926 - DNA, 16 bp, Homo sapiens
tgaagaaagtcaaaaa

SEQ ID NO: 664927 - DNA, 13 bp, Homo sapiens
tgaagaacactgt

SEQ ID NO: 664928 - DNA, 11 bp, Homo sapiens
tgaagattctt

SEQ ID NO: 664929 - DNA, 19 bp, Homo sapiens
tgaagattcttaaaaattg

SEQ ID NO: 664930 - DNA, 22 bp, Homo sapiens
tgaagattcttaaaaattgaat

SEQ ID NO: 664931 - DNA, 13 bp, Homo sapiens
tgaagcagtcttg

SEQ ID NO: 664932 - DNA, 20 bp, Homo sapiens
tgaagcagtcttgctctgtt

SEQ ID NO: 664933 - DNA, 15 bp, Homo sapiens
tgaagccaactgaca

SEQ ID NO: 664934 - DNA, 16 bp, Homo sapiens
tgaagccaactgacaa

SEQ ID NO: 664935 - DNA, 16 bp, Homo sapiens
tgaagctgttgtgtga

SEQ ID NO: 664936 - DNA, 16 bp, Homo sapiens
tgaaggaaattcttat

SEQ ID NO: 664937 - DNA, 17 bp, Homo sapiens
tgaaggcttaattgact

SEQ ID NO: 664938 - DNA, 23 bp, Homo sapiens
tgaaggtctcctaaaactgggat

SEQ ID NO: 664939 - DNA, 17 bp, Homo sapiens
tgaagtaacttatttga

SEQ ID NO: 664940 - DNA, 23 bp, Homo sapiens
tgaagtcacccctttctgtccca

SEQ ID NO: 664941 - DNA, 19 bp, Homo sapiens
tgaagtctttaataaataa

SEQ ID NO: 664942 - DNA, 14 bp, Homo sapiens
tgaagtgcagctca

SEQ ID NO: 664943 - DNA, 21 bp, Homo sapiens
tgaagtgcgtgaatgtatgta

SEQ ID NO: 664944 - DNA, 19 bp, Homo sapiens
tgaagtttaattgtctcaa

SEQ ID NO: 664945 - DNA, 17 bp, Homo sapiens
tgaagttttactgtcta

SEQ ID NO: 664946 - DNA, 22 bp, Homo sapiens
tgaagtttttttgctgctgcct

SEQ ID NO: 664947 - DNA, 14 bp, Homo sapiens
tgaatataatccct

SEQ ID NO: 664948 - DNA, 14 bp, Homo sapiens
tgaatatgccttaa

SEQ ID NO: 664949 - DNA, 17 bp, Homo sapiens
tgaatatgccttaattt

SEQ ID NO: 664950 - DNA, 21 bp, Homo sapiens
tgaatatgccttaatttagaa

SEQ ID NO: 664951 - DNA, 22 bp, Homo sapiens
tgaatctataagtagtaaatca

SEQ ID NO: 664952 - DNA, 14 bp, Homo sapiens
tgaatctgctttaa

SEQ ID NO: 664953 - DNA, 20 bp, Homo sapiens
tgaatctgctttaattacct

SEQ ID NO: 664954 - DNA, 19 bp, Homo sapiens
tgaatgaaccctccttttc

SEQ ID NO: 664955 - DNA, 15 bp, Homo sapiens
tgaatgcacgtttca

SEQ ID NO: 664956 - DNA, 16 bp, Homo sapiens
tgaatgcctcctgtgg

SEQ ID NO: 664957 - DNA, 12 bp, Homo sapiens
tgaattgaaaaa

SEQ ID NO: 664958 - DNA, 16 bp, Homo sapiens
tgaattgaaaaacaat

SEQ ID NO: 664959 - DNA, 16 bp, Homo sapiens
tgaattggaaagactt

SEQ ID NO: 664960 - DNA, 19 bp, Homo sapiens
tgaattggaactgcaatga

SEQ ID NO: 664961 - DNA, 22 bp, Homo sapiens
tgaattggaactgcaatgaaag

SEQ ID NO: 664962 - DNA, 16 bp, Homo sapiens
tgaatttttattgttg

SEQ ID NO: 664963 - DNA, 22 bp, Homo sapiens
tgacaaaatggggcagaagaga

SEQ ID NO: 664964 - DNA, 14 bp, Homo sapiens
tgacaaagatgcat

SEQ ID NO: 664965 - DNA, 20 bp, Homo sapiens
tgacaaataaattaggacca

SEQ ID NO: 664966 - DNA, 19 bp, Homo sapiens
tgacaaccgagaaggttta

SEQ ID NO: 664967 - DNA, 15 bp, Homo sapiens
tgacaactgtgaagc

SEQ ID NO: 664968 - DNA, 18 bp, Homo sapiens
tgacaagccaatgtgaat

SEQ ID NO: 664969 - DNA, 18 bp, Homo sapiens
tgacaatcaactctaata

SEQ ID NO: 664970 - DNA, 15 bp, Homo sapiens
tgacaattgtgaaca

SEQ ID NO: 664971 - DNA, 19 bp, Homo sapiens
tgacacgcctaaggtcaca

SEQ ID NO: 664972 - DNA, 12 bp, Homo sapiens
tgacacgcttca

SEQ ID NO: 664973 - DNA, 13 bp, Homo sapiens
tgacagggccagt

SEQ ID NO: 664974 - DNA, 20 bp, Homo sapiens
tgacagggccagtggggcct

SEQ ID NO: 664975 - DNA, 23 bp, Homo sapiens
tgacagggccagtggggcctgtg

SEQ ID NO: 664976 - DNA, 11 bp, Homo sapiens
tgacagtcatc

SEQ ID NO: 664977 - DNA, 16 bp, Homo sapiens
tgacagtttttctgtt

SEQ ID NO: 664978 - DNA, 21 bp, Homo sapiens
tgacataggtcataaagcatt

SEQ ID NO: 664979 - DNA, 15 bp, Homo sapiens
tgacatgaagctgtt

SEQ ID NO: 664980 - DNA, 20 bp, Homo sapiens
tgacattaaatgcaataatt

SEQ ID NO: 664981 - DNA, 21 bp, Homo sapiens
tgacattaaatgcaataattt

SEQ ID NO: 664982 - DNA, 23 bp, Homo sapiens
tgaccacccctctcgcctcatta

SEQ ID NO: 664983 - DNA, 19 bp, Homo sapiens
tgaccataattttttttaa

SEQ ID NO: 664984 - DNA, 17 bp, Homo sapiens
tgaccattcaattagtg

SEQ ID NO: 664985 - DNA, 22 bp, Homo sapiens
tgaccattttttaatttacttg

SEQ ID NO: 664986 - DNA, 14 bp, Homo sapiens
tgacccctccttgt

SEQ ID NO: 664987 - DNA, 19 bp, Homo sapiens
tgacctcaggtgatccgcc

SEQ ID NO: 664988 - DNA, 17 bp, Homo sapiens
tgacctctgtcctccct

SEQ ID NO: 664989 - DNA, 19 bp, Homo sapiens
tgacctgaaataatatatt

SEQ ID NO: 664990 - DNA, 17 bp, Homo sapiens
tgacctggactgaagtt

SEQ ID NO: 664991 - DNA, 16 bp, Homo sapiens
tgacctgtttctctgc

SEQ ID NO: 664992 - DNA, 14 bp, Homo sapiens
tgaccttaaatgca

SEQ ID NO: 664993 - DNA, 14 bp, Homo sapiens
tgacggaagaacat

SEQ ID NO: 664994 - DNA, 18 bp, Homo sapiens
tgacggaagaacatagaa

SEQ ID NO: 664995 - DNA, 16 bp, Homo sapiens
tgactaaagagagaat

SEQ ID NO: 664996 - DNA, 18 bp, Homo sapiens
tgactcctcagtccctct

SEQ ID NO: 664997 - DNA, 13 bp, Homo sapiens
tgactgaatgcag

SEQ ID NO: 664998 - DNA, 15 bp, Homo sapiens
tgactgatgattttc

SEQ ID NO: 664999 - DNA, 18 bp, Homo sapiens
tgactgcccattcaccaa

SEQ ID NO: 665000 - DNA, 14 bp, Homo sapiens
tgactggaggaggc

SEQ ID NO: 665001 - DNA, 19 bp, Homo sapiens
tgactgtcacttgctgctt

SEQ ID NO: 665002 - DNA, 18 bp, Homo sapiens
tgacttaaaaaatcagaa

SEQ ID NO: 665003 - DNA, 23 bp, Homo sapiens
tgacttactttaattactggaat

SEQ ID NO: 665004 - DNA, 19 bp, Homo sapiens
tgacttagcgtcaagacat

SEQ ID NO: 665005 - DNA, 20 bp, Homo sapiens
tgacttagcgtcaagacatt

SEQ ID NO: 665006 - DNA, 23 bp, Homo sapiens
tgacttagcgtcaagacatttgc

SEQ ID NO: 665007 - DNA, 13 bp, Homo sapiens
tatataaatgtat

SEQ ID NO: 665008 - DNA, 15 bp, Homo sapiens
tatatataaatgtat

SEQ ID NO: 665009 - DNA, 17 bp, Homo sapiens
tatatataataaatact

SEQ ID NO: 665010 - DNA, 13 bp, Homo sapiens
tatatatatataa

SEQ ID NO: 665011 - DNA, 14 bp, Homo sapiens
tatatatatataac

SEQ ID NO: 665012 - DNA, 15 bp, Homo sapiens
tatatatatttctag

SEQ ID NO: 665013 - DNA, 16 bp, Homo sapiens
tatatattttgtgtga

SEQ ID NO: 665014 - DNA, 14 bp, Homo sapiens
tatatcacacaata

SEQ ID NO: 665015 - DNA, 17 bp, Homo sapiens
tatatcacacaatatag

SEQ ID NO: 665016 - DNA, 23 bp, Homo sapiens
tctggccttgccccaggccctgc

SEQ ID NO: 665017 - DNA, 16 bp, Homo sapiens
tctgggattattcttt

SEQ ID NO: 665018 - DNA, 18 bp, Homo sapiens
tctggggcaggctgggcc

SEQ ID NO: 665019 - DNA, 19 bp, Homo sapiens
tctggggcaggctgggcca

SEQ ID NO: 665020 - DNA, 20 bp, Homo sapiens
tctggggcaggctgggccat

SEQ ID NO: 665021 - DNA, 15 bp, Homo sapiens
tctggtactttctgt

SEQ ID NO: 665022 - DNA, 20 bp, Homo sapiens
tctggtcaagggctgtcatt

SEQ ID NO: 665023 - DNA, 22 bp, Homo sapiens
tctggtctaaattgtgttacta

SEQ ID NO: 665024 - DNA, 15 bp, Homo sapiens
tctggtgctcctgca

SEQ ID NO: 665025 - DNA, 15 bp, Homo sapiens
tctggttccctgctg

SEQ ID NO: 665026 - DNA, 17 bp, Homo sapiens
tctggttccctgctgcg

SEQ ID NO: 665027 - DNA, 20 bp, Homo sapiens
tctggttccctgctgcgctg

SEQ ID NO: 665028 - DNA, 13 bp, Homo sapiens
tctgtaatgtaaa

SEQ ID NO: 665029 - DNA, 17 bp, Homo sapiens
tctgtaatgtaaataaa

SEQ ID NO: 665030 - DNA, 13 bp, Homo sapiens
tctgtagctcctc

SEQ ID NO: 665031 - DNA, 14 bp, Homo sapiens
tctgtagctcctca

SEQ ID NO: 665032 - DNA, 12 bp, Homo sapiens
tctgtccctctc

SEQ ID NO: 665033 - DNA, 16 bp, Homo sapiens
gttcattttaaatgaa

SEQ ID NO: 665034 - DNA, 14 bp, Homo sapiens
gttccacagaggac

SEQ ID NO: 665035 - DNA, 21 bp, Homo sapiens
gttcccttgaaactttgggaa

SEQ ID NO: 665036 - DNA, 23 bp, Homo sapiens
gttcctagtgatggcttatgata

SEQ ID NO: 665037 - DNA, 13 bp, Homo sapiens
gttcctctgctca

SEQ ID NO: 665038 - DNA, 12 bp, Homo sapiens
gttcctctgggt

SEQ ID NO: 665039 - DNA, 18 bp, Homo sapiens
gttcctctgggtttctaa

SEQ ID NO: 665040 - DNA, 19 bp, Homo sapiens
gttcctctgggtttctaag

SEQ ID NO: 665041 - DNA, 19 bp, Homo sapiens
gttccttatccctctcttc

SEQ ID NO: 665042 - DNA, 14 bp, Homo sapiens
gttctcatgactcc

SEQ ID NO: 665043 - DNA, 21 bp, Homo sapiens
gttctgctccataccttttct

SEQ ID NO: 665044 - DNA, 11 bp, Homo sapiens
gttctgggcaa

SEQ ID NO: 665045 - DNA, 17 bp, Homo sapiens
gttctgtccccatctag

SEQ ID NO: 665046 - DNA, 22 bp, Homo sapiens
gttctttcatttgctttggaag

SEQ ID NO: 665047 - DNA, 14 bp, Homo sapiens
gttctttggattct

SEQ ID NO: 665048 - DNA, 15 bp, Homo sapiens
gttgaaaacttgtaa

SEQ ID NO: 665049 - DNA, 17 bp, Homo sapiens
gttgaaaatgcaactct

SEQ ID NO: 665050 - DNA, 18 bp, Homo sapiens
gttgattaagaaaggaag

SEQ ID NO: 665051 - DNA, 20 bp, Homo sapiens
gttgcatatagttaaactga

SEQ ID NO: 665052 - DNA, 21 bp, Homo sapiens
gttgcttctcaggctatatgc

SEQ ID NO: 665053 - DNA, 21 bp, Homo sapiens
gttggcaaacgagactttctc

SEQ ID NO: 665054 - DNA, 13 bp, Homo sapiens
gttggcacagaac

SEQ ID NO: 665055 - DNA, 15 bp, Homo sapiens
gttggcacagaacag

SEQ ID NO: 665056 - DNA, 14 bp, Homo sapiens
gttggtaaacagtt

SEQ ID NO: 665057 - DNA, 20 bp, Homo sapiens
gttggtctgccttctgctga

SEQ ID NO: 665058 - DNA, 18 bp, Homo sapiens
gttgtaaataatttattt

SEQ ID NO: 665059 - DNA, 16 bp, Homo sapiens
gttgtaagaattctga

SEQ ID NO: 665060 - DNA, 14 bp, Homo sapiens
gttgtaccaagtga

SEQ ID NO: 665061 - DNA, 15 bp, Homo sapiens
gttgtacttaaatgg

SEQ ID NO: 665062 - DNA, 22 bp, Homo sapiens
gttgtatatcactaaaagcatg

SEQ ID NO: 665063 - DNA, 23 bp, Homo sapiens
taaaggcagctgcctctgctccc

SEQ ID NO: 665064 - DNA, 24 bp, Homo sapiens
taaaggcagctgcctctgctccct

SEQ ID NO: 665065 - DNA, 22 bp, Homo sapiens
taaagggatatttttttctatt

SEQ ID NO: 665066 - DNA, 14 bp, Homo sapiens
taaaggtgtattta

SEQ ID NO: 665067 - DNA, 12 bp, Homo sapiens
taaagtacaaat

SEQ ID NO: 665068 - DNA, 13 bp, Homo sapiens
taaagtacaaatg

SEQ ID NO: 665069 - DNA, 15 bp, Homo sapiens
taaagtacaaatgaa

SEQ ID NO: 665070 - DNA, 22 bp, Homo sapiens
taaagtgcacacctttattcag

SEQ ID NO: 665071 - DNA, 13 bp, Homo sapiens
taaagttgtattg

SEQ ID NO: 665072 - DNA, 14 bp, Homo sapiens
taaagttttagggt

SEQ ID NO: 665073 - DNA, 13 bp, Homo sapiens
taaataaaaacaa

SEQ ID NO: 665074 - DNA, 17 bp, Homo sapiens
taaataaaaacaaagtt

SEQ ID NO: 665075 - DNA, 15 bp, Homo sapiens
taaataaaaatgcat

SEQ ID NO: 665076 - DNA, 17 bp, Homo sapiens
taaataaaattcatttc

SEQ ID NO: 665077 - DNA, 16 bp, Homo sapiens
taaataaatgggtgta

SEQ ID NO: 665078 - DNA, 18 bp, Homo sapiens
taaataatgcttcagata

SEQ ID NO: 665079 - DNA, 13 bp, Homo sapiens
taaataattggaa

SEQ ID NO: 665080 - DNA, 23 bp, Homo sapiens
taaatagtgtcatataaactcat

SEQ ID NO: 665081 - DNA, 17 bp, Homo sapiens
taaatatttatgtagat

SEQ ID NO: 665082 - DNA, 20 bp, Homo sapiens
taaatatttgtccttaaagg

SEQ ID NO: 665083 - DNA, 22 bp, Homo sapiens
taaatcagaaagtaacaatcta

SEQ ID NO: 665084 - DNA, 16 bp, Homo sapiens
taaatcagttctcaat

SEQ ID NO: 665085 - DNA, 14 bp, Homo sapiens
taaatccaataaaa

SEQ ID NO: 665086 - DNA, 17 bp, Homo sapiens
taaatcctgccatttaa

SEQ ID NO: 665087 - DNA, 13 bp, Homo sapiens
taaatctttcaaa

SEQ ID NO: 665088 - DNA, 21 bp, Homo sapiens
taaatgaaacttaagaattga

SEQ ID NO: 665089 - DNA, 14 bp, Homo sapiens
taaatgcaataatt

SEQ ID NO: 665090 - DNA, 10 bp, Homo sapiens
taaatgcata

SEQ ID NO: 665091 - DNA, 19 bp, Homo sapiens
taaatggcttcttctagaa

SEQ ID NO: 665092 - DNA, 18 bp, Homo sapiens
taaatggtaataagcact

SEQ ID NO: 665093 - DNA, 15 bp, Homo sapiens
taaatgtataaatat

SEQ ID NO: 665094 - DNA, 19 bp, Homo sapiens
taaatgtataaatatacag

SEQ ID NO: 665095 - DNA, 15 bp, Homo sapiens
taaatgtttatactg

SEQ ID NO: 665096 - DNA, 21 bp, Homo sapiens
taaatgtttcttttaaagacc

SEQ ID NO: 665097 - DNA, 19 bp, Homo sapiens
taaatgtttcttttgtttg

SEQ ID NO: 665098 - DNA, 17 bp, Homo sapiens
taaattatggcatttct

SEQ ID NO: 665099 - DNA, 15 bp, Homo sapiens
taaattcaactttgt

SEQ ID NO: 665100 - DNA, 18 bp, Homo sapiens
taaattcaactttgtaaa

SEQ ID NO: 665101 - DNA, 22 bp, Homo sapiens
taaattgtagggctttagcttt

SEQ ID NO: 665102 - DNA, 15 bp, Homo sapiens
taaattgtgtattta

SEQ ID NO: 665103 - DNA, 14 bp, Homo sapiens
taaatttaatcctt

SEQ ID NO: 665104 - DNA, 20 bp, Homo sapiens
taaatttatattcataaagt

SEQ ID NO: 665105 - DNA, 21 bp, Homo sapiens
taaatttcactactagattga

SEQ ID NO: 665106 - DNA, 16 bp, Homo sapiens
taaattttatatcatt

SEQ ID NO: 665107 - DNA, 18 bp, Homo sapiens
taaattttatatcatttt

SEQ ID NO: 665108 - DNA, 21 bp, Homo sapiens
taaattttatatcattttaaa

SEQ ID NO: 665109 - DNA, 21 bp, Homo sapiens
taacacatttttttgcatgca

SEQ ID NO: 665110 - DNA, 22 bp, Homo sapiens
taacacttcttacgcaatgctt

SEQ ID NO: 665111 - DNA, 19 bp, Homo sapiens
taacaggtgtgtatgtaaa

SEQ ID NO: 665112 - DNA, 21 bp, Homo sapiens
taacagtatgtgggatattga

SEQ ID NO: 665113 - DNA, 19 bp, Homo sapiens
taacagttttgtgtaactc

SEQ ID NO: 665114 - DNA, 20 bp, Homo sapiens
taacatacaagaaaatgtat

SEQ ID NO: 665115 - DNA, 20 bp, Homo sapiens
taacattgtgactttgcttt

SEQ ID NO: 665116 - DNA, 14 bp, Homo sapiens
taacattttggaaa

SEQ ID NO: 665117 - DNA, 18 bp, Homo sapiens
taacattttggaaattgt

SEQ ID NO: 665118 - DNA, 19 bp, Homo sapiens
taacattttggaaattgtt

SEQ ID NO: 665119 - DNA, 16 bp, Homo sapiens
taaccactaacattgt

SEQ ID NO: 665120 - DNA, 21 bp, Homo sapiens
taaccaggggtcctaaccact

SEQ ID NO: 665121 - DNA, 14 bp, Homo sapiens
taaccattattatg

SEQ ID NO: 665122 - DNA, 22 bp, Homo sapiens
taaccattattatgcaaaattt

SEQ ID NO: 665123 - DNA, 15 bp, Homo sapiens
taaccattggaatgg

SEQ ID NO: 665124 - DNA, 14 bp, Homo sapiens
taacccacctctcc

SEQ ID NO: 665125 - DNA, 16 bp, Homo sapiens
taacccacctctcctg

SEQ ID NO: 665126 - DNA, 19 bp, Homo sapiens
taacccccttaaatttaat

SEQ ID NO: 665127 - DNA, 20 bp, Homo sapiens
taaccgtcctcgagcaactg

SEQ ID NO: 665128 - DNA, 20 bp, Homo sapiens
taaccttaaaattgatatta

SEQ ID NO: 665129 - DNA, 18 bp, Homo sapiens
taactaaaataattttgt

SEQ ID NO: 665130 - DNA, 14 bp, Homo sapiens
taactaaaggggac

SEQ ID NO: 665131 - DNA, 22 bp, Homo sapiens
taactactatattgattgtcct

SEQ ID NO: 665132 - DNA, 20 bp, Homo sapiens
taactcaaatacacatttgc

SEQ ID NO: 665133 - DNA, 17 bp, Homo sapiens
taactgtgctgaatgct

SEQ ID NO: 665134 - DNA, 15 bp, Homo sapiens
taacttagaaaagtg

SEQ ID NO: 665135 - DNA, 15 bp, Homo sapiens
taacttatttagaga

SEQ ID NO: 665136 - DNA, 18 bp, Homo sapiens
taactttaaggatttgaa

SEQ ID NO: 665137 - DNA, 16 bp, Homo sapiens
taacttttaatttaaa

SEQ ID NO: 665138 - DNA, 19 bp, Homo sapiens
taagaaaccttgctctcct

SEQ ID NO: 665139 - DNA, 13 bp, Homo sapiens
taagaaaggaagc

SEQ ID NO: 665140 - DNA, 20 bp, Homo sapiens
taagaaaggaagcaacagat

SEQ ID NO: 665141 - DNA, 13 bp, Homo sapiens
taagaaaggaagt

SEQ ID NO: 665142 - DNA, 15 bp, Homo sapiens
taagaaatacagact

SEQ ID NO: 665143 - DNA, 12 bp, Homo sapiens
taagaactgtgg

SEQ ID NO: 665144 - DNA, 14 bp, Homo sapiens
taagaagacatgaa

SEQ ID NO: 665145 - DNA, 22 bp, Homo sapiens
taagaagacattttgttacata

SEQ ID NO: 665146 - DNA, 18 bp, Homo sapiens
taagaataccacatcaaa

SEQ ID NO: 665147 - DNA, 22 bp, Homo sapiens
taagaataccacatcaaataag

SEQ ID NO: 665148 - DNA, 23 bp, Homo sapiens
taagaatatttttagactatttc

SEQ ID NO: 665149 - DNA, 16 bp, Homo sapiens
taagaatgcttaaaaa

SEQ ID NO: 665150 - DNA, 19 bp, Homo sapiens
taagaattctgattgattt

SEQ ID NO: 665151 - DNA, 21 bp, Homo sapiens
taagacaagagatctacacat

SEQ ID NO: 665152 - DNA, 22 bp, Homo sapiens
taagacaagagatctacacatg

SEQ ID NO: 665153 - DNA, 23 bp, Homo sapiens
taagacaagagatctacacatgt

SEQ ID NO: 665154 - DNA, 17 bp, Homo sapiens
taagacatttgtttgct

SEQ ID NO: 665155 - DNA, 19 bp, Homo sapiens
taagacatttgtttgctgt

SEQ ID NO: 665156 - DNA, 17 bp, Homo sapiens
taagatatctcaatgaa

SEQ ID NO: 665157 - DNA, 17 bp, Homo sapiens
taagatctatgggaaga

SEQ ID NO: 665158 - DNA, 12 bp, Homo sapiens
taagatgtgaaa

SEQ ID NO: 665159 - DNA, 16 bp, Homo sapiens
taagatgtgaaaatta

SEQ ID NO: 665160 - DNA, 20 bp, Homo sapiens
tacatggaattttttgaata

SEQ ID NO: 665161 - DNA, 21 bp, Homo sapiens
tacatggaattttttgaatat

SEQ ID NO: 665162 - DNA, 18 bp, Homo sapiens
tacatgtgtatattcctt

SEQ ID NO: 665163 - DNA, 22 bp, Homo sapiens
tacattcgaaggaacctgtgtt

SEQ ID NO: 665164 - DNA, 12 bp, Homo sapiens
tacattgtcttg

SEQ ID NO: 665165 - DNA, 16 bp, Homo sapiens
tacatttaaaacatta

SEQ ID NO: 665166 - DNA, 21 bp, Homo sapiens
tacatttaaaattgctatgtt

SEQ ID NO: 665167 - DNA, 13 bp, Homo sapiens
tacatttatcatg

SEQ ID NO: 665168 - DNA, 14 bp, Homo sapiens
tacatttatttatc

SEQ ID NO: 665169 - DNA, 20 bp, Homo sapiens
tacatttatttatccagaaa

SEQ ID NO: 665170 - DNA, 14 bp, Homo sapiens
tacattttctaaat

SEQ ID NO: 665171 - DNA, 16 bp, Homo sapiens
tacattttctaaataa

SEQ ID NO: 665172 - DNA, 16 bp, Homo sapiens
taccaaaaaaaggaag

SEQ ID NO: 665173 - DNA, 18 bp, Homo sapiens
taccaaaccgccagcgaa

SEQ ID NO: 665174 - DNA, 22 bp, Homo sapiens
taccaaggtacaactgtattta

SEQ ID NO: 665175 - DNA, 16 bp, Homo sapiens
taccaagtgctgtctt

SEQ ID NO: 665176 - DNA, 17 bp, Homo sapiens
taccacatcaaataaga

SEQ ID NO: 665177 - DNA, 17 bp, Homo sapiens
taccagtgttgggtttt

SEQ ID NO: 665178 - DNA, 16 bp, Homo sapiens
taccatggtttgatat

SEQ ID NO: 665179 - DNA, 22 bp, Homo sapiens
taccattatggataaagatgag

SEQ ID NO: 665180 - DNA, 22 bp, Homo sapiens
taccattcagatcactgaattt

SEQ ID NO: 665181 - DNA, 20 bp, Homo sapiens
tacccaggctggagtgcagt

SEQ ID NO: 665182 - DNA, 20 bp, Homo sapiens
tacccatctagtacttgaaa

SEQ ID NO: 665183 - DNA, 22 bp, Homo sapiens
tacccgagaagcacttgagcat

SEQ ID NO: 665184 - DNA, 21 bp, Homo sapiens
taccctgggtgtccccgctgc

SEQ ID NO: 665185 - DNA, 15 bp, Homo sapiens
tacccttttcctttt

SEQ ID NO: 665186 - DNA, 15 bp, Homo sapiens
tacctactattggcc

SEQ ID NO: 665187 - DNA, 14 bp, Homo sapiens
tacctcaatttttg

SEQ ID NO: 665188 - DNA, 21 bp, Homo sapiens
tacctccctccccgtctcatt

SEQ ID NO: 665189 - DNA, 13 bp, Homo sapiens
tacctcctctcag

SEQ ID NO: 665190 - DNA, 15 bp, Homo sapiens
tacctcctctcagtg

SEQ ID NO: 665191 - DNA, 17 bp, Homo sapiens
tacctcctctcagtgtt

SEQ ID NO: 665192 - DNA, 19 bp, Homo sapiens
tacctcctctcagtgtttt

SEQ ID NO: 665193 - DNA, 21 bp, Homo sapiens
tacctctcaagctagtgtttc

SEQ ID NO: 665194 - DNA, 14 bp, Homo sapiens
tacctctctgtccc

SEQ ID NO: 665195 - DNA, 15 bp, Homo sapiens
tacctcttcacctga

SEQ ID NO: 665196 - DNA, 21 bp, Homo sapiens
tacctgacctaaattagataa

SEQ ID NO: 665197 - DNA, 17 bp, Homo sapiens
tacctgctggaagaatt

SEQ ID NO: 665198 - DNA, 19 bp, Homo sapiens
tacctggagcagaggaggg

SEQ ID NO: 665199 - DNA, 15 bp, Homo sapiens
tacctggcagacttg

SEQ ID NO: 665200 - DNA, 18 bp, Homo sapiens
tacctggtccccactgct

SEQ ID NO: 665201 - DNA, 20 bp, Homo sapiens
tacctggtgagtaacttaga

SEQ ID NO: 665202 - DNA, 17 bp, Homo sapiens
tacctgtccaagacagg

SEQ ID NO: 665203 - DNA, 12 bp, Homo sapiens
tacctgtgtgtt

SEQ ID NO: 665204 - DNA, 13 bp, Homo sapiens
tacctgtgtgttt

SEQ ID NO: 665205 - DNA, 12 bp, Homo sapiens
taccttatttat

SEQ ID NO: 665206 - DNA, 18 bp, Homo sapiens
taccttatttatttttgt

SEQ ID NO: 665207 - DNA, 17 bp, Homo sapiens
taccttgaaatgctgtt

SEQ ID NO: 665208 - DNA, 18 bp, Homo sapiens
taccttttctcttttctt

SEQ ID NO: 665209 - DNA, 14 bp, Homo sapiens
tactaagttcacat

SEQ ID NO: 665210 - DNA, 22 bp, Homo sapiens
tactaagttcacattagaatta

SEQ ID NO: 665211 - DNA, 14 bp, Homo sapiens
tactaataaatata

SEQ ID NO: 665212 - DNA, 13 bp, Homo sapiens
tactaatgatgtt

SEQ ID NO: 665213 - DNA, 15 bp, Homo sapiens
tactaatgatgtttt

SEQ ID NO: 665214 - DNA, 20 bp, Homo sapiens
tactacagctatatttgatt

SEQ ID NO: 665215 - DNA, 15 bp, Homo sapiens
tactactgaaacaga

SEQ ID NO: 665216 - DNA, 19 bp, Homo sapiens
tactatcctgtaaatatat

SEQ ID NO: 665217 - DNA, 12 bp, Homo sapiens
tactatttaaga

SEQ ID NO: 665218 - DNA, 15 bp, Homo sapiens
tactatttaagatgt

SEQ ID NO: 665219 - DNA, 18 bp, Homo sapiens
tactatttaagatgtgaa

SEQ ID NO: 665220 - DNA, 17 bp, Homo sapiens
tactattttgacagtta

SEQ ID NO: 665221 - DNA, 17 bp, Homo sapiens
tactcccccaccactca

SEQ ID NO: 665222 - DNA, 14 bp, Homo sapiens
tactcctagaagaa

SEQ ID NO: 665223 - DNA, 23 bp, Homo sapiens
tactctggggtgctgcctgaatc

SEQ ID NO: 665224 - DNA, 14 bp, Homo sapiens
tactctttgaaagc

SEQ ID NO: 665225 - DNA, 13 bp, Homo sapiens
tactgaaagcctt

SEQ ID NO: 665226 - DNA, 14 bp, Homo sapiens
tactgaactgaaag

SEQ ID NO: 665227 - DNA, 15 bp, Homo sapiens
tactgaataatatca

SEQ ID NO: 665228 - DNA, 19 bp, Homo sapiens
tactgaggtgctatgaagc

SEQ ID NO: 665229 - DNA, 20 bp, Homo sapiens
tactgcactccagcctgggg

SEQ ID NO: 665230 - DNA, 19 bp, Homo sapiens
tactgccttcctccttatc

SEQ ID NO: 665231 - DNA, 23 bp, Homo sapiens
tactgccttgaaaaatgacaatt

SEQ ID NO: 665232 - DNA, 14 bp, Homo sapiens
tactgcttgatttt

SEQ ID NO: 665233 - DNA, 19 bp, Homo sapiens
tactggaattcttctgcaa

SEQ ID NO: 665234 - DNA, 18 bp, Homo sapiens
tactgggccctgagtctg

SEQ ID NO: 665235 - DNA, 22 bp, Homo sapiens
tactgggccttagtgggccagg

SEQ ID NO: 665236 - DNA, 23 bp, Homo sapiens
tactgggccttagtgggccaggg

SEQ ID NO: 665237 - DNA, 15 bp, Homo sapiens
tactgtatttctaag

SEQ ID NO: 665238 - DNA, 16 bp, Homo sapiens
tactgtatttctaaga

SEQ ID NO: 665239 - DNA, 18 bp, Homo sapiens
tactgtctattaatattc

SEQ ID NO: 665240 - DNA, 21 bp, Homo sapiens
tactgtgtgcttgttttataa

SEQ ID NO: 665241 - DNA, 15 bp, Homo sapiens
tactgtgttcaatta

SEQ ID NO: 665242 - DNA, 13 bp, Homo sapiens
tactgttactggg

SEQ ID NO: 665243 - DNA, 23 bp, Homo sapiens
tacttaaaaatagtcttccacaa

SEQ ID NO: 665244 - DNA, 22 bp, Homo sapiens
tacttcaaaagtttgtttgctt

SEQ ID NO: 665245 - DNA, 20 bp, Homo sapiens
tacttgaataaccatctgaa

SEQ ID NO: 665246 - DNA, 16 bp, Homo sapiens
tacttgcaagataatt

SEQ ID NO: 665247 - DNA, 18 bp, Homo sapiens
tacttgggaggctgaggc

SEQ ID NO: 665248 - DNA, 21 bp, Homo sapiens
tacttggggacataatttcag

SEQ ID NO: 665249 - DNA, 22 bp, Homo sapiens
tacttggggacataatttcagt

SEQ ID NO: 665250 - DNA, 13 bp, Homo sapiens
tacttgttttgga

SEQ ID NO: 665251 - DNA, 22 bp, Homo sapiens
tactttaacattttggaaattg

SEQ ID NO: 665252 - DNA, 16 bp, Homo sapiens
tactttgccactgctg

SEQ ID NO: 665253 - DNA, 14 bp, Homo sapiens
tacttttaaaaaca

SEQ ID NO: 665254 - DNA, 18 bp, Homo sapiens
tacttttaaaaacataac

SEQ ID NO: 665255 - DNA, 12 bp, Homo sapiens
tagaaaaataaa

SEQ ID NO: 665256 - DNA, 16 bp, Homo sapiens
tagaaaaataaaatgt

SEQ ID NO: 665257 - DNA, 18 bp, Homo sapiens
tagaaaaataaaatgttt

SEQ ID NO: 665258 - DNA, 15 bp, Homo sapiens
tagaaaattcttgag

SEQ ID NO: 665259 - DNA, 13 bp, Homo sapiens
tagaaatgcatat

SEQ ID NO: 665260 - DNA, 16 bp, Homo sapiens
tagaactccaggccct

SEQ ID NO: 665261 - DNA, 20 bp, Homo sapiens
tagaactttattaagtaaaa

SEQ ID NO: 665262 - DNA, 21 bp, Homo sapiens
tagaagaaccaaatacctcaa

SEQ ID NO: 665263 - DNA, 22 bp, Homo sapiens
tagaagtctgtccaaatttaaa

SEQ ID NO: 665264 - DNA, 20 bp, Homo sapiens
tagaagtgagcaaaaaagag

SEQ ID NO: 665265 - DNA, 17 bp, Homo sapiens
ggcccccaataaaggca

SEQ ID NO: 665266 - DNA, 19 bp, Homo sapiens
ggcccccaataaaggcagc

SEQ ID NO: 665267 - DNA, 22 bp, Homo sapiens
ggcccccaataaaggcagctgc

SEQ ID NO: 665268 - DNA, 23 bp, Homo sapiens
ggcccccaataaaggcagctgcc

SEQ ID NO: 665269 - DNA, 14 bp, Homo sapiens
ggccctcctgtgct

SEQ ID NO: 665270 - DNA, 17 bp, Homo sapiens
ggccctgggggtctggg

SEQ ID NO: 665271 - DNA, 12 bp, Homo sapiens
ggccggccctgt

SEQ ID NO: 665272 - DNA, 22 bp, Homo sapiens
ggcctagcgatctctcctggcc

SEQ ID NO: 665273 - DNA, 16 bp, Homo sapiens
ggcctcagaccccctc

SEQ ID NO: 665274 - DNA, 13 bp, Homo sapiens
ggcctgagagaat

SEQ ID NO: 665275 - DNA, 18 bp, Homo sapiens
ggcctgcgaccctggggg

SEQ ID NO: 665276 - DNA, 14 bp, Homo sapiens
ggcctggggcctga

SEQ ID NO: 665277 - DNA, 18 bp, Homo sapiens
ggcctgtcccttgcctct

SEQ ID NO: 665278 - DNA, 21 bp, Homo sapiens
ggcctgtcccttgcctctgcc

SEQ ID NO: 665279 - DNA, 18 bp, Homo sapiens
ggcctgtggaatgagtgt

SEQ ID NO: 665280 - DNA, 21 bp, Homo sapiens
ggccttagtgggccagggctg

SEQ ID NO: 665281 - DNA, 22 bp, Homo sapiens
ggccttagtgggccagggctgc

SEQ ID NO: 665282 - DNA, 15 bp, Homo sapiens
ggccttgatcccctt

SEQ ID NO: 665283 - DNA, 12 bp, Homo sapiens
ggccttggaaat

SEQ ID NO: 665284 - DNA, 16 bp, Homo sapiens
ggccttttctggcacc

SEQ ID NO: 665285 - DNA, 17 bp, Homo sapiens
ggccttttctggcaccg

SEQ ID NO: 665286 - DNA, 16 bp, Homo sapiens
ggcctttttctgagat

SEQ ID NO: 665287 - DNA, 16 bp, Homo sapiens
ggcgcaggtgggctgg

SEQ ID NO: 665288 - DNA, 18 bp, Homo sapiens
ggcgcctttttggcctgt

SEQ ID NO: 665289 - DNA, 12 bp, Homo sapiens
ggcgtctccctc

SEQ ID NO: 665290 - DNA, 13 bp, Homo sapiens
ggcgtggcctccc

SEQ ID NO: 665291 - DNA, 21 bp, Homo sapiens
ggctaccagaagaggggcagc

SEQ ID NO: 665292 - DNA, 17 bp, Homo sapiens
ggctatttttgaagcaa

SEQ ID NO: 665293 - DNA, 16 bp, Homo sapiens
ggctcagattgtaata

SEQ ID NO: 665294 - DNA, 20 bp, Homo sapiens
ggctcccaggggtctccctg

SEQ ID NO: 665295 - DNA, 21 bp, Homo sapiens
ggctcccaggggtctccctgg

SEQ ID NO: 665296 - DNA, 17 bp, Homo sapiens
ggctcccgggggcccca

SEQ ID NO: 665297 - DNA, 16 bp, Homo sapiens
ggctcctcctcaccca

SEQ ID NO: 665298 - DNA, 18 bp, Homo sapiens
ggctcctcctcacccacc

SEQ ID NO: 665299 - DNA, 19 bp, Homo sapiens
ggctcctcctcacccacct

SEQ ID NO: 665300 - DNA, 22 bp, Homo sapiens
ggctcctcctcacccacctctg

SEQ ID NO: 665301 - DNA, 18 bp, Homo sapiens
ggctcgtcagccacctgg

SEQ ID NO: 665302 - DNA, 20 bp, Homo sapiens
ggctgaaagaggccaatgcc

SEQ ID NO: 665303 - DNA, 22 bp, Homo sapiens
ggctgaaatatccacccagcag

SEQ ID NO: 665304 - DNA, 13 bp, Homo sapiens
ggctgcaggcagg

SEQ ID NO: 665305 - DNA, 15 bp, Homo sapiens
ggctgcaggcaggcg

SEQ ID NO: 665306 - DNA, 15 bp, Homo sapiens
ggctgcccctctcac

SEQ ID NO: 665307 - DNA, 13 bp, Homo sapiens
ggctgccctgaga

SEQ ID NO: 665308 - DNA, 16 bp, Homo sapiens
ggctggaaagcagagc

SEQ ID NO: 665309 - DNA, 19 bp, Homo sapiens
ggctggaaagcagagcctc

SEQ ID NO: 665310 - DNA, 22 bp, Homo sapiens
ggctggaaagcagagcctcctg

SEQ ID NO: 665311 - DNA, 23 bp, Homo sapiens
ggctggaaagcagagcctcctgg

SEQ ID NO: 665312 - DNA, 16 bp, Homo sapiens
ggctggaaggggtcca

SEQ ID NO: 665313 - DNA, 16 bp, Homo sapiens
ggctggagcctggggt

SEQ ID NO: 665314 - DNA, 20 bp, Homo sapiens
ggctggagtgcagtggtgtg

SEQ ID NO: 665315 - DNA, 20 bp, Homo sapiens
ggctgggccatgtccaaaga

SEQ ID NO: 665316 - DNA, 16 bp, Homo sapiens
ggctggtccttattta

SEQ ID NO: 665317 - DNA, 21 bp, Homo sapiens
ggctgtccttaacccacctct

SEQ ID NO: 665318 - DNA, 17 bp, Homo sapiens
gtaagattgatatctat

SEQ ID NO: 665319 - DNA, 17 bp, Homo sapiens
gtaagcatctcaatctt

SEQ ID NO: 665320 - DNA, 23 bp, Homo sapiens
gtaagggtctttggtgtttttaa

SEQ ID NO: 665321 - DNA, 15 bp, Homo sapiens
gtaagtgaaattaag

SEQ ID NO: 665322 - DNA, 16 bp, Homo sapiens
gtaagtgggcccaccc

SEQ ID NO: 665323 - DNA, 17 bp, Homo sapiens
gtaagtgggcccacccg

SEQ ID NO: 665324 - DNA, 13 bp, Homo sapiens
gtaataagcactg

SEQ ID NO: 665325 - DNA, 21 bp, Homo sapiens
gtaataagcactgtaaacttc

SEQ ID NO: 665326 - DNA, 12 bp, Homo sapiens
gtaataataaag

SEQ ID NO: 665327 - DNA, 13 bp, Homo sapiens
gtaatcctaaatt

SEQ ID NO: 665328 - DNA, 11 bp, Homo sapiens
gtaatctacac

SEQ ID NO: 665329 - DNA, 18 bp, Homo sapiens
gtaatctacaccaatgaa

SEQ ID NO: 665330 - DNA, 15 bp, Homo sapiens
gtaatgcagttttta

SEQ ID NO: 665331 - DNA, 13 bp, Homo sapiens
gtaatggcagagc

SEQ ID NO: 665332 - DNA, 14 bp, Homo sapiens
gtaatgtaaataaa

SEQ ID NO: 665333 - DNA, 18 bp, Homo sapiens
gtaatgtaaataaactat

SEQ ID NO: 665334 - DNA, 18 bp, Homo sapiens
gtaatgtgtggtggcctc

SEQ ID NO: 665335 - DNA, 13 bp, Homo sapiens
gtaattcttttct

SEQ ID NO: 665336 - DNA, 14 bp, Homo sapiens
gtaattttgtgtaa

SEQ ID NO: 665337 - DNA, 16 bp, Homo sapiens
gtaattttgtgtaaga

SEQ ID NO: 665338 - DNA, 13 bp, Homo sapiens
gtaatttttgctc

SEQ ID NO: 665339 - DNA, 14 bp, Homo sapiens
gtacaaaattaagc

SEQ ID NO: 665340 - DNA, 20 bp, Homo sapiens
gtacaaacagtatttctggt

SEQ ID NO: 665341 - DNA, 17 bp, Homo sapiens
gtacaaccccctccacc

SEQ ID NO: 665342 - DNA, 20 bp, Homo sapiens
gtacaaccccctccaccccc

SEQ ID NO: 665343 - DNA, 13 bp, Homo sapiens
gtacaactgtatt

SEQ ID NO: 665344 - DNA, 18 bp, Homo sapiens
gtacaactgtatttatta

SEQ ID NO: 665345 - DNA, 18 bp, Homo sapiens
gtacaatgaagaagtttc

SEQ ID NO: 665346 - DNA, 13 bp, Homo sapiens
gtacaccctttcc

SEQ ID NO: 665347 - DNA, 23 bp, Homo sapiens
gtacagttgctgttgtgtgatca

SEQ ID NO: 665348 - DNA, 15 bp, Homo sapiens
gtacatctgcaatat

SEQ ID NO: 665349 - DNA, 17 bp, Homo sapiens
gtacatctttcatttcg

SEQ ID NO: 665350 - DNA, 15 bp, Homo sapiens
gtacatggaattttt

SEQ ID NO: 665351 - DNA, 15 bp, Homo sapiens
gtacatttaaaattg

SEQ ID NO: 665352 - DNA, 13 bp, Homo sapiens
gtaccctgggtgt

SEQ ID NO: 665353 - DNA, 18 bp, Homo sapiens
gtacctcctctcagtgtt

SEQ ID NO: 665354 - DNA, 16 bp, Homo sapiens
gtacctgctggaagaa

SEQ ID NO: 665355 - DNA, 15 bp, Homo sapiens
gtacctgtgtgtttc

SEQ ID NO: 665356 - DNA, 23 bp, Homo sapiens
gtaccttgcttcttactgataat

SEQ ID NO: 665357 - DNA, 19 bp, Homo sapiens
gtactccacatatttcagt

SEQ ID NO: 665358 - DNA, 22 bp, Homo sapiens
gtactgaaagccttagggaagc

SEQ ID NO: 665359 - DNA, 23 bp, Homo sapiens
gtactgaggtgctatgaagccaa

SEQ ID NO: 665360 - DNA, 19 bp, Homo sapiens
gtactgccccccatgagga

SEQ ID NO: 665361 - DNA, 19 bp, Homo sapiens
gtactgtctgttatgattt

SEQ ID NO: 665362 - DNA, 16 bp, Homo sapiens
gtcctcagggagcagg

SEQ ID NO: 665363 - DNA, 22 bp, Homo sapiens
gtcctcttctgctcttttcctg

SEQ ID NO: 665364 - DNA, 14 bp, Homo sapiens
gtcctgaatgtagc

SEQ ID NO: 665365 - DNA, 23 bp, Homo sapiens
gtccttaacccacctctcctgcc

SEQ ID NO: 665366 - DNA, 18 bp, Homo sapiens
gtccttatttatttaact

SEQ ID NO: 665367 - DNA, 16 bp, Homo sapiens
gtccttccctcaaaga

SEQ ID NO: 665368 - DNA, 15 bp, Homo sapiens
gtcctttcagtctga

SEQ ID NO: 665369 - DNA, 14 bp, Homo sapiens
gtcgcctgcctgca

SEQ ID NO: 665370 - DNA, 16 bp, Homo sapiens
gtcgtggttcttaaat

SEQ ID NO: 665371 - DNA, 20 bp, Homo sapiens
gtcgtggttcttaaatgttt

SEQ ID NO: 665372 - DNA, 16 bp, Homo sapiens
gtctaactcagaatta

SEQ ID NO: 665373 - DNA, 15 bp, Homo sapiens
gtctattttaaaata

SEQ ID NO: 665374 - DNA, 14 bp, Homo sapiens
gtctcccctcctgc

SEQ ID NO: 665375 - DNA, 15 bp, Homo sapiens
gtctcccctcctgca

SEQ ID NO: 665376 - DNA, 20 bp, Homo sapiens
gtctcccgattcccaactga

SEQ ID NO: 665377 - DNA, 20 bp, Homo sapiens
gtctcccgtgcatgctctgc

SEQ ID NO: 665378 - DNA, 14 bp, Homo sapiens
gtctccctggctcc

SEQ ID NO: 665379 - DNA, 12 bp, Homo sapiens
gtctgaaactgg

SEQ ID NO: 665380 - DNA, 13 bp, Homo sapiens
gtctgaatatttt

SEQ ID NO: 665381 - DNA, 13 bp, Homo sapiens
gtctgatttctta

SEQ ID NO: 665382 - DNA, 18 bp, Homo sapiens
gtctgccttcacaaatgt

SEQ ID NO: 665383 - DNA, 22 bp, Homo sapiens
gtctgccttcacaaatgtcatt

SEQ ID NO: 665384 - DNA, 16 bp, Homo sapiens
gtctgccttctgctga

SEQ ID NO: 665385 - DNA, 17 bp, Homo sapiens
gtctgccttctgctgaa

SEQ ID NO: 665386 - DNA, 22 bp, Homo sapiens
gtctgcgatgcagcggcgtgag

SEQ ID NO: 665387 - DNA, 12 bp, Homo sapiens
gtctgctgctgt

SEQ ID NO: 665388 - DNA, 14 bp, Homo sapiens
gtctggggacaggc

SEQ ID NO: 665389 - DNA, 17 bp, Homo sapiens
gtctgggtccatcctgg

SEQ ID NO: 665390 - DNA, 13 bp, Homo sapiens
gtctggtgttcca

SEQ ID NO: 665391 - DNA, 20 bp, Homo sapiens
gtctgtaggtgaaagaacaa

SEQ ID NO: 665392 - DNA, 20 bp, Homo sapiens
gtctgtatagtgtctgtatt

SEQ ID NO: 665393 - DNA, 15 bp, Homo sapiens
gtctgtgtcatttct

SEQ ID NO: 665394 - DNA, 15 bp, Homo sapiens
gtctgtgtgaatgtg

SEQ ID NO: 665395 - DNA, 21 bp, Homo sapiens
gtctgtgtgtgtgtgtgtgcg

SEQ ID NO: 665396 - DNA, 16 bp, Homo sapiens
gtctgttgattaaaga

SEQ ID NO: 665397 - DNA, 16 bp, Homo sapiens
gtcttaatttatttct

SEQ ID NO: 665398 - DNA, 21 bp, Homo sapiens
gtcttatagtgtttggacagc

SEQ ID NO: 665399 - DNA, 12 bp, Homo sapiens
gtcttattctta

SEQ ID NO: 665400 - DNA, 13 bp, Homo sapiens
gtcttattcttaa

SEQ ID NO: 665401 - DNA, 19 bp, Homo sapiens
gtcttctactgccttgaaa

SEQ ID NO: 665402 - DNA, 20 bp, Homo sapiens
gtcttctactgccttgaaaa

SEQ ID NO: 665403 - DNA, 21 bp, Homo sapiens
gtcttgatgttttttctgtaa

SEQ ID NO: 665404 - DNA, 13 bp, Homo sapiens
gtcttgttagaaa

SEQ ID NO: 665405 - DNA, 13 bp, Homo sapiens
gtctttcatggct

SEQ ID NO: 665406 - DNA, 23 bp, Homo sapiens
gtctttctcaaagaaatattaag

SEQ ID NO: 665407 - DNA, 12 bp, Homo sapiens
gtctttcttgaa

SEQ ID NO: 665408 - DNA, 16 bp, Homo sapiens
gtcttttggttatgaa

SEQ ID NO: 665409 - DNA, 15 bp, Homo sapiens
gtcttttttttcctg

SEQ ID NO: 665410 - DNA, 12 bp, Homo sapiens
gtgaaaatcttg

SEQ ID NO: 665411 - DNA, 11 bp, Homo sapiens
gtgaaattaag

SEQ ID NO: 665412 - DNA, 20 bp, Homo sapiens
gtgaaattgcatactttgta

SEQ ID NO: 665413 - DNA, 19 bp, Homo sapiens
gtgaataggttatatgcaa

SEQ ID NO: 665414 - DNA, 13 bp, Homo sapiens
gtgaatattttca

SEQ ID NO: 665415 - DNA, 16 bp, Homo sapiens
gtgaatttttattgtt

SEQ ID NO: 665416 - DNA, 19 bp, Homo sapiens
gtgaatttttattgttgta

SEQ ID NO: 665417 - DNA, 12 bp, Homo sapiens
gtgacagggcca

SEQ ID NO: 665418 - DNA, 18 bp, Homo sapiens
gtgacagtcatcatcagg

SEQ ID NO: 665419 - DNA, 21 bp, Homo sapiens
gtgacagtcatcatcagggcc

SEQ ID NO: 665420 - DNA, 22 bp, Homo sapiens
gtgacagtcatcatcagggcct

SEQ ID NO: 665421 - DNA, 14 bp, Homo sapiens
gtgacagtttccaa

SEQ ID NO: 665422 - DNA, 12 bp, Homo sapiens
gtgacatttctc

SEQ ID NO: 665423 - DNA, 16 bp, Homo sapiens
gtgacggccctcatct

SEQ ID NO: 665424 - DNA, 14 bp, Homo sapiens
gtgactccctggga

SEQ ID NO: 665425 - DNA, 16 bp, Homo sapiens
gtgactgtcacttgct

SEQ ID NO: 665426 - DNA, 19 bp, Homo sapiens
gtgacttaaaaaatcagaa

SEQ ID NO: 665427 - DNA, 23 bp, Homo sapiens
gtgagcatgtaagtgttaagttt

SEQ ID NO: 665428 - DNA, 21 bp, Homo sapiens
gtgaggagtctgggtccatcc

SEQ ID NO: 665429 - DNA, 13 bp, Homo sapiens
gtgagtgcctttt

SEQ ID NO: 665430 - DNA, 22 bp, Homo sapiens
gtgagtgggagagtacctgtgt

SEQ ID NO: 665431 - DNA, 16 bp, Homo sapiens
gtgagtgtgacagggc

SEQ ID NO: 665432 - DNA, 18 bp, Homo sapiens
gtgagtgtgacagggcca

SEQ ID NO: 665433 - DNA, 19 bp, Homo sapiens
gtgagtgtgacagggccag

SEQ ID NO: 665434 - DNA, 15 bp, Homo sapiens
gtgatacatttttta

SEQ ID NO: 665435 - DNA, 17 bp, Homo sapiens
gtgatcatttaaaaagc

SEQ ID NO: 665436 - DNA, 23 bp, Homo sapiens
gtgatggagtttctctagaagct

SEQ ID NO: 665437 - DNA, 14 bp, Homo sapiens
gtgatgtttgctct

SEQ ID NO: 665438 - DNA, 19 bp, Homo sapiens
gtgattagaggcagatctg

SEQ ID NO: 665439 - DNA, 21 bp, Homo sapiens
gtgattcctaagccacttgaa

SEQ ID NO: 665440 - DNA, 16 bp, Homo sapiens
gtgatttaatccagtt

SEQ ID NO: 665441 - DNA, 23 bp, Homo sapiens
gtgatttgaaaaatataaaatta

SEQ ID NO: 665442 - DNA, 19 bp, Homo sapiens
gtgcaacctcgctgagggc

SEQ ID NO: 665443 - DNA, 22 bp, Homo sapiens
gtgcaattgtaggggtgtgtgt

SEQ ID NO: 665444 - DNA, 12 bp, Homo sapiens
gtgcactacagt

SEQ ID NO: 665445 - DNA, 13 bp, Homo sapiens
gtgcagacccagt

SEQ ID NO: 665446 - DNA, 19 bp, Homo sapiens
aaccatttgaaacccctgt

SEQ ID NO: 665447 - DNA, 15 bp, Homo sapiens
aacccacctctcctg

SEQ ID NO: 665448 - DNA, 21 bp, Homo sapiens
aacccacctctcctgccctgt

SEQ ID NO: 665449 - DNA, 19 bp, Homo sapiens
aaccctgggctattgctgc

SEQ ID NO: 665450 - DNA, 17 bp, Homo sapiens
aacccttctctgttggt

SEQ ID NO: 665451 - DNA, 14 bp, Homo sapiens
aacctcattctggt

SEQ ID NO: 665452 - DNA, 15 bp, Homo sapiens
aacctgtcctaagga

SEQ ID NO: 665453 - DNA, 21 bp, Homo sapiens
aacctttgagtagatccattt

SEQ ID NO: 665454 - DNA, 17 bp, Homo sapiens
aacctttgctatgtaag

SEQ ID NO: 665455 - DNA, 15 bp, Homo sapiens
aacgcgtctgcctgg

SEQ ID NO: 665456 - DNA, 16 bp, Homo sapiens
aacgcgtctgcctggg

SEQ ID NO: 665457 - DNA, 19 bp, Homo sapiens
aacgcgtctgcctgggccg

SEQ ID NO: 665458 - DNA, 18 bp, Homo sapiens
aacgcttcgggaaaatat

SEQ ID NO: 665459 - DNA, 19 bp, Homo sapiens
aacggaggcctgcgaccct

SEQ ID NO: 665460 - DNA, 23 bp, Homo sapiens
aacggaggcctgcgaccctgggg

SEQ ID NO: 665461 - DNA, 19 bp, Homo sapiens
aacgtggcacacactgacc

SEQ ID NO: 665462 - DNA, 19 bp, Homo sapiens
aactaaaataattttgtaa

SEQ ID NO: 665463 - DNA, 14 bp, Homo sapiens
aactaatgtttgaa

SEQ ID NO: 665464 - DNA, 18 bp, Homo sapiens
aactaatgtttgaacaaa

SEQ ID NO: 665465 - DNA, 16 bp, Homo sapiens
aactacggttgggaga

SEQ ID NO: 665466 - DNA, 14 bp, Homo sapiens
aactagtgtacatt

SEQ ID NO: 665467 - DNA, 22 bp, Homo sapiens
aactatgttcctaacaaaatga

SEQ ID NO: 665468 - DNA, 14 bp, Homo sapiens
aactatttactttt

SEQ ID NO: 665469 - DNA, 17 bp, Homo sapiens
aactcacctaatgttta

SEQ ID NO: 665470 - DNA, 21 bp, Homo sapiens
aactcagaattatttttaaaa

SEQ ID NO: 665471 - DNA, 23 bp, Homo sapiens
aactcagagaaaaatgctcccca

SEQ ID NO: 665472 - DNA, 20 bp, Homo sapiens
aactcagtcctgtactctgg

SEQ ID NO: 665473 - DNA, 13 bp, Homo sapiens
aactccagagtca

SEQ ID NO: 665474 - DNA, 22 bp, Homo sapiens
aactcccccattttacagattt

SEQ ID NO: 665475 - DNA, 13 bp, Homo sapiens
aactcctggcctt

SEQ ID NO: 665476 - DNA, 14 bp, Homo sapiens
aactcctggccttt

SEQ ID NO: 665477 - DNA, 12 bp, Homo sapiens
aactcctgtccc

SEQ ID NO: 665478 - DNA, 20 bp, Homo sapiens
aactcctgtcccttttccct

SEQ ID NO: 665479 - DNA, 21 bp, Homo sapiens
ttttgtgcaaaagcttcaaat

SEQ ID NO: 665480 - DNA, 15 bp, Homo sapiens
ttttgtgtgaaattg

SEQ ID NO: 665481 - DNA, 18 bp, Homo sapiens
ttttgtttggcaaggaaa

SEQ ID NO: 665482 - DNA, 12 bp, Homo sapiens
tttttaaaattt

SEQ ID NO: 665483 - DNA, 16 bp, Homo sapiens
tttttaactgattctt

SEQ ID NO: 665484 - DNA, 13 bp, Homo sapiens
tttttaagaaagt

SEQ ID NO: 665485 - DNA, 15 bp, Homo sapiens
tttttaagaaagtaa

SEQ ID NO: 665486 - DNA, 14 bp, Homo sapiens
tttttacaagatgt

SEQ ID NO: 665487 - DNA, 13 bp, Homo sapiens
tttttactgccct

SEQ ID NO: 665488 - DNA, 16 bp, Homo sapiens
tttttagactatttct

SEQ ID NO: 665489 - DNA, 17 bp, Homo sapiens
tttttcaagttgtaaat

SEQ ID NO: 665490 - DNA, 15 bp, Homo sapiens
tttttctcagtccta

SEQ ID NO: 665491 - DNA, 12 bp, Homo sapiens
tttttctgcgct

SEQ ID NO: 665492 - DNA, 15 bp, Homo sapiens
tttttgaatatgcct

SEQ ID NO: 665493 - DNA, 19 bp, Homo sapiens
tttttgcaactaggtattt

SEQ ID NO: 665494 - DNA, 18 bp, Homo sapiens
tttttgccagttttccct

SEQ ID NO: 665495 - DNA, 23 bp, Homo sapiens
tttttgctgctgcctctttccct

SEQ ID NO: 665496 - DNA, 15 bp, Homo sapiens
tttttggaagtgaaa

SEQ ID NO: 665497 - DNA, 19 bp, Homo sapiens
tttttggaagtgaaaactt

SEQ ID NO: 665498 - DNA, 12 bp, Homo sapiens
tttttggacttc

SEQ ID NO: 665499 - DNA, 14 bp, Homo sapiens
ttttttatgttcct

SEQ ID NO: 665500 - DNA, 11 bp, Homo sapiens
ttttttattat

SEQ ID NO: 665501 - DNA, 11 bp, Homo sapiens
ttttttcctct

SEQ ID NO: 665502 - DNA, 12 bp, Homo sapiens
ttttttcctctt

SEQ ID NO: 665503 - DNA, 20 bp, Homo sapiens
catatgagaatataccttat

SEQ ID NO: 665504 - DNA, 22 bp, Homo sapiens
catatgggtgggattttgcaaa

SEQ ID NO: 665505 - DNA, 19 bp, Homo sapiens
catatgtgtaaagatttat

SEQ ID NO: 665506 - DNA, 12 bp, Homo sapiens
catattcaatgt

SEQ ID NO: 665507 - DNA, 12 bp, Homo sapiens
catatttatcca

SEQ ID NO: 665508 - DNA, 21 bp, Homo sapiens
catatttgatttctaattgta

SEQ ID NO: 665509 - DNA, 16 bp, Homo sapiens
catattttaaacagag

SEQ ID NO: 665510 - DNA, 17 bp, Homo sapiens
catattttaaacagagg

SEQ ID NO: 665511 - DNA, 13 bp, Homo sapiens
catattttttgta

SEQ ID NO: 665512 - DNA, 18 bp, Homo sapiens
catcacagggtgggcctc

SEQ ID NO: 665513 - DNA, 19 bp, Homo sapiens
catcacagggtgggcctcg

SEQ ID NO: 665514 - DNA, 15 bp, Homo sapiens
catcaggaaagagag

SEQ ID NO: 665515 - DNA, 11 bp, Homo sapiens
catcagggcct

SEQ ID NO: 665516 - DNA, 12 bp, Homo sapiens
catcagggcctg

SEQ ID NO: 665517 - DNA, 15 bp, Homo sapiens
catcagggcctgggg

SEQ ID NO: 665518 - DNA, 21 bp, Homo sapiens
catcagggcctggggcctgag

SEQ ID NO: 665519 - DNA, 13 bp, Homo sapiens
catcatcagggcc

SEQ ID NO: 665520 - DNA, 15 bp, Homo sapiens
catcatcagggcctg

SEQ ID NO: 665521 - DNA, 20 bp, Homo sapiens
catcatcctcccgccaggag

SEQ ID NO: 665522 - DNA, 23 bp, Homo sapiens
catcatcctcccgccaggagctt

SEQ ID NO: 665523 - DNA, 16 bp, Homo sapiens
catcattccctctcat

SEQ ID NO: 665524 - DNA, 22 bp, Homo sapiens
catccagctccccagcccacct

SEQ ID NO: 665525 - DNA, 20 bp, Homo sapiens
catcccaaccaggcacctct

SEQ ID NO: 665526 - DNA, 23 bp, Homo sapiens
catccctgagacagggagggaag

SEQ ID NO: 665527 - DNA, 23 bp, Homo sapiens
cattcagaaatgttgagtctgta

SEQ ID NO: 665528 - DNA, 16 bp, Homo sapiens
cattcagatcactgaa

SEQ ID NO: 665529 - DNA, 21 bp, Homo sapiens
cattcagatcactgaatttat

SEQ ID NO: 665530 - DNA, 19 bp, Homo sapiens
cattcataaaccttgtcta

SEQ ID NO: 665531 - DNA, 18 bp, Homo sapiens
cattccactgttggtatt

SEQ ID NO: 665532 - DNA, 16 bp, Homo sapiens
cattccgttgtctgtg

SEQ ID NO: 665533 - DNA, 20 bp, Homo sapiens
cattcctaacacagcatgtg

SEQ ID NO: 665534 - DNA, 23 bp, Homo sapiens
cattcctaacacagcatgtgtat

SEQ ID NO: 665535 - DNA, 20 bp, Homo sapiens
cattcgaaggaacctgtgtt

SEQ ID NO: 665536 - DNA, 22 bp, Homo sapiens
cattcgctactatgatttaatt

SEQ ID NO: 665537 - DNA, 21 bp, Homo sapiens
cattctggttccctgctgcgc

SEQ ID NO: 665538 - DNA, 22 bp, Homo sapiens
cattctggttccctgctgcgct

SEQ ID NO: 665539 - DNA, 22 bp, Homo sapiens
cattgaaagcttcaaagtttat

SEQ ID NO: 665540 - DNA, 20 bp, Homo sapiens
cattgaagtatggtgtgttc

SEQ ID NO: 665541 - DNA, 17 bp, Homo sapiens
cattgaggaagagtctt

SEQ ID NO: 665542 - DNA, 14 bp, Homo sapiens
cattgagtattgtt

SEQ ID NO: 665543 - DNA, 15 bp, Homo sapiens
cattgagtattgttt

SEQ ID NO: 665544 - DNA, 18 bp, Homo sapiens
cattgagtattgtttaaa

SEQ ID NO: 665545 - DNA, 14 bp, Homo sapiens
cattgataatcttc

SEQ ID NO: 665546 - DNA, 20 bp, Homo sapiens
cattgataatcttcaggtga

SEQ ID NO: 665547 - DNA, 16 bp, Homo sapiens
cattgattgtcagcta

SEQ ID NO: 665548 - DNA, 17 bp, Homo sapiens
cattgattgtcagctac

SEQ ID NO: 665549 - DNA, 21 bp, Homo sapiens
cattgcacataagcttccatt

SEQ ID NO: 665550 - DNA, 15 bp, Homo sapiens
cattgccaagtcaga

SEQ ID NO: 665551 - DNA, 17 bp, Homo sapiens
cattgccgctgtataaa

SEQ ID NO: 665552 - DNA, 22 bp, Homo sapiens
cattgtctactcctagaagaac

SEQ ID NO: 665553 - DNA, 19 bp, Homo sapiens
cattgtgactttgctttga

SEQ ID NO: 665554 - DNA, 16 bp, Homo sapiens
cattgttatttataca

SEQ ID NO: 665555 - DNA, 20 bp, Homo sapiens
cattgttcttattctggcat

SEQ ID NO: 665556 - DNA, 23 bp, Homo sapiens
catttaaaaagctcactgctgat

SEQ ID NO: 665557 - DNA, 21 bp, Homo sapiens
catttaaaacattaaaatata

SEQ ID NO: 665558 - DNA, 19 bp, Homo sapiens
catttaaaattgctatgtt

SEQ ID NO: 665559 - DNA, 18 bp, Homo sapiens
catttacaaaagatttat

SEQ ID NO: 665560 - DNA, 22 bp, Homo sapiens
catttagatcctggtttcataa

SEQ ID NO: 665561 - DNA, 14 bp, Homo sapiens
catttagtaagaat

SEQ ID NO: 665562 - DNA, 22 bp, Homo sapiens
catttatgtgaggtaattattg

SEQ ID NO: 665563 - DNA, 23 bp, Homo sapiens
catttatttatccagaaaactgt

SEQ ID NO: 665564 - DNA, 16 bp, Homo sapiens
catttcatcattgttt

SEQ ID NO: 665565 - DNA, 15 bp, Homo sapiens
catttcattcctaac

SEQ ID NO: 665566 - DNA, 17 bp, Homo sapiens
catttctatgcaggcag

SEQ ID NO: 665567 - DNA, 21 bp, Homo sapiens
catttctcttccccttagaaa

SEQ ID NO: 665568 - DNA, 21 bp, Homo sapiens
catttcttagatggagaagtt

SEQ ID NO: 665569 - DNA, 21 bp, Homo sapiens
catttgacaaaactaaccttg

SEQ ID NO: 665570 - DNA, 15 bp, Homo sapiens
catttggaatgaata

SEQ ID NO: 665571 - DNA, 20 bp, Homo sapiens
catttgtaagtgtaaaaaat

SEQ ID NO: 665572 - DNA, 23 bp, Homo sapiens
catttgtggcagtcccttataat

SEQ ID NO: 665573 - DNA, 14 bp, Homo sapiens
cattttaattttaa

SEQ ID NO: 665574 - DNA, 18 bp, Homo sapiens
cattttaattttaaagtg

SEQ ID NO: 665575 - DNA, 23 bp, Homo sapiens
cattttacccttgcagttttact

SEQ ID NO: 665576 - DNA, 21 bp, Homo sapiens
cattttagaaacggacagctt

SEQ ID NO: 665577 - DNA, 18 bp, Homo sapiens
cattttatcattaaaaat

SEQ ID NO: 665578 - DNA, 20 bp, Homo sapiens
cattttattaataatattta

SEQ ID NO: 665579 - DNA, 13 bp, Homo sapiens
cattttgaaacaa

SEQ ID NO: 665580 - DNA, 11 bp, Homo sapiens
cattttggaaa

SEQ ID NO: 665581 - DNA, 12 bp, Homo sapiens
cattttgtaaat

SEQ ID NO: 665582 - DNA, 19 bp, Homo sapiens
catttttccgtttgctttt

SEQ ID NO: 665583 - DNA, 16 bp, Homo sapiens
catttttctcccaaga

SEQ ID NO: 665584 - DNA, 21 bp, Homo sapiens
cattttttaatttacttgttt

SEQ ID NO: 665585 - DNA, 17 bp, Homo sapiens
cattttttcttctgaag

SEQ ID NO: 665586 - DNA, 15 bp, Homo sapiens
ccaaactcctttctt

SEQ ID NO: 665587 - DNA, 19 bp, Homo sapiens
ccaaactcctttcttatct

SEQ ID NO: 665588 - DNA, 14 bp, Homo sapiens
ccaaactgttctga

SEQ ID NO: 665589 - DNA, 17 bp, Homo sapiens
ccaaagaggctgcccct

SEQ ID NO: 665590 - DNA, 23 bp, Homo sapiens
ccaaagaggctgcccctctcacc

SEQ ID NO: 665591 - DNA, 14 bp, Homo sapiens
ccaaagctgagcct

SEQ ID NO: 665592 - DNA, 12 bp, Homo sapiens
ccaaagtacctt

SEQ ID NO: 665593 - DNA, 20 bp, Homo sapiens
ccaaatacctcaatttttgt

SEQ ID NO: 665594 - DNA, 14 bp, Homo sapiens
ccaaattaaaacaa

SEQ ID NO: 665595 - DNA, 13 bp, Homo sapiens
ccaacacttccag

SEQ ID NO: 665596 - DNA, 17 bp, Homo sapiens
ccaacatgcactgatgt

SEQ ID NO: 665597 - DNA, 21 bp, Homo sapiens
ccaacatgcactgatgttgtg

SEQ ID NO: 665598 - DNA, 16 bp, Homo sapiens
ccaaccgtgtctgtct

SEQ ID NO: 665599 - DNA, 14 bp, Homo sapiens
ccaacctcagggct

SEQ ID NO: 665600 - DNA, 20 bp, Homo sapiens
ccaacctcagggctcccagg

SEQ ID NO: 665601 - DNA, 12 bp, Homo sapiens
ccaacctccagt

SEQ ID NO: 665602 - DNA, 18 bp, Homo sapiens
ccaacctccagtgtcagg

SEQ ID NO: 665603 - DNA, 16 bp, Homo sapiens
ccaacttcttcctgtg

SEQ ID NO: 665604 - DNA, 14 bp, Homo sapiens
ccaagaaaatgaag

SEQ ID NO: 665605 - DNA, 18 bp, Homo sapiens
ccaagaaactgagaccaa

SEQ ID NO: 665606 - DNA, 12 bp, Homo sapiens
ccaagaagcaaa

SEQ ID NO: 665607 - DNA, 16 bp, Homo sapiens
ccaagagtgcactact

SEQ ID NO: 665608 - DNA, 13 bp, Homo sapiens
ccaagcaacattt

SEQ ID NO: 665609 - DNA, 19 bp, Homo sapiens
ccaaggagggggcctcatt

SEQ ID NO: 665610 - DNA, 20 bp, Homo sapiens
ccaaggagggggcctcattg

SEQ ID NO: 665611 - DNA, 21 bp, Homo sapiens
ccaagggacgttgacctggac

SEQ ID NO: 665612 - DNA, 21 bp, Homo sapiens
ccaagtccgcagaagccctga

SEQ ID NO: 665613 - DNA, 17 bp, Homo sapiens
ccaagtgcactttctaa

SEQ ID NO: 665614 - DNA, 12 bp, Homo sapiens
ccaataaaggca

SEQ ID NO: 665615 - DNA, 17 bp, Homo sapiens
ccaataaaggcagctgc

SEQ ID NO: 665616 - DNA, 22 bp, Homo sapiens
ccaataataaatgccctcttct

SEQ ID NO: 665617 - DNA, 14 bp, Homo sapiens
ccaatacagtctag

SEQ ID NO: 665618 - DNA, 23 bp, Homo sapiens
ccaatatatagtgggtacatcaa

SEQ ID NO: 665619 - DNA, 18 bp, Homo sapiens
ccaatgccccactggcag

SEQ ID NO: 665620 - DNA, 15 bp, Homo sapiens
ccacaaaaaatactt

SEQ ID NO: 665621 - DNA, 21 bp, Homo sapiens
ccacaaaacttcagtgtggta

SEQ ID NO: 665622 - DNA, 19 bp, Homo sapiens
ccacaaagcattttcattt

SEQ ID NO: 665623 - DNA, 15 bp, Homo sapiens
ccacaaatcttcagt

SEQ ID NO: 665624 - DNA, 22 bp, Homo sapiens
ccacaactcctgtctaactgct

SEQ ID NO: 665625 - DNA, 23 bp, Homo sapiens
ccacaactttgtcgtggttctta

SEQ ID NO: 665626 - DNA, 24 bp, Homo sapiens
ccacaaggaataaatgagagggaa

SEQ ID NO: 665627 - DNA, 21 bp, Homo sapiens
ccacaccccaacacttccagc

SEQ ID NO: 665628 - DNA, 15 bp, Homo sapiens
ccacagcgtccctgg

SEQ ID NO: 665629 - DNA, 23 bp, Homo sapiens
ctttatcataaacattttacatg

SEQ ID NO: 665630 - DNA, 19 bp, Homo sapiens
ctttattaatgttttcaaa

SEQ ID NO: 665631 - DNA, 17 bp, Homo sapiens
ctttattcagaacttta

SEQ ID NO: 665632 - DNA, 11 bp, Homo sapiens
ctttatttctg

SEQ ID NO: 665633 - DNA, 15 bp, Homo sapiens
ctttcagaaatataa

SEQ ID NO: 665634 - DNA, 19 bp, Homo sapiens
ctttcatattttaaacaga

SEQ ID NO: 665635 - DNA, 14 bp, Homo sapiens
ctttccaaattaaa

SEQ ID NO: 665636 - DNA, 15 bp, Homo sapiens
ctttccaaattaaaa

SEQ ID NO: 665637 - DNA, 18 bp, Homo sapiens
ctttccaaattaaaacaa

SEQ ID NO: 665638 - DNA, 22 bp, Homo sapiens
ctttccaaattaaaacaaatat

SEQ ID NO: 665639 - DNA, 14 bp, Homo sapiens
ctttccaagcttgg

SEQ ID NO: 665640 - DNA, 17 bp, Homo sapiens
ctttccaaggaagcaga

SEQ ID NO: 665641 - DNA, 22 bp, Homo sapiens
ctttccaggctatgtataaaat

SEQ ID NO: 665642 - DNA, 23 bp, Homo sapiens
ctttccaggctatgtataaaata

SEQ ID NO: 665643 - DNA, 16 bp, Homo sapiens
ctttcctgtttccagg

SEQ ID NO: 665644 - DNA, 13 bp, Homo sapiens
ctttcctgtttct

SEQ ID NO: 665645 - DNA, 13 bp, Homo sapiens
ctttccttgttca

SEQ ID NO: 665646 - DNA, 15 bp, Homo sapiens
ctttctcaactgtcc

SEQ ID NO: 665647 - DNA, 12 bp, Homo sapiens
ctttctctgagg

SEQ ID NO: 665648 - DNA, 13 bp, Homo sapiens
ctttctgtcccac

SEQ ID NO: 665649 - DNA, 13 bp, Homo sapiens
ctttctgtcttgt

SEQ ID NO: 665650 - DNA, 15 bp, Homo sapiens
ctttctgtcttgtta

SEQ ID NO: 665651 - DNA, 16 bp, Homo sapiens
ctttgaagtgcagctc

SEQ ID NO: 665652 - DNA, 18 bp, Homo sapiens
ctttgaagtgcagctcat

SEQ ID NO: 665653 - DNA, 23 bp, Homo sapiens
ctttgagtagatccatttccatt

SEQ ID NO: 665654 - DNA, 22 bp, Homo sapiens
ctttgatcgcttttaataaact

SEQ ID NO: 665655 - DNA, 17 bp, Homo sapiens
ctttgcccttcctcctg

SEQ ID NO: 665656 - DNA, 12 bp, Homo sapiens
ctttgcctctgc

SEQ ID NO: 665657 - DNA, 12 bp, Homo sapiens
ctttgcctcttc

SEQ ID NO: 665658 - DNA, 16 bp, Homo sapiens
ctttgctatgtaaggg

SEQ ID NO: 665659 - DNA, 11 bp, Homo sapiens
ctttgctgcag

SEQ ID NO: 665660 - DNA, 20 bp, Homo sapiens
ctttggattctaaatacatg

SEQ ID NO: 665661 - DNA, 20 bp, Homo sapiens
ctttggcctggggtgcatct

SEQ ID NO: 665662 - DNA, 22 bp, Homo sapiens
ctttggcctggggtgcatctcc

SEQ ID NO: 665663 - DNA, 20 bp, Homo sapiens
ctttgggaggccgaggcggg

SEQ ID NO: 665664 - DNA, 18 bp, Homo sapiens
ctttggtgaacagttttg

SEQ ID NO: 665665 - DNA, 15 bp, Homo sapiens
ctttgtacagagtgc

SEQ ID NO: 665666 - DNA, 13 bp, Homo sapiens
ctttgtattttga

SEQ ID NO: 665667 - DNA, 18 bp, Homo sapiens
ctttgtattttgattatt

SEQ ID NO: 665668 - DNA, 23 bp, Homo sapiens
ctttgtcgtggttcttaaatgtt

SEQ ID NO: 665669 - DNA, 23 bp, Homo sapiens
ctttgtctacttcaaaagtttgt

SEQ ID NO: 665670 - DNA, 22 bp, Homo sapiens
ctttgtgagccaaagcttatgt

SEQ ID NO: 665671 - DNA, 14 bp, Homo sapiens
ctttgtgcattctg

SEQ ID NO: 665672 - DNA, 11 bp, Homo sapiens
ctttgttgaag

SEQ ID NO: 665673 - DNA, 18 bp, Homo sapiens
cttttaaagaagctttat

SEQ ID NO: 665674 - DNA, 18 bp, Homo sapiens
cttttaaagaccctccta

SEQ ID NO: 665675 - DNA, 12 bp, Homo sapiens
cttttaaatcat

SEQ ID NO: 665676 - DNA, 13 bp, Homo sapiens
cttttaaatcatc

SEQ ID NO: 665677 - DNA, 14 bp, Homo sapiens
cttttaataaactg

SEQ ID NO: 665678 - DNA, 17 bp, Homo sapiens
cttttaataaactgcaa

SEQ ID NO: 665679 - DNA, 15 bp, Homo sapiens
cttttaatggcattt

SEQ ID NO: 665680 - DNA, 11 bp, Homo sapiens
cttttaattta

SEQ ID NO: 665681 - DNA, 13 bp, Homo sapiens
cttttaatttaaa

SEQ ID NO: 665682 - DNA, 21 bp, Homo sapiens
cttttaggaaaatcactttgt

SEQ ID NO: 665683 - DNA, 13 bp, Homo sapiens
cttttataaagca

SEQ ID NO: 665684 - DNA, 16 bp, Homo sapiens
cttttataaagcatgt

SEQ ID NO: 665685 - DNA, 13 bp, Homo sapiens
cttttatatttgt

SEQ ID NO: 665686 - DNA, 18 bp, Homo sapiens
cttttatgcaaaaggttt

SEQ ID NO: 665687 - DNA, 19 bp, Homo sapiens
cttttatttggtgtgttcg

SEQ ID NO: 665688 - DNA, 12 bp, Homo sapiens
cttttcctatcc

SEQ ID NO: 665689 - DNA, 14 bp, Homo sapiens
cttttctctgagat

SEQ ID NO: 665690 - DNA, 13 bp, Homo sapiens
cttttctgtaatg

SEQ ID NO: 665691 - DNA, 20 bp, Homo sapiens
cttttctgtttctgtttata

SEQ ID NO: 665692 - DNA, 15 bp, Homo sapiens
cttttctttgttata

SEQ ID NO: 665693 - DNA, 21 bp, Homo sapiens
cttttgaagcatagataatat

SEQ ID NO: 665694 - DNA, 18 bp, Homo sapiens
cttttgcagaagagggtg

SEQ ID NO: 665695 - DNA, 15 bp, Homo sapiens
cttttgctactaagt

SEQ ID NO: 665696 - DNA, 13 bp, Homo sapiens
cttttgctgtgca

SEQ ID NO: 665697 - DNA, 14 bp, Homo sapiens
cttttgtatctttt

SEQ ID NO: 665698 - DNA, 15 bp, Homo sapiens
cttttgtggagggga

SEQ ID NO: 665699 - DNA, 12 bp, Homo sapiens
cttttgtttggt

SEQ ID NO: 665700 - DNA, 14 bp, Homo sapiens
cttttgtttggtaa

SEQ ID NO: 665701 - DNA, 18 bp, Homo sapiens
cttttgtttggtaaatgt

SEQ ID NO: 665702 - DNA, 17 bp, Homo sapiens
ctttttaagaatatttt

SEQ ID NO: 665703 - DNA, 18 bp, Homo sapiens
cttttttctcagtcctaa

SEQ ID NO: 665704 - DNA, 24 bp, Homo sapiens
cttttttggggagtacctgtccaa

SEQ ID NO: 665705 - DNA, 18 bp, Homo sapiens
cttttttttttttttaca

SEQ ID NO: 665706 - DNA, 15 bp, Homo sapiens
gaaaaaaatactatt

SEQ ID NO: 665707 - DNA, 20 bp, Homo sapiens
gaaaaaaatactatttaaga

SEQ ID NO: 665708 - DNA, 15 bp, Homo sapiens
gaaaaacaattttct

SEQ ID NO: 665709 - DNA, 22 bp, Homo sapiens
gaaaaataaagacacctggttg

SEQ ID NO: 665710 - DNA, 18 bp, Homo sapiens
gaaaaatctcaattgaaa

SEQ ID NO: 665711 - DNA, 16 bp, Homo sapiens
gcagacccagtcccac

SEQ ID NO: 665712 - DNA, 23 bp, Homo sapiens
gcagagaacagaactggaggcag

SEQ ID NO: 665713 - DNA, 13 bp, Homo sapiens
gcagagcctcctg

SEQ ID NO: 665714 - DNA, 14 bp, Homo sapiens
gcagagcctcctgg

SEQ ID NO: 665715 - DNA, 15 bp, Homo sapiens
gcagagcctcctggg

SEQ ID NO: 665716 - DNA, 17 bp, Homo sapiens
gcagagcctcctgggaa

SEQ ID NO: 665717 - DNA, 16 bp, Homo sapiens
gcagaggaccagggcc

SEQ ID NO: 665718 - DNA, 21 bp, Homo sapiens
gcagagtggcgtggcctcccc

SEQ ID NO: 665719 - DNA, 12 bp, Homo sapiens
gcagagttttca

SEQ ID NO: 665720 - DNA, 19 bp, Homo sapiens
gcagagttttcattaaatc

SEQ ID NO: 665721 - DNA, 19 bp, Homo sapiens
gcagatctacatgtctaga

SEQ ID NO: 665722 - DNA, 15 bp, Homo sapiens
gcagattacactgat

SEQ ID NO: 665723 - DNA, 16 bp, Homo sapiens
gcagcaccgaggggcc

SEQ ID NO: 665724 - DNA, 20 bp, Homo sapiens
gcagcaccgaggggcctttg

SEQ ID NO: 665725 - DNA, 15 bp, Homo sapiens
gcagccgtgatcaag

SEQ ID NO: 665726 - DNA, 14 bp, Homo sapiens
gcagcgcagggctg

SEQ ID NO: 665727 - DNA, 15 bp, Homo sapiens
gcccatggcttctgg

SEQ ID NO: 665728 - DNA, 20 bp, Homo sapiens
gccccacctcggcacacact

SEQ ID NO: 665729 - DNA, 22 bp, Homo sapiens
gccccacctcggcacacactgt

SEQ ID NO: 665730 - DNA, 13 bp, Homo sapiens
gccccaggccctg

SEQ ID NO: 665731 - DNA, 14 bp, Homo sapiens
gccccaggccctgc

SEQ ID NO: 665732 - DNA, 20 bp, Homo sapiens
gccccaggcctgtggctccc

SEQ ID NO: 665733 - DNA, 21 bp, Homo sapiens
gccccaggcctgtggctccct

SEQ ID NO: 665734 - DNA, 20 bp, Homo sapiens
gccccatccagacctggctc

SEQ ID NO: 665735 - DNA, 23 bp, Homo sapiens
gcccccaacctcagggctcccag

SEQ ID NO: 665736 - DNA, 13 bp, Homo sapiens
gcccccaataaag

SEQ ID NO: 665737 - DNA, 14 bp, Homo sapiens
gcccccaataaagg

SEQ ID NO: 665738 - DNA, 17 bp, Homo sapiens
gcccccaataaaggcag

SEQ ID NO: 665739 - DNA, 21 bp, Homo sapiens
gcccccaataaaggcagctgc

SEQ ID NO: 665740 - DNA, 16 bp, Homo sapiens
gcccccagtgcctcac

SEQ ID NO: 665741 - DNA, 19 bp, Homo sapiens
gcccccagtgcctcacctt

SEQ ID NO: 665742 - DNA, 18 bp, Homo sapiens
gccccctgggctggggcc

SEQ ID NO: 665743 - DNA, 15 bp, Homo sapiens
gcccctcagagactg

SEQ ID NO: 665744 - DNA, 23 bp, Homo sapiens
gcccctcccacacccaaagctga

SEQ ID NO: 665745 - DNA, 14 bp, Homo sapiens
gcccctctcaccaa

SEQ ID NO: 665746 - DNA, 14 bp, Homo sapiens
gcccctcttcccca

SEQ ID NO: 665747 - DNA, 11 bp, Homo sapiens
gcccctggctt

SEQ ID NO: 665748 - DNA, 22 bp, Homo sapiens
gcccctggctttgcctcttctt

SEQ ID NO: 665749 - DNA, 19 bp, Homo sapiens
gcccgaagtctgctgctgt

SEQ ID NO: 665750 - DNA, 19 bp, Homo sapiens
gcccgacatggctccggcc

SEQ ID NO: 665751 - DNA, 20 bp, Homo sapiens
gcccgagagcctcgcttttt

SEQ ID NO: 665752 - DNA, 21 bp, Homo sapiens
gcccggagcagcagcttctcc

SEQ ID NO: 665753 - DNA, 22 bp, Homo sapiens
gcccggagcagcagcttctcca

SEQ ID NO: 665754 - DNA, 18 bp, Homo sapiens
gccctaaatagcagaaag

SEQ ID NO: 665755 - DNA, 20 bp, Homo sapiens
gccctaagtggctgccttct

SEQ ID NO: 665756 - DNA, 21 bp, Homo sapiens
gccctaagtggctgccttctt

SEQ ID NO: 665757 - DNA, 14 bp, Homo sapiens
gccctcccactttg

SEQ ID NO: 665758 - DNA, 9 bp, Homo sapiens
gccctcctc

SEQ ID NO: 665759 - DNA, 14 bp, Homo sapiens
gccctcctctccca

SEQ ID NO: 665760 - DNA, 14 bp, Homo sapiens
gccctcgcctcctc

SEQ ID NO: 665761 - DNA, 16 bp, Homo sapiens
gccctctcctccctct

SEQ ID NO: 665762 - DNA, 17 bp, Homo sapiens
gccctgagtctgggcag

SEQ ID NO: 665763 - DNA, 13 bp, Homo sapiens
gccctgcctgaga

SEQ ID NO: 665764 - DNA, 22 bp, Homo sapiens
gccctgggggtctgggcgtcca

SEQ ID NO: 665765 - DNA, 12 bp, Homo sapiens
gccctgtgtgca

SEQ ID NO: 665766 - DNA, 12 bp, Homo sapiens
gccctgtgtgtg

SEQ ID NO: 665767 - DNA, 23 bp, Homo sapiens
gcccttccgcagtgtggccaggc

SEQ ID NO: 665768 - DNA, 14 bp, Homo sapiens
gccgatagagggac

SEQ ID NO: 665769 - DNA, 18 bp, Homo sapiens
gccgcgcgtccagctgcc

SEQ ID NO: 665770 - DNA, 11 bp, Homo sapiens
gccgctacctc

SEQ ID NO: 665771 - DNA, 19 bp, Homo sapiens
gccgctgtataaagcatgt

SEQ ID NO: 665772 - DNA, 15 bp, Homo sapiens
gccggccctgtgtgc

SEQ ID NO: 665773 - DNA, 14 bp, Homo sapiens
gcctacatttatca

SEQ ID NO: 665774 - DNA, 22 bp, Homo sapiens
gcctagtttcttacacactgtc

SEQ ID NO: 665775 - DNA, 15 bp, Homo sapiens
gcctatagtcccact

SEQ ID NO: 665776 - DNA, 14 bp, Homo sapiens
gcctcaccttccaa

SEQ ID NO: 665777 - DNA, 19 bp, Homo sapiens
gcctcacttcctttgccct

SEQ ID NO: 665778 - DNA, 19 bp, Homo sapiens
gcctcagctgaatgcctcc

SEQ ID NO: 665779 - DNA, 19 bp, Homo sapiens
gcctccacatgctgcctgg

SEQ ID NO: 665780 - DNA, 20 bp, Homo sapiens
gcctccacatgctgcctggc

SEQ ID NO: 665781 - DNA, 17 bp, Homo sapiens
gcctccaggtgcagagg

SEQ ID NO: 665782 - DNA, 21 bp, Homo sapiens
gcctccagtccaaagccggct

SEQ ID NO: 665783 - DNA, 12 bp, Homo sapiens
gcctcccaggtt

SEQ ID NO: 665784 - DNA, 17 bp, Homo sapiens
gcctccccacctccagg

SEQ ID NO: 665785 - DNA, 17 bp, Homo sapiens
gcctcctcctcctgccc

SEQ ID NO: 665786 - DNA, 18 bp, Homo sapiens
gcctcctcctcctgccct

SEQ ID NO: 665787 - DNA, 19 bp, Homo sapiens
gcctcgctttttcatcctt

SEQ ID NO: 665788 - DNA, 23 bp, Homo sapiens
gcctcgctttttcatccttcttt

SEQ ID NO: 665789 - DNA, 12 bp, Homo sapiens
gcctctccctgg

SEQ ID NO: 665790 - DNA, 17 bp, Homo sapiens
gcctctgcagtctcatt

SEQ ID NO: 665791 - DNA, 20 bp, Homo sapiens
gcctctgcagtctcatttct

SEQ ID NO: 665792 - DNA, 13 bp, Homo sapiens
gcctctgccctgg

SEQ ID NO: 665793 - DNA, 13 bp, Homo sapiens
gcctctgctccct

SEQ ID NO: 665794 - DNA, 16 bp, Homo sapiens
gcctctgctccctctg

SEQ ID NO: 665795 - DNA, 13 bp, Homo sapiens
gcctcttctttgt

SEQ ID NO: 665796 - DNA, 14 bp, Homo sapiens
gcctcttctttgtg

SEQ ID NO: 665797 - DNA, 15 bp, Homo sapiens
gcctcttctttgtgc

SEQ ID NO: 665798 - DNA, 16 bp, Homo sapiens
gcctcttctttgtgcc

SEQ ID NO: 665799 - DNA, 17 bp, Homo sapiens
gcctcttctttgtgcct

SEQ ID NO: 665800 - DNA, 20 bp, Homo sapiens
gcctcttctttgtgcctttg

SEQ ID NO: 665801 - DNA, 16 bp, Homo sapiens
gcctctttccctagga

SEQ ID NO: 665802 - DNA, 12 bp, Homo sapiens
gcctgaataaag

SEQ ID NO: 665803 - DNA, 16 bp, Homo sapiens
gcctgaataaagagcc

SEQ ID NO: 665804 - DNA, 16 bp, Homo sapiens
gcctgagaggggaagc

SEQ ID NO: 665805 - DNA, 13 bp, Homo sapiens
gcctgagagtatt

SEQ ID NO: 665806 - DNA, 20 bp, Homo sapiens
gcctgaggggaaagagagat

SEQ ID NO: 665807 - DNA, 13 bp, Homo sapiens
gcctgcagcaggc

SEQ ID NO: 665808 - DNA, 20 bp, Homo sapiens
gcctgcagggaagccccaca

SEQ ID NO: 665809 - DNA, 13 bp, Homo sapiens
gcctgcagggcca

SEQ ID NO: 665810 - DNA, 16 bp, Homo sapiens
gcctgcagggccatgg

SEQ ID NO: 665811 - DNA, 21 bp, Homo sapiens
gcctgcagggccatggctcag

SEQ ID NO: 665812 - DNA, 13 bp, Homo sapiens
gcctgccacctcc

SEQ ID NO: 665813 - DNA, 16 bp, Homo sapiens
gcctgcctgcagcagg

SEQ ID NO: 665814 - DNA, 20 bp, Homo sapiens
gcctgcttcttctctccaca

SEQ ID NO: 665815 - DNA, 22 bp, Homo sapiens
gcctgcttcttctctccacatg

SEQ ID NO: 665816 - DNA, 19 bp, Homo sapiens
gcctggaagagccgagcac

SEQ ID NO: 665817 - DNA, 16 bp, Homo sapiens
gcctggcacagaccag

SEQ ID NO: 665818 - DNA, 14 bp, Homo sapiens
gcctggccatttcc

SEQ ID NO: 665819 - DNA, 22 bp, Homo sapiens
gcctggccttgtcctcagccag

SEQ ID NO: 665820 - DNA, 20 bp, Homo sapiens
gcctgggccgtggcacagct

SEQ ID NO: 665821 - DNA, 21 bp, Homo sapiens
gcctgggccgtggcacagctg

SEQ ID NO: 665822 - DNA, 19 bp, Homo sapiens
gcctggttcagacacagct

SEQ ID NO: 665823 - DNA, 23 bp, Homo sapiens
gcctgtatcctccctggcagaca

SEQ ID NO: 665824 - DNA, 16 bp, Homo sapiens
gcctgtcccttgcctc

SEQ ID NO: 665825 - DNA, 17 bp, Homo sapiens
gcctgtcccttgcctct

SEQ ID NO: 665826 - DNA, 19 bp, Homo sapiens
gcctgtcccttgcctctgc

SEQ ID NO: 665827 - DNA, 20 bp, Homo sapiens
gcctgtcccttgcctctgcc

SEQ ID NO: 665828 - DNA, 16 bp, Homo sapiens
gcctgtcttaattttc

SEQ ID NO: 665829 - DNA, 17 bp, Homo sapiens
gcctgtggaatgagtgt

SEQ ID NO: 665830 - DNA, 18 bp, Homo sapiens
gccttaatttagaaactg

SEQ ID NO: 665831 - DNA, 20 bp, Homo sapiens
gccttaatttagaaactgaa

SEQ ID NO: 665832 - DNA, 22 bp, Homo sapiens
gccttaatttagaaactgaaaa

SEQ ID NO: 665833 - DNA, 15 bp, Homo sapiens
gccttagggaagctg

SEQ ID NO: 665834 - DNA, 19 bp, Homo sapiens
gccttagtgggccagggct

SEQ ID NO: 665835 - DNA, 22 bp, Homo sapiens
gccttcaaaactatagcttgca

SEQ ID NO: 665836 - DNA, 13 bp, Homo sapiens
gccttctgctgaa

SEQ ID NO: 665837 - DNA, 23 bp, Homo sapiens
gccttctttccatcaactcccaa

SEQ ID NO: 665838 - DNA, 23 bp, Homo sapiens
gcctttaaaacgcgtctgcctgg

SEQ ID NO: 665839 - DNA, 15 bp, Homo sapiens
gaatatgacggaaga

SEQ ID NO: 665840 - DNA, 17 bp, Homo sapiens
gaatatgccttaattta

SEQ ID NO: 665841 - DNA, 19 bp, Homo sapiens
gaatattgccattatgctt

SEQ ID NO: 665842 - DNA, 16 bp, Homo sapiens
gaatcccactgtatga

SEQ ID NO: 665843 - DNA, 19 bp, Homo sapiens
gaatctataagtagtaaat

SEQ ID NO: 665844 - DNA, 20 bp, Homo sapiens
gaatctataagtagtaaatc

SEQ ID NO: 665845 - DNA, 21 bp, Homo sapiens
gaatctataagtagtaaatca

SEQ ID NO: 665846 - DNA, 18 bp, Homo sapiens
gaatctcttcatgcttga

SEQ ID NO: 665847 - DNA, 18 bp, Homo sapiens
gaatgaaccctccttttc

SEQ ID NO: 665848 - DNA, 16 bp, Homo sapiens
gaatgagcccagagaa

SEQ ID NO: 665849 - DNA, 19 bp, Homo sapiens
gaatgagcccagagaacag

SEQ ID NO: 665850 - DNA, 14 bp, Homo sapiens
gaatgagtgtgcat

SEQ ID NO: 665851 - DNA, 17 bp, Homo sapiens
gaatgcctcctgtgggg

SEQ ID NO: 665852 - DNA, 21 bp, Homo sapiens
gaatgctgcccgctctgcaga

SEQ ID NO: 665853 - DNA, 19 bp, Homo sapiens
gaatggtgtgaacccggga

SEQ ID NO: 665854 - DNA, 21 bp, Homo sapiens
gaatgtagcgtgtaagcttgt

SEQ ID NO: 665855 - DNA, 21 bp, Homo sapiens
gaatgtgggcactggcccagg

SEQ ID NO: 665856 - DNA, 14 bp, Homo sapiens
gaatgtggtctcag

SEQ ID NO: 665857 - DNA, 16 bp, Homo sapiens
gaatgtggtctcagga

SEQ ID NO: 665858 - DNA, 17 bp, Homo sapiens
gaatgtggtctcaggat

SEQ ID NO: 665859 - DNA, 17 bp, Homo sapiens
gaattcaagaaaggaaa

SEQ ID NO: 665860 - DNA, 18 bp, Homo sapiens
gaattcctaacttttcaa

SEQ ID NO: 665861 - DNA, 14 bp, Homo sapiens
gaattcttctgcaa

SEQ ID NO: 665862 - DNA, 17 bp, Homo sapiens
gaattgaaaagtttttg

SEQ ID NO: 665863 - DNA, 12 bp, Homo sapiens
gaatttgaagag

SEQ ID NO: 665864 - DNA, 19 bp, Homo sapiens
gaattttaggaacttcaga

SEQ ID NO: 665865 - DNA, 18 bp, Homo sapiens
gaattttattgacacagt

SEQ ID NO: 665866 - DNA, 19 bp, Homo sapiens
gaattttttgaatatgcct

SEQ ID NO: 665867 - DNA, 16 bp, Homo sapiens
gacaaagatttcttct

SEQ ID NO: 665868 - DNA, 20 bp, Homo sapiens
gacaactgtgaagccaccct

SEQ ID NO: 665869 - DNA, 12 bp, Homo sapiens
gacaagacagag

SEQ ID NO: 665870 - DNA, 14 bp, Homo sapiens
gctgcccctctcac

SEQ ID NO: 665871 - DNA, 20 bp, Homo sapiens
ggagacagaggttgcagtga

SEQ ID NO: 665872 - DNA, 15 bp, Homo sapiens
ggcgcaggtgggctg

SEQ ID NO: 665873 - DNA, 17 bp, Homo sapiens
ggcgcctttttggcctg

SEQ ID NO: 665874 - DNA, 22 bp, Homo sapiens
ggcggctgcacaacagccctgc

SEQ ID NO: 665875 - DNA, 20 bp, Homo sapiens
ggcgtccagctcagccctgg

SEQ ID NO: 665876 - DNA, 22 bp, Homo sapiens
ggctatttttgaagcaaagaag

SEQ ID NO: 665877 - DNA, 16 bp, Homo sapiens
ggctcaagctttcccg

SEQ ID NO: 665878 - DNA, 12 bp, Homo sapiens
ggctcagggtgg

SEQ ID NO: 665879 - DNA, 22 bp, Homo sapiens
ggctcccaggggtctccctggc

SEQ ID NO: 665880 - DNA, 23 bp, Homo sapiens
ggctcccaggggtctccctggct

SEQ ID NO: 665881 - DNA, 15 bp, Homo sapiens
ggctcctcctcaccc

SEQ ID NO: 665882 - DNA, 22 bp, Homo sapiens
ggctcgtcagccacctgggaac

SEQ ID NO: 665883 - DNA, 22 bp, Homo sapiens
ggctgacatgaagctgttgtgt

SEQ ID NO: 665884 - DNA, 15 bp, Homo sapiens
ggctgaggcaggaga

SEQ ID NO: 665885 - DNA, 23 bp, Homo sapiens
ggctgaggcaggagaatggtgtg

SEQ ID NO: 665886 - DNA, 16 bp, Homo sapiens
ggctgaggcaggagga

SEQ ID NO: 665887 - DNA, 19 bp, Homo sapiens
ggctgcacaacagccctgc

SEQ ID NO: 665888 - DNA, 22 bp, Homo sapiens
ggctgcacaacagccctgcctg

SEQ ID NO: 665889 - DNA, 23 bp, Homo sapiens
ggctgcacaacagccctgcctga

SEQ ID NO: 665890 - DNA, 14 bp, Homo sapiens
ggctgcacaggctg

SEQ ID NO: 665891 - DNA, 15 bp, Homo sapiens
ggctgcacaggctga

SEQ ID NO: 665892 - DNA, 14 bp, Homo sapiens
ggctgcaggcaggc

SEQ ID NO: 665893 - DNA, 18 bp, Homo sapiens
ggctgccatgtgaagagg

SEQ ID NO: 665894 - DNA, 13 bp, Homo sapiens
ggctgcccctctc

SEQ ID NO: 665895 - DNA, 13 bp, Homo sapiens
ggctgccttcttt

SEQ ID NO: 665896 - DNA, 21 bp, Homo sapiens
ggctggacttctacctgccct

SEQ ID NO: 665897 - DNA, 18 bp, Homo sapiens
ggctggcacgtgacaggc

SEQ ID NO: 665898 - DNA, 19 bp, Homo sapiens
ggctggcacgtgacaggct

SEQ ID NO: 665899 - DNA, 20 bp, Homo sapiens
ggctggcacgtgacaggctc

SEQ ID NO: 665900 - DNA, 20 bp, Homo sapiens
ggctgggtgtttcagtttga

SEQ ID NO: 665901 - DNA, 15 bp, Homo sapiens
ggctggtaagagaag

SEQ ID NO: 665902 - DNA, 14 bp, Homo sapiens
ggctgttctggaag

SEQ ID NO: 665903 - DNA, 18 bp, Homo sapiens
ggctgttctgtggttcct

SEQ ID NO: 665904 - DNA, 21 bp, Homo sapiens
ggctgttctgtggttcctctg

SEQ ID NO: 665905 - DNA, 13 bp, Homo sapiens
ggcttatttctat

SEQ ID NO: 665906 - DNA, 19 bp, Homo sapiens
ggcttatttctatgacaaa

SEQ ID NO: 665907 - DNA, 15 bp, Homo sapiens
ggcttccccactccc

SEQ ID NO: 665908 - DNA, 13 bp, Homo sapiens
ggctttgcctctt

SEQ ID NO: 665909 - DNA, 17 bp, Homo sapiens
ggctttgcctcttcttt

SEQ ID NO: 665910 - DNA, 19 bp, Homo sapiens
gggaaacactgaaatgaaa

SEQ ID NO: 665911 - DNA, 22 bp, Homo sapiens
gggaaagtgtgagctcttccct

SEQ ID NO: 665912 - DNA, 15 bp, Homo sapiens
gggaagctggcctga

SEQ ID NO: 665913 - DNA, 16 bp, Homo sapiens
gggaatgagcccagag

SEQ ID NO: 665914 - DNA, 17 bp, Homo sapiens
gggaatgagcccagaga

SEQ ID NO: 665915 - DNA, 13 bp, Homo sapiens
gggacaagggatt

SEQ ID NO: 665916 - DNA, 22 bp, Homo sapiens
gggacatcacagggtgggcctc

SEQ ID NO: 665917 - DNA, 20 bp, Homo sapiens
gggactatctttgctgcaga

SEQ ID NO: 665918 - DNA, 21 bp, Homo sapiens
gggactccatgctccttgaga

SEQ ID NO: 665919 - DNA, 23 bp, Homo sapiens
gggagaatgtcaaggaagacttt

SEQ ID NO: 665920 - DNA, 20 bp, Homo sapiens
gggagacagaggttgcagtg

SEQ ID NO: 665921 - DNA, 20 bp, Homo sapiens
gggagacggtttccagggag

SEQ ID NO: 665922 - DNA, 22 bp, Homo sapiens
gggagaggtgattctcagggct

SEQ ID NO: 665923 - DNA, 14 bp, Homo sapiens
gggagcactgcgtt

SEQ ID NO: 665924 - DNA, 13 bp, Homo sapiens
gggagcggaggtt

SEQ ID NO: 665925 - DNA, 13 bp, Homo sapiens
gggagctgggccc

SEQ ID NO: 665926 - DNA, 19 bp, Homo sapiens
gggagctgggcccgacatg

SEQ ID NO: 665927 - DNA, 17 bp, Homo sapiens
gggaggggccggccctg

SEQ ID NO: 665928 - DNA, 16 bp, Homo sapiens
gggagtgctggctcac

SEQ ID NO: 665929 - DNA, 16 bp, Homo sapiens
gggatatggcaggact

SEQ ID NO: 665930 - DNA, 21 bp, Homo sapiens
gggcaagagagcgagaccctg

SEQ ID NO: 665931 - DNA, 14 bp, Homo sapiens
gggcactggcccag

SEQ ID NO: 665932 - DNA, 17 bp, Homo sapiens
gggcagcggctccactt

SEQ ID NO: 665933 - DNA, 15 bp, Homo sapiens
gggcaggctgggcca

SEQ ID NO: 665934 - DNA, 15 bp, Homo sapiens
gggcagggagctggg

SEQ ID NO: 665935 - DNA, 20 bp, Homo sapiens
gggcagggagctgggcccga

SEQ ID NO: 665936 - DNA, 14 bp, Homo sapiens
gggccacctgcagg

SEQ ID NO: 665937 - DNA, 15 bp, Homo sapiens
gggccacctgcagga

SEQ ID NO: 665938 - DNA, 12 bp, Homo sapiens
gggccagggctg

SEQ ID NO: 665939 - DNA, 13 bp, Homo sapiens
gggccagggctgc

SEQ ID NO: 665940 - DNA, 18 bp, Homo sapiens
gggccagggtctgtgtga

SEQ ID NO: 665941 - DNA, 13 bp, Homo sapiens
gggccatggctca

SEQ ID NO: 665942 - DNA, 21 bp, Homo sapiens
gggccatgtccaaagaggctg

SEQ ID NO: 665943 - DNA, 13 bp, Homo sapiens
gggcccagtgcat

SEQ ID NO: 665944 - DNA, 22 bp, Homo sapiens
gggcccagtgcatggtggccag

SEQ ID NO: 665945 - DNA, 12 bp, Homo sapiens
gggcccctggca

SEQ ID NO: 665946 - DNA, 21 bp, Homo sapiens
gggcctagcgatctctcctgg

SEQ ID NO: 665947 - DNA, 16 bp, Homo sapiens
gggcctggggcctgag

SEQ ID NO: 665948 - DNA, 23 bp, Homo sapiens
gggccttgctacctcaaggggga

SEQ ID NO: 665949 - DNA, 16 bp, Homo sapiens
gggcgtccagctcagc

SEQ ID NO: 665950 - DNA, 21 bp, Homo sapiens
gggctacagaaaccacagtct

SEQ ID NO: 665951 - DNA, 11 bp, Homo sapiens
gggctcccagg

SEQ ID NO: 665952 - DNA, 22 bp, Homo sapiens
gggctcccaggggtctccctgg

SEQ ID NO: 665953 - DNA, 13 bp, Homo sapiens
gggctggggcctc

SEQ ID NO: 665954 - DNA, 14 bp, Homo sapiens
gggctggggcctca

SEQ ID NO: 665955 - DNA, 16 bp, Homo sapiens
gggctggtccttattt

SEQ ID NO: 665956 - DNA, 15 bp, Homo sapiens
ggggacccagtgcag

SEQ ID NO: 665957 - DNA, 14 bp, Homo sapiens
ggggactgtctttc

SEQ ID NO: 665958 - DNA, 15 bp, Homo sapiens
ggggcaactgtatga

SEQ ID NO: 665959 - DNA, 13 bp, Homo sapiens
ggggcacaggagg

SEQ ID NO: 665960 - DNA, 13 bp, Homo sapiens
ggggcaggctggg

SEQ ID NO: 665961 - DNA, 14 bp, Homo sapiens
ggggcaggctgggc

SEQ ID NO: 665962 - DNA, 15 bp, Homo sapiens
ggggcaggctgggcc

SEQ ID NO: 665963 - DNA, 12 bp, Homo sapiens
ggggcccagtgc

SEQ ID NO: 665964 - DNA, 15 bp, Homo sapiens
gggggacccagtgca

SEQ ID NO: 665965 - DNA, 17 bp, Homo sapiens
ggggtctcacccatgca

SEQ ID NO: 665966 - DNA, 22 bp, Homo sapiens
ggggtctgggcgtccagctcag

SEQ ID NO: 665967 - DNA, 21 bp, Homo sapiens
ggggtgacagtcatcatcagg

SEQ ID NO: 665968 - DNA, 19 bp, Homo sapiens
gggtacctggtccccactg

SEQ ID NO: 665969 - DNA, 16 bp, Homo sapiens
gggtatgcgtttcatg

SEQ ID NO: 665970 - DNA, 18 bp, Homo sapiens
gggtccaggagagcctgg

SEQ ID NO: 665971 - DNA, 15 bp, Homo sapiens
gggtccttctccaca

SEQ ID NO: 665972 - DNA, 12 bp, Homo sapiens
gggtctcccctc

SEQ ID NO: 665973 - DNA, 16 bp, Homo sapiens
gggtctccctggctcc

SEQ ID NO: 665974 - DNA, 18 bp, Homo sapiens
gggtctccctggctccct

SEQ ID NO: 665975 - DNA, 17 bp, Homo sapiens
gggtctctccctcaggt

SEQ ID NO: 665976 - DNA, 15 bp, Homo sapiens
gggtctgggcgtcca

SEQ ID NO: 665977 - DNA, 22 bp, Homo sapiens
gggtctgggcgtccagctcagc

SEQ ID NO: 665978 - DNA, 22 bp, Homo sapiens
gggtctttgtggtagcttatct

SEQ ID NO: 665979 - DNA, 13 bp, Homo sapiens
gggtgacagtcat

SEQ ID NO: 665980 - DNA, 20 bp, Homo sapiens
gggtgacagtcatcatcagg

SEQ ID NO: 665981 - DNA, 22 bp, Homo sapiens
gggtgacagtcatcatcagggc

SEQ ID NO: 665982 - DNA, 13 bp, Homo sapiens
gggtgacggccct

SEQ ID NO: 665983 - DNA, 23 bp, Homo sapiens
gggtgattttatgatcagtgttg

SEQ ID NO: 665984 - DNA, 13 bp, Homo sapiens
gggtgctcagaat

SEQ ID NO: 665985 - DNA, 15 bp, Homo sapiens
gggtgggtgctcaga

SEQ ID NO: 665986 - DNA, 18 bp, Homo sapiens
gggtggtattctggtagg

SEQ ID NO: 665987 - DNA, 22 bp, Homo sapiens
gggtggtctcttcttggggccc

SEQ ID NO: 665988 - DNA, 19 bp, Homo sapiens
gggtgtccccgctgctgtg

SEQ ID NO: 665989 - DNA, 20 bp, Homo sapiens
gggtttcaccatgttggcca

SEQ ID NO: 665990 - DNA, 12 bp, Homo sapiens
ggtaaatgtttc

SEQ ID NO: 665991 - DNA, 13 bp, Homo sapiens
ggtaaatgtttct

SEQ ID NO: 665992 - DNA, 16 bp, Homo sapiens
ggtaaatgtttctttt

SEQ ID NO: 665993 - DNA, 21 bp, Homo sapiens
ggtaaatgtttcttttaaaga

SEQ ID NO: 665994 - DNA, 19 bp, Homo sapiens
ggtaagcaacatggctttg

SEQ ID NO: 665995 - DNA, 15 bp, Homo sapiens
agtaaatcagaaagt

SEQ ID NO: 665996 - DNA, 17 bp, Homo sapiens
agtaacaatctatggct

SEQ ID NO: 665997 - DNA, 21 bp, Homo sapiens
agtaacccccttaaatttaat

SEQ ID NO: 665998 - DNA, 13 bp, Homo sapiens
agtaacttagaaa

SEQ ID NO: 665999 - DNA, 20 bp, Homo sapiens
agtaacttagaaaagtggtg

SEQ ID NO: 666000 - DNA, 21 bp, Homo sapiens
agtaagaataccacatcaaat

SEQ ID NO: 666001 - DNA, 14 bp, Homo sapiens
agtaagatatctca

SEQ ID NO: 666002 - DNA, 12 bp, Homo sapiens
agtaagattgat

SEQ ID NO: 666003 - DNA, 13 bp, Homo sapiens
agtaatggcagag

SEQ ID NO: 666004 - DNA, 15 bp, Homo sapiens
agtaattcttttctg

SEQ ID NO: 666005 - DNA, 14 bp, Homo sapiens
agtaatttcattta

SEQ ID NO: 666006 - DNA, 18 bp, Homo sapiens
agtacaaatgaagaaagt

SEQ ID NO: 666007 - DNA, 15 bp, Homo sapiens
agtacagcatgtgcc

SEQ ID NO: 666008 - DNA, 23 bp, Homo sapiens
agtacctctcaagctagtgtttc

SEQ ID NO: 666009 - DNA, 13 bp, Homo sapiens
agtaccttgcttc

SEQ ID NO: 666010 - DNA, 12 bp, Homo sapiens
agtactctttaa

SEQ ID NO: 666011 - DNA, 14 bp, Homo sapiens
agtactctttaaca

SEQ ID NO: 666012 - DNA, 13 bp, Homo sapiens
gtagctctgctgc

SEQ ID NO: 666013 - DNA, 17 bp, Homo sapiens
gtagctgggatgacagg

SEQ ID NO: 666014 - DNA, 18 bp, Homo sapiens
gtaggatttttttcctcc

SEQ ID NO: 666015 - DNA, 21 bp, Homo sapiens
gtaggatttttttcctcccca

SEQ ID NO: 666016 - DNA, 16 bp, Homo sapiens
gtagggatatggcagg

SEQ ID NO: 666017 - DNA, 23 bp, Homo sapiens
gtagggatatggcaggactcctg

SEQ ID NO: 666018 - DNA, 13 bp, Homo sapiens
gtaggtaagactg

SEQ ID NO: 666019 - DNA, 16 bp, Homo sapiens
gtagtgtggcctgtgc

SEQ ID NO: 666020 - DNA, 19 bp, Homo sapiens
gtagtttatggcagaaggg

SEQ ID NO: 666021 - DNA, 21 bp, Homo sapiens
gtagtttatggcagaagggaa

SEQ ID NO: 666022 - DNA, 20 bp, Homo sapiens
gtagtttttatatgttgtaa

SEQ ID NO: 666023 - DNA, 12 bp, Homo sapiens
gtataaaataca

SEQ ID NO: 666024 - DNA, 20 bp, Homo sapiens
gtataaaatacatagtgaaa

SEQ ID NO: 666025 - DNA, 21 bp, Homo sapiens
gtatataagtactgaccactg

SEQ ID NO: 666026 - DNA, 12 bp, Homo sapiens
gtatataatttt

SEQ ID NO: 666027 - DNA, 19 bp, Homo sapiens
gtatatactttgccactgc

SEQ ID NO: 666028 - DNA, 20 bp, Homo sapiens
gtatatatggatcagaggag

SEQ ID NO: 666029 - DNA, 18 bp, Homo sapiens
gtatatcactaaaagcat

SEQ ID NO: 666030 - DNA, 19 bp, Homo sapiens
gtatatcactaaaagcatg

SEQ ID NO: 666031 - DNA, 21 bp, Homo sapiens
gtatatcactaaaagcatgaa

SEQ ID NO: 666032 - DNA, 24 bp, Homo sapiens
gtatattccttttaaagaagcttt

SEQ ID NO: 666033 - DNA, 18 bp, Homo sapiens
gtatatttgttgggaaag

SEQ ID NO: 666034 - DNA, 14 bp, Homo sapiens
gtatatttgtttta

SEQ ID NO: 666035 - DNA, 21 bp, Homo sapiens
gtatatttgttttatgctact

SEQ ID NO: 666036 - DNA, 21 bp, Homo sapiens
gtatccaaggaaacattttat

SEQ ID NO: 666037 - DNA, 17 bp, Homo sapiens
gtatcctccctggcaga

SEQ ID NO: 666038 - DNA, 19 bp, Homo sapiens
gtatcctccctggcagaca

SEQ ID NO: 666039 - DNA, 17 bp, Homo sapiens
gtatcctggccctgggg

SEQ ID NO: 666040 - DNA, 21 bp, Homo sapiens
gtatctgtttacatccagagt

SEQ ID NO: 666041 - DNA, 15 bp, Homo sapiens
gtatctttccaggct

SEQ ID NO: 666042 - DNA, 18 bp, Homo sapiens
gtatcttttatcctggga

SEQ ID NO: 666043 - DNA, 19 bp, Homo sapiens
gtatcttttatcctgggag

SEQ ID NO: 666044 - DNA, 20 bp, Homo sapiens
gtatgactaaagagagaatg

SEQ ID NO: 666045 - DNA, 21 bp, Homo sapiens
gtatgctgatcatcgccagag

SEQ ID NO: 666046 - DNA, 16 bp, Homo sapiens
gtatggaagttttcct

SEQ ID NO: 666047 - DNA, 15 bp, Homo sapiens
gtatgtaaagttaaa

SEQ ID NO: 666048 - DNA, 22 bp, Homo sapiens
gtatgtaatgtgtggtggcctc

SEQ ID NO: 666049 - DNA, 23 bp, Homo sapiens
gtatgtaatgtgtggtggcctca

SEQ ID NO: 666050 - DNA, 22 bp, Homo sapiens
gtattactgaataatatcaaat

SEQ ID NO: 666051 - DNA, 20 bp, Homo sapiens
gtattatacatgtgatacat

SEQ ID NO: 666052 - DNA, 23 bp, Homo sapiens
gtattatccacaattattggcaa

SEQ ID NO: 666053 - DNA, 17 bp, Homo sapiens
gtattgatttttaagaa

SEQ ID NO: 666054 - DNA, 14 bp, Homo sapiens
gtattgccccctct

SEQ ID NO: 666055 - DNA, 23 bp, Homo sapiens
gtattgtgttttgctttggaaac

SEQ ID NO: 666056 - DNA, 18 bp, Homo sapiens
gtatttaaaaaaaagaaa

SEQ ID NO: 666057 - DNA, 22 bp, Homo sapiens
gtatttaaactatcttgtgtga

SEQ ID NO: 666058 - DNA, 16 bp, Homo sapiens
gtatttccagtgcaat

SEQ ID NO: 666059 - DNA, 21 bp, Homo sapiens
gtatttctctattttcataat

SEQ ID NO: 666060 - DNA, 17 bp, Homo sapiens
gtattttaagaagacat

SEQ ID NO: 666061 - DNA, 19 bp, Homo sapiens
gtattttcatgaaaatacc

SEQ ID NO: 666062 - DNA, 12 bp, Homo sapiens
gtattttctcca

SEQ ID NO: 666063 - DNA, 15 bp, Homo sapiens
gtcaagacatttgct

SEQ ID NO: 666064 - DNA, 14 bp, Homo sapiens
gtcaagtaagaaga

SEQ ID NO: 666065 - DNA, 18 bp, Homo sapiens
gtcaagtgttaggtcaat

SEQ ID NO: 666066 - DNA, 18 bp, Homo sapiens
gtcacaacccttctctgt

SEQ ID NO: 666067 - DNA, 17 bp, Homo sapiens
gtcaccaagcagtggcc

SEQ ID NO: 666068 - DNA, 14 bp, Homo sapiens
gtcaccaaggaaac

SEQ ID NO: 666069 - DNA, 17 bp, Homo sapiens
gtcaccggtcagtgcct

SEQ ID NO: 666070 - DNA, 18 bp, Homo sapiens
gtcaccggtcagtgcctt

SEQ ID NO: 666071 - DNA, 19 bp, Homo sapiens
gtcaccggtcagtgccttt

SEQ ID NO: 666072 - DNA, 16 bp, Homo sapiens
gtcacctacatatgct

SEQ ID NO: 666073 - DNA, 13 bp, Homo sapiens
gtcagaggagcgc

SEQ ID NO: 666074 - DNA, 13 bp, Homo sapiens
gtcagccacctgg

SEQ ID NO: 666075 - DNA, 17 bp, Homo sapiens
gtcagctactaatgatg

SEQ ID NO: 666076 - DNA, 17 bp, Homo sapiens
gtcagctgctccctggc

SEQ ID NO: 666077 - DNA, 22 bp, Homo sapiens
gtcagggagtgctggctcacag

SEQ ID NO: 666078 - DNA, 18 bp, Homo sapiens
gtcagggtctccttcctt

SEQ ID NO: 666079 - DNA, 20 bp, Homo sapiens
gtcagtagtgctaatgcatt

SEQ ID NO: 666080 - DNA, 10 bp, Homo sapiens
gtcagtgttt

SEQ ID NO: 666081 - DNA, 18 bp, Homo sapiens
gtcataaaatagaataat

SEQ ID NO: 666082 - DNA, 20 bp, Homo sapiens
gtcatagcaagcttttgctc

SEQ ID NO: 666083 - DNA, 21 bp, Homo sapiens
gtcatagcaagcttttgctca

SEQ ID NO: 666084 - DNA, 15 bp, Homo sapiens
gtcatatacatattg

SEQ ID NO: 666085 - DNA, 15 bp, Homo sapiens
gtcatcatcagggcc

SEQ ID NO: 666086 - DNA, 17 bp, Homo sapiens
gtcatctcattccactg

SEQ ID NO: 666087 - DNA, 21 bp, Homo sapiens
gtcatctgatgagaacaagct

SEQ ID NO: 666088 - DNA, 12 bp, Homo sapiens
gtcatgcttcat

SEQ ID NO: 666089 - DNA, 23 bp, Homo sapiens
gtcatgggagagtacaccctttc

SEQ ID NO: 666090 - DNA, 21 bp, Homo sapiens
gtcattcgctactatgattta

SEQ ID NO: 666091 - DNA, 19 bp, Homo sapiens
gtcattgcacataagcttc

SEQ ID NO: 666092 - DNA, 18 bp, Homo sapiens
gtcattgcagtttaagag

SEQ ID NO: 666093 - DNA, 20 bp, Homo sapiens
gtcatttggtgctctgctaa

SEQ ID NO: 666094 - DNA, 19 bp, Homo sapiens
gtccaagacagggctcatt

SEQ ID NO: 666095 - DNA, 21 bp, Homo sapiens
gtccaagacagggctcatttt

SEQ ID NO: 666096 - DNA, 19 bp, Homo sapiens
gtccagcaccttgtgcctg

SEQ ID NO: 666097 - DNA, 14 bp, Homo sapiens
gtccagcctgcccc

SEQ ID NO: 666098 - DNA, 23 bp, Homo sapiens
gtccagcctgccccggagctgga

SEQ ID NO: 666099 - DNA, 17 bp, Homo sapiens
gtccagctcagccctgg

SEQ ID NO: 666100 - DNA, 18 bp, Homo sapiens
gtccagctcagccctggc

SEQ ID NO: 666101 - DNA, 16 bp, Homo sapiens
gtcccaaggagggggc

SEQ ID NO: 666102 - DNA, 15 bp, Homo sapiens
gtcccaattctgccc

SEQ ID NO: 666103 - DNA, 13 bp, Homo sapiens
gtcccacactgtg

SEQ ID NO: 666104 - DNA, 15 bp, Homo sapiens
gtcccacactgtggc

SEQ ID NO: 666105 - DNA, 16 bp, Homo sapiens
gtccccagctgagtga

SEQ ID NO: 666106 - DNA, 15 bp, Homo sapiens
gtccccgctgctgtg

SEQ ID NO: 666107 - DNA, 16 bp, Homo sapiens
gtcccggtgtatcctg

SEQ ID NO: 666108 - DNA, 23 bp, Homo sapiens
gtcccggtgtatcctggccctgg

SEQ ID NO: 666109 - DNA, 21 bp, Homo sapiens
gtccctagcagcccaccctgc

SEQ ID NO: 666110 - DNA, 21 bp, Homo sapiens
gtccctataataaaggctgag

SEQ ID NO: 666111 - DNA, 16 bp, Homo sapiens
gtccctcttctggttt

SEQ ID NO: 666112 - DNA, 14 bp, Homo sapiens
gtgtatcctggccc

SEQ ID NO: 666113 - DNA, 16 bp, Homo sapiens
gtgtatgactaaagag

SEQ ID NO: 666114 - DNA, 19 bp, Homo sapiens
gtgtatttccagtgcaatt

SEQ ID NO: 666115 - DNA, 16 bp, Homo sapiens
gtgtcagtatccaggc

SEQ ID NO: 666116 - DNA, 21 bp, Homo sapiens
gtgtcatataaactcatttat

SEQ ID NO: 666117 - DNA, 17 bp, Homo sapiens
gtgtcatttcttcactt

SEQ ID NO: 666118 - DNA, 21 bp, Homo sapiens
gtgtcctggtgagaaaatata

SEQ ID NO: 666119 - DNA, 21 bp, Homo sapiens
gtgtctgggctcaagctttcc

SEQ ID NO: 666120 - DNA, 14 bp, Homo sapiens
gtgtgaatgcacgt

SEQ ID NO: 666121 - DNA, 11 bp, Homo sapiens
gtgtgaatgtg

SEQ ID NO: 666122 - DNA, 15 bp, Homo sapiens
gtgtgaatgtgggca

SEQ ID NO: 666123 - DNA, 14 bp, Homo sapiens
gtgtgacagggcca

SEQ ID NO: 666124 - DNA, 23 bp, Homo sapiens
gtgtgacagggccagtggggcct

SEQ ID NO: 666125 - DNA, 19 bp, Homo sapiens
gtgtgacagtttccaaatt

SEQ ID NO: 666126 - DNA, 18 bp, Homo sapiens
gtgtgagtgtgacagggc

SEQ ID NO: 666127 - DNA, 18 bp, Homo sapiens
gtgtgatccggtttcttt

SEQ ID NO: 666128 - DNA, 14 bp, Homo sapiens
gtgtgccctgtgtg

SEQ ID NO: 666129 - DNA, 16 bp, Homo sapiens
gtgtggtggcctcagc

SEQ ID NO: 666130 - DNA, 20 bp, Homo sapiens
gtgtgtacaaatacatgtgt

SEQ ID NO: 666131 - DNA, 22 bp, Homo sapiens
gtgtgtgtacaaatacatgtgt

SEQ ID NO: 666132 - DNA, 11 bp, Homo sapiens
gtgtgttcaag

SEQ ID NO: 666133 - DNA, 15 bp, Homo sapiens
gtgttagtggcaccg

SEQ ID NO: 666134 - DNA, 17 bp, Homo sapiens
gtgttcagctctttcca

SEQ ID NO: 666135 - DNA, 16 bp, Homo sapiens
gtgttcaggcattcca

SEQ ID NO: 666136 - DNA, 17 bp, Homo sapiens
gtgtttgtttttgcaca

SEQ ID NO: 666137 - DNA, 15 bp, Homo sapiens
gttaaataactgtgt

SEQ ID NO: 666138 - DNA, 14 bp, Homo sapiens
gttaaattcagtaa

SEQ ID NO: 666139 - DNA, 15 bp, Homo sapiens
gttaaattcagtaat

SEQ ID NO: 666140 - DNA, 18 bp, Homo sapiens
gttaatgatggcagagga

SEQ ID NO: 666141 - DNA, 15 bp, Homo sapiens
gttaatgttatatca

SEQ ID NO: 666142 - DNA, 18 bp, Homo sapiens
gttacactttttggaagt

SEQ ID NO: 666143 - DNA, 22 bp, Homo sapiens
gttacactttttggaagtgaaa

SEQ ID NO: 666144 - DNA, 13 bp, Homo sapiens
gttacagagacct

SEQ ID NO: 666145 - DNA, 17 bp, Homo sapiens
gttacagagacctatgt

SEQ ID NO: 666146 - DNA, 18 bp, Homo sapiens
gttacataaggatgactt

SEQ ID NO: 666147 - DNA, 19 bp, Homo sapiens
gttaccaatgtaacactgg

SEQ ID NO: 666148 - DNA, 11 bp, Homo sapiens
gttagctttcc

SEQ ID NO: 666149 - DNA, 18 bp, Homo sapiens
gttaggcattaatgtttc

SEQ ID NO: 666150 - DNA, 17 bp, Homo sapiens
gttagtaatggcagagc

SEQ ID NO: 666151 - DNA, 16 bp, Homo sapiens
gttagttccactgaga

SEQ ID NO: 666152 - DNA, 13 bp, Homo sapiens
gttataagaagaa

SEQ ID NO: 666153 - DNA, 14 bp, Homo sapiens
gttatgtttgaatg

SEQ ID NO: 666154 - DNA, 13 bp, Homo sapiens
gttattatgggat

SEQ ID NO: 666155 - DNA, 16 bp, Homo sapiens
gttattgttgttgcca

SEQ ID NO: 666156 - DNA, 13 bp, Homo sapiens
gttatttcttccc

SEQ ID NO: 666157 - DNA, 14 bp, Homo sapiens
gttatttcttccct

SEQ ID NO: 666158 - DNA, 22 bp, Homo sapiens
gttatttcttccctgctttgca

SEQ ID NO: 666159 - DNA, 15 bp, Homo sapiens
gttattttgataaca

SEQ ID NO: 666160 - DNA, 17 bp, Homo sapiens
gttcacattagaattag

SEQ ID NO: 666161 - DNA, 15 bp, Homo sapiens
gttcagacaagacag

SEQ ID NO: 666162 - DNA, 16 bp, Homo sapiens
gttcagacacagctct

SEQ ID NO: 666163 - DNA, 22 bp, Homo sapiens
gttcatagagttcccatgaact

SEQ ID NO: 666164 - DNA, 16 bp, Homo sapiens
gttcatttctaaattt

SEQ ID NO: 666165 - DNA, 12 bp, Homo sapiens
gttccactgaga

SEQ ID NO: 666166 - DNA, 16 bp, Homo sapiens
gttccagtgtctgtct

SEQ ID NO: 666167 - DNA, 18 bp, Homo sapiens
gttccccctgtttcagag

SEQ ID NO: 666168 - DNA, 13 bp, Homo sapiens
gttccctgctgcg

SEQ ID NO: 666169 - DNA, 16 bp, Homo sapiens
gttccctgctgcgctg

SEQ ID NO: 666170 - DNA, 22 bp, Homo sapiens
gttccctgctgcgctgcttggt

SEQ ID NO: 666171 - DNA, 23 bp, Homo sapiens
gttcctctgctcaccgcccatca

SEQ ID NO: 666172 - DNA, 17 bp, Homo sapiens
gttccttatccctctct

SEQ ID NO: 666173 - DNA, 21 bp, Homo sapiens
gttccttggtcctagtaagaa

SEQ ID NO: 666174 - DNA, 16 bp, Homo sapiens
gttcgatacctggagc

SEQ ID NO: 666175 - DNA, 16 bp, Homo sapiens
gttctacactcatctt

SEQ ID NO: 666176 - DNA, 20 bp, Homo sapiens
gttctaggctaccagaagag

SEQ ID NO: 666177 - DNA, 20 bp, Homo sapiens
gttctcctgaatattttttg

SEQ ID NO: 666178 - DNA, 15 bp, Homo sapiens
gttctgagaaggtga

SEQ ID NO: 666179 - DNA, 15 bp, Homo sapiens
gttctgccagatctt

SEQ ID NO: 666180 - DNA, 14 bp, Homo sapiens
gttctggggggacc

SEQ ID NO: 666181 - DNA, 18 bp, Homo sapiens
gttctgtggttcctctgc

SEQ ID NO: 666182 - DNA, 15 bp, Homo sapiens
gttcttaaatgttta

SEQ ID NO: 666183 - DNA, 22 bp, Homo sapiens
gttgaaaatgcaactctaactc

SEQ ID NO: 666184 - DNA, 16 bp, Homo sapiens
gttgactttcctccca

SEQ ID NO: 666185 - DNA, 19 bp, Homo sapiens
gttgattaagaaaggaagt

SEQ ID NO: 666186 - DNA, 21 bp, Homo sapiens
gttgcatatagttaaactgag

SEQ ID NO: 666187 - DNA, 15 bp, Homo sapiens
gttgcctgaaaaatg

SEQ ID NO: 666188 - DNA, 15 bp, Homo sapiens
gttgccttgcatttg

SEQ ID NO: 666189 - DNA, 20 bp, Homo sapiens
gttgctctaggaagacattt

SEQ ID NO: 666190 - DNA, 14 bp, Homo sapiens
gttgcttgtcttct

SEQ ID NO: 666191 - DNA, 22 bp, Homo sapiens
gttggcaaacgagactttctcc

SEQ ID NO: 666192 - DNA, 13 bp, Homo sapiens
gttggggtgacag

SEQ ID NO: 666193 - DNA, 19 bp, Homo sapiens
gttggtctgccttctgctg

SEQ ID NO: 666194 - DNA, 20 bp, Homo sapiens
gttggttaaataaacttttt

SEQ ID NO: 666195 - DNA, 21 bp, Homo sapiens
gttgtatatcactaaaagcat

SEQ ID NO: 666196 - DNA, 22 bp, Homo sapiens
gttgtatgtttgctgattattt

SEQ ID NO: 666197 - DNA, 20 bp, Homo sapiens
gttgtattgatttttaagaa

SEQ ID NO: 666198 - DNA, 22 bp, Homo sapiens
gttgtcaagaatagcattgtaa

SEQ ID NO: 666199 - DNA, 21 bp, Homo sapiens
gttgtctccacttgtatatat

SEQ ID NO: 666200 - DNA, 22 bp, Homo sapiens
gttgtcttatgtgaaaaattaa

SEQ ID NO: 666201 - DNA, 16 bp, Homo sapiens
gtttaaaaagatgaaa

SEQ ID NO: 666202 - DNA, 19 bp, Homo sapiens
gtttaaaatgtaatttaaa

SEQ ID NO: 666203 - DNA, 20 bp, Homo sapiens
gtttaaaatgtaatttaaat

SEQ ID NO: 666204 - DNA, 16 bp, Homo sapiens
taccagcagaaaacct

SEQ ID NO: 666205 - DNA, 14 bp, Homo sapiens
taccaggtgttcta

SEQ ID NO: 666206 - DNA, 13 bp, Homo sapiens
taccattcagatc

SEQ ID NO: 666207 - DNA, 15 bp, Homo sapiens
taccattcagatcac

SEQ ID NO: 666208 - DNA, 18 bp, Homo sapiens
taccatttagtaagaata

SEQ ID NO: 666209 - DNA, 15 bp, Homo sapiens
tacccatagacatga

SEQ ID NO: 666210 - DNA, 21 bp, Homo sapiens
tacccccaggtggaaggcaga

SEQ ID NO: 666211 - DNA, 11 bp, Homo sapiens
taccctgggtg

SEQ ID NO: 666212 - DNA, 16 bp, Homo sapiens
tacccttttccccctt

SEQ ID NO: 666213 - DNA, 20 bp, Homo sapiens
tacccttttcccccttccca

SEQ ID NO: 666214 - DNA, 13 bp, Homo sapiens
tacctaacatctg

SEQ ID NO: 666215 - DNA, 14 bp, Homo sapiens
tacctaccagtatt

SEQ ID NO: 666216 - DNA, 15 bp, Homo sapiens
tacctcaatttttgt

SEQ ID NO: 666217 - DNA, 11 bp, Homo sapiens
tacctccctcc

SEQ ID NO: 666218 - DNA, 12 bp, Homo sapiens
tacctctctgtc

SEQ ID NO: 666219 - DNA, 14 bp, Homo sapiens
tacctgctggaaga

SEQ ID NO: 666220 - DNA, 15 bp, Homo sapiens
tacctggagcagagg

SEQ ID NO: 666221 - DNA, 16 bp, Homo sapiens
tacctggtccccactg

SEQ ID NO: 666222 - DNA, 11 bp, Homo sapiens
tacctgtgtgt

SEQ ID NO: 666223 - DNA, 23 bp, Homo sapiens
taccttatcttacaatattgatt

SEQ ID NO: 666224 - DNA, 17 bp, Homo sapiens
taccttatttatttttg

SEQ ID NO: 666225 - DNA, 21 bp, Homo sapiens
taccttatttatttttgtgta

SEQ ID NO: 666226 - DNA, 15 bp, Homo sapiens
taccttgaaaggaag

SEQ ID NO: 666227 - DNA, 18 bp, Homo sapiens
taccttgaaatgctgtta

SEQ ID NO: 666228 - DNA, 16 bp, Homo sapiens
tacctttaattttaat

SEQ ID NO: 666229 - DNA, 18 bp, Homo sapiens
tacctttctctctctaag

SEQ ID NO: 666230 - DNA, 20 bp, Homo sapiens
taccttttctcttttctttc

SEQ ID NO: 666231 - DNA, 18 bp, Homo sapiens
taccttttttttttcttg

SEQ ID NO: 666232 - DNA, 16 bp, Homo sapiens
tactaactaaatacca

SEQ ID NO: 666233 - DNA, 22 bp, Homo sapiens
tactattaggaaaataaacaga

SEQ ID NO: 666234 - DNA, 21 bp, Homo sapiens
tactatttaagatgtgaaaat

SEQ ID NO: 666235 - DNA, 19 bp, Homo sapiens
tactattttctacaattaa

SEQ ID NO: 666236 - DNA, 15 bp, Homo sapiens
tactcccccaccact

SEQ ID NO: 666237 - DNA, 23 bp, Homo sapiens
tactcccccaccactcaggccac

SEQ ID NO: 666238 - DNA, 17 bp, Homo sapiens
tactcctagaagaacca

SEQ ID NO: 666239 - DNA, 13 bp, Homo sapiens
tactcctgcctca

SEQ ID NO: 666240 - DNA, 17 bp, Homo sapiens
tactcctttttattcat

SEQ ID NO: 666241 - DNA, 22 bp, Homo sapiens
tactcgtgcattaaaatttctt

SEQ ID NO: 666242 - DNA, 17 bp, Homo sapiens
tactctggggtgctgcc

SEQ ID NO: 666243 - DNA, 17 bp, Homo sapiens
tactctttgaaagcttt

SEQ ID NO: 666244 - DNA, 17 bp, Homo sapiens
tactgaactgaaaggat

SEQ ID NO: 666245 - DNA, 13 bp, Homo sapiens
tactgaattgtat

SEQ ID NO: 666246 - DNA, 15 bp, Homo sapiens
tactgaattgtatca

SEQ ID NO: 666247 - DNA, 18 bp, Homo sapiens
tactgacaataaaaatgt

SEQ ID NO: 666248 - DNA, 15 bp, Homo sapiens
tactgaggtgctatg

SEQ ID NO: 666249 - DNA, 12 bp, Homo sapiens
tactgccctttc

SEQ ID NO: 666250 - DNA, 13 bp, Homo sapiens
tactgccttgaaa

SEQ ID NO: 666251 - DNA, 22 bp, Homo sapiens
tactgggtaaaagcagggcagc

SEQ ID NO: 666252 - DNA, 21 bp, Homo sapiens
gtctcccctcctgcacacagg

SEQ ID NO: 666253 - DNA, 18 bp, Homo sapiens
gtctcccgtgcatgctct

SEQ ID NO: 666254 - DNA, 23 bp, Homo sapiens
gtctcccgtgcatgctctgcagc

SEQ ID NO: 666255 - DNA, 20 bp, Homo sapiens
gtctcttcttggggcccagt

SEQ ID NO: 666256 - DNA, 23 bp, Homo sapiens
gtctcttcttggggcccagtgca

SEQ ID NO: 666257 - DNA, 22 bp, Homo sapiens
gtctgaaactggcttccccact

SEQ ID NO: 666258 - DNA, 16 bp, Homo sapiens
gtctgaggcctgcccc

SEQ ID NO: 666259 - DNA, 17 bp, Homo sapiens
gtctgaggcctgccccc

SEQ ID NO: 666260 - DNA, 20 bp, Homo sapiens
gtctgaggcctgccccctgg

SEQ ID NO: 666261 - DNA, 19 bp, Homo sapiens
gtctgatccatccatctct

SEQ ID NO: 666262 - DNA, 13 bp, Homo sapiens
gtctgccttcaca

SEQ ID NO: 666263 - DNA, 23 bp, Homo sapiens
gtctgccttctgctgaaagactc

SEQ ID NO: 666264 - DNA, 22 bp, Homo sapiens
gtctgctgagttggcctggcca

SEQ ID NO: 666265 - DNA, 16 bp, Homo sapiens
gtctggactgctattc

SEQ ID NO: 666266 - DNA, 18 bp, Homo sapiens
gtctgggctcaagctttc

SEQ ID NO: 666267 - DNA, 23 bp, Homo sapiens
gtctggttttgtcccttccagga

SEQ ID NO: 666268 - DNA, 21 bp, Homo sapiens
gtctgtccaaatttaaaatgt

SEQ ID NO: 666269 - DNA, 18 bp, Homo sapiens
gtctgtgtcatttcttca

SEQ ID NO: 666270 - DNA, 16 bp, Homo sapiens
gtctgtgtgaatgtgg

SEQ ID NO: 666271 - DNA, 21 bp, Homo sapiens
gtcttaagatggaaatacagt

SEQ ID NO: 666272 - DNA, 17 bp, Homo sapiens
gtcttacaatcaaatct

SEQ ID NO: 666273 - DNA, 20 bp, Homo sapiens
gtcttatgtgaaaaattaac

SEQ ID NO: 666274 - DNA, 22 bp, Homo sapiens
gtcttatgtgaaaaattaactt

SEQ ID NO: 666275 - DNA, 14 bp, Homo sapiens
gtcttattcttaag

SEQ ID NO: 666276 - DNA, 22 bp, Homo sapiens
gtcttatttaaccaggggtcct

SEQ ID NO: 666277 - DNA, 22 bp, Homo sapiens
gtcttgactgttagttgtccac

SEQ ID NO: 666278 - DNA, 22 bp, Homo sapiens
gtcttgagccagtaatctttat

SEQ ID NO: 666279 - DNA, 17 bp, Homo sapiens
gtcttgatgactgctga

SEQ ID NO: 666280 - DNA, 16 bp, Homo sapiens
gtcttgatgttttttc

SEQ ID NO: 666281 - DNA, 22 bp, Homo sapiens
gtcttgtggttgtgtgtgttct

SEQ ID NO: 666282 - DNA, 16 bp, Homo sapiens
gtctttcatggctgct

SEQ ID NO: 666283 - DNA, 23 bp, Homo sapiens
gtctttcatggctgctgttgctt

SEQ ID NO: 666284 - DNA, 13 bp, Homo sapiens
gtctttcttgaaa

SEQ ID NO: 666285 - DNA, 21 bp, Homo sapiens
gtctttcttgaaattgaagag

SEQ ID NO: 666286 - DNA, 12 bp, Homo sapiens
gtgaaaagaata

SEQ ID NO: 666287 - DNA, 21 bp, Homo sapiens
gtgaaacagggcttgtccctc

SEQ ID NO: 666288 - DNA, 15 bp, Homo sapiens
gtgaaattaagcatt

SEQ ID NO: 666289 - DNA, 14 bp, Homo sapiens
gtgaaattattttg

SEQ ID NO: 666290 - DNA, 19 bp, Homo sapiens
gtgaagagggagaagcatg

SEQ ID NO: 666291 - DNA, 18 bp, Homo sapiens
gtgaagttttactgtcta

SEQ ID NO: 666292 - DNA, 16 bp, Homo sapiens
gtgaataatggcactg

SEQ ID NO: 666293 - DNA, 14 bp, Homo sapiens
gtgaatgtgggcac

SEQ ID NO: 666294 - DNA, 15 bp, Homo sapiens
gtgaatttttattgt

SEQ ID NO: 666295 - DNA, 13 bp, Homo sapiens
gtgacagggccag

SEQ ID NO: 666296 - DNA, 19 bp, Homo sapiens
gtgacagggccagtggggc

SEQ ID NO: 666297 - DNA, 11 bp, Homo sapiens
gtgacagtcat

SEQ ID NO: 666298 - DNA, 19 bp, Homo sapiens
gtgacagtcatcatcaggg

SEQ ID NO: 666299 - DNA, 20 bp, Homo sapiens
gtgacagtcatcatcagggc

SEQ ID NO: 666300 - DNA, 15 bp, Homo sapiens
gtgacagtttccaaa

SEQ ID NO: 666301 - DNA, 16 bp, Homo sapiens
gtgacagtttccaaat

SEQ ID NO: 666302 - DNA, 21 bp, Homo sapiens
gtgacccccttgattcccacc

SEQ ID NO: 666303 - DNA, 23 bp, Homo sapiens
gtgacccccttgattcccaccgt

SEQ ID NO: 666304 - DNA, 22 bp, Homo sapiens
gtgacctctctaggtgtgtcca

SEQ ID NO: 666305 - DNA, 17 bp, Homo sapiens
gtgagaacccagtttcc

SEQ ID NO: 666306 - DNA, 20 bp, Homo sapiens
gtgagaaggtttattgttaa

SEQ ID NO: 666307 - DNA, 23 bp, Homo sapiens
gtgagtgggagagtacctgtgtg

SEQ ID NO: 666308 - DNA, 15 bp, Homo sapiens
gtgagtgtgacaggg

SEQ ID NO: 666309 - DNA, 20 bp, Homo sapiens
gtgagtgtgacagggccagt

SEQ ID NO: 666310 - DNA, 18 bp, Homo sapiens
gtgatatttcgtgtactg

SEQ ID NO: 666311 - DNA, 17 bp, Homo sapiens
gtgatttgaaaaatata

SEQ ID NO: 666312 - DNA, 14 bp, Homo sapiens
gtgcaaattgtatc

SEQ ID NO: 666313 - DNA, 22 bp, Homo sapiens
gtgcagaatgtaagtgggccca

SEQ ID NO: 666314 - DNA, 16 bp, Homo sapiens
gtgcagacagaagtct

SEQ ID NO: 666315 - DNA, 19 bp, Homo sapiens
gtgcataatgataaaataa

SEQ ID NO: 666316 - DNA, 22 bp, Homo sapiens
gtgcatacgcctcttgttcatg

SEQ ID NO: 666317 - DNA, 22 bp, Homo sapiens
gtgcatctcctcccgcccttcc

SEQ ID NO: 666318 - DNA, 13 bp, Homo sapiens
gtgcatgctctgc

SEQ ID NO: 666319 - DNA, 16 bp, Homo sapiens
gtgcatggaggccctc

SEQ ID NO: 666320 - DNA, 15 bp, Homo sapiens
gtgcatggtggccag

SEQ ID NO: 666321 - DNA, 16 bp, Homo sapiens
gtgcatggtggccaga

SEQ ID NO: 666322 - DNA, 17 bp, Homo sapiens
gtgcatgtctgttcttc

SEQ ID NO: 666323 - DNA, 20 bp, Homo sapiens
gtgcatttttggatcatttt

SEQ ID NO: 666324 - DNA, 15 bp, Homo sapiens
gtgccaactcctcac

SEQ ID NO: 666325 - DNA, 22 bp, Homo sapiens
gtgccactcaccgaagccactt

SEQ ID NO: 666326 - DNA, 15 bp, Homo sapiens
gtgccagaggccaga

SEQ ID NO: 666327 - DNA, 14 bp, Homo sapiens
gtgcccaggggagc

SEQ ID NO: 666328 - DNA, 23 bp, Homo sapiens
gtgcccgactgactggaggaggc

SEQ ID NO: 666329 - DNA, 18 bp, Homo sapiens
gtgccctcgcctcctcct

SEQ ID NO: 666330 - DNA, 19 bp, Homo sapiens
gtgcctggttaatattaat

SEQ ID NO: 666331 - DNA, 21 bp, Homo sapiens
gtgccttttgcagaagagggt

SEQ ID NO: 666332 - DNA, 15 bp, Homo sapiens
gtgcgattctggata

SEQ ID NO: 666333 - DNA, 20 bp, Homo sapiens
gtgctaatgcattttgcact

SEQ ID NO: 666334 - DNA, 15 bp, Homo sapiens
gtgctatgaagccaa

SEQ ID NO: 666335 - DNA, 23 bp, Homo sapiens
gtgctccatatttgatttctaat

SEQ ID NO: 666336 - DNA, 17 bp, Homo sapiens
gtgctccgtagctctgc

SEQ ID NO: 666337 - DNA, 19 bp, Homo sapiens
gtgctccgtagctctgctg

SEQ ID NO: 666338 - DNA, 22 bp, Homo sapiens
gtgctccgtagctctgctgctg

SEQ ID NO: 666339 - DNA, 17 bp, Homo sapiens
gtgctgagtaaacataa

SEQ ID NO: 666340 - DNA, 14 bp, Homo sapiens
gtgctggctcacag

SEQ ID NO: 666341 - DNA, 19 bp, Homo sapiens
gtgctggctcacagtacag

SEQ ID NO: 666342 - DNA, 20 bp, Homo sapiens
gtgctgggattacaggcgtg

SEQ ID NO: 666343 - DNA, 15 bp, Homo sapiens
gtggaaggcagacag

SEQ ID NO: 666344 - DNA, 13 bp, Homo sapiens
gtggagaccacac

SEQ ID NO: 666345 - DNA, 15 bp, Homo sapiens
gtggagggaggcccc

SEQ ID NO: 666346 - DNA, 16 bp, Homo sapiens
gtggcaatctgtgggc

SEQ ID NO: 666347 - DNA, 22 bp, Homo sapiens
taggtatgatctcttctggtgt

SEQ ID NO: 666348 - DNA, 23 bp, Homo sapiens
taggtcaataacactgtatttta

SEQ ID NO: 666349 - DNA, 12 bp, Homo sapiens
taggtcctggct

SEQ ID NO: 666350 - DNA, 22 bp, Homo sapiens
taggtggtaaaacctgttctcc

SEQ ID NO: 666351 - DNA, 21 bp, Homo sapiens
taggtgtctgccttcacaaat

SEQ ID NO: 666352 - DNA, 17 bp, Homo sapiens
taggtttctctccctcc

SEQ ID NO: 666353 - DNA, 16 bp, Homo sapiens
tagtaaatcagaaagt

SEQ ID NO: 666354 - DNA, 16 bp, Homo sapiens
tagtaagcatagaaac

SEQ ID NO: 666355 - DNA, 17 bp, Homo sapiens
tagtaggaatgtacatg

SEQ ID NO: 666356 - DNA, 15 bp, Homo sapiens
tagtagtgtggcctg

SEQ ID NO: 666357 - DNA, 16 bp, Homo sapiens
tagtcaatttctactt

SEQ ID NO: 666358 - DNA, 13 bp, Homo sapiens
tagtccaaaatta

SEQ ID NO: 666359 - DNA, 17 bp, Homo sapiens
tagtctagcattctgca

SEQ ID NO: 666360 - DNA, 18 bp, Homo sapiens
tagtctgaaactggcttc

SEQ ID NO: 666361 - DNA, 22 bp, Homo sapiens
tagtcttccacaaaaaatactt

SEQ ID NO: 666362 - DNA, 20 bp, Homo sapiens
tagtgaaaattgtttagtga

SEQ ID NO: 666363 - DNA, 22 bp, Homo sapiens
tagtgcctgagagtatttaggc

SEQ ID NO: 666364 - DNA, 22 bp, Homo sapiens
tagtgctaatgcattttgcact

SEQ ID NO: 666365 - DNA, 15 bp, Homo sapiens
tagtgggtacatcaa

SEQ ID NO: 666366 - DNA, 14 bp, Homo sapiens
tagtggtcataaaa

SEQ ID NO: 666367 - DNA, 15 bp, Homo sapiens
tagtggtgagcatgt

SEQ ID NO: 666368 - DNA, 18 bp, Homo sapiens
tagtgtacatttctataa

SEQ ID NO: 666369 - DNA, 23 bp, Homo sapiens
tagtgtacatttctataaataga

SEQ ID NO: 666370 - DNA, 22 bp, Homo sapiens
tagttaaactgagagtaattca

SEQ ID NO: 666371 - DNA, 14 bp, Homo sapiens
tagttccactgaga

SEQ ID NO: 666372 - DNA, 13 bp, Homo sapiens
tagttgccaacag

SEQ ID NO: 666373 - DNA, 14 bp, Homo sapiens
tagttgccaacagt

SEQ ID NO: 666374 - DNA, 19 bp, Homo sapiens
tagttgccaacagttgtat

SEQ ID NO: 666375 - DNA, 15 bp, Homo sapiens
tagtttgtctatttt

SEQ ID NO: 666376 - DNA, 18 bp, Homo sapiens
tagttttgtgaaggtgat

SEQ ID NO: 666377 - DNA, 18 bp, Homo sapiens
tataaaacttaaaaacaa

SEQ ID NO: 666378 - DNA, 15 bp, Homo sapiens
tataaaatacatagt

SEQ ID NO: 666379 - DNA, 21 bp, Homo sapiens
tataaaatcctgtgcaataga

SEQ ID NO: 666380 - DNA, 12 bp, Homo sapiens
tataaaattatg

SEQ ID NO: 666381 - DNA, 16 bp, Homo sapiens
tataaacagaaatgga

SEQ ID NO: 666382 - DNA, 14 bp, Homo sapiens
tataaatatacagt

SEQ ID NO: 666383 - DNA, 12 bp, Homo sapiens
tataaatgtata

SEQ ID NO: 666384 - DNA, 20 bp, Homo sapiens
tataaatgtataaatataca

SEQ ID NO: 666385 - DNA, 13 bp, Homo sapiens
tataacacatttt

SEQ ID NO: 666386 - DNA, 23 bp, Homo sapiens
tataacacatttttttgcatgca

SEQ ID NO: 666387 - DNA, 17 bp, Homo sapiens
tataaccagctgaagtt

SEQ ID NO: 666388 - DNA, 19 bp, Homo sapiens
tataagacatttgtttgct

SEQ ID NO: 666389 - DNA, 12 bp, Homo sapiens
tataataaatat

SEQ ID NO: 666390 - DNA, 14 bp, Homo sapiens
tataataaatatat

SEQ ID NO: 666391 - DNA, 20 bp, Homo sapiens
tataatgttgataatatata

SEQ ID NO: 666392 - DNA, 15 bp, Homo sapiens
tataatttataagca

SEQ ID NO: 666393 - DNA, 17 bp, Homo sapiens
tataatttataagcatt

SEQ ID NO: 666394 - DNA, 20 bp, Homo sapiens
tatacaaattttcagaaggt

SEQ ID NO: 666395 - DNA, 19 bp, Homo sapiens
tatacaggaggatgtgaat

SEQ ID NO: 666396 - DNA, 22 bp, Homo sapiens
tatacagtatagatttttgggt

SEQ ID NO: 666397 - DNA, 19 bp, Homo sapiens
tatacagttgaaaacttgt

SEQ ID NO: 666398 - DNA, 15 bp, Homo sapiens
tatacatattgtata

SEQ ID NO: 666399 - DNA, 21 bp, Homo sapiens
tatttcaataaatctttcaaa

SEQ ID NO: 666400 - DNA, 13 bp, Homo sapiens
tatttcataattg

SEQ ID NO: 666401 - DNA, 19 bp, Homo sapiens
tatttctaatccttttcct

SEQ ID NO: 666402 - DNA, 21 bp, Homo sapiens
tatttctagtccaaaattaca

SEQ ID NO: 666403 - DNA, 14 bp, Homo sapiens
tatttctatgacaa

SEQ ID NO: 666404 - DNA, 16 bp, Homo sapiens
tatttctatgacaaat

SEQ ID NO: 666405 - DNA, 22 bp, Homo sapiens
tatttctcataggctatgccat

SEQ ID NO: 666406 - DNA, 23 bp, Homo sapiens
tatttctcttctacccttttcct

SEQ ID NO: 666407 - DNA, 18 bp, Homo sapiens
tatttctgggtcttttgc

SEQ ID NO: 666408 - DNA, 21 bp, Homo sapiens
tatttctgtttcctatttaat

SEQ ID NO: 666409 - DNA, 18 bp, Homo sapiens
tatttcttatacgctttt

SEQ ID NO: 666410 - DNA, 14 bp, Homo sapiens
tatttgaaggccag

SEQ ID NO: 666411 - DNA, 16 bp, Homo sapiens
tatttgaggtcagtgt

SEQ ID NO: 666412 - DNA, 16 bp, Homo sapiens
tatttgatttctaatt

SEQ ID NO: 666413 - DNA, 12 bp, Homo sapiens
tatttgcaattt

SEQ ID NO: 666414 - DNA, 15 bp, Homo sapiens
tatttgcaatttgag

SEQ ID NO: 666415 - DNA, 19 bp, Homo sapiens
tatttgcaatttgagccat

SEQ ID NO: 666416 - DNA, 17 bp, Homo sapiens
tatttgttatatataat

SEQ ID NO: 666417 - DNA, 21 bp, Homo sapiens
tatttgttatatataataaat

SEQ ID NO: 666418 - DNA, 21 bp, Homo sapiens
tattttacagctcattaaact

SEQ ID NO: 666419 - DNA, 12 bp, Homo sapiens
tattttactatt

SEQ ID NO: 666420 - DNA, 17 bp, Homo sapiens
tattttactattggaat

SEQ ID NO: 666421 - DNA, 16 bp, Homo sapiens
tattttcatacaaatt

SEQ ID NO: 666422 - DNA, 14 bp, Homo sapiens
tattttcatgaaaa

SEQ ID NO: 666423 - DNA, 17 bp, Homo sapiens
tattttctccacttcat

SEQ ID NO: 666424 - DNA, 16 bp, Homo sapiens
tattttgagaaactgc

SEQ ID NO: 666425 - DNA, 21 bp, Homo sapiens
tattttgagaaactgctgcag

SEQ ID NO: 666426 - DNA, 17 bp, Homo sapiens
tattttgatgtaaagat

SEQ ID NO: 666427 - DNA, 20 bp, Homo sapiens
tattttgcactctgtaattg

SEQ ID NO: 666428 - DNA, 20 bp, Homo sapiens
tatttttataattgtacaaa

SEQ ID NO: 666429 - DNA, 13 bp, Homo sapiens
tatttttgacaga

SEQ ID NO: 666430 - DNA, 15 bp, Homo sapiens
tattttttggacttc

SEQ ID NO: 666431 - DNA, 16 bp, Homo sapiens
tatttttttaaaattt

SEQ ID NO: 666432 - DNA, 17 bp, Homo sapiens
tattttttttttcttct

SEQ ID NO: 666433 - DNA, 11 bp, Homo sapiens
tcaaaaaatta

SEQ ID NO: 666434 - DNA, 12 bp, Homo sapiens
tcaaaaaattat

SEQ ID NO: 666435 - DNA, 21 bp, Homo sapiens
tcaaaagaaaattgatatttt

SEQ ID NO: 666436 - DNA, 20 bp, Homo sapiens
tcaaaaggtattatacatgt

SEQ ID NO: 666437 - DNA, 14 bp, Homo sapiens
tcaaaagtttgttt

SEQ ID NO: 666438 - DNA, 22 bp, Homo sapiens
tcaaaatatgtaagaacacatt

SEQ ID NO: 666439 - DNA, 16 bp, Homo sapiens
tcaaaatatttctcat

SEQ ID NO: 666440 - DNA, 14 bp, Homo sapiens
tcaaaatgtctgta

SEQ ID NO: 666441 - DNA, 15 bp, Homo sapiens
tcaaacttactattt

SEQ ID NO: 666442 - DNA, 16 bp, Homo sapiens
tcaaacttactatttt

SEQ ID NO: 666443 - DNA, 18 bp, Homo sapiens
tcaaactttacagaaaga

SEQ ID NO: 666444 - DNA, 15 bp, Homo sapiens
tcaaagaaatattaa

SEQ ID NO: 666445 - DNA, 15 bp, Homo sapiens
tcaaagatgtgttca

SEQ ID NO: 666446 - DNA, 23 bp, Homo sapiens
tcaaagctttcctgtttccaggg

SEQ ID NO: 666447 - DNA, 15 bp, Homo sapiens
tcaaagtatgcaatg

SEQ ID NO: 666448 - DNA, 14 bp, Homo sapiens
tcaaagttgaaaat

SEQ ID NO: 666449 - DNA, 18 bp, Homo sapiens
tcaaataaaatatcataa

SEQ ID NO: 666450 - DNA, 23 bp, Homo sapiens
tcaaataaaatatcataaagcat

SEQ ID NO: 666451 - DNA, 17 bp, Homo sapiens
tcaaatacacatttgct

SEQ ID NO: 666452 - DNA, 17 bp, Homo sapiens
tcaaatcagtgataatt

SEQ ID NO: 666453 - DNA, 15 bp, Homo sapiens
tcaaatctaccactg

SEQ ID NO: 666454 - DNA, 16 bp, Homo sapiens
tcaaatttactttaaa

SEQ ID NO: 666455 - DNA, 15 bp, Homo sapiens
tcaacgcctccccct

SEQ ID NO: 666456 - DNA, 19 bp, Homo sapiens
tcaactacggttgggagaa

SEQ ID NO: 666457 - DNA, 22 bp, Homo sapiens
tcaactacggttgggagaatga

SEQ ID NO: 666458 - DNA, 14 bp, Homo sapiens
tcaacttatttcat

SEQ ID NO: 666459 - DNA, 15 bp, Homo sapiens
tcaacttatttcata

SEQ ID NO: 666460 - DNA, 22 bp, Homo sapiens
tcaacttatttcataattgcct

SEQ ID NO: 666461 - DNA, 23 bp, Homo sapiens
tcccaaggagggggcctcattgt

SEQ ID NO: 666462 - DNA, 17 bp, Homo sapiens
tcccacacccaaagctg

SEQ ID NO: 666463 - DNA, 22 bp, Homo sapiens
tcccacactgtgcagacccagt

SEQ ID NO: 666464 - DNA, 13 bp, Homo sapiens
tcccactgtatga

SEQ ID NO: 666465 - DNA, 18 bp, Homo sapiens
tcccactgtatgatttat

SEQ ID NO: 666466 - DNA, 16 bp, Homo sapiens
tcccagcactttggga

SEQ ID NO: 666467 - DNA, 19 bp, Homo sapiens
tcccagcactttgggaggc

SEQ ID NO: 666468 - DNA, 18 bp, Homo sapiens
tcccagctgccatgtttc

SEQ ID NO: 666469 - DNA, 17 bp, Homo sapiens
tcccaggggtctccctg

SEQ ID NO: 666470 - DNA, 18 bp, Homo sapiens
tcccaggggtctccctgg

SEQ ID NO: 666471 - DNA, 19 bp, Homo sapiens
tcccaggggtctccctggc

SEQ ID NO: 666472 - DNA, 22 bp, Homo sapiens
tcccatgtatttgttatatata

SEQ ID NO: 666473 - DNA, 14 bp, Homo sapiens
tcccatttcttccc

SEQ ID NO: 666474 - DNA, 18 bp, Homo sapiens
tccccaaacaggacagca

SEQ ID NO: 666475 - DNA, 19 bp, Homo sapiens
tccccacagcgtccctggc

SEQ ID NO: 666476 - DNA, 18 bp, Homo sapiens
tccccacaggagccctgc

SEQ ID NO: 666477 - DNA, 17 bp, Homo sapiens
tccccactgctgagctg

SEQ ID NO: 666478 - DNA, 23 bp, Homo sapiens
tccccagcccacctgctcccagg

SEQ ID NO: 666479 - DNA, 15 bp, Homo sapiens
tccccatctccctgc

SEQ ID NO: 666480 - DNA, 19 bp, Homo sapiens
tccccatgggcacagtggt

SEQ ID NO: 666481 - DNA, 24 bp, Homo sapiens
tccccatgggcacagtggtgaccc

SEQ ID NO: 666482 - DNA, 17 bp, Homo sapiens
tccccccacaagtgccc

SEQ ID NO: 666483 - DNA, 17 bp, Homo sapiens
tccccctcccccattcc

SEQ ID NO: 666484 - DNA, 15 bp, Homo sapiens
tccccgtctcattcc

SEQ ID NO: 666485 - DNA, 13 bp, Homo sapiens
tcccctcctgcac

SEQ ID NO: 666486 - DNA, 18 bp, Homo sapiens
tcccctcctgcacacagg

SEQ ID NO: 666487 - DNA, 15 bp, Homo sapiens
tcccctgcccatgct

SEQ ID NO: 666488 - DNA, 21 bp, Homo sapiens
tcccctgcccatgctgggagc

SEQ ID NO: 666489 - DNA, 12 bp, Homo sapiens
tccccttccctt

SEQ ID NO: 666490 - DNA, 18 bp, Homo sapiens
tccccttcctcttgtctg

SEQ ID NO: 666491 - DNA, 13 bp, Homo sapiens
tcccgaagccacc

SEQ ID NO: 666492 - DNA, 14 bp, Homo sapiens
tcccgcagcctcgc

SEQ ID NO: 666493 - DNA, 22 bp, Homo sapiens
tcccgcccttccatgtgccttt

SEQ ID NO: 666494 - DNA, 19 bp, Homo sapiens
tccctataataaaggctga

SEQ ID NO: 666495 - DNA, 17 bp, Homo sapiens
tccctcaaagaggcctt

SEQ ID NO: 666496 - DNA, 16 bp, Homo sapiens
tccctccatttttctc

SEQ ID NO: 666497 - DNA, 14 bp, Homo sapiens
tccctcctccaggc

SEQ ID NO: 666498 - DNA, 16 bp, Homo sapiens
tccctcctccaggcct

SEQ ID NO: 666499 - DNA, 14 bp, Homo sapiens
tccctctcatctca

SEQ ID NO: 666500 - DNA, 15 bp, Homo sapiens
tccctctcttcccct

SEQ ID NO: 666501 - DNA, 18 bp, Homo sapiens
tccctgctgcgctgcttg

SEQ ID NO: 666502 - DNA, 18 bp, Homo sapiens
tccctgctttgcatcttt

SEQ ID NO: 666503 - DNA, 16 bp, Homo sapiens
tccctgggccagggtc

SEQ ID NO: 666504 - DNA, 13 bp, Homo sapiens
tcccttgcctctg

SEQ ID NO: 666505 - DNA, 16 bp, Homo sapiens
tcccttgcctctgccc

SEQ ID NO: 666506 - DNA, 18 bp, Homo sapiens
tcccttgccttcctcagc

SEQ ID NO: 666507 - DNA, 12 bp, Homo sapiens
tccctttggtta

SEQ ID NO: 666508 - DNA, 14 bp, Homo sapiens
tcccttttccctta

SEQ ID NO: 666509 - DNA, 18 bp, Homo sapiens
tccgcagtgtggccaggc

SEQ ID NO: 666510 - DNA, 14 bp, Homo sapiens
tccgctagaagtct

SEQ ID NO: 666511 - DNA, 14 bp, Homo sapiens
tccggcctctgcct

SEQ ID NO: 666512 - DNA, 20 bp, Homo sapiens
tccggtcggatctctctcct

SEQ ID NO: 666513 - DNA, 15 bp, Homo sapiens
tccgtagctctgctg

SEQ ID NO: 666514 - DNA, 16 bp, Homo sapiens
tccgtagctctgctgc

SEQ ID NO: 666515 - DNA, 19 bp, Homo sapiens
tccgtagctctgctgctga

SEQ ID NO: 666516 - DNA, 17 bp, Homo sapiens
tccgtgaactctggtgc

SEQ ID NO: 666517 - DNA, 13 bp, Homo sapiens
tcctaaaactggg

SEQ ID NO: 666518 - DNA, 21 bp, Homo sapiens
tcctaaaactgggattaagaa

SEQ ID NO: 666519 - DNA, 16 bp, Homo sapiens
tcctaacacagcatgt

SEQ ID NO: 666520 - DNA, 13 bp, Homo sapiens
tcctaaggaacct

SEQ ID NO: 666521 - DNA, 14 bp, Homo sapiens
tcctacagtacaat

SEQ ID NO: 666522 - DNA, 21 bp, Homo sapiens
tcctacagtgactccctggga

SEQ ID NO: 666523 - DNA, 22 bp, Homo sapiens
tcctacagtgactccctgggag

SEQ ID NO: 666524 - DNA, 20 bp, Homo sapiens
tcctagaagaaccaaatacc

SEQ ID NO: 666525 - DNA, 21 bp, Homo sapiens
tcctagaagaaccaaatacct

SEQ ID NO: 666526 - DNA, 23 bp, Homo sapiens
tcctagaagaaccaaatacctca

SEQ ID NO: 666527 - DNA, 20 bp, Homo sapiens
tcctagctgtgttattcctg

SEQ ID NO: 666528 - DNA, 13 bp, Homo sapiens
tcctagtaagaag

SEQ ID NO: 666529 - DNA, 20 bp, Homo sapiens
tcctataatataataaatat

SEQ ID NO: 666530 - DNA, 13 bp, Homo sapiens
tcctatccttata

SEQ ID NO: 666531 - DNA, 15 bp, Homo sapiens
tcctattctataaaa

SEQ ID NO: 666532 - DNA, 16 bp, Homo sapiens
tcctcacccacctctg

SEQ ID NO: 666533 - DNA, 17 bp, Homo sapiens
tcctcacccacctctgg

SEQ ID NO: 666534 - DNA, 14 bp, Homo sapiens
tcctcagctgcctc

SEQ ID NO: 666535 - DNA, 21 bp, Homo sapiens
tcctcagggagcagggaaggc

SEQ ID NO: 666536 - DNA, 15 bp, Homo sapiens
tcctcagtccctctt

SEQ ID NO: 666537 - DNA, 16 bp, Homo sapiens
tcctcagtccctcttc

SEQ ID NO: 666538 - DNA, 18 bp, Homo sapiens
tcctcatctccaaggcag

SEQ ID NO: 666539 - DNA, 19 bp, Homo sapiens
tcctccaggcctgcctccc

SEQ ID NO: 666540 - DNA, 22 bp, Homo sapiens
tcctcccgccaggagcttcttc

SEQ ID NO: 666541 - DNA, 13 bp, Homo sapiens
tcctcccgccctt

SEQ ID NO: 666542 - DNA, 19 bp, Homo sapiens
tcctcccgcccttccatgt

SEQ ID NO: 666543 - DNA, 22 bp, Homo sapiens
tcctcctcacccacctctgggt

SEQ ID NO: 666544 - DNA, 13 bp, Homo sapiens
tcctcctccaggg

SEQ ID NO: 666545 - DNA, 15 bp, Homo sapiens
tcctcctccagggtg

SEQ ID NO: 666546 - DNA, 13 bp, Homo sapiens
tcctcctcctgcc

SEQ ID NO: 666547 - DNA, 15 bp, Homo sapiens
tcctcctgccctcct

SEQ ID NO: 666548 - DNA, 15 bp, Homo sapiens
tcctcctgcctttct

SEQ ID NO: 666549 - DNA, 17 bp, Homo sapiens
tcctcctgcctttctca

SEQ ID NO: 666550 - DNA, 17 bp, Homo sapiens
tcctctgggtttctaag

SEQ ID NO: 666551 - DNA, 16 bp, Homo sapiens
tcctctggtgtttatt

SEQ ID NO: 666552 - DNA, 18 bp, Homo sapiens
tcctcttctgctcttttc

SEQ ID NO: 666553 - DNA, 20 bp, Homo sapiens
tcctcttgtctgatttctta

SEQ ID NO: 666554 - DNA, 12 bp, Homo sapiens
tcctgaatattt

SEQ ID NO: 666555 - DNA, 19 bp, Homo sapiens
tcctgaatgtagcgtgtaa

SEQ ID NO: 666556 - DNA, 23 bp, Homo sapiens
tcctgacatttgtttattttttg

SEQ ID NO: 666557 - DNA, 14 bp, Homo sapiens
tcctgactggtgct

SEQ ID NO: 666558 - DNA, 13 bp, Homo sapiens
tcctgagaagcat

SEQ ID NO: 666559 - DNA, 13 bp, Homo sapiens
tcctgagctagga

SEQ ID NO: 666560 - DNA, 13 bp, Homo sapiens
tcctgcacacagg

SEQ ID NO: 666561 - DNA, 14 bp, Homo sapiens
tcctgcacacaggg

SEQ ID NO: 666562 - DNA, 13 bp, Homo sapiens
tcctgcgccctgt

SEQ ID NO: 666563 - DNA, 18 bp, Homo sapiens
tcctgcgccctgtgcccg

SEQ ID NO: 666564 - DNA, 23 bp, Homo sapiens
tcctggcagggccacctgcagga

SEQ ID NO: 666565 - DNA, 13 bp, Homo sapiens
tcctggcccctgc

SEQ ID NO: 666566 - DNA, 18 bp, Homo sapiens
tcctggcccctgcctgct

SEQ ID NO: 666567 - DNA, 13 bp, Homo sapiens
tcctggccctggg

SEQ ID NO: 666568 - DNA, 22 bp, Homo sapiens
tcctggcctatccgctgccagc

SEQ ID NO: 666569 - DNA, 23 bp, Homo sapiens
tcctggcctatccgctgccagcc

SEQ ID NO: 666570 - DNA, 16 bp, Homo sapiens
tcctggccttttgtgg

SEQ ID NO: 666571 - DNA, 22 bp, Homo sapiens
tcctgggaacacatctggctgc

SEQ ID NO: 666572 - DNA, 14 bp, Homo sapiens
tcctggtcagctgc

SEQ ID NO: 666573 - DNA, 18 bp, Homo sapiens
tcctggtcagctgcccca

SEQ ID NO: 666574 - DNA, 17 bp, Homo sapiens
tcctggtgagaaaatat

SEQ ID NO: 666575 - DNA, 22 bp, Homo sapiens
tcctggtttcataacttcctgt

SEQ ID NO: 666576 - DNA, 23 bp, Homo sapiens
tcctggtttcataacttcctgta

SEQ ID NO: 666577 - DNA, 12 bp, Homo sapiens
tcctgtgctggg

SEQ ID NO: 666578 - DNA, 14 bp, Homo sapiens
tcctgtgctggggg

SEQ ID NO: 666579 - DNA, 16 bp, Homo sapiens
tcctgtggcataaatt

SEQ ID NO: 666580 - DNA, 15 bp, Homo sapiens
tcctgtggggaaagg

SEQ ID NO: 666581 - DNA, 17 bp, Homo sapiens
tcctgtttccagggtct

SEQ ID NO: 666582 - DNA, 20 bp, Homo sapiens
tccttaacccacctctcctg

SEQ ID NO: 666583 - DNA, 17 bp, Homo sapiens
tccttaagctgcagaga

SEQ ID NO: 666584 - DNA, 13 bp, Homo sapiens
tgcaatttgaagt

SEQ ID NO: 666585 - DNA, 17 bp, Homo sapiens
tgcaatttgagccattt

SEQ ID NO: 666586 - DNA, 22 bp, Homo sapiens
tgcaatttgagccatttaaaga

SEQ ID NO: 666587 - DNA, 23 bp, Homo sapiens
tgcaatttgattgactgcccatt

SEQ ID NO: 666588 - DNA, 14 bp, Homo sapiens
tgcacaacagccct

SEQ ID NO: 666589 - DNA, 15 bp, Homo sapiens
tgcacaacagccctg

SEQ ID NO: 666590 - DNA, 18 bp, Homo sapiens
tgcacaccattttgtaaa

SEQ ID NO: 666591 - DNA, 19 bp, Homo sapiens
tgcacacctttattcagaa

SEQ ID NO: 666592 - DNA, 20 bp, Homo sapiens
tgcacagccactccccggca

SEQ ID NO: 666593 - DNA, 15 bp, Homo sapiens
tgcacagctgtttga

SEQ ID NO: 666594 - DNA, 17 bp, Homo sapiens
tgcacagctgtttgaaa

SEQ ID NO: 666595 - DNA, 18 bp, Homo sapiens
tgcacaggctggaggagg

SEQ ID NO: 666596 - DNA, 18 bp, Homo sapiens
tgcacccctgagccagca

SEQ ID NO: 666597 - DNA, 14 bp, Homo sapiens
tgcactgatgttgt

SEQ ID NO: 666598 - DNA, 19 bp, Homo sapiens
tgcactttctaatgtttct

SEQ ID NO: 666599 - DNA, 15 bp, Homo sapiens
tgcagaaaacgtggc

SEQ ID NO: 666600 - DNA, 15 bp, Homo sapiens
tgcagaactgtagct

SEQ ID NO: 666601 - DNA, 20 bp, Homo sapiens
tgcagaagagggtgtgtttg

SEQ ID NO: 666602 - DNA, 19 bp, Homo sapiens
tgcagaatgtaagtgggcc

SEQ ID NO: 666603 - DNA, 20 bp, Homo sapiens
tgcagaatgtaagtgggccc

SEQ ID NO: 666604 - DNA, 15 bp, Homo sapiens
tgcagatgcaattgt

SEQ ID NO: 666605 - DNA, 17 bp, Homo sapiens
tgcagatgttagatatt

SEQ ID NO: 666606 - DNA, 17 bp, Homo sapiens
tgcagattacactgatc

SEQ ID NO: 666607 - DNA, 21 bp, Homo sapiens
tgcagcaccgaggggcctttg

SEQ ID NO: 666608 - DNA, 13 bp, Homo sapiens
tgcagcaggagtg

SEQ ID NO: 666609 - DNA, 20 bp, Homo sapiens
tgcagcaggagtggtgcaga

SEQ ID NO: 666610 - DNA, 14 bp, Homo sapiens
tgcagctttgcaaa

SEQ ID NO: 666611 - DNA, 20 bp, Homo sapiens
tgcaggaccctgtcctgcag

SEQ ID NO: 666612 - DNA, 15 bp, Homo sapiens
tgcaggcagcacagc

SEQ ID NO: 666613 - DNA, 19 bp, Homo sapiens
tgcagggccatggctcagg

SEQ ID NO: 666614 - DNA, 18 bp, Homo sapiens
tgcagtattcttgcactg

SEQ ID NO: 666615 - DNA, 18 bp, Homo sapiens
tgcagtttaagagcagaa

SEQ ID NO: 666616 - DNA, 18 bp, Homo sapiens
tgcataatgataaaataa

SEQ ID NO: 666617 - DNA, 22 bp, Homo sapiens
tgcatactttgtattttgatta

SEQ ID NO: 666618 - DNA, 22 bp, Homo sapiens
tgcatagcagatggtttccaca

SEQ ID NO: 666619 - DNA, 17 bp, Homo sapiens
tgcatatagttaaactg

SEQ ID NO: 666620 - DNA, 21 bp, Homo sapiens
tgcatatagttaaactgagag

SEQ ID NO: 666621 - DNA, 15 bp, Homo sapiens
tgcatattaaataat

SEQ ID NO: 666622 - DNA, 15 bp, Homo sapiens
tgcatatttatccaa

SEQ ID NO: 666623 - DNA, 13 bp, Homo sapiens
tgcatatttgcca

SEQ ID NO: 666624 - DNA, 16 bp, Homo sapiens
tgcatattttgagaaa

SEQ ID NO: 666625 - DNA, 20 bp, Homo sapiens
tgcatattttgagaaactgc

SEQ ID NO: 666626 - DNA, 19 bp, Homo sapiens
tgcatctcaaaattattct

SEQ ID NO: 666627 - DNA, 19 bp, Homo sapiens
tgcatgaatatcatacaaa

SEQ ID NO: 666628 - DNA, 16 bp, Homo sapiens
tgcatgcaatttgaag

SEQ ID NO: 666629 - DNA, 18 bp, Homo sapiens
tgcatgcatgcaaatgag

SEQ ID NO: 666630 - DNA, 13 bp, Homo sapiens
tgcatggaggccc

SEQ ID NO: 666631 - DNA, 15 bp, Homo sapiens
tgcatggtggccaga

SEQ ID NO: 666632 - DNA, 15 bp, Homo sapiens
tgcatgtctgttctt

SEQ ID NO: 666633 - DNA, 19 bp, Homo sapiens
tgcattaaaatttcttatt

SEQ ID NO: 666634 - DNA, 20 bp, Homo sapiens
tgcattcttttggcagttct

SEQ ID NO: 666635 - DNA, 18 bp, Homo sapiens
tgcattgccgctgtataa

SEQ ID NO: 666636 - DNA, 20 bp, Homo sapiens
tgcatttttggatcattttt

SEQ ID NO: 666637 - DNA, 22 bp, Homo sapiens
tgccaagagtcaacaggtcact

SEQ ID NO: 666638 - DNA, 21 bp, Homo sapiens
tgccagccttgagccctggct

SEQ ID NO: 666639 - DNA, 23 bp, Homo sapiens
tgccagccttgagccctggctgt

SEQ ID NO: 666640 - DNA, 22 bp, Homo sapiens
tgccaggaacctgtcctaagga

SEQ ID NO: 666641 - DNA, 20 bp, Homo sapiens
tgccaggacatgcaataaaa

SEQ ID NO: 666642 - DNA, 18 bp, Homo sapiens
tgccagtttaaaaagatg

SEQ ID NO: 666643 - DNA, 18 bp, Homo sapiens
tgccagttttccctggaa

SEQ ID NO: 666644 - DNA, 21 bp, Homo sapiens
tgccatattctggttcttgaa

SEQ ID NO: 666645 - DNA, 22 bp, Homo sapiens
tgccatattctggttcttgaaa

SEQ ID NO: 666646 - DNA, 17 bp, Homo sapiens
tgccatctagccagccc

SEQ ID NO: 666647 - DNA, 15 bp, Homo sapiens
tgccatctgttcatt

SEQ ID NO: 666648 - DNA, 22 bp, Homo sapiens
tgccatctgttcatttctaaat

SEQ ID NO: 666649 - DNA, 22 bp, Homo sapiens
tgccatggctaggtagaagtga

SEQ ID NO: 666650 - DNA, 23 bp, Homo sapiens
tgccattgaaggcttaattgact

SEQ ID NO: 666651 - DNA, 14 bp, Homo sapiens
tgccatttaaaaag

SEQ ID NO: 666652 - DNA, 20 bp, Homo sapiens
tgcccaatgagactctaggg

SEQ ID NO: 666653 - DNA, 17 bp, Homo sapiens
tgcccagaatttaccat

SEQ ID NO: 666654 - DNA, 23 bp, Homo sapiens
tgcccagctaatttttgtatttt

SEQ ID NO: 666655 - DNA, 21 bp, Homo sapiens
tgcccaggggagcgtgttcct

SEQ ID NO: 666656 - DNA, 18 bp, Homo sapiens
tgcccaggtcaccaagca

SEQ ID NO: 666657 - DNA, 19 bp, Homo sapiens
tgcccaggtcaccaagcag

SEQ ID NO: 666658 - DNA, 20 bp, Homo sapiens
tgcccaggttggagtgcagt

SEQ ID NO: 666659 - DNA, 19 bp, Homo sapiens
tgcccattcaccaaaatta

SEQ ID NO: 666660 - DNA, 21 bp, Homo sapiens
tgccccatccagacctggctc

SEQ ID NO: 666661 - DNA, 15 bp, Homo sapiens
tgccccatgtgtcct

SEQ ID NO: 666662 - DNA, 14 bp, Homo sapiens
tgcccccagtgcct

SEQ ID NO: 666663 - DNA, 14 bp, Homo sapiens
tgccccctctcact

SEQ ID NO: 666664 - DNA, 15 bp, Homo sapiens
tgccccctctcactt

SEQ ID NO: 666665 - DNA, 18 bp, Homo sapiens
tgccccctgggctggggc

SEQ ID NO: 666666 - DNA, 14 bp, Homo sapiens
tgcccctcagagac

SEQ ID NO: 666667 - DNA, 16 bp, Homo sapiens
tgcccctcagagactg

SEQ ID NO: 666668 - DNA, 12 bp, Homo sapiens
tgcccctctcac

SEQ ID NO: 666669 - DNA, 15 bp, Homo sapiens
tgcccctctcaccaa

SEQ ID NO: 666670 - DNA, 15 bp, Homo sapiens
tgcccctggctttgc

SEQ ID NO: 666671 - DNA, 15 bp, Homo sapiens
tgcccgactgactgg

SEQ ID NO: 666672 - DNA, 18 bp, Homo sapiens
tgccctcattactgggcc

SEQ ID NO: 666673 - DNA, 16 bp, Homo sapiens
tgccctcgcctcctcc

SEQ ID NO: 666674 - DNA, 11 bp, Homo sapiens
tgcccttcctc

SEQ ID NO: 666675 - DNA, 23 bp, Homo sapiens
tgcccttcctcctgcctttctca

SEQ ID NO: 666676 - DNA, 18 bp, Homo sapiens
tgccgatatcttcagaaa

SEQ ID NO: 666677 - DNA, 16 bp, Homo sapiens
tgccgctacctccctc

SEQ ID NO: 666678 - DNA, 16 bp, Homo sapiens
tgccgctgtataaagc

SEQ ID NO: 666679 - DNA, 19 bp, Homo sapiens
tgccgctgtataaagcatg

SEQ ID NO: 666680 - DNA, 21 bp, Homo sapiens
tgccgtgtgagtgtgacaggg

SEQ ID NO: 666681 - DNA, 15 bp, Homo sapiens
tgcctacatttatca

SEQ ID NO: 666682 - DNA, 17 bp, Homo sapiens
tgcctacatttatcatg

SEQ ID NO: 666683 - DNA, 19 bp, Homo sapiens
tgcctcaagccccagagtg

SEQ ID NO: 666684 - DNA, 22 bp, Homo sapiens
tgcctcaccttccaacactcca

SEQ ID NO: 666685 - DNA, 16 bp, Homo sapiens
tgcctccaagttcaaa

SEQ ID NO: 666686 - DNA, 17 bp, Homo sapiens
tgcctccaagttcaaaa

SEQ ID NO: 666687 - DNA, 22 bp, Homo sapiens
tgcctccacatgctgcctggca

SEQ ID NO: 666688 - DNA, 15 bp, Homo sapiens
tgcctccaggtgcag

SEQ ID NO: 666689 - DNA, 16 bp, Homo sapiens
tgcctcccaggttcca

SEQ ID NO: 666690 - DNA, 19 bp, Homo sapiens
tgcctccgtcccctgccca

SEQ ID NO: 666691 - DNA, 17 bp, Homo sapiens
tgcctcctgcgccctgt

SEQ ID NO: 666692 - DNA, 13 bp, Homo sapiens
tgcctcctgtggg

SEQ ID NO: 666693 - DNA, 18 bp, Homo sapiens
tgcctctccctgggtctg

SEQ ID NO: 666694 - DNA, 24 bp, Homo sapiens
tgcctctgcagtctcatttctcat

SEQ ID NO: 666695 - DNA, 12 bp, Homo sapiens
tgcctctgctcc

SEQ ID NO: 666696 - DNA, 13 bp, Homo sapiens
tgcctctgctccc

SEQ ID NO: 666697 - DNA, 14 bp, Homo sapiens
tgcctctgctccct

SEQ ID NO: 666698 - DNA, 17 bp, Homo sapiens
tgcctctgctccctctg

SEQ ID NO: 666699 - DNA, 14 bp, Homo sapiens
tgcctcttctttgt

SEQ ID NO: 666700 - DNA, 19 bp, Homo sapiens
tgcctcttctttgtgcctt

SEQ ID NO: 666701 - DNA, 20 bp, Homo sapiens
tgcctcttctttgtgccttt

SEQ ID NO: 666702 - DNA, 17 bp, Homo sapiens
tgcctctttccctagga

SEQ ID NO: 666703 - DNA, 12 bp, Homo sapiens
tgcctgaataaa

SEQ ID NO: 666704 - DNA, 13 bp, Homo sapiens
tgcctgaataaag

SEQ ID NO: 666705 - DNA, 17 bp, Homo sapiens
tgcctgaataaagagcc

SEQ ID NO: 666706 - DNA, 17 bp, Homo sapiens
tgcctgcagcaggcagc

SEQ ID NO: 666707 - DNA, 13 bp, Homo sapiens
tgcctgcagggcc

SEQ ID NO: 666708 - DNA, 16 bp, Homo sapiens
tgcctgcagggccatg

SEQ ID NO: 666709 - DNA, 17 bp, Homo sapiens
tgcctgcagggccatgg

SEQ ID NO: 666710 - DNA, 22 bp, Homo sapiens
tgcctggccttgtcctcagcca

SEQ ID NO: 666711 - DNA, 22 bp, Homo sapiens
tgcctgggccgtggcacagctg

SEQ ID NO: 666712 - DNA, 12 bp, Homo sapiens
tgccttaattta

SEQ ID NO: 666713 - DNA, 16 bp, Homo sapiens
tgccttaatttagaaa

SEQ ID NO: 666714 - DNA, 20 bp, Homo sapiens
tgccttaatttagaaactga

SEQ ID NO: 666715 - DNA, 15 bp, Homo sapiens
tgccttcacaaatgt

SEQ ID NO: 666716 - DNA, 16 bp, Homo sapiens
tgccttcacaaatgtc

SEQ ID NO: 666717 - DNA, 18 bp, Homo sapiens
tgccttcatcttcactgc

SEQ ID NO: 666718 - DNA, 13 bp, Homo sapiens
tgccttcctcctt

SEQ ID NO: 666719 - DNA, 17 bp, Homo sapiens
tgccttctactcccctt

SEQ ID NO: 666720 - DNA, 13 bp, Homo sapiens
tgccttctttcca

SEQ ID NO: 666721 - DNA, 13 bp, Homo sapiens
tgccttcttttgt

SEQ ID NO: 666722 - DNA, 12 bp, Homo sapiens
tgccttgaaaaa

SEQ ID NO: 666723 - DNA, 15 bp, Homo sapiens
tgccttgaaaaatga

SEQ ID NO: 666724 - DNA, 17 bp, Homo sapiens
tgccttgaaaaatgaca

SEQ ID NO: 666725 - DNA, 13 bp, Homo sapiens
tgccttgctgttt

SEQ ID NO: 666726 - DNA, 12 bp, Homo sapiens
tgcctttctttg

SEQ ID NO: 666727 - DNA, 15 bp, Homo sapiens
tgcctttctttgcct

SEQ ID NO: 666728 - DNA, 17 bp, Homo sapiens
tgcctttctttgcctct

SEQ ID NO: 666729 - DNA, 12 bp, Homo sapiens
tgcctttggcct

SEQ ID NO: 666730 - DNA, 19 bp, Homo sapiens
tgcgaccctgggggcacag

SEQ ID NO: 666731 - DNA, 12 bp, Homo sapiens
tgcgattctgga

SEQ ID NO: 666732 - DNA, 23 bp, Homo sapiens
tgcgattctggataaagccactg

SEQ ID NO: 666733 - DNA, 14 bp, Homo sapiens
tgcggatctctgga

SEQ ID NO: 666734 - DNA, 16 bp, Homo sapiens
tgcgtctgaggcctgc

SEQ ID NO: 666735 - DNA, 16 bp, Homo sapiens
tgctaaagcctgtggg

SEQ ID NO: 666736 - DNA, 17 bp, Homo sapiens
tgctaaaggagcatcta

SEQ ID NO: 666737 - DNA, 16 bp, Homo sapiens
tgctaatcaaagccag

SEQ ID NO: 666738 - DNA, 13 bp, Homo sapiens
tgctaatgcattt

SEQ ID NO: 666739 - DNA, 19 bp, Homo sapiens
tgctaatgcattttgcact

SEQ ID NO: 666740 - DNA, 14 bp, Homo sapiens
tgctaatttagaga

SEQ ID NO: 666741 - DNA, 18 bp, Homo sapiens
tgctactaagttcacatt

SEQ ID NO: 666742 - DNA, 23 bp, Homo sapiens
tgctactgttgtaagaattctga

SEQ ID NO: 666743 - DNA, 19 bp, Homo sapiens
tgctatccccatctccctg

SEQ ID NO: 666744 - DNA, 20 bp, Homo sapiens
tgctatccccatctccctgc

SEQ ID NO: 666745 - DNA, 20 bp, Homo sapiens
tgctatggaacataaagttg

SEQ ID NO: 666746 - DNA, 17 bp, Homo sapiens
tgctatgtaagggtctt

SEQ ID NO: 666747 - DNA, 16 bp, Homo sapiens
tgctatgttactattt

SEQ ID NO: 666748 - DNA, 19 bp, Homo sapiens
tgctatgttactattttct

SEQ ID NO: 666749 - DNA, 20 bp, Homo sapiens
tgctattctagagcttttat

SEQ ID NO: 666750 - DNA, 16 bp, Homo sapiens
tgctcagctgtcaagg

SEQ ID NO: 666751 - DNA, 19 bp, Homo sapiens
tgctccccacagcgtccct

SEQ ID NO: 666752 - DNA, 22 bp, Homo sapiens
tgctccccacagcgtccctggc

SEQ ID NO: 666753 - DNA, 23 bp, Homo sapiens
tgctccccacagcgtccctggcg

SEQ ID NO: 666754 - DNA, 12 bp, Homo sapiens
tgctccctgtgt

SEQ ID NO: 666755 - DNA, 17 bp, Homo sapiens
tgctccctgtgtccacc

SEQ ID NO: 666756 - DNA, 18 bp, Homo sapiens
tgctccgtagctctgctg

SEQ ID NO: 666757 - DNA, 20 bp, Homo sapiens
tgctccgtagctctgctgct

SEQ ID NO: 666758 - DNA, 19 bp, Homo sapiens
tgctcgtttacactgcaca

SEQ ID NO: 666759 - DNA, 14 bp, Homo sapiens
tgctctcctcatct

SEQ ID NO: 666760 - DNA, 14 bp, Homo sapiens
tgctctctgtgacc

SEQ ID NO: 666761 - DNA, 23 bp, Homo sapiens
tgctcttgtttttattaatttat

SEQ ID NO: 666762 - DNA, 13 bp, Homo sapiens
tgctcttttcctg

SEQ ID NO: 666763 - DNA, 19 bp, Homo sapiens
tgctgaaaactagctcgtg

SEQ ID NO: 666764 - DNA, 13 bp, Homo sapiens
tgctgaaactgcc

SEQ ID NO: 666765 - DNA, 17 bp, Homo sapiens
tgctgaaactgcccact

SEQ ID NO: 666766 - DNA, 12 bp, Homo sapiens
tgctgaaagact

SEQ ID NO: 666767 - DNA, 13 bp, Homo sapiens
tgctgaaagactc

SEQ ID NO: 666768 - DNA, 19 bp, Homo sapiens
tgctgaactcagcacattc

SEQ ID NO: 666769 - DNA, 14 bp, Homo sapiens
tgctgagctggccc

SEQ ID NO: 666770 - DNA, 17 bp, Homo sapiens
tgctgagggtttgaata

SEQ ID NO: 666771 - DNA, 15 bp, Homo sapiens
tgctgagttggcctg

SEQ ID NO: 666772 - DNA, 21 bp, Homo sapiens
tgctgatcatcgccagaggtg

SEQ ID NO: 666773 - DNA, 19 bp, Homo sapiens
tgctgatcgtagaaaattt

SEQ ID NO: 666774 - DNA, 20 bp, Homo sapiens
tgctgatcttttaaaatcat

SEQ ID NO: 666775 - DNA, 12 bp, Homo sapiens
tgctgattattt

SEQ ID NO: 666776 - DNA, 14 bp, Homo sapiens
tgctgattatttat

SEQ ID NO: 666777 - DNA, 17 bp, Homo sapiens
tgctgattatttatgac

SEQ ID NO: 666778 - DNA, 21 bp, Homo sapiens
tgctgattatttatgacctga

SEQ ID NO: 666779 - DNA, 17 bp, Homo sapiens
tgctgccaccacttttg

SEQ ID NO: 666780 - DNA, 14 bp, Homo sapiens
tgctgcctgaatcc

SEQ ID NO: 666781 - DNA, 16 bp, Homo sapiens
tgctgctggtgcacag

SEQ ID NO: 666782 - DNA, 16 bp, Homo sapiens
tgctgctgtcagacga

SEQ ID NO: 666783 - DNA, 13 bp, Homo sapiens
tgctgctgtgcag

SEQ ID NO: 666784 - DNA, 18 bp, Homo sapiens
tgctgctgtgcagcatgg

SEQ ID NO: 666785 - DNA, 21 bp, Homo sapiens
tgctgctttttctgcgcttca

SEQ ID NO: 666786 - DNA, 19 bp, Homo sapiens
tgctggctcacagtacagc

SEQ ID NO: 666787 - DNA, 23 bp, Homo sapiens
tgctgggggaatgagcccagaga

SEQ ID NO: 666788 - DNA, 19 bp, Homo sapiens
tgctggggtcaaggcagta

SEQ ID NO: 666789 - DNA, 22 bp, Homo sapiens
tgctgtatgctgatcatcgcca

SEQ ID NO: 666790 - DNA, 23 bp, Homo sapiens
tgctgtttctaagaaaatgtagt

SEQ ID NO: 666791 - DNA, 19 bp, Homo sapiens
tgcttaaaaatcattgatt

SEQ ID NO: 666792 - DNA, 14 bp, Homo sapiens
tgcttaaaccactt

SEQ ID NO: 666793 - DNA, 14 bp, Homo sapiens
tgcttaatcttcaa

SEQ ID NO: 666794 - DNA, 15 bp, Homo sapiens
tgcttaatcttcaaa

SEQ ID NO: 666795 - DNA, 21 bp, Homo sapiens
tgcttaatcttcaaagccttc

SEQ ID NO: 666796 - DNA, 15 bp, Homo sapiens
tgcttcttactgata

SEQ ID NO: 666797 - DNA, 17 bp, Homo sapiens
tgcttcttctctccaca

SEQ ID NO: 666798 - DNA, 15 bp, Homo sapiens
tgcttgacataccta

SEQ ID NO: 666799 - DNA, 22 bp, Homo sapiens
tgcttgacatacctaccagtat

SEQ ID NO: 666800 - DNA, 15 bp, Homo sapiens
tgcttgcctgcaggg

SEQ ID NO: 666801 - DNA, 21 bp, Homo sapiens
tgcttggtgtgacccacggag

SEQ ID NO: 666802 - DNA, 20 bp, Homo sapiens
tgcttgtcttctggtacttt

SEQ ID NO: 666803 - DNA, 22 bp, Homo sapiens
tgcttgtcttctggtactttct

SEQ ID NO: 666804 - DNA, 13 bp, Homo sapiens
tgcttgtttatga

SEQ ID NO: 666805 - DNA, 16 bp, Homo sapiens
tctctgccgctacctc

SEQ ID NO: 666806 - DNA, 23 bp, Homo sapiens
tctctgtagaaggagtagctgcc

SEQ ID NO: 666807 - DNA, 19 bp, Homo sapiens
tctctgtgagaaggtttat

SEQ ID NO: 666808 - DNA, 15 bp, Homo sapiens
tctctgttggtctgc

SEQ ID NO: 666809 - DNA, 18 bp, Homo sapiens
tctcttaaatataacact

SEQ ID NO: 666810 - DNA, 17 bp, Homo sapiens
tctcttccccttagaaa

SEQ ID NO: 666811 - DNA, 16 bp, Homo sapiens
tctcttccccttccct

SEQ ID NO: 666812 - DNA, 13 bp, Homo sapiens
tctcttctggtgt

SEQ ID NO: 666813 - DNA, 18 bp, Homo sapiens
tctcttgtcctcttctgc

SEQ ID NO: 666814 - DNA, 20 bp, Homo sapiens
tctcttttatatttgtagga

SEQ ID NO: 666815 - DNA, 19 bp, Homo sapiens
tctcttttctttctgtctt

SEQ ID NO: 666816 - DNA, 14 bp, Homo sapiens
tctctttttgtttg

SEQ ID NO: 666817 - DNA, 12 bp, Homo sapiens
tctgaaactggc

SEQ ID NO: 666818 - DNA, 10 bp, Homo sapiens
tctgaatatt

SEQ ID NO: 666819 - DNA, 20 bp, Homo sapiens
tctgacaaaatggggcagaa

SEQ ID NO: 666820 - DNA, 15 bp, Homo sapiens
tctgagatgctcact

SEQ ID NO: 666821 - DNA, 21 bp, Homo sapiens
tctgagatgctcactttatta

SEQ ID NO: 666822 - DNA, 18 bp, Homo sapiens
tctgaggacaagagaaaa

SEQ ID NO: 666823 - DNA, 20 bp, Homo sapiens
tctgaggcctgccccctggg

SEQ ID NO: 666824 - DNA, 21 bp, Homo sapiens
tctgaggcctgccccctgggc

SEQ ID NO: 666825 - DNA, 17 bp, Homo sapiens
tctgatgagaacaagct

SEQ ID NO: 666826 - DNA, 19 bp, Homo sapiens
tctgattctggctttaagc

SEQ ID NO: 666827 - DNA, 22 bp, Homo sapiens
tctgattgatttgattgggatg

SEQ ID NO: 666828 - DNA, 14 bp, Homo sapiens
tctgattttgaggt

SEQ ID NO: 666829 - DNA, 16 bp, Homo sapiens
tctgcaacaagcatgc

SEQ ID NO: 666830 - DNA, 21 bp, Homo sapiens
tctgcacccctctgccctcat

SEQ ID NO: 666831 - DNA, 18 bp, Homo sapiens
tctgcagcattgaagtat

SEQ ID NO: 666832 - DNA, 21 bp, Homo sapiens
tctgccctcattactgggcct

SEQ ID NO: 666833 - DNA, 18 bp, Homo sapiens
tctgccgctacctccctc

SEQ ID NO: 666834 - DNA, 19 bp, Homo sapiens
tctgccgctacctccctcc

SEQ ID NO: 666835 - DNA, 18 bp, Homo sapiens
tctgcctctccctgggtc

SEQ ID NO: 666836 - DNA, 15 bp, Homo sapiens
tctgccttctgctga

SEQ ID NO: 666837 - DNA, 16 bp, Homo sapiens
tctgctcttttcctgg

SEQ ID NO: 666838 - DNA, 15 bp, Homo sapiens
tctgctttatgttgc

SEQ ID NO: 666839 - DNA, 22 bp, Homo sapiens
tctggcaaaaaggagccttttg

SEQ ID NO: 666840 - DNA, 22 bp, Homo sapiens
tctggcttgggcagggtctgtt

SEQ ID NO: 666841 - DNA, 17 bp, Homo sapiens
tgaaacagttgctgtga

SEQ ID NO: 666842 - DNA, 18 bp, Homo sapiens
tgaaacagttgctgtgaa

SEQ ID NO: 666843 - DNA, 16 bp, Homo sapiens
tgaaacctacacactg

SEQ ID NO: 666844 - DNA, 20 bp, Homo sapiens
tgaaacctacacactgtcat

SEQ ID NO: 666845 - DNA, 19 bp, Homo sapiens
tgaaacctagtactgcccc

SEQ ID NO: 666846 - DNA, 16 bp, Homo sapiens
tgaaactggcttcccc

SEQ ID NO: 666847 - DNA, 13 bp, Homo sapiens
tgaaactggtttt

SEQ ID NO: 666848 - DNA, 15 bp, Homo sapiens
tgaaactttgggaaa

SEQ ID NO: 666849 - DNA, 23 bp, Homo sapiens
tgaaactttgggaaaacatgtta

SEQ ID NO: 666850 - DNA, 17 bp, Homo sapiens
tgaaagccttagggaag

SEQ ID NO: 666851 - DNA, 16 bp, Homo sapiens
tgaaagtcaaatttac

SEQ ID NO: 666852 - DNA, 17 bp, Homo sapiens
tgaaagtcaaatttact

SEQ ID NO: 666853 - DNA, 18 bp, Homo sapiens
tgaaagtcaaatttactt

SEQ ID NO: 666854 - DNA, 13 bp, Homo sapiens
tgaaataatatat

SEQ ID NO: 666855 - DNA, 22 bp, Homo sapiens
tgaaatcttcccatgcattctg

SEQ ID NO: 666856 - DNA, 20 bp, Homo sapiens
tgaaatgaaaacatgtaata

SEQ ID NO: 666857 - DNA, 20 bp, Homo sapiens
tgaaatgtgaatttttattg

SEQ ID NO: 666858 - DNA, 22 bp, Homo sapiens
tgaaatgtgaatttttattgtt

SEQ ID NO: 666859 - DNA, 18 bp, Homo sapiens
tgaaatgtttaataaagc

SEQ ID NO: 666860 - DNA, 19 bp, Homo sapiens
tgaaatgtttaataaagct

SEQ ID NO: 666861 - DNA, 16 bp, Homo sapiens
tgaaattactttaaca

SEQ ID NO: 666862 - DNA, 22 bp, Homo sapiens
tgaaattactttaacattttgg

SEQ ID NO: 666863 - DNA, 15 bp, Homo sapiens
tgaacatgatagtta

SEQ ID NO: 666864 - DNA, 20 bp, Homo sapiens
tgaacattggttctttcatt

SEQ ID NO: 666865 - DNA, 14 bp, Homo sapiens
tgaaccacaacttt

SEQ ID NO: 666866 - DNA, 16 bp, Homo sapiens
tgaacgtccacatgaa

SEQ ID NO: 666867 - DNA, 17 bp, Homo sapiens
tgaactggcaattgtct

SEQ ID NO: 666868 - DNA, 23 bp, Homo sapiens
tgaacttggctttcctgtttcta

SEQ ID NO: 666869 - DNA, 19 bp, Homo sapiens
tgaagaaggaaagaaccga

SEQ ID NO: 666870 - DNA, 18 bp, Homo sapiens
tgaagagggagaagcatg

SEQ ID NO: 666871 - DNA, 21 bp, Homo sapiens
tgaagagggagaagcatgaaa

SEQ ID NO: 666872 - DNA, 15 bp, Homo sapiens
tgaagatgggagcct

SEQ ID NO: 666873 - DNA, 18 bp, Homo sapiens
tgaagcaattagtctgaa

SEQ ID NO: 666874 - DNA, 21 bp, Homo sapiens
tgaagcaattagtctgaaact

SEQ ID NO: 666875 - DNA, 16 bp, Homo sapiens
tgaagcagtcttgctc

SEQ ID NO: 666876 - DNA, 17 bp, Homo sapiens
tgaagcagtcttgctct

SEQ ID NO: 666877 - DNA, 14 bp, Homo sapiens
tgaagccaccctgg

SEQ ID NO: 666878 - DNA, 18 bp, Homo sapiens
tgaaggcttaattgactg

SEQ ID NO: 666879 - DNA, 20 bp, Homo sapiens
tgaaggcttaattgactgaa

SEQ ID NO: 666880 - DNA, 19 bp, Homo sapiens
tgaaggtctcctaaaactg

SEQ ID NO: 666881 - DNA, 21 bp, Homo sapiens
tgaaggtctcctaaaactggg

SEQ ID NO: 666882 - DNA, 13 bp, Homo sapiens
tgaagtacatatt

SEQ ID NO: 666883 - DNA, 20 bp, Homo sapiens
tgaagtacatattaggaaaa

SEQ ID NO: 666884 - DNA, 22 bp, Homo sapiens
tgaagtcacccctttctgtccc

SEQ ID NO: 666885 - DNA, 18 bp, Homo sapiens
tgaagtgcagctcatgtt

SEQ ID NO: 666886 - DNA, 13 bp, Homo sapiens
tgaagtgcgtgaa

SEQ ID NO: 666887 - DNA, 20 bp, Homo sapiens
tgaagtgtataatataaaaa

SEQ ID NO: 666888 - DNA, 14 bp, Homo sapiens
tgaagtttgaacca

SEQ ID NO: 666889 - DNA, 17 bp, Homo sapiens
tgaagttttgatttatt

SEQ ID NO: 666890 - DNA, 13 bp, Homo sapiens
tgaataaagagcc

SEQ ID NO: 666891 - DNA, 16 bp, Homo sapiens
tgaataatatcaaata

SEQ ID NO: 666892 - DNA, 13 bp, Homo sapiens
tgaatatgcctta

SEQ ID NO: 666893 - DNA, 18 bp, Homo sapiens
tgaatattgccattatgc

SEQ ID NO: 666894 - DNA, 16 bp, Homo sapiens
tgaatctgctttaatt

SEQ ID NO: 666895 - DNA, 15 bp, Homo sapiens
tgaatgcagaacggt

SEQ ID NO: 666896 - DNA, 18 bp, Homo sapiens
tgaatgcctcctgtgggg

SEQ ID NO: 666897 - DNA, 18 bp, Homo sapiens
tgaatgtggctgaagttg

SEQ ID NO: 666898 - DNA, 15 bp, Homo sapiens
tgaatgtgggcactg

SEQ ID NO: 666899 - DNA, 16 bp, Homo sapiens
tgaatgtggtctcagg

SEQ ID NO: 666900 - DNA, 21 bp, Homo sapiens
tgaatgttaaagggatatttt

SEQ ID NO: 666901 - DNA, 15 bp, Homo sapiens
tgaattaaataaata

SEQ ID NO: 666902 - DNA, 17 bp, Homo sapiens
tgaattcaagaaaggaa

SEQ ID NO: 666903 - DNA, 15 bp, Homo sapiens
tgaattgaaaaacaa

SEQ ID NO: 666904 - DNA, 15 bp, Homo sapiens
tgaattggaaagact

SEQ ID NO: 666905 - DNA, 21 bp, Homo sapiens
tgaattggaactgcaatgaaa

SEQ ID NO: 666906 - DNA, 17 bp, Homo sapiens
tgaattgtatcaatttg

SEQ ID NO: 666907 - DNA, 19 bp, Homo sapiens
tgacaaaactaaccttgaa

SEQ ID NO: 666908 - DNA, 22 bp, Homo sapiens
tgacaactgtgaagccaccctg

SEQ ID NO: 666909 - DNA, 12 bp, Homo sapiens
tgacaattgtga

SEQ ID NO: 666910 - DNA, 17 bp, Homo sapiens
tgacaattgtgaacatg

SEQ ID NO: 666911 - DNA, 18 bp, Homo sapiens
tgacaattgtgaacatga

SEQ ID NO: 666912 - DNA, 19 bp, Homo sapiens
tgacagactatttgctaat

SEQ ID NO: 666913 - DNA, 18 bp, Homo sapiens
tgacaggctcgtcagcca

SEQ ID NO: 666914 - DNA, 17 bp, Homo sapiens
tgacagggccagtgggg

SEQ ID NO: 666915 - DNA, 18 bp, Homo sapiens
tgacagggccagtggggc

SEQ ID NO: 666916 - DNA, 21 bp, Homo sapiens
tgacagggccagtggggcctg

SEQ ID NO: 666917 - DNA, 14 bp, Homo sapiens
tgacagtcatcatc

SEQ ID NO: 666918 - DNA, 17 bp, Homo sapiens
tgacagtcatcatcagg

SEQ ID NO: 666919 - DNA, 18 bp, Homo sapiens
tgacagtcatcatcaggg

SEQ ID NO: 666920 - DNA, 19 bp, Homo sapiens
tgacagtcatcatcagggc

SEQ ID NO: 666921 - DNA, 17 bp, Homo sapiens
tgacagtttttctgttt

SEQ ID NO: 666922 - DNA, 18 bp, Homo sapiens
tgacatacctaccagtat

SEQ ID NO: 666923 - DNA, 13 bp, Homo sapiens
tgacatttcttct

SEQ ID NO: 666924 - DNA, 22 bp, Homo sapiens
tgacatttcttctagtgatgat

SEQ ID NO: 666925 - DNA, 12 bp, Homo sapiens
tgacatttgttt

SEQ ID NO: 666926 - DNA, 16 bp, Homo sapiens
tgacatttgtttattt

SEQ ID NO: 666927 - DNA, 22 bp, Homo sapiens
tgaccacccctctcgcctcatt

SEQ ID NO: 666928 - DNA, 13 bp, Homo sapiens
tgaccatactaat

SEQ ID NO: 666929 - DNA, 16 bp, Homo sapiens
tgaccatactaataaa

SEQ ID NO: 666930 - DNA, 17 bp, Homo sapiens
tgaccatactaataaat

SEQ ID NO: 666931 - DNA, 20 bp, Homo sapiens
tgaccatactaataaatata

SEQ ID NO: 666932 - DNA, 18 bp, Homo sapiens
tgcttgtttatgatattt

SEQ ID NO: 666933 - DNA, 15 bp, Homo sapiens
tgctttaattaatta

SEQ ID NO: 666934 - DNA, 20 bp, Homo sapiens
tgctttaattaattaagtat

SEQ ID NO: 666935 - DNA, 17 bp, Homo sapiens
tgctttattaatgtttt

SEQ ID NO: 666936 - DNA, 21 bp, Homo sapiens
tgctttattaatgttttcaaa

SEQ ID NO: 666937 - DNA, 16 bp, Homo sapiens
tgctttattgcttttt

SEQ ID NO: 666938 - DNA, 19 bp, Homo sapiens
tgctttcaattacaaagca

SEQ ID NO: 666939 - DNA, 11 bp, Homo sapiens
tgctttcttac

SEQ ID NO: 666940 - DNA, 12 bp, Homo sapiens
tgcttttaatta

SEQ ID NO: 666941 - DNA, 13 bp, Homo sapiens
tgcttttaattaa

SEQ ID NO: 666942 - DNA, 16 bp, Homo sapiens
tggaaaaatgtatcca

SEQ ID NO: 666943 - DNA, 16 bp, Homo sapiens
tggaaaataccagtgt

SEQ ID NO: 666944 - DNA, 18 bp, Homo sapiens
tggaaagacttctcaaag

SEQ ID NO: 666945 - DNA, 22 bp, Homo sapiens
tggaaagcagagcctcctggga

SEQ ID NO: 666946 - DNA, 16 bp, Homo sapiens
tggaaagttttctcca

SEQ ID NO: 666947 - DNA, 15 bp, Homo sapiens
tggaaatacagttat

SEQ ID NO: 666948 - DNA, 16 bp, Homo sapiens
tggaaatacagttatt

SEQ ID NO: 666949 - DNA, 16 bp, Homo sapiens
tggaaatccctttctg

SEQ ID NO: 666950 - DNA, 19 bp, Homo sapiens
tggaaattcctgtactgtg

SEQ ID NO: 666951 - DNA, 22 bp, Homo sapiens
tggaaattcctgtactgtgtct

SEQ ID NO: 666952 - DNA, 24 bp, Homo sapiens
tggaaattgttgtatatcactaaa

SEQ ID NO: 666953 - DNA, 19 bp, Homo sapiens
tggaagagccgagcacctg

SEQ ID NO: 666954 - DNA, 14 bp, Homo sapiens
tggaagcaaagtat

SEQ ID NO: 666955 - DNA, 19 bp, Homo sapiens
tggaagcccaactggggtt

SEQ ID NO: 666956 - DNA, 18 bp, Homo sapiens
tggaagtgaaaactttgt

SEQ ID NO: 666957 - DNA, 22 bp, Homo sapiens
tggaagtgtatttattttacag

SEQ ID NO: 666958 - DNA, 22 bp, Homo sapiens
tggaattttttgaatatgcctt

SEQ ID NO: 666959 - DNA, 20 bp, Homo sapiens
tggacagctgataaatttaa

SEQ ID NO: 666960 - DNA, 16 bp, Homo sapiens
tggacccttataaaat

SEQ ID NO: 666961 - DNA, 20 bp, Homo sapiens
tggactaattattattttaa

SEQ ID NO: 666962 - DNA, 13 bp, Homo sapiens
tggactacacaat

SEQ ID NO: 666963 - DNA, 20 bp, Homo sapiens
tggactacacaatacagtat

SEQ ID NO: 666964 - DNA, 15 bp, Homo sapiens
tggactattgtgcca

SEQ ID NO: 666965 - DNA, 13 bp, Homo sapiens
tggactgcagaag

SEQ ID NO: 666966 - DNA, 19 bp, Homo sapiens
tggactgcagaagcaaggg

SEQ ID NO: 666967 - DNA, 22 bp, Homo sapiens
tggactgctacctttcaaagct

SEQ ID NO: 666968 - DNA, 14 bp, Homo sapiens
tggacttcaaagca

SEQ ID NO: 666969 - DNA, 22 bp, Homo sapiens
tggagacgtttataaacagaaa

SEQ ID NO: 666970 - DNA, 14 bp, Homo sapiens
tggagagggcccag

SEQ ID NO: 666971 - DNA, 16 bp, Homo sapiens
tggagattataataaa

SEQ ID NO: 666972 - DNA, 19 bp, Homo sapiens
tggagattataataaatat

SEQ ID NO: 666973 - DNA, 14 bp, Homo sapiens
tggagcctggggtg

SEQ ID NO: 666974 - DNA, 12 bp, Homo sapiens
tggaggaggcct

SEQ ID NO: 666975 - DNA, 19 bp, Homo sapiens
tggaggaggcctgtcccaa

SEQ ID NO: 666976 - DNA, 16 bp, Homo sapiens
tggaggccctcctgtg

SEQ ID NO: 666977 - DNA, 11 bp, Homo sapiens
tggagggaggc

SEQ ID NO: 666978 - DNA, 23 bp, Homo sapiens
tggaggtccctggtcggagaggg

SEQ ID NO: 666979 - DNA, 20 bp, Homo sapiens
tggagttaacgggtgaataa

SEQ ID NO: 666980 - DNA, 14 bp, Homo sapiens
tggagttccttatc

SEQ ID NO: 666981 - DNA, 16 bp, Homo sapiens
tggataaagccactga

SEQ ID NO: 666982 - DNA, 13 bp, Homo sapiens
tggataccattat

SEQ ID NO: 666983 - DNA, 15 bp, Homo sapiens
tggatatatttgaaa

SEQ ID NO: 666984 - DNA, 18 bp, Homo sapiens
tggatatatttgaaatag

SEQ ID NO: 666985 - DNA, 17 bp, Homo sapiens
tggatcatagaattgca

SEQ ID NO: 666986 - DNA, 19 bp, Homo sapiens
tggatgatattttttatca

SEQ ID NO: 666987 - DNA, 20 bp, Homo sapiens
tggatgccacagcccagctt

SEQ ID NO: 666988 - DNA, 18 bp, Homo sapiens
tggatggtcattgcagtt

SEQ ID NO: 666989 - DNA, 20 bp, Homo sapiens
tggattctgaggccctgccc

SEQ ID NO: 666990 - DNA, 23 bp, Homo sapiens
tggatttaagagtattttaagaa

SEQ ID NO: 666991 - DNA, 21 bp, Homo sapiens
tggatttggcactagccaaag

SEQ ID NO: 666992 - DNA, 18 bp, Homo sapiens
tggcaaaaaggagccttt

SEQ ID NO: 666993 - DNA, 21 bp, Homo sapiens
tggcaaagggagcagaactga

SEQ ID NO: 666994 - DNA, 19 bp, Homo sapiens
tggcaaagtttaaatgtat

SEQ ID NO: 666995 - DNA, 11 bp, Homo sapiens
tggcaaggaaa

SEQ ID NO: 666996 - DNA, 12 bp, Homo sapiens
tggcaaggaaag

SEQ ID NO: 666997 - DNA, 13 bp, Homo sapiens
tggcacacagcag

SEQ ID NO: 666998 - DNA, 14 bp, Homo sapiens
tggcacagaacagg

SEQ ID NO: 666999 - DNA, 16 bp, Homo sapiens
tggcaccgcctcccca

SEQ ID NO: 667000 - DNA, 14 bp, Homo sapiens
tggcaggactcctg

SEQ ID NO: 667001 - DNA, 24 bp, Homo sapiens
tggcagggccacctgcaggaccct

SEQ ID NO: 667002 - DNA, 14 bp, Homo sapiens
tggcagtggcagag

SEQ ID NO: 667003 - DNA, 18 bp, Homo sapiens
tggcagtggcagagaatc

SEQ ID NO: 667004 - DNA, 15 bp, Homo sapiens
tggcataaattgcat

SEQ ID NO: 667005 - DNA, 20 bp, Homo sapiens
tggcatcttagacctccaca

SEQ ID NO: 667006 - DNA, 16 bp, Homo sapiens
tggcatttctctttaa

SEQ ID NO: 667007 - DNA, 17 bp, Homo sapiens
tggcatttctctttaaa

SEQ ID NO: 667008 - DNA, 12 bp, Homo sapiens
tggccacagact

SEQ ID NO: 667009 - DNA, 15 bp, Homo sapiens
tggccatcatcctcc

SEQ ID NO: 667010 - DNA, 13 bp, Homo sapiens
tggcccccaataa

SEQ ID NO: 667011 - DNA, 15 bp, Homo sapiens
tggcccccaataaag

SEQ ID NO: 667012 - DNA, 16 bp, Homo sapiens
tggcccccaataaagg

SEQ ID NO: 667013 - DNA, 20 bp, Homo sapiens
tggccccgcaaggcctccag

SEQ ID NO: 667014 - DNA, 18 bp, Homo sapiens
tggccctgggggtctggg

SEQ ID NO: 667015 - DNA, 19 bp, Homo sapiens
tggcctatccgctgccagc

SEQ ID NO: 667016 - DNA, 22 bp, Homo sapiens
tggcctccccatgggcacagtg

SEQ ID NO: 667017 - DNA, 20 bp, Homo sapiens
tggccttgtcctcagccagt

SEQ ID NO: 667018 - DNA, 14 bp, Homo sapiens
tggcggagagtttt

SEQ ID NO: 667019 - DNA, 22 bp, Homo sapiens
tggcggctgcacaacagccctg

SEQ ID NO: 667020 - DNA, 13 bp, Homo sapiens
tggcgtctccctc

SEQ ID NO: 667021 - DNA, 12 bp, Homo sapiens
tggcgtggcctc

SEQ ID NO: 667022 - DNA, 14 bp, Homo sapiens
tggcgtggcctccc

SEQ ID NO: 667023 - DNA, 13 bp, Homo sapiens
tggctcacgcctg

SEQ ID NO: 667024 - DNA, 14 bp, Homo sapiens
tggctcacgcctgt

SEQ ID NO: 667025 - DNA, 14 bp, Homo sapiens
tggctcagggtggt

SEQ ID NO: 667026 - DNA, 19 bp, Homo sapiens
tggctccactcttgatctc

SEQ ID NO: 667027 - DNA, 14 bp, Homo sapiens
tggctccggcctct

SEQ ID NO: 667028 - DNA, 18 bp, Homo sapiens
tggctccggcctctgcct

SEQ ID NO: 667029 - DNA, 16 bp, Homo sapiens
tggctgccttctttcc

SEQ ID NO: 667030 - DNA, 17 bp, Homo sapiens
tggctgccttctttcca

SEQ ID NO: 667031 - DNA, 17 bp, Homo sapiens
tggctggaaagcagagc

SEQ ID NO: 667032 - DNA, 13 bp, Homo sapiens
tggcttatttcta

SEQ ID NO: 667033 - DNA, 21 bp, Homo sapiens
tggcttcaccaagaagcaaag

SEQ ID NO: 667034 - DNA, 17 bp, Homo sapiens
tggctttcctgtttcta

SEQ ID NO: 667035 - DNA, 11 bp, Homo sapiens
tggctttgcct

SEQ ID NO: 667036 - DNA, 14 bp, Homo sapiens
tgggaaaacatttg

SEQ ID NO: 667037 - DNA, 21 bp, Homo sapiens
tgggaaattaaatccaataaa

SEQ ID NO: 667038 - DNA, 14 bp, Homo sapiens
tgggaacaaggaag

SEQ ID NO: 667039 - DNA, 15 bp, Homo sapiens
tgggaacaaggaagg

SEQ ID NO: 667040 - DNA, 13 bp, Homo sapiens
tgggaagaagaag

SEQ ID NO: 667041 - DNA, 16 bp, Homo sapiens
tgggaatgaggaaaat

SEQ ID NO: 667042 - DNA, 19 bp, Homo sapiens
tgggagagtacctgtgtgt

SEQ ID NO: 667043 - DNA, 13 bp, Homo sapiens
tgggagccgcctg

SEQ ID NO: 667044 - DNA, 20 bp, Homo sapiens
tgggagcctggttcagacac

SEQ ID NO: 667045 - DNA, 17 bp, Homo sapiens
tgggaggccgaggtggg

SEQ ID NO: 667046 - DNA, 14 bp, Homo sapiens
tgggatatggtctt

SEQ ID NO: 667047 - DNA, 14 bp, Homo sapiens
tgggattattcttt

SEQ ID NO: 667048 - DNA, 14 bp, Homo sapiens
tgggattttgcaaa

SEQ ID NO: 667049 - DNA, 15 bp, Homo sapiens
tgggattttgcaaaa

SEQ ID NO: 667050 - DNA, 19 bp, Homo sapiens
tgggcagctgtcccttgct

SEQ ID NO: 667051 - DNA, 12 bp, Homo sapiens
tgggccagggct

SEQ ID NO: 667052 - DNA, 21 bp, Homo sapiens
tgggccagggctgccctgaga

SEQ ID NO: 667053 - DNA, 19 bp, Homo sapiens
tgggccatgtccaaagagg

SEQ ID NO: 667054 - DNA, 19 bp, Homo sapiens
tgggccttagtgggccagg

SEQ ID NO: 667055 - DNA, 13 bp, Homo sapiens
tgggccttgctac

SEQ ID NO: 667056 - DNA, 19 bp, Homo sapiens
aaagaggagaaaatttata

SEQ ID NO: 667057 - DNA, 22 bp, Homo sapiens
aaagaggctgcccctctcacca

SEQ ID NO: 667058 - DNA, 20 bp, Homo sapiens
aaagataatttatttcaata

SEQ ID NO: 667059 - DNA, 13 bp, Homo sapiens
aaagatattgttg

SEQ ID NO: 667060 - DNA, 16 bp, Homo sapiens
aaagatgaaaaagaat

SEQ ID NO: 667061 - DNA, 12 bp, Homo sapiens
aaagatttcttc

SEQ ID NO: 667062 - DNA, 19 bp, Homo sapiens
aaagcaaccacaaatgcat

SEQ ID NO: 667063 - DNA, 14 bp, Homo sapiens
aaagcacttaagtg

SEQ ID NO: 667064 - DNA, 19 bp, Homo sapiens
aaagcagagcctcctggga

SEQ ID NO: 667065 - DNA, 13 bp, Homo sapiens
aaagcagggcagc

SEQ ID NO: 667066 - DNA, 15 bp, Homo sapiens
aaagcatgaattgga

SEQ ID NO: 667067 - DNA, 16 bp, Homo sapiens
aaagcatgaattggaa

SEQ ID NO: 667068 - DNA, 20 bp, Homo sapiens
aaagcatgaattggaactgc

SEQ ID NO: 667069 - DNA, 20 bp, Homo sapiens
aaagcatgtggtcttatagt

SEQ ID NO: 667070 - DNA, 14 bp, Homo sapiens
aaagcattttgtaa

SEQ ID NO: 667071 - DNA, 18 bp, Homo sapiens
aaagccacattatttcta

SEQ ID NO: 667072 - DNA, 21 bp, Homo sapiens
aaagccacattatttctagtc

SEQ ID NO: 667073 - DNA, 22 bp, Homo sapiens
aaagctagtgtacctcctctca

SEQ ID NO: 667074 - DNA, 14 bp, Homo sapiens
aaagctgttccttg

SEQ ID NO: 667075 - DNA, 16 bp, Homo sapiens
aaagcttcaaagttta

SEQ ID NO: 667076 - DNA, 17 bp, Homo sapiens
aaagctttttcctcctg

SEQ ID NO: 667077 - DNA, 11 bp, Homo sapiens
aaaggcagctg

SEQ ID NO: 667078 - DNA, 12 bp, Homo sapiens
aaaggcagctgc

SEQ ID NO: 667079 - DNA, 13 bp, Homo sapiens
aaaggcagctgcc

SEQ ID NO: 667080 - DNA, 15 bp, Homo sapiens
aaaggcagctgcctc

SEQ ID NO: 667081 - DNA, 17 bp, Homo sapiens
aaaggcagctgcctctg

SEQ ID NO: 667082 - DNA, 20 bp, Homo sapiens
aaaggcagctgcctctgctc

SEQ ID NO: 667083 - DNA, 15 bp, Homo sapiens
aaagggaagaaagga

SEQ ID NO: 667084 - DNA, 20 bp, Homo sapiens
aaagggagcagaactgaacc

SEQ ID NO: 667085 - DNA, 22 bp, Homo sapiens
aaaggggttggggtgacagtca

SEQ ID NO: 667086 - DNA, 21 bp, Homo sapiens
aaagggtttgagatgtacatc

SEQ ID NO: 667087 - DNA, 16 bp, Homo sapiens
aaaggtaatgtgtgga

SEQ ID NO: 667088 - DNA, 13 bp, Homo sapiens
aaaggtgtattta

SEQ ID NO: 667089 - DNA, 14 bp, Homo sapiens
aaagtaacaatcta

SEQ ID NO: 667090 - DNA, 12 bp, Homo sapiens
aaagtaatttaa

SEQ ID NO: 667091 - DNA, 13 bp, Homo sapiens
aaagtactcttta

SEQ ID NO: 667092 - DNA, 16 bp, Homo sapiens
aaagtactctttaaca

SEQ ID NO: 667093 - DNA, 21 bp, Homo sapiens
aaagtactctttaacatacaa

SEQ ID NO: 667094 - DNA, 14 bp, Homo sapiens
aaagtatatgttag

SEQ ID NO: 667095 - DNA, 12 bp, Homo sapiens
aaagtattttct

SEQ ID NO: 667096 - DNA, 20 bp, Homo sapiens
aaagtcaaatttactttaaa

SEQ ID NO: 667097 - DNA, 18 bp, Homo sapiens
aaagtgcatatttatcca

SEQ ID NO: 667098 - DNA, 22 bp, Homo sapiens
aaagtggcgtgggagccagcct

SEQ ID NO: 667099 - DNA, 23 bp, Homo sapiens
aaagtggtacttgatcattttta

SEQ ID NO: 667100 - DNA, 18 bp, Homo sapiens
aaagtgtgtatatatttt

SEQ ID NO: 667101 - DNA, 19 bp, Homo sapiens
aaagtgtgtatatattttg

SEQ ID NO: 667102 - DNA, 19 bp, Homo sapiens
aaagttacagtttgataca

SEQ ID NO: 667103 - DNA, 19 bp, Homo sapiens
aaagttcaacttatttcat

SEQ ID NO: 667104 - DNA, 14 bp, Homo sapiens
aaagtttgtttgct

SEQ ID NO: 667105 - DNA, 23 bp, Homo sapiens
aaagttttgttgtacttaaatgg

SEQ ID NO: 667106 - DNA, 19 bp, Homo sapiens
aaagtttttaatttgatgc

SEQ ID NO: 667107 - DNA, 22 bp, Homo sapiens
aaagttttttattatgcattat

SEQ ID NO: 667108 - DNA, 16 bp, Homo sapiens
aaataaaatgtttcat

SEQ ID NO: 667109 - DNA, 13 bp, Homo sapiens
aaataaactattt

SEQ ID NO: 667110 - DNA, 14 bp, Homo sapiens
aaataaactgttgc

SEQ ID NO: 667111 - DNA, 13 bp, Homo sapiens
aaataaagccttt

SEQ ID NO: 667112 - DNA, 13 bp, Homo sapiens
aaataaataattt

SEQ ID NO: 667113 - DNA, 17 bp, Homo sapiens
aaataaataattttaat

SEQ ID NO: 667114 - DNA, 15 bp, Homo sapiens
aaataacccataatt

SEQ ID NO: 667115 - DNA, 22 bp, Homo sapiens
aaataactgtgtggcagttaat

SEQ ID NO: 667116 - DNA, 19 bp, Homo sapiens
aaataatgctacaatttta

SEQ ID NO: 667117 - DNA, 12 bp, Homo sapiens
aaatacacattt

SEQ ID NO: 667118 - DNA, 13 bp, Homo sapiens
aaatacacatttg

SEQ ID NO: 667119 - DNA, 19 bp, Homo sapiens
aaatacattataacaacta

SEQ ID NO: 667120 - DNA, 14 bp, Homo sapiens
aaatacatttgtaa

SEQ ID NO: 667121 - DNA, 15 bp, Homo sapiens
aaataccattcacta

SEQ ID NO: 667122 - DNA, 18 bp, Homo sapiens
aaatactatttaagatgt

SEQ ID NO: 667123 - DNA, 21 bp, Homo sapiens
aaatactatttaagatgtgaa

SEQ ID NO: 667124 - DNA, 22 bp, Homo sapiens
aaatactatttaagatgtgaaa

SEQ ID NO: 667125 - DNA, 14 bp, Homo sapiens
aaatactcagtgat

SEQ ID NO: 667126 - DNA, 13 bp, Homo sapiens
aaatagataattt

SEQ ID NO: 667127 - DNA, 21 bp, Homo sapiens
aaaattgatatttttatacaa

SEQ ID NO: 667128 - DNA, 13 bp, Homo sapiens
aaaattgctatgt

SEQ ID NO: 667129 - DNA, 21 bp, Homo sapiens
aaaatttagaagaaaagttat

SEQ ID NO: 667130 - DNA, 22 bp, Homo sapiens
aaaattttgtatgttaaagaga

SEQ ID NO: 667131 - DNA, 20 bp, Homo sapiens
aaacaattttctgtaatctt

SEQ ID NO: 667132 - DNA, 19 bp, Homo sapiens
aaacactacacatttgaaa

SEQ ID NO: 667133 - DNA, 15 bp, Homo sapiens
aaacactgcaaattt

SEQ ID NO: 667134 - DNA, 12 bp, Homo sapiens
aaacagaacagg

SEQ ID NO: 667135 - DNA, 13 bp, Homo sapiens
aaacagtatttct

SEQ ID NO: 667136 - DNA, 22 bp, Homo sapiens
aaacagtatttctggtgtatat

SEQ ID NO: 667137 - DNA, 16 bp, Homo sapiens
aaacagttgctgtgaa

SEQ ID NO: 667138 - DNA, 22 bp, Homo sapiens
aaacagttgctgtgaactttca

SEQ ID NO: 667139 - DNA, 16 bp, Homo sapiens
aaacatacataataca

SEQ ID NO: 667140 - DNA, 12 bp, Homo sapiens
aaacatttgctg

SEQ ID NO: 667141 - DNA, 14 bp, Homo sapiens
aaacattttacatg

SEQ ID NO: 667142 - DNA, 16 bp, Homo sapiens
aaacattttatcatta

SEQ ID NO: 667143 - DNA, 17 bp, Homo sapiens
aaacattttgaagtgtg

SEQ ID NO: 667144 - DNA, 22 bp, Homo sapiens
aaacattttttcttctgaagat

SEQ ID NO: 667145 - DNA, 15 bp, Homo sapiens
aaaccaagcaaagga

SEQ ID NO: 667146 - DNA, 18 bp, Homo sapiens
aaaccaattaagcagctt

SEQ ID NO: 667147 - DNA, 22 bp, Homo sapiens
aaaccacttaaacgaagagttc

SEQ ID NO: 667148 - DNA, 18 bp, Homo sapiens
aaacccctgtaggcctca

SEQ ID NO: 667149 - DNA, 18 bp, Homo sapiens
aaacctacacactgtcat

SEQ ID NO: 667150 - DNA, 22 bp, Homo sapiens
aaacctgttcaggcaggctttc

SEQ ID NO: 667151 - DNA, 12 bp, Homo sapiens
aaacgctacctc

SEQ ID NO: 667152 - DNA, 18 bp, Homo sapiens
aaacgctacctctctgtc

SEQ ID NO: 667153 - DNA, 21 bp, Homo sapiens
aaacgctacctctctgtccct

SEQ ID NO: 667154 - DNA, 14 bp, Homo sapiens
aaacgtcctcttta

SEQ ID NO: 667155 - DNA, 15 bp, Homo sapiens
aaactaacagataag

SEQ ID NO: 667156 - DNA, 15 bp, Homo sapiens
aaactagctcgtgat

SEQ ID NO: 667157 - DNA, 14 bp, Homo sapiens
aaactatgttccta

SEQ ID NO: 667158 - DNA, 17 bp, Homo sapiens
aaactatgttcctaaca

SEQ ID NO: 667159 - DNA, 18 bp, Homo sapiens
aaactatttatatcacac

SEQ ID NO: 667160 - DNA, 13 bp, Homo sapiens
aaactcctttctt

SEQ ID NO: 667161 - DNA, 21 bp, Homo sapiens
aaactctccttttccttacca

SEQ ID NO: 667162 - DNA, 23 bp, Homo sapiens
aaactgcaagttcattttaaatg

SEQ ID NO: 667163 - DNA, 16 bp, Homo sapiens
aaactgctgtcgttgt

SEQ ID NO: 667164 - DNA, 21 bp, Homo sapiens
aaactgggtatgcgtttcatg

SEQ ID NO: 667165 - DNA, 12 bp, Homo sapiens
aaacttgtacat

SEQ ID NO: 667166 - DNA, 13 bp, Homo sapiens
aaagaaaattgag

SEQ ID NO: 667167 - DNA, 12 bp, Homo sapiens
aaagaaactttt

SEQ ID NO: 667168 - DNA, 12 bp, Homo sapiens
aaagaaatacag

SEQ ID NO: 667169 - DNA, 11 bp, Homo sapiens
aaagaaatatt

SEQ ID NO: 667170 - DNA, 18 bp, Homo sapiens
aaagaacgctgatttaaa

SEQ ID NO: 667171 - DNA, 20 bp, Homo sapiens
aaagaacgctgatttaaaga

SEQ ID NO: 667172 - DNA, 15 bp, Homo sapiens
aaagaatagaaggat

SEQ ID NO: 667173 - DNA, 17 bp, Homo sapiens
aaagactcaagagaatt

SEQ ID NO: 667174 - DNA, 16 bp, Homo sapiens
aaagacttgagacaat

SEQ ID NO: 667175 - DNA, 14 bp, Homo sapiens
aaagagaatgagtc

SEQ ID NO: 667176 - DNA, 20 bp, Homo sapiens
aaagagaatgagtccttgat

SEQ ID NO: 667177 - DNA, 22 bp, Homo sapiens
aaagaggcccaagtgcaaaaga

SEQ ID NO: 667178 - DNA, 16 bp, Homo sapiens
aaagaggctgaaagag

SEQ ID NO: 667179 - DNA, 14 bp, Homo sapiens
aaagaggctgcccc

SEQ ID NO: 667180 - DNA, 18 bp, Homo sapiens
aaagagtaatttcattta

SEQ ID NO: 667181 - DNA, 20 bp, Homo sapiens
aaagagtaatttcatttaaa

SEQ ID NO: 667182 - DNA, 23 bp, Homo sapiens
aaagagtaatttcatttaaatat

SEQ ID NO: 667183 - DNA, 21 bp, Homo sapiens
aaagagttgggtgtctcctta

SEQ ID NO: 667184 - DNA, 22 bp, Homo sapiens
aaagatattgttgttttccatg

SEQ ID NO: 667185 - DNA, 18 bp, Homo sapiens
aaagatgctagaaaaatg

SEQ ID NO: 667186 - DNA, 14 bp, Homo sapiens
aaagatttattgta

SEQ ID NO: 667187 - DNA, 17 bp, Homo sapiens
aaagatttattgtaagc

SEQ ID NO: 667188 - DNA, 16 bp, Homo sapiens
aaagcatgaaatgtga

SEQ ID NO: 667189 - DNA, 13 bp, Homo sapiens
aaagcatgaattg

SEQ ID NO: 667190 - DNA, 17 bp, Homo sapiens
aaagcatgaattggaac

SEQ ID NO: 667191 - DNA, 23 bp, Homo sapiens
aaagcatgaattggaactgcaat

SEQ ID NO: 667192 - DNA, 22 bp, Homo sapiens
aaagcatgttcacccttatagt

SEQ ID NO: 667193 - DNA, 13 bp, Homo sapiens
aaagcattttgta

SEQ ID NO: 667194 - DNA, 17 bp, Homo sapiens
aaagccacattatttct

SEQ ID NO: 667195 - DNA, 20 bp, Homo sapiens
aaagccacattatttctagt

SEQ ID NO: 667196 - DNA, 14 bp, Homo sapiens
aaagccagggtctc

SEQ ID NO: 667197 - DNA, 22 bp, Homo sapiens
aaagccatccccgctcctggtt

SEQ ID NO: 667198 - DNA, 24 bp, Homo sapiens
aaagctcactgctgatcgtagaaa

SEQ ID NO: 667199 - DNA, 21 bp, Homo sapiens
aaagctttcctgtttccaggg

SEQ ID NO: 667200 - DNA, 14 bp, Homo sapiens
aaagcttttaaaat

SEQ ID NO: 667201 - DNA, 16 bp, Homo sapiens
aaagctttttcctcct

SEQ ID NO: 667202 - DNA, 13 bp, Homo sapiens
aaaggaagactag

SEQ ID NO: 667203 - DNA, 19 bp, Homo sapiens
aaaggaagagctaataaat

SEQ ID NO: 667204 - DNA, 22 bp, Homo sapiens
aaaggacaccttttaactcacc

SEQ ID NO: 667205 - DNA, 13 bp, Homo sapiens
aaaggactcagtg

SEQ ID NO: 667206 - DNA, 19 bp, Homo sapiens
aaaggagccttttgctctc

SEQ ID NO: 667207 - DNA, 14 bp, Homo sapiens
aaaggcagctgcct

SEQ ID NO: 667208 - DNA, 16 bp, Homo sapiens
aaaggcagctgcctct

SEQ ID NO: 667209 - DNA, 18 bp, Homo sapiens
aaaggcagctgcctctgc

SEQ ID NO: 667210 - DNA, 22 bp, Homo sapiens
aaaggcagctgcctctgctccc

SEQ ID NO: 667211 - DNA, 23 bp, Homo sapiens
aaaggcagctgcctctgctccct

SEQ ID NO: 667212 - DNA, 20 bp, Homo sapiens
aaaggggttggggtgacagt

SEQ ID NO: 667213 - DNA, 16 bp, Homo sapiens
aaagtaactgtgagaa

SEQ ID NO: 667214 - DNA, 23 bp, Homo sapiens
aaagtcaaaaaattatttgctat

SEQ ID NO: 667215 - DNA, 16 bp, Homo sapiens
aaagtcaaatttactt

SEQ ID NO: 667216 - DNA, 17 bp, Homo sapiens
aaagtcaaatttacttt

SEQ ID NO: 667217 - DNA, 18 bp, Homo sapiens
aaagtctgttgattaaag

SEQ ID NO: 667218 - DNA, 19 bp, Homo sapiens
aaagtctgttgattaaaga

SEQ ID NO: 667219 - DNA, 18 bp, Homo sapiens
aaagtcttttttttcctg

SEQ ID NO: 667220 - DNA, 20 bp, Homo sapiens
aaagtgcacacctttattca

SEQ ID NO: 667221 - DNA, 21 bp, Homo sapiens
aaagtggcgtgggagccagcc

SEQ ID NO: 667222 - DNA, 16 bp, Homo sapiens
aaagtgtgtatatatt

SEQ ID NO: 667223 - DNA, 21 bp, Homo sapiens
aaagtgtgtatatattttgtg

SEQ ID NO: 667224 - DNA, 16 bp, Homo sapiens
aaagttaccagtgcct

SEQ ID NO: 667225 - DNA, 21 bp, Homo sapiens
aaagttctgtgtaaacagaag

SEQ ID NO: 667226 - DNA, 12 bp, Homo sapiens
aaagtttaaatg

SEQ ID NO: 667227 - DNA, 17 bp, Homo sapiens
aaagttttatatgcttt

SEQ ID NO: 667228 - DNA, 17 bp, Homo sapiens
aaagtttttaatttgat

SEQ ID NO: 667229 - DNA, 14 bp, Homo sapiens
aaagtttttagaat

SEQ ID NO: 667230 - DNA, 14 bp, Homo sapiens
aaataaactattta

SEQ ID NO: 667231 - DNA, 19 bp, Homo sapiens
aaataaactatttatatca

SEQ ID NO: 667232 - DNA, 21 bp, Homo sapiens
aaataaactatttatatcaca

SEQ ID NO: 667233 - DNA, 17 bp, Homo sapiens
aaataaactttttttag

SEQ ID NO: 667234 - DNA, 12 bp, Homo sapiens
aaataaagcctt

SEQ ID NO: 667235 - DNA, 16 bp, Homo sapiens
aaataaagccttttaa

SEQ ID NO: 667236 - DNA, 21 bp, Homo sapiens
aaataaagccttttaaatcat

SEQ ID NO: 667237 - DNA, 14 bp, Homo sapiens
aaataaataatttt

SEQ ID NO: 667238 - DNA, 17 bp, Homo sapiens
aaataaattagttgtta

SEQ ID NO: 667239 - DNA, 16 bp, Homo sapiens
aaataagaaataatgc

SEQ ID NO: 667240 - DNA, 19 bp, Homo sapiens
aaataagacaaaaataata

SEQ ID NO: 667241 - DNA, 17 bp, Homo sapiens
aaataatatatttcttc

SEQ ID NO: 667242 - DNA, 17 bp, Homo sapiens
aaataatgcttcagata

SEQ ID NO: 667243 - DNA, 12 bp, Homo sapiens
aaataattttaa

SEQ ID NO: 667244 - DNA, 12 bp, Homo sapiens
aaataattttgt

SEQ ID NO: 667245 - DNA, 18 bp, Homo sapiens
aaatacagttatttcatc

SEQ ID NO: 667246 - DNA, 15 bp, Homo sapiens
aaatacatagtgaaa

SEQ ID NO: 667247 - DNA, 13 bp, Homo sapiens
aagagacactcca

SEQ ID NO: 667248 - DNA, 15 bp, Homo sapiens
aagagagatgttttg

SEQ ID NO: 667249 - DNA, 20 bp, Homo sapiens
aagaggaacagcactgggga

SEQ ID NO: 667250 - DNA, 21 bp, Homo sapiens
aagaggctgcccctctcacca

SEQ ID NO: 667251 - DNA, 18 bp, Homo sapiens
aagagggagaagcatgaa

SEQ ID NO: 667252 - DNA, 16 bp, Homo sapiens
aagaggtgggagggcc

SEQ ID NO: 667253 - DNA, 18 bp, Homo sapiens
aagagtgacttattttgt

SEQ ID NO: 667254 - DNA, 20 bp, Homo sapiens
aagagttcccttgaaacttt

SEQ ID NO: 667255 - DNA, 21 bp, Homo sapiens
aagagtttcagtttgttggaa

SEQ ID NO: 667256 - DNA, 16 bp, Homo sapiens
aagataatttatttca

SEQ ID NO: 667257 - DNA, 14 bp, Homo sapiens
aagatattgaagga

SEQ ID NO: 667258 - DNA, 19 bp, Homo sapiens
aagatattgttgttttcca

SEQ ID NO: 667259 - DNA, 20 bp, Homo sapiens
aagatattgttgttttccat

SEQ ID NO: 667260 - DNA, 21 bp, Homo sapiens
aagatcttttcgaagctgtta

SEQ ID NO: 667261 - DNA, 22 bp, Homo sapiens
aagatgatttaagtatacagga

SEQ ID NO: 667262 - DNA, 16 bp, Homo sapiens
aagatggaaatacagt

SEQ ID NO: 667263 - DNA, 21 bp, Homo sapiens
aagatgtagcgctttgaatat

SEQ ID NO: 667264 - DNA, 15 bp, Homo sapiens
aagatgttctggata

SEQ ID NO: 667265 - DNA, 14 bp, Homo sapiens
aagattgatatcta

SEQ ID NO: 667266 - DNA, 16 bp, Homo sapiens
aagattgatatctata

SEQ ID NO: 667267 - DNA, 22 bp, Homo sapiens
aagatttgtgtttttctttttc

SEQ ID NO: 667268 - DNA, 17 bp, Homo sapiens
aagattttgaatgcttc

SEQ ID NO: 667269 - DNA, 15 bp, Homo sapiens
aagatttttttcctg

SEQ ID NO: 667270 - DNA, 13 bp, Homo sapiens
aagcaaacttaca

SEQ ID NO: 667271 - DNA, 19 bp, Homo sapiens
aagcaaatgttaaaagttt

SEQ ID NO: 667272 - DNA, 13 bp, Homo sapiens
aagcaacatttgt

SEQ ID NO: 667273 - DNA, 18 bp, Homo sapiens
aagcaagagagatgtttt

SEQ ID NO: 667274 - DNA, 18 bp, Homo sapiens
aagcactttgggattctt

SEQ ID NO: 667275 - DNA, 18 bp, Homo sapiens
aagcagagcctcctggga

SEQ ID NO: 667276 - DNA, 18 bp, Homo sapiens
aagcagaggaccagggcc

SEQ ID NO: 667277 - DNA, 22 bp, Homo sapiens
aagcagggcagcagggaacaaa

SEQ ID NO: 667278 - DNA, 16 bp, Homo sapiens
aagcaggtttgttttc

SEQ ID NO: 667279 - DNA, 22 bp, Homo sapiens
aagcagttatggtgatgactta

SEQ ID NO: 667280 - DNA, 20 bp, Homo sapiens
aagcatagataatattgttt

SEQ ID NO: 667281 - DNA, 18 bp, Homo sapiens
aagcatatcccaccaacc

SEQ ID NO: 667282 - DNA, 16 bp, Homo sapiens
aagcatgaattggaac

SEQ ID NO: 667283 - DNA, 18 bp, Homo sapiens
aagcatgaattggaactg

SEQ ID NO: 667284 - DNA, 12 bp, Homo sapiens
aagcattttgaa

SEQ ID NO: 667285 - DNA, 13 bp, Homo sapiens
aagcattttgtaa

SEQ ID NO: 667286 - DNA, 14 bp, Homo sapiens
aagcattttgtaat

SEQ ID NO: 667287 - DNA, 19 bp, Homo sapiens
aagccaatctacaatctct

SEQ ID NO: 667288 - DNA, 18 bp, Homo sapiens
aagccacattatttctag

SEQ ID NO: 667289 - DNA, 19 bp, Homo sapiens
aagccagggtctctccctc

SEQ ID NO: 667290 - DNA, 20 bp, Homo sapiens
aagccagggtctctccctca

SEQ ID NO: 667291 - DNA, 23 bp, Homo sapiens
aagccagggtctctccctcaggt

SEQ ID NO: 667292 - DNA, 23 bp, Homo sapiens
aagccaggttccacagaggacac

SEQ ID NO: 667293 - DNA, 12 bp, Homo sapiens
aagcccaactgg

SEQ ID NO: 667294 - DNA, 13 bp, Homo sapiens
aagccccgacaca

SEQ ID NO: 667295 - DNA, 17 bp, Homo sapiens
aagccgagagccttttg

SEQ ID NO: 667296 - DNA, 17 bp, Homo sapiens
aagccgttgacaaggct

SEQ ID NO: 667297 - DNA, 14 bp, Homo sapiens
aagcctaaatttgt

SEQ ID NO: 667298 - DNA, 18 bp, Homo sapiens
aagcctcaaaacaaaggc

SEQ ID NO: 667299 - DNA, 17 bp, Homo sapiens
aagcctgcctggaagag

SEQ ID NO: 667300 - DNA, 13 bp, Homo sapiens
aagccttcaaaac

SEQ ID NO: 667301 - DNA, 22 bp, Homo sapiens
aagccttcaaaactatagcttg

SEQ ID NO: 667302 - DNA, 14 bp, Homo sapiens
aagccttttaaatc

SEQ ID NO: 667303 - DNA, 15 bp, Homo sapiens
aagccttttaaatca

SEQ ID NO: 667304 - DNA, 11 bp, Homo sapiens
aagctaaagag

SEQ ID NO: 667305 - DNA, 12 bp, Homo sapiens
aagctagtgttt

SEQ ID NO: 667306 - DNA, 14 bp, Homo sapiens
aagctagtgtttct

SEQ ID NO: 667307 - DNA, 22 bp, Homo sapiens
aagctcaaagtatgcaatgctt

SEQ ID NO: 667308 - DNA, 23 bp, Homo sapiens
aagctcactgctgatcgtagaaa

SEQ ID NO: 667309 - DNA, 19 bp, Homo sapiens
aagctgacagcactacaaa

SEQ ID NO: 667310 - DNA, 23 bp, Homo sapiens
aagctgcagagatttctcattga

SEQ ID NO: 667311 - DNA, 17 bp, Homo sapiens
aagctgctccaggcctg

SEQ ID NO: 667312 - DNA, 14 bp, Homo sapiens
aagctggcctgaga

SEQ ID NO: 667313 - DNA, 17 bp, Homo sapiens
aagctgttatttcttcc

SEQ ID NO: 667314 - DNA, 21 bp, Homo sapiens
aagctgttatttcttccctgc

SEQ ID NO: 667315 - DNA, 20 bp, Homo sapiens
aagctttattttgagatgta

SEQ ID NO: 667316 - DNA, 23 bp, Homo sapiens
aaggaaccttccttcctgcttga

SEQ ID NO: 667317 - DNA, 14 bp, Homo sapiens
aaggaagcaacaga

SEQ ID NO: 667318 - DNA, 21 bp, Homo sapiens
aaggaagttttaactttaata

SEQ ID NO: 667319 - DNA, 14 bp, Homo sapiens
aaggagaggcaaag

SEQ ID NO: 667320 - DNA, 22 bp, Homo sapiens
aaggagttacagggaagtggtc

SEQ ID NO: 667321 - DNA, 15 bp, Homo sapiens
aaggatagtaagcat

SEQ ID NO: 667322 - DNA, 14 bp, Homo sapiens
aaggatatactgca

SEQ ID NO: 667323 - DNA, 22 bp, Homo sapiens
aaggatcaacaacatccactgt

SEQ ID NO: 667324 - DNA, 16 bp, Homo sapiens
aaggcagctgcctctg

SEQ ID NO: 667325 - DNA, 17 bp, Homo sapiens
aaggcagctgcctctgc

SEQ ID NO: 667326 - DNA, 12 bp, Homo sapiens
aaggcagggacc

SEQ ID NO: 667327 - DNA, 15 bp, Homo sapiens
aaggcattgattgca

SEQ ID NO: 667328 - DNA, 15 bp, Homo sapiens
aaggccagcaacatt

SEQ ID NO: 667329 - DNA, 22 bp, Homo sapiens
aaggctgaggcaggaggatcac

SEQ ID NO: 667330 - DNA, 14 bp, Homo sapiens
aaggctggctgtgt

SEQ ID NO: 667331 - DNA, 20 bp, Homo sapiens
aaggctggtaagagaagtga

SEQ ID NO: 667332 - DNA, 15 bp, Homo sapiens
aaggcttaattgact

SEQ ID NO: 667333 - DNA, 17 bp, Homo sapiens
aagggaatcctcctcca

SEQ ID NO: 667334 - DNA, 15 bp, Homo sapiens
aagggcattttaccc

SEQ ID NO: 667335 - DNA, 18 bp, Homo sapiens
aagggccagcatatatac

SEQ ID NO: 667336 - DNA, 15 bp, Homo sapiens
aaggggttggggtga

SEQ ID NO: 667337 - DNA, 19 bp, Homo sapiens
aaggggttggggtgacagt

SEQ ID NO: 667338 - DNA, 22 bp, Homo sapiens
aaggggttggggtgacagtcat

SEQ ID NO: 667339 - DNA, 16 bp, Homo sapiens
aagggtgggtgctcag

SEQ ID NO: 667340 - DNA, 18 bp, Homo sapiens
aagggtgggtgctcagaa

SEQ ID NO: 667341 - DNA, 17 bp, Homo sapiens
aaggtacaactgtattt

SEQ ID NO: 667342 - DNA, 19 bp, Homo sapiens
aaggtctcctaaaactggg

SEQ ID NO: 667343 - DNA, 21 bp, Homo sapiens
aaggtctcctaaaactgggat

SEQ ID NO: 667344 - DNA, 18 bp, Homo sapiens
aaggtgacttcctctggt

SEQ ID NO: 667345 - DNA, 22 bp, Homo sapiens
aaggtgggccttgctacctcaa

SEQ ID NO: 667346 - DNA, 20 bp, Homo sapiens
aaggtttctggagcagtgga

SEQ ID NO: 667347 - DNA, 22 bp, Homo sapiens
aaggttttggatcttgaatgtg

SEQ ID NO: 667348 - DNA, 13 bp, Homo sapiens
aagtaaaattgct

SEQ ID NO: 667349 - DNA, 12 bp, Homo sapiens
aagtaaatatat

SEQ ID NO: 667350 - DNA, 14 bp, Homo sapiens
aagtaagaagacat

SEQ ID NO: 667351 - DNA, 22 bp, Homo sapiens
aagtaccttgaactcttagtga

SEQ ID NO: 667352 - DNA, 19 bp, Homo sapiens
aagtagtgggcatttcata

SEQ ID NO: 667353 - DNA, 21 bp, Homo sapiens
aagtatgcaatgcttcattat

SEQ ID NO: 667354 - DNA, 14 bp, Homo sapiens
aagtcaaaaaatta

SEQ ID NO: 667355 - DNA, 17 bp, Homo sapiens
aagtcaaaatatgtaag

SEQ ID NO: 667356 - DNA, 16 bp, Homo sapiens
aagtcaaatttacttt

SEQ ID NO: 667357 - DNA, 22 bp, Homo sapiens
aagtcacccctttctgtcccac

SEQ ID NO: 667358 - DNA, 20 bp, Homo sapiens
aagtcagctccagctttctg

SEQ ID NO: 667359 - DNA, 19 bp, Homo sapiens
aagtccctataataaaggc

SEQ ID NO: 667360 - DNA, 19 bp, Homo sapiens
aagtccgcagaagccctga

SEQ ID NO: 667361 - DNA, 13 bp, Homo sapiens
aagtctgctgctg

SEQ ID NO: 667362 - DNA, 23 bp, Homo sapiens
aagtctgtccaaatttaaaatgt

SEQ ID NO: 667363 - DNA, 14 bp, Homo sapiens
aagtctttaataaa

SEQ ID NO: 667364 - DNA, 16 bp, Homo sapiens
aagtctttaataaata

SEQ ID NO: 667365 - DNA, 19 bp, Homo sapiens
aagtgcacacctttattca

SEQ ID NO: 667366 - DNA, 21 bp, Homo sapiens
aagtgcacacctttattcaga

SEQ ID NO: 667367 - DNA, 20 bp, Homo sapiens
acatttagctgtgctcagaa

SEQ ID NO: 667368 - DNA, 15 bp, Homo sapiens
acatttatgttcctt

SEQ ID NO: 667369 - DNA, 14 bp, Homo sapiens
acatttctcttccc

SEQ ID NO: 667370 - DNA, 21 bp, Homo sapiens
acatttgctgaactcagcaca

SEQ ID NO: 667371 - DNA, 19 bp, Homo sapiens
acattttcagaagttaaca

SEQ ID NO: 667372 - DNA, 13 bp, Homo sapiens
acattttctaaat

SEQ ID NO: 667373 - DNA, 14 bp, Homo sapiens
acattttctaaata

SEQ ID NO: 667374 - DNA, 12 bp, Homo sapiens
acattttgaagt

SEQ ID NO: 667375 - DNA, 15 bp, Homo sapiens
acattttggaaattg

SEQ ID NO: 667376 - DNA, 19 bp, Homo sapiens
acattttttcttctgaaga

SEQ ID NO: 667377 - DNA, 18 bp, Homo sapiens
acatttttttgcatgcat

SEQ ID NO: 667378 - DNA, 20 bp, Homo sapiens
accaaggaaacgctacctct

SEQ ID NO: 667379 - DNA, 22 bp, Homo sapiens
accaaggacggaaaatgcttaa

SEQ ID NO: 667380 - DNA, 12 bp, Homo sapiens
accaataaactt

SEQ ID NO: 667381 - DNA, 20 bp, Homo sapiens
accaattacatggaactttt

SEQ ID NO: 667382 - DNA, 19 bp, Homo sapiens
accacagccggtcagagga

SEQ ID NO: 667383 - DNA, 17 bp, Homo sapiens
accacagggttcaaaat

SEQ ID NO: 667384 - DNA, 22 bp, Homo sapiens
accacagggttcaaaatgtctg

SEQ ID NO: 667385 - DNA, 17 bp, Homo sapiens
accacatcaaataagaa

SEQ ID NO: 667386 - DNA, 22 bp, Homo sapiens
accacgggacatcacagggtgg

SEQ ID NO: 667387 - DNA, 21 bp, Homo sapiens
accactcgtgcatccctgaga

SEQ ID NO: 667388 - DNA, 18 bp, Homo sapiens
accactcttttgctgtgc

SEQ ID NO: 667389 - DNA, 23 bp, Homo sapiens
accactgggccataatgttgctt

SEQ ID NO: 667390 - DNA, 14 bp, Homo sapiens
accacttccagggg

SEQ ID NO: 667391 - DNA, 20 bp, Homo sapiens
accacttccaggggaacctg

SEQ ID NO: 667392 - DNA, 20 bp, Homo sapiens
accagcctggtcaacatagt

SEQ ID NO: 667393 - DNA, 20 bp, Homo sapiens
accagcttcactctctccgt

SEQ ID NO: 667394 - DNA, 23 bp, Homo sapiens
accagggccttttctggcaccgc

SEQ ID NO: 667395 - DNA, 19 bp, Homo sapiens
accaggtgttctacactca

SEQ ID NO: 667396 - DNA, 16 bp, Homo sapiens
accagtacttctaaga

SEQ ID NO: 667397 - DNA, 19 bp, Homo sapiens
accagtgttgggttttttt

SEQ ID NO: 667398 - DNA, 17 bp, Homo sapiens
accagttatgtttgaat

SEQ ID NO: 667399 - DNA, 20 bp, Homo sapiens
accagttatgtttgaatgaa

SEQ ID NO: 667400 - DNA, 21 bp, Homo sapiens
accagttatgtttgaatgaac

SEQ ID NO: 667401 - DNA, 14 bp, Homo sapiens
accataaattcaac

SEQ ID NO: 667402 - DNA, 12 bp, Homo sapiens
accatccagctc

SEQ ID NO: 667403 - DNA, 13 bp, Homo sapiens
accatccagctcc

SEQ ID NO: 667404 - DNA, 12 bp, Homo sapiens
accatcctggct

SEQ ID NO: 667405 - DNA, 13 bp, Homo sapiens
accatcctggcta

SEQ ID NO: 667406 - DNA, 19 bp, Homo sapiens
accatgtgagctcttccta

SEQ ID NO: 667407 - DNA, 22 bp, Homo sapiens
accatttcctcagcttatctct

SEQ ID NO: 667408 - DNA, 17 bp, Homo sapiens
accattttttaatttac

SEQ ID NO: 667409 - DNA, 23 bp, Homo sapiens
accattttttaatttacttgttt

SEQ ID NO: 667410 - DNA, 19 bp, Homo sapiens
acccactttgtaatttttg

SEQ ID NO: 667411 - DNA, 19 bp, Homo sapiens
acccaggctggagtgcagt

SEQ ID NO: 667412 - DNA, 13 bp, Homo sapiens
acccagtcccaca

SEQ ID NO: 667413 - DNA, 21 bp, Homo sapiens
acccattcagagactgtccct

SEQ ID NO: 667414 - DNA, 11 bp, Homo sapiens
accccactcct

SEQ ID NO: 667415 - DNA, 14 bp, Homo sapiens
accccactcctgtc

SEQ ID NO: 667416 - DNA, 20 bp, Homo sapiens
acccccgtggggcagggagc

SEQ ID NO: 667417 - DNA, 13 bp, Homo sapiens
accccctcagcct

SEQ ID NO: 667418 - DNA, 19 bp, Homo sapiens
acccccttgattcccaccg

SEQ ID NO: 667419 - DNA, 16 bp, Homo sapiens
accccgtctctactaa

SEQ ID NO: 667420 - DNA, 18 bp, Homo sapiens
acccctgagccagcaggg

SEQ ID NO: 667421 - DNA, 13 bp, Homo sapiens
acccctgtttctg

SEQ ID NO: 667422 - DNA, 17 bp, Homo sapiens
acccctttctgtcccac

SEQ ID NO: 667423 - DNA, 19 bp, Homo sapiens
acccgagttcctctgggtt

SEQ ID NO: 667424 - DNA, 22 bp, Homo sapiens
accctcttgcccatcctgactg

SEQ ID NO: 667425 - DNA, 20 bp, Homo sapiens
accctgaggtcagggagtgc

SEQ ID NO: 667426 - DNA, 19 bp, Homo sapiens
accctgcaaacagaacagg

SEQ ID NO: 667427 - DNA, 23 bp, Homo sapiens
accctgggtgtccccgctgctgt

SEQ ID NO: 667428 - DNA, 19 bp, Homo sapiens
accctgtcctgcagtccca

SEQ ID NO: 667429 - DNA, 22 bp, Homo sapiens
acccttactggcttacctcctc

SEQ ID NO: 667430 - DNA, 12 bp, Homo sapiens
acccttagaaaa

SEQ ID NO: 667431 - DNA, 13 bp, Homo sapiens
acccttagaaaat

SEQ ID NO: 667432 - DNA, 14 bp, Homo sapiens
acccttataaaatc

SEQ ID NO: 667433 - DNA, 15 bp, Homo sapiens
acccttataaaatcc

SEQ ID NO: 667434 - DNA, 16 bp, Homo sapiens
acccttttcccccttc

SEQ ID NO: 667435 - DNA, 18 bp, Homo sapiens
acccttttcccccttccc

SEQ ID NO: 667436 - DNA, 22 bp, Homo sapiens
acccttttcccccttcccattt

SEQ ID NO: 667437 - DNA, 12 bp, Homo sapiens
acccttttcctt

SEQ ID NO: 667438 - DNA, 15 bp, Homo sapiens
acccttttccttttt

SEQ ID NO: 667439 - DNA, 19 bp, Homo sapiens
acccttttccttttttggg

SEQ ID NO: 667440 - DNA, 22 bp, Homo sapiens
accgattttttttttttcctct

SEQ ID NO: 667441 - DNA, 11 bp, Homo sapiens
accgcccatca

SEQ ID NO: 667442 - DNA, 14 bp, Homo sapiens
accggtcagtgcct

SEQ ID NO: 667443 - DNA, 16 bp, Homo sapiens
accggtcagtgccttt

SEQ ID NO: 667444 - DNA, 22 bp, Homo sapiens
accggtcagtgccttttggaac

SEQ ID NO: 667445 - DNA, 13 bp, Homo sapiens
accggtgctttta

SEQ ID NO: 667446 - DNA, 16 bp, Homo sapiens
acctaaaggtgtattt

SEQ ID NO: 667447 - DNA, 20 bp, Homo sapiens
acctaaaggtgtatttaaac

SEQ ID NO: 667448 - DNA, 12 bp, Homo sapiens
acctaatgttta

SEQ ID NO: 667449 - DNA, 20 bp, Homo sapiens
acctaatgtttatgagccag

SEQ ID NO: 667450 - DNA, 19 bp, Homo sapiens
acctacagactccatctct

SEQ ID NO: 667451 - DNA, 21 bp, Homo sapiens
acctacagactccatctcttc

SEQ ID NO: 667452 - DNA, 22 bp, Homo sapiens
acctacatatgctgatctttta

SEQ ID NO: 667453 - DNA, 15 bp, Homo sapiens
acctcaagggggact

SEQ ID NO: 667454 - DNA, 14 bp, Homo sapiens
acctcaatttttgt

SEQ ID NO: 667455 - DNA, 20 bp, Homo sapiens
acctcaatttttgtttttga

SEQ ID NO: 667456 - DNA, 21 bp, Homo sapiens
acctcaatttttgtttttgag

SEQ ID NO: 667457 - DNA, 18 bp, Homo sapiens
acctcacccttgcaccgt

SEQ ID NO: 667458 - DNA, 17 bp, Homo sapiens
acctcagattcttcatt

SEQ ID NO: 667459 - DNA, 19 bp, Homo sapiens
acctcagattcttcattga

SEQ ID NO: 667460 - DNA, 17 bp, Homo sapiens
acctcctaaatgcccca

SEQ ID NO: 667461 - DNA, 12 bp, Homo sapiens
acctcctctcag

SEQ ID NO: 667462 - DNA, 16 bp, Homo sapiens
acctcggcacacactg

SEQ ID NO: 667463 - DNA, 15 bp, Homo sapiens
acctctcaagctagt

SEQ ID NO: 667464 - DNA, 22 bp, Homo sapiens
acctctcaagctagtgtttcta

SEQ ID NO: 667465 - DNA, 14 bp, Homo sapiens
acctctcctgccct

SEQ ID NO: 667466 - DNA, 15 bp, Homo sapiens
acctctgacaactgt

SEQ ID NO: 667467 - DNA, 19 bp, Homo sapiens
acctctgacaactgtgaag

SEQ ID NO: 667468 - DNA, 18 bp, Homo sapiens
acctctggattcattgtc

SEQ ID NO: 667469 - DNA, 23 bp, Homo sapiens
acctctgggtccttggctcccgg

SEQ ID NO: 667470 - DNA, 15 bp, Homo sapiens
acctcttcacctgac

SEQ ID NO: 667471 - DNA, 21 bp, Homo sapiens
acctgaaataatatatttctt

SEQ ID NO: 667472 - DNA, 20 bp, Homo sapiens
acctgacactaaccagagtc

SEQ ID NO: 667473 - DNA, 14 bp, Homo sapiens
acctgcaggaccct

SEQ ID NO: 667474 - DNA, 13 bp, Homo sapiens
acctgctcccagg

SEQ ID NO: 667475 - DNA, 16 bp, Homo sapiens
acctggcaaaggaccc

SEQ ID NO: 667476 - DNA, 22 bp, Homo sapiens
acctggggagtggttaggcagc

SEQ ID NO: 667477 - DNA, 23 bp, Homo sapiens
acctggggagtggttaggcagca

SEQ ID NO: 667478 - DNA, 20 bp, Homo sapiens
acctggtgagtaacttagaa

SEQ ID NO: 667479 - DNA, 21 bp, Homo sapiens
acctggtgagtaacttagaaa

SEQ ID NO: 667480 - DNA, 21 bp, Homo sapiens
acctgtatatttgtaaagcta

SEQ ID NO: 667481 - DNA, 12 bp, Homo sapiens
acctgtgggtgt

SEQ ID NO: 667482 - DNA, 17 bp, Homo sapiens
accttatttatttttgt

SEQ ID NO: 667483 - DNA, 22 bp, Homo sapiens
accttcatgattatagcaacta

SEQ ID NO: 667484 - DNA, 13 bp, Homo sapiens
accttccaacact

SEQ ID NO: 667485 - DNA, 19 bp, Homo sapiens
accttccaatgcttctgtt

SEQ ID NO: 667486 - DNA, 16 bp, Homo sapiens
accttccttcctgctt

SEQ ID NO: 667487 - DNA, 16 bp, Homo sapiens
agataagcaagagaga

SEQ ID NO: 667488 - DNA, 22 bp, Homo sapiens
agataagcaagagagatgtttt

SEQ ID NO: 667489 - DNA, 20 bp, Homo sapiens
agataatattgtttggtaaa

SEQ ID NO: 667490 - DNA, 19 bp, Homo sapiens
agataatttacaagatatt

SEQ ID NO: 667491 - DNA, 17 bp, Homo sapiens
agatacttatttttctg

SEQ ID NO: 667492 - DNA, 15 bp, Homo sapiens
agataggaaactgaa

SEQ ID NO: 667493 - DNA, 18 bp, Homo sapiens
agatattattaattttta

SEQ ID NO: 667494 - DNA, 18 bp, Homo sapiens
agatattgtgaagtacat

SEQ ID NO: 667495 - DNA, 21 bp, Homo sapiens
agatattgtgaagtacatatt

SEQ ID NO: 667496 - DNA, 18 bp, Homo sapiens
agatccatttccattgct

SEQ ID NO: 667497 - DNA, 18 bp, Homo sapiens
agatccttttattctcca

SEQ ID NO: 667498 - DNA, 21 bp, Homo sapiens
agatcgagaccatcctggcta

SEQ ID NO: 667499 - DNA, 14 bp, Homo sapiens
agatcgtgtattga

SEQ ID NO: 667500 - DNA, 16 bp, Homo sapiens
agatctaaacagttat

SEQ ID NO: 667501 - DNA, 20 bp, Homo sapiens
agatctgtgccatagaacaa

SEQ ID NO: 667502 - DNA, 23 bp, Homo sapiens
agatcttaggtatagaggaccct

SEQ ID NO: 667503 - DNA, 20 bp, Homo sapiens
agatctttcagaaatataac

SEQ ID NO: 667504 - DNA, 14 bp, Homo sapiens
agatgaaaaagaat

SEQ ID NO: 667505 - DNA, 17 bp, Homo sapiens
agatgaccataattttt

SEQ ID NO: 667506 - DNA, 14 bp, Homo sapiens
agatgcaattgttt

SEQ ID NO: 667507 - DNA, 20 bp, Homo sapiens
agatgctgtaacttaaaata

SEQ ID NO: 667508 - DNA, 22 bp, Homo sapiens
agatgctgtaacttaaaatagg

SEQ ID NO: 667509 - DNA, 20 bp, Homo sapiens
agatggtggccacagactga

SEQ ID NO: 667510 - DNA, 13 bp, Homo sapiens
agatgtaattttg

SEQ ID NO: 667511 - DNA, 16 bp, Homo sapiens
agatgtacatctttca

SEQ ID NO: 667512 - DNA, 15 bp, Homo sapiens
agatgtgaaaattac

SEQ ID NO: 667513 - DNA, 18 bp, Homo sapiens
agatgtgttcaggcattc

SEQ ID NO: 667514 - DNA, 23 bp, Homo sapiens
agatgttacaagtttatatatat

SEQ ID NO: 667515 - DNA, 17 bp, Homo sapiens
agatgttagatcagggg

SEQ ID NO: 667516 - DNA, 14 bp, Homo sapiens
agatgttgctcttt

SEQ ID NO: 667517 - DNA, 17 bp, Homo sapiens
agatgttgctctttcac

SEQ ID NO: 667518 - DNA, 15 bp, Homo sapiens
agatgtttggatatt

SEQ ID NO: 667519 - DNA, 12 bp, Homo sapiens
agattacactga

SEQ ID NO: 667520 - DNA, 13 bp, Homo sapiens
agattataataaa

SEQ ID NO: 667521 - DNA, 18 bp, Homo sapiens
agattataataaatatat

SEQ ID NO: 667522 - DNA, 20 bp, Homo sapiens
agattctgcctatgtaaaat

SEQ ID NO: 667523 - DNA, 20 bp, Homo sapiens
agattctggtccctggaaat

SEQ ID NO: 667524 - DNA, 21 bp, Homo sapiens
agattctttcagttctttgga

SEQ ID NO: 667525 - DNA, 14 bp, Homo sapiens
agattgaaaatctt

SEQ ID NO: 667526 - DNA, 18 bp, Homo sapiens
agattgaaaatcttgtgt

SEQ ID NO: 667527 - DNA, 20 bp, Homo sapiens
agattgaacctgaatattgc

SEQ ID NO: 667528 - DNA, 17 bp, Homo sapiens
agattgactaactcaaa

SEQ ID NO: 667529 - DNA, 19 bp, Homo sapiens
agattgactaactcaaata

SEQ ID NO: 667530 - DNA, 20 bp, Homo sapiens
agattgatatctataaaata

SEQ ID NO: 667531 - DNA, 21 bp, Homo sapiens
agattgatatctataaaatag

SEQ ID NO: 667532 - DNA, 15 bp, Homo sapiens
agattgctgcaaaga

SEQ ID NO: 667533 - DNA, 18 bp, Homo sapiens
agatttatacagttgaaa

SEQ ID NO: 667534 - DNA, 17 bp, Homo sapiens
agatttccttaacctta

SEQ ID NO: 667535 - DNA, 16 bp, Homo sapiens
agatttctcattgact

SEQ ID NO: 667536 - DNA, 18 bp, Homo sapiens
agatttctcattgacttt

SEQ ID NO: 667537 - DNA, 12 bp, Homo sapiens
agattttgttgg

SEQ ID NO: 667538 - DNA, 22 bp, Homo sapiens
agcaaagaaggccagcaacatt

SEQ ID NO: 667539 - DNA, 22 bp, Homo sapiens
agcaaagttcaacttatttcat

SEQ ID NO: 667540 - DNA, 15 bp, Homo sapiens
agcaaatgacagatt

SEQ ID NO: 667541 - DNA, 15 bp, Homo sapiens
agcaaatggcctcat

SEQ ID NO: 667542 - DNA, 13 bp, Homo sapiens
agcaacagataga

SEQ ID NO: 667543 - DNA, 12 bp, Homo sapiens
agcaacatggct

SEQ ID NO: 667544 - DNA, 16 bp, Homo sapiens
agcaagcaactaattt

SEQ ID NO: 667545 - DNA, 15 bp, Homo sapiens
agcaagttttcttcc

SEQ ID NO: 667546 - DNA, 17 bp, Homo sapiens
agcaatctccatgtgta

SEQ ID NO: 667547 - DNA, 17 bp, Homo sapiens
agcaattcccaggtcat

SEQ ID NO: 667548 - DNA, 13 bp, Homo sapiens
agcacattcggga

SEQ ID NO: 667549 - DNA, 20 bp, Homo sapiens
agcaccacagccggtcagag

SEQ ID NO: 667550 - DNA, 21 bp, Homo sapiens
agcaccagttatgtttgaatg

SEQ ID NO: 667551 - DNA, 14 bp, Homo sapiens
agcaccgaggggcc

SEQ ID NO: 667552 - DNA, 19 bp, Homo sapiens
agcaccttgtgcctggggt

SEQ ID NO: 667553 - DNA, 15 bp, Homo sapiens
agcacttaagtgtta

SEQ ID NO: 667554 - DNA, 17 bp, Homo sapiens
agcactttgggaggccg

SEQ ID NO: 667555 - DNA, 13 bp, Homo sapiens
agcagaaagaaga

SEQ ID NO: 667556 - DNA, 20 bp, Homo sapiens
agcagaaagaagagaagtga

SEQ ID NO: 667557 - DNA, 14 bp, Homo sapiens
agcagaactgaagt

SEQ ID NO: 667558 - DNA, 22 bp, Homo sapiens
agcagaactgaagtgtgctgtg

SEQ ID NO: 667559 - DNA, 15 bp, Homo sapiens
agcagagcctcctgg

SEQ ID NO: 667560 - DNA, 16 bp, Homo sapiens
agcagagcctcctggg

SEQ ID NO: 667561 - DNA, 17 bp, Homo sapiens
agcagagcctcctggga

SEQ ID NO: 667562 - DNA, 13 bp, Homo sapiens
agcagagttttca

SEQ ID NO: 667563 - DNA, 22 bp, Homo sapiens
agcagattgtttcctcttccaa

SEQ ID NO: 667564 - DNA, 19 bp, Homo sapiens
agcagcacgattttgcaca

SEQ ID NO: 667565 - DNA, 16 bp, Homo sapiens
agcagcccaccctgct

SEQ ID NO: 667566 - DNA, 15 bp, Homo sapiens
agcagcttattgttt

SEQ ID NO: 667567 - DNA, 15 bp, Homo sapiens
agcagcttctccagg

SEQ ID NO: 667568 - DNA, 13 bp, Homo sapiens
agcaggagtggtg

SEQ ID NO: 667569 - DNA, 14 bp, Homo sapiens
agcagggaaggcct

SEQ ID NO: 667570 - DNA, 21 bp, Homo sapiens
agcagggagaccatgcctccc

SEQ ID NO: 667571 - DNA, 14 bp, Homo sapiens
agcagggcagcagg

SEQ ID NO: 667572 - DNA, 13 bp, Homo sapiens
agcaggtttgttt

SEQ ID NO: 667573 - DNA, 21 bp, Homo sapiens
agcaggtttgttttcagcact

SEQ ID NO: 667574 - DNA, 19 bp, Homo sapiens
agcagtccccagctgagtg

SEQ ID NO: 667575 - DNA, 17 bp, Homo sapiens
agcagtctaaacagagt

SEQ ID NO: 667576 - DNA, 17 bp, Homo sapiens
agcagtctgataaactg

SEQ ID NO: 667577 - DNA, 18 bp, Homo sapiens
agcagtctgataaactga

SEQ ID NO: 667578 - DNA, 17 bp, Homo sapiens
agcagtgagccaaatgt

SEQ ID NO: 667579 - DNA, 16 bp, Homo sapiens
agcatagaaaccacta

SEQ ID NO: 667580 - DNA, 14 bp, Homo sapiens
agcatatcccacca

SEQ ID NO: 667581 - DNA, 23 bp, Homo sapiens
agcatatgggtgggattttgcaa

SEQ ID NO: 667582 - DNA, 20 bp, Homo sapiens
agcatctccctcactgaaac

SEQ ID NO: 667583 - DNA, 13 bp, Homo sapiens
agcatgaaaaagc

SEQ ID NO: 667584 - DNA, 14 bp, Homo sapiens
agcatgaaatgtga

SEQ ID NO: 667585 - DNA, 14 bp, Homo sapiens
agcatgaatgtttt

SEQ ID NO: 667586 - DNA, 20 bp, Homo sapiens
agcatggagagaggcctgtg

SEQ ID NO: 667587 - DNA, 11 bp, Homo sapiens
agcatggggat

SEQ ID NO: 667588 - DNA, 19 bp, Homo sapiens
agcatgtgtatttccagtg

SEQ ID NO: 667589 - DNA, 23 bp, Homo sapiens
agcattgaagtatggtgtgttca

SEQ ID NO: 667590 - DNA, 15 bp, Homo sapiens
agcattgataatctt

SEQ ID NO: 667591 - DNA, 16 bp, Homo sapiens
agcattgataatcttc

SEQ ID NO: 667592 - DNA, 17 bp, Homo sapiens
agcattgataatcttca

SEQ ID NO: 667593 - DNA, 19 bp, Homo sapiens
agcattgataatcttcagg

SEQ ID NO: 667594 - DNA, 20 bp, Homo sapiens
agcattgataatcttcaggt

SEQ ID NO: 667595 - DNA, 18 bp, Homo sapiens
agcattgtttgtgatatt

SEQ ID NO: 667596 - DNA, 13 bp, Homo sapiens
agccaaatgtaaa

SEQ ID NO: 667597 - DNA, 22 bp, Homo sapiens
agccaatctacaatctcttttt

SEQ ID NO: 667598 - DNA, 12 bp, Homo sapiens
agccacctggga

SEQ ID NO: 667599 - DNA, 17 bp, Homo sapiens
agccacctgggaacaca

SEQ ID NO: 667600 - DNA, 18 bp, Homo sapiens
agccacctgggaacacag

SEQ ID NO: 667601 - DNA, 15 bp, Homo sapiens
agccagactctgtct

SEQ ID NO: 667602 - DNA, 16 bp, Homo sapiens
agccagcccctcttcc

SEQ ID NO: 667603 - DNA, 15 bp, Homo sapiens
agccaggagctgtca

SEQ ID NO: 667604 - DNA, 17 bp, Homo sapiens
agccaggtatggctctg

SEQ ID NO: 667605 - DNA, 15 bp, Homo sapiens
agccagtaatcttta

SEQ ID NO: 667606 - DNA, 23 bp, Homo sapiens
agccatctaatgcttgtttatga

SEQ ID NO: 667607 - DNA, 17 bp, Homo sapiens
agggatatggcaggact

SEQ ID NO: 667608 - DNA, 18 bp, Homo sapiens
agggatatggcaggactc

SEQ ID NO: 667609 - DNA, 22 bp, Homo sapiens
agggatggaaaaggaagactag

SEQ ID NO: 667610 - DNA, 18 bp, Homo sapiens
agggcaccatccagctcc

SEQ ID NO: 667611 - DNA, 20 bp, Homo sapiens
agggcagactggggcatcct

SEQ ID NO: 667612 - DNA, 15 bp, Homo sapiens
agggcagcggctcca

SEQ ID NO: 667613 - DNA, 22 bp, Homo sapiens
agggcataggaagaaaatgtca

SEQ ID NO: 667614 - DNA, 19 bp, Homo sapiens
agggccagtggggcctgtg

SEQ ID NO: 667615 - DNA, 19 bp, Homo sapiens
agggccagttggtgttcct

SEQ ID NO: 667616 - DNA, 16 bp, Homo sapiens
agggccatggctcagg

SEQ ID NO: 667617 - DNA, 21 bp, Homo sapiens
agggccatggctcagggtggt

SEQ ID NO: 667618 - DNA, 18 bp, Homo sapiens
agggcctggggcctgaga

SEQ ID NO: 667619 - DNA, 21 bp, Homo sapiens
agggccttggaaattcctgta

SEQ ID NO: 667620 - DNA, 19 bp, Homo sapiens
agggccttttctggcaccg

SEQ ID NO: 667621 - DNA, 16 bp, Homo sapiens
agggctgccctgagaa

SEQ ID NO: 667622 - DNA, 17 bp, Homo sapiens
agggctggagcctgggg

SEQ ID NO: 667623 - DNA, 22 bp, Homo sapiens
agggctggcacgtgacaggctc

SEQ ID NO: 667624 - DNA, 19 bp, Homo sapiens
agggctggtccttatttat

SEQ ID NO: 667625 - DNA, 15 bp, Homo sapiens
agggctgtcattgca

SEQ ID NO: 667626 - DNA, 17 bp, Homo sapiens
aggggaaggagaagtaa

SEQ ID NO: 667627 - DNA, 22 bp, Homo sapiens
aggggacaagggatttgaggtg

SEQ ID NO: 667628 - DNA, 13 bp, Homo sapiens
aggggatatttaa

SEQ ID NO: 667629 - DNA, 14 bp, Homo sapiens
aggggatatttaag

SEQ ID NO: 667630 - DNA, 14 bp, Homo sapiens
aggggccggccctg

SEQ ID NO: 667631 - DNA, 16 bp, Homo sapiens
agggggatgccactcc

SEQ ID NO: 667632 - DNA, 15 bp, Homo sapiens
agggggcctcattgt

SEQ ID NO: 667633 - DNA, 21 bp, Homo sapiens
agggggcctcattgtgtctcc

SEQ ID NO: 667634 - DNA, 18 bp, Homo sapiens
agggggctttctggggcc

SEQ ID NO: 667635 - DNA, 14 bp, Homo sapiens
aggggtctccctgg

SEQ ID NO: 667636 - DNA, 21 bp, Homo sapiens
aggggttggggtgacagtcat

SEQ ID NO: 667637 - DNA, 23 bp, Homo sapiens
agggtcggggaggaaataccaaa

SEQ ID NO: 667638 - DNA, 17 bp, Homo sapiens
agggtctcccctcctgc

SEQ ID NO: 667639 - DNA, 18 bp, Homo sapiens
agggtctcccctcctgca

SEQ ID NO: 667640 - DNA, 13 bp, Homo sapiens
agggtctgtgtga

SEQ ID NO: 667641 - DNA, 21 bp, Homo sapiens
agggtctttctcaaagaaata

SEQ ID NO: 667642 - DNA, 16 bp, Homo sapiens
agggtgggtgctcaga

SEQ ID NO: 667643 - DNA, 17 bp, Homo sapiens
agggtgggtgctcagaa

SEQ ID NO: 667644 - DNA, 20 bp, Homo sapiens
agggtgggtgctcagaataa

SEQ ID NO: 667645 - DNA, 20 bp, Homo sapiens
agggttacagagacctatgt

SEQ ID NO: 667646 - DNA, 15 bp, Homo sapiens
agggtttgggcagag

SEQ ID NO: 667647 - DNA, 16 bp, Homo sapiens
aggtacaactgtattt

SEQ ID NO: 667648 - DNA, 13 bp, Homo sapiens
aggtagcttcagc

SEQ ID NO: 667649 - DNA, 18 bp, Homo sapiens
aggtatgatctcttctgg

SEQ ID NO: 667650 - DNA, 17 bp, Homo sapiens
aggtcaagtaagaagac

SEQ ID NO: 667651 - DNA, 19 bp, Homo sapiens
aggtcaagtaagaagacat

SEQ ID NO: 667652 - DNA, 18 bp, Homo sapiens
aggtcataaagcattgga

SEQ ID NO: 667653 - DNA, 21 bp, Homo sapiens
aggtcctttggacagctgact

SEQ ID NO: 667654 - DNA, 20 bp, Homo sapiens
aggtcgcttgggaattttat

SEQ ID NO: 667655 - DNA, 21 bp, Homo sapiens
aggtctccagttggctttact

SEQ ID NO: 667656 - DNA, 21 bp, Homo sapiens
aggtgaaactccagatgccac

SEQ ID NO: 667657 - DNA, 18 bp, Homo sapiens
aggtgatatttttcttat

SEQ ID NO: 667658 - DNA, 17 bp, Homo sapiens
aggtgattctcagggct

SEQ ID NO: 667659 - DNA, 12 bp, Homo sapiens
aggtgcagaggt

SEQ ID NO: 667660 - DNA, 19 bp, Homo sapiens
aggtgctatgaagccaact

SEQ ID NO: 667661 - DNA, 21 bp, Homo sapiens
aggtgggccttgctacctcaa

SEQ ID NO: 667662 - DNA, 15 bp, Homo sapiens
aggtgggctggactt

SEQ ID NO: 667663 - DNA, 19 bp, Homo sapiens
aggtgtgaacctacctgcc

SEQ ID NO: 667664 - DNA, 13 bp, Homo sapiens
aggtgtgaatgca

SEQ ID NO: 667665 - DNA, 17 bp, Homo sapiens
aggtgtgtatgtaaagt

SEQ ID NO: 667666 - DNA, 22 bp, Homo sapiens
aggtgttttttatgaagtgcgt

SEQ ID NO: 667667 - DNA, 18 bp, Homo sapiens
aggttccacagaggacac

SEQ ID NO: 667668 - DNA, 22 bp, Homo sapiens
aggttctgtttatggccacatt

SEQ ID NO: 667669 - DNA, 12 bp, Homo sapiens
aggtttattgtt

SEQ ID NO: 667670 - DNA, 15 bp, Homo sapiens
aggtttctggagcag

SEQ ID NO: 667671 - DNA, 23 bp, Homo sapiens
aggttttggatcttgaatgtggt

SEQ ID NO: 667672 - DNA, 14 bp, Homo sapiens
aggttttgttgcta

SEQ ID NO: 667673 - DNA, 15 bp, Homo sapiens
agtaaataattggaa

SEQ ID NO: 667674 - DNA, 17 bp, Homo sapiens
agtaaatcagaaagtaa

SEQ ID NO: 667675 - DNA, 24 bp, Homo sapiens
agtaaatcagaaagtaacaatcta

SEQ ID NO: 667676 - DNA, 22 bp, Homo sapiens
agtaacttatttgactatgaat

SEQ ID NO: 667677 - DNA, 16 bp, Homo sapiens
agtaagaagacatgaa

SEQ ID NO: 667678 - DNA, 23 bp, Homo sapiens
agtaagaataccacatcaaataa

SEQ ID NO: 667679 - DNA, 22 bp, Homo sapiens
agtaagattgatatctataaaa

SEQ ID NO: 667680 - DNA, 21 bp, Homo sapiens
agtaaggctggtaagagaagt

SEQ ID NO: 667681 - DNA, 23 bp, Homo sapiens
agtaaggctggtaagagaagtga

SEQ ID NO: 667682 - DNA, 16 bp, Homo sapiens
agtaatctttatactg

SEQ ID NO: 667683 - DNA, 20 bp, Homo sapiens
agtaatgcagtttttaaaaa

SEQ ID NO: 667684 - DNA, 13 bp, Homo sapiens
agtaatgtaaaga

SEQ ID NO: 667685 - DNA, 17 bp, Homo sapiens
agtaatgtaaagatgat

SEQ ID NO: 667686 - DNA, 22 bp, Homo sapiens
agtaatttaatttgtaaaactt

SEQ ID NO: 667687 - DNA, 12 bp, Homo sapiens
agtacaatcagc

SEQ ID NO: 667688 - DNA, 18 bp, Homo sapiens
agtacatattaggaaaat

SEQ ID NO: 667689 - DNA, 12 bp, Homo sapiens
agtaccatttaa

SEQ ID NO: 667690 - DNA, 18 bp, Homo sapiens
agtacccatctagtactt

SEQ ID NO: 667691 - DNA, 19 bp, Homo sapiens
agtacctgtccaagacagg

SEQ ID NO: 667692 - DNA, 14 bp, Homo sapiens
agtaccttgaactc

SEQ ID NO: 667693 - DNA, 13 bp, Homo sapiens
agtactgtactat

SEQ ID NO: 667694 - DNA, 16 bp, Homo sapiens
agtactttgtgcattc

SEQ ID NO: 667695 - DNA, 13 bp, Homo sapiens
agtagctgggatg

SEQ ID NO: 667696 - DNA, 21 bp, Homo sapiens
agtagctgggatgacaggcgc

SEQ ID NO: 667697 - DNA, 16 bp, Homo sapiens
agtagcttgctccctg

SEQ ID NO: 667698 - DNA, 19 bp, Homo sapiens
agtagcttgctccctgtgt

SEQ ID NO: 667699 - DNA, 23 bp, Homo sapiens
agtagcttgctccctgtgtccac

SEQ ID NO: 667700 - DNA, 14 bp, Homo sapiens
agtagtgtggcctg

SEQ ID NO: 667701 - DNA, 13 bp, Homo sapiens
agtagttaaataa

SEQ ID NO: 667702 - DNA, 19 bp, Homo sapiens
agtataaccatatgatact

SEQ ID NO: 667703 - DNA, 13 bp, Homo sapiens
agtatacattgtc

SEQ ID NO: 667704 - DNA, 18 bp, Homo sapiens
agtatacattgtcttgat

SEQ ID NO: 667705 - DNA, 18 bp, Homo sapiens
agtatctgggattattct

SEQ ID NO: 667706 - DNA, 19 bp, Homo sapiens
agtatctgggattattctt

SEQ ID NO: 667707 - DNA, 20 bp, Homo sapiens
agtatctgggattattcttt

SEQ ID NO: 667708 - DNA, 14 bp, Homo sapiens
agtatgcaatgctt

SEQ ID NO: 667709 - DNA, 17 bp, Homo sapiens
agtatgttttttatgtt

SEQ ID NO: 667710 - DNA, 16 bp, Homo sapiens
agtattgtttaaaatg

SEQ ID NO: 667711 - DNA, 19 bp, Homo sapiens
agtattgtttaaaatgtaa

SEQ ID NO: 667712 - DNA, 19 bp, Homo sapiens
agtattttaagaagacata

SEQ ID NO: 667713 - DNA, 19 bp, Homo sapiens
agtattttttcaagttgta

SEQ ID NO: 667714 - DNA, 20 bp, Homo sapiens
agtcaaagttgaaaattcat

SEQ ID NO: 667715 - DNA, 14 bp, Homo sapiens
agtcaataggccta

SEQ ID NO: 667716 - DNA, 20 bp, Homo sapiens
agtcacccctttctgtccca

SEQ ID NO: 667717 - DNA, 13 bp, Homo sapiens
agtcactgggaga

SEQ ID NO: 667718 - DNA, 20 bp, Homo sapiens
agtcagaaaattggcagtgg

SEQ ID NO: 667719 - DNA, 15 bp, Homo sapiens
agtcatcatcagggc

SEQ ID NO: 667720 - DNA, 16 bp, Homo sapiens
agtcatcatcagggcc

SEQ ID NO: 667721 - DNA, 17 bp, Homo sapiens
agtcatcatcagggcct

SEQ ID NO: 667722 - DNA, 18 bp, Homo sapiens
agtcatcatcagggcctg

SEQ ID NO: 667723 - DNA, 21 bp, Homo sapiens
agtcatcatcagggcctgggg

SEQ ID NO: 667724 - DNA, 22 bp, Homo sapiens
agtcatcatcagggcctggggc

SEQ ID NO: 667725 - DNA, 15 bp, Homo sapiens
agtcatctgatgaga

SEQ ID NO: 667726 - DNA, 21 bp, Homo sapiens
atagatgttgctctttcacct

SEQ ID NO: 667727 - DNA, 16 bp, Homo sapiens
atagcaactaatgttt

SEQ ID NO: 667728 - DNA, 24 bp, Homo sapiens
atagcattgataatcttcaggtga

SEQ ID NO: 667729 - DNA, 14 bp, Homo sapiens
atagctcaagaatt

SEQ ID NO: 667730 - DNA, 17 bp, Homo sapiens
atagcttgcagaactgt

SEQ ID NO: 667731 - DNA, 16 bp, Homo sapiens
ataggaaactgaagca

SEQ ID NO: 667732 - DNA, 14 bp, Homo sapiens
ataggaagaaaatg

SEQ ID NO: 667733 - DNA, 23 bp, Homo sapiens
ataggcctgtcccttgcctctgc

SEQ ID NO: 667734 - DNA, 18 bp, Homo sapiens
atagtaccttcaatactt

SEQ ID NO: 667735 - DNA, 15 bp, Homo sapiens
atagtatacattgtc

SEQ ID NO: 667736 - DNA, 17 bp, Homo sapiens
atagtatacattgtctt

SEQ ID NO: 667737 - DNA, 17 bp, Homo sapiens
atagtcaatttctactt

SEQ ID NO: 667738 - DNA, 14 bp, Homo sapiens
atagtgagacactg

SEQ ID NO: 667739 - DNA, 19 bp, Homo sapiens
atagtgtcatataaactca

SEQ ID NO: 667740 - DNA, 21 bp, Homo sapiens
atagtgtcatataaactcatt

SEQ ID NO: 667741 - DNA, 13 bp, Homo sapiens
atagttaaactga

SEQ ID NO: 667742 - DNA, 18 bp, Homo sapiens
atagttagatctttgtaa

SEQ ID NO: 667743 - DNA, 20 bp, Homo sapiens
atagttcccaggtgatattt

SEQ ID NO: 667744 - DNA, 23 bp, Homo sapiens
atagttggaggtgattccagtga

SEQ ID NO: 667745 - DNA, 23 bp, Homo sapiens
atagttttttctttcccatgtat

SEQ ID NO: 667746 - DNA, 13 bp, Homo sapiens
atataaaacttaa

SEQ ID NO: 667747 - DNA, 12 bp, Homo sapiens
atataaaattat

SEQ ID NO: 667748 - DNA, 12 bp, Homo sapiens
atataacacatt

SEQ ID NO: 667749 - DNA, 14 bp, Homo sapiens
atataatgtatttt

SEQ ID NO: 667750 - DNA, 16 bp, Homo sapiens
atataatgtattttct

SEQ ID NO: 667751 - DNA, 22 bp, Homo sapiens
atataatgtattttctttttat

SEQ ID NO: 667752 - DNA, 15 bp, Homo sapiens
atataatgttgataa

SEQ ID NO: 667753 - DNA, 12 bp, Homo sapiens
atataattttat

SEQ ID NO: 667754 - DNA, 13 bp, Homo sapiens
atataattttatg

SEQ ID NO: 667755 - DNA, 14 bp, Homo sapiens
atatacatatatat

SEQ ID NO: 667756 - DNA, 22 bp, Homo sapiens
atatacatatgagaatatacct

SEQ ID NO: 667757 - DNA, 16 bp, Homo sapiens
atatacatattgtata

SEQ ID NO: 667758 - DNA, 13 bp, Homo sapiens
atatacattttct

SEQ ID NO: 667759 - DNA, 23 bp, Homo sapiens
atatacattttctaaataaaaat

SEQ ID NO: 667760 - DNA, 21 bp, Homo sapiens
atataccttatttatttttgt

SEQ ID NO: 667761 - DNA, 17 bp, Homo sapiens
atatagtgggtacatca

SEQ ID NO: 667762 - DNA, 16 bp, Homo sapiens
atatagttaaactgag

SEQ ID NO: 667763 - DNA, 12 bp, Homo sapiens
atatataaatgt

SEQ ID NO: 667764 - DNA, 15 bp, Homo sapiens
atatatacttgcaag

SEQ ID NO: 667765 - DNA, 14 bp, Homo sapiens
atatatagtcaaat

SEQ ID NO: 667766 - DNA, 16 bp, Homo sapiens
atatatataaatgtat

SEQ ID NO: 667767 - DNA, 11 bp, Homo sapiens
atatatataat

SEQ ID NO: 667768 - DNA, 15 bp, Homo sapiens
atatatatctatata

SEQ ID NO: 667769 - DNA, 20 bp, Homo sapiens
atatatatggtcatatacat

SEQ ID NO: 667770 - DNA, 16 bp, Homo sapiens
atatatcttaagcagg

SEQ ID NO: 667771 - DNA, 23 bp, Homo sapiens
atatatcttaagcaggtttgttt

SEQ ID NO: 667772 - DNA, 19 bp, Homo sapiens
atatatgaagacaataatt

SEQ ID NO: 667773 - DNA, 19 bp, Homo sapiens
atatatgcactatgtatat

SEQ ID NO: 667774 - DNA, 15 bp, Homo sapiens
atatatggaagagga

SEQ ID NO: 667775 - DNA, 24 bp, Homo sapiens
atatattaaaacaataatgcaatt

SEQ ID NO: 667776 - DNA, 19 bp, Homo sapiens
atatattttgtgtgaaatt

SEQ ID NO: 667777 - DNA, 16 bp, Homo sapiens
atatcattttaaaatg

SEQ ID NO: 667778 - DNA, 16 bp, Homo sapiens
atatcccaagtgcact

SEQ ID NO: 667779 - DNA, 22 bp, Homo sapiens
atatctataaaatagatataaa

SEQ ID NO: 667780 - DNA, 23 bp, Homo sapiens
atatctataaaatagatataaat

SEQ ID NO: 667781 - DNA, 23 bp, Homo sapiens
atatctcaatgaaccataaattc

SEQ ID NO: 667782 - DNA, 19 bp, Homo sapiens
atatctgggttaagtgttt

SEQ ID NO: 667783 - DNA, 14 bp, Homo sapiens
atatgaatctataa

SEQ ID NO: 667784 - DNA, 16 bp, Homo sapiens
atatgacggaagaaca

SEQ ID NO: 667785 - DNA, 18 bp, Homo sapiens
atatgacggaagaacata

SEQ ID NO: 667786 - DNA, 19 bp, Homo sapiens
atatgccttaatttagaaa

SEQ ID NO: 667787 - DNA, 15 bp, Homo sapiens
atatgctgatctttt

SEQ ID NO: 667788 - DNA, 14 bp, Homo sapiens
atatgctttattaa

SEQ ID NO: 667789 - DNA, 13 bp, Homo sapiens
atatggcaggact

SEQ ID NO: 667790 - DNA, 14 bp, Homo sapiens
atatggcaggactc

SEQ ID NO: 667791 - DNA, 19 bp, Homo sapiens
atatggcttcaccaagaag

SEQ ID NO: 667792 - DNA, 22 bp, Homo sapiens
atatgggttgcatttggtcaag

SEQ ID NO: 667793 - DNA, 14 bp, Homo sapiens
atatggtatatata

SEQ ID NO: 667794 - DNA, 23 bp, Homo sapiens
atatggtcttgagccagtaatct

SEQ ID NO: 667795 - DNA, 14 bp, Homo sapiens
atatgtaatttcaa

SEQ ID NO: 667796 - DNA, 23 bp, Homo sapiens
atatgtaatttcaaaatacattt

SEQ ID NO: 667797 - DNA, 13 bp, Homo sapiens
atatgtattcttt

SEQ ID NO: 667798 - DNA, 21 bp, Homo sapiens
atatgtgacactgcagcagaa

SEQ ID NO: 667799 - DNA, 20 bp, Homo sapiens
atatgtgagtgccttttgca

SEQ ID NO: 667800 - DNA, 19 bp, Homo sapiens
atattaaaacaataatgca

SEQ ID NO: 667801 - DNA, 15 bp, Homo sapiens
atattacctggatta

SEQ ID NO: 667802 - DNA, 18 bp, Homo sapiens
atattacggaggaacaga

SEQ ID NO: 667803 - DNA, 17 bp, Homo sapiens
atattactgacatttct

SEQ ID NO: 667804 - DNA, 19 bp, Homo sapiens
atattcagggtaaatagga

SEQ ID NO: 667805 - DNA, 20 bp, Homo sapiens
atattcagggtaaataggaa

SEQ ID NO: 667806 - DNA, 11 bp, Homo sapiens
atattcataaa

SEQ ID NO: 667807 - DNA, 21 bp, Homo sapiens
atattccagatctttcagaaa

SEQ ID NO: 667808 - DNA, 11 bp, Homo sapiens
atattcctttt

SEQ ID NO: 667809 - DNA, 12 bp, Homo sapiens
atattcctttta

SEQ ID NO: 667810 - DNA, 16 bp, Homo sapiens
atattccttttaaaga

SEQ ID NO: 667811 - DNA, 22 bp, Homo sapiens
atattccttttaaagaagcttt

SEQ ID NO: 667812 - DNA, 23 bp, Homo sapiens
atattccttttaaagaagcttta

SEQ ID NO: 667813 - DNA, 13 bp, Homo sapiens
atattgaatgtta

SEQ ID NO: 667814 - DNA, 15 bp, Homo sapiens
atattgattgggaaa

SEQ ID NO: 667815 - DNA, 21 bp, Homo sapiens
atattgattgggaaaacattt

SEQ ID NO: 667816 - DNA, 17 bp, Homo sapiens
atattgccattatgctt

SEQ ID NO: 667817 - DNA, 13 bp, Homo sapiens
atattgtgaagta

SEQ ID NO: 667818 - DNA, 21 bp, Homo sapiens
atattgtttggtaaatgtttc

SEQ ID NO: 667819 - DNA, 9 bp, Homo sapiens
atatttaat

SEQ ID NO: 667820 - DNA, 20 bp, Homo sapiens
atatttagatgtaattttgt

SEQ ID NO: 667821 - DNA, 22 bp, Homo sapiens
atatttagatgtaattttgtgt

SEQ ID NO: 667822 - DNA, 20 bp, Homo sapiens
atatttatgtagatgtgcat

SEQ ID NO: 667823 - DNA, 13 bp, Homo sapiens
atatttctcatct

SEQ ID NO: 667824 - DNA, 22 bp, Homo sapiens
atatttcttcttctaagaagac

SEQ ID NO: 667825 - DNA, 13 bp, Homo sapiens
atatttcttgctt

SEQ ID NO: 667826 - DNA, 14 bp, Homo sapiens
atatttcttgcttt

SEQ ID NO: 667827 - DNA, 20 bp, Homo sapiens
atatttcttgctttcaatta

SEQ ID NO: 667828 - DNA, 15 bp, Homo sapiens
atatttgatttctaa

SEQ ID NO: 667829 - DNA, 18 bp, Homo sapiens
atatttgatttctaattg

SEQ ID NO: 667830 - DNA, 20 bp, Homo sapiens
atatttgttttatgctactg

SEQ ID NO: 667831 - DNA, 12 bp, Homo sapiens
atattttaatgt

SEQ ID NO: 667832 - DNA, 19 bp, Homo sapiens
atatttttatacaagtaat

SEQ ID NO: 667833 - DNA, 18 bp, Homo sapiens
atatttttcataaacaag

SEQ ID NO: 667834 - DNA, 13 bp, Homo sapiens
atattttttgctc

SEQ ID NO: 667835 - DNA, 17 bp, Homo sapiens
atatttttttaatttaa

SEQ ID NO: 667836 - DNA, 13 bp, Homo sapiens
atcaaagccaggg

SEQ ID NO: 667837 - DNA, 20 bp, Homo sapiens
atcaaagggataaagaaaaa

SEQ ID NO: 667838 - DNA, 21 bp, Homo sapiens
atcaaataaaatatcataaag

SEQ ID NO: 667839 - DNA, 20 bp, Homo sapiens
atcaaatctaccactgtatg

SEQ ID NO: 667840 - DNA, 17 bp, Homo sapiens
atcaaatctcctgctga

SEQ ID NO: 667841 - DNA, 18 bp, Homo sapiens
atcaactcccaacttctt

SEQ ID NO: 667842 - DNA, 18 bp, Homo sapiens
atcaagatttttttcctg

SEQ ID NO: 667843 - DNA, 16 bp, Homo sapiens
atcaagtccatctgac

SEQ ID NO: 667844 - DNA, 21 bp, Homo sapiens
atcacacaatatagttttttc

SEQ ID NO: 667845 - DNA, 20 bp, Homo sapiens
atcacagcccaaaatttgat

SEQ ID NO: 667846 - DNA, 14 bp, Homo sapiens
atgtaagaacacat

SEQ ID NO: 667847 - DNA, 21 bp, Homo sapiens
atgtaagggtctttggtgttt

SEQ ID NO: 667848 - DNA, 13 bp, Homo sapiens
atgtaagtgttaa

SEQ ID NO: 667849 - DNA, 12 bp, Homo sapiens
atgtaatttaaa

SEQ ID NO: 667850 - DNA, 15 bp, Homo sapiens
atgtaatttaaatga

SEQ ID NO: 667851 - DNA, 21 bp, Homo sapiens
atgtaatttcaaaatacattt

SEQ ID NO: 667852 - DNA, 12 bp, Homo sapiens
atgtaattttgt

SEQ ID NO: 667853 - DNA, 22 bp, Homo sapiens
atgtaattttgtgtaagaaata

SEQ ID NO: 667854 - DNA, 23 bp, Homo sapiens
atgtaattttgtgtaagaaatac

SEQ ID NO: 667855 - DNA, 14 bp, Homo sapiens
atgtacataactcc

SEQ ID NO: 667856 - DNA, 15 bp, Homo sapiens
atgtacatgaagcaa

SEQ ID NO: 667857 - DNA, 18 bp, Homo sapiens
atgtacgtccagcctgcc

SEQ ID NO: 667858 - DNA, 17 bp, Homo sapiens
atgtagactgtgccaga

SEQ ID NO: 667859 - DNA, 23 bp, Homo sapiens
atgtagatattgtgaagtacata

SEQ ID NO: 667860 - DNA, 17 bp, Homo sapiens
atgtagatgtgcatttt

SEQ ID NO: 667861 - DNA, 17 bp, Homo sapiens
atgtagcgtgtaagctt

SEQ ID NO: 667862 - DNA, 19 bp, Homo sapiens
atgtaggtaagactgtaga

SEQ ID NO: 667863 - DNA, 20 bp, Homo sapiens
atgtataaaatacatagtga

SEQ ID NO: 667864 - DNA, 22 bp, Homo sapiens
atgtataaaatacatagtgaaa

SEQ ID NO: 667865 - DNA, 12 bp, Homo sapiens
atgtataaatat

SEQ ID NO: 667866 - DNA, 16 bp, Homo sapiens
atgtataaatatacag

SEQ ID NO: 667867 - DNA, 19 bp, Homo sapiens
atgtataaccaagtgtgct

SEQ ID NO: 667868 - DNA, 22 bp, Homo sapiens
atgtataaccaagtgtgctctt

SEQ ID NO: 667869 - DNA, 20 bp, Homo sapiens
atgtataatgtgcagaaaat

SEQ ID NO: 667870 - DNA, 15 bp, Homo sapiens
atgtatataagtact

SEQ ID NO: 667871 - DNA, 17 bp, Homo sapiens
atgtatcaaatacattt

SEQ ID NO: 667872 - DNA, 18 bp, Homo sapiens
atgtatcagtgtcctttc

SEQ ID NO: 667873 - DNA, 16 bp, Homo sapiens
atgtatggatatattt

SEQ ID NO: 667874 - DNA, 18 bp, Homo sapiens
atgtatggatatatttga

SEQ ID NO: 667875 - DNA, 17 bp, Homo sapiens
atgtattcttttctcag

SEQ ID NO: 667876 - DNA, 17 bp, Homo sapiens
atgtattgttttactcc

SEQ ID NO: 667877 - DNA, 19 bp, Homo sapiens
atgtatttaaagttgtatc

SEQ ID NO: 667878 - DNA, 10 bp, Homo sapiens
atgtatttgt

SEQ ID NO: 667879 - DNA, 14 bp, Homo sapiens
atgtatttgttata

SEQ ID NO: 667880 - DNA, 17 bp, Homo sapiens
atgtatttgttatatat

SEQ ID NO: 667881 - DNA, 18 bp, Homo sapiens
atgtatttgttatatata

SEQ ID NO: 667882 - DNA, 21 bp, Homo sapiens
atgtcaccggtcagtgccttt

SEQ ID NO: 667883 - DNA, 22 bp, Homo sapiens
atgtcaccggtcagtgcctttt

SEQ ID NO: 667884 - DNA, 17 bp, Homo sapiens
atgtcagtgtttgggaa

SEQ ID NO: 667885 - DNA, 14 bp, Homo sapiens
atgtcattgtctac

SEQ ID NO: 667886 - DNA, 18 bp, Homo sapiens
atgtccaaagaggctgcc

SEQ ID NO: 667887 - DNA, 20 bp, Homo sapiens
atgtccaaagaggctgcccc

SEQ ID NO: 667888 - DNA, 21 bp, Homo sapiens
atgtccagcaccttgtgcctg

SEQ ID NO: 667889 - DNA, 22 bp, Homo sapiens
atgtccagcaccttgtgcctgg

SEQ ID NO: 667890 - DNA, 15 bp, Homo sapiens
atgtccctgggccag

SEQ ID NO: 667891 - DNA, 18 bp, Homo sapiens
atgtcttccatgtatctt

SEQ ID NO: 667892 - DNA, 19 bp, Homo sapiens
atgtcttggtcttctactg

SEQ ID NO: 667893 - DNA, 13 bp, Homo sapiens
atgtgaaaaatta

SEQ ID NO: 667894 - DNA, 15 bp, Homo sapiens
atgtgaaaaattaac

SEQ ID NO: 667895 - DNA, 20 bp, Homo sapiens
atgtgaaaaattaacttttt

SEQ ID NO: 667896 - DNA, 17 bp, Homo sapiens
atgtgaaatgctttctg

SEQ ID NO: 667897 - DNA, 19 bp, Homo sapiens
atgtgaataatggcactga

SEQ ID NO: 667898 - DNA, 17 bp, Homo sapiens
atgtgaatttttattgt

SEQ ID NO: 667899 - DNA, 14 bp, Homo sapiens
atgtgacatttctc

SEQ ID NO: 667900 - DNA, 19 bp, Homo sapiens
atgtgaggtaattattgct

SEQ ID NO: 667901 - DNA, 22 bp, Homo sapiens
atgtgagtgccttttgcagaag

SEQ ID NO: 667902 - DNA, 15 bp, Homo sapiens
atgtgatacattttt

SEQ ID NO: 667903 - DNA, 11 bp, Homo sapiens
atgtgcctttc

SEQ ID NO: 667904 - DNA, 17 bp, Homo sapiens
atgtgggatattgaatg

SEQ ID NO: 667905 - DNA, 18 bp, Homo sapiens
atgtgggcactggcccag

SEQ ID NO: 667906 - DNA, 13 bp, Homo sapiens
atgtggtctcagg

SEQ ID NO: 667907 - DNA, 15 bp, Homo sapiens
atgtggtctcaggat

SEQ ID NO: 667908 - DNA, 16 bp, Homo sapiens
atgtgtatattccttt

SEQ ID NO: 667909 - DNA, 17 bp, Homo sapiens
atgtgtatattcctttt

SEQ ID NO: 667910 - DNA, 20 bp, Homo sapiens
atgtgtatttccagtgcaat

SEQ ID NO: 667911 - DNA, 16 bp, Homo sapiens
atgtgtatttcttata

SEQ ID NO: 667912 - DNA, 18 bp, Homo sapiens
atgtgtcctcagggagca

SEQ ID NO: 667913 - DNA, 19 bp, Homo sapiens
atgtgtgtaggttatcttt

SEQ ID NO: 667914 - DNA, 23 bp, Homo sapiens
atgtgtgtaggttatctttttaa

SEQ ID NO: 667915 - DNA, 17 bp, Homo sapiens
atgttaaagagaatgag

SEQ ID NO: 667916 - DNA, 18 bp, Homo sapiens
atgttaaagagaatgagt

SEQ ID NO: 667917 - DNA, 23 bp, Homo sapiens
atgttactattttctacaattaa

SEQ ID NO: 667918 - DNA, 17 bp, Homo sapiens
atgttactgactcctca

SEQ ID NO: 667919 - DNA, 15 bp, Homo sapiens
atgttagtcattgtt

SEQ ID NO: 667920 - DNA, 22 bp, Homo sapiens
atgttagtcattgttatttata

SEQ ID NO: 667921 - DNA, 18 bp, Homo sapiens
atgttatatcatatgtat

SEQ ID NO: 667922 - DNA, 19 bp, Homo sapiens
atgttatatcatatgtata

SEQ ID NO: 667923 - DNA, 20 bp, Homo sapiens
atgttatcggattactgaat

SEQ ID NO: 667924 - DNA, 16 bp, Homo sapiens
atgttcctaacaaaat

SEQ ID NO: 667925 - DNA, 17 bp, Homo sapiens
atgttcctaacaaaatg

SEQ ID NO: 667926 - DNA, 18 bp, Homo sapiens
atgttcctaacaaaatga

SEQ ID NO: 667927 - DNA, 12 bp, Homo sapiens
atgttgctcttt

SEQ ID NO: 667928 - DNA, 16 bp, Homo sapiens
atgttgctctttcacc

SEQ ID NO: 667929 - DNA, 14 bp, Homo sapiens
atgttgcttctcag

SEQ ID NO: 667930 - DNA, 17 bp, Homo sapiens
atgttggccaggctggt

SEQ ID NO: 667931 - DNA, 22 bp, Homo sapiens
atgttgtattgatttttaagaa

SEQ ID NO: 667932 - DNA, 23 bp, Homo sapiens
atgttgtattgatttttaagaaa

SEQ ID NO: 667933 - DNA, 15 bp, Homo sapiens
atgtttaaaagaaat

SEQ ID NO: 667934 - DNA, 19 bp, Homo sapiens
atgtttaaaagaaatatat

SEQ ID NO: 667935 - DNA, 16 bp, Homo sapiens
atgtttaataaagctt

SEQ ID NO: 667936 - DNA, 19 bp, Homo sapiens
atgtttaataaagctttat

SEQ ID NO: 667937 - DNA, 22 bp, Homo sapiens
atgtttatactgtatttctaag

SEQ ID NO: 667938 - DNA, 20 bp, Homo sapiens
atgtttctgggtcctgaaga

SEQ ID NO: 667939 - DNA, 21 bp, Homo sapiens
atgtttctgggtcctgaagaa

SEQ ID NO: 667940 - DNA, 16 bp, Homo sapiens
atgtttcttttaaaga

SEQ ID NO: 667941 - DNA, 12 bp, Homo sapiens
atgtttggggtc

SEQ ID NO: 667942 - DNA, 23 bp, Homo sapiens
atgttttgggaaacactgaaatg

SEQ ID NO: 667943 - DNA, 15 bp, Homo sapiens
atgttttttctgtaa

SEQ ID NO: 667944 - DNA, 20 bp, Homo sapiens
atgttttttctgtaatgtaa

SEQ ID NO: 667945 - DNA, 13 bp, Homo sapiens
attaaaaattacc

SEQ ID NO: 667946 - DNA, 19 bp, Homo sapiens
attaaaacaaatatacatt

SEQ ID NO: 667947 - DNA, 16 bp, Homo sapiens
attaaaactaaatttc

SEQ ID NO: 667948 - DNA, 16 bp, Homo sapiens
attaaataataaagta

SEQ ID NO: 667949 - DNA, 14 bp, Homo sapiens
attaaattctgagc

SEQ ID NO: 667950 - DNA, 14 bp, Homo sapiens
attaacttatttag

SEQ ID NO: 667951 - DNA, 11 bp, Homo sapiens
attaagaaacc

SEQ ID NO: 667952 - DNA, 21 bp, Homo sapiens
attaagaaaccttgctctcct

SEQ ID NO: 667953 - DNA, 15 bp, Homo sapiens
attaagaaaggaagt

SEQ ID NO: 667954 - DNA, 14 bp, Homo sapiens
attaagcaaatgtt

SEQ ID NO: 667955 - DNA, 18 bp, Homo sapiens
attaaggggaagaatgaa

SEQ ID NO: 667956 - DNA, 13 bp, Homo sapiens
attaataatattt

SEQ ID NO: 667957 - DNA, 15 bp, Homo sapiens
attaataatatttat

SEQ ID NO: 667958 - DNA, 18 bp, Homo sapiens
attaatcacctctctgta

SEQ ID NO: 667959 - DNA, 15 bp, Homo sapiens
attaatgacttactt

SEQ ID NO: 667960 - DNA, 20 bp, Homo sapiens
attaatgtttctatctgatt

SEQ ID NO: 667961 - DNA, 22 bp, Homo sapiens
attaatgtttctatctgatttt

SEQ ID NO: 667962 - DNA, 15 bp, Homo sapiens
attaatgttttcaaa

SEQ ID NO: 667963 - DNA, 13 bp, Homo sapiens
attaattttactc

SEQ ID NO: 667964 - DNA, 17 bp, Homo sapiens
attaatttttatttatt

SEQ ID NO: 667965 - DNA, 22 bp, Homo sapiens
attaatttttatttatttttct

SEQ ID NO: 667966 - DNA, 14 bp, Homo sapiens
atttgttttatgct

SEQ ID NO: 667967 - DNA, 14 bp, Homo sapiens
attttaaaatatat

SEQ ID NO: 667968 - DNA, 17 bp, Homo sapiens
attttaaaatatatgaa

SEQ ID NO: 667969 - DNA, 14 bp, Homo sapiens
attttaaaatgtct

SEQ ID NO: 667970 - DNA, 15 bp, Homo sapiens
attttaagaagacat

SEQ ID NO: 667971 - DNA, 18 bp, Homo sapiens
attttaagaagacatact

SEQ ID NO: 667972 - DNA, 18 bp, Homo sapiens
attttaatgctgtttcta

SEQ ID NO: 667973 - DNA, 21 bp, Homo sapiens
attttaatgctgtttctaaga

SEQ ID NO: 667974 - DNA, 23 bp, Homo sapiens
attttaatgctgtttctaagaaa

SEQ ID NO: 667975 - DNA, 19 bp, Homo sapiens
attttacacattagatttt

SEQ ID NO: 667976 - DNA, 18 bp, Homo sapiens
attttacagctcattaaa

SEQ ID NO: 667977 - DNA, 23 bp, Homo sapiens
attttacagctcattaaactttt

SEQ ID NO: 667978 - DNA, 15 bp, Homo sapiens
attttacataacgga

SEQ ID NO: 667979 - DNA, 19 bp, Homo sapiens
attttaggaacttcagaga

SEQ ID NO: 667980 - DNA, 13 bp, Homo sapiens
attttatcattaa

SEQ ID NO: 667981 - DNA, 17 bp, Homo sapiens
attttatgatcagtgtt

SEQ ID NO: 667982 - DNA, 15 bp, Homo sapiens
attttattaataata

SEQ ID NO: 667983 - DNA, 13 bp, Homo sapiens
attttcaagttta

SEQ ID NO: 667984 - DNA, 16 bp, Homo sapiens
attttcaagtttacac

SEQ ID NO: 667985 - DNA, 16 bp, Homo sapiens
attttcagaagttaac

SEQ ID NO: 667986 - DNA, 16 bp, Homo sapiens
attttcataatcagta

SEQ ID NO: 667987 - DNA, 14 bp, Homo sapiens
attttcatgaaaat

SEQ ID NO: 667988 - DNA, 20 bp, Homo sapiens
attttcatgaaaataccatt

SEQ ID NO: 667989 - DNA, 21 bp, Homo sapiens
attttcatgaaaataccattt

SEQ ID NO: 667990 - DNA, 17 bp, Homo sapiens
attttcctttttcttcg

SEQ ID NO: 667991 - DNA, 22 bp, Homo sapiens
attttctaaataaaaatatgta

SEQ ID NO: 667992 - DNA, 13 bp, Homo sapiens
attttgagaaact

SEQ ID NO: 667993 - DNA, 13 bp, Homo sapiens
attttgaggttta

SEQ ID NO: 667994 - DNA, 17 bp, Homo sapiens
attttgaggtttagcaa

SEQ ID NO: 667995 - DNA, 18 bp, Homo sapiens
attttggagattataata

SEQ ID NO: 667996 - DNA, 20 bp, Homo sapiens
attttggattaatttgtgaa

SEQ ID NO: 667997 - DNA, 14 bp, Homo sapiens
attttgtaataata

SEQ ID NO: 667998 - DNA, 19 bp, Homo sapiens
attttgtaataataaagaa

SEQ ID NO: 667999 - DNA, 22 bp, Homo sapiens
attttgtaataataaagaatag

SEQ ID NO: 668000 - DNA, 17 bp, Homo sapiens
attttgtcttattctta

SEQ ID NO: 668001 - DNA, 23 bp, Homo sapiens
atttttaaaaagaaatctggtct

SEQ ID NO: 668002 - DNA, 12 bp, Homo sapiens
atttttaagaaa

SEQ ID NO: 668003 - DNA, 20 bp, Homo sapiens
atttttaagaaaggaagcaa

SEQ ID NO: 668004 - DNA, 15 bp, Homo sapiens
atttttaagaaagta

SEQ ID NO: 668005 - DNA, 15 bp, Homo sapiens
atttttagactattt

SEQ ID NO: 668006 - DNA, 17 bp, Homo sapiens
atttttaggcaaagata

SEQ ID NO: 668007 - DNA, 18 bp, Homo sapiens
atttttatacaagtaatt

SEQ ID NO: 668008 - DNA, 18 bp, Homo sapiens
atttttatttttgcacaa

SEQ ID NO: 668009 - DNA, 23 bp, Homo sapiens
atttttccaaatgaaaaatctca

SEQ ID NO: 668010 - DNA, 19 bp, Homo sapiens
atttttctcccaagaaacc

SEQ ID NO: 668011 - DNA, 12 bp, Homo sapiens
atttttgacaga

SEQ ID NO: 668012 - DNA, 21 bp, Homo sapiens
atttttgacagactatttgct

SEQ ID NO: 668013 - DNA, 16 bp, Homo sapiens
atttttgcacaacttt

SEQ ID NO: 668014 - DNA, 12 bp, Homo sapiens
atttttgtattt

SEQ ID NO: 668015 - DNA, 20 bp, Homo sapiens
atttttgtgaaatgaaaaca

SEQ ID NO: 668016 - DNA, 17 bp, Homo sapiens
attttttggtgtgccct

SEQ ID NO: 668017 - DNA, 12 bp, Homo sapiens
atttttttcctg

SEQ ID NO: 668018 - DNA, 13 bp, Homo sapiens
atttttttctatt

SEQ ID NO: 668019 - DNA, 19 bp, Homo sapiens
caaaaacaagtaaatatat

SEQ ID NO: 668020 - DNA, 15 bp, Homo sapiens
caaaaatagccctgc

SEQ ID NO: 668021 - DNA, 16 bp, Homo sapiens
caaaacctgtattact

SEQ ID NO: 668022 - DNA, 17 bp, Homo sapiens
caaaagatttattgtaa

SEQ ID NO: 668023 - DNA, 11 bp, Homo sapiens
caaaaggttta

SEQ ID NO: 668024 - DNA, 15 bp, Homo sapiens
caaaaggtttattcc

SEQ ID NO: 668025 - DNA, 15 bp, Homo sapiens
caaaatacatttgta

SEQ ID NO: 668026 - DNA, 16 bp, Homo sapiens
caaaatacatttgtaa

SEQ ID NO: 668027 - DNA, 18 bp, Homo sapiens
caaaatggggcagaagag

SEQ ID NO: 668028 - DNA, 20 bp, Homo sapiens
caaaatggggcagaagagaa

SEQ ID NO: 668029 - DNA, 22 bp, Homo sapiens
caaaatgtctgtagctcctcaa

SEQ ID NO: 668030 - DNA, 20 bp, Homo sapiens
caaaatgtgtatttcttata

SEQ ID NO: 668031 - DNA, 19 bp, Homo sapiens
caaaattttattttgtgct

SEQ ID NO: 668032 - DNA, 15 bp, Homo sapiens
caaacaaaagttctg

SEQ ID NO: 668033 - DNA, 13 bp, Homo sapiens
caaacagaacagg

SEQ ID NO: 668034 - DNA, 15 bp, Homo sapiens
caaacagaacagggt

SEQ ID NO: 668035 - DNA, 21 bp, Homo sapiens
caaaccgccagcgaacttgac

SEQ ID NO: 668036 - DNA, 17 bp, Homo sapiens
caaacgagactttctcc

SEQ ID NO: 668037 - DNA, 21 bp, Homo sapiens
caaacgagactttctcctggc

SEQ ID NO: 668038 - DNA, 15 bp, Homo sapiens
caaactcctttctta

SEQ ID NO: 668039 - DNA, 12 bp, Homo sapiens
caaactgttctg

SEQ ID NO: 668040 - DNA, 18 bp, Homo sapiens
caaacttactattttgac

SEQ ID NO: 668041 - DNA, 12 bp, Homo sapiens
caaagaggctgc

SEQ ID NO: 668042 - DNA, 13 bp, Homo sapiens
caaagaggctgcc

SEQ ID NO: 668043 - DNA, 18 bp, Homo sapiens
caaagatgtgttcaggca

SEQ ID NO: 668044 - DNA, 16 bp, Homo sapiens
caaagccttctcccta

SEQ ID NO: 668045 - DNA, 12 bp, Homo sapiens
caaagctgagcc

SEQ ID NO: 668046 - DNA, 22 bp, Homo sapiens
caaagctgagcctgcagggaag

SEQ ID NO: 668047 - DNA, 21 bp, Homo sapiens
caaaggaaggaccctgaggcc

SEQ ID NO: 668048 - DNA, 20 bp, Homo sapiens
caaagtactctttaacatac

SEQ ID NO: 668049 - DNA, 13 bp, Homo sapiens
caaagttcaactt

SEQ ID NO: 668050 - DNA, 12 bp, Homo sapiens
caaataaaatat

SEQ ID NO: 668051 - DNA, 15 bp, Homo sapiens
caaataaaatatcat

SEQ ID NO: 668052 - DNA, 13 bp, Homo sapiens
caaatacacattt

SEQ ID NO: 668053 - DNA, 13 bp, Homo sapiens
caaatacatgtgt

SEQ ID NO: 668054 - DNA, 14 bp, Homo sapiens
caaatacatgtgta

SEQ ID NO: 668055 - DNA, 13 bp, Homo sapiens
caaatacatttta

SEQ ID NO: 668056 - DNA, 19 bp, Homo sapiens
caaatatacattttctaaa

SEQ ID NO: 668057 - DNA, 21 bp, Homo sapiens
caaatatacattttctaaata

SEQ ID NO: 668058 - DNA, 18 bp, Homo sapiens
caaatattcactggcccc

SEQ ID NO: 668059 - DNA, 20 bp, Homo sapiens
caaatcttcagtattttctc

SEQ ID NO: 668060 - DNA, 20 bp, Homo sapiens
caaatgagctctgaaatctt

SEQ ID NO: 668061 - DNA, 17 bp, Homo sapiens
caaatgcataaatgcat

SEQ ID NO: 668062 - DNA, 15 bp, Homo sapiens
caaatgtcattgtct

SEQ ID NO: 668063 - DNA, 17 bp, Homo sapiens
caaatgtcattgtctac

SEQ ID NO: 668064 - DNA, 14 bp, Homo sapiens
caaattaaaacaaa

SEQ ID NO: 668065 - DNA, 22 bp, Homo sapiens
caaattaaaacaaatatacatt

SEQ ID NO: 668066 - DNA, 23 bp, Homo sapiens
caaattaaaacaaatatacattt

SEQ ID NO: 668067 - DNA, 13 bp, Homo sapiens
caaattaactgta

SEQ ID NO: 668068 - DNA, 21 bp, Homo sapiens
caaattcaagagctagaaaaa

SEQ ID NO: 668069 - DNA, 22 bp, Homo sapiens
caaattcaagagctagaaaaat

SEQ ID NO: 668070 - DNA, 20 bp, Homo sapiens
caaattgccctatgctgtgc

SEQ ID NO: 668071 - DNA, 15 bp, Homo sapiens
caaatttactttaaa

SEQ ID NO: 668072 - DNA, 20 bp, Homo sapiens
caaatttactttaaaaagaa

SEQ ID NO: 668073 - DNA, 13 bp, Homo sapiens
caacacaaagatt

SEQ ID NO: 668074 - DNA, 12 bp, Homo sapiens
caacagccctgc

SEQ ID NO: 668075 - DNA, 20 bp, Homo sapiens
caacaggtcacttgatcatg

SEQ ID NO: 668076 - DNA, 20 bp, Homo sapiens
caacatagtgagacactgtc

SEQ ID NO: 668077 - DNA, 13 bp, Homo sapiens
caacatccactgt

SEQ ID NO: 668078 - DNA, 20 bp, Homo sapiens
caacattaaggaatttgatg

SEQ ID NO: 668079 - DNA, 16 bp, Homo sapiens
caacattgtagcctca

SEQ ID NO: 668080 - DNA, 12 bp, Homo sapiens
caacatttatat

SEQ ID NO: 668081 - DNA, 12 bp, Homo sapiens
caacatttatgt

SEQ ID NO: 668082 - DNA, 14 bp, Homo sapiens
caaccatttgaaac

SEQ ID NO: 668083 - DNA, 17 bp, Homo sapiens
caacccaataggagtct

SEQ ID NO: 668084 - DNA, 15 bp, Homo sapiens
caacccttctctgtt

SEQ ID NO: 668085 - DNA, 18 bp, Homo sapiens
caacctcacctcccgggt

SEQ ID NO: 668086 - DNA, 14 bp, Homo sapiens
caacctcagggctc

SEQ ID NO: 668087 - DNA, 23 bp, Homo sapiens
cagaagagggtgtgtttgaaatc

SEQ ID NO: 668088 - DNA, 17 bp, Homo sapiens
cagaagggaattgctca

SEQ ID NO: 668089 - DNA, 15 bp, Homo sapiens
cagaagtcaataggc

SEQ ID NO: 668090 - DNA, 15 bp, Homo sapiens
cagaagtctcctcaa

SEQ ID NO: 668091 - DNA, 13 bp, Homo sapiens
cagaagtgaaaat

SEQ ID NO: 668092 - DNA, 14 bp, Homo sapiens
cagaagttaacatc

SEQ ID NO: 668093 - DNA, 13 bp, Homo sapiens
cagaatgtaagtg

SEQ ID NO: 668094 - DNA, 18 bp, Homo sapiens
cagaatgtaagtgggccc

SEQ ID NO: 668095 - DNA, 22 bp, Homo sapiens
cagaatgtaagtgggcccaccc

SEQ ID NO: 668096 - DNA, 23 bp, Homo sapiens
cagaatgtaagtgggcccacccg

SEQ ID NO: 668097 - DNA, 15 bp, Homo sapiens
cagaattttaggaac

SEQ ID NO: 668098 - DNA, 17 bp, Homo sapiens
cagacagaagtctcctc

SEQ ID NO: 668099 - DNA, 18 bp, Homo sapiens
cagacagaagtctcctca

SEQ ID NO: 668100 - DNA, 17 bp, Homo sapiens
cagacagcaggcagcgc

SEQ ID NO: 668101 - DNA, 12 bp, Homo sapiens
cagaccaggcct

SEQ ID NO: 668102 - DNA, 14 bp, Homo sapiens
cagaccaggccttt

SEQ ID NO: 668103 - DNA, 13 bp, Homo sapiens
cagacccagtccc

SEQ ID NO: 668104 - DNA, 15 bp, Homo sapiens
cagactccatctctt

SEQ ID NO: 668105 - DNA, 22 bp, Homo sapiens
cagactccatctcttctgcaag

SEQ ID NO: 668106 - DNA, 18 bp, Homo sapiens
cagactggggcatcctgt

SEQ ID NO: 668107 - DNA, 18 bp, Homo sapiens
cagagaaaaatgctcccc

SEQ ID NO: 668108 - DNA, 20 bp, Homo sapiens
cagagaaaaatgctccccac

SEQ ID NO: 668109 - DNA, 17 bp, Homo sapiens
cagagaacagaactgga

SEQ ID NO: 668110 - DNA, 23 bp, Homo sapiens
cagagaacagaactggaggcagt

SEQ ID NO: 668111 - DNA, 23 bp, Homo sapiens
cagagataaagcttaggtcaaag

SEQ ID NO: 668112 - DNA, 16 bp, Homo sapiens
cagagatttctcattg

SEQ ID NO: 668113 - DNA, 19 bp, Homo sapiens
cagagatttctcattgact

SEQ ID NO: 668114 - DNA, 13 bp, Homo sapiens
cagagcctcctgg

SEQ ID NO: 668115 - DNA, 22 bp, Homo sapiens
cagagctaagggtgggtgctca

SEQ ID NO: 668116 - DNA, 14 bp, Homo sapiens
cagagctctttgat

SEQ ID NO: 668117 - DNA, 18 bp, Homo sapiens
cagagcttgttgtctcca

SEQ ID NO: 668118 - DNA, 17 bp, Homo sapiens
cagaggacacagagaag

SEQ ID NO: 668119 - DNA, 17 bp, Homo sapiens
cagaggagcgcaggcag

SEQ ID NO: 668120 - DNA, 13 bp, Homo sapiens
cagaggggagcag

SEQ ID NO: 668121 - DNA, 15 bp, Homo sapiens
cagaggtaccctggg

SEQ ID NO: 668122 - DNA, 16 bp, Homo sapiens
cagaggtaccctgggt

SEQ ID NO: 668123 - DNA, 17 bp, Homo sapiens
cagaggtaccctgggtg

SEQ ID NO: 668124 - DNA, 22 bp, Homo sapiens
cagaggtattaaaactaaattt

SEQ ID NO: 668125 - DNA, 17 bp, Homo sapiens
cagagtggcgtggcctc

SEQ ID NO: 668126 - DNA, 22 bp, Homo sapiens
cagagttgactttcctcccatt

SEQ ID NO: 668127 - DNA, 23 bp, Homo sapiens
cagagttttcattaaatcctttt

SEQ ID NO: 668128 - DNA, 20 bp, Homo sapiens
cagataagcaagagagatgt

SEQ ID NO: 668129 - DNA, 18 bp, Homo sapiens
cagataccttatcttaca

SEQ ID NO: 668130 - DNA, 17 bp, Homo sapiens
cagataccttgaaagga

SEQ ID NO: 668131 - DNA, 19 bp, Homo sapiens
cagataccttgaaaggaag

SEQ ID NO: 668132 - DNA, 18 bp, Homo sapiens
cagatcactgaatttata

SEQ ID NO: 668133 - DNA, 17 bp, Homo sapiens
cagatgaccataatttt

SEQ ID NO: 668134 - DNA, 21 bp, Homo sapiens
cagatgatgctttgagaacat

SEQ ID NO: 668135 - DNA, 13 bp, Homo sapiens
cagattgtttcct

SEQ ID NO: 668136 - DNA, 13 bp, Homo sapiens
cagatttggaaag

SEQ ID NO: 668137 - DNA, 11 bp, Homo sapiens
cagatttttat

SEQ ID NO: 668138 - DNA, 17 bp, Homo sapiens
cagatttttatttatga

SEQ ID NO: 668139 - DNA, 19 bp, Homo sapiens
cagcaatctccatgtgtac

SEQ ID NO: 668140 - DNA, 20 bp, Homo sapiens
cagcacattcgggaccaata

SEQ ID NO: 668141 - DNA, 13 bp, Homo sapiens
cagcaccacagcc

SEQ ID NO: 668142 - DNA, 15 bp, Homo sapiens
cagcaccttgtgcct

SEQ ID NO: 668143 - DNA, 15 bp, Homo sapiens
cagcactttgggagg

SEQ ID NO: 668144 - DNA, 18 bp, Homo sapiens
cagcagaaaacctgttca

SEQ ID NO: 668145 - DNA, 19 bp, Homo sapiens
cagcagaaaacctgttcag

SEQ ID NO: 668146 - DNA, 22 bp, Homo sapiens
cagcagaggcccagatattaga

SEQ ID NO: 668147 - DNA, 16 bp, Homo sapiens
cagcagcttctccagg

SEQ ID NO: 668148 - DNA, 13 bp, Homo sapiens
cagcaggcagcgc

SEQ ID NO: 668149 - DNA, 15 bp, Homo sapiens
cagcaggcagcgcca

SEQ ID NO: 668150 - DNA, 16 bp, Homo sapiens
cagcaggcagcgccaa

SEQ ID NO: 668151 - DNA, 15 bp, Homo sapiens
cagcagggaacaaaa

SEQ ID NO: 668152 - DNA, 21 bp, Homo sapiens
cagcagggcatcttggaaaag

SEQ ID NO: 668153 - DNA, 14 bp, Homo sapiens
cagcatggagagag

SEQ ID NO: 668154 - DNA, 14 bp, Homo sapiens
cagcattgaagtat

SEQ ID NO: 668155 - DNA, 21 bp, Homo sapiens
cagcatttagctggccacatg

SEQ ID NO: 668156 - DNA, 23 bp, Homo sapiens
cagccagcccatggcccccaata

SEQ ID NO: 668157 - DNA, 17 bp, Homo sapiens
cagccagggcaagagag

SEQ ID NO: 668158 - DNA, 14 bp, Homo sapiens
cagcccaccctgct

SEQ ID NO: 668159 - DNA, 18 bp, Homo sapiens
cagcccaccctgctgctg

SEQ ID NO: 668160 - DNA, 17 bp, Homo sapiens
cagcccacctgctccca

SEQ ID NO: 668161 - DNA, 19 bp, Homo sapiens
cagcccacctgctcccagg

SEQ ID NO: 668162 - DNA, 22 bp, Homo sapiens
cagcccacctgctcccaggccc

SEQ ID NO: 668163 - DNA, 23 bp, Homo sapiens
cagcccagcttggccctttcctt

SEQ ID NO: 668164 - DNA, 19 bp, Homo sapiens
cagcccatggcccccaata

SEQ ID NO: 668165 - DNA, 20 bp, Homo sapiens
cagcccatggcccccaataa

SEQ ID NO: 668166 - DNA, 23 bp, Homo sapiens
cagcccatggcccccaataaagg

SEQ ID NO: 668167 - DNA, 14 bp, Homo sapiens
cagcctcacttcct

SEQ ID NO: 668168 - DNA, 20 bp, Homo sapiens
cagcctcacttcctttgccc

SEQ ID NO: 668169 - DNA, 16 bp, Homo sapiens
cagcctgtggcagggc

SEQ ID NO: 668170 - DNA, 13 bp, Homo sapiens
cagccttctctca

SEQ ID NO: 668171 - DNA, 19 bp, Homo sapiens
cagcgaagtagcttgctcc

SEQ ID NO: 668172 - DNA, 18 bp, Homo sapiens
cagcgcagggctggcacg

SEQ ID NO: 668173 - DNA, 21 bp, Homo sapiens
cagcgtcagctgctccctggc

SEQ ID NO: 668174 - DNA, 15 bp, Homo sapiens
cagcgtccctggcgc

SEQ ID NO: 668175 - DNA, 19 bp, Homo sapiens
cagctaatttttgtatttt

SEQ ID NO: 668176 - DNA, 18 bp, Homo sapiens
cagctaccaggtgttcta

SEQ ID NO: 668177 - DNA, 19 bp, Homo sapiens
cagctacttgggaggctga

SEQ ID NO: 668178 - DNA, 14 bp, Homo sapiens
cagctatatttgat

SEQ ID NO: 668179 - DNA, 16 bp, Homo sapiens
cagctcagccctggcc

SEQ ID NO: 668180 - DNA, 18 bp, Homo sapiens
cagctcagccctggcctg

SEQ ID NO: 668181 - DNA, 23 bp, Homo sapiens
cagctcagccctggcctggctgg

SEQ ID NO: 668182 - DNA, 16 bp, Homo sapiens
cagctccccagcccac

SEQ ID NO: 668183 - DNA, 18 bp, Homo sapiens
cagctccccagcccacct

SEQ ID NO: 668184 - DNA, 18 bp, Homo sapiens
cagctctgctatgagtgt

SEQ ID NO: 668185 - DNA, 18 bp, Homo sapiens
cagctcttccagggcagc

SEQ ID NO: 668186 - DNA, 23 bp, Homo sapiens
cagctgaagttgcagatgttaga

SEQ ID NO: 668187 - DNA, 17 bp, Homo sapiens
cagctgactgaatgcag

SEQ ID NO: 668188 - DNA, 16 bp, Homo sapiens
cagctgagtgagtggg

SEQ ID NO: 668189 - DNA, 20 bp, Homo sapiens
cagctgccccaatgtgacct

SEQ ID NO: 668190 - DNA, 16 bp, Homo sapiens
cagctgcctctgctcc

SEQ ID NO: 668191 - DNA, 24 bp, Homo sapiens
cagctgtcccttgcttgcctgcag

SEQ ID NO: 668192 - DNA, 14 bp, Homo sapiens
cagctgtttgaaat

SEQ ID NO: 668193 - DNA, 13 bp, Homo sapiens
cagcttattgttt

SEQ ID NO: 668194 - DNA, 22 bp, Homo sapiens
cagcttcactctctccgtctgt

SEQ ID NO: 668195 - DNA, 22 bp, Homo sapiens
cagctttactgccttcctcctt

SEQ ID NO: 668196 - DNA, 12 bp, Homo sapiens
cagctttgcaaa

SEQ ID NO: 668197 - DNA, 11 bp, Homo sapiens
cagctttgtcc

SEQ ID NO: 668198 - DNA, 20 bp, Homo sapiens
caggaatgaagccttagcca

SEQ ID NO: 668199 - DNA, 21 bp, Homo sapiens
caggacaccacgattctccca

SEQ ID NO: 668200 - DNA, 19 bp, Homo sapiens
caggacatgcaataaaatt

SEQ ID NO: 668201 - DNA, 13 bp, Homo sapiens
caggactcctggc

SEQ ID NO: 668202 - DNA, 19 bp, Homo sapiens
caggactcctggcagggcc

SEQ ID NO: 668203 - DNA, 13 bp, Homo sapiens
caggagagcctgg

SEQ ID NO: 668204 - DNA, 16 bp, Homo sapiens
caggagagcctggggg

SEQ ID NO: 668205 - DNA, 19 bp, Homo sapiens
caggagctgtcaccaagga

SEQ ID NO: 668206 - DNA, 19 bp, Homo sapiens
caggagcttcttcgttcct

SEQ ID NO: 668207 - DNA, 18 bp, Homo sapiens
ccacccctctcgcctcat

SEQ ID NO: 668208 - DNA, 19 bp, Homo sapiens
ccacccctctcgcctcatt

SEQ ID NO: 668209 - DNA, 16 bp, Homo sapiens
ccaccctgctgctggt

SEQ ID NO: 668210 - DNA, 21 bp, Homo sapiens
ccacctccaggctttcccact

SEQ ID NO: 668211 - DNA, 15 bp, Homo sapiens
ccacctcggcacaca

SEQ ID NO: 668212 - DNA, 11 bp, Homo sapiens
ccacctgctcc

SEQ ID NO: 668213 - DNA, 15 bp, Homo sapiens
ccacctgctcccagg

SEQ ID NO: 668214 - DNA, 15 bp, Homo sapiens
ccacctgggaacaca

SEQ ID NO: 668215 - DNA, 17 bp, Homo sapiens
ccacctgggaacacagt

SEQ ID NO: 668216 - DNA, 12 bp, Homo sapiens
ccacctgtgggt

SEQ ID NO: 668217 - DNA, 23 bp, Homo sapiens
ccacgagggtctcccctcctgca

SEQ ID NO: 668218 - DNA, 20 bp, Homo sapiens
ccacgggacatcacagggtg

SEQ ID NO: 668219 - DNA, 16 bp, Homo sapiens
ccactcaggccacagt

SEQ ID NO: 668220 - DNA, 22 bp, Homo sapiens
ccactcccccgtttctcctttt

SEQ ID NO: 668221 - DNA, 15 bp, Homo sapiens
ccactccccggcatg

SEQ ID NO: 668222 - DNA, 13 bp, Homo sapiens
ccactctgcaaga

SEQ ID NO: 668223 - DNA, 17 bp, Homo sapiens
ccactcttttgctgtgc

SEQ ID NO: 668224 - DNA, 16 bp, Homo sapiens
ccactgcaaataaagc

SEQ ID NO: 668225 - DNA, 19 bp, Homo sapiens
ccactgcaaataaagcctt

SEQ ID NO: 668226 - DNA, 20 bp, Homo sapiens
ccactggtccccaacaatgt

SEQ ID NO: 668227 - DNA, 13 bp, Homo sapiens
ccacttcactgcg

SEQ ID NO: 668228 - DNA, 19 bp, Homo sapiens
ccacttccaggggaacctg

SEQ ID NO: 668229 - DNA, 14 bp, Homo sapiens
ccacttgaaatgtt

SEQ ID NO: 668230 - DNA, 13 bp, Homo sapiens
ccactttgtccat

SEQ ID NO: 668231 - DNA, 21 bp, Homo sapiens
ccagaatttaccatcatctct

SEQ ID NO: 668232 - DNA, 13 bp, Homo sapiens
ccagacctggctc

SEQ ID NO: 668233 - DNA, 19 bp, Homo sapiens
ccagagcaaccagaaggag

SEQ ID NO: 668234 - DNA, 12 bp, Homo sapiens
ccagaggtgctt

SEQ ID NO: 668235 - DNA, 12 bp, Homo sapiens
ccagatcctggg

SEQ ID NO: 668236 - DNA, 15 bp, Homo sapiens
ccagcacactattta

SEQ ID NO: 668237 - DNA, 14 bp, Homo sapiens
ccagcaccttgtgc

SEQ ID NO: 668238 - DNA, 16 bp, Homo sapiens
ccagcaccttgtgcct

SEQ ID NO: 668239 - DNA, 19 bp, Homo sapiens
ccagcaccttgtgcctggg

SEQ ID NO: 668240 - DNA, 17 bp, Homo sapiens
ccagcactttgggaggc

SEQ ID NO: 668241 - DNA, 20 bp, Homo sapiens
ccagcagggcatcttggaaa

SEQ ID NO: 668242 - DNA, 16 bp, Homo sapiens
ccagcatttagctggc

SEQ ID NO: 668243 - DNA, 17 bp, Homo sapiens
ccagcatttagctggcc

SEQ ID NO: 668244 - DNA, 19 bp, Homo sapiens
ccagcatttagctggccac

SEQ ID NO: 668245 - DNA, 18 bp, Homo sapiens
ccagcccacctgctccca

SEQ ID NO: 668246 - DNA, 17 bp, Homo sapiens
ccagcccatggccccca

SEQ ID NO: 668247 - DNA, 22 bp, Homo sapiens
ccagcccatggcccccaataaa

SEQ ID NO: 668248 - DNA, 17 bp, Homo sapiens
ccagcctcacttccttt

SEQ ID NO: 668249 - DNA, 22 bp, Homo sapiens
ccagcctcacttcctttgccct

SEQ ID NO: 668250 - DNA, 18 bp, Homo sapiens
ccagccttgagccctggc

SEQ ID NO: 668251 - DNA, 23 bp, Homo sapiens
ccagcgtcagctgctccctggca

SEQ ID NO: 668252 - DNA, 15 bp, Homo sapiens
ccagctacttgggag

SEQ ID NO: 668253 - DNA, 21 bp, Homo sapiens
ccagctcagccctggcctggc

SEQ ID NO: 668254 - DNA, 15 bp, Homo sapiens
ccagctgagtgagtg

SEQ ID NO: 668255 - DNA, 12 bp, Homo sapiens
ccagcttcactc

SEQ ID NO: 668256 - DNA, 23 bp, Homo sapiens
ccaggacatgcaataaaatttaa

SEQ ID NO: 668257 - DNA, 15 bp, Homo sapiens
ccaggagagcctggg

SEQ ID NO: 668258 - DNA, 23 bp, Homo sapiens
ccaggagctgtcaccaaggaaac

SEQ ID NO: 668259 - DNA, 14 bp, Homo sapiens
ccaggagttctgaa

SEQ ID NO: 668260 - DNA, 15 bp, Homo sapiens
ccaggagttctgaag

SEQ ID NO: 668261 - DNA, 12 bp, Homo sapiens
ccaggcagggag

SEQ ID NO: 668262 - DNA, 14 bp, Homo sapiens
ccaggccccaggcc

SEQ ID NO: 668263 - DNA, 19 bp, Homo sapiens
ccaggccctcctctcccat

SEQ ID NO: 668264 - DNA, 19 bp, Homo sapiens
ccaggctatgtataaaata

SEQ ID NO: 668265 - DNA, 20 bp, Homo sapiens
ccaggctatgtataaaatac

SEQ ID NO: 668266 - DNA, 22 bp, Homo sapiens
ccaggctatgtataaaatacat

SEQ ID NO: 668267 - DNA, 14 bp, Homo sapiens
ccaggctgcctcct

SEQ ID NO: 668268 - DNA, 21 bp, Homo sapiens
ccaggctgcctcctgccctta

SEQ ID NO: 668269 - DNA, 17 bp, Homo sapiens
ccagggactatctttgc

SEQ ID NO: 668270 - DNA, 23 bp, Homo sapiens
ccagggaggggccggccctgtgt

SEQ ID NO: 668271 - DNA, 18 bp, Homo sapiens
ccagggcagcggctccac

SEQ ID NO: 668272 - DNA, 12 bp, Homo sapiens
ccagggcctttt

SEQ ID NO: 668273 - DNA, 15 bp, Homo sapiens
ccagggctgccctga

SEQ ID NO: 668274 - DNA, 16 bp, Homo sapiens
ccagggctgccctgag

SEQ ID NO: 668275 - DNA, 17 bp, Homo sapiens
ccaggggaacctgccat

SEQ ID NO: 668276 - DNA, 17 bp, Homo sapiens
ccaggggtctccctggc

SEQ ID NO: 668277 - DNA, 15 bp, Homo sapiens
ccaggtatggctctg

SEQ ID NO: 668278 - DNA, 17 bp, Homo sapiens
ccaggtatggctctgca

SEQ ID NO: 668279 - DNA, 14 bp, Homo sapiens
ccaggtgcagaggt

SEQ ID NO: 668280 - DNA, 22 bp, Homo sapiens
ccaggtgcagaggtaccctggg

SEQ ID NO: 668281 - DNA, 23 bp, Homo sapiens
ccaggtgcagaggtaccctgggt

SEQ ID NO: 668282 - DNA, 15 bp, Homo sapiens
ccaggtggaaggcag

SEQ ID NO: 668283 - DNA, 18 bp, Homo sapiens
ccaggttccacagaggac

SEQ ID NO: 668284 - DNA, 20 bp, Homo sapiens
ccagtaggagaaatctcagc

SEQ ID NO: 668285 - DNA, 14 bp, Homo sapiens
ccagtattgccccc

SEQ ID NO: 668286 - DNA, 16 bp, Homo sapiens
ccagtattgccccctc

SEQ ID NO: 668287 - DNA, 13 bp, Homo sapiens
ccagtcccacact

SEQ ID NO: 668288 - DNA, 19 bp, Homo sapiens
ccagtcccacactgtggcc

SEQ ID NO: 668289 - DNA, 15 bp, Homo sapiens
ccagtgcgattctgg

SEQ ID NO: 668290 - DNA, 15 bp, Homo sapiens
ccagtggggcctgtg

SEQ ID NO: 668291 - DNA, 12 bp, Homo sapiens
ccagttcaaaaa

SEQ ID NO: 668292 - DNA, 16 bp, Homo sapiens
ccagttttccctggaa

SEQ ID NO: 668293 - DNA, 20 bp, Homo sapiens
ccagttttccctggaactcc

SEQ ID NO: 668294 - DNA, 16 bp, Homo sapiens
ccataattttttttaa

SEQ ID NO: 668295 - DNA, 13 bp, Homo sapiens
ccataccttttct

SEQ ID NO: 668296 - DNA, 17 bp, Homo sapiens
ccatactaataaatata

SEQ ID NO: 668297 - DNA, 18 bp, Homo sapiens
ccataggtttctctccct

SEQ ID NO: 668298 - DNA, 22 bp, Homo sapiens
ccatcaagaacctacagactcc

SEQ ID NO: 668299 - DNA, 19 bp, Homo sapiens
ccatcagggttctcttagc

SEQ ID NO: 668300 - DNA, 20 bp, Homo sapiens
ccatcagggttctcttagca

SEQ ID NO: 668301 - DNA, 13 bp, Homo sapiens
ccatccagctccc

SEQ ID NO: 668302 - DNA, 21 bp, Homo sapiens
ccatcctgcagatactttgaa

SEQ ID NO: 668303 - DNA, 12 bp, Homo sapiens
ccatcctggcta

SEQ ID NO: 668304 - DNA, 15 bp, Homo sapiens
ccatccttccctttg

SEQ ID NO: 668305 - DNA, 16 bp, Homo sapiens
ccatctccctgcctgg

SEQ ID NO: 668306 - DNA, 17 bp, Homo sapiens
ccatctccctgcctggc

SEQ ID NO: 668307 - DNA, 18 bp, Homo sapiens
ccatctctcatcctccag

SEQ ID NO: 668308 - DNA, 17 bp, Homo sapiens
ccatctgaaagtggtac

SEQ ID NO: 668309 - DNA, 12 bp, Homo sapiens
ccatctgagctg

SEQ ID NO: 668310 - DNA, 14 bp, Homo sapiens
ccatctgagctggg

SEQ ID NO: 668311 - DNA, 19 bp, Homo sapiens
ccatgaccttggggtacaa

SEQ ID NO: 668312 - DNA, 17 bp, Homo sapiens
ccatgatttagcaagca

SEQ ID NO: 668313 - DNA, 15 bp, Homo sapiens
ccatgcaagcagagg

SEQ ID NO: 668314 - DNA, 16 bp, Homo sapiens
ccatgcaagcagagga

SEQ ID NO: 668315 - DNA, 20 bp, Homo sapiens
ccatgcaagcagaggaccag

SEQ ID NO: 668316 - DNA, 23 bp, Homo sapiens
ccatgcaagcagaggaccagggc

SEQ ID NO: 668317 - DNA, 14 bp, Homo sapiens
ccatgccaggaacc

SEQ ID NO: 668318 - DNA, 15 bp, Homo sapiens
ccatgccaggaacct

SEQ ID NO: 668319 - DNA, 15 bp, Homo sapiens
ccatggcccccaata

SEQ ID NO: 668320 - DNA, 18 bp, Homo sapiens
ccatggcccccaataaag

SEQ ID NO: 668321 - DNA, 20 bp, Homo sapiens
ccatggcccccaataaaggc

SEQ ID NO: 668322 - DNA, 23 bp, Homo sapiens
ccatgtatggaatcccactgtat

SEQ ID NO: 668323 - DNA, 14 bp, Homo sapiens
ccatgtatttgtta

SEQ ID NO: 668324 - DNA, 13 bp, Homo sapiens
ccatgtccaaaga

SEQ ID NO: 668325 - DNA, 14 bp, Homo sapiens
ccatgtccaaagag

SEQ ID NO: 668326 - DNA, 18 bp, Homo sapiens
ccatgtccaaagaggctg

SEQ ID NO: 668327 - DNA, 16 bp, Homo sapiens
ccatgtgcctttcttt

SEQ ID NO: 668328 - DNA, 14 bp, Homo sapiens
cctcctgcctttct

SEQ ID NO: 668329 - DNA, 12 bp, Homo sapiens
cctcctgtgggg

SEQ ID NO: 668330 - DNA, 18 bp, Homo sapiens
cctcctgtggggaaaggg

SEQ ID NO: 668331 - DNA, 14 bp, Homo sapiens
cctcgagcagagag

SEQ ID NO: 668332 - DNA, 15 bp, Homo sapiens
cctcgctttttcatc

SEQ ID NO: 668333 - DNA, 19 bp, Homo sapiens
cctcgctttttcatccttc

SEQ ID NO: 668334 - DNA, 16 bp, Homo sapiens
cctcggcacacactgt

SEQ ID NO: 668335 - DNA, 14 bp, Homo sapiens
cctctcaccccact

SEQ ID NO: 668336 - DNA, 18 bp, Homo sapiens
cctctcaccccactcctg

SEQ ID NO: 668337 - DNA, 21 bp, Homo sapiens
cctctcaccccactcctgtca

SEQ ID NO: 668338 - DNA, 13 bp, Homo sapiens
cctctcagtgttt

SEQ ID NO: 668339 - DNA, 15 bp, Homo sapiens
cctctcatctcaggt

SEQ ID NO: 668340 - DNA, 13 bp, Homo sapiens
cctctccctgggt

SEQ ID NO: 668341 - DNA, 14 bp, Homo sapiens
cctctcctccctct

SEQ ID NO: 668342 - DNA, 14 bp, Homo sapiens
cctctcctgccctg

SEQ ID NO: 668343 - DNA, 15 bp, Homo sapiens
cctctcctgccctgt

SEQ ID NO: 668344 - DNA, 21 bp, Homo sapiens
cctctccttgcccccagtgcc

SEQ ID NO: 668345 - DNA, 14 bp, Homo sapiens
cctctcgcctcatt

SEQ ID NO: 668346 - DNA, 19 bp, Homo sapiens
cctctctgtagtttatggc

SEQ ID NO: 668347 - DNA, 17 bp, Homo sapiens
cctctctgtcccttgct

SEQ ID NO: 668348 - DNA, 12 bp, Homo sapiens
cctctcttcccc

SEQ ID NO: 668349 - DNA, 13 bp, Homo sapiens
cctctcttcccct

SEQ ID NO: 668350 - DNA, 16 bp, Homo sapiens
cctctcttccccttcc

SEQ ID NO: 668351 - DNA, 14 bp, Homo sapiens
cctctgcagtctca

SEQ ID NO: 668352 - DNA, 21 bp, Homo sapiens
cctctgcagtctcatttctca

SEQ ID NO: 668353 - DNA, 23 bp, Homo sapiens
cctctgccctcattactgggcct

SEQ ID NO: 668354 - DNA, 12 bp, Homo sapiens
cctctgccctgg

SEQ ID NO: 668355 - DNA, 15 bp, Homo sapiens
cctctgccctggatt

SEQ ID NO: 668356 - DNA, 11 bp, Homo sapiens
cctctgctccc

SEQ ID NO: 668357 - DNA, 14 bp, Homo sapiens
cctctgctccctct

SEQ ID NO: 668358 - DNA, 20 bp, Homo sapiens
cctctgtccctctccttgcc

SEQ ID NO: 668359 - DNA, 21 bp, Homo sapiens
cctctgtgacccctccttgtc

SEQ ID NO: 668360 - DNA, 20 bp, Homo sapiens
cctcttctgctcttttcctg

SEQ ID NO: 668361 - DNA, 16 bp, Homo sapiens
cctcttctttgtgcct

SEQ ID NO: 668362 - DNA, 21 bp, Homo sapiens
cctcttctttgtgcctttggc

SEQ ID NO: 668363 - DNA, 17 bp, Homo sapiens
cctgaagatgggagcct

SEQ ID NO: 668364 - DNA, 16 bp, Homo sapiens
cctgagaagctgctcc

SEQ ID NO: 668365 - DNA, 22 bp, Homo sapiens
cctgagaagctgctccaggcct

SEQ ID NO: 668366 - DNA, 15 bp, Homo sapiens
cctgagagaattggc

SEQ ID NO: 668367 - DNA, 19 bp, Homo sapiens
cctgagggaagagtagctg

SEQ ID NO: 668368 - DNA, 20 bp, Homo sapiens
cctgaggtcagggagtgctg

SEQ ID NO: 668369 - DNA, 13 bp, Homo sapiens
cctgagtctgggc

SEQ ID NO: 668370 - DNA, 16 bp, Homo sapiens
cctgagtctgggcagc

SEQ ID NO: 668371 - DNA, 18 bp, Homo sapiens
cctgatggggaagggact

SEQ ID NO: 668372 - DNA, 21 bp, Homo sapiens
cctgcaaacagaacagggtca

SEQ ID NO: 668373 - DNA, 13 bp, Homo sapiens
cctgcacacaggg

SEQ ID NO: 668374 - DNA, 14 bp, Homo sapiens
cctgcacacagggc

SEQ ID NO: 668375 - DNA, 21 bp, Homo sapiens
cctgcagatactttgaagtgc

SEQ ID NO: 668376 - DNA, 12 bp, Homo sapiens
cctgcagcaggc

SEQ ID NO: 668377 - DNA, 15 bp, Homo sapiens
cctgcagcaggcagc

SEQ ID NO: 668378 - DNA, 20 bp, Homo sapiens
cctgcagcaggcagcttcta

SEQ ID NO: 668379 - DNA, 19 bp, Homo sapiens
cctgcagggccatggctca

SEQ ID NO: 668380 - DNA, 20 bp, Homo sapiens
cctgcagggccatggctcag

SEQ ID NO: 668381 - DNA, 21 bp, Homo sapiens
cctgcagtcccacactgtgca

SEQ ID NO: 668382 - DNA, 18 bp, Homo sapiens
cctgccacctccccccac

SEQ ID NO: 668383 - DNA, 16 bp, Homo sapiens
cctgccatcatgcctg

SEQ ID NO: 668384 - DNA, 15 bp, Homo sapiens
cctgccatgccagga

SEQ ID NO: 668385 - DNA, 15 bp, Homo sapiens
cctgccccctgggct

SEQ ID NO: 668386 - DNA, 12 bp, Homo sapiens
cctgccctcctc

SEQ ID NO: 668387 - DNA, 16 bp, Homo sapiens
cctgccctcctctccc

SEQ ID NO: 668388 - DNA, 21 bp, Homo sapiens
cctgccctgtgatatgtctgc

SEQ ID NO: 668389 - DNA, 20 bp, Homo sapiens
cctgcctcccacttcactgc

SEQ ID NO: 668390 - DNA, 15 bp, Homo sapiens
cctgcctggccccca

SEQ ID NO: 668391 - DNA, 16 bp, Homo sapiens
cctgcgaccctggggg

SEQ ID NO: 668392 - DNA, 16 bp, Homo sapiens
cctgctcccaggcccc

SEQ ID NO: 668393 - DNA, 12 bp, Homo sapiens
cctgctgcgctg

SEQ ID NO: 668394 - DNA, 16 bp, Homo sapiens
cctgctgcgctgcttg

SEQ ID NO: 668395 - DNA, 18 bp, Homo sapiens
cctgctgctggtgcacag

SEQ ID NO: 668396 - DNA, 14 bp, Homo sapiens
cctgctttgcatct

SEQ ID NO: 668397 - DNA, 15 bp, Homo sapiens
cctgctttgcatctt

SEQ ID NO: 668398 - DNA, 21 bp, Homo sapiens
cctggaagagccgagcacctg

SEQ ID NO: 668399 - DNA, 14 bp, Homo sapiens
cctggactgctacc

SEQ ID NO: 668400 - DNA, 12 bp, Homo sapiens
cctggagcagag

SEQ ID NO: 668401 - DNA, 18 bp, Homo sapiens
cctggattaccagggact

SEQ ID NO: 668402 - DNA, 23 bp, Homo sapiens
cctggcaaagggagcagaactga

SEQ ID NO: 668403 - DNA, 12 bp, Homo sapiens
cctggcagacac

SEQ ID NO: 668404 - DNA, 14 bp, Homo sapiens
cctggcagacacaa

SEQ ID NO: 668405 - DNA, 23 bp, Homo sapiens
cctggccatttccaagaggctgt

SEQ ID NO: 668406 - DNA, 16 bp, Homo sapiens
cctggcccccaacctc

SEQ ID NO: 668407 - DNA, 20 bp, Homo sapiens
cctggcccccaacctcaggg

SEQ ID NO: 668408 - DNA, 13 bp, Homo sapiens
cctggccctgggg

SEQ ID NO: 668409 - DNA, 14 bp, Homo sapiens
cctggccctggggg

SEQ ID NO: 668410 - DNA, 21 bp, Homo sapiens
cctggcctatccgctgccagc

SEQ ID NO: 668411 - DNA, 13 bp, Homo sapiens
cctggcctggctg

SEQ ID NO: 668412 - DNA, 15 bp, Homo sapiens
cctggcctggctggg

SEQ ID NO: 668413 - DNA, 14 bp, Homo sapiens
cctggcctgtgcct

SEQ ID NO: 668414 - DNA, 16 bp, Homo sapiens
cctggcctttcctggt

SEQ ID NO: 668415 - DNA, 14 bp, Homo sapiens
cctggccttttgtg

SEQ ID NO: 668416 - DNA, 15 bp, Homo sapiens
cctggcgcaggtggg

SEQ ID NO: 668417 - DNA, 22 bp, Homo sapiens
cctggcgcaggtgggctggact

SEQ ID NO: 668418 - DNA, 22 bp, Homo sapiens
cctggctccactcttgatctct

SEQ ID NO: 668419 - DNA, 15 bp, Homo sapiens
cctggctccctcctc

SEQ ID NO: 668420 - DNA, 22 bp, Homo sapiens
cctggctccctcctccaggcct

SEQ ID NO: 668421 - DNA, 17 bp, Homo sapiens
cctggctttgcctcttc

SEQ ID NO: 668422 - DNA, 19 bp, Homo sapiens
cctggctttgcctcttctt

SEQ ID NO: 668423 - DNA, 14 bp, Homo sapiens
cctgggaacacagt

SEQ ID NO: 668424 - DNA, 17 bp, Homo sapiens
cctgggaacacagttct

SEQ ID NO: 668425 - DNA, 21 bp, Homo sapiens
cctgggaacacagttctgggc

SEQ ID NO: 668426 - DNA, 22 bp, Homo sapiens
cctgggaacacagttctgggca

SEQ ID NO: 668427 - DNA, 21 bp, Homo sapiens
cctgggccgtggcacagctgg

SEQ ID NO: 668428 - DNA, 19 bp, Homo sapiens
cctgggctacagaaaccac

SEQ ID NO: 668429 - DNA, 13 bp, Homo sapiens
cctgggctggggc

SEQ ID NO: 668430 - DNA, 14 bp, Homo sapiens
cctgggctggttgg

SEQ ID NO: 668431 - DNA, 20 bp, Homo sapiens
cctgggctggttggagaagg

SEQ ID NO: 668432 - DNA, 13 bp, Homo sapiens
cctggggcctgag

SEQ ID NO: 668433 - DNA, 15 bp, Homo sapiens
cctggggcctgagag

SEQ ID NO: 668434 - DNA, 18 bp, Homo sapiens
cctgggggcacaggaggc

SEQ ID NO: 668435 - DNA, 23 bp, Homo sapiens
cctgggggcacaggaggcaggca

SEQ ID NO: 668436 - DNA, 14 bp, Homo sapiens
cctggggtgcatct

SEQ ID NO: 668437 - DNA, 16 bp, Homo sapiens
cctggggtgcatctcc

SEQ ID NO: 668438 - DNA, 18 bp, Homo sapiens
cctggggtgcatctcctc

SEQ ID NO: 668439 - DNA, 20 bp, Homo sapiens
cctggggtgttagtggcacc

SEQ ID NO: 668440 - DNA, 21 bp, Homo sapiens
cctggggtgttagtggcaccg

SEQ ID NO: 668441 - DNA, 22 bp, Homo sapiens
cctgggtactgaggtgctatga

SEQ ID NO: 668442 - DNA, 21 bp, Homo sapiens
cctgggtctggggacaggccc

SEQ ID NO: 668443 - DNA, 22 bp, Homo sapiens
cctgggtctggggacaggcccg

SEQ ID NO: 668444 - DNA, 13 bp, Homo sapiens
cctggtccccact

SEQ ID NO: 668445 - DNA, 21 bp, Homo sapiens
cctggtccccactgctgagct

SEQ ID NO: 668446 - DNA, 14 bp, Homo sapiens
cctggtgagaaaat

SEQ ID NO: 668447 - DNA, 16 bp, Homo sapiens
cctggttcagacacag

SEQ ID NO: 668448 - DNA, 19 bp, Homo sapiens
cctggtttaattcagcaga

SEQ ID NO: 668449 - DNA, 13 bp, Homo sapiens
ctacctccctccc

SEQ ID NO: 668450 - DNA, 16 bp, Homo sapiens
ctacctctctgtccct

SEQ ID NO: 668451 - DNA, 16 bp, Homo sapiens
ctacctgccctcaagg

SEQ ID NO: 668452 - DNA, 16 bp, Homo sapiens
ctacctttcaaagctt

SEQ ID NO: 668453 - DNA, 14 bp, Homo sapiens
ctactaatgatgtt

SEQ ID NO: 668454 - DNA, 11 bp, Homo sapiens
ctactcctgcc

SEQ ID NO: 668455 - DNA, 12 bp, Homo sapiens
ctactgaaacag

SEQ ID NO: 668456 - DNA, 18 bp, Homo sapiens
ctactgaaacagatttca

SEQ ID NO: 668457 - DNA, 17 bp, Homo sapiens
ctactgccttgaaaaat

SEQ ID NO: 668458 - DNA, 18 bp, Homo sapiens
ctactgccttgaaaaatg

SEQ ID NO: 668459 - DNA, 20 bp, Homo sapiens
ctactgccttgaaaaatgac

SEQ ID NO: 668460 - DNA, 23 bp, Homo sapiens
ctactggcctccctttgtgtgca

SEQ ID NO: 668461 - DNA, 13 bp, Homo sapiens
ctacttgggaggc

SEQ ID NO: 668462 - DNA, 16 bp, Homo sapiens
ctacttgggaggctga

SEQ ID NO: 668463 - DNA, 21 bp, Homo sapiens
ctacttggggacataatttca

SEQ ID NO: 668464 - DNA, 14 bp, Homo sapiens
ctagaaaaataaaa

SEQ ID NO: 668465 - DNA, 17 bp, Homo sapiens
ctagaaaaataaaatgt

SEQ ID NO: 668466 - DNA, 20 bp, Homo sapiens
ctagaaaaataaaatgtttc

SEQ ID NO: 668467 - DNA, 20 bp, Homo sapiens
ctagaacgcttcgggaaaat

SEQ ID NO: 668468 - DNA, 16 bp, Homo sapiens
ctagaagaaccaaata

SEQ ID NO: 668469 - DNA, 18 bp, Homo sapiens
ctagaagaaccaaatacc

SEQ ID NO: 668470 - DNA, 21 bp, Homo sapiens
ctagaagaaccaaatacctca

SEQ ID NO: 668471 - DNA, 18 bp, Homo sapiens
ctagaagattagaaacta

SEQ ID NO: 668472 - DNA, 19 bp, Homo sapiens
ctagaagcctaagaactgt

SEQ ID NO: 668473 - DNA, 23 bp, Homo sapiens
ctagaagtctgtccaaatttaaa

SEQ ID NO: 668474 - DNA, 14 bp, Homo sapiens
ctagaatgtaaagt

SEQ ID NO: 668475 - DNA, 22 bp, Homo sapiens
ctagaatgtaaagttatgtatt

SEQ ID NO: 668476 - DNA, 19 bp, Homo sapiens
ctagcagcccaccctgctg

SEQ ID NO: 668477 - DNA, 21 bp, Homo sapiens
ctagcagttgttgaggggagg

SEQ ID NO: 668478 - DNA, 18 bp, Homo sapiens
ctagccagcccctcttcc

SEQ ID NO: 668479 - DNA, 16 bp, Homo sapiens
ctagcgatctctcctg

SEQ ID NO: 668480 - DNA, 13 bp, Homo sapiens
ctagctaaataaa

SEQ ID NO: 668481 - DNA, 15 bp, Homo sapiens
ctagcttttaggaaa

SEQ ID NO: 668482 - DNA, 14 bp, Homo sapiens
ctaggaaactcaca

SEQ ID NO: 668483 - DNA, 15 bp, Homo sapiens
ctaggctgctgctgt

SEQ ID NO: 668484 - DNA, 22 bp, Homo sapiens
ctaggtatcattcaactctcca

SEQ ID NO: 668485 - DNA, 23 bp, Homo sapiens
ctagtgtacctcctctcagtgtt

SEQ ID NO: 668486 - DNA, 18 bp, Homo sapiens
ctagtttcttacacactg

SEQ ID NO: 668487 - DNA, 22 bp, Homo sapiens
ctagtttcttacacactgtctg

SEQ ID NO: 668488 - DNA, 13 bp, Homo sapiens
ctataaaactctg

SEQ ID NO: 668489 - DNA, 15 bp, Homo sapiens
ctataaaactctgca

SEQ ID NO: 668490 - DNA, 16 bp, Homo sapiens
ctataataaaggctga

SEQ ID NO: 668491 - DNA, 21 bp, Homo sapiens
ctatacaaattttcagaaggt

SEQ ID NO: 668492 - DNA, 16 bp, Homo sapiens
ctatatatataaatgt

SEQ ID NO: 668493 - DNA, 21 bp, Homo sapiens
ctatatgtgaaacattttttc

SEQ ID NO: 668494 - DNA, 17 bp, Homo sapiens
ctatatttgattatgta

SEQ ID NO: 668495 - DNA, 23 bp, Homo sapiens
ctatccccatctccctgcctggc

SEQ ID NO: 668496 - DNA, 14 bp, Homo sapiens
ctatccgctgccag

SEQ ID NO: 668497 - DNA, 15 bp, Homo sapiens
ctatccgctgccagc

SEQ ID NO: 668498 - DNA, 22 bp, Homo sapiens
ctatccgctgccagccttgagc

SEQ ID NO: 668499 - DNA, 18 bp, Homo sapiens
ctatcctgtaaatatatc

SEQ ID NO: 668500 - DNA, 18 bp, Homo sapiens
ctatccttataggcctgt

SEQ ID NO: 668501 - DNA, 18 bp, Homo sapiens
ctatctagttctaacagt

SEQ ID NO: 668502 - DNA, 18 bp, Homo sapiens
ctatctccgttccatctg

SEQ ID NO: 668503 - DNA, 18 bp, Homo sapiens
ctatctgattttgtgcaa

SEQ ID NO: 668504 - DNA, 13 bp, Homo sapiens
ctatcttccaaat

SEQ ID NO: 668505 - DNA, 14 bp, Homo sapiens
ctatctttgctgca

SEQ ID NO: 668506 - DNA, 17 bp, Homo sapiens
ctatgaagccaactgac

SEQ ID NO: 668507 - DNA, 19 bp, Homo sapiens
ctatgaagccaactgacaa

SEQ ID NO: 668508 - DNA, 20 bp, Homo sapiens
ctatgaagccaactgacaaa

SEQ ID NO: 668509 - DNA, 20 bp, Homo sapiens
ctatgatttaatttgaaata

SEQ ID NO: 668510 - DNA, 21 bp, Homo sapiens
ctatgtaagaattcagaagac

SEQ ID NO: 668511 - DNA, 24 bp, Homo sapiens
ctatgtataaaatacatagtgaaa

SEQ ID NO: 668512 - DNA, 21 bp, Homo sapiens
ctatgtgacatttctcttccc

SEQ ID NO: 668513 - DNA, 22 bp, Homo sapiens
ctatgttactattttctacaat

SEQ ID NO: 668514 - DNA, 19 bp, Homo sapiens
ctattaatcacctctctgt

SEQ ID NO: 668515 - DNA, 13 bp, Homo sapiens
ctattatccagag

SEQ ID NO: 668516 - DNA, 21 bp, Homo sapiens
ctattctgatgaatctcaaag

SEQ ID NO: 668517 - DNA, 14 bp, Homo sapiens
ctatttaagatgtg

SEQ ID NO: 668518 - DNA, 18 bp, Homo sapiens
ctattttcataatcagta

SEQ ID NO: 668519 - DNA, 21 bp, Homo sapiens
ctattttcataatcagtaaat

SEQ ID NO: 668520 - DNA, 22 bp, Homo sapiens
ctcaaaaaaacaaaaaagactt

SEQ ID NO: 668521 - DNA, 14 bp, Homo sapiens
ctcaaagaggcctt

SEQ ID NO: 668522 - DNA, 16 bp, Homo sapiens
ctcaaatacacatttg

SEQ ID NO: 668523 - DNA, 17 bp, Homo sapiens
ctcaactcacctaatgt

SEQ ID NO: 668524 - DNA, 19 bp, Homo sapiens
ctcaaggtgggccttgcta

SEQ ID NO: 668525 - DNA, 14 bp, Homo sapiens
ctcaagtttaaaag

SEQ ID NO: 668526 - DNA, 22 bp, Homo sapiens
ctcaatgcagttagctgaagaa

SEQ ID NO: 668527 - DNA, 20 bp, Homo sapiens
ctcaatttttgtctcagaag

SEQ ID NO: 668528 - DNA, 17 bp, Homo sapiens
ctcacaaaatcacttta

SEQ ID NO: 668529 - DNA, 18 bp, Homo sapiens
ctcacaaaatcactttaa

SEQ ID NO: 668530 - DNA, 12 bp, Homo sapiens
ctcacacctgta

SEQ ID NO: 668531 - DNA, 20 bp, Homo sapiens
ctcacagtacagcatgtgcc

SEQ ID NO: 668532 - DNA, 22 bp, Homo sapiens
ctcacagtacagcatgtgcctt

SEQ ID NO: 668533 - DNA, 13 bp, Homo sapiens
ctcaccccactcc

SEQ ID NO: 668534 - DNA, 15 bp, Homo sapiens
ctcaccccactcctg

SEQ ID NO: 668535 - DNA, 14 bp, Homo sapiens
ctcaccccctcacc

SEQ ID NO: 668536 - DNA, 23 bp, Homo sapiens
ctcacctaatgtttatgagccag

SEQ ID NO: 668537 - DNA, 14 bp, Homo sapiens
ctcactaaagcatg

SEQ ID NO: 668538 - DNA, 20 bp, Homo sapiens
ctcactaaagcatgaaatgt

SEQ ID NO: 668539 - DNA, 13 bp, Homo sapiens
ctcactatatata

SEQ ID NO: 668540 - DNA, 15 bp, Homo sapiens
ctcactctgtttcct

SEQ ID NO: 668541 - DNA, 16 bp, Homo sapiens
ctcacttcctttgccc

SEQ ID NO: 668542 - DNA, 17 bp, Homo sapiens
ctcagaatgtaaaagaa

SEQ ID NO: 668543 - DNA, 13 bp, Homo sapiens
ctcagaccccctc

SEQ ID NO: 668544 - DNA, 16 bp, Homo sapiens
ctcagaccccctcagc

SEQ ID NO: 668545 - DNA, 20 bp, Homo sapiens
ctcagagaaaaatgctcccc

SEQ ID NO: 668546 - DNA, 21 bp, Homo sapiens
ctcagagaaaaatgctcccca

SEQ ID NO: 668547 - DNA, 16 bp, Homo sapiens
ctcagattcttcattg

SEQ ID NO: 668548 - DNA, 22 bp, Homo sapiens
ctcagattcttcattgaggatt

SEQ ID NO: 668549 - DNA, 22 bp, Homo sapiens
ctcagattgtaatatgtaaatg

SEQ ID NO: 668550 - DNA, 15 bp, Homo sapiens
ctcagccctggcctg

SEQ ID NO: 668551 - DNA, 17 bp, Homo sapiens
ctcagccctggcctggc

SEQ ID NO: 668552 - DNA, 17 bp, Homo sapiens
ctcagctataattctgt

SEQ ID NO: 668553 - DNA, 22 bp, Homo sapiens
ctcagctataattctgttatat

SEQ ID NO: 668554 - DNA, 17 bp, Homo sapiens
ctcagctgcctcctgcg

SEQ ID NO: 668555 - DNA, 19 bp, Homo sapiens
ctcagctgtcaaggctcag

SEQ ID NO: 668556 - DNA, 14 bp, Homo sapiens
ctcagcttatctct

SEQ ID NO: 668557 - DNA, 13 bp, Homo sapiens
ctcaggccacagt

SEQ ID NO: 668558 - DNA, 20 bp, Homo sapiens
ctcaggccacagtggggctg

SEQ ID NO: 668559 - DNA, 19 bp, Homo sapiens
ctcagggagcagggaaggc

SEQ ID NO: 668560 - DNA, 23 bp, Homo sapiens
ctcagggagcagggaaggcctga

SEQ ID NO: 668561 - DNA, 16 bp, Homo sapiens
ctcagggctcccaggg

SEQ ID NO: 668562 - DNA, 23 bp, Homo sapiens
ctcaggtagaaggttgacacagt

SEQ ID NO: 668563 - DNA, 13 bp, Homo sapiens
ctcagtccctctt

SEQ ID NO: 668564 - DNA, 15 bp, Homo sapiens
ctcagtcctaatttg

SEQ ID NO: 668565 - DNA, 10 bp, Homo sapiens
ctcagtgcag

SEQ ID NO: 668566 - DNA, 11 bp, Homo sapiens
ctcagtgcaga

SEQ ID NO: 668567 - DNA, 15 bp, Homo sapiens
ctcagtgcagatgga

SEQ ID NO: 668568 - DNA, 14 bp, Homo sapiens
ctcagtgcctccac

SEQ ID NO: 668569 - DNA, 13 bp, Homo sapiens
ctgcacagggtcc

SEQ ID NO: 668570 - DNA, 23 bp, Homo sapiens
ctgcaccttcactctccagggta

SEQ ID NO: 668571 - DNA, 14 bp, Homo sapiens
ctgcactccagcct

SEQ ID NO: 668572 - DNA, 17 bp, Homo sapiens
ctgcactccagcctggg

SEQ ID NO: 668573 - DNA, 20 bp, Homo sapiens
ctgcagattagttctttttg

SEQ ID NO: 668574 - DNA, 22 bp, Homo sapiens
ctgcagattagttctttttgcc

SEQ ID NO: 668575 - DNA, 23 bp, Homo sapiens
ctgcagattagttctttttgcca

SEQ ID NO: 668576 - DNA, 18 bp, Homo sapiens
ctgcagcaccgaggggcc

SEQ ID NO: 668577 - DNA, 13 bp, Homo sapiens
ctgcagcaggagt

SEQ ID NO: 668578 - DNA, 12 bp, Homo sapiens
ctgcaggaccct

SEQ ID NO: 668579 - DNA, 23 bp, Homo sapiens
ctgcagggccatggctcagggtg

SEQ ID NO: 668580 - DNA, 22 bp, Homo sapiens
ctgcagtcccacactgtgcaga

SEQ ID NO: 668581 - DNA, 17 bp, Homo sapiens
ctgcagtctcatttctc

SEQ ID NO: 668582 - DNA, 13 bp, Homo sapiens
ctgcattagaaaa

SEQ ID NO: 668583 - DNA, 23 bp, Homo sapiens
ctgcattgccgctgtataaagca

SEQ ID NO: 668584 - DNA, 21 bp, Homo sapiens
ctgccaagagtcaacaggtca

SEQ ID NO: 668585 - DNA, 13 bp, Homo sapiens
ctgccagccttga

SEQ ID NO: 668586 - DNA, 14 bp, Homo sapiens
ctgccaggctgcct

SEQ ID NO: 668587 - DNA, 16 bp, Homo sapiens
ctgccaggctgcctcc

SEQ ID NO: 668588 - DNA, 19 bp, Homo sapiens
ctgccaggctgcctcctgc

SEQ ID NO: 668589 - DNA, 17 bp, Homo sapiens
ctgccatctagccagcc

SEQ ID NO: 668590 - DNA, 22 bp, Homo sapiens
ctgccatgccaggaacctgtcc

SEQ ID NO: 668591 - DNA, 23 bp, Homo sapiens
ctgccatggctaggtagaagtga

SEQ ID NO: 668592 - DNA, 13 bp, Homo sapiens
ctgccatttaaaa

SEQ ID NO: 668593 - DNA, 15 bp, Homo sapiens
ctgcccactctgcaa

SEQ ID NO: 668594 - DNA, 21 bp, Homo sapiens
ctgcccattcaccaaaattat

SEQ ID NO: 668595 - DNA, 15 bp, Homo sapiens
ctgccccctgggctg

SEQ ID NO: 668596 - DNA, 23 bp, Homo sapiens
ctgcccggagcagcagcttctcc

SEQ ID NO: 668597 - DNA, 21 bp, Homo sapiens
ctgccctcattactgggcctt

SEQ ID NO: 668598 - DNA, 17 bp, Homo sapiens
ctgccctcctctcccct

SEQ ID NO: 668599 - DNA, 17 bp, Homo sapiens
ctgccctccttaatttg

SEQ ID NO: 668600 - DNA, 20 bp, Homo sapiens
ctgccctgtgatatgtctgc

SEQ ID NO: 668601 - DNA, 18 bp, Homo sapiens
ctgccgctacctccctcc

SEQ ID NO: 668602 - DNA, 17 bp, Homo sapiens
ctgcctcagcctcctga

SEQ ID NO: 668603 - DNA, 14 bp, Homo sapiens
ctgcctctccctgg

SEQ ID NO: 668604 - DNA, 16 bp, Homo sapiens
ctgcctctccctgggt

SEQ ID NO: 668605 - DNA, 11 bp, Homo sapiens
ctgcctctgct

SEQ ID NO: 668606 - DNA, 12 bp, Homo sapiens
ctgcctctgctc

SEQ ID NO: 668607 - DNA, 15 bp, Homo sapiens
ctgcctctgctccct

SEQ ID NO: 668608 - DNA, 14 bp, Homo sapiens
ctgcctgcagcagg

SEQ ID NO: 668609 - DNA, 15 bp, Homo sapiens
ctgcctgcagcaggc

SEQ ID NO: 668610 - DNA, 13 bp, Homo sapiens
ctgcctggcacag

SEQ ID NO: 668611 - DNA, 19 bp, Homo sapiens
ctgcctggcccccaacctc

SEQ ID NO: 668612 - DNA, 11 bp, Homo sapiens
ctgcctgggcc

SEQ ID NO: 668613 - DNA, 22 bp, Homo sapiens
ctgcctgggccgtggcacagct

SEQ ID NO: 668614 - DNA, 23 bp, Homo sapiens
ctgcctgggccgtggcacagctg

SEQ ID NO: 668615 - DNA, 18 bp, Homo sapiens
ctgccttctgctgaaaga

SEQ ID NO: 668616 - DNA, 21 bp, Homo sapiens
ctgccttgaaaaatgacaatt

SEQ ID NO: 668617 - DNA, 21 bp, Homo sapiens
ctgcctttctcaactgtccca

SEQ ID NO: 668618 - DNA, 14 bp, Homo sapiens
ctgcctttgcacca

SEQ ID NO: 668619 - DNA, 22 bp, Homo sapiens
ctgcgaagaccctcttgcccat

SEQ ID NO: 668620 - DNA, 14 bp, Homo sapiens
ctgcgaccctgggg

SEQ ID NO: 668621 - DNA, 15 bp, Homo sapiens
ctgcgaccctggggg

SEQ ID NO: 668622 - DNA, 22 bp, Homo sapiens
ctgcgaccctgggggcacagga

SEQ ID NO: 668623 - DNA, 13 bp, Homo sapiens
ctgcgatgcagcg

SEQ ID NO: 668624 - DNA, 16 bp, Homo sapiens
ctgcgcttcagtaaca

SEQ ID NO: 668625 - DNA, 20 bp, Homo sapiens
ctgctatccccatctccctg

SEQ ID NO: 668626 - DNA, 15 bp, Homo sapiens
ctgctcaccgcccat

SEQ ID NO: 668627 - DNA, 19 bp, Homo sapiens
ctgctcaccgcccatcagg

SEQ ID NO: 668628 - DNA, 15 bp, Homo sapiens
ctgctccaggcctgc

SEQ ID NO: 668629 - DNA, 18 bp, Homo sapiens
ctgctcccaggccccagg

SEQ ID NO: 668630 - DNA, 11 bp, Homo sapiens
ctgctcctcca

SEQ ID NO: 668631 - DNA, 13 bp, Homo sapiens
ctgctgagctggc

SEQ ID NO: 668632 - DNA, 16 bp, Homo sapiens
ctgctgagctggccct

SEQ ID NO: 668633 - DNA, 17 bp, Homo sapiens
ctgctgagttggcctgg

SEQ ID NO: 668634 - DNA, 20 bp, Homo sapiens
ctgctgagttggcctggcca

SEQ ID NO: 668635 - DNA, 21 bp, Homo sapiens
ctgctgagttggcctggccat

SEQ ID NO: 668636 - DNA, 20 bp, Homo sapiens
ctgctgcagattagttcttt

SEQ ID NO: 668637 - DNA, 21 bp, Homo sapiens
ctgctgcctctttccctagga

SEQ ID NO: 668638 - DNA, 15 bp, Homo sapiens
ctgctgcgctgcttg

SEQ ID NO: 668639 - DNA, 16 bp, Homo sapiens
ctgctgcgctgcttgg

SEQ ID NO: 668640 - DNA, 17 bp, Homo sapiens
ctgctgcgctgcttggt

SEQ ID NO: 668641 - DNA, 20 bp, Homo sapiens
ctgctggagatcagcatgcc

SEQ ID NO: 668642 - DNA, 15 bp, Homo sapiens
ctgctggtgcacagc

SEQ ID NO: 668643 - DNA, 15 bp, Homo sapiens
ctgctgtatttttat

SEQ ID NO: 668644 - DNA, 20 bp, Homo sapiens
ctgctgtatttttatttttg

SEQ ID NO: 668645 - DNA, 22 bp, Homo sapiens
ctgctgtatttttatttttgca

SEQ ID NO: 668646 - DNA, 16 bp, Homo sapiens
ctgctgtgcagcatgg

SEQ ID NO: 668647 - DNA, 15 bp, Homo sapiens
ctgcttcccttactt

SEQ ID NO: 668648 - DNA, 14 bp, Homo sapiens
ctgctttaattacc

SEQ ID NO: 668649 - DNA, 20 bp, Homo sapiens
ctgctttaattacctggtga

SEQ ID NO: 668650 - DNA, 17 bp, Homo sapiens
ctgctttgcatctttgt

SEQ ID NO: 668651 - DNA, 17 bp, Homo sapiens
ctgctttttctgcgctt

SEQ ID NO: 668652 - DNA, 23 bp, Homo sapiens
ctggaaagcagagcctcctggga

SEQ ID NO: 668653 - DNA, 17 bp, Homo sapiens
ctggaactcctggcctt

SEQ ID NO: 668654 - DNA, 22 bp, Homo sapiens
ctggaatggtacatgtcttcca

SEQ ID NO: 668655 - DNA, 23 bp, Homo sapiens
ctggaattcctaacttttcaatg

SEQ ID NO: 668656 - DNA, 14 bp, Homo sapiens
ctggaattcttctg

SEQ ID NO: 668657 - DNA, 17 bp, Homo sapiens
ctggaattcttctgcaa

SEQ ID NO: 668658 - DNA, 17 bp, Homo sapiens
ctggacccttataaaat

SEQ ID NO: 668659 - DNA, 13 bp, Homo sapiens
ctggactgcttgg

SEQ ID NO: 668660 - DNA, 15 bp, Homo sapiens
ctggacttctacctg

SEQ ID NO: 668661 - DNA, 23 bp, Homo sapiens
ctggacttctacctgccctcaag

SEQ ID NO: 668662 - DNA, 15 bp, Homo sapiens
ctggagcaccaggtg

SEQ ID NO: 668663 - DNA, 22 bp, Homo sapiens
ctggagcagaggaggggaaagt

SEQ ID NO: 668664 - DNA, 15 bp, Homo sapiens
ctggagcctggggtg

SEQ ID NO: 668665 - DNA, 16 bp, Homo sapiens
ctggagctggcactgt

SEQ ID NO: 668666 - DNA, 22 bp, Homo sapiens
ctggaggagggtttgggcagag

SEQ ID NO: 668667 - DNA, 14 bp, Homo sapiens
ctggatgaaagagc

SEQ ID NO: 668668 - DNA, 16 bp, Homo sapiens
ctggattcattgtctc

SEQ ID NO: 668669 - DNA, 23 bp, Homo sapiens
ctggattggttggcaaactaaag

SEQ ID NO: 668670 - DNA, 18 bp, Homo sapiens
ctggcaattgtctattta

SEQ ID NO: 668671 - DNA, 17 bp, Homo sapiens
ctggcacgtgacaggct

SEQ ID NO: 668672 - DNA, 14 bp, Homo sapiens
ctggcagggccacc

SEQ ID NO: 668673 - DNA, 20 bp, Homo sapiens
ctggcagggccacctgcagg

SEQ ID NO: 668674 - DNA, 21 bp, Homo sapiens
ctggcagggccacctgcagga

SEQ ID NO: 668675 - DNA, 22 bp, Homo sapiens
ctggcatcaagaggtgggaggg

SEQ ID NO: 668676 - DNA, 20 bp, Homo sapiens
ctggcatgttcaaagccaca

SEQ ID NO: 668677 - DNA, 20 bp, Homo sapiens
ctggccagcgggcccagcaa

SEQ ID NO: 668678 - DNA, 22 bp, Homo sapiens
ctggcccctaggctgctgctgt

SEQ ID NO: 668679 - DNA, 19 bp, Homo sapiens
ctggccctgggggtctggg

SEQ ID NO: 668680 - DNA, 15 bp, Homo sapiens
ctggccttgtcctca

SEQ ID NO: 668681 - DNA, 13 bp, Homo sapiens
ctggcgcaggtgg

SEQ ID NO: 668682 - DNA, 23 bp, Homo sapiens
ctggctccactcttgatctctct

SEQ ID NO: 668683 - DNA, 22 bp, Homo sapiens
ctggctccctcctccaggcctg

SEQ ID NO: 668684 - DNA, 23 bp, Homo sapiens
ctggctccctcctccaggcctgc

SEQ ID NO: 668685 - DNA, 15 bp, Homo sapiens
ctggctgcacaggct

SEQ ID NO: 668686 - DNA, 16 bp, Homo sapiens
ctggctgcacaggctg

SEQ ID NO: 668687 - DNA, 17 bp, Homo sapiens
ctggctttaagccttca

SEQ ID NO: 668688 - DNA, 19 bp, Homo sapiens
cttctctgttggtctgcct

SEQ ID NO: 668689 - DNA, 18 bp, Homo sapiens
cttctgcaagcctcatgc

SEQ ID NO: 668690 - DNA, 22 bp, Homo sapiens
cttctgctgaaagactcgagaa

SEQ ID NO: 668691 - DNA, 15 bp, Homo sapiens
cttctggtactttct

SEQ ID NO: 668692 - DNA, 18 bp, Homo sapiens
cttctggtgttgactgga

SEQ ID NO: 668693 - DNA, 19 bp, Homo sapiens
cttctggtttccctttatt

SEQ ID NO: 668694 - DNA, 13 bp, Homo sapiens
cttcttacatgca

SEQ ID NO: 668695 - DNA, 14 bp, Homo sapiens
cttcttagaatgtt

SEQ ID NO: 668696 - DNA, 19 bp, Homo sapiens
cttcttctaagaagacatt

SEQ ID NO: 668697 - DNA, 20 bp, Homo sapiens
cttcttctaagaagacattt

SEQ ID NO: 668698 - DNA, 22 bp, Homo sapiens
cttcttctaagaagacattttg

SEQ ID NO: 668699 - DNA, 11 bp, Homo sapiens
cttcttgggat

SEQ ID NO: 668700 - DNA, 19 bp, Homo sapiens
cttcttggggcccagtgca

SEQ ID NO: 668701 - DNA, 21 bp, Homo sapiens
cttcttggggcccagtgcatg

SEQ ID NO: 668702 - DNA, 22 bp, Homo sapiens
cttcttggggcccagtgcatgg

SEQ ID NO: 668703 - DNA, 23 bp, Homo sapiens
cttcttggggcccagtgcatggt

SEQ ID NO: 668704 - DNA, 13 bp, Homo sapiens
cttctttccatca

SEQ ID NO: 668705 - DNA, 15 bp, Homo sapiens
cttctttgtgccttt

SEQ ID NO: 668706 - DNA, 18 bp, Homo sapiens
cttctttgtgcctttggc

SEQ ID NO: 668707 - DNA, 22 bp, Homo sapiens
cttctttgtgcctttggcctgg

SEQ ID NO: 668708 - DNA, 17 bp, Homo sapiens
cttgaaaaatgacaatt

SEQ ID NO: 668709 - DNA, 20 bp, Homo sapiens
cttgaaaataagattccaga

SEQ ID NO: 668710 - DNA, 18 bp, Homo sapiens
cttgaaactttgggaaaa

SEQ ID NO: 668711 - DNA, 14 bp, Homo sapiens
cttgaaattgaaga

SEQ ID NO: 668712 - DNA, 16 bp, Homo sapiens
cttgaagaaggaaaga

SEQ ID NO: 668713 - DNA, 18 bp, Homo sapiens
cttgaagcctaaatttgt

SEQ ID NO: 668714 - DNA, 21 bp, Homo sapiens
cttgaatgtggtctcaggata

SEQ ID NO: 668715 - DNA, 19 bp, Homo sapiens
cttgacatacctaccagta

SEQ ID NO: 668716 - DNA, 20 bp, Homo sapiens
cttgacatacctaccagtat

SEQ ID NO: 668717 - DNA, 18 bp, Homo sapiens
cttgacctgtttctctgc

SEQ ID NO: 668718 - DNA, 21 bp, Homo sapiens
cttgactgttagttgtccaca

SEQ ID NO: 668719 - DNA, 12 bp, Homo sapiens
cttgagacaatg

SEQ ID NO: 668720 - DNA, 18 bp, Homo sapiens
cttgagacaatgttttct

SEQ ID NO: 668721 - DNA, 13 bp, Homo sapiens
cttgagccagtaa

SEQ ID NO: 668722 - DNA, 18 bp, Homo sapiens
cttgagccagtaatcttt

SEQ ID NO: 668723 - DNA, 17 bp, Homo sapiens
cttgatcatgctgcagt

SEQ ID NO: 668724 - DNA, 13 bp, Homo sapiens
cttgatctctctt

SEQ ID NO: 668725 - DNA, 16 bp, Homo sapiens
cttgatgactgctgat

SEQ ID NO: 668726 - DNA, 17 bp, Homo sapiens
cttgatgtttggggtct

SEQ ID NO: 668727 - DNA, 16 bp, Homo sapiens
cttgcaagataatttt

SEQ ID NO: 668728 - DNA, 22 bp, Homo sapiens
cttgcataataagctaaagagg

SEQ ID NO: 668729 - DNA, 21 bp, Homo sapiens
cttgcatattgttggcacaga

SEQ ID NO: 668730 - DNA, 21 bp, Homo sapiens
cttgcatttgtggtaatctac

SEQ ID NO: 668731 - DNA, 20 bp, Homo sapiens
cttgcattttggaaggctga

SEQ ID NO: 668732 - DNA, 17 bp, Homo sapiens
cttgccaagaaaatgaa

SEQ ID NO: 668733 - DNA, 15 bp, Homo sapiens
cttgcccaagtccca

SEQ ID NO: 668734 - DNA, 12 bp, Homo sapiens
cttgcccatcct

SEQ ID NO: 668735 - DNA, 18 bp, Homo sapiens
cttgcccatcctgactga

SEQ ID NO: 668736 - DNA, 14 bp, Homo sapiens
cttgcccccagtgc

SEQ ID NO: 668737 - DNA, 13 bp, Homo sapiens
cttgcctccaggt

SEQ ID NO: 668738 - DNA, 18 bp, Homo sapiens
cttgcctccaggtgcaga

SEQ ID NO: 668739 - DNA, 13 bp, Homo sapiens
cttgcctgagggg

SEQ ID NO: 668740 - DNA, 14 bp, Homo sapiens
cttgcctgagggga

SEQ ID NO: 668741 - DNA, 14 bp, Homo sapiens
cttgctctcctcat

SEQ ID NO: 668742 - DNA, 16 bp, Homo sapiens
cttgctctcctcatct

SEQ ID NO: 668743 - DNA, 15 bp, Homo sapiens
cttgctgctttttct

SEQ ID NO: 668744 - DNA, 20 bp, Homo sapiens
cttgctgctttttctgcgct

SEQ ID NO: 668745 - DNA, 13 bp, Homo sapiens
cttgctgtatgct

SEQ ID NO: 668746 - DNA, 19 bp, Homo sapiens
cttgcttcttactgataat

SEQ ID NO: 668747 - DNA, 17 bp, Homo sapiens
cttgcttgcctgcaggg

SEQ ID NO: 668748 - DNA, 20 bp, Homo sapiens
cttggaaattcctgtactgt

SEQ ID NO: 668749 - DNA, 13 bp, Homo sapiens
cttggactacaca

SEQ ID NO: 668750 - DNA, 21 bp, Homo sapiens
cttggactacacaatacagta

SEQ ID NO: 668751 - DNA, 13 bp, Homo sapiens
cttggcaacagaa

SEQ ID NO: 668752 - DNA, 13 bp, Homo sapiens
cttgggaatttta

SEQ ID NO: 668753 - DNA, 16 bp, Homo sapiens
cttgggaggctgaggc

SEQ ID NO: 668754 - DNA, 23 bp, Homo sapiens
cttgggaggctgaggcaggagaa

SEQ ID NO: 668755 - DNA, 21 bp, Homo sapiens
cttgggccgtccccatttgca

SEQ ID NO: 668756 - DNA, 19 bp, Homo sapiens
cttggggacataatttcag

SEQ ID NO: 668757 - DNA, 19 bp, Homo sapiens
cttggggcccagtgcatgg

SEQ ID NO: 668758 - DNA, 21 bp, Homo sapiens
cttggtcttctactgccttga

SEQ ID NO: 668759 - DNA, 19 bp, Homo sapiens
cttggtttctctctacagt

SEQ ID NO: 668760 - DNA, 20 bp, Homo sapiens
cttggtttctctctacagtg

SEQ ID NO: 668761 - DNA, 14 bp, Homo sapiens
cttgtaactaaaat

SEQ ID NO: 668762 - DNA, 17 bp, Homo sapiens
cttgtaactaaaataat

SEQ ID NO: 668763 - DNA, 22 bp, Homo sapiens
cttgtacccccaggtggaaggc

SEQ ID NO: 668764 - DNA, 13 bp, Homo sapiens
cttgtcctcttct

SEQ ID NO: 668765 - DNA, 16 bp, Homo sapiens
cttgtcctcttctgct

SEQ ID NO: 668766 - DNA, 17 bp, Homo sapiens
cttgtcctcttctgctc

SEQ ID NO: 668767 - DNA, 22 bp, Homo sapiens
cttgtcctcttctgctcttttc

SEQ ID NO: 668768 - DNA, 14 bp, Homo sapiens
cttgtctgatttct

SEQ ID NO: 668769 - DNA, 19 bp, Homo sapiens
cttgtggggctaaggcagg

SEQ ID NO: 668770 - DNA, 12 bp, Homo sapiens
cttgtggttgtg

SEQ ID NO: 668771 - DNA, 22 bp, Homo sapiens
cttgtgttcagctctttccaaa

SEQ ID NO: 668772 - DNA, 15 bp, Homo sapiens
ctttaaaaagaaatt

SEQ ID NO: 668773 - DNA, 22 bp, Homo sapiens
ctttaaaaaggtgcactacagt

SEQ ID NO: 668774 - DNA, 18 bp, Homo sapiens
ctttaacatacaagaaaa

SEQ ID NO: 668775 - DNA, 21 bp, Homo sapiens
ctttaacatacaagaaaatgt

SEQ ID NO: 668776 - DNA, 17 bp, Homo sapiens
ctttaacattttggaaa

SEQ ID NO: 668777 - DNA, 18 bp, Homo sapiens
ctttaacattttggaaat

SEQ ID NO: 668778 - DNA, 21 bp, Homo sapiens
ctttaatgatatgcttgtaac

SEQ ID NO: 668779 - DNA, 13 bp, Homo sapiens
ctttactgcctga

SEQ ID NO: 668780 - DNA, 16 bp, Homo sapiens
ctttagatatttacat

SEQ ID NO: 668781 - DNA, 16 bp, Homo sapiens
ctttagcttcatttta

SEQ ID NO: 668782 - DNA, 21 bp, Homo sapiens
ctttagtttttggttgggaat

SEQ ID NO: 668783 - DNA, 14 bp, Homo sapiens
ctttattaagtaaa

SEQ ID NO: 668784 - DNA, 14 bp, Homo sapiens
ctttattaatgttt

SEQ ID NO: 668785 - DNA, 14 bp, Homo sapiens
ctttattgcttttt

SEQ ID NO: 668786 - DNA, 20 bp, Homo sapiens
ctttatttctcttctaccct

SEQ ID NO: 668787 - DNA, 17 bp, Homo sapiens
ctttattttgagatgta

SEQ ID NO: 668788 - DNA, 12 bp, Homo sapiens
ctttcaaagctt

SEQ ID NO: 668789 - DNA, 19 bp, Homo sapiens
ctttcaattgtcacttttt

SEQ ID NO: 668790 - DNA, 22 bp, Homo sapiens
ctttcagaaatataacacattt

SEQ ID NO: 668791 - DNA, 16 bp, Homo sapiens
ctttcatctacctttt

SEQ ID NO: 668792 - DNA, 18 bp, Homo sapiens
ctttcatgttgcaaagaa

SEQ ID NO: 668793 - DNA, 11 bp, Homo sapiens
ctttccaaatt

SEQ ID NO: 668794 - DNA, 19 bp, Homo sapiens
ctttccaaattaaaacaaa

SEQ ID NO: 668795 - DNA, 12 bp, Homo sapiens
ctttccaaggaa

SEQ ID NO: 668796 - DNA, 14 bp, Homo sapiens
ctttccaaggaagc

SEQ ID NO: 668797 - DNA, 21 bp, Homo sapiens
ctttccaggcttccctgactt

SEQ ID NO: 668798 - DNA, 13 bp, Homo sapiens
ctttccatcaact

SEQ ID NO: 668799 - DNA, 19 bp, Homo sapiens
ctttcccatgtatttgtta

SEQ ID NO: 668800 - DNA, 20 bp, Homo sapiens
ctttccccacctcttacagt

SEQ ID NO: 668801 - DNA, 13 bp, Homo sapiens
ctttcctgtttcc

SEQ ID NO: 668802 - DNA, 12 bp, Homo sapiens
ctttctcctggc

SEQ ID NO: 668803 - DNA, 17 bp, Homo sapiens
ctttctcctggcccctg

SEQ ID NO: 668804 - DNA, 14 bp, Homo sapiens
ctttctctgaggac

SEQ ID NO: 668805 - DNA, 15 bp, Homo sapiens
ctttctctgaggaca

SEQ ID NO: 668806 - DNA, 22 bp, Homo sapiens
ctttctgccatctagccagccc

SEQ ID NO: 668807 - DNA, 12 bp, Homo sapiens
ctttctgtccca

SEQ ID NO: 668808 - DNA, 19 bp, Homo sapiens
gaaatgtgaatttttattg

SEQ ID NO: 668809 - DNA, 20 bp, Homo sapiens
gaaatgtgaatttttattgt

SEQ ID NO: 668810 - DNA, 22 bp, Homo sapiens
gaaatgtttaataaagctttat

SEQ ID NO: 668811 - DNA, 18 bp, Homo sapiens
gaaattaagcattttgaa

SEQ ID NO: 668812 - DNA, 23 bp, Homo sapiens
gaaattaatatggcttcaccaag

SEQ ID NO: 668813 - DNA, 19 bp, Homo sapiens
gaaattactttaacatttt

SEQ ID NO: 668814 - DNA, 20 bp, Homo sapiens
gaaatttcctaatttattct

SEQ ID NO: 668815 - DNA, 13 bp, Homo sapiens
gaacaaaacttct

SEQ ID NO: 668816 - DNA, 12 bp, Homo sapiens
gaacaaggaagg

SEQ ID NO: 668817 - DNA, 15 bp, Homo sapiens
gaacaaggaaggaaa

SEQ ID NO: 668818 - DNA, 15 bp, Homo sapiens
gaacacagttctggg

SEQ ID NO: 668819 - DNA, 22 bp, Homo sapiens
gaacagatcttttactttggcc

SEQ ID NO: 668820 - DNA, 17 bp, Homo sapiens
gaacagatttcaaaaaa

SEQ ID NO: 668821 - DNA, 21 bp, Homo sapiens
gaacagcgaagtagcttgctc

SEQ ID NO: 668822 - DNA, 20 bp, Homo sapiens
gaacaggaggtgtgaatgca

SEQ ID NO: 668823 - DNA, 22 bp, Homo sapiens
gaacaggaggtgtgaatgcacg

SEQ ID NO: 668824 - DNA, 22 bp, Homo sapiens
gaacatgtcctaattcttctgt

SEQ ID NO: 668825 - DNA, 22 bp, Homo sapiens
gaaccaaatacctcaatttttg

SEQ ID NO: 668826 - DNA, 13 bp, Homo sapiens
gaaccataaattc

SEQ ID NO: 668827 - DNA, 15 bp, Homo sapiens
gaaccttccttcctg

SEQ ID NO: 668828 - DNA, 14 bp, Homo sapiens
gaactccagagtca

SEQ ID NO: 668829 - DNA, 20 bp, Homo sapiens
gaactgaaccggctttacca

SEQ ID NO: 668830 - DNA, 20 bp, Homo sapiens
gaactgtagctgccatggct

SEQ ID NO: 668831 - DNA, 18 bp, Homo sapiens
gaacttacttgcatacca

SEQ ID NO: 668832 - DNA, 12 bp, Homo sapiens
gaacttgacaat

SEQ ID NO: 668833 - DNA, 21 bp, Homo sapiens
gaagaaacacgtggtcatgaa

SEQ ID NO: 668834 - DNA, 16 bp, Homo sapiens
gaagaatacccaggaa

SEQ ID NO: 668835 - DNA, 17 bp, Homo sapiens
gaagaattgaaaagttt

SEQ ID NO: 668836 - DNA, 23 bp, Homo sapiens
gaagaccctcttgcccatcctga

SEQ ID NO: 668837 - DNA, 15 bp, Homo sapiens
gaagacgggagggga

SEQ ID NO: 668838 - DNA, 23 bp, Homo sapiens
gaagacgggaggggaggcattga

SEQ ID NO: 668839 - DNA, 22 bp, Homo sapiens
gaagactttgtgactgtcactt

SEQ ID NO: 668840 - DNA, 16 bp, Homo sapiens
gaagagccgagcacct

SEQ ID NO: 668841 - DNA, 17 bp, Homo sapiens
gaagaggaaaaggctgg

SEQ ID NO: 668842 - DNA, 20 bp, Homo sapiens
gaagagggagaagcatgaaa

SEQ ID NO: 668843 - DNA, 21 bp, Homo sapiens
gaagagttcccttgaaacttt

SEQ ID NO: 668844 - DNA, 21 bp, Homo sapiens
gaagcagaagacgggagggga

SEQ ID NO: 668845 - DNA, 16 bp, Homo sapiens
gaagcatgaaaaagca

SEQ ID NO: 668846 - DNA, 10 bp, Homo sapiens
gaagcatgta

SEQ ID NO: 668847 - DNA, 18 bp, Homo sapiens
gaagccccacatgtccag

SEQ ID NO: 668848 - DNA, 22 bp, Homo sapiens
gaagctgcctggtgtggagtga

SEQ ID NO: 668849 - DNA, 13 bp, Homo sapiens
gaagctgctccag

SEQ ID NO: 668850 - DNA, 18 bp, Homo sapiens
gaagctgctccaggcctg

SEQ ID NO: 668851 - DNA, 14 bp, Homo sapiens
gaagctggcctgag

SEQ ID NO: 668852 - DNA, 20 bp, Homo sapiens
gaagctgttaatttttctta

SEQ ID NO: 668853 - DNA, 20 bp, Homo sapiens
gaaggaaatcccatcagtga

SEQ ID NO: 668854 - DNA, 17 bp, Homo sapiens
gaaggagaagtaagagg

SEQ ID NO: 668855 - DNA, 13 bp, Homo sapiens
gaaggcagacagc

SEQ ID NO: 668856 - DNA, 14 bp, Homo sapiens
gaaggcagacagca

SEQ ID NO: 668857 - DNA, 19 bp, Homo sapiens
gaaggcagacagcaggcag

SEQ ID NO: 668858 - DNA, 20 bp, Homo sapiens
gaaggcctgacttctgctgg

SEQ ID NO: 668859 - DNA, 21 bp, Homo sapiens
gaaggcttaattgactgaaat

SEQ ID NO: 668860 - DNA, 12 bp, Homo sapiens
gaaggtgaaaca

SEQ ID NO: 668861 - DNA, 22 bp, Homo sapiens
gaagtaactgtccgctagaagt

SEQ ID NO: 668862 - DNA, 19 bp, Homo sapiens
gaagtagcttgctccctgt

SEQ ID NO: 668863 - DNA, 17 bp, Homo sapiens
gaagtcaaaatatgtaa

SEQ ID NO: 668864 - DNA, 22 bp, Homo sapiens
gaagtcaataggcctatttatt

SEQ ID NO: 668865 - DNA, 21 bp, Homo sapiens
gaagtgagcagtcgcctgcct

SEQ ID NO: 668866 - DNA, 15 bp, Homo sapiens
gaagtgcagctcatg

SEQ ID NO: 668867 - DNA, 14 bp, Homo sapiens
gaagtgtataatat

SEQ ID NO: 668868 - DNA, 15 bp, Homo sapiens
gaagtgtatttattt

SEQ ID NO: 668869 - DNA, 14 bp, Homo sapiens
gaagtttggctgct

SEQ ID NO: 668870 - DNA, 15 bp, Homo sapiens
gaataaacacacaga

SEQ ID NO: 668871 - DNA, 20 bp, Homo sapiens
gaatacccaggaagactttg

SEQ ID NO: 668872 - DNA, 20 bp, Homo sapiens
gaataggctgatgggcaaaa

SEQ ID NO: 668873 - DNA, 18 bp, Homo sapiens
gaatataccttatttatt

SEQ ID NO: 668874 - DNA, 19 bp, Homo sapiens
gaatatcctttaaaattta

SEQ ID NO: 668875 - DNA, 20 bp, Homo sapiens
gaatatgccttaatttagaa

SEQ ID NO: 668876 - DNA, 21 bp, Homo sapiens
gaatatgccttaatttagaaa

SEQ ID NO: 668877 - DNA, 23 bp, Homo sapiens
gaatatgccttaatttagaaact

SEQ ID NO: 668878 - DNA, 12 bp, Homo sapiens
gaatatttacta

SEQ ID NO: 668879 - DNA, 21 bp, Homo sapiens
gaatatttttagactatttct

SEQ ID NO: 668880 - DNA, 22 bp, Homo sapiens
gaatatttttagactatttctt

SEQ ID NO: 668881 - DNA, 17 bp, Homo sapiens
gaatctcttcatgcttg

SEQ ID NO: 668882 - DNA, 21 bp, Homo sapiens
gaatctcttcatgcttgacat

SEQ ID NO: 668883 - DNA, 15 bp, Homo sapiens
gaatcttcactagaa

SEQ ID NO: 668884 - DNA, 12 bp, Homo sapiens
gaatgagcccag

SEQ ID NO: 668885 - DNA, 14 bp, Homo sapiens
gaatgagcccagag

SEQ ID NO: 668886 - DNA, 20 bp, Homo sapiens
gaatgagcccagagaacagc

SEQ ID NO: 668887 - DNA, 19 bp, Homo sapiens
gaatgccatctatctagtt

SEQ ID NO: 668888 - DNA, 16 bp, Homo sapiens
gaatgcctcctgtggg

SEQ ID NO: 668889 - DNA, 11 bp, Homo sapiens
gaatgggaatt

SEQ ID NO: 668890 - DNA, 11 bp, Homo sapiens
gaatgggactg

SEQ ID NO: 668891 - DNA, 22 bp, Homo sapiens
gaatgtaaaagaacttactgat

SEQ ID NO: 668892 - DNA, 19 bp, Homo sapiens
gaatgtaaagttatgtatt

SEQ ID NO: 668893 - DNA, 15 bp, Homo sapiens
gaatgtaactgctga

SEQ ID NO: 668894 - DNA, 14 bp, Homo sapiens
gaatgtacgtccag

SEQ ID NO: 668895 - DNA, 19 bp, Homo sapiens
gaatgtagcgtgtaagctt

SEQ ID NO: 668896 - DNA, 13 bp, Homo sapiens
gaatgtggtctca

SEQ ID NO: 668897 - DNA, 15 bp, Homo sapiens
gaatgtggtctcagg

SEQ ID NO: 668898 - DNA, 17 bp, Homo sapiens
gaattagatttctatag

SEQ ID NO: 668899 - DNA, 12 bp, Homo sapiens
gaattcttctgc

SEQ ID NO: 668900 - DNA, 18 bp, Homo sapiens
gaattggaaagacttctc

SEQ ID NO: 668901 - DNA, 16 bp, Homo sapiens
gaattggaactgcaat

SEQ ID NO: 668902 - DNA, 20 bp, Homo sapiens
gaattgttagcaaatgacag

SEQ ID NO: 668903 - DNA, 18 bp, Homo sapiens
gaatttagtattatcaaa

SEQ ID NO: 668904 - DNA, 20 bp, Homo sapiens
gaatttatgtgaaatgcttt

SEQ ID NO: 668905 - DNA, 22 bp, Homo sapiens
gaatttgaaaaatgcataataa

SEQ ID NO: 668906 - DNA, 14 bp, Homo sapiens
gaatttgaagagat

SEQ ID NO: 668907 - DNA, 22 bp, Homo sapiens
gaatttgatgattttcatttca

SEQ ID NO: 668908 - DNA, 13 bp, Homo sapiens
gaatttttattgt

SEQ ID NO: 668909 - DNA, 19 bp, Homo sapiens
gacaaaaataatagtttta

SEQ ID NO: 668910 - DNA, 14 bp, Homo sapiens
gacaaagatttctt

SEQ ID NO: 668911 - DNA, 20 bp, Homo sapiens
gacaagagatctacacatgt

SEQ ID NO: 668912 - DNA, 13 bp, Homo sapiens
gacacacggggct

SEQ ID NO: 668913 - DNA, 19 bp, Homo sapiens
gacacagctcttccagggc

SEQ ID NO: 668914 - DNA, 15 bp, Homo sapiens
gacacatatacatat

SEQ ID NO: 668915 - DNA, 22 bp, Homo sapiens
gacagaaacatgtcttgactgt

SEQ ID NO: 668916 - DNA, 15 bp, Homo sapiens
gacagaagtctcctc

SEQ ID NO: 668917 - DNA, 16 bp, Homo sapiens
gacagaagtctcctca

SEQ ID NO: 668918 - DNA, 14 bp, Homo sapiens
gacagcaggcagcg

SEQ ID NO: 668919 - DNA, 12 bp, Homo sapiens
gacagcatgaga

SEQ ID NO: 668920 - DNA, 20 bp, Homo sapiens
gacagctgactgaatgcaga

SEQ ID NO: 668921 - DNA, 14 bp, Homo sapiens
gacaggctcgtcag

SEQ ID NO: 668922 - DNA, 18 bp, Homo sapiens
gacaggctcgtcagccac

SEQ ID NO: 668923 - DNA, 22 bp, Homo sapiens
gacaggctcgtcagccacctgg

SEQ ID NO: 668924 - DNA, 11 bp, Homo sapiens
gacagggccag

SEQ ID NO: 668925 - DNA, 12 bp, Homo sapiens
gacagggccagt

SEQ ID NO: 668926 - DNA, 16 bp, Homo sapiens
gacagggccagtgggg

SEQ ID NO: 668927 - DNA, 18 bp, Homo sapiens
gacagtcatcatcagggc

SEQ ID NO: 668928 - DNA, 15 bp, Homo sapiens
gatgagaacaagcta

SEQ ID NO: 668929 - DNA, 16 bp, Homo sapiens
gatgataaacgacttt

SEQ ID NO: 668930 - DNA, 19 bp, Homo sapiens
gatgattttcatttcatga

SEQ ID NO: 668931 - DNA, 15 bp, Homo sapiens
gatgccactcctccc

SEQ ID NO: 668932 - DNA, 17 bp, Homo sapiens
gatgccactcctccctc

SEQ ID NO: 668933 - DNA, 14 bp, Homo sapiens
gatgcgcactgcat

SEQ ID NO: 668934 - DNA, 20 bp, Homo sapiens
gatgctagaaaaatgttctt

SEQ ID NO: 668935 - DNA, 20 bp, Homo sapiens
gatggaaatacagttatttc

SEQ ID NO: 668936 - DNA, 18 bp, Homo sapiens
gatggacttacctggcag

SEQ ID NO: 668937 - DNA, 17 bp, Homo sapiens
gatggccccgcaaggcc

SEQ ID NO: 668938 - DNA, 19 bp, Homo sapiens
gatggcgtgggctgcgtga

SEQ ID NO: 668939 - DNA, 19 bp, Homo sapiens
gatggctggaaggggtcca

SEQ ID NO: 668940 - DNA, 13 bp, Homo sapiens
gatggcttgtcta

SEQ ID NO: 668941 - DNA, 18 bp, Homo sapiens
gatgggccaggcagagaa

SEQ ID NO: 668942 - DNA, 21 bp, Homo sapiens
gatggtggccacagactgacc

SEQ ID NO: 668943 - DNA, 17 bp, Homo sapiens
gatggttttaaactttc

SEQ ID NO: 668944 - DNA, 13 bp, Homo sapiens
gatgtaaagatgt

SEQ ID NO: 668945 - DNA, 17 bp, Homo sapiens
gatgtaggcattctgga

SEQ ID NO: 668946 - DNA, 15 bp, Homo sapiens
gatgtatgtaaatat

SEQ ID NO: 668947 - DNA, 16 bp, Homo sapiens
gatgtccctgggccag

SEQ ID NO: 668948 - DNA, 19 bp, Homo sapiens
gatgtccctgggccagggt

SEQ ID NO: 668949 - DNA, 21 bp, Homo sapiens
gatgtccctgggccagggtct

SEQ ID NO: 668950 - DNA, 22 bp, Homo sapiens
gatgtccctgggccagggtctg

SEQ ID NO: 668951 - DNA, 23 bp, Homo sapiens
gatgtgaataggttatatgcaag

SEQ ID NO: 668952 - DNA, 14 bp, Homo sapiens
gatgtgactgtata

SEQ ID NO: 668953 - DNA, 21 bp, Homo sapiens
gatgtgcatttttgtgaaatg

SEQ ID NO: 668954 - DNA, 20 bp, Homo sapiens
gattaaagatgagctttgtc

SEQ ID NO: 668955 - DNA, 15 bp, Homo sapiens
gattaagaaaggaag

SEQ ID NO: 668956 - DNA, 21 bp, Homo sapiens
gattaatttgtgaaaatgtaa

SEQ ID NO: 668957 - DNA, 23 bp, Homo sapiens
gattaccagggactatctttgct

SEQ ID NO: 668958 - DNA, 18 bp, Homo sapiens
gattagaggcagatctgg

SEQ ID NO: 668959 - DNA, 22 bp, Homo sapiens
gattatgtatggatatatttga

SEQ ID NO: 668960 - DNA, 13 bp, Homo sapiens
gattctaaataca

SEQ ID NO: 668961 - DNA, 22 bp, Homo sapiens
gattctcagggctggagcctgg

SEQ ID NO: 668962 - DNA, 16 bp, Homo sapiens
gattctcccaaagtac

SEQ ID NO: 668963 - DNA, 20 bp, Homo sapiens
gattctttcagttctttgga

SEQ ID NO: 668964 - DNA, 14 bp, Homo sapiens
gattgcccctggct

SEQ ID NO: 668965 - DNA, 19 bp, Homo sapiens
gattgcccctggctttgcc

SEQ ID NO: 668966 - DNA, 13 bp, Homo sapiens
gattgcctctgaa

SEQ ID NO: 668967 - DNA, 18 bp, Homo sapiens
gattggaagaaacacgtg

SEQ ID NO: 668968 - DNA, 15 bp, Homo sapiens
gatttatgtcagcac

SEQ ID NO: 668969 - DNA, 19 bp, Homo sapiens
gatttccagaaccacactt

SEQ ID NO: 668970 - DNA, 22 bp, Homo sapiens
gatttctaattgtaagtgaaat

SEQ ID NO: 668971 - DNA, 18 bp, Homo sapiens
gatttgtagcataactgt

SEQ ID NO: 668972 - DNA, 19 bp, Homo sapiens
gatttgtagcataactgta

SEQ ID NO: 668973 - DNA, 22 bp, Homo sapiens
gatttgtagcataactgtagct

SEQ ID NO: 668974 - DNA, 16 bp, Homo sapiens
gatttgtttatttgca

SEQ ID NO: 668975 - DNA, 16 bp, Homo sapiens
gatttttttcctcccc

SEQ ID NO: 668976 - DNA, 20 bp, Homo sapiens
gattttttttttttcctctt

SEQ ID NO: 668977 - DNA, 20 bp, Homo sapiens
gcaaaaaggagccttttgct

SEQ ID NO: 668978 - DNA, 16 bp, Homo sapiens
gcaaacccattaaggg

SEQ ID NO: 668979 - DNA, 15 bp, Homo sapiens
gcaaacgagactttc

SEQ ID NO: 668980 - DNA, 17 bp, Homo sapiens
gcaaagggagcagaact

SEQ ID NO: 668981 - DNA, 18 bp, Homo sapiens
gcaaagggagcagaactg

SEQ ID NO: 668982 - DNA, 15 bp, Homo sapiens
gcaaagtttaaatgt

SEQ ID NO: 668983 - DNA, 17 bp, Homo sapiens
gcaaagtttaaatgtat

SEQ ID NO: 668984 - DNA, 16 bp, Homo sapiens
gcaaataaagcctttt

SEQ ID NO: 668985 - DNA, 23 bp, Homo sapiens
gcaaatgttaaaagttttatatg

SEQ ID NO: 668986 - DNA, 17 bp, Homo sapiens
gcaaattgtatcttatt

SEQ ID NO: 668987 - DNA, 13 bp, Homo sapiens
gcaacatggcttt

SEQ ID NO: 668988 - DNA, 22 bp, Homo sapiens
gcaacatttgtatggatttaag

SEQ ID NO: 668989 - DNA, 14 bp, Homo sapiens
gcaagagagatgtt

SEQ ID NO: 668990 - DNA, 17 bp, Homo sapiens
gcaagagagatgttttg

SEQ ID NO: 668991 - DNA, 12 bp, Homo sapiens
gcaagcagagga

SEQ ID NO: 668992 - DNA, 16 bp, Homo sapiens
gcaagcagaggaccag

SEQ ID NO: 668993 - DNA, 10 bp, Homo sapiens
gcaaggaaag

SEQ ID NO: 668994 - DNA, 22 bp, Homo sapiens
gcaagtgtggggggtccttctc

SEQ ID NO: 668995 - DNA, 16 bp, Homo sapiens
gcaagttcattttaaa

SEQ ID NO: 668996 - DNA, 12 bp, Homo sapiens
gcaataaaattt

SEQ ID NO: 668997 - DNA, 14 bp, Homo sapiens
gcaataaaatttaa

SEQ ID NO: 668998 - DNA, 15 bp, Homo sapiens
gcaataactctggga

SEQ ID NO: 668999 - DNA, 17 bp, Homo sapiens
gcaatctccatgtgtac

SEQ ID NO: 669000 - DNA, 19 bp, Homo sapiens
gcaatctgcctgtatctct

SEQ ID NO: 669001 - DNA, 18 bp, Homo sapiens
gcaattagtctgaaactg

SEQ ID NO: 669002 - DNA, 22 bp, Homo sapiens
gcaattagtctgaaactggctt

SEQ ID NO: 669003 - DNA, 13 bp, Homo sapiens
gcaattgtctatt

SEQ ID NO: 669004 - DNA, 15 bp, Homo sapiens
gcacaacagccctgc

SEQ ID NO: 669005 - DNA, 13 bp, Homo sapiens
gcacactgaggcc

SEQ ID NO: 669006 - DNA, 11 bp, Homo sapiens
gcacagaacag

SEQ ID NO: 669007 - DNA, 12 bp, Homo sapiens
gcacagaacagg

SEQ ID NO: 669008 - DNA, 16 bp, Homo sapiens
gcacagaccaggcctt

SEQ ID NO: 669009 - DNA, 17 bp, Homo sapiens
gcacagctgtttgaaat

SEQ ID NO: 669010 - DNA, 16 bp, Homo sapiens
gcacaggaggcaggca

SEQ ID NO: 669011 - DNA, 21 bp, Homo sapiens
gcacaggaggcaggcatggcc

SEQ ID NO: 669012 - DNA, 15 bp, Homo sapiens
gcacagttcatggtt

SEQ ID NO: 669013 - DNA, 19 bp, Homo sapiens
gcacatccgcgtgtgcctg

SEQ ID NO: 669014 - DNA, 20 bp, Homo sapiens
gcacatccgcgtgtgcctgt

SEQ ID NO: 669015 - DNA, 19 bp, Homo sapiens
gcacccctgagccagcagg

SEQ ID NO: 669016 - DNA, 16 bp, Homo sapiens
gcacctgtagtcccag

SEQ ID NO: 669017 - DNA, 15 bp, Homo sapiens
gcaccttgtgcctgg

SEQ ID NO: 669018 - DNA, 16 bp, Homo sapiens
gcacgattttgcacaa

SEQ ID NO: 669019 - DNA, 17 bp, Homo sapiens
gcactacaccttgcctt

SEQ ID NO: 669020 - DNA, 20 bp, Homo sapiens
gcactactgtactccagcca

SEQ ID NO: 669021 - DNA, 14 bp, Homo sapiens
gcactccagcctgg

SEQ ID NO: 669022 - DNA, 19 bp, Homo sapiens
gcactgatggaaaatacca

SEQ ID NO: 669023 - DNA, 20 bp, Homo sapiens
gcactgatgttgtgttttta

SEQ ID NO: 669024 - DNA, 19 bp, Homo sapiens
gcacttattgaccattttt

SEQ ID NO: 669025 - DNA, 23 bp, Homo sapiens
gcacttattgaccattttttaat

SEQ ID NO: 669026 - DNA, 17 bp, Homo sapiens
gcactttctaatgtttc

SEQ ID NO: 669027 - DNA, 22 bp, Homo sapiens
gcactttgggaggccgaggcgg

SEQ ID NO: 669028 - DNA, 14 bp, Homo sapiens
gcagaaaatattta

SEQ ID NO: 669029 - DNA, 17 bp, Homo sapiens
gcagaacggtttttgga

SEQ ID NO: 669030 - DNA, 18 bp, Homo sapiens
gcagaagacgggagggga

SEQ ID NO: 669031 - DNA, 19 bp, Homo sapiens
gcagaagacgggaggggag

SEQ ID NO: 669032 - DNA, 14 bp, Homo sapiens
gcagaagagggtgt

SEQ ID NO: 669033 - DNA, 18 bp, Homo sapiens
gcagaatgtaagtgggcc

SEQ ID NO: 669034 - DNA, 20 bp, Homo sapiens
gcagacagaagtctcctcaa

SEQ ID NO: 669035 - DNA, 19 bp, Homo sapiens
gcagacagcaggcagcgcc

SEQ ID NO: 669036 - DNA, 21 bp, Homo sapiens
gcagactgctgctagagccag

SEQ ID NO: 669037 - DNA, 23 bp, Homo sapiens
gcagagatttctcattgactttt

SEQ ID NO: 669038 - DNA, 17 bp, Homo sapiens
gcagaggtaccctgggt

SEQ ID NO: 669039 - DNA, 18 bp, Homo sapiens
gcagaggtaccctgggtg

SEQ ID NO: 669040 - DNA, 22 bp, Homo sapiens
gcagagtggcgtggcctcccca

SEQ ID NO: 669041 - DNA, 14 bp, Homo sapiens
gcagcagcttctcc

SEQ ID NO: 669042 - DNA, 13 bp, Homo sapiens
gcagcaggcagct

SEQ ID NO: 669043 - DNA, 13 bp, Homo sapiens
gcagcattgaagt

SEQ ID NO: 669044 - DNA, 18 bp, Homo sapiens
gcagcattgaagtatggt

SEQ ID NO: 669045 - DNA, 13 bp, Homo sapiens
gcagcccaccctg

SEQ ID NO: 669046 - DNA, 14 bp, Homo sapiens
gcagcggctccact

SEQ ID NO: 669047 - DNA, 10 bp, Homo sapiens
gcagctgcct

SEQ ID NO: 669048 - DNA, 20 bp, Homo sapiens
gctggacttctacctgccct

SEQ ID NO: 669049 - DNA, 21 bp, Homo sapiens
gctggacttctacctgccctc

SEQ ID NO: 669050 - DNA, 22 bp, Homo sapiens
gctggacttctacctgccctca

SEQ ID NO: 669051 - DNA, 20 bp, Homo sapiens
gctggagtgcagtggtgtga

SEQ ID NO: 669052 - DNA, 18 bp, Homo sapiens
gctggctcacagtacagc

SEQ ID NO: 669053 - DNA, 23 bp, Homo sapiens
gctggctcacagtacagcatgtg

SEQ ID NO: 669054 - DNA, 13 bp, Homo sapiens
gctgggagcctgg

SEQ ID NO: 669055 - DNA, 22 bp, Homo sapiens
gctgggcccgacatggctccgg

SEQ ID NO: 669056 - DNA, 20 bp, Homo sapiens
gctgggggaatgagcccaga

SEQ ID NO: 669057 - DNA, 21 bp, Homo sapiens
gctgggggaatgagcccagag

SEQ ID NO: 669058 - DNA, 13 bp, Homo sapiens
gctgggtgtttca

SEQ ID NO: 669059 - DNA, 12 bp, Homo sapiens
gctggtccttat

SEQ ID NO: 669060 - DNA, 20 bp, Homo sapiens
gctggtgcacagccactccc

SEQ ID NO: 669061 - DNA, 20 bp, Homo sapiens
gctgtatttttatttttgca

SEQ ID NO: 669062 - DNA, 16 bp, Homo sapiens
gctgtcaccaaggaaa

SEQ ID NO: 669063 - DNA, 22 bp, Homo sapiens
gctgtccttaacccacctctcc

SEQ ID NO: 669064 - DNA, 23 bp, Homo sapiens
gctgtctgttgtattcattgtgg

SEQ ID NO: 669065 - DNA, 22 bp, Homo sapiens
gcttaatcttcaaagccttctc

SEQ ID NO: 669066 - DNA, 16 bp, Homo sapiens
gcttaatgctacatgt

SEQ ID NO: 669067 - DNA, 18 bp, Homo sapiens
gcttaattgactgaaatt

SEQ ID NO: 669068 - DNA, 13 bp, Homo sapiens
gcttacctcctca

SEQ ID NO: 669069 - DNA, 13 bp, Homo sapiens
gcttactatttct

SEQ ID NO: 669070 - DNA, 14 bp, Homo sapiens
gcttatatgtactt

SEQ ID NO: 669071 - DNA, 22 bp, Homo sapiens
gcttatatgtacttttattttt

SEQ ID NO: 669072 - DNA, 22 bp, Homo sapiens
gcttatctcttttatatttgta

SEQ ID NO: 669073 - DNA, 21 bp, Homo sapiens
gcttcaaggatatactgcagc

SEQ ID NO: 669074 - DNA, 17 bp, Homo sapiens
gcttcagtaacaagtgt

SEQ ID NO: 669075 - DNA, 15 bp, Homo sapiens
gcttcagttgcttgt

SEQ ID NO: 669076 - DNA, 17 bp, Homo sapiens
gcttcatcattccctct

SEQ ID NO: 669077 - DNA, 19 bp, Homo sapiens
gcttcatcattccctctca

SEQ ID NO: 669078 - DNA, 14 bp, Homo sapiens
gcttccccactccc

SEQ ID NO: 669079 - DNA, 19 bp, Homo sapiens
gcttccctgacttgcttta

SEQ ID NO: 669080 - DNA, 15 bp, Homo sapiens
gcttcccttactttg

SEQ ID NO: 669081 - DNA, 21 bp, Homo sapiens
gcttcctagaaagttctgtgt

SEQ ID NO: 669082 - DNA, 19 bp, Homo sapiens
gcttctcatgttaaatatt

SEQ ID NO: 669083 - DNA, 13 bp, Homo sapiens
gcttgacatacct

SEQ ID NO: 669084 - DNA, 13 bp, Homo sapiens
gcttgattttaat

SEQ ID NO: 669085 - DNA, 23 bp, Homo sapiens
gcttgcataataagctaaagagg

SEQ ID NO: 669086 - DNA, 16 bp, Homo sapiens
gcttgcctgcagggcc

SEQ ID NO: 669087 - DNA, 17 bp, Homo sapiens
gcttgcctgcagggcca

SEQ ID NO: 669088 - DNA, 20 bp, Homo sapiens
gcttgtctatactccttccc

SEQ ID NO: 669089 - DNA, 16 bp, Homo sapiens
gcttgtttacctttct

SEQ ID NO: 669090 - DNA, 15 bp, Homo sapiens
gcttgtttgcctgtc

SEQ ID NO: 669091 - DNA, 14 bp, Homo sapiens
gctttataaacttt

SEQ ID NO: 669092 - DNA, 15 bp, Homo sapiens
gctttataacaaatg

SEQ ID NO: 669093 - DNA, 20 bp, Homo sapiens
gctttatcgaacgtggtctg

SEQ ID NO: 669094 - DNA, 17 bp, Homo sapiens
gctttcctgtttccagg

SEQ ID NO: 669095 - DNA, 12 bp, Homo sapiens
gctttgcctctt

SEQ ID NO: 669096 - DNA, 14 bp, Homo sapiens
gctttggaagtttt

SEQ ID NO: 669097 - DNA, 18 bp, Homo sapiens
gcttttaataaactgcaa

SEQ ID NO: 669098 - DNA, 20 bp, Homo sapiens
gcttttatttggtgtgttcg

SEQ ID NO: 669099 - DNA, 14 bp, Homo sapiens
gcttttgcttgcaa

SEQ ID NO: 669100 - DNA, 18 bp, Homo sapiens
gcttttggggagccagaa

SEQ ID NO: 669101 - DNA, 18 bp, Homo sapiens
gcttttgttccaatgtca

SEQ ID NO: 669102 - DNA, 13 bp, Homo sapiens
gctttttcatcct

SEQ ID NO: 669103 - DNA, 15 bp, Homo sapiens
gctttttcatccttc

SEQ ID NO: 669104 - DNA, 12 bp, Homo sapiens
ggaaaacatttg

SEQ ID NO: 669105 - DNA, 14 bp, Homo sapiens
ggaaaacatttgct

SEQ ID NO: 669106 - DNA, 14 bp, Homo sapiens
ggaaaattgcccca

SEQ ID NO: 669107 - DNA, 20 bp, Homo sapiens
ggaaagcagagcctcctggg

SEQ ID NO: 669108 - DNA, 20 bp, Homo sapiens
ggaaattaaatccaataaaa

SEQ ID NO: 669109 - DNA, 16 bp, Homo sapiens
ggaacagatttcaaaa

SEQ ID NO: 669110 - DNA, 17 bp, Homo sapiens
ggaacagcactggggag

SEQ ID NO: 669111 - DNA, 22 bp, Homo sapiens
ggaacctgtcctaaggaacctt

SEQ ID NO: 669112 - DNA, 16 bp, Homo sapiens
ggaactcctggccttt

SEQ ID NO: 669113 - DNA, 22 bp, Homo sapiens
ggaactgcaatgaaagtcaaat

SEQ ID NO: 669114 - DNA, 14 bp, Homo sapiens
ggaacttcagagat

SEQ ID NO: 669115 - DNA, 14 bp, Homo sapiens
ggaagaaaatgtca

SEQ ID NO: 669116 - DNA, 15 bp, Homo sapiens
ggaagaaaatgtcag

SEQ ID NO: 669117 - DNA, 16 bp, Homo sapiens
ggaagaatgaaagctg

SEQ ID NO: 669118 - DNA, 18 bp, Homo sapiens
ggaagagccgagcacctg

SEQ ID NO: 669119 - DNA, 20 bp, Homo sapiens
ggaagcagaagacgggaggg

SEQ ID NO: 669120 - DNA, 21 bp, Homo sapiens
ggaagcggccctaagggagtg

SEQ ID NO: 669121 - DNA, 15 bp, Homo sapiens
ggaagctggcctgag

SEQ ID NO: 669122 - DNA, 13 bp, Homo sapiens
ggaagctgtcctg

SEQ ID NO: 669123 - DNA, 13 bp, Homo sapiens
ggaaggcagacag

SEQ ID NO: 669124 - DNA, 17 bp, Homo sapiens
ggaaggcagacagcagg

SEQ ID NO: 669125 - DNA, 22 bp, Homo sapiens
ggaaggcagacagcaggcagcg

SEQ ID NO: 669126 - DNA, 15 bp, Homo sapiens
ggaagggaaagtttt

SEQ ID NO: 669127 - DNA, 21 bp, Homo sapiens
ggaagtataggccaggcacag

SEQ ID NO: 669128 - DNA, 18 bp, Homo sapiens
ggaagtcatcctgccaac

SEQ ID NO: 669129 - DNA, 17 bp, Homo sapiens
ggaatgagcccagagaa

SEQ ID NO: 669130 - DNA, 16 bp, Homo sapiens
ggaatgaggaaaattc

SEQ ID NO: 669131 - DNA, 15 bp, Homo sapiens
ggaattttttgaata

SEQ ID NO: 669132 - DNA, 13 bp, Homo sapiens
ggacaaaaggaat

SEQ ID NO: 669133 - DNA, 15 bp, Homo sapiens
ggacacaaattttca

SEQ ID NO: 669134 - DNA, 22 bp, Homo sapiens
ggacacaaattttcaagtttac

SEQ ID NO: 669135 - DNA, 20 bp, Homo sapiens
ggacagctgactgaatgcag

SEQ ID NO: 669136 - DNA, 22 bp, Homo sapiens
ggacataatttcagtgggaaat

SEQ ID NO: 669137 - DNA, 17 bp, Homo sapiens
ggacatagaatctgtga

SEQ ID NO: 669138 - DNA, 16 bp, Homo sapiens
ggacatgcaataaaat

SEQ ID NO: 669139 - DNA, 13 bp, Homo sapiens
ggacccagtgcag

SEQ ID NO: 669140 - DNA, 22 bp, Homo sapiens
ggacccccgtggggcagggagc

SEQ ID NO: 669141 - DNA, 17 bp, Homo sapiens
ggaccctgtcctgcagt

SEQ ID NO: 669142 - DNA, 15 bp, Homo sapiens
ggacgatcaggagga

SEQ ID NO: 669143 - DNA, 17 bp, Homo sapiens
ggacggccaagaatgta

SEQ ID NO: 669144 - DNA, 18 bp, Homo sapiens
ggactattacatattttt

SEQ ID NO: 669145 - DNA, 19 bp, Homo sapiens
ggactattgtgccaactgc

SEQ ID NO: 669146 - DNA, 11 bp, Homo sapiens
ggactccatct

SEQ ID NO: 669147 - DNA, 22 bp, Homo sapiens
ggactccatctctcatcctcca

SEQ ID NO: 669148 - DNA, 12 bp, Homo sapiens
ggactcctggca

SEQ ID NO: 669149 - DNA, 13 bp, Homo sapiens
ggactcctggcag

SEQ ID NO: 669150 - DNA, 14 bp, Homo sapiens
ggactcctggcagg

SEQ ID NO: 669151 - DNA, 20 bp, Homo sapiens
ggactcctggcagggccacc

SEQ ID NO: 669152 - DNA, 13 bp, Homo sapiens
ggactctaaagtc

SEQ ID NO: 669153 - DNA, 15 bp, Homo sapiens
ggactgtaagggatt

SEQ ID NO: 669154 - DNA, 17 bp, Homo sapiens
ggacttctacctgccct

SEQ ID NO: 669155 - DNA, 23 bp, Homo sapiens
ggagaaatgcaataactctggga

SEQ ID NO: 669156 - DNA, 21 bp, Homo sapiens
ggagaccctgcaaacagaaca

SEQ ID NO: 669157 - DNA, 23 bp, Homo sapiens
ggagaccctgcaaacagaacagg

SEQ ID NO: 669158 - DNA, 12 bp, Homo sapiens
ggagagacagct

SEQ ID NO: 669159 - DNA, 14 bp, Homo sapiens
ggagaggcgagagg

SEQ ID NO: 669160 - DNA, 20 bp, Homo sapiens
ggagagggacatagaatctg

SEQ ID NO: 669161 - DNA, 21 bp, Homo sapiens
ggagaggttacccgagaagca

SEQ ID NO: 669162 - DNA, 22 bp, Homo sapiens
ggagatacagtggagacatctg

SEQ ID NO: 669163 - DNA, 16 bp, Homo sapiens
ggagcagaactgaacc

SEQ ID NO: 669164 - DNA, 22 bp, Homo sapiens
ggagcagcacgattttgcacaa

SEQ ID NO: 669165 - DNA, 13 bp, Homo sapiens
ggagcagggaagg

SEQ ID NO: 669166 - DNA, 21 bp, Homo sapiens
ggagcagggaaggcctgactt

SEQ ID NO: 669167 - DNA, 12 bp, Homo sapiens
ggagcctggggt

SEQ ID NO: 669168 - DNA, 18 bp, Homo sapiens
ggtcccatcagtgaaaga

SEQ ID NO: 669169 - DNA, 21 bp, Homo sapiens
ggtccccactgctgagctggc

SEQ ID NO: 669170 - DNA, 22 bp, Homo sapiens
ggtccccactgctgagctggcc

SEQ ID NO: 669171 - DNA, 15 bp, Homo sapiens
ggtccttatttattt

SEQ ID NO: 669172 - DNA, 18 bp, Homo sapiens
ggtcgcttgggaatttta

SEQ ID NO: 669173 - DNA, 21 bp, Homo sapiens
ggtctcaggatatccttatca

SEQ ID NO: 669174 - DNA, 15 bp, Homo sapiens
ggtctccccaattct

SEQ ID NO: 669175 - DNA, 20 bp, Homo sapiens
ggtctccccaattctcccct

SEQ ID NO: 669176 - DNA, 15 bp, Homo sapiens
ggtctcccctcctgc

SEQ ID NO: 669177 - DNA, 17 bp, Homo sapiens
ggtctcccctcctgcac

SEQ ID NO: 669178 - DNA, 21 bp, Homo sapiens
ggtctcccctcctgcacacag

SEQ ID NO: 669179 - DNA, 12 bp, Homo sapiens
ggtctccctggc

SEQ ID NO: 669180 - DNA, 13 bp, Homo sapiens
ggtctccctggct

SEQ ID NO: 669181 - DNA, 24 bp, Homo sapiens
ggtctccctggctccctcctccag

SEQ ID NO: 669182 - DNA, 23 bp, Homo sapiens
ggtctcctgactggtgctgcagc

SEQ ID NO: 669183 - DNA, 13 bp, Homo sapiens
ggtctccttcctt

SEQ ID NO: 669184 - DNA, 23 bp, Homo sapiens
ggtctccttccttcccagaatgt

SEQ ID NO: 669185 - DNA, 16 bp, Homo sapiens
ggtctctccctcaggt

SEQ ID NO: 669186 - DNA, 16 bp, Homo sapiens
ggtctgccttctgctg

SEQ ID NO: 669187 - DNA, 22 bp, Homo sapiens
ggtctgtgtgtgtgtgtgtgcg

SEQ ID NO: 669188 - DNA, 16 bp, Homo sapiens
ggtcttctactgcctt

SEQ ID NO: 669189 - DNA, 20 bp, Homo sapiens
ggtcttctactgccttgaaa

SEQ ID NO: 669190 - DNA, 21 bp, Homo sapiens
ggtgacagtcatcatcagggc

SEQ ID NO: 669191 - DNA, 22 bp, Homo sapiens
ggtgacagtcatcatcagggcc

SEQ ID NO: 669192 - DNA, 23 bp, Homo sapiens
ggtgacagtcatcatcagggcct

SEQ ID NO: 669193 - DNA, 12 bp, Homo sapiens
ggtgacggccct

SEQ ID NO: 669194 - DNA, 19 bp, Homo sapiens
ggtgacggccctcatctat

SEQ ID NO: 669195 - DNA, 14 bp, Homo sapiens
ggtgacttcctctg

SEQ ID NO: 669196 - DNA, 15 bp, Homo sapiens
ggtgcagacagaagt

SEQ ID NO: 669197 - DNA, 23 bp, Homo sapiens
ggtgcagacagaagtctcctcaa

SEQ ID NO: 669198 - DNA, 19 bp, Homo sapiens
ggtgcagaggtaccctggg

SEQ ID NO: 669199 - DNA, 21 bp, Homo sapiens
ggtgcctgttatatatttact

SEQ ID NO: 669200 - DNA, 16 bp, Homo sapiens
ggtgcctttgagttct

SEQ ID NO: 669201 - DNA, 23 bp, Homo sapiens
ggtgctcagaataaggcaggcat

SEQ ID NO: 669202 - DNA, 21 bp, Homo sapiens
ggtgctgcagcaccgaggggc

SEQ ID NO: 669203 - DNA, 16 bp, Homo sapiens
ggtgctgcctgaatcc

SEQ ID NO: 669204 - DNA, 20 bp, Homo sapiens
ggtgcttttattgtaaagtc

SEQ ID NO: 669205 - DNA, 20 bp, Homo sapiens
ggtgggcagatcacttgagc

SEQ ID NO: 669206 - DNA, 13 bp, Homo sapiens
ggtggtcttgtgg

SEQ ID NO: 669207 - DNA, 17 bp, Homo sapiens
ggtgtagccctcccact

SEQ ID NO: 669208 - DNA, 20 bp, Homo sapiens
ggtgtagccctcccactttg

SEQ ID NO: 669209 - DNA, 20 bp, Homo sapiens
ggtgtatcctggccctgggg

SEQ ID NO: 669210 - DNA, 13 bp, Homo sapiens
ggtgtcctgagca

SEQ ID NO: 669211 - DNA, 15 bp, Homo sapiens
ggtgtctccttaagc

SEQ ID NO: 669212 - DNA, 13 bp, Homo sapiens
ggtgtgaatgcac

SEQ ID NO: 669213 - DNA, 15 bp, Homo sapiens
ggtgtgccctgtgtg

SEQ ID NO: 669214 - DNA, 15 bp, Homo sapiens
ggtgtgtccacagag

SEQ ID NO: 669215 - DNA, 22 bp, Homo sapiens
ggttaaaactgtacatttaaaa

SEQ ID NO: 669216 - DNA, 12 bp, Homo sapiens
ggttaagtgttt

SEQ ID NO: 669217 - DNA, 23 bp, Homo sapiens
ggttattttgatgtaaagatgtt

SEQ ID NO: 669218 - DNA, 19 bp, Homo sapiens
ggttcagacacagctcttc

SEQ ID NO: 669219 - DNA, 13 bp, Homo sapiens
ggttcttgaaaat

SEQ ID NO: 669220 - DNA, 17 bp, Homo sapiens
ggttgtgtgtgttctgt

SEQ ID NO: 669221 - DNA, 20 bp, Homo sapiens
ggtttccctttatttctctt

SEQ ID NO: 669222 - DNA, 14 bp, Homo sapiens
ggtttctaagcagt

SEQ ID NO: 669223 - DNA, 13 bp, Homo sapiens
ggtttctctccct

SEQ ID NO: 669224 - DNA, 18 bp, Homo sapiens
ggtttgtggcgtctccct

SEQ ID NO: 669225 - DNA, 12 bp, Homo sapiens
ggtttttgctct

SEQ ID NO: 669226 - DNA, 15 bp, Homo sapiens
gtaaaacttctgctc

SEQ ID NO: 669227 - DNA, 16 bp, Homo sapiens
gtaaaacttctgctcg

SEQ ID NO: 669228 - DNA, 17 bp, Homo sapiens
gtaaaatgaattgaaaa

SEQ ID NO: 669229 - DNA, 14 bp, Homo sapiens
gtaaacttgtacat

SEQ ID NO: 669230 - DNA, 16 bp, Homo sapiens
gtaaataaactattta

SEQ ID NO: 669231 - DNA, 21 bp, Homo sapiens
gtaaataaactatttatatca

SEQ ID NO: 669232 - DNA, 21 bp, Homo sapiens
gtaaataggaatcattcagaa

SEQ ID NO: 669233 - DNA, 11 bp, Homo sapiens
gtaaatatata

SEQ ID NO: 669234 - DNA, 15 bp, Homo sapiens
gtaaatcagaaagta

SEQ ID NO: 669235 - DNA, 18 bp, Homo sapiens
gtaaatcagaaagtaaca

SEQ ID NO: 669236 - DNA, 16 bp, Homo sapiens
gtaaatggtatgtcat

SEQ ID NO: 669237 - DNA, 20 bp, Homo sapiens
gtaactaaaataattttgta

SEQ ID NO: 669238 - DNA, 14 bp, Homo sapiens
gtaacttaaaatag

SEQ ID NO: 669239 - DNA, 16 bp, Homo sapiens
gtaagaagacaaactg

SEQ ID NO: 669240 - DNA, 22 bp, Homo sapiens
gtaagatatctcaatgaaccat

SEQ ID NO: 669241 - DNA, 20 bp, Homo sapiens
gtaataagcactgtaaactt

SEQ ID NO: 669242 - DNA, 16 bp, Homo sapiens
gtaataataaagaata

SEQ ID NO: 669243 - DNA, 19 bp, Homo sapiens
gtaatacgtagctctctta

SEQ ID NO: 669244 - DNA, 14 bp, Homo sapiens
gtaatataatgtat

SEQ ID NO: 669245 - DNA, 14 bp, Homo sapiens
gtaatcacttttca

SEQ ID NO: 669246 - DNA, 17 bp, Homo sapiens
gtaatctacaccaatga

SEQ ID NO: 669247 - DNA, 22 bp, Homo sapiens
gtaatgcagtttttaaaaacct

SEQ ID NO: 669248 - DNA, 23 bp, Homo sapiens
gtaatgggtacaatgaagaagtt

SEQ ID NO: 669249 - DNA, 19 bp, Homo sapiens
gtaatgtatcaaatacatt

SEQ ID NO: 669250 - DNA, 20 bp, Homo sapiens
gtaatgtgtggtggcctcag

SEQ ID NO: 669251 - DNA, 20 bp, Homo sapiens
gtaatgttaatgttatatca

SEQ ID NO: 669252 - DNA, 10 bp, Homo sapiens
gtaatttaaa

SEQ ID NO: 669253 - DNA, 17 bp, Homo sapiens
gtaatttaatttgtaaa

SEQ ID NO: 669254 - DNA, 12 bp, Homo sapiens
gtaatttcaaaa

SEQ ID NO: 669255 - DNA, 14 bp, Homo sapiens
gtaatttcatttaa

SEQ ID NO: 669256 - DNA, 22 bp, Homo sapiens
gtaatttcctgagctaaatgct

SEQ ID NO: 669257 - DNA, 23 bp, Homo sapiens
gtaatttttgctccaatatccat

SEQ ID NO: 669258 - DNA, 12 bp, Homo sapiens
gtacaaaattaa

SEQ ID NO: 669259 - DNA, 16 bp, Homo sapiens
gtacaaacagtatttc

SEQ ID NO: 669260 - DNA, 16 bp, Homo sapiens
gtacaaatacatgtgt

SEQ ID NO: 669261 - DNA, 15 bp, Homo sapiens
gtacaactgtattta

SEQ ID NO: 669262 - DNA, 23 bp, Homo sapiens
gtacaataagcgttaagggcaga

SEQ ID NO: 669263 - DNA, 15 bp, Homo sapiens
gtacagcatgtgcct

SEQ ID NO: 669264 - DNA, 20 bp, Homo sapiens
gtacataactcctgtccctt

SEQ ID NO: 669265 - DNA, 17 bp, Homo sapiens
gtacatacgatttaagg

SEQ ID NO: 669266 - DNA, 14 bp, Homo sapiens
gtacatttctataa

SEQ ID NO: 669267 - DNA, 16 bp, Homo sapiens
gtacctcctctcagtg

SEQ ID NO: 669268 - DNA, 19 bp, Homo sapiens
gtacctcctctcagtgttt

SEQ ID NO: 669269 - DNA, 12 bp, Homo sapiens
gtacctgtgtgt

SEQ ID NO: 669270 - DNA, 12 bp, Homo sapiens
gtacgtcccaca

SEQ ID NO: 669271 - DNA, 14 bp, Homo sapiens
gtactctttaacat

SEQ ID NO: 669272 - DNA, 21 bp, Homo sapiens
gtactgccccccatgaggaag

SEQ ID NO: 669273 - DNA, 22 bp, Homo sapiens
gtactgccccccatgaggaagg

SEQ ID NO: 669274 - DNA, 16 bp, Homo sapiens
gtagaaaatttgcttt

SEQ ID NO: 669275 - DNA, 19 bp, Homo sapiens
gtagaaggttgacacagtt

SEQ ID NO: 669276 - DNA, 14 bp, Homo sapiens
gtagaggcttgttt

SEQ ID NO: 669277 - DNA, 22 bp, Homo sapiens
gtagagtcttacaatcaaatct

SEQ ID NO: 669278 - DNA, 13 bp, Homo sapiens
gtagcataactgt

SEQ ID NO: 669279 - DNA, 14 bp, Homo sapiens
gtagcataactgta

SEQ ID NO: 669280 - DNA, 17 bp, Homo sapiens
gtagcccatccttccct

SEQ ID NO: 669281 - DNA, 22 bp, Homo sapiens
gtagcctcaatcgagtgagaca

SEQ ID NO: 669282 - DNA, 15 bp, Homo sapiens
gtagctcaagtttaa

SEQ ID NO: 669283 - DNA, 14 bp, Homo sapiens
gtagctctgctgct

SEQ ID NO: 669284 - DNA, 18 bp, Homo sapiens
gtagctgggatgacaggc

SEQ ID NO: 669285 - DNA, 22 bp, Homo sapiens
gtagtatgataggttattttga

SEQ ID NO: 669286 - DNA, 14 bp, Homo sapiens
gtagtcaataaaac

SEQ ID NO: 669287 - DNA, 23 bp, Homo sapiens
gtagtcccagctacttgggaggc

SEQ ID NO: 669288 - DNA, 23 bp, Homo sapiens
gtgtagccaggtatggctctgca

SEQ ID NO: 669289 - DNA, 15 bp, Homo sapiens
gtgtatattcctttt

SEQ ID NO: 669290 - DNA, 12 bp, Homo sapiens
gtgtatcctggc

SEQ ID NO: 669291 - DNA, 20 bp, Homo sapiens
gtgtatcctggccctggggg

SEQ ID NO: 669292 - DNA, 18 bp, Homo sapiens
gtgtatttaaaaaaaaga

SEQ ID NO: 669293 - DNA, 23 bp, Homo sapiens
gtgtatttaaaaaaaagaaactt

SEQ ID NO: 669294 - DNA, 12 bp, Homo sapiens
gtgtatttattt

SEQ ID NO: 669295 - DNA, 14 bp, Homo sapiens
gtgtatttcattta

SEQ ID NO: 669296 - DNA, 19 bp, Homo sapiens
gtgtatttcttatacgctt

SEQ ID NO: 669297 - DNA, 16 bp, Homo sapiens
gtgtccacctgtgggt

SEQ ID NO: 669298 - DNA, 13 bp, Homo sapiens
gtgtcccaggcag

SEQ ID NO: 669299 - DNA, 19 bp, Homo sapiens
gtgtccccgctgctgtgca

SEQ ID NO: 669300 - DNA, 20 bp, Homo sapiens
gtgtcctcctggggttcttt

SEQ ID NO: 669301 - DNA, 17 bp, Homo sapiens
gtgtcctggtgagaaaa

SEQ ID NO: 669302 - DNA, 22 bp, Homo sapiens
gtgtctccttaagctgcagaga

SEQ ID NO: 669303 - DNA, 19 bp, Homo sapiens
gtgtcttaggctgatgcca

SEQ ID NO: 669304 - DNA, 21 bp, Homo sapiens
gtgtgaatgtgggcactggcc

SEQ ID NO: 669305 - DNA, 13 bp, Homo sapiens
gtgtgacagggcc

SEQ ID NO: 669306 - DNA, 18 bp, Homo sapiens
gtgtgacagggccagtgg

SEQ ID NO: 669307 - DNA, 18 bp, Homo sapiens
gtgtgacagtttccaaat

SEQ ID NO: 669308 - DNA, 14 bp, Homo sapiens
gtgtgagtgtgaca

SEQ ID NO: 669309 - DNA, 15 bp, Homo sapiens
gtgtgagtgtgacag

SEQ ID NO: 669310 - DNA, 19 bp, Homo sapiens
gtgtgagtgtgacagggcc

SEQ ID NO: 669311 - DNA, 16 bp, Homo sapiens
gtgtgcctggttaata

SEQ ID NO: 669312 - DNA, 19 bp, Homo sapiens
gtgtggattgcctctgaaa

SEQ ID NO: 669313 - DNA, 23 bp, Homo sapiens
gtgtggattgcctctgaaaagtg

SEQ ID NO: 669314 - DNA, 12 bp, Homo sapiens
gtgtggtggcct

SEQ ID NO: 669315 - DNA, 23 bp, Homo sapiens
gtgtggtggcctcagctgaatgc

SEQ ID NO: 669316 - DNA, 14 bp, Homo sapiens
gtgtgtgtgtgtgt

SEQ ID NO: 669317 - DNA, 20 bp, Homo sapiens
gtgtgttcgttgcacagctg

SEQ ID NO: 669318 - DNA, 11 bp, Homo sapiens
gtgttaaacac

SEQ ID NO: 669319 - DNA, 20 bp, Homo sapiens
gtgttaaacactacacattt

SEQ ID NO: 669320 - DNA, 22 bp, Homo sapiens
gtgttaaacactacacatttga

SEQ ID NO: 669321 - DNA, 23 bp, Homo sapiens
gtgttactagcctcaaaatacat

SEQ ID NO: 669322 - DNA, 21 bp, Homo sapiens
gtgttagtggcaccgcctccc

SEQ ID NO: 669323 - DNA, 20 bp, Homo sapiens
gtgttccagtgtctgtctga

SEQ ID NO: 669324 - DNA, 20 bp, Homo sapiens
gtgttcgttgcacagctgtt

SEQ ID NO: 669325 - DNA, 21 bp, Homo sapiens
gtgttcgttgcacagctgttt

SEQ ID NO: 669326 - DNA, 15 bp, Homo sapiens
gtgttcttactgaca

SEQ ID NO: 669327 - DNA, 16 bp, Homo sapiens
gtgttggcaaacgaga

SEQ ID NO: 669328 - DNA, 17 bp, Homo sapiens
gtgttgttgctctagga

SEQ ID NO: 669329 - DNA, 19 bp, Homo sapiens
gtgtttattataaagctta

SEQ ID NO: 669330 - DNA, 14 bp, Homo sapiens
gtgtttttgggaag

SEQ ID NO: 669331 - DNA, 23 bp, Homo sapiens
gttaaatgtaatataatgtattt

SEQ ID NO: 669332 - DNA, 16 bp, Homo sapiens
gttaacatcaagccat

SEQ ID NO: 669333 - DNA, 12 bp, Homo sapiens
gttaagggcaga

SEQ ID NO: 669334 - DNA, 14 bp, Homo sapiens
gttaagggcagagt

SEQ ID NO: 669335 - DNA, 14 bp, Homo sapiens
gttaatacaaggta

SEQ ID NO: 669336 - DNA, 17 bp, Homo sapiens
gttaatgatggcagagg

SEQ ID NO: 669337 - DNA, 22 bp, Homo sapiens
gttacaggcaccgagaatgttg

SEQ ID NO: 669338 - DNA, 19 bp, Homo sapiens
gttacataaggatgacttt

SEQ ID NO: 669339 - DNA, 22 bp, Homo sapiens
gttaccaatgtaacactggcca

SEQ ID NO: 669340 - DNA, 20 bp, Homo sapiens
gttacccaggctggagtgca

SEQ ID NO: 669341 - DNA, 14 bp, Homo sapiens
gttactgggccctg

SEQ ID NO: 669342 - DNA, 21 bp, Homo sapiens
gttagatctttgtaaatgcat

SEQ ID NO: 669343 - DNA, 21 bp, Homo sapiens
gttagctttccaaggaagcag

SEQ ID NO: 669344 - DNA, 19 bp, Homo sapiens
gttagtaatggcagagcag

SEQ ID NO: 669345 - DNA, 20 bp, Homo sapiens
gttatcaaactgctgtcgtt

SEQ ID NO: 669346 - DNA, 12 bp, Homo sapiens
gttatgtattta

SEQ ID NO: 669347 - DNA, 15 bp, Homo sapiens
gttatgtatttaaag

SEQ ID NO: 669348 - DNA, 20 bp, Homo sapiens
gttatttatacaagattgaa

SEQ ID NO: 669349 - DNA, 15 bp, Homo sapiens
gttatttcttccctg

SEQ ID NO: 669350 - DNA, 21 bp, Homo sapiens
gttcaaaacttattggaatgt

SEQ ID NO: 669351 - DNA, 15 bp, Homo sapiens
gttcaacttatttca

SEQ ID NO: 669352 - DNA, 17 bp, Homo sapiens
gttcaacttatttcata

SEQ ID NO: 669353 - DNA, 16 bp, Homo sapiens
gttcaattatctttat

SEQ ID NO: 669354 - DNA, 16 bp, Homo sapiens
gttcagacaagacaga

SEQ ID NO: 669355 - DNA, 22 bp, Homo sapiens
gttcagacaagacagaggggag

SEQ ID NO: 669356 - DNA, 21 bp, Homo sapiens
gttcagctctttccaaattaa

SEQ ID NO: 669357 - DNA, 14 bp, Homo sapiens
gttccactgagacc

SEQ ID NO: 669358 - DNA, 22 bp, Homo sapiens
gttccactgcaaataaagcctt

SEQ ID NO: 669359 - DNA, 18 bp, Homo sapiens
gttccagccttctctcaa

SEQ ID NO: 669360 - DNA, 20 bp, Homo sapiens
gttccagccttctctcaagg

SEQ ID NO: 669361 - DNA, 21 bp, Homo sapiens
gttcccagatggctggaaggg

SEQ ID NO: 669362 - DNA, 14 bp, Homo sapiens
gttccctgctgcgc

SEQ ID NO: 669363 - DNA, 19 bp, Homo sapiens
gttccctgctgcgctgctt

SEQ ID NO: 669364 - DNA, 22 bp, Homo sapiens
gttcccttgaaactttgggaaa

SEQ ID NO: 669365 - DNA, 22 bp, Homo sapiens
gttcctgcgcatatagactgta

SEQ ID NO: 669366 - DNA, 15 bp, Homo sapiens
gttccttatccctct

SEQ ID NO: 669367 - DNA, 18 bp, Homo sapiens
gttctagcagtccccagc

SEQ ID NO: 669368 - DNA, 22 bp, Homo sapiens
gttctattaatcacctctctgt

SEQ ID NO: 669369 - DNA, 16 bp, Homo sapiens
gttctcctgaatattt

SEQ ID NO: 669370 - DNA, 13 bp, Homo sapiens
gttctgaaatgtt

SEQ ID NO: 669371 - DNA, 17 bp, Homo sapiens
gttctgaaatgttctta

SEQ ID NO: 669372 - DNA, 19 bp, Homo sapiens
gttctgcctctccctgggt

SEQ ID NO: 669373 - DNA, 20 bp, Homo sapiens
gttctgcctctccctgggtc

SEQ ID NO: 669374 - DNA, 14 bp, Homo sapiens
gttctgctccatac

SEQ ID NO: 669375 - DNA, 19 bp, Homo sapiens
gttctggggggacccagtg

SEQ ID NO: 669376 - DNA, 20 bp, Homo sapiens
gttctggggggacccagtgc

SEQ ID NO: 669377 - DNA, 20 bp, Homo sapiens
gttcttaaatgtttatactg

SEQ ID NO: 669378 - DNA, 21 bp, Homo sapiens
gttcttaaatgtttatactgt

SEQ ID NO: 669379 - DNA, 20 bp, Homo sapiens
gttctttcatttgctttgga

SEQ ID NO: 669380 - DNA, 14 bp, Homo sapiens
gttgattaaagatg

SEQ ID NO: 669381 - DNA, 19 bp, Homo sapiens
gttgattcaacaaagtatt

SEQ ID NO: 669382 - DNA, 19 bp, Homo sapiens
gttgcacagctgtttgaaa

SEQ ID NO: 669383 - DNA, 20 bp, Homo sapiens
gttgcacagctgtttgaaat

SEQ ID NO: 669384 - DNA, 16 bp, Homo sapiens
gttgcatatagttaaa

SEQ ID NO: 669385 - DNA, 15 bp, Homo sapiens
gttgccaacagttgt

SEQ ID NO: 669386 - DNA, 15 bp, Homo sapiens
gttgcgtctgaggcc

SEQ ID NO: 669387 - DNA, 14 bp, Homo sapiens
gttgctctttcacc

SEQ ID NO: 669388 - DNA, 22 bp, Homo sapiens
gttggaggtgattccagtgaag

SEQ ID NO: 669389 - DNA, 11 bp, Homo sapiens
gttggcacaga

SEQ ID NO: 669390 - DNA, 23 bp, Homo sapiens
gttgggaatgaggaaaattctta

SEQ ID NO: 669391 - DNA, 19 bp, Homo sapiens
gttggggtgacagtcatca

SEQ ID NO: 669392 - DNA, 16 bp, Homo sapiens
gttggtctgccttctg

SEQ ID NO: 669393 - DNA, 16 bp, Homo sapiens
gttgtaccaagtgaaa

SEQ ID NO: 669394 - DNA, 23 bp, Homo sapiens
gttgtatatcactaaaagcatga

SEQ ID NO: 669395 - DNA, 21 bp, Homo sapiens
gttgtattgcatgcaatttga

SEQ ID NO: 669396 - DNA, 16 bp, Homo sapiens
gttgtcttatgtgaaa

SEQ ID NO: 669397 - DNA, 23 bp, Homo sapiens
gttgtcttatgtgaaaaattaac

SEQ ID NO: 669398 - DNA, 16 bp, Homo sapiens
gttgtgcccctttcca

SEQ ID NO: 669399 - DNA, 13 bp, Homo sapiens
gttgtgtgtgttc

SEQ ID NO: 669400 - DNA, 16 bp, Homo sapiens
gttgtgtgtgttctgt

SEQ ID NO: 669401 - DNA, 14 bp, Homo sapiens
gttgttgtggaagc

SEQ ID NO: 669402 - DNA, 12 bp, Homo sapiens
gttgttttccat

SEQ ID NO: 669403 - DNA, 12 bp, Homo sapiens
gtttaaatgtat

SEQ ID NO: 669404 - DNA, 18 bp, Homo sapiens
gtttaaccttaaaattaa

SEQ ID NO: 669405 - DNA, 21 bp, Homo sapiens
gtttaactttaaggatttgaa

SEQ ID NO: 669406 - DNA, 19 bp, Homo sapiens
gtttaataaagctttataa

SEQ ID NO: 669407 - DNA, 18 bp, Homo sapiens
tacctcaatttttgtttt

SEQ ID NO: 669408 - DNA, 12 bp, Homo sapiens
tacctccctccc

SEQ ID NO: 669409 - DNA, 13 bp, Homo sapiens
tacctcgcagtgt

SEQ ID NO: 669410 - DNA, 15 bp, Homo sapiens
tacctctctgtccct

SEQ ID NO: 669411 - DNA, 18 bp, Homo sapiens
tacctctctgtcccttgc

SEQ ID NO: 669412 - DNA, 16 bp, Homo sapiens
tacctcttcacctgac

SEQ ID NO: 669413 - DNA, 15 bp, Homo sapiens
tacctgctggaagaa

SEQ ID NO: 669414 - DNA, 21 bp, Homo sapiens
tacctgctggaagaattctag

SEQ ID NO: 669415 - DNA, 14 bp, Homo sapiens
taccttatcttaca

SEQ ID NO: 669416 - DNA, 16 bp, Homo sapiens
taccttatttattttt

SEQ ID NO: 669417 - DNA, 15 bp, Homo sapiens
tacctttcaaagctt

SEQ ID NO: 669418 - DNA, 17 bp, Homo sapiens
taccttttctcttttct

SEQ ID NO: 669419 - DNA, 20 bp, Homo sapiens
taccttttttttttcttggt

SEQ ID NO: 669420 - DNA, 20 bp, Homo sapiens
tacgatttaaggtatttaaa

SEQ ID NO: 669421 - DNA, 12 bp, Homo sapiens
tacgcttttctt

SEQ ID NO: 669422 - DNA, 17 bp, Homo sapiens
tacgcttttctttgtta

SEQ ID NO: 669423 - DNA, 14 bp, Homo sapiens
tacgtagctctctt

SEQ ID NO: 669424 - DNA, 23 bp, Homo sapiens
tacgttaggaggacaaaaggaat

SEQ ID NO: 669425 - DNA, 19 bp, Homo sapiens
tactaaacagtaagatatc

SEQ ID NO: 669426 - DNA, 13 bp, Homo sapiens
tactaataaatat

SEQ ID NO: 669427 - DNA, 15 bp, Homo sapiens
tactaataaatataa

SEQ ID NO: 669428 - DNA, 17 bp, Homo sapiens
tactaattttacacatt

SEQ ID NO: 669429 - DNA, 20 bp, Homo sapiens
tactactgaaacagatttca

SEQ ID NO: 669430 - DNA, 21 bp, Homo sapiens
tactactgaaacagatttcat

SEQ ID NO: 669431 - DNA, 21 bp, Homo sapiens
tactatcatactactgaaaca

SEQ ID NO: 669432 - DNA, 17 bp, Homo sapiens
tactatttaagatgtga

SEQ ID NO: 669433 - DNA, 21 bp, Homo sapiens
tactccagccagggcaagaga

SEQ ID NO: 669434 - DNA, 18 bp, Homo sapiens
tactcccccaccactcag

SEQ ID NO: 669435 - DNA, 21 bp, Homo sapiens
tactcccccaccactcaggcc

SEQ ID NO: 669436 - DNA, 21 bp, Homo sapiens
tactcctagaagaaccaaata

SEQ ID NO: 669437 - DNA, 21 bp, Homo sapiens
tactctccttgagtgtatgag

SEQ ID NO: 669438 - DNA, 16 bp, Homo sapiens
tactcttggtttttat

SEQ ID NO: 669439 - DNA, 14 bp, Homo sapiens
tactgaaacagatt

SEQ ID NO: 669440 - DNA, 19 bp, Homo sapiens
tactgaataatatcaaata

SEQ ID NO: 669441 - DNA, 15 bp, Homo sapiens
tactgacaacattat

SEQ ID NO: 669442 - DNA, 14 bp, Homo sapiens
tactgacatttctt

SEQ ID NO: 669443 - DNA, 21 bp, Homo sapiens
tactgaggtgctatgaagcca

SEQ ID NO: 669444 - DNA, 13 bp, Homo sapiens
tactgcaaagtgt

SEQ ID NO: 669445 - DNA, 18 bp, Homo sapiens
tactgcactccagcctgg

SEQ ID NO: 669446 - DNA, 19 bp, Homo sapiens
tactgcactccagcctggg

SEQ ID NO: 669447 - DNA, 13 bp, Homo sapiens
tactgccctttca

SEQ ID NO: 669448 - DNA, 21 bp, Homo sapiens
tactgccctttcaaagcactt

SEQ ID NO: 669449 - DNA, 14 bp, Homo sapiens
tactgccttgaaaa

SEQ ID NO: 669450 - DNA, 20 bp, Homo sapiens
tactgccttgaaaaatgaca

SEQ ID NO: 669451 - DNA, 16 bp, Homo sapiens
tactggaattcttctg

SEQ ID NO: 669452 - DNA, 18 bp, Homo sapiens
tactggaattcttctgca

SEQ ID NO: 669453 - DNA, 23 bp, Homo sapiens
tactggaattcttctgcaacatt

SEQ ID NO: 669454 - DNA, 18 bp, Homo sapiens
tactggcttacctcctca

SEQ ID NO: 669455 - DNA, 12 bp, Homo sapiens
tactgggcctta

SEQ ID NO: 669456 - DNA, 14 bp, Homo sapiens
tactgggtctgcga

SEQ ID NO: 669457 - DNA, 17 bp, Homo sapiens
tactgggtttcaagaaa

SEQ ID NO: 669458 - DNA, 17 bp, Homo sapiens
tactgtatttctaagaa

SEQ ID NO: 669459 - DNA, 20 bp, Homo sapiens
tactgtgaggagtctgggtc

SEQ ID NO: 669460 - DNA, 16 bp, Homo sapiens
tactgttgtaagaatt

SEQ ID NO: 669461 - DNA, 22 bp, Homo sapiens
tactgttgtaagaattctgatt

SEQ ID NO: 669462 - DNA, 23 bp, Homo sapiens
tacttaaatggtaataagcactg

SEQ ID NO: 669463 - DNA, 24 bp, Homo sapiens
tacttaaatggtaataagcactgt

SEQ ID NO: 669464 - DNA, 17 bp, Homo sapiens
tacttattacagtctta

SEQ ID NO: 669465 - DNA, 21 bp, Homo sapiens
tacttattacagtcttattta

SEQ ID NO: 669466 - DNA, 15 bp, Homo sapiens
tacttatttttctga

SEQ ID NO: 669467 - DNA, 17 bp, Homo sapiens
tacttcaaaagtttgtt

SEQ ID NO: 669468 - DNA, 15 bp, Homo sapiens
tacttgaaaaagtaa

SEQ ID NO: 669469 - DNA, 12 bp, Homo sapiens
tacttgggaggc

SEQ ID NO: 669470 - DNA, 18 bp, Homo sapiens
tacttggggacataattt

SEQ ID NO: 669471 - DNA, 15 bp, Homo sapiens
tactttaaaaagaaa

SEQ ID NO: 669472 - DNA, 16 bp, Homo sapiens
tactttaaaaagaaat

SEQ ID NO: 669473 - DNA, 14 bp, Homo sapiens
tactttaacatttt

SEQ ID NO: 669474 - DNA, 13 bp, Homo sapiens
tactttatttctg

SEQ ID NO: 669475 - DNA, 22 bp, Homo sapiens
tactttgaagtgcagctcatgt

SEQ ID NO: 669476 - DNA, 21 bp, Homo sapiens
tactttgtattttgattattt

SEQ ID NO: 669477 - DNA, 15 bp, Homo sapiens
tacttttaaaaacat

SEQ ID NO: 669478 - DNA, 15 bp, Homo sapiens
tagaaaaataaaatg

SEQ ID NO: 669479 - DNA, 19 bp, Homo sapiens
tagaaaagtggtgtaaact

SEQ ID NO: 669480 - DNA, 22 bp, Homo sapiens
tagaaaagtggtgtaaacttgt

SEQ ID NO: 669481 - DNA, 19 bp, Homo sapiens
tagaaaattcttgagaagt

SEQ ID NO: 669482 - DNA, 17 bp, Homo sapiens
tagaaacatgtaatcct

SEQ ID NO: 669483 - DNA, 13 bp, Homo sapiens
tagaaactgaaaa

SEQ ID NO: 669484 - DNA, 14 bp, Homo sapiens
tagaaactgaaaaa

SEQ ID NO: 669485 - DNA, 22 bp, Homo sapiens
tagaaagttctgtgtaaacaga

SEQ ID NO: 669486 - DNA, 19 bp, Homo sapiens
tagaactccaggccctcct

SEQ ID NO: 669487 - DNA, 12 bp, Homo sapiens
tagaagaaaagt

SEQ ID NO: 669488 - DNA, 19 bp, Homo sapiens
tagaaggttgacacagttg

SEQ ID NO: 669489 - DNA, 16 bp, Homo sapiens
tagaagtttggctgct

SEQ ID NO: 669490 - DNA, 14 bp, Homo sapiens
tagaataattcttt

SEQ ID NO: 669491 - DNA, 19 bp, Homo sapiens
tagaatctgtgacctctga

SEQ ID NO: 669492 - DNA, 15 bp, Homo sapiens
tagaatgttgaaaag

SEQ ID NO: 669493 - DNA, 14 bp, Homo sapiens
tagacagcatgaga

SEQ ID NO: 669494 - DNA, 16 bp, Homo sapiens
tagagataggaaactg

SEQ ID NO: 669495 - DNA, 14 bp, Homo sapiens
tagagcaaagccat

SEQ ID NO: 669496 - DNA, 23 bp, Homo sapiens
tagagggacggccaagaatgtac

SEQ ID NO: 669497 - DNA, 21 bp, Homo sapiens
tagataaattgtagggcttta

SEQ ID NO: 669498 - DNA, 22 bp, Homo sapiens
tagatatgtattcttttctcag

SEQ ID NO: 669499 - DNA, 18 bp, Homo sapiens
tagatccatttccattgc

SEQ ID NO: 669500 - DNA, 12 bp, Homo sapiens
tagatctccagc

SEQ ID NO: 669501 - DNA, 17 bp, Homo sapiens
tagatgttgctctttca

SEQ ID NO: 669502 - DNA, 22 bp, Homo sapiens
tagattgactaactcaaataca

SEQ ID NO: 669503 - DNA, 16 bp, Homo sapiens
tagattttattttact

SEQ ID NO: 669504 - DNA, 17 bp, Homo sapiens
tagattttattttacta

SEQ ID NO: 669505 - DNA, 13 bp, Homo sapiens
tagcaagcaacta

SEQ ID NO: 669506 - DNA, 15 bp, Homo sapiens
tagcaagcaactaat

SEQ ID NO: 669507 - DNA, 12 bp, Homo sapiens
tagcagatggtt

SEQ ID NO: 669508 - DNA, 16 bp, Homo sapiens
tagcagcccaccctgc

SEQ ID NO: 669509 - DNA, 17 bp, Homo sapiens
tagcagcccaccctgct

SEQ ID NO: 669510 - DNA, 18 bp, Homo sapiens
tagcattctgcaacattt

SEQ ID NO: 669511 - DNA, 16 bp, Homo sapiens
tagcattgataatctt

SEQ ID NO: 669512 - DNA, 19 bp, Homo sapiens
tagcattgataatcttcag

SEQ ID NO: 669513 - DNA, 19 bp, Homo sapiens
tagcattgtaaaagcattt

SEQ ID NO: 669514 - DNA, 17 bp, Homo sapiens
tagccagaggctctaat

SEQ ID NO: 669515 - DNA, 13 bp, Homo sapiens
tagccctcccact

SEQ ID NO: 669516 - DNA, 17 bp, Homo sapiens
tagccctcccactttgc

SEQ ID NO: 669517 - DNA, 18 bp, Homo sapiens
tagcctcaattctccatt

SEQ ID NO: 669518 - DNA, 15 bp, Homo sapiens
tagcgtcaagacatt

SEQ ID NO: 669519 - DNA, 16 bp, Homo sapiens
tagcgtcaagacattt

SEQ ID NO: 669520 - DNA, 17 bp, Homo sapiens
tagcgtcaagacatttg

SEQ ID NO: 669521 - DNA, 19 bp, Homo sapiens
tagctaataacatgtgaaa

SEQ ID NO: 669522 - DNA, 18 bp, Homo sapiens
tagctacattttcagaag

SEQ ID NO: 669523 - DNA, 17 bp, Homo sapiens
tagctcaagaattgtta

SEQ ID NO: 669524 - DNA, 15 bp, Homo sapiens
tagctcaagtttaaa

SEQ ID NO: 669525 - DNA, 20 bp, Homo sapiens
tagctcaagtttaaaagcca

SEQ ID NO: 669526 - DNA, 21 bp, Homo sapiens
tagctcaagtttaaaagccat

SEQ ID NO: 669527 - DNA, 16 bp, Homo sapiens
tattgatttttaagaa

SEQ ID NO: 669528 - DNA, 17 bp, Homo sapiens
tattgcatgcaatttga

SEQ ID NO: 669529 - DNA, 13 bp, Homo sapiens
tattggcaaagtt

SEQ ID NO: 669530 - DNA, 15 bp, Homo sapiens
tattgtttggtaaat

SEQ ID NO: 669531 - DNA, 20 bp, Homo sapiens
tatttaaaaaaaagaaactt

SEQ ID NO: 669532 - DNA, 22 bp, Homo sapiens
tatttaaaaaaaagaaactttt

SEQ ID NO: 669533 - DNA, 15 bp, Homo sapiens
tatttaaactatctt

SEQ ID NO: 669534 - DNA, 13 bp, Homo sapiens
tatttaaagttgt

SEQ ID NO: 669535 - DNA, 14 bp, Homo sapiens
tatttaatatcaaa

SEQ ID NO: 669536 - DNA, 13 bp, Homo sapiens
tatttactaacta

SEQ ID NO: 669537 - DNA, 17 bp, Homo sapiens
tatttaggcagattgaa

SEQ ID NO: 669538 - DNA, 19 bp, Homo sapiens
tatttatacaagattgaaa

SEQ ID NO: 669539 - DNA, 20 bp, Homo sapiens
tatttatacaagattgaaaa

SEQ ID NO: 669540 - DNA, 14 bp, Homo sapiens
tatttatttgaggt

SEQ ID NO: 669541 - DNA, 22 bp, Homo sapiens
tatttcaataaatctttcaaaa

SEQ ID NO: 669542 - DNA, 16 bp, Homo sapiens
tatttcataattgcct

SEQ ID NO: 669543 - DNA, 19 bp, Homo sapiens
tatttcgtgtactgcaaag

SEQ ID NO: 669544 - DNA, 17 bp, Homo sapiens
tatttctagtccaaaat

SEQ ID NO: 669545 - DNA, 23 bp, Homo sapiens
tatttctcatctgcactatgttt

SEQ ID NO: 669546 - DNA, 13 bp, Homo sapiens
tatttctgatcta

SEQ ID NO: 669547 - DNA, 20 bp, Homo sapiens
tatttcttaacctttgctat

SEQ ID NO: 669548 - DNA, 23 bp, Homo sapiens
tatttcttaacctttgctatgta

SEQ ID NO: 669549 - DNA, 12 bp, Homo sapiens
tatttcttccct

SEQ ID NO: 669550 - DNA, 14 bp, Homo sapiens
tatttcttgctttc

SEQ ID NO: 669551 - DNA, 15 bp, Homo sapiens
tatttctttttatag

SEQ ID NO: 669552 - DNA, 14 bp, Homo sapiens
tatttgaaatagta

SEQ ID NO: 669553 - DNA, 22 bp, Homo sapiens
tatttgaaatagtatacattgt

SEQ ID NO: 669554 - DNA, 18 bp, Homo sapiens
tatttgaggtcagtgttt

SEQ ID NO: 669555 - DNA, 18 bp, Homo sapiens
tatttgatttctaattgt

SEQ ID NO: 669556 - DNA, 19 bp, Homo sapiens
tatttgctaatgtataatg

SEQ ID NO: 669557 - DNA, 14 bp, Homo sapiens
tatttgtaaagcta

SEQ ID NO: 669558 - DNA, 19 bp, Homo sapiens
tatttgttatatataataa

SEQ ID NO: 669559 - DNA, 20 bp, Homo sapiens
tatttgttatatataataaa

SEQ ID NO: 669560 - DNA, 22 bp, Homo sapiens
tatttgttatatataataaata

SEQ ID NO: 669561 - DNA, 21 bp, Homo sapiens
tatttgtttttattgtaaaac

SEQ ID NO: 669562 - DNA, 13 bp, Homo sapiens
tattttaaaatat

SEQ ID NO: 669563 - DNA, 12 bp, Homo sapiens
tattttcttcat

SEQ ID NO: 669564 - DNA, 13 bp, Homo sapiens
tattttcttttta

SEQ ID NO: 669565 - DNA, 17 bp, Homo sapiens
tattttgtgctcattta

SEQ ID NO: 669566 - DNA, 15 bp, Homo sapiens
tatttttaaaaagaa

SEQ ID NO: 669567 - DNA, 19 bp, Homo sapiens
tatttttaaaaagaaatct

SEQ ID NO: 669568 - DNA, 16 bp, Homo sapiens
tatttttcataaacaa

SEQ ID NO: 669569 - DNA, 18 bp, Homo sapiens
tatttttcataaacaagt

SEQ ID NO: 669570 - DNA, 17 bp, Homo sapiens
tatttttgcacaacttt

SEQ ID NO: 669571 - DNA, 18 bp, Homo sapiens
tatttttgtatttctcta

SEQ ID NO: 669572 - DNA, 11 bp, Homo sapiens
tattttttcaa

SEQ ID NO: 669573 - DNA, 14 bp, Homo sapiens
tattttttggtgtg

SEQ ID NO: 669574 - DNA, 15 bp, Homo sapiens
tatttttttaaaatt

SEQ ID NO: 669575 - DNA, 16 bp, Homo sapiens
tatttttttaatttaa

SEQ ID NO: 669576 - DNA, 16 bp, Homo sapiens
tattttttttttcttc

SEQ ID NO: 669577 - DNA, 19 bp, Homo sapiens
tattttttttttcttcttg

SEQ ID NO: 669578 - DNA, 15 bp, Homo sapiens
tcaaaatatttctca

SEQ ID NO: 669579 - DNA, 18 bp, Homo sapiens
tcaaagccacattatttc

SEQ ID NO: 669580 - DNA, 20 bp, Homo sapiens
tcaaagccacattatttcta

SEQ ID NO: 669581 - DNA, 22 bp, Homo sapiens
tcaaagcccaaactcctttctt

SEQ ID NO: 669582 - DNA, 16 bp, Homo sapiens
tcaaagtaaggctggt

SEQ ID NO: 669583 - DNA, 17 bp, Homo sapiens
tcaaagttgaaaattca

SEQ ID NO: 669584 - DNA, 18 bp, Homo sapiens
tcaaagttgaaaattcat

SEQ ID NO: 669585 - DNA, 12 bp, Homo sapiens
tcaaagtttata

SEQ ID NO: 669586 - DNA, 17 bp, Homo sapiens
tcaaagtttatatgcct

SEQ ID NO: 669587 - DNA, 16 bp, Homo sapiens
tcaaataaaatatcat

SEQ ID NO: 669588 - DNA, 16 bp, Homo sapiens
tcaaatacacatttgc

SEQ ID NO: 669589 - DNA, 21 bp, Homo sapiens
tcaaatacatttaaaacatta

SEQ ID NO: 669590 - DNA, 22 bp, Homo sapiens
tcaaatacatttaaaacattaa

SEQ ID NO: 669591 - DNA, 20 bp, Homo sapiens
tcaaatctaccactgtatga

SEQ ID NO: 669592 - DNA, 21 bp, Homo sapiens
tcaaatctcctgctgatttca

SEQ ID NO: 669593 - DNA, 20 bp, Homo sapiens
tcaaattaaaacagctgcat

SEQ ID NO: 669594 - DNA, 22 bp, Homo sapiens
tcaaattgtgcagtactttgtg

SEQ ID NO: 669595 - DNA, 21 bp, Homo sapiens
tcaaatttactttaaaaagaa

SEQ ID NO: 669596 - DNA, 22 bp, Homo sapiens
tcaacaaatattcactggcccc

SEQ ID NO: 669597 - DNA, 16 bp, Homo sapiens
tcaacatagtgagaca

SEQ ID NO: 669598 - DNA, 20 bp, Homo sapiens
tcaacatagtgagacactgt

SEQ ID NO: 669599 - DNA, 20 bp, Homo sapiens
tcaactctccaatgttctat

SEQ ID NO: 669600 - DNA, 13 bp, Homo sapiens
tcaacttttatgc

SEQ ID NO: 669601 - DNA, 14 bp, Homo sapiens
tcaagaaaatcttt

SEQ ID NO: 669602 - DNA, 19 bp, Homo sapiens
tcaagaatagcattgtaaa

SEQ ID NO: 669603 - DNA, 14 bp, Homo sapiens
tcaagacatttgct

SEQ ID NO: 669604 - DNA, 16 bp, Homo sapiens
tcaagattttgaatgc

SEQ ID NO: 669605 - DNA, 14 bp, Homo sapiens
tcaagctagtgttt

SEQ ID NO: 669606 - DNA, 13 bp, Homo sapiens
tcaagctttcccg

SEQ ID NO: 669607 - DNA, 19 bp, Homo sapiens
tcaaggcagttgcttgtgt

SEQ ID NO: 669608 - DNA, 20 bp, Homo sapiens
tcaagggaatgtaactgctg

SEQ ID NO: 669609 - DNA, 15 bp, Homo sapiens
tcaagggctgtcatt

SEQ ID NO: 669610 - DNA, 22 bp, Homo sapiens
tcaaggtttaaccttaaaatta

SEQ ID NO: 669611 - DNA, 22 bp, Homo sapiens
tcaagtaagaagacatgaacca

SEQ ID NO: 669612 - DNA, 17 bp, Homo sapiens
tcaagttaccaatgtaa

SEQ ID NO: 669613 - DNA, 14 bp, Homo sapiens
tcaagtttaaaagc

SEQ ID NO: 669614 - DNA, 14 bp, Homo sapiens
tcaagtttacactt

SEQ ID NO: 669615 - DNA, 17 bp, Homo sapiens
tcaagtttacacttcat

SEQ ID NO: 669616 - DNA, 15 bp, Homo sapiens
tcaataaatctttca

SEQ ID NO: 669617 - DNA, 16 bp, Homo sapiens
tcaatagatctccagc

SEQ ID NO: 669618 - DNA, 19 bp, Homo sapiens
tcaatcttggtttgtcagt

SEQ ID NO: 669619 - DNA, 16 bp, Homo sapiens
tcaatgaaccataaat

SEQ ID NO: 669620 - DNA, 20 bp, Homo sapiens
tcaattagtggtcataaaat

SEQ ID NO: 669621 - DNA, 21 bp, Homo sapiens
tcaattagtggtcataaaata

SEQ ID NO: 669622 - DNA, 14 bp, Homo sapiens
tcacaaatgtcatt

SEQ ID NO: 669623 - DNA, 20 bp, Homo sapiens
tcacaacccttctctgttgg

SEQ ID NO: 669624 - DNA, 21 bp, Homo sapiens
tcacaatgttccttttttgta

SEQ ID NO: 669625 - DNA, 13 bp, Homo sapiens
tcacacacgtgag

SEQ ID NO: 669626 - DNA, 16 bp, Homo sapiens
tcacaccctgacttca

SEQ ID NO: 669627 - DNA, 19 bp, Homo sapiens
tcacacgactgtcatctaa

SEQ ID NO: 669628 - DNA, 12 bp, Homo sapiens
tcacagggtggg

SEQ ID NO: 669629 - DNA, 15 bp, Homo sapiens
tcacagggtgggcct

SEQ ID NO: 669630 - DNA, 17 bp, Homo sapiens
tcacagtacagcatgtg

SEQ ID NO: 669631 - DNA, 13 bp, Homo sapiens
tcacattagaatt

SEQ ID NO: 669632 - DNA, 20 bp, Homo sapiens
tcacattggagtcactgcca

SEQ ID NO: 669633 - DNA, 13 bp, Homo sapiens
tcaccaaggaaac

SEQ ID NO: 669634 - DNA, 19 bp, Homo sapiens
tcaccagtgcgattctgga

SEQ ID NO: 669635 - DNA, 19 bp, Homo sapiens
tcacccatgcaagcagagg

SEQ ID NO: 669636 - DNA, 21 bp, Homo sapiens
tcacccatgcaagcagaggac

SEQ ID NO: 669637 - DNA, 15 bp, Homo sapiens
tcaccccactcctgt

SEQ ID NO: 669638 - DNA, 19 bp, Homo sapiens
tcacccctttctgtcccac

SEQ ID NO: 669639 - DNA, 13 bp, Homo sapiens
tcaccgagcagag

SEQ ID NO: 669640 - DNA, 14 bp, Homo sapiens
tcaccgagcagagg

SEQ ID NO: 669641 - DNA, 16 bp, Homo sapiens
tcaccggtcagtgcct

SEQ ID NO: 669642 - DNA, 14 bp, Homo sapiens
tcacctaatgttta

SEQ ID NO: 669643 - DNA, 21 bp, Homo sapiens
tcacctaatgtttatgagcca

SEQ ID NO: 669644 - DNA, 18 bp, Homo sapiens
tcacctcccgaagccacc

SEQ ID NO: 669645 - DNA, 23 bp, Homo sapiens
tcacgtgtcttaggctgatgcca

SEQ ID NO: 669646 - DNA, 23 bp, Homo sapiens
tcactaaaagcatgaattggaac

SEQ ID NO: 669647 - DNA, 17 bp, Homo sapiens
tctccctgcctggcccc

SEQ ID NO: 669648 - DNA, 13 bp, Homo sapiens
tctccctggctcc

SEQ ID NO: 669649 - DNA, 23 bp, Homo sapiens
tctccctggctccctcctccagg

SEQ ID NO: 669650 - DNA, 20 bp, Homo sapiens
tctccgttccatctgggctt

SEQ ID NO: 669651 - DNA, 14 bp, Homo sapiens
tctcctcatctcca

SEQ ID NO: 669652 - DNA, 23 bp, Homo sapiens
tctcctcccgcccttccatgtgc

SEQ ID NO: 669653 - DNA, 14 bp, Homo sapiens
tctcctgagctagg

SEQ ID NO: 669654 - DNA, 20 bp, Homo sapiens
tctcctggcccctgcctgct

SEQ ID NO: 669655 - DNA, 16 bp, Homo sapiens
tctccttgagtgtatg

SEQ ID NO: 669656 - DNA, 13 bp, Homo sapiens
tctccttttccta

SEQ ID NO: 669657 - DNA, 16 bp, Homo sapiens
tctccttttccttacc

SEQ ID NO: 669658 - DNA, 17 bp, Homo sapiens
tctccttttccttacca

SEQ ID NO: 669659 - DNA, 14 bp, Homo sapiens
tctctaacagtgga

SEQ ID NO: 669660 - DNA, 20 bp, Homo sapiens
tctctaacagtggacaaagt

SEQ ID NO: 669661 - DNA, 17 bp, Homo sapiens
tctctaaggtttacaat

SEQ ID NO: 669662 - DNA, 14 bp, Homo sapiens
tctctacaaaaata

SEQ ID NO: 669663 - DNA, 23 bp, Homo sapiens
tctctattttcataatcagtaaa

SEQ ID NO: 669664 - DNA, 13 bp, Homo sapiens
tctctcctggcct

SEQ ID NO: 669665 - DNA, 14 bp, Homo sapiens
tctctctcttgcct

SEQ ID NO: 669666 - DNA, 16 bp, Homo sapiens
tctctcttgtcctctt

SEQ ID NO: 669667 - DNA, 19 bp, Homo sapiens
tctctcttgtcctcttctg

SEQ ID NO: 669668 - DNA, 22 bp, Homo sapiens
tctctgccgctacctccctccc

SEQ ID NO: 669669 - DNA, 19 bp, Homo sapiens
tctctgtcccttgctgtat

SEQ ID NO: 669670 - DNA, 20 bp, Homo sapiens
tctctgtcccttgctgtatg

SEQ ID NO: 669671 - DNA, 13 bp, Homo sapiens
tctctgtgagaag

SEQ ID NO: 669672 - DNA, 16 bp, Homo sapiens
tctctgttggtctgcc

SEQ ID NO: 669673 - DNA, 19 bp, Homo sapiens
tctcttccccttagaaaca

SEQ ID NO: 669674 - DNA, 12 bp, Homo sapiens
tctctttttgtt

SEQ ID NO: 669675 - DNA, 20 bp, Homo sapiens
tctgacagtttttctgtttt

SEQ ID NO: 669676 - DNA, 17 bp, Homo sapiens
tctgacccactttgtaa

SEQ ID NO: 669677 - DNA, 16 bp, Homo sapiens
tctgagaccacagagg

SEQ ID NO: 669678 - DNA, 16 bp, Homo sapiens
tctgagatgctcactt

SEQ ID NO: 669679 - DNA, 19 bp, Homo sapiens
tctgagatgctcactttat

SEQ ID NO: 669680 - DNA, 14 bp, Homo sapiens
tctgagattctggt

SEQ ID NO: 669681 - DNA, 14 bp, Homo sapiens
tctgaggacaagag

SEQ ID NO: 669682 - DNA, 22 bp, Homo sapiens
tctgaggatagtagttaaataa

SEQ ID NO: 669683 - DNA, 23 bp, Homo sapiens
tctgattctggctttaagccttc

SEQ ID NO: 669684 - DNA, 17 bp, Homo sapiens
tctgattttgaggttta

SEQ ID NO: 669685 - DNA, 18 bp, Homo sapiens
tctgcaacatttgacaaa

SEQ ID NO: 669686 - DNA, 14 bp, Homo sapiens
tctgcacagggtcc

SEQ ID NO: 669687 - DNA, 15 bp, Homo sapiens
tctgcagcattgaag

SEQ ID NO: 669688 - DNA, 16 bp, Homo sapiens
tctgcagcattgaagt

SEQ ID NO: 669689 - DNA, 14 bp, Homo sapiens
tctgcagtctcatt

SEQ ID NO: 669690 - DNA, 17 bp, Homo sapiens
tctgcagtctcatttct

SEQ ID NO: 669691 - DNA, 18 bp, Homo sapiens
tctgcagtctcatttctc

SEQ ID NO: 669692 - DNA, 15 bp, Homo sapiens
tctgccgctacctcc

SEQ ID NO: 669693 - DNA, 20 bp, Homo sapiens
tctgccgctacctccctccc

SEQ ID NO: 669694 - DNA, 15 bp, Homo sapiens
tctgcctctccctgg

SEQ ID NO: 669695 - DNA, 20 bp, Homo sapiens
tctgccttcacaaatgtcat

SEQ ID NO: 669696 - DNA, 21 bp, Homo sapiens
tctgccttcacaaatgtcatt

SEQ ID NO: 669697 - DNA, 19 bp, Homo sapiens
tctgccttctgctgaaaga

SEQ ID NO: 669698 - DNA, 17 bp, Homo sapiens
tctgcgcttcagtaaca

SEQ ID NO: 669699 - DNA, 15 bp, Homo sapiens
tctgctcaccgccca

SEQ ID NO: 669700 - DNA, 13 bp, Homo sapiens
tctgctccctctg

SEQ ID NO: 669701 - DNA, 14 bp, Homo sapiens
tctgctgaaagact

SEQ ID NO: 669702 - DNA, 23 bp, Homo sapiens
tctgctgaaagactcgagaacca

SEQ ID NO: 669703 - DNA, 16 bp, Homo sapiens
tctgctgagttggcct

SEQ ID NO: 669704 - DNA, 22 bp, Homo sapiens
tctgctgagttggcctggccat

SEQ ID NO: 669705 - DNA, 12 bp, Homo sapiens
tctgctgctgat

SEQ ID NO: 669706 - DNA, 23 bp, Homo sapiens
tctgctggcatcaagaggtggga

SEQ ID NO: 669707 - DNA, 21 bp, Homo sapiens
tctggagctggcactgtggag

SEQ ID NO: 669708 - DNA, 19 bp, Homo sapiens
tctggcaaaaaggagcctt

SEQ ID NO: 669709 - DNA, 22 bp, Homo sapiens
tctggctggaaagcagagcctc

SEQ ID NO: 669710 - DNA, 21 bp, Homo sapiens
tctgggagcagggcataggaa

SEQ ID NO: 669711 - DNA, 20 bp, Homo sapiens
tctgggcgtccagctcagcc

SEQ ID NO: 669712 - DNA, 15 bp, Homo sapiens
tctgggctcaagctt

SEQ ID NO: 669713 - DNA, 19 bp, Homo sapiens
tctgggctcaagctttccc

SEQ ID NO: 669714 - DNA, 13 bp, Homo sapiens
tctggggacaggc

SEQ ID NO: 669715 - DNA, 16 bp, Homo sapiens
tctggggacaggcccg

SEQ ID NO: 669716 - DNA, 16 bp, Homo sapiens
tctgggtatctttcca

SEQ ID NO: 669717 - DNA, 17 bp, Homo sapiens
tctgggtccttggctcc

SEQ ID NO: 669718 - DNA, 13 bp, Homo sapiens
tctggtgttgact

SEQ ID NO: 669719 - DNA, 16 bp, Homo sapiens
tctggttccctgctgc

SEQ ID NO: 669720 - DNA, 19 bp, Homo sapiens
tctggttccctgctgcgct

SEQ ID NO: 669721 - DNA, 22 bp, Homo sapiens
tctgtactaaacagtaagatat

SEQ ID NO: 669722 - DNA, 23 bp, Homo sapiens
tctgtagctcctcaactcaccta

SEQ ID NO: 669723 - DNA, 20 bp, Homo sapiens
tctgtccgttcacatgtgtg

SEQ ID NO: 669724 - DNA, 12 bp, Homo sapiens
tctgtctggcac

SEQ ID NO: 669725 - DNA, 17 bp, Homo sapiens
tctgtgacccctccttg

SEQ ID NO: 669726 - DNA, 14 bp, Homo sapiens
tctgtgacctctga

SEQ ID NO: 669727 - DNA, 19 bp, Homo sapiens
tctgtgagaaggtttattg

SEQ ID NO: 669728 - DNA, 23 bp, Homo sapiens
tctgtgagaaggtttattgttaa

SEQ ID NO: 669729 - DNA, 17 bp, Homo sapiens
tctgtgccatagaacaa

SEQ ID NO: 669730 - DNA, 20 bp, Homo sapiens
tctgtgggctacatgctggg

SEQ ID NO: 669731 - DNA, 23 bp, Homo sapiens
tctgtgggctacatgctggggtc

SEQ ID NO: 669732 - DNA, 14 bp, Homo sapiens
tctgtgtcatttct

SEQ ID NO: 669733 - DNA, 13 bp, Homo sapiens
tctgtgtgaatgt

SEQ ID NO: 669734 - DNA, 14 bp, Homo sapiens
tctgtgtgaatgtg

SEQ ID NO: 669735 - DNA, 22 bp, Homo sapiens
tctgtgtgaatgtgggcactgg

SEQ ID NO: 669736 - DNA, 20 bp, Homo sapiens
tctgtgtgtgtgtgtgtgcg

SEQ ID NO: 669737 - DNA, 23 bp, Homo sapiens
tctgttatgatttccttcaatgt

SEQ ID NO: 669738 - DNA, 15 bp, Homo sapiens
tctgttatgggcttt

SEQ ID NO: 669739 - DNA, 17 bp, Homo sapiens
tctgttcatttctaaat

SEQ ID NO: 669740 - DNA, 19 bp, Homo sapiens
tctgttccatgcaactgga

SEQ ID NO: 669741 - DNA, 22 bp, Homo sapiens
tctgttggtctgccttctgctg

SEQ ID NO: 669742 - DNA, 18 bp, Homo sapiens
tctgtttataatgaagaa

SEQ ID NO: 669743 - DNA, 21 bp, Homo sapiens
tctgtttggactgcagaagca

SEQ ID NO: 669744 - DNA, 16 bp, Homo sapiens
tcttaacctttgctat

SEQ ID NO: 669745 - DNA, 19 bp, Homo sapiens
tcttaagatggaaatacag

SEQ ID NO: 669746 - DNA, 16 bp, Homo sapiens
tcttaagcaggtttgt

SEQ ID NO: 669747 - DNA, 16 bp, Homo sapiens
tcttacacactgtctg

SEQ ID NO: 669748 - DNA, 17 bp, Homo sapiens
tcttacacactgtctgt

SEQ ID NO: 669749 - DNA, 14 bp, Homo sapiens
tcttactgataatt

SEQ ID NO: 669750 - DNA, 16 bp, Homo sapiens
tcttactgataatttt

SEQ ID NO: 669751 - DNA, 13 bp, Homo sapiens
tcttagtgaatgg

SEQ ID NO: 669752 - DNA, 14 bp, Homo sapiens
tcttagtgcctgag

SEQ ID NO: 669753 - DNA, 20 bp, Homo sapiens
tcttatacgcttttctttgt

SEQ ID NO: 669754 - DNA, 17 bp, Homo sapiens
tcttatgtgaaaaatta

SEQ ID NO: 669755 - DNA, 17 bp, Homo sapiens
tcttcaaccaaggccac

SEQ ID NO: 669756 - DNA, 18 bp, Homo sapiens
tcttcaatatgaatctat

SEQ ID NO: 669757 - DNA, 20 bp, Homo sapiens
tcttcactgcaattttgtgt

SEQ ID NO: 669758 - DNA, 23 bp, Homo sapiens
tcttcatggcatcttcaatatga

SEQ ID NO: 669759 - DNA, 20 bp, Homo sapiens
tcttccaaagtaaaattgct

SEQ ID NO: 669760 - DNA, 20 bp, Homo sapiens
tcttccacaaaaaatacttt

SEQ ID NO: 669761 - DNA, 14 bp, Homo sapiens
tcttcgctggacta

SEQ ID NO: 669762 - DNA, 18 bp, Homo sapiens
tcttcgctggactattgt

SEQ ID NO: 669763 - DNA, 19 bp, Homo sapiens
tcttcgctggactattgtg

SEQ ID NO: 669764 - DNA, 21 bp, Homo sapiens
tcttcgctggactattgtgcc

SEQ ID NO: 669765 - DNA, 14 bp, Homo sapiens
tcttctaccctttt

SEQ ID NO: 669766 - DNA, 18 bp, Homo sapiens
tcttctacccttttcctt

SEQ ID NO: 669767 - DNA, 15 bp, Homo sapiens
tgagtactgtactat

SEQ ID NO: 669768 - DNA, 12 bp, Homo sapiens
tgagtattgttt

SEQ ID NO: 669769 - DNA, 19 bp, Homo sapiens
tgagtgggagagtacctgt

SEQ ID NO: 669770 - DNA, 18 bp, Homo sapiens
tgagtgtatgagtagcca

SEQ ID NO: 669771 - DNA, 12 bp, Homo sapiens
tgagtgtgacag

SEQ ID NO: 669772 - DNA, 13 bp, Homo sapiens
tgagtgtgacagg

SEQ ID NO: 669773 - DNA, 16 bp, Homo sapiens
tgagtgtgacagggcc

SEQ ID NO: 669774 - DNA, 17 bp, Homo sapiens
tgataaaataaataatt

SEQ ID NO: 669775 - DNA, 19 bp, Homo sapiens
tgataaacctgccaagagt

SEQ ID NO: 669776 - DNA, 14 bp, Homo sapiens
tgataatatatatt

SEQ ID NO: 669777 - DNA, 12 bp, Homo sapiens
tgataatcttca

SEQ ID NO: 669778 - DNA, 22 bp, Homo sapiens
tgataatcttcaggtgaacact

SEQ ID NO: 669779 - DNA, 13 bp, Homo sapiens
tgataattttgct

SEQ ID NO: 669780 - DNA, 21 bp, Homo sapiens
tgatactatcatactactgaa

SEQ ID NO: 669781 - DNA, 18 bp, Homo sapiens
tgatagcaaatggcctca

SEQ ID NO: 669782 - DNA, 23 bp, Homo sapiens
tgataggtaaatttttaggcaaa

SEQ ID NO: 669783 - DNA, 15 bp, Homo sapiens
tgatatctataaaat

SEQ ID NO: 669784 - DNA, 23 bp, Homo sapiens
tgatatctataaaatagatataa

SEQ ID NO: 669785 - DNA, 17 bp, Homo sapiens
tgatattacatttattt

SEQ ID NO: 669786 - DNA, 15 bp, Homo sapiens
tgatatttcttgctt

SEQ ID NO: 669787 - DNA, 15 bp, Homo sapiens
tgatatttttataca

SEQ ID NO: 669788 - DNA, 17 bp, Homo sapiens
tgatcaaacatgtctct

SEQ ID NO: 669789 - DNA, 18 bp, Homo sapiens
tgatcagtgttgttgctc

SEQ ID NO: 669790 - DNA, 15 bp, Homo sapiens
tgatcatcgccagag

SEQ ID NO: 669791 - DNA, 20 bp, Homo sapiens
tgatcatcgccagaggtgct

SEQ ID NO: 669792 - DNA, 16 bp, Homo sapiens
tgatccatccatctct

SEQ ID NO: 669793 - DNA, 20 bp, Homo sapiens
tgatccccaagtggtgaatg

SEQ ID NO: 669794 - DNA, 24 bp, Homo sapiens
tgatctctcttgtcctcttctgct

SEQ ID NO: 669795 - DNA, 13 bp, Homo sapiens
tgatgactgctga

SEQ ID NO: 669796 - DNA, 16 bp, Homo sapiens
tgatgactgctgattt

SEQ ID NO: 669797 - DNA, 21 bp, Homo sapiens
tgatgattttcatttcatgaa

SEQ ID NO: 669798 - DNA, 15 bp, Homo sapiens
tgatgattttccttt

SEQ ID NO: 669799 - DNA, 22 bp, Homo sapiens
tgatggagtttctctagaagct

SEQ ID NO: 669800 - DNA, 14 bp, Homo sapiens
tgatggcagaggag

SEQ ID NO: 669801 - DNA, 18 bp, Homo sapiens
tgatggtcaatcagtgtt

SEQ ID NO: 669802 - DNA, 20 bp, Homo sapiens
tgatgtacataactcctgtc

SEQ ID NO: 669803 - DNA, 24 bp, Homo sapiens
tgatgtacataactcctgtccctt

SEQ ID NO: 669804 - DNA, 20 bp, Homo sapiens
tgatgttttttctgtaatgt

SEQ ID NO: 669805 - DNA, 22 bp, Homo sapiens
tgatgttttttctgtaatgtaa

SEQ ID NO: 669806 - DNA, 13 bp, Homo sapiens
tgattaagaaagg

SEQ ID NO: 669807 - DNA, 16 bp, Homo sapiens
tgattatgtatggata

SEQ ID NO: 669808 - DNA, 17 bp, Homo sapiens
tgattatgtatggatat

SEQ ID NO: 669809 - DNA, 13 bp, Homo sapiens
tgattattttctt

SEQ ID NO: 669810 - DNA, 18 bp, Homo sapiens
tgattattttttttttct

SEQ ID NO: 669811 - DNA, 15 bp, Homo sapiens
tgattctcagggctg

SEQ ID NO: 669812 - DNA, 18 bp, Homo sapiens
tgattctggctttaagcc

SEQ ID NO: 669813 - DNA, 19 bp, Homo sapiens
tgattctttgttacaggca

SEQ ID NO: 669814 - DNA, 15 bp, Homo sapiens
tgattgggaaaacat

SEQ ID NO: 669815 - DNA, 16 bp, Homo sapiens
tgattgggaaaacatt

SEQ ID NO: 669816 - DNA, 14 bp, Homo sapiens
tgattgtcagctac

SEQ ID NO: 669817 - DNA, 20 bp, Homo sapiens
tgatttcaaagttttgttgt

SEQ ID NO: 669818 - DNA, 21 bp, Homo sapiens
tgatttcaaagttttgttgta

SEQ ID NO: 669819 - DNA, 22 bp, Homo sapiens
tgatttccgtgaactctggtgc

SEQ ID NO: 669820 - DNA, 11 bp, Homo sapiens
tgatttctaat

SEQ ID NO: 669821 - DNA, 22 bp, Homo sapiens
tgatttctaattgtaagtgaaa

SEQ ID NO: 669822 - DNA, 22 bp, Homo sapiens
tgatttcttaggggaaggagaa

SEQ ID NO: 669823 - DNA, 16 bp, Homo sapiens
tgatttgaaaaatata

SEQ ID NO: 669824 - DNA, 16 bp, Homo sapiens
tgattttcatttcatg

SEQ ID NO: 669825 - DNA, 13 bp, Homo sapiens
tgattttgaggtt

SEQ ID NO: 669826 - DNA, 15 bp, Homo sapiens
tgcaaaagcttcaaa

SEQ ID NO: 669827 - DNA, 16 bp, Homo sapiens
tgcaaaatttagaaga

SEQ ID NO: 669828 - DNA, 21 bp, Homo sapiens
tgcaaaatttagaagaaaagt

SEQ ID NO: 669829 - DNA, 22 bp, Homo sapiens
tgcaaaatttagaagaaaagtt

SEQ ID NO: 669830 - DNA, 15 bp, Homo sapiens
tgcaaacagaacagg

SEQ ID NO: 669831 - DNA, 19 bp, Homo sapiens
tgcaaacagaacagggtca

SEQ ID NO: 669832 - DNA, 15 bp, Homo sapiens
tgcaaattttaactg

SEQ ID NO: 669833 - DNA, 15 bp, Homo sapiens
tgcaacaagcatgca

SEQ ID NO: 669834 - DNA, 20 bp, Homo sapiens
tgcaacggtctcctgactgg

SEQ ID NO: 669835 - DNA, 16 bp, Homo sapiens
tgcaagataattttca

SEQ ID NO: 669836 - DNA, 13 bp, Homo sapiens
tgcaagttcattt

SEQ ID NO: 669837 - DNA, 19 bp, Homo sapiens
tgcaagttcattttaaatg

SEQ ID NO: 669838 - DNA, 15 bp, Homo sapiens
tgcaataactctggg

SEQ ID NO: 669839 - DNA, 22 bp, Homo sapiens
tgcaatccatttatttcattta

SEQ ID NO: 669840 - DNA, 17 bp, Homo sapiens
tgcaatgaaagtcaaat

SEQ ID NO: 669841 - DNA, 15 bp, Homo sapiens
tgcaatttgagccat

SEQ ID NO: 669842 - DNA, 12 bp, Homo sapiens
tgcacaacagcc

SEQ ID NO: 669843 - DNA, 20 bp, Homo sapiens
tgcacaacagccctgcctga

SEQ ID NO: 669844 - DNA, 14 bp, Homo sapiens
tgcacaacttttga

SEQ ID NO: 669845 - DNA, 13 bp, Homo sapiens
tgcacacagggca

SEQ ID NO: 669846 - DNA, 15 bp, Homo sapiens
tgcacacagggcagt

SEQ ID NO: 669847 - DNA, 18 bp, Homo sapiens
tgcacagctgtttgaaat

SEQ ID NO: 669848 - DNA, 12 bp, Homo sapiens
tgcacagggtcc

SEQ ID NO: 669849 - DNA, 21 bp, Homo sapiens
tgcacataagcttccatttta

SEQ ID NO: 669850 - DNA, 22 bp, Homo sapiens
tgcacataagcttccattttaa

SEQ ID NO: 669851 - DNA, 21 bp, Homo sapiens
tgcacatccgcgtgtgcctgt

SEQ ID NO: 669852 - DNA, 22 bp, Homo sapiens
tgcacccctgagccagcagggc

SEQ ID NO: 669853 - DNA, 16 bp, Homo sapiens
tgcaccgtcctcagca

SEQ ID NO: 669854 - DNA, 21 bp, Homo sapiens
tgcaccttcactctccagggt

SEQ ID NO: 669855 - DNA, 18 bp, Homo sapiens
tgcactccagcctggggg

SEQ ID NO: 669856 - DNA, 15 bp, Homo sapiens
tgcactgatgttgtg

SEQ ID NO: 669857 - DNA, 21 bp, Homo sapiens
tgcacttgattaagcttttgt

SEQ ID NO: 669858 - DNA, 22 bp, Homo sapiens
tgcactttttaagtttgaagag

SEQ ID NO: 669859 - DNA, 21 bp, Homo sapiens
tgcagaatgtaagtgggccca

SEQ ID NO: 669860 - DNA, 21 bp, Homo sapiens
tgcagacagaagtctcctcaa

SEQ ID NO: 669861 - DNA, 22 bp, Homo sapiens
tgcagactgctgctagagccag

SEQ ID NO: 669862 - DNA, 15 bp, Homo sapiens
tgcagagatttctca

SEQ ID NO: 669863 - DNA, 18 bp, Homo sapiens
tgcagaggtaccctgggt

SEQ ID NO: 669864 - DNA, 23 bp, Homo sapiens
tgcagagtgaccagcacactgga

SEQ ID NO: 669865 - DNA, 20 bp, Homo sapiens
tgcagagtttccaaaaccag

SEQ ID NO: 669866 - DNA, 20 bp, Homo sapiens
tgcagcaaatatatgattct

SEQ ID NO: 669867 - DNA, 17 bp, Homo sapiens
tgcagcaccgaggggcc

SEQ ID NO: 669868 - DNA, 20 bp, Homo sapiens
tgcagcaccgaggggccttt

SEQ ID NO: 669869 - DNA, 15 bp, Homo sapiens
tgcagctttgcaaac

SEQ ID NO: 669870 - DNA, 19 bp, Homo sapiens
tgcaggaccctgtcctgca

SEQ ID NO: 669871 - DNA, 14 bp, Homo sapiens
tgcaggcagcacag

SEQ ID NO: 669872 - DNA, 10 bp, Homo sapiens
tgcagggcca

SEQ ID NO: 669873 - DNA, 15 bp, Homo sapiens
tgcagggccatggct

SEQ ID NO: 669874 - DNA, 22 bp, Homo sapiens
tgcaggggtgacggccctcatc

SEQ ID NO: 669875 - DNA, 19 bp, Homo sapiens
tgcaggtaagtctggtttt

SEQ ID NO: 669876 - DNA, 16 bp, Homo sapiens
tgcaggtgtcctgagc

SEQ ID NO: 669877 - DNA, 17 bp, Homo sapiens
tgcagtactttgtgcat

SEQ ID NO: 669878 - DNA, 22 bp, Homo sapiens
tgcataataagctaaagaggct

SEQ ID NO: 669879 - DNA, 23 bp, Homo sapiens
tgcataataagctaaagaggctg

SEQ ID NO: 669880 - DNA, 17 bp, Homo sapiens
tgcataatgataaaata

SEQ ID NO: 669881 - DNA, 20 bp, Homo sapiens
tgcataatgataaaataaat

SEQ ID NO: 669882 - DNA, 13 bp, Homo sapiens
tgcatactttgta

SEQ ID NO: 669883 - DNA, 14 bp, Homo sapiens
tgcatatagttaaa

SEQ ID NO: 669884 - DNA, 18 bp, Homo sapiens
tgcatatagttaaactga

SEQ ID NO: 669885 - DNA, 22 bp, Homo sapiens
tgcatatttatccaaaatgtgt

SEQ ID NO: 669886 - DNA, 23 bp, Homo sapiens
tgcatatttgccacaaaacctgt

SEQ ID NO: 669887 - DNA, 18 bp, Homo sapiens
tggcacagaccaggcctt

SEQ ID NO: 669888 - DNA, 13 bp, Homo sapiens
tggcacagctggg

SEQ ID NO: 669889 - DNA, 20 bp, Homo sapiens
tggcactgaccggtgctttt

SEQ ID NO: 669890 - DNA, 19 bp, Homo sapiens
tggcagaagggaattgctc

SEQ ID NO: 669891 - DNA, 17 bp, Homo sapiens
tggcaggactcctggca

SEQ ID NO: 669892 - DNA, 18 bp, Homo sapiens
tggcaggactcctggcag

SEQ ID NO: 669893 - DNA, 20 bp, Homo sapiens
tggcagggccacctgcagga

SEQ ID NO: 669894 - DNA, 17 bp, Homo sapiens
tggcatcttcaatatga

SEQ ID NO: 669895 - DNA, 23 bp, Homo sapiens
tggcatttctctttaaactatgt

SEQ ID NO: 669896 - DNA, 18 bp, Homo sapiens
tggccagaggtgtcaccc

SEQ ID NO: 669897 - DNA, 23 bp, Homo sapiens
tggccaggccttacatctggctg

SEQ ID NO: 669898 - DNA, 14 bp, Homo sapiens
tggcccccaataaa

SEQ ID NO: 669899 - DNA, 18 bp, Homo sapiens
tggcccccaataaaggca

SEQ ID NO: 669900 - DNA, 20 bp, Homo sapiens
tggcccccaataaaggcagc

SEQ ID NO: 669901 - DNA, 22 bp, Homo sapiens
tggcccccaataaaggcagctg

SEQ ID NO: 669902 - DNA, 21 bp, Homo sapiens
tggccctgggcggggcgtggg

SEQ ID NO: 669903 - DNA, 13 bp, Homo sapiens
tggcccttgggga

SEQ ID NO: 669904 - DNA, 13 bp, Homo sapiens
tggccctttcctt

SEQ ID NO: 669905 - DNA, 18 bp, Homo sapiens
tggcctatccgctgccag

SEQ ID NO: 669906 - DNA, 17 bp, Homo sapiens
tggcctccccatgggca

SEQ ID NO: 669907 - DNA, 20 bp, Homo sapiens
tggcctccctttgtgtgcat

SEQ ID NO: 669908 - DNA, 19 bp, Homo sapiens
tggcctggccatttccaag

SEQ ID NO: 669909 - DNA, 18 bp, Homo sapiens
tggcctggggtgcatctc

SEQ ID NO: 669910 - DNA, 13 bp, Homo sapiens
tggcctgtgatgt

SEQ ID NO: 669911 - DNA, 17 bp, Homo sapiens
tggcctgtgatgtttta

SEQ ID NO: 669912 - DNA, 21 bp, Homo sapiens
tggcctgtgccagcaccacag

SEQ ID NO: 669913 - DNA, 14 bp, Homo sapiens
tggcgcaggtgggc

SEQ ID NO: 669914 - DNA, 16 bp, Homo sapiens
tggcgcaggtgggctg

SEQ ID NO: 669915 - DNA, 21 bp, Homo sapiens
tggcgcaggtgggctggactt

SEQ ID NO: 669916 - DNA, 17 bp, Homo sapiens
tggcggctgcacaacag

SEQ ID NO: 669917 - DNA, 17 bp, Homo sapiens
tggcgtgggagccagcc

SEQ ID NO: 669918 - DNA, 22 bp, Homo sapiens
tggctcacagtacagcatgtgc

SEQ ID NO: 669919 - DNA, 24 bp, Homo sapiens
tggctcacagtacagcatgtgcct

SEQ ID NO: 669920 - DNA, 18 bp, Homo sapiens
tggctccactcttgatct

SEQ ID NO: 669921 - DNA, 20 bp, Homo sapiens
tggctccactcttgatctct

SEQ ID NO: 669922 - DNA, 15 bp, Homo sapiens
tggctccctcctcca

SEQ ID NO: 669923 - DNA, 20 bp, Homo sapiens
tggctccctcctccaggcct

SEQ ID NO: 669924 - DNA, 15 bp, Homo sapiens
tggctccggcctctg

SEQ ID NO: 669925 - DNA, 13 bp, Homo sapiens
tggctgcacaggc

SEQ ID NO: 669926 - DNA, 15 bp, Homo sapiens
tggctgcacaggctg

SEQ ID NO: 669927 - DNA, 22 bp, Homo sapiens
tggctggaaagcagagcctcct

SEQ ID NO: 669928 - DNA, 13 bp, Homo sapiens
tggctggaagggg

SEQ ID NO: 669929 - DNA, 18 bp, Homo sapiens
tggctggaaggggtccag

SEQ ID NO: 669930 - DNA, 23 bp, Homo sapiens
tggctgggtggtattctggtagg

SEQ ID NO: 669931 - DNA, 16 bp, Homo sapiens
tggcttatgaaagagg

SEQ ID NO: 669932 - DNA, 15 bp, Homo sapiens
tggcttccccactcc

SEQ ID NO: 669933 - DNA, 13 bp, Homo sapiens
tggctttgcctct

SEQ ID NO: 669934 - DNA, 17 bp, Homo sapiens
tggctttgcctcttctt

SEQ ID NO: 669935 - DNA, 20 bp, Homo sapiens
tggctttgcctcttctttgt

SEQ ID NO: 669936 - DNA, 18 bp, Homo sapiens
tgggaaatatgccactga

SEQ ID NO: 669937 - DNA, 22 bp, Homo sapiens
tgggaaattaaatccaataaaa

SEQ ID NO: 669938 - DNA, 22 bp, Homo sapiens
tgggaacctagctacactgagc

SEQ ID NO: 669939 - DNA, 23 bp, Homo sapiens
tgggaacctagctacactgagca

SEQ ID NO: 669940 - DNA, 18 bp, Homo sapiens
tgggaagaagaagacctc

SEQ ID NO: 669941 - DNA, 17 bp, Homo sapiens
tgggacccccgtggggc

SEQ ID NO: 669942 - DNA, 22 bp, Homo sapiens
tgggacccccgtggggcaggga

SEQ ID NO: 669943 - DNA, 15 bp, Homo sapiens
tgggactgactttcc

SEQ ID NO: 669944 - DNA, 23 bp, Homo sapiens
tgggagagtacctgtgtgtttcg

SEQ ID NO: 669945 - DNA, 13 bp, Homo sapiens
tgggagccagcct

SEQ ID NO: 669946 - DNA, 21 bp, Homo sapiens
tgggagcctggttcagacaca

SEQ ID NO: 669947 - DNA, 15 bp, Homo sapiens
tgggaggaaaggtga

SEQ ID NO: 669948 - DNA, 17 bp, Homo sapiens
tgggattaagaaacctt

SEQ ID NO: 669949 - DNA, 21 bp, Homo sapiens
tgggcacagtggtgaccccct

SEQ ID NO: 669950 - DNA, 16 bp, Homo sapiens
tgggcactggcccagg

SEQ ID NO: 669951 - DNA, 16 bp, Homo sapiens
tgggcagatcacttga

SEQ ID NO: 669952 - DNA, 21 bp, Homo sapiens
tgggcagggtctgtttggact

SEQ ID NO: 669953 - DNA, 14 bp, Homo sapiens
tgggcagtctttct

SEQ ID NO: 669954 - DNA, 19 bp, Homo sapiens
tgggcagtctttcttgaaa

SEQ ID NO: 669955 - DNA, 22 bp, Homo sapiens
tgggcagtctttcttgaaattg

SEQ ID NO: 669956 - DNA, 13 bp, Homo sapiens
tgggccagggtct

SEQ ID NO: 669957 - DNA, 14 bp, Homo sapiens
tgggccagggtctg

SEQ ID NO: 669958 - DNA, 23 bp, Homo sapiens
tgggccataatgttgcttctcag

SEQ ID NO: 669959 - DNA, 17 bp, Homo sapiens
tgggccatgtccaaaga

SEQ ID NO: 669960 - DNA, 18 bp, Homo sapiens
tgggccatgtccaaagag

SEQ ID NO: 669961 - DNA, 23 bp, Homo sapiens
tgggccatgtccaaagaggctgc

SEQ ID NO: 669962 - DNA, 24 bp, Homo sapiens
tgggccatgtccaaagaggctgcc

SEQ ID NO: 669963 - DNA, 12 bp, Homo sapiens
tgggcccctggc

SEQ ID NO: 669964 - DNA, 18 bp, Homo sapiens
tgggccgtggcacagctg

SEQ ID NO: 669965 - DNA, 19 bp, Homo sapiens
tgggccgtggcacagctgg

SEQ ID NO: 669966 - DNA, 15 bp, Homo sapiens
tgggcctcggcccct

SEQ ID NO: 669967 - DNA, 19 bp, Homo sapiens
tgggcctcggcccctccca

SEQ ID NO: 669968 - DNA, 21 bp, Homo sapiens
tgggctattgctgctgcccct

SEQ ID NO: 669969 - DNA, 12 bp, Homo sapiens
tgggctggactt

SEQ ID NO: 669970 - DNA, 17 bp, Homo sapiens
tgggctggggcctcaga

SEQ ID NO: 669971 - DNA, 18 bp, Homo sapiens
tgggctggggcctcagac

SEQ ID NO: 669972 - DNA, 20 bp, Homo sapiens
tggggaaaggggttggggtg

SEQ ID NO: 669973 - DNA, 12 bp, Homo sapiens
tggggaggacaa

SEQ ID NO: 669974 - DNA, 22 bp, Homo sapiens
tggggcctagcgatctctcctg

SEQ ID NO: 669975 - DNA, 14 bp, Homo sapiens
tggggcctgtggaa

SEQ ID NO: 669976 - DNA, 20 bp, Homo sapiens
tgggggacagaaagagactc

SEQ ID NO: 669977 - DNA, 19 bp, Homo sapiens
tgggggacgatcaggagga

SEQ ID NO: 669978 - DNA, 19 bp, Homo sapiens
tggggggacccagtgcaga

SEQ ID NO: 669979 - DNA, 14 bp, Homo sapiens
tggggtgacagtca

SEQ ID NO: 669980 - DNA, 23 bp, Homo sapiens
tggggtgacagtcatcatcaggg

SEQ ID NO: 669981 - DNA, 16 bp, Homo sapiens
tggggtgcatctcctc

SEQ ID NO: 669982 - DNA, 18 bp, Homo sapiens
tgggtaaaagcagggcag

SEQ ID NO: 669983 - DNA, 15 bp, Homo sapiens
tgggtgtttcagttt

SEQ ID NO: 669984 - DNA, 22 bp, Homo sapiens
tgggttaggcattaatgtttct

SEQ ID NO: 669985 - DNA, 13 bp, Homo sapiens
tgggtttcaagaa

SEQ ID NO: 669986 - DNA, 23 bp, Homo sapiens
tgggtttcaagaaaatctttgtt

SEQ ID NO: 669987 - DNA, 15 bp, Homo sapiens
tgggtttctaagcag

SEQ ID NO: 669988 - DNA, 13 bp, Homo sapiens
tggtaaatgtttc

SEQ ID NO: 669989 - DNA, 20 bp, Homo sapiens
tggtacaacggaggcctgcg

SEQ ID NO: 669990 - DNA, 17 bp, Homo sapiens
tggtatagccatgattt

SEQ ID NO: 669991 - DNA, 22 bp, Homo sapiens
tggtcaacatagtgagacactg

SEQ ID NO: 669992 - DNA, 15 bp, Homo sapiens
tggtcaagattttga

SEQ ID NO: 669993 - DNA, 13 bp, Homo sapiens
tggtcataaaata

SEQ ID NO: 669994 - DNA, 15 bp, Homo sapiens
tggtcataaaataga

SEQ ID NO: 669995 - DNA, 16 bp, Homo sapiens
tggtcatatacatatt

SEQ ID NO: 669996 - DNA, 19 bp, Homo sapiens
tggtccccaacaatgtgag

SEQ ID NO: 669997 - DNA, 20 bp, Homo sapiens
tggtccccactgctgagctg

SEQ ID NO: 669998 - DNA, 17 bp, Homo sapiens
tggtctaacactggcat

SEQ ID NO: 669999 - DNA, 23 bp, Homo sapiens
tggtctaacactggcatgttcaa

SEQ ID NO: 670000 - DNA, 15 bp, Homo sapiens
tggtctgccttctgc

SEQ ID NO: 670001 - DNA, 23 bp, Homo sapiens
tggtcttatagtgtttggacagc

SEQ ID NO: 670002 - DNA, 21 bp, Homo sapiens
tggtcttctactgccttgaaa

SEQ ID NO: 670003 - DNA, 15 bp, Homo sapiens
tggtcttgagccagt

SEQ ID NO: 670004 - DNA, 22 bp, Homo sapiens
tggtcttgagccagtaatcttt

SEQ ID NO: 670005 - DNA, 14 bp, Homo sapiens
tggtcttttggtta

SEQ ID NO: 670006 - DNA, 21 bp, Homo sapiens
ttaagaggttgattataaagt

SEQ ID NO: 670007 - DNA, 14 bp, Homo sapiens
ttaagatacaaatt

SEQ ID NO: 670008 - DNA, 15 bp, Homo sapiens
ttaagatacaaatta

SEQ ID NO: 670009 - DNA, 15 bp, Homo sapiens
ttaagatgtgaaaat

SEQ ID NO: 670010 - DNA, 19 bp, Homo sapiens
ttaagcaaatgttaaaagt

SEQ ID NO: 670011 - DNA, 15 bp, Homo sapiens
ttaagcaagttaagt

SEQ ID NO: 670012 - DNA, 11 bp, Homo sapiens
ttaagcagctt

SEQ ID NO: 670013 - DNA, 18 bp, Homo sapiens
ttaagcatgtcaattcat

SEQ ID NO: 670014 - DNA, 14 bp, Homo sapiens
ttaaggaatttgat

SEQ ID NO: 670015 - DNA, 22 bp, Homo sapiens
ttaagtatctgggattattctt

SEQ ID NO: 670016 - DNA, 17 bp, Homo sapiens
ttaagtgaaaatatagc

SEQ ID NO: 670017 - DNA, 15 bp, Homo sapiens
ttaagtttcaaactt

SEQ ID NO: 670018 - DNA, 16 bp, Homo sapiens
ttaagtttcaaactta

SEQ ID NO: 670019 - DNA, 22 bp, Homo sapiens
ttaagtttcaaacttactattt

SEQ ID NO: 670020 - DNA, 14 bp, Homo sapiens
ttaagtttgaagag

SEQ ID NO: 670021 - DNA, 14 bp, Homo sapiens
ttaataaaacctgt

SEQ ID NO: 670022 - DNA, 13 bp, Homo sapiens
ttaataaactgca

SEQ ID NO: 670023 - DNA, 23 bp, Homo sapiens
ttaatacaaggtataataaaatt

SEQ ID NO: 670024 - DNA, 18 bp, Homo sapiens
ttaatagtttgtctattt

SEQ ID NO: 670025 - DNA, 18 bp, Homo sapiens
ttaatatggcttcaccaa

SEQ ID NO: 670026 - DNA, 14 bp, Homo sapiens
ttaatgacaatatt

SEQ ID NO: 670027 - DNA, 15 bp, Homo sapiens
ttaatgctgtttcta

SEQ ID NO: 670028 - DNA, 16 bp, Homo sapiens
ttaatgctgtttctaa

SEQ ID NO: 670029 - DNA, 15 bp, Homo sapiens
ttaatgttttcaaaa

SEQ ID NO: 670030 - DNA, 16 bp, Homo sapiens
ttaatgttttcaaaag

SEQ ID NO: 670031 - DNA, 12 bp, Homo sapiens
ttaatgttttta

SEQ ID NO: 670032 - DNA, 23 bp, Homo sapiens
ttaattataggagccttaatttt

SEQ ID NO: 670033 - DNA, 16 bp, Homo sapiens
ttaatttagaaactga

SEQ ID NO: 670034 - DNA, 14 bp, Homo sapiens
ttaatttatatgta

SEQ ID NO: 670035 - DNA, 13 bp, Homo sapiens
ttaatttgaaata

SEQ ID NO: 670036 - DNA, 15 bp, Homo sapiens
ttaatttgaaatatg

SEQ ID NO: 670037 - DNA, 16 bp, Homo sapiens
ttaattttaaagtgca

SEQ ID NO: 670038 - DNA, 14 bp, Homo sapiens
ttacaaagcagtta

SEQ ID NO: 670039 - DNA, 22 bp, Homo sapiens
ttacaagatattattaattttt

SEQ ID NO: 670040 - DNA, 21 bp, Homo sapiens
ttacaatattgattgggaaaa

SEQ ID NO: 670041 - DNA, 14 bp, Homo sapiens
ttacaatcaaatct

SEQ ID NO: 670042 - DNA, 16 bp, Homo sapiens
ttacaatcaaatctcc

SEQ ID NO: 670043 - DNA, 18 bp, Homo sapiens
ttacacttcatatagcat

SEQ ID NO: 670044 - DNA, 18 bp, Homo sapiens
ttacaggcaccgagaatg

SEQ ID NO: 670045 - DNA, 15 bp, Homo sapiens
ttacagggaagtggt

SEQ ID NO: 670046 - DNA, 19 bp, Homo sapiens
ttacaggtcctgctgaaac

SEQ ID NO: 670047 - DNA, 13 bp, Homo sapiens
ttacatccagagt

SEQ ID NO: 670048 - DNA, 13 bp, Homo sapiens
ttacatgcatttg

SEQ ID NO: 670049 - DNA, 18 bp, Homo sapiens
ttaccaatgtaacactgg

SEQ ID NO: 670050 - DNA, 19 bp, Homo sapiens
ttaccagatgctgactggc

SEQ ID NO: 670051 - DNA, 15 bp, Homo sapiens
ttaccatcatctctg

SEQ ID NO: 670052 - DNA, 16 bp, Homo sapiens
ttaccatcatctctga

SEQ ID NO: 670053 - DNA, 21 bp, Homo sapiens
ttacccatcagttccagcctt

SEQ ID NO: 670054 - DNA, 12 bp, Homo sapiens
ttacctggatta

SEQ ID NO: 670055 - DNA, 19 bp, Homo sapiens
ttaccttttttttttcttg

SEQ ID NO: 670056 - DNA, 16 bp, Homo sapiens
ttacgacccaggacaa

SEQ ID NO: 670057 - DNA, 16 bp, Homo sapiens
ttacggaggaacagat

SEQ ID NO: 670058 - DNA, 21 bp, Homo sapiens
ttactattaggaaaataaaca

SEQ ID NO: 670059 - DNA, 16 bp, Homo sapiens
ttactccataaacaga

SEQ ID NO: 670060 - DNA, 14 bp, Homo sapiens
ttactcctttttat

SEQ ID NO: 670061 - DNA, 20 bp, Homo sapiens
ttactgaataatatcaaata

SEQ ID NO: 670062 - DNA, 22 bp, Homo sapiens
ttactgaataatatcaaataaa

SEQ ID NO: 670063 - DNA, 15 bp, Homo sapiens
ttactgactcctcag

SEQ ID NO: 670064 - DNA, 22 bp, Homo sapiens
ttactgccctttcaaagcactt

SEQ ID NO: 670065 - DNA, 15 bp, Homo sapiens
ttacttgttttggat

SEQ ID NO: 670066 - DNA, 17 bp, Homo sapiens
ttactttaaaaagaaat

SEQ ID NO: 670067 - DNA, 20 bp, Homo sapiens
ttactttaacattttggaaa

SEQ ID NO: 670068 - DNA, 19 bp, Homo sapiens
ttactttaattactggaat

SEQ ID NO: 670069 - DNA, 13 bp, Homo sapiens
ttactttgctgag

SEQ ID NO: 670070 - DNA, 13 bp, Homo sapiens
ttactttttatgg

SEQ ID NO: 670071 - DNA, 16 bp, Homo sapiens
ttagaaaaaaattact

SEQ ID NO: 670072 - DNA, 12 bp, Homo sapiens
ttagaaaagtgg

SEQ ID NO: 670073 - DNA, 22 bp, Homo sapiens
ttagaaaagtggtgtaaacttg

SEQ ID NO: 670074 - DNA, 12 bp, Homo sapiens
ttagaaaatgtg

SEQ ID NO: 670075 - DNA, 12 bp, Homo sapiens
ttagaaactgaa

SEQ ID NO: 670076 - DNA, 16 bp, Homo sapiens
ttagaaactgaaaaat

SEQ ID NO: 670077 - DNA, 15 bp, Homo sapiens
ttagataaatattga

SEQ ID NO: 670078 - DNA, 18 bp, Homo sapiens
ttagatatttacatccag

SEQ ID NO: 670079 - DNA, 16 bp, Homo sapiens
ttagatgtaattttgt

SEQ ID NO: 670080 - DNA, 16 bp, Homo sapiens
ttagcaagcaactaat

SEQ ID NO: 670081 - DNA, 20 bp, Homo sapiens
ttagccatctaatgcttgtt

SEQ ID NO: 670082 - DNA, 16 bp, Homo sapiens
ttagcgtcaagacatt

SEQ ID NO: 670083 - DNA, 17 bp, Homo sapiens
ttagcgtcaagacattt

SEQ ID NO: 670084 - DNA, 18 bp, Homo sapiens
ttaggaaaatcactttgt

SEQ ID NO: 670085 - DNA, 20 bp, Homo sapiens
ttaggaactcactctttaga

SEQ ID NO: 670086 - DNA, 17 bp, Homo sapiens
ttaggaacttcagagat

SEQ ID NO: 670087 - DNA, 21 bp, Homo sapiens
ttaggcctggtgtgttcaaga

SEQ ID NO: 670088 - DNA, 14 bp, Homo sapiens
ttaggctgatgcca

SEQ ID NO: 670089 - DNA, 21 bp, Homo sapiens
ttaggctgtgtcaccattgtg

SEQ ID NO: 670090 - DNA, 23 bp, Homo sapiens
ttagggactacccatagacatga

SEQ ID NO: 670091 - DNA, 19 bp, Homo sapiens
ttaggggaaggagaagtaa

SEQ ID NO: 670092 - DNA, 15 bp, Homo sapiens
ttagtctgaaactgg

SEQ ID NO: 670093 - DNA, 19 bp, Homo sapiens
ttagtgtgacagtttccaa

SEQ ID NO: 670094 - DNA, 19 bp, Homo sapiens
ttagtttttggttgggaat

SEQ ID NO: 670095 - DNA, 23 bp, Homo sapiens
ttagtttttggttgggaatgagg

SEQ ID NO: 670096 - DNA, 18 bp, Homo sapiens
ttataaaattttgctttt

SEQ ID NO: 670097 - DNA, 19 bp, Homo sapiens
ttataaacagacaatatgt

SEQ ID NO: 670098 - DNA, 19 bp, Homo sapiens
ttataaataaactgttgct

SEQ ID NO: 670099 - DNA, 12 bp, Homo sapiens
ttataagcattg

SEQ ID NO: 670100 - DNA, 20 bp, Homo sapiens
ttataataaatatatacatt

SEQ ID NO: 670101 - DNA, 19 bp, Homo sapiens
ttataatgaagaacactgt

SEQ ID NO: 670102 - DNA, 21 bp, Homo sapiens
ttatactgacaataaaaatgt

SEQ ID NO: 670103 - DNA, 20 bp, Homo sapiens
ttatactgtatttctaagaa

SEQ ID NO: 670104 - DNA, 13 bp, Homo sapiens
ttatagacaaaag

SEQ ID NO: 670105 - DNA, 16 bp, Homo sapiens
ttatagacaaaagaat

SEQ ID NO: 670106 - DNA, 22 bp, Homo sapiens
ttatagacaaaagaataagaca

SEQ ID NO: 670107 - DNA, 18 bp, Homo sapiens
ttatagcaactaatgttt

SEQ ID NO: 670108 - DNA, 20 bp, Homo sapiens
ttatagcctggactgctacc

SEQ ID NO: 670109 - DNA, 23 bp, Homo sapiens
ttataggcctgtcccttgcctct

SEQ ID NO: 670110 - DNA, 17 bp, Homo sapiens
ttatagtgtttggacag

SEQ ID NO: 670111 - DNA, 12 bp, Homo sapiens
ttatatataata

SEQ ID NO: 670112 - DNA, 13 bp, Homo sapiens
ttatatataataa

SEQ ID NO: 670113 - DNA, 17 bp, Homo sapiens
ttatatataataaatac

SEQ ID NO: 670114 - DNA, 18 bp, Homo sapiens
ttatatataataaatact

SEQ ID NO: 670115 - DNA, 15 bp, Homo sapiens
ttatatcacacaata

SEQ ID NO: 670116 - DNA, 18 bp, Homo sapiens
ttatatcacacaatatag

SEQ ID NO: 670117 - DNA, 18 bp, Homo sapiens
ttatatcattctgggtgt

SEQ ID NO: 670118 - DNA, 21 bp, Homo sapiens
ttatatcgaaatagttacagg

SEQ ID NO: 670119 - DNA, 21 bp, Homo sapiens
ttatatctgggttaagtgttt

SEQ ID NO: 670120 - DNA, 20 bp, Homo sapiens
ttatatgctttattaatgtt

SEQ ID NO: 670121 - DNA, 15 bp, Homo sapiens
ttatatgtactttta

SEQ ID NO: 670122 - DNA, 19 bp, Homo sapiens
ttatattactgacatttct

SEQ ID NO: 670123 - DNA, 23 bp, Homo sapiens
ttatattcataaagttacagttt

SEQ ID NO: 670124 - DNA, 15 bp, Homo sapiens
ttatatttgtaggag

SEQ ID NO: 670125 - DNA, 13 bp, Homo sapiens
ttatcatggtcct

SEQ ID NO: 670126 - DNA, 20 bp, Homo sapiens
ttctttttattttgcactct

SEQ ID NO: 670127 - DNA, 22 bp, Homo sapiens
ttcttttttttttttttacagt

SEQ ID NO: 670128 - DNA, 16 bp, Homo sapiens
ttgaaaaaaaagtttt

SEQ ID NO: 670129 - DNA, 21 bp, Homo sapiens
ttgaaaaatgacaattgtgaa

SEQ ID NO: 670130 - DNA, 15 bp, Homo sapiens
ttgaaaatcttgtgt

SEQ ID NO: 670131 - DNA, 22 bp, Homo sapiens
ttgaacaggtcaaagatgtgtt

SEQ ID NO: 670132 - DNA, 18 bp, Homo sapiens
ttgaagaaggaaagaacc

SEQ ID NO: 670133 - DNA, 20 bp, Homo sapiens
ttgaaggcttaattgactga

SEQ ID NO: 670134 - DNA, 23 bp, Homo sapiens
ttgaagggctttattaaagaaat

SEQ ID NO: 670135 - DNA, 19 bp, Homo sapiens
ttgaagggtctttctcaaa

SEQ ID NO: 670136 - DNA, 20 bp, Homo sapiens
ttgaagtaacttatttgact

SEQ ID NO: 670137 - DNA, 14 bp, Homo sapiens
ttgaagtgcagctc

SEQ ID NO: 670138 - DNA, 15 bp, Homo sapiens
ttgaagtgcagctca

SEQ ID NO: 670139 - DNA, 19 bp, Homo sapiens
ttgaagtgcagctcatgtt

SEQ ID NO: 670140 - DNA, 15 bp, Homo sapiens
ttgaagtttgaacca

SEQ ID NO: 670141 - DNA, 14 bp, Homo sapiens
ttgaatgttaaagg

SEQ ID NO: 670142 - DNA, 22 bp, Homo sapiens
ttgacacttatagattgaaatt

SEQ ID NO: 670143 - DNA, 14 bp, Homo sapiens
ttgacagactattt

SEQ ID NO: 670144 - DNA, 21 bp, Homo sapiens
ttgacataggtcataaagcat

SEQ ID NO: 670145 - DNA, 23 bp, Homo sapiens
ttgacataggtcataaagcattg

SEQ ID NO: 670146 - DNA, 20 bp, Homo sapiens
ttgactaactcaaatacaca

SEQ ID NO: 670147 - DNA, 22 bp, Homo sapiens
ttgactaactcaaatacacatt

SEQ ID NO: 670148 - DNA, 13 bp, Homo sapiens
ttgactgaaatta

SEQ ID NO: 670149 - DNA, 17 bp, Homo sapiens
ttgactgatgattttcc

SEQ ID NO: 670150 - DNA, 17 bp, Homo sapiens
ttgagactcaaaaaaac

SEQ ID NO: 670151 - DNA, 22 bp, Homo sapiens
ttgagccatttaaagaccaata

SEQ ID NO: 670152 - DNA, 15 bp, Homo sapiens
ttgagccctggctgt

SEQ ID NO: 670153 - DNA, 22 bp, Homo sapiens
ttgaggtcaagtaagaagacat

SEQ ID NO: 670154 - DNA, 14 bp, Homo sapiens
ttgaggtttagcaa

SEQ ID NO: 670155 - DNA, 15 bp, Homo sapiens
ttgagtattgtttaa

SEQ ID NO: 670156 - DNA, 15 bp, Homo sapiens
ttgagtgtatgagta

SEQ ID NO: 670157 - DNA, 22 bp, Homo sapiens
ttgataatcttcaggtgaacac

SEQ ID NO: 670158 - DNA, 15 bp, Homo sapiens
ttgatagatgtttgg

SEQ ID NO: 670159 - DNA, 15 bp, Homo sapiens
ttgatattatattaa

SEQ ID NO: 670160 - DNA, 13 bp, Homo sapiens
ttgatctctcttg

SEQ ID NO: 670161 - DNA, 17 bp, Homo sapiens
ttgatctctcttgtcct

SEQ ID NO: 670162 - DNA, 22 bp, Homo sapiens
ttgatctctcttgtcctcttct

SEQ ID NO: 670163 - DNA, 15 bp, Homo sapiens
ttgatgactgctgat

SEQ ID NO: 670164 - DNA, 20 bp, Homo sapiens
ttgatgattttcatttcatg

SEQ ID NO: 670165 - DNA, 23 bp, Homo sapiens
ttgatgtacataactcctgtccc

SEQ ID NO: 670166 - DNA, 17 bp, Homo sapiens
ttgattgggaaaacatt

SEQ ID NO: 670167 - DNA, 20 bp, Homo sapiens
ttgatttcaaagttttgttg

SEQ ID NO: 670168 - DNA, 18 bp, Homo sapiens
ttgatttgattgggatga

SEQ ID NO: 670169 - DNA, 15 bp, Homo sapiens
ttgattttaatacat

SEQ ID NO: 670170 - DNA, 23 bp, Homo sapiens
ttgattttaatacattgatcagg

SEQ ID NO: 670171 - DNA, 14 bp, Homo sapiens
ttgatttttaagaa

SEQ ID NO: 670172 - DNA, 19 bp, Homo sapiens
ttgcaaagaactccagagt

SEQ ID NO: 670173 - DNA, 15 bp, Homo sapiens
ttgcaatttgagcca

SEQ ID NO: 670174 - DNA, 21 bp, Homo sapiens
ttgcaatttgagccatttaaa

SEQ ID NO: 670175 - DNA, 23 bp, Homo sapiens
ttgcaatttgagccatttaaaga

SEQ ID NO: 670176 - DNA, 19 bp, Homo sapiens
ttgcacaccattttgtaaa

SEQ ID NO: 670177 - DNA, 16 bp, Homo sapiens
ttgcagaactgtagct

SEQ ID NO: 670178 - DNA, 13 bp, Homo sapiens
ttgcagaagaggg

SEQ ID NO: 670179 - DNA, 22 bp, Homo sapiens
ttgcatattttgagaaactgct

SEQ ID NO: 670180 - DNA, 20 bp, Homo sapiens
ttgcatcactgtatcatttt

SEQ ID NO: 670181 - DNA, 18 bp, Homo sapiens
ttgcatctcaaaattatt

SEQ ID NO: 670182 - DNA, 17 bp, Homo sapiens
ttgcatgcatgcaaatg

SEQ ID NO: 670183 - DNA, 20 bp, Homo sapiens
ttgccaacagttgtatgttt

SEQ ID NO: 670184 - DNA, 16 bp, Homo sapiens
ttgccaggacatgcaa

SEQ ID NO: 670185 - DNA, 20 bp, Homo sapiens
ttgccatctgttcatttcta

SEQ ID NO: 670186 - DNA, 13 bp, Homo sapiens
ttgcccccagtgc

SEQ ID NO: 670187 - DNA, 14 bp, Homo sapiens
ttgccccctctcac

SEQ ID NO: 670188 - DNA, 15 bp, Homo sapiens
ttgccccctctcact

SEQ ID NO: 670189 - DNA, 16 bp, Homo sapiens
ttgccccctctcactt

SEQ ID NO: 670190 - DNA, 14 bp, Homo sapiens
ttgcccctggcttt

SEQ ID NO: 670191 - DNA, 15 bp, Homo sapiens
ttgccgctgtataaa

SEQ ID NO: 670192 - DNA, 12 bp, Homo sapiens
ttgcctccaggt

SEQ ID NO: 670193 - DNA, 19 bp, Homo sapiens
ttgcctctgccctggattg

SEQ ID NO: 670194 - DNA, 12 bp, Homo sapiens
ttgcctcttctt

SEQ ID NO: 670195 - DNA, 15 bp, Homo sapiens
ttgcctcttctttgt

SEQ ID NO: 670196 - DNA, 13 bp, Homo sapiens
ttgctaaactgat

SEQ ID NO: 670197 - DNA, 18 bp, Homo sapiens
ttgctaatcaaagccagg

SEQ ID NO: 670198 - DNA, 21 bp, Homo sapiens
ttgctaatcaaagccagggtc

SEQ ID NO: 670199 - DNA, 15 bp, Homo sapiens
ttgctaatgtataat

SEQ ID NO: 670200 - DNA, 17 bp, Homo sapiens
ttgctatgtaagggtct

SEQ ID NO: 670201 - DNA, 16 bp, Homo sapiens
ttgctatgttactatt

SEQ ID NO: 670202 - DNA, 21 bp, Homo sapiens
ttgctatgttactattttcta

SEQ ID NO: 670203 - DNA, 23 bp, Homo sapiens
ttgctcagagaaggaaaagactg

SEQ ID NO: 670204 - DNA, 13 bp, Homo sapiens
ttgctctctgtga

SEQ ID NO: 670205 - DNA, 11 bp, Homo sapiens
ttgctctttca

SEQ ID NO: 670206 - DNA, 15 bp, Homo sapiens
ttgctgaactcagca

SEQ ID NO: 670207 - DNA, 16 bp, Homo sapiens
ttgcttgagcaggatt

SEQ ID NO: 670208 - DNA, 19 bp, Homo sapiens
ttgcttgcctgcagggcca

SEQ ID NO: 670209 - DNA, 14 bp, Homo sapiens
ttgcttttaattaa

SEQ ID NO: 670210 - DNA, 11 bp, Homo sapiens
ttggaaattcc

SEQ ID NO: 670211 - DNA, 18 bp, Homo sapiens
ttggaaattcctgtactg

SEQ ID NO: 670212 - DNA, 15 bp, Homo sapiens
ttggaaattgttgta

SEQ ID NO: 670213 - DNA, 15 bp, Homo sapiens
ttggaactgcaatga

SEQ ID NO: 670214 - DNA, 20 bp, Homo sapiens
ttggaagtgaaaactttgta

SEQ ID NO: 670215 - DNA, 15 bp, Homo sapiens
ttggactacacaata

SEQ ID NO: 670216 - DNA, 20 bp, Homo sapiens
ttggagccccaggggacaag

SEQ ID NO: 670217 - DNA, 15 bp, Homo sapiens
ttggagtcactgcca

SEQ ID NO: 670218 - DNA, 21 bp, Homo sapiens
ttggcaaacgagactttctcc

SEQ ID NO: 670219 - DNA, 16 bp, Homo sapiens
ttggcacatgccacct

SEQ ID NO: 670220 - DNA, 20 bp, Homo sapiens
ttggcaccatggtatcatat

SEQ ID NO: 670221 - DNA, 14 bp, Homo sapiens
ttggccctttcctt

SEQ ID NO: 670222 - DNA, 16 bp, Homo sapiens
ttgggaaaacatgtta

SEQ ID NO: 670223 - DNA, 15 bp, Homo sapiens
ttggggcccagtgca

SEQ ID NO: 670224 - DNA, 14 bp, Homo sapiens
ttggtaaatgtttc

SEQ ID NO: 670225 - DNA, 21 bp, Homo sapiens
ttggtattatataattcaagg

SEQ ID NO: 670226 - DNA, 18 bp, Homo sapiens
ttggtctgccttctgctg

SEQ ID NO: 670227 - DNA, 18 bp, Homo sapiens
ttggtgccctcgcctcct

SEQ ID NO: 670228 - DNA, 14 bp, Homo sapiens
ttggtgtgccctgt

SEQ ID NO: 670229 - DNA, 17 bp, Homo sapiens
ttggtgtgccctgtgtg

SEQ ID NO: 670230 - DNA, 22 bp, Homo sapiens
ttggttaaaactgtacatttaa

SEQ ID NO: 670231 - DNA, 18 bp, Homo sapiens
ttggttcgatacctggag

SEQ ID NO: 670232 - DNA, 22 bp, Homo sapiens
ttggttgggaatgaggaaaatt

SEQ ID NO: 670233 - DNA, 17 bp, Homo sapiens
ttggttttcctgtggca

SEQ ID NO: 670234 - DNA, 22 bp, Homo sapiens
ttgtaaaaatcttttgaagcat

SEQ ID NO: 670235 - DNA, 18 bp, Homo sapiens
ttgtaaaacttctgctcg

SEQ ID NO: 670236 - DNA, 17 bp, Homo sapiens
ttgtaaaagcattttgt

SEQ ID NO: 670237 - DNA, 20 bp, Homo sapiens
ttgtaaatgaaacttaagaa

SEQ ID NO: 670238 - DNA, 19 bp, Homo sapiens
ttgtaaatttcagggtttt

SEQ ID NO: 670239 - DNA, 15 bp, Homo sapiens
ttgtaataataaaga

SEQ ID NO: 670240 - DNA, 20 bp, Homo sapiens
ttgtacaaaattaagcaaat

SEQ ID NO: 670241 - DNA, 19 bp, Homo sapiens
ttgtacatacgatttaagg

SEQ ID NO: 670242 - DNA, 15 bp, Homo sapiens
ttgtacttaaatggt

SEQ ID NO: 670243 - DNA, 19 bp, Homo sapiens
ttgtagcagattgtttcct

SEQ ID NO: 670244 - DNA, 14 bp, Homo sapiens
ttgtagcataactg

SEQ ID NO: 670245 - DNA, 16 bp, Homo sapiens
ttgtatatcactaaaa

SEQ ID NO: 670246 - DNA, 15 bp, Homo sapiens
tttgtgcctttggcc

SEQ ID NO: 670247 - DNA, 18 bp, Homo sapiens
tttgtgtaaatttctcaa

SEQ ID NO: 670248 - DNA, 19 bp, Homo sapiens
tttgttatatataataaat

SEQ ID NO: 670249 - DNA, 17 bp, Homo sapiens
tttgtttctttctctga

SEQ ID NO: 670250 - DNA, 15 bp, Homo sapiens
tttgttttgctgaga

SEQ ID NO: 670251 - DNA, 18 bp, Homo sapiens
ttttaaaaactcttcagt

SEQ ID NO: 670252 - DNA, 18 bp, Homo sapiens
ttttaaaaagagtaattt

SEQ ID NO: 670253 - DNA, 20 bp, Homo sapiens
ttttaaaactggacctgtat

SEQ ID NO: 670254 - DNA, 19 bp, Homo sapiens
ttttaaaaggtagagtctt

SEQ ID NO: 670255 - DNA, 24 bp, Homo sapiens
ttttaaaaggtagagtcttacaat

SEQ ID NO: 670256 - DNA, 22 bp, Homo sapiens
ttttaaaatgtcttggtcttct

SEQ ID NO: 670257 - DNA, 15 bp, Homo sapiens
ttttaaagaagcttt

SEQ ID NO: 670258 - DNA, 16 bp, Homo sapiens
ttttaaagaagcttta

SEQ ID NO: 670259 - DNA, 22 bp, Homo sapiens
ttttaaccggtaagagtttcag

SEQ ID NO: 670260 - DNA, 12 bp, Homo sapiens
ttttaactcacc

SEQ ID NO: 670261 - DNA, 18 bp, Homo sapiens
ttttaactttaatacagc

SEQ ID NO: 670262 - DNA, 18 bp, Homo sapiens
ttttaagaaagtaattta

SEQ ID NO: 670263 - DNA, 23 bp, Homo sapiens
ttttaagaaagtaatttaatttg

SEQ ID NO: 670264 - DNA, 12 bp, Homo sapiens
ttttaataaact

SEQ ID NO: 670265 - DNA, 20 bp, Homo sapiens
ttttaatattcttttgtttc

SEQ ID NO: 670266 - DNA, 22 bp, Homo sapiens
ttttaatattcttttgtttcca

SEQ ID NO: 670267 - DNA, 14 bp, Homo sapiens
ttttaatttaaaaa

SEQ ID NO: 670268 - DNA, 12 bp, Homo sapiens
ttttaatttaac

SEQ ID NO: 670269 - DNA, 17 bp, Homo sapiens
ttttaatttaacatgaa

SEQ ID NO: 670270 - DNA, 18 bp, Homo sapiens
ttttaatttacttgtttt

SEQ ID NO: 670271 - DNA, 23 bp, Homo sapiens
ttttaggtcaagggcttactatt

SEQ ID NO: 670272 - DNA, 18 bp, Homo sapiens
ttttataaataaactgtt

SEQ ID NO: 670273 - DNA, 23 bp, Homo sapiens
ttttatatcattttaaaatgtct

SEQ ID NO: 670274 - DNA, 13 bp, Homo sapiens
ttttatatgcttt

SEQ ID NO: 670275 - DNA, 19 bp, Homo sapiens
ttttatattactgacattt

SEQ ID NO: 670276 - DNA, 13 bp, Homo sapiens
ttttatatttgta

SEQ ID NO: 670277 - DNA, 19 bp, Homo sapiens
ttttatcattaaaaattac

SEQ ID NO: 670278 - DNA, 15 bp, Homo sapiens
ttttatccttacaat

SEQ ID NO: 670279 - DNA, 20 bp, Homo sapiens
ttttatccttacaatgtgaa

SEQ ID NO: 670280 - DNA, 23 bp, Homo sapiens
ttttatcgtttttgtattttcat

SEQ ID NO: 670281 - DNA, 21 bp, Homo sapiens
ttttatgaagtgcgtgaatgt

SEQ ID NO: 670282 - DNA, 22 bp, Homo sapiens
ttttatggtggaaaagaactgt

SEQ ID NO: 670283 - DNA, 13 bp, Homo sapiens
ttttattgttgta

SEQ ID NO: 670284 - DNA, 18 bp, Homo sapiens
ttttatttggtgtgttcg

SEQ ID NO: 670285 - DNA, 17 bp, Homo sapiens
ttttcaaaaggtattat

SEQ ID NO: 670286 - DNA, 18 bp, Homo sapiens
ttttcaccgagcagaggt

SEQ ID NO: 670287 - DNA, 11 bp, Homo sapiens
ttttcatcctt

SEQ ID NO: 670288 - DNA, 18 bp, Homo sapiens
ttttcatttcatgaaaat

SEQ ID NO: 670289 - DNA, 18 bp, Homo sapiens
ttttccatgatttagcaa

SEQ ID NO: 670290 - DNA, 16 bp, Homo sapiens
ttttcccccttcccat

SEQ ID NO: 670291 - DNA, 14 bp, Homo sapiens
ttttctcccaagaa

SEQ ID NO: 670292 - DNA, 22 bp, Homo sapiens
ttttctgtaatcttttatttaa

SEQ ID NO: 670293 - DNA, 14 bp, Homo sapiens
ttttctgtaatgta

SEQ ID NO: 670294 - DNA, 23 bp, Homo sapiens
ttttcttgggaattgaaaaaaat

SEQ ID NO: 670295 - DNA, 19 bp, Homo sapiens
ttttctttcccatgtattt

SEQ ID NO: 670296 - DNA, 11 bp, Homo sapiens
ttttgaagtgt

SEQ ID NO: 670297 - DNA, 16 bp, Homo sapiens
ttttgaatatgcctta

SEQ ID NO: 670298 - DNA, 20 bp, Homo sapiens
ttttgacagccttcttgatg

SEQ ID NO: 670299 - DNA, 13 bp, Homo sapiens
ttttgagaaactg

SEQ ID NO: 670300 - DNA, 14 bp, Homo sapiens
ttttgagatgtaaa

SEQ ID NO: 670301 - DNA, 15 bp, Homo sapiens
ttttgatatatgaaa

SEQ ID NO: 670302 - DNA, 13 bp, Homo sapiens
ttttgcagaagag

SEQ ID NO: 670303 - DNA, 15 bp, Homo sapiens
ttttgcttgcaatgt

SEQ ID NO: 670304 - DNA, 16 bp, Homo sapiens
ttttgcttgcaatgta

SEQ ID NO: 670305 - DNA, 17 bp, Homo sapiens
ttttggactccatctct

SEQ ID NO: 670306 - DNA, 17 bp, Homo sapiens
ttttggacttcaaagca

SEQ ID NO: 670307 - DNA, 18 bp, Homo sapiens
ttttggatggtgttacat

SEQ ID NO: 670308 - DNA, 18 bp, Homo sapiens
ttttggcctgtgatgttt

SEQ ID NO: 670309 - DNA, 16 bp, Homo sapiens
ttttggggagccagaa

SEQ ID NO: 670310 - DNA, 17 bp, Homo sapiens
ttttggtagagaaggag

SEQ ID NO: 670311 - DNA, 19 bp, Homo sapiens
ttttggtgtgccctgtgtg

SEQ ID NO: 670312 - DNA, 14 bp, Homo sapiens
ttttgtatgttaaa

SEQ ID NO: 670313 - DNA, 15 bp, Homo sapiens
ttttgtggaggggag

SEQ ID NO: 670314 - DNA, 16 bp, Homo sapiens
ttttgtgtaggtgtct

SEQ ID NO: 670315 - DNA, 14 bp, Homo sapiens
ttttgtgtgaaatt

SEQ ID NO: 670316 - DNA, 14 bp, Homo sapiens
ttttgttgctttct

SEQ ID NO: 670317 - DNA, 14 bp, Homo sapiens
ttttgtttccatgg

SEQ ID NO: 670318 - DNA, 15 bp, Homo sapiens
ttttgtttgccagga

SEQ ID NO: 670319 - DNA, 16 bp, Homo sapiens
ttttgttttaaaactg

SEQ ID NO: 670320 - DNA, 13 bp, Homo sapiens
tttttaaaaacct

SEQ ID NO: 670321 - DNA, 12 bp, Homo sapiens
tttttaactgat

SEQ ID NO: 670322 - DNA, 23 bp, Homo sapiens
tttttaactgattcttatgatta

SEQ ID NO: 670323 - DNA, 20 bp, Homo sapiens
tttttaagaaagtaatttaa

SEQ ID NO: 670324 - DNA, 21 bp, Homo sapiens
tttttaagaaagtaatttaat

SEQ ID NO: 670325 - DNA, 14 bp, Homo sapiens
tttttaagaatatt

SEQ ID NO: 670326 - DNA, 14 bp, Homo sapiens
tttttaggcaaaga

SEQ ID NO: 670327 - DNA, 16 bp, Homo sapiens
tttttaggcaaagata

SEQ ID NO: 670328 - DNA, 23 bp, Homo sapiens
tttttagttgccaacagttgtat

SEQ ID NO: 670329 - DNA, 15 bp, Homo sapiens
tttttataccattca

SEQ ID NO: 670330 - DNA, 16 bp, Homo sapiens
tttttatgctatttct

SEQ ID NO: 670331 - DNA, 14 bp, Homo sapiens
tttttattaattta

SEQ ID NO: 670332 - DNA, 13 bp, Homo sapiens
tttttattgtaaa

SEQ ID NO: 670333 - DNA, 19 bp, Homo sapiens
tttttcaagttgtaaataa

SEQ ID NO: 670334 - DNA, 13 bp, Homo sapiens
tttttcataaaca

SEQ ID NO: 670335 - DNA, 14 bp, Homo sapiens
tttttcttcgctgg

SEQ ID NO: 670336 - DNA, 12 bp, Homo sapiens
ttttttaagctt

SEQ ID NO: 670337 - DNA, 15 bp, Homo sapiens
ttttttaagcttcag

SEQ ID NO: 670338 - DNA, 23 bp, Homo sapiens
ttttttaagcttcagttgcttgt

SEQ ID NO: 670339 - DNA, 12 bp, Homo sapiens
ttttttaattta

SEQ ID NO: 670340 - DNA, 17 bp, Homo sapiens
ttttttactctttgaaa

SEQ ID NO: 670341 - DNA, 17 bp, Homo sapiens
ttttttctgtaatgtaa

SEQ ID NO: 670342 - DNA, 20 bp, Homo sapiens
ttttttctttcccatgtatt

SEQ ID NO: 670343 - DNA, 13 bp, Homo sapiens
ttttttgatatat

SEQ ID NO: 670344 - DNA, 22 bp, Homo sapiens
ttttttggtgtgccctgtgtgt

SEQ ID NO: 670345 - DNA, 13 bp, Homo sapiens
ttttttgtatatt

SEQ ID NO: 670346 - DNA, 12 bp, Homo sapiens
tttttttctatt

SEQ ID NO: 670347 - DNA, 14 bp, Homo sapiens
aacacattttaaat

SEQ ID NO: 670348 - DNA, 21 bp, Homo sapiens
aacaccaggtttatggaaaat

SEQ ID NO: 670349 - DNA, 14 bp, Homo sapiens
aacacccttagaaa

SEQ ID NO: 670350 - DNA, 15 bp, Homo sapiens
aacacccttagaaaa

SEQ ID NO: 670351 - DNA, 23 bp, Homo sapiens
aacactagggccttggaaattcc

SEQ ID NO: 670352 - DNA, 19 bp, Homo sapiens
aacactccattattcctct

SEQ ID NO: 670353 - DNA, 14 bp, Homo sapiens
aacactgaaatgaa

SEQ ID NO: 670354 - DNA, 12 bp, Homo sapiens
aacagaacaggg

SEQ ID NO: 670355 - DNA, 14 bp, Homo sapiens
aacagaacagggtc

SEQ ID NO: 670356 - DNA, 21 bp, Homo sapiens
aacagacaatatgtgagtgcc

SEQ ID NO: 670357 - DNA, 13 bp, Homo sapiens
aacagatttggaa

SEQ ID NO: 670358 - DNA, 15 bp, Homo sapiens
aacagatttggaaag

SEQ ID NO: 670359 - DNA, 20 bp, Homo sapiens
aacagcgaagtagcttgctc

SEQ ID NO: 670360 - DNA, 13 bp, Homo sapiens
aacaggacagcac

SEQ ID NO: 670361 - DNA, 20 bp, Homo sapiens
aacaggaggtgtgaatgcac

SEQ ID NO: 670362 - DNA, 15 bp, Homo sapiens
aacataaaaactgat

SEQ ID NO: 670363 - DNA, 17 bp, Homo sapiens
aacatacaagaaaatgt

SEQ ID NO: 670364 - DNA, 16 bp, Homo sapiens
aacatacataatacaa

SEQ ID NO: 670365 - DNA, 20 bp, Homo sapiens
aacatgaacacccttagaaa

SEQ ID NO: 670366 - DNA, 22 bp, Homo sapiens
aacatgaacacccttagaaaat

SEQ ID NO: 670367 - DNA, 16 bp, Homo sapiens
aacatgcactgatgtt

SEQ ID NO: 670368 - DNA, 13 bp, Homo sapiens
aacatggctttga

SEQ ID NO: 670369 - DNA, 21 bp, Homo sapiens
aacatgggagcttattgctaa

SEQ ID NO: 670370 - DNA, 20 bp, Homo sapiens
aacatgtactacagctatat

SEQ ID NO: 670371 - DNA, 21 bp, Homo sapiens
aacattggcacatgccacctg

SEQ ID NO: 670372 - DNA, 13 bp, Homo sapiens
aacatttatgtga

SEQ ID NO: 670373 - DNA, 13 bp, Homo sapiens
aacatttgctgcc

SEQ ID NO: 670374 - DNA, 16 bp, Homo sapiens
aacatttgctgtcagc

SEQ ID NO: 670375 - DNA, 23 bp, Homo sapiens
aacattttatcattaaaaattac

SEQ ID NO: 670376 - DNA, 16 bp, Homo sapiens
aacattttggaaattg

SEQ ID NO: 670377 - DNA, 14 bp, Homo sapiens
aaccaaatacctca

SEQ ID NO: 670378 - DNA, 15 bp, Homo sapiens
aaccaaatacctcaa

SEQ ID NO: 670379 - DNA, 18 bp, Homo sapiens
aaccactaacattgtgac

SEQ ID NO: 670380 - DNA, 18 bp, Homo sapiens
aaccagagtcagcacagg

SEQ ID NO: 670381 - DNA, 15 bp, Homo sapiens
aaccaggaaatggaa

SEQ ID NO: 670382 - DNA, 19 bp, Homo sapiens
aacccacctctcctgccct

SEQ ID NO: 670383 - DNA, 16 bp, Homo sapiens
aacccagagctgtatt

SEQ ID NO: 670384 - DNA, 23 bp, Homo sapiens
aacccattaaggggaagaatgaa

SEQ ID NO: 670385 - DNA, 17 bp, Homo sapiens
aaccctgagagtctgag

SEQ ID NO: 670386 - DNA, 17 bp, Homo sapiens
aacctagtactgccccc

SEQ ID NO: 670387 - DNA, 18 bp, Homo sapiens
aacctcacctcccgggtt

SEQ ID NO: 670388 - DNA, 18 bp, Homo sapiens
aacctcagattcttcatt

SEQ ID NO: 670389 - DNA, 19 bp, Homo sapiens
aacctcagggctcccaggg

SEQ ID NO: 670390 - DNA, 20 bp, Homo sapiens
aacctgactcaattatttgc

SEQ ID NO: 670391 - DNA, 20 bp, Homo sapiens
aacctggtctctacataaaa

SEQ ID NO: 670392 - DNA, 23 bp, Homo sapiens
aacctgtcctaaggaaccttcct

SEQ ID NO: 670393 - DNA, 16 bp, Homo sapiens
aacctgttcaggcagg

SEQ ID NO: 670394 - DNA, 19 bp, Homo sapiens
aaccttccttcctgcttga

SEQ ID NO: 670395 - DNA, 15 bp, Homo sapiens
aaccttgctctcctc

SEQ ID NO: 670396 - DNA, 21 bp, Homo sapiens
aaccttgctctcctcatctcc

SEQ ID NO: 670397 - DNA, 11 bp, Homo sapiens
aacctttgcta

SEQ ID NO: 670398 - DNA, 19 bp, Homo sapiens
aacctttgctatgtaaggg

SEQ ID NO: 670399 - DNA, 16 bp, Homo sapiens
aacgaagagttccctt

SEQ ID NO: 670400 - DNA, 18 bp, Homo sapiens
aactaaataccattcact

SEQ ID NO: 670401 - DNA, 21 bp, Homo sapiens
aactaccactttttttaacca

SEQ ID NO: 670402 - DNA, 22 bp, Homo sapiens
aactaccactttttttaaccat

SEQ ID NO: 670403 - DNA, 17 bp, Homo sapiens
aactatgttcctaacaa

SEQ ID NO: 670404 - DNA, 20 bp, Homo sapiens
aactatgttcctaacaaaat

SEQ ID NO: 670405 - DNA, 12 bp, Homo sapiens
aactatttactt

SEQ ID NO: 670406 - DNA, 22 bp, Homo sapiens
aactatttatatcacacaatat

SEQ ID NO: 670407 - DNA, 14 bp, Homo sapiens
aactcaacatttgt

SEQ ID NO: 670408 - DNA, 24 bp, Homo sapiens
aactcatcctcttttaatggcatt

SEQ ID NO: 670409 - DNA, 15 bp, Homo sapiens
aactcattcatagga

SEQ ID NO: 670410 - DNA, 16 bp, Homo sapiens
aactccaggccctcct

SEQ ID NO: 670411 - DNA, 14 bp, Homo sapiens
aactcctgtccctt

SEQ ID NO: 670412 - DNA, 17 bp, Homo sapiens
aactcctgtcccttttc

SEQ ID NO: 670413 - DNA, 13 bp, Homo sapiens
aactcctttctta

SEQ ID NO: 670414 - DNA, 18 bp, Homo sapiens
aactcctttcttatcttg

SEQ ID NO: 670415 - DNA, 15 bp, Homo sapiens
aactctaatagtgct

SEQ ID NO: 670416 - DNA, 15 bp, Homo sapiens
aactctgcatgtaga

SEQ ID NO: 670417 - DNA, 11 bp, Homo sapiens
aactcttcagt

SEQ ID NO: 670418 - DNA, 22 bp, Homo sapiens
aactcttcagtgcaaattgtat

SEQ ID NO: 670419 - DNA, 15 bp, Homo sapiens
aactgacaaagatgc

SEQ ID NO: 670420 - DNA, 22 bp, Homo sapiens
aactgacgattcttaatcaaga

SEQ ID NO: 670421 - DNA, 17 bp, Homo sapiens
aactgcaagttcatttt

SEQ ID NO: 670422 - DNA, 14 bp, Homo sapiens
aactgcaatgaaag

SEQ ID NO: 670423 - DNA, 21 bp, Homo sapiens
aactgcaatgaaagtcaaatt

SEQ ID NO: 670424 - DNA, 22 bp, Homo sapiens
aactgcaatgaaagtcaaattt

SEQ ID NO: 670425 - DNA, 15 bp, Homo sapiens
aactgcagctctcca

SEQ ID NO: 670426 - DNA, 17 bp, Homo sapiens
aactgccaggctgcctc

SEQ ID NO: 670427 - DNA, 18 bp, Homo sapiens
aactgccaggctgcctcc

SEQ ID NO: 670428 - DNA, 13 bp, Homo sapiens
aactgctgcagat

SEQ ID NO: 670429 - DNA, 22 bp, Homo sapiens
aactgcttcccttactttgctg

SEQ ID NO: 670430 - DNA, 23 bp, Homo sapiens
aactgcttcccttactttgctga

SEQ ID NO: 670431 - DNA, 16 bp, Homo sapiens
aactggagttccttat

SEQ ID NO: 670432 - DNA, 13 bp, Homo sapiens
aactggcttcccc

SEQ ID NO: 670433 - DNA, 18 bp, Homo sapiens
aactgtagctcaagttta

SEQ ID NO: 670434 - DNA, 23 bp, Homo sapiens
aactgtagctcaagtttaaaagc

SEQ ID NO: 670435 - DNA, 19 bp, Homo sapiens
aactgtatgtgtgtaggtt

SEQ ID NO: 670436 - DNA, 16 bp, Homo sapiens
aactgtgatttcagga

SEQ ID NO: 670437 - DNA, 13 bp, Homo sapiens
aacttaagaattg

SEQ ID NO: 670438 - DNA, 15 bp, Homo sapiens
aacttaagaattgaa

SEQ ID NO: 670439 - DNA, 11 bp, Homo sapiens
aacttagaaaa

SEQ ID NO: 670440 - DNA, 22 bp, Homo sapiens
aacttctgcaacaagcatgcag

SEQ ID NO: 670441 - DNA, 16 bp, Homo sapiens
aacttgactccatttc

SEQ ID NO: 670442 - DNA, 18 bp, Homo sapiens
aacttgtaatcttcccca

SEQ ID NO: 670443 - DNA, 14 bp, Homo sapiens
aactttaatacagc

SEQ ID NO: 670444 - DNA, 18 bp, Homo sapiens
aactttgtaaaaatcttt

SEQ ID NO: 670445 - DNA, 16 bp, Homo sapiens
aacttttttgtggcaa

SEQ ID NO: 670446 - DNA, 15 bp, Homo sapiens
aagaaaaaaatacta

SEQ ID NO: 670447 - DNA, 22 bp, Homo sapiens
aagaaaaaaatactatttaaga

SEQ ID NO: 670448 - DNA, 14 bp, Homo sapiens
aagaaaatctttgt

SEQ ID NO: 670449 - DNA, 14 bp, Homo sapiens
aagaaaattgagtt

SEQ ID NO: 670450 - DNA, 19 bp, Homo sapiens
aagaaacagatctcctggc

SEQ ID NO: 670451 - DNA, 13 bp, Homo sapiens
aagaaacttttct

SEQ ID NO: 670452 - DNA, 14 bp, Homo sapiens
aagaaattaatatg

SEQ ID NO: 670453 - DNA, 22 bp, Homo sapiens
aagaacctacagactccatctc

SEQ ID NO: 670454 - DNA, 23 bp, Homo sapiens
aagaacctacagactccatctct

SEQ ID NO: 670455 - DNA, 15 bp, Homo sapiens
aagaacttactgatt

SEQ ID NO: 670456 - DNA, 11 bp, Homo sapiens
aagaagacata

SEQ ID NO: 670457 - DNA, 16 bp, Homo sapiens
aagaagacatgaacca

SEQ ID NO: 670458 - DNA, 13 bp, Homo sapiens
aagaagacatttt

SEQ ID NO: 670459 - DNA, 18 bp, Homo sapiens
aagaataaaaacttttga

SEQ ID NO: 670460 - DNA, 20 bp, Homo sapiens
aagaataaaaacttttgagg

SEQ ID NO: 670461 - DNA, 18 bp, Homo sapiens
aagaatagcattgtaaaa

SEQ ID NO: 670462 - DNA, 17 bp, Homo sapiens
aagaatagctttaatga

SEQ ID NO: 670463 - DNA, 19 bp, Homo sapiens
aagcttcaaagtttatatg

SEQ ID NO: 670464 - DNA, 18 bp, Homo sapiens
aagcttcaaattaaaaca

SEQ ID NO: 670465 - DNA, 21 bp, Homo sapiens
aagctttcctgtttccagggt

SEQ ID NO: 670466 - DNA, 12 bp, Homo sapiens
aaggaaccttcc

SEQ ID NO: 670467 - DNA, 13 bp, Homo sapiens
aaggaataaatga

SEQ ID NO: 670468 - DNA, 14 bp, Homo sapiens
aaggaatttgatga

SEQ ID NO: 670469 - DNA, 16 bp, Homo sapiens
aaggagttacagggaa

SEQ ID NO: 670470 - DNA, 19 bp, Homo sapiens
aaggatgacttttttatac

SEQ ID NO: 670471 - DNA, 12 bp, Homo sapiens
aaggcagctgcc

SEQ ID NO: 670472 - DNA, 18 bp, Homo sapiens
aaggcagctgcctctgct

SEQ ID NO: 670473 - DNA, 19 bp, Homo sapiens
aaggcagctgcctctgctc

SEQ ID NO: 670474 - DNA, 23 bp, Homo sapiens
aaggcagctgcctctgctccctc

SEQ ID NO: 670475 - DNA, 16 bp, Homo sapiens
aaggcaggaggatcac

SEQ ID NO: 670476 - DNA, 19 bp, Homo sapiens
aaggcaggtgggcagacag

SEQ ID NO: 670477 - DNA, 15 bp, Homo sapiens
aaggcccactgtaat

SEQ ID NO: 670478 - DNA, 20 bp, Homo sapiens
aaggcttaattgactgaaat

SEQ ID NO: 670479 - DNA, 15 bp, Homo sapiens
aagggaaagtttttt

SEQ ID NO: 670480 - DNA, 13 bp, Homo sapiens
aagggataaagaa

SEQ ID NO: 670481 - DNA, 15 bp, Homo sapiens
aagggatggaaaagg

SEQ ID NO: 670482 - DNA, 20 bp, Homo sapiens
aagggatggaaaaggaagac

SEQ ID NO: 670483 - DNA, 21 bp, Homo sapiens
aagggatggaaaaggaagact

SEQ ID NO: 670484 - DNA, 14 bp, Homo sapiens
aagggcttactatt

SEQ ID NO: 670485 - DNA, 19 bp, Homo sapiens
aagggtgggtgctcagaat

SEQ ID NO: 670486 - DNA, 13 bp, Homo sapiens
aaggtaatgtgtg

SEQ ID NO: 670487 - DNA, 18 bp, Homo sapiens
aaggtacaactgtattta

SEQ ID NO: 670488 - DNA, 20 bp, Homo sapiens
aaggtacaactgtatttatt

SEQ ID NO: 670489 - DNA, 19 bp, Homo sapiens
aaggtactttcatatttta

SEQ ID NO: 670490 - DNA, 22 bp, Homo sapiens
aaggtactttcatattttaaac

SEQ ID NO: 670491 - DNA, 15 bp, Homo sapiens
aaggtataataaaat

SEQ ID NO: 670492 - DNA, 16 bp, Homo sapiens
aaggtataataaaatt

SEQ ID NO: 670493 - DNA, 12 bp, Homo sapiens
aaggtgaaacag

SEQ ID NO: 670494 - DNA, 21 bp, Homo sapiens
aaggtgacttcctctggtgtt

SEQ ID NO: 670495 - DNA, 21 bp, Homo sapiens
aataggctgatgggcaaaaaa

SEQ ID NO: 670496 - DNA, 18 bp, Homo sapiens
aatagtgtcatataaact

SEQ ID NO: 670497 - DNA, 19 bp, Homo sapiens
aatagttagatctttgtaa

SEQ ID NO: 670498 - DNA, 23 bp, Homo sapiens
aatagttagatctttgtaaatgc

SEQ ID NO: 670499 - DNA, 18 bp, Homo sapiens
aatagtttgtctatttta

SEQ ID NO: 670500 - DNA, 19 bp, Homo sapiens
aatagtttgtctattttaa

SEQ ID NO: 670501 - DNA, 12 bp, Homo sapiens
aatataaaatta

SEQ ID NO: 670502 - DNA, 16 bp, Homo sapiens
aatataagacatttgt

SEQ ID NO: 670503 - DNA, 17 bp, Homo sapiens
aatataagacatttgtt

SEQ ID NO: 670504 - DNA, 13 bp, Homo sapiens
aatataatgtatt

SEQ ID NO: 670505 - DNA, 17 bp, Homo sapiens
aatataatgtattttct

SEQ ID NO: 670506 - DNA, 17 bp, Homo sapiens
aatataatttataagca

SEQ ID NO: 670507 - DNA, 20 bp, Homo sapiens
aatataatttataagcattg

SEQ ID NO: 670508 - DNA, 17 bp, Homo sapiens
aatatacattttctaaa

SEQ ID NO: 670509 - DNA, 18 bp, Homo sapiens
aatatacattttctaaat

SEQ ID NO: 670510 - DNA, 18 bp, Homo sapiens
aatataggtcctgtgtta

SEQ ID NO: 670511 - DNA, 16 bp, Homo sapiens
aatatatattaagtgt

SEQ ID NO: 670512 - DNA, 13 bp, Homo sapiens
aatatatcttaag

SEQ ID NO: 670513 - DNA, 18 bp, Homo sapiens
aatatatgattctagtgt

SEQ ID NO: 670514 - DNA, 16 bp, Homo sapiens
actcacctaatgttta

SEQ ID NO: 670515 - DNA, 19 bp, Homo sapiens
actcacgtgggtcctgagg

SEQ ID NO: 670516 - DNA, 21 bp, Homo sapiens
actcagagaaaaatgctcccc

SEQ ID NO: 670517 - DNA, 12 bp, Homo sapiens
actcaggccaca

SEQ ID NO: 670518 - DNA, 14 bp, Homo sapiens
actcaggccacagt

SEQ ID NO: 670519 - DNA, 11 bp, Homo sapiens
actcagtgcag

SEQ ID NO: 670520 - DNA, 18 bp, Homo sapiens
actcagtgcctccacatg

SEQ ID NO: 670521 - DNA, 13 bp, Homo sapiens
actcatcatttgt

SEQ ID NO: 670522 - DNA, 11 bp, Homo sapiens
actccatctct

SEQ ID NO: 670523 - DNA, 21 bp, Homo sapiens
actccatctctcatcctccag

SEQ ID NO: 670524 - DNA, 18 bp, Homo sapiens
actccatctcttctgcaa

SEQ ID NO: 670525 - DNA, 18 bp, Homo sapiens
actccattattcctctca

SEQ ID NO: 670526 - DNA, 17 bp, Homo sapiens
actcccaacttcttcct

SEQ ID NO: 670527 - DNA, 20 bp, Homo sapiens
actcccccaccactcaggcc

SEQ ID NO: 670528 - DNA, 17 bp, Homo sapiens
actcccccgtttctcct

SEQ ID NO: 670529 - DNA, 21 bp, Homo sapiens
actccgaggtggttcagacaa

SEQ ID NO: 670530 - DNA, 20 bp, Homo sapiens
actcctagaagaaccaaata

SEQ ID NO: 670531 - DNA, 12 bp, Homo sapiens
actcctccctcc

SEQ ID NO: 670532 - DNA, 16 bp, Homo sapiens
actcctggcagggcca

SEQ ID NO: 670533 - DNA, 18 bp, Homo sapiens
actcctttcttatcttga

SEQ ID NO: 670534 - DNA, 16 bp, Homo sapiens
actcctttttattcat

SEQ ID NO: 670535 - DNA, 16 bp, Homo sapiens
actctaactctgagag

SEQ ID NO: 670536 - DNA, 14 bp, Homo sapiens
actctaatagtgct

SEQ ID NO: 670537 - DNA, 11 bp, Homo sapiens
actctccaggg

SEQ ID NO: 670538 - DNA, 14 bp, Homo sapiens
actctgcaagaaga

SEQ ID NO: 670539 - DNA, 23 bp, Homo sapiens
actctgtaattgcactttttaag

SEQ ID NO: 670540 - DNA, 10 bp, Homo sapiens
actcttcagt

SEQ ID NO: 670541 - DNA, 12 bp, Homo sapiens
actcttcagtgc

SEQ ID NO: 670542 - DNA, 21 bp, Homo sapiens
actcttggttcgatacctgga

SEQ ID NO: 670543 - DNA, 23 bp, Homo sapiens
actcttggttcgatacctggagc

SEQ ID NO: 670544 - DNA, 15 bp, Homo sapiens
actcttttgctgtgc

SEQ ID NO: 670545 - DNA, 13 bp, Homo sapiens
actgaaacagatt

SEQ ID NO: 670546 - DNA, 20 bp, Homo sapiens
actgaaagccttagggaagc

SEQ ID NO: 670547 - DNA, 18 bp, Homo sapiens
actgaataatatcaaata

SEQ ID NO: 670548 - DNA, 19 bp, Homo sapiens
actgaattgtatcaatttg

SEQ ID NO: 670549 - DNA, 12 bp, Homo sapiens
actgacaaagat

SEQ ID NO: 670550 - DNA, 13 bp, Homo sapiens
actgaccactggg

SEQ ID NO: 670551 - DNA, 16 bp, Homo sapiens
actgaccggtgctttt

SEQ ID NO: 670552 - DNA, 16 bp, Homo sapiens
actgactggaggaggc

SEQ ID NO: 670553 - DNA, 15 bp, Homo sapiens
actgagagtaattca

SEQ ID NO: 670554 - DNA, 20 bp, Homo sapiens
actgaggaggaggctgcaca

SEQ ID NO: 670555 - DNA, 15 bp, Homo sapiens
actgatgacttacta

SEQ ID NO: 670556 - DNA, 16 bp, Homo sapiens
actgatgattttcctt

SEQ ID NO: 670557 - DNA, 16 bp, Homo sapiens
actgcaaattttaact

SEQ ID NO: 670558 - DNA, 17 bp, Homo sapiens
actgcaacctctgcctc

SEQ ID NO: 670559 - DNA, 18 bp, Homo sapiens
actgcaacctctgcctcc

SEQ ID NO: 670560 - DNA, 21 bp, Homo sapiens
actgcaagttcattttaaatg

SEQ ID NO: 670561 - DNA, 14 bp, Homo sapiens
actgcaatgaaagt

SEQ ID NO: 670562 - DNA, 16 bp, Homo sapiens
actgcaatgaaagtca

SEQ ID NO: 670563 - DNA, 13 bp, Homo sapiens
actgcagaagcaa

SEQ ID NO: 670564 - DNA, 14 bp, Homo sapiens
actgcagcagaaag

SEQ ID NO: 670565 - DNA, 18 bp, Homo sapiens
actgcaggaaaaccctta

SEQ ID NO: 670566 - DNA, 13 bp, Homo sapiens
actgccaggctgc

SEQ ID NO: 670567 - DNA, 18 bp, Homo sapiens
actgccaggctgcctcct

SEQ ID NO: 670568 - DNA, 21 bp, Homo sapiens
actgccaggctgcctcctgcc

SEQ ID NO: 670569 - DNA, 19 bp, Homo sapiens
actgccccccatgaggaag

SEQ ID NO: 670570 - DNA, 15 bp, Homo sapiens
actgcctgaataaag

SEQ ID NO: 670571 - DNA, 14 bp, Homo sapiens
actgccttgaaaaa

SEQ ID NO: 670572 - DNA, 17 bp, Homo sapiens
actgccttgaaaaatga

SEQ ID NO: 670573 - DNA, 20 bp, Homo sapiens
actgctacctttcaaagctt

SEQ ID NO: 670574 - DNA, 12 bp, Homo sapiens
actgctgagctg

SEQ ID NO: 670575 - DNA, 17 bp, Homo sapiens
actgctgagctggccct

SEQ ID NO: 670576 - DNA, 17 bp, Homo sapiens
actgctgatcgtagaaa

SEQ ID NO: 670577 - DNA, 18 bp, Homo sapiens
actgctgatcgtagaaaa

SEQ ID NO: 670578 - DNA, 19 bp, Homo sapiens
actgctgcagattagttct

SEQ ID NO: 670579 - DNA, 15 bp, Homo sapiens
actgcttgattttaa

SEQ ID NO: 670580 - DNA, 21 bp, Homo sapiens
actggacttcccaagataaat

SEQ ID NO: 670581 - DNA, 12 bp, Homo sapiens
actggaggaggc

SEQ ID NO: 670582 - DNA, 15 bp, Homo sapiens
actggaggaggcctg

SEQ ID NO: 670583 - DNA, 16 bp, Homo sapiens
actggaggaggcctgt

SEQ ID NO: 670584 - DNA, 19 bp, Homo sapiens
actggcaattgtctattta

SEQ ID NO: 670585 - DNA, 14 bp, Homo sapiens
actggcagcatctt

SEQ ID NO: 670586 - DNA, 21 bp, Homo sapiens
actggcccctactttgtggca

SEQ ID NO: 670587 - DNA, 22 bp, Homo sapiens
actgggattaagaaaccttgct

SEQ ID NO: 670588 - DNA, 23 bp, Homo sapiens
actgggccataatgttgcttctc

SEQ ID NO: 670589 - DNA, 20 bp, Homo sapiens
actgggccttagtgggccag

SEQ ID NO: 670590 - DNA, 15 bp, Homo sapiens
actggggcatcctgt

SEQ ID NO: 670591 - DNA, 23 bp, Homo sapiens
actggggttgcgtctgaggcctg

SEQ ID NO: 670592 - DNA, 15 bp, Homo sapiens
actgggtctgcgatg

SEQ ID NO: 670593 - DNA, 18 bp, Homo sapiens
actgggtttcaagaaaat

SEQ ID NO: 670594 - DNA, 14 bp, Homo sapiens
actggtattgttta

SEQ ID NO: 670595 - DNA, 17 bp, Homo sapiens
actggttttaagtgctt

SEQ ID NO: 670596 - DNA, 21 bp, Homo sapiens
actgtaatacgtagctctctt

SEQ ID NO: 670597 - DNA, 17 bp, Homo sapiens
actgtacattatgaaga

SEQ ID NO: 670598 - DNA, 14 bp, Homo sapiens
actgtacatttaaa

SEQ ID NO: 670599 - DNA, 19 bp, Homo sapiens
actgtaccatggtttgata

SEQ ID NO: 670600 - DNA, 20 bp, Homo sapiens
actgtagatatgtattcttt

SEQ ID NO: 670601 - DNA, 15 bp, Homo sapiens
actgtagctacattt

SEQ ID NO: 670602 - DNA, 18 bp, Homo sapiens
actgtagctcaagtttaa

SEQ ID NO: 670603 - DNA, 20 bp, Homo sapiens
actgtagctcaagtttaaaa

SEQ ID NO: 670604 - DNA, 15 bp, Homo sapiens
actgtatcattttct

SEQ ID NO: 670605 - DNA, 15 bp, Homo sapiens
actgtatgatttata

SEQ ID NO: 670606 - DNA, 13 bp, Homo sapiens
actgtatgtgtgt

SEQ ID NO: 670607 - DNA, 15 bp, Homo sapiens
actgtgcagacccag

SEQ ID NO: 670608 - DNA, 14 bp, Homo sapiens
actgtgccagaggc

SEQ ID NO: 670609 - DNA, 13 bp, Homo sapiens
actgtgctgaatg

SEQ ID NO: 670610 - DNA, 20 bp, Homo sapiens
actgtggaaggcctccctct

SEQ ID NO: 670611 - DNA, 14 bp, Homo sapiens
actgtggccaggcc

SEQ ID NO: 670612 - DNA, 12 bp, Homo sapiens
acttactatttt

SEQ ID NO: 670613 - DNA, 17 bp, Homo sapiens
acttagcgtcaagacat

SEQ ID NO: 670614 - DNA, 21 bp, Homo sapiens
acttagcgtcaagacatttgc

SEQ ID NO: 670615 - DNA, 20 bp, Homo sapiens
acttagtgatcatttaaaaa

SEQ ID NO: 670616 - DNA, 16 bp, Homo sapiens
acttatgtttttaaat

SEQ ID NO: 670617 - DNA, 19 bp, Homo sapiens
acttattttgtcttattct

SEQ ID NO: 670618 - DNA, 22 bp, Homo sapiens
acttattttgtcttattcttaa

SEQ ID NO: 670619 - DNA, 14 bp, Homo sapiens
acttcatatagcat

SEQ ID NO: 670620 - DNA, 19 bp, Homo sapiens
acttcatatagcattgata

SEQ ID NO: 670621 - DNA, 16 bp, Homo sapiens
acttcatttttaagaa

SEQ ID NO: 670622 - DNA, 19 bp, Homo sapiens
acttcatttttaagaaagg

SEQ ID NO: 670623 - DNA, 16 bp, Homo sapiens
acttccatccctgctt

SEQ ID NO: 670624 - DNA, 19 bp, Homo sapiens
acttcccaccctgcccctc

SEQ ID NO: 670625 - DNA, 10 bp, Homo sapiens
acttcctctg

SEQ ID NO: 670626 - DNA, 18 bp, Homo sapiens
acttcctttgcccttcct

SEQ ID NO: 670627 - DNA, 16 bp, Homo sapiens
acttctgcaacaagca

SEQ ID NO: 670628 - DNA, 24 bp, Homo sapiens
acttctgcaacaagcatgcagctt

SEQ ID NO: 670629 - DNA, 10 bp, Homo sapiens
acttctgctc

SEQ ID NO: 670630 - DNA, 20 bp, Homo sapiens
acttgaataaccatctgaaa

SEQ ID NO: 670631 - DNA, 19 bp, Homo sapiens
acttgaccgggagacagag

SEQ ID NO: 670632 - DNA, 18 bp, Homo sapiens
acttgactccatttcatc

SEQ ID NO: 670633 - DNA, 19 bp, Homo sapiens
acttggctttcctgtttct

SEQ ID NO: 670634 - DNA, 17 bp, Homo sapiens
acttgtacaaacagtat

SEQ ID NO: 670635 - DNA, 22 bp, Homo sapiens
acttgtatatatggatcagagg

SEQ ID NO: 670636 - DNA, 20 bp, Homo sapiens
acttgttttggatggcttgt

SEQ ID NO: 670637 - DNA, 16 bp, Homo sapiens
actttaacattttgga

SEQ ID NO: 670638 - DNA, 17 bp, Homo sapiens
acctacagactccatct

SEQ ID NO: 670639 - DNA, 16 bp, Homo sapiens
acctacctgccttgga

SEQ ID NO: 670640 - DNA, 15 bp, Homo sapiens
acctaggtctccagt

SEQ ID NO: 670641 - DNA, 20 bp, Homo sapiens
acctcaagggggactgtctt

SEQ ID NO: 670642 - DNA, 21 bp, Homo sapiens
acctcaagggggactgtcttt

SEQ ID NO: 670643 - DNA, 21 bp, Homo sapiens
acctcacctcccgaagccacc

SEQ ID NO: 670644 - DNA, 15 bp, Homo sapiens
acctcagggctccca

SEQ ID NO: 670645 - DNA, 16 bp, Homo sapiens
acctcagggctcccag

SEQ ID NO: 670646 - DNA, 17 bp, Homo sapiens
acctcagggctcccagg

SEQ ID NO: 670647 - DNA, 20 bp, Homo sapiens
acctcagggctcccaggggt

SEQ ID NO: 670648 - DNA, 22 bp, Homo sapiens
acctcagttgaaaatgcaactc

SEQ ID NO: 670649 - DNA, 18 bp, Homo sapiens
acctcagttttatgcccc

SEQ ID NO: 670650 - DNA, 14 bp, Homo sapiens
acctccaggctttc

SEQ ID NO: 670651 - DNA, 15 bp, Homo sapiens
acctcctcatggcag

SEQ ID NO: 670652 - DNA, 16 bp, Homo sapiens
acctcctctcagtgtt

SEQ ID NO: 670653 - DNA, 21 bp, Homo sapiens
acctccttgtaacatcaggga

SEQ ID NO: 670654 - DNA, 14 bp, Homo sapiens
acctcgctgagggc

SEQ ID NO: 670655 - DNA, 17 bp, Homo sapiens
acctcggcacacactgt

SEQ ID NO: 670656 - DNA, 15 bp, Homo sapiens
acctctctgtccctt

SEQ ID NO: 670657 - DNA, 19 bp, Homo sapiens
acctctctgtcccttgctg

SEQ ID NO: 670658 - DNA, 19 bp, Homo sapiens
acctgaagatgggagcctt

SEQ ID NO: 670659 - DNA, 22 bp, Homo sapiens
acctgactcaattatttgcata

SEQ ID NO: 670660 - DNA, 13 bp, Homo sapiens
acctgccaagagt

SEQ ID NO: 670661 - DNA, 17 bp, Homo sapiens
acctgccctcaagggtg

SEQ ID NO: 670662 - DNA, 14 bp, Homo sapiens
acctgctcccaggc

SEQ ID NO: 670663 - DNA, 15 bp, Homo sapiens
acctgctcccaggcc

SEQ ID NO: 670664 - DNA, 16 bp, Homo sapiens
acctgctcccaggccc

SEQ ID NO: 670665 - DNA, 21 bp, Homo sapiens
acctggagaaggaagctgcct

SEQ ID NO: 670666 - DNA, 18 bp, Homo sapiens
acctggagcagaggaggg

SEQ ID NO: 670667 - DNA, 23 bp, Homo sapiens
acctggcggtgtataccaggcag

SEQ ID NO: 670668 - DNA, 14 bp, Homo sapiens
acctgggaacacag

SEQ ID NO: 670669 - DNA, 15 bp, Homo sapiens
acctgggctcagcct

SEQ ID NO: 670670 - DNA, 20 bp, Homo sapiens
acctgggtatagtgcagaaa

SEQ ID NO: 670671 - DNA, 23 bp, Homo sapiens
acctggtccccactgctgagctg

SEQ ID NO: 670672 - DNA, 14 bp, Homo sapiens
acctgtagtcccag

SEQ ID NO: 670673 - DNA, 16 bp, Homo sapiens
acctgtagtcccagct

SEQ ID NO: 670674 - DNA, 20 bp, Homo sapiens
acctgtatatttgtaaagct

SEQ ID NO: 670675 - DNA, 15 bp, Homo sapiens
acctgtttctctgcc

SEQ ID NO: 670676 - DNA, 20 bp, Homo sapiens
accttaaaattaagatttcc

SEQ ID NO: 670677 - DNA, 16 bp, Homo sapiens
accttaaccttaaaat

SEQ ID NO: 670678 - DNA, 13 bp, Homo sapiens
accttatttattt

SEQ ID NO: 670679 - DNA, 19 bp, Homo sapiens
accttatttatttttgtgt

SEQ ID NO: 670680 - DNA, 22 bp, Homo sapiens
accttatttgctaatcaaagcc

SEQ ID NO: 670681 - DNA, 18 bp, Homo sapiens
accttcactctccagggt

SEQ ID NO: 670682 - DNA, 19 bp, Homo sapiens
accttcagatccttttatt

SEQ ID NO: 670683 - DNA, 16 bp, Homo sapiens
accttccaacactcca

SEQ ID NO: 670684 - DNA, 22 bp, Homo sapiens
accttgaataaggcccactgta

SEQ ID NO: 670685 - DNA, 15 bp, Homo sapiens
accttgctctcctca

SEQ ID NO: 670686 - DNA, 17 bp, Homo sapiens
accttgctctcctcatc

SEQ ID NO: 670687 - DNA, 12 bp, Homo sapiens
accttgcttctt

SEQ ID NO: 670688 - DNA, 15 bp, Homo sapiens
accttggtgagatgg

SEQ ID NO: 670689 - DNA, 12 bp, Homo sapiens
acctttcctctc

SEQ ID NO: 670690 - DNA, 18 bp, Homo sapiens
acctttgctatgtaaggg

SEQ ID NO: 670691 - DNA, 22 bp, Homo sapiens
accttttccaggagttctgaag

SEQ ID NO: 670692 - DNA, 14 bp, Homo sapiens
accttttctctttt

SEQ ID NO: 670693 - DNA, 19 bp, Homo sapiens
acgacacatatacatatga

SEQ ID NO: 670694 - DNA, 19 bp, Homo sapiens
acgagactttctcctggcc

SEQ ID NO: 670695 - DNA, 22 bp, Homo sapiens
acgatgttgtattgatttttaa

SEQ ID NO: 670696 - DNA, 13 bp, Homo sapiens
acgattttgcaca

SEQ ID NO: 670697 - DNA, 19 bp, Homo sapiens
acgccgtcccaccagcttc

SEQ ID NO: 670698 - DNA, 21 bp, Homo sapiens
acgccgtcccaccagcttcac

SEQ ID NO: 670699 - DNA, 14 bp, Homo sapiens
acgcgtctgcctgg

SEQ ID NO: 670700 - DNA, 15 bp, Homo sapiens
acgcgtctgcctggg

SEQ ID NO: 670701 - DNA, 18 bp, Homo sapiens
acgcttactagatgtgag

SEQ ID NO: 670702 - DNA, 21 bp, Homo sapiens
acgcttcgggaaaatattcat

SEQ ID NO: 670703 - DNA, 20 bp, Homo sapiens
acggaggcctgcgaccctgg

SEQ ID NO: 670704 - DNA, 21 bp, Homo sapiens
acggaggcctgcgaccctggg

SEQ ID NO: 670705 - DNA, 21 bp, Homo sapiens
acggcattagcttcctgcccc

SEQ ID NO: 670706 - DNA, 22 bp, Homo sapiens
acggccctcatctatgaggaaa

SEQ ID NO: 670707 - DNA, 23 bp, Homo sapiens
acgggacatcacagggtgggcct

SEQ ID NO: 670708 - DNA, 15 bp, Homo sapiens
acggtttccagggag

SEQ ID NO: 670709 - DNA, 17 bp, Homo sapiens
acggtttccagggaggg

SEQ ID NO: 670710 - DNA, 18 bp, Homo sapiens
acgtagttctagcagtcc

SEQ ID NO: 670711 - DNA, 13 bp, Homo sapiens
acgtgacaggctc

SEQ ID NO: 670712 - DNA, 18 bp, Homo sapiens
acgtgctccgtagctctg

SEQ ID NO: 670713 - DNA, 19 bp, Homo sapiens
acgtgctccgtagctctgc

SEQ ID NO: 670714 - DNA, 20 bp, Homo sapiens
acgtgctccgtagctctgct

SEQ ID NO: 670715 - DNA, 21 bp, Homo sapiens
acgtgctccgtagctctgctg

SEQ ID NO: 670716 - DNA, 22 bp, Homo sapiens
acgtgctccgtagctctgctgc

SEQ ID NO: 670717 - DNA, 24 bp, Homo sapiens
acgtgctccgtagctctgctgctg

SEQ ID NO: 670718 - DNA, 20 bp, Homo sapiens
acgttaggaggacaaaagga

SEQ ID NO: 670719 - DNA, 22 bp, Homo sapiens
acgttggttaaataaacttttt

SEQ ID NO: 670720 - DNA, 14 bp, Homo sapiens
acgtttataaacag

SEQ ID NO: 670721 - DNA, 16 bp, Homo sapiens
acgtttataaacagaa

SEQ ID NO: 670722 - DNA, 21 bp, Homo sapiens
acgtttataaacagaaatgga

SEQ ID NO: 670723 - DNA, 15 bp, Homo sapiens
acgtttgatacaaca

SEQ ID NO: 670724 - DNA, 14 bp, Homo sapiens
actaaaataatttt

SEQ ID NO: 670725 - DNA, 15 bp, Homo sapiens
actaaaataattttg

SEQ ID NO: 670726 - DNA, 16 bp, Homo sapiens
actaaaataattttgt

SEQ ID NO: 670727 - DNA, 19 bp, Homo sapiens
actaaaataattttgtaat

SEQ ID NO: 670728 - DNA, 14 bp, Homo sapiens
actaaagagagaat

SEQ ID NO: 670729 - DNA, 13 bp, Homo sapiens
actaacagataag

SEQ ID NO: 670730 - DNA, 19 bp, Homo sapiens
actaaggcaggtgggcaga

SEQ ID NO: 670731 - DNA, 14 bp, Homo sapiens
actaataaatataa

SEQ ID NO: 670732 - DNA, 18 bp, Homo sapiens
actaataaatataattta

SEQ ID NO: 670733 - DNA, 12 bp, Homo sapiens
actaattggaag

SEQ ID NO: 670734 - DNA, 23 bp, Homo sapiens
actaattttacacattagatttt

SEQ ID NO: 670735 - DNA, 13 bp, Homo sapiens
actaatttttgta

SEQ ID NO: 670736 - DNA, 12 bp, Homo sapiens
actacacaatac

SEQ ID NO: 670737 - DNA, 17 bp, Homo sapiens
actacacaatacagtat

SEQ ID NO: 670738 - DNA, 19 bp, Homo sapiens
actacacaatacagtatta

SEQ ID NO: 670739 - DNA, 16 bp, Homo sapiens
actacagctatatttg

SEQ ID NO: 670740 - DNA, 14 bp, Homo sapiens
actaccactttttt

SEQ ID NO: 670741 - DNA, 15 bp, Homo sapiens
actacccatagacat

SEQ ID NO: 670742 - DNA, 22 bp, Homo sapiens
actacctgtaatgacaggcctg

SEQ ID NO: 670743 - DNA, 19 bp, Homo sapiens
actacttccatccctgctt

SEQ ID NO: 670744 - DNA, 13 bp, Homo sapiens
actagattgacta

SEQ ID NO: 670745 - DNA, 16 bp, Homo sapiens
actatatatataaatg

SEQ ID NO: 670746 - DNA, 20 bp, Homo sapiens
actatatatataaatgtata

SEQ ID NO: 670747 - DNA, 16 bp, Homo sapiens
actatatatatttcta

SEQ ID NO: 670748 - DNA, 21 bp, Homo sapiens
actatatgtgaaacatttttt

SEQ ID NO: 670749 - DNA, 23 bp, Homo sapiens
actatatgtgaaacattttttct

SEQ ID NO: 670750 - DNA, 19 bp, Homo sapiens
actatctccgttccatctg

SEQ ID NO: 670751 - DNA, 22 bp, Homo sapiens
agacacagctcttccagggcag

SEQ ID NO: 670752 - DNA, 21 bp, Homo sapiens
agacacatacatgtcacattt

SEQ ID NO: 670753 - DNA, 14 bp, Homo sapiens
agacacctggttgc

SEQ ID NO: 670754 - DNA, 14 bp, Homo sapiens
agacagactagaag

SEQ ID NO: 670755 - DNA, 22 bp, Homo sapiens
agacatactgcttgattttaat

SEQ ID NO: 670756 - DNA, 22 bp, Homo sapiens
agacatttttccgtttgctttt

SEQ ID NO: 670757 - DNA, 17 bp, Homo sapiens
agaccaataaacttcct

SEQ ID NO: 670758 - DNA, 20 bp, Homo sapiens
agaccaataaacttcctttt

SEQ ID NO: 670759 - DNA, 16 bp, Homo sapiens
agaccacagaggctca

SEQ ID NO: 670760 - DNA, 20 bp, Homo sapiens
agaccacagggttcaaaatg

SEQ ID NO: 670761 - DNA, 16 bp, Homo sapiens
agaccatattacctgg

SEQ ID NO: 670762 - DNA, 19 bp, Homo sapiens
agaccatattacctggatt

SEQ ID NO: 670763 - DNA, 18 bp, Homo sapiens
agacccagtcccacactg

SEQ ID NO: 670764 - DNA, 14 bp, Homo sapiens
agaccctcttgccc

SEQ ID NO: 670765 - DNA, 18 bp, Homo sapiens
agaccctcttgcccatcc

SEQ ID NO: 670766 - DNA, 16 bp, Homo sapiens
agacctatgtaagaat

SEQ ID NO: 670767 - DNA, 14 bp, Homo sapiens
agacctttcctctc

SEQ ID NO: 670768 - DNA, 20 bp, Homo sapiens
agacctttgaggatatcaaa

SEQ ID NO: 670769 - DNA, 16 bp, Homo sapiens
agacggtttccaggga

SEQ ID NO: 670770 - DNA, 19 bp, Homo sapiens
agacggtttccagggaggg

SEQ ID NO: 670771 - DNA, 12 bp, Homo sapiens
agactatttgct

SEQ ID NO: 670772 - DNA, 15 bp, Homo sapiens
agactatttgctaat

SEQ ID NO: 670773 - DNA, 19 bp, Homo sapiens
agactatttgctaatgtat

SEQ ID NO: 670774 - DNA, 24 bp, Homo sapiens
agactcgagaaccaaccagggaag

SEQ ID NO: 670775 - DNA, 14 bp, Homo sapiens
agactgtacattat

SEQ ID NO: 670776 - DNA, 23 bp, Homo sapiens
agacttttgaaaaaaaagttttt

SEQ ID NO: 670777 - DNA, 17 bp, Homo sapiens
agagaatgtagatattg

SEQ ID NO: 670778 - DNA, 13 bp, Homo sapiens
agagacaaagatt

SEQ ID NO: 670779 - DNA, 17 bp, Homo sapiens
agagagcttcctcccct

SEQ ID NO: 670780 - DNA, 21 bp, Homo sapiens
agagataaagcttaggtcaaa

SEQ ID NO: 670781 - DNA, 20 bp, Homo sapiens
agagatctctgtagaaggag

SEQ ID NO: 670782 - DNA, 21 bp, Homo sapiens
agagatgctgtaacttaaaat

SEQ ID NO: 670783 - DNA, 12 bp, Homo sapiens
agagatttctca

SEQ ID NO: 670784 - DNA, 20 bp, Homo sapiens
agagcaagagataagtcttt

SEQ ID NO: 670785 - DNA, 18 bp, Homo sapiens
agagccctctcctccctc

SEQ ID NO: 670786 - DNA, 20 bp, Homo sapiens
agagccctctcctccctctg

SEQ ID NO: 670787 - DNA, 14 bp, Homo sapiens
agagcctcgctttt

SEQ ID NO: 670788 - DNA, 18 bp, Homo sapiens
agagcctgggggtggggg

SEQ ID NO: 670789 - DNA, 17 bp, Homo sapiens
agagctaagggtgggtg

SEQ ID NO: 670790 - DNA, 22 bp, Homo sapiens
agagctaagggtgggtgctcag

SEQ ID NO: 670791 - DNA, 17 bp, Homo sapiens
agagctagaaaaataaa

SEQ ID NO: 670792 - DNA, 21 bp, Homo sapiens
agagctagaaaaataaaatgt

SEQ ID NO: 670793 - DNA, 15 bp, Homo sapiens
agagcttggactaca

SEQ ID NO: 670794 - DNA, 17 bp, Homo sapiens
agagcttggactacaca

SEQ ID NO: 670795 - DNA, 20 bp, Homo sapiens
agaggagcgcaggcagcgca

SEQ ID NO: 670796 - DNA, 13 bp, Homo sapiens
agaggctgaaaga

SEQ ID NO: 670797 - DNA, 14 bp, Homo sapiens
agaggctgtctgtt

SEQ ID NO: 670798 - DNA, 14 bp, Homo sapiens
agaggcttgtttac

SEQ ID NO: 670799 - DNA, 16 bp, Homo sapiens
agagggagaagcatga

SEQ ID NO: 670800 - DNA, 16 bp, Homo sapiens
agagggtatttttgta

SEQ ID NO: 670801 - DNA, 16 bp, Homo sapiens
agaggtattaaaacta

SEQ ID NO: 670802 - DNA, 17 bp, Homo sapiens
agaggtattaaaactaa

SEQ ID NO: 670803 - DNA, 16 bp, Homo sapiens
agaggtgcttcaccct

SEQ ID NO: 670804 - DNA, 17 bp, Homo sapiens
agaggtgggagggccct

SEQ ID NO: 670805 - DNA, 15 bp, Homo sapiens
agagtgcactactgt

SEQ ID NO: 670806 - DNA, 16 bp, Homo sapiens
agagtgcactactgta

SEQ ID NO: 670807 - DNA, 18 bp, Homo sapiens
agagtggcgtggcctccc

SEQ ID NO: 670808 - DNA, 14 bp, Homo sapiens
agataaagcttagg

SEQ ID NO: 670809 - DNA, 17 bp, Homo sapiens
agataagcaagagagat

SEQ ID NO: 670810 - DNA, 17 bp, Homo sapiens
agataatattgtttggt

SEQ ID NO: 670811 - DNA, 14 bp, Homo sapiens
agataatatttttg

SEQ ID NO: 670812 - DNA, 18 bp, Homo sapiens
agataatttacaagatat

SEQ ID NO: 670813 - DNA, 14 bp, Homo sapiens
agatacaaattaat

SEQ ID NO: 670814 - DNA, 18 bp, Homo sapiens
agatacaaattaatttta

SEQ ID NO: 670815 - DNA, 19 bp, Homo sapiens
agataccttatcttacaat

SEQ ID NO: 670816 - DNA, 18 bp, Homo sapiens
agatacttatttttctga

SEQ ID NO: 670817 - DNA, 19 bp, Homo sapiens
agatactttgaagtgcagc

SEQ ID NO: 670818 - DNA, 14 bp, Homo sapiens
agataggaaactga

SEQ ID NO: 670819 - DNA, 15 bp, Homo sapiens
agatataaattttta

SEQ ID NO: 670820 - DNA, 14 bp, Homo sapiens
agatatgtattctt

SEQ ID NO: 670821 - DNA, 18 bp, Homo sapiens
agatattgttgttttcca

SEQ ID NO: 670822 - DNA, 20 bp, Homo sapiens
agatatttacatccagcttc

SEQ ID NO: 670823 - DNA, 16 bp, Homo sapiens
agatatttttcataaa

SEQ ID NO: 670824 - DNA, 16 bp, Homo sapiens
agatcagcctgggcaa

SEQ ID NO: 670825 - DNA, 17 bp, Homo sapiens
agatcgagaccatcctg

SEQ ID NO: 670826 - DNA, 19 bp, Homo sapiens
agatcgtgctactgcactc

SEQ ID NO: 670827 - DNA, 14 bp, Homo sapiens
agatctaaacagtt

SEQ ID NO: 670828 - DNA, 23 bp, Homo sapiens
agatctaacgtgttccagtgtct

SEQ ID NO: 670829 - DNA, 20 bp, Homo sapiens
agatctacatgtctagagaa

SEQ ID NO: 670830 - DNA, 12 bp, Homo sapiens
agatctttcaga

SEQ ID NO: 670831 - DNA, 16 bp, Homo sapiens
agatctttcagaaata

SEQ ID NO: 670832 - DNA, 17 bp, Homo sapiens
agatctttcagaaatat

SEQ ID NO: 670833 - DNA, 13 bp, Homo sapiens
agatgaaaactag

SEQ ID NO: 670834 - DNA, 21 bp, Homo sapiens
agatgaaataaagacccaggg

SEQ ID NO: 670835 - DNA, 23 bp, Homo sapiens
agatgaccataattttttttaaa

SEQ ID NO: 670836 - DNA, 20 bp, Homo sapiens
agatgagaaatgatgaaaag

SEQ ID NO: 670837 - DNA, 18 bp, Homo sapiens
agatgctgtgtatatggt

SEQ ID NO: 670838 - DNA, 14 bp, Homo sapiens
agatggaaatacag

SEQ ID NO: 670839 - DNA, 15 bp, Homo sapiens
agatggtggccacag

SEQ ID NO: 670840 - DNA, 17 bp, Homo sapiens
agatggtttccacattt

SEQ ID NO: 670841 - DNA, 15 bp, Homo sapiens
agatgtaattttgtg

SEQ ID NO: 670842 - DNA, 19 bp, Homo sapiens
agatgtaattttgtgtaag

SEQ ID NO: 670843 - DNA, 15 bp, Homo sapiens
agatgttagatattt

SEQ ID NO: 670844 - DNA, 13 bp, Homo sapiens
agattaagaaata

SEQ ID NO: 670845 - DNA, 14 bp, Homo sapiens
agattaagaaatag

SEQ ID NO: 670846 - DNA, 18 bp, Homo sapiens
agattagttctttttgcc

SEQ ID NO: 670847 - DNA, 19 bp, Homo sapiens
agattagttctttttgcca

SEQ ID NO: 670848 - DNA, 21 bp, Homo sapiens
agattgactaactcaaataca

SEQ ID NO: 670849 - DNA, 15 bp, Homo sapiens
agattggttttcctg

SEQ ID NO: 670850 - DNA, 14 bp, Homo sapiens
agatttatacagtt

SEQ ID NO: 670851 - DNA, 17 bp, Homo sapiens
agatttctcactatata

SEQ ID NO: 670852 - DNA, 22 bp, Homo sapiens
agatttcttaaataatgcttca

SEQ ID NO: 670853 - DNA, 13 bp, Homo sapiens
agatttgatgtat

SEQ ID NO: 670854 - DNA, 16 bp, Homo sapiens
agattttgcttttcca

SEQ ID NO: 670855 - DNA, 13 bp, Homo sapiens
agatttttattta

SEQ ID NO: 670856 - DNA, 18 bp, Homo sapiens
agatttttatttatgagt

SEQ ID NO: 670857 - DNA, 14 bp, Homo sapiens
agcaaaaaagagtt

SEQ ID NO: 670858 - DNA, 18 bp, Homo sapiens
agcaaagccatccccgct

SEQ ID NO: 670859 - DNA, 20 bp, Homo sapiens
agcaaagttcaacttatttc

SEQ ID NO: 670860 - DNA, 16 bp, Homo sapiens
agcaaatgacagattt

SEQ ID NO: 670861 - DNA, 20 bp, Homo sapiens
agcaaatggcctcatgtcaa

SEQ ID NO: 670862 - DNA, 23 bp, Homo sapiens
agcaacattggcacatgccacct

SEQ ID NO: 670863 - DNA, 16 bp, Homo sapiens
agcaactaatgtttga

SEQ ID NO: 670864 - DNA, 15 bp, Homo sapiens
agcaagcaactaatt

SEQ ID NO: 670865 - DNA, 23 bp, Homo sapiens
agcaagccagccaatagaatggg

SEQ ID NO: 670866 - DNA, 14 bp, Homo sapiens
agcaagctttggtt

SEQ ID NO: 670867 - DNA, 18 bp, Homo sapiens
agcaatctgcctgtatct

SEQ ID NO: 670868 - DNA, 21 bp, Homo sapiens
agcaatggacggtccgcagaa

SEQ ID NO: 670869 - DNA, 23 bp, Homo sapiens
agcaattagtctgaaactggctt

SEQ ID NO: 670870 - DNA, 16 bp, Homo sapiens
agcaattctcctgcct

SEQ ID NO: 670871 - DNA, 23 bp, Homo sapiens
agcaattctcctgcctcagcctc

SEQ ID NO: 670872 - DNA, 17 bp, Homo sapiens
agcaccgaggggccttt

SEQ ID NO: 670873 - DNA, 18 bp, Homo sapiens
agcaccgaggggcctttg

SEQ ID NO: 670874 - DNA, 15 bp, Homo sapiens
aatgtggtctcagga

SEQ ID NO: 670875 - DNA, 16 bp, Homo sapiens
aatgtggtctcaggat

SEQ ID NO: 670876 - DNA, 19 bp, Homo sapiens
aatgtgtcctatctatctt

SEQ ID NO: 670877 - DNA, 16 bp, Homo sapiens
aatgtgtggtggcctc

SEQ ID NO: 670878 - DNA, 13 bp, Homo sapiens
aatgttaaaggga

SEQ ID NO: 670879 - DNA, 19 bp, Homo sapiens
aatgtttaataaagcttta

SEQ ID NO: 670880 - DNA, 22 bp, Homo sapiens
aatgtttatactgtatttctaa

SEQ ID NO: 670881 - DNA, 15 bp, Homo sapiens
aatgtttatgagcca

SEQ ID NO: 670882 - DNA, 18 bp, Homo sapiens
aatgtttatgagccagac

SEQ ID NO: 670883 - DNA, 22 bp, Homo sapiens
aatgtttatgagccagacaaat

SEQ ID NO: 670884 - DNA, 21 bp, Homo sapiens
aatgtttcttttgtttggtaa

SEQ ID NO: 670885 - DNA, 22 bp, Homo sapiens
aattaagatacaaattaatttt

SEQ ID NO: 670886 - DNA, 22 bp, Homo sapiens
aattaagcaaatgttaaaagtt

SEQ ID NO: 670887 - DNA, 21 bp, Homo sapiens
aattaagcattttgaaacaaa

SEQ ID NO: 670888 - DNA, 16 bp, Homo sapiens
agcaccttgtgcctgg

SEQ ID NO: 670889 - DNA, 17 bp, Homo sapiens
agcaccttgtgcctggg

SEQ ID NO: 670890 - DNA, 18 bp, Homo sapiens
agcaccttgtgcctgggg

SEQ ID NO: 670891 - DNA, 14 bp, Homo sapiens
agcacttaagtgtt

SEQ ID NO: 670892 - DNA, 20 bp, Homo sapiens
agcactttgggaggccgagg

SEQ ID NO: 670893 - DNA, 20 bp, Homo sapiens
agcagaaaacctgttcaggc

SEQ ID NO: 670894 - DNA, 22 bp, Homo sapiens
agcagaaaactggccctgccct

SEQ ID NO: 670895 - DNA, 17 bp, Homo sapiens
agcagaaaggctctgaa

SEQ ID NO: 670896 - DNA, 20 bp, Homo sapiens
agcagaacagatcttttact

SEQ ID NO: 670897 - DNA, 13 bp, Homo sapiens
agcagaggaccag

SEQ ID NO: 670898 - DNA, 14 bp, Homo sapiens
agcagaggaccagg

SEQ ID NO: 670899 - DNA, 17 bp, Homo sapiens
agcagaggaccagggcc

SEQ ID NO: 670900 - DNA, 18 bp, Homo sapiens
agcagaggaccagggcct

SEQ ID NO: 670901 - DNA, 15 bp, Homo sapiens
agcagagttttcatt

SEQ ID NO: 670902 - DNA, 20 bp, Homo sapiens
agcagcacgattttgcacaa

SEQ ID NO: 670903 - DNA, 21 bp, Homo sapiens
agcagcacgattttgcacaaa

SEQ ID NO: 670904 - DNA, 11 bp, Homo sapiens
agcagctacca

SEQ ID NO: 670905 - DNA, 14 bp, Homo sapiens
agcagcttattgtt

SEQ ID NO: 670906 - DNA, 18 bp, Homo sapiens
agcaggagtggtgcagac

SEQ ID NO: 670907 - DNA, 20 bp, Homo sapiens
agcaggagtggtgcagacag

SEQ ID NO: 670908 - DNA, 14 bp, Homo sapiens
agcaggcagcgcca

SEQ ID NO: 670909 - DNA, 16 bp, Homo sapiens
agcaggcagcgccaag

SEQ ID NO: 670910 - DNA, 21 bp, Homo sapiens
agcagggcataggaagaaaat

SEQ ID NO: 670911 - DNA, 20 bp, Homo sapiens
agcaggtttgttttcagcac

SEQ ID NO: 670912 - DNA, 14 bp, Homo sapiens
agcagtcactggga

SEQ ID NO: 670913 - DNA, 17 bp, Homo sapiens
agcagtcactgggagag

SEQ ID NO: 670914 - DNA, 15 bp, Homo sapiens
agcagtccccagctg

SEQ ID NO: 670915 - DNA, 19 bp, Homo sapiens
agcagtctgataaactgac

SEQ ID NO: 670916 - DNA, 19 bp, Homo sapiens
agcagtggccatcatcctc

SEQ ID NO: 670917 - DNA, 22 bp, Homo sapiens
agcagtggcctttttctgagat

SEQ ID NO: 670918 - DNA, 21 bp, Homo sapiens
agcagttatggtgatgactta

SEQ ID NO: 670919 - DNA, 16 bp, Homo sapiens
agcataactgtagctc

SEQ ID NO: 670920 - DNA, 22 bp, Homo sapiens
agcataactgtagctcaagttt

SEQ ID NO: 670921 - DNA, 20 bp, Homo sapiens
agcatagaaaccactagaaa

SEQ ID NO: 670922 - DNA, 15 bp, Homo sapiens
agcatagataatatt

SEQ ID NO: 670923 - DNA, 13 bp, Homo sapiens
agcatatatactt

SEQ ID NO: 670924 - DNA, 22 bp, Homo sapiens
agcatctccctcactgaaacca

SEQ ID NO: 670925 - DNA, 23 bp, Homo sapiens
agcatcttcacttctaaatgcat

SEQ ID NO: 670926 - DNA, 15 bp, Homo sapiens
agcatgaaatgtgaa

SEQ ID NO: 670927 - DNA, 17 bp, Homo sapiens
agcatgcagctttgcaa

SEQ ID NO: 670928 - DNA, 13 bp, Homo sapiens
agcatgtaagtgt

SEQ ID NO: 670929 - DNA, 21 bp, Homo sapiens
agcatgtaatgttaatgttat

SEQ ID NO: 670930 - DNA, 18 bp, Homo sapiens
agcatgtgccttaatgct

SEQ ID NO: 670931 - DNA, 16 bp, Homo sapiens
agcattgccattgaag

SEQ ID NO: 670932 - DNA, 14 bp, Homo sapiens
agcattttgaaaca

SEQ ID NO: 670933 - DNA, 18 bp, Homo sapiens
agcattttgaaacaaagt

SEQ ID NO: 670934 - DNA, 21 bp, Homo sapiens
agccaactgacaaagatgcat

SEQ ID NO: 670935 - DNA, 14 bp, Homo sapiens
agccaatgtgaatt

SEQ ID NO: 670936 - DNA, 19 bp, Homo sapiens
agccacctgggaacacagt

SEQ ID NO: 670937 - DNA, 16 bp, Homo sapiens
agccagactctgtctc

SEQ ID NO: 670938 - DNA, 11 bp, Homo sapiens
agccagcaggg

SEQ ID NO: 670939 - DNA, 19 bp, Homo sapiens
agccagcccatggccccca

SEQ ID NO: 670940 - DNA, 20 bp, Homo sapiens
agccagcccatggcccccaa

SEQ ID NO: 670941 - DNA, 17 bp, Homo sapiens
agccaggagctgtcacc

SEQ ID NO: 670942 - DNA, 16 bp, Homo sapiens
agccagggtctctccc

SEQ ID NO: 670943 - DNA, 19 bp, Homo sapiens
agccaggtatggctctgca

SEQ ID NO: 670944 - DNA, 14 bp, Homo sapiens
agccatttcttgtt

SEQ ID NO: 670945 - DNA, 19 bp, Homo sapiens
agcccaaactcctttctta

SEQ ID NO: 670946 - DNA, 17 bp, Homo sapiens
agcccacctgctcccag

SEQ ID NO: 670947 - DNA, 15 bp, Homo sapiens
agcccagagaacagc

SEQ ID NO: 670948 - DNA, 15 bp, Homo sapiens
agcccatggccccca

SEQ ID NO: 670949 - DNA, 18 bp, Homo sapiens
agcccatggcccccaata

SEQ ID NO: 670950 - DNA, 15 bp, Homo sapiens
ataggaaactgaagc

SEQ ID NO: 670951 - DNA, 19 bp, Homo sapiens
ataggaagacgcagagcaa

SEQ ID NO: 670952 - DNA, 21 bp, Homo sapiens
ataggaatcattcagaaatgt

SEQ ID NO: 670953 - DNA, 18 bp, Homo sapiens
ataggcctgtcccttgcc

SEQ ID NO: 670954 - DNA, 20 bp, Homo sapiens
ataggcctgtcccttgcctc

SEQ ID NO: 670955 - DNA, 15 bp, Homo sapiens
ataggtaaattttta

SEQ ID NO: 670956 - DNA, 23 bp, Homo sapiens
ataggtaaatttttaggcaaaga

SEQ ID NO: 670957 - DNA, 18 bp, Homo sapiens
ataggtcataaagcattg

SEQ ID NO: 670958 - DNA, 13 bp, Homo sapiens
ataggttatatgc

SEQ ID NO: 670959 - DNA, 16 bp, Homo sapiens
ataggttatatgcaag

SEQ ID NO: 670960 - DNA, 14 bp, Homo sapiens
ataggtttctctcc

SEQ ID NO: 670961 - DNA, 18 bp, Homo sapiens
ataggtttctctccctcc

SEQ ID NO: 670962 - DNA, 13 bp, Homo sapiens
atagtaagattga

SEQ ID NO: 670963 - DNA, 17 bp, Homo sapiens
atagtagttaaataact

SEQ ID NO: 670964 - DNA, 14 bp, Homo sapiens
atagtcttccacaa

SEQ ID NO: 670965 - DNA, 19 bp, Homo sapiens
atagtgcagaaaacgtggc

SEQ ID NO: 670966 - DNA, 15 bp, Homo sapiens
atagtgggatttcca

SEQ ID NO: 670967 - DNA, 16 bp, Homo sapiens
atagtgggtacatcaa

SEQ ID NO: 670968 - DNA, 17 bp, Homo sapiens
atagtgggtacatcaag

SEQ ID NO: 670969 - DNA, 18 bp, Homo sapiens
atagtgtcatataaactc

SEQ ID NO: 670970 - DNA, 23 bp, Homo sapiens
atagttagatctttgtaaatgca

SEQ ID NO: 670971 - DNA, 17 bp, Homo sapiens
atagtttgtctatttta

SEQ ID NO: 670972 - DNA, 20 bp, Homo sapiens
atataaatttttaagagaaa

SEQ ID NO: 670973 - DNA, 22 bp, Homo sapiens
atataacacttaggactagaag

SEQ ID NO: 670974 - DNA, 13 bp, Homo sapiens
atataacatatat

SEQ ID NO: 670975 - DNA, 15 bp, Homo sapiens
atataagtgacttga

SEQ ID NO: 670976 - DNA, 18 bp, Homo sapiens
atataagtgacttgaaca

SEQ ID NO: 670977 - DNA, 12 bp, Homo sapiens
atataataaata

SEQ ID NO: 670978 - DNA, 18 bp, Homo sapiens
atataataaatactcagt

SEQ ID NO: 670979 - DNA, 17 bp, Homo sapiens
atataatttataagcat

SEQ ID NO: 670980 - DNA, 19 bp, Homo sapiens
atataatttataagcattg

SEQ ID NO: 670981 - DNA, 11 bp, Homo sapiens
atataatttta

SEQ ID NO: 670982 - DNA, 17 bp, Homo sapiens
atatacagtatagattt

SEQ ID NO: 670983 - DNA, 14 bp, Homo sapiens
atatacattttcta

SEQ ID NO: 670984 - DNA, 15 bp, Homo sapiens
atatacattttctaa

SEQ ID NO: 670985 - DNA, 14 bp, Homo sapiens
atataccttattta

SEQ ID NO: 670986 - DNA, 16 bp, Homo sapiens
atataccttatttatt

SEQ ID NO: 670987 - DNA, 13 bp, Homo sapiens
atatactgcagct

SEQ ID NO: 670988 - DNA, 15 bp, Homo sapiens
atatactgcagcttt

SEQ ID NO: 670989 - DNA, 13 bp, Homo sapiens
atatactgtgtgc

SEQ ID NO: 670990 - DNA, 20 bp, Homo sapiens
atatacttgcaagataattt

SEQ ID NO: 670991 - DNA, 15 bp, Homo sapiens
atatagactgtacat

SEQ ID NO: 670992 - DNA, 14 bp, Homo sapiens
atatagactgttga

SEQ ID NO: 670993 - DNA, 17 bp, Homo sapiens
atatagcattgataatc

SEQ ID NO: 670994 - DNA, 20 bp, Homo sapiens
atatagcattgataatcttc

SEQ ID NO: 670995 - DNA, 23 bp, Homo sapiens
atatagcattgataatcttcagg

SEQ ID NO: 670996 - DNA, 21 bp, Homo sapiens
atataggtcctgtgttaaaca

SEQ ID NO: 670997 - DNA, 18 bp, Homo sapiens
atataggtgatgtttgct

SEQ ID NO: 670998 - DNA, 14 bp, Homo sapiens
atatagttaaactg

SEQ ID NO: 670999 - DNA, 21 bp, Homo sapiens
atatagttaaactgagagtaa

SEQ ID NO: 671000 - DNA, 18 bp, Homo sapiens
atatataacatatatgga

SEQ ID NO: 671001 - DNA, 15 bp, Homo sapiens
atatatataaatgta

SEQ ID NO: 671002 - DNA, 13 bp, Homo sapiens
atatatggatcag

SEQ ID NO: 671003 - DNA, 19 bp, Homo sapiens
atatatggtcatatacata

SEQ ID NO: 671004 - DNA, 13 bp, Homo sapiens
atatatttgaaat

SEQ ID NO: 671005 - DNA, 15 bp, Homo sapiens
atatatttgaaatag

SEQ ID NO: 671006 - DNA, 19 bp, Homo sapiens
atatatttgaaatagtata

SEQ ID NO: 671007 - DNA, 14 bp, Homo sapiens
atatcaaataaaat

SEQ ID NO: 671008 - DNA, 15 bp, Homo sapiens
atatcaaataaaata

SEQ ID NO: 671009 - DNA, 17 bp, Homo sapiens
atatcaaataaaatatc

SEQ ID NO: 671010 - DNA, 21 bp, Homo sapiens
atatcaaataaaatatcataa

SEQ ID NO: 671011 - DNA, 23 bp, Homo sapiens
atatcaaataaaatatcataaag

SEQ ID NO: 671012 - DNA, 16 bp, Homo sapiens
atatcactaaaagcat

SEQ ID NO: 671013 - DNA, 18 bp, Homo sapiens
atatcactaaaagcatga

SEQ ID NO: 671014 - DNA, 23 bp, Homo sapiens
atatcactaaaagcatgaattgg

SEQ ID NO: 671015 - DNA, 14 bp, Homo sapiens
atatcagctttgat

SEQ ID NO: 671016 - DNA, 14 bp, Homo sapiens
atatcataaagcat

SEQ ID NO: 671017 - DNA, 14 bp, Homo sapiens
atatcatatgtata

SEQ ID NO: 671018 - DNA, 17 bp, Homo sapiens
atatcattttaaaatgt

SEQ ID NO: 671019 - DNA, 19 bp, Homo sapiens
atatcattttaaaatgtct

SEQ ID NO: 671020 - DNA, 14 bp, Homo sapiens
atatcctgagccat

SEQ ID NO: 671021 - DNA, 15 bp, Homo sapiens
atatcctgagccatc

SEQ ID NO: 671022 - DNA, 18 bp, Homo sapiens
atatccttatcagagcta

SEQ ID NO: 671023 - DNA, 13 bp, Homo sapiens
atatctataaaat

SEQ ID NO: 671024 - DNA, 14 bp, Homo sapiens
atatctataaaata

SEQ ID NO: 671025 - DNA, 17 bp, Homo sapiens
atatctatatatataat

SEQ ID NO: 671026 - DNA, 18 bp, Homo sapiens
atatctatatatataatt

SEQ ID NO: 671027 - DNA, 18 bp, Homo sapiens
atatctgggttaagtgtt

SEQ ID NO: 671028 - DNA, 16 bp, Homo sapiens
atatctgttattcaaa

SEQ ID NO: 671029 - DNA, 21 bp, Homo sapiens
atatctgttattcaaatttga

SEQ ID NO: 671030 - DNA, 14 bp, Homo sapiens
atatgaactgcagg

SEQ ID NO: 671031 - DNA, 20 bp, Homo sapiens
atatgacggaagaacataga

SEQ ID NO: 671032 - DNA, 21 bp, Homo sapiens
atatgaggggcagtggacagt

SEQ ID NO: 671033 - DNA, 13 bp, Homo sapiens
atatgccactgac

SEQ ID NO: 671034 - DNA, 16 bp, Homo sapiens
atatgccttaatttag

SEQ ID NO: 671035 - DNA, 16 bp, Homo sapiens
atatgctgatctttta

SEQ ID NO: 671036 - DNA, 18 bp, Homo sapiens
atatggtatatatacata

SEQ ID NO: 671037 - DNA, 19 bp, Homo sapiens
atatggtcatatacatatt

SEQ ID NO: 671038 - DNA, 18 bp, Homo sapiens
atatggtcttgagccagt

SEQ ID NO: 671039 - DNA, 20 bp, Homo sapiens
atatgtaatttcaaaataca

SEQ ID NO: 671040 - DNA, 18 bp, Homo sapiens
atatgtatatttttttaa

SEQ ID NO: 671041 - DNA, 23 bp, Homo sapiens
atatgtatatttttttaatttaa

SEQ ID NO: 671042 - DNA, 20 bp, Homo sapiens
atatgtattcttttctcagt

SEQ ID NO: 671043 - DNA, 23 bp, Homo sapiens
atattaaacatacataatacaat

SEQ ID NO: 671044 - DNA, 18 bp, Homo sapiens
atattaagtgtgccaaat

SEQ ID NO: 671045 - DNA, 22 bp, Homo sapiens
atattaagtgtgccaaatcagt

SEQ ID NO: 671046 - DNA, 23 bp, Homo sapiens
atattaattagcaggttgggcta

SEQ ID NO: 671047 - DNA, 15 bp, Homo sapiens
atattacaacattta

SEQ ID NO: 671048 - DNA, 15 bp, Homo sapiens
atattaggaaaatat

SEQ ID NO: 671049 - DNA, 19 bp, Homo sapiens
atattattagaaattagaa

SEQ ID NO: 671050 - DNA, 14 bp, Homo sapiens
atattcaatgtatt

SEQ ID NO: 671051 - DNA, 16 bp, Homo sapiens
atattcaatgtattga

SEQ ID NO: 671052 - DNA, 20 bp, Homo sapiens
atattcataaagttacagtt

SEQ ID NO: 671053 - DNA, 17 bp, Homo sapiens
atattcatgcttgccat

SEQ ID NO: 671054 - DNA, 15 bp, Homo sapiens
atattccagatcttt

SEQ ID NO: 671055 - DNA, 15 bp, Homo sapiens
atattcccattttat

SEQ ID NO: 671056 - DNA, 19 bp, Homo sapiens
atattccttttaaagaagc

SEQ ID NO: 671057 - DNA, 19 bp, Homo sapiens
atattctggttcttgaaaa

SEQ ID NO: 671058 - DNA, 13 bp, Homo sapiens
atattcttttgtt

SEQ ID NO: 671059 - DNA, 16 bp, Homo sapiens
atattcttttgtttcc

SEQ ID NO: 671060 - DNA, 17 bp, Homo sapiens
atattcttttgtttcca

SEQ ID NO: 671061 - DNA, 14 bp, Homo sapiens
atattgtttggtaa

SEQ ID NO: 671062 - DNA, 19 bp, Homo sapiens
atattgtttggtaaatgtt

SEQ ID NO: 671063 - DNA, 14 bp, Homo sapiens
atatttaatatcaa

SEQ ID NO: 671064 - DNA, 20 bp, Homo sapiens
atatttatccaaaatgtgta

SEQ ID NO: 671065 - DNA, 24 bp, Homo sapiens
atatttcttcttctaagaagacat

SEQ ID NO: 671066 - DNA, 15 bp, Homo sapiens
atatttgaaatagta

SEQ ID NO: 671067 - DNA, 18 bp, Homo sapiens
atatttgaaatagtatac

SEQ ID NO: 671068 - DNA, 15 bp, Homo sapiens
atatttgattatgta

SEQ ID NO: 671069 - DNA, 14 bp, Homo sapiens
atattttaaacaga

SEQ ID NO: 671070 - DNA, 15 bp, Homo sapiens
atattttgagaaact

SEQ ID NO: 671071 - DNA, 22 bp, Homo sapiens
atattttgtgtgaaattgcata

SEQ ID NO: 671072 - DNA, 21 bp, Homo sapiens
atattttgttgctttcttacc

SEQ ID NO: 671073 - DNA, 22 bp, Homo sapiens
atcaaaagaaaattgatatttt

SEQ ID NO: 671074 - DNA, 13 bp, Homo sapiens
atcaaactgaaac

SEQ ID NO: 671075 - DNA, 13 bp, Homo sapiens
atcaaacttatgg

SEQ ID NO: 671076 - DNA, 15 bp, Homo sapiens
atcaaataagaaata

SEQ ID NO: 671077 - DNA, 20 bp, Homo sapiens
atcaactcccaacttcttcc

SEQ ID NO: 671078 - DNA, 13 bp, Homo sapiens
atcaagatttttt

SEQ ID NO: 671079 - DNA, 16 bp, Homo sapiens
atcaagcaacattctt

SEQ ID NO: 671080 - DNA, 20 bp, Homo sapiens
atcaagtccatctgacaaaa

SEQ ID NO: 671081 - DNA, 19 bp, Homo sapiens
atcaattctgtattccaga

SEQ ID NO: 671082 - DNA, 17 bp, Homo sapiens
atcacagggtgggcctc

SEQ ID NO: 671083 - DNA, 13 bp, Homo sapiens
atcactaaaagca

SEQ ID NO: 671084 - DNA, 15 bp, Homo sapiens
atcactaaaagcatg

SEQ ID NO: 671085 - DNA, 20 bp, Homo sapiens
atcactaaaagcatgaattg

SEQ ID NO: 671086 - DNA, 22 bp, Homo sapiens
atcactaaaagcatgaattgga

SEQ ID NO: 671087 - DNA, 15 bp, Homo sapiens
atcactgaatttata

SEQ ID NO: 671088 - DNA, 18 bp, Homo sapiens
atcactgtatcattttct

SEQ ID NO: 671089 - DNA, 18 bp, Homo sapiens
atcagaacaaaacttcta

SEQ ID NO: 671090 - DNA, 17 bp, Homo sapiens
atcagagataaagctta

SEQ ID NO: 671091 - DNA, 21 bp, Homo sapiens
atcagccagcccatggccccc

SEQ ID NO: 671092 - DNA, 23 bp, Homo sapiens
atcagccagcccatggcccccaa

SEQ ID NO: 671093 - DNA, 14 bp, Homo sapiens
atcagcctgggcaa

SEQ ID NO: 671094 - DNA, 14 bp, Homo sapiens
atcaggaaagagag

SEQ ID NO: 671095 - DNA, 14 bp, Homo sapiens
atcagggcctgggg

SEQ ID NO: 671096 - DNA, 19 bp, Homo sapiens
atcagggcctggggcctga

SEQ ID NO: 671097 - DNA, 12 bp, Homo sapiens
atcagtaaatag

SEQ ID NO: 671098 - DNA, 22 bp, Homo sapiens
atcagtaaatagtgtcatataa

SEQ ID NO: 671099 - DNA, 19 bp, Homo sapiens
atcagtaacccccttaaat

SEQ ID NO: 671100 - DNA, 22 bp, Homo sapiens
atcagtaacccccttaaattta

SEQ ID NO: 671101 - DNA, 14 bp, Homo sapiens
atcagtgataattg

SEQ ID NO: 671102 - DNA, 22 bp, Homo sapiens
atcagttccagccttctctcaa

SEQ ID NO: 671103 - DNA, 21 bp, Homo sapiens
atcatagaattgcagtcattt

SEQ ID NO: 671104 - DNA, 13 bp, Homo sapiens
atcatcagggcct

SEQ ID NO: 671105 - DNA, 15 bp, Homo sapiens
atcatcagggcctgg

SEQ ID NO: 671106 - DNA, 15 bp, Homo sapiens
atcatcgccagaggt

SEQ ID NO: 671107 - DNA, 22 bp, Homo sapiens
atcatcgccagaggtgcttcac

SEQ ID NO: 671108 - DNA, 17 bp, Homo sapiens
atcatggtcctgaatgt

SEQ ID NO: 671109 - DNA, 14 bp, Homo sapiens
atcattaaaaatta

SEQ ID NO: 671110 - DNA, 13 bp, Homo sapiens
atcattccctctc

SEQ ID NO: 671111 - DNA, 17 bp, Homo sapiens
atcatttaaaaagctca

SEQ ID NO: 671112 - DNA, 20 bp, Homo sapiens
atcattttaaaatgtcttgg

SEQ ID NO: 671113 - DNA, 19 bp, Homo sapiens
atccaaaatgtgtatttct

SEQ ID NO: 671114 - DNA, 23 bp, Homo sapiens
atccaaaatgtgtatttcttata

SEQ ID NO: 671115 - DNA, 16 bp, Homo sapiens
atccacccagcaggca

SEQ ID NO: 671116 - DNA, 15 bp, Homo sapiens
atccagaaaactgtg

SEQ ID NO: 671117 - DNA, 21 bp, Homo sapiens
atccagagtcatgggagagta

SEQ ID NO: 671118 - DNA, 22 bp, Homo sapiens
atccagcttctcatgttaaata

SEQ ID NO: 671119 - DNA, 15 bp, Homo sapiens
atccatgcattatat

SEQ ID NO: 671120 - DNA, 16 bp, Homo sapiens
atccatttatttcatt

SEQ ID NO: 671121 - DNA, 11 bp, Homo sapiens
atcccatcagt

SEQ ID NO: 671122 - DNA, 15 bp, Homo sapiens
atccccatctccctg

SEQ ID NO: 671123 - DNA, 18 bp, Homo sapiens
atccccatctccctgcct

SEQ ID NO: 671124 - DNA, 13 bp, Homo sapiens
atcccctaaaata

SEQ ID NO: 671125 - DNA, 12 bp, Homo sapiens
atccctctcttc

SEQ ID NO: 671126 - DNA, 19 bp, Homo sapiens
atcctccagtaccttgctt

SEQ ID NO: 671127 - DNA, 23 bp, Homo sapiens
atcctcttttaatggcatttctc

SEQ ID NO: 671128 - DNA, 13 bp, Homo sapiens
atcctgccattta

SEQ ID NO: 671129 - DNA, 14 bp, Homo sapiens
atcctggtcagctg

SEQ ID NO: 671130 - DNA, 20 bp, Homo sapiens
atccttatcagagctaaggg

SEQ ID NO: 671131 - DNA, 17 bp, Homo sapiens
atccttccctttggaga

SEQ ID NO: 671132 - DNA, 20 bp, Homo sapiens
atccttctttgtaatacttt

SEQ ID NO: 671133 - DNA, 19 bp, Homo sapiens
atccttgtgttcagctctt

SEQ ID NO: 671134 - DNA, 12 bp, Homo sapiens
atccttttcctt

SEQ ID NO: 671135 - DNA, 15 bp, Homo sapiens
atcgagaccatcctg

SEQ ID NO: 671136 - DNA, 19 bp, Homo sapiens
atcgagaccatcctggcta

SEQ ID NO: 671137 - DNA, 18 bp, Homo sapiens
atcggtgaaactaacaga

SEQ ID NO: 671138 - DNA, 14 bp, Homo sapiens
atcgtgctactgca

SEQ ID NO: 671139 - DNA, 14 bp, Homo sapiens
atcgtttttgtatt

SEQ ID NO: 671140 - DNA, 13 bp, Homo sapiens
atctaattctgat

SEQ ID NO: 671141 - DNA, 11 bp, Homo sapiens
atctacacatg

SEQ ID NO: 671142 - DNA, 12 bp, Homo sapiens
atctacacatgt

SEQ ID NO: 671143 - DNA, 15 bp, Homo sapiens
atctacaccaatgaa

SEQ ID NO: 671144 - DNA, 22 bp, Homo sapiens
atctacaccaatgaaaacatgt

SEQ ID NO: 671145 - DNA, 13 bp, Homo sapiens
atctacttttttt

SEQ ID NO: 671146 - DNA, 12 bp, Homo sapiens
atctagccagcc

SEQ ID NO: 671147 - DNA, 21 bp, Homo sapiens
atctagccagcccctcttccc

SEQ ID NO: 671148 - DNA, 15 bp, Homo sapiens
atctaggtcctggct

SEQ ID NO: 671149 - DNA, 22 bp, Homo sapiens
atctataagtagtaaatcagaa

SEQ ID NO: 671150 - DNA, 14 bp, Homo sapiens
atctatatatataa

SEQ ID NO: 671151 - DNA, 13 bp, Homo sapiens
atctatgaggaaa

SEQ ID NO: 671152 - DNA, 21 bp, Homo sapiens
atctatggcttatttctatga

SEQ ID NO: 671153 - DNA, 17 bp, Homo sapiens
atctcaggcttctgcag

SEQ ID NO: 671154 - DNA, 13 bp, Homo sapiens
atctccctgcctg

SEQ ID NO: 671155 - DNA, 17 bp, Homo sapiens
atctccgttccatctgg

SEQ ID NO: 671156 - DNA, 19 bp, Homo sapiens
atctcggctcactgcaacc

SEQ ID NO: 671157 - DNA, 12 bp, Homo sapiens
atctctcatcct

SEQ ID NO: 671158 - DNA, 12 bp, Homo sapiens
atctctcctggc

SEQ ID NO: 671159 - DNA, 14 bp, Homo sapiens
atctctcctggcct

SEQ ID NO: 671160 - DNA, 13 bp, Homo sapiens
atctctctcttgc

SEQ ID NO: 671161 - DNA, 23 bp, Homo sapiens
atctctctcttgcctgaggggaa

SEQ ID NO: 671162 - DNA, 18 bp, Homo sapiens
atctctcttgtcctcttc

SEQ ID NO: 671163 - DNA, 22 bp, Homo sapiens
atctctgaaggagttacaggga

SEQ ID NO: 671164 - DNA, 19 bp, Homo sapiens
atctcttcatgcttgacat

SEQ ID NO: 671165 - DNA, 13 bp, Homo sapiens
atctcttctgcaa

SEQ ID NO: 671166 - DNA, 23 bp, Homo sapiens
atctcttctgcaagcctcatgcc

SEQ ID NO: 671167 - DNA, 14 bp, Homo sapiens
atctcttctggtgt

SEQ ID NO: 671168 - DNA, 20 bp, Homo sapiens
atctcttttatatttgtagg

SEQ ID NO: 671169 - DNA, 15 bp, Homo sapiens
atctctttttgtttg

SEQ ID NO: 671170 - DNA, 16 bp, Homo sapiens
atctctttttgtttgc

SEQ ID NO: 671171 - DNA, 17 bp, Homo sapiens
atctgaattaaataaat

SEQ ID NO: 671172 - DNA, 15 bp, Homo sapiens
atctgacccactttg

SEQ ID NO: 671173 - DNA, 15 bp, Homo sapiens
atctggctgcacagg

SEQ ID NO: 671174 - DNA, 17 bp, Homo sapiens
atctggctgcacaggct

SEQ ID NO: 671175 - DNA, 15 bp, Homo sapiens
atctgggtatctttc

SEQ ID NO: 671176 - DNA, 21 bp, Homo sapiens
atctggtcttgttagaaaaca

SEQ ID NO: 671177 - DNA, 19 bp, Homo sapiens
atctggttatatcattctg

SEQ ID NO: 671178 - DNA, 16 bp, Homo sapiens
atctgtgacctctgac

SEQ ID NO: 671179 - DNA, 14 bp, Homo sapiens
atctgttattcaaa

SEQ ID NO: 671180 - DNA, 21 bp, Homo sapiens
atctgttattcaaatttgatg

SEQ ID NO: 671181 - DNA, 14 bp, Homo sapiens
atctgttcatttct

SEQ ID NO: 671182 - DNA, 15 bp, Homo sapiens
atctgttcatttcta

SEQ ID NO: 671183 - DNA, 12 bp, Homo sapiens
atcttaagcagg

SEQ ID NO: 671184 - DNA, 18 bp, Homo sapiens
atcttagtgcctgagagt

SEQ ID NO: 671185 - DNA, 14 bp, Homo sapiens
atcttattataaaa

SEQ ID NO: 671186 - DNA, 15 bp, Homo sapiens
atcttcaaagccttc

SEQ ID NO: 671187 - DNA, 15 bp, Homo sapiens
atcttcaggtgaaca

SEQ ID NO: 671188 - DNA, 12 bp, Homo sapiens
atcttgaatgtg

SEQ ID NO: 671189 - DNA, 20 bp, Homo sapiens
atcttgaatgtggtctcagg

SEQ ID NO: 671190 - DNA, 21 bp, Homo sapiens
atcttgaatgtggtctcagga

SEQ ID NO: 671191 - DNA, 14 bp, Homo sapiens
atcttgcctccagg

SEQ ID NO: 671192 - DNA, 15 bp, Homo sapiens
atcttgcctccaggt

SEQ ID NO: 671193 - DNA, 21 bp, Homo sapiens
atggatatatttgaaatagta

SEQ ID NO: 671194 - DNA, 12 bp, Homo sapiens
atggcagagcag

SEQ ID NO: 671195 - DNA, 15 bp, Homo sapiens
atggcagaggagctt

SEQ ID NO: 671196 - DNA, 17 bp, Homo sapiens
atggcatcttcaatatg

SEQ ID NO: 671197 - DNA, 13 bp, Homo sapiens
atggcatttctct

SEQ ID NO: 671198 - DNA, 17 bp, Homo sapiens
atggcatttctctttaa

SEQ ID NO: 671199 - DNA, 15 bp, Homo sapiens
atggcccccaataaa

SEQ ID NO: 671200 - DNA, 19 bp, Homo sapiens
atggcccccaataaaggca

SEQ ID NO: 671201 - DNA, 21 bp, Homo sapiens
atggcccccaataaaggcagc

SEQ ID NO: 671202 - DNA, 22 bp, Homo sapiens
atggcccccaataaaggcagct

SEQ ID NO: 671203 - DNA, 17 bp, Homo sapiens
atggctatttttgaagc

SEQ ID NO: 671204 - DNA, 14 bp, Homo sapiens
atggctcagggtgg

SEQ ID NO: 671205 - DNA, 15 bp, Homo sapiens
atggctgctgttgct

SEQ ID NO: 671206 - DNA, 21 bp, Homo sapiens
atggcttatttctatgacaaa

SEQ ID NO: 671207 - DNA, 19 bp, Homo sapiens
atgggaaaaaacttaaaaa

SEQ ID NO: 671208 - DNA, 17 bp, Homo sapiens
atgggacggaggtcctt

SEQ ID NO: 671209 - DNA, 17 bp, Homo sapiens
atggggaggacaaaatg

SEQ ID NO: 671210 - DNA, 17 bp, Homo sapiens
atggggaggcaagtgtg

SEQ ID NO: 671211 - DNA, 20 bp, Homo sapiens
atggggcagaagagaaagga

SEQ ID NO: 671212 - DNA, 20 bp, Homo sapiens
atggtaataagcactgtaaa

SEQ ID NO: 671213 - DNA, 12 bp, Homo sapiens
atggtatatata

SEQ ID NO: 671214 - DNA, 16 bp, Homo sapiens
atggtcctgaatgtag

SEQ ID NO: 671215 - DNA, 12 bp, Homo sapiens
atggtcttgagc

SEQ ID NO: 671216 - DNA, 23 bp, Homo sapiens
atggtcttgagccagtaatcttt

SEQ ID NO: 671217 - DNA, 22 bp, Homo sapiens
atggtgtagccctcccactttg

SEQ ID NO: 671218 - DNA, 12 bp, Homo sapiens
atggtgtatttt

SEQ ID NO: 671219 - DNA, 18 bp, Homo sapiens
atggttgcgtcctttgaa

SEQ ID NO: 671220 - DNA, 16 bp, Homo sapiens
atggttgttgcatata

SEQ ID NO: 671221 - DNA, 22 bp, Homo sapiens
atgtaaaatgaattgaaaaaca

SEQ ID NO: 671222 - DNA, 16 bp, Homo sapiens
atgtaaagatgattta

SEQ ID NO: 671223 - DNA, 19 bp, Homo sapiens
atgtaaagatgatttaagt

SEQ ID NO: 671224 - DNA, 12 bp, Homo sapiens
atgtaaagttat

SEQ ID NO: 671225 - DNA, 20 bp, Homo sapiens
atgtaaataaactatttata

SEQ ID NO: 671226 - DNA, 23 bp, Homo sapiens
atgtaaataaactatttatatca

SEQ ID NO: 671227 - DNA, 13 bp, Homo sapiens
atgtaactgctga

SEQ ID NO: 671228 - DNA, 16 bp, Homo sapiens
atgtaagaacacattt

SEQ ID NO: 671229 - DNA, 14 bp, Homo sapiens
atgtaagtgggccc

SEQ ID NO: 671230 - DNA, 19 bp, Homo sapiens
atgtaataaaaagtatatg

SEQ ID NO: 671231 - DNA, 14 bp, Homo sapiens
atgtaatataatgt

SEQ ID NO: 671232 - DNA, 21 bp, Homo sapiens
atgtaatataatgtattttct

SEQ ID NO: 671233 - DNA, 16 bp, Homo sapiens
atgtaatttaaatgaa

SEQ ID NO: 671234 - DNA, 13 bp, Homo sapiens
atgtaatttcaaa

SEQ ID NO: 671235 - DNA, 20 bp, Homo sapiens
atgtaatttcaaaatacatt

SEQ ID NO: 671236 - DNA, 15 bp, Homo sapiens
atgtaattttgtgta

SEQ ID NO: 671237 - DNA, 16 bp, Homo sapiens
atgtaattttgtgtaa

SEQ ID NO: 671238 - DNA, 17 bp, Homo sapiens
atgtaattttgtgtaag

SEQ ID NO: 671239 - DNA, 14 bp, Homo sapiens
atgtacagattctt

SEQ ID NO: 671240 - DNA, 12 bp, Homo sapiens
atgtacatcttt

SEQ ID NO: 671241 - DNA, 20 bp, Homo sapiens
atgtactacagctatatttg

SEQ ID NO: 671242 - DNA, 20 bp, Homo sapiens
atgtacttgaaaaatgtttt

SEQ ID NO: 671243 - DNA, 13 bp, Homo sapiens
atgtagaaactta

SEQ ID NO: 671244 - DNA, 14 bp, Homo sapiens
atgtagaaacttaa

SEQ ID NO: 671245 - DNA, 18 bp, Homo sapiens
atgtagaggcttgtttac

SEQ ID NO: 671246 - DNA, 22 bp, Homo sapiens
atgtagatattgtgaagtacat

SEQ ID NO: 671247 - DNA, 17 bp, Homo sapiens
atgtagccagcagaact

SEQ ID NO: 671248 - DNA, 20 bp, Homo sapiens
atgtagccagcagaactgaa

SEQ ID NO: 671249 - DNA, 13 bp, Homo sapiens
atgtagcccatcc

SEQ ID NO: 671250 - DNA, 16 bp, Homo sapiens
atgtagcccatccttc

SEQ ID NO: 671251 - DNA, 23 bp, Homo sapiens
atgtagcgtgtaagcttgtgttt

SEQ ID NO: 671252 - DNA, 14 bp, Homo sapiens
atgtataaaataca

SEQ ID NO: 671253 - DNA, 14 bp, Homo sapiens
atgtataaatatac

SEQ ID NO: 671254 - DNA, 17 bp, Homo sapiens
atgtataaatatacagt

SEQ ID NO: 671255 - DNA, 17 bp, Homo sapiens
atgtataaccaagtgtg

SEQ ID NO: 671256 - DNA, 22 bp, Homo sapiens
atgtataatgtgcagaaaatat

SEQ ID NO: 671257 - DNA, 19 bp, Homo sapiens
atgtatatatatatatgca

SEQ ID NO: 671258 - DNA, 18 bp, Homo sapiens
atgtatatttttttaatt

SEQ ID NO: 671259 - DNA, 22 bp, Homo sapiens
atgtatggaatcccactgtatg

SEQ ID NO: 671260 - DNA, 14 bp, Homo sapiens
atgtatggatatat

SEQ ID NO: 671261 - DNA, 15 bp, Homo sapiens
atgtatggatatatt

SEQ ID NO: 671262 - DNA, 17 bp, Homo sapiens
atgtatggatatatttg

SEQ ID NO: 671263 - DNA, 19 bp, Homo sapiens
atgtatggatatatttgaa

SEQ ID NO: 671264 - DNA, 16 bp, Homo sapiens
atgtatttgttatata

SEQ ID NO: 671265 - DNA, 21 bp, Homo sapiens
atgtattttctttttattttg

SEQ ID NO: 671266 - DNA, 19 bp, Homo sapiens
atgtcaaatatttagatgt

SEQ ID NO: 671267 - DNA, 19 bp, Homo sapiens
atgtcaattcataaaaaca

SEQ ID NO: 671268 - DNA, 18 bp, Homo sapiens
atgtcaccggtcagtgcc

SEQ ID NO: 671269 - DNA, 12 bp, Homo sapiens
atgtccaaagag

SEQ ID NO: 671270 - DNA, 21 bp, Homo sapiens
atgtccaaagaggctgcccct

SEQ ID NO: 671271 - DNA, 22 bp, Homo sapiens
atgtccaaagaggctgcccctc

SEQ ID NO: 671272 - DNA, 16 bp, Homo sapiens
atgtccagcaccttgt

SEQ ID NO: 671273 - DNA, 20 bp, Homo sapiens
atgtccctgggccagggtct

SEQ ID NO: 671274 - DNA, 19 bp, Homo sapiens
atgtcctaattcttctgtc

SEQ ID NO: 671275 - DNA, 13 bp, Homo sapiens
atgtctgctgagt

SEQ ID NO: 671276 - DNA, 20 bp, Homo sapiens
atgtctgctgagttggcctg

SEQ ID NO: 671277 - DNA, 18 bp, Homo sapiens
atgtctgtagctcctcaa

SEQ ID NO: 671278 - DNA, 22 bp, Homo sapiens
atgtcttccatgtatcttttga

SEQ ID NO: 671279 - DNA, 17 bp, Homo sapiens
atgtgaaaaattaactt

SEQ ID NO: 671280 - DNA, 19 bp, Homo sapiens
atgtgaataggttatatgc

SEQ ID NO: 671281 - DNA, 15 bp, Homo sapiens
atgtgagctcttcct

SEQ ID NO: 671282 - DNA, 19 bp, Homo sapiens
atgtgaggggtccctagca

SEQ ID NO: 671283 - DNA, 20 bp, Homo sapiens
atgtgagtgacgatgatgta

SEQ ID NO: 671284 - DNA, 23 bp, Homo sapiens
atgtgagtgccttttgcagaaga

SEQ ID NO: 671285 - DNA, 18 bp, Homo sapiens
atgtgcagaaaatattta

SEQ ID NO: 671286 - DNA, 21 bp, Homo sapiens
atgtgcatttttgtgaaatga

SEQ ID NO: 671287 - DNA, 16 bp, Homo sapiens
atgtgcccaggggagc

SEQ ID NO: 671288 - DNA, 10 bp, Homo sapiens
atgtgccttt

SEQ ID NO: 671289 - DNA, 13 bp, Homo sapiens
atgtgcctttctt

SEQ ID NO: 671290 - DNA, 18 bp, Homo sapiens
atgtgcctttctttgcct

SEQ ID NO: 671291 - DNA, 20 bp, Homo sapiens
atgtgcctttctttgcctct

SEQ ID NO: 671292 - DNA, 22 bp, Homo sapiens
atgtgcctttctttgcctctgc

SEQ ID NO: 671293 - DNA, 15 bp, Homo sapiens
atgtgtaaagattta

SEQ ID NO: 671294 - DNA, 18 bp, Homo sapiens
atgtgtcctatctatctt

SEQ ID NO: 671295 - DNA, 14 bp, Homo sapiens
atgtgtcctggtga

SEQ ID NO: 671296 - DNA, 16 bp, Homo sapiens
atgtgtggtggcctca

SEQ ID NO: 671297 - DNA, 19 bp, Homo sapiens
atgtgtggtggcctcagct

SEQ ID NO: 671298 - DNA, 14 bp, Homo sapiens
atgtgtgtaggtta

SEQ ID NO: 671299 - DNA, 22 bp, Homo sapiens
atgttaaagagaatgagtcctt

SEQ ID NO: 671300 - DNA, 16 bp, Homo sapiens
atgttatatcatatgt

SEQ ID NO: 671301 - DNA, 17 bp, Homo sapiens
atgttatcggattactg

SEQ ID NO: 671302 - DNA, 19 bp, Homo sapiens
atgttatcggattactgaa

SEQ ID NO: 671303 - DNA, 22 bp, Homo sapiens
atgttatcggattactgaattg

SEQ ID NO: 671304 - DNA, 18 bp, Homo sapiens
atgttcaaagccacatta

SEQ ID NO: 671305 - DNA, 19 bp, Homo sapiens
atgttcctaacaaaatgag

SEQ ID NO: 671306 - DNA, 16 bp, Homo sapiens
atgttcctcaaatcag

SEQ ID NO: 671307 - DNA, 18 bp, Homo sapiens
atgttccttttaaagaaa

SEQ ID NO: 671308 - DNA, 23 bp, Homo sapiens
atgttccttttttgtatattaca

SEQ ID NO: 671309 - DNA, 21 bp, Homo sapiens
atgttctgcctctccctgggt

SEQ ID NO: 671310 - DNA, 15 bp, Homo sapiens
atttccaagaggctg

SEQ ID NO: 671311 - DNA, 20 bp, Homo sapiens
atttccgtgaactctggtgc

SEQ ID NO: 671312 - DNA, 21 bp, Homo sapiens
atttccgtgaactctggtgct

SEQ ID NO: 671313 - DNA, 21 bp, Homo sapiens
atttcctcagcttatctcttt

SEQ ID NO: 671314 - DNA, 20 bp, Homo sapiens
atttcctttcataccttgaa

SEQ ID NO: 671315 - DNA, 13 bp, Homo sapiens
atttcgtatttct

SEQ ID NO: 671316 - DNA, 17 bp, Homo sapiens
atttcgtatttctcata

SEQ ID NO: 671317 - DNA, 13 bp, Homo sapiens
atttctaaattta

SEQ ID NO: 671318 - DNA, 16 bp, Homo sapiens
atttctaagaagttgt

SEQ ID NO: 671319 - DNA, 17 bp, Homo sapiens
atttctaagaagttgtt

SEQ ID NO: 671320 - DNA, 22 bp, Homo sapiens
atttctaagaagttgtttgagg

SEQ ID NO: 671321 - DNA, 18 bp, Homo sapiens
atttctaatccttttcct

SEQ ID NO: 671322 - DNA, 20 bp, Homo sapiens
atttctaatccttttcctta

SEQ ID NO: 671323 - DNA, 20 bp, Homo sapiens
atttctagtccaaaattaca

SEQ ID NO: 671324 - DNA, 22 bp, Homo sapiens
atttctcattgacttttataaa

SEQ ID NO: 671325 - DNA, 23 bp, Homo sapiens
atttctctattttcataatcagt

SEQ ID NO: 671326 - DNA, 20 bp, Homo sapiens
atttctcttctacccttttc

SEQ ID NO: 671327 - DNA, 22 bp, Homo sapiens
atttctcttctacccttttcct

SEQ ID NO: 671328 - DNA, 16 bp, Homo sapiens
atttctgggtcttttg

SEQ ID NO: 671329 - DNA, 18 bp, Homo sapiens
atttctgggtcttttgct

SEQ ID NO: 671330 - DNA, 20 bp, Homo sapiens
atttctgggtcttttgctac

SEQ ID NO: 671331 - DNA, 23 bp, Homo sapiens
atttcttaaataatgcttcagat

SEQ ID NO: 671332 - DNA, 17 bp, Homo sapiens
atttcttcacttcaagc

SEQ ID NO: 671333 - DNA, 12 bp, Homo sapiens
atttcttccctg

SEQ ID NO: 671334 - DNA, 13 bp, Homo sapiens
atttcttccctgc

SEQ ID NO: 671335 - DNA, 13 bp, Homo sapiens
atttgaaggccag

SEQ ID NO: 671336 - DNA, 17 bp, Homo sapiens
atttgaagtaacttatt

SEQ ID NO: 671337 - DNA, 24 bp, Homo sapiens
atttgaagtaacttatttgactat

SEQ ID NO: 671338 - DNA, 20 bp, Homo sapiens
atttgactatgaatgttatc

SEQ ID NO: 671339 - DNA, 16 bp, Homo sapiens
atttgagcatatcagt

SEQ ID NO: 671340 - DNA, 14 bp, Homo sapiens
atttgaggtcagtg

SEQ ID NO: 671341 - DNA, 16 bp, Homo sapiens
atttgaggtcagtgtt

SEQ ID NO: 671342 - DNA, 22 bp, Homo sapiens
atttgatggactaattattatt

SEQ ID NO: 671343 - DNA, 14 bp, Homo sapiens
atttgattatgtat

SEQ ID NO: 671344 - DNA, 14 bp, Homo sapiens
atttgatttctaat

SEQ ID NO: 671345 - DNA, 15 bp, Homo sapiens
atttgcaatttgagc

SEQ ID NO: 671346 - DNA, 22 bp, Homo sapiens
atttgcatattttgagaaactg

SEQ ID NO: 671347 - DNA, 16 bp, Homo sapiens
atttgctactgttgta

SEQ ID NO: 671348 - DNA, 14 bp, Homo sapiens
atttgctgaactca

SEQ ID NO: 671349 - DNA, 13 bp, Homo sapiens
atttgctttggaa

SEQ ID NO: 671350 - DNA, 20 bp, Homo sapiens
atttgggagaagcaaatata

SEQ ID NO: 671351 - DNA, 21 bp, Homo sapiens
atttggtatatactttgccac

SEQ ID NO: 671352 - DNA, 14 bp, Homo sapiens
atttgtaaaacttc

SEQ ID NO: 671353 - DNA, 17 bp, Homo sapiens
atttgtaaaacttctgc

SEQ ID NO: 671354 - DNA, 21 bp, Homo sapiens
atttgtaaaacttctgctcgt

SEQ ID NO: 671355 - DNA, 17 bp, Homo sapiens
atttgtaaagctattta

SEQ ID NO: 671356 - DNA, 19 bp, Homo sapiens
atttgtaaagctatttatg

SEQ ID NO: 671357 - DNA, 15 bp, Homo sapiens
atttgtaagtgtaaa

SEQ ID NO: 671358 - DNA, 9 bp, Homo sapiens
atttgtagc

SEQ ID NO: 671359 - DNA, 11 bp, Homo sapiens
atttgtagcat

SEQ ID NO: 671360 - DNA, 17 bp, Homo sapiens
atttgtagcataactgt

SEQ ID NO: 671361 - DNA, 18 bp, Homo sapiens
atttgtagcataactgta

SEQ ID NO: 671362 - DNA, 22 bp, Homo sapiens
atttgtagcataactgtagctc

SEQ ID NO: 671363 - DNA, 16 bp, Homo sapiens
atttgtgaaaatgtaa

SEQ ID NO: 671364 - DNA, 14 bp, Homo sapiens
atttgtgcttttta

SEQ ID NO: 671365 - DNA, 19 bp, Homo sapiens
atttgtggtaatctacacc

SEQ ID NO: 671366 - DNA, 19 bp, Homo sapiens
atttgtgtttttctttttc

SEQ ID NO: 671367 - DNA, 15 bp, Homo sapiens
atttgttatatataa

SEQ ID NO: 671368 - DNA, 18 bp, Homo sapiens
atttgttatatataataa

SEQ ID NO: 671369 - DNA, 19 bp, Homo sapiens
atttgttatatataataaa

SEQ ID NO: 671370 - DNA, 21 bp, Homo sapiens
atttgtttatttgcaatttga

SEQ ID NO: 671371 - DNA, 21 bp, Homo sapiens
atttgtttgtgttcaatatca

SEQ ID NO: 671372 - DNA, 19 bp, Homo sapiens
attttaaaataaattagtt

SEQ ID NO: 671373 - DNA, 16 bp, Homo sapiens
attttaaaatatatga

SEQ ID NO: 671374 - DNA, 15 bp, Homo sapiens
attttaaaatgtctt

SEQ ID NO: 671375 - DNA, 17 bp, Homo sapiens
attttaaagtgcaaaag

SEQ ID NO: 671376 - DNA, 19 bp, Homo sapiens
attttaatgtacttgaaaa

SEQ ID NO: 671377 - DNA, 15 bp, Homo sapiens
attttacagatttct

SEQ ID NO: 671378 - DNA, 22 bp, Homo sapiens
attttacagctcattaaacttt

SEQ ID NO: 671379 - DNA, 15 bp, Homo sapiens
attttaggaacttca

SEQ ID NO: 671380 - DNA, 11 bp, Homo sapiens
attttatatca

SEQ ID NO: 671381 - DNA, 19 bp, Homo sapiens
attttatcattaaaaatta

SEQ ID NO: 671382 - DNA, 20 bp, Homo sapiens
attttatcattaaaaattac

SEQ ID NO: 671383 - DNA, 13 bp, Homo sapiens
attttattaataa

SEQ ID NO: 671384 - DNA, 16 bp, Homo sapiens
attttattaataatat

SEQ ID NO: 671385 - DNA, 21 bp, Homo sapiens
attttcagaagttaacatcaa

SEQ ID NO: 671386 - DNA, 16 bp, Homo sapiens
attttcagctgcaagg

SEQ ID NO: 671387 - DNA, 17 bp, Homo sapiens
attttcagctgcaagga

SEQ ID NO: 671388 - DNA, 19 bp, Homo sapiens
attttcctgttgtcaagaa

SEQ ID NO: 671389 - DNA, 12 bp, Homo sapiens
attttctaaata

SEQ ID NO: 671390 - DNA, 15 bp, Homo sapiens
attttctacaattaa

SEQ ID NO: 671391 - DNA, 17 bp, Homo sapiens
attttctgtaatctttt

SEQ ID NO: 671392 - DNA, 18 bp, Homo sapiens
attttcttctctgtgaga

SEQ ID NO: 671393 - DNA, 18 bp, Homo sapiens
attttctttatcattgct

SEQ ID NO: 671394 - DNA, 15 bp, Homo sapiens
attttgaaacaaagt

SEQ ID NO: 671395 - DNA, 17 bp, Homo sapiens
attttgatgtaaagatg

SEQ ID NO: 671396 - DNA, 18 bp, Homo sapiens
attttgatgtaaagatgt

SEQ ID NO: 671397 - DNA, 14 bp, Homo sapiens
attttgcactagaa

SEQ ID NO: 671398 - DNA, 18 bp, Homo sapiens
attttgcactctgtaatt

SEQ ID NO: 671399 - DNA, 18 bp, Homo sapiens
attttggaaattgttgta

SEQ ID NO: 671400 - DNA, 19 bp, Homo sapiens
attttggagattataataa

SEQ ID NO: 671401 - DNA, 21 bp, Homo sapiens
attttggagattataataaat

SEQ ID NO: 671402 - DNA, 20 bp, Homo sapiens
attttgtaatgtatcaaata

SEQ ID NO: 671403 - DNA, 16 bp, Homo sapiens
attttgtcttattctt

SEQ ID NO: 671404 - DNA, 18 bp, Homo sapiens
attttgtcttattcttaa

SEQ ID NO: 671405 - DNA, 19 bp, Homo sapiens
attttgtcttattcttaag

SEQ ID NO: 671406 - DNA, 20 bp, Homo sapiens
attttgtgctcatttaagtt

SEQ ID NO: 671407 - DNA, 20 bp, Homo sapiens
attttgtgtaaatttctcaa

SEQ ID NO: 671408 - DNA, 17 bp, Homo sapiens
attttgtgtaagaaata

SEQ ID NO: 671409 - DNA, 18 bp, Homo sapiens
attttgtgtaagaaatac

SEQ ID NO: 671410 - DNA, 20 bp, Homo sapiens
attttgtgtaagaaatacag

SEQ ID NO: 671411 - DNA, 13 bp, Homo sapiens
attttgttgcctt

SEQ ID NO: 671412 - DNA, 17 bp, Homo sapiens
atttttaaaaagaaatc

SEQ ID NO: 671413 - DNA, 19 bp, Homo sapiens
atttttaagaaaggaagca

SEQ ID NO: 671414 - DNA, 19 bp, Homo sapiens
atttttaagaaagtaattt

SEQ ID NO: 671415 - DNA, 16 bp, Homo sapiens
atttttaggcaaagat

SEQ ID NO: 671416 - DNA, 19 bp, Homo sapiens
atttttatacaagtaattt

SEQ ID NO: 671417 - DNA, 15 bp, Homo sapiens
atttttatactgaca

SEQ ID NO: 671418 - DNA, 12 bp, Homo sapiens
atttttattgtt

SEQ ID NO: 671419 - DNA, 16 bp, Homo sapiens
atttttctcccaagaa

SEQ ID NO: 671420 - DNA, 19 bp, Homo sapiens
atttttctgaggtccttat

SEQ ID NO: 671421 - DNA, 12 bp, Homo sapiens
atttttgcactt

SEQ ID NO: 671422 - DNA, 14 bp, Homo sapiens
atttttgtatttct

SEQ ID NO: 671423 - DNA, 13 bp, Homo sapiens
atttttgtatttt

SEQ ID NO: 671424 - DNA, 12 bp, Homo sapiens
attttttaagct

SEQ ID NO: 671425 - DNA, 12 bp, Homo sapiens
attttttcttct

SEQ ID NO: 671426 - DNA, 18 bp, Homo sapiens
attttttcttctgaagat

SEQ ID NO: 671427 - DNA, 12 bp, Homo sapiens
attttttgaata

SEQ ID NO: 671428 - DNA, 14 bp, Homo sapiens
attttttgaatatg

SEQ ID NO: 671429 - DNA, 19 bp, Homo sapiens
attttttggtggtgaaatt

SEQ ID NO: 671430 - DNA, 20 bp, Homo sapiens
attttttggtggtgaaattg

SEQ ID NO: 671431 - DNA, 17 bp, Homo sapiens
atttttttaaaattttg

SEQ ID NO: 671432 - DNA, 22 bp, Homo sapiens
atttttttgcatgcatgcaaat

SEQ ID NO: 671433 - DNA, 23 bp, Homo sapiens
atttttttgcatgcatgcaaatg

SEQ ID NO: 671434 - DNA, 21 bp, Homo sapiens
caaaaaaaatttagccgggcg

SEQ ID NO: 671435 - DNA, 15 bp, Homo sapiens
caaaaaaacaaaaaa

SEQ ID NO: 671436 - DNA, 23 bp, Homo sapiens
caaaaaagacttgagacaatgtt

SEQ ID NO: 671437 - DNA, 12 bp, Homo sapiens
caaaaaatacat

SEQ ID NO: 671438 - DNA, 21 bp, Homo sapiens
caaaaaggagccttttgctct

SEQ ID NO: 671439 - DNA, 19 bp, Homo sapiens
caaaaatcccaccttccca

SEQ ID NO: 671440 - DNA, 13 bp, Homo sapiens
caaaaatgatttt

SEQ ID NO: 671441 - DNA, 23 bp, Homo sapiens
caaaacctgtattactgaataat

SEQ ID NO: 671442 - DNA, 17 bp, Homo sapiens
caaaagaaaattgatat

SEQ ID NO: 671443 - DNA, 21 bp, Homo sapiens
caaaagaaatttaagttctat

SEQ ID NO: 671444 - DNA, 16 bp, Homo sapiens
caaaagcttcaaatta

SEQ ID NO: 671445 - DNA, 18 bp, Homo sapiens
caaaatacatttgtaagt

SEQ ID NO: 671446 - DNA, 13 bp, Homo sapiens
caaaatgtctgta

SEQ ID NO: 671447 - DNA, 15 bp, Homo sapiens
caaaattagaaatgt

SEQ ID NO: 671448 - DNA, 20 bp, Homo sapiens
caaaattgtctaaaatgtca

SEQ ID NO: 671449 - DNA, 15 bp, Homo sapiens
caaacaggacagcac

SEQ ID NO: 671450 - DNA, 14 bp, Homo sapiens
caaacagtatttct

SEQ ID NO: 671451 - DNA, 15 bp, Homo sapiens
caaacatgtatgtat

SEQ ID NO: 671452 - DNA, 23 bp, Homo sapiens
caaaccgccagcgaacttgacaa

SEQ ID NO: 671453 - DNA, 13 bp, Homo sapiens
caaaccggcaggt

SEQ ID NO: 671454 - DNA, 14 bp, Homo sapiens
caaacttactattt

SEQ ID NO: 671455 - DNA, 15 bp, Homo sapiens
caaacttactatttt

SEQ ID NO: 671456 - DNA, 13 bp, Homo sapiens
caaagaaaggaga

SEQ ID NO: 671457 - DNA, 15 bp, Homo sapiens
caaagaggctgcccc

SEQ ID NO: 671458 - DNA, 21 bp, Homo sapiens
caaagaggctgcccctctcac

SEQ ID NO: 671459 - DNA, 23 bp, Homo sapiens
caaagaggctgcccctctcacca

SEQ ID NO: 671460 - DNA, 23 bp, Homo sapiens
caaagatctgaattaaataaata

SEQ ID NO: 671461 - DNA, 22 bp, Homo sapiens
caaagatgtgttcaggcattcc

SEQ ID NO: 671462 - DNA, 23 bp, Homo sapiens
caaagccagggtctctccctcag

SEQ ID NO: 671463 - DNA, 14 bp, Homo sapiens
caaagctgagcctg

SEQ ID NO: 671464 - DNA, 23 bp, Homo sapiens
caaagctttcctgtttccagggt

SEQ ID NO: 671465 - DNA, 14 bp, Homo sapiens
caaagtactcttta

SEQ ID NO: 671466 - DNA, 13 bp, Homo sapiens
caaagtataacca

SEQ ID NO: 671467 - DNA, 19 bp, Homo sapiens
caaagtatttttttctttt

SEQ ID NO: 671468 - DNA, 22 bp, Homo sapiens
caaagttgattaagaaaggaag

SEQ ID NO: 671469 - DNA, 23 bp, Homo sapiens
caaagttgattaagaaaggaagt

SEQ ID NO: 671470 - DNA, 12 bp, Homo sapiens
caaataaagcct

SEQ ID NO: 671471 - DNA, 16 bp, Homo sapiens
caaataaagcctttta

SEQ ID NO: 671472 - DNA, 22 bp, Homo sapiens
caaataaagccttttaaatcat

SEQ ID NO: 671473 - DNA, 22 bp, Homo sapiens
caaatacatgtgtatattcctt

SEQ ID NO: 671474 - DNA, 13 bp, Homo sapiens
caaatacctcaat

SEQ ID NO: 671475 - DNA, 20 bp, Homo sapiens
caaatacctcaatttttgtt

SEQ ID NO: 671476 - DNA, 19 bp, Homo sapiens
caaatataagacatttgtt

SEQ ID NO: 671477 - DNA, 23 bp, Homo sapiens
caaatataagacatttgtttgct

SEQ ID NO: 671478 - DNA, 23 bp, Homo sapiens
caaatatacattttctaaataaa

SEQ ID NO: 671479 - DNA, 21 bp, Homo sapiens
caaatataggtcctgtgttaa

SEQ ID NO: 671480 - DNA, 21 bp, Homo sapiens
caaatatttagatgtaatttt

SEQ ID NO: 671481 - DNA, 22 bp, Homo sapiens
caaatatttagatgtaattttg

SEQ ID NO: 671482 - DNA, 17 bp, Homo sapiens
caaatcaacttttatgc

SEQ ID NO: 671483 - DNA, 17 bp, Homo sapiens
caaatcagtgataattg

SEQ ID NO: 671484 - DNA, 17 bp, Homo sapiens
caaatcccgcagcctcg

SEQ ID NO: 671485 - DNA, 16 bp, Homo sapiens
caaatcgatttagtaa

SEQ ID NO: 671486 - DNA, 22 bp, Homo sapiens
caaatcgatttagtaagtatgt

SEQ ID NO: 671487 - DNA, 14 bp, Homo sapiens
caaatctaccactg

SEQ ID NO: 671488 - DNA, 15 bp, Homo sapiens
caaatctcctgctga

SEQ ID NO: 671489 - DNA, 14 bp, Homo sapiens
caaatgaagaaagt

SEQ ID NO: 671490 - DNA, 22 bp, Homo sapiens
caaatgaagaaagtcaaaaaat

SEQ ID NO: 671491 - DNA, 18 bp, Homo sapiens
caaatgtcattgtctact

SEQ ID NO: 671492 - DNA, 15 bp, Homo sapiens
caaattaaaacaaat

SEQ ID NO: 671493 - DNA, 12 bp, Homo sapiens
caaattaactgt

SEQ ID NO: 671494 - DNA, 14 bp, Homo sapiens
caaattgtatctta

SEQ ID NO: 671495 - DNA, 19 bp, Homo sapiens
caaatttgatgatgttaaa

SEQ ID NO: 671496 - DNA, 21 bp, Homo sapiens
caaattttcaagtttacactt

SEQ ID NO: 671497 - DNA, 16 bp, Homo sapiens
caaattttcagaaggt

SEQ ID NO: 671498 - DNA, 22 bp, Homo sapiens
caacaaagtatttttttctttt

SEQ ID NO: 671499 - DNA, 22 bp, Homo sapiens
caacaaatattcactggcccct

SEQ ID NO: 671500 - DNA, 15 bp, Homo sapiens
caacaacaaaaaata

SEQ ID NO: 671501 - DNA, 22 bp, Homo sapiens
caacaacaaaaaatacattata

SEQ ID NO: 671502 - DNA, 22 bp, Homo sapiens
caacacatcaggaaagagagca

SEQ ID NO: 671503 - DNA, 24 bp, Homo sapiens
caacacttccagcatttagctggc

SEQ ID NO: 671504 - DNA, 17 bp, Homo sapiens
caacagccctgcctgag

SEQ ID NO: 671505 - DNA, 16 bp, Homo sapiens
caacaggtcacttgat

SEQ ID NO: 671506 - DNA, 20 bp, Homo sapiens
caacagttgtatgtttgctg

SEQ ID NO: 671507 - DNA, 22 bp, Homo sapiens
caacagttgtatgtttgctgat

SEQ ID NO: 671508 - DNA, 13 bp, Homo sapiens
caacatggctttg

SEQ ID NO: 671509 - DNA, 16 bp, Homo sapiens
caaccaggcacctctt

SEQ ID NO: 671510 - DNA, 19 bp, Homo sapiens
caacctcagggctcccagg

SEQ ID NO: 671511 - DNA, 16 bp, Homo sapiens
caacctcgctgagggc

SEQ ID NO: 671512 - DNA, 20 bp, Homo sapiens
caacggaggcctgcgaccct

SEQ ID NO: 671513 - DNA, 15 bp, Homo sapiens
caactaattttctcc

SEQ ID NO: 671514 - DNA, 15 bp, Homo sapiens
caactgccaggctgc

SEQ ID NO: 671515 - DNA, 16 bp, Homo sapiens
caactgccaggctgcc

SEQ ID NO: 671516 - DNA, 23 bp, Homo sapiens
caactggagttccttatccctct

SEQ ID NO: 671517 - DNA, 21 bp, Homo sapiens
caactggggttgcgtctgagg

SEQ ID NO: 671518 - DNA, 18 bp, Homo sapiens
caacttcttcctgtgaag

SEQ ID NO: 671519 - DNA, 23 bp, Homo sapiens
caactttgtcgtggttcttaaat

SEQ ID NO: 671520 - DNA, 23 bp, Homo sapiens
caacttttatgcagcaaatatat

SEQ ID NO: 671521 - DNA, 14 bp, Homo sapiens
caagaatgaaaaat

SEQ ID NO: 671522 - DNA, 19 bp, Homo sapiens
caagaatgaaaaatataat

SEQ ID NO: 671523 - DNA, 21 bp, Homo sapiens
caagaatgaaaaatataatgt

SEQ ID NO: 671524 - DNA, 14 bp, Homo sapiens
caagacagagggga

SEQ ID NO: 671525 - DNA, 15 bp, Homo sapiens
caagacagaggggag

SEQ ID NO: 671526 - DNA, 11 bp, Homo sapiens
caagacatttg

SEQ ID NO: 671527 - DNA, 13 bp, Homo sapiens
caagacatttgct

SEQ ID NO: 671528 - DNA, 15 bp, Homo sapiens
caagacatttgctga

SEQ ID NO: 671529 - DNA, 13 bp, Homo sapiens
caagagagatgtt

SEQ ID NO: 671530 - DNA, 15 bp, Homo sapiens
caagagagatgtttt

SEQ ID NO: 671531 - DNA, 23 bp, Homo sapiens
caagagagcgagaccctgtctca

SEQ ID NO: 671532 - DNA, 12 bp, Homo sapiens
caagagatctac

SEQ ID NO: 671533 - DNA, 19 bp, Homo sapiens
caagagatctacacatgtt

SEQ ID NO: 671534 - DNA, 21 bp, Homo sapiens
caagagctagaaaaataaaat

SEQ ID NO: 671535 - DNA, 21 bp, Homo sapiens
caagatattattaatttttat

SEQ ID NO: 671536 - DNA, 21 bp, Homo sapiens
caagatggacttacctggcag

SEQ ID NO: 671537 - DNA, 15 bp, Homo sapiens
caagatttttttcct

SEQ ID NO: 671538 - DNA, 22 bp, Homo sapiens
caagcaacatttgtatggattt

SEQ ID NO: 671539 - DNA, 11 bp, Homo sapiens
caagcagagga

SEQ ID NO: 671540 - DNA, 21 bp, Homo sapiens
caagcagaggaccagggcctt

SEQ ID NO: 671541 - DNA, 15 bp, Homo sapiens
caagctagtgtttct

SEQ ID NO: 671542 - DNA, 15 bp, Homo sapiens
caagctgattttatt

SEQ ID NO: 671543 - DNA, 20 bp, Homo sapiens
caagctgttatttcttccct

SEQ ID NO: 671544 - DNA, 22 bp, Homo sapiens
caagctgttatttcttccctgc

SEQ ID NO: 671545 - DNA, 12 bp, Homo sapiens
caaggaagcaga

SEQ ID NO: 671546 - DNA, 15 bp, Homo sapiens
caaggaagcagaaga

SEQ ID NO: 671547 - DNA, 16 bp, Homo sapiens
caaggaataaatgaga

SEQ ID NO: 671548 - DNA, 20 bp, Homo sapiens
caaggaataaatgagaggga

SEQ ID NO: 671549 - DNA, 18 bp, Homo sapiens
caaggagggggcctcatt

SEQ ID NO: 671550 - DNA, 19 bp, Homo sapiens
caaggagggggcctcattg

SEQ ID NO: 671551 - DNA, 18 bp, Homo sapiens
caaggatatactgcagct

SEQ ID NO: 671552 - DNA, 14 bp, Homo sapiens
caagggatttgagg

SEQ ID NO: 671553 - DNA, 15 bp, Homo sapiens
caagggggactgtct

SEQ ID NO: 671554 - DNA, 19 bp, Homo sapiens
caaggtataataaaattat

SEQ ID NO: 671555 - DNA, 19 bp, Homo sapiens
caaggtggggattgcccct

SEQ ID NO: 671556 - DNA, 18 bp, Homo sapiens
caagtaagaagacatgaa

SEQ ID NO: 671557 - DNA, 17 bp, Homo sapiens
caagtcccatcatagaa

SEQ ID NO: 671558 - DNA, 19 bp, Homo sapiens
caagtccgcagaagccctg

SEQ ID NO: 671559 - DNA, 20 bp, Homo sapiens
caagtgaaattattttggag

SEQ ID NO: 671560 - DNA, 16 bp, Homo sapiens
caagttaccaatgtaa

SEQ ID NO: 671561 - DNA, 20 bp, Homo sapiens
caagtttaaaagccatgtat

SEQ ID NO: 671562 - DNA, 15 bp, Homo sapiens
caagtttatatatat

SEQ ID NO: 671563 - DNA, 18 bp, Homo sapiens
caataaaaacattttgaa

SEQ ID NO: 671564 - DNA, 20 bp, Homo sapiens
caataaaatttaaaaaataa

SEQ ID NO: 671565 - DNA, 13 bp, Homo sapiens
caataaagcaatg

SEQ ID NO: 671566 - DNA, 11 bp, Homo sapiens
caataaaggca

SEQ ID NO: 671567 - DNA, 15 bp, Homo sapiens
caataaaggcagctg

SEQ ID NO: 671568 - DNA, 18 bp, Homo sapiens
caataaaggcagctgcct

SEQ ID NO: 671569 - DNA, 21 bp, Homo sapiens
caataaaggcagctgcctctg

SEQ ID NO: 671570 - DNA, 23 bp, Homo sapiens
caataaaggcagctgcctctgct

SEQ ID NO: 671571 - DNA, 15 bp, Homo sapiens
caataacactgtatt

SEQ ID NO: 671572 - DNA, 12 bp, Homo sapiens
caataactctgg

SEQ ID NO: 671573 - DNA, 14 bp, Homo sapiens
caataactctggga

SEQ ID NO: 671574 - DNA, 21 bp, Homo sapiens
caataagcgttaagggcagag

SEQ ID NO: 671575 - DNA, 16 bp, Homo sapiens
caataattctacatgt

SEQ ID NO: 671576 - DNA, 17 bp, Homo sapiens
attctgagcctgatatt

SEQ ID NO: 671577 - DNA, 22 bp, Homo sapiens
attctgattctggctttaagcc

SEQ ID NO: 671578 - DNA, 16 bp, Homo sapiens
attctgcctatgtaaa

SEQ ID NO: 671579 - DNA, 21 bp, Homo sapiens
attctggataaagccactgaa

SEQ ID NO: 671580 - DNA, 19 bp, Homo sapiens
attctggctttaagccttc

SEQ ID NO: 671581 - DNA, 19 bp, Homo sapiens
attctggttccctgctgcg

SEQ ID NO: 671582 - DNA, 17 bp, Homo sapiens
attcttaaaaattgaat

SEQ ID NO: 671583 - DNA, 21 bp, Homo sapiens
attctttccattatgattctt

SEQ ID NO: 671584 - DNA, 12 bp, Homo sapiens
attctttgaaaa

SEQ ID NO: 671585 - DNA, 14 bp, Homo sapiens
attctttgaaaaca

SEQ ID NO: 671586 - DNA, 22 bp, Homo sapiens
attctttgaaaacagatgacca

SEQ ID NO: 671587 - DNA, 14 bp, Homo sapiens
attcttttgtttcc

SEQ ID NO: 671588 - DNA, 16 bp, Homo sapiens
attcttttgtttccat

SEQ ID NO: 671589 - DNA, 17 bp, Homo sapiens
attcttttgtttccatg

SEQ ID NO: 671590 - DNA, 18 bp, Homo sapiens
attcttttgtttccatgg

SEQ ID NO: 671591 - DNA, 15 bp, Homo sapiens
caatagatctccagc

SEQ ID NO: 671592 - DNA, 16 bp, Homo sapiens
caatagatctccagcg

SEQ ID NO: 671593 - DNA, 18 bp, Homo sapiens
caatagctagctatatat

SEQ ID NO: 671594 - DNA, 20 bp, Homo sapiens
caatatagttttttctttcc

SEQ ID NO: 671595 - DNA, 22 bp, Homo sapiens
caatatatagtgggtacatcaa

SEQ ID NO: 671596 - DNA, 21 bp, Homo sapiens
caatatcagctttgataattg

SEQ ID NO: 671597 - DNA, 16 bp, Homo sapiens
caatatgtgagtgcct

SEQ ID NO: 671598 - DNA, 17 bp, Homo sapiens
caatatgtgagtgcctt

SEQ ID NO: 671599 - DNA, 17 bp, Homo sapiens
caatattgattgggaaa

SEQ ID NO: 671600 - DNA, 21 bp, Homo sapiens
caatattgattgggaaaacat

SEQ ID NO: 671601 - DNA, 15 bp, Homo sapiens
caatcaactctaata

SEQ ID NO: 671602 - DNA, 23 bp, Homo sapiens
caatcataaagtgcacaccttta

SEQ ID NO: 671603 - DNA, 19 bp, Homo sapiens
caatctatggcttatttct

SEQ ID NO: 671604 - DNA, 21 bp, Homo sapiens
caatctatggcttatttctat

SEQ ID NO: 671605 - DNA, 22 bp, Homo sapiens
caatctccatgtgtacttatta

SEQ ID NO: 671606 - DNA, 17 bp, Homo sapiens
caatctctttttgtttg

SEQ ID NO: 671607 - DNA, 13 bp, Homo sapiens
caatctgcctgta

SEQ ID NO: 671608 - DNA, 12 bp, Homo sapiens
caatctgtgggc

SEQ ID NO: 671609 - DNA, 20 bp, Homo sapiens
caatgaaaacatgtactaca

SEQ ID NO: 671610 - DNA, 14 bp, Homo sapiens
caatgaaagtcaaa

SEQ ID NO: 671611 - DNA, 19 bp, Homo sapiens
caatgaaccataaattcaa

SEQ ID NO: 671612 - DNA, 13 bp, Homo sapiens
caatgtaacactg

SEQ ID NO: 671613 - DNA, 20 bp, Homo sapiens
caatgtgaataatggcactg

SEQ ID NO: 671614 - DNA, 13 bp, Homo sapiens
caatgtgcataat

SEQ ID NO: 671615 - DNA, 22 bp, Homo sapiens
caatgtgcataatgataaaata

SEQ ID NO: 671616 - DNA, 14 bp, Homo sapiens
caattaagcagctt

SEQ ID NO: 671617 - DNA, 22 bp, Homo sapiens
caattagatctaaacagttatt

SEQ ID NO: 671618 - DNA, 15 bp, Homo sapiens
caattagtctgaaac

SEQ ID NO: 671619 - DNA, 22 bp, Homo sapiens
caattagtgtgacagtttccaa

SEQ ID NO: 671620 - DNA, 23 bp, Homo sapiens
caattagtgtgacagtttccaaa

SEQ ID NO: 671621 - DNA, 14 bp, Homo sapiens
caattattggcaaa

SEQ ID NO: 671622 - DNA, 16 bp, Homo sapiens
caattattggcaaagt

SEQ ID NO: 671623 - DNA, 20 bp, Homo sapiens
caattatttgcatattttga

SEQ ID NO: 671624 - DNA, 16 bp, Homo sapiens
caattcataaaaacaa

SEQ ID NO: 671625 - DNA, 18 bp, Homo sapiens
caattcccccatccttca

SEQ ID NO: 671626 - DNA, 16 bp, Homo sapiens
caattgtcacttttta

SEQ ID NO: 671627 - DNA, 17 bp, Homo sapiens
caattgtcactttttat

SEQ ID NO: 671628 - DNA, 22 bp, Homo sapiens
caattgtttgggtgattcctaa

SEQ ID NO: 671629 - DNA, 20 bp, Homo sapiens
caatttgagccatttaaaga

SEQ ID NO: 671630 - DNA, 21 bp, Homo sapiens
caatttgagccatttaaagac

SEQ ID NO: 671631 - DNA, 19 bp, Homo sapiens
caattttctgtaatctttt

SEQ ID NO: 671632 - DNA, 16 bp, Homo sapiens
caatttttgtctcaga

SEQ ID NO: 671633 - DNA, 20 bp, Homo sapiens
caattttttaagtgaaaata

SEQ ID NO: 671634 - DNA, 17 bp, Homo sapiens
cacaaatgtcattgtct

SEQ ID NO: 671635 - DNA, 18 bp, Homo sapiens
cacaaattttcaagttta

SEQ ID NO: 671636 - DNA, 22 bp, Homo sapiens
cacaaattttcaagtttacact

SEQ ID NO: 671637 - DNA, 17 bp, Homo sapiens
cacaacagccctgcctg

SEQ ID NO: 671638 - DNA, 19 bp, Homo sapiens
cacaacagccctgcctgag

SEQ ID NO: 671639 - DNA, 18 bp, Homo sapiens
cacaacttgatggctgcg

SEQ ID NO: 671640 - DNA, 17 bp, Homo sapiens
cacaatacagtattata

SEQ ID NO: 671641 - DNA, 17 bp, Homo sapiens
cacaattattggcaaag

SEQ ID NO: 671642 - DNA, 15 bp, Homo sapiens
cacacagggcagtcc

SEQ ID NO: 671643 - DNA, 16 bp, Homo sapiens
cacaccattttgtaaa

SEQ ID NO: 671644 - DNA, 12 bp, Homo sapiens
cacaccctgagg

SEQ ID NO: 671645 - DNA, 13 bp, Homo sapiens
cacaccctgaggt

SEQ ID NO: 671646 - DNA, 20 bp, Homo sapiens
cacactggactccgaggtgg

SEQ ID NO: 671647 - DNA, 18 bp, Homo sapiens
cacactgtcatgcttcat

SEQ ID NO: 671648 - DNA, 17 bp, Homo sapiens
cacactgtgcagaccca

SEQ ID NO: 671649 - DNA, 16 bp, Homo sapiens
cacacttgaaaccttt

SEQ ID NO: 671650 - DNA, 11 bp, Homo sapiens
cacagaacagg

SEQ ID NO: 671651 - DNA, 23 bp, Homo sapiens
cacagagcaagagataagtcttt

SEQ ID NO: 671652 - DNA, 21 bp, Homo sapiens
cacagagctttggtctgtgtg

SEQ ID NO: 671653 - DNA, 15 bp, Homo sapiens
cacagaggacacaga

SEQ ID NO: 671654 - DNA, 21 bp, Homo sapiens
cacagccgcctgaaagccaca

SEQ ID NO: 671655 - DNA, 19 bp, Homo sapiens
cacagccggtcagaggagc

SEQ ID NO: 671656 - DNA, 22 bp, Homo sapiens
cacagcgtccctggcgcaggtg

SEQ ID NO: 671657 - DNA, 14 bp, Homo sapiens
cacagctgagaggc

SEQ ID NO: 671658 - DNA, 17 bp, Homo sapiens
cacagctgtttgaaatg

SEQ ID NO: 671659 - DNA, 21 bp, Homo sapiens
cacagctgtttgaaatgttta

SEQ ID NO: 671660 - DNA, 19 bp, Homo sapiens
cacaggaggcaggcatggc

SEQ ID NO: 671661 - DNA, 14 bp, Homo sapiens
cacaggccctggct

SEQ ID NO: 671662 - DNA, 14 bp, Homo sapiens
cacaggctggtgtg

SEQ ID NO: 671663 - DNA, 17 bp, Homo sapiens
cacagtacagcatgtgc

SEQ ID NO: 671664 - DNA, 17 bp, Homo sapiens
cacagtgggaagatttt

SEQ ID NO: 671665 - DNA, 17 bp, Homo sapiens
cacagtggggctgcagg

SEQ ID NO: 671666 - DNA, 18 bp, Homo sapiens
cacagtggtgaccccctt

SEQ ID NO: 671667 - DNA, 14 bp, Homo sapiens
cacagtgtgagccc

SEQ ID NO: 671668 - DNA, 15 bp, Homo sapiens
cacatatacatatga

SEQ ID NO: 671669 - DNA, 18 bp, Homo sapiens
cacatatcaaactgaaac

SEQ ID NO: 671670 - DNA, 16 bp, Homo sapiens
cacatcccattgggac

SEQ ID NO: 671671 - DNA, 21 bp, Homo sapiens
cacatctggctgcacaggctg

SEQ ID NO: 671672 - DNA, 14 bp, Homo sapiens
cacatgctgcctgg

SEQ ID NO: 671673 - DNA, 16 bp, Homo sapiens
cacatgctgcctggca

SEQ ID NO: 671674 - DNA, 19 bp, Homo sapiens
cacatgctgcctggcacag

SEQ ID NO: 671675 - DNA, 18 bp, Homo sapiens
cacattaatcagattagc

SEQ ID NO: 671676 - DNA, 15 bp, Homo sapiens
cacattagaattagt

SEQ ID NO: 671677 - DNA, 18 bp, Homo sapiens
cacattcgggaccaatat

SEQ ID NO: 671678 - DNA, 14 bp, Homo sapiens
caccaacctccagt

SEQ ID NO: 671679 - DNA, 13 bp, Homo sapiens
caccaagcagtgg

SEQ ID NO: 671680 - DNA, 14 bp, Homo sapiens
caccaagcagtggc

SEQ ID NO: 671681 - DNA, 23 bp, Homo sapiens
caccaagcagtggcctttttctg

SEQ ID NO: 671682 - DNA, 11 bp, Homo sapiens
caccaaggaaa

SEQ ID NO: 671683 - DNA, 12 bp, Homo sapiens
caccaaggaaac

SEQ ID NO: 671684 - DNA, 16 bp, Homo sapiens
caccaatgaaaacatg

SEQ ID NO: 671685 - DNA, 21 bp, Homo sapiens
caccaatgaaaacatgtacta

SEQ ID NO: 671686 - DNA, 20 bp, Homo sapiens
caccacagccggtcagagga

SEQ ID NO: 671687 - DNA, 14 bp, Homo sapiens
caccactcaggcca

SEQ ID NO: 671688 - DNA, 20 bp, Homo sapiens
caccatggtatcatatatta

SEQ ID NO: 671689 - DNA, 23 bp, Homo sapiens
caccatggtatcatatattaaaa

SEQ ID NO: 671690 - DNA, 16 bp, Homo sapiens
cacccaaagctgagcc

SEQ ID NO: 671691 - DNA, 22 bp, Homo sapiens
cacccaaagctgagcctgcagg

SEQ ID NO: 671692 - DNA, 13 bp, Homo sapiens
cacccacctctgg

SEQ ID NO: 671693 - DNA, 17 bp, Homo sapiens
cacccacctctgggtcc

SEQ ID NO: 671694 - DNA, 18 bp, Homo sapiens
cacccacctctgggtcct

SEQ ID NO: 671695 - DNA, 16 bp, Homo sapiens
cacccagtgggaagag

SEQ ID NO: 671696 - DNA, 22 bp, Homo sapiens
cacccatgcaagcagaggacca

SEQ ID NO: 671697 - DNA, 17 bp, Homo sapiens
caccctgaggtcaggga

SEQ ID NO: 671698 - DNA, 17 bp, Homo sapiens
caccctgcccctcagag

SEQ ID NO: 671699 - DNA, 14 bp, Homo sapiens
cacccttagaaaat

SEQ ID NO: 671700 - DNA, 19 bp, Homo sapiens
cacccttagaaaatgtgtc

SEQ ID NO: 671701 - DNA, 16 bp, Homo sapiens
caccctttccaggaat

SEQ ID NO: 671702 - DNA, 13 bp, Homo sapiens
caccgaggggcct

SEQ ID NO: 671703 - DNA, 14 bp, Homo sapiens
caccgcccatcagg

SEQ ID NO: 671704 - DNA, 19 bp, Homo sapiens
caccgcctccccacctcca

SEQ ID NO: 671705 - DNA, 17 bp, Homo sapiens
caccgtacaaccccctc

SEQ ID NO: 671706 - DNA, 19 bp, Homo sapiens
caccgtacaaccccctcca

SEQ ID NO: 671707 - DNA, 17 bp, Homo sapiens
cacctcggcacacactg

SEQ ID NO: 671708 - DNA, 17 bp, Homo sapiens
cacctctcctgccctgt

SEQ ID NO: 671709 - DNA, 21 bp, Homo sapiens
cacctctgggtccttggctcc

SEQ ID NO: 671710 - DNA, 20 bp, Homo sapiens
cacctctgtgacccctcctt

SEQ ID NO: 671711 - DNA, 14 bp, Homo sapiens
cacctgctcccagg

SEQ ID NO: 671712 - DNA, 16 bp, Homo sapiens
cacctggcaaaggacc

SEQ ID NO: 671713 - DNA, 23 bp, Homo sapiens
cacctgggaacacagttctgggc

SEQ ID NO: 671714 - DNA, 18 bp, Homo sapiens
cacctgtaaagtgcctta

SEQ ID NO: 671715 - DNA, 22 bp, Homo sapiens
cacctgtagtcccagctacttg

SEQ ID NO: 671716 - DNA, 10 bp, Homo sapiens
cacctgtggg

SEQ ID NO: 671717 - DNA, 22 bp, Homo sapiens
cacctgtgggtgtagccaggta

SEQ ID NO: 671718 - DNA, 21 bp, Homo sapiens
caccttcaatgacttctaatt

SEQ ID NO: 671719 - DNA, 17 bp, Homo sapiens
caccttcactctccagg

SEQ ID NO: 671720 - DNA, 14 bp, Homo sapiens
caccttccaacact

SEQ ID NO: 671721 - DNA, 16 bp, Homo sapiens
caccttttccaggagt

SEQ ID NO: 671722 - DNA, 22 bp, Homo sapiens
cacgcttcaaggatatactgca

SEQ ID NO: 671723 - DNA, 19 bp, Homo sapiens
cacggaggcctcgagcaga

SEQ ID NO: 671724 - DNA, 18 bp, Homo sapiens
cacgggacatcacagggt

SEQ ID NO: 671725 - DNA, 22 bp, Homo sapiens
cacgtgacaggctcgtcagcca

SEQ ID NO: 671726 - DNA, 20 bp, Homo sapiens
cacgtgagaatccctggcaa

SEQ ID NO: 671727 - DNA, 21 bp, Homo sapiens
cacgtgagaatccctggcaaa

SEQ ID NO: 671728 - DNA, 17 bp, Homo sapiens
cacgttggggtgattta

SEQ ID NO: 671729 - DNA, 18 bp, Homo sapiens
cactaaaagcatgaattg

SEQ ID NO: 671730 - DNA, 22 bp, Homo sapiens
cactaaaagcatgaattggaac

SEQ ID NO: 671731 - DNA, 23 bp, Homo sapiens
cactaaaagcatgaattggaact

SEQ ID NO: 671732 - DNA, 17 bp, Homo sapiens
cactaattggtactttt

SEQ ID NO: 671733 - DNA, 12 bp, Homo sapiens
cactagaaaact

SEQ ID NO: 671734 - DNA, 16 bp, Homo sapiens
cactatatatatttct

SEQ ID NO: 671735 - DNA, 13 bp, Homo sapiens
cactcaggccaca

SEQ ID NO: 671736 - DNA, 22 bp, Homo sapiens
cactcagtgcctccacatgctg

SEQ ID NO: 671737 - DNA, 13 bp, Homo sapiens
cactcccaggatg

SEQ ID NO: 671738 - DNA, 15 bp, Homo sapiens
cactccccaaccccc

SEQ ID NO: 671739 - DNA, 12 bp, Homo sapiens
cactcctccctc

SEQ ID NO: 671740 - DNA, 13 bp, Homo sapiens
cactcctccctcc

SEQ ID NO: 671741 - DNA, 16 bp, Homo sapiens
cactcttgatctctct

SEQ ID NO: 671742 - DNA, 17 bp, Homo sapiens
cactcttgttcccacac

SEQ ID NO: 671743 - DNA, 23 bp, Homo sapiens
cactgaaatgaaatcttcccagt

SEQ ID NO: 671744 - DNA, 14 bp, Homo sapiens
cactgaatttataa

SEQ ID NO: 671745 - DNA, 15 bp, Homo sapiens
cactgaccacacatt

SEQ ID NO: 671746 - DNA, 19 bp, Homo sapiens
cactgaccggtgcttttat

SEQ ID NO: 671747 - DNA, 12 bp, Homo sapiens
cactgagcaggg

SEQ ID NO: 671748 - DNA, 16 bp, Homo sapiens
cactgcaaataaagcc

SEQ ID NO: 671749 - DNA, 14 bp, Homo sapiens
cactgcaacctctg

SEQ ID NO: 671750 - DNA, 20 bp, Homo sapiens
cactgcgaagaccctcttgc

SEQ ID NO: 671751 - DNA, 22 bp, Homo sapiens
cactgcgttttcctagctgtgt

SEQ ID NO: 671752 - DNA, 12 bp, Homo sapiens
cactgctgagct

SEQ ID NO: 671753 - DNA, 17 bp, Homo sapiens
cactgctgagctggccc

SEQ ID NO: 671754 - DNA, 13 bp, Homo sapiens
cactgctgtattt

SEQ ID NO: 671755 - DNA, 22 bp, Homo sapiens
cactgggccataatgttgcttc

SEQ ID NO: 671756 - DNA, 19 bp, Homo sapiens
cactggtggtttttgctct

SEQ ID NO: 671757 - DNA, 15 bp, Homo sapiens
cactgtagctacatt

SEQ ID NO: 671758 - DNA, 15 bp, Homo sapiens
cactgtatgagtgga

SEQ ID NO: 671759 - DNA, 16 bp, Homo sapiens
cactgtattttaatgt

SEQ ID NO: 671760 - DNA, 12 bp, Homo sapiens
cactgtgcagac

SEQ ID NO: 671761 - DNA, 22 bp, Homo sapiens
cactgtgcagacccagtcccac

SEQ ID NO: 671762 - DNA, 13 bp, Homo sapiens
cactgtgccccac

SEQ ID NO: 671763 - DNA, 21 bp, Homo sapiens
cacttaaacgaagagttccct

SEQ ID NO: 671764 - DNA, 12 bp, Homo sapiens
cacttccagggg

SEQ ID NO: 671765 - DNA, 14 bp, Homo sapiens
cacttccaggggaa

SEQ ID NO: 671766 - DNA, 17 bp, Homo sapiens
cacttccaggggaacct

SEQ ID NO: 671767 - DNA, 14 bp, Homo sapiens
cacttcccaccctg

SEQ ID NO: 671768 - DNA, 20 bp, Homo sapiens
cacttcctttgcccttcctc

SEQ ID NO: 671769 - DNA, 14 bp, Homo sapiens
cacttgaaaccttt

SEQ ID NO: 671770 - DNA, 21 bp, Homo sapiens
cacttgaaacctttttttatc

SEQ ID NO: 671771 - DNA, 19 bp, Homo sapiens
cacttgaccgggagacaga

SEQ ID NO: 671772 - DNA, 13 bp, Homo sapiens
cacttgagagaaa

SEQ ID NO: 671773 - DNA, 22 bp, Homo sapiens
cacttgctgctttttctgcgct

SEQ ID NO: 671774 - DNA, 17 bp, Homo sapiens
cacttttagaaatgcat

SEQ ID NO: 671775 - DNA, 20 bp, Homo sapiens
cagaaaacctgttcaggcag

SEQ ID NO: 671776 - DNA, 20 bp, Homo sapiens
cagaaaatatttaatatcaa

SEQ ID NO: 671777 - DNA, 19 bp, Homo sapiens
cagaaaattggcagtggca

SEQ ID NO: 671778 - DNA, 22 bp, Homo sapiens
cagaaaattggcagtggcagag

SEQ ID NO: 671779 - DNA, 15 bp, Homo sapiens
cagaaatggaaagca

SEQ ID NO: 671780 - DNA, 13 bp, Homo sapiens
cagaacaaaactt

SEQ ID NO: 671781 - DNA, 15 bp, Homo sapiens
cagaacaaaacttct

SEQ ID NO: 671782 - DNA, 20 bp, Homo sapiens
cagaacaggaggtgtgaatg

SEQ ID NO: 671783 - DNA, 21 bp, Homo sapiens
cagaacaggaggtgtgaatgc

SEQ ID NO: 671784 - DNA, 14 bp, Homo sapiens
cagaacagggtcat

SEQ ID NO: 671785 - DNA, 22 bp, Homo sapiens
cagaactgaaccggctttacca

SEQ ID NO: 671786 - DNA, 16 bp, Homo sapiens
cagaagacccctgact

SEQ ID NO: 671787 - DNA, 23 bp, Homo sapiens
cagaagccctgatgtgtcctcag

SEQ ID NO: 671788 - DNA, 14 bp, Homo sapiens
cagaagtctcctca

SEQ ID NO: 671789 - DNA, 20 bp, Homo sapiens
cagaataaggcaggcattga

SEQ ID NO: 671790 - DNA, 18 bp, Homo sapiens
cagaatgactgacaaaga

SEQ ID NO: 671791 - DNA, 20 bp, Homo sapiens
cagaatgtaagtgggcccac

SEQ ID NO: 671792 - DNA, 21 bp, Homo sapiens
cagaatgtaagtgggcccacc

SEQ ID NO: 671793 - DNA, 15 bp, Homo sapiens
cagaattatttttaa

SEQ ID NO: 671794 - DNA, 19 bp, Homo sapiens
cagaatttaccatcatctc

SEQ ID NO: 671795 - DNA, 13 bp, Homo sapiens
cagacaagacaga

SEQ ID NO: 671796 - DNA, 15 bp, Homo sapiens
cagacaagacagagg

SEQ ID NO: 671797 - DNA, 18 bp, Homo sapiens
cagacaagacagagggga

SEQ ID NO: 671798 - DNA, 19 bp, Homo sapiens
cagacaagacagaggggag

SEQ ID NO: 671799 - DNA, 17 bp, Homo sapiens
cagacaaggtgcctgtt

SEQ ID NO: 671800 - DNA, 17 bp, Homo sapiens
cagacaatatgtgagtg

SEQ ID NO: 671801 - DNA, 12 bp, Homo sapiens
cagacacagctc

SEQ ID NO: 671802 - DNA, 13 bp, Homo sapiens
cagacacagctct

SEQ ID NO: 671803 - DNA, 14 bp, Homo sapiens
cagacacagctctt

SEQ ID NO: 671804 - DNA, 15 bp, Homo sapiens
cagacacagctcttc

SEQ ID NO: 671805 - DNA, 17 bp, Homo sapiens
cagacacagctcttcca

SEQ ID NO: 671806 - DNA, 13 bp, Homo sapiens
cagacagaagtct

SEQ ID NO: 671807 - DNA, 14 bp, Homo sapiens
cagacagcaggcag

SEQ ID NO: 671808 - DNA, 15 bp, Homo sapiens
cagacagcaggcagc

SEQ ID NO: 671809 - DNA, 20 bp, Homo sapiens
cagacccacgggctcatgca

SEQ ID NO: 671810 - DNA, 17 bp, Homo sapiens
cagacccagtcccacac

SEQ ID NO: 671811 - DNA, 15 bp, Homo sapiens
cagacctgcattgaa

SEQ ID NO: 671812 - DNA, 21 bp, Homo sapiens
cagactatttgctaatgtata

SEQ ID NO: 671813 - DNA, 14 bp, Homo sapiens
cagactccatctct

SEQ ID NO: 671814 - DNA, 19 bp, Homo sapiens
cagactccatctcttctgc

SEQ ID NO: 671815 - DNA, 21 bp, Homo sapiens
cagactgacccccatctgagc

SEQ ID NO: 671816 - DNA, 23 bp, Homo sapiens
cagagaaaaatgctccccacagc

SEQ ID NO: 671817 - DNA, 18 bp, Homo sapiens
cagagaacagaactggag

SEQ ID NO: 671818 - DNA, 11 bp, Homo sapiens
cagagaacagc

SEQ ID NO: 671819 - DNA, 15 bp, Homo sapiens
cagagaaggaaaaga

SEQ ID NO: 671820 - DNA, 22 bp, Homo sapiens
cagagaaggaaaagactgaatc

SEQ ID NO: 671821 - DNA, 21 bp, Homo sapiens
cagagactgtccctgaaacct

SEQ ID NO: 671822 - DNA, 20 bp, Homo sapiens
cagagataaaccaataaatc

SEQ ID NO: 671823 - DNA, 20 bp, Homo sapiens
cagagatttctcattgactt

SEQ ID NO: 671824 - DNA, 14 bp, Homo sapiens
cagagcacctcacc

SEQ ID NO: 671825 - DNA, 21 bp, Homo sapiens
cagagctaagggtgggtgctc

SEQ ID NO: 671826 - DNA, 17 bp, Homo sapiens
cagagctttggtctgtg

SEQ ID NO: 671827 - DNA, 15 bp, Homo sapiens
cagaggacacagaga

SEQ ID NO: 671828 - DNA, 15 bp, Homo sapiens
cagaggagcgcaggc

SEQ ID NO: 671829 - DNA, 16 bp, Homo sapiens
cagaggagcgcaggca

SEQ ID NO: 671830 - DNA, 16 bp, Homo sapiens
cagaggaggggaaagt

SEQ ID NO: 671831 - DNA, 23 bp, Homo sapiens
cagaggagtaaataattggaaaa

SEQ ID NO: 671832 - DNA, 21 bp, Homo sapiens
cagaggctcagattgtaatat

SEQ ID NO: 671833 - DNA, 14 bp, Homo sapiens
cagaggtaccctgg

SEQ ID NO: 671834 - DNA, 18 bp, Homo sapiens
cagaggtaccctgggtgt

SEQ ID NO: 671835 - DNA, 23 bp, Homo sapiens
cagaggtattaaaactaaatttc

SEQ ID NO: 671836 - DNA, 17 bp, Homo sapiens
ctcctccctctgtccct

SEQ ID NO: 671837 - DNA, 15 bp, Homo sapiens
ctcctcctcctgccc

SEQ ID NO: 671838 - DNA, 15 bp, Homo sapiens
ctcctctcagtgttt

SEQ ID NO: 671839 - DNA, 20 bp, Homo sapiens
ctcctgagctaggaagagtc

SEQ ID NO: 671840 - DNA, 14 bp, Homo sapiens
ctcctgcacacagg

SEQ ID NO: 671841 - DNA, 15 bp, Homo sapiens
ctcctgcacacaggg

SEQ ID NO: 671842 - DNA, 12 bp, Homo sapiens
ctcctgccctcc

SEQ ID NO: 671843 - DNA, 13 bp, Homo sapiens
ctcctgccctgtg

SEQ ID NO: 671844 - DNA, 19 bp, Homo sapiens
ctcctgcctcagcctcctg

SEQ ID NO: 671845 - DNA, 11 bp, Homo sapiens
ctcctggcagg

SEQ ID NO: 671846 - DNA, 18 bp, Homo sapiens
ctcctggcagggccacct

SEQ ID NO: 671847 - DNA, 21 bp, Homo sapiens
ctcctggcagggccacctgca

SEQ ID NO: 671848 - DNA, 22 bp, Homo sapiens
ctcctggcagggccacctgcag

SEQ ID NO: 671849 - DNA, 16 bp, Homo sapiens
ctcctggcccctgcct

SEQ ID NO: 671850 - DNA, 18 bp, Homo sapiens
ctcctggcctatccgctg

SEQ ID NO: 671851 - DNA, 14 bp, Homo sapiens
ctcctggccttttg

SEQ ID NO: 671852 - DNA, 14 bp, Homo sapiens
ctcctgggaacaca

SEQ ID NO: 671853 - DNA, 22 bp, Homo sapiens
ctcctgggaacacatctggctg

SEQ ID NO: 671854 - DNA, 23 bp, Homo sapiens
ctcctgggaacacatctggctgc

SEQ ID NO: 671855 - DNA, 13 bp, Homo sapiens
ctcctgtcccttt

SEQ ID NO: 671856 - DNA, 23 bp, Homo sapiens
ctccttaagctgcagagatttct

SEQ ID NO: 671857 - DNA, 14 bp, Homo sapiens
ctccttccttccca

SEQ ID NO: 671858 - DNA, 18 bp, Homo sapiens
ctccttgcccccagtgcc

SEQ ID NO: 671859 - DNA, 19 bp, Homo sapiens
ctccttgcccccagtgcct

SEQ ID NO: 671860 - DNA, 22 bp, Homo sapiens
ctcctttcttatcttgaccata

SEQ ID NO: 671861 - DNA, 19 bp, Homo sapiens
ctcgaatttgaagagattg

SEQ ID NO: 671862 - DNA, 14 bp, Homo sapiens
ctcgagcagagaga

SEQ ID NO: 671863 - DNA, 18 bp, Homo sapiens
ctcgcctcctcctcctgc

SEQ ID NO: 671864 - DNA, 20 bp, Homo sapiens
ctcgcctcctcctcctgccc

SEQ ID NO: 671865 - DNA, 12 bp, Homo sapiens
ctcgctgagggc

SEQ ID NO: 671866 - DNA, 17 bp, Homo sapiens
ctcgctttttcatcctt

SEQ ID NO: 671867 - DNA, 21 bp, Homo sapiens
ctcggcacacactgtgcccca

SEQ ID NO: 671868 - DNA, 22 bp, Homo sapiens
ctcggcacacactgtgccccac

SEQ ID NO: 671869 - DNA, 17 bp, Homo sapiens
ctcgtcagccacctggg

SEQ ID NO: 671870 - DNA, 16 bp, Homo sapiens
ctcgtgcatccctgag

SEQ ID NO: 671871 - DNA, 20 bp, Homo sapiens
ctcgtgcattaaaatttctt

SEQ ID NO: 671872 - DNA, 19 bp, Homo sapiens
ctcgttattgttgttgcca

SEQ ID NO: 671873 - DNA, 20 bp, Homo sapiens
ctctacagtgccaactcctc

SEQ ID NO: 671874 - DNA, 19 bp, Homo sapiens
ctctaggtgtgtccacaga

SEQ ID NO: 671875 - DNA, 12 bp, Homo sapiens
ctctagtagtgt

SEQ ID NO: 671876 - DNA, 13 bp, Homo sapiens
ctctcaccccact

SEQ ID NO: 671877 - DNA, 14 bp, Homo sapiens
ctctcaccccactc

SEQ ID NO: 671878 - DNA, 15 bp, Homo sapiens
ctctcaccccactcc

SEQ ID NO: 671879 - DNA, 17 bp, Homo sapiens
ctctcaccccactcctg

SEQ ID NO: 671880 - DNA, 18 bp, Homo sapiens
ctctcagtgttttggact

SEQ ID NO: 671881 - DNA, 19 bp, Homo sapiens
ctctccccccgcctgccac

SEQ ID NO: 671882 - DNA, 13 bp, Homo sapiens
ctctccctgggtc

SEQ ID NO: 671883 - DNA, 18 bp, Homo sapiens
ctctcctcatctccaagg

SEQ ID NO: 671884 - DNA, 22 bp, Homo sapiens
ctctcctccctctgtccctctc

SEQ ID NO: 671885 - DNA, 20 bp, Homo sapiens
ctctcctggcctatccgctg

SEQ ID NO: 671886 - DNA, 16 bp, Homo sapiens
ctctccttgcccccag

SEQ ID NO: 671887 - DNA, 18 bp, Homo sapiens
ctctccttgcccccagtg

SEQ ID NO: 671888 - DNA, 14 bp, Homo sapiens
ctctctcttgcctg

SEQ ID NO: 671889 - DNA, 19 bp, Homo sapiens
ctctctgtcccttgctgta

SEQ ID NO: 671890 - DNA, 18 bp, Homo sapiens
ctctcttgcctgagggga

SEQ ID NO: 671891 - DNA, 12 bp, Homo sapiens
ctctcttttgtt

SEQ ID NO: 671892 - DNA, 14 bp, Homo sapiens
ctctcttttgttta

SEQ ID NO: 671893 - DNA, 20 bp, Homo sapiens
ctctgacaactgtgaagcca

SEQ ID NO: 671894 - DNA, 23 bp, Homo sapiens
ctctgccctcattactgggcctt

SEQ ID NO: 671895 - DNA, 16 bp, Homo sapiens
ctctgccctggattgg

SEQ ID NO: 671896 - DNA, 22 bp, Homo sapiens
ctctgcctttgcaccacgggac

SEQ ID NO: 671897 - DNA, 18 bp, Homo sapiens
ctctggggtgctgcctga

SEQ ID NO: 671898 - DNA, 22 bp, Homo sapiens
ctctgggtccttggctcccggg

SEQ ID NO: 671899 - DNA, 16 bp, Homo sapiens
ctctggtgctcctgca

SEQ ID NO: 671900 - DNA, 22 bp, Homo sapiens
ctctggtgtttattataaagct

SEQ ID NO: 671901 - DNA, 16 bp, Homo sapiens
ctctgtccctctcctt

SEQ ID NO: 671902 - DNA, 16 bp, Homo sapiens
ctctgtcccttgctgt

SEQ ID NO: 671903 - DNA, 16 bp, Homo sapiens
ctctgtgacccctcct

SEQ ID NO: 671904 - DNA, 19 bp, Homo sapiens
ctctgtgagaaggtttatt

SEQ ID NO: 671905 - DNA, 23 bp, Homo sapiens
ctctgtgagaaggtttattgtta

SEQ ID NO: 671906 - DNA, 16 bp, Homo sapiens
ctctgttggtctgcct

SEQ ID NO: 671907 - DNA, 23 bp, Homo sapiens
ctctgttggtctgccttctgctg

SEQ ID NO: 671908 - DNA, 17 bp, Homo sapiens
ctcttcatgcttgacat

SEQ ID NO: 671909 - DNA, 15 bp, Homo sapiens
ctcttccccttagaa

SEQ ID NO: 671910 - DNA, 15 bp, Homo sapiens
ctcttccccttccct

SEQ ID NO: 671911 - DNA, 16 bp, Homo sapiens
ctcttccccttccctt

SEQ ID NO: 671912 - DNA, 18 bp, Homo sapiens
ctcttctacccttttcct

SEQ ID NO: 671913 - DNA, 12 bp, Homo sapiens
ctcttctgctct

SEQ ID NO: 671914 - DNA, 21 bp, Homo sapiens
ctcttctggggcaggctgggc

SEQ ID NO: 671915 - DNA, 18 bp, Homo sapiens
ctcttctttgtgcctttg

SEQ ID NO: 671916 - DNA, 20 bp, Homo sapiens
ctcttgatgccaccttcaga

SEQ ID NO: 671917 - DNA, 16 bp, Homo sapiens
ctcttgcccatcctga

SEQ ID NO: 671918 - DNA, 19 bp, Homo sapiens
ctcttgcccatcctgactg

SEQ ID NO: 671919 - DNA, 22 bp, Homo sapiens
ctcttggttcgatacctggagc

SEQ ID NO: 671920 - DNA, 19 bp, Homo sapiens
ctcttgtttttattaattt

SEQ ID NO: 671921 - DNA, 20 bp, Homo sapiens
ctcttgtttttattaattta

SEQ ID NO: 671922 - DNA, 13 bp, Homo sapiens
ctctttagatatt

SEQ ID NO: 671923 - DNA, 20 bp, Homo sapiens
ctctttgatcgcttttaata

SEQ ID NO: 671924 - DNA, 22 bp, Homo sapiens
ctcttttcctggtgctcttttt

SEQ ID NO: 671925 - DNA, 12 bp, Homo sapiens
ctcttttctttc

SEQ ID NO: 671926 - DNA, 16 bp, Homo sapiens
ctgaaataatatattt

SEQ ID NO: 671927 - DNA, 19 bp, Homo sapiens
ctgaaataatatatttctt

SEQ ID NO: 671928 - DNA, 20 bp, Homo sapiens
ctgaaataatatatttcttc

SEQ ID NO: 671929 - DNA, 21 bp, Homo sapiens
ctgaaataatatatttcttct

SEQ ID NO: 671930 - DNA, 19 bp, Homo sapiens
ctgaaattgcttatttttg

SEQ ID NO: 671931 - DNA, 17 bp, Homo sapiens
ctgaagaattaagatac

SEQ ID NO: 671932 - DNA, 13 bp, Homo sapiens
ctgaagaattgaa

SEQ ID NO: 671933 - DNA, 18 bp, Homo sapiens
ctgaagaattgaaaagtt

SEQ ID NO: 671934 - DNA, 18 bp, Homo sapiens
ctgaagttgcagatgtta

SEQ ID NO: 671935 - DNA, 23 bp, Homo sapiens
ctgaagtttttttgctgctgcct

SEQ ID NO: 671936 - DNA, 21 bp, Homo sapiens
ctgaataatatcaaataaaat

SEQ ID NO: 671937 - DNA, 20 bp, Homo sapiens
ctgaatccattaaaaatggg

SEQ ID NO: 671938 - DNA, 21 bp, Homo sapiens
ctgaatgtagcgtgtaagctt

SEQ ID NO: 671939 - DNA, 19 bp, Homo sapiens
ctgaattgtatcaatttgt

SEQ ID NO: 671940 - DNA, 13 bp, Homo sapiens
ctgacaatcaact

SEQ ID NO: 671941 - DNA, 21 bp, Homo sapiens
ctgacaatcaactctaatagt

SEQ ID NO: 671942 - DNA, 17 bp, Homo sapiens
ctgacactaaccagagt

SEQ ID NO: 671943 - DNA, 15 bp, Homo sapiens
ctgacagtttttctg

SEQ ID NO: 671944 - DNA, 16 bp, Homo sapiens
ctgacagtttttctgt

SEQ ID NO: 671945 - DNA, 23 bp, Homo sapiens
ctgacatgaagctgttgtgtgag

SEQ ID NO: 671946 - DNA, 20 bp, Homo sapiens
ctgacatttgtttatttttt

SEQ ID NO: 671947 - DNA, 21 bp, Homo sapiens
ctgaccgttaaaaaattcttg

SEQ ID NO: 671948 - DNA, 19 bp, Homo sapiens
ctgaccttaaatgcaacca

SEQ ID NO: 671949 - DNA, 23 bp, Homo sapiens
ctgacggcgcctttttggcctgt

SEQ ID NO: 671950 - DNA, 17 bp, Homo sapiens
ctgactcaattatttgc

SEQ ID NO: 671951 - DNA, 21 bp, Homo sapiens
ctgactgaaagtagggggctt

SEQ ID NO: 671952 - DNA, 15 bp, Homo sapiens
ctgactggaggaggc

SEQ ID NO: 671953 - DNA, 16 bp, Homo sapiens
ctgactggtgctgcag

SEQ ID NO: 671954 - DNA, 20 bp, Homo sapiens
ctgactttccgagcctccag

SEQ ID NO: 671955 - DNA, 18 bp, Homo sapiens
ctgagaagccccgacaca

SEQ ID NO: 671956 - DNA, 21 bp, Homo sapiens
ctgagaagctgctccaggcct

SEQ ID NO: 671957 - DNA, 23 bp, Homo sapiens
ctgagaagctgctccaggcctgc

SEQ ID NO: 671958 - DNA, 12 bp, Homo sapiens
ctgagaccacag

SEQ ID NO: 671959 - DNA, 14 bp, Homo sapiens
ctgagaccacagag

SEQ ID NO: 671960 - DNA, 20 bp, Homo sapiens
ctgagagaattggctcaata

SEQ ID NO: 671961 - DNA, 17 bp, Homo sapiens
ctgagagctgtttttga

SEQ ID NO: 671962 - DNA, 14 bp, Homo sapiens
ctgagaggggaagc

SEQ ID NO: 671963 - DNA, 20 bp, Homo sapiens
ctgagagtatttaggcagat

SEQ ID NO: 671964 - DNA, 19 bp, Homo sapiens
ctgagatcgtgctactgca

SEQ ID NO: 671965 - DNA, 14 bp, Homo sapiens
ctgagcctgcaggg

SEQ ID NO: 671966 - DNA, 13 bp, Homo sapiens
ctgagctgggggg

SEQ ID NO: 671967 - DNA, 13 bp, Homo sapiens
ctgaggcaggaga

SEQ ID NO: 671968 - DNA, 16 bp, Homo sapiens
ctgaggccctgcccaa

SEQ ID NO: 671969 - DNA, 16 bp, Homo sapiens
ctgaggcctgcagcac

SEQ ID NO: 671970 - DNA, 20 bp, Homo sapiens
ctgaggcctgccccctgggc

SEQ ID NO: 671971 - DNA, 17 bp, Homo sapiens
ctgaggtcagggagtgc

SEQ ID NO: 671972 - DNA, 21 bp, Homo sapiens
ctgaggtccttatgtcctgtc

SEQ ID NO: 671973 - DNA, 14 bp, Homo sapiens
ctgagtaaacataa

SEQ ID NO: 671974 - DNA, 20 bp, Homo sapiens
ctgagtaaacataaaaactg

SEQ ID NO: 671975 - DNA, 22 bp, Homo sapiens
ctgagtctgggcagctgtccct

SEQ ID NO: 671976 - DNA, 15 bp, Homo sapiens
ctgatcgtagaaaat

SEQ ID NO: 671977 - DNA, 16 bp, Homo sapiens
ctgatcgtagaaaatt

SEQ ID NO: 671978 - DNA, 17 bp, Homo sapiens
ctgatcgtagaaaattt

SEQ ID NO: 671979 - DNA, 18 bp, Homo sapiens
ctgatgggcaaaaaacca

SEQ ID NO: 671980 - DNA, 20 bp, Homo sapiens
ctgatgtgtcctcagggagc

SEQ ID NO: 671981 - DNA, 12 bp, Homo sapiens
ctgatgttgtgt

SEQ ID NO: 671982 - DNA, 18 bp, Homo sapiens
ctgattatttatgacctg

SEQ ID NO: 671983 - DNA, 17 bp, Homo sapiens
ctgattattttcttcat

SEQ ID NO: 671984 - DNA, 14 bp, Homo sapiens
ctgattctggcttt

SEQ ID NO: 671985 - DNA, 18 bp, Homo sapiens
ctgattctggctttaagc

SEQ ID NO: 671986 - DNA, 21 bp, Homo sapiens
ctgcaaaaatggatattatta

SEQ ID NO: 671987 - DNA, 16 bp, Homo sapiens
ctgcaaacagaacagg

SEQ ID NO: 671988 - DNA, 19 bp, Homo sapiens
ctgcaaagtgtatgcagta

SEQ ID NO: 671989 - DNA, 18 bp, Homo sapiens
ctgcaaataaagcctttt

SEQ ID NO: 671990 - DNA, 17 bp, Homo sapiens
ctgcaacatttgacaaa

SEQ ID NO: 671991 - DNA, 19 bp, Homo sapiens
ctgcaacctcacctcccgg

SEQ ID NO: 671992 - DNA, 22 bp, Homo sapiens
ctgcaagaagaaatcatgatat

SEQ ID NO: 671993 - DNA, 19 bp, Homo sapiens
ctgcaagccgactacacct

SEQ ID NO: 671994 - DNA, 16 bp, Homo sapiens
ctgcaaggattcagca

SEQ ID NO: 671995 - DNA, 22 bp, Homo sapiens
ctgcaagttcattttaaatgaa

SEQ ID NO: 671996 - DNA, 21 bp, Homo sapiens
ctgcaatgaaagtcaaattta

SEQ ID NO: 671997 - DNA, 13 bp, Homo sapiens
ctgcacacagggc

SEQ ID NO: 671998 - DNA, 23 bp, Homo sapiens
ctgcagagatttctcattgactt

SEQ ID NO: 671999 - DNA, 24 bp, Homo sapiens
ctgcagattagttctttttgccag

SEQ ID NO: 672000 - DNA, 22 bp, Homo sapiens
ctgcagcaccgaggggcctttg

SEQ ID NO: 672001 - DNA, 15 bp, Homo sapiens
ctgcaggcaggcggc

SEQ ID NO: 672002 - DNA, 20 bp, Homo sapiens
ctgcaggcaggcggctcctc

SEQ ID NO: 672003 - DNA, 22 bp, Homo sapiens
ctgcaggcaggcggctcctcct

SEQ ID NO: 672004 - DNA, 11 bp, Homo sapiens
ctgcagggcca

SEQ ID NO: 672005 - DNA, 19 bp, Homo sapiens
ctgcagggccatggctcag

SEQ ID NO: 672006 - DNA, 16 bp, Homo sapiens
ctgcagtctcatttct

SEQ ID NO: 672007 - DNA, 20 bp, Homo sapiens
ctgcagttctcatgactcct

SEQ ID NO: 672008 - DNA, 15 bp, Homo sapiens
ctgcatgaatatcat

SEQ ID NO: 672009 - DNA, 15 bp, Homo sapiens
ctgcattagaaaaag

SEQ ID NO: 672010 - DNA, 15 bp, Homo sapiens
ctgccagccttgagc

SEQ ID NO: 672011 - DNA, 20 bp, Homo sapiens
ctgccagccttgagccctgg

SEQ ID NO: 672012 - DNA, 20 bp, Homo sapiens
ctgccaggctgcctcctgcc

SEQ ID NO: 672013 - DNA, 14 bp, Homo sapiens
ctgccatctagcca

SEQ ID NO: 672014 - DNA, 16 bp, Homo sapiens
ctgccatgccaggaac

SEQ ID NO: 672015 - DNA, 20 bp, Homo sapiens
ctgcccactctgcaagaaga

SEQ ID NO: 672016 - DNA, 19 bp, Homo sapiens
ctgccccaatgtgacctgg

SEQ ID NO: 672017 - DNA, 14 bp, Homo sapiens
ctgccccctgggct

SEQ ID NO: 672018 - DNA, 21 bp, Homo sapiens
ctgccccttaaacacaggctg

SEQ ID NO: 672019 - DNA, 23 bp, Homo sapiens
ctgccccttaaacacaggctgtc

SEQ ID NO: 672020 - DNA, 15 bp, Homo sapiens
ctgccctcctctccc

SEQ ID NO: 672021 - DNA, 11 bp, Homo sapiens
ctgccctgaga

SEQ ID NO: 672022 - DNA, 19 bp, Homo sapiens
ctgccctgagaagctgctc

SEQ ID NO: 672023 - DNA, 21 bp, Homo sapiens
ctgccctgagaagctgctcca

SEQ ID NO: 672024 - DNA, 15 bp, Homo sapiens
ctgcccttccgcagt

SEQ ID NO: 672025 - DNA, 15 bp, Homo sapiens
ctgccctttctcagg

SEQ ID NO: 672026 - DNA, 13 bp, Homo sapiens
ctgccgctacctc

SEQ ID NO: 672027 - DNA, 17 bp, Homo sapiens
ctgccgctacctccctc

SEQ ID NO: 672028 - DNA, 14 bp, Homo sapiens
ctgcctcccacttc

SEQ ID NO: 672029 - DNA, 15 bp, Homo sapiens
ctgcctcccacttca

SEQ ID NO: 672030 - DNA, 12 bp, Homo sapiens
ctgcctcctgcg

SEQ ID NO: 672031 - DNA, 15 bp, Homo sapiens
ctgcctctccctggg

SEQ ID NO: 672032 - DNA, 17 bp, Homo sapiens
ctgcctctccctgggtc

SEQ ID NO: 672033 - DNA, 13 bp, Homo sapiens
ctgcctctgctcc

SEQ ID NO: 672034 - DNA, 14 bp, Homo sapiens
ctgcctctgctccc

SEQ ID NO: 672035 - DNA, 16 bp, Homo sapiens
ctgcctctgctccctc

SEQ ID NO: 672036 - DNA, 17 bp, Homo sapiens
ctgcctctgctccctct

SEQ ID NO: 672037 - DNA, 18 bp, Homo sapiens
ctgcctctttccctagga

SEQ ID NO: 672038 - DNA, 19 bp, Homo sapiens
ctgcctctttccctaggaa

SEQ ID NO: 672039 - DNA, 18 bp, Homo sapiens
ctgcctgaataaagagcc

SEQ ID NO: 672040 - DNA, 18 bp, Homo sapiens
ctgcctgcagcaggcagc

SEQ ID NO: 672041 - DNA, 12 bp, Homo sapiens
ctgcctggcccc

SEQ ID NO: 672042 - DNA, 23 bp, Homo sapiens
ctgcctggcccccaacctcaggg

SEQ ID NO: 672043 - DNA, 12 bp, Homo sapiens
ctgcctggcctt

SEQ ID NO: 672044 - DNA, 17 bp, Homo sapiens
ctgcctgggccgtggca

SEQ ID NO: 672045 - DNA, 20 bp, Homo sapiens
ctgcctgggccgtggcacag

SEQ ID NO: 672046 - DNA, 13 bp, Homo sapiens
ctgcctgtcccca

SEQ ID NO: 672047 - DNA, 21 bp, Homo sapiens
ctgcctgtccccaaacaggac

SEQ ID NO: 672048 - DNA, 23 bp, Homo sapiens
ctgcctgtccccaaacaggacag

SEQ ID NO: 672049 - DNA, 13 bp, Homo sapiens
ctgccttctgctg

SEQ ID NO: 672050 - DNA, 14 bp, Homo sapiens
ctgccttctgctga

SEQ ID NO: 672051 - DNA, 17 bp, Homo sapiens
ctgccttctttccatca

SEQ ID NO: 672052 - DNA, 14 bp, Homo sapiens
ctgccttgaaaaat

SEQ ID NO: 672053 - DNA, 20 bp, Homo sapiens
ctgcctttgcaccacgggac

SEQ ID NO: 672054 - DNA, 20 bp, Homo sapiens
ctgcggatactcttggagag

SEQ ID NO: 672055 - DNA, 20 bp, Homo sapiens
ctgctacctttcaaagcttg

SEQ ID NO: 672056 - DNA, 21 bp, Homo sapiens
ctgctattctagagcttttat

SEQ ID NO: 672057 - DNA, 15 bp, Homo sapiens
ctgctcaatacatct

SEQ ID NO: 672058 - DNA, 20 bp, Homo sapiens
ctgctcaccgcccatcaggg

SEQ ID NO: 672059 - DNA, 23 bp, Homo sapiens
ctgctcaccgcccatcagggttc

SEQ ID NO: 672060 - DNA, 12 bp, Homo sapiens
ctgctccaggcc

SEQ ID NO: 672061 - DNA, 13 bp, Homo sapiens
ctgctccctggca

SEQ ID NO: 672062 - DNA, 15 bp, Homo sapiens
ctgctccctggcatt

SEQ ID NO: 672063 - DNA, 12 bp, Homo sapiens
ctgctgaaactg

SEQ ID NO: 672064 - DNA, 21 bp, Homo sapiens
ctgctgaaagactcgagaacc

SEQ ID NO: 672065 - DNA, 15 bp, Homo sapiens
ctgctgagttggcct

SEQ ID NO: 672066 - DNA, 22 bp, Homo sapiens
ctgctgagttggcctggccatt

SEQ ID NO: 672067 - DNA, 20 bp, Homo sapiens
ctgctgatactgggtctgcg

SEQ ID NO: 672068 - DNA, 13 bp, Homo sapiens
ctgctgcctcttt

SEQ ID NO: 672069 - DNA, 22 bp, Homo sapiens
ctgctgcctctttccctaggaa

SEQ ID NO: 672070 - DNA, 17 bp, Homo sapiens
ctgctgtatttttattt

SEQ ID NO: 672071 - DNA, 22 bp, Homo sapiens
ctgcttaatcttcaaagccttc

SEQ ID NO: 672072 - DNA, 21 bp, Homo sapiens
ctgctttaattacctggtgag

SEQ ID NO: 672073 - DNA, 19 bp, Homo sapiens
ctgctttgcatctttgtta

SEQ ID NO: 672074 - DNA, 14 bp, Homo sapiens
ctggaaaacctcct

SEQ ID NO: 672075 - DNA, 21 bp, Homo sapiens
ctggaaagcagagcctcctgg

SEQ ID NO: 672076 - DNA, 17 bp, Homo sapiens
ctggaaatccctttctg

SEQ ID NO: 672077 - DNA, 16 bp, Homo sapiens
ctggaactcctggcct

SEQ ID NO: 672078 - DNA, 15 bp, Homo sapiens
ctggacctgtatatt

SEQ ID NO: 672079 - DNA, 19 bp, Homo sapiens
ctggactattgtgccaact

SEQ ID NO: 672080 - DNA, 22 bp, Homo sapiens
ctggactgctattctagagctt

SEQ ID NO: 672081 - DNA, 20 bp, Homo sapiens
ctggagagaagcaagccagc

SEQ ID NO: 672082 - DNA, 13 bp, Homo sapiens
ctggagcctgggg

SEQ ID NO: 672083 - DNA, 14 bp, Homo sapiens
ctggaggaggcctg

SEQ ID NO: 672084 - DNA, 20 bp, Homo sapiens
ctggaggaggcctgtcccaa

SEQ ID NO: 672085 - DNA, 20 bp, Homo sapiens
ctggagttccttatccctct

SEQ ID NO: 672086 - DNA, 17 bp, Homo sapiens
ctggatgaaagagccag

SEQ ID NO: 672087 - DNA, 15 bp, Homo sapiens
ctggatgtaccacca

SEQ ID NO: 672088 - DNA, 23 bp, Homo sapiens
ctggcaaaggctggctgtgtata

SEQ ID NO: 672089 - DNA, 19 bp, Homo sapiens
ctggcaaagggagcagaac

SEQ ID NO: 672090 - DNA, 15 bp, Homo sapiens
ctggcaattgtctat

SEQ ID NO: 672091 - DNA, 19 bp, Homo sapiens
ctggcaattgtctatttat

SEQ ID NO: 672092 - DNA, 14 bp, Homo sapiens
ctggcacagaccag

SEQ ID NO: 672093 - DNA, 16 bp, Homo sapiens
ctggcacagaccaggc

SEQ ID NO: 672094 - DNA, 19 bp, Homo sapiens
ctggcacagaccaggcctt

SEQ ID NO: 672095 - DNA, 16 bp, Homo sapiens
ctggcacgtgacaggc

SEQ ID NO: 672096 - DNA, 12 bp, Homo sapiens
ctggcagacaca

SEQ ID NO: 672097 - DNA, 13 bp, Homo sapiens
ctggcagacacaa

SEQ ID NO: 672098 - DNA, 20 bp, Homo sapiens
ctggcagacacaacccaata

SEQ ID NO: 672099 - DNA, 15 bp, Homo sapiens
ctggcagggccacct

SEQ ID NO: 672100 - DNA, 17 bp, Homo sapiens
ctggcattaagggcatt

SEQ ID NO: 672101 - DNA, 21 bp, Homo sapiens
ctggccatttccaagaggctg

SEQ ID NO: 672102 - DNA, 23 bp, Homo sapiens
ctggccatttccaagaggctgta

SEQ ID NO: 672103 - DNA, 17 bp, Homo sapiens
ctggcccccaacctcag

SEQ ID NO: 672104 - DNA, 22 bp, Homo sapiens
ctggcccccaacctcagggctc

SEQ ID NO: 672105 - DNA, 23 bp, Homo sapiens
ctggcccccaacctcagggctcc

SEQ ID NO: 672106 - DNA, 14 bp, Homo sapiens
ctggccctgggggt

SEQ ID NO: 672107 - DNA, 15 bp, Homo sapiens
ctggcccttggggag

SEQ ID NO: 672108 - DNA, 19 bp, Homo sapiens
ctggcctgagaggggaagc

SEQ ID NO: 672109 - DNA, 13 bp, Homo sapiens
ctggcctggctgg

SEQ ID NO: 672110 - DNA, 19 bp, Homo sapiens
ctggccttgtcctcagcca

SEQ ID NO: 672111 - DNA, 19 bp, Homo sapiens
ctggctcacagtacagcat

SEQ ID NO: 672112 - DNA, 21 bp, Homo sapiens
ctggctccctcctccaggcct

SEQ ID NO: 672113 - DNA, 13 bp, Homo sapiens
ctggctgcacagg

SEQ ID NO: 672114 - DNA, 14 bp, Homo sapiens
ctggctggaaagca

SEQ ID NO: 672115 - DNA, 21 bp, Homo sapiens
ctggctggaaagcagagcctc

SEQ ID NO: 672116 - DNA, 12 bp, Homo sapiens
ctggctttgcct

SEQ ID NO: 672117 - DNA, 16 bp, Homo sapiens
ctggctttgcctcttc

SEQ ID NO: 672118 - DNA, 13 bp, Homo sapiens
ctgggaacacagt

SEQ ID NO: 672119 - DNA, 20 bp, Homo sapiens
ctgggaacacatctggctgc

SEQ ID NO: 672120 - DNA, 22 bp, Homo sapiens
ctgggagcctggttcagacaca

SEQ ID NO: 672121 - DNA, 15 bp, Homo sapiens
ctgggattattcttt

SEQ ID NO: 672122 - DNA, 17 bp, Homo sapiens
ctgggcagctgtccctt

SEQ ID NO: 672123 - DNA, 14 bp, Homo sapiens
ctgggccagggtct

SEQ ID NO: 672124 - DNA, 20 bp, Homo sapiens
ctgggccagggtctgtgtga

SEQ ID NO: 672125 - DNA, 19 bp, Homo sapiens
ctgggccgtggcacagctg

SEQ ID NO: 672126 - DNA, 18 bp, Homo sapiens
ctgggctggggcctcaga

SEQ ID NO: 672127 - DNA, 12 bp, Homo sapiens
ctggggacaggc

SEQ ID NO: 672128 - DNA, 12 bp, Homo sapiens
ctggggcaggct

SEQ ID NO: 672129 - DNA, 19 bp, Homo sapiens
ctggggcaggctgggccat

SEQ ID NO: 672130 - DNA, 14 bp, Homo sapiens
ctggggcctcagac

SEQ ID NO: 672131 - DNA, 17 bp, Homo sapiens
ctggggcctgagagaat

SEQ ID NO: 672132 - DNA, 20 bp, Homo sapiens
ctgggggaatgagcccagag

SEQ ID NO: 672133 - DNA, 21 bp, Homo sapiens
ctggggggacccagtgcagaa

SEQ ID NO: 672134 - DNA, 14 bp, Homo sapiens
ctggggtgcatctc

SEQ ID NO: 672135 - DNA, 20 bp, Homo sapiens
ctggggtgttagtggcaccg

SEQ ID NO: 672136 - DNA, 20 bp, Homo sapiens
ctgggtaaaagcagggcagc

SEQ ID NO: 672137 - DNA, 17 bp, Homo sapiens
ctgggtactgaaagcct

SEQ ID NO: 672138 - DNA, 19 bp, Homo sapiens
ctgggtactgaggtgctat

SEQ ID NO: 672139 - DNA, 14 bp, Homo sapiens
ctgggtccttggct

SEQ ID NO: 672140 - DNA, 13 bp, Homo sapiens
ctgggtctgcgat

SEQ ID NO: 672141 - DNA, 20 bp, Homo sapiens
ctgggtgtccccgctgctgt

SEQ ID NO: 672142 - DNA, 18 bp, Homo sapiens
ctgggtgtgactgattcc

SEQ ID NO: 672143 - DNA, 16 bp, Homo sapiens
ctggtacaacggaggc

SEQ ID NO: 672144 - DNA, 19 bp, Homo sapiens
ctggtagggatatggcagg

SEQ ID NO: 672145 - DNA, 14 bp, Homo sapiens
ctgtgccagaggcc

SEQ ID NO: 672146 - DNA, 16 bp, Homo sapiens
ctgtgccagaggccag

SEQ ID NO: 672147 - DNA, 20 bp, Homo sapiens
ctgtgccagcaccacagccg

SEQ ID NO: 672148 - DNA, 23 bp, Homo sapiens
ctgtgctccatatttgatttcta

SEQ ID NO: 672149 - DNA, 19 bp, Homo sapiens
ctgtggaaggcctccctct

SEQ ID NO: 672150 - DNA, 19 bp, Homo sapiens
ctgtggaatgagtgtgcat

SEQ ID NO: 672151 - DNA, 21 bp, Homo sapiens
ctgtggaatgagtgtgcatgg

SEQ ID NO: 672152 - DNA, 15 bp, Homo sapiens
ctgtggccaggcctt

SEQ ID NO: 672153 - DNA, 15 bp, Homo sapiens
ctgtggctagtgaca

SEQ ID NO: 672154 - DNA, 14 bp, Homo sapiens
ctgtgtcatttctt

SEQ ID NO: 672155 - DNA, 15 bp, Homo sapiens
ctgtgtcatttcttc

SEQ ID NO: 672156 - DNA, 16 bp, Homo sapiens
ctgtgtcatttcttca

SEQ ID NO: 672157 - DNA, 18 bp, Homo sapiens
ctgtgtcatttcttcact

SEQ ID NO: 672158 - DNA, 9 bp, Homo sapiens
ctgtgtgca

SEQ ID NO: 672159 - DNA, 15 bp, Homo sapiens
ctgtgtgtgttgccc

SEQ ID NO: 672160 - DNA, 13 bp, Homo sapiens
ctgtgttaaacac

SEQ ID NO: 672161 - DNA, 22 bp, Homo sapiens
ctgtgttaaacactacacattt

SEQ ID NO: 672162 - DNA, 18 bp, Homo sapiens
ctgttaatttttatactg

SEQ ID NO: 672163 - DNA, 19 bp, Homo sapiens
ctgttacactttttggaag

SEQ ID NO: 672164 - DNA, 12 bp, Homo sapiens
ctgttagtaaat

SEQ ID NO: 672165 - DNA, 14 bp, Homo sapiens
ctgttatttcttcc

SEQ ID NO: 672166 - DNA, 15 bp, Homo sapiens
ctgttccatgcaact

SEQ ID NO: 672167 - DNA, 18 bp, Homo sapiens
ctgttctgaaatgttctt

SEQ ID NO: 672168 - DNA, 15 bp, Homo sapiens
ctgttctgagaaggt

SEQ ID NO: 672169 - DNA, 11 bp, Homo sapiens
ctgttctggaa

SEQ ID NO: 672170 - DNA, 22 bp, Homo sapiens
ctgttctttaaatgtctgaaat

SEQ ID NO: 672171 - DNA, 18 bp, Homo sapiens
ctgttgccatggtgatgg

SEQ ID NO: 672172 - DNA, 19 bp, Homo sapiens
cttctactgccttgaaaaa

SEQ ID NO: 672173 - DNA, 19 bp, Homo sapiens
cttctagaatgtaaagtta

SEQ ID NO: 672174 - DNA, 13 bp, Homo sapiens
cttctagagtttt

SEQ ID NO: 672175 - DNA, 18 bp, Homo sapiens
cttctagtgatgatggtt

SEQ ID NO: 672176 - DNA, 19 bp, Homo sapiens
cttctcaaagagaattgta

SEQ ID NO: 672177 - DNA, 11 bp, Homo sapiens
cttctccagga

SEQ ID NO: 672178 - DNA, 14 bp, Homo sapiens
cttctctgtgagaa

SEQ ID NO: 672179 - DNA, 22 bp, Homo sapiens
cttctgcaaaaatggatattat

SEQ ID NO: 672180 - DNA, 17 bp, Homo sapiens
cttctgctcgtttacac

SEQ ID NO: 672181 - DNA, 16 bp, Homo sapiens
cttctgctcttttcct

SEQ ID NO: 672182 - DNA, 17 bp, Homo sapiens
cttctgctcttttcctg

SEQ ID NO: 672183 - DNA, 18 bp, Homo sapiens
cttctgctcttttcctgg

SEQ ID NO: 672184 - DNA, 11 bp, Homo sapiens
cttctgctgaa

SEQ ID NO: 672185 - DNA, 15 bp, Homo sapiens
cttctggggacagac

SEQ ID NO: 672186 - DNA, 19 bp, Homo sapiens
cttctggggcaggctgggc

SEQ ID NO: 672187 - DNA, 21 bp, Homo sapiens
cttctggggcaggctgggcca

SEQ ID NO: 672188 - DNA, 16 bp, Homo sapiens
cttcttacgcaatgct

SEQ ID NO: 672189 - DNA, 17 bp, Homo sapiens
cttcttctctccacatg

SEQ ID NO: 672190 - DNA, 23 bp, Homo sapiens
cttctttccatcaactcccaact

SEQ ID NO: 672191 - DNA, 13 bp, Homo sapiens
cttctttgtgcct

SEQ ID NO: 672192 - DNA, 21 bp, Homo sapiens
cttctttgtgcctttggcctg

SEQ ID NO: 672193 - DNA, 14 bp, Homo sapiens
cttgaaaaatgaca

SEQ ID NO: 672194 - DNA, 22 bp, Homo sapiens
cttgaaaccaattaagcagctt

SEQ ID NO: 672195 - DNA, 23 bp, Homo sapiens
cttgaaactttgggaaaacatgt

SEQ ID NO: 672196 - DNA, 11 bp, Homo sapiens
cttgaaattga

SEQ ID NO: 672197 - DNA, 15 bp, Homo sapiens
cttgaagaaggaaag

SEQ ID NO: 672198 - DNA, 19 bp, Homo sapiens
cttgaagtctaaaagcaga

SEQ ID NO: 672199 - DNA, 20 bp, Homo sapiens
cttgaatgtggtctcaggat

SEQ ID NO: 672200 - DNA, 15 bp, Homo sapiens
cttgacatacctacc

SEQ ID NO: 672201 - DNA, 23 bp, Homo sapiens
cttgaccatactaataaatataa

SEQ ID NO: 672202 - DNA, 12 bp, Homo sapiens
cttgactgcatt

SEQ ID NO: 672203 - DNA, 15 bp, Homo sapiens
cttgagcaggattag

SEQ ID NO: 672204 - DNA, 12 bp, Homo sapiens
cttgagccctgg

SEQ ID NO: 672205 - DNA, 14 bp, Homo sapiens
cttgagccctggct

SEQ ID NO: 672206 - DNA, 17 bp, Homo sapiens
cttgagttcccagatgg

SEQ ID NO: 672207 - DNA, 20 bp, Homo sapiens
cttgatccccttgatagatg

SEQ ID NO: 672208 - DNA, 15 bp, Homo sapiens
cttgatctctcttgt

SEQ ID NO: 672209 - DNA, 16 bp, Homo sapiens
cttgatctctcttgtc

SEQ ID NO: 672210 - DNA, 22 bp, Homo sapiens
cttgatctctcttgtcctcttc

SEQ ID NO: 672211 - DNA, 14 bp, Homo sapiens
cttgatgactgctg

SEQ ID NO: 672212 - DNA, 17 bp, Homo sapiens
cttgatgactgctgatt

SEQ ID NO: 672213 - DNA, 13 bp, Homo sapiens
cttgatgtatttc

SEQ ID NO: 672214 - DNA, 14 bp, Homo sapiens
cttgattcccaccg

SEQ ID NO: 672215 - DNA, 21 bp, Homo sapiens
cttgcctccaggtgcagaggt

SEQ ID NO: 672216 - DNA, 19 bp, Homo sapiens
cttgcctctgccctggatt

SEQ ID NO: 672217 - DNA, 15 bp, Homo sapiens
cttgcctgaggggaa

SEQ ID NO: 672218 - DNA, 23 bp, Homo sapiens
cttgccttcctcagctgcctcct

SEQ ID NO: 672219 - DNA, 19 bp, Homo sapiens
cttgctctgttacccaggc

SEQ ID NO: 672220 - DNA, 15 bp, Homo sapiens
cttgcttcttactga

SEQ ID NO: 672221 - DNA, 12 bp, Homo sapiens
cttgcttgcctg

SEQ ID NO: 672222 - DNA, 19 bp, Homo sapiens
cttgcttgcctgcagggcc

SEQ ID NO: 672223 - DNA, 17 bp, Homo sapiens
cttggacagtctgagct

SEQ ID NO: 672224 - DNA, 16 bp, Homo sapiens
cttggactacacaata

SEQ ID NO: 672225 - DNA, 20 bp, Homo sapiens
cttgggcagtctttcttgaa

SEQ ID NO: 672226 - DNA, 17 bp, Homo sapiens
cttggggacataatttc

SEQ ID NO: 672227 - DNA, 15 bp, Homo sapiens
cttggggcccagtgc

SEQ ID NO: 672228 - DNA, 16 bp, Homo sapiens
cttggggcccagtgca

SEQ ID NO: 672229 - DNA, 17 bp, Homo sapiens
cttggtcttctactgcc

SEQ ID NO: 672230 - DNA, 19 bp, Homo sapiens
cttggtcttctactgcctt

SEQ ID NO: 672231 - DNA, 18 bp, Homo sapiens
cttggtgccctcgcctcc

SEQ ID NO: 672232 - DNA, 23 bp, Homo sapiens
cttggtttgtggcgtctccctcg

SEQ ID NO: 672233 - DNA, 21 bp, Homo sapiens
cttgtacatggaattttttga

SEQ ID NO: 672234 - DNA, 23 bp, Homo sapiens
cttgtcagggtctccttccttcc

SEQ ID NO: 672235 - DNA, 19 bp, Homo sapiens
cttgtcccatgtggcttgt

SEQ ID NO: 672236 - DNA, 15 bp, Homo sapiens
cttgtcctcagccag

SEQ ID NO: 672237 - DNA, 23 bp, Homo sapiens
cttgtcttctggtactttctgtt

SEQ ID NO: 672238 - DNA, 17 bp, Homo sapiens
cttgtgaaacgtctgga

SEQ ID NO: 672239 - DNA, 14 bp, Homo sapiens
cttgtgcctggggt

SEQ ID NO: 672240 - DNA, 13 bp, Homo sapiens
cttgttagaaaac

SEQ ID NO: 672241 - DNA, 22 bp, Homo sapiens
cttgttcagcaggctagacaga

SEQ ID NO: 672242 - DNA, 15 bp, Homo sapiens
cttgtttacctttct

SEQ ID NO: 672243 - DNA, 13 bp, Homo sapiens
cttgtttatgata

SEQ ID NO: 672244 - DNA, 19 bp, Homo sapiens
cttgtttatgatatttctt

SEQ ID NO: 672245 - DNA, 22 bp, Homo sapiens
cttgttttataaaattttgctt

SEQ ID NO: 672246 - DNA, 23 bp, Homo sapiens
ctttaaaaaagaaaagtgcatat

SEQ ID NO: 672247 - DNA, 13 bp, Homo sapiens
ctttaaaaagaaa

SEQ ID NO: 672248 - DNA, 19 bp, Homo sapiens
ctttaaccaggaatattaa

SEQ ID NO: 672249 - DNA, 20 bp, Homo sapiens
ctttaacttttttttctctc

SEQ ID NO: 672250 - DNA, 20 bp, Homo sapiens
ctttaagccttcaaaactat

SEQ ID NO: 672251 - DNA, 20 bp, Homo sapiens
ctttaaggatttgaaccatg

SEQ ID NO: 672252 - DNA, 17 bp, Homo sapiens
ctttaattactggaatt

SEQ ID NO: 672253 - DNA, 15 bp, Homo sapiens
ctttactcgtgcatt

SEQ ID NO: 672254 - DNA, 18 bp, Homo sapiens
ctttactgcctgaataaa

SEQ ID NO: 672255 - DNA, 16 bp, Homo sapiens
ctttagtattaaatca

SEQ ID NO: 672256 - DNA, 14 bp, Homo sapiens
ctttagtttttggt

SEQ ID NO: 672257 - DNA, 23 bp, Homo sapiens
ctttagtttttggttgggaatga

SEQ ID NO: 672258 - DNA, 19 bp, Homo sapiens
ctttatgtagtttttatat

SEQ ID NO: 672259 - DNA, 22 bp, Homo sapiens
ctttatgttgcggtgagaactc

SEQ ID NO: 672260 - DNA, 21 bp, Homo sapiens
ctttattcagaactttagtat

SEQ ID NO: 672261 - DNA, 19 bp, Homo sapiens
ctttattgcttttttgtat

SEQ ID NO: 672262 - DNA, 14 bp, Homo sapiens
ctttatttctcttc

SEQ ID NO: 672263 - DNA, 22 bp, Homo sapiens
ctttattttgagatgtaaaaag

SEQ ID NO: 672264 - DNA, 20 bp, Homo sapiens
ctttcaattgtcacttttta

SEQ ID NO: 672265 - DNA, 14 bp, Homo sapiens
ctttcacctgggtg

SEQ ID NO: 672266 - DNA, 22 bp, Homo sapiens
ctttcacctgggtgtctgggct

SEQ ID NO: 672267 - DNA, 21 bp, Homo sapiens
ctttcagaaatataacacatt

SEQ ID NO: 672268 - DNA, 23 bp, Homo sapiens
ctttcagaaatataacacatttt

SEQ ID NO: 672269 - DNA, 16 bp, Homo sapiens
ctttcatattttaaac

SEQ ID NO: 672270 - DNA, 23 bp, Homo sapiens
ctttcatattttaaacagaggat

SEQ ID NO: 672271 - DNA, 20 bp, Homo sapiens
ctttcatttcgtatttctca

SEQ ID NO: 672272 - DNA, 14 bp, Homo sapiens
ctttcatttgcttt

SEQ ID NO: 672273 - DNA, 18 bp, Homo sapiens
ctttcatttgctttggaa

SEQ ID NO: 672274 - DNA, 13 bp, Homo sapiens
ctttccaaattaa

SEQ ID NO: 672275 - DNA, 15 bp, Homo sapiens
ctttcccatgtattt

SEQ ID NO: 672276 - DNA, 17 bp, Homo sapiens
ctttcccgcccagcctc

SEQ ID NO: 672277 - DNA, 16 bp, Homo sapiens
ctttcctctcctgggt

SEQ ID NO: 672278 - DNA, 19 bp, Homo sapiens
ctttcctctcctgggtact

SEQ ID NO: 672279 - DNA, 17 bp, Homo sapiens
ctttcctgtttccaggg

SEQ ID NO: 672280 - DNA, 15 bp, Homo sapiens
ctttctaatgtttct

SEQ ID NO: 672281 - DNA, 14 bp, Homo sapiens
ctttctatgtgaca

SEQ ID NO: 672282 - DNA, 20 bp, Homo sapiens
gaaattactaattttacttc

SEQ ID NO: 672283 - DNA, 13 bp, Homo sapiens
gaaattactttaa

SEQ ID NO: 672284 - DNA, 15 bp, Homo sapiens
gaaattactttaaca

SEQ ID NO: 672285 - DNA, 17 bp, Homo sapiens
gaaattactttaacatt

SEQ ID NO: 672286 - DNA, 22 bp, Homo sapiens
gaaattactttaacattttgga

SEQ ID NO: 672287 - DNA, 23 bp, Homo sapiens
gaaattcttataactcaacattt

SEQ ID NO: 672288 - DNA, 13 bp, Homo sapiens
gaaattgcatact

SEQ ID NO: 672289 - DNA, 16 bp, Homo sapiens
gaaattgcatactttg

SEQ ID NO: 672290 - DNA, 15 bp, Homo sapiens
gaacaaaactccaga

SEQ ID NO: 672291 - DNA, 17 bp, Homo sapiens
gaacacagttctgggca

SEQ ID NO: 672292 - DNA, 17 bp, Homo sapiens
gaacacttagtgatcat

SEQ ID NO: 672293 - DNA, 14 bp, Homo sapiens
gaacagatttcaaa

SEQ ID NO: 672294 - DNA, 18 bp, Homo sapiens
gaacaggaggtgtgaatg

SEQ ID NO: 672295 - DNA, 17 bp, Homo sapiens
gaacaggtcaaagatgt

SEQ ID NO: 672296 - DNA, 18 bp, Homo sapiens
gaacaggtcaaagatgtg

SEQ ID NO: 672297 - DNA, 19 bp, Homo sapiens
gaacaggtcaaagatgtgt

SEQ ID NO: 672298 - DNA, 20 bp, Homo sapiens
gaacatgatagttaaactac

SEQ ID NO: 672299 - DNA, 15 bp, Homo sapiens
gaaccaaatacctca

SEQ ID NO: 672300 - DNA, 21 bp, Homo sapiens
gaaccaggaaatggaacccca

SEQ ID NO: 672301 - DNA, 15 bp, Homo sapiens
gaaccataaattcaa

SEQ ID NO: 672302 - DNA, 18 bp, Homo sapiens
gaaccctccttttctctg

SEQ ID NO: 672303 - DNA, 19 bp, Homo sapiens
gaacctacagactccatct

SEQ ID NO: 672304 - DNA, 20 bp, Homo sapiens
gaacctacagactccatctc

SEQ ID NO: 672305 - DNA, 21 bp, Homo sapiens
gaacctacagactccatctct

SEQ ID NO: 672306 - DNA, 16 bp, Homo sapiens
gaacctcattctggtt

SEQ ID NO: 672307 - DNA, 12 bp, Homo sapiens
gaacctggaact

SEQ ID NO: 672308 - DNA, 16 bp, Homo sapiens
gaacctgtcctaagga

SEQ ID NO: 672309 - DNA, 19 bp, Homo sapiens
gaaccttccttcctgcttg

SEQ ID NO: 672310 - DNA, 20 bp, Homo sapiens
gaacgcttcgggaaaatatt

SEQ ID NO: 672311 - DNA, 19 bp, Homo sapiens
gaactcagcacattcggga

SEQ ID NO: 672312 - DNA, 23 bp, Homo sapiens
gaactccaggccctcctctccca

SEQ ID NO: 672313 - DNA, 18 bp, Homo sapiens
gaactctgggctgccatg

SEQ ID NO: 672314 - DNA, 20 bp, Homo sapiens
gaactgcaatgaaagtcaaa

SEQ ID NO: 672315 - DNA, 21 bp, Homo sapiens
gaacttgaagggttactgacg

SEQ ID NO: 672316 - DNA, 16 bp, Homo sapiens
gaactttattaagtaa

SEQ ID NO: 672317 - DNA, 19 bp, Homo sapiens
gaagaaacacgtggtcatg

SEQ ID NO: 672318 - DNA, 16 bp, Homo sapiens
gaagaaccaaatacct

SEQ ID NO: 672319 - DNA, 20 bp, Homo sapiens
gaagaaccaaatacctcaat

SEQ ID NO: 672320 - DNA, 12 bp, Homo sapiens
gaagaatgaaag

SEQ ID NO: 672321 - DNA, 16 bp, Homo sapiens
gaagaatgaaagctgt

SEQ ID NO: 672322 - DNA, 18 bp, Homo sapiens
gaagacatgaaccaagtg

SEQ ID NO: 672323 - DNA, 16 bp, Homo sapiens
gaagacattttgttac

SEQ ID NO: 672324 - DNA, 20 bp, Homo sapiens
gaagacattttgttacataa

SEQ ID NO: 672325 - DNA, 19 bp, Homo sapiens
gaagagacaaagatttctt

SEQ ID NO: 672326 - DNA, 11 bp, Homo sapiens
gaagaggcttc

SEQ ID NO: 672327 - DNA, 20 bp, Homo sapiens
gaagaggggcagctttttca

SEQ ID NO: 672328 - DNA, 20 bp, Homo sapiens
gaagcaaagttcaacttatt

SEQ ID NO: 672329 - DNA, 23 bp, Homo sapiens
gaagcaaagttcaacttatttca

SEQ ID NO: 672330 - DNA, 19 bp, Homo sapiens
gaagcaacagatagatgtt

SEQ ID NO: 672331 - DNA, 21 bp, Homo sapiens
gaagcactacaccttgccttg

SEQ ID NO: 672332 - DNA, 13 bp, Homo sapiens
gaagcatgaaaaa

SEQ ID NO: 672333 - DNA, 21 bp, Homo sapiens
gaagccaactgacaaagatgc

SEQ ID NO: 672334 - DNA, 22 bp, Homo sapiens
gaagccactttctacaggccag

SEQ ID NO: 672335 - DNA, 17 bp, Homo sapiens
gaagccccacatgtcca

SEQ ID NO: 672336 - DNA, 23 bp, Homo sapiens
gaagccccacatgtccagcacct

SEQ ID NO: 672337 - DNA, 13 bp, Homo sapiens
gaagctccatgga

SEQ ID NO: 672338 - DNA, 15 bp, Homo sapiens
gaagctggcctgaga

SEQ ID NO: 672339 - DNA, 16 bp, Homo sapiens
gaagctgtcctggagg

SEQ ID NO: 672340 - DNA, 15 bp, Homo sapiens
gaaggcagacagcag

SEQ ID NO: 672341 - DNA, 21 bp, Homo sapiens
gaaggcagacagcaggcagcg

SEQ ID NO: 672342 - DNA, 16 bp, Homo sapiens
gaaggccagcaacatt

SEQ ID NO: 672343 - DNA, 13 bp, Homo sapiens
gaaggcctgactt

SEQ ID NO: 672344 - DNA, 23 bp, Homo sapiens
gaaggcttaattgactgaaatta

SEQ ID NO: 672345 - DNA, 14 bp, Homo sapiens
gaagggaaagtttt

SEQ ID NO: 672346 - DNA, 14 bp, Homo sapiens
gaaggtttattgtt

SEQ ID NO: 672347 - DNA, 18 bp, Homo sapiens
gaagtagcttgctccctg

SEQ ID NO: 672348 - DNA, 17 bp, Homo sapiens
gaagtatggtgtgttca

SEQ ID NO: 672349 - DNA, 20 bp, Homo sapiens
gaagtcaaaatatgtaagaa

SEQ ID NO: 672350 - DNA, 22 bp, Homo sapiens
gaagtcacccctttctgtccca

SEQ ID NO: 672351 - DNA, 23 bp, Homo sapiens
gaagtcacccctttctgtcccac

SEQ ID NO: 672352 - DNA, 21 bp, Homo sapiens
gaagtgctctaacttttctta

SEQ ID NO: 672353 - DNA, 17 bp, Homo sapiens
gaagtgtataatataaa

SEQ ID NO: 672354 - DNA, 20 bp, Homo sapiens
gaataaattatggcatttct

SEQ ID NO: 672355 - DNA, 23 bp, Homo sapiens
gaataaattatggcatttctatt

SEQ ID NO: 672356 - DNA, 22 bp, Homo sapiens
gaataagacaagagatctacac

SEQ ID NO: 672357 - DNA, 19 bp, Homo sapiens
gaataataaaagtatatat

SEQ ID NO: 672358 - DNA, 21 bp, Homo sapiens
gaataataaaagtatatatat

SEQ ID NO: 672359 - DNA, 18 bp, Homo sapiens
gaatagaagctaaggttt

SEQ ID NO: 672360 - DNA, 22 bp, Homo sapiens
gaatagctttaatgatatgctt

SEQ ID NO: 672361 - DNA, 21 bp, Homo sapiens
gaatatatcagtacctctcaa

SEQ ID NO: 672362 - DNA, 19 bp, Homo sapiens
gaatatgacggaagaacat

SEQ ID NO: 672363 - DNA, 18 bp, Homo sapiens
gaatcattcagaaatgtt

SEQ ID NO: 672364 - DNA, 15 bp, Homo sapiens
gaatgaaagctgttc

SEQ ID NO: 672365 - DNA, 17 bp, Homo sapiens
gaatgaaccctcctttt

SEQ ID NO: 672366 - DNA, 13 bp, Homo sapiens
gaatgagcccaga

SEQ ID NO: 672367 - DNA, 14 bp, Homo sapiens
gaatgcacgtttca

SEQ ID NO: 672368 - DNA, 14 bp, Homo sapiens
gaatgcctcctgtg

SEQ ID NO: 672369 - DNA, 18 bp, Homo sapiens
gaatgcctcctgtgggga

SEQ ID NO: 672370 - DNA, 20 bp, Homo sapiens
gaatggtacatgtcttccat

SEQ ID NO: 672371 - DNA, 20 bp, Homo sapiens
gaatgtacatgaagcaatta

SEQ ID NO: 672372 - DNA, 14 bp, Homo sapiens
gaatgtatgtaatg

SEQ ID NO: 672373 - DNA, 15 bp, Homo sapiens
gaatgtgggcactgg

SEQ ID NO: 672374 - DNA, 20 bp, Homo sapiens
gaatgtgggcactggcccag

SEQ ID NO: 672375 - DNA, 13 bp, Homo sapiens
gaatgttaaaggg

SEQ ID NO: 672376 - DNA, 15 bp, Homo sapiens
gaattctgattgatt

SEQ ID NO: 672377 - DNA, 13 bp, Homo sapiens
gaattcttctgca

SEQ ID NO: 672378 - DNA, 14 bp, Homo sapiens
gaattgaaaagttt

SEQ ID NO: 672379 - DNA, 19 bp, Homo sapiens
gaattggaaagacttctca

SEQ ID NO: 672380 - DNA, 21 bp, Homo sapiens
gaattggaaagacttctcaaa

SEQ ID NO: 672381 - DNA, 23 bp, Homo sapiens
gaatttatgtgaaatgctttctg

SEQ ID NO: 672382 - DNA, 15 bp, Homo sapiens
gaatttttattgttg

SEQ ID NO: 672383 - DNA, 14 bp, Homo sapiens
gacaaaaggaatgt

SEQ ID NO: 672384 - DNA, 17 bp, Homo sapiens
gacaagacagaggggag

SEQ ID NO: 672385 - DNA, 16 bp, Homo sapiens
gacaagagatctacac

SEQ ID NO: 672386 - DNA, 19 bp, Homo sapiens
gacaagagatctacacatg

SEQ ID NO: 672387 - DNA, 16 bp, Homo sapiens
gacaataattctacat

SEQ ID NO: 672388 - DNA, 23 bp, Homo sapiens
gacaataattctacatgttgtct

SEQ ID NO: 672389 - DNA, 20 bp, Homo sapiens
gacaatggaccctttttgtt

SEQ ID NO: 672390 - DNA, 16 bp, Homo sapiens
gacaattagaaaaaag

SEQ ID NO: 672391 - DNA, 17 bp, Homo sapiens
gacacatatacatatga

SEQ ID NO: 672392 - DNA, 14 bp, Homo sapiens
gacactagaaaact

SEQ ID NO: 672393 - DNA, 17 bp, Homo sapiens
gacagaagtctcctcaa

SEQ ID NO: 672394 - DNA, 15 bp, Homo sapiens
gacagactatttgct

SEQ ID NO: 672395 - DNA, 13 bp, Homo sapiens
gacagaggggagc

SEQ ID NO: 672396 - DNA, 12 bp, Homo sapiens
gacagcaggcag

SEQ ID NO: 672397 - DNA, 19 bp, Homo sapiens
gacagctgactgaatgcag

SEQ ID NO: 672398 - DNA, 18 bp, Homo sapiens
gacagctgataaatttaa

SEQ ID NO: 672399 - DNA, 13 bp, Homo sapiens
gacagggccagtg

SEQ ID NO: 672400 - DNA, 14 bp, Homo sapiens
gacagggccagtgg

SEQ ID NO: 672401 - DNA, 20 bp, Homo sapiens
gacagggccagtggggcctg

SEQ ID NO: 672402 - DNA, 22 bp, Homo sapiens
gacagggccagtggggcctgtg

SEQ ID NO: 672403 - DNA, 20 bp, Homo sapiens
gacagtcatcatcagggcct

SEQ ID NO: 672404 - DNA, 22 bp, Homo sapiens
gacagtcatcatcagggcctgg

SEQ ID NO: 672405 - DNA, 22 bp, Homo sapiens
gacatagaatctgtgacctctg

SEQ ID NO: 672406 - DNA, 20 bp, Homo sapiens
gacatggctccggcctctgc

SEQ ID NO: 672407 - DNA, 17 bp, Homo sapiens
gacatttgctgaactca

SEQ ID NO: 672408 - DNA, 22 bp, Homo sapiens
gacatttgctgaactcagcaca

SEQ ID NO: 672409 - DNA, 23 bp, Homo sapiens
gacatttttccgtttgcttttgt

SEQ ID NO: 672410 - DNA, 23 bp, Homo sapiens
gaccacagggttcaaaatgtctg

SEQ ID NO: 672411 - DNA, 22 bp, Homo sapiens
gaccacttccaggggaacctgc

SEQ ID NO: 672412 - DNA, 14 bp, Homo sapiens
gaccagggcctttt

SEQ ID NO: 672413 - DNA, 18 bp, Homo sapiens
gaccatattacctggatt

SEQ ID NO: 672414 - DNA, 14 bp, Homo sapiens
gaccatcctggcta

SEQ ID NO: 672415 - DNA, 20 bp, Homo sapiens
gacccagtcccacactgtgg

SEQ ID NO: 672416 - DNA, 12 bp, Homo sapiens
gacccagtgcag

SEQ ID NO: 672417 - DNA, 14 bp, Homo sapiens
gacccagtgcagaa

SEQ ID NO: 672418 - DNA, 19 bp, Homo sapiens
gacccccatctgagctggg

SEQ ID NO: 672419 - DNA, 14 bp, Homo sapiens
gaccccctcagcct

SEQ ID NO: 672420 - DNA, 11 bp, Homo sapiens
gacccctcctt

SEQ ID NO: 672421 - DNA, 14 bp, Homo sapiens
gacccctccttgtc

SEQ ID NO: 672422 - DNA, 14 bp, Homo sapiens
gaccctcttgccca

SEQ ID NO: 672423 - DNA, 20 bp, Homo sapiens
gaccctcttgcccatcctga

SEQ ID NO: 672424 - DNA, 19 bp, Homo sapiens
gaccctgcaaacagaacag

SEQ ID NO: 672425 - DNA, 22 bp, Homo sapiens
gaccctgcaaacagaacagggt

SEQ ID NO: 672426 - DNA, 15 bp, Homo sapiens
gaccctgcccccact

SEQ ID NO: 672427 - DNA, 16 bp, Homo sapiens
gaccgggagacagagg

SEQ ID NO: 672428 - DNA, 22 bp, Homo sapiens
gaccggtgcttttattgtaaag

SEQ ID NO: 672429 - DNA, 23 bp, Homo sapiens
gaccgtgcccacgagggtctccc

SEQ ID NO: 672430 - DNA, 14 bp, Homo sapiens
gaccgttaaaaaat

SEQ ID NO: 672431 - DNA, 19 bp, Homo sapiens
gacctcagttttatgcccc

SEQ ID NO: 672432 - DNA, 14 bp, Homo sapiens
gacctctaggagga

SEQ ID NO: 672433 - DNA, 20 bp, Homo sapiens
gacctctgacaactgtgaag

SEQ ID NO: 672434 - DNA, 18 bp, Homo sapiens
gacctgaaataatatatt

SEQ ID NO: 672435 - DNA, 18 bp, Homo sapiens
gaccttggggtacaattg

SEQ ID NO: 672436 - DNA, 19 bp, Homo sapiens
gacctttcctctcctgggt

SEQ ID NO: 672437 - DNA, 20 bp, Homo sapiens
gacctttcctctcctgggta

SEQ ID NO: 672438 - DNA, 20 bp, Homo sapiens
gacgcccgagagcctcgctt

SEQ ID NO: 672439 - DNA, 19 bp, Homo sapiens
gacggaaaatgcttaaaaa

SEQ ID NO: 672440 - DNA, 18 bp, Homo sapiens
gacggtttccagggaggg

SEQ ID NO: 672441 - DNA, 23 bp, Homo sapiens
gacgtgctccgtagctctgctgc

SEQ ID NO: 672442 - DNA, 19 bp, Homo sapiens
gacgtttataaacagaaat

SEQ ID NO: 672443 - DNA, 23 bp, Homo sapiens
gacgtttataaacagaaatggaa

SEQ ID NO: 672444 - DNA, 14 bp, Homo sapiens
gactaaagagagaa

SEQ ID NO: 672445 - DNA, 16 bp, Homo sapiens
gactaactcaaataca

SEQ ID NO: 672446 - DNA, 19 bp, Homo sapiens
gactacacaatacagtatt

SEQ ID NO: 672447 - DNA, 17 bp, Homo sapiens
gactattgtgccaactg

SEQ ID NO: 672448 - DNA, 13 bp, Homo sapiens
gactatttgctaa

SEQ ID NO: 672449 - DNA, 18 bp, Homo sapiens
gactcaaaaaaacaaaaa

SEQ ID NO: 672450 - DNA, 12 bp, Homo sapiens
gactccatctct

SEQ ID NO: 672451 - DNA, 21 bp, Homo sapiens
gactccatctctcatcctcca

SEQ ID NO: 672452 - DNA, 14 bp, Homo sapiens
gactccatctcttc

SEQ ID NO: 672453 - DNA, 18 bp, Homo sapiens
gactccatctcttctgca

SEQ ID NO: 672454 - DNA, 13 bp, Homo sapiens
gactcctggcagg

SEQ ID NO: 672455 - DNA, 14 bp, Homo sapiens
gactcctggcaggg

SEQ ID NO: 672456 - DNA, 13 bp, Homo sapiens
gactctccaggga

SEQ ID NO: 672457 - DNA, 19 bp, Homo sapiens
gactgaaattacgggtacc

SEQ ID NO: 672458 - DNA, 19 bp, Homo sapiens
gactgaaattactttaaca

SEQ ID NO: 672459 - DNA, 16 bp, Homo sapiens
gactgacccccatctg

SEQ ID NO: 672460 - DNA, 17 bp, Homo sapiens
gactgatgattttcctt

SEQ ID NO: 672461 - DNA, 21 bp, Homo sapiens
gactgctattctagagctttt

SEQ ID NO: 672462 - DNA, 22 bp, Homo sapiens
gactgctattctagagctttta

SEQ ID NO: 672463 - DNA, 14 bp, Homo sapiens
gactggaggaggcc

SEQ ID NO: 672464 - DNA, 15 bp, Homo sapiens
gactggaggaggcct

SEQ ID NO: 672465 - DNA, 17 bp, Homo sapiens
gactggatgtaccacca

SEQ ID NO: 672466 - DNA, 15 bp, Homo sapiens
gactggtgctgcagc

SEQ ID NO: 672467 - DNA, 22 bp, Homo sapiens
gactgtgaggccatacttgtga

SEQ ID NO: 672468 - DNA, 17 bp, Homo sapiens
gactgtgccagaggcca

SEQ ID NO: 672469 - DNA, 19 bp, Homo sapiens
gacttagcgtcaagacatt

SEQ ID NO: 672470 - DNA, 21 bp, Homo sapiens
gacttattttgtcttattctt

SEQ ID NO: 672471 - DNA, 22 bp, Homo sapiens
gacttattttgtcttattctta

SEQ ID NO: 672472 - DNA, 11 bp, Homo sapiens
gacttgcttta

SEQ ID NO: 672473 - DNA, 22 bp, Homo sapiens
gacttgtacaaacagtatttct

SEQ ID NO: 672474 - DNA, 18 bp, Homo sapiens
gacttttggtagagaagg

SEQ ID NO: 672475 - DNA, 15 bp, Homo sapiens
gagaaaatttatatc

SEQ ID NO: 672476 - DNA, 13 bp, Homo sapiens
gagaaatgcaata

SEQ ID NO: 672477 - DNA, 22 bp, Homo sapiens
gagaaatgcaataactctggga

SEQ ID NO: 672478 - DNA, 14 bp, Homo sapiens
gagaaccaaagcaa

SEQ ID NO: 672479 - DNA, 18 bp, Homo sapiens
gagaaccaaccagggaag

SEQ ID NO: 672480 - DNA, 13 bp, Homo sapiens
gagaagcatgaaa

SEQ ID NO: 672481 - DNA, 19 bp, Homo sapiens
gagaagctgctccaggcct

SEQ ID NO: 672482 - DNA, 20 bp, Homo sapiens
gagaagctgctccaggcctg

SEQ ID NO: 672483 - DNA, 16 bp, Homo sapiens
gagacaatgttttctt

SEQ ID NO: 672484 - DNA, 17 bp, Homo sapiens
gagacagactagaagtt

SEQ ID NO: 672485 - DNA, 14 bp, Homo sapiens
gagacatctggaaa

SEQ ID NO: 672486 - DNA, 17 bp, Homo sapiens
gagacggtttccaggga

SEQ ID NO: 672487 - DNA, 18 bp, Homo sapiens
gagactcaaaaaaacaaa

SEQ ID NO: 672488 - DNA, 15 bp, Homo sapiens
gagagcgagaccctg

SEQ ID NO: 672489 - DNA, 17 bp, Homo sapiens
gagagcttggactacac

SEQ ID NO: 672490 - DNA, 18 bp, Homo sapiens
gagagcttggactacaca

SEQ ID NO: 672491 - DNA, 19 bp, Homo sapiens
gagaggacaatactggggt

SEQ ID NO: 672492 - DNA, 18 bp, Homo sapiens
gagagggctggtccttat

SEQ ID NO: 672493 - DNA, 21 bp, Homo sapiens
gagagggctggtccttattta

SEQ ID NO: 672494 - DNA, 16 bp, Homo sapiens
gagagtacctgtgtgt

SEQ ID NO: 672495 - DNA, 17 bp, Homo sapiens
gagagtctgaatatttt

SEQ ID NO: 672496 - DNA, 17 bp, Homo sapiens
gagatcgagaccatcct

SEQ ID NO: 672497 - DNA, 18 bp, Homo sapiens
gagatcgagaccatcctg

SEQ ID NO: 672498 - DNA, 21 bp, Homo sapiens
gagatcgagaccatcctggct

SEQ ID NO: 672499 - DNA, 12 bp, Homo sapiens
gagatctacaca

SEQ ID NO: 672500 - DNA, 13 bp, Homo sapiens
gagatctacacat

SEQ ID NO: 672501 - DNA, 13 bp, Homo sapiens
gagctcttccctt

SEQ ID NO: 672502 - DNA, 21 bp, Homo sapiens
gagctcttcctatccctctcc

SEQ ID NO: 672503 - DNA, 17 bp, Homo sapiens
gagctgtcaccaaggaa

SEQ ID NO: 672504 - DNA, 19 bp, Homo sapiens
gagctgtcaccaaggaaac

SEQ ID NO: 672505 - DNA, 22 bp, Homo sapiens
gagcttaatgctacatgtgagt

SEQ ID NO: 672506 - DNA, 23 bp, Homo sapiens
gagctttgtctacttcaaaagtt

SEQ ID NO: 672507 - DNA, 13 bp, Homo sapiens
gaggaaaattctt

SEQ ID NO: 672508 - DNA, 16 bp, Homo sapiens
gaggaagtgagcagtc

SEQ ID NO: 672509 - DNA, 23 bp, Homo sapiens
gaggaatatgacggaagaacata

SEQ ID NO: 672510 - DNA, 13 bp, Homo sapiens
gaggacacagaga

SEQ ID NO: 672511 - DNA, 15 bp, Homo sapiens
gaggagacattggct

SEQ ID NO: 672512 - DNA, 13 bp, Homo sapiens
gaggagcgcaggc

SEQ ID NO: 672513 - DNA, 20 bp, Homo sapiens
gaggagcgcaggcagcgcag

SEQ ID NO: 672514 - DNA, 16 bp, Homo sapiens
gaggaggcctgtccca

SEQ ID NO: 672515 - DNA, 21 bp, Homo sapiens
gaggatccactcccaggatga

SEQ ID NO: 672516 - DNA, 22 bp, Homo sapiens
gaggatggtagaagtttggctg

SEQ ID NO: 672517 - DNA, 22 bp, Homo sapiens
gaggatttaagggatggaaaag

SEQ ID NO: 672518 - DNA, 20 bp, Homo sapiens
gaggcaggcatggccctggg

SEQ ID NO: 672519 - DNA, 14 bp, Homo sapiens
gaggcattgacata

SEQ ID NO: 672520 - DNA, 16 bp, Homo sapiens
gaggccacttagggaa

SEQ ID NO: 672521 - DNA, 16 bp, Homo sapiens
gaggccatacttgtga

SEQ ID NO: 672522 - DNA, 14 bp, Homo sapiens
gaggccctcctgtg

SEQ ID NO: 672523 - DNA, 18 bp, Homo sapiens
gaggcctcgagcagagag

SEQ ID NO: 672524 - DNA, 19 bp, Homo sapiens
gaggcctgccccctgggct

SEQ ID NO: 672525 - DNA, 14 bp, Homo sapiens
gaggctcagattgt

SEQ ID NO: 672526 - DNA, 15 bp, Homo sapiens
gaggctgaggcagga

SEQ ID NO: 672527 - DNA, 18 bp, Homo sapiens
gaggctgcccctctcacc

SEQ ID NO: 672528 - DNA, 19 bp, Homo sapiens
gaggcttgtttacctttct

SEQ ID NO: 672529 - DNA, 16 bp, Homo sapiens
gagggaggccccaggg

SEQ ID NO: 672530 - DNA, 17 bp, Homo sapiens
gagggcagactggggca

SEQ ID NO: 672531 - DNA, 23 bp, Homo sapiens
gagggcagactggggcatcctgt

SEQ ID NO: 672532 - DNA, 17 bp, Homo sapiens
gaggggccggccctgtg

SEQ ID NO: 672533 - DNA, 21 bp, Homo sapiens
gagggtctcccctcctgcaca

SEQ ID NO: 672534 - DNA, 14 bp, Homo sapiens
gagggtttgggcag

SEQ ID NO: 672535 - DNA, 16 bp, Homo sapiens
gagggtttgggcagag

SEQ ID NO: 672536 - DNA, 11 bp, Homo sapiens
gaggtcaggga

SEQ ID NO: 672537 - DNA, 21 bp, Homo sapiens
gaggtgattccagtgaagata

SEQ ID NO: 672538 - DNA, 20 bp, Homo sapiens
gaggtgctatgaagccaact

SEQ ID NO: 672539 - DNA, 12 bp, Homo sapiens
gaggtgcttcac

SEQ ID NO: 672540 - DNA, 15 bp, Homo sapiens
gaggtttttttgctt

SEQ ID NO: 672541 - DNA, 18 bp, Homo sapiens
gagtaaataattggaaaa

SEQ ID NO: 672542 - DNA, 23 bp, Homo sapiens
gagtaattcttttctgtttctgt

SEQ ID NO: 672543 - DNA, 14 bp, Homo sapiens
gagtaatttcattt

SEQ ID NO: 672544 - DNA, 12 bp, Homo sapiens
gagtacctgtgt

SEQ ID NO: 672545 - DNA, 14 bp, Homo sapiens
gagtacctgtgtgt

SEQ ID NO: 672546 - DNA, 13 bp, Homo sapiens
gagtcagcacagg

SEQ ID NO: 672547 - DNA, 20 bp, Homo sapiens
gagtctgggtccatcctggt

SEQ ID NO: 672548 - DNA, 20 bp, Homo sapiens
gagtcttacaatcaaatctc

SEQ ID NO: 672549 - DNA, 19 bp, Homo sapiens
gagtcttggtttctctcta

SEQ ID NO: 672550 - DNA, 22 bp, Homo sapiens
gagtcttggtttctctctacag

SEQ ID NO: 672551 - DNA, 18 bp, Homo sapiens
gagtgctggctcacagta

SEQ ID NO: 672552 - DNA, 22 bp, Homo sapiens
gagtgctggctcacagtacagc

SEQ ID NO: 672553 - DNA, 23 bp, Homo sapiens
gagtgggagagtacctgtgtgtt

SEQ ID NO: 672554 - DNA, 15 bp, Homo sapiens
gagtggtgcagacag

SEQ ID NO: 672555 - DNA, 15 bp, Homo sapiens
gagtgtagactgtgg

SEQ ID NO: 672556 - DNA, 11 bp, Homo sapiens
gagtgtgacag

SEQ ID NO: 672557 - DNA, 12 bp, Homo sapiens
gagtgtgacagg

SEQ ID NO: 672558 - DNA, 15 bp, Homo sapiens
gagtgtgcatggagg

SEQ ID NO: 672559 - DNA, 18 bp, Homo sapiens
gagtgtgggggaggcgca

SEQ ID NO: 672560 - DNA, 14 bp, Homo sapiens
gagttcctctgggt

SEQ ID NO: 672561 - DNA, 18 bp, Homo sapiens
gagtttctctagaagctc

SEQ ID NO: 672562 - DNA, 19 bp, Homo sapiens
gataaaataaataatttta

SEQ ID NO: 672563 - DNA, 16 bp, Homo sapiens
gataaaccaataaatc

SEQ ID NO: 672564 - DNA, 19 bp, Homo sapiens
gataaagccactgaaaatt

SEQ ID NO: 672565 - DNA, 17 bp, Homo sapiens
gataaagcttaggtcaa

SEQ ID NO: 672566 - DNA, 21 bp, Homo sapiens
gataaatattgagcagatcta

SEQ ID NO: 672567 - DNA, 15 bp, Homo sapiens
gataatattgtttgg

SEQ ID NO: 672568 - DNA, 21 bp, Homo sapiens
gataatcttcaggtgaacact

SEQ ID NO: 672569 - DNA, 15 bp, Homo sapiens
gataatttatttcaa

SEQ ID NO: 672570 - DNA, 22 bp, Homo sapiens
gatactttgaagtgcagctcat

SEQ ID NO: 672571 - DNA, 12 bp, Homo sapiens
gatagatgtttg

SEQ ID NO: 672572 - DNA, 14 bp, Homo sapiens
gataggaaactgaa

SEQ ID NO: 672573 - DNA, 13 bp, Homo sapiens
gatagtaagcata

SEQ ID NO: 672574 - DNA, 22 bp, Homo sapiens
gatagtagttaaataactgtgt

SEQ ID NO: 672575 - DNA, 22 bp, Homo sapiens
gatagttaaactaccacttttt

SEQ ID NO: 672576 - DNA, 15 bp, Homo sapiens
gatataaaatgtgca

SEQ ID NO: 672577 - DNA, 13 bp, Homo sapiens
gatatatttgaaa

SEQ ID NO: 672578 - DNA, 16 bp, Homo sapiens
gatatccttatcagag

SEQ ID NO: 672579 - DNA, 15 bp, Homo sapiens
gatatctataaaata

SEQ ID NO: 672580 - DNA, 15 bp, Homo sapiens
gatatggcaggactc

SEQ ID NO: 672581 - DNA, 19 bp, Homo sapiens
gatatggcaggactcctgg

SEQ ID NO: 672582 - DNA, 18 bp, Homo sapiens
gatattatattaaacata

SEQ ID NO: 672583 - DNA, 13 bp, Homo sapiens
gatattgaatgtt

SEQ ID NO: 672584 - DNA, 16 bp, Homo sapiens
gatattgtgaagtaca

SEQ ID NO: 672585 - DNA, 13 bp, Homo sapiens
gatatttcttgct

SEQ ID NO: 672586 - DNA, 14 bp, Homo sapiens
gatatttcttgctt

SEQ ID NO: 672587 - DNA, 16 bp, Homo sapiens
gatatttcttgctttc

SEQ ID NO: 672588 - DNA, 11 bp, Homo sapiens
gatatttttat

SEQ ID NO: 672589 - DNA, 17 bp, Homo sapiens
gatatttttcataaaca

SEQ ID NO: 672590 - DNA, 19 bp, Homo sapiens
gatcaacaacatccactgt

SEQ ID NO: 672591 - DNA, 14 bp, Homo sapiens
gatcaggaggaagt

SEQ ID NO: 672592 - DNA, 21 bp, Homo sapiens
gatcatcgccagaggtgcttc

SEQ ID NO: 672593 - DNA, 15 bp, Homo sapiens
gatccactcccagga

SEQ ID NO: 672594 - DNA, 19 bp, Homo sapiens
gatccttttattctccaga

SEQ ID NO: 672595 - DNA, 18 bp, Homo sapiens
gatcgagaccatcctggc

SEQ ID NO: 672596 - DNA, 16 bp, Homo sapiens
gatcgtagaaaatttg

SEQ ID NO: 672597 - DNA, 23 bp, Homo sapiens
gatctaaacagttatttctgttt

SEQ ID NO: 672598 - DNA, 14 bp, Homo sapiens
gatctatgggaaga

SEQ ID NO: 672599 - DNA, 11 bp, Homo sapiens
gatctccagcg

SEQ ID NO: 672600 - DNA, 21 bp, Homo sapiens
gatctctcttgtcctcttctg

SEQ ID NO: 672601 - DNA, 22 bp, Homo sapiens
gatcttgaatgtggtctcagga

SEQ ID NO: 672602 - DNA, 16 bp, Homo sapiens
gatcttttaaaatcat

SEQ ID NO: 672603 - DNA, 19 bp, Homo sapiens
gatgacaggcgcctgccat

SEQ ID NO: 672604 - DNA, 12 bp, Homo sapiens
gatgactgctga

SEQ ID NO: 672605 - DNA, 23 bp, Homo sapiens
gatgacttagcgtcaagacattt

SEQ ID NO: 672606 - DNA, 20 bp, Homo sapiens
gatgagtcccctgtgagatt

SEQ ID NO: 672607 - DNA, 12 bp, Homo sapiens
gatgatttaagt

SEQ ID NO: 672608 - DNA, 17 bp, Homo sapiens
gatgatttaagtataca

SEQ ID NO: 672609 - DNA, 23 bp, Homo sapiens
gatgattttcatttcatgaaaat

SEQ ID NO: 672610 - DNA, 23 bp, Homo sapiens
gatgcagcggcgtgaggcctggg

SEQ ID NO: 672611 - DNA, 17 bp, Homo sapiens
gatgctgtgtatatggt

SEQ ID NO: 672612 - DNA, 17 bp, Homo sapiens
gatggaaaaggaagact

SEQ ID NO: 672613 - DNA, 13 bp, Homo sapiens
gatggaaaggtga

SEQ ID NO: 672614 - DNA, 17 bp, Homo sapiens
gatgggaacaaggaagg

SEQ ID NO: 672615 - DNA, 14 bp, Homo sapiens
gatgtaaagatgtt

SEQ ID NO: 672616 - DNA, 19 bp, Homo sapiens
gatgtaattttgtgtaaga

SEQ ID NO: 672617 - DNA, 20 bp, Homo sapiens
gatgtccctgggccagggtc

SEQ ID NO: 672618 - DNA, 18 bp, Homo sapiens
gatgtgtcctcagggagc

SEQ ID NO: 672619 - DNA, 20 bp, Homo sapiens
gatgttctgcctctccctgg

SEQ ID NO: 672620 - DNA, 21 bp, Homo sapiens
gatgttttatccttacaatgt

SEQ ID NO: 672621 - DNA, 16 bp, Homo sapiens
gatgttttttctgtaa

SEQ ID NO: 672622 - DNA, 13 bp, Homo sapiens
gattaagaaacct

SEQ ID NO: 672623 - DNA, 22 bp, Homo sapiens
gattactgaaatataccttttg

SEQ ID NO: 672624 - DNA, 20 bp, Homo sapiens
gcaccatggtatcatatatt

SEQ ID NO: 672625 - DNA, 15 bp, Homo sapiens
gcacctgtagtccca

SEQ ID NO: 672626 - DNA, 22 bp, Homo sapiens
gcacctgtgcccatggcttctg

SEQ ID NO: 672627 - DNA, 13 bp, Homo sapiens
gcacgcctgcccc

SEQ ID NO: 672628 - DNA, 15 bp, Homo sapiens
gcacgtgacaggctc

SEQ ID NO: 672629 - DNA, 17 bp, Homo sapiens
gcactccagcctggggg

SEQ ID NO: 672630 - DNA, 18 bp, Homo sapiens
gcactcttgttcccacac

SEQ ID NO: 672631 - DNA, 21 bp, Homo sapiens
gcactgcgcgctatcccctca

SEQ ID NO: 672632 - DNA, 22 bp, Homo sapiens
gcacttatctcgaatttgaaga

SEQ ID NO: 672633 - DNA, 23 bp, Homo sapiens
gcacttatctcgaatttgaagag

SEQ ID NO: 672634 - DNA, 21 bp, Homo sapiens
gcacttccttttacctgccca

SEQ ID NO: 672635 - DNA, 17 bp, Homo sapiens
gcagaaaatatttaata

SEQ ID NO: 672636 - DNA, 13 bp, Homo sapiens
gcagaagggaatt

SEQ ID NO: 672637 - DNA, 22 bp, Homo sapiens
gcagaatgtaagtgggcccacc

SEQ ID NO: 672638 - DNA, 18 bp, Homo sapiens
gcagacagcaggcagcgc

SEQ ID NO: 672639 - DNA, 12 bp, Homo sapiens
gcagagcctcct

SEQ ID NO: 672640 - DNA, 16 bp, Homo sapiens
gcagagcctcctggga

SEQ ID NO: 672641 - DNA, 14 bp, Homo sapiens
gcagaggtaccctg

SEQ ID NO: 672642 - DNA, 15 bp, Homo sapiens
gcagaggtaccctgg

SEQ ID NO: 672643 - DNA, 14 bp, Homo sapiens
gcagaggtggaaaa

SEQ ID NO: 672644 - DNA, 20 bp, Homo sapiens
gcagagtggcgtggcctccc

SEQ ID NO: 672645 - DNA, 18 bp, Homo sapiens
gcagagtttccaaaacca

SEQ ID NO: 672646 - DNA, 14 bp, Homo sapiens
gcagatcacttgag

SEQ ID NO: 672647 - DNA, 20 bp, Homo sapiens
gcagatcacttgagctcagg

SEQ ID NO: 672648 - DNA, 18 bp, Homo sapiens
gcagatgttagatatttt

SEQ ID NO: 672649 - DNA, 20 bp, Homo sapiens
gcagatgttagatatttttc

SEQ ID NO: 672650 - DNA, 15 bp, Homo sapiens
gcagcacagctgaga

SEQ ID NO: 672651 - DNA, 19 bp, Homo sapiens
gcagcatcttcacttctaa

SEQ ID NO: 672652 - DNA, 17 bp, Homo sapiens
gcagcccaccctgctgc

SEQ ID NO: 672653 - DNA, 20 bp, Homo sapiens
gcagcccaccctgctgctgg

SEQ ID NO: 672654 - DNA, 15 bp, Homo sapiens
gcagcgcagggctgg

SEQ ID NO: 672655 - DNA, 19 bp, Homo sapiens
gcagcgcagggctggcacg

SEQ ID NO: 672656 - DNA, 13 bp, Homo sapiens
gcagctcatgttt

SEQ ID NO: 672657 - DNA, 12 bp, Homo sapiens
gcagctgcctct

SEQ ID NO: 672658 - DNA, 14 bp, Homo sapiens
gcagctgcctctgc

SEQ ID NO: 672659 - DNA, 18 bp, Homo sapiens
gcagctgcctctgctccc

SEQ ID NO: 672660 - DNA, 21 bp, Homo sapiens
gcagctgcctctgctccctct

SEQ ID NO: 672661 - DNA, 13 bp, Homo sapiens
gcagcttattgtt

SEQ ID NO: 672662 - DNA, 21 bp, Homo sapiens
gcagcttctactcctgcctca

SEQ ID NO: 672663 - DNA, 23 bp, Homo sapiens
gcagctttactgccttcctcctt

SEQ ID NO: 672664 - DNA, 12 bp, Homo sapiens
gcaggaccctgt

SEQ ID NO: 672665 - DNA, 18 bp, Homo sapiens
gcaggaccctgtcctgca

SEQ ID NO: 672666 - DNA, 19 bp, Homo sapiens
gcaggagtggtgcagacag

SEQ ID NO: 672667 - DNA, 22 bp, Homo sapiens
gcaggcagcttctactcctgcc

SEQ ID NO: 672668 - DNA, 16 bp, Homo sapiens
gcaggcatggccctgg

SEQ ID NO: 672669 - DNA, 16 bp, Homo sapiens
gcaggcattgaggaag

SEQ ID NO: 672670 - DNA, 18 bp, Homo sapiens
gcaggcattgaggaagag

SEQ ID NO: 672671 - DNA, 18 bp, Homo sapiens
gcaggcggctcctcctca

SEQ ID NO: 672672 - DNA, 14 bp, Homo sapiens
gcaggctgggccat

SEQ ID NO: 672673 - DNA, 23 bp, Homo sapiens
gcaggctgggccatgtccaaaga

SEQ ID NO: 672674 - DNA, 15 bp, Homo sapiens
gcagggaaggcctga

SEQ ID NO: 672675 - DNA, 16 bp, Homo sapiens
gcagggagctgggccc

SEQ ID NO: 672676 - DNA, 17 bp, Homo sapiens
gcagggcataggaagaa

SEQ ID NO: 672677 - DNA, 16 bp, Homo sapiens
gcagggccatggctca

SEQ ID NO: 672678 - DNA, 19 bp, Homo sapiens
gcagggtctgtttggactg

SEQ ID NO: 672679 - DNA, 17 bp, Homo sapiens
gcaggtgggctggactt

SEQ ID NO: 672680 - DNA, 15 bp, Homo sapiens
gcaggtgtcctgagc

SEQ ID NO: 672681 - DNA, 20 bp, Homo sapiens
gcaggtttgttttcagcact

SEQ ID NO: 672682 - DNA, 17 bp, Homo sapiens
gcagtagaactccaggc

SEQ ID NO: 672683 - DNA, 14 bp, Homo sapiens
gcagtcccacactg

SEQ ID NO: 672684 - DNA, 18 bp, Homo sapiens
gcagtcccacactgtgca

SEQ ID NO: 672685 - DNA, 17 bp, Homo sapiens
gcagtcgcctgcctgca

SEQ ID NO: 672686 - DNA, 20 bp, Homo sapiens
gcagtcgcctgcctgcagca

SEQ ID NO: 672687 - DNA, 17 bp, Homo sapiens
gcagtctgataaactga

SEQ ID NO: 672688 - DNA, 14 bp, Homo sapiens
gcagtcttgctctg

SEQ ID NO: 672689 - DNA, 10 bp, Homo sapiens
gcagtgagcc

SEQ ID NO: 672690 - DNA, 19 bp, Homo sapiens
gcagttatggtgatgactt

SEQ ID NO: 672691 - DNA, 15 bp, Homo sapiens
gcataaattgcatca

SEQ ID NO: 672692 - DNA, 22 bp, Homo sapiens
gcataactgtagctcaagttta

SEQ ID NO: 672693 - DNA, 15 bp, Homo sapiens
gcataatgataaaat

SEQ ID NO: 672694 - DNA, 17 bp, Homo sapiens
gcatataggtgatgttt

SEQ ID NO: 672695 - DNA, 16 bp, Homo sapiens
gcatatcctgagccat

SEQ ID NO: 672696 - DNA, 21 bp, Homo sapiens
gcatattcaatgtattgagaa

SEQ ID NO: 672697 - DNA, 23 bp, Homo sapiens
gcatatttatccaaaatgtgtat

SEQ ID NO: 672698 - DNA, 12 bp, Homo sapiens
gcatccctgaga

SEQ ID NO: 672699 - DNA, 13 bp, Homo sapiens
gcatccctgagac

SEQ ID NO: 672700 - DNA, 16 bp, Homo sapiens
gcatcctgtgccacta

SEQ ID NO: 672701 - DNA, 13 bp, Homo sapiens
gcatctgatagaa

SEQ ID NO: 672702 - DNA, 15 bp, Homo sapiens
gcatcttgcctccag

SEQ ID NO: 672703 - DNA, 17 bp, Homo sapiens
gcatcttgcctccaggt

SEQ ID NO: 672704 - DNA, 19 bp, Homo sapiens
gcatcttgcctccaggtgc

SEQ ID NO: 672705 - DNA, 23 bp, Homo sapiens
gcatcttgcctccaggtgcagag

SEQ ID NO: 672706 - DNA, 20 bp, Homo sapiens
gcatgaaatgtgaattttta

SEQ ID NO: 672707 - DNA, 19 bp, Homo sapiens
gcatgaattggaactgcaa

SEQ ID NO: 672708 - DNA, 21 bp, Homo sapiens
gcatgaccacccctctcgcct

SEQ ID NO: 672709 - DNA, 16 bp, Homo sapiens
gcatgcaaatgagctc

SEQ ID NO: 672710 - DNA, 21 bp, Homo sapiens
gcatgcaaatgagctctgaaa

SEQ ID NO: 672711 - DNA, 13 bp, Homo sapiens
gcatgcaatttga

SEQ ID NO: 672712 - DNA, 14 bp, Homo sapiens
gcatgcagctttgc

SEQ ID NO: 672713 - DNA, 13 bp, Homo sapiens
gcatggccctggg

SEQ ID NO: 672714 - DNA, 20 bp, Homo sapiens
gcatggggattgcagagtga

SEQ ID NO: 672715 - DNA, 15 bp, Homo sapiens
gcatggtggccagag

SEQ ID NO: 672716 - DNA, 15 bp, Homo sapiens
gcatgtctgttcttc

SEQ ID NO: 672717 - DNA, 12 bp, Homo sapiens
gcatgtgtattt

SEQ ID NO: 672718 - DNA, 21 bp, Homo sapiens
gcattgaaagaagagatgaga

SEQ ID NO: 672719 - DNA, 23 bp, Homo sapiens
gcattgacataggtcataaagca

SEQ ID NO: 672720 - DNA, 17 bp, Homo sapiens
gcattgagtattgttta

SEQ ID NO: 672721 - DNA, 14 bp, Homo sapiens
gcattgataatctt

SEQ ID NO: 672722 - DNA, 17 bp, Homo sapiens
gcattgataatcttcag

SEQ ID NO: 672723 - DNA, 21 bp, Homo sapiens
gcattgataatcttcaggtga

SEQ ID NO: 672724 - DNA, 18 bp, Homo sapiens
gcattgattgcacttgat

SEQ ID NO: 672725 - DNA, 20 bp, Homo sapiens
gcattgccgctgtataaagc

SEQ ID NO: 672726 - DNA, 20 bp, Homo sapiens
gcattgtaaaagcattttgt

SEQ ID NO: 672727 - DNA, 23 bp, Homo sapiens
gcatttcatagcttcacaatgtt

SEQ ID NO: 672728 - DNA, 16 bp, Homo sapiens
gcatttctctttaaac

SEQ ID NO: 672729 - DNA, 14 bp, Homo sapiens
gccaaccctgggct

SEQ ID NO: 672730 - DNA, 13 bp, Homo sapiens
gccaactcctcac

SEQ ID NO: 672731 - DNA, 17 bp, Homo sapiens
gccaactgccaggctgc

SEQ ID NO: 672732 - DNA, 22 bp, Homo sapiens
gccaactgccaggctgcctcct

SEQ ID NO: 672733 - DNA, 23 bp, Homo sapiens
gccaactgccaggctgcctcctg

SEQ ID NO: 672734 - DNA, 21 bp, Homo sapiens
gccaagtccgcagaagccctg

SEQ ID NO: 672735 - DNA, 19 bp, Homo sapiens
gccaagtgcgtgccgtgtg

SEQ ID NO: 672736 - DNA, 19 bp, Homo sapiens
gccacagtggggctgcagg

SEQ ID NO: 672737 - DNA, 23 bp, Homo sapiens
gccacagtggggctgcaggcagg

SEQ ID NO: 672738 - DNA, 15 bp, Homo sapiens
gccacatcaaacctt

SEQ ID NO: 672739 - DNA, 16 bp, Homo sapiens
gccacatcaaaccttt

SEQ ID NO: 672740 - DNA, 15 bp, Homo sapiens
ggtctgccttctgct

SEQ ID NO: 672741 - DNA, 18 bp, Homo sapiens
ggtctgggcgtccagctc

SEQ ID NO: 672742 - DNA, 21 bp, Homo sapiens
ggtctgggcgtccagctcagc

SEQ ID NO: 672743 - DNA, 23 bp, Homo sapiens
ggtctgggcgtccagctcagccc

SEQ ID NO: 672744 - DNA, 16 bp, Homo sapiens
ggtctgtgtcatttct

SEQ ID NO: 672745 - DNA, 16 bp, Homo sapiens
ggtctgtgtgaatgtg

SEQ ID NO: 672746 - DNA, 17 bp, Homo sapiens
ggtctgtgtgaatgtgg

SEQ ID NO: 672747 - DNA, 24 bp, Homo sapiens
ggtctgtgtgaatgtgggcactgg

SEQ ID NO: 672748 - DNA, 21 bp, Homo sapiens
ggtcttgagccagtaatcttt

SEQ ID NO: 672749 - DNA, 21 bp, Homo sapiens
ggtgaaaataagacaaaaata

SEQ ID NO: 672750 - DNA, 15 bp, Homo sapiens
ggtgaagtaaattag

SEQ ID NO: 672751 - DNA, 13 bp, Homo sapiens
ggtgaatattttc

SEQ ID NO: 672752 - DNA, 12 bp, Homo sapiens
ggtgacagtcat

SEQ ID NO: 672753 - DNA, 19 bp, Homo sapiens
ggtgacagtcatcatcagg

SEQ ID NO: 672754 - DNA, 14 bp, Homo sapiens
ggtgagaaaatata

SEQ ID NO: 672755 - DNA, 16 bp, Homo sapiens
ggtgagggttggcgct

SEQ ID NO: 672756 - DNA, 16 bp, Homo sapiens
ggtgataggtaaattt

SEQ ID NO: 672757 - DNA, 20 bp, Homo sapiens
ggtgatccgcctacctcagc

SEQ ID NO: 672758 - DNA, 18 bp, Homo sapiens
ggtgattctcagggctgg

SEQ ID NO: 672759 - DNA, 22 bp, Homo sapiens
ggtgcagaggtaccctgggtgt

SEQ ID NO: 672760 - DNA, 15 bp, Homo sapiens
ggtgcatctcctccc

SEQ ID NO: 672761 - DNA, 22 bp, Homo sapiens
ggtgcctgtaatcctagctact

SEQ ID NO: 672762 - DNA, 17 bp, Homo sapiens
ggtggccagaggtgtca

SEQ ID NO: 672763 - DNA, 12 bp, Homo sapiens
ggtggcctcagc

SEQ ID NO: 672764 - DNA, 20 bp, Homo sapiens
ggtgggacccccgtggggca

SEQ ID NO: 672765 - DNA, 15 bp, Homo sapiens
ggtgtatataatttt

SEQ ID NO: 672766 - DNA, 15 bp, Homo sapiens
ggtgtcacattcctg

SEQ ID NO: 672767 - DNA, 21 bp, Homo sapiens
ggtgtcacccaaaccggcagg

SEQ ID NO: 672768 - DNA, 24 bp, Homo sapiens
ggtgtcacccaaaccggcaggtgc

SEQ ID NO: 672769 - DNA, 17 bp, Homo sapiens
ggtgtcagtatccaggc

SEQ ID NO: 672770 - DNA, 15 bp, Homo sapiens
ggtgtgaacccggga

SEQ ID NO: 672771 - DNA, 17 bp, Homo sapiens
ggtgtgaacccgggagc

SEQ ID NO: 672772 - DNA, 21 bp, Homo sapiens
ggtgttgactggactgcttgg

SEQ ID NO: 672773 - DNA, 19 bp, Homo sapiens
ggtgttttttatgaagtgc

SEQ ID NO: 672774 - DNA, 22 bp, Homo sapiens
ggtgttttttatgaagtgcgtg

SEQ ID NO: 672775 - DNA, 11 bp, Homo sapiens
ggttaaataaa

SEQ ID NO: 672776 - DNA, 14 bp, Homo sapiens
ggttaataaataaa

SEQ ID NO: 672777 - DNA, 23 bp, Homo sapiens
ggttatatcattctgggtgtgtt

SEQ ID NO: 672778 - DNA, 16 bp, Homo sapiens
ggttatctttttaaaa

SEQ ID NO: 672779 - DNA, 20 bp, Homo sapiens
ggttccagcaattctcctgc

SEQ ID NO: 672780 - DNA, 15 bp, Homo sapiens
ggttgcgtctgaggc

SEQ ID NO: 672781 - DNA, 14 bp, Homo sapiens
ggttggggtgacag

SEQ ID NO: 672782 - DNA, 20 bp, Homo sapiens
ggttgttgcatatagttaaa

SEQ ID NO: 672783 - DNA, 17 bp, Homo sapiens
ggtttcaagaaaatctt

SEQ ID NO: 672784 - DNA, 12 bp, Homo sapiens
ggtttccaggga

SEQ ID NO: 672785 - DNA, 15 bp, Homo sapiens
ggtttctctctacag

SEQ ID NO: 672786 - DNA, 14 bp, Homo sapiens
ggtttgggcagagc

SEQ ID NO: 672787 - DNA, 13 bp, Homo sapiens
ggtttttgctctc

SEQ ID NO: 672788 - DNA, 19 bp, Homo sapiens
gtaaaaagtattttttcaa

SEQ ID NO: 672789 - DNA, 12 bp, Homo sapiens
gtaaaacttctg

SEQ ID NO: 672790 - DNA, 15 bp, Homo sapiens
gtaaaatgaattgaa

SEQ ID NO: 672791 - DNA, 20 bp, Homo sapiens
gtaaacagaagcctgtttca

SEQ ID NO: 672792 - DNA, 15 bp, Homo sapiens
gtaaacataaaaact

SEQ ID NO: 672793 - DNA, 17 bp, Homo sapiens
gtaaacgaaggcataat

SEQ ID NO: 672794 - DNA, 19 bp, Homo sapiens
gtaaataaactatttatat

SEQ ID NO: 672795 - DNA, 17 bp, Homo sapiens
gtaaatcctgccattta

SEQ ID NO: 672796 - DNA, 20 bp, Homo sapiens
gtaaatcctgccatttaaaa

SEQ ID NO: 672797 - DNA, 18 bp, Homo sapiens
gtaaatgaaacttaagaa

SEQ ID NO: 672798 - DNA, 19 bp, Homo sapiens
gtaaatgcatattaaataa

SEQ ID NO: 672799 - DNA, 13 bp, Homo sapiens
gtaaatgtttctt

SEQ ID NO: 672800 - DNA, 14 bp, Homo sapiens
gtaaatgtttcttt

SEQ ID NO: 672801 - DNA, 19 bp, Homo sapiens
gtaaatttttaggcaaaga

SEQ ID NO: 672802 - DNA, 22 bp, Homo sapiens
gtaacaggtgtgtatgtaaagt

SEQ ID NO: 672803 - DNA, 15 bp, Homo sapiens
gtaactaaaataatt

SEQ ID NO: 672804 - DNA, 14 bp, Homo sapiens
gtaacttagaaaag

SEQ ID NO: 672805 - DNA, 18 bp, Homo sapiens
gtaagaacacattttaaa

SEQ ID NO: 672806 - DNA, 15 bp, Homo sapiens
gtaagaagacatgaa

SEQ ID NO: 672807 - DNA, 13 bp, Homo sapiens
gtaagaattctga

SEQ ID NO: 672808 - DNA, 14 bp, Homo sapiens
gtaagtgggcccac

SEQ ID NO: 672809 - DNA, 17 bp, Homo sapiens
gtaatataatgtatttt

SEQ ID NO: 672810 - DNA, 22 bp, Homo sapiens
gtaatataatgtattttctttt

SEQ ID NO: 672811 - DNA, 20 bp, Homo sapiens
gtaatcccctaaaataacag

SEQ ID NO: 672812 - DNA, 14 bp, Homo sapiens
gtaatctacaccaa

SEQ ID NO: 672813 - DNA, 14 bp, Homo sapiens
gtaatggcagagca

SEQ ID NO: 672814 - DNA, 16 bp, Homo sapiens
gtaatggcagagcagt

SEQ ID NO: 672815 - DNA, 16 bp, Homo sapiens
gtaatgtaaataaact

SEQ ID NO: 672816 - DNA, 22 bp, Homo sapiens
gtaattcatctgtgaatctgct

SEQ ID NO: 672817 - DNA, 19 bp, Homo sapiens
gtaatttaaatgaaagaaa

SEQ ID NO: 672818 - DNA, 21 bp, Homo sapiens
gtaatttaaatgaaagaaaat

SEQ ID NO: 672819 - DNA, 23 bp, Homo sapiens
gtaatttaaatgaaagaaaattg

SEQ ID NO: 672820 - DNA, 18 bp, Homo sapiens
gtaatttaatttgtaaaa

SEQ ID NO: 672821 - DNA, 20 bp, Homo sapiens
gtaattttgtgtaagaaata

SEQ ID NO: 672822 - DNA, 15 bp, Homo sapiens
gtacaaacagtattt

SEQ ID NO: 672823 - DNA, 15 bp, Homo sapiens
gtacaacggaggcct

SEQ ID NO: 672824 - DNA, 17 bp, Homo sapiens
gtacataactcctgtcc

SEQ ID NO: 672825 - DNA, 22 bp, Homo sapiens
gtacatcaagtccatctgacaa

SEQ ID NO: 672826 - DNA, 22 bp, Homo sapiens
gtacatggaattttttgaatat

SEQ ID NO: 672827 - DNA, 21 bp, Homo sapiens
gtacatttctataaatagatg

SEQ ID NO: 672828 - DNA, 13 bp, Homo sapiens
gtaccaagtgaaa

SEQ ID NO: 672829 - DNA, 22 bp, Homo sapiens
gtaccatttaatggggaggaca

SEQ ID NO: 672830 - DNA, 22 bp, Homo sapiens
gtacctctcaagctagtgtttc

SEQ ID NO: 672831 - DNA, 16 bp, Homo sapiens
gtacctggtccccact

SEQ ID NO: 672832 - DNA, 11 bp, Homo sapiens
gtacctgtcca

SEQ ID NO: 672833 - DNA, 15 bp, Homo sapiens
gtaccttaagatatt

SEQ ID NO: 672834 - DNA, 11 bp, Homo sapiens
gtaccttgctt

SEQ ID NO: 672835 - DNA, 18 bp, Homo sapiens
gtactacagctatatttg

SEQ ID NO: 672836 - DNA, 19 bp, Homo sapiens
gtactacagctatatttga

SEQ ID NO: 672837 - DNA, 23 bp, Homo sapiens
gtactccagccagggcaagagag

SEQ ID NO: 672838 - DNA, 23 bp, Homo sapiens
gtactgaaagccttagggaagct

SEQ ID NO: 672839 - DNA, 14 bp, Homo sapiens
gtactgcaaagtgt

SEQ ID NO: 672840 - DNA, 23 bp, Homo sapiens
gtactgccccccatgaggaagga

SEQ ID NO: 672841 - DNA, 15 bp, Homo sapiens
gtactgtctgttatg

SEQ ID NO: 672842 - DNA, 18 bp, Homo sapiens
gtactgttactgggccct

SEQ ID NO: 672843 - DNA, 23 bp, Homo sapiens
gtacttaaatggtaataagcact

SEQ ID NO: 672844 - DNA, 23 bp, Homo sapiens
gtacttgaaaaatgtttttattt

SEQ ID NO: 672845 - DNA, 22 bp, Homo sapiens
gtactttcatattttaaacaga

SEQ ID NO: 672846 - DNA, 16 bp, Homo sapiens
gtacttttaaaaacat

SEQ ID NO: 672847 - DNA, 17 bp, Homo sapiens
gtacttttaaaaacata

SEQ ID NO: 672848 - DNA, 17 bp, Homo sapiens
gtagaactccaggccct

SEQ ID NO: 672849 - DNA, 20 bp, Homo sapiens
gtagaactttattaagtaaa

SEQ ID NO: 672850 - DNA, 21 bp, Homo sapiens
gtagactgtgccagaggccag

SEQ ID NO: 672851 - DNA, 15 bp, Homo sapiens
gtagatccatttcca

SEQ ID NO: 672852 - DNA, 22 bp, Homo sapiens
gtagatccatttccattgctta

SEQ ID NO: 672853 - DNA, 21 bp, Homo sapiens
gtagatgtgcatttttgtgaa

SEQ ID NO: 672854 - DNA, 15 bp, Homo sapiens
gtagcataactgtag

SEQ ID NO: 672855 - DNA, 14 bp, Homo sapiens
gtagccctcccact

SEQ ID NO: 672856 - DNA, 19 bp, Homo sapiens
gtagctacattttcagaag

SEQ ID NO: 672857 - DNA, 17 bp, Homo sapiens
gtagctcaagtttaaaa

SEQ ID NO: 672858 - DNA, 19 bp, Homo sapiens
gtagctcaagtttaaaagc

SEQ ID NO: 672859 - DNA, 23 bp, Homo sapiens
gtagctcctcaactcacctaatg

SEQ ID NO: 672860 - DNA, 17 bp, Homo sapiens
gtagctctgctgctgat

SEQ ID NO: 672861 - DNA, 21 bp, Homo sapiens
gtaggaatgtacatgaagcaa

SEQ ID NO: 672862 - DNA, 20 bp, Homo sapiens
gtagggatatggcaggactc

SEQ ID NO: 672863 - DNA, 14 bp, Homo sapiens
gtagttaaataact

SEQ ID NO: 672864 - DNA, 16 bp, Homo sapiens
gtataaccaagtgtgc

SEQ ID NO: 672865 - DNA, 19 bp, Homo sapiens
gtataaccaagtgtgctct

SEQ ID NO: 672866 - DNA, 13 bp, Homo sapiens
gtataataaaatt

SEQ ID NO: 672867 - DNA, 14 bp, Homo sapiens
gtataataaaatta

SEQ ID NO: 672868 - DNA, 12 bp, Homo sapiens
gtataatataaa

SEQ ID NO: 672869 - DNA, 13 bp, Homo sapiens
gtataatataaaa

SEQ ID NO: 672870 - DNA, 14 bp, Homo sapiens
gtataatataaaaa

SEQ ID NO: 672871 - DNA, 18 bp, Homo sapiens
gtataatgtgcagaaaat

SEQ ID NO: 672872 - DNA, 18 bp, Homo sapiens
gtatagaaaattcttgag

SEQ ID NO: 672873 - DNA, 16 bp, Homo sapiens
gtatatactttgccac

SEQ ID NO: 672874 - DNA, 22 bp, Homo sapiens
gtatatattttgtgtgaaattg

SEQ ID NO: 672875 - DNA, 19 bp, Homo sapiens
gtatcaaatacatttaaaa

SEQ ID NO: 672876 - DNA, 18 bp, Homo sapiens
gtatcatatattaaaaca

SEQ ID NO: 672877 - DNA, 18 bp, Homo sapiens
gtatcctccctggcagac

SEQ ID NO: 672878 - DNA, 20 bp, Homo sapiens
gtatcctccctggcagacac

SEQ ID NO: 672879 - DNA, 21 bp, Homo sapiens
gtatcctccctggcagacaca

SEQ ID NO: 672880 - DNA, 18 bp, Homo sapiens
gtatcctggccctggggg

SEQ ID NO: 672881 - DNA, 18 bp, Homo sapiens
gtatctgggattattctt

SEQ ID NO: 672882 - DNA, 17 bp, Homo sapiens
gtatcttattataaaat

SEQ ID NO: 672883 - DNA, 14 bp, Homo sapiens
gtatgactaaagag

SEQ ID NO: 672884 - DNA, 24 bp, Homo sapiens
gtatgataggttattttgatgtaa

SEQ ID NO: 672885 - DNA, 18 bp, Homo sapiens
gtatgcagtattcttgca

SEQ ID NO: 672886 - DNA, 13 bp, Homo sapiens
gtatggtgtgttc

SEQ ID NO: 672887 - DNA, 14 bp, Homo sapiens
gtatggtgtgttca

SEQ ID NO: 672888 - DNA, 15 bp, Homo sapiens
gtatgtgggatattg

SEQ ID NO: 672889 - DNA, 20 bp, Homo sapiens
gtatgtgggatattgaatgt

SEQ ID NO: 672890 - DNA, 20 bp, Homo sapiens
gtatgtttgctgattattta

SEQ ID NO: 672891 - DNA, 15 bp, Homo sapiens
gtatgtttgtacttg

SEQ ID NO: 672892 - DNA, 20 bp, Homo sapiens
gtattaaaactaaatttcac

SEQ ID NO: 672893 - DNA, 22 bp, Homo sapiens
gtattatacatgtgatacattt

SEQ ID NO: 672894 - DNA, 15 bp, Homo sapiens
gtattattattattg

SEQ ID NO: 672895 - DNA, 16 bp, Homo sapiens
gtattgagatttctta

SEQ ID NO: 672896 - DNA, 12 bp, Homo sapiens
gtatttctcata

SEQ ID NO: 672897 - DNA, 16 bp, Homo sapiens
gtatttgttatatata

SEQ ID NO: 672898 - DNA, 14 bp, Homo sapiens
gtattttcatacaa

SEQ ID NO: 672899 - DNA, 15 bp, Homo sapiens
gtattttcatgaaaa

SEQ ID NO: 672900 - DNA, 16 bp, Homo sapiens
gtattttcttctctgt

SEQ ID NO: 672901 - DNA, 19 bp, Homo sapiens
gtattttcttctctgtgag

SEQ ID NO: 672902 - DNA, 19 bp, Homo sapiens
gtatttttatttttgcaca

SEQ ID NO: 672903 - DNA, 22 bp, Homo sapiens
gtatttttatttttgcacaact

SEQ ID NO: 672904 - DNA, 20 bp, Homo sapiens
gtatttttcatctttaagaa

SEQ ID NO: 672905 - DNA, 19 bp, Homo sapiens
gtcaaaaaattatttgcta

SEQ ID NO: 672906 - DNA, 22 bp, Homo sapiens
gtcaaatttactttaaaaagaa

SEQ ID NO: 672907 - DNA, 13 bp, Homo sapiens
gtcaagacatttg

SEQ ID NO: 672908 - DNA, 15 bp, Homo sapiens
gtcaagtaagaagac

SEQ ID NO: 672909 - DNA, 19 bp, Homo sapiens
gtcacaacccttctctgtt

SEQ ID NO: 672910 - DNA, 21 bp, Homo sapiens
gtcacccaaaccggcaggtgc

SEQ ID NO: 672911 - DNA, 20 bp, Homo sapiens
gtcacccctttctgtcccac

SEQ ID NO: 672912 - DNA, 22 bp, Homo sapiens
gtcacctctgtgacccctcctt

SEQ ID NO: 672913 - DNA, 21 bp, Homo sapiens
gtcacttgatcatgctgcagt

SEQ ID NO: 672914 - DNA, 23 bp, Homo sapiens
gtcacttgctgctttttctgcgc

SEQ ID NO: 672915 - DNA, 20 bp, Homo sapiens
gtcagaagtcaataggccta

SEQ ID NO: 672916 - DNA, 20 bp, Homo sapiens
gtcagaggagcgcaggcagc

SEQ ID NO: 672917 - DNA, 21 bp, Homo sapiens
gtcagaggctaattctgcaga

SEQ ID NO: 672918 - DNA, 18 bp, Homo sapiens
gtcagatttttatttatg

SEQ ID NO: 672919 - DNA, 15 bp, Homo sapiens
gtcagccaggagctg

SEQ ID NO: 672920 - DNA, 13 bp, Homo sapiens
gtcagctccagct

SEQ ID NO: 672921 - DNA, 19 bp, Homo sapiens
gtcagggagtgctggctca

SEQ ID NO: 672922 - DNA, 18 bp, Homo sapiens
gtcagggtccaggagagc

SEQ ID NO: 672923 - DNA, 17 bp, Homo sapiens
gtcagggtctccttcct

SEQ ID NO: 672924 - DNA, 19 bp, Homo sapiens
gtcagtagtgctaatgcat

SEQ ID NO: 672925 - DNA, 20 bp, Homo sapiens
gtcatcatcagggcctgggg

SEQ ID NO: 672926 - DNA, 21 bp, Homo sapiens
gtcatcatcagggcctggggc

SEQ ID NO: 672927 - DNA, 18 bp, Homo sapiens
gtcatctcattccactgt

SEQ ID NO: 672928 - DNA, 14 bp, Homo sapiens
gtcatctgatgaga

SEQ ID NO: 672929 - DNA, 15 bp, Homo sapiens
gtcatgtttgcaggg

SEQ ID NO: 672930 - DNA, 16 bp, Homo sapiens
gtcatgtttgcagggg

SEQ ID NO: 672931 - DNA, 23 bp, Homo sapiens
gtcatgtttgcaggggtgacggc

SEQ ID NO: 672932 - DNA, 21 bp, Homo sapiens
gtcattatgggttaggcatta

SEQ ID NO: 672933 - DNA, 13 bp, Homo sapiens
gtcattgtctact

SEQ ID NO: 672934 - DNA, 11 bp, Homo sapiens
gtcatttttgt

SEQ ID NO: 672935 - DNA, 12 bp, Homo sapiens
gtcatttttgta

SEQ ID NO: 672936 - DNA, 16 bp, Homo sapiens
gtcatttttgtatttt

SEQ ID NO: 672937 - DNA, 17 bp, Homo sapiens
gtccaaacgtcctcttt

SEQ ID NO: 672938 - DNA, 23 bp, Homo sapiens
gtccacctgtgggtgtagccagg

SEQ ID NO: 672939 - DNA, 13 bp, Homo sapiens
gtccagcagtctg

SEQ ID NO: 672940 - DNA, 14 bp, Homo sapiens
gtccagctcagccc

SEQ ID NO: 672941 - DNA, 22 bp, Homo sapiens
gtccagctcagccctggcctgg

SEQ ID NO: 672942 - DNA, 19 bp, Homo sapiens
gtccagctgcccttccgca

SEQ ID NO: 672943 - DNA, 22 bp, Homo sapiens
gtccatctagggaatgggactg

SEQ ID NO: 672944 - DNA, 22 bp, Homo sapiens
gtcccacactgtgcagacccag

SEQ ID NO: 672945 - DNA, 22 bp, Homo sapiens
gtcccacactgtggccaggcct

SEQ ID NO: 672946 - DNA, 24 bp, Homo sapiens
gtcccactacttgtggggctaagg

SEQ ID NO: 672947 - DNA, 18 bp, Homo sapiens
gtcccagagcacctcacc

SEQ ID NO: 672948 - DNA, 16 bp, Homo sapiens
gtcccaggcagggaga

SEQ ID NO: 672949 - DNA, 20 bp, Homo sapiens
gtccccactgctgagctggc

SEQ ID NO: 672950 - DNA, 22 bp, Homo sapiens
gtccccagctgagtgagtggga

SEQ ID NO: 672951 - DNA, 18 bp, Homo sapiens
gtccctagcagcccaccc

SEQ ID NO: 672952 - DNA, 23 bp, Homo sapiens
gtccctctccttgcccccagtgc

SEQ ID NO: 672953 - DNA, 20 bp, Homo sapiens
gtccctcttctggtttccct

SEQ ID NO: 672954 - DNA, 17 bp, Homo sapiens
gtccctggcgcaggtgg

SEQ ID NO: 672955 - DNA, 14 bp, Homo sapiens
gtccctgggccagg

SEQ ID NO: 672956 - DNA, 17 bp, Homo sapiens
gtccctgggccagggtc

SEQ ID NO: 672957 - DNA, 22 bp, Homo sapiens
gtcccttgcctctgccctggat

SEQ ID NO: 672958 - DNA, 16 bp, Homo sapiens
gtcccttgctgtatgc

SEQ ID NO: 672959 - DNA, 19 bp, Homo sapiens
gtccgttcacatgtgtggt

SEQ ID NO: 672960 - DNA, 22 bp, Homo sapiens
gtcctaaccactaacattgtga

SEQ ID NO: 672961 - DNA, 12 bp, Homo sapiens
gtcctaatttga

SEQ ID NO: 672962 - DNA, 18 bp, Homo sapiens
gtcctacagtgactccct

SEQ ID NO: 672963 - DNA, 20 bp, Homo sapiens
gtcctacagtgactccctgg

SEQ ID NO: 672964 - DNA, 13 bp, Homo sapiens
gtcctcagccagt

SEQ ID NO: 672965 - DNA, 22 bp, Homo sapiens
gtcctcagggagcagggaaggc

SEQ ID NO: 672966 - DNA, 15 bp, Homo sapiens
gtcctcttctgctct

SEQ ID NO: 672967 - DNA, 23 bp, Homo sapiens
gtcctcttctgctcttttcctgg

SEQ ID NO: 672968 - DNA, 18 bp, Homo sapiens
gtcctgcagtcccacact

SEQ ID NO: 672969 - DNA, 20 bp, Homo sapiens
gtcctgcagtcccacactgt

SEQ ID NO: 672970 - DNA, 13 bp, Homo sapiens
gtcctgcagtcct

SEQ ID NO: 672971 - DNA, 16 bp, Homo sapiens
gtcctggctggccgca

SEQ ID NO: 672972 - DNA, 22 bp, Homo sapiens
gtcctggtgagaaaatatatgc

SEQ ID NO: 672973 - DNA, 18 bp, Homo sapiens
gtcctgtgttaaacacta

SEQ ID NO: 672974 - DNA, 18 bp, Homo sapiens
gtccttactcccccacca

SEQ ID NO: 672975 - DNA, 15 bp, Homo sapiens
gtccttgggtccatt

SEQ ID NO: 672976 - DNA, 12 bp, Homo sapiens
gtcctttggaca

SEQ ID NO: 672977 - DNA, 18 bp, Homo sapiens
gtcgcctgcctgcagcag

SEQ ID NO: 672978 - DNA, 14 bp, Homo sapiens
gtcgtggttcttaa

SEQ ID NO: 672979 - DNA, 23 bp, Homo sapiens
gtctaagactatatatataaatg

SEQ ID NO: 672980 - DNA, 22 bp, Homo sapiens
gtctaattgcatctcaaaatta

SEQ ID NO: 672981 - DNA, 17 bp, Homo sapiens
gtctactcctagaagaa

SEQ ID NO: 672982 - DNA, 14 bp, Homo sapiens
gtctagtttcctgg

SEQ ID NO: 672983 - DNA, 11 bp, Homo sapiens
gtctattttaa

SEQ ID NO: 672984 - DNA, 16 bp, Homo sapiens
gtctattttaaaataa

SEQ ID NO: 672985 - DNA, 23 bp, Homo sapiens
gtctcacccatgcaagcagagga

SEQ ID NO: 672986 - DNA, 20 bp, Homo sapiens
gtctcattccgttgtctgtg

SEQ ID NO: 672987 - DNA, 19 bp, Homo sapiens
gtctcattgtcacctctgt

SEQ ID NO: 672988 - DNA, 20 bp, Homo sapiens
gtctccacttgtatatatgg

SEQ ID NO: 672989 - DNA, 21 bp, Homo sapiens
gtctcccgtgcatgctctgca

SEQ ID NO: 672990 - DNA, 12 bp, Homo sapiens
gtctccctggct

SEQ ID NO: 672991 - DNA, 17 bp, Homo sapiens
gtctcctaaaactggga

SEQ ID NO: 672992 - DNA, 23 bp, Homo sapiens
gtctcctcaatttttgtctcaga

SEQ ID NO: 672993 - DNA, 21 bp, Homo sapiens
gtctctaccaaaaaaaggaag

SEQ ID NO: 672994 - DNA, 22 bp, Homo sapiens
gtctctaccaaaaaaaggaagg

SEQ ID NO: 672995 - DNA, 16 bp, Homo sapiens
gtctctcacagatgtg

SEQ ID NO: 672996 - DNA, 22 bp, Homo sapiens
gtctcttcttggggcccagtgc

SEQ ID NO: 672997 - DNA, 14 bp, Homo sapiens
gtctgaaactggct

SEQ ID NO: 672998 - DNA, 12 bp, Homo sapiens
gtctgaatattt

SEQ ID NO: 672999 - DNA, 16 bp, Homo sapiens
gtctgcacagggtcct

SEQ ID NO: 673000 - DNA, 18 bp, Homo sapiens
gtctgctgagttggcctg

SEQ ID NO: 673001 - DNA, 14 bp, Homo sapiens
gtctggactgctat

SEQ ID NO: 673002 - DNA, 22 bp, Homo sapiens
gtctgggcagctgtcccttgct

SEQ ID NO: 673003 - DNA, 20 bp, Homo sapiens
gtctgggcgtccagctcagc

SEQ ID NO: 673004 - DNA, 16 bp, Homo sapiens
gtctgggtccatcctg

SEQ ID NO: 673005 - DNA, 16 bp, Homo sapiens
gtctgtaggtgaaaga

SEQ ID NO: 673006 - DNA, 20 bp, Homo sapiens
gtctgtatttggtatatact

SEQ ID NO: 673007 - DNA, 19 bp, Homo sapiens
gtctgttgattaaagatga

SEQ ID NO: 673008 - DNA, 13 bp, Homo sapiens
gtctgtttggact

SEQ ID NO: 673009 - DNA, 20 bp, Homo sapiens
gtcttaagatggaaatacag

SEQ ID NO: 673010 - DNA, 17 bp, Homo sapiens
gtcttaggctgatgcca

SEQ ID NO: 673011 - DNA, 18 bp, Homo sapiens
gtcttataagtaaagaca

SEQ ID NO: 673012 - DNA, 18 bp, Homo sapiens
gtcttatgtgaaaaatta

SEQ ID NO: 673013 - DNA, 19 bp, Homo sapiens
gtcttatgtgaaaaattaa

SEQ ID NO: 673014 - DNA, 11 bp, Homo sapiens
gtcttccacaa

SEQ ID NO: 673015 - DNA, 14 bp, Homo sapiens
gtcttctactgcct

SEQ ID NO: 673016 - DNA, 15 bp, Homo sapiens
gtcttctactgcctt

SEQ ID NO: 673017 - DNA, 21 bp, Homo sapiens
gtcttctactgccttgaaaaa

SEQ ID NO: 673018 - DNA, 14 bp, Homo sapiens
gtcttgagccagta

SEQ ID NO: 673019 - DNA, 18 bp, Homo sapiens
gtcttggtttctctctac

SEQ ID NO: 673020 - DNA, 21 bp, Homo sapiens
gtcttgtggttgtgtgtgttc

SEQ ID NO: 673021 - DNA, 16 bp, Homo sapiens
gtcttgttagaaaaca

SEQ ID NO: 673022 - DNA, 16 bp, Homo sapiens
gtctttctcaaagaaa

SEQ ID NO: 673023 - DNA, 14 bp, Homo sapiens
gtctttcttgaaat

SEQ ID NO: 673024 - DNA, 15 bp, Homo sapiens
gtctttcttgaaatt

SEQ ID NO: 673025 - DNA, 14 bp, Homo sapiens
gtcttttttttcct

SEQ ID NO: 673026 - DNA, 17 bp, Homo sapiens
gtgaaaataagacaaaa

SEQ ID NO: 673027 - DNA, 18 bp, Homo sapiens
gtgaaacagttgctgtga

SEQ ID NO: 673028 - DNA, 19 bp, Homo sapiens
gtgaaactaacagataagc

SEQ ID NO: 673029 - DNA, 17 bp, Homo sapiens
gtgaacacttagtgatc

SEQ ID NO: 673030 - DNA, 19 bp, Homo sapiens
gtgaacttggctttcctgt

SEQ ID NO: 673031 - DNA, 15 bp, Homo sapiens
gtgaataataaaagt

SEQ ID NO: 673032 - DNA, 17 bp, Homo sapiens
gtgaataggttatatgc

SEQ ID NO: 673033 - DNA, 21 bp, Homo sapiens
gtgacaggctcgtcagccacc

SEQ ID NO: 673034 - DNA, 14 bp, Homo sapiens
gtgacagggccagt

SEQ ID NO: 673035 - DNA, 20 bp, Homo sapiens
gtgacagggccagtggggcc

SEQ ID NO: 673036 - DNA, 21 bp, Homo sapiens
gtgacagggccagtggggcct

SEQ ID NO: 673037 - DNA, 23 bp, Homo sapiens
gtgacagggccagtggggcctgt

SEQ ID NO: 673038 - DNA, 23 bp, Homo sapiens
gtgacagtcatcatcagggcctg

SEQ ID NO: 673039 - DNA, 16 bp, Homo sapiens
gtgacatttctcttcc

SEQ ID NO: 673040 - DNA, 23 bp, Homo sapiens
gtgacctgaggatttaagggatg

SEQ ID NO: 673041 - DNA, 17 bp, Homo sapiens
gtgagaaggtttattgt

SEQ ID NO: 673042 - DNA, 18 bp, Homo sapiens
gtgagaatccctggcaaa

SEQ ID NO: 673043 - DNA, 12 bp, Homo sapiens
gtgagacagact

SEQ ID NO: 673044 - DNA, 18 bp, Homo sapiens
gtgagcagtcgcctgcct

SEQ ID NO: 673045 - DNA, 23 bp, Homo sapiens
gtgagcatacctgtctcagctgt

SEQ ID NO: 673046 - DNA, 13 bp, Homo sapiens
gtgaggggtccct

SEQ ID NO: 673047 - DNA, 18 bp, Homo sapiens
gtgagtgacgatgatgta

SEQ ID NO: 673048 - DNA, 12 bp, Homo sapiens
gtgagtgccttt

SEQ ID NO: 673049 - DNA, 13 bp, Homo sapiens
gtgagtgtgacag

SEQ ID NO: 673050 - DNA, 14 bp, Homo sapiens
gtgagtgtgacagg

SEQ ID NO: 673051 - DNA, 18 bp, Homo sapiens
gtgattctcagggctgga

SEQ ID NO: 673052 - DNA, 21 bp, Homo sapiens
gtgattttatgatcagtgttg

SEQ ID NO: 673053 - DNA, 23 bp, Homo sapiens
gtgcacaacccaccacccccttt

SEQ ID NO: 673054 - DNA, 19 bp, Homo sapiens
gtgcactttctaatgtttc

SEQ ID NO: 673055 - DNA, 15 bp, Homo sapiens
gtgcagaaaatattt

SEQ ID NO: 673056 - DNA, 13 bp, Homo sapiens
gtgcagaatgtaa

SEQ ID NO: 673057 - DNA, 17 bp, Homo sapiens
gtgcagacccagtccca

SEQ ID NO: 673058 - DNA, 15 bp, Homo sapiens
gtgcagaggtaccct

SEQ ID NO: 673059 - DNA, 15 bp, Homo sapiens
gtgcagatggagaga

SEQ ID NO: 673060 - DNA, 14 bp, Homo sapiens
gtgcataatgataa

SEQ ID NO: 673061 - DNA, 22 bp, Homo sapiens
gtgcatttttgtgaaatgaaaa

SEQ ID NO: 673062 - DNA, 12 bp, Homo sapiens
gtgccctgtgtg

SEQ ID NO: 673063 - DNA, 14 bp, Homo sapiens
gtgccctgtgtgtg

SEQ ID NO: 673064 - DNA, 18 bp, Homo sapiens
gtgccgtgtgagtgtgac

SEQ ID NO: 673065 - DNA, 21 bp, Homo sapiens
gtgccgtgtgagtgtgacagg

SEQ ID NO: 673066 - DNA, 23 bp, Homo sapiens
gtgccgtgtgagtgtgacagggc

SEQ ID NO: 673067 - DNA, 12 bp, Homo sapiens
gtgcctgagagt

SEQ ID NO: 673068 - DNA, 18 bp, Homo sapiens
gtgcctttctttgcctct

SEQ ID NO: 673069 - DNA, 13 bp, Homo sapiens
gtgcctttggcct

SEQ ID NO: 673070 - DNA, 23 bp, Homo sapiens
gtgccttttgcagaagagggtgt

SEQ ID NO: 673071 - DNA, 18 bp, Homo sapiens
gtgcgcatcttgcctcca

SEQ ID NO: 673072 - DNA, 16 bp, Homo sapiens
gtgcgtgccgtgtgag

SEQ ID NO: 673073 - DNA, 22 bp, Homo sapiens
gtgcgtgccgtgtgagtgtgac

SEQ ID NO: 673074 - DNA, 14 bp, Homo sapiens
gtgctatgaagcca

SEQ ID NO: 673075 - DNA, 21 bp, Homo sapiens
gtgctatgaagccaactgaca

SEQ ID NO: 673076 - DNA, 19 bp, Homo sapiens
gtgctcagaataaggcagg

SEQ ID NO: 673077 - DNA, 22 bp, Homo sapiens
gtgctcagaataaggcaggcat

SEQ ID NO: 673078 - DNA, 22 bp, Homo sapiens
gtgctccatatttgatttctaa

SEQ ID NO: 673079 - DNA, 15 bp, Homo sapiens
gtgctcccgagagat

SEQ ID NO: 673080 - DNA, 14 bp, Homo sapiens
gtgctcctgaaaga

SEQ ID NO: 673081 - DNA, 14 bp, Homo sapiens
gtgctgcagcaccg

SEQ ID NO: 673082 - DNA, 20 bp, Homo sapiens
gtgctggctcacagtacagc

SEQ ID NO: 673083 - DNA, 21 bp, Homo sapiens
gtgctgggggaatgagcccag

SEQ ID NO: 673084 - DNA, 23 bp, Homo sapiens
gttggcaaacgagactttctcct

SEQ ID NO: 673085 - DNA, 14 bp, Homo sapiens
gttggggtgacagt

SEQ ID NO: 673086 - DNA, 15 bp, Homo sapiens
gttggggtgacagtc

SEQ ID NO: 673087 - DNA, 21 bp, Homo sapiens
gttgggtgtctccttaagctg

SEQ ID NO: 673088 - DNA, 18 bp, Homo sapiens
gttggtatattttatatt

SEQ ID NO: 673089 - DNA, 13 bp, Homo sapiens
gttggtctgcctt

SEQ ID NO: 673090 - DNA, 12 bp, Homo sapiens
gttggtgttcct

SEQ ID NO: 673091 - DNA, 17 bp, Homo sapiens
gttgtaatatttcttca

SEQ ID NO: 673092 - DNA, 12 bp, Homo sapiens
gttgtattcatt

SEQ ID NO: 673093 - DNA, 23 bp, Homo sapiens
gttgtattgatttttaagaaagt

SEQ ID NO: 673094 - DNA, 18 bp, Homo sapiens
gttgtcaagaatagcatt

SEQ ID NO: 673095 - DNA, 17 bp, Homo sapiens
gttgtcacaccctgact

SEQ ID NO: 673096 - DNA, 14 bp, Homo sapiens
gttgtgtgtgttct

SEQ ID NO: 673097 - DNA, 20 bp, Homo sapiens
gtttaaaaagatgaaaaaga

SEQ ID NO: 673098 - DNA, 22 bp, Homo sapiens
gtttaaaaagatgaaaaagaat

SEQ ID NO: 673099 - DNA, 13 bp, Homo sapiens
gtttaaaatgtaa

SEQ ID NO: 673100 - DNA, 13 bp, Homo sapiens
gtttaataaagct

SEQ ID NO: 673101 - DNA, 14 bp, Homo sapiens
gtttaataaagctt

SEQ ID NO: 673102 - DNA, 20 bp, Homo sapiens
gtttatactgtatttctaag

SEQ ID NO: 673103 - DNA, 15 bp, Homo sapiens
gtttatgatatttct

SEQ ID NO: 673104 - DNA, 16 bp, Homo sapiens
gtttatggcagaaggg

SEQ ID NO: 673105 - DNA, 18 bp, Homo sapiens
gtttatggccacatttaa

SEQ ID NO: 673106 - DNA, 20 bp, Homo sapiens
gtttattataaagcttaaat

SEQ ID NO: 673107 - DNA, 14 bp, Homo sapiens
gtttatttgcaatt

SEQ ID NO: 673108 - DNA, 18 bp, Homo sapiens
gtttatttgcaatttgag

SEQ ID NO: 673109 - DNA, 15 bp, Homo sapiens
gtttcaagaaaatct

SEQ ID NO: 673110 - DNA, 17 bp, Homo sapiens
gtttcaagaaaatcttt

SEQ ID NO: 673111 - DNA, 15 bp, Homo sapiens
gtttcagtttgttgg

SEQ ID NO: 673112 - DNA, 18 bp, Homo sapiens
gtttcagtttgttggaaa

SEQ ID NO: 673113 - DNA, 21 bp, Homo sapiens
gtttcagtttgttggaaagta

SEQ ID NO: 673114 - DNA, 14 bp, Homo sapiens
gtttcctcttccaa

SEQ ID NO: 673115 - DNA, 15 bp, Homo sapiens
gtttctccttttcct

SEQ ID NO: 673116 - DNA, 23 bp, Homo sapiens
gtttctctgccgctacctccctc

SEQ ID NO: 673117 - DNA, 14 bp, Homo sapiens
gtttcttacacact

SEQ ID NO: 673118 - DNA, 23 bp, Homo sapiens
gtttcttcttcatgcttttgctt

SEQ ID NO: 673119 - DNA, 19 bp, Homo sapiens
gtttctttctctgaggaca

SEQ ID NO: 673120 - DNA, 23 bp, Homo sapiens
gtttctttcttttttttttcatt

SEQ ID NO: 673121 - DNA, 21 bp, Homo sapiens
gtttgaggcaaattaactgta

SEQ ID NO: 673122 - DNA, 22 bp, Homo sapiens
gtttgaggcaaattaactgtat

SEQ ID NO: 673123 - DNA, 16 bp, Homo sapiens
gtttggtagttagcca

SEQ ID NO: 673124 - DNA, 13 bp, Homo sapiens
gtttgtctatttt

SEQ ID NO: 673125 - DNA, 13 bp, Homo sapiens
gtttgttggaaag

SEQ ID NO: 673126 - DNA, 21 bp, Homo sapiens
gttttaaaactggacctgtat

SEQ ID NO: 673127 - DNA, 20 bp, Homo sapiens
gttttaaccagtacttctaa

SEQ ID NO: 673128 - DNA, 20 bp, Homo sapiens
gttttactcctttttattca

SEQ ID NO: 673129 - DNA, 13 bp, Homo sapiens
gttttactgtcta

SEQ ID NO: 673130 - DNA, 20 bp, Homo sapiens
gttttagcggggagggggat

SEQ ID NO: 673131 - DNA, 18 bp, Homo sapiens
gttttatagcctggactg

SEQ ID NO: 673132 - DNA, 14 bp, Homo sapiens
gttttatgctactg

SEQ ID NO: 673133 - DNA, 18 bp, Homo sapiens
gttttccatgatttagca

SEQ ID NO: 673134 - DNA, 14 bp, Homo sapiens
gttttctaaattta

SEQ ID NO: 673135 - DNA, 10 bp, Homo sapiens
gttttggaca

SEQ ID NO: 673136 - DNA, 23 bp, Homo sapiens
gttttgtggtagtccttttggga

SEQ ID NO: 673137 - DNA, 12 bp, Homo sapiens
gttttgttgcta

SEQ ID NO: 673138 - DNA, 14 bp, Homo sapiens
gtttttatttttgt

SEQ ID NO: 673139 - DNA, 12 bp, Homo sapiens
gtttttctacta

SEQ ID NO: 673140 - DNA, 24 bp, Homo sapiens
gtttttggatggtgttacatatta

SEQ ID NO: 673141 - DNA, 15 bp, Homo sapiens
gtttttgtttggaga

SEQ ID NO: 673142 - DNA, 13 bp, Homo sapiens
gttttttgtagaa

SEQ ID NO: 673143 - DNA, 13 bp, Homo sapiens
taaaaaaaagaaa

SEQ ID NO: 673144 - DNA, 15 bp, Homo sapiens
taaaaaataatacaa

SEQ ID NO: 673145 - DNA, 23 bp, Homo sapiens
taaaaaatcagaacaaaacttct

SEQ ID NO: 673146 - DNA, 12 bp, Homo sapiens
taaaaaatgtct

SEQ ID NO: 673147 - DNA, 14 bp, Homo sapiens
taaaaacacaaaaa

SEQ ID NO: 673148 - DNA, 20 bp, Homo sapiens
taaaaacacaaaaaaaattt

SEQ ID NO: 673149 - DNA, 15 bp, Homo sapiens
taaaaacattttgaa

SEQ ID NO: 673150 - DNA, 18 bp, Homo sapiens
taaaaacattttgaagtg

SEQ ID NO: 673151 - DNA, 15 bp, Homo sapiens
taaaaactcttcagt

SEQ ID NO: 673152 - DNA, 14 bp, Homo sapiens
taaaaacttttgag

SEQ ID NO: 673153 - DNA, 16 bp, Homo sapiens
taaaaacttttgagga

SEQ ID NO: 673154 - DNA, 16 bp, Homo sapiens
taaaaagaaatctggt

SEQ ID NO: 673155 - DNA, 18 bp, Homo sapiens
taaaaagagtaatttcat

SEQ ID NO: 673156 - DNA, 22 bp, Homo sapiens
taaaaagagtaatttcatttaa

SEQ ID NO: 673157 - DNA, 18 bp, Homo sapiens
taaaaagatgaaaaagaa

SEQ ID NO: 673158 - DNA, 12 bp, Homo sapiens
taaaaagctcac

SEQ ID NO: 673159 - DNA, 18 bp, Homo sapiens
taaaaagtattttttcaa

SEQ ID NO: 673160 - DNA, 18 bp, Homo sapiens
taaaaataaagggaagaa

SEQ ID NO: 673161 - DNA, 14 bp, Homo sapiens
taaaaataggcttt

SEQ ID NO: 673162 - DNA, 16 bp, Homo sapiens
taaaaatatgtaattt

SEQ ID NO: 673163 - DNA, 22 bp, Homo sapiens
taaaaatctaagcagcttattg

SEQ ID NO: 673164 - DNA, 18 bp, Homo sapiens
taaaaatcttttgaagca

SEQ ID NO: 673165 - DNA, 20 bp, Homo sapiens
taaaaattacctttaatttt

SEQ ID NO: 673166 - DNA, 22 bp, Homo sapiens
taaaacaaatatacattttcta

SEQ ID NO: 673167 - DNA, 13 bp, Homo sapiens
taaaactctcctt

SEQ ID NO: 673168 - DNA, 18 bp, Homo sapiens
taaaactggacctgtata

SEQ ID NO: 673169 - DNA, 15 bp, Homo sapiens
taaaacttaaaaaca

SEQ ID NO: 673170 - DNA, 14 bp, Homo sapiens
taaaacttctgctc

SEQ ID NO: 673171 - DNA, 15 bp, Homo sapiens
taaaacttctgctcg

SEQ ID NO: 673172 - DNA, 18 bp, Homo sapiens
taaaagaaatatattttt

SEQ ID NO: 673173 - DNA, 22 bp, Homo sapiens
taaaagcagaaaataaaggaag

SEQ ID NO: 673174 - DNA, 18 bp, Homo sapiens
taaaagcatgaattggaa

SEQ ID NO: 673175 - DNA, 15 bp, Homo sapiens
taaaagcattttgta

SEQ ID NO: 673176 - DNA, 16 bp, Homo sapiens
taaaagcattttgtaa

SEQ ID NO: 673177 - DNA, 20 bp, Homo sapiens
taaaagggctctttagccag

SEQ ID NO: 673178 - DNA, 15 bp, Homo sapiens
taaaaggtaatgtgt

SEQ ID NO: 673179 - DNA, 21 bp, Homo sapiens
taaaataattttgtaatgtat

SEQ ID NO: 673180 - DNA, 19 bp, Homo sapiens
taaaatacatagtgaaaat

SEQ ID NO: 673181 - DNA, 19 bp, Homo sapiens
taaaatagaataattcttt

SEQ ID NO: 673182 - DNA, 18 bp, Homo sapiens
taaaatatcataaagcat

SEQ ID NO: 673183 - DNA, 15 bp, Homo sapiens
taaaatcctgtgcaa

SEQ ID NO: 673184 - DNA, 18 bp, Homo sapiens
taagaattctgattgatt

SEQ ID NO: 673185 - DNA, 22 bp, Homo sapiens
taagaattgaattggaaagact

SEQ ID NO: 673186 - DNA, 20 bp, Homo sapiens
taagacaagagatctacaca

SEQ ID NO: 673187 - DNA, 20 bp, Homo sapiens
taagacatttgtttgctgta

SEQ ID NO: 673188 - DNA, 23 bp, Homo sapiens
taagactatatatataaatgtat

SEQ ID NO: 673189 - DNA, 14 bp, Homo sapiens
taagatacaaatta

SEQ ID NO: 673190 - DNA, 12 bp, Homo sapiens
taagattccaga

SEQ ID NO: 673191 - DNA, 23 bp, Homo sapiens
taagatttgtgtttttctttttc

SEQ ID NO: 673192 - DNA, 14 bp, Homo sapiens
taagcaaatgttaa

SEQ ID NO: 673193 - DNA, 17 bp, Homo sapiens
taagcaacatggctttg

SEQ ID NO: 673194 - DNA, 13 bp, Homo sapiens
taagcaagagaga

SEQ ID NO: 673195 - DNA, 20 bp, Homo sapiens
taagcattttgaaacaaagt

SEQ ID NO: 673196 - DNA, 21 bp, Homo sapiens
taagcattttgaaacaaagta

SEQ ID NO: 673197 - DNA, 17 bp, Homo sapiens
taagcttcagttgcttg

SEQ ID NO: 673198 - DNA, 23 bp, Homo sapiens
taagcttccattttaattttaaa

SEQ ID NO: 673199 - DNA, 15 bp, Homo sapiens
taaggaaccttcctt

SEQ ID NO: 673200 - DNA, 13 bp, Homo sapiens
taaggatgacttt

SEQ ID NO: 673201 - DNA, 21 bp, Homo sapiens
taaggatggaaaggtgacagt

SEQ ID NO: 673202 - DNA, 18 bp, Homo sapiens
taaggcaggtgggcagac

SEQ ID NO: 673203 - DNA, 15 bp, Homo sapiens
taagtagtaaatcag

SEQ ID NO: 673204 - DNA, 20 bp, Homo sapiens
taagtagtaaatcagaaagt

SEQ ID NO: 673205 - DNA, 20 bp, Homo sapiens
taagtattttcctgttgtca

SEQ ID NO: 673206 - DNA, 20 bp, Homo sapiens
taagtcatctgatgagaaca

SEQ ID NO: 673207 - DNA, 15 bp, Homo sapiens
taagtgtaaaaaatg

SEQ ID NO: 673208 - DNA, 18 bp, Homo sapiens
taagtgtaaaaaatgtct

SEQ ID NO: 673209 - DNA, 18 bp, Homo sapiens
taagtgtgccaaatcagt

SEQ ID NO: 673210 - DNA, 13 bp, Homo sapiens
taagttcacatta

SEQ ID NO: 673211 - DNA, 16 bp, Homo sapiens
taagttcacattagaa

SEQ ID NO: 673212 - DNA, 20 bp, Homo sapiens
taagtttcaaacttactatt

SEQ ID NO: 673213 - DNA, 20 bp, Homo sapiens
taataaaatcttctgatgag

SEQ ID NO: 673214 - DNA, 15 bp, Homo sapiens
tagctacactgagca

SEQ ID NO: 673215 - DNA, 18 bp, Homo sapiens
tagctcaagtttaaaagc

SEQ ID NO: 673216 - DNA, 21 bp, Homo sapiens
tagctccataaagtacaaatg

SEQ ID NO: 673217 - DNA, 16 bp, Homo sapiens
tagctcctccccttcc

SEQ ID NO: 673218 - DNA, 11 bp, Homo sapiens
tagctctgctg

SEQ ID NO: 673219 - DNA, 13 bp, Homo sapiens
tagctctgctgct

SEQ ID NO: 673220 - DNA, 15 bp, Homo sapiens
tagctgaagaattga

SEQ ID NO: 673221 - DNA, 21 bp, Homo sapiens
tagctgaagaattgaaaagtt

SEQ ID NO: 673222 - DNA, 23 bp, Homo sapiens
tagctttaatgatatgcttgtaa

SEQ ID NO: 673223 - DNA, 17 bp, Homo sapiens
tagctttccaaggaagc

SEQ ID NO: 673224 - DNA, 15 bp, Homo sapiens
taggaacttcagaga

SEQ ID NO: 673225 - DNA, 14 bp, Homo sapiens
taggaagaatcagt

SEQ ID NO: 673226 - DNA, 20 bp, Homo sapiens
taggaatcattcagaaatgt

SEQ ID NO: 673227 - DNA, 22 bp, Homo sapiens
taggaatcattcagaaatgttg

SEQ ID NO: 673228 - DNA, 17 bp, Homo sapiens
taggaatgtacatgaag

SEQ ID NO: 673229 - DNA, 15 bp, Homo sapiens
taggatttttttcct

SEQ ID NO: 673230 - DNA, 20 bp, Homo sapiens
taggcagattgaaaaggaca

SEQ ID NO: 673231 - DNA, 12 bp, Homo sapiens
taggcagcaagc

SEQ ID NO: 673232 - DNA, 17 bp, Homo sapiens
taggcctgtcccttgcc

SEQ ID NO: 673233 - DNA, 19 bp, Homo sapiens
taggcctgtcccttgcctc

SEQ ID NO: 673234 - DNA, 19 bp, Homo sapiens
tagggactacccatagaca

SEQ ID NO: 673235 - DNA, 17 bp, Homo sapiens
taggtatgatctcttct

SEQ ID NO: 673236 - DNA, 15 bp, Homo sapiens
taggtcataaagcat

SEQ ID NO: 673237 - DNA, 12 bp, Homo sapiens
taggtctccagt

SEQ ID NO: 673238 - DNA, 12 bp, Homo sapiens
taggtttctctc

SEQ ID NO: 673239 - DNA, 22 bp, Homo sapiens
tagtaagaataccacatcaaat

SEQ ID NO: 673240 - DNA, 21 bp, Homo sapiens
tagtaagattgatatctataa

SEQ ID NO: 673241 - DNA, 18 bp, Homo sapiens
tagtaatggcagagcagt

SEQ ID NO: 673242 - DNA, 15 bp, Homo sapiens
tagtatacattgtct

SEQ ID NO: 673243 - DNA, 23 bp, Homo sapiens
tagtattatcaaagggataaaga

SEQ ID NO: 673244 - DNA, 19 bp, Homo sapiens
tagtcaatttctacttctg

SEQ ID NO: 673245 - DNA, 23 bp, Homo sapiens
tagtcccagctacttgggaggct

SEQ ID NO: 673246 - DNA, 18 bp, Homo sapiens
tagtccttttgggaagaa

SEQ ID NO: 673247 - DNA, 15 bp, Homo sapiens
tagtctgaaactggc

SEQ ID NO: 673248 - DNA, 16 bp, Homo sapiens
tagtgatcatttaaaa

SEQ ID NO: 673249 - DNA, 17 bp, Homo sapiens
tagtgatcatttaaaaa

SEQ ID NO: 673250 - DNA, 18 bp, Homo sapiens
tagtgatcatttaaaaag

SEQ ID NO: 673251 - DNA, 19 bp, Homo sapiens
tagtgatgatggttcacgt

SEQ ID NO: 673252 - DNA, 20 bp, Homo sapiens
tagtgccagaattttaggaa

SEQ ID NO: 673253 - DNA, 14 bp, Homo sapiens
tagtgggccagggc

SEQ ID NO: 673254 - DNA, 21 bp, Homo sapiens
tagtgtacatttctataaata

SEQ ID NO: 673255 - DNA, 22 bp, Homo sapiens
tagtgtacctcctctcagtgtt

SEQ ID NO: 673256 - DNA, 20 bp, Homo sapiens
tagttagccatctaatgctt

SEQ ID NO: 673257 - DNA, 17 bp, Homo sapiens
tataaaacttaaaaaca

SEQ ID NO: 673258 - DNA, 17 bp, Homo sapiens
tataaacagaaatggaa

SEQ ID NO: 673259 - DNA, 20 bp, Homo sapiens
tataaacagacaatatgtga

SEQ ID NO: 673260 - DNA, 12 bp, Homo sapiens
tataaactcatt

SEQ ID NO: 673261 - DNA, 19 bp, Homo sapiens
tataaagtacccatctagt

SEQ ID NO: 673262 - DNA, 23 bp, Homo sapiens
tataaagtacccatctagtactt

SEQ ID NO: 673263 - DNA, 14 bp, Homo sapiens
tataaatgtataaa

SEQ ID NO: 673264 - DNA, 16 bp, Homo sapiens
tataaatgtataaata

SEQ ID NO: 673265 - DNA, 17 bp, Homo sapiens
tataacaactatttact

SEQ ID NO: 673266 - DNA, 14 bp, Homo sapiens
tataacacattttt

SEQ ID NO: 673267 - DNA, 22 bp, Homo sapiens
tataacacatttttttgcatgc

SEQ ID NO: 673268 - DNA, 15 bp, Homo sapiens
tataaccatatgata

SEQ ID NO: 673269 - DNA, 15 bp, Homo sapiens
tataactcatttgtt

SEQ ID NO: 673270 - DNA, 17 bp, Homo sapiens
tataagcattgccattg

SEQ ID NO: 673271 - DNA, 15 bp, Homo sapiens
tataagtagtaaatc

SEQ ID NO: 673272 - DNA, 14 bp, Homo sapiens
tataatgaagaaca

SEQ ID NO: 673273 - DNA, 13 bp, Homo sapiens
tataattgtacaa

SEQ ID NO: 673274 - DNA, 16 bp, Homo sapiens
tataattgtacaaaat

SEQ ID NO: 673275 - DNA, 15 bp, Homo sapiens
tatacaagtaatttc

SEQ ID NO: 673276 - DNA, 15 bp, Homo sapiens
tatacattttctaaa

SEQ ID NO: 673277 - DNA, 14 bp, Homo sapiens
tataccagcagaaa

SEQ ID NO: 673278 - DNA, 19 bp, Homo sapiens
tataccaggatttattttg

SEQ ID NO: 673279 - DNA, 12 bp, Homo sapiens
tataccttattt

SEQ ID NO: 673280 - DNA, 13 bp, Homo sapiens
tatactgcagctt

SEQ ID NO: 673281 - DNA, 19 bp, Homo sapiens
tatactgggtttcaagaaa

SEQ ID NO: 673282 - DNA, 16 bp, Homo sapiens
tatactttgccactgc

SEQ ID NO: 673283 - DNA, 18 bp, Homo sapiens
tatagacaaaagaataag

SEQ ID NO: 673284 - DNA, 20 bp, Homo sapiens
tatagacaaaagaataagac

SEQ ID NO: 673285 - DNA, 17 bp, Homo sapiens
tatagcaactaatgttt

SEQ ID NO: 673286 - DNA, 17 bp, Homo sapiens
tatagcattgataatct

SEQ ID NO: 673287 - DNA, 14 bp, Homo sapiens
tatagccatgattt

SEQ ID NO: 673288 - DNA, 14 bp, Homo sapiens
tatagcctggactg

SEQ ID NO: 673289 - DNA, 23 bp, Homo sapiens
tataggcctgtcccttgcctctg

SEQ ID NO: 673290 - DNA, 23 bp, Homo sapiens
tataggtcctgtgttaaacacta

SEQ ID NO: 673291 - DNA, 17 bp, Homo sapiens
tataggtgatgtttgct

SEQ ID NO: 673292 - DNA, 15 bp, Homo sapiens
tcactgggagaggtt

SEQ ID NO: 673293 - DNA, 18 bp, Homo sapiens
tcacttcaagctgttatt

SEQ ID NO: 673294 - DNA, 20 bp, Homo sapiens
tcacttcctttgcccttcct

SEQ ID NO: 673295 - DNA, 21 bp, Homo sapiens
tcacttcctttgcccttcctc

SEQ ID NO: 673296 - DNA, 13 bp, Homo sapiens
tcacttctaaatg

SEQ ID NO: 673297 - DNA, 13 bp, Homo sapiens
tcagaaagtaaca

SEQ ID NO: 673298 - DNA, 19 bp, Homo sapiens
tcagaaagtaacaatctat

SEQ ID NO: 673299 - DNA, 15 bp, Homo sapiens
tcagaataaggcagg

SEQ ID NO: 673300 - DNA, 20 bp, Homo sapiens
tcagaataaggcaggcattg

SEQ ID NO: 673301 - DNA, 18 bp, Homo sapiens
tcagaatgtaaaagaact

SEQ ID NO: 673302 - DNA, 15 bp, Homo sapiens
tcagacaagacagag

SEQ ID NO: 673303 - DNA, 19 bp, Homo sapiens
tcagaccccctcagccttg

SEQ ID NO: 673304 - DNA, 22 bp, Homo sapiens
tcagaccccctcagccttggga

SEQ ID NO: 673305 - DNA, 21 bp, Homo sapiens
tcagagatcgtgtattgagat

SEQ ID NO: 673306 - DNA, 19 bp, Homo sapiens
tcagaggagcgcaggcagc

SEQ ID NO: 673307 - DNA, 23 bp, Homo sapiens
tcagagttgactttcctcccatt

SEQ ID NO: 673308 - DNA, 21 bp, Homo sapiens
tcagcacattcgggaccaata

SEQ ID NO: 673309 - DNA, 22 bp, Homo sapiens
tcagcaccagttatgtttgaat

SEQ ID NO: 673310 - DNA, 19 bp, Homo sapiens
tcagcactgatggaaaata

SEQ ID NO: 673311 - DNA, 21 bp, Homo sapiens
tcagcaggctagacagaaaca

SEQ ID NO: 673312 - DNA, 12 bp, Homo sapiens
tcagccacctgg

SEQ ID NO: 673313 - DNA, 22 bp, Homo sapiens
tcagccagcccatggcccccaa

SEQ ID NO: 673314 - DNA, 15 bp, Homo sapiens
tcagccctggcctgg

SEQ ID NO: 673315 - DNA, 17 bp, Homo sapiens
tcagccctggcctggct

SEQ ID NO: 673316 - DNA, 16 bp, Homo sapiens
tcagctcaatgcagtt

SEQ ID NO: 673317 - DNA, 13 bp, Homo sapiens
tcagctctttttg

SEQ ID NO: 673318 - DNA, 23 bp, Homo sapiens
tcagctgaatgcctcctgtgggg

SEQ ID NO: 673319 - DNA, 22 bp, Homo sapiens
tcagctgcaatccatttatttc

SEQ ID NO: 673320 - DNA, 13 bp, Homo sapiens
tcagcttatctct

SEQ ID NO: 673321 - DNA, 13 bp, Homo sapiens
tcaggaaagagag

SEQ ID NO: 673322 - DNA, 22 bp, Homo sapiens
tcaggatatccttatcagagct

SEQ ID NO: 673323 - DNA, 23 bp, Homo sapiens
tcaggatatccttatcagagcta

SEQ ID NO: 673324 - DNA, 18 bp, Homo sapiens
tcagggcctggggcctga

SEQ ID NO: 673325 - DNA, 23 bp, Homo sapiens
tcagggcctggggcctgagagaa

SEQ ID NO: 673326 - DNA, 14 bp, Homo sapiens
tcagggctcccagg

SEQ ID NO: 673327 - DNA, 18 bp, Homo sapiens
tcagggctggagcctggg

SEQ ID NO: 673328 - DNA, 17 bp, Homo sapiens
tcagggtaaataggaat

SEQ ID NO: 673329 - DNA, 23 bp, Homo sapiens
tcagtaacccccttaaatttaat

SEQ ID NO: 673330 - DNA, 17 bp, Homo sapiens
tcagtaatcacttttca

SEQ ID NO: 673331 - DNA, 13 bp, Homo sapiens
tcagtagtgctaa

SEQ ID NO: 673332 - DNA, 18 bp, Homo sapiens
tcagtagtgctaatgcat

SEQ ID NO: 673333 - DNA, 11 bp, Homo sapiens
tcagtcctaat

SEQ ID NO: 673334 - DNA, 17 bp, Homo sapiens
tcagtgcaaattgtatc

SEQ ID NO: 673335 - DNA, 19 bp, Homo sapiens
tcagtggaaaccctgagag

SEQ ID NO: 673336 - DNA, 15 bp, Homo sapiens
tcagtgttttggact

SEQ ID NO: 673337 - DNA, 16 bp, Homo sapiens
tcagtgttttggactc

SEQ ID NO: 673338 - DNA, 20 bp, Homo sapiens
tcagtgttttggactccatc

SEQ ID NO: 673339 - DNA, 12 bp, Homo sapiens
tcagttctcaat

SEQ ID NO: 673340 - DNA, 15 bp, Homo sapiens
tcagttgcttgtctt

SEQ ID NO: 673341 - DNA, 14 bp, Homo sapiens
tcagtttgttggaa

SEQ ID NO: 673342 - DNA, 15 bp, Homo sapiens
tcagtttgttggaaa

SEQ ID NO: 673343 - DNA, 20 bp, Homo sapiens
tcataaaaacaagtcatttt

SEQ ID NO: 673344 - DNA, 21 bp, Homo sapiens
tcataaaatagaataattctt

SEQ ID NO: 673345 - DNA, 19 bp, Homo sapiens
tcataacatccagagcttt

SEQ ID NO: 673346 - DNA, 17 bp, Homo sapiens
tcataacttcctgtact

SEQ ID NO: 673347 - DNA, 21 bp, Homo sapiens
tcatactactgaaacagattt

SEQ ID NO: 673348 - DNA, 14 bp, Homo sapiens
tcatagagatttgt

SEQ ID NO: 673349 - DNA, 15 bp, Homo sapiens
tcatataaactcatt

SEQ ID NO: 673350 - DNA, 15 bp, Homo sapiens
tcatatacaaacatg

SEQ ID NO: 673351 - DNA, 15 bp, Homo sapiens
tcatatattaaaaca

SEQ ID NO: 673352 - DNA, 18 bp, Homo sapiens
tcatatattaaaacaata

SEQ ID NO: 673353 - DNA, 13 bp, Homo sapiens
tcatcagggcctg

SEQ ID NO: 673354 - DNA, 16 bp, Homo sapiens
tcatcagggcctgggg

SEQ ID NO: 673355 - DNA, 23 bp, Homo sapiens
tcatcagggcctggggcctgaga

SEQ ID NO: 673356 - DNA, 14 bp, Homo sapiens
tcatcatcagggcc

SEQ ID NO: 673357 - DNA, 21 bp, Homo sapiens
tcatcctccagtaccttgctt

SEQ ID NO: 673358 - DNA, 15 bp, Homo sapiens
tcatcgaatgctaaa

SEQ ID NO: 673359 - DNA, 18 bp, Homo sapiens
tcatctaccttttctggc

SEQ ID NO: 673360 - DNA, 17 bp, Homo sapiens
tcatctatgaggaaagg

SEQ ID NO: 673361 - DNA, 21 bp, Homo sapiens
tcatcttcactgcaattttgt

SEQ ID NO: 673362 - DNA, 12 bp, Homo sapiens
tcatgaaaatac

SEQ ID NO: 673363 - DNA, 16 bp, Homo sapiens
tcatgaaaataccatt

SEQ ID NO: 673364 - DNA, 20 bp, Homo sapiens
tcatgcacccctgagccagc

SEQ ID NO: 673365 - DNA, 13 bp, Homo sapiens
tcatgcagccgtg

SEQ ID NO: 673366 - DNA, 14 bp, Homo sapiens
tcatgcagccgtga

SEQ ID NO: 673367 - DNA, 23 bp, Homo sapiens
tcatgcagccgtgatcaagggaa

SEQ ID NO: 673368 - DNA, 21 bp, Homo sapiens
tcatgcttgccatctgttcat

SEQ ID NO: 673369 - DNA, 16 bp, Homo sapiens
tcatggctgctgttgc

SEQ ID NO: 673370 - DNA, 17 bp, Homo sapiens
tcatgggatagcacgtg

SEQ ID NO: 673371 - DNA, 17 bp, Homo sapiens
tcatggtcctgaatgta

SEQ ID NO: 673372 - DNA, 21 bp, Homo sapiens
tcatgtagccagcagaactga

SEQ ID NO: 673373 - DNA, 21 bp, Homo sapiens
tcatgtccaaacgtcctcttt

SEQ ID NO: 673374 - DNA, 16 bp, Homo sapiens
tcattaaaaattacct

SEQ ID NO: 673375 - DNA, 16 bp, Homo sapiens
tcattaaactttttta

SEQ ID NO: 673376 - DNA, 14 bp, Homo sapiens
tcattactgggcct

SEQ ID NO: 673377 - DNA, 23 bp, Homo sapiens
tcattactgtgaggagtctgggt

SEQ ID NO: 673378 - DNA, 23 bp, Homo sapiens
tcattatgcacttttagaaatgc

SEQ ID NO: 673379 - DNA, 16 bp, Homo sapiens
tcattattcaagaatg

SEQ ID NO: 673380 - DNA, 17 bp, Homo sapiens
tcattccctctcatctc

SEQ ID NO: 673381 - DNA, 16 bp, Homo sapiens
tcattccgttgtctgt

SEQ ID NO: 673382 - DNA, 18 bp, Homo sapiens
tcattcctaacacagcat

SEQ ID NO: 673383 - DNA, 18 bp, Homo sapiens
tcattctgggtgtgttct

SEQ ID NO: 673384 - DNA, 11 bp, Homo sapiens
tcattgacttt

SEQ ID NO: 673385 - DNA, 21 bp, Homo sapiens
tcattgacttttataaagcat

SEQ ID NO: 673386 - DNA, 23 bp, Homo sapiens
tcattgtctactcctagaagaac

SEQ ID NO: 673387 - DNA, 14 bp, Homo sapiens
tcattgtgtctccc

SEQ ID NO: 673388 - DNA, 23 bp, Homo sapiens
tcattgtgtctcccgtgcatgct

SEQ ID NO: 673389 - DNA, 20 bp, Homo sapiens
tcatttaaaaagctcactgc

SEQ ID NO: 673390 - DNA, 14 bp, Homo sapiens
tcatttaaatatct

SEQ ID NO: 673391 - DNA, 23 bp, Homo sapiens
tcatttaagtttcaaacttacta

SEQ ID NO: 673392 - DNA, 20 bp, Homo sapiens
tcatttacctcgcagtgtgt

SEQ ID NO: 673393 - DNA, 15 bp, Homo sapiens
tcatttcatgaaaat

SEQ ID NO: 673394 - DNA, 19 bp, Homo sapiens
tcatttcgtatttctcata

SEQ ID NO: 673395 - DNA, 16 bp, Homo sapiens
tcatttctaaatttat

SEQ ID NO: 673396 - DNA, 13 bp, Homo sapiens
tcattttaaatga

SEQ ID NO: 673397 - DNA, 16 bp, Homo sapiens
tcatttttaagaaagg

SEQ ID NO: 673398 - DNA, 22 bp, Homo sapiens
tcatttttaagaaaggaagcaa

SEQ ID NO: 673399 - DNA, 13 bp, Homo sapiens
tccaaagaggctg

SEQ ID NO: 673400 - DNA, 18 bp, Homo sapiens
tccaaagaggctgcccct

SEQ ID NO: 673401 - DNA, 16 bp, Homo sapiens
tccaaatgcaatttga

SEQ ID NO: 673402 - DNA, 19 bp, Homo sapiens
tccaaattaaaacaaatat

SEQ ID NO: 673403 - DNA, 17 bp, Homo sapiens
tccaaatttaaaatgtg

SEQ ID NO: 673404 - DNA, 17 bp, Homo sapiens
tccaacccattagccat

SEQ ID NO: 673405 - DNA, 17 bp, Homo sapiens
tccaactttcaggggct

SEQ ID NO: 673406 - DNA, 14 bp, Homo sapiens
tccaagaggctgta

SEQ ID NO: 673407 - DNA, 17 bp, Homo sapiens
tccaagctcactcccca

SEQ ID NO: 673408 - DNA, 22 bp, Homo sapiens
tccaagctcactccccaacccc

SEQ ID NO: 673409 - DNA, 13 bp, Homo sapiens
tccaaggaagcag

SEQ ID NO: 673410 - DNA, 15 bp, Homo sapiens
tccaaggaagcagaa

SEQ ID NO: 673411 - DNA, 21 bp, Homo sapiens
tccaataaaaacattttgaag

SEQ ID NO: 673412 - DNA, 22 bp, Homo sapiens
tccaataaaaacattttgaagt

SEQ ID NO: 673413 - DNA, 17 bp, Homo sapiens
tccacaaggaataaatg

SEQ ID NO: 673414 - DNA, 21 bp, Homo sapiens
tccttataggcctgtcccttg

SEQ ID NO: 673415 - DNA, 15 bp, Homo sapiens
tccttatcagagcta

SEQ ID NO: 673416 - DNA, 17 bp, Homo sapiens
tccttatccctctcttc

SEQ ID NO: 673417 - DNA, 21 bp, Homo sapiens
tccttatccctctcttcccct

SEQ ID NO: 673418 - DNA, 22 bp, Homo sapiens
tccttatccctctcttcccctt

SEQ ID NO: 673419 - DNA, 23 bp, Homo sapiens
tccttatcctacagtacaatcag

SEQ ID NO: 673420 - DNA, 21 bp, Homo sapiens
tccttatgtatcagtgtcctt

SEQ ID NO: 673421 - DNA, 15 bp, Homo sapiens
tccttatgtcctgtc

SEQ ID NO: 673422 - DNA, 11 bp, Homo sapiens
tccttatttat

SEQ ID NO: 673423 - DNA, 16 bp, Homo sapiens
tccttatttgccttct

SEQ ID NO: 673424 - DNA, 19 bp, Homo sapiens
tccttatttgccttctact

SEQ ID NO: 673425 - DNA, 16 bp, Homo sapiens
tccttcccagaatgtt

SEQ ID NO: 673426 - DNA, 21 bp, Homo sapiens
tccttccccgagtgactctgg

SEQ ID NO: 673427 - DNA, 13 bp, Homo sapiens
tccttctttcctt

SEQ ID NO: 673428 - DNA, 13 bp, Homo sapiens
tccttgaggacag

SEQ ID NO: 673429 - DNA, 16 bp, Homo sapiens
tccttgagtgtatgag

SEQ ID NO: 673430 - DNA, 21 bp, Homo sapiens
tccttgtcagggtctccttcc

SEQ ID NO: 673431 - DNA, 23 bp, Homo sapiens
tccttgtcccgtctggacctggg

SEQ ID NO: 673432 - DNA, 14 bp, Homo sapiens
tccttttccttacc

SEQ ID NO: 673433 - DNA, 23 bp, Homo sapiens
tccttttccttatttgccttcta

SEQ ID NO: 673434 - DNA, 15 bp, Homo sapiens
tcgaacgtggtctga

SEQ ID NO: 673435 - DNA, 17 bp, Homo sapiens
tcgaatttgaagagatt

SEQ ID NO: 673436 - DNA, 18 bp, Homo sapiens
tcgagaccatcctggcta

SEQ ID NO: 673437 - DNA, 14 bp, Homo sapiens
tcgagtgagacaga

SEQ ID NO: 673438 - DNA, 20 bp, Homo sapiens
tcgcattgaactctacaaca

SEQ ID NO: 673439 - DNA, 18 bp, Homo sapiens
tcgcctcctcctcctgcc

SEQ ID NO: 673440 - DNA, 23 bp, Homo sapiens
tcgctagcatttcccaacacaaa

SEQ ID NO: 673441 - DNA, 18 bp, Homo sapiens
tcgcttttaataaactgc

SEQ ID NO: 673442 - DNA, 11 bp, Homo sapiens
tcggcacacac

SEQ ID NO: 673443 - DNA, 12 bp, Homo sapiens
tcggcacacact

SEQ ID NO: 673444 - DNA, 22 bp, Homo sapiens
tcgtgctactgcactccagcct

SEQ ID NO: 673445 - DNA, 17 bp, Homo sapiens
tcgtggttcttaaatgt

SEQ ID NO: 673446 - DNA, 16 bp, Homo sapiens
tcgttaaaaagttgtt

SEQ ID NO: 673447 - DNA, 11 bp, Homo sapiens
tcgtttttgta

SEQ ID NO: 673448 - DNA, 17 bp, Homo sapiens
tctaaaaggtaatgtgt

SEQ ID NO: 673449 - DNA, 14 bp, Homo sapiens
tctaaacagttatt

SEQ ID NO: 673450 - DNA, 18 bp, Homo sapiens
tctaaataaaaatatgta

SEQ ID NO: 673451 - DNA, 22 bp, Homo sapiens
tctaacagtgaagttttactgt

SEQ ID NO: 673452 - DNA, 15 bp, Homo sapiens
tctaagaagacattt

SEQ ID NO: 673453 - DNA, 16 bp, Homo sapiens
tctaagactatatata

SEQ ID NO: 673454 - DNA, 17 bp, Homo sapiens
tctaatccttttcctta

SEQ ID NO: 673455 - DNA, 17 bp, Homo sapiens
tctaattgcatctcaaa

SEQ ID NO: 673456 - DNA, 22 bp, Homo sapiens
tctaattgtaagtgaaattaag

SEQ ID NO: 673457 - DNA, 17 bp, Homo sapiens
tctacacatgttgcctt

SEQ ID NO: 673458 - DNA, 18 bp, Homo sapiens
tctacaccaatgaaaaca

SEQ ID NO: 673459 - DNA, 15 bp, Homo sapiens
tctacccttttcctt

SEQ ID NO: 673460 - DNA, 18 bp, Homo sapiens
tctacctgccctcaaggg

SEQ ID NO: 673461 - DNA, 14 bp, Homo sapiens
tctaccttttctgg

SEQ ID NO: 673462 - DNA, 18 bp, Homo sapiens
tctactgccttgaaaaat

SEQ ID NO: 673463 - DNA, 18 bp, Homo sapiens
tctactttttttttaatt

SEQ ID NO: 673464 - DNA, 21 bp, Homo sapiens
tctagagcttaatgctacatg

SEQ ID NO: 673465 - DNA, 15 bp, Homo sapiens
tctagagcttttatt

SEQ ID NO: 673466 - DNA, 15 bp, Homo sapiens
tctaggaagacattt

SEQ ID NO: 673467 - DNA, 23 bp, Homo sapiens
tctaggaggagctagtaggaatg

SEQ ID NO: 673468 - DNA, 21 bp, Homo sapiens
tctagggaatgggactgtgag

SEQ ID NO: 673469 - DNA, 12 bp, Homo sapiens
tctataaaactc

SEQ ID NO: 673470 - DNA, 16 bp, Homo sapiens
tctataaaactctgca

SEQ ID NO: 673471 - DNA, 14 bp, Homo sapiens
tctataaaatagat

SEQ ID NO: 673472 - DNA, 17 bp, Homo sapiens
tctataagtagtaaatc

SEQ ID NO: 673473 - DNA, 19 bp, Homo sapiens
tctataagtagtaaatcag

SEQ ID NO: 673474 - DNA, 21 bp, Homo sapiens
tctataagtagtaaatcagaa

SEQ ID NO: 673475 - DNA, 14 bp, Homo sapiens
tctatcttccaaat

SEQ ID NO: 673476 - DNA, 13 bp, Homo sapiens
tctatgggaagat

SEQ ID NO: 673477 - DNA, 16 bp, Homo sapiens
tctattaatattcagg

SEQ ID NO: 673478 - DNA, 14 bp, Homo sapiens
tctattatccagag

SEQ ID NO: 673479 - DNA, 15 bp, Homo sapiens
tctattccaataaac

SEQ ID NO: 673480 - DNA, 21 bp, Homo sapiens
tctattgacttttcaataaat

SEQ ID NO: 673481 - DNA, 14 bp, Homo sapiens
tctattttcataat

SEQ ID NO: 673482 - DNA, 16 bp, Homo sapiens
tctattttcataatca

SEQ ID NO: 673483 - DNA, 22 bp, Homo sapiens
tctcaaggagaggcaaagaaag

SEQ ID NO: 673484 - DNA, 19 bp, Homo sapiens
tctcaatcttggtttgtca

SEQ ID NO: 673485 - DNA, 17 bp, Homo sapiens
tctcaattgaaagcttt

SEQ ID NO: 673486 - DNA, 18 bp, Homo sapiens
tctcaattgaaagctttt

SEQ ID NO: 673487 - DNA, 16 bp, Homo sapiens
tctcacagatgtgact

SEQ ID NO: 673488 - DNA, 22 bp, Homo sapiens
tctcacccatgcaagcagagga

SEQ ID NO: 673489 - DNA, 13 bp, Homo sapiens
tctcaccccactc

SEQ ID NO: 673490 - DNA, 15 bp, Homo sapiens
tctcaccccactcct

SEQ ID NO: 673491 - DNA, 18 bp, Homo sapiens
tctcaccccactcctgtc

SEQ ID NO: 673492 - DNA, 20 bp, Homo sapiens
tctcactatatatatttcta

SEQ ID NO: 673493 - DNA, 13 bp, Homo sapiens
tctcacttgtttc

SEQ ID NO: 673494 - DNA, 15 bp, Homo sapiens
tctcagctataattc

SEQ ID NO: 673495 - DNA, 23 bp, Homo sapiens
tctcaggatatccttatcagagc

SEQ ID NO: 673496 - DNA, 15 bp, Homo sapiens
tctcaggcttctgca

SEQ ID NO: 673497 - DNA, 14 bp, Homo sapiens
tctcagggctggag

SEQ ID NO: 673498 - DNA, 16 bp, Homo sapiens
tctcagtcctaatttg

SEQ ID NO: 673499 - DNA, 19 bp, Homo sapiens
tctcagtcctaatttgaac

SEQ ID NO: 673500 - DNA, 12 bp, Homo sapiens
tctcagtgtttt

SEQ ID NO: 673501 - DNA, 23 bp, Homo sapiens
tctcagtgttttggactccatct

SEQ ID NO: 673502 - DNA, 16 bp, Homo sapiens
tctcataattttgcaa

SEQ ID NO: 673503 - DNA, 22 bp, Homo sapiens
tctcataggctatgccatgtgc

SEQ ID NO: 673504 - DNA, 21 bp, Homo sapiens
tctcatcctccagtaccttgc

SEQ ID NO: 673505 - DNA, 18 bp, Homo sapiens
tctcattccgttgtctgt

SEQ ID NO: 673506 - DNA, 20 bp, Homo sapiens
tctcattccgttgtctgtgg

SEQ ID NO: 673507 - DNA, 15 bp, Homo sapiens
tctccatcctgcaga

SEQ ID NO: 673508 - DNA, 14 bp, Homo sapiens
tctccatgtgtact

SEQ ID NO: 673509 - DNA, 15 bp, Homo sapiens
tctccctagctcctc

SEQ ID NO: 673510 - DNA, 16 bp, Homo sapiens
tctccctgcctggccc

SEQ ID NO: 673511 - DNA, 20 bp, Homo sapiens
tctccctggctccctcctcc

SEQ ID NO: 673512 - DNA, 18 bp, Homo sapiens
tctccctgggtctgggga

SEQ ID NO: 673513 - DNA, 15 bp, Homo sapiens
tctcccttttccatg

SEQ ID NO: 673514 - DNA, 13 bp, Homo sapiens
tctcctcatctcc

SEQ ID NO: 673515 - DNA, 22 bp, Homo sapiens
tctcctcccgcccttccatgtg

SEQ ID NO: 673516 - DNA, 22 bp, Homo sapiens
tctcctcttcatggcatcttca

SEQ ID NO: 673517 - DNA, 14 bp, Homo sapiens
tctcctgaatattt

SEQ ID NO: 673518 - DNA, 13 bp, Homo sapiens
tctcctgactggt

SEQ ID NO: 673519 - DNA, 15 bp, Homo sapiens
tctcctgcctcagcc

SEQ ID NO: 673520 - DNA, 16 bp, Homo sapiens
tctcctgctgatttca

SEQ ID NO: 673521 - DNA, 22 bp, Homo sapiens
tctccttccagtataaccagct

SEQ ID NO: 673522 - DNA, 13 bp, Homo sapiens
tctccttccttcc

SEQ ID NO: 673523 - DNA, 19 bp, Homo sapiens
tctccttgcccccagtgcc

SEQ ID NO: 673524 - DNA, 18 bp, Homo sapiens
tctcgaatttgaagagat

SEQ ID NO: 673525 - DNA, 23 bp, Homo sapiens
tctcgaatttgaagagattgctg

SEQ ID NO: 673526 - DNA, 12 bp, Homo sapiens
tctcgcctcatt

SEQ ID NO: 673527 - DNA, 20 bp, Homo sapiens
tctctaccaaaaaaaggaag

SEQ ID NO: 673528 - DNA, 22 bp, Homo sapiens
tctctaggtgtgtccacagagt

SEQ ID NO: 673529 - DNA, 18 bp, Homo sapiens
tctctagtagtgtggcct

SEQ ID NO: 673530 - DNA, 12 bp, Homo sapiens
tctctatgtact

SEQ ID NO: 673531 - DNA, 13 bp, Homo sapiens
tctctattttcat

SEQ ID NO: 673532 - DNA, 15 bp, Homo sapiens
tctctattttcataa

SEQ ID NO: 673533 - DNA, 23 bp, Homo sapiens
tctctcatcctccagtaccttgc

SEQ ID NO: 673534 - DNA, 15 bp, Homo sapiens
tctctccctccttct

SEQ ID NO: 673535 - DNA, 11 bp, Homo sapiens
tctctcctggc

SEQ ID NO: 673536 - DNA, 15 bp, Homo sapiens
tctctctacagtgcc

SEQ ID NO: 673537 - DNA, 21 bp, Homo sapiens
tctctcttgtcctcttctgct

SEQ ID NO: 673538 - DNA, 11 bp, Homo sapiens
tctctcttttg

SEQ ID NO: 673539 - DNA, 22 bp, Homo sapiens
tctctggagtgagctctgtttc

SEQ ID NO: 673540 - DNA, 15 bp, Homo sapiens
tctctgtcccttgct

SEQ ID NO: 673541 - DNA, 22 bp, Homo sapiens
tctctgttggtctgccttctgc

SEQ ID NO: 673542 - DNA, 23 bp, Homo sapiens
tctctgttggtctgccttctgct

SEQ ID NO: 673543 - DNA, 17 bp, Homo sapiens
tctcttctacccttttc

SEQ ID NO: 673544 - DNA, 13 bp, Homo sapiens
tctcttgtcctct

SEQ ID NO: 673545 - DNA, 21 bp, Homo sapiens
tctcttttctttctgtcttgt

SEQ ID NO: 673546 - DNA, 11 bp, Homo sapiens
tctgaaactgg

SEQ ID NO: 673547 - DNA, 13 bp, Homo sapiens
tctgaaactggct

SEQ ID NO: 673548 - DNA, 12 bp, Homo sapiens
tctgaatatttt

SEQ ID NO: 673549 - DNA, 23 bp, Homo sapiens
tctgacaaaatggggcagaagag

SEQ ID NO: 673550 - DNA, 23 bp, Homo sapiens
tctgacctggcatctaattctga

SEQ ID NO: 673551 - DNA, 14 bp, Homo sapiens
tctgaccttaaatg

SEQ ID NO: 673552 - DNA, 12 bp, Homo sapiens
tctgacttttgt

SEQ ID NO: 673553 - DNA, 19 bp, Homo sapiens
tctgagacaaagcaatgga

SEQ ID NO: 673554 - DNA, 17 bp, Homo sapiens
tctgaggacaagagaaa

SEQ ID NO: 673555 - DNA, 14 bp, Homo sapiens
tctgaggccctgcc

SEQ ID NO: 673556 - DNA, 13 bp, Homo sapiens
tctgataaactga

SEQ ID NO: 673557 - DNA, 13 bp, Homo sapiens
tctgatctataca

SEQ ID NO: 673558 - DNA, 13 bp, Homo sapiens
tctgatgaatctc

SEQ ID NO: 673559 - DNA, 15 bp, Homo sapiens
tctgattctggcttt

SEQ ID NO: 673560 - DNA, 17 bp, Homo sapiens
tctgcaagcctcatgcc

SEQ ID NO: 673561 - DNA, 13 bp, Homo sapiens
tctgcacccctct

SEQ ID NO: 673562 - DNA, 16 bp, Homo sapiens
tctgcagtctcatttc

SEQ ID NO: 673563 - DNA, 18 bp, Homo sapiens
tctgccatctagccagcc

SEQ ID NO: 673564 - DNA, 13 bp, Homo sapiens
tctgccctggatt

SEQ ID NO: 673565 - DNA, 16 bp, Homo sapiens
tctgcctctccctggg

SEQ ID NO: 673566 - DNA, 17 bp, Homo sapiens
tctgcctctccctgggt

SEQ ID NO: 673567 - DNA, 11 bp, Homo sapiens
tctgcctgggc

SEQ ID NO: 673568 - DNA, 23 bp, Homo sapiens
tctgcctgggccgtggcacagct

SEQ ID NO: 673569 - DNA, 23 bp, Homo sapiens
tctgcctgtccccaaacaggaca

SEQ ID NO: 673570 - DNA, 13 bp, Homo sapiens
tctgccttctgct

SEQ ID NO: 673571 - DNA, 14 bp, Homo sapiens
tctgccttctgctg

SEQ ID NO: 673572 - DNA, 16 bp, Homo sapiens
tctgccttctgctgaa

SEQ ID NO: 673573 - DNA, 20 bp, Homo sapiens
tctgctcaccgcccatcagg

SEQ ID NO: 673574 - DNA, 21 bp, Homo sapiens
tctgctcaccgcccatcaggg

SEQ ID NO: 673575 - DNA, 22 bp, Homo sapiens
tctgctcccctaaagcctcaaa

SEQ ID NO: 673576 - DNA, 23 bp, Homo sapiens
tctggaatggtacatgtcttcca

SEQ ID NO: 673577 - DNA, 18 bp, Homo sapiens
tctggacccttataaaat

SEQ ID NO: 673578 - DNA, 19 bp, Homo sapiens
tctggacttggcaacagaa

SEQ ID NO: 673579 - DNA, 15 bp, Homo sapiens
tctggatttggtgct

SEQ ID NO: 673580 - DNA, 14 bp, Homo sapiens
tctggctttaagcc

SEQ ID NO: 673581 - DNA, 17 bp, Homo sapiens
tctggctttaagccttc

SEQ ID NO: 673582 - DNA, 15 bp, Homo sapiens
tctgggattattctt

SEQ ID NO: 673583 - DNA, 17 bp, Homo sapiens
tctgggcgtccagctca

SEQ ID NO: 673584 - DNA, 21 bp, Homo sapiens
tctgggcgtccagctcagccc

SEQ ID NO: 673585 - DNA, 21 bp, Homo sapiens
tctggggcaggctgggccatg

SEQ ID NO: 673586 - DNA, 18 bp, Homo sapiens
tctggggggacccagtgc

SEQ ID NO: 673587 - DNA, 20 bp, Homo sapiens
tctggggggacccagtgcag

SEQ ID NO: 673588 - DNA, 13 bp, Homo sapiens
tctgggtttctaa

SEQ ID NO: 673589 - DNA, 17 bp, Homo sapiens
tctggtgctcctgcatc

SEQ ID NO: 673590 - DNA, 19 bp, Homo sapiens
tctggtgtatattttaatg

SEQ ID NO: 673591 - DNA, 16 bp, Homo sapiens
tctggttatatcattc

SEQ ID NO: 673592 - DNA, 16 bp, Homo sapiens
tctgtaatgtaaataa

SEQ ID NO: 673593 - DNA, 21 bp, Homo sapiens
tctgtaatgtaaataaactat

SEQ ID NO: 673594 - DNA, 23 bp, Homo sapiens
tctgtactgttactgggccctga

SEQ ID NO: 673595 - DNA, 18 bp, Homo sapiens
tctgtagacttttgaaaa

SEQ ID NO: 673596 - DNA, 21 bp, Homo sapiens
tctgtaggtgaaagaacaagt

SEQ ID NO: 673597 - DNA, 18 bp, Homo sapiens
tctgtccctctccttgcc

SEQ ID NO: 673598 - DNA, 17 bp, Homo sapiens
tctgtcccttgctgtat

SEQ ID NO: 673599 - DNA, 16 bp, Homo sapiens
tctgtcctgagaagca

SEQ ID NO: 673600 - DNA, 19 bp, Homo sapiens
tctgtcttgttaatgcttt

SEQ ID NO: 673601 - DNA, 20 bp, Homo sapiens
tctgtgacccctccttgtca

SEQ ID NO: 673602 - DNA, 17 bp, Homo sapiens
tctgtggttcctctgct

SEQ ID NO: 673603 - DNA, 19 bp, Homo sapiens
tctgtggttcctctgctca

SEQ ID NO: 673604 - DNA, 21 bp, Homo sapiens
tctgttatgggcttttgggga

SEQ ID NO: 673605 - DNA, 17 bp, Homo sapiens
tctgttccatgcaactg

SEQ ID NO: 673606 - DNA, 16 bp, Homo sapiens
tctgttgtattcattg

SEQ ID NO: 673607 - DNA, 18 bp, Homo sapiens
tctgtttacatccagagt

SEQ ID NO: 673608 - DNA, 20 bp, Homo sapiens
tctgtttatggccacattta

SEQ ID NO: 673609 - DNA, 23 bp, Homo sapiens
tctgtttatggccacatttaata

SEQ ID NO: 673610 - DNA, 22 bp, Homo sapiens
tcttaaataatgcttcagatat

SEQ ID NO: 673611 - DNA, 16 bp, Homo sapiens
tcttaagtcagatttt

SEQ ID NO: 673612 - DNA, 18 bp, Homo sapiens
tcttaagtcagattttta

SEQ ID NO: 673613 - DNA, 18 bp, Homo sapiens
tcttacctactattggcc

SEQ ID NO: 673614 - DNA, 21 bp, Homo sapiens
tcttacctactattggcccta

SEQ ID NO: 673615 - DNA, 18 bp, Homo sapiens
tcttagtgcctgagagta

SEQ ID NO: 673616 - DNA, 17 bp, Homo sapiens
tcttattaaagtattct

SEQ ID NO: 673617 - DNA, 14 bp, Homo sapiens
tcttctttgtgcct

SEQ ID NO: 673618 - DNA, 21 bp, Homo sapiens
tcttctttgtgcctttggcct

SEQ ID NO: 673619 - DNA, 22 bp, Homo sapiens
tcttctttgtgcctttggcctg

SEQ ID NO: 673620 - DNA, 21 bp, Homo sapiens
tcttgaaaataagattccaga

SEQ ID NO: 673621 - DNA, 12 bp, Homo sapiens
tcttgaatgtgg

SEQ ID NO: 673622 - DNA, 18 bp, Homo sapiens
tcttgaatgtggtctcag

SEQ ID NO: 673623 - DNA, 19 bp, Homo sapiens
tcttgaccatactaataaa

SEQ ID NO: 673624 - DNA, 20 bp, Homo sapiens
tcttgaccatactaataaat

SEQ ID NO: 673625 - DNA, 16 bp, Homo sapiens
tcttgagaagtaactg

SEQ ID NO: 673626 - DNA, 11 bp, Homo sapiens
tcttgagccag

SEQ ID NO: 673627 - DNA, 14 bp, Homo sapiens
tcttgatgtatttc

SEQ ID NO: 673628 - DNA, 17 bp, Homo sapiens
tcttgcattcaaaatct

SEQ ID NO: 673629 - DNA, 23 bp, Homo sapiens
tcttgcctgaggggaaagagaga

SEQ ID NO: 673630 - DNA, 13 bp, Homo sapiens
tcttggggaagat

SEQ ID NO: 673631 - DNA, 17 bp, Homo sapiens
tcttggggcccagtgca

SEQ ID NO: 673632 - DNA, 18 bp, Homo sapiens
tcttggggcccagtgcat

SEQ ID NO: 673633 - DNA, 16 bp, Homo sapiens
tcttgtcctcttctgc

SEQ ID NO: 673634 - DNA, 15 bp, Homo sapiens
tcttgtttttattaa

SEQ ID NO: 673635 - DNA, 22 bp, Homo sapiens
tctttaacatacaagaaaatgt

SEQ ID NO: 673636 - DNA, 15 bp, Homo sapiens
tctttaataaataac

SEQ ID NO: 673637 - DNA, 16 bp, Homo sapiens
tctttaggagatttat

SEQ ID NO: 673638 - DNA, 22 bp, Homo sapiens
tctttagtttttggttgggaat

SEQ ID NO: 673639 - DNA, 23 bp, Homo sapiens
tctttagtttttggttgggaatg

SEQ ID NO: 673640 - DNA, 15 bp, Homo sapiens
tctttcaaaagcctt

SEQ ID NO: 673641 - DNA, 10 bp, Homo sapiens
tctttcatgg

SEQ ID NO: 673642 - DNA, 21 bp, Homo sapiens
tctttcattaaaaagaataga

SEQ ID NO: 673643 - DNA, 13 bp, Homo sapiens
tctttccaggctt

SEQ ID NO: 673644 - DNA, 22 bp, Homo sapiens
tctttccaggcttccctgactt

SEQ ID NO: 673645 - DNA, 21 bp, Homo sapiens
tctttccagtggatcataaga

SEQ ID NO: 673646 - DNA, 20 bp, Homo sapiens
tctttccatcaactcccaac

SEQ ID NO: 673647 - DNA, 15 bp, Homo sapiens
tctttccttgttcag

SEQ ID NO: 673648 - DNA, 13 bp, Homo sapiens
tctttctctgagg

SEQ ID NO: 673649 - DNA, 19 bp, Homo sapiens
tctttcttgaaattgaaga

SEQ ID NO: 673650 - DNA, 13 bp, Homo sapiens
tctttgaaagctt

SEQ ID NO: 673651 - DNA, 12 bp, Homo sapiens
tctttgcctctg

SEQ ID NO: 673652 - DNA, 13 bp, Homo sapiens
tctttgcctctgc

SEQ ID NO: 673653 - DNA, 15 bp, Homo sapiens
tctttgcctctgcag

SEQ ID NO: 673654 - DNA, 17 bp, Homo sapiens
tctttgcctctgcagtc

SEQ ID NO: 673655 - DNA, 13 bp, Homo sapiens
tctttgtgccttt

SEQ ID NO: 673656 - DNA, 19 bp, Homo sapiens
tctttgtgcctttggcctg

SEQ ID NO: 673657 - DNA, 15 bp, Homo sapiens
tctttgttacaggca

SEQ ID NO: 673658 - DNA, 16 bp, Homo sapiens
tctttgttgaagtttg

SEQ ID NO: 673659 - DNA, 13 bp, Homo sapiens
tcttttaaagacc

SEQ ID NO: 673660 - DNA, 18 bp, Homo sapiens
tcttttaaagaccctcct

SEQ ID NO: 673661 - DNA, 14 bp, Homo sapiens
tcttttatatttgt

SEQ ID NO: 673662 - DNA, 12 bp, Homo sapiens
tcttttgaagca

SEQ ID NO: 673663 - DNA, 14 bp, Homo sapiens
tcttttgaagcata

SEQ ID NO: 673664 - DNA, 17 bp, Homo sapiens
tcttttgctactaagtt

SEQ ID NO: 673665 - DNA, 13 bp, Homo sapiens
tcttttgctgtgc

SEQ ID NO: 673666 - DNA, 20 bp, Homo sapiens
tcttttggttatgaatactt

SEQ ID NO: 673667 - DNA, 12 bp, Homo sapiens
tcttttgtttcc

SEQ ID NO: 673668 - DNA, 21 bp, Homo sapiens
tctttttgccagttttccctg

SEQ ID NO: 673669 - DNA, 14 bp, Homo sapiens
tctttttttaaaag

SEQ ID NO: 673670 - DNA, 23 bp, Homo sapiens
tcttttttttttttttacagtat

SEQ ID NO: 673671 - DNA, 15 bp, Homo sapiens
tgaaaaaaaagtttt

SEQ ID NO: 673672 - DNA, 15 bp, Homo sapiens
tgaaaaaaattgaaa

SEQ ID NO: 673673 - DNA, 14 bp, Homo sapiens
tgaaaaacaatttt

SEQ ID NO: 673674 - DNA, 19 bp, Homo sapiens
tgaaaaatataaaattatg

SEQ ID NO: 673675 - DNA, 20 bp, Homo sapiens
tgaaaaatattccaagcttc

SEQ ID NO: 673676 - DNA, 19 bp, Homo sapiens
tgaaaaatctcaattgaaa

SEQ ID NO: 673677 - DNA, 12 bp, Homo sapiens
tgaaaaatgaca

SEQ ID NO: 673678 - DNA, 16 bp, Homo sapiens
tgaaaaatgacaattg

SEQ ID NO: 673679 - DNA, 22 bp, Homo sapiens
tgaaaaatgacaattgtgaaca

SEQ ID NO: 673680 - DNA, 11 bp, Homo sapiens
tgaaaaattaa

SEQ ID NO: 673681 - DNA, 23 bp, Homo sapiens
tgaaaacagatgaccataatttt

SEQ ID NO: 673682 - DNA, 14 bp, Homo sapiens
tgaaaacatgtaat

SEQ ID NO: 673683 - DNA, 22 bp, Homo sapiens
tgaaaacatgtactacagctat

SEQ ID NO: 673684 - DNA, 20 bp, Homo sapiens
tgaaaactagggctcatttt

SEQ ID NO: 673685 - DNA, 13 bp, Homo sapiens
tgaaaactttgta

SEQ ID NO: 673686 - DNA, 24 bp, Homo sapiens
tgaaaagtaattgaaaaaggtgat

SEQ ID NO: 673687 - DNA, 18 bp, Homo sapiens
tgaaaagtgtgtatatat

SEQ ID NO: 673688 - DNA, 13 bp, Homo sapiens
tgaaaataccatt

SEQ ID NO: 673689 - DNA, 20 bp, Homo sapiens
tgaaacaaagtactctttaa

SEQ ID NO: 673690 - DNA, 18 bp, Homo sapiens
tgaaacattttttcttct

SEQ ID NO: 673691 - DNA, 20 bp, Homo sapiens
tgaaacccctgtaggcctca

SEQ ID NO: 673692 - DNA, 18 bp, Homo sapiens
tgaaactccagatgccac

SEQ ID NO: 673693 - DNA, 19 bp, Homo sapiens
tgaaactccagatgccaca

SEQ ID NO: 673694 - DNA, 22 bp, Homo sapiens
tgaaactgcccactctgcaaga

SEQ ID NO: 673695 - DNA, 22 bp, Homo sapiens
tgaaactggttttaagtgcttt

SEQ ID NO: 673696 - DNA, 21 bp, Homo sapiens
tgaaactttgggaaaacatgt

SEQ ID NO: 673697 - DNA, 22 bp, Homo sapiens
tgaaactttgggaaaacatgtt

SEQ ID NO: 673698 - DNA, 22 bp, Homo sapiens
tgaaagaaaattgagttgcact

SEQ ID NO: 673699 - DNA, 19 bp, Homo sapiens
tgaaagactcgagaaccaa

SEQ ID NO: 673700 - DNA, 18 bp, Homo sapiens
tgaaagagccagactctg

SEQ ID NO: 673701 - DNA, 15 bp, Homo sapiens
tgaaagtagggggct

SEQ ID NO: 673702 - DNA, 15 bp, Homo sapiens
tgaaagtcaaattta

SEQ ID NO: 673703 - DNA, 19 bp, Homo sapiens
tgaaagtcaaatttacttt

SEQ ID NO: 673704 - DNA, 22 bp, Homo sapiens
tgaaagtcaaatttactttaaa

SEQ ID NO: 673705 - DNA, 21 bp, Homo sapiens
tgaaataaagacccaggggga

SEQ ID NO: 673706 - DNA, 21 bp, Homo sapiens
tgaaataatatatttcttctt

SEQ ID NO: 673707 - DNA, 14 bp, Homo sapiens
tgaaatagtataca

SEQ ID NO: 673708 - DNA, 15 bp, Homo sapiens
tgaaatagtatacat

SEQ ID NO: 673709 - DNA, 17 bp, Homo sapiens
tgaaatagtatacattg

SEQ ID NO: 673710 - DNA, 21 bp, Homo sapiens
tgaaatagtatacattgtctt

SEQ ID NO: 673711 - DNA, 17 bp, Homo sapiens
tgaaatatccacccagc

SEQ ID NO: 673712 - DNA, 18 bp, Homo sapiens
tgaaatatccacccagca

SEQ ID NO: 673713 - DNA, 16 bp, Homo sapiens
tgaaatgaaatcttcc

SEQ ID NO: 673714 - DNA, 13 bp, Homo sapiens
tgaaatgttctta

SEQ ID NO: 673715 - DNA, 21 bp, Homo sapiens
tgaaatgtttaataaagcttt

SEQ ID NO: 673716 - DNA, 19 bp, Homo sapiens
tgaaattaagcattttgaa

SEQ ID NO: 673717 - DNA, 19 bp, Homo sapiens
tgaaattacgggtacctga

SEQ ID NO: 673718 - DNA, 13 bp, Homo sapiens
tgaaattacttta

SEQ ID NO: 673719 - DNA, 18 bp, Homo sapiens
tgaaattactttaacatt

SEQ ID NO: 673720 - DNA, 20 bp, Homo sapiens
tgaaattactttaacatttt

SEQ ID NO: 673721 - DNA, 11 bp, Homo sapiens
tgaaattgaag

SEQ ID NO: 673722 - DNA, 16 bp, Homo sapiens
tgaaattgcatacttt

SEQ ID NO: 673723 - DNA, 19 bp, Homo sapiens
tgaaatttcctaatttatt

SEQ ID NO: 673724 - DNA, 18 bp, Homo sapiens
tgaacacttagtgatcat

SEQ ID NO: 673725 - DNA, 14 bp, Homo sapiens
tgaacatgatagtt

SEQ ID NO: 673726 - DNA, 16 bp, Homo sapiens
tgaaccataaattcaa

SEQ ID NO: 673727 - DNA, 17 bp, Homo sapiens
tgaacctacctgccttg

SEQ ID NO: 673728 - DNA, 12 bp, Homo sapiens
tgaacctgaata

SEQ ID NO: 673729 - DNA, 14 bp, Homo sapiens
tgaacctgtgcaat

SEQ ID NO: 673730 - DNA, 19 bp, Homo sapiens
tgaactcttctgcaaaaat

SEQ ID NO: 673731 - DNA, 13 bp, Homo sapiens
tgaagaaagtcaa

SEQ ID NO: 673732 - DNA, 20 bp, Homo sapiens
tgaagaaagtcaaaaaatta

SEQ ID NO: 673733 - DNA, 16 bp, Homo sapiens
ttttctgcgcttcagt

SEQ ID NO: 673734 - DNA, 11 bp, Homo sapiens
ttttctggcac

SEQ ID NO: 673735 - DNA, 11 bp, Homo sapiens
ttttcttctga

SEQ ID NO: 673736 - DNA, 16 bp, Homo sapiens
ttttcttcttgggata

SEQ ID NO: 673737 - DNA, 18 bp, Homo sapiens
ttttgaaaaaaaagtttt

SEQ ID NO: 673738 - DNA, 15 bp, Homo sapiens
ttttgaaacaaagta

SEQ ID NO: 673739 - DNA, 22 bp, Homo sapiens
ttttgaaacaaagtactcttta

SEQ ID NO: 673740 - DNA, 15 bp, Homo sapiens
ttttgaatatgcctt

SEQ ID NO: 673741 - DNA, 23 bp, Homo sapiens
ttttgacagactatttgctaatg

SEQ ID NO: 673742 - DNA, 13 bp, Homo sapiens
ttttgagcacttt

SEQ ID NO: 673743 - DNA, 16 bp, Homo sapiens
ttttgatgtaaagatg

SEQ ID NO: 673744 - DNA, 18 bp, Homo sapiens
ttttgatgtaaagatgtt

SEQ ID NO: 673745 - DNA, 19 bp, Homo sapiens
ttttgccagttttccctgg

SEQ ID NO: 673746 - DNA, 22 bp, Homo sapiens
tctttccaaattaaaacaaata

SEQ ID NO: 673747 - DNA, 12 bp, Homo sapiens
tctttccaggct

SEQ ID NO: 673748 - DNA, 15 bp, Homo sapiens
tctttcccatgtatt

SEQ ID NO: 673749 - DNA, 11 bp, Homo sapiens
tctttgcctct

SEQ ID NO: 673750 - DNA, 22 bp, Homo sapiens
tctttgctgcagtcatctactt

SEQ ID NO: 673751 - DNA, 18 bp, Homo sapiens
tctttgtaaatgcatatt

SEQ ID NO: 673752 - DNA, 17 bp, Homo sapiens
tctttgttacttcctta

SEQ ID NO: 673753 - DNA, 15 bp, Homo sapiens
tctttgttataccat

SEQ ID NO: 673754 - DNA, 12 bp, Homo sapiens
tcttttagagag

SEQ ID NO: 673755 - DNA, 15 bp, Homo sapiens
tcttttagagagggg

SEQ ID NO: 673756 - DNA, 13 bp, Homo sapiens
tcttttatatttg

SEQ ID NO: 673757 - DNA, 14 bp, Homo sapiens
tcttttatcctggg

SEQ ID NO: 673758 - DNA, 13 bp, Homo sapiens
tcttttctttctg

SEQ ID NO: 673759 - DNA, 15 bp, Homo sapiens
tcttttgtttccatg

SEQ ID NO: 673760 - DNA, 12 bp, Homo sapiens
tctttttgtttg

SEQ ID NO: 673761 - DNA, 23 bp, Homo sapiens
tcttttttaaccggtaagagttt

SEQ ID NO: 673762 - DNA, 21 bp, Homo sapiens
tgaaaaagcagctaccaggtg

SEQ ID NO: 673763 - DNA, 20 bp, Homo sapiens
tgaaaaagctggattttctt

SEQ ID NO: 673764 - DNA, 17 bp, Homo sapiens
tgaaaaatataaaatta

SEQ ID NO: 673765 - DNA, 20 bp, Homo sapiens
tgaaaaatgtttttattttt

SEQ ID NO: 673766 - DNA, 16 bp, Homo sapiens
tgaaaaattaactttt

SEQ ID NO: 673767 - DNA, 17 bp, Homo sapiens
tgaaaaattaacttttt

SEQ ID NO: 673768 - DNA, 13 bp, Homo sapiens
tgaaaacatgtac

SEQ ID NO: 673769 - DNA, 20 bp, Homo sapiens
tgaaaacatgtactacagct

SEQ ID NO: 673770 - DNA, 21 bp, Homo sapiens
tgaaaacatgtactacagcta

SEQ ID NO: 673771 - DNA, 16 bp, Homo sapiens
tgaaaactttgtagta

SEQ ID NO: 673772 - DNA, 17 bp, Homo sapiens
tgaaaaggttgcctgaa

SEQ ID NO: 673773 - DNA, 19 bp, Homo sapiens
tgaaaagtgtgtatatatt

SEQ ID NO: 673774 - DNA, 15 bp, Homo sapiens
tgaaaagtttttgtt

SEQ ID NO: 673775 - DNA, 15 bp, Homo sapiens
tgaaaatagtgttcc

SEQ ID NO: 673776 - DNA, 19 bp, Homo sapiens
tgaaacaaagtactcttta

SEQ ID NO: 673777 - DNA, 16 bp, Homo sapiens
tgaaacagttgctgtg

SEQ ID NO: 673778 - DNA, 14 bp, Homo sapiens
ttagactatttctt

SEQ ID NO: 673779 - DNA, 18 bp, Homo sapiens
ttagagataggaaactga

SEQ ID NO: 673780 - DNA, 14 bp, Homo sapiens
ttagatatttacat

SEQ ID NO: 673781 - DNA, 22 bp, Homo sapiens
ttagatctaaacagttatttct

SEQ ID NO: 673782 - DNA, 15 bp, Homo sapiens
ttagattaagaaata

SEQ ID NO: 673783 - DNA, 23 bp, Homo sapiens
ttagcaagcaactaattttctcc

SEQ ID NO: 673784 - DNA, 13 bp, Homo sapiens
ttagcgtcaagac

SEQ ID NO: 673785 - DNA, 18 bp, Homo sapiens
ttagctccataaagtaca

SEQ ID NO: 673786 - DNA, 14 bp, Homo sapiens
ttagctcttcccac

SEQ ID NO: 673787 - DNA, 18 bp, Homo sapiens
ttagctggccacatggcg

SEQ ID NO: 673788 - DNA, 19 bp, Homo sapiens
ttagctttccaaggaagca

SEQ ID NO: 673789 - DNA, 20 bp, Homo sapiens
ttagctttccaaggaagcag

SEQ ID NO: 673790 - DNA, 20 bp, Homo sapiens
ttaggaaaataaacagacaa

SEQ ID NO: 673791 - DNA, 18 bp, Homo sapiens
ttaggaggacaaaaggaa

SEQ ID NO: 673792 - DNA, 19 bp, Homo sapiens
ttaggaggacaaaaggaat

SEQ ID NO: 673793 - DNA, 11 bp, Homo sapiens
ttagggtacag

SEQ ID NO: 673794 - DNA, 23 bp, Homo sapiens
ttaggtcaataacactgtatttt

SEQ ID NO: 673795 - DNA, 18 bp, Homo sapiens
ttagtaaatttctgtgat

SEQ ID NO: 673796 - DNA, 16 bp, Homo sapiens
ttagtaatggcagagc

SEQ ID NO: 673797 - DNA, 13 bp, Homo sapiens
ttagtggcaccgc

SEQ ID NO: 673798 - DNA, 15 bp, Homo sapiens
ttagtgggccagggc

SEQ ID NO: 673799 - DNA, 16 bp, Homo sapiens
ttagtgggccagggct

SEQ ID NO: 673800 - DNA, 17 bp, Homo sapiens
ttagtgtgacagtttcc

SEQ ID NO: 673801 - DNA, 20 bp, Homo sapiens
ttagtgtgacagtttccaaa

SEQ ID NO: 673802 - DNA, 21 bp, Homo sapiens
ttagtgtgacagtttccaaat

SEQ ID NO: 673803 - DNA, 16 bp, Homo sapiens
ttagttccactgagac

SEQ ID NO: 673804 - DNA, 19 bp, Homo sapiens
ttagttctttttgccagtt

SEQ ID NO: 673805 - DNA, 21 bp, Homo sapiens
ttataaaaataaagggaagaa

SEQ ID NO: 673806 - DNA, 18 bp, Homo sapiens
ttataaaatcctgtgcaa

SEQ ID NO: 673807 - DNA, 16 bp, Homo sapiens
ttataaaatggacaca

SEQ ID NO: 673808 - DNA, 17 bp, Homo sapiens
ttataaacagaaatgga

SEQ ID NO: 673809 - DNA, 23 bp, Homo sapiens
ttataaacagacaatatgtgagt

SEQ ID NO: 673810 - DNA, 13 bp, Homo sapiens
ttataaagcatgt

SEQ ID NO: 673811 - DNA, 14 bp, Homo sapiens
ttataatgaagaac

SEQ ID NO: 673812 - DNA, 20 bp, Homo sapiens
ttataattgtacaaaattaa

SEQ ID NO: 673813 - DNA, 19 bp, Homo sapiens
ttatacaagtaatttcctg

SEQ ID NO: 673814 - DNA, 16 bp, Homo sapiens
ttataccattcagatc

SEQ ID NO: 673815 - DNA, 20 bp, Homo sapiens
ttatactgggtttcaagaaa

SEQ ID NO: 673816 - DNA, 17 bp, Homo sapiens
ttatactgtatttctaa

SEQ ID NO: 673817 - DNA, 20 bp, Homo sapiens
ttatagtctaagactatata

SEQ ID NO: 673818 - DNA, 19 bp, Homo sapiens
ttatataaataaagttttt

SEQ ID NO: 673819 - DNA, 14 bp, Homo sapiens
ttatatataataaa

SEQ ID NO: 673820 - DNA, 15 bp, Homo sapiens
ttatatataataaat

SEQ ID NO: 673821 - DNA, 15 bp, Homo sapiens
ttatatcatatgtat

SEQ ID NO: 673822 - DNA, 16 bp, Homo sapiens
ttatatcatatgtata

SEQ ID NO: 673823 - DNA, 21 bp, Homo sapiens
ttatcataaacattttacatg

SEQ ID NO: 673824 - DNA, 17 bp, Homo sapiens
ttatcatggtcctgaat

SEQ ID NO: 673825 - DNA, 16 bp, Homo sapiens
ttatcattaaaaatta

SEQ ID NO: 673826 - DNA, 18 bp, Homo sapiens
ttatcattaaaaattacc

SEQ ID NO: 673827 - DNA, 18 bp, Homo sapiens
ttatccaaaatgtgtatt

SEQ ID NO: 673828 - DNA, 21 bp, Homo sapiens
ttatccacaattattggcaaa

SEQ ID NO: 673829 - DNA, 14 bp, Homo sapiens
ttatccctctcttc

SEQ ID NO: 673830 - DNA, 17 bp, Homo sapiens
ttatccctctcttcccc

SEQ ID NO: 673831 - DNA, 18 bp, Homo sapiens
ttatccctctcttcccct

SEQ ID NO: 673832 - DNA, 22 bp, Homo sapiens
ttatcctgaactcttctgcaaa

SEQ ID NO: 673833 - DNA, 17 bp, Homo sapiens
ttatcctggcatgtgct

SEQ ID NO: 673834 - DNA, 22 bp, Homo sapiens
ttatccttacaatgtgaataat

SEQ ID NO: 673835 - DNA, 22 bp, Homo sapiens
ttatcgtttttgtattttcatg

SEQ ID NO: 673836 - DNA, 20 bp, Homo sapiens
ttatctcgaatttgaagaga

SEQ ID NO: 673837 - DNA, 20 bp, Homo sapiens
ttatctcttttatatttgta

SEQ ID NO: 673838 - DNA, 13 bp, Homo sapiens
ttatctttttaaa

SEQ ID NO: 673839 - DNA, 20 bp, Homo sapiens
ttatgaagtgcgtgaatgta

SEQ ID NO: 673840 - DNA, 22 bp, Homo sapiens
ttatgacctgaaataatatatt

SEQ ID NO: 673841 - DNA, 16 bp, Homo sapiens
ttatgagtctttgaga

SEQ ID NO: 673842 - DNA, 20 bp, Homo sapiens
ttatgatggttttaaacttt

SEQ ID NO: 673843 - DNA, 16 bp, Homo sapiens
ttatgatttccttcaa

SEQ ID NO: 673844 - DNA, 16 bp, Homo sapiens
ttatgcaaaatttaga

SEQ ID NO: 673845 - DNA, 22 bp, Homo sapiens
ttatgcaaaatttagaagaaaa

SEQ ID NO: 673846 - DNA, 18 bp, Homo sapiens
ttatgcacttttagaaat

SEQ ID NO: 673847 - DNA, 17 bp, Homo sapiens
ttatggatgatttaagt

SEQ ID NO: 673848 - DNA, 19 bp, Homo sapiens
ttatgtatcagtgtccttt

SEQ ID NO: 673849 - DNA, 22 bp, Homo sapiens
ttatgtatggatatatttgaaa

SEQ ID NO: 673850 - DNA, 18 bp, Homo sapiens
ttatgtgaaaaattaact

SEQ ID NO: 673851 - DNA, 20 bp, Homo sapiens
ttatgttccttttaaagaaa

SEQ ID NO: 673852 - DNA, 18 bp, Homo sapiens
ttatgtttaaaagaaata

SEQ ID NO: 673853 - DNA, 14 bp, Homo sapiens
ttattaagtaaaat

SEQ ID NO: 673854 - DNA, 12 bp, Homo sapiens
ttattagataat

SEQ ID NO: 673855 - DNA, 12 bp, Homo sapiens
ttattagatgtt

SEQ ID NO: 673856 - DNA, 14 bp, Homo sapiens
ttattataaagctt

SEQ ID NO: 673857 - DNA, 17 bp, Homo sapiens
ttattataaagcttaaa

SEQ ID NO: 673858 - DNA, 18 bp, Homo sapiens
ttattataaagcttaaat

SEQ ID NO: 673859 - DNA, 18 bp, Homo sapiens
ttattattttaaaatata

SEQ ID NO: 673860 - DNA, 14 bp, Homo sapiens
ttattcagaacttt

SEQ ID NO: 673861 - DNA, 16 bp, Homo sapiens
ttattctttgaaaaca

SEQ ID NO: 673862 - DNA, 13 bp, Homo sapiens
ttattggcaaagt

SEQ ID NO: 673863 - DNA, 14 bp, Homo sapiens
ttattggcaaagtt

SEQ ID NO: 673864 - DNA, 21 bp, Homo sapiens
ttattggcaaagtttaaatgt

SEQ ID NO: 673865 - DNA, 23 bp, Homo sapiens
ttattggcaaagtttaaatgtat

SEQ ID NO: 673866 - DNA, 20 bp, Homo sapiens
ttattgtaaagtcctatagt

SEQ ID NO: 673867 - DNA, 12 bp, Homo sapiens
ttatttagagat

SEQ ID NO: 673868 - DNA, 16 bp, Homo sapiens
ttatttcaataaatct

SEQ ID NO: 673869 - DNA, 18 bp, Homo sapiens
ttatttcaataaatcttt

SEQ ID NO: 673870 - DNA, 18 bp, Homo sapiens
ttatttcataattgccta

SEQ ID NO: 673871 - DNA, 19 bp, Homo sapiens
ttatttgactatgaatgtt

SEQ ID NO: 673872 - DNA, 17 bp, Homo sapiens
ttatttgaggtcagtgt

SEQ ID NO: 673873 - DNA, 11 bp, Homo sapiens
ttatttgcaat

SEQ ID NO: 673874 - DNA, 19 bp, Homo sapiens
ttatttgcaatttgagcca

SEQ ID NO: 673875 - DNA, 15 bp, Homo sapiens
ttatttggtgtgttc

SEQ ID NO: 673876 - DNA, 16 bp, Homo sapiens
ttatttggtgtgttcg

SEQ ID NO: 673877 - DNA, 16 bp, Homo sapiens
ttattttgatgtaaag

SEQ ID NO: 673878 - DNA, 21 bp, Homo sapiens
ttattttggagattataataa

SEQ ID NO: 673879 - DNA, 16 bp, Homo sapiens
ttatttttataattgt

SEQ ID NO: 673880 - DNA, 21 bp, Homo sapiens
ttatttttataattgtacaaa

SEQ ID NO: 673881 - DNA, 13 bp, Homo sapiens
ttcaaaaagatat

SEQ ID NO: 673882 - DNA, 23 bp, Homo sapiens
ttcaaaagaaatttaagttctat

SEQ ID NO: 673883 - DNA, 18 bp, Homo sapiens
ttcaaaatgtctgtagct

SEQ ID NO: 673884 - DNA, 19 bp, Homo sapiens
ttcaaagcacttaagtgtt

SEQ ID NO: 673885 - DNA, 13 bp, Homo sapiens
ttcaaagccacat

SEQ ID NO: 673886 - DNA, 17 bp, Homo sapiens
ttcaaagccttctccct

SEQ ID NO: 673887 - DNA, 20 bp, Homo sapiens
ttcaaagttttgttgtactt

SEQ ID NO: 673888 - DNA, 21 bp, Homo sapiens
ttcaaagttttgttgtactta

SEQ ID NO: 673889 - DNA, 18 bp, Homo sapiens
ttcaaatcccgcagcctc

SEQ ID NO: 673890 - DNA, 12 bp, Homo sapiens
ttcaacttattt

SEQ ID NO: 673891 - DNA, 14 bp, Homo sapiens
ttcaacttatttca

SEQ ID NO: 673892 - DNA, 19 bp, Homo sapiens
ttcaacttatttcataatt

SEQ ID NO: 673893 - DNA, 22 bp, Homo sapiens
ttcaagaaaatctttgttgaag

SEQ ID NO: 673894 - DNA, 20 bp, Homo sapiens
ttcaagaatgaaaaatataa

SEQ ID NO: 673895 - DNA, 20 bp, Homo sapiens
ttcaagagctagaaaaataa

SEQ ID NO: 673896 - DNA, 22 bp, Homo sapiens
ttcaagttgtaaataatttatt

SEQ ID NO: 673897 - DNA, 18 bp, Homo sapiens
ttcaataaatctttcaaa

SEQ ID NO: 673898 - DNA, 11 bp, Homo sapiens
ttcaatatcag

SEQ ID NO: 673899 - DNA, 15 bp, Homo sapiens
ttcaatgtgcataat

SEQ ID NO: 673900 - DNA, 18 bp, Homo sapiens
ttcaattagtggtcataa

SEQ ID NO: 673901 - DNA, 18 bp, Homo sapiens
ttcacaaatgtcattgtc

SEQ ID NO: 673902 - DNA, 17 bp, Homo sapiens
ttcacatcccattggga

SEQ ID NO: 673903 - DNA, 13 bp, Homo sapiens
ttcaccaaaatta

SEQ ID NO: 673904 - DNA, 14 bp, Homo sapiens
ttcaccaagaagca

SEQ ID NO: 673905 - DNA, 23 bp, Homo sapiens
ttcactagaagccgtgggaagaa

SEQ ID NO: 673906 - DNA, 16 bp, Homo sapiens
ttctcccaagctgatt

SEQ ID NO: 673907 - DNA, 13 bp, Homo sapiens
ttctcccctccct

SEQ ID NO: 673908 - DNA, 13 bp, Homo sapiens
ttctcctgaatat

SEQ ID NO: 673909 - DNA, 17 bp, Homo sapiens
ttctcgtgcctccccac

SEQ ID NO: 673910 - DNA, 15 bp, Homo sapiens
ttctctagaagctcc

SEQ ID NO: 673911 - DNA, 13 bp, Homo sapiens
ttctctgaggaca

SEQ ID NO: 673912 - DNA, 16 bp, Homo sapiens
ttctctgaggacaaga

SEQ ID NO: 673913 - DNA, 20 bp, Homo sapiens
ttctctgaggacaagagaaa

SEQ ID NO: 673914 - DNA, 17 bp, Homo sapiens
ttctcttccccttagaa

SEQ ID NO: 673915 - DNA, 17 bp, Homo sapiens
ttctcttttctttctgt

SEQ ID NO: 673916 - DNA, 12 bp, Homo sapiens
ttctgaaatgtt

SEQ ID NO: 673917 - DNA, 19 bp, Homo sapiens
ttctgaagctgacagcact

SEQ ID NO: 673918 - DNA, 13 bp, Homo sapiens
ttctgagaaggtg

SEQ ID NO: 673919 - DNA, 17 bp, Homo sapiens
ttctgcaacaagcatgc

SEQ ID NO: 673920 - DNA, 17 bp, Homo sapiens
ttctgctcttttcctgg

SEQ ID NO: 673921 - DNA, 18 bp, Homo sapiens
ttctggataaagccactg

SEQ ID NO: 673922 - DNA, 21 bp, Homo sapiens
ttctggcaaaaaggagccttt

SEQ ID NO: 673923 - DNA, 18 bp, Homo sapiens
ttctggctttaagccttc

SEQ ID NO: 673924 - DNA, 18 bp, Homo sapiens
ttctggggcaggctgggc

SEQ ID NO: 673925 - DNA, 21 bp, Homo sapiens
ttctggggcaggctgggccat

SEQ ID NO: 673926 - DNA, 20 bp, Homo sapiens
ttctggggggacccagtgca

SEQ ID NO: 673927 - DNA, 21 bp, Homo sapiens
ttctggggggacccagtgcag

SEQ ID NO: 673928 - DNA, 16 bp, Homo sapiens
ttctgggtcttttgct

SEQ ID NO: 673929 - DNA, 17 bp, Homo sapiens
ttctgggtcttttgcta

SEQ ID NO: 673930 - DNA, 19 bp, Homo sapiens
ttctggtgttgactggact

SEQ ID NO: 673931 - DNA, 19 bp, Homo sapiens
ttctgtaatgtaaataaac

SEQ ID NO: 673932 - DNA, 16 bp, Homo sapiens
ttctgtagacttttga

SEQ ID NO: 673933 - DNA, 23 bp, Homo sapiens
ttctgtccccatctaggtcctgg

SEQ ID NO: 673934 - DNA, 23 bp, Homo sapiens
ttctgttttgtttggcaaggaaa

SEQ ID NO: 673935 - DNA, 21 bp, Homo sapiens
ttcttaaaaggcccatagcag

SEQ ID NO: 673936 - DNA, 16 bp, Homo sapiens
ttcttaaataatgctt

SEQ ID NO: 673937 - DNA, 15 bp, Homo sapiens
ttcttaaatgtttat

SEQ ID NO: 673938 - DNA, 13 bp, Homo sapiens
ttcttaaggtttt

SEQ ID NO: 673939 - DNA, 14 bp, Homo sapiens
ttcttaaggttttg

SEQ ID NO: 673940 - DNA, 12 bp, Homo sapiens
ttcttactgaca

SEQ ID NO: 673941 - DNA, 20 bp, Homo sapiens
ttcttatacgcttttctttg

SEQ ID NO: 673942 - DNA, 18 bp, Homo sapiens
ttcttcacatgtttaact

SEQ ID NO: 673943 - DNA, 15 bp, Homo sapiens
ttcttctaagaagac

SEQ ID NO: 673944 - DNA, 15 bp, Homo sapiens
ttcttctctgtgaga

SEQ ID NO: 673945 - DNA, 22 bp, Homo sapiens
ttcttctctgtgagaaggttta

SEQ ID NO: 673946 - DNA, 19 bp, Homo sapiens
ttcttctgaagattcttaa

SEQ ID NO: 673947 - DNA, 14 bp, Homo sapiens
ttcttcttctaaga

SEQ ID NO: 673948 - DNA, 15 bp, Homo sapiens
ttcttcttctaagaa

SEQ ID NO: 673949 - DNA, 13 bp, Homo sapiens
ttcttgaaattga

SEQ ID NO: 673950 - DNA, 14 bp, Homo sapiens
ttcttgaaattgaa

SEQ ID NO: 673951 - DNA, 18 bp, Homo sapiens
ttcttgagaagtaactgt

SEQ ID NO: 673952 - DNA, 12 bp, Homo sapiens
ttcttgctttca

SEQ ID NO: 673953 - DNA, 17 bp, Homo sapiens
ttcttggggcccagtgc

SEQ ID NO: 673954 - DNA, 15 bp, Homo sapiens
ttctttccttgttca

SEQ ID NO: 673955 - DNA, 12 bp, Homo sapiens
ttctttgcctct

SEQ ID NO: 673956 - DNA, 13 bp, Homo sapiens
ttctttgcctctg

SEQ ID NO: 673957 - DNA, 16 bp, Homo sapiens
ttctttgttacaggca

SEQ ID NO: 673958 - DNA, 20 bp, Homo sapiens
ttgaaaaaaattgaaataaa

SEQ ID NO: 673959 - DNA, 11 bp, Homo sapiens
ttgaaaaacaa

SEQ ID NO: 673960 - DNA, 13 bp, Homo sapiens
ttgaaaaatataa

SEQ ID NO: 673961 - DNA, 20 bp, Homo sapiens
ttgaaaaatataaaattatg

SEQ ID NO: 673962 - DNA, 13 bp, Homo sapiens
ttgaaaaatgaca

SEQ ID NO: 673963 - DNA, 16 bp, Homo sapiens
ttgaaaatgcaactct

SEQ ID NO: 673964 - DNA, 12 bp, Homo sapiens
ttgaaacaaagt

SEQ ID NO: 673965 - DNA, 21 bp, Homo sapiens
ttgaaatatggtcttttggtt

SEQ ID NO: 673966 - DNA, 13 bp, Homo sapiens
ttgaaatttccta

SEQ ID NO: 673967 - DNA, 17 bp, Homo sapiens
ttgaaggagaaaataga

SEQ ID NO: 673968 - DNA, 23 bp, Homo sapiens
ttgaaggcttaattgactgaaat

SEQ ID NO: 673969 - DNA, 18 bp, Homo sapiens
ttgaagtatggtgtgttc

SEQ ID NO: 673970 - DNA, 18 bp, Homo sapiens
ttgaagtctttaataaat

SEQ ID NO: 673971 - DNA, 20 bp, Homo sapiens
ttgaagtctttaataaataa

SEQ ID NO: 673972 - DNA, 21 bp, Homo sapiens
ttgaagtgcagctcatgtttt

SEQ ID NO: 673973 - DNA, 16 bp, Homo sapiens
ttgaagtgtataatat

SEQ ID NO: 673974 - DNA, 15 bp, Homo sapiens
ttgaatatgccttaa

SEQ ID NO: 673975 - DNA, 19 bp, Homo sapiens
ttgaatatgccttaattta

SEQ ID NO: 673976 - DNA, 23 bp, Homo sapiens
ttgaatatgccttaatttagaaa

SEQ ID NO: 673977 - DNA, 19 bp, Homo sapiens
ttgacactggtatcttatt

SEQ ID NO: 673978 - DNA, 20 bp, Homo sapiens
ttgacatacctaccagtatt

SEQ ID NO: 673979 - DNA, 18 bp, Homo sapiens
ttgacataggtcataaag

SEQ ID NO: 673980 - DNA, 20 bp, Homo sapiens
ttgacataggtcataaagca

SEQ ID NO: 673981 - DNA, 22 bp, Homo sapiens
ttgacataggtcataaagcatt

SEQ ID NO: 673982 - DNA, 18 bp, Homo sapiens
ttgacttttataaagcat

SEQ ID NO: 673983 - DNA, 17 bp, Homo sapiens
ttgacttttcaataaat

SEQ ID NO: 673984 - DNA, 14 bp, Homo sapiens
ttgagacaatgttt

SEQ ID NO: 673985 - DNA, 14 bp, Homo sapiens
ttgagatgtacatc

SEQ ID NO: 673986 - DNA, 23 bp, Homo sapiens
ttgagccagtaatctttatactg

SEQ ID NO: 673987 - DNA, 19 bp, Homo sapiens
ttgagctcaggaggtcaag

SEQ ID NO: 673988 - DNA, 18 bp, Homo sapiens
ttgaggcaaattaactgt

SEQ ID NO: 673989 - DNA, 19 bp, Homo sapiens
ttgaggcaaattaactgta

SEQ ID NO: 673990 - DNA, 15 bp, Homo sapiens
ttgaggtcagtgttt

SEQ ID NO: 673991 - DNA, 22 bp, Homo sapiens
ttgagtattgtttaaaatgtaa

SEQ ID NO: 673992 - DNA, 22 bp, Homo sapiens
ttgataacaatgacactagaaa

SEQ ID NO: 673993 - DNA, 21 bp, Homo sapiens
ttgataatatatattaagtgt

SEQ ID NO: 673994 - DNA, 14 bp, Homo sapiens
ttgataatcttcag

SEQ ID NO: 673995 - DNA, 15 bp, Homo sapiens
ttgataatcttcagg

SEQ ID NO: 673996 - DNA, 16 bp, Homo sapiens
ttgataatcttcaggt

SEQ ID NO: 673997 - DNA, 21 bp, Homo sapiens
ttgatcgcttttaataaactg

SEQ ID NO: 673998 - DNA, 22 bp, Homo sapiens
ttgatcgcttttaataaactgc

SEQ ID NO: 673999 - DNA, 14 bp, Homo sapiens
ttgatctctcttgt

SEQ ID NO: 674000 - DNA, 17 bp, Homo sapiens
ttgatgcccaatatatt

SEQ ID NO: 674001 - DNA, 12 bp, Homo sapiens
ttgatggctgcg

SEQ ID NO: 674002 - DNA, 20 bp, Homo sapiens
ttgatgtacataactcctgt

SEQ ID NO: 674003 - DNA, 18 bp, Homo sapiens
ttgattaagaaaggaagt

SEQ ID NO: 674004 - DNA, 22 bp, Homo sapiens
ttgattgggaaaacatttgctg

SEQ ID NO: 674005 - DNA, 21 bp, Homo sapiens
ttgattgtcagctactaatga

SEQ ID NO: 674006 - DNA, 23 bp, Homo sapiens
ttgatttccgtgaactctggtgc

SEQ ID NO: 674007 - DNA, 16 bp, Homo sapiens
ttgatttcctgtgtgt

SEQ ID NO: 674008 - DNA, 21 bp, Homo sapiens
ttgatttttaagaaagtaatt

SEQ ID NO: 674009 - DNA, 17 bp, Homo sapiens
ttgcagtggggctagga

SEQ ID NO: 674010 - DNA, 20 bp, Homo sapiens
ttgcataataagctaaagag

SEQ ID NO: 674011 - DNA, 16 bp, Homo sapiens
ttgcatactttgtatt

SEQ ID NO: 674012 - DNA, 17 bp, Homo sapiens
ttgcatactttgtattt

SEQ ID NO: 674013 - DNA, 21 bp, Homo sapiens
ttgcatatagttaaactgaga

SEQ ID NO: 674014 - DNA, 15 bp, Homo sapiens
ttgcatattttgaga

SEQ ID NO: 674015 - DNA, 16 bp, Homo sapiens
ttgcatattttgagaa

SEQ ID NO: 674016 - DNA, 18 bp, Homo sapiens
ttgcatattttgagaaac

SEQ ID NO: 674017 - DNA, 19 bp, Homo sapiens
ttgcatcagaaagctttat

SEQ ID NO: 674018 - DNA, 15 bp, Homo sapiens
ttgcatgcaatttga

SEQ ID NO: 674019 - DNA, 13 bp, Homo sapiens
ttgcatgcatgca

SEQ ID NO: 674020 - DNA, 15 bp, Homo sapiens
ttgcatgcatgcaaa

SEQ ID NO: 674021 - DNA, 16 bp, Homo sapiens
ttgcatgcatgcaaat

SEQ ID NO: 674022 - DNA, 15 bp, Homo sapiens
ttgcattcttttggc

SEQ ID NO: 674023 - DNA, 22 bp, Homo sapiens
ttgccaaccttatagggatgag

SEQ ID NO: 674024 - DNA, 15 bp, Homo sapiens
ttgccaccatacctc

SEQ ID NO: 674025 - DNA, 17 bp, Homo sapiens
ttgccaggacatgcaat

SEQ ID NO: 674026 - DNA, 15 bp, Homo sapiens
tatacatgtgataca

SEQ ID NO: 674027 - DNA, 20 bp, Homo sapiens
tatacatgtgatacattttt

SEQ ID NO: 674028 - DNA, 15 bp, Homo sapiens
tatacattgtcttga

SEQ ID NO: 674029 - DNA, 21 bp, Homo sapiens
tataccttatttatttttgtg

SEQ ID NO: 674030 - DNA, 15 bp, Homo sapiens
tatacgcttttcttt

SEQ ID NO: 674031 - DNA, 17 bp, Homo sapiens
tatactttgccactgct

SEQ ID NO: 674032 - DNA, 19 bp, Homo sapiens
tatactttgccactgctgt

SEQ ID NO: 674033 - DNA, 22 bp, Homo sapiens
tatagaaaattcttgagaagta

SEQ ID NO: 674034 - DNA, 14 bp, Homo sapiens
tatagactgtacat

SEQ ID NO: 674035 - DNA, 22 bp, Homo sapiens
tatagactgtacattatgaaga

SEQ ID NO: 674036 - DNA, 19 bp, Homo sapiens
tatagattgaaatttccta

SEQ ID NO: 674037 - DNA, 14 bp, Homo sapiens
tatagcaactaatg

SEQ ID NO: 674038 - DNA, 19 bp, Homo sapiens
tatagcattgataatcttc

SEQ ID NO: 674039 - DNA, 15 bp, Homo sapiens
tatagcttgcagaac

SEQ ID NO: 674040 - DNA, 21 bp, Homo sapiens
tataggcctgtcccttgcctc

SEQ ID NO: 674041 - DNA, 20 bp, Homo sapiens
tataggtcctgtgttaaaca

SEQ ID NO: 674042 - DNA, 13 bp, Homo sapiens
tatagtcaaatcg

SEQ ID NO: 674043 - DNA, 20 bp, Homo sapiens
tatagtcccactacttgtgg

SEQ ID NO: 674044 - DNA, 20 bp, Homo sapiens
tatagtctaagactatatat

SEQ ID NO: 674045 - DNA, 13 bp, Homo sapiens
tatagtgcagaaa

SEQ ID NO: 674046 - DNA, 17 bp, Homo sapiens
tatagtgggtacatcaa

SEQ ID NO: 674047 - DNA, 15 bp, Homo sapiens
tatagttaaactgag

SEQ ID NO: 674048 - DNA, 12 bp, Homo sapiens
tatataaatgta

SEQ ID NO: 674049 - DNA, 14 bp, Homo sapiens
tatataacatatat

SEQ ID NO: 674050 - DNA, 17 bp, Homo sapiens
tatataacatatatgga

SEQ ID NO: 674051 - DNA, 13 bp, Homo sapiens
tatatataaatgt

SEQ ID NO: 674052 - DNA, 23 bp, Homo sapiens
tatatataataaatactcagtga

SEQ ID NO: 674053 - DNA, 15 bp, Homo sapiens
tatatatggatcaga

SEQ ID NO: 674054 - DNA, 19 bp, Homo sapiens
tatatatggtcatatacat

SEQ ID NO: 674055 - DNA, 14 bp, Homo sapiens
tatatattaagtgt

SEQ ID NO: 674056 - DNA, 18 bp, Homo sapiens
tatatattttgtgtgaaa

SEQ ID NO: 674057 - DNA, 13 bp, Homo sapiens
tatatcactaaaa

SEQ ID NO: 674058 - DNA, 15 bp, Homo sapiens
tatatcatatgtata

SEQ ID NO: 674059 - DNA, 19 bp, Homo sapiens
tatatctgggttaagtgtt

SEQ ID NO: 674060 - DNA, 17 bp, Homo sapiens
tatatgaggctacagaa

SEQ ID NO: 674061 - DNA, 15 bp, Homo sapiens
tatatggtatatata

SEQ ID NO: 674062 - DNA, 21 bp, Homo sapiens
tatatgtatatttttttaatt

SEQ ID NO: 674063 - DNA, 13 bp, Homo sapiens
tatattaaaacaa

SEQ ID NO: 674064 - DNA, 14 bp, Homo sapiens
tatattaaaacaat

SEQ ID NO: 674065 - DNA, 15 bp, Homo sapiens
tatattaaaacaata

SEQ ID NO: 674066 - DNA, 12 bp, Homo sapiens
tatattaaacat

SEQ ID NO: 674067 - DNA, 13 bp, Homo sapiens
tatattaaacata

SEQ ID NO: 674068 - DNA, 20 bp, Homo sapiens
tatattaagtgtgccaaatc

SEQ ID NO: 674069 - DNA, 16 bp, Homo sapiens
tatattactgacattt

SEQ ID NO: 674070 - DNA, 22 bp, Homo sapiens
tatattcaaattatgtataaat

SEQ ID NO: 674071 - DNA, 13 bp, Homo sapiens
tatattcataaag

SEQ ID NO: 674072 - DNA, 22 bp, Homo sapiens
tatattcatatacaaacatgta

SEQ ID NO: 674073 - DNA, 20 bp, Homo sapiens
tatattctgaccgttaaaaa

SEQ ID NO: 674074 - DNA, 14 bp, Homo sapiens
tatatttcttcttc

SEQ ID NO: 674075 - DNA, 22 bp, Homo sapiens
tatatttgaaatagtatacatt

SEQ ID NO: 674076 - DNA, 21 bp, Homo sapiens
tatatttgattatgtatggat

SEQ ID NO: 674077 - DNA, 17 bp, Homo sapiens
tatatttgtaaagctat

SEQ ID NO: 674078 - DNA, 22 bp, Homo sapiens
tatcaaaagaaaattgatattt

SEQ ID NO: 674079 - DNA, 23 bp, Homo sapiens
tatcaaatacatttaaaacatta

SEQ ID NO: 674080 - DNA, 14 bp, Homo sapiens
tatcaagcaacatt

SEQ ID NO: 674081 - DNA, 16 bp, Homo sapiens
tatcactaaaagcatg

SEQ ID NO: 674082 - DNA, 16 bp, Homo sapiens
tatcatacaaatcagt

SEQ ID NO: 674083 - DNA, 12 bp, Homo sapiens
tatcatagcaaa

SEQ ID NO: 674084 - DNA, 17 bp, Homo sapiens
tatcatatattaaaaca

SEQ ID NO: 674085 - DNA, 19 bp, Homo sapiens
tatcatggtcctgaatgta

SEQ ID NO: 674086 - DNA, 13 bp, Homo sapiens
tatcattaaaaat

SEQ ID NO: 674087 - DNA, 16 bp, Homo sapiens
tatcattaaaaattac

SEQ ID NO: 674088 - DNA, 15 bp, Homo sapiens
tatcattttaaaatg

SEQ ID NO: 674089 - DNA, 21 bp, Homo sapiens
tatcattttaaaatgtcttgg

SEQ ID NO: 674090 - DNA, 22 bp, Homo sapiens
tatccaaaatgtgtatttctta

SEQ ID NO: 674091 - DNA, 20 bp, Homo sapiens
tatccccatctccctgcctg

SEQ ID NO: 674092 - DNA, 22 bp, Homo sapiens
tttaaccattattatgcaaaat

SEQ ID NO: 674093 - DNA, 13 bp, Homo sapiens
tttaagatgtgaa

SEQ ID NO: 674094 - DNA, 14 bp, Homo sapiens
tttaagatgtgaaa

SEQ ID NO: 674095 - DNA, 17 bp, Homo sapiens
tttaagcaagttaagtg

SEQ ID NO: 674096 - DNA, 18 bp, Homo sapiens
tttaagccttcaaaacta

SEQ ID NO: 674097 - DNA, 14 bp, Homo sapiens
tttaagcttcagtt

SEQ ID NO: 674098 - DNA, 21 bp, Homo sapiens
tttaagcttcagttgcttgtc

SEQ ID NO: 674099 - DNA, 19 bp, Homo sapiens
tttaaggtagcttcagcta

SEQ ID NO: 674100 - DNA, 22 bp, Homo sapiens
tttaagtagtgggcatttcata

SEQ ID NO: 674101 - DNA, 14 bp, Homo sapiens
tttaataaactgca

SEQ ID NO: 674102 - DNA, 12 bp, Homo sapiens
tttaataaagct

SEQ ID NO: 674103 - DNA, 16 bp, Homo sapiens
tttaataaagctttat

SEQ ID NO: 674104 - DNA, 12 bp, Homo sapiens
tttaatccagtt

SEQ ID NO: 674105 - DNA, 17 bp, Homo sapiens
tttaatttgtaaaactt

SEQ ID NO: 674106 - DNA, 23 bp, Homo sapiens
tttaatttgtaaaacttctgctc

SEQ ID NO: 674107 - DNA, 13 bp, Homo sapiens
tttacaagatatt

SEQ ID NO: 674108 - DNA, 15 bp, Homo sapiens
tttacagatttctca

SEQ ID NO: 674109 - DNA, 21 bp, Homo sapiens
tttacagctcattaaactttt

SEQ ID NO: 674110 - DNA, 16 bp, Homo sapiens
tttacagtatccaaaa

SEQ ID NO: 674111 - DNA, 13 bp, Homo sapiens
tttaccatcatct

SEQ ID NO: 674112 - DNA, 13 bp, Homo sapiens
tttacccttttcc

SEQ ID NO: 674113 - DNA, 17 bp, Homo sapiens
tttacccttttccccct

SEQ ID NO: 674114 - DNA, 18 bp, Homo sapiens
tttaccttttatgcaaaa

SEQ ID NO: 674115 - DNA, 14 bp, Homo sapiens
tttactaactaaat

SEQ ID NO: 674116 - DNA, 18 bp, Homo sapiens
tttactcctttttattca

SEQ ID NO: 674117 - DNA, 17 bp, Homo sapiens
tttactgcctgaataaa

SEQ ID NO: 674118 - DNA, 13 bp, Homo sapiens
tttagaaactgaa

SEQ ID NO: 674119 - DNA, 13 bp, Homo sapiens
tttagaaatgcat

SEQ ID NO: 674120 - DNA, 11 bp, Homo sapiens
tttagcaagca

SEQ ID NO: 674121 - DNA, 13 bp, Homo sapiens
tttagctggccac

SEQ ID NO: 674122 - DNA, 22 bp, Homo sapiens
tttaggaaaatcactttgtcta

SEQ ID NO: 674123 - DNA, 21 bp, Homo sapiens
tttaggatctcaggcttctgc

SEQ ID NO: 674124 - DNA, 23 bp, Homo sapiens
tttaggatgtgtatttcatttat

SEQ ID NO: 674125 - DNA, 16 bp, Homo sapiens
tttaggcaaagataat

SEQ ID NO: 674126 - DNA, 14 bp, Homo sapiens
tttagtaagtatgt

SEQ ID NO: 674127 - DNA, 17 bp, Homo sapiens
tttataagcattgccat

SEQ ID NO: 674128 - DNA, 20 bp, Homo sapiens
tttatactgggtttcaagaa

SEQ ID NO: 674129 - DNA, 18 bp, Homo sapiens
tttatatcacacaatata

SEQ ID NO: 674130 - DNA, 14 bp, Homo sapiens
tttatatcatttta

SEQ ID NO: 674131 - DNA, 21 bp, Homo sapiens
tttatatcattttaaaatgtc

SEQ ID NO: 674132 - DNA, 22 bp, Homo sapiens
tttatatcattttaaaatgtct

SEQ ID NO: 674133 - DNA, 12 bp, Homo sapiens
tttatatgcttt

SEQ ID NO: 674134 - DNA, 13 bp, Homo sapiens
tttatatgttgta

SEQ ID NO: 674135 - DNA, 15 bp, Homo sapiens
tttatcaactttggt

SEQ ID NO: 674136 - DNA, 17 bp, Homo sapiens
tttatcatggtcctgaa

SEQ ID NO: 674137 - DNA, 17 bp, Homo sapiens
tttatccaaaatgtgta

SEQ ID NO: 674138 - DNA, 20 bp, Homo sapiens
tttatccaaaatgtgtattt

SEQ ID NO: 674139 - DNA, 19 bp, Homo sapiens
tttatccagaaaactgtga

SEQ ID NO: 674140 - DNA, 17 bp, Homo sapiens
tttatgagtctttgaga

SEQ ID NO: 674141 - DNA, 18 bp, Homo sapiens
tttatgcagcaaatatat

SEQ ID NO: 674142 - DNA, 18 bp, Homo sapiens
tttatgggcccctggcac

SEQ ID NO: 674143 - DNA, 18 bp, Homo sapiens
tttatgtttaaaagaaat

SEQ ID NO: 674144 - DNA, 16 bp, Homo sapiens
tttattataaagctta

SEQ ID NO: 674145 - DNA, 18 bp, Homo sapiens
tttattataaagcttaaa

SEQ ID NO: 674146 - DNA, 22 bp, Homo sapiens
tttattataaagcttaaatttt

SEQ ID NO: 674147 - DNA, 20 bp, Homo sapiens
tttattcagaactttagtat

SEQ ID NO: 674148 - DNA, 12 bp, Homo sapiens
tttattgtaaaa

SEQ ID NO: 674149 - DNA, 15 bp, Homo sapiens
tttattgttaataca

SEQ ID NO: 674150 - DNA, 17 bp, Homo sapiens
tttattgttaatacaag

SEQ ID NO: 674151 - DNA, 21 bp, Homo sapiens
tttatttatccagaaaactgt

SEQ ID NO: 674152 - DNA, 11 bp, Homo sapiens
tttattttctt

SEQ ID NO: 674153 - DNA, 18 bp, Homo sapiens
tttattttgagatgtaaa

SEQ ID NO: 674154 - DNA, 15 bp, Homo sapiens
tttatttttgcacaa

SEQ ID NO: 674155 - DNA, 15 bp, Homo sapiens
tttatttttgtgtag

SEQ ID NO: 674156 - DNA, 22 bp, Homo sapiens
tttcaaacaatcaagttgactc

SEQ ID NO: 674157 - DNA, 19 bp, Homo sapiens
tttcaaacttactattttg

SEQ ID NO: 674158 - DNA, 22 bp, Homo sapiens
tttcaaacttactattttgaca

SEQ ID NO: 674159 - DNA, 13 bp, Homo sapiens
tttcaaagcactt

SEQ ID NO: 674160 - DNA, 21 bp, Homo sapiens
tttcaaagttttgttgtactt

SEQ ID NO: 674161 - DNA, 13 bp, Homo sapiens
tttcaagaaaatc

SEQ ID NO: 674162 - DNA, 11 bp, Homo sapiens
tttcaagttta

SEQ ID NO: 674163 - DNA, 20 bp, Homo sapiens
tttcaagtttacacttcata

SEQ ID NO: 674164 - DNA, 20 bp, Homo sapiens
tttcagaaatataacacatt

SEQ ID NO: 674165 - DNA, 17 bp, Homo sapiens
tttcagaagttaacatc

SEQ ID NO: 674166 - DNA, 15 bp, Homo sapiens
tttcagcactgatgg

SEQ ID NO: 674167 - DNA, 14 bp, Homo sapiens
tttcagtgggaaat

SEQ ID NO: 674168 - DNA, 14 bp, Homo sapiens
tttcagtttgttgg

SEQ ID NO: 674169 - DNA, 17 bp, Homo sapiens
tttcataaacaagttcg

SEQ ID NO: 674170 - DNA, 14 bp, Homo sapiens
tttcataatcagta

SEQ ID NO: 674171 - DNA, 23 bp, Homo sapiens
tttcataattgcctacatttatc

SEQ ID NO: 674172 - DNA, 22 bp, Homo sapiens
tttcatccttctttccttgttc

SEQ ID NO: 674173 - DNA, 14 bp, Homo sapiens
tttcatctaccttt

SEQ ID NO: 674174 - DNA, 20 bp, Homo sapiens
tttcatggctgctgttgctt

SEQ ID NO: 674175 - DNA, 16 bp, Homo sapiens
tttcattaaatccttt

SEQ ID NO: 674176 - DNA, 13 bp, Homo sapiens
tttcatttacaaa

SEQ ID NO: 674177 - DNA, 13 bp, Homo sapiens
tttccaaattaaa

SEQ ID NO: 674178 - DNA, 22 bp, Homo sapiens
tttccaggctatgtataaaata

SEQ ID NO: 674179 - DNA, 17 bp, Homo sapiens
tttccatcaactcccaa

SEQ ID NO: 674180 - DNA, 23 bp, Homo sapiens
tttccatcaactcccaacttctt

SEQ ID NO: 674181 - DNA, 14 bp, Homo sapiens
tttcccatgtattt

SEQ ID NO: 674182 - DNA, 23 bp, Homo sapiens
tttcccccttcccatttcttccc

SEQ ID NO: 674183 - DNA, 19 bp, Homo sapiens
tttccgtgaactctggtgc

SEQ ID NO: 674184 - DNA, 23 bp, Homo sapiens
tttcctgatggggaagggacttt

SEQ ID NO: 674185 - DNA, 18 bp, Homo sapiens
tttcctgtgtgtgttgcc

SEQ ID NO: 674186 - DNA, 15 bp, Homo sapiens
tttcctgtttccagg

SEQ ID NO: 674187 - DNA, 16 bp, Homo sapiens
tttccttatttgcctt

SEQ ID NO: 674188 - DNA, 22 bp, Homo sapiens
tttctgtaatgtaaataaacta

SEQ ID NO: 674189 - DNA, 13 bp, Homo sapiens
tttcttacacact

SEQ ID NO: 674190 - DNA, 16 bp, Homo sapiens
tttcttacacactgtc

SEQ ID NO: 674191 - DNA, 13 bp, Homo sapiens
tttcttatcttga

SEQ ID NO: 674192 - DNA, 17 bp, Homo sapiens
tttcttatcttgaccat

SEQ ID NO: 674193 - DNA, 15 bp, Homo sapiens
tttcttcatccaact

SEQ ID NO: 674194 - DNA, 13 bp, Homo sapiens
tttcttcttcatg

SEQ ID NO: 674195 - DNA, 16 bp, Homo sapiens
tttcttcttctaagaa

SEQ ID NO: 674196 - DNA, 18 bp, Homo sapiens
tttcttcttctaagaaga

SEQ ID NO: 674197 - DNA, 13 bp, Homo sapiens
tttcttgaaattg

SEQ ID NO: 674198 - DNA, 14 bp, Homo sapiens
tttcttgaaattga

SEQ ID NO: 674199 - DNA, 17 bp, Homo sapiens
tttctttcccatgtatt

SEQ ID NO: 674200 - DNA, 14 bp, Homo sapiens
tttctttgcctctg

SEQ ID NO: 674201 - DNA, 22 bp, Homo sapiens
tttctttgcctctgcagtctca

SEQ ID NO: 674202 - DNA, 12 bp, Homo sapiens
tttgaaaaatat

SEQ ID NO: 674203 - DNA, 22 bp, Homo sapiens
tttgaaaactctgtgtttggaa

SEQ ID NO: 674204 - DNA, 15 bp, Homo sapiens
tttgaaacaaagtac

SEQ ID NO: 674205 - DNA, 12 bp, Homo sapiens
tttgaaagcttt

SEQ ID NO: 674206 - DNA, 16 bp, Homo sapiens
tttgaaatatggtctt

SEQ ID NO: 674207 - DNA, 21 bp, Homo sapiens
tttgaaatgtttaataaagct

SEQ ID NO: 674208 - DNA, 23 bp, Homo sapiens
tttgaaatgtttaataaagcttt

SEQ ID NO: 674209 - DNA, 19 bp, Homo sapiens
tttgaactggcaattgtct

SEQ ID NO: 674210 - DNA, 22 bp, Homo sapiens
tttgaactggcaattgtctatt

SEQ ID NO: 674211 - DNA, 20 bp, Homo sapiens
tttgaagcagtcttgctctg

SEQ ID NO: 674212 - DNA, 17 bp, Homo sapiens
tttgaagtaacttattt

SEQ ID NO: 674213 - DNA, 14 bp, Homo sapiens
tttgaatatgcctt

SEQ ID NO: 674214 - DNA, 18 bp, Homo sapiens
tttgacagttattttgat

SEQ ID NO: 674215 - DNA, 14 bp, Homo sapiens
tttgagccatttaa

SEQ ID NO: 674216 - DNA, 19 bp, Homo sapiens
tttgaggcaaattaactgt

SEQ ID NO: 674217 - DNA, 14 bp, Homo sapiens
tttgatatatgaaa

SEQ ID NO: 674218 - DNA, 13 bp, Homo sapiens
tttgatatgtagt

SEQ ID NO: 674219 - DNA, 19 bp, Homo sapiens
tttgattatgtatggatat

SEQ ID NO: 674220 - DNA, 14 bp, Homo sapiens
tttgattctgaagt

SEQ ID NO: 674221 - DNA, 16 bp, Homo sapiens
tttgatttctaattgt

SEQ ID NO: 674222 - DNA, 14 bp, Homo sapiens
tttgcactctgtaa

SEQ ID NO: 674223 - DNA, 13 bp, Homo sapiens
tttgcatattttg

SEQ ID NO: 674224 - DNA, 13 bp, Homo sapiens
tttgcatctttgt

SEQ ID NO: 674225 - DNA, 14 bp, Homo sapiens
tttgccactgctgt

SEQ ID NO: 674226 - DNA, 19 bp, Homo sapiens
tttgccagttttccctgga

SEQ ID NO: 674227 - DNA, 14 bp, Homo sapiens
tttgcccttcctcc

SEQ ID NO: 674228 - DNA, 15 bp, Homo sapiens
tttgcccttcctcct

SEQ ID NO: 674229 - DNA, 22 bp, Homo sapiens
tttgcccttcctcctgcctttc

SEQ ID NO: 674230 - DNA, 15 bp, Homo sapiens
tttgctatgtaaggg

SEQ ID NO: 674231 - DNA, 12 bp, Homo sapiens
tttgctcaacag

SEQ ID NO: 674232 - DNA, 17 bp, Homo sapiens
tttgctcttgtttttat

SEQ ID NO: 674233 - DNA, 14 bp, Homo sapiens
tttgctttggaaac

SEQ ID NO: 674234 - DNA, 13 bp, Homo sapiens
tttggacagctga

SEQ ID NO: 674235 - DNA, 18 bp, Homo sapiens
tttggactccatctctca

SEQ ID NO: 674236 - DNA, 15 bp, Homo sapiens
tttggatcttgaatg

SEQ ID NO: 674237 - DNA, 14 bp, Homo sapiens
tttggcaaggaaag

SEQ ID NO: 674238 - DNA, 21 bp, Homo sapiens
tttggcctggggtgcatctcc

SEQ ID NO: 674239 - DNA, 22 bp, Homo sapiens
tttggcctggggtgcatctcct

SEQ ID NO: 674240 - DNA, 12 bp, Homo sapiens
tttgggaagaat

SEQ ID NO: 674241 - DNA, 16 bp, Homo sapiens
tttggggagtacctgt

SEQ ID NO: 674242 - DNA, 14 bp, Homo sapiens
tttgtaaaaatctt

SEQ ID NO: 674243 - DNA, 23 bp, Homo sapiens
tttgtaaaaatcttttgaagcat

SEQ ID NO: 674244 - DNA, 14 bp, Homo sapiens
tttgtaaaacttct

SEQ ID NO: 674245 - DNA, 18 bp, Homo sapiens
tttgtaaaacttctgctc

SEQ ID NO: 674246 - DNA, 13 bp, Homo sapiens
tttgtaagtgtaa

SEQ ID NO: 674247 - DNA, 19 bp, Homo sapiens
tttgtaataataaagaata

SEQ ID NO: 674248 - DNA, 14 bp, Homo sapiens
tttgtaatttttgc

SEQ ID NO: 674249 - DNA, 16 bp, Homo sapiens
tttgtagcataactgt

SEQ ID NO: 674250 - DNA, 20 bp, Homo sapiens
tttgtatattacaacattta

SEQ ID NO: 674251 - DNA, 16 bp, Homo sapiens
tttgtatgttaaagag

SEQ ID NO: 674252 - DNA, 14 bp, Homo sapiens
tttgtcttattctt

SEQ ID NO: 674253 - DNA, 21 bp, Homo sapiens
tttgtgaaacagttgctgtga

SEQ ID NO: 674254 - DNA, 18 bp, Homo sapiens
tttgtgaaggtgatttat

SEQ ID NO: 674255 - DNA, 15 bp, Homo sapiens
tttgtgcaaagccaa

SEQ ID NO: 674256 - DNA, 21 bp, Homo sapiens
tttgtgtaactcccagtgatg

SEQ ID NO: 674257 - DNA, 15 bp, Homo sapiens
tttgttgctttctta

SEQ ID NO: 674258 - DNA, 12 bp, Homo sapiens
tttgttgtttat

SEQ ID NO: 674259 - DNA, 20 bp, Homo sapiens
ttttaaaaacataacataaa

SEQ ID NO: 674260 - DNA, 13 bp, Homo sapiens
ttttaaaaaccta

SEQ ID NO: 674261 - DNA, 19 bp, Homo sapiens
ttttaaaaactcttcagtg

SEQ ID NO: 674262 - DNA, 20 bp, Homo sapiens
ttttaaaaactcttcagtgc

SEQ ID NO: 674263 - DNA, 13 bp, Homo sapiens
ttttaaagtgcaa

SEQ ID NO: 674264 - DNA, 12 bp, Homo sapiens
ttttaaatcatc

SEQ ID NO: 674265 - DNA, 22 bp, Homo sapiens
ttttaaccagtacttctaagag

SEQ ID NO: 674266 - DNA, 13 bp, Homo sapiens
ttttaactttaat

SEQ ID NO: 674267 - DNA, 16 bp, Homo sapiens
ttttaactttaataca

SEQ ID NO: 674268 - DNA, 18 bp, Homo sapiens
ttttaagaaaggaagcaa

SEQ ID NO: 674269 - DNA, 12 bp, Homo sapiens
ttttaagaagac

SEQ ID NO: 674270 - DNA, 15 bp, Homo sapiens
ttttaagatttgtgt

SEQ ID NO: 674271 - DNA, 18 bp, Homo sapiens
ttttaatattcttttgtt

SEQ ID NO: 674272 - DNA, 11 bp, Homo sapiens
ttttaatttga

SEQ ID NO: 674273 - DNA, 19 bp, Homo sapiens
ttttacacattagatttta

SEQ ID NO: 674274 - DNA, 15 bp, Homo sapiens
ttttactctttgaaa

SEQ ID NO: 674275 - DNA, 14 bp, Homo sapiens
ttttagaaatgcat

SEQ ID NO: 674276 - DNA, 20 bp, Homo sapiens
ttttaggaaaatcactttgt

SEQ ID NO: 674277 - DNA, 13 bp, Homo sapiens
ttttaggaactca

SEQ ID NO: 674278 - DNA, 19 bp, Homo sapiens
ttttaggaactcactcttt

SEQ ID NO: 674279 - DNA, 21 bp, Homo sapiens
ttttaggcaaagataatttat

SEQ ID NO: 674280 - DNA, 16 bp, Homo sapiens
cttggaaattcctgta

SEQ ID NO: 674281 - DNA, 15 bp, Homo sapiens
cttggagaccctgca

SEQ ID NO: 674282 - DNA, 18 bp, Homo sapiens
cttggagagggcccaggt

SEQ ID NO: 674283 - DNA, 15 bp, Homo sapiens
cttggccctttcctt

SEQ ID NO: 674284 - DNA, 18 bp, Homo sapiens
cttggctttcctgtttct

SEQ ID NO: 674285 - DNA, 14 bp, Homo sapiens
cttgggaggctgag

SEQ ID NO: 674286 - DNA, 17 bp, Homo sapiens
cttggggcccagtgcat

SEQ ID NO: 674287 - DNA, 16 bp, Homo sapiens
cttggtgccctcgcct

SEQ ID NO: 674288 - DNA, 16 bp, Homo sapiens
cttgtaactaaaataa

SEQ ID NO: 674289 - DNA, 22 bp, Homo sapiens
cttgtaactaaaataattttgt

SEQ ID NO: 674290 - DNA, 23 bp, Homo sapiens
cttgtatatatggatcagaggag

SEQ ID NO: 674291 - DNA, 21 bp, Homo sapiens
cttgtcccgtctggacctggg

SEQ ID NO: 674292 - DNA, 14 bp, Homo sapiens
cttgtccctccaac

SEQ ID NO: 674293 - DNA, 20 bp, Homo sapiens
cttgtgaaacgtctggactg

SEQ ID NO: 674294 - DNA, 17 bp, Homo sapiens
cttgtggttgtgtgtgt

SEQ ID NO: 674295 - DNA, 20 bp, Homo sapiens
cttgtggttgtgtgtgttct

SEQ ID NO: 674296 - DNA, 21 bp, Homo sapiens
cttgtggttgtgtgtgttctg

SEQ ID NO: 674297 - DNA, 21 bp, Homo sapiens
cttgtgttcagctctttccaa

SEQ ID NO: 674298 - DNA, 23 bp, Homo sapiens
cttgtgttcagctctttccaaat

SEQ ID NO: 674299 - DNA, 23 bp, Homo sapiens
cttgttagaaaacaaaattttat

SEQ ID NO: 674300 - DNA, 23 bp, Homo sapiens
cttgttccactgcaaataaagcc

SEQ ID NO: 674301 - DNA, 19 bp, Homo sapiens
cttgttgtctccacttgta

SEQ ID NO: 674302 - DNA, 19 bp, Homo sapiens
cttgtttacctttctctct

SEQ ID NO: 674303 - DNA, 22 bp, Homo sapiens
cttgtttacctttctctctcta

SEQ ID NO: 674304 - DNA, 16 bp, Homo sapiens
cttgtttatgatattt

SEQ ID NO: 674305 - DNA, 19 bp, Homo sapiens
cttgtttggtagttagcca

SEQ ID NO: 674306 - DNA, 17 bp, Homo sapiens
cttgttttggatggctt

SEQ ID NO: 674307 - DNA, 18 bp, Homo sapiens
cttgtttttattaattta

SEQ ID NO: 674308 - DNA, 20 bp, Homo sapiens
ctttaaaacgcgtctgcctg

SEQ ID NO: 674309 - DNA, 15 bp, Homo sapiens
ctttaaacaccccca

SEQ ID NO: 674310 - DNA, 23 bp, Homo sapiens
ctttaaactatgttcctaacaaa

SEQ ID NO: 674311 - DNA, 21 bp, Homo sapiens
ctttaaaggcatctacacaat

SEQ ID NO: 674312 - DNA, 22 bp, Homo sapiens
ctttaacttttttttctctctt

SEQ ID NO: 674313 - DNA, 17 bp, Homo sapiens
ctttaagccttcaaaac

SEQ ID NO: 674314 - DNA, 12 bp, Homo sapiens
ctttaatacagc

SEQ ID NO: 674315 - DNA, 16 bp, Homo sapiens
ctttaatgatatgctt

SEQ ID NO: 674316 - DNA, 22 bp, Homo sapiens
ctttaatgatatgcttgtaact

SEQ ID NO: 674317 - DNA, 21 bp, Homo sapiens
ctttaattacctggtgagtaa

SEQ ID NO: 674318 - DNA, 23 bp, Homo sapiens
ctttactgcctgaataaagagcc

SEQ ID NO: 674319 - DNA, 22 bp, Homo sapiens
ctttaggagatttattttttgg

SEQ ID NO: 674320 - DNA, 19 bp, Homo sapiens
ctttataaggaaatgtatt

SEQ ID NO: 674321 - DNA, 17 bp, Homo sapiens
gaaagtcaaatttactt

SEQ ID NO: 674322 - DNA, 20 bp, Homo sapiens
gaaagtcaaatttactttaa

SEQ ID NO: 674323 - DNA, 15 bp, Homo sapiens
gaaagtgtgagctct

SEQ ID NO: 674324 - DNA, 23 bp, Homo sapiens
gaaagtgtgtgtagttttacttt

SEQ ID NO: 674325 - DNA, 19 bp, Homo sapiens
gaaagtttttttttattat

SEQ ID NO: 674326 - DNA, 18 bp, Homo sapiens
gaaataatatatttcttc

SEQ ID NO: 674327 - DNA, 21 bp, Homo sapiens
gaaataatgctacaattttaa

SEQ ID NO: 674328 - DNA, 18 bp, Homo sapiens
gaaatagacagcatgaga

SEQ ID NO: 674329 - DNA, 19 bp, Homo sapiens
gaaatagtaccttcaatac

SEQ ID NO: 674330 - DNA, 16 bp, Homo sapiens
gaaatggaaagcagag

SEQ ID NO: 674331 - DNA, 21 bp, Homo sapiens
gaaatgtgaatttttattgtt

SEQ ID NO: 674332 - DNA, 19 bp, Homo sapiens
gaaatgtttaataaagctt

SEQ ID NO: 674333 - DNA, 23 bp, Homo sapiens
gaaatgtttaataaagctttata

SEQ ID NO: 674334 - DNA, 18 bp, Homo sapiens
gaaattaaatccaataaa

SEQ ID NO: 674335 - DNA, 23 bp, Homo sapiens
gaaattaagactttatgtagttt

SEQ ID NO: 674336 - DNA, 22 bp, Homo sapiens
gaaattaagcattttgaaacaa

SEQ ID NO: 674337 - DNA, 21 bp, Homo sapiens
gaaattaatatggcttcacca

SEQ ID NO: 674338 - DNA, 22 bp, Homo sapiens
gaaattgactgatgattttcct

SEQ ID NO: 674339 - DNA, 19 bp, Homo sapiens
gaaattgttgtatatcact

SEQ ID NO: 674340 - DNA, 22 bp, Homo sapiens
gaaattgttgtatatcactaaa

SEQ ID NO: 674341 - DNA, 15 bp, Homo sapiens
gaacacattttaaat

SEQ ID NO: 674342 - DNA, 13 bp, Homo sapiens
gaacacccttaga

SEQ ID NO: 674343 - DNA, 20 bp, Homo sapiens
gaacactgtagctacatttt

SEQ ID NO: 674344 - DNA, 21 bp, Homo sapiens
gaacaggaggtgtgaatgcac

SEQ ID NO: 674345 - DNA, 15 bp, Homo sapiens
gaacattggttcttt

SEQ ID NO: 674346 - DNA, 20 bp, Homo sapiens
gaacccgggagcggaggttg

SEQ ID NO: 674347 - DNA, 22 bp, Homo sapiens
gaacctacctgccttggagagg

SEQ ID NO: 674348 - DNA, 15 bp, Homo sapiens
gaacctcagattctt

SEQ ID NO: 674349 - DNA, 18 bp, Homo sapiens
gaacctcagattcttcat

SEQ ID NO: 674350 - DNA, 15 bp, Homo sapiens
gaacctcatccagct

SEQ ID NO: 674351 - DNA, 19 bp, Homo sapiens
gaacgtggtctgattttga

SEQ ID NO: 674352 - DNA, 20 bp, Homo sapiens
gaactcagcacattcgggac

SEQ ID NO: 674353 - DNA, 19 bp, Homo sapiens
gaactctggtgctcctgca

SEQ ID NO: 674354 - DNA, 15 bp, Homo sapiens
gaacttttctgtaat

SEQ ID NO: 674355 - DNA, 13 bp, Homo sapiens
gaagaaaagttat

SEQ ID NO: 674356 - DNA, 14 bp, Homo sapiens
gaagaaaagttatt

SEQ ID NO: 674357 - DNA, 13 bp, Homo sapiens
gaagaaaatgtca

SEQ ID NO: 674358 - DNA, 22 bp, Homo sapiens
gaagaaagtcaaaaaattattt

SEQ ID NO: 674359 - DNA, 13 bp, Homo sapiens
gaagaacatagaa

SEQ ID NO: 674360 - DNA, 17 bp, Homo sapiens
gaagaaccaaatacctc

SEQ ID NO: 674361 - DNA, 18 bp, Homo sapiens
gaagaaccaaatacctca

SEQ ID NO: 674362 - DNA, 17 bp, Homo sapiens
gaagaatccagtattat

SEQ ID NO: 674363 - DNA, 18 bp, Homo sapiens
gaagaattgaaaagtttt

SEQ ID NO: 674364 - DNA, 21 bp, Homo sapiens
gaagaattgaaaagtttttgt

SEQ ID NO: 674365 - DNA, 22 bp, Homo sapiens
gaagaattgaaaagtttttgtt

SEQ ID NO: 674366 - DNA, 14 bp, Homo sapiens
gaagacattttgtt

SEQ ID NO: 674367 - DNA, 20 bp, Homo sapiens
gaagacgggaggggaggcat

SEQ ID NO: 674368 - DNA, 15 bp, Homo sapiens
gaagagaaaggactc

SEQ ID NO: 674369 - DNA, 24 bp, Homo sapiens
gaagagaagtgaccgagagaacct

SEQ ID NO: 674370 - DNA, 14 bp, Homo sapiens
gaagaggggcagct

SEQ ID NO: 674371 - DNA, 16 bp, Homo sapiens
gaagaggggcagcttt

SEQ ID NO: 674372 - DNA, 18 bp, Homo sapiens
gaagagggtgtgtttgaa

SEQ ID NO: 674373 - DNA, 20 bp, Homo sapiens
gaagagttcccttgaaactt

SEQ ID NO: 674374 - DNA, 19 bp, Homo sapiens
gaagcaaagttcaacttat

SEQ ID NO: 674375 - DNA, 20 bp, Homo sapiens
gaagcactacaccttgcctt

SEQ ID NO: 674376 - DNA, 23 bp, Homo sapiens
gaagcactttgggattctttcca

SEQ ID NO: 674377 - DNA, 16 bp, Homo sapiens
gaagcagaagacggga

SEQ ID NO: 674378 - DNA, 15 bp, Homo sapiens
gaagcagtcttgctc

SEQ ID NO: 674379 - DNA, 13 bp, Homo sapiens
gaagccaccctgg

SEQ ID NO: 674380 - DNA, 14 bp, Homo sapiens
gaagccaccctggg

SEQ ID NO: 674381 - DNA, 16 bp, Homo sapiens
gaagccccgacacacg

SEQ ID NO: 674382 - DNA, 14 bp, Homo sapiens
gaagccttagccag

SEQ ID NO: 674383 - DNA, 20 bp, Homo sapiens
gaagcggccctaagggagtg

SEQ ID NO: 674384 - DNA, 14 bp, Homo sapiens
gaagctgctccagg

SEQ ID NO: 674385 - DNA, 22 bp, Homo sapiens
gaaggattcagtcataaagagg

SEQ ID NO: 674386 - DNA, 20 bp, Homo sapiens
gaaggcagacagcaggcagc

SEQ ID NO: 674387 - DNA, 14 bp, Homo sapiens
gaaggcctccctct

SEQ ID NO: 674388 - DNA, 19 bp, Homo sapiens
gaagggaatcctcctccag

SEQ ID NO: 674389 - DNA, 12 bp, Homo sapiens
gaagggccagca

SEQ ID NO: 674390 - DNA, 14 bp, Homo sapiens
gaaggtcaaggtca

SEQ ID NO: 674391 - DNA, 22 bp, Homo sapiens
gaaggtttgtgttttctctgga

SEQ ID NO: 674392 - DNA, 23 bp, Homo sapiens
gaagtgagcagtcgcctgcctgc

SEQ ID NO: 674393 - DNA, 15 bp, Homo sapiens
gaagtgcgtgaatgt

SEQ ID NO: 674394 - DNA, 21 bp, Homo sapiens
gaagtgcgtgaatgtatgtaa

SEQ ID NO: 674395 - DNA, 22 bp, Homo sapiens
gaagttttaactttaatacagc

SEQ ID NO: 674396 - DNA, 12 bp, Homo sapiens
gaagttttccta

SEQ ID NO: 674397 - DNA, 17 bp, Homo sapiens
gaataaattatggcatt

SEQ ID NO: 674398 - DNA, 22 bp, Homo sapiens
gaataaattatggcatttctat

SEQ ID NO: 674399 - DNA, 23 bp, Homo sapiens
gaataagacaagagatctacaca

SEQ ID NO: 674400 - DNA, 19 bp, Homo sapiens
gaataatatcaaataaaat

SEQ ID NO: 674401 - DNA, 20 bp, Homo sapiens
gaataatatcaaataaaata

SEQ ID NO: 674402 - DNA, 19 bp, Homo sapiens
gaataatcaaatacatttt

SEQ ID NO: 674403 - DNA, 19 bp, Homo sapiens
gaataccacatcaaataag

SEQ ID NO: 674404 - DNA, 16 bp, Homo sapiens
gaatacccaggaagac

SEQ ID NO: 674405 - DNA, 17 bp, Homo sapiens
gaatagaagctaaggtt

SEQ ID NO: 674406 - DNA, 17 bp, Homo sapiens
gagaatgctggcaaagg

SEQ ID NO: 674407 - DNA, 20 bp, Homo sapiens
gagaatggtgtgaacccggg

SEQ ID NO: 674408 - DNA, 21 bp, Homo sapiens
gagaatggtgtgaacccggga

SEQ ID NO: 674409 - DNA, 13 bp, Homo sapiens
gagaattggctca

SEQ ID NO: 674410 - DNA, 15 bp, Homo sapiens
gagacagactagaag

SEQ ID NO: 674411 - DNA, 17 bp, Homo sapiens
gagaccctgtctcaata

SEQ ID NO: 674412 - DNA, 19 bp, Homo sapiens
gagacggtttccagggagg

SEQ ID NO: 674413 - DNA, 16 bp, Homo sapiens
gagactctagggtcca

SEQ ID NO: 674414 - DNA, 13 bp, Homo sapiens
gagactgtccctg

SEQ ID NO: 674415 - DNA, 19 bp, Homo sapiens
gagactttccgactgcttt

SEQ ID NO: 674416 - DNA, 17 bp, Homo sapiens
gagagaagcaagccagc

SEQ ID NO: 674417 - DNA, 16 bp, Homo sapiens
gagagaattggctcaa

SEQ ID NO: 674418 - DNA, 17 bp, Homo sapiens
gagagaattggctcaat

SEQ ID NO: 674419 - DNA, 16 bp, Homo sapiens
gagagcctcgcttttt

SEQ ID NO: 674420 - DNA, 22 bp, Homo sapiens
gagagggacatagaatctgtga

SEQ ID NO: 674421 - DNA, 19 bp, Homo sapiens
gagaggtgattctcagggc

SEQ ID NO: 674422 - DNA, 17 bp, Homo sapiens
gagagtacaccctttcc

SEQ ID NO: 674423 - DNA, 19 bp, Homo sapiens
gagataagtaggctggttt

SEQ ID NO: 674424 - DNA, 19 bp, Homo sapiens
gagatcgagaccatcctgg

SEQ ID NO: 674425 - DNA, 22 bp, Homo sapiens
gagatcgagaccatcctggcta

SEQ ID NO: 674426 - DNA, 22 bp, Homo sapiens
gagatcgtacctattgcactcc

SEQ ID NO: 674427 - DNA, 21 bp, Homo sapiens
gagatcgtgctactgcactcc

SEQ ID NO: 674428 - DNA, 17 bp, Homo sapiens
gagatctacacatgttg

SEQ ID NO: 674429 - DNA, 16 bp, Homo sapiens
gagatgagttttagga

SEQ ID NO: 674430 - DNA, 16 bp, Homo sapiens
gagatgctgagggtgt

SEQ ID NO: 674431 - DNA, 16 bp, Homo sapiens
gagatgggccaggcag

SEQ ID NO: 674432 - DNA, 17 bp, Homo sapiens
gagatgggccaggcaga

SEQ ID NO: 674433 - DNA, 19 bp, Homo sapiens
gagcagaggaggggaaagt

SEQ ID NO: 674434 - DNA, 16 bp, Homo sapiens
gagcagcagcttctcc

SEQ ID NO: 674435 - DNA, 18 bp, Homo sapiens
gagcagggaaggcctgac

SEQ ID NO: 674436 - DNA, 18 bp, Homo sapiens
gagcagtcactgggagag

SEQ ID NO: 674437 - DNA, 15 bp, Homo sapiens
gagcagtcgcctgcc

SEQ ID NO: 674438 - DNA, 12 bp, Homo sapiens
gagcatgtaagt

SEQ ID NO: 674439 - DNA, 22 bp, Homo sapiens
gagccaaagcttatgtgacatg

SEQ ID NO: 674440 - DNA, 11 bp, Homo sapiens
gagccctctcc

SEQ ID NO: 674441 - DNA, 16 bp, Homo sapiens
gagccctctcctccct

SEQ ID NO: 674442 - DNA, 11 bp, Homo sapiens
gagcctcctgg

SEQ ID NO: 674443 - DNA, 13 bp, Homo sapiens
gagcctgcaggga

SEQ ID NO: 674444 - DNA, 16 bp, Homo sapiens
gagcctgcagggaagc

SEQ ID NO: 674445 - DNA, 12 bp, Homo sapiens
gagcctggggtg

SEQ ID NO: 674446 - DNA, 13 bp, Homo sapiens
gagccttttgctc

SEQ ID NO: 674447 - DNA, 17 bp, Homo sapiens
gagccttttgctctctg

SEQ ID NO: 674448 - DNA, 15 bp, Homo sapiens
gagcgagaccctgtc

SEQ ID NO: 674449 - DNA, 12 bp, Homo sapiens
gagcgcaggcag

SEQ ID NO: 674450 - DNA, 13 bp, Homo sapiens
gagcgcaggcagc

SEQ ID NO: 674451 - DNA, 15 bp, Homo sapiens
gagcgcaggcagcgc

SEQ ID NO: 674452 - DNA, 22 bp, Homo sapiens
gagcgcaggcagcgcagggctg

SEQ ID NO: 674453 - DNA, 22 bp, Homo sapiens
gagctaagggtgggtgctcaga

SEQ ID NO: 674454 - DNA, 23 bp, Homo sapiens
gagctaagggtgggtgctcagaa

SEQ ID NO: 674455 - DNA, 16 bp, Homo sapiens
gagctctgaaatcttc

SEQ ID NO: 674456 - DNA, 12 bp, Homo sapiens
gagctcttccta

SEQ ID NO: 674457 - DNA, 23 bp, Homo sapiens
gagctgggcccgacatggctccg

SEQ ID NO: 674458 - DNA, 16 bp, Homo sapiens
gagctgtcaccaagga

SEQ ID NO: 674459 - DNA, 13 bp, Homo sapiens
gagcttggacagt

SEQ ID NO: 674460 - DNA, 16 bp, Homo sapiens
gagcttggactacaca

SEQ ID NO: 674461 - DNA, 21 bp, Homo sapiens
gaggaaaggtgacttcctctg

SEQ ID NO: 674462 - DNA, 18 bp, Homo sapiens
gaggacaagagaaaaaag

SEQ ID NO: 674463 - DNA, 14 bp, Homo sapiens
gaggaccagggcct

SEQ ID NO: 674464 - DNA, 15 bp, Homo sapiens
gaggagaaatgcaat

SEQ ID NO: 674465 - DNA, 21 bp, Homo sapiens
gaggagaaatgcaataactct

SEQ ID NO: 674466 - DNA, 16 bp, Homo sapiens
gaggagcgcaggcagc

SEQ ID NO: 674467 - DNA, 19 bp, Homo sapiens
gaggaggatgtccctgggc

SEQ ID NO: 674468 - DNA, 21 bp, Homo sapiens
gaggaggatgtccctgggcca

SEQ ID NO: 674469 - DNA, 23 bp, Homo sapiens
gaggaggatgtccctgggccagg

SEQ ID NO: 674470 - DNA, 22 bp, Homo sapiens
gaggatgtataaaatggtcatg

SEQ ID NO: 674471 - DNA, 16 bp, Homo sapiens
gaggcaaattaactgt

SEQ ID NO: 674472 - DNA, 16 bp, Homo sapiens
gaggcaggcatggccc

SEQ ID NO: 674473 - DNA, 18 bp, Homo sapiens
gaggcaggcatggccctg

SEQ ID NO: 674474 - DNA, 12 bp, Homo sapiens
gaggccccaggg

SEQ ID NO: 674475 - DNA, 14 bp, Homo sapiens
gaggccccaggggg

SEQ ID NO: 674476 - DNA, 21 bp, Homo sapiens
gaggccctcctgtgctggggg

SEQ ID NO: 674477 - DNA, 14 bp, Homo sapiens
gaggccgaggcggg

SEQ ID NO: 674478 - DNA, 14 bp, Homo sapiens
gaggcctgcacagg

SEQ ID NO: 674479 - DNA, 19 bp, Homo sapiens
gaggcctgcgaccctgggg

SEQ ID NO: 674480 - DNA, 14 bp, Homo sapiens
gaggcctgtcccaa

SEQ ID NO: 674481 - DNA, 15 bp, Homo sapiens
gaggctgcccctctc

SEQ ID NO: 674482 - DNA, 19 bp, Homo sapiens
gaggctgcccctctcacca

SEQ ID NO: 674483 - DNA, 15 bp, Homo sapiens
gagggacatagaatc

SEQ ID NO: 674484 - DNA, 20 bp, Homo sapiens
gagggacatagaatctgtga

SEQ ID NO: 674485 - DNA, 15 bp, Homo sapiens
gagggacggccaaga

SEQ ID NO: 674486 - DNA, 21 bp, Homo sapiens
gagggcagactggggcatcct

SEQ ID NO: 674487 - DNA, 22 bp, Homo sapiens
gaggggccggccctgtgtgcag

SEQ ID NO: 674488 - DNA, 14 bp, Homo sapiens
gagggggccgggcg

SEQ ID NO: 674489 - DNA, 21 bp, Homo sapiens
gagggggccgggcgcggtggc

SEQ ID NO: 674490 - DNA, 15 bp, Homo sapiens
gagggggcctcattg

SEQ ID NO: 674491 - DNA, 17 bp, Homo sapiens
gagggtctcccctcctg

SEQ ID NO: 674492 - DNA, 19 bp, Homo sapiens
gagggtctcccctcctgca

SEQ ID NO: 674493 - DNA, 23 bp, Homo sapiens
gaggtcagggagtgctggctcac

SEQ ID NO: 674494 - DNA, 16 bp, Homo sapiens
gaggtcctttggacag

SEQ ID NO: 674495 - DNA, 18 bp, Homo sapiens
gaggtcctttggacagct

SEQ ID NO: 674496 - DNA, 13 bp, Homo sapiens
gaggtgaaatggg

SEQ ID NO: 674497 - DNA, 13 bp, Homo sapiens
gaggtgattccag

SEQ ID NO: 674498 - DNA, 20 bp, Homo sapiens
gaggtgattctcagggctgg

SEQ ID NO: 674499 - DNA, 15 bp, Homo sapiens
gaggttgcagtgagc

SEQ ID NO: 674500 - DNA, 19 bp, Homo sapiens
gaggtttagcaatagctag

SEQ ID NO: 674501 - DNA, 12 bp, Homo sapiens
gagtattttaag

SEQ ID NO: 674502 - DNA, 12 bp, Homo sapiens
gagtatttttgg

SEQ ID NO: 674503 - DNA, 16 bp, Homo sapiens
gagtcagccaggagct

SEQ ID NO: 674504 - DNA, 21 bp, Homo sapiens
gagtcatgttgaaggtgccca

SEQ ID NO: 674505 - DNA, 20 bp, Homo sapiens
gagtctttgagactaaattc

SEQ ID NO: 674506 - DNA, 12 bp, Homo sapiens
gagtgactctgg

SEQ ID NO: 674507 - DNA, 18 bp, Homo sapiens
gagtgacttattttgtct

SEQ ID NO: 674508 - DNA, 18 bp, Homo sapiens
gagtgccttttgcagaag

SEQ ID NO: 674509 - DNA, 19 bp, Homo sapiens
gagtggcgtggcctcccca

SEQ ID NO: 674510 - DNA, 13 bp, Homo sapiens
gagtggttaggca

SEQ ID NO: 674511 - DNA, 17 bp, Homo sapiens
gagtgtagactgtggct

SEQ ID NO: 674512 - DNA, 13 bp, Homo sapiens
gagtgtatgagta

SEQ ID NO: 674513 - DNA, 17 bp, Homo sapiens
gagtgtgacagggccag

SEQ ID NO: 674514 - DNA, 20 bp, Homo sapiens
gagtgtgcatggaggccctc

SEQ ID NO: 674515 - DNA, 17 bp, Homo sapiens
gagttattttttgtatt

SEQ ID NO: 674516 - DNA, 16 bp, Homo sapiens
gagtttccaaaaccag

SEQ ID NO: 674517 - DNA, 16 bp, Homo sapiens
gagttttcattaaatc

SEQ ID NO: 674518 - DNA, 16 bp, Homo sapiens
gataaaataaataatt

SEQ ID NO: 674519 - DNA, 17 bp, Homo sapiens
gataaaataaataattt

SEQ ID NO: 674520 - DNA, 13 bp, Homo sapiens
gataaatttaatc

SEQ ID NO: 674521 - DNA, 22 bp, Homo sapiens
gataatattgtttggtaaatgt

SEQ ID NO: 674522 - DNA, 13 bp, Homo sapiens
gataatcttcagg

SEQ ID NO: 674523 - DNA, 15 bp, Homo sapiens
gatacaggaattatt

SEQ ID NO: 674524 - DNA, 17 bp, Homo sapiens
gatagtgggatttccag

SEQ ID NO: 674525 - DNA, 19 bp, Homo sapiens
gatagtgggatttccagaa

SEQ ID NO: 674526 - DNA, 18 bp, Homo sapiens
gatataaatttttaagag

SEQ ID NO: 674527 - DNA, 21 bp, Homo sapiens
gatataaatttttaagagaaa

SEQ ID NO: 674528 - DNA, 18 bp, Homo sapiens
gatatccttatcagagct

SEQ ID NO: 674529 - DNA, 13 bp, Homo sapiens
gatctctcttgtc

SEQ ID NO: 674530 - DNA, 16 bp, Homo sapiens
gatctctcttgtcctc

SEQ ID NO: 674531 - DNA, 23 bp, Homo sapiens
gatctctcttgtcctcttctgct

SEQ ID NO: 674532 - DNA, 18 bp, Homo sapiens
gatctctgtagaaggagt

SEQ ID NO: 674533 - DNA, 16 bp, Homo sapiens
gatctgaattaaataa

SEQ ID NO: 674534 - DNA, 14 bp, Homo sapiens
gatcttgaatgtgg

SEQ ID NO: 674535 - DNA, 18 bp, Homo sapiens
gatctttcagaaatataa

SEQ ID NO: 674536 - DNA, 13 bp, Homo sapiens
gatgaaaaagaat

SEQ ID NO: 674537 - DNA, 20 bp, Homo sapiens
gatgaagtcacccctttctg

SEQ ID NO: 674538 - DNA, 14 bp, Homo sapiens
gatgactgctgatt

SEQ ID NO: 674539 - DNA, 22 bp, Homo sapiens
gatgacttagcgtcaagacatt

SEQ ID NO: 674540 - DNA, 18 bp, Homo sapiens
gatgccactcctccctcc

SEQ ID NO: 674541 - DNA, 18 bp, Homo sapiens
gatgctatggaacataaa

SEQ ID NO: 674542 - DNA, 18 bp, Homo sapiens
gatggaaaaactgaggct

SEQ ID NO: 674543 - DNA, 15 bp, Homo sapiens
gatggaaaaggaaga

SEQ ID NO: 674544 - DNA, 18 bp, Homo sapiens
gatggaaaagtgtccttc

SEQ ID NO: 674545 - DNA, 22 bp, Homo sapiens
gatggagtttctctagaagctc

SEQ ID NO: 674546 - DNA, 11 bp, Homo sapiens
gatggcagagg

SEQ ID NO: 674547 - DNA, 20 bp, Homo sapiens
gatggtgtagccctcccact

SEQ ID NO: 674548 - DNA, 16 bp, Homo sapiens
gatggttttaaacttt

SEQ ID NO: 674549 - DNA, 13 bp, Homo sapiens
gatgtaattttgt

SEQ ID NO: 674550 - DNA, 23 bp, Homo sapiens
gatgtgcatttttgtgaaatgaa

SEQ ID NO: 674551 - DNA, 13 bp, Homo sapiens
gatgtgtcctcag

SEQ ID NO: 674552 - DNA, 21 bp, Homo sapiens
gatgttacaagtttatatata

SEQ ID NO: 674553 - DNA, 22 bp, Homo sapiens
gatgttctgcctctccctgggt

SEQ ID NO: 674554 - DNA, 21 bp, Homo sapiens
gatgttttttctgtaatgtaa

SEQ ID NO: 674555 - DNA, 17 bp, Homo sapiens
gattaacttatttagag

SEQ ID NO: 674556 - DNA, 19 bp, Homo sapiens
gattaacttatttagagat

SEQ ID NO: 674557 - DNA, 11 bp, Homo sapiens
gattaagaaac

SEQ ID NO: 674558 - DNA, 12 bp, Homo sapiens
gattagaaacta

SEQ ID NO: 674559 - DNA, 14 bp, Homo sapiens
gattctcagggctg

SEQ ID NO: 674560 - DNA, 15 bp, Homo sapiens
gattctcagggctgg

SEQ ID NO: 674561 - DNA, 23 bp, Homo sapiens
gattctgaccttaaatgcaacca

SEQ ID NO: 674562 - DNA, 23 bp, Homo sapiens
gattgactaactcaaatacacat

SEQ ID NO: 674563 - DNA, 19 bp, Homo sapiens
gattgatatctataaaata

SEQ ID NO: 674564 - DNA, 15 bp, Homo sapiens
gattgctgcaaagat

SEQ ID NO: 674565 - DNA, 22 bp, Homo sapiens
gatttaagggatggaaaaggaa

SEQ ID NO: 674566 - DNA, 15 bp, Homo sapiens
gatttaaggtattta

SEQ ID NO: 674567 - DNA, 16 bp, Homo sapiens
gatttaatttgaaata

SEQ ID NO: 674568 - DNA, 14 bp, Homo sapiens
gatttagcaagcaa

SEQ ID NO: 674569 - DNA, 20 bp, Homo sapiens
gatttagcaagcaactaatt

SEQ ID NO: 674570 - DNA, 14 bp, Homo sapiens
gatttataaacaga

SEQ ID NO: 674571 - DNA, 15 bp, Homo sapiens
gatttcaagatcctc

SEQ ID NO: 674572 - DNA, 23 bp, Homo sapiens
gatttcatacctcagaatgtaaa

SEQ ID NO: 674573 - DNA, 23 bp, Homo sapiens
gatttctcactatatatatttct

SEQ ID NO: 674574 - DNA, 15 bp, Homo sapiens
gatttctcattgact

SEQ ID NO: 674575 - DNA, 11 bp, Homo sapiens
gatttgtagca

SEQ ID NO: 674576 - DNA, 18 bp, Homo sapiens
gatttgtgtttttctttt

SEQ ID NO: 674577 - DNA, 15 bp, Homo sapiens
gattttcatttcatg

SEQ ID NO: 674578 - DNA, 11 bp, Homo sapiens
gattttgcaaa

SEQ ID NO: 674579 - DNA, 17 bp, Homo sapiens
gattttggataataaac

SEQ ID NO: 674580 - DNA, 20 bp, Homo sapiens
gattttttactgccctttca

SEQ ID NO: 674581 - DNA, 13 bp, Homo sapiens
gatttttttcctg

SEQ ID NO: 674582 - DNA, 17 bp, Homo sapiens
gcaaaatttagaagaaa

SEQ ID NO: 674583 - DNA, 15 bp, Homo sapiens
gcaaacagaacaggg

SEQ ID NO: 674584 - DNA, 14 bp, Homo sapiens
gcaaagaaaggaga

SEQ ID NO: 674585 - DNA, 14 bp, Homo sapiens
gcaaagctggttgt

SEQ ID NO: 674586 - DNA, 19 bp, Homo sapiens
gcaaataaagccttttaaa

SEQ ID NO: 674587 - DNA, 12 bp, Homo sapiens
gcaaatatatga

SEQ ID NO: 674588 - DNA, 14 bp, Homo sapiens
gcaaatatatgatt

SEQ ID NO: 674589 - DNA, 19 bp, Homo sapiens
gcaaatgacagatttctgt

SEQ ID NO: 674590 - DNA, 19 bp, Homo sapiens
gcaaattaactgtatgtgt

SEQ ID NO: 674591 - DNA, 16 bp, Homo sapiens
gcaaattgtatcttat

SEQ ID NO: 674592 - DNA, 14 bp, Homo sapiens
gcaaattttaactg

SEQ ID NO: 674593 - DNA, 23 bp, Homo sapiens
gcaacagatagatgttgctcttt

SEQ ID NO: 674594 - DNA, 20 bp, Homo sapiens
gcaacatttgacaaaactaa

SEQ ID NO: 674595 - DNA, 13 bp, Homo sapiens
gcaagataatttt

SEQ ID NO: 674596 - DNA, 9 bp, Homo sapiens
gcaaggaaa

SEQ ID NO: 674597 - DNA, 15 bp, Homo sapiens
gcaagttcatgtgtg

SEQ ID NO: 674598 - DNA, 13 bp, Homo sapiens
gcaataaaattta

SEQ ID NO: 674599 - DNA, 16 bp, Homo sapiens
gcaataactctgggag

SEQ ID NO: 674600 - DNA, 23 bp, Homo sapiens
gcaatggtgtcagtatccaggct

SEQ ID NO: 674601 - DNA, 17 bp, Homo sapiens
gcaattagtctgaaact

SEQ ID NO: 674602 - DNA, 13 bp, Homo sapiens
gcaatttgagcca

SEQ ID NO: 674603 - DNA, 14 bp, Homo sapiens
gcaatttgagccat

SEQ ID NO: 674604 - DNA, 15 bp, Homo sapiens
gcacacactgaccac

SEQ ID NO: 674605 - DNA, 12 bp, Homo sapiens
gcacacagggca

SEQ ID NO: 674606 - DNA, 11 bp, Homo sapiens
gcacactattt

SEQ ID NO: 674607 - DNA, 16 bp, Homo sapiens
gcacagaacaggaggt

SEQ ID NO: 674608 - DNA, 14 bp, Homo sapiens
gcacagctgggagc

SEQ ID NO: 674609 - DNA, 20 bp, Homo sapiens
gcacaggaggcaggcatggc

SEQ ID NO: 674610 - DNA, 23 bp, Homo sapiens
gcacagggaaaattgccccatcc

SEQ ID NO: 674611 - DNA, 23 bp, Homo sapiens
gcaccacgggacatcacagggtg

SEQ ID NO: 674612 - DNA, 20 bp, Homo sapiens
gcacccctgagccagcaggg

SEQ ID NO: 674613 - DNA, 15 bp, Homo sapiens
gcaccgtcctcagca

SEQ ID NO: 674614 - DNA, 17 bp, Homo sapiens
gcacctgtagtcccagc

SEQ ID NO: 674615 - DNA, 14 bp, Homo sapiens
gcaccttgtgcctg

SEQ ID NO: 674616 - DNA, 19 bp, Homo sapiens
gcaccttgtgcctggggtg

SEQ ID NO: 674617 - DNA, 17 bp, Homo sapiens
gcactaaagttagtaaa

SEQ ID NO: 674618 - DNA, 15 bp, Homo sapiens
gcactccagcctggg

SEQ ID NO: 674619 - DNA, 19 bp, Homo sapiens
gcactccagcctgggggac

SEQ ID NO: 674620 - DNA, 17 bp, Homo sapiens
gcactgatgttgtgttt

SEQ ID NO: 674621 - DNA, 12 bp, Homo sapiens
gcactggcccag

SEQ ID NO: 674622 - DNA, 21 bp, Homo sapiens
gcacttatctcgaatttgaag

SEQ ID NO: 674623 - DNA, 20 bp, Homo sapiens
gcacttgattaagcttttgt

SEQ ID NO: 674624 - DNA, 14 bp, Homo sapiens
gcacttttagaaat

SEQ ID NO: 674625 - DNA, 12 bp, Homo sapiens
gcagaagagggt

SEQ ID NO: 674626 - DNA, 16 bp, Homo sapiens
gcagaagagggtgtgt

SEQ ID NO: 674627 - DNA, 21 bp, Homo sapiens
gcagaagcaagggggtgatgt

SEQ ID NO: 674628 - DNA, 15 bp, Homo sapiens
gcagaagccctgatg

SEQ ID NO: 674629 - DNA, 17 bp, Homo sapiens
gcagacagaagtctcct

SEQ ID NO: 674630 - DNA, 20 bp, Homo sapiens
gcagacagcaggcagcgcca

SEQ ID NO: 674631 - DNA, 13 bp, Homo sapiens
gcccacctgctcc

SEQ ID NO: 674632 - DNA, 20 bp, Homo sapiens
gcccacctgctcccaggccc

SEQ ID NO: 674633 - DNA, 23 bp, Homo sapiens
gcccacgagggtctcccctcctg

SEQ ID NO: 674634 - DNA, 20 bp, Homo sapiens
gcccagcctcacttcctttg

SEQ ID NO: 674635 - DNA, 17 bp, Homo sapiens
gcccagctaatttttgt

SEQ ID NO: 674636 - DNA, 23 bp, Homo sapiens
gcccaggtcaccaagcagtggcc

SEQ ID NO: 674637 - DNA, 15 bp, Homo sapiens
gcccatcctgactga

SEQ ID NO: 674638 - DNA, 14 bp, Homo sapiens
gcccatggccccca

SEQ ID NO: 674639 - DNA, 18 bp, Homo sapiens
gcccatggcccccaataa

SEQ ID NO: 674640 - DNA, 21 bp, Homo sapiens
gcccatggcccccaataaagg

SEQ ID NO: 674641 - DNA, 20 bp, Homo sapiens
gccttttgctctctgtgacc

SEQ ID NO: 674642 - DNA, 14 bp, Homo sapiens
gcctttttggcctg

SEQ ID NO: 674643 - DNA, 17 bp, Homo sapiens
gcgaagacccggccagg

SEQ ID NO: 674644 - DNA, 19 bp, Homo sapiens
gcgaagaccctcttgccca

SEQ ID NO: 674645 - DNA, 22 bp, Homo sapiens
gcgaagaccctcttgcccatcc

SEQ ID NO: 674646 - DNA, 19 bp, Homo sapiens
gcgagaggtgagctacttt

SEQ ID NO: 674647 - DNA, 20 bp, Homo sapiens
gcgattctggataaagccac

SEQ ID NO: 674648 - DNA, 14 bp, Homo sapiens
gcgcaggcagcgca

SEQ ID NO: 674649 - DNA, 17 bp, Homo sapiens
gcgcctttttggcctgt

SEQ ID NO: 674650 - DNA, 11 bp, Homo sapiens
gcgctgcaaat

SEQ ID NO: 674651 - DNA, 20 bp, Homo sapiens
gcggatactcttggagagtt

SEQ ID NO: 674652 - DNA, 20 bp, Homo sapiens
gcggatctctggagtgagct

SEQ ID NO: 674653 - DNA, 14 bp, Homo sapiens
gcggctgcacaaca

SEQ ID NO: 674654 - DNA, 12 bp, Homo sapiens
gcgggtgtcaca

SEQ ID NO: 674655 - DNA, 14 bp, Homo sapiens
gcgtcaagacattt

SEQ ID NO: 674656 - DNA, 16 bp, Homo sapiens
gcgtccagctcagccc

SEQ ID NO: 674657 - DNA, 20 bp, Homo sapiens
gcgtccagctcagccctggc

SEQ ID NO: 674658 - DNA, 12 bp, Homo sapiens
gcgtccctggcg

SEQ ID NO: 674659 - DNA, 12 bp, Homo sapiens
gcgtctccctcg

SEQ ID NO: 674660 - DNA, 15 bp, Homo sapiens
gcgtgatggcaggtg

SEQ ID NO: 674661 - DNA, 20 bp, Homo sapiens
gcgtgccgtgtgagtgtgac

SEQ ID NO: 674662 - DNA, 22 bp, Homo sapiens
gcgtgccgtgtgagtgtgacag

SEQ ID NO: 674663 - DNA, 17 bp, Homo sapiens
gcgtggagggaggcccc

SEQ ID NO: 674664 - DNA, 15 bp, Homo sapiens
gcgtgggagccagcc

SEQ ID NO: 674665 - DNA, 16 bp, Homo sapiens
gcgtgggagccagcct

SEQ ID NO: 674666 - DNA, 14 bp, Homo sapiens
gcgtgtaagcttgt

SEQ ID NO: 674667 - DNA, 16 bp, Homo sapiens
gcgtgtgcctgtgtgc

SEQ ID NO: 674668 - DNA, 14 bp, Homo sapiens
gcgttaagggcaga

SEQ ID NO: 674669 - DNA, 21 bp, Homo sapiens
gctaagggtgggtgctcagaa

SEQ ID NO: 674670 - DNA, 23 bp, Homo sapiens
gctaatttagagataggaaactg

SEQ ID NO: 674671 - DNA, 17 bp, Homo sapiens
gctaatttttgtatttt

SEQ ID NO: 674672 - DNA, 18 bp, Homo sapiens
gctacactgagcagggag

SEQ ID NO: 674673 - DNA, 21 bp, Homo sapiens
gctacagaaaccacagtcttc

SEQ ID NO: 674674 - DNA, 20 bp, Homo sapiens
gctaccagaagaggggcagc

SEQ ID NO: 674675 - DNA, 13 bp, Homo sapiens
gctacctccctcc

SEQ ID NO: 674676 - DNA, 14 bp, Homo sapiens
gctacctctctgtc

SEQ ID NO: 674677 - DNA, 22 bp, Homo sapiens
gctacctctctgtcccttgctg

SEQ ID NO: 674678 - DNA, 17 bp, Homo sapiens
gctacctttcaaagctt

SEQ ID NO: 674679 - DNA, 21 bp, Homo sapiens
gctactaagttcacattagaa

SEQ ID NO: 674680 - DNA, 22 bp, Homo sapiens
gctactatgatttaatttgaaa

SEQ ID NO: 674681 - DNA, 18 bp, Homo sapiens
gctactgcactccagcct

SEQ ID NO: 674682 - DNA, 20 bp, Homo sapiens
gctactgcactccagcctgg

SEQ ID NO: 674683 - DNA, 23 bp, Homo sapiens
gctagaagtctgtccaaatttaa

SEQ ID NO: 674684 - DNA, 21 bp, Homo sapiens
gctagcttttaggaaaatcac

SEQ ID NO: 674685 - DNA, 21 bp, Homo sapiens
gctagtggtgagcatgtaagt

SEQ ID NO: 674686 - DNA, 17 bp, Homo sapiens
gctagtgtacctcctct

SEQ ID NO: 674687 - DNA, 13 bp, Homo sapiens
gctagtgtttcta

SEQ ID NO: 674688 - DNA, 21 bp, Homo sapiens
gctatagggtgtgatgaagtc

SEQ ID NO: 674689 - DNA, 19 bp, Homo sapiens
gctatatttgattatgtat

SEQ ID NO: 674690 - DNA, 17 bp, Homo sapiens
gctatgcatattcaatg

SEQ ID NO: 674691 - DNA, 20 bp, Homo sapiens
gctatggcaggataagaaag

SEQ ID NO: 674692 - DNA, 20 bp, Homo sapiens
gctatggggtaggagaaaag

SEQ ID NO: 674693 - DNA, 12 bp, Homo sapiens
gctatgtaaggg

SEQ ID NO: 674694 - DNA, 13 bp, Homo sapiens
gctatgtaagggt

SEQ ID NO: 674695 - DNA, 15 bp, Homo sapiens
gctatgtcagtacta

SEQ ID NO: 674696 - DNA, 16 bp, Homo sapiens
gctattctagagcttt

SEQ ID NO: 674697 - DNA, 15 bp, Homo sapiens
gctcaagctttcccg

SEQ ID NO: 674698 - DNA, 14 bp, Homo sapiens
gctcaagtttaaaa

SEQ ID NO: 674699 - DNA, 13 bp, Homo sapiens
gctcacacctgta

SEQ ID NO: 674700 - DNA, 16 bp, Homo sapiens
gctcaccgcccatcag

SEQ ID NO: 674701 - DNA, 17 bp, Homo sapiens
gctcaccgcccatcagg

SEQ ID NO: 674702 - DNA, 15 bp, Homo sapiens
gctcagaataaggca

SEQ ID NO: 674703 - DNA, 12 bp, Homo sapiens
gctcagccctgg

SEQ ID NO: 674704 - DNA, 13 bp, Homo sapiens
gctcagccctggc

SEQ ID NO: 674705 - DNA, 18 bp, Homo sapiens
gctcagccctggcctggc

SEQ ID NO: 674706 - DNA, 17 bp, Homo sapiens
gctcattaaactttttt

SEQ ID NO: 674707 - DNA, 13 bp, Homo sapiens
gctcatttttgca

SEQ ID NO: 674708 - DNA, 21 bp, Homo sapiens
gctccactcttgatctctctt

SEQ ID NO: 674709 - DNA, 22 bp, Homo sapiens
gctccactcttgatctctcttg

SEQ ID NO: 674710 - DNA, 21 bp, Homo sapiens
gctccagctttctgccatcta

SEQ ID NO: 674711 - DNA, 22 bp, Homo sapiens
gctccaggcctgcagcaggagt

SEQ ID NO: 674712 - DNA, 22 bp, Homo sapiens
gctccataccttttctcttttc

SEQ ID NO: 674713 - DNA, 19 bp, Homo sapiens
gctccatatttgatttcta

SEQ ID NO: 674714 - DNA, 21 bp, Homo sapiens
gctccatatttgatttctaat

SEQ ID NO: 674715 - DNA, 17 bp, Homo sapiens
gctcccaggccccaggc

SEQ ID NO: 674716 - DNA, 21 bp, Homo sapiens
gctcccaggggtctccctggc

SEQ ID NO: 674717 - DNA, 19 bp, Homo sapiens
gctccccacagcgtccctg

SEQ ID NO: 674718 - DNA, 20 bp, Homo sapiens
gctccccacagcgtccctgg

SEQ ID NO: 674719 - DNA, 18 bp, Homo sapiens
gctccccagcccacctgc

SEQ ID NO: 674720 - DNA, 20 bp, Homo sapiens
gctccccagcccacctgctc

SEQ ID NO: 674721 - DNA, 22 bp, Homo sapiens
gctccccagcccacctgctccc

SEQ ID NO: 674722 - DNA, 23 bp, Homo sapiens
gctccccagcccacctgctccca

SEQ ID NO: 674723 - DNA, 19 bp, Homo sapiens
gctcccctaaagcctcaaa

SEQ ID NO: 674724 - DNA, 17 bp, Homo sapiens
gctccgtagctctgctg

SEQ ID NO: 674725 - DNA, 14 bp, Homo sapiens
gctctaaaaggtaa

SEQ ID NO: 674726 - DNA, 23 bp, Homo sapiens
gctctaaaaggtaatgtgtggat

SEQ ID NO: 674727 - DNA, 13 bp, Homo sapiens
gctctcagaagcc

SEQ ID NO: 674728 - DNA, 16 bp, Homo sapiens
gctctcctcatctcca

SEQ ID NO: 674729 - DNA, 20 bp, Homo sapiens
gctctgcagcattgaagtat

SEQ ID NO: 674730 - DNA, 11 bp, Homo sapiens
gctctgctgct

SEQ ID NO: 674731 - DNA, 17 bp, Homo sapiens
gctctgttacccaggct

SEQ ID NO: 674732 - DNA, 17 bp, Homo sapiens
gctctttccaaattaaa

SEQ ID NO: 674733 - DNA, 12 bp, Homo sapiens
gctcttttcctg

SEQ ID NO: 674734 - DNA, 23 bp, Homo sapiens
gctgaaatatccacccagcaggc

SEQ ID NO: 674735 - DNA, 19 bp, Homo sapiens
gctgaactcagcacattcg

SEQ ID NO: 674736 - DNA, 15 bp, Homo sapiens
gctgaatccagatca

SEQ ID NO: 674737 - DNA, 19 bp, Homo sapiens
gctgacacgctcagttgaa

SEQ ID NO: 674738 - DNA, 17 bp, Homo sapiens
gctgacatgaagctgtt

SEQ ID NO: 674739 - DNA, 19 bp, Homo sapiens
gctgagcctgcagggaagc

SEQ ID NO: 674740 - DNA, 18 bp, Homo sapiens
gctgaggcaggaggatca

SEQ ID NO: 674741 - DNA, 14 bp, Homo sapiens
gctgagggtttgaa

SEQ ID NO: 674742 - DNA, 14 bp, Homo sapiens
gctgagttggcctg

SEQ ID NO: 674743 - DNA, 16 bp, Homo sapiens
gctgataaatttaatc

SEQ ID NO: 674744 - DNA, 18 bp, Homo sapiens
gctgatcatcgccagagg

SEQ ID NO: 674745 - DNA, 20 bp, Homo sapiens
gctgatcatcgccagaggtg

SEQ ID NO: 674746 - DNA, 18 bp, Homo sapiens
gctgatcgtagaaaattt

SEQ ID NO: 674747 - DNA, 13 bp, Homo sapiens
gctgattatttat

SEQ ID NO: 674748 - DNA, 17 bp, Homo sapiens
gctgattatttatgacc

SEQ ID NO: 674749 - DNA, 13 bp, Homo sapiens
gctgatttcactt

SEQ ID NO: 674750 - DNA, 17 bp, Homo sapiens
gctgcacaacagccctg

SEQ ID NO: 674751 - DNA, 19 bp, Homo sapiens
gctgcagattagttctttt

SEQ ID NO: 674752 - DNA, 21 bp, Homo sapiens
gctgcagattagttctttttg

SEQ ID NO: 674753 - DNA, 23 bp, Homo sapiens
gctgcagcaccgaggggcctttg

SEQ ID NO: 674754 - DNA, 20 bp, Homo sapiens
gctgccagccttgagccctg

SEQ ID NO: 674755 - DNA, 13 bp, Homo sapiens
gctgccatgtgaa

SEQ ID NO: 674756 - DNA, 17 bp, Homo sapiens
gctgccatgtgaagagg

SEQ ID NO: 674757 - DNA, 18 bp, Homo sapiens
gctgccccaatgtgacct

SEQ ID NO: 674758 - DNA, 17 bp, Homo sapiens
ctgtaatgtaaataaac

SEQ ID NO: 674759 - DNA, 16 bp, Homo sapiens
ctgtacattatgaaga

SEQ ID NO: 674760 - DNA, 18 bp, Homo sapiens
ctgtacattatgaagaat

SEQ ID NO: 674761 - DNA, 18 bp, Homo sapiens
ctgtactctggggtgctg

SEQ ID NO: 674762 - DNA, 18 bp, Homo sapiens
ctgtactgttactgggcc

SEQ ID NO: 674763 - DNA, 22 bp, Homo sapiens
ctgtacttgaagtctaaaagca

SEQ ID NO: 674764 - DNA, 19 bp, Homo sapiens
ctgtagaaaggggagaatg

SEQ ID NO: 674765 - DNA, 16 bp, Homo sapiens
ctgtagctacaaggga

SEQ ID NO: 674766 - DNA, 22 bp, Homo sapiens
ctgtaggcctcaggtgaaactc

SEQ ID NO: 674767 - DNA, 18 bp, Homo sapiens
ctgtagggagaagcttta

SEQ ID NO: 674768 - DNA, 20 bp, Homo sapiens
ctgtaggtatgatctcttct

SEQ ID NO: 674769 - DNA, 14 bp, Homo sapiens
ctgtataaagcatg

SEQ ID NO: 674770 - DNA, 15 bp, Homo sapiens
ctgtataaagcatgt

SEQ ID NO: 674771 - DNA, 20 bp, Homo sapiens
ctgtatcctccctggcagac

SEQ ID NO: 674772 - DNA, 21 bp, Homo sapiens
ctgtatgaaaaattggggagg

SEQ ID NO: 674773 - DNA, 22 bp, Homo sapiens
ctgtatgctgatcatcgccaga

SEQ ID NO: 674774 - DNA, 13 bp, Homo sapiens
ctgtatttctaag

SEQ ID NO: 674775 - DNA, 18 bp, Homo sapiens
ctgtatttttatttttgc

SEQ ID NO: 674776 - DNA, 13 bp, Homo sapiens
ctgtcaaggctca

SEQ ID NO: 674777 - DNA, 17 bp, Homo sapiens
ctgtcacttgctgcttt

SEQ ID NO: 674778 - DNA, 16 bp, Homo sapiens
ctgtccaagacagggc

SEQ ID NO: 674779 - DNA, 16 bp, Homo sapiens
ctgtccccaaacagga

SEQ ID NO: 674780 - DNA, 22 bp, Homo sapiens
ctgtccccaaacaggacagcac

SEQ ID NO: 674781 - DNA, 22 bp, Homo sapiens
ctgtccccatctaggtcctggc

SEQ ID NO: 674782 - DNA, 11 bp, Homo sapiens
ctgtccctctc

SEQ ID NO: 674783 - DNA, 18 bp, Homo sapiens
ctgtccctctccttgccc

SEQ ID NO: 674784 - DNA, 16 bp, Homo sapiens
ctgtcccttgcctctg

SEQ ID NO: 674785 - DNA, 17 bp, Homo sapiens
ctgtcccttttccctta

SEQ ID NO: 674786 - DNA, 20 bp, Homo sapiens
ctgtccttaacccacctctc

SEQ ID NO: 674787 - DNA, 21 bp, Homo sapiens
ctgtccttaacccacctctcc

SEQ ID NO: 674788 - DNA, 16 bp, Homo sapiens
ctgtcctttcagtctg

SEQ ID NO: 674789 - DNA, 21 bp, Homo sapiens
ctgtcctttcagtctgatcca

SEQ ID NO: 674790 - DNA, 15 bp, Homo sapiens
ctgtcgatgtaggca

SEQ ID NO: 674791 - DNA, 13 bp, Homo sapiens
ctgtctaactgct

SEQ ID NO: 674792 - DNA, 16 bp, Homo sapiens
ctgtctgttatgattt

SEQ ID NO: 674793 - DNA, 18 bp, Homo sapiens
ctgtctgttgtattcatt

SEQ ID NO: 674794 - DNA, 18 bp, Homo sapiens
ctgtcttgttaatgcttt

SEQ ID NO: 674795 - DNA, 20 bp, Homo sapiens
ctgtgaagccaccctgggct

SEQ ID NO: 674796 - DNA, 16 bp, Homo sapiens
ctgtgacccctccttg

SEQ ID NO: 674797 - DNA, 14 bp, Homo sapiens
ctgtgacctctgac

SEQ ID NO: 674798 - DNA, 23 bp, Homo sapiens
ctgtgagaacccagtttcccgtc

SEQ ID NO: 674799 - DNA, 19 bp, Homo sapiens
ctgtgagaaggtttattgt

SEQ ID NO: 674800 - DNA, 15 bp, Homo sapiens
ctgtgaggagtctgg

SEQ ID NO: 674801 - DNA, 16 bp, Homo sapiens
ctgtgaggagtctggg

SEQ ID NO: 674802 - DNA, 18 bp, Homo sapiens
ctgtgaggagtctgggtc

SEQ ID NO: 674803 - DNA, 18 bp, Homo sapiens
ctgtgcaacggtctcctg

SEQ ID NO: 674804 - DNA, 19 bp, Homo sapiens
ctgtgcaacggtctcctga

SEQ ID NO: 674805 - DNA, 13 bp, Homo sapiens
ctgtgccagaggc

SEQ ID NO: 674806 - DNA, 17 bp, Homo sapiens
ctgtgccagaggccaga

SEQ ID NO: 674807 - DNA, 19 bp, Homo sapiens
ctgtgcccatggcttctgg

SEQ ID NO: 674808 - DNA, 17 bp, Homo sapiens
ctgtgctagaagctcca

SEQ ID NO: 674809 - DNA, 14 bp, Homo sapiens
ctgtgctgaatgct

SEQ ID NO: 674810 - DNA, 14 bp, Homo sapiens
ctgtggcataaatt

SEQ ID NO: 674811 - DNA, 15 bp, Homo sapiens
ctgtggcataaattg

SEQ ID NO: 674812 - DNA, 23 bp, Homo sapiens
ctgtgggctacatgctggggtca

SEQ ID NO: 674813 - DNA, 14 bp, Homo sapiens
ctgtggggaaaggg

SEQ ID NO: 674814 - DNA, 22 bp, Homo sapiens
ctgtggtcctgaattctttccc

SEQ ID NO: 674815 - DNA, 15 bp, Homo sapiens
ctgtggttcctctgc

SEQ ID NO: 674816 - DNA, 17 bp, Homo sapiens
ctgtgtacacctctgga

SEQ ID NO: 674817 - DNA, 17 bp, Homo sapiens
ctgtgtccacctgtggg

SEQ ID NO: 674818 - DNA, 17 bp, Homo sapiens
ctgtgtggcagttaatt

SEQ ID NO: 674819 - DNA, 20 bp, Homo sapiens
ctgtgtgtcccaggcaggga

SEQ ID NO: 674820 - DNA, 23 bp, Homo sapiens
ctgtgtgtgtgtgtgtgcgtgtg

SEQ ID NO: 674821 - DNA, 14 bp, Homo sapiens
ctgttactgggccc

SEQ ID NO: 674822 - DNA, 13 bp, Homo sapiens
ctgttagctttcc

SEQ ID NO: 674823 - DNA, 22 bp, Homo sapiens
ctgttagctttccaaggaagca

SEQ ID NO: 674824 - DNA, 23 bp, Homo sapiens
ctgttagctttccaaggaagcag

SEQ ID NO: 674825 - DNA, 15 bp, Homo sapiens
ctgttatatatttac

SEQ ID NO: 674826 - DNA, 22 bp, Homo sapiens
ctgttatttcttccctgctttg

SEQ ID NO: 674827 - DNA, 16 bp, Homo sapiens
ctgttccatgcaactg

SEQ ID NO: 674828 - DNA, 19 bp, Homo sapiens
ctgttctgtggttcctctg

SEQ ID NO: 674829 - DNA, 11 bp, Homo sapiens
ctgtttctaag

SEQ ID NO: 674830 - DNA, 12 bp, Homo sapiens
ctgtttctaaga

SEQ ID NO: 674831 - DNA, 23 bp, Homo sapiens
ctgtttctggacccttataaaat

SEQ ID NO: 674832 - DNA, 15 bp, Homo sapiens
ctgtttctgtttata

SEQ ID NO: 674833 - DNA, 17 bp, Homo sapiens
ctgttttgtttggcaag

SEQ ID NO: 674834 - DNA, 16 bp, Homo sapiens
cttaaaaaataataca

SEQ ID NO: 674835 - DNA, 18 bp, Homo sapiens
cttaaaattgatattata

SEQ ID NO: 674836 - DNA, 19 bp, Homo sapiens
cttaaaattgatattatat

SEQ ID NO: 674837 - DNA, 17 bp, Homo sapiens
cttaaacacaggctgtc

SEQ ID NO: 674838 - DNA, 19 bp, Homo sapiens
cttaaacgaagagttccct

SEQ ID NO: 674839 - DNA, 21 bp, Homo sapiens
cttaaataatgcttcagatat

SEQ ID NO: 674840 - DNA, 22 bp, Homo sapiens
cttaaatgcaaccatttgaaac

SEQ ID NO: 674841 - DNA, 14 bp, Homo sapiens
cttaaattttatat

SEQ ID NO: 674842 - DNA, 22 bp, Homo sapiens
cttaaattttatatcattttaa

SEQ ID NO: 674843 - DNA, 16 bp, Homo sapiens
cttaacccacctctcc

SEQ ID NO: 674844 - DNA, 12 bp, Homo sapiens
cttaaccttaaa

SEQ ID NO: 674845 - DNA, 12 bp, Homo sapiens
cttaactttata

SEQ ID NO: 674846 - DNA, 22 bp, Homo sapiens
cttaagtcagatttttatttat

SEQ ID NO: 674847 - DNA, 21 bp, Homo sapiens
cttaatcaagatttttttcct

SEQ ID NO: 674848 - DNA, 18 bp, Homo sapiens
cttaatggagttcttgtg

SEQ ID NO: 674849 - DNA, 18 bp, Homo sapiens
cttaattgactgaaatta

SEQ ID NO: 674850 - DNA, 18 bp, Homo sapiens
cttaatttagaaactgaa

SEQ ID NO: 674851 - DNA, 20 bp, Homo sapiens
cttaatttagaaactgaaaa

SEQ ID NO: 674852 - DNA, 14 bp, Homo sapiens
cttaatttatttct

SEQ ID NO: 674853 - DNA, 19 bp, Homo sapiens
cttaatttttttttcatag

SEQ ID NO: 674854 - DNA, 17 bp, Homo sapiens
cttacaatcaaatctcc

SEQ ID NO: 674855 - DNA, 15 bp, Homo sapiens
cttacatctggctgg

SEQ ID NO: 674856 - DNA, 21 bp, Homo sapiens
cttactcccccaccactcagg

SEQ ID NO: 674857 - DNA, 24 bp, Homo sapiens
cttacttgcataccaagttgatac

SEQ ID NO: 674858 - DNA, 15 bp, Homo sapiens
cttagaaagggaagg

SEQ ID NO: 674859 - DNA, 22 bp, Homo sapiens
cttagatggagaagttgtgaaa

SEQ ID NO: 674860 - DNA, 17 bp, Homo sapiens
cttagcgtcaagacatt

SEQ ID NO: 674861 - DNA, 23 bp, Homo sapiens
cttagcgtcaagacatttgctga

SEQ ID NO: 674862 - DNA, 19 bp, Homo sapiens
cttagtgatcatttaaaaa

SEQ ID NO: 674863 - DNA, 22 bp, Homo sapiens
cttagtgatcatttaaaaagct

SEQ ID NO: 674864 - DNA, 23 bp, Homo sapiens
cttagtgggccagggctgccctg

SEQ ID NO: 674865 - DNA, 18 bp, Homo sapiens
cttataaaatcctgtgca

SEQ ID NO: 674866 - DNA, 18 bp, Homo sapiens
cttataagtaaagacagc

SEQ ID NO: 674867 - DNA, 17 bp, Homo sapiens
cttataggcctgtccct

SEQ ID NO: 674868 - DNA, 13 bp, Homo sapiens
cttatcagagcta

SEQ ID NO: 674869 - DNA, 13 bp, Homo sapiens
cttatccctctct

SEQ ID NO: 674870 - DNA, 14 bp, Homo sapiens
cttatccctctctt

SEQ ID NO: 674871 - DNA, 17 bp, Homo sapiens
cttatccctctcttccc

SEQ ID NO: 674872 - DNA, 18 bp, Homo sapiens
cttatccctctcttcccc

SEQ ID NO: 674873 - DNA, 21 bp, Homo sapiens
cttatctcgaatttgaagaga

SEQ ID NO: 674874 - DNA, 12 bp, Homo sapiens
cttatctctttt

SEQ ID NO: 674875 - DNA, 20 bp, Homo sapiens
cttatcttacaatattgatt

SEQ ID NO: 674876 - DNA, 19 bp, Homo sapiens
cttatgtatcagtgtcctt

SEQ ID NO: 674877 - DNA, 14 bp, Homo sapiens
cttatgtgaaaaat

SEQ ID NO: 674878 - DNA, 17 bp, Homo sapiens
cttatgtgaaaaattaa

SEQ ID NO: 674879 - DNA, 19 bp, Homo sapiens
cttatgtgaaaaattaact

SEQ ID NO: 674880 - DNA, 12 bp, Homo sapiens
gtggcaattagt

SEQ ID NO: 674881 - DNA, 13 bp, Homo sapiens
gtggcaattagtg

SEQ ID NO: 674882 - DNA, 15 bp, Homo sapiens
gtggcacacactgac

SEQ ID NO: 674883 - DNA, 15 bp, Homo sapiens
gtggccacagactga

SEQ ID NO: 674884 - DNA, 16 bp, Homo sapiens
gtggccatcatcctcc

SEQ ID NO: 674885 - DNA, 11 bp, Homo sapiens
gtggcctcagc

SEQ ID NO: 674886 - DNA, 22 bp, Homo sapiens
gtggcctcagctcaatgcagtt

SEQ ID NO: 674887 - DNA, 18 bp, Homo sapiens
gtggcctcagctgaatgc

SEQ ID NO: 674888 - DNA, 19 bp, Homo sapiens
gtggcggctgcacaacagc

SEQ ID NO: 674889 - DNA, 15 bp, Homo sapiens
gtggcgtggcctccc

SEQ ID NO: 674890 - DNA, 13 bp, Homo sapiens
gtgggaaatatgc

SEQ ID NO: 674891 - DNA, 22 bp, Homo sapiens
gtgggaaatatgccactgaccg

SEQ ID NO: 674892 - DNA, 20 bp, Homo sapiens
gtgggatttccagaaccaca

SEQ ID NO: 674893 - DNA, 14 bp, Homo sapiens
gtgggcctcggccc

SEQ ID NO: 674894 - DNA, 16 bp, Homo sapiens
gtgggctacatgctgg

SEQ ID NO: 674895 - DNA, 19 bp, Homo sapiens
gtgggctggacttctacct

SEQ ID NO: 674896 - DNA, 17 bp, Homo sapiens
gtggggggtctgtgtca

SEQ ID NO: 674897 - DNA, 14 bp, Homo sapiens
gtgggtgctcagaa

SEQ ID NO: 674898 - DNA, 16 bp, Homo sapiens
gtggtattctggtagg

SEQ ID NO: 674899 - DNA, 14 bp, Homo sapiens
gtggtcataaaata

SEQ ID NO: 674900 - DNA, 13 bp, Homo sapiens
gtggtctcaggat

SEQ ID NO: 674901 - DNA, 22 bp, Homo sapiens
gtggtctgattttgaggtttag

SEQ ID NO: 674902 - DNA, 21 bp, Homo sapiens
gtggtgatttgaaaaatataa

SEQ ID NO: 674903 - DNA, 13 bp, Homo sapiens
gtggtggcctcag

SEQ ID NO: 674904 - DNA, 18 bp, Homo sapiens
gtgtaagaaatacagact

SEQ ID NO: 674905 - DNA, 18 bp, Homo sapiens
gtgtacctgctggaagaa

SEQ ID NO: 674906 - DNA, 14 bp, Homo sapiens
gtgtaggttatctt

SEQ ID NO: 674907 - DNA, 21 bp, Homo sapiens
gtttaaaatgtaatttaaatg

SEQ ID NO: 674908 - DNA, 13 bp, Homo sapiens
gtttaaccttaaa

SEQ ID NO: 674909 - DNA, 15 bp, Homo sapiens
gtttaataaagcttt

SEQ ID NO: 674910 - DNA, 17 bp, Homo sapiens
gtttaataaagctttat

SEQ ID NO: 674911 - DNA, 15 bp, Homo sapiens
gtttacactgcacat

SEQ ID NO: 674912 - DNA, 15 bp, Homo sapiens
gtttacacttcatat

SEQ ID NO: 674913 - DNA, 19 bp, Homo sapiens
gtttattataaagcttaaa

SEQ ID NO: 674914 - DNA, 22 bp, Homo sapiens
gtttattataaagcttaaattt

SEQ ID NO: 674915 - DNA, 15 bp, Homo sapiens
gtttatttgcaattt

SEQ ID NO: 674916 - DNA, 17 bp, Homo sapiens
gtttatttgcaatttga

SEQ ID NO: 674917 - DNA, 21 bp, Homo sapiens
gtttatttgcaatttgagcca

SEQ ID NO: 674918 - DNA, 20 bp, Homo sapiens
gtttcaaagctttcctgttt

SEQ ID NO: 674919 - DNA, 14 bp, Homo sapiens
gtttcaagaaaatc

SEQ ID NO: 674920 - DNA, 13 bp, Homo sapiens
gtttccatttgtg

SEQ ID NO: 674921 - DNA, 18 bp, Homo sapiens
gtttctaagaaaatgtag

SEQ ID NO: 674922 - DNA, 13 bp, Homo sapiens
gtttctaagcagt

SEQ ID NO: 674923 - DNA, 14 bp, Homo sapiens
gtttctccttttcc

SEQ ID NO: 674924 - DNA, 13 bp, Homo sapiens
gtttctctccctc

SEQ ID NO: 674925 - DNA, 16 bp, Homo sapiens
gtttctctctacagtg

SEQ ID NO: 674926 - DNA, 19 bp, Homo sapiens
gtttctctctacagtgcca

SEQ ID NO: 674927 - DNA, 22 bp, Homo sapiens
gtttctgcatgaatatcataca

SEQ ID NO: 674928 - DNA, 19 bp, Homo sapiens
gtttctgggtcctgaagaa

SEQ ID NO: 674929 - DNA, 22 bp, Homo sapiens
gtttctgggtcctgaagaatta

SEQ ID NO: 674930 - DNA, 20 bp, Homo sapiens
gtttctttctctgaggacaa

SEQ ID NO: 674931 - DNA, 14 bp, Homo sapiens
gtttcttttgtttg

SEQ ID NO: 674932 - DNA, 18 bp, Homo sapiens
gtttcttttgtttggtaa

SEQ ID NO: 674933 - DNA, 14 bp, Homo sapiens
gtttgaaatgttta

SEQ ID NO: 674934 - DNA, 22 bp, Homo sapiens
gtttgaagagccattttggtaa

SEQ ID NO: 674935 - DNA, 23 bp, Homo sapiens
gtttgaatgaaccctccttttct

SEQ ID NO: 674936 - DNA, 20 bp, Homo sapiens
gtttgaggcaaattaactgt

SEQ ID NO: 674937 - DNA, 22 bp, Homo sapiens
gtttgcctccgtcccctgccca

SEQ ID NO: 674938 - DNA, 17 bp, Homo sapiens
gtttgctgattatttat

SEQ ID NO: 674939 - DNA, 17 bp, Homo sapiens
gtttgggtgattcctaa

SEQ ID NO: 674940 - DNA, 17 bp, Homo sapiens
gtttgtggcgtctccct

SEQ ID NO: 674941 - DNA, 18 bp, Homo sapiens
gttttaaaactggacctg

SEQ ID NO: 674942 - DNA, 16 bp, Homo sapiens
gttttaaactttcaat

SEQ ID NO: 674943 - DNA, 17 bp, Homo sapiens
gttttaactttaataca

SEQ ID NO: 674944 - DNA, 22 bp, Homo sapiens
gttttcctataatataataaat

SEQ ID NO: 674945 - DNA, 14 bp, Homo sapiens
gttttgctgagagc

SEQ ID NO: 674946 - DNA, 19 bp, Homo sapiens
gttttggatcttgaatgtg

SEQ ID NO: 674947 - DNA, 16 bp, Homo sapiens
gttttggggactcatt

SEQ ID NO: 674948 - DNA, 22 bp, Homo sapiens
gtttttaacttttaatttaaaa

SEQ ID NO: 674949 - DNA, 18 bp, Homo sapiens
gtttttagaatgttgaaa

SEQ ID NO: 674950 - DNA, 17 bp, Homo sapiens
gtttttattaatttata

SEQ ID NO: 674951 - DNA, 23 bp, Homo sapiens
gtttttgaggctttctgttgcca

SEQ ID NO: 674952 - DNA, 16 bp, Homo sapiens
gttttttatgaagtgc

SEQ ID NO: 674953 - DNA, 14 bp, Homo sapiens
taaaaaaaagaaac

SEQ ID NO: 674954 - DNA, 17 bp, Homo sapiens
taaaaaaaagaaacttt

SEQ ID NO: 674955 - DNA, 13 bp, Homo sapiens
taaaaaatgtctc

SEQ ID NO: 674956 - DNA, 19 bp, Homo sapiens
taaaaaattttaaaaatct

SEQ ID NO: 674957 - DNA, 22 bp, Homo sapiens
taaaaacagatttggaaagact

SEQ ID NO: 674958 - DNA, 14 bp, Homo sapiens
taaaaactcttcag

SEQ ID NO: 674959 - DNA, 15 bp, Homo sapiens
taaaaagagtaattt

SEQ ID NO: 674960 - DNA, 17 bp, Homo sapiens
taaaaagagtaatttca

SEQ ID NO: 674961 - DNA, 16 bp, Homo sapiens
taaaaagctcactgct

SEQ ID NO: 674962 - DNA, 16 bp, Homo sapiens
taaaaagtatatgtta

SEQ ID NO: 674963 - DNA, 21 bp, Homo sapiens
taaaaataggctttttaggaa

SEQ ID NO: 674964 - DNA, 11 bp, Homo sapiens
taaaaatcttt

SEQ ID NO: 674965 - DNA, 11 bp, Homo sapiens
taaaacaaata

SEQ ID NO: 674966 - DNA, 12 bp, Homo sapiens
taaaacattaaa

SEQ ID NO: 674967 - DNA, 17 bp, Homo sapiens
taaaactaaatttcact

SEQ ID NO: 674968 - DNA, 23 bp, Homo sapiens
taaaactgggattaagaaacctt

SEQ ID NO: 674969 - DNA, 16 bp, Homo sapiens
taaaacttaaaaacaa

SEQ ID NO: 674970 - DNA, 15 bp, Homo sapiens
taaaagcagggcagc

SEQ ID NO: 674971 - DNA, 15 bp, Homo sapiens
taaaagcatgaattg

SEQ ID NO: 674972 - DNA, 22 bp, Homo sapiens
taaaagcatgaattggaactgc

SEQ ID NO: 674973 - DNA, 14 bp, Homo sapiens
taaaagcattgttt

SEQ ID NO: 674974 - DNA, 22 bp, Homo sapiens
taaaaggcccatagcagccagt

SEQ ID NO: 674975 - DNA, 21 bp, Homo sapiens
taaaagttttttattatgcat

SEQ ID NO: 674976 - DNA, 14 bp, Homo sapiens
taaaataaataatt

SEQ ID NO: 674977 - DNA, 16 bp, Homo sapiens
taaaataaataatttt

SEQ ID NO: 674978 - DNA, 13 bp, Homo sapiens
taaaataattttg

SEQ ID NO: 674979 - DNA, 14 bp, Homo sapiens
taaaataattttgt

SEQ ID NO: 674980 - DNA, 18 bp, Homo sapiens
taaaatagaataattctt

SEQ ID NO: 674981 - DNA, 22 bp, Homo sapiens
taaaatagaataattcttttct

SEQ ID NO: 674982 - DNA, 16 bp, Homo sapiens
taaaatagatataaat

SEQ ID NO: 674983 - DNA, 18 bp, Homo sapiens
taaaatagatataaattt

SEQ ID NO: 674984 - DNA, 16 bp, Homo sapiens
taaaatatatgaggct

SEQ ID NO: 674985 - DNA, 15 bp, Homo sapiens
taaaatatcataaag

SEQ ID NO: 674986 - DNA, 20 bp, Homo sapiens
taaaatatcataaagcattt

SEQ ID NO: 674987 - DNA, 21 bp, Homo sapiens
taaaatcttctgatgagttct

SEQ ID NO: 674988 - DNA, 21 bp, Homo sapiens
taaaatggacacaaattttca

SEQ ID NO: 674989 - DNA, 23 bp, Homo sapiens
taaaatggacacaaattttcaag

SEQ ID NO: 674990 - DNA, 16 bp, Homo sapiens
taaaatgtaatttaaa

SEQ ID NO: 674991 - DNA, 12 bp, Homo sapiens
taaaatgtttca

SEQ ID NO: 674992 - DNA, 23 bp, Homo sapiens
taaaatgtttcattatgcacttt

SEQ ID NO: 674993 - DNA, 22 bp, Homo sapiens
taaaattatgagattggttttc

SEQ ID NO: 674994 - DNA, 18 bp, Homo sapiens
taaaattgctatgttact

SEQ ID NO: 674995 - DNA, 19 bp, Homo sapiens
taaaattttgcttttaatt

SEQ ID NO: 674996 - DNA, 16 bp, Homo sapiens
taaaattttgtatgtt

SEQ ID NO: 674997 - DNA, 19 bp, Homo sapiens
taaaattttgtatgttaaa

SEQ ID NO: 674998 - DNA, 17 bp, Homo sapiens
taaacacaggctgtcct

SEQ ID NO: 674999 - DNA, 18 bp, Homo sapiens
taaacacaggctgtcctt

SEQ ID NO: 675000 - DNA, 12 bp, Homo sapiens
taaacagaaatg

SEQ ID NO: 675001 - DNA, 16 bp, Homo sapiens
taaacagttatttctg

SEQ ID NO: 675002 - DNA, 22 bp, Homo sapiens
taaacataaaaactgatttgct

SEQ ID NO: 675003 - DNA, 23 bp, Homo sapiens
taaactatgttcctaacaaaatg

SEQ ID NO: 675004 - DNA, 17 bp, Homo sapiens
taaactatttatatcac

SEQ ID NO: 675005 - DNA, 23 bp, Homo sapiens
taaactatttatatcacacaata

SEQ ID NO: 675006 - DNA, 22 bp, Homo sapiens
taaacttctgcaacaagcatgc

SEQ ID NO: 675007 - DNA, 15 bp, Homo sapiens
taaagaaaaaaatac

SEQ ID NO: 675008 - DNA, 15 bp, Homo sapiens
taaagaagctttatc

SEQ ID NO: 675009 - DNA, 17 bp, Homo sapiens
taaagaattaatgactt

SEQ ID NO: 675010 - DNA, 17 bp, Homo sapiens
taaagaccaataaactt

SEQ ID NO: 675011 - DNA, 22 bp, Homo sapiens
taaagaccaataaacttccttt

SEQ ID NO: 675012 - DNA, 12 bp, Homo sapiens
taaagagaatga

SEQ ID NO: 675013 - DNA, 20 bp, Homo sapiens
taaagatttatacagttgaa

SEQ ID NO: 675014 - DNA, 14 bp, Homo sapiens
taaagcatgaaatg

SEQ ID NO: 675015 - DNA, 17 bp, Homo sapiens
taaagccttttaaatca

SEQ ID NO: 675016 - DNA, 12 bp, Homo sapiens
taaagcttaaat

SEQ ID NO: 675017 - DNA, 13 bp, Homo sapiens
taaagcttaaatt

SEQ ID NO: 675018 - DNA, 13 bp, Homo sapiens
taaaggcagctgc

SEQ ID NO: 675019 - DNA, 14 bp, Homo sapiens
taaaggcagctgcc

SEQ ID NO: 675020 - DNA, 20 bp, Homo sapiens
taaaggcagctgcctctgct

SEQ ID NO: 675021 - DNA, 21 bp, Homo sapiens
taaagtacaaatgaagaaagt

SEQ ID NO: 675022 - DNA, 20 bp, Homo sapiens
taaagtacacaattgtttta

SEQ ID NO: 675023 - DNA, 23 bp, Homo sapiens
taaagtatgacccacattacttt

SEQ ID NO: 675024 - DNA, 21 bp, Homo sapiens
taaagtctgttgattaaagat

SEQ ID NO: 675025 - DNA, 22 bp, Homo sapiens
taaagtctgttgattaaagatg

SEQ ID NO: 675026 - DNA, 20 bp, Homo sapiens
taaagtgttctgccagatct

SEQ ID NO: 675027 - DNA, 20 bp, Homo sapiens
taaagttaaaaataggcttt

SEQ ID NO: 675028 - DNA, 15 bp, Homo sapiens
taaagttgtattgca

SEQ ID NO: 675029 - DNA, 19 bp, Homo sapiens
taaataaaaactaattaag

SEQ ID NO: 675030 - DNA, 12 bp, Homo sapiens
taaataaactat

SEQ ID NO: 675031 - DNA, 16 bp, Homo sapiens
taaataaactatttat

SEQ ID NO: 675032 - DNA, 20 bp, Homo sapiens
taaataaactgttgctcgtt

SEQ ID NO: 675033 - DNA, 14 bp, Homo sapiens
taaataaacttttt

SEQ ID NO: 675034 - DNA, 14 bp, Homo sapiens
taaataatttattt

SEQ ID NO: 675035 - DNA, 14 bp, Homo sapiens
taaataattttaat

SEQ ID NO: 675036 - DNA, 13 bp, Homo sapiens
taaatataacact

SEQ ID NO: 675037 - DNA, 14 bp, Homo sapiens
taaatataatttat

SEQ ID NO: 675038 - DNA, 21 bp, Homo sapiens
taaatataatttataagcatt

SEQ ID NO: 675039 - DNA, 22 bp, Homo sapiens
taaatataatttataagcattg

SEQ ID NO: 675040 - DNA, 14 bp, Homo sapiens
taaatatatatggt

SEQ ID NO: 675041 - DNA, 17 bp, Homo sapiens
taaatcagaaagtaaca

SEQ ID NO: 675042 - DNA, 21 bp, Homo sapiens
taaatcagaaagtaacaatct

SEQ ID NO: 675043 - DNA, 15 bp, Homo sapiens
taaatctcttctttg

SEQ ID NO: 675044 - DNA, 18 bp, Homo sapiens
taaatgaaacttaagaat

SEQ ID NO: 675045 - DNA, 22 bp, Homo sapiens
taaatgaaagaaaattgagttg

SEQ ID NO: 675046 - DNA, 21 bp, Homo sapiens
taaatgaagggccagcatata

SEQ ID NO: 675047 - DNA, 20 bp, Homo sapiens
taaatgcataatttatggtc

SEQ ID NO: 675048 - DNA, 21 bp, Homo sapiens
taaatgcatatcctgagccat

SEQ ID NO: 675049 - DNA, 16 bp, Homo sapiens
taaatgtttatactgt

SEQ ID NO: 675050 - DNA, 17 bp, Homo sapiens
taaatgtttatactgta

SEQ ID NO: 675051 - DNA, 19 bp, Homo sapiens
taaatgtttatactgtatt

SEQ ID NO: 675052 - DNA, 16 bp, Homo sapiens
taaattcaactttgta

SEQ ID NO: 675053 - DNA, 17 bp, Homo sapiens
taaattctgagcctgat

SEQ ID NO: 675054 - DNA, 12 bp, Homo sapiens
taaattgcatca

SEQ ID NO: 675055 - DNA, 19 bp, Homo sapiens
taaattgcatcactgtatc

SEQ ID NO: 675056 - DNA, 23 bp, Homo sapiens
taaattgtagggctttagctttc

SEQ ID NO: 675057 - DNA, 17 bp, Homo sapiens
taaatttaataccagat

SEQ ID NO: 675058 - DNA, 22 bp, Homo sapiens
taaatttaatccttctttgtaa

SEQ ID NO: 675059 - DNA, 23 bp, Homo sapiens
taaatttatattcataaagttac

SEQ ID NO: 675060 - DNA, 15 bp, Homo sapiens
taaattttatatcat

SEQ ID NO: 675061 - DNA, 23 bp, Homo sapiens
taacaatctatggcttatttcta

SEQ ID NO: 675062 - DNA, 21 bp, Homo sapiens
taacaatgacactagaaaact

SEQ ID NO: 675063 - DNA, 17 bp, Homo sapiens
taacacagcatgtgtat

SEQ ID NO: 675064 - DNA, 20 bp, Homo sapiens
taacacatttttttgcatgc

SEQ ID NO: 675065 - DNA, 21 bp, Homo sapiens
taacaccaggtttatggaaaa

SEQ ID NO: 675066 - DNA, 14 bp, Homo sapiens
taacactgtatttt

SEQ ID NO: 675067 - DNA, 17 bp, Homo sapiens
taacagtggacaaagtt

SEQ ID NO: 675068 - DNA, 23 bp, Homo sapiens
taacatacaagaaaatgtatcca

SEQ ID NO: 675069 - DNA, 16 bp, Homo sapiens
taaccagtacttctaa

SEQ ID NO: 675070 - DNA, 22 bp, Homo sapiens
taacccacctctcctgccctgt

SEQ ID NO: 675071 - DNA, 17 bp, Homo sapiens
taacccagttaacttac

SEQ ID NO: 675072 - DNA, 13 bp, Homo sapiens
taaccttagagct

SEQ ID NO: 675073 - DNA, 14 bp, Homo sapiens
taactcctgtccct

SEQ ID NO: 675074 - DNA, 12 bp, Homo sapiens
taactctgagag

SEQ ID NO: 675075 - DNA, 16 bp, Homo sapiens
taactctgagagctgt

SEQ ID NO: 675076 - DNA, 18 bp, Homo sapiens
taactgtagctcaagttt

SEQ ID NO: 675077 - DNA, 19 bp, Homo sapiens
taactgtagctcaagttta

SEQ ID NO: 675078 - DNA, 21 bp, Homo sapiens
taactgtagctcaagtttaaa

SEQ ID NO: 675079 - DNA, 23 bp, Homo sapiens
taacttcacccgagttcctctgg

SEQ ID NO: 675080 - DNA, 15 bp, Homo sapiens
taacttttaatttaa

SEQ ID NO: 675081 - DNA, 22 bp, Homo sapiens
taacttttttgtggcaattagt

SEQ ID NO: 675082 - DNA, 19 bp, Homo sapiens
taacttttttttctctctt

SEQ ID NO: 675083 - DNA, 20 bp, Homo sapiens
taacttttttttctctcttt

SEQ ID NO: 675084 - DNA, 12 bp, Homo sapiens
taagaaaatgta

SEQ ID NO: 675085 - DNA, 17 bp, Homo sapiens
taagaaagtaatttaat

SEQ ID NO: 675086 - DNA, 13 bp, Homo sapiens
taagaagacattt

SEQ ID NO: 675087 - DNA, 15 bp, Homo sapiens
taagaagttgtttga

SEQ ID NO: 675088 - DNA, 23 bp, Homo sapiens
taagaataccacatcaaataaga

SEQ ID NO: 675089 - DNA, 13 bp, Homo sapiens
taagaattctgat

SEQ ID NO: 675090 - DNA, 20 bp, Homo sapiens
taagaattctgattgatttg

SEQ ID NO: 675091 - DNA, 20 bp, Homo sapiens
taagaattgaattggaaaga

SEQ ID NO: 675092 - DNA, 18 bp, Homo sapiens
taagacaagagatctaca

SEQ ID NO: 675093 - DNA, 22 bp, Homo sapiens
taagacaatggaccctttttgt

SEQ ID NO: 675094 - DNA, 19 bp, Homo sapiens
taagactatatatataaat

SEQ ID NO: 675095 - DNA, 20 bp, Homo sapiens
taagactatatatataaatg

SEQ ID NO: 675096 - DNA, 17 bp, Homo sapiens
taagactgtagatatgt

SEQ ID NO: 675097 - DNA, 22 bp, Homo sapiens
taagatacaaattaattttact

SEQ ID NO: 675098 - DNA, 13 bp, Homo sapiens
taagatgtgaaaa

SEQ ID NO: 675099 - DNA, 14 bp, Homo sapiens
taagatgtgaaaat

SEQ ID NO: 675100 - DNA, 22 bp, Homo sapiens
taagattgatatctataaaata

SEQ ID NO: 675101 - DNA, 16 bp, Homo sapiens
taagcaacatggcttt

SEQ ID NO: 675102 - DNA, 12 bp, Homo sapiens
taagcatgtcaa

SEQ ID NO: 675103 - DNA, 16 bp, Homo sapiens
taagcattgccattga

SEQ ID NO: 675104 - DNA, 14 bp, Homo sapiens
taagccacttgaaa

SEQ ID NO: 675105 - DNA, 22 bp, Homo sapiens
taagcctatatatatagtcaaa

SEQ ID NO: 675106 - DNA, 19 bp, Homo sapiens
taaggaaccttccttcctg

SEQ ID NO: 675107 - DNA, 12 bp, Homo sapiens
taaggatgactt

SEQ ID NO: 675108 - DNA, 14 bp, Homo sapiens
taaggcaggcattg

SEQ ID NO: 675109 - DNA, 21 bp, Homo sapiens
taaggcaggtgggcagacagt

SEQ ID NO: 675110 - DNA, 16 bp, Homo sapiens
taaggcccactgtaat

SEQ ID NO: 675111 - DNA, 11 bp, Homo sapiens
taagggcagag

SEQ ID NO: 675112 - DNA, 15 bp, Homo sapiens
taaggggaagaatga

SEQ ID NO: 675113 - DNA, 20 bp, Homo sapiens
taagggtctttggtgttttt

SEQ ID NO: 675114 - DNA, 19 bp, Homo sapiens
taagggtgggtgctcagaa

SEQ ID NO: 675115 - DNA, 18 bp, Homo sapiens
taagtcagatttttattt

SEQ ID NO: 675116 - DNA, 18 bp, Homo sapiens
taagtcattcataaacct

SEQ ID NO: 675117 - DNA, 14 bp, Homo sapiens
taagtctttcatgg

SEQ ID NO: 675118 - DNA, 15 bp, Homo sapiens
taagtgaaaatatag

SEQ ID NO: 675119 - DNA, 22 bp, Homo sapiens
taagtggttctttggttccagt

SEQ ID NO: 675120 - DNA, 19 bp, Homo sapiens
taagtgtaaaaaatgtctc

SEQ ID NO: 675121 - DNA, 12 bp, Homo sapiens
taataaactgca

SEQ ID NO: 675122 - DNA, 12 bp, Homo sapiens
taataaagcttt

SEQ ID NO: 675123 - DNA, 12 bp, Homo sapiens
taataaatataa

SEQ ID NO: 675124 - DNA, 16 bp, Homo sapiens
taataaatataattta

SEQ ID NO: 675125 - DNA, 19 bp, Homo sapiens
taataaatataatttataa

SEQ ID NO: 675126 - DNA, 15 bp, Homo sapiens
taataagcactgtaa

SEQ ID NO: 675127 - DNA, 14 bp, Homo sapiens
taatacaaggtata

SEQ ID NO: 675128 - DNA, 21 bp, Homo sapiens
taatacaaggtataataaaat

SEQ ID NO: 675129 - DNA, 16 bp, Homo sapiens
taatatcaaataaaat

SEQ ID NO: 675130 - DNA, 21 bp, Homo sapiens
taatatcaaataaaatatcat

SEQ ID NO: 675131 - DNA, 20 bp, Homo sapiens
taatattgtttggtaaatgt

SEQ ID NO: 675132 - DNA, 21 bp, Homo sapiens
taatattgtttggtaaatgtt

SEQ ID NO: 675133 - DNA, 18 bp, Homo sapiens
taatcaaagccagggtct

SEQ ID NO: 675134 - DNA, 19 bp, Homo sapiens
taatcagcatatgtgtaaa

SEQ ID NO: 675135 - DNA, 22 bp, Homo sapiens
taatccttctttgtaatacttt

SEQ ID NO: 675136 - DNA, 13 bp, Homo sapiens
taatctacaccaa

SEQ ID NO: 675137 - DNA, 17 bp, Homo sapiens
taatctacaccaatgaa

SEQ ID NO: 675138 - DNA, 18 bp, Homo sapiens
taatctacaccaatgaaa

SEQ ID NO: 675139 - DNA, 22 bp, Homo sapiens
taatctacaccaatgaaaacat

SEQ ID NO: 675140 - DNA, 17 bp, Homo sapiens
taatcttcaaagccttc

SEQ ID NO: 675141 - DNA, 19 bp, Homo sapiens
tatgtaatttcaaaataca

SEQ ID NO: 675142 - DNA, 21 bp, Homo sapiens
tatgtaggtaagactgtagat

SEQ ID NO: 675143 - DNA, 19 bp, Homo sapiens
tatgtatatttttttaatt

SEQ ID NO: 675144 - DNA, 23 bp, Homo sapiens
tatgtatatttttttaatttaac

SEQ ID NO: 675145 - DNA, 18 bp, Homo sapiens
tatgtatggatatatttg

SEQ ID NO: 675146 - DNA, 21 bp, Homo sapiens
tatgtatggatatatttgaaa

SEQ ID NO: 675147 - DNA, 22 bp, Homo sapiens
tatgtatggatatatttgaaat

SEQ ID NO: 675148 - DNA, 14 bp, Homo sapiens
tatgtatttaaagt

SEQ ID NO: 675149 - DNA, 16 bp, Homo sapiens
tatgtgaaaaattaac

SEQ ID NO: 675150 - DNA, 21 bp, Homo sapiens
tatgtgaaaaattaacttttt

SEQ ID NO: 675151 - DNA, 15 bp, Homo sapiens
tatgtgaggtaatta

SEQ ID NO: 675152 - DNA, 16 bp, Homo sapiens
tatgtgagtgcctttt

SEQ ID NO: 675153 - DNA, 15 bp, Homo sapiens
tatgtgtaaagattt

SEQ ID NO: 675154 - DNA, 19 bp, Homo sapiens
tatgttcctaacaaaatga

SEQ ID NO: 675155 - DNA, 16 bp, Homo sapiens
tatgtttaaaagaaat

SEQ ID NO: 675156 - DNA, 14 bp, Homo sapiens
tattaaaactaaat

SEQ ID NO: 675157 - DNA, 22 bp, Homo sapiens
tattaaacatacataatacaat

SEQ ID NO: 675158 - DNA, 13 bp, Homo sapiens
tattaaatcagtt

SEQ ID NO: 675159 - DNA, 17 bp, Homo sapiens
tattaagtgtgccaaat

SEQ ID NO: 675160 - DNA, 22 bp, Homo sapiens
tattaagtgtgccaaatcagtt

SEQ ID NO: 675161 - DNA, 15 bp, Homo sapiens
tattaatactggtat

SEQ ID NO: 675162 - DNA, 13 bp, Homo sapiens
tattacaacattt

SEQ ID NO: 675163 - DNA, 17 bp, Homo sapiens
tattacaagtaatgtaa

SEQ ID NO: 675164 - DNA, 19 bp, Homo sapiens
tattactgaataatatcaa

SEQ ID NO: 675165 - DNA, 18 bp, Homo sapiens
tattactgacatttcttc

SEQ ID NO: 675166 - DNA, 21 bp, Homo sapiens
tattaggaaaataaacagaca

SEQ ID NO: 675167 - DNA, 13 bp, Homo sapiens
tattataaagctt

SEQ ID NO: 675168 - DNA, 18 bp, Homo sapiens
tattataaagcttaaatt

SEQ ID NO: 675169 - DNA, 20 bp, Homo sapiens
tattataaagcttaaatttt

SEQ ID NO: 675170 - DNA, 21 bp, Homo sapiens
tattatacatgtgatacattt

SEQ ID NO: 675171 - DNA, 18 bp, Homo sapiens
tattatagacaaaagaat

SEQ ID NO: 675172 - DNA, 14 bp, Homo sapiens
tattatatgttcta

SEQ ID NO: 675173 - DNA, 17 bp, Homo sapiens
tattatatgttctagaa

SEQ ID NO: 675174 - DNA, 14 bp, Homo sapiens
tattatattaaaca

SEQ ID NO: 675175 - DNA, 13 bp, Homo sapiens
tattattagaaat

SEQ ID NO: 675176 - DNA, 23 bp, Homo sapiens
tattattcccgacgacacatata

SEQ ID NO: 675177 - DNA, 21 bp, Homo sapiens
tattatttctaatccttttcc

SEQ ID NO: 675178 - DNA, 20 bp, Homo sapiens
tattatttttataattgtac

SEQ ID NO: 675179 - DNA, 20 bp, Homo sapiens
tattatttttttaaaatttt

SEQ ID NO: 675180 - DNA, 18 bp, Homo sapiens
tattcaagaatgaaaaat

SEQ ID NO: 675181 - DNA, 16 bp, Homo sapiens
tattcagggtaaatag

SEQ ID NO: 675182 - DNA, 19 bp, Homo sapiens
tattcatacgtaaaatttt

SEQ ID NO: 675183 - DNA, 21 bp, Homo sapiens
tattcctaatggctatttttg

SEQ ID NO: 675184 - DNA, 14 bp, Homo sapiens
tattctttgaaaac

SEQ ID NO: 675185 - DNA, 13 bp, Homo sapiens
tattcttttctca

SEQ ID NO: 675186 - DNA, 17 bp, Homo sapiens
tattggtgtaaggtact

SEQ ID NO: 675187 - DNA, 19 bp, Homo sapiens
tattgtgaagtacatatta

SEQ ID NO: 675188 - DNA, 22 bp, Homo sapiens
tattgtgccaactgccaggctg

SEQ ID NO: 675189 - DNA, 17 bp, Homo sapiens
tattgttcaaaaagata

SEQ ID NO: 675190 - DNA, 20 bp, Homo sapiens
tattgttggcacagaacagg

SEQ ID NO: 675191 - DNA, 17 bp, Homo sapiens
tatttaaaaaaaagaaa

SEQ ID NO: 675192 - DNA, 13 bp, Homo sapiens
tatttaagatgtg

SEQ ID NO: 675193 - DNA, 18 bp, Homo sapiens
tatttaagatgtgaaaat

SEQ ID NO: 675194 - DNA, 23 bp, Homo sapiens
tatttaatacagctgaagtcaaa

SEQ ID NO: 675195 - DNA, 18 bp, Homo sapiens
tatttaatatcaaaagaa

SEQ ID NO: 675196 - DNA, 17 bp, Homo sapiens
tatttaatggaagtgta

SEQ ID NO: 675197 - DNA, 21 bp, Homo sapiens
tatttactaactaaataccat

SEQ ID NO: 675198 - DNA, 20 bp, Homo sapiens
tatttatccaaaatgtgtat

SEQ ID NO: 675199 - DNA, 20 bp, Homo sapiens
tatttatccagaaaactgtg

SEQ ID NO: 675200 - DNA, 23 bp, Homo sapiens
tatttatccagaaaactgtgatt

SEQ ID NO: 675201 - DNA, 19 bp, Homo sapiens
tcactacaagtcagctcca

SEQ ID NO: 675202 - DNA, 14 bp, Homo sapiens
tcactgaatttata

SEQ ID NO: 675203 - DNA, 18 bp, Homo sapiens
tcactgcaacctctgcct

SEQ ID NO: 675204 - DNA, 19 bp, Homo sapiens
tcactgctgatcgtagaaa

SEQ ID NO: 675205 - DNA, 22 bp, Homo sapiens
tcacttaagttagttccactga

SEQ ID NO: 675206 - DNA, 12 bp, Homo sapiens
tcacttcctttg

SEQ ID NO: 675207 - DNA, 19 bp, Homo sapiens
tcacttgctgctttttctg

SEQ ID NO: 675208 - DNA, 22 bp, Homo sapiens
tcactttttatgctatttctgt

SEQ ID NO: 675209 - DNA, 13 bp, Homo sapiens
tcagaaatataac

SEQ ID NO: 675210 - DNA, 19 bp, Homo sapiens
tcagaaatataacacattt

SEQ ID NO: 675211 - DNA, 20 bp, Homo sapiens
tcagaaatataacacatttt

SEQ ID NO: 675212 - DNA, 14 bp, Homo sapiens
tcagaacaaaactt

SEQ ID NO: 675213 - DNA, 16 bp, Homo sapiens
tcagaacaaaacttct

SEQ ID NO: 675214 - DNA, 16 bp, Homo sapiens
tcagaattatttttaa

SEQ ID NO: 675215 - DNA, 14 bp, Homo sapiens
tcagacaagacaga

SEQ ID NO: 675216 - DNA, 12 bp, Homo sapiens
tcagacacagct

SEQ ID NO: 675217 - DNA, 13 bp, Homo sapiens
tcagacacagctc

SEQ ID NO: 675218 - DNA, 14 bp, Homo sapiens
tcagacacagctct

SEQ ID NO: 675219 - DNA, 21 bp, Homo sapiens
tcagacacagctcttccaggg

SEQ ID NO: 675220 - DNA, 17 bp, Homo sapiens
tcagaccccctcagcct

SEQ ID NO: 675221 - DNA, 20 bp, Homo sapiens
tcagagaaggaaaagactga

SEQ ID NO: 675222 - DNA, 21 bp, Homo sapiens
tcagagaaggaaaagactgaa

SEQ ID NO: 675223 - DNA, 13 bp, Homo sapiens
tcagagataaagc

SEQ ID NO: 675224 - DNA, 23 bp, Homo sapiens
tcagagataaagcttaggtcaaa

SEQ ID NO: 675225 - DNA, 21 bp, Homo sapiens
tcagagttgactttcctccca

SEQ ID NO: 675226 - DNA, 14 bp, Homo sapiens
tcagataactgggt

SEQ ID NO: 675227 - DNA, 19 bp, Homo sapiens
tcagatcactgaatttata

SEQ ID NO: 675228 - DNA, 21 bp, Homo sapiens
tcagatcactgaatttataaa

SEQ ID NO: 675229 - DNA, 12 bp, Homo sapiens
tcagcagtctag

SEQ ID NO: 675230 - DNA, 17 bp, Homo sapiens
tcagcatatgtgtaaag

SEQ ID NO: 675231 - DNA, 19 bp, Homo sapiens
tcagcatatgtgtaaagat

SEQ ID NO: 675232 - DNA, 15 bp, Homo sapiens
tcagcatgcctgtcc

SEQ ID NO: 675233 - DNA, 20 bp, Homo sapiens
tcagcatgcctgtcctttca

SEQ ID NO: 675234 - DNA, 19 bp, Homo sapiens
tcagcatttccttgtcccg

SEQ ID NO: 675235 - DNA, 13 bp, Homo sapiens
tcagccacctggg

SEQ ID NO: 675236 - DNA, 14 bp, Homo sapiens
tcagccacctggga

SEQ ID NO: 675237 - DNA, 15 bp, Homo sapiens
tcagccacctgggaa

SEQ ID NO: 675238 - DNA, 18 bp, Homo sapiens
tcagccaggagctgtcac

SEQ ID NO: 675239 - DNA, 19 bp, Homo sapiens
tcagccctggcctggctgg

SEQ ID NO: 675240 - DNA, 20 bp, Homo sapiens
tcagcctccctagtagctgg

SEQ ID NO: 675241 - DNA, 16 bp, Homo sapiens
tcagcgttaatgtaaa

SEQ ID NO: 675242 - DNA, 15 bp, Homo sapiens
tcagctactaatgat

SEQ ID NO: 675243 - DNA, 18 bp, Homo sapiens
tcagctagcttttaggaa

SEQ ID NO: 675244 - DNA, 21 bp, Homo sapiens
tcagctcttgtcaaaaggtct

SEQ ID NO: 675245 - DNA, 19 bp, Homo sapiens
tcagctgccccaatgtgac

SEQ ID NO: 675246 - DNA, 23 bp, Homo sapiens
tcagctgccccaatgtgacctgg

SEQ ID NO: 675247 - DNA, 21 bp, Homo sapiens
tcagctgcctcctgcgccctg

SEQ ID NO: 675248 - DNA, 15 bp, Homo sapiens
tcagctgctccctgg

SEQ ID NO: 675249 - DNA, 19 bp, Homo sapiens
tcagctgctccctggcatt

SEQ ID NO: 675250 - DNA, 20 bp, Homo sapiens
tcagcttatctcttttatat

SEQ ID NO: 675251 - DNA, 15 bp, Homo sapiens
tcaggaaagagagca

SEQ ID NO: 675252 - DNA, 22 bp, Homo sapiens
tcaggagatcgagaccatcctg

SEQ ID NO: 675253 - DNA, 22 bp, Homo sapiens
tcaggcaattcctacctcttca

SEQ ID NO: 675254 - DNA, 18 bp, Homo sapiens
tcaggctatatgcagtcc

SEQ ID NO: 675255 - DNA, 23 bp, Homo sapiens
tcagggagcagggaaggcctgac

SEQ ID NO: 675256 - DNA, 13 bp, Homo sapiens
tcagggagtgctg

SEQ ID NO: 675257 - DNA, 20 bp, Homo sapiens
tcagggcctggggcctgaga

SEQ ID NO: 675258 - DNA, 21 bp, Homo sapiens
tcagggcctggggcctgagag

SEQ ID NO: 675259 - DNA, 22 bp, Homo sapiens
tcagggcctggggcctgagaga

SEQ ID NO: 675260 - DNA, 16 bp, Homo sapiens
tcagggctcccagggg

SEQ ID NO: 675261 - DNA, 20 bp, Homo sapiens
tcagggctggagcctggggt

SEQ ID NO: 675262 - DNA, 17 bp, Homo sapiens
tcagggtctccttcctt

SEQ ID NO: 675263 - DNA, 23 bp, Homo sapiens
tcagggtggtctcttcttggggc

SEQ ID NO: 675264 - DNA, 21 bp, Homo sapiens
tcaggtgaacacttagtgatc

SEQ ID NO: 675265 - DNA, 22 bp, Homo sapiens
tcaggtgttttttatgaagtgc

SEQ ID NO: 675266 - DNA, 15 bp, Homo sapiens
tcagtagtgctaatg

SEQ ID NO: 675267 - DNA, 22 bp, Homo sapiens
tcagtagtgctaatgcattttg

SEQ ID NO: 675268 - DNA, 13 bp, Homo sapiens
tcagtccctcttc

SEQ ID NO: 675269 - DNA, 17 bp, Homo sapiens
tcagtcctaatttgaac

SEQ ID NO: 675270 - DNA, 16 bp, Homo sapiens
tcagtcctgggcaaag

SEQ ID NO: 675271 - DNA, 22 bp, Homo sapiens
tcagtgcaaattgtatcttatt

SEQ ID NO: 675272 - DNA, 16 bp, Homo sapiens
tcagtgtaagccctgc

SEQ ID NO: 675273 - DNA, 15 bp, Homo sapiens
tcagtgttggtatat

SEQ ID NO: 675274 - DNA, 18 bp, Homo sapiens
tcagtgttgttgctctag

SEQ ID NO: 675275 - DNA, 17 bp, Homo sapiens
tcagtgtttttgtgaat

SEQ ID NO: 675276 - DNA, 20 bp, Homo sapiens
tcagttgaaaatgcaactct

SEQ ID NO: 675277 - DNA, 19 bp, Homo sapiens
tcagtttgttggaaagtaa

SEQ ID NO: 675278 - DNA, 16 bp, Homo sapiens
tcataaaatagaataa

SEQ ID NO: 675279 - DNA, 19 bp, Homo sapiens
tcataaacattttacatgc

SEQ ID NO: 675280 - DNA, 21 bp, Homo sapiens
tcataaagcattggagtttca

SEQ ID NO: 675281 - DNA, 14 bp, Homo sapiens
tcatacctcagaat

SEQ ID NO: 675282 - DNA, 20 bp, Homo sapiens
tcatactactgaaacagatt

SEQ ID NO: 675283 - DNA, 17 bp, Homo sapiens
tcatagaaaattgaaac

SEQ ID NO: 675284 - DNA, 15 bp, Homo sapiens
tcatagaattgcagt

SEQ ID NO: 675285 - DNA, 15 bp, Homo sapiens
tcatagcttcacaat

SEQ ID NO: 675286 - DNA, 23 bp, Homo sapiens
tcatataattaaagactcaagag

SEQ ID NO: 675287 - DNA, 13 bp, Homo sapiens
tcatatacaaaca

SEQ ID NO: 675288 - DNA, 14 bp, Homo sapiens
tcatatacaaacat

SEQ ID NO: 675289 - DNA, 22 bp, Homo sapiens
tcatatagcattgataatcttc

SEQ ID NO: 675290 - DNA, 23 bp, Homo sapiens
tcatatagcattgataatcttca

SEQ ID NO: 675291 - DNA, 13 bp, Homo sapiens
tcatcactttgga

SEQ ID NO: 675292 - DNA, 14 bp, Homo sapiens
tcatcagggcctgg

SEQ ID NO: 675293 - DNA, 17 bp, Homo sapiens
tcatcaggggcctgcag

SEQ ID NO: 675294 - DNA, 13 bp, Homo sapiens
tcatcatcagggc

SEQ ID NO: 675295 - DNA, 15 bp, Homo sapiens
tcatcatcagggcct

SEQ ID NO: 675296 - DNA, 16 bp, Homo sapiens
tcatcatcagggcctg

SEQ ID NO: 675297 - DNA, 13 bp, Homo sapiens
tcatccctttggt

SEQ ID NO: 675298 - DNA, 14 bp, Homo sapiens
tcatccttctttcc

SEQ ID NO: 675299 - DNA, 17 bp, Homo sapiens
tcatccttctttccttg

SEQ ID NO: 675300 - DNA, 21 bp, Homo sapiens
tcatccttctttccttgttca

SEQ ID NO: 675301 - DNA, 14 bp, Homo sapiens
tcatcgccagaggt

SEQ ID NO: 675302 - DNA, 15 bp, Homo sapiens
tcatcgccagaggtg

SEQ ID NO: 675303 - DNA, 21 bp, Homo sapiens
tcatcgccagaggtgcttcac

SEQ ID NO: 675304 - DNA, 22 bp, Homo sapiens
tcatcggagtcagccaggagct

SEQ ID NO: 675305 - DNA, 16 bp, Homo sapiens
tcatctaccttttctg

SEQ ID NO: 675306 - DNA, 16 bp, Homo sapiens
tcatctcaggtagaag

SEQ ID NO: 675307 - DNA, 15 bp, Homo sapiens
tcatgaaaatgacat

SEQ ID NO: 675308 - DNA, 16 bp, Homo sapiens
tcatgcacccctgagc

SEQ ID NO: 675309 - DNA, 23 bp, Homo sapiens
tcatgcctgtaatcccagcactt

SEQ ID NO: 675310 - DNA, 14 bp, Homo sapiens
tcatgcttgacata

SEQ ID NO: 675311 - DNA, 14 bp, Homo sapiens
tcatggtcctgaat

SEQ ID NO: 675312 - DNA, 13 bp, Homo sapiens
tcatgttccaaat

SEQ ID NO: 675313 - DNA, 15 bp, Homo sapiens
tcatgtttttaactt

SEQ ID NO: 675314 - DNA, 13 bp, Homo sapiens
tcattaaaaatta

SEQ ID NO: 675315 - DNA, 17 bp, Homo sapiens
tcattaaacttttttaa

SEQ ID NO: 675316 - DNA, 17 bp, Homo sapiens
tcattactgtgaggagt

SEQ ID NO: 675317 - DNA, 23 bp, Homo sapiens
tcattcaactctccaatgttcta

SEQ ID NO: 675318 - DNA, 23 bp, Homo sapiens
tcattcgctactatgatttaatt

SEQ ID NO: 675319 - DNA, 16 bp, Homo sapiens
tctaagaaaatgtagt

SEQ ID NO: 675320 - DNA, 18 bp, Homo sapiens
tctaagaagacattttgt

SEQ ID NO: 675321 - DNA, 22 bp, Homo sapiens
tctaagaagacattttgttaca

SEQ ID NO: 675322 - DNA, 23 bp, Homo sapiens
tctaagactatatatataaatgt

SEQ ID NO: 675323 - DNA, 15 bp, Homo sapiens
tctaatccttttcct

SEQ ID NO: 675324 - DNA, 12 bp, Homo sapiens
tctaattctgat

SEQ ID NO: 675325 - DNA, 19 bp, Homo sapiens
tctaattgcatctcaaaat

SEQ ID NO: 675326 - DNA, 16 bp, Homo sapiens
tctaattgctgtgtgt

SEQ ID NO: 675327 - DNA, 12 bp, Homo sapiens
tctaattgtaag

SEQ ID NO: 675328 - DNA, 21 bp, Homo sapiens
tctaattgtaagtgaaattaa

SEQ ID NO: 675329 - DNA, 22 bp, Homo sapiens
tctacaatctctttttgtttgc

SEQ ID NO: 675330 - DNA, 16 bp, Homo sapiens
tctacacaatttaatt

SEQ ID NO: 675331 - DNA, 21 bp, Homo sapiens
tctacaccaatgaaaacatgt

SEQ ID NO: 675332 - DNA, 19 bp, Homo sapiens
tctacataaaatacaaaaa

SEQ ID NO: 675333 - DNA, 14 bp, Homo sapiens
tctacatgtctaga

SEQ ID NO: 675334 - DNA, 17 bp, Homo sapiens
tctacccttttcctttt

SEQ ID NO: 675335 - DNA, 19 bp, Homo sapiens
tctactcctagaagaacca

SEQ ID NO: 675336 - DNA, 18 bp, Homo sapiens
tctagaatgtaaagttat

SEQ ID NO: 675337 - DNA, 14 bp, Homo sapiens
tctagcattctgca

SEQ ID NO: 675338 - DNA, 21 bp, Homo sapiens
tctagccagcccctcttcccc

SEQ ID NO: 675339 - DNA, 14 bp, Homo sapiens
tctagctaaataaa

SEQ ID NO: 675340 - DNA, 18 bp, Homo sapiens
tctaggatgggaacaagg

SEQ ID NO: 675341 - DNA, 17 bp, Homo sapiens
tctagtacttgaaaaag

SEQ ID NO: 675342 - DNA, 20 bp, Homo sapiens
tctagtagtgtggcctgtgc

SEQ ID NO: 675343 - DNA, 22 bp, Homo sapiens
tctataagtagtaaatcagaaa

SEQ ID NO: 675344 - DNA, 23 bp, Homo sapiens
tctatcttccaaatgcaatttga

SEQ ID NO: 675345 - DNA, 14 bp, Homo sapiens
tctatgacaaattc

SEQ ID NO: 675346 - DNA, 15 bp, Homo sapiens
tctatgacaaattca

SEQ ID NO: 675347 - DNA, 16 bp, Homo sapiens
tctatggcttatttct

SEQ ID NO: 675348 - DNA, 19 bp, Homo sapiens
tctatggcttatttctatg

SEQ ID NO: 675349 - DNA, 21 bp, Homo sapiens
tctatggcttatttctatgac

SEQ ID NO: 675350 - DNA, 19 bp, Homo sapiens
tctattaatcacctctctg

SEQ ID NO: 675351 - DNA, 14 bp, Homo sapiens
tctattccaataaa

SEQ ID NO: 675352 - DNA, 15 bp, Homo sapiens
tctattgcttggact

SEQ ID NO: 675353 - DNA, 16 bp, Homo sapiens
tctcaaagagaattgt

SEQ ID NO: 675354 - DNA, 14 bp, Homo sapiens
tctcaactgtccca

SEQ ID NO: 675355 - DNA, 18 bp, Homo sapiens
tctcaagctagtgtttct

SEQ ID NO: 675356 - DNA, 19 bp, Homo sapiens
tctcaagctagtgtttcta

SEQ ID NO: 675357 - DNA, 20 bp, Homo sapiens
tctcaagctagtgtttctag

SEQ ID NO: 675358 - DNA, 23 bp, Homo sapiens
tctcaagctagtgtttctagcta

SEQ ID NO: 675359 - DNA, 15 bp, Homo sapiens
tctcaaggagaggca

SEQ ID NO: 675360 - DNA, 23 bp, Homo sapiens
tctcacccatgcaagcagaggac

SEQ ID NO: 675361 - DNA, 16 bp, Homo sapiens
tctcaccccactcctg

SEQ ID NO: 675362 - DNA, 19 bp, Homo sapiens
tctcaccccactcctgtca

SEQ ID NO: 675363 - DNA, 18 bp, Homo sapiens
tctcactaaagcatgaaa

SEQ ID NO: 675364 - DNA, 10 bp, Homo sapiens
tctcagggct

SEQ ID NO: 675365 - DNA, 11 bp, Homo sapiens
tctcagggctg

SEQ ID NO: 675366 - DNA, 12 bp, Homo sapiens
tctcagggctgg

SEQ ID NO: 675367 - DNA, 21 bp, Homo sapiens
tctcagggctggagcctgggg

SEQ ID NO: 675368 - DNA, 22 bp, Homo sapiens
tctcaggtagaaggttgacaca

SEQ ID NO: 675369 - DNA, 13 bp, Homo sapiens
tctcagtgttggt

SEQ ID NO: 675370 - DNA, 17 bp, Homo sapiens
tctcataattttgcaaa

SEQ ID NO: 675371 - DNA, 14 bp, Homo sapiens
tctcatcctccagt

SEQ ID NO: 675372 - DNA, 15 bp, Homo sapiens
tctcatgttaaatat

SEQ ID NO: 675373 - DNA, 16 bp, Homo sapiens
tctcatgttaaatatt

SEQ ID NO: 675374 - DNA, 21 bp, Homo sapiens
tctcattccgttgtctgtgga

SEQ ID NO: 675375 - DNA, 22 bp, Homo sapiens
tctcattgacttttataaagca

SEQ ID NO: 675376 - DNA, 14 bp, Homo sapiens
tctcattgtcacct

SEQ ID NO: 675377 - DNA, 16 bp, Homo sapiens
tctcattgtcacctct

SEQ ID NO: 675378 - DNA, 11 bp, Homo sapiens
tctccatgtgt

SEQ ID NO: 675379 - DNA, 20 bp, Homo sapiens
tctcccaagctgattttatt

SEQ ID NO: 675380 - DNA, 20 bp, Homo sapiens
tctcccctagagccctctcc

SEQ ID NO: 675381 - DNA, 14 bp, Homo sapiens
tctccctggctccc

SEQ ID NO: 675382 - DNA, 15 bp, Homo sapiens
tctcctgaatatttt

SEQ ID NO: 675383 - DNA, 15 bp, Homo sapiens
tctcctgactggtgc

SEQ ID NO: 675384 - DNA, 12 bp, Homo sapiens
tctcctgccctg

SEQ ID NO: 675385 - DNA, 13 bp, Homo sapiens
tctcctgccctgt

SEQ ID NO: 675386 - DNA, 22 bp, Homo sapiens
tctcctgctgatttcactttgg

SEQ ID NO: 675387 - DNA, 20 bp, Homo sapiens
tctccttaagctgcagagat

SEQ ID NO: 675388 - DNA, 22 bp, Homo sapiens
tctccttaagctgcagagattt

SEQ ID NO: 675389 - DNA, 12 bp, Homo sapiens
tctccttccttc

SEQ ID NO: 675390 - DNA, 17 bp, Homo sapiens
tctccttttcctatcct

SEQ ID NO: 675391 - DNA, 15 bp, Homo sapiens
tctcgaatttgaaga

SEQ ID NO: 675392 - DNA, 16 bp, Homo sapiens
tctcgaatttgaagag

SEQ ID NO: 675393 - DNA, 14 bp, Homo sapiens
tctctacagtgcca

SEQ ID NO: 675394 - DNA, 14 bp, Homo sapiens
tctctatgtactat

SEQ ID NO: 675395 - DNA, 12 bp, Homo sapiens
tctctcctggcc

SEQ ID NO: 675396 - DNA, 16 bp, Homo sapiens
tctctcctggcctatc

SEQ ID NO: 675397 - DNA, 14 bp, Homo sapiens
tctctctctaaggt

SEQ ID NO: 675398 - DNA, 20 bp, Homo sapiens
tctctcttgcctgaggggaa

SEQ ID NO: 675399 - DNA, 13 bp, Homo sapiens
tctctcttgtcct

SEQ ID NO: 675400 - DNA, 14 bp, Homo sapiens
tctctgaaagtgtg

SEQ ID NO: 675401 - DNA, 15 bp, Homo sapiens
ttggaagttttaatc

SEQ ID NO: 675402 - DNA, 16 bp, Homo sapiens
ttggacaactgcatgg

SEQ ID NO: 675403 - DNA, 22 bp, Homo sapiens
ttggacagctgactgaatgcag

SEQ ID NO: 675404 - DNA, 16 bp, Homo sapiens
ttggacagctgataaa

SEQ ID NO: 675405 - DNA, 13 bp, Homo sapiens
ttggacaggagtt

SEQ ID NO: 675406 - DNA, 13 bp, Homo sapiens
ttggactacacaa

SEQ ID NO: 675407 - DNA, 17 bp, Homo sapiens
ttggactacacaataca

SEQ ID NO: 675408 - DNA, 14 bp, Homo sapiens
ttggactccatctc

SEQ ID NO: 675409 - DNA, 22 bp, Homo sapiens
ttggagagggcccaggtcccaa

SEQ ID NO: 675410 - DNA, 22 bp, Homo sapiens
ttggagatgctgagggtgtttc

SEQ ID NO: 675411 - DNA, 16 bp, Homo sapiens
ttggatcttgaatgtg

SEQ ID NO: 675412 - DNA, 15 bp, Homo sapiens
ttggcacagaacagg

SEQ ID NO: 675413 - DNA, 20 bp, Homo sapiens
ttggcacatgccacctggca

SEQ ID NO: 675414 - DNA, 16 bp, Homo sapiens
ttggcagtggcagaga

SEQ ID NO: 675415 - DNA, 18 bp, Homo sapiens
ttggcctggggtgcatct

SEQ ID NO: 675416 - DNA, 22 bp, Homo sapiens
ttggcctggggtgcatctcctc

SEQ ID NO: 675417 - DNA, 20 bp, Homo sapiens
ttggcctgtgatgttttatc

SEQ ID NO: 675418 - DNA, 15 bp, Homo sapiens
ttggctcccgggggc

SEQ ID NO: 675419 - DNA, 10 bp, Homo sapiens
ttgggaagaa

SEQ ID NO: 675420 - DNA, 23 bp, Homo sapiens
ttgggaatgaggaaaattcttaa

SEQ ID NO: 675421 - DNA, 19 bp, Homo sapiens
ttgggagaagcaaatatag

SEQ ID NO: 675422 - DNA, 21 bp, Homo sapiens
ttgggcagtctttcttgaaat

SEQ ID NO: 675423 - DNA, 22 bp, Homo sapiens
ttggggaggagggggccgggcg

SEQ ID NO: 675424 - DNA, 17 bp, Homo sapiens
ttggtaaatgtttcttt

SEQ ID NO: 675425 - DNA, 18 bp, Homo sapiens
ttggtatagccatgattt

SEQ ID NO: 675426 - DNA, 12 bp, Homo sapiens
ttggtcagcttt

SEQ ID NO: 675427 - DNA, 19 bp, Homo sapiens
ttggtctgccttctgctga

SEQ ID NO: 675428 - DNA, 18 bp, Homo sapiens
ttggtcttctactgcctt

SEQ ID NO: 675429 - DNA, 12 bp, Homo sapiens
ttggttaaataa

SEQ ID NO: 675430 - DNA, 21 bp, Homo sapiens
ttggtttgtggcgtctccctc

SEQ ID NO: 675431 - DNA, 13 bp, Homo sapiens
ttgtaaaacttct

SEQ ID NO: 675432 - DNA, 15 bp, Homo sapiens
ttgtaaaacttctgc

SEQ ID NO: 675433 - DNA, 18 bp, Homo sapiens
ttgtaaaagcattttgta

SEQ ID NO: 675434 - DNA, 19 bp, Homo sapiens
ttgtaaaagcattttgtaa

SEQ ID NO: 675435 - DNA, 16 bp, Homo sapiens
ttgtaaatgaaactta

SEQ ID NO: 675436 - DNA, 18 bp, Homo sapiens
ttgtaaatgaaacttaag

SEQ ID NO: 675437 - DNA, 21 bp, Homo sapiens
ttgtaaatgaaacttaagaat

SEQ ID NO: 675438 - DNA, 22 bp, Homo sapiens
ttgtaaatgaaacttaagaatt

SEQ ID NO: 675439 - DNA, 21 bp, Homo sapiens
ttgtaactaaaataattttgt

SEQ ID NO: 675440 - DNA, 22 bp, Homo sapiens
ttgtaactaaaataattttgta

SEQ ID NO: 675441 - DNA, 23 bp, Homo sapiens
ttgtaactaaaataattttgtaa

SEQ ID NO: 675442 - DNA, 15 bp, Homo sapiens
ttctgctgaaagact

SEQ ID NO: 675443 - DNA, 19 bp, Homo sapiens
ttctggacccttataaaat

SEQ ID NO: 675444 - DNA, 19 bp, Homo sapiens
ttctggataaagccactga

SEQ ID NO: 675445 - DNA, 23 bp, Homo sapiens
ttctggggggacccagtgcagaa

SEQ ID NO: 675446 - DNA, 18 bp, Homo sapiens
ttctggtgtatattttaa

SEQ ID NO: 675447 - DNA, 14 bp, Homo sapiens
ttctggttcttgaa

SEQ ID NO: 675448 - DNA, 16 bp, Homo sapiens
ttctgtaatgtaaata

SEQ ID NO: 675449 - DNA, 17 bp, Homo sapiens
ttctgtaatgtaaataa

SEQ ID NO: 675450 - DNA, 18 bp, Homo sapiens
ttctgtaatgtaaataaa

SEQ ID NO: 675451 - DNA, 15 bp, Homo sapiens
ttctgtactgttact

SEQ ID NO: 675452 - DNA, 19 bp, Homo sapiens
ttctgtagacttttgaaaa

SEQ ID NO: 675453 - DNA, 21 bp, Homo sapiens
ttctgtggttcctctgctcac

SEQ ID NO: 675454 - DNA, 21 bp, Homo sapiens
ttctgtgtaaacagaagcctg

SEQ ID NO: 675455 - DNA, 20 bp, Homo sapiens
ttcttaaggttttgttgcta

SEQ ID NO: 675456 - DNA, 14 bp, Homo sapiens
ttcttacacactgt

SEQ ID NO: 675457 - DNA, 16 bp, Homo sapiens
ttcttacatgcatttg

SEQ ID NO: 675458 - DNA, 16 bp, Homo sapiens
ttcttatacgcttttc

SEQ ID NO: 675459 - DNA, 21 bp, Homo sapiens
ttcttcaacatgctccaaata

SEQ ID NO: 675460 - DNA, 23 bp, Homo sapiens
ttcttcgctggactattgtgcca

SEQ ID NO: 675461 - DNA, 12 bp, Homo sapiens
ttcttctaagaa

SEQ ID NO: 675462 - DNA, 14 bp, Homo sapiens
ttcttctaagaaga

SEQ ID NO: 675463 - DNA, 17 bp, Homo sapiens
ttcttctaagaagacat

SEQ ID NO: 675464 - DNA, 21 bp, Homo sapiens
ttcttctaagaagacattttg

SEQ ID NO: 675465 - DNA, 22 bp, Homo sapiens
ttcttctaagaagacattttgt

SEQ ID NO: 675466 - DNA, 20 bp, Homo sapiens
ttcttctgcaacatttgaca

SEQ ID NO: 675467 - DNA, 19 bp, Homo sapiens
ttcttgagaagtaactgtc

SEQ ID NO: 675468 - DNA, 15 bp, Homo sapiens
ttcttgctttcaatt

SEQ ID NO: 675469 - DNA, 17 bp, Homo sapiens
ttctttccattatgatt

SEQ ID NO: 675470 - DNA, 19 bp, Homo sapiens
ttctttcccatgtatttgt

SEQ ID NO: 675471 - DNA, 14 bp, Homo sapiens
ttctttccttgttc

SEQ ID NO: 675472 - DNA, 21 bp, Homo sapiens
ttctttggattctaaatacat

SEQ ID NO: 675473 - DNA, 12 bp, Homo sapiens
ttctttgtgcct

SEQ ID NO: 675474 - DNA, 15 bp, Homo sapiens
ttctttgtgcctttg

SEQ ID NO: 675475 - DNA, 16 bp, Homo sapiens
ttctttgtgcctttgg

SEQ ID NO: 675476 - DNA, 14 bp, Homo sapiens
ttcttttgtttggt

SEQ ID NO: 675477 - DNA, 14 bp, Homo sapiens
ttctttttgccagt

SEQ ID NO: 675478 - DNA, 17 bp, Homo sapiens
ttcttttttttttcatt

SEQ ID NO: 675479 - DNA, 17 bp, Homo sapiens
ttgaaaaatataaaatt

SEQ ID NO: 675480 - DNA, 19 bp, Homo sapiens
ttgaaaaatataaaattat

SEQ ID NO: 675481 - DNA, 15 bp, Homo sapiens
ttgaaaaatgacaat

SEQ ID NO: 675482 - DNA, 16 bp, Homo sapiens
ttgaaaaatgacaatt

SEQ ID NO: 675483 - DNA, 20 bp, Homo sapiens
ttgaaactttgggaaaacat

SEQ ID NO: 675484 - DNA, 22 bp, Homo sapiens
ttgaaactttgggaaaacatgt

SEQ ID NO: 675485 - DNA, 23 bp, Homo sapiens
ttgaaatagtatacattgtcttg

SEQ ID NO: 675486 - DNA, 20 bp, Homo sapiens
ttgaaatgtttaataaagct

SEQ ID NO: 675487 - DNA, 22 bp, Homo sapiens
ttgaaatgtttaataaagcttt

SEQ ID NO: 675488 - DNA, 19 bp, Homo sapiens
ttaaacactacacatttga

SEQ ID NO: 675489 - DNA, 18 bp, Homo sapiens
ttaaacatacataataca

SEQ ID NO: 675490 - DNA, 16 bp, Homo sapiens
ttaaactatgttccta

SEQ ID NO: 675491 - DNA, 18 bp, Homo sapiens
ttaaactatgttcctaac

SEQ ID NO: 675492 - DNA, 15 bp, Homo sapiens
ttaaacttttttaac

SEQ ID NO: 675493 - DNA, 14 bp, Homo sapiens
ttaaagagaatgag

SEQ ID NO: 675494 - DNA, 14 bp, Homo sapiens
ttaaagtattttct

SEQ ID NO: 675495 - DNA, 17 bp, Homo sapiens
ttaaataataaagtatg

SEQ ID NO: 675496 - DNA, 23 bp, Homo sapiens
ttaaatcacagcccaaaatttga

SEQ ID NO: 675497 - DNA, 12 bp, Homo sapiens
ttaaatgaaaga

SEQ ID NO: 675498 - DNA, 16 bp, Homo sapiens
ttaaatgaaagaaaat

SEQ ID NO: 675499 - DNA, 18 bp, Homo sapiens
ttaaatgtattttacata

SEQ ID NO: 675500 - DNA, 17 bp, Homo sapiens
ttaaatgtttatactgt

SEQ ID NO: 675501 - DNA, 15 bp, Homo sapiens
ttaaatttaatacca

SEQ ID NO: 675502 - DNA, 19 bp, Homo sapiens
ttaaattttgtaggatttt

SEQ ID NO: 675503 - DNA, 23 bp, Homo sapiens
ttaacagtggttcaaatttcctt

SEQ ID NO: 675504 - DNA, 20 bp, Homo sapiens
ttaacatacaagaaaatgta

SEQ ID NO: 675505 - DNA, 22 bp, Homo sapiens
ttaacatgaacacccttagaaa

SEQ ID NO: 675506 - DNA, 19 bp, Homo sapiens
ttaacattttggaaattgt

SEQ ID NO: 675507 - DNA, 17 bp, Homo sapiens
ttaaccattattatgca

SEQ ID NO: 675508 - DNA, 16 bp, Homo sapiens
ttaacccacctctcct

SEQ ID NO: 675509 - DNA, 18 bp, Homo sapiens
ttaactactatattgatt

SEQ ID NO: 675510 - DNA, 21 bp, Homo sapiens
ttaactatatgtgaaacattt

SEQ ID NO: 675511 - DNA, 16 bp, Homo sapiens
ttaactttaatacagc

SEQ ID NO: 675512 - DNA, 13 bp, Homo sapiens
ttaagatattgaa

SEQ ID NO: 675513 - DNA, 11 bp, Homo sapiens
ttaagatgtga

SEQ ID NO: 675514 - DNA, 13 bp, Homo sapiens
ttaagatgtgaaa

SEQ ID NO: 675515 - DNA, 16 bp, Homo sapiens
ttaagcaggtttgttt

SEQ ID NO: 675516 - DNA, 22 bp, Homo sapiens
ttaagcattttgaaacaaagta

SEQ ID NO: 675517 - DNA, 16 bp, Homo sapiens
ttaagccttcaaaact

SEQ ID NO: 675518 - DNA, 19 bp, Homo sapiens
ttaagctgcagagatttct

SEQ ID NO: 675519 - DNA, 11 bp, Homo sapiens
ttaaggattct

SEQ ID NO: 675520 - DNA, 19 bp, Homo sapiens
ttaaggccaggcatggtgg

SEQ ID NO: 675521 - DNA, 21 bp, Homo sapiens
ttaagggatggaaaaggaaga

SEQ ID NO: 675522 - DNA, 12 bp, Homo sapiens
ttaagggcagag

SEQ ID NO: 675523 - DNA, 17 bp, Homo sapiens
ttaaggggaagaatgaa

SEQ ID NO: 675524 - DNA, 23 bp, Homo sapiens
ttaagtatctgggattattcttt

SEQ ID NO: 675525 - DNA, 16 bp, Homo sapiens
ttaagtttttaatctg

SEQ ID NO: 675526 - DNA, 14 bp, Homo sapiens
ttaataaactgcaa

SEQ ID NO: 675527 - DNA, 16 bp, Homo sapiens
ttaataaactgcaagt

SEQ ID NO: 675528 - DNA, 11 bp, Homo sapiens
ttaataaagct

SEQ ID NO: 675529 - DNA, 13 bp, Homo sapiens
ttaataaagcttt

SEQ ID NO: 675530 - DNA, 18 bp, Homo sapiens
ttaataaattggtaatat

SEQ ID NO: 675531 - DNA, 23 bp, Homo sapiens
ttaataccagataccttatctta

SEQ ID NO: 675532 - DNA, 19 bp, Homo sapiens
ttaatagtttgtctatttt

SEQ ID NO: 675533 - DNA, 17 bp, Homo sapiens
ttaatatggtgtatttt

SEQ ID NO: 675534 - DNA, 20 bp, Homo sapiens
ttaatattcttttgtttcca

SEQ ID NO: 675535 - DNA, 20 bp, Homo sapiens
ttaatcacctctctgtagtt

SEQ ID NO: 675536 - DNA, 18 bp, Homo sapiens
ttaatccagttataagaa

SEQ ID NO: 675537 - DNA, 20 bp, Homo sapiens
ttaatccagttataagaaga

SEQ ID NO: 675538 - DNA, 21 bp, Homo sapiens
ttaatccagttataagaagaa

SEQ ID NO: 675539 - DNA, 11 bp, Homo sapiens
ttaatgactta

SEQ ID NO: 675540 - DNA, 21 bp, Homo sapiens
ttaatgctgtttctaagaaaa

SEQ ID NO: 675541 - DNA, 23 bp, Homo sapiens
ttaatgctgtttctaagaaaatg

SEQ ID NO: 675542 - DNA, 20 bp, Homo sapiens
ttaatggaagtgtatttatt

SEQ ID NO: 675543 - DNA, 22 bp, Homo sapiens
ttaattactggaattcttctgc

SEQ ID NO: 675544 - DNA, 20 bp, Homo sapiens
ttaatttagaaactgaaaaa

SEQ ID NO: 675545 - DNA, 21 bp, Homo sapiens
ttaatttgtaaaacttctgct

SEQ ID NO: 675546 - DNA, 22 bp, Homo sapiens
ttaatttgtaaaacttctgctc

SEQ ID NO: 675547 - DNA, 22 bp, Homo sapiens
ttaatttgtgaaaatgtaatta

SEQ ID NO: 675548 - DNA, 13 bp, Homo sapiens
ttaattttaatgc

SEQ ID NO: 675549 - DNA, 17 bp, Homo sapiens
ttaattttactccataa

SEQ ID NO: 675550 - DNA, 18 bp, Homo sapiens
ttaatttttcttagtgtt

SEQ ID NO: 675551 - DNA, 16 bp, Homo sapiens
ttacaaagcagttact

SEQ ID NO: 675552 - DNA, 15 bp, Homo sapiens
ttacaagatattatt

SEQ ID NO: 675553 - DNA, 17 bp, Homo sapiens
ttacaataggagtggtg

SEQ ID NO: 675554 - DNA, 20 bp, Homo sapiens
ttacagacctcagttttatg

SEQ ID NO: 675555 - DNA, 22 bp, Homo sapiens
ttacagatttctcactatatat

SEQ ID NO: 675556 - DNA, 19 bp, Homo sapiens
ttacagctcattaaacttt

SEQ ID NO: 675557 - DNA, 19 bp, Homo sapiens
ttacataacggaaagtttt

SEQ ID NO: 675558 - DNA, 18 bp, Homo sapiens
ttacataaggatgacttt

SEQ ID NO: 675559 - DNA, 22 bp, Homo sapiens
ttacataaggatgactttttta

SEQ ID NO: 675560 - DNA, 18 bp, Homo sapiens
ttaccagtgccttaaact

SEQ ID NO: 675561 - DNA, 16 bp, Homo sapiens
ttacccttttccccct

SEQ ID NO: 675562 - DNA, 19 bp, Homo sapiens
ttacctggtgagtaactta

SEQ ID NO: 675563 - DNA, 23 bp, Homo sapiens
ttacctggtgagtaacttagaaa

SEQ ID NO: 675564 - DNA, 14 bp, Homo sapiens
ttacctttctctct

SEQ ID NO: 675565 - DNA, 18 bp, Homo sapiens
ttactaactaaataccat

SEQ ID NO: 675566 - DNA, 21 bp, Homo sapiens
ttactattttctacaattaat

SEQ ID NO: 675567 - DNA, 20 bp, Homo sapiens
ttactcccccaccactcagg

SEQ ID NO: 675568 - DNA, 16 bp, Homo sapiens
ttactgaataatatca

SEQ ID NO: 675569 - DNA, 22 bp, Homo sapiens
ttactgaattgtatcaatttgt

SEQ ID NO: 675570 - DNA, 14 bp, Homo sapiens
ttactgacatttct

SEQ ID NO: 675571 - DNA, 16 bp, Homo sapiens
ttactgactcctcagt

SEQ ID NO: 675572 - DNA, 19 bp, Homo sapiens
ttactgtctattaatattc

SEQ ID NO: 675573 - DNA, 17 bp, Homo sapiens
ttactttaattactgga

SEQ ID NO: 675574 - DNA, 17 bp, Homo sapiens
ttagaaaagtggtgtaa

SEQ ID NO: 675575 - DNA, 13 bp, Homo sapiens
ttagaaactgaaa

SEQ ID NO: 675576 - DNA, 20 bp, Homo sapiens
ttagagataggaaactgaag

SEQ ID NO: 675577 - DNA, 21 bp, Homo sapiens
ttagattttattttactattg

SEQ ID NO: 675578 - DNA, 20 bp, Homo sapiens
ttagcaatagctagctatat

SEQ ID NO: 675579 - DNA, 22 bp, Homo sapiens
ttagcaggttgggctagagaaa

SEQ ID NO: 675580 - DNA, 21 bp, Homo sapiens
ttagcgtcaagacatttgctg

SEQ ID NO: 675581 - DNA, 24 bp, Homo sapiens
ttagctccataaagtacaaatgaa

SEQ ID NO: 675582 - DNA, 16 bp, Homo sapiens
ttagctgaagaattga

SEQ ID NO: 675583 - DNA, 16 bp, Homo sapiens
ttagctgcacggcatt

SEQ ID NO: 675584 - DNA, 21 bp, Homo sapiens
ttaggaaaatcactttgtcta

SEQ ID NO: 675585 - DNA, 15 bp, Homo sapiens
ttaggcagattgaaa

SEQ ID NO: 675586 - DNA, 19 bp, Homo sapiens
ttaggtttggtttggtttt

SEQ ID NO: 675587 - DNA, 19 bp, Homo sapiens
ttagtaatggcagagcagt

SEQ ID NO: 675588 - DNA, 18 bp, Homo sapiens
ttagtctgaaactggctt

SEQ ID NO: 675589 - DNA, 19 bp, Homo sapiens
ttagtctgaaactggcttc

SEQ ID NO: 675590 - DNA, 14 bp, Homo sapiens
ttagtgaatgggaa

SEQ ID NO: 675591 - DNA, 14 bp, Homo sapiens
ttagtgccagaatt

SEQ ID NO: 675592 - DNA, 12 bp, Homo sapiens
ttagtggcaccg

SEQ ID NO: 675593 - DNA, 19 bp, Homo sapiens
ttagtggtcataaaataga

SEQ ID NO: 675594 - DNA, 22 bp, Homo sapiens
ttagtgtgacagtttccaaatt

SEQ ID NO: 675595 - DNA, 15 bp, Homo sapiens
ttagttccactgaga

SEQ ID NO: 675596 - DNA, 15 bp, Homo sapiens
ttagttgccaacagt

SEQ ID NO: 675597 - DNA, 18 bp, Homo sapiens
ttagtttttggttgggaa

SEQ ID NO: 675598 - DNA, 18 bp, Homo sapiens
ttataaaaataaagggaa

SEQ ID NO: 675599 - DNA, 17 bp, Homo sapiens
ttataaaattttgcttt

SEQ ID NO: 675600 - DNA, 21 bp, Homo sapiens
ttataaacagacaatatgtga

SEQ ID NO: 675601 - DNA, 11 bp, Homo sapiens
ttataagcatt

SEQ ID NO: 675602 - DNA, 16 bp, Homo sapiens
ttataagcattgccat

SEQ ID NO: 675603 - DNA, 15 bp, Homo sapiens
ttataataaatatat

SEQ ID NO: 675604 - DNA, 18 bp, Homo sapiens
ttatacaatggaataaat

SEQ ID NO: 675605 - DNA, 20 bp, Homo sapiens
ttatacatgtgatacatttt

SEQ ID NO: 675606 - DNA, 14 bp, Homo sapiens
ttatacgcttttct

SEQ ID NO: 675607 - DNA, 23 bp, Homo sapiens
atcctggtttcataacttcctgt

SEQ ID NO: 675608 - DNA, 18 bp, Homo sapiens
atccttacaatgtgaata

SEQ ID NO: 675609 - DNA, 15 bp, Homo sapiens
atccttatcagagct

SEQ ID NO: 675610 - DNA, 16 bp, Homo sapiens
atccttccctttggag

SEQ ID NO: 675611 - DNA, 13 bp, Homo sapiens
atccttctttcct

SEQ ID NO: 675612 - DNA, 13 bp, Homo sapiens
atccttttcctta

SEQ ID NO: 675613 - DNA, 21 bp, Homo sapiens
atccttttccttatttgcctt

SEQ ID NO: 675614 - DNA, 22 bp, Homo sapiens
atccttttccttatttgccttc

SEQ ID NO: 675615 - DNA, 17 bp, Homo sapiens
atcgagaccatcctggc

SEQ ID NO: 675616 - DNA, 19 bp, Homo sapiens
atcgccagaggtgcttcac

SEQ ID NO: 675617 - DNA, 17 bp, Homo sapiens
atcgcttttaataaact

SEQ ID NO: 675618 - DNA, 18 bp, Homo sapiens
atcggagtcagccaggag

SEQ ID NO: 675619 - DNA, 15 bp, Homo sapiens
atcggcatttgtttc

SEQ ID NO: 675620 - DNA, 14 bp, Homo sapiens
atcgtagaaaattt

SEQ ID NO: 675621 - DNA, 19 bp, Homo sapiens
atctaaacagttatttctg

SEQ ID NO: 675622 - DNA, 23 bp, Homo sapiens
atctaatgcttgtttatgatatt

SEQ ID NO: 675623 - DNA, 15 bp, Homo sapiens
atctaattctgattc

SEQ ID NO: 675624 - DNA, 19 bp, Homo sapiens
atctacaatctctttttgt

SEQ ID NO: 675625 - DNA, 13 bp, Homo sapiens
atctacacatgtt

SEQ ID NO: 675626 - DNA, 11 bp, Homo sapiens
atctacaccaa

SEQ ID NO: 675627 - DNA, 16 bp, Homo sapiens
atctacaccaatgaaa

SEQ ID NO: 675628 - DNA, 14 bp, Homo sapiens
atctaccttttctg

SEQ ID NO: 675629 - DNA, 19 bp, Homo sapiens
atctaccttttctggcaaa

SEQ ID NO: 675630 - DNA, 16 bp, Homo sapiens
atctagagcaaagcca

SEQ ID NO: 675631 - DNA, 23 bp, Homo sapiens
atctaggatgggaacaaggaagg

SEQ ID NO: 675632 - DNA, 12 bp, Homo sapiens
atctataaaata

SEQ ID NO: 675633 - DNA, 20 bp, Homo sapiens
atctataaaatagatataaa

SEQ ID NO: 675634 - DNA, 21 bp, Homo sapiens
atctataggaagattgaacct

SEQ ID NO: 675635 - DNA, 18 bp, Homo sapiens
atctatggcttatttcta

SEQ ID NO: 675636 - DNA, 19 bp, Homo sapiens
atctatggcttatttctat

SEQ ID NO: 675637 - DNA, 21 bp, Homo sapiens
atctattgcttggacttaact

SEQ ID NO: 675638 - DNA, 17 bp, Homo sapiens
atctcaattgaaagctt

SEQ ID NO: 675639 - DNA, 12 bp, Homo sapiens
atctccatgtgt

SEQ ID NO: 675640 - DNA, 21 bp, Homo sapiens
atctccctcactgaaaccagg

SEQ ID NO: 675641 - DNA, 14 bp, Homo sapiens
atctccctgcctgg

SEQ ID NO: 675642 - DNA, 17 bp, Homo sapiens
atctccctgcctggccc

SEQ ID NO: 675643 - DNA, 11 bp, Homo sapiens
atctcctcccg

SEQ ID NO: 675644 - DNA, 11 bp, Homo sapiens
aaaaaaggaag

SEQ ID NO: 675645 - DNA, 12 bp, Homo sapiens
aaaaaaggaagg

SEQ ID NO: 675646 - DNA, 21 bp, Homo sapiens
aaaaaagtttttaatttgatg

SEQ ID NO: 675647 - DNA, 23 bp, Homo sapiens
aaaaacaagtcatttttgtattt

SEQ ID NO: 675648 - DNA, 18 bp, Homo sapiens
aaaaacagatttggaaag

SEQ ID NO: 675649 - DNA, 13 bp, Homo sapiens
aaaaacataacat

SEQ ID NO: 675650 - DNA, 18 bp, Homo sapiens
aaaaacataacataaatt

SEQ ID NO: 675651 - DNA, 16 bp, Homo sapiens
aaaaagaaacttttct

SEQ ID NO: 675652 - DNA, 16 bp, Homo sapiens
aaaaagaacttttgta

SEQ ID NO: 675653 - DNA, 11 bp, Homo sapiens
aaaaagtttgt

SEQ ID NO: 675654 - DNA, 13 bp, Homo sapiens
aaaaataaaatgt

SEQ ID NO: 675655 - DNA, 13 bp, Homo sapiens
aaaaataggcttt

SEQ ID NO: 675656 - DNA, 16 bp, Homo sapiens
aaaaatataatgttga

SEQ ID NO: 675657 - DNA, 20 bp, Homo sapiens
aaaaatcctattctgatgaa

SEQ ID NO: 675658 - DNA, 15 bp, Homo sapiens
aaaaatggatattat

SEQ ID NO: 675659 - DNA, 23 bp, Homo sapiens
aaaaatggatattattagaaatt

SEQ ID NO: 675660 - DNA, 19 bp, Homo sapiens
aaaaattacctttaatttt

SEQ ID NO: 675661 - DNA, 18 bp, Homo sapiens
aaagaggctgcccctctc

SEQ ID NO: 675662 - DNA, 20 bp, Homo sapiens
aaagaggctgcccctctcac

SEQ ID NO: 675663 - DNA, 23 bp, Homo sapiens
aaagaggctgcccctctcaccaa

SEQ ID NO: 675664 - DNA, 18 bp, Homo sapiens
aaagaggtcgcttgggaa

SEQ ID NO: 675665 - DNA, 16 bp, Homo sapiens
aaagagtaatttcatt

SEQ ID NO: 675666 - DNA, 21 bp, Homo sapiens
aaagatattgttgttttccat

SEQ ID NO: 675667 - DNA, 19 bp, Homo sapiens
aaagatgaaaaagaataaa

SEQ ID NO: 675668 - DNA, 20 bp, Homo sapiens
aaagatgagctttgtctact

SEQ ID NO: 675669 - DNA, 20 bp, Homo sapiens
aaagatgtccttggagatga

SEQ ID NO: 675670 - DNA, 22 bp, Homo sapiens
aaagatgtgttcaggcattcca

SEQ ID NO: 675671 - DNA, 16 bp, Homo sapiens
aaagatgttctggata

SEQ ID NO: 675672 - DNA, 19 bp, Homo sapiens
aaagcagggcagcagggaa

SEQ ID NO: 675673 - DNA, 21 bp, Homo sapiens
aaagcatgaattggaactgca

SEQ ID NO: 675674 - DNA, 15 bp, Homo sapiens
aaagcattttgtaat

SEQ ID NO: 675675 - DNA, 20 bp, Homo sapiens
aaagcccaaactcctttctt

SEQ ID NO: 675676 - DNA, 21 bp, Homo sapiens
aaagcccaaactcctttctta

SEQ ID NO: 675677 - DNA, 15 bp, Homo sapiens
aaagccttagggaag

SEQ ID NO: 675678 - DNA, 16 bp, Homo sapiens
aaagccttttaaatca

SEQ ID NO: 675679 - DNA, 13 bp, Homo sapiens
aaagctgagcctg

SEQ ID NO: 675680 - DNA, 15 bp, Homo sapiens
aaagctgagcctgca

SEQ ID NO: 675681 - DNA, 15 bp, Homo sapiens
aaagcttaaatttta

SEQ ID NO: 675682 - DNA, 15 bp, Homo sapiens
aaagcttaggtcaaa

SEQ ID NO: 675683 - DNA, 11 bp, Homo sapiens
aaagctttata

SEQ ID NO: 675684 - DNA, 23 bp, Homo sapiens
aaagctttcctgtttccagggtc

SEQ ID NO: 675685 - DNA, 15 bp, Homo sapiens
aaagctttgttttgt

SEQ ID NO: 675686 - DNA, 21 bp, Homo sapiens
aaaggacccttgagtaagtga

SEQ ID NO: 675687 - DNA, 22 bp, Homo sapiens
aaaggatcaacaacatccactg

SEQ ID NO: 675688 - DNA, 21 bp, Homo sapiens
aaaggcagctgcctctgctcc

SEQ ID NO: 675689 - DNA, 13 bp, Homo sapiens
aaagggatatttt

SEQ ID NO: 675690 - DNA, 14 bp, Homo sapiens
aaaggtagagtctt

SEQ ID NO: 675691 - DNA, 20 bp, Homo sapiens
aaaggtgacttcctctggtg

SEQ ID NO: 675692 - DNA, 12 bp, Homo sapiens
aaagtagggggc

SEQ ID NO: 675693 - DNA, 16 bp, Homo sapiens
aaagtcaaaaaattat

SEQ ID NO: 675694 - DNA, 17 bp, Homo sapiens
aaagtcctggccctggc

SEQ ID NO: 675695 - DNA, 20 bp, Homo sapiens
aaagtctgttgattaaagat

SEQ ID NO: 675696 - DNA, 22 bp, Homo sapiens
aaagtgcacacctttattcaga

SEQ ID NO: 675697 - DNA, 14 bp, Homo sapiens
aaagtggtacttga

SEQ ID NO: 675698 - DNA, 23 bp, Homo sapiens
aaagtgtgtatatattttgtgtg

SEQ ID NO: 675699 - DNA, 22 bp, Homo sapiens
aaagttaccagtgccttaaact

SEQ ID NO: 675700 - DNA, 14 bp, Homo sapiens
aaagttatgtattt

SEQ ID NO: 675701 - DNA, 22 bp, Homo sapiens
aaagttatgtatttaaagttgt

SEQ ID NO: 675702 - DNA, 19 bp, Homo sapiens
aaagttctgtgtaaacaga

SEQ ID NO: 675703 - DNA, 13 bp, Homo sapiens
aaagtttaaatgt

SEQ ID NO: 675704 - DNA, 17 bp, Homo sapiens
aaagtttaaatgtattt

SEQ ID NO: 675705 - DNA, 16 bp, Homo sapiens
aagacagaggggagca

SEQ ID NO: 675706 - DNA, 14 bp, Homo sapiens
aagacatttgctga

SEQ ID NO: 675707 - DNA, 15 bp, Homo sapiens
aagacatttgctgaa

SEQ ID NO: 675708 - DNA, 16 bp, Homo sapiens
aagacatttgtttgct

SEQ ID NO: 675709 - DNA, 16 bp, Homo sapiens
aagaccctcttgccca

SEQ ID NO: 675710 - DNA, 21 bp, Homo sapiens
aagaccctcttgcccatcctg

SEQ ID NO: 675711 - DNA, 16 bp, Homo sapiens
aagacgggaggggagg

SEQ ID NO: 675712 - DNA, 14 bp, Homo sapiens
aagactatatatat

SEQ ID NO: 675713 - DNA, 20 bp, Homo sapiens
aagactatatatataaatgt

SEQ ID NO: 675714 - DNA, 21 bp, Homo sapiens
aagactatatatataaatgta

SEQ ID NO: 675715 - DNA, 21 bp, Homo sapiens
aagacttgagacaatgttttc

SEQ ID NO: 675716 - DNA, 15 bp, Homo sapiens
aagagacaaagattt

SEQ ID NO: 675717 - DNA, 12 bp, Homo sapiens
aagagagaatgt

SEQ ID NO: 675718 - DNA, 13 bp, Homo sapiens
aagagagaatgta

SEQ ID NO: 675719 - DNA, 20 bp, Homo sapiens
aagagatctacacatgttgc

SEQ ID NO: 675720 - DNA, 17 bp, Homo sapiens
aagagatgagaaatgat

SEQ ID NO: 675721 - DNA, 14 bp, Homo sapiens
aagagcagaacaga

SEQ ID NO: 675722 - DNA, 15 bp, Homo sapiens
aagagctaataaatc

SEQ ID NO: 675723 - DNA, 15 bp, Homo sapiens
aagaggccaatgccc

SEQ ID NO: 675724 - DNA, 16 bp, Homo sapiens
aagaggctgaaagagg

SEQ ID NO: 675725 - DNA, 17 bp, Homo sapiens
aagaggctgcccctctc

SEQ ID NO: 675726 - DNA, 22 bp, Homo sapiens
aagaggctgcccctctcaccaa

SEQ ID NO: 675727 - DNA, 22 bp, Homo sapiens
aagataattttcagctgcaagg

SEQ ID NO: 675728 - DNA, 22 bp, Homo sapiens
aagatacagcctgcaagtggta

SEQ ID NO: 675729 - DNA, 19 bp, Homo sapiens
aagatgtgttcaggcattc

SEQ ID NO: 675730 - DNA, 17 bp, Homo sapiens
aagattactgaaatata

SEQ ID NO: 675731 - DNA, 13 bp, Homo sapiens
aagatttttttcc

SEQ ID NO: 675732 - DNA, 15 bp, Homo sapiens
aagcaacatggcttt

SEQ ID NO: 675733 - DNA, 14 bp, Homo sapiens
aagcaacatttgta

SEQ ID NO: 675734 - DNA, 18 bp, Homo sapiens
aagcaacatttgtatgga

SEQ ID NO: 675735 - DNA, 21 bp, Homo sapiens
aagcaacatttgtatggattt

SEQ ID NO: 675736 - DNA, 13 bp, Homo sapiens
aagcaactaattt

SEQ ID NO: 675737 - DNA, 23 bp, Homo sapiens
aagcaattagtctgaaactggct

SEQ ID NO: 675738 - DNA, 16 bp, Homo sapiens
aagcagagcctcctgg

SEQ ID NO: 675739 - DNA, 15 bp, Homo sapiens
aagcagaggaccagg

SEQ ID NO: 675740 - DNA, 15 bp, Homo sapiens
aagcagagttttcat

SEQ ID NO: 675741 - DNA, 16 bp, Homo sapiens
aagcagcttattgttt

SEQ ID NO: 675742 - DNA, 12 bp, Homo sapiens
aagcagggcagc

SEQ ID NO: 675743 - DNA, 15 bp, Homo sapiens
aagcagggcagcagg

SEQ ID NO: 675744 - DNA, 14 bp, Homo sapiens
aagcagtcttgctc

SEQ ID NO: 675745 - DNA, 12 bp, Homo sapiens
aagcatgaattg

SEQ ID NO: 675746 - DNA, 20 bp, Homo sapiens
aagcatgtagactgtgccag

SEQ ID NO: 675747 - DNA, 13 bp, Homo sapiens
aagcatgtcaatt

SEQ ID NO: 675748 - DNA, 16 bp, Homo sapiens
aagcattgccattgaa

SEQ ID NO: 675749 - DNA, 20 bp, Homo sapiens
aagcattggagtttcaaatc

SEQ ID NO: 675750 - DNA, 17 bp, Homo sapiens
aagcattttgaaacaaa

SEQ ID NO: 675751 - DNA, 19 bp, Homo sapiens
aagcattttgaaacaaagt

SEQ ID NO: 675752 - DNA, 12 bp, Homo sapiens
aagcattttgta

SEQ ID NO: 675753 - DNA, 23 bp, Homo sapiens
aagccaccctgggctacagaaac

SEQ ID NO: 675754 - DNA, 13 bp, Homo sapiens
aagccacttgaaa

SEQ ID NO: 675755 - DNA, 18 bp, Homo sapiens
aagccacttgaaatgtta

SEQ ID NO: 675756 - DNA, 20 bp, Homo sapiens
aagcccagggcaccatccag

SEQ ID NO: 675757 - DNA, 16 bp, Homo sapiens
aagcctaaatttgtgc

SEQ ID NO: 675758 - DNA, 14 bp, Homo sapiens
aagccttagggaag

SEQ ID NO: 675759 - DNA, 16 bp, Homo sapiens
aagcgttaagggcaga

SEQ ID NO: 675760 - DNA, 17 bp, Homo sapiens
aagctaaggtttagata

SEQ ID NO: 675761 - DNA, 20 bp, Homo sapiens
aagctagtgtacctcctctc

SEQ ID NO: 675762 - DNA, 21 bp, Homo sapiens
aagctagtgtacctcctctca

SEQ ID NO: 675763 - DNA, 13 bp, Homo sapiens
aagctagtgtttc

SEQ ID NO: 675764 - DNA, 20 bp, Homo sapiens
aagctagtgtttctagctaa

SEQ ID NO: 675765 - DNA, 17 bp, Homo sapiens
aagctatttatgggccc

SEQ ID NO: 675766 - DNA, 18 bp, Homo sapiens
aagctatttatgggcccc

SEQ ID NO: 675767 - DNA, 22 bp, Homo sapiens
aagctatttatgggcccctggc

SEQ ID NO: 675768 - DNA, 15 bp, Homo sapiens
actcccaacttcttc

SEQ ID NO: 675769 - DNA, 20 bp, Homo sapiens
actcccaacttcttcctgtg

SEQ ID NO: 675770 - DNA, 15 bp, Homo sapiens
actccccaaccccca

SEQ ID NO: 675771 - DNA, 16 bp, Homo sapiens
actccgaggtggttca

SEQ ID NO: 675772 - DNA, 14 bp, Homo sapiens
actcctagaagaac

SEQ ID NO: 675773 - DNA, 13 bp, Homo sapiens
actcctgcttaat

SEQ ID NO: 675774 - DNA, 21 bp, Homo sapiens
actcctgtcccttttccctta

SEQ ID NO: 675775 - DNA, 21 bp, Homo sapiens
actctaatagtgcttaaaaat

SEQ ID NO: 675776 - DNA, 16 bp, Homo sapiens
actctccaatgttcta

SEQ ID NO: 675777 - DNA, 14 bp, Homo sapiens
actctgagagctgt

SEQ ID NO: 675778 - DNA, 15 bp, Homo sapiens
actctgagagctgtt

SEQ ID NO: 675779 - DNA, 20 bp, Homo sapiens
actctgcatgtagaggcttg

SEQ ID NO: 675780 - DNA, 15 bp, Homo sapiens
actctggtgctcctg

SEQ ID NO: 675781 - DNA, 14 bp, Homo sapiens
actcttactcctta

SEQ ID NO: 675782 - DNA, 13 bp, Homo sapiens
actcttgatctct

SEQ ID NO: 675783 - DNA, 20 bp, Homo sapiens
actctttatcaagcaacatt

SEQ ID NO: 675784 - DNA, 16 bp, Homo sapiens
actctttgaaagcttt

SEQ ID NO: 675785 - DNA, 13 bp, Homo sapiens
actcttttgatgg

SEQ ID NO: 675786 - DNA, 21 bp, Homo sapiens
actcttttgatggtggccctg

SEQ ID NO: 675787 - DNA, 22 bp, Homo sapiens
actgaaaattcgaaccaggaaa

SEQ ID NO: 675788 - DNA, 14 bp, Homo sapiens
actgaaacagattt

SEQ ID NO: 675789 - DNA, 19 bp, Homo sapiens
actgaaattactttaacat

SEQ ID NO: 675790 - DNA, 20 bp, Homo sapiens
actgaaattactttaacatt

SEQ ID NO: 675791 - DNA, 19 bp, Homo sapiens
actgaaccggctttaccaa

SEQ ID NO: 675792 - DNA, 11 bp, Homo sapiens
actgaatgcag

SEQ ID NO: 675793 - DNA, 21 bp, Homo sapiens
actgaattgtatcaatttgtt

SEQ ID NO: 675794 - DNA, 14 bp, Homo sapiens
actgacaacattat

SEQ ID NO: 675795 - DNA, 19 bp, Homo sapiens
actgaccggtgcttttatt

SEQ ID NO: 675796 - DNA, 13 bp, Homo sapiens
actgaggtgctat

SEQ ID NO: 675797 - DNA, 18 bp, Homo sapiens
actgaggtgctatgaagc

SEQ ID NO: 675798 - DNA, 20 bp, Homo sapiens
actgaggtgctatgaagcca

SEQ ID NO: 675799 - DNA, 14 bp, Homo sapiens
actgaggttttttt

SEQ ID NO: 675800 - DNA, 17 bp, Homo sapiens
actgatgattttccttt

SEQ ID NO: 675801 - DNA, 15 bp, Homo sapiens
actgattattttctt

SEQ ID NO: 675802 - DNA, 12 bp, Homo sapiens
actgatttgctc

SEQ ID NO: 675803 - DNA, 17 bp, Homo sapiens
actgcaaataaagcctt

SEQ ID NO: 675804 - DNA, 18 bp, Homo sapiens
actgcaaataaagccttt

SEQ ID NO: 675805 - DNA, 20 bp, Homo sapiens
actgcaatgaaagtcaaatt

SEQ ID NO: 675806 - DNA, 20 bp, Homo sapiens
actgcactccagcctggggg

SEQ ID NO: 675807 - DNA, 22 bp, Homo sapiens
actgcagcagaaaggctctgaa

SEQ ID NO: 675808 - DNA, 16 bp, Homo sapiens
actgcccactctgcaa

SEQ ID NO: 675809 - DNA, 18 bp, Homo sapiens
actgccttgaaaaatgac

SEQ ID NO: 675810 - DNA, 21 bp, Homo sapiens
actgccttgaaaaatgacaat

SEQ ID NO: 675811 - DNA, 21 bp, Homo sapiens
actgcgaagaccctcttgccc

SEQ ID NO: 675812 - DNA, 18 bp, Homo sapiens
actgctattctagagctt

SEQ ID NO: 675813 - DNA, 22 bp, Homo sapiens
actgctattctagagcttttat

SEQ ID NO: 675814 - DNA, 14 bp, Homo sapiens
actgctgagctggc

SEQ ID NO: 675815 - DNA, 19 bp, Homo sapiens
actgctgatcgtagaaaat

SEQ ID NO: 675816 - DNA, 23 bp, Homo sapiens
actgctgatcgtagaaaatttgc

SEQ ID NO: 675817 - DNA, 23 bp, Homo sapiens
actgcttgattttaatacattga

SEQ ID NO: 675818 - DNA, 20 bp, Homo sapiens
actgcttttttgattctgaa

SEQ ID NO: 675819 - DNA, 21 bp, Homo sapiens
actggactccgaggtggttca

SEQ ID NO: 675820 - DNA, 23 bp, Homo sapiens
actggagttccttatccctctct

SEQ ID NO: 675821 - DNA, 18 bp, Homo sapiens
actggcttacctcctcat

SEQ ID NO: 675822 - DNA, 16 bp, Homo sapiens
actggcttccccactc

SEQ ID NO: 675823 - DNA, 14 bp, Homo sapiens
actgggccctgagt

SEQ ID NO: 675824 - DNA, 15 bp, Homo sapiens
actggggagtctttg

SEQ ID NO: 675825 - DNA, 21 bp, Homo sapiens
actggggttgcgtctgaggcc

SEQ ID NO: 675826 - DNA, 20 bp, Homo sapiens
actgggtaaaagcagggcag

SEQ ID NO: 675827 - DNA, 17 bp, Homo sapiens
actggtggtttttgctc

SEQ ID NO: 675828 - DNA, 14 bp, Homo sapiens
actgtacattatga

SEQ ID NO: 675829 - DNA, 15 bp, Homo sapiens
actgtacatttaaaa

SEQ ID NO: 675830 - DNA, 19 bp, Homo sapiens
actgtagcttttaggaata

SEQ ID NO: 675831 - DNA, 21 bp, Homo sapiens
actgtaggtatgatctcttct

SEQ ID NO: 675832 - DNA, 16 bp, Homo sapiens
actgtatcattttctt

SEQ ID NO: 675833 - DNA, 13 bp, Homo sapiens
actgtatttctaa

SEQ ID NO: 675834 - DNA, 17 bp, Homo sapiens
actgtcaaaatatttct

SEQ ID NO: 675835 - DNA, 13 bp, Homo sapiens
actgtcacttgct

SEQ ID NO: 675836 - DNA, 18 bp, Homo sapiens
actgtcacttgctgcttt

SEQ ID NO: 675837 - DNA, 15 bp, Homo sapiens
actgtcatgcttcat

SEQ ID NO: 675838 - DNA, 24 bp, Homo sapiens
actgtcatgcttcatcattccctc

SEQ ID NO: 675839 - DNA, 17 bp, Homo sapiens
actgtctattaatattc

SEQ ID NO: 675840 - DNA, 12 bp, Homo sapiens
actgtctttcag

SEQ ID NO: 675841 - DNA, 17 bp, Homo sapiens
actgtgagaacccagtt

SEQ ID NO: 675842 - DNA, 22 bp, Homo sapiens
actgtgaggccatacttgtgaa

SEQ ID NO: 675843 - DNA, 24 bp, Homo sapiens
actgtgcagacccagtcccacact

SEQ ID NO: 675844 - DNA, 15 bp, Homo sapiens
actgtggccaggcct

SEQ ID NO: 675845 - DNA, 16 bp, Homo sapiens
actgttactgggccct

SEQ ID NO: 675846 - DNA, 15 bp, Homo sapiens
actgttctttccagg

SEQ ID NO: 675847 - DNA, 13 bp, Homo sapiens
actgttgaaagga

SEQ ID NO: 675848 - DNA, 22 bp, Homo sapiens
actgttgtaagaattctgattg

SEQ ID NO: 675849 - DNA, 13 bp, Homo sapiens
actgttttcaaat

SEQ ID NO: 675850 - DNA, 21 bp, Homo sapiens
acttaaaaaatcagaacaaaa

SEQ ID NO: 675851 - DNA, 17 bp, Homo sapiens
acttaaaaacaagagaa

SEQ ID NO: 675852 - DNA, 23 bp, Homo sapiens
acttaaaataggggatatttaag

SEQ ID NO: 675853 - DNA, 19 bp, Homo sapiens
acttaaatggtaataagca

SEQ ID NO: 675854 - DNA, 13 bp, Homo sapiens
acttaagaattga

SEQ ID NO: 675855 - DNA, 23 bp, Homo sapiens
acttagaaaagtggtgtaaactt

SEQ ID NO: 675856 - DNA, 19 bp, Homo sapiens
acttagatgggcatggtgg

SEQ ID NO: 675857 - DNA, 20 bp, Homo sapiens
acttaggactagaagattag

SEQ ID NO: 675858 - DNA, 21 bp, Homo sapiens
acttatctcgaatttgaagag

SEQ ID NO: 675859 - DNA, 23 bp, Homo sapiens
acttatctcgaatttgaagagat

SEQ ID NO: 675860 - DNA, 14 bp, Homo sapiens
acttatttcataat

SEQ ID NO: 675861 - DNA, 15 bp, Homo sapiens
acttattttgtctta

SEQ ID NO: 675862 - DNA, 23 bp, Homo sapiens
acttattttgtcttattcttaag

SEQ ID NO: 675863 - DNA, 12 bp, Homo sapiens
acttatttttct

SEQ ID NO: 675864 - DNA, 13 bp, Homo sapiens
acttatttttctg

SEQ ID NO: 675865 - DNA, 15 bp, Homo sapiens
acttcaaagcaagct

SEQ ID NO: 675866 - DNA, 20 bp, Homo sapiens
acttcagggaaggtgaaaca

SEQ ID NO: 675867 - DNA, 16 bp, Homo sapiens
acttccaggggaacct

SEQ ID NO: 675868 - DNA, 18 bp, Homo sapiens
acttccaggggaacctgc

SEQ ID NO: 675869 - DNA, 21 bp, Homo sapiens
acttccaggggaacctgccat

SEQ ID NO: 675870 - DNA, 22 bp, Homo sapiens
acttcctttgcccttcctcctg

SEQ ID NO: 675871 - DNA, 17 bp, Homo sapiens
acttctaaatgcatatc

SEQ ID NO: 675872 - DNA, 14 bp, Homo sapiens
acttctaatttata

SEQ ID NO: 675873 - DNA, 16 bp, Homo sapiens
acttctacctgccctc

SEQ ID NO: 675874 - DNA, 17 bp, Homo sapiens
acttctcaaagagaatt

SEQ ID NO: 675875 - DNA, 19 bp, Homo sapiens
acttctcaaagagaattgt

SEQ ID NO: 675876 - DNA, 19 bp, Homo sapiens
acttctgcaacaagcatgc

SEQ ID NO: 675877 - DNA, 18 bp, Homo sapiens
acttcttcctgtgaagtt

SEQ ID NO: 675878 - DNA, 14 bp, Homo sapiens
acttgaaatgttag

SEQ ID NO: 675879 - DNA, 23 bp, Homo sapiens
acttgaaatgttagtcattgtta

SEQ ID NO: 675880 - DNA, 21 bp, Homo sapiens
acttgaagcctaaatttgtgc

SEQ ID NO: 675881 - DNA, 22 bp, Homo sapiens
acttgaagcctaaatttgtgct

SEQ ID NO: 675882 - DNA, 19 bp, Homo sapiens
acttgaataaccatctgaa

SEQ ID NO: 675883 - DNA, 21 bp, Homo sapiens
acttgactccatttcatcatt

SEQ ID NO: 675884 - DNA, 21 bp, Homo sapiens
acttgagacaatgttttcttc

SEQ ID NO: 675885 - DNA, 23 bp, Homo sapiens
acttgatgtacataactcctgtc

SEQ ID NO: 675886 - DNA, 23 bp, Homo sapiens
acttgtacatggaattttttgaa

SEQ ID NO: 675887 - DNA, 14 bp, Homo sapiens
acttgtatatatgg

SEQ ID NO: 675888 - DNA, 17 bp, Homo sapiens
acttgtggggctaaggc

SEQ ID NO: 675889 - DNA, 19 bp, Homo sapiens
acttgttttggatggcttg

SEQ ID NO: 675890 - DNA, 18 bp, Homo sapiens
aaatttcactactagatt

SEQ ID NO: 675891 - DNA, 15 bp, Homo sapiens
aaatttgatgatgtt

SEQ ID NO: 675892 - DNA, 17 bp, Homo sapiens
aaatttgtgctttttaa

SEQ ID NO: 675893 - DNA, 22 bp, Homo sapiens
aaattttgcttttaattaaata

SEQ ID NO: 675894 - DNA, 21 bp, Homo sapiens
aacaaaattttattttgtgct

SEQ ID NO: 675895 - DNA, 19 bp, Homo sapiens
aacaaagtatttttttctt

SEQ ID NO: 675896 - DNA, 22 bp, Homo sapiens
aacaaagtatttttttcttttt

SEQ ID NO: 675897 - DNA, 17 bp, Homo sapiens
aacaagtcatttttgta

SEQ ID NO: 675898 - DNA, 21 bp, Homo sapiens
aacaatatgtttgcaaacttg

SEQ ID NO: 675899 - DNA, 20 bp, Homo sapiens
aacaatgacactagaaaact

SEQ ID NO: 675900 - DNA, 16 bp, Homo sapiens
aacacacagatctgca

SEQ ID NO: 675901 - DNA, 16 bp, Homo sapiens
aacacagcatgtgtat

SEQ ID NO: 675902 - DNA, 21 bp, Homo sapiens
aacacatcaggaaagagagca

SEQ ID NO: 675903 - DNA, 18 bp, Homo sapiens
aacacatctggctgcaca

SEQ ID NO: 675904 - DNA, 13 bp, Homo sapiens
aacacattttaaa

SEQ ID NO: 675905 - DNA, 20 bp, Homo sapiens
aacacatttttttgcatgca

SEQ ID NO: 675906 - DNA, 21 bp, Homo sapiens
aacactccccattaacagatg

SEQ ID NO: 675907 - DNA, 15 bp, Homo sapiens
aacactgaaatgaaa

SEQ ID NO: 675908 - DNA, 16 bp, Homo sapiens
aacactgaaatgaaat

SEQ ID NO: 675909 - DNA, 17 bp, Homo sapiens
aacagaacagggtcatg

SEQ ID NO: 675910 - DNA, 23 bp, Homo sapiens
aacagagtccgggagaatgctgg

SEQ ID NO: 675911 - DNA, 14 bp, Homo sapiens
aacagatcttttac

SEQ ID NO: 675912 - DNA, 18 bp, Homo sapiens
aacagatgaccataattt

SEQ ID NO: 675913 - DNA, 13 bp, Homo sapiens
aacagatttcaaa

SEQ ID NO: 675914 - DNA, 14 bp, Homo sapiens
aacagttgctgtga

SEQ ID NO: 675915 - DNA, 14 bp, Homo sapiens
aacataaagttgta

SEQ ID NO: 675916 - DNA, 18 bp, Homo sapiens
aacatacaagaaaatgta

SEQ ID NO: 675917 - DNA, 22 bp, Homo sapiens
aacatgctggtgaatattttca

SEQ ID NO: 675918 - DNA, 21 bp, Homo sapiens
aacatgtactacagctatatt

SEQ ID NO: 675919 - DNA, 20 bp, Homo sapiens
aacatgttaatgacaatatt

SEQ ID NO: 675920 - DNA, 22 bp, Homo sapiens
aacatgttaatgacaatattcc

SEQ ID NO: 675921 - DNA, 20 bp, Homo sapiens
aacattctgtgggatatatt

SEQ ID NO: 675922 - DNA, 14 bp, Homo sapiens
aacattttggaaat

SEQ ID NO: 675923 - DNA, 23 bp, Homo sapiens
aacattttttcttctgaagattc

SEQ ID NO: 675924 - DNA, 14 bp, Homo sapiens
aaccaagtgtgctc

SEQ ID NO: 675925 - DNA, 16 bp, Homo sapiens
aaccaggcacctcttc

SEQ ID NO: 675926 - DNA, 18 bp, Homo sapiens
aaccaggcacctcttcct

SEQ ID NO: 675927 - DNA, 15 bp, Homo sapiens
aaccagtacttctaa

SEQ ID NO: 675928 - DNA, 16 bp, Homo sapiens
aaccagtacttctaag

SEQ ID NO: 675929 - DNA, 14 bp, Homo sapiens
aaccataaattcaa

SEQ ID NO: 675930 - DNA, 14 bp, Homo sapiens
aaccatatgatact

SEQ ID NO: 675931 - DNA, 15 bp, Homo sapiens
aaccattccaacttc

SEQ ID NO: 675932 - DNA, 16 bp, Homo sapiens
aacccaagcaacattt

SEQ ID NO: 675933 - DNA, 14 bp, Homo sapiens
aacccacctctcct

SEQ ID NO: 675934 - DNA, 20 bp, Homo sapiens
aacccacctctcctgccctg

SEQ ID NO: 675935 - DNA, 16 bp, Homo sapiens
aacccagtttcccgtc

SEQ ID NO: 675936 - DNA, 23 bp, Homo sapiens
aacccgggagcggaggttgcagt

SEQ ID NO: 675937 - DNA, 15 bp, Homo sapiens
aaccctccttttctc

SEQ ID NO: 675938 - DNA, 13 bp, Homo sapiens
aacccttctctgt

SEQ ID NO: 675939 - DNA, 15 bp, Homo sapiens
aacccttctctgttg

SEQ ID NO: 675940 - DNA, 18 bp, Homo sapiens
aacctacacactgtcatg

SEQ ID NO: 675941 - DNA, 18 bp, Homo sapiens
aacctcagggctcccagg

SEQ ID NO: 675942 - DNA, 22 bp, Homo sapiens
aacctgactcaattatttgcat

SEQ ID NO: 675943 - DNA, 16 bp, Homo sapiens
aacctgtattactgaa

SEQ ID NO: 675944 - DNA, 23 bp, Homo sapiens
aacgaagagttcccttgaaactt

SEQ ID NO: 675945 - DNA, 21 bp, Homo sapiens
aacgctagaagcctaagaact

SEQ ID NO: 675946 - DNA, 19 bp, Homo sapiens
aacgtcctctttagttttt

SEQ ID NO: 675947 - DNA, 22 bp, Homo sapiens
aactaaaaattaaaacctcttt

SEQ ID NO: 675948 - DNA, 17 bp, Homo sapiens
aactaaaataattttgt

SEQ ID NO: 675949 - DNA, 22 bp, Homo sapiens
aactaaatttcactactagatt

SEQ ID NO: 675950 - DNA, 20 bp, Homo sapiens
aactactacctgtaatgaca

SEQ ID NO: 675951 - DNA, 23 bp, Homo sapiens
aactagtactcaaggtttaacct

SEQ ID NO: 675952 - DNA, 23 bp, Homo sapiens
aactatagcttgcagaactgtag

SEQ ID NO: 675953 - DNA, 16 bp, Homo sapiens
aactatgttcctaaca

SEQ ID NO: 675954 - DNA, 21 bp, Homo sapiens
aactatgttcctaacaaaatg

SEQ ID NO: 675955 - DNA, 13 bp, Homo sapiens
aactcaaatacac

SEQ ID NO: 675956 - DNA, 15 bp, Homo sapiens
aactcaacatttgtc

SEQ ID NO: 675957 - DNA, 23 bp, Homo sapiens
actttgaagtgcagctcatgttt

SEQ ID NO: 675958 - DNA, 22 bp, Homo sapiens
actttgcagcacagctgagagg

SEQ ID NO: 675959 - DNA, 14 bp, Homo sapiens
actttgtattttga

SEQ ID NO: 675960 - DNA, 17 bp, Homo sapiens
actttgtcgtggttctt

SEQ ID NO: 675961 - DNA, 21 bp, Homo sapiens
actttgtcgtggttcttaaat

SEQ ID NO: 675962 - DNA, 18 bp, Homo sapiens
actttgtgcattctggat

SEQ ID NO: 675963 - DNA, 18 bp, Homo sapiens
acttttagaaatgcatat

SEQ ID NO: 675964 - DNA, 16 bp, Homo sapiens
acttttataaagcatg

SEQ ID NO: 675965 - DNA, 20 bp, Homo sapiens
acttttatgcagcaaatata

SEQ ID NO: 675966 - DNA, 11 bp, Homo sapiens
acttttgagga

SEQ ID NO: 675967 - DNA, 16 bp, Homo sapiens
acttttggattttatg

SEQ ID NO: 675968 - DNA, 17 bp, Homo sapiens
acttttgttaaattcag

SEQ ID NO: 675969 - DNA, 18 bp, Homo sapiens
acttttttttctctcttt

SEQ ID NO: 675970 - DNA, 19 bp, Homo sapiens
agaaaaaaattactaattt

SEQ ID NO: 675971 - DNA, 13 bp, Homo sapiens
agaaaaatgttct

SEQ ID NO: 675972 - DNA, 15 bp, Homo sapiens
agaaaacgtggcaca

SEQ ID NO: 675973 - DNA, 20 bp, Homo sapiens
agaaaatatttaatatcaaa

SEQ ID NO: 675974 - DNA, 12 bp, Homo sapiens
agaaaatctttg

SEQ ID NO: 675975 - DNA, 14 bp, Homo sapiens
agaaaattgaaaca

SEQ ID NO: 675976 - DNA, 16 bp, Homo sapiens
agaaaccacagtcttc

SEQ ID NO: 675977 - DNA, 22 bp, Homo sapiens
agaaacctgactcaattatttg

SEQ ID NO: 675978 - DNA, 13 bp, Homo sapiens
agaaactgctgca

SEQ ID NO: 675979 - DNA, 23 bp, Homo sapiens
agaaactgctgcagattagttct

SEQ ID NO: 675980 - DNA, 14 bp, Homo sapiens
agaaagtaatttaa

SEQ ID NO: 675981 - DNA, 22 bp, Homo sapiens
agaaagttctgtgtaaacagaa

SEQ ID NO: 675982 - DNA, 23 bp, Homo sapiens
agaaagttctgtgtaaacagaag

SEQ ID NO: 675983 - DNA, 19 bp, Homo sapiens
agaaataatgctacaattt

SEQ ID NO: 675984 - DNA, 19 bp, Homo sapiens
agaaatataacacattttt

SEQ ID NO: 675985 - DNA, 14 bp, Homo sapiens
agaaatatattttt

SEQ ID NO: 675986 - DNA, 15 bp, Homo sapiens
agaaatgcaataact

SEQ ID NO: 675987 - DNA, 16 bp, Homo sapiens
agaaatgcaataactc

SEQ ID NO: 675988 - DNA, 22 bp, Homo sapiens
agaaatgttgagtctgtactaa

SEQ ID NO: 675989 - DNA, 21 bp, Homo sapiens
agaaattagaaaaaaattact

SEQ ID NO: 675990 - DNA, 14 bp, Homo sapiens
agaacaaaacttct

SEQ ID NO: 675991 - DNA, 15 bp, Homo sapiens
agaacaaaacttcta

SEQ ID NO: 675992 - DNA, 18 bp, Homo sapiens
agaacaggaggtgtgaat

SEQ ID NO: 675993 - DNA, 23 bp, Homo sapiens
agaacaggaggtgtgaatgcacg

SEQ ID NO: 675994 - DNA, 11 bp, Homo sapiens
agaacatagaa

SEQ ID NO: 675995 - DNA, 16 bp, Homo sapiens
agaaccaaatacctca

SEQ ID NO: 675996 - DNA, 17 bp, Homo sapiens
agaaccaaatacctcaa

SEQ ID NO: 675997 - DNA, 21 bp, Homo sapiens
agaaccaaccagggaagctgt

SEQ ID NO: 675998 - DNA, 19 bp, Homo sapiens
agaaccacacttgaaacct

SEQ ID NO: 675999 - DNA, 21 bp, Homo sapiens
agaaccacacttgaaaccttt

SEQ ID NO: 676000 - DNA, 23 bp, Homo sapiens
agaacctacagactccatctctt

SEQ ID NO: 676001 - DNA, 21 bp, Homo sapiens
agaacctcagattcttcattg

SEQ ID NO: 676002 - DNA, 20 bp, Homo sapiens
agaacgcttcgggaaaatat

SEQ ID NO: 676003 - DNA, 23 bp, Homo sapiens
agaacggtttttggatctggcat

SEQ ID NO: 676004 - DNA, 15 bp, Homo sapiens
agaactccaggccct

SEQ ID NO: 676005 - DNA, 20 bp, Homo sapiens
agaactctgggctgccatgt

SEQ ID NO: 676006 - DNA, 21 bp, Homo sapiens
agaactgaaccggctttacca

SEQ ID NO: 676007 - DNA, 23 bp, Homo sapiens
agaactgaaccggctttaccaaa

SEQ ID NO: 676008 - DNA, 20 bp, Homo sapiens
agaactttattaagtaaaat

SEQ ID NO: 676009 - DNA, 22 bp, Homo sapiens
agaactttattaagtaaaatcc

SEQ ID NO: 676010 - DNA, 23 bp, Homo sapiens
agaagaaccaaatacctcaattt

SEQ ID NO: 676011 - DNA, 17 bp, Homo sapiens
agaagacattttgttac

SEQ ID NO: 676012 - DNA, 23 bp, Homo sapiens
agaagacgggaggggaggcattg

SEQ ID NO: 676013 - DNA, 15 bp, Homo sapiens
agaagagggtgtgtt

SEQ ID NO: 676014 - DNA, 13 bp, Homo sapiens
agaagctgctcca

SEQ ID NO: 676015 - DNA, 20 bp, Homo sapiens
agaagctgctccaggcctgc

SEQ ID NO: 676016 - DNA, 22 bp, Homo sapiens
agaagctgctccaggcctgcag

SEQ ID NO: 676017 - DNA, 17 bp, Homo sapiens
agaaggttgacacagtt

SEQ ID NO: 676018 - DNA, 14 bp, Homo sapiens
agaaggtttattgt

SEQ ID NO: 676019 - DNA, 21 bp, Homo sapiens
agaagtaagaggctacctctt

SEQ ID NO: 676020 - DNA, 18 bp, Homo sapiens
agaagtgagcaaaaaaga

SEQ ID NO: 676021 - DNA, 22 bp, Homo sapiens
agaagtgagtggtgtgactctt

SEQ ID NO: 676022 - DNA, 13 bp, Homo sapiens
agaagtttctgtc

SEQ ID NO: 676023 - DNA, 13 bp, Homo sapiens
agaataaaaactt

SEQ ID NO: 676024 - DNA, 20 bp, Homo sapiens
agaataaaaacttttgagga

SEQ ID NO: 676025 - DNA, 22 bp, Homo sapiens
agaataagacaagagatctaca

SEQ ID NO: 676026 - DNA, 15 bp, Homo sapiens
agaataaggcaggca

SEQ ID NO: 676027 - DNA, 13 bp, Homo sapiens
agaatatgataaa

SEQ ID NO: 676028 - DNA, 21 bp, Homo sapiens
agaatatttactaactaaata

SEQ ID NO: 676029 - DNA, 18 bp, Homo sapiens
agaatccctggcaaaggg

SEQ ID NO: 676030 - DNA, 20 bp, Homo sapiens
agaatgagtccttgatttca

SEQ ID NO: 676031 - DNA, 20 bp, Homo sapiens
agaatggtgtgaacccggga

SEQ ID NO: 676032 - DNA, 16 bp, Homo sapiens
agaatgtaaaagaact

SEQ ID NO: 676033 - DNA, 17 bp, Homo sapiens
agaatgtaaaagaactt

SEQ ID NO: 676034 - DNA, 12 bp, Homo sapiens
agaatgtaaagt

SEQ ID NO: 676035 - DNA, 20 bp, Homo sapiens
agaatgttgaaaagtaattg

SEQ ID NO: 676036 - DNA, 19 bp, Homo sapiens
agaattatttttaaaaaga

SEQ ID NO: 676037 - DNA, 23 bp, Homo sapiens
agaattatttttaaaaagaaatc

SEQ ID NO: 676038 - DNA, 18 bp, Homo sapiens
agaattcagaagacccct

SEQ ID NO: 676039 - DNA, 18 bp, Homo sapiens
agaattctgattgatttg

SEQ ID NO: 676040 - DNA, 15 bp, Homo sapiens
agaattgaattggaa

SEQ ID NO: 676041 - DNA, 21 bp, Homo sapiens
agaattgaattggaaagactt

SEQ ID NO: 676042 - DNA, 14 bp, Homo sapiens
agaatttagtatta

SEQ ID NO: 676043 - DNA, 20 bp, Homo sapiens
agaattttaggaacttcaga

SEQ ID NO: 676044 - DNA, 22 bp, Homo sapiens
agaattttaggaacttcagaga

SEQ ID NO: 676045 - DNA, 12 bp, Homo sapiens
agacaaaaacaa

SEQ ID NO: 676046 - DNA, 13 bp, Homo sapiens
agacaaaaacaag

SEQ ID NO: 676047 - DNA, 12 bp, Homo sapiens
agacaagacaga

SEQ ID NO: 676048 - DNA, 14 bp, Homo sapiens
agacaataattcta

SEQ ID NO: 676049 - DNA, 15 bp, Homo sapiens
agacaataattctac

SEQ ID NO: 676050 - DNA, 20 bp, Homo sapiens
agacaatatgtgagtgcctt

SEQ ID NO: 676051 - DNA, 21 bp, Homo sapiens
agacaatatgtgagtgccttt

SEQ ID NO: 676052 - DNA, 18 bp, Homo sapiens
agacaatggacccttttt

SEQ ID NO: 676053 - DNA, 15 bp, Homo sapiens
agacaatgttttctt

SEQ ID NO: 676054 - DNA, 12 bp, Homo sapiens
agacacagctct

SEQ ID NO: 676055 - DNA, 16 bp, Homo sapiens
agacagaagtctcctc

SEQ ID NO: 676056 - DNA, 14 bp, Homo sapiens
agacagaggggagc

SEQ ID NO: 676057 - DNA, 15 bp, Homo sapiens
agacagaggggagca

SEQ ID NO: 676058 - DNA, 15 bp, Homo sapiens
agacatactgcttga

SEQ ID NO: 676059 - DNA, 17 bp, Homo sapiens
agacatttgctgaactc

SEQ ID NO: 676060 - DNA, 18 bp, Homo sapiens
agacatttgtttgctgta

SEQ ID NO: 676061 - DNA, 13 bp, Homo sapiens
agaccaataaact

SEQ ID NO: 676062 - DNA, 22 bp, Homo sapiens
agaccaataaacttcctttttt

SEQ ID NO: 676063 - DNA, 21 bp, Homo sapiens
agaccacagggttcaaaatgt

SEQ ID NO: 676064 - DNA, 15 bp, Homo sapiens
agaccagccctgcag

SEQ ID NO: 676065 - DNA, 13 bp, Homo sapiens
agaccccctcagc

SEQ ID NO: 676066 - DNA, 15 bp, Homo sapiens
agaccccctcagcct

SEQ ID NO: 676067 - DNA, 21 bp, Homo sapiens
agactcactgttaagaataga

SEQ ID NO: 676068 - DNA, 16 bp, Homo sapiens
agactcagtgcagatg

SEQ ID NO: 676069 - DNA, 15 bp, Homo sapiens
agactctagggtcca

SEQ ID NO: 676070 - DNA, 19 bp, Homo sapiens
agactgacaacctcatcca

SEQ ID NO: 676071 - DNA, 18 bp, Homo sapiens
agactgtacattatgaag

SEQ ID NO: 676072 - DNA, 17 bp, Homo sapiens
agactgtagatatgtat

SEQ ID NO: 676073 - DNA, 16 bp, Homo sapiens
agactttatgtagttt

SEQ ID NO: 676074 - DNA, 19 bp, Homo sapiens
agactttgtgactgtcact

SEQ ID NO: 676075 - DNA, 13 bp, Homo sapiens
agacttttgaaaa

SEQ ID NO: 676076 - DNA, 14 bp, Homo sapiens
agagaaaaaagcca

SEQ ID NO: 676077 - DNA, 13 bp, Homo sapiens
agagaaggaaaag

SEQ ID NO: 676078 - DNA, 16 bp, Homo sapiens
agagaaggaaaagact

SEQ ID NO: 676079 - DNA, 18 bp, Homo sapiens
agagaaggagcagaaaga

SEQ ID NO: 676080 - DNA, 17 bp, Homo sapiens
agagaagtgagtggtgt

SEQ ID NO: 676081 - DNA, 10 bp, Homo sapiens
agagaatgag

SEQ ID NO: 676082 - DNA, 12 bp, Homo sapiens
agagaattggct

SEQ ID NO: 676083 - DNA, 21 bp, Homo sapiens
agagacagctacacagagctt

SEQ ID NO: 676084 - DNA, 14 bp, Homo sapiens
agagactgaaatta

SEQ ID NO: 676085 - DNA, 19 bp, Homo sapiens
agagaggggaaagtgtgag

SEQ ID NO: 676086 - DNA, 16 bp, Homo sapiens
agagataggaaactga

SEQ ID NO: 676087 - DNA, 18 bp, Homo sapiens
agagataggaaactgaag

SEQ ID NO: 676088 - DNA, 19 bp, Homo sapiens
agagatctacacatgttgc

SEQ ID NO: 676089 - DNA, 15 bp, Homo sapiens
agagatgagaaatga

SEQ ID NO: 676090 - DNA, 17 bp, Homo sapiens
agagcagtctaaacaga

SEQ ID NO: 676091 - DNA, 19 bp, Homo sapiens
agagcagtctaaacagagt

SEQ ID NO: 676092 - DNA, 12 bp, Homo sapiens
agagccctctcc

SEQ ID NO: 676093 - DNA, 13 bp, Homo sapiens
agagcctcctggg

SEQ ID NO: 676094 - DNA, 18 bp, Homo sapiens
agagctaagggtgggtgc

SEQ ID NO: 676095 - DNA, 16 bp, Homo sapiens
agagctagaaaaataa

SEQ ID NO: 676096 - DNA, 20 bp, Homo sapiens
agagctagaaaaataaaatg

SEQ ID NO: 676097 - DNA, 18 bp, Homo sapiens
agagcttggacagtctga

SEQ ID NO: 676098 - DNA, 21 bp, Homo sapiens
agagcttggacagtctgagct

SEQ ID NO: 676099 - DNA, 23 bp, Homo sapiens
agagcttgttgtctccacttgta

SEQ ID NO: 676100 - DNA, 17 bp, Homo sapiens
agagctttgtcgtattt

SEQ ID NO: 676101 - DNA, 23 bp, Homo sapiens
agagcttttatttggtgtgttcg

SEQ ID NO: 676102 - DNA, 14 bp, Homo sapiens
agaggaaggagggt

SEQ ID NO: 676103 - DNA, 14 bp, Homo sapiens
agaggaccagggcc

SEQ ID NO: 676104 - DNA, 15 bp, Homo sapiens
agaggaccagggcct

SEQ ID NO: 676105 - DNA, 17 bp, Homo sapiens
agaggaccagggccttt

SEQ ID NO: 676106 - DNA, 19 bp, Homo sapiens
agaggagaaatgcaataac

SEQ ID NO: 676107 - DNA, 22 bp, Homo sapiens
agaggagaaatgcaataactct

SEQ ID NO: 676108 - DNA, 18 bp, Homo sapiens
agaggcaaagaaaggaga

SEQ ID NO: 676109 - DNA, 13 bp, Homo sapiens
agaggccaatgcc

SEQ ID NO: 676110 - DNA, 20 bp, Homo sapiens
agaggcccagatattagaaa

SEQ ID NO: 676111 - DNA, 12 bp, Homo sapiens
agaggctgcccc

SEQ ID NO: 676112 - DNA, 20 bp, Homo sapiens
agaggctgcccctctcacca

SEQ ID NO: 676113 - DNA, 19 bp, Homo sapiens
agaggcttgtttacctttc

SEQ ID NO: 676114 - DNA, 20 bp, Homo sapiens
agagggacggccaagaatgt

SEQ ID NO: 676115 - DNA, 19 bp, Homo sapiens
agagggagaagcatgaaaa

SEQ ID NO: 676116 - DNA, 20 bp, Homo sapiens
agagggctggtccttattta

SEQ ID NO: 676117 - DNA, 14 bp, Homo sapiens
agaggtaccctggg

SEQ ID NO: 676118 - DNA, 17 bp, Homo sapiens
agaggtaccctgggtgt

SEQ ID NO: 676119 - DNA, 18 bp, Homo sapiens
agaggtgattctcagggc

SEQ ID NO: 676120 - DNA, 14 bp, Homo sapiens
agaggtgggagggc

SEQ ID NO: 676121 - DNA, 20 bp, Homo sapiens
agagtaattcatctgtgaat

SEQ ID NO: 676122 - DNA, 21 bp, Homo sapiens
agagtaattcatctgtgaatc

SEQ ID NO: 676123 - DNA, 15 bp, Homo sapiens
agagtacctgtgtgt

SEQ ID NO: 676124 - DNA, 17 bp, Homo sapiens
agagtacctgtgtgttt

SEQ ID NO: 676125 - DNA, 21 bp, Homo sapiens
agagtattttaagaagacata

SEQ ID NO: 676126 - DNA, 21 bp, Homo sapiens
agagtccttgcaaaattgtct

SEQ ID NO: 676127 - DNA, 22 bp, Homo sapiens
agagtcttacaatcaaatctcc

SEQ ID NO: 676128 - DNA, 18 bp, Homo sapiens
agagtgaccagcacactg

SEQ ID NO: 676129 - DNA, 18 bp, Homo sapiens
agagtgtagactgtggct

SEQ ID NO: 676130 - DNA, 20 bp, Homo sapiens
agagtgtgggggaggcgcac

SEQ ID NO: 676131 - DNA, 20 bp, Homo sapiens
agagtttcagtttgttggaa

SEQ ID NO: 676132 - DNA, 23 bp, Homo sapiens
agagttttatagcctggactgct

SEQ ID NO: 676133 - DNA, 16 bp, Homo sapiens
agagttttatcaactt

SEQ ID NO: 676134 - DNA, 17 bp, Homo sapiens
agataaaactctagcag

SEQ ID NO: 676135 - DNA, 18 bp, Homo sapiens
agataaagcttaggtcaa

SEQ ID NO: 676136 - DNA, 13 bp, Homo sapiens
agataagcaagag

SEQ ID NO: 676137 - DNA, 15 bp, Homo sapiens
agataatatttttgt

SEQ ID NO: 676138 - DNA, 20 bp, Homo sapiens
agataatttacaagatatta

SEQ ID NO: 676139 - DNA, 20 bp, Homo sapiens
agataatttatttcaataaa

SEQ ID NO: 676140 - DNA, 18 bp, Homo sapiens
agatacagtggagacatc

SEQ ID NO: 676141 - DNA, 22 bp, Homo sapiens
agataccttatcttacaatatt

SEQ ID NO: 676142 - DNA, 19 bp, Homo sapiens
agataccttgaaaggaaga

SEQ ID NO: 676143 - DNA, 14 bp, Homo sapiens
agatactttgaagt

SEQ ID NO: 676144 - DNA, 16 bp, Homo sapiens
agataggaaactgaag

SEQ ID NO: 676145 - DNA, 15 bp, Homo sapiens
agatatctcaatgaa

SEQ ID NO: 676146 - DNA, 14 bp, Homo sapiens
agatattattgctt

SEQ ID NO: 676147 - DNA, 19 bp, Homo sapiens
agatattgaaggagaaaat

SEQ ID NO: 676148 - DNA, 19 bp, Homo sapiens
agatattgtgaagtacata

SEQ ID NO: 676149 - DNA, 19 bp, Homo sapiens
agatattgttgttttccat

SEQ ID NO: 676150 - DNA, 18 bp, Homo sapiens
agatcgagaccatcctgg

SEQ ID NO: 676151 - DNA, 23 bp, Homo sapiens
agatcgtgtattgagatttctta

SEQ ID NO: 676152 - DNA, 21 bp, Homo sapiens
agatctaaacagttatttctg

SEQ ID NO: 676153 - DNA, 13 bp, Homo sapiens
agatctacacatg

SEQ ID NO: 676154 - DNA, 14 bp, Homo sapiens
agatctacacatgt

SEQ ID NO: 676155 - DNA, 16 bp, Homo sapiens
agatctatgggaagat

SEQ ID NO: 676156 - DNA, 18 bp, Homo sapiens
agatctcctggcaaaggc

SEQ ID NO: 676157 - DNA, 17 bp, Homo sapiens
agatctggacttggcaa

SEQ ID NO: 676158 - DNA, 13 bp, Homo sapiens
agatcttaggtat

SEQ ID NO: 676159 - DNA, 14 bp, Homo sapiens
agatctttcagaaa

SEQ ID NO: 676160 - DNA, 21 bp, Homo sapiens
agatctttcagaaatataaca

SEQ ID NO: 676161 - DNA, 16 bp, Homo sapiens
agatgaaaaagaataa

SEQ ID NO: 676162 - DNA, 16 bp, Homo sapiens
agatgctagaaaaatg

SEQ ID NO: 676163 - DNA, 15 bp, Homo sapiens
agatgctcactttat

SEQ ID NO: 676164 - DNA, 16 bp, Homo sapiens
agatgctcactttatt

SEQ ID NO: 676165 - DNA, 13 bp, Homo sapiens
agatggaaataca

SEQ ID NO: 676166 - DNA, 15 bp, Homo sapiens
agatggaaatacagt

SEQ ID NO: 676167 - DNA, 14 bp, Homo sapiens
agatgtaattttgt

SEQ ID NO: 676168 - DNA, 21 bp, Homo sapiens
agatgtttggatattttttgg

SEQ ID NO: 676169 - DNA, 23 bp, Homo sapiens
agattaaaattatatagctgctc

SEQ ID NO: 676170 - DNA, 18 bp, Homo sapiens
agattctgcctatgtaaa

SEQ ID NO: 676171 - DNA, 21 bp, Homo sapiens
agattctgcctatgtaaaatg

SEQ ID NO: 676172 - DNA, 19 bp, Homo sapiens
agattctggtccctggaaa

SEQ ID NO: 676173 - DNA, 20 bp, Homo sapiens
agattctttcagttctttgg

SEQ ID NO: 676174 - DNA, 17 bp, Homo sapiens
agattgatatctataaa

SEQ ID NO: 676175 - DNA, 19 bp, Homo sapiens
agattgtttcctcttccaa

SEQ ID NO: 676176 - DNA, 19 bp, Homo sapiens
agatttattttttggactt

SEQ ID NO: 676177 - DNA, 14 bp, Homo sapiens
agatttcaaaaaaa

SEQ ID NO: 676178 - DNA, 15 bp, Homo sapiens
agatttttatttatg

SEQ ID NO: 676179 - DNA, 13 bp, Homo sapiens
agatttttttcct

SEQ ID NO: 676180 - DNA, 15 bp, Homo sapiens
agatttttttcctga

SEQ ID NO: 676181 - DNA, 13 bp, Homo sapiens
agcaacatggctt

SEQ ID NO: 676182 - DNA, 13 bp, Homo sapiens
agcaacatttgta

SEQ ID NO: 676183 - DNA, 14 bp, Homo sapiens
agcaacatttgtat

SEQ ID NO: 676184 - DNA, 16 bp, Homo sapiens
aggcatggccctgggc

SEQ ID NO: 676185 - DNA, 22 bp, Homo sapiens
aggcattgacataggtcataaa

SEQ ID NO: 676186 - DNA, 14 bp, Homo sapiens
aggcattgaggaag

SEQ ID NO: 676187 - DNA, 23 bp, Homo sapiens
aggccaagtccgcagaagccctg

SEQ ID NO: 676188 - DNA, 19 bp, Homo sapiens
aggccacagtggggctgca

SEQ ID NO: 676189 - DNA, 19 bp, Homo sapiens
aggccagcaacattggcac

SEQ ID NO: 676190 - DNA, 13 bp, Homo sapiens
aggcccatagcag

SEQ ID NO: 676191 - DNA, 21 bp, Homo sapiens
aggccctcctctcccatcctt

SEQ ID NO: 676192 - DNA, 16 bp, Homo sapiens
aggccgaggcgggtgg

SEQ ID NO: 676193 - DNA, 22 bp, Homo sapiens
aggcctaattctatgcctgtct

SEQ ID NO: 676194 - DNA, 22 bp, Homo sapiens
aggcctgcctcccacttcactg

SEQ ID NO: 676195 - DNA, 19 bp, Homo sapiens
aggcctgcgaccctggggg

SEQ ID NO: 676196 - DNA, 18 bp, Homo sapiens
aggcctgtcccttgcctc

SEQ ID NO: 676197 - DNA, 17 bp, Homo sapiens
aggcctgtggctccctt

SEQ ID NO: 676198 - DNA, 20 bp, Homo sapiens
aggcggaggttgcagtgagc

SEQ ID NO: 676199 - DNA, 16 bp, Homo sapiens
aggcggctcctcctca

SEQ ID NO: 676200 - DNA, 20 bp, Homo sapiens
aggcggctcctcctcaccca

SEQ ID NO: 676201 - DNA, 12 bp, Homo sapiens
aggcgtgatcca

SEQ ID NO: 676202 - DNA, 17 bp, Homo sapiens
aggctatgccatgtgcg

SEQ ID NO: 676203 - DNA, 22 bp, Homo sapiens
aggctatggggtaggagaaaag

SEQ ID NO: 676204 - DNA, 20 bp, Homo sapiens
aggctatgtataaaatacat

SEQ ID NO: 676205 - DNA, 16 bp, Homo sapiens
aggctcgtcagccacc

SEQ ID NO: 676206 - DNA, 18 bp, Homo sapiens
aggctcgtcagccacctg

SEQ ID NO: 676207 - DNA, 21 bp, Homo sapiens
aggctcgtcagccacctggga

SEQ ID NO: 676208 - DNA, 23 bp, Homo sapiens
aggctctattccaataaactatg

SEQ ID NO: 676209 - DNA, 12 bp, Homo sapiens
aggctctgaagg

SEQ ID NO: 676210 - DNA, 17 bp, Homo sapiens
aggctgaaagaggccaa

SEQ ID NO: 676211 - DNA, 17 bp, Homo sapiens
aggctgaggcaggagga

SEQ ID NO: 676212 - DNA, 19 bp, Homo sapiens
aggctgatgggcaaaaaac

SEQ ID NO: 676213 - DNA, 18 bp, Homo sapiens
aggctgggccatgtccaa

SEQ ID NO: 676214 - DNA, 21 bp, Homo sapiens
aggctgggccatgtccaaaga

SEQ ID NO: 676215 - DNA, 18 bp, Homo sapiens
aggctgtagaaaggggag

SEQ ID NO: 676216 - DNA, 20 bp, Homo sapiens
aggcttccctgacttgcttt

SEQ ID NO: 676217 - DNA, 21 bp, Homo sapiens
aggcttccctgacttgcttta

SEQ ID NO: 676218 - DNA, 18 bp, Homo sapiens
aggctttcccacttccca

SEQ ID NO: 676219 - DNA, 13 bp, Homo sapiens
agggaactgggga

SEQ ID NO: 676220 - DNA, 19 bp, Homo sapiens
agggaagaaaggaggcagc

SEQ ID NO: 676221 - DNA, 17 bp, Homo sapiens
agggaagctggcctgag

SEQ ID NO: 676222 - DNA, 15 bp, Homo sapiens
agggaagctgtcctg

SEQ ID NO: 676223 - DNA, 17 bp, Homo sapiens
agggaagctgtcctgga

SEQ ID NO: 676224 - DNA, 16 bp, Homo sapiens
agggaaggcctgactt

SEQ ID NO: 676225 - DNA, 14 bp, Homo sapiens
agggaaggtgaaac

SEQ ID NO: 676226 - DNA, 16 bp, Homo sapiens
agggacttaacttgtt

SEQ ID NO: 676227 - DNA, 15 bp, Homo sapiens
agggagctgggcccg

SEQ ID NO: 676228 - DNA, 11 bp, Homo sapiens
agggaggcccc

SEQ ID NO: 676229 - DNA, 18 bp, Homo sapiens
agggaggggccggccctg

SEQ ID NO: 676230 - DNA, 19 bp, Homo sapiens
agggaggggccggccctgt

SEQ ID NO: 676231 - DNA, 16 bp, Homo sapiens
agggagtgctggctca

SEQ ID NO: 676232 - DNA, 15 bp, Homo sapiens
agggatatggcagga

SEQ ID NO: 676233 - DNA, 21 bp, Homo sapiens
agggcagtccttactccccca

SEQ ID NO: 676234 - DNA, 14 bp, Homo sapiens
agggccacctgcag

SEQ ID NO: 676235 - DNA, 15 bp, Homo sapiens
agggccagcatatat

SEQ ID NO: 676236 - DNA, 18 bp, Homo sapiens
agggcccacccatgtcac

SEQ ID NO: 676237 - DNA, 15 bp, Homo sapiens
agggcctggggcctg

SEQ ID NO: 676238 - DNA, 16 bp, Homo sapiens
agggcctggggcctga

SEQ ID NO: 676239 - DNA, 22 bp, Homo sapiens
agggcctggggcctgagagaat

SEQ ID NO: 676240 - DNA, 19 bp, Homo sapiens
agggctcatttttgcactt

SEQ ID NO: 676241 - DNA, 13 bp, Homo sapiens
agggctcccaggg

SEQ ID NO: 676242 - DNA, 22 bp, Homo sapiens
agggctcccaggggtctccctg

SEQ ID NO: 676243 - DNA, 15 bp, Homo sapiens
agggctctttagcca

SEQ ID NO: 676244 - DNA, 13 bp, Homo sapiens
agggctgccctga

SEQ ID NO: 676245 - DNA, 18 bp, Homo sapiens
agggctggagcctggggt

SEQ ID NO: 676246 - DNA, 17 bp, Homo sapiens
agggctggtccttattt

SEQ ID NO: 676247 - DNA, 16 bp, Homo sapiens
aggggagcgtgttcct

SEQ ID NO: 676248 - DNA, 21 bp, Homo sapiens
aggggatatttaaggtagctt

SEQ ID NO: 676249 - DNA, 21 bp, Homo sapiens
aggggccggccctgtgtgcag

SEQ ID NO: 676250 - DNA, 23 bp, Homo sapiens
agggggatgccactcctccctcc

SEQ ID NO: 676251 - DNA, 12 bp, Homo sapiens
agggtaagtatt

SEQ ID NO: 676252 - DNA, 19 bp, Homo sapiens
agggtccaggagagcctgg

SEQ ID NO: 676253 - DNA, 22 bp, Homo sapiens
agggtccaggagagcctggggg

SEQ ID NO: 676254 - DNA, 24 bp, Homo sapiens
agggtcccggtgtatcctggccct

SEQ ID NO: 676255 - DNA, 15 bp, Homo sapiens
agggtctgtgtgaat

SEQ ID NO: 676256 - DNA, 18 bp, Homo sapiens
agggtctgtgtgaatgtg

SEQ ID NO: 676257 - DNA, 22 bp, Homo sapiens
agggttcaaaatgtctgtagct

SEQ ID NO: 676258 - DNA, 20 bp, Homo sapiens
aggtaacaggtgtgtatgta

SEQ ID NO: 676259 - DNA, 12 bp, Homo sapiens
aggtaccctggg

SEQ ID NO: 676260 - DNA, 15 bp, Homo sapiens
aggtataataaaatt

SEQ ID NO: 676261 - DNA, 15 bp, Homo sapiens
aggtatctagagctt

SEQ ID NO: 676262 - DNA, 13 bp, Homo sapiens
aggtatggctctg

SEQ ID NO: 676263 - DNA, 19 bp, Homo sapiens
aggtattaaaactaaattt

SEQ ID NO: 676264 - DNA, 19 bp, Homo sapiens
aggtattacaagtaatgta

SEQ ID NO: 676265 - DNA, 13 bp, Homo sapiens
aggtattatacat

SEQ ID NO: 676266 - DNA, 20 bp, Homo sapiens
aggtcacaacccttctctgt

SEQ ID NO: 676267 - DNA, 22 bp, Homo sapiens
aggtcacaacccttctctgttg

SEQ ID NO: 676268 - DNA, 20 bp, Homo sapiens
aggtcagggaggatctgttc

SEQ ID NO: 676269 - DNA, 13 bp, Homo sapiens
aggtcataaagca

SEQ ID NO: 676270 - DNA, 14 bp, Homo sapiens
aggtcataaagcat

SEQ ID NO: 676271 - DNA, 16 bp, Homo sapiens
aggtcataaagcattg

SEQ ID NO: 676272 - DNA, 18 bp, Homo sapiens
aggtcatggaatggaaac

SEQ ID NO: 676273 - DNA, 16 bp, Homo sapiens
aggtcctgtgttaaac

SEQ ID NO: 676274 - DNA, 14 bp, Homo sapiens
aggtgagctacttt

SEQ ID NO: 676275 - DNA, 15 bp, Homo sapiens
aggtgattctcaggg

SEQ ID NO: 676276 - DNA, 18 bp, Homo sapiens
aggtgattctcagggctg

SEQ ID NO: 676277 - DNA, 19 bp, Homo sapiens
aggtgattctcagggctgg

SEQ ID NO: 676278 - DNA, 22 bp, Homo sapiens
aggtggggattgcccctggctt

SEQ ID NO: 676279 - DNA, 22 bp, Homo sapiens
aggtggttcagacaagacagag

SEQ ID NO: 676280 - DNA, 13 bp, Homo sapiens
aggtgtatttaaa

SEQ ID NO: 676281 - DNA, 15 bp, Homo sapiens
aggtgtcctgagcac

SEQ ID NO: 676282 - DNA, 16 bp, Homo sapiens
aggtgtgtatgtaaag

SEQ ID NO: 676283 - DNA, 20 bp, Homo sapiens
aggtgtgtatgtaaagttaa

SEQ ID NO: 676284 - DNA, 16 bp, Homo sapiens
aggttgcagtgagctg

SEQ ID NO: 676285 - DNA, 12 bp, Homo sapiens
aggttgcctgaa

SEQ ID NO: 676286 - DNA, 17 bp, Homo sapiens
aggtttaaccttaaaat

SEQ ID NO: 676287 - DNA, 15 bp, Homo sapiens
aggtttctctccctc

SEQ ID NO: 676288 - DNA, 15 bp, Homo sapiens
aggtttgtgttttct

SEQ ID NO: 676289 - DNA, 18 bp, Homo sapiens
aggtttgttttcagcact

SEQ ID NO: 676290 - DNA, 17 bp, Homo sapiens
atgtaagggtctttggt

SEQ ID NO: 676291 - DNA, 18 bp, Homo sapiens
atgtaagtgggcccaccc

SEQ ID NO: 676292 - DNA, 21 bp, Homo sapiens
atgtaatacatatagcagctc

SEQ ID NO: 676293 - DNA, 20 bp, Homo sapiens
atgtaatgtgtggtggcctc

SEQ ID NO: 676294 - DNA, 22 bp, Homo sapiens
atgtaatgtgtggtggcctcag

SEQ ID NO: 676295 - DNA, 23 bp, Homo sapiens
atgtaatgtgtggtggcctcagc

SEQ ID NO: 676296 - DNA, 18 bp, Homo sapiens
atgtaatgttaatgttat

SEQ ID NO: 676297 - DNA, 14 bp, Homo sapiens
atgtaattataagc

SEQ ID NO: 676298 - DNA, 13 bp, Homo sapiens
atgtaatttaaat

SEQ ID NO: 676299 - DNA, 17 bp, Homo sapiens
atgtaatttaaatgaaa

SEQ ID NO: 676300 - DNA, 16 bp, Homo sapiens
atgtaatttcaaaata

SEQ ID NO: 676301 - DNA, 17 bp, Homo sapiens
atgtaatttcaaaatac

SEQ ID NO: 676302 - DNA, 19 bp, Homo sapiens
atgtaatttcaaaatacat

SEQ ID NO: 676303 - DNA, 15 bp, Homo sapiens
atgtacagattcttt

SEQ ID NO: 676304 - DNA, 18 bp, Homo sapiens
atgtacagattctttcag

SEQ ID NO: 676305 - DNA, 13 bp, Homo sapiens
atgtacataactc

SEQ ID NO: 676306 - DNA, 15 bp, Homo sapiens
atgtactacagctat

SEQ ID NO: 676307 - DNA, 16 bp, Homo sapiens
atgtactacagctata

SEQ ID NO: 676308 - DNA, 17 bp, Homo sapiens
atgtactacagctatat

SEQ ID NO: 676309 - DNA, 19 bp, Homo sapiens
atgtactacagctatattt

SEQ ID NO: 676310 - DNA, 22 bp, Homo sapiens
atgtagactgtgccagaggcca

SEQ ID NO: 676311 - DNA, 20 bp, Homo sapiens
atgtagcccatccttccctt

SEQ ID NO: 676312 - DNA, 19 bp, Homo sapiens
atgtagcgctttgaatatg

SEQ ID NO: 676313 - DNA, 16 bp, Homo sapiens
atgtaggtaagactgt

SEQ ID NO: 676314 - DNA, 20 bp, Homo sapiens
atgtaggtaagactgtagat

SEQ ID NO: 676315 - DNA, 20 bp, Homo sapiens
atgtagtttttatatgttgt

SEQ ID NO: 676316 - DNA, 21 bp, Homo sapiens
atgtagtttttatatgttgta

SEQ ID NO: 676317 - DNA, 15 bp, Homo sapiens
atgtataaaatacat

SEQ ID NO: 676318 - DNA, 23 bp, Homo sapiens
atgtataaccaagtgtgctcttt

SEQ ID NO: 676319 - DNA, 21 bp, Homo sapiens
atgtatatttttttaatttaa

SEQ ID NO: 676320 - DNA, 20 bp, Homo sapiens
atgtatccaaggaaacattt

SEQ ID NO: 676321 - DNA, 16 bp, Homo sapiens
atgtatgtatgtatta

SEQ ID NO: 676322 - DNA, 15 bp, Homo sapiens
atgtatttaaagttg

SEQ ID NO: 676323 - DNA, 22 bp, Homo sapiens
atgtatttctccatcctgcaga

SEQ ID NO: 676324 - DNA, 19 bp, Homo sapiens
atgtatttgttatatataa

SEQ ID NO: 676325 - DNA, 21 bp, Homo sapiens
atgtatttgttatatataata

SEQ ID NO: 676326 - DNA, 16 bp, Homo sapiens
atgtattttgacactg

SEQ ID NO: 676327 - DNA, 23 bp, Homo sapiens
atgtcaaatatttagatgtaatt

SEQ ID NO: 676328 - DNA, 16 bp, Homo sapiens
atgtcacctacatatg

SEQ ID NO: 676329 - DNA, 23 bp, Homo sapiens
atgtcagtagtgctaatgcattt

SEQ ID NO: 676330 - DNA, 16 bp, Homo sapiens
atgtccaaagaggctg

SEQ ID NO: 676331 - DNA, 14 bp, Homo sapiens
atgtccctgggcca

SEQ ID NO: 676332 - DNA, 17 bp, Homo sapiens
atgtccctgggccaggg

SEQ ID NO: 676333 - DNA, 18 bp, Homo sapiens
atgtccctgggccagggt

SEQ ID NO: 676334 - DNA, 21 bp, Homo sapiens
atgtctgctgagttggcctgg

SEQ ID NO: 676335 - DNA, 16 bp, Homo sapiens
atgtctgtagctcctc

SEQ ID NO: 676336 - DNA, 19 bp, Homo sapiens
atgtgaaaaattaactttt

SEQ ID NO: 676337 - DNA, 16 bp, Homo sapiens
atgtgaataatggcac

SEQ ID NO: 676338 - DNA, 17 bp, Homo sapiens
attgtaagtgaaattaa

SEQ ID NO: 676339 - DNA, 22 bp, Homo sapiens
attgtacaaaattaagcaaatg

SEQ ID NO: 676340 - DNA, 20 bp, Homo sapiens
attgtatatatattcatata

SEQ ID NO: 676341 - DNA, 13 bp, Homo sapiens
attgtcacttttt

SEQ ID NO: 676342 - DNA, 19 bp, Homo sapiens
attgtcagctactaatgat

SEQ ID NO: 676343 - DNA, 18 bp, Homo sapiens
attgtctactcctagaag

SEQ ID NO: 676344 - DNA, 13 bp, Homo sapiens
attgtctatttat

SEQ ID NO: 676345 - DNA, 14 bp, Homo sapiens
attgtctatttatc

SEQ ID NO: 676346 - DNA, 13 bp, Homo sapiens
attgtgaacatga

SEQ ID NO: 676347 - DNA, 21 bp, Homo sapiens
attgtgaccacaggctggtgt

SEQ ID NO: 676348 - DNA, 12 bp, Homo sapiens
attgtgtctccc

SEQ ID NO: 676349 - DNA, 22 bp, Homo sapiens
attgttagcaaatgacagattt

SEQ ID NO: 676350 - DNA, 13 bp, Homo sapiens
attgttatttata

SEQ ID NO: 676351 - DNA, 17 bp, Homo sapiens
attgttcaaaaagatat

SEQ ID NO: 676352 - DNA, 18 bp, Homo sapiens
attgttcttattctggca

SEQ ID NO: 676353 - DNA, 14 bp, Homo sapiens
attgttgtatatca

SEQ ID NO: 676354 - DNA, 14 bp, Homo sapiens
attgtttaaaatgt

SEQ ID NO: 676355 - DNA, 18 bp, Homo sapiens
attgtttggtaaatgttt

SEQ ID NO: 676356 - DNA, 19 bp, Homo sapiens
attgtttggtaaatgtttc

SEQ ID NO: 676357 - DNA, 19 bp, Homo sapiens
attgttttacctgttctga

SEQ ID NO: 676358 - DNA, 19 bp, Homo sapiens
atttaaaaaaaagaaactt

SEQ ID NO: 676359 - DNA, 17 bp, Homo sapiens
atttaaaaaataaataa

SEQ ID NO: 676360 - DNA, 13 bp, Homo sapiens
atttaaaaagctc

SEQ ID NO: 676361 - DNA, 20 bp, Homo sapiens
atttaaaacattaaaatata

SEQ ID NO: 676362 - DNA, 22 bp, Homo sapiens
atttaaatatctgttattcaaa

SEQ ID NO: 676363 - DNA, 13 bp, Homo sapiens
atttaagatgtga

SEQ ID NO: 676364 - DNA, 14 bp, Homo sapiens
atttaagatgtgaa

SEQ ID NO: 676365 - DNA, 23 bp, Homo sapiens
atttaagtagtgggcatttcata

SEQ ID NO: 676366 - DNA, 13 bp, Homo sapiens
atttaatatcaaa

SEQ ID NO: 676367 - DNA, 22 bp, Homo sapiens
atttaatggaagtgtatttatt

SEQ ID NO: 676368 - DNA, 17 bp, Homo sapiens
atttaatggggaggaca

SEQ ID NO: 676369 - DNA, 18 bp, Homo sapiens
atttaattcctcttttta

SEQ ID NO: 676370 - DNA, 18 bp, Homo sapiens
atttaatttgaaatatgg

SEQ ID NO: 676371 - DNA, 17 bp, Homo sapiens
atttacaagatattatt

SEQ ID NO: 676372 - DNA, 16 bp, Homo sapiens
atttacagggatttct

SEQ ID NO: 676373 - DNA, 15 bp, Homo sapiens
atttacatccagctt

SEQ ID NO: 676374 - DNA, 23 bp, Homo sapiens
atttacccttttcccccttccca

SEQ ID NO: 676375 - DNA, 15 bp, Homo sapiens
atttacttgttttgg

SEQ ID NO: 676376 - DNA, 14 bp, Homo sapiens
atttactttaaaaa

SEQ ID NO: 676377 - DNA, 16 bp, Homo sapiens
atttagaaactgaaaa

SEQ ID NO: 676378 - DNA, 16 bp, Homo sapiens
atttagagatgctgta

SEQ ID NO: 676379 - DNA, 14 bp, Homo sapiens
atttagtaagaata

SEQ ID NO: 676380 - DNA, 17 bp, Homo sapiens
atttataaacagacaat

SEQ ID NO: 676381 - DNA, 14 bp, Homo sapiens
atttataagcattg

SEQ ID NO: 676382 - DNA, 18 bp, Homo sapiens
atttataagcattgccat

SEQ ID NO: 676383 - DNA, 13 bp, Homo sapiens
atttatacaagat

SEQ ID NO: 676384 - DNA, 15 bp, Homo sapiens
atttatattcataaa

SEQ ID NO: 676385 - DNA, 21 bp, Homo sapiens
atttatattcataaagttaca

SEQ ID NO: 676386 - DNA, 22 bp, Homo sapiens
atttatcatggtcctgaatgta

SEQ ID NO: 676387 - DNA, 23 bp, Homo sapiens
atttatctcctcttcatggcatc

SEQ ID NO: 676388 - DNA, 16 bp, Homo sapiens
atttatgggcccctgg

SEQ ID NO: 676389 - DNA, 18 bp, Homo sapiens
atttatgggcccctggca

SEQ ID NO: 676390 - DNA, 12 bp, Homo sapiens
atttatgtagat

SEQ ID NO: 676391 - DNA, 14 bp, Homo sapiens
atttattgagtttt

SEQ ID NO: 676392 - DNA, 21 bp, Homo sapiens
atttatttgaggtcagtgttt

SEQ ID NO: 676393 - DNA, 21 bp, Homo sapiens
atttcaaaatacatttgtaag

SEQ ID NO: 676394 - DNA, 16 bp, Homo sapiens
atttcaataaatcttt

SEQ ID NO: 676395 - DNA, 18 bp, Homo sapiens
atttcactactagattga

SEQ ID NO: 676396 - DNA, 21 bp, Homo sapiens
atttcatacctcagaatgtaa

SEQ ID NO: 676397 - DNA, 18 bp, Homo sapiens
cttcttctaagaagacat

SEQ ID NO: 676398 - DNA, 16 bp, Homo sapiens
cttctttgtgcctttg

SEQ ID NO: 676399 - DNA, 20 bp, Homo sapiens
cttctttgtgcctttggcct

SEQ ID NO: 676400 - DNA, 18 bp, Homo sapiens
cttgaaaaatgacaattg

SEQ ID NO: 676401 - DNA, 16 bp, Homo sapiens
cttgaaactttgggaa

SEQ ID NO: 676402 - DNA, 14 bp, Homo sapiens
cttgaagggttact

SEQ ID NO: 676403 - DNA, 17 bp, Homo sapiens
cttgaatgtggtctcag

SEQ ID NO: 676404 - DNA, 22 bp, Homo sapiens
cttgacatacctaccagtatta

SEQ ID NO: 676405 - DNA, 22 bp, Homo sapiens
cttgaccatactaataaatata

SEQ ID NO: 676406 - DNA, 18 bp, Homo sapiens
cttgaccgggagacagag

SEQ ID NO: 676407 - DNA, 18 bp, Homo sapiens
cttgactgcattgccgct

SEQ ID NO: 676408 - DNA, 16 bp, Homo sapiens
cttgagaagtaactgt

SEQ ID NO: 676409 - DNA, 18 bp, Homo sapiens
cttgagaggagaaatgca

SEQ ID NO: 676410 - DNA, 14 bp, Homo sapiens
cttgagcaggatta

SEQ ID NO: 676411 - DNA, 13 bp, Homo sapiens
cttgagccctggc

SEQ ID NO: 676412 - DNA, 20 bp, Homo sapiens
cttgagccctggctgttctg

SEQ ID NO: 676413 - DNA, 13 bp, Homo sapiens
cttgaggacagac

SEQ ID NO: 676414 - DNA, 15 bp, Homo sapiens
cttgagtaagtgaag

SEQ ID NO: 676415 - DNA, 15 bp, Homo sapiens
cttgatagatgtttg

SEQ ID NO: 676416 - DNA, 17 bp, Homo sapiens
cttgatctctcttgtcc

SEQ ID NO: 676417 - DNA, 20 bp, Homo sapiens
cttgatctctcttgtcctct

SEQ ID NO: 676418 - DNA, 23 bp, Homo sapiens
cttgatctctcttgtcctcttct

SEQ ID NO: 676419 - DNA, 15 bp, Homo sapiens
cttgatgactgctga

SEQ ID NO: 676420 - DNA, 22 bp, Homo sapiens
cttgatgtacataactcctgtc

SEQ ID NO: 676421 - DNA, 19 bp, Homo sapiens
cttgatgttttttctgtaa

SEQ ID NO: 676422 - DNA, 22 bp, Homo sapiens
cttgatgttttttctgtaatgt

SEQ ID NO: 676423 - DNA, 23 bp, Homo sapiens
cttgatgttttttctgtaatgta

SEQ ID NO: 676424 - DNA, 23 bp, Homo sapiens
cttgatttcaaagttttgttgta

SEQ ID NO: 676425 - DNA, 18 bp, Homo sapiens
cttgattttaatacattg

SEQ ID NO: 676426 - DNA, 17 bp, Homo sapiens
cttgcaatcttctactt

SEQ ID NO: 676427 - DNA, 21 bp, Homo sapiens
cttgcataataagctaaagag

SEQ ID NO: 676428 - DNA, 13 bp, Homo sapiens
cttgcccatcctg

SEQ ID NO: 676429 - DNA, 14 bp, Homo sapiens
cttgcccatcctga

SEQ ID NO: 676430 - DNA, 20 bp, Homo sapiens
cttgcccccagtgcctcacc

SEQ ID NO: 676431 - DNA, 16 bp, Homo sapiens
cttgcctccaggtgca

SEQ ID NO: 676432 - DNA, 19 bp, Homo sapiens
cttgcctccaggtgcagag

SEQ ID NO: 676433 - DNA, 23 bp, Homo sapiens
cttgcctccaggtgcagaggtac

SEQ ID NO: 676434 - DNA, 21 bp, Homo sapiens
cttgcctgaggggaaagagag

SEQ ID NO: 676435 - DNA, 22 bp, Homo sapiens
cttgcctgaggggaaagagaga

SEQ ID NO: 676436 - DNA, 13 bp, Homo sapiens
cttgcctgcaggg

SEQ ID NO: 676437 - DNA, 16 bp, Homo sapiens
cttgcctgcagggcca

SEQ ID NO: 676438 - DNA, 20 bp, Homo sapiens
cttgcctgcagggccatggc

SEQ ID NO: 676439 - DNA, 18 bp, Homo sapiens
cttgccttcctcagctgc

SEQ ID NO: 676440 - DNA, 15 bp, Homo sapiens
cttgctctcctcatc

SEQ ID NO: 676441 - DNA, 11 bp, Homo sapiens
cttgctgggta

SEQ ID NO: 676442 - DNA, 19 bp, Homo sapiens
cttgctgtatgctgatcat

SEQ ID NO: 676443 - DNA, 19 bp, Homo sapiens
cttgctgtttgtcctgaga

SEQ ID NO: 676444 - DNA, 14 bp, Homo sapiens
cttgcttcttactg

SEQ ID NO: 676445 - DNA, 14 bp, Homo sapiens
ctatatatatttct

SEQ ID NO: 676446 - DNA, 16 bp, Homo sapiens
ctatatgcagtccttt

SEQ ID NO: 676447 - DNA, 21 bp, Homo sapiens
ctatccccatctccctgcctg

SEQ ID NO: 676448 - DNA, 22 bp, Homo sapiens
ctatccccatctccctgcctgg

SEQ ID NO: 676449 - DNA, 17 bp, Homo sapiens
ctatccgctgccagcct

SEQ ID NO: 676450 - DNA, 15 bp, Homo sapiens
ctatctatcttccaa

SEQ ID NO: 676451 - DNA, 23 bp, Homo sapiens
ctatctccgttccatctgggctt

SEQ ID NO: 676452 - DNA, 17 bp, Homo sapiens
ctatgacaaattcaaga

SEQ ID NO: 676453 - DNA, 20 bp, Homo sapiens
ctatgcatattcaatgtatt

SEQ ID NO: 676454 - DNA, 16 bp, Homo sapiens
ctatggcttatttcta

SEQ ID NO: 676455 - DNA, 15 bp, Homo sapiens
ctatgtataaaatac

SEQ ID NO: 676456 - DNA, 18 bp, Homo sapiens
ctatgtataaaatacata

SEQ ID NO: 676457 - DNA, 16 bp, Homo sapiens
ctattatttttataat

SEQ ID NO: 676458 - DNA, 15 bp, Homo sapiens
ctattccaataaact

SEQ ID NO: 676459 - DNA, 18 bp, Homo sapiens
ctattgacttttcaataa

SEQ ID NO: 676460 - DNA, 18 bp, Homo sapiens
ctattgctgctgcccctt

SEQ ID NO: 676461 - DNA, 10 bp, Homo sapiens
ctatttaaga

SEQ ID NO: 676462 - DNA, 19 bp, Homo sapiens
ctatttacaagatggactt

SEQ ID NO: 676463 - DNA, 13 bp, Homo sapiens
ctatttatatcac

SEQ ID NO: 676464 - DNA, 14 bp, Homo sapiens
ctatttgctaatgt

SEQ ID NO: 676465 - DNA, 20 bp, Homo sapiens
ctattttaaaataaattagt

SEQ ID NO: 676466 - DNA, 12 bp, Homo sapiens
ctattttcataa

SEQ ID NO: 676467 - DNA, 14 bp, Homo sapiens
ctcaaaacaaaggc

SEQ ID NO: 676468 - DNA, 17 bp, Homo sapiens
ctcaaatacacatttgc

SEQ ID NO: 676469 - DNA, 20 bp, Homo sapiens
ctcaacatttgtctggtctt

SEQ ID NO: 676470 - DNA, 16 bp, Homo sapiens
ctcaacgcctccccct

SEQ ID NO: 676471 - DNA, 22 bp, Homo sapiens
ctcaacgcctccccctccccca

SEQ ID NO: 676472 - DNA, 20 bp, Homo sapiens
ctcaactgtcccaaggaggg

SEQ ID NO: 676473 - DNA, 17 bp, Homo sapiens
ctcaagctagtgtttct

SEQ ID NO: 676474 - DNA, 21 bp, Homo sapiens
ctcaagctttcccgcccagcc

SEQ ID NO: 676475 - DNA, 21 bp, Homo sapiens
ctcaaggagaggcaaagaaag

SEQ ID NO: 676476 - DNA, 22 bp, Homo sapiens
ctcaaggagaggcaaagaaagg

SEQ ID NO: 676477 - DNA, 16 bp, Homo sapiens
ctcaattatttgcata

SEQ ID NO: 676478 - DNA, 22 bp, Homo sapiens
ctcaattatttgcatattttga

SEQ ID NO: 676479 - DNA, 16 bp, Homo sapiens
ctcaatttttgtctca

SEQ ID NO: 676480 - DNA, 23 bp, Homo sapiens
ctcaatttttgtttttgagtact

SEQ ID NO: 676481 - DNA, 14 bp, Homo sapiens
ctcacccacctctg

SEQ ID NO: 676482 - DNA, 21 bp, Homo sapiens
ctcacccatgcaagcagagga

SEQ ID NO: 676483 - DNA, 14 bp, Homo sapiens
ctcaccccactcct

SEQ ID NO: 676484 - DNA, 17 bp, Homo sapiens
ctcaccccactcctgtc

SEQ ID NO: 676485 - DNA, 13 bp, Homo sapiens
ctcaccgcccatc

SEQ ID NO: 676486 - DNA, 16 bp, Homo sapiens
ctcaccgcccatcagg

SEQ ID NO: 676487 - DNA, 16 bp, Homo sapiens
ctcaccttccaacact

SEQ ID NO: 676488 - DNA, 13 bp, Homo sapiens
ctcacttcctttg

SEQ ID NO: 676489 - DNA, 18 bp, Homo sapiens
ctcacttcctttgccctt

SEQ ID NO: 676490 - DNA, 21 bp, Homo sapiens
ctcacttcctttgcccttcct

SEQ ID NO: 676491 - DNA, 20 bp, Homo sapiens
ctcagaccccctcagccttg

SEQ ID NO: 676492 - DNA, 19 bp, Homo sapiens
ctcagagaaaaatgctccc

SEQ ID NO: 676493 - DNA, 17 bp, Homo sapiens
ctcagagaaggaaaaga

SEQ ID NO: 676494 - DNA, 15 bp, Homo sapiens
ctcagagagcaccat

SEQ ID NO: 676495 - DNA, 21 bp, Homo sapiens
ctcagcatttccttgtcccgt

SEQ ID NO: 676496 - DNA, 16 bp, Homo sapiens
ctcagccccaactctt

SEQ ID NO: 676497 - DNA, 17 bp, Homo sapiens
ctcagccccaactcttt

SEQ ID NO: 676498 - DNA, 19 bp, Homo sapiens
ctcagccctggcctggctg

SEQ ID NO: 676499 - DNA, 16 bp, Homo sapiens
ctcagcctagcacagg

SEQ ID NO: 676500 - DNA, 15 bp, Homo sapiens
ctcagctgcctcctg

SEQ ID NO: 676501 - DNA, 20 bp, Homo sapiens
ctcagcttatctcttttata

SEQ ID NO: 676502 - DNA, 18 bp, Homo sapiens
ctcagggagcagggaagg

SEQ ID NO: 676503 - DNA, 21 bp, Homo sapiens
ctcagggagcagggaaggcct

SEQ ID NO: 676504 - DNA, 10 bp, Homo sapiens
ctcagggctg

SEQ ID NO: 676505 - DNA, 23 bp, Homo sapiens
ctcagggctggagcctggggtgt

SEQ ID NO: 676506 - DNA, 16 bp, Homo sapiens
ctcagggtggtctctt

SEQ ID NO: 676507 - DNA, 12 bp, Homo sapiens
ctcagtgcctcc

SEQ ID NO: 676508 - DNA, 13 bp, Homo sapiens
ctcagtgcctcca

SEQ ID NO: 676509 - DNA, 19 bp, Homo sapiens
ctcagtgttggtatatttt

SEQ ID NO: 676510 - DNA, 21 bp, Homo sapiens
ctcagtgttggtatattttat

SEQ ID NO: 676511 - DNA, 23 bp, Homo sapiens
ctcagtgttttggactccatctc

SEQ ID NO: 676512 - DNA, 16 bp, Homo sapiens
ctcagttttatgcccc

SEQ ID NO: 676513 - DNA, 16 bp, Homo sapiens
ctcataattttgcaaa

SEQ ID NO: 676514 - DNA, 14 bp, Homo sapiens
ctcatcatttgtgg

SEQ ID NO: 676515 - DNA, 22 bp, Homo sapiens
ctcatcctccagtaccttgctt

SEQ ID NO: 676516 - DNA, 12 bp, Homo sapiens
ctcatctcaggt

SEQ ID NO: 676517 - DNA, 14 bp, Homo sapiens
ctcatctttttact

SEQ ID NO: 676518 - DNA, 12 bp, Homo sapiens
ctcatgcctgta

SEQ ID NO: 676519 - DNA, 14 bp, Homo sapiens
ctcatgtttttaac

SEQ ID NO: 676520 - DNA, 18 bp, Homo sapiens
ctcattactgggccttag

SEQ ID NO: 676521 - DNA, 17 bp, Homo sapiens
ctcattccactgttggt

SEQ ID NO: 676522 - DNA, 21 bp, Homo sapiens
ctcattgacttttataaagca

SEQ ID NO: 676523 - DNA, 19 bp, Homo sapiens
ctcattgtcacctctgtga

SEQ ID NO: 676524 - DNA, 22 bp, Homo sapiens
ctcattgtgtctcccgtgcatg

SEQ ID NO: 676525 - DNA, 16 bp, Homo sapiens
ctccaaggcagggacc

SEQ ID NO: 676526 - DNA, 15 bp, Homo sapiens
ctccaattttttaag

SEQ ID NO: 676527 - DNA, 15 bp, Homo sapiens
ctccacatgctgcct

SEQ ID NO: 676528 - DNA, 18 bp, Homo sapiens
ctccacatgctgcctggc

SEQ ID NO: 676529 - DNA, 21 bp, Homo sapiens
ctccaccccccactcagtgcc

SEQ ID NO: 676530 - DNA, 23 bp, Homo sapiens
ctccactcttgatctctcttgtc

SEQ ID NO: 676531 - DNA, 21 bp, Homo sapiens
ctccacttcatttttaagaaa

SEQ ID NO: 676532 - DNA, 23 bp, Homo sapiens
ctccacttgtatatatggatcag

SEQ ID NO: 676533 - DNA, 17 bp, Homo sapiens
ctccactttctcatccg

SEQ ID NO: 676534 - DNA, 13 bp, Homo sapiens
ctccagcctgggg

SEQ ID NO: 676535 - DNA, 18 bp, Homo sapiens
ctccaggccctcctctcc

SEQ ID NO: 676536 - DNA, 20 bp, Homo sapiens
ctccaggccctcctctccca

SEQ ID NO: 676537 - DNA, 15 bp, Homo sapiens
ctccaggcctgcagc

SEQ ID NO: 676538 - DNA, 19 bp, Homo sapiens
ctccaggcctgcctcccac

SEQ ID NO: 676539 - DNA, 20 bp, Homo sapiens
ctccaggcctgcctcccact

SEQ ID NO: 676540 - DNA, 13 bp, Homo sapiens
ctccaggtgcaga

SEQ ID NO: 676541 - DNA, 16 bp, Homo sapiens
ctccagtaccttgctt

SEQ ID NO: 676542 - DNA, 20 bp, Homo sapiens
ctccataaagtacaaatgaa

SEQ ID NO: 676543 - DNA, 14 bp, Homo sapiens
ctccataccttttc

SEQ ID NO: 676544 - DNA, 17 bp, Homo sapiens
ctccataccttttctct

SEQ ID NO: 676545 - DNA, 18 bp, Homo sapiens
ctccataccttttctctt

SEQ ID NO: 676546 - DNA, 20 bp, Homo sapiens
ctccataccttttctctttt

SEQ ID NO: 676547 - DNA, 17 bp, Homo sapiens
ctccataggagggaagg

SEQ ID NO: 676548 - DNA, 19 bp, Homo sapiens
cctccaggcctgcctccca

SEQ ID NO: 676549 - DNA, 21 bp, Homo sapiens
cctccaggcctgcctcccact

SEQ ID NO: 676550 - DNA, 14 bp, Homo sapiens
cctccatttttctc

SEQ ID NO: 676551 - DNA, 22 bp, Homo sapiens
cctcccacacccaaagctgagc

SEQ ID NO: 676552 - DNA, 14 bp, Homo sapiens
cctcccccattccc

SEQ ID NO: 676553 - DNA, 16 bp, Homo sapiens
cctcccgccaggagct

SEQ ID NO: 676554 - DNA, 16 bp, Homo sapiens
cctcccgcccttccat

SEQ ID NO: 676555 - DNA, 18 bp, Homo sapiens
cctccctctgatttttca

SEQ ID NO: 676556 - DNA, 17 bp, Homo sapiens
cctccctggcagacaca

SEQ ID NO: 676557 - DNA, 13 bp, Homo sapiens
cctccgtttttct

SEQ ID NO: 676558 - DNA, 13 bp, Homo sapiens
cctcctcacccac

SEQ ID NO: 676559 - DNA, 15 bp, Homo sapiens
cctcctccaggcctg

SEQ ID NO: 676560 - DNA, 14 bp, Homo sapiens
cctcctcctcctgc

SEQ ID NO: 676561 - DNA, 15 bp, Homo sapiens
cctcctcctcctgcc

SEQ ID NO: 676562 - DNA, 14 bp, Homo sapiens
cctcctctcagtgt

SEQ ID NO: 676563 - DNA, 19 bp, Homo sapiens
cctcctgcacacagggcag

SEQ ID NO: 676564 - DNA, 18 bp, Homo sapiens
cctcctgggaacacatct

SEQ ID NO: 676565 - DNA, 23 bp, Homo sapiens
cctccttccccgagtgactctgg

SEQ ID NO: 676566 - DNA, 23 bp, Homo sapiens
cctccttgtcagggtctccttcc

SEQ ID NO: 676567 - DNA, 14 bp, Homo sapiens
cctcgcctcctcct

SEQ ID NO: 676568 - DNA, 18 bp, Homo sapiens
cctcgctttttcatcctt

SEQ ID NO: 676569 - DNA, 18 bp, Homo sapiens
cctcggcccctcccacac

SEQ ID NO: 676570 - DNA, 15 bp, Homo sapiens
cctctcaccccactc

SEQ ID NO: 676571 - DNA, 17 bp, Homo sapiens
cctctcaccccactcct

SEQ ID NO: 676572 - DNA, 16 bp, Homo sapiens
cctctcctgccctgtg

SEQ ID NO: 676573 - DNA, 15 bp, Homo sapiens
cctctccttgccccc

SEQ ID NO: 676574 - DNA, 23 bp, Homo sapiens
cctctctgtagtttatggcagaa

SEQ ID NO: 676575 - DNA, 18 bp, Homo sapiens
cctctgaaaagtgtgtat

SEQ ID NO: 676576 - DNA, 19 bp, Homo sapiens
cctctgcagtctcatttct

SEQ ID NO: 676577 - DNA, 13 bp, Homo sapiens
cctctgccctgga

SEQ ID NO: 676578 - DNA, 23 bp, Homo sapiens
cctctgcctttgcaccacgggac

SEQ ID NO: 676579 - DNA, 15 bp, Homo sapiens
cctctgctcaccgcc

SEQ ID NO: 676580 - DNA, 17 bp, Homo sapiens
cctctggagcaccaggt

SEQ ID NO: 676581 - DNA, 14 bp, Homo sapiens
cctcttctgctctt

SEQ ID NO: 676582 - DNA, 16 bp, Homo sapiens
cctcttctgctctttt

SEQ ID NO: 676583 - DNA, 17 bp, Homo sapiens
cctcttctgctcttttc

SEQ ID NO: 676584 - DNA, 20 bp, Homo sapiens
cctcttctggtttcccttta

SEQ ID NO: 676585 - DNA, 22 bp, Homo sapiens
cctcttctggtttccctttatt

SEQ ID NO: 676586 - DNA, 19 bp, Homo sapiens
cctcttctttgtgcctttg

SEQ ID NO: 676587 - DNA, 15 bp, Homo sapiens
cctctttccctagga

SEQ ID NO: 676588 - DNA, 15 bp, Homo sapiens
cctgaataaagagcc

SEQ ID NO: 676589 - DNA, 12 bp, Homo sapiens
cctgaatatttt

SEQ ID NO: 676590 - DNA, 20 bp, Homo sapiens
cctgactaatttttgtattt

SEQ ID NO: 676591 - DNA, 12 bp, Homo sapiens
cctgactggtgc

SEQ ID NO: 676592 - DNA, 15 bp, Homo sapiens
cctgagaagctgctc

SEQ ID NO: 676593 - DNA, 17 bp, Homo sapiens
cctgagaagctgctcca

SEQ ID NO: 676594 - DNA, 20 bp, Homo sapiens
cctgagaggggaagcggccc

SEQ ID NO: 676595 - DNA, 14 bp, Homo sapiens
cctgagccagcagg

SEQ ID NO: 676596 - DNA, 18 bp, Homo sapiens
cctgagctaggaagagtc

SEQ ID NO: 676597 - DNA, 11 bp, Homo sapiens
cctgaggggaa

SEQ ID NO: 676598 - DNA, 22 bp, Homo sapiens
cctgcaaaaattcagagtcctt

SEQ ID NO: 676599 - DNA, 17 bp, Homo sapiens
cctgcaaacagaacagg

SEQ ID NO: 676600 - DNA, 18 bp, Homo sapiens
cctgcaaacagaacaggg

SEQ ID NO: 676601 - DNA, 11 bp, Homo sapiens
cctgcacacag

SEQ ID NO: 676602 - DNA, 14 bp, Homo sapiens
cctgcagcaggcag

SEQ ID NO: 676603 - DNA, 19 bp, Homo sapiens
cctgcagtcccacactgtg

SEQ ID NO: 676604 - DNA, 22 bp, Homo sapiens
cctgcagtcccacactgtgcag

SEQ ID NO: 676605 - DNA, 18 bp, Homo sapiens
cctgccatttaaaaagtt

SEQ ID NO: 676606 - DNA, 23 bp, Homo sapiens
cctgcccaatgagactctagggt

SEQ ID NO: 676607 - DNA, 14 bp, Homo sapiens
cctgccccctgggc

SEQ ID NO: 676608 - DNA, 22 bp, Homo sapiens
cctgccccctgggctggggcct

SEQ ID NO: 676609 - DNA, 18 bp, Homo sapiens
cctgccccggagctggag

SEQ ID NO: 676610 - DNA, 18 bp, Homo sapiens
cctgccctcaagggtgtg

SEQ ID NO: 676611 - DNA, 13 bp, Homo sapiens
cctgccctcctct

SEQ ID NO: 676612 - DNA, 13 bp, Homo sapiens
cctgcctcagcct

SEQ ID NO: 676613 - DNA, 13 bp, Homo sapiens
cctgcctttctca

SEQ ID NO: 676614 - DNA, 17 bp, Homo sapiens
cctgcgcatatagactg

SEQ ID NO: 676615 - DNA, 17 bp, Homo sapiens
cctgcgccctgtgcccg

SEQ ID NO: 676616 - DNA, 11 bp, Homo sapiens
cctgctcccag

SEQ ID NO: 676617 - DNA, 15 bp, Homo sapiens
cctgctcccaggccc

SEQ ID NO: 676618 - DNA, 14 bp, Homo sapiens
cctgctgctggtgc

SEQ ID NO: 676619 - DNA, 15 bp, Homo sapiens
cctgctgctggtgca

SEQ ID NO: 676620 - DNA, 17 bp, Homo sapiens
cctggaactcctggcct

SEQ ID NO: 676621 - DNA, 15 bp, Homo sapiens
cctggactgctacct

SEQ ID NO: 676622 - DNA, 14 bp, Homo sapiens
cctggagaaggaag

SEQ ID NO: 676623 - DNA, 20 bp, Homo sapiens
cctggagaaggaagctgcct

SEQ ID NO: 676624 - DNA, 17 bp, Homo sapiens
cctggagcagaggaggg

SEQ ID NO: 676625 - DNA, 23 bp, Homo sapiens
cctggagcagaggaggggaaagt

SEQ ID NO: 676626 - DNA, 15 bp, Homo sapiens
cctggattaccaggg

SEQ ID NO: 676627 - DNA, 13 bp, Homo sapiens
cctggcagacaca

SEQ ID NO: 676628 - DNA, 19 bp, Homo sapiens
cctggcagacacaacccaa

SEQ ID NO: 676629 - DNA, 14 bp, Homo sapiens
cctggcagggccac

SEQ ID NO: 676630 - DNA, 22 bp, Homo sapiens
cctggcccccaacctcagggct

SEQ ID NO: 676631 - DNA, 23 bp, Homo sapiens
cctggcccccaacctcagggctc

SEQ ID NO: 676632 - DNA, 20 bp, Homo sapiens
cctggccctgggggtctggg

SEQ ID NO: 676633 - DNA, 23 bp, Homo sapiens
cctggcctatccgctgccagcct

SEQ ID NO: 676634 - DNA, 12 bp, Homo sapiens
cctggcctggct

SEQ ID NO: 676635 - DNA, 14 bp, Homo sapiens
cctggcctggctgg

SEQ ID NO: 676636 - DNA, 17 bp, Homo sapiens
cctggcctggctgggtg

SEQ ID NO: 676637 - DNA, 22 bp, Homo sapiens
cctggccttgtcctcagccagt

SEQ ID NO: 676638 - DNA, 12 bp, Homo sapiens
cctggctccact

SEQ ID NO: 676639 - DNA, 21 bp, Homo sapiens
cctggctccactcttgatctc

SEQ ID NO: 676640 - DNA, 12 bp, Homo sapiens
cctggctccctc

SEQ ID NO: 676641 - DNA, 23 bp, Homo sapiens
cctggctccctcctccaggcctg

SEQ ID NO: 676642 - DNA, 21 bp, Homo sapiens
cctggctgttctgtggttcct

SEQ ID NO: 676643 - DNA, 14 bp, Homo sapiens
cctggctttgcctc

SEQ ID NO: 676644 - DNA, 15 bp, Homo sapiens
cctggctttgcctct

SEQ ID NO: 676645 - DNA, 16 bp, Homo sapiens
cctggctttgcctctt

SEQ ID NO: 676646 - DNA, 19 bp, Homo sapiens
cctgggaacacagttctgg

SEQ ID NO: 676647 - DNA, 17 bp, Homo sapiens
cctgggaacacatctgg

SEQ ID NO: 676648 - DNA, 15 bp, Homo sapiens
cctgggagccgcctg

SEQ ID NO: 676649 - DNA, 16 bp, Homo sapiens
cctgggccagggtctg

SEQ ID NO: 676650 - DNA, 18 bp, Homo sapiens
cctgggccgtggcacagc

SEQ ID NO: 676651 - DNA, 17 bp, Homo sapiens
cctgggctggttggaga

SEQ ID NO: 676652 - DNA, 14 bp, Homo sapiens
cctggggcctgaga

SEQ ID NO: 676653 - DNA, 17 bp, Homo sapiens
cctggggtgtcctacag

SEQ ID NO: 676654 - DNA, 23 bp, Homo sapiens
cctggggtgtcctacagtgactc

SEQ ID NO: 676655 - DNA, 18 bp, Homo sapiens
cctggggtgttagtggca

SEQ ID NO: 676656 - DNA, 18 bp, Homo sapiens
cctgggtactgaaagcct

SEQ ID NO: 676657 - DNA, 19 bp, Homo sapiens
cctgggtactgaggtgcta

SEQ ID NO: 676658 - DNA, 20 bp, Homo sapiens
cctgggtgtccccgctgctg

SEQ ID NO: 676659 - DNA, 14 bp, Homo sapiens
cctggtccccactg

SEQ ID NO: 676660 - DNA, 20 bp, Homo sapiens
cctggtgagtaacttagaaa

SEQ ID NO: 676661 - DNA, 18 bp, Homo sapiens
cctggttcagacacagct

SEQ ID NO: 676662 - DNA, 13 bp, Homo sapiens
cctggtttaattc

SEQ ID NO: 676663 - DNA, 19 bp, Homo sapiens
cctgtatatttgtaaagct

SEQ ID NO: 676664 - DNA, 20 bp, Homo sapiens
cctgtatatttgtaaagcta

SEQ ID NO: 676665 - DNA, 21 bp, Homo sapiens
cctgtatcctccctggcagac

SEQ ID NO: 676666 - DNA, 13 bp, Homo sapiens
ctgctccaggcct

SEQ ID NO: 676667 - DNA, 14 bp, Homo sapiens
ctgctccaggcctg

SEQ ID NO: 676668 - DNA, 19 bp, Homo sapiens
ctgctccaggcctgcagca

SEQ ID NO: 676669 - DNA, 14 bp, Homo sapiens
ctgctcccaggccc

SEQ ID NO: 676670 - DNA, 19 bp, Homo sapiens
ctgctcccaggccccaggc

SEQ ID NO: 676671 - DNA, 19 bp, Homo sapiens
ctgctcccctaaagcctca

SEQ ID NO: 676672 - DNA, 13 bp, Homo sapiens
ctgctcttttcct

SEQ ID NO: 676673 - DNA, 14 bp, Homo sapiens
ctgctcttttcctg

SEQ ID NO: 676674 - DNA, 14 bp, Homo sapiens
ctgctgaaactgcc

SEQ ID NO: 676675 - DNA, 18 bp, Homo sapiens
ctgctgaaactgcccact

SEQ ID NO: 676676 - DNA, 22 bp, Homo sapiens
ctgctgaaagactcgagaacca

SEQ ID NO: 676677 - DNA, 12 bp, Homo sapiens
ctgctgagctgg

SEQ ID NO: 676678 - DNA, 16 bp, Homo sapiens
ctgctgagttggcctg

SEQ ID NO: 676679 - DNA, 23 bp, Homo sapiens
ctgctgcagattagttctttttg

SEQ ID NO: 676680 - DNA, 13 bp, Homo sapiens
ctgctgcgctgct

SEQ ID NO: 676681 - DNA, 21 bp, Homo sapiens
ctgctggagatcagcatgcct

SEQ ID NO: 676682 - DNA, 15 bp, Homo sapiens
ctgctgtcataacat

SEQ ID NO: 676683 - DNA, 11 bp, Homo sapiens
ctgctgtgcaa

SEQ ID NO: 676684 - DNA, 23 bp, Homo sapiens
ctgcttaatcttcaaagccttct

SEQ ID NO: 676685 - DNA, 20 bp, Homo sapiens
ctgcttcccttactttgctg

SEQ ID NO: 676686 - DNA, 18 bp, Homo sapiens
ctgcttcttctctccaca

SEQ ID NO: 676687 - DNA, 14 bp, Homo sapiens
ctgctttgcatctt

SEQ ID NO: 676688 - DNA, 19 bp, Homo sapiens
ctggaaagcagagcctcct

SEQ ID NO: 676689 - DNA, 22 bp, Homo sapiens
ctggaaagcagagcctcctggg

SEQ ID NO: 676690 - DNA, 21 bp, Homo sapiens
ctggaagagccgagcacctgt

SEQ ID NO: 676691 - DNA, 23 bp, Homo sapiens
ctggaagtcatctcattccactg

SEQ ID NO: 676692 - DNA, 16 bp, Homo sapiens
ctggacccttataaaa

SEQ ID NO: 676693 - DNA, 18 bp, Homo sapiens
ctggacccttataaaatc

SEQ ID NO: 676694 - DNA, 20 bp, Homo sapiens
ctggactccgaggtggttca

SEQ ID NO: 676695 - DNA, 23 bp, Homo sapiens
ctggactgctattctagagcttt

SEQ ID NO: 676696 - DNA, 18 bp, Homo sapiens
ctggacttctacctgccc

SEQ ID NO: 676697 - DNA, 20 bp, Homo sapiens
ctggacttctacctgccctc

SEQ ID NO: 676698 - DNA, 20 bp, Homo sapiens
ctggagatcagcatgcctgt

SEQ ID NO: 676699 - DNA, 14 bp, Homo sapiens
ctggagcctggggt

SEQ ID NO: 676700 - DNA, 22 bp, Homo sapiens
ctggaggatcccctccaagcct

SEQ ID NO: 676701 - DNA, 22 bp, Homo sapiens
ctggaggcagtccatctaggga

SEQ ID NO: 676702 - DNA, 19 bp, Homo sapiens
ctggagtggtgttcagcca

SEQ ID NO: 676703 - DNA, 19 bp, Homo sapiens
ctggagttccttatccctc

SEQ ID NO: 676704 - DNA, 21 bp, Homo sapiens
ctggagttccttatccctctc

SEQ ID NO: 676705 - DNA, 24 bp, Homo sapiens
ctggagttccttatccctctcttc

SEQ ID NO: 676706 - DNA, 12 bp, Homo sapiens
ctggatgaaaga

SEQ ID NO: 676707 - DNA, 14 bp, Homo sapiens
ctggatgatatttt

SEQ ID NO: 676708 - DNA, 18 bp, Homo sapiens
ctggcaaagggagcagaa

SEQ ID NO: 676709 - DNA, 22 bp, Homo sapiens
ctggcaaagggagcagaactga

SEQ ID NO: 676710 - DNA, 18 bp, Homo sapiens
ctggcacgtgacaggctc

SEQ ID NO: 676711 - DNA, 19 bp, Homo sapiens
ctggcacgtgacaggctcg

SEQ ID NO: 676712 - DNA, 19 bp, Homo sapiens
ctggcactcttgttcccac

SEQ ID NO: 676713 - DNA, 22 bp, Homo sapiens
ctggcagacttgcccaggtcac

SEQ ID NO: 676714 - DNA, 17 bp, Homo sapiens
ctggcagggccacctgc

SEQ ID NO: 676715 - DNA, 19 bp, Homo sapiens
ctggcagggccacctgcag

SEQ ID NO: 676716 - DNA, 18 bp, Homo sapiens
ctggcatcttagacctcc

SEQ ID NO: 676717 - DNA, 17 bp, Homo sapiens
ctggccacacaggatct

SEQ ID NO: 676718 - DNA, 18 bp, Homo sapiens
ctggcccccaacctcagg

SEQ ID NO: 676719 - DNA, 19 bp, Homo sapiens
ctggcctatccgctgccag

SEQ ID NO: 676720 - DNA, 14 bp, Homo sapiens
ctggcgcaggtggg

SEQ ID NO: 676721 - DNA, 15 bp, Homo sapiens
ctggctcacagtaca

SEQ ID NO: 676722 - DNA, 16 bp, Homo sapiens
ctggctcacagtacag

SEQ ID NO: 676723 - DNA, 17 bp, Homo sapiens
ctggctcacagtacagc

SEQ ID NO: 676724 - DNA, 22 bp, Homo sapiens
ctggctcacagtacagcatgtg

SEQ ID NO: 676725 - DNA, 15 bp, Homo sapiens
ctggctccactcttg

SEQ ID NO: 676726 - DNA, 18 bp, Homo sapiens
ctggctccctcctccagg

SEQ ID NO: 676727 - DNA, 12 bp, Homo sapiens
ctggctgggtgg

SEQ ID NO: 676728 - DNA, 23 bp, Homo sapiens
ctggctgttctgtggttcctctg

SEQ ID NO: 676729 - DNA, 13 bp, Homo sapiens
ctggctttgcctc

SEQ ID NO: 676730 - DNA, 17 bp, Homo sapiens
ctggctttgcctcttct

SEQ ID NO: 676731 - DNA, 20 bp, Homo sapiens
ctggctttgcctcttctttg

SEQ ID NO: 676732 - DNA, 15 bp, Homo sapiens
ctggcttttgagcac

SEQ ID NO: 676733 - DNA, 17 bp, Homo sapiens
ctgggagccgcctgctt

SEQ ID NO: 676734 - DNA, 22 bp, Homo sapiens
ctgggatgacaggcgcctgcca

SEQ ID NO: 676735 - DNA, 19 bp, Homo sapiens
ctgggattaagaaaccttg

SEQ ID NO: 676736 - DNA, 18 bp, Homo sapiens
ctgggattattctttgaa

SEQ ID NO: 676737 - DNA, 14 bp, Homo sapiens
ctgggcagcagcat

SEQ ID NO: 676738 - DNA, 17 bp, Homo sapiens
ctgggccagggtctgtg

SEQ ID NO: 676739 - DNA, 19 bp, Homo sapiens
ctgggccagggtctgtgtg

SEQ ID NO: 676740 - DNA, 22 bp, Homo sapiens
ctgggccatgtccaaagaggct

SEQ ID NO: 676741 - DNA, 21 bp, Homo sapiens
ctgggcccgacatggctccgg

SEQ ID NO: 676742 - DNA, 13 bp, Homo sapiens
ctgggccctgagt

SEQ ID NO: 676743 - DNA, 17 bp, Homo sapiens
ctgggcgtccagctcag

SEQ ID NO: 676744 - DNA, 18 bp, Homo sapiens
ctgggcgtccagctcagc

SEQ ID NO: 676745 - DNA, 19 bp, Homo sapiens
ctgggctacagaaaccaca

SEQ ID NO: 676746 - DNA, 23 bp, Homo sapiens
ctgggctattgctgctgcccctt

SEQ ID NO: 676747 - DNA, 19 bp, Homo sapiens
ctgggctggttggagaagg

SEQ ID NO: 676748 - DNA, 19 bp, Homo sapiens
ctggggagtggttaggcag

SEQ ID NO: 676749 - DNA, 20 bp, Homo sapiens
ctggggagtggttaggcagc

SEQ ID NO: 676750 - DNA, 22 bp, Homo sapiens
ctggggcctagcgatctctcct

SEQ ID NO: 676751 - DNA, 14 bp, Homo sapiens
caaagatgcatcac

SEQ ID NO: 676752 - DNA, 19 bp, Homo sapiens
caaagatgtgttcaggcat

SEQ ID NO: 676753 - DNA, 21 bp, Homo sapiens
caaagatgtgttcaggcattc

SEQ ID NO: 676754 - DNA, 18 bp, Homo sapiens
caaagcacttaagtgtta

SEQ ID NO: 676755 - DNA, 14 bp, Homo sapiens
caaagccagggtct

SEQ ID NO: 676756 - DNA, 15 bp, Homo sapiens
caaagccagggtctc

SEQ ID NO: 676757 - DNA, 22 bp, Homo sapiens
caaagccagggtctctccctca

SEQ ID NO: 676758 - DNA, 20 bp, Homo sapiens
caaagcccaaactcctttct

SEQ ID NO: 676759 - DNA, 19 bp, Homo sapiens
caaagcttggagggaagcc

SEQ ID NO: 676760 - DNA, 18 bp, Homo sapiens
caaagctttcctgtttcc

SEQ ID NO: 676761 - DNA, 20 bp, Homo sapiens
caaaggagacgggggagcag

SEQ ID NO: 676762 - DNA, 17 bp, Homo sapiens
caaaggccccagcatct

SEQ ID NO: 676763 - DNA, 23 bp, Homo sapiens
caaaggcctaattctatgcctgt

SEQ ID NO: 676764 - DNA, 17 bp, Homo sapiens
caaagtatgcaatgctt

SEQ ID NO: 676765 - DNA, 24 bp, Homo sapiens
caaagtgatgggagaattggtata

SEQ ID NO: 676766 - DNA, 19 bp, Homo sapiens
caaagtgctgggattacag

SEQ ID NO: 676767 - DNA, 16 bp, Homo sapiens
caaataaaatatcata

SEQ ID NO: 676768 - DNA, 13 bp, Homo sapiens
caaataaagcctt

SEQ ID NO: 676769 - DNA, 14 bp, Homo sapiens
caaataaagccttt

SEQ ID NO: 676770 - DNA, 17 bp, Homo sapiens
caaataaagccttttaa

SEQ ID NO: 676771 - DNA, 14 bp, Homo sapiens
caaataagaaataa

SEQ ID NO: 676772 - DNA, 19 bp, Homo sapiens
caaataagtcatctgatga

SEQ ID NO: 676773 - DNA, 14 bp, Homo sapiens
caaatacacatttg

SEQ ID NO: 676774 - DNA, 16 bp, Homo sapiens
caaatacacatttgct

SEQ ID NO: 676775 - DNA, 17 bp, Homo sapiens
caaatacacatttgcta

SEQ ID NO: 676776 - DNA, 19 bp, Homo sapiens
caaatacatttaaaacatt

SEQ ID NO: 676777 - DNA, 15 bp, Homo sapiens
caaatacctcaattt

SEQ ID NO: 676778 - DNA, 16 bp, Homo sapiens
caaatacctcaatttt

SEQ ID NO: 676779 - DNA, 17 bp, Homo sapiens
caaatatacattttcta

SEQ ID NO: 676780 - DNA, 23 bp, Homo sapiens
caaatatttagatgtaattttgt

SEQ ID NO: 676781 - DNA, 18 bp, Homo sapiens
caaatcagtttgactact

SEQ ID NO: 676782 - DNA, 18 bp, Homo sapiens
caaatctaccactgtatg

SEQ ID NO: 676783 - DNA, 16 bp, Homo sapiens
caaatctcctgctgat

SEQ ID NO: 676784 - DNA, 20 bp, Homo sapiens
caaatctgggtatctttcca

SEQ ID NO: 676785 - DNA, 12 bp, Homo sapiens
caaatgaagaaa

SEQ ID NO: 676786 - DNA, 12 bp, Homo sapiens
caaatgcataaa

SEQ ID NO: 676787 - DNA, 14 bp, Homo sapiens
caaatggaggaata

SEQ ID NO: 676788 - DNA, 16 bp, Homo sapiens
caaatgtcattgtcta

SEQ ID NO: 676789 - DNA, 21 bp, Homo sapiens
caaattaaaacaaatatacat

SEQ ID NO: 676790 - DNA, 13 bp, Homo sapiens
caaattaatttta

SEQ ID NO: 676791 - DNA, 19 bp, Homo sapiens
caaattgtatcttattata

SEQ ID NO: 676792 - DNA, 18 bp, Homo sapiens
caaattgtgcagtacttt

SEQ ID NO: 676793 - DNA, 14 bp, Homo sapiens
caaatttaaaatgt

SEQ ID NO: 676794 - DNA, 18 bp, Homo sapiens
caaatttactttaaaaag

SEQ ID NO: 676795 - DNA, 11 bp, Homo sapiens
caaatttgatg

SEQ ID NO: 676796 - DNA, 13 bp, Homo sapiens
caaattttcaagt

SEQ ID NO: 676797 - DNA, 18 bp, Homo sapiens
caaattttcaagtttaca

SEQ ID NO: 676798 - DNA, 13 bp, Homo sapiens
caacaaaaaatac

SEQ ID NO: 676799 - DNA, 17 bp, Homo sapiens
caacaaaaaatacatta

SEQ ID NO: 676800 - DNA, 18 bp, Homo sapiens
caacaatgtgaggggtcc

SEQ ID NO: 676801 - DNA, 12 bp, Homo sapiens
caacagaagtgg

SEQ ID NO: 676802 - DNA, 16 bp, Homo sapiens
caacagccctgcctga

SEQ ID NO: 676803 - DNA, 11 bp, Homo sapiens
caacagttgta

SEQ ID NO: 676804 - DNA, 17 bp, Homo sapiens
caacatagtgagacact

SEQ ID NO: 676805 - DNA, 14 bp, Homo sapiens
caacatccactgtt

SEQ ID NO: 676806 - DNA, 15 bp, Homo sapiens
caacatgcactgatg

SEQ ID NO: 676807 - DNA, 12 bp, Homo sapiens
caacatggcttt

SEQ ID NO: 676808 - DNA, 13 bp, Homo sapiens
caacatttatgtg

SEQ ID NO: 676809 - DNA, 19 bp, Homo sapiens
caaccaggcacctcttcct

SEQ ID NO: 676810 - DNA, 15 bp, Homo sapiens
caacccattagccat

SEQ ID NO: 676811 - DNA, 22 bp, Homo sapiens
caaccctgggctattgctgctg

SEQ ID NO: 676812 - DNA, 14 bp, Homo sapiens
caaccgagaaggtt

SEQ ID NO: 676813 - DNA, 15 bp, Homo sapiens
caacctcagggctcc

SEQ ID NO: 676814 - DNA, 17 bp, Homo sapiens
caacctcagggctccca

SEQ ID NO: 676815 - DNA, 14 bp, Homo sapiens
caacctctgcctcc

SEQ ID NO: 676816 - DNA, 20 bp, Homo sapiens
caacctctgcctcccaggtt

SEQ ID NO: 676817 - DNA, 16 bp, Homo sapiens
caacgcctccccctcc

SEQ ID NO: 676818 - DNA, 18 bp, Homo sapiens
caactgccaggctgcctc

SEQ ID NO: 676819 - DNA, 21 bp, Homo sapiens
caactgccaggctgcctcctg

SEQ ID NO: 676820 - DNA, 16 bp, Homo sapiens
caactggagttcctta

SEQ ID NO: 676821 - DNA, 15 bp, Homo sapiens
caacttatttcataa

SEQ ID NO: 676822 - DNA, 17 bp, Homo sapiens
caacttatttcataatt

SEQ ID NO: 676823 - DNA, 22 bp, Homo sapiens
caactttgtaaaaatcttttga

SEQ ID NO: 676824 - DNA, 19 bp, Homo sapiens
caactttttccctcactaa

SEQ ID NO: 676825 - DNA, 12 bp, Homo sapiens
caagaaaatctt

SEQ ID NO: 676826 - DNA, 13 bp, Homo sapiens
caagaaaatcttt

SEQ ID NO: 676827 - DNA, 14 bp, Homo sapiens
caagaagtgattag

SEQ ID NO: 676828 - DNA, 18 bp, Homo sapiens
caagaatatcctttaaaa

SEQ ID NO: 676829 - DNA, 16 bp, Homo sapiens
caagacatttgctgaa

SEQ ID NO: 676830 - DNA, 20 bp, Homo sapiens
caagagaaaagaaaaatcaa

SEQ ID NO: 676831 - DNA, 20 bp, Homo sapiens
caagagagcgagaccctgtc

SEQ ID NO: 676832 - DNA, 16 bp, Homo sapiens
caagagataagtcttt

SEQ ID NO: 676833 - DNA, 16 bp, Homo sapiens
caagagatctacacat

SEQ ID NO: 676834 - DNA, 22 bp, Homo sapiens
caagaggccacttagggaaaga

SEQ ID NO: 676835 - DNA, 17 bp, Homo sapiens
caagatggacttacctg

SEQ ID NO: 676836 - DNA, 22 bp, Homo sapiens
caagcactatgcccttttatat

SEQ ID NO: 676837 - DNA, 22 bp, Homo sapiens
caagcagaggaccagggccttt

SEQ ID NO: 676838 - DNA, 17 bp, Homo sapiens
caagcatgcagctttgc

SEQ ID NO: 676839 - DNA, 21 bp, Homo sapiens
caagctgttatttcttccctg

SEQ ID NO: 676840 - DNA, 14 bp, Homo sapiens
caagcttttgctca

SEQ ID NO: 676841 - DNA, 14 bp, Homo sapiens
caaggaataaatga

SEQ ID NO: 676842 - DNA, 18 bp, Homo sapiens
caaggacggaaaatgctt

SEQ ID NO: 676843 - DNA, 16 bp, Homo sapiens
caaggagaggcaaaga

SEQ ID NO: 676844 - DNA, 23 bp, Homo sapiens
caaggctctgctatacagtctat

SEQ ID NO: 676845 - DNA, 18 bp, Homo sapiens
caagggaatgtaactgct

SEQ ID NO: 676846 - DNA, 22 bp, Homo sapiens
caaggtgggccttgctacctca

SEQ ID NO: 676847 - DNA, 14 bp, Homo sapiens
caagtaagaagaca

SEQ ID NO: 676848 - DNA, 20 bp, Homo sapiens
caagtcatagccataaatga

SEQ ID NO: 676849 - DNA, 14 bp, Homo sapiens
caagtcatttttgt

SEQ ID NO: 676850 - DNA, 16 bp, Homo sapiens
caagtcatttttgtat

SEQ ID NO: 676851 - DNA, 19 bp, Homo sapiens
caagtcatttttgtatttt

SEQ ID NO: 676852 - DNA, 13 bp, Homo sapiens
caagtgaaattat

SEQ ID NO: 676853 - DNA, 19 bp, Homo sapiens
caagtggaccttgagacca

SEQ ID NO: 676854 - DNA, 18 bp, Homo sapiens
caagtgttaggtcaataa

SEQ ID NO: 676855 - DNA, 13 bp, Homo sapiens
caagttcatttta

SEQ ID NO: 676856 - DNA, 12 bp, Homo sapiens
caagttgtaaat

SEQ ID NO: 676857 - DNA, 13 bp, Homo sapiens
caagtttacactt

SEQ ID NO: 676858 - DNA, 21 bp, Homo sapiens
caagttttcttccatgatttt

SEQ ID NO: 676859 - DNA, 14 bp, Homo sapiens
caataaaatttaaa

SEQ ID NO: 676860 - DNA, 16 bp, Homo sapiens
caataaacttcctttt

SEQ ID NO: 676861 - DNA, 22 bp, Homo sapiens
caataaaggcagctgcctctgc

SEQ ID NO: 676862 - DNA, 14 bp, Homo sapiens
caataaatctttca

SEQ ID NO: 676863 - DNA, 15 bp, Homo sapiens
caataaatctttcaa

SEQ ID NO: 676864 - DNA, 16 bp, Homo sapiens
caataacactgtattt

SEQ ID NO: 676865 - DNA, 21 bp, Homo sapiens
caatacagtattatagacaaa

SEQ ID NO: 676866 - DNA, 22 bp, Homo sapiens
caatagctagctatatatggta

SEQ ID NO: 676867 - DNA, 17 bp, Homo sapiens
caatatcagctttgata

SEQ ID NO: 676868 - DNA, 20 bp, Homo sapiens
caatatgtgagtgccttttg

SEQ ID NO: 676869 - DNA, 22 bp, Homo sapiens
caatatgtgagtgccttttgca

SEQ ID NO: 676870 - DNA, 16 bp, Homo sapiens
caatattgattgggaa

SEQ ID NO: 676871 - DNA, 20 bp, Homo sapiens
caatattgattgggaaaaca

SEQ ID NO: 676872 - DNA, 16 bp, Homo sapiens
caatcaccaccaggta

SEQ ID NO: 676873 - DNA, 15 bp, Homo sapiens
caatccgagcagtgg

SEQ ID NO: 676874 - DNA, 11 bp, Homo sapiens
ccacctgtggg

SEQ ID NO: 676875 - DNA, 13 bp, Homo sapiens
ccacgagggtctc

SEQ ID NO: 676876 - DNA, 21 bp, Homo sapiens
ccacggaggatccactcccag

SEQ ID NO: 676877 - DNA, 22 bp, Homo sapiens
ccacgggacatcacagggtggg

SEQ ID NO: 676878 - DNA, 22 bp, Homo sapiens
ccacgtcctccaagctcacgac

SEQ ID NO: 676879 - DNA, 11 bp, Homo sapiens
ccactcctccc

SEQ ID NO: 676880 - DNA, 14 bp, Homo sapiens
ccactcctccctcc

SEQ ID NO: 676881 - DNA, 17 bp, Homo sapiens
ccactcttgatctctct

SEQ ID NO: 676882 - DNA, 13 bp, Homo sapiens
ccactgctgagct

SEQ ID NO: 676883 - DNA, 21 bp, Homo sapiens
ccactgtatgatttataaaca

SEQ ID NO: 676884 - DNA, 13 bp, Homo sapiens
ccacttccagggg

SEQ ID NO: 676885 - DNA, 21 bp, Homo sapiens
ccacttccaggggaacctgcc

SEQ ID NO: 676886 - DNA, 15 bp, Homo sapiens
ccacttcccaccctg

SEQ ID NO: 676887 - DNA, 18 bp, Homo sapiens
ccactttcatctaccttt

SEQ ID NO: 676888 - DNA, 16 bp, Homo sapiens
ccactttgctgttcct

SEQ ID NO: 676889 - DNA, 17 bp, Homo sapiens
ccactttgctgttcctt

SEQ ID NO: 676890 - DNA, 15 bp, Homo sapiens
ccactttgtaatttt

SEQ ID NO: 676891 - DNA, 18 bp, Homo sapiens
ccagacctttgaggatat

SEQ ID NO: 676892 - DNA, 14 bp, Homo sapiens
ccagactctgtctc

SEQ ID NO: 676893 - DNA, 13 bp, Homo sapiens
ccagaggagacat

SEQ ID NO: 676894 - DNA, 16 bp, Homo sapiens
ccagagtcatgggaga

SEQ ID NO: 676895 - DNA, 16 bp, Homo sapiens
ccagatctttcagaaa

SEQ ID NO: 676896 - DNA, 20 bp, Homo sapiens
ccagcacactatttacaaga

SEQ ID NO: 676897 - DNA, 18 bp, Homo sapiens
ccagcaccttgtgcctgg

SEQ ID NO: 676898 - DNA, 13 bp, Homo sapiens
ccagcagaactga

SEQ ID NO: 676899 - DNA, 14 bp, Homo sapiens
ccagcagaactgaa

SEQ ID NO: 676900 - DNA, 21 bp, Homo sapiens
ccagcatatatacttgcaaga

SEQ ID NO: 676901 - DNA, 20 bp, Homo sapiens
ccagcatttagctggccaca

SEQ ID NO: 676902 - DNA, 20 bp, Homo sapiens
ccagcccacctgctcccagg

SEQ ID NO: 676903 - DNA, 18 bp, Homo sapiens
ccagcccatggcccccaa

SEQ ID NO: 676904 - DNA, 15 bp, Homo sapiens
ccagcccctcttccc

SEQ ID NO: 676905 - DNA, 15 bp, Homo sapiens
ccagcctcacttcct

SEQ ID NO: 676906 - DNA, 18 bp, Homo sapiens
ccagcctcacttcctttg

SEQ ID NO: 676907 - DNA, 11 bp, Homo sapiens
ccagcctccct

SEQ ID NO: 676908 - DNA, 19 bp, Homo sapiens
ccagcctcgttggaagagg

SEQ ID NO: 676909 - DNA, 17 bp, Homo sapiens
ccagccttctctcaagg

SEQ ID NO: 676910 - DNA, 19 bp, Homo sapiens
ccagccttgagccctggct

SEQ ID NO: 676911 - DNA, 20 bp, Homo sapiens
ccagctaatttttgtatttt

SEQ ID NO: 676912 - DNA, 19 bp, Homo sapiens
ccagctacttgggaggctg

SEQ ID NO: 676913 - DNA, 18 bp, Homo sapiens
ccagctgaggcaggggga

SEQ ID NO: 676914 - DNA, 13 bp, Homo sapiens
ccagctgagtgag

SEQ ID NO: 676915 - DNA, 17 bp, Homo sapiens
ccagctgcccttccgca

SEQ ID NO: 676916 - DNA, 20 bp, Homo sapiens
ccaggacatgcaataaaatt

SEQ ID NO: 676917 - DNA, 14 bp, Homo sapiens
ccaggagagcctgg

SEQ ID NO: 676918 - DNA, 21 bp, Homo sapiens
ccaggagcttcttcgttcctg

SEQ ID NO: 676919 - DNA, 16 bp, Homo sapiens
ccaggatttattttga

SEQ ID NO: 676920 - DNA, 16 bp, Homo sapiens
ccaggcacctcttcct

SEQ ID NO: 676921 - DNA, 17 bp, Homo sapiens
ccaggcagagaacagaa

SEQ ID NO: 676922 - DNA, 13 bp, Homo sapiens
ccaggcagggaga

SEQ ID NO: 676923 - DNA, 13 bp, Homo sapiens
ccaggcctgcagc

SEQ ID NO: 676924 - DNA, 16 bp, Homo sapiens
ccaggcctgtggctcc

SEQ ID NO: 676925 - DNA, 19 bp, Homo sapiens
ccaggcctgtggctccctt

SEQ ID NO: 676926 - DNA, 16 bp, Homo sapiens
ccaggctgcctcctgc

SEQ ID NO: 676927 - DNA, 18 bp, Homo sapiens
ccaggctggagtgcagtg

SEQ ID NO: 676928 - DNA, 18 bp, Homo sapiens
ccaggctttgtacagagt

SEQ ID NO: 676929 - DNA, 21 bp, Homo sapiens
ccagggaagctgtcctggagg

SEQ ID NO: 676930 - DNA, 15 bp, Homo sapiens
ccagggagctgatgt

SEQ ID NO: 676931 - DNA, 21 bp, Homo sapiens
ccagggcaccatccagctccc

SEQ ID NO: 676932 - DNA, 13 bp, Homo sapiens
ccagggcagcggc

SEQ ID NO: 676933 - DNA, 21 bp, Homo sapiens
ccagggccttttctggcaccg

SEQ ID NO: 676934 - DNA, 18 bp, Homo sapiens
ccagggctgccctgagaa

SEQ ID NO: 676935 - DNA, 12 bp, Homo sapiens
ccaggggaacct

SEQ ID NO: 676936 - DNA, 24 bp, Homo sapiens
ccaggggaacctgccatgccagga

SEQ ID NO: 676937 - DNA, 18 bp, Homo sapiens
ccagggggatgccactcc

SEQ ID NO: 676938 - DNA, 16 bp, Homo sapiens
ccaggggtctccctgg

SEQ ID NO: 676939 - DNA, 21 bp, Homo sapiens
ccaggggtctccctggctccc

SEQ ID NO: 676940 - DNA, 16 bp, Homo sapiens
ccagggtctgtgtgaa

SEQ ID NO: 676941 - DNA, 20 bp, Homo sapiens
ccagggtctgtgtgaatgtg

SEQ ID NO: 676942 - DNA, 22 bp, Homo sapiens
ccagggtctgtgtgaatgtggg

SEQ ID NO: 676943 - DNA, 14 bp, Homo sapiens
ccaggtatggctct

SEQ ID NO: 676944 - DNA, 20 bp, Homo sapiens
ccaggtcaccaagcagtggc

SEQ ID NO: 676945 - DNA, 15 bp, Homo sapiens
ccaggttccacagag

SEQ ID NO: 676946 - DNA, 15 bp, Homo sapiens
ccagtattgccccct

SEQ ID NO: 676947 - DNA, 22 bp, Homo sapiens
ccagtcccacactgtggccagg

SEQ ID NO: 676948 - DNA, 19 bp, Homo sapiens
ccagtgcatggtggccaga

SEQ ID NO: 676949 - DNA, 21 bp, Homo sapiens
ccagtggatgccacagcccag

SEQ ID NO: 676950 - DNA, 13 bp, Homo sapiens
ccagtggggcctg

SEQ ID NO: 676951 - DNA, 16 bp, Homo sapiens
ccagtggggcctgtgg

SEQ ID NO: 676952 - DNA, 22 bp, Homo sapiens
ccagtggggcctgtggaatgag

SEQ ID NO: 676953 - DNA, 21 bp, Homo sapiens
ccagtgtcagggtccaggaga

SEQ ID NO: 676954 - DNA, 15 bp, Homo sapiens
ccagtgtctgtctga

SEQ ID NO: 676955 - DNA, 12 bp, Homo sapiens
ccagttttccct

SEQ ID NO: 676956 - DNA, 15 bp, Homo sapiens
ccagttttccctgga

SEQ ID NO: 676957 - DNA, 16 bp, Homo sapiens
ccataggtttctctcc

SEQ ID NO: 676958 - DNA, 20 bp, Homo sapiens
ccataggtttctctccctcc

SEQ ID NO: 676959 - DNA, 16 bp, Homo sapiens
ccatattacctggatt

SEQ ID NO: 676960 - DNA, 19 bp, Homo sapiens
ccatcagtgaaagaaactg

SEQ ID NO: 676961 - DNA, 17 bp, Homo sapiens
ccatcagttccagcctt

SEQ ID NO: 676962 - DNA, 15 bp, Homo sapiens
ccatcatctctgaag

SEQ ID NO: 676963 - DNA, 12 bp, Homo sapiens
ccatcctgactg

SEQ ID NO: 676964 - DNA, 13 bp, Homo sapiens
ccatcctgactga

SEQ ID NO: 676965 - DNA, 13 bp, Homo sapiens
ccatcctgcagat

SEQ ID NO: 676966 - DNA, 17 bp, Homo sapiens
ccatcctggtcagctgc

SEQ ID NO: 676967 - DNA, 20 bp, Homo sapiens
ccatctagggaatgggactg

SEQ ID NO: 676968 - DNA, 17 bp, Homo sapiens
ccatctagtacttgaaa

SEQ ID NO: 676969 - DNA, 13 bp, Homo sapiens
ccatctccctgcc

SEQ ID NO: 676970 - DNA, 12 bp, Homo sapiens
ccatctctctct

SEQ ID NO: 676971 - DNA, 18 bp, Homo sapiens
ccatctctctcttgcctg

SEQ ID NO: 676972 - DNA, 21 bp, Homo sapiens
ccatctcttctgcaagcctca

SEQ ID NO: 676973 - DNA, 17 bp, Homo sapiens
ccatgaggaaggaacag

SEQ ID NO: 676974 - DNA, 15 bp, Homo sapiens
ccatgatttagcaag

SEQ ID NO: 676975 - DNA, 17 bp, Homo sapiens
ccatgcaagcagaggac

SEQ ID NO: 676976 - DNA, 19 bp, Homo sapiens
ccatgcaagcagaggacca

SEQ ID NO: 676977 - DNA, 20 bp, Homo sapiens
ccatgctccttgagaggaga

SEQ ID NO: 676978 - DNA, 17 bp, Homo sapiens
ccatggcccccaataaa

SEQ ID NO: 676979 - DNA, 21 bp, Homo sapiens
ccatggcccccaataaaggca

SEQ ID NO: 676980 - DNA, 22 bp, Homo sapiens
ccatggcccccaataaaggcag

SEQ ID NO: 676981 - DNA, 16 bp, Homo sapiens
ccatggctcagggtgg

SEQ ID NO: 676982 - DNA, 17 bp, Homo sapiens
ccatggctcagggtggt

SEQ ID NO: 676983 - DNA, 12 bp, Homo sapiens
cctgtccctttt

SEQ ID NO: 676984 - DNA, 14 bp, Homo sapiens
cctgtcccttttcc

SEQ ID NO: 676985 - DNA, 21 bp, Homo sapiens
cctgtcctaaggaaccttcct

SEQ ID NO: 676986 - DNA, 12 bp, Homo sapiens
cctgtcctgcag

SEQ ID NO: 676987 - DNA, 17 bp, Homo sapiens
cctgtctgactactttg

SEQ ID NO: 676988 - DNA, 16 bp, Homo sapiens
cctgtgatatgtctgc

SEQ ID NO: 676989 - DNA, 18 bp, Homo sapiens
cctgtgatgttttatcct

SEQ ID NO: 676990 - DNA, 18 bp, Homo sapiens
cctgtgcccgactgactg

SEQ ID NO: 676991 - DNA, 20 bp, Homo sapiens
cctgtgcccgactgactgga

SEQ ID NO: 676992 - DNA, 21 bp, Homo sapiens
cctgtgctagaagctccatgg

SEQ ID NO: 676993 - DNA, 21 bp, Homo sapiens
cctgtggctcccttggtgccc

SEQ ID NO: 676994 - DNA, 17 bp, Homo sapiens
cctgtgggtgtagccag

SEQ ID NO: 676995 - DNA, 18 bp, Homo sapiens
cctgtgggtgtagccagg

SEQ ID NO: 676996 - DNA, 23 bp, Homo sapiens
cctgtgggtgtagccaggtatgg

SEQ ID NO: 676997 - DNA, 10 bp, Homo sapiens
cctgtgtgca

SEQ ID NO: 676998 - DNA, 14 bp, Homo sapiens
cctgttagctttcc

SEQ ID NO: 676999 - DNA, 17 bp, Homo sapiens
cctgttctgaaatgttc

SEQ ID NO: 677000 - DNA, 13 bp, Homo sapiens
cctgtttctctgc

SEQ ID NO: 677001 - DNA, 14 bp, Homo sapiens
cctgtttctggcac

SEQ ID NO: 677002 - DNA, 17 bp, Homo sapiens
ccttaaacacaggctgt

SEQ ID NO: 677003 - DNA, 14 bp, Homo sapiens
ccttaacccacctc

SEQ ID NO: 677004 - DNA, 14 bp, Homo sapiens
ccttaatctaatct

SEQ ID NO: 677005 - DNA, 19 bp, Homo sapiens
ccttaatctaatctaaaag

SEQ ID NO: 677006 - DNA, 11 bp, Homo sapiens
ccttaatttag

SEQ ID NO: 677007 - DNA, 23 bp, Homo sapiens
ccttaatttagaaactgaaaaat

SEQ ID NO: 677008 - DNA, 12 bp, Homo sapiens
ccttacatctgg

SEQ ID NO: 677009 - DNA, 19 bp, Homo sapiens
ccttaccataccactttga

SEQ ID NO: 677010 - DNA, 12 bp, Homo sapiens
ccttataaaatc

SEQ ID NO: 677011 - DNA, 17 bp, Homo sapiens
ccttatccctctcttcc

SEQ ID NO: 677012 - DNA, 19 bp, Homo sapiens
ccttatttatttttgtgta

SEQ ID NO: 677013 - DNA, 14 bp, Homo sapiens
ccttatttgccttc

SEQ ID NO: 677014 - DNA, 15 bp, Homo sapiens
ccttatttgccttct

SEQ ID NO: 677015 - DNA, 19 bp, Homo sapiens
ccttatttgccttctactc

SEQ ID NO: 677016 - DNA, 20 bp, Homo sapiens
ccttcagtgaactaagtccc

SEQ ID NO: 677017 - DNA, 18 bp, Homo sapiens
ccttccaatgcttctgtt

SEQ ID NO: 677018 - DNA, 14 bp, Homo sapiens
ccttcccatttctt

SEQ ID NO: 677019 - DNA, 15 bp, Homo sapiens
ccttcccatttcttc

SEQ ID NO: 677020 - DNA, 18 bp, Homo sapiens
ccttcccatttcttccca

SEQ ID NO: 677021 - DNA, 18 bp, Homo sapiens
ccttccgcagtgtggcca

SEQ ID NO: 677022 - DNA, 13 bp, Homo sapiens
ccttcctcctgcc

SEQ ID NO: 677023 - DNA, 12 bp, Homo sapiens
ccttcctcctta

SEQ ID NO: 677024 - DNA, 11 bp, Homo sapiens
ccttctgctga

SEQ ID NO: 677025 - DNA, 14 bp, Homo sapiens
ccttgaaaaatgac

SEQ ID NO: 677026 - DNA, 15 bp, Homo sapiens
ccttgaaaaatgaca

SEQ ID NO: 677027 - DNA, 14 bp, Homo sapiens
ccttgagccctggc

SEQ ID NO: 677028 - DNA, 18 bp, Homo sapiens
ccttgcccccagtgcctc

SEQ ID NO: 677029 - DNA, 17 bp, Homo sapiens
ccttgctacctcaaggg

SEQ ID NO: 677030 - DNA, 14 bp, Homo sapiens
ccttgctctcctca

SEQ ID NO: 677031 - DNA, 15 bp, Homo sapiens
ccttgctctcctcat

SEQ ID NO: 677032 - DNA, 13 bp, Homo sapiens
ccttggagccccg

SEQ ID NO: 677033 - DNA, 20 bp, Homo sapiens
ccttggctgacatgaagctg

SEQ ID NO: 677034 - DNA, 19 bp, Homo sapiens
ccttgtcagggtctccttc

SEQ ID NO: 677035 - DNA, 22 bp, Homo sapiens
ccttgtcagggtctccttcctt

SEQ ID NO: 677036 - DNA, 15 bp, Homo sapiens
cctttaaaaaagaaa

SEQ ID NO: 677037 - DNA, 15 bp, Homo sapiens
cctttaggatctcag

SEQ ID NO: 677038 - DNA, 21 bp, Homo sapiens
cctttcaaagcacttaagtgt

SEQ ID NO: 677039 - DNA, 18 bp, Homo sapiens
cctttccagagcaaccag

SEQ ID NO: 677040 - DNA, 17 bp, Homo sapiens
cctttcctctcctgggt

SEQ ID NO: 677041 - DNA, 12 bp, Homo sapiens
cctttctttgcc

SEQ ID NO: 677042 - DNA, 15 bp, Homo sapiens
cctttctttgcctct

SEQ ID NO: 677043 - DNA, 18 bp, Homo sapiens
cctttctttgcctctgca

SEQ ID NO: 677044 - DNA, 14 bp, Homo sapiens
cctttgctatgtaa

SEQ ID NO: 677045 - DNA, 14 bp, Homo sapiens
cctttggagaccat

SEQ ID NO: 677046 - DNA, 15 bp, Homo sapiens
cctttggagatgctg

SEQ ID NO: 677047 - DNA, 21 bp, Homo sapiens
cctttggcctggggtgcatct

SEQ ID NO: 677048 - DNA, 22 bp, Homo sapiens
cctttggcctggggtgcatctc

SEQ ID NO: 677049 - DNA, 14 bp, Homo sapiens
ccttttcctttttt

SEQ ID NO: 677050 - DNA, 11 bp, Homo sapiens
ccttttgctct

SEQ ID NO: 677051 - DNA, 14 bp, Homo sapiens
ccttttgctctctg

SEQ ID NO: 677052 - DNA, 19 bp, Homo sapiens
ccttttgctctctgtgacc

SEQ ID NO: 677053 - DNA, 11 bp, Homo sapiens
ccttttggaac

SEQ ID NO: 677054 - DNA, 18 bp, Homo sapiens
cctttttggcctgtgatg

SEQ ID NO: 677055 - DNA, 19 bp, Homo sapiens
cctttttggcctgtgatgt

SEQ ID NO: 677056 - DNA, 18 bp, Homo sapiens
cgaagaccctcttgccca

SEQ ID NO: 677057 - DNA, 14 bp, Homo sapiens
cgaaggcataataa

SEQ ID NO: 677058 - DNA, 16 bp, Homo sapiens
cgaagtctgctgctgt

SEQ ID NO: 677059 - DNA, 14 bp, Homo sapiens
cgaccacttccagg

SEQ ID NO: 677060 - DNA, 17 bp, Homo sapiens
cgaccctgggggcacag

SEQ ID NO: 677061 - DNA, 18 bp, Homo sapiens
cgagactttctcctggcc

SEQ ID NO: 677062 - DNA, 18 bp, Homo sapiens
cgagaggtgagctacttt

SEQ ID NO: 677063 - DNA, 22 bp, Homo sapiens
cgagaggtgagctactttgtga

SEQ ID NO: 677064 - DNA, 15 bp, Homo sapiens
cgagcctccagtcca

SEQ ID NO: 677065 - DNA, 22 bp, Homo sapiens
cgaggggcctttgttctggggg

SEQ ID NO: 677066 - DNA, 17 bp, Homo sapiens
cgatacctggagcagag

SEQ ID NO: 677067 - DNA, 16 bp, Homo sapiens
cgatctctcctggcct

SEQ ID NO: 677068 - DNA, 17 bp, Homo sapiens
cgatgttattagatgtt

SEQ ID NO: 677069 - DNA, 19 bp, Homo sapiens
cgcatcttgcctccaggtg

SEQ ID NO: 677070 - DNA, 21 bp, Homo sapiens
cgcccagcctcacttcctttg

SEQ ID NO: 677071 - DNA, 22 bp, Homo sapiens
cgcccttccatgtgcctttctt

SEQ ID NO: 677072 - DNA, 20 bp, Homo sapiens
cgcctaaggtcacagctagt

SEQ ID NO: 677073 - DNA, 17 bp, Homo sapiens
cgcctccccacctccag

SEQ ID NO: 677074 - DNA, 18 bp, Homo sapiens
cgcctccccacctccagg

SEQ ID NO: 677075 - DNA, 11 bp, Homo sapiens
cgcctcctcct

SEQ ID NO: 677076 - DNA, 12 bp, Homo sapiens
cgcctgcctgca

SEQ ID NO: 677077 - DNA, 15 bp, Homo sapiens
cgcctgcctgcagca

SEQ ID NO: 677078 - DNA, 18 bp, Homo sapiens
cgcctgcctgcagcaggc

SEQ ID NO: 677079 - DNA, 13 bp, Homo sapiens
cgcggtggctcac

SEQ ID NO: 677080 - DNA, 14 bp, Homo sapiens
cgcgtctgcctggg

SEQ ID NO: 677081 - DNA, 12 bp, Homo sapiens
cgctacctccct

SEQ ID NO: 677082 - DNA, 17 bp, Homo sapiens
cgctacctctctgtccc

SEQ ID NO: 677083 - DNA, 20 bp, Homo sapiens
cgctactatgatttaatttg

SEQ ID NO: 677084 - DNA, 12 bp, Homo sapiens
cgctagaagtct

SEQ ID NO: 677085 - DNA, 16 bp, Homo sapiens
cgcttcgggaaaatat

SEQ ID NO: 677086 - DNA, 19 bp, Homo sapiens
cggaaactagtgtacattt

SEQ ID NO: 677087 - DNA, 19 bp, Homo sapiens
cggaaagtttttagaatgt

SEQ ID NO: 677088 - DNA, 13 bp, Homo sapiens
cggaatatatttt

SEQ ID NO: 677089 - DNA, 16 bp, Homo sapiens
cggaggcctcgagcag

SEQ ID NO: 677090 - DNA, 21 bp, Homo sapiens
cggaggcctgcgaccctgggg

SEQ ID NO: 677091 - DNA, 16 bp, Homo sapiens
cggcacacactgtgcc

SEQ ID NO: 677092 - DNA, 18 bp, Homo sapiens
cggcatgagactcagtgc

SEQ ID NO: 677093 - DNA, 23 bp, Homo sapiens
cggcatgagactcagtgcagatg

SEQ ID NO: 677094 - DNA, 13 bp, Homo sapiens
cggccaagaatgt

SEQ ID NO: 677095 - DNA, 12 bp, Homo sapiens
cggccctaaggg

SEQ ID NO: 677096 - DNA, 18 bp, Homo sapiens
cggccctcatctatgagg

SEQ ID NO: 677097 - DNA, 17 bp, Homo sapiens
cggcctctgcctttgca

SEQ ID NO: 677098 - DNA, 13 bp, Homo sapiens
cggtttccaggga

SEQ ID NO: 677099 - DNA, 13 bp, Homo sapiens
cggtttttattaa

SEQ ID NO: 677100 - DNA, 13 bp, Homo sapiens
cgtagctctctta

SEQ ID NO: 677101 - DNA, 13 bp, Homo sapiens
cgtatttctcata

SEQ ID NO: 677102 - DNA, 12 bp, Homo sapiens
cgtcaagacatt

SEQ ID NO: 677103 - DNA, 13 bp, Homo sapiens
cgtcaagacattt

SEQ ID NO: 677104 - DNA, 16 bp, Homo sapiens
cgtcaagacatttgct

SEQ ID NO: 677105 - DNA, 17 bp, Homo sapiens
cgtccagctcagccctg

SEQ ID NO: 677106 - DNA, 16 bp, Homo sapiens
cgtccagctgcccttc

SEQ ID NO: 677107 - DNA, 17 bp, Homo sapiens
cgtccagctgcccttcc

SEQ ID NO: 677108 - DNA, 14 bp, Homo sapiens
cgtctgaggcctgc

SEQ ID NO: 677109 - DNA, 11 bp, Homo sapiens
cgtgaacaaac

SEQ ID NO: 677110 - DNA, 22 bp, Homo sapiens
cgtgaactctggtgctcctgca

SEQ ID NO: 677111 - DNA, 13 bp, Homo sapiens
cgtgacaggctcg

SEQ ID NO: 677112 - DNA, 17 bp, Homo sapiens
cgtgcatgctctgcagc

SEQ ID NO: 677113 - DNA, 19 bp, Homo sapiens
cgtgctccgtagctctgct

SEQ ID NO: 677114 - DNA, 22 bp, Homo sapiens
cgtgctccgtagctctgctgct

SEQ ID NO: 677115 - DNA, 16 bp, Homo sapiens
cgtggagggaggcccc

SEQ ID NO: 677116 - DNA, 14 bp, Homo sapiens
cgtggcacagctgg

SEQ ID NO: 677117 - DNA, 17 bp, Homo sapiens
cgtggggtaacatctgt

SEQ ID NO: 677118 - DNA, 17 bp, Homo sapiens
cgtggtcatgaatagaa

SEQ ID NO: 677119 - DNA, 20 bp, Homo sapiens
cgtgtcttaggctgatgcca

SEQ ID NO: 677120 - DNA, 20 bp, Homo sapiens
cgtgtgagtgtgacagggcc

SEQ ID NO: 677121 - DNA, 21 bp, Homo sapiens
cgttaaaaacagatttggaaa

SEQ ID NO: 677122 - DNA, 19 bp, Homo sapiens
cgttctgccttccttgtta

SEQ ID NO: 677123 - DNA, 17 bp, Homo sapiens
cgttgcacagctgtttg

SEQ ID NO: 677124 - DNA, 16 bp, Homo sapiens
cgtttacactgcacat

SEQ ID NO: 677125 - DNA, 18 bp, Homo sapiens
cgtttataaacagaaatg

SEQ ID NO: 677126 - DNA, 17 bp, Homo sapiens
cgtttctccttttccta

SEQ ID NO: 677127 - DNA, 11 bp, Homo sapiens
ctaaaaacata

SEQ ID NO: 677128 - DNA, 23 bp, Homo sapiens
ctaaaatagttagatctttgtaa

SEQ ID NO: 677129 - DNA, 18 bp, Homo sapiens
ctaaagagagaatgtaga

SEQ ID NO: 677130 - DNA, 16 bp, Homo sapiens
ctaaagcctcaaaaca

SEQ ID NO: 677131 - DNA, 17 bp, Homo sapiens
ctaaaggtgtatttaaa

SEQ ID NO: 677132 - DNA, 12 bp, Homo sapiens
ctaaataaatgg

SEQ ID NO: 677133 - DNA, 22 bp, Homo sapiens
ctaaatgcatatcctgagccat

SEQ ID NO: 677134 - DNA, 19 bp, Homo sapiens
ctaaatgctgttcttacac

SEQ ID NO: 677135 - DNA, 20 bp, Homo sapiens
ctaaatttgtgctttttaag

SEQ ID NO: 677136 - DNA, 23 bp, Homo sapiens
ctaacacggtgctcattttttct

SEQ ID NO: 677137 - DNA, 20 bp, Homo sapiens
ctaacactggcatgttcaaa

SEQ ID NO: 677138 - DNA, 20 bp, Homo sapiens
ctaacagtgaagttttactg

SEQ ID NO: 677139 - DNA, 14 bp, Homo sapiens
ctaacattgtgact

SEQ ID NO: 677140 - DNA, 19 bp, Homo sapiens
ctaacttttcaatgacatt

SEQ ID NO: 677141 - DNA, 13 bp, Homo sapiens
ctaagaaaatgta

SEQ ID NO: 677142 - DNA, 12 bp, Homo sapiens
ctaagaagacat

SEQ ID NO: 677143 - DNA, 13 bp, Homo sapiens
ctaagaagacatt

SEQ ID NO: 677144 - DNA, 20 bp, Homo sapiens
ctaagaagacattttgttac

SEQ ID NO: 677145 - DNA, 22 bp, Homo sapiens
ctaagactatatatataaatgt

SEQ ID NO: 677146 - DNA, 15 bp, Homo sapiens
ctaaggaaccttcct

SEQ ID NO: 677147 - DNA, 19 bp, Homo sapiens
ctaaggcaggaggatcact

SEQ ID NO: 677148 - DNA, 22 bp, Homo sapiens
ctaaggcaggtgggcagacagt

SEQ ID NO: 677149 - DNA, 19 bp, Homo sapiens
ctaagggtgggtgctcaga

SEQ ID NO: 677150 - DNA, 17 bp, Homo sapiens
ctaaggtggattttcat

SEQ ID NO: 677151 - DNA, 14 bp, Homo sapiens
ctaagtggctgcct

SEQ ID NO: 677152 - DNA, 22 bp, Homo sapiens
ctaagtggctgccttctttcca

SEQ ID NO: 677153 - DNA, 14 bp, Homo sapiens
ctaagttcacatta

SEQ ID NO: 677154 - DNA, 21 bp, Homo sapiens
ctaataaatataatttataag

SEQ ID NO: 677155 - DNA, 23 bp, Homo sapiens
ctaataaatataatttataagca

SEQ ID NO: 677156 - DNA, 17 bp, Homo sapiens
ctaataacatgtgaaaa

SEQ ID NO: 677157 - DNA, 19 bp, Homo sapiens
ctaatcaaagccagggtct

SEQ ID NO: 677158 - DNA, 12 bp, Homo sapiens
ctaatccttttc

SEQ ID NO: 677159 - DNA, 22 bp, Homo sapiens
ctaatccttttccttatttgcc

SEQ ID NO: 677160 - DNA, 12 bp, Homo sapiens
ctaatgatgttt

SEQ ID NO: 677161 - DNA, 18 bp, Homo sapiens
ctaatgtttatgagccag

SEQ ID NO: 677162 - DNA, 15 bp, Homo sapiens
ctaattctatgcctg

SEQ ID NO: 677163 - DNA, 19 bp, Homo sapiens
ctaattggaaggagagggg

SEQ ID NO: 677164 - DNA, 15 bp, Homo sapiens
ctaattggtactttt

SEQ ID NO: 677165 - DNA, 19 bp, Homo sapiens
ctaattggtacttttaaaa

SEQ ID NO: 677166 - DNA, 16 bp, Homo sapiens
ctaattgtaagtgaaa

SEQ ID NO: 677167 - DNA, 20 bp, Homo sapiens
ctaatttatattatccatag

SEQ ID NO: 677168 - DNA, 15 bp, Homo sapiens
ctaatttttgtattt

SEQ ID NO: 677169 - DNA, 13 bp, Homo sapiens
ctacaagggaagc

SEQ ID NO: 677170 - DNA, 22 bp, Homo sapiens
ctacaattaatagtttgtctat

SEQ ID NO: 677171 - DNA, 15 bp, Homo sapiens
ctacacaatacagta

SEQ ID NO: 677172 - DNA, 22 bp, Homo sapiens
ctacacactgtcatgcttcatc

SEQ ID NO: 677173 - DNA, 20 bp, Homo sapiens
ctacagaaaccacagtcttc

SEQ ID NO: 677174 - DNA, 21 bp, Homo sapiens
ctacagaaaccacagtcttcc

SEQ ID NO: 677175 - DNA, 18 bp, Homo sapiens
ctacagtgactccctggg

SEQ ID NO: 677176 - DNA, 11 bp, Homo sapiens
ctacagtgcca

SEQ ID NO: 677177 - DNA, 20 bp, Homo sapiens
ctacagtgccaactcctcac

SEQ ID NO: 677178 - DNA, 13 bp, Homo sapiens
ctacatgtgagtg

SEQ ID NO: 677179 - DNA, 13 bp, Homo sapiens
ctacctcagcctc

SEQ ID NO: 677180 - DNA, 14 bp, Homo sapiens
ctacctctctgtcc

SEQ ID NO: 677181 - DNA, 14 bp, Homo sapiens
ctacctgccttgga

SEQ ID NO: 677182 - DNA, 16 bp, Homo sapiens
ctaccttgggggaacc

SEQ ID NO: 677183 - DNA, 21 bp, Homo sapiens
ctactaaggggcttgtgttct

SEQ ID NO: 677184 - DNA, 17 bp, Homo sapiens
ctactacctgtaatgac

SEQ ID NO: 677185 - DNA, 14 bp, Homo sapiens
ctactcctagaaga

SEQ ID NO: 677186 - DNA, 17 bp, Homo sapiens
ctactgcactccagcct

SEQ ID NO: 677187 - DNA, 20 bp, Homo sapiens
ctactgcactccagcctggg

SEQ ID NO: 677188 - DNA, 20 bp, Homo sapiens
ctacttgggaggctgaggca

SEQ ID NO: 677189 - DNA, 20 bp, Homo sapiens
ctacttggggacataatttc

SEQ ID NO: 677190 - DNA, 22 bp, Homo sapiens
ctacttggggacataatttcag

SEQ ID NO: 677191 - DNA, 12 bp, Homo sapiens
ctagaaaaataa

SEQ ID NO: 677192 - DNA, 20 bp, Homo sapiens
ctagaagaaccaaatacctc

SEQ ID NO: 677193 - DNA, 22 bp, Homo sapiens
ctagaagaaccaaatacctcaa

SEQ ID NO: 677194 - DNA, 18 bp, Homo sapiens
ctagaagcctaagaactg

SEQ ID NO: 677195 - DNA, 16 bp, Homo sapiens
ctagaagctccatgga

SEQ ID NO: 677196 - DNA, 19 bp, Homo sapiens
ctagaatgtaaagttatgt

SEQ ID NO: 677197 - DNA, 23 bp, Homo sapiens
ctagacagttagagactctgtca

SEQ ID NO: 677198 - DNA, 18 bp, Homo sapiens
ctagagaaatcagctgct

SEQ ID NO: 677199 - DNA, 18 bp, Homo sapiens
ctagagccctctcctccc

SEQ ID NO: 677200 - DNA, 20 bp, Homo sapiens
ctagagccctctcctccctc

SEQ ID NO: 677201 - DNA, 22 bp, Homo sapiens
ctagaggcttgcataataagct

SEQ ID NO: 677202 - DNA, 17 bp, Homo sapiens
ctagcagtccccagctg

SEQ ID NO: 677203 - DNA, 19 bp, Homo sapiens
ctagcatttcccaacacaa

SEQ ID NO: 677204 - DNA, 15 bp, Homo sapiens
ctagctaaataaatg

SEQ ID NO: 677205 - DNA, 14 bp, Homo sapiens
ctagctcgtgattg

SEQ ID NO: 677206 - DNA, 19 bp, Homo sapiens
ctaggaggctgtgggtttt

SEQ ID NO: 677207 - DNA, 11 bp, Homo sapiens
ctaggtatcat

SEQ ID NO: 677208 - DNA, 12 bp, Homo sapiens
ctaggtctccag

SEQ ID NO: 677209 - DNA, 13 bp, Homo sapiens
ctaggtctccagt

SEQ ID NO: 677210 - DNA, 16 bp, Homo sapiens
ctagtacttgaaaaag

SEQ ID NO: 677211 - DNA, 18 bp, Homo sapiens
ctagtaggaatgtacatg

SEQ ID NO: 677212 - DNA, 14 bp, Homo sapiens
ctagtagtgtggcc

SEQ ID NO: 677213 - DNA, 15 bp, Homo sapiens
ctagtagtgtggcct

SEQ ID NO: 677214 - DNA, 20 bp, Homo sapiens
ctagtcagaaaattggcagt

SEQ ID NO: 677215 - DNA, 21 bp, Homo sapiens
ctagtgtacctcctctcagtg

SEQ ID NO: 677216 - DNA, 21 bp, Homo sapiens
ctagtgtttctagctaaataa

SEQ ID NO: 677217 - DNA, 13 bp, Homo sapiens
ctataaaatagat

SEQ ID NO: 677218 - DNA, 21 bp, Homo sapiens
ctatagcttgcagaactgtag

SEQ ID NO: 677219 - DNA, 18 bp, Homo sapiens
ctatatatataaatgtat

SEQ ID NO: 677220 - DNA, 13 bp, Homo sapiens
ctatatatataat

SEQ ID NO: 677221 - DNA, 13 bp, Homo sapiens
aaaaaatactatt

SEQ ID NO: 677222 - DNA, 16 bp, Homo sapiens
aaaaacattttgaagt

SEQ ID NO: 677223 - DNA, 14 bp, Homo sapiens
aaaaactcttcagt

SEQ ID NO: 677224 - DNA, 15 bp, Homo sapiens
aaaaactgatttgct

SEQ ID NO: 677225 - DNA, 20 bp, Homo sapiens
aaaaagacttgagacaatgt

SEQ ID NO: 677226 - DNA, 21 bp, Homo sapiens
aaaaagcagctaccaggtgtt

SEQ ID NO: 677227 - DNA, 17 bp, Homo sapiens
aaaaagctcactgctga

SEQ ID NO: 677228 - DNA, 18 bp, Homo sapiens
aaaaagctcactgctgat

SEQ ID NO: 677229 - DNA, 11 bp, Homo sapiens
aaaaaggaagg

SEQ ID NO: 677230 - DNA, 13 bp, Homo sapiens
aaaaataatacaa

SEQ ID NO: 677231 - DNA, 18 bp, Homo sapiens
aaaaatactatttaagat

SEQ ID NO: 677232 - DNA, 12 bp, Homo sapiens
aaaaatataatg

SEQ ID NO: 677233 - DNA, 18 bp, Homo sapiens
aaaaatcagaacaaaact

SEQ ID NO: 677234 - DNA, 17 bp, Homo sapiens
aaaaatgcattgaacat

SEQ ID NO: 677235 - DNA, 20 bp, Homo sapiens
aaaaatgggagacagcctct

SEQ ID NO: 677236 - DNA, 17 bp, Homo sapiens
actcacctaatgtttat

SEQ ID NO: 677237 - DNA, 20 bp, Homo sapiens
actcacctaatgtttatgag

SEQ ID NO: 677238 - DNA, 20 bp, Homo sapiens
actcactctttagatattta

SEQ ID NO: 677239 - DNA, 22 bp, Homo sapiens
actcactctttagatatttaca

SEQ ID NO: 677240 - DNA, 17 bp, Homo sapiens
actcagaattattttta

SEQ ID NO: 677241 - DNA, 22 bp, Homo sapiens
actcagagaaaaatgctcccca

SEQ ID NO: 677242 - DNA, 12 bp, Homo sapiens
actcagtgcaga

SEQ ID NO: 677243 - DNA, 14 bp, Homo sapiens
actcatcctctttt

SEQ ID NO: 677244 - DNA, 22 bp, Homo sapiens
actcatcttagtgcctgagagt

SEQ ID NO: 677245 - DNA, 18 bp, Homo sapiens
actccagccagggcaaga

SEQ ID NO: 677246 - DNA, 21 bp, Homo sapiens
actccagccagggcaagagag

SEQ ID NO: 677247 - DNA, 18 bp, Homo sapiens
actccaggccctcctctc

SEQ ID NO: 677248 - DNA, 16 bp, Homo sapiens
actccatctctcatcc

SEQ ID NO: 677249 - DNA, 13 bp, Homo sapiens
actccatctcttc

SEQ ID NO: 677250 - DNA, 14 bp, Homo sapiens
actccatctcttct

SEQ ID NO: 677251 - DNA, 21 bp, Homo sapiens
actccatgctccttgagagga

SEQ ID NO: 677252 - DNA, 18 bp, Homo sapiens
actcccaacttcttcctg

SEQ ID NO: 677253 - DNA, 23 bp, Homo sapiens
actcccaggatgacgtgctccgt

SEQ ID NO: 677254 - DNA, 21 bp, Homo sapiens
actcccccaccactcaggcca

SEQ ID NO: 677255 - DNA, 19 bp, Homo sapiens
actcccccgtttctccttt

SEQ ID NO: 677256 - DNA, 13 bp, Homo sapiens
actcctagaagaa

SEQ ID NO: 677257 - DNA, 23 bp, Homo sapiens
actcctagaagaaccaaatacct

SEQ ID NO: 677258 - DNA, 16 bp, Homo sapiens
actcctcagtccctct

SEQ ID NO: 677259 - DNA, 11 bp, Homo sapiens
actcctccctc

SEQ ID NO: 677260 - DNA, 13 bp, Homo sapiens
actcctccctccg

SEQ ID NO: 677261 - DNA, 12 bp, Homo sapiens
actcctggcagg

SEQ ID NO: 677262 - DNA, 13 bp, Homo sapiens
actcctggcaggg

SEQ ID NO: 677263 - DNA, 19 bp, Homo sapiens
actcctggcagggccacct

SEQ ID NO: 677264 - DNA, 20 bp, Homo sapiens
actcctggcagggccacctg

SEQ ID NO: 677265 - DNA, 13 bp, Homo sapiens
actcctgtccctt

SEQ ID NO: 677266 - DNA, 18 bp, Homo sapiens
actcctgtcccttttccc

SEQ ID NO: 677267 - DNA, 19 bp, Homo sapiens
actcctgtcccttttccct

SEQ ID NO: 677268 - DNA, 23 bp, Homo sapiens
actcctttcttatcttgaccata

SEQ ID NO: 677269 - DNA, 22 bp, Homo sapiens
actcgtgcattaaaatttctta

SEQ ID NO: 677270 - DNA, 14 bp, Homo sapiens
actctaactctgag

SEQ ID NO: 677271 - DNA, 15 bp, Homo sapiens
actctaactctgaga

SEQ ID NO: 677272 - DNA, 22 bp, Homo sapiens
actctaactctgagagctgttt

SEQ ID NO: 677273 - DNA, 19 bp, Homo sapiens
actctccaatgttctatta

SEQ ID NO: 677274 - DNA, 23 bp, Homo sapiens
actctctgttttagtgtttatgt

SEQ ID NO: 677275 - DNA, 15 bp, Homo sapiens
actctgcaagaagaa

SEQ ID NO: 677276 - DNA, 13 bp, Homo sapiens
actctgtaattgc

SEQ ID NO: 677277 - DNA, 22 bp, Homo sapiens
actctgtaattgcactttttaa

SEQ ID NO: 677278 - DNA, 15 bp, Homo sapiens
actcttcagtgcaaa

SEQ ID NO: 677279 - DNA, 20 bp, Homo sapiens
actcttcagtgcaaattgta

SEQ ID NO: 677280 - DNA, 19 bp, Homo sapiens
actcttgatctctcttgtc

SEQ ID NO: 677281 - DNA, 18 bp, Homo sapiens
actctttagatatttaca

SEQ ID NO: 677282 - DNA, 14 bp, Homo sapiens
actgaaaaatatct

SEQ ID NO: 677283 - DNA, 18 bp, Homo sapiens
actgaaacagatttcata

SEQ ID NO: 677284 - DNA, 13 bp, Homo sapiens
actgaaattactt

SEQ ID NO: 677285 - DNA, 15 bp, Homo sapiens
actgaaattacttta

SEQ ID NO: 677286 - DNA, 18 bp, Homo sapiens
actgaaccggctttacca

SEQ ID NO: 677287 - DNA, 22 bp, Homo sapiens
actgaataatatcaaataaaat

SEQ ID NO: 677288 - DNA, 15 bp, Homo sapiens
actgacaaagatgca

SEQ ID NO: 677289 - DNA, 15 bp, Homo sapiens
actgacatttcttct

SEQ ID NO: 677290 - DNA, 12 bp, Homo sapiens
actgaccactgg

SEQ ID NO: 677291 - DNA, 20 bp, Homo sapiens
actgacccccatctgagctg

SEQ ID NO: 677292 - DNA, 21 bp, Homo sapiens
actgacccccatctgagctgg

SEQ ID NO: 677293 - DNA, 15 bp, Homo sapiens
actgagaccaaagaa

SEQ ID NO: 677294 - DNA, 23 bp, Homo sapiens
actgagagtaattcatctgtgaa

SEQ ID NO: 677295 - DNA, 24 bp, Homo sapiens
actgagagtaattcatctgtgaat

SEQ ID NO: 677296 - DNA, 17 bp, Homo sapiens
actgatggaaaatacca

SEQ ID NO: 677297 - DNA, 18 bp, Homo sapiens
actgatgttgtgttttta

SEQ ID NO: 677298 - DNA, 15 bp, Homo sapiens
actgcaaataaagcc

SEQ ID NO: 677299 - DNA, 14 bp, Homo sapiens
actgcaaattttaa

SEQ ID NO: 677300 - DNA, 16 bp, Homo sapiens
actgcaacctctgcct

SEQ ID NO: 677301 - DNA, 23 bp, Homo sapiens
actgcaagttcattttaaatgaa

SEQ ID NO: 677302 - DNA, 13 bp, Homo sapiens
actgcactccagc

SEQ ID NO: 677303 - DNA, 16 bp, Homo sapiens
actgcactccagcctg

SEQ ID NO: 677304 - DNA, 18 bp, Homo sapiens
actgcactccagcctggg

SEQ ID NO: 677305 - DNA, 12 bp, Homo sapiens
actgccacaagc

SEQ ID NO: 677306 - DNA, 15 bp, Homo sapiens
actgccaggctgcct

SEQ ID NO: 677307 - DNA, 22 bp, Homo sapiens
actgccccccatgaggaaggaa

SEQ ID NO: 677308 - DNA, 17 bp, Homo sapiens
actgcctgaataaagag

SEQ ID NO: 677309 - DNA, 19 bp, Homo sapiens
actgcctgaataaagagcc

SEQ ID NO: 677310 - DNA, 13 bp, Homo sapiens
actgccttgaaaa

SEQ ID NO: 677311 - DNA, 19 bp, Homo sapiens
actgccttgaaaaatgaca

SEQ ID NO: 677312 - DNA, 23 bp, Homo sapiens
actgccttgaaaaatgacaattg

SEQ ID NO: 677313 - DNA, 22 bp, Homo sapiens
actgcgaagaccctcttgccca

SEQ ID NO: 677314 - DNA, 19 bp, Homo sapiens
actgctattctagagcttt

SEQ ID NO: 677315 - DNA, 20 bp, Homo sapiens
actgctattctagagctttt

SEQ ID NO: 677316 - DNA, 21 bp, Homo sapiens
actgctattctagagctttta

SEQ ID NO: 677317 - DNA, 23 bp, Homo sapiens
actgctattctagagcttttatt

SEQ ID NO: 677318 - DNA, 21 bp, Homo sapiens
actgctgatcgtagaaaattt

SEQ ID NO: 677319 - DNA, 15 bp, Homo sapiens
actgctgcagattag

SEQ ID NO: 677320 - DNA, 23 bp, Homo sapiens
actgctgtatttttatttttgca

SEQ ID NO: 677321 - DNA, 18 bp, Homo sapiens
actggaattcttctgcaa

SEQ ID NO: 677322 - DNA, 15 bp, Homo sapiens
actggagttccttat

SEQ ID NO: 677323 - DNA, 23 bp, Homo sapiens
actgggattaagaaaccttgctc

SEQ ID NO: 677324 - DNA, 17 bp, Homo sapiens
actgggccctgagtctg

SEQ ID NO: 677325 - DNA, 21 bp, Homo sapiens
actgggccttagtgggccagg

SEQ ID NO: 677326 - DNA, 21 bp, Homo sapiens
actgggtaaaagcagggcagc

SEQ ID NO: 677327 - DNA, 17 bp, Homo sapiens
actgggtatgcgtttca

SEQ ID NO: 677328 - DNA, 13 bp, Homo sapiens
actgggtctgcga

SEQ ID NO: 677329 - DNA, 17 bp, Homo sapiens
actgtaaacttctgcaa

SEQ ID NO: 677330 - DNA, 16 bp, Homo sapiens
actgtacattatgaag

SEQ ID NO: 677331 - DNA, 22 bp, Homo sapiens
actgtacatttaaaattgctat

SEQ ID NO: 677332 - DNA, 20 bp, Homo sapiens
actgtactatcctgtaaata

SEQ ID NO: 677333 - DNA, 15 bp, Homo sapiens
actgtagatatgtat

SEQ ID NO: 677334 - DNA, 15 bp, Homo sapiens
actgtagcaggttct

SEQ ID NO: 677335 - DNA, 16 bp, Homo sapiens
actgtagctcaagttt

SEQ ID NO: 677336 - DNA, 19 bp, Homo sapiens
actgtagctcaagtttaaa

SEQ ID NO: 677337 - DNA, 21 bp, Homo sapiens
actgtatttctaagaagttgt

SEQ ID NO: 677338 - DNA, 21 bp, Homo sapiens
actgtcaaaatatttctcatc

SEQ ID NO: 677339 - DNA, 20 bp, Homo sapiens
actgtcacttgctgcttttt

SEQ ID NO: 677340 - DNA, 17 bp, Homo sapiens
actgtgcagacccagtc

SEQ ID NO: 677341 - DNA, 17 bp, Homo sapiens
actgtgccagaggccag

SEQ ID NO: 677342 - DNA, 13 bp, Homo sapiens
actgtggccaggc

SEQ ID NO: 677343 - DNA, 18 bp, Homo sapiens
actgttactgggccctga

SEQ ID NO: 677344 - DNA, 14 bp, Homo sapiens
actgttgtaagaat

SEQ ID NO: 677345 - DNA, 15 bp, Homo sapiens
actgttgtaagaatt

SEQ ID NO: 677346 - DNA, 21 bp, Homo sapiens
actgttgtaagaattctgatt

SEQ ID NO: 677347 - DNA, 13 bp, Homo sapiens
acttacctggcag

SEQ ID NO: 677348 - DNA, 19 bp, Homo sapiens
acttagcgtcaagacattt

SEQ ID NO: 677349 - DNA, 14 bp, Homo sapiens
acttatgtttttaa

SEQ ID NO: 677350 - DNA, 12 bp, Homo sapiens
acttatttcata

SEQ ID NO: 677351 - DNA, 22 bp, Homo sapiens
acttatttcataattgcctaca

SEQ ID NO: 677352 - DNA, 20 bp, Homo sapiens
acttattttgtcttattctt

SEQ ID NO: 677353 - DNA, 15 bp, Homo sapiens
acttcaaaagtttgt

SEQ ID NO: 677354 - DNA, 16 bp, Homo sapiens
acttcaaagcaagctg

SEQ ID NO: 677355 - DNA, 20 bp, Homo sapiens
acccatgtcaccggtcagtg

SEQ ID NO: 677356 - DNA, 22 bp, Homo sapiens
acccattaaggggaagaatgaa

SEQ ID NO: 677357 - DNA, 15 bp, Homo sapiens
acccccatctgagct

SEQ ID NO: 677358 - DNA, 14 bp, Homo sapiens
accccccactcagt

SEQ ID NO: 677359 - DNA, 13 bp, Homo sapiens
accccctcacccc

SEQ ID NO: 677360 - DNA, 17 bp, Homo sapiens
acccccttaaatttaat

SEQ ID NO: 677361 - DNA, 18 bp, Homo sapiens
acccctctcgcctcatta

SEQ ID NO: 677362 - DNA, 17 bp, Homo sapiens
acccctgagccagcagg

SEQ ID NO: 677363 - DNA, 16 bp, Homo sapiens
acccctgtaggcctca

SEQ ID NO: 677364 - DNA, 23 bp, Homo sapiens
acccgagttcctctgggtttcta

SEQ ID NO: 677365 - DNA, 22 bp, Homo sapiens
acccggccaggaccttggtgag

SEQ ID NO: 677366 - DNA, 23 bp, Homo sapiens
accctcttgcccatcctgactga

SEQ ID NO: 677367 - DNA, 22 bp, Homo sapiens
accctgaggtcagggagtgctg

SEQ ID NO: 677368 - DNA, 17 bp, Homo sapiens
accctgagttttgtttt

SEQ ID NO: 677369 - DNA, 10 bp, Homo sapiens
accctgcccc

SEQ ID NO: 677370 - DNA, 14 bp, Homo sapiens
accctgggggcaca

SEQ ID NO: 677371 - DNA, 15 bp, Homo sapiens
accctgtcctgcagt

SEQ ID NO: 677372 - DNA, 21 bp, Homo sapiens
accctgtcctgcagtcccaca

SEQ ID NO: 677373 - DNA, 20 bp, Homo sapiens
acccttctctgttggtctgc

SEQ ID NO: 677374 - DNA, 21 bp, Homo sapiens
acccttttcccccttcccatt

SEQ ID NO: 677375 - DNA, 21 bp, Homo sapiens
accgcctccccacctccaggc

SEQ ID NO: 677376 - DNA, 19 bp, Homo sapiens
accggctttaccaaaccgc

SEQ ID NO: 677377 - DNA, 13 bp, Homo sapiens
accggtcagtgcc

SEQ ID NO: 677378 - DNA, 16 bp, Homo sapiens
accgtacaaccccctc

SEQ ID NO: 677379 - DNA, 22 bp, Homo sapiens
acctacagactccatctcttct

SEQ ID NO: 677380 - DNA, 23 bp, Homo sapiens
acctacatatgctgatcttttaa

SEQ ID NO: 677381 - DNA, 12 bp, Homo sapiens
acctcagggctc

SEQ ID NO: 677382 - DNA, 13 bp, Homo sapiens
acctcagggctcc

SEQ ID NO: 677383 - DNA, 23 bp, Homo sapiens
acctcattctggttccctgctgc

SEQ ID NO: 677384 - DNA, 19 bp, Homo sapiens
acctccacacccgtgagaa

SEQ ID NO: 677385 - DNA, 11 bp, Homo sapiens
acctccctccc

SEQ ID NO: 677386 - DNA, 17 bp, Homo sapiens
acctcctctcagtgttt

SEQ ID NO: 677387 - DNA, 14 bp, Homo sapiens
acctctctgtagtt

SEQ ID NO: 677388 - DNA, 19 bp, Homo sapiens
acctctctgtagtttatgg

SEQ ID NO: 677389 - DNA, 20 bp, Homo sapiens
acctctctgtagtttatggc

SEQ ID NO: 677390 - DNA, 12 bp, Homo sapiens
acctctctgtcc

SEQ ID NO: 677391 - DNA, 16 bp, Homo sapiens
acctctctgtcccttg

SEQ ID NO: 677392 - DNA, 22 bp, Homo sapiens
acctctctgtcccttgctgtat

SEQ ID NO: 677393 - DNA, 14 bp, Homo sapiens
acctgaaataatat

SEQ ID NO: 677394 - DNA, 17 bp, Homo sapiens
acctgaaataatatatt

SEQ ID NO: 677395 - DNA, 22 bp, Homo sapiens
acctgaaataatatatttcttc

SEQ ID NO: 677396 - DNA, 19 bp, Homo sapiens
acctgccatgccaggaacc

SEQ ID NO: 677397 - DNA, 15 bp, Homo sapiens
acctggcaaaggacc

SEQ ID NO: 677398 - DNA, 21 bp, Homo sapiens
acctggcatctaattctgatt

SEQ ID NO: 677399 - DNA, 14 bp, Homo sapiens
acctggtccccact

SEQ ID NO: 677400 - DNA, 22 bp, Homo sapiens
acctggtccccactgctgagct

SEQ ID NO: 677401 - DNA, 15 bp, Homo sapiens
acctgtaatgacagg

SEQ ID NO: 677402 - DNA, 22 bp, Homo sapiens
acctgtcctaaggaaccttcct

SEQ ID NO: 677403 - DNA, 19 bp, Homo sapiens
acctgttaatttttatact

SEQ ID NO: 677404 - DNA, 16 bp, Homo sapiens
accttaaaattgatat

SEQ ID NO: 677405 - DNA, 22 bp, Homo sapiens
accttaaaattgatattatatt

SEQ ID NO: 677406 - DNA, 20 bp, Homo sapiens
accttagttgaaatgatagc

SEQ ID NO: 677407 - DNA, 20 bp, Homo sapiens
accttcaatgacttctaatt

SEQ ID NO: 677408 - DNA, 22 bp, Homo sapiens
accttcagatccttttattctc

SEQ ID NO: 677409 - DNA, 20 bp, Homo sapiens
accttgaataaggcccactg

SEQ ID NO: 677410 - DNA, 23 bp, Homo sapiens
accttgaataaggcccactgtaa

SEQ ID NO: 677411 - DNA, 14 bp, Homo sapiens
accttgctctcctc

SEQ ID NO: 677412 - DNA, 14 bp, Homo sapiens
acctttattcagaa

SEQ ID NO: 677413 - DNA, 16 bp, Homo sapiens
acctttgctatgtaag

SEQ ID NO: 677414 - DNA, 13 bp, Homo sapiens
accttttctcttt

SEQ ID NO: 677415 - DNA, 17 bp, Homo sapiens
accttttgcatttcttt

SEQ ID NO: 677416 - DNA, 24 bp, Homo sapiens
acctttttttatcgtttttgtatt

SEQ ID NO: 677417 - DNA, 13 bp, Homo sapiens
acgacctttacct

SEQ ID NO: 677418 - DNA, 14 bp, Homo sapiens
acgagactttctcc

SEQ ID NO: 677419 - DNA, 21 bp, Homo sapiens
acgagggtctcccctcctgca

SEQ ID NO: 677420 - DNA, 13 bp, Homo sapiens
acgatcaggagga

SEQ ID NO: 677421 - DNA, 16 bp, Homo sapiens
acgatcaggaggaagt

SEQ ID NO: 677422 - DNA, 12 bp, Homo sapiens
acgatttaaggt

SEQ ID NO: 677423 - DNA, 16 bp, Homo sapiens
acgcccgagagcctcg

SEQ ID NO: 677424 - DNA, 18 bp, Homo sapiens
acgcctcttgttcatgtc

SEQ ID NO: 677425 - DNA, 13 bp, Homo sapiens
acgcgtctgcctg

SEQ ID NO: 677426 - DNA, 15 bp, Homo sapiens
acgctacctctctgt

SEQ ID NO: 677427 - DNA, 14 bp, Homo sapiens
acgcttttctttgt

SEQ ID NO: 677428 - DNA, 16 bp, Homo sapiens
acggccaagaatgtac

SEQ ID NO: 677429 - DNA, 17 bp, Homo sapiens
acggccttgatcccctt

SEQ ID NO: 677430 - DNA, 22 bp, Homo sapiens
acggcgcctttttggcctgtga

SEQ ID NO: 677431 - DNA, 13 bp, Homo sapiens
acgggaggggagg

SEQ ID NO: 677432 - DNA, 14 bp, Homo sapiens
acgtagctctctta

SEQ ID NO: 677433 - DNA, 17 bp, Homo sapiens
acgtctggactgctatt

SEQ ID NO: 677434 - DNA, 17 bp, Homo sapiens
acgtggcacacactgac

SEQ ID NO: 677435 - DNA, 15 bp, Homo sapiens
acgttggttaaataa

SEQ ID NO: 677436 - DNA, 19 bp, Homo sapiens
acgtttataaacagaaatg

SEQ ID NO: 677437 - DNA, 13 bp, Homo sapiens
actaaaagcatga

SEQ ID NO: 677438 - DNA, 14 bp, Homo sapiens
actaaaagcatgaa

SEQ ID NO: 677439 - DNA, 15 bp, Homo sapiens
actaaaagcatgaat

SEQ ID NO: 677440 - DNA, 12 bp, Homo sapiens
actaaagagaga

SEQ ID NO: 677441 - DNA, 16 bp, Homo sapiens
actaaagagagaatgt

SEQ ID NO: 677442 - DNA, 21 bp, Homo sapiens
actaaagagagaatgtagata

SEQ ID NO: 677443 - DNA, 22 bp, Homo sapiens
actaaagcatgaaatgtgaatt

SEQ ID NO: 677444 - DNA, 16 bp, Homo sapiens
actaacagataagcaa

SEQ ID NO: 677445 - DNA, 18 bp, Homo sapiens
actaactcaaatacacat

SEQ ID NO: 677446 - DNA, 13 bp, Homo sapiens
actaataaatata

SEQ ID NO: 677447 - DNA, 19 bp, Homo sapiens
actaataaatataatttat

SEQ ID NO: 677448 - DNA, 22 bp, Homo sapiens
actaattattattttaaaatat

SEQ ID NO: 677449 - DNA, 13 bp, Homo sapiens
actacaagtcagc

SEQ ID NO: 677450 - DNA, 16 bp, Homo sapiens
actacacaatacagta

SEQ ID NO: 677451 - DNA, 21 bp, Homo sapiens
actacaccttgccttgctgtt

SEQ ID NO: 677452 - DNA, 11 bp, Homo sapiens
actacatctgg

SEQ ID NO: 677453 - DNA, 16 bp, Homo sapiens
actaccaatcccaact

SEQ ID NO: 677454 - DNA, 19 bp, Homo sapiens
actacccatagacatgaaa

SEQ ID NO: 677455 - DNA, 14 bp, Homo sapiens
actactctctgttt

SEQ ID NO: 677456 - DNA, 13 bp, Homo sapiens
actactttgcctt

SEQ ID NO: 677457 - DNA, 18 bp, Homo sapiens
actagaacgcttcgggaa

SEQ ID NO: 677458 - DNA, 23 bp, Homo sapiens
actaggtatttctaacgccagca

SEQ ID NO: 677459 - DNA, 23 bp, Homo sapiens
actagtgtacatttctataaata

SEQ ID NO: 677460 - DNA, 17 bp, Homo sapiens
actatatatataaatgt

SEQ ID NO: 677461 - DNA, 17 bp, Homo sapiens
actatatatatttctag

SEQ ID NO: 677462 - DNA, 12 bp, Homo sapiens
actatatgtgaa

SEQ ID NO: 677463 - DNA, 11 bp, Homo sapiens
actatcttgtg

SEQ ID NO: 677464 - DNA, 15 bp, Homo sapiens
actatgtatatacat

SEQ ID NO: 677465 - DNA, 17 bp, Homo sapiens
actatgttcctaacaaa

SEQ ID NO: 677466 - DNA, 14 bp, Homo sapiens
actattacatattt

SEQ ID NO: 677467 - DNA, 13 bp, Homo sapiens
actattggcccta

SEQ ID NO: 677468 - DNA, 18 bp, Homo sapiens
actatttaagatgtgaaa

SEQ ID NO: 677469 - DNA, 14 bp, Homo sapiens
actattttctacaa

SEQ ID NO: 677470 - DNA, 20 bp, Homo sapiens
actcaaaaaaacaaaaaaga

SEQ ID NO: 677471 - DNA, 24 bp, Homo sapiens
aatgctgtttctaagaaaatgtag

SEQ ID NO: 677472 - DNA, 12 bp, Homo sapiens
aatgcttaaaaa

SEQ ID NO: 677473 - DNA, 16 bp, Homo sapiens
aatgcttaaaaaataa

SEQ ID NO: 677474 - DNA, 18 bp, Homo sapiens
aatgcttcagatattatt

SEQ ID NO: 677475 - DNA, 17 bp, Homo sapiens
aatgcttcattgaaagc

SEQ ID NO: 677476 - DNA, 21 bp, Homo sapiens
aatgcttcattgaaagcttca

SEQ ID NO: 677477 - DNA, 21 bp, Homo sapiens
aatgcttcctgacaatcaact

SEQ ID NO: 677478 - DNA, 19 bp, Homo sapiens
aatggaacagatttcaaaa

SEQ ID NO: 677479 - DNA, 15 bp, Homo sapiens
aatggacacaaattt

SEQ ID NO: 677480 - DNA, 15 bp, Homo sapiens
aatggaggaatatga

SEQ ID NO: 677481 - DNA, 20 bp, Homo sapiens
aatggtactccacatatttc

SEQ ID NO: 677482 - DNA, 17 bp, Homo sapiens
aatgtaaagttatgtat

SEQ ID NO: 677483 - DNA, 12 bp, Homo sapiens
aatgtaaataaa

SEQ ID NO: 677484 - DNA, 15 bp, Homo sapiens
aatgtaagtgggccc

SEQ ID NO: 677485 - DNA, 15 bp, Homo sapiens
aatgtaatataatgt

SEQ ID NO: 677486 - DNA, 17 bp, Homo sapiens
aatgtaatataatgtat

SEQ ID NO: 677487 - DNA, 15 bp, Homo sapiens
aatgtataaatatac

SEQ ID NO: 677488 - DNA, 17 bp, Homo sapiens
aatgtcaaggaagactt

SEQ ID NO: 677489 - DNA, 18 bp, Homo sapiens
aatgtcagtgtttgggaa

SEQ ID NO: 677490 - DNA, 18 bp, Homo sapiens
acatacaagaaaatgtat

SEQ ID NO: 677491 - DNA, 15 bp, Homo sapiens
acatacataatacaa

SEQ ID NO: 677492 - DNA, 17 bp, Homo sapiens
acatacataatacaatg

SEQ ID NO: 677493 - DNA, 19 bp, Homo sapiens
acatacctaccagtattat

SEQ ID NO: 677494 - DNA, 19 bp, Homo sapiens
acatacgggctttaatagt

SEQ ID NO: 677495 - DNA, 20 bp, Homo sapiens
acatactgcttgattttaat

SEQ ID NO: 677496 - DNA, 17 bp, Homo sapiens
acataggtcataaagca

SEQ ID NO: 677497 - DNA, 18 bp, Homo sapiens
acatagtgaaaattgttt

SEQ ID NO: 677498 - DNA, 23 bp, Homo sapiens
acatagtgaaaattgtttagtga

SEQ ID NO: 677499 - DNA, 14 bp, Homo sapiens
acatatacatatga

SEQ ID NO: 677500 - DNA, 16 bp, Homo sapiens
acatatatatatataa

SEQ ID NO: 677501 - DNA, 17 bp, Homo sapiens
acatatatatatataac

SEQ ID NO: 677502 - DNA, 21 bp, Homo sapiens
acatatgagaatataccttat

SEQ ID NO: 677503 - DNA, 23 bp, Homo sapiens
acatattttttgtatatttgttt

SEQ ID NO: 677504 - DNA, 13 bp, Homo sapiens
acatcaaaccttt

SEQ ID NO: 677505 - DNA, 19 bp, Homo sapiens
acatcaagtccatctgaca

SEQ ID NO: 677506 - DNA, 15 bp, Homo sapiens
acatcacagggtggg

SEQ ID NO: 677507 - DNA, 16 bp, Homo sapiens
acatccgcgtgtgcct

SEQ ID NO: 677508 - DNA, 17 bp, Homo sapiens
acatccgcgtgtgcctg

SEQ ID NO: 677509 - DNA, 22 bp, Homo sapiens
acatccgcgtgtgcctgtgtgc

SEQ ID NO: 677510 - DNA, 20 bp, Homo sapiens
acatctgcaatatgaattca

SEQ ID NO: 677511 - DNA, 21 bp, Homo sapiens
acatctggctgcacaggctga

SEQ ID NO: 677512 - DNA, 13 bp, Homo sapiens
acatgaagctgtt

SEQ ID NO: 677513 - DNA, 19 bp, Homo sapiens
acatgaagctgttgtgtga

SEQ ID NO: 677514 - DNA, 19 bp, Homo sapiens
acatgcaataaaatttaaa

SEQ ID NO: 677515 - DNA, 12 bp, Homo sapiens
acatgcatttga

SEQ ID NO: 677516 - DNA, 17 bp, Homo sapiens
acatgcatttgaggtca

SEQ ID NO: 677517 - DNA, 21 bp, Homo sapiens
acatgcatttgaggtcaagta

SEQ ID NO: 677518 - DNA, 19 bp, Homo sapiens
acatgccacatcaaacctt

SEQ ID NO: 677519 - DNA, 22 bp, Homo sapiens
acatgccacatcaaacctttga

SEQ ID NO: 677520 - DNA, 15 bp, Homo sapiens
acatgctgcctggca

SEQ ID NO: 677521 - DNA, 18 bp, Homo sapiens
acatggaattttttgaat

SEQ ID NO: 677522 - DNA, 23 bp, Homo sapiens
acatgtaataaaaagtatatgtt

SEQ ID NO: 677523 - DNA, 21 bp, Homo sapiens
acatgtaggtaggaagcactg

SEQ ID NO: 677524 - DNA, 17 bp, Homo sapiens
acatgtccagcaccttg

SEQ ID NO: 677525 - DNA, 20 bp, Homo sapiens
acatgtcttccatgtatctt

SEQ ID NO: 677526 - DNA, 15 bp, Homo sapiens
acatgtgatacattt

SEQ ID NO: 677527 - DNA, 17 bp, Homo sapiens
acatgtgatacattttt

SEQ ID NO: 677528 - DNA, 16 bp, Homo sapiens
acatgttaatgacaat

SEQ ID NO: 677529 - DNA, 13 bp, Homo sapiens
acatgttgccttg

SEQ ID NO: 677530 - DNA, 14 bp, Homo sapiens
acattaaggaattt

SEQ ID NO: 677531 - DNA, 19 bp, Homo sapiens
acattaaggaatttgatga

SEQ ID NO: 677532 - DNA, 19 bp, Homo sapiens
acattaggctgtgtcacca

SEQ ID NO: 677533 - DNA, 21 bp, Homo sapiens
acattaggctgtgtcaccatt

SEQ ID NO: 677534 - DNA, 14 bp, Homo sapiens
acattataacaact

SEQ ID NO: 677535 - DNA, 18 bp, Homo sapiens
acattataacaactattt

SEQ ID NO: 677536 - DNA, 13 bp, Homo sapiens
acattatttctag

SEQ ID NO: 677537 - DNA, 21 bp, Homo sapiens
acattgtgactttgctttgag

SEQ ID NO: 677538 - DNA, 22 bp, Homo sapiens
acattgtgactttgctttgaga

SEQ ID NO: 677539 - DNA, 23 bp, Homo sapiens
acatttagatcctggtttcataa

SEQ ID NO: 677540 - DNA, 19 bp, Homo sapiens
acatttatgtgaggtaatt

SEQ ID NO: 677541 - DNA, 15 bp, Homo sapiens
acatttctataaata

SEQ ID NO: 677542 - DNA, 20 bp, Homo sapiens
acatttctcttccccttaga

SEQ ID NO: 677543 - DNA, 21 bp, Homo sapiens
acatttctcttccccttagaa

SEQ ID NO: 677544 - DNA, 22 bp, Homo sapiens
acatttctcttccccttagaaa

SEQ ID NO: 677545 - DNA, 19 bp, Homo sapiens
acatttcttctagtgatga

SEQ ID NO: 677546 - DNA, 17 bp, Homo sapiens
acatttgctactgttgt

SEQ ID NO: 677547 - DNA, 19 bp, Homo sapiens
acatttgctactgttgtaa

SEQ ID NO: 677548 - DNA, 12 bp, Homo sapiens
acatttgctgaa

SEQ ID NO: 677549 - DNA, 19 bp, Homo sapiens
acatttgctgaactcagca

SEQ ID NO: 677550 - DNA, 21 bp, Homo sapiens
acatttgtaagtgtaaaaaat

SEQ ID NO: 677551 - DNA, 23 bp, Homo sapiens
acatttgtaagtgtaaaaaatgt

SEQ ID NO: 677552 - DNA, 16 bp, Homo sapiens
acatttgtttgctgta

SEQ ID NO: 677553 - DNA, 12 bp, Homo sapiens
acattttaaata

SEQ ID NO: 677554 - DNA, 21 bp, Homo sapiens
acattttaaatactctactta

SEQ ID NO: 677555 - DNA, 19 bp, Homo sapiens
acattttatcattaaaaat

SEQ ID NO: 677556 - DNA, 13 bp, Homo sapiens
acattttcagaag

SEQ ID NO: 677557 - DNA, 12 bp, Homo sapiens
acattttctaaa

SEQ ID NO: 677558 - DNA, 19 bp, Homo sapiens
acattttctaaataaaaat

SEQ ID NO: 677559 - DNA, 12 bp, Homo sapiens
acattttggaaa

SEQ ID NO: 677560 - DNA, 18 bp, Homo sapiens
acattttggaaattgttg

SEQ ID NO: 677561 - DNA, 15 bp, Homo sapiens
acattttgttacata

SEQ ID NO: 677562 - DNA, 21 bp, Homo sapiens
acatttttccgtttgcttttg

SEQ ID NO: 677563 - DNA, 14 bp, Homo sapiens
acattttttaagct

SEQ ID NO: 677564 - DNA, 17 bp, Homo sapiens
acattttttaagcttca

SEQ ID NO: 677565 - DNA, 21 bp, Homo sapiens
acattttttcttctgaagatt

SEQ ID NO: 677566 - DNA, 22 bp, Homo sapiens
accaaatacctcaatttttgtt

SEQ ID NO: 677567 - DNA, 15 bp, Homo sapiens
accaagaaagctcac

SEQ ID NO: 677568 - DNA, 17 bp, Homo sapiens
accaagcagtggccttt

SEQ ID NO: 677569 - DNA, 11 bp, Homo sapiens
accaaggaaac

SEQ ID NO: 677570 - DNA, 20 bp, Homo sapiens
accaaggacggaaaatgctt

SEQ ID NO: 677571 - DNA, 21 bp, Homo sapiens
accaaggtacaactgtattta

SEQ ID NO: 677572 - DNA, 16 bp, Homo sapiens
accaagtggaccttga

SEQ ID NO: 677573 - DNA, 17 bp, Homo sapiens
accaatgaaaacatgta

SEQ ID NO: 677574 - DNA, 22 bp, Homo sapiens
accaatgaaaacatgtactaca

SEQ ID NO: 677575 - DNA, 16 bp, Homo sapiens
accacaaatgcataaa

SEQ ID NO: 677576 - DNA, 17 bp, Homo sapiens
accacacttgaaacctt

SEQ ID NO: 677577 - DNA, 17 bp, Homo sapiens
accacagccggtcagag

SEQ ID NO: 677578 - DNA, 23 bp, Homo sapiens
accacagggttcaaaatgtctgt

SEQ ID NO: 677579 - DNA, 14 bp, Homo sapiens
accactcgtgcatc

SEQ ID NO: 677580 - DNA, 21 bp, Homo sapiens
accagattctgcctatgtaaa

SEQ ID NO: 677581 - DNA, 23 bp, Homo sapiens
accagctgaagttgcagatgtta

SEQ ID NO: 677582 - DNA, 14 bp, Homo sapiens
accaggcagtgtgc

SEQ ID NO: 677583 - DNA, 16 bp, Homo sapiens
accaggtatcaaatca

SEQ ID NO: 677584 - DNA, 23 bp, Homo sapiens
accaggtgttctacactcatctt

SEQ ID NO: 677585 - DNA, 14 bp, Homo sapiens
accagtacttctaa

SEQ ID NO: 677586 - DNA, 14 bp, Homo sapiens
accagtgttgggtt

SEQ ID NO: 677587 - DNA, 19 bp, Homo sapiens
accagttatgtttgaatga

SEQ ID NO: 677588 - DNA, 14 bp, Homo sapiens
accatattacctgg

SEQ ID NO: 677589 - DNA, 17 bp, Homo sapiens
accatattacctggatt

SEQ ID NO: 677590 - DNA, 22 bp, Homo sapiens
accatctgaaagtggtacttga

SEQ ID NO: 677591 - DNA, 20 bp, Homo sapiens
accattatggataaagatga

SEQ ID NO: 677592 - DNA, 21 bp, Homo sapiens
accattatggataaagatgag

SEQ ID NO: 677593 - DNA, 15 bp, Homo sapiens
accattggaatggac

SEQ ID NO: 677594 - DNA, 11 bp, Homo sapiens
acccaaagctg

SEQ ID NO: 677595 - DNA, 17 bp, Homo sapiens
acccaaagctgagcctg

SEQ ID NO: 677596 - DNA, 21 bp, Homo sapiens
acccaatacagtctagtttcc

SEQ ID NO: 677597 - DNA, 17 bp, Homo sapiens
acccactttgtaatttt

SEQ ID NO: 677598 - DNA, 16 bp, Homo sapiens
acccagagctgtattt

SEQ ID NO: 677599 - DNA, 12 bp, Homo sapiens
acccagcaggca

SEQ ID NO: 677600 - DNA, 20 bp, Homo sapiens
acccaggctggagtgcagtg

SEQ ID NO: 677601 - DNA, 22 bp, Homo sapiens
aagatgtgttcaggcattccag

SEQ ID NO: 677602 - DNA, 23 bp, Homo sapiens
aagattcctcgttattgttgttg

SEQ ID NO: 677603 - DNA, 20 bp, Homo sapiens
aagattgatatctataaaat

SEQ ID NO: 677604 - DNA, 21 bp, Homo sapiens
aagattgatatctataaaata

SEQ ID NO: 677605 - DNA, 12 bp, Homo sapiens
aagatttattgt

SEQ ID NO: 677606 - DNA, 15 bp, Homo sapiens
aagattttgaatgct

SEQ ID NO: 677607 - DNA, 21 bp, Homo sapiens
aagattttgaatgcttcctga

SEQ ID NO: 677608 - DNA, 14 bp, Homo sapiens
aagcaaagttcaac

SEQ ID NO: 677609 - DNA, 22 bp, Homo sapiens
aagcaaagttcaacttatttca

SEQ ID NO: 677610 - DNA, 17 bp, Homo sapiens
aagcaaatgttaaaagt

SEQ ID NO: 677611 - DNA, 13 bp, Homo sapiens
aagcaacatggct

SEQ ID NO: 677612 - DNA, 14 bp, Homo sapiens
aagcactaagaggt

SEQ ID NO: 677613 - DNA, 19 bp, Homo sapiens
aagcactacaccttgcctt

SEQ ID NO: 677614 - DNA, 23 bp, Homo sapiens
aagcactacaccttgccttgctg

SEQ ID NO: 677615 - DNA, 19 bp, Homo sapiens
aagcagaaaataaaggaag

SEQ ID NO: 677616 - DNA, 20 bp, Homo sapiens
aagcagaaaataaaggaagc

SEQ ID NO: 677617 - DNA, 23 bp, Homo sapiens
aagcagaagacgggaggggaggc

SEQ ID NO: 677618 - DNA, 19 bp, Homo sapiens
aagcagaggaccagggcct

SEQ ID NO: 677619 - DNA, 14 bp, Homo sapiens
aagcagagttttca

SEQ ID NO: 677620 - DNA, 14 bp, Homo sapiens
aagcaggtttgttt

SEQ ID NO: 677621 - DNA, 21 bp, Homo sapiens
aagcagttatggtgatgactt

SEQ ID NO: 677622 - DNA, 21 bp, Homo sapiens
aagcatagataatattgtttg

SEQ ID NO: 677623 - DNA, 22 bp, Homo sapiens
aagcatagataatattgtttgg

SEQ ID NO: 677624 - DNA, 13 bp, Homo sapiens
aagcatgaaatgt

SEQ ID NO: 677625 - DNA, 17 bp, Homo sapiens
aagcatgaaatgtgaat

SEQ ID NO: 677626 - DNA, 22 bp, Homo sapiens
aagcatgaattggaactgcaat

SEQ ID NO: 677627 - DNA, 20 bp, Homo sapiens
aagcattttgaaacaaagta

SEQ ID NO: 677628 - DNA, 16 bp, Homo sapiens
aatacaaaaacttaga

SEQ ID NO: 677629 - DNA, 12 bp, Homo sapiens
aatacaaggtat

SEQ ID NO: 677630 - DNA, 17 bp, Homo sapiens
aatacagctcagtaaat

SEQ ID NO: 677631 - DNA, 20 bp, Homo sapiens
aatacagtattatagacaaa

SEQ ID NO: 677632 - DNA, 17 bp, Homo sapiens
aatacattcgaaggaac

SEQ ID NO: 677633 - DNA, 15 bp, Homo sapiens
aataccatttagtaa

SEQ ID NO: 677634 - DNA, 18 bp, Homo sapiens
aataccatttagtaagaa

SEQ ID NO: 677635 - DNA, 18 bp, Homo sapiens
aatacgttaggaggacaa

SEQ ID NO: 677636 - DNA, 21 bp, Homo sapiens
aatacgttaggaggacaaaag

SEQ ID NO: 677637 - DNA, 15 bp, Homo sapiens
aatactatttaagat

SEQ ID NO: 677638 - DNA, 19 bp, Homo sapiens
aatactatttaagatgtga

SEQ ID NO: 677639 - DNA, 21 bp, Homo sapiens
aatactatttaagatgtgaaa

SEQ ID NO: 677640 - DNA, 20 bp, Homo sapiens
aatacttttgctttcaggga

SEQ ID NO: 677641 - DNA, 16 bp, Homo sapiens
aatagctttaatgata

SEQ ID NO: 677642 - DNA, 16 bp, Homo sapiens
aataggctttttagga

SEQ ID NO: 677643 - DNA, 17 bp, Homo sapiens
aataggctttttaggaa

SEQ ID NO: 677644 - DNA, 15 bp, Homo sapiens
aataggggatattta

SEQ ID NO: 677645 - DNA, 15 bp, Homo sapiens
aatagtatacattgt

SEQ ID NO: 677646 - DNA, 21 bp, Homo sapiens
aatagtcaccttcatgattat

SEQ ID NO: 677647 - DNA, 14 bp, Homo sapiens
aatataatgtattt

SEQ ID NO: 677648 - DNA, 15 bp, Homo sapiens
aatataatgtatttt

SEQ ID NO: 677649 - DNA, 18 bp, Homo sapiens
aatataatgtattttctt

SEQ ID NO: 677650 - DNA, 12 bp, Homo sapiens
aatataatgttg

SEQ ID NO: 677651 - DNA, 16 bp, Homo sapiens
aatatacattttctaa

SEQ ID NO: 677652 - DNA, 14 bp, Homo sapiens
aatataccttattt

SEQ ID NO: 677653 - DNA, 23 bp, Homo sapiens
aatatagttttttctttcccatg

SEQ ID NO: 677654 - DNA, 20 bp, Homo sapiens
aatatatagtgggtacatca

SEQ ID NO: 677655 - DNA, 13 bp, Homo sapiens
aatatatattaag

SEQ ID NO: 677656 - DNA, 23 bp, Homo sapiens
aatatatattaagtgtgccaaat

SEQ ID NO: 677657 - DNA, 13 bp, Homo sapiens
aatatatgattct

SEQ ID NO: 677658 - DNA, 16 bp, Homo sapiens
aatatatttcttcttc

SEQ ID NO: 677659 - DNA, 23 bp, Homo sapiens
aatatcaaaagaaaattgatatt

SEQ ID NO: 677660 - DNA, 18 bp, Homo sapiens
aatatcagctttgataat

SEQ ID NO: 677661 - DNA, 14 bp, Homo sapiens
aatatgaatctata

SEQ ID NO: 677662 - DNA, 21 bp, Homo sapiens
aatatgacggaagaacataga

SEQ ID NO: 677663 - DNA, 19 bp, Homo sapiens
aatatgccactgaccgatt

SEQ ID NO: 677664 - DNA, 18 bp, Homo sapiens
aatatgccttaatttaga

SEQ ID NO: 677665 - DNA, 15 bp, Homo sapiens
aatatgtaatttcaa

SEQ ID NO: 677666 - DNA, 21 bp, Homo sapiens
aatatgtgagtgccttttgca

SEQ ID NO: 677667 - DNA, 16 bp, Homo sapiens
aatattccagatcttt

SEQ ID NO: 677668 - DNA, 18 bp, Homo sapiens
aatattcttttgtttcca

SEQ ID NO: 677669 - DNA, 21 bp, Homo sapiens
aatattgtttggtaaatgttt

SEQ ID NO: 677670 - DNA, 22 bp, Homo sapiens
aatattgtttggtaaatgtttc

SEQ ID NO: 677671 - DNA, 15 bp, Homo sapiens
aatatttaatatcaa

SEQ ID NO: 677672 - DNA, 12 bp, Homo sapiens
aatatttcttca

SEQ ID NO: 677673 - DNA, 20 bp, Homo sapiens
aatattttttgctctaatct

SEQ ID NO: 677674 - DNA, 22 bp, Homo sapiens
aatattttttgctctaatctct

SEQ ID NO: 677675 - DNA, 13 bp, Homo sapiens
aatcaacttttat

SEQ ID NO: 677676 - DNA, 20 bp, Homo sapiens
aatcacagcccaaaatttga

SEQ ID NO: 677677 - DNA, 22 bp, Homo sapiens
aatcacagcccaaaatttgatg

SEQ ID NO: 677678 - DNA, 21 bp, Homo sapiens
aatcataaagtgcacaccttt

SEQ ID NO: 677679 - DNA, 22 bp, Homo sapiens
aatccaataaaaacattttgaa

SEQ ID NO: 677680 - DNA, 14 bp, Homo sapiens
aatccagtattatc

SEQ ID NO: 677681 - DNA, 13 bp, Homo sapiens
aatccagttataa

SEQ ID NO: 677682 - DNA, 19 bp, Homo sapiens
aatcccatcagtgaatcct

SEQ ID NO: 677683 - DNA, 14 bp, Homo sapiens
aatcccctaaaata

SEQ ID NO: 677684 - DNA, 17 bp, Homo sapiens
aatccttttccttattt

SEQ ID NO: 677685 - DNA, 20 bp, Homo sapiens
aatctaagcagcttattgtt

SEQ ID NO: 677686 - DNA, 16 bp, Homo sapiens
aatctacaccaatgaa

SEQ ID NO: 677687 - DNA, 17 bp, Homo sapiens
aatctacaccaatgaaa

SEQ ID NO: 677688 - DNA, 19 bp, Homo sapiens
aatctatggcttatttcta

SEQ ID NO: 677689 - DNA, 22 bp, Homo sapiens
aatctatggcttatttctatga

SEQ ID NO: 677690 - DNA, 21 bp, Homo sapiens
aatctcttcatgcttgacata

SEQ ID NO: 677691 - DNA, 23 bp, Homo sapiens
aatctgggagcagggcataggaa

SEQ ID NO: 677692 - DNA, 14 bp, Homo sapiens
aatctggtcttgtt

SEQ ID NO: 677693 - DNA, 20 bp, Homo sapiens
aatctggtcttgttagaaaa

SEQ ID NO: 677694 - DNA, 18 bp, Homo sapiens
aatcttagtgaatgggaa

SEQ ID NO: 677695 - DNA, 16 bp, Homo sapiens
aatcttcaaagccttc

SEQ ID NO: 677696 - DNA, 18 bp, Homo sapiens
aatcttcagtattttctc

SEQ ID NO: 677697 - DNA, 17 bp, Homo sapiens
aatcttcccatgcattc

SEQ ID NO: 677698 - DNA, 12 bp, Homo sapiens
aatcttctactt

SEQ ID NO: 677699 - DNA, 12 bp, Homo sapiens
aatctttcaaaa

SEQ ID NO: 677700 - DNA, 19 bp, Homo sapiens
aatctttgttgaagtttga

SEQ ID NO: 677701 - DNA, 18 bp, Homo sapiens
aatgaaaaatataatgtt

SEQ ID NO: 677702 - DNA, 14 bp, Homo sapiens
aatgaaaacatgta

SEQ ID NO: 677703 - DNA, 22 bp, Homo sapiens
aatgaaaacatgtactacagct

SEQ ID NO: 677704 - DNA, 22 bp, Homo sapiens
aatgaaggcgggcctgcaagcc

SEQ ID NO: 677705 - DNA, 14 bp, Homo sapiens
aatgacagatttct

SEQ ID NO: 677706 - DNA, 21 bp, Homo sapiens
aatgacattaaatgcaataat

SEQ ID NO: 677707 - DNA, 23 bp, Homo sapiens
aatgacattaaatgcaataattt

SEQ ID NO: 677708 - DNA, 20 bp, Homo sapiens
aatgaccaagctcagttcaa

SEQ ID NO: 677709 - DNA, 21 bp, Homo sapiens
aatgacttgtacaaacagtat

SEQ ID NO: 677710 - DNA, 13 bp, Homo sapiens
aatgagcccagag

SEQ ID NO: 677711 - DNA, 14 bp, Homo sapiens
aatgagctctgaaa

SEQ ID NO: 677712 - DNA, 20 bp, Homo sapiens
aatgataaaataaataattt

SEQ ID NO: 677713 - DNA, 21 bp, Homo sapiens
aatgataaaataaataatttt

SEQ ID NO: 677714 - DNA, 17 bp, Homo sapiens
aatgcaaccatttgaaa

SEQ ID NO: 677715 - DNA, 18 bp, Homo sapiens
aatgcaaccatttgaaac

SEQ ID NO: 677716 - DNA, 15 bp, Homo sapiens
aatgcaataactctg

SEQ ID NO: 677717 - DNA, 16 bp, Homo sapiens
aatgcaataactctgg

SEQ ID NO: 677718 - DNA, 16 bp, Homo sapiens
aatgcaataattttac

SEQ ID NO: 677719 - DNA, 18 bp, Homo sapiens
aatgcacgtttcaaagct

SEQ ID NO: 677720 - DNA, 17 bp, Homo sapiens
aatgcagattacactga

SEQ ID NO: 677721 - DNA, 15 bp, Homo sapiens
aatgcagtttttaaa

SEQ ID NO: 677722 - DNA, 11 bp, Homo sapiens
aatgccctctt

SEQ ID NO: 677723 - DNA, 17 bp, Homo sapiens
aatgccgatatcttcag

SEQ ID NO: 677724 - DNA, 20 bp, Homo sapiens
aatgctacaattttaagagg

SEQ ID NO: 677725 - DNA, 20 bp, Homo sapiens
aatgctccccacagcgtccc

SEQ ID NO: 677726 - DNA, 20 bp, Homo sapiens
aatgctgttagtaaatttct

SEQ ID NO: 677727 - DNA, 14 bp, Homo sapiens
aatgctgtttctaa

SEQ ID NO: 677728 - DNA, 14 bp, Homo sapiens
aaatagatataaat

SEQ ID NO: 677729 - DNA, 21 bp, Homo sapiens
aaatagccctgcaaaaattca

SEQ ID NO: 677730 - DNA, 19 bp, Homo sapiens
aaataggaatcattcagaa

SEQ ID NO: 677731 - DNA, 12 bp, Homo sapiens
aaatagtgttcc

SEQ ID NO: 677732 - DNA, 20 bp, Homo sapiens
aaatagttagatctttgtaa

SEQ ID NO: 677733 - DNA, 13 bp, Homo sapiens
aaatataatttat

SEQ ID NO: 677734 - DNA, 22 bp, Homo sapiens
aaatataatttataagcattgc

SEQ ID NO: 677735 - DNA, 18 bp, Homo sapiens
aaatatacattttctaaa

SEQ ID NO: 677736 - DNA, 19 bp, Homo sapiens
aaatatacattttctaaat

SEQ ID NO: 677737 - DNA, 13 bp, Homo sapiens
aaatatatacatt

SEQ ID NO: 677738 - DNA, 21 bp, Homo sapiens
aaatatatgaagacaataatt

SEQ ID NO: 677739 - DNA, 19 bp, Homo sapiens
aaatatggtcttttggtta

SEQ ID NO: 677740 - DNA, 15 bp, Homo sapiens
aaatattataactca

SEQ ID NO: 677741 - DNA, 16 bp, Homo sapiens
aaatcactatgggtga

SEQ ID NO: 677742 - DNA, 16 bp, Homo sapiens
aaatcagaaagtaaca

SEQ ID NO: 677743 - DNA, 18 bp, Homo sapiens
aaatcagaaagtaacaat

SEQ ID NO: 677744 - DNA, 13 bp, Homo sapiens
aaatccaataaaa

SEQ ID NO: 677745 - DNA, 16 bp, Homo sapiens
aaatcccaccttccca

SEQ ID NO: 677746 - DNA, 22 bp, Homo sapiens
aaatcctattctgatgaatctc

SEQ ID NO: 677747 - DNA, 17 bp, Homo sapiens
aaatccttttacctttt

SEQ ID NO: 677748 - DNA, 21 bp, Homo sapiens
aaatctaagcagcttattgtt

SEQ ID NO: 677749 - DNA, 13 bp, Homo sapiens
aaatctaccactg

SEQ ID NO: 677750 - DNA, 13 bp, Homo sapiens
aaatcttcccatg

SEQ ID NO: 677751 - DNA, 17 bp, Homo sapiens
aaatcttttgaagcata

SEQ ID NO: 677752 - DNA, 14 bp, Homo sapiens
aaatgaaagaaaat

SEQ ID NO: 677753 - DNA, 15 bp, Homo sapiens
aaatgaaagaaaatt

SEQ ID NO: 677754 - DNA, 18 bp, Homo sapiens
aaatgacaattgtgaaca

SEQ ID NO: 677755 - DNA, 15 bp, Homo sapiens
aaatgcaataactct

SEQ ID NO: 677756 - DNA, 17 bp, Homo sapiens
aaatgcaataattttac

SEQ ID NO: 677757 - DNA, 13 bp, Homo sapiens
aaatgctccccac

SEQ ID NO: 677758 - DNA, 18 bp, Homo sapiens
aaatgctgttagtaaatt

SEQ ID NO: 677759 - DNA, 15 bp, Homo sapiens
aaatgcttaaaaaat

SEQ ID NO: 677760 - DNA, 15 bp, Homo sapiens
aaatgcttcattgaa

SEQ ID NO: 677761 - DNA, 19 bp, Homo sapiens
aaatggatattattagaaa

SEQ ID NO: 677762 - DNA, 17 bp, Homo sapiens
aaatgggagacagcctc

SEQ ID NO: 677763 - DNA, 17 bp, Homo sapiens
aaatgtaattataagct

SEQ ID NO: 677764 - DNA, 13 bp, Homo sapiens
aaatgtaatttaa

SEQ ID NO: 677765 - DNA, 18 bp, Homo sapiens
aaatgtaatttaaatgaa

SEQ ID NO: 677766 - DNA, 15 bp, Homo sapiens
aaatgtattttacat

SEQ ID NO: 677767 - DNA, 22 bp, Homo sapiens
aaatgtcagtagtgctaatgca

SEQ ID NO: 677768 - DNA, 21 bp, Homo sapiens
aaatgtgtcctatctatcttc

SEQ ID NO: 677769 - DNA, 21 bp, Homo sapiens
aaatgtgtgccatattctggt

SEQ ID NO: 677770 - DNA, 17 bp, Homo sapiens
aaatgtttaataaagct

SEQ ID NO: 677771 - DNA, 15 bp, Homo sapiens
aaatgtttatactgt

SEQ ID NO: 677772 - DNA, 10 bp, Homo sapiens
aaatgtttct

SEQ ID NO: 677773 - DNA, 15 bp, Homo sapiens
ctgaagaattaagat

SEQ ID NO: 677774 - DNA, 15 bp, Homo sapiens
ctgaagatgggagcc

SEQ ID NO: 677775 - DNA, 17 bp, Homo sapiens
ctgaagatgggagcctt

SEQ ID NO: 677776 - DNA, 15 bp, Homo sapiens
ctgaagtcaaaatat

SEQ ID NO: 677777 - DNA, 21 bp, Homo sapiens
ctgaatattgccattatgctt

SEQ ID NO: 677778 - DNA, 13 bp, Homo sapiens
ctgaatatttttt

SEQ ID NO: 677779 - DNA, 22 bp, Homo sapiens
ctcacttcctttgcccttcctc

SEQ ID NO: 677780 - DNA, 18 bp, Homo sapiens
ctcctgccctcctctccc

SEQ ID NO: 677781 - DNA, 13 bp, Homo sapiens
ctcctggcctatc

SEQ ID NO: 677782 - DNA, 16 bp, Homo sapiens
ctaataaatataattt

SEQ ID NO: 677783 - DNA, 13 bp, Homo sapiens
ctaatgatgtttt

SEQ ID NO: 677784 - DNA, 21 bp, Homo sapiens
ctaatgcattttgcactagaa

SEQ ID NO: 677785 - DNA, 20 bp, Homo sapiens
ctaatgtttatgagccagac

SEQ ID NO: 677786 - DNA, 19 bp, Homo sapiens
ctaattattattttaaaat

SEQ ID NO: 677787 - DNA, 16 bp, Homo sapiens
ctaattcttctgtcct

SEQ ID NO: 677788 - DNA, 17 bp, Homo sapiens
ctaattgtaagtgaaat

SEQ ID NO: 677789 - DNA, 20 bp, Homo sapiens
ctaattgtaagtgaaattaa

SEQ ID NO: 677790 - DNA, 21 bp, Homo sapiens
ctaattgtaagtgaaattaag

SEQ ID NO: 677791 - DNA, 20 bp, Homo sapiens
ctaattttacacattagatt

SEQ ID NO: 677792 - DNA, 21 bp, Homo sapiens
ctacaatctctttttgtttgc

SEQ ID NO: 677793 - DNA, 21 bp, Homo sapiens
ctacaattaatagtttgtcta

SEQ ID NO: 677794 - DNA, 14 bp, Homo sapiens
ctacacaatacagt

SEQ ID NO: 677795 - DNA, 17 bp, Homo sapiens
ctacacaatacagtatt

SEQ ID NO: 677796 - DNA, 20 bp, Homo sapiens
ctacacaatacagtattata

SEQ ID NO: 677797 - DNA, 13 bp, Homo sapiens
ctacaccaatgaa

SEQ ID NO: 677798 - DNA, 14 bp, Homo sapiens
ctacaccaatgaaa

SEQ ID NO: 677799 - DNA, 18 bp, Homo sapiens
ctacagactccatctctt

SEQ ID NO: 677800 - DNA, 20 bp, Homo sapiens
ctacagactccatctcttct

SEQ ID NO: 677801 - DNA, 16 bp, Homo sapiens
ctacagctatatttga

SEQ ID NO: 677802 - DNA, 15 bp, Homo sapiens
ctacagtgactccct

SEQ ID NO: 677803 - DNA, 20 bp, Homo sapiens
ctacagtgactccctgggag

SEQ ID NO: 677804 - DNA, 18 bp, Homo sapiens
ctacatatgctgatcttt

SEQ ID NO: 677805 - DNA, 23 bp, Homo sapiens
ctacatttatcatggtcctgaat

SEQ ID NO: 677806 - DNA, 22 bp, Homo sapiens
ctacccgatttgtttatttgca

SEQ ID NO: 677807 - DNA, 17 bp, Homo sapiens
ctaccctccgtttttct

SEQ ID NO: 677808 - DNA, 14 bp, Homo sapiens
ctacccttttcctt

SEQ ID NO: 677809 - DNA, 17 bp, Homo sapiens
ctacccttttccttttt

SEQ ID NO: 677810 - DNA, 11 bp, Homo sapiens
ctacctccctc

SEQ ID NO: 677811 - DNA, 23 bp, Homo sapiens
ctacctccctccccgtctcattc

SEQ ID NO: 677812 - DNA, 20 bp, Homo sapiens
ctactaagttcacattagaa

SEQ ID NO: 677813 - DNA, 13 bp, Homo sapiens
ctactaatgatgt

SEQ ID NO: 677814 - DNA, 15 bp, Homo sapiens
ctactcctagaagaa

SEQ ID NO: 677815 - DNA, 16 bp, Homo sapiens
ctactcctagaagaac

SEQ ID NO: 677816 - DNA, 18 bp, Homo sapiens
ctactcctagaagaacca

SEQ ID NO: 677817 - DNA, 14 bp, Homo sapiens
ctactcctgcctca

SEQ ID NO: 677818 - DNA, 13 bp, Homo sapiens
ctactgaaacaga

SEQ ID NO: 677819 - DNA, 20 bp, Homo sapiens
ctactgaaacagatttcata

SEQ ID NO: 677820 - DNA, 19 bp, Homo sapiens
ctactgcactccagcctgg

SEQ ID NO: 677821 - DNA, 21 bp, Homo sapiens
ctactgcactccagcctgggg

SEQ ID NO: 677822 - DNA, 23 bp, Homo sapiens
ctactgcactccagcctggggga

SEQ ID NO: 677823 - DNA, 14 bp, Homo sapiens
ctactgccttgaaa

SEQ ID NO: 677824 - DNA, 20 bp, Homo sapiens
ctacttctggaagtcatctc

SEQ ID NO: 677825 - DNA, 18 bp, Homo sapiens
ctacttggggacataatt

SEQ ID NO: 677826 - DNA, 19 bp, Homo sapiens
ctagaagaaccaaatacct

SEQ ID NO: 677827 - DNA, 13 bp, Homo sapiens
ctagagccctctc

SEQ ID NO: 677828 - DNA, 14 bp, Homo sapiens
ctagagcttttatt

SEQ ID NO: 677829 - DNA, 16 bp, Homo sapiens
ctagagttttatcaac

SEQ ID NO: 677830 - DNA, 20 bp, Homo sapiens
ctagcagcccaccctgctgc

SEQ ID NO: 677831 - DNA, 15 bp, Homo sapiens
ctagcagtccccagc

SEQ ID NO: 677832 - DNA, 17 bp, Homo sapiens
ctagcgatctctcctgg

SEQ ID NO: 677833 - DNA, 18 bp, Homo sapiens
ctagcgatctctcctggc

SEQ ID NO: 677834 - DNA, 20 bp, Homo sapiens
ctagcgatctctcctggcct

SEQ ID NO: 677835 - DNA, 14 bp, Homo sapiens
ctagctatatatgg

SEQ ID NO: 677836 - DNA, 23 bp, Homo sapiens
ctaggagaaggaggggaaccaga

SEQ ID NO: 677837 - DNA, 20 bp, Homo sapiens
ctaggaggagctagtaggaa

SEQ ID NO: 677838 - DNA, 16 bp, Homo sapiens
ctagggccttggaaat

SEQ ID NO: 677839 - DNA, 20 bp, Homo sapiens
ctaggtatcattcaactctc

SEQ ID NO: 677840 - DNA, 13 bp, Homo sapiens
ctaggtcctggct

SEQ ID NO: 677841 - DNA, 14 bp, Homo sapiens
ctaggtcctggctg

SEQ ID NO: 677842 - DNA, 16 bp, Homo sapiens
ctagtagtgtggcctg

SEQ ID NO: 677843 - DNA, 21 bp, Homo sapiens
ctagtagtgtggcctgtgcca

SEQ ID NO: 677844 - DNA, 19 bp, Homo sapiens
ctagtgtacctcctctcag

SEQ ID NO: 677845 - DNA, 13 bp, Homo sapiens
ctagtgtttctag

SEQ ID NO: 677846 - DNA, 16 bp, Homo sapiens
ctagttctaacagtga

SEQ ID NO: 677847 - DNA, 21 bp, Homo sapiens
ctagtttcttacacactgtct

SEQ ID NO: 677848 - DNA, 13 bp, Homo sapiens
ctataataaaggc

SEQ ID NO: 677849 - DNA, 14 bp, Homo sapiens
ctataataaaggct

SEQ ID NO: 677850 - DNA, 17 bp, Homo sapiens
ctataatcccagcattt

SEQ ID NO: 677851 - DNA, 15 bp, Homo sapiens
ctatagcttgcagaa

SEQ ID NO: 677852 - DNA, 19 bp, Homo sapiens
ctatatgtgaaacattttt

SEQ ID NO: 677853 - DNA, 18 bp, Homo sapiens
ctatattgattgtccttt

SEQ ID NO: 677854 - DNA, 23 bp, Homo sapiens
ctatatttgattatgtatggata

SEQ ID NO: 677855 - DNA, 17 bp, Homo sapiens
ctatccccatctccctg

SEQ ID NO: 677856 - DNA, 22 bp, Homo sapiens
ctatccttataggcctgtccct

SEQ ID NO: 677857 - DNA, 17 bp, Homo sapiens
ctatctgattttgtgca

SEQ ID NO: 677858 - DNA, 14 bp, Homo sapiens
ctatcttccaaatg

SEQ ID NO: 677859 - DNA, 16 bp, Homo sapiens
ctatgaagccaactga

SEQ ID NO: 677860 - DNA, 12 bp, Homo sapiens
ctatgaggaaag

SEQ ID NO: 677861 - DNA, 13 bp, Homo sapiens
ctatgaggaaagg

SEQ ID NO: 677862 - DNA, 14 bp, Homo sapiens
ctatgaggaaaggt

SEQ ID NO: 677863 - DNA, 19 bp, Homo sapiens
ctatgatttaatttgaaat

SEQ ID NO: 677864 - DNA, 15 bp, Homo sapiens
ctatgcaggcagcac

SEQ ID NO: 677865 - DNA, 22 bp, Homo sapiens
ctatgcatattcaatgtattga

SEQ ID NO: 677866 - DNA, 18 bp, Homo sapiens
ctatggaacataaagttg

SEQ ID NO: 677867 - DNA, 22 bp, Homo sapiens
ctatggaacataaagttgtatt

SEQ ID NO: 677868 - DNA, 20 bp, Homo sapiens
ctatggcaggataagaaagc

SEQ ID NO: 677869 - DNA, 14 bp, Homo sapiens
ctatgtatatacat

SEQ ID NO: 677870 - DNA, 18 bp, Homo sapiens
ctatgttactattttcta

SEQ ID NO: 677871 - DNA, 18 bp, Homo sapiens
ctattatttttataattg

SEQ ID NO: 677872 - DNA, 12 bp, Homo sapiens
ctattccaataa

SEQ ID NO: 677873 - DNA, 14 bp, Homo sapiens
ctattctagagctt

SEQ ID NO: 677874 - DNA, 15 bp, Homo sapiens
ctattctagagcttt

SEQ ID NO: 677875 - DNA, 18 bp, Homo sapiens
ctattctagagcttttat

SEQ ID NO: 677876 - DNA, 16 bp, Homo sapiens
ctattgacttttcaat

SEQ ID NO: 677877 - DNA, 15 bp, Homo sapiens
ctatttaagatgtga

SEQ ID NO: 677878 - DNA, 14 bp, Homo sapiens
ctatttaatacagc

SEQ ID NO: 677879 - DNA, 21 bp, Homo sapiens
ctatttctgggtcttttgcta

SEQ ID NO: 677880 - DNA, 22 bp, Homo sapiens
ctatttctgggtcttttgctac

SEQ ID NO: 677881 - DNA, 14 bp, Homo sapiens
ctattttaaaataa

SEQ ID NO: 677882 - DNA, 13 bp, Homo sapiens
ctcaaaacaaagg

SEQ ID NO: 677883 - DNA, 16 bp, Homo sapiens
ctcaaagatctgaatt

SEQ ID NO: 677884 - DNA, 21 bp, Homo sapiens
ctcaaatcagtgataattggt

SEQ ID NO: 677885 - DNA, 11 bp, Homo sapiens
ctcaagctttc

SEQ ID NO: 677886 - DNA, 13 bp, Homo sapiens
ctcaagctttccc

SEQ ID NO: 677887 - DNA, 20 bp, Homo sapiens
ctcaatgaaccataaattca

SEQ ID NO: 677888 - DNA, 13 bp, Homo sapiens
ctcaattatttgc

SEQ ID NO: 677889 - DNA, 14 bp, Homo sapiens
ctcaattatttgca

SEQ ID NO: 677890 - DNA, 18 bp, Homo sapiens
ctcaatttttgtctcaga

SEQ ID NO: 677891 - DNA, 22 bp, Homo sapiens
ctcaatttttgtttttgagtac

SEQ ID NO: 677892 - DNA, 13 bp, Homo sapiens
ctcacagtacagc

SEQ ID NO: 677893 - DNA, 15 bp, Homo sapiens
ctcacccacctctgg

SEQ ID NO: 677894 - DNA, 16 bp, Homo sapiens
ctcacccacctctggg

SEQ ID NO: 677895 - DNA, 12 bp, Homo sapiens
ctcaccccactc

SEQ ID NO: 677896 - DNA, 14 bp, Homo sapiens
ctcacccttgcacc

SEQ ID NO: 677897 - DNA, 14 bp, Homo sapiens
ctcaccgcccatca

SEQ ID NO: 677898 - DNA, 17 bp, Homo sapiens
ctcaccgcccatcaggg

SEQ ID NO: 677899 - DNA, 19 bp, Homo sapiens
ctcactaaagcatgaaatg

SEQ ID NO: 677900 - DNA, 15 bp, Homo sapiens
ctcacttcctttgcc

SEQ ID NO: 677901 - DNA, 14 bp, Homo sapiens
cgaacgtggtctga

SEQ ID NO: 677902 - DNA, 20 bp, Homo sapiens
cgaagaccctcttgcccatc

SEQ ID NO: 677903 - DNA, 15 bp, Homo sapiens
cgaagagttcccttg

SEQ ID NO: 677904 - DNA, 18 bp, Homo sapiens
cgacacacggggctcggg

SEQ ID NO: 677905 - DNA, 20 bp, Homo sapiens
cgacacacggggctcgggcc

SEQ ID NO: 677906 - DNA, 12 bp, Homo sapiens
cgacctttacct

SEQ ID NO: 677907 - DNA, 13 bp, Homo sapiens
cgagaccatcctg

SEQ ID NO: 677908 - DNA, 15 bp, Homo sapiens
cgagaccatcctggc

SEQ ID NO: 677909 - DNA, 23 bp, Homo sapiens
cgagagcctcgctttttcatcct

SEQ ID NO: 677910 - DNA, 22 bp, Homo sapiens
cgagagcttggactacacaata

SEQ ID NO: 677911 - DNA, 12 bp, Homo sapiens
cgatcaggagga

SEQ ID NO: 677912 - DNA, 18 bp, Homo sapiens
cgatgtaggcattctgga

SEQ ID NO: 677913 - DNA, 14 bp, Homo sapiens
cgatttaaggtatt

SEQ ID NO: 677914 - DNA, 13 bp, Homo sapiens
cgatttgtttatt

SEQ ID NO: 677915 - DNA, 13 bp, Homo sapiens
cgcagaagcagac

SEQ ID NO: 677916 - DNA, 16 bp, Homo sapiens
cgcaggcagcgcaggg

SEQ ID NO: 677917 - DNA, 17 bp, Homo sapiens
cgcaggcagcgcagggc

SEQ ID NO: 677918 - DNA, 20 bp, Homo sapiens
cgcaggcagcgcagggctgg

SEQ ID NO: 677919 - DNA, 21 bp, Homo sapiens
cgcaggcagcgcagggctggc

SEQ ID NO: 677920 - DNA, 13 bp, Homo sapiens
cgcaggtgggctg

SEQ ID NO: 677921 - DNA, 14 bp, Homo sapiens
cgcaggtgggctgg

SEQ ID NO: 677922 - DNA, 16 bp, Homo sapiens
cgcatcttgcctccag

SEQ ID NO: 677923 - DNA, 23 bp, Homo sapiens
cgccaggagcttcttcgttcctg

SEQ ID NO: 677924 - DNA, 20 bp, Homo sapiens
cgcccttccatgtgcctttc

SEQ ID NO: 677925 - DNA, 20 bp, Homo sapiens
cgccgatagagggacggcca

SEQ ID NO: 677926 - DNA, 15 bp, Homo sapiens
cgcctcctcctcctg

SEQ ID NO: 677927 - DNA, 16 bp, Homo sapiens
cgcctgaaagccacaa

SEQ ID NO: 677928 - DNA, 19 bp, Homo sapiens
cgcctgcttcttctctcca

SEQ ID NO: 677929 - DNA, 15 bp, Homo sapiens
cgcctttttggcctg

SEQ ID NO: 677930 - DNA, 15 bp, Homo sapiens
cgcgtctgcctgggc

SEQ ID NO: 677931 - DNA, 21 bp, Homo sapiens
cgctgccagccttgagccctg

SEQ ID NO: 677932 - DNA, 15 bp, Homo sapiens
cgctgccccatgtgt

SEQ ID NO: 677933 - DNA, 24 bp, Homo sapiens
cgctgcttggtgtgacccacggag

SEQ ID NO: 677934 - DNA, 22 bp, Homo sapiens
cgcttcaaggatatactgcagc

SEQ ID NO: 677935 - DNA, 21 bp, Homo sapiens
cgcttttaataaactgcaagt

SEQ ID NO: 677936 - DNA, 20 bp, Homo sapiens
cgctttttcatccttctttc

SEQ ID NO: 677937 - DNA, 20 bp, Homo sapiens
cggaggcctcgagcagagag

SEQ ID NO: 677938 - DNA, 20 bp, Homo sapiens
cggaggcctgcgaccctggg

SEQ ID NO: 677939 - DNA, 22 bp, Homo sapiens
cggaggttgcagtgagctgaga

SEQ ID NO: 677940 - DNA, 15 bp, Homo sapiens
cggccctgtgtgcag

SEQ ID NO: 677941 - DNA, 18 bp, Homo sapiens
cggctttttgccatctgt

SEQ ID NO: 677942 - DNA, 23 bp, Homo sapiens
cgggacatcacagggtgggcctc

SEQ ID NO: 677943 - DNA, 22 bp, Homo sapiens
cgggagacagaggttgcagtga

SEQ ID NO: 677944 - DNA, 10 bp, Homo sapiens
cgggagggga

SEQ ID NO: 677945 - DNA, 12 bp, Homo sapiens
cgggaggggagg

SEQ ID NO: 677946 - DNA, 19 bp, Homo sapiens
cgggggccccacctcggca

SEQ ID NO: 677947 - DNA, 22 bp, Homo sapiens
cggtcagaggagcgcaggcagc

SEQ ID NO: 677948 - DNA, 13 bp, Homo sapiens
cggtcagtgcctt

SEQ ID NO: 677949 - DNA, 15 bp, Homo sapiens
cggtctcctgactgg

SEQ ID NO: 677950 - DNA, 16 bp, Homo sapiens
cggtgagaactctgcc

SEQ ID NO: 677951 - DNA, 17 bp, Homo sapiens
cggtgtatcctggccct

SEQ ID NO: 677952 - DNA, 22 bp, Homo sapiens
cggtgtatcctggccctggggg

SEQ ID NO: 677953 - DNA, 16 bp, Homo sapiens
cggtttccagggaggg

SEQ ID NO: 677954 - DNA, 23 bp, Homo sapiens
cgtacaaccccctccacccccca

SEQ ID NO: 677955 - DNA, 15 bp, Homo sapiens
cgtagctctgctgct

SEQ ID NO: 677956 - DNA, 14 bp, Homo sapiens
cgtcagccacctgg

SEQ ID NO: 677957 - DNA, 15 bp, Homo sapiens
cgtcagtgcctaccc

SEQ ID NO: 677958 - DNA, 15 bp, Homo sapiens
cgtccagctcagccc

SEQ ID NO: 677959 - DNA, 11 bp, Homo sapiens
cgtctccctcg

SEQ ID NO: 677960 - DNA, 21 bp, Homo sapiens
cgtcttaagtcagatttttat

SEQ ID NO: 677961 - DNA, 17 bp, Homo sapiens
cgtgcatccctgagaca

SEQ ID NO: 677962 - DNA, 14 bp, Homo sapiens
cgtgcatgctctgc

SEQ ID NO: 677963 - DNA, 17 bp, Homo sapiens
cgtgctactgcactcca

SEQ ID NO: 677964 - DNA, 20 bp, Homo sapiens
cgtgctccgtagctctgctg

SEQ ID NO: 677965 - DNA, 13 bp, Homo sapiens
cgtggagggaggc

SEQ ID NO: 677966 - DNA, 20 bp, Homo sapiens
cgtggagggaggccccaggg

SEQ ID NO: 677967 - DNA, 17 bp, Homo sapiens
cgtggcacacactgacc

SEQ ID NO: 677968 - DNA, 15 bp, Homo sapiens
cgtggcacagctggg

SEQ ID NO: 677969 - DNA, 20 bp, Homo sapiens
cgtggcacagctgggagcct

SEQ ID NO: 677970 - DNA, 22 bp, Homo sapiens
cgtggcacagctgggagcctgg

SEQ ID NO: 677971 - DNA, 14 bp, Homo sapiens
cgtgggagccagcc

SEQ ID NO: 677972 - DNA, 16 bp, Homo sapiens
cgtggggcagggagct

SEQ ID NO: 677973 - DNA, 23 bp, Homo sapiens
cgtggggcagggagctgggcccg

SEQ ID NO: 677974 - DNA, 16 bp, Homo sapiens
cgtgggggggcgtgga

SEQ ID NO: 677975 - DNA, 17 bp, Homo sapiens
cgtgtattgagatttct

SEQ ID NO: 677976 - DNA, 15 bp, Homo sapiens
cgtgtgagtgtgaca

SEQ ID NO: 677977 - DNA, 17 bp, Homo sapiens
cgtgtgagtgtgacagg

SEQ ID NO: 677978 - DNA, 15 bp, Homo sapiens
cgtgtgcctgtgtgc

SEQ ID NO: 677979 - DNA, 22 bp, Homo sapiens
cgtgtgtgtgtgtgtgtgtgca

SEQ ID NO: 677980 - DNA, 20 bp, Homo sapiens
cgttctgtactgttactggg

SEQ ID NO: 677981 - DNA, 15 bp, Homo sapiens
cgttgcacagctgtt

SEQ ID NO: 677982 - DNA, 15 bp, Homo sapiens
cgttggttaaataaa

SEQ ID NO: 677983 - DNA, 17 bp, Homo sapiens
cgttgtctgtggatggt

SEQ ID NO: 677984 - DNA, 12 bp, Homo sapiens
cgtttctccttt

SEQ ID NO: 677985 - DNA, 16 bp, Homo sapiens
cgtttctccttttcct

SEQ ID NO: 677986 - DNA, 16 bp, Homo sapiens
ctaaaagcatgaattg

SEQ ID NO: 677987 - DNA, 21 bp, Homo sapiens
ctaaaagcatgaattggaact

SEQ ID NO: 677988 - DNA, 15 bp, Homo sapiens
ctaaaagctctgttc

SEQ ID NO: 677989 - DNA, 15 bp, Homo sapiens
ctaaaataattttgt

SEQ ID NO: 677990 - DNA, 19 bp, Homo sapiens
ctaaactggtgtttttccc

SEQ ID NO: 677991 - DNA, 16 bp, Homo sapiens
ctaaagagagaatgta

SEQ ID NO: 677992 - DNA, 19 bp, Homo sapiens
ctaaagagagaatgtagat

SEQ ID NO: 677993 - DNA, 18 bp, Homo sapiens
ctaaagaggctgaaagag

SEQ ID NO: 677994 - DNA, 19 bp, Homo sapiens
ctaaagcatgaaatgtgaa

SEQ ID NO: 677995 - DNA, 19 bp, Homo sapiens
ctaaaggggactagacagt

SEQ ID NO: 677996 - DNA, 16 bp, Homo sapiens
ctaaaggtgtatttaa

SEQ ID NO: 677997 - DNA, 15 bp, Homo sapiens
ctaaattagataaat

SEQ ID NO: 677998 - DNA, 16 bp, Homo sapiens
ctaaatttatattcat

SEQ ID NO: 677999 - DNA, 13 bp, Homo sapiens
ctaaatttcacta

SEQ ID NO: 678000 - DNA, 15 bp, Homo sapiens
ctaacatgttatcaa

SEQ ID NO: 678001 - DNA, 22 bp, Homo sapiens
ctaacattgtgactttgctttg

SEQ ID NO: 678002 - DNA, 16 bp, Homo sapiens
ctaaccactaacattg

SEQ ID NO: 678003 - DNA, 13 bp, Homo sapiens
ctaaccatttata

SEQ ID NO: 678004 - DNA, 14 bp, Homo sapiens
ctaacgccagcaca

SEQ ID NO: 678005 - DNA, 14 bp, Homo sapiens
ctaactcaaataca

SEQ ID NO: 678006 - DNA, 14 bp, Homo sapiens
ctaactctgagagc

SEQ ID NO: 678007 - DNA, 18 bp, Homo sapiens
ctaactctgagagctgtt

SEQ ID NO: 678008 - DNA, 19 bp, Homo sapiens
ctaacttttcttaaggttt

SEQ ID NO: 678009 - DNA, 15 bp, Homo sapiens
ctaagaagacatttt

SEQ ID NO: 678010 - DNA, 19 bp, Homo sapiens
ctaagaagacattttgtta

SEQ ID NO: 678011 - DNA, 17 bp, Homo sapiens
ctaagaagttgtttgag

SEQ ID NO: 678012 - DNA, 14 bp, Homo sapiens
ctaagaggtgggag

SEQ ID NO: 678013 - DNA, 17 bp, Homo sapiens
ctaagcagcttattgtt

SEQ ID NO: 678014 - DNA, 14 bp, Homo sapiens
ctaagctgcggaat

SEQ ID NO: 678015 - DNA, 14 bp, Homo sapiens
ctaagtcattcata

SEQ ID NO: 678016 - DNA, 14 bp, Homo sapiens
cctggagcagagga

SEQ ID NO: 678017 - DNA, 22 bp, Homo sapiens
cctggaggtccctggtcggaga

SEQ ID NO: 678018 - DNA, 17 bp, Homo sapiens
cctggcacagaccaggc

SEQ ID NO: 678019 - DNA, 19 bp, Homo sapiens
cctggcacagaccaggcct

SEQ ID NO: 678020 - DNA, 22 bp, Homo sapiens
cctggcagacttgcccaggtca

SEQ ID NO: 678021 - DNA, 17 bp, Homo sapiens
cctggcagggccacctg

SEQ ID NO: 678022 - DNA, 22 bp, Homo sapiens
cctggcagggccacctgcagga

SEQ ID NO: 678023 - DNA, 14 bp, Homo sapiens
cctggccatttcca

SEQ ID NO: 678024 - DNA, 19 bp, Homo sapiens
cctggcccccaacctcagg

SEQ ID NO: 678025 - DNA, 21 bp, Homo sapiens
cctggccttgtcctcagccag

SEQ ID NO: 678026 - DNA, 19 bp, Homo sapiens
cctggcgcaggtgggctgg

SEQ ID NO: 678027 - DNA, 23 bp, Homo sapiens
cctggcgcaggtgggctggactt

SEQ ID NO: 678028 - DNA, 22 bp, Homo sapiens
cctggcggtgtataccaggcag

SEQ ID NO: 678029 - DNA, 23 bp, Homo sapiens
cctggcgtcccctccctctgtct

SEQ ID NO: 678030 - DNA, 19 bp, Homo sapiens
cctggctccactcttgatc

SEQ ID NO: 678031 - DNA, 20 bp, Homo sapiens
cctggctccctcctccaggc

SEQ ID NO: 678032 - DNA, 18 bp, Homo sapiens
cctggctttgcctcttct

SEQ ID NO: 678033 - DNA, 13 bp, Homo sapiens
cctgggaacacag

SEQ ID NO: 678034 - DNA, 21 bp, Homo sapiens
cctgggaacacatctggctgc

SEQ ID NO: 678035 - DNA, 15 bp, Homo sapiens
cctgggccagggtct

SEQ ID NO: 678036 - DNA, 17 bp, Homo sapiens
cctgggccgtggcacag

SEQ ID NO: 678037 - DNA, 22 bp, Homo sapiens
cctgggccgtggcacagctggg

SEQ ID NO: 678038 - DNA, 14 bp, Homo sapiens
cctgggctcagcct

SEQ ID NO: 678039 - DNA, 19 bp, Homo sapiens
cctgggctggggcctcaga

SEQ ID NO: 678040 - DNA, 22 bp, Homo sapiens
cctgggctggggcctcagaccc

SEQ ID NO: 678041 - DNA, 15 bp, Homo sapiens
cctgggggcacagga

SEQ ID NO: 678042 - DNA, 15 bp, Homo sapiens
cctggggtgcatctc

SEQ ID NO: 678043 - DNA, 22 bp, Homo sapiens
cctggggtgtcctacagtgact

SEQ ID NO: 678044 - DNA, 19 bp, Homo sapiens
cctgggtgtctgggctcaa

SEQ ID NO: 678045 - DNA, 15 bp, Homo sapiens
cctggtccccactgc

SEQ ID NO: 678046 - DNA, 18 bp, Homo sapiens
cctggtccccactgctga

SEQ ID NO: 678047 - DNA, 15 bp, Homo sapiens
cctggtgagaaaata

SEQ ID NO: 678048 - DNA, 23 bp, Homo sapiens
cctggtgagtaacttagaaaagt

SEQ ID NO: 678049 - DNA, 13 bp, Homo sapiens
cctgtaaatatat

SEQ ID NO: 678050 - DNA, 15 bp, Homo sapiens
cctgtaatcccagca

SEQ ID NO: 678051 - DNA, 16 bp, Homo sapiens
cctgtaatcccagcac

SEQ ID NO: 678052 - DNA, 13 bp, Homo sapiens
cctgtagtcccag

SEQ ID NO: 678053 - DNA, 22 bp, Homo sapiens
cctgtatcctccctggcagaca

SEQ ID NO: 678054 - DNA, 15 bp, Homo sapiens
cctgtcccttgcctc

SEQ ID NO: 678055 - DNA, 16 bp, Homo sapiens
cctgtcccttgcctct

SEQ ID NO: 678056 - DNA, 16 bp, Homo sapiens
cctgtcccttttccct

SEQ ID NO: 678057 - DNA, 17 bp, Homo sapiens
cctgtcctaaggaacct

SEQ ID NO: 678058 - DNA, 14 bp, Homo sapiens
cctgtctcagctgt

SEQ ID NO: 678059 - DNA, 21 bp, Homo sapiens
cctgtggaatgagtgtgcatg

SEQ ID NO: 678060 - DNA, 18 bp, Homo sapiens
cctgtggcataaattgca

SEQ ID NO: 678061 - DNA, 17 bp, Homo sapiens
cctgtgtccacctgtgg

SEQ ID NO: 678062 - DNA, 18 bp, Homo sapiens
cctgtgtccacctgtggg

SEQ ID NO: 678063 - DNA, 19 bp, Homo sapiens
cctgtgtccacctgtgggt

SEQ ID NO: 678064 - DNA, 12 bp, Homo sapiens
cctgtgtgcagg

SEQ ID NO: 678065 - DNA, 13 bp, Homo sapiens
cctgtgtgcaggt

SEQ ID NO: 678066 - DNA, 20 bp, Homo sapiens
cctgttctgaaatgttctta

SEQ ID NO: 678067 - DNA, 18 bp, Homo sapiens
cctgtttcagaggctcag

SEQ ID NO: 678068 - DNA, 13 bp, Homo sapiens
cctgtttccaggg

SEQ ID NO: 678069 - DNA, 14 bp, Homo sapiens
cctgtttccagggt

SEQ ID NO: 678070 - DNA, 13 bp, Homo sapiens
cctgttttttgta

SEQ ID NO: 678071 - DNA, 22 bp, Homo sapiens
ccttaaacacaggctgtcctta

SEQ ID NO: 678072 - DNA, 18 bp, Homo sapiens
ccttaacccacctctcct

SEQ ID NO: 678073 - DNA, 21 bp, Homo sapiens
ccttactcccccaccactcag

SEQ ID NO: 678074 - DNA, 22 bp, Homo sapiens
ccttactcccccaccactcagg

SEQ ID NO: 678075 - DNA, 13 bp, Homo sapiens
ccttactggctta

SEQ ID NO: 678076 - DNA, 18 bp, Homo sapiens
ccttactggcttacctcc

SEQ ID NO: 678077 - DNA, 22 bp, Homo sapiens
ccttactttactgcctgaataa

SEQ ID NO: 678078 - DNA, 10 bp, Homo sapiens
ccttagccag

SEQ ID NO: 678079 - DNA, 22 bp, Homo sapiens
ccttagtgggccagggctgccc

SEQ ID NO: 678080 - DNA, 13 bp, Homo sapiens
ccttatcagagct

SEQ ID NO: 678081 - DNA, 13 bp, Homo sapiens
ccttatccctctc

SEQ ID NO: 678082 - DNA, 16 bp, Homo sapiens
ccttatttgccttcta

SEQ ID NO: 678083 - DNA, 11 bp, Homo sapiens
ccttcacaaat

SEQ ID NO: 678084 - DNA, 20 bp, Homo sapiens
ccttcagatcagccacacct

SEQ ID NO: 678085 - DNA, 16 bp, Homo sapiens
ccttccaatgcttctg

SEQ ID NO: 678086 - DNA, 17 bp, Homo sapiens
ccttccatgtgcctttc

SEQ ID NO: 678087 - DNA, 20 bp, Homo sapiens
ccttccccgagtgactctgg

SEQ ID NO: 678088 - DNA, 22 bp, Homo sapiens
ccttccgcagtgtggccaggct

SEQ ID NO: 678089 - DNA, 19 bp, Homo sapiens
ccttcctcagctgcctcct

SEQ ID NO: 678090 - DNA, 20 bp, Homo sapiens
ccttcctcagctgcctcctg

SEQ ID NO: 678091 - DNA, 14 bp, Homo sapiens
ccttcctcctgcct

SEQ ID NO: 678092 - DNA, 20 bp, Homo sapiens
ccttctaacatgttatcaaa

SEQ ID NO: 678093 - DNA, 12 bp, Homo sapiens
ccttctctcaag

SEQ ID NO: 678094 - DNA, 14 bp, Homo sapiens
ccttctctgttggt

SEQ ID NO: 678095 - DNA, 17 bp, Homo sapiens
ccttctgctgaaagact

SEQ ID NO: 678096 - DNA, 13 bp, Homo sapiens
ccttctttgtaat

SEQ ID NO: 678097 - DNA, 12 bp, Homo sapiens
ccttcttttgta

SEQ ID NO: 678098 - DNA, 17 bp, Homo sapiens
ccttgaaaaatgacaat

SEQ ID NO: 678099 - DNA, 13 bp, Homo sapiens
ccttgaaaggaag

SEQ ID NO: 678100 - DNA, 16 bp, Homo sapiens
ccttgagaggagaaat

SEQ ID NO: 678101 - DNA, 17 bp, Homo sapiens
ccttgagccctggctgt

SEQ ID NO: 678102 - DNA, 22 bp, Homo sapiens
ccttgagccctggctgttctgt

SEQ ID NO: 678103 - DNA, 13 bp, Homo sapiens
ccttgatttcaaa

SEQ ID NO: 678104 - DNA, 14 bp, Homo sapiens
ccttgccccaggcc

SEQ ID NO: 678105 - DNA, 18 bp, Homo sapiens
ccttgccccaggccctgc

SEQ ID NO: 678106 - DNA, 19 bp, Homo sapiens
ccttgcccccagtgcctca

SEQ ID NO: 678107 - DNA, 11 bp, Homo sapiens
ccttgcctctg

SEQ ID NO: 678108 - DNA, 13 bp, Homo sapiens
ccttgcctctgcc

SEQ ID NO: 678109 - DNA, 18 bp, Homo sapiens
ccttgcctctgccctgga

SEQ ID NO: 678110 - DNA, 11 bp, Homo sapiens
ccttgctacct

SEQ ID NO: 678111 - DNA, 12 bp, Homo sapiens
ccttgctacctc

SEQ ID NO: 678112 - DNA, 13 bp, Homo sapiens
ccttgctctcctc

SEQ ID NO: 678113 - DNA, 19 bp, Homo sapiens
ccttgctgtttgtcctgag

SEQ ID NO: 678114 - DNA, 21 bp, Homo sapiens
ccttgctgtttgtcctgagat

SEQ ID NO: 678115 - DNA, 20 bp, Homo sapiens
ccttgcttcttactgataat

SEQ ID NO: 678116 - DNA, 21 bp, Homo sapiens
ccttgcttgcctgcagggcca

SEQ ID NO: 678117 - DNA, 18 bp, Homo sapiens
ccttgtcagggtctcctt

SEQ ID NO: 678118 - DNA, 21 bp, Homo sapiens
ccttgtcagggtctccttcct

SEQ ID NO: 678119 - DNA, 13 bp, Homo sapiens
ccttgtgcctggg

SEQ ID NO: 678120 - DNA, 21 bp, Homo sapiens
cctttaaaacgcgtctgcctg

SEQ ID NO: 678121 - DNA, 12 bp, Homo sapiens
cctttcaaagct

SEQ ID NO: 678122 - DNA, 13 bp, Homo sapiens
cctttccaggaat

SEQ ID NO: 678123 - DNA, 15 bp, Homo sapiens
cctttctctctctaa

SEQ ID NO: 678124 - DNA, 13 bp, Homo sapiens
cctttctgtccca

SEQ ID NO: 678125 - DNA, 17 bp, Homo sapiens
cctttcttatcttgacc

SEQ ID NO: 678126 - DNA, 13 bp, Homo sapiens
cctttctttgcct

SEQ ID NO: 678127 - DNA, 24 bp, Homo sapiens
cctttgcccttcctcctgcctttc

SEQ ID NO: 678128 - DNA, 16 bp, Homo sapiens
cagtctgataaactga

SEQ ID NO: 678129 - DNA, 15 bp, Homo sapiens
cagtgactccctggg

SEQ ID NO: 678130 - DNA, 17 bp, Homo sapiens
cagtgactccctgggag

SEQ ID NO: 678131 - DNA, 23 bp, Homo sapiens
cagtgagggtcttcttacatgca

SEQ ID NO: 678132 - DNA, 20 bp, Homo sapiens
cagtgcaaattgtatcttat

SEQ ID NO: 678133 - DNA, 12 bp, Homo sapiens
cagtgcagaatg

SEQ ID NO: 678134 - DNA, 15 bp, Homo sapiens
cagtgcagaatgtaa

SEQ ID NO: 678135 - DNA, 22 bp, Homo sapiens
cagtgcagaatgtaagtgggcc

SEQ ID NO: 678136 - DNA, 15 bp, Homo sapiens
cagtgcctcaccttc

SEQ ID NO: 678137 - DNA, 22 bp, Homo sapiens
cagtgcctcaccttccaacact

SEQ ID NO: 678138 - DNA, 15 bp, Homo sapiens
cagtgctaaagcctg

SEQ ID NO: 678139 - DNA, 19 bp, Homo sapiens
cagtgctaaagcctgtggg

SEQ ID NO: 678140 - DNA, 17 bp, Homo sapiens
cagtggccatcatcctc

SEQ ID NO: 678141 - DNA, 20 bp, Homo sapiens
cagtggctcacacctgtaat

SEQ ID NO: 678142 - DNA, 13 bp, Homo sapiens
cagtggggcctgt

SEQ ID NO: 678143 - DNA, 14 bp, Homo sapiens
cagtggggcctgtg

SEQ ID NO: 678144 - DNA, 15 bp, Homo sapiens
cagtggggcctgtgg

SEQ ID NO: 678145 - DNA, 16 bp, Homo sapiens
cagtggggctgcaggc

SEQ ID NO: 678146 - DNA, 17 bp, Homo sapiens
cagtgttgggttttttt

SEQ ID NO: 678147 - DNA, 19 bp, Homo sapiens
cagttatggtgatgactta

SEQ ID NO: 678148 - DNA, 15 bp, Homo sapiens
cagttatttctgttt

SEQ ID NO: 678149 - DNA, 23 bp, Homo sapiens
cagttatttctgtttcctattta

SEQ ID NO: 678150 - DNA, 14 bp, Homo sapiens
cagttattttgata

SEQ ID NO: 678151 - DNA, 17 bp, Homo sapiens
cagttattttgataaca

SEQ ID NO: 678152 - DNA, 13 bp, Homo sapiens
cagttctgggcaa

SEQ ID NO: 678153 - DNA, 13 bp, Homo sapiens
cagttgctgtgaa

SEQ ID NO: 678154 - DNA, 14 bp, Homo sapiens
cagttgcttgtctt

SEQ ID NO: 678155 - DNA, 21 bp, Homo sapiens
cagttgtagggttacagagac

SEQ ID NO: 678156 - DNA, 21 bp, Homo sapiens
cagttgtatgtttgctgatta

SEQ ID NO: 678157 - DNA, 18 bp, Homo sapiens
cagtttaaaaagatgaaa

SEQ ID NO: 678158 - DNA, 14 bp, Homo sapiens
cagtttgttggaaa

SEQ ID NO: 678159 - DNA, 22 bp, Homo sapiens
cagtttttaaaaacctgtatct

SEQ ID NO: 678160 - DNA, 15 bp, Homo sapiens
cataaaatacaaaaa

SEQ ID NO: 678161 - DNA, 14 bp, Homo sapiens
cataaagttgtatt

SEQ ID NO: 678162 - DNA, 19 bp, Homo sapiens
cataaattcaactttgtaa

SEQ ID NO: 678163 - DNA, 14 bp, Homo sapiens
cataacatccagag

SEQ ID NO: 678164 - DNA, 10 bp, Homo sapiens
cataactgta

SEQ ID NO: 678165 - DNA, 19 bp, Homo sapiens
cataagcttccattttaat

SEQ ID NO: 678166 - DNA, 19 bp, Homo sapiens
cataatgataaaataaata

SEQ ID NO: 678167 - DNA, 21 bp, Homo sapiens
cataattgcctacatttatca

SEQ ID NO: 678168 - DNA, 18 bp, Homo sapiens
cataattttttttaaaga

SEQ ID NO: 678169 - DNA, 19 bp, Homo sapiens
cataattttttttaaagaa

SEQ ID NO: 678170 - DNA, 16 bp, Homo sapiens
catacaagaaaatgta

SEQ ID NO: 678171 - DNA, 17 bp, Homo sapiens
catacaagaaaatgtat

SEQ ID NO: 678172 - DNA, 17 bp, Homo sapiens
catacctaccagtatta

SEQ ID NO: 678173 - DNA, 14 bp, Homo sapiens
catacgatttaagg

SEQ ID NO: 678174 - DNA, 19 bp, Homo sapiens
catacgcctcttgttcatg

SEQ ID NO: 678175 - DNA, 15 bp, Homo sapiens
catactaataaatat

SEQ ID NO: 678176 - DNA, 21 bp, Homo sapiens
catactaataaatataattta

SEQ ID NO: 678177 - DNA, 23 bp, Homo sapiens
catactaataaatataatttata

SEQ ID NO: 678178 - DNA, 22 bp, Homo sapiens
catactactgaaacagatttca

SEQ ID NO: 678179 - DNA, 17 bp, Homo sapiens
catactttgtattttga

SEQ ID NO: 678180 - DNA, 14 bp, Homo sapiens
catagaatctgtga

SEQ ID NO: 678181 - DNA, 14 bp, Homo sapiens
catagacatgaaag

SEQ ID NO: 678182 - DNA, 16 bp, Homo sapiens
catagacatgaaaggt

SEQ ID NO: 678183 - DNA, 16 bp, Homo sapiens
catagataatattgtt

SEQ ID NO: 678184 - DNA, 22 bp, Homo sapiens
catagataatattgtttggtaa

SEQ ID NO: 678185 - DNA, 17 bp, Homo sapiens
catagcaagcttttgct

SEQ ID NO: 678186 - DNA, 19 bp, Homo sapiens
catagtgaaaattgtttag

SEQ ID NO: 678187 - DNA, 14 bp, Homo sapiens
catagtgagacact

SEQ ID NO: 678188 - DNA, 23 bp, Homo sapiens
catatagcattgataatcttcag

SEQ ID NO: 678189 - DNA, 18 bp, Homo sapiens
catataggtgatgtttgc

SEQ ID NO: 678190 - DNA, 19 bp, Homo sapiens
catataggtgatgtttgct

SEQ ID NO: 678191 - DNA, 16 bp, Homo sapiens
catatagttaaactga

SEQ ID NO: 678192 - DNA, 19 bp, Homo sapiens
catatagttaaactgagag

SEQ ID NO: 678193 - DNA, 12 bp, Homo sapiens
catatatacttg

SEQ ID NO: 678194 - DNA, 14 bp, Homo sapiens
catatcctgagcca

SEQ ID NO: 678195 - DNA, 23 bp, Homo sapiens
catatgctgatcttttaaaatca

SEQ ID NO: 678196 - DNA, 14 bp, Homo sapiens
catatgtgtaaaga

SEQ ID NO: 678197 - DNA, 15 bp, Homo sapiens
catattaaataataa

SEQ ID NO: 678198 - DNA, 15 bp, Homo sapiens
catattacctggatt

SEQ ID NO: 678199 - DNA, 16 bp, Homo sapiens
catattgttggcacag

SEQ ID NO: 678200 - DNA, 22 bp, Homo sapiens
catattgttggcacagaacagg

SEQ ID NO: 678201 - DNA, 21 bp, Homo sapiens
catatttatccaaaatgtgta

SEQ ID NO: 678202 - DNA, 16 bp, Homo sapiens
catatttgaagggtct

SEQ ID NO: 678203 - DNA, 15 bp, Homo sapiens
catatttgatttcta

SEQ ID NO: 678204 - DNA, 18 bp, Homo sapiens
catatttgatttctaatt

SEQ ID NO: 678205 - DNA, 23 bp, Homo sapiens
catatttgatttctaattgtaag

SEQ ID NO: 678206 - DNA, 18 bp, Homo sapiens
catattttaaacagagga

SEQ ID NO: 678207 - DNA, 16 bp, Homo sapiens
catattttgagaaact

SEQ ID NO: 678208 - DNA, 17 bp, Homo sapiens
catcaaacctttgagta

SEQ ID NO: 678209 - DNA, 18 bp, Homo sapiens
catcaaacctttgagtag

SEQ ID NO: 678210 - DNA, 22 bp, Homo sapiens
catcaactcccaacttcttcct

SEQ ID NO: 678211 - DNA, 21 bp, Homo sapiens
catcaagaggtgggagggccc

SEQ ID NO: 678212 - DNA, 14 bp, Homo sapiens
catcaagtccatct

SEQ ID NO: 678213 - DNA, 21 bp, Homo sapiens
catcacagggtgggcctcggc

SEQ ID NO: 678214 - DNA, 22 bp, Homo sapiens
catcacagggtgggcctcggcc

SEQ ID NO: 678215 - DNA, 21 bp, Homo sapiens
cattgtaaaagcattttgtaa

SEQ ID NO: 678216 - DNA, 22 bp, Homo sapiens
cattgtaaaagcattttgtaat

SEQ ID NO: 678217 - DNA, 20 bp, Homo sapiens
catttaaaaagctcactgct

SEQ ID NO: 678218 - DNA, 20 bp, Homo sapiens
catttaaaacattaaaatat

SEQ ID NO: 678219 - DNA, 20 bp, Homo sapiens
catttaaaattgctatgtta

SEQ ID NO: 678220 - DNA, 22 bp, Homo sapiens
catttaaagaccaataaacttc

SEQ ID NO: 678221 - DNA, 12 bp, Homo sapiens
catttaagtttc

SEQ ID NO: 678222 - DNA, 22 bp, Homo sapiens
catttaatggggaggacaaaat

SEQ ID NO: 678223 - DNA, 20 bp, Homo sapiens
catttacattaggtattaca

SEQ ID NO: 678224 - DNA, 24 bp, Homo sapiens
catttacattaggtattacaagta

SEQ ID NO: 678225 - DNA, 17 bp, Homo sapiens
catttacctcgcagtgt

SEQ ID NO: 678226 - DNA, 21 bp, Homo sapiens
catttagcttgttccactgca

SEQ ID NO: 678227 - DNA, 23 bp, Homo sapiens
catttatcatggtcctgaatgta

SEQ ID NO: 678228 - DNA, 17 bp, Homo sapiens
catttcatgaaaatgac

SEQ ID NO: 678229 - DNA, 18 bp, Homo sapiens
catttcattcctaacaca

SEQ ID NO: 678230 - DNA, 15 bp, Homo sapiens
catttccattgctta

SEQ ID NO: 678231 - DNA, 15 bp, Homo sapiens
catttccttgtcccg

SEQ ID NO: 678232 - DNA, 14 bp, Homo sapiens
catttctctttaaa

SEQ ID NO: 678233 - DNA, 12 bp, Homo sapiens
catttcttccca

SEQ ID NO: 678234 - DNA, 19 bp, Homo sapiens
catttgaaacccctgtagg

SEQ ID NO: 678235 - DNA, 18 bp, Homo sapiens
catttgctactgttgtaa

SEQ ID NO: 678236 - DNA, 15 bp, Homo sapiens
catttgctttggaag

SEQ ID NO: 678237 - DNA, 21 bp, Homo sapiens
catttgtttctttctctgagg

SEQ ID NO: 678238 - DNA, 14 bp, Homo sapiens
cattttaaaatgtc

SEQ ID NO: 678239 - DNA, 15 bp, Homo sapiens
cattttaaaatgtct

SEQ ID NO: 678240 - DNA, 21 bp, Homo sapiens
cattttaaaatgtcttggtct

SEQ ID NO: 678241 - DNA, 16 bp, Homo sapiens
cattttacagatttct

SEQ ID NO: 678242 - DNA, 23 bp, Homo sapiens
cctagcagcccaccctgctgctg

SEQ ID NO: 678243 - DNA, 22 bp, Homo sapiens
cctagctacactgagcagggag

SEQ ID NO: 678244 - DNA, 16 bp, Homo sapiens
cctaggaaactcacac

SEQ ID NO: 678245 - DNA, 22 bp, Homo sapiens
cctaggaaactcacactcccct

SEQ ID NO: 678246 - DNA, 13 bp, Homo sapiens
cctaggctgctgc

SEQ ID NO: 678247 - DNA, 14 bp, Homo sapiens
cctaggtctccagt

SEQ ID NO: 678248 - DNA, 14 bp, Homo sapiens
cctataataaaggc

SEQ ID NO: 678249 - DNA, 15 bp, Homo sapiens
cctataataaaggct

SEQ ID NO: 678250 - DNA, 16 bp, Homo sapiens
cctataataaaggctg

SEQ ID NO: 678251 - DNA, 17 bp, Homo sapiens
cctataatcccagcatt

SEQ ID NO: 678252 - DNA, 21 bp, Homo sapiens
cctatctatcttccaaatgca

SEQ ID NO: 678253 - DNA, 19 bp, Homo sapiens
cctcaatttttgtctcaga

SEQ ID NO: 678254 - DNA, 17 bp, Homo sapiens
cctcacacaccctgagg

SEQ ID NO: 678255 - DNA, 13 bp, Homo sapiens
cctcagattcttc

SEQ ID NO: 678256 - DNA, 14 bp, Homo sapiens
cctcagctgcctcc

SEQ ID NO: 678257 - DNA, 18 bp, Homo sapiens
cctcagctgcctcctgcg

SEQ ID NO: 678258 - DNA, 22 bp, Homo sapiens
cctcagggagcagggaaggcct

SEQ ID NO: 678259 - DNA, 17 bp, Homo sapiens
cctcagggctcccaggg

SEQ ID NO: 678260 - DNA, 18 bp, Homo sapiens
cctcagggctcccagggg

SEQ ID NO: 678261 - DNA, 23 bp, Homo sapiens
cctcagttttatgccccattgga

SEQ ID NO: 678262 - DNA, 21 bp, Homo sapiens
cctcatgccaaccctgggcta

SEQ ID NO: 678263 - DNA, 23 bp, Homo sapiens
cctcattctggttccctgctgcg

SEQ ID NO: 678264 - DNA, 15 bp, Homo sapiens
cctccaggcctgcct

SEQ ID NO: 678265 - DNA, 18 bp, Homo sapiens
cctccaggcctgcctccc

SEQ ID NO: 678266 - DNA, 15 bp, Homo sapiens
cctccaggtgcagag

SEQ ID NO: 678267 - DNA, 18 bp, Homo sapiens
cctccaggtgcagaggta

SEQ ID NO: 678268 - DNA, 17 bp, Homo sapiens
cctccagtgtcagggtc

SEQ ID NO: 678269 - DNA, 16 bp, Homo sapiens
cctcccacttcactgc

SEQ ID NO: 678270 - DNA, 19 bp, Homo sapiens
cctcccactttgctgttcc

SEQ ID NO: 678271 - DNA, 17 bp, Homo sapiens
cctcccccattccctcc

SEQ ID NO: 678272 - DNA, 14 bp, Homo sapiens
cctccctctgtccc

SEQ ID NO: 678273 - DNA, 20 bp, Homo sapiens
cctccgaccacttccagggg

SEQ ID NO: 678274 - DNA, 20 bp, Homo sapiens
cctcctccagggtgatttta

SEQ ID NO: 678275 - DNA, 12 bp, Homo sapiens
cctcctcctcct

SEQ ID NO: 678276 - DNA, 13 bp, Homo sapiens
cctcctcctcctg

SEQ ID NO: 678277 - DNA, 13 bp, Homo sapiens
cctcctcctgccc

SEQ ID NO: 678278 - DNA, 16 bp, Homo sapiens
cctcctcctgccctcc

SEQ ID NO: 678279 - DNA, 15 bp, Homo sapiens
cctcctgcacacagg

SEQ ID NO: 678280 - DNA, 23 bp, Homo sapiens
cctccttatcctacagtacaatc

SEQ ID NO: 678281 - DNA, 13 bp, Homo sapiens
cctccttgtcagg

SEQ ID NO: 678282 - DNA, 19 bp, Homo sapiens
cctcgcctcctcctcctgc

SEQ ID NO: 678283 - DNA, 21 bp, Homo sapiens
cctcgcgggtgtcacattcct

SEQ ID NO: 678284 - DNA, 22 bp, Homo sapiens
cctcgcgggtgtcacattcctg

SEQ ID NO: 678285 - DNA, 13 bp, Homo sapiens
cctcgctttttca

SEQ ID NO: 678286 - DNA, 14 bp, Homo sapiens
cctcgctttttcat

SEQ ID NO: 678287 - DNA, 17 bp, Homo sapiens
cctcggcacacactgtg

SEQ ID NO: 678288 - DNA, 15 bp, Homo sapiens
cctcgttggaagagg

SEQ ID NO: 678289 - DNA, 20 bp, Homo sapiens
cctctcaagctagtgtttct

SEQ ID NO: 678290 - DNA, 21 bp, Homo sapiens
cctctcaagctagtgtttcta

SEQ ID NO: 678291 - DNA, 16 bp, Homo sapiens
cctctcaccccactcc

SEQ ID NO: 678292 - DNA, 19 bp, Homo sapiens
cctctcaccccactcctgt

SEQ ID NO: 678293 - DNA, 16 bp, Homo sapiens
cctctccctgggtctg

SEQ ID NO: 678294 - DNA, 17 bp, Homo sapiens
cctctcctgccctgtga

SEQ ID NO: 678295 - DNA, 18 bp, Homo sapiens
cctctcctgccctgtgat

SEQ ID NO: 678296 - DNA, 20 bp, Homo sapiens
cctctccttgcccccagtgc

SEQ ID NO: 678297 - DNA, 22 bp, Homo sapiens
cctctccttgcccccagtgcct

SEQ ID NO: 678298 - DNA, 13 bp, Homo sapiens
cctctcgcctcat

SEQ ID NO: 678299 - DNA, 15 bp, Homo sapiens
cctctcgcctcatta

SEQ ID NO: 678300 - DNA, 14 bp, Homo sapiens
cctctctggccttg

SEQ ID NO: 678301 - DNA, 16 bp, Homo sapiens
cctctgcagtctcatt

SEQ ID NO: 678302 - DNA, 14 bp, Homo sapiens
cctctgccctggat

SEQ ID NO: 678303 - DNA, 18 bp, Homo sapiens
cctctgctcaccgcccat

SEQ ID NO: 678304 - DNA, 20 bp, Homo sapiens
cctctgctcaccgcccatca

SEQ ID NO: 678305 - DNA, 12 bp, Homo sapiens
cctctgctccct

SEQ ID NO: 678306 - DNA, 13 bp, Homo sapiens
cctctgctccctc

SEQ ID NO: 678307 - DNA, 21 bp, Homo sapiens
cctctgggtccttggctcccg

SEQ ID NO: 678308 - DNA, 23 bp, Homo sapiens
cctctggtgtttattataaagct

SEQ ID NO: 678309 - DNA, 17 bp, Homo sapiens
cctctgtgacccctcct

SEQ ID NO: 678310 - DNA, 19 bp, Homo sapiens
cctcttctgctcttttcct

SEQ ID NO: 678311 - DNA, 21 bp, Homo sapiens
cctcttctgctcttttcctgg

SEQ ID NO: 678312 - DNA, 21 bp, Homo sapiens
cctcttctggtttccctttat

SEQ ID NO: 678313 - DNA, 12 bp, Homo sapiens
cctcttctttgt

SEQ ID NO: 678314 - DNA, 20 bp, Homo sapiens
cctcttctttgtgcctttgg

SEQ ID NO: 678315 - DNA, 22 bp, Homo sapiens
cctcttctttgtgcctttggcc

SEQ ID NO: 678316 - DNA, 23 bp, Homo sapiens
cctctttagtttttggttgggaa

SEQ ID NO: 678317 - DNA, 20 bp, Homo sapiens
cctgaaacctagtactgccc

SEQ ID NO: 678318 - DNA, 15 bp, Homo sapiens
cctgaaataatatat

SEQ ID NO: 678319 - DNA, 16 bp, Homo sapiens
cctgacggcgcctttt

SEQ ID NO: 678320 - DNA, 23 bp, Homo sapiens
cctgacggcgcctttttggcctg

SEQ ID NO: 678321 - DNA, 17 bp, Homo sapiens
cctgactcaattatttg

SEQ ID NO: 678322 - DNA, 21 bp, Homo sapiens
cctgactcaattatttgcata

SEQ ID NO: 678323 - DNA, 16 bp, Homo sapiens
cctgactcatcatttg

SEQ ID NO: 678324 - DNA, 13 bp, Homo sapiens
cctgactggtgct

SEQ ID NO: 678325 - DNA, 15 bp, Homo sapiens
cctgagccagcaggg

SEQ ID NO: 678326 - DNA, 14 bp, Homo sapiens
cctgaggtcaggga

SEQ ID NO: 678327 - DNA, 22 bp, Homo sapiens
cctgaggtcagggagtgctggc

SEQ ID NO: 678328 - DNA, 17 bp, Homo sapiens
cctgagtctgggcagct

SEQ ID NO: 678329 - DNA, 19 bp, Homo sapiens
cctgatgtgtcctcaggga

SEQ ID NO: 678330 - DNA, 21 bp, Homo sapiens
cctgatgtgtcctcagggagc

SEQ ID NO: 678331 - DNA, 20 bp, Homo sapiens
cctgcaaacagaacagggtc

SEQ ID NO: 678332 - DNA, 17 bp, Homo sapiens
cctgcacacagggcagt

SEQ ID NO: 678333 - DNA, 21 bp, Homo sapiens
cctgcaggaccctgtcctgca

SEQ ID NO: 678334 - DNA, 12 bp, Homo sapiens
cctgcagggcca

SEQ ID NO: 678335 - DNA, 17 bp, Homo sapiens
cctgcagggccatggct

SEQ ID NO: 678336 - DNA, 14 bp, Homo sapiens
cctgcagtcccaca

SEQ ID NO: 678337 - DNA, 17 bp, Homo sapiens
cctgcagtcccacactg

SEQ ID NO: 678338 - DNA, 13 bp, Homo sapiens
cctgccacctccc

SEQ ID NO: 678339 - DNA, 19 bp, Homo sapiens
cctgccatgccaggaacct

SEQ ID NO: 678340 - DNA, 13 bp, Homo sapiens
cctgccccctggg

SEQ ID NO: 678341 - DNA, 18 bp, Homo sapiens
cctgccccctgggctggg

SEQ ID NO: 678342 - DNA, 23 bp, Homo sapiens
cctgccccctgggctggggcctc

SEQ ID NO: 678343 - DNA, 13 bp, Homo sapiens
cctgccctcaagg

SEQ ID NO: 678344 - DNA, 14 bp, Homo sapiens
cctgccctcaaggg

SEQ ID NO: 678345 - DNA, 18 bp, Homo sapiens
cctgccctgttagctttc

SEQ ID NO: 678346 - DNA, 20 bp, Homo sapiens
cctgccctgttagctttcca

SEQ ID NO: 678347 - DNA, 15 bp, Homo sapiens
cctgcctgcagcagg

SEQ ID NO: 678348 - DNA, 17 bp, Homo sapiens
cctgccttggagagggc

SEQ ID NO: 678349 - DNA, 14 bp, Homo sapiens
cctgcgaccctggg

SEQ ID NO: 678350 - DNA, 12 bp, Homo sapiens
gaagacattttg

SEQ ID NO: 678351 - DNA, 18 bp, Homo sapiens
gaagacattttgttacat

SEQ ID NO: 678352 - DNA, 19 bp, Homo sapiens
gaagacccctgactcatca

SEQ ID NO: 678353 - DNA, 17 bp, Homo sapiens
gaagaccctcttgccca

SEQ ID NO: 678354 - DNA, 19 bp, Homo sapiens
gaagacgcagagcaaatga

SEQ ID NO: 678355 - DNA, 17 bp, Homo sapiens
gaagactttgtgactgt

SEQ ID NO: 678356 - DNA, 14 bp, Homo sapiens
gaagagattgctga

SEQ ID NO: 678357 - DNA, 22 bp, Homo sapiens
gaagagtcttggtttctctcta

SEQ ID NO: 678358 - DNA, 15 bp, Homo sapiens
gaagatggtggccac

SEQ ID NO: 678359 - DNA, 15 bp, Homo sapiens
gaagcaaagttcaac

SEQ ID NO: 678360 - DNA, 16 bp, Homo sapiens
gaagcaaagttcaact

SEQ ID NO: 678361 - DNA, 22 bp, Homo sapiens
gaagcagttgtaccaagtgaaa

SEQ ID NO: 678362 - DNA, 19 bp, Homo sapiens
gaagcctgcctggaagagc

SEQ ID NO: 678363 - DNA, 20 bp, Homo sapiens
gaagctgctccaggcctgca

SEQ ID NO: 678364 - DNA, 19 bp, Homo sapiens
gaagctggcctgagagggg

SEQ ID NO: 678365 - DNA, 22 bp, Homo sapiens
gaagctggcctgagaggggaag

SEQ ID NO: 678366 - DNA, 16 bp, Homo sapiens
gaagctgttgtgtgag

SEQ ID NO: 678367 - DNA, 14 bp, Homo sapiens
gaaggagcagaaag

SEQ ID NO: 678368 - DNA, 18 bp, Homo sapiens
gaaggagttacagggaag

SEQ ID NO: 678369 - DNA, 16 bp, Homo sapiens
gaaggcagacagcagg

SEQ ID NO: 678370 - DNA, 20 bp, Homo sapiens
gaagggaatcctcctccagg

SEQ ID NO: 678371 - DNA, 23 bp, Homo sapiens
gaagggaattgctcagagaagga

SEQ ID NO: 678372 - DNA, 15 bp, Homo sapiens
gaagggacttttatt

SEQ ID NO: 678373 - DNA, 16 bp, Homo sapiens
gaaggtgatttattct

SEQ ID NO: 678374 - DNA, 20 bp, Homo sapiens
gaaggtggaggttgcggtga

SEQ ID NO: 678375 - DNA, 13 bp, Homo sapiens
gaaggtttattgt

SEQ ID NO: 678376 - DNA, 22 bp, Homo sapiens
gaaggtttattgttaatacaag

SEQ ID NO: 678377 - DNA, 18 bp, Homo sapiens
gaagtaaattaggcagtg

SEQ ID NO: 678378 - DNA, 13 bp, Homo sapiens
gaagtaacttatt

SEQ ID NO: 678379 - DNA, 18 bp, Homo sapiens
gaagtaacttatttgact

SEQ ID NO: 678380 - DNA, 19 bp, Homo sapiens
gaagtctgtccaaatttaa

SEQ ID NO: 678381 - DNA, 16 bp, Homo sapiens
gaagtgcgtgaatgta

SEQ ID NO: 678382 - DNA, 12 bp, Homo sapiens
cttttaaagacc

SEQ ID NO: 678383 - DNA, 23 bp, Homo sapiens
cttttaatggcatttctctttaa

SEQ ID NO: 678384 - DNA, 20 bp, Homo sapiens
cttttaattaaataaaagct

SEQ ID NO: 678385 - DNA, 21 bp, Homo sapiens
cttttaccttttttttttctt

SEQ ID NO: 678386 - DNA, 14 bp, Homo sapiens
cttttaggaaaatc

SEQ ID NO: 678387 - DNA, 20 bp, Homo sapiens
cttttaggaaaatcactttg

SEQ ID NO: 678388 - DNA, 14 bp, Homo sapiens
cttttataaagcat

SEQ ID NO: 678389 - DNA, 17 bp, Homo sapiens
cttttatgcagcaaata

SEQ ID NO: 678390 - DNA, 15 bp, Homo sapiens
cttttattgtaaagt

SEQ ID NO: 678391 - DNA, 15 bp, Homo sapiens
cttttcaatgacatt

SEQ ID NO: 678392 - DNA, 18 bp, Homo sapiens
cttttccaggagttctga

SEQ ID NO: 678393 - DNA, 15 bp, Homo sapiens
cttttcctggtgctc

SEQ ID NO: 678394 - DNA, 16 bp, Homo sapiens
cttttcctggtgctct

SEQ ID NO: 678395 - DNA, 13 bp, Homo sapiens
cttttccttacca

SEQ ID NO: 678396 - DNA, 17 bp, Homo sapiens
cttttccttatttgcct

SEQ ID NO: 678397 - DNA, 18 bp, Homo sapiens
cttttccttatttgcctt

SEQ ID NO: 678398 - DNA, 12 bp, Homo sapiens
cttttccttttt

SEQ ID NO: 678399 - DNA, 12 bp, Homo sapiens
cttttctggcac

SEQ ID NO: 678400 - DNA, 14 bp, Homo sapiens
cttttctggcaccg

SEQ ID NO: 678401 - DNA, 15 bp, Homo sapiens
cttttctggcaccgc

SEQ ID NO: 678402 - DNA, 19 bp, Homo sapiens
cttttgaaaaaaaagtttt

SEQ ID NO: 678403 - DNA, 22 bp, Homo sapiens
cttttgaactggcaattgtcta

SEQ ID NO: 678404 - DNA, 14 bp, Homo sapiens
cttttgcagaagag

SEQ ID NO: 678405 - DNA, 23 bp, Homo sapiens
cttttgcagaagagggtgtgttt

SEQ ID NO: 678406 - DNA, 23 bp, Homo sapiens
cttttgctactaagttcacatta

SEQ ID NO: 678407 - DNA, 14 bp, Homo sapiens
cttttgctctctgt

SEQ ID NO: 678408 - DNA, 21 bp, Homo sapiens
cttttgggaagaatccagtat

SEQ ID NO: 678409 - DNA, 19 bp, Homo sapiens
cttttgtatagaaaattct

SEQ ID NO: 678410 - DNA, 22 bp, Homo sapiens
cttttgtatagaaaattcttga

SEQ ID NO: 678411 - DNA, 16 bp, Homo sapiens
cttgctacctcaaggg

SEQ ID NO: 678412 - DNA, 15 bp, Homo sapiens
cttgctccctgtgtc

SEQ ID NO: 678413 - DNA, 20 bp, Homo sapiens
cttgctccctgtgtccacct

SEQ ID NO: 678414 - DNA, 19 bp, Homo sapiens
cttgctctcctcatctcca

SEQ ID NO: 678415 - DNA, 13 bp, Homo sapiens
cttgctgcttttt

SEQ ID NO: 678416 - DNA, 23 bp, Homo sapiens
cttgctgggtacctggtccccac

SEQ ID NO: 678417 - DNA, 20 bp, Homo sapiens
cttgcttcttactgataatt

SEQ ID NO: 678418 - DNA, 19 bp, Homo sapiens
cttggaaattcctgtactg

SEQ ID NO: 678419 - DNA, 15 bp, Homo sapiens
cttggacagtctgag

SEQ ID NO: 678420 - DNA, 14 bp, Homo sapiens
cttggactacacaa

SEQ ID NO: 678421 - DNA, 18 bp, Homo sapiens
cttggactacacaataca

SEQ ID NO: 678422 - DNA, 14 bp, Homo sapiens
cttggagggaagcc

SEQ ID NO: 678423 - DNA, 14 bp, Homo sapiens
cttggccctttcct

SEQ ID NO: 678424 - DNA, 20 bp, Homo sapiens
cttggccctttccttccaga

SEQ ID NO: 678425 - DNA, 20 bp, Homo sapiens
cttggctcccgggggcccca

SEQ ID NO: 678426 - DNA, 17 bp, Homo sapiens
cttggctttcctgtttc

SEQ ID NO: 678427 - DNA, 18 bp, Homo sapiens
cttgggcagtctttcttg

SEQ ID NO: 678428 - DNA, 12 bp, Homo sapiens
cttggggcccag

SEQ ID NO: 678429 - DNA, 19 bp, Homo sapiens
cttggtgccctcgcctcct

SEQ ID NO: 678430 - DNA, 23 bp, Homo sapiens
cttggtttctctctacagtgcca

SEQ ID NO: 678431 - DNA, 22 bp, Homo sapiens
cttggtttgtggcgtctccctc

SEQ ID NO: 678432 - DNA, 20 bp, Homo sapiens
cttgtcagggtctccttcct

SEQ ID NO: 678433 - DNA, 16 bp, Homo sapiens
cttgtccctccaactg

SEQ ID NO: 678434 - DNA, 20 bp, Homo sapiens
ctgctgcctctttccctagg

SEQ ID NO: 678435 - DNA, 16 bp, Homo sapiens
ctgctgctgtgcagca

SEQ ID NO: 678436 - DNA, 15 bp, Homo sapiens
ctgctggcatcaaga

SEQ ID NO: 678437 - DNA, 14 bp, Homo sapiens
ctgctgtgcaacgg

SEQ ID NO: 678438 - DNA, 21 bp, Homo sapiens
ctgcttcccttactttgctga

SEQ ID NO: 678439 - DNA, 20 bp, Homo sapiens
ctgcttgagttcccagatgg

SEQ ID NO: 678440 - DNA, 15 bp, Homo sapiens
ctgctttgcatcttt

SEQ ID NO: 678441 - DNA, 20 bp, Homo sapiens
ctggaaagcagagcctcctg

SEQ ID NO: 678442 - DNA, 19 bp, Homo sapiens
ctggaaagttttctccact

SEQ ID NO: 678443 - DNA, 13 bp, Homo sapiens
ctggacctgggga

SEQ ID NO: 678444 - DNA, 16 bp, Homo sapiens
ctggacctgtatattt

SEQ ID NO: 678445 - DNA, 14 bp, Homo sapiens
ctggactattgtgc

SEQ ID NO: 678446 - DNA, 16 bp, Homo sapiens
ctggactattgtgcca

SEQ ID NO: 678447 - DNA, 21 bp, Homo sapiens
ctggactattgtgccaactgc

SEQ ID NO: 678448 - DNA, 23 bp, Homo sapiens
ctggactctaaagtctgttgatt

SEQ ID NO: 678449 - DNA, 19 bp, Homo sapiens
ctggacttctacctgccct

SEQ ID NO: 678450 - DNA, 14 bp, Homo sapiens
ctggagatcagcat

SEQ ID NO: 678451 - DNA, 23 bp, Homo sapiens
ctggagcagaggaggggaaagtc

SEQ ID NO: 678452 - DNA, 12 bp, Homo sapiens
ctggagcctggg

SEQ ID NO: 678453 - DNA, 15 bp, Homo sapiens
ctggaggaggcctgt

SEQ ID NO: 678454 - DNA, 18 bp, Homo sapiens
ctggaggaggcctgtccc

SEQ ID NO: 678455 - DNA, 19 bp, Homo sapiens
ctggaggaggcctgtccca

SEQ ID NO: 678456 - DNA, 23 bp, Homo sapiens
ctggaggagggtttgggcagagc

SEQ ID NO: 678457 - DNA, 10 bp, Homo sapiens
ctggaggcag

SEQ ID NO: 678458 - DNA, 16 bp, Homo sapiens
ctggataaagccactg

SEQ ID NO: 678459 - DNA, 17 bp, Homo sapiens
ctggataaagccactga

SEQ ID NO: 678460 - DNA, 17 bp, Homo sapiens
ctggattcattgtctct

SEQ ID NO: 678461 - DNA, 22 bp, Homo sapiens
ctggcaaaggacccttgagtaa

SEQ ID NO: 678462 - DNA, 12 bp, Homo sapiens
ctggcaaaggcc

SEQ ID NO: 678463 - DNA, 18 bp, Homo sapiens
ctggcacagaccaggcct

SEQ ID NO: 678464 - DNA, 23 bp, Homo sapiens
ctggcatcaagaggtgggagggc

SEQ ID NO: 678465 - DNA, 21 bp, Homo sapiens
ctggcatctaattctgattct

SEQ ID NO: 678466 - DNA, 13 bp, Homo sapiens
ctggcattgaaat

SEQ ID NO: 678467 - DNA, 12 bp, Homo sapiens
ctggccctgggg

SEQ ID NO: 678468 - DNA, 13 bp, Homo sapiens
ctggccctggggg

SEQ ID NO: 678469 - DNA, 22 bp, Homo sapiens
ctggcctatccgctgccagcct

SEQ ID NO: 678470 - DNA, 21 bp, Homo sapiens
ctggccttgtcctcagccagt

SEQ ID NO: 678471 - DNA, 16 bp, Homo sapiens
ctggcgcaggtgggct

SEQ ID NO: 678472 - DNA, 24 bp, Homo sapiens
ctggctcacagtacagcatgtgcc

SEQ ID NO: 678473 - DNA, 14 bp, Homo sapiens
ctggctccactctt

SEQ ID NO: 678474 - DNA, 16 bp, Homo sapiens
ctggctccactcttga

SEQ ID NO: 678475 - DNA, 17 bp, Homo sapiens
ctggctccctcctccag

SEQ ID NO: 678476 - DNA, 14 bp, Homo sapiens
ctggctgcacaggc

SEQ ID NO: 678477 - DNA, 17 bp, Homo sapiens
ctggctgcacaggctga

SEQ ID NO: 678478 - DNA, 18 bp, Homo sapiens
ctggctggaaagcagagc

SEQ ID NO: 678479 - DNA, 23 bp, Homo sapiens
ctggctggaaagcagagcctcct

SEQ ID NO: 678480 - DNA, 19 bp, Homo sapiens
ctggctggccgcatgacca

SEQ ID NO: 678481 - DNA, 16 bp, Homo sapiens
ctggctttaagccttc

SEQ ID NO: 678482 - DNA, 14 bp, Homo sapiens
ctggctttgagaag

SEQ ID NO: 678483 - DNA, 14 bp, Homo sapiens
ctggctttgcctct

SEQ ID NO: 678484 - DNA, 15 bp, Homo sapiens
ctggctttgcctctt

SEQ ID NO: 678485 - DNA, 19 bp, Homo sapiens
ctgggaacacatctggctg

SEQ ID NO: 678486 - DNA, 16 bp, Homo sapiens
ctgggagccgcctgct

SEQ ID NO: 678487 - DNA, 14 bp, Homo sapiens
ctgggattaagaaa

SEQ ID NO: 678488 - DNA, 20 bp, Homo sapiens
ctgggattaagaaaccttgc

SEQ ID NO: 678489 - DNA, 23 bp, Homo sapiens
ctgggattaagaaaccttgctct

SEQ ID NO: 678490 - DNA, 14 bp, Homo sapiens
ctgggattattctt

SEQ ID NO: 678491 - DNA, 16 bp, Homo sapiens
ctgggcaaagaggatc

SEQ ID NO: 678492 - DNA, 19 bp, Homo sapiens
ctgggcagctgtcccttgc

SEQ ID NO: 678493 - DNA, 15 bp, Homo sapiens
ctgggccagggtctg

SEQ ID NO: 678494 - DNA, 22 bp, Homo sapiens
ctgggccagggtctgtgtgaat

SEQ ID NO: 678495 - DNA, 21 bp, Homo sapiens
ctgggccataatgttgcttct

SEQ ID NO: 678496 - DNA, 17 bp, Homo sapiens
ctgggccatgtccaaag

SEQ ID NO: 678497 - DNA, 19 bp, Homo sapiens
ctgggccatgtccaaagag

SEQ ID NO: 678498 - DNA, 23 bp, Homo sapiens
ctgggccatgtccaaagaggctg

SEQ ID NO: 678499 - DNA, 20 bp, Homo sapiens
ctgggcccgacatggctccg

SEQ ID NO: 678500 - DNA, 11 bp, Homo sapiens
ctgggccctga

SEQ ID NO: 678501 - DNA, 18 bp, Homo sapiens
ctgggccgtggcacagct

SEQ ID NO: 678502 - DNA, 20 bp, Homo sapiens
ctgggccgtggcacagctgg

SEQ ID NO: 678503 - DNA, 22 bp, Homo sapiens
ctgggccgtggcacagctggga

SEQ ID NO: 678504 - DNA, 16 bp, Homo sapiens
ctgggcgtccagctca

SEQ ID NO: 678505 - DNA, 19 bp, Homo sapiens
ctgggcgtccagctcagcc

SEQ ID NO: 678506 - DNA, 20 bp, Homo sapiens
ctgggcgtccagctcagccc

SEQ ID NO: 678507 - DNA, 16 bp, Homo sapiens
ctgggctacagaaacc

SEQ ID NO: 678508 - DNA, 22 bp, Homo sapiens
ctgggctattgctgctgcccct

SEQ ID NO: 678509 - DNA, 15 bp, Homo sapiens
ctgggctcaagcttt

SEQ ID NO: 678510 - DNA, 17 bp, Homo sapiens
ctgggctcaagctttcc

SEQ ID NO: 678511 - DNA, 17 bp, Homo sapiens
ctgggctgccatgtgaa

SEQ ID NO: 678512 - DNA, 20 bp, Homo sapiens
ctgggctgccatgtgaagag

SEQ ID NO: 678513 - DNA, 16 bp, Homo sapiens
ctgggctggggcctca

SEQ ID NO: 678514 - DNA, 17 bp, Homo sapiens
ctgggctggggcctcag

SEQ ID NO: 678515 - DNA, 14 bp, Homo sapiens
ctggggacaggccc

SEQ ID NO: 678516 - DNA, 15 bp, Homo sapiens
ctggggcaggctggg

SEQ ID NO: 678517 - DNA, 17 bp, Homo sapiens
ctggggcaggctgggcc

SEQ ID NO: 678518 - DNA, 18 bp, Homo sapiens
ctggggcaggctgggcca

SEQ ID NO: 678519 - DNA, 23 bp, Homo sapiens
ctggggcctagcgatctctcctg

SEQ ID NO: 678520 - DNA, 14 bp, Homo sapiens
ctggggcctgagag

SEQ ID NO: 678521 - DNA, 21 bp, Homo sapiens
ctgggggaatgagcccagaga

SEQ ID NO: 678522 - DNA, 20 bp, Homo sapiens
ctggggggacccagtgcaga

SEQ ID NO: 678523 - DNA, 22 bp, Homo sapiens
ctggggggatgttctgcctctc

SEQ ID NO: 678524 - DNA, 16 bp, Homo sapiens
ctgggtatgcgtttca

SEQ ID NO: 678525 - DNA, 14 bp, Homo sapiens
ctgggtccatcctg

SEQ ID NO: 678526 - DNA, 18 bp, Homo sapiens
ctgggtccttggctcccg

SEQ ID NO: 678527 - DNA, 18 bp, Homo sapiens
ctgggtttctaagcagtt

SEQ ID NO: 678528 - DNA, 20 bp, Homo sapiens
ctgggtttctaagcagttat

SEQ ID NO: 678529 - DNA, 19 bp, Homo sapiens
ctggtacaacggaggcctg

SEQ ID NO: 678530 - DNA, 15 bp, Homo sapiens
ctggtattgtttacg

SEQ ID NO: 678531 - DNA, 21 bp, Homo sapiens
ctggtccccactgctgagctg

SEQ ID NO: 678532 - DNA, 16 bp, Homo sapiens
ctggtccctggaaatc

SEQ ID NO: 678533 - DNA, 14 bp, Homo sapiens
ctggtccttattta

SEQ ID NO: 678534 - DNA, 15 bp, Homo sapiens
ctggtcggagaggga

SEQ ID NO: 678535 - DNA, 17 bp, Homo sapiens
ctggtgagaaaatatat

SEQ ID NO: 678536 - DNA, 19 bp, Homo sapiens
ctggtgcacagccactccc

SEQ ID NO: 678537 - DNA, 13 bp, Homo sapiens
ctggtgctcctgc

SEQ ID NO: 678538 - DNA, 14 bp, Homo sapiens
ctggtgctcctgca

SEQ ID NO: 678539 - DNA, 12 bp, Homo sapiens
ctggtgtttatt

SEQ ID NO: 678540 - DNA, 17 bp, Homo sapiens
ctggttccctgctgcgc

SEQ ID NO: 678541 - DNA, 12 bp, Homo sapiens
cttagggaaaga

SEQ ID NO: 678542 - DNA, 22 bp, Homo sapiens
cttagggaaagatgtagaaaga

SEQ ID NO: 678543 - DNA, 23 bp, Homo sapiens
cttagggactacccatagacatg

SEQ ID NO: 678544 - DNA, 21 bp, Homo sapiens
cttagtgattgagactcaaaa

SEQ ID NO: 678545 - DNA, 17 bp, Homo sapiens
cttagtgggccagggct

SEQ ID NO: 678546 - DNA, 21 bp, Homo sapiens
cttagtgggccagggctgccc

SEQ ID NO: 678547 - DNA, 22 bp, Homo sapiens
cttatagtgtttggacagctga

SEQ ID NO: 678548 - DNA, 12 bp, Homo sapiens
cttatccctctc

SEQ ID NO: 678549 - DNA, 16 bp, Homo sapiens
cttatccctctcttcc

SEQ ID NO: 678550 - DNA, 20 bp, Homo sapiens
cttatcctacagtacaatca

SEQ ID NO: 678551 - DNA, 21 bp, Homo sapiens
cttatctcttttatatttgta

SEQ ID NO: 678552 - DNA, 23 bp, Homo sapiens
cttatgatagcaaatggcctcat

SEQ ID NO: 678553 - DNA, 21 bp, Homo sapiens
cttatgtatcagtgtcctttc

SEQ ID NO: 678554 - DNA, 16 bp, Homo sapiens
cttatgtgaaaaatta

SEQ ID NO: 678555 - DNA, 15 bp, Homo sapiens
cttattaaagtattc

SEQ ID NO: 678556 - DNA, 19 bp, Homo sapiens
cttattcctaatggctatt

SEQ ID NO: 678557 - DNA, 14 bp, Homo sapiens
cttattgaccattt

SEQ ID NO: 678558 - DNA, 17 bp, Homo sapiens
caccttgtgcctggggt

SEQ ID NO: 678559 - DNA, 18 bp, Homo sapiens
caccttttaactcacctc

SEQ ID NO: 678560 - DNA, 21 bp, Homo sapiens
caccttttccaggagttctga

SEQ ID NO: 678561 - DNA, 20 bp, Homo sapiens
cacgttggggtgatttaatc

SEQ ID NO: 678562 - DNA, 13 bp, Homo sapiens
cactaaaagcatg

SEQ ID NO: 678563 - DNA, 17 bp, Homo sapiens
cactaaaagcatgaatt

SEQ ID NO: 678564 - DNA, 21 bp, Homo sapiens
cactaaagcatgaaatgtgaa

SEQ ID NO: 678565 - DNA, 21 bp, Homo sapiens
cactacaagtcagctccagct

SEQ ID NO: 678566 - DNA, 16 bp, Homo sapiens
cactacaccttgcctt

SEQ ID NO: 678567 - DNA, 17 bp, Homo sapiens
cactagggccttggaaa

SEQ ID NO: 678568 - DNA, 19 bp, Homo sapiens
cactatctccgttccatct

SEQ ID NO: 678569 - DNA, 12 bp, Homo sapiens
cactcaggccac

SEQ ID NO: 678570 - DNA, 14 bp, Homo sapiens
cactcagtgcctcc

SEQ ID NO: 678571 - DNA, 13 bp, Homo sapiens
cactccagcctgg

SEQ ID NO: 678572 - DNA, 15 bp, Homo sapiens
cactccagcctgggg

SEQ ID NO: 678573 - DNA, 17 bp, Homo sapiens
cactccattattcctct

SEQ ID NO: 678574 - DNA, 14 bp, Homo sapiens
cactcccctagggg

SEQ ID NO: 678575 - DNA, 19 bp, Homo sapiens
cactcctgcttaatcttca

SEQ ID NO: 678576 - DNA, 21 bp, Homo sapiens
cactcctgcttaatcttcaaa

SEQ ID NO: 678577 - DNA, 15 bp, Homo sapiens
cactctgcaagaaga

SEQ ID NO: 678578 - DNA, 22 bp, Homo sapiens
cactctgtaattgcacttttta

SEQ ID NO: 678579 - DNA, 15 bp, Homo sapiens
cactcttttgatggt

SEQ ID NO: 678580 - DNA, 16 bp, Homo sapiens
cactcttttgctgtgc

SEQ ID NO: 678581 - DNA, 18 bp, Homo sapiens
cactgaaaatagtgttcc

SEQ ID NO: 678582 - DNA, 13 bp, Homo sapiens
cactgaatttata

SEQ ID NO: 678583 - DNA, 19 bp, Homo sapiens
cactgcaaataaagccttt

SEQ ID NO: 678584 - DNA, 19 bp, Homo sapiens
cactgcaacctcacctccc

SEQ ID NO: 678585 - DNA, 17 bp, Homo sapiens
cactgcagacttgtcca

SEQ ID NO: 678586 - DNA, 22 bp, Homo sapiens
cactgcgaagaccctcttgccc

SEQ ID NO: 678587 - DNA, 22 bp, Homo sapiens
cactgctgtatttttatttttg

SEQ ID NO: 678588 - DNA, 22 bp, Homo sapiens
cactgtagctacattttcagaa

SEQ ID NO: 678589 - DNA, 22 bp, Homo sapiens
cactgtatgatttataaacaga

SEQ ID NO: 678590 - DNA, 11 bp, Homo sapiens
cactgtatttt

SEQ ID NO: 678591 - DNA, 16 bp, Homo sapiens
cactgtgcagacccag

SEQ ID NO: 678592 - DNA, 17 bp, Homo sapiens
cactgtgcagacccagt

SEQ ID NO: 678593 - DNA, 12 bp, Homo sapiens
cactgtggccag

SEQ ID NO: 678594 - DNA, 16 bp, Homo sapiens
cactgtggccaggcct

SEQ ID NO: 678595 - DNA, 22 bp, Homo sapiens
cacttaagttagttccactgag

SEQ ID NO: 678596 - DNA, 15 bp, Homo sapiens
cacttagtgatcatt

SEQ ID NO: 678597 - DNA, 24 bp, Homo sapiens
cacttatctcgaatttgaagagat

SEQ ID NO: 678598 - DNA, 23 bp, Homo sapiens
cacttcaagctgttatttcttcc

SEQ ID NO: 678599 - DNA, 21 bp, Homo sapiens
cacttcactgcgaagaccctc

SEQ ID NO: 678600 - DNA, 13 bp, Homo sapiens
cacttcattttta

SEQ ID NO: 678601 - DNA, 16 bp, Homo sapiens
cacttcccaccctgcc

SEQ ID NO: 678602 - DNA, 17 bp, Homo sapiens
cacttgctgctttttct

SEQ ID NO: 678603 - DNA, 13 bp, Homo sapiens
cactttgggaggc

SEQ ID NO: 678604 - DNA, 15 bp, Homo sapiens
cactttgtaattttt

SEQ ID NO: 678605 - DNA, 18 bp, Homo sapiens
cactttgtaatttttgct

SEQ ID NO: 678606 - DNA, 15 bp, Homo sapiens
cacttttagaaatgc

SEQ ID NO: 678607 - DNA, 19 bp, Homo sapiens
cactttttaagtttgaaga

SEQ ID NO: 678608 - DNA, 16 bp, Homo sapiens
cagaaaatatttaata

SEQ ID NO: 678609 - DNA, 23 bp, Homo sapiens
cagaaaattggcagtggcagaga

SEQ ID NO: 678610 - DNA, 18 bp, Homo sapiens
cagaaagctttattttga

SEQ ID NO: 678611 - DNA, 21 bp, Homo sapiens
cagaaatataacacatttttt

SEQ ID NO: 678612 - DNA, 17 bp, Homo sapiens
cagaacaggaggtgtga

SEQ ID NO: 678613 - DNA, 19 bp, Homo sapiens
cagaacaggaggtgtgaat

SEQ ID NO: 678614 - DNA, 16 bp, Homo sapiens
cagaaccacacttgaa

SEQ ID NO: 678615 - DNA, 22 bp, Homo sapiens
cagaaccacacttgaaaccttt

SEQ ID NO: 678616 - DNA, 15 bp, Homo sapiens
cagaactggaggcag

SEQ ID NO: 678617 - DNA, 16 bp, Homo sapiens
cagaacttgaagggtt

SEQ ID NO: 678618 - DNA, 15 bp, Homo sapiens
cagaactttagtatt

SEQ ID NO: 678619 - DNA, 17 bp, Homo sapiens
cagaactttagtattaa

SEQ ID NO: 678620 - DNA, 21 bp, Homo sapiens
cagaagagaaaggactcagtg

SEQ ID NO: 678621 - DNA, 22 bp, Homo sapiens
cagaagagaaaggactcagtgt

SEQ ID NO: 678622 - DNA, 23 bp, Homo sapiens
cagaagccaatctacaatctctt

SEQ ID NO: 678623 - DNA, 15 bp, Homo sapiens
cagaagcctgtttca

SEQ ID NO: 678624 - DNA, 15 bp, Homo sapiens
cagaagggaattgct

SEQ ID NO: 678625 - DNA, 18 bp, Homo sapiens
cagaagggaattgctcag

SEQ ID NO: 678626 - DNA, 20 bp, Homo sapiens
cagaataatcaaatacattt

SEQ ID NO: 678627 - DNA, 16 bp, Homo sapiens
cagaatctagagcaaa

SEQ ID NO: 678628 - DNA, 22 bp, Homo sapiens
cagacaatatgtgagtgccttt

SEQ ID NO: 678629 - DNA, 20 bp, Homo sapiens
cagacacaacccaataggag

SEQ ID NO: 678630 - DNA, 20 bp, Homo sapiens
cagacacagctcttccaggg

SEQ ID NO: 678631 - DNA, 19 bp, Homo sapiens
cagacagcaggcagcgcca

SEQ ID NO: 678632 - DNA, 20 bp, Homo sapiens
cagaccatattacctggatt

SEQ ID NO: 678633 - DNA, 15 bp, Homo sapiens
cagacccagtcccac

SEQ ID NO: 678634 - DNA, 20 bp, Homo sapiens
cagacccagtcccacactgt

SEQ ID NO: 678635 - DNA, 16 bp, Homo sapiens
cagaccccttcagcca

SEQ ID NO: 678636 - DNA, 15 bp, Homo sapiens
cagacctttgaggat

SEQ ID NO: 678637 - DNA, 13 bp, Homo sapiens
cagactccatctc

SEQ ID NO: 678638 - DNA, 16 bp, Homo sapiens
cagactccatctcttc

SEQ ID NO: 678639 - DNA, 17 bp, Homo sapiens
cagactccatctcttct

SEQ ID NO: 678640 - DNA, 20 bp, Homo sapiens
cagactccatctcttctgca

SEQ ID NO: 678641 - DNA, 21 bp, Homo sapiens
cagactggggcatcctgtgcc

SEQ ID NO: 678642 - DNA, 22 bp, Homo sapiens
cagactggggcatcctgtgcca

SEQ ID NO: 678643 - DNA, 18 bp, Homo sapiens
cagacttgcccaggtcac

SEQ ID NO: 678644 - DNA, 22 bp, Homo sapiens
cagagaacagaactggaggcag

SEQ ID NO: 678645 - DNA, 14 bp, Homo sapiens
cagagaaggaaaag

SEQ ID NO: 678646 - DNA, 17 bp, Homo sapiens
cagagcaaccagaagga

SEQ ID NO: 678647 - DNA, 22 bp, Homo sapiens
cagagcactttgcaactccctg

SEQ ID NO: 678648 - DNA, 14 bp, Homo sapiens
cagagcctcctggg

SEQ ID NO: 678649 - DNA, 16 bp, Homo sapiens
cagagcctcctgggaa

SEQ ID NO: 678650 - DNA, 21 bp, Homo sapiens
cagagcgaagacccggccagg

SEQ ID NO: 678651 - DNA, 21 bp, Homo sapiens
cagagctctttgatcgctttt

SEQ ID NO: 678652 - DNA, 15 bp, Homo sapiens
cagagctttggtctg

SEQ ID NO: 678653 - DNA, 20 bp, Homo sapiens
cagagctttggtctgtgtgt

SEQ ID NO: 678654 - DNA, 15 bp, Homo sapiens
cagaggaccagggcc

SEQ ID NO: 678655 - DNA, 16 bp, Homo sapiens
cagaggaccagggcct

SEQ ID NO: 678656 - DNA, 18 bp, Homo sapiens
cagaggagcgcaggcagc

SEQ ID NO: 678657 - DNA, 15 bp, Homo sapiens
cagaggccagaccca

SEQ ID NO: 678658 - DNA, 11 bp, Homo sapiens
cagaggggagc

SEQ ID NO: 678659 - DNA, 19 bp, Homo sapiens
cagaggggagcagtggcca

SEQ ID NO: 678660 - DNA, 13 bp, Homo sapiens
cagaggtaccctg

SEQ ID NO: 678661 - DNA, 14 bp, Homo sapiens
cagaggtgcttcac

SEQ ID NO: 678662 - DNA, 21 bp, Homo sapiens
cagagtgaccagcacactgga

SEQ ID NO: 678663 - DNA, 19 bp, Homo sapiens
cagagttgactttcctccc

SEQ ID NO: 678664 - DNA, 19 bp, Homo sapiens
cagataccttatcttacaa

SEQ ID NO: 678665 - DNA, 23 bp, Homo sapiens
cagataccttatcttacaatatt

SEQ ID NO: 678666 - DNA, 15 bp, Homo sapiens
cagatactttgaagt

SEQ ID NO: 678667 - DNA, 18 bp, Homo sapiens
cagatagatgttgctctt

SEQ ID NO: 678668 - DNA, 19 bp, Homo sapiens
cagatagatgttgctcttt

SEQ ID NO: 678669 - DNA, 19 bp, Homo sapiens
cagatggtttccacattta

SEQ ID NO: 678670 - DNA, 16 bp, Homo sapiens
cagatgtgactgtata

SEQ ID NO: 678671 - DNA, 18 bp, Homo sapiens
cagattagttctttttgc

SEQ ID NO: 678672 - DNA, 18 bp, Homo sapiens
cagattctgcctatgtaa

SEQ ID NO: 678673 - DNA, 16 bp, Homo sapiens
cagatttctcactata

SEQ ID NO: 678674 - DNA, 13 bp, Homo sapiens
cagatttctgtaa

SEQ ID NO: 678675 - DNA, 13 bp, Homo sapiens
cagcaaatatatg

SEQ ID NO: 678676 - DNA, 19 bp, Homo sapiens
cagcaccttgtgcctgggg

SEQ ID NO: 678677 - DNA, 18 bp, Homo sapiens
cagcactgatggaaaata

SEQ ID NO: 678678 - DNA, 16 bp, Homo sapiens
cagcactttgggaggc

SEQ ID NO: 678679 - DNA, 18 bp, Homo sapiens
cagcactttgggaggccg

SEQ ID NO: 678680 - DNA, 20 bp, Homo sapiens
caataaaaacattttgaagt

SEQ ID NO: 678681 - DNA, 13 bp, Homo sapiens
caataaaatttaa

SEQ ID NO: 678682 - DNA, 14 bp, Homo sapiens
caataaaggcagct

SEQ ID NO: 678683 - DNA, 20 bp, Homo sapiens
caataaaggcagctgcctct

SEQ ID NO: 678684 - DNA, 24 bp, Homo sapiens
caataaaggcagctgcctctgctc

SEQ ID NO: 678685 - DNA, 14 bp, Homo sapiens
caataaatccacac

SEQ ID NO: 678686 - DNA, 17 bp, Homo sapiens
caataacactgtatttt

SEQ ID NO: 678687 - DNA, 12 bp, Homo sapiens
caatagaatggg

SEQ ID NO: 678688 - DNA, 22 bp, Homo sapiens
caataggagtggtgatttgaaa

SEQ ID NO: 678689 - DNA, 16 bp, Homo sapiens
caatatgaatctataa

SEQ ID NO: 678690 - DNA, 20 bp, Homo sapiens
caatcaaatctcctgctgat

SEQ ID NO: 678691 - DNA, 17 bp, Homo sapiens
caatctccatgtgtact

SEQ ID NO: 678692 - DNA, 21 bp, Homo sapiens
caatctccatgtgtacttatt

SEQ ID NO: 678693 - DNA, 12 bp, Homo sapiens
caatgaaaacat

SEQ ID NO: 678694 - DNA, 16 bp, Homo sapiens
caatgaaagtcaaatt

SEQ ID NO: 678695 - DNA, 20 bp, Homo sapiens
caatgaaagtcaaatttact

SEQ ID NO: 678696 - DNA, 19 bp, Homo sapiens
caatgaccattcaattagt

SEQ ID NO: 678697 - DNA, 14 bp, Homo sapiens
caatgtaacactgg

SEQ ID NO: 678698 - DNA, 17 bp, Homo sapiens
caatgtgaataatggca

SEQ ID NO: 678699 - DNA, 20 bp, Homo sapiens
caatgtgaggggtccctagc

SEQ ID NO: 678700 - DNA, 20 bp, Homo sapiens
caatgttccttttttgtata

SEQ ID NO: 678701 - DNA, 15 bp, Homo sapiens
caattaatagtttgt

SEQ ID NO: 678702 - DNA, 20 bp, Homo sapiens
caattagatctaaacagtta

SEQ ID NO: 678703 - DNA, 19 bp, Homo sapiens
caattagtggtcataaaat

SEQ ID NO: 678704 - DNA, 21 bp, Homo sapiens
caattagtggtcataaaatag

SEQ ID NO: 678705 - DNA, 18 bp, Homo sapiens
caattatttgcatatttt

SEQ ID NO: 678706 - DNA, 19 bp, Homo sapiens
caattcccccatccttcag

SEQ ID NO: 678707 - DNA, 21 bp, Homo sapiens
caattctcctgcctcagcctc

SEQ ID NO: 678708 - DNA, 14 bp, Homo sapiens
caattctgcccgct

SEQ ID NO: 678709 - DNA, 14 bp, Homo sapiens
caattgtgaacatg

SEQ ID NO: 678710 - DNA, 24 bp, Homo sapiens
caatttgaagtaacttatttgact

SEQ ID NO: 678711 - DNA, 16 bp, Homo sapiens
caatttgtttgtgttc

SEQ ID NO: 678712 - DNA, 21 bp, Homo sapiens
cacaaaacctgtattactgaa

SEQ ID NO: 678713 - DNA, 18 bp, Homo sapiens
cacaaaacttcagtgtgg

SEQ ID NO: 678714 - DNA, 17 bp, Homo sapiens
cacaaatgcagtatata

SEQ ID NO: 678715 - DNA, 21 bp, Homo sapiens
cacaaatgtcattgtctactc

SEQ ID NO: 678716 - DNA, 20 bp, Homo sapiens
cacaaattttcaagtttaca

SEQ ID NO: 678717 - DNA, 20 bp, Homo sapiens
cacaacagccctgcctgaga

SEQ ID NO: 678718 - DNA, 18 bp, Homo sapiens
cacaacccaataggagtc

SEQ ID NO: 678719 - DNA, 19 bp, Homo sapiens
cacaacccttctctgttgg

SEQ ID NO: 678720 - DNA, 20 bp, Homo sapiens
cacaacccttctctgttggt

SEQ ID NO: 678721 - DNA, 21 bp, Homo sapiens
cacaagtgccctccaggcttt

SEQ ID NO: 678722 - DNA, 16 bp, Homo sapiens
cacaattgttttacct

SEQ ID NO: 678723 - DNA, 13 bp, Homo sapiens
cacacagggcagt

SEQ ID NO: 678724 - DNA, 14 bp, Homo sapiens
cacacccaaagctg

SEQ ID NO: 678725 - DNA, 15 bp, Homo sapiens
cacacccaaagctga

SEQ ID NO: 678726 - DNA, 12 bp, Homo sapiens
catcactgtatc

SEQ ID NO: 678727 - DNA, 22 bp, Homo sapiens
catcagggcctggggcctgaga

SEQ ID NO: 678728 - DNA, 16 bp, Homo sapiens
catcatcagggcctgg

SEQ ID NO: 678729 - DNA, 21 bp, Homo sapiens
catcatcctcccgccaggagc

SEQ ID NO: 678730 - DNA, 22 bp, Homo sapiens
catcatcctcccgccaggagct

SEQ ID NO: 678731 - DNA, 13 bp, Homo sapiens
catcatgcctgac

SEQ ID NO: 678732 - DNA, 13 bp, Homo sapiens
catcattgtttct

SEQ ID NO: 678733 - DNA, 12 bp, Homo sapiens
catccactgtta

SEQ ID NO: 678734 - DNA, 15 bp, Homo sapiens
catccagacctggct

SEQ ID NO: 678735 - DNA, 16 bp, Homo sapiens
catccagacctggctc

SEQ ID NO: 678736 - DNA, 15 bp, Homo sapiens
catccagctccccag

SEQ ID NO: 678737 - DNA, 21 bp, Homo sapiens
catcctacaactcacattaga

SEQ ID NO: 678738 - DNA, 14 bp, Homo sapiens
catcctcttttaat

SEQ ID NO: 678739 - DNA, 23 bp, Homo sapiens
catcctcttttaatggcatttct

SEQ ID NO: 678740 - DNA, 20 bp, Homo sapiens
catcgccagaggtgcttcac

SEQ ID NO: 678741 - DNA, 21 bp, Homo sapiens
catcggtgaaactaacagata

SEQ ID NO: 678742 - DNA, 18 bp, Homo sapiens
catctaatgcttgtttat

SEQ ID NO: 678743 - DNA, 20 bp, Homo sapiens
catctaccttttctggcaaa

SEQ ID NO: 678744 - DNA, 22 bp, Homo sapiens
catctagccagcccctcttccc

SEQ ID NO: 678745 - DNA, 12 bp, Homo sapiens
catctaggtcct

SEQ ID NO: 678746 - DNA, 16 bp, Homo sapiens
catctaggtcctggct

SEQ ID NO: 678747 - DNA, 13 bp, Homo sapiens
catctatctagtt

SEQ ID NO: 678748 - DNA, 18 bp, Homo sapiens
catctcatgagtgtgccc

SEQ ID NO: 678749 - DNA, 19 bp, Homo sapiens
catctccctgcctggcccc

SEQ ID NO: 678750 - DNA, 16 bp, Homo sapiens
catctctcatcctcca

SEQ ID NO: 678751 - DNA, 18 bp, Homo sapiens
catctctctcttgcctga

SEQ ID NO: 678752 - DNA, 17 bp, Homo sapiens
catctgcaatatgaatt

SEQ ID NO: 678753 - DNA, 20 bp, Homo sapiens
catctggctgcacaggctga

SEQ ID NO: 678754 - DNA, 23 bp, Homo sapiens
catctgtgaatctgctttaatta

SEQ ID NO: 678755 - DNA, 17 bp, Homo sapiens
catctgttcatttctaa

SEQ ID NO: 678756 - DNA, 15 bp, Homo sapiens
catcttcaatatgaa

SEQ ID NO: 678757 - DNA, 16 bp, Homo sapiens
catcttgcctccaggt

SEQ ID NO: 678758 - DNA, 22 bp, Homo sapiens
catcttgcctccaggtgcagag

SEQ ID NO: 678759 - DNA, 18 bp, Homo sapiens
catctttcatttcgtatt

SEQ ID NO: 678760 - DNA, 13 bp, Homo sapiens
catgaaaaagcag

SEQ ID NO: 678761 - DNA, 23 bp, Homo sapiens
catgaaaaagcagctaccaggtg

SEQ ID NO: 678762 - DNA, 14 bp, Homo sapiens
catgaaatgtgaat

SEQ ID NO: 678763 - DNA, 16 bp, Homo sapiens
catgaaatgtgaattt

SEQ ID NO: 678764 - DNA, 17 bp, Homo sapiens
catgaacgttattatat

SEQ ID NO: 678765 - DNA, 12 bp, Homo sapiens
catgatttagca

SEQ ID NO: 678766 - DNA, 16 bp, Homo sapiens
catgatttagcaagca

SEQ ID NO: 678767 - DNA, 17 bp, Homo sapiens
catgatttagcaagcaa

SEQ ID NO: 678768 - DNA, 22 bp, Homo sapiens
catgcaagcagaggaccagggc

SEQ ID NO: 678769 - DNA, 15 bp, Homo sapiens
catgcaataaaattt

SEQ ID NO: 678770 - DNA, 18 bp, Homo sapiens
catgcaataaaatttaaa

SEQ ID NO: 678771 - DNA, 14 bp, Homo sapiens
catgcaatttgaag

SEQ ID NO: 678772 - DNA, 15 bp, Homo sapiens
catgcaatttgaagt

SEQ ID NO: 678773 - DNA, 17 bp, Homo sapiens
catgcatttgaggtcaa

SEQ ID NO: 678774 - DNA, 16 bp, Homo sapiens
catgcctgtcctttca

SEQ ID NO: 678775 - DNA, 21 bp, Homo sapiens
catgcctgtcctttcagtctg

SEQ ID NO: 678776 - DNA, 13 bp, Homo sapiens
catgctgcctggc

SEQ ID NO: 678777 - DNA, 20 bp, Homo sapiens
catgctgcctggcacagacc

SEQ ID NO: 678778 - DNA, 14 bp, Homo sapiens
catgcttcatcatt

SEQ ID NO: 678779 - DNA, 14 bp, Homo sapiens
catgcttgacatac

SEQ ID NO: 678780 - DNA, 19 bp, Homo sapiens
catggaacttttctgtaat

SEQ ID NO: 678781 - DNA, 18 bp, Homo sapiens
catggaggccctcctgtg

SEQ ID NO: 678782 - DNA, 20 bp, Homo sapiens
catggcagcctactctcctt

SEQ ID NO: 678783 - DNA, 13 bp, Homo sapiens
catggcccccaat

SEQ ID NO: 678784 - DNA, 14 bp, Homo sapiens
catggcccccaata

SEQ ID NO: 678785 - DNA, 16 bp, Homo sapiens
catggcccccaataaa

SEQ ID NO: 678786 - DNA, 23 bp, Homo sapiens
catggcccccaataaaggcagct

SEQ ID NO: 678787 - DNA, 12 bp, Homo sapiens
catggccctggg

SEQ ID NO: 678788 - DNA, 18 bp, Homo sapiens
catggctgctgttgctta

SEQ ID NO: 678789 - DNA, 17 bp, Homo sapiens
catggcttctggtcatg

SEQ ID NO: 678790 - DNA, 22 bp, Homo sapiens
catggggattgcagagtgacca

SEQ ID NO: 678791 - DNA, 17 bp, Homo sapiens
catggtcctgaatgtag

SEQ ID NO: 678792 - DNA, 22 bp, Homo sapiens
catgtaataaaaagtatatgtt

SEQ ID NO: 678793 - DNA, 19 bp, Homo sapiens
catgtaatgttaatgttat

SEQ ID NO: 678794 - DNA, 22 bp, Homo sapiens
catgtactacagctatatttga

SEQ ID NO: 678795 - DNA, 16 bp, Homo sapiens
catgtagactgtgcca

SEQ ID NO: 678796 - DNA, 15 bp, Homo sapiens
catgtagccagcaga

SEQ ID NO: 678797 - DNA, 15 bp, Homo sapiens
catgtataaccaagt

SEQ ID NO: 678798 - DNA, 22 bp, Homo sapiens
catgtatggaatcccactgtat

SEQ ID NO: 678799 - DNA, 14 bp, Homo sapiens
catgtatgtataca

SEQ ID NO: 678800 - DNA, 15 bp, Homo sapiens
catgtatttgagcat

SEQ ID NO: 678801 - DNA, 20 bp, Homo sapiens
catgtatttgttatatataa

SEQ ID NO: 678802 - DNA, 22 bp, Homo sapiens
catgtcaacaatccacatcaga

SEQ ID NO: 678803 - DNA, 21 bp, Homo sapiens
catgtcaccggtcagtgcctt

SEQ ID NO: 678804 - DNA, 18 bp, Homo sapiens
catgtccaaagaggctgc

SEQ ID NO: 678805 - DNA, 19 bp, Homo sapiens
catgtccaaagaggctgcc

SEQ ID NO: 678806 - DNA, 20 bp, Homo sapiens
catgtccagcaccttgtgcc

SEQ ID NO: 678807 - DNA, 21 bp, Homo sapiens
catgtccagcaccttgtgcct

SEQ ID NO: 678808 - DNA, 23 bp, Homo sapiens
catgtccagcaccttgtgcctgg

SEQ ID NO: 678809 - DNA, 13 bp, Homo sapiens
catgtgaagaggg

SEQ ID NO: 678810 - DNA, 12 bp, Homo sapiens
catgtgcctttc

SEQ ID NO: 678811 - DNA, 18 bp, Homo sapiens
catgtgtatattcctttt

SEQ ID NO: 678812 - DNA, 23 bp, Homo sapiens
catgtgtatattccttttaaaga

SEQ ID NO: 678813 - DNA, 23 bp, Homo sapiens
catgtgtatccatgcattatata

SEQ ID NO: 678814 - DNA, 12 bp, Homo sapiens
catgtgtggaaa

SEQ ID NO: 678815 - DNA, 20 bp, Homo sapiens
catgttcaaattttatcatg

SEQ ID NO: 678816 - DNA, 14 bp, Homo sapiens
catgtttcacagtg

SEQ ID NO: 678817 - DNA, 17 bp, Homo sapiens
catgtttttaactttta

SEQ ID NO: 678818 - DNA, 11 bp, Homo sapiens
cattaaaatat

SEQ ID NO: 678819 - DNA, 14 bp, Homo sapiens
cattaaactttttt

SEQ ID NO: 678820 - DNA, 18 bp, Homo sapiens
cattaaatgcaataattt

SEQ ID NO: 678821 - DNA, 19 bp, Homo sapiens
cattaaatgcaataatttt

SEQ ID NO: 678822 - DNA, 19 bp, Homo sapiens
cattaaggggaagaatgaa

SEQ ID NO: 678823 - DNA, 13 bp, Homo sapiens
cattactgggcct

SEQ ID NO: 678824 - DNA, 21 bp, Homo sapiens
cattagattttattttactat

SEQ ID NO: 678825 - DNA, 13 bp, Homo sapiens
cattatgaagaat

SEQ ID NO: 678826 - DNA, 21 bp, Homo sapiens
cattatgaagaatacccagga

SEQ ID NO: 678827 - DNA, 18 bp, Homo sapiens
cattatggataaagatga

SEQ ID NO: 678828 - DNA, 21 bp, Homo sapiens
cattatgggttaggcattaat

SEQ ID NO: 678829 - DNA, 22 bp, Homo sapiens
cattattatgcaaaatttagaa

SEQ ID NO: 678830 - DNA, 20 bp, Homo sapiens
cattatttctagtccaaaat

SEQ ID NO: 678831 - DNA, 20 bp, Homo sapiens
cattcagaaatgttgagtct

SEQ ID NO: 678832 - DNA, 23 bp, Homo sapiens
cattcagatcactgaatttataa

SEQ ID NO: 678833 - DNA, 21 bp, Homo sapiens
cattccctctcatctcaggta

SEQ ID NO: 678834 - DNA, 13 bp, Homo sapiens
cattcctgacggc

SEQ ID NO: 678835 - DNA, 16 bp, Homo sapiens
cattcgggaccaatat

SEQ ID NO: 678836 - DNA, 18 bp, Homo sapiens
cattctctatgtactatg

SEQ ID NO: 678837 - DNA, 21 bp, Homo sapiens
cattctggtcaagggctgtca

SEQ ID NO: 678838 - DNA, 20 bp, Homo sapiens
cattctggttccctgctgcg

SEQ ID NO: 678839 - DNA, 12 bp, Homo sapiens
cattgaaagaag

SEQ ID NO: 678840 - DNA, 11 bp, Homo sapiens
cattgacatag

SEQ ID NO: 678841 - DNA, 21 bp, Homo sapiens
cattgacataggtcataaagc

SEQ ID NO: 678842 - DNA, 22 bp, Homo sapiens
cattgacataggtcataaagca

SEQ ID NO: 678843 - DNA, 16 bp, Homo sapiens
cattgacttttataaa

SEQ ID NO: 678844 - DNA, 9 bp, Homo sapiens
cattgagta

SEQ ID NO: 678845 - DNA, 10 bp, Homo sapiens
cattgagtat

SEQ ID NO: 678846 - DNA, 19 bp, Homo sapiens
cattgcacataagcttcca

SEQ ID NO: 678847 - DNA, 20 bp, Homo sapiens
cattgtaaaagcattttgta

SEQ ID NO: 678848 - DNA, 15 bp, Homo sapiens
cagctgcctcctgcg

SEQ ID NO: 678849 - DNA, 21 bp, Homo sapiens
cagctgcctcctgcgccctgt

SEQ ID NO: 678850 - DNA, 20 bp, Homo sapiens
cagctgcctctgctccctct

SEQ ID NO: 678851 - DNA, 18 bp, Homo sapiens
cagctgctccctggcatt

SEQ ID NO: 678852 - DNA, 19 bp, Homo sapiens
cagcttatctcttttatat

SEQ ID NO: 678853 - DNA, 22 bp, Homo sapiens
cagcttatctcttttatatttg

SEQ ID NO: 678854 - DNA, 23 bp, Homo sapiens
cagcttatctcttttatatttgt

SEQ ID NO: 678855 - DNA, 12 bp, Homo sapiens
cagcttattgtt

SEQ ID NO: 678856 - DNA, 13 bp, Homo sapiens
cagcttctccagg

SEQ ID NO: 678857 - DNA, 19 bp, Homo sapiens
cagctttataacaaatgtg

SEQ ID NO: 678858 - DNA, 12 bp, Homo sapiens
cagctttgataa

SEQ ID NO: 678859 - DNA, 20 bp, Homo sapiens
cagctttgataattgtgtac

SEQ ID NO: 678860 - DNA, 18 bp, Homo sapiens
cagcttttgttgtttata

SEQ ID NO: 678861 - DNA, 12 bp, Homo sapiens
caggaagacttt

SEQ ID NO: 678862 - DNA, 21 bp, Homo sapiens
caggacatgcaataaaattta

SEQ ID NO: 678863 - DNA, 19 bp, Homo sapiens
caggaccctgtcctgcagt

SEQ ID NO: 678864 - DNA, 23 bp, Homo sapiens
caggaccctgtcctgcagtccca

SEQ ID NO: 678865 - DNA, 22 bp, Homo sapiens
caggactcctggcagggccacc

SEQ ID NO: 678866 - DNA, 16 bp, Homo sapiens
caggagaacctaacat

SEQ ID NO: 678867 - DNA, 15 bp, Homo sapiens
caggagagcctgggg

SEQ ID NO: 678868 - DNA, 15 bp, Homo sapiens
caggaggcaggcatg

SEQ ID NO: 678869 - DNA, 17 bp, Homo sapiens
caggagtggtgcagaca

SEQ ID NO: 678870 - DNA, 20 bp, Homo sapiens
caggagtggtgcagacagaa

SEQ ID NO: 678871 - DNA, 24 bp, Homo sapiens
caggagtggtgcagacagaagtct

SEQ ID NO: 678872 - DNA, 22 bp, Homo sapiens
caggatatccttatcagagcta

SEQ ID NO: 678873 - DNA, 16 bp, Homo sapiens
caggattagataaggc

SEQ ID NO: 678874 - DNA, 19 bp, Homo sapiens
caggattagataaggctgt

SEQ ID NO: 678875 - DNA, 16 bp, Homo sapiens
caggcaccgagaatgt

SEQ ID NO: 678876 - DNA, 16 bp, Homo sapiens
caggcagagaacagaa

SEQ ID NO: 678877 - DNA, 19 bp, Homo sapiens
caggcagagaacagaactg

SEQ ID NO: 678878 - DNA, 22 bp, Homo sapiens
caggcagagtggcgtggcctcc

SEQ ID NO: 678879 - DNA, 23 bp, Homo sapiens
caggcagagtggcgtggcctccc

SEQ ID NO: 678880 - DNA, 19 bp, Homo sapiens
caggcagcgccaagtgcgt

SEQ ID NO: 678881 - DNA, 20 bp, Homo sapiens
caggcagcgccaagtgcgtg

SEQ ID NO: 678882 - DNA, 20 bp, Homo sapiens
caggcagcttctactcctgc

SEQ ID NO: 678883 - DNA, 17 bp, Homo sapiens
caggcaggcggctcctc

SEQ ID NO: 678884 - DNA, 13 bp, Homo sapiens
caggcctgcctcc

SEQ ID NO: 678885 - DNA, 18 bp, Homo sapiens
caggcctgtggctccctt

SEQ ID NO: 678886 - DNA, 17 bp, Homo sapiens
caggcggctcctcctca

SEQ ID NO: 678887 - DNA, 17 bp, Homo sapiens
caggctatgtataaaat

SEQ ID NO: 678888 - DNA, 21 bp, Homo sapiens
caggctatgtataaaatacat

SEQ ID NO: 678889 - DNA, 14 bp, Homo sapiens
caggctcgtcagcc

SEQ ID NO: 678890 - DNA, 16 bp, Homo sapiens
caggctcgtcagccac

SEQ ID NO: 678891 - DNA, 20 bp, Homo sapiens
caggctgaaatatccaccca

SEQ ID NO: 678892 - DNA, 19 bp, Homo sapiens
caggctgcctcctgccctt

SEQ ID NO: 678893 - DNA, 10 bp, Homo sapiens
caggctgggc

SEQ ID NO: 678894 - DNA, 13 bp, Homo sapiens
caggctgggccat

SEQ ID NO: 678895 - DNA, 18 bp, Homo sapiens
caggctgggccatgtcca

SEQ ID NO: 678896 - DNA, 13 bp, Homo sapiens
caggctgtcctta

SEQ ID NO: 678897 - DNA, 12 bp, Homo sapiens
cagggaacaaaa

SEQ ID NO: 678898 - DNA, 22 bp, Homo sapiens
cagggaagccccacatgtccag

SEQ ID NO: 678899 - DNA, 17 bp, Homo sapiens
cagggaagctgtcctgg

SEQ ID NO: 678900 - DNA, 18 bp, Homo sapiens
cagggaagctgtcctgga

SEQ ID NO: 678901 - DNA, 17 bp, Homo sapiens
cagggactatctttgct

SEQ ID NO: 678902 - DNA, 20 bp, Homo sapiens
cagggagcagggaaggcctg

SEQ ID NO: 678903 - DNA, 14 bp, Homo sapiens
cagggagctgatgt

SEQ ID NO: 678904 - DNA, 19 bp, Homo sapiens
cagggaggggccggccctg

SEQ ID NO: 678905 - DNA, 15 bp, Homo sapiens
cagggcaccatccag

SEQ ID NO: 678906 - DNA, 19 bp, Homo sapiens
cagggcaccatccagctcc

SEQ ID NO: 678907 - DNA, 22 bp, Homo sapiens
cagggcagcagggaacaaaact

SEQ ID NO: 678908 - DNA, 13 bp, Homo sapiens
cagggcagcggct

SEQ ID NO: 678909 - DNA, 16 bp, Homo sapiens
cagggccagtggggcc

SEQ ID NO: 678910 - DNA, 19 bp, Homo sapiens
cagggccagtggggcctgt

SEQ ID NO: 678911 - DNA, 22 bp, Homo sapiens
cagggccagtggggcctgtgga

SEQ ID NO: 678912 - DNA, 17 bp, Homo sapiens
cagggccatggctcagg

SEQ ID NO: 678913 - DNA, 12 bp, Homo sapiens
cagggcctgggg

SEQ ID NO: 678914 - DNA, 13 bp, Homo sapiens
cagggcctggggc

SEQ ID NO: 678915 - DNA, 14 bp, Homo sapiens
cagggcctggggcc

SEQ ID NO: 678916 - DNA, 18 bp, Homo sapiens
cagggcctggggcctgag

SEQ ID NO: 678917 - DNA, 20 bp, Homo sapiens
cagggccttttctggcaccg

SEQ ID NO: 678918 - DNA, 14 bp, Homo sapiens
cagggctcccaggg

SEQ ID NO: 678919 - DNA, 23 bp, Homo sapiens
cagggctgccctgagaagctgct

SEQ ID NO: 678920 - DNA, 14 bp, Homo sapiens
cagggctggagcct

SEQ ID NO: 678921 - DNA, 21 bp, Homo sapiens
cagggcttgtccctccaactg

SEQ ID NO: 678922 - DNA, 13 bp, Homo sapiens
caggggtcctaac

SEQ ID NO: 678923 - DNA, 17 bp, Homo sapiens
caggggtctccctggct

SEQ ID NO: 678924 - DNA, 19 bp, Homo sapiens
caggggtctccctggctcc

SEQ ID NO: 678925 - DNA, 20 bp, Homo sapiens
caggggtctccctggctccc

SEQ ID NO: 678926 - DNA, 20 bp, Homo sapiens
cagggtccaggagagcctgg

SEQ ID NO: 678927 - DNA, 21 bp, Homo sapiens
cagggtccaggagagcctggg

SEQ ID NO: 678928 - DNA, 18 bp, Homo sapiens
cagggtctccttccttcc

SEQ ID NO: 678929 - DNA, 15 bp, Homo sapiens
cagggtctctccctc

SEQ ID NO: 678930 - DNA, 14 bp, Homo sapiens
atttgaagggtctt

SEQ ID NO: 678931 - DNA, 22 bp, Homo sapiens
atttgaagtaacttatttgact

SEQ ID NO: 678932 - DNA, 13 bp, Homo sapiens
atttgactatgaa

SEQ ID NO: 678933 - DNA, 17 bp, Homo sapiens
atttgagccatttaaag

SEQ ID NO: 678934 - DNA, 18 bp, Homo sapiens
atttgagccatttaaaga

SEQ ID NO: 678935 - DNA, 17 bp, Homo sapiens
atttgatgatgttaaat

SEQ ID NO: 678936 - DNA, 19 bp, Homo sapiens
atttgatgatgttaaatgt

SEQ ID NO: 678937 - DNA, 22 bp, Homo sapiens
atttgatgcccaatatattctg

SEQ ID NO: 678938 - DNA, 20 bp, Homo sapiens
atttgattatgtatggatat

SEQ ID NO: 678939 - DNA, 13 bp, Homo sapiens
atttgatttctaa

SEQ ID NO: 678940 - DNA, 15 bp, Homo sapiens
atttgatttctaatt

SEQ ID NO: 678941 - DNA, 20 bp, Homo sapiens
atttgatttctaattgtaag

SEQ ID NO: 678942 - DNA, 21 bp, Homo sapiens
atttgatttctaattgtaagt

SEQ ID NO: 678943 - DNA, 18 bp, Homo sapiens
atttgcaatttgagccat

SEQ ID NO: 678944 - DNA, 21 bp, Homo sapiens
atttgctaatgtataatgtgc

SEQ ID NO: 678945 - DNA, 16 bp, Homo sapiens
atttgctgaactcagc

SEQ ID NO: 678946 - DNA, 14 bp, Homo sapiens
atttgctttggaag

SEQ ID NO: 678947 - DNA, 17 bp, Homo sapiens
atttggtgctctgctaa

SEQ ID NO: 678948 - DNA, 13 bp, Homo sapiens
atttggtgtgttc

SEQ ID NO: 678949 - DNA, 14 bp, Homo sapiens
atttggtgtgttcg

SEQ ID NO: 678950 - DNA, 22 bp, Homo sapiens
atttggtgtttgcttgaatgct

SEQ ID NO: 678951 - DNA, 18 bp, Homo sapiens
atttgtaaaacttctgct

SEQ ID NO: 678952 - DNA, 21 bp, Homo sapiens
atttgtaagtgtaaaaaatgt

SEQ ID NO: 678953 - DNA, 22 bp, Homo sapiens
atttgtgctttttaagaatatt

SEQ ID NO: 678954 - DNA, 22 bp, Homo sapiens
atttgtggtaatctacaccaat

SEQ ID NO: 678955 - DNA, 17 bp, Homo sapiens
atttgttatatataata

SEQ ID NO: 678956 - DNA, 21 bp, Homo sapiens
atttgttatatataataaata

SEQ ID NO: 678957 - DNA, 17 bp, Homo sapiens
atttgtttatttgcaat

SEQ ID NO: 678958 - DNA, 16 bp, Homo sapiens
atttgtttattttttg

SEQ ID NO: 678959 - DNA, 18 bp, Homo sapiens
atttgtttctttctctga

SEQ ID NO: 678960 - DNA, 15 bp, Homo sapiens
attttaaacagagga

SEQ ID NO: 678961 - DNA, 12 bp, Homo sapiens
attttaatacat

SEQ ID NO: 678962 - DNA, 20 bp, Homo sapiens
attttaatgctgtttctaag

SEQ ID NO: 678963 - DNA, 13 bp, Homo sapiens
attttacacatta

SEQ ID NO: 678964 - DNA, 17 bp, Homo sapiens
attttaggaacttcaga

SEQ ID NO: 678965 - DNA, 21 bp, Homo sapiens
attttatatcattttaaaatg

SEQ ID NO: 678966 - DNA, 22 bp, Homo sapiens
attttattaataatatttatgt

SEQ ID NO: 678967 - DNA, 22 bp, Homo sapiens
attttattttgtgctcatttaa

SEQ ID NO: 678968 - DNA, 15 bp, Homo sapiens
attttcaagtttaca

SEQ ID NO: 678969 - DNA, 14 bp, Homo sapiens
attttcaccgagca

SEQ ID NO: 678970 - DNA, 17 bp, Homo sapiens
attttcagaagttaaca

SEQ ID NO: 678971 - DNA, 20 bp, Homo sapiens
attttcagaagttaacatca

SEQ ID NO: 678972 - DNA, 17 bp, Homo sapiens
attttcataatcagtaa

SEQ ID NO: 678973 - DNA, 20 bp, Homo sapiens
attttctaaataaaaatatg

SEQ ID NO: 678974 - DNA, 17 bp, Homo sapiens
attttctcccaagctga

SEQ ID NO: 678975 - DNA, 24 bp, Homo sapiens
attttgacagttattttgataaca

SEQ ID NO: 678976 - DNA, 14 bp, Homo sapiens
attttgagaaactg

SEQ ID NO: 678977 - DNA, 23 bp, Homo sapiens
attttgagaaactgctgcagatt

SEQ ID NO: 678978 - DNA, 20 bp, Homo sapiens
attttgcaaaaatcctattc

SEQ ID NO: 678979 - DNA, 22 bp, Homo sapiens
attttgcaaaaatcctattctg

SEQ ID NO: 678980 - DNA, 10 bp, Homo sapiens
attttgcaca

SEQ ID NO: 678981 - DNA, 12 bp, Homo sapiens
attttgcacaaa

SEQ ID NO: 678982 - DNA, 15 bp, Homo sapiens
attttggattaattt

SEQ ID NO: 678983 - DNA, 10 bp, Homo sapiens
attttgtatg

SEQ ID NO: 678984 - DNA, 16 bp, Homo sapiens
attttgtgctcattta

SEQ ID NO: 678985 - DNA, 22 bp, Homo sapiens
attttgttacataaggatgact

SEQ ID NO: 678986 - DNA, 18 bp, Homo sapiens
atttttaagaaagtaatt

SEQ ID NO: 678987 - DNA, 17 bp, Homo sapiens
atttttagactatttct

SEQ ID NO: 678988 - DNA, 19 bp, Homo sapiens
atttttagactatttcttt

SEQ ID NO: 678989 - DNA, 21 bp, Homo sapiens
atttttataattgtacaaaat

SEQ ID NO: 678990 - DNA, 14 bp, Homo sapiens
atttttatttatga

SEQ ID NO: 678991 - DNA, 20 bp, Homo sapiens
atttttatttatttttcttg

SEQ ID NO: 678992 - DNA, 18 bp, Homo sapiens
atttttcatctttaagaa

SEQ ID NO: 678993 - DNA, 18 bp, Homo sapiens
atttttctcccaagaaac

SEQ ID NO: 678994 - DNA, 24 bp, Homo sapiens
atttttctcccaagaaacctgact

SEQ ID NO: 678995 - DNA, 19 bp, Homo sapiens
atttttcttagtgttgtgg

SEQ ID NO: 678996 - DNA, 22 bp, Homo sapiens
atttttgtttttgagtactgta

SEQ ID NO: 678997 - DNA, 13 bp, Homo sapiens
atccccatctccc

SEQ ID NO: 678998 - DNA, 19 bp, Homo sapiens
atccccatctccctgcctg

SEQ ID NO: 678999 - DNA, 11 bp, Homo sapiens
atccctctctt

SEQ ID NO: 679000 - DNA, 19 bp, Homo sapiens
atccctctcttccccttcc

SEQ ID NO: 679001 - DNA, 19 bp, Homo sapiens
atccgcctacctcagcctc

SEQ ID NO: 679002 - DNA, 16 bp, Homo sapiens
atccgcgtgtgcctgt

SEQ ID NO: 679003 - DNA, 20 bp, Homo sapiens
atccgctgccagccttgagc

SEQ ID NO: 679004 - DNA, 18 bp, Homo sapiens
atcctaaatttaccctct

SEQ ID NO: 679005 - DNA, 15 bp, Homo sapiens
atcctacagtacaat

SEQ ID NO: 679006 - DNA, 17 bp, Homo sapiens
atcctacagtacaatca

SEQ ID NO: 679007 - DNA, 21 bp, Homo sapiens
atcctccagtaccttgcttct

SEQ ID NO: 679008 - DNA, 16 bp, Homo sapiens
atcctccctggcagac

SEQ ID NO: 679009 - DNA, 17 bp, Homo sapiens
atcctccctggcagaca

SEQ ID NO: 679010 - DNA, 20 bp, Homo sapiens
atcctccctggcagacacaa

SEQ ID NO: 679011 - DNA, 18 bp, Homo sapiens
atcctcttttaatggcat

SEQ ID NO: 679012 - DNA, 22 bp, Homo sapiens
atcctgcagatactttgaagtg

SEQ ID NO: 679013 - DNA, 16 bp, Homo sapiens
atcctgccatttaaaa

SEQ ID NO: 679014 - DNA, 13 bp, Homo sapiens
atcctggccctgg

SEQ ID NO: 679015 - DNA, 18 bp, Homo sapiens
atcctggctaacatggtg

SEQ ID NO: 679016 - DNA, 14 bp, Homo sapiens
atcctggtttcata

SEQ ID NO: 679017 - DNA, 13 bp, Homo sapiens
atccttacaatgt

SEQ ID NO: 679018 - DNA, 20 bp, Homo sapiens
atccttacaatgtgaataat

SEQ ID NO: 679019 - DNA, 19 bp, Homo sapiens
atccttataggcctgtccc

SEQ ID NO: 679020 - DNA, 21 bp, Homo sapiens
atccttataggcctgtccctt

SEQ ID NO: 679021 - DNA, 14 bp, Homo sapiens
atccttctttgtaa

SEQ ID NO: 679022 - DNA, 20 bp, Homo sapiens
atccttttccttatttgcct

SEQ ID NO: 679023 - DNA, 16 bp, Homo sapiens
atcgagaccatcctgg

SEQ ID NO: 679024 - DNA, 20 bp, Homo sapiens
atcgatttagtaagtatgtt

SEQ ID NO: 679025 - DNA, 20 bp, Homo sapiens
atcgccagaggtgcttcacc

SEQ ID NO: 679026 - DNA, 18 bp, Homo sapiens
atcgcttttaataaactg

SEQ ID NO: 679027 - DNA, 21 bp, Homo sapiens
atcggtgaaactaacagataa

SEQ ID NO: 679028 - DNA, 15 bp, Homo sapiens
atcgtacctattgca

SEQ ID NO: 679029 - DNA, 19 bp, Homo sapiens
atcgtagaaaatttgcttt

SEQ ID NO: 679030 - DNA, 21 bp, Homo sapiens
atcgtgtattgagatttctta

SEQ ID NO: 679031 - DNA, 15 bp, Homo sapiens
atcgtttttgtattt

SEQ ID NO: 679032 - DNA, 18 bp, Homo sapiens
atctaaaagctctgttcc

SEQ ID NO: 679033 - DNA, 20 bp, Homo sapiens
atctaacgtgttccagtgtc

SEQ ID NO: 679034 - DNA, 14 bp, Homo sapiens
atctaatctaaaag

SEQ ID NO: 679035 - DNA, 14 bp, Homo sapiens
atctacaatctctt

SEQ ID NO: 679036 - DNA, 19 bp, Homo sapiens
atctagccagcccctcttc

SEQ ID NO: 679037 - DNA, 23 bp, Homo sapiens
atctagggaatgggactgtgagg

SEQ ID NO: 679038 - DNA, 11 bp, Homo sapiens
atctataaaat

SEQ ID NO: 679039 - DNA, 12 bp, Homo sapiens
acttcattttta

SEQ ID NO: 679040 - DNA, 20 bp, Homo sapiens
acttcatttttaagaaagga

SEQ ID NO: 679041 - DNA, 17 bp, Homo sapiens
acttcccaccctgcccc

SEQ ID NO: 679042 - DNA, 12 bp, Homo sapiens
acttcctgtact

SEQ ID NO: 679043 - DNA, 21 bp, Homo sapiens
acttcctttgcccttcctcct

SEQ ID NO: 679044 - DNA, 13 bp, Homo sapiens
acttctaatttat

SEQ ID NO: 679045 - DNA, 14 bp, Homo sapiens
acttctacctgccc

SEQ ID NO: 679046 - DNA, 16 bp, Homo sapiens
acttctcaaagagaat

SEQ ID NO: 679047 - DNA, 22 bp, Homo sapiens
acttgaagtctaaaagcagaaa

SEQ ID NO: 679048 - DNA, 15 bp, Homo sapiens
acttgagacaatgtt

SEQ ID NO: 679049 - DNA, 19 bp, Homo sapiens
acttgatagcaaacactgg

SEQ ID NO: 679050 - DNA, 20 bp, Homo sapiens
acttgatcatttttaccatt

SEQ ID NO: 679051 - DNA, 17 bp, Homo sapiens
acttgcaagataatttt

SEQ ID NO: 679052 - DNA, 15 bp, Homo sapiens
acttgctgctttttc

SEQ ID NO: 679053 - DNA, 22 bp, Homo sapiens
acttgggaggctgaggcaggag

SEQ ID NO: 679054 - DNA, 20 bp, Homo sapiens
acttggggacataatttcag

SEQ ID NO: 679055 - DNA, 22 bp, Homo sapiens
acttgtacaaacagtatttctg

SEQ ID NO: 679056 - DNA, 14 bp, Homo sapiens
actttaacattttg

SEQ ID NO: 679057 - DNA, 21 bp, Homo sapiens
actttaacattttggaaattg

SEQ ID NO: 679058 - DNA, 17 bp, Homo sapiens
actttattaagtaaaat

SEQ ID NO: 679059 - DNA, 17 bp, Homo sapiens
actttccgagcctccag

SEQ ID NO: 679060 - DNA, 12 bp, Homo sapiens
actttctcctgg

SEQ ID NO: 679061 - DNA, 16 bp, Homo sapiens
actttgaagtgcagct

SEQ ID NO: 679062 - DNA, 14 bp, Homo sapiens
actttgccactgct

SEQ ID NO: 679063 - DNA, 18 bp, Homo sapiens
actttgccactgctgtat

SEQ ID NO: 679064 - DNA, 21 bp, Homo sapiens
actttgccactgctgtatttt

SEQ ID NO: 679065 - DNA, 12 bp, Homo sapiens
actttgggaggc

SEQ ID NO: 679066 - DNA, 21 bp, Homo sapiens
actttgggaggccgaggcggg

SEQ ID NO: 679067 - DNA, 17 bp, Homo sapiens
actttgtaaaaatcttt

SEQ ID NO: 679068 - DNA, 16 bp, Homo sapiens
actttgtgactgtcac

SEQ ID NO: 679069 - DNA, 12 bp, Homo sapiens
acttttaattta

SEQ ID NO: 679070 - DNA, 17 bp, Homo sapiens
acttttagaaatgcata

SEQ ID NO: 679071 - DNA, 22 bp, Homo sapiens
acttttatgcagcaaatatatg

SEQ ID NO: 679072 - DNA, 15 bp, Homo sapiens
acttttattttcttt

SEQ ID NO: 679073 - DNA, 12 bp, Homo sapiens
acttttgttaaa

SEQ ID NO: 679074 - DNA, 13 bp, Homo sapiens
agaaaaataaaat

SEQ ID NO: 679075 - DNA, 16 bp, Homo sapiens
agaaaaataaaatgtt

SEQ ID NO: 679076 - DNA, 16 bp, Homo sapiens
agaaaactgtgatttc

SEQ ID NO: 679077 - DNA, 19 bp, Homo sapiens
agaaaatatttaatatcaa

SEQ ID NO: 679078 - DNA, 17 bp, Homo sapiens
agaaaatctttgttgaa

SEQ ID NO: 679079 - DNA, 11 bp, Homo sapiens
agaaaatgaag

SEQ ID NO: 679080 - DNA, 22 bp, Homo sapiens
agaaaatgtcagtagtgctaat

SEQ ID NO: 679081 - DNA, 18 bp, Homo sapiens
agaaaattcttgagaagt

SEQ ID NO: 679082 - DNA, 13 bp, Homo sapiens
agaaaattgagtt

SEQ ID NO: 679083 - DNA, 22 bp, Homo sapiens
agaaaattgagttgcacttatt

SEQ ID NO: 679084 - DNA, 15 bp, Homo sapiens
agaaaccttgctctc

SEQ ID NO: 679085 - DNA, 19 bp, Homo sapiens
agaaaccttgctctcctca

SEQ ID NO: 679086 - DNA, 16 bp, Homo sapiens
agaaactgaaaaatat

SEQ ID NO: 679087 - DNA, 18 bp, Homo sapiens
agaaactgaaaaatatct

SEQ ID NO: 679088 - DNA, 13 bp, Homo sapiens
agaaacttaaaca

SEQ ID NO: 679089 - DNA, 12 bp, Homo sapiens
agaaacttttct

SEQ ID NO: 679090 - DNA, 18 bp, Homo sapiens
agaaagcatatcccacca

SEQ ID NO: 679091 - DNA, 18 bp, Homo sapiens
agaaagcctaaaattgag

SEQ ID NO: 679092 - DNA, 13 bp, Homo sapiens
agaaaggaagcaa

SEQ ID NO: 679093 - DNA, 14 bp, Homo sapiens
agaaaggctctgaa

SEQ ID NO: 679094 - DNA, 18 bp, Homo sapiens
agaaaggctctgaaggtc

SEQ ID NO: 679095 - DNA, 13 bp, Homo sapiens
agaaagtaattta

SEQ ID NO: 679096 - DNA, 17 bp, Homo sapiens
agaaagtaatttaattt

SEQ ID NO: 679097 - DNA, 18 bp, Homo sapiens
agaaagtaatttaatttg

SEQ ID NO: 679098 - DNA, 21 bp, Homo sapiens
agaaagtaatttaatttgtaa

SEQ ID NO: 679099 - DNA, 22 bp, Homo sapiens
agaaataatgctacaattttaa

SEQ ID NO: 679100 - DNA, 16 bp, Homo sapiens
agaaatatattttttg

SEQ ID NO: 679101 - DNA, 13 bp, Homo sapiens
agaaatgcatatt

SEQ ID NO: 679102 - DNA, 15 bp, Homo sapiens
agaaatgcatatttg

SEQ ID NO: 679103 - DNA, 16 bp, Homo sapiens
agaaatggaaagcaga

SEQ ID NO: 679104 - DNA, 12 bp, Homo sapiens
agaaattagaaa

SEQ ID NO: 679105 - DNA, 21 bp, Homo sapiens
agaacactgtagctacatttt

SEQ ID NO: 679106 - DNA, 17 bp, Homo sapiens
agaacaggaggtgtgaa

SEQ ID NO: 679107 - DNA, 19 bp, Homo sapiens
agaacaggaggtgtgaatg

SEQ ID NO: 679108 - DNA, 21 bp, Homo sapiens
agaacaggaggtgtgaatgca

SEQ ID NO: 679109 - DNA, 21 bp, Homo sapiens
agaacagggtcatgtttgcag

SEQ ID NO: 679110 - DNA, 15 bp, Homo sapiens
agaaccaaatacctc

SEQ ID NO: 679111 - DNA, 20 bp, Homo sapiens
agaaccacacttgaaacctt

SEQ ID NO: 679112 - DNA, 17 bp, Homo sapiens
agaactcattcatagga

SEQ ID NO: 679113 - DNA, 16 bp, Homo sapiens
agaactccaggccctc

SEQ ID NO: 679114 - DNA, 17 bp, Homo sapiens
agaactccaggccctcc

SEQ ID NO: 679115 - DNA, 20 bp, Homo sapiens
agaactgaagtgtgctgtga

SEQ ID NO: 679116 - DNA, 20 bp, Homo sapiens
agaagaaccaaatacctcaa

SEQ ID NO: 679117 - DNA, 16 bp, Homo sapiens
agaagaagttcatgtc

SEQ ID NO: 679118 - DNA, 15 bp, Homo sapiens
agaagacaaactgct

SEQ ID NO: 679119 - DNA, 21 bp, Homo sapiens
agaagacgggaggggaggcat

SEQ ID NO: 679120 - DNA, 16 bp, Homo sapiens
agaagattagaaacta

SEQ ID NO: 679121 - DNA, 14 bp, Homo sapiens
agaagcaaagttca

SEQ ID NO: 679122 - DNA, 15 bp, Homo sapiens
agaagcaaagttcaa

SEQ ID NO: 679123 - DNA, 18 bp, Homo sapiens
agaagcaaagttcaactt

SEQ ID NO: 679124 - DNA, 19 bp, Homo sapiens
agaagcaaagttcaactta

SEQ ID NO: 679125 - DNA, 14 bp, Homo sapiens
agaagcaaatatag

SEQ ID NO: 679126 - DNA, 23 bp, Homo sapiens
agaagccccgacacacggggctc

SEQ ID NO: 679127 - DNA, 21 bp, Homo sapiens
agaagccgagagccttttgtg

SEQ ID NO: 679128 - DNA, 18 bp, Homo sapiens
agaagctaaggtttagat

SEQ ID NO: 679129 - DNA, 18 bp, Homo sapiens
agaagctgctccaggcct

SEQ ID NO: 679130 - DNA, 22 bp, Homo sapiens
agaaggagtagctgccctttct

SEQ ID NO: 679131 - DNA, 20 bp, Homo sapiens
agaaggtaaggtgtgaacct

SEQ ID NO: 679132 - DNA, 18 bp, Homo sapiens
agaaggtttctggagcag

SEQ ID NO: 679133 - DNA, 20 bp, Homo sapiens
agaagtctgtccaaatttaa

SEQ ID NO: 679134 - DNA, 23 bp, Homo sapiens
agaagtctgtccaaatttaaaat

SEQ ID NO: 679135 - DNA, 21 bp, Homo sapiens
agaagtttggctgctgtcata

SEQ ID NO: 679136 - DNA, 22 bp, Homo sapiens
agaagtttggctgctgtcataa

SEQ ID NO: 679137 - DNA, 16 bp, Homo sapiens
agaataaggcaggcat

SEQ ID NO: 679138 - DNA, 17 bp, Homo sapiens
agaataatcaaatacat

SEQ ID NO: 679139 - DNA, 16 bp, Homo sapiens
agaataccacatcaaa

SEQ ID NO: 679140 - DNA, 17 bp, Homo sapiens
agaataccacatcaaat

SEQ ID NO: 679141 - DNA, 12 bp, Homo sapiens
agaatatacctt

SEQ ID NO: 679142 - DNA, 17 bp, Homo sapiens
agaatataccttattta

SEQ ID NO: 679143 - DNA, 19 bp, Homo sapiens
agaatataccttatttatt

SEQ ID NO: 679144 - DNA, 22 bp, Homo sapiens
agaatatcctttaaaatttaaa

SEQ ID NO: 679145 - DNA, 22 bp, Homo sapiens
agaatctcttcatgcttgacat

SEQ ID NO: 679146 - DNA, 23 bp, Homo sapiens
agaatctcttcatgcttgacata

SEQ ID NO: 679147 - DNA, 19 bp, Homo sapiens
agaatggtgtgaacccggg

SEQ ID NO: 679148 - DNA, 15 bp, Homo sapiens
agaatgttgtattca

SEQ ID NO: 679149 - DNA, 18 bp, Homo sapiens
agaatgttgtattcagtg

SEQ ID NO: 679150 - DNA, 19 bp, Homo sapiens
agaatgttgtattcagtga

SEQ ID NO: 679151 - DNA, 20 bp, Homo sapiens
agaattagatttctatagga

SEQ ID NO: 679152 - DNA, 21 bp, Homo sapiens
agaattagtgccagaatttta

SEQ ID NO: 679153 - DNA, 22 bp, Homo sapiens
agaattagtgccagaattttag

SEQ ID NO: 679154 - DNA, 17 bp, Homo sapiens
agaattgaaaagttttt

SEQ ID NO: 679155 - DNA, 15 bp, Homo sapiens
agttgtatgtttgct

SEQ ID NO: 679156 - DNA, 17 bp, Homo sapiens
agttgtatgtttgctga

SEQ ID NO: 679157 - DNA, 18 bp, Homo sapiens
agttgtatgtttgctgat

SEQ ID NO: 679158 - DNA, 17 bp, Homo sapiens
agttgtccacaaatctt

SEQ ID NO: 679159 - DNA, 20 bp, Homo sapiens
agttgttagattaagaaata

SEQ ID NO: 679160 - DNA, 13 bp, Homo sapiens
agtttaaaagcca

SEQ ID NO: 679161 - DNA, 12 bp, Homo sapiens
agtttaccatct

SEQ ID NO: 679162 - DNA, 18 bp, Homo sapiens
agtttcagtttgttggaa

SEQ ID NO: 679163 - DNA, 19 bp, Homo sapiens
agtttcagtttgttggaaa

SEQ ID NO: 679164 - DNA, 15 bp, Homo sapiens
agtttccaaaaccag

SEQ ID NO: 679165 - DNA, 17 bp, Homo sapiens
agtttcttacacactgt

SEQ ID NO: 679166 - DNA, 19 bp, Homo sapiens
agtttcttacacactgtct

SEQ ID NO: 679167 - DNA, 17 bp, Homo sapiens
agtttgtagaactttat

SEQ ID NO: 679168 - DNA, 14 bp, Homo sapiens
agtttgtctatttt

SEQ ID NO: 679169 - DNA, 13 bp, Homo sapiens
agtttgttggaaa

SEQ ID NO: 679170 - DNA, 19 bp, Homo sapiens
agttttaactttaatacag

SEQ ID NO: 679171 - DNA, 20 bp, Homo sapiens
agttttaactttaatacagc

SEQ ID NO: 679172 - DNA, 23 bp, Homo sapiens
agttttactgtctattaatattc

SEQ ID NO: 679173 - DNA, 14 bp, Homo sapiens
agttttatatgctt

SEQ ID NO: 679174 - DNA, 15 bp, Homo sapiens
agttttatatgcttt

SEQ ID NO: 679175 - DNA, 17 bp, Homo sapiens
agttttatatgctttat

SEQ ID NO: 679176 - DNA, 15 bp, Homo sapiens
agttttcattaaatc

SEQ ID NO: 679177 - DNA, 15 bp, Homo sapiens
agttttcttccatga

SEQ ID NO: 679178 - DNA, 23 bp, Homo sapiens
agttttgttttaaaactggacct

SEQ ID NO: 679179 - DNA, 23 bp, Homo sapiens
agtttttatttagcatggggatt

SEQ ID NO: 679180 - DNA, 23 bp, Homo sapiens
agtttttctgttttgtttggcaa

SEQ ID NO: 679181 - DNA, 16 bp, Homo sapiens
agtttttggttgggaa

SEQ ID NO: 679182 - DNA, 19 bp, Homo sapiens
ataaaaaagaacttttgta

SEQ ID NO: 679183 - DNA, 17 bp, Homo sapiens
ataaaaacaagtcattt

SEQ ID NO: 679184 - DNA, 13 bp, Homo sapiens
ataaaaatgcatt

SEQ ID NO: 679185 - DNA, 18 bp, Homo sapiens
ataaaactctagcagttg

SEQ ID NO: 679186 - DNA, 17 bp, Homo sapiens
ataaaacttaaaaacaa

SEQ ID NO: 679187 - DNA, 14 bp, Homo sapiens
ataaaataaataat

SEQ ID NO: 679188 - DNA, 15 bp, Homo sapiens
ataaaataaataatt

SEQ ID NO: 679189 - DNA, 18 bp, Homo sapiens
ataaaatacatagtgaaa

SEQ ID NO: 679190 - DNA, 14 bp, Homo sapiens
ataaaatatcataa

SEQ ID NO: 679191 - DNA, 16 bp, Homo sapiens
ataaaatcctgtgcaa

SEQ ID NO: 679192 - DNA, 21 bp, Homo sapiens
ataaaatggacacaaattttc

SEQ ID NO: 679193 - DNA, 11 bp, Homo sapiens
ataaaatgtgc

SEQ ID NO: 679194 - DNA, 20 bp, Homo sapiens
ataaaatttaaaaaataaat

SEQ ID NO: 679195 - DNA, 14 bp, Homo sapiens
ataaacagacaata

SEQ ID NO: 679196 - DNA, 17 bp, Homo sapiens
ataaactatttatatca

SEQ ID NO: 679197 - DNA, 23 bp, Homo sapiens
ataaactatttatatcacacaat

SEQ ID NO: 679198 - DNA, 14 bp, Homo sapiens
ataaactcatttat

SEQ ID NO: 679199 - DNA, 12 bp, Homo sapiens
ataaagcatgtg

SEQ ID NO: 679200 - DNA, 12 bp, Homo sapiens
ataaagccactg

SEQ ID NO: 679201 - DNA, 16 bp, Homo sapiens
ataaagccactgaaaa

SEQ ID NO: 679202 - DNA, 15 bp, Homo sapiens
ataaagccttttaaa

SEQ ID NO: 679203 - DNA, 17 bp, Homo sapiens
ataaagcttaaatttta

SEQ ID NO: 679204 - DNA, 12 bp, Homo sapiens
ataaaggcagct

SEQ ID NO: 679205 - DNA, 15 bp, Homo sapiens
ataaaggcagctgcc

SEQ ID NO: 679206 - DNA, 21 bp, Homo sapiens
ataaaggcagctgcctctgct

SEQ ID NO: 679207 - DNA, 23 bp, Homo sapiens
ataaaggcagctgcctctgctcc

SEQ ID NO: 679208 - DNA, 14 bp, Homo sapiens
ataaagtacaaatg

SEQ ID NO: 679209 - DNA, 22 bp, Homo sapiens
ataaagtacaaatgaagaaagt

SEQ ID NO: 679210 - DNA, 17 bp, Homo sapiens
ataaagtgcacaccttt

SEQ ID NO: 679211 - DNA, 23 bp, Homo sapiens
ataaagtgcacacctttattcag

SEQ ID NO: 679212 - DNA, 15 bp, Homo sapiens
ataaagttacagttt

SEQ ID NO: 679213 - DNA, 16 bp, Homo sapiens
ataaagttgtattgca

SEQ ID NO: 679214 - DNA, 17 bp, Homo sapiens
ataaagttgtattgcat

SEQ ID NO: 679215 - DNA, 20 bp, Homo sapiens
ataaataacccataattgaa

SEQ ID NO: 679216 - DNA, 12 bp, Homo sapiens
ataaataatttt

SEQ ID NO: 679217 - DNA, 13 bp, Homo sapiens
ataaataatttta

SEQ ID NO: 679218 - DNA, 16 bp, Homo sapiens
ataaatataatttata

SEQ ID NO: 679219 - DNA, 20 bp, Homo sapiens
ataaatataatttataagca

SEQ ID NO: 679220 - DNA, 21 bp, Homo sapiens
ataaatataatttataagcat

SEQ ID NO: 679221 - DNA, 15 bp, Homo sapiens
ataaatatatacatt

SEQ ID NO: 679222 - DNA, 14 bp, Homo sapiens
ataaatatttatgt

SEQ ID NO: 679223 - DNA, 14 bp, Homo sapiens
ataaatctcttctt

SEQ ID NO: 679224 - DNA, 17 bp, Homo sapiens
ataaatgcataatttat

SEQ ID NO: 679225 - DNA, 17 bp, Homo sapiens
ataaatgtataaatata

SEQ ID NO: 679226 - DNA, 14 bp, Homo sapiens
ataaattaggacca

SEQ ID NO: 679227 - DNA, 15 bp, Homo sapiens
ataaattatggcatt

SEQ ID NO: 679228 - DNA, 12 bp, Homo sapiens
ataacacatttt

SEQ ID NO: 679229 - DNA, 13 bp, Homo sapiens
ataacacattttt

SEQ ID NO: 679230 - DNA, 22 bp, Homo sapiens
ataacactgtattttaatgtac

SEQ ID NO: 679231 - DNA, 20 bp, Homo sapiens
ataacatatatggaagagga

SEQ ID NO: 679232 - DNA, 19 bp, Homo sapiens
ataacatgtgaaaagaata

SEQ ID NO: 679233 - DNA, 16 bp, Homo sapiens
ataaccatctgaaagt

SEQ ID NO: 679234 - DNA, 22 bp, Homo sapiens
ataagaaataatgctacaattt

SEQ ID NO: 679235 - DNA, 20 bp, Homo sapiens
ataagacaagagatctacac

SEQ ID NO: 679236 - DNA, 15 bp, Homo sapiens
ataagcaagagagat

SEQ ID NO: 679237 - DNA, 22 bp, Homo sapiens
ataagcttccattttaatttta

SEQ ID NO: 679238 - DNA, 15 bp, Homo sapiens
ataaggatgactttt

SEQ ID NO: 679239 - DNA, 13 bp, Homo sapiens
ataaggcaggcat

SEQ ID NO: 679240 - DNA, 21 bp, Homo sapiens
ataagtagtaaatcagaaagt

SEQ ID NO: 679241 - DNA, 13 bp, Homo sapiens
ataataaaattat

SEQ ID NO: 679242 - DNA, 13 bp, Homo sapiens
ataataaagaata

SEQ ID NO: 679243 - DNA, 13 bp, Homo sapiens
ataataaaggctg

SEQ ID NO: 679244 - DNA, 15 bp, Homo sapiens
ataataagctaaaga

SEQ ID NO: 679245 - DNA, 11 bp, Homo sapiens
ataatataaaa

SEQ ID NO: 679246 - DNA, 16 bp, Homo sapiens
atatattttgtgtgaa

SEQ ID NO: 679247 - DNA, 22 bp, Homo sapiens
atatattttgtgtgaaattgca

SEQ ID NO: 679248 - DNA, 21 bp, Homo sapiens
atatattttttgttattatta

SEQ ID NO: 679249 - DNA, 13 bp, Homo sapiens
atatcacacaata

SEQ ID NO: 679250 - DNA, 14 bp, Homo sapiens
atatcacacaatat

SEQ ID NO: 679251 - DNA, 15 bp, Homo sapiens
atatcactaaaagca

SEQ ID NO: 679252 - DNA, 19 bp, Homo sapiens
atatcactaaaagcatgaa

SEQ ID NO: 679253 - DNA, 13 bp, Homo sapiens
atatcatatgtat

SEQ ID NO: 679254 - DNA, 14 bp, Homo sapiens
atatccacccagca

SEQ ID NO: 679255 - DNA, 18 bp, Homo sapiens
atatccacccagcaggca

SEQ ID NO: 679256 - DNA, 20 bp, Homo sapiens
atatccacccagcaggcaga

SEQ ID NO: 679257 - DNA, 20 bp, Homo sapiens
atatcttcagctctttttgt

SEQ ID NO: 679258 - DNA, 13 bp, Homo sapiens
atatgataaaaca

SEQ ID NO: 679259 - DNA, 14 bp, Homo sapiens
atatgccactgacc

SEQ ID NO: 679260 - DNA, 17 bp, Homo sapiens
atatgccttaatttaga

SEQ ID NO: 679261 - DNA, 20 bp, Homo sapiens
atatgccttaatttagaaac

SEQ ID NO: 679262 - DNA, 22 bp, Homo sapiens
atatgccttaatttagaaactg

SEQ ID NO: 679263 - DNA, 17 bp, Homo sapiens
atatgctgatcttttaa

SEQ ID NO: 679264 - DNA, 19 bp, Homo sapiens
atatgcttgtaactaaaat

SEQ ID NO: 679265 - DNA, 19 bp, Homo sapiens
atatgctttattaatgttt

SEQ ID NO: 679266 - DNA, 20 bp, Homo sapiens
atatgctttattaatgtttt

SEQ ID NO: 679267 - DNA, 14 bp, Homo sapiens
atatggatcagagg

SEQ ID NO: 679268 - DNA, 19 bp, Homo sapiens
atatggcaggactcctggc

SEQ ID NO: 679269 - DNA, 22 bp, Homo sapiens
atatggcaggactcctggcagg

SEQ ID NO: 679270 - DNA, 20 bp, Homo sapiens
atatgggtgggattttgcaa

SEQ ID NO: 679271 - DNA, 15 bp, Homo sapiens
atatggtatatatac

SEQ ID NO: 679272 - DNA, 19 bp, Homo sapiens
atatggtatatatacatat

SEQ ID NO: 679273 - DNA, 22 bp, Homo sapiens
atatgtaaatggtatgtcattc

SEQ ID NO: 679274 - DNA, 13 bp, Homo sapiens
atatgtaatttca

SEQ ID NO: 679275 - DNA, 21 bp, Homo sapiens
atatgtaatttcaaaatacat

SEQ ID NO: 679276 - DNA, 21 bp, Homo sapiens
atatgtatatatatatatgca

SEQ ID NO: 679277 - DNA, 14 bp, Homo sapiens
atatgtattctttt

SEQ ID NO: 679278 - DNA, 18 bp, Homo sapiens
atatgtattcttttctca

SEQ ID NO: 679279 - DNA, 21 bp, Homo sapiens
atatgttgtaatatttcttca

SEQ ID NO: 679280 - DNA, 20 bp, Homo sapiens
atattacaacatttatgtga

SEQ ID NO: 679281 - DNA, 21 bp, Homo sapiens
atattacaacatttatgtgag

SEQ ID NO: 679282 - DNA, 12 bp, Homo sapiens
atattacattta

SEQ ID NO: 679283 - DNA, 12 bp, Homo sapiens
attcaacaaagt

SEQ ID NO: 679284 - DNA, 13 bp, Homo sapiens
attcaactttgta

SEQ ID NO: 679285 - DNA, 15 bp, Homo sapiens
attcaactttgtaaa

SEQ ID NO: 679286 - DNA, 13 bp, Homo sapiens
attcaagaaagga

SEQ ID NO: 679287 - DNA, 16 bp, Homo sapiens
attcaagaatgaaaaa

SEQ ID NO: 679288 - DNA, 20 bp, Homo sapiens
attcaagagctagaaaaata

SEQ ID NO: 679289 - DNA, 20 bp, Homo sapiens
attcaaggagaatatgataa

SEQ ID NO: 679290 - DNA, 19 bp, Homo sapiens
attcaatatggttacgttg

SEQ ID NO: 679291 - DNA, 13 bp, Homo sapiens
attcaatgtattg

SEQ ID NO: 679292 - DNA, 12 bp, Homo sapiens
attcaattagtg

SEQ ID NO: 679293 - DNA, 16 bp, Homo sapiens
attcaccaaaattatc

SEQ ID NO: 679294 - DNA, 13 bp, Homo sapiens
attcagaacttta

SEQ ID NO: 679295 - DNA, 17 bp, Homo sapiens
attcagaactttagtat

SEQ ID NO: 679296 - DNA, 23 bp, Homo sapiens
attcagatcactgaatttataaa

SEQ ID NO: 679297 - DNA, 14 bp, Homo sapiens
attcagctttgtcc

SEQ ID NO: 679298 - DNA, 18 bp, Homo sapiens
attcagggtaaataggaa

SEQ ID NO: 679299 - DNA, 21 bp, Homo sapiens
attcatatacaaacatgtatg

SEQ ID NO: 679300 - DNA, 14 bp, Homo sapiens
attcatctgtgaat

SEQ ID NO: 679301 - DNA, 17 bp, Homo sapiens
attcatctgtgaatctg

SEQ ID NO: 679302 - DNA, 12 bp, Homo sapiens
attcattggtga

SEQ ID NO: 679303 - DNA, 19 bp, Homo sapiens
attccaagcttcatattaa

SEQ ID NO: 679304 - DNA, 12 bp, Homo sapiens
attccaataaac

SEQ ID NO: 679305 - DNA, 19 bp, Homo sapiens
attccagagctctttgatc

SEQ ID NO: 679306 - DNA, 22 bp, Homo sapiens
attcccaactgagtgttatttg

SEQ ID NO: 679307 - DNA, 19 bp, Homo sapiens
attccgttgtctgtggatg

SEQ ID NO: 679308 - DNA, 18 bp, Homo sapiens
attcctaacttttcaatg

SEQ ID NO: 679309 - DNA, 20 bp, Homo sapiens
attcctctcaccccactcct

SEQ ID NO: 679310 - DNA, 20 bp, Homo sapiens
attcctgagatttcctcctg

SEQ ID NO: 679311 - DNA, 21 bp, Homo sapiens
attcctgtactgtgtctcatg

SEQ ID NO: 679312 - DNA, 15 bp, Homo sapiens
attccttttaaagaa

SEQ ID NO: 679313 - DNA, 22 bp, Homo sapiens
attccttttaaagaagctttat

SEQ ID NO: 679314 - DNA, 23 bp, Homo sapiens
attccttttaaagaagctttatc

SEQ ID NO: 679315 - DNA, 21 bp, Homo sapiens
attcgctactatgatttaatt

SEQ ID NO: 679316 - DNA, 13 bp, Homo sapiens
attctataaaact

SEQ ID NO: 679317 - DNA, 15 bp, Homo sapiens
attctataaaactct

SEQ ID NO: 679318 - DNA, 24 bp, Homo sapiens
attctataaaactctgcatgtaga

SEQ ID NO: 679319 - DNA, 13 bp, Homo sapiens
attctcagggctg

SEQ ID NO: 679320 - DNA, 14 bp, Homo sapiens
attctcagggctgg

SEQ ID NO: 679321 - DNA, 14 bp, Homo sapiens
attctcccctccct

SEQ ID NO: 679322 - DNA, 15 bp, Homo sapiens
attctcctgcctcag

SEQ ID NO: 679323 - DNA, 20 bp, Homo sapiens
attctcctgcctcagcctcc

SEQ ID NO: 679324 - DNA, 19 bp, Homo sapiens
attctgccctccttaattt

SEQ ID NO: 679325 - DNA, 17 bp, Homo sapiens
attctggataaagccac

SEQ ID NO: 679326 - DNA, 17 bp, Homo sapiens
attctggttcttgaaaa

SEQ ID NO: 679327 - DNA, 23 bp, Homo sapiens
attcttaaaaggcccatagcagc

SEQ ID NO: 679328 - DNA, 15 bp, Homo sapiens
attcttctgtcctga

SEQ ID NO: 679329 - DNA, 17 bp, Homo sapiens
attcttgagaagtaact

SEQ ID NO: 679330 - DNA, 19 bp, Homo sapiens
attcttgagaagtaactgt

SEQ ID NO: 679331 - DNA, 17 bp, Homo sapiens
attctttccattatgat

SEQ ID NO: 679332 - DNA, 13 bp, Homo sapiens
attcttttctcag

SEQ ID NO: 679333 - DNA, 19 bp, Homo sapiens
attgaaaaaaattgaaata

SEQ ID NO: 679334 - DNA, 13 bp, Homo sapiens
attgaaaaacaat

SEQ ID NO: 679335 - DNA, 13 bp, Homo sapiens
attgaaaaggaca

SEQ ID NO: 679336 - DNA, 23 bp, Homo sapiens
attgaaaagtttttgtttggaga

SEQ ID NO: 679337 - DNA, 16 bp, Homo sapiens
attgaaagcttttaaa

SEQ ID NO: 679338 - DNA, 20 bp, Homo sapiens
attgaaggcttaattgactg

SEQ ID NO: 679339 - DNA, 21 bp, Homo sapiens
attgaaggcttaattgactga

SEQ ID NO: 679340 - DNA, 20 bp, Homo sapiens
attgacataggtcataaagc

SEQ ID NO: 679341 - DNA, 18 bp, Homo sapiens
attgacttttataaagca

SEQ ID NO: 679342 - DNA, 23 bp, Homo sapiens
attgagtattgtttaaaatgtaa

SEQ ID NO: 679343 - DNA, 15 bp, Homo sapiens
attgataatcttcag

SEQ ID NO: 679344 - DNA, 22 bp, Homo sapiens
attgatattatattaaacatac

SEQ ID NO: 679345 - DNA, 20 bp, Homo sapiens
attgatatttttatacaagt

SEQ ID NO: 679346 - DNA, 18 bp, Homo sapiens
attgattgggaaaacatt

SEQ ID NO: 679347 - DNA, 21 bp, Homo sapiens
attgattgggaaaacatttgc

SEQ ID NO: 679348 - DNA, 14 bp, Homo sapiens
attgatttttaaga

SEQ ID NO: 679349 - DNA, 20 bp, Homo sapiens
attgatttttaagaaagtaa

SEQ ID NO: 679350 - DNA, 16 bp, Homo sapiens
attgcactttttaagt

SEQ ID NO: 679351 - DNA, 20 bp, Homo sapiens
attgcactttttaagtttga

SEQ ID NO: 679352 - DNA, 19 bp, Homo sapiens
attgcagagtgaccagcac

SEQ ID NO: 679353 - DNA, 15 bp, Homo sapiens
attgcatactttgta

SEQ ID NO: 679354 - DNA, 21 bp, Homo sapiens
attgcatactttgtattttga

SEQ ID NO: 679355 - DNA, 16 bp, Homo sapiens
attgcatcactgtatc

SEQ ID NO: 679356 - DNA, 23 bp, Homo sapiens
attgccccatccagacctggctc

SEQ ID NO: 679357 - DNA, 14 bp, Homo sapiens
attgcccctggctt

SEQ ID NO: 679358 - DNA, 19 bp, Homo sapiens
attgcccctggctttgcct

SEQ ID NO: 679359 - DNA, 13 bp, Homo sapiens
attgcctacattt

SEQ ID NO: 679360 - DNA, 13 bp, Homo sapiens
attgctgctgccc

SEQ ID NO: 679361 - DNA, 17 bp, Homo sapiens
attgctgtgtgtcccag

SEQ ID NO: 679362 - DNA, 19 bp, Homo sapiens
attgctgtgtgtcccaggc

SEQ ID NO: 679363 - DNA, 18 bp, Homo sapiens
attgcttttttgtattgg

SEQ ID NO: 679364 - DNA, 16 bp, Homo sapiens
attggaaagacttctc

SEQ ID NO: 679365 - DNA, 16 bp, Homo sapiens
attggaactgcaatga

SEQ ID NO: 679366 - DNA, 18 bp, Homo sapiens
attggagtttcaaatccc

SEQ ID NO: 679367 - DNA, 22 bp, Homo sapiens
attggcaaagtttaaatgtatt

SEQ ID NO: 679368 - DNA, 20 bp, Homo sapiens
attgtaaaagcattttgtaa

SEQ ID NO: 679369 - DNA, 21 bp, Homo sapiens
attgtaaaagcattttgtaat

SEQ ID NO: 679370 - DNA, 15 bp, Homo sapiens
attgtacaaaattaa

SEQ ID NO: 679371 - DNA, 18 bp, Homo sapiens
attgtagggctttagctt

SEQ ID NO: 679372 - DNA, 13 bp, Homo sapiens
attgtcagctact

SEQ ID NO: 679373 - DNA, 15 bp, Homo sapiens
attgtgaagtacata

SEQ ID NO: 679374 - DNA, 20 bp, Homo sapiens
attgtgactttgctttgaga

SEQ ID NO: 679375 - DNA, 21 bp, Homo sapiens
attgtgtatttaaaaaaaaga

SEQ ID NO: 679376 - DNA, 23 bp, Homo sapiens
attgttgtatatcactaaaagca

SEQ ID NO: 679377 - DNA, 19 bp, Homo sapiens
attgtttcttcttcatgct

SEQ ID NO: 679378 - DNA, 17 bp, Homo sapiens
attgtttggtaaatgtt

SEQ ID NO: 679379 - DNA, 21 bp, Homo sapiens
attgttttacctgttctgaaa

SEQ ID NO: 679380 - DNA, 15 bp, Homo sapiens
atttaaaaaaaagaa

SEQ ID NO: 679381 - DNA, 16 bp, Homo sapiens
atttaaaaaaaagaaa

SEQ ID NO: 679382 - DNA, 15 bp, Homo sapiens
atttaaaaacacaaa

SEQ ID NO: 679383 - DNA, 23 bp, Homo sapiens
atttaaaaggatggcaagttgca

SEQ ID NO: 679384 - DNA, 18 bp, Homo sapiens
atttaaaatgtgtgccat

SEQ ID NO: 679385 - DNA, 16 bp, Homo sapiens
atttaaatatctgtta

SEQ ID NO: 679386 - DNA, 13 bp, Homo sapiens
atttaaatgaaag

SEQ ID NO: 679387 - DNA, 15 bp, Homo sapiens
atttaagatgtgaaa

SEQ ID NO: 679388 - DNA, 17 bp, Homo sapiens
atttaatatcaaaagaa

SEQ ID NO: 679389 - DNA, 20 bp, Homo sapiens
atttaatatcaaaagaaaat

SEQ ID NO: 679390 - DNA, 15 bp, Homo sapiens
atttaatatcttcag

SEQ ID NO: 679391 - DNA, 23 bp, Homo sapiens
atttaatccagttataagaagaa

SEQ ID NO: 679392 - DNA, 18 bp, Homo sapiens
atttaatccttctttgta

SEQ ID NO: 679393 - DNA, 22 bp, Homo sapiens
atttaatccttctttgtaatac

SEQ ID NO: 679394 - DNA, 23 bp, Homo sapiens
atttaattcctctttttagggct

SEQ ID NO: 679395 - DNA, 11 bp, Homo sapiens
atttaatttgt

SEQ ID NO: 679396 - DNA, 18 bp, Homo sapiens
atttaatttgtaaaactt

SEQ ID NO: 679397 - DNA, 23 bp, Homo sapiens
atttaatttgtaaaacttctgct

SEQ ID NO: 679398 - DNA, 15 bp, Homo sapiens
atttacaaaagattt

SEQ ID NO: 679399 - DNA, 14 bp, Homo sapiens
atttacaagatatt

SEQ ID NO: 679400 - DNA, 18 bp, Homo sapiens
atttacaagatattatta

SEQ ID NO: 679401 - DNA, 22 bp, Homo sapiens
atttacaagatattattaattt

SEQ ID NO: 679402 - DNA, 14 bp, Homo sapiens
atttagaaactgaa

SEQ ID NO: 679403 - DNA, 17 bp, Homo sapiens
atttagagataggaaac

SEQ ID NO: 679404 - DNA, 19 bp, Homo sapiens
atttagagataggaaactg

SEQ ID NO: 679405 - DNA, 21 bp, Homo sapiens
atgacattttttttaactact

SEQ ID NO: 679406 - DNA, 17 bp, Homo sapiens
atgaccttggggtacaa

SEQ ID NO: 679407 - DNA, 19 bp, Homo sapiens
atgacggaagaacatagaa

SEQ ID NO: 679408 - DNA, 11 bp, Homo sapiens
atgactaaaga

SEQ ID NO: 679409 - DNA, 15 bp, Homo sapiens
atgactaaagagaga

SEQ ID NO: 679410 - DNA, 14 bp, Homo sapiens
atgactgctgattt

SEQ ID NO: 679411 - DNA, 21 bp, Homo sapiens
atgacttagcgtcaagacatt

SEQ ID NO: 679412 - DNA, 23 bp, Homo sapiens
atgacttagcgtcaagacatttg

SEQ ID NO: 679413 - DNA, 14 bp, Homo sapiens
atgagaatatacct

SEQ ID NO: 679414 - DNA, 15 bp, Homo sapiens
atgagactctagggt

SEQ ID NO: 679415 - DNA, 17 bp, Homo sapiens
atgagactctagggtcc

SEQ ID NO: 679416 - DNA, 12 bp, Homo sapiens
atgagcccagag

SEQ ID NO: 679417 - DNA, 16 bp, Homo sapiens
atgagcccagagaaca

SEQ ID NO: 679418 - DNA, 17 bp, Homo sapiens
atgagcccagagaacag

SEQ ID NO: 679419 - DNA, 22 bp, Homo sapiens
atgagctctgaaatcttcccat

SEQ ID NO: 679420 - DNA, 21 bp, Homo sapiens
atgaggaaaattcttaaaagg

SEQ ID NO: 679421 - DNA, 21 bp, Homo sapiens
atgaggaggatgtccctgggc

SEQ ID NO: 679422 - DNA, 13 bp, Homo sapiens
atgagtagccagg

SEQ ID NO: 679423 - DNA, 13 bp, Homo sapiens
atgagtgtgcatg

SEQ ID NO: 679424 - DNA, 14 bp, Homo sapiens
atgataaaataaat

SEQ ID NO: 679425 - DNA, 17 bp, Homo sapiens
atgataaaataaataat

SEQ ID NO: 679426 - DNA, 19 bp, Homo sapiens
atgataaaataaataattt

SEQ ID NO: 679427 - DNA, 21 bp, Homo sapiens
atgataaaataaataatttta

SEQ ID NO: 679428 - DNA, 12 bp, Homo sapiens
atgatagttaaa

SEQ ID NO: 679429 - DNA, 23 bp, Homo sapiens
atgatatgcttgtaactaaaata

SEQ ID NO: 679430 - DNA, 12 bp, Homo sapiens
atgatatttctt

SEQ ID NO: 679431 - DNA, 15 bp, Homo sapiens
atgatatttcttgct

SEQ ID NO: 679432 - DNA, 13 bp, Homo sapiens
atgatcagtgttg

SEQ ID NO: 679433 - DNA, 13 bp, Homo sapiens
atgatggcagagg

SEQ ID NO: 679434 - DNA, 14 bp, Homo sapiens
atgatggttcacgt

SEQ ID NO: 679435 - DNA, 20 bp, Homo sapiens
atgattctttgttacaggca

SEQ ID NO: 679436 - DNA, 18 bp, Homo sapiens
atgattgtttcttcttca

SEQ ID NO: 679437 - DNA, 15 bp, Homo sapiens
atgatttaagtatac

SEQ ID NO: 679438 - DNA, 17 bp, Homo sapiens
atgatttagcaagcaac

SEQ ID NO: 679439 - DNA, 18 bp, Homo sapiens
atgattttcatttcatga

SEQ ID NO: 679440 - DNA, 22 bp, Homo sapiens
atgattttcatttcatgaaaat

SEQ ID NO: 679441 - DNA, 13 bp, Homo sapiens
atgattttccttt

SEQ ID NO: 679442 - DNA, 21 bp, Homo sapiens
atgcaaatgagctctgaaatc

SEQ ID NO: 679443 - DNA, 14 bp, Homo sapiens
atgcaagcagagga

SEQ ID NO: 679444 - DNA, 17 bp, Homo sapiens
atgcaagcagaggacca

SEQ ID NO: 679445 - DNA, 21 bp, Homo sapiens
atgcaagcagaggaccagggc

SEQ ID NO: 679446 - DNA, 18 bp, Homo sapiens
atgcaataactctgggag

SEQ ID NO: 679447 - DNA, 12 bp, Homo sapiens
atgcaataattt

SEQ ID NO: 679448 - DNA, 14 bp, Homo sapiens
atgcaataatttta

SEQ ID NO: 679449 - DNA, 23 bp, Homo sapiens
atgcaatgcttcattattcaaga

SEQ ID NO: 679450 - DNA, 17 bp, Homo sapiens
atgcaatttgattgact

SEQ ID NO: 679451 - DNA, 22 bp, Homo sapiens
atgcacccctgagccagcaggg

SEQ ID NO: 679452 - DNA, 23 bp, Homo sapiens
atgcacgtttcaaagctttcctg

SEQ ID NO: 679453 - DNA, 15 bp, Homo sapiens
atgcagctttgcaaa

SEQ ID NO: 679454 - DNA, 14 bp, Homo sapiens
atgcataatttatg

SEQ ID NO: 679455 - DNA, 20 bp, Homo sapiens
atgcatattaaataataaag

SEQ ID NO: 679456 - DNA, 15 bp, Homo sapiens
atgcatattcaatgt

SEQ ID NO: 679457 - DNA, 17 bp, Homo sapiens
atgcatattcaatgtat

SEQ ID NO: 679458 - DNA, 22 bp, Homo sapiens
atgcattgaacatcttgcattc

SEQ ID NO: 679459 - DNA, 18 bp, Homo sapiens
atgccacatcaaaccttt

SEQ ID NO: 679460 - DNA, 21 bp, Homo sapiens
atgccacctggcaaaggaccc

SEQ ID NO: 679461 - DNA, 15 bp, Homo sapiens
atgcccagctaattt

SEQ ID NO: 679462 - DNA, 21 bp, Homo sapiens
atgcccagctaatttttgtat

SEQ ID NO: 679463 - DNA, 19 bp, Homo sapiens
atgcctgactaatttttgt

SEQ ID NO: 679464 - DNA, 15 bp, Homo sapiens
atgccttaatttaga

SEQ ID NO: 679465 - DNA, 18 bp, Homo sapiens
atgccttaatttagaaac

SEQ ID NO: 679466 - DNA, 21 bp, Homo sapiens
atgccttaatttagaaactga

SEQ ID NO: 679467 - DNA, 22 bp, Homo sapiens
atgccttaatttagaaactgaa

SEQ ID NO: 679468 - DNA, 19 bp, Homo sapiens
atgctaccccactatgaca

SEQ ID NO: 679469 - DNA, 22 bp, Homo sapiens
atgctatggaacataaagttgt

SEQ ID NO: 679470 - DNA, 17 bp, Homo sapiens
atgctcactttattatc

SEQ ID NO: 679471 - DNA, 15 bp, Homo sapiens
atgctccaaatataa

SEQ ID NO: 679472 - DNA, 19 bp, Homo sapiens
atgctccttgagaggagaa

SEQ ID NO: 679473 - DNA, 13 bp, Homo sapiens
atgctgagggtgt

SEQ ID NO: 679474 - DNA, 24 bp, Homo sapiens
atgctgatcatcgccagaggtgct

SEQ ID NO: 679475 - DNA, 12 bp, Homo sapiens
atgctgcagtgg

SEQ ID NO: 679476 - DNA, 14 bp, Homo sapiens
atgctgcctggcac

SEQ ID NO: 679477 - DNA, 13 bp, Homo sapiens
atgctggcaaagg

SEQ ID NO: 679478 - DNA, 23 bp, Homo sapiens
atgctgtgtatatggtatatata

SEQ ID NO: 679479 - DNA, 21 bp, Homo sapiens
atgctgttagtaaatttctgt

SEQ ID NO: 679480 - DNA, 13 bp, Homo sapiens
atgctgtttctaa

SEQ ID NO: 679481 - DNA, 15 bp, Homo sapiens
atgctgtttctaaga

SEQ ID NO: 679482 - DNA, 22 bp, Homo sapiens
atgctgtttctaagaaaatgta

SEQ ID NO: 679483 - DNA, 20 bp, Homo sapiens
atgcttcctgacaatcaact

SEQ ID NO: 679484 - DNA, 22 bp, Homo sapiens
atgcttgtttatgatatttctt

SEQ ID NO: 679485 - DNA, 18 bp, Homo sapiens
atgctttattaatgtttt

SEQ ID NO: 679486 - DNA, 22 bp, Homo sapiens
atgctttattaatgttttcaaa

SEQ ID NO: 679487 - DNA, 23 bp, Homo sapiens
atggaaagcagagttttcattaa

SEQ ID NO: 679488 - DNA, 17 bp, Homo sapiens
atggaaatacagttatt

SEQ ID NO: 679489 - DNA, 14 bp, Homo sapiens
atggaataaattat

SEQ ID NO: 679490 - DNA, 20 bp, Homo sapiens
atggaataaattatggcatt

SEQ ID NO: 679491 - DNA, 21 bp, Homo sapiens
atggaatcccactgtatgatt

SEQ ID NO: 679492 - DNA, 15 bp, Homo sapiens
atggaattttttgaa

SEQ ID NO: 679493 - DNA, 18 bp, Homo sapiens
atggaattttttgaatat

SEQ ID NO: 679494 - DNA, 13 bp, Homo sapiens
atggacacaaatt

SEQ ID NO: 679495 - DNA, 16 bp, Homo sapiens
atggacacaaattttc

SEQ ID NO: 679496 - DNA, 16 bp, Homo sapiens
atggaggccctcctgt

SEQ ID NO: 679497 - DNA, 20 bp, Homo sapiens
atggaggccctcctgtgctg

SEQ ID NO: 679498 - DNA, 17 bp, Homo sapiens
atggagttaacgggtga

SEQ ID NO: 679499 - DNA, 13 bp, Homo sapiens
atggatatatttg

SEQ ID NO: 679500 - DNA, 18 bp, Homo sapiens
atggatattattagaaat

SEQ ID NO: 679501 - DNA, 15 bp, Homo sapiens
atggatgatttaagt

SEQ ID NO: 679502 - DNA, 14 bp, Homo sapiens
atggcagaagggaa

SEQ ID NO: 679503 - DNA, 19 bp, Homo sapiens
atggcaggactcctggcag

SEQ ID NO: 679504 - DNA, 16 bp, Homo sapiens
atggcatcttcaatat

SEQ ID NO: 679505 - DNA, 13 bp, Homo sapiens
atggcccccaata

SEQ ID NO: 679506 - DNA, 14 bp, Homo sapiens
atggcccccaataa

SEQ ID NO: 679507 - DNA, 16 bp, Homo sapiens
atggcccccaataaag

SEQ ID NO: 679508 - DNA, 18 bp, Homo sapiens
atggcccccaataaaggc

SEQ ID NO: 679509 - DNA, 20 bp, Homo sapiens
atggcccccaataaaggcag

SEQ ID NO: 679510 - DNA, 23 bp, Homo sapiens
atggcccccaataaaggcagctg

SEQ ID NO: 679511 - DNA, 13 bp, Homo sapiens
atggccctgggcg

SEQ ID NO: 679512 - DNA, 19 bp, Homo sapiens
atggctatttttgaagcaa

SEQ ID NO: 679513 - DNA, 14 bp, Homo sapiens
atggctcatcagat

SEQ ID NO: 679514 - DNA, 14 bp, Homo sapiens
atggctctgcaccc

SEQ ID NO: 679515 - DNA, 17 bp, Homo sapiens
atggctctgcacccctc

SEQ ID NO: 679516 - DNA, 23 bp, Homo sapiens
atggctctgcacccctctgccct

SEQ ID NO: 679517 - DNA, 20 bp, Homo sapiens
atggcttgtctatactcctt

SEQ ID NO: 679518 - DNA, 16 bp, Homo sapiens
atgggaacaaggaagg

SEQ ID NO: 679519 - DNA, 13 bp, Homo sapiens
atggggaggacaa

SEQ ID NO: 679520 - DNA, 14 bp, Homo sapiens
atggggcagaagag

SEQ ID NO: 679521 - DNA, 15 bp, Homo sapiens
atggggcagaagaga

SEQ ID NO: 679522 - DNA, 16 bp, Homo sapiens
atggggcagaagagaa

SEQ ID NO: 679523 - DNA, 21 bp, Homo sapiens
atgggtgttgtatggggaggc

SEQ ID NO: 679524 - DNA, 16 bp, Homo sapiens
atggtatatatacata

SEQ ID NO: 679525 - DNA, 18 bp, Homo sapiens
tgtatatttgtaaagcta

SEQ ID NO: 679526 - DNA, 15 bp, Homo sapiens
tgtatcagtgtcctt

SEQ ID NO: 679527 - DNA, 16 bp, Homo sapiens
tgtatcctggccctgg

SEQ ID NO: 679528 - DNA, 15 bp, Homo sapiens
tgtatgactaaagag

SEQ ID NO: 679529 - DNA, 16 bp, Homo sapiens
tgtatgactaaagaga

SEQ ID NO: 679530 - DNA, 20 bp, Homo sapiens
tgtatgactaaagagagaat

SEQ ID NO: 679531 - DNA, 17 bp, Homo sapiens
tgtatgagtagccaggg

SEQ ID NO: 679532 - DNA, 14 bp, Homo sapiens
tgtatgctgatcat

SEQ ID NO: 679533 - DNA, 18 bp, Homo sapiens
tgtatgggagcttaactt

SEQ ID NO: 679534 - DNA, 19 bp, Homo sapiens
tgtatgtttgctgattatt

SEQ ID NO: 679535 - DNA, 17 bp, Homo sapiens
tgtattcagtgagggtc

SEQ ID NO: 679536 - DNA, 16 bp, Homo sapiens
tgtattcttttctcag

SEQ ID NO: 679537 - DNA, 18 bp, Homo sapiens
tgtattgatttttaagaa

SEQ ID NO: 679538 - DNA, 19 bp, Homo sapiens
tgtattgatttttaagaaa

SEQ ID NO: 679539 - DNA, 15 bp, Homo sapiens
tgtatttccagtgca

SEQ ID NO: 679540 - DNA, 21 bp, Homo sapiens
tgtatttctccatcctgcaga

SEQ ID NO: 679541 - DNA, 13 bp, Homo sapiens
tgtatttcttata

SEQ ID NO: 679542 - DNA, 19 bp, Homo sapiens
tgtatttttatttttgcac

SEQ ID NO: 679543 - DNA, 19 bp, Homo sapiens
tgtcaaaatatttctcatc

SEQ ID NO: 679544 - DNA, 16 bp, Homo sapiens
tgtcacaccctgactt

SEQ ID NO: 679545 - DNA, 15 bp, Homo sapiens
tgtcacattcctgac

SEQ ID NO: 679546 - DNA, 14 bp, Homo sapiens
tgtcaccaaggaaa

SEQ ID NO: 679547 - DNA, 22 bp, Homo sapiens
tgtcacctctgtgacccctcct

SEQ ID NO: 679548 - DNA, 19 bp, Homo sapiens
tgtcacttgctgctttttc

SEQ ID NO: 679549 - DNA, 17 bp, Homo sapiens
tgtcagaagtgcagaat

SEQ ID NO: 679550 - DNA, 15 bp, Homo sapiens
tgtcagggtccagga

SEQ ID NO: 679551 - DNA, 21 bp, Homo sapiens
tgtcagggtctccttccttcc

SEQ ID NO: 679552 - DNA, 23 bp, Homo sapiens
tgtcataacatccagagctttgt

SEQ ID NO: 679553 - DNA, 23 bp, Homo sapiens
tgtcattcgctactatgatttaa

SEQ ID NO: 679554 - DNA, 17 bp, Homo sapiens
tgtcattgcacataagc

SEQ ID NO: 679555 - DNA, 13 bp, Homo sapiens
tgtcattgtctac

SEQ ID NO: 679556 - DNA, 22 bp, Homo sapiens
tgtcatttcttcacttcaagct

SEQ ID NO: 679557 - DNA, 21 bp, Homo sapiens
tgtccaaacgtcctctttagt

SEQ ID NO: 679558 - DNA, 19 bp, Homo sapiens
tgtccaaagaggctgcccc

SEQ ID NO: 679559 - DNA, 17 bp, Homo sapiens
tgtccaaatttaaaatg

SEQ ID NO: 679560 - DNA, 14 bp, Homo sapiens
tgtccacctgtggg

SEQ ID NO: 679561 - DNA, 15 bp, Homo sapiens
tgtccagcaccttgt

SEQ ID NO: 679562 - DNA, 16 bp, Homo sapiens
tgtcccaaggaggggg

SEQ ID NO: 679563 - DNA, 14 bp, Homo sapiens
tgtcccaggcaggg

SEQ ID NO: 679564 - DNA, 20 bp, Homo sapiens
tgtccccatctaggtcctgg

SEQ ID NO: 679565 - DNA, 21 bp, Homo sapiens
tgtccctctccttgcccccag

SEQ ID NO: 679566 - DNA, 15 bp, Homo sapiens
tgtccctgaaaccta

SEQ ID NO: 679567 - DNA, 13 bp, Homo sapiens
tgtcccttccagg

SEQ ID NO: 679568 - DNA, 16 bp, Homo sapiens
tgtcccttttccctta

SEQ ID NO: 679569 - DNA, 12 bp, Homo sapiens
tgtcctcaggga

SEQ ID NO: 679570 - DNA, 17 bp, Homo sapiens
tgtcctcttctgctctt

SEQ ID NO: 679571 - DNA, 18 bp, Homo sapiens
tgtcctcttctgctcttt

SEQ ID NO: 679572 - DNA, 23 bp, Homo sapiens
tgtcctcttctgctcttttcctg

SEQ ID NO: 679573 - DNA, 17 bp, Homo sapiens
tgtccttaacccacctc

SEQ ID NO: 679574 - DNA, 19 bp, Homo sapiens
tgtccttaacccacctctc

SEQ ID NO: 679575 - DNA, 20 bp, Homo sapiens
tgtccttaacccacctctcc

SEQ ID NO: 679576 - DNA, 20 bp, Homo sapiens
tttgttatatataataaata

SEQ ID NO: 679577 - DNA, 21 bp, Homo sapiens
tttgttatatataataaatac

SEQ ID NO: 679578 - DNA, 15 bp, Homo sapiens
tttgttgaagtttga

SEQ ID NO: 679579 - DNA, 18 bp, Homo sapiens
tttgttgtacttaaatgg

SEQ ID NO: 679580 - DNA, 19 bp, Homo sapiens
ttttaaaaacctgtatctg

SEQ ID NO: 679581 - DNA, 21 bp, Homo sapiens
ttttaaaaagagtaatttcat

SEQ ID NO: 679582 - DNA, 15 bp, Homo sapiens
ttttaaaaggtagag

SEQ ID NO: 679583 - DNA, 22 bp, Homo sapiens
ttttaaaaggtagagtcttaca

SEQ ID NO: 679584 - DNA, 11 bp, Homo sapiens
ttttaaagaag

SEQ ID NO: 679585 - DNA, 17 bp, Homo sapiens
ttttaaagaagctttat

SEQ ID NO: 679586 - DNA, 23 bp, Homo sapiens
ttttaaagaccctcctattctat

SEQ ID NO: 679587 - DNA, 14 bp, Homo sapiens
ttttaaagtgcaaa

SEQ ID NO: 679588 - DNA, 17 bp, Homo sapiens
ttttaacttttaattta

SEQ ID NO: 679589 - DNA, 22 bp, Homo sapiens
ttttaatacattgatcaggcca

SEQ ID NO: 679590 - DNA, 21 bp, Homo sapiens
ttttaatgctgtttctaagaa

SEQ ID NO: 679591 - DNA, 18 bp, Homo sapiens
ttttacagtatccaaaaa

SEQ ID NO: 679592 - DNA, 13 bp, Homo sapiens
ttttactgccctt

SEQ ID NO: 679593 - DNA, 23 bp, Homo sapiens
ttttactgccctttcaaagcact

SEQ ID NO: 679594 - DNA, 22 bp, Homo sapiens
ttttagaaatgcatatttgcca

SEQ ID NO: 679595 - DNA, 20 bp, Homo sapiens
ttttagaatgttgaaaagta

SEQ ID NO: 679596 - DNA, 23 bp, Homo sapiens
ttttagaggactattacatattt

SEQ ID NO: 679597 - DNA, 13 bp, Homo sapiens
ttttaggcaaaga

SEQ ID NO: 679598 - DNA, 17 bp, Homo sapiens
ttttataaaattttgct

SEQ ID NO: 679599 - DNA, 16 bp, Homo sapiens
ttttatacaagtaatt

SEQ ID NO: 679600 - DNA, 20 bp, Homo sapiens
ttttatagcctggactgcta

SEQ ID NO: 679601 - DNA, 20 bp, Homo sapiens
ttttataggggctttgctga

SEQ ID NO: 679602 - DNA, 14 bp, Homo sapiens
ttttatatttgtag

SEQ ID NO: 679603 - DNA, 16 bp, Homo sapiens
ttttatgggtgaaaat

SEQ ID NO: 679604 - DNA, 13 bp, Homo sapiens
ttttattaaagat

SEQ ID NO: 679605 - DNA, 13 bp, Homo sapiens
ttttattaataat

SEQ ID NO: 679606 - DNA, 16 bp, Homo sapiens
ttttattaataatatt

SEQ ID NO: 679607 - DNA, 11 bp, Homo sapiens
ttttattttac

SEQ ID NO: 679608 - DNA, 15 bp, Homo sapiens
ttttattttactatt

SEQ ID NO: 679609 - DNA, 21 bp, Homo sapiens
ttttcagaaggttattttctt

SEQ ID NO: 679610 - DNA, 15 bp, Homo sapiens
ttttcagctgcaagg

SEQ ID NO: 679611 - DNA, 13 bp, Homo sapiens
ttttcatgaaaat

SEQ ID NO: 679612 - DNA, 17 bp, Homo sapiens
ttttccatgatttagca

SEQ ID NO: 679613 - DNA, 12 bp, Homo sapiens
ttttcccccttc

SEQ ID NO: 679614 - DNA, 15 bp, Homo sapiens
ttttcccccttccca

SEQ ID NO: 679615 - DNA, 14 bp, Homo sapiens
ttttccctggaact

SEQ ID NO: 679616 - DNA, 18 bp, Homo sapiens
ttttccctggaactcctg

SEQ ID NO: 679617 - DNA, 22 bp, Homo sapiens
ttttccctggaactcctggcct

SEQ ID NO: 679618 - DNA, 22 bp, Homo sapiens
ttttctaaataaaaatatgtaa

SEQ ID NO: 679619 - DNA, 14 bp, Homo sapiens
ttttctccacttca

SEQ ID NO: 679620 - DNA, 20 bp, Homo sapiens
ttttctcccaagaaacctga

SEQ ID NO: 679621 - DNA, 22 bp, Homo sapiens
ttttctgagatgctcactttat

SEQ ID NO: 679622 - DNA, 22 bp, Homo sapiens
ttttctgaggatagtagttaaa

SEQ ID NO: 679623 - DNA, 23 bp, Homo sapiens
ttttctgaggatagtagttaaat

SEQ ID NO: 679624 - DNA, 23 bp, Homo sapiens
ttttctgaggtccttatgtcctg

SEQ ID NO: 679625 - DNA, 13 bp, Homo sapiens
ttttgaaacaaag

SEQ ID NO: 679626 - DNA, 21 bp, Homo sapiens
ttttgaagcagtcttgctctg

SEQ ID NO: 679627 - DNA, 13 bp, Homo sapiens
ttttgaagcatag

SEQ ID NO: 679628 - DNA, 18 bp, Homo sapiens
ttttgaatgcttcctgac

SEQ ID NO: 679629 - DNA, 22 bp, Homo sapiens
ttttgaatgcttcctgacaatc

SEQ ID NO: 679630 - DNA, 19 bp, Homo sapiens
ttttgacagactatttgct

SEQ ID NO: 679631 - DNA, 13 bp, Homo sapiens
ttttgataacaat

SEQ ID NO: 679632 - DNA, 10 bp, Homo sapiens
ttttgcacaa

SEQ ID NO: 679633 - DNA, 19 bp, Homo sapiens
ttttgcatgcatgcaaatg

SEQ ID NO: 679634 - DNA, 21 bp, Homo sapiens
ttttgcatgcatgcaaatgag

SEQ ID NO: 679635 - DNA, 17 bp, Homo sapiens
ttttgccagttttccct

SEQ ID NO: 679636 - DNA, 23 bp, Homo sapiens
ttttgctggaattcctaactttt

SEQ ID NO: 679637 - DNA, 19 bp, Homo sapiens
ttttgcttttaattaaata

SEQ ID NO: 679638 - DNA, 15 bp, Homo sapiens
ttttggtgtgccctg

SEQ ID NO: 679639 - DNA, 16 bp, Homo sapiens
ttttggtgtgccctgt

SEQ ID NO: 679640 - DNA, 19 bp, Homo sapiens
ttttgtaaatgaaacttaa

SEQ ID NO: 679641 - DNA, 21 bp, Homo sapiens
ttttgtaaatgaaacttaaga

SEQ ID NO: 679642 - DNA, 16 bp, Homo sapiens
ttttgtcttattctta

SEQ ID NO: 679643 - DNA, 22 bp, Homo sapiens
ttttgtgcaaaagcttcaaatt

SEQ ID NO: 679644 - DNA, 20 bp, Homo sapiens
ttttgttccaatgtcaatgt

SEQ ID NO: 679645 - DNA, 17 bp, Homo sapiens
ttttgtttataaaaaac

SEQ ID NO: 679646 - DNA, 18 bp, Homo sapiens
ttttgtttggagacgttt

SEQ ID NO: 679647 - DNA, 19 bp, Homo sapiens
ttttgtttggcaaggaaag

SEQ ID NO: 679648 - DNA, 13 bp, Homo sapiens
ttttgtttggtta

SEQ ID NO: 679649 - DNA, 16 bp, Homo sapiens
ttttgtttggttatat

SEQ ID NO: 679650 - DNA, 16 bp, Homo sapiens
tttttaagcttcagtt

SEQ ID NO: 679651 - DNA, 20 bp, Homo sapiens
tttttaagtgaaaatatagc

SEQ ID NO: 679652 - DNA, 11 bp, Homo sapiens
tttttaattta

SEQ ID NO: 679653 - DNA, 13 bp, Homo sapiens
tttttataattgt

SEQ ID NO: 679654 - DNA, 17 bp, Homo sapiens
tttttataccattcaga

SEQ ID NO: 679655 - DNA, 23 bp, Homo sapiens
tttttatgggtgaaaataagaca

SEQ ID NO: 679656 - DNA, 16 bp, Homo sapiens
tttttatgtattgttt

SEQ ID NO: 679657 - DNA, 14 bp, Homo sapiens
tttttattatgcat

SEQ ID NO: 679658 - DNA, 15 bp, Homo sapiens
tttttattatgcatt

SEQ ID NO: 679659 - DNA, 12 bp, Homo sapiens
tttttattgttg

SEQ ID NO: 679660 - DNA, 19 bp, Homo sapiens
tttttcatattttctaaag

SEQ ID NO: 679661 - DNA, 12 bp, Homo sapiens
tttttcatcctt

SEQ ID NO: 679662 - DNA, 19 bp, Homo sapiens
tttttcatccttctttcct

SEQ ID NO: 679663 - DNA, 24 bp, Homo sapiens
tttttcatccttctttccttgttc

SEQ ID NO: 679664 - DNA, 21 bp, Homo sapiens
tttttccacaaggaataaatg

SEQ ID NO: 679665 - DNA, 16 bp, Homo sapiens
tttttctgtaatgtaa

SEQ ID NO: 679666 - DNA, 19 bp, Homo sapiens
tggagaccctgcaaacaga

SEQ ID NO: 679667 - DNA, 11 bp, Homo sapiens
tggagagaata

SEQ ID NO: 679668 - DNA, 15 bp, Homo sapiens
tggagaggcgagagg

SEQ ID NO: 679669 - DNA, 15 bp, Homo sapiens
tggagattataataa

SEQ ID NO: 679670 - DNA, 13 bp, Homo sapiens
tggagcctggggt

SEQ ID NO: 679671 - DNA, 20 bp, Homo sapiens
tggaggagggtttgggcaga

SEQ ID NO: 679672 - DNA, 21 bp, Homo sapiens
tggaggagggtttgggcagag

SEQ ID NO: 679673 - DNA, 12 bp, Homo sapiens
tggagggaagcc

SEQ ID NO: 679674 - DNA, 23 bp, Homo sapiens
tggagttccttatccctctcttc

SEQ ID NO: 679675 - DNA, 20 bp, Homo sapiens
tggagtttctctagaagctc

SEQ ID NO: 679676 - DNA, 15 bp, Homo sapiens
tggatataaaatgtg

SEQ ID NO: 679677 - DNA, 17 bp, Homo sapiens
tggatattattagaaat

SEQ ID NO: 679678 - DNA, 24 bp, Homo sapiens
tggatattttttggtgtgccctgt

SEQ ID NO: 679679 - DNA, 19 bp, Homo sapiens
tggatcataagacaatgga

SEQ ID NO: 679680 - DNA, 16 bp, Homo sapiens
tggatcttgaatgtgg

SEQ ID NO: 679681 - DNA, 14 bp, Homo sapiens
tggattcattgtct

SEQ ID NO: 679682 - DNA, 20 bp, Homo sapiens
tggatttccttctaacatgt

SEQ ID NO: 679683 - DNA, 18 bp, Homo sapiens
tggatttggcactagcca

SEQ ID NO: 679684 - DNA, 17 bp, Homo sapiens
tggattttttattatta

SEQ ID NO: 679685 - DNA, 20 bp, Homo sapiens
tggcaaacgagactttctcc

SEQ ID NO: 679686 - DNA, 21 bp, Homo sapiens
tggcaaaggacccttgagtaa

SEQ ID NO: 679687 - DNA, 22 bp, Homo sapiens
tggcaaagggagcagaactgaa

SEQ ID NO: 679688 - DNA, 23 bp, Homo sapiens
tggcacagaacaggaggtgtgaa

SEQ ID NO: 679689 - DNA, 15 bp, Homo sapiens
tggcacagaccaggc

SEQ ID NO: 679690 - DNA, 17 bp, Homo sapiens
tggcacagaccaggcct

SEQ ID NO: 679691 - DNA, 16 bp, Homo sapiens
tggcacagctgggagc

SEQ ID NO: 679692 - DNA, 23 bp, Homo sapiens
tggcaccgcctccccacctccag

SEQ ID NO: 679693 - DNA, 15 bp, Homo sapiens
tggcacgtgacaggc

SEQ ID NO: 679694 - DNA, 17 bp, Homo sapiens
tggcacgtgacaggctc

SEQ ID NO: 679695 - DNA, 12 bp, Homo sapiens
tggcagacagac

SEQ ID NO: 679696 - DNA, 21 bp, Homo sapiens
tggcagagcagtctaaacaga

SEQ ID NO: 679697 - DNA, 15 bp, Homo sapiens
tggcaggactcctgg

SEQ ID NO: 679698 - DNA, 16 bp, Homo sapiens
tggcaggactcctggc

SEQ ID NO: 679699 - DNA, 19 bp, Homo sapiens
tggcaggactcctggcagg

SEQ ID NO: 679700 - DNA, 21 bp, Homo sapiens
tggcaggactcctggcagggc

SEQ ID NO: 679701 - DNA, 20 bp, Homo sapiens
tggcaggtgcctgtaatcct

SEQ ID NO: 679702 - DNA, 15 bp, Homo sapiens
tggcagtggcagaga

SEQ ID NO: 679703 - DNA, 23 bp, Homo sapiens
tggcagttaattggatgttcact

SEQ ID NO: 679704 - DNA, 20 bp, Homo sapiens
tggcataatagtcaatttct

SEQ ID NO: 679705 - DNA, 19 bp, Homo sapiens
tggcatggttgttgcatat

SEQ ID NO: 679706 - DNA, 12 bp, Homo sapiens
tggcatttctat

SEQ ID NO: 679707 - DNA, 14 bp, Homo sapiens
tgggtcctgaagaa

SEQ ID NO: 679708 - DNA, 18 bp, Homo sapiens
tgggtgggattttgcaaa

SEQ ID NO: 679709 - DNA, 22 bp, Homo sapiens
tgggtgtctgggctcaagcttt

SEQ ID NO: 679710 - DNA, 19 bp, Homo sapiens
tgggtttcaagaaaatctt

SEQ ID NO: 679711 - DNA, 20 bp, Homo sapiens
tgggtttcaagaaaatcttt

SEQ ID NO: 679712 - DNA, 14 bp, Homo sapiens
tggtaaatgtttct

SEQ ID NO: 679713 - DNA, 18 bp, Homo sapiens
tggtaagcaacatggctt

SEQ ID NO: 679714 - DNA, 19 bp, Homo sapiens
tggtaagcaacatggcttt

SEQ ID NO: 679715 - DNA, 13 bp, Homo sapiens
tggtaatatacaa

SEQ ID NO: 679716 - DNA, 21 bp, Homo sapiens
tggtaatctacaccaatgaaa

SEQ ID NO: 679717 - DNA, 23 bp, Homo sapiens
tggtaatctacaccaatgaaaac

SEQ ID NO: 679718 - DNA, 15 bp, Homo sapiens
tggtacaacggaggc

SEQ ID NO: 679719 - DNA, 13 bp, Homo sapiens
tggtacatgtctt

SEQ ID NO: 679720 - DNA, 13 bp, Homo sapiens
tggtatatataca

SEQ ID NO: 679721 - DNA, 22 bp, Homo sapiens
tggtcaagattttgaatgcttc

SEQ ID NO: 679722 - DNA, 15 bp, Homo sapiens
tggtcagcttttgtt

SEQ ID NO: 679723 - DNA, 17 bp, Homo sapiens
tggtcatatacatattg

SEQ ID NO: 679724 - DNA, 13 bp, Homo sapiens
tggtccttattta

SEQ ID NO: 679725 - DNA, 12 bp, Homo sapiens
tggtctcaggat

SEQ ID NO: 679726 - DNA, 19 bp, Homo sapiens
tggtctcttcttggggccc

SEQ ID NO: 679727 - DNA, 16 bp, Homo sapiens
tggtctgccttctgct

SEQ ID NO: 679728 - DNA, 17 bp, Homo sapiens
tggtctgccttctgctg

SEQ ID NO: 679729 - DNA, 15 bp, Homo sapiens
tggtctggtgttcca

SEQ ID NO: 679730 - DNA, 17 bp, Homo sapiens
tggtcttctactgcctt

SEQ ID NO: 679731 - DNA, 19 bp, Homo sapiens
tggtcttctactgccttga

SEQ ID NO: 679732 - DNA, 23 bp, Homo sapiens
tggtcttgagccagtaatcttta

SEQ ID NO: 679733 - DNA, 19 bp, Homo sapiens
tggtcttgtggttgtgtgt

SEQ ID NO: 679734 - DNA, 19 bp, Homo sapiens
tggtgaaattgactgatga

SEQ ID NO: 679735 - DNA, 16 bp, Homo sapiens
tggtgaagtaaattag

SEQ ID NO: 679736 - DNA, 16 bp, Homo sapiens
tggtgagtaacttaga

SEQ ID NO: 679737 - DNA, 14 bp, Homo sapiens
tggtgatttgaaaa

SEQ ID NO: 679738 - DNA, 22 bp, Homo sapiens
tggtgatttgaaaaatataaaa

SEQ ID NO: 679739 - DNA, 20 bp, Homo sapiens
tggtgctggaaccagctctc

SEQ ID NO: 679740 - DNA, 20 bp, Homo sapiens
tggtgtacctgctggaagaa

SEQ ID NO: 679741 - DNA, 18 bp, Homo sapiens
tggtgtagccctcccact

SEQ ID NO: 679742 - DNA, 21 bp, Homo sapiens
tggtgtagccctcccactttg

SEQ ID NO: 679743 - DNA, 17 bp, Homo sapiens
tggtgtgaacccgggag

SEQ ID NO: 679744 - DNA, 13 bp, Homo sapiens
tggtgtgccctgt

SEQ ID NO: 679745 - DNA, 19 bp, Homo sapiens
tggtgtttattataaagct

SEQ ID NO: 679746 - DNA, 23 bp, Homo sapiens
tggttacctgacctaaattagat

SEQ ID NO: 679747 - DNA, 17 bp, Homo sapiens
tggttatgaatactttg

SEQ ID NO: 679748 - DNA, 18 bp, Homo sapiens
tggttccctgctgcgctg

SEQ ID NO: 679749 - DNA, 18 bp, Homo sapiens
tggttcgatacctggagc

SEQ ID NO: 679750 - DNA, 14 bp, Homo sapiens
tggttcttaaatgt

SEQ ID NO: 679751 - DNA, 15 bp, Homo sapiens
tggttgttgcatata

SEQ ID NO: 679752 - DNA, 17 bp, Homo sapiens
gtacttattacagtctt

SEQ ID NO: 679753 - DNA, 12 bp, Homo sapiens
gtacttctaaga

SEQ ID NO: 679754 - DNA, 13 bp, Homo sapiens
gtacttctaagag

SEQ ID NO: 679755 - DNA, 21 bp, Homo sapiens
gtagaatctcttcatgcttga

SEQ ID NO: 679756 - DNA, 15 bp, Homo sapiens
gtagactgtgccaga

SEQ ID NO: 679757 - DNA, 17 bp, Homo sapiens
gtagatatgtattcttt

SEQ ID NO: 679758 - DNA, 18 bp, Homo sapiens
gtagcataactgtagctc

SEQ ID NO: 679759 - DNA, 21 bp, Homo sapiens
gtagcctcaatcgagtgagac

SEQ ID NO: 679760 - DNA, 17 bp, Homo sapiens
gtagctacaagggaagc

SEQ ID NO: 679761 - DNA, 12 bp, Homo sapiens
gtagctctgctg

SEQ ID NO: 679762 - DNA, 14 bp, Homo sapiens
gtagcttgctccct

SEQ ID NO: 679763 - DNA, 19 bp, Homo sapiens
gtagcttgctccctgtgtc

SEQ ID NO: 679764 - DNA, 13 bp, Homo sapiens
gtaggctggttta

SEQ ID NO: 679765 - DNA, 22 bp, Homo sapiens
gtagggatatggcaggactcct

SEQ ID NO: 679766 - DNA, 15 bp, Homo sapiens
gtaggggtgtgtgtg

SEQ ID NO: 679767 - DNA, 23 bp, Homo sapiens
gtaggtatgatctcttctggtgt

SEQ ID NO: 679768 - DNA, 20 bp, Homo sapiens
gtaggtgtctgccttcacaa

SEQ ID NO: 679769 - DNA, 19 bp, Homo sapiens
gtaggttatctttttaaaa

SEQ ID NO: 679770 - DNA, 12 bp, Homo sapiens
gtagtccccaac

SEQ ID NO: 679771 - DNA, 13 bp, Homo sapiens
gtagttaaataac

SEQ ID NO: 679772 - DNA, 15 bp, Homo sapiens
gtagttaaataactg

SEQ ID NO: 679773 - DNA, 16 bp, Homo sapiens
gtataaagcatgtggt

SEQ ID NO: 679774 - DNA, 12 bp, Homo sapiens
gtataaatatac

SEQ ID NO: 679775 - DNA, 20 bp, Homo sapiens
gtataaccaagtgtgctctt

SEQ ID NO: 679776 - DNA, 16 bp, Homo sapiens
gtatacattgtcttga

SEQ ID NO: 679777 - DNA, 20 bp, Homo sapiens
gtatagaaaattcttgagaa

SEQ ID NO: 679778 - DNA, 18 bp, Homo sapiens
gtatatactttgccactg

SEQ ID NO: 679779 - DNA, 20 bp, Homo sapiens
gtatatactttgccactgct

SEQ ID NO: 679780 - DNA, 13 bp, Homo sapiens
gtatatatattca

SEQ ID NO: 679781 - DNA, 14 bp, Homo sapiens
gtatatatattcat

SEQ ID NO: 679782 - DNA, 20 bp, Homo sapiens
gtatatcactaaaagcatga

SEQ ID NO: 679783 - DNA, 22 bp, Homo sapiens
gtatattgtataggggcaactg

SEQ ID NO: 679784 - DNA, 19 bp, Homo sapiens
gtatatttttttaatttaa

SEQ ID NO: 679785 - DNA, 13 bp, Homo sapiens
gtatcaaatacat

SEQ ID NO: 679786 - DNA, 14 bp, Homo sapiens
gtatcaaatacatt

SEQ ID NO: 679787 - DNA, 14 bp, Homo sapiens
gtatcagtgtcctt

SEQ ID NO: 679788 - DNA, 19 bp, Homo sapiens
gtatcatatattaaaacaa

SEQ ID NO: 679789 - DNA, 16 bp, Homo sapiens
gtatcattcaactctc

SEQ ID NO: 679790 - DNA, 20 bp, Homo sapiens
gtatccaaaaatagccctgc

SEQ ID NO: 679791 - DNA, 14 bp, Homo sapiens
gtatcctggccctg

SEQ ID NO: 679792 - DNA, 22 bp, Homo sapiens
gtatctagagcttaatgctaca

SEQ ID NO: 679793 - DNA, 19 bp, Homo sapiens
gtatcttgacacaggaaat

SEQ ID NO: 679794 - DNA, 21 bp, Homo sapiens
gtatcttttatcctgggagca

SEQ ID NO: 679795 - DNA, 18 bp, Homo sapiens
gtatgactaaagagagaa

SEQ ID NO: 679796 - DNA, 13 bp, Homo sapiens
gtatgctgatcat

SEQ ID NO: 679797 - DNA, 15 bp, Homo sapiens
gtatggtgtgttcac

SEQ ID NO: 679798 - DNA, 14 bp, Homo sapiens
gtatgtaaagttaa

SEQ ID NO: 679799 - DNA, 18 bp, Homo sapiens
gtattaaaactaaatttc

SEQ ID NO: 679800 - DNA, 23 bp, Homo sapiens
gtattatagacaaaagaataaga

SEQ ID NO: 679801 - DNA, 22 bp, Homo sapiens
gtattatcaaagggataaagaa

SEQ ID NO: 679802 - DNA, 22 bp, Homo sapiens
gtattcagtgagggtcttctta

SEQ ID NO: 679803 - DNA, 19 bp, Homo sapiens
gtattgatttttaagaaag

SEQ ID NO: 679804 - DNA, 22 bp, Homo sapiens
gtattgcatgcaatttgaagta

SEQ ID NO: 679805 - DNA, 18 bp, Homo sapiens
gtatttaaactatcttgt

SEQ ID NO: 679806 - DNA, 23 bp, Homo sapiens
gtatttctcataggctatgccat

SEQ ID NO: 679807 - DNA, 22 bp, Homo sapiens
gtatttctctattttcataatc

SEQ ID NO: 679808 - DNA, 22 bp, Homo sapiens
gtatttcttatacgcttttctt

SEQ ID NO: 679809 - DNA, 14 bp, Homo sapiens
gtatttgatttcct

SEQ ID NO: 679810 - DNA, 22 bp, Homo sapiens
gtatttggtatatactttgcca

SEQ ID NO: 679811 - DNA, 16 bp, Homo sapiens
gtattttcatgaaaat

SEQ ID NO: 679812 - DNA, 21 bp, Homo sapiens
gtattttttcaagttgtaaat

SEQ ID NO: 679813 - DNA, 15 bp, Homo sapiens
gtcaaaagttggtgt

SEQ ID NO: 679814 - DNA, 15 bp, Homo sapiens
gtcaaagttgaaaat

SEQ ID NO: 679815 - DNA, 22 bp, Homo sapiens
gtcaacatagtgagacactgtc

SEQ ID NO: 679816 - DNA, 12 bp, Homo sapiens
gtcaagacattt

SEQ ID NO: 679817 - DNA, 14 bp, Homo sapiens
gtcaagacatttgc

SEQ ID NO: 679818 - DNA, 14 bp, Homo sapiens
gtcaagattttgaa

SEQ ID NO: 679819 - DNA, 22 bp, Homo sapiens
gtcaagggctgtcattgcacat

SEQ ID NO: 679820 - DNA, 20 bp, Homo sapiens
gtcaagggcttactatttct

SEQ ID NO: 679821 - DNA, 21 bp, Homo sapiens
gtcaataacactgtattttaa

SEQ ID NO: 679822 - DNA, 17 bp, Homo sapiens
gtcacaacccttctctg

SEQ ID NO: 679823 - DNA, 13 bp, Homo sapiens
gtcaccaaggaaa

SEQ ID NO: 679824 - DNA, 16 bp, Homo sapiens
gtcaccggtcagtgcc

SEQ ID NO: 679825 - DNA, 14 bp, Homo sapiens
gtcactttttatgc

SEQ ID NO: 679826 - DNA, 17 bp, Homo sapiens
gtcagaggagcgcaggc

SEQ ID NO: 679827 - DNA, 16 bp, Homo sapiens
gtcagccacctgggaa

SEQ ID NO: 679828 - DNA, 19 bp, Homo sapiens
gtcagctactaatgatgtt

SEQ ID NO: 679829 - DNA, 20 bp, Homo sapiens
gtcagctcttgtcaaaaggt

SEQ ID NO: 679830 - DNA, 20 bp, Homo sapiens
gtcagctgctccctggcatt

SEQ ID NO: 679831 - DNA, 14 bp, Homo sapiens
tctgtcccttgctg

SEQ ID NO: 679832 - DNA, 15 bp, Homo sapiens
tctgtcccttgctgt

SEQ ID NO: 679833 - DNA, 14 bp, Homo sapiens
tctgtctgaggtga

SEQ ID NO: 679834 - DNA, 18 bp, Homo sapiens
tctgtcttgttaatgctt

SEQ ID NO: 679835 - DNA, 19 bp, Homo sapiens
tctgtgaatctgctttaat

SEQ ID NO: 679836 - DNA, 22 bp, Homo sapiens
tctgtgatttttttttttaatt

SEQ ID NO: 679837 - DNA, 18 bp, Homo sapiens
tctgtgccatagaacaag

SEQ ID NO: 679838 - DNA, 16 bp, Homo sapiens
tctgtggttcctctgc

SEQ ID NO: 679839 - DNA, 16 bp, Homo sapiens
tctgtgtcatttcttc

SEQ ID NO: 679840 - DNA, 15 bp, Homo sapiens
tctgtgtgaatgtgg

SEQ ID NO: 679841 - DNA, 16 bp, Homo sapiens
tctgttggtctgcctt

SEQ ID NO: 679842 - DNA, 20 bp, Homo sapiens
tctgttggtctgccttctgc

SEQ ID NO: 679843 - DNA, 23 bp, Homo sapiens
tctgttggtctgccttctgctga

SEQ ID NO: 679844 - DNA, 18 bp, Homo sapiens
tctgtttctgtttataat

SEQ ID NO: 679845 - DNA, 23 bp, Homo sapiens
tctgttttgtttggcaaggaaag

SEQ ID NO: 679846 - DNA, 20 bp, Homo sapiens
tcttaaatgtttatactgta

SEQ ID NO: 679847 - DNA, 18 bp, Homo sapiens
tcttaagatggaaataca

SEQ ID NO: 679848 - DNA, 20 bp, Homo sapiens
tcttaagatggaaatacagt

SEQ ID NO: 679849 - DNA, 23 bp, Homo sapiens
tcttaatttatttcttaaccttt

SEQ ID NO: 679850 - DNA, 21 bp, Homo sapiens
tcttacaatattgattgggaa

SEQ ID NO: 679851 - DNA, 13 bp, Homo sapiens
tcttacacactgt

SEQ ID NO: 679852 - DNA, 17 bp, Homo sapiens
tcttacctactattggc

SEQ ID NO: 679853 - DNA, 16 bp, Homo sapiens
tcttatacgcttttct

SEQ ID NO: 679854 - DNA, 19 bp, Homo sapiens
tcttatacgcttttctttg

SEQ ID NO: 679855 - DNA, 15 bp, Homo sapiens
tcttatgtgaaaaat

SEQ ID NO: 679856 - DNA, 13 bp, Homo sapiens
tcttattataaaa

SEQ ID NO: 679857 - DNA, 14 bp, Homo sapiens
tcttcaaagccttc

SEQ ID NO: 679858 - DNA, 20 bp, Homo sapiens
tcttcaacatgctccaaata

SEQ ID NO: 679859 - DNA, 19 bp, Homo sapiens
tcttcacatgtttaacttt

SEQ ID NO: 679860 - DNA, 15 bp, Homo sapiens
tcttcactgcaattt

SEQ ID NO: 679861 - DNA, 16 bp, Homo sapiens
tcttcaggtgaacact

SEQ ID NO: 679862 - DNA, 17 bp, Homo sapiens
tcttcaggtgaacactt

SEQ ID NO: 679863 - DNA, 18 bp, Homo sapiens
tcttcagtgcaaattgta

SEQ ID NO: 679864 - DNA, 19 bp, Homo sapiens
tcttcagtgcaaattgtat

SEQ ID NO: 679865 - DNA, 21 bp, Homo sapiens
tcttcagtgcaaattgtatct

SEQ ID NO: 679866 - DNA, 15 bp, Homo sapiens
tcttcatgcttgaca

SEQ ID NO: 679867 - DNA, 22 bp, Homo sapiens
tcttcatggcatcttcaatatg

SEQ ID NO: 679868 - DNA, 18 bp, Homo sapiens
tcttccagggcagcggct

SEQ ID NO: 679869 - DNA, 16 bp, Homo sapiens
tcttccatgtatcttt

SEQ ID NO: 679870 - DNA, 19 bp, Homo sapiens
tcttccatgtatcttttga

SEQ ID NO: 679871 - DNA, 15 bp, Homo sapiens
tcttccccttccctt

SEQ ID NO: 679872 - DNA, 13 bp, Homo sapiens
tcttccctgcttt

SEQ ID NO: 679873 - DNA, 16 bp, Homo sapiens
tcttccctgctttgca

SEQ ID NO: 679874 - DNA, 22 bp, Homo sapiens
tcttccctgctttgcatctttg

SEQ ID NO: 679875 - DNA, 21 bp, Homo sapiens
tcttcccttattcctaatggc

SEQ ID NO: 679876 - DNA, 17 bp, Homo sapiens
tcttcctatccctctcc

SEQ ID NO: 679877 - DNA, 22 bp, Homo sapiens
tcttcctatccctctcctaact

SEQ ID NO: 679878 - DNA, 20 bp, Homo sapiens
tcttcgctggactattgtgc

SEQ ID NO: 679879 - DNA, 14 bp, Homo sapiens
tcttctactgcctt

SEQ ID NO: 679880 - DNA, 19 bp, Homo sapiens
tcttctactgccttgaaaa

SEQ ID NO: 679881 - DNA, 15 bp, Homo sapiens
tcttctgctcttttc

SEQ ID NO: 679882 - DNA, 17 bp, Homo sapiens
tcttctggtttcccttt

SEQ ID NO: 679883 - DNA, 20 bp, Homo sapiens
tcttcttggggcccagtgca

SEQ ID NO: 679884 - DNA, 21 bp, Homo sapiens
tcttcttggggcccagtgcat

SEQ ID NO: 679885 - DNA, 22 bp, Homo sapiens
tcttgaaaataagattccagag

SEQ ID NO: 679886 - DNA, 16 bp, Homo sapiens
tcttgaaattgaagag

SEQ ID NO: 679887 - DNA, 13 bp, Homo sapiens
tcttgagccagta

SEQ ID NO: 679888 - DNA, 19 bp, Homo sapiens
tcttgagccagtaatcttt

SEQ ID NO: 679889 - DNA, 14 bp, Homo sapiens
tcttgatctctctt

SEQ ID NO: 679890 - DNA, 15 bp, Homo sapiens
tcttgatctgttctg

SEQ ID NO: 679891 - DNA, 15 bp, Homo sapiens
tcttgatgactgctg

SEQ ID NO: 679892 - DNA, 14 bp, Homo sapiens
tcttgcccatcctg

SEQ ID NO: 679893 - DNA, 15 bp, Homo sapiens
tcttgcccatcctga

SEQ ID NO: 679894 - DNA, 14 bp, Homo sapiens
tcttgcctccaggt

SEQ ID NO: 679895 - DNA, 17 bp, Homo sapiens
tcttgcctccaggtgca

SEQ ID NO: 679896 - DNA, 19 bp, Homo sapiens
tcttgcctccaggtgcaga

SEQ ID NO: 679897 - DNA, 17 bp, Homo sapiens
tcttggagaccctgcaa

SEQ ID NO: 679898 - DNA, 18 bp, Homo sapiens
tcttgggcagtctttctt

SEQ ID NO: 679899 - DNA, 13 bp, Homo sapiens
tcttggtcagctt

SEQ ID NO: 679900 - DNA, 22 bp, Homo sapiens
tcttggtttgtcagtttatctt

SEQ ID NO: 679901 - DNA, 18 bp, Homo sapiens
tcttgtgtgattaactta

SEQ ID NO: 679902 - DNA, 19 bp, Homo sapiens
tcttgtgtgattaacttat

SEQ ID NO: 679903 - DNA, 20 bp, Homo sapiens
tcttgtttttattaatttat

SEQ ID NO: 679904 - DNA, 15 bp, Homo sapiens
tctttaggagattta

SEQ ID NO: 679905 - DNA, 12 bp, Homo sapiens
tctttagttttt

SEQ ID NO: 679906 - DNA, 18 bp, Homo sapiens
tctttcagaaatataaca

SEQ ID NO: 679907 - DNA, 23 bp, Homo sapiens
tctttcagaaatataacacattt

SEQ ID NO: 679908 - DNA, 22 bp, Homo sapiens
tctttcaggaatacttggacct

SEQ ID NO: 679909 - DNA, 19 bp, Homo sapiens
tctttccattatgattctt

SEQ ID NO: 679910 - DNA, 15 bp, Homo sapiens
tctttctcaaagaaa

SEQ ID NO: 679911 - DNA, 13 bp, Homo sapiens
tctttcttgaaat

SEQ ID NO: 679912 - DNA, 20 bp, Homo sapiens
tctttgcctctgcagtctca

SEQ ID NO: 679913 - DNA, 15 bp, Homo sapiens
tctttggattctaaa

SEQ ID NO: 679914 - DNA, 16 bp, Homo sapiens
tctttgttacttcctt

SEQ ID NO: 679915 - DNA, 13 bp, Homo sapiens
tcttttcctggtg

SEQ ID NO: 679916 - DNA, 19 bp, Homo sapiens
tcttttgctactaagttca

SEQ ID NO: 679917 - DNA, 16 bp, Homo sapiens
tcttttgtttggtaaa

SEQ ID NO: 679918 - DNA, 21 bp, Homo sapiens
tctttttaaaaactcttcagt

SEQ ID NO: 679919 - DNA, 21 bp, Homo sapiens
tcttttttaaccggtaagagt

SEQ ID NO: 679920 - DNA, 21 bp, Homo sapiens
tgaaaaaaattgaaataaata

SEQ ID NO: 679921 - DNA, 13 bp, Homo sapiens
tgaaaaagaataa

SEQ ID NO: 679922 - DNA, 23 bp, Homo sapiens
tgaaaaagaataaaaacttttga

SEQ ID NO: 679923 - DNA, 11 bp, Homo sapiens
tgaaaaatata

SEQ ID NO: 679924 - DNA, 12 bp, Homo sapiens
tgaaaaatataa

SEQ ID NO: 679925 - DNA, 13 bp, Homo sapiens
tgaaaaatataaa

SEQ ID NO: 679926 - DNA, 20 bp, Homo sapiens
tgaaaaatataaaattatga

SEQ ID NO: 679927 - DNA, 14 bp, Homo sapiens
tgaaaaatgacaat

SEQ ID NO: 679928 - DNA, 12 bp, Homo sapiens
tgaaaaattaac

SEQ ID NO: 679929 - DNA, 14 bp, Homo sapiens
tgaaaaattaactt

SEQ ID NO: 679930 - DNA, 24 bp, Homo sapiens
tgaaaacatgtactacagctatat

SEQ ID NO: 679931 - DNA, 18 bp, Homo sapiens
tgaaaagtaattgaaaaa

SEQ ID NO: 679932 - DNA, 22 bp, Homo sapiens
tgacttcagggaaggtgaaaca

SEQ ID NO: 679933 - DNA, 15 bp, Homo sapiens
tgacttgctttagtt

SEQ ID NO: 679934 - DNA, 23 bp, Homo sapiens
tgacttgtacaaacagtatttct

SEQ ID NO: 679935 - DNA, 15 bp, Homo sapiens
tgactttcctcccat

SEQ ID NO: 679936 - DNA, 17 bp, Homo sapiens
tgacttttataaagcat

SEQ ID NO: 679937 - DNA, 17 bp, Homo sapiens
tgacttttgttaaattc

SEQ ID NO: 679938 - DNA, 13 bp, Homo sapiens
tgagaaatgatga

SEQ ID NO: 679939 - DNA, 14 bp, Homo sapiens
tgagaacaagctat

SEQ ID NO: 679940 - DNA, 13 bp, Homo sapiens
tgagaagctgctc

SEQ ID NO: 679941 - DNA, 21 bp, Homo sapiens
tgagaagctgctccaggcctg

SEQ ID NO: 679942 - DNA, 22 bp, Homo sapiens
tgagaagctgctccaggcctgc

SEQ ID NO: 679943 - DNA, 17 bp, Homo sapiens
tgagaaggtttattgtt

SEQ ID NO: 679944 - DNA, 21 bp, Homo sapiens
tgagaatataccttatttatt

SEQ ID NO: 679945 - DNA, 16 bp, Homo sapiens
tgagagaattggctca

SEQ ID NO: 679946 - DNA, 20 bp, Homo sapiens
tgagataagtaggctggttt

SEQ ID NO: 679947 - DNA, 23 bp, Homo sapiens
tgagatcgtgctactgcactcca

SEQ ID NO: 679948 - DNA, 13 bp, Homo sapiens
tgagattggtttt

SEQ ID NO: 679949 - DNA, 15 bp, Homo sapiens
tgagatttcctcctg

SEQ ID NO: 679950 - DNA, 20 bp, Homo sapiens
tgagcaccacacccagtggg

SEQ ID NO: 679951 - DNA, 15 bp, Homo sapiens
tgagcagtcgcctgc

SEQ ID NO: 679952 - DNA, 19 bp, Homo sapiens
tgagcagtcgcctgcctgc

SEQ ID NO: 679953 - DNA, 19 bp, Homo sapiens
tgagcatgtaagtgttaag

SEQ ID NO: 679954 - DNA, 14 bp, Homo sapiens
tgagccagcagggc

SEQ ID NO: 679955 - DNA, 14 bp, Homo sapiens
tgagccagtaatct

SEQ ID NO: 679956 - DNA, 19 bp, Homo sapiens
tgagccccggaggtcgagg

SEQ ID NO: 679957 - DNA, 13 bp, Homo sapiens
tgagccctggctg

SEQ ID NO: 679958 - DNA, 19 bp, Homo sapiens
tcaattagtggtcataaaa

SEQ ID NO: 679959 - DNA, 16 bp, Homo sapiens
tcaattcataaaaaca

SEQ ID NO: 679960 - DNA, 17 bp, Homo sapiens
tcaattgtcacttttta

SEQ ID NO: 679961 - DNA, 17 bp, Homo sapiens
tcaatttttgtctcaga

SEQ ID NO: 679962 - DNA, 15 bp, Homo sapiens
tcacaaatgtcattg

SEQ ID NO: 679963 - DNA, 18 bp, Homo sapiens
tcacaacccttctctgtt

SEQ ID NO: 679964 - DNA, 21 bp, Homo sapiens
tcacacaatatagttttttct

SEQ ID NO: 679965 - DNA, 15 bp, Homo sapiens
tcacacaccctgagg

SEQ ID NO: 679966 - DNA, 19 bp, Homo sapiens
tcacagcccaaaatttgat

SEQ ID NO: 679967 - DNA, 16 bp, Homo sapiens
tcacagggtgggcctc

SEQ ID NO: 679968 - DNA, 19 bp, Homo sapiens
tcacagtacagcatgtgcc

SEQ ID NO: 679969 - DNA, 20 bp, Homo sapiens
tcacagtacagcatgtgcct

SEQ ID NO: 679970 - DNA, 13 bp, Homo sapiens
tcacccacctctg

SEQ ID NO: 679971 - DNA, 12 bp, Homo sapiens
tcaccccactcc

SEQ ID NO: 679972 - DNA, 13 bp, Homo sapiens
tcaccccactcct

SEQ ID NO: 679973 - DNA, 13 bp, Homo sapiens
tcaccgcccatca

SEQ ID NO: 679974 - DNA, 22 bp, Homo sapiens
tcacctacatatgctgatcttt

SEQ ID NO: 679975 - DNA, 20 bp, Homo sapiens
tcacgttggggtgatttaat

SEQ ID NO: 679976 - DNA, 18 bp, Homo sapiens
tcactaaaagcatgaatt

SEQ ID NO: 679977 - DNA, 20 bp, Homo sapiens
tcactaaaagcatgaattgg

SEQ ID NO: 679978 - DNA, 22 bp, Homo sapiens
tcactaaagcatgaaatgtgaa

SEQ ID NO: 679979 - DNA, 15 bp, Homo sapiens
tcactatatatattt

SEQ ID NO: 679980 - DNA, 19 bp, Homo sapiens
tcactattatctaaaagaa

SEQ ID NO: 679981 - DNA, 14 bp, Homo sapiens
tcactctccagggt

SEQ ID NO: 679982 - DNA, 15 bp, Homo sapiens
tcactctctccgtct

SEQ ID NO: 679983 - DNA, 15 bp, Homo sapiens
tcactctttagatat

SEQ ID NO: 679984 - DNA, 21 bp, Homo sapiens
tcactgcaacctctgcctccc

SEQ ID NO: 679985 - DNA, 18 bp, Homo sapiens
tcactgcgaagaccctct

SEQ ID NO: 679986 - DNA, 14 bp, Homo sapiens
tcacttgctgcttt

SEQ ID NO: 679987 - DNA, 16 bp, Homo sapiens
tcacttgctgcttttt

SEQ ID NO: 679988 - DNA, 16 bp, Homo sapiens
tcagaaaattggcagt

SEQ ID NO: 679989 - DNA, 16 bp, Homo sapiens
tcagaaagctttattt

SEQ ID NO: 679990 - DNA, 18 bp, Homo sapiens
tcagaaagtaacaatcta

SEQ ID NO: 679991 - DNA, 15 bp, Homo sapiens
tcagaacaaaacttc

SEQ ID NO: 679992 - DNA, 17 bp, Homo sapiens
tcagaacaaaacttcta

SEQ ID NO: 679993 - DNA, 15 bp, Homo sapiens
tcagaagttaacatc

SEQ ID NO: 679994 - DNA, 20 bp, Homo sapiens
tcagaattatttttaaaaag

SEQ ID NO: 679995 - DNA, 15 bp, Homo sapiens
tcagacacagctctt

SEQ ID NO: 679996 - DNA, 21 bp, Homo sapiens
tcagagctaagggtgggtgct

SEQ ID NO: 679997 - DNA, 23 bp, Homo sapiens
tcagagctaagggtgggtgctca

SEQ ID NO: 679998 - DNA, 14 bp, Homo sapiens
tcagattttttcct

SEQ ID NO: 679999 - DNA, 21 bp, Homo sapiens
tcagcagagaaggtaaggtgt

SEQ ID NO: 680000 - DNA, 17 bp, Homo sapiens
tcagcaggctagacaga

SEQ ID NO: 680001 - DNA, 18 bp, Homo sapiens
tcagcaggctagacagaa

SEQ ID NO: 680002 - DNA, 16 bp, Homo sapiens
tcagcatgcctgtcct

SEQ ID NO: 680003 - DNA, 12 bp, Homo sapiens
tcagctccagct

SEQ ID NO: 680004 - DNA, 15 bp, Homo sapiens
tcagctctttccaaa

SEQ ID NO: 680005 - DNA, 16 bp, Homo sapiens
tcagctctttccaaat

SEQ ID NO: 680006 - DNA, 17 bp, Homo sapiens
tcagctctttccaaatt

SEQ ID NO: 680007 - DNA, 21 bp, Homo sapiens
tcagctgaatgcctcctgtgg

SEQ ID NO: 680008 - DNA, 21 bp, Homo sapiens
tcagctgcaatccatttattt

SEQ ID NO: 680009 - DNA, 21 bp, Homo sapiens
tcagctgccccaatgtgacct

SEQ ID NO: 680010 - DNA, 18 bp, Homo sapiens
tcagcttttgttgtttat

SEQ ID NO: 680011 - DNA, 18 bp, Homo sapiens
tcaggaaagagagcacca

SEQ ID NO: 680012 - DNA, 18 bp, Homo sapiens
tcaggagaattagatttc

SEQ ID NO: 680013 - DNA, 15 bp, Homo sapiens
tcaggcattccaggt

SEQ ID NO: 680014 - DNA, 22 bp, Homo sapiens
tcaggctatatgcagtccttta

SEQ ID NO: 680015 - DNA, 21 bp, Homo sapiens
tcagggagcagggaaggcctg

SEQ ID NO: 680016 - DNA, 22 bp, Homo sapiens
tcagggagtgctggctcacagt

SEQ ID NO: 680017 - DNA, 14 bp, Homo sapiens
tcagggctggagcc

SEQ ID NO: 680018 - DNA, 21 bp, Homo sapiens
tcagggtccaggagagcctgg

SEQ ID NO: 680019 - DNA, 22 bp, Homo sapiens
tcagggtccaggagagcctggg

SEQ ID NO: 680020 - DNA, 23 bp, Homo sapiens
tcagggtccaggagagcctgggg

SEQ ID NO: 680021 - DNA, 16 bp, Homo sapiens
tcagggtctccttcct

SEQ ID NO: 680022 - DNA, 20 bp, Homo sapiens
tcagtaaatagtgtcatata

SEQ ID NO: 680023 - DNA, 21 bp, Homo sapiens
tcagtaacccccttaaattta

SEQ ID NO: 680024 - DNA, 22 bp, Homo sapiens
tcagtaacccccttaaatttaa

SEQ ID NO: 680025 - DNA, 22 bp, Homo sapiens
tcagtaatgcagtttttaaaaa

SEQ ID NO: 680026 - DNA, 17 bp, Homo sapiens
tcagtatccaggctttg

SEQ ID NO: 680027 - DNA, 20 bp, Homo sapiens
tcagtattttctccacttca

SEQ ID NO: 680028 - DNA, 14 bp, Homo sapiens
tcagtgcctccaca

SEQ ID NO: 680029 - DNA, 15 bp, Homo sapiens
tcagtgtcctttcca

SEQ ID NO: 680030 - DNA, 23 bp, Homo sapiens
tcagtgttttggactccatctct

SEQ ID NO: 680031 - DNA, 18 bp, Homo sapiens
tcagttccagccttctct

SEQ ID NO: 680032 - DNA, 20 bp, Homo sapiens
tcagtttgaaaatattttgt

SEQ ID NO: 680033 - DNA, 21 bp, Homo sapiens
tcagtttgaaaatattttgtt

SEQ ID NO: 680034 - DNA, 16 bp, Homo sapiens
tcagtttgttggaaag

SEQ ID NO: 680035 - DNA, 14 bp, Homo sapiens
tcataatcagtaaa

SEQ ID NO: 680036 - DNA, 18 bp, Homo sapiens
tcataattgcctacattt

SEQ ID NO: 680037 - DNA, 13 bp, Homo sapiens
tcataattttgca

SEQ ID NO: 680038 - DNA, 17 bp, Homo sapiens
tcatacgtaaaattttg

SEQ ID NO: 680039 - DNA, 18 bp, Homo sapiens
tcatagcaagcttttgct

SEQ ID NO: 680040 - DNA, 16 bp, Homo sapiens
tcatataaactcattt

SEQ ID NO: 680041 - DNA, 17 bp, Homo sapiens
tcatataaactcattta

SEQ ID NO: 680042 - DNA, 12 bp, Homo sapiens
tcatatattaaa

SEQ ID NO: 680043 - DNA, 12 bp, Homo sapiens
tcatcagggcct

SEQ ID NO: 680044 - DNA, 21 bp, Homo sapiens
tcatcagggcctggggcctga

SEQ ID NO: 680045 - DNA, 14 bp, Homo sapiens
tcatcattccctct

SEQ ID NO: 680046 - DNA, 15 bp, Homo sapiens
tcatcattccctctc

SEQ ID NO: 680047 - DNA, 12 bp, Homo sapiens
tcatcattgttt

SEQ ID NO: 680048 - DNA, 22 bp, Homo sapiens
tcatcattgtttctgcatgaat

SEQ ID NO: 680049 - DNA, 13 bp, Homo sapiens
tcatcctccagta

SEQ ID NO: 680050 - DNA, 17 bp, Homo sapiens
tcatcctcttttaatgg

SEQ ID NO: 680051 - DNA, 21 bp, Homo sapiens
tcatctaattctggcaggacc

SEQ ID NO: 680052 - DNA, 15 bp, Homo sapiens
tcatctaccttttct

SEQ ID NO: 680053 - DNA, 13 bp, Homo sapiens
tcatctacttttt

SEQ ID NO: 680054 - DNA, 13 bp, Homo sapiens
tcatctttaagaa

SEQ ID NO: 680055 - DNA, 24 bp, Homo sapiens
tcatgccaaccctgggctattgct

SEQ ID NO: 680056 - DNA, 12 bp, Homo sapiens
tcatgcccaaga

SEQ ID NO: 680057 - DNA, 15 bp, Homo sapiens
tcatgtatttgagca

SEQ ID NO: 680058 - DNA, 23 bp, Homo sapiens
tcatgtcaaatatttagatgtaa

SEQ ID NO: 680059 - DNA, 15 bp, Homo sapiens
tcatgtcaatgacca

SEQ ID NO: 680060 - DNA, 18 bp, Homo sapiens
tcatgtcacctacatatg

SEQ ID NO: 680061 - DNA, 22 bp, Homo sapiens
tcattaaaaattacctttaatt

SEQ ID NO: 680062 - DNA, 15 bp, Homo sapiens
tcattactgggcctt

SEQ ID NO: 680063 - DNA, 19 bp, Homo sapiens
tcattactgtgttcaatta

SEQ ID NO: 680064 - DNA, 13 bp, Homo sapiens
tcattattcaaga

SEQ ID NO: 680065 - DNA, 13 bp, Homo sapiens
tcattcagaaatg

SEQ ID NO: 680066 - DNA, 14 bp, Homo sapiens
tcattcagaaatgt

SEQ ID NO: 680067 - DNA, 18 bp, Homo sapiens
tcattccctctcatctca

SEQ ID NO: 680068 - DNA, 17 bp, Homo sapiens
tcattccgttgtctgtg

SEQ ID NO: 680069 - DNA, 17 bp, Homo sapiens
tcattcctaacacagca

SEQ ID NO: 680070 - DNA, 20 bp, Homo sapiens
tcattgaaagcttcaaagtt

SEQ ID NO: 680071 - DNA, 12 bp, Homo sapiens
tcattgactttt

SEQ ID NO: 680072 - DNA, 14 bp, Homo sapiens
tcattgacttttat

SEQ ID NO: 680073 - DNA, 16 bp, Homo sapiens
tcattgacttttataa

SEQ ID NO: 680074 - DNA, 18 bp, Homo sapiens
tcattgattgtcagctac

SEQ ID NO: 680075 - DNA, 17 bp, Homo sapiens
tcattgcacataagctt

SEQ ID NO: 680076 - DNA, 23 bp, Homo sapiens
tcattgcacataagcttccattt

SEQ ID NO: 680077 - DNA, 12 bp, Homo sapiens
tctacacatgtt

SEQ ID NO: 680078 - DNA, 16 bp, Homo sapiens
tctacaccaatgaaaa

SEQ ID NO: 680079 - DNA, 19 bp, Homo sapiens
tctacaccaatgaaaacat

SEQ ID NO: 680080 - DNA, 18 bp, Homo sapiens
tctaccaaaaaaaggaag

SEQ ID NO: 680081 - DNA, 19 bp, Homo sapiens
tctaccaaaaaaaggaagg

SEQ ID NO: 680082 - DNA, 23 bp, Homo sapiens
tctaccagattctgcctatgtaa

SEQ ID NO: 680083 - DNA, 12 bp, Homo sapiens
tctacctgccct

SEQ ID NO: 680084 - DNA, 13 bp, Homo sapiens
tctaccttttctg

SEQ ID NO: 680085 - DNA, 12 bp, Homo sapiens
tctactcccctt

SEQ ID NO: 680086 - DNA, 16 bp, Homo sapiens
tctactcctagaagaa

SEQ ID NO: 680087 - DNA, 12 bp, Homo sapiens
tctactcctgcc

SEQ ID NO: 680088 - DNA, 14 bp, Homo sapiens
tctactcctgcctc

SEQ ID NO: 680089 - DNA, 15 bp, Homo sapiens
tctactcctgcctca

SEQ ID NO: 680090 - DNA, 16 bp, Homo sapiens
tattactgacatttct

SEQ ID NO: 680091 - DNA, 19 bp, Homo sapiens
tattaggaaaataaacaga

SEQ ID NO: 680092 - DNA, 14 bp, Homo sapiens
tattatacatgtga

SEQ ID NO: 680093 - DNA, 17 bp, Homo sapiens
tattattagataatatt

SEQ ID NO: 680094 - DNA, 17 bp, Homo sapiens
tattattcccgacgaca

SEQ ID NO: 680095 - DNA, 22 bp, Homo sapiens
tattcaaatttgatgatgttaa

SEQ ID NO: 680096 - DNA, 21 bp, Homo sapiens
tattccttttaaagaagcttt

SEQ ID NO: 680097 - DNA, 18 bp, Homo sapiens
tattctggttcttgaaaa

SEQ ID NO: 680098 - DNA, 15 bp, Homo sapiens
tattcttttgtttcc

SEQ ID NO: 680099 - DNA, 14 bp, Homo sapiens
tattgaccattttt

SEQ ID NO: 680100 - DNA, 14 bp, Homo sapiens
tattgagatttctt

SEQ ID NO: 680101 - DNA, 18 bp, Homo sapiens
tattgagatttcttaaat

SEQ ID NO: 680102 - DNA, 19 bp, Homo sapiens
tattgattgggaaaacatt

SEQ ID NO: 680103 - DNA, 20 bp, Homo sapiens
tattgattgggaaaacattt

SEQ ID NO: 680104 - DNA, 22 bp, Homo sapiens
tattgattgggaaaacatttgc

SEQ ID NO: 680105 - DNA, 15 bp, Homo sapiens
tattgatttttaaga

SEQ ID NO: 680106 - DNA, 11 bp, Homo sapiens
tattgcataag

SEQ ID NO: 680107 - DNA, 19 bp, Homo sapiens
tattgcatgcaatttgaag

SEQ ID NO: 680108 - DNA, 13 bp, Homo sapiens
tattgctgctgcc

SEQ ID NO: 680109 - DNA, 17 bp, Homo sapiens
tattgtgaagtacatat

SEQ ID NO: 680110 - DNA, 22 bp, Homo sapiens
tattgtgttttgctttggaaac

SEQ ID NO: 680111 - DNA, 16 bp, Homo sapiens
tattgttaatacaagg

SEQ ID NO: 680112 - DNA, 18 bp, Homo sapiens
tattgttcaaaaagatat

SEQ ID NO: 680113 - DNA, 16 bp, Homo sapiens
tattgtttaaaatgta

SEQ ID NO: 680114 - DNA, 17 bp, Homo sapiens
tattgtttaaaatgtaa

SEQ ID NO: 680115 - DNA, 16 bp, Homo sapiens
tattgtttctctgaaa

SEQ ID NO: 680116 - DNA, 16 bp, Homo sapiens
tattgtttggtaaatg

SEQ ID NO: 680117 - DNA, 17 bp, Homo sapiens
tattgtttggtaaatgt

SEQ ID NO: 680118 - DNA, 19 bp, Homo sapiens
tattgttttactccttttt

SEQ ID NO: 680119 - DNA, 16 bp, Homo sapiens
tatttaaaaaaaagaa

SEQ ID NO: 680120 - DNA, 12 bp, Homo sapiens
tatttaaagttg

SEQ ID NO: 680121 - DNA, 18 bp, Homo sapiens
tatttaaggtagcttcag

SEQ ID NO: 680122 - DNA, 12 bp, Homo sapiens
tatttaagtagt

SEQ ID NO: 680123 - DNA, 22 bp, Homo sapiens
tatttaagtagtgggcatttca

SEQ ID NO: 680124 - DNA, 23 bp, Homo sapiens
tatttaagtagtgggcatttcat

SEQ ID NO: 680125 - DNA, 15 bp, Homo sapiens
tatttacccttttcc

SEQ ID NO: 680126 - DNA, 14 bp, Homo sapiens
tatttactaactaa

SEQ ID NO: 680127 - DNA, 15 bp, Homo sapiens
tatttatttttcttg

SEQ ID NO: 680128 - DNA, 12 bp, Homo sapiens
tatttcataatt

SEQ ID NO: 680129 - DNA, 13 bp, Homo sapiens
tatttcatctttt

SEQ ID NO: 680130 - DNA, 13 bp, Homo sapiens
tatttcatttatt

SEQ ID NO: 680131 - DNA, 15 bp, Homo sapiens
tatttcgtgtactgc

SEQ ID NO: 680132 - DNA, 20 bp, Homo sapiens
tatttctaatccttttcctt

SEQ ID NO: 680133 - DNA, 19 bp, Homo sapiens
tatttctatgacaaattca

SEQ ID NO: 680134 - DNA, 17 bp, Homo sapiens
tatttctgggtcttttg

SEQ ID NO: 680135 - DNA, 22 bp, Homo sapiens
tatttctgggtcttttgctact

SEQ ID NO: 680136 - DNA, 20 bp, Homo sapiens
tatttctgtttcctatttaa

SEQ ID NO: 680137 - DNA, 13 bp, Homo sapiens
tatttcttccctg

SEQ ID NO: 680138 - DNA, 23 bp, Homo sapiens
tatttcttcttctaagaagacat

SEQ ID NO: 680139 - DNA, 12 bp, Homo sapiens
tatttcttttta

SEQ ID NO: 680140 - DNA, 20 bp, Homo sapiens
tatttgaaatagtatacatt

SEQ ID NO: 680141 - DNA, 17 bp, Homo sapiens
tatttgaggtcagtgtt

SEQ ID NO: 680142 - DNA, 17 bp, Homo sapiens
tatttgattatgtatgg

SEQ ID NO: 680143 - DNA, 13 bp, Homo sapiens
tatttgatttcta

SEQ ID NO: 680144 - DNA, 14 bp, Homo sapiens
tatttgatttctaa

SEQ ID NO: 680145 - DNA, 15 bp, Homo sapiens
tatttgctaatgtat

SEQ ID NO: 680146 - DNA, 13 bp, Homo sapiens
tatttgtaaagct

SEQ ID NO: 680147 - DNA, 15 bp, Homo sapiens
tatttgtaggagaaa

SEQ ID NO: 680148 - DNA, 15 bp, Homo sapiens
tattttaaaatatat

SEQ ID NO: 680149 - DNA, 19 bp, Homo sapiens
tattttaaaatatatgaag

SEQ ID NO: 680150 - DNA, 18 bp, Homo sapiens
tattttacagctcattaa

SEQ ID NO: 680151 - DNA, 19 bp, Homo sapiens
tattttcttcatccaactt

SEQ ID NO: 680152 - DNA, 17 bp, Homo sapiens
tattttgtcttattctt

SEQ ID NO: 680153 - DNA, 14 bp, Homo sapiens
tattttgtgtgaaa

SEQ ID NO: 680154 - DNA, 15 bp, Homo sapiens
tattttgtgtgaaat

SEQ ID NO: 680155 - DNA, 23 bp, Homo sapiens
tatttttatacaagtaatttcct

SEQ ID NO: 680156 - DNA, 13 bp, Homo sapiens
tatttttgtgtag

SEQ ID NO: 680157 - DNA, 15 bp, Homo sapiens
tatttttgtgtaggt

SEQ ID NO: 680158 - DNA, 21 bp, Homo sapiens
tattttttggacttcaaagca

SEQ ID NO: 680159 - DNA, 20 bp, Homo sapiens
tatttttttaatttaacatg

SEQ ID NO: 680160 - DNA, 21 bp, Homo sapiens
tattttttttttcttcttggg

SEQ ID NO: 680161 - DNA, 22 bp, Homo sapiens
tcaaaagaaaattgatattttt

SEQ ID NO: 680162 - DNA, 21 bp, Homo sapiens
tcaaaaggtattatacatgtg

SEQ ID NO: 680163 - DNA, 17 bp, Homo sapiens
tcaaacttactattttg

SEQ ID NO: 680164 - DNA, 15 bp, Homo sapiens
tcaaagagaattgta

SEQ ID NO: 680165 - DNA, 18 bp, Homo sapiens
tcaaagcacttaagtgtt

SEQ ID NO: 680166 - DNA, 17 bp, Homo sapiens
tcaaagccacattattt

SEQ ID NO: 680167 - DNA, 15 bp, Homo sapiens
tcaaagccagggtct

SEQ ID NO: 680168 - DNA, 11 bp, Homo sapiens
tcaaagccttc

SEQ ID NO: 680169 - DNA, 20 bp, Homo sapiens
tcaaagctttcctgtttcca

SEQ ID NO: 680170 - DNA, 15 bp, Homo sapiens
tcaaaggacaaagtg

SEQ ID NO: 680171 - DNA, 17 bp, Homo sapiens
tcaaagggataaagaaa

SEQ ID NO: 680172 - DNA, 14 bp, Homo sapiens
tcaaagtatgcaat

SEQ ID NO: 680173 - DNA, 18 bp, Homo sapiens
tcaaagtatgcaatgctt

SEQ ID NO: 680174 - DNA, 17 bp, Homo sapiens
tcaaataaaatatcata

SEQ ID NO: 680175 - DNA, 20 bp, Homo sapiens
tcaaataaaatatcataaag

SEQ ID NO: 680176 - DNA, 13 bp, Homo sapiens
tcaaataagaaat

SEQ ID NO: 680177 - DNA, 14 bp, Homo sapiens
tcaaatacacattt

SEQ ID NO: 680178 - DNA, 15 bp, Homo sapiens
tcaaatcgatttagt

SEQ ID NO: 680179 - DNA, 16 bp, Homo sapiens
tcaaatctcctgctga

SEQ ID NO: 680180 - DNA, 17 bp, Homo sapiens
tcaaatctcctgctgat

SEQ ID NO: 680181 - DNA, 22 bp, Homo sapiens
tcaaatttactttaaaaagaaa

SEQ ID NO: 680182 - DNA, 18 bp, Homo sapiens
tcaacaaatattcactgg

SEQ ID NO: 680183 - DNA, 14 bp, Homo sapiens
tcaacagacaatta

SEQ ID NO: 680184 - DNA, 16 bp, Homo sapiens
tcaactcacctaatgt

SEQ ID NO: 680185 - DNA, 19 bp, Homo sapiens
tcaactcacctaatgttta

SEQ ID NO: 680186 - DNA, 11 bp, Homo sapiens
tcaactcccaa

SEQ ID NO: 680187 - DNA, 13 bp, Homo sapiens
tcaacttatttca

SEQ ID NO: 680188 - DNA, 17 bp, Homo sapiens
tcaacttatttcataat

SEQ ID NO: 680189 - DNA, 19 bp, Homo sapiens
tcaacttatttcataattg

SEQ ID NO: 680190 - DNA, 16 bp, Homo sapiens
tcaactttgtaaaaat

SEQ ID NO: 680191 - DNA, 21 bp, Homo sapiens
tcaagaatgaaaaatataatg

SEQ ID NO: 680192 - DNA, 13 bp, Homo sapiens
tcaagacatttgc

SEQ ID NO: 680193 - DNA, 17 bp, Homo sapiens
tcaagacatttgctgaa

SEQ ID NO: 680194 - DNA, 20 bp, Homo sapiens
tcaagagctagaaaaataaa

SEQ ID NO: 680195 - DNA, 19 bp, Homo sapiens
tcaagattttgaatgcttc

SEQ ID NO: 680196 - DNA, 15 bp, Homo sapiens
tcaagatttttttcc

SEQ ID NO: 680197 - DNA, 19 bp, Homo sapiens
tcaagccatcaaacctggg

SEQ ID NO: 680198 - DNA, 14 bp, Homo sapiens
tcaagcctctggtc

SEQ ID NO: 680199 - DNA, 12 bp, Homo sapiens
tcaagctttccc

SEQ ID NO: 680200 - DNA, 16 bp, Homo sapiens
tcaaggagaatatgat

SEQ ID NO: 680201 - DNA, 18 bp, Homo sapiens
tcaagggcttactatttc

SEQ ID NO: 680202 - DNA, 16 bp, Homo sapiens
tcaagggggactgtct

SEQ ID NO: 680203 - DNA, 18 bp, Homo sapiens
tcaagtaagaagacatga

SEQ ID NO: 680204 - DNA, 23 bp, Homo sapiens
tcaagtaagaagacatgaaccaa

SEQ ID NO: 680205 - DNA, 14 bp, Homo sapiens
tcaagtccatctga

SEQ ID NO: 680206 - DNA, 17 bp, Homo sapiens
tcaagtccatctgacaa

SEQ ID NO: 680207 - DNA, 20 bp, Homo sapiens
tcaagtgttaggtcaataac

SEQ ID NO: 680208 - DNA, 15 bp, Homo sapiens
tcaagtttacacttc

SEQ ID NO: 680209 - DNA, 17 bp, Homo sapiens
tcaataaatctttcaaa

SEQ ID NO: 680210 - DNA, 16 bp, Homo sapiens
tacagctatatttgat

SEQ ID NO: 680211 - DNA, 18 bp, Homo sapiens
tacagctcattaaacttt

SEQ ID NO: 680212 - DNA, 16 bp, Homo sapiens
tacaggtaactaattg

SEQ ID NO: 680213 - DNA, 19 bp, Homo sapiens
tacaggtaactaattggaa

SEQ ID NO: 680214 - DNA, 19 bp, Homo sapiens
tacagtattatagacaaaa

SEQ ID NO: 680215 - DNA, 13 bp, Homo sapiens
tacagtcttattt

SEQ ID NO: 680216 - DNA, 17 bp, Homo sapiens
tacagtgactccctggg

SEQ ID NO: 680217 - DNA, 19 bp, Homo sapiens
tacagtttttatttagcat

SEQ ID NO: 680218 - DNA, 20 bp, Homo sapiens
tacataactcctgtcccttt

SEQ ID NO: 680219 - DNA, 16 bp, Homo sapiens
tacataaggatgactt

SEQ ID NO: 680220 - DNA, 17 bp, Homo sapiens
tacatatagcagctctt

SEQ ID NO: 680221 - DNA, 11 bp, Homo sapiens
tacatatatat

SEQ ID NO: 680222 - DNA, 22 bp, Homo sapiens
tacatcaagtccatctgacaaa

SEQ ID NO: 680223 - DNA, 23 bp, Homo sapiens
tacatcaagtccatctgacaaaa

SEQ ID NO: 680224 - DNA, 22 bp, Homo sapiens
tacatcctcatgcagccgtgat

SEQ ID NO: 680225 - DNA, 16 bp, Homo sapiens
tacatctttcatttcg

SEQ ID NO: 680226 - DNA, 18 bp, Homo sapiens
tacatgcagctatttcaa

SEQ ID NO: 680227 - DNA, 13 bp, Homo sapiens
tagataaattgta

SEQ ID NO: 680228 - DNA, 15 bp, Homo sapiens
tagataatttacaag

SEQ ID NO: 680229 - DNA, 13 bp, Homo sapiens
tagatatttttca

SEQ ID NO: 680230 - DNA, 22 bp, Homo sapiens
tagatgtgcatttttgtgaaat

SEQ ID NO: 680231 - DNA, 14 bp, Homo sapiens
tagatgttgctctt

SEQ ID NO: 680232 - DNA, 13 bp, Homo sapiens
tagcataactgta

SEQ ID NO: 680233 - DNA, 13 bp, Homo sapiens
tagcatgaatgtt

SEQ ID NO: 680234 - DNA, 16 bp, Homo sapiens
tagcatgaatgttttt

SEQ ID NO: 680235 - DNA, 18 bp, Homo sapiens
tagcattgataatcttca

SEQ ID NO: 680236 - DNA, 20 bp, Homo sapiens
tagcattgataatcttcagg

SEQ ID NO: 680237 - DNA, 18 bp, Homo sapiens
tagcattgtaaaagcatt

SEQ ID NO: 680238 - DNA, 15 bp, Homo sapiens
tagcctgcaaagctg

SEQ ID NO: 680239 - DNA, 17 bp, Homo sapiens
tagcgatctctcctggc

SEQ ID NO: 680240 - DNA, 21 bp, Homo sapiens
tagcgtcaagacatttgctga

SEQ ID NO: 680241 - DNA, 12 bp, Homo sapiens
tagctacactga

SEQ ID NO: 680242 - DNA, 13 bp, Homo sapiens
tagctacactgag

SEQ ID NO: 680243 - DNA, 22 bp, Homo sapiens
tagctcaagtttaaaagccatg

SEQ ID NO: 680244 - DNA, 19 bp, Homo sapiens
tagctcctccccttcctct

SEQ ID NO: 680245 - DNA, 22 bp, Homo sapiens
tagctgaagaattgaaaagttt

SEQ ID NO: 680246 - DNA, 17 bp, Homo sapiens
tagcttgcagaactgta

SEQ ID NO: 680247 - DNA, 14 bp, Homo sapiens
tagcttttaggaaa

SEQ ID NO: 680248 - DNA, 20 bp, Homo sapiens
taggaaactgaagcataaag

SEQ ID NO: 680249 - DNA, 16 bp, Homo sapiens
taggaacttcagagat

SEQ ID NO: 680250 - DNA, 14 bp, Homo sapiens
taggaccaagaaag

SEQ ID NO: 680251 - DNA, 23 bp, Homo sapiens
taggactagaagattagaaacta

SEQ ID NO: 680252 - DNA, 18 bp, Homo sapiens
taggaggacaaaaggaat

SEQ ID NO: 680253 - DNA, 19 bp, Homo sapiens
taggaggacaaaaggaatg

SEQ ID NO: 680254 - DNA, 19 bp, Homo sapiens
taggatgggaacaaggaag

SEQ ID NO: 680255 - DNA, 20 bp, Homo sapiens
taggatgggaacaaggaagg

SEQ ID NO: 680256 - DNA, 23 bp, Homo sapiens
taggatgggaacaaggaaggaaa

SEQ ID NO: 680257 - DNA, 19 bp, Homo sapiens
taggcattaatgtttctat

SEQ ID NO: 680258 - DNA, 19 bp, Homo sapiens
taggcctcaggtgaaactc

SEQ ID NO: 680259 - DNA, 19 bp, Homo sapiens
taggctgatgggcaaaaaa

SEQ ID NO: 680260 - DNA, 22 bp, Homo sapiens
taggctttcatgttgcaaagaa

SEQ ID NO: 680261 - DNA, 15 bp, Homo sapiens
tagggggctttctgg

SEQ ID NO: 680262 - DNA, 22 bp, Homo sapiens
taggtaaatttttaggcaaaga

SEQ ID NO: 680263 - DNA, 20 bp, Homo sapiens
taggtagaagtgagcaaaaa

SEQ ID NO: 680264 - DNA, 18 bp, Homo sapiens
taggtattacaagtaatg

SEQ ID NO: 680265 - DNA, 17 bp, Homo sapiens
taggtcataaagcattg

SEQ ID NO: 680266 - DNA, 22 bp, Homo sapiens
taggtgtctgccttcacaaatg

SEQ ID NO: 680267 - DNA, 19 bp, Homo sapiens
taggttatctttttaaaaa

SEQ ID NO: 680268 - DNA, 15 bp, Homo sapiens
taggtttctctccct

SEQ ID NO: 680269 - DNA, 18 bp, Homo sapiens
tagtaagaagacaaactg

SEQ ID NO: 680270 - DNA, 22 bp, Homo sapiens
tagtaagattgatatctataaa

SEQ ID NO: 680271 - DNA, 11 bp, Homo sapiens
tagtaagcata

SEQ ID NO: 680272 - DNA, 15 bp, Homo sapiens
tagtaagcatagaaa

SEQ ID NO: 680273 - DNA, 13 bp, Homo sapiens
tagtaatggcaga

SEQ ID NO: 680274 - DNA, 20 bp, Homo sapiens
tagtagttaaataactgtgt

SEQ ID NO: 680275 - DNA, 13 bp, Homo sapiens
tagtctaagacta

SEQ ID NO: 680276 - DNA, 14 bp, Homo sapiens
tagtctgaaactgg

SEQ ID NO: 680277 - DNA, 17 bp, Homo sapiens
tagtctgaaactggctt

SEQ ID NO: 680278 - DNA, 13 bp, Homo sapiens
tagtgaatgggaa

SEQ ID NO: 680279 - DNA, 15 bp, Homo sapiens
tagtgatcatttaaa

SEQ ID NO: 680280 - DNA, 16 bp, Homo sapiens
tagtgctaatgcattt

SEQ ID NO: 680281 - DNA, 19 bp, Homo sapiens
tagtgtgacagtttccaaa

SEQ ID NO: 680282 - DNA, 20 bp, Homo sapiens
tagtgtgacagtttccaaat

SEQ ID NO: 680283 - DNA, 21 bp, Homo sapiens
tagtgtgacagtttccaaatt

SEQ ID NO: 680284 - DNA, 17 bp, Homo sapiens
tagtgtttctagctaaa

SEQ ID NO: 680285 - DNA, 22 bp, Homo sapiens
tagtgtttctagctaaataaat

SEQ ID NO: 680286 - DNA, 18 bp, Homo sapiens
tagtgtttggacagctga

SEQ ID NO: 680287 - DNA, 21 bp, Homo sapiens
tagtgtttggacagctgataa

SEQ ID NO: 680288 - DNA, 13 bp, Homo sapiens
tagttaaactgag

SEQ ID NO: 680289 - DNA, 14 bp, Homo sapiens
tagttaaactgaga

SEQ ID NO: 680290 - DNA, 17 bp, Homo sapiens
tagttaaataactgtgt

SEQ ID NO: 680291 - DNA, 16 bp, Homo sapiens
tagttagatctttgta

SEQ ID NO: 680292 - DNA, 15 bp, Homo sapiens
tagttccactgagac

SEQ ID NO: 680293 - DNA, 12 bp, Homo sapiens
tagtttgtctat

SEQ ID NO: 680294 - DNA, 15 bp, Homo sapiens
tagtttttatatgtt

SEQ ID NO: 680295 - DNA, 12 bp, Homo sapiens
tataaaatacat

SEQ ID NO: 680296 - DNA, 21 bp, Homo sapiens
tataaaatacatagtgaaaat

SEQ ID NO: 680297 - DNA, 17 bp, Homo sapiens
tataaaatcctgtgcaa

SEQ ID NO: 680298 - DNA, 12 bp, Homo sapiens
tataaaatgtgc

SEQ ID NO: 680299 - DNA, 21 bp, Homo sapiens
tataaaatgtgcagatgcaat

SEQ ID NO: 680300 - DNA, 20 bp, Homo sapiens
tataaaattatgagattggt

SEQ ID NO: 680301 - DNA, 18 bp, Homo sapiens
tataaacagaaatggaaa

SEQ ID NO: 680302 - DNA, 16 bp, Homo sapiens
tataaagcttaaattt

SEQ ID NO: 680303 - DNA, 17 bp, Homo sapiens
tataaagcttaaatttt

SEQ ID NO: 680304 - DNA, 18 bp, Homo sapiens
tataaagcttaaatttta

SEQ ID NO: 680305 - DNA, 17 bp, Homo sapiens
tataaattgtgtattta

SEQ ID NO: 680306 - DNA, 22 bp, Homo sapiens
tataaatttttaagagaaagaa

SEQ ID NO: 680307 - DNA, 12 bp, Homo sapiens
tataataaaggc

SEQ ID NO: 680308 - DNA, 13 bp, Homo sapiens
tataatataaaaa

SEQ ID NO: 680309 - DNA, 17 bp, Homo sapiens
tataatgaagaacactg

SEQ ID NO: 680310 - DNA, 18 bp, Homo sapiens
tataatgaagaacactgt

SEQ ID NO: 680311 - DNA, 16 bp, Homo sapiens
tataatggagttaacg

SEQ ID NO: 680312 - DNA, 13 bp, Homo sapiens
tataatgtatttt

SEQ ID NO: 680313 - DNA, 19 bp, Homo sapiens
tataatgttgataatatat

SEQ ID NO: 680314 - DNA, 23 bp, Homo sapiens
tataattgtacaaaattaagcaa

SEQ ID NO: 680315 - DNA, 16 bp, Homo sapiens
tataatttataagcat

SEQ ID NO: 680316 - DNA, 18 bp, Homo sapiens
tataatttataagcattg

SEQ ID NO: 680317 - DNA, 19 bp, Homo sapiens
tatacatatgagaatatac

SEQ ID NO: 680318 - DNA, 21 bp, Homo sapiens
tatacatatgagaatatacct

SEQ ID NO: 680319 - DNA, 16 bp, Homo sapiens
tatacatattgtatat

SEQ ID NO: 680320 - DNA, 16 bp, Homo sapiens
tatacattgtcttgat

SEQ ID NO: 680321 - DNA, 13 bp, Homo sapiens
tatacattttcta

SEQ ID NO: 680322 - DNA, 19 bp, Homo sapiens
tatacattttctaaataaa

SEQ ID NO: 680323 - DNA, 22 bp, Homo sapiens
tataccttatttatttttgtgt

SEQ ID NO: 680324 - DNA, 16 bp, Homo sapiens
tatactgtatttctaa

SEQ ID NO: 680325 - DNA, 21 bp, Homo sapiens
tatactgtatttctaagaagt

SEQ ID NO: 680326 - DNA, 15 bp, Homo sapiens
tatactttgccactg

SEQ ID NO: 680327 - DNA, 19 bp, Homo sapiens
tatagaaaattcttgagaa

SEQ ID NO: 680328 - DNA, 13 bp, Homo sapiens
tatagacaaaaga

SEQ ID NO: 680329 - DNA, 22 bp, Homo sapiens
tatagcatgaatgtttttagag

SEQ ID NO: 680330 - DNA, 18 bp, Homo sapiens
tataggagccttaatttt

SEQ ID NO: 680331 - DNA, 22 bp, Homo sapiens
tataggcctgtcccttgcctct

SEQ ID NO: 680332 - DNA, 16 bp, Homo sapiens
tatagtctaagactat

SEQ ID NO: 680333 - DNA, 19 bp, Homo sapiens
tatagtgcagaaaacgtgg

SEQ ID NO: 680334 - DNA, 12 bp, Homo sapiens
tatagttaaact

SEQ ID NO: 680335 - DNA, 17 bp, Homo sapiens
tatataaaacttaaaaa

SEQ ID NO: 680336 - DNA, 19 bp, Homo sapiens
gtgcagaggtaccctgggt

SEQ ID NO: 680337 - DNA, 18 bp, Homo sapiens
gtgcatttttgtgaaatg

SEQ ID NO: 680338 - DNA, 14 bp, Homo sapiens
gtgccaactgccag

SEQ ID NO: 680339 - DNA, 20 bp, Homo sapiens
gtgccagcaccacagccggt

SEQ ID NO: 680340 - DNA, 23 bp, Homo sapiens
gtgccatattctggttcttgaaa

SEQ ID NO: 680341 - DNA, 17 bp, Homo sapiens
gtgcccacgagggtctc

SEQ ID NO: 680342 - DNA, 16 bp, Homo sapiens
gtgccctcgcctcctc

SEQ ID NO: 680343 - DNA, 15 bp, Homo sapiens
gtgccgtgtgagtgt

SEQ ID NO: 680344 - DNA, 19 bp, Homo sapiens
gtgccgtgtgagtgtgaca

SEQ ID NO: 680345 - DNA, 12 bp, Homo sapiens
gtgcctcacctt

SEQ ID NO: 680346 - DNA, 23 bp, Homo sapiens
gtgcctccacatgctgcctggca

SEQ ID NO: 680347 - DNA, 14 bp, Homo sapiens
gtgcctgtgtgcgt

SEQ ID NO: 680348 - DNA, 16 bp, Homo sapiens
gtgcctttctttgcct

SEQ ID NO: 680349 - DNA, 17 bp, Homo sapiens
gtgcctttctttgcctc

SEQ ID NO: 680350 - DNA, 20 bp, Homo sapiens
gtgcgcatcttgcctccagg

SEQ ID NO: 680351 - DNA, 24 bp, Homo sapiens
gtgcgcatcttgcctccaggtgca

SEQ ID NO: 680352 - DNA, 13 bp, Homo sapiens
gtgcgtgaatgta

SEQ ID NO: 680353 - DNA, 17 bp, Homo sapiens
gtgctatgaagccaact

SEQ ID NO: 680354 - DNA, 16 bp, Homo sapiens
gtgctcagaagggcta

SEQ ID NO: 680355 - DNA, 13 bp, Homo sapiens
gtgctcatttaag

SEQ ID NO: 680356 - DNA, 14 bp, Homo sapiens
gtgctcccacggcc

SEQ ID NO: 680357 - DNA, 20 bp, Homo sapiens
gtgctccgtagctctgctgc

SEQ ID NO: 680358 - DNA, 21 bp, Homo sapiens
gtgctccgtagctctgctgct

SEQ ID NO: 680359 - DNA, 16 bp, Homo sapiens
gtgctcctgaaagaaa

SEQ ID NO: 680360 - DNA, 20 bp, Homo sapiens
gtgctctgctaaccatttat

SEQ ID NO: 680361 - DNA, 19 bp, Homo sapiens
gtgctctttttttaaaagg

SEQ ID NO: 680362 - DNA, 22 bp, Homo sapiens
gtgctgcagcaccgaggggcct

SEQ ID NO: 680363 - DNA, 22 bp, Homo sapiens
gtgctgtcttgatgactgctga

SEQ ID NO: 680364 - DNA, 13 bp, Homo sapiens
gtgcttgttttat

SEQ ID NO: 680365 - DNA, 23 bp, Homo sapiens
gtgctttttaagaatatttttag

SEQ ID NO: 680366 - DNA, 20 bp, Homo sapiens
gtggaaattaagactttatg

SEQ ID NO: 680367 - DNA, 19 bp, Homo sapiens
gtggaaggcctccctctgt

SEQ ID NO: 680368 - DNA, 14 bp, Homo sapiens
gtggaatgagtgtg

SEQ ID NO: 680369 - DNA, 12 bp, Homo sapiens
gtggagggaggc

SEQ ID NO: 680370 - DNA, 22 bp, Homo sapiens
gtggatcacgaggtcaggagat

SEQ ID NO: 680371 - DNA, 17 bp, Homo sapiens
gtggattgcctctgaaa

SEQ ID NO: 680372 - DNA, 13 bp, Homo sapiens
gtggcacagctgg

SEQ ID NO: 680373 - DNA, 13 bp, Homo sapiens
gtggccaggcctt

SEQ ID NO: 680374 - DNA, 21 bp, Homo sapiens
gtggccaggctgcctggcctt

SEQ ID NO: 680375 - DNA, 14 bp, Homo sapiens
gtggccctgaacct

SEQ ID NO: 680376 - DNA, 17 bp, Homo sapiens
gtggcggctgcacaaca

SEQ ID NO: 680377 - DNA, 14 bp, Homo sapiens
gtggcgggcacctg

SEQ ID NO: 680378 - DNA, 14 bp, Homo sapiens
gtggcgtctccctc

SEQ ID NO: 680379 - DNA, 18 bp, Homo sapiens
gtggcgtgggagccagcc

SEQ ID NO: 680380 - DNA, 22 bp, Homo sapiens
gtggctcccttggtgccctcgc

SEQ ID NO: 680381 - DNA, 14 bp, Homo sapiens
gtggggcagggagc

SEQ ID NO: 680382 - DNA, 13 bp, Homo sapiens
gtggggctgcagg

SEQ ID NO: 680383 - DNA, 14 bp, Homo sapiens
gtggggctgcaggc

SEQ ID NO: 680384 - DNA, 18 bp, Homo sapiens
gtgggtcctgaggcctgc

SEQ ID NO: 680385 - DNA, 15 bp, Homo sapiens
gtgggtgctcagaat

SEQ ID NO: 680386 - DNA, 21 bp, Homo sapiens
gtggtaagcaacatggctttg

SEQ ID NO: 680387 - DNA, 20 bp, Homo sapiens
gtggtctcttcttggggccc

SEQ ID NO: 680388 - DNA, 14 bp, Homo sapiens
gtggtggcctcagc

SEQ ID NO: 680389 - DNA, 13 bp, Homo sapiens
gtggtgtgactct

SEQ ID NO: 680390 - DNA, 14 bp, Homo sapiens
gtggttaggcagca

SEQ ID NO: 680391 - DNA, 21 bp, Homo sapiens
gtgtagccaggtatggctctg

SEQ ID NO: 680392 - DNA, 17 bp, Homo sapiens
gtgtatataattttatg

SEQ ID NO: 680393 - DNA, 14 bp, Homo sapiens
gtgtatattttaat

SEQ ID NO: 680394 - DNA, 13 bp, Homo sapiens
gtgtatcctggcc

SEQ ID NO: 680395 - DNA, 15 bp, Homo sapiens
gtgtatgactaaaga

SEQ ID NO: 680396 - DNA, 19 bp, Homo sapiens
gtgtcacccaaaccggcag

SEQ ID NO: 680397 - DNA, 17 bp, Homo sapiens
gtgtcagggtccaggag

SEQ ID NO: 680398 - DNA, 17 bp, Homo sapiens
gtgtccacctgtgggtg

SEQ ID NO: 680399 - DNA, 19 bp, Homo sapiens
gtgtcccaggcagggagac

SEQ ID NO: 680400 - DNA, 12 bp, Homo sapiens
gtgtcctggtga

SEQ ID NO: 680401 - DNA, 13 bp, Homo sapiens
gtgtctgcacagg

SEQ ID NO: 680402 - DNA, 18 bp, Homo sapiens
gtgtgaacctacctgcct

SEQ ID NO: 680403 - DNA, 11 bp, Homo sapiens
gtgtgaatgca

SEQ ID NO: 680404 - DNA, 19 bp, Homo sapiens
gtgtgaatgtgggcactgg

SEQ ID NO: 680405 - DNA, 23 bp, Homo sapiens
gtgtgaatgtgggcactggccca

SEQ ID NO: 680406 - DNA, 17 bp, Homo sapiens
gtgtgagctcttccctt

SEQ ID NO: 680407 - DNA, 23 bp, Homo sapiens
gtgtgcacatccgcgtgtgcctg

SEQ ID NO: 680408 - DNA, 22 bp, Homo sapiens
gtgtgcatggaggccctcctgt

SEQ ID NO: 680409 - DNA, 13 bp, Homo sapiens
gtgtggtggcctc

SEQ ID NO: 680410 - DNA, 14 bp, Homo sapiens
gtgtgtcccaggca

SEQ ID NO: 680411 - DNA, 18 bp, Homo sapiens
gtgtgtcccaggcaggga

SEQ ID NO: 680412 - DNA, 20 bp, Homo sapiens
gtgtgtgtacaaatacatgt

SEQ ID NO: 680413 - DNA, 14 bp, Homo sapiens
gtgtgtgtgtgcac

SEQ ID NO: 680414 - DNA, 14 bp, Homo sapiens
gtgttagtggcacc

SEQ ID NO: 680415 - DNA, 23 bp, Homo sapiens
gtgttcagctctttccaaattaa

SEQ ID NO: 680416 - DNA, 23 bp, Homo sapiens
gtgttctgctccataccttttct

SEQ ID NO: 680417 - DNA, 20 bp, Homo sapiens
gtgttggcaaacgagacttt

SEQ ID NO: 680418 - DNA, 18 bp, Homo sapiens
gtgtttattataaagctt

SEQ ID NO: 680419 - DNA, 14 bp, Homo sapiens
gtgtttgtttttgc

SEQ ID NO: 680420 - DNA, 20 bp, Homo sapiens
gttaaaaacagatttggaaa

SEQ ID NO: 680421 - DNA, 18 bp, Homo sapiens
gttaaaactgtacattta

SEQ ID NO: 680422 - DNA, 19 bp, Homo sapiens
gttaaaactgtacatttaa

SEQ ID NO: 680423 - DNA, 20 bp, Homo sapiens
gttaaaactgtacatttaaa

SEQ ID NO: 680424 - DNA, 22 bp, Homo sapiens
gttaaaactgtacatttaaaat

SEQ ID NO: 680425 - DNA, 23 bp, Homo sapiens
gttaaaactgtacatttaaaatt

SEQ ID NO: 680426 - DNA, 14 bp, Homo sapiens
gttaaactgagagt

SEQ ID NO: 680427 - DNA, 15 bp, Homo sapiens
gttaaagagaatgag

SEQ ID NO: 680428 - DNA, 21 bp, Homo sapiens
gttaaagggatatttttttct

SEQ ID NO: 680429 - DNA, 18 bp, Homo sapiens
gttaaatgtaatataatg

SEQ ID NO: 680430 - DNA, 15 bp, Homo sapiens
gttaatacaaggtat

SEQ ID NO: 680431 - DNA, 14 bp, Homo sapiens
gttaatttttctta

SEQ ID NO: 680432 - DNA, 17 bp, Homo sapiens
gttacactttttggaag

SEQ ID NO: 680433 - DNA, 22 bp, Homo sapiens
gttacagggaagtggtctcccc

SEQ ID NO: 680434 - DNA, 22 bp, Homo sapiens
gttacataaggatgactttttt

SEQ ID NO: 680435 - DNA, 19 bp, Homo sapiens
gttacctgacctaaattag

SEQ ID NO: 680436 - DNA, 19 bp, Homo sapiens
gttacgttggttaaataaa

SEQ ID NO: 680437 - DNA, 16 bp, Homo sapiens
gttactaatatgccta

SEQ ID NO: 680438 - DNA, 17 bp, Homo sapiens
gttactgggccctgagt

SEQ ID NO: 680439 - DNA, 13 bp, Homo sapiens
gttacttccttat

SEQ ID NO: 680440 - DNA, 13 bp, Homo sapiens
gttagattaagaa

SEQ ID NO: 680441 - DNA, 14 bp, Homo sapiens
gttaggcagcaagc

SEQ ID NO: 680442 - DNA, 16 bp, Homo sapiens
gttatatataataaat

SEQ ID NO: 680443 - DNA, 18 bp, Homo sapiens
gttatatataataaatac

SEQ ID NO: 680444 - DNA, 22 bp, Homo sapiens
gttatctttttaaaaactcttc

SEQ ID NO: 680445 - DNA, 13 bp, Homo sapiens
gttattagatgtt

SEQ ID NO: 680446 - DNA, 22 bp, Homo sapiens
gttattggtgtaaggtactttc

SEQ ID NO: 680447 - DNA, 21 bp, Homo sapiens
gttattttctttatcattgct

SEQ ID NO: 680448 - DNA, 13 bp, Homo sapiens
gttcaaaatgtct

SEQ ID NO: 680449 - DNA, 14 bp, Homo sapiens
gttcaaaatgtctg

SEQ ID NO: 680450 - DNA, 20 bp, Homo sapiens
gttcaattatctttatcata

SEQ ID NO: 680451 - DNA, 23 bp, Homo sapiens
gttcagacaagacagaggggagc

SEQ ID NO: 680452 - DNA, 14 bp, Homo sapiens
gttcagacacagct

SEQ ID NO: 680453 - DNA, 15 bp, Homo sapiens
gttcagacacagctc

SEQ ID NO: 680454 - DNA, 17 bp, Homo sapiens
gttcagctctttccaaa

SEQ ID NO: 680455 - DNA, 16 bp, Homo sapiens
gttcaggcattccagg

SEQ ID NO: 680456 - DNA, 23 bp, Homo sapiens
gttcatgtcagcttatatgtgac

SEQ ID NO: 680457 - DNA, 17 bp, Homo sapiens
gttcatttctaaattta

SEQ ID NO: 680458 - DNA, 18 bp, Homo sapiens
gttcatttctaaatttat

SEQ ID NO: 680459 - DNA, 17 bp, Homo sapiens
ggaatgaggaaaattct

SEQ ID NO: 680460 - DNA, 15 bp, Homo sapiens
ggaatgagtgtgcat

SEQ ID NO: 680461 - DNA, 23 bp, Homo sapiens
ggaatgctgcccgctctgcagac

SEQ ID NO: 680462 - DNA, 20 bp, Homo sapiens
ggaatgtaactgctgaaaac

SEQ ID NO: 680463 - DNA, 19 bp, Homo sapiens
ggacagctgataaatttaa

SEQ ID NO: 680464 - DNA, 21 bp, Homo sapiens
ggacatcacagggtgggcctc

SEQ ID NO: 680465 - DNA, 18 bp, Homo sapiens
ggacatgcaataaaattt

SEQ ID NO: 680466 - DNA, 19 bp, Homo sapiens
ggacatgcaataaaattta

SEQ ID NO: 680467 - DNA, 12 bp, Homo sapiens
ggaccagggcct

SEQ ID NO: 680468 - DNA, 15 bp, Homo sapiens
ggaccctgtcctgca

SEQ ID NO: 680469 - DNA, 16 bp, Homo sapiens
ggacccttataaaatc

SEQ ID NO: 680470 - DNA, 18 bp, Homo sapiens
ggaccctttttgttatga

SEQ ID NO: 680471 - DNA, 23 bp, Homo sapiens
ggacctttaacttttttttctct

SEQ ID NO: 680472 - DNA, 23 bp, Homo sapiens
ggacgatcaggaggaagtgagca

SEQ ID NO: 680473 - DNA, 22 bp, Homo sapiens
ggactaccgagagcttggacta

SEQ ID NO: 680474 - DNA, 14 bp, Homo sapiens
ggactatctttgct

SEQ ID NO: 680475 - DNA, 18 bp, Homo sapiens
ggactcctggcagggcca

SEQ ID NO: 680476 - DNA, 19 bp, Homo sapiens
ggacttcaaagcaagctgg

SEQ ID NO: 680477 - DNA, 18 bp, Homo sapiens
ggagaaatgcaataactc

SEQ ID NO: 680478 - DNA, 18 bp, Homo sapiens
ggagaagcatgaaaaagc

SEQ ID NO: 680479 - DNA, 17 bp, Homo sapiens
ggagaatatttactaac

SEQ ID NO: 680480 - DNA, 22 bp, Homo sapiens
ggagaatggtgtgaacccggga

SEQ ID NO: 680481 - DNA, 13 bp, Homo sapiens
ggagaccctgcaa

SEQ ID NO: 680482 - DNA, 12 bp, Homo sapiens
ggagaggcaaag

SEQ ID NO: 680483 - DNA, 16 bp, Homo sapiens
ggagagtacctgtgtg

SEQ ID NO: 680484 - DNA, 17 bp, Homo sapiens
ggagcagcagcttctcc

SEQ ID NO: 680485 - DNA, 16 bp, Homo sapiens
ggagcagggaaggcct

SEQ ID NO: 680486 - DNA, 15 bp, Homo sapiens
ggagccagcctccct

SEQ ID NO: 680487 - DNA, 20 bp, Homo sapiens
ggagcccacgctcaccccct

SEQ ID NO: 680488 - DNA, 13 bp, Homo sapiens
ggagcgcaggcag

SEQ ID NO: 680489 - DNA, 21 bp, Homo sapiens
ggagcttcttcgttcctgcgc

SEQ ID NO: 680490 - DNA, 16 bp, Homo sapiens
ggaggacaaaaggaat

SEQ ID NO: 680491 - DNA, 15 bp, Homo sapiens
ggaggagggggccgg

SEQ ID NO: 680492 - DNA, 21 bp, Homo sapiens
ggaggatgtccctgggccagg

SEQ ID NO: 680493 - DNA, 11 bp, Homo sapiens
ggaggcagcat

SEQ ID NO: 680494 - DNA, 15 bp, Homo sapiens
ggaggccccaggggg

SEQ ID NO: 680495 - DNA, 16 bp, Homo sapiens
ggaggccctcctgtgc

SEQ ID NO: 680496 - DNA, 20 bp, Homo sapiens
ggaggtcctttggacagctg

SEQ ID NO: 680497 - DNA, 13 bp, Homo sapiens
ggaggtgtgaatg

SEQ ID NO: 680498 - DNA, 15 bp, Homo sapiens
ggaggtgtgaatgca

SEQ ID NO: 680499 - DNA, 23 bp, Homo sapiens
ggagtacctgtccaagacagggc

SEQ ID NO: 680500 - DNA, 22 bp, Homo sapiens
ggagtgctggctcacagtacag

SEQ ID NO: 680501 - DNA, 18 bp, Homo sapiens
ggagtggttaggcagcaa

SEQ ID NO: 680502 - DNA, 21 bp, Homo sapiens
ggataagaaagcctaaaattg

SEQ ID NO: 680503 - DNA, 23 bp, Homo sapiens
ggatagtagttaaataactgtgt

SEQ ID NO: 680504 - DNA, 16 bp, Homo sapiens
ggatatatttgaaata

SEQ ID NO: 680505 - DNA, 11 bp, Homo sapiens
ggatatttaag

SEQ ID NO: 680506 - DNA, 22 bp, Homo sapiens
ggatcacttgagccccggaggt

SEQ ID NO: 680507 - DNA, 14 bp, Homo sapiens
ggatcttgaatgtg

SEQ ID NO: 680508 - DNA, 22 bp, Homo sapiens
ggatcttgaatgtggtctcagg

SEQ ID NO: 680509 - DNA, 13 bp, Homo sapiens
ggatgatttaagt

SEQ ID NO: 680510 - DNA, 19 bp, Homo sapiens
ggatggaaaaggaagacta

SEQ ID NO: 680511 - DNA, 20 bp, Homo sapiens
ggattaatttgtgaaaatgt

SEQ ID NO: 680512 - DNA, 15 bp, Homo sapiens
ggattctaaatacat

SEQ ID NO: 680513 - DNA, 21 bp, Homo sapiens
ggattctgaggccctgcccaa

SEQ ID NO: 680514 - DNA, 15 bp, Homo sapiens
ggattgcccctggct

SEQ ID NO: 680515 - DNA, 17 bp, Homo sapiens
ggattgcccctggcttt

SEQ ID NO: 680516 - DNA, 23 bp, Homo sapiens
ggattgcccctggctttgcctct

SEQ ID NO: 680517 - DNA, 21 bp, Homo sapiens
ggcaaagggagcagaactgaa

SEQ ID NO: 680518 - DNA, 17 bp, Homo sapiens
ggctgtctgttgtattc

SEQ ID NO: 680519 - DNA, 22 bp, Homo sapiens
ggctttcccacttcccaccctg

SEQ ID NO: 680520 - DNA, 14 bp, Homo sapiens
ggctttctggggcc

SEQ ID NO: 680521 - DNA, 19 bp, Homo sapiens
ggctttctgggtgtgactg

SEQ ID NO: 680522 - DNA, 15 bp, Homo sapiens
ggctttctgttgcca

SEQ ID NO: 680523 - DNA, 17 bp, Homo sapiens
ggctttttgccatctgt

SEQ ID NO: 680524 - DNA, 23 bp, Homo sapiens
gggaaagtgtgagctcttccctt

SEQ ID NO: 680525 - DNA, 21 bp, Homo sapiens
gggaaatatgccactgaccga

SEQ ID NO: 680526 - DNA, 13 bp, Homo sapiens
gggaacctggaac

SEQ ID NO: 680527 - DNA, 15 bp, Homo sapiens
gggaatgagcccaga

SEQ ID NO: 680528 - DNA, 21 bp, Homo sapiens
gggaatgagcccagagaacag

SEQ ID NO: 680529 - DNA, 13 bp, Homo sapiens
gggaatgggactg

SEQ ID NO: 680530 - DNA, 18 bp, Homo sapiens
gggacatcacagggtggg

SEQ ID NO: 680531 - DNA, 15 bp, Homo sapiens
gggacccagtgcaga

SEQ ID NO: 680532 - DNA, 16 bp, Homo sapiens
gggacccagtgcagaa

SEQ ID NO: 680533 - DNA, 23 bp, Homo sapiens
gggacccccgtggggcagggagc

SEQ ID NO: 680534 - DNA, 14 bp, Homo sapiens
gggacctttaactt

SEQ ID NO: 680535 - DNA, 16 bp, Homo sapiens
gggacgatcaggagga

SEQ ID NO: 680536 - DNA, 20 bp, Homo sapiens
gggactacccatagacatga

SEQ ID NO: 680537 - DNA, 24 bp, Homo sapiens
gggactgactttccgagcctccag

SEQ ID NO: 680538 - DNA, 21 bp, Homo sapiens
gggactgccttgtctctagta

SEQ ID NO: 680539 - DNA, 21 bp, Homo sapiens
gggagaggtgattctcagggc

SEQ ID NO: 680540 - DNA, 15 bp, Homo sapiens
gggagcagggaaggc

SEQ ID NO: 680541 - DNA, 15 bp, Homo sapiens
gggaggccgaggcgg

SEQ ID NO: 680542 - DNA, 14 bp, Homo sapiens
gggaggggaggcat

SEQ ID NO: 680543 - DNA, 16 bp, Homo sapiens
gggaggggaggcattg

SEQ ID NO: 680544 - DNA, 21 bp, Homo sapiens
gggagtacctgtccaagacag

SEQ ID NO: 680545 - DNA, 15 bp, Homo sapiens
gggatggaaaaggaa

SEQ ID NO: 680546 - DNA, 22 bp, Homo sapiens
gggattgcccctggctttgcct

SEQ ID NO: 680547 - DNA, 15 bp, Homo sapiens
gggcagcacctctgc

SEQ ID NO: 680548 - DNA, 16 bp, Homo sapiens
gggcaggctgggccat

SEQ ID NO: 680549 - DNA, 18 bp, Homo sapiens
gggcagggagctgggccc

SEQ ID NO: 680550 - DNA, 21 bp, Homo sapiens
gggcagtccttactcccccac

SEQ ID NO: 680551 - DNA, 21 bp, Homo sapiens
gggcagtctttcttgaaattg

SEQ ID NO: 680552 - DNA, 17 bp, Homo sapiens
gggcattttacccttgc

SEQ ID NO: 680553 - DNA, 22 bp, Homo sapiens
gggccagcatatatacttgcaa

SEQ ID NO: 680554 - DNA, 21 bp, Homo sapiens
gggccagggctgccctgagaa

SEQ ID NO: 680555 - DNA, 20 bp, Homo sapiens
gggccagtggggcctgtgga

SEQ ID NO: 680556 - DNA, 15 bp, Homo sapiens
gggccatggctcagg

SEQ ID NO: 680557 - DNA, 19 bp, Homo sapiens
gggccatggctcagggtgg

SEQ ID NO: 680558 - DNA, 14 bp, Homo sapiens
gggccatgtccaaa

SEQ ID NO: 680559 - DNA, 15 bp, Homo sapiens
gggccatgtccaaag

SEQ ID NO: 680560 - DNA, 16 bp, Homo sapiens
gggccatgtccaaaga

SEQ ID NO: 680561 - DNA, 17 bp, Homo sapiens
gggccatgtccaaagag

SEQ ID NO: 680562 - DNA, 23 bp, Homo sapiens
gggccatgtccaaagaggctgcc

SEQ ID NO: 680563 - DNA, 17 bp, Homo sapiens
gggccccacctcggcac

SEQ ID NO: 680564 - DNA, 14 bp, Homo sapiens
gggccctgagtctg

SEQ ID NO: 680565 - DNA, 12 bp, Homo sapiens
gggccggccctg

SEQ ID NO: 680566 - DNA, 19 bp, Homo sapiens
gggccggccctgtgtgcag

SEQ ID NO: 680567 - DNA, 20 bp, Homo sapiens
gggccgggcgcggtggctca

SEQ ID NO: 680568 - DNA, 14 bp, Homo sapiens
gggcctggggcctg

SEQ ID NO: 680569 - DNA, 17 bp, Homo sapiens
gggcctggggcctgaga

SEQ ID NO: 680570 - DNA, 22 bp, Homo sapiens
gggcctgtggaatgagtgtgca

SEQ ID NO: 680571 - DNA, 17 bp, Homo sapiens
gggccttagtgggccag

SEQ ID NO: 680572 - DNA, 20 bp, Homo sapiens
gggccttagtgggccagggc

SEQ ID NO: 680573 - DNA, 22 bp, Homo sapiens
gggcctttaaaacgcgtctgcc

SEQ ID NO: 680574 - DNA, 18 bp, Homo sapiens
gggccttttctggcaccg

SEQ ID NO: 680575 - DNA, 15 bp, Homo sapiens
gggcgtccagctcag

SEQ ID NO: 680576 - DNA, 14 bp, Homo sapiens
gggctcccaggggt

SEQ ID NO: 680577 - DNA, 23 bp, Homo sapiens
gggctgcaggcaggcggctcctc

SEQ ID NO: 680578 - DNA, 18 bp, Homo sapiens
gggctgccatgtgaagag

SEQ ID NO: 680579 - DNA, 18 bp, Homo sapiens
gggctggacttctacctg

SEQ ID NO: 680580 - DNA, 15 bp, Homo sapiens
gggctggagcctggg

SEQ ID NO: 680581 - DNA, 19 bp, Homo sapiens
ggggaatgagcccagagaa

SEQ ID NO: 680582 - DNA, 21 bp, Homo sapiens
ggggaatgagcccagagaaca

SEQ ID NO: 680583 - DNA, 23 bp, Homo sapiens
ggggaatgagcccagagaacagc

SEQ ID NO: 680584 - DNA, 14 bp, Homo sapiens
ggggagcagtggcc

SEQ ID NO: 680585 - DNA, 22 bp, Homo sapiens
ggggagcagtggccatcatcct

SEQ ID NO: 680586 - DNA, 23 bp, Homo sapiens
ggggatgttctgcctctccctgg

SEQ ID NO: 680587 - DNA, 12 bp, Homo sapiens
gcctgaggggaa

SEQ ID NO: 680588 - DNA, 12 bp, Homo sapiens
gcctgcagcagg

SEQ ID NO: 680589 - DNA, 12 bp, Homo sapiens
gcctgcagggaa

SEQ ID NO: 680590 - DNA, 13 bp, Homo sapiens
gcctgcctcccac

SEQ ID NO: 680591 - DNA, 21 bp, Homo sapiens
gcctgcctgcagcaggcagct

SEQ ID NO: 680592 - DNA, 21 bp, Homo sapiens
gcctggcacagaccaggcctt

SEQ ID NO: 680593 - DNA, 10 bp, Homo sapiens
gcctggcccc

SEQ ID NO: 680594 - DNA, 22 bp, Homo sapiens
gcctggcccccaacctcagggc

SEQ ID NO: 680595 - DNA, 23 bp, Homo sapiens
gcctggccttgtcctcagccagt

SEQ ID NO: 680596 - DNA, 18 bp, Homo sapiens
gcctgggccgtggcacag

SEQ ID NO: 680597 - DNA, 15 bp, Homo sapiens
gcctggggcctgaga

SEQ ID NO: 680598 - DNA, 20 bp, Homo sapiens
gcctggggtgcatctcctcc

SEQ ID NO: 680599 - DNA, 21 bp, Homo sapiens
gcctggggtgtcctacagtga

SEQ ID NO: 680600 - DNA, 21 bp, Homo sapiens
gcctggggtgttagtggcacc

SEQ ID NO: 680601 - DNA, 21 bp, Homo sapiens
gcctggttcagacacagctct

SEQ ID NO: 680602 - DNA, 15 bp, Homo sapiens
gcctgtaatcccagc

SEQ ID NO: 680603 - DNA, 21 bp, Homo sapiens
gcctgtatcctccctggcaga

SEQ ID NO: 680604 - DNA, 22 bp, Homo sapiens
gcctgtatcctccctggcagac

SEQ ID NO: 680605 - DNA, 14 bp, Homo sapiens
gcctgtgatgtttt

SEQ ID NO: 680606 - DNA, 20 bp, Homo sapiens
gcctgtgatgttttatcctt

SEQ ID NO: 680607 - DNA, 19 bp, Homo sapiens
gcctgtggaatgagtgtgc

SEQ ID NO: 680608 - DNA, 19 bp, Homo sapiens
gccttaatttagaaactga

SEQ ID NO: 680609 - DNA, 22 bp, Homo sapiens
gccttagggaagctggcctgag

SEQ ID NO: 680610 - DNA, 14 bp, Homo sapiens
gccttagtgggcca

SEQ ID NO: 680611 - DNA, 17 bp, Homo sapiens
gccttagtgggccaggg

SEQ ID NO: 680612 - DNA, 20 bp, Homo sapiens
gccttcctcagctgcctcct

SEQ ID NO: 680613 - DNA, 12 bp, Homo sapiens
gccttctgctga

SEQ ID NO: 680614 - DNA, 20 bp, Homo sapiens
gccttctgctgaaagactcg

SEQ ID NO: 680615 - DNA, 12 bp, Homo sapiens
gccttctttcca

SEQ ID NO: 680616 - DNA, 21 bp, Homo sapiens
gccttctttccatcaactccc

SEQ ID NO: 680617 - DNA, 16 bp, Homo sapiens
gccttgaaaaatgaca

SEQ ID NO: 680618 - DNA, 22 bp, Homo sapiens
gccttgaaaaatgacaattgtg

SEQ ID NO: 680619 - DNA, 15 bp, Homo sapiens
gccttgagccctggc

SEQ ID NO: 680620 - DNA, 16 bp, Homo sapiens
gccttgagccctggct

SEQ ID NO: 680621 - DNA, 15 bp, Homo sapiens
gccttgatccccttg

SEQ ID NO: 680622 - DNA, 20 bp, Homo sapiens
gccttggctgacatgaagct

SEQ ID NO: 680623 - DNA, 18 bp, Homo sapiens
gccttgtcctcagccagt

SEQ ID NO: 680624 - DNA, 15 bp, Homo sapiens
gcctttctttgcctc

SEQ ID NO: 680625 - DNA, 14 bp, Homo sapiens
gcctttgttctggg

SEQ ID NO: 680626 - DNA, 12 bp, Homo sapiens
gccttttcctga

SEQ ID NO: 680627 - DNA, 16 bp, Homo sapiens
gccttttctggcaccg

SEQ ID NO: 680628 - DNA, 13 bp, Homo sapiens
gccttttgctctc

SEQ ID NO: 680629 - DNA, 22 bp, Homo sapiens
gccttttgttaaacccttctgt

SEQ ID NO: 680630 - DNA, 22 bp, Homo sapiens
gcctttttggcctgtgatgttt

SEQ ID NO: 680631 - DNA, 23 bp, Homo sapiens
gcctttttggcctgtgatgtttt

SEQ ID NO: 680632 - DNA, 16 bp, Homo sapiens
gcgatctctcctggcc

SEQ ID NO: 680633 - DNA, 16 bp, Homo sapiens
gcgcaggcagcgcagg

SEQ ID NO: 680634 - DNA, 15 bp, Homo sapiens
gcgcctttttggcct

SEQ ID NO: 680635 - DNA, 13 bp, Homo sapiens
gcgcggtggctca

SEQ ID NO: 680636 - DNA, 16 bp, Homo sapiens
gcggaattcaagttac

SEQ ID NO: 680637 - DNA, 20 bp, Homo sapiens
gcggctgcacaacagccctg

SEQ ID NO: 680638 - DNA, 15 bp, Homo sapiens
gcggtggctcacgcc

SEQ ID NO: 680639 - DNA, 18 bp, Homo sapiens
gcggtggctcacgcctgt

SEQ ID NO: 680640 - DNA, 11 bp, Homo sapiens
gcgtccctggc

SEQ ID NO: 680641 - DNA, 14 bp, Homo sapiens
gcgtccctggcgca

SEQ ID NO: 680642 - DNA, 18 bp, Homo sapiens
gcgtccctggcgcaggtg

SEQ ID NO: 680643 - DNA, 16 bp, Homo sapiens
gcgtgaggcctgggct

SEQ ID NO: 680644 - DNA, 14 bp, Homo sapiens
gcgtgccgtgtgag

SEQ ID NO: 680645 - DNA, 17 bp, Homo sapiens
gcgtgccgtgtgagtgt

SEQ ID NO: 680646 - DNA, 21 bp, Homo sapiens
gcgtgccgtgtgagtgtgaca

SEQ ID NO: 680647 - DNA, 22 bp, Homo sapiens
gcgtgcgcatcttgcctccagg

SEQ ID NO: 680648 - DNA, 16 bp, Homo sapiens
gcgtggagggaggccc

SEQ ID NO: 680649 - DNA, 20 bp, Homo sapiens
gcgtggagggaggccccagg

SEQ ID NO: 680650 - DNA, 19 bp, Homo sapiens
gcgtggcctccccatgggc

SEQ ID NO: 680651 - DNA, 23 bp, Homo sapiens
gcgtggctctaaaaggtaatgtg

SEQ ID NO: 680652 - DNA, 17 bp, Homo sapiens
gcgtgtgcctgtgtgcg

SEQ ID NO: 680653 - DNA, 12 bp, Homo sapiens
gctaaataaatg

SEQ ID NO: 680654 - DNA, 20 bp, Homo sapiens
gcataatgataaaataaata

SEQ ID NO: 680655 - DNA, 14 bp, Homo sapiens
gcataccacttgaa

SEQ ID NO: 680656 - DNA, 18 bp, Homo sapiens
gcatactttgtattttga

SEQ ID NO: 680657 - DNA, 19 bp, Homo sapiens
gcatagataatattgtttg

SEQ ID NO: 680658 - DNA, 13 bp, Homo sapiens
gcataggaagaaa

SEQ ID NO: 680659 - DNA, 15 bp, Homo sapiens
gcataggaagaaaat

SEQ ID NO: 680660 - DNA, 15 bp, Homo sapiens
gcatatagactgtac

SEQ ID NO: 680661 - DNA, 17 bp, Homo sapiens
gcatatagttaaactga

SEQ ID NO: 680662 - DNA, 18 bp, Homo sapiens
gcatatagttaaactgag

SEQ ID NO: 680663 - DNA, 23 bp, Homo sapiens
gcatatgggtgggattttgcaaa

SEQ ID NO: 680664 - DNA, 18 bp, Homo sapiens
gcatattgttggcacaga

SEQ ID NO: 680665 - DNA, 21 bp, Homo sapiens
gcatatttatccaaaatgtgt

SEQ ID NO: 680666 - DNA, 15 bp, Homo sapiens
gcatattttgagaaa

SEQ ID NO: 680667 - DNA, 23 bp, Homo sapiens
gcatcaagaggtgggagggccct

SEQ ID NO: 680668 - DNA, 21 bp, Homo sapiens
gcatcctcctctctggccttg

SEQ ID NO: 680669 - DNA, 17 bp, Homo sapiens
gcatctccctcactgaa

SEQ ID NO: 680670 - DNA, 20 bp, Homo sapiens
gcatctccctcactgaaacc

SEQ ID NO: 680671 - DNA, 16 bp, Homo sapiens
gcatcttgcctccagg

SEQ ID NO: 680672 - DNA, 15 bp, Homo sapiens
gcatgaaatgtgaat

SEQ ID NO: 680673 - DNA, 22 bp, Homo sapiens
gcatgaaatgtgaatttttatt

SEQ ID NO: 680674 - DNA, 18 bp, Homo sapiens
gcatgcaaatgagctctg

SEQ ID NO: 680675 - DNA, 15 bp, Homo sapiens
gcatgcaatttgaag

SEQ ID NO: 680676 - DNA, 17 bp, Homo sapiens
gcatgcagctttgcaaa

SEQ ID NO: 680677 - DNA, 16 bp, Homo sapiens
gcatgcctgtcctttc

SEQ ID NO: 680678 - DNA, 14 bp, Homo sapiens
gcatggccctgggc

SEQ ID NO: 680679 - DNA, 16 bp, Homo sapiens
gcatggtggccagagg

SEQ ID NO: 680680 - DNA, 20 bp, Homo sapiens
gcatgtgtatttccagtgca

SEQ ID NO: 680681 - DNA, 21 bp, Homo sapiens
gcatgtgtatttccagtgcaa

SEQ ID NO: 680682 - DNA, 12 bp, Homo sapiens
gcattaatgttt

SEQ ID NO: 680683 - DNA, 20 bp, Homo sapiens
gcattccaggtaacaggtgt

SEQ ID NO: 680684 - DNA, 23 bp, Homo sapiens
gcattgaagtatggtgtgttcac

SEQ ID NO: 680685 - DNA, 21 bp, Homo sapiens
gcattgacataggtcataaag

SEQ ID NO: 680686 - DNA, 22 bp, Homo sapiens
gcattgacataggtcataaagc

SEQ ID NO: 680687 - DNA, 10 bp, Homo sapiens
gcattgagta

SEQ ID NO: 680688 - DNA, 15 bp, Homo sapiens
gcattgagtattgtt

SEQ ID NO: 680689 - DNA, 13 bp, Homo sapiens
gcattgataatct

SEQ ID NO: 680690 - DNA, 17 bp, Homo sapiens
gcattgtttgtgatatt

SEQ ID NO: 680691 - DNA, 16 bp, Homo sapiens
gcatttagctggccac

SEQ ID NO: 680692 - DNA, 21 bp, Homo sapiens
gcatttctatgcaggcagcac

SEQ ID NO: 680693 - DNA, 20 bp, Homo sapiens
gcatttgtggtaatctacac

SEQ ID NO: 680694 - DNA, 21 bp, Homo sapiens
gcatttgtggtaatctacacc

SEQ ID NO: 680695 - DNA, 21 bp, Homo sapiens
gcatttttgtgaaatgaaaac

SEQ ID NO: 680696 - DNA, 17 bp, Homo sapiens
gccaaaatataatcaga

SEQ ID NO: 680697 - DNA, 13 bp, Homo sapiens
gccaacagttgta

SEQ ID NO: 680698 - DNA, 16 bp, Homo sapiens
gccaactgacaaagat

SEQ ID NO: 680699 - DNA, 22 bp, Homo sapiens
gccaactgacaaagatgcatca

SEQ ID NO: 680700 - DNA, 12 bp, Homo sapiens
gccaagaatgta

SEQ ID NO: 680701 - DNA, 19 bp, Homo sapiens
cccgtttctccttttccta

SEQ ID NO: 680702 - DNA, 20 bp, Homo sapiens
ccctaaaagcactcctgctt

SEQ ID NO: 680703 - DNA, 20 bp, Homo sapiens
ccctagcagcccaccctgct

SEQ ID NO: 680704 - DNA, 11 bp, Homo sapiens
aaaaaaagaaa

SEQ ID NO: 680705 - DNA, 13 bp, Homo sapiens
aaaaaaagaaact

SEQ ID NO: 680706 - DNA, 11 bp, Homo sapiens
aaaaaaaggaa

SEQ ID NO: 680707 - DNA, 13 bp, Homo sapiens
aaaaaagttttta

SEQ ID NO: 680708 - DNA, 10 bp, Homo sapiens
aaaaaataca

SEQ ID NO: 680709 - DNA, 13 bp, Homo sapiens
aaaaactcttcag

SEQ ID NO: 680710 - DNA, 14 bp, Homo sapiens
aaaaacttttgagg

SEQ ID NO: 680711 - DNA, 13 bp, Homo sapiens
ggcagattgaaaa

SEQ ID NO: 680712 - DNA, 18 bp, Homo sapiens
ggcagcatggagagaggc

SEQ ID NO: 680713 - DNA, 12 bp, Homo sapiens
ggcagcgcaggg

SEQ ID NO: 680714 - DNA, 13 bp, Homo sapiens
ggcagcgcagggc

SEQ ID NO: 680715 - DNA, 19 bp, Homo sapiens
ggcagcgcagggctggcac

SEQ ID NO: 680716 - DNA, 20 bp, Homo sapiens
ggcagcgcagggctggcacg

SEQ ID NO: 680717 - DNA, 18 bp, Homo sapiens
ggcagcgccaagtgcgtg

SEQ ID NO: 680718 - DNA, 22 bp, Homo sapiens
ggcagcgccaagtgcgtgccgt

SEQ ID NO: 680719 - DNA, 17 bp, Homo sapiens
ggcagctgcctctgctc

SEQ ID NO: 680720 - DNA, 19 bp, Homo sapiens
ggcagctgcctctgctccc

SEQ ID NO: 680721 - DNA, 20 bp, Homo sapiens
ggcagctgcctctgctccct

SEQ ID NO: 680722 - DNA, 19 bp, Homo sapiens
ggcagcttctactcctgcc

SEQ ID NO: 680723 - DNA, 17 bp, Homo sapiens
ggcaggactcctggcag

SEQ ID NO: 680724 - DNA, 20 bp, Homo sapiens
ggcaggcatggccctgggcg

SEQ ID NO: 680725 - DNA, 13 bp, Homo sapiens
ggcaggcattgag

SEQ ID NO: 680726 - DNA, 15 bp, Homo sapiens
ggcaggcggctcctc

SEQ ID NO: 680727 - DNA, 10 bp, Homo sapiens
ggcaggctgg

SEQ ID NO: 680728 - DNA, 13 bp, Homo sapiens
ggcaggctgggcc

SEQ ID NO: 680729 - DNA, 22 bp, Homo sapiens
ggcagggccacctgcaggaccc

SEQ ID NO: 680730 - DNA, 21 bp, Homo sapiens
ggcaggtgccatgtctgggaa

SEQ ID NO: 680731 - DNA, 21 bp, Homo sapiens
ggcagtagaactccaggccct

SEQ ID NO: 680732 - DNA, 18 bp, Homo sapiens
ggcagtccttactccccc

SEQ ID NO: 680733 - DNA, 16 bp, Homo sapiens
ggcattaatgtttcta

SEQ ID NO: 680734 - DNA, 17 bp, Homo sapiens
ggcattaatgtttctat

SEQ ID NO: 680735 - DNA, 15 bp, Homo sapiens
ggcattgacataggt

SEQ ID NO: 680736 - DNA, 11 bp, Homo sapiens
ggcattgagta

SEQ ID NO: 680737 - DNA, 12 bp, Homo sapiens
ggcatttctatt

SEQ ID NO: 680738 - DNA, 23 bp, Homo sapiens
ggccacagactgacccccatctg

SEQ ID NO: 680739 - DNA, 11 bp, Homo sapiens
ggccaggcctt

SEQ ID NO: 680740 - DNA, 18 bp, Homo sapiens
ggccaggctgcctggcct

SEQ ID NO: 680741 - DNA, 19 bp, Homo sapiens
ggccagggctgccctgaga

SEQ ID NO: 680742 - DNA, 18 bp, Homo sapiens
ggccagtggggcctgtgg

SEQ ID NO: 680743 - DNA, 16 bp, Homo sapiens
ggccatgtccaaagag

SEQ ID NO: 680744 - DNA, 22 bp, Homo sapiens
ggcccagcaatctccatgtgta

SEQ ID NO: 680745 - DNA, 19 bp, Homo sapiens
ggccccacctcggcacaca

SEQ ID NO: 680746 - DNA, 16 bp, Homo sapiens
ggcccccaacctcagg

SEQ ID NO: 680747 - DNA, 23 bp, Homo sapiens
ggcccccaacctcagggctccca

SEQ ID NO: 680748 - DNA, 14 bp, Homo sapiens
ggcccccaataaag

SEQ ID NO: 680749 - DNA, 20 bp, Homo sapiens
ggcccctaggctgctgctgt

SEQ ID NO: 680750 - DNA, 21 bp, Homo sapiens
ggccctcatctatgaggaaag

SEQ ID NO: 680751 - DNA, 22 bp, Homo sapiens
ggccctccgaccacttccaggg

SEQ ID NO: 680752 - DNA, 20 bp, Homo sapiens
ggccctcctgtgctggggga

SEQ ID NO: 680753 - DNA, 19 bp, Homo sapiens
ggccctgagtctgggcagc

SEQ ID NO: 680754 - DNA, 11 bp, Homo sapiens
ggccctggggg

SEQ ID NO: 680755 - DNA, 14 bp, Homo sapiens
ggccctgtgtgcag

SEQ ID NO: 680756 - DNA, 15 bp, Homo sapiens
ggccctgtgtgcagg

SEQ ID NO: 680757 - DNA, 12 bp, Homo sapiens
ggccgaggcggg

SEQ ID NO: 680758 - DNA, 14 bp, Homo sapiens
ggccgaggcgggtg

SEQ ID NO: 680759 - DNA, 15 bp, Homo sapiens
ggccggccctgtgtg

SEQ ID NO: 680760 - DNA, 16 bp, Homo sapiens
ggccgtggcacagctg

SEQ ID NO: 680761 - DNA, 21 bp, Homo sapiens
ggcctagcgatctctcctggc

SEQ ID NO: 680762 - DNA, 19 bp, Homo sapiens
ggcctcagctcaatgcagt

SEQ ID NO: 680763 - DNA, 18 bp, Homo sapiens
ggcctgagaggggaagcg

SEQ ID NO: 680764 - DNA, 19 bp, Homo sapiens
ggcctgcagcaggagtggt

SEQ ID NO: 680765 - DNA, 16 bp, Homo sapiens
ggcctgccccctgggc

SEQ ID NO: 680766 - DNA, 23 bp, Homo sapiens
ggcctgcgaccctgggggcacag

SEQ ID NO: 680767 - DNA, 15 bp, Homo sapiens
ggcctggggcctgag

SEQ ID NO: 680768 - DNA, 18 bp, Homo sapiens
ggcctggggcctgagaga

SEQ ID NO: 680769 - DNA, 18 bp, Homo sapiens
ggcctggggtgcatctcc

SEQ ID NO: 680770 - DNA, 18 bp, Homo sapiens
ggcctgtccaacacatct

SEQ ID NO: 680771 - DNA, 12 bp, Homo sapiens
ggcctgtcccaa

SEQ ID NO: 680772 - DNA, 19 bp, Homo sapiens
ggcctgtcccttgcctctg

SEQ ID NO: 680773 - DNA, 21 bp, Homo sapiens
ggcctgtgccagcaccacagc

SEQ ID NO: 680774 - DNA, 23 bp, Homo sapiens
ggcctgtgccagcaccacagccg

SEQ ID NO: 680775 - DNA, 19 bp, Homo sapiens
ggcctgtggaatgagtgtg

SEQ ID NO: 680776 - DNA, 19 bp, Homo sapiens
ggccttacatctggctgga

SEQ ID NO: 680777 - DNA, 16 bp, Homo sapiens
ggccttagtgggccag

SEQ ID NO: 680778 - DNA, 19 bp, Homo sapiens
ggccttgtcctcagccagt

SEQ ID NO: 680779 - DNA, 22 bp, Homo sapiens
ggcggatcatgaggtcaggagt

SEQ ID NO: 680780 - DNA, 13 bp, Homo sapiens
ggcggctcctcct

SEQ ID NO: 680781 - DNA, 15 bp, Homo sapiens
ggcggctgcacaaca

SEQ ID NO: 680782 - DNA, 21 bp, Homo sapiens
ggcggctgcacaacagccctg

SEQ ID NO: 680783 - DNA, 14 bp, Homo sapiens
ggcgtccagctcag

SEQ ID NO: 680784 - DNA, 18 bp, Homo sapiens
ggcgtgaggcctgggctg

SEQ ID NO: 680785 - DNA, 17 bp, Homo sapiens
ggcgtggagggaggccc

SEQ ID NO: 680786 - DNA, 18 bp, Homo sapiens
ggcgtggagggaggcccc

SEQ ID NO: 680787 - DNA, 14 bp, Homo sapiens
ggctaaggcaggag

SEQ ID NO: 680788 - DNA, 14 bp, Homo sapiens
ggctacagtgagcc

SEQ ID NO: 680789 - DNA, 22 bp, Homo sapiens
ggctagacagaaacatgtcttg

SEQ ID NO: 680790 - DNA, 23 bp, Homo sapiens
ggctaggtatcattcaactctcc

SEQ ID NO: 680791 - DNA, 23 bp, Homo sapiens
ggctcacagtacagcatgtgcct

SEQ ID NO: 680792 - DNA, 13 bp, Homo sapiens
ggctcacgcctgt

SEQ ID NO: 680793 - DNA, 23 bp, Homo sapiens
ggctcacgcctgtaatcccagca

SEQ ID NO: 680794 - DNA, 15 bp, Homo sapiens
ggctcatgcacccct

SEQ ID NO: 680795 - DNA, 19 bp, Homo sapiens
ggctcccgggggccccacc

SEQ ID NO: 680796 - DNA, 15 bp, Homo sapiens
ggctccctcctccag

SEQ ID NO: 680797 - DNA, 16 bp, Homo sapiens
ggctccctcctccagg

SEQ ID NO: 680798 - DNA, 20 bp, Homo sapiens
ggctccctcctccaggcctg

SEQ ID NO: 680799 - DNA, 14 bp, Homo sapiens
ggctccggcctctg

SEQ ID NO: 680800 - DNA, 15 bp, Homo sapiens
ggctccggcctctgc

SEQ ID NO: 680801 - DNA, 17 bp, Homo sapiens
ggctccggcctctgcct

SEQ ID NO: 680802 - DNA, 17 bp, Homo sapiens
ggctcgtcagccacctg

SEQ ID NO: 680803 - DNA, 23 bp, Homo sapiens
ggctctattccaataaactatga

SEQ ID NO: 680804 - DNA, 16 bp, Homo sapiens
ggctctgcacccctct

SEQ ID NO: 680805 - DNA, 20 bp, Homo sapiens
ggctgaaatatccacccagc

SEQ ID NO: 680806 - DNA, 17 bp, Homo sapiens
ggctgactctccaggga

SEQ ID NO: 680807 - DNA, 13 bp, Homo sapiens
ggctgcacaacag

SEQ ID NO: 680808 - DNA, 16 bp, Homo sapiens
ggctgcacaacagccc

SEQ ID NO: 680809 - DNA, 13 bp, Homo sapiens
ggctgcacaggct

SEQ ID NO: 680810 - DNA, 18 bp, Homo sapiens
ggctgccctgagaagctg

SEQ ID NO: 680811 - DNA, 24 bp, Homo sapiens
ggctgccctgagaagctgctccag

SEQ ID NO: 680812 - DNA, 18 bp, Homo sapiens
ggctgccttctttccatc

SEQ ID NO: 680813 - DNA, 20 bp, Homo sapiens
ggctggacttctacctgccc

SEQ ID NO: 680814 - DNA, 11 bp, Homo sapiens
ggctgggccat

SEQ ID NO: 680815 - DNA, 17 bp, Homo sapiens
ggctgggccatgtccaa

SEQ ID NO: 680816 - DNA, 21 bp, Homo sapiens
ggctgggccatgtccaaagag

SEQ ID NO: 680817 - DNA, 20 bp, Homo sapiens
ggctggtacaacggaggcct

SEQ ID NO: 680818 - DNA, 17 bp, Homo sapiens
ggctgtttcaaaaaaat

SEQ ID NO: 680819 - DNA, 15 bp, Homo sapiens
ggcttatgaaagagg

SEQ ID NO: 680820 - DNA, 17 bp, Homo sapiens
ggcttgtttacctttct

SEQ ID NO: 680821 - DNA, 12 bp, Homo sapiens
ggctttgcctct

SEQ ID NO: 680822 - DNA, 19 bp, Homo sapiens
ggctttgcctcttctttgt

SEQ ID NO: 680823 - DNA, 20 bp, Homo sapiens
gggaaaaaacttaaaaatta

SEQ ID NO: 680824 - DNA, 14 bp, Homo sapiens
gggaacaaggaagg

SEQ ID NO: 680825 - DNA, 14 bp, Homo sapiens
gggaagagtagctg

SEQ ID NO: 680826 - DNA, 16 bp, Homo sapiens
gggaagctggcctgag

SEQ ID NO: 680827 - DNA, 13 bp, Homo sapiens
gggaaggcctgac

SEQ ID NO: 680828 - DNA, 15 bp, Homo sapiens
gggaaggcctgactt

SEQ ID NO: 680829 - DNA, 14 bp, Homo sapiens
gggaatgagcccag

SEQ ID NO: 680830 - DNA, 18 bp, Homo sapiens
gggaatgagcccagagaa

SEQ ID NO: 680831 - DNA, 22 bp, Homo sapiens
gggaatgagcccagagaacagc

SEQ ID NO: 680832 - DNA, 12 bp, Homo sapiens
gggacccagtgc

SEQ ID NO: 680833 - DNA, 12 bp, Homo sapiens
gggacttttatt

SEQ ID NO: 680834 - DNA, 11 bp, Homo sapiens
gggagccagcc

SEQ ID NO: 680835 - DNA, 18 bp, Homo sapiens
gggaggcaagtgtggggg

SEQ ID NO: 680836 - DNA, 14 bp, Homo sapiens
gggaggccccaggg

SEQ ID NO: 680837 - DNA, 11 bp, Homo sapiens
gggaggggagg

SEQ ID NO: 680838 - DNA, 15 bp, Homo sapiens
gggagtgctggctca

SEQ ID NO: 680839 - DNA, 21 bp, Homo sapiens
gggagtggttaggcagcaagc

SEQ ID NO: 680840 - DNA, 22 bp, Homo sapiens
gggatatggcaggactcctggc

SEQ ID NO: 680841 - DNA, 20 bp, Homo sapiens
gggatgccactcctccctcc

SEQ ID NO: 680842 - DNA, 17 bp, Homo sapiens
gggatgttctgcctctc

SEQ ID NO: 680843 - DNA, 13 bp, Homo sapiens
gggcacaggaggc

SEQ ID NO: 680844 - DNA, 13 bp, Homo sapiens
gggcactggccca

SEQ ID NO: 680845 - DNA, 15 bp, Homo sapiens
gggcagctgtccctt

SEQ ID NO: 680846 - DNA, 13 bp, Homo sapiens
gggcaggctgggc

SEQ ID NO: 680847 - DNA, 11 bp, Homo sapiens
gggcagggagc

SEQ ID NO: 680848 - DNA, 19 bp, Homo sapiens
gggcagggagctgggcccg

SEQ ID NO: 680849 - DNA, 17 bp, Homo sapiens
gggccacctgcaggacc

SEQ ID NO: 680850 - DNA, 15 bp, Homo sapiens
gggccagtggggcct

SEQ ID NO: 680851 - DNA, 16 bp, Homo sapiens
gggccagtggggcctg

SEQ ID NO: 680852 - DNA, 17 bp, Homo sapiens
gggccagtggggcctgt

SEQ ID NO: 680853 - DNA, 18 bp, Homo sapiens
gggccagtggggcctgtg

SEQ ID NO: 680854 - DNA, 22 bp, Homo sapiens
gggccatgtccaaagaggctgc

SEQ ID NO: 680855 - DNA, 11 bp, Homo sapiens
gggcccctggc

SEQ ID NO: 680856 - DNA, 15 bp, Homo sapiens
gggcccctggcactc

SEQ ID NO: 680857 - DNA, 21 bp, Homo sapiens
gggccctccgaccacttccag

SEQ ID NO: 680858 - DNA, 16 bp, Homo sapiens
gggccgtggcacagct

SEQ ID NO: 680859 - DNA, 20 bp, Homo sapiens
gggcctagcgatctctcctg

SEQ ID NO: 680860 - DNA, 23 bp, Homo sapiens
gggcctagcgatctctcctggcc

SEQ ID NO: 680861 - DNA, 13 bp, Homo sapiens
gggcctcattgtg

SEQ ID NO: 680862 - DNA, 18 bp, Homo sapiens
gggcctggggcctgagag

SEQ ID NO: 680863 - DNA, 19 bp, Homo sapiens
gggcctggggcctgagaga

SEQ ID NO: 680864 - DNA, 18 bp, Homo sapiens
gggccttagtgggccagg

SEQ ID NO: 680865 - DNA, 22 bp, Homo sapiens
gggccttagtgggccagggctg

SEQ ID NO: 680866 - DNA, 20 bp, Homo sapiens
gggcctttgttctgggggga

SEQ ID NO: 680867 - DNA, 16 bp, Homo sapiens
gggcgcggtggctcac

SEQ ID NO: 680868 - DNA, 21 bp, Homo sapiens
gggcgtccagctcagccctgg

SEQ ID NO: 680869 - DNA, 21 bp, Homo sapiens
gggcgtggagggaggccccag

SEQ ID NO: 680870 - DNA, 15 bp, Homo sapiens
gggctcatgcctgta

SEQ ID NO: 680871 - DNA, 13 bp, Homo sapiens
gggctcccagggg

SEQ ID NO: 680872 - DNA, 15 bp, Homo sapiens
gggctgcaggcaggc

SEQ ID NO: 680873 - DNA, 21 bp, Homo sapiens
gggctgcaggcaggcggctcc

SEQ ID NO: 680874 - DNA, 16 bp, Homo sapiens
gggctgccctgagaag

SEQ ID NO: 680875 - DNA, 17 bp, Homo sapiens
gggctggagcctggggt

SEQ ID NO: 680876 - DNA, 20 bp, Homo sapiens
gggcttaatggagttcttgt

SEQ ID NO: 680877 - DNA, 21 bp, Homo sapiens
gggcttatatgtacttttatt

SEQ ID NO: 680878 - DNA, 13 bp, Homo sapiens
ggggacaggcccg

SEQ ID NO: 680879 - DNA, 21 bp, Homo sapiens
ggggacttctggggacagaca

SEQ ID NO: 680880 - DNA, 23 bp, Homo sapiens
ggggagaggtgattctcagggct

SEQ ID NO: 680881 - DNA, 18 bp, Homo sapiens
ggggagtggttaggcagc

SEQ ID NO: 680882 - DNA, 14 bp, Homo sapiens
ggggatgttctgcc

SEQ ID NO: 680883 - DNA, 23 bp, Homo sapiens
ggggattgcccctggctttgcct

SEQ ID NO: 680884 - DNA, 20 bp, Homo sapiens
ggggattttttactgccctt

SEQ ID NO: 680885 - DNA, 19 bp, Homo sapiens
ggggcagggagctgggccc

SEQ ID NO: 680886 - DNA, 14 bp, Homo sapiens
ggggcccagtgcat

SEQ ID NO: 680887 - DNA, 23 bp, Homo sapiens
ggggccccacctcggcacacact

SEQ ID NO: 680888 - DNA, 21 bp, Homo sapiens
ggggccgggcgcggtggctca

SEQ ID NO: 680889 - DNA, 15 bp, Homo sapiens
ggggcctgagagaat

SEQ ID NO: 680890 - DNA, 12 bp, Homo sapiens
ggggcctgtgga

SEQ ID NO: 680891 - DNA, 14 bp, Homo sapiens
ggggctgcaggcag

SEQ ID NO: 680892 - DNA, 22 bp, Homo sapiens
ggggctgcaggcaggcggctcc

SEQ ID NO: 680893 - DNA, 12 bp, Homo sapiens
gggggaatgagc

SEQ ID NO: 680894 - DNA, 16 bp, Homo sapiens
gggggaatgagcccag

SEQ ID NO: 680895 - DNA, 12 bp, Homo sapiens
gggggccccacc

SEQ ID NO: 680896 - DNA, 18 bp, Homo sapiens
gggggcctcattgtgtct

SEQ ID NO: 680897 - DNA, 16 bp, Homo sapiens
ggggtcccatcagtga

SEQ ID NO: 680898 - DNA, 22 bp, Homo sapiens
ggggtccctagcagcccaccct

SEQ ID NO: 680899 - DNA, 14 bp, Homo sapiens
ggggtctccctggc

SEQ ID NO: 680900 - DNA, 19 bp, Homo sapiens
gggtccaggagagcctggg

SEQ ID NO: 680901 - DNA, 19 bp, Homo sapiens
gggtccagtggatgccaca

SEQ ID NO: 680902 - DNA, 14 bp, Homo sapiens
gggtctccctggct

SEQ ID NO: 680903 - DNA, 17 bp, Homo sapiens
gggtctccctggctccc

SEQ ID NO: 680904 - DNA, 14 bp, Homo sapiens
gggtctctccctca

SEQ ID NO: 680905 - DNA, 20 bp, Homo sapiens
gggtctggggacaggcccgc

SEQ ID NO: 680906 - DNA, 18 bp, Homo sapiens
gggtgacggccctcatct

SEQ ID NO: 680907 - DNA, 18 bp, Homo sapiens
gggtgctcagaataaggc

SEQ ID NO: 680908 - DNA, 21 bp, Homo sapiens
gggtgctcagaataaggcagg

SEQ ID NO: 680909 - DNA, 13 bp, Homo sapiens
gggtgggcctcgg

SEQ ID NO: 680910 - DNA, 13 bp, Homo sapiens
gggtgtagccagg

SEQ ID NO: 680911 - DNA, 18 bp, Homo sapiens
gggtgttgtatggggagg

SEQ ID NO: 680912 - DNA, 15 bp, Homo sapiens
gggttgcgtctgagg

SEQ ID NO: 680913 - DNA, 23 bp, Homo sapiens
gggttgcgtctgaggcctgcccc

SEQ ID NO: 680914 - DNA, 15 bp, Homo sapiens
gggttggggtgacag

SEQ ID NO: 680915 - DNA, 17 bp, Homo sapiens
ggtaaaagcagggcagc

SEQ ID NO: 680916 - DNA, 16 bp, Homo sapiens
ggtaagcaacatggct

SEQ ID NO: 680917 - DNA, 13 bp, Homo sapiens
ggtaatctacacc

SEQ ID NO: 680918 - DNA, 18 bp, Homo sapiens
ggtaatctacaccaatga

SEQ ID NO: 680919 - DNA, 15 bp, Homo sapiens
ggtacaactgtattt

SEQ ID NO: 680920 - DNA, 13 bp, Homo sapiens
ggtaccctgggtg

SEQ ID NO: 680921 - DNA, 13 bp, Homo sapiens
ggtatatatacat

SEQ ID NO: 680922 - DNA, 19 bp, Homo sapiens
ggtatcattcaactctcca

SEQ ID NO: 680923 - DNA, 21 bp, Homo sapiens
ggtcaagggcttactatttct

SEQ ID NO: 680924 - DNA, 13 bp, Homo sapiens
ggtcacaacttga

SEQ ID NO: 680925 - DNA, 16 bp, Homo sapiens
ggtcaccaagcagtgg

SEQ ID NO: 680926 - DNA, 20 bp, Homo sapiens
ggtcagggagtgctggctca

SEQ ID NO: 680927 - DNA, 23 bp, Homo sapiens
ggtcagggagtgctggctcacag

SEQ ID NO: 680928 - DNA, 13 bp, Homo sapiens
ggtcataaaatag

SEQ ID NO: 680929 - DNA, 22 bp, Homo sapiens
ggtccagcctcgttggaagagg

SEQ ID NO: 680930 - DNA, 17 bp, Homo sapiens
ggtccaggagagcctgg

SEQ ID NO: 680931 - DNA, 18 bp, Homo sapiens
ggtccaggagagcctggg

SEQ ID NO: 680932 - DNA, 14 bp, Homo sapiens
ggtccatcctggtc

SEQ ID NO: 680933 - DNA, 12 bp, Homo sapiens
ggtccccactgc

SEQ ID NO: 680934 - DNA, 18 bp, Homo sapiens
ggtcctgaagaattaaga

SEQ ID NO: 680935 - DNA, 23 bp, Homo sapiens
ggtctcaaactcctgacctcagg

SEQ ID NO: 680936 - DNA, 13 bp, Homo sapiens
ggtctcacccatg

SEQ ID NO: 680937 - DNA, 22 bp, Homo sapiens
ggtctcaggatatccttatcag

SEQ ID NO: 680938 - DNA, 11 bp, Homo sapiens
ggtctccctgg

SEQ ID NO: 680939 - DNA, 14 bp, Homo sapiens
ggtctccctggctc

SEQ ID NO: 680940 - DNA, 12 bp, Homo sapiens
ggtctccttcct

SEQ ID NO: 680941 - DNA, 19 bp, Homo sapiens
ggtctgagtgcaagttcat

SEQ ID NO: 680942 - DNA, 23 bp, Homo sapiens
gtgctgggggaatgagcccagag

SEQ ID NO: 680943 - DNA, 20 bp, Homo sapiens
gtgcttgttttataaaattt

SEQ ID NO: 680944 - DNA, 14 bp, Homo sapiens
gtggaaggcctccc

SEQ ID NO: 680945 - DNA, 21 bp, Homo sapiens
gtggatgccacagcccagctt

SEQ ID NO: 680946 - DNA, 19 bp, Homo sapiens
gtggattttttattattat

SEQ ID NO: 680947 - DNA, 16 bp, Homo sapiens
gtggcacacactgacc

SEQ ID NO: 680948 - DNA, 14 bp, Homo sapiens
gtggcacagctggg

SEQ ID NO: 680949 - DNA, 15 bp, Homo sapiens
gtggcacagctggga

SEQ ID NO: 680950 - DNA, 17 bp, Homo sapiens
gttctgcctctccctgg

SEQ ID NO: 680951 - DNA, 16 bp, Homo sapiens
gttctggggggaccca

SEQ ID NO: 680952 - DNA, 21 bp, Homo sapiens
gttctggggggacccagtgca

SEQ ID NO: 680953 - DNA, 14 bp, Homo sapiens
gttctgtggttcct

SEQ ID NO: 680954 - DNA, 18 bp, Homo sapiens
gttctgtgtaaacagaag

SEQ ID NO: 680955 - DNA, 18 bp, Homo sapiens
gttcttgaaaataagatt

SEQ ID NO: 680956 - DNA, 16 bp, Homo sapiens
gttgaagtttgaacca

SEQ ID NO: 680957 - DNA, 19 bp, Homo sapiens
gttgacacagttgtagggt

SEQ ID NO: 680958 - DNA, 15 bp, Homo sapiens
gttgagtctgtacta

SEQ ID NO: 680959 - DNA, 15 bp, Homo sapiens
gttgcatatagttaa

SEQ ID NO: 680960 - DNA, 22 bp, Homo sapiens
gttgcatatagttaaactgaga

SEQ ID NO: 680961 - DNA, 13 bp, Homo sapiens
gttgccctggcat

SEQ ID NO: 680962 - DNA, 18 bp, Homo sapiens
gttgcgtctgaggcctgc

SEQ ID NO: 680963 - DNA, 13 bp, Homo sapiens
gttgcttgtcttc

SEQ ID NO: 680964 - DNA, 15 bp, Homo sapiens
gttggaagaggaaca

SEQ ID NO: 680965 - DNA, 17 bp, Homo sapiens
taaaatggacacaaatt

SEQ ID NO: 680966 - DNA, 13 bp, Homo sapiens
taaaatggtcatg

SEQ ID NO: 680967 - DNA, 10 bp, Homo sapiens
taaaatgtaa

SEQ ID NO: 680968 - DNA, 15 bp, Homo sapiens
taaaatgtaatttaa

SEQ ID NO: 680969 - DNA, 17 bp, Homo sapiens
taaaatgtaatttaaat

SEQ ID NO: 680970 - DNA, 13 bp, Homo sapiens
taaaatgtcttgg

SEQ ID NO: 680971 - DNA, 15 bp, Homo sapiens
taaaattaagatttc

SEQ ID NO: 680972 - DNA, 18 bp, Homo sapiens
taaaattatatagctgct

SEQ ID NO: 680973 - DNA, 14 bp, Homo sapiens
taaaattcatttct

SEQ ID NO: 680974 - DNA, 12 bp, Homo sapiens
taaaattgatat

SEQ ID NO: 680975 - DNA, 21 bp, Homo sapiens
taaaattttgcttttaattaa

SEQ ID NO: 680976 - DNA, 19 bp, Homo sapiens
taaaattttggattaattt

SEQ ID NO: 680977 - DNA, 23 bp, Homo sapiens
taaaattttgtatgttaaagaga

SEQ ID NO: 680978 - DNA, 15 bp, Homo sapiens
taaacacaggctgtc

SEQ ID NO: 680979 - DNA, 19 bp, Homo sapiens
taaacacaggctgtcctta

SEQ ID NO: 680980 - DNA, 20 bp, Homo sapiens
taaacactacacatttgaaa

SEQ ID NO: 680981 - DNA, 14 bp, Homo sapiens
taaacagaaatgga

SEQ ID NO: 680982 - DNA, 19 bp, Homo sapiens
taaacagaagcctgtttca

SEQ ID NO: 680983 - DNA, 17 bp, Homo sapiens
taaacagtaagatatct

SEQ ID NO: 680984 - DNA, 14 bp, Homo sapiens
taaacataaaaact

SEQ ID NO: 680985 - DNA, 15 bp, Homo sapiens
taaacattttacatg

SEQ ID NO: 680986 - DNA, 18 bp, Homo sapiens
taaacctgggctcagcct

SEQ ID NO: 680987 - DNA, 16 bp, Homo sapiens
taaacggtttttatta

SEQ ID NO: 680988 - DNA, 20 bp, Homo sapiens
taaactatgttcctaacaaa

SEQ ID NO: 680989 - DNA, 20 bp, Homo sapiens
gtagagtgtagactgtggct

SEQ ID NO: 680990 - DNA, 18 bp, Homo sapiens
gtagatatgtattctttt

SEQ ID NO: 680991 - DNA, 19 bp, Homo sapiens
taaactgagagtaattcat

SEQ ID NO: 680992 - DNA, 15 bp, Homo sapiens
taaacttgtacatgg

SEQ ID NO: 680993 - DNA, 23 bp, Homo sapiens
taaagaagagtgacttattttgt

SEQ ID NO: 680994 - DNA, 18 bp, Homo sapiens
taaagaattaatgactta

SEQ ID NO: 680995 - DNA, 21 bp, Homo sapiens
taaagaccaataaacttcctt

SEQ ID NO: 680996 - DNA, 19 bp, Homo sapiens
taaagaccctcctattcta

SEQ ID NO: 680997 - DNA, 23 bp, Homo sapiens
taaagaccctcctattctataaa

SEQ ID NO: 680998 - DNA, 13 bp, Homo sapiens
taaagagaatgag

SEQ ID NO: 680999 - DNA, 16 bp, Homo sapiens
taaagcatgaaatgtg

SEQ ID NO: 681000 - DNA, 17 bp, Homo sapiens
taaagcatgaaatgtga

SEQ ID NO: 681001 - DNA, 21 bp, Homo sapiens
taaagcatgaaatgtgaattt

SEQ ID NO: 681002 - DNA, 11 bp, Homo sapiens
taaagcctcaa

SEQ ID NO: 681003 - DNA, 17 bp, Homo sapiens
taaagcttaaattttat

SEQ ID NO: 681004 - DNA, 12 bp, Homo sapiens
taaagctttata

SEQ ID NO: 681005 - DNA, 15 bp, Homo sapiens
taaaggcagctgcct

SEQ ID NO: 681006 - DNA, 19 bp, Homo sapiens
taaaggcagctgcctctgc

SEQ ID NO: 681007 - DNA, 21 bp, Homo sapiens
taaaggcagctgcctctgctc

SEQ ID NO: 681008 - DNA, 18 bp, Homo sapiens
taaagggtttgagatgta

SEQ ID NO: 681009 - DNA, 21 bp, Homo sapiens
taaagggtttgagatgtacat

SEQ ID NO: 681010 - DNA, 14 bp, Homo sapiens
taaagttacagttt

SEQ ID NO: 681011 - DNA, 14 bp, Homo sapiens
taaataaaaactaa

SEQ ID NO: 681012 - DNA, 15 bp, Homo sapiens
taaataaaaatatgt

SEQ ID NO: 681013 - DNA, 17 bp, Homo sapiens
taaataaaaatatgtaa

SEQ ID NO: 681014 - DNA, 19 bp, Homo sapiens
taaataaaaatatgtaatt

SEQ ID NO: 681015 - DNA, 13 bp, Homo sapiens
taaataactgtgt

SEQ ID NO: 681016 - DNA, 17 bp, Homo sapiens
taaataatgcttcagat

SEQ ID NO: 681017 - DNA, 23 bp, Homo sapiens
taaataggaatcattcagaaatg

SEQ ID NO: 681018 - DNA, 21 bp, Homo sapiens
taaatagtgtcatataaactc

SEQ ID NO: 681019 - DNA, 20 bp, Homo sapiens
taaatataatttataagcat

SEQ ID NO: 681020 - DNA, 16 bp, Homo sapiens
taaatatttatgtaga

SEQ ID NO: 681021 - DNA, 12 bp, Homo sapiens
taaatcagaaag

SEQ ID NO: 681022 - DNA, 14 bp, Homo sapiens
taaatcagaaagta

SEQ ID NO: 681023 - DNA, 19 bp, Homo sapiens
taaatcagaaagtaacaat

SEQ ID NO: 681024 - DNA, 23 bp, Homo sapiens
taaatcagctgcaatccatttat

SEQ ID NO: 681025 - DNA, 18 bp, Homo sapiens
taaatcctgccatttaaa

SEQ ID NO: 681026 - DNA, 17 bp, Homo sapiens
taaatgaaacttaagaa

SEQ ID NO: 681027 - DNA, 22 bp, Homo sapiens
taaatgaaacttaagaattgaa

SEQ ID NO: 681028 - DNA, 14 bp, Homo sapiens
taaatgaaagaaaa

SEQ ID NO: 681029 - DNA, 15 bp, Homo sapiens
taaatgcaataattt

SEQ ID NO: 681030 - DNA, 20 bp, Homo sapiens
taaatgcatatcctgagcca

SEQ ID NO: 681031 - DNA, 15 bp, Homo sapiens
taaatgccctcttct

SEQ ID NO: 681032 - DNA, 19 bp, Homo sapiens
taaatgctgttcttacaca

SEQ ID NO: 681033 - DNA, 23 bp, Homo sapiens
taaatgggtgtatataattttat

SEQ ID NO: 681034 - DNA, 13 bp, Homo sapiens
taaatgtatttta

SEQ ID NO: 681035 - DNA, 13 bp, Homo sapiens
taaattaggcagt

SEQ ID NO: 681036 - DNA, 14 bp, Homo sapiens
taaattatggcatt

SEQ ID NO: 681037 - DNA, 18 bp, Homo sapiens
taaattatggcatttcta

SEQ ID NO: 681038 - DNA, 19 bp, Homo sapiens
taaattatggcatttctat

SEQ ID NO: 681039 - DNA, 16 bp, Homo sapiens
taaattgcatcactgt

SEQ ID NO: 681040 - DNA, 18 bp, Homo sapiens
taaattgcatcactgtat

SEQ ID NO: 681041 - DNA, 15 bp, Homo sapiens
taaatttatattcat

SEQ ID NO: 681042 - DNA, 19 bp, Homo sapiens
taaattttatatcatttta

SEQ ID NO: 681043 - DNA, 13 bp, Homo sapiens
taaatttttaaga

SEQ ID NO: 681044 - DNA, 19 bp, Homo sapiens
taaatttttaggcaaagat

SEQ ID NO: 681045 - DNA, 20 bp, Homo sapiens
taaatttttaggcaaagata

SEQ ID NO: 681046 - DNA, 11 bp, Homo sapiens
taacaagtgtt

SEQ ID NO: 681047 - DNA, 12 bp, Homo sapiens
taacacattttt

SEQ ID NO: 681048 - DNA, 18 bp, Homo sapiens
taacagataagcaagaga

SEQ ID NO: 681049 - DNA, 15 bp, Homo sapiens
taacattaaatcaca

SEQ ID NO: 681050 - DNA, 22 bp, Homo sapiens
taacattgtgactttgctttga

SEQ ID NO: 681051 - DNA, 18 bp, Homo sapiens
taaccaagtgtgctcttt

SEQ ID NO: 681052 - DNA, 15 bp, Homo sapiens
taaccactaacattg

SEQ ID NO: 681053 - DNA, 23 bp, Homo sapiens
taaccaggggtcctaaccactaa

SEQ ID NO: 681054 - DNA, 21 bp, Homo sapiens
taaccagtacttctaagagca

SEQ ID NO: 681055 - DNA, 18 bp, Homo sapiens
taaccatttatataaaac

SEQ ID NO: 681056 - DNA, 18 bp, Homo sapiens
taacccacctctcctgcc

SEQ ID NO: 681057 - DNA, 21 bp, Homo sapiens
taacccacctctcctgccctg

SEQ ID NO: 681058 - DNA, 19 bp, Homo sapiens
taacccaggcctgtctgac

SEQ ID NO: 681059 - DNA, 16 bp, Homo sapiens
taacccataattgaag

SEQ ID NO: 681060 - DNA, 17 bp, Homo sapiens
taaccttaaaattgata

SEQ ID NO: 681061 - DNA, 19 bp, Homo sapiens
taaccttaaccttaaaatt

SEQ ID NO: 681062 - DNA, 20 bp, Homo sapiens
taaccttaaccttaaaattg

SEQ ID NO: 681063 - DNA, 24 bp, Homo sapiens
taacgtgttccagtgtctgtctga

SEQ ID NO: 681064 - DNA, 12 bp, Homo sapiens
taactaaaataa

SEQ ID NO: 681065 - DNA, 22 bp, Homo sapiens
taactaattggaaggagagggg

SEQ ID NO: 681066 - DNA, 15 bp, Homo sapiens
taactcaaatacaca

SEQ ID NO: 681067 - DNA, 14 bp, Homo sapiens
taactcagaattat

SEQ ID NO: 681068 - DNA, 19 bp, Homo sapiens
taactcctgtcccttttcc

SEQ ID NO: 681069 - DNA, 11 bp, Homo sapiens
taactctggga

SEQ ID NO: 681070 - DNA, 20 bp, Homo sapiens
taactgtagctcaagtttaa

SEQ ID NO: 681071 - DNA, 21 bp, Homo sapiens
taactgtaggtatgatctctt

SEQ ID NO: 681072 - DNA, 11 bp, Homo sapiens
taacttagaaa

SEQ ID NO: 681073 - DNA, 16 bp, Homo sapiens
taacttatttagagat

SEQ ID NO: 681074 - DNA, 14 bp, Homo sapiens
taacttcctgtact

SEQ ID NO: 681075 - DNA, 23 bp, Homo sapiens
taacttttttgtggcaattagtg

SEQ ID NO: 681076 - DNA, 22 bp, Homo sapiens
taacttttttttctctcttttg

SEQ ID NO: 681077 - DNA, 12 bp, Homo sapiens
taagaaaggaag

SEQ ID NO: 681078 - DNA, 22 bp, Homo sapiens
taagaaagtaatttaatttgta

SEQ ID NO: 681079 - DNA, 15 bp, Homo sapiens
taagaagacatgaac

SEQ ID NO: 681080 - DNA, 12 bp, Homo sapiens
taagaagacatt

SEQ ID NO: 681081 - DNA, 14 bp, Homo sapiens
taagaagacatttt

SEQ ID NO: 681082 - DNA, 17 bp, Homo sapiens
taagaagttgtttgagg

SEQ ID NO: 681083 - DNA, 15 bp, Homo sapiens
taataaactgcaagt

SEQ ID NO: 681084 - DNA, 14 bp, Homo sapiens
taataaataaatgt

SEQ ID NO: 681085 - DNA, 15 bp, Homo sapiens
taataaatataattt

SEQ ID NO: 681086 - DNA, 23 bp, Homo sapiens
taataaatataatttataagcat

SEQ ID NO: 681087 - DNA, 14 bp, Homo sapiens
taataaatatatac

SEQ ID NO: 681088 - DNA, 16 bp, Homo sapiens
taataaatatttatgt

SEQ ID NO: 681089 - DNA, 18 bp, Homo sapiens
taataagctaaagaggct

SEQ ID NO: 681090 - DNA, 16 bp, Homo sapiens
taataataaagaatag

SEQ ID NO: 681091 - DNA, 10 bp, Homo sapiens
taataatatt

SEQ ID NO: 681092 - DNA, 22 bp, Homo sapiens
taatacaaggtataataaaatt

SEQ ID NO: 681093 - DNA, 14 bp, Homo sapiens
taatactttctatg

SEQ ID NO: 681094 - DNA, 15 bp, Homo sapiens
taataggagtatttt

SEQ ID NO: 681095 - DNA, 17 bp, Homo sapiens
taatagtttgtctattt

SEQ ID NO: 681096 - DNA, 18 bp, Homo sapiens
taatagtttgtctatttt

SEQ ID NO: 681097 - DNA, 15 bp, Homo sapiens
taatatcaaaagaaa

SEQ ID NO: 681098 - DNA, 16 bp, Homo sapiens
taatatggtgtatttt

SEQ ID NO: 681099 - DNA, 23 bp, Homo sapiens
taatattaatattcccattttat

SEQ ID NO: 681100 - DNA, 21 bp, Homo sapiens
taatattcagggtaaatagga

SEQ ID NO: 681101 - DNA, 22 bp, Homo sapiens
taatattcttttgtttccatgg

SEQ ID NO: 681102 - DNA, 13 bp, Homo sapiens
taatatttatgtt

SEQ ID NO: 681103 - DNA, 19 bp, Homo sapiens
taatatttttgtatttctc

SEQ ID NO: 681104 - DNA, 19 bp, Homo sapiens
taatccagttataagaaga

SEQ ID NO: 681105 - DNA, 23 bp, Homo sapiens
taatcccagcactttgggaggcc

SEQ ID NO: 681106 - DNA, 19 bp, Homo sapiens
taatcccctaaaataacag

SEQ ID NO: 681107 - DNA, 15 bp, Homo sapiens
taatccttttcctta

SEQ ID NO: 681108 - DNA, 17 bp, Homo sapiens
taatccttttccttatt

SEQ ID NO: 681109 - DNA, 19 bp, Homo sapiens
taatctaaaagctctgttc

SEQ ID NO: 681110 - DNA, 14 bp, Homo sapiens
taatcttcaggtga

SEQ ID NO: 681111 - DNA, 14 bp, Homo sapiens
taatctttatactg

SEQ ID NO: 681112 - DNA, 22 bp, Homo sapiens
taatctttatactgggtttcaa

SEQ ID NO: 681113 - DNA, 13 bp, Homo sapiens
taatgataaaata

SEQ ID NO: 681114 - DNA, 15 bp, Homo sapiens
taatgataaaataaa

SEQ ID NO: 681115 - DNA, 20 bp, Homo sapiens
taatgcattttgcactagaa

SEQ ID NO: 681116 - DNA, 16 bp, Homo sapiens
taatgctgtttctaag

SEQ ID NO: 681117 - DNA, 14 bp, Homo sapiens
taatgcttcagata

SEQ ID NO: 681118 - DNA, 19 bp, Homo sapiens
taatgcttgtttatgatat

SEQ ID NO: 681119 - DNA, 21 bp, Homo sapiens
taatggatcatagaattgcag

SEQ ID NO: 681120 - DNA, 14 bp, Homo sapiens
taatggcatttctc

SEQ ID NO: 681121 - DNA, 19 bp, Homo sapiens
taatgtatcaaatacattt

SEQ ID NO: 681122 - DNA, 15 bp, Homo sapiens
taatgtgtggattgc

SEQ ID NO: 681123 - DNA, 15 bp, Homo sapiens
taatgtttatgagcc

SEQ ID NO: 681124 - DNA, 15 bp, Homo sapiens
taatgtttttaaaaa

SEQ ID NO: 681125 - DNA, 20 bp, Homo sapiens
taattacctggtgagtaact

SEQ ID NO: 681126 - DNA, 17 bp, Homo sapiens
taattcaaggagaatat

SEQ ID NO: 681127 - DNA, 15 bp, Homo sapiens
taattcagctttgtc

SEQ ID NO: 681128 - DNA, 15 bp, Homo sapiens
taattcctcttttta

SEQ ID NO: 681129 - DNA, 15 bp, Homo sapiens
taattctatgcctgt

SEQ ID NO: 681130 - DNA, 15 bp, Homo sapiens
taattcttctgtcct

SEQ ID NO: 681131 - DNA, 14 bp, Homo sapiens
taattgactgaaat

SEQ ID NO: 681132 - DNA, 15 bp, Homo sapiens
taattgcacttttta

SEQ ID NO: 681133 - DNA, 22 bp, Homo sapiens
taattgcactttttaagtttga

SEQ ID NO: 681134 - DNA, 22 bp, Homo sapiens
taattgctgtgtgtcccaggca

SEQ ID NO: 681135 - DNA, 20 bp, Homo sapiens
taatttaatttgtaaaactt

SEQ ID NO: 681136 - DNA, 15 bp, Homo sapiens
taatttagaaactga

SEQ ID NO: 681137 - DNA, 14 bp, Homo sapiens
taatttataagcat

SEQ ID NO: 681138 - DNA, 15 bp, Homo sapiens
taatttataagcatt

SEQ ID NO: 681139 - DNA, 20 bp, Homo sapiens
taatttataagcattgccat

SEQ ID NO: 681140 - DNA, 20 bp, Homo sapiens
taatttatttaatatttaat

SEQ ID NO: 681141 - DNA, 22 bp, Homo sapiens
taatttatttcaataaatcttt

SEQ ID NO: 681142 - DNA, 16 bp, Homo sapiens
taatttcaaaatacat

SEQ ID NO: 681143 - DNA, 14 bp, Homo sapiens
taatttcatttaaa

SEQ ID NO: 681144 - DNA, 19 bp, Homo sapiens
taatttgtaaaacttctgc

SEQ ID NO: 681145 - DNA, 23 bp, Homo sapiens
taatttgtaaaacttctgctcgt

SEQ ID NO: 681146 - DNA, 17 bp, Homo sapiens
taattttaatattcttt

SEQ ID NO: 681147 - DNA, 16 bp, Homo sapiens
taattttaatgctgtt

SEQ ID NO: 681148 - DNA, 15 bp, Homo sapiens
taattttacacatta

SEQ ID NO: 681149 - DNA, 19 bp, Homo sapiens
taattttgtgtaagaaata

SEQ ID NO: 681150 - DNA, 20 bp, Homo sapiens
taattttgtgtaagaaatac

SEQ ID NO: 681151 - DNA, 15 bp, Homo sapiens
tacaaacagtatttc

SEQ ID NO: 681152 - DNA, 15 bp, Homo sapiens
tacaacggaggcctg

SEQ ID NO: 681153 - DNA, 18 bp, Homo sapiens
tacaactgtatttattaa

SEQ ID NO: 681154 - DNA, 20 bp, Homo sapiens
tacaagatattattaatttt

SEQ ID NO: 681155 - DNA, 15 bp, Homo sapiens
tacaagattgaaaat

SEQ ID NO: 681156 - DNA, 19 bp, Homo sapiens
tacaaggtataataaaatt

SEQ ID NO: 681157 - DNA, 22 bp, Homo sapiens
tacaaggtggggattgcccctg

SEQ ID NO: 681158 - DNA, 12 bp, Homo sapiens
tacaagtaatgt

SEQ ID NO: 681159 - DNA, 12 bp, Homo sapiens
tacaagtaattt

SEQ ID NO: 681160 - DNA, 18 bp, Homo sapiens
tacaagtcagctccagct

SEQ ID NO: 681161 - DNA, 22 bp, Homo sapiens
tacaataagcgttaagggcaga

SEQ ID NO: 681162 - DNA, 19 bp, Homo sapiens
tacaatattgattgggaaa

SEQ ID NO: 681163 - DNA, 23 bp, Homo sapiens
tacaatattgattgggaaaacat

SEQ ID NO: 681164 - DNA, 16 bp, Homo sapiens
tacaatggaataaatt

SEQ ID NO: 681165 - DNA, 23 bp, Homo sapiens
tacaatgtgaataatggcactga

SEQ ID NO: 681166 - DNA, 13 bp, Homo sapiens
tacaattttaaga

SEQ ID NO: 681167 - DNA, 14 bp, Homo sapiens
tacacaatacagta

SEQ ID NO: 681168 - DNA, 15 bp, Homo sapiens
tacacaatacagtat

SEQ ID NO: 681169 - DNA, 17 bp, Homo sapiens
tacacaatacagtatta

SEQ ID NO: 681170 - DNA, 17 bp, Homo sapiens
tagaaaaataaaatgtt

SEQ ID NO: 681171 - DNA, 24 bp, Homo sapiens
tagaaaatgtgtcctatctatctt

SEQ ID NO: 681172 - DNA, 13 bp, Homo sapiens
tagaaaatttgct

SEQ ID NO: 681173 - DNA, 15 bp, Homo sapiens
tagaaacttaaacac

SEQ ID NO: 681174 - DNA, 14 bp, Homo sapiens
tagaaatgcatatt

SEQ ID NO: 681175 - DNA, 23 bp, Homo sapiens
tagaaattagaaaaaaattacta

SEQ ID NO: 681176 - DNA, 19 bp, Homo sapiens
tagaagaaccaaatacctc

SEQ ID NO: 681177 - DNA, 17 bp, Homo sapiens
tagaagattagaaacta

SEQ ID NO: 681178 - DNA, 13 bp, Homo sapiens
tagaataattctt

SEQ ID NO: 681179 - DNA, 12 bp, Homo sapiens
tagaatgttgaa

SEQ ID NO: 681180 - DNA, 17 bp, Homo sapiens
tagacagttagagactc

SEQ ID NO: 681181 - DNA, 11 bp, Homo sapiens
tagacatgaaa

SEQ ID NO: 681182 - DNA, 12 bp, Homo sapiens
tagacatgaaag

SEQ ID NO: 681183 - DNA, 14 bp, Homo sapiens
tagactatttcttt

SEQ ID NO: 681184 - DNA, 15 bp, Homo sapiens
tagagatttgtctaa

SEQ ID NO: 681185 - DNA, 16 bp, Homo sapiens
tagagatttgtctaat

SEQ ID NO: 681186 - DNA, 20 bp, Homo sapiens
tagagatttgtctaattgca

SEQ ID NO: 681187 - DNA, 17 bp, Homo sapiens
tagagccctctcctccc

SEQ ID NO: 681188 - DNA, 19 bp, Homo sapiens
tagagcttggacagtctga

SEQ ID NO: 681189 - DNA, 21 bp, Homo sapiens
tagagggacggccaagaatgt

SEQ ID NO: 681190 - DNA, 20 bp, Homo sapiens
tagatatttttcataaacaa

SEQ ID NO: 681191 - DNA, 20 bp, Homo sapiens
tagcaagcaactaattttct

SEQ ID NO: 681192 - DNA, 16 bp, Homo sapiens
tagcaagcttttgctc

SEQ ID NO: 681193 - DNA, 15 bp, Homo sapiens
tagcaatctgcctgt

SEQ ID NO: 681194 - DNA, 23 bp, Homo sapiens
tagcaatctgcctgtatctctca

SEQ ID NO: 681195 - DNA, 21 bp, Homo sapiens
tagcagatggtttccacattt

SEQ ID NO: 681196 - DNA, 23 bp, Homo sapiens
tagcagattgtttcctcttccaa

SEQ ID NO: 681197 - DNA, 16 bp, Homo sapiens
tagcagccagttcaaa

SEQ ID NO: 681198 - DNA, 18 bp, Homo sapiens
tagcagccagttcaaaaa

SEQ ID NO: 681199 - DNA, 15 bp, Homo sapiens
tagcagcccaccctg

SEQ ID NO: 681200 - DNA, 21 bp, Homo sapiens
tagcagcccaccctgctgctg

SEQ ID NO: 681201 - DNA, 17 bp, Homo sapiens
tagcatggggattgcag

SEQ ID NO: 681202 - DNA, 20 bp, Homo sapiens
tagcatggggattgcagagt

SEQ ID NO: 681203 - DNA, 22 bp, Homo sapiens
tagcatggggattgcagagtga

SEQ ID NO: 681204 - DNA, 17 bp, Homo sapiens
tagcattgataatcttc

SEQ ID NO: 681205 - DNA, 19 bp, Homo sapiens
tagcgatctctcctggcct

SEQ ID NO: 681206 - DNA, 20 bp, Homo sapiens
tagcgatctctcctggccta

SEQ ID NO: 681207 - DNA, 20 bp, Homo sapiens
tagcgtcaagacatttgctg

SEQ ID NO: 681208 - DNA, 21 bp, Homo sapiens
tcaacaggtcacttgatcatg

SEQ ID NO: 681209 - DNA, 20 bp, Homo sapiens
tcaacatgctccaaatataa

SEQ ID NO: 681210 - DNA, 20 bp, Homo sapiens
tcaactcccaacttcttcct

SEQ ID NO: 681211 - DNA, 18 bp, Homo sapiens
tcaacttatttcataatt

SEQ ID NO: 681212 - DNA, 14 bp, Homo sapiens
tcaactttgtaaaa

SEQ ID NO: 681213 - DNA, 19 bp, Homo sapiens
tcaagaaaatctttgttga

SEQ ID NO: 681214 - DNA, 14 bp, Homo sapiens
tcaagaatgaaaaa

SEQ ID NO: 681215 - DNA, 11 bp, Homo sapiens
tcaagacattt

SEQ ID NO: 681216 - DNA, 22 bp, Homo sapiens
tcaagagctagaaaaataaaat

SEQ ID NO: 681217 - DNA, 19 bp, Homo sapiens
tcaagaggtgggagggccc

SEQ ID NO: 681218 - DNA, 13 bp, Homo sapiens
tcaagattttgaa

SEQ ID NO: 681219 - DNA, 18 bp, Homo sapiens
tcaagatttttttcctga

SEQ ID NO: 681220 - DNA, 16 bp, Homo sapiens
tcaagctagtgtttct

SEQ ID NO: 681221 - DNA, 21 bp, Homo sapiens
tcaagctgttatttcttccct

SEQ ID NO: 681222 - DNA, 23 bp, Homo sapiens
tcaagctgttatttcttccctgc

SEQ ID NO: 681223 - DNA, 22 bp, Homo sapiens
tcaagctttcccgcccagcctc

SEQ ID NO: 681224 - DNA, 13 bp, Homo sapiens
tcaaggagaggca

SEQ ID NO: 681225 - DNA, 19 bp, Homo sapiens
tcaaggagaggcaaagaaa

SEQ ID NO: 681226 - DNA, 11 bp, Homo sapiens
tcaaggctcag

SEQ ID NO: 681227 - DNA, 19 bp, Homo sapiens
tcaagggaatgtaactgct

SEQ ID NO: 681228 - DNA, 21 bp, Homo sapiens
tcaagggaatgtaactgctga

SEQ ID NO: 681229 - DNA, 16 bp, Homo sapiens
tcaagtaagaagacat

SEQ ID NO: 681230 - DNA, 16 bp, Homo sapiens
tcaagttgtaaataat

SEQ ID NO: 681231 - DNA, 17 bp, Homo sapiens
tcaagtttaaaagccat

SEQ ID NO: 681232 - DNA, 12 bp, Homo sapiens
tcaagtttacac

SEQ ID NO: 681233 - DNA, 20 bp, Homo sapiens
tcaatatcagctttgataat

SEQ ID NO: 681234 - DNA, 14 bp, Homo sapiens
tcaatatgaatcta

SEQ ID NO: 681235 - DNA, 15 bp, Homo sapiens
tcaatgtattgagaa

SEQ ID NO: 681236 - DNA, 19 bp, Homo sapiens
tcaatttttgtctcagaag

SEQ ID NO: 681237 - DNA, 12 bp, Homo sapiens
tcaatttttgtt

SEQ ID NO: 681238 - DNA, 21 bp, Homo sapiens
tcaatttttgtttttgagtac

SEQ ID NO: 681239 - DNA, 19 bp, Homo sapiens
tcacaaatgtcattgtcta

SEQ ID NO: 681240 - DNA, 21 bp, Homo sapiens
tcacaaatgtcattgtctact

SEQ ID NO: 681241 - DNA, 19 bp, Homo sapiens
tcacaacccttctctgttg

SEQ ID NO: 681242 - DNA, 15 bp, Homo sapiens
tcacacaatatagtt

SEQ ID NO: 681243 - DNA, 13 bp, Homo sapiens
tcacagtaaccca

SEQ ID NO: 681244 - DNA, 18 bp, Homo sapiens
tcacagtacagcatgtgc

SEQ ID NO: 681245 - DNA, 15 bp, Homo sapiens
tcacatgtttaactt

SEQ ID NO: 681246 - DNA, 14 bp, Homo sapiens
tcaccaagcagtgg

SEQ ID NO: 681247 - DNA, 20 bp, Homo sapiens
tcacccatgcaagcagagga

SEQ ID NO: 681248 - DNA, 15 bp, Homo sapiens
tcacccctgtttctg

SEQ ID NO: 681249 - DNA, 15 bp, Homo sapiens
tcaccgaagccactt

SEQ ID NO: 681250 - DNA, 15 bp, Homo sapiens
tcaccggtcagtgcc

SEQ ID NO: 681251 - DNA, 17 bp, Homo sapiens
tcaccggtcagtgcctt

SEQ ID NO: 681252 - DNA, 21 bp, Homo sapiens
tcacctccggtcgtgtctctg

SEQ ID NO: 681253 - DNA, 23 bp, Homo sapiens
tcacctccggtcgtgtctctggt

SEQ ID NO: 681254 - DNA, 15 bp, Homo sapiens
tcacctctgtgaccc

SEQ ID NO: 681255 - DNA, 18 bp, Homo sapiens
tcactaaagcatgaaatg

SEQ ID NO: 681256 - DNA, 21 bp, Homo sapiens
tcactaaagcatgaaatgtga

SEQ ID NO: 681257 - DNA, 23 bp, Homo sapiens
tcactaaagcatgaaatgtgaat

SEQ ID NO: 681258 - DNA, 18 bp, Homo sapiens
tcactctttagatattta

SEQ ID NO: 681259 - DNA, 21 bp, Homo sapiens
tcactctttagatatttacat

SEQ ID NO: 681260 - DNA, 13 bp, Homo sapiens
tcactcttttgat

SEQ ID NO: 681261 - DNA, 18 bp, Homo sapiens
tcactgcaattttgtgta

SEQ ID NO: 681262 - DNA, 18 bp, Homo sapiens
tccacaaggaataaatga

SEQ ID NO: 681263 - DNA, 16 bp, Homo sapiens
tccacacccgtgagaa

SEQ ID NO: 681264 - DNA, 15 bp, Homo sapiens
tccacagaggacaca

SEQ ID NO: 681265 - DNA, 17 bp, Homo sapiens
tccacatgctgcctggc

SEQ ID NO: 681266 - DNA, 19 bp, Homo sapiens
tccacatgctgcctggcac

SEQ ID NO: 681267 - DNA, 20 bp, Homo sapiens
tccacccagcaggcagagtg

SEQ ID NO: 681268 - DNA, 21 bp, Homo sapiens
tccacccagcaggcagagtgg

SEQ ID NO: 681269 - DNA, 19 bp, Homo sapiens
tccaccccccactcagtgc

SEQ ID NO: 681270 - DNA, 12 bp, Homo sapiens
tccacctgtggg

SEQ ID NO: 681271 - DNA, 14 bp, Homo sapiens
tccactcccaggat

SEQ ID NO: 681272 - DNA, 20 bp, Homo sapiens
tccactgcaaataaagcctt

SEQ ID NO: 681273 - DNA, 21 bp, Homo sapiens
tccactgcaaataaagccttt

SEQ ID NO: 681274 - DNA, 12 bp, Homo sapiens
tccactgcctgg

SEQ ID NO: 681275 - DNA, 23 bp, Homo sapiens
tccacttcatttttaagaaagga

SEQ ID NO: 681276 - DNA, 23 bp, Homo sapiens
tccagaaaactgtgatttcagga

SEQ ID NO: 681277 - DNA, 19 bp, Homo sapiens
tccagacctggctccactc

SEQ ID NO: 681278 - DNA, 21 bp, Homo sapiens
tccagacctggctccactctt

SEQ ID NO: 681279 - DNA, 22 bp, Homo sapiens
tccagagttctgtgacacatgc

SEQ ID NO: 681280 - DNA, 21 bp, Homo sapiens
tccagcaattctcctgcctca

SEQ ID NO: 681281 - DNA, 15 bp, Homo sapiens
tccagcaccttgtgc

SEQ ID NO: 681282 - DNA, 21 bp, Homo sapiens
tccagcatttagctggccaca

SEQ ID NO: 681283 - DNA, 21 bp, Homo sapiens
tccagccttctctcaaggaga

SEQ ID NO: 681284 - DNA, 16 bp, Homo sapiens
tccagctcagccctgg

SEQ ID NO: 681285 - DNA, 22 bp, Homo sapiens
tccagctccccagcccacctgc

SEQ ID NO: 681286 - DNA, 23 bp, Homo sapiens
tccagcttctcatgttaaatatt

SEQ ID NO: 681287 - DNA, 16 bp, Homo sapiens
tccagctttctgccat

SEQ ID NO: 681288 - DNA, 15 bp, Homo sapiens
tccaggagagcctgg

SEQ ID NO: 681289 - DNA, 16 bp, Homo sapiens
tccaggagagcctggg

SEQ ID NO: 681290 - DNA, 14 bp, Homo sapiens
tccaggcctgcagc

SEQ ID NO: 681291 - DNA, 17 bp, Homo sapiens
tccaggcctgcctccca

SEQ ID NO: 681292 - DNA, 19 bp, Homo sapiens
tccaggctatgtataaaat

SEQ ID NO: 681293 - DNA, 20 bp, Homo sapiens
tccaggctatgtataaaata

SEQ ID NO: 681294 - DNA, 17 bp, Homo sapiens
tccaggcttggatgtaa

SEQ ID NO: 681295 - DNA, 20 bp, Homo sapiens
tccaggctttcccacttccc

SEQ ID NO: 681296 - DNA, 20 bp, Homo sapiens
tccaggctttgtacagagtg

SEQ ID NO: 681297 - DNA, 13 bp, Homo sapiens
tccagggtctgag

SEQ ID NO: 681298 - DNA, 15 bp, Homo sapiens
tccaggtgcagaggt

SEQ ID NO: 681299 - DNA, 16 bp, Homo sapiens
tccagtgtctgtctga

SEQ ID NO: 681300 - DNA, 18 bp, Homo sapiens
tccagttaattacatcct

SEQ ID NO: 681301 - DNA, 23 bp, Homo sapiens
tccataaacagactgttaattat

SEQ ID NO: 681302 - DNA, 22 bp, Homo sapiens
tccataccttttctcttttctt

SEQ ID NO: 681303 - DNA, 21 bp, Homo sapiens
tccataggtttctctccctcc

SEQ ID NO: 681304 - DNA, 18 bp, Homo sapiens
tccatatttgatttctaa

SEQ ID NO: 681305 - DNA, 19 bp, Homo sapiens
tccatatttgatttctaat

SEQ ID NO: 681306 - DNA, 14 bp, Homo sapiens
tccatccatctctc

SEQ ID NO: 681307 - DNA, 12 bp, Homo sapiens
tccatcctggtc

SEQ ID NO: 681308 - DNA, 16 bp, Homo sapiens
tccatctctcatcctc

SEQ ID NO: 681309 - DNA, 18 bp, Homo sapiens
tccatctctcatcctcca

SEQ ID NO: 681310 - DNA, 12 bp, Homo sapiens
tccatctctctc

SEQ ID NO: 681311 - DNA, 16 bp, Homo sapiens
tccatctctctcttgc

SEQ ID NO: 681312 - DNA, 14 bp, Homo sapiens
tccatctgacaaaa

SEQ ID NO: 681313 - DNA, 16 bp, Homo sapiens
tccatgatttagcaag

SEQ ID NO: 681314 - DNA, 13 bp, Homo sapiens
tccatgtgccttt
